United States Patent 11,492,591 (UNIVERSAL DONOR STEM CELLS AND RELATED METHODS) - sequence listing, part 13

SEQ ID NO: 401504 - DNA, 20 bp, Artificial
  CRISPR gRNA sequence
tgactagtttttagagagac

SEQ ID NO: 401505 - DNA, 20 bp, Artificial
  CRISPR gRNA sequence
actagtttttagagagacac

SEQ ID NO: 401506 - DNA, 20 bp, Artificial
  CRISPR gRNA sequence
gtttttagagagacacacaa

SEQ ID NO: 401507 - DNA, 20 bp, Artificial
  CRISPR gRNA sequence
ttagagagacacacaaaata

SEQ ID NO: 401508 - DNA, 20 bp, Artificial
  CRISPR gRNA sequence
tagagagacacacaaaataa

SEQ ID NO: 401509 - DNA, 20 bp, Artificial
  CRISPR gRNA sequence
agagagacacacaaaataaa

SEQ ID NO: 401510 - DNA, 20 bp, Artificial
  CRISPR gRNA sequence
gagagacacacaaaataaaa

SEQ ID NO: 401511 - DNA, 20 bp, Artificial
  CRISPR gRNA sequence
ttctttcaccacctaaaaga

SEQ ID NO: 401512 - DNA, 20 bp, Artificial
  CRISPR gRNA sequence
tctttcaccacctaaaagat

SEQ ID NO: 401513 - DNA, 20 bp, Artificial
  CRISPR gRNA sequence
ctttcaccacctaaaagatt

SEQ ID NO: 401514 - DNA, 20 bp, Artificial
  CRISPR gRNA sequence
tttcaccacctaaaagatta

SEQ ID NO: 401515 - DNA, 20 bp, Artificial
  CRISPR gRNA sequence
tcaccacctaaaagattaca

SEQ ID NO: 401516 - DNA, 20 bp, Artificial
  CRISPR gRNA sequence
caccacctaaaagattacac

SEQ ID NO: 401517 - DNA, 20 bp, Artificial
  CRISPR gRNA sequence
accacctaaaagattacact

SEQ ID NO: 401518 - DNA, 20 bp, Artificial
  CRISPR gRNA sequence
aaagattacactagctgcag

SEQ ID NO: 401519 - DNA, 20 bp, Artificial
  CRISPR gRNA sequence
cactagctgcagtcttttag

SEQ ID NO: 401520 - DNA, 20 bp, Artificial
  CRISPR gRNA sequence
gctgcagtcttttaggagag

SEQ ID NO: 401521 - DNA, 20 bp, Artificial
  CRISPR gRNA sequence
cagtcttttaggagagtaag

SEQ ID NO: 401522 - DNA, 20 bp, Artificial
  CRISPR gRNA sequence
ttaggagagtaagagtttgc

SEQ ID NO: 401523 - DNA, 20 bp, Artificial
  CRISPR gRNA sequence
taggagagtaagagtttgca

SEQ ID NO: 401524 - DNA, 20 bp, Artificial
  CRISPR gRNA sequence
aggagagtaagagtttgcag

SEQ ID NO: 401525 - DNA, 20 bp, Artificial
  CRISPR gRNA sequence
ggagagtaagagtttgcagg

SEQ ID NO: 401526 - DNA, 20 bp, Artificial
  CRISPR gRNA sequence
gcaggcaaggtaagcaaata

SEQ ID NO: 401527 - DNA, 20 bp, Artificial
  CRISPR gRNA sequence
caggcaaggtaagcaaatag

SEQ ID NO: 401528 - DNA, 20 bp, Artificial
  CRISPR gRNA sequence
tagattggaacctttacaca

SEQ ID NO: 401529 - DNA, 20 bp, Artificial
  CRISPR gRNA sequence
gaacctttacacactgctag

SEQ ID NO: 401530 - DNA, 20 bp, Artificial
  CRISPR gRNA sequence
tacacactgctagcaggagg

SEQ ID NO: 401531 - DNA, 20 bp, Artificial
  CRISPR gRNA sequence
acacactgctagcaggagga

SEQ ID NO: 401532 - DNA, 20 bp, Artificial
  CRISPR gRNA sequence
cacactgctagcaggaggat

SEQ ID NO: 401533 - DNA, 20 bp, Artificial
  CRISPR gRNA sequence
ctagcaggaggattaattgg

SEQ ID NO: 401534 - DNA, 20 bp, Artificial
  CRISPR gRNA sequence
gcaggaggattaattggtat

SEQ ID NO: 401535 - DNA, 20 bp, Artificial
  CRISPR gRNA sequence
attggtatctctattatttt

SEQ ID NO: 401536 - DNA, 20 bp, Artificial
  CRISPR gRNA sequence
gtatctctattattttagtc

SEQ ID NO: 401537 - DNA, 20 bp, Artificial
  CRISPR gRNA sequence
tattattttagtcaggcttc

SEQ ID NO: 401538 - DNA, 20 bp, Artificial
  CRISPR gRNA sequence
ttattttagtcaggcttctc

SEQ ID NO: 401539 - DNA, 20 bp, Artificial
  CRISPR gRNA sequence
ttttagtcaggcttctccag

SEQ ID NO: 401540 - DNA, 20 bp, Artificial
  CRISPR gRNA sequence
tagtcaggcttctccagaga

SEQ ID NO: 401541 - DNA, 20 bp, Artificial
  CRISPR gRNA sequence
agtcaggcttctccagagaa

SEQ ID NO: 401542 - DNA, 20 bp, Artificial
  CRISPR gRNA sequence
gtcaggcttctccagagaaa

SEQ ID NO: 401543 - DNA, 20 bp, Artificial
  CRISPR gRNA sequence
ctccagagaaagagaaccaa

SEQ ID NO: 401544 - DNA, 20 bp, Artificial
  CRISPR gRNA sequence
tccagagaaagagaaccaat

SEQ ID NO: 401545 - DNA, 20 bp, Artificial
  CRISPR gRNA sequence
cagagaaagagaaccaatgt

SEQ ID NO: 401546 - DNA, 20 bp, Artificial
  CRISPR gRNA sequence
attataagaaattggctcac

SEQ ID NO: 401547 - DNA, 20 bp, Artificial
  CRISPR gRNA sequence
ttataagaaattggctcaca

SEQ ID NO: 401548 - DNA, 20 bp, Artificial
  CRISPR gRNA sequence
taagaaattggctcacatga

SEQ ID NO: 401549 - DNA, 20 bp, Artificial
  CRISPR gRNA sequence
gctcacatgatgtattagtc

SEQ ID NO: 401550 - DNA, 20 bp, Artificial
  CRISPR gRNA sequence
acatgatgtattagtctatt

SEQ ID NO: 401551 - DNA, 20 bp, Artificial
  CRISPR gRNA sequence
gtctattctcacactgctgt

SEQ ID NO: 401552 - DNA, 20 bp, Artificial
  CRISPR gRNA sequence
ttctcacactgctgtgaaga

SEQ ID NO: 401553 - DNA, 20 bp, Artificial
  CRISPR gRNA sequence
tcacactgctgtgaagaaat

SEQ ID NO: 401554 - DNA, 20 bp, Artificial
  CRISPR gRNA sequence
acactgctgtgaagaaatac

SEQ ID NO: 401555 - DNA, 20 bp, Artificial
  CRISPR gRNA sequence
ctgtgaagaaatacttaaga

SEQ ID NO: 401556 - DNA, 20 bp, Artificial
  CRISPR gRNA sequence
tgaagaaatacttaagactg

SEQ ID NO: 401557 - DNA, 20 bp, Artificial
  CRISPR gRNA sequence
aagactgggtaatttataag

SEQ ID NO: 401558 - DNA, 20 bp, Artificial
  CRISPR gRNA sequence
agactgggtaatttataagg

SEQ ID NO: 401559 - DNA, 20 bp, Artificial
  CRISPR gRNA sequence
ggtaatttataagggaaaga

SEQ ID NO: 401560 - DNA, 20 bp, Artificial
  CRISPR gRNA sequence
ataagggaaagaggtttaat

SEQ ID NO: 401561 - DNA, 20 bp, Artificial
  CRISPR gRNA sequence
taagggaaagaggtttaatt

SEQ ID NO: 401562 - DNA, 20 bp, Artificial
  CRISPR gRNA sequence
aattgactcacagttcagta

SEQ ID NO: 401563 - DNA, 20 bp, Artificial
  CRISPR gRNA sequence
attgactcacagttcagtat

SEQ ID NO: 401564 - DNA, 20 bp, Artificial
  CRISPR gRNA sequence
actcacagttcagtatggct

SEQ ID NO: 401565 - DNA, 20 bp, Artificial
  CRISPR gRNA sequence
acagttcagtatggctgggg

SEQ ID NO: 401566 - DNA, 20 bp, Artificial
  CRISPR gRNA sequence
agtatggctggggaggcctc

SEQ ID NO: 401567 - DNA, 20 bp, Artificial
  CRISPR gRNA sequence
gggaggcctcaggaaacgta

SEQ ID NO: 401568 - DNA, 20 bp, Artificial
  CRISPR gRNA sequence
aggaaacgtacaatcatggt

SEQ ID NO: 401569 - DNA, 20 bp, Artificial
  CRISPR gRNA sequence
cttcacatggcagcaggaag

SEQ ID NO: 401570 - DNA, 20 bp, Artificial
  CRISPR gRNA sequence
ttcacatggcagcaggaagg

SEQ ID NO: 401571 - DNA, 20 bp, Artificial
  CRISPR gRNA sequence
cacatggcagcaggaaggag

SEQ ID NO: 401572 - DNA, 20 bp, Artificial
  CRISPR gRNA sequence
acatggcagcaggaaggaga

SEQ ID NO: 401573 - DNA, 20 bp, Artificial
  CRISPR gRNA sequence
ataaaaccatcagattttgt

SEQ ID NO: 401574 - DNA, 20 bp, Artificial
  CRISPR gRNA sequence
taaaaccatcagattttgtg

SEQ ID NO: 401575 - DNA, 20 bp, Artificial
  CRISPR gRNA sequence
tgtgagaattcactcactgt

SEQ ID NO: 401576 - DNA, 20 bp, Artificial
  CRISPR gRNA sequence
gtgagaattcactcactgtc

SEQ ID NO: 401577 - DNA, 20 bp, Artificial
  CRISPR gRNA sequence
tgagaattcactcactgtca

SEQ ID NO: 401578 - DNA, 20 bp, Artificial
  CRISPR gRNA sequence
actcactgtcaccagaacag

SEQ ID NO: 401579 - DNA, 20 bp, Artificial
  CRISPR gRNA sequence
actgtcaccagaacagcatg

SEQ ID NO: 401580 - DNA, 20 bp, Artificial
  CRISPR gRNA sequence
tcaccagaacagcatgaagg

SEQ ID NO: 401581 - DNA, 20 bp, Artificial
  CRISPR gRNA sequence
gccccatgattcagctacct

SEQ ID NO: 401582 - DNA, 20 bp, Artificial
  CRISPR gRNA sequence
agctacctcccaccgggtcc

SEQ ID NO: 401583 - DNA, 20 bp, Artificial
  CRISPR gRNA sequence
cctcccaccgggtccttccc

SEQ ID NO: 401584 - DNA, 20 bp, Artificial
  CRISPR gRNA sequence
ccaccgggtccttcccacaa

SEQ ID NO: 401585 - DNA, 20 bp, Artificial
  CRISPR gRNA sequence
cccacaatacatggggatta

SEQ ID NO: 401586 - DNA, 20 bp, Artificial
  CRISPR gRNA sequence
ccacaatacatggggattat

SEQ ID NO: 401587 - DNA, 20 bp, Artificial
  CRISPR gRNA sequence
tgggaactacaagatgagat

SEQ ID NO: 401588 - DNA, 20 bp, Artificial
  CRISPR gRNA sequence
caagatgagatttgggtggg

SEQ ID NO: 401589 - DNA, 20 bp, Artificial
  CRISPR gRNA sequence
gggtggggaaacagccaaat

SEQ ID NO: 401590 - DNA, 20 bp, Artificial
  CRISPR gRNA sequence
ggtggggaaacagccaaatt

SEQ ID NO: 401591 - DNA, 20 bp, Artificial
  CRISPR gRNA sequence
tatcattttgcccctggccc

SEQ ID NO: 401592 - DNA, 20 bp, Artificial
  CRISPR gRNA sequence
tgcccctggcccctctgaaa

SEQ ID NO: 401593 - DNA, 20 bp, Artificial
  CRISPR gRNA sequence
gcccctggcccctctgaaat

SEQ ID NO: 401594 - DNA, 20 bp, Artificial
  CRISPR gRNA sequence
cccctggcccctctgaaatc

SEQ ID NO: 401595 - DNA, 20 bp, Artificial
  CRISPR gRNA sequence
gcccctctgaaatctcatgc

SEQ ID NO: 401596 - DNA, 20 bp, Artificial
  CRISPR gRNA sequence
tgaaatctcatgccctcaca

SEQ ID NO: 401597 - DNA, 20 bp, Artificial
  CRISPR gRNA sequence
aaatctcatgccctcacatt

SEQ ID NO: 401598 - DNA, 20 bp, Artificial
  CRISPR gRNA sequence
atgccctcacatttcaaaat

SEQ ID NO: 401599 - DNA, 20 bp, Artificial
  CRISPR gRNA sequence
acatttcaaaatacaaccat

SEQ ID NO: 401600 - DNA, 20 bp, Artificial
  CRISPR gRNA sequence
caaaatacaaccataccctc

SEQ ID NO: 401601 - DNA, 20 bp, Artificial
  CRISPR gRNA sequence
aaaatacaaccataccctcc

SEQ ID NO: 401602 - DNA, 20 bp, Artificial
  CRISPR gRNA sequence
ccaacagtcccccaaagtct

SEQ ID NO: 401603 - DNA, 20 bp, Artificial
  CRISPR gRNA sequence
aactctttccagcattaact

SEQ ID NO: 401604 - DNA, 20 bp, Artificial
  CRISPR gRNA sequence
actctttccagcattaactg

SEQ ID NO: 401605 - DNA, 20 bp, Artificial
  CRISPR gRNA sequence
tttccagcattaactgaaag

SEQ ID NO: 401606 - DNA, 20 bp, Artificial
  CRISPR gRNA sequence
tccagcattaactgaaagtc

SEQ ID NO: 401607 - DNA, 20 bp, Artificial
  CRISPR gRNA sequence
ccagcattaactgaaagtcc

SEQ ID NO: 401608 - DNA, 20 bp, Artificial
  CRISPR gRNA sequence
cagcattaactgaaagtcca

SEQ ID NO: 401609 - DNA, 20 bp, Artificial
  CRISPR gRNA sequence
actgaaagtccacagcccaa

SEQ ID NO: 401610 - DNA, 20 bp, Artificial
  CRISPR gRNA sequence
aaagtccacagcccaaagtc

SEQ ID NO: 401611 - DNA, 20 bp, Artificial
  CRISPR gRNA sequence
atctgagacaaggcaagtac

SEQ ID NO: 401612 - DNA, 20 bp, Artificial
  CRISPR gRNA sequence
agacaaggcaagtaccttcc

SEQ ID NO: 401613 - DNA, 20 bp, Artificial
  CRISPR gRNA sequence
ccgcctatgagcctgtaaaa

SEQ ID NO: 401614 - DNA, 20 bp, Artificial
  CRISPR gRNA sequence
cgcctatgagcctgtaaaat

SEQ ID NO: 401615 - DNA, 20 bp, Artificial
  CRISPR gRNA sequence
tgagcctgtaaaatcaaaag

SEQ ID NO: 401616 - DNA, 20 bp, Artificial
  CRISPR gRNA sequence
taaaatcaaaagcaagttag

SEQ ID NO: 401617 - DNA, 20 bp, Artificial
  CRISPR gRNA sequence
gttacttcctagataaaaga

SEQ ID NO: 401618 - DNA, 20 bp, Artificial
  CRISPR gRNA sequence
cttcctagataaaagagggg

SEQ ID NO: 401619 - DNA, 20 bp, Artificial
  CRISPR gRNA sequence
cctagataaaagaggggtac

SEQ ID NO: 401620 - DNA, 20 bp, Artificial
  CRISPR gRNA sequence
ctagataaaagaggggtaca

SEQ ID NO: 401621 - DNA, 20 bp, Artificial
  CRISPR gRNA sequence
gataaaagaggggtacaggc

SEQ ID NO: 401622 - DNA, 20 bp, Artificial
  CRISPR gRNA sequence
gataaatacaccaattctaa

SEQ ID NO: 401623 - DNA, 20 bp, Artificial
  CRISPR gRNA sequence
taaatgagagaaattggcca

SEQ ID NO: 401624 - DNA, 20 bp, Artificial
  CRISPR gRNA sequence
aatgagagaaattggccaaa

SEQ ID NO: 401625 - DNA, 20 bp, Artificial
  CRISPR gRNA sequence
gccaaaacaaaggggctact

SEQ ID NO: 401626 - DNA, 20 bp, Artificial
  CRISPR gRNA sequence
ctagctccatgcaagtctga

SEQ ID NO: 401627 - DNA, 20 bp, Artificial
  CRISPR gRNA sequence
gctccatgcaagtctgaaat

SEQ ID NO: 401628 - DNA, 20 bp, Artificial
  CRISPR gRNA sequence
catgcaagtctgaaatcctg

SEQ ID NO: 401629 - DNA, 20 bp, Artificial
  CRISPR gRNA sequence
aaatcctgtagggcagtcat

SEQ ID NO: 401630 - DNA, 20 bp, Artificial
  CRISPR gRNA sequence
tagggcagtcattaaaactt

SEQ ID NO: 401631 - DNA, 20 bp, Artificial
  CRISPR gRNA sequence
aaacttcaagttccaaaaat

SEQ ID NO: 401632 - DNA, 20 bp, Artificial
  CRISPR gRNA sequence
caagttccaaaaatgatctc

SEQ ID NO: 401633 - DNA, 20 bp, Artificial
  CRISPR gRNA sequence
aagttccaaaaatgatctcc

SEQ ID NO: 401634 - DNA, 20 bp, Artificial
  CRISPR gRNA sequence
caaaaatgatctcctttgac

SEQ ID NO: 401635 - DNA, 20 bp, Artificial
  CRISPR gRNA sequence
ctttgactccatgtcccaca

SEQ ID NO: 401636 - DNA, 20 bp, Artificial
  CRISPR gRNA sequence
tgactccatgtcccacatcc

SEQ ID NO: 401637 - DNA, 20 bp, Artificial
  CRISPR gRNA sequence
gactccatgtcccacatcct

SEQ ID NO: 401638 - DNA, 20 bp, Artificial
  CRISPR gRNA sequence
actccatgtcccacatcctg

SEQ ID NO: 401639 - DNA, 20 bp, Artificial
  CRISPR gRNA sequence
catgtcccacatcctgggca

SEQ ID NO: 401640 - DNA, 20 bp, Artificial
  CRISPR gRNA sequence
ggcatgctgatgcaagaggt

SEQ ID NO: 401641 - DNA, 20 bp, Artificial
  CRISPR gRNA sequence
atgcaagaggtgggcaccca

SEQ ID NO: 401642 - DNA, 20 bp, Artificial
  CRISPR gRNA sequence
gggcagctccacccctctgg

SEQ ID NO: 401643 - DNA, 20 bp, Artificial
  CRISPR gRNA sequence
ggcagctccacccctctggc

SEQ ID NO: 401644 - DNA, 20 bp, Artificial
  CRISPR gRNA sequence
cacccctctggctatgcagg

SEQ ID NO: 401645 - DNA, 20 bp, Artificial
  CRISPR gRNA sequence
tggctatgcagggtacagcc

SEQ ID NO: 401646 - DNA, 20 bp, Artificial
  CRISPR gRNA sequence
gctatgcagggtacagcctc

SEQ ID NO: 401647 - DNA, 20 bp, Artificial
  CRISPR gRNA sequence
tgcagggtacagcctcccct

SEQ ID NO: 401648 - DNA, 20 bp, Artificial
  CRISPR gRNA sequence
ccctcttggctgctttcaca

SEQ ID NO: 401649 - DNA, 20 bp, Artificial
  CRISPR gRNA sequence
ttggctgctttcacaggctg

SEQ ID NO: 401650 - DNA, 20 bp, Artificial
  CRISPR gRNA sequence
ggctgctttcacaggctggt

SEQ ID NO: 401651 - DNA, 20 bp, Artificial
  CRISPR gRNA sequence
gctgctttcacaggctggtg

SEQ ID NO: 401652 - DNA, 20 bp, Artificial
  CRISPR gRNA sequence
ctttcacaggctggtgttga

SEQ ID NO: 401653 - DNA, 20 bp, Artificial
  CRISPR gRNA sequence
tcacaggctggtgttgagtg

SEQ ID NO: 401654 - DNA, 20 bp, Artificial
  CRISPR gRNA sequence
cacaggctggtgttgagtgt

SEQ ID NO: 401655 - DNA, 20 bp, Artificial
  CRISPR gRNA sequence
acaggctggtgttgagtgtc

SEQ ID NO: 401656 - DNA, 20 bp, Artificial
  CRISPR gRNA sequence
gtgttgagtgtctgtggctt

SEQ ID NO: 401657 - DNA, 20 bp, Artificial
  CRISPR gRNA sequence
agtgtctgtggcttctccag

SEQ ID NO: 401658 - DNA, 20 bp, Artificial
  CRISPR gRNA sequence
tggcttctccagttgcatgg

SEQ ID NO: 401659 - DNA, 20 bp, Artificial
  CRISPR gRNA sequence
ctccagttgcatggtgcaag

SEQ ID NO: 401660 - DNA, 20 bp, Artificial
  CRISPR gRNA sequence
tccagttgcatggtgcaagc

SEQ ID NO: 401661 - DNA, 20 bp, Artificial
  CRISPR gRNA sequence
cagttgcatggtgcaagccg

SEQ ID NO: 401662 - DNA, 20 bp, Artificial
  CRISPR gRNA sequence
catggtgcaagccgtctgtg

SEQ ID NO: 401663 - DNA, 20 bp, Artificial
  CRISPR gRNA sequence
tggatcagattcagattgtg

SEQ ID NO: 401664 - DNA, 20 bp, Artificial
  CRISPR gRNA sequence
agattgtggggtctgaagga

SEQ ID NO: 401665 - DNA, 20 bp, Artificial
  CRISPR gRNA sequence
tggggtctgaaggatggtgg

SEQ ID NO: 401666 - DNA, 20 bp, Artificial
  CRISPR gRNA sequence
aaggatggtggccctcttct

SEQ ID NO: 401667 - DNA, 20 bp, Artificial
  CRISPR gRNA sequence
ttctcacagctctactagac

SEQ ID NO: 401668 - DNA, 20 bp, Artificial
  CRISPR gRNA sequence
ctcacagctctactagacag

SEQ ID NO: 401669 - DNA, 20 bp, Artificial
  CRISPR gRNA sequence
tcacagctctactagacagt

SEQ ID NO: 401670 - DNA, 20 bp, Artificial
  CRISPR gRNA sequence
acagctctactagacagtgc

SEQ ID NO: 401671 - DNA, 20 bp, Artificial
  CRISPR gRNA sequence
tactagacagtgccccagtg

SEQ ID NO: 401672 - DNA, 20 bp, Artificial
  CRISPR gRNA sequence
ctagacagtgccccagtggg

SEQ ID NO: 401673 - DNA, 20 bp, Artificial
  CRISPR gRNA sequence
gacagtgccccagtggggat

SEQ ID NO: 401674 - DNA, 20 bp, Artificial
  CRISPR gRNA sequence
tgtgtgggggctccaacccc

SEQ ID NO: 401675 - DNA, 20 bp, Artificial
  CRISPR gRNA sequence
tgtgggggctccaaccccac

SEQ ID NO: 401676 - DNA, 20 bp, Artificial
  CRISPR gRNA sequence
caaccccacatttccctgct

SEQ ID NO: 401677 - DNA, 20 bp, Artificial
  CRISPR gRNA sequence
ccctgctgcagtgccctagc

SEQ ID NO: 401678 - DNA, 20 bp, Artificial
  CRISPR gRNA sequence
cctgctgcagtgccctagca

SEQ ID NO: 401679 - DNA, 20 bp, Artificial
  CRISPR gRNA sequence
ctgcagtgccctagcagagg

SEQ ID NO: 401680 - DNA, 20 bp, Artificial
  CRISPR gRNA sequence
cagtgccctagcagaggtct

SEQ ID NO: 401681 - DNA, 20 bp, Artificial
  CRISPR gRNA sequence
gcagaggtcttccatgaggg

SEQ ID NO: 401682 - DNA, 20 bp, Artificial
  CRISPR gRNA sequence
ccatgagggctctgcccttg

SEQ ID NO: 401683 - DNA, 20 bp, Artificial
  CRISPR gRNA sequence
catgagggctctgcccttgc

SEQ ID NO: 401684 - DNA, 20 bp, Artificial
  CRISPR gRNA sequence
tgcccttgcagcaacttctg

SEQ ID NO: 401685 - DNA, 20 bp, Artificial
  CRISPR gRNA sequence
cccttgcagcaacttctgaa

SEQ ID NO: 401686 - DNA, 20 bp, Artificial
  CRISPR gRNA sequence
gcagcaacttctgaatggac

SEQ ID NO: 401687 - DNA, 20 bp, Artificial
  CRISPR gRNA sequence
cagcaacttctgaatggaca

SEQ ID NO: 401688 - DNA, 20 bp, Artificial
  CRISPR gRNA sequence
ctgaatggacacccaggtgt

SEQ ID NO: 401689 - DNA, 20 bp, Artificial
  CRISPR gRNA sequence
tgaatggacacccaggtgtt

SEQ ID NO: 401690 - DNA, 20 bp, Artificial
  CRISPR gRNA sequence
aatggacacccaggtgtttc

SEQ ID NO: 401691 - DNA, 20 bp, Artificial
  CRISPR gRNA sequence
ctgtacattttctgaagtct

SEQ ID NO: 401692 - DNA, 20 bp, Artificial
  CRISPR gRNA sequence
tgtacattttctgaagtcta

SEQ ID NO: 401693 - DNA, 20 bp, Artificial
  CRISPR gRNA sequence
tacattttctgaagtctagg

SEQ ID NO: 401694 - DNA, 20 bp, Artificial
  CRISPR gRNA sequence
tctgaagtctaggcagaggt

SEQ ID NO: 401695 - DNA, 20 bp, Artificial
  CRISPR gRNA sequence
ctgaagtctaggcagaggtt

SEQ ID NO: 401696 - DNA, 20 bp, Artificial
  CRISPR gRNA sequence
tgaagtctaggcagaggttc

SEQ ID NO: 401697 - DNA, 20 bp, Artificial
  CRISPR gRNA sequence
aagtctaggcagaggttctc

SEQ ID NO: 401698 - DNA, 20 bp, Artificial
  CRISPR gRNA sequence
ggcagaggttctcaaaccac

SEQ ID NO: 401699 - DNA, 20 bp, Artificial
  CRISPR gRNA sequence
tcaaaccacagttcttgact

SEQ ID NO: 401700 - DNA, 20 bp, Artificial
  CRISPR gRNA sequence
aaaccacagttcttgacttc

SEQ ID NO: 401701 - DNA, 20 bp, Artificial
  CRISPR gRNA sequence
ttgacttctgtgcacccgca

SEQ ID NO: 401702 - DNA, 20 bp, Artificial
  CRISPR gRNA sequence
gacttctgtgcacccgcagg

SEQ ID NO: 401703 - DNA, 20 bp, Artificial
  CRISPR gRNA sequence
acttctgtgcacccgcaggc

SEQ ID NO: 401704 - DNA, 20 bp, Artificial
  CRISPR gRNA sequence
ctgtgcacccgcaggcccaa

SEQ ID NO: 401705 - DNA, 20 bp, Artificial
  CRISPR gRNA sequence
tgtgcacccgcaggcccaac

SEQ ID NO: 401706 - DNA, 20 bp, Artificial
  CRISPR gRNA sequence
tgcacccgcaggcccaacac

SEQ ID NO: 401707 - DNA, 20 bp, Artificial
  CRISPR gRNA sequence
tcaaggcttggggcttgcac

SEQ ID NO: 401708 - DNA, 20 bp, Artificial
  CRISPR gRNA sequence
ggggcttgcaccctctgaag

SEQ ID NO: 401709 - DNA, 20 bp, Artificial
  CRISPR gRNA sequence
gggcttgcaccctctgaagc

SEQ ID NO: 401710 - DNA, 20 bp, Artificial
  CRISPR gRNA sequence
gcaccctctgaagcaacagc

SEQ ID NO: 401711 - DNA, 20 bp, Artificial
  CRISPR gRNA sequence
caccctctgaagcaacagcc

SEQ ID NO: 401712 - DNA, 20 bp, Artificial
  CRISPR gRNA sequence
tgaagcaacagcctgagctg

SEQ ID NO: 401713 - DNA, 20 bp, Artificial
  CRISPR gRNA sequence
aagcaacagcctgagctgta

SEQ ID NO: 401714 - DNA, 20 bp, Artificial
  CRISPR gRNA sequence
agctgtatgttggccccttt

SEQ ID NO: 401715 - DNA, 20 bp, Artificial
  CRISPR gRNA sequence
tatgttggccccttttagcc

SEQ ID NO: 401716 - DNA, 20 bp, Artificial
  CRISPR gRNA sequence
gccccttttagccgtggctg

SEQ ID NO: 401717 - DNA, 20 bp, Artificial
  CRISPR gRNA sequence
ttagccgtggctgggacata

SEQ ID NO: 401718 - DNA, 20 bp, Artificial
  CRISPR gRNA sequence
tagccgtggctgggacatag

SEQ ID NO: 401719 - DNA, 20 bp, Artificial
  CRISPR gRNA sequence
agccgtggctgggacatagg

SEQ ID NO: 401720 - DNA, 20 bp, Artificial
  CRISPR gRNA sequence
gccgtggctgggacataggg

SEQ ID NO: 401721 - DNA, 20 bp, Artificial
  CRISPR gRNA sequence
ggacatagggcaccatatgc

SEQ ID NO: 401722 - DNA, 20 bp, Artificial
  CRISPR gRNA sequence
catagagcagggggtcttag

SEQ ID NO: 401723 - DNA, 20 bp, Artificial
  CRISPR gRNA sequence
aggcttggcccaggaaatca

SEQ ID NO: 401724 - DNA, 20 bp, Artificial
  CRISPR gRNA sequence
ggcttggcccaggaaatcac

SEQ ID NO: 401725 - DNA, 20 bp, Artificial
  CRISPR gRNA sequence
ggcccaggaaatcacttttc

SEQ ID NO: 401726 - DNA, 20 bp, Artificial
  CRISPR gRNA sequence
gcccaggaaatcacttttcc

SEQ ID NO: 401727 - DNA, 20 bp, Artificial
  CRISPR gRNA sequence
ttccctcctaggcttatgat

SEQ ID NO: 401728 - DNA, 20 bp, Artificial
  CRISPR gRNA sequence
tccctcctaggcttatgatg

SEQ ID NO: 401729 - DNA, 20 bp, Artificial
  CRISPR gRNA sequence
ccctcctaggcttatgatgg

SEQ ID NO: 401730 - DNA, 20 bp, Artificial
  CRISPR gRNA sequence
cctcctaggcttatgatgga

SEQ ID NO: 401731 - DNA, 20 bp, Artificial
  CRISPR gRNA sequence
ctaggcttatgatggaaggg

SEQ ID NO: 401732 - DNA, 20 bp, Artificial
  CRISPR gRNA sequence
ggcttatgatggaaggggct

SEQ ID NO: 401733 - DNA, 20 bp, Artificial
  CRISPR gRNA sequence
atgatggaaggggctgccat

SEQ ID NO: 401734 - DNA, 20 bp, Artificial
  CRISPR gRNA sequence
tgatggaaggggctgccatg

SEQ ID NO: 401735 - DNA, 20 bp, Artificial
  CRISPR gRNA sequence
ccatgaaggtctctgacatg

SEQ ID NO: 401736 - DNA, 20 bp, Artificial
  CRISPR gRNA sequence
tgacatgccttggagacatt

SEQ ID NO: 401737 - DNA, 20 bp, Artificial
  CRISPR gRNA sequence
acatgccttggagacatttt

SEQ ID NO: 401738 - DNA, 20 bp, Artificial
  CRISPR gRNA sequence
ggagacattttccccattgt

SEQ ID NO: 401739 - DNA, 20 bp, Artificial
  CRISPR gRNA sequence
gagacattttccccattgtc

SEQ ID NO: 401740 - DNA, 20 bp, Artificial
  CRISPR gRNA sequence
tccccattgtcttggtgatt

SEQ ID NO: 401741 - DNA, 20 bp, Artificial
  CRISPR gRNA sequence
ccccattgtcttggtgattt

SEQ ID NO: 401742 - DNA, 20 bp, Artificial
  CRISPR gRNA sequence
cccattgtcttggtgattta

SEQ ID NO: 401743 - DNA, 20 bp, Artificial
  CRISPR gRNA sequence
tcttggtgatttacatttgg

SEQ ID NO: 401744 - DNA, 20 bp, Artificial
  CRISPR gRNA sequence
ggtgatttacatttggctcc

SEQ ID NO: 401745 - DNA, 20 bp, Artificial
  CRISPR gRNA sequence
gtgatttacatttggctcct

SEQ ID NO: 401746 - DNA, 20 bp, Artificial
  CRISPR gRNA sequence
acatttggctcctcattact

SEQ ID NO: 401747 - DNA, 20 bp, Artificial
  CRISPR gRNA sequence
catttggctcctcattactt

SEQ ID NO: 401748 - DNA, 20 bp, Artificial
  CRISPR gRNA sequence
ggctcctcattacttatgca

SEQ ID NO: 401749 - DNA, 20 bp, Artificial
  CRISPR gRNA sequence
gctcctcattacttatgcaa

SEQ ID NO: 401750 - DNA, 20 bp, Artificial
  CRISPR gRNA sequence
ctcattacttatgcaaattt

SEQ ID NO: 401751 - DNA, 20 bp, Artificial
  CRISPR gRNA sequence
attacttatgcaaatttctg

SEQ ID NO: 401752 - DNA, 20 bp, Artificial
  CRISPR gRNA sequence
cttatgcaaatttctgcagc

SEQ ID NO: 401753 - DNA, 20 bp, Artificial
  CRISPR gRNA sequence
atgcaaatttctgcagctgg

SEQ ID NO: 401754 - DNA, 20 bp, Artificial
  CRISPR gRNA sequence
tgcaaatttctgcagctggc

SEQ ID NO: 401755 - DNA, 20 bp, Artificial
  CRISPR gRNA sequence
ctgcagctggctggaatttc

SEQ ID NO: 401756 - DNA, 20 bp, Artificial
  CRISPR gRNA sequence
tgcagctggctggaatttct

SEQ ID NO: 401757 - DNA, 20 bp, Artificial
  CRISPR gRNA sequence
cagctggctggaatttcttc

SEQ ID NO: 401758 - DNA, 20 bp, Artificial
  CRISPR gRNA sequence
gctggaatttcttcccagaa

SEQ ID NO: 401759 - DNA, 20 bp, Artificial
  CRISPR gRNA sequence
gaatttcttcccagaaaatg

SEQ ID NO: 401760 - DNA, 20 bp, Artificial
  CRISPR gRNA sequence
cttcccagaaaatgtttttc

SEQ ID NO: 401761 - DNA, 20 bp, Artificial
  CRISPR gRNA sequence
ttcccagaaaatgtttttct

SEQ ID NO: 401762 - DNA, 20 bp, Artificial
  CRISPR gRNA sequence
cccagaaaatgtttttcttt

SEQ ID NO: 401763 - DNA, 20 bp, Artificial
  CRISPR gRNA sequence
ccagaaaatgtttttctttt

SEQ ID NO: 401764 - DNA, 20 bp, Artificial
  CRISPR gRNA sequence
ttcttttctgtcgcatcatc

SEQ ID NO: 401765 - DNA, 20 bp, Artificial
  CRISPR gRNA sequence
tcttttctgtcgcatcatca

SEQ ID NO: 401766 - DNA, 20 bp, Artificial
  CRISPR gRNA sequence
cttttctgtcgcatcatcag

SEQ ID NO: 401767 - DNA, 20 bp, Artificial
  CRISPR gRNA sequence
ttttctgtcgcatcatcagg

SEQ ID NO: 401768 - DNA, 20 bp, Artificial
  CRISPR gRNA sequence
ttctgtcgcatcatcaggct

SEQ ID NO: 401769 - DNA, 20 bp, Artificial
  CRISPR gRNA sequence
tctgtcgcatcatcaggctg

SEQ ID NO: 401770 - DNA, 20 bp, Artificial
  CRISPR gRNA sequence
ctgtcgcatcatcaggctgc

SEQ ID NO: 401771 - DNA, 20 bp, Artificial
  CRISPR gRNA sequence
tgtcgcatcatcaggctgca

SEQ ID NO: 401772 - DNA, 20 bp, Artificial
  CRISPR gRNA sequence
tcgcatcatcaggctgcaaa

SEQ ID NO: 401773 - DNA, 20 bp, Artificial
  CRISPR gRNA sequence
caaattttccaaatttttta

SEQ ID NO: 401774 - DNA, 20 bp, Artificial
  CRISPR gRNA sequence
tccaaattttttatgctctg

SEQ ID NO: 401775 - DNA, 20 bp, Artificial
  CRISPR gRNA sequence
ccaaattttttatgctctgc

SEQ ID NO: 401776 - DNA, 20 bp, Artificial
  CRISPR gRNA sequence
caaattttttatgctctgct

SEQ ID NO: 401777 - DNA, 20 bp, Artificial
  CRISPR gRNA sequence
tttatgctctgcttcctctt

SEQ ID NO: 401778 - DNA, 20 bp, Artificial
  CRISPR gRNA sequence
ttatgctctgcttcctcttg

SEQ ID NO: 401779 - DNA, 20 bp, Artificial
  CRISPR gRNA sequence
tatgctctgcttcctcttga

SEQ ID NO: 401780 - DNA, 20 bp, Artificial
  CRISPR gRNA sequence
atgctctgcttcctcttgaa

SEQ ID NO: 401781 - DNA, 20 bp, Artificial
  CRISPR gRNA sequence
tgctctgcttcctcttgaat

SEQ ID NO: 401782 - DNA, 20 bp, Artificial
  CRISPR gRNA sequence
tgcttcctcttgaatgcttt

SEQ ID NO: 401783 - DNA, 20 bp, Artificial
  CRISPR gRNA sequence
cttcctcttgaatgctttgc

SEQ ID NO: 401784 - DNA, 20 bp, Artificial
  CRISPR gRNA sequence
cctcttgaatgctttgcccc

SEQ ID NO: 401785 - DNA, 20 bp, Artificial
  CRISPR gRNA sequence
ctcttgaatgctttgcccct

SEQ ID NO: 401786 - DNA, 20 bp, Artificial
  CRISPR gRNA sequence
ttgaatgctttgccccttag

SEQ ID NO: 401787 - DNA, 20 bp, Artificial
  CRISPR gRNA sequence
gaatgctttgccccttagaa

SEQ ID NO: 401788 - DNA, 20 bp, Artificial
  CRISPR gRNA sequence
aatgctttgccccttagaag

SEQ ID NO: 401789 - DNA, 20 bp, Artificial
  CRISPR gRNA sequence
tgccccttagaagtttcttc

SEQ ID NO: 401790 - DNA, 20 bp, Artificial
  CRISPR gRNA sequence
gccccttagaagtttcttct

SEQ ID NO: 401791 - DNA, 20 bp, Artificial
  CRISPR gRNA sequence
ccccttagaagtttcttctg

SEQ ID NO: 401792 - DNA, 20 bp, Artificial
  CRISPR gRNA sequence
agaagtttcttctgccagat

SEQ ID NO: 401793 - DNA, 20 bp, Artificial
  CRISPR gRNA sequence
gaagtttcttctgccagata

SEQ ID NO: 401794 - DNA, 20 bp, Artificial
  CRISPR gRNA sequence
cttctgccagataccctaaa

SEQ ID NO: 401795 - DNA, 20 bp, Artificial
  CRISPR gRNA sequence
ttctgccagataccctaaat

SEQ ID NO: 401796 - DNA, 20 bp, Artificial
  CRISPR gRNA sequence
ctgccagataccctaaatta

SEQ ID NO: 401797 - DNA, 20 bp, Artificial
  CRISPR gRNA sequence
tgccagataccctaaattat

SEQ ID NO: 401798 - DNA, 20 bp, Artificial
  CRISPR gRNA sequence
ccagataccctaaattatct

SEQ ID NO: 401799 - DNA, 20 bp, Artificial
  CRISPR gRNA sequence
aattatctctctcaagttca

SEQ ID NO: 401800 - DNA, 20 bp, Artificial
  CRISPR gRNA sequence
tctctctcaagttcaaagtt

SEQ ID NO: 401801 - DNA, 20 bp, Artificial
  CRISPR gRNA sequence
tctcaagttcaaagttccac

SEQ ID NO: 401802 - DNA, 20 bp, Artificial
  CRISPR gRNA sequence
tcaagttcaaagttccacag

SEQ ID NO: 401803 - DNA, 20 bp, Artificial
  CRISPR gRNA sequence
aagttcaaagttccacagat

SEQ ID NO: 401804 - DNA, 20 bp, Artificial
  CRISPR gRNA sequence
aaagttccacagatctctgg

SEQ ID NO: 401805 - DNA, 20 bp, Artificial
  CRISPR gRNA sequence
cacagatctctggggcaggg

SEQ ID NO: 401806 - DNA, 20 bp, Artificial
  CRISPR gRNA sequence
tggggcaggggcaaaatgcc

SEQ ID NO: 401807 - DNA, 20 bp, Artificial
  CRISPR gRNA sequence
gggcaggggcaaaatgccac

SEQ ID NO: 401808 - DNA, 20 bp, Artificial
  CRISPR gRNA sequence
tttgcatagcaagagtgacc

SEQ ID NO: 401809 - DNA, 20 bp, Artificial
  CRISPR gRNA sequence
tgcatagcaagagtgacctt

SEQ ID NO: 401810 - DNA, 20 bp, Artificial
  CRISPR gRNA sequence
gcatagcaagagtgaccttt

SEQ ID NO: 401811 - DNA, 20 bp, Artificial
  CRISPR gRNA sequence
catagcaagagtgaccttta

SEQ ID NO: 401812 - DNA, 20 bp, Artificial
  CRISPR gRNA sequence
tactccatttcccaaaaagt

SEQ ID NO: 401813 - DNA, 20 bp, Artificial
  CRISPR gRNA sequence
actccatttcccaaaaagtt

SEQ ID NO: 401814 - DNA, 20 bp, Artificial
  CRISPR gRNA sequence
ctccatttcccaaaaagttc

SEQ ID NO: 401815 - DNA, 20 bp, Artificial
  CRISPR gRNA sequence
catttcccaaaaagttcctc

SEQ ID NO: 401816 - DNA, 20 bp, Artificial
  CRISPR gRNA sequence
cccaaaaagttcctcatctc

SEQ ID NO: 401817 - DNA, 20 bp, Artificial
  CRISPR gRNA sequence
ccaaaaagttcctcatctcc

SEQ ID NO: 401818 - DNA, 20 bp, Artificial
  CRISPR gRNA sequence
ctcatctccatctgagacca

SEQ ID NO: 401819 - DNA, 20 bp, Artificial
  CRISPR gRNA sequence
atctccatctgagaccacct

SEQ ID NO: 401820 - DNA, 20 bp, Artificial
  CRISPR gRNA sequence
catctgagaccacctcagcc

SEQ ID NO: 401821 - DNA, 20 bp, Artificial
  CRISPR gRNA sequence
agaccacctcagcctggact

SEQ ID NO: 401822 - DNA, 20 bp, Artificial
  CRISPR gRNA sequence
agcctggacttcattgttta

SEQ ID NO: 401823 - DNA, 20 bp, Artificial
  CRISPR gRNA sequence
gacttcattgtttatatcac

SEQ ID NO: 401824 - DNA, 20 bp, Artificial
  CRISPR gRNA sequence
cattgtttatatcactgtca

SEQ ID NO: 401825 - DNA, 20 bp, Artificial
  CRISPR gRNA sequence
attgtttatatcactgtcag

SEQ ID NO: 401826 - DNA, 20 bp, Artificial
  CRISPR gRNA sequence
tttatatcactgtcagcatt

SEQ ID NO: 401827 - DNA, 20 bp, Artificial
  CRISPR gRNA sequence
atatcactgtcagcattttg

SEQ ID NO: 401828 - DNA, 20 bp, Artificial
  CRISPR gRNA sequence
tatcactgtcagcattttgg

SEQ ID NO: 401829 - DNA, 20 bp, Artificial
  CRISPR gRNA sequence
tcagcattttggtcaatgtc

SEQ ID NO: 401830 - DNA, 20 bp, Artificial
  CRISPR gRNA sequence
tggtcaatgtcattcaacaa

SEQ ID NO: 401831 - DNA, 20 bp, Artificial
  CRISPR gRNA sequence
ggtcaatgtcattcaacaaa

SEQ ID NO: 401832 - DNA, 20 bp, Artificial
  CRISPR gRNA sequence
gtcaatgtcattcaacaaat

SEQ ID NO: 401833 - DNA, 20 bp, Artificial
  CRISPR gRNA sequence
aacaaatttctaggaagttc

SEQ ID NO: 401834 - DNA, 20 bp, Artificial
  CRISPR gRNA sequence
ctaggaagttcccaaatttc

SEQ ID NO: 401835 - DNA, 20 bp, Artificial
  CRISPR gRNA sequence
taggaagttcccaaatttcc

SEQ ID NO: 401836 - DNA, 20 bp, Artificial
  CRISPR gRNA sequence
ggaagttcccaaatttccca

SEQ ID NO: 401837 - DNA, 20 bp, Artificial
  CRISPR gRNA sequence
ccaaatttcccacattttcc

SEQ ID NO: 401838 - DNA, 20 bp, Artificial
  CRISPR gRNA sequence
cccacattttcctgtcttct

SEQ ID NO: 401839 - DNA, 20 bp, Artificial
  CRISPR gRNA sequence
ccacattttcctgtcttctt

SEQ ID NO: 401840 - DNA, 20 bp, Artificial
  CRISPR gRNA sequence
tcctgtcttcttctgagccc

SEQ ID NO: 401841 - DNA, 20 bp, Artificial
  CRISPR gRNA sequence
cctgtcttcttctgagccct

SEQ ID NO: 401842 - DNA, 20 bp, Artificial
  CRISPR gRNA sequence
ctgtcttcttctgagccctc

SEQ ID NO: 401843 - DNA, 20 bp, Artificial
  CRISPR gRNA sequence
tcttcttctgagccctcaaa

SEQ ID NO: 401844 - DNA, 20 bp, Artificial
  CRISPR gRNA sequence
cttctgagccctcaaaactg

SEQ ID NO: 401845 - DNA, 20 bp, Artificial
  CRISPR gRNA sequence
ttctgagccctcaaaactgt

SEQ ID NO: 401846 - DNA, 20 bp, Artificial
  CRISPR gRNA sequence
ctgagccctcaaaactgttc

SEQ ID NO: 401847 - DNA, 20 bp, Artificial
  CRISPR gRNA sequence
tgagccctcaaaactgttcc

SEQ ID NO: 401848 - DNA, 20 bp, Artificial
  CRISPR gRNA sequence
agccctcaaaactgttccaa

SEQ ID NO: 401849 - DNA, 20 bp, Artificial
  CRISPR gRNA sequence
aaaactgttccaacctctac

SEQ ID NO: 401850 - DNA, 20 bp, Artificial
  CRISPR gRNA sequence
ttccaacctctacctgttac

SEQ ID NO: 401851 - DNA, 20 bp, Artificial
  CRISPR gRNA sequence
caacctctacctgttaccca

SEQ ID NO: 401852 - DNA, 20 bp, Artificial
  CRISPR gRNA sequence
tacctgttacccagttccaa

SEQ ID NO: 401853 - DNA, 20 bp, Artificial
  CRISPR gRNA sequence
cctgttacccagttccaaag

SEQ ID NO: 401854 - DNA, 20 bp, Artificial
  CRISPR gRNA sequence
ttacccagttccaaagttgc

SEQ ID NO: 401855 - DNA, 20 bp, Artificial
  CRISPR gRNA sequence
cccagttccaaagttgcttt

SEQ ID NO: 401856 - DNA, 20 bp, Artificial
  CRISPR gRNA sequence
caaagttgctttcacacttg

SEQ ID NO: 401857 - DNA, 20 bp, Artificial
  CRISPR gRNA sequence
ctttcacacttgtggatatc

SEQ ID NO: 401858 - DNA, 20 bp, Artificial
  CRISPR gRNA sequence
tcacacttgtggatatcttt

SEQ ID NO: 401859 - DNA, 20 bp, Artificial
  CRISPR gRNA sequence
cacacttgtggatatcttta

SEQ ID NO: 401860 - DNA, 20 bp, Artificial
  CRISPR gRNA sequence
acacttgtggatatctttac

SEQ ID NO: 401861 - DNA, 20 bp, Artificial
  CRISPR gRNA sequence
gtggatatctttacagcaac

SEQ ID NO: 401862 - DNA, 20 bp, Artificial
  CRISPR gRNA sequence
tggatatctttacagcaacc

SEQ ID NO: 401863 - DNA, 20 bp, Artificial
  CRISPR gRNA sequence
tacagcaaccctccactctc

SEQ ID NO: 401864 - DNA, 20 bp, Artificial
  CRISPR gRNA sequence
acagcaaccctccactctct

SEQ ID NO: 401865 - DNA, 20 bp, Artificial
  CRISPR gRNA sequence
cagcaaccctccactctctg

SEQ ID NO: 401866 - DNA, 20 bp, Artificial
  CRISPR gRNA sequence
cactctctgctgtactcatt

SEQ ID NO: 401867 - DNA, 20 bp, Artificial
  CRISPR gRNA sequence
tctgctgtactcatttactg

SEQ ID NO: 401868 - DNA, 20 bp, Artificial
  CRISPR gRNA sequence
tgctgtactcatttactgta

SEQ ID NO: 401869 - DNA, 20 bp, Artificial
  CRISPR gRNA sequence
ctgtactcatttactgtatt

SEQ ID NO: 401870 - DNA, 20 bp, Artificial
  CRISPR gRNA sequence
tactcatttactgtattact

SEQ ID NO: 401871 - DNA, 20 bp, Artificial
  CRISPR gRNA sequence
atttactgtattactcagtt

SEQ ID NO: 401872 - DNA, 20 bp, Artificial
  CRISPR gRNA sequence
actgtattactcagttttca

SEQ ID NO: 401873 - DNA, 20 bp, Artificial
  CRISPR gRNA sequence
ctgtattactcagttttcat

SEQ ID NO: 401874 - DNA, 20 bp, Artificial
  CRISPR gRNA sequence
tattactcagttttcatgct

SEQ ID NO: 401875 - DNA, 20 bp, Artificial
  CRISPR gRNA sequence
ctcagttttcatgctgctaa

SEQ ID NO: 401876 - DNA, 20 bp, Artificial
  CRISPR gRNA sequence
agttttcatgctgctaataa

SEQ ID NO: 401877 - DNA, 20 bp, Artificial
  CRISPR gRNA sequence
tcatgctgctaataaagaca

SEQ ID NO: 401878 - DNA, 20 bp, Artificial
  CRISPR gRNA sequence
catgctgctaataaagacat

SEQ ID NO: 401879 - DNA, 20 bp, Artificial
  CRISPR gRNA sequence
atgctgctaataaagacata

SEQ ID NO: 401880 - DNA, 20 bp, Artificial
  CRISPR gRNA sequence
ctaataaagacatacctgag

SEQ ID NO: 401881 - DNA, 20 bp, Artificial
  CRISPR gRNA sequence
ataaagacatacctgagaca

SEQ ID NO: 401882 - DNA, 20 bp, Artificial
  CRISPR gRNA sequence
agacagggtaatttataaag

SEQ ID NO: 401883 - DNA, 20 bp, Artificial
  CRISPR gRNA sequence
ataaaggaaagaggtttaat

SEQ ID NO: 401884 - DNA, 20 bp, Artificial
  CRISPR gRNA sequence
taaaggaaagaggtttaatt

SEQ ID NO: 401885 - DNA, 20 bp, Artificial
  CRISPR gRNA sequence
aattgattctcagttcagta

SEQ ID NO: 401886 - DNA, 20 bp, Artificial
  CRISPR gRNA sequence
attgattctcagttcagtat

SEQ ID NO: 401887 - DNA, 20 bp, Artificial
  CRISPR gRNA sequence
attctcagttcagtatgggt

SEQ ID NO: 401888 - DNA, 20 bp, Artificial
  CRISPR gRNA sequence
tcagttcagtatgggtgggg

SEQ ID NO: 401889 - DNA, 20 bp, Artificial
  CRISPR gRNA sequence
agttcagtatgggtggggag

SEQ ID NO: 401890 - DNA, 20 bp, Artificial
  CRISPR gRNA sequence
agtatgggtggggaggcctc

SEQ ID NO: 401891 - DNA, 20 bp, Artificial
  CRISPR gRNA sequence
aggaaacttacaatcatggt

SEQ ID NO: 401892 - DNA, 20 bp, Artificial
  CRISPR gRNA sequence
acaatcatggtggaagggga

SEQ ID NO: 401893 - DNA, 20 bp, Artificial
  CRISPR gRNA sequence
caatcatggtggaaggggaa

SEQ ID NO: 401894 - DNA, 20 bp, Artificial
  CRISPR gRNA sequence
cacatggtagcagggagaag

SEQ ID NO: 401895 - DNA, 20 bp, Artificial
  CRISPR gRNA sequence
acatggtagcagggagaaga

SEQ ID NO: 401896 - DNA, 20 bp, Artificial
  CRISPR gRNA sequence
ataaaaccatcagatctcat

SEQ ID NO: 401897 - DNA, 20 bp, Artificial
  CRISPR gRNA sequence
taaaaccatcagatctcatg

SEQ ID NO: 401898 - DNA, 20 bp, Artificial
  CRISPR gRNA sequence
atgagaactaactcactatc

SEQ ID NO: 401899 - DNA, 20 bp, Artificial
  CRISPR gRNA sequence
actcactatcatgagaacag

SEQ ID NO: 401900 - DNA, 20 bp, Artificial
  CRISPR gRNA sequence
actatcatgagaacaggatg

SEQ ID NO: 401901 - DNA, 20 bp, Artificial
  CRISPR gRNA sequence
tcatgagaacaggatggggg

SEQ ID NO: 401902 - DNA, 20 bp, Artificial
  CRISPR gRNA sequence
agttatctccacctggtctc

SEQ ID NO: 401903 - DNA, 20 bp, Artificial
  CRISPR gRNA sequence
tctccacctggtctctccca

SEQ ID NO: 401904 - DNA, 20 bp, Artificial
  CRISPR gRNA sequence
cacctggtctctcccacgac

SEQ ID NO: 401905 - DNA, 20 bp, Artificial
  CRISPR gRNA sequence
gtctctcccacgacacgtga

SEQ ID NO: 401906 - DNA, 20 bp, Artificial
  CRISPR gRNA sequence
tcccacgacacgtgagggtt

SEQ ID NO: 401907 - DNA, 20 bp, Artificial
  CRISPR gRNA sequence
ccacgacacgtgagggttat

SEQ ID NO: 401908 - DNA, 20 bp, Artificial
  CRISPR gRNA sequence
tgggaactacaactcaagat

SEQ ID NO: 401909 - DNA, 20 bp, Artificial
  CRISPR gRNA sequence
caactcaagatgagatttgg

SEQ ID NO: 401910 - DNA, 20 bp, Artificial
  CRISPR gRNA sequence
aagatgagatttgggtgggc

SEQ ID NO: 401911 - DNA, 20 bp, Artificial
  CRISPR gRNA sequence
gggtgggcacacggccaaat

SEQ ID NO: 401912 - DNA, 20 bp, Artificial
  CRISPR gRNA sequence
ggtgggcacacggccaaatt

SEQ ID NO: 401913 - DNA, 20 bp, Artificial
  CRISPR gRNA sequence
tatcatatgatcatggagac

SEQ ID NO: 401914 - DNA, 20 bp, Artificial
  CRISPR gRNA sequence
ataagcccaaatttgcagtg

SEQ ID NO: 401915 - DNA, 20 bp, Artificial
  CRISPR gRNA sequence
gcagtgtgggcttgcaggct

SEQ ID NO: 401916 - DNA, 20 bp, Artificial
  CRISPR gRNA sequence
cagtgtgggcttgcaggctg

SEQ ID NO: 401917 - DNA, 20 bp, Artificial
  CRISPR gRNA sequence
gcaggctgcagacccaggag

SEQ ID NO: 401918 - DNA, 20 bp, Artificial
  CRISPR gRNA sequence
caggctgcagacccaggaga

SEQ ID NO: 401919 - DNA, 20 bp, Artificial
  CRISPR gRNA sequence
cagacccaggagagccgatg

SEQ ID NO: 401920 - DNA, 20 bp, Artificial
  CRISPR gRNA sequence
ctgcagaatccctcttgctt

SEQ ID NO: 401921 - DNA, 20 bp, Artificial
  CRISPR gRNA sequence
cagaatccctcttgcttggg

SEQ ID NO: 401922 - DNA, 20 bp, Artificial
  CRISPR gRNA sequence
ttgcttggggaggctggtct

SEQ ID NO: 401923 - DNA, 20 bp, Artificial
  CRISPR gRNA sequence
gcttggggaggctggtcttt

SEQ ID NO: 401924 - DNA, 20 bp, Artificial
  CRISPR gRNA sequence
cttggggaggctggtctttt

SEQ ID NO: 401925 - DNA, 20 bp, Artificial
  CRISPR gRNA sequence
ggggaggctggtctttttgt

SEQ ID NO: 401926 - DNA, 20 bp, Artificial
  CRISPR gRNA sequence
gggaggctggtctttttgtt

SEQ ID NO: 401927 - DNA, 20 bp, Artificial
  CRISPR gRNA sequence
gtctttttgttgaattaggc

SEQ ID NO: 401928 - DNA, 20 bp, Artificial
  CRISPR gRNA sequence
tttgttgaattaggctcacc

SEQ ID NO: 401929 - DNA, 20 bp, Artificial
  CRISPR gRNA sequence
ttgttgaattaggctcacct

SEQ ID NO: 401930 - DNA, 20 bp, Artificial
  CRISPR gRNA sequence
tgttgaattaggctcaccta

SEQ ID NO: 401931 - DNA, 20 bp, Artificial
  CRISPR gRNA sequence
gttgaattaggctcacctac

SEQ ID NO: 401932 - DNA, 20 bp, Artificial
  CRISPR gRNA sequence
ttgaattaggctcacctaca

SEQ ID NO: 401933 - DNA, 20 bp, Artificial
  CRISPR gRNA sequence
aattaggctcacctacatta

SEQ ID NO: 401934 - DNA, 20 bp, Artificial
  CRISPR gRNA sequence
ggctcacctacattatggag

SEQ ID NO: 401935 - DNA, 20 bp, Artificial
  CRISPR gRNA sequence
acctacattatggaggcaaa

SEQ ID NO: 401936 - DNA, 20 bp, Artificial
  CRISPR gRNA sequence
cattatggaggcaaactgct

SEQ ID NO: 401937 - DNA, 20 bp, Artificial
  CRISPR gRNA sequence
tggaggcaaactgcttattc

SEQ ID NO: 401938 - DNA, 20 bp, Artificial
  CRISPR gRNA sequence
cttattcaaaattcaccaat

SEQ ID NO: 401939 - DNA, 20 bp, Artificial
  CRISPR gRNA sequence
attcaaaattcaccaattta

SEQ ID NO: 401940 - DNA, 20 bp, Artificial
  CRISPR gRNA sequence
ttcaaaattcaccaatttaa

SEQ ID NO: 401941 - DNA, 20 bp, Artificial
  CRISPR gRNA sequence
aaaattcaccaatttaaatg

SEQ ID NO: 401942 - DNA, 20 bp, Artificial
  CRISPR gRNA sequence
accaatttaaatgttaatct

SEQ ID NO: 401943 - DNA, 20 bp, Artificial
  CRISPR gRNA sequence
aaatgttaatctcatcccaa

SEQ ID NO: 401944 - DNA, 20 bp, Artificial
  CRISPR gRNA sequence
aatgttaatctcatcccaaa

SEQ ID NO: 401945 - DNA, 20 bp, Artificial
  CRISPR gRNA sequence
atctcatcccaaaacaccct

SEQ ID NO: 401946 - DNA, 20 bp, Artificial
  CRISPR gRNA sequence
atcccaaaacacccttcaaa

SEQ ID NO: 401947 - DNA, 20 bp, Artificial
  CRISPR gRNA sequence
caaattgacacgtaaaatta

SEQ ID NO: 401948 - DNA, 20 bp, Artificial
  CRISPR gRNA sequence
aaattgacacgtaaaattaa

SEQ ID NO: 401949 - DNA, 20 bp, Artificial
  CRISPR gRNA sequence
acacgtaaaattaaccatca

SEQ ID NO: 401950 - DNA, 20 bp, Artificial
  CRISPR gRNA sequence
accatcatacctgttttgga

SEQ ID NO: 401951 - DNA, 20 bp, Artificial
  CRISPR gRNA sequence
ttttggaaaatgatatggca

SEQ ID NO: 401952 - DNA, 20 bp, Artificial
  CRISPR gRNA sequence
tggaaaatgatatggcatta

SEQ ID NO: 401953 - DNA, 20 bp, Artificial
  CRISPR gRNA sequence
ggaaaatgatatggcattag

SEQ ID NO: 401954 - DNA, 20 bp, Artificial
  CRISPR gRNA sequence
gaaaatgatatggcattagc

SEQ ID NO: 401955 - DNA, 20 bp, Artificial
  CRISPR gRNA sequence
gctagttaaaaaccccaaat

SEQ ID NO: 401956 - DNA, 20 bp, Artificial
  CRISPR gRNA sequence
gttaaaaaccccaaatccta

SEQ ID NO: 401957 - DNA, 20 bp, Artificial
  CRISPR gRNA sequence
aaaaccccaaatcctatgat

SEQ ID NO: 401958 - DNA, 20 bp, Artificial
  CRISPR gRNA sequence
tgatccaataattctactct

SEQ ID NO: 401959 - DNA, 20 bp, Artificial
  CRISPR gRNA sequence
tactctgtttggtatccaag

SEQ ID NO: 401960 - DNA, 20 bp, Artificial
  CRISPR gRNA sequence
ctctgtttggtatccaagag

SEQ ID NO: 401961 - DNA, 20 bp, Artificial
  CRISPR gRNA sequence
tgtttggtatccaagagttc

SEQ ID NO: 401962 - DNA, 20 bp, Artificial
  CRISPR gRNA sequence
tttggtatccaagagttctc

SEQ ID NO: 401963 - DNA, 20 bp, Artificial
  CRISPR gRNA sequence
ggtatccaagagttctctca

SEQ ID NO: 401964 - DNA, 20 bp, Artificial
  CRISPR gRNA sequence
gtatccaagagttctctcat

SEQ ID NO: 401965 - DNA, 20 bp, Artificial
  CRISPR gRNA sequence
tctcattatagggaaaattc

SEQ ID NO: 401966 - DNA, 20 bp, Artificial
  CRISPR gRNA sequence
tcattatagggaaaattcct

SEQ ID NO: 401967 - DNA, 20 bp, Artificial
  CRISPR gRNA sequence
attatagggaaaattcctga

SEQ ID NO: 401968 - DNA, 20 bp, Artificial
  CRISPR gRNA sequence
tagggaaaattcctgacaat

SEQ ID NO: 401969 - DNA, 20 bp, Artificial
  CRISPR gRNA sequence
ctgacaatatttatagcaac

SEQ ID NO: 401970 - DNA, 20 bp, Artificial
  CRISPR gRNA sequence
acaatatttatagcaacagt

SEQ ID NO: 401971 - DNA, 20 bp, Artificial
  CRISPR gRNA sequence
atagcaacagtgattgcaat

SEQ ID NO: 401972 - DNA, 20 bp, Artificial
  CRISPR gRNA sequence
tagcaacagtgattgcaata

SEQ ID NO: 401973 - DNA, 20 bp, Artificial
  CRISPR gRNA sequence
caatagcaaaaaattggtaa

SEQ ID NO: 401974 - DNA, 20 bp, Artificial
  CRISPR gRNA sequence
gtaacaacccaaatacccat

SEQ ID NO: 401975 - DNA, 20 bp, Artificial
  CRISPR gRNA sequence
aggtctattcacacattagg

SEQ ID NO: 401976 - DNA, 20 bp, Artificial
  CRISPR gRNA sequence
ttcacacattaggatactct

SEQ ID NO: 401977 - DNA, 20 bp, Artificial
  CRISPR gRNA sequence
acacattaggatactctaca

SEQ ID NO: 401978 - DNA, 20 bp, Artificial
  CRISPR gRNA sequence
ggatactctacatcactaaa

SEQ ID NO: 401979 - DNA, 20 bp, Artificial
  CRISPR gRNA sequence
tacatcactaaaatgagtga

SEQ ID NO: 401980 - DNA, 20 bp, Artificial
  CRISPR gRNA sequence
catcactaaaatgagtgaat

SEQ ID NO: 401981 - DNA, 20 bp, Artificial
  CRISPR gRNA sequence
aaatgagtgaattatcactt

SEQ ID NO: 401982 - DNA, 20 bp, Artificial
  CRISPR gRNA sequence
tcacttgctcaccgacatgg

SEQ ID NO: 401983 - DNA, 20 bp, Artificial
  CRISPR gRNA sequence
gctcaccgacatggatgaag

SEQ ID NO: 401984 - DNA, 20 bp, Artificial
  CRISPR gRNA sequence
ctcaccgacatggatgaagc

SEQ ID NO: 401985 - DNA, 20 bp, Artificial
  CRISPR gRNA sequence
accgacatggatgaagctca

SEQ ID NO: 401986 - DNA, 20 bp, Artificial
  CRISPR gRNA sequence
atgaactttgtgttgaaaga

SEQ ID NO: 401987 - DNA, 20 bp, Artificial
  CRISPR gRNA sequence
tgtgttgaaagaaaagagca

SEQ ID NO: 401988 - DNA, 20 bp, Artificial
  CRISPR gRNA sequence
gtgttgaaagaaaagagcaa

SEQ ID NO: 401989 - DNA, 20 bp, Artificial
  CRISPR gRNA sequence
tgttgaaagaaaagagcaag

SEQ ID NO: 401990 - DNA, 20 bp, Artificial
  CRISPR gRNA sequence
aaagaaaagagcaagttacc

SEQ ID NO: 401991 - DNA, 20 bp, Artificial
  CRISPR gRNA sequence
ccaaaaaaaataggtaaact

SEQ ID NO: 401992 - DNA, 20 bp, Artificial
  CRISPR gRNA sequence
gggttccttttctttaaagg

SEQ ID NO: 401993 - DNA, 20 bp, Artificial
  CRISPR gRNA sequence
cttttctttaaaggttttag

SEQ ID NO: 401994 - DNA, 20 bp, Artificial
  CRISPR gRNA sequence
ttctttaaaggttttagaaa

SEQ ID NO: 401995 - DNA, 20 bp, Artificial
  CRISPR gRNA sequence
tctttaaaggttttagaaat

SEQ ID NO: 401996 - DNA, 20 bp, Artificial
  CRISPR gRNA sequence
ctttaaaggttttagaaata

SEQ ID NO: 401997 - DNA, 20 bp, Artificial
  CRISPR gRNA sequence
tttaaaggttttagaaatat

SEQ ID NO: 401998 - DNA, 20 bp, Artificial
  CRISPR gRNA sequence
taaaggttttagaaatatgc

SEQ ID NO: 401999 - DNA, 20 bp, Artificial
  CRISPR gRNA sequence
aaaggttttagaaatatgca

SEQ ID NO: 402000 - DNA, 20 bp, Artificial
  CRISPR gRNA sequence
aaggttttagaaatatgcat

SEQ ID NO: 402001 - DNA, 20 bp, Artificial
  CRISPR gRNA sequence
tagaaatatgcataattaaa

SEQ ID NO: 402002 - DNA, 20 bp, Artificial
  CRISPR gRNA sequence
agaaatatgcataattaaac

SEQ ID NO: 402003 - DNA, 20 bp, Artificial
  CRISPR gRNA sequence
gaaatatgcataattaaaca

SEQ ID NO: 402004 - DNA, 20 bp, Artificial
  CRISPR gRNA sequence
aacaatacgttatttataga

SEQ ID NO: 402005 - DNA, 20 bp, Artificial
  CRISPR gRNA sequence
tttatagatacaaacgtggt

SEQ ID NO: 402006 - DNA, 20 bp, Artificial
  CRISPR gRNA sequence
atagatacaaacgtggtaaa

SEQ ID NO: 402007 - DNA, 20 bp, Artificial
  CRISPR gRNA sequence
tagatacaaacgtggtaaaa

SEQ ID NO: 402008 - DNA, 20 bp, Artificial
  CRISPR gRNA sequence
taaagaaaagcaaagttcag

SEQ ID NO: 402009 - DNA, 20 bp, Artificial
  CRISPR gRNA sequence
agaaacatggtaggtggggg

SEQ ID NO: 402010 - DNA, 20 bp, Artificial
  CRISPR gRNA sequence
aaagggtctttaaggctcat

SEQ ID NO: 402011 - DNA, 20 bp, Artificial
  CRISPR gRNA sequence
taaggctcatagtcagggtg

SEQ ID NO: 402012 - DNA, 20 bp, Artificial
  CRISPR gRNA sequence
aaggctcatagtcagggtgt

SEQ ID NO: 402013 - DNA, 20 bp, Artificial
  CRISPR gRNA sequence
aggctcatagtcagggtgtt

SEQ ID NO: 402014 - DNA, 20 bp, Artificial
  CRISPR gRNA sequence
atagtcagggtgttttcctt

SEQ ID NO: 402015 - DNA, 20 bp, Artificial
  CRISPR gRNA sequence
tccttatacaggtgttttat

SEQ ID NO: 402016 - DNA, 20 bp, Artificial
  CRISPR gRNA sequence
ccttatacaggtgttttatt

SEQ ID NO: 402017 - DNA, 20 bp, Artificial
  CRISPR gRNA sequence
cttatacaggtgttttattt

SEQ ID NO: 402018 - DNA, 20 bp, Artificial
  CRISPR gRNA sequence
atacaggtgttttattttgc

SEQ ID NO: 402019 - DNA, 20 bp, Artificial
  CRISPR gRNA sequence
tacaggtgttttattttgca

SEQ ID NO: 402020 - DNA, 20 bp, Artificial
  CRISPR gRNA sequence
tattttgcatttgtctcaaa

SEQ ID NO: 402021 - DNA, 20 bp, Artificial
  CRISPR gRNA sequence
attttgcatttgtctcaaaa

SEQ ID NO: 402022 - DNA, 20 bp, Artificial
  CRISPR gRNA sequence
ttttgcatttgtctcaaaat

SEQ ID NO: 402023 - DNA, 20 bp, Artificial
  CRISPR gRNA sequence
tgcatttgtctcaaaatgtt

SEQ ID NO: 402024 - DNA, 20 bp, Artificial
  CRISPR gRNA sequence
gcatttgtctcaaaatgttt

SEQ ID NO: 402025 - DNA, 20 bp, Artificial
  CRISPR gRNA sequence
catttgtctcaaaatgtttt

SEQ ID NO: 402026 - DNA, 20 bp, Artificial
  CRISPR gRNA sequence
gtctcaaaatgttttagaag

SEQ ID NO: 402027 - DNA, 20 bp, Artificial
  CRISPR gRNA sequence
tctcaaaatgttttagaaga

SEQ ID NO: 402028 - DNA, 20 bp, Artificial
  CRISPR gRNA sequence
aaaatgttttagaagatttc

SEQ ID NO: 402029 - DNA, 20 bp, Artificial
  CRISPR gRNA sequence
tagaagatttctttcaaatc

SEQ ID NO: 402030 - DNA, 20 bp, Artificial
  CRISPR gRNA sequence
agaagatttctttcaaatct

SEQ ID NO: 402031 - DNA, 20 bp, Artificial
  CRISPR gRNA sequence
gaagatttctttcaaatcta

SEQ ID NO: 402032 - DNA, 20 bp, Artificial
  CRISPR gRNA sequence
ctttcaaatctactgatttc

SEQ ID NO: 402033 - DNA, 20 bp, Artificial
  CRISPR gRNA sequence
tttcaaatctactgatttct

SEQ ID NO: 402034 - DNA, 20 bp, Artificial
  CRISPR gRNA sequence
tcaaatctactgatttcttt

SEQ ID NO: 402035 - DNA, 20 bp, Artificial
  CRISPR gRNA sequence
caaatctactgatttctttt

SEQ ID NO: 402036 - DNA, 20 bp, Artificial
  CRISPR gRNA sequence
aaatctactgatttcttttt

SEQ ID NO: 402037 - DNA, 20 bp, Artificial
  CRISPR gRNA sequence
ctgatttctttttcttttcc

SEQ ID NO: 402038 - DNA, 20 bp, Artificial
  CRISPR gRNA sequence
atttctttttcttttccttt

SEQ ID NO: 402039 - DNA, 20 bp, Artificial
  CRISPR gRNA sequence
ctttttcttttccttttttg

SEQ ID NO: 402040 - DNA, 20 bp, Artificial
  CRISPR gRNA sequence
tttttcttttccttttttga

SEQ ID NO: 402041 - DNA, 20 bp, Artificial
  CRISPR gRNA sequence
tttcttttccttttttgaga

SEQ ID NO: 402042 - DNA, 20 bp, Artificial
  CRISPR gRNA sequence
ttcttttccttttttgagac

SEQ ID NO: 402043 - DNA, 20 bp, Artificial
  CRISPR gRNA sequence
tcttttccttttttgagaca

SEQ ID NO: 402044 - DNA, 20 bp, Artificial
  CRISPR gRNA sequence
cttttccttttttgagacag

SEQ ID NO: 402045 - DNA, 20 bp, Artificial
  CRISPR gRNA sequence
ttttccttttttgagacaga

SEQ ID NO: 402046 - DNA, 20 bp, Artificial
  CRISPR gRNA sequence
ttccttttttgagacagagt

SEQ ID NO: 402047 - DNA, 20 bp, Artificial
  CRISPR gRNA sequence
tccttttttgagacagagtc

SEQ ID NO: 402048 - DNA, 20 bp, Artificial
  CRISPR gRNA sequence
ccttttttgagacagagtct

SEQ ID NO: 402049 - DNA, 20 bp, Artificial
  CRISPR gRNA sequence
cttttttgagacagagtctc

SEQ ID NO: 402050 - DNA, 20 bp, Artificial
  CRISPR gRNA sequence
ttttgagacagagtctcact

SEQ ID NO: 402051 - DNA, 20 bp, Artificial
  CRISPR gRNA sequence
tttgagacagagtctcactc

SEQ ID NO: 402052 - DNA, 20 bp, Artificial
  CRISPR gRNA sequence
ttgagacagagtctcactct

SEQ ID NO: 402053 - DNA, 20 bp, Artificial
  CRISPR gRNA sequence
tgagacagagtctcactctg

SEQ ID NO: 402054 - DNA, 20 bp, Artificial
  CRISPR gRNA sequence
gagacagagtctcactctgt

SEQ ID NO: 402055 - DNA, 20 bp, Artificial
  CRISPR gRNA sequence
agacagagtctcactctgtt

SEQ ID NO: 402056 - DNA, 20 bp, Artificial
  CRISPR gRNA sequence
actctgttgcccaggctgga

SEQ ID NO: 402057 - DNA, 20 bp, Artificial
  CRISPR gRNA sequence
tgttgcccaggctggagtgc

SEQ ID NO: 402058 - DNA, 20 bp, Artificial
  CRISPR gRNA sequence
ttgcccaggctggagtgcag

SEQ ID NO: 402059 - DNA, 20 bp, Artificial
  CRISPR gRNA sequence
cccaggctggagtgcagtgg

SEQ ID NO: 402060 - DNA, 20 bp, Artificial
  CRISPR gRNA sequence
gagtgcagtggcatgatctc

SEQ ID NO: 402061 - DNA, 20 bp, Artificial
  CRISPR gRNA sequence
agctcattgcaacctctgcc

SEQ ID NO: 402062 - DNA, 20 bp, Artificial
  CRISPR gRNA sequence
attgcaacctctgcctcctg

SEQ ID NO: 402063 - DNA, 20 bp, Artificial
  CRISPR gRNA sequence
caacctctgcctcctgggtt

SEQ ID NO: 402064 - DNA, 20 bp, Artificial
  CRISPR gRNA sequence
tgcctcctgggttcaagtgg

SEQ ID NO: 402065 - DNA, 20 bp, Artificial
  CRISPR gRNA sequence
cctcctgggttcaagtggtt

SEQ ID NO: 402066 - DNA, 20 bp, Artificial
  CRISPR gRNA sequence
ctgggttcaagtggttctcc

SEQ ID NO: 402067 - DNA, 20 bp, Artificial
  CRISPR gRNA sequence
ggttcaagtggttctcctgc

SEQ ID NO: 402068 - DNA, 20 bp, Artificial
  CRISPR gRNA sequence
aagtggttctcctgcctcag

SEQ ID NO: 402069 - DNA, 20 bp, Artificial
  CRISPR gRNA sequence
tcctgcctcagcctcctgag

SEQ ID NO: 402070 - DNA, 20 bp, Artificial
  CRISPR gRNA sequence
ctgcctcagcctcctgagta

SEQ ID NO: 402071 - DNA, 20 bp, Artificial
  CRISPR gRNA sequence
cctcagcctcctgagtagct

SEQ ID NO: 402072 - DNA, 20 bp, Artificial
  CRISPR gRNA sequence
agcctcctgagtagctggga

SEQ ID NO: 402073 - DNA, 20 bp, Artificial
  CRISPR gRNA sequence
ctgagtagctgggattacag

SEQ ID NO: 402074 - DNA, 20 bp, Artificial
  CRISPR gRNA sequence
agtagctgggattacaggcc

SEQ ID NO: 402075 - DNA, 20 bp, Artificial
  CRISPR gRNA sequence
ggattacaggcctgcatcat

SEQ ID NO: 402076 - DNA, 20 bp, Artificial
  CRISPR gRNA sequence
caggcctgcatcatcacacc

SEQ ID NO: 402077 - DNA, 20 bp, Artificial
  CRISPR gRNA sequence
catcatcacacccagctaat

SEQ ID NO: 402078 - DNA, 20 bp, Artificial
  CRISPR gRNA sequence
atttttgtatttttgtagag

SEQ ID NO: 402079 - DNA, 20 bp, Artificial
  CRISPR gRNA sequence
ttgtatttttgtagagatgg

SEQ ID NO: 402080 - DNA, 20 bp, Artificial
  CRISPR gRNA sequence
tgtatttttgtagagatggg

SEQ ID NO: 402081 - DNA, 20 bp, Artificial
  CRISPR gRNA sequence
gtatttttgtagagatgggg

SEQ ID NO: 402082 - DNA, 20 bp, Artificial
  CRISPR gRNA sequence
tatttttgtagagatggggg

SEQ ID NO: 402083 - DNA, 20 bp, Artificial
  CRISPR gRNA sequence
ttgtagagatgggggttttg

SEQ ID NO: 402084 - DNA, 20 bp, Artificial
  CRISPR gRNA sequence
tgtagagatgggggttttgc

SEQ ID NO: 402085 - DNA, 20 bp, Artificial
  CRISPR gRNA sequence
gtagagatgggggttttgcc

SEQ ID NO: 402086 - DNA, 20 bp, Artificial
  CRISPR gRNA sequence
tagagatgggggttttgcca

SEQ ID NO: 402087 - DNA, 20 bp, Artificial
  CRISPR gRNA sequence
tgccatgttggccaggctga

SEQ ID NO: 402088 - DNA, 20 bp, Artificial
  CRISPR gRNA sequence
gccatgttggccaggctgat

SEQ ID NO: 402089 - DNA, 20 bp, Artificial
  CRISPR gRNA sequence
ccatgttggccaggctgatc

SEQ ID NO: 402090 - DNA, 20 bp, Artificial
  CRISPR gRNA sequence
gccaggctgatctcaaactc

SEQ ID NO: 402091 - DNA, 20 bp, Artificial
  CRISPR gRNA sequence
atctcaaactcctgacctca

SEQ ID NO: 402092 - DNA, 20 bp, Artificial
  CRISPR gRNA sequence
aaactcctgacctcaggtga

SEQ ID NO: 402093 - DNA, 20 bp, Artificial
  CRISPR gRNA sequence
ctgacctcaggtgatccacc

SEQ ID NO: 402094 - DNA, 20 bp, Artificial
  CRISPR gRNA sequence
acctcaggtgatccacccca

SEQ ID NO: 402095 - DNA, 20 bp, Artificial
  CRISPR gRNA sequence
aggtgatccaccccaccttg

SEQ ID NO: 402096 - DNA, 20 bp, Artificial
  CRISPR gRNA sequence
ggcctcccaaagtgctggaa

SEQ ID NO: 402097 - DNA, 20 bp, Artificial
  CRISPR gRNA sequence
gcctcccaaagtgctggaat

SEQ ID NO: 402098 - DNA, 20 bp, Artificial
  CRISPR gRNA sequence
ccaaagtgctggaattacag

SEQ ID NO: 402099 - DNA, 20 bp, Artificial
  CRISPR gRNA sequence
gaattacaggcataggccac

SEQ ID NO: 402100 - DNA, 20 bp, Artificial
  CRISPR gRNA sequence
caggcataggccaccttgcc

SEQ ID NO: 402101 - DNA, 20 bp, Artificial
  CRISPR gRNA sequence
gcctggccaaatctactgat

SEQ ID NO: 402102 - DNA, 20 bp, Artificial
  CRISPR gRNA sequence
cctggccaaatctactgatt

SEQ ID NO: 402103 - DNA, 20 bp, Artificial
  CRISPR gRNA sequence
gccaaatctactgatttcta

SEQ ID NO: 402104 - DNA, 20 bp, Artificial
  CRISPR gRNA sequence
ctgatttctaatggtgaaaa

SEQ ID NO: 402105 - DNA, 20 bp, Artificial
  CRISPR gRNA sequence
atttctaatggtgaaaagag

SEQ ID NO: 402106 - DNA, 20 bp, Artificial
  CRISPR gRNA sequence
ctaatggtgaaaagagatgt

SEQ ID NO: 402107 - DNA, 20 bp, Artificial
  CRISPR gRNA sequence
taatggtgaaaagagatgtg

SEQ ID NO: 402108 - DNA, 20 bp, Artificial
  CRISPR gRNA sequence
atggtgaaaagagatgtgat

SEQ ID NO: 402109 - DNA, 20 bp, Artificial
  CRISPR gRNA sequence
caatttttgagcagttgaaa

SEQ ID NO: 402110 - DNA, 20 bp, Artificial
  CRISPR gRNA sequence
ttgagcagttgaaagctcta

SEQ ID NO: 402111 - DNA, 20 bp, Artificial
  CRISPR gRNA sequence
tgagcagttgaaagctctaa

SEQ ID NO: 402112 - DNA, 20 bp, Artificial
  CRISPR gRNA sequence
gagcagttgaaagctctaag

SEQ ID NO: 402113 - DNA, 20 bp, Artificial
  CRISPR gRNA sequence
agcagttgaaagctctaagg

SEQ ID NO: 402114 - DNA, 20 bp, Artificial
  CRISPR gRNA sequence
aaagctctaaggtaaggatg

SEQ ID NO: 402115 - DNA, 20 bp, Artificial
  CRISPR gRNA sequence
taaggtaaggatgaaatctt

SEQ ID NO: 402116 - DNA, 20 bp, Artificial
  CRISPR gRNA sequence
aggtaaggatgaaatcttca

SEQ ID NO: 402117 - DNA, 20 bp, Artificial
  CRISPR gRNA sequence
cattctgatatggcctgggg

SEQ ID NO: 402118 - DNA, 20 bp, Artificial
  CRISPR gRNA sequence
attctgatatggcctggggg

SEQ ID NO: 402119 - DNA, 20 bp, Artificial
  CRISPR gRNA sequence
tgatatggcctgggggccag

SEQ ID NO: 402120 - DNA, 20 bp, Artificial
  CRISPR gRNA sequence
atatggcctgggggccaggt

SEQ ID NO: 402121 - DNA, 20 bp, Artificial
  CRISPR gRNA sequence
ggggccaggtagaggtaagt

SEQ ID NO: 402122 - DNA, 20 bp, Artificial
  CRISPR gRNA sequence
cagcaatggtttcaaatttt

SEQ ID NO: 402123 - DNA, 20 bp, Artificial
  CRISPR gRNA sequence
agcaatggtttcaaattttt

SEQ ID NO: 402124 - DNA, 20 bp, Artificial
  CRISPR gRNA sequence
caaatttttatgatccaagg

SEQ ID NO: 402125 - DNA, 20 bp, Artificial
  CRISPR gRNA sequence
aaatttttatgatccaagga

SEQ ID NO: 402126 - DNA, 20 bp, Artificial
  CRISPR gRNA sequence
ttatgatccaaggactaaaa

SEQ ID NO: 402127 - DNA, 20 bp, Artificial
  CRISPR gRNA sequence
tatgatccaaggactaaaaa

SEQ ID NO: 402128 - DNA, 20 bp, Artificial
  CRISPR gRNA sequence
atgatccaaggactaaaaaa

SEQ ID NO: 402129 - DNA, 20 bp, Artificial
  CRISPR gRNA sequence
tgatccaaggactaaaaaat

SEQ ID NO: 402130 - DNA, 20 bp, Artificial
  CRISPR gRNA sequence
aaaaatgatgattttagtga

SEQ ID NO: 402131 - DNA, 20 bp, Artificial
  CRISPR gRNA sequence
tagtgaaaaagatgtgaaat

SEQ ID NO: 402132 - DNA, 20 bp, Artificial
  CRISPR gRNA sequence
agtgaaaaagatgtgaaatt

SEQ ID NO: 402133 - DNA, 20 bp, Artificial
  CRISPR gRNA sequence
gtgaaaaagatgtgaaatta

SEQ ID NO: 402134 - DNA, 20 bp, Artificial
  CRISPR gRNA sequence
agagaccaacttggctagca

SEQ ID NO: 402135 - DNA, 20 bp, Artificial
  CRISPR gRNA sequence
ggctagcaagagtggaatta

SEQ ID NO: 402136 - DNA, 20 bp, Artificial
  CRISPR gRNA sequence
gctagcaagagtggaattaa

SEQ ID NO: 402137 - DNA, 20 bp, Artificial
  CRISPR gRNA sequence
gcaagagtggaattaagtct

SEQ ID NO: 402138 - DNA, 20 bp, Artificial
  CRISPR gRNA sequence
agtctgtttcaggtgtatta

SEQ ID NO: 402139 - DNA, 20 bp, Artificial
  CRISPR gRNA sequence
tttcaggtgtattaaattgt

SEQ ID NO: 402140 - DNA, 20 bp, Artificial
  CRISPR gRNA sequence
caggtgtattaaattgtaaa

SEQ ID NO: 402141 - DNA, 20 bp, Artificial
  CRISPR gRNA sequence
aggtgtattaaattgtaaag

SEQ ID NO: 402142 - DNA, 20 bp, Artificial
  CRISPR gRNA sequence
aattgtaaagtagcctttga

SEQ ID NO: 402143 - DNA, 20 bp, Artificial
  CRISPR gRNA sequence
taaagtagcctttgaccagc

SEQ ID NO: 402144 - DNA, 20 bp, Artificial
  CRISPR gRNA sequence
tgaccagctgacaattgaaa

SEQ ID NO: 402145 - DNA, 20 bp, Artificial
  CRISPR gRNA sequence
gaccagctgacaattgaaat

SEQ ID NO: 402146 - DNA, 20 bp, Artificial
  CRISPR gRNA sequence
accagctgacaattgaaatt

SEQ ID NO: 402147 - DNA, 20 bp, Artificial
  CRISPR gRNA sequence
acaattgaaattatggaaca

SEQ ID NO: 402148 - DNA, 20 bp, Artificial
  CRISPR gRNA sequence
aaattatggaacaacaaacc

SEQ ID NO: 402149 - DNA, 20 bp, Artificial
  CRISPR gRNA sequence
tggaacaacaaaccaggatt

SEQ ID NO: 402150 - DNA, 20 bp, Artificial
  CRISPR gRNA sequence
aaaatatccaatttgaagtc

SEQ ID NO: 402151 - DNA, 20 bp, Artificial
  CRISPR gRNA sequence
gaagtcatctgaatgatcat

SEQ ID NO: 402152 - DNA, 20 bp, Artificial
  CRISPR gRNA sequence
aagtcatctgaatgatcatc

SEQ ID NO: 402153 - DNA, 20 bp, Artificial
  CRISPR gRNA sequence
aatgatcatccagcacatgt

SEQ ID NO: 402154 - DNA, 20 bp, Artificial
  CRISPR gRNA sequence
actaagaaagtaccaatgga

SEQ ID NO: 402155 - DNA, 20 bp, Artificial
  CRISPR gRNA sequence
agaaagtaccaatggatggg

SEQ ID NO: 402156 - DNA, 20 bp, Artificial
  CRISPR gRNA sequence
aggtcatagcttgtggcttg

SEQ ID NO: 402157 - DNA, 20 bp, Artificial
  CRISPR gRNA sequence
gtggcttggaggatggtcac

SEQ ID NO: 402158 - DNA, 20 bp, Artificial
  CRISPR gRNA sequence
tggcttggaggatggtcaca

SEQ ID NO: 402159 - DNA, 20 bp, Artificial
  CRISPR gRNA sequence
ggaggatggtcacattgtag

SEQ ID NO: 402160 - DNA, 20 bp, Artificial
  CRISPR gRNA sequence
gaggatggtcacattgtagt

SEQ ID NO: 402161 - DNA, 20 bp, Artificial
  CRISPR gRNA sequence
tagtgtgttaaagaaggtgt

SEQ ID NO: 402162 - DNA, 20 bp, Artificial
  CRISPR gRNA sequence
aagaaggtgttcatgttaaa

SEQ ID NO: 402163 - DNA, 20 bp, Artificial
  CRISPR gRNA sequence
atgttaaagaatgtagaggg

SEQ ID NO: 402164 - DNA, 20 bp, Artificial
  CRISPR gRNA sequence
aagaatgtagagggcataga

SEQ ID NO: 402165 - DNA, 20 bp, Artificial
  CRISPR gRNA sequence
ggagggagaggaaagtgaac

SEQ ID NO: 402166 - DNA, 20 bp, Artificial
  CRISPR gRNA sequence
ttgatgtgagagcagaagac

SEQ ID NO: 402167 - DNA, 20 bp, Artificial
  CRISPR gRNA sequence
atgtgagagcagaagacaca

SEQ ID NO: 402168 - DNA, 20 bp, Artificial
  CRISPR gRNA sequence
atatttatagtagagggtta

SEQ ID NO: 402169 - DNA, 20 bp, Artificial
  CRISPR gRNA sequence
atagtagagggttagatttt

SEQ ID NO: 402170 - DNA, 20 bp, Artificial
  CRISPR gRNA sequence
tagtagagggttagattttc

SEQ ID NO: 402171 - DNA, 20 bp, Artificial
  CRISPR gRNA sequence
gattttcttgctccacacat

SEQ ID NO: 402172 - DNA, 20 bp, Artificial
  CRISPR gRNA sequence
tcttgctccacacatgcagg

SEQ ID NO: 402173 - DNA, 20 bp, Artificial
  CRISPR gRNA sequence
cttgctccacacatgcaggt

SEQ ID NO: 402174 - DNA, 20 bp, Artificial
  CRISPR gRNA sequence
ttgctccacacatgcaggta

SEQ ID NO: 402175 - DNA, 20 bp, Artificial
  CRISPR gRNA sequence
gctccacacatgcaggtact

SEQ ID NO: 402176 - DNA, 20 bp, Artificial
  CRISPR gRNA sequence
ctccacacatgcaggtactt

SEQ ID NO: 402177 - DNA, 20 bp, Artificial
  CRISPR gRNA sequence
cacacatgcaggtactttgt

SEQ ID NO: 402178 - DNA, 20 bp, Artificial
  CRISPR gRNA sequence
tgtgttggctgtattgtatg

SEQ ID NO: 402179 - DNA, 20 bp, Artificial
  CRISPR gRNA sequence
gtgttggctgtattgtatgt

SEQ ID NO: 402180 - DNA, 20 bp, Artificial
  CRISPR gRNA sequence
tgttggctgtattgtatgtt

SEQ ID NO: 402181 - DNA, 20 bp, Artificial
  CRISPR gRNA sequence
gctgtattgtatgtttgctg

SEQ ID NO: 402182 - DNA, 20 bp, Artificial
  CRISPR gRNA sequence
tattgtatgtttgctgactc

SEQ ID NO: 402183 - DNA, 20 bp, Artificial
  CRISPR gRNA sequence
tatgtttgctgactctgtga

SEQ ID NO: 402184 - DNA, 20 bp, Artificial
  CRISPR gRNA sequence
gctgactctgtgatctccca

SEQ ID NO: 402185 - DNA, 20 bp, Artificial
  CRISPR gRNA sequence
ctgactctgtgatctcccat

SEQ ID NO: 402186 - DNA, 20 bp, Artificial
  CRISPR gRNA sequence
actctgtgatctcccatatt

SEQ ID NO: 402187 - DNA, 20 bp, Artificial
  CRISPR gRNA sequence
tgtgatctcccatattccag

SEQ ID NO: 402188 - DNA, 20 bp, Artificial
  CRISPR gRNA sequence
tgatctcccatattccagtc

SEQ ID NO: 402189 - DNA, 20 bp, Artificial
  CRISPR gRNA sequence
ccatattccagtccatttat

SEQ ID NO: 402190 - DNA, 20 bp, Artificial
  CRISPR gRNA sequence
cagtccatttatctcaaact

SEQ ID NO: 402191 - DNA, 20 bp, Artificial
  CRISPR gRNA sequence
atctcaaactgggcacagag

SEQ ID NO: 402192 - DNA, 20 bp, Artificial
  CRISPR gRNA sequence
tctcaaactgggcacagaga

SEQ ID NO: 402193 - DNA, 20 bp, Artificial
  CRISPR gRNA sequence
aaactgggcacagagatgtt

SEQ ID NO: 402194 - DNA, 20 bp, Artificial
  CRISPR gRNA sequence
ggcacagagatgttcctcac

SEQ ID NO: 402195 - DNA, 20 bp, Artificial
  CRISPR gRNA sequence
ctcactgtttccctttaaga

SEQ ID NO: 402196 - DNA, 20 bp, Artificial
  CRISPR gRNA sequence
actgtttccctttaagagtc

SEQ ID NO: 402197 - DNA, 20 bp, Artificial
  CRISPR gRNA sequence
tttccctttaagagtctcat

SEQ ID NO: 402198 - DNA, 20 bp, Artificial
  CRISPR gRNA sequence
ccctttaagagtctcattct

SEQ ID NO: 402199 - DNA, 20 bp, Artificial
  CRISPR gRNA sequence
cctttaagagtctcattctc

SEQ ID NO: 402200 - DNA, 20 bp, Artificial
  CRISPR gRNA sequence
taagagtctcattctctccc

SEQ ID NO: 402201 - DNA, 20 bp, Artificial
  CRISPR gRNA sequence
aagagtctcattctctccca

SEQ ID NO: 402202 - DNA, 20 bp, Artificial
  CRISPR gRNA sequence
agagtctcattctctcccag

SEQ ID NO: 402203 - DNA, 20 bp, Artificial
  CRISPR gRNA sequence
attctctcccaggtgggatg

SEQ ID NO: 402204 - DNA, 20 bp, Artificial
  CRISPR gRNA sequence
tctcccaggtgggatgaggc

SEQ ID NO: 402205 - DNA, 20 bp, Artificial
  CRISPR gRNA sequence
tcccaggtgggatgaggctc

SEQ ID NO: 402206 - DNA, 20 bp, Artificial
  CRISPR gRNA sequence
ccaggtgggatgaggctcct

SEQ ID NO: 402207 - DNA, 20 bp, Artificial
  CRISPR gRNA sequence
cttatatgccatccatgctc

SEQ ID NO: 402208 - DNA, 20 bp, Artificial
  CRISPR gRNA sequence
atatgccatccatgctcatt

SEQ ID NO: 402209 - DNA, 20 bp, Artificial
  CRISPR gRNA sequence
tatgccatccatgctcattc

SEQ ID NO: 402210 - DNA, 20 bp, Artificial
  CRISPR gRNA sequence
attcttagaaggctcttatc

SEQ ID NO: 402211 - DNA, 20 bp, Artificial
  CRISPR gRNA sequence
ttagaaggctcttatctcta

SEQ ID NO: 402212 - DNA, 20 bp, Artificial
  CRISPR gRNA sequence
agaaggctcttatctctaca

SEQ ID NO: 402213 - DNA, 20 bp, Artificial
  CRISPR gRNA sequence
gaaggctcttatctctacac

SEQ ID NO: 402214 - DNA, 20 bp, Artificial
  CRISPR gRNA sequence
ttatctctacacccttcagg

SEQ ID NO: 402215 - DNA, 20 bp, Artificial
  CRISPR gRNA sequence
atctctacacccttcaggga

SEQ ID NO: 402216 - DNA, 20 bp, Artificial
  CRISPR gRNA sequence
tctctacacccttcagggac

SEQ ID NO: 402217 - DNA, 20 bp, Artificial
  CRISPR gRNA sequence
tacacccttcagggacaagt

SEQ ID NO: 402218 - DNA, 20 bp, Artificial
  CRISPR gRNA sequence
cacccttcagggacaagtgt

SEQ ID NO: 402219 - DNA, 20 bp, Artificial
  CRISPR gRNA sequence
cagggacaagtgttctctgt

SEQ ID NO: 402220 - DNA, 20 bp, Artificial
  CRISPR gRNA sequence
agggacaagtgttctctgtc

SEQ ID NO: 402221 - DNA, 20 bp, Artificial
  CRISPR gRNA sequence
tctgtccaggttcccagcag

SEQ ID NO: 402222 - DNA, 20 bp, Artificial
  CRISPR gRNA sequence
tgtccaggttcccagcagct

SEQ ID NO: 402223 - DNA, 20 bp, Artificial
  CRISPR gRNA sequence
tccaggttcccagcagctga

SEQ ID NO: 402224 - DNA, 20 bp, Artificial
  CRISPR gRNA sequence
ccagcagctgacatagcagc

SEQ ID NO: 402225 - DNA, 20 bp, Artificial
  CRISPR gRNA sequence
acatagcagccaaagttttc

SEQ ID NO: 402226 - DNA, 20 bp, Artificial
  CRISPR gRNA sequence
tctttcattcttgtatatat

SEQ ID NO: 402227 - DNA, 20 bp, Artificial
  CRISPR gRNA sequence
ctttcattcttgtatatatc

SEQ ID NO: 402228 - DNA, 20 bp, Artificial
  CRISPR gRNA sequence
tttcattcttgtatatatct

SEQ ID NO: 402229 - DNA, 20 bp, Artificial
  CRISPR gRNA sequence
tcattcttgtatatatctgc

SEQ ID NO: 402230 - DNA, 20 bp, Artificial
  CRISPR gRNA sequence
cattcttgtatatatctgct

SEQ ID NO: 402231 - DNA, 20 bp, Artificial
  CRISPR gRNA sequence
attcttgtatatatctgctg

SEQ ID NO: 402232 - DNA, 20 bp, Artificial
  CRISPR gRNA sequence
ttgtatatatctgctggtta

SEQ ID NO: 402233 - DNA, 20 bp, Artificial
  CRISPR gRNA sequence
gtatatatctgctggttagt

SEQ ID NO: 402234 - DNA, 20 bp, Artificial
  CRISPR gRNA sequence
tatatatctgctggttagtg

SEQ ID NO: 402235 - DNA, 20 bp, Artificial
  CRISPR gRNA sequence
ctggttagtggcactaaaga

SEQ ID NO: 402236 - DNA, 20 bp, Artificial
  CRISPR gRNA sequence
gttagtggcactaaagagat

SEQ ID NO: 402237 - DNA, 20 bp, Artificial
  CRISPR gRNA sequence
gtggcactaaagagattcct

SEQ ID NO: 402238 - DNA, 20 bp, Artificial
  CRISPR gRNA sequence
aagagattcctttaatatta

SEQ ID NO: 402239 - DNA, 20 bp, Artificial
  CRISPR gRNA sequence
ctttaatattaagggctcca

SEQ ID NO: 402240 - DNA, 20 bp, Artificial
  CRISPR gRNA sequence
taatattaagggctccagaa

SEQ ID NO: 402241 - DNA, 20 bp, Artificial
  CRISPR gRNA sequence
aatattaagggctccagaat

SEQ ID NO: 402242 - DNA, 20 bp, Artificial
  CRISPR gRNA sequence
atattaagggctccagaatt

SEQ ID NO: 402243 - DNA, 20 bp, Artificial
  CRISPR gRNA sequence
agggctccagaattgatggc

SEQ ID NO: 402244 - DNA, 20 bp, Artificial
  CRISPR gRNA sequence
cagaattgatggcagttctg

SEQ ID NO: 402245 - DNA, 20 bp, Artificial
  CRISPR gRNA sequence
atggcagttctgaggaatcc

SEQ ID NO: 402246 - DNA, 20 bp, Artificial
  CRISPR gRNA sequence
tgaggaatcctatgatgaaa

SEQ ID NO: 402247 - DNA, 20 bp, Artificial
  CRISPR gRNA sequence
aggaatcctatgatgaaagg

SEQ ID NO: 402248 - DNA, 20 bp, Artificial
  CRISPR gRNA sequence
tgatgaaagggattctaaag

SEQ ID NO: 402249 - DNA, 20 bp, Artificial
  CRISPR gRNA sequence
taaagatcatgctggcctat

SEQ ID NO: 402250 - DNA, 20 bp, Artificial
  CRISPR gRNA sequence
aagatcatgctggcctatat

SEQ ID NO: 402251 - DNA, 20 bp, Artificial
  CRISPR gRNA sequence
gcctatatattagttgaggg

SEQ ID NO: 402252 - DNA, 20 bp, Artificial
  CRISPR gRNA sequence
tatattagttgagggcagca

SEQ ID NO: 402253 - DNA, 20 bp, Artificial
  CRISPR gRNA sequence
gttgagggcagcatggccaa

SEQ ID NO: 402254 - DNA, 20 bp, Artificial
  CRISPR gRNA sequence
agggcagcatggccaacatt

SEQ ID NO: 402255 - DNA, 20 bp, Artificial
  CRISPR gRNA sequence
ttctaatgctggggtataat

SEQ ID NO: 402256 - DNA, 20 bp, Artificial
  CRISPR gRNA sequence
tctaatgctggggtataatc

SEQ ID NO: 402257 - DNA, 20 bp, Artificial
  CRISPR gRNA sequence
ctaatgctggggtataatct

SEQ ID NO: 402258 - DNA, 20 bp, Artificial
  CRISPR gRNA sequence
taatgctggggtataatctc

SEQ ID NO: 402259 - DNA, 20 bp, Artificial
  CRISPR gRNA sequence
atgctggggtataatctcag

SEQ ID NO: 402260 - DNA, 20 bp, Artificial
  CRISPR gRNA sequence
gggtataatctcagccttta

SEQ ID NO: 402261 - DNA, 20 bp, Artificial
  CRISPR gRNA sequence
agcctttaaatttgatttaa

SEQ ID NO: 402262 - DNA, 20 bp, Artificial
  CRISPR gRNA sequence
taaatttgatttaaagctgg

SEQ ID NO: 402263 - DNA, 20 bp, Artificial
  CRISPR gRNA sequence
aaatttgatttaaagctggg

SEQ ID NO: 402264 - DNA, 20 bp, Artificial
  CRISPR gRNA sequence
aatttgatttaaagctgggg

SEQ ID NO: 402265 - DNA, 20 bp, Artificial
  CRISPR gRNA sequence
gatttaaagctggggagagg

SEQ ID NO: 402266 - DNA, 20 bp, Artificial
  CRISPR gRNA sequence
atttaaagctggggagaggg

SEQ ID NO: 402267 - DNA, 20 bp, Artificial
  CRISPR gRNA sequence
aaagctggggagagggaagt

SEQ ID NO: 402268 - DNA, 20 bp, Artificial
  CRISPR gRNA sequence
aagctggggagagggaagtg

SEQ ID NO: 402269 - DNA, 20 bp, Artificial
  CRISPR gRNA sequence
gggagagggaagtgtctcaa

SEQ ID NO: 402270 - DNA, 20 bp, Artificial
  CRISPR gRNA sequence
aaatctggcttttataaatg

SEQ ID NO: 402271 - DNA, 20 bp, Artificial
  CRISPR gRNA sequence
gcttttataaatgggtgtgc

SEQ ID NO: 402272 - DNA, 20 bp, Artificial
  CRISPR gRNA sequence
ttataaatgggtgtgctgat

SEQ ID NO: 402273 - DNA, 20 bp, Artificial
  CRISPR gRNA sequence
tataaatgggtgtgctgatt

SEQ ID NO: 402274 - DNA, 20 bp, Artificial
  CRISPR gRNA sequence
ataaatgggtgtgctgattt

SEQ ID NO: 402275 - DNA, 20 bp, Artificial
  CRISPR gRNA sequence
taaatgggtgtgctgatttg

SEQ ID NO: 402276 - DNA, 20 bp, Artificial
  CRISPR gRNA sequence
atttgcaggagctgaaccca

SEQ ID NO: 402277 - DNA, 20 bp, Artificial
  CRISPR gRNA sequence
gcaggagctgaacccactta

SEQ ID NO: 402278 - DNA, 20 bp, Artificial
  CRISPR gRNA sequence
caggagctgaacccacttat

SEQ ID NO: 402279 - DNA, 20 bp, Artificial
  CRISPR gRNA sequence
aacccacttatccattaatt

SEQ ID NO: 402280 - DNA, 20 bp, Artificial
  CRISPR gRNA sequence
atccattaattcactcatca

SEQ ID NO: 402281 - DNA, 20 bp, Artificial
  CRISPR gRNA sequence
tccattaattcactcatcaa

SEQ ID NO: 402282 - DNA, 20 bp, Artificial
  CRISPR gRNA sequence
attcactcatcaagtctttc

SEQ ID NO: 402283 - DNA, 20 bp, Artificial
  CRISPR gRNA sequence
actcatcaagtctttcctga

SEQ ID NO: 402284 - DNA, 20 bp, Artificial
  CRISPR gRNA sequence
atcaagtctttcctgagaat

SEQ ID NO: 402285 - DNA, 20 bp, Artificial
  CRISPR gRNA sequence
tcctgagaatctacaatgta

SEQ ID NO: 402286 - DNA, 20 bp, Artificial
  CRISPR gRNA sequence
cctgagaatctacaatgtac

SEQ ID NO: 402287 - DNA, 20 bp, Artificial
  CRISPR gRNA sequence
ctgagaatctacaatgtaca

SEQ ID NO: 402288 - DNA, 20 bp, Artificial
  CRISPR gRNA sequence
agaatctacaatgtacaatg

SEQ ID NO: 402289 - DNA, 20 bp, Artificial
  CRISPR gRNA sequence
caatgtacaatgtaatgttc

SEQ ID NO: 402290 - DNA, 20 bp, Artificial
  CRISPR gRNA sequence
agtggtttggaagatagaaa

SEQ ID NO: 402291 - DNA, 20 bp, Artificial
  CRISPR gRNA sequence
ggaagatagaaagacataga

SEQ ID NO: 402292 - DNA, 20 bp, Artificial
  CRISPR gRNA sequence
gaagatagaaagacatagat

SEQ ID NO: 402293 - DNA, 20 bp, Artificial
  CRISPR gRNA sequence
agctctaaataggatgtaga

SEQ ID NO: 402294 - DNA, 20 bp, Artificial
  CRISPR gRNA sequence
gctctaaataggatgtagaa

SEQ ID NO: 402295 - DNA, 20 bp, Artificial
  CRISPR gRNA sequence
taaataggatgtagaatatt

SEQ ID NO: 402296 - DNA, 20 bp, Artificial
  CRISPR gRNA sequence
aataggatgtagaatattgg

SEQ ID NO: 402297 - DNA, 20 bp, Artificial
  CRISPR gRNA sequence
ggagagagaaaagtttatat

SEQ ID NO: 402298 - DNA, 20 bp, Artificial
  CRISPR gRNA sequence
atatcacaaattattatttg

SEQ ID NO: 402299 - DNA, 20 bp, Artificial
  CRISPR gRNA sequence
tatcacaaattattatttga

SEQ ID NO: 402300 - DNA, 20 bp, Artificial
  CRISPR gRNA sequence
ttatttgaggcaaaaaaata

SEQ ID NO: 402301 - DNA, 20 bp, Artificial
  CRISPR gRNA sequence
tttgaggcaaaaaaataagt

SEQ ID NO: 402302 - DNA, 20 bp, Artificial
  CRISPR gRNA sequence
gaggcaaaaaaataagtcgc

SEQ ID NO: 402303 - DNA, 20 bp, Artificial
  CRISPR gRNA sequence
aggcaaaaaaataagtcgca

SEQ ID NO: 402304 - DNA, 20 bp, Artificial
  CRISPR gRNA sequence
tagtctagaggatataattt

SEQ ID NO: 402305 - DNA, 20 bp, Artificial
  CRISPR gRNA sequence
gaggatataattttatttta

SEQ ID NO: 402306 - DNA, 20 bp, Artificial
  CRISPR gRNA sequence
tattttacctaggaaattca

SEQ ID NO: 402307 - DNA, 20 bp, Artificial
  CRISPR gRNA sequence
attttacctaggaaattcag

SEQ ID NO: 402308 - DNA, 20 bp, Artificial
  CRISPR gRNA sequence
ttttacctaggaaattcagg

SEQ ID NO: 402309 - DNA, 20 bp, Artificial
  CRISPR gRNA sequence
tacctaggaaattcagggca

SEQ ID NO: 402310 - DNA, 20 bp, Artificial
  CRISPR gRNA sequence
acctaggaaattcagggcag

SEQ ID NO: 402311 - DNA, 20 bp, Artificial
  CRISPR gRNA sequence
cctaggaaattcagggcaga

SEQ ID NO: 402312 - DNA, 20 bp, Artificial
  CRISPR gRNA sequence
ggaaattcagggcagagtcc

SEQ ID NO: 402313 - DNA, 20 bp, Artificial
  CRISPR gRNA sequence
agggcagagtccctgaaaaa

SEQ ID NO: 402314 - DNA, 20 bp, Artificial
  CRISPR gRNA sequence
aaaaagtggaatttgaactg

SEQ ID NO: 402315 - DNA, 20 bp, Artificial
  CRISPR gRNA sequence
gaactgccaacccagaaaat

SEQ ID NO: 402316 - DNA, 20 bp, Artificial
  CRISPR gRNA sequence
aactgccaacccagaaaatt

SEQ ID NO: 402317 - DNA, 20 bp, Artificial
  CRISPR gRNA sequence
ccaacccagaaaatttggat

SEQ ID NO: 402318 - DNA, 20 bp, Artificial
  CRISPR gRNA sequence
ggatgttgagattaataggc

SEQ ID NO: 402319 - DNA, 20 bp, Artificial
  CRISPR gRNA sequence
gatgttgagattaataggca

SEQ ID NO: 402320 - DNA, 20 bp, Artificial
  CRISPR gRNA sequence
agattaataggcactattcc

SEQ ID NO: 402321 - DNA, 20 bp, Artificial
  CRISPR gRNA sequence
ataggcactattccaggaga

SEQ ID NO: 402322 - DNA, 20 bp, Artificial
  CRISPR gRNA sequence
ttccaggagaattgctttag

SEQ ID NO: 402323 - DNA, 20 bp, Artificial
  CRISPR gRNA sequence
caggagaattgctttagaaa

SEQ ID NO: 402324 - DNA, 20 bp, Artificial
  CRISPR gRNA sequence
ctttagaaaattatctagaa

SEQ ID NO: 402325 - DNA, 20 bp, Artificial
  CRISPR gRNA sequence
tagaaaattatctagaaaat

SEQ ID NO: 402326 - DNA, 20 bp, Artificial
  CRISPR gRNA sequence
agaaaattatctagaaaata

SEQ ID NO: 402327 - DNA, 20 bp, Artificial
  CRISPR gRNA sequence
gaaaattatctagaaaatag

SEQ ID NO: 402328 - DNA, 20 bp, Artificial
  CRISPR gRNA sequence
tctagaaaatagacagctat

SEQ ID NO: 402329 - DNA, 20 bp, Artificial
  CRISPR gRNA sequence
gaaaatagacagctattttc

SEQ ID NO: 402330 - DNA, 20 bp, Artificial
  CRISPR gRNA sequence
ttttctagatagtaggctcc

SEQ ID NO: 402331 - DNA, 20 bp, Artificial
  CRISPR gRNA sequence
tctagatagtaggctccagt

SEQ ID NO: 402332 - DNA, 20 bp, Artificial
  CRISPR gRNA sequence
ctagatagtaggctccagtg

SEQ ID NO: 402333 - DNA, 20 bp, Artificial
  CRISPR gRNA sequence
tagatagtaggctccagtgt

SEQ ID NO: 402334 - DNA, 20 bp, Artificial
  CRISPR gRNA sequence
gatagtaggctccagtgtaa

SEQ ID NO: 402335 - DNA, 20 bp, Artificial
  CRISPR gRNA sequence
cagtgtaacctactttggaa

SEQ ID NO: 402336 - DNA, 20 bp, Artificial
  CRISPR gRNA sequence
ctttggaagataattttcat

SEQ ID NO: 402337 - DNA, 20 bp, Artificial
  CRISPR gRNA sequence
tggaagataattttcattgt

SEQ ID NO: 402338 - DNA, 20 bp, Artificial
  CRISPR gRNA sequence
ggaagataattttcattgtt

SEQ ID NO: 402339 - DNA, 20 bp, Artificial
  CRISPR gRNA sequence
gaagataattttcattgttc

SEQ ID NO: 402340 - DNA, 20 bp, Artificial
  CRISPR gRNA sequence
tcattgttcaaaaggacccc

SEQ ID NO: 402341 - DNA, 20 bp, Artificial
  CRISPR gRNA sequence
cattgttcaaaaggacccca

SEQ ID NO: 402342 - DNA, 20 bp, Artificial
  CRISPR gRNA sequence
attgttcaaaaggaccccaa

SEQ ID NO: 402343 - DNA, 20 bp, Artificial
  CRISPR gRNA sequence
ttcaaaaggaccccaacaac

SEQ ID NO: 402344 - DNA, 20 bp, Artificial
  CRISPR gRNA sequence
aaaaggaccccaacaacaaa

SEQ ID NO: 402345 - DNA, 20 bp, Artificial
  CRISPR gRNA sequence
taaaattgaaccaacacata

SEQ ID NO: 402346 - DNA, 20 bp, Artificial
  CRISPR gRNA sequence
aaattgaaccaacacataga

SEQ ID NO: 402347 - DNA, 20 bp, Artificial
  CRISPR gRNA sequence
aaccaacacatagaattgat

SEQ ID NO: 402348 - DNA, 20 bp, Artificial
  CRISPR gRNA sequence
atcaacaaattaaagcaatt

SEQ ID NO: 402349 - DNA, 20 bp, Artificial
  CRISPR gRNA sequence
aagcaatttattccggttta

SEQ ID NO: 402350 - DNA, 20 bp, Artificial
  CRISPR gRNA sequence
attccggtttacaattcatg

SEQ ID NO: 402351 - DNA, 20 bp, Artificial
  CRISPR gRNA sequence
ttccggtttacaattcatgg

SEQ ID NO: 402352 - DNA, 20 bp, Artificial
  CRISPR gRNA sequence
cggtttacaattcatggctt

SEQ ID NO: 402353 - DNA, 20 bp, Artificial
  CRISPR gRNA sequence
acaattcatggcttggttga

SEQ ID NO: 402354 - DNA, 20 bp, Artificial
  CRISPR gRNA sequence
caattcatggcttggttgac

SEQ ID NO: 402355 - DNA, 20 bp, Artificial
  CRISPR gRNA sequence
atggcttggttgacatgttg

SEQ ID NO: 402356 - DNA, 20 bp, Artificial
  CRISPR gRNA sequence
ggttgacatgttgaattgct

SEQ ID NO: 402357 - DNA, 20 bp, Artificial
  CRISPR gRNA sequence
gttgacatgttgaattgctg

SEQ ID NO: 402358 - DNA, 20 bp, Artificial
  CRISPR gRNA sequence
acatgttgaattgctgcttc

SEQ ID NO: 402359 - DNA, 20 bp, Artificial
  CRISPR gRNA sequence
aattgctgcttcaaaaggca

SEQ ID NO: 402360 - DNA, 20 bp, Artificial
  CRISPR gRNA sequence
ctgcttcaaaaggcaaggga

SEQ ID NO: 402361 - DNA, 20 bp, Artificial
  CRISPR gRNA sequence
cttcaaaaggcaagggaagc

SEQ ID NO: 402362 - DNA, 20 bp, Artificial
  CRISPR gRNA sequence
caaaaggcaagggaagccag

SEQ ID NO: 402363 - DNA, 20 bp, Artificial
  CRISPR gRNA sequence
aaaaggcaagggaagccaga

SEQ ID NO: 402364 - DNA, 20 bp, Artificial
  CRISPR gRNA sequence
tgcaattgtattttacaacc

SEQ ID NO: 402365 - DNA, 20 bp, Artificial
  CRISPR gRNA sequence
tattttacaacctatcttac

SEQ ID NO: 402366 - DNA, 20 bp, Artificial
  CRISPR gRNA sequence
tacaacctatcttacggtat

SEQ ID NO: 402367 - DNA, 20 bp, Artificial
  CRISPR gRNA sequence
acaacctatcttacggtatt

SEQ ID NO: 402368 - DNA, 20 bp, Artificial
  CRISPR gRNA sequence
caacctatcttacggtattt

SEQ ID NO: 402369 - DNA, 20 bp, Artificial
  CRISPR gRNA sequence
tcttacggtatttgcacact

SEQ ID NO: 402370 - DNA, 20 bp, Artificial
  CRISPR gRNA sequence
acggtatttgcacactttca

SEQ ID NO: 402371 - DNA, 20 bp, Artificial
  CRISPR gRNA sequence
cggtatttgcacactttcat

SEQ ID NO: 402372 - DNA, 20 bp, Artificial
  CRISPR gRNA sequence
gcacactttcatttcggctt

SEQ ID NO: 402373 - DNA, 20 bp, Artificial
  CRISPR gRNA sequence
cacactttcatttcggcttt

SEQ ID NO: 402374 - DNA, 20 bp, Artificial
  CRISPR gRNA sequence
tcatttcggcttttgttttg

SEQ ID NO: 402375 - DNA, 20 bp, Artificial
  CRISPR gRNA sequence
catttcggcttttgttttgc

SEQ ID NO: 402376 - DNA, 20 bp, Artificial
  CRISPR gRNA sequence
atttcggcttttgttttgcc

SEQ ID NO: 402377 - DNA, 20 bp, Artificial
  CRISPR gRNA sequence
cggcttttgttttgcctatc

SEQ ID NO: 402378 - DNA, 20 bp, Artificial
  CRISPR gRNA sequence
ggcttttgttttgcctatcc

SEQ ID NO: 402379 - DNA, 20 bp, Artificial
  CRISPR gRNA sequence
ttgttttgcctatcccaaat

SEQ ID NO: 402380 - DNA, 20 bp, Artificial
  CRISPR gRNA sequence
tgttttgcctatcccaaatt

SEQ ID NO: 402381 - DNA, 20 bp, Artificial
  CRISPR gRNA sequence
gttttgcctatcccaaattc

SEQ ID NO: 402382 - DNA, 20 bp, Artificial
  CRISPR gRNA sequence
ttttgcctatcccaaattca

SEQ ID NO: 402383 - DNA, 20 bp, Artificial
  CRISPR gRNA sequence
tgcctatcccaaattcagaa

SEQ ID NO: 402384 - DNA, 20 bp, Artificial
  CRISPR gRNA sequence
gcctatcccaaattcagaag

SEQ ID NO: 402385 - DNA, 20 bp, Artificial
  CRISPR gRNA sequence
cctatcccaaattcagaagg

SEQ ID NO: 402386 - DNA, 20 bp, Artificial
  CRISPR gRNA sequence
tcccaaattcagaaggaagg

SEQ ID NO: 402387 - DNA, 20 bp, Artificial
  CRISPR gRNA sequence
agaaggaaggaagaaaacat

SEQ ID NO: 402388 - DNA, 20 bp, Artificial
  CRISPR gRNA sequence
tcatatctattaatgacagg

SEQ ID NO: 402389 - DNA, 20 bp, Artificial
  CRISPR gRNA sequence
ttaatgacaggtgaaagtga

SEQ ID NO: 402390 - DNA, 20 bp, Artificial
  CRISPR gRNA sequence
atgacaggtgaaagtgatgg

SEQ ID NO: 402391 - DNA, 20 bp, Artificial
  CRISPR gRNA sequence
ggtctgaaaggctattgcct

SEQ ID NO: 402392 - DNA, 20 bp, Artificial
  CRISPR gRNA sequence
gtctgaaaggctattgcctg

SEQ ID NO: 402393 - DNA, 20 bp, Artificial
  CRISPR gRNA sequence
aaaggctattgcctgtcaaa

SEQ ID NO: 402394 - DNA, 20 bp, Artificial
  CRISPR gRNA sequence
ttgcctgtcaaaggaaattt

SEQ ID NO: 402395 - DNA, 20 bp, Artificial
  CRISPR gRNA sequence
cctgtcaaaggaaatttcaa

SEQ ID NO: 402396 - DNA, 20 bp, Artificial
  CRISPR gRNA sequence
tcaaaggaaatttcaaacaa

SEQ ID NO: 402397 - DNA, 20 bp, Artificial
  CRISPR gRNA sequence
caaacaaggttaagaaggcc

SEQ ID NO: 402398 - DNA, 20 bp, Artificial
  CRISPR gRNA sequence
aaacaaggttaagaaggcca

SEQ ID NO: 402399 - DNA, 20 bp, Artificial
  CRISPR gRNA sequence
agaaggccacagagaaagag

SEQ ID NO: 402400 - DNA, 20 bp, Artificial
  CRISPR gRNA sequence
tcttattctcctgttataag

SEQ ID NO: 402401 - DNA, 20 bp, Artificial
  CRISPR gRNA sequence
cttattctcctgttataagg

SEQ ID NO: 402402 - DNA, 20 bp, Artificial
  CRISPR gRNA sequence
ttattctcctgttataaggg

SEQ ID NO: 402403 - DNA, 20 bp, Artificial
  CRISPR gRNA sequence
attctcctgttataagggtc

SEQ ID NO: 402404 - DNA, 20 bp, Artificial
  CRISPR gRNA sequence
ttctcctgttataagggtca

SEQ ID NO: 402405 - DNA, 20 bp, Artificial
  CRISPR gRNA sequence
tcctgttataagggtcacca

SEQ ID NO: 402406 - DNA, 20 bp, Artificial
  CRISPR gRNA sequence
ctgttataagggtcaccaat

SEQ ID NO: 402407 - DNA, 20 bp, Artificial
  CRISPR gRNA sequence
ttataagggtcaccaattcc

SEQ ID NO: 402408 - DNA, 20 bp, Artificial
  CRISPR gRNA sequence
taagggtcaccaattcctgc

SEQ ID NO: 402409 - DNA, 20 bp, Artificial
  CRISPR gRNA sequence
ctgctagcttccttagtcct

SEQ ID NO: 402410 - DNA, 20 bp, Artificial
  CRISPR gRNA sequence
ctagcttccttagtccttgt

SEQ ID NO: 402411 - DNA, 20 bp, Artificial
  CRISPR gRNA sequence
gcttccttagtccttgtgta

SEQ ID NO: 402412 - DNA, 20 bp, Artificial
  CRISPR gRNA sequence
ccttagtccttgtgtagacc

SEQ ID NO: 402413 - DNA, 20 bp, Artificial
  CRISPR gRNA sequence
cttagtccttgtgtagacct

SEQ ID NO: 402414 - DNA, 20 bp, Artificial
  CRISPR gRNA sequence
agtccttgtgtagacctttt

SEQ ID NO: 402415 - DNA, 20 bp, Artificial
  CRISPR gRNA sequence
gtccttgtgtagaccttttt

SEQ ID NO: 402416 - DNA, 20 bp, Artificial
  CRISPR gRNA sequence
gtgtagacctttttcagttt

SEQ ID NO: 402417 - DNA, 20 bp, Artificial
  CRISPR gRNA sequence
tgtagacctttttcagtttt

SEQ ID NO: 402418 - DNA, 20 bp, Artificial
  CRISPR gRNA sequence
tttcagttttgtctatcata

SEQ ID NO: 402419 - DNA, 20 bp, Artificial
  CRISPR gRNA sequence
ttcagttttgtctatcatat

SEQ ID NO: 402420 - DNA, 20 bp, Artificial
  CRISPR gRNA sequence
tcagttttgtctatcatatg

SEQ ID NO: 402421 - DNA, 20 bp, Artificial
  CRISPR gRNA sequence
cagttttgtctatcatatgt

SEQ ID NO: 402422 - DNA, 20 bp, Artificial
  CRISPR gRNA sequence
agttttgtctatcatatgta

SEQ ID NO: 402423 - DNA, 20 bp, Artificial
  CRISPR gRNA sequence
tgtctatcatatgtatctct

SEQ ID NO: 402424 - DNA, 20 bp, Artificial
  CRISPR gRNA sequence
gtctatcatatgtatctcta

SEQ ID NO: 402425 - DNA, 20 bp, Artificial
  CRISPR gRNA sequence
tctatcatatgtatctctat

SEQ ID NO: 402426 - DNA, 20 bp, Artificial
  CRISPR gRNA sequence
tcatatgtatctctatcact

SEQ ID NO: 402427 - DNA, 20 bp, Artificial
  CRISPR gRNA sequence
tatcacttttaattttctta

SEQ ID NO: 402428 - DNA, 20 bp, Artificial
  CRISPR gRNA sequence
tcacttttaattttcttaag

SEQ ID NO: 402429 - DNA, 20 bp, Artificial
  CRISPR gRNA sequence
ttaattttcttaagtcagat

SEQ ID NO: 402430 - DNA, 20 bp, Artificial
  CRISPR gRNA sequence
taattttcttaagtcagatg

SEQ ID NO: 402431 - DNA, 20 bp, Artificial
  CRISPR gRNA sequence
aattttcttaagtcagatgg

SEQ ID NO: 402432 - DNA, 20 bp, Artificial
  CRISPR gRNA sequence
attttcttaagtcagatgga

SEQ ID NO: 402433 - DNA, 20 bp, Artificial
  CRISPR gRNA sequence
tcttaagtcagatggagaaa

SEQ ID NO: 402434 - DNA, 20 bp, Artificial
  CRISPR gRNA sequence
cttaagtcagatggagaaat

SEQ ID NO: 402435 - DNA, 20 bp, Artificial
  CRISPR gRNA sequence
ttaagtcagatggagaaata

SEQ ID NO: 402436 - DNA, 20 bp, Artificial
  CRISPR gRNA sequence
aagtcagatggagaaataag

SEQ ID NO: 402437 - DNA, 20 bp, Artificial
  CRISPR gRNA sequence
agtcagatggagaaataaga

SEQ ID NO: 402438 - DNA, 20 bp, Artificial
  CRISPR gRNA sequence
caagtcaactgattagagaa

SEQ ID NO: 402439 - DNA, 20 bp, Artificial
  CRISPR gRNA sequence
attagagaatgaagccataa

SEQ ID NO: 402440 - DNA, 20 bp, Artificial
  CRISPR gRNA sequence
gagaatgaagccataagctc

SEQ ID NO: 402441 - DNA, 20 bp, Artificial
  CRISPR gRNA sequence
tctcttcaggcccattctgg

SEQ ID NO: 402442 - DNA, 20 bp, Artificial
  CRISPR gRNA sequence
tcttcaggcccattctggtg

SEQ ID NO: 402443 - DNA, 20 bp, Artificial
  CRISPR gRNA sequence
ttcaggcccattctggtgag

SEQ ID NO: 402444 - DNA, 20 bp, Artificial
  CRISPR gRNA sequence
caggcccattctggtgagat

SEQ ID NO: 402445 - DNA, 20 bp, Artificial
  CRISPR gRNA sequence
aggcccattctggtgagatt

SEQ ID NO: 402446 - DNA, 20 bp, Artificial
  CRISPR gRNA sequence
tggtgagattagaaataagt

SEQ ID NO: 402447 - DNA, 20 bp, Artificial
  CRISPR gRNA sequence
gtgagattagaaataagtca

SEQ ID NO: 402448 - DNA, 20 bp, Artificial
  CRISPR gRNA sequence
gaaataagtcataaaggttt

SEQ ID NO: 402449 - DNA, 20 bp, Artificial
  CRISPR gRNA sequence
tatatatccatgtgtgtgtg

SEQ ID NO: 402450 - DNA, 20 bp, Artificial
  CRISPR gRNA sequence
atatatccatgtgtgtgtgt

SEQ ID NO: 402451 - DNA, 20 bp, Artificial
  CRISPR gRNA sequence
tatatccatgtgtgtgtgta

SEQ ID NO: 402452 - DNA, 20 bp, Artificial
  CRISPR gRNA sequence
aaaaatgttacattttagca

SEQ ID NO: 402453 - DNA, 20 bp, Artificial
  CRISPR gRNA sequence
cattttagcagtttttcatt

SEQ ID NO: 402454 - DNA, 20 bp, Artificial
  CRISPR gRNA sequence
tagcagtttttcatttaaag

SEQ ID NO: 402455 - DNA, 20 bp, Artificial
  CRISPR gRNA sequence
agcagtttttcatttaaaga

SEQ ID NO: 402456 - DNA, 20 bp, Artificial
  CRISPR gRNA sequence
gcagtttttcatttaaagaa

SEQ ID NO: 402457 - DNA, 20 bp, Artificial
  CRISPR gRNA sequence
ttcatttaaagaaaaaaata

SEQ ID NO: 402458 - DNA, 20 bp, Artificial
  CRISPR gRNA sequence
tcatttaaagaaaaaaatac

SEQ ID NO: 402459 - DNA, 20 bp, Artificial
  CRISPR gRNA sequence
catttaaagaaaaaaatact

SEQ ID NO: 402460 - DNA, 20 bp, Artificial
  CRISPR gRNA sequence
atttaaagaaaaaaatacta

SEQ ID NO: 402461 - DNA, 20 bp, Artificial
  CRISPR gRNA sequence
aaagaaaaaaatactaaatg

SEQ ID NO: 402462 - DNA, 20 bp, Artificial
  CRISPR gRNA sequence
aagaaaaaaatactaaatgg

SEQ ID NO: 402463 - DNA, 20 bp, Artificial
  CRISPR gRNA sequence
aatggtacctataaggaatc

SEQ ID NO: 402464 - DNA, 20 bp, Artificial
  CRISPR gRNA sequence
taaggaatccacaagggatg

SEQ ID NO: 402465 - DNA, 20 bp, Artificial
  CRISPR gRNA sequence
taaaggcttaaaaatctcac

SEQ ID NO: 402466 - DNA, 20 bp, Artificial
  CRISPR gRNA sequence
aaaggcttaaaaatctcact

SEQ ID NO: 402467 - DNA, 20 bp, Artificial
  CRISPR gRNA sequence
aaggcttaaaaatctcactc

SEQ ID NO: 402468 - DNA, 20 bp, Artificial
  CRISPR gRNA sequence
aaaaatctcactccgtaatg

SEQ ID NO: 402469 - DNA, 20 bp, Artificial
  CRISPR gRNA sequence
aaaatctcactccgtaatga

SEQ ID NO: 402470 - DNA, 20 bp, Artificial
  CRISPR gRNA sequence
actccgtaatgaaataaaat

SEQ ID NO: 402471 - DNA, 20 bp, Artificial
  CRISPR gRNA sequence
cgtaatgaaataaaatagta

SEQ ID NO: 402472 - DNA, 20 bp, Artificial
  CRISPR gRNA sequence
taagactcacagaaagcaag

SEQ ID NO: 402473 - DNA, 20 bp, Artificial
  CRISPR gRNA sequence
aagactcacagaaagcaagg

SEQ ID NO: 402474 - DNA, 20 bp, Artificial
  CRISPR gRNA sequence
agactcacagaaagcaaggt

SEQ ID NO: 402475 - DNA, 20 bp, Artificial
  CRISPR gRNA sequence
acagaaagcaaggttatggt

SEQ ID NO: 402476 - DNA, 20 bp, Artificial
  CRISPR gRNA sequence
tggtcactgcacttctcaag

SEQ ID NO: 402477 - DNA, 20 bp, Artificial
  CRISPR gRNA sequence
cacttctcaagggtgaagta

SEQ ID NO: 402478 - DNA, 20 bp, Artificial
  CRISPR gRNA sequence
ctcaagggtgaagtaaatgg

SEQ ID NO: 402479 - DNA, 20 bp, Artificial
  CRISPR gRNA sequence
tcaagggtgaagtaaatggg

SEQ ID NO: 402480 - DNA, 20 bp, Artificial
  CRISPR gRNA sequence
aagggtgaagtaaatgggaa

SEQ ID NO: 402481 - DNA, 20 bp, Artificial
  CRISPR gRNA sequence
aaagtggatggttaccagaa

SEQ ID NO: 402482 - DNA, 20 bp, Artificial
  CRISPR gRNA sequence
ccagaacgtgtgccaaggtt

SEQ ID NO: 402483 - DNA, 20 bp, Artificial
  CRISPR gRNA sequence
tttttatccacgtgctttcc

SEQ ID NO: 402484 - DNA, 20 bp, Artificial
  CRISPR gRNA sequence
ttatccacgtgctttccctg

SEQ ID NO: 402485 - DNA, 20 bp, Artificial
  CRISPR gRNA sequence
tatccacgtgctttccctgt

SEQ ID NO: 402486 - DNA, 20 bp, Artificial
  CRISPR gRNA sequence
atccacgtgctttccctgtg

SEQ ID NO: 402487 - DNA, 20 bp, Artificial
  CRISPR gRNA sequence
tccacgtgctttccctgtgc

SEQ ID NO: 402488 - DNA, 20 bp, Artificial
  CRISPR gRNA sequence
tccctgtgctaagcccagga

SEQ ID NO: 402489 - DNA, 20 bp, Artificial
  CRISPR gRNA sequence
ccctgtgctaagcccaggaa

SEQ ID NO: 402490 - DNA, 20 bp, Artificial
  CRISPR gRNA sequence
cctgtgctaagcccaggaag

SEQ ID NO: 402491 - DNA, 20 bp, Artificial
  CRISPR gRNA sequence
tgctaagcccaggaaggaac

SEQ ID NO: 402492 - DNA, 20 bp, Artificial
  CRISPR gRNA sequence
agcccaggaaggaacaggca

SEQ ID NO: 402493 - DNA, 20 bp, Artificial
  CRISPR gRNA sequence
tgggaatcaaccctcaggct

SEQ ID NO: 402494 - DNA, 20 bp, Artificial
  CRISPR gRNA sequence
aggctttcaggcaaagctct

SEQ ID NO: 402495 - DNA, 20 bp, Artificial
  CRISPR gRNA sequence
tcaggcaaagctctgtaatc

SEQ ID NO: 402496 - DNA, 20 bp, Artificial
  CRISPR gRNA sequence
caggcaaagctctgtaatca

SEQ ID NO: 402497 - DNA, 20 bp, Artificial
  CRISPR gRNA sequence
aggcaaagctctgtaatcaa

SEQ ID NO: 402498 - DNA, 20 bp, Artificial
  CRISPR gRNA sequence
tgtaatcaaaaatcaaaaaa

SEQ ID NO: 402499 - DNA, 20 bp, Artificial
  CRISPR gRNA sequence
taatcaaaaatcaaaaaaaa

SEQ ID NO: 402500 - DNA, 20 bp, Artificial
  CRISPR gRNA sequence
aaaaactctctaaagccaga

SEQ ID NO: 402501 - DNA, 20 bp, Artificial
  CRISPR gRNA sequence
aaaactctctaaagccagat

SEQ ID NO: 402502 - DNA, 20 bp, Artificial
  CRISPR gRNA sequence
tctaaagccagataatacta

SEQ ID NO: 402503 - DNA, 20 bp, Artificial
  CRISPR gRNA sequence
taaagccagataatactaaa

SEQ ID NO: 402504 - DNA, 20 bp, Artificial
  CRISPR gRNA sequence
aagccagataatactaaatt

SEQ ID NO: 402505 - DNA, 20 bp, Artificial
  CRISPR gRNA sequence
aatttatatacacaattgaa

SEQ ID NO: 402506 - DNA, 20 bp, Artificial
  CRISPR gRNA sequence
atatacacaattgaattcaa

SEQ ID NO: 402507 - DNA, 20 bp, Artificial
  CRISPR gRNA sequence
tatacacaattgaattcaat

SEQ ID NO: 402508 - DNA, 20 bp, Artificial
  CRISPR gRNA sequence
aattcaataatcgaatggct

SEQ ID NO: 402509 - DNA, 20 bp, Artificial
  CRISPR gRNA sequence
aataatcgaatggctgatac

SEQ ID NO: 402510 - DNA, 20 bp, Artificial
  CRISPR gRNA sequence
atacagtggaattcacgtac

SEQ ID NO: 402511 - DNA, 20 bp, Artificial
  CRISPR gRNA sequence
acgtacaggcacgggtacag

SEQ ID NO: 402512 - DNA, 20 bp, Artificial
  CRISPR gRNA sequence
ggatttttggggattgagat

SEQ ID NO: 402513 - DNA, 20 bp, Artificial
  CRISPR gRNA sequence
gatttttggggattgagatt

SEQ ID NO: 402514 - DNA, 20 bp, Artificial
  CRISPR gRNA sequence
ttggggattgagattgtccg

SEQ ID NO: 402515 - DNA, 20 bp, Artificial
  CRISPR gRNA sequence
tggggattgagattgtccgt

SEQ ID NO: 402516 - DNA, 20 bp, Artificial
  CRISPR gRNA sequence
ggggattgagattgtccgtc

SEQ ID NO: 402517 - DNA, 20 bp, Artificial
  CRISPR gRNA sequence
gggattgagattgtccgtct

SEQ ID NO: 402518 - DNA, 20 bp, Artificial
  CRISPR gRNA sequence
agattgtccgtctgtctcga

SEQ ID NO: 402519 - DNA, 20 bp, Artificial
  CRISPR gRNA sequence
tccgtctgtctcgatgcctg

SEQ ID NO: 402520 - DNA, 20 bp, Artificial
  CRISPR gRNA sequence
tctcgatgcctgggtttctc

SEQ ID NO: 402521 - DNA, 20 bp, Artificial
  CRISPR gRNA sequence
gatgcctgggtttctctcta

SEQ ID NO: 402522 - DNA, 20 bp, Artificial
  CRISPR gRNA sequence
ggtttctctctacctccttc

SEQ ID NO: 402523 - DNA, 20 bp, Artificial
  CRISPR gRNA sequence
ctctctacctccttcacctc

SEQ ID NO: 402524 - DNA, 20 bp, Artificial
  CRISPR gRNA sequence
tctctacctccttcacctcc

SEQ ID NO: 402525 - DNA, 20 bp, Artificial
  CRISPR gRNA sequence
tctacctccttcacctcctt

SEQ ID NO: 402526 - DNA, 20 bp, Artificial
  CRISPR gRNA sequence
tacctccttcacctccttta

SEQ ID NO: 402527 - DNA, 20 bp, Artificial
  CRISPR gRNA sequence
cctccttcacctcctttatg

SEQ ID NO: 402528 - DNA, 20 bp, Artificial
  CRISPR gRNA sequence
cttcacctcctttatgcccc

SEQ ID NO: 402529 - DNA, 20 bp, Artificial
  CRISPR gRNA sequence
cacctcctttatgccccgtg

SEQ ID NO: 402530 - DNA, 20 bp, Artificial
  CRISPR gRNA sequence
acctcctttatgccccgtga

SEQ ID NO: 402531 - DNA, 20 bp, Artificial
  CRISPR gRNA sequence
ctttatgccccgtgagacac

SEQ ID NO: 402532 - DNA, 20 bp, Artificial
  CRISPR gRNA sequence
tatgccccgtgagacacccc

SEQ ID NO: 402533 - DNA, 20 bp, Artificial
  CRISPR gRNA sequence
atgccccgtgagacacccca

SEQ ID NO: 402534 - DNA, 20 bp, Artificial
  CRISPR gRNA sequence
tgccccgtgagacaccccag

SEQ ID NO: 402535 - DNA, 20 bp, Artificial
  CRISPR gRNA sequence
tgacacttctgagctgtagc

SEQ ID NO: 402536 - DNA, 20 bp, Artificial
  CRISPR gRNA sequence
gacacttctgagctgtagca

SEQ ID NO: 402537 - DNA, 20 bp, Artificial
  CRISPR gRNA sequence
acacttctgagctgtagcaa

SEQ ID NO: 402538 - DNA, 20 bp, Artificial
  CRISPR gRNA sequence
ctgagctgtagcaaaatcca

SEQ ID NO: 402539 - DNA, 20 bp, Artificial
  CRISPR gRNA sequence
tgagctgtagcaaaatccag

SEQ ID NO: 402540 - DNA, 20 bp, Artificial
  CRISPR gRNA sequence
agctgtagcaaaatccagag

SEQ ID NO: 402541 - DNA, 20 bp, Artificial
  CRISPR gRNA sequence
tagcaaaatccagaggaaac

SEQ ID NO: 402542 - DNA, 20 bp, Artificial
  CRISPR gRNA sequence
ttactttgggcttgttgtca

SEQ ID NO: 402543 - DNA, 20 bp, Artificial
  CRISPR gRNA sequence
tactttgggcttgttgtcaa

SEQ ID NO: 402544 - DNA, 20 bp, Artificial
  CRISPR gRNA sequence
actttgggcttgttgtcaaa

SEQ ID NO: 402545 - DNA, 20 bp, Artificial
  CRISPR gRNA sequence
ctttgggcttgttgtcaaat

SEQ ID NO: 402546 - DNA, 20 bp, Artificial
  CRISPR gRNA sequence
tgggcttgttgtcaaatgca

SEQ ID NO: 402547 - DNA, 20 bp, Artificial
  CRISPR gRNA sequence
gggcttgttgtcaaatgcag

SEQ ID NO: 402548 - DNA, 20 bp, Artificial
  CRISPR gRNA sequence
ggcttgttgtcaaatgcagt

SEQ ID NO: 402549 - DNA, 20 bp, Artificial
  CRISPR gRNA sequence
gttgtcaaatgcagtcaggc

SEQ ID NO: 402550 - DNA, 20 bp, Artificial
  CRISPR gRNA sequence
ttgtcaaatgcagtcaggcg

SEQ ID NO: 402551 - DNA, 20 bp, Artificial
  CRISPR gRNA sequence
tcaaatgcagtcaggcgagc

SEQ ID NO: 402552 - DNA, 20 bp, Artificial
  CRISPR gRNA sequence
gctgccatctttgtgtgcag

SEQ ID NO: 402553 - DNA, 20 bp, Artificial
  CRISPR gRNA sequence
ccatctttgtgtgcagccat

SEQ ID NO: 402554 - DNA, 20 bp, Artificial
  CRISPR gRNA sequence
tgtgtgcagccattttgttt

SEQ ID NO: 402555 - DNA, 20 bp, Artificial
  CRISPR gRNA sequence
gtgtgcagccattttgttta

SEQ ID NO: 402556 - DNA, 20 bp, Artificial
  CRISPR gRNA sequence
tgtgcagccattttgtttat

SEQ ID NO: 402557 - DNA, 20 bp, Artificial
  CRISPR gRNA sequence
tgtttatttatactacctat

SEQ ID NO: 402558 - DNA, 20 bp, Artificial
  CRISPR gRNA sequence
gtttatttatactacctatg

SEQ ID NO: 402559 - DNA, 20 bp, Artificial
  CRISPR gRNA sequence
tttatttatactacctatgt

SEQ ID NO: 402560 - DNA, 20 bp, Artificial
  CRISPR gRNA sequence
atttatactacctatgtaaa

SEQ ID NO: 402561 - DNA, 20 bp, Artificial
  CRISPR gRNA sequence
tttatactacctatgtaaac

SEQ ID NO: 402562 - DNA, 20 bp, Artificial
  CRISPR gRNA sequence
atactacctatgtaaacttg

SEQ ID NO: 402563 - DNA, 20 bp, Artificial
  CRISPR gRNA sequence
tactacctatgtaaacttga

SEQ ID NO: 402564 - DNA, 20 bp, Artificial
  CRISPR gRNA sequence
cctatgtaaacttgaaactg

SEQ ID NO: 402565 - DNA, 20 bp, Artificial
  CRISPR gRNA sequence
tgtaaacttgaaactgtacc

SEQ ID NO: 402566 - DNA, 20 bp, Artificial
  CRISPR gRNA sequence
gaaactgtacccttcttatt

SEQ ID NO: 402567 - DNA, 20 bp, Artificial
  CRISPR gRNA sequence
aaactgtacccttcttattg

SEQ ID NO: 402568 - DNA, 20 bp, Artificial
  CRISPR gRNA sequence
tacccttcttattgtaggta

SEQ ID NO: 402569 - DNA, 20 bp, Artificial
  CRISPR gRNA sequence
cttattgtaggtatttatat

SEQ ID NO: 402570 - DNA, 20 bp, Artificial
  CRISPR gRNA sequence
ttattgtaggtatttatatt

SEQ ID NO: 402571 - DNA, 20 bp, Artificial
  CRISPR gRNA sequence
attgtaggtatttatatttt

SEQ ID NO: 402572 - DNA, 20 bp, Artificial
  CRISPR gRNA sequence
ttgtaggtatttatattttc

SEQ ID NO: 402573 - DNA, 20 bp, Artificial
  CRISPR gRNA sequence
taggtatttatattttcaag

SEQ ID NO: 402574 - DNA, 20 bp, Artificial
  CRISPR gRNA sequence
atattttcaagatgattgta

SEQ ID NO: 402575 - DNA, 20 bp, Artificial
  CRISPR gRNA sequence
tattttcaagatgattgtag

SEQ ID NO: 402576 - DNA, 20 bp, Artificial
  CRISPR gRNA sequence
tcaagatgattgtagagtag

SEQ ID NO: 402577 - DNA, 20 bp, Artificial
  CRISPR gRNA sequence
caagatgattgtagagtagg

SEQ ID NO: 402578 - DNA, 20 bp, Artificial
  CRISPR gRNA sequence
aagatgattgtagagtaggg

SEQ ID NO: 402579 - DNA, 20 bp, Artificial
  CRISPR gRNA sequence
tagagtaggggtatgcttgg

SEQ ID NO: 402580 - DNA, 20 bp, Artificial
  CRISPR gRNA sequence
ggctgaattgatagagaatg

SEQ ID NO: 402581 - DNA, 20 bp, Artificial
  CRISPR gRNA sequence
gctgaattgatagagaatgg

SEQ ID NO: 402582 - DNA, 20 bp, Artificial
  CRISPR gRNA sequence
aattgatagagaatgggcta

SEQ ID NO: 402583 - DNA, 20 bp, Artificial
  CRISPR gRNA sequence
atagagaatgggctacagct

SEQ ID NO: 402584 - DNA, 20 bp, Artificial
  CRISPR gRNA sequence
cagctgaagcttcggacact

SEQ ID NO: 402585 - DNA, 20 bp, Artificial
  CRISPR gRNA sequence
aagcttcggacactgattct

SEQ ID NO: 402586 - DNA, 20 bp, Artificial
  CRISPR gRNA sequence
cggacactgattctcctgtg

SEQ ID NO: 402587 - DNA, 20 bp, Artificial
  CRISPR gRNA sequence
ggacactgattctcctgtga

SEQ ID NO: 402588 - DNA, 20 bp, Artificial
  CRISPR gRNA sequence
attctcctgtgacctcagaa

SEQ ID NO: 402589 - DNA, 20 bp, Artificial
  CRISPR gRNA sequence
tcctgtgacctcagaacatt

SEQ ID NO: 402590 - DNA, 20 bp, Artificial
  CRISPR gRNA sequence
ctgtgacctcagaacattct

SEQ ID NO: 402591 - DNA, 20 bp, Artificial
  CRISPR gRNA sequence
tgacctcagaacattctgtg

SEQ ID NO: 402592 - DNA, 20 bp, Artificial
  CRISPR gRNA sequence
agaacattctgtgagtatag

SEQ ID NO: 402593 - DNA, 20 bp, Artificial
  CRISPR gRNA sequence
tgtgagtatagctggaaact

SEQ ID NO: 402594 - DNA, 20 bp, Artificial
  CRISPR gRNA sequence
tgagtatagctggaaactac

SEQ ID NO: 402595 - DNA, 20 bp, Artificial
  CRISPR gRNA sequence
gaaactacacagttcttggt

SEQ ID NO: 402596 - DNA, 20 bp, Artificial
  CRISPR gRNA sequence
cacagttcttggtttttcct

SEQ ID NO: 402597 - DNA, 20 bp, Artificial
  CRISPR gRNA sequence
ttggtttttcctccttcaac

SEQ ID NO: 402598 - DNA, 20 bp, Artificial
  CRISPR gRNA sequence
ggtttttcctccttcaactc

SEQ ID NO: 402599 - DNA, 20 bp, Artificial
  CRISPR gRNA sequence
gtttttcctccttcaactct

SEQ ID NO: 402600 - DNA, 20 bp, Artificial
  CRISPR gRNA sequence
ttcctccttcaactctcagt

SEQ ID NO: 402601 - DNA, 20 bp, Artificial
  CRISPR gRNA sequence
tcctccttcaactctcagtg

SEQ ID NO: 402602 - DNA, 20 bp, Artificial
  CRISPR gRNA sequence
cctccttcaactctcagtga

SEQ ID NO: 402603 - DNA, 20 bp, Artificial
  CRISPR gRNA sequence
ctccttcaactctcagtgat

SEQ ID NO: 402604 - DNA, 20 bp, Artificial
  CRISPR gRNA sequence
cttcaactctcagtgatcaa

SEQ ID NO: 402605 - DNA, 20 bp, Artificial
  CRISPR gRNA sequence
caactctcagtgatcaagac

SEQ ID NO: 402606 - DNA, 20 bp, Artificial
  CRISPR gRNA sequence
aactctcagtgatcaagaca

SEQ ID NO: 402607 - DNA, 20 bp, Artificial
  CRISPR gRNA sequence
tcagtgatcaagacaactca

SEQ ID NO: 402608 - DNA, 20 bp, Artificial
  CRISPR gRNA sequence
agtgatcaagacaactcaca

SEQ ID NO: 402609 - DNA, 20 bp, Artificial
  CRISPR gRNA sequence
acacctttaccacaacagct

SEQ ID NO: 402610 - DNA, 20 bp, Artificial
  CRISPR gRNA sequence
taccacaacagctgtttacc

SEQ ID NO: 402611 - DNA, 20 bp, Artificial
  CRISPR gRNA sequence
accacaacagctgtttaccc

SEQ ID NO: 402612 - DNA, 20 bp, Artificial
  CRISPR gRNA sequence
ccacaacagctgtttaccca

SEQ ID NO: 402613 - DNA, 20 bp, Artificial
  CRISPR gRNA sequence
tttacccagcactgaaggcg

SEQ ID NO: 402614 - DNA, 20 bp, Artificial
  CRISPR gRNA sequence
acccagcactgaaggcggct

SEQ ID NO: 402615 - DNA, 20 bp, Artificial
  CRISPR gRNA sequence
cccagcactgaaggcggctg

SEQ ID NO: 402616 - DNA, 20 bp, Artificial
  CRISPR gRNA sequence
aaggcggctgccaaccacaa

SEQ ID NO: 402617 - DNA, 20 bp, Artificial
  CRISPR gRNA sequence
ccaaccacaacatgaggaat

SEQ ID NO: 402618 - DNA, 20 bp, Artificial
  CRISPR gRNA sequence
cctcttcagaatgggtgttg

SEQ ID NO: 402619 - DNA, 20 bp, Artificial
  CRISPR gRNA sequence
ctcttcagaatgggtgttgg

SEQ ID NO: 402620 - DNA, 20 bp, Artificial
  CRISPR gRNA sequence
ttcagaatgggtgttggtgg

SEQ ID NO: 402621 - DNA, 20 bp, Artificial
  CRISPR gRNA sequence
cagaatgggtgttggtggtg

SEQ ID NO: 402622 - DNA, 20 bp, Artificial
  CRISPR gRNA sequence
agaatgggtgttggtggtgt

SEQ ID NO: 402623 - DNA, 20 bp, Artificial
  CRISPR gRNA sequence
gtggtgtgtgggtgccaatg

SEQ ID NO: 402624 - DNA, 20 bp, Artificial
  CRISPR gRNA sequence
tggcctcacacatgagtaag

SEQ ID NO: 402625 - DNA, 20 bp, Artificial
  CRISPR gRNA sequence
acacatgagtaagagctggt

SEQ ID NO: 402626 - DNA, 20 bp, Artificial
  CRISPR gRNA sequence
gtgtcctatagccttcaatg

SEQ ID NO: 402627 - DNA, 20 bp, Artificial
  CRISPR gRNA sequence
tagccttcaatgcctgtcaa

SEQ ID NO: 402628 - DNA, 20 bp, Artificial
  CRISPR gRNA sequence
caatgcctgtcaaataactg

SEQ ID NO: 402629 - DNA, 20 bp, Artificial
  CRISPR gRNA sequence
aatgcctgtcaaataactgt

SEQ ID NO: 402630 - DNA, 20 bp, Artificial
  CRISPR gRNA sequence
tcaaataactgtggaacatg

SEQ ID NO: 402631 - DNA, 20 bp, Artificial
  CRISPR gRNA sequence
tggaacatgttcagcccaca

SEQ ID NO: 402632 - DNA, 20 bp, Artificial
  CRISPR gRNA sequence
agcccacacacgttgagact

SEQ ID NO: 402633 - DNA, 20 bp, Artificial
  CRISPR gRNA sequence
agactcctcctcagaccatc

SEQ ID NO: 402634 - DNA, 20 bp, Artificial
  CRISPR gRNA sequence
ctcctcagaccatctcggct

SEQ ID NO: 402635 - DNA, 20 bp, Artificial
  CRISPR gRNA sequence
ctcagaccatctcggcttct

SEQ ID NO: 402636 - DNA, 20 bp, Artificial
  CRISPR gRNA sequence
agaccatctcggcttctgtg

SEQ ID NO: 402637 - DNA, 20 bp, Artificial
  CRISPR gRNA sequence
ggcttctgtgatcttttaaa

SEQ ID NO: 402638 - DNA, 20 bp, Artificial
  CRISPR gRNA sequence
ctgtgatcttttaaaaaatt

SEQ ID NO: 402639 - DNA, 20 bp, Artificial
  CRISPR gRNA sequence
tgtgatcttttaaaaaattc

SEQ ID NO: 402640 - DNA, 20 bp, Artificial
  CRISPR gRNA sequence
tgatcttttaaaaaattcct

SEQ ID NO: 402641 - DNA, 20 bp, Artificial
  CRISPR gRNA sequence
ttaaaaaattcctcacttca

SEQ ID NO: 402642 - DNA, 20 bp, Artificial
  CRISPR gRNA sequence
taaaaaattcctcacttcaa

SEQ ID NO: 402643 - DNA, 20 bp, Artificial
  CRISPR gRNA sequence
aaaaaattcctcacttcaaa

SEQ ID NO: 402644 - DNA, 20 bp, Artificial
  CRISPR gRNA sequence
aaaaattcctcacttcaaag

SEQ ID NO: 402645 - DNA, 20 bp, Artificial
  CRISPR gRNA sequence
ctcacttcaaaggttgagag

SEQ ID NO: 402646 - DNA, 20 bp, Artificial
  CRISPR gRNA sequence
acttcaaaggttgagagctg

SEQ ID NO: 402647 - DNA, 20 bp, Artificial
  CRISPR gRNA sequence
caaaggttgagagctgcaga

SEQ ID NO: 402648 - DNA, 20 bp, Artificial
  CRISPR gRNA sequence
aaaggttgagagctgcagat

SEQ ID NO: 402649 - DNA, 20 bp, Artificial
  CRISPR gRNA sequence
agagctgcagatagtgggca

SEQ ID NO: 402650 - DNA, 20 bp, Artificial
  CRISPR gRNA sequence
cagatagtgggcattgttct

SEQ ID NO: 402651 - DNA, 20 bp, Artificial
  CRISPR gRNA sequence
ttctccagcacttgctctgg

SEQ ID NO: 402652 - DNA, 20 bp, Artificial
  CRISPR gRNA sequence
tccagcacttgctctgggaa

SEQ ID NO: 402653 - DNA, 20 bp, Artificial
  CRISPR gRNA sequence
cagcacttgctctgggaaac

SEQ ID NO: 402654 - DNA, 20 bp, Artificial
  CRISPR gRNA sequence
gctctgggaaacttccttat

SEQ ID NO: 402655 - DNA, 20 bp, Artificial
  CRISPR gRNA sequence
ctctgggaaacttccttata

SEQ ID NO: 402656 - DNA, 20 bp, Artificial
  CRISPR gRNA sequence
tgggaaacttccttatagga

SEQ ID NO: 402657 - DNA, 20 bp, Artificial
  CRISPR gRNA sequence
ggaaacttccttataggatt

SEQ ID NO: 402658 - DNA, 20 bp, Artificial
  CRISPR gRNA sequence
ccttataggattagtgagta

SEQ ID NO: 402659 - DNA, 20 bp, Artificial
  CRISPR gRNA sequence
cttataggattagtgagtag

SEQ ID NO: 402660 - DNA, 20 bp, Artificial
  CRISPR gRNA sequence
ataggattagtgagtaggtg

SEQ ID NO: 402661 - DNA, 20 bp, Artificial
  CRISPR gRNA sequence
taggattagtgagtaggtgt

SEQ ID NO: 402662 - DNA, 20 bp, Artificial
  CRISPR gRNA sequence
gtgagtaggtgtgagtgacc

SEQ ID NO: 402663 - DNA, 20 bp, Artificial
  CRISPR gRNA sequence
caaaaaggccttataggaat

SEQ ID NO: 402664 - DNA, 20 bp, Artificial
  CRISPR gRNA sequence
aaaaaggccttataggaatt

SEQ ID NO: 402665 - DNA, 20 bp, Artificial
  CRISPR gRNA sequence
ataggaatttacctcttaac

SEQ ID NO: 402666 - DNA, 20 bp, Artificial
  CRISPR gRNA sequence
taggaatttacctcttaaca

SEQ ID NO: 402667 - DNA, 20 bp, Artificial
  CRISPR gRNA sequence
acctcttaacagatcacatt

SEQ ID NO: 402668 - DNA, 20 bp, Artificial
  CRISPR gRNA sequence
cctcttaacagatcacatta

SEQ ID NO: 402669 - DNA, 20 bp, Artificial
  CRISPR gRNA sequence
ttaacagatcacattattaa

SEQ ID NO: 402670 - DNA, 20 bp, Artificial
  CRISPR gRNA sequence
aacagatcacattattaact

SEQ ID NO: 402671 - DNA, 20 bp, Artificial
  CRISPR gRNA sequence
acagatcacattattaactg

SEQ ID NO: 402672 - DNA, 20 bp, Artificial
  CRISPR gRNA sequence
ttaactgaaagtaacattat

SEQ ID NO: 402673 - DNA, 20 bp, Artificial
  CRISPR gRNA sequence
actgaaagtaacattataaa

SEQ ID NO: 402674 - DNA, 20 bp, Artificial
  CRISPR gRNA sequence
aaagtaacattataaattgc

SEQ ID NO: 402675 - DNA, 20 bp, Artificial
  CRISPR gRNA sequence
taaattgcattttgtaaaat

SEQ ID NO: 402676 - DNA, 20 bp, Artificial
  CRISPR gRNA sequence
cattttgtaaaataaaaaat

SEQ ID NO: 402677 - DNA, 20 bp, Artificial
  CRISPR gRNA sequence
tgtaaaataaaaaatgtgag

SEQ ID NO: 402678 - DNA, 20 bp, Artificial
  CRISPR gRNA sequence
gtaaaataaaaaatgtgaga

SEQ ID NO: 402679 - DNA, 20 bp, Artificial
  CRISPR gRNA sequence
taaaataaaaaatgtgagat

SEQ ID NO: 402680 - DNA, 20 bp, Artificial
  CRISPR gRNA sequence
gagatattcaaaagcaaaca

SEQ ID NO: 402681 - DNA, 20 bp, Artificial
  CRISPR gRNA sequence
agatattcaaaagcaaacaa

SEQ ID NO: 402682 - DNA, 20 bp, Artificial
  CRISPR gRNA sequence
aaaagcaaacaaaaagaaaa

SEQ ID NO: 402683 - DNA, 20 bp, Artificial
  CRISPR gRNA sequence
aagaaagtccaaaagctctt

SEQ ID NO: 402684 - DNA, 20 bp, Artificial
  CRISPR gRNA sequence
ttagctggtaaagctctcag

SEQ ID NO: 402685 - DNA, 20 bp, Artificial
  CRISPR gRNA sequence
agctggtaaagctctcagtt

SEQ ID NO: 402686 - DNA, 20 bp, Artificial
  CRISPR gRNA sequence
gctggtaaagctctcagttt

SEQ ID NO: 402687 - DNA, 20 bp, Artificial
  CRISPR gRNA sequence
gtaaagctctcagtttttac

SEQ ID NO: 402688 - DNA, 20 bp, Artificial
  CRISPR gRNA sequence
tcagtttttactgatgcttg

SEQ ID NO: 402689 - DNA, 20 bp, Artificial
  CRISPR gRNA sequence
agtttttactgatgcttgga

SEQ ID NO: 402690 - DNA, 20 bp, Artificial
  CRISPR gRNA sequence
ttactgatgcttggagctcc

SEQ ID NO: 402691 - DNA, 20 bp, Artificial
  CRISPR gRNA sequence
tactgatgcttggagctcct

SEQ ID NO: 402692 - DNA, 20 bp, Artificial
  CRISPR gRNA sequence
actgatgcttggagctcctc

SEQ ID NO: 402693 - DNA, 20 bp, Artificial
  CRISPR gRNA sequence
ctgatgcttggagctcctct

SEQ ID NO: 402694 - DNA, 20 bp, Artificial
  CRISPR gRNA sequence
atgcttggagctcctctgtg

SEQ ID NO: 402695 - DNA, 20 bp, Artificial
  CRISPR gRNA sequence
ggagctcctctgtggcttta

SEQ ID NO: 402696 - DNA, 20 bp, Artificial
  CRISPR gRNA sequence
gagctcctctgtggctttat

SEQ ID NO: 402697 - DNA, 20 bp, Artificial
  CRISPR gRNA sequence
ctctgtggctttatctttga

SEQ ID NO: 402698 - DNA, 20 bp, Artificial
  CRISPR gRNA sequence
tgtggctttatctttgagtt

SEQ ID NO: 402699 - DNA, 20 bp, Artificial
  CRISPR gRNA sequence
tggctttatctttgagttaa

SEQ ID NO: 402700 - DNA, 20 bp, Artificial
  CRISPR gRNA sequence
tatctttgagttaatgctgt

SEQ ID NO: 402701 - DNA, 20 bp, Artificial
  CRISPR gRNA sequence
atctttgagttaatgctgtc

SEQ ID NO: 402702 - DNA, 20 bp, Artificial
  CRISPR gRNA sequence
tctttgagttaatgctgtcc

SEQ ID NO: 402703 - DNA, 20 bp, Artificial
  CRISPR gRNA sequence
tgagttaatgctgtcctgtg

SEQ ID NO: 402704 - DNA, 20 bp, Artificial
  CRISPR gRNA sequence
gagttaatgctgtcctgtga

SEQ ID NO: 402705 - DNA, 20 bp, Artificial
  CRISPR gRNA sequence
agttaatgctgtcctgtgat

SEQ ID NO: 402706 - DNA, 20 bp, Artificial
  CRISPR gRNA sequence
atgctgtcctgtgatggttt

SEQ ID NO: 402707 - DNA, 20 bp, Artificial
  CRISPR gRNA sequence
tcctgtgatggtttaggtag

SEQ ID NO: 402708 - DNA, 20 bp, Artificial
  CRISPR gRNA sequence
tgatggtttaggtagcgtcg

SEQ ID NO: 402709 - DNA, 20 bp, Artificial
  CRISPR gRNA sequence
aggtagcgtcgataaaaaga

SEQ ID NO: 402710 - DNA, 20 bp, Artificial
  CRISPR gRNA sequence
ggtagcgtcgataaaaagat

SEQ ID NO: 402711 - DNA, 20 bp, Artificial
  CRISPR gRNA sequence
gtttctaagttatggttttt

SEQ ID NO: 402712 - DNA, 20 bp, Artificial
  CRISPR gRNA sequence
ctaagttatggtttttgttg

SEQ ID NO: 402713 - DNA, 20 bp, Artificial
  CRISPR gRNA sequence
taagttatggtttttgttgc

SEQ ID NO: 402714 - DNA, 20 bp, Artificial
  CRISPR gRNA sequence
agttatggtttttgttgctg

SEQ ID NO: 402715 - DNA, 20 bp, Artificial
  CRISPR gRNA sequence
tggtttttgttgctggtttt

SEQ ID NO: 402716 - DNA, 20 bp, Artificial
  CRISPR gRNA sequence
ttgttgctggtttttgtttt

SEQ ID NO: 402717 - DNA, 20 bp, Artificial
  CRISPR gRNA sequence
tgttgctggtttttgttttt

SEQ ID NO: 402718 - DNA, 20 bp, Artificial
  CRISPR gRNA sequence
gttgctggtttttgtttttg

SEQ ID NO: 402719 - DNA, 20 bp, Artificial
  CRISPR gRNA sequence
ttgctggtttttgtttttgt

SEQ ID NO: 402720 - DNA, 20 bp, Artificial
  CRISPR gRNA sequence
ctggtttttgtttttgtttg

SEQ ID NO: 402721 - DNA, 20 bp, Artificial
  CRISPR gRNA sequence
gtttttgtttttgtttggtt

SEQ ID NO: 402722 - DNA, 20 bp, Artificial
  CRISPR gRNA sequence
ttgtttttgtttggttttat

SEQ ID NO: 402723 - DNA, 20 bp, Artificial
  CRISPR gRNA sequence
tgtttttgtttggttttata

SEQ ID NO: 402724 - DNA, 20 bp, Artificial
  CRISPR gRNA sequence
gtttttgtttggttttatag

SEQ ID NO: 402725 - DNA, 20 bp, Artificial
  CRISPR gRNA sequence
tttttgtttggttttatagg

SEQ ID NO: 402726 - DNA, 20 bp, Artificial
  CRISPR gRNA sequence
ttgtttggttttatagggag

SEQ ID NO: 402727 - DNA, 20 bp, Artificial
  CRISPR gRNA sequence
tgtttggttttatagggaga

SEQ ID NO: 402728 - DNA, 20 bp, Artificial
  CRISPR gRNA sequence
gtttggttttatagggagag

SEQ ID NO: 402729 - DNA, 20 bp, Artificial
  CRISPR gRNA sequence
tttggttttatagggagagg

SEQ ID NO: 402730 - DNA, 20 bp, Artificial
  CRISPR gRNA sequence
ggttttatagggagaggagg

SEQ ID NO: 402731 - DNA, 20 bp, Artificial
  CRISPR gRNA sequence
gttttatagggagaggaggt

SEQ ID NO: 402732 - DNA, 20 bp, Artificial
  CRISPR gRNA sequence
tatagggagaggaggttgca

SEQ ID NO: 402733 - DNA, 20 bp, Artificial
  CRISPR gRNA sequence
atagggagaggaggttgcag

SEQ ID NO: 402734 - DNA, 20 bp, Artificial
  CRISPR gRNA sequence
tagggagaggaggttgcagg

SEQ ID NO: 402735 - DNA, 20 bp, Artificial
  CRISPR gRNA sequence
caggcagaatggctttttct

SEQ ID NO: 402736 - DNA, 20 bp, Artificial
  CRISPR gRNA sequence
tttctttccgtggagaaaat

SEQ ID NO: 402737 - DNA, 20 bp, Artificial
  CRISPR gRNA sequence
ttctttccgtggagaaaatg

SEQ ID NO: 402738 - DNA, 20 bp, Artificial
  CRISPR gRNA sequence
tctttccgtggagaaaatgg

SEQ ID NO: 402739 - DNA, 20 bp, Artificial
  CRISPR gRNA sequence
ctttccgtggagaaaatggt

SEQ ID NO: 402740 - DNA, 20 bp, Artificial
  CRISPR gRNA sequence
tttccgtggagaaaatggta

SEQ ID NO: 402741 - DNA, 20 bp, Artificial
  CRISPR gRNA sequence
tccgtggagaaaatggtagg

SEQ ID NO: 402742 - DNA, 20 bp, Artificial
  CRISPR gRNA sequence
ccgtggagaaaatggtagga

SEQ ID NO: 402743 - DNA, 20 bp, Artificial
  CRISPR gRNA sequence
cgtggagaaaatggtaggag

SEQ ID NO: 402744 - DNA, 20 bp, Artificial
  CRISPR gRNA sequence
tttctgaagacatttaagat

SEQ ID NO: 402745 - DNA, 20 bp, Artificial
  CRISPR gRNA sequence
ctgaagacatttaagatttt

SEQ ID NO: 402746 - DNA, 20 bp, Artificial
  CRISPR gRNA sequence
tgaagacatttaagattttg

SEQ ID NO: 402747 - DNA, 20 bp, Artificial
  CRISPR gRNA sequence
aagacatttaagattttgaa

SEQ ID NO: 402748 - DNA, 20 bp, Artificial
  CRISPR gRNA sequence
aagattttgaaactgttaag

SEQ ID NO: 402749 - DNA, 20 bp, Artificial
  CRISPR gRNA sequence
agattttgaaactgttaaga

SEQ ID NO: 402750 - DNA, 20 bp, Artificial
  CRISPR gRNA sequence
tgaaactgttaagaatttca

SEQ ID NO: 402751 - DNA, 20 bp, Artificial
  CRISPR gRNA sequence
gaaactgttaagaatttcaa

SEQ ID NO: 402752 - DNA, 20 bp, Artificial
  CRISPR gRNA sequence
aaactgttaagaatttcaag

SEQ ID NO: 402753 - DNA, 20 bp, Artificial
  CRISPR gRNA sequence
ttaagaatttcaagaccatc

SEQ ID NO: 402754 - DNA, 20 bp, Artificial
  CRISPR gRNA sequence
agaatttcaagaccatcaag

SEQ ID NO: 402755 - DNA, 20 bp, Artificial
  CRISPR gRNA sequence
caagaccatcaagtcaatcc

SEQ ID NO: 402756 - DNA, 20 bp, Artificial
  CRISPR gRNA sequence
aagaccatcaagtcaatcct

SEQ ID NO: 402757 - DNA, 20 bp, Artificial
  CRISPR gRNA sequence
cagggatcagtgtgaaatta

SEQ ID NO: 402758 - DNA, 20 bp, Artificial
  CRISPR gRNA sequence
agggatcagtgtgaaattat

SEQ ID NO: 402759 - DNA, 20 bp, Artificial
  CRISPR gRNA sequence
ttccctcaggcaacatctct

SEQ ID NO: 402760 - DNA, 20 bp, Artificial
  CRISPR gRNA sequence
cctcaggcaacatctcttct

SEQ ID NO: 402761 - DNA, 20 bp, Artificial
  CRISPR gRNA sequence
aggcaacatctcttctactt

SEQ ID NO: 402762 - DNA, 20 bp, Artificial
  CRISPR gRNA sequence
ttctacttactcctgagcag

SEQ ID NO: 402763 - DNA, 20 bp, Artificial
  CRISPR gRNA sequence
ctacttactcctgagcagtt

SEQ ID NO: 402764 - DNA, 20 bp, Artificial
  CRISPR gRNA sequence
tacttactcctgagcagttt

SEQ ID NO: 402765 - DNA, 20 bp, Artificial
  CRISPR gRNA sequence
cttactcctgagcagtttta

SEQ ID NO: 402766 - DNA, 20 bp, Artificial
  CRISPR gRNA sequence
actcctgagcagttttaatt

SEQ ID NO: 402767 - DNA, 20 bp, Artificial
  CRISPR gRNA sequence
ctcctgagcagttttaatta

SEQ ID NO: 402768 - DNA, 20 bp, Artificial
  CRISPR gRNA sequence
ctgagcagttttaattaaat

SEQ ID NO: 402769 - DNA, 20 bp, Artificial
  CRISPR gRNA sequence
agcagttttaattaaataac

SEQ ID NO: 402770 - DNA, 20 bp, Artificial
  CRISPR gRNA sequence
taattaaataactcagttga

SEQ ID NO: 402771 - DNA, 20 bp, Artificial
  CRISPR gRNA sequence
aattaaataactcagttgat

SEQ ID NO: 402772 - DNA, 20 bp, Artificial
  CRISPR gRNA sequence
attaaataactcagttgatg

SEQ ID NO: 402773 - DNA, 20 bp, Artificial
  CRISPR gRNA sequence
aataactcagttgatggggc

SEQ ID NO: 402774 - DNA, 20 bp, Artificial
  CRISPR gRNA sequence
agttgatggggcttctggca

SEQ ID NO: 402775 - DNA, 20 bp, Artificial
  CRISPR gRNA sequence
atggggcttctggcacttcc

SEQ ID NO: 402776 - DNA, 20 bp, Artificial
  CRISPR gRNA sequence
ctggcacttcccttgagaga

SEQ ID NO: 402777 - DNA, 20 bp, Artificial
  CRISPR gRNA sequence
tggcacttcccttgagagat

SEQ ID NO: 402778 - DNA, 20 bp, Artificial
  CRISPR gRNA sequence
gcacttcccttgagagatta

SEQ ID NO: 402779 - DNA, 20 bp, Artificial
  CRISPR gRNA sequence
cccttgagagattattcaca

SEQ ID NO: 402780 - DNA, 20 bp, Artificial
  CRISPR gRNA sequence
ccttgagagattattcacaa

SEQ ID NO: 402781 - DNA, 20 bp, Artificial
  CRISPR gRNA sequence
gagagattattcacaatcca

SEQ ID NO: 402782 - DNA, 20 bp, Artificial
  CRISPR gRNA sequence
agagattattcacaatccaa

SEQ ID NO: 402783 - DNA, 20 bp, Artificial
  CRISPR gRNA sequence
ttcacaatccaataactctt

SEQ ID NO: 402784 - DNA, 20 bp, Artificial
  CRISPR gRNA sequence
acaatccaataactcttaat

SEQ ID NO: 402785 - DNA, 20 bp, Artificial
  CRISPR gRNA sequence
ttaatgtgagaaaatttttc

SEQ ID NO: 402786 - DNA, 20 bp, Artificial
  CRISPR gRNA sequence
aatgtgagaaaatttttcct

SEQ ID NO: 402787 - DNA, 20 bp, Artificial
  CRISPR gRNA sequence
atgtgagaaaatttttcctg

SEQ ID NO: 402788 - DNA, 20 bp, Artificial
  CRISPR gRNA sequence
ttcctgacttcagctattta

SEQ ID NO: 402789 - DNA, 20 bp, Artificial
  CRISPR gRNA sequence
tcctgacttcagctatttaa

SEQ ID NO: 402790 - DNA, 20 bp, Artificial
  CRISPR gRNA sequence
cctgacttcagctatttaac

SEQ ID NO: 402791 - DNA, 20 bp, Artificial
  CRISPR gRNA sequence
ctgacttcagctatttaacc

SEQ ID NO: 402792 - DNA, 20 bp, Artificial
  CRISPR gRNA sequence
acttcagctatttaaccaac

SEQ ID NO: 402793 - DNA, 20 bp, Artificial
  CRISPR gRNA sequence
cagctatttaaccaacttac

SEQ ID NO: 402794 - DNA, 20 bp, Artificial
  CRISPR gRNA sequence
agctatttaaccaacttaca

SEQ ID NO: 402795 - DNA, 20 bp, Artificial
  CRISPR gRNA sequence
tttaaccaacttacacttta

SEQ ID NO: 402796 - DNA, 20 bp, Artificial
  CRISPR gRNA sequence
aaccaacttacactttaaaa

SEQ ID NO: 402797 - DNA, 20 bp, Artificial
  CRISPR gRNA sequence
accaacttacactttaaaaa

SEQ ID NO: 402798 - DNA, 20 bp, Artificial
  CRISPR gRNA sequence
acactttaaaaaaatcttct

SEQ ID NO: 402799 - DNA, 20 bp, Artificial
  CRISPR gRNA sequence
cactttaaaaaaatcttctt

SEQ ID NO: 402800 - DNA, 20 bp, Artificial
  CRISPR gRNA sequence
taaaaaaatcttctttgtaa

SEQ ID NO: 402801 - DNA, 20 bp, Artificial
  CRISPR gRNA sequence
aaaaaaatcttctttgtaat

SEQ ID NO: 402802 - DNA, 20 bp, Artificial
  CRISPR gRNA sequence
aaaaaatcttctttgtaatc

SEQ ID NO: 402803 - DNA, 20 bp, Artificial
  CRISPR gRNA sequence
ctttgtaatctgcctcgaga

SEQ ID NO: 402804 - DNA, 20 bp, Artificial
  CRISPR gRNA sequence
tttgtaatctgcctcgagag

SEQ ID NO: 402805 - DNA, 20 bp, Artificial
  CRISPR gRNA sequence
tgtaatctgcctcgagagaa

SEQ ID NO: 402806 - DNA, 20 bp, Artificial
  CRISPR gRNA sequence
gtaatctgcctcgagagaaa

SEQ ID NO: 402807 - DNA, 20 bp, Artificial
  CRISPR gRNA sequence
taatctgcctcgagagaaag

SEQ ID NO: 402808 - DNA, 20 bp, Artificial
  CRISPR gRNA sequence
cctcgagagaaagagccatg

SEQ ID NO: 402809 - DNA, 20 bp, Artificial
  CRISPR gRNA sequence
gagagaaagagccatgtttc

SEQ ID NO: 402810 - DNA, 20 bp, Artificial
  CRISPR gRNA sequence
catagaatactgatataaga

SEQ ID NO: 402811 - DNA, 20 bp, Artificial
  CRISPR gRNA sequence
atagaatactgatataagaa

SEQ ID NO: 402812 - DNA, 20 bp, Artificial
  CRISPR gRNA sequence
atataagaagacttccaagg

SEQ ID NO: 402813 - DNA, 20 bp, Artificial
  CRISPR gRNA sequence
ccaaggatggaggtgtaaaa

SEQ ID NO: 402814 - DNA, 20 bp, Artificial
  CRISPR gRNA sequence
caaggatggaggtgtaaaac

SEQ ID NO: 402815 - DNA, 20 bp, Artificial
  CRISPR gRNA sequence
atacttactagtgttgtaaa

SEQ ID NO: 402816 - DNA, 20 bp, Artificial
  CRISPR gRNA sequence
actagtgttgtaaatagcta

SEQ ID NO: 402817 - DNA, 20 bp, Artificial
  CRISPR gRNA sequence
ctagtgttgtaaatagctat

SEQ ID NO: 402818 - DNA, 20 bp, Artificial
  CRISPR gRNA sequence
gtgttgtaaatagctatgtg

SEQ ID NO: 402819 - DNA, 20 bp, Artificial
  CRISPR gRNA sequence
taaatagctatgtgcatcat

SEQ ID NO: 402820 - DNA, 20 bp, Artificial
  CRISPR gRNA sequence
tgtgcatcatatctgcacac

SEQ ID NO: 402821 - DNA, 20 bp, Artificial
  CRISPR gRNA sequence
cacacagtggtgaccgtggc

SEQ ID NO: 402822 - DNA, 20 bp, Artificial
  CRISPR gRNA sequence
ggcattaattctgggagcat

SEQ ID NO: 402823 - DNA, 20 bp, Artificial
  CRISPR gRNA sequence
attctgggagcatttagctg

SEQ ID NO: 402824 - DNA, 20 bp, Artificial
  CRISPR gRNA sequence
tgggagcatttagctgcacc

SEQ ID NO: 402825 - DNA, 20 bp, Artificial
  CRISPR gRNA sequence
ggagcatttagctgcaccat

SEQ ID NO: 402826 - DNA, 20 bp, Artificial
  CRISPR gRNA sequence
agctgcaccatttaatgagc

SEQ ID NO: 402827 - DNA, 20 bp, Artificial
  CRISPR gRNA sequence
gctgcaccatttaatgagca

SEQ ID NO: 402828 - DNA, 20 bp, Artificial
  CRISPR gRNA sequence
caccatttaatgagcagaat

SEQ ID NO: 402829 - DNA, 20 bp, Artificial
  CRISPR gRNA sequence
aatgagcagaatcctaagaa

SEQ ID NO: 402830 - DNA, 20 bp, Artificial
  CRISPR gRNA sequence
atgagcagaatcctaagaaa

SEQ ID NO: 402831 - DNA, 20 bp, Artificial
  CRISPR gRNA sequence
agaaacttaacattctcatt

SEQ ID NO: 402832 - DNA, 20 bp, Artificial
  CRISPR gRNA sequence
aacattctcattttagcaga

SEQ ID NO: 402833 - DNA, 20 bp, Artificial
  CRISPR gRNA sequence
acattctcattttagcagac

SEQ ID NO: 402834 - DNA, 20 bp, Artificial
  CRISPR gRNA sequence
tcattttagcagacaggctc

SEQ ID NO: 402835 - DNA, 20 bp, Artificial
  CRISPR gRNA sequence
attttagcagacaggctctt

SEQ ID NO: 402836 - DNA, 20 bp, Artificial
  CRISPR gRNA sequence
tagcagacaggctcttaaga

SEQ ID NO: 402837 - DNA, 20 bp, Artificial
  CRISPR gRNA sequence
agcagacaggctcttaagaa

SEQ ID NO: 402838 - DNA, 20 bp, Artificial
  CRISPR gRNA sequence
gcagacaggctcttaagaac

SEQ ID NO: 402839 - DNA, 20 bp, Artificial
  CRISPR gRNA sequence
ttaagaacatacttgttcca

SEQ ID NO: 402840 - DNA, 20 bp, Artificial
  CRISPR gRNA sequence
aagaacatacttgttccaat

SEQ ID NO: 402841 - DNA, 20 bp, Artificial
  CRISPR gRNA sequence
agaacatacttgttccaatt

SEQ ID NO: 402842 - DNA, 20 bp, Artificial
  CRISPR gRNA sequence
gttccaattcttggccagct

SEQ ID NO: 402843 - DNA, 20 bp, Artificial
  CRISPR gRNA sequence
ttccaattcttggccagcta

SEQ ID NO: 402844 - DNA, 20 bp, Artificial
  CRISPR gRNA sequence
caattcttggccagctacat

SEQ ID NO: 402845 - DNA, 20 bp, Artificial
  CRISPR gRNA sequence
ttggccagctacataaaatt

SEQ ID NO: 402846 - DNA, 20 bp, Artificial
  CRISPR gRNA sequence
ggccagctacataaaattct

SEQ ID NO: 402847 - DNA, 20 bp, Artificial
  CRISPR gRNA sequence
gccagctacataaaattcta

SEQ ID NO: 402848 - DNA, 20 bp, Artificial
  CRISPR gRNA sequence
cataaaattctatatgctac

SEQ ID NO: 402849 - DNA, 20 bp, Artificial
  CRISPR gRNA sequence
tatatgctaccaacaccgat

SEQ ID NO: 402850 - DNA, 20 bp, Artificial
  CRISPR gRNA sequence
tatgctaccaacaccgatat

SEQ ID NO: 402851 - DNA, 20 bp, Artificial
  CRISPR gRNA sequence
ccaacaccgatatttccaga

SEQ ID NO: 402852 - DNA, 20 bp, Artificial
  CRISPR gRNA sequence
ccagaattgcttagtgaagg

SEQ ID NO: 402853 - DNA, 20 bp, Artificial
  CRISPR gRNA sequence
cagaattgcttagtgaaggg

SEQ ID NO: 402854 - DNA, 20 bp, Artificial
  CRISPR gRNA sequence
cttagtgaaggggtgtgcgt

SEQ ID NO: 402855 - DNA, 20 bp, Artificial
  CRISPR gRNA sequence
agtgaaggggtgtgcgtgcg

SEQ ID NO: 402856 - DNA, 20 bp, Artificial
  CRISPR gRNA sequence
gtgaaggggtgtgcgtgcgt

SEQ ID NO: 402857 - DNA, 20 bp, Artificial
  CRISPR gRNA sequence
tgtgtggacaggatcatttc

SEQ ID NO: 402858 - DNA, 20 bp, Artificial
  CRISPR gRNA sequence
tgtggacaggatcatttcct

SEQ ID NO: 402859 - DNA, 20 bp, Artificial
  CRISPR gRNA sequence
ccttcatgatatataaagaa

SEQ ID NO: 402860 - DNA, 20 bp, Artificial
  CRISPR gRNA sequence
cttcatgatatataaagaac

SEQ ID NO: 402861 - DNA, 20 bp, Artificial
  CRISPR gRNA sequence
catgatatataaagaacccg

SEQ ID NO: 402862 - DNA, 20 bp, Artificial
  CRISPR gRNA sequence
atgatatataaagaacccga

SEQ ID NO: 402863 - DNA, 20 bp, Artificial
  CRISPR gRNA sequence
tagcaaattttaagtcattt

SEQ ID NO: 402864 - DNA, 20 bp, Artificial
  CRISPR gRNA sequence
taagtcatttacctaattca

SEQ ID NO: 402865 - DNA, 20 bp, Artificial
  CRISPR gRNA sequence
aagtcatttacctaattcat

SEQ ID NO: 402866 - DNA, 20 bp, Artificial
  CRISPR gRNA sequence
agtcatttacctaattcatt

SEQ ID NO: 402867 - DNA, 20 bp, Artificial
  CRISPR gRNA sequence
acctaattcatttcactaat

SEQ ID NO: 402868 - DNA, 20 bp, Artificial
  CRISPR gRNA sequence
cctaattcatttcactaata

SEQ ID NO: 402869 - DNA, 20 bp, Artificial
  CRISPR gRNA sequence
attcatttcactaataggat

SEQ ID NO: 402870 - DNA, 20 bp, Artificial
  CRISPR gRNA sequence
atttcactaataggatacat

SEQ ID NO: 402871 - DNA, 20 bp, Artificial
  CRISPR gRNA sequence
cactaataggatacatttat

SEQ ID NO: 402872 - DNA, 20 bp, Artificial
  CRISPR gRNA sequence
actaataggatacatttatt

SEQ ID NO: 402873 - DNA, 20 bp, Artificial
  CRISPR gRNA sequence
ataggatacatttatttctc

SEQ ID NO: 402874 - DNA, 20 bp, Artificial
  CRISPR gRNA sequence
atttctctttgcaaactgga

SEQ ID NO: 402875 - DNA, 20 bp, Artificial
  CRISPR gRNA sequence
tttctctttgcaaactggaa

SEQ ID NO: 402876 - DNA, 20 bp, Artificial
  CRISPR gRNA sequence
ctctttgcaaactggaagct

SEQ ID NO: 402877 - DNA, 20 bp, Artificial
  CRISPR gRNA sequence
tctttgcaaactggaagctc

SEQ ID NO: 402878 - DNA, 20 bp, Artificial
  CRISPR gRNA sequence
tttgcaaactggaagctcta

SEQ ID NO: 402879 - DNA, 20 bp, Artificial
  CRISPR gRNA sequence
tgcaaactggaagctctagt

SEQ ID NO: 402880 - DNA, 20 bp, Artificial
  CRISPR gRNA sequence
gcaaactggaagctctagtt

SEQ ID NO: 402881 - DNA, 20 bp, Artificial
  CRISPR gRNA sequence
caaactggaagctctagttg

SEQ ID NO: 402882 - DNA, 20 bp, Artificial
  CRISPR gRNA sequence
gaagctctagttgaatgtat

SEQ ID NO: 402883 - DNA, 20 bp, Artificial
  CRISPR gRNA sequence
tagttgaatgtatacctttt

SEQ ID NO: 402884 - DNA, 20 bp, Artificial
  CRISPR gRNA sequence
gttgaatgtatacctttttc

SEQ ID NO: 402885 - DNA, 20 bp, Artificial
  CRISPR gRNA sequence
aatgtatacctttttcatgt

SEQ ID NO: 402886 - DNA, 20 bp, Artificial
  CRISPR gRNA sequence
tttcatgtgagaaacagcca

SEQ ID NO: 402887 - DNA, 20 bp, Artificial
  CRISPR gRNA sequence
ttcatgtgagaaacagccaa

SEQ ID NO: 402888 - DNA, 20 bp, Artificial
  CRISPR gRNA sequence
tcatgtgagaaacagccaaa

SEQ ID NO: 402889 - DNA, 20 bp, Artificial
  CRISPR gRNA sequence
catgtgagaaacagccaaag

SEQ ID NO: 402890 - DNA, 20 bp, Artificial
  CRISPR gRNA sequence
atgtgagaaacagccaaaga

SEQ ID NO: 402891 - DNA, 20 bp, Artificial
  CRISPR gRNA sequence
agttgttgtattggtaatgt

SEQ ID NO: 402892 - DNA, 20 bp, Artificial
  CRISPR gRNA sequence
ttgtattggtaatgttagta

SEQ ID NO: 402893 - DNA, 20 bp, Artificial
  CRISPR gRNA sequence
tattggtaatgttagtatat

SEQ ID NO: 402894 - DNA, 20 bp, Artificial
  CRISPR gRNA sequence
gtaatgttagtatatgtctc

SEQ ID NO: 402895 - DNA, 20 bp, Artificial
  CRISPR gRNA sequence
gtatatgtctccaaaagaga

SEQ ID NO: 402896 - DNA, 20 bp, Artificial
  CRISPR gRNA sequence
caaaagagatcctttgtaaa

SEQ ID NO: 402897 - DNA, 20 bp, Artificial
  CRISPR gRNA sequence
tgtaaagtcccattaactcc

SEQ ID NO: 402898 - DNA, 20 bp, Artificial
  CRISPR gRNA sequence
gtaaagtcccattaactcct

SEQ ID NO: 402899 - DNA, 20 bp, Artificial
  CRISPR gRNA sequence
taaagtcccattaactcctg

SEQ ID NO: 402900 - DNA, 20 bp, Artificial
  CRISPR gRNA sequence
actcctgacatcagatttct

SEQ ID NO: 402901 - DNA, 20 bp, Artificial
  CRISPR gRNA sequence
ctgacatcagatttctcaaa

SEQ ID NO: 402902 - DNA, 20 bp, Artificial
  CRISPR gRNA sequence
acatcagatttctcaaaata

SEQ ID NO: 402903 - DNA, 20 bp, Artificial
  CRISPR gRNA sequence
ctcaaaatacctctttatta

SEQ ID NO: 402904 - DNA, 20 bp, Artificial
  CRISPR gRNA sequence
tcaaaatacctctttattat

SEQ ID NO: 402905 - DNA, 20 bp, Artificial
  CRISPR gRNA sequence
aaaatacctctttattatct

SEQ ID NO: 402906 - DNA, 20 bp, Artificial
  CRISPR gRNA sequence
tttattatcttttaagaaac

SEQ ID NO: 402907 - DNA, 20 bp, Artificial
  CRISPR gRNA sequence
tattatcttttaagaaacat

SEQ ID NO: 402908 - DNA, 20 bp, Artificial
  CRISPR gRNA sequence
attatcttttaagaaacata

SEQ ID NO: 402909 - DNA, 20 bp, Artificial
  CRISPR gRNA sequence
ttatcttttaagaaacatag

SEQ ID NO: 402910 - DNA, 20 bp, Artificial
  CRISPR gRNA sequence
tcttttaagaaacatagttg

SEQ ID NO: 402911 - DNA, 20 bp, Artificial
  CRISPR gRNA sequence
ttaagaaacatagttgctca

SEQ ID NO: 402912 - DNA, 20 bp, Artificial
  CRISPR gRNA sequence
taagaaacatagttgctcat

SEQ ID NO: 402913 - DNA, 20 bp, Artificial
  CRISPR gRNA sequence
aagaaacatagttgctcatt

SEQ ID NO: 402914 - DNA, 20 bp, Artificial
  CRISPR gRNA sequence
agaaacatagttgctcattt

SEQ ID NO: 402915 - DNA, 20 bp, Artificial
  CRISPR gRNA sequence
ctcatttaagtgaaataaag

SEQ ID NO: 402916 - DNA, 20 bp, Artificial
  CRISPR gRNA sequence
atttaagtgaaataaagaat

SEQ ID NO: 402917 - DNA, 20 bp, Artificial
  CRISPR gRNA sequence
aagtgaaataaagaatactt

SEQ ID NO: 402918 - DNA, 20 bp, Artificial
  CRISPR gRNA sequence
agtgaaataaagaatactta

SEQ ID NO: 402919 - DNA, 20 bp, Artificial
  CRISPR gRNA sequence
aacatagggcttgtaacttc

SEQ ID NO: 402920 - DNA, 20 bp, Artificial
  CRISPR gRNA sequence
acatagggcttgtaacttct

SEQ ID NO: 402921 - DNA, 20 bp, Artificial
  CRISPR gRNA sequence
gtaacttcttccttttattc

SEQ ID NO: 402922 - DNA, 20 bp, Artificial
  CRISPR gRNA sequence
taacttcttccttttattct

SEQ ID NO: 402923 - DNA, 20 bp, Artificial
  CRISPR gRNA sequence
cttccttttattctctttaa

SEQ ID NO: 402924 - DNA, 20 bp, Artificial
  CRISPR gRNA sequence
ttccttttattctctttaaa

SEQ ID NO: 402925 - DNA, 20 bp, Artificial
  CRISPR gRNA sequence
ccttttattctctttaaatc

SEQ ID NO: 402926 - DNA, 20 bp, Artificial
  CRISPR gRNA sequence
cttttattctctttaaatcc

SEQ ID NO: 402927 - DNA, 20 bp, Artificial
  CRISPR gRNA sequence
ttattctctttaaatcctat

SEQ ID NO: 402928 - DNA, 20 bp, Artificial
  CRISPR gRNA sequence
tattctctttaaatcctata

SEQ ID NO: 402929 - DNA, 20 bp, Artificial
  CRISPR gRNA sequence
attctctttaaatcctataa

SEQ ID NO: 402930 - DNA, 20 bp, Artificial
  CRISPR gRNA sequence
ttctctttaaatcctataaa

SEQ ID NO: 402931 - DNA, 20 bp, Artificial
  CRISPR gRNA sequence
tctttaaatcctataaatgt

SEQ ID NO: 402932 - DNA, 20 bp, Artificial
  CRISPR gRNA sequence
tttaaatcctataaatgttt

SEQ ID NO: 402933 - DNA, 20 bp, Artificial
  CRISPR gRNA sequence
taaatcctataaatgtttct

SEQ ID NO: 402934 - DNA, 20 bp, Artificial
  CRISPR gRNA sequence
aaatcctataaatgtttctg

SEQ ID NO: 402935 - DNA, 20 bp, Artificial
  CRISPR gRNA sequence
aatcctataaatgtttctgg

SEQ ID NO: 402936 - DNA, 20 bp, Artificial
  CRISPR gRNA sequence
taaatgtttctggaaagagc

SEQ ID NO: 402937 - DNA, 20 bp, Artificial
  CRISPR gRNA sequence
ctggaaagagcaaacattta

SEQ ID NO: 402938 - DNA, 20 bp, Artificial
  CRISPR gRNA sequence
tggaaagagcaaacatttaa

SEQ ID NO: 402939 - DNA, 20 bp, Artificial
  CRISPR gRNA sequence
gaaagagcaaacatttaata

SEQ ID NO: 402940 - DNA, 20 bp, Artificial
  CRISPR gRNA sequence
aataagatgaaaatattttc

SEQ ID NO: 402941 - DNA, 20 bp, Artificial
  CRISPR gRNA sequence
ataagatgaaaatattttca

SEQ ID NO: 402942 - DNA, 20 bp, Artificial
  CRISPR gRNA sequence
tcaactactcacattgtgtt

SEQ ID NO: 402943 - DNA, 20 bp, Artificial
  CRISPR gRNA sequence
caactactcacattgtgttt

SEQ ID NO: 402944 - DNA, 20 bp, Artificial
  CRISPR gRNA sequence
aactactcacattgtgtttc

SEQ ID NO: 402945 - DNA, 20 bp, Artificial
  CRISPR gRNA sequence
ctcacattgtgtttctttgt

SEQ ID NO: 402946 - DNA, 20 bp, Artificial
  CRISPR gRNA sequence
acattgtgtttctttgtgct

SEQ ID NO: 402947 - DNA, 20 bp, Artificial
  CRISPR gRNA sequence
tgtttctttgtgctgacaca

SEQ ID NO: 402948 - DNA, 20 bp, Artificial
  CRISPR gRNA sequence
ctttgtgctgacacagtgtt

SEQ ID NO: 402949 - DNA, 20 bp, Artificial
  CRISPR gRNA sequence
tttgtgctgacacagtgttt

SEQ ID NO: 402950 - DNA, 20 bp, Artificial
  CRISPR gRNA sequence
tgtgctgacacagtgtttga

SEQ ID NO: 402951 - DNA, 20 bp, Artificial
  CRISPR gRNA sequence
gtgctgacacagtgtttgaa

SEQ ID NO: 402952 - DNA, 20 bp, Artificial
  CRISPR gRNA sequence
tgctgacacagtgtttgaat

SEQ ID NO: 402953 - DNA, 20 bp, Artificial
  CRISPR gRNA sequence
acacagtgtttgaattttca

SEQ ID NO: 402954 - DNA, 20 bp, Artificial
  CRISPR gRNA sequence
gaattttcattcttaacatg

SEQ ID NO: 402955 - DNA, 20 bp, Artificial
  CRISPR gRNA sequence
aattttcattcttaacatgg

SEQ ID NO: 402956 - DNA, 20 bp, Artificial
  CRISPR gRNA sequence
tcattcttaacatggtctga

SEQ ID NO: 402957 - DNA, 20 bp, Artificial
  CRISPR gRNA sequence
cattcttaacatggtctgat

SEQ ID NO: 402958 - DNA, 20 bp, Artificial
  CRISPR gRNA sequence
attcttaacatggtctgatt

SEQ ID NO: 402959 - DNA, 20 bp, Artificial
  CRISPR gRNA sequence
ttaacatggtctgattattc

SEQ ID NO: 402960 - DNA, 20 bp, Artificial
  CRISPR gRNA sequence
aacatggtctgattattctg

SEQ ID NO: 402961 - DNA, 20 bp, Artificial
  CRISPR gRNA sequence
acatggtctgattattctgt

SEQ ID NO: 402962 - DNA, 20 bp, Artificial
  CRISPR gRNA sequence
attattctgttttcagtgaa

SEQ ID NO: 402963 - DNA, 20 bp, Artificial
  CRISPR gRNA sequence
ttctgttttcagtgaaaata

SEQ ID NO: 402964 - DNA, 20 bp, Artificial
  CRISPR gRNA sequence
tgttttcagtgaaaatagca

SEQ ID NO: 402965 - DNA, 20 bp, Artificial
  CRISPR gRNA sequence
ttttcagtgaaaatagcaga

SEQ ID NO: 402966 - DNA, 20 bp, Artificial
  CRISPR gRNA sequence
tcagtgaaaatagcagaatt

SEQ ID NO: 402967 - DNA, 20 bp, Artificial
  CRISPR gRNA sequence
cagtgaaaatagcagaattg

SEQ ID NO: 402968 - DNA, 20 bp, Artificial
  CRISPR gRNA sequence
agtgaaaatagcagaattga

SEQ ID NO: 402969 - DNA, 20 bp, Artificial
  CRISPR gRNA sequence
aactaaagggaaaatggcta

SEQ ID NO: 402970 - DNA, 20 bp, Artificial
  CRISPR gRNA sequence
aagggaaaatggctaaacct

SEQ ID NO: 402971 - DNA, 20 bp, Artificial
  CRISPR gRNA sequence
aaccttgttgttgctcaaat

SEQ ID NO: 402972 - DNA, 20 bp, Artificial
  CRISPR gRNA sequence
gttgttgctcaaatgacaca

SEQ ID NO: 402973 - DNA, 20 bp, Artificial
  CRISPR gRNA sequence
ttgttgctcaaatgacacag

SEQ ID NO: 402974 - DNA, 20 bp, Artificial
  CRISPR gRNA sequence
ttgctcaaatgacacagagg

SEQ ID NO: 402975 - DNA, 20 bp, Artificial
  CRISPR gRNA sequence
ctcaaatgacacagaggtaa

SEQ ID NO: 402976 - DNA, 20 bp, Artificial
  CRISPR gRNA sequence
aaatgacacagaggtaattg

SEQ ID NO: 402977 - DNA, 20 bp, Artificial
  CRISPR gRNA sequence
aatctgctttattggatgaa

SEQ ID NO: 402978 - DNA, 20 bp, Artificial
  CRISPR gRNA sequence
ctttattggatgaaggatga

SEQ ID NO: 402979 - DNA, 20 bp, Artificial
  CRISPR gRNA sequence
tattggatgaaggatgataa

SEQ ID NO: 402980 - DNA, 20 bp, Artificial
  CRISPR gRNA sequence
attggatgaaggatgataac

SEQ ID NO: 402981 - DNA, 20 bp, Artificial
  CRISPR gRNA sequence
ttggatgaaggatgataaca

SEQ ID NO: 402982 - DNA, 20 bp, Artificial
  CRISPR gRNA sequence
gatgaaggatgataacagta

SEQ ID NO: 402983 - DNA, 20 bp, Artificial
  CRISPR gRNA sequence
aaaaatccctgtaaatctta

SEQ ID NO: 402984 - DNA, 20 bp, Artificial
  CRISPR gRNA sequence
taaatcttacctaaatctgt

SEQ ID NO: 402985 - DNA, 20 bp, Artificial
  CRISPR gRNA sequence
acctaaatctgttgaataga

SEQ ID NO: 402986 - DNA, 20 bp, Artificial
  CRISPR gRNA sequence
cctaaatctgttgaatagat

SEQ ID NO: 402987 - DNA, 20 bp, Artificial
  CRISPR gRNA sequence
aatctgttgaatagatatta

SEQ ID NO: 402988 - DNA, 20 bp, Artificial
  CRISPR gRNA sequence
ttgaatagatattattgttt

SEQ ID NO: 402989 - DNA, 20 bp, Artificial
  CRISPR gRNA sequence
aatagatattattgtttgct

SEQ ID NO: 402990 - DNA, 20 bp, Artificial
  CRISPR gRNA sequence
ttgtttgctgtgaggaaaag

SEQ ID NO: 402991 - DNA, 20 bp, Artificial
  CRISPR gRNA sequence
tttgctgtgaggaaaagaaa

SEQ ID NO: 402992 - DNA, 20 bp, Artificial
  CRISPR gRNA sequence
gctgtgaggaaaagaaagaa

SEQ ID NO: 402993 - DNA, 20 bp, Artificial
  CRISPR gRNA sequence
ctgtgaggaaaagaaagaat

SEQ ID NO: 402994 - DNA, 20 bp, Artificial
  CRISPR gRNA sequence
tgaggaaaagaaagaatgta

SEQ ID NO: 402995 - DNA, 20 bp, Artificial
  CRISPR gRNA sequence
tacgccatgtaaaacgtttg

SEQ ID NO: 402996 - DNA, 20 bp, Artificial
  CRISPR gRNA sequence
gggccaagtgactgtaatgc

SEQ ID NO: 402997 - DNA, 20 bp, Artificial
  CRISPR gRNA sequence
ggccaagtgactgtaatgca

SEQ ID NO: 402998 - DNA, 20 bp, Artificial
  CRISPR gRNA sequence
taatgcaaggtggaatttgg

SEQ ID NO: 402999 - DNA, 20 bp, Artificial
  CRISPR gRNA sequence
ggaaagtagcttaaagcaag

SEQ ID NO: 403000 - DNA, 20 bp, Artificial
  CRISPR gRNA sequence
gaaagtagcttaaagcaagg

SEQ ID NO: 403001 - DNA, 20 bp, Artificial
  CRISPR gRNA sequence
aaagcaaggtttggggagtt

SEQ ID NO: 403002 - DNA, 20 bp, Artificial
  CRISPR gRNA sequence
aagcaaggtttggggagttg

SEQ ID NO: 403003 - DNA, 20 bp, Artificial
  CRISPR gRNA sequence
ggggagttggaggtgacaga

SEQ ID NO: 403004 - DNA, 20 bp, Artificial
  CRISPR gRNA sequence
gggagttggaggtgacagag

SEQ ID NO: 403005 - DNA, 20 bp, Artificial
  CRISPR gRNA sequence
gaggtgacagaggttacttc

SEQ ID NO: 403006 - DNA, 20 bp, Artificial
  CRISPR gRNA sequence
cttctggtttggggaaacca

SEQ ID NO: 403007 - DNA, 20 bp, Artificial
  CRISPR gRNA sequence
ctggtttggggaaaccatgg

SEQ ID NO: 403008 - DNA, 20 bp, Artificial
  CRISPR gRNA sequence
tggtttggggaaaccatggc

SEQ ID NO: 403009 - DNA, 20 bp, Artificial
  CRISPR gRNA sequence
gtttggggaaaccatggcct

SEQ ID NO: 403010 - DNA, 20 bp, Artificial
  CRISPR gRNA sequence
ggggaaaccatggcctggaa

SEQ ID NO: 403011 - DNA, 20 bp, Artificial
  CRISPR gRNA sequence
gggaaaccatggcctggaaa

SEQ ID NO: 403012 - DNA, 20 bp, Artificial
  CRISPR gRNA sequence
gaaatataggtgtaatttgg

SEQ ID NO: 403013 - DNA, 20 bp, Artificial
  CRISPR gRNA sequence
ggatgaatggagacaagggc

SEQ ID NO: 403014 - DNA, 20 bp, Artificial
  CRISPR gRNA sequence
gatgaatggagacaagggct

SEQ ID NO: 403015 - DNA, 20 bp, Artificial
  CRISPR gRNA sequence
gcaggaagagggaggaagtt

SEQ ID NO: 403016 - DNA, 20 bp, Artificial
  CRISPR gRNA sequence
aaacaggaaagtgcatcaca

SEQ ID NO: 403017 - DNA, 20 bp, Artificial
  CRISPR gRNA sequence
tttgtgtttgaggcacatga

SEQ ID NO: 403018 - DNA, 20 bp, Artificial
  CRISPR gRNA sequence
tgtgtttgaggcacatgaaa

SEQ ID NO: 403019 - DNA, 20 bp, Artificial
  CRISPR gRNA sequence
gtgtttgaggcacatgaaaa

SEQ ID NO: 403020 - DNA, 20 bp, Artificial
  CRISPR gRNA sequence
tgtttgaggcacatgaaaaa

SEQ ID NO: 403021 - DNA, 20 bp, Artificial
  CRISPR gRNA sequence
gaggcacatgaaaaacaaat

SEQ ID NO: 403022 - DNA, 20 bp, Artificial
  CRISPR gRNA sequence
aggcacatgaaaaacaaatt

SEQ ID NO: 403023 - DNA, 20 bp, Artificial
  CRISPR gRNA sequence
ggccagaggcttaggggaag

SEQ ID NO: 403024 - DNA, 20 bp, Artificial
  CRISPR gRNA sequence
gccagaggcttaggggaagg

SEQ ID NO: 403025 - DNA, 20 bp, Artificial
  CRISPR gRNA sequence
aggggaaggtcggagggtgg

SEQ ID NO: 403026 - DNA, 20 bp, Artificial
  CRISPR gRNA sequence
ggggaaggtcggagggtgga

SEQ ID NO: 403027 - DNA, 20 bp, Artificial
  CRISPR gRNA sequence
tggacttcatttggttgtta

SEQ ID NO: 403028 - DNA, 20 bp, Artificial
  CRISPR gRNA sequence
ggacttcatttggttgttag

SEQ ID NO: 403029 - DNA, 20 bp, Artificial
  CRISPR gRNA sequence
gacttcatttggttgttagt

SEQ ID NO: 403030 - DNA, 20 bp, Artificial
  CRISPR gRNA sequence
catttggttgttagtaaagt

SEQ ID NO: 403031 - DNA, 20 bp, Artificial
  CRISPR gRNA sequence
atttggttgttagtaaagtt

SEQ ID NO: 403032 - DNA, 20 bp, Artificial
  CRISPR gRNA sequence
ggttgttagtaaagttttca

SEQ ID NO: 403033 - DNA, 20 bp, Artificial
  CRISPR gRNA sequence
gttgttagtaaagttttcaa

SEQ ID NO: 403034 - DNA, 20 bp, Artificial
  CRISPR gRNA sequence
ttagtaaagttttcaaatag

SEQ ID NO: 403035 - DNA, 20 bp, Artificial
  CRISPR gRNA sequence
gtaaagttttcaaatagtga

SEQ ID NO: 403036 - DNA, 20 bp, Artificial
  CRISPR gRNA sequence
tcaaatagtgaaagtctcat

SEQ ID NO: 403037 - DNA, 20 bp, Artificial
  CRISPR gRNA sequence
caaatagtgaaagtctcatg

SEQ ID NO: 403038 - DNA, 20 bp, Artificial
  CRISPR gRNA sequence
aaatagtgaaagtctcatgt

SEQ ID NO: 403039 - DNA, 20 bp, Artificial
  CRISPR gRNA sequence
atgttggccatgattgggag

SEQ ID NO: 403040 - DNA, 20 bp, Artificial
  CRISPR gRNA sequence
gccatgattgggagccatga

SEQ ID NO: 403041 - DNA, 20 bp, Artificial
  CRISPR gRNA sequence
ggagccatgaccctaccaac

SEQ ID NO: 403042 - DNA, 20 bp, Artificial
  CRISPR gRNA sequence
ccaacagcacggaggatgat

SEQ ID NO: 403043 - DNA, 20 bp, Artificial
  CRISPR gRNA sequence
tggccctgcagtgagggagg

SEQ ID NO: 403044 - DNA, 20 bp, Artificial
  CRISPR gRNA sequence
cagtgagggaggacactgcc

SEQ ID NO: 403045 - DNA, 20 bp, Artificial
  CRISPR gRNA sequence
cccccacggtgcagcccacc

SEQ ID NO: 403046 - DNA, 20 bp, Artificial
  CRISPR gRNA sequence
tccaaattacacaccaggaa

SEQ ID NO: 403047 - DNA, 20 bp, Artificial
  CRISPR gRNA sequence
ccaaattacacaccaggaaa

SEQ ID NO: 403048 - DNA, 20 bp, Artificial
  CRISPR gRNA sequence
caaattacacaccaggaaag

SEQ ID NO: 403049 - DNA, 20 bp, Artificial
  CRISPR gRNA sequence
cacaccaggaaagctcccct

SEQ ID NO: 403050 - DNA, 20 bp, Artificial
  CRISPR gRNA sequence
ccctgctgcaagtttctcct

SEQ ID NO: 403051 - DNA, 20 bp, Artificial
  CRISPR gRNA sequence
ctgcaagtttctccttccca

SEQ ID NO: 403052 - DNA, 20 bp, Artificial
  CRISPR gRNA sequence
caagtttctccttcccattt

SEQ ID NO: 403053 - DNA, 20 bp, Artificial
  CRISPR gRNA sequence
ctccttcccatttccccgct

SEQ ID NO: 403054 - DNA, 20 bp, Artificial
  CRISPR gRNA sequence
tccttcccatttccccgctc

SEQ ID NO: 403055 - DNA, 20 bp, Artificial
  CRISPR gRNA sequence
cttcccatttccccgctctt

SEQ ID NO: 403056 - DNA, 20 bp, Artificial
  CRISPR gRNA sequence
cccatttccccgctctttaa

SEQ ID NO: 403057 - DNA, 20 bp, Artificial
  CRISPR gRNA sequence
ccatttccccgctctttaat

SEQ ID NO: 403058 - DNA, 20 bp, Artificial
  CRISPR gRNA sequence
ccccgctctttaattctata

SEQ ID NO: 403059 - DNA, 20 bp, Artificial
  CRISPR gRNA sequence
cccgctctttaattctataa

SEQ ID NO: 403060 - DNA, 20 bp, Artificial
  CRISPR gRNA sequence
tttaattctataaatgttta

SEQ ID NO: 403061 - DNA, 20 bp, Artificial
  CRISPR gRNA sequence
taattctataaatgtttatt

SEQ ID NO: 403062 - DNA, 20 bp, Artificial
  CRISPR gRNA sequence
aattctataaatgtttattg

SEQ ID NO: 403063 - DNA, 20 bp, Artificial
  CRISPR gRNA sequence
attctataaatgtttattga

SEQ ID NO: 403064 - DNA, 20 bp, Artificial
  CRISPR gRNA sequence
tataaatgtttattgaatgt

SEQ ID NO: 403065 - DNA, 20 bp, Artificial
  CRISPR gRNA sequence
taaatgtttattgaatgtct

SEQ ID NO: 403066 - DNA, 20 bp, Artificial
  CRISPR gRNA sequence
attgaatgtctgtcatatgc

SEQ ID NO: 403067 - DNA, 20 bp, Artificial
  CRISPR gRNA sequence
ttgaatgtctgtcatatgct

SEQ ID NO: 403068 - DNA, 20 bp, Artificial
  CRISPR gRNA sequence
aatgtctgtcatatgctggg

SEQ ID NO: 403069 - DNA, 20 bp, Artificial
  CRISPR gRNA sequence
tcatatgctgggcctgtgtg

SEQ ID NO: 403070 - DNA, 20 bp, Artificial
  CRISPR gRNA sequence
ggcctgtgtgaggttggagg

SEQ ID NO: 403071 - DNA, 20 bp, Artificial
  CRISPR gRNA sequence
tgtgaggttggaggcataca

SEQ ID NO: 403072 - DNA, 20 bp, Artificial
  CRISPR gRNA sequence
gaggcatacaggagaaatgt

SEQ ID NO: 403073 - DNA, 20 bp, Artificial
  CRISPR gRNA sequence
atctcaagctcaaggctctg

SEQ ID NO: 403074 - DNA, 20 bp, Artificial
  CRISPR gRNA sequence
aagctcaaggctctgtgtga

SEQ ID NO: 403075 - DNA, 20 bp, Artificial
  CRISPR gRNA sequence
aaggctctgtgtgacttgat

SEQ ID NO: 403076 - DNA, 20 bp, Artificial
  CRISPR gRNA sequence
tgtgtgacttgatgcttaca

SEQ ID NO: 403077 - DNA, 20 bp, Artificial
  CRISPR gRNA sequence
tgtgacttgatgcttacatt

SEQ ID NO: 403078 - DNA, 20 bp, Artificial
  CRISPR gRNA sequence
gatgcttacattgtttgtgt

SEQ ID NO: 403079 - DNA, 20 bp, Artificial
  CRISPR gRNA sequence
atgcttacattgtttgtgtg

SEQ ID NO: 403080 - DNA, 20 bp, Artificial
  CRISPR gRNA sequence
acattgtttgtgtgcagagg

SEQ ID NO: 403081 - DNA, 20 bp, Artificial
  CRISPR gRNA sequence
cattgtttgtgtgcagagga

SEQ ID NO: 403082 - DNA, 20 bp, Artificial
  CRISPR gRNA sequence
tttgtgtgcagaggacggga

SEQ ID NO: 403083 - DNA, 20 bp, Artificial
  CRISPR gRNA sequence
gtgtgcagaggacgggaatt

SEQ ID NO: 403084 - DNA, 20 bp, Artificial
  CRISPR gRNA sequence
tgtgcagaggacgggaattg

SEQ ID NO: 403085 - DNA, 20 bp, Artificial
  CRISPR gRNA sequence
gtggagctaggagtgggtcg

SEQ ID NO: 403086 - DNA, 20 bp, Artificial
  CRISPR gRNA sequence
ggagtgggtcgtgacagtgt

SEQ ID NO: 403087 - DNA, 20 bp, Artificial
  CRISPR gRNA sequence
tggagtgagggaaggggtca

SEQ ID NO: 403088 - DNA, 20 bp, Artificial
  CRISPR gRNA sequence
aaggaacttcagagatcaga

SEQ ID NO: 403089 - DNA, 20 bp, Artificial
  CRISPR gRNA sequence
cagagatcagaagacacgag

SEQ ID NO: 403090 - DNA, 20 bp, Artificial
  CRISPR gRNA sequence
agagatcagaagacacgaga

SEQ ID NO: 403091 - DNA, 20 bp, Artificial
  CRISPR gRNA sequence
actcatgagggaagatgaga

SEQ ID NO: 403092 - DNA, 20 bp, Artificial
  CRISPR gRNA sequence
ctcatgagggaagatgagaa

SEQ ID NO: 403093 - DNA, 20 bp, Artificial
  CRISPR gRNA sequence
atgagggaagatgagaacgg

SEQ ID NO: 403094 - DNA, 20 bp, Artificial
  CRISPR gRNA sequence
aagcgtggtcatgctgttag

SEQ ID NO: 403095 - DNA, 20 bp, Artificial
  CRISPR gRNA sequence
ttagctggatggcattcctg

SEQ ID NO: 403096 - DNA, 20 bp, Artificial
  CRISPR gRNA sequence
gctggatggcattcctgctg

SEQ ID NO: 403097 - DNA, 20 bp, Artificial
  CRISPR gRNA sequence
gatggcattcctgctggagg

SEQ ID NO: 403098 - DNA, 20 bp, Artificial
  CRISPR gRNA sequence
ctgctggagggaaatcatgc

SEQ ID NO: 403099 - DNA, 20 bp, Artificial
  CRISPR gRNA sequence
ctggagggaaatcatgctaa

SEQ ID NO: 403100 - DNA, 20 bp, Artificial
  CRISPR gRNA sequence
gagggaaatcatgctaatgg

SEQ ID NO: 403101 - DNA, 20 bp, Artificial
  CRISPR gRNA sequence
atggcgcaaaagcaaaatga

SEQ ID NO: 403102 - DNA, 20 bp, Artificial
  CRISPR gRNA sequence
gtgtgcttgggaattgcagg

SEQ ID NO: 403103 - DNA, 20 bp, Artificial
  CRISPR gRNA sequence
gggaattgcaggatggatca

SEQ ID NO: 403104 - DNA, 20 bp, Artificial
  CRISPR gRNA sequence
ggaattgcaggatggatcat

SEQ ID NO: 403105 - DNA, 20 bp, Artificial
  CRISPR gRNA sequence
caggatggatcataaagcct

SEQ ID NO: 403106 - DNA, 20 bp, Artificial
  CRISPR gRNA sequence
agtaaaagctaatttaagtg

SEQ ID NO: 403107 - DNA, 20 bp, Artificial
  CRISPR gRNA sequence
atttaagtgggtagtggtgc

SEQ ID NO: 403108 - DNA, 20 bp, Artificial
  CRISPR gRNA sequence
aagtgggtagtggtgccagg

SEQ ID NO: 403109 - DNA, 20 bp, Artificial
  CRISPR gRNA sequence
agtgggtagtggtgccaggt

SEQ ID NO: 403110 - DNA, 20 bp, Artificial
  CRISPR gRNA sequence
ggaggggtggatagtggtga

SEQ ID NO: 403111 - DNA, 20 bp, Artificial
  CRISPR gRNA sequence
gaggggtggatagtggtgat

SEQ ID NO: 403112 - DNA, 20 bp, Artificial
  CRISPR gRNA sequence
gatgtgtgatcagcaggagc

SEQ ID NO: 403113 - DNA, 20 bp, Artificial
  CRISPR gRNA sequence
atgtgtgatcagcaggagct

SEQ ID NO: 403114 - DNA, 20 bp, Artificial
  CRISPR gRNA sequence
cagatttttgcttagaagag

SEQ ID NO: 403115 - DNA, 20 bp, Artificial
  CRISPR gRNA sequence
ttgcttagaagagggggcat

SEQ ID NO: 403116 - DNA, 20 bp, Artificial
  CRISPR gRNA sequence
tgcttagaagagggggcatt

SEQ ID NO: 403117 - DNA, 20 bp, Artificial
  CRISPR gRNA sequence
gcttagaagagggggcattc

SEQ ID NO: 403118 - DNA, 20 bp, Artificial
  CRISPR gRNA sequence
cttagaagagggggcattca

SEQ ID NO: 403119 - DNA, 20 bp, Artificial
  CRISPR gRNA sequence
agaagagggggcattcagaa

SEQ ID NO: 403120 - DNA, 20 bp, Artificial
  CRISPR gRNA sequence
gaagagggggcattcagaac

SEQ ID NO: 403121 - DNA, 20 bp, Artificial
  CRISPR gRNA sequence
agaacacttgatttggaact

SEQ ID NO: 403122 - DNA, 20 bp, Artificial
  CRISPR gRNA sequence
gatttggaactgcatgttca

SEQ ID NO: 403123 - DNA, 20 bp, Artificial
  CRISPR gRNA sequence
atttggaactgcatgttcac

SEQ ID NO: 403124 - DNA, 20 bp, Artificial
  CRISPR gRNA sequence
ggaactgcatgttcacagca

SEQ ID NO: 403125 - DNA, 20 bp, Artificial
  CRISPR gRNA sequence
gaactgcatgttcacagcaa

SEQ ID NO: 403126 - DNA, 20 bp, Artificial
  CRISPR gRNA sequence
catgttcacagcaaacccac

SEQ ID NO: 403127 - DNA, 20 bp, Artificial
  CRISPR gRNA sequence
acagcaaacccacatgctta

SEQ ID NO: 403128 - DNA, 20 bp, Artificial
  CRISPR gRNA sequence
acttagatgcattttctttg

SEQ ID NO: 403129 - DNA, 20 bp, Artificial
  CRISPR gRNA sequence
cttagatgcattttctttgc

SEQ ID NO: 403130 - DNA, 20 bp, Artificial
  CRISPR gRNA sequence
agatgcattttctttgcagt

SEQ ID NO: 403131 - DNA, 20 bp, Artificial
  CRISPR gRNA sequence
gatgcattttctttgcagtg

SEQ ID NO: 403132 - DNA, 20 bp, Artificial
  CRISPR gRNA sequence
tctttgcagtgggctgggag

SEQ ID NO: 403133 - DNA, 20 bp, Artificial
  CRISPR gRNA sequence
ctttgcagtgggctgggagt

SEQ ID NO: 403134 - DNA, 20 bp, Artificial
  CRISPR gRNA sequence
tttgcagtgggctgggagta

SEQ ID NO: 403135 - DNA, 20 bp, Artificial
  CRISPR gRNA sequence
tgcagtgggctgggagtagg

SEQ ID NO: 403136 - DNA, 20 bp, Artificial
  CRISPR gRNA sequence
gcagtgggctgggagtagga

SEQ ID NO: 403137 - DNA, 20 bp, Artificial
  CRISPR gRNA sequence
cagtgggctgggagtaggag

SEQ ID NO: 403138 - DNA, 20 bp, Artificial
  CRISPR gRNA sequence
ggagtaggagctttacttcc

SEQ ID NO: 403139 - DNA, 20 bp, Artificial
  CRISPR gRNA sequence
tacttccctctagttacatt

SEQ ID NO: 403140 - DNA, 20 bp, Artificial
  CRISPR gRNA sequence
acttccctctagttacattg

SEQ ID NO: 403141 - DNA, 20 bp, Artificial
  CRISPR gRNA sequence
cttccctctagttacattgt

SEQ ID NO: 403142 - DNA, 20 bp, Artificial
  CRISPR gRNA sequence
ccctctagttacattgtcgt

SEQ ID NO: 403143 - DNA, 20 bp, Artificial
  CRISPR gRNA sequence
cctctagttacattgtcgtg

SEQ ID NO: 403144 - DNA, 20 bp, Artificial
  CRISPR gRNA sequence
tagttacattgtcgtgtcat

SEQ ID NO: 403145 - DNA, 20 bp, Artificial
  CRISPR gRNA sequence
gttacattgtcgtgtcatgt

SEQ ID NO: 403146 - DNA, 20 bp, Artificial
  CRISPR gRNA sequence
cattgtcgtgtcatgtcaca

SEQ ID NO: 403147 - DNA, 20 bp, Artificial
  CRISPR gRNA sequence
tcgtgtcatgtcacaaatgt

SEQ ID NO: 403148 - DNA, 20 bp, Artificial
  CRISPR gRNA sequence
ttctaagatattttgacttt

SEQ ID NO: 403149 - DNA, 20 bp, Artificial
  CRISPR gRNA sequence
taagatattttgactttaga

SEQ ID NO: 403150 - DNA, 20 bp, Artificial
  CRISPR gRNA sequence
agatattttgactttagatt

SEQ ID NO: 403151 - DNA, 20 bp, Artificial
  CRISPR gRNA sequence
tgactttagattttaggcaa

SEQ ID NO: 403152 - DNA, 20 bp, Artificial
  CRISPR gRNA sequence
gactttagattttaggcaag

SEQ ID NO: 403153 - DNA, 20 bp, Artificial
  CRISPR gRNA sequence
actttagattttaggcaagg

SEQ ID NO: 403154 - DNA, 20 bp, Artificial
  CRISPR gRNA sequence
tagattttaggcaagggatt

SEQ ID NO: 403155 - DNA, 20 bp, Artificial
  CRISPR gRNA sequence
agattttaggcaagggattt

SEQ ID NO: 403156 - DNA, 20 bp, Artificial
  CRISPR gRNA sequence
gattttaggcaagggatttc

SEQ ID NO: 403157 - DNA, 20 bp, Artificial
  CRISPR gRNA sequence
taggcaagggatttcgatta

SEQ ID NO: 403158 - DNA, 20 bp, Artificial
  CRISPR gRNA sequence
aggcaagggatttcgattag

SEQ ID NO: 403159 - DNA, 20 bp, Artificial
  CRISPR gRNA sequence
ggcaagggatttcgattagt

SEQ ID NO: 403160 - DNA, 20 bp, Artificial
  CRISPR gRNA sequence
cgattagtctgcagttagaa

SEQ ID NO: 403161 - DNA, 20 bp, Artificial
  CRISPR gRNA sequence
gattagtctgcagttagaaa

SEQ ID NO: 403162 - DNA, 20 bp, Artificial
  CRISPR gRNA sequence
gtctgcagttagaaagagca

SEQ ID NO: 403163 - DNA, 20 bp, Artificial
  CRISPR gRNA sequence
cagttagaaagagcactcag

SEQ ID NO: 403164 - DNA, 20 bp, Artificial
  CRISPR gRNA sequence
gaaagagcactcagacaggg

SEQ ID NO: 403165 - DNA, 20 bp, Artificial
  CRISPR gRNA sequence
agacagggtttagaagagag

SEQ ID NO: 403166 - DNA, 20 bp, Artificial
  CRISPR gRNA sequence
agaagagagattggaagtaa

SEQ ID NO: 403167 - DNA, 20 bp, Artificial
  CRISPR gRNA sequence
gaagagagattggaagtaag

SEQ ID NO: 403168 - DNA, 20 bp, Artificial
  CRISPR gRNA sequence
gaagtaagagagaatagagg

SEQ ID NO: 403169 - DNA, 20 bp, Artificial
  CRISPR gRNA sequence
tgtccccaagtttatttggt

SEQ ID NO: 403170 - DNA, 20 bp, Artificial
  CRISPR gRNA sequence
atttggtgaagttgcaactc

SEQ ID NO: 403171 - DNA, 20 bp, Artificial
  CRISPR gRNA sequence
tttggtgaagttgcaactcc

SEQ ID NO: 403172 - DNA, 20 bp, Artificial
  CRISPR gRNA sequence
ggtgaagttgcaactcctga

SEQ ID NO: 403173 - DNA, 20 bp, Artificial
  CRISPR gRNA sequence
gtgaagttgcaactcctgat

SEQ ID NO: 403174 - DNA, 20 bp, Artificial
  CRISPR gRNA sequence
caactcctgatatctcagaa

SEQ ID NO: 403175 - DNA, 20 bp, Artificial
  CRISPR gRNA sequence
ctgatatctcagaaggtgac

SEQ ID NO: 403176 - DNA, 20 bp, Artificial
  CRISPR gRNA sequence
atatctcagaaggtgactat

SEQ ID NO: 403177 - DNA, 20 bp, Artificial
  CRISPR gRNA sequence
agaaggtgactatttggaaa

SEQ ID NO: 403178 - DNA, 20 bp, Artificial
  CRISPR gRNA sequence
tttggaaatgaggcttttaa

SEQ ID NO: 403179 - DNA, 20 bp, Artificial
  CRISPR gRNA sequence
ggaaatgaggcttttaaaga

SEQ ID NO: 403180 - DNA, 20 bp, Artificial
  CRISPR gRNA sequence
gaaatgaggcttttaaagag

SEQ ID NO: 403181 - DNA, 20 bp, Artificial
  CRISPR gRNA sequence
ttaaagaggtaattaagtta

SEQ ID NO: 403182 - DNA, 20 bp, Artificial
  CRISPR gRNA sequence
taaagaggtaattaagttaa

SEQ ID NO: 403183 - DNA, 20 bp, Artificial
  CRISPR gRNA sequence
aaagaggtaattaagttaaa

SEQ ID NO: 403184 - DNA, 20 bp, Artificial
  CRISPR gRNA sequence
aagaggtaattaagttaaaa

SEQ ID NO: 403185 - DNA, 20 bp, Artificial
  CRISPR gRNA sequence
agttaaaatgaggttattag

SEQ ID NO: 403186 - DNA, 20 bp, Artificial
  CRISPR gRNA sequence
aaatgaggttattagggtgg

SEQ ID NO: 403187 - DNA, 20 bp, Artificial
  CRISPR gRNA sequence
ttagggtgggatctaatcca

SEQ ID NO: 403188 - DNA, 20 bp, Artificial
  CRISPR gRNA sequence
gggtgggatctaatccaata

SEQ ID NO: 403189 - DNA, 20 bp, Artificial
  CRISPR gRNA sequence
atccaatatgactggtttcc

SEQ ID NO: 403190 - DNA, 20 bp, Artificial
  CRISPR gRNA sequence
gtttccaaataagaagagga

SEQ ID NO: 403191 - DNA, 20 bp, Artificial
  CRISPR gRNA sequence
ccaaataagaagaggagatt

SEQ ID NO: 403192 - DNA, 20 bp, Artificial
  CRISPR gRNA sequence
caaataagaagaggagatta

SEQ ID NO: 403193 - DNA, 20 bp, Artificial
  CRISPR gRNA sequence
ggacacagagggtcatctgg

SEQ ID NO: 403194 - DNA, 20 bp, Artificial
  CRISPR gRNA sequence
gaaaccaaggagagaggcct

SEQ ID NO: 403195 - DNA, 20 bp, Artificial
  CRISPR gRNA sequence
aaaaggaatcaaccctgctg

SEQ ID NO: 403196 - DNA, 20 bp, Artificial
  CRISPR gRNA sequence
ctggcacctgaattttgggt

SEQ ID NO: 403197 - DNA, 20 bp, Artificial
  CRISPR gRNA sequence
gcacctgaattttgggtttc

SEQ ID NO: 403198 - DNA, 20 bp, Artificial
  CRISPR gRNA sequence
aattttgggtttctagcctg

SEQ ID NO: 403199 - DNA, 20 bp, Artificial
  CRISPR gRNA sequence
tgggtttctagcctgcagaa

SEQ ID NO: 403200 - DNA, 20 bp, Artificial
  CRISPR gRNA sequence
gggtttctagcctgcagaat

SEQ ID NO: 403201 - DNA, 20 bp, Artificial
  CRISPR gRNA sequence
ggtttctagcctgcagaatt

SEQ ID NO: 403202 - DNA, 20 bp, Artificial
  CRISPR gRNA sequence
ctagcctgcagaattgcgat

SEQ ID NO: 403203 - DNA, 20 bp, Artificial
  CRISPR gRNA sequence
tagcctgcagaattgcgata

SEQ ID NO: 403204 - DNA, 20 bp, Artificial
  CRISPR gRNA sequence
gcctgcagaattgcgataaa

SEQ ID NO: 403205 - DNA, 20 bp, Artificial
  CRISPR gRNA sequence
cagaattgcgataaaataag

SEQ ID NO: 403206 - DNA, 20 bp, Artificial
  CRISPR gRNA sequence
cgataaaataagtttctgtt

SEQ ID NO: 403207 - DNA, 20 bp, Artificial
  CRISPR gRNA sequence
ctgttgtttaagccatccag

SEQ ID NO: 403208 - DNA, 20 bp, Artificial
  CRISPR gRNA sequence
tgttgtttaagccatccagt

SEQ ID NO: 403209 - DNA, 20 bp, Artificial
  CRISPR gRNA sequence
ttgtttaagccatccagtct

SEQ ID NO: 403210 - DNA, 20 bp, Artificial
  CRISPR gRNA sequence
tttaagccatccagtctgtg

SEQ ID NO: 403211 - DNA, 20 bp, Artificial
  CRISPR gRNA sequence
aagccatccagtctgtggta

SEQ ID NO: 403212 - DNA, 20 bp, Artificial
  CRISPR gRNA sequence
agccatccagtctgtggtac

SEQ ID NO: 403213 - DNA, 20 bp, Artificial
  CRISPR gRNA sequence
tggtactttattatggcagc

SEQ ID NO: 403214 - DNA, 20 bp, Artificial
  CRISPR gRNA sequence
tattatggcagccctagcaa

SEQ ID NO: 403215 - DNA, 20 bp, Artificial
  CRISPR gRNA sequence
attatggcagccctagcaaa

SEQ ID NO: 403216 - DNA, 20 bp, Artificial
  CRISPR gRNA sequence
ttatggcagccctagcaaac

SEQ ID NO: 403217 - DNA, 20 bp, Artificial
  CRISPR gRNA sequence
tggcagccctagcaaactaa

SEQ ID NO: 403218 - DNA, 20 bp, Artificial
  CRISPR gRNA sequence
gcaaactaatgcagaggtga

SEQ ID NO: 403219 - DNA, 20 bp, Artificial
  CRISPR gRNA sequence
atgcagaggtgatgggaata

SEQ ID NO: 403220 - DNA, 20 bp, Artificial
  CRISPR gRNA sequence
aactaaggcagcttaagtgg

SEQ ID NO: 403221 - DNA, 20 bp, Artificial
  CRISPR gRNA sequence
aggcagcttaagtggggata

SEQ ID NO: 403222 - DNA, 20 bp, Artificial
  CRISPR gRNA sequence
aagtggggataaagcagatg

SEQ ID NO: 403223 - DNA, 20 bp, Artificial
  CRISPR gRNA sequence
agtggggataaagcagatgg

SEQ ID NO: 403224 - DNA, 20 bp, Artificial
  CRISPR gRNA sequence
aagatgaattttattcctag

SEQ ID NO: 403225 - DNA, 20 bp, Artificial
  CRISPR gRNA sequence
tattcctagtgtgttcttca

SEQ ID NO: 403226 - DNA, 20 bp, Artificial
  CRISPR gRNA sequence
attcctagtgtgttcttcat

SEQ ID NO: 403227 - DNA, 20 bp, Artificial
  CRISPR gRNA sequence
ttcctagtgtgttcttcatt

SEQ ID NO: 403228 - DNA, 20 bp, Artificial
  CRISPR gRNA sequence
ctagtgtgttcttcattatt

SEQ ID NO: 403229 - DNA, 20 bp, Artificial
  CRISPR gRNA sequence
gtgtgttcttcattattctg

SEQ ID NO: 403230 - DNA, 20 bp, Artificial
  CRISPR gRNA sequence
ttcattattctgaattcttc

SEQ ID NO: 403231 - DNA, 20 bp, Artificial
  CRISPR gRNA sequence
cattattctgaattcttccc

SEQ ID NO: 403232 - DNA, 20 bp, Artificial
  CRISPR gRNA sequence
attattctgaattcttcccc

SEQ ID NO: 403233 - DNA, 20 bp, Artificial
  CRISPR gRNA sequence
ttctgaattcttcccctctt

SEQ ID NO: 403234 - DNA, 20 bp, Artificial
  CRISPR gRNA sequence
tgaattcttcccctcttgaa

SEQ ID NO: 403235 - DNA, 20 bp, Artificial
  CRISPR gRNA sequence
aattcttcccctcttgaaga

SEQ ID NO: 403236 - DNA, 20 bp, Artificial
  CRISPR gRNA sequence
ttcccctcttgaagattcag

SEQ ID NO: 403237 - DNA, 20 bp, Artificial
  CRISPR gRNA sequence
cccctcttgaagattcaggt

SEQ ID NO: 403238 - DNA, 20 bp, Artificial
  CRISPR gRNA sequence
ccctcttgaagattcaggtc

SEQ ID NO: 403239 - DNA, 20 bp, Artificial
  CRISPR gRNA sequence
ttgaagattcaggtcttaca

SEQ ID NO: 403240 - DNA, 20 bp, Artificial
  CRISPR gRNA sequence
gaagattcaggtcttacatt

SEQ ID NO: 403241 - DNA, 20 bp, Artificial
  CRISPR gRNA sequence
aagattcaggtcttacattt

SEQ ID NO: 403242 - DNA, 20 bp, Artificial
  CRISPR gRNA sequence
aggtcttacattttaaaaaa

SEQ ID NO: 403243 - DNA, 20 bp, Artificial
  CRISPR gRNA sequence
acattttaaaaaactattac

SEQ ID NO: 403244 - DNA, 20 bp, Artificial
  CRISPR gRNA sequence
cattttaaaaaactattaca

SEQ ID NO: 403245 - DNA, 20 bp, Artificial
  CRISPR gRNA sequence
taaaaaactattacaactgc

SEQ ID NO: 403246 - DNA, 20 bp, Artificial
  CRISPR gRNA sequence
aaaaaactattacaactgcc

SEQ ID NO: 403247 - DNA, 20 bp, Artificial
  CRISPR gRNA sequence
aaaaactattacaactgcca

SEQ ID NO: 403248 - DNA, 20 bp, Artificial
  CRISPR gRNA sequence
ttacaactgccagagctttg

SEQ ID NO: 403249 - DNA, 20 bp, Artificial
  CRISPR gRNA sequence
caactgccagagctttggct

SEQ ID NO: 403250 - DNA, 20 bp, Artificial
  CRISPR gRNA sequence
ccagagctttggctcagaaa

SEQ ID NO: 403251 - DNA, 20 bp, Artificial
  CRISPR gRNA sequence
tggctcagaaattgctggaa

SEQ ID NO: 403252 - DNA, 20 bp, Artificial
  CRISPR gRNA sequence
ggctcagaaattgctggaac

SEQ ID NO: 403253 - DNA, 20 bp, Artificial
  CRISPR gRNA sequence
gctcagaaattgctggaaca

SEQ ID NO: 403254 - DNA, 20 bp, Artificial
  CRISPR gRNA sequence
agaaattgctggaacactgc

SEQ ID NO: 403255 - DNA, 20 bp, Artificial
  CRISPR gRNA sequence
ctggaacactgctccctgcc

SEQ ID NO: 403256 - DNA, 20 bp, Artificial
  CRISPR gRNA sequence
gaacactgctccctgcctac

SEQ ID NO: 403257 - DNA, 20 bp, Artificial
  CRISPR gRNA sequence
ctccctgcctacttgctttg

SEQ ID NO: 403258 - DNA, 20 bp, Artificial
  CRISPR gRNA sequence
cctgcctacttgctttgtca

SEQ ID NO: 403259 - DNA, 20 bp, Artificial
  CRISPR gRNA sequence
cctacttgctttgtcaaagt

SEQ ID NO: 403260 - DNA, 20 bp, Artificial
  CRISPR gRNA sequence
cttgctttgtcaaagtttca

SEQ ID NO: 403261 - DNA, 20 bp, Artificial
  CRISPR gRNA sequence
gctttgtcaaagtttcactc

SEQ ID NO: 403262 - DNA, 20 bp, Artificial
  CRISPR gRNA sequence
ctttgtcaaagtttcactca

SEQ ID NO: 403263 - DNA, 20 bp, Artificial
  CRISPR gRNA sequence
tgtcaaagtttcactcatgg

SEQ ID NO: 403264 - DNA, 20 bp, Artificial
  CRISPR gRNA sequence
gtcaaagtttcactcatggt

SEQ ID NO: 403265 - DNA, 20 bp, Artificial
  CRISPR gRNA sequence
tcaaagtttcactcatggtt

SEQ ID NO: 403266 - DNA, 20 bp, Artificial
  CRISPR gRNA sequence
cactcatggttctgtcggtc

SEQ ID NO: 403267 - DNA, 20 bp, Artificial
  CRISPR gRNA sequence
actcatggttctgtcggtct

SEQ ID NO: 403268 - DNA, 20 bp, Artificial
  CRISPR gRNA sequence
atggttctgtcggtctctct

SEQ ID NO: 403269 - DNA, 20 bp, Artificial
  CRISPR gRNA sequence
tgtcggtctctctaccttaa

SEQ ID NO: 403270 - DNA, 20 bp, Artificial
  CRISPR gRNA sequence
tcggtctctctaccttaatt

SEQ ID NO: 403271 - DNA, 20 bp, Artificial
  CRISPR gRNA sequence
tctaccttaatttgtgtttt

SEQ ID NO: 403272 - DNA, 20 bp, Artificial
  CRISPR gRNA sequence
taccttaatttgtgttttgc

SEQ ID NO: 403273 - DNA, 20 bp, Artificial
  CRISPR gRNA sequence
ccttaatttgtgttttgcag

SEQ ID NO: 403274 - DNA, 20 bp, Artificial
  CRISPR gRNA sequence
aatttgtgttttgcagtgca

SEQ ID NO: 403275 - DNA, 20 bp, Artificial
  CRISPR gRNA sequence
atttgtgttttgcagtgcac

SEQ ID NO: 403276 - DNA, 20 bp, Artificial
  CRISPR gRNA sequence
gtgttttgcagtgcacacac

SEQ ID NO: 403277 - DNA, 20 bp, Artificial
  CRISPR gRNA sequence
tgttttgcagtgcacacacc

SEQ ID NO: 403278 - DNA, 20 bp, Artificial
  CRISPR gRNA sequence
tgcagtgcacacacctccat

SEQ ID NO: 403279 - DNA, 20 bp, Artificial
  CRISPR gRNA sequence
gcagtgcacacacctccatc

SEQ ID NO: 403280 - DNA, 20 bp, Artificial
  CRISPR gRNA sequence
cagtgcacacacctccatct

SEQ ID NO: 403281 - DNA, 20 bp, Artificial
  CRISPR gRNA sequence
catctttcccagaattagta

SEQ ID NO: 403282 - DNA, 20 bp, Artificial
  CRISPR gRNA sequence
tcccagaattagtacactta

SEQ ID NO: 403283 - DNA, 20 bp, Artificial
  CRISPR gRNA sequence
cccagaattagtacacttag

SEQ ID NO: 403284 - DNA, 20 bp, Artificial
  CRISPR gRNA sequence
ccagaattagtacacttagt

SEQ ID NO: 403285 - DNA, 20 bp, Artificial
  CRISPR gRNA sequence
gtacacttagttattttgta

SEQ ID NO: 403286 - DNA, 20 bp, Artificial
  CRISPR gRNA sequence
agttattttgtaatctatgc

SEQ ID NO: 403287 - DNA, 20 bp, Artificial
  CRISPR gRNA sequence
gttattttgtaatctatgcc

SEQ ID NO: 403288 - DNA, 20 bp, Artificial
  CRISPR gRNA sequence
ttttgtaatctatgcctgat

SEQ ID NO: 403289 - DNA, 20 bp, Artificial
  CRISPR gRNA sequence
tgtaatctatgcctgatgct

SEQ ID NO: 403290 - DNA, 20 bp, Artificial
  CRISPR gRNA sequence
gtaatctatgcctgatgctg

SEQ ID NO: 403291 - DNA, 20 bp, Artificial
  CRISPR gRNA sequence
taatctatgcctgatgctgt

SEQ ID NO: 403292 - DNA, 20 bp, Artificial
  CRISPR gRNA sequence
tgcctgatgctgtaatatta

SEQ ID NO: 403293 - DNA, 20 bp, Artificial
  CRISPR gRNA sequence
atgctgtaatattaaagtag

SEQ ID NO: 403294 - DNA, 20 bp, Artificial
  CRISPR gRNA sequence
taatattaaagtagttctat

SEQ ID NO: 403295 - DNA, 20 bp, Artificial
  CRISPR gRNA sequence
aagtagttctatctctgttg

SEQ ID NO: 403296 - DNA, 20 bp, Artificial
  CRISPR gRNA sequence
tatctctgttgtctgttttt

SEQ ID NO: 403297 - DNA, 20 bp, Artificial
  CRISPR gRNA sequence
tctctgttgtctgttttttt

SEQ ID NO: 403298 - DNA, 20 bp, Artificial
  CRISPR gRNA sequence
tgttgtctgtttttttcttc

SEQ ID NO: 403299 - DNA, 20 bp, Artificial
  CRISPR gRNA sequence
ttgtctgtttttttcttctt

SEQ ID NO: 403300 - DNA, 20 bp, Artificial
  CRISPR gRNA sequence
tctgtttttttcttctttgc

SEQ ID NO: 403301 - DNA, 20 bp, Artificial
  CRISPR gRNA sequence
tttttttcttctttgctcag

SEQ ID NO: 403302 - DNA, 20 bp, Artificial
  CRISPR gRNA sequence
ttttcttctttgctcagttt

SEQ ID NO: 403303 - DNA, 20 bp, Artificial
  CRISPR gRNA sequence
tttcttctttgctcagtttt

SEQ ID NO: 403304 - DNA, 20 bp, Artificial
  CRISPR gRNA sequence
ttcttctttgctcagttttt

SEQ ID NO: 403305 - DNA, 20 bp, Artificial
  CRISPR gRNA sequence
tcttctttgctcagtttttt

SEQ ID NO: 403306 - DNA, 20 bp, Artificial
  CRISPR gRNA sequence
cttctttgctcagttttttt

SEQ ID NO: 403307 - DNA, 20 bp, Artificial
  CRISPR gRNA sequence
ttctttgctcagtttttttt

SEQ ID NO: 403308 - DNA, 20 bp, Artificial
  CRISPR gRNA sequence
ctttgctcagttttttttct

SEQ ID NO: 403309 - DNA, 20 bp, Artificial
  CRISPR gRNA sequence
tttgctcagttttttttctt

SEQ ID NO: 403310 - DNA, 20 bp, Artificial
  CRISPR gRNA sequence
tgctcagttttttttcttcc

SEQ ID NO: 403311 - DNA, 20 bp, Artificial
  CRISPR gRNA sequence
gctcagttttttttcttcct

SEQ ID NO: 403312 - DNA, 20 bp, Artificial
  CRISPR gRNA sequence
ctcagttttttttcttcctg

SEQ ID NO: 403313 - DNA, 20 bp, Artificial
  CRISPR gRNA sequence
agttttttttcttcctgtca

SEQ ID NO: 403314 - DNA, 20 bp, Artificial
  CRISPR gRNA sequence
tttttcttcctgtcattact

SEQ ID NO: 403315 - DNA, 20 bp, Artificial
  CRISPR gRNA sequence
ttttcttcctgtcattactt

SEQ ID NO: 403316 - DNA, 20 bp, Artificial
  CRISPR gRNA sequence
tttcttcctgtcattacttt

SEQ ID NO: 403317 - DNA, 20 bp, Artificial
  CRISPR gRNA sequence
ttcttcctgtcattactttc

SEQ ID NO: 403318 - DNA, 20 bp, Artificial
  CRISPR gRNA sequence
tcttcctgtcattactttct

SEQ ID NO: 403319 - DNA, 20 bp, Artificial
  CRISPR gRNA sequence
cttcctgtcattactttctt

SEQ ID NO: 403320 - DNA, 20 bp, Artificial
  CRISPR gRNA sequence
ttcctgtcattactttcttt

SEQ ID NO: 403321 - DNA, 20 bp, Artificial
  CRISPR gRNA sequence
cctgtcattactttcttttc

SEQ ID NO: 403322 - DNA, 20 bp, Artificial
  CRISPR gRNA sequence
ctgtcattactttcttttct

SEQ ID NO: 403323 - DNA, 20 bp, Artificial
  CRISPR gRNA sequence
tcattactttcttttctttt

SEQ ID NO: 403324 - DNA, 20 bp, Artificial
  CRISPR gRNA sequence
ctttcttttcttttttttaa

SEQ ID NO: 403325 - DNA, 20 bp, Artificial
  CRISPR gRNA sequence
tcttttcttttttttaaatt

SEQ ID NO: 403326 - DNA, 20 bp, Artificial
  CRISPR gRNA sequence
cttttcttttttttaaattt

SEQ ID NO: 403327 - DNA, 20 bp, Artificial
  CRISPR gRNA sequence
ttttcttttttttaaatttt

SEQ ID NO: 403328 - DNA, 20 bp, Artificial
  CRISPR gRNA sequence
ttcttttttttaaattttat

SEQ ID NO: 403329 - DNA, 20 bp, Artificial
  CRISPR gRNA sequence
tcttttttttaaattttatt

SEQ ID NO: 403330 - DNA, 20 bp, Artificial
  CRISPR gRNA sequence
cttttttttaaattttatta

SEQ ID NO: 403331 - DNA, 20 bp, Artificial
  CRISPR gRNA sequence
ttttttttaaattttattat

SEQ ID NO: 403332 - DNA, 20 bp, Artificial
  CRISPR gRNA sequence
ttttttaaattttattatta

SEQ ID NO: 403333 - DNA, 20 bp, Artificial
  CRISPR gRNA sequence
tttttaaattttattattat

SEQ ID NO: 403334 - DNA, 20 bp, Artificial
  CRISPR gRNA sequence
ttttaaattttattattatt

SEQ ID NO: 403335 - DNA, 20 bp, Artificial
  CRISPR gRNA sequence
tttaaattttattattatta

SEQ ID NO: 403336 - DNA, 20 bp, Artificial
  CRISPR gRNA sequence
ttaaattttattattattat

SEQ ID NO: 403337 - DNA, 20 bp, Artificial
  CRISPR gRNA sequence
taaattttattattattata

SEQ ID NO: 403338 - DNA, 20 bp, Artificial
  CRISPR gRNA sequence
aaattttattattattatac

SEQ ID NO: 403339 - DNA, 20 bp, Artificial
  CRISPR gRNA sequence
aattttattattattatact

SEQ ID NO: 403340 - DNA, 20 bp, Artificial
  CRISPR gRNA sequence
tattattattatactttaag

SEQ ID NO: 403341 - DNA, 20 bp, Artificial
  CRISPR gRNA sequence
attattattatactttaagt

SEQ ID NO: 403342 - DNA, 20 bp, Artificial
  CRISPR gRNA sequence
ttattattatactttaagtt

SEQ ID NO: 403343 - DNA, 20 bp, Artificial
  CRISPR gRNA sequence
ttattatactttaagtttta

SEQ ID NO: 403344 - DNA, 20 bp, Artificial
  CRISPR gRNA sequence
ttatactttaagttttaggg

SEQ ID NO: 403345 - DNA, 20 bp, Artificial
  CRISPR gRNA sequence
tactttaagttttagggtac

SEQ ID NO: 403346 - DNA, 20 bp, Artificial
  CRISPR gRNA sequence
taagttttagggtacatgtg

SEQ ID NO: 403347 - DNA, 20 bp, Artificial
  CRISPR gRNA sequence
aagttttagggtacatgtgc

SEQ ID NO: 403348 - DNA, 20 bp, Artificial
  CRISPR gRNA sequence
agttttagggtacatgtgca

SEQ ID NO: 403349 - DNA, 20 bp, Artificial
  CRISPR gRNA sequence
tagggtacatgtgcacaaca

SEQ ID NO: 403350 - DNA, 20 bp, Artificial
  CRISPR gRNA sequence
agggtacatgtgcacaacat

SEQ ID NO: 403351 - DNA, 20 bp, Artificial
  CRISPR gRNA sequence
gggtacatgtgcacaacatg

SEQ ID NO: 403352 - DNA, 20 bp, Artificial
  CRISPR gRNA sequence
gttacatatgtatacatgtg

SEQ ID NO: 403353 - DNA, 20 bp, Artificial
  CRISPR gRNA sequence
ttacatatgtatacatgtgc

SEQ ID NO: 403354 - DNA, 20 bp, Artificial
  CRISPR gRNA sequence
catatgtatacatgtgccat

SEQ ID NO: 403355 - DNA, 20 bp, Artificial
  CRISPR gRNA sequence
gtgtgctgcacccattaact

SEQ ID NO: 403356 - DNA, 20 bp, Artificial
  CRISPR gRNA sequence
cacccattaacttgtcattt

SEQ ID NO: 403357 - DNA, 20 bp, Artificial
  CRISPR gRNA sequence
acttgtcatttagcattagg

SEQ ID NO: 403358 - DNA, 20 bp, Artificial
  CRISPR gRNA sequence
gtcatttagcattaggtata

SEQ ID NO: 403359 - DNA, 20 bp, Artificial
  CRISPR gRNA sequence
tcatttagcattaggtatat

SEQ ID NO: 403360 - DNA, 20 bp, Artificial
  CRISPR gRNA sequence
agcattaggtatatctccta

SEQ ID NO: 403361 - DNA, 20 bp, Artificial
  CRISPR gRNA sequence
gcattaggtatatctcctaa

SEQ ID NO: 403362 - DNA, 20 bp, Artificial
  CRISPR gRNA sequence
ggtatatctcctaatgctat

SEQ ID NO: 403363 - DNA, 20 bp, Artificial
  CRISPR gRNA sequence
ctaatgctatccctcccccc

SEQ ID NO: 403364 - DNA, 20 bp, Artificial
  CRISPR gRNA sequence
atgctatccctcccccctct

SEQ ID NO: 403365 - DNA, 20 bp, Artificial
  CRISPR gRNA sequence
tccctcccccctctccccac

SEQ ID NO: 403366 - DNA, 20 bp, Artificial
  CRISPR gRNA sequence
ccccctctccccaccccaca

SEQ ID NO: 403367 - DNA, 20 bp, Artificial
  CRISPR gRNA sequence
tccccaccccacaacagttc

SEQ ID NO: 403368 - DNA, 20 bp, Artificial
  CRISPR gRNA sequence
cccaccccacaacagttcct

SEQ ID NO: 403369 - DNA, 20 bp, Artificial
  CRISPR gRNA sequence
ctggtgtgtgatgttcccct

SEQ ID NO: 403370 - DNA, 20 bp, Artificial
  CRISPR gRNA sequence
gtgtgtgatgttccccttcc

SEQ ID NO: 403371 - DNA, 20 bp, Artificial
  CRISPR gRNA sequence
cccttcctgtgtccatgtgt

SEQ ID NO: 403372 - DNA, 20 bp, Artificial
  CRISPR gRNA sequence
cctgtgtccatgtgttctca

SEQ ID NO: 403373 - DNA, 20 bp, Artificial
  CRISPR gRNA sequence
ctgtgtccatgtgttctcat

SEQ ID NO: 403374 - DNA, 20 bp, Artificial
  CRISPR gRNA sequence
tgtccatgtgttctcattgt

SEQ ID NO: 403375 - DNA, 20 bp, Artificial
  CRISPR gRNA sequence
tcattgttcaattcccacct

SEQ ID NO: 403376 - DNA, 20 bp, Artificial
  CRISPR gRNA sequence
attgttcaattcccacctat

SEQ ID NO: 403377 - DNA, 20 bp, Artificial
  CRISPR gRNA sequence
ttcaattcccacctatgagt

SEQ ID NO: 403378 - DNA, 20 bp, Artificial
  CRISPR gRNA sequence
aattcccacctatgagtgag

SEQ ID NO: 403379 - DNA, 20 bp, Artificial
  CRISPR gRNA sequence
ccacctatgagtgagaacat

SEQ ID NO: 403380 - DNA, 20 bp, Artificial
  CRISPR gRNA sequence
tgagtgagaacatgcggtgt

SEQ ID NO: 403381 - DNA, 20 bp, Artificial
  CRISPR gRNA sequence
ggtttttgtctttgtgatag

SEQ ID NO: 403382 - DNA, 20 bp, Artificial
  CRISPR gRNA sequence
gtttttgtctttgtgatagt

SEQ ID NO: 403383 - DNA, 20 bp, Artificial
  CRISPR gRNA sequence
ttgtctttgtgatagtttgc

SEQ ID NO: 403384 - DNA, 20 bp, Artificial
  CRISPR gRNA sequence
tgtctttgtgatagtttgct

SEQ ID NO: 403385 - DNA, 20 bp, Artificial
  CRISPR gRNA sequence
gtctttgtgatagtttgctg

SEQ ID NO: 403386 - DNA, 20 bp, Artificial
  CRISPR gRNA sequence
tctttgtgatagtttgctga

SEQ ID NO: 403387 - DNA, 20 bp, Artificial
  CRISPR gRNA sequence
tgtgatagtttgctgagaat

SEQ ID NO: 403388 - DNA, 20 bp, Artificial
  CRISPR gRNA sequence
gtgatagtttgctgagaatg

SEQ ID NO: 403389 - DNA, 20 bp, Artificial
  CRISPR gRNA sequence
tgatagtttgctgagaatga

SEQ ID NO: 403390 - DNA, 20 bp, Artificial
  CRISPR gRNA sequence
gctgagaatgatggtttcca

SEQ ID NO: 403391 - DNA, 20 bp, Artificial
  CRISPR gRNA sequence
ctgagaatgatggtttccag

SEQ ID NO: 403392 - DNA, 20 bp, Artificial
  CRISPR gRNA sequence
agaatgatggtttccagttt

SEQ ID NO: 403393 - DNA, 20 bp, Artificial
  CRISPR gRNA sequence
ccagtttcatccatgtccct

SEQ ID NO: 403394 - DNA, 20 bp, Artificial
  CRISPR gRNA sequence
cagtttcatccatgtcccta

SEQ ID NO: 403395 - DNA, 20 bp, Artificial
  CRISPR gRNA sequence
catccatgtccctacaaagg

SEQ ID NO: 403396 - DNA, 20 bp, Artificial
  CRISPR gRNA sequence
atccatgtccctacaaagga

SEQ ID NO: 403397 - DNA, 20 bp, Artificial
  CRISPR gRNA sequence
caaaggacatgaactcatca

SEQ ID NO: 403398 - DNA, 20 bp, Artificial
  CRISPR gRNA sequence
atcattttttatggctgcat

SEQ ID NO: 403399 - DNA, 20 bp, Artificial
  CRISPR gRNA sequence
tttatggctgcatagtattc

SEQ ID NO: 403400 - DNA, 20 bp, Artificial
  CRISPR gRNA sequence
ttatggctgcatagtattcc

SEQ ID NO: 403401 - DNA, 20 bp, Artificial
  CRISPR gRNA sequence
tatggctgcatagtattcca

SEQ ID NO: 403402 - DNA, 20 bp, Artificial
  CRISPR gRNA sequence
atggctgcatagtattccat

SEQ ID NO: 403403 - DNA, 20 bp, Artificial
  CRISPR gRNA sequence
tggctgcatagtattccatg

SEQ ID NO: 403404 - DNA, 20 bp, Artificial
  CRISPR gRNA sequence
catagtattccatggtgtat

SEQ ID NO: 403405 - DNA, 20 bp, Artificial
  CRISPR gRNA sequence
catggtgtatatgtgccaca

SEQ ID NO: 403406 - DNA, 20 bp, Artificial
  CRISPR gRNA sequence
tcttaatccagtctatcgtt

SEQ ID NO: 403407 - DNA, 20 bp, Artificial
  CRISPR gRNA sequence
cttaatccagtctatcgttg

SEQ ID NO: 403408 - DNA, 20 bp, Artificial
  CRISPR gRNA sequence
ttaatccagtctatcgttgt

SEQ ID NO: 403409 - DNA, 20 bp, Artificial
  CRISPR gRNA sequence
aatccagtctatcgttgttg

SEQ ID NO: 403410 - DNA, 20 bp, Artificial
  CRISPR gRNA sequence
atccagtctatcgttgttgg

SEQ ID NO: 403411 - DNA, 20 bp, Artificial
  CRISPR gRNA sequence
tcgttgttggacatttgggt

SEQ ID NO: 403412 - DNA, 20 bp, Artificial
  CRISPR gRNA sequence
ttggacatttgggttggttc

SEQ ID NO: 403413 - DNA, 20 bp, Artificial
  CRISPR gRNA sequence
gacatttgggttggttccaa

SEQ ID NO: 403414 - DNA, 20 bp, Artificial
  CRISPR gRNA sequence
gggttggttccaagtctttg

SEQ ID NO: 403415 - DNA, 20 bp, Artificial
  CRISPR gRNA sequence
ggttggttccaagtctttgc

SEQ ID NO: 403416 - DNA, 20 bp, Artificial
  CRISPR gRNA sequence
gttccaagtctttgctactg

SEQ ID NO: 403417 - DNA, 20 bp, Artificial
  CRISPR gRNA sequence
caagtctttgctactgtgaa

SEQ ID NO: 403418 - DNA, 20 bp, Artificial
  CRISPR gRNA sequence
tgctactgtgaatagtgccg

SEQ ID NO: 403419 - DNA, 20 bp, Artificial
  CRISPR gRNA sequence
gctactgtgaatagtgccgc

SEQ ID NO: 403420 - DNA, 20 bp, Artificial
  CRISPR gRNA sequence
ctactgtgaatagtgccgca

SEQ ID NO: 403421 - DNA, 20 bp, Artificial
  CRISPR gRNA sequence
ctgtgaatagtgccgcagtg

SEQ ID NO: 403422 - DNA, 20 bp, Artificial
  CRISPR gRNA sequence
tgaatagtgccgcagtgttt

SEQ ID NO: 403423 - DNA, 20 bp, Artificial
  CRISPR gRNA sequence
gtggttatttttcactgtgt

SEQ ID NO: 403424 - DNA, 20 bp, Artificial
  CRISPR gRNA sequence
tggttatttttcactgtgtg

SEQ ID NO: 403425 - DNA, 20 bp, Artificial
  CRISPR gRNA sequence
tttttcactgtgtgctgctc

SEQ ID NO: 403426 - DNA, 20 bp, Artificial
  CRISPR gRNA sequence
ttcactgtgtgctgctcata

SEQ ID NO: 403427 - DNA, 20 bp, Artificial
  CRISPR gRNA sequence
tcactgtgtgctgctcatag

SEQ ID NO: 403428 - DNA, 20 bp, Artificial
  CRISPR gRNA sequence
cactgtgtgctgctcatagt

SEQ ID NO: 403429 - DNA, 20 bp, Artificial
  CRISPR gRNA sequence
actgtgtgctgctcatagtc

SEQ ID NO: 403430 - DNA, 20 bp, Artificial
  CRISPR gRNA sequence
tgtgctgctcatagtccttg

SEQ ID NO: 403431 - DNA, 20 bp, Artificial
  CRISPR gRNA sequence
ctcatagtccttgataaagc

SEQ ID NO: 403432 - DNA, 20 bp, Artificial
  CRISPR gRNA sequence
atagtccttgataaagcctt

SEQ ID NO: 403433 - DNA, 20 bp, Artificial
  CRISPR gRNA sequence
gataaagccttctggggatt

SEQ ID NO: 403434 - DNA, 20 bp, Artificial
  CRISPR gRNA sequence
ataaagccttctggggattc

SEQ ID NO: 403435 - DNA, 20 bp, Artificial
  CRISPR gRNA sequence
ctggggattctctgaagtct

SEQ ID NO: 403436 - DNA, 20 bp, Artificial
  CRISPR gRNA sequence
tggggattctctgaagtcta

SEQ ID NO: 403437 - DNA, 20 bp, Artificial
  CRISPR gRNA sequence
gggattctctgaagtctaac

SEQ ID NO: 403438 - DNA, 20 bp, Artificial
  CRISPR gRNA sequence
tctgaagtctaacatgaagg

SEQ ID NO: 403439 - DNA, 20 bp, Artificial
  CRISPR gRNA sequence
tgaagtctaacatgaaggga

SEQ ID NO: 403440 - DNA, 20 bp, Artificial
  CRISPR gRNA sequence
aagtctaacatgaagggacc

SEQ ID NO: 403441 - DNA, 20 bp, Artificial
  CRISPR gRNA sequence
acatgaagggacctttgttc

SEQ ID NO: 403442 - DNA, 20 bp, Artificial
  CRISPR gRNA sequence
tgttctcagaggagtcgaaa

SEQ ID NO: 403443 - DNA, 20 bp, Artificial
  CRISPR gRNA sequence
gttctcagaggagtcgaaac

SEQ ID NO: 403444 - DNA, 20 bp, Artificial
  CRISPR gRNA sequence
ttctcagaggagtcgaaacc

SEQ ID NO: 403445 - DNA, 20 bp, Artificial
  CRISPR gRNA sequence
tcagaggagtcgaaacctgg

SEQ ID NO: 403446 - DNA, 20 bp, Artificial
  CRISPR gRNA sequence
agaggagtcgaaacctggat

SEQ ID NO: 403447 - DNA, 20 bp, Artificial
  CRISPR gRNA sequence
gattactttcagcctgagct

SEQ ID NO: 403448 - DNA, 20 bp, Artificial
  CRISPR gRNA sequence
ctttcagcctgagctttatg

SEQ ID NO: 403449 - DNA, 20 bp, Artificial
  CRISPR gRNA sequence
tcagcctgagctttatggag

SEQ ID NO: 403450 - DNA, 20 bp, Artificial
  CRISPR gRNA sequence
cagcctgagctttatggagc

SEQ ID NO: 403451 - DNA, 20 bp, Artificial
  CRISPR gRNA sequence
agcctgagctttatggagca

SEQ ID NO: 403452 - DNA, 20 bp, Artificial
  CRISPR gRNA sequence
agctttatggagcacctgta

SEQ ID NO: 403453 - DNA, 20 bp, Artificial
  CRISPR gRNA sequence
tatggagcacctgtactatg

SEQ ID NO: 403454 - DNA, 20 bp, Artificial
  CRISPR gRNA sequence
atggagcacctgtactatgg

SEQ ID NO: 403455 - DNA, 20 bp, Artificial
  CRISPR gRNA sequence
tggagcacctgtactatggg

SEQ ID NO: 403456 - DNA, 20 bp, Artificial
  CRISPR gRNA sequence
tactatgggaatttaggcta

SEQ ID NO: 403457 - DNA, 20 bp, Artificial
  CRISPR gRNA sequence
tgggaatttaggctataaat

SEQ ID NO: 403458 - DNA, 20 bp, Artificial
  CRISPR gRNA sequence
aggctataaatccacatgag

SEQ ID NO: 403459 - DNA, 20 bp, Artificial
  CRISPR gRNA sequence
ggctataaatccacatgagg

SEQ ID NO: 403460 - DNA, 20 bp, Artificial
  CRISPR gRNA sequence
taaatccacatgaggactga

SEQ ID NO: 403461 - DNA, 20 bp, Artificial
  CRISPR gRNA sequence
atttgtgcttagaactactc

SEQ ID NO: 403462 - DNA, 20 bp, Artificial
  CRISPR gRNA sequence
gtgcttagaactactcaagg

SEQ ID NO: 403463 - DNA, 20 bp, Artificial
  CRISPR gRNA sequence
tgcttagaactactcaagga

SEQ ID NO: 403464 - DNA, 20 bp, Artificial
  CRISPR gRNA sequence
agaactactcaaggattttc

SEQ ID NO: 403465 - DNA, 20 bp, Artificial
  CRISPR gRNA sequence
gaactactcaaggattttct

SEQ ID NO: 403466 - DNA, 20 bp, Artificial
  CRISPR gRNA sequence
ctcaaggattttctttcttt

SEQ ID NO: 403467 - DNA, 20 bp, Artificial
  CRISPR gRNA sequence
aaggattttctttctttccc

SEQ ID NO: 403468 - DNA, 20 bp, Artificial
  CRISPR gRNA sequence
tctttctttcccttattcac

SEQ ID NO: 403469 - DNA, 20 bp, Artificial
  CRISPR gRNA sequence
ctttctttcccttattcacc

SEQ ID NO: 403470 - DNA, 20 bp, Artificial
  CRISPR gRNA sequence
tttctttcccttattcacct

SEQ ID NO: 403471 - DNA, 20 bp, Artificial
  CRISPR gRNA sequence
tctttcccttattcacctgg

SEQ ID NO: 403472 - DNA, 20 bp, Artificial
  CRISPR gRNA sequence
ctttcccttattcacctggg

SEQ ID NO: 403473 - DNA, 20 bp, Artificial
  CRISPR gRNA sequence
tttcccttattcacctgggg

SEQ ID NO: 403474 - DNA, 20 bp, Artificial
  CRISPR gRNA sequence
tcccttattcacctggggat

SEQ ID NO: 403475 - DNA, 20 bp, Artificial
  CRISPR gRNA sequence
cccttattcacctggggatg

SEQ ID NO: 403476 - DNA, 20 bp, Artificial
  CRISPR gRNA sequence
ccttattcacctggggatgc

SEQ ID NO: 403477 - DNA, 20 bp, Artificial
  CRISPR gRNA sequence
attcacctggggatgcgggt

SEQ ID NO: 403478 - DNA, 20 bp, Artificial
  CRISPR gRNA sequence
ttcacctggggatgcgggtg

SEQ ID NO: 403479 - DNA, 20 bp, Artificial
  CRISPR gRNA sequence
acctggggatgcgggtgagc

SEQ ID NO: 403480 - DNA, 20 bp, Artificial
  CRISPR gRNA sequence
gggatgcgggtgagcacatg

SEQ ID NO: 403481 - DNA, 20 bp, Artificial
  CRISPR gRNA sequence
atttccaggtcattgttacc

SEQ ID NO: 403482 - DNA, 20 bp, Artificial
  CRISPR gRNA sequence
tttccaggtcattgttacca

SEQ ID NO: 403483 - DNA, 20 bp, Artificial
  CRISPR gRNA sequence
ccaggtcattgttaccatga

SEQ ID NO: 403484 - DNA, 20 bp, Artificial
  CRISPR gRNA sequence
caggtcattgttaccatgaa

SEQ ID NO: 403485 - DNA, 20 bp, Artificial
  CRISPR gRNA sequence
ttaccatgaaggagtatcac

SEQ ID NO: 403486 - DNA, 20 bp, Artificial
  CRISPR gRNA sequence
ccatgaaggagtatcactta

SEQ ID NO: 403487 - DNA, 20 bp, Artificial
  CRISPR gRNA sequence
agaggtctcgacaagacaag

SEQ ID NO: 403488 - DNA, 20 bp, Artificial
  CRISPR gRNA sequence
gaggtctcgacaagacaaga

SEQ ID NO: 403489 - DNA, 20 bp, Artificial
  CRISPR gRNA sequence
gacaagacaagaggaaggtc

SEQ ID NO: 403490 - DNA, 20 bp, Artificial
  CRISPR gRNA sequence
ctttttaattctcacttcag

SEQ ID NO: 403491 - DNA, 20 bp, Artificial
  CRISPR gRNA sequence
tttttaattctcacttcagg

SEQ ID NO: 403492 - DNA, 20 bp, Artificial
  CRISPR gRNA sequence
tttaattctcacttcaggta

SEQ ID NO: 403493 - DNA, 20 bp, Artificial
  CRISPR gRNA sequence
ttaattctcacttcaggtag

SEQ ID NO: 403494 - DNA, 20 bp, Artificial
  CRISPR gRNA sequence
taattctcacttcaggtagg

SEQ ID NO: 403495 - DNA, 20 bp, Artificial
  CRISPR gRNA sequence
aattctcacttcaggtaggt

SEQ ID NO: 403496 - DNA, 20 bp, Artificial
  CRISPR gRNA sequence
attctcacttcaggtaggtc

SEQ ID NO: 403497 - DNA, 20 bp, Artificial
  CRISPR gRNA sequence
tcacttcaggtaggtcctgg

SEQ ID NO: 403498 - DNA, 20 bp, Artificial
  CRISPR gRNA sequence
acttcaggtaggtcctgggt

SEQ ID NO: 403499 - DNA, 20 bp, Artificial
  CRISPR gRNA sequence
caggtaggtcctgggttttg

SEQ ID NO: 403500 - DNA, 20 bp, Artificial
  CRISPR gRNA sequence
aggtaggtcctgggttttga

SEQ ID NO: 403501 - DNA, 20 bp, Artificial
  CRISPR gRNA sequence
ggttttgacacctatttctt

SEQ ID NO: 403502 - DNA, 20 bp, Artificial
  CRISPR gRNA sequence
tgacacctatttctttcgtg

SEQ ID NO: 403503 - DNA, 20 bp, Artificial
  CRISPR gRNA sequence
gacacctatttctttcgtgt

SEQ ID NO: 403504 - DNA, 20 bp, Artificial
  CRISPR gRNA sequence
acacctatttctttcgtgtt

SEQ ID NO: 403505 - DNA, 20 bp, Artificial
  CRISPR gRNA sequence
tttctttcgtgttgtatgag

SEQ ID NO: 403506 - DNA, 20 bp, Artificial
  CRISPR gRNA sequence
ctttcgtgttgtatgaggtt

SEQ ID NO: 403507 - DNA, 20 bp, Artificial
  CRISPR gRNA sequence
tttcgtgttgtatgaggttc

SEQ ID NO: 403508 - DNA, 20 bp, Artificial
  CRISPR gRNA sequence
tcgtgttgtatgaggttcaa

SEQ ID NO: 403509 - DNA, 20 bp, Artificial
  CRISPR gRNA sequence
cgtgttgtatgaggttcaaa

SEQ ID NO: 403510 - DNA, 20 bp, Artificial
  CRISPR gRNA sequence
gtgttgtatgaggttcaaaa

SEQ ID NO: 403511 - DNA, 20 bp, Artificial
  CRISPR gRNA sequence
tatgaggttcaaaaatcaga

SEQ ID NO: 403512 - DNA, 20 bp, Artificial
  CRISPR gRNA sequence
aaaaatcagagttcacgttg

SEQ ID NO: 403513 - DNA, 20 bp, Artificial
  CRISPR gRNA sequence
acgttgcttagactggcagg

SEQ ID NO: 403514 - DNA, 20 bp, Artificial
  CRISPR gRNA sequence
cttagactggcaggtgtgct

SEQ ID NO: 403515 - DNA, 20 bp, Artificial
  CRISPR gRNA sequence
agactggcaggtgtgctcag

SEQ ID NO: 403516 - DNA, 20 bp, Artificial
  CRISPR gRNA sequence
gactggcaggtgtgctcagg

SEQ ID NO: 403517 - DNA, 20 bp, Artificial
  CRISPR gRNA sequence
gcaggtgtgctcagggcaga

SEQ ID NO: 403518 - DNA, 20 bp, Artificial
  CRISPR gRNA sequence
agggcagaagtggcttccac

SEQ ID NO: 403519 - DNA, 20 bp, Artificial
  CRISPR gRNA sequence
ccacgtccctatgtctctag

SEQ ID NO: 403520 - DNA, 20 bp, Artificial
  CRISPR gRNA sequence
cacgtccctatgtctctagt

SEQ ID NO: 403521 - DNA, 20 bp, Artificial
  CRISPR gRNA sequence
tgtctctagtttttcacttc

SEQ ID NO: 403522 - DNA, 20 bp, Artificial
  CRISPR gRNA sequence
tagtttttcacttctacctg

SEQ ID NO: 403523 - DNA, 20 bp, Artificial
  CRISPR gRNA sequence
gtttttcacttctacctgga

SEQ ID NO: 403524 - DNA, 20 bp, Artificial
  CRISPR gRNA sequence
ttcacttctacctggatttt

SEQ ID NO: 403525 - DNA, 20 bp, Artificial
  CRISPR gRNA sequence
tcacttctacctggattttt

SEQ ID NO: 403526 - DNA, 20 bp, Artificial
  CRISPR gRNA sequence
cacttctacctggatttttc

SEQ ID NO: 403527 - DNA, 20 bp, Artificial
  CRISPR gRNA sequence
acttctacctggatttttcc

SEQ ID NO: 403528 - DNA, 20 bp, Artificial
  CRISPR gRNA sequence
ctacctggatttttccggtg

SEQ ID NO: 403529 - DNA, 20 bp, Artificial
  CRISPR gRNA sequence
tacctggatttttccggtgg

SEQ ID NO: 403530 - DNA, 20 bp, Artificial
  CRISPR gRNA sequence
cctggatttttccggtggtc

SEQ ID NO: 403531 - DNA, 20 bp, Artificial
  CRISPR gRNA sequence
gatttttccggtggtccctg

SEQ ID NO: 403532 - DNA, 20 bp, Artificial
  CRISPR gRNA sequence
ttccggtggtccctgtgttc

SEQ ID NO: 403533 - DNA, 20 bp, Artificial
  CRISPR gRNA sequence
tccggtggtccctgtgttct

SEQ ID NO: 403534 - DNA, 20 bp, Artificial
  CRISPR gRNA sequence
ccggtggtccctgtgttctc

SEQ ID NO: 403535 - DNA, 20 bp, Artificial
  CRISPR gRNA sequence
cggtggtccctgtgttctca

SEQ ID NO: 403536 - DNA, 20 bp, Artificial
  CRISPR gRNA sequence
tgttctcagagatttgatgc

SEQ ID NO: 403537 - DNA, 20 bp, Artificial
  CRISPR gRNA sequence
tcagagatttgatgcttttg

SEQ ID NO: 403538 - DNA, 20 bp, Artificial
  CRISPR gRNA sequence
agagatttgatgcttttgct

SEQ ID NO: 403539 - DNA, 20 bp, Artificial
  CRISPR gRNA sequence
gatgcttttgctcctttcac

SEQ ID NO: 403540 - DNA, 20 bp, Artificial
  CRISPR gRNA sequence
atgcttttgctcctttcaca

SEQ ID NO: 403541 - DNA, 20 bp, Artificial
  CRISPR gRNA sequence
ttgctcctttcacaaataca

SEQ ID NO: 403542 - DNA, 20 bp, Artificial
  CRISPR gRNA sequence
tgctcctttcacaaatacat

SEQ ID NO: 403543 - DNA, 20 bp, Artificial
  CRISPR gRNA sequence
gctcctttcacaaatacatt

SEQ ID NO: 403544 - DNA, 20 bp, Artificial
  CRISPR gRNA sequence
ctcctttcacaaatacattt

SEQ ID NO: 403545 - DNA, 20 bp, Artificial
  CRISPR gRNA sequence
ctttcacaaatacatttgct

SEQ ID NO: 403546 - DNA, 20 bp, Artificial
  CRISPR gRNA sequence
tcacaaatacatttgctcct

SEQ ID NO: 403547 - DNA, 20 bp, Artificial
  CRISPR gRNA sequence
cacaaatacatttgctcctt

SEQ ID NO: 403548 - DNA, 20 bp, Artificial
  CRISPR gRNA sequence
acaaatacatttgctccttt

SEQ ID NO: 403549 - DNA, 20 bp, Artificial
  CRISPR gRNA sequence
gctcctttcacaaatctgtc

SEQ ID NO: 403550 - DNA, 20 bp, Artificial
  CRISPR gRNA sequence
ctcctttcacaaatctgtcc

SEQ ID NO: 403551 - DNA, 20 bp, Artificial
  CRISPR gRNA sequence
ctttcacaaatctgtcctgc

SEQ ID NO: 403552 - DNA, 20 bp, Artificial
  CRISPR gRNA sequence
tcacaaatctgtcctgctcc

SEQ ID NO: 403553 - DNA, 20 bp, Artificial
  CRISPR gRNA sequence
cacaaatctgtcctgctccc

SEQ ID NO: 403554 - DNA, 20 bp, Artificial
  CRISPR gRNA sequence
acaaatctgtcctgctccca

SEQ ID NO: 403555 - DNA, 20 bp, Artificial
  CRISPR gRNA sequence
tcctgctcccagtctttctc

SEQ ID NO: 403556 - DNA, 20 bp, Artificial
  CRISPR gRNA sequence
ctcccagtctttctcatttg

SEQ ID NO: 403557 - DNA, 20 bp, Artificial
  CRISPR gRNA sequence
ccagtctttctcatttgagt

SEQ ID NO: 403558 - DNA, 20 bp, Artificial
  CRISPR gRNA sequence
tctcatttgagtcaatattc

SEQ ID NO: 403559 - DNA, 20 bp, Artificial
  CRISPR gRNA sequence
ctcatttgagtcaatattcc

SEQ ID NO: 403560 - DNA, 20 bp, Artificial
  CRISPR gRNA sequence
tcatttgagtcaatattccc

SEQ ID NO: 403561 - DNA, 20 bp, Artificial
  CRISPR gRNA sequence
atttgagtcaatattcccac

SEQ ID NO: 403562 - DNA, 20 bp, Artificial
  CRISPR gRNA sequence
gagtcaatattcccacatct

SEQ ID NO: 403563 - DNA, 20 bp, Artificial
  CRISPR gRNA sequence
agtcaatattcccacatctt

SEQ ID NO: 403564 - DNA, 20 bp, Artificial
  CRISPR gRNA sequence
ccacatcttaaaaacataga

SEQ ID NO: 403565 - DNA, 20 bp, Artificial
  CRISPR gRNA sequence
aaaaacatagaagtcatctt

SEQ ID NO: 403566 - DNA, 20 bp, Artificial
  CRISPR gRNA sequence
aaaacatagaagtcatcttt

SEQ ID NO: 403567 - DNA, 20 bp, Artificial
  CRISPR gRNA sequence
ttatgctttgttttgcctca

SEQ ID NO: 403568 - DNA, 20 bp, Artificial
  CRISPR gRNA sequence
tatgctttgttttgcctcat

SEQ ID NO: 403569 - DNA, 20 bp, Artificial
  CRISPR gRNA sequence
atgctttgttttgcctcatt

SEQ ID NO: 403570 - DNA, 20 bp, Artificial
  CRISPR gRNA sequence
tgctttgttttgcctcattt

SEQ ID NO: 403571 - DNA, 20 bp, Artificial
  CRISPR gRNA sequence
tgttttgcctcatttttcac

SEQ ID NO: 403572 - DNA, 20 bp, Artificial
  CRISPR gRNA sequence
gttttgcctcatttttcaca

SEQ ID NO: 403573 - DNA, 20 bp, Artificial
  CRISPR gRNA sequence
ttttgcctcatttttcacat

SEQ ID NO: 403574 - DNA, 20 bp, Artificial
  CRISPR gRNA sequence
tgcctcatttttcacatcta

SEQ ID NO: 403575 - DNA, 20 bp, Artificial
  CRISPR gRNA sequence
gcctcatttttcacatctaa

SEQ ID NO: 403576 - DNA, 20 bp, Artificial
  CRISPR gRNA sequence
cctcatttttcacatctaag

SEQ ID NO: 403577 - DNA, 20 bp, Artificial
  CRISPR gRNA sequence
atttttcacatctaagtgtc

SEQ ID NO: 403578 - DNA, 20 bp, Artificial
  CRISPR gRNA sequence
ttcacatctaagtgtctaga

SEQ ID NO: 403579 - DNA, 20 bp, Artificial
  CRISPR gRNA sequence
tcacatctaagtgtctagac

SEQ ID NO: 403580 - DNA, 20 bp, Artificial
  CRISPR gRNA sequence
cacatctaagtgtctagact

SEQ ID NO: 403581 - DNA, 20 bp, Artificial
  CRISPR gRNA sequence
acatctaagtgtctagactt

SEQ ID NO: 403582 - DNA, 20 bp, Artificial
  CRISPR gRNA sequence
agtgtctagacttgcaaaat

SEQ ID NO: 403583 - DNA, 20 bp, Artificial
  CRISPR gRNA sequence
gacttgcaaaatagacacct

SEQ ID NO: 403584 - DNA, 20 bp, Artificial
  CRISPR gRNA sequence
gcaaaatagacacctcatat

SEQ ID NO: 403585 - DNA, 20 bp, Artificial
  CRISPR gRNA sequence
caaaatagacacctcatatc

SEQ ID NO: 403586 - DNA, 20 bp, Artificial
  CRISPR gRNA sequence
atatccatttatctcaaacc

SEQ ID NO: 403587 - DNA, 20 bp, Artificial
  CRISPR gRNA sequence
atctcaaaccatattgcaac

SEQ ID NO: 403588 - DNA, 20 bp, Artificial
  CRISPR gRNA sequence
tctcaaaccatattgcaaca

SEQ ID NO: 403589 - DNA, 20 bp, Artificial
  CRISPR gRNA sequence
aaaccatattgcaacagcct

SEQ ID NO: 403590 - DNA, 20 bp, Artificial
  CRISPR gRNA sequence
caacagccttcattcaaaac

SEQ ID NO: 403591 - DNA, 20 bp, Artificial
  CRISPR gRNA sequence
cattcaaaacactcatcttt

SEQ ID NO: 403592 - DNA, 20 bp, Artificial
  CRISPR gRNA sequence
attcaaaacactcatctttt

SEQ ID NO: 403593 - DNA, 20 bp, Artificial
  CRISPR gRNA sequence
aaaacactcatcttttacct

SEQ ID NO: 403594 - DNA, 20 bp, Artificial
  CRISPR gRNA sequence
atcttttacctctttgtatt

SEQ ID NO: 403595 - DNA, 20 bp, Artificial
  CRISPR gRNA sequence
ttacctctttgtatttttta

SEQ ID NO: 403596 - DNA, 20 bp, Artificial
  CRISPR gRNA sequence
tacctctttgtattttttaa

SEQ ID NO: 403597 - DNA, 20 bp, Artificial
  CRISPR gRNA sequence
acctctttgtattttttaaa

SEQ ID NO: 403598 - DNA, 20 bp, Artificial
  CRISPR gRNA sequence
cctctttgtattttttaaaa

SEQ ID NO: 403599 - DNA, 20 bp, Artificial
  CRISPR gRNA sequence
tttgtattttttaaaaaata

SEQ ID NO: 403600 - DNA, 20 bp, Artificial
  CRISPR gRNA sequence
tgtattttttaaaaaatatt

SEQ ID NO: 403601 - DNA, 20 bp, Artificial
  CRISPR gRNA sequence
gtattttttaaaaaatattt

SEQ ID NO: 403602 - DNA, 20 bp, Artificial
  CRISPR gRNA sequence
tattttttaaaaaatatttg

SEQ ID NO: 403603 - DNA, 20 bp, Artificial
  CRISPR gRNA sequence
tttaaaaaatatttgtcatc

SEQ ID NO: 403604 - DNA, 20 bp, Artificial
  CRISPR gRNA sequence
ttaaaaaatatttgtcatct

SEQ ID NO: 403605 - DNA, 20 bp, Artificial
  CRISPR gRNA sequence
taaaaaatatttgtcatcta

SEQ ID NO: 403606 - DNA, 20 bp, Artificial
  CRISPR gRNA sequence
aaaaaatatttgtcatctag

SEQ ID NO: 403607 - DNA, 20 bp, Artificial
  CRISPR gRNA sequence
aaaaatatttgtcatctaga

SEQ ID NO: 403608 - DNA, 20 bp, Artificial
  CRISPR gRNA sequence
gtcatctagatgcttttacc

SEQ ID NO: 403609 - DNA, 20 bp, Artificial
  CRISPR gRNA sequence
tcatctagatgcttttacct

SEQ ID NO: 403610 - DNA, 20 bp, Artificial
  CRISPR gRNA sequence
gatgcttttacctgaaagtc

SEQ ID NO: 403611 - DNA, 20 bp, Artificial
  CRISPR gRNA sequence
ttacctgaaagtctgatctg

SEQ ID NO: 403612 - DNA, 20 bp, Artificial
  CRISPR gRNA sequence
tacctgaaagtctgatctga

SEQ ID NO: 403613 - DNA, 20 bp, Artificial
  CRISPR gRNA sequence
acctgaaagtctgatctgaa

SEQ ID NO: 403614 - DNA, 20 bp, Artificial
  CRISPR gRNA sequence
cctgaaagtctgatctgaat

SEQ ID NO: 403615 - DNA, 20 bp, Artificial
  CRISPR gRNA sequence
aaagtctgatctgaataatg

SEQ ID NO: 403616 - DNA, 20 bp, Artificial
  CRISPR gRNA sequence
atctgaataatgtagcccat

SEQ ID NO: 403617 - DNA, 20 bp, Artificial
  CRISPR gRNA sequence
aataatgtagcccatcatct

SEQ ID NO: 403618 - DNA, 20 bp, Artificial
  CRISPR gRNA sequence
cccaggaatgatgtatcaaa

SEQ ID NO: 403619 - DNA, 20 bp, Artificial
  CRISPR gRNA sequence
ccaggaatgatgtatcaaat

SEQ ID NO: 403620 - DNA, 20 bp, Artificial
  CRISPR gRNA sequence
ttggactcttctccagtccc

SEQ ID NO: 403621 - DNA, 20 bp, Artificial
  CRISPR gRNA sequence
tggactcttctccagtccca

SEQ ID NO: 403622 - DNA, 20 bp, Artificial
  CRISPR gRNA sequence
ggactcttctccagtcccag

SEQ ID NO: 403623 - DNA, 20 bp, Artificial
  CRISPR gRNA sequence
gactcttctccagtcccagt

SEQ ID NO: 403624 - DNA, 20 bp, Artificial
  CRISPR gRNA sequence
ttctccagtcccagtaggat

SEQ ID NO: 403625 - DNA, 20 bp, Artificial
  CRISPR gRNA sequence
ctccagtcccagtaggattt

SEQ ID NO: 403626 - DNA, 20 bp, Artificial
  CRISPR gRNA sequence
tccagtcccagtaggatttt

SEQ ID NO: 403627 - DNA, 20 bp, Artificial
  CRISPR gRNA sequence
cagtcccagtaggattttgt

SEQ ID NO: 403628 - DNA, 20 bp, Artificial
  CRISPR gRNA sequence
tgtttgtagttgcccgtgct

SEQ ID NO: 403629 - DNA, 20 bp, Artificial
  CRISPR gRNA sequence
gtttgtagttgcccgtgctc

SEQ ID NO: 403630 - DNA, 20 bp, Artificial
  CRISPR gRNA sequence
tttgtagttgcccgtgctca

SEQ ID NO: 403631 - DNA, 20 bp, Artificial
  CRISPR gRNA sequence
gtagttgcccgtgctcatgg

SEQ ID NO: 403632 - DNA, 20 bp, Artificial
  CRISPR gRNA sequence
tagttgcccgtgctcatggt

SEQ ID NO: 403633 - DNA, 20 bp, Artificial
  CRISPR gRNA sequence
cccgtgctcatggtgcagag

SEQ ID NO: 403634 - DNA, 20 bp, Artificial
  CRISPR gRNA sequence
atggtgcagaggagagatgc

SEQ ID NO: 403635 - DNA, 20 bp, Artificial
  CRISPR gRNA sequence
cttcattcttgatcacctcc

SEQ ID NO: 403636 - DNA, 20 bp, Artificial
  CRISPR gRNA sequence
cattcttgatcacctccaga

SEQ ID NO: 403637 - DNA, 20 bp, Artificial
  CRISPR gRNA sequence
attcttgatcacctccagag

SEQ ID NO: 403638 - DNA, 20 bp, Artificial
  CRISPR gRNA sequence
ttgatcacctccagagatgg

SEQ ID NO: 403639 - DNA, 20 bp, Artificial
  CRISPR gRNA sequence
gatcacctccagagatggca

SEQ ID NO: 403640 - DNA, 20 bp, Artificial
  CRISPR gRNA sequence
atcacctccagagatggcat

SEQ ID NO: 403641 - DNA, 20 bp, Artificial
  CRISPR gRNA sequence
cagagatggcatgcagcctg

SEQ ID NO: 403642 - DNA, 20 bp, Artificial
  CRISPR gRNA sequence
tggaatttccatatttctgg

SEQ ID NO: 403643 - DNA, 20 bp, Artificial
  CRISPR gRNA sequence
ccatatttctgggaatgagc

SEQ ID NO: 403644 - DNA, 20 bp, Artificial
  CRISPR gRNA sequence
catatttctgggaatgagct

SEQ ID NO: 403645 - DNA, 20 bp, Artificial
  CRISPR gRNA sequence
ctgggaatgagctcagacaa

SEQ ID NO: 403646 - DNA, 20 bp, Artificial
  CRISPR gRNA sequence
tgggaatgagctcagacaat

SEQ ID NO: 403647 - DNA, 20 bp, Artificial
  CRISPR gRNA sequence
ggaatgagctcagacaatag

SEQ ID NO: 403648 - DNA, 20 bp, Artificial
  CRISPR gRNA sequence
agacaataggctagagagag

SEQ ID NO: 403649 - DNA, 20 bp, Artificial
  CRISPR gRNA sequence
gagagagacacacagagaca

SEQ ID NO: 403650 - DNA, 20 bp, Artificial
  CRISPR gRNA sequence
agaaatgacagatttcataa

SEQ ID NO: 403651 - DNA, 20 bp, Artificial
  CRISPR gRNA sequence
cataatatattcgatgttgc

SEQ ID NO: 403652 - DNA, 20 bp, Artificial
  CRISPR gRNA sequence
ataatatattcgatgttgcg

SEQ ID NO: 403653 - DNA, 20 bp, Artificial
  CRISPR gRNA sequence
gatgttgcgtgtgaaataga

SEQ ID NO: 403654 - DNA, 20 bp, Artificial
  CRISPR gRNA sequence
cgtgtgaaatagaaaaggga

SEQ ID NO: 403655 - DNA, 20 bp, Artificial
  CRISPR gRNA sequence
aagagtggcaccaggtttta

SEQ ID NO: 403656 - DNA, 20 bp, Artificial
  CRISPR gRNA sequence
tacttgggatcctgagtaga

SEQ ID NO: 403657 - DNA, 20 bp, Artificial
  CRISPR gRNA sequence
acttgggatcctgagtagat

SEQ ID NO: 403658 - DNA, 20 bp, Artificial
  CRISPR gRNA sequence
cttgggatcctgagtagatg

SEQ ID NO: 403659 - DNA, 20 bp, Artificial
  CRISPR gRNA sequence
gggatcctgagtagatggtg

SEQ ID NO: 403660 - DNA, 20 bp, Artificial
  CRISPR gRNA sequence
ggatcctgagtagatggtgc

SEQ ID NO: 403661 - DNA, 20 bp, Artificial
  CRISPR gRNA sequence
agtagatggtgctgtcattg

SEQ ID NO: 403662 - DNA, 20 bp, Artificial
  CRISPR gRNA sequence
tcattgactgcatcagggag

SEQ ID NO: 403663 - DNA, 20 bp, Artificial
  CRISPR gRNA sequence
actgcatcagggagaatgag

SEQ ID NO: 403664 - DNA, 20 bp, Artificial
  CRISPR gRNA sequence
catcagggagaatgagatga

SEQ ID NO: 403665 - DNA, 20 bp, Artificial
  CRISPR gRNA sequence
cggagtggggttgaatcgtt

SEQ ID NO: 403666 - DNA, 20 bp, Artificial
  CRISPR gRNA sequence
aatcgtttaggtttagacat

SEQ ID NO: 403667 - DNA, 20 bp, Artificial
  CRISPR gRNA sequence
aggtttagacatccaagtga

SEQ ID NO: 403668 - DNA, 20 bp, Artificial
  CRISPR gRNA sequence
ggtttagacatccaagtgaa

SEQ ID NO: 403669 - DNA, 20 bp, Artificial
  CRISPR gRNA sequence
agacatccaagtgaagctct

SEQ ID NO: 403670 - DNA, 20 bp, Artificial
  CRISPR gRNA sequence
gacatccaagtgaagctctc

SEQ ID NO: 403671 - DNA, 20 bp, Artificial
  CRISPR gRNA sequence
tctagcaggcaggaggattt

SEQ ID NO: 403672 - DNA, 20 bp, Artificial
  CRISPR gRNA sequence
tagcaggcaggaggattttt

SEQ ID NO: 403673 - DNA, 20 bp, Artificial
  CRISPR gRNA sequence
gcaggcaggaggatttttta

SEQ ID NO: 403674 - DNA, 20 bp, Artificial
  CRISPR gRNA sequence
tttaatcagaacccaagaga

SEQ ID NO: 403675 - DNA, 20 bp, Artificial
  CRISPR gRNA sequence
ttaatcagaacccaagagag

SEQ ID NO: 403676 - DNA, 20 bp, Artificial
  CRISPR gRNA sequence
taatcagaacccaagagaga

SEQ ID NO: 403677 - DNA, 20 bp, Artificial
  CRISPR gRNA sequence
aatcagaacccaagagagaa

SEQ ID NO: 403678 - DNA, 20 bp, Artificial
  CRISPR gRNA sequence
atcagaacccaagagagaac

SEQ ID NO: 403679 - DNA, 20 bp, Artificial
  CRISPR gRNA sequence
gggttggagatgcaaatgtg

SEQ ID NO: 403680 - DNA, 20 bp, Artificial
  CRISPR gRNA sequence
ggttggagatgcaaatgtgg

SEQ ID NO: 403681 - DNA, 20 bp, Artificial
  CRISPR gRNA sequence
gagatgcaaatgtggtaaag

SEQ ID NO: 403682 - DNA, 20 bp, Artificial
  CRISPR gRNA sequence
tggctagtcttccttcacat

SEQ ID NO: 403683 - DNA, 20 bp, Artificial
  CRISPR gRNA sequence
ggctagtcttccttcacatt

SEQ ID NO: 403684 - DNA, 20 bp, Artificial
  CRISPR gRNA sequence
gctagtcttccttcacattc

SEQ ID NO: 403685 - DNA, 20 bp, Artificial
  CRISPR gRNA sequence
gtcttccttcacattcataa

SEQ ID NO: 403686 - DNA, 20 bp, Artificial
  CRISPR gRNA sequence
ccttcacattcataaccgtt

SEQ ID NO: 403687 - DNA, 20 bp, Artificial
  CRISPR gRNA sequence
cttcacattcataaccgttg

SEQ ID NO: 403688 - DNA, 20 bp, Artificial
  CRISPR gRNA sequence
cacattcataaccgttgaat

SEQ ID NO: 403689 - DNA, 20 bp, Artificial
  CRISPR gRNA sequence
acattcataaccgttgaatg

SEQ ID NO: 403690 - DNA, 20 bp, Artificial
  CRISPR gRNA sequence
ataaccgttgaatgtttatt

SEQ ID NO: 403691 - DNA, 20 bp, Artificial
  CRISPR gRNA sequence
aatgtttattatgtggcagc

SEQ ID NO: 403692 - DNA, 20 bp, Artificial
  CRISPR gRNA sequence
attatgtggcagccctgggc

SEQ ID NO: 403693 - DNA, 20 bp, Artificial
  CRISPR gRNA sequence
ttatgtggcagccctgggca

SEQ ID NO: 403694 - DNA, 20 bp, Artificial
  CRISPR gRNA sequence
tgtggcagccctgggcaggg

SEQ ID NO: 403695 - DNA, 20 bp, Artificial
  CRISPR gRNA sequence
ggcagggctctaaaggcttt

SEQ ID NO: 403696 - DNA, 20 bp, Artificial
  CRISPR gRNA sequence
taaaggctttacattgatta

SEQ ID NO: 403697 - DNA, 20 bp, Artificial
  CRISPR gRNA sequence
aaggctttacattgattatt

SEQ ID NO: 403698 - DNA, 20 bp, Artificial
  CRISPR gRNA sequence
tacattgattatttcattta

SEQ ID NO: 403699 - DNA, 20 bp, Artificial
  CRISPR gRNA sequence
acattgattatttcatttaa

SEQ ID NO: 403700 - DNA, 20 bp, Artificial
  CRISPR gRNA sequence
cattgattatttcatttaac

SEQ ID NO: 403701 - DNA, 20 bp, Artificial
  CRISPR gRNA sequence
attatttcatttaaccctca

SEQ ID NO: 403702 - DNA, 20 bp, Artificial
  CRISPR gRNA sequence
tttcatttaaccctcacatt

SEQ ID NO: 403703 - DNA, 20 bp, Artificial
  CRISPR gRNA sequence
catttaaccctcacattgtc

SEQ ID NO: 403704 - DNA, 20 bp, Artificial
  CRISPR gRNA sequence
atttaaccctcacattgtcc

SEQ ID NO: 403705 - DNA, 20 bp, Artificial
  CRISPR gRNA sequence
aaccctcacattgtccctgt

SEQ ID NO: 403706 - DNA, 20 bp, Artificial
  CRISPR gRNA sequence
accctcacattgtccctgtg

SEQ ID NO: 403707 - DNA, 20 bp, Artificial
  CRISPR gRNA sequence
acattgtccctgtgagggag

SEQ ID NO: 403708 - DNA, 20 bp, Artificial
  CRISPR gRNA sequence
tccctgtgagggagatagta

SEQ ID NO: 403709 - DNA, 20 bp, Artificial
  CRISPR gRNA sequence
tgagggagatagtattatta

SEQ ID NO: 403710 - DNA, 20 bp, Artificial
  CRISPR gRNA sequence
ttaatacataatttaaaaag

SEQ ID NO: 403711 - DNA, 20 bp, Artificial
  CRISPR gRNA sequence
atacataatttaaaaagcaa

SEQ ID NO: 403712 - DNA, 20 bp, Artificial
  CRISPR gRNA sequence
aaaaagcaaaatttaaaaag

SEQ ID NO: 403713 - DNA, 20 bp, Artificial
  CRISPR gRNA sequence
aaaagcaaaatttaaaaagt

SEQ ID NO: 403714 - DNA, 20 bp, Artificial
  CRISPR gRNA sequence
aaaaagtgaggatagactat

SEQ ID NO: 403715 - DNA, 20 bp, Artificial
  CRISPR gRNA sequence
aaaagtgaggatagactatg

SEQ ID NO: 403716 - DNA, 20 bp, Artificial
  CRISPR gRNA sequence
tggagcatatagggagaaaa

SEQ ID NO: 403717 - DNA, 20 bp, Artificial
  CRISPR gRNA sequence
gcacatgagagtgacttgat

SEQ ID NO: 403718 - DNA, 20 bp, Artificial
  CRISPR gRNA sequence
gataaaatgatgttacaagt

SEQ ID NO: 403719 - DNA, 20 bp, Artificial
  CRISPR gRNA sequence
ataaaatgatgttacaagta

SEQ ID NO: 403720 - DNA, 20 bp, Artificial
  CRISPR gRNA sequence
caagtacatgaagaaatcaa

SEQ ID NO: 403721 - DNA, 20 bp, Artificial
  CRISPR gRNA sequence
ctagatccagggtgtcctca

SEQ ID NO: 403722 - DNA, 20 bp, Artificial
  CRISPR gRNA sequence
gatccagggtgtcctcacga

SEQ ID NO: 403723 - DNA, 20 bp, Artificial
  CRISPR gRNA sequence
acgatccacaccacagtttg

SEQ ID NO: 403724 - DNA, 20 bp, Artificial
  CRISPR gRNA sequence
gcaaacaagtggcctgtaac

SEQ ID NO: 403725 - DNA, 20 bp, Artificial
  CRISPR gRNA sequence
caaacaagtggcctgtaaca

SEQ ID NO: 403726 - DNA, 20 bp, Artificial
  CRISPR gRNA sequence
taacacccatttcatttgac

SEQ ID NO: 403727 - DNA, 20 bp, Artificial
  CRISPR gRNA sequence
catttgaccaacacattttt

SEQ ID NO: 403728 - DNA, 20 bp, Artificial
  CRISPR gRNA sequence
atttgaccaacacatttttg

SEQ ID NO: 403729 - DNA, 20 bp, Artificial
  CRISPR gRNA sequence
gaccaacacatttttggaag

SEQ ID NO: 403730 - DNA, 20 bp, Artificial
  CRISPR gRNA sequence
accaacacatttttggaaga

SEQ ID NO: 403731 - DNA, 20 bp, Artificial
  CRISPR gRNA sequence
ttggaagatcagaaacactc

SEQ ID NO: 403732 - DNA, 20 bp, Artificial
  CRISPR gRNA sequence
tggaagatcagaaacactca

SEQ ID NO: 403733 - DNA, 20 bp, Artificial
  CRISPR gRNA sequence
ggaagatcagaaacactcat

SEQ ID NO: 403734 - DNA, 20 bp, Artificial
  CRISPR gRNA sequence
gaagatcagaaacactcata

SEQ ID NO: 403735 - DNA, 20 bp, Artificial
  CRISPR gRNA sequence
atatgcacatctggatggac

SEQ ID NO: 403736 - DNA, 20 bp, Artificial
  CRISPR gRNA sequence
gatggactattaatactgcc

SEQ ID NO: 403737 - DNA, 20 bp, Artificial
  CRISPR gRNA sequence
ttaatactgccataagtttt

SEQ ID NO: 403738 - DNA, 20 bp, Artificial
  CRISPR gRNA sequence
atactgccataagttttctg

SEQ ID NO: 403739 - DNA, 20 bp, Artificial
  CRISPR gRNA sequence
ccataagttttctgcttggc

SEQ ID NO: 403740 - DNA, 20 bp, Artificial
  CRISPR gRNA sequence
tctgcttggcagcattttct

SEQ ID NO: 403741 - DNA, 20 bp, Artificial
  CRISPR gRNA sequence
ctgcttggcagcattttcta

SEQ ID NO: 403742 - DNA, 20 bp, Artificial
  CRISPR gRNA sequence
tgcttggcagcattttctag

SEQ ID NO: 403743 - DNA, 20 bp, Artificial
  CRISPR gRNA sequence
cttggcagcattttctaggc

SEQ ID NO: 403744 - DNA, 20 bp, Artificial
  CRISPR gRNA sequence
ggcagcattttctaggctgg

SEQ ID NO: 403745 - DNA, 20 bp, Artificial
  CRISPR gRNA sequence
gcagcattttctaggctggg

SEQ ID NO: 403746 - DNA, 20 bp, Artificial
  CRISPR gRNA sequence
tctaggctgggtagcagcaa

SEQ ID NO: 403747 - DNA, 20 bp, Artificial
  CRISPR gRNA sequence
ctaggctgggtagcagcaac

SEQ ID NO: 403748 - DNA, 20 bp, Artificial
  CRISPR gRNA sequence
taggctgggtagcagcaacc

SEQ ID NO: 403749 - DNA, 20 bp, Artificial
  CRISPR gRNA sequence
ggctgggtagcagcaacctt

SEQ ID NO: 403750 - DNA, 20 bp, Artificial
  CRISPR gRNA sequence
ggtagcagcaacctttttgt

SEQ ID NO: 403751 - DNA, 20 bp, Artificial
  CRISPR gRNA sequence
tttgtaaataatatattcct

SEQ ID NO: 403752 - DNA, 20 bp, Artificial
  CRISPR gRNA sequence
ttgtaaataatatattcctg

SEQ ID NO: 403753 - DNA, 20 bp, Artificial
  CRISPR gRNA sequence
tgtaaataatatattcctga

SEQ ID NO: 403754 - DNA, 20 bp, Artificial
  CRISPR gRNA sequence
gtaaataatatattcctgag

SEQ ID NO: 403755 - DNA, 20 bp, Artificial
  CRISPR gRNA sequence
taaataatatattcctgagt

SEQ ID NO: 403756 - DNA, 20 bp, Artificial
  CRISPR gRNA sequence
ctgagtcacccacaatcccc

SEQ ID NO: 403757 - DNA, 20 bp, Artificial
  CRISPR gRNA sequence
agtcacccacaatccccact

SEQ ID NO: 403758 - DNA, 20 bp, Artificial
  CRISPR gRNA sequence
ttccctattgtaataccttt

SEQ ID NO: 403759 - DNA, 20 bp, Artificial
  CRISPR gRNA sequence
ccctattgtaatacctttgg

SEQ ID NO: 403760 - DNA, 20 bp, Artificial
  CRISPR gRNA sequence
cctattgtaatacctttggc

SEQ ID NO: 403761 - DNA, 20 bp, Artificial
  CRISPR gRNA sequence
ttgtaatacctttggctctg

SEQ ID NO: 403762 - DNA, 20 bp, Artificial
  CRISPR gRNA sequence
taatacctttggctctggtc

SEQ ID NO: 403763 - DNA, 20 bp, Artificial
  CRISPR gRNA sequence
tggctctggtcatttccatg

SEQ ID NO: 403764 - DNA, 20 bp, Artificial
  CRISPR gRNA sequence
ggctctggtcatttccatga

SEQ ID NO: 403765 - DNA, 20 bp, Artificial
  CRISPR gRNA sequence
gctctggtcatttccatgat

SEQ ID NO: 403766 - DNA, 20 bp, Artificial
  CRISPR gRNA sequence
tggtcatttccatgatcttc

SEQ ID NO: 403767 - DNA, 20 bp, Artificial
  CRISPR gRNA sequence
gtcatttccatgatcttcct

SEQ ID NO: 403768 - DNA, 20 bp, Artificial
  CRISPR gRNA sequence
ccatgatcttcctggaccct

SEQ ID NO: 403769 - DNA, 20 bp, Artificial
  CRISPR gRNA sequence
catgatcttcctggaccctc

SEQ ID NO: 403770 - DNA, 20 bp, Artificial
  CRISPR gRNA sequence
cctggaccctctgggaattt

SEQ ID NO: 403771 - DNA, 20 bp, Artificial
  CRISPR gRNA sequence
ctggaccctctgggaatttg

SEQ ID NO: 403772 - DNA, 20 bp, Artificial
  CRISPR gRNA sequence
gaccctctgggaatttgtct

SEQ ID NO: 403773 - DNA, 20 bp, Artificial
  CRISPR gRNA sequence
tgggaatttgtctttggagc

SEQ ID NO: 403774 - DNA, 20 bp, Artificial
  CRISPR gRNA sequence
ggaatttgtctttggagccc

SEQ ID NO: 403775 - DNA, 20 bp, Artificial
  CRISPR gRNA sequence
gtctttggagccctcaccta

SEQ ID NO: 403776 - DNA, 20 bp, Artificial
  CRISPR gRNA sequence
tctttggagccctcacctac

SEQ ID NO: 403777 - DNA, 20 bp, Artificial
  CRISPR gRNA sequence
tggagccctcacctacgtgg

SEQ ID NO: 403778 - DNA, 20 bp, Artificial
  CRISPR gRNA sequence
ggagccctcacctacgtggt

SEQ ID NO: 403779 - DNA, 20 bp, Artificial
  CRISPR gRNA sequence
gagccctcacctacgtggtt

SEQ ID NO: 403780 - DNA, 20 bp, Artificial
  CRISPR gRNA sequence
acctacgtggttaatcttga

SEQ ID NO: 403781 - DNA, 20 bp, Artificial
  CRISPR gRNA sequence
cgtggttaatcttgattctt

SEQ ID NO: 403782 - DNA, 20 bp, Artificial
  CRISPR gRNA sequence
atcttgattcttacaagtgc

SEQ ID NO: 403783 - DNA, 20 bp, Artificial
  CRISPR gRNA sequence
gattcttacaagtgctgttc

SEQ ID NO: 403784 - DNA, 20 bp, Artificial
  CRISPR gRNA sequence
attcttacaagtgctgttca

SEQ ID NO: 403785 - DNA, 20 bp, Artificial
  CRISPR gRNA sequence
ttacaagtgctgttcaaggt

SEQ ID NO: 403786 - DNA, 20 bp, Artificial
  CRISPR gRNA sequence
acaagtgctgttcaaggtct

SEQ ID NO: 403787 - DNA, 20 bp, Artificial
  CRISPR gRNA sequence
caagtgctgttcaaggtctt

SEQ ID NO: 403788 - DNA, 20 bp, Artificial
  CRISPR gRNA sequence
ttcaaggtcttctaaggctt

SEQ ID NO: 403789 - DNA, 20 bp, Artificial
  CRISPR gRNA sequence
aaggtcttctaaggcttggt

SEQ ID NO: 403790 - DNA, 20 bp, Artificial
  CRISPR gRNA sequence
ctaaggcttggtccctgcat

SEQ ID NO: 403791 - DNA, 20 bp, Artificial
  CRISPR gRNA sequence
taaggcttggtccctgcata

SEQ ID NO: 403792 - DNA, 20 bp, Artificial
  CRISPR gRNA sequence
aggcttggtccctgcatacc

SEQ ID NO: 403793 - DNA, 20 bp, Artificial
  CRISPR gRNA sequence
ggtccctgcataccttccaa

SEQ ID NO: 403794 - DNA, 20 bp, Artificial
  CRISPR gRNA sequence
gtccctgcataccttccaaa

SEQ ID NO: 403795 - DNA, 20 bp, Artificial
  CRISPR gRNA sequence
cataccttccaaagtcactt

SEQ ID NO: 403796 - DNA, 20 bp, Artificial
  CRISPR gRNA sequence
ccaaagtcactttgcattcc

SEQ ID NO: 403797 - DNA, 20 bp, Artificial
  CRISPR gRNA sequence
caaagtcactttgcattcct

SEQ ID NO: 403798 - DNA, 20 bp, Artificial
  CRISPR gRNA sequence
tgcattcctttttttcagcc

SEQ ID NO: 403799 - DNA, 20 bp, Artificial
  CRISPR gRNA sequence
gcattcctttttttcagcca

SEQ ID NO: 403800 - DNA, 20 bp, Artificial
  CRISPR gRNA sequence
cattcctttttttcagccaa

SEQ ID NO: 403801 - DNA, 20 bp, Artificial
  CRISPR gRNA sequence
ctttttttcagccaaacatg

SEQ ID NO: 403802 - DNA, 20 bp, Artificial
  CRISPR gRNA sequence
tttttcagccaaacatggtt

SEQ ID NO: 403803 - DNA, 20 bp, Artificial
  CRISPR gRNA sequence
ttttcagccaaacatggtta

SEQ ID NO: 403804 - DNA, 20 bp, Artificial
  CRISPR gRNA sequence
tttcagccaaacatggttaa

SEQ ID NO: 403805 - DNA, 20 bp, Artificial
  CRISPR gRNA sequence
ttcagccaaacatggttaag

SEQ ID NO: 403806 - DNA, 20 bp, Artificial
  CRISPR gRNA sequence
tcagccaaacatggttaagt

SEQ ID NO: 403807 - DNA, 20 bp, Artificial
  CRISPR gRNA sequence
cagccaaacatggttaagtg

SEQ ID NO: 403808 - DNA, 20 bp, Artificial
  CRISPR gRNA sequence
agccaaacatggttaagtgc

SEQ ID NO: 403809 - DNA, 20 bp, Artificial
  CRISPR gRNA sequence
agtgcaaattccctaggcat

SEQ ID NO: 403810 - DNA, 20 bp, Artificial
  CRISPR gRNA sequence
cctaggcatcctctgcattt

SEQ ID NO: 403811 - DNA, 20 bp, Artificial
  CRISPR gRNA sequence
ggcatcctctgcatttctga

SEQ ID NO: 403812 - DNA, 20 bp, Artificial
  CRISPR gRNA sequence
tgcatttctgaattgtagat

SEQ ID NO: 403813 - DNA, 20 bp, Artificial
  CRISPR gRNA sequence
catttctgaattgtagatat

SEQ ID NO: 403814 - DNA, 20 bp, Artificial
  CRISPR gRNA sequence
ctgaattgtagatatttttg

SEQ ID NO: 403815 - DNA, 20 bp, Artificial
  CRISPR gRNA sequence
tgaattgtagatatttttgc

SEQ ID NO: 403816 - DNA, 20 bp, Artificial
  CRISPR gRNA sequence
aattgtagatatttttgctt

SEQ ID NO: 403817 - DNA, 20 bp, Artificial
  CRISPR gRNA sequence
tagatatttttgcttgtgcc

SEQ ID NO: 403818 - DNA, 20 bp, Artificial
  CRISPR gRNA sequence
ttgcttgtgccttttctttc

SEQ ID NO: 403819 - DNA, 20 bp, Artificial
  CRISPR gRNA sequence
tgcttgtgccttttctttcc

SEQ ID NO: 403820 - DNA, 20 bp, Artificial
  CRISPR gRNA sequence
gcttgtgccttttctttccc

SEQ ID NO: 403821 - DNA, 20 bp, Artificial
  CRISPR gRNA sequence
cttgtgccttttctttccct

SEQ ID NO: 403822 - DNA, 20 bp, Artificial
  CRISPR gRNA sequence
gtgccttttctttcccttac

SEQ ID NO: 403823 - DNA, 20 bp, Artificial
  CRISPR gRNA sequence
tgccttttctttcccttact

SEQ ID NO: 403824 - DNA, 20 bp, Artificial
  CRISPR gRNA sequence
ttctttcccttactctttca

SEQ ID NO: 403825 - DNA, 20 bp, Artificial
  CRISPR gRNA sequence
tctttcccttactctttcac

SEQ ID NO: 403826 - DNA, 20 bp, Artificial
  CRISPR gRNA sequence
ctttcccttactctttcact

SEQ ID NO: 403827 - DNA, 20 bp, Artificial
  CRISPR gRNA sequence
tttcccttactctttcactc

SEQ ID NO: 403828 - DNA, 20 bp, Artificial
  CRISPR gRNA sequence
tcccttactctttcactctg

SEQ ID NO: 403829 - DNA, 20 bp, Artificial
  CRISPR gRNA sequence
cccttactctttcactctgt

SEQ ID NO: 403830 - DNA, 20 bp, Artificial
  CRISPR gRNA sequence
ccttactctttcactctgtg

SEQ ID NO: 403831 - DNA, 20 bp, Artificial
  CRISPR gRNA sequence
actctttcactctgtgtact

SEQ ID NO: 403832 - DNA, 20 bp, Artificial
  CRISPR gRNA sequence
ctctttcactctgtgtacta

SEQ ID NO: 403833 - DNA, 20 bp, Artificial
  CRISPR gRNA sequence
tttcactctgtgtactacag

SEQ ID NO: 403834 - DNA, 20 bp, Artificial
  CRISPR gRNA sequence
tcactctgtgtactacagac

SEQ ID NO: 403835 - DNA, 20 bp, Artificial
  CRISPR gRNA sequence
cactctgtgtactacagact

SEQ ID NO: 403836 - DNA, 20 bp, Artificial
  CRISPR gRNA sequence
actctgtgtactacagactg

SEQ ID NO: 403837 - DNA, 20 bp, Artificial
  CRISPR gRNA sequence
tgtgtactacagactgaata

SEQ ID NO: 403838 - DNA, 20 bp, Artificial
  CRISPR gRNA sequence
tgtactacagactgaatatc

SEQ ID NO: 403839 - DNA, 20 bp, Artificial
  CRISPR gRNA sequence
cagactgaatatcccaaatc

SEQ ID NO: 403840 - DNA, 20 bp, Artificial
  CRISPR gRNA sequence
aatatcccaaatcaaaaaat

SEQ ID NO: 403841 - DNA, 20 bp, Artificial
  CRISPR gRNA sequence
aaatctgaaatgctccaaaa

SEQ ID NO: 403842 - DNA, 20 bp, Artificial
  CRISPR gRNA sequence
aaatgctccaaaatccaaaa

SEQ ID NO: 403843 - DNA, 20 bp, Artificial
  CRISPR gRNA sequence
caaaatccaaaactctttga

SEQ ID NO: 403844 - DNA, 20 bp, Artificial
  CRISPR gRNA sequence
tttgaatgccaacatgatgc

SEQ ID NO: 403845 - DNA, 20 bp, Artificial
  CRISPR gRNA sequence
tgaatgccaacatgatgctc

SEQ ID NO: 403846 - DNA, 20 bp, Artificial
  CRISPR gRNA sequence
gaatgccaacatgatgctca

SEQ ID NO: 403847 - DNA, 20 bp, Artificial
  CRISPR gRNA sequence
aatgccaacatgatgctcaa

SEQ ID NO: 403848 - DNA, 20 bp, Artificial
  CRISPR gRNA sequence
aaaggaaatgctcattggag

SEQ ID NO: 403849 - DNA, 20 bp, Artificial
  CRISPR gRNA sequence
attggagcattttagatttc

SEQ ID NO: 403850 - DNA, 20 bp, Artificial
  CRISPR gRNA sequence
gagcattttagatttcagat

SEQ ID NO: 403851 - DNA, 20 bp, Artificial
  CRISPR gRNA sequence
tagatttcagatttttggat

SEQ ID NO: 403852 - DNA, 20 bp, Artificial
  CRISPR gRNA sequence
agatttcagatttttggatt

SEQ ID NO: 403853 - DNA, 20 bp, Artificial
  CRISPR gRNA sequence
gatttcagatttttggattt

SEQ ID NO: 403854 - DNA, 20 bp, Artificial
  CRISPR gRNA sequence
cagatttttggatttgggat

SEQ ID NO: 403855 - DNA, 20 bp, Artificial
  CRISPR gRNA sequence
agatttttggatttgggatg

SEQ ID NO: 403856 - DNA, 20 bp, Artificial
  CRISPR gRNA sequence
ttggatttgggatgttcagc

SEQ ID NO: 403857 - DNA, 20 bp, Artificial
  CRISPR gRNA sequence
tggatttgggatgttcagct

SEQ ID NO: 403858 - DNA, 20 bp, Artificial
  CRISPR gRNA sequence
ggatttgggatgttcagctg

SEQ ID NO: 403859 - DNA, 20 bp, Artificial
  CRISPR gRNA sequence
gatttgggatgttcagctgg

SEQ ID NO: 403860 - DNA, 20 bp, Artificial
  CRISPR gRNA sequence
gggatgttcagctggtatga

SEQ ID NO: 403861 - DNA, 20 bp, Artificial
  CRISPR gRNA sequence
ggatgttcagctggtatgat

SEQ ID NO: 403862 - DNA, 20 bp, Artificial
  CRISPR gRNA sequence
agctggtatgatgtaaatat

SEQ ID NO: 403863 - DNA, 20 bp, Artificial
  CRISPR gRNA sequence
gtatgatgtaaatattccaa

SEQ ID NO: 403864 - DNA, 20 bp, Artificial
  CRISPR gRNA sequence
caaaatccaaaagaatccca

SEQ ID NO: 403865 - DNA, 20 bp, Artificial
  CRISPR gRNA sequence
aaacacttatgttcccaagt

SEQ ID NO: 403866 - DNA, 20 bp, Artificial
  CRISPR gRNA sequence
atgttcccaagtattttgga

SEQ ID NO: 403867 - DNA, 20 bp, Artificial
  CRISPR gRNA sequence
tgttcccaagtattttggat

SEQ ID NO: 403868 - DNA, 20 bp, Artificial
  CRISPR gRNA sequence
ccaagtattttggataaggg

SEQ ID NO: 403869 - DNA, 20 bp, Artificial
  CRISPR gRNA sequence
tggataagggatactcaacc

SEQ ID NO: 403870 - DNA, 20 bp, Artificial
  CRISPR gRNA sequence
ggataagggatactcaacct

SEQ ID NO: 403871 - DNA, 20 bp, Artificial
  CRISPR gRNA sequence
gataagggatactcaacctg

SEQ ID NO: 403872 - DNA, 20 bp, Artificial
  CRISPR gRNA sequence
aacctgtactcattcttcag

SEQ ID NO: 403873 - DNA, 20 bp, Artificial
  CRISPR gRNA sequence
tactcattcttcagctaagg

SEQ ID NO: 403874 - DNA, 20 bp, Artificial
  CRISPR gRNA sequence
attcttcagctaaggaaaca

SEQ ID NO: 403875 - DNA, 20 bp, Artificial
  CRISPR gRNA sequence
ttcagctaaggaaacattgt

SEQ ID NO: 403876 - DNA, 20 bp, Artificial
  CRISPR gRNA sequence
cagctaaggaaacattgtcc

SEQ ID NO: 403877 - DNA, 20 bp, Artificial
  CRISPR gRNA sequence
agctaaggaaacattgtccc

SEQ ID NO: 403878 - DNA, 20 bp, Artificial
  CRISPR gRNA sequence
aggaaacattgtcccacccc

SEQ ID NO: 403879 - DNA, 20 bp, Artificial
  CRISPR gRNA sequence
tcccacccctaaaacaggaa

SEQ ID NO: 403880 - DNA, 20 bp, Artificial
  CRISPR gRNA sequence
aaacaggaatccatgtttcc

SEQ ID NO: 403881 - DNA, 20 bp, Artificial
  CRISPR gRNA sequence
cctgcattcccccggatgtt

SEQ ID NO: 403882 - DNA, 20 bp, Artificial
  CRISPR gRNA sequence
ctgcattcccccggatgttg

SEQ ID NO: 403883 - DNA, 20 bp, Artificial
  CRISPR gRNA sequence
cattcccccggatgttgttt

SEQ ID NO: 403884 - DNA, 20 bp, Artificial
  CRISPR gRNA sequence
ccccggatgttgtttgtggc

SEQ ID NO: 403885 - DNA, 20 bp, Artificial
  CRISPR gRNA sequence
tttgtggccaccttttcatt

SEQ ID NO: 403886 - DNA, 20 bp, Artificial
  CRISPR gRNA sequence
gtggccaccttttcattgaa

SEQ ID NO: 403887 - DNA, 20 bp, Artificial
  CRISPR gRNA sequence
tggccaccttttcattgaac

SEQ ID NO: 403888 - DNA, 20 bp, Artificial
  CRISPR gRNA sequence
ttcattgaacatattttatt

SEQ ID NO: 403889 - DNA, 20 bp, Artificial
  CRISPR gRNA sequence
tcattgaacatattttattt

SEQ ID NO: 403890 - DNA, 20 bp, Artificial
  CRISPR gRNA sequence
cattgaacatattttatttt

SEQ ID NO: 403891 - DNA, 20 bp, Artificial
  CRISPR gRNA sequence
attgaacatattttattttc

SEQ ID NO: 403892 - DNA, 20 bp, Artificial
  CRISPR gRNA sequence
aacatattttattttccttg

SEQ ID NO: 403893 - DNA, 20 bp, Artificial
  CRISPR gRNA sequence
tattttccttgcattccatc

SEQ ID NO: 403894 - DNA, 20 bp, Artificial
  CRISPR gRNA sequence
attttccttgcattccatct

SEQ ID NO: 403895 - DNA, 20 bp, Artificial
  CRISPR gRNA sequence
ttttccttgcattccatcta

SEQ ID NO: 403896 - DNA, 20 bp, Artificial
  CRISPR gRNA sequence
tccttgcattccatctagtg

SEQ ID NO: 403897 - DNA, 20 bp, Artificial
  CRISPR gRNA sequence
ccttgcattccatctagtga

SEQ ID NO: 403898 - DNA, 20 bp, Artificial
  CRISPR gRNA sequence
cttgcattccatctagtgat

SEQ ID NO: 403899 - DNA, 20 bp, Artificial
  CRISPR gRNA sequence
gcattccatctagtgattac

SEQ ID NO: 403900 - DNA, 20 bp, Artificial
  CRISPR gRNA sequence
cattccatctagtgattacc

SEQ ID NO: 403901 - DNA, 20 bp, Artificial
  CRISPR gRNA sequence
catctagtgattaccattgc

SEQ ID NO: 403902 - DNA, 20 bp, Artificial
  CRISPR gRNA sequence
gtgattaccattgccatctc

SEQ ID NO: 403903 - DNA, 20 bp, Artificial
  CRISPR gRNA sequence
ccattgccatctccctcacc

SEQ ID NO: 403904 - DNA, 20 bp, Artificial
  CRISPR gRNA sequence
ccatctccctcaccgcctcc

SEQ ID NO: 403905 - DNA, 20 bp, Artificial
  CRISPR gRNA sequence
cctcaccgcctcctgtcctg

SEQ ID NO: 403906 - DNA, 20 bp, Artificial
  CRISPR gRNA sequence
accgcctcctgtcctgaatg

SEQ ID NO: 403907 - DNA, 20 bp, Artificial
  CRISPR gRNA sequence
ctgtcctgaatgagggcagg

SEQ ID NO: 403908 - DNA, 20 bp, Artificial
  CRISPR gRNA sequence
tcctgaatgagggcaggcca

SEQ ID NO: 403909 - DNA, 20 bp, Artificial
  CRISPR gRNA sequence
aatgagggcaggccacatcc

SEQ ID NO: 403910 - DNA, 20 bp, Artificial
  CRISPR gRNA sequence
ccctcttcatgatcccaata

SEQ ID NO: 403911 - DNA, 20 bp, Artificial
  CRISPR gRNA sequence
cctcttcatgatcccaataa

SEQ ID NO: 403912 - DNA, 20 bp, Artificial
  CRISPR gRNA sequence
ttcatgatcccaataatgtt

SEQ ID NO: 403913 - DNA, 20 bp, Artificial
  CRISPR gRNA sequence
catgatcccaataatgttgg

SEQ ID NO: 403914 - DNA, 20 bp, Artificial
  CRISPR gRNA sequence
atgatcccaataatgttggg

SEQ ID NO: 403915 - DNA, 20 bp, Artificial
  CRISPR gRNA sequence
ggaacagagctttgccctta

SEQ ID NO: 403916 - DNA, 20 bp, Artificial
  CRISPR gRNA sequence
tgcccttaggagacatgctc

SEQ ID NO: 403917 - DNA, 20 bp, Artificial
  CRISPR gRNA sequence
gcccttaggagacatgctca

SEQ ID NO: 403918 - DNA, 20 bp, Artificial
  CRISPR gRNA sequence
cccttaggagacatgctcaa

SEQ ID NO: 403919 - DNA, 20 bp, Artificial
  CRISPR gRNA sequence
aggagacatgctcaataaaa

SEQ ID NO: 403920 - DNA, 20 bp, Artificial
  CRISPR gRNA sequence
ggagacatgctcaataaaac

SEQ ID NO: 403921 - DNA, 20 bp, Artificial
  CRISPR gRNA sequence
aataaaacagcaaaagagtt

SEQ ID NO: 403922 - DNA, 20 bp, Artificial
  CRISPR gRNA sequence
gggtgaagtagggggagtga

SEQ ID NO: 403923 - DNA, 20 bp, Artificial
  CRISPR gRNA sequence
ctgatctgtacataggaaac

SEQ ID NO: 403924 - DNA, 20 bp, Artificial
  CRISPR gRNA sequence
atctgtacataggaaacgta

SEQ ID NO: 403925 - DNA, 20 bp, Artificial
  CRISPR gRNA sequence
tacataggaaacgtatgaat

SEQ ID NO: 403926 - DNA, 20 bp, Artificial
  CRISPR gRNA sequence
catatgtaattaagtagaat

SEQ ID NO: 403927 - DNA, 20 bp, Artificial
  CRISPR gRNA sequence
agtagaatagaacagctgcc

SEQ ID NO: 403928 - DNA, 20 bp, Artificial
  CRISPR gRNA sequence
cctatgagtactttcgagta

SEQ ID NO: 403929 - DNA, 20 bp, Artificial
  CRISPR gRNA sequence
tgagtactttcgagtaagtg

SEQ ID NO: 403930 - DNA, 20 bp, Artificial
  CRISPR gRNA sequence
tcgagtaagtgaaaagtatt

SEQ ID NO: 403931 - DNA, 20 bp, Artificial
  CRISPR gRNA sequence
cgagtaagtgaaaagtattc

SEQ ID NO: 403932 - DNA, 20 bp, Artificial
  CRISPR gRNA sequence
gagtaagtgaaaagtattcc

SEQ ID NO: 403933 - DNA, 20 bp, Artificial
  CRISPR gRNA sequence
ccctgggtgggaacaaaggt

SEQ ID NO: 403934 - DNA, 20 bp, Artificial
  CRISPR gRNA sequence
ggtgggaacaaaggtttata

SEQ ID NO: 403935 - DNA, 20 bp, Artificial
  CRISPR gRNA sequence
atagctcatcatatgtgaaa

SEQ ID NO: 403936 - DNA, 20 bp, Artificial
  CRISPR gRNA sequence
tagctcatcatatgtgaaac

SEQ ID NO: 403937 - DNA, 20 bp, Artificial
  CRISPR gRNA sequence
atcatatgtgaaacatggtt

SEQ ID NO: 403938 - DNA, 20 bp, Artificial
  CRISPR gRNA sequence
gaagtgtatttggatatgaa

SEQ ID NO: 403939 - DNA, 20 bp, Artificial
  CRISPR gRNA sequence
aagtgtatttggatatgaat

SEQ ID NO: 403940 - DNA, 20 bp, Artificial
  CRISPR gRNA sequence
ggatatgaatttgtctttct

SEQ ID NO: 403941 - DNA, 20 bp, Artificial
  CRISPR gRNA sequence
gatatgaatttgtctttcta

SEQ ID NO: 403942 - DNA, 20 bp, Artificial
  CRISPR gRNA sequence
gtctttctaaatggtttgaa

SEQ ID NO: 403943 - DNA, 20 bp, Artificial
  CRISPR gRNA sequence
tctttctaaatggtttgaaa

SEQ ID NO: 403944 - DNA, 20 bp, Artificial
  CRISPR gRNA sequence
tctaaatggtttgaaactta

SEQ ID NO: 403945 - DNA, 20 bp, Artificial
  CRISPR gRNA sequence
ctaaatggtttgaaacttat

SEQ ID NO: 403946 - DNA, 20 bp, Artificial
  CRISPR gRNA sequence
taaatggtttgaaacttatc

SEQ ID NO: 403947 - DNA, 20 bp, Artificial
  CRISPR gRNA sequence
aatggtttgaaacttatcta

SEQ ID NO: 403948 - DNA, 20 bp, Artificial
  CRISPR gRNA sequence
gaaacttatctaccgctttt

SEQ ID NO: 403949 - DNA, 20 bp, Artificial
  CRISPR gRNA sequence
aaacttatctaccgcttttc

SEQ ID NO: 403950 - DNA, 20 bp, Artificial
  CRISPR gRNA sequence
atctaccgcttttctgcata

SEQ ID NO: 403951 - DNA, 20 bp, Artificial
  CRISPR gRNA sequence
tctaccgcttttctgcatat

SEQ ID NO: 403952 - DNA, 20 bp, Artificial
  CRISPR gRNA sequence
ccgcttttctgcatatttca

SEQ ID NO: 403953 - DNA, 20 bp, Artificial
  CRISPR gRNA sequence
ttctgcatatttcatagctt

SEQ ID NO: 403954 - DNA, 20 bp, Artificial
  CRISPR gRNA sequence
tctgcatatttcatagctta

SEQ ID NO: 403955 - DNA, 20 bp, Artificial
  CRISPR gRNA sequence
ctgcatatttcatagcttaa

SEQ ID NO: 403956 - DNA, 20 bp, Artificial
  CRISPR gRNA sequence
tgcatatttcatagcttaat

SEQ ID NO: 403957 - DNA, 20 bp, Artificial
  CRISPR gRNA sequence
catatttcatagcttaatga

SEQ ID NO: 403958 - DNA, 20 bp, Artificial
  CRISPR gRNA sequence
catagcttaatgagattctt

SEQ ID NO: 403959 - DNA, 20 bp, Artificial
  CRISPR gRNA sequence
atagcttaatgagattcttc

SEQ ID NO: 403960 - DNA, 20 bp, Artificial
  CRISPR gRNA sequence
aatgagattcttcagtattt

SEQ ID NO: 403961 - DNA, 20 bp, Artificial
  CRISPR gRNA sequence
atgagattcttcagtatttc

SEQ ID NO: 403962 - DNA, 20 bp, Artificial
  CRISPR gRNA sequence
ttcagtatttcacccactag

SEQ ID NO: 403963 - DNA, 20 bp, Artificial
  CRISPR gRNA sequence
cagtatttcacccactagtt

SEQ ID NO: 403964 - DNA, 20 bp, Artificial
  CRISPR gRNA sequence
agtatttcacccactagttt

SEQ ID NO: 403965 - DNA, 20 bp, Artificial
  CRISPR gRNA sequence
cacccactagtttgttattt

SEQ ID NO: 403966 - DNA, 20 bp, Artificial
  CRISPR gRNA sequence
acccactagtttgttatttt

SEQ ID NO: 403967 - DNA, 20 bp, Artificial
  CRISPR gRNA sequence
gtttgttattttaccactca

SEQ ID NO: 403968 - DNA, 20 bp, Artificial
  CRISPR gRNA sequence
gttattttaccactcagagt

SEQ ID NO: 403969 - DNA, 20 bp, Artificial
  CRISPR gRNA sequence
ttattttaccactcagagtg

SEQ ID NO: 403970 - DNA, 20 bp, Artificial
  CRISPR gRNA sequence
ttttaccactcagagtggtt

SEQ ID NO: 403971 - DNA, 20 bp, Artificial
  CRISPR gRNA sequence
taccactcagagtggtttag

SEQ ID NO: 403972 - DNA, 20 bp, Artificial
  CRISPR gRNA sequence
accactcagagtggtttagt

SEQ ID NO: 403973 - DNA, 20 bp, Artificial
  CRISPR gRNA sequence
ccactcagagtggtttagtg

SEQ ID NO: 403974 - DNA, 20 bp, Artificial
  CRISPR gRNA sequence
agagtggtttagtgtcattt

SEQ ID NO: 403975 - DNA, 20 bp, Artificial
  CRISPR gRNA sequence
agtgtcatttgcaagttttt

SEQ ID NO: 403976 - DNA, 20 bp, Artificial
  CRISPR gRNA sequence
gtgtcatttgcaagtttttg

SEQ ID NO: 403977 - DNA, 20 bp, Artificial
  CRISPR gRNA sequence
gcaagtttttgatagggata

SEQ ID NO: 403978 - DNA, 20 bp, Artificial
  CRISPR gRNA sequence
caagtttttgatagggatat

SEQ ID NO: 403979 - DNA, 20 bp, Artificial
  CRISPR gRNA sequence
ttgatagggatatttattag

SEQ ID NO: 403980 - DNA, 20 bp, Artificial
  CRISPR gRNA sequence
tgatagggatatttattagc

SEQ ID NO: 403981 - DNA, 20 bp, Artificial
  CRISPR gRNA sequence
gatagggatatttattagca

SEQ ID NO: 403982 - DNA, 20 bp, Artificial
  CRISPR gRNA sequence
atagggatatttattagcac

SEQ ID NO: 403983 - DNA, 20 bp, Artificial
  CRISPR gRNA sequence
attagcacattatttgtaaa

SEQ ID NO: 403984 - DNA, 20 bp, Artificial
  CRISPR gRNA sequence
ttagcacattatttgtaaac

SEQ ID NO: 403985 - DNA, 20 bp, Artificial
  CRISPR gRNA sequence
gcacattatttgtaaacata

SEQ ID NO: 403986 - DNA, 20 bp, Artificial
  CRISPR gRNA sequence
tttgtaaacatattatgtga

SEQ ID NO: 403987 - DNA, 20 bp, Artificial
  CRISPR gRNA sequence
gtaaacatattatgtgaact

SEQ ID NO: 403988 - DNA, 20 bp, Artificial
  CRISPR gRNA sequence
taaacatattatgtgaactt

SEQ ID NO: 403989 - DNA, 20 bp, Artificial
  CRISPR gRNA sequence
tgtgaacttagtacactcat

SEQ ID NO: 403990 - DNA, 20 bp, Artificial
  CRISPR gRNA sequence
agtacactcatgttcataac

SEQ ID NO: 403991 - DNA, 20 bp, Artificial
  CRISPR gRNA sequence
gtacactcatgttcataaca

SEQ ID NO: 403992 - DNA, 20 bp, Artificial
  CRISPR gRNA sequence
atgttcataacagcattatt

SEQ ID NO: 403993 - DNA, 20 bp, Artificial
  CRISPR gRNA sequence
ataacagcattattcacaac

SEQ ID NO: 403994 - DNA, 20 bp, Artificial
  CRISPR gRNA sequence
ttcacaacagctaaaaagaa

SEQ ID NO: 403995 - DNA, 20 bp, Artificial
  CRISPR gRNA sequence
acaacagctaaaaagaagaa

SEQ ID NO: 403996 - DNA, 20 bp, Artificial
  CRISPR gRNA sequence
aaaagaagaagcaacctaag

SEQ ID NO: 403997 - DNA, 20 bp, Artificial
  CRISPR gRNA sequence
agtgtctacggaggaataaa

SEQ ID NO: 403998 - DNA, 20 bp, Artificial
  CRISPR gRNA sequence
cggaggaataaatggacaaa

SEQ ID NO: 403999 - DNA, 20 bp, Artificial
  CRISPR gRNA sequence
cagtgtatatctattatgcg

SEQ ID NO: 404000 - DNA, 20 bp, Artificial
  CRISPR gRNA sequence
ttatgcgtatatgtatataa

SEQ ID NO: 404001 - DNA, 20 bp, Artificial
  CRISPR gRNA sequence
tgcgtatatgtatataaaat

SEQ ID NO: 404002 - DNA, 20 bp, Artificial
  CRISPR gRNA sequence
ttcattcttaaaaatgagga

SEQ ID NO: 404003 - DNA, 20 bp, Artificial
  CRISPR gRNA sequence
cattcttaaaaatgaggact

SEQ ID NO: 404004 - DNA, 20 bp, Artificial
  CRISPR gRNA sequence
attcttaaaaatgaggacta

SEQ ID NO: 404005 - DNA, 20 bp, Artificial
  CRISPR gRNA sequence
ttaaaaatgaggactatttg

SEQ ID NO: 404006 - DNA, 20 bp, Artificial
  CRISPR gRNA sequence
aaaaatgaggactatttgaa

SEQ ID NO: 404007 - DNA, 20 bp, Artificial
  CRISPR gRNA sequence
aaaatgaggactatttgaac

SEQ ID NO: 404008 - DNA, 20 bp, Artificial
  CRISPR gRNA sequence
tttgaacacatgctgcaaca

SEQ ID NO: 404009 - DNA, 20 bp, Artificial
  CRISPR gRNA sequence
gaacacatgctgcaacatgg

SEQ ID NO: 404010 - DNA, 20 bp, Artificial
  CRISPR gRNA sequence
aacacatgctgcaacatggg

SEQ ID NO: 404011 - DNA, 20 bp, Artificial
  CRISPR gRNA sequence
caacatgggtgaaccctggg

SEQ ID NO: 404012 - DNA, 20 bp, Artificial
  CRISPR gRNA sequence
gggacattattccaaatgaa

SEQ ID NO: 404013 - DNA, 20 bp, Artificial
  CRISPR gRNA sequence
ttccaaatgaacaaagccag

SEQ ID NO: 404014 - DNA, 20 bp, Artificial
  CRISPR gRNA sequence
caaatgaacaaagccagtca

SEQ ID NO: 404015 - DNA, 20 bp, Artificial
  CRISPR gRNA sequence
tgtgattccacttatatgag

SEQ ID NO: 404016 - DNA, 20 bp, Artificial
  CRISPR gRNA sequence
gtgattccacttatatgagg

SEQ ID NO: 404017 - DNA, 20 bp, Artificial
  CRISPR gRNA sequence
tgattccacttatatgaggt

SEQ ID NO: 404018 - DNA, 20 bp, Artificial
  CRISPR gRNA sequence
cacttatatgaggtacacag

SEQ ID NO: 404019 - DNA, 20 bp, Artificial
  CRISPR gRNA sequence
atatgaggtacacagaggag

SEQ ID NO: 404020 - DNA, 20 bp, Artificial
  CRISPR gRNA sequence
tatgaggtacacagaggagt

SEQ ID NO: 404021 - DNA, 20 bp, Artificial
  CRISPR gRNA sequence
attgattcagaaagtggaat

SEQ ID NO: 404022 - DNA, 20 bp, Artificial
  CRISPR gRNA sequence
attcagaaagtggaatggta

SEQ ID NO: 404023 - DNA, 20 bp, Artificial
  CRISPR gRNA sequence
agaaagtggaatggtagttg

SEQ ID NO: 404024 - DNA, 20 bp, Artificial
  CRISPR gRNA sequence
tcgggggtgggggatgggag

SEQ ID NO: 404025 - DNA, 20 bp, Artificial
  CRISPR gRNA sequence
tttaatgggtaggatttcga

SEQ ID NO: 404026 - DNA, 20 bp, Artificial
  CRISPR gRNA sequence
aatgggtaggatttcgattc

SEQ ID NO: 404027 - DNA, 20 bp, Artificial
  CRISPR gRNA sequence
atgggtaggatttcgattct

SEQ ID NO: 404028 - DNA, 20 bp, Artificial
  CRISPR gRNA sequence
cgattctgtgagataaaaag

SEQ ID NO: 404029 - DNA, 20 bp, Artificial
  CRISPR gRNA sequence
gattctgtgagataaaaaga

SEQ ID NO: 404030 - DNA, 20 bp, Artificial
  CRISPR gRNA sequence
tgtgagataaaaagagttct

SEQ ID NO: 404031 - DNA, 20 bp, Artificial
  CRISPR gRNA sequence
tgagataaaaagagttctga

SEQ ID NO: 404032 - DNA, 20 bp, Artificial
  CRISPR gRNA sequence
tgaaaattgggtatacaaca

SEQ ID NO: 404033 - DNA, 20 bp, Artificial
  CRISPR gRNA sequence
aaaattgggtatacaacaat

SEQ ID NO: 404034 - DNA, 20 bp, Artificial
  CRISPR gRNA sequence
ggtatacaacaatgtgaata

SEQ ID NO: 404035 - DNA, 20 bp, Artificial
  CRISPR gRNA sequence
aatgctactgaactgtacat

SEQ ID NO: 404036 - DNA, 20 bp, Artificial
  CRISPR gRNA sequence
atgctactgaactgtacatt

SEQ ID NO: 404037 - DNA, 20 bp, Artificial
  CRISPR gRNA sequence
ctgaactgtacattttaaaa

SEQ ID NO: 404038 - DNA, 20 bp, Artificial
  CRISPR gRNA sequence
aactgtacattttaaaaggg

SEQ ID NO: 404039 - DNA, 20 bp, Artificial
  CRISPR gRNA sequence
tacattttaaaagggctaag

SEQ ID NO: 404040 - DNA, 20 bp, Artificial
  CRISPR gRNA sequence
taaaagggctaagatggtat

SEQ ID NO: 404041 - DNA, 20 bp, Artificial
  CRISPR gRNA sequence
aaaagggctaagatggtata

SEQ ID NO: 404042 - DNA, 20 bp, Artificial
  CRISPR gRNA sequence
aaagggctaagatggtatat

SEQ ID NO: 404043 - DNA, 20 bp, Artificial
  CRISPR gRNA sequence
agatggtatatgtgtgtgtg

SEQ ID NO: 404044 - DNA, 20 bp, Artificial
  CRISPR gRNA sequence
gtgtgtgtgtgtgtgtgtgt

SEQ ID NO: 404045 - DNA, 20 bp, Artificial
  CRISPR gRNA sequence
tgtgtgtgtgtgtgtgtgtg

SEQ ID NO: 404046 - DNA, 20 bp, Artificial
  CRISPR gRNA sequence
agtctgttcaggctgctata

SEQ ID NO: 404047 - DNA, 20 bp, Artificial
  CRISPR gRNA sequence
gtctgttcaggctgctataa

SEQ ID NO: 404048 - DNA, 20 bp, Artificial
  CRISPR gRNA sequence
ttcaggctgctataacaaag

SEQ ID NO: 404049 - DNA, 20 bp, Artificial
  CRISPR gRNA sequence
aggctgctataacaaagtac

SEQ ID NO: 404050 - DNA, 20 bp, Artificial
  CRISPR gRNA sequence
ctataacaaagtaccttaga

SEQ ID NO: 404051 - DNA, 20 bp, Artificial
  CRISPR gRNA sequence
taacaaagtaccttagatgg

SEQ ID NO: 404052 - DNA, 20 bp, Artificial
  CRISPR gRNA sequence
agatgggtaatttataaata

SEQ ID NO: 404053 - DNA, 20 bp, Artificial
  CRISPR gRNA sequence
gatgggtaatttataaataa

SEQ ID NO: 404054 - DNA, 20 bp, Artificial
  CRISPR gRNA sequence
ataaataaatgagttgtata

SEQ ID NO: 404055 - DNA, 20 bp, Artificial
  CRISPR gRNA sequence
taaataaatgagttgtatat

SEQ ID NO: 404056 - DNA, 20 bp, Artificial
  CRISPR gRNA sequence
tatatctcaccgttctagag

SEQ ID NO: 404057 - DNA, 20 bp, Artificial
  CRISPR gRNA sequence
accgttctagaggctaggaa

SEQ ID NO: 404058 - DNA, 20 bp, Artificial
  CRISPR gRNA sequence
tagaggctaggaagtccaag

SEQ ID NO: 404059 - DNA, 20 bp, Artificial
  CRISPR gRNA sequence
gaggctaggaagtccaagac

SEQ ID NO: 404060 - DNA, 20 bp, Artificial
  CRISPR gRNA sequence
ggaagtccaagaccaaagca

SEQ ID NO: 404061 - DNA, 20 bp, Artificial
  CRISPR gRNA sequence
actgtctagtgaggggttgc

SEQ ID NO: 404062 - DNA, 20 bp, Artificial
  CRISPR gRNA sequence
ctgtctagtgaggggttgct

SEQ ID NO: 404063 - DNA, 20 bp, Artificial
  CRISPR gRNA sequence
tctagtgaggggttgctctt

SEQ ID NO: 404064 - DNA, 20 bp, Artificial
  CRISPR gRNA sequence
gtgaggggttgctctttgct

SEQ ID NO: 404065 - DNA, 20 bp, Artificial
  CRISPR gRNA sequence
ctctttgcttccaagacggc

SEQ ID NO: 404066 - DNA, 20 bp, Artificial
  CRISPR gRNA sequence
tttgcttccaagacggcgcc

SEQ ID NO: 404067 - DNA, 20 bp, Artificial
  CRISPR gRNA sequence
tgcttccaagacggcgcctt

SEQ ID NO: 404068 - DNA, 20 bp, Artificial
  CRISPR gRNA sequence
gcttccaagacggcgccttc

SEQ ID NO: 404069 - DNA, 20 bp, Artificial
  CRISPR gRNA sequence
cttccaagacggcgccttct

SEQ ID NO: 404070 - DNA, 20 bp, Artificial
  CRISPR gRNA sequence
ccaagacggcgccttcttgc

SEQ ID NO: 404071 - DNA, 20 bp, Artificial
  CRISPR gRNA sequence
caagacggcgccttcttgct

SEQ ID NO: 404072 - DNA, 20 bp, Artificial
  CRISPR gRNA sequence
cttgctgcgtcctcatatgg

SEQ ID NO: 404073 - DNA, 20 bp, Artificial
  CRISPR gRNA sequence
ttgctgcgtcctcatatggt

SEQ ID NO: 404074 - DNA, 20 bp, Artificial
  CRISPR gRNA sequence
gctgcgtcctcatatggtgg

SEQ ID NO: 404075 - DNA, 20 bp, Artificial
  CRISPR gRNA sequence
ctgcgtcctcatatggtgga

SEQ ID NO: 404076 - DNA, 20 bp, Artificial
  CRISPR gRNA sequence
cgtcctcatatggtggaagg

SEQ ID NO: 404077 - DNA, 20 bp, Artificial
  CRISPR gRNA sequence
atatggtggaaggggcaaag

SEQ ID NO: 404078 - DNA, 20 bp, Artificial
  CRISPR gRNA sequence
ccttcaacatctttctgaag

SEQ ID NO: 404079 - DNA, 20 bp, Artificial
  CRISPR gRNA sequence
caacatctttctgaagggca

SEQ ID NO: 404080 - DNA, 20 bp, Artificial
  CRISPR gRNA sequence
aacatctttctgaagggcac

SEQ ID NO: 404081 - DNA, 20 bp, Artificial
  CRISPR gRNA sequence
tctgaagggcactaatcaca

SEQ ID NO: 404082 - DNA, 20 bp, Artificial
  CRISPR gRNA sequence
ctgaagggcactaatcacat

SEQ ID NO: 404083 - DNA, 20 bp, Artificial
  CRISPR gRNA sequence
tgaagggcactaatcacatt

SEQ ID NO: 404084 - DNA, 20 bp, Artificial
  CRISPR gRNA sequence
aagggcactaatcacattca

SEQ ID NO: 404085 - DNA, 20 bp, Artificial
  CRISPR gRNA sequence
atcacattcatgaaagcaga

SEQ ID NO: 404086 - DNA, 20 bp, Artificial
  CRISPR gRNA sequence
atgaaagcagaattctcaag

SEQ ID NO: 404087 - DNA, 20 bp, Artificial
  CRISPR gRNA sequence
tcaagacttaatgatgtccc

SEQ ID NO: 404088 - DNA, 20 bp, Artificial
  CRISPR gRNA sequence
aagacttaatgatgtcccca

SEQ ID NO: 404089 - DNA, 20 bp, Artificial
  CRISPR gRNA sequence
aatgatgtccccaaaagcac

SEQ ID NO: 404090 - DNA, 20 bp, Artificial
  CRISPR gRNA sequence
atgatgtccccaaaagcacc

SEQ ID NO: 404091 - DNA, 20 bp, Artificial
  CRISPR gRNA sequence
ttaataccaccacaatgggg

SEQ ID NO: 404092 - DNA, 20 bp, Artificial
  CRISPR gRNA sequence
aataccaccacaatggggat

SEQ ID NO: 404093 - DNA, 20 bp, Artificial
  CRISPR gRNA sequence
ataccaccacaatggggatt

SEQ ID NO: 404094 - DNA, 20 bp, Artificial
  CRISPR gRNA sequence
ggtttcaatatgaatttgag

SEQ ID NO: 404095 - DNA, 20 bp, Artificial
  CRISPR gRNA sequence
caatatgaatttgagaaaca

SEQ ID NO: 404096 - DNA, 20 bp, Artificial
  CRISPR gRNA sequence
aatatgaatttgagaaacat

SEQ ID NO: 404097 - DNA, 20 bp, Artificial
  CRISPR gRNA sequence
gagaaacattcagatcatag

SEQ ID NO: 404098 - DNA, 20 bp, Artificial
  CRISPR gRNA sequence
agaaacattcagatcatagc

SEQ ID NO: 404099 - DNA, 20 bp, Artificial
  CRISPR gRNA sequence
agatcatagcagtgagctta

SEQ ID NO: 404100 - DNA, 20 bp, Artificial
  CRISPR gRNA sequence
agttccaggattatttcaag

SEQ ID NO: 404101 - DNA, 20 bp, Artificial
  CRISPR gRNA sequence
gttccaggattatttcaagg

SEQ ID NO: 404102 - DNA, 20 bp, Artificial
  CRISPR gRNA sequence
caggattatttcaagggaaa

SEQ ID NO: 404103 - DNA, 20 bp, Artificial
  CRISPR gRNA sequence
tttcaagggaaatttcattg

SEQ ID NO: 404104 - DNA, 20 bp, Artificial
  CRISPR gRNA sequence
caagggaaatttcattgtta

SEQ ID NO: 404105 - DNA, 20 bp, Artificial
  CRISPR gRNA sequence
aagggaaatttcattgttaa

SEQ ID NO: 404106 - DNA, 20 bp, Artificial
  CRISPR gRNA sequence
cattgttaacaattctttat

SEQ ID NO: 404107 - DNA, 20 bp, Artificial
  CRISPR gRNA sequence
attgttaacaattctttatt

SEQ ID NO: 404108 - DNA, 20 bp, Artificial
  CRISPR gRNA sequence
ttaacaattctttatttaga

SEQ ID NO: 404109 - DNA, 20 bp, Artificial
  CRISPR gRNA sequence
acaattctttatttagagaa

SEQ ID NO: 404110 - DNA, 20 bp, Artificial
  CRISPR gRNA sequence
tttatttagagaaattcctg

SEQ ID NO: 404111 - DNA, 20 bp, Artificial
  CRISPR gRNA sequence
tatttagagaaattcctgct

SEQ ID NO: 404112 - DNA, 20 bp, Artificial
  CRISPR gRNA sequence
atttagagaaattcctgcta

SEQ ID NO: 404113 - DNA, 20 bp, Artificial
  CRISPR gRNA sequence
tttagagaaattcctgctat

SEQ ID NO: 404114 - DNA, 20 bp, Artificial
  CRISPR gRNA sequence
agagaaattcctgctatcta

SEQ ID NO: 404115 - DNA, 20 bp, Artificial
  CRISPR gRNA sequence
gagaaattcctgctatctat

SEQ ID NO: 404116 - DNA, 20 bp, Artificial
  CRISPR gRNA sequence
ctgctatctattgttttggt

SEQ ID NO: 404117 - DNA, 20 bp, Artificial
  CRISPR gRNA sequence
ctatctattgttttggttct

SEQ ID NO: 404118 - DNA, 20 bp, Artificial
  CRISPR gRNA sequence
tctattgttttggttcttgt

SEQ ID NO: 404119 - DNA, 20 bp, Artificial
  CRISPR gRNA sequence
ttgttttggttcttgtcttt

SEQ ID NO: 404120 - DNA, 20 bp, Artificial
  CRISPR gRNA sequence
ttttggttcttgtctttatt

SEQ ID NO: 404121 - DNA, 20 bp, Artificial
  CRISPR gRNA sequence
tggttcttgtctttattaca

SEQ ID NO: 404122 - DNA, 20 bp, Artificial
  CRISPR gRNA sequence
ggttcttgtctttattacac

SEQ ID NO: 404123 - DNA, 20 bp, Artificial
  CRISPR gRNA sequence
gttcttgtctttattacacg

SEQ ID NO: 404124 - DNA, 20 bp, Artificial
  CRISPR gRNA sequence
ttgtctttattacacgaaaa

SEQ ID NO: 404125 - DNA, 20 bp, Artificial
  CRISPR gRNA sequence
gtctttattacacgaaaaca

SEQ ID NO: 404126 - DNA, 20 bp, Artificial
  CRISPR gRNA sequence
tctttattacacgaaaacaa

SEQ ID NO: 404127 - DNA, 20 bp, Artificial
  CRISPR gRNA sequence
tattacacgaaaacaaaaaa

SEQ ID NO: 404128 - DNA, 20 bp, Artificial
  CRISPR gRNA sequence
attacacgaaaacaaaaaag

SEQ ID NO: 404129 - DNA, 20 bp, Artificial
  CRISPR gRNA sequence
ttacacgaaaacaaaaaagg

SEQ ID NO: 404130 - DNA, 20 bp, Artificial
  CRISPR gRNA sequence
cacgaaaacaaaaaaggatt

SEQ ID NO: 404131 - DNA, 20 bp, Artificial
  CRISPR gRNA sequence
gttgacacagagctttgagt

SEQ ID NO: 404132 - DNA, 20 bp, Artificial
  CRISPR gRNA sequence
ttgacacagagctttgagtt

SEQ ID NO: 404133 - DNA, 20 bp, Artificial
  CRISPR gRNA sequence
acacagagctttgagttctg

SEQ ID NO: 404134 - DNA, 20 bp, Artificial
  CRISPR gRNA sequence
tgagttctgtcctgctccta

SEQ ID NO: 404135 - DNA, 20 bp, Artificial
  CRISPR gRNA sequence
gagttctgtcctgctcctaa

SEQ ID NO: 404136 - DNA, 20 bp, Artificial
  CRISPR gRNA sequence
agttctgtcctgctcctaac

SEQ ID NO: 404137 - DNA, 20 bp, Artificial
  CRISPR gRNA sequence
tgtcctgctcctaactcatc

SEQ ID NO: 404138 - DNA, 20 bp, Artificial
  CRISPR gRNA sequence
tcctgctcctaactcatctg

SEQ ID NO: 404139 - DNA, 20 bp, Artificial
  CRISPR gRNA sequence
ctcctaactcatctggtgat

SEQ ID NO: 404140 - DNA, 20 bp, Artificial
  CRISPR gRNA sequence
ctaactcatctggtgatgtc

SEQ ID NO: 404141 - DNA, 20 bp, Artificial
  CRISPR gRNA sequence
actcatctggtgatgtctga

SEQ ID NO: 404142 - DNA, 20 bp, Artificial
  CRISPR gRNA sequence
atctggtgatgtctgaaaag

SEQ ID NO: 404143 - DNA, 20 bp, Artificial
  CRISPR gRNA sequence
gtgatgtctgaaaagtttct

SEQ ID NO: 404144 - DNA, 20 bp, Artificial
  CRISPR gRNA sequence
aaaagtttcttcatttttct

SEQ ID NO: 404145 - DNA, 20 bp, Artificial
  CRISPR gRNA sequence
cttcatttttctgagcttca

SEQ ID NO: 404146 - DNA, 20 bp, Artificial
  CRISPR gRNA sequence
ttcatttttctgagcttcag

SEQ ID NO: 404147 - DNA, 20 bp, Artificial
  CRISPR gRNA sequence
catttttctgagcttcagtt

SEQ ID NO: 404148 - DNA, 20 bp, Artificial
  CRISPR gRNA sequence
atttttctgagcttcagttt

SEQ ID NO: 404149 - DNA, 20 bp, Artificial
  CRISPR gRNA sequence
ttctgagcttcagtttactc

SEQ ID NO: 404150 - DNA, 20 bp, Artificial
  CRISPR gRNA sequence
tctgagcttcagtttactca

SEQ ID NO: 404151 - DNA, 20 bp, Artificial
  CRISPR gRNA sequence
ctgagcttcagtttactcat

SEQ ID NO: 404152 - DNA, 20 bp, Artificial
  CRISPR gRNA sequence
tgagcttcagtttactcatg

SEQ ID NO: 404153 - DNA, 20 bp, Artificial
  CRISPR gRNA sequence
agcttcagtttactcatgta

SEQ ID NO: 404154 - DNA, 20 bp, Artificial
  CRISPR gRNA sequence
cagtttactcatgtatagaa

SEQ ID NO: 404155 - DNA, 20 bp, Artificial
  CRISPR gRNA sequence
agtttactcatgtatagaaa

SEQ ID NO: 404156 - DNA, 20 bp, Artificial
  CRISPR gRNA sequence
actcatgtatagaaagtact

SEQ ID NO: 404157 - DNA, 20 bp, Artificial
  CRISPR gRNA sequence
ctcatgtatagaaagtactc

SEQ ID NO: 404158 - DNA, 20 bp, Artificial
  CRISPR gRNA sequence
atgtatagaaagtactcatg

SEQ ID NO: 404159 - DNA, 20 bp, Artificial
  CRISPR gRNA sequence
atgtataatatgtaccttag

SEQ ID NO: 404160 - DNA, 20 bp, Artificial
  CRISPR gRNA sequence
aggggaggcatgagaactaa

SEQ ID NO: 404161 - DNA, 20 bp, Artificial
  CRISPR gRNA sequence
ggggaggcatgagaactaat

SEQ ID NO: 404162 - DNA, 20 bp, Artificial
  CRISPR gRNA sequence
atgagataatatacaaagat

SEQ ID NO: 404163 - DNA, 20 bp, Artificial
  CRISPR gRNA sequence
tataatacttggcacatgga

SEQ ID NO: 404164 - DNA, 20 bp, Artificial
  CRISPR gRNA sequence
ggcacatggaagttgcccag

SEQ ID NO: 404165 - DNA, 20 bp, Artificial
  CRISPR gRNA sequence
gcacatggaagttgcccagc

SEQ ID NO: 404166 - DNA, 20 bp, Artificial
  CRISPR gRNA sequence
cccagcacatgatggttcca

SEQ ID NO: 404167 - DNA, 20 bp, Artificial
  CRISPR gRNA sequence
cattgaattccctttccatg

SEQ ID NO: 404168 - DNA, 20 bp, Artificial
  CRISPR gRNA sequence
aattccctttccatgttccc

SEQ ID NO: 404169 - DNA, 20 bp, Artificial
  CRISPR gRNA sequence
cctttccatgttccctgaag

SEQ ID NO: 404170 - DNA, 20 bp, Artificial
  CRISPR gRNA sequence
tccatgttccctgaagaatt

SEQ ID NO: 404171 - DNA, 20 bp, Artificial
  CRISPR gRNA sequence
ccatgttccctgaagaatta

SEQ ID NO: 404172 - DNA, 20 bp, Artificial
  CRISPR gRNA sequence
catgttccctgaagaattag

SEQ ID NO: 404173 - DNA, 20 bp, Artificial
  CRISPR gRNA sequence
cctgaagaattagatatctt

SEQ ID NO: 404174 - DNA, 20 bp, Artificial
  CRISPR gRNA sequence
aagaattagatatcttgttg

SEQ ID NO: 404175 - DNA, 20 bp, Artificial
  CRISPR gRNA sequence
gatatcttgttgagtctgaa

SEQ ID NO: 404176 - DNA, 20 bp, Artificial
  CRISPR gRNA sequence
gttgagtctgaaacttcaac

SEQ ID NO: 404177 - DNA, 20 bp, Artificial
  CRISPR gRNA sequence
ttgagtctgaaacttcaact

SEQ ID NO: 404178 - DNA, 20 bp, Artificial
  CRISPR gRNA sequence
agtctgaaacttcaactcat

SEQ ID NO: 404179 - DNA, 20 bp, Artificial
  CRISPR gRNA sequence
aaacttcaactcatttcaac

SEQ ID NO: 404180 - DNA, 20 bp, Artificial
  CRISPR gRNA sequence
caactcatttcaactaacac

SEQ ID NO: 404181 - DNA, 20 bp, Artificial
  CRISPR gRNA sequence
aactcatttcaactaacaca

SEQ ID NO: 404182 - DNA, 20 bp, Artificial
  CRISPR gRNA sequence
atttcaactaacacatattt

SEQ ID NO: 404183 - DNA, 20 bp, Artificial
  CRISPR gRNA sequence
caactaacacatatttagct

SEQ ID NO: 404184 - DNA, 20 bp, Artificial
  CRISPR gRNA sequence
aactaacacatatttagctg

SEQ ID NO: 404185 - DNA, 20 bp, Artificial
  CRISPR gRNA sequence
acacatatttagctgttacc

SEQ ID NO: 404186 - DNA, 20 bp, Artificial
  CRISPR gRNA sequence
agctgttaccacttgccagg

SEQ ID NO: 404187 - DNA, 20 bp, Artificial
  CRISPR gRNA sequence
gctgttaccacttgccaggc

SEQ ID NO: 404188 - DNA, 20 bp, Artificial
  CRISPR gRNA sequence
ttaccacttgccaggcattc

SEQ ID NO: 404189 - DNA, 20 bp, Artificial
  CRISPR gRNA sequence
ccacttgccaggcattccat

SEQ ID NO: 404190 - DNA, 20 bp, Artificial
  CRISPR gRNA sequence
gccaggcattccatcaggaa

SEQ ID NO: 404191 - DNA, 20 bp, Artificial
  CRISPR gRNA sequence
ccaggcattccatcaggaac

SEQ ID NO: 404192 - DNA, 20 bp, Artificial
  CRISPR gRNA sequence
catcaggaactggaaatatt

SEQ ID NO: 404193 - DNA, 20 bp, Artificial
  CRISPR gRNA sequence
gaaatattaggatgaatgag

SEQ ID NO: 404194 - DNA, 20 bp, Artificial
  CRISPR gRNA sequence
ggatgaatgagatattatag

SEQ ID NO: 404195 - DNA, 20 bp, Artificial
  CRISPR gRNA sequence
tagctcctgccctcctccct

SEQ ID NO: 404196 - DNA, 20 bp, Artificial
  CRISPR gRNA sequence
ctgccctcctccctatcata

SEQ ID NO: 404197 - DNA, 20 bp, Artificial
  CRISPR gRNA sequence
ccctcctccctatcatatgt

SEQ ID NO: 404198 - DNA, 20 bp, Artificial
  CRISPR gRNA sequence
ctccctatcatatgtaagta

SEQ ID NO: 404199 - DNA, 20 bp, Artificial
  CRISPR gRNA sequence
cctatcatatgtaagtagac

SEQ ID NO: 404200 - DNA, 20 bp, Artificial
  CRISPR gRNA sequence
tcatatgtaagtagacatta

SEQ ID NO: 404201 - DNA, 20 bp, Artificial
  CRISPR gRNA sequence
catgatggtatgaaataacg

SEQ ID NO: 404202 - DNA, 20 bp, Artificial
  CRISPR gRNA sequence
tcatggggataatgccataa

SEQ ID NO: 404203 - DNA, 20 bp, Artificial
  CRISPR gRNA sequence
atggggataatgccataaag

SEQ ID NO: 404204 - DNA, 20 bp, Artificial
  CRISPR gRNA sequence
tcagagtccttaagatgact

SEQ ID NO: 404205 - DNA, 20 bp, Artificial
  CRISPR gRNA sequence
agagtccttaagatgactgt

SEQ ID NO: 404206 - DNA, 20 bp, Artificial
  CRISPR gRNA sequence
aagatgactgttgtcattcc

SEQ ID NO: 404207 - DNA, 20 bp, Artificial
  CRISPR gRNA sequence
agatgactgttgtcattcct

SEQ ID NO: 404208 - DNA, 20 bp, Artificial
  CRISPR gRNA sequence
ttgtcattcctcattgttca

SEQ ID NO: 404209 - DNA, 20 bp, Artificial
  CRISPR gRNA sequence
tcattcctcattgttcaagt

SEQ ID NO: 404210 - DNA, 20 bp, Artificial
  CRISPR gRNA sequence
ctcattgttcaagttggatg

SEQ ID NO: 404211 - DNA, 20 bp, Artificial
  CRISPR gRNA sequence
attgttcaagttggatggaa

SEQ ID NO: 404212 - DNA, 20 bp, Artificial
  CRISPR gRNA sequence
ttcaagttggatggaaaaca

SEQ ID NO: 404213 - DNA, 20 bp, Artificial
  CRISPR gRNA sequence
aagttggatggaaaacacat

SEQ ID NO: 404214 - DNA, 20 bp, Artificial
  CRISPR gRNA sequence
gatggaaaacacatctgaca

SEQ ID NO: 404215 - DNA, 20 bp, Artificial
  CRISPR gRNA sequence
acaactaaagaagtaggagt

SEQ ID NO: 404216 - DNA, 20 bp, Artificial
  CRISPR gRNA sequence
aagaagtaggagttagccaa

SEQ ID NO: 404217 - DNA, 20 bp, Artificial
  CRISPR gRNA sequence
gccaaagaaagggcagggtg

SEQ ID NO: 404218 - DNA, 20 bp, Artificial
  CRISPR gRNA sequence
gcagtaggaatagcaagtgc

SEQ ID NO: 404219 - DNA, 20 bp, Artificial
  CRISPR gRNA sequence
cagtaggaatagcaagtgca

SEQ ID NO: 404220 - DNA, 20 bp, Artificial
  CRISPR gRNA sequence
aaacataatgtatgaggtgg

SEQ ID NO: 404221 - DNA, 20 bp, Artificial
  CRISPR gRNA sequence
atgctgagtggttctttgtt

SEQ ID NO: 404222 - DNA, 20 bp, Artificial
  CRISPR gRNA sequence
agtggttctttgttgttatt

SEQ ID NO: 404223 - DNA, 20 bp, Artificial
  CRISPR gRNA sequence
tttgttgttattgttgtttt

SEQ ID NO: 404224 - DNA, 20 bp, Artificial
  CRISPR gRNA sequence
tgttgttattgttgttttga

SEQ ID NO: 404225 - DNA, 20 bp, Artificial
  CRISPR gRNA sequence
gttgttattgttgttttgag

SEQ ID NO: 404226 - DNA, 20 bp, Artificial
  CRISPR gRNA sequence
ttgttattgttgttttgaga

SEQ ID NO: 404227 - DNA, 20 bp, Artificial
  CRISPR gRNA sequence
ttattgttgttttgagatgg

SEQ ID NO: 404228 - DNA, 20 bp, Artificial
  CRISPR gRNA sequence
ttgttgttttgagatggagt

SEQ ID NO: 404229 - DNA, 20 bp, Artificial
  CRISPR gRNA sequence
ttgttttgagatggagtctc

SEQ ID NO: 404230 - DNA, 20 bp, Artificial
  CRISPR gRNA sequence
ttttgagatggagtctcact

SEQ ID NO: 404231 - DNA, 20 bp, Artificial
  CRISPR gRNA sequence
tgagatggagtctcactctg

SEQ ID NO: 404232 - DNA, 20 bp, Artificial
  CRISPR gRNA sequence
gagatggagtctcactctgt

SEQ ID NO: 404233 - DNA, 20 bp, Artificial
  CRISPR gRNA sequence
agatggagtctcactctgtc

SEQ ID NO: 404234 - DNA, 20 bp, Artificial
  CRISPR gRNA sequence
actctgtcgcccagtctgga

SEQ ID NO: 404235 - DNA, 20 bp, Artificial
  CRISPR gRNA sequence
tgtcgcccagtctggagtgc

SEQ ID NO: 404236 - DNA, 20 bp, Artificial
  CRISPR gRNA sequence
tcgcccagtctggagtgcag

SEQ ID NO: 404237 - DNA, 20 bp, Artificial
  CRISPR gRNA sequence
gagtgcagtggcgcaatctt

SEQ ID NO: 404238 - DNA, 20 bp, Artificial
  CRISPR gRNA sequence
ggcacactgcgacctccaca

SEQ ID NO: 404239 - DNA, 20 bp, Artificial
  CRISPR gRNA sequence
gcacactgcgacctccacat

SEQ ID NO: 404240 - DNA, 20 bp, Artificial
  CRISPR gRNA sequence
cgacctccacatcctgggtt

SEQ ID NO: 404241 - DNA, 20 bp, Artificial
  CRISPR gRNA sequence
cacatcctgggttccagtga

SEQ ID NO: 404242 - DNA, 20 bp, Artificial
  CRISPR gRNA sequence
ggttccagtgattctccttc

SEQ ID NO: 404243 - DNA, 20 bp, Artificial
  CRISPR gRNA sequence
cagtgattctccttcctcag

SEQ ID NO: 404244 - DNA, 20 bp, Artificial
  CRISPR gRNA sequence
tccttcctcagcctcccgag

SEQ ID NO: 404245 - DNA, 20 bp, Artificial
  CRISPR gRNA sequence
cttcctcagcctcccgagta

SEQ ID NO: 404246 - DNA, 20 bp, Artificial
  CRISPR gRNA sequence
cctcagcctcccgagtagct

SEQ ID NO: 404247 - DNA, 20 bp, Artificial
  CRISPR gRNA sequence
ctcagcctcccgagtagctt

SEQ ID NO: 404248 - DNA, 20 bp, Artificial
  CRISPR gRNA sequence
agcctcccgagtagcttgga

SEQ ID NO: 404249 - DNA, 20 bp, Artificial
  CRISPR gRNA sequence
ccgagtagcttggattgcag

SEQ ID NO: 404250 - DNA, 20 bp, Artificial
  CRISPR gRNA sequence
ggattgcagttgtgcgccct

SEQ ID NO: 404251 - DNA, 20 bp, Artificial
  CRISPR gRNA sequence
gattgcagttgtgcgccctc

SEQ ID NO: 404252 - DNA, 20 bp, Artificial
  CRISPR gRNA sequence
cagttgtgcgccctcacacc

SEQ ID NO: 404253 - DNA, 20 bp, Artificial
  CRISPR gRNA sequence
tgcgccctcacacctgacta

SEQ ID NO: 404254 - DNA, 20 bp, Artificial
  CRISPR gRNA sequence
acacctgactactttttgta

SEQ ID NO: 404255 - DNA, 20 bp, Artificial
  CRISPR gRNA sequence
actactttttgtatatttgg

SEQ ID NO: 404256 - DNA, 20 bp, Artificial
  CRISPR gRNA sequence
ctttttgtatatttggtaga

SEQ ID NO: 404257 - DNA, 20 bp, Artificial
  CRISPR gRNA sequence
tttgtatatttggtagagat

SEQ ID NO: 404258 - DNA, 20 bp, Artificial
  CRISPR gRNA sequence
ttgtatatttggtagagatg

SEQ ID NO: 404259 - DNA, 20 bp, Artificial
  CRISPR gRNA sequence
tgtatatttggtagagatgg

SEQ ID NO: 404260 - DNA, 20 bp, Artificial
  CRISPR gRNA sequence
gtatatttggtagagatggg

SEQ ID NO: 404261 - DNA, 20 bp, Artificial
  CRISPR gRNA sequence
tatatttggtagagatgggg

SEQ ID NO: 404262 - DNA, 20 bp, Artificial
  CRISPR gRNA sequence
ggtagagatggggtatcacc

SEQ ID NO: 404263 - DNA, 20 bp, Artificial
  CRISPR gRNA sequence
gtagagatggggtatcacca

SEQ ID NO: 404264 - DNA, 20 bp, Artificial
  CRISPR gRNA sequence
gccaggctggtctcgaactc

SEQ ID NO: 404265 - DNA, 20 bp, Artificial
  CRISPR gRNA sequence
gtctcgaactcctggcctca

SEQ ID NO: 404266 - DNA, 20 bp, Artificial
  CRISPR gRNA sequence
gaactcctggcctcaggtgg

SEQ ID NO: 404267 - DNA, 20 bp, Artificial
  CRISPR gRNA sequence
ctggcctcaggtggtctgcc

SEQ ID NO: 404268 - DNA, 20 bp, Artificial
  CRISPR gRNA sequence
gcctcaggtggtctgcccgc

SEQ ID NO: 404269 - DNA, 20 bp, Artificial
  CRISPR gRNA sequence
aggtggtctgcccgcctcgg

SEQ ID NO: 404270 - DNA, 20 bp, Artificial
  CRISPR gRNA sequence
cccgcctcggcctcccaaag

SEQ ID NO: 404271 - DNA, 20 bp, Artificial
  CRISPR gRNA sequence
ggcctcccaaagtgctggga

SEQ ID NO: 404272 - DNA, 20 bp, Artificial
  CRISPR gRNA sequence
ccaaagtgctgggattacag

SEQ ID NO: 404273 - DNA, 20 bp, Artificial
  CRISPR gRNA sequence
ggattacaggcaggatccac

SEQ ID NO: 404274 - DNA, 20 bp, Artificial
  CRISPR gRNA sequence
caggcaggatccactgtttc

SEQ ID NO: 404275 - DNA, 20 bp, Artificial
  CRISPR gRNA sequence
tttccagcctgctaagtgat

SEQ ID NO: 404276 - DNA, 20 bp, Artificial
  CRISPR gRNA sequence
ccagcctgctaagtgattct

SEQ ID NO: 404277 - DNA, 20 bp, Artificial
  CRISPR gRNA sequence
cagcctgctaagtgattcta

SEQ ID NO: 404278 - DNA, 20 bp, Artificial
  CRISPR gRNA sequence
ctaagtgattctatgtgctg

SEQ ID NO: 404279 - DNA, 20 bp, Artificial
  CRISPR gRNA sequence
agtgattctatgtgctgtgg

SEQ ID NO: 404280 - DNA, 20 bp, Artificial
  CRISPR gRNA sequence
tatgtgctgtggtgagaagt

SEQ ID NO: 404281 - DNA, 20 bp, Artificial
  CRISPR gRNA sequence
tgtgctgtggtgagaagtgc

SEQ ID NO: 404282 - DNA, 20 bp, Artificial
  CRISPR gRNA sequence
tggtgagaagtgcatactca

SEQ ID NO: 404283 - DNA, 20 bp, Artificial
  CRISPR gRNA sequence
accataaggggactgagagt

SEQ ID NO: 404284 - DNA, 20 bp, Artificial
  CRISPR gRNA sequence
agagtttattgaagggtttt

SEQ ID NO: 404285 - DNA, 20 bp, Artificial
  CRISPR gRNA sequence
attgaagggttttaatgtct

SEQ ID NO: 404286 - DNA, 20 bp, Artificial
  CRISPR gRNA sequence
ttgaagggttttaatgtctt

SEQ ID NO: 404287 - DNA, 20 bp, Artificial
  CRISPR gRNA sequence
aagggttttaatgtcttgag

SEQ ID NO: 404288 - DNA, 20 bp, Artificial
  CRISPR gRNA sequence
taatgtcttgagagagagat

SEQ ID NO: 404289 - DNA, 20 bp, Artificial
  CRISPR gRNA sequence
aatgtcttgagagagagatc

SEQ ID NO: 404290 - DNA, 20 bp, Artificial
  CRISPR gRNA sequence
atgtcttgagagagagatca

SEQ ID NO: 404291 - DNA, 20 bp, Artificial
  CRISPR gRNA sequence
gagagagagatcagattgat

SEQ ID NO: 404292 - DNA, 20 bp, Artificial
  CRISPR gRNA sequence
agagagagatcagattgatg

SEQ ID NO: 404293 - DNA, 20 bp, Artificial
  CRISPR gRNA sequence
atggtatcgtggactgtcgt

SEQ ID NO: 404294 - DNA, 20 bp, Artificial
  CRISPR gRNA sequence
tcgttcatatgggagcgaga

SEQ ID NO: 404295 - DNA, 20 bp, Artificial
  CRISPR gRNA sequence
atatgggagcgagactggag

SEQ ID NO: 404296 - DNA, 20 bp, Artificial
  CRISPR gRNA sequence
gagtgaaggaggctgggcag

SEQ ID NO: 404297 - DNA, 20 bp, Artificial
  CRISPR gRNA sequence
ggcagaagtctattttagta

SEQ ID NO: 404298 - DNA, 20 bp, Artificial
  CRISPR gRNA sequence
ttttagtaatatagtaggga

SEQ ID NO: 404299 - DNA, 20 bp, Artificial
  CRISPR gRNA sequence
tagtaatatagtagggatgg

SEQ ID NO: 404300 - DNA, 20 bp, Artificial
  CRISPR gRNA sequence
agtaatatagtagggatgga

SEQ ID NO: 404301 - DNA, 20 bp, Artificial
  CRISPR gRNA sequence
gtaatatagtagggatggag

SEQ ID NO: 404302 - DNA, 20 bp, Artificial
  CRISPR gRNA sequence
gtatagagagtgtagggtcc

SEQ ID NO: 404303 - DNA, 20 bp, Artificial
  CRISPR gRNA sequence
tatagagagtgtagggtcca

SEQ ID NO: 404304 - DNA, 20 bp, Artificial
  CRISPR gRNA sequence
gagagatgtttaaaaggtag

SEQ ID NO: 404305 - DNA, 20 bp, Artificial
  CRISPR gRNA sequence
agagatgtttaaaaggtaga

SEQ ID NO: 404306 - DNA, 20 bp, Artificial
  CRISPR gRNA sequence
aaaaggtagagttgacggga

SEQ ID NO: 404307 - DNA, 20 bp, Artificial
  CRISPR gRNA sequence
aaaggtagagttgacgggat

SEQ ID NO: 404308 - DNA, 20 bp, Artificial
  CRISPR gRNA sequence
acgggatccagcaactgatt

SEQ ID NO: 404309 - DNA, 20 bp, Artificial
  CRISPR gRNA sequence
attggatgagtgagaaaggg

SEQ ID NO: 404310 - DNA, 20 bp, Artificial
  CRISPR gRNA sequence
gatgagtgagaaagggaaga

SEQ ID NO: 404311 - DNA, 20 bp, Artificial
  CRISPR gRNA sequence
agaaggatacccagtttctg

SEQ ID NO: 404312 - DNA, 20 bp, Artificial
  CRISPR gRNA sequence
ctgaacagtggggagagtaa

SEQ ID NO: 404313 - DNA, 20 bp, Artificial
  CRISPR gRNA sequence
tgaacagtggggagagtaaa

SEQ ID NO: 404314 - DNA, 20 bp, Artificial
  CRISPR gRNA sequence
aacagtggggagagtaaaaa

SEQ ID NO: 404315 - DNA, 20 bp, Artificial
  CRISPR gRNA sequence
ggagaggggaatatggtttt

SEQ ID NO: 404316 - DNA, 20 bp, Artificial
  CRISPR gRNA sequence
gagaggggaatatggttttg

SEQ ID NO: 404317 - DNA, 20 bp, Artificial
  CRISPR gRNA sequence
tggaatatctgtgaatagaa

SEQ ID NO: 404318 - DNA, 20 bp, Artificial
  CRISPR gRNA sequence
ggaatatctgtgaatagaaa

SEQ ID NO: 404319 - DNA, 20 bp, Artificial
  CRISPR gRNA sequence
gaatatctgtgaatagaaag

SEQ ID NO: 404320 - DNA, 20 bp, Artificial
  CRISPR gRNA sequence
tgaatagaaagtggaaaaaa

SEQ ID NO: 404321 - DNA, 20 bp, Artificial
  CRISPR gRNA sequence
gaaaatctaaacgagttttt

SEQ ID NO: 404322 - DNA, 20 bp, Artificial
  CRISPR gRNA sequence
aaaatctaaacgagtttttt

SEQ ID NO: 404323 - DNA, 20 bp, Artificial
  CRISPR gRNA sequence
aacgagttttttcttttgtt

SEQ ID NO: 404324 - DNA, 20 bp, Artificial
  CRISPR gRNA sequence
tttcttttgtttctcctttg

SEQ ID NO: 404325 - DNA, 20 bp, Artificial
  CRISPR gRNA sequence
ttcttttgtttctcctttga

SEQ ID NO: 404326 - DNA, 20 bp, Artificial
  CRISPR gRNA sequence
tcttttgtttctcctttgac

SEQ ID NO: 404327 - DNA, 20 bp, Artificial
  CRISPR gRNA sequence
cttttgtttctcctttgaca

SEQ ID NO: 404328 - DNA, 20 bp, Artificial
  CRISPR gRNA sequence
ttttgtttctcctttgacat

SEQ ID NO: 404329 - DNA, 20 bp, Artificial
  CRISPR gRNA sequence
ttgtttctcctttgacatgt

SEQ ID NO: 404330 - DNA, 20 bp, Artificial
  CRISPR gRNA sequence
tgtttctcctttgacatgtg

SEQ ID NO: 404331 - DNA, 20 bp, Artificial
  CRISPR gRNA sequence
gtttctcctttgacatgtga

SEQ ID NO: 404332 - DNA, 20 bp, Artificial
  CRISPR gRNA sequence
tttctcctttgacatgtgat

SEQ ID NO: 404333 - DNA, 20 bp, Artificial
  CRISPR gRNA sequence
ctcctttgacatgtgattta

SEQ ID NO: 404334 - DNA, 20 bp, Artificial
  CRISPR gRNA sequence
tcctttgacatgtgatttat

SEQ ID NO: 404335 - DNA, 20 bp, Artificial
  CRISPR gRNA sequence
ctttgacatgtgatttatct

SEQ ID NO: 404336 - DNA, 20 bp, Artificial
  CRISPR gRNA sequence
tgacatgtgatttatctacc

SEQ ID NO: 404337 - DNA, 20 bp, Artificial
  CRISPR gRNA sequence
gacatgtgatttatctaccc

SEQ ID NO: 404338 - DNA, 20 bp, Artificial
  CRISPR gRNA sequence
acatgtgatttatctaccca

SEQ ID NO: 404339 - DNA, 20 bp, Artificial
  CRISPR gRNA sequence
atctacccaggaaattctag

SEQ ID NO: 404340 - DNA, 20 bp, Artificial
  CRISPR gRNA sequence
tctacccaggaaattctagc

SEQ ID NO: 404341 - DNA, 20 bp, Artificial
  CRISPR gRNA sequence
cccaggaaattctagcaggt

SEQ ID NO: 404342 - DNA, 20 bp, Artificial
  CRISPR gRNA sequence
tagcaggtgaatttgcattc

SEQ ID NO: 404343 - DNA, 20 bp, Artificial
  CRISPR gRNA sequence
gcaggtgaatttgcattctt

SEQ ID NO: 404344 - DNA, 20 bp, Artificial
  CRISPR gRNA sequence
gcattctttttctttgcaga

SEQ ID NO: 404345 - DNA, 20 bp, Artificial
  CRISPR gRNA sequence
cattctttttctttgcagag

SEQ ID NO: 404346 - DNA, 20 bp, Artificial
  CRISPR gRNA sequence
tttttctttgcagagatcat

SEQ ID NO: 404347 - DNA, 20 bp, Artificial
  CRISPR gRNA sequence
tttctttgcagagatcattc

SEQ ID NO: 404348 - DNA, 20 bp, Artificial
  CRISPR gRNA sequence
ttctttgcagagatcattct

SEQ ID NO: 404349 - DNA, 20 bp, Artificial
  CRISPR gRNA sequence
tctttgcagagatcattctg

SEQ ID NO: 404350 - DNA, 20 bp, Artificial
  CRISPR gRNA sequence
ctttgcagagatcattctgc

SEQ ID NO: 404351 - DNA, 20 bp, Artificial
  CRISPR gRNA sequence
tttgcagagatcattctgca

SEQ ID NO: 404352 - DNA, 20 bp, Artificial
  CRISPR gRNA sequence
tgcagagatcattctgcatt

SEQ ID NO: 404353 - DNA, 20 bp, Artificial
  CRISPR gRNA sequence
gcagagatcattctgcattt

SEQ ID NO: 404354 - DNA, 20 bp, Artificial
  CRISPR gRNA sequence
cagagatcattctgcatttc

SEQ ID NO: 404355 - DNA, 20 bp, Artificial
  CRISPR gRNA sequence
tgcatttctgatcctagttt

SEQ ID NO: 404356 - DNA, 20 bp, Artificial
  CRISPR gRNA sequence
catttctgatcctagtttgt

SEQ ID NO: 404357 - DNA, 20 bp, Artificial
  CRISPR gRNA sequence
ctgatcctagtttgtatttg

SEQ ID NO: 404358 - DNA, 20 bp, Artificial
  CRISPR gRNA sequence
tgatcctagtttgtatttgg

SEQ ID NO: 404359 - DNA, 20 bp, Artificial
  CRISPR gRNA sequence
atcctagtttgtatttggtt

SEQ ID NO: 404360 - DNA, 20 bp, Artificial
  CRISPR gRNA sequence
gtttgtatttggttatgcac

SEQ ID NO: 404361 - DNA, 20 bp, Artificial
  CRISPR gRNA sequence
gtatttggttatgcacgaag

SEQ ID NO: 404362 - DNA, 20 bp, Artificial
  CRISPR gRNA sequence
tatttggttatgcacgaagt

SEQ ID NO: 404363 - DNA, 20 bp, Artificial
  CRISPR gRNA sequence
ggttatgcacgaagtacttg

SEQ ID NO: 404364 - DNA, 20 bp, Artificial
  CRISPR gRNA sequence
gttatgcacgaagtacttgt

SEQ ID NO: 404365 - DNA, 20 bp, Artificial
  CRISPR gRNA sequence
tgcacgaagtacttgtccca

SEQ ID NO: 404366 - DNA, 20 bp, Artificial
  CRISPR gRNA sequence
gtcccagcacattctctcag

SEQ ID NO: 404367 - DNA, 20 bp, Artificial
  CRISPR gRNA sequence
tcccagcacattctctcagt

SEQ ID NO: 404368 - DNA, 20 bp, Artificial
  CRISPR gRNA sequence
tctcagttttttagacatag

SEQ ID NO: 404369 - DNA, 20 bp, Artificial
  CRISPR gRNA sequence
tcagttttttagacatagca

SEQ ID NO: 404370 - DNA, 20 bp, Artificial
  CRISPR gRNA sequence
agttttttagacatagcagt

SEQ ID NO: 404371 - DNA, 20 bp, Artificial
  CRISPR gRNA sequence
tttagacatagcagtgagac

SEQ ID NO: 404372 - DNA, 20 bp, Artificial
  CRISPR gRNA sequence
ttagacatagcagtgagact

SEQ ID NO: 404373 - DNA, 20 bp, Artificial
  CRISPR gRNA sequence
tagacatagcagtgagactc

SEQ ID NO: 404374 - DNA, 20 bp, Artificial
  CRISPR gRNA sequence
agacatagcagtgagactct

SEQ ID NO: 404375 - DNA, 20 bp, Artificial
  CRISPR gRNA sequence
gacatagcagtgagactctc

SEQ ID NO: 404376 - DNA, 20 bp, Artificial
  CRISPR gRNA sequence
tctggctttaatttcatgac

SEQ ID NO: 404377 - DNA, 20 bp, Artificial
  CRISPR gRNA sequence
tggctttaatttcatgacct

SEQ ID NO: 404378 - DNA, 20 bp, Artificial
  CRISPR gRNA sequence
gctttaatttcatgacctac

SEQ ID NO: 404379 - DNA, 20 bp, Artificial
  CRISPR gRNA sequence
taatttcatgacctacctag

SEQ ID NO: 404380 - DNA, 20 bp, Artificial
  CRISPR gRNA sequence
aatttcatgacctacctaga

SEQ ID NO: 404381 - DNA, 20 bp, Artificial
  CRISPR gRNA sequence
atttcatgacctacctagag

SEQ ID NO: 404382 - DNA, 20 bp, Artificial
  CRISPR gRNA sequence
catgacctacctagagttcc

SEQ ID NO: 404383 - DNA, 20 bp, Artificial
  CRISPR gRNA sequence
atgacctacctagagttccc

SEQ ID NO: 404384 - DNA, 20 bp, Artificial
  CRISPR gRNA sequence
cctagagttccccttttgga

SEQ ID NO: 404385 - DNA, 20 bp, Artificial
  CRISPR gRNA sequence
gagttccccttttggatggc

SEQ ID NO: 404386 - DNA, 20 bp, Artificial
  CRISPR gRNA sequence
cccttttggatggcacccat

SEQ ID NO: 404387 - DNA, 20 bp, Artificial
  CRISPR gRNA sequence
ttggatggcacccattgaaa

SEQ ID NO: 404388 - DNA, 20 bp, Artificial
  CRISPR gRNA sequence
tggatggcacccattgaaaa

SEQ ID NO: 404389 - DNA, 20 bp, Artificial
  CRISPR gRNA sequence
ggatggcacccattgaaaac

SEQ ID NO: 404390 - DNA, 20 bp, Artificial
  CRISPR gRNA sequence
gatggcacccattgaaaaca

SEQ ID NO: 404391 - DNA, 20 bp, Artificial
  CRISPR gRNA sequence
aaaacacactcattctgaag

SEQ ID NO: 404392 - DNA, 20 bp, Artificial
  CRISPR gRNA sequence
attctgaagcatggtggcca

SEQ ID NO: 404393 - DNA, 20 bp, Artificial
  CRISPR gRNA sequence
tgaagcatggtggccatttg

SEQ ID NO: 404394 - DNA, 20 bp, Artificial
  CRISPR gRNA sequence
aagcatggtggccatttgca

SEQ ID NO: 404395 - DNA, 20 bp, Artificial
  CRISPR gRNA sequence
gcaaatatcggaagtgcatt

SEQ ID NO: 404396 - DNA, 20 bp, Artificial
  CRISPR gRNA sequence
caaatatcggaagtgcattt

SEQ ID NO: 404397 - DNA, 20 bp, Artificial
  CRISPR gRNA sequence
tgtccaacaggttgtcttgt

SEQ ID NO: 404398 - DNA, 20 bp, Artificial
  CRISPR gRNA sequence
gtccaacaggttgtcttgta

SEQ ID NO: 404399 - DNA, 20 bp, Artificial
  CRISPR gRNA sequence
tccaacaggttgtcttgtag

SEQ ID NO: 404400 - DNA, 20 bp, Artificial
  CRISPR gRNA sequence
tcttgtagcacctgcaaagc

SEQ ID NO: 404401 - DNA, 20 bp, Artificial
  CRISPR gRNA sequence
gtagcacctgcaaagcaagc

SEQ ID NO: 404402 - DNA, 20 bp, Artificial
  CRISPR gRNA sequence
tagcacctgcaaagcaagct

SEQ ID NO: 404403 - DNA, 20 bp, Artificial
  CRISPR gRNA sequence
caaagcaagctgagtggagg

SEQ ID NO: 404404 - DNA, 20 bp, Artificial
  CRISPR gRNA sequence
agtggaggatttttgttccc

SEQ ID NO: 404405 - DNA, 20 bp, Artificial
  CRISPR gRNA sequence
ttgttcccggtgagaacgtt

SEQ ID NO: 404406 - DNA, 20 bp, Artificial
  CRISPR gRNA sequence
tgttcccggtgagaacgttt

SEQ ID NO: 404407 - DNA, 20 bp, Artificial
  CRISPR gRNA sequence
gttcccggtgagaacgtttt

SEQ ID NO: 404408 - DNA, 20 bp, Artificial
  CRISPR gRNA sequence
ttcccggtgagaacgttttg

SEQ ID NO: 404409 - DNA, 20 bp, Artificial
  CRISPR gRNA sequence
ccggtgagaacgttttgttc

SEQ ID NO: 404410 - DNA, 20 bp, Artificial
  CRISPR gRNA sequence
tgttcagttcatgagttagg

SEQ ID NO: 404411 - DNA, 20 bp, Artificial
  CRISPR gRNA sequence
gttcagttcatgagttaggt

SEQ ID NO: 404412 - DNA, 20 bp, Artificial
  CRISPR gRNA sequence
ttcagttcatgagttaggtc

SEQ ID NO: 404413 - DNA, 20 bp, Artificial
  CRISPR gRNA sequence
agttcatgagttaggtcaaa

SEQ ID NO: 404414 - DNA, 20 bp, Artificial
  CRISPR gRNA sequence
atgagttaggtcaaaggctt

SEQ ID NO: 404415 - DNA, 20 bp, Artificial
  CRISPR gRNA sequence
ggtcaaaggcttatttattt

SEQ ID NO: 404416 - DNA, 20 bp, Artificial
  CRISPR gRNA sequence
atttatttaaagtaatatat

SEQ ID NO: 404417 - DNA, 20 bp, Artificial
  CRISPR gRNA sequence
tttatttaaagtaatatatg

SEQ ID NO: 404418 - DNA, 20 bp, Artificial
  CRISPR gRNA sequence
atttaaagtaatatatgttg

SEQ ID NO: 404419 - DNA, 20 bp, Artificial
  CRISPR gRNA sequence
tttaaagtaatatatgttgc

SEQ ID NO: 404420 - DNA, 20 bp, Artificial
  CRISPR gRNA sequence
aaagtaatatatgttgctta

SEQ ID NO: 404421 - DNA, 20 bp, Artificial
  CRISPR gRNA sequence
aagtaatatatgttgcttat

SEQ ID NO: 404422 - DNA, 20 bp, Artificial
  CRISPR gRNA sequence
cttatctgttctaatggaaa

SEQ ID NO: 404423 - DNA, 20 bp, Artificial
  CRISPR gRNA sequence
atctgttctaatggaaaatt

SEQ ID NO: 404424 - DNA, 20 bp, Artificial
  CRISPR gRNA sequence
tctgttctaatggaaaattc

SEQ ID NO: 404425 - DNA, 20 bp, Artificial
  CRISPR gRNA sequence
ttctaatggaaaattcagga

SEQ ID NO: 404426 - DNA, 20 bp, Artificial
  CRISPR gRNA sequence
taatggaaaattcaggaatt

SEQ ID NO: 404427 - DNA, 20 bp, Artificial
  CRISPR gRNA sequence
atggaaaattcaggaattct

SEQ ID NO: 404428 - DNA, 20 bp, Artificial
  CRISPR gRNA sequence
aggaattctctaatcacttt

SEQ ID NO: 404429 - DNA, 20 bp, Artificial
  CRISPR gRNA sequence
tctaatcactttttccaaaa

SEQ ID NO: 404430 - DNA, 20 bp, Artificial
  CRISPR gRNA sequence
taatcactttttccaaaaag

SEQ ID NO: 404431 - DNA, 20 bp, Artificial
  CRISPR gRNA sequence
atcactttttccaaaaagat

SEQ ID NO: 404432 - DNA, 20 bp, Artificial
  CRISPR gRNA sequence
tttccaaaaagatgaaacga

SEQ ID NO: 404433 - DNA, 20 bp, Artificial
  CRISPR gRNA sequence
ttccaaaaagatgaaacgaa

SEQ ID NO: 404434 - DNA, 20 bp, Artificial
  CRISPR gRNA sequence
tccaaaaagatgaaacgaat

SEQ ID NO: 404435 - DNA, 20 bp, Artificial
  CRISPR gRNA sequence
ccaaaaagatgaaacgaatc

SEQ ID NO: 404436 - DNA, 20 bp, Artificial
  CRISPR gRNA sequence
caaaaagatgaaacgaatcc

SEQ ID NO: 404437 - DNA, 20 bp, Artificial
  CRISPR gRNA sequence
tagtgtccttgttactctgt

SEQ ID NO: 404438 - DNA, 20 bp, Artificial
  CRISPR gRNA sequence
agtgtccttgttactctgtt

SEQ ID NO: 404439 - DNA, 20 bp, Artificial
  CRISPR gRNA sequence
gtgtccttgttactctgttt

SEQ ID NO: 404440 - DNA, 20 bp, Artificial
  CRISPR gRNA sequence
gttactctgtttttattcac

SEQ ID NO: 404441 - DNA, 20 bp, Artificial
  CRISPR gRNA sequence
ttactctgtttttattcact

SEQ ID NO: 404442 - DNA, 20 bp, Artificial
  CRISPR gRNA sequence
ctctgtttttattcactgaa

SEQ ID NO: 404443 - DNA, 20 bp, Artificial
  CRISPR gRNA sequence
tgtttttattcactgaaaaa

SEQ ID NO: 404444 - DNA, 20 bp, Artificial
  CRISPR gRNA sequence
tttttattcactgaaaaact

SEQ ID NO: 404445 - DNA, 20 bp, Artificial
  CRISPR gRNA sequence
ttattcactgaaaaactttt

SEQ ID NO: 404446 - DNA, 20 bp, Artificial
  CRISPR gRNA sequence
tattcactgaaaaacttttg

SEQ ID NO: 404447 - DNA, 20 bp, Artificial
  CRISPR gRNA sequence
attcactgaaaaacttttgt

SEQ ID NO: 404448 - DNA, 20 bp, Artificial
  CRISPR gRNA sequence
ttcactgaaaaacttttgtt

SEQ ID NO: 404449 - DNA, 20 bp, Artificial
  CRISPR gRNA sequence
actgaaaaacttttgttgtg

SEQ ID NO: 404450 - DNA, 20 bp, Artificial
  CRISPR gRNA sequence
aaaaacttttgttgtgtatg

SEQ ID NO: 404451 - DNA, 20 bp, Artificial
  CRISPR gRNA sequence
ttgttgtgtatgttgttttc

SEQ ID NO: 404452 - DNA, 20 bp, Artificial
  CRISPR gRNA sequence
tgttgtgtatgttgttttca

SEQ ID NO: 404453 - DNA, 20 bp, Artificial
  CRISPR gRNA sequence
gttgtgtatgttgttttcaa

SEQ ID NO: 404454 - DNA, 20 bp, Artificial
  CRISPR gRNA sequence
ttgtgtatgttgttttcaaa

SEQ ID NO: 404455 - DNA, 20 bp, Artificial
  CRISPR gRNA sequence
tgtatgttgttttcaaatgc

SEQ ID NO: 404456 - DNA, 20 bp, Artificial
  CRISPR gRNA sequence
ttttcaaatgccatgcagtt

SEQ ID NO: 404457 - DNA, 20 bp, Artificial
  CRISPR gRNA sequence
tcaaatgccatgcagtttct

SEQ ID NO: 404458 - DNA, 20 bp, Artificial
  CRISPR gRNA sequence
caaatgccatgcagtttctc

SEQ ID NO: 404459 - DNA, 20 bp, Artificial
  CRISPR gRNA sequence
aaatgccatgcagtttctct

SEQ ID NO: 404460 - DNA, 20 bp, Artificial
  CRISPR gRNA sequence
ctctccctctctttctcttt

SEQ ID NO: 404461 - DNA, 20 bp, Artificial
  CRISPR gRNA sequence
tctccctctctttctctttt

SEQ ID NO: 404462 - DNA, 20 bp, Artificial
  CRISPR gRNA sequence
tccctctctttctctttttg

SEQ ID NO: 404463 - DNA, 20 bp, Artificial
  CRISPR gRNA sequence
cctctctttctctttttgat

SEQ ID NO: 404464 - DNA, 20 bp, Artificial
  CRISPR gRNA sequence
tctttctctttttgatgtgc

SEQ ID NO: 404465 - DNA, 20 bp, Artificial
  CRISPR gRNA sequence
tttctctttttgatgtgctg

SEQ ID NO: 404466 - DNA, 20 bp, Artificial
  CRISPR gRNA sequence
tctctttttgatgtgctgaa

SEQ ID NO: 404467 - DNA, 20 bp, Artificial
  CRISPR gRNA sequence
ctctttttgatgtgctgaaa

SEQ ID NO: 404468 - DNA, 20 bp, Artificial
  CRISPR gRNA sequence
tctttttgatgtgctgaaaa

SEQ ID NO: 404469 - DNA, 20 bp, Artificial
  CRISPR gRNA sequence
tttttgatgtgctgaaaaac

SEQ ID NO: 404470 - DNA, 20 bp, Artificial
  CRISPR gRNA sequence
tttgatgtgctgaaaaactt

SEQ ID NO: 404471 - DNA, 20 bp, Artificial
  CRISPR gRNA sequence
ttgatgtgctgaaaaacttc

SEQ ID NO: 404472 - DNA, 20 bp, Artificial
  CRISPR gRNA sequence
tgatgtgctgaaaaacttct

SEQ ID NO: 404473 - DNA, 20 bp, Artificial
  CRISPR gRNA sequence
gatgtgctgaaaaacttctc

SEQ ID NO: 404474 - DNA, 20 bp, Artificial
  CRISPR gRNA sequence
atgtgctgaaaaacttctca

SEQ ID NO: 404475 - DNA, 20 bp, Artificial
  CRISPR gRNA sequence
aaaaacttctcagcatttac

SEQ ID NO: 404476 - DNA, 20 bp, Artificial
  CRISPR gRNA sequence
ctcagcatttactttggagt

SEQ ID NO: 404477 - DNA, 20 bp, Artificial
  CRISPR gRNA sequence
tcagcatttactttggagtg

SEQ ID NO: 404478 - DNA, 20 bp, Artificial
  CRISPR gRNA sequence
agcatttactttggagtgct

SEQ ID NO: 404479 - DNA, 20 bp, Artificial
  CRISPR gRNA sequence
actttggagtgctatgtgag

SEQ ID NO: 404480 - DNA, 20 bp, Artificial
  CRISPR gRNA sequence
ctttggagtgctatgtgaga

SEQ ID NO: 404481 - DNA, 20 bp, Artificial
  CRISPR gRNA sequence
tggagtgctatgtgagatag

SEQ ID NO: 404482 - DNA, 20 bp, Artificial
  CRISPR gRNA sequence
ggagtgctatgtgagatagt

SEQ ID NO: 404483 - DNA, 20 bp, Artificial
  CRISPR gRNA sequence
gagtgctatgtgagatagtt

SEQ ID NO: 404484 - DNA, 20 bp, Artificial
  CRISPR gRNA sequence
tgtgagatagttttcaaaca

SEQ ID NO: 404485 - DNA, 20 bp, Artificial
  CRISPR gRNA sequence
tcaaacactctttgggcctc

SEQ ID NO: 404486 - DNA, 20 bp, Artificial
  CRISPR gRNA sequence
caaacactctttgggcctca

SEQ ID NO: 404487 - DNA, 20 bp, Artificial
  CRISPR gRNA sequence
aaacactctttgggcctcac

SEQ ID NO: 404488 - DNA, 20 bp, Artificial
  CRISPR gRNA sequence
tttgggcctcactgcttatt

SEQ ID NO: 404489 - DNA, 20 bp, Artificial
  CRISPR gRNA sequence
tgggcctcactgcttatttg

SEQ ID NO: 404490 - DNA, 20 bp, Artificial
  CRISPR gRNA sequence
gggcctcactgcttatttgt

SEQ ID NO: 404491 - DNA, 20 bp, Artificial
  CRISPR gRNA sequence
ggcctcactgcttatttgta

SEQ ID NO: 404492 - DNA, 20 bp, Artificial
  CRISPR gRNA sequence
actgcttatttgtacctctg

SEQ ID NO: 404493 - DNA, 20 bp, Artificial
  CRISPR gRNA sequence
cttatttgtacctctgggct

SEQ ID NO: 404494 - DNA, 20 bp, Artificial
  CRISPR gRNA sequence
atttgtacctctgggctttg

SEQ ID NO: 404495 - DNA, 20 bp, Artificial
  CRISPR gRNA sequence
tttgtacctctgggctttgc

SEQ ID NO: 404496 - DNA, 20 bp, Artificial
  CRISPR gRNA sequence
gtacctctgggctttgcagt

SEQ ID NO: 404497 - DNA, 20 bp, Artificial
  CRISPR gRNA sequence
tacctctgggctttgcagtt

SEQ ID NO: 404498 - DNA, 20 bp, Artificial
  CRISPR gRNA sequence
tgggctttgcagttctcccc

SEQ ID NO: 404499 - DNA, 20 bp, Artificial
  CRISPR gRNA sequence
ggctttgcagttctccccag

SEQ ID NO: 404500 - DNA, 20 bp, Artificial
  CRISPR gRNA sequence
tgcagttctccccagtttga

SEQ ID NO: 404501 - DNA, 20 bp, Artificial
  CRISPR gRNA sequence
gcagttctccccagtttgaa

SEQ ID NO: 404502 - DNA, 20 bp, Artificial
  CRISPR gRNA sequence
cagttctccccagtttgaat

SEQ ID NO: 404503 - DNA, 20 bp, Artificial
  CRISPR gRNA sequence
tccccagtttgaatgattct

SEQ ID NO: 404504 - DNA, 20 bp, Artificial
  CRISPR gRNA sequence
cccagtttgaatgattcttt

SEQ ID NO: 404505 - DNA, 20 bp, Artificial
  CRISPR gRNA sequence
gaatgattcttttttttttt

SEQ ID NO: 404506 - DNA, 20 bp, Artificial
  CRISPR gRNA sequence
aatgattctttttttttttt

SEQ ID NO: 404507 - DNA, 20 bp, Artificial
  CRISPR gRNA sequence
tttttttttttttttttttt

SEQ ID NO: 404508 - DNA, 20 bp, Artificial
  CRISPR gRNA sequence
ttttttttttttttttttgg

SEQ ID NO: 404509 - DNA, 20 bp, Artificial
  CRISPR gRNA sequence
tttttttttttttttttggc

SEQ ID NO: 404510 - DNA, 20 bp, Artificial
  CRISPR gRNA sequence
ttttttttttttttttggca

SEQ ID NO: 404511 - DNA, 20 bp, Artificial
  CRISPR gRNA sequence
tttttttttttttttggcaa

SEQ ID NO: 404512 - DNA, 20 bp, Artificial
  CRISPR gRNA sequence
ttttttttttttttggcaat

SEQ ID NO: 404513 - DNA, 20 bp, Artificial
  CRISPR gRNA sequence
tttttttttttttggcaata

SEQ ID NO: 404514 - DNA, 20 bp, Artificial
  CRISPR gRNA sequence
ttttttttttttggcaatac

SEQ ID NO: 404515 - DNA, 20 bp, Artificial
  CRISPR gRNA sequence
tttttttttttggcaatacc

SEQ ID NO: 404516 - DNA, 20 bp, Artificial
  CRISPR gRNA sequence
ttttttttttggcaatacct

SEQ ID NO: 404517 - DNA, 20 bp, Artificial
  CRISPR gRNA sequence
tttttttttggcaatacctt

SEQ ID NO: 404518 - DNA, 20 bp, Artificial
  CRISPR gRNA sequence
ttttttttggcaataccttc

SEQ ID NO: 404519 - DNA, 20 bp, Artificial
  CRISPR gRNA sequence
tttttttggcaataccttca

SEQ ID NO: 404520 - DNA, 20 bp, Artificial
  CRISPR gRNA sequence
ttttttggcaataccttcat

SEQ ID NO: 404521 - DNA, 20 bp, Artificial
  CRISPR gRNA sequence
tttttggcaataccttcatc

SEQ ID NO: 404522 - DNA, 20 bp, Artificial
  CRISPR gRNA sequence
ttttggcaataccttcatcc

SEQ ID NO: 404523 - DNA, 20 bp, Artificial
  CRISPR gRNA sequence
tttggcaataccttcatcct

SEQ ID NO: 404524 - DNA, 20 bp, Artificial
  CRISPR gRNA sequence
ttggcaataccttcatccta

SEQ ID NO: 404525 - DNA, 20 bp, Artificial
  CRISPR gRNA sequence
tggcaataccttcatcctac

SEQ ID NO: 404526 - DNA, 20 bp, Artificial
  CRISPR gRNA sequence
ggcaataccttcatcctact

SEQ ID NO: 404527 - DNA, 20 bp, Artificial
  CRISPR gRNA sequence
gcaataccttcatcctactg

SEQ ID NO: 404528 - DNA, 20 bp, Artificial
  CRISPR gRNA sequence
catcctactgttgccctttg

SEQ ID NO: 404529 - DNA, 20 bp, Artificial
  CRISPR gRNA sequence
atcctactgttgccctttga

SEQ ID NO: 404530 - DNA, 20 bp, Artificial
  CRISPR gRNA sequence
ctgttgccctttgactttgt

SEQ ID NO: 404531 - DNA, 20 bp, Artificial
  CRISPR gRNA sequence
ttgccctttgactttgtcag

SEQ ID NO: 404532 - DNA, 20 bp, Artificial
  CRISPR gRNA sequence
ccctttgactttgtcagttc

SEQ ID NO: 404533 - DNA, 20 bp, Artificial
  CRISPR gRNA sequence
tgactttgtcagttcagcca

SEQ ID NO: 404534 - DNA, 20 bp, Artificial
  CRISPR gRNA sequence
gactttgtcagttcagccat

SEQ ID NO: 404535 - DNA, 20 bp, Artificial
  CRISPR gRNA sequence
actttgtcagttcagccata

SEQ ID NO: 404536 - DNA, 20 bp, Artificial
  CRISPR gRNA sequence
tgtcagttcagccataaggg

SEQ ID NO: 404537 - DNA, 20 bp, Artificial
  CRISPR gRNA sequence
gtcagttcagccataagggg

SEQ ID NO: 404538 - DNA, 20 bp, Artificial
  CRISPR gRNA sequence
tcagttcagccataaggggt

SEQ ID NO: 404539 - DNA, 20 bp, Artificial
  CRISPR gRNA sequence
agccataaggggttttattt

SEQ ID NO: 404540 - DNA, 20 bp, Artificial
  CRISPR gRNA sequence
tatttgaagcacttggccct

SEQ ID NO: 404541 - DNA, 20 bp, Artificial
  CRISPR gRNA sequence
atttgaagcacttggccctt

SEQ ID NO: 404542 - DNA, 20 bp, Artificial
  CRISPR gRNA sequence
tttgaagcacttggcccttt

SEQ ID NO: 404543 - DNA, 20 bp, Artificial
  CRISPR gRNA sequence
gaagcacttggccctttaga

SEQ ID NO: 404544 - DNA, 20 bp, Artificial
  CRISPR gRNA sequence
aagcacttggccctttagat

SEQ ID NO: 404545 - DNA, 20 bp, Artificial
  CRISPR gRNA sequence
ggccctttagatctgttggc

SEQ ID NO: 404546 - DNA, 20 bp, Artificial
  CRISPR gRNA sequence
gccctttagatctgttggca

SEQ ID NO: 404547 - DNA, 20 bp, Artificial
  CRISPR gRNA sequence
tagatctgttggcatatatt

SEQ ID NO: 404548 - DNA, 20 bp, Artificial
  CRISPR gRNA sequence
agatctgttggcatatattt

SEQ ID NO: 404549 - DNA, 20 bp, Artificial
  CRISPR gRNA sequence
gatctgttggcatatatttt

SEQ ID NO: 404550 - DNA, 20 bp, Artificial
  CRISPR gRNA sequence
ttggcatatattttccctgg

SEQ ID NO: 404551 - DNA, 20 bp, Artificial
  CRISPR gRNA sequence
gcatatattttccctggact

SEQ ID NO: 404552 - DNA, 20 bp, Artificial
  CRISPR gRNA sequence
tccctggactttcaaaaaca

SEQ ID NO: 404553 - DNA, 20 bp, Artificial
  CRISPR gRNA sequence
ccctggactttcaaaaacat

SEQ ID NO: 404554 - DNA, 20 bp, Artificial
  CRISPR gRNA sequence
cctggactttcaaaaacatg

SEQ ID NO: 404555 - DNA, 20 bp, Artificial
  CRISPR gRNA sequence
gactttcaaaaacatgtttt

SEQ ID NO: 404556 - DNA, 20 bp, Artificial
  CRISPR gRNA sequence
tcaaaaacatgttttggttt

SEQ ID NO: 404557 - DNA, 20 bp, Artificial
  CRISPR gRNA sequence
caaaaacatgttttggtttt

SEQ ID NO: 404558 - DNA, 20 bp, Artificial
  CRISPR gRNA sequence
aaaaacatgttttggttttt

SEQ ID NO: 404559 - DNA, 20 bp, Artificial
  CRISPR gRNA sequence
tggtttttttttttttgtaa

SEQ ID NO: 404560 - DNA, 20 bp, Artificial
  CRISPR gRNA sequence
ggtttttttttttttgtaag

SEQ ID NO: 404561 - DNA, 20 bp, Artificial
  CRISPR gRNA sequence
gtttttttttttttgtaagt

SEQ ID NO: 404562 - DNA, 20 bp, Artificial
  CRISPR gRNA sequence
ttttttttttgtaagtctag

SEQ ID NO: 404563 - DNA, 20 bp, Artificial
  CRISPR gRNA sequence
tttttttttgtaagtctagg

SEQ ID NO: 404564 - DNA, 20 bp, Artificial
  CRISPR gRNA sequence
ttttttttgtaagtctaggg

SEQ ID NO: 404565 - DNA, 20 bp, Artificial
  CRISPR gRNA sequence
tttttttgtaagtctagggg

SEQ ID NO: 404566 - DNA, 20 bp, Artificial
  CRISPR gRNA sequence
ttttttgtaagtctaggggt

SEQ ID NO: 404567 - DNA, 20 bp, Artificial
  CRISPR gRNA sequence
tttttgtaagtctaggggtt

SEQ ID NO: 404568 - DNA, 20 bp, Artificial
  CRISPR gRNA sequence
ttttgtaagtctaggggttt

SEQ ID NO: 404569 - DNA, 20 bp, Artificial
  CRISPR gRNA sequence
tttgtaagtctaggggtttc

SEQ ID NO: 404570 - DNA, 20 bp, Artificial
  CRISPR gRNA sequence
ttgtaagtctaggggtttct

SEQ ID NO: 404571 - DNA, 20 bp, Artificial
  CRISPR gRNA sequence
tgtaagtctaggggtttctt

SEQ ID NO: 404572 - DNA, 20 bp, Artificial
  CRISPR gRNA sequence
gtaagtctaggggtttcttt

SEQ ID NO: 404573 - DNA, 20 bp, Artificial
  CRISPR gRNA sequence
taagtctaggggtttctttg

SEQ ID NO: 404574 - DNA, 20 bp, Artificial
  CRISPR gRNA sequence
ggggtttctttgggattttt

SEQ ID NO: 404575 - DNA, 20 bp, Artificial
  CRISPR gRNA sequence
ctttgggatttttacctttt

SEQ ID NO: 404576 - DNA, 20 bp, Artificial
  CRISPR gRNA sequence
tttgggatttttaccttttc

SEQ ID NO: 404577 - DNA, 20 bp, Artificial
  CRISPR gRNA sequence
tgggatttttaccttttcaa

SEQ ID NO: 404578 - DNA, 20 bp, Artificial
  CRISPR gRNA sequence
gggatttttaccttttcaac

SEQ ID NO: 404579 - DNA, 20 bp, Artificial
  CRISPR gRNA sequence
ggatttttaccttttcaact

SEQ ID NO: 404580 - DNA, 20 bp, Artificial
  CRISPR gRNA sequence
ttaccttttcaactatactt

SEQ ID NO: 404581 - DNA, 20 bp, Artificial
  CRISPR gRNA sequence
taccttttcaactatacttt

SEQ ID NO: 404582 - DNA, 20 bp, Artificial
  CRISPR gRNA sequence
accttttcaactatactttt

SEQ ID NO: 404583 - DNA, 20 bp, Artificial
  CRISPR gRNA sequence
ccttttcaactatactttta

SEQ ID NO: 404584 - DNA, 20 bp, Artificial
  CRISPR gRNA sequence
ttcaactatacttttacttt

SEQ ID NO: 404585 - DNA, 20 bp, Artificial
  CRISPR gRNA sequence
tcaactatacttttactttt

SEQ ID NO: 404586 - DNA, 20 bp, Artificial
  CRISPR gRNA sequence
caactatacttttacttttt

SEQ ID NO: 404587 - DNA, 20 bp, Artificial
  CRISPR gRNA sequence
aactatacttttactttttt

SEQ ID NO: 404588 - DNA, 20 bp, Artificial
  CRISPR gRNA sequence
tacttttacttttttaacca

SEQ ID NO: 404589 - DNA, 20 bp, Artificial
  CRISPR gRNA sequence
ttacttttttaaccagaata

SEQ ID NO: 404590 - DNA, 20 bp, Artificial
  CRISPR gRNA sequence
tacttttttaaccagaatat

SEQ ID NO: 404591 - DNA, 20 bp, Artificial
  CRISPR gRNA sequence
acttttttaaccagaatatt

SEQ ID NO: 404592 - DNA, 20 bp, Artificial
  CRISPR gRNA sequence
cttttttaaccagaatattt

SEQ ID NO: 404593 - DNA, 20 bp, Artificial
  CRISPR gRNA sequence
ttttaaccagaatatttgca

SEQ ID NO: 404594 - DNA, 20 bp, Artificial
  CRISPR gRNA sequence
tttaaccagaatatttgcat

SEQ ID NO: 404595 - DNA, 20 bp, Artificial
  CRISPR gRNA sequence
ttaaccagaatatttgcatt

SEQ ID NO: 404596 - DNA, 20 bp, Artificial
  CRISPR gRNA sequence
taaccagaatatttgcattt

SEQ ID NO: 404597 - DNA, 20 bp, Artificial
  CRISPR gRNA sequence
aaccagaatatttgcatttt

SEQ ID NO: 404598 - DNA, 20 bp, Artificial
  CRISPR gRNA sequence
accagaatatttgcatttta

SEQ ID NO: 404599 - DNA, 20 bp, Artificial
  CRISPR gRNA sequence
gcattttattgtagttttca

SEQ ID NO: 404600 - DNA, 20 bp, Artificial
  CRISPR gRNA sequence
cattttattgtagttttcat

SEQ ID NO: 404601 - DNA, 20 bp, Artificial
  CRISPR gRNA sequence
tattgtagttttcatttgta

SEQ ID NO: 404602 - DNA, 20 bp, Artificial
  CRISPR gRNA sequence
attgtagttttcatttgtaa

SEQ ID NO: 404603 - DNA, 20 bp, Artificial
  CRISPR gRNA sequence
ttgtagttttcatttgtaat

SEQ ID NO: 404604 - DNA, 20 bp, Artificial
  CRISPR gRNA sequence
tagttttcatttgtaattat

SEQ ID NO: 404605 - DNA, 20 bp, Artificial
  CRISPR gRNA sequence
tcatttgtaattatgcaaaa

SEQ ID NO: 404606 - DNA, 20 bp, Artificial
  CRISPR gRNA sequence
catttgtaattatgcaaaaa

SEQ ID NO: 404607 - DNA, 20 bp, Artificial
  CRISPR gRNA sequence
atttgtaattatgcaaaaat

SEQ ID NO: 404608 - DNA, 20 bp, Artificial
  CRISPR gRNA sequence
gtaattatgcaaaaatttcc

SEQ ID NO: 404609 - DNA, 20 bp, Artificial
  CRISPR gRNA sequence
taattatgcaaaaatttcca

SEQ ID NO: 404610 - DNA, 20 bp, Artificial
  CRISPR gRNA sequence
tgcaaaaatttccaatgaac

SEQ ID NO: 404611 - DNA, 20 bp, Artificial
  CRISPR gRNA sequence
ccaatgaacttttgactttg

SEQ ID NO: 404612 - DNA, 20 bp, Artificial
  CRISPR gRNA sequence
caatgaacttttgactttgc

SEQ ID NO: 404613 - DNA, 20 bp, Artificial
  CRISPR gRNA sequence
ttgactttgcctttctagtc

SEQ ID NO: 404614 - DNA, 20 bp, Artificial
  CRISPR gRNA sequence
tgactttgcctttctagtca

SEQ ID NO: 404615 - DNA, 20 bp, Artificial
  CRISPR gRNA sequence
gactttgcctttctagtcag

SEQ ID NO: 404616 - DNA, 20 bp, Artificial
  CRISPR gRNA sequence
actttgcctttctagtcaga

SEQ ID NO: 404617 - DNA, 20 bp, Artificial
  CRISPR gRNA sequence
tgcctttctagtcagaatca

SEQ ID NO: 404618 - DNA, 20 bp, Artificial
  CRISPR gRNA sequence
gcctttctagtcagaatcac

SEQ ID NO: 404619 - DNA, 20 bp, Artificial
  CRISPR gRNA sequence
cctttctagtcagaatcacc

SEQ ID NO: 404620 - DNA, 20 bp, Artificial
  CRISPR gRNA sequence
tctagtcagaatcacctttt

SEQ ID NO: 404621 - DNA, 20 bp, Artificial
  CRISPR gRNA sequence
ctagtcagaatcaccttttg

SEQ ID NO: 404622 - DNA, 20 bp, Artificial
  CRISPR gRNA sequence
tagtcagaatcaccttttgt

SEQ ID NO: 404623 - DNA, 20 bp, Artificial
  CRISPR gRNA sequence
gtcagaatcaccttttgtca

SEQ ID NO: 404624 - DNA, 20 bp, Artificial
  CRISPR gRNA sequence
ttgtcatttgatcatgacag

SEQ ID NO: 404625 - DNA, 20 bp, Artificial
  CRISPR gRNA sequence
tgtcatttgatcatgacaga

SEQ ID NO: 404626 - DNA, 20 bp, Artificial
  CRISPR gRNA sequence
gtcatttgatcatgacagat

SEQ ID NO: 404627 - DNA, 20 bp, Artificial
  CRISPR gRNA sequence
tcatttgatcatgacagatg

SEQ ID NO: 404628 - DNA, 20 bp, Artificial
  CRISPR gRNA sequence
gatcatgacagatgattcaa

SEQ ID NO: 404629 - DNA, 20 bp, Artificial
  CRISPR gRNA sequence
atcatgacagatgattcaaa

SEQ ID NO: 404630 - DNA, 20 bp, Artificial
  CRISPR gRNA sequence
aaagtgcatattgtatatat

SEQ ID NO: 404631 - DNA, 20 bp, Artificial
  CRISPR gRNA sequence
tatatatctatttcattccg

SEQ ID NO: 404632 - DNA, 20 bp, Artificial
  CRISPR gRNA sequence
tttcattccgcaatgcaata

SEQ ID NO: 404633 - DNA, 20 bp, Artificial
  CRISPR gRNA sequence
cattccgcaatgcaatataa

SEQ ID NO: 404634 - DNA, 20 bp, Artificial
  CRISPR gRNA sequence
attccgcaatgcaatataaa

SEQ ID NO: 404635 - DNA, 20 bp, Artificial
  CRISPR gRNA sequence
cgcaatgcaatataaatttc

SEQ ID NO: 404636 - DNA, 20 bp, Artificial
  CRISPR gRNA sequence
ccatatatttttattcctat

SEQ ID NO: 404637 - DNA, 20 bp, Artificial
  CRISPR gRNA sequence
catatatttttattcctata

SEQ ID NO: 404638 - DNA, 20 bp, Artificial
  CRISPR gRNA sequence
ttattcctataaattcagga

SEQ ID NO: 404639 - DNA, 20 bp, Artificial
  CRISPR gRNA sequence
tattcctataaattcaggag

SEQ ID NO: 404640 - DNA, 20 bp, Artificial
  CRISPR gRNA sequence
attcctataaattcaggagc

SEQ ID NO: 404641 - DNA, 20 bp, Artificial
  CRISPR gRNA sequence
ttcctataaattcaggagcc

SEQ ID NO: 404642 - DNA, 20 bp, Artificial
  CRISPR gRNA sequence
ctataaattcaggagccagt

SEQ ID NO: 404643 - DNA, 20 bp, Artificial
  CRISPR gRNA sequence
taaattcaggagccagttat

SEQ ID NO: 404644 - DNA, 20 bp, Artificial
  CRISPR gRNA sequence
aggagccagttatgtgtagt

SEQ ID NO: 404645 - DNA, 20 bp, Artificial
  CRISPR gRNA sequence
tgtgtagtacaaatgtagtg

SEQ ID NO: 404646 - DNA, 20 bp, Artificial
  CRISPR gRNA sequence
tagctttttcagaggtagaa

SEQ ID NO: 404647 - DNA, 20 bp, Artificial
  CRISPR gRNA sequence
tttcagaggtagaattcaag

SEQ ID NO: 404648 - DNA, 20 bp, Artificial
  CRISPR gRNA sequence
ttcagaggtagaattcaaga

SEQ ID NO: 404649 - DNA, 20 bp, Artificial
  CRISPR gRNA sequence
tcagaggtagaattcaagat

SEQ ID NO: 404650 - DNA, 20 bp, Artificial
  CRISPR gRNA sequence
cagaggtagaattcaagata

SEQ ID NO: 404651 - DNA, 20 bp, Artificial
  CRISPR gRNA sequence
agaggtagaattcaagatac

SEQ ID NO: 404652 - DNA, 20 bp, Artificial
  CRISPR gRNA sequence
aagatacgatgcagataatg

SEQ ID NO: 404653 - DNA, 20 bp, Artificial
  CRISPR gRNA sequence
gtccttcctaatttaatttt

SEQ ID NO: 404654 - DNA, 20 bp, Artificial
  CRISPR gRNA sequence
cctaatttaatttttccatc

SEQ ID NO: 404655 - DNA, 20 bp, Artificial
  CRISPR gRNA sequence
ctaatttaatttttccatct

SEQ ID NO: 404656 - DNA, 20 bp, Artificial
  CRISPR gRNA sequence
atttaatttttccatctgtc

SEQ ID NO: 404657 - DNA, 20 bp, Artificial
  CRISPR gRNA sequence
aatttttccatctgtctcat

SEQ ID NO: 404658 - DNA, 20 bp, Artificial
  CRISPR gRNA sequence
atttttccatctgtctcatt

SEQ ID NO: 404659 - DNA, 20 bp, Artificial
  CRISPR gRNA sequence
ttccatctgtctcattttgc

SEQ ID NO: 404660 - DNA, 20 bp, Artificial
  CRISPR gRNA sequence
tccatctgtctcattttgca

SEQ ID NO: 404661 - DNA, 20 bp, Artificial
  CRISPR gRNA sequence
ccatctgtctcattttgcat

SEQ ID NO: 404662 - DNA, 20 bp, Artificial
  CRISPR gRNA sequence
catctgtctcattttgcata

SEQ ID NO: 404663 - DNA, 20 bp, Artificial
  CRISPR gRNA sequence
tctcattttgcataatattt

SEQ ID NO: 404664 - DNA, 20 bp, Artificial
  CRISPR gRNA sequence
attttgcataatattttctt

SEQ ID NO: 404665 - DNA, 20 bp, Artificial
  CRISPR gRNA sequence
tgcataatattttcttctat

SEQ ID NO: 404666 - DNA, 20 bp, Artificial
  CRISPR gRNA sequence
gcataatattttcttctatg

SEQ ID NO: 404667 - DNA, 20 bp, Artificial
  CRISPR gRNA sequence
cataatattttcttctatga

SEQ ID NO: 404668 - DNA, 20 bp, Artificial
  CRISPR gRNA sequence
tcttctatgacgttggctcg

SEQ ID NO: 404669 - DNA, 20 bp, Artificial
  CRISPR gRNA sequence
cttctatgacgttggctcgg

SEQ ID NO: 404670 - DNA, 20 bp, Artificial
  CRISPR gRNA sequence
ttctatgacgttggctcggt

SEQ ID NO: 404671 - DNA, 20 bp, Artificial
  CRISPR gRNA sequence
ctatgacgttggctcggtgg

SEQ ID NO: 404672 - DNA, 20 bp, Artificial
  CRISPR gRNA sequence
tatgacgttggctcggtggt

SEQ ID NO: 404673 - DNA, 20 bp, Artificial
  CRISPR gRNA sequence
tgacgttggctcggtggtct

SEQ ID NO: 404674 - DNA, 20 bp, Artificial
  CRISPR gRNA sequence
gctcggtggtctatggtata

SEQ ID NO: 404675 - DNA, 20 bp, Artificial
  CRISPR gRNA sequence
ggtggtctatggtataattc

SEQ ID NO: 404676 - DNA, 20 bp, Artificial
  CRISPR gRNA sequence
tggtataattcaagaagctc

SEQ ID NO: 404677 - DNA, 20 bp, Artificial
  CRISPR gRNA sequence
aagaagctcgtttctccctt

SEQ ID NO: 404678 - DNA, 20 bp, Artificial
  CRISPR gRNA sequence
gtttctcccttgtaaagtgt

SEQ ID NO: 404679 - DNA, 20 bp, Artificial
  CRISPR gRNA sequence
ctcccttgtaaagtgttgag

SEQ ID NO: 404680 - DNA, 20 bp, Artificial
  CRISPR gRNA sequence
tcccttgtaaagtgttgagg

SEQ ID NO: 404681 - DNA, 20 bp, Artificial
  CRISPR gRNA sequence
ccttgtaaagtgttgaggtt

SEQ ID NO: 404682 - DNA, 20 bp, Artificial
  CRISPR gRNA sequence
gtaaagtgttgaggtttctg

SEQ ID NO: 404683 - DNA, 20 bp, Artificial
  CRISPR gRNA sequence
taaagtgttgaggtttctgt

SEQ ID NO: 404684 - DNA, 20 bp, Artificial
  CRISPR gRNA sequence
aggtttctgttggcagttgc

SEQ ID NO: 404685 - DNA, 20 bp, Artificial
  CRISPR gRNA sequence
ctgttggcagttgctattta

SEQ ID NO: 404686 - DNA, 20 bp, Artificial
  CRISPR gRNA sequence
tgttggcagttgctatttag

SEQ ID NO: 404687 - DNA, 20 bp, Artificial
  CRISPR gRNA sequence
ttggcagttgctatttagat

SEQ ID NO: 404688 - DNA, 20 bp, Artificial
  CRISPR gRNA sequence
gcagttgctatttagatatg

SEQ ID NO: 404689 - DNA, 20 bp, Artificial
  CRISPR gRNA sequence
ctatttagatatgagttttg

SEQ ID NO: 404690 - DNA, 20 bp, Artificial
  CRISPR gRNA sequence
tttagatatgagttttgtgg

SEQ ID NO: 404691 - DNA, 20 bp, Artificial
  CRISPR gRNA sequence
agatatgagttttgtggaag

SEQ ID NO: 404692 - DNA, 20 bp, Artificial
  CRISPR gRNA sequence
gatatgagttttgtggaagc

SEQ ID NO: 404693 - DNA, 20 bp, Artificial
  CRISPR gRNA sequence
tgtggaagccatcctcgata

SEQ ID NO: 404694 - DNA, 20 bp, Artificial
  CRISPR gRNA sequence
gtggaagccatcctcgataa

SEQ ID NO: 404695 - DNA, 20 bp, Artificial
  CRISPR gRNA sequence
tggaagccatcctcgataaa

SEQ ID NO: 404696 - DNA, 20 bp, Artificial
  CRISPR gRNA sequence
gataaatgatgctgcatctg

SEQ ID NO: 404697 - DNA, 20 bp, Artificial
  CRISPR gRNA sequence
catctgtttttattttgaag

SEQ ID NO: 404698 - DNA, 20 bp, Artificial
  CRISPR gRNA sequence
tttttattttgaagtctgag

SEQ ID NO: 404699 - DNA, 20 bp, Artificial
  CRISPR gRNA sequence
ttattttgaagtctgaggac

SEQ ID NO: 404700 - DNA, 20 bp, Artificial
  CRISPR gRNA sequence
tattttgaagtctgaggaca

SEQ ID NO: 404701 - DNA, 20 bp, Artificial
  CRISPR gRNA sequence
attttgaagtctgaggacac

SEQ ID NO: 404702 - DNA, 20 bp, Artificial
  CRISPR gRNA sequence
ttttgaagtctgaggacaca

SEQ ID NO: 404703 - DNA, 20 bp, Artificial
  CRISPR gRNA sequence
tgaagtctgaggacacaata

SEQ ID NO: 404704 - DNA, 20 bp, Artificial
  CRISPR gRNA sequence
gaagtctgaggacacaatac

SEQ ID NO: 404705 - DNA, 20 bp, Artificial
  CRISPR gRNA sequence
aagtctgaggacacaatact

SEQ ID NO: 404706 - DNA, 20 bp, Artificial
  CRISPR gRNA sequence
aggacacaatactccattga

SEQ ID NO: 404707 - DNA, 20 bp, Artificial
  CRISPR gRNA sequence
cattgatttttttttttttt

SEQ ID NO: 404708 - DNA, 20 bp, Artificial
  CRISPR gRNA sequence
atttttttttttttttttga

SEQ ID NO: 404709 - DNA, 20 bp, Artificial
  CRISPR gRNA sequence
ttttttttttttttgagacg

SEQ ID NO: 404710 - DNA, 20 bp, Artificial
  CRISPR gRNA sequence
tttttttttttttgagacgg

SEQ ID NO: 404711 - DNA, 20 bp, Artificial
  CRISPR gRNA sequence
ttttttttttttgagacgga

SEQ ID NO: 404712 - DNA, 20 bp, Artificial
  CRISPR gRNA sequence
tttttttttttgagacggag

SEQ ID NO: 404713 - DNA, 20 bp, Artificial
  CRISPR gRNA sequence
ttttttttttgagacggagt

SEQ ID NO: 404714 - DNA, 20 bp, Artificial
  CRISPR gRNA sequence
tttttttttgagacggagtc

SEQ ID NO: 404715 - DNA, 20 bp, Artificial
  CRISPR gRNA sequence
ttttttttgagacggagtct

SEQ ID NO: 404716 - DNA, 20 bp, Artificial
  CRISPR gRNA sequence
tttttttgagacggagtctc

SEQ ID NO: 404717 - DNA, 20 bp, Artificial
  CRISPR gRNA sequence
ttttttgagacggagtctcg

SEQ ID NO: 404718 - DNA, 20 bp, Artificial
  CRISPR gRNA sequence
tttttgagacggagtctcgc

SEQ ID NO: 404719 - DNA, 20 bp, Artificial
  CRISPR gRNA sequence
ttttgagacggagtctcgct

SEQ ID NO: 404720 - DNA, 20 bp, Artificial
  CRISPR gRNA sequence
tttgagacggagtctcgctc

SEQ ID NO: 404721 - DNA, 20 bp, Artificial
  CRISPR gRNA sequence
ttgagacggagtctcgctct

SEQ ID NO: 404722 - DNA, 20 bp, Artificial
  CRISPR gRNA sequence
tgagacggagtctcgctctg

SEQ ID NO: 404723 - DNA, 20 bp, Artificial
  CRISPR gRNA sequence
gagacggagtctcgctctgt

SEQ ID NO: 404724 - DNA, 20 bp, Artificial
  CRISPR gRNA sequence
agacggagtctcgctctgtc

SEQ ID NO: 404725 - DNA, 20 bp, Artificial
  CRISPR gRNA sequence
gctctgtcgcccaggctgga

SEQ ID NO: 404726 - DNA, 20 bp, Artificial
  CRISPR gRNA sequence
tgtcgcccaggctggagtgc

SEQ ID NO: 404727 - DNA, 20 bp, Artificial
  CRISPR gRNA sequence
tcgcccaggctggagtgcag

SEQ ID NO: 404728 - DNA, 20 bp, Artificial
  CRISPR gRNA sequence
gagtgcagtggcgcgatctc

SEQ ID NO: 404729 - DNA, 20 bp, Artificial
  CRISPR gRNA sequence
ggctcactgcaagctccgcc

SEQ ID NO: 404730 - DNA, 20 bp, Artificial
  CRISPR gRNA sequence
actgcaagctccgcctcctg

SEQ ID NO: 404731 - DNA, 20 bp, Artificial
  CRISPR gRNA sequence
caagctccgcctcctgggtt

SEQ ID NO: 404732 - DNA, 20 bp, Artificial
  CRISPR gRNA sequence
cgcctcctgggttcatgcca

SEQ ID NO: 404733 - DNA, 20 bp, Artificial
  CRISPR gRNA sequence
ctgggttcatgccattctcc

SEQ ID NO: 404734 - DNA, 20 bp, Artificial
  CRISPR gRNA sequence
ggttcatgccattctcctgc

SEQ ID NO: 404735 - DNA, 20 bp, Artificial
  CRISPR gRNA sequence
atgccattctcctgcctcag

SEQ ID NO: 404736 - DNA, 20 bp, Artificial
  CRISPR gRNA sequence
tcctgcctcagcctcccaag

SEQ ID NO: 404737 - DNA, 20 bp, Artificial
  CRISPR gRNA sequence
ctgcctcagcctcccaagta

SEQ ID NO: 404738 - DNA, 20 bp, Artificial
  CRISPR gRNA sequence
cctcagcctcccaagtagct

SEQ ID NO: 404739 - DNA, 20 bp, Artificial
  CRISPR gRNA sequence
agcctcccaagtagctggga

SEQ ID NO: 404740 - DNA, 20 bp, Artificial
  CRISPR gRNA sequence
ccaagtagctgggactacag

SEQ ID NO: 404741 - DNA, 20 bp, Artificial
  CRISPR gRNA sequence
ggactacaggcgcccgccac

SEQ ID NO: 404742 - DNA, 20 bp, Artificial
  CRISPR gRNA sequence
caggcgcccgccactacgcc

SEQ ID NO: 404743 - DNA, 20 bp, Artificial
  CRISPR gRNA sequence
cgcccggctaattttttgta

SEQ ID NO: 404744 - DNA, 20 bp, Artificial
  CRISPR gRNA sequence
attttttgtatttttagtag

SEQ ID NO: 404745 - DNA, 20 bp, Artificial
  CRISPR gRNA sequence
tttgtatttttagtagagac

SEQ ID NO: 404746 - DNA, 20 bp, Artificial
  CRISPR gRNA sequence
ttgtatttttagtagagacg

SEQ ID NO: 404747 - DNA, 20 bp, Artificial
  CRISPR gRNA sequence
tgtatttttagtagagacgg

SEQ ID NO: 404748 - DNA, 20 bp, Artificial
  CRISPR gRNA sequence
gtatttttagtagagacggg

SEQ ID NO: 404749 - DNA, 20 bp, Artificial
  CRISPR gRNA sequence
tatttttagtagagacgggg

SEQ ID NO: 404750 - DNA, 20 bp, Artificial
  CRISPR gRNA sequence
ttagtagagacggggtttca

SEQ ID NO: 404751 - DNA, 20 bp, Artificial
  CRISPR gRNA sequence
tagtagagacggggtttcac

SEQ ID NO: 404752 - DNA, 20 bp, Artificial
  CRISPR gRNA sequence
agtagagacggggtttcacc

SEQ ID NO: 404753 - DNA, 20 bp, Artificial
  CRISPR gRNA sequence
gtagagacggggtttcaccg

SEQ ID NO: 404754 - DNA, 20 bp, Artificial
  CRISPR gRNA sequence
caccgtttttagccgggatg

SEQ ID NO: 404755 - DNA, 20 bp, Artificial
  CRISPR gRNA sequence
accgtttttagccgggatgg

SEQ ID NO: 404756 - DNA, 20 bp, Artificial
  CRISPR gRNA sequence
ttagccgggatggtctcgat

SEQ ID NO: 404757 - DNA, 20 bp, Artificial
  CRISPR gRNA sequence
tagccgggatggtctcgatc

SEQ ID NO: 404758 - DNA, 20 bp, Artificial
  CRISPR gRNA sequence
agccgggatggtctcgatct

SEQ ID NO: 404759 - DNA, 20 bp, Artificial
  CRISPR gRNA sequence
gccgggatggtctcgatctc

SEQ ID NO: 404760 - DNA, 20 bp, Artificial
  CRISPR gRNA sequence
gatctcctgacctcgtgatc

SEQ ID NO: 404761 - DNA, 20 bp, Artificial
  CRISPR gRNA sequence
ctgacctcgtgatccgcccg

SEQ ID NO: 404762 - DNA, 20 bp, Artificial
  CRISPR gRNA sequence
acctcgtgatccgcccgcct

SEQ ID NO: 404763 - DNA, 20 bp, Artificial
  CRISPR gRNA sequence
gtgatccgcccgcctcggcc

SEQ ID NO: 404764 - DNA, 20 bp, Artificial
  CRISPR gRNA sequence
ggcctcccaaagtgctggga

SEQ ID NO: 404765 - DNA, 20 bp, Artificial
  CRISPR gRNA sequence
ccaaagtgctgggattacag

SEQ ID NO: 404766 - DNA, 20 bp, Artificial
  CRISPR gRNA sequence
ggattacaggcgtgagccac

SEQ ID NO: 404767 - DNA, 20 bp, Artificial
  CRISPR gRNA sequence
caggcgtgagccaccgcgcc

SEQ ID NO: 404768 - DNA, 20 bp, Artificial
  CRISPR gRNA sequence
atttttattgactaaccttt

SEQ ID NO: 404769 - DNA, 20 bp, Artificial
  CRISPR gRNA sequence
ttattgactaacctttttcc

SEQ ID NO: 404770 - DNA, 20 bp, Artificial
  CRISPR gRNA sequence
tattgactaacctttttcca

SEQ ID NO: 404771 - DNA, 20 bp, Artificial
  CRISPR gRNA sequence
attgactaacctttttccat

SEQ ID NO: 404772 - DNA, 20 bp, Artificial
  CRISPR gRNA sequence
ttgactaacctttttccatc

SEQ ID NO: 404773 - DNA, 20 bp, Artificial
  CRISPR gRNA sequence
actaacctttttccatccta

SEQ ID NO: 404774 - DNA, 20 bp, Artificial
  CRISPR gRNA sequence
acctttttccatcctaaatc

SEQ ID NO: 404775 - DNA, 20 bp, Artificial
  CRISPR gRNA sequence
tttccatcctaaatcagatg

SEQ ID NO: 404776 - DNA, 20 bp, Artificial
  CRISPR gRNA sequence
ttccatcctaaatcagatgt

SEQ ID NO: 404777 - DNA, 20 bp, Artificial
  CRISPR gRNA sequence
tccatcctaaatcagatgtg

SEQ ID NO: 404778 - DNA, 20 bp, Artificial
  CRISPR gRNA sequence
ccatcctaaatcagatgtgt

SEQ ID NO: 404779 - DNA, 20 bp, Artificial
  CRISPR gRNA sequence
catcctaaatcagatgtgtc

SEQ ID NO: 404780 - DNA, 20 bp, Artificial
  CRISPR gRNA sequence
aatcagatgtgtcacttcta

SEQ ID NO: 404781 - DNA, 20 bp, Artificial
  CRISPR gRNA sequence
ctatcgaggttgtcactttc

SEQ ID NO: 404782 - DNA, 20 bp, Artificial
  CRISPR gRNA sequence
tatcgaggttgtcactttct

SEQ ID NO: 404783 - DNA, 20 bp, Artificial
  CRISPR gRNA sequence
tcgaggttgtcactttcttg

SEQ ID NO: 404784 - DNA, 20 bp, Artificial
  CRISPR gRNA sequence
tcactttcttgcaagtttcc

SEQ ID NO: 404785 - DNA, 20 bp, Artificial
  CRISPR gRNA sequence
tcttgcaagtttcccattaa

SEQ ID NO: 404786 - DNA, 20 bp, Artificial
  CRISPR gRNA sequence
cttgcaagtttcccattaat

SEQ ID NO: 404787 - DNA, 20 bp, Artificial
  CRISPR gRNA sequence
ttgcaagtttcccattaatc

SEQ ID NO: 404788 - DNA, 20 bp, Artificial
  CRISPR gRNA sequence
gcaagtttcccattaatcct

SEQ ID NO: 404789 - DNA, 20 bp, Artificial
  CRISPR gRNA sequence
caagtttcccattaatcctc

SEQ ID NO: 404790 - DNA, 20 bp, Artificial
  CRISPR gRNA sequence
cccattaatcctcttaattt

SEQ ID NO: 404791 - DNA, 20 bp, Artificial
  CRISPR gRNA sequence
ccattaatcctcttaatttt

SEQ ID NO: 404792 - DNA, 20 bp, Artificial
  CRISPR gRNA sequence
atcctcttaatttttttagg

SEQ ID NO: 404793 - DNA, 20 bp, Artificial
  CRISPR gRNA sequence
ttaatttttttaggcctctg

SEQ ID NO: 404794 - DNA, 20 bp, Artificial
  CRISPR gRNA sequence
aatttttttaggcctctggg

SEQ ID NO: 404795 - DNA, 20 bp, Artificial
  CRISPR gRNA sequence
atttttttaggcctctggga

SEQ ID NO: 404796 - DNA, 20 bp, Artificial
  CRISPR gRNA sequence
ttttaggcctctgggatttc

SEQ ID NO: 404797 - DNA, 20 bp, Artificial
  CRISPR gRNA sequence
tttaggcctctgggatttct

SEQ ID NO: 404798 - DNA, 20 bp, Artificial
  CRISPR gRNA sequence
ttaggcctctgggatttctg

SEQ ID NO: 404799 - DNA, 20 bp, Artificial
  CRISPR gRNA sequence
taggcctctgggatttctgg

SEQ ID NO: 404800 - DNA, 20 bp, Artificial
  CRISPR gRNA sequence
aggcctctgggatttctgga

SEQ ID NO: 404801 - DNA, 20 bp, Artificial
  CRISPR gRNA sequence
ggcctctgggatttctggag

SEQ ID NO: 404802 - DNA, 20 bp, Artificial
  CRISPR gRNA sequence
tgggatttctggagataaag

SEQ ID NO: 404803 - DNA, 20 bp, Artificial
  CRISPR gRNA sequence
ggatttctggagataaagtt

SEQ ID NO: 404804 - DNA, 20 bp, Artificial
  CRISPR gRNA sequence
ctggagataaagttatgaat

SEQ ID NO: 404805 - DNA, 20 bp, Artificial
  CRISPR gRNA sequence
tggagataaagttatgaatt

SEQ ID NO: 404806 - DNA, 20 bp, Artificial
  CRISPR gRNA sequence
gagataaagttatgaatttc

SEQ ID NO: 404807 - DNA, 20 bp, Artificial
  CRISPR gRNA sequence
tgaatttccattggtcagtt

SEQ ID NO: 404808 - DNA, 20 bp, Artificial
  CRISPR gRNA sequence
ccattggtcagttctcagat

SEQ ID NO: 404809 - DNA, 20 bp, Artificial
  CRISPR gRNA sequence
cattggtcagttctcagata

SEQ ID NO: 404810 - DNA, 20 bp, Artificial
  CRISPR gRNA sequence
gtcagttctcagatagagaa

SEQ ID NO: 404811 - DNA, 20 bp, Artificial
  CRISPR gRNA sequence
tcagatagagaaggtgatag

SEQ ID NO: 404812 - DNA, 20 bp, Artificial
  CRISPR gRNA sequence
agatagagaaggtgatagag

SEQ ID NO: 404813 - DNA, 20 bp, Artificial
  CRISPR gRNA sequence
cactagagaacaacaaatgt

SEQ ID NO: 404814 - DNA, 20 bp, Artificial
  CRISPR gRNA sequence
actagagaacaacaaatgtt

SEQ ID NO: 404815 - DNA, 20 bp, Artificial
  CRISPR gRNA sequence
gagaacaacaaatgttttta

SEQ ID NO: 404816 - DNA, 20 bp, Artificial
  CRISPR gRNA sequence
ttaaaaaggccagagctgat

SEQ ID NO: 404817 - DNA, 20 bp, Artificial
  CRISPR gRNA sequence
taaaaaggccagagctgatg

SEQ ID NO: 404818 - DNA, 20 bp, Artificial
  CRISPR gRNA sequence
aaaaaggccagagctgatgg

SEQ ID NO: 404819 - DNA, 20 bp, Artificial
  CRISPR gRNA sequence
aaaaggccagagctgatggg

SEQ ID NO: 404820 - DNA, 20 bp, Artificial
  CRISPR gRNA sequence
atggggtaaggcagggataa

SEQ ID NO: 404821 - DNA, 20 bp, Artificial
  CRISPR gRNA sequence
tcgcagttggttttgaggag

SEQ ID NO: 404822 - DNA, 20 bp, Artificial
  CRISPR gRNA sequence
cgcagttggttttgaggagg

SEQ ID NO: 404823 - DNA, 20 bp, Artificial
  CRISPR gRNA sequence
gcagttggttttgaggaggg

SEQ ID NO: 404824 - DNA, 20 bp, Artificial
  CRISPR gRNA sequence
gttttgaggagggggcagga

SEQ ID NO: 404825 - DNA, 20 bp, Artificial
  CRISPR gRNA sequence
tgaggagggggcaggattct

SEQ ID NO: 404826 - DNA, 20 bp, Artificial
  CRISPR gRNA sequence
gaggagggggcaggattcta

SEQ ID NO: 404827 - DNA, 20 bp, Artificial
  CRISPR gRNA sequence
aggagggggcaggattctaa

SEQ ID NO: 404828 - DNA, 20 bp, Artificial
  CRISPR gRNA sequence
taaccagtgagaacttcagc

SEQ ID NO: 404829 - DNA, 20 bp, Artificial
  CRISPR gRNA sequence
accagtgagaacttcagccc

SEQ ID NO: 404830 - DNA, 20 bp, Artificial
  CRISPR gRNA sequence
cagccctgcattgatcccac

SEQ ID NO: 404831 - DNA, 20 bp, Artificial
  CRISPR gRNA sequence
agccctgcattgatcccact

SEQ ID NO: 404832 - DNA, 20 bp, Artificial
  CRISPR gRNA sequence
cattgatcccactcctggcc

SEQ ID NO: 404833 - DNA, 20 bp, Artificial
  CRISPR gRNA sequence
atcccactcctggcccccaa

SEQ ID NO: 404834 - DNA, 20 bp, Artificial
  CRISPR gRNA sequence
ctggcccccaattcttgtct

SEQ ID NO: 404835 - DNA, 20 bp, Artificial
  CRISPR gRNA sequence
gcccccaattcttgtcttcc

SEQ ID NO: 404836 - DNA, 20 bp, Artificial
  CRISPR gRNA sequence
ttgtcttcctgcaacacgac

SEQ ID NO: 404837 - DNA, 20 bp, Artificial
  CRISPR gRNA sequence
gtcttcctgcaacacgacac

SEQ ID NO: 404838 - DNA, 20 bp, Artificial
  CRISPR gRNA sequence
tcttcctgcaacacgacact

SEQ ID NO: 404839 - DNA, 20 bp, Artificial
  CRISPR gRNA sequence
cctgcaacacgacacttgcc

SEQ ID NO: 404840 - DNA, 20 bp, Artificial
  CRISPR gRNA sequence
ctgcaacacgacacttgcct

SEQ ID NO: 404841 - DNA, 20 bp, Artificial
  CRISPR gRNA sequence
caacacgacacttgccttcc

SEQ ID NO: 404842 - DNA, 20 bp, Artificial
  CRISPR gRNA sequence
gccttccaacattatgatgc

SEQ ID NO: 404843 - DNA, 20 bp, Artificial
  CRISPR gRNA sequence
ccttccaacattatgatgcc

SEQ ID NO: 404844 - DNA, 20 bp, Artificial
  CRISPR gRNA sequence
ccaacattatgatgccatgt

SEQ ID NO: 404845 - DNA, 20 bp, Artificial
  CRISPR gRNA sequence
caacattatgatgccatgtt

SEQ ID NO: 404846 - DNA, 20 bp, Artificial
  CRISPR gRNA sequence
tgatgccatgttttgctatt

SEQ ID NO: 404847 - DNA, 20 bp, Artificial
  CRISPR gRNA sequence
tgctattttgttatcagatt

SEQ ID NO: 404848 - DNA, 20 bp, Artificial
  CRISPR gRNA sequence
gctattttgttatcagattt

SEQ ID NO: 404849 - DNA, 20 bp, Artificial
  CRISPR gRNA sequence
ctattttgttatcagatttt

SEQ ID NO: 404850 - DNA, 20 bp, Artificial
  CRISPR gRNA sequence
ttttgttatcagattttctt

SEQ ID NO: 404851 - DNA, 20 bp, Artificial
  CRISPR gRNA sequence
tgttatcagattttctttcc

SEQ ID NO: 404852 - DNA, 20 bp, Artificial
  CRISPR gRNA sequence
gttatcagattttctttcct

SEQ ID NO: 404853 - DNA, 20 bp, Artificial
  CRISPR gRNA sequence
ttatcagattttctttcctt

SEQ ID NO: 404854 - DNA, 20 bp, Artificial
  CRISPR gRNA sequence
tcagattttctttccttcct

SEQ ID NO: 404855 - DNA, 20 bp, Artificial
  CRISPR gRNA sequence
tctttccttccttctctctc

SEQ ID NO: 404856 - DNA, 20 bp, Artificial
  CRISPR gRNA sequence
ctttccttccttctctctct

SEQ ID NO: 404857 - DNA, 20 bp, Artificial
  CRISPR gRNA sequence
tttccttccttctctctctc

SEQ ID NO: 404858 - DNA, 20 bp, Artificial
  CRISPR gRNA sequence
tccttccttctctctctctc

SEQ ID NO: 404859 - DNA, 20 bp, Artificial
  CRISPR gRNA sequence
ccttccttctctctctctct

SEQ ID NO: 404860 - DNA, 20 bp, Artificial
  CRISPR gRNA sequence
cttccttctctctctctctt

SEQ ID NO: 404861 - DNA, 20 bp, Artificial
  CRISPR gRNA sequence
ccttctctctctctctttct

SEQ ID NO: 404862 - DNA, 20 bp, Artificial
  CRISPR gRNA sequence
cttctctctctctctttctt

SEQ ID NO: 404863 - DNA, 20 bp, Artificial
  CRISPR gRNA sequence
ctctctctctctttctttct

SEQ ID NO: 404864 - DNA, 20 bp, Artificial
  CRISPR gRNA sequence
tctctctctctttctttctc

SEQ ID NO: 404865 - DNA, 20 bp, Artificial
  CRISPR gRNA sequence
tctctctctttctttctctc

SEQ ID NO: 404866 - DNA, 20 bp, Artificial
  CRISPR gRNA sequence
tctctctttctttctctctc

SEQ ID NO: 404867 - DNA, 20 bp, Artificial
  CRISPR gRNA sequence
tctctttctttctctctctc

SEQ ID NO: 404868 - DNA, 20 bp, Artificial
  CRISPR gRNA sequence
tctttctttctctctctctt

SEQ ID NO: 404869 - DNA, 20 bp, Artificial
  CRISPR gRNA sequence
tttctttctctctctctttc

SEQ ID NO: 404870 - DNA, 20 bp, Artificial
  CRISPR gRNA sequence
tctttctctctctctttctt

SEQ ID NO: 404871 - DNA, 20 bp, Artificial
  CRISPR gRNA sequence
ctttctctctctctttcttt

SEQ ID NO: 404872 - DNA, 20 bp, Artificial
  CRISPR gRNA sequence
tttctctctctctttctttc

SEQ ID NO: 404873 - DNA, 20 bp, Artificial
  CRISPR gRNA sequence
tctctctctctttctttctc

SEQ ID NO: 404874 - DNA, 20 bp, Artificial
  CRISPR gRNA sequence
ctctctctctttctttctcc

SEQ ID NO: 404875 - DNA, 20 bp, Artificial
  CRISPR gRNA sequence
tctctctctttctttctccc

SEQ ID NO: 404876 - DNA, 20 bp, Artificial
  CRISPR gRNA sequence
tctctctttctttctccctt

SEQ ID NO: 404877 - DNA, 20 bp, Artificial
  CRISPR gRNA sequence
tctctttctttctccctttc

SEQ ID NO: 404878 - DNA, 20 bp, Artificial
  CRISPR gRNA sequence
tctttctttctccctttcct

SEQ ID NO: 404879 - DNA, 20 bp, Artificial
  CRISPR gRNA sequence
tttctttctccctttccttc

SEQ ID NO: 404880 - DNA, 20 bp, Artificial
  CRISPR gRNA sequence
tctttctccctttccttcct

SEQ ID NO: 404881 - DNA, 20 bp, Artificial
  CRISPR gRNA sequence
ctttctccctttccttcctt

SEQ ID NO: 404882 - DNA, 20 bp, Artificial
  CRISPR gRNA sequence
tttctccctttccttccttc

SEQ ID NO: 404883 - DNA, 20 bp, Artificial
  CRISPR gRNA sequence
tctccctttccttccttcct

SEQ ID NO: 404884 - DNA, 20 bp, Artificial
  CRISPR gRNA sequence
ctccctttccttccttcctt

SEQ ID NO: 404885 - DNA, 20 bp, Artificial
  CRISPR gRNA sequence
tccctttccttccttccttc

SEQ ID NO: 404886 - DNA, 20 bp, Artificial
  CRISPR gRNA sequence
cctttccttccttccttcct

SEQ ID NO: 404887 - DNA, 20 bp, Artificial
  CRISPR gRNA sequence
tccttccttccttccttcct

SEQ ID NO: 404888 - DNA, 20 bp, Artificial
  CRISPR gRNA sequence
ccttccttccttccttcctt

SEQ ID NO: 404889 - DNA, 20 bp, Artificial
  CRISPR gRNA sequence
cttccttccttccttccttt

SEQ ID NO: 404890 - DNA, 20 bp, Artificial
  CRISPR gRNA sequence
ccttccttccttcctttctt

SEQ ID NO: 404891 - DNA, 20 bp, Artificial
  CRISPR gRNA sequence
cttccttccttcctttcttt

SEQ ID NO: 404892 - DNA, 20 bp, Artificial
  CRISPR gRNA sequence
ccttccttcctttctttctt

SEQ ID NO: 404893 - DNA, 20 bp, Artificial
  CRISPR gRNA sequence
cttccttcctttctttcttt

SEQ ID NO: 404894 - DNA, 20 bp, Artificial
  CRISPR gRNA sequence
ccttcctttctttctttctc

SEQ ID NO: 404895 - DNA, 20 bp, Artificial
  CRISPR gRNA sequence
cttcctttctttctttctct

SEQ ID NO: 404896 - DNA, 20 bp, Artificial
  CRISPR gRNA sequence
cctttctttctttctctctt

SEQ ID NO: 404897 - DNA, 20 bp, Artificial
  CRISPR gRNA sequence
ctttctttctttctctcttt

SEQ ID NO: 404898 - DNA, 20 bp, Artificial
  CRISPR gRNA sequence
tctttctttctctctttttc

SEQ ID NO: 404899 - DNA, 20 bp, Artificial
  CRISPR gRNA sequence
ctttctttctctctttttct

SEQ ID NO: 404900 - DNA, 20 bp, Artificial
  CRISPR gRNA sequence
tttctttctctctttttctc

SEQ ID NO: 404901 - DNA, 20 bp, Artificial
  CRISPR gRNA sequence
tctttctctctttttctctt

SEQ ID NO: 404902 - DNA, 20 bp, Artificial
  CRISPR gRNA sequence
ctttctctctttttctcttt

SEQ ID NO: 404903 - DNA, 20 bp, Artificial
  CRISPR gRNA sequence
tttctctctttttctctttc

SEQ ID NO: 404904 - DNA, 20 bp, Artificial
  CRISPR gRNA sequence
tctctctttttctctttctc

SEQ ID NO: 404905 - DNA, 20 bp, Artificial
  CRISPR gRNA sequence
ctctctttttctctttctct

SEQ ID NO: 404906 - DNA, 20 bp, Artificial
  CRISPR gRNA sequence
tctctttttctctttctctc

SEQ ID NO: 404907 - DNA, 20 bp, Artificial
  CRISPR gRNA sequence
tctttttctctttctctctt

SEQ ID NO: 404908 - DNA, 20 bp, Artificial
  CRISPR gRNA sequence
tttttctctttctctctttc

SEQ ID NO: 404909 - DNA, 20 bp, Artificial
  CRISPR gRNA sequence
tttctctttctctctttctt

SEQ ID NO: 404910 - DNA, 20 bp, Artificial
  CRISPR gRNA sequence
ttctctttctctctttcttt

SEQ ID NO: 404911 - DNA, 20 bp, Artificial
  CRISPR gRNA sequence
tctctttctctctttctttc

SEQ ID NO: 404912 - DNA, 20 bp, Artificial
  CRISPR gRNA sequence
ctctttctctctttctttct

SEQ ID NO: 404913 - DNA, 20 bp, Artificial
  CRISPR gRNA sequence
tctttctctctttctttctt

SEQ ID NO: 404914 - DNA, 20 bp, Artificial
  CRISPR gRNA sequence
tttctctctttctttctttc

SEQ ID NO: 404915 - DNA, 20 bp, Artificial
  CRISPR gRNA sequence
tctctctttctttctttctt

SEQ ID NO: 404916 - DNA, 20 bp, Artificial
  CRISPR gRNA sequence
ctctctttctttctttcttc

SEQ ID NO: 404917 - DNA, 20 bp, Artificial
  CRISPR gRNA sequence
tctctttctttctttcttct

SEQ ID NO: 404918 - DNA, 20 bp, Artificial
  CRISPR gRNA sequence
tctttctttctttcttcttt

SEQ ID NO: 404919 - DNA, 20 bp, Artificial
  CRISPR gRNA sequence
tttctttctttcttctttga

SEQ ID NO: 404920 - DNA, 20 bp, Artificial
  CRISPR gRNA sequence
tctttctttcttctttgact

SEQ ID NO: 404921 - DNA, 20 bp, Artificial
  CRISPR gRNA sequence
ctttctttcttctttgactt

SEQ ID NO: 404922 - DNA, 20 bp, Artificial
  CRISPR gRNA sequence
tttctttcttctttgacttt

SEQ ID NO: 404923 - DNA, 20 bp, Artificial
  CRISPR gRNA sequence
tctttcttctttgacttttt

SEQ ID NO: 404924 - DNA, 20 bp, Artificial
  CRISPR gRNA sequence
ctttcttctttgactttttt

SEQ ID NO: 404925 - DNA, 20 bp, Artificial
  CRISPR gRNA sequence
tttcttctttgacttttttg

SEQ ID NO: 404926 - DNA, 20 bp, Artificial
  CRISPR gRNA sequence
tcttctttgacttttttgag

SEQ ID NO: 404927 - DNA, 20 bp, Artificial
  CRISPR gRNA sequence
cttctttgacttttttgaga

SEQ ID NO: 404928 - DNA, 20 bp, Artificial
  CRISPR gRNA sequence
ttctttgacttttttgagac

SEQ ID NO: 404929 - DNA, 20 bp, Artificial
  CRISPR gRNA sequence
ctttgacttttttgagacag

SEQ ID NO: 404930 - DNA, 20 bp, Artificial
  CRISPR gRNA sequence
tttgacttttttgagacaga

SEQ ID NO: 404931 - DNA, 20 bp, Artificial
  CRISPR gRNA sequence
tgacttttttgagacagagt

SEQ ID NO: 404932 - DNA, 20 bp, Artificial
  CRISPR gRNA sequence
gacttttttgagacagagtc

SEQ ID NO: 404933 - DNA, 20 bp, Artificial
  CRISPR gRNA sequence
acttttttgagacagagtct

SEQ ID NO: 404934 - DNA, 20 bp, Artificial
  CRISPR gRNA sequence
ttttgagacagagtctcact

SEQ ID NO: 404935 - DNA, 20 bp, Artificial
  CRISPR gRNA sequence
tttgagacagagtctcactg

SEQ ID NO: 404936 - DNA, 20 bp, Artificial
  CRISPR gRNA sequence
ttgagacagagtctcactgt

SEQ ID NO: 404937 - DNA, 20 bp, Artificial
  CRISPR gRNA sequence
tgagacagagtctcactgtt

SEQ ID NO: 404938 - DNA, 20 bp, Artificial
  CRISPR gRNA sequence
gagacagagtctcactgttg

SEQ ID NO: 404939 - DNA, 20 bp, Artificial
  CRISPR gRNA sequence
agacagagtctcactgttgc

SEQ ID NO: 404940 - DNA, 20 bp, Artificial
  CRISPR gRNA sequence
actgttgcccaggctggagt

SEQ ID NO: 404941 - DNA, 20 bp, Artificial
  CRISPR gRNA sequence
ttgcccaggctggagtgtag

SEQ ID NO: 404942 - DNA, 20 bp, Artificial
  CRISPR gRNA sequence
cccaggctggagtgtagtgg

SEQ ID NO: 404943 - DNA, 20 bp, Artificial
  CRISPR gRNA sequence
gagtgtagtggcgcaatctc

SEQ ID NO: 404944 - DNA, 20 bp, Artificial
  CRISPR gRNA sequence
ggatcactgcaacctctgcc

SEQ ID NO: 404945 - DNA, 20 bp, Artificial
  CRISPR gRNA sequence
caacctctgcctcttgggtt

SEQ ID NO: 404946 - DNA, 20 bp, Artificial
  CRISPR gRNA sequence
tgcctcttgggttcaagcca

SEQ ID NO: 404947 - DNA, 20 bp, Artificial
  CRISPR gRNA sequence
cctcttgggttcaagccatt

SEQ ID NO: 404948 - DNA, 20 bp, Artificial
  CRISPR gRNA sequence
ttgggttcaagccattctcc

SEQ ID NO: 404949 - DNA, 20 bp, Artificial
  CRISPR gRNA sequence
gggttcaagccattctcctg

SEQ ID NO: 404950 - DNA, 20 bp, Artificial
  CRISPR gRNA sequence
ggttcaagccattctcctgc

SEQ ID NO: 404951 - DNA, 20 bp, Artificial
  CRISPR gRNA sequence
aagccattctcctgcctcag

SEQ ID NO: 404952 - DNA, 20 bp, Artificial
  CRISPR gRNA sequence
tcctgcctcagcctcctgag

SEQ ID NO: 404953 - DNA, 20 bp, Artificial
  CRISPR gRNA sequence
ctgcctcagcctcctgagta

SEQ ID NO: 404954 - DNA, 20 bp, Artificial
  CRISPR gRNA sequence
cctcagcctcctgagtagct

SEQ ID NO: 404955 - DNA, 20 bp, Artificial
  CRISPR gRNA sequence
agcctcctgagtagctggga

SEQ ID NO: 404956 - DNA, 20 bp, Artificial
  CRISPR gRNA sequence
ctgagtagctgggattacag

SEQ ID NO: 404957 - DNA, 20 bp, Artificial
  CRISPR gRNA sequence
agtagctgggattacaggtg

SEQ ID NO: 404958 - DNA, 20 bp, Artificial
  CRISPR gRNA sequence
ggattacaggtgcccgccac

SEQ ID NO: 404959 - DNA, 20 bp, Artificial
  CRISPR gRNA sequence
caggtgcccgccaccatgct

SEQ ID NO: 404960 - DNA, 20 bp, Artificial
  CRISPR gRNA sequence
ggctaatttttgtaatttta

SEQ ID NO: 404961 - DNA, 20 bp, Artificial
  CRISPR gRNA sequence
gctaatttttgtaattttag

SEQ ID NO: 404962 - DNA, 20 bp, Artificial
  CRISPR gRNA sequence
atttttgtaattttagtaga

SEQ ID NO: 404963 - DNA, 20 bp, Artificial
  CRISPR gRNA sequence
ttgtaattttagtagagatg

SEQ ID NO: 404964 - DNA, 20 bp, Artificial
  CRISPR gRNA sequence
tgtaattttagtagagatgg

SEQ ID NO: 404965 - DNA, 20 bp, Artificial
  CRISPR gRNA sequence
gtaattttagtagagatggg

SEQ ID NO: 404966 - DNA, 20 bp, Artificial
  CRISPR gRNA sequence
taattttagtagagatgggg

SEQ ID NO: 404967 - DNA, 20 bp, Artificial
  CRISPR gRNA sequence
tagtagagatgggggtttca

SEQ ID NO: 404968 - DNA, 20 bp, Artificial
  CRISPR gRNA sequence
agtagagatgggggtttcac

SEQ ID NO: 404969 - DNA, 20 bp, Artificial
  CRISPR gRNA sequence
gtagagatgggggtttcacc

SEQ ID NO: 404970 - DNA, 20 bp, Artificial
  CRISPR gRNA sequence
caccatgttggccaggctgg

SEQ ID NO: 404971 - DNA, 20 bp, Artificial
  CRISPR gRNA sequence
accatgttggccaggctggt

SEQ ID NO: 404972 - DNA, 20 bp, Artificial
  CRISPR gRNA sequence
gccaggctggtctcgaactc

SEQ ID NO: 404973 - DNA, 20 bp, Artificial
  CRISPR gRNA sequence
gtctcgaactcctgacctta

SEQ ID NO: 404974 - DNA, 20 bp, Artificial
  CRISPR gRNA sequence
gaactcctgaccttaggcga

SEQ ID NO: 404975 - DNA, 20 bp, Artificial
  CRISPR gRNA sequence
ctgaccttaggcgatctgcc

SEQ ID NO: 404976 - DNA, 20 bp, Artificial
  CRISPR gRNA sequence
accttaggcgatctgcctgc

SEQ ID NO: 404977 - DNA, 20 bp, Artificial
  CRISPR gRNA sequence
aggcgatctgcctgccttgg

SEQ ID NO: 404978 - DNA, 20 bp, Artificial
  CRISPR gRNA sequence
ggcgatctgcctgccttggc

SEQ ID NO: 404979 - DNA, 20 bp, Artificial
  CRISPR gRNA sequence
cctgccttggcctcccaaag

SEQ ID NO: 404980 - DNA, 20 bp, Artificial
  CRISPR gRNA sequence
ccttggcctcccaaagtgct

SEQ ID NO: 404981 - DNA, 20 bp, Artificial
  CRISPR gRNA sequence
ggcctcccaaagtgctggga

SEQ ID NO: 404982 - DNA, 20 bp, Artificial
  CRISPR gRNA sequence
gcctcccaaagtgctgggag

SEQ ID NO: 404983 - DNA, 20 bp, Artificial
  CRISPR gRNA sequence
ccaaagtgctgggagtacaa

SEQ ID NO: 404984 - DNA, 20 bp, Artificial
  CRISPR gRNA sequence
ggagtacaaggcatgagcca

SEQ ID NO: 404985 - DNA, 20 bp, Artificial
  CRISPR gRNA sequence
gccagttatgagattttctt

SEQ ID NO: 404986 - DNA, 20 bp, Artificial
  CRISPR gRNA sequence
tgagattttcttttcaaaac

SEQ ID NO: 404987 - DNA, 20 bp, Artificial
  CRISPR gRNA sequence
tcttttcaaaactgctctca

SEQ ID NO: 404988 - DNA, 20 bp, Artificial
  CRISPR gRNA sequence
cttttcaaaactgctctcat

SEQ ID NO: 404989 - DNA, 20 bp, Artificial
  CRISPR gRNA sequence
ttttcaaaactgctctcatg

SEQ ID NO: 404990 - DNA, 20 bp, Artificial
  CRISPR gRNA sequence
ttcaaaactgctctcatgcc

SEQ ID NO: 404991 - DNA, 20 bp, Artificial
  CRISPR gRNA sequence
tcaaaactgctctcatgcca

SEQ ID NO: 404992 - DNA, 20 bp, Artificial
  CRISPR gRNA sequence
caaaactgctctcatgccag

SEQ ID NO: 404993 - DNA, 20 bp, Artificial
  CRISPR gRNA sequence
aaaactgctctcatgccagt

SEQ ID NO: 404994 - DNA, 20 bp, Artificial
  CRISPR gRNA sequence
ctctcatgccagtgtttatc

SEQ ID NO: 404995 - DNA, 20 bp, Artificial
  CRISPR gRNA sequence
tcatgccagtgtttatcagc

SEQ ID NO: 404996 - DNA, 20 bp, Artificial
  CRISPR gRNA sequence
atgccagtgtttatcagctc

SEQ ID NO: 404997 - DNA, 20 bp, Artificial
  CRISPR gRNA sequence
atcagctctcactacttgaa

SEQ ID NO: 404998 - DNA, 20 bp, Artificial
  CRISPR gRNA sequence
tcagctctcactacttgaaa

SEQ ID NO: 404999 - DNA, 20 bp, Artificial
  CRISPR gRNA sequence
tcactacttgaaagctgtat

SEQ ID NO: 405000 - DNA, 20 bp, Artificial
  CRISPR gRNA sequence
actacttgaaagctgtatga

SEQ ID NO: 405001 - DNA, 20 bp, Artificial
  CRISPR gRNA sequence
cttgaaagctgtatgagggt

SEQ ID NO: 405002 - DNA, 20 bp, Artificial
  CRISPR gRNA sequence
gaaagctgtatgagggtgga

SEQ ID NO: 405003 - DNA, 20 bp, Artificial
  CRISPR gRNA sequence
aaagctgtatgagggtggaa

SEQ ID NO: 405004 - DNA, 20 bp, Artificial
  CRISPR gRNA sequence
tatgagggtggaattgggta

SEQ ID NO: 405005 - DNA, 20 bp, Artificial
  CRISPR gRNA sequence
ggtagactgcgaagggcccc

SEQ ID NO: 405006 - DNA, 20 bp, Artificial
  CRISPR gRNA sequence
cgaagggccccattcccagg

SEQ ID NO: 405007 - DNA, 20 bp, Artificial
  CRISPR gRNA sequence
ccaggggttcgttttcagca

SEQ ID NO: 405008 - DNA, 20 bp, Artificial
  CRISPR gRNA sequence
gttttcagcactgtgcatcc

SEQ ID NO: 405009 - DNA, 20 bp, Artificial
  CRISPR gRNA sequence
tcagcactgtgcatcctcac

SEQ ID NO: 405010 - DNA, 20 bp, Artificial
  CRISPR gRNA sequence
cagcactgtgcatcctcaca

SEQ ID NO: 405011 - DNA, 20 bp, Artificial
  CRISPR gRNA sequence
agcactgtgcatcctcacaa

SEQ ID NO: 405012 - DNA, 20 bp, Artificial
  CRISPR gRNA sequence
tgcatcctcacaatggcctg

SEQ ID NO: 405013 - DNA, 20 bp, Artificial
  CRISPR gRNA sequence
acaatggcctggtctgtttc

SEQ ID NO: 405014 - DNA, 20 bp, Artificial
  CRISPR gRNA sequence
gtctgtttcttgactagata

SEQ ID NO: 405015 - DNA, 20 bp, Artificial
  CRISPR gRNA sequence
tttcttgactagataagatt

SEQ ID NO: 405016 - DNA, 20 bp, Artificial
  CRISPR gRNA sequence
cttgactagataagatttgt

SEQ ID NO: 405017 - DNA, 20 bp, Artificial
  CRISPR gRNA sequence
ttgactagataagatttgtg

SEQ ID NO: 405018 - DNA, 20 bp, Artificial
  CRISPR gRNA sequence
gactagataagatttgtgga

SEQ ID NO: 405019 - DNA, 20 bp, Artificial
  CRISPR gRNA sequence
actagataagatttgtggag

SEQ ID NO: 405020 - DNA, 20 bp, Artificial
  CRISPR gRNA sequence
gataagatttgtggagagat

SEQ ID NO: 405021 - DNA, 20 bp, Artificial
  CRISPR gRNA sequence
gtggagagatgagtcctcat

SEQ ID NO: 405022 - DNA, 20 bp, Artificial
  CRISPR gRNA sequence
tggagagatgagtcctcatt

SEQ ID NO: 405023 - DNA, 20 bp, Artificial
  CRISPR gRNA sequence
atttctcaagtccagcattt

SEQ ID NO: 405024 - DNA, 20 bp, Artificial
  CRISPR gRNA sequence
ctcaagtccagcatttccat

SEQ ID NO: 405025 - DNA, 20 bp, Artificial
  CRISPR gRNA sequence
tcaagtccagcatttccata

SEQ ID NO: 405026 - DNA, 20 bp, Artificial
  CRISPR gRNA sequence
aagtccagcatttccataat

SEQ ID NO: 405027 - DNA, 20 bp, Artificial
  CRISPR gRNA sequence
ccataattgttccatttaca

SEQ ID NO: 405028 - DNA, 20 bp, Artificial
  CRISPR gRNA sequence
cataattgttccatttacag

SEQ ID NO: 405029 - DNA, 20 bp, Artificial
  CRISPR gRNA sequence
ttccatttacagaagtctgt

SEQ ID NO: 405030 - DNA, 20 bp, Artificial
  CRISPR gRNA sequence
catttacagaagtctgtttt

SEQ ID NO: 405031 - DNA, 20 bp, Artificial
  CRISPR gRNA sequence
acagaagtctgtttttagtg

SEQ ID NO: 405032 - DNA, 20 bp, Artificial
  CRISPR gRNA sequence
cagaagtctgtttttagtgt

SEQ ID NO: 405033 - DNA, 20 bp, Artificial
  CRISPR gRNA sequence
tttttagtgtaaaacattat

SEQ ID NO: 405034 - DNA, 20 bp, Artificial
  CRISPR gRNA sequence
ttagtgtaaaacattataca

SEQ ID NO: 405035 - DNA, 20 bp, Artificial
  CRISPR gRNA sequence
tagtgtaaaacattatacaa

SEQ ID NO: 405036 - DNA, 20 bp, Artificial
  CRISPR gRNA sequence
agtgtaaaacattatacaaa

SEQ ID NO: 405037 - DNA, 20 bp, Artificial
  CRISPR gRNA sequence
gtgtaaaacattatacaaag

SEQ ID NO: 405038 - DNA, 20 bp, Artificial
  CRISPR gRNA sequence
tacaaagccgggcacagtgg

SEQ ID NO: 405039 - DNA, 20 bp, Artificial
  CRISPR gRNA sequence
acacctgtaatcacagaatt

SEQ ID NO: 405040 - DNA, 20 bp, Artificial
  CRISPR gRNA sequence
taatcacagaattttgggaa

SEQ ID NO: 405041 - DNA, 20 bp, Artificial
  CRISPR gRNA sequence
tgggaaaccgaggcaggagg

SEQ ID NO: 405042 - DNA, 20 bp, Artificial
  CRISPR gRNA sequence
gggaaaccgaggcaggagga

SEQ ID NO: 405043 - DNA, 20 bp, Artificial
  CRISPR gRNA sequence
ggaaaccgaggcaggaggat

SEQ ID NO: 405044 - DNA, 20 bp, Artificial
  CRISPR gRNA sequence
cttgagcctaggagtttgaa

SEQ ID NO: 405045 - DNA, 20 bp, Artificial
  CRISPR gRNA sequence
gagcctaggagtttgaaacc

SEQ ID NO: 405046 - DNA, 20 bp, Artificial
  CRISPR gRNA sequence
agcctaggagtttgaaacca

SEQ ID NO: 405047 - DNA, 20 bp, Artificial
  CRISPR gRNA sequence
ggagtttgaaaccagcctgg

SEQ ID NO: 405048 - DNA, 20 bp, Artificial
  CRISPR gRNA sequence
gaaaccagcctgggtaacat

SEQ ID NO: 405049 - DNA, 20 bp, Artificial
  CRISPR gRNA sequence
aaaccagcctgggtaacata

SEQ ID NO: 405050 - DNA, 20 bp, Artificial
  CRISPR gRNA sequence
ggtaacatagtgagactgtg

SEQ ID NO: 405051 - DNA, 20 bp, Artificial
  CRISPR gRNA sequence
tggctcgattgaaaataaaa

SEQ ID NO: 405052 - DNA, 20 bp, Artificial
  CRISPR gRNA sequence
gattgaaaataaaaaattat

SEQ ID NO: 405053 - DNA, 20 bp, Artificial
  CRISPR gRNA sequence
aaaataaaaaattatccagt

SEQ ID NO: 405054 - DNA, 20 bp, Artificial
  CRISPR gRNA sequence
tccagttgtggtggtatgca

SEQ ID NO: 405055 - DNA, 20 bp, Artificial
  CRISPR gRNA sequence
tggtggtatgcatctgtggt

SEQ ID NO: 405056 - DNA, 20 bp, Artificial
  CRISPR gRNA sequence
tggtcccagctacttgggag

SEQ ID NO: 405057 - DNA, 20 bp, Artificial
  CRISPR gRNA sequence
cttgggaggctgaggcagga

SEQ ID NO: 405058 - DNA, 20 bp, Artificial
  CRISPR gRNA sequence
gggaggctgaggcaggagga

SEQ ID NO: 405059 - DNA, 20 bp, Artificial
  CRISPR gRNA sequence
ggaggctgaggcaggaggac

SEQ ID NO: 405060 - DNA, 20 bp, Artificial
  CRISPR gRNA sequence
aggcaggaggactgcctgtg

SEQ ID NO: 405061 - DNA, 20 bp, Artificial
  CRISPR gRNA sequence
cctgtgcccaggtgcttgaa

SEQ ID NO: 405062 - DNA, 20 bp, Artificial
  CRISPR gRNA sequence
tgcccaggtgcttgaagctg

SEQ ID NO: 405063 - DNA, 20 bp, Artificial
  CRISPR gRNA sequence
gaagctgcagtgagctatga

SEQ ID NO: 405064 - DNA, 20 bp, Artificial
  CRISPR gRNA sequence
aagctgcagtgagctatgat

SEQ ID NO: 405065 - DNA, 20 bp, Artificial
  CRISPR gRNA sequence
cagtgagctatgatcgcacc

SEQ ID NO: 405066 - DNA, 20 bp, Artificial
  CRISPR gRNA sequence
tgatcgcaccactggactcc

SEQ ID NO: 405067 - DNA, 20 bp, Artificial
  CRISPR gRNA sequence
gactccaggctgggtgccag

SEQ ID NO: 405068 - DNA, 20 bp, Artificial
  CRISPR gRNA sequence
caggctgggtgccagagtga

SEQ ID NO: 405069 - DNA, 20 bp, Artificial
  CRISPR gRNA sequence
ggtgccagagtgagacccta

SEQ ID NO: 405070 - DNA, 20 bp, Artificial
  CRISPR gRNA sequence
tctcaaaaaataaacaaacg

SEQ ID NO: 405071 - DNA, 20 bp, Artificial
  CRISPR gRNA sequence
aaaaaataaacaaacgaaaa

SEQ ID NO: 405072 - DNA, 20 bp, Artificial
  CRISPR gRNA sequence
tagacattcaacaaatactc

SEQ ID NO: 405073 - DNA, 20 bp, Artificial
  CRISPR gRNA sequence
aacaaatactcaaggcctta

SEQ ID NO: 405074 - DNA, 20 bp, Artificial
  CRISPR gRNA sequence
aaggccttacttcttgacaa

SEQ ID NO: 405075 - DNA, 20 bp, Artificial
  CRISPR gRNA sequence
acttcttgacaatgaaatca

SEQ ID NO: 405076 - DNA, 20 bp, Artificial
  CRISPR gRNA sequence
cttcttgacaatgaaatcat

SEQ ID NO: 405077 - DNA, 20 bp, Artificial
  CRISPR gRNA sequence
cttgacaatgaaatcatttg

SEQ ID NO: 405078 - DNA, 20 bp, Artificial
  CRISPR gRNA sequence
ttgacaatgaaatcatttgc

SEQ ID NO: 405079 - DNA, 20 bp, Artificial
  CRISPR gRNA sequence
gacaatgaaatcatttgcca

SEQ ID NO: 405080 - DNA, 20 bp, Artificial
  CRISPR gRNA sequence
acaatgaaatcatttgccat

SEQ ID NO: 405081 - DNA, 20 bp, Artificial
  CRISPR gRNA sequence
gccattccttgaattaggcc

SEQ ID NO: 405082 - DNA, 20 bp, Artificial
  CRISPR gRNA sequence
ccattccttgaattaggcct

SEQ ID NO: 405083 - DNA, 20 bp, Artificial
  CRISPR gRNA sequence
cttgaattaggcctatatta

SEQ ID NO: 405084 - DNA, 20 bp, Artificial
  CRISPR gRNA sequence
gaattaggcctatattaata

SEQ ID NO: 405085 - DNA, 20 bp, Artificial
  CRISPR gRNA sequence
aattaggcctatattaatat

SEQ ID NO: 405086 - DNA, 20 bp, Artificial
  CRISPR gRNA sequence
ggcctatattaatatttttt

SEQ ID NO: 405087 - DNA, 20 bp, Artificial
  CRISPR gRNA sequence
tattaatattttttaaatat

SEQ ID NO: 405088 - DNA, 20 bp, Artificial
  CRISPR gRNA sequence
atattttttaaatatttatg

SEQ ID NO: 405089 - DNA, 20 bp, Artificial
  CRISPR gRNA sequence
tttaaatatttatgcttttt

SEQ ID NO: 405090 - DNA, 20 bp, Artificial
  CRISPR gRNA sequence
ttaaatatttatgcttttta

SEQ ID NO: 405091 - DNA, 20 bp, Artificial
  CRISPR gRNA sequence
taaatatttatgctttttag

SEQ ID NO: 405092 - DNA, 20 bp, Artificial
  CRISPR gRNA sequence
aaatatttatgctttttaga

SEQ ID NO: 405093 - DNA, 20 bp, Artificial
  CRISPR gRNA sequence
aatatttatgctttttagat

SEQ ID NO: 405094 - DNA, 20 bp, Artificial
  CRISPR gRNA sequence
atgctttttagatagaaaaa

SEQ ID NO: 405095 - DNA, 20 bp, Artificial
  CRISPR gRNA sequence
tgctttttagatagaaaaaa

SEQ ID NO: 405096 - DNA, 20 bp, Artificial
  CRISPR gRNA sequence
tttagatagaaaaaataaaa

SEQ ID NO: 405097 - DNA, 20 bp, Artificial
  CRISPR gRNA sequence
ttagatagaaaaaataaaaa

SEQ ID NO: 405098 - DNA, 20 bp, Artificial
  CRISPR gRNA sequence
tagatagaaaaaataaaaac

SEQ ID NO: 405099 - DNA, 20 bp, Artificial
  CRISPR gRNA sequence
agatagaaaaaataaaaaca

SEQ ID NO: 405100 - DNA, 20 bp, Artificial
  CRISPR gRNA sequence
gatagaaaaaataaaaacat

SEQ ID NO: 405101 - DNA, 20 bp, Artificial
  CRISPR gRNA sequence
gcaatacatttgccacattt

SEQ ID NO: 405102 - DNA, 20 bp, Artificial
  CRISPR gRNA sequence
caatacatttgccacatttc

SEQ ID NO: 405103 - DNA, 20 bp, Artificial
  CRISPR gRNA sequence
gccacatttctgatgctgtt

SEQ ID NO: 405104 - DNA, 20 bp, Artificial
  CRISPR gRNA sequence
ccacatttctgatgctgtta

SEQ ID NO: 405105 - DNA, 20 bp, Artificial
  CRISPR gRNA sequence
ctgatgctgttagaaaaacc

SEQ ID NO: 405106 - DNA, 20 bp, Artificial
  CRISPR gRNA sequence
tgatgctgttagaaaaacct

SEQ ID NO: 405107 - DNA, 20 bp, Artificial
  CRISPR gRNA sequence
atgctgttagaaaaacctcc

SEQ ID NO: 405108 - DNA, 20 bp, Artificial
  CRISPR gRNA sequence
ttagaaaaacctcctgcatg

SEQ ID NO: 405109 - DNA, 20 bp, Artificial
  CRISPR gRNA sequence
gaaaaacctcctgcatgttt

SEQ ID NO: 405110 - DNA, 20 bp, Artificial
  CRISPR gRNA sequence
ctgcatgtttatttttccag

SEQ ID NO: 405111 - DNA, 20 bp, Artificial
  CRISPR gRNA sequence
catgtttatttttccagact

SEQ ID NO: 405112 - DNA, 20 bp, Artificial
  CRISPR gRNA sequence
atttttccagacttttgtac

SEQ ID NO: 405113 - DNA, 20 bp, Artificial
  CRISPR gRNA sequence
tttttccagacttttgtaca

SEQ ID NO: 405114 - DNA, 20 bp, Artificial
  CRISPR gRNA sequence
ttccagacttttgtacacct

SEQ ID NO: 405115 - DNA, 20 bp, Artificial
  CRISPR gRNA sequence
tccagacttttgtacacctt

SEQ ID NO: 405116 - DNA, 20 bp, Artificial
  CRISPR gRNA sequence
ccagacttttgtacacctta

SEQ ID NO: 405117 - DNA, 20 bp, Artificial
  CRISPR gRNA sequence
cagacttttgtacaccttag

SEQ ID NO: 405118 - DNA, 20 bp, Artificial
  CRISPR gRNA sequence
ttgtacaccttagtgctccg

SEQ ID NO: 405119 - DNA, 20 bp, Artificial
  CRISPR gRNA sequence
tgtacaccttagtgctccgt

SEQ ID NO: 405120 - DNA, 20 bp, Artificial
  CRISPR gRNA sequence
gtacaccttagtgctccgtt

SEQ ID NO: 405121 - DNA, 20 bp, Artificial
  CRISPR gRNA sequence
tacaccttagtgctccgttt

SEQ ID NO: 405122 - DNA, 20 bp, Artificial
  CRISPR gRNA sequence
agtgctccgtttagtaagtg

SEQ ID NO: 405123 - DNA, 20 bp, Artificial
  CRISPR gRNA sequence
gtgctccgtttagtaagtgt

SEQ ID NO: 405124 - DNA, 20 bp, Artificial
  CRISPR gRNA sequence
cgtttagtaagtgtaactag

SEQ ID NO: 405125 - DNA, 20 bp, Artificial
  CRISPR gRNA sequence
agtaagtgtaactagtcctt

SEQ ID NO: 405126 - DNA, 20 bp, Artificial
  CRISPR gRNA sequence
gtaagtgtaactagtccttt

SEQ ID NO: 405127 - DNA, 20 bp, Artificial
  CRISPR gRNA sequence
gtcctttatcatggggattt

SEQ ID NO: 405128 - DNA, 20 bp, Artificial
  CRISPR gRNA sequence
tatcatggggatttcttatg

SEQ ID NO: 405129 - DNA, 20 bp, Artificial
  CRISPR gRNA sequence
atcatggggatttcttatgc

SEQ ID NO: 405130 - DNA, 20 bp, Artificial
  CRISPR gRNA sequence
tcatggggatttcttatgct

SEQ ID NO: 405131 - DNA, 20 bp, Artificial
  CRISPR gRNA sequence
cttatgcttgatgtgactgg

SEQ ID NO: 405132 - DNA, 20 bp, Artificial
  CRISPR gRNA sequence
ttatgcttgatgtgactggt

SEQ ID NO: 405133 - DNA, 20 bp, Artificial
  CRISPR gRNA sequence
atgcttgatgtgactggtaa

SEQ ID NO: 405134 - DNA, 20 bp, Artificial
  CRISPR gRNA sequence
tgcttgatgtgactggtaat

SEQ ID NO: 405135 - DNA, 20 bp, Artificial
  CRISPR gRNA sequence
gatgtgactggtaataacga

SEQ ID NO: 405136 - DNA, 20 bp, Artificial
  CRISPR gRNA sequence
atgtgactggtaataacgag

SEQ ID NO: 405137 - DNA, 20 bp, Artificial
  CRISPR gRNA sequence
gtaataacgaggtccctaaa

SEQ ID NO: 405138 - DNA, 20 bp, Artificial
  CRISPR gRNA sequence
aaacagtgaagattcttggt

SEQ ID NO: 405139 - DNA, 20 bp, Artificial
  CRISPR gRNA sequence
ttggtacttcctcaagtgga

SEQ ID NO: 405140 - DNA, 20 bp, Artificial
  CRISPR gRNA sequence
ggtacttcctcaagtggagt

SEQ ID NO: 405141 - DNA, 20 bp, Artificial
  CRISPR gRNA sequence
gtacttcctcaagtggagtt

SEQ ID NO: 405142 - DNA, 20 bp, Artificial
  CRISPR gRNA sequence
cctcaagtggagttttccaa

SEQ ID NO: 405143 - DNA, 20 bp, Artificial
  CRISPR gRNA sequence
ctcaagtggagttttccaaa

SEQ ID NO: 405144 - DNA, 20 bp, Artificial
  CRISPR gRNA sequence
aagtggagttttccaaagac

SEQ ID NO: 405145 - DNA, 20 bp, Artificial
  CRISPR gRNA sequence
tccaaagacaaaaatgggag

SEQ ID NO: 405146 - DNA, 20 bp, Artificial
  CRISPR gRNA sequence
ccaaagacaaaaatgggagc

SEQ ID NO: 405147 - DNA, 20 bp, Artificial
  CRISPR gRNA sequence
caaagacaaaaatgggagct

SEQ ID NO: 405148 - DNA, 20 bp, Artificial
  CRISPR gRNA sequence
gtttttaatttctaccaaaa

SEQ ID NO: 405149 - DNA, 20 bp, Artificial
  CRISPR gRNA sequence
tttttaatttctaccaaaag

SEQ ID NO: 405150 - DNA, 20 bp, Artificial
  CRISPR gRNA sequence
ttaatttctaccaaaagaaa

SEQ ID NO: 405151 - DNA, 20 bp, Artificial
  CRISPR gRNA sequence
taatttctaccaaaagaaac

SEQ ID NO: 405152 - DNA, 20 bp, Artificial
  CRISPR gRNA sequence
aatttctaccaaaagaaaca

SEQ ID NO: 405153 - DNA, 20 bp, Artificial
  CRISPR gRNA sequence
atttctaccaaaagaaacaa

SEQ ID NO: 405154 - DNA, 20 bp, Artificial
  CRISPR gRNA sequence
ctaccaaaagaaacaaagaa

SEQ ID NO: 405155 - DNA, 20 bp, Artificial
  CRISPR gRNA sequence
taccaaaagaaacaaagaaa

SEQ ID NO: 405156 - DNA, 20 bp, Artificial
  CRISPR gRNA sequence
ccaaaagaaacaaagaaaca

SEQ ID NO: 405157 - DNA, 20 bp, Artificial
  CRISPR gRNA sequence
aaattaaaaaaacccataaa

SEQ ID NO: 405158 - DNA, 20 bp, Artificial
  CRISPR gRNA sequence
aaaaaacccataaaatcccc

SEQ ID NO: 405159 - DNA, 20 bp, Artificial
  CRISPR gRNA sequence
aatcaaaacaaaaaacccgg

SEQ ID NO: 405160 - DNA, 20 bp, Artificial
  CRISPR gRNA sequence
agaataaagaatatcatgga

SEQ ID NO: 405161 - DNA, 20 bp, Artificial
  CRISPR gRNA sequence
tgccaaagagcattggataa

SEQ ID NO: 405162 - DNA, 20 bp, Artificial
  CRISPR gRNA sequence
gataaaacttggagtgtgta

SEQ ID NO: 405163 - DNA, 20 bp, Artificial
  CRISPR gRNA sequence
ggagtgtgtagatttgcatt

SEQ ID NO: 405164 - DNA, 20 bp, Artificial
  CRISPR gRNA sequence
gagtgtgtagatttgcattc

SEQ ID NO: 405165 - DNA, 20 bp, Artificial
  CRISPR gRNA sequence
gcattcttccctttgactta

SEQ ID NO: 405166 - DNA, 20 bp, Artificial
  CRISPR gRNA sequence
cattcttccctttgacttac

SEQ ID NO: 405167 - DNA, 20 bp, Artificial
  CRISPR gRNA sequence
ttccctttgacttacagtta

SEQ ID NO: 405168 - DNA, 20 bp, Artificial
  CRISPR gRNA sequence
ccctttgacttacagttact

SEQ ID NO: 405169 - DNA, 20 bp, Artificial
  CRISPR gRNA sequence
cctttgacttacagttactt

SEQ ID NO: 405170 - DNA, 20 bp, Artificial
  CRISPR gRNA sequence
tgacttacagttacttaaac

SEQ ID NO: 405171 - DNA, 20 bp, Artificial
  CRISPR gRNA sequence
gacttacagttacttaaact

SEQ ID NO: 405172 - DNA, 20 bp, Artificial
  CRISPR gRNA sequence
acttacagttacttaaactg

SEQ ID NO: 405173 - DNA, 20 bp, Artificial
  CRISPR gRNA sequence
acagttacttaaactgacta

SEQ ID NO: 405174 - DNA, 20 bp, Artificial
  CRISPR gRNA sequence
cagttacttaaactgactaa

SEQ ID NO: 405175 - DNA, 20 bp, Artificial
  CRISPR gRNA sequence
cttaaactgactaacaagga

SEQ ID NO: 405176 - DNA, 20 bp, Artificial
  CRISPR gRNA sequence
aaactgactaacaaggagac

SEQ ID NO: 405177 - DNA, 20 bp, Artificial
  CRISPR gRNA sequence
aactgactaacaaggagaca

SEQ ID NO: 405178 - DNA, 20 bp, Artificial
  CRISPR gRNA sequence
actaacaaggagacaagtga

SEQ ID NO: 405179 - DNA, 20 bp, Artificial
  CRISPR gRNA sequence
acaaggagacaagtgattta

SEQ ID NO: 405180 - DNA, 20 bp, Artificial
  CRISPR gRNA sequence
aagataatattcaaaagata

SEQ ID NO: 405181 - DNA, 20 bp, Artificial
  CRISPR gRNA sequence
agataatattcaaaagataa

SEQ ID NO: 405182 - DNA, 20 bp, Artificial
  CRISPR gRNA sequence
aaaagataaggccaatccac

SEQ ID NO: 405183 - DNA, 20 bp, Artificial
  CRISPR gRNA sequence
atgggtcttcccacagggca

SEQ ID NO: 405184 - DNA, 20 bp, Artificial
  CRISPR gRNA sequence
cccacagggcaggtgtgatg

SEQ ID NO: 405185 - DNA, 20 bp, Artificial
  CRISPR gRNA sequence
ccacagggcaggtgtgatgt

SEQ ID NO: 405186 - DNA, 20 bp, Artificial
  CRISPR gRNA sequence
tgccttgtggctcggcctgg

SEQ ID NO: 405187 - DNA, 20 bp, Artificial
  CRISPR gRNA sequence
ccttgtggctcggcctgggg

SEQ ID NO: 405188 - DNA, 20 bp, Artificial
  CRISPR gRNA sequence
gtggctcggcctgggggaag

SEQ ID NO: 405189 - DNA, 20 bp, Artificial
  CRISPR gRNA sequence
tggctcggcctgggggaagg

SEQ ID NO: 405190 - DNA, 20 bp, Artificial
  CRISPR gRNA sequence
ggcctgggggaaggaggaca

SEQ ID NO: 405191 - DNA, 20 bp, Artificial
  CRISPR gRNA sequence
ggggaaggaggacagccacc

SEQ ID NO: 405192 - DNA, 20 bp, Artificial
  CRISPR gRNA sequence
attaaagagattgggtagga

SEQ ID NO: 405193 - DNA, 20 bp, Artificial
  CRISPR gRNA sequence
ttaaagagattgggtaggaa

SEQ ID NO: 405194 - DNA, 20 bp, Artificial
  CRISPR gRNA sequence
aagagattgggtaggaaggt

SEQ ID NO: 405195 - DNA, 20 bp, Artificial
  CRISPR gRNA sequence
ggtaggaaggttaaaagatg

SEQ ID NO: 405196 - DNA, 20 bp, Artificial
  CRISPR gRNA sequence
aaagatgtggtgccctctta

SEQ ID NO: 405197 - DNA, 20 bp, Artificial
  CRISPR gRNA sequence
ttatatgactaagaagtcat

SEQ ID NO: 405198 - DNA, 20 bp, Artificial
  CRISPR gRNA sequence
atatgactaagaagtcattc

SEQ ID NO: 405199 - DNA, 20 bp, Artificial
  CRISPR gRNA sequence
tatgactaagaagtcattcc

SEQ ID NO: 405200 - DNA, 20 bp, Artificial
  CRISPR gRNA sequence
agaagtcattccttctgtgg

SEQ ID NO: 405201 - DNA, 20 bp, Artificial
  CRISPR gRNA sequence
cttctgtggagatgcttaca

SEQ ID NO: 405202 - DNA, 20 bp, Artificial
  CRISPR gRNA sequence
ctgtggagatgcttacaatc

SEQ ID NO: 405203 - DNA, 20 bp, Artificial
  CRISPR gRNA sequence
tgtggagatgcttacaatcc

SEQ ID NO: 405204 - DNA, 20 bp, Artificial
  CRISPR gRNA sequence
tggagatgcttacaatccaa

SEQ ID NO: 405205 - DNA, 20 bp, Artificial
  CRISPR gRNA sequence
acaatccaatggcccaataa

SEQ ID NO: 405206 - DNA, 20 bp, Artificial
  CRISPR gRNA sequence
caatccaatggcccaataag

SEQ ID NO: 405207 - DNA, 20 bp, Artificial
  CRISPR gRNA sequence
gcttctcacagagatggcca

SEQ ID NO: 405208 - DNA, 20 bp, Artificial
  CRISPR gRNA sequence
ctcacagagatggccagagt

SEQ ID NO: 405209 - DNA, 20 bp, Artificial
  CRISPR gRNA sequence
tcacagagatggccagagtg

SEQ ID NO: 405210 - DNA, 20 bp, Artificial
  CRISPR gRNA sequence
acagagatggccagagtgca

SEQ ID NO: 405211 - DNA, 20 bp, Artificial
  CRISPR gRNA sequence
cgcccccaaagctggcgaag

SEQ ID NO: 405212 - DNA, 20 bp, Artificial
  CRISPR gRNA sequence
gcgaagcttcccagatgatc

SEQ ID NO: 405213 - DNA, 20 bp, Artificial
  CRISPR gRNA sequence
cccagatgatcccatgcgag

SEQ ID NO: 405214 - DNA, 20 bp, Artificial
  CRISPR gRNA sequence
ccagatgatcccatgcgagg

SEQ ID NO: 405215 - DNA, 20 bp, Artificial
  CRISPR gRNA sequence
cagggtttgaggatctcagc

SEQ ID NO: 405216 - DNA, 20 bp, Artificial
  CRISPR gRNA sequence
agggtttgaggatctcagca

SEQ ID NO: 405217 - DNA, 20 bp, Artificial
  CRISPR gRNA sequence
gaggatctcagcagacagaa

SEQ ID NO: 405218 - DNA, 20 bp, Artificial
  CRISPR gRNA sequence
aggatctcagcagacagaac

SEQ ID NO: 405219 - DNA, 20 bp, Artificial
  CRISPR gRNA sequence
agcagacagaacaacctgca

SEQ ID NO: 405220 - DNA, 20 bp, Artificial
  CRISPR gRNA sequence
cacggggcatggaggcgtgg

SEQ ID NO: 405221 - DNA, 20 bp, Artificial
  CRISPR gRNA sequence
gagtggtggtgattaatggt

SEQ ID NO: 405222 - DNA, 20 bp, Artificial
  CRISPR gRNA sequence
atggtggtgattgtggggca

SEQ ID NO: 405223 - DNA, 20 bp, Artificial
  CRISPR gRNA sequence
tggggcatggacagatgtag

SEQ ID NO: 405224 - DNA, 20 bp, Artificial
  CRISPR gRNA sequence
agagagagattatacttgca

SEQ ID NO: 405225 - DNA, 20 bp, Artificial
  CRISPR gRNA sequence
gagagagattatacttgcat

SEQ ID NO: 405226 - DNA, 20 bp, Artificial
  CRISPR gRNA sequence
tacttgcatgagtgtaagaa

SEQ ID NO: 405227 - DNA, 20 bp, Artificial
  CRISPR gRNA sequence
gcatgagtgtaagaagctcc

SEQ ID NO: 405228 - DNA, 20 bp, Artificial
  CRISPR gRNA sequence
catgagtgtaagaagctcca

SEQ ID NO: 405229 - DNA, 20 bp, Artificial
  CRISPR gRNA sequence
caagtattgaaactggtttg

SEQ ID NO: 405230 - DNA, 20 bp, Artificial
  CRISPR gRNA sequence
aaactggtttgcaagcagag

SEQ ID NO: 405231 - DNA, 20 bp, Artificial
  CRISPR gRNA sequence
gtttgcaagcagagaggtcc

SEQ ID NO: 405232 - DNA, 20 bp, Artificial
  CRISPR gRNA sequence
gcaagcagagaggtccatga

SEQ ID NO: 405233 - DNA, 20 bp, Artificial
  CRISPR gRNA sequence
caagcagagaggtccatgat

SEQ ID NO: 405234 - DNA, 20 bp, Artificial
  CRISPR gRNA sequence
acatttgggaagaattgccc

SEQ ID NO: 405235 - DNA, 20 bp, Artificial
  CRISPR gRNA sequence
catttgggaagaattgccct

SEQ ID NO: 405236 - DNA, 20 bp, Artificial
  CRISPR gRNA sequence
gggaagaattgccctcccag

SEQ ID NO: 405237 - DNA, 20 bp, Artificial
  CRISPR gRNA sequence
ggaagaattgccctcccaga

SEQ ID NO: 405238 - DNA, 20 bp, Artificial
  CRISPR gRNA sequence
ccctcccagaggaaacattg

SEQ ID NO: 405239 - DNA, 20 bp, Artificial
  CRISPR gRNA sequence
ccagaggaaacattgggtat

SEQ ID NO: 405240 - DNA, 20 bp, Artificial
  CRISPR gRNA sequence
ggtataagttttcattgcct

SEQ ID NO: 405241 - DNA, 20 bp, Artificial
  CRISPR gRNA sequence
tcattgcctcggcatgaaga

SEQ ID NO: 405242 - DNA, 20 bp, Artificial
  CRISPR gRNA sequence
cattgcctcggcatgaagaa

SEQ ID NO: 405243 - DNA, 20 bp, Artificial
  CRISPR gRNA sequence
attgcctcggcatgaagaac

SEQ ID NO: 405244 - DNA, 20 bp, Artificial
  CRISPR gRNA sequence
cctcggcatgaagaactgag

SEQ ID NO: 405245 - DNA, 20 bp, Artificial
  CRISPR gRNA sequence
ggcatgaagaactgagcaat

SEQ ID NO: 405246 - DNA, 20 bp, Artificial
  CRISPR gRNA sequence
agcaattgcgtcctgtgacg

SEQ ID NO: 405247 - DNA, 20 bp, Artificial
  CRISPR gRNA sequence
cgtcctgtgacggcagtgac

SEQ ID NO: 405248 - DNA, 20 bp, Artificial
  CRISPR gRNA sequence
tgacggcagtgacctgcaga

SEQ ID NO: 405249 - DNA, 20 bp, Artificial
  CRISPR gRNA sequence
cagatgggaaaaagacaaat

SEQ ID NO: 405250 - DNA, 20 bp, Artificial
  CRISPR gRNA sequence
agttgtgctgcataagcgag

SEQ ID NO: 405251 - DNA, 20 bp, Artificial
  CRISPR gRNA sequence
tgctgcataagcgagatgac

SEQ ID NO: 405252 - DNA, 20 bp, Artificial
  CRISPR gRNA sequence
cataagcgagatgacttttt

SEQ ID NO: 405253 - DNA, 20 bp, Artificial
  CRISPR gRNA sequence
ttttgtataaaggattccag

SEQ ID NO: 405254 - DNA, 20 bp, Artificial
  CRISPR gRNA sequence
tttgtataaaggattccaga

SEQ ID NO: 405255 - DNA, 20 bp, Artificial
  CRISPR gRNA sequence
ttgtataaaggattccagaa

SEQ ID NO: 405256 - DNA, 20 bp, Artificial
  CRISPR gRNA sequence
tgtataaaggattccagaat

SEQ ID NO: 405257 - DNA, 20 bp, Artificial
  CRISPR gRNA sequence
gtataaaggattccagaatt

SEQ ID NO: 405258 - DNA, 20 bp, Artificial
  CRISPR gRNA sequence
tataaaggattccagaatta

SEQ ID NO: 405259 - DNA, 20 bp, Artificial
  CRISPR gRNA sequence
cagaattaataatttgtagt

SEQ ID NO: 405260 - DNA, 20 bp, Artificial
  CRISPR gRNA sequence
ataatttgtagttatcattt

SEQ ID NO: 405261 - DNA, 20 bp, Artificial
  CRISPR gRNA sequence
gtagttatcattttagggaa

SEQ ID NO: 405262 - DNA, 20 bp, Artificial
  CRISPR gRNA sequence
tagttatcattttagggaac

SEQ ID NO: 405263 - DNA, 20 bp, Artificial
  CRISPR gRNA sequence
tcattttagggaacatgttg

SEQ ID NO: 405264 - DNA, 20 bp, Artificial
  CRISPR gRNA sequence
tagggaacatgttgtgctag

SEQ ID NO: 405265 - DNA, 20 bp, Artificial
  CRISPR gRNA sequence
agggaacatgttgtgctaga

SEQ ID NO: 405266 - DNA, 20 bp, Artificial
  CRISPR gRNA sequence
gggaacatgttgtgctagat

SEQ ID NO: 405267 - DNA, 20 bp, Artificial
  CRISPR gRNA sequence
tgctagatgctattcatcta

SEQ ID NO: 405268 - DNA, 20 bp, Artificial
  CRISPR gRNA sequence
gatgctattcatctactatt

SEQ ID NO: 405269 - DNA, 20 bp, Artificial
  CRISPR gRNA sequence
ttcatctactatttgggtac

SEQ ID NO: 405270 - DNA, 20 bp, Artificial
  CRISPR gRNA sequence
atctactatttgggtacgta

SEQ ID NO: 405271 - DNA, 20 bp, Artificial
  CRISPR gRNA sequence
ctatttgggtacgtaagttt

SEQ ID NO: 405272 - DNA, 20 bp, Artificial
  CRISPR gRNA sequence
tttgggtacgtaagttttta

SEQ ID NO: 405273 - DNA, 20 bp, Artificial
  CRISPR gRNA sequence
gggtacgtaagtttttattt

SEQ ID NO: 405274 - DNA, 20 bp, Artificial
  CRISPR gRNA sequence
ggtacgtaagtttttatttt

SEQ ID NO: 405275 - DNA, 20 bp, Artificial
  CRISPR gRNA sequence
ttatttttgttcttttaagg

SEQ ID NO: 405276 - DNA, 20 bp, Artificial
  CRISPR gRNA sequence
tatttttgttcttttaagga

SEQ ID NO: 405277 - DNA, 20 bp, Artificial
  CRISPR gRNA sequence
atttttgttcttttaaggaa

SEQ ID NO: 405278 - DNA, 20 bp, Artificial
  CRISPR gRNA sequence
tttttgttcttttaaggaac

SEQ ID NO: 405279 - DNA, 20 bp, Artificial
  CRISPR gRNA sequence
ttgttcttttaaggaactca

SEQ ID NO: 405280 - DNA, 20 bp, Artificial
  CRISPR gRNA sequence
tgttcttttaaggaactcag

SEQ ID NO: 405281 - DNA, 20 bp, Artificial
  CRISPR gRNA sequence
gttcttttaaggaactcagt

SEQ ID NO: 405282 - DNA, 20 bp, Artificial
  CRISPR gRNA sequence
ttcttttaaggaactcagtc

SEQ ID NO: 405283 - DNA, 20 bp, Artificial
  CRISPR gRNA sequence
ttttaaggaactcagtcaaa

SEQ ID NO: 405284 - DNA, 20 bp, Artificial
  CRISPR gRNA sequence
ttaaggaactcagtcaaatt

SEQ ID NO: 405285 - DNA, 20 bp, Artificial
  CRISPR gRNA sequence
taaggaactcagtcaaattt

SEQ ID NO: 405286 - DNA, 20 bp, Artificial
  CRISPR gRNA sequence
aaggaactcagtcaaatttc

SEQ ID NO: 405287 - DNA, 20 bp, Artificial
  CRISPR gRNA sequence
aggaactcagtcaaatttct

SEQ ID NO: 405288 - DNA, 20 bp, Artificial
  CRISPR gRNA sequence
agtcaaatttctgtgttcaa

SEQ ID NO: 405289 - DNA, 20 bp, Artificial
  CRISPR gRNA sequence
ctgtgttcaaatactgactc

SEQ ID NO: 405290 - DNA, 20 bp, Artificial
  CRISPR gRNA sequence
tgtgttcaaatactgactct

SEQ ID NO: 405291 - DNA, 20 bp, Artificial
  CRISPR gRNA sequence
tgttcaaatactgactctgt

SEQ ID NO: 405292 - DNA, 20 bp, Artificial
  CRISPR gRNA sequence
aaatactgactctgtcttcg

SEQ ID NO: 405293 - DNA, 20 bp, Artificial
  CRISPR gRNA sequence
actctgtcttcgctagtcat

SEQ ID NO: 405294 - DNA, 20 bp, Artificial
  CRISPR gRNA sequence
tgtcttcgctagtcataacc

SEQ ID NO: 405295 - DNA, 20 bp, Artificial
  CRISPR gRNA sequence
tcttcgctagtcataaccct

SEQ ID NO: 405296 - DNA, 20 bp, Artificial
  CRISPR gRNA sequence
cgctagtcataacccttgtt

SEQ ID NO: 405297 - DNA, 20 bp, Artificial
  CRISPR gRNA sequence
gctagtcataacccttgtta

SEQ ID NO: 405298 - DNA, 20 bp, Artificial
  CRISPR gRNA sequence
gtcataacccttgttacaat

SEQ ID NO: 405299 - DNA, 20 bp, Artificial
  CRISPR gRNA sequence
gttacaatatctttaaaatg

SEQ ID NO: 405300 - DNA, 20 bp, Artificial
  CRISPR gRNA sequence
ttacaatatctttaaaatga

SEQ ID NO: 405301 - DNA, 20 bp, Artificial
  CRISPR gRNA sequence
caatatctttaaaatgagag

SEQ ID NO: 405302 - DNA, 20 bp, Artificial
  CRISPR gRNA sequence
taaaatgagagtcataataa

SEQ ID NO: 405303 - DNA, 20 bp, Artificial
  CRISPR gRNA sequence
aaaatgagagtcataataac

SEQ ID NO: 405304 - DNA, 20 bp, Artificial
  CRISPR gRNA sequence
aaatgagagtcataataaca

SEQ ID NO: 405305 - DNA, 20 bp, Artificial
  CRISPR gRNA sequence
aaatgaaaggtgagattcaa

SEQ ID NO: 405306 - DNA, 20 bp, Artificial
  CRISPR gRNA sequence
aataaacatccgctgcaaag

SEQ ID NO: 405307 - DNA, 20 bp, Artificial
  CRISPR gRNA sequence
caaagtgtttatcacacatc

SEQ ID NO: 405308 - DNA, 20 bp, Artificial
  CRISPR gRNA sequence
atcacacatcgtgcctcatt

SEQ ID NO: 405309 - DNA, 20 bp, Artificial
  CRISPR gRNA sequence
tcacacatcgtgcctcatta

SEQ ID NO: 405310 - DNA, 20 bp, Artificial
  CRISPR gRNA sequence
attataaatacttagtatat

SEQ ID NO: 405311 - DNA, 20 bp, Artificial
  CRISPR gRNA sequence
taaatacttagtatatatta

SEQ ID NO: 405312 - DNA, 20 bp, Artificial
  CRISPR gRNA sequence
agtatatattaaatttttta

SEQ ID NO: 405313 - DNA, 20 bp, Artificial
  CRISPR gRNA sequence
gtatatattaaattttttat

SEQ ID NO: 405314 - DNA, 20 bp, Artificial
  CRISPR gRNA sequence
aattttttattatgattaat

SEQ ID NO: 405315 - DNA, 20 bp, Artificial
  CRISPR gRNA sequence
tttattatgattaattggcc

SEQ ID NO: 405316 - DNA, 20 bp, Artificial
  CRISPR gRNA sequence
ttattatgattaattggccc

SEQ ID NO: 405317 - DNA, 20 bp, Artificial
  CRISPR gRNA sequence
tattatgattaattggccca

SEQ ID NO: 405318 - DNA, 20 bp, Artificial
  CRISPR gRNA sequence
attatgattaattggcccaa

SEQ ID NO: 405319 - DNA, 20 bp, Artificial
  CRISPR gRNA sequence
ttatgattaattggcccaaa

SEQ ID NO: 405320 - DNA, 20 bp, Artificial
  CRISPR gRNA sequence
tgattaattggcccaaataa

SEQ ID NO: 405321 - DNA, 20 bp, Artificial
  CRISPR gRNA sequence
attggcccaaataacaacat

SEQ ID NO: 405322 - DNA, 20 bp, Artificial
  CRISPR gRNA sequence
gcccaaataacaacatatag

SEQ ID NO: 405323 - DNA, 20 bp, Artificial
  CRISPR gRNA sequence
tttttcttttgaggagtaat

SEQ ID NO: 405324 - DNA, 20 bp, Artificial
  CRISPR gRNA sequence
ttcttttgaggagtaattgt

SEQ ID NO: 405325 - DNA, 20 bp, Artificial
  CRISPR gRNA sequence
tcttttgaggagtaattgta

SEQ ID NO: 405326 - DNA, 20 bp, Artificial
  CRISPR gRNA sequence
cttttgaggagtaattgtaa

SEQ ID NO: 405327 - DNA, 20 bp, Artificial
  CRISPR gRNA sequence
ttttgaggagtaattgtaag

SEQ ID NO: 405328 - DNA, 20 bp, Artificial
  CRISPR gRNA sequence
ttgaggagtaattgtaagta

SEQ ID NO: 405329 - DNA, 20 bp, Artificial
  CRISPR gRNA sequence
tgaggagtaattgtaagtac

SEQ ID NO: 405330 - DNA, 20 bp, Artificial
  CRISPR gRNA sequence
gaggagtaattgtaagtact

SEQ ID NO: 405331 - DNA, 20 bp, Artificial
  CRISPR gRNA sequence
aggagtaattgtaagtacta

SEQ ID NO: 405332 - DNA, 20 bp, Artificial
  CRISPR gRNA sequence
taagtactactgggtataaa

SEQ ID NO: 405333 - DNA, 20 bp, Artificial
  CRISPR gRNA sequence
ctgggtataaagaaaaatac

SEQ ID NO: 405334 - DNA, 20 bp, Artificial
  CRISPR gRNA sequence
ggtataaagaaaaatacaga

SEQ ID NO: 405335 - DNA, 20 bp, Artificial
  CRISPR gRNA sequence
tcatgtaagtaaaaaggaga

SEQ ID NO: 405336 - DNA, 20 bp, Artificial
  CRISPR gRNA sequence
catgtaagtaaaaaggagaa

SEQ ID NO: 405337 - DNA, 20 bp, Artificial
  CRISPR gRNA sequence
atgtaagtaaaaaggagaag

SEQ ID NO: 405338 - DNA, 20 bp, Artificial
  CRISPR gRNA sequence
tcttatataaaaatgaagaa

SEQ ID NO: 405339 - DNA, 20 bp, Artificial
  CRISPR gRNA sequence
cttatataaaaatgaagaaa

SEQ ID NO: 405340 - DNA, 20 bp, Artificial
  CRISPR gRNA sequence
ttatataaaaatgaagaaat

SEQ ID NO: 405341 - DNA, 20 bp, Artificial
  CRISPR gRNA sequence
atataaaaatgaagaaatga

SEQ ID NO: 405342 - DNA, 20 bp, Artificial
  CRISPR gRNA sequence
tataaaaatgaagaaatgaa

SEQ ID NO: 405343 - DNA, 20 bp, Artificial
  CRISPR gRNA sequence
gtgaggcaataagtgattct

SEQ ID NO: 405344 - DNA, 20 bp, Artificial
  CRISPR gRNA sequence
tatattataaactccatgaa

SEQ ID NO: 405345 - DNA, 20 bp, Artificial
  CRISPR gRNA sequence
tattataaactccatgaagc

SEQ ID NO: 405346 - DNA, 20 bp, Artificial
  CRISPR gRNA sequence
taaactccatgaagcattgt

SEQ ID NO: 405347 - DNA, 20 bp, Artificial
  CRISPR gRNA sequence
catgaagcattgtttttatc

SEQ ID NO: 405348 - DNA, 20 bp, Artificial
  CRISPR gRNA sequence
tttttatcttgtatataaat

SEQ ID NO: 405349 - DNA, 20 bp, Artificial
  CRISPR gRNA sequence
ttatcttgtatataaatgga

SEQ ID NO: 405350 - DNA, 20 bp, Artificial
  CRISPR gRNA sequence
tatcttgtatataaatggac

SEQ ID NO: 405351 - DNA, 20 bp, Artificial
  CRISPR gRNA sequence
atcttgtatataaatggaca

SEQ ID NO: 405352 - DNA, 20 bp, Artificial
  CRISPR gRNA sequence
tcttgtatataaatggacat

SEQ ID NO: 405353 - DNA, 20 bp, Artificial
  CRISPR gRNA sequence
gtatataaatggacatttca

SEQ ID NO: 405354 - DNA, 20 bp, Artificial
  CRISPR gRNA sequence
tatataaatggacatttcaa

SEQ ID NO: 405355 - DNA, 20 bp, Artificial
  CRISPR gRNA sequence
caaggcagtaggggatggat

SEQ ID NO: 405356 - DNA, 20 bp, Artificial
  CRISPR gRNA sequence
aaggcagtaggggatggatt

SEQ ID NO: 405357 - DNA, 20 bp, Artificial
  CRISPR gRNA sequence
tctatggaaaattcctgttt

SEQ ID NO: 405358 - DNA, 20 bp, Artificial
  CRISPR gRNA sequence
ctatggaaaattcctgtttc

SEQ ID NO: 405359 - DNA, 20 bp, Artificial
  CRISPR gRNA sequence
tatggaaaattcctgtttca

SEQ ID NO: 405360 - DNA, 20 bp, Artificial
  CRISPR gRNA sequence
tggaaaattcctgtttcata

SEQ ID NO: 405361 - DNA, 20 bp, Artificial
  CRISPR gRNA sequence
ctgtttcataatgtgaagaa

SEQ ID NO: 405362 - DNA, 20 bp, Artificial
  CRISPR gRNA sequence
tttcataatgtgaagaacaa

SEQ ID NO: 405363 - DNA, 20 bp, Artificial
  CRISPR gRNA sequence
cataatgtgaagaacaaaga

SEQ ID NO: 405364 - DNA, 20 bp, Artificial
  CRISPR gRNA sequence
ataatgtgaagaacaaagag

SEQ ID NO: 405365 - DNA, 20 bp, Artificial
  CRISPR gRNA sequence
tagtctttttatcaaagcaa

SEQ ID NO: 405366 - DNA, 20 bp, Artificial
  CRISPR gRNA sequence
gtctttttatcaaagcaaat

SEQ ID NO: 405367 - DNA, 20 bp, Artificial
  CRISPR gRNA sequence
tttatcaaagcaaatggaag

SEQ ID NO: 405368 - DNA, 20 bp, Artificial
  CRISPR gRNA sequence
ttatcaaagcaaatggaagt

SEQ ID NO: 405369 - DNA, 20 bp, Artificial
  CRISPR gRNA sequence
tatcaaagcaaatggaagta

SEQ ID NO: 405370 - DNA, 20 bp, Artificial
  CRISPR gRNA sequence
atcaaagcaaatggaagtag

SEQ ID NO: 405371 - DNA, 20 bp, Artificial
  CRISPR gRNA sequence
tcaaagcaaatggaagtaga

SEQ ID NO: 405372 - DNA, 20 bp, Artificial
  CRISPR gRNA sequence
atttgtaatatcttccccag

SEQ ID NO: 405373 - DNA, 20 bp, Artificial
  CRISPR gRNA sequence
gtaatatcttccccaggaaa

SEQ ID NO: 405374 - DNA, 20 bp, Artificial
  CRISPR gRNA sequence
taatatcttccccaggaaag

SEQ ID NO: 405375 - DNA, 20 bp, Artificial
  CRISPR gRNA sequence
ccccaggaaagcaaagcagt

SEQ ID NO: 405376 - DNA, 20 bp, Artificial
  CRISPR gRNA sequence
cccaggaaagcaaagcagtt

SEQ ID NO: 405377 - DNA, 20 bp, Artificial
  CRISPR gRNA sequence
aaaaaatatcttcagttttt

SEQ ID NO: 405378 - DNA, 20 bp, Artificial
  CRISPR gRNA sequence
aaaaatatcttcagtttttc

SEQ ID NO: 405379 - DNA, 20 bp, Artificial
  CRISPR gRNA sequence
cagtttttcctgtttctatt

SEQ ID NO: 405380 - DNA, 20 bp, Artificial
  CRISPR gRNA sequence
agtttttcctgtttctattt

SEQ ID NO: 405381 - DNA, 20 bp, Artificial
  CRISPR gRNA sequence
ttcctgtttctatttttggg

SEQ ID NO: 405382 - DNA, 20 bp, Artificial
  CRISPR gRNA sequence
tcctgtttctatttttgggt

SEQ ID NO: 405383 - DNA, 20 bp, Artificial
  CRISPR gRNA sequence
cctgtttctatttttgggtt

SEQ ID NO: 405384 - DNA, 20 bp, Artificial
  CRISPR gRNA sequence
ctgtttctatttttgggttt

SEQ ID NO: 405385 - DNA, 20 bp, Artificial
  CRISPR gRNA sequence
tttctatttttgggtttgag

SEQ ID NO: 405386 - DNA, 20 bp, Artificial
  CRISPR gRNA sequence
ctatttttgggtttgagcct

SEQ ID NO: 405387 - DNA, 20 bp, Artificial
  CRISPR gRNA sequence
tatttttgggtttgagcctg

SEQ ID NO: 405388 - DNA, 20 bp, Artificial
  CRISPR gRNA sequence
tttttgggtttgagcctgtg

SEQ ID NO: 405389 - DNA, 20 bp, Artificial
  CRISPR gRNA sequence
ttgggtttgagcctgtgtag

SEQ ID NO: 405390 - DNA, 20 bp, Artificial
  CRISPR gRNA sequence
tgggtttgagcctgtgtaga

SEQ ID NO: 405391 - DNA, 20 bp, Artificial
  CRISPR gRNA sequence
gggtttgagcctgtgtagag

SEQ ID NO: 405392 - DNA, 20 bp, Artificial
  CRISPR gRNA sequence
ggtttgagcctgtgtagaga

SEQ ID NO: 405393 - DNA, 20 bp, Artificial
  CRISPR gRNA sequence
gagcctgtgtagagagtgac

SEQ ID NO: 405394 - DNA, 20 bp, Artificial
  CRISPR gRNA sequence
agcctgtgtagagagtgaca

SEQ ID NO: 405395 - DNA, 20 bp, Artificial
  CRISPR gRNA sequence
tgtagagagtgacaacaagg

SEQ ID NO: 405396 - DNA, 20 bp, Artificial
  CRISPR gRNA sequence
ggcatggtggctcacacctg

SEQ ID NO: 405397 - DNA, 20 bp, Artificial
  CRISPR gRNA sequence
acacctgtaatcccagcact

SEQ ID NO: 405398 - DNA, 20 bp, Artificial
  CRISPR gRNA sequence
taatcccagcactttgggag

SEQ ID NO: 405399 - DNA, 20 bp, Artificial
  CRISPR gRNA sequence
tgggaggctgaggcaggcag

SEQ ID NO: 405400 - DNA, 20 bp, Artificial
  CRISPR gRNA sequence
gggaggctgaggcaggcaga

SEQ ID NO: 405401 - DNA, 20 bp, Artificial
  CRISPR gRNA sequence
ggaggctgaggcaggcagat

SEQ ID NO: 405402 - DNA, 20 bp, Artificial
  CRISPR gRNA sequence
aggcaggcagatcccttgat

SEQ ID NO: 405403 - DNA, 20 bp, Artificial
  CRISPR gRNA sequence
gatcctagagttcgagacca

SEQ ID NO: 405404 - DNA, 20 bp, Artificial
  CRISPR gRNA sequence
atcctagagttcgagaccag

SEQ ID NO: 405405 - DNA, 20 bp, Artificial
  CRISPR gRNA sequence
gagttcgagaccagcctggg

SEQ ID NO: 405406 - DNA, 20 bp, Artificial
  CRISPR gRNA sequence
gagaccagcctgggcaactt

SEQ ID NO: 405407 - DNA, 20 bp, Artificial
  CRISPR gRNA sequence
ggcaacttggcaaaaccctg

SEQ ID NO: 405408 - DNA, 20 bp, Artificial
  CRISPR gRNA sequence
ggcaaaaccctgttgctaca

SEQ ID NO: 405409 - DNA, 20 bp, Artificial
  CRISPR gRNA sequence
gcaaaaccctgttgctacaa

SEQ ID NO: 405410 - DNA, 20 bp, Artificial
  CRISPR gRNA sequence
ttgctacaaaaaaatataaa

SEQ ID NO: 405411 - DNA, 20 bp, Artificial
  CRISPR gRNA sequence
ctacaaaaaaatataaaaat

SEQ ID NO: 405412 - DNA, 20 bp, Artificial
  CRISPR gRNA sequence
caaaaaaatataaaaattag

SEQ ID NO: 405413 - DNA, 20 bp, Artificial
  CRISPR gRNA sequence
gctgagtgtggtggcacatg

SEQ ID NO: 405414 - DNA, 20 bp, Artificial
  CRISPR gRNA sequence
agtgtggtggcacatgtctg

SEQ ID NO: 405415 - DNA, 20 bp, Artificial
  CRISPR gRNA sequence
ttgtcccagctacttaggag

SEQ ID NO: 405416 - DNA, 20 bp, Artificial
  CRISPR gRNA sequence
tcccagctacttaggaggct

SEQ ID NO: 405417 - DNA, 20 bp, Artificial
  CRISPR gRNA sequence
cttaggaggctgaggtggga

SEQ ID NO: 405418 - DNA, 20 bp, Artificial
  CRISPR gRNA sequence
aggaggctgaggtgggatga

SEQ ID NO: 405419 - DNA, 20 bp, Artificial
  CRISPR gRNA sequence
ggaggctgaggtgggatgat

SEQ ID NO: 405420 - DNA, 20 bp, Artificial
  CRISPR gRNA sequence
aggtgggatgatggtttgat

SEQ ID NO: 405421 - DNA, 20 bp, Artificial
  CRISPR gRNA sequence
gatcctgaaaggtcggggct

SEQ ID NO: 405422 - DNA, 20 bp, Artificial
  CRISPR gRNA sequence
atcctgaaaggtcggggctt

SEQ ID NO: 405423 - DNA, 20 bp, Artificial
  CRISPR gRNA sequence
aaaggtcggggcttcagtga

SEQ ID NO: 405424 - DNA, 20 bp, Artificial
  CRISPR gRNA sequence
cagtgacctgtgattgctca

SEQ ID NO: 405425 - DNA, 20 bp, Artificial
  CRISPR gRNA sequence
agtgacctgtgattgctcat

SEQ ID NO: 405426 - DNA, 20 bp, Artificial
  CRISPR gRNA sequence
tgattgctcatgggcaatag

SEQ ID NO: 405427 - DNA, 20 bp, Artificial
  CRISPR gRNA sequence
ctcatgggcaatagagcgag

SEQ ID NO: 405428 - DNA, 20 bp, Artificial
  CRISPR gRNA sequence
atgggcaatagagcgagacc

SEQ ID NO: 405429 - DNA, 20 bp, Artificial
  CRISPR gRNA sequence
gtctttggaaaaaaaaaaaa

SEQ ID NO: 405430 - DNA, 20 bp, Artificial
  CRISPR gRNA sequence
tctttggaaaaaaaaaaaaa

SEQ ID NO: 405431 - DNA, 20 bp, Artificial
  CRISPR gRNA sequence
tggaaaaaaaaaaaaaaaag

SEQ ID NO: 405432 - DNA, 20 bp, Artificial
  CRISPR gRNA sequence
ggaaaaaaaaaaaaaaaaga

SEQ ID NO: 405433 - DNA, 20 bp, Artificial
  CRISPR gRNA sequence
gaaaaaaaaaaaaaaaagag

SEQ ID NO: 405434 - DNA, 20 bp, Artificial
  CRISPR gRNA sequence
atgcttcttatagtaaccga

SEQ ID NO: 405435 - DNA, 20 bp, Artificial
  CRISPR gRNA sequence
cttatagtaaccgactcttt

SEQ ID NO: 405436 - DNA, 20 bp, Artificial
  CRISPR gRNA sequence
ttatagtaaccgactctttt

SEQ ID NO: 405437 - DNA, 20 bp, Artificial
  CRISPR gRNA sequence
atagtaaccgactctttttt

SEQ ID NO: 405438 - DNA, 20 bp, Artificial
  CRISPR gRNA sequence
tagtaaccgactcttttttg

SEQ ID NO: 405439 - DNA, 20 bp, Artificial
  CRISPR gRNA sequence
ttttttgaaataacttcatt

SEQ ID NO: 405440 - DNA, 20 bp, Artificial
  CRISPR gRNA sequence
ttttgaaataacttcattta

SEQ ID NO: 405441 - DNA, 20 bp, Artificial
  CRISPR gRNA sequence
tttgaaataacttcatttaa

SEQ ID NO: 405442 - DNA, 20 bp, Artificial
  CRISPR gRNA sequence
ttgaaataacttcatttaaa

SEQ ID NO: 405443 - DNA, 20 bp, Artificial
  CRISPR gRNA sequence
tgaaataacttcatttaaaa

SEQ ID NO: 405444 - DNA, 20 bp, Artificial
  CRISPR gRNA sequence
gaaataacttcatttaaaaa

SEQ ID NO: 405445 - DNA, 20 bp, Artificial
  CRISPR gRNA sequence
aaataacttcatttaaaaaa

SEQ ID NO: 405446 - DNA, 20 bp, Artificial
  CRISPR gRNA sequence
catttaaaaaatcctcattc

SEQ ID NO: 405447 - DNA, 20 bp, Artificial
  CRISPR gRNA sequence
atttaaaaaatcctcattcg

SEQ ID NO: 405448 - DNA, 20 bp, Artificial
  CRISPR gRNA sequence
aaaaaatcctcattcggtgt

SEQ ID NO: 405449 - DNA, 20 bp, Artificial
  CRISPR gRNA sequence
aaaaatcctcattcggtgtt

SEQ ID NO: 405450 - DNA, 20 bp, Artificial
  CRISPR gRNA sequence
attcggtgtttggtactgtt

SEQ ID NO: 405451 - DNA, 20 bp, Artificial
  CRISPR gRNA sequence
ggtgtttggtactgttcagt

SEQ ID NO: 405452 - DNA, 20 bp, Artificial
  CRISPR gRNA sequence
ggtactgttcagtaaatcac

SEQ ID NO: 405453 - DNA, 20 bp, Artificial
  CRISPR gRNA sequence
gtactgttcagtaaatcaca

SEQ ID NO: 405454 - DNA, 20 bp, Artificial
  CRISPR gRNA sequence
ttcagtaaatcacatctctt

SEQ ID NO: 405455 - DNA, 20 bp, Artificial
  CRISPR gRNA sequence
agtaaatcacatctcttggt

SEQ ID NO: 405456 - DNA, 20 bp, Artificial
  CRISPR gRNA sequence
ttggtactagtatttatgac

SEQ ID NO: 405457 - DNA, 20 bp, Artificial
  CRISPR gRNA sequence
ggtactagtatttatgactc

SEQ ID NO: 405458 - DNA, 20 bp, Artificial
  CRISPR gRNA sequence
gtactagtatttatgactca

SEQ ID NO: 405459 - DNA, 20 bp, Artificial
  CRISPR gRNA sequence
gtatttatgactcagtcatg

SEQ ID NO: 405460 - DNA, 20 bp, Artificial
  CRISPR gRNA sequence
atgactcagtcatgataaac

SEQ ID NO: 405461 - DNA, 20 bp, Artificial
  CRISPR gRNA sequence
tgactcagtcatgataaaca

SEQ ID NO: 405462 - DNA, 20 bp, Artificial
  CRISPR gRNA sequence
agtcatgataaacaatttgc

SEQ ID NO: 405463 - DNA, 20 bp, Artificial
  CRISPR gRNA sequence
gccttgtcagacttaataac

SEQ ID NO: 405464 - DNA, 20 bp, Artificial
  CRISPR gRNA sequence
ccttgtcagacttaataacc

SEQ ID NO: 405465 - DNA, 20 bp, Artificial
  CRISPR gRNA sequence
gtcagacttaataaccctgg

SEQ ID NO: 405466 - DNA, 20 bp, Artificial
  CRISPR gRNA sequence
tcagacttaataaccctggc

SEQ ID NO: 405467 - DNA, 20 bp, Artificial
  CRISPR gRNA sequence
aataaccctggcctgcattg

SEQ ID NO: 405468 - DNA, 20 bp, Artificial
  CRISPR gRNA sequence
ataaccctggcctgcattgt

SEQ ID NO: 405469 - DNA, 20 bp, Artificial
  CRISPR gRNA sequence
gcctgcattgttcagcgaaa

SEQ ID NO: 405470 - DNA, 20 bp, Artificial
  CRISPR gRNA sequence
cattgttcagcgaaataaga

SEQ ID NO: 405471 - DNA, 20 bp, Artificial
  CRISPR gRNA sequence
ttcagcgaaataagatgaaa

SEQ ID NO: 405472 - DNA, 20 bp, Artificial
  CRISPR gRNA sequence
agcgaaataagatgaaaatg

SEQ ID NO: 405473 - DNA, 20 bp, Artificial
  CRISPR gRNA sequence
tgcctggtgccatttacttc

SEQ ID NO: 405474 - DNA, 20 bp, Artificial
  CRISPR gRNA sequence
gcctggtgccatttacttca

SEQ ID NO: 405475 - DNA, 20 bp, Artificial
  CRISPR gRNA sequence
cctggtgccatttacttcac

SEQ ID NO: 405476 - DNA, 20 bp, Artificial
  CRISPR gRNA sequence
gtgccatttacttcacagac

SEQ ID NO: 405477 - DNA, 20 bp, Artificial
  CRISPR gRNA sequence
acttcacagacagatattat

SEQ ID NO: 405478 - DNA, 20 bp, Artificial
  CRISPR gRNA sequence
cttcacagacagatattatg

SEQ ID NO: 405479 - DNA, 20 bp, Artificial
  CRISPR gRNA sequence
cacagacagatattatgttt

SEQ ID NO: 405480 - DNA, 20 bp, Artificial
  CRISPR gRNA sequence
acagacagatattatgtttt

SEQ ID NO: 405481 - DNA, 20 bp, Artificial
  CRISPR gRNA sequence
tgttttgtctcttcagcatt

SEQ ID NO: 405482 - DNA, 20 bp, Artificial
  CRISPR gRNA sequence
tgtctcttcagcatttattt

SEQ ID NO: 405483 - DNA, 20 bp, Artificial
  CRISPR gRNA sequence
gtctcttcagcatttattta

SEQ ID NO: 405484 - DNA, 20 bp, Artificial
  CRISPR gRNA sequence
tctcttcagcatttatttac

SEQ ID NO: 405485 - DNA, 20 bp, Artificial
  CRISPR gRNA sequence
ttcagcatttatttactctt

SEQ ID NO: 405486 - DNA, 20 bp, Artificial
  CRISPR gRNA sequence
cagcatttatttactcttaa

SEQ ID NO: 405487 - DNA, 20 bp, Artificial
  CRISPR gRNA sequence
agcatttatttactcttaaa

SEQ ID NO: 405488 - DNA, 20 bp, Artificial
  CRISPR gRNA sequence
atttactcttaaaatttagg

SEQ ID NO: 405489 - DNA, 20 bp, Artificial
  CRISPR gRNA sequence
tttactcttaaaatttaggt

SEQ ID NO: 405490 - DNA, 20 bp, Artificial
  CRISPR gRNA sequence
actcttaaaatttaggtaat

SEQ ID NO: 405491 - DNA, 20 bp, Artificial
  CRISPR gRNA sequence
ctcttaaaatttaggtaatc

SEQ ID NO: 405492 - DNA, 20 bp, Artificial
  CRISPR gRNA sequence
ttaaaatttaggtaatctcc

SEQ ID NO: 405493 - DNA, 20 bp, Artificial
  CRISPR gRNA sequence
aaaatttaggtaatctcctt

SEQ ID NO: 405494 - DNA, 20 bp, Artificial
  CRISPR gRNA sequence
aaatttaggtaatctccttg

SEQ ID NO: 405495 - DNA, 20 bp, Artificial
  CRISPR gRNA sequence
aggtaatctccttgccttca

SEQ ID NO: 405496 - DNA, 20 bp, Artificial
  CRISPR gRNA sequence
ggtaatctccttgccttcag

SEQ ID NO: 405497 - DNA, 20 bp, Artificial
  CRISPR gRNA sequence
cttgccttcagttctttcag

SEQ ID NO: 405498 - DNA, 20 bp, Artificial
  CRISPR gRNA sequence
gccttcagttctttcagaaa

SEQ ID NO: 405499 - DNA, 20 bp, Artificial
  CRISPR gRNA sequence
ccttcagttctttcagaaag

SEQ ID NO: 405500 - DNA, 20 bp, Artificial
  CRISPR gRNA sequence
cagttctttcagaaagtaga

SEQ ID NO: 405501 - DNA, 20 bp, Artificial
  CRISPR gRNA sequence
agttctttcagaaagtagaa

SEQ ID NO: 405502 - DNA, 20 bp, Artificial
  CRISPR gRNA sequence
tttcagaaagtagaattatt

SEQ ID NO: 405503 - DNA, 20 bp, Artificial
  CRISPR gRNA sequence
tcagaaagtagaattattca

SEQ ID NO: 405504 - DNA, 20 bp, Artificial
  CRISPR gRNA sequence
cagaaagtagaattattcac

SEQ ID NO: 405505 - DNA, 20 bp, Artificial
  CRISPR gRNA sequence
agaaagtagaattattcact

SEQ ID NO: 405506 - DNA, 20 bp, Artificial
  CRISPR gRNA sequence
ttcactttcttttgatacta

SEQ ID NO: 405507 - DNA, 20 bp, Artificial
  CRISPR gRNA sequence
actttcttttgatactagac

SEQ ID NO: 405508 - DNA, 20 bp, Artificial
  CRISPR gRNA sequence
tcttttgatactagacattg

SEQ ID NO: 405509 - DNA, 20 bp, Artificial
  CRISPR gRNA sequence
cttttgatactagacattgt

SEQ ID NO: 405510 - DNA, 20 bp, Artificial
  CRISPR gRNA sequence
ttttgatactagacattgtt

SEQ ID NO: 405511 - DNA, 20 bp, Artificial
  CRISPR gRNA sequence
ttgatactagacattgtttg

SEQ ID NO: 405512 - DNA, 20 bp, Artificial
  CRISPR gRNA sequence
tgatactagacattgtttga

SEQ ID NO: 405513 - DNA, 20 bp, Artificial
  CRISPR gRNA sequence
gatactagacattgtttgaa

SEQ ID NO: 405514 - DNA, 20 bp, Artificial
  CRISPR gRNA sequence
atactagacattgtttgaag

SEQ ID NO: 405515 - DNA, 20 bp, Artificial
  CRISPR gRNA sequence
gacattgtttgaagagtttt

SEQ ID NO: 405516 - DNA, 20 bp, Artificial
  CRISPR gRNA sequence
tttgaagagttttgtctact

SEQ ID NO: 405517 - DNA, 20 bp, Artificial
  CRISPR gRNA sequence
gaagagttttgtctacttcc

SEQ ID NO: 405518 - DNA, 20 bp, Artificial
  CRISPR gRNA sequence
aagagttttgtctacttcct

SEQ ID NO: 405519 - DNA, 20 bp, Artificial
  CRISPR gRNA sequence
tgtctacttcctggatgatc

SEQ ID NO: 405520 - DNA, 20 bp, Artificial
  CRISPR gRNA sequence
gtctacttcctggatgatcc

SEQ ID NO: 405521 - DNA, 20 bp, Artificial
  CRISPR gRNA sequence
tctacttcctggatgatcct

SEQ ID NO: 405522 - DNA, 20 bp, Artificial
  CRISPR gRNA sequence
cttcctggatgatcctttaa

SEQ ID NO: 405523 - DNA, 20 bp, Artificial
  CRISPR gRNA sequence
cctggatgatcctttaaata

SEQ ID NO: 405524 - DNA, 20 bp, Artificial
  CRISPR gRNA sequence
ctggatgatcctttaaatat

SEQ ID NO: 405525 - DNA, 20 bp, Artificial
  CRISPR gRNA sequence
gatgatcctttaaatattat

SEQ ID NO: 405526 - DNA, 20 bp, Artificial
  CRISPR gRNA sequence
taaatattatggtgaaaatg

SEQ ID NO: 405527 - DNA, 20 bp, Artificial
  CRISPR gRNA sequence
aaatattatggtgaaaatga

SEQ ID NO: 405528 - DNA, 20 bp, Artificial
  CRISPR gRNA sequence
aatattatggtgaaaatgaa

SEQ ID NO: 405529 - DNA, 20 bp, Artificial
  CRISPR gRNA sequence
tggtgaaaatgaaatggttt

SEQ ID NO: 405530 - DNA, 20 bp, Artificial
  CRISPR gRNA sequence
gtcttatgtgataaatttcc

SEQ ID NO: 405531 - DNA, 20 bp, Artificial
  CRISPR gRNA sequence
tcttatgtgataaatttcct

SEQ ID NO: 405532 - DNA, 20 bp, Artificial
  CRISPR gRNA sequence
atgtgataaatttccttggt

SEQ ID NO: 405533 - DNA, 20 bp, Artificial
  CRISPR gRNA sequence
tgtgataaatttccttggtt

SEQ ID NO: 405534 - DNA, 20 bp, Artificial
  CRISPR gRNA sequence
ccttggttcaagacttcttt

SEQ ID NO: 405535 - DNA, 20 bp, Artificial
  CRISPR gRNA sequence
cttggttcaagacttctttt

SEQ ID NO: 405536 - DNA, 20 bp, Artificial
  CRISPR gRNA sequence
ggttcaagacttcttttgac

SEQ ID NO: 405537 - DNA, 20 bp, Artificial
  CRISPR gRNA sequence
gttcaagacttcttttgaca

SEQ ID NO: 405538 - DNA, 20 bp, Artificial
  CRISPR gRNA sequence
aagacttcttttgacaatat

SEQ ID NO: 405539 - DNA, 20 bp, Artificial
  CRISPR gRNA sequence
cttttgacaatattttagat

SEQ ID NO: 405540 - DNA, 20 bp, Artificial
  CRISPR gRNA sequence
ttttgacaatattttagata

SEQ ID NO: 405541 - DNA, 20 bp, Artificial
  CRISPR gRNA sequence
ttgacaatattttagatatt

SEQ ID NO: 405542 - DNA, 20 bp, Artificial
  CRISPR gRNA sequence
tgacaatattttagatattt

SEQ ID NO: 405543 - DNA, 20 bp, Artificial
  CRISPR gRNA sequence
gacaatattttagatatttt

SEQ ID NO: 405544 - DNA, 20 bp, Artificial
  CRISPR gRNA sequence
acaatattttagatattttt

SEQ ID NO: 405545 - DNA, 20 bp, Artificial
  CRISPR gRNA sequence
tagatatttttttgtagcta

SEQ ID NO: 405546 - DNA, 20 bp, Artificial
  CRISPR gRNA sequence
agatatttttttgtagctat

SEQ ID NO: 405547 - DNA, 20 bp, Artificial
  CRISPR gRNA sequence
gatatttttttgtagctatg

SEQ ID NO: 405548 - DNA, 20 bp, Artificial
  CRISPR gRNA sequence
ttttgtagctatgtaaacgg

SEQ ID NO: 405549 - DNA, 20 bp, Artificial
  CRISPR gRNA sequence
tttgtagctatgtaaacggt

SEQ ID NO: 405550 - DNA, 20 bp, Artificial
  CRISPR gRNA sequence
ttgtagctatgtaaacggtc

SEQ ID NO: 405551 - DNA, 20 bp, Artificial
  CRISPR gRNA sequence
tgtagctatgtaaacggtca

SEQ ID NO: 405552 - DNA, 20 bp, Artificial
  CRISPR gRNA sequence
gtagctatgtaaacggtcag

SEQ ID NO: 405553 - DNA, 20 bp, Artificial
  CRISPR gRNA sequence
tagctatgtaaacggtcagt

SEQ ID NO: 405554 - DNA, 20 bp, Artificial
  CRISPR gRNA sequence
tgtaaacggtcagttttttc

SEQ ID NO: 405555 - DNA, 20 bp, Artificial
  CRISPR gRNA sequence
tttccttcctatgtttgaaa

SEQ ID NO: 405556 - DNA, 20 bp, Artificial
  CRISPR gRNA sequence
ttccttcctatgtttgaaaa

SEQ ID NO: 405557 - DNA, 20 bp, Artificial
  CRISPR gRNA sequence
tccttcctatgtttgaaaaa

SEQ ID NO: 405558 - DNA, 20 bp, Artificial
  CRISPR gRNA sequence
ccttcctatgtttgaaaaaa

SEQ ID NO: 405559 - DNA, 20 bp, Artificial
  CRISPR gRNA sequence
cttcctatgtttgaaaaaag

SEQ ID NO: 405560 - DNA, 20 bp, Artificial
  CRISPR gRNA sequence
cctatgtttgaaaaaagctc

SEQ ID NO: 405561 - DNA, 20 bp, Artificial
  CRISPR gRNA sequence
ctatgtttgaaaaaagctcc

SEQ ID NO: 405562 - DNA, 20 bp, Artificial
  CRISPR gRNA sequence
tgtttgaaaaaagctccctg

SEQ ID NO: 405563 - DNA, 20 bp, Artificial
  CRISPR gRNA sequence
gaaaaaagctccctgacagc

SEQ ID NO: 405564 - DNA, 20 bp, Artificial
  CRISPR gRNA sequence
aaaaaagctccctgacagcg

SEQ ID NO: 405565 - DNA, 20 bp, Artificial
  CRISPR gRNA sequence
cctgacagcgtttctggaat

SEQ ID NO: 405566 - DNA, 20 bp, Artificial
  CRISPR gRNA sequence
acagcgtttctggaatgttt

SEQ ID NO: 405567 - DNA, 20 bp, Artificial
  CRISPR gRNA sequence
ctggaatgtttaaattgcct

SEQ ID NO: 405568 - DNA, 20 bp, Artificial
  CRISPR gRNA sequence
tggaatgtttaaattgcctg

SEQ ID NO: 405569 - DNA, 20 bp, Artificial
  CRISPR gRNA sequence
gaatgtttaaattgcctggg

SEQ ID NO: 405570 - DNA, 20 bp, Artificial
  CRISPR gRNA sequence
aaattgcctgggttgctccg

SEQ ID NO: 405571 - DNA, 20 bp, Artificial
  CRISPR gRNA sequence
aattgcctgggttgctccgt

SEQ ID NO: 405572 - DNA, 20 bp, Artificial
  CRISPR gRNA sequence
cctgggttgctccgttattt

SEQ ID NO: 405573 - DNA, 20 bp, Artificial
  CRISPR gRNA sequence
ggttgctccgttatttttct

SEQ ID NO: 405574 - DNA, 20 bp, Artificial
  CRISPR gRNA sequence
ctccgttatttttcttcagt

SEQ ID NO: 405575 - DNA, 20 bp, Artificial
  CRISPR gRNA sequence
cgttatttttcttcagtttg

SEQ ID NO: 405576 - DNA, 20 bp, Artificial
  CRISPR gRNA sequence
tttttcttcagtttgagcat

SEQ ID NO: 405577 - DNA, 20 bp, Artificial
  CRISPR gRNA sequence
ttcttcagtttgagcattat

SEQ ID NO: 405578 - DNA, 20 bp, Artificial
  CRISPR gRNA sequence
tcttcagtttgagcattatg

SEQ ID NO: 405579 - DNA, 20 bp, Artificial
  CRISPR gRNA sequence
cttcagtttgagcattatgg

SEQ ID NO: 405580 - DNA, 20 bp, Artificial
  CRISPR gRNA sequence
ttcagtttgagcattatgga

SEQ ID NO: 405581 - DNA, 20 bp, Artificial
  CRISPR gRNA sequence
cagtttgagcattatggaaa

SEQ ID NO: 405582 - DNA, 20 bp, Artificial
  CRISPR gRNA sequence
agtttgagcattatggaaac

SEQ ID NO: 405583 - DNA, 20 bp, Artificial
  CRISPR gRNA sequence
gagcattatggaaacagaga

SEQ ID NO: 405584 - DNA, 20 bp, Artificial
  CRISPR gRNA sequence
agcattatggaaacagagag

SEQ ID NO: 405585 - DNA, 20 bp, Artificial
  CRISPR gRNA sequence
tggaaacagagaggccacaa

SEQ ID NO: 405586 - DNA, 20 bp, Artificial
  CRISPR gRNA sequence
ttggttatccttgagaaacg

SEQ ID NO: 405587 - DNA, 20 bp, Artificial
  CRISPR gRNA sequence
ggttatccttgagaaacgaa

SEQ ID NO: 405588 - DNA, 20 bp, Artificial
  CRISPR gRNA sequence
gttatccttgagaaacgaag

SEQ ID NO: 405589 - DNA, 20 bp, Artificial
  CRISPR gRNA sequence
tccttgagaaacgaagtggc

SEQ ID NO: 405590 - DNA, 20 bp, Artificial
  CRISPR gRNA sequence
gagaaacgaagtggcaaatt

SEQ ID NO: 405591 - DNA, 20 bp, Artificial
  CRISPR gRNA sequence
agaaacgaagtggcaaatta

SEQ ID NO: 405592 - DNA, 20 bp, Artificial
  CRISPR gRNA sequence
gctgagataatatccagtac

SEQ ID NO: 405593 - DNA, 20 bp, Artificial
  CRISPR gRNA sequence
agataatatccagtactcat

SEQ ID NO: 405594 - DNA, 20 bp, Artificial
  CRISPR gRNA sequence
attggacgcagtgcttgaag

SEQ ID NO: 405595 - DNA, 20 bp, Artificial
  CRISPR gRNA sequence
gacgcagtgcttgaagcctc

SEQ ID NO: 405596 - DNA, 20 bp, Artificial
  CRISPR gRNA sequence
gaagcctcaactgtccgaac

SEQ ID NO: 405597 - DNA, 20 bp, Artificial
  CRISPR gRNA sequence
aagcctcaactgtccgaaca

SEQ ID NO: 405598 - DNA, 20 bp, Artificial
  CRISPR gRNA sequence
aactgtccgaacattttctg

SEQ ID NO: 405599 - DNA, 20 bp, Artificial
  CRISPR gRNA sequence
tccgaacattttctgtttaa

SEQ ID NO: 405600 - DNA, 20 bp, Artificial
  CRISPR gRNA sequence
tctgtttaaagtgttaacct

SEQ ID NO: 405601 - DNA, 20 bp, Artificial
  CRISPR gRNA sequence
ctgtttaaagtgttaacctt

SEQ ID NO: 405602 - DNA, 20 bp, Artificial
  CRISPR gRNA sequence
tgtttaaagtgttaaccttt

SEQ ID NO: 405603 - DNA, 20 bp, Artificial
  CRISPR gRNA sequence
tttaaagtgttaaccttttt

SEQ ID NO: 405604 - DNA, 20 bp, Artificial
  CRISPR gRNA sequence
aaagtgttaacctttttctc

SEQ ID NO: 405605 - DNA, 20 bp, Artificial
  CRISPR gRNA sequence
aagtgttaacctttttctca

SEQ ID NO: 405606 - DNA, 20 bp, Artificial
  CRISPR gRNA sequence
acctttttctcagtttgcca

SEQ ID NO: 405607 - DNA, 20 bp, Artificial
  CRISPR gRNA sequence
tttctcagtttgccatttat

SEQ ID NO: 405608 - DNA, 20 bp, Artificial
  CRISPR gRNA sequence
ttctcagtttgccatttatt

SEQ ID NO: 405609 - DNA, 20 bp, Artificial
  CRISPR gRNA sequence
tctcagtttgccatttattt

SEQ ID NO: 405610 - DNA, 20 bp, Artificial
  CRISPR gRNA sequence
ctcagtttgccatttatttc

SEQ ID NO: 405611 - DNA, 20 bp, Artificial
  CRISPR gRNA sequence
tcagtttgccatttatttcc

SEQ ID NO: 405612 - DNA, 20 bp, Artificial
  CRISPR gRNA sequence
agtttgccatttatttcctt

SEQ ID NO: 405613 - DNA, 20 bp, Artificial
  CRISPR gRNA sequence
gccatttatttcctttcggc

SEQ ID NO: 405614 - DNA, 20 bp, Artificial
  CRISPR gRNA sequence
ccatttatttcctttcggct

SEQ ID NO: 405615 - DNA, 20 bp, Artificial
  CRISPR gRNA sequence
atttcctttcggctcttttt

SEQ ID NO: 405616 - DNA, 20 bp, Artificial
  CRISPR gRNA sequence
tttcctttcggctctttttt

SEQ ID NO: 405617 - DNA, 20 bp, Artificial
  CRISPR gRNA sequence
cctttcggctcttttttctt

SEQ ID NO: 405618 - DNA, 20 bp, Artificial
  CRISPR gRNA sequence
ctttcggctcttttttcttc

SEQ ID NO: 405619 - DNA, 20 bp, Artificial
  CRISPR gRNA sequence
tcggctcttttttcttcatt

SEQ ID NO: 405620 - DNA, 20 bp, Artificial
  CRISPR gRNA sequence
cggctcttttttcttcattt

SEQ ID NO: 405621 - DNA, 20 bp, Artificial
  CRISPR gRNA sequence
ggctcttttttcttcatttg

SEQ ID NO: 405622 - DNA, 20 bp, Artificial
  CRISPR gRNA sequence
ttttttcttcatttggctgc

SEQ ID NO: 405623 - DNA, 20 bp, Artificial
  CRISPR gRNA sequence
ttttcttcatttggctgcca

SEQ ID NO: 405624 - DNA, 20 bp, Artificial
  CRISPR gRNA sequence
tttcttcatttggctgccag

SEQ ID NO: 405625 - DNA, 20 bp, Artificial
  CRISPR gRNA sequence
ttcttcatttggctgccagg

SEQ ID NO: 405626 - DNA, 20 bp, Artificial
  CRISPR gRNA sequence
tcttcatttggctgccaggt

SEQ ID NO: 405627 - DNA, 20 bp, Artificial
  CRISPR gRNA sequence
cttcatttggctgccaggtc

SEQ ID NO: 405628 - DNA, 20 bp, Artificial
  CRISPR gRNA sequence
ttcatttggctgccaggtcc

SEQ ID NO: 405629 - DNA, 20 bp, Artificial
  CRISPR gRNA sequence
catttggctgccaggtcctc

SEQ ID NO: 405630 - DNA, 20 bp, Artificial
  CRISPR gRNA sequence
atttggctgccaggtcctct

SEQ ID NO: 405631 - DNA, 20 bp, Artificial
  CRISPR gRNA sequence
ggctgccaggtcctctggca

SEQ ID NO: 405632 - DNA, 20 bp, Artificial
  CRISPR gRNA sequence
gctgccaggtcctctggcag

SEQ ID NO: 405633 - DNA, 20 bp, Artificial
  CRISPR gRNA sequence
ccaggtcctctggcagtgac

SEQ ID NO: 405634 - DNA, 20 bp, Artificial
  CRISPR gRNA sequence
tggcagtgacattatttcct

SEQ ID NO: 405635 - DNA, 20 bp, Artificial
  CRISPR gRNA sequence
gcagtgacattatttcctaa

SEQ ID NO: 405636 - DNA, 20 bp, Artificial
  CRISPR gRNA sequence
tttcctaaatacttcttcat

SEQ ID NO: 405637 - DNA, 20 bp, Artificial
  CRISPR gRNA sequence
cctaaatacttcttcatctt

SEQ ID NO: 405638 - DNA, 20 bp, Artificial
  CRISPR gRNA sequence
ctaaatacttcttcatcttt

SEQ ID NO: 405639 - DNA, 20 bp, Artificial
  CRISPR gRNA sequence
aatacttcttcatctttcca

SEQ ID NO: 405640 - DNA, 20 bp, Artificial
  CRISPR gRNA sequence
cttcatctttccatttctag

SEQ ID NO: 405641 - DNA, 20 bp, Artificial
  CRISPR gRNA sequence
ttcatctttccatttctagg

SEQ ID NO: 405642 - DNA, 20 bp, Artificial
  CRISPR gRNA sequence
catctttccatttctaggcc

SEQ ID NO: 405643 - DNA, 20 bp, Artificial
  CRISPR gRNA sequence
atctttccatttctaggcct

SEQ ID NO: 405644 - DNA, 20 bp, Artificial
  CRISPR gRNA sequence
tccatttctaggccttggga

SEQ ID NO: 405645 - DNA, 20 bp, Artificial
  CRISPR gRNA sequence
ccatttctaggccttgggag

SEQ ID NO: 405646 - DNA, 20 bp, Artificial
  CRISPR gRNA sequence
catttctaggccttgggagg

SEQ ID NO: 405647 - DNA, 20 bp, Artificial
  CRISPR gRNA sequence
ctaggccttgggagggccca

SEQ ID NO: 405648 - DNA, 20 bp, Artificial
  CRISPR gRNA sequence
taggccttgggagggcccat

SEQ ID NO: 405649 - DNA, 20 bp, Artificial
  CRISPR gRNA sequence
ggccttgggagggcccatgg

SEQ ID NO: 405650 - DNA, 20 bp, Artificial
  CRISPR gRNA sequence
gggagggcccatggccccca

SEQ ID NO: 405651 - DNA, 20 bp, Artificial
  CRISPR gRNA sequence
ggagggcccatggcccccac

SEQ ID NO: 405652 - DNA, 20 bp, Artificial
  CRISPR gRNA sequence
ctctgattgcatcccatgtc

SEQ ID NO: 405653 - DNA, 20 bp, Artificial
  CRISPR gRNA sequence
tgattgcatcccatgtctgt

SEQ ID NO: 405654 - DNA, 20 bp, Artificial
  CRISPR gRNA sequence
attgcatcccatgtctgtat

SEQ ID NO: 405655 - DNA, 20 bp, Artificial
  CRISPR gRNA sequence
catcccatgtctgtatcagt

SEQ ID NO: 405656 - DNA, 20 bp, Artificial
  CRISPR gRNA sequence
tatcagtgcagcaacaatct

SEQ ID NO: 405657 - DNA, 20 bp, Artificial
  CRISPR gRNA sequence
agcccttcctgaagtatcac

SEQ ID NO: 405658 - DNA, 20 bp, Artificial
  CRISPR gRNA sequence
cctgaagtatcactagcctg

SEQ ID NO: 405659 - DNA, 20 bp, Artificial
  CRISPR gRNA sequence
ctgaagtatcactagcctgc

SEQ ID NO: 405660 - DNA, 20 bp, Artificial
  CRISPR gRNA sequence
aagtatcactagcctgcccc

SEQ ID NO: 405661 - DNA, 20 bp, Artificial
  CRISPR gRNA sequence
gcctgccccacacattcagt

SEQ ID NO: 405662 - DNA, 20 bp, Artificial
  CRISPR gRNA sequence
ccccacacattcagtccacg

SEQ ID NO: 405663 - DNA, 20 bp, Artificial
  CRISPR gRNA sequence
agtccacgaaattatacaga

SEQ ID NO: 405664 - DNA, 20 bp, Artificial
  CRISPR gRNA sequence
tacagatgcgtattgggcaa

SEQ ID NO: 405665 - DNA, 20 bp, Artificial
  CRISPR gRNA sequence
ggcaacagtccaggccttcc

SEQ ID NO: 405666 - DNA, 20 bp, Artificial
  CRISPR gRNA sequence
ccactttccatctgtatttt

SEQ ID NO: 405667 - DNA, 20 bp, Artificial
  CRISPR gRNA sequence
cactttccatctgtattttc

SEQ ID NO: 405668 - DNA, 20 bp, Artificial
  CRISPR gRNA sequence
tccatctgtattttccatga

SEQ ID NO: 405669 - DNA, 20 bp, Artificial
  CRISPR gRNA sequence
ccatctgtattttccatgac

SEQ ID NO: 405670 - DNA, 20 bp, Artificial
  CRISPR gRNA sequence
catctgtattttccatgact

SEQ ID NO: 405671 - DNA, 20 bp, Artificial
  CRISPR gRNA sequence
tattttccatgactccccta

SEQ ID NO: 405672 - DNA, 20 bp, Artificial
  CRISPR gRNA sequence
tccatgactcccctatttgc

SEQ ID NO: 405673 - DNA, 20 bp, Artificial
  CRISPR gRNA sequence
ccatgactcccctatttgca

SEQ ID NO: 405674 - DNA, 20 bp, Artificial
  CRISPR gRNA sequence
catgactcccctatttgcac

SEQ ID NO: 405675 - DNA, 20 bp, Artificial
  CRISPR gRNA sequence
ccctatttgcacaggggtgt

SEQ ID NO: 405676 - DNA, 20 bp, Artificial
  CRISPR gRNA sequence
tttgcacaggggtgtctata

SEQ ID NO: 405677 - DNA, 20 bp, Artificial
  CRISPR gRNA sequence
gcacaggggtgtctataagt

SEQ ID NO: 405678 - DNA, 20 bp, Artificial
  CRISPR gRNA sequence
cacaggggtgtctataagtg

SEQ ID NO: 405679 - DNA, 20 bp, Artificial
  CRISPR gRNA sequence
taagtgccctggatgcctgc

SEQ ID NO: 405680 - DNA, 20 bp, Artificial
  CRISPR gRNA sequence
gatgcctgctgatggctgtg

SEQ ID NO: 405681 - DNA, 20 bp, Artificial
  CRISPR gRNA sequence
ctgatggctgtggctctgct

SEQ ID NO: 405682 - DNA, 20 bp, Artificial
  CRISPR gRNA sequence
atggctgtggctctgctcca

SEQ ID NO: 405683 - DNA, 20 bp, Artificial
  CRISPR gRNA sequence
tggctctgctccaagtcaag

SEQ ID NO: 405684 - DNA, 20 bp, Artificial
  CRISPR gRNA sequence
tgctccaagtcaagacattg

SEQ ID NO: 405685 - DNA, 20 bp, Artificial
  CRISPR gRNA sequence
ctccaagtcaagacattgct

SEQ ID NO: 405686 - DNA, 20 bp, Artificial
  CRISPR gRNA sequence
caagtcaagacattgctctc

SEQ ID NO: 405687 - DNA, 20 bp, Artificial
  CRISPR gRNA sequence
ctctctatctggctcctttc

SEQ ID NO: 405688 - DNA, 20 bp, Artificial
  CRISPR gRNA sequence
tctatctggctcctttccta

SEQ ID NO: 405689 - DNA, 20 bp, Artificial
  CRISPR gRNA sequence
tatctggctcctttcctact

SEQ ID NO: 405690 - DNA, 20 bp, Artificial
  CRISPR gRNA sequence
tctggctcctttcctactgt

SEQ ID NO: 405691 - DNA, 20 bp, Artificial
  CRISPR gRNA sequence
gctcctttcctactgtgtcc

SEQ ID NO: 405692 - DNA, 20 bp, Artificial
  CRISPR gRNA sequence
ctttcctactgtgtccctgc

SEQ ID NO: 405693 - DNA, 20 bp, Artificial
  CRISPR gRNA sequence
tcctactgtgtccctgcaca

SEQ ID NO: 405694 - DNA, 20 bp, Artificial
  CRISPR gRNA sequence
cctactgtgtccctgcacag

SEQ ID NO: 405695 - DNA, 20 bp, Artificial
  CRISPR gRNA sequence
ctactgtgtccctgcacaga

SEQ ID NO: 405696 - DNA, 20 bp, Artificial
  CRISPR gRNA sequence
ctgtgtccctgcacagagct

SEQ ID NO: 405697 - DNA, 20 bp, Artificial
  CRISPR gRNA sequence
tgtccctgcacagagctcac

SEQ ID NO: 405698 - DNA, 20 bp, Artificial
  CRISPR gRNA sequence
cacagagctcacagtgcatt

SEQ ID NO: 405699 - DNA, 20 bp, Artificial
  CRISPR gRNA sequence
acagtgcattttacattgta

SEQ ID NO: 405700 - DNA, 20 bp, Artificial
  CRISPR gRNA sequence
tacattgtaaacatctgttt

SEQ ID NO: 405701 - DNA, 20 bp, Artificial
  CRISPR gRNA sequence
acattgtaaacatctgttta

SEQ ID NO: 405702 - DNA, 20 bp, Artificial
  CRISPR gRNA sequence
cattgtaaacatctgtttag

SEQ ID NO: 405703 - DNA, 20 bp, Artificial
  CRISPR gRNA sequence
taaacatctgtttagtttta

SEQ ID NO: 405704 - DNA, 20 bp, Artificial
  CRISPR gRNA sequence
tttagttttatggcttcctt

SEQ ID NO: 405705 - DNA, 20 bp, Artificial
  CRISPR gRNA sequence
agttttatggcttccttatt

SEQ ID NO: 405706 - DNA, 20 bp, Artificial
  CRISPR gRNA sequence
gttttatggcttccttatta

SEQ ID NO: 405707 - DNA, 20 bp, Artificial
  CRISPR gRNA sequence
tatggcttccttattagttc

SEQ ID NO: 405708 - DNA, 20 bp, Artificial
  CRISPR gRNA sequence
atggcttccttattagttcc

SEQ ID NO: 405709 - DNA, 20 bp, Artificial
  CRISPR gRNA sequence
tggcttccttattagttcct

SEQ ID NO: 405710 - DNA, 20 bp, Artificial
  CRISPR gRNA sequence
ccttattagttcctaagccc

SEQ ID NO: 405711 - DNA, 20 bp, Artificial
  CRISPR gRNA sequence
cttattagttcctaagccct

SEQ ID NO: 405712 - DNA, 20 bp, Artificial
  CRISPR gRNA sequence
attagttcctaagccctgtg

SEQ ID NO: 405713 - DNA, 20 bp, Artificial
  CRISPR gRNA sequence
ttagttcctaagccctgtga

SEQ ID NO: 405714 - DNA, 20 bp, Artificial
  CRISPR gRNA sequence
gttcctaagccctgtgagga

SEQ ID NO: 405715 - DNA, 20 bp, Artificial
  CRISPR gRNA sequence
ctaagccctgtgaggaccga

SEQ ID NO: 405716 - DNA, 20 bp, Artificial
  CRISPR gRNA sequence
agccctgtgaggaccgagac

SEQ ID NO: 405717 - DNA, 20 bp, Artificial
  CRISPR gRNA sequence
tgaggaccgagaccatgcct

SEQ ID NO: 405718 - DNA, 20 bp, Artificial
  CRISPR gRNA sequence
aggtattatccactctatcc

SEQ ID NO: 405719 - DNA, 20 bp, Artificial
  CRISPR gRNA sequence
tccactctatccttaatagc

SEQ ID NO: 405720 - DNA, 20 bp, Artificial
  CRISPR gRNA sequence
tatccttaatagctgctttt

SEQ ID NO: 405721 - DNA, 20 bp, Artificial
  CRISPR gRNA sequence
tccttaatagctgcttttta

SEQ ID NO: 405722 - DNA, 20 bp, Artificial
  CRISPR gRNA sequence
aatagctgctttttaattaa

SEQ ID NO: 405723 - DNA, 20 bp, Artificial
  CRISPR gRNA sequence
atagctgctttttaattaat

SEQ ID NO: 405724 - DNA, 20 bp, Artificial
  CRISPR gRNA sequence
ctttttaattaatttatttt

SEQ ID NO: 405725 - DNA, 20 bp, Artificial
  CRISPR gRNA sequence
tttaattaatttattttttg

SEQ ID NO: 405726 - DNA, 20 bp, Artificial
  CRISPR gRNA sequence
ttaattaatttattttttga

SEQ ID NO: 405727 - DNA, 20 bp, Artificial
  CRISPR gRNA sequence
taattaatttattttttgag

SEQ ID NO: 405728 - DNA, 20 bp, Artificial
  CRISPR gRNA sequence
aattaatttattttttgaga

SEQ ID NO: 405729 - DNA, 20 bp, Artificial
  CRISPR gRNA sequence
attaatttattttttgagac

SEQ ID NO: 405730 - DNA, 20 bp, Artificial
  CRISPR gRNA sequence
atttattttttgagacagag

SEQ ID NO: 405731 - DNA, 20 bp, Artificial
  CRISPR gRNA sequence
attttttgagacagagtccc

SEQ ID NO: 405732 - DNA, 20 bp, Artificial
  CRISPR gRNA sequence
ttttttgagacagagtccca

SEQ ID NO: 405733 - DNA, 20 bp, Artificial
  CRISPR gRNA sequence
tttgagacagagtcccactc

SEQ ID NO: 405734 - DNA, 20 bp, Artificial
  CRISPR gRNA sequence
ttgagacagagtcccactct

SEQ ID NO: 405735 - DNA, 20 bp, Artificial
  CRISPR gRNA sequence
tgagacagagtcccactctg

SEQ ID NO: 405736 - DNA, 20 bp, Artificial
  CRISPR gRNA sequence
gagacagagtcccactctgt

SEQ ID NO: 405737 - DNA, 20 bp, Artificial
  CRISPR gRNA sequence
agacagagtcccactctgtc

SEQ ID NO: 405738 - DNA, 20 bp, Artificial
  CRISPR gRNA sequence
tgtcaccaaagctggagtgc

SEQ ID NO: 405739 - DNA, 20 bp, Artificial
  CRISPR gRNA sequence
tcaccaaagctggagtgcaa

SEQ ID NO: 405740 - DNA, 20 bp, Artificial
  CRISPR gRNA sequence
gagtgcaatggcacaatctc

SEQ ID NO: 405741 - DNA, 20 bp, Artificial
  CRISPR gRNA sequence
ggctcaccgcaacctccacc

SEQ ID NO: 405742 - DNA, 20 bp, Artificial
  CRISPR gRNA sequence
accgcaacctccacctgcca

SEQ ID NO: 405743 - DNA, 20 bp, Artificial
  CRISPR gRNA sequence
cacctgccaagttcaagtga

SEQ ID NO: 405744 - DNA, 20 bp, Artificial
  CRISPR gRNA sequence
ccaagttcaagtgattcttc

SEQ ID NO: 405745 - DNA, 20 bp, Artificial
  CRISPR gRNA sequence
aagtgattcttctgcctcag

SEQ ID NO: 405746 - DNA, 20 bp, Artificial
  CRISPR gRNA sequence
ttctgcctcagcctcccaag

SEQ ID NO: 405747 - DNA, 20 bp, Artificial
  CRISPR gRNA sequence
ctgcctcagcctcccaagta

SEQ ID NO: 405748 - DNA, 20 bp, Artificial
  CRISPR gRNA sequence
tgcctcagcctcccaagtag

SEQ ID NO: 405749 - DNA, 20 bp, Artificial
  CRISPR gRNA sequence
cctcagcctcccaagtagct

SEQ ID NO: 405750 - DNA, 20 bp, Artificial
  CRISPR gRNA sequence
agcctcccaagtagctggga

SEQ ID NO: 405751 - DNA, 20 bp, Artificial
  CRISPR gRNA sequence
ccaagtagctgggattacag

SEQ ID NO: 405752 - DNA, 20 bp, Artificial
  CRISPR gRNA sequence
ggattacaggtgcctgccac

SEQ ID NO: 405753 - DNA, 20 bp, Artificial
  CRISPR gRNA sequence
caggtgcctgccaccacacc

SEQ ID NO: 405754 - DNA, 20 bp, Artificial
  CRISPR gRNA sequence
ccaccacacctggctaattt

SEQ ID NO: 405755 - DNA, 20 bp, Artificial
  CRISPR gRNA sequence
gctaattttatttttgtatt

SEQ ID NO: 405756 - DNA, 20 bp, Artificial
  CRISPR gRNA sequence
attttatttttgtattttta

SEQ ID NO: 405757 - DNA, 20 bp, Artificial
  CRISPR gRNA sequence
tatttttgtatttttagtag

SEQ ID NO: 405758 - DNA, 20 bp, Artificial
  CRISPR gRNA sequence
atttttgtatttttagtagt

SEQ ID NO: 405759 - DNA, 20 bp, Artificial
  CRISPR gRNA sequence
tttttgtatttttagtagtg

SEQ ID NO: 405760 - DNA, 20 bp, Artificial
  CRISPR gRNA sequence
ttgtatttttagtagtgatg

SEQ ID NO: 405761 - DNA, 20 bp, Artificial
  CRISPR gRNA sequence
tgtatttttagtagtgatgg

SEQ ID NO: 405762 - DNA, 20 bp, Artificial
  CRISPR gRNA sequence
gtatttttagtagtgatggg

SEQ ID NO: 405763 - DNA, 20 bp, Artificial
  CRISPR gRNA sequence
tatttttagtagtgatgggg

SEQ ID NO: 405764 - DNA, 20 bp, Artificial
  CRISPR gRNA sequence
ttagtagtgatggggtttca

SEQ ID NO: 405765 - DNA, 20 bp, Artificial
  CRISPR gRNA sequence
tagtagtgatggggtttcat

SEQ ID NO: 405766 - DNA, 20 bp, Artificial
  CRISPR gRNA sequence
agtagtgatggggtttcatg

SEQ ID NO: 405767 - DNA, 20 bp, Artificial
  CRISPR gRNA sequence
gtagtgatggggtttcatga

SEQ ID NO: 405768 - DNA, 20 bp, Artificial
  CRISPR gRNA sequence
catgatgttggccaggctgg

SEQ ID NO: 405769 - DNA, 20 bp, Artificial
  CRISPR gRNA sequence
atgatgttggccaggctggt

SEQ ID NO: 405770 - DNA, 20 bp, Artificial
  CRISPR gRNA sequence
gccaggctggtctcaaactc

SEQ ID NO: 405771 - DNA, 20 bp, Artificial
  CRISPR gRNA sequence
gtctcaaactcctgacctca

SEQ ID NO: 405772 - DNA, 20 bp, Artificial
  CRISPR gRNA sequence
aaactcctgacctcaggtga

SEQ ID NO: 405773 - DNA, 20 bp, Artificial
  CRISPR gRNA sequence
ctgacctcaggtgatccacc

SEQ ID NO: 405774 - DNA, 20 bp, Artificial
  CRISPR gRNA sequence
acctcaggtgatccacctgc

SEQ ID NO: 405775 - DNA, 20 bp, Artificial
  CRISPR gRNA sequence
aggtgatccacctgcctcgg

SEQ ID NO: 405776 - DNA, 20 bp, Artificial
  CRISPR gRNA sequence
cctcggcctcccaaagtgct

SEQ ID NO: 405777 - DNA, 20 bp, Artificial
  CRISPR gRNA sequence
ggcctcccaaagtgctggga

SEQ ID NO: 405778 - DNA, 20 bp, Artificial
  CRISPR gRNA sequence
ccaaagtgctgggattacag

SEQ ID NO: 405779 - DNA, 20 bp, Artificial
  CRISPR gRNA sequence
ggattacaggcgtgagccac

SEQ ID NO: 405780 - DNA, 20 bp, Artificial
  CRISPR gRNA sequence
caggcgtgagccaccgtgcc

SEQ ID NO: 405781 - DNA, 20 bp, Artificial
  CRISPR gRNA sequence
gccctaatagcttctttagt

SEQ ID NO: 405782 - DNA, 20 bp, Artificial
  CRISPR gRNA sequence
atagcttctttagtacttct

SEQ ID NO: 405783 - DNA, 20 bp, Artificial
  CRISPR gRNA sequence
ctttagtacttctcatgtac

SEQ ID NO: 405784 - DNA, 20 bp, Artificial
  CRISPR gRNA sequence
tttagtacttctcatgtact

SEQ ID NO: 405785 - DNA, 20 bp, Artificial
  CRISPR gRNA sequence
tagtacttctcatgtactag

SEQ ID NO: 405786 - DNA, 20 bp, Artificial
  CRISPR gRNA sequence
agtacttctcatgtactagg

SEQ ID NO: 405787 - DNA, 20 bp, Artificial
  CRISPR gRNA sequence
gtacttctcatgtactaggc

SEQ ID NO: 405788 - DNA, 20 bp, Artificial
  CRISPR gRNA sequence
ctcatgtactaggcccttac

SEQ ID NO: 405789 - DNA, 20 bp, Artificial
  CRISPR gRNA sequence
tcatgtactaggcccttacc

SEQ ID NO: 405790 - DNA, 20 bp, Artificial
  CRISPR gRNA sequence
atgtactaggcccttaccaa

SEQ ID NO: 405791 - DNA, 20 bp, Artificial
  CRISPR gRNA sequence
ggcccttaccaaatattttt

SEQ ID NO: 405792 - DNA, 20 bp, Artificial
  CRISPR gRNA sequence
accaaatatttttgaactga

SEQ ID NO: 405793 - DNA, 20 bp, Artificial
  CRISPR gRNA sequence
ccaaatatttttgaactgaa

SEQ ID NO: 405794 - DNA, 20 bp, Artificial
  CRISPR gRNA sequence
ttgaactgaatttgtaattg

SEQ ID NO: 405795 - DNA, 20 bp, Artificial
  CRISPR gRNA sequence
tgaactgaatttgtaattga

SEQ ID NO: 405796 - DNA, 20 bp, Artificial
  CRISPR gRNA sequence
gaactgaatttgtaattgaa

SEQ ID NO: 405797 - DNA, 20 bp, Artificial
  CRISPR gRNA sequence
aactgaatttgtaattgaag

SEQ ID NO: 405798 - DNA, 20 bp, Artificial
  CRISPR gRNA sequence
aatttgtaattgaagtaggt

SEQ ID NO: 405799 - DNA, 20 bp, Artificial
  CRISPR gRNA sequence
gtaattgaagtaggtgactc

SEQ ID NO: 405800 - DNA, 20 bp, Artificial
  CRISPR gRNA sequence
taattgaagtaggtgactct

SEQ ID NO: 405801 - DNA, 20 bp, Artificial
  CRISPR gRNA sequence
aagtaggtgactctttttgt

SEQ ID NO: 405802 - DNA, 20 bp, Artificial
  CRISPR gRNA sequence
tttttgtaagctctttcagg

SEQ ID NO: 405803 - DNA, 20 bp, Artificial
  CRISPR gRNA sequence
tttgtaagctctttcaggga

SEQ ID NO: 405804 - DNA, 20 bp, Artificial
  CRISPR gRNA sequence
ttgtaagctctttcagggac

SEQ ID NO: 405805 - DNA, 20 bp, Artificial
  CRISPR gRNA sequence
tgtaagctctttcagggacg

SEQ ID NO: 405806 - DNA, 20 bp, Artificial
  CRISPR gRNA sequence
gtaagctctttcagggacgt

SEQ ID NO: 405807 - DNA, 20 bp, Artificial
  CRISPR gRNA sequence
taagctctttcagggacgtg

SEQ ID NO: 405808 - DNA, 20 bp, Artificial
  CRISPR gRNA sequence
tttcagggacgtgatgggtc

SEQ ID NO: 405809 - DNA, 20 bp, Artificial
  CRISPR gRNA sequence
tcagggacgtgatgggtctt

SEQ ID NO: 405810 - DNA, 20 bp, Artificial
  CRISPR gRNA sequence
cagggacgtgatgggtcttg

SEQ ID NO: 405811 - DNA, 20 bp, Artificial
  CRISPR gRNA sequence
agggacgtgatgggtcttgt

SEQ ID NO: 405812 - DNA, 20 bp, Artificial
  CRISPR gRNA sequence
gtcccatcaacattgcctca

SEQ ID NO: 405813 - DNA, 20 bp, Artificial
  CRISPR gRNA sequence
tcccatcaacattgcctcac

SEQ ID NO: 405814 - DNA, 20 bp, Artificial
  CRISPR gRNA sequence
cctcacacatattttacaat

SEQ ID NO: 405815 - DNA, 20 bp, Artificial
  CRISPR gRNA sequence
acacatattttacaatagac

SEQ ID NO: 405816 - DNA, 20 bp, Artificial
  CRISPR gRNA sequence
tacaatagacccttaaaagt

SEQ ID NO: 405817 - DNA, 20 bp, Artificial
  CRISPR gRNA sequence
acaatagacccttaaaagta

SEQ ID NO: 405818 - DNA, 20 bp, Artificial
  CRISPR gRNA sequence
caatagacccttaaaagtag

SEQ ID NO: 405819 - DNA, 20 bp, Artificial
  CRISPR gRNA sequence
aaaagtagatttgtttaatt

SEQ ID NO: 405820 - DNA, 20 bp, Artificial
  CRISPR gRNA sequence
aaagtagatttgtttaattg

SEQ ID NO: 405821 - DNA, 20 bp, Artificial
  CRISPR gRNA sequence
gtttaattgagatgaactca

SEQ ID NO: 405822 - DNA, 20 bp, Artificial
  CRISPR gRNA sequence
tttaattgagatgaactcac

SEQ ID NO: 405823 - DNA, 20 bp, Artificial
  CRISPR gRNA sequence
aattgagatgaactcacctc

SEQ ID NO: 405824 - DNA, 20 bp, Artificial
  CRISPR gRNA sequence
attgagatgaactcacctcc

SEQ ID NO: 405825 - DNA, 20 bp, Artificial
  CRISPR gRNA sequence
agatgaactcacctccatgt

SEQ ID NO: 405826 - DNA, 20 bp, Artificial
  CRISPR gRNA sequence
acctccatgttgaagactaa

SEQ ID NO: 405827 - DNA, 20 bp, Artificial
  CRISPR gRNA sequence
catgttgaagactaaattgg

SEQ ID NO: 405828 - DNA, 20 bp, Artificial
  CRISPR gRNA sequence
aagactaaattggctgtgcc

SEQ ID NO: 405829 - DNA, 20 bp, Artificial
  CRISPR gRNA sequence
aattggctgtgcccttctcc

SEQ ID NO: 405830 - DNA, 20 bp, Artificial
  CRISPR gRNA sequence
gctgtgcccttctccttgct

SEQ ID NO: 405831 - DNA, 20 bp, Artificial
  CRISPR gRNA sequence
tgcccttctccttgcttggt

SEQ ID NO: 405832 - DNA, 20 bp, Artificial
  CRISPR gRNA sequence
ctccttgcttggtgtggctg

SEQ ID NO: 405833 - DNA, 20 bp, Artificial
  CRISPR gRNA sequence
tccttgcttggtgtggctgg

SEQ ID NO: 405834 - DNA, 20 bp, Artificial
  CRISPR gRNA sequence
cttgcttggtgtggctggtg

SEQ ID NO: 405835 - DNA, 20 bp, Artificial
  CRISPR gRNA sequence
gcttggtgtggctggtgagg

SEQ ID NO: 405836 - DNA, 20 bp, Artificial
  CRISPR gRNA sequence
cttggtgtggctggtgaggc

SEQ ID NO: 405837 - DNA, 20 bp, Artificial
  CRISPR gRNA sequence
ggtgtggctggtgaggcaca

SEQ ID NO: 405838 - DNA, 20 bp, Artificial
  CRISPR gRNA sequence
gtgtggctggtgaggcacaa

SEQ ID NO: 405839 - DNA, 20 bp, Artificial
  CRISPR gRNA sequence
gtgaggcacaaatttaatct

SEQ ID NO: 405840 - DNA, 20 bp, Artificial
  CRISPR gRNA sequence
aatctcatatggccttgggt

SEQ ID NO: 405841 - DNA, 20 bp, Artificial
  CRISPR gRNA sequence
atctcatatggccttgggta

SEQ ID NO: 405842 - DNA, 20 bp, Artificial
  CRISPR gRNA sequence
atatggccttgggtaggtgg

SEQ ID NO: 405843 - DNA, 20 bp, Artificial
  CRISPR gRNA sequence
gggtaggtgggttcagtggg

SEQ ID NO: 405844 - DNA, 20 bp, Artificial
  CRISPR gRNA sequence
ggtaggtgggttcagtgggc

SEQ ID NO: 405845 - DNA, 20 bp, Artificial
  CRISPR gRNA sequence
agtgggcagctgacttgttt

SEQ ID NO: 405846 - DNA, 20 bp, Artificial
  CRISPR gRNA sequence
acttgttttcaaggttttag

SEQ ID NO: 405847 - DNA, 20 bp, Artificial
  CRISPR gRNA sequence
gttttcaaggttttagagcc

SEQ ID NO: 405848 - DNA, 20 bp, Artificial
  CRISPR gRNA sequence
ttttcaaggttttagagcca

SEQ ID NO: 405849 - DNA, 20 bp, Artificial
  CRISPR gRNA sequence
tcaaggttttagagccaggg

SEQ ID NO: 405850 - DNA, 20 bp, Artificial
  CRISPR gRNA sequence
caaggttttagagccagggg

SEQ ID NO: 405851 - DNA, 20 bp, Artificial
  CRISPR gRNA sequence
aaggttttagagccaggggc

SEQ ID NO: 405852 - DNA, 20 bp, Artificial
  CRISPR gRNA sequence
tagagccaggggctcttggt

SEQ ID NO: 405853 - DNA, 20 bp, Artificial
  CRISPR gRNA sequence
agagccaggggctcttggtc

SEQ ID NO: 405854 - DNA, 20 bp, Artificial
  CRISPR gRNA sequence
gagccaggggctcttggtca

SEQ ID NO: 405855 - DNA, 20 bp, Artificial
  CRISPR gRNA sequence
ttggtcattataaagctctt

SEQ ID NO: 405856 - DNA, 20 bp, Artificial
  CRISPR gRNA sequence
ggtcattataaagctctttt

SEQ ID NO: 405857 - DNA, 20 bp, Artificial
  CRISPR gRNA sequence
gtcattataaagctcttttg

SEQ ID NO: 405858 - DNA, 20 bp, Artificial
  CRISPR gRNA sequence
taaagctcttttgctcctct

SEQ ID NO: 405859 - DNA, 20 bp, Artificial
  CRISPR gRNA sequence
ttttgctcctctttggagtg

SEQ ID NO: 405860 - DNA, 20 bp, Artificial
  CRISPR gRNA sequence
ttgctcctctttggagtgaa

SEQ ID NO: 405861 - DNA, 20 bp, Artificial
  CRISPR gRNA sequence
tgctcctctttggagtgaat

SEQ ID NO: 405862 - DNA, 20 bp, Artificial
  CRISPR gRNA sequence
gctcctctttggagtgaatt

SEQ ID NO: 405863 - DNA, 20 bp, Artificial
  CRISPR gRNA sequence
ctcctctttggagtgaattc

SEQ ID NO: 405864 - DNA, 20 bp, Artificial
  CRISPR gRNA sequence
ctctttggagtgaattcaaa

SEQ ID NO: 405865 - DNA, 20 bp, Artificial
  CRISPR gRNA sequence
tttggagtgaattcaaacca

SEQ ID NO: 405866 - DNA, 20 bp, Artificial
  CRISPR gRNA sequence
tggagtgaattcaaaccact

SEQ ID NO: 405867 - DNA, 20 bp, Artificial
  CRISPR gRNA sequence
ggagtgaattcaaaccactc

SEQ ID NO: 405868 - DNA, 20 bp, Artificial
  CRISPR gRNA sequence
gagtgaattcaaaccactca

SEQ ID NO: 405869 - DNA, 20 bp, Artificial
  CRISPR gRNA sequence
aaaccactcattttccttca

SEQ ID NO: 405870 - DNA, 20 bp, Artificial
  CRISPR gRNA sequence
attttccttcactataactt

SEQ ID NO: 405871 - DNA, 20 bp, Artificial
  CRISPR gRNA sequence
tccttcactataacttccct

SEQ ID NO: 405872 - DNA, 20 bp, Artificial
  CRISPR gRNA sequence
ccttcactataacttccctc

SEQ ID NO: 405873 - DNA, 20 bp, Artificial
  CRISPR gRNA sequence
cttcactataacttccctct

SEQ ID NO: 405874 - DNA, 20 bp, Artificial
  CRISPR gRNA sequence
cactataacttccctctgtg

SEQ ID NO: 405875 - DNA, 20 bp, Artificial
  CRISPR gRNA sequence
actataacttccctctgtga

SEQ ID NO: 405876 - DNA, 20 bp, Artificial
  CRISPR gRNA sequence
taacttccctctgtgatctc

SEQ ID NO: 405877 - DNA, 20 bp, Artificial
  CRISPR gRNA sequence
ccctctgtgatctcaaagca

SEQ ID NO: 405878 - DNA, 20 bp, Artificial
  CRISPR gRNA sequence
cctctgtgatctcaaagcat

SEQ ID NO: 405879 - DNA, 20 bp, Artificial
  CRISPR gRNA sequence
tgtgatctcaaagcataatc

SEQ ID NO: 405880 - DNA, 20 bp, Artificial
  CRISPR gRNA sequence
tgatctcaaagcataatcaa

SEQ ID NO: 405881 - DNA, 20 bp, Artificial
  CRISPR gRNA sequence
aaagcataatcaacaatgga

SEQ ID NO: 405882 - DNA, 20 bp, Artificial
  CRISPR gRNA sequence
agtattagacaggagactca

SEQ ID NO: 405883 - DNA, 20 bp, Artificial
  CRISPR gRNA sequence
gacaggagactcaatctttg

SEQ ID NO: 405884 - DNA, 20 bp, Artificial
  CRISPR gRNA sequence
aatctttgatccttttcaat

SEQ ID NO: 405885 - DNA, 20 bp, Artificial
  CRISPR gRNA sequence
tgatccttttcaatgactcc

SEQ ID NO: 405886 - DNA, 20 bp, Artificial
  CRISPR gRNA sequence
gatccttttcaatgactccc

SEQ ID NO: 405887 - DNA, 20 bp, Artificial
  CRISPR gRNA sequence
atccttttcaatgactcccc

SEQ ID NO: 405888 - DNA, 20 bp, Artificial
  CRISPR gRNA sequence
ttcaatgactccccccttgt

SEQ ID NO: 405889 - DNA, 20 bp, Artificial
  CRISPR gRNA sequence
tcaatgactccccccttgtc

SEQ ID NO: 405890 - DNA, 20 bp, Artificial
  CRISPR gRNA sequence
caatgactccccccttgtcc

SEQ ID NO: 405891 - DNA, 20 bp, Artificial
  CRISPR gRNA sequence
aatgactccccccttgtcca

SEQ ID NO: 405892 - DNA, 20 bp, Artificial
  CRISPR gRNA sequence
cccccttgtccaagaagctg

SEQ ID NO: 405893 - DNA, 20 bp, Artificial
  CRISPR gRNA sequence
gtccaagaagctgtatgaag

SEQ ID NO: 405894 - DNA, 20 bp, Artificial
  CRISPR gRNA sequence
tccaagaagctgtatgaaga

SEQ ID NO: 405895 - DNA, 20 bp, Artificial
  CRISPR gRNA sequence
tatgaagacttaaagatata

SEQ ID NO: 405896 - DNA, 20 bp, Artificial
  CRISPR gRNA sequence
aaagatatatttatacacat

SEQ ID NO: 405897 - DNA, 20 bp, Artificial
  CRISPR gRNA sequence
aagatatatttatacacata

SEQ ID NO: 405898 - DNA, 20 bp, Artificial
  CRISPR gRNA sequence
atacacataacgcaggtcat

SEQ ID NO: 405899 - DNA, 20 bp, Artificial
  CRISPR gRNA sequence
tacacataacgcaggtcata

SEQ ID NO: 405900 - DNA, 20 bp, Artificial
  CRISPR gRNA sequence
aagttcacaatgatagacga

SEQ ID NO: 405901 - DNA, 20 bp, Artificial
  CRISPR gRNA sequence
acaatgatagacgaaagcac

SEQ ID NO: 405902 - DNA, 20 bp, Artificial
  CRISPR gRNA sequence
ggaaaagtaaactcaaacta

SEQ ID NO: 405903 - DNA, 20 bp, Artificial
  CRISPR gRNA sequence
gaaaagtaaactcaaactat

SEQ ID NO: 405904 - DNA, 20 bp, Artificial
  CRISPR gRNA sequence
aaactatcaacttaactaaa

SEQ ID NO: 405905 - DNA, 20 bp, Artificial
  CRISPR gRNA sequence
tcaacttaactaaactgaca

SEQ ID NO: 405906 - DNA, 20 bp, Artificial
  CRISPR gRNA sequence
aactaaactgacagcgctaa

SEQ ID NO: 405907 - DNA, 20 bp, Artificial
  CRISPR gRNA sequence
actaaactgacagcgctaac

SEQ ID NO: 405908 - DNA, 20 bp, Artificial
  CRISPR gRNA sequence
aactgacagcgctaactcac

SEQ ID NO: 405909 - DNA, 20 bp, Artificial
  CRISPR gRNA sequence
acagcgctaactcactaaaa

SEQ ID NO: 405910 - DNA, 20 bp, Artificial
  CRISPR gRNA sequence
actcactaaaatcaggtagg

SEQ ID NO: 405911 - DNA, 20 bp, Artificial
  CRISPR gRNA sequence
actaaaatcaggtaggagaa

SEQ ID NO: 405912 - DNA, 20 bp, Artificial
  CRISPR gRNA sequence
aaatcaggtaggagaacata

SEQ ID NO: 405913 - DNA, 20 bp, Artificial
  CRISPR gRNA sequence
ctgtgctttatttttaaaaa

SEQ ID NO: 405914 - DNA, 20 bp, Artificial
  CRISPR gRNA sequence
tgctttatttttaaaaaagt

SEQ ID NO: 405915 - DNA, 20 bp, Artificial
  CRISPR gRNA sequence
tatttttaaaaaagtcaaca

SEQ ID NO: 405916 - DNA, 20 bp, Artificial
  CRISPR gRNA sequence
atttttaaaaaagtcaacag

SEQ ID NO: 405917 - DNA, 20 bp, Artificial
  CRISPR gRNA sequence
tttttaaaaaagtcaacagc

SEQ ID NO: 405918 - DNA, 20 bp, Artificial
  CRISPR gRNA sequence
ttaaaaaagtcaacagctgc

SEQ ID NO: 405919 - DNA, 20 bp, Artificial
  CRISPR gRNA sequence
taaaaaagtcaacagctgca

SEQ ID NO: 405920 - DNA, 20 bp, Artificial
  CRISPR gRNA sequence
aaaaaagtcaacagctgcac

SEQ ID NO: 405921 - DNA, 20 bp, Artificial
  CRISPR gRNA sequence
aaaaagtcaacagctgcaca

SEQ ID NO: 405922 - DNA, 20 bp, Artificial
  CRISPR gRNA sequence
cacaagaggcatatcttagg

SEQ ID NO: 405923 - DNA, 20 bp, Artificial
  CRISPR gRNA sequence
aggagcagcactgtaaatga

SEQ ID NO: 405924 - DNA, 20 bp, Artificial
  CRISPR gRNA sequence
ggagcagcactgtaaatgaa

SEQ ID NO: 405925 - DNA, 20 bp, Artificial
  CRISPR gRNA sequence
taaatgaagaggtgcatata

SEQ ID NO: 405926 - DNA, 20 bp, Artificial
  CRISPR gRNA sequence
aaatatgagcataaagtgca

SEQ ID NO: 405927 - DNA, 20 bp, Artificial
  CRISPR gRNA sequence
ggggggtgtgtaacctagct

SEQ ID NO: 405928 - DNA, 20 bp, Artificial
  CRISPR gRNA sequence
gcttgaggaggaggagcaac

SEQ ID NO: 405929 - DNA, 20 bp, Artificial
  CRISPR gRNA sequence
gaggaggaggagcaacccag

SEQ ID NO: 405930 - DNA, 20 bp, Artificial
  CRISPR gRNA sequence
aggaggaggagcaacccagg

SEQ ID NO: 405931 - DNA, 20 bp, Artificial
  CRISPR gRNA sequence
aatggaagaggcagaaagca

SEQ ID NO: 405932 - DNA, 20 bp, Artificial
  CRISPR gRNA sequence
ggggagggagtgtcctggtc

SEQ ID NO: 405933 - DNA, 20 bp, Artificial
  CRISPR gRNA sequence
gtccagagttcagacgtgag

SEQ ID NO: 405934 - DNA, 20 bp, Artificial
  CRISPR gRNA sequence
agacgtgagatggagtgtat

SEQ ID NO: 405935 - DNA, 20 bp, Artificial
  CRISPR gRNA sequence
gaggatctgagaatgagccc

SEQ ID NO: 405936 - DNA, 20 bp, Artificial
  CRISPR gRNA sequence
agaatgagcccaggggcaag

SEQ ID NO: 405937 - DNA, 20 bp, Artificial
  CRISPR gRNA sequence
acacttggagaaaccatgac

SEQ ID NO: 405938 - DNA, 20 bp, Artificial
  CRISPR gRNA sequence
ggagaaaccatgactacttc

SEQ ID NO: 405939 - DNA, 20 bp, Artificial
  CRISPR gRNA sequence
gagaaaccatgactacttct

SEQ ID NO: 405940 - DNA, 20 bp, Artificial
  CRISPR gRNA sequence
cttctattaggccttagaat

SEQ ID NO: 405941 - DNA, 20 bp, Artificial
  CRISPR gRNA sequence
ctattaggccttagaatatg

SEQ ID NO: 405942 - DNA, 20 bp, Artificial
  CRISPR gRNA sequence
tattaggccttagaatatgt

SEQ ID NO: 405943 - DNA, 20 bp, Artificial
  CRISPR gRNA sequence
ttaggccttagaatatgtgc

SEQ ID NO: 405944 - DNA, 20 bp, Artificial
  CRISPR gRNA sequence
ggccttagaatatgtgctga

SEQ ID NO: 405945 - DNA, 20 bp, Artificial
  CRISPR gRNA sequence
agaatatgtgctgagaagtt

SEQ ID NO: 405946 - DNA, 20 bp, Artificial
  CRISPR gRNA sequence
gaatatgtgctgagaagttt

SEQ ID NO: 405947 - DNA, 20 bp, Artificial
  CRISPR gRNA sequence
agaagtttgaattttatcct

SEQ ID NO: 405948 - DNA, 20 bp, Artificial
  CRISPR gRNA sequence
gaattttatcctggaggctt

SEQ ID NO: 405949 - DNA, 20 bp, Artificial
  CRISPR gRNA sequence
aattttatcctggaggcttt

SEQ ID NO: 405950 - DNA, 20 bp, Artificial
  CRISPR gRNA sequence
tatcctggaggctttgggga

SEQ ID NO: 405951 - DNA, 20 bp, Artificial
  CRISPR gRNA sequence
atcctggaggctttggggat

SEQ ID NO: 405952 - DNA, 20 bp, Artificial
  CRISPR gRNA sequence
tcctggaggctttggggata

SEQ ID NO: 405953 - DNA, 20 bp, Artificial
  CRISPR gRNA sequence
gaggctttggggatacatag

SEQ ID NO: 405954 - DNA, 20 bp, Artificial
  CRISPR gRNA sequence
tggggatacatagaatttta

SEQ ID NO: 405955 - DNA, 20 bp, Artificial
  CRISPR gRNA sequence
ggggatacatagaattttaa

SEQ ID NO: 405956 - DNA, 20 bp, Artificial
  CRISPR gRNA sequence
gggatacatagaattttaag

SEQ ID NO: 405957 - DNA, 20 bp, Artificial
  CRISPR gRNA sequence
taagctagggactaataggg

SEQ ID NO: 405958 - DNA, 20 bp, Artificial
  CRISPR gRNA sequence
aagctagggactaatagggc

SEQ ID NO: 405959 - DNA, 20 bp, Artificial
  CRISPR gRNA sequence
agctagggactaatagggcc

SEQ ID NO: 405960 - DNA, 20 bp, Artificial
  CRISPR gRNA sequence
gggactaatagggccagatc

SEQ ID NO: 405961 - DNA, 20 bp, Artificial
  CRISPR gRNA sequence
atagggccagatctgtttta

SEQ ID NO: 405962 - DNA, 20 bp, Artificial
  CRISPR gRNA sequence
ttttacaaagattactctgg

SEQ ID NO: 405963 - DNA, 20 bp, Artificial
  CRISPR gRNA sequence
tacaaagattactctggctg

SEQ ID NO: 405964 - DNA, 20 bp, Artificial
  CRISPR gRNA sequence
acaaagattactctggctgt

SEQ ID NO: 405965 - DNA, 20 bp, Artificial
  CRISPR gRNA sequence
caaagattactctggctgta

SEQ ID NO: 405966 - DNA, 20 bp, Artificial
  CRISPR gRNA sequence
ctctggctgtactatgtaat

SEQ ID NO: 405967 - DNA, 20 bp, Artificial
  CRISPR gRNA sequence
tggctgtactatgtaatgta

SEQ ID NO: 405968 - DNA, 20 bp, Artificial
  CRISPR gRNA sequence
gctgtactatgtaatgtata

SEQ ID NO: 405969 - DNA, 20 bp, Artificial
  CRISPR gRNA sequence
tactatgtaatgtatataga

SEQ ID NO: 405970 - DNA, 20 bp, Artificial
  CRISPR gRNA sequence
tgtaatgtatatagagaatt

SEQ ID NO: 405971 - DNA, 20 bp, Artificial
  CRISPR gRNA sequence
tgacaaggcccttgtcatta

SEQ ID NO: 405972 - DNA, 20 bp, Artificial
  CRISPR gRNA sequence
gtcattaccacctggggaga

SEQ ID NO: 405973 - DNA, 20 bp, Artificial
  CRISPR gRNA sequence
tcattaccacctggggagag

SEQ ID NO: 405974 - DNA, 20 bp, Artificial
  CRISPR gRNA sequence
ccacctggggagaggtgatg

SEQ ID NO: 405975 - DNA, 20 bp, Artificial
  CRISPR gRNA sequence
gggagaggtgatgataagaa

SEQ ID NO: 405976 - DNA, 20 bp, Artificial
  CRISPR gRNA sequence
ttcaagtgggaaagcagaga

SEQ ID NO: 405977 - DNA, 20 bp, Artificial
  CRISPR gRNA sequence
aagtgggaaagcagagaagt

SEQ ID NO: 405978 - DNA, 20 bp, Artificial
  CRISPR gRNA sequence
ttaaggaggaggaagtgaca

SEQ ID NO: 405979 - DNA, 20 bp, Artificial
  CRISPR gRNA sequence
aggaggaggaagtgacagga

SEQ ID NO: 405980 - DNA, 20 bp, Artificial
  CRISPR gRNA sequence
gggtgtgagtgaaatgggag

SEQ ID NO: 405981 - DNA, 20 bp, Artificial
  CRISPR gRNA sequence
ggtgtgagtgaaatgggagg

SEQ ID NO: 405982 - DNA, 20 bp, Artificial
  CRISPR gRNA sequence
ggcttcaaatcttgatagca

SEQ ID NO: 405983 - DNA, 20 bp, Artificial
  CRISPR gRNA sequence
gcttcaaatcttgatagcag

SEQ ID NO: 405984 - DNA, 20 bp, Artificial
  CRISPR gRNA sequence
caaatcttgatagcaggtca

SEQ ID NO: 405985 - DNA, 20 bp, Artificial
  CRISPR gRNA sequence
aaatcttgatagcaggtcat

SEQ ID NO: 405986 - DNA, 20 bp, Artificial
  CRISPR gRNA sequence
gatagcaggtcatgtgggga

SEQ ID NO: 405987 - DNA, 20 bp, Artificial
  CRISPR gRNA sequence
atagcaggtcatgtggggag

SEQ ID NO: 405988 - DNA, 20 bp, Artificial
  CRISPR gRNA sequence
accaagatagagattgtcag

SEQ ID NO: 405989 - DNA, 20 bp, Artificial
  CRISPR gRNA sequence
tcagaaggataccatgtcac

SEQ ID NO: 405990 - DNA, 20 bp, Artificial
  CRISPR gRNA sequence
agaattcgtatgcagaaagt

SEQ ID NO: 405991 - DNA, 20 bp, Artificial
  CRISPR gRNA sequence
gtatgcagaaagttatactg

SEQ ID NO: 405992 - DNA, 20 bp, Artificial
  CRISPR gRNA sequence
tactgctctctcaacatccc

SEQ ID NO: 405993 - DNA, 20 bp, Artificial
  CRISPR gRNA sequence
ctctctcaacatcccttaaa

SEQ ID NO: 405994 - DNA, 20 bp, Artificial
  CRISPR gRNA sequence
tctcaacatcccttaaagca

SEQ ID NO: 405995 - DNA, 20 bp, Artificial
  CRISPR gRNA sequence
tcaacatcccttaaagcaaa

SEQ ID NO: 405996 - DNA, 20 bp, Artificial
  CRISPR gRNA sequence
aacatcccttaaagcaaact

SEQ ID NO: 405997 - DNA, 20 bp, Artificial
  CRISPR gRNA sequence
aaagcaaacttgatgagcat

SEQ ID NO: 405998 - DNA, 20 bp, Artificial
  CRISPR gRNA sequence
aagcaaacttgatgagcata

SEQ ID NO: 405999 - DNA, 20 bp, Artificial
  CRISPR gRNA sequence
gatgagcatataatgagtgc

SEQ ID NO: 406000 - DNA, 20 bp, Artificial
  CRISPR gRNA sequence
atgagcatataatgagtgcc

SEQ ID NO: 406001 - DNA, 20 bp, Artificial
  CRISPR gRNA sequence
ggtgctcatattgagtataa

SEQ ID NO: 406002 - DNA, 20 bp, Artificial
  CRISPR gRNA sequence
atattgagtataagaatctc

SEQ ID NO: 406003 - DNA, 20 bp, Artificial
  CRISPR gRNA sequence
agtataagaatctcgtctgt

SEQ ID NO: 406004 - DNA, 20 bp, Artificial
  CRISPR gRNA sequence
gtctgttcccttatgtacaa

SEQ ID NO: 406005 - DNA, 20 bp, Artificial
  CRISPR gRNA sequence
ttcccttatgtacaaaatgt

SEQ ID NO: 406006 - DNA, 20 bp, Artificial
  CRISPR gRNA sequence
ccttatgtacaaaatgtata

SEQ ID NO: 406007 - DNA, 20 bp, Artificial
  CRISPR gRNA sequence
atgtacaaaatgtataaaaa

SEQ ID NO: 406008 - DNA, 20 bp, Artificial
  CRISPR gRNA sequence
tgtacaaaatgtataaaaag

SEQ ID NO: 406009 - DNA, 20 bp, Artificial
  CRISPR gRNA sequence
atgcccctagtaggttgata

SEQ ID NO: 406010 - DNA, 20 bp, Artificial
  CRISPR gRNA sequence
gtaggttgataccctagtgg

SEQ ID NO: 406011 - DNA, 20 bp, Artificial
  CRISPR gRNA sequence
ataccctagtggatgaaccg

SEQ ID NO: 406012 - DNA, 20 bp, Artificial
  CRISPR gRNA sequence
gtggatgaaccgtgtattta

SEQ ID NO: 406013 - DNA, 20 bp, Artificial
  CRISPR gRNA sequence
agtatgaaagataaagctca

SEQ ID NO: 406014 - DNA, 20 bp, Artificial
  CRISPR gRNA sequence
gtatgaaagataaagctcag

SEQ ID NO: 406015 - DNA, 20 bp, Artificial
  CRISPR gRNA sequence
agatttctagtccaatgact

SEQ ID NO: 406016 - DNA, 20 bp, Artificial
  CRISPR gRNA sequence
ctagtccaatgactcattaa

SEQ ID NO: 406017 - DNA, 20 bp, Artificial
  CRISPR gRNA sequence
tagtccaatgactcattaaa

SEQ ID NO: 406018 - DNA, 20 bp, Artificial
  CRISPR gRNA sequence
gtccaatgactcattaaaaa

SEQ ID NO: 406019 - DNA, 20 bp, Artificial
  CRISPR gRNA sequence
attaaaaaatattgtgtggt

SEQ ID NO: 406020 - DNA, 20 bp, Artificial
  CRISPR gRNA sequence
aaaaatattgtgtggtttga

SEQ ID NO: 406021 - DNA, 20 bp, Artificial
  CRISPR gRNA sequence
tgtggtttgatgcttgtcta

SEQ ID NO: 406022 - DNA, 20 bp, Artificial
  CRISPR gRNA sequence
gatgcttgtctaaacatcag

SEQ ID NO: 406023 - DNA, 20 bp, Artificial
  CRISPR gRNA sequence
atgcttgtctaaacatcagg

SEQ ID NO: 406024 - DNA, 20 bp, Artificial
  CRISPR gRNA sequence
gtctaaacatcaggaaaaca

SEQ ID NO: 406025 - DNA, 20 bp, Artificial
  CRISPR gRNA sequence
tctaaacatcaggaaaacaa

SEQ ID NO: 406026 - DNA, 20 bp, Artificial
  CRISPR gRNA sequence
aacatcaggaaaacaaatat

SEQ ID NO: 406027 - DNA, 20 bp, Artificial
  CRISPR gRNA sequence
tttgtattactttatgaatc

SEQ ID NO: 406028 - DNA, 20 bp, Artificial
  CRISPR gRNA sequence
ttgtattactttatgaatca

SEQ ID NO: 406029 - DNA, 20 bp, Artificial
  CRISPR gRNA sequence
tgtattactttatgaatcaa

SEQ ID NO: 406030 - DNA, 20 bp, Artificial
  CRISPR gRNA sequence
gtattactttatgaatcaaa

SEQ ID NO: 406031 - DNA, 20 bp, Artificial
  CRISPR gRNA sequence
tattactttatgaatcaaac

SEQ ID NO: 406032 - DNA, 20 bp, Artificial
  CRISPR gRNA sequence
ctttatgaatcaaacacatc

SEQ ID NO: 406033 - DNA, 20 bp, Artificial
  CRISPR gRNA sequence
tatgaatcaaacacatcatt

SEQ ID NO: 406034 - DNA, 20 bp, Artificial
  CRISPR gRNA sequence
atgaatcaaacacatcattg

SEQ ID NO: 406035 - DNA, 20 bp, Artificial
  CRISPR gRNA sequence
tgaatcaaacacatcattgt

SEQ ID NO: 406036 - DNA, 20 bp, Artificial
  CRISPR gRNA sequence
tttcttgttgagatgataaa

SEQ ID NO: 406037 - DNA, 20 bp, Artificial
  CRISPR gRNA sequence
cttgttgagatgataaatgt

SEQ ID NO: 406038 - DNA, 20 bp, Artificial
  CRISPR gRNA sequence
ttgttgagatgataaatgtt

SEQ ID NO: 406039 - DNA, 20 bp, Artificial
  CRISPR gRNA sequence
gttgagatgataaatgtttt

SEQ ID NO: 406040 - DNA, 20 bp, Artificial
  CRISPR gRNA sequence
ttgagatgataaatgttttg

SEQ ID NO: 406041 - DNA, 20 bp, Artificial
  CRISPR gRNA sequence
agatgataaatgttttgagt

SEQ ID NO: 406042 - DNA, 20 bp, Artificial
  CRISPR gRNA sequence
tgagtcatggctttccggag

SEQ ID NO: 406043 - DNA, 20 bp, Artificial
  CRISPR gRNA sequence
gagtcatggctttccggagg

SEQ ID NO: 406044 - DNA, 20 bp, Artificial
  CRISPR gRNA sequence
agtcatggctttccggaggg

SEQ ID NO: 406045 - DNA, 20 bp, Artificial
  CRISPR gRNA sequence
tccggagggtattttattca

SEQ ID NO: 406046 - DNA, 20 bp, Artificial
  CRISPR gRNA sequence
ccggagggtattttattcag

SEQ ID NO: 406047 - DNA, 20 bp, Artificial
  CRISPR gRNA sequence
cggagggtattttattcagt

SEQ ID NO: 406048 - DNA, 20 bp, Artificial
  CRISPR gRNA sequence
tattcagtacagattagtct

SEQ ID NO: 406049 - DNA, 20 bp, Artificial
  CRISPR gRNA sequence
attcagtacagattagtctg

SEQ ID NO: 406050 - DNA, 20 bp, Artificial
  CRISPR gRNA sequence
ttcagtacagattagtctga

SEQ ID NO: 406051 - DNA, 20 bp, Artificial
  CRISPR gRNA sequence
agtacagattagtctgacag

SEQ ID NO: 406052 - DNA, 20 bp, Artificial
  CRISPR gRNA sequence
gtctgacagcctatatttta

SEQ ID NO: 406053 - DNA, 20 bp, Artificial
  CRISPR gRNA sequence
acagcctatattttaccttt

SEQ ID NO: 406054 - DNA, 20 bp, Artificial
  CRISPR gRNA sequence
tattttaccttttatttttt

SEQ ID NO: 406055 - DNA, 20 bp, Artificial
  CRISPR gRNA sequence
taccttttattttttaaggt

SEQ ID NO: 406056 - DNA, 20 bp, Artificial
  CRISPR gRNA sequence
accttttattttttaaggtg

SEQ ID NO: 406057 - DNA, 20 bp, Artificial
  CRISPR gRNA sequence
ccttttattttttaaggtgt

SEQ ID NO: 406058 - DNA, 20 bp, Artificial
  CRISPR gRNA sequence
ttattttttaaggtgtattt

SEQ ID NO: 406059 - DNA, 20 bp, Artificial
  CRISPR gRNA sequence
tattttttaaggtgtatttc

SEQ ID NO: 406060 - DNA, 20 bp, Artificial
  CRISPR gRNA sequence
attttttaaggtgtatttca

SEQ ID NO: 406061 - DNA, 20 bp, Artificial
  CRISPR gRNA sequence
ttttttaaggtgtatttcac

SEQ ID NO: 406062 - DNA, 20 bp, Artificial
  CRISPR gRNA sequence
tttaaggtgtatttcacttt

SEQ ID NO: 406063 - DNA, 20 bp, Artificial
  CRISPR gRNA sequence
ttaaggtgtatttcactttc

SEQ ID NO: 406064 - DNA, 20 bp, Artificial
  CRISPR gRNA sequence
taaggtgtatttcactttca

SEQ ID NO: 406065 - DNA, 20 bp, Artificial
  CRISPR gRNA sequence
aaggtgtatttcactttcag

SEQ ID NO: 406066 - DNA, 20 bp, Artificial
  CRISPR gRNA sequence
aggtgtatttcactttcagc

SEQ ID NO: 406067 - DNA, 20 bp, Artificial
  CRISPR gRNA sequence
cactttcagcatccgaacta

SEQ ID NO: 406068 - DNA, 20 bp, Artificial
  CRISPR gRNA sequence
actttcagcatccgaactat

SEQ ID NO: 406069 - DNA, 20 bp, Artificial
  CRISPR gRNA sequence
tcagcatccgaactatattt

SEQ ID NO: 406070 - DNA, 20 bp, Artificial
  CRISPR gRNA sequence
cagcatccgaactatatttt

SEQ ID NO: 406071 - DNA, 20 bp, Artificial
  CRISPR gRNA sequence
agcatccgaactatattttg

SEQ ID NO: 406072 - DNA, 20 bp, Artificial
  CRISPR gRNA sequence
tattttgggagaggaaatag

SEQ ID NO: 406073 - DNA, 20 bp, Artificial
  CRISPR gRNA sequence
tgggagaggaaatagaggga

SEQ ID NO: 406074 - DNA, 20 bp, Artificial
  CRISPR gRNA sequence
gggagaggaaatagagggat

SEQ ID NO: 406075 - DNA, 20 bp, Artificial
  CRISPR gRNA sequence
ggagaggaaatagagggatg

SEQ ID NO: 406076 - DNA, 20 bp, Artificial
  CRISPR gRNA sequence
gatggtcaatgtcatactaa

SEQ ID NO: 406077 - DNA, 20 bp, Artificial
  CRISPR gRNA sequence
aattattctttaggactaga

SEQ ID NO: 406078 - DNA, 20 bp, Artificial
  CRISPR gRNA sequence
ttctttaggactagagcatt

SEQ ID NO: 406079 - DNA, 20 bp, Artificial
  CRISPR gRNA sequence
tttaggactagagcattctt

SEQ ID NO: 406080 - DNA, 20 bp, Artificial
  CRISPR gRNA sequence
taggactagagcattcttaa

SEQ ID NO: 406081 - DNA, 20 bp, Artificial
  CRISPR gRNA sequence
aggactagagcattcttaaa

SEQ ID NO: 406082 - DNA, 20 bp, Artificial
  CRISPR gRNA sequence
ggactagagcattcttaaat

SEQ ID NO: 406083 - DNA, 20 bp, Artificial
  CRISPR gRNA sequence
gagcattcttaaattctatt

SEQ ID NO: 406084 - DNA, 20 bp, Artificial
  CRISPR gRNA sequence
ttaaattctattatttaaaa

SEQ ID NO: 406085 - DNA, 20 bp, Artificial
  CRISPR gRNA sequence
aaattctattatttaaaatt

SEQ ID NO: 406086 - DNA, 20 bp, Artificial
  CRISPR gRNA sequence
aattctattatttaaaattg

SEQ ID NO: 406087 - DNA, 20 bp, Artificial
  CRISPR gRNA sequence
tattatttaaaattggtttt

SEQ ID NO: 406088 - DNA, 20 bp, Artificial
  CRISPR gRNA sequence
ttatttaaaattggttttgt

SEQ ID NO: 406089 - DNA, 20 bp, Artificial
  CRISPR gRNA sequence
tttaaaattggttttgtctt

SEQ ID NO: 406090 - DNA, 20 bp, Artificial
  CRISPR gRNA sequence
aaaattggttttgtcttgtt

SEQ ID NO: 406091 - DNA, 20 bp, Artificial
  CRISPR gRNA sequence
aaattggttttgtcttgtta

SEQ ID NO: 406092 - DNA, 20 bp, Artificial
  CRISPR gRNA sequence
gttttgtcttgttactctta

SEQ ID NO: 406093 - DNA, 20 bp, Artificial
  CRISPR gRNA sequence
tgtcttgttactcttacatg

SEQ ID NO: 406094 - DNA, 20 bp, Artificial
  CRISPR gRNA sequence
gtcttgttactcttacatga

SEQ ID NO: 406095 - DNA, 20 bp, Artificial
  CRISPR gRNA sequence
tcttgttactcttacatgat

SEQ ID NO: 406096 - DNA, 20 bp, Artificial
  CRISPR gRNA sequence
gttactcttacatgatttta

SEQ ID NO: 406097 - DNA, 20 bp, Artificial
  CRISPR gRNA sequence
ttactcttacatgattttat

SEQ ID NO: 406098 - DNA, 20 bp, Artificial
  CRISPR gRNA sequence
ctcttacatgattttataag

SEQ ID NO: 406099 - DNA, 20 bp, Artificial
  CRISPR gRNA sequence
ttacatgattttataagtaa

SEQ ID NO: 406100 - DNA, 20 bp, Artificial
  CRISPR gRNA sequence
acatgattttataagtaacc

SEQ ID NO: 406101 - DNA, 20 bp, Artificial
  CRISPR gRNA sequence
catgattttataagtaacca

SEQ ID NO: 406102 - DNA, 20 bp, Artificial
  CRISPR gRNA sequence
tataagtaaccacacaccaa

SEQ ID NO: 406103 - DNA, 20 bp, Artificial
  CRISPR gRNA sequence
ataagtaaccacacaccaaa

SEQ ID NO: 406104 - DNA, 20 bp, Artificial
  CRISPR gRNA sequence
taagtaaccacacaccaaat

SEQ ID NO: 406105 - DNA, 20 bp, Artificial
  CRISPR gRNA sequence
atcttttcctgaaatataca

SEQ ID NO: 406106 - DNA, 20 bp, Artificial
  CRISPR gRNA sequence
ttcctgaaatatacattgaa

SEQ ID NO: 406107 - DNA, 20 bp, Artificial
  CRISPR gRNA sequence
tcctgaaatatacattgaag

SEQ ID NO: 406108 - DNA, 20 bp, Artificial
  CRISPR gRNA sequence
cctgaaatatacattgaagt

SEQ ID NO: 406109 - DNA, 20 bp, Artificial
  CRISPR gRNA sequence
ctgaaatatacattgaagtt

SEQ ID NO: 406110 - DNA, 20 bp, Artificial
  CRISPR gRNA sequence
aaatatacattgaagttttt

SEQ ID NO: 406111 - DNA, 20 bp, Artificial
  CRISPR gRNA sequence
aagtttttagttttgtttgt

SEQ ID NO: 406112 - DNA, 20 bp, Artificial
  CRISPR gRNA sequence
ttagttttgtttgtggtata

SEQ ID NO: 406113 - DNA, 20 bp, Artificial
  CRISPR gRNA sequence
tagttttgtttgtggtatat

SEQ ID NO: 406114 - DNA, 20 bp, Artificial
  CRISPR gRNA sequence
agttttgtttgtggtatatt

SEQ ID NO: 406115 - DNA, 20 bp, Artificial
  CRISPR gRNA sequence
gttttgtttgtggtatatta

SEQ ID NO: 406116 - DNA, 20 bp, Artificial
  CRISPR gRNA sequence
tgtttgtggtatattacaaa

SEQ ID NO: 406117 - DNA, 20 bp, Artificial
  CRISPR gRNA sequence
gtttgtggtatattacaaat

SEQ ID NO: 406118 - DNA, 20 bp, Artificial
  CRISPR gRNA sequence
tttgtggtatattacaaata

SEQ ID NO: 406119 - DNA, 20 bp, Artificial
  CRISPR gRNA sequence
gtggtatattacaaataaat

SEQ ID NO: 406120 - DNA, 20 bp, Artificial
  CRISPR gRNA sequence
tggtatattacaaataaatc

SEQ ID NO: 406121 - DNA, 20 bp, Artificial
  CRISPR gRNA sequence
caaataaatcacaaatcagt

SEQ ID NO: 406122 - DNA, 20 bp, Artificial
  CRISPR gRNA sequence
tgtggttatctctggttgct

SEQ ID NO: 406123 - DNA, 20 bp, Artificial
  CRISPR gRNA sequence
tctctggttgctgaaatcat

SEQ ID NO: 406124 - DNA, 20 bp, Artificial
  CRISPR gRNA sequence
tggttgctgaaatcatcagt

SEQ ID NO: 406125 - DNA, 20 bp, Artificial
  CRISPR gRNA sequence
gttgctgaaatcatcagtga

SEQ ID NO: 406126 - DNA, 20 bp, Artificial
  CRISPR gRNA sequence
ctgaaatcatcagtgattta

SEQ ID NO: 406127 - DNA, 20 bp, Artificial
  CRISPR gRNA sequence
aaatcatcagtgatttattt

SEQ ID NO: 406128 - DNA, 20 bp, Artificial
  CRISPR gRNA sequence
atttatttgcatcacttaga

SEQ ID NO: 406129 - DNA, 20 bp, Artificial
  CRISPR gRNA sequence
tttatttgcatcacttagat

SEQ ID NO: 406130 - DNA, 20 bp, Artificial
  CRISPR gRNA sequence
atttgcatcacttagatgtc

SEQ ID NO: 406131 - DNA, 20 bp, Artificial
  CRISPR gRNA sequence
tttgcatcacttagatgtct

SEQ ID NO: 406132 - DNA, 20 bp, Artificial
  CRISPR gRNA sequence
gcatcacttagatgtctaat

SEQ ID NO: 406133 - DNA, 20 bp, Artificial
  CRISPR gRNA sequence
catcacttagatgtctaatt

SEQ ID NO: 406134 - DNA, 20 bp, Artificial
  CRISPR gRNA sequence
agatgtctaatttaaacctg

SEQ ID NO: 406135 - DNA, 20 bp, Artificial
  CRISPR gRNA sequence
gatgtctaatttaaacctgc

SEQ ID NO: 406136 - DNA, 20 bp, Artificial
  CRISPR gRNA sequence
atttaaacctgcgagtaaat

SEQ ID NO: 406137 - DNA, 20 bp, Artificial
  CRISPR gRNA sequence
aaacctgcgagtaaattatt

SEQ ID NO: 406138 - DNA, 20 bp, Artificial
  CRISPR gRNA sequence
aacctgcgagtaaattattt

SEQ ID NO: 406139 - DNA, 20 bp, Artificial
  CRISPR gRNA sequence
cgagtaaattatttttgctg

SEQ ID NO: 406140 - DNA, 20 bp, Artificial
  CRISPR gRNA sequence
tttttgctgtaaaatgcaat

SEQ ID NO: 406141 - DNA, 20 bp, Artificial
  CRISPR gRNA sequence
ttgctgtaaaatgcaattga

SEQ ID NO: 406142 - DNA, 20 bp, Artificial
  CRISPR gRNA sequence
tgctgtaaaatgcaattgaa

SEQ ID NO: 406143 - DNA, 20 bp, Artificial
  CRISPR gRNA sequence
gctgtaaaatgcaattgaat

SEQ ID NO: 406144 - DNA, 20 bp, Artificial
  CRISPR gRNA sequence
ctgtaaaatgcaattgaatc

SEQ ID NO: 406145 - DNA, 20 bp, Artificial
  CRISPR gRNA sequence
taaaatgcaattgaatctat

SEQ ID NO: 406146 - DNA, 20 bp, Artificial
  CRISPR gRNA sequence
aatctattgacaggcaaaaa

SEQ ID NO: 406147 - DNA, 20 bp, Artificial
  CRISPR gRNA sequence
ttgacaggcaaaaaatatgc

SEQ ID NO: 406148 - DNA, 20 bp, Artificial
  CRISPR gRNA sequence
acaggcaaaaaatatgcttt

SEQ ID NO: 406149 - DNA, 20 bp, Artificial
  CRISPR gRNA sequence
tgttctcttaactgttattc

SEQ ID NO: 406150 - DNA, 20 bp, Artificial
  CRISPR gRNA sequence
gttctcttaactgttattct

SEQ ID NO: 406151 - DNA, 20 bp, Artificial
  CRISPR gRNA sequence
ttctcttaactgttattcta

SEQ ID NO: 406152 - DNA, 20 bp, Artificial
  CRISPR gRNA sequence
tcttaactgttattctacag

SEQ ID NO: 406153 - DNA, 20 bp, Artificial
  CRISPR gRNA sequence
ttaactgttattctacagta

SEQ ID NO: 406154 - DNA, 20 bp, Artificial
  CRISPR gRNA sequence
aactgttattctacagtaat

SEQ ID NO: 406155 - DNA, 20 bp, Artificial
  CRISPR gRNA sequence
actgttattctacagtaata

SEQ ID NO: 406156 - DNA, 20 bp, Artificial
  CRISPR gRNA sequence
ttattctacagtaatatacc

SEQ ID NO: 406157 - DNA, 20 bp, Artificial
  CRISPR gRNA sequence
ttctacagtaatatacctct

SEQ ID NO: 406158 - DNA, 20 bp, Artificial
  CRISPR gRNA sequence
tacagtaatatacctctgaa

SEQ ID NO: 406159 - DNA, 20 bp, Artificial
  CRISPR gRNA sequence
cagtaatatacctctgaaat

SEQ ID NO: 406160 - DNA, 20 bp, Artificial
  CRISPR gRNA sequence
tgaaatgaaatagcacaact

SEQ ID NO: 406161 - DNA, 20 bp, Artificial
  CRISPR gRNA sequence
aaatgaaatagcacaactgc

SEQ ID NO: 406162 - DNA, 20 bp, Artificial
  CRISPR gRNA sequence
caataaacctcacattaggg

SEQ ID NO: 406163 - DNA, 20 bp, Artificial
  CRISPR gRNA sequence
acattagggtatatctgtaa

SEQ ID NO: 406164 - DNA, 20 bp, Artificial
  CRISPR gRNA sequence
gggtatatctgtaatcatta

SEQ ID NO: 406165 - DNA, 20 bp, Artificial
  CRISPR gRNA sequence
taatcattaccactggctct

SEQ ID NO: 406166 - DNA, 20 bp, Artificial
  CRISPR gRNA sequence
ccactggctctggcacatcc

SEQ ID NO: 406167 - DNA, 20 bp, Artificial
  CRISPR gRNA sequence
gctctggcacatcctgtgat

SEQ ID NO: 406168 - DNA, 20 bp, Artificial
  CRISPR gRNA sequence
tggcacatcctgtgatttga

SEQ ID NO: 406169 - DNA, 20 bp, Artificial
  CRISPR gRNA sequence
gcacatcctgtgatttgatt

SEQ ID NO: 406170 - DNA, 20 bp, Artificial
  CRISPR gRNA sequence
tgatttgattctgatcccca

SEQ ID NO: 406171 - DNA, 20 bp, Artificial
  CRISPR gRNA sequence
gattctgatccccaaatttt

SEQ ID NO: 406172 - DNA, 20 bp, Artificial
  CRISPR gRNA sequence
attctgatccccaaatttta

SEQ ID NO: 406173 - DNA, 20 bp, Artificial
  CRISPR gRNA sequence
tgatccccaaattttatggc

SEQ ID NO: 406174 - DNA, 20 bp, Artificial
  CRISPR gRNA sequence
atccccaaattttatggctt

SEQ ID NO: 406175 - DNA, 20 bp, Artificial
  CRISPR gRNA sequence
tatggcttttttgttttgtt

SEQ ID NO: 406176 - DNA, 20 bp, Artificial
  CRISPR gRNA sequence
atggcttttttgttttgttt

SEQ ID NO: 406177 - DNA, 20 bp, Artificial
  CRISPR gRNA sequence
tggcttttttgttttgtttt

SEQ ID NO: 406178 - DNA, 20 bp, Artificial
  CRISPR gRNA sequence
ttttgttttgttttgctttt

SEQ ID NO: 406179 - DNA, 20 bp, Artificial
  CRISPR gRNA sequence
tttgttttgttttgctttta

SEQ ID NO: 406180 - DNA, 20 bp, Artificial
  CRISPR gRNA sequence
ttgttttgttttgcttttaa

SEQ ID NO: 406181 - DNA, 20 bp, Artificial
  CRISPR gRNA sequence
tgttttgttttgcttttaaa

SEQ ID NO: 406182 - DNA, 20 bp, Artificial
  CRISPR gRNA sequence
gttttgttttgcttttaaaa

SEQ ID NO: 406183 - DNA, 20 bp, Artificial
  CRISPR gRNA sequence
ttttgttttgcttttaaaag

SEQ ID NO: 406184 - DNA, 20 bp, Artificial
  CRISPR gRNA sequence
tgttttgcttttaaaagaca

SEQ ID NO: 406185 - DNA, 20 bp, Artificial
  CRISPR gRNA sequence
gttttgcttttaaaagacaa

SEQ ID NO: 406186 - DNA, 20 bp, Artificial
  CRISPR gRNA sequence
ttttgcttttaaaagacaaa

SEQ ID NO: 406187 - DNA, 20 bp, Artificial
  CRISPR gRNA sequence
tgcttttaaaagacaaacct

SEQ ID NO: 406188 - DNA, 20 bp, Artificial
  CRISPR gRNA sequence
gcttttaaaagacaaaccta

SEQ ID NO: 406189 - DNA, 20 bp, Artificial
  CRISPR gRNA sequence
cttttaaaagacaaacctat

SEQ ID NO: 406190 - DNA, 20 bp, Artificial
  CRISPR gRNA sequence
ttaaaagacaaacctataaa

SEQ ID NO: 406191 - DNA, 20 bp, Artificial
  CRISPR gRNA sequence
taaaagacaaacctataaat

SEQ ID NO: 406192 - DNA, 20 bp, Artificial
  CRISPR gRNA sequence
aaaagacaaacctataaatg

SEQ ID NO: 406193 - DNA, 20 bp, Artificial
  CRISPR gRNA sequence
aaagacaaacctataaatgt

SEQ ID NO: 406194 - DNA, 20 bp, Artificial
  CRISPR gRNA sequence
taaatgtgaaaaatgtaatt

SEQ ID NO: 406195 - DNA, 20 bp, Artificial
  CRISPR gRNA sequence
caagacagtagagttaggaa

SEQ ID NO: 406196 - DNA, 20 bp, Artificial
  CRISPR gRNA sequence
ggaagccattatgaaggcaa

SEQ ID NO: 406197 - DNA, 20 bp, Artificial
  CRISPR gRNA sequence
tgaaggcaattgtagaggaa

SEQ ID NO: 406198 - DNA, 20 bp, Artificial
  CRISPR gRNA sequence
tagaggaaaattgagagtgt

SEQ ID NO: 406199 - DNA, 20 bp, Artificial
  CRISPR gRNA sequence
agagtgtaaaatgataactt

SEQ ID NO: 406200 - DNA, 20 bp, Artificial
  CRISPR gRNA sequence
taaaatatttaaaattatgg

SEQ ID NO: 406201 - DNA, 20 bp, Artificial
  CRISPR gRNA sequence
aaaatatttaaaattatgga

SEQ ID NO: 406202 - DNA, 20 bp, Artificial
  CRISPR gRNA sequence
aaatatttaaaattatggag

SEQ ID NO: 406203 - DNA, 20 bp, Artificial
  CRISPR gRNA sequence
aaaattatggaggtggaaat

SEQ ID NO: 406204 - DNA, 20 bp, Artificial
  CRISPR gRNA sequence
aaattatggaggtggaaatt

SEQ ID NO: 406205 - DNA, 20 bp, Artificial
  CRISPR gRNA sequence
tggaggtggaaattaaattg

SEQ ID NO: 406206 - DNA, 20 bp, Artificial
  CRISPR gRNA sequence
aattgcagacttcggggaag

SEQ ID NO: 406207 - DNA, 20 bp, Artificial
  CRISPR gRNA sequence
cagacttcggggaagtgcgt

SEQ ID NO: 406208 - DNA, 20 bp, Artificial
  CRISPR gRNA sequence
cggggaagtgcgtactatgc

SEQ ID NO: 406209 - DNA, 20 bp, Artificial
  CRISPR gRNA sequence
ggggaagtgcgtactatgca

SEQ ID NO: 406210 - DNA, 20 bp, Artificial
  CRISPR gRNA sequence
tgcaggggaaatggaagtca

SEQ ID NO: 406211 - DNA, 20 bp, Artificial
  CRISPR gRNA sequence
acttagaaaaagagtgtgta

SEQ ID NO: 406212 - DNA, 20 bp, Artificial
  CRISPR gRNA sequence
agaaaaagagtgtgtagtga

SEQ ID NO: 406213 - DNA, 20 bp, Artificial
  CRISPR gRNA sequence
gaaaaagagtgtgtagtgag

SEQ ID NO: 406214 - DNA, 20 bp, Artificial
  CRISPR gRNA sequence
agcttaaatatttcaaagca

SEQ ID NO: 406215 - DNA, 20 bp, Artificial
  CRISPR gRNA sequence
aaatatttcaaagcaactat

SEQ ID NO: 406216 - DNA, 20 bp, Artificial
  CRISPR gRNA sequence
aatatttcaaagcaactatt

SEQ ID NO: 406217 - DNA, 20 bp, Artificial
  CRISPR gRNA sequence
caaagcaactatttcaatta

SEQ ID NO: 406218 - DNA, 20 bp, Artificial
  CRISPR gRNA sequence
aaagcaactatttcaattag

SEQ ID NO: 406219 - DNA, 20 bp, Artificial
  CRISPR gRNA sequence
tttcaattagtttccgcatt

SEQ ID NO: 406220 - DNA, 20 bp, Artificial
  CRISPR gRNA sequence
caattagtttccgcatttaa

SEQ ID NO: 406221 - DNA, 20 bp, Artificial
  CRISPR gRNA sequence
aattagtttccgcatttaaa

SEQ ID NO: 406222 - DNA, 20 bp, Artificial
  CRISPR gRNA sequence
gtttccgcatttaaaaaatg

SEQ ID NO: 406223 - DNA, 20 bp, Artificial
  CRISPR gRNA sequence
ccgcatttaaaaaatggcgc

SEQ ID NO: 406224 - DNA, 20 bp, Artificial
  CRISPR gRNA sequence
cgcatttaaaaaatggcgcg

SEQ ID NO: 406225 - DNA, 20 bp, Artificial
  CRISPR gRNA sequence
aaaaaatggcgcgtagcaat

SEQ ID NO: 406226 - DNA, 20 bp, Artificial
  CRISPR gRNA sequence
aaaaatggcgcgtagcaata

SEQ ID NO: 406227 - DNA, 20 bp, Artificial
  CRISPR gRNA sequence
ataggaagcatatttatcta

SEQ ID NO: 406228 - DNA, 20 bp, Artificial
  CRISPR gRNA sequence
atctaagttctttctgacct

SEQ ID NO: 406229 - DNA, 20 bp, Artificial
  CRISPR gRNA sequence
tctaagttctttctgaccta

SEQ ID NO: 406230 - DNA, 20 bp, Artificial
  CRISPR gRNA sequence
agttctttctgacctagctt

SEQ ID NO: 406231 - DNA, 20 bp, Artificial
  CRISPR gRNA sequence
tttctgacctagcttccaaa

SEQ ID NO: 406232 - DNA, 20 bp, Artificial
  CRISPR gRNA sequence
tctgacctagcttccaaagg

SEQ ID NO: 406233 - DNA, 20 bp, Artificial
  CRISPR gRNA sequence
ctgacctagcttccaaaggt

SEQ ID NO: 406234 - DNA, 20 bp, Artificial
  CRISPR gRNA sequence
tgacctagcttccaaaggta

SEQ ID NO: 406235 - DNA, 20 bp, Artificial
  CRISPR gRNA sequence
acctagcttccaaaggtata

SEQ ID NO: 406236 - DNA, 20 bp, Artificial
  CRISPR gRNA sequence
gcttccaaaggtatatttga

SEQ ID NO: 406237 - DNA, 20 bp, Artificial
  CRISPR gRNA sequence
ccaaaggtatatttgagaac

SEQ ID NO: 406238 - DNA, 20 bp, Artificial
  CRISPR gRNA sequence
caaaggtatatttgagaact

SEQ ID NO: 406239 - DNA, 20 bp, Artificial
  CRISPR gRNA sequence
gagaactaactgtaatctgg

SEQ ID NO: 406240 - DNA, 20 bp, Artificial
  CRISPR gRNA sequence
agaactaactgtaatctgga

SEQ ID NO: 406241 - DNA, 20 bp, Artificial
  CRISPR gRNA sequence
actgtaatctggaaaagaat

SEQ ID NO: 406242 - DNA, 20 bp, Artificial
  CRISPR gRNA sequence
taatctggaaaagaattgtt

SEQ ID NO: 406243 - DNA, 20 bp, Artificial
  CRISPR gRNA sequence
gaaaagaattgtttgttttc

SEQ ID NO: 406244 - DNA, 20 bp, Artificial
  CRISPR gRNA sequence
tttgttttctccatttcatc

SEQ ID NO: 406245 - DNA, 20 bp, Artificial
  CRISPR gRNA sequence
gttttctccatttcatcttt

SEQ ID NO: 406246 - DNA, 20 bp, Artificial
  CRISPR gRNA sequence
ttttctccatttcatctttg

SEQ ID NO: 406247 - DNA, 20 bp, Artificial
  CRISPR gRNA sequence
tctccatttcatctttgctt

SEQ ID NO: 406248 - DNA, 20 bp, Artificial
  CRISPR gRNA sequence
ctccatttcatctttgcttc

SEQ ID NO: 406249 - DNA, 20 bp, Artificial
  CRISPR gRNA sequence
tccatttcatctttgcttcc

SEQ ID NO: 406250 - DNA, 20 bp, Artificial
  CRISPR gRNA sequence
catttcatctttgcttccag

SEQ ID NO: 406251 - DNA, 20 bp, Artificial
  CRISPR gRNA sequence
catctttgcttccagtgttt

SEQ ID NO: 406252 - DNA, 20 bp, Artificial
  CRISPR gRNA sequence
atctttgcttccagtgttta

SEQ ID NO: 406253 - DNA, 20 bp, Artificial
  CRISPR gRNA sequence
tgcttccagtgtttacaatt

SEQ ID NO: 406254 - DNA, 20 bp, Artificial
  CRISPR gRNA sequence
gcttccagtgtttacaattt

SEQ ID NO: 406255 - DNA, 20 bp, Artificial
  CRISPR gRNA sequence
cttccagtgtttacaatttt

SEQ ID NO: 406256 - DNA, 20 bp, Artificial
  CRISPR gRNA sequence
ccagtgtttacaattttaat

SEQ ID NO: 406257 - DNA, 20 bp, Artificial
  CRISPR gRNA sequence
cagtgtttacaattttaatg

SEQ ID NO: 406258 - DNA, 20 bp, Artificial
  CRISPR gRNA sequence
acaattttaatggggctgtt

SEQ ID NO: 406259 - DNA, 20 bp, Artificial
  CRISPR gRNA sequence
caattttaatggggctgtta

SEQ ID NO: 406260 - DNA, 20 bp, Artificial
  CRISPR gRNA sequence
taatggggctgttagatgaa

SEQ ID NO: 406261 - DNA, 20 bp, Artificial
  CRISPR gRNA sequence
aatggggctgttagatgaat

SEQ ID NO: 406262 - DNA, 20 bp, Artificial
  CRISPR gRNA sequence
atggggctgttagatgaatt

SEQ ID NO: 406263 - DNA, 20 bp, Artificial
  CRISPR gRNA sequence
ttagatgaattctggcaaat

SEQ ID NO: 406264 - DNA, 20 bp, Artificial
  CRISPR gRNA sequence
gatgaattctggcaaatgga

SEQ ID NO: 406265 - DNA, 20 bp, Artificial
  CRISPR gRNA sequence
tggcaaatggagaaccatgg

SEQ ID NO: 406266 - DNA, 20 bp, Artificial
  CRISPR gRNA sequence
gcaaatggagaaccatggca

SEQ ID NO: 406267 - DNA, 20 bp, Artificial
  CRISPR gRNA sequence
aggacctttggttagttata

SEQ ID NO: 406268 - DNA, 20 bp, Artificial
  CRISPR gRNA sequence
tggttagttatattaacatt

SEQ ID NO: 406269 - DNA, 20 bp, Artificial
  CRISPR gRNA sequence
ggttagttatattaacattg

SEQ ID NO: 406270 - DNA, 20 bp, Artificial
  CRISPR gRNA sequence
gttagttatattaacattga

SEQ ID NO: 406271 - DNA, 20 bp, Artificial
  CRISPR gRNA sequence
gttatattaacattgaattc

SEQ ID NO: 406272 - DNA, 20 bp, Artificial
  CRISPR gRNA sequence
tattaacattgaattcattt

SEQ ID NO: 406273 - DNA, 20 bp, Artificial
  CRISPR gRNA sequence
acattgaattcatttattag

SEQ ID NO: 406274 - DNA, 20 bp, Artificial
  CRISPR gRNA sequence
aattcatttattagattaaa

SEQ ID NO: 406275 - DNA, 20 bp, Artificial
  CRISPR gRNA sequence
atttattagattaaaaatac

SEQ ID NO: 406276 - DNA, 20 bp, Artificial
  CRISPR gRNA sequence
attagattaaaaatacatca

SEQ ID NO: 406277 - DNA, 20 bp, Artificial
  CRISPR gRNA sequence
ttagattaaaaatacatcat

SEQ ID NO: 406278 - DNA, 20 bp, Artificial
  CRISPR gRNA sequence
gattaaaaatacatcatatg

SEQ ID NO: 406279 - DNA, 20 bp, Artificial
  CRISPR gRNA sequence
aaaatacatcatatggactc

SEQ ID NO: 406280 - DNA, 20 bp, Artificial
  CRISPR gRNA sequence
tttgatcatttgctaaagtg

SEQ ID NO: 406281 - DNA, 20 bp, Artificial
  CRISPR gRNA sequence
tgatcatttgctaaagtgta

SEQ ID NO: 406282 - DNA, 20 bp, Artificial
  CRISPR gRNA sequence
gatcatttgctaaagtgtat

SEQ ID NO: 406283 - DNA, 20 bp, Artificial
  CRISPR gRNA sequence
atcatttgctaaagtgtata

SEQ ID NO: 406284 - DNA, 20 bp, Artificial
  CRISPR gRNA sequence
gctaaagtgtatatgcattt

SEQ ID NO: 406285 - DNA, 20 bp, Artificial
  CRISPR gRNA sequence
ctaaagtgtatatgcatttc

SEQ ID NO: 406286 - DNA, 20 bp, Artificial
  CRISPR gRNA sequence
aagtgtatatgcatttctgc

SEQ ID NO: 406287 - DNA, 20 bp, Artificial
  CRISPR gRNA sequence
ctgcatatttttactcattc

SEQ ID NO: 406288 - DNA, 20 bp, Artificial
  CRISPR gRNA sequence
tgcatatttttactcattct

SEQ ID NO: 406289 - DNA, 20 bp, Artificial
  CRISPR gRNA sequence
catatttttactcattctgc

SEQ ID NO: 406290 - DNA, 20 bp, Artificial
  CRISPR gRNA sequence
ttactcattctgctactaat

SEQ ID NO: 406291 - DNA, 20 bp, Artificial
  CRISPR gRNA sequence
tactcattctgctactaata

SEQ ID NO: 406292 - DNA, 20 bp, Artificial
  CRISPR gRNA sequence
actcattctgctactaataa

SEQ ID NO: 406293 - DNA, 20 bp, Artificial
  CRISPR gRNA sequence
ctcattctgctactaataaa

SEQ ID NO: 406294 - DNA, 20 bp, Artificial
  CRISPR gRNA sequence
attctgctactaataaagca

SEQ ID NO: 406295 - DNA, 20 bp, Artificial
  CRISPR gRNA sequence
tgctactaataaagcaaata

SEQ ID NO: 406296 - DNA, 20 bp, Artificial
  CRISPR gRNA sequence
ctactaataaagcaaatagc

SEQ ID NO: 406297 - DNA, 20 bp, Artificial
  CRISPR gRNA sequence
ctaataaagcaaatagcaat

SEQ ID NO: 406298 - DNA, 20 bp, Artificial
  CRISPR gRNA sequence
ataaagcaaatagcaatgat

SEQ ID NO: 406299 - DNA, 20 bp, Artificial
  CRISPR gRNA sequence
tcaaccctatcagatccaat

SEQ ID NO: 406300 - DNA, 20 bp, Artificial
  CRISPR gRNA sequence
tcagatccaatgttctcttc

SEQ ID NO: 406301 - DNA, 20 bp, Artificial
  CRISPR gRNA sequence
tcttctgtaataaatacttt

SEQ ID NO: 406302 - DNA, 20 bp, Artificial
  CRISPR gRNA sequence
ttctgtaataaatactttat

SEQ ID NO: 406303 - DNA, 20 bp, Artificial
  CRISPR gRNA sequence
ctgtaataaatactttataa

SEQ ID NO: 406304 - DNA, 20 bp, Artificial
  CRISPR gRNA sequence
tgtaataaatactttataag

SEQ ID NO: 406305 - DNA, 20 bp, Artificial
  CRISPR gRNA sequence
taataaatactttataagtc

SEQ ID NO: 406306 - DNA, 20 bp, Artificial
  CRISPR gRNA sequence
tataagtctccttaaccatt

SEQ ID NO: 406307 - DNA, 20 bp, Artificial
  CRISPR gRNA sequence
ataagtctccttaaccattt

SEQ ID NO: 406308 - DNA, 20 bp, Artificial
  CRISPR gRNA sequence
taagtctccttaaccatttt

SEQ ID NO: 406309 - DNA, 20 bp, Artificial
  CRISPR gRNA sequence
cttaaccattttgaaatcgt

SEQ ID NO: 406310 - DNA, 20 bp, Artificial
  CRISPR gRNA sequence
aaccattttgaaatcgtgtc

SEQ ID NO: 406311 - DNA, 20 bp, Artificial
  CRISPR gRNA sequence
accattttgaaatcgtgtcc

SEQ ID NO: 406312 - DNA, 20 bp, Artificial
  CRISPR gRNA sequence
tgaaatcgtgtccaggtgct

SEQ ID NO: 406313 - DNA, 20 bp, Artificial
  CRISPR gRNA sequence
gaaatcgtgtccaggtgcta

SEQ ID NO: 406314 - DNA, 20 bp, Artificial
  CRISPR gRNA sequence
aaatcgtgtccaggtgctat

SEQ ID NO: 406315 - DNA, 20 bp, Artificial
  CRISPR gRNA sequence
ttgtgtgagagggataaaat

SEQ ID NO: 406316 - DNA, 20 bp, Artificial
  CRISPR gRNA sequence
tgtgagagggataaaatgaa

SEQ ID NO: 406317 - DNA, 20 bp, Artificial
  CRISPR gRNA sequence
acctccatttagaatcaccg

SEQ ID NO: 406318 - DNA, 20 bp, Artificial
  CRISPR gRNA sequence
catttagaatcaccgtgaac

SEQ ID NO: 406319 - DNA, 20 bp, Artificial
  CRISPR gRNA sequence
agaatcaccgtgaactatga

SEQ ID NO: 406320 - DNA, 20 bp, Artificial
  CRISPR gRNA sequence
gaatcaccgtgaactatgac

SEQ ID NO: 406321 - DNA, 20 bp, Artificial
  CRISPR gRNA sequence
tgactagaagatgtgattac

SEQ ID NO: 406322 - DNA, 20 bp, Artificial
  CRISPR gRNA sequence
gaagatgtgattaccctgaa

SEQ ID NO: 406323 - DNA, 20 bp, Artificial
  CRISPR gRNA sequence
ccctgaatggcattgtcaat

SEQ ID NO: 406324 - DNA, 20 bp, Artificial
  CRISPR gRNA sequence
aatggcattgtcaatcatta

SEQ ID NO: 406325 - DNA, 20 bp, Artificial
  CRISPR gRNA sequence
tcaatcattaacgatactgt

SEQ ID NO: 406326 - DNA, 20 bp, Artificial
  CRISPR gRNA sequence
acgatactgtttccaaaatg

SEQ ID NO: 406327 - DNA, 20 bp, Artificial
  CRISPR gRNA sequence
tttccaaaatgaacaactct

SEQ ID NO: 406328 - DNA, 20 bp, Artificial
  CRISPR gRNA sequence
ccaaaatgaacaactctggt

SEQ ID NO: 406329 - DNA, 20 bp, Artificial
  CRISPR gRNA sequence
caaaatgaacaactctggta

SEQ ID NO: 406330 - DNA, 20 bp, Artificial
  CRISPR gRNA sequence
tggtaaagctctaatacttc

SEQ ID NO: 406331 - DNA, 20 bp, Artificial
  CRISPR gRNA sequence
gtaaagctctaatacttcaa

SEQ ID NO: 406332 - DNA, 20 bp, Artificial
  CRISPR gRNA sequence
taatacttcaaagtaaaatc

SEQ ID NO: 406333 - DNA, 20 bp, Artificial
  CRISPR gRNA sequence
atacttcaaagtaaaatctt

SEQ ID NO: 406334 - DNA, 20 bp, Artificial
  CRISPR gRNA sequence
caaagtaaaatcttccctca

SEQ ID NO: 406335 - DNA, 20 bp, Artificial
  CRISPR gRNA sequence
aaagtaaaatcttccctcac

SEQ ID NO: 406336 - DNA, 20 bp, Artificial
  CRISPR gRNA sequence
ccctcactttaaactgaaca

SEQ ID NO: 406337 - DNA, 20 bp, Artificial
  CRISPR gRNA sequence
cctcactttaaactgaacaa

SEQ ID NO: 406338 - DNA, 20 bp, Artificial
  CRISPR gRNA sequence
actttaaactgaacaagagt

SEQ ID NO: 406339 - DNA, 20 bp, Artificial
  CRISPR gRNA sequence
taaactgaacaagagtagaa

SEQ ID NO: 406340 - DNA, 20 bp, Artificial
  CRISPR gRNA sequence
aaactgaacaagagtagaat

SEQ ID NO: 406341 - DNA, 20 bp, Artificial
  CRISPR gRNA sequence
aactgaacaagagtagaatt

SEQ ID NO: 406342 - DNA, 20 bp, Artificial
  CRISPR gRNA sequence
aacaagagtagaatttctag

SEQ ID NO: 406343 - DNA, 20 bp, Artificial
  CRISPR gRNA sequence
ctagaaaatcagagtatgct

SEQ ID NO: 406344 - DNA, 20 bp, Artificial
  CRISPR gRNA sequence
tagaaaatcagagtatgcta

SEQ ID NO: 406345 - DNA, 20 bp, Artificial
  CRISPR gRNA sequence
gaaaatcagagtatgctaag

SEQ ID NO: 406346 - DNA, 20 bp, Artificial
  CRISPR gRNA sequence
agatagtaaaaaaatatttt

SEQ ID NO: 406347 - DNA, 20 bp, Artificial
  CRISPR gRNA sequence
ttttggatgttttcttgtgc

SEQ ID NO: 406348 - DNA, 20 bp, Artificial
  CRISPR gRNA sequence
tttggatgttttcttgtgcc

SEQ ID NO: 406349 - DNA, 20 bp, Artificial
  CRISPR gRNA sequence
ttggatgttttcttgtgcca

SEQ ID NO: 406350 - DNA, 20 bp, Artificial
  CRISPR gRNA sequence
tggatgttttcttgtgccaa

SEQ ID NO: 406351 - DNA, 20 bp, Artificial
  CRISPR gRNA sequence
ggatgttttcttgtgccaat

SEQ ID NO: 406352 - DNA, 20 bp, Artificial
  CRISPR gRNA sequence
gatgttttcttgtgccaatt

SEQ ID NO: 406353 - DNA, 20 bp, Artificial
  CRISPR gRNA sequence
tcttgtgccaatttactttc

SEQ ID NO: 406354 - DNA, 20 bp, Artificial
  CRISPR gRNA sequence
cttgtgccaatttactttca

SEQ ID NO: 406355 - DNA, 20 bp, Artificial
  CRISPR gRNA sequence
ttgtgccaatttactttcag

SEQ ID NO: 406356 - DNA, 20 bp, Artificial
  CRISPR gRNA sequence
gtgccaatttactttcaggc

SEQ ID NO: 406357 - DNA, 20 bp, Artificial
  CRISPR gRNA sequence
tgccaatttactttcaggcg

SEQ ID NO: 406358 - DNA, 20 bp, Artificial
  CRISPR gRNA sequence
actttcaggcgagtcaggac

SEQ ID NO: 406359 - DNA, 20 bp, Artificial
  CRISPR gRNA sequence
ctttcaggcgagtcaggacc

SEQ ID NO: 406360 - DNA, 20 bp, Artificial
  CRISPR gRNA sequence
tcaggcgagtcaggacctat

SEQ ID NO: 406361 - DNA, 20 bp, Artificial
  CRISPR gRNA sequence
caggcgagtcaggacctatt

SEQ ID NO: 406362 - DNA, 20 bp, Artificial
  CRISPR gRNA sequence
aggcgagtcaggacctattg

SEQ ID NO: 406363 - DNA, 20 bp, Artificial
  CRISPR gRNA sequence
ttgcattattgattttaatt

SEQ ID NO: 406364 - DNA, 20 bp, Artificial
  CRISPR gRNA sequence
cattattgattttaattcct

SEQ ID NO: 406365 - DNA, 20 bp, Artificial
  CRISPR gRNA sequence
ttgattttaattcctttgac

SEQ ID NO: 406366 - DNA, 20 bp, Artificial
  CRISPR gRNA sequence
attttaattcctttgacttt

SEQ ID NO: 406367 - DNA, 20 bp, Artificial
  CRISPR gRNA sequence
taattcctttgactttcctt

SEQ ID NO: 406368 - DNA, 20 bp, Artificial
  CRISPR gRNA sequence
aattcctttgactttccttt

SEQ ID NO: 406369 - DNA, 20 bp, Artificial
  CRISPR gRNA sequence
attcctttgactttcctttg

SEQ ID NO: 406370 - DNA, 20 bp, Artificial
  CRISPR gRNA sequence
ctttgactttcctttgcaat

SEQ ID NO: 406371 - DNA, 20 bp, Artificial
  CRISPR gRNA sequence
tgactttcctttgcaatttc

SEQ ID NO: 406372 - DNA, 20 bp, Artificial
  CRISPR gRNA sequence
gactttcctttgcaatttcc

SEQ ID NO: 406373 - DNA, 20 bp, Artificial
  CRISPR gRNA sequence
actttcctttgcaatttcct

SEQ ID NO: 406374 - DNA, 20 bp, Artificial
  CRISPR gRNA sequence
tcctttgcaatttccttgag

SEQ ID NO: 406375 - DNA, 20 bp, Artificial
  CRISPR gRNA sequence
cctttgcaatttccttgaga

SEQ ID NO: 406376 - DNA, 20 bp, Artificial
  CRISPR gRNA sequence
ctttgcaatttccttgagat

SEQ ID NO: 406377 - DNA, 20 bp, Artificial
  CRISPR gRNA sequence
tgcaatttccttgagatttg

SEQ ID NO: 406378 - DNA, 20 bp, Artificial
  CRISPR gRNA sequence
gcaatttccttgagatttgg

SEQ ID NO: 406379 - DNA, 20 bp, Artificial
  CRISPR gRNA sequence
caatttccttgagatttggc

SEQ ID NO: 406380 - DNA, 20 bp, Artificial
  CRISPR gRNA sequence
ccttgagatttggctcagaa

SEQ ID NO: 406381 - DNA, 20 bp, Artificial
  CRISPR gRNA sequence
cttgagatttggctcagaat

SEQ ID NO: 406382 - DNA, 20 bp, Artificial
  CRISPR gRNA sequence
gagatttggctcagaatttg

SEQ ID NO: 406383 - DNA, 20 bp, Artificial
  CRISPR gRNA sequence
agatttggctcagaatttgg

SEQ ID NO: 406384 - DNA, 20 bp, Artificial
  CRISPR gRNA sequence
ggctcagaatttgggacatt

SEQ ID NO: 406385 - DNA, 20 bp, Artificial
  CRISPR gRNA sequence
gctcagaatttgggacattg

SEQ ID NO: 406386 - DNA, 20 bp, Artificial
  CRISPR gRNA sequence
agaatttgggacattgtctt

SEQ ID NO: 406387 - DNA, 20 bp, Artificial
  CRISPR gRNA sequence
gggacattgtcttaaatata

SEQ ID NO: 406388 - DNA, 20 bp, Artificial
  CRISPR gRNA sequence
ggacattgtcttaaatatag

SEQ ID NO: 406389 - DNA, 20 bp, Artificial
  CRISPR gRNA sequence
tcttaaatatagtaggtcct

SEQ ID NO: 406390 - DNA, 20 bp, Artificial
  CRISPR gRNA sequence
aaatatagtaggtcctcaat

SEQ ID NO: 406391 - DNA, 20 bp, Artificial
  CRISPR gRNA sequence
aatatagtaggtcctcaatt

SEQ ID NO: 406392 - DNA, 20 bp, Artificial
  CRISPR gRNA sequence
aattgatggttatttgtgtt

SEQ ID NO: 406393 - DNA, 20 bp, Artificial
  CRISPR gRNA sequence
atggttatttgtgttagtta

SEQ ID NO: 406394 - DNA, 20 bp, Artificial
  CRISPR gRNA sequence
tttgtgttagttactttaga

SEQ ID NO: 406395 - DNA, 20 bp, Artificial
  CRISPR gRNA sequence
gtgttagttactttagagca

SEQ ID NO: 406396 - DNA, 20 bp, Artificial
  CRISPR gRNA sequence
tgttagttactttagagcat

SEQ ID NO: 406397 - DNA, 20 bp, Artificial
  CRISPR gRNA sequence
gttactttagagcatgaaca

SEQ ID NO: 406398 - DNA, 20 bp, Artificial
  CRISPR gRNA sequence
ctttagagcatgaacatttc

SEQ ID NO: 406399 - DNA, 20 bp, Artificial
  CRISPR gRNA sequence
tagagcatgaacatttctgt

SEQ ID NO: 406400 - DNA, 20 bp, Artificial
  CRISPR gRNA sequence
agagcatgaacatttctgtt

SEQ ID NO: 406401 - DNA, 20 bp, Artificial
  CRISPR gRNA sequence
gagcatgaacatttctgttt

SEQ ID NO: 406402 - DNA, 20 bp, Artificial
  CRISPR gRNA sequence
ctgttttattgggagtaaca

SEQ ID NO: 406403 - DNA, 20 bp, Artificial
  CRISPR gRNA sequence
tgttttattgggagtaacag

SEQ ID NO: 406404 - DNA, 20 bp, Artificial
  CRISPR gRNA sequence
ttttattgggagtaacagaa

SEQ ID NO: 406405 - DNA, 20 bp, Artificial
  CRISPR gRNA sequence
tattgggagtaacagaatga

SEQ ID NO: 406406 - DNA, 20 bp, Artificial
  CRISPR gRNA sequence
attgggagtaacagaatgac

SEQ ID NO: 406407 - DNA, 20 bp, Artificial
  CRISPR gRNA sequence
ttgggagtaacagaatgaca

SEQ ID NO: 406408 - DNA, 20 bp, Artificial
  CRISPR gRNA sequence
ggagtaacagaatgacagct

SEQ ID NO: 406409 - DNA, 20 bp, Artificial
  CRISPR gRNA sequence
aatgcaactgaaatggttgt

SEQ ID NO: 406410 - DNA, 20 bp, Artificial
  CRISPR gRNA sequence
aaatggttgtggttgtcatt

SEQ ID NO: 406411 - DNA, 20 bp, Artificial
  CRISPR gRNA sequence
tggttgtcattctcaattag

SEQ ID NO: 406412 - DNA, 20 bp, Artificial
  CRISPR gRNA sequence
tcattctcaattagaaggag

SEQ ID NO: 406413 - DNA, 20 bp, Artificial
  CRISPR gRNA sequence
tcaattagaaggagggccaa

SEQ ID NO: 406414 - DNA, 20 bp, Artificial
  CRISPR gRNA sequence
aattagaaggagggccaaaa

SEQ ID NO: 406415 - DNA, 20 bp, Artificial
  CRISPR gRNA sequence
gaaggagggccaaaagtcta

SEQ ID NO: 406416 - DNA, 20 bp, Artificial
  CRISPR gRNA sequence
gtctatcttgccttttcttc

SEQ ID NO: 406417 - DNA, 20 bp, Artificial
  CRISPR gRNA sequence
tcttgccttttcttcttttt

SEQ ID NO: 406418 - DNA, 20 bp, Artificial
  CRISPR gRNA sequence
gccttttcttctttttccaa

SEQ ID NO: 406419 - DNA, 20 bp, Artificial
  CRISPR gRNA sequence
ccttttcttctttttccaat

SEQ ID NO: 406420 - DNA, 20 bp, Artificial
  CRISPR gRNA sequence
ttcttctttttccaatttac

SEQ ID NO: 406421 - DNA, 20 bp, Artificial
  CRISPR gRNA sequence
tcttctttttccaatttact

SEQ ID NO: 406422 - DNA, 20 bp, Artificial
  CRISPR gRNA sequence
cttctttttccaatttactt

SEQ ID NO: 406423 - DNA, 20 bp, Artificial
  CRISPR gRNA sequence
ttctttttccaatttacttc

SEQ ID NO: 406424 - DNA, 20 bp, Artificial
  CRISPR gRNA sequence
ctttttccaatttacttcag

SEQ ID NO: 406425 - DNA, 20 bp, Artificial
  CRISPR gRNA sequence
tttttccaatttacttcagt

SEQ ID NO: 406426 - DNA, 20 bp, Artificial
  CRISPR gRNA sequence
tttccaatttacttcagtag

SEQ ID NO: 406427 - DNA, 20 bp, Artificial
  CRISPR gRNA sequence
ttccaatttacttcagtaga

SEQ ID NO: 406428 - DNA, 20 bp, Artificial
  CRISPR gRNA sequence
tccaatttacttcagtagaa

SEQ ID NO: 406429 - DNA, 20 bp, Artificial
  CRISPR gRNA sequence
ccaatttacttcagtagaaa

SEQ ID NO: 406430 - DNA, 20 bp, Artificial
  CRISPR gRNA sequence
caatttacttcagtagaaat

SEQ ID NO: 406431 - DNA, 20 bp, Artificial
  CRISPR gRNA sequence
acttcagtagaaatgctttt

SEQ ID NO: 406432 - DNA, 20 bp, Artificial
  CRISPR gRNA sequence
cttcagtagaaatgcttttg

SEQ ID NO: 406433 - DNA, 20 bp, Artificial
  CRISPR gRNA sequence
cagtagaaatgcttttgtaa

SEQ ID NO: 406434 - DNA, 20 bp, Artificial
  CRISPR gRNA sequence
agtagaaatgcttttgtaaa

SEQ ID NO: 406435 - DNA, 20 bp, Artificial
  CRISPR gRNA sequence
ttgtaaaggagcaatatata

SEQ ID NO: 406436 - DNA, 20 bp, Artificial
  CRISPR gRNA sequence
tgtaaaggagcaatatatag

SEQ ID NO: 406437 - DNA, 20 bp, Artificial
  CRISPR gRNA sequence
gtaaaggagcaatatatagg

SEQ ID NO: 406438 - DNA, 20 bp, Artificial
  CRISPR gRNA sequence
taaaggagcaatatatagga

SEQ ID NO: 406439 - DNA, 20 bp, Artificial
  CRISPR gRNA sequence
ggcacaaatacggaactctg

SEQ ID NO: 406440 - DNA, 20 bp, Artificial
  CRISPR gRNA sequence
gcacaaatacggaactctgt

SEQ ID NO: 406441 - DNA, 20 bp, Artificial
  CRISPR gRNA sequence
tgtagcccttcagtgagaaa

SEQ ID NO: 406442 - DNA, 20 bp, Artificial
  CRISPR gRNA sequence
tagcccttcagtgagaaaat

SEQ ID NO: 406443 - DNA, 20 bp, Artificial
  CRISPR gRNA sequence
cagtgagaaaattggaaact

SEQ ID NO: 406444 - DNA, 20 bp, Artificial
  CRISPR gRNA sequence
agtgagaaaattggaaactg

SEQ ID NO: 406445 - DNA, 20 bp, Artificial
  CRISPR gRNA sequence
gaaactggcagaactatcac

SEQ ID NO: 406446 - DNA, 20 bp, Artificial
  CRISPR gRNA sequence
gcagaactatcacaaggaat

SEQ ID NO: 406447 - DNA, 20 bp, Artificial
  CRISPR gRNA sequence
tcacaaggaattgctaacca

SEQ ID NO: 406448 - DNA, 20 bp, Artificial
  CRISPR gRNA sequence
ctaaccacaaaacttgaaaa

SEQ ID NO: 406449 - DNA, 20 bp, Artificial
  CRISPR gRNA sequence
accacaaaacttgaaaataa

SEQ ID NO: 406450 - DNA, 20 bp, Artificial
  CRISPR gRNA sequence
gaaaataaatattctcctct

SEQ ID NO: 406451 - DNA, 20 bp, Artificial
  CRISPR gRNA sequence
aaaataaatattctcctctt

SEQ ID NO: 406452 - DNA, 20 bp, Artificial
  CRISPR gRNA sequence
tcctcttggtccatgaactc

SEQ ID NO: 406453 - DNA, 20 bp, Artificial
  CRISPR gRNA sequence
ctcttggtccatgaactcaa

SEQ ID NO: 406454 - DNA, 20 bp, Artificial
  CRISPR gRNA sequence
ttggtccatgaactcaatgg

SEQ ID NO: 406455 - DNA, 20 bp, Artificial
  CRISPR gRNA sequence
ggtccatgaactcaatggaa

SEQ ID NO: 406456 - DNA, 20 bp, Artificial
  CRISPR gRNA sequence
gtccatgaactcaatggaat

SEQ ID NO: 406457 - DNA, 20 bp, Artificial
  CRISPR gRNA sequence
aatggaataattgatatatg

SEQ ID NO: 406458 - DNA, 20 bp, Artificial
  CRISPR gRNA sequence
atatatggtgttcactgtga

SEQ ID NO: 406459 - DNA, 20 bp, Artificial
  CRISPR gRNA sequence
actgtgagtttcttttctgg

SEQ ID NO: 406460 - DNA, 20 bp, Artificial
  CRISPR gRNA sequence
tgagtttcttttctggtagt

SEQ ID NO: 406461 - DNA, 20 bp, Artificial
  CRISPR gRNA sequence
cttttctggtagtgctaatc

SEQ ID NO: 406462 - DNA, 20 bp, Artificial
  CRISPR gRNA sequence
ttttctggtagtgctaatca

SEQ ID NO: 406463 - DNA, 20 bp, Artificial
  CRISPR gRNA sequence
ttctggtagtgctaatcaac

SEQ ID NO: 406464 - DNA, 20 bp, Artificial
  CRISPR gRNA sequence
tctggtagtgctaatcaact

SEQ ID NO: 406465 - DNA, 20 bp, Artificial
  CRISPR gRNA sequence
ctggtagtgctaatcaactt

SEQ ID NO: 406466 - DNA, 20 bp, Artificial
  CRISPR gRNA sequence
tggtagtgctaatcaacttg

SEQ ID NO: 406467 - DNA, 20 bp, Artificial
  CRISPR gRNA sequence
gtagtgctaatcaacttgaa

SEQ ID NO: 406468 - DNA, 20 bp, Artificial
  CRISPR gRNA sequence
atcaacttgaaccaagctcc

SEQ ID NO: 406469 - DNA, 20 bp, Artificial
  CRISPR gRNA sequence
gaaccaagctcctctttgtc

SEQ ID NO: 406470 - DNA, 20 bp, Artificial
  CRISPR gRNA sequence
aaccaagctcctctttgtct

SEQ ID NO: 406471 - DNA, 20 bp, Artificial
  CRISPR gRNA sequence
ctctttgtcttcctcaaatt

SEQ ID NO: 406472 - DNA, 20 bp, Artificial
  CRISPR gRNA sequence
tttgtcttcctcaaattgcc

SEQ ID NO: 406473 - DNA, 20 bp, Artificial
  CRISPR gRNA sequence
tgtcttcctcaaattgccaa

SEQ ID NO: 406474 - DNA, 20 bp, Artificial
  CRISPR gRNA sequence
gtcttcctcaaattgccaat

SEQ ID NO: 406475 - DNA, 20 bp, Artificial
  CRISPR gRNA sequence
tcttcctcaaattgccaatg

SEQ ID NO: 406476 - DNA, 20 bp, Artificial
  CRISPR gRNA sequence
cctcaaattgccaatggcac

SEQ ID NO: 406477 - DNA, 20 bp, Artificial
  CRISPR gRNA sequence
ctcaaattgccaatggcact

SEQ ID NO: 406478 - DNA, 20 bp, Artificial
  CRISPR gRNA sequence
aaattgccaatggcactgat

SEQ ID NO: 406479 - DNA, 20 bp, Artificial
  CRISPR gRNA sequence
ccaatggcactgatatgagg

SEQ ID NO: 406480 - DNA, 20 bp, Artificial
  CRISPR gRNA sequence
atatgaggtgattgacttga

SEQ ID NO: 406481 - DNA, 20 bp, Artificial
  CRISPR gRNA sequence
acttgaagcagtcgaagatc

SEQ ID NO: 406482 - DNA, 20 bp, Artificial
  CRISPR gRNA sequence
gaagcagtcgaagatctcat

SEQ ID NO: 406483 - DNA, 20 bp, Artificial
  CRISPR gRNA sequence
aagcagtcgaagatctcatc

SEQ ID NO: 406484 - DNA, 20 bp, Artificial
  CRISPR gRNA sequence
atcaaactcatcaaaaatgt

SEQ ID NO: 406485 - DNA, 20 bp, Artificial
  CRISPR gRNA sequence
atcaaaaatgtcaaggtcgt

SEQ ID NO: 406486 - DNA, 20 bp, Artificial
  CRISPR gRNA sequence
tgcaggtgtgatctgaaata

SEQ ID NO: 406487 - DNA, 20 bp, Artificial
  CRISPR gRNA sequence
gcaggtgtgatctgaaatat

SEQ ID NO: 406488 - DNA, 20 bp, Artificial
  CRISPR gRNA sequence
caggtgtgatctgaaatatt

SEQ ID NO: 406489 - DNA, 20 bp, Artificial
  CRISPR gRNA sequence
aaatattatatagaaaggta

SEQ ID NO: 406490 - DNA, 20 bp, Artificial
  CRISPR gRNA sequence
tatagaaaggtagaatttca

SEQ ID NO: 406491 - DNA, 20 bp, Artificial
  CRISPR gRNA sequence
cagagccagagatttttcac

SEQ ID NO: 406492 - DNA, 20 bp, Artificial
  CRISPR gRNA sequence
agagccagagatttttcaca

SEQ ID NO: 406493 - DNA, 20 bp, Artificial
  CRISPR gRNA sequence
ttcacattctgacataatac

SEQ ID NO: 406494 - DNA, 20 bp, Artificial
  CRISPR gRNA sequence
tcacattctgacataataca

SEQ ID NO: 406495 - DNA, 20 bp, Artificial
  CRISPR gRNA sequence
cacattctgacataatacat

SEQ ID NO: 406496 - DNA, 20 bp, Artificial
  CRISPR gRNA sequence
acattctgacataatacata

SEQ ID NO: 406497 - DNA, 20 bp, Artificial
  CRISPR gRNA sequence
tgacataatacatacaagcc

SEQ ID NO: 406498 - DNA, 20 bp, Artificial
  CRISPR gRNA sequence
acataatacatacaagccaa

SEQ ID NO: 406499 - DNA, 20 bp, Artificial
  CRISPR gRNA sequence
atagatggtagtataaatac

SEQ ID NO: 406500 - DNA, 20 bp, Artificial
  CRISPR gRNA sequence
gacattttagattattgttc

SEQ ID NO: 406501 - DNA, 20 bp, Artificial
  CRISPR gRNA sequence
tagattattgttccaaaatc

SEQ ID NO: 406502 - DNA, 20 bp, Artificial
  CRISPR gRNA sequence
agattattgttccaaaatca

SEQ ID NO: 406503 - DNA, 20 bp, Artificial
  CRISPR gRNA sequence
gattattgttccaaaatcat

SEQ ID NO: 406504 - DNA, 20 bp, Artificial
  CRISPR gRNA sequence
ttgttccaaaatcatgctat

SEQ ID NO: 406505 - DNA, 20 bp, Artificial
  CRISPR gRNA sequence
ttccaaaatcatgctatgaa

SEQ ID NO: 406506 - DNA, 20 bp, Artificial
  CRISPR gRNA sequence
caaaatcatgctatgaaaat

SEQ ID NO: 406507 - DNA, 20 bp, Artificial
  CRISPR gRNA sequence
tgaaaatatgatcacagtga

SEQ ID NO: 406508 - DNA, 20 bp, Artificial
  CRISPR gRNA sequence
tccaaattttggaaatctct

SEQ ID NO: 406509 - DNA, 20 bp, Artificial
  CRISPR gRNA sequence
ccaaattttggaaatctctc

SEQ ID NO: 406510 - DNA, 20 bp, Artificial
  CRISPR gRNA sequence
caaattttggaaatctctct

SEQ ID NO: 406511 - DNA, 20 bp, Artificial
  CRISPR gRNA sequence
tggaaatctctctaatagaa

SEQ ID NO: 406512 - DNA, 20 bp, Artificial
  CRISPR gRNA sequence
ggaaatctctctaatagaag

SEQ ID NO: 406513 - DNA, 20 bp, Artificial
  CRISPR gRNA sequence
gaaatctctctaatagaagt

SEQ ID NO: 406514 - DNA, 20 bp, Artificial
  CRISPR gRNA sequence
tctaatagaagtagtgcatt

SEQ ID NO: 406515 - DNA, 20 bp, Artificial
  CRISPR gRNA sequence
taatagaagtagtgcatttc

SEQ ID NO: 406516 - DNA, 20 bp, Artificial
  CRISPR gRNA sequence
atagaagtagtgcatttccc

SEQ ID NO: 406517 - DNA, 20 bp, Artificial
  CRISPR gRNA sequence
cccccaactcattttgtttc

SEQ ID NO: 406518 - DNA, 20 bp, Artificial
  CRISPR gRNA sequence
ccccaactcattttgtttcc

SEQ ID NO: 406519 - DNA, 20 bp, Artificial
  CRISPR gRNA sequence
attttgtttccagaaacctc

SEQ ID NO: 406520 - DNA, 20 bp, Artificial
  CRISPR gRNA sequence
tgtttccagaaacctcatta

SEQ ID NO: 406521 - DNA, 20 bp, Artificial
  CRISPR gRNA sequence
gtttccagaaacctcattaa

SEQ ID NO: 406522 - DNA, 20 bp, Artificial
  CRISPR gRNA sequence
tttccagaaacctcattaag

SEQ ID NO: 406523 - DNA, 20 bp, Artificial
  CRISPR gRNA sequence
ccagaaacctcattaagatc

SEQ ID NO: 406524 - DNA, 20 bp, Artificial
  CRISPR gRNA sequence
cagaaacctcattaagatca

SEQ ID NO: 406525 - DNA, 20 bp, Artificial
  CRISPR gRNA sequence
attaagatcaatagaatgat

SEQ ID NO: 406526 - DNA, 20 bp, Artificial
  CRISPR gRNA sequence
agatcaatagaatgatagag

SEQ ID NO: 406527 - DNA, 20 bp, Artificial
  CRISPR gRNA sequence
tttccccttcacactttagt

SEQ ID NO: 406528 - DNA, 20 bp, Artificial
  CRISPR gRNA sequence
ttccccttcacactttagta

SEQ ID NO: 406529 - DNA, 20 bp, Artificial
  CRISPR gRNA sequence
tccccttcacactttagtaa

SEQ ID NO: 406530 - DNA, 20 bp, Artificial
  CRISPR gRNA sequence
ccccttcacactttagtaag

SEQ ID NO: 406531 - DNA, 20 bp, Artificial
  CRISPR gRNA sequence
cccttcacactttagtaaga

SEQ ID NO: 406532 - DNA, 20 bp, Artificial
  CRISPR gRNA sequence
cacactttagtaagaaacat

SEQ ID NO: 406533 - DNA, 20 bp, Artificial
  CRISPR gRNA sequence
acactttagtaagaaacatc

SEQ ID NO: 406534 - DNA, 20 bp, Artificial
  CRISPR gRNA sequence
tagtaagaaacatcttcttc

SEQ ID NO: 406535 - DNA, 20 bp, Artificial
  CRISPR gRNA sequence
agtaagaaacatcttcttcc

SEQ ID NO: 406536 - DNA, 20 bp, Artificial
  CRISPR gRNA sequence
gtaagaaacatcttcttcct

SEQ ID NO: 406537 - DNA, 20 bp, Artificial
  CRISPR gRNA sequence
cttcctttttctccctttcc

SEQ ID NO: 406538 - DNA, 20 bp, Artificial
  CRISPR gRNA sequence
ttcctttttctccctttccg

SEQ ID NO: 406539 - DNA, 20 bp, Artificial
  CRISPR gRNA sequence
cctttttctccctttccggt

SEQ ID NO: 406540 - DNA, 20 bp, Artificial
  CRISPR gRNA sequence
ctttttctccctttccggtg

SEQ ID NO: 406541 - DNA, 20 bp, Artificial
  CRISPR gRNA sequence
tttctccctttccggtgagg

SEQ ID NO: 406542 - DNA, 20 bp, Artificial
  CRISPR gRNA sequence
ttctccctttccggtgaggt

SEQ ID NO: 406543 - DNA, 20 bp, Artificial
  CRISPR gRNA sequence
tctccctttccggtgaggtt

SEQ ID NO: 406544 - DNA, 20 bp, Artificial
  CRISPR gRNA sequence
ctccctttccggtgaggttg

SEQ ID NO: 406545 - DNA, 20 bp, Artificial
  CRISPR gRNA sequence
tccctttccggtgaggttgt

SEQ ID NO: 406546 - DNA, 20 bp, Artificial
  CRISPR gRNA sequence
cctttccggtgaggttgtct

SEQ ID NO: 406547 - DNA, 20 bp, Artificial
  CRISPR gRNA sequence
tccggtgaggttgtctataa

SEQ ID NO: 406548 - DNA, 20 bp, Artificial
  CRISPR gRNA sequence
ccggtgaggttgtctataat

SEQ ID NO: 406549 - DNA, 20 bp, Artificial
  CRISPR gRNA sequence
cggtgaggttgtctataatt

SEQ ID NO: 406550 - DNA, 20 bp, Artificial
  CRISPR gRNA sequence
tctataattctccaattctt

SEQ ID NO: 406551 - DNA, 20 bp, Artificial
  CRISPR gRNA sequence
taattctccaattcttttag

SEQ ID NO: 406552 - DNA, 20 bp, Artificial
  CRISPR gRNA sequence
tccaattcttttagcacatc

SEQ ID NO: 406553 - DNA, 20 bp, Artificial
  CRISPR gRNA sequence
caattcttttagcacatctg

SEQ ID NO: 406554 - DNA, 20 bp, Artificial
  CRISPR gRNA sequence
ttttagcacatctgaagccc

SEQ ID NO: 406555 - DNA, 20 bp, Artificial
  CRISPR gRNA sequence
ttagcacatctgaagcccat

SEQ ID NO: 406556 - DNA, 20 bp, Artificial
  CRISPR gRNA sequence
tagcacatctgaagcccatc

SEQ ID NO: 406557 - DNA, 20 bp, Artificial
  CRISPR gRNA sequence
agcacatctgaagcccatct

SEQ ID NO: 406558 - DNA, 20 bp, Artificial
  CRISPR gRNA sequence
gcacatctgaagcccatctt

SEQ ID NO: 406559 - DNA, 20 bp, Artificial
  CRISPR gRNA sequence
aagcccatctttcagagggc

SEQ ID NO: 406560 - DNA, 20 bp, Artificial
  CRISPR gRNA sequence
tcagagggctggtcccttgc

SEQ ID NO: 406561 - DNA, 20 bp, Artificial
  CRISPR gRNA sequence
cagagggctggtcccttgct

SEQ ID NO: 406562 - DNA, 20 bp, Artificial
  CRISPR gRNA sequence
agagggctggtcccttgctc

SEQ ID NO: 406563 - DNA, 20 bp, Artificial
  CRISPR gRNA sequence
gtcccttgctccataatatg

SEQ ID NO: 406564 - DNA, 20 bp, Artificial
  CRISPR gRNA sequence
gctccataatatgcaggctt

SEQ ID NO: 406565 - DNA, 20 bp, Artificial
  CRISPR gRNA sequence
ctccataatatgcaggctta

SEQ ID NO: 406566 - DNA, 20 bp, Artificial
  CRISPR gRNA sequence
cataatatgcaggcttagca

SEQ ID NO: 406567 - DNA, 20 bp, Artificial
  CRISPR gRNA sequence
agcatttcactaggacactt

SEQ ID NO: 406568 - DNA, 20 bp, Artificial
  CRISPR gRNA sequence
gcatttcactaggacacttg

SEQ ID NO: 406569 - DNA, 20 bp, Artificial
  CRISPR gRNA sequence
cactaggacacttgagccct

SEQ ID NO: 406570 - DNA, 20 bp, Artificial
  CRISPR gRNA sequence
actaggacacttgagccctg

SEQ ID NO: 406571 - DNA, 20 bp, Artificial
  CRISPR gRNA sequence
ggacacttgagccctgcaaa

SEQ ID NO: 406572 - DNA, 20 bp, Artificial
  CRISPR gRNA sequence
gagccctgcaaaaagagttc

SEQ ID NO: 406573 - DNA, 20 bp, Artificial
  CRISPR gRNA sequence
agccctgcaaaaagagttct

SEQ ID NO: 406574 - DNA, 20 bp, Artificial
  CRISPR gRNA sequence
caaaaagagttctctgccca

SEQ ID NO: 406575 - DNA, 20 bp, Artificial
  CRISPR gRNA sequence
tctgcccacactgaactcct

SEQ ID NO: 406576 - DNA, 20 bp, Artificial
  CRISPR gRNA sequence
tgcccacactgaactcctgc

SEQ ID NO: 406577 - DNA, 20 bp, Artificial
  CRISPR gRNA sequence
cccacactgaactcctgcct

SEQ ID NO: 406578 - DNA, 20 bp, Artificial
  CRISPR gRNA sequence
aactcctgcctgctcgtgag

SEQ ID NO: 406579 - DNA, 20 bp, Artificial
  CRISPR gRNA sequence
ctgcctgctcgtgaggtcca

SEQ ID NO: 406580 - DNA, 20 bp, Artificial
  CRISPR gRNA sequence
cctgctcgtgaggtccatcc

SEQ ID NO: 406581 - DNA, 20 bp, Artificial
  CRISPR gRNA sequence
ctcgtgaggtccatcctgca

SEQ ID NO: 406582 - DNA, 20 bp, Artificial
  CRISPR gRNA sequence
gtgaggtccatcctgcagag

SEQ ID NO: 406583 - DNA, 20 bp, Artificial
  CRISPR gRNA sequence
cagagacttctcctgcctcc

SEQ ID NO: 406584 - DNA, 20 bp, Artificial
  CRISPR gRNA sequence
ctcctgcctccttcccaact

SEQ ID NO: 406585 - DNA, 20 bp, Artificial
  CRISPR gRNA sequence
tcctgcctccttcccaacta

SEQ ID NO: 406586 - DNA, 20 bp, Artificial
  CRISPR gRNA sequence
ctgcctccttcccaactact

SEQ ID NO: 406587 - DNA, 20 bp, Artificial
  CRISPR gRNA sequence
cctccttcccaactactcta

SEQ ID NO: 406588 - DNA, 20 bp, Artificial
  CRISPR gRNA sequence
cttcccaactactctaagca

SEQ ID NO: 406589 - DNA, 20 bp, Artificial
  CRISPR gRNA sequence
cccaactactctaagcacca

SEQ ID NO: 406590 - DNA, 20 bp, Artificial
  CRISPR gRNA sequence
ccaactactctaagcaccaa

SEQ ID NO: 406591 - DNA, 20 bp, Artificial
  CRISPR gRNA sequence
ctctaagcaccaacttaccc

SEQ ID NO: 406592 - DNA, 20 bp, Artificial
  CRISPR gRNA sequence
taagcaccaacttaccccac

SEQ ID NO: 406593 - DNA, 20 bp, Artificial
  CRISPR gRNA sequence
agcaccaacttaccccacgc

SEQ ID NO: 406594 - DNA, 20 bp, Artificial
  CRISPR gRNA sequence
accccacgcttgtaatttaa

SEQ ID NO: 406595 - DNA, 20 bp, Artificial
  CRISPR gRNA sequence
ccccacgcttgtaatttaaa

SEQ ID NO: 406596 - DNA, 20 bp, Artificial
  CRISPR gRNA sequence
gtaatttaaacagtaattta

SEQ ID NO: 406597 - DNA, 20 bp, Artificial
  CRISPR gRNA sequence
taatttaaacagtaatttac

SEQ ID NO: 406598 - DNA, 20 bp, Artificial
  CRISPR gRNA sequence
aaacagtaatttacaaaggt

SEQ ID NO: 406599 - DNA, 20 bp, Artificial
  CRISPR gRNA sequence
aacagtaatttacaaaggtt

SEQ ID NO: 406600 - DNA, 20 bp, Artificial
  CRISPR gRNA sequence
acaaaggttgttactctaag

SEQ ID NO: 406601 - DNA, 20 bp, Artificial
  CRISPR gRNA sequence
caaaggttgttactctaaga

SEQ ID NO: 406602 - DNA, 20 bp, Artificial
  CRISPR gRNA sequence
ttactctaagagtatggcat

SEQ ID NO: 406603 - DNA, 20 bp, Artificial
  CRISPR gRNA sequence
ctctaagagtatggcatacg

SEQ ID NO: 406604 - DNA, 20 bp, Artificial
  CRISPR gRNA sequence
taagagtatggcatacgttt

SEQ ID NO: 406605 - DNA, 20 bp, Artificial
  CRISPR gRNA sequence
agagtatggcatacgtttac

SEQ ID NO: 406606 - DNA, 20 bp, Artificial
  CRISPR gRNA sequence
actgagtttgctctaagatg

SEQ ID NO: 406607 - DNA, 20 bp, Artificial
  CRISPR gRNA sequence
ctgagtttgctctaagatga

SEQ ID NO: 406608 - DNA, 20 bp, Artificial
  CRISPR gRNA sequence
agtttgctctaagatgatct

SEQ ID NO: 406609 - DNA, 20 bp, Artificial
  CRISPR gRNA sequence
gctctaagatgatctatttt

SEQ ID NO: 406610 - DNA, 20 bp, Artificial
  CRISPR gRNA sequence
ctctaagatgatctattttt

SEQ ID NO: 406611 - DNA, 20 bp, Artificial
  CRISPR gRNA sequence
taagatgatctatttttttt

SEQ ID NO: 406612 - DNA, 20 bp, Artificial
  CRISPR gRNA sequence
agatgatctattttttttaa

SEQ ID NO: 406613 - DNA, 20 bp, Artificial
  CRISPR gRNA sequence
ttttttttaaataatgttca

SEQ ID NO: 406614 - DNA, 20 bp, Artificial
  CRISPR gRNA sequence
tttttaaataatgttcacat

SEQ ID NO: 406615 - DNA, 20 bp, Artificial
  CRISPR gRNA sequence
ttttaaataatgttcacatg

SEQ ID NO: 406616 - DNA, 20 bp, Artificial
  CRISPR gRNA sequence
tttaaataatgttcacatgt

SEQ ID NO: 406617 - DNA, 20 bp, Artificial
  CRISPR gRNA sequence
ttaaataatgttcacatgta

SEQ ID NO: 406618 - DNA, 20 bp, Artificial
  CRISPR gRNA sequence
taaataatgttcacatgtaa

SEQ ID NO: 406619 - DNA, 20 bp, Artificial
  CRISPR gRNA sequence
aaataatgttcacatgtaat

SEQ ID NO: 406620 - DNA, 20 bp, Artificial
  CRISPR gRNA sequence
aataatgttcacatgtaatg

SEQ ID NO: 406621 - DNA, 20 bp, Artificial
  CRISPR gRNA sequence
acatgtaatgcataaacata

SEQ ID NO: 406622 - DNA, 20 bp, Artificial
  CRISPR gRNA sequence
ataaaattctagagttgctt

SEQ ID NO: 406623 - DNA, 20 bp, Artificial
  CRISPR gRNA sequence
tagagttgctttaggcagtt

SEQ ID NO: 406624 - DNA, 20 bp, Artificial
  CRISPR gRNA sequence
gagttgctttaggcagtttt

SEQ ID NO: 406625 - DNA, 20 bp, Artificial
  CRISPR gRNA sequence
ctttaggcagtttttcattt

SEQ ID NO: 406626 - DNA, 20 bp, Artificial
  CRISPR gRNA sequence
taggcagtttttcatttaga

SEQ ID NO: 406627 - DNA, 20 bp, Artificial
  CRISPR gRNA sequence
aggcagtttttcatttagaa

SEQ ID NO: 406628 - DNA, 20 bp, Artificial
  CRISPR gRNA sequence
ggcagtttttcatttagaaa

SEQ ID NO: 406629 - DNA, 20 bp, Artificial
  CRISPR gRNA sequence
ttcatttagaaaaaagcaca

SEQ ID NO: 406630 - DNA, 20 bp, Artificial
  CRISPR gRNA sequence
tcatttagaaaaaagcacat

SEQ ID NO: 406631 - DNA, 20 bp, Artificial
  CRISPR gRNA sequence
catttagaaaaaagcacatg

SEQ ID NO: 406632 - DNA, 20 bp, Artificial
  CRISPR gRNA sequence
atttagaaaaaagcacatgt

SEQ ID NO: 406633 - DNA, 20 bp, Artificial
  CRISPR gRNA sequence
agaaaaaagcacatgtttag

SEQ ID NO: 406634 - DNA, 20 bp, Artificial
  CRISPR gRNA sequence
gaaaaaagcacatgtttaga

SEQ ID NO: 406635 - DNA, 20 bp, Artificial
  CRISPR gRNA sequence
agaaaataaaaagtttattt

SEQ ID NO: 406636 - DNA, 20 bp, Artificial
  CRISPR gRNA sequence
gaaaataaaaagtttatttt

SEQ ID NO: 406637 - DNA, 20 bp, Artificial
  CRISPR gRNA sequence
attttgttttctaattatga

SEQ ID NO: 406638 - DNA, 20 bp, Artificial
  CRISPR gRNA sequence
ttttgttttctaattatgaa

SEQ ID NO: 406639 - DNA, 20 bp, Artificial
  CRISPR gRNA sequence
tgttttctaattatgaacag

SEQ ID NO: 406640 - DNA, 20 bp, Artificial
  CRISPR gRNA sequence
gttttctaattatgaacaga

SEQ ID NO: 406641 - DNA, 20 bp, Artificial
  CRISPR gRNA sequence
ttttctaattatgaacagac

SEQ ID NO: 406642 - DNA, 20 bp, Artificial
  CRISPR gRNA sequence
tctaattatgaacagacctg

SEQ ID NO: 406643 - DNA, 20 bp, Artificial
  CRISPR gRNA sequence
ctaattatgaacagacctgt

SEQ ID NO: 406644 - DNA, 20 bp, Artificial
  CRISPR gRNA sequence
taattatgaacagacctgtc

SEQ ID NO: 406645 - DNA, 20 bp, Artificial
  CRISPR gRNA sequence
attatgaacagacctgtcct

SEQ ID NO: 406646 - DNA, 20 bp, Artificial
  CRISPR gRNA sequence
tgaacagacctgtccttttc

SEQ ID NO: 406647 - DNA, 20 bp, Artificial
  CRISPR gRNA sequence
tccttttctcactctgagaa

SEQ ID NO: 406648 - DNA, 20 bp, Artificial
  CRISPR gRNA sequence
ttctcactctgagaaataaa

SEQ ID NO: 406649 - DNA, 20 bp, Artificial
  CRISPR gRNA sequence
tctcactctgagaaataaaa

SEQ ID NO: 406650 - DNA, 20 bp, Artificial
  CRISPR gRNA sequence
ctcactctgagaaataaaaa

SEQ ID NO: 406651 - DNA, 20 bp, Artificial
  CRISPR gRNA sequence
tcactctgagaaataaaaag

SEQ ID NO: 406652 - DNA, 20 bp, Artificial
  CRISPR gRNA sequence
actctgagaaataaaaagct

SEQ ID NO: 406653 - DNA, 20 bp, Artificial
  CRISPR gRNA sequence
tgagaaataaaaagcttaaa

SEQ ID NO: 406654 - DNA, 20 bp, Artificial
  CRISPR gRNA sequence
agaaataaaaagcttaaata

SEQ ID NO: 406655 - DNA, 20 bp, Artificial
  CRISPR gRNA sequence
aaataatcccatctttgatc

SEQ ID NO: 406656 - DNA, 20 bp, Artificial
  CRISPR gRNA sequence
aataatcccatctttgatct

SEQ ID NO: 406657 - DNA, 20 bp, Artificial
  CRISPR gRNA sequence
tgatctgtgctctgtgacaa

SEQ ID NO: 406658 - DNA, 20 bp, Artificial
  CRISPR gRNA sequence
gatctgtgctctgtgacaat

SEQ ID NO: 406659 - DNA, 20 bp, Artificial
  CRISPR gRNA sequence
atctgtgctctgtgacaata

SEQ ID NO: 406660 - DNA, 20 bp, Artificial
  CRISPR gRNA sequence
tgctctgtgacaataacaaa

SEQ ID NO: 406661 - DNA, 20 bp, Artificial
  CRISPR gRNA sequence
tgtgacaataacaaatcctt

SEQ ID NO: 406662 - DNA, 20 bp, Artificial
  CRISPR gRNA sequence
tgacaataacaaatccttta

SEQ ID NO: 406663 - DNA, 20 bp, Artificial
  CRISPR gRNA sequence
taggcacacttatctcttca

SEQ ID NO: 406664 - DNA, 20 bp, Artificial
  CRISPR gRNA sequence
aggcacacttatctcttcaa

SEQ ID NO: 406665 - DNA, 20 bp, Artificial
  CRISPR gRNA sequence
ggcacacttatctcttcaat

SEQ ID NO: 406666 - DNA, 20 bp, Artificial
  CRISPR gRNA sequence
atctcttcaataaggacttt

SEQ ID NO: 406667 - DNA, 20 bp, Artificial
  CRISPR gRNA sequence
tctcttcaataaggactttt

SEQ ID NO: 406668 - DNA, 20 bp, Artificial
  CRISPR gRNA sequence
ttcaataaggacttttttgg

SEQ ID NO: 406669 - DNA, 20 bp, Artificial
  CRISPR gRNA sequence
caataaggacttttttggtt

SEQ ID NO: 406670 - DNA, 20 bp, Artificial
  CRISPR gRNA sequence
aataaggacttttttggttt

SEQ ID NO: 406671 - DNA, 20 bp, Artificial
  CRISPR gRNA sequence
ttttggttttcagagctctg

SEQ ID NO: 406672 - DNA, 20 bp, Artificial
  CRISPR gRNA sequence
tttggttttcagagctctgg

SEQ ID NO: 406673 - DNA, 20 bp, Artificial
  CRISPR gRNA sequence
ttggttttcagagctctggc

SEQ ID NO: 406674 - DNA, 20 bp, Artificial
  CRISPR gRNA sequence
tggttttcagagctctggcg

SEQ ID NO: 406675 - DNA, 20 bp, Artificial
  CRISPR gRNA sequence
ggttttcagagctctggcga

SEQ ID NO: 406676 - DNA, 20 bp, Artificial
  CRISPR gRNA sequence
gttttcagagctctggcgat

SEQ ID NO: 406677 - DNA, 20 bp, Artificial
  CRISPR gRNA sequence
tcagagctctggcgatctat

SEQ ID NO: 406678 - DNA, 20 bp, Artificial
  CRISPR gRNA sequence
cagagctctggcgatctatt

SEQ ID NO: 406679 - DNA, 20 bp, Artificial
  CRISPR gRNA sequence
agagctctggcgatctattt

SEQ ID NO: 406680 - DNA, 20 bp, Artificial
  CRISPR gRNA sequence
tggcgatctattttctaaaa

SEQ ID NO: 406681 - DNA, 20 bp, Artificial
  CRISPR gRNA sequence
gcgatctattttctaaaatg

SEQ ID NO: 406682 - DNA, 20 bp, Artificial
  CRISPR gRNA sequence
ttttctaaaatgtttccacg

SEQ ID NO: 406683 - DNA, 20 bp, Artificial
  CRISPR gRNA sequence
tctaaaatgtttccacgttc

SEQ ID NO: 406684 - DNA, 20 bp, Artificial
  CRISPR gRNA sequence
ctaaaatgtttccacgttca

SEQ ID NO: 406685 - DNA, 20 bp, Artificial
  CRISPR gRNA sequence
taaaatgtttccacgttcat

SEQ ID NO: 406686 - DNA, 20 bp, Artificial
  CRISPR gRNA sequence
aaatgtttccacgttcattt

SEQ ID NO: 406687 - DNA, 20 bp, Artificial
  CRISPR gRNA sequence
ccacgttcatttttctttct

SEQ ID NO: 406688 - DNA, 20 bp, Artificial
  CRISPR gRNA sequence
cacgttcatttttctttcta

SEQ ID NO: 406689 - DNA, 20 bp, Artificial
  CRISPR gRNA sequence
atttttctttctatgatatc

SEQ ID NO: 406690 - DNA, 20 bp, Artificial
  CRISPR gRNA sequence
ttctttctatgatatccttg

SEQ ID NO: 406691 - DNA, 20 bp, Artificial
  CRISPR gRNA sequence
tctttctatgatatccttgg

SEQ ID NO: 406692 - DNA, 20 bp, Artificial
  CRISPR gRNA sequence
ctttctatgatatccttggt

SEQ ID NO: 406693 - DNA, 20 bp, Artificial
  CRISPR gRNA sequence
tttctatgatatccttggta

SEQ ID NO: 406694 - DNA, 20 bp, Artificial
  CRISPR gRNA sequence
tctatgatatccttggtatt

SEQ ID NO: 406695 - DNA, 20 bp, Artificial
  CRISPR gRNA sequence
ctatgatatccttggtattc

SEQ ID NO: 406696 - DNA, 20 bp, Artificial
  CRISPR gRNA sequence
tatgatatccttggtattct

SEQ ID NO: 406697 - DNA, 20 bp, Artificial
  CRISPR gRNA sequence
tgatatccttggtattcttg

SEQ ID NO: 406698 - DNA, 20 bp, Artificial
  CRISPR gRNA sequence
ggtattcttgtgatgtctct

SEQ ID NO: 406699 - DNA, 20 bp, Artificial
  CRISPR gRNA sequence
gtattcttgtgatgtctctc

SEQ ID NO: 406700 - DNA, 20 bp, Artificial
  CRISPR gRNA sequence
ttgtgatgtctctctctctt

SEQ ID NO: 406701 - DNA, 20 bp, Artificial
  CRISPR gRNA sequence
gtgatgtctctctctcttct

SEQ ID NO: 406702 - DNA, 20 bp, Artificial
  CRISPR gRNA sequence
tgatgtctctctctcttctc

SEQ ID NO: 406703 - DNA, 20 bp, Artificial
  CRISPR gRNA sequence
tctctcttctccactgctat

SEQ ID NO: 406704 - DNA, 20 bp, Artificial
  CRISPR gRNA sequence
tctcttctccactgctattg

SEQ ID NO: 406705 - DNA, 20 bp, Artificial
  CRISPR gRNA sequence
tcttctccactgctattggg

SEQ ID NO: 406706 - DNA, 20 bp, Artificial
  CRISPR gRNA sequence
ttctccactgctattgggaa

SEQ ID NO: 406707 - DNA, 20 bp, Artificial
  CRISPR gRNA sequence
ctccactgctattgggaaag

SEQ ID NO: 406708 - DNA, 20 bp, Artificial
  CRISPR gRNA sequence
tccactgctattgggaaagg

SEQ ID NO: 406709 - DNA, 20 bp, Artificial
  CRISPR gRNA sequence
cactgctattgggaaaggtg

SEQ ID NO: 406710 - DNA, 20 bp, Artificial
  CRISPR gRNA sequence
ctattgggaaaggtgagggt

SEQ ID NO: 406711 - DNA, 20 bp, Artificial
  CRISPR gRNA sequence
ttgggaaaggtgagggtgtg

SEQ ID NO: 406712 - DNA, 20 bp, Artificial
  CRISPR gRNA sequence
ggaaaggtgagggtgtggag

SEQ ID NO: 406713 - DNA, 20 bp, Artificial
  CRISPR gRNA sequence
tggttgctgggctggcaggt

SEQ ID NO: 406714 - DNA, 20 bp, Artificial
  CRISPR gRNA sequence
ctgggctggcaggtatgacg

SEQ ID NO: 406715 - DNA, 20 bp, Artificial
  CRISPR gRNA sequence
ggctggcaggtatgacggcg

SEQ ID NO: 406716 - DNA, 20 bp, Artificial
  CRISPR gRNA sequence
gcaggtatgacggcgcatcc

SEQ ID NO: 406717 - DNA, 20 bp, Artificial
  CRISPR gRNA sequence
atcccaccatctggtgctgg

SEQ ID NO: 406718 - DNA, 20 bp, Artificial
  CRISPR gRNA sequence
tcccaccatctggtgctggt

SEQ ID NO: 406719 - DNA, 20 bp, Artificial
  CRISPR gRNA sequence
gtgctggtgctagaggaatc

SEQ ID NO: 406720 - DNA, 20 bp, Artificial
  CRISPR gRNA sequence
gtgctagaggaatctgccca

SEQ ID NO: 406721 - DNA, 20 bp, Artificial
  CRISPR gRNA sequence
gaggaatctgcccatcagaa

SEQ ID NO: 406722 - DNA, 20 bp, Artificial
  CRISPR gRNA sequence
cccatcagaagtgatctttt

SEQ ID NO: 406723 - DNA, 20 bp, Artificial
  CRISPR gRNA sequence
ttctattgtccctattcata

SEQ ID NO: 406724 - DNA, 20 bp, Artificial
  CRISPR gRNA sequence
tctattgtccctattcataa

SEQ ID NO: 406725 - DNA, 20 bp, Artificial
  CRISPR gRNA sequence
ctattgtccctattcataat

SEQ ID NO: 406726 - DNA, 20 bp, Artificial
  CRISPR gRNA sequence
tattgtccctattcataata

SEQ ID NO: 406727 - DNA, 20 bp, Artificial
  CRISPR gRNA sequence
ttgtccctattcataataag

SEQ ID NO: 406728 - DNA, 20 bp, Artificial
  CRISPR gRNA sequence
tccctattcataataagcag

SEQ ID NO: 406729 - DNA, 20 bp, Artificial
  CRISPR gRNA sequence
ttcataataagcagagtgtc

SEQ ID NO: 406730 - DNA, 20 bp, Artificial
  CRISPR gRNA sequence
ataataagcagagtgtcatt

SEQ ID NO: 406731 - DNA, 20 bp, Artificial
  CRISPR gRNA sequence
agatctgggagtaccttatt

SEQ ID NO: 406732 - DNA, 20 bp, Artificial
  CRISPR gRNA sequence
gatctgggagtaccttattc

SEQ ID NO: 406733 - DNA, 20 bp, Artificial
  CRISPR gRNA sequence
ggagtaccttattctagtta

SEQ ID NO: 406734 - DNA, 20 bp, Artificial
  CRISPR gRNA sequence
attctagttataagaaacca

SEQ ID NO: 406735 - DNA, 20 bp, Artificial
  CRISPR gRNA sequence
ttctagttataagaaaccag

SEQ ID NO: 406736 - DNA, 20 bp, Artificial
  CRISPR gRNA sequence
tagttataagaaaccagtga

SEQ ID NO: 406737 - DNA, 20 bp, Artificial
  CRISPR gRNA sequence
gttataagaaaccagtgaga

SEQ ID NO: 406738 - DNA, 20 bp, Artificial
  CRISPR gRNA sequence
taagaaaccagtgagacaaa

SEQ ID NO: 406739 - DNA, 20 bp, Artificial
  CRISPR gRNA sequence
tttgttgcactgagttccct

SEQ ID NO: 406740 - DNA, 20 bp, Artificial
  CRISPR gRNA sequence
gttgcactgagttccctaaa

SEQ ID NO: 406741 - DNA, 20 bp, Artificial
  CRISPR gRNA sequence
ttgcactgagttccctaaat

SEQ ID NO: 406742 - DNA, 20 bp, Artificial
  CRISPR gRNA sequence
cactgagttccctaaatgct

SEQ ID NO: 406743 - DNA, 20 bp, Artificial
  CRISPR gRNA sequence
agttccctaaatgctcttta

SEQ ID NO: 406744 - DNA, 20 bp, Artificial
  CRISPR gRNA sequence
cctaaatgctctttatctgc

SEQ ID NO: 406745 - DNA, 20 bp, Artificial
  CRISPR gRNA sequence
aatgctctttatctgctagc

SEQ ID NO: 406746 - DNA, 20 bp, Artificial
  CRISPR gRNA sequence
tttatctgctagctcctggt

SEQ ID NO: 406747 - DNA, 20 bp, Artificial
  CRISPR gRNA sequence
tatctgctagctcctggttg

SEQ ID NO: 406748 - DNA, 20 bp, Artificial
  CRISPR gRNA sequence
atctgctagctcctggttgt

SEQ ID NO: 406749 - DNA, 20 bp, Artificial
  CRISPR gRNA sequence
tctgctagctcctggttgtg

SEQ ID NO: 406750 - DNA, 20 bp, Artificial
  CRISPR gRNA sequence
ctagctcctggttgtgctgt

SEQ ID NO: 406751 - DNA, 20 bp, Artificial
  CRISPR gRNA sequence
gctcctggttgtgctgtgtg

SEQ ID NO: 406752 - DNA, 20 bp, Artificial
  CRISPR gRNA sequence
ctggttgtgctgtgtggttc

SEQ ID NO: 406753 - DNA, 20 bp, Artificial
  CRISPR gRNA sequence
gttgtgctgtgtggttcctt

SEQ ID NO: 406754 - DNA, 20 bp, Artificial
  CRISPR gRNA sequence
tgctgtgtggttcctttcct

SEQ ID NO: 406755 - DNA, 20 bp, Artificial
  CRISPR gRNA sequence
tgtggttcctttcctaaagc

SEQ ID NO: 406756 - DNA, 20 bp, Artificial
  CRISPR gRNA sequence
ctttcctaaagctgaggaga

SEQ ID NO: 406757 - DNA, 20 bp, Artificial
  CRISPR gRNA sequence
tcctaaagctgaggagagag

SEQ ID NO: 406758 - DNA, 20 bp, Artificial
  CRISPR gRNA sequence
cctaaagctgaggagagaga

SEQ ID NO: 406759 - DNA, 20 bp, Artificial
  CRISPR gRNA sequence
ctaaagctgaggagagagag

SEQ ID NO: 406760 - DNA, 20 bp, Artificial
  CRISPR gRNA sequence
aagctgaggagagagagaga

SEQ ID NO: 406761 - DNA, 20 bp, Artificial
  CRISPR gRNA sequence
aggagagagagagaaacaga

SEQ ID NO: 406762 - DNA, 20 bp, Artificial
  CRISPR gRNA sequence
gttacaagtgattagatcca

SEQ ID NO: 406763 - DNA, 20 bp, Artificial
  CRISPR gRNA sequence
ttacaagtgattagatccaa

SEQ ID NO: 406764 - DNA, 20 bp, Artificial
  CRISPR gRNA sequence
caagtgattagatccaaaga

SEQ ID NO: 406765 - DNA, 20 bp, Artificial
  CRISPR gRNA sequence
gatccaaagactgattcttc

SEQ ID NO: 406766 - DNA, 20 bp, Artificial
  CRISPR gRNA sequence
attcttctctttacttctct

SEQ ID NO: 406767 - DNA, 20 bp, Artificial
  CRISPR gRNA sequence
ttctctttacttctctaccc

SEQ ID NO: 406768 - DNA, 20 bp, Artificial
  CRISPR gRNA sequence
ctctttacttctctaccctg

SEQ ID NO: 406769 - DNA, 20 bp, Artificial
  CRISPR gRNA sequence
tctttacttctctaccctga

SEQ ID NO: 406770 - DNA, 20 bp, Artificial
  CRISPR gRNA sequence
tttacttctctaccctgaat

SEQ ID NO: 406771 - DNA, 20 bp, Artificial
  CRISPR gRNA sequence
tacttctctaccctgaattt

SEQ ID NO: 406772 - DNA, 20 bp, Artificial
  CRISPR gRNA sequence
acttctctaccctgaatttc

SEQ ID NO: 406773 - DNA, 20 bp, Artificial
  CRISPR gRNA sequence
cttctctaccctgaatttca

SEQ ID NO: 406774 - DNA, 20 bp, Artificial
  CRISPR gRNA sequence
ctctaccctgaatttcatcc

SEQ ID NO: 406775 - DNA, 20 bp, Artificial
  CRISPR gRNA sequence
tctaccctgaatttcatcct

SEQ ID NO: 406776 - DNA, 20 bp, Artificial
  CRISPR gRNA sequence
taccctgaatttcatcctct

SEQ ID NO: 406777 - DNA, 20 bp, Artificial
  CRISPR gRNA sequence
ccctgaatttcatcctctat

SEQ ID NO: 406778 - DNA, 20 bp, Artificial
  CRISPR gRNA sequence
aatttcatcctctataaaat

SEQ ID NO: 406779 - DNA, 20 bp, Artificial
  CRISPR gRNA sequence
catcctctataaaatgatac

SEQ ID NO: 406780 - DNA, 20 bp, Artificial
  CRISPR gRNA sequence
atcctctataaaatgataca

SEQ ID NO: 406781 - DNA, 20 bp, Artificial
  CRISPR gRNA sequence
tataaaatgatacaataatc

SEQ ID NO: 406782 - DNA, 20 bp, Artificial
  CRISPR gRNA sequence
taaaatgatacaataatcca

SEQ ID NO: 406783 - DNA, 20 bp, Artificial
  CRISPR gRNA sequence
cactgaattgtaaatgtgaa

SEQ ID NO: 406784 - DNA, 20 bp, Artificial
  CRISPR gRNA sequence
actgaattgtaaatgtgaaa

SEQ ID NO: 406785 - DNA, 20 bp, Artificial
  CRISPR gRNA sequence
aattgtaaatgtgaaaatga

SEQ ID NO: 406786 - DNA, 20 bp, Artificial
  CRISPR gRNA sequence
taaatgtgaaaatgaaatag

SEQ ID NO: 406787 - DNA, 20 bp, Artificial
  CRISPR gRNA sequence
catatgcaaagcattgaata

SEQ ID NO: 406788 - DNA, 20 bp, Artificial
  CRISPR gRNA sequence
aatatagtcacaagcagata

SEQ ID NO: 406789 - DNA, 20 bp, Artificial
  CRISPR gRNA sequence
aaactatagctgttattatt

SEQ ID NO: 406790 - DNA, 20 bp, Artificial
  CRISPR gRNA sequence
tagctgttattattattaat

SEQ ID NO: 406791 - DNA, 20 bp, Artificial
  CRISPR gRNA sequence
ttattattattaatcagacc

SEQ ID NO: 406792 - DNA, 20 bp, Artificial
  CRISPR gRNA sequence
ttattattaatcagacctaa

SEQ ID NO: 406793 - DNA, 20 bp, Artificial
  CRISPR gRNA sequence
ttattaatcagacctaaaga

SEQ ID NO: 406794 - DNA, 20 bp, Artificial
  CRISPR gRNA sequence
ttaatcagacctaaagacta

SEQ ID NO: 406795 - DNA, 20 bp, Artificial
  CRISPR gRNA sequence
atcagacctaaagactagat

SEQ ID NO: 406796 - DNA, 20 bp, Artificial
  CRISPR gRNA sequence
aagactagattattatcatc

SEQ ID NO: 406797 - DNA, 20 bp, Artificial
  CRISPR gRNA sequence
gattattatcatctttctta

SEQ ID NO: 406798 - DNA, 20 bp, Artificial
  CRISPR gRNA sequence
ttatcatctttcttaataaa

SEQ ID NO: 406799 - DNA, 20 bp, Artificial
  CRISPR gRNA sequence
tcatctttcttaataaagat

SEQ ID NO: 406800 - DNA, 20 bp, Artificial
  CRISPR gRNA sequence
tcttaataaagatcatgaaa

SEQ ID NO: 406801 - DNA, 20 bp, Artificial
  CRISPR gRNA sequence
cttaataaagatcatgaaat

SEQ ID NO: 406802 - DNA, 20 bp, Artificial
  CRISPR gRNA sequence
ttaataaagatcatgaaata

SEQ ID NO: 406803 - DNA, 20 bp, Artificial
  CRISPR gRNA sequence
aataaagatcatgaaatata

SEQ ID NO: 406804 - DNA, 20 bp, Artificial
  CRISPR gRNA sequence
ataaagatcatgaaatatag

SEQ ID NO: 406805 - DNA, 20 bp, Artificial
  CRISPR gRNA sequence
agcaaatcagaggtgacatt

SEQ ID NO: 406806 - DNA, 20 bp, Artificial
  CRISPR gRNA sequence
gttctagccctcagtagaga

SEQ ID NO: 406807 - DNA, 20 bp, Artificial
  CRISPR gRNA sequence
ttctagccctcagtagagag

SEQ ID NO: 406808 - DNA, 20 bp, Artificial
  CRISPR gRNA sequence
tagccctcagtagagaggaa

SEQ ID NO: 406809 - DNA, 20 bp, Artificial
  CRISPR gRNA sequence
gccctcagtagagaggaatt

SEQ ID NO: 406810 - DNA, 20 bp, Artificial
  CRISPR gRNA sequence
agtagagaggaattttatgt

SEQ ID NO: 406811 - DNA, 20 bp, Artificial
  CRISPR gRNA sequence
tatgtccaaaaatttaaaga

SEQ ID NO: 406812 - DNA, 20 bp, Artificial
  CRISPR gRNA sequence
atgtccaaaaatttaaagaa

SEQ ID NO: 406813 - DNA, 20 bp, Artificial
  CRISPR gRNA sequence
tgtccaaaaatttaaagaat

SEQ ID NO: 406814 - DNA, 20 bp, Artificial
  CRISPR gRNA sequence
aaagaattttgtagcctaga

SEQ ID NO: 406815 - DNA, 20 bp, Artificial
  CRISPR gRNA sequence
aagaattttgtagcctagac

SEQ ID NO: 406816 - DNA, 20 bp, Artificial
  CRISPR gRNA sequence
tgtagcctagacatctcaat

SEQ ID NO: 406817 - DNA, 20 bp, Artificial
  CRISPR gRNA sequence
gtagcctagacatctcaatc

SEQ ID NO: 406818 - DNA, 20 bp, Artificial
  CRISPR gRNA sequence
tagcctagacatctcaatct

SEQ ID NO: 406819 - DNA, 20 bp, Artificial
  CRISPR gRNA sequence
gacatctcaatctcaaaatg

SEQ ID NO: 406820 - DNA, 20 bp, Artificial
  CRISPR gRNA sequence
aatctcaaaatgtacagagc

SEQ ID NO: 406821 - DNA, 20 bp, Artificial
  CRISPR gRNA sequence
aaaatgtacagagctttgta

SEQ ID NO: 406822 - DNA, 20 bp, Artificial
  CRISPR gRNA sequence
tgtataccctttctcagaac

SEQ ID NO: 406823 - DNA, 20 bp, Artificial
  CRISPR gRNA sequence
gtataccctttctcagaact

SEQ ID NO: 406824 - DNA, 20 bp, Artificial
  CRISPR gRNA sequence
tataccctttctcagaactc

SEQ ID NO: 406825 - DNA, 20 bp, Artificial
  CRISPR gRNA sequence
tctcagaactcaggaaggaa

SEQ ID NO: 406826 - DNA, 20 bp, Artificial
  CRISPR gRNA sequence
ctcagaactcaggaaggaaa

SEQ ID NO: 406827 - DNA, 20 bp, Artificial
  CRISPR gRNA sequence
tcagaactcaggaaggaaaa

SEQ ID NO: 406828 - DNA, 20 bp, Artificial
  CRISPR gRNA sequence
agaactcaggaaggaaaaga

SEQ ID NO: 406829 - DNA, 20 bp, Artificial
  CRISPR gRNA sequence
aggaaggaaaagatatgtgg

SEQ ID NO: 406830 - DNA, 20 bp, Artificial
  CRISPR gRNA sequence
taaaaatagccactcacttt

SEQ ID NO: 406831 - DNA, 20 bp, Artificial
  CRISPR gRNA sequence
aaaaatagccactcacttta

SEQ ID NO: 406832 - DNA, 20 bp, Artificial
  CRISPR gRNA sequence
aaaatagccactcactttat

SEQ ID NO: 406833 - DNA, 20 bp, Artificial
  CRISPR gRNA sequence
actttatgacaacattgcag

SEQ ID NO: 406834 - DNA, 20 bp, Artificial
  CRISPR gRNA sequence
tatgacaacattgcagattt

SEQ ID NO: 406835 - DNA, 20 bp, Artificial
  CRISPR gRNA sequence
atgacaacattgcagatttt

SEQ ID NO: 406836 - DNA, 20 bp, Artificial
  CRISPR gRNA sequence
tgacaacattgcagattttg

SEQ ID NO: 406837 - DNA, 20 bp, Artificial
  CRISPR gRNA sequence
cagattttgatgtctcctgg

SEQ ID NO: 406838 - DNA, 20 bp, Artificial
  CRISPR gRNA sequence
tgatgtctcctgggttttca

SEQ ID NO: 406839 - DNA, 20 bp, Artificial
  CRISPR gRNA sequence
gatgtctcctgggttttcac

SEQ ID NO: 406840 - DNA, 20 bp, Artificial
  CRISPR gRNA sequence
atgtctcctgggttttcact

SEQ ID NO: 406841 - DNA, 20 bp, Artificial
  CRISPR gRNA sequence
ctgggttttcactaatttct

SEQ ID NO: 406842 - DNA, 20 bp, Artificial
  CRISPR gRNA sequence
ggttttcactaatttcttcc

SEQ ID NO: 406843 - DNA, 20 bp, Artificial
  CRISPR gRNA sequence
tcactaatttcttcctgtaa

SEQ ID NO: 406844 - DNA, 20 bp, Artificial
  CRISPR gRNA sequence
cactaatttcttcctgtaag

SEQ ID NO: 406845 - DNA, 20 bp, Artificial
  CRISPR gRNA sequence
actaatttcttcctgtaaga

SEQ ID NO: 406846 - DNA, 20 bp, Artificial
  CRISPR gRNA sequence
atttcttcctgtaagaaggc

SEQ ID NO: 406847 - DNA, 20 bp, Artificial
  CRISPR gRNA sequence
cttcctgtaagaaggctcaa

SEQ ID NO: 406848 - DNA, 20 bp, Artificial
  CRISPR gRNA sequence
ttcctgtaagaaggctcaac

SEQ ID NO: 406849 - DNA, 20 bp, Artificial
  CRISPR gRNA sequence
cctgtaagaaggctcaacca

SEQ ID NO: 406850 - DNA, 20 bp, Artificial
  CRISPR gRNA sequence
ctgtaagaaggctcaaccat

SEQ ID NO: 406851 - DNA, 20 bp, Artificial
  CRISPR gRNA sequence
taagaaggctcaaccatttt

SEQ ID NO: 406852 - DNA, 20 bp, Artificial
  CRISPR gRNA sequence
aaccattttatgtttaaatg

SEQ ID NO: 406853 - DNA, 20 bp, Artificial
  CRISPR gRNA sequence
tatgtttaaatgaagaaatg

SEQ ID NO: 406854 - DNA, 20 bp, Artificial
  CRISPR gRNA sequence
atgtttaaatgaagaaatga

SEQ ID NO: 406855 - DNA, 20 bp, Artificial
  CRISPR gRNA sequence
tgtttaaatgaagaaatgaa

SEQ ID NO: 406856 - DNA, 20 bp, Artificial
  CRISPR gRNA sequence
aaatgaagaaatgaaagaaa

SEQ ID NO: 406857 - DNA, 20 bp, Artificial
  CRISPR gRNA sequence
aatgaagaaatgaaagaaac

SEQ ID NO: 406858 - DNA, 20 bp, Artificial
  CRISPR gRNA sequence
tgacttttgttgccattgct

SEQ ID NO: 406859 - DNA, 20 bp, Artificial
  CRISPR gRNA sequence
gacttttgttgccattgctt

SEQ ID NO: 406860 - DNA, 20 bp, Artificial
  CRISPR gRNA sequence
acttttgttgccattgcttt

SEQ ID NO: 406861 - DNA, 20 bp, Artificial
  CRISPR gRNA sequence
ttgttgccattgcttttggt

SEQ ID NO: 406862 - DNA, 20 bp, Artificial
  CRISPR gRNA sequence
tgttgccattgcttttggtg

SEQ ID NO: 406863 - DNA, 20 bp, Artificial
  CRISPR gRNA sequence
gttgccattgcttttggtgt

SEQ ID NO: 406864 - DNA, 20 bp, Artificial
  CRISPR gRNA sequence
ttgccattgcttttggtgtt

SEQ ID NO: 406865 - DNA, 20 bp, Artificial
  CRISPR gRNA sequence
ccattgcttttggtgtttta

SEQ ID NO: 406866 - DNA, 20 bp, Artificial
  CRISPR gRNA sequence
cttttggtgttttaggcatg

SEQ ID NO: 406867 - DNA, 20 bp, Artificial
  CRISPR gRNA sequence
ttggtgttttaggcatgaag

SEQ ID NO: 406868 - DNA, 20 bp, Artificial
  CRISPR gRNA sequence
tggtgttttaggcatgaagc

SEQ ID NO: 406869 - DNA, 20 bp, Artificial
  CRISPR gRNA sequence
ggtgttttaggcatgaagcc

SEQ ID NO: 406870 - DNA, 20 bp, Artificial
  CRISPR gRNA sequence
gtgttttaggcatgaagccc

SEQ ID NO: 406871 - DNA, 20 bp, Artificial
  CRISPR gRNA sequence
taggcatgaagcccttgccc

SEQ ID NO: 406872 - DNA, 20 bp, Artificial
  CRISPR gRNA sequence
aggcatgaagcccttgccca

SEQ ID NO: 406873 - DNA, 20 bp, Artificial
  CRISPR gRNA sequence
ggcatgaagcccttgcccat

SEQ ID NO: 406874 - DNA, 20 bp, Artificial
  CRISPR gRNA sequence
gcccatgcctatgtcctgaa

SEQ ID NO: 406875 - DNA, 20 bp, Artificial
  CRISPR gRNA sequence
cccatgcctatgtcctgaat

SEQ ID NO: 406876 - DNA, 20 bp, Artificial
  CRISPR gRNA sequence
tgtcctgaatggtaatgcct

SEQ ID NO: 406877 - DNA, 20 bp, Artificial
  CRISPR gRNA sequence
aatggtaatgcctaggtttt

SEQ ID NO: 406878 - DNA, 20 bp, Artificial
  CRISPR gRNA sequence
ggttttcttctagggttttt

SEQ ID NO: 406879 - DNA, 20 bp, Artificial
  CRISPR gRNA sequence
tcttctagggtttttatggt

SEQ ID NO: 406880 - DNA, 20 bp, Artificial
  CRISPR gRNA sequence
cttctagggtttttatggtt

SEQ ID NO: 406881 - DNA, 20 bp, Artificial
  CRISPR gRNA sequence
ttctagggtttttatggttt

SEQ ID NO: 406882 - DNA, 20 bp, Artificial
  CRISPR gRNA sequence
ctagggtttttatggtttta

SEQ ID NO: 406883 - DNA, 20 bp, Artificial
  CRISPR gRNA sequence
tagggtttttatggttttag

SEQ ID NO: 406884 - DNA, 20 bp, Artificial
  CRISPR gRNA sequence
gggtttttatggttttaggt

SEQ ID NO: 406885 - DNA, 20 bp, Artificial
  CRISPR gRNA sequence
ttatggttttaggtctaaca

SEQ ID NO: 406886 - DNA, 20 bp, Artificial
  CRISPR gRNA sequence
tatggttttaggtctaacat

SEQ ID NO: 406887 - DNA, 20 bp, Artificial
  CRISPR gRNA sequence
atggttttaggtctaacatt

SEQ ID NO: 406888 - DNA, 20 bp, Artificial
  CRISPR gRNA sequence
tggttttaggtctaacattt

SEQ ID NO: 406889 - DNA, 20 bp, Artificial
  CRISPR gRNA sequence
taggtctaacatttaagtct

SEQ ID NO: 406890 - DNA, 20 bp, Artificial
  CRISPR gRNA sequence
aggtctaacatttaagtctt

SEQ ID NO: 406891 - DNA, 20 bp, Artificial
  CRISPR gRNA sequence
ggtctaacatttaagtcttt

SEQ ID NO: 406892 - DNA, 20 bp, Artificial
  CRISPR gRNA sequence
acatttaagtctttaatcca

SEQ ID NO: 406893 - DNA, 20 bp, Artificial
  CRISPR gRNA sequence
aagtctttaatccatcttga

SEQ ID NO: 406894 - DNA, 20 bp, Artificial
  CRISPR gRNA sequence
agtctttaatccatcttgaa

SEQ ID NO: 406895 - DNA, 20 bp, Artificial
  CRISPR gRNA sequence
taatccatcttgaattaatt

SEQ ID NO: 406896 - DNA, 20 bp, Artificial
  CRISPR gRNA sequence
aatccatcttgaattaattt

SEQ ID NO: 406897 - DNA, 20 bp, Artificial
  CRISPR gRNA sequence
atccatcttgaattaatttt

SEQ ID NO: 406898 - DNA, 20 bp, Artificial
  CRISPR gRNA sequence
gaattaatttttgtataagg

SEQ ID NO: 406899 - DNA, 20 bp, Artificial
  CRISPR gRNA sequence
aattaatttttgtataaggt

SEQ ID NO: 406900 - DNA, 20 bp, Artificial
  CRISPR gRNA sequence
atttttgtataaggtgtaag

SEQ ID NO: 406901 - DNA, 20 bp, Artificial
  CRISPR gRNA sequence
ttgtataaggtgtaaggaag

SEQ ID NO: 406902 - DNA, 20 bp, Artificial
  CRISPR gRNA sequence
tgtataaggtgtaaggaagg

SEQ ID NO: 406903 - DNA, 20 bp, Artificial
  CRISPR gRNA sequence
gtataaggtgtaaggaaggg

SEQ ID NO: 406904 - DNA, 20 bp, Artificial
  CRISPR gRNA sequence
tataaggtgtaaggaaggga

SEQ ID NO: 406905 - DNA, 20 bp, Artificial
  CRISPR gRNA sequence
cagctttctacatatggcta

SEQ ID NO: 406906 - DNA, 20 bp, Artificial
  CRISPR gRNA sequence
agctttctacatatggctag

SEQ ID NO: 406907 - DNA, 20 bp, Artificial
  CRISPR gRNA sequence
tctacatatggctagccagt

SEQ ID NO: 406908 - DNA, 20 bp, Artificial
  CRISPR gRNA sequence
ctacatatggctagccagtt

SEQ ID NO: 406909 - DNA, 20 bp, Artificial
  CRISPR gRNA sequence
tacatatggctagccagttt

SEQ ID NO: 406910 - DNA, 20 bp, Artificial
  CRISPR gRNA sequence
catatggctagccagttttc

SEQ ID NO: 406911 - DNA, 20 bp, Artificial
  CRISPR gRNA sequence
gccagttttcccagcaccat

SEQ ID NO: 406912 - DNA, 20 bp, Artificial
  CRISPR gRNA sequence
tcccagcaccatacatatgt

SEQ ID NO: 406913 - DNA, 20 bp, Artificial
  CRISPR gRNA sequence
cccagcaccatacatatgta

SEQ ID NO: 406914 - DNA, 20 bp, Artificial
  CRISPR gRNA sequence
ccagcaccatacatatgtaa

SEQ ID NO: 406915 - DNA, 20 bp, Artificial
  CRISPR gRNA sequence
cacgtgtgcacatgtaccct

SEQ ID NO: 406916 - DNA, 20 bp, Artificial
  CRISPR gRNA sequence
gaacttaaagtataataaaa

SEQ ID NO: 406917 - DNA, 20 bp, Artificial
  CRISPR gRNA sequence
aaagtataataaaaaaagaa

SEQ ID NO: 406918 - DNA, 20 bp, Artificial
  CRISPR gRNA sequence
aagtataataaaaaaagaaa

SEQ ID NO: 406919 - DNA, 20 bp, Artificial
  CRISPR gRNA sequence
tgaatagatataagaaaatg

SEQ ID NO: 406920 - DNA, 20 bp, Artificial
  CRISPR gRNA sequence
gaatagatataagaaaatga

SEQ ID NO: 406921 - DNA, 20 bp, Artificial
  CRISPR gRNA sequence
aatagatataagaaaatgaa

SEQ ID NO: 406922 - DNA, 20 bp, Artificial
  CRISPR gRNA sequence
actgtattcagctgaacaaa

SEQ ID NO: 406923 - DNA, 20 bp, Artificial
  CRISPR gRNA sequence
ctgtattcagctgaacaaaa

SEQ ID NO: 406924 - DNA, 20 bp, Artificial
  CRISPR gRNA sequence
tattcagctgaacaaaaagt

SEQ ID NO: 406925 - DNA, 20 bp, Artificial
  CRISPR gRNA sequence
agctgaacaaaaagttaagt

SEQ ID NO: 406926 - DNA, 20 bp, Artificial
  CRISPR gRNA sequence
aacaaaaagttaagtccaca

SEQ ID NO: 406927 - DNA, 20 bp, Artificial
  CRISPR gRNA sequence
agtccacagccaagaaatat

SEQ ID NO: 406928 - DNA, 20 bp, Artificial
  CRISPR gRNA sequence
agagatatatttttgtgggc

SEQ ID NO: 406929 - DNA, 20 bp, Artificial
  CRISPR gRNA sequence
ttgtgggcaaagactcttag

SEQ ID NO: 406930 - DNA, 20 bp, Artificial
  CRISPR gRNA sequence
tgtgggcaaagactcttagt

SEQ ID NO: 406931 - DNA, 20 bp, Artificial
  CRISPR gRNA sequence
gtgggcaaagactcttagtt

SEQ ID NO: 406932 - DNA, 20 bp, Artificial
  CRISPR gRNA sequence
tgggcaaagactcttagttc

SEQ ID NO: 406933 - DNA, 20 bp, Artificial
  CRISPR gRNA sequence
ttagttcagtatgcttatta

SEQ ID NO: 406934 - DNA, 20 bp, Artificial
  CRISPR gRNA sequence
agttcagtatgcttattagt

SEQ ID NO: 406935 - DNA, 20 bp, Artificial
  CRISPR gRNA sequence
gttcagtatgcttattagta

SEQ ID NO: 406936 - DNA, 20 bp, Artificial
  CRISPR gRNA sequence
agtatgcttattagtaatac

SEQ ID NO: 406937 - DNA, 20 bp, Artificial
  CRISPR gRNA sequence
attagtaatacacacacaca

SEQ ID NO: 406938 - DNA, 20 bp, Artificial
  CRISPR gRNA sequence
ttagtaatacacacacacat

SEQ ID NO: 406939 - DNA, 20 bp, Artificial
  CRISPR gRNA sequence
gtaatacacacacacatatg

SEQ ID NO: 406940 - DNA, 20 bp, Artificial
  CRISPR gRNA sequence
tattttattttgagaaaaga

SEQ ID NO: 406941 - DNA, 20 bp, Artificial
  CRISPR gRNA sequence
ttttattttgagaaaagaat

SEQ ID NO: 406942 - DNA, 20 bp, Artificial
  CRISPR gRNA sequence
tattttgagaaaagaataaa

SEQ ID NO: 406943 - DNA, 20 bp, Artificial
  CRISPR gRNA sequence
attttgagaaaagaataaaa

SEQ ID NO: 406944 - DNA, 20 bp, Artificial
  CRISPR gRNA sequence
ttttgagaaaagaataaaaa

SEQ ID NO: 406945 - DNA, 20 bp, Artificial
  CRISPR gRNA sequence
tgagaaaagaataaaaatca

SEQ ID NO: 406946 - DNA, 20 bp, Artificial
  CRISPR gRNA sequence
gagaaaagaataaaaatcac

SEQ ID NO: 406947 - DNA, 20 bp, Artificial
  CRISPR gRNA sequence
agaaaagaataaaaatcaca

SEQ ID NO: 406948 - DNA, 20 bp, Artificial
  CRISPR gRNA sequence
aaaatgtataccaaagtatt

SEQ ID NO: 406949 - DNA, 20 bp, Artificial
  CRISPR gRNA sequence
acctctttattttaatcaag

SEQ ID NO: 406950 - DNA, 20 bp, Artificial
  CRISPR gRNA sequence
cctctttattttaatcaagt

SEQ ID NO: 406951 - DNA, 20 bp, Artificial
  CRISPR gRNA sequence
tttattttaatcaagtgatt

SEQ ID NO: 406952 - DNA, 20 bp, Artificial
  CRISPR gRNA sequence
tattttaatcaagtgattag

SEQ ID NO: 406953 - DNA, 20 bp, Artificial
  CRISPR gRNA sequence
attttaatcaagtgattaga

SEQ ID NO: 406954 - DNA, 20 bp, Artificial
  CRISPR gRNA sequence
ttttaatcaagtgattagaa

SEQ ID NO: 406955 - DNA, 20 bp, Artificial
  CRISPR gRNA sequence
taatcaagtgattagaaaat

SEQ ID NO: 406956 - DNA, 20 bp, Artificial
  CRISPR gRNA sequence
aatcaagtgattagaaaata

SEQ ID NO: 406957 - DNA, 20 bp, Artificial
  CRISPR gRNA sequence
atcaagtgattagaaaatac

SEQ ID NO: 406958 - DNA, 20 bp, Artificial
  CRISPR gRNA sequence
gaaaatacatgaaaaagtaa

SEQ ID NO: 406959 - DNA, 20 bp, Artificial
  CRISPR gRNA sequence
ctttggattagagttgagaa

SEQ ID NO: 406960 - DNA, 20 bp, Artificial
  CRISPR gRNA sequence
tggattagagttgagaattc

SEQ ID NO: 406961 - DNA, 20 bp, Artificial
  CRISPR gRNA sequence
ggattagagttgagaattct

SEQ ID NO: 406962 - DNA, 20 bp, Artificial
  CRISPR gRNA sequence
gattagagttgagaattctg

SEQ ID NO: 406963 - DNA, 20 bp, Artificial
  CRISPR gRNA sequence
gagttgagaattctggcctc

SEQ ID NO: 406964 - DNA, 20 bp, Artificial
  CRISPR gRNA sequence
agaattctggcctcattttg

SEQ ID NO: 406965 - DNA, 20 bp, Artificial
  CRISPR gRNA sequence
tggcctcattttgagtgaat

SEQ ID NO: 406966 - DNA, 20 bp, Artificial
  CRISPR gRNA sequence
gcctcattttgagtgaattg

SEQ ID NO: 406967 - DNA, 20 bp, Artificial
  CRISPR gRNA sequence
attttgagtgaattgggtat

SEQ ID NO: 406968 - DNA, 20 bp, Artificial
  CRISPR gRNA sequence
tgagtgaattgggtattatt

SEQ ID NO: 406969 - DNA, 20 bp, Artificial
  CRISPR gRNA sequence
gagtgaattgggtattattc

SEQ ID NO: 406970 - DNA, 20 bp, Artificial
  CRISPR gRNA sequence
agtgaattgggtattattcc

SEQ ID NO: 406971 - DNA, 20 bp, Artificial
  CRISPR gRNA sequence
ggtattattccaaacttata

SEQ ID NO: 406972 - DNA, 20 bp, Artificial
  CRISPR gRNA sequence
ttccaaacttatatgagtgt

SEQ ID NO: 406973 - DNA, 20 bp, Artificial
  CRISPR gRNA sequence
caaacttatatgagtgttag

SEQ ID NO: 406974 - DNA, 20 bp, Artificial
  CRISPR gRNA sequence
atatgagtgttagcattccc

SEQ ID NO: 406975 - DNA, 20 bp, Artificial
  CRISPR gRNA sequence
tatgagtgttagcattcccg

SEQ ID NO: 406976 - DNA, 20 bp, Artificial
  CRISPR gRNA sequence
gcattcccgtgtgtgtgagt

SEQ ID NO: 406977 - DNA, 20 bp, Artificial
  CRISPR gRNA sequence
ccgtgtgtgtgagtattgcc

SEQ ID NO: 406978 - DNA, 20 bp, Artificial
  CRISPR gRNA sequence
ccgacctgcggggatgggtg

SEQ ID NO: 406979 - DNA, 20 bp, Artificial
  CRISPR gRNA sequence
cggggatgggtgaagtggag

SEQ ID NO: 406980 - DNA, 20 bp, Artificial
  CRISPR gRNA sequence
gccgcatcagttgtgcccac

SEQ ID NO: 406981 - DNA, 20 bp, Artificial
  CRISPR gRNA sequence
tgcccactctgtgaacatgg

SEQ ID NO: 406982 - DNA, 20 bp, Artificial
  CRISPR gRNA sequence
tgtgaacatggactttaagg

SEQ ID NO: 406983 - DNA, 20 bp, Artificial
  CRISPR gRNA sequence
tgaacatggactttaaggtc

SEQ ID NO: 406984 - DNA, 20 bp, Artificial
  CRISPR gRNA sequence
taaggtcgctcttcatatgt

SEQ ID NO: 406985 - DNA, 20 bp, Artificial
  CRISPR gRNA sequence
aaggtcgctcttcatatgtg

SEQ ID NO: 406986 - DNA, 20 bp, Artificial
  CRISPR gRNA sequence
aggtcgctcttcatatgtgg

SEQ ID NO: 406987 - DNA, 20 bp, Artificial
  CRISPR gRNA sequence
ttcatatgtggtttgtagca

SEQ ID NO: 406988 - DNA, 20 bp, Artificial
  CRISPR gRNA sequence
catatgtggtttgtagcaat

SEQ ID NO: 406989 - DNA, 20 bp, Artificial
  CRISPR gRNA sequence
atatgtggtttgtagcaata

SEQ ID NO: 406990 - DNA, 20 bp, Artificial
  CRISPR gRNA sequence
gtagcaatatctgtttaggg

SEQ ID NO: 406991 - DNA, 20 bp, Artificial
  CRISPR gRNA sequence
tagcaatatctgtttagggt

SEQ ID NO: 406992 - DNA, 20 bp, Artificial
  CRISPR gRNA sequence
tttagggtttattttcaatt

SEQ ID NO: 406993 - DNA, 20 bp, Artificial
  CRISPR gRNA sequence
agggtttattttcaatttgt

SEQ ID NO: 406994 - DNA, 20 bp, Artificial
  CRISPR gRNA sequence
gggtttattttcaatttgtt

SEQ ID NO: 406995 - DNA, 20 bp, Artificial
  CRISPR gRNA sequence
attttcaatttgttttggtc

SEQ ID NO: 406996 - DNA, 20 bp, Artificial
  CRISPR gRNA sequence
ttttcaatttgttttggtcc

SEQ ID NO: 406997 - DNA, 20 bp, Artificial
  CRISPR gRNA sequence
tcaatttgttttggtcccaa

SEQ ID NO: 406998 - DNA, 20 bp, Artificial
  CRISPR gRNA sequence
caatttgttttggtcccaac

SEQ ID NO: 406999 - DNA, 20 bp, Artificial
  CRISPR gRNA sequence
aatttgttttggtcccaact

SEQ ID NO: 407000 - DNA, 20 bp, Artificial
  CRISPR gRNA sequence
gttttggtcccaacttccaa

SEQ ID NO: 407001 - DNA, 20 bp, Artificial
  CRISPR gRNA sequence
ttttggtcccaacttccaaa

SEQ ID NO: 407002 - DNA, 20 bp, Artificial
  CRISPR gRNA sequence
tggtcccaacttccaaaaat

SEQ ID NO: 407003 - DNA, 20 bp, Artificial
  CRISPR gRNA sequence
ggtcccaacttccaaaaatg

SEQ ID NO: 407004 - DNA, 20 bp, Artificial
  CRISPR gRNA sequence
gtcccaacttccaaaaatga

SEQ ID NO: 407005 - DNA, 20 bp, Artificial
  CRISPR gRNA sequence
ccaaaaatgaagaaggcagt

SEQ ID NO: 407006 - DNA, 20 bp, Artificial
  CRISPR gRNA sequence
caaaaatgaagaaggcagtt

SEQ ID NO: 407007 - DNA, 20 bp, Artificial
  CRISPR gRNA sequence
ccagggcttgctaggctaat

SEQ ID NO: 407008 - DNA, 20 bp, Artificial
  CRISPR gRNA sequence
gctaggctaatagactttta

SEQ ID NO: 407009 - DNA, 20 bp, Artificial
  CRISPR gRNA sequence
ctaggctaatagacttttaa

SEQ ID NO: 407010 - DNA, 20 bp, Artificial
  CRISPR gRNA sequence
ggctaatagacttttaatag

SEQ ID NO: 407011 - DNA, 20 bp, Artificial
  CRISPR gRNA sequence
atagacttttaatagctcaa

SEQ ID NO: 407012 - DNA, 20 bp, Artificial
  CRISPR gRNA sequence
ttaatagctcaatattctag

SEQ ID NO: 407013 - DNA, 20 bp, Artificial
  CRISPR gRNA sequence
taatagctcaatattctagt

SEQ ID NO: 407014 - DNA, 20 bp, Artificial
  CRISPR gRNA sequence
aatagctcaatattctagtt

SEQ ID NO: 407015 - DNA, 20 bp, Artificial
  CRISPR gRNA sequence
atagctcaatattctagttg

SEQ ID NO: 407016 - DNA, 20 bp, Artificial
  CRISPR gRNA sequence
aatattctagttggataaat

SEQ ID NO: 407017 - DNA, 20 bp, Artificial
  CRISPR gRNA sequence
tagttggataaatgtcagca

SEQ ID NO: 407018 - DNA, 20 bp, Artificial
  CRISPR gRNA sequence
gttggataaatgtcagcatt

SEQ ID NO: 407019 - DNA, 20 bp, Artificial
  CRISPR gRNA sequence
gataaatgtcagcatttgga

SEQ ID NO: 407020 - DNA, 20 bp, Artificial
  CRISPR gRNA sequence
ggagaaaggatgccggtgtt

SEQ ID NO: 407021 - DNA, 20 bp, Artificial
  CRISPR gRNA sequence
gagaaaggatgccggtgttc

SEQ ID NO: 407022 - DNA, 20 bp, Artificial
  CRISPR gRNA sequence
agttgctctttgctaatcca

SEQ ID NO: 407023 - DNA, 20 bp, Artificial
  CRISPR gRNA sequence
ctctttgctaatccactcta

SEQ ID NO: 407024 - DNA, 20 bp, Artificial
  CRISPR gRNA sequence
tttgctaatccactctatta

SEQ ID NO: 407025 - DNA, 20 bp, Artificial
  CRISPR gRNA sequence
tgctaatccactctattacc

SEQ ID NO: 407026 - DNA, 20 bp, Artificial
  CRISPR gRNA sequence
gctaatccactctattaccc

SEQ ID NO: 407027 - DNA, 20 bp, Artificial
  CRISPR gRNA sequence
ctaatccactctattaccct

SEQ ID NO: 407028 - DNA, 20 bp, Artificial
  CRISPR gRNA sequence
atccactctattacccttcc

SEQ ID NO: 407029 - DNA, 20 bp, Artificial
  CRISPR gRNA sequence
tattacccttcctcaaggga

SEQ ID NO: 407030 - DNA, 20 bp, Artificial
  CRISPR gRNA sequence
ttacccttcctcaagggaaa

SEQ ID NO: 407031 - DNA, 20 bp, Artificial
  CRISPR gRNA sequence
cccttcctcaagggaaagat

SEQ ID NO: 407032 - DNA, 20 bp, Artificial
  CRISPR gRNA sequence
cctcaagggaaagatggggc

SEQ ID NO: 407033 - DNA, 20 bp, Artificial
  CRISPR gRNA sequence
ctcaagggaaagatggggct

SEQ ID NO: 407034 - DNA, 20 bp, Artificial
  CRISPR gRNA sequence
aagggaaagatggggctctg

SEQ ID NO: 407035 - DNA, 20 bp, Artificial
  CRISPR gRNA sequence
tgtggcaatctccagcaccc

SEQ ID NO: 407036 - DNA, 20 bp, Artificial
  CRISPR gRNA sequence
tggcaatctccagcacccca

SEQ ID NO: 407037 - DNA, 20 bp, Artificial
  CRISPR gRNA sequence
cagcaccccaaacctgttcc

SEQ ID NO: 407038 - DNA, 20 bp, Artificial
  CRISPR gRNA sequence
ttccactgaagccttctctg

SEQ ID NO: 407039 - DNA, 20 bp, Artificial
  CRISPR gRNA sequence
cactgaagccttctctgagt

SEQ ID NO: 407040 - DNA, 20 bp, Artificial
  CRISPR gRNA sequence
aagccttctctgagtttttt

SEQ ID NO: 407041 - DNA, 20 bp, Artificial
  CRISPR gRNA sequence
ctctgagttttttgacagta

SEQ ID NO: 407042 - DNA, 20 bp, Artificial
  CRISPR gRNA sequence
tctgagttttttgacagtac

SEQ ID NO: 407043 - DNA, 20 bp, Artificial
  CRISPR gRNA sequence
tgagttttttgacagtactc

SEQ ID NO: 407044 - DNA, 20 bp, Artificial
  CRISPR gRNA sequence
agttttttgacagtactcac

SEQ ID NO: 407045 - DNA, 20 bp, Artificial
  CRISPR gRNA sequence
tttgacagtactcacttcaa

SEQ ID NO: 407046 - DNA, 20 bp, Artificial
  CRISPR gRNA sequence
ttgacagtactcacttcaaa

SEQ ID NO: 407047 - DNA, 20 bp, Artificial
  CRISPR gRNA sequence
tgacagtactcacttcaaaa

SEQ ID NO: 407048 - DNA, 20 bp, Artificial
  CRISPR gRNA sequence
gacagtactcacttcaaaaa

SEQ ID NO: 407049 - DNA, 20 bp, Artificial
  CRISPR gRNA sequence
acagtactcacttcaaaaaa

SEQ ID NO: 407050 - DNA, 20 bp, Artificial
  CRISPR gRNA sequence
acttcaaaaaataagattaa

SEQ ID NO: 407051 - DNA, 20 bp, Artificial
  CRISPR gRNA sequence
caaaaaataagattaactca

SEQ ID NO: 407052 - DNA, 20 bp, Artificial
  CRISPR gRNA sequence
aaaaaataagattaactcac

SEQ ID NO: 407053 - DNA, 20 bp, Artificial
  CRISPR gRNA sequence
actcacatgtgccaacatgg

SEQ ID NO: 407054 - DNA, 20 bp, Artificial
  CRISPR gRNA sequence
acatgtgccaacatggacct

SEQ ID NO: 407055 - DNA, 20 bp, Artificial
  CRISPR gRNA sequence
tctcaaggaagacagagaaa

SEQ ID NO: 407056 - DNA, 20 bp, Artificial
  CRISPR gRNA sequence
aaggaagacagagaaattta

SEQ ID NO: 407057 - DNA, 20 bp, Artificial
  CRISPR gRNA sequence
atactttttagctagcaaaa

SEQ ID NO: 407058 - DNA, 20 bp, Artificial
  CRISPR gRNA sequence
tactttttagctagcaaaat

SEQ ID NO: 407059 - DNA, 20 bp, Artificial
  CRISPR gRNA sequence
tttagctagcaaaatgttgg

SEQ ID NO: 407060 - DNA, 20 bp, Artificial
  CRISPR gRNA sequence
ttagctagcaaaatgttgga

SEQ ID NO: 407061 - DNA, 20 bp, Artificial
  CRISPR gRNA sequence
tagctagcaaaatgttggac

SEQ ID NO: 407062 - DNA, 20 bp, Artificial
  CRISPR gRNA sequence
agctagcaaaatgttggacc

SEQ ID NO: 407063 - DNA, 20 bp, Artificial
  CRISPR gRNA sequence
gctagcaaaatgttggacca

SEQ ID NO: 407064 - DNA, 20 bp, Artificial
  CRISPR gRNA sequence
gcaaaatgttggaccatttc

SEQ ID NO: 407065 - DNA, 20 bp, Artificial
  CRISPR gRNA sequence
gaccatttcaattaacattg

SEQ ID NO: 407066 - DNA, 20 bp, Artificial
  CRISPR gRNA sequence
caattaacattgtttcttgt

SEQ ID NO: 407067 - DNA, 20 bp, Artificial
  CRISPR gRNA sequence
aattaacattgtttcttgtg

SEQ ID NO: 407068 - DNA, 20 bp, Artificial
  CRISPR gRNA sequence
acattgtttcttgtgcacca

SEQ ID NO: 407069 - DNA, 20 bp, Artificial
  CRISPR gRNA sequence
tttcttgtgcaccagtatgt

SEQ ID NO: 407070 - DNA, 20 bp, Artificial
  CRISPR gRNA sequence
cttgtgcaccagtatgttga

SEQ ID NO: 407071 - DNA, 20 bp, Artificial
  CRISPR gRNA sequence
ttgtgcaccagtatgttgag

SEQ ID NO: 407072 - DNA, 20 bp, Artificial
  CRISPR gRNA sequence
gtgcaccagtatgttgagct

SEQ ID NO: 407073 - DNA, 20 bp, Artificial
  CRISPR gRNA sequence
tgcaccagtatgttgagcta

SEQ ID NO: 407074 - DNA, 20 bp, Artificial
  CRISPR gRNA sequence
agctaactcacttcgccaac

SEQ ID NO: 407075 - DNA, 20 bp, Artificial
  CRISPR gRNA sequence
actcacttcgccaacaccca

SEQ ID NO: 407076 - DNA, 20 bp, Artificial
  CRISPR gRNA sequence
acttcgccaacacccagttt

SEQ ID NO: 407077 - DNA, 20 bp, Artificial
  CRISPR gRNA sequence
cgccaacacccagtttgcta

SEQ ID NO: 407078 - DNA, 20 bp, Artificial
  CRISPR gRNA sequence
gccaacacccagtttgctat

SEQ ID NO: 407079 - DNA, 20 bp, Artificial
  CRISPR gRNA sequence
gctatttatggcctcggttc

SEQ ID NO: 407080 - DNA, 20 bp, Artificial
  CRISPR gRNA sequence
ctatttatggcctcggttcc

SEQ ID NO: 407081 - DNA, 20 bp, Artificial
  CRISPR gRNA sequence
tttatggcctcggttccacc

SEQ ID NO: 407082 - DNA, 20 bp, Artificial
  CRISPR gRNA sequence
atggcctcggttccacccat

SEQ ID NO: 407083 - DNA, 20 bp, Artificial
  CRISPR gRNA sequence
tggcctcggttccacccatg

SEQ ID NO: 407084 - DNA, 20 bp, Artificial
  CRISPR gRNA sequence
ggttccacccatgagaactc

SEQ ID NO: 407085 - DNA, 20 bp, Artificial
  CRISPR gRNA sequence
cacccatgagaactcattat

SEQ ID NO: 407086 - DNA, 20 bp, Artificial
  CRISPR gRNA sequence
attattattcctctttccta

SEQ ID NO: 407087 - DNA, 20 bp, Artificial
  CRISPR gRNA sequence
ttattcctctttcctaaccg

SEQ ID NO: 407088 - DNA, 20 bp, Artificial
  CRISPR gRNA sequence
ttcctctttcctaaccgact

SEQ ID NO: 407089 - DNA, 20 bp, Artificial
  CRISPR gRNA sequence
ctctttcctaaccgactgca

SEQ ID NO: 407090 - DNA, 20 bp, Artificial
  CRISPR gRNA sequence
tttcctaaccgactgcagtg

SEQ ID NO: 407091 - DNA, 20 bp, Artificial
  CRISPR gRNA sequence
tcctaaccgactgcagtgta

SEQ ID NO: 407092 - DNA, 20 bp, Artificial
  CRISPR gRNA sequence
cctaaccgactgcagtgtag

SEQ ID NO: 407093 - DNA, 20 bp, Artificial
  CRISPR gRNA sequence
ctaaccgactgcagtgtagt

SEQ ID NO: 407094 - DNA, 20 bp, Artificial
  CRISPR gRNA sequence
accgactgcagtgtagtccc

SEQ ID NO: 407095 - DNA, 20 bp, Artificial
  CRISPR gRNA sequence
cagtgtagtcccagcgtctt

SEQ ID NO: 407096 - DNA, 20 bp, Artificial
  CRISPR gRNA sequence
gtggtgtttactccattgcc

SEQ ID NO: 407097 - DNA, 20 bp, Artificial
  CRISPR gRNA sequence
tggtgtttactccattgcct

SEQ ID NO: 407098 - DNA, 20 bp, Artificial
  CRISPR gRNA sequence
actccattgccttgtaccac

SEQ ID NO: 407099 - DNA, 20 bp, Artificial
  CRISPR gRNA sequence
ctccattgccttgtaccact

SEQ ID NO: 407100 - DNA, 20 bp, Artificial
  CRISPR gRNA sequence
cattgccttgtaccactcaa

SEQ ID NO: 407101 - DNA, 20 bp, Artificial
  CRISPR gRNA sequence
ccttgtaccactcaagatgg

SEQ ID NO: 407102 - DNA, 20 bp, Artificial
  CRISPR gRNA sequence
gtaccactcaagatggtgtt

SEQ ID NO: 407103 - DNA, 20 bp, Artificial
  CRISPR gRNA sequence
taccactcaagatggtgttg

SEQ ID NO: 407104 - DNA, 20 bp, Artificial
  CRISPR gRNA sequence
aagatggtgttgcaaaaaca

SEQ ID NO: 407105 - DNA, 20 bp, Artificial
  CRISPR gRNA sequence
caaaaacattccttctgctc

SEQ ID NO: 407106 - DNA, 20 bp, Artificial
  CRISPR gRNA sequence
cttctgctctaccatctgtc

SEQ ID NO: 407107 - DNA, 20 bp, Artificial
  CRISPR gRNA sequence
ctgctctaccatctgtcttg

SEQ ID NO: 407108 - DNA, 20 bp, Artificial
  CRISPR gRNA sequence
tgctctaccatctgtcttgt

SEQ ID NO: 407109 - DNA, 20 bp, Artificial
  CRISPR gRNA sequence
ctctaccatctgtcttgtgt

SEQ ID NO: 407110 - DNA, 20 bp, Artificial
  CRISPR gRNA sequence
taccatctgtcttgtgtttc

SEQ ID NO: 407111 - DNA, 20 bp, Artificial
  CRISPR gRNA sequence
ccatctgtcttgtgtttctt

SEQ ID NO: 407112 - DNA, 20 bp, Artificial
  CRISPR gRNA sequence
tcttgtgtttcttttctttt

SEQ ID NO: 407113 - DNA, 20 bp, Artificial
  CRISPR gRNA sequence
gtgtttcttttcttttatag

SEQ ID NO: 407114 - DNA, 20 bp, Artificial
  CRISPR gRNA sequence
tgtttcttttcttttataga

SEQ ID NO: 407115 - DNA, 20 bp, Artificial
  CRISPR gRNA sequence
cttttcttttatagactccc

SEQ ID NO: 407116 - DNA, 20 bp, Artificial
  CRISPR gRNA sequence
ttttcttttatagactccca

SEQ ID NO: 407117 - DNA, 20 bp, Artificial
  CRISPR gRNA sequence
ttcttttatagactcccaaa

SEQ ID NO: 407118 - DNA, 20 bp, Artificial
  CRISPR gRNA sequence
tcttttatagactcccaaat

SEQ ID NO: 407119 - DNA, 20 bp, Artificial
  CRISPR gRNA sequence
cttttatagactcccaaatc

SEQ ID NO: 407120 - DNA, 20 bp, Artificial
  CRISPR gRNA sequence
ttttatagactcccaaatct

SEQ ID NO: 407121 - DNA, 20 bp, Artificial
  CRISPR gRNA sequence
ttatagactcccaaatctgg

SEQ ID NO: 407122 - DNA, 20 bp, Artificial
  CRISPR gRNA sequence
tatagactcccaaatctggc

SEQ ID NO: 407123 - DNA, 20 bp, Artificial
  CRISPR gRNA sequence
atagactcccaaatctggcc

SEQ ID NO: 407124 - DNA, 20 bp, Artificial
  CRISPR gRNA sequence
tagactcccaaatctggccc

SEQ ID NO: 407125 - DNA, 20 bp, Artificial
  CRISPR gRNA sequence
ccaaatctggccctcttacc

SEQ ID NO: 407126 - DNA, 20 bp, Artificial
  CRISPR gRNA sequence
gccctcttacccttctaata

SEQ ID NO: 407127 - DNA, 20 bp, Artificial
  CRISPR gRNA sequence
ttacccttctaataatcttt

SEQ ID NO: 407128 - DNA, 20 bp, Artificial
  CRISPR gRNA sequence
acccttctaataatctttaa

SEQ ID NO: 407129 - DNA, 20 bp, Artificial
  CRISPR gRNA sequence
cccttctaataatctttaaa

SEQ ID NO: 407130 - DNA, 20 bp, Artificial
  CRISPR gRNA sequence
ctaataatctttaaatttta

SEQ ID NO: 407131 - DNA, 20 bp, Artificial
  CRISPR gRNA sequence
taataatctttaaattttag

SEQ ID NO: 407132 - DNA, 20 bp, Artificial
  CRISPR gRNA sequence
ataatctttaaattttagaa

SEQ ID NO: 407133 - DNA, 20 bp, Artificial
  CRISPR gRNA sequence
taaattttagaatattttta

SEQ ID NO: 407134 - DNA, 20 bp, Artificial
  CRISPR gRNA sequence
aaattttagaatatttttag

SEQ ID NO: 407135 - DNA, 20 bp, Artificial
  CRISPR gRNA sequence
aattttagaatatttttaga

SEQ ID NO: 407136 - DNA, 20 bp, Artificial
  CRISPR gRNA sequence
tagaatatttttagatttac

SEQ ID NO: 407137 - DNA, 20 bp, Artificial
  CRISPR gRNA sequence
agaatatttttagatttaca

SEQ ID NO: 407138 - DNA, 20 bp, Artificial
  CRISPR gRNA sequence
gaatatttttagatttacag

SEQ ID NO: 407139 - DNA, 20 bp, Artificial
  CRISPR gRNA sequence
ttagatttacagaaaagtgg

SEQ ID NO: 407140 - DNA, 20 bp, Artificial
  CRISPR gRNA sequence
tagatttacagaaaagtgga

SEQ ID NO: 407141 - DNA, 20 bp, Artificial
  CRISPR gRNA sequence
agatttacagaaaagtggaa

SEQ ID NO: 407142 - DNA, 20 bp, Artificial
  CRISPR gRNA sequence
gatttacagaaaagtggaaa

SEQ ID NO: 407143 - DNA, 20 bp, Artificial
  CRISPR gRNA sequence
acagaaaagtggaaaaacta

SEQ ID NO: 407144 - DNA, 20 bp, Artificial
  CRISPR gRNA sequence
cagaaaagtggaaaaactag

SEQ ID NO: 407145 - DNA, 20 bp, Artificial
  CRISPR gRNA sequence
gtacagatagtttccatata

SEQ ID NO: 407146 - DNA, 20 bp, Artificial
  CRISPR gRNA sequence
ccatataccccttatccagt

SEQ ID NO: 407147 - DNA, 20 bp, Artificial
  CRISPR gRNA sequence
catataccccttatccagtc

SEQ ID NO: 407148 - DNA, 20 bp, Artificial
  CRISPR gRNA sequence
atccagtctcccccattgtt

SEQ ID NO: 407149 - DNA, 20 bp, Artificial
  CRISPR gRNA sequence
tccagtctcccccattgtta

SEQ ID NO: 407150 - DNA, 20 bp, Artificial
  CRISPR gRNA sequence
ccccattgttaacatctcac

SEQ ID NO: 407151 - DNA, 20 bp, Artificial
  CRISPR gRNA sequence
ttaacatctcacattattgt

SEQ ID NO: 407152 - DNA, 20 bp, Artificial
  CRISPR gRNA sequence
acatctcacattattgtggt

SEQ ID NO: 407153 - DNA, 20 bp, Artificial
  CRISPR gRNA sequence
acattattgtggtatgtttg

SEQ ID NO: 407154 - DNA, 20 bp, Artificial
  CRISPR gRNA sequence
ttgtggtatgtttgttaaac

SEQ ID NO: 407155 - DNA, 20 bp, Artificial
  CRISPR gRNA sequence
tggtatgtttgttaaaccaa

SEQ ID NO: 407156 - DNA, 20 bp, Artificial
  CRISPR gRNA sequence
gttaaaccaaagaaactgaa

SEQ ID NO: 407157 - DNA, 20 bp, Artificial
  CRISPR gRNA sequence
ttaaaccaaagaaactgaaa

SEQ ID NO: 407158 - DNA, 20 bp, Artificial
  CRISPR gRNA sequence
aaccaaagaaactgaaacta

SEQ ID NO: 407159 - DNA, 20 bp, Artificial
  CRISPR gRNA sequence
aaactagtatactaccgtta

SEQ ID NO: 407160 - DNA, 20 bp, Artificial
  CRISPR gRNA sequence
gtatactaccgttaactcag

SEQ ID NO: 407161 - DNA, 20 bp, Artificial
  CRISPR gRNA sequence
ccgttaactcagctctagac

SEQ ID NO: 407162 - DNA, 20 bp, Artificial
  CRISPR gRNA sequence
actcagctctagactttatt

SEQ ID NO: 407163 - DNA, 20 bp, Artificial
  CRISPR gRNA sequence
agctctagactttatttgga

SEQ ID NO: 407164 - DNA, 20 bp, Artificial
  CRISPR gRNA sequence
tagactttatttggatccaa

SEQ ID NO: 407165 - DNA, 20 bp, Artificial
  CRISPR gRNA sequence
gactttatttggatccaaag

SEQ ID NO: 407166 - DNA, 20 bp, Artificial
  CRISPR gRNA sequence
tatttggatccaaagtgatt

SEQ ID NO: 407167 - DNA, 20 bp, Artificial
  CRISPR gRNA sequence
atttggatccaaagtgatta

SEQ ID NO: 407168 - DNA, 20 bp, Artificial
  CRISPR gRNA sequence
tttggatccaaagtgattat

SEQ ID NO: 407169 - DNA, 20 bp, Artificial
  CRISPR gRNA sequence
ggatccaaagtgattatgtt

SEQ ID NO: 407170 - DNA, 20 bp, Artificial
  CRISPR gRNA sequence
gatccaaagtgattatgttt

SEQ ID NO: 407171 - DNA, 20 bp, Artificial
  CRISPR gRNA sequence
tgttttgtcctctttccttt

SEQ ID NO: 407172 - DNA, 20 bp, Artificial
  CRISPR gRNA sequence
tgtcctctttcctttccagg

SEQ ID NO: 407173 - DNA, 20 bp, Artificial
  CRISPR gRNA sequence
gtcctctttcctttccaggg

SEQ ID NO: 407174 - DNA, 20 bp, Artificial
  CRISPR gRNA sequence
tcctctttcctttccagggt

SEQ ID NO: 407175 - DNA, 20 bp, Artificial
  CRISPR gRNA sequence
tttcctttccagggtctcct

SEQ ID NO: 407176 - DNA, 20 bp, Artificial
  CRISPR gRNA sequence
tcctttccagggtctcctcc

SEQ ID NO: 407177 - DNA, 20 bp, Artificial
  CRISPR gRNA sequence
cctttccagggtctcctcca

SEQ ID NO: 407178 - DNA, 20 bp, Artificial
  CRISPR gRNA sequence
ctttccagggtctcctccac

SEQ ID NO: 407179 - DNA, 20 bp, Artificial
  CRISPR gRNA sequence
tccagggtctcctccaccag

SEQ ID NO: 407180 - DNA, 20 bp, Artificial
  CRISPR gRNA sequence
ccagggtctcctccaccagg

SEQ ID NO: 407181 - DNA, 20 bp, Artificial
  CRISPR gRNA sequence
cagggtctcctccaccaggc

SEQ ID NO: 407182 - DNA, 20 bp, Artificial
  CRISPR gRNA sequence
ctccaccaggccaccacatt

SEQ ID NO: 407183 - DNA, 20 bp, Artificial
  CRISPR gRNA sequence
caccaggccaccacattgca

SEQ ID NO: 407184 - DNA, 20 bp, Artificial
  CRISPR gRNA sequence
cattgagttgccacttctcc

SEQ ID NO: 407185 - DNA, 20 bp, Artificial
  CRISPR gRNA sequence
agttgccacttctccccagt

SEQ ID NO: 407186 - DNA, 20 bp, Artificial
  CRISPR gRNA sequence
ccacttctccccagtttcct

SEQ ID NO: 407187 - DNA, 20 bp, Artificial
  CRISPR gRNA sequence
ctccccagtttcctctgatc

SEQ ID NO: 407188 - DNA, 20 bp, Artificial
  CRISPR gRNA sequence
tccccagtttcctctgatct

SEQ ID NO: 407189 - DNA, 20 bp, Artificial
  CRISPR gRNA sequence
cccagtttcctctgatctgt

SEQ ID NO: 407190 - DNA, 20 bp, Artificial
  CRISPR gRNA sequence
cctctgatctgtgacagttt

SEQ ID NO: 407191 - DNA, 20 bp, Artificial
  CRISPR gRNA sequence
ctctgatctgtgacagtttc

SEQ ID NO: 407192 - DNA, 20 bp, Artificial
  CRISPR gRNA sequence
tgatctgtgacagtttctat

SEQ ID NO: 407193 - DNA, 20 bp, Artificial
  CRISPR gRNA sequence
atctgtgacagtttctatct

SEQ ID NO: 407194 - DNA, 20 bp, Artificial
  CRISPR gRNA sequence
tgacagtttctatctctcct

SEQ ID NO: 407195 - DNA, 20 bp, Artificial
  CRISPR gRNA sequence
ctatctctccttgcttttca

SEQ ID NO: 407196 - DNA, 20 bp, Artificial
  CRISPR gRNA sequence
tatctctccttgcttttcac

SEQ ID NO: 407197 - DNA, 20 bp, Artificial
  CRISPR gRNA sequence
tctctccttgcttttcacaa

SEQ ID NO: 407198 - DNA, 20 bp, Artificial
  CRISPR gRNA sequence
tccttgcttttcacaaccct

SEQ ID NO: 407199 - DNA, 20 bp, Artificial
  CRISPR gRNA sequence
cttgcttttcacaaccctgt

SEQ ID NO: 407200 - DNA, 20 bp, Artificial
  CRISPR gRNA sequence
gcttttcacaaccctgtgag

SEQ ID NO: 407201 - DNA, 20 bp, Artificial
  CRISPR gRNA sequence
cttttcacaaccctgtgagg

SEQ ID NO: 407202 - DNA, 20 bp, Artificial
  CRISPR gRNA sequence
ttcacaaccctgtgaggcct

SEQ ID NO: 407203 - DNA, 20 bp, Artificial
  CRISPR gRNA sequence
tcacaaccctgtgaggcctg

SEQ ID NO: 407204 - DNA, 20 bp, Artificial
  CRISPR gRNA sequence
cacaaccctgtgaggcctga

SEQ ID NO: 407205 - DNA, 20 bp, Artificial
  CRISPR gRNA sequence
acaaccctgtgaggcctgag

SEQ ID NO: 407206 - DNA, 20 bp, Artificial
  CRISPR gRNA sequence
tgaggcctgaggaatactag

SEQ ID NO: 407207 - DNA, 20 bp, Artificial
  CRISPR gRNA sequence
aggaatactagcccagtgtc

SEQ ID NO: 407208 - DNA, 20 bp, Artificial
  CRISPR gRNA sequence
gcccagtgtcctgcagagca

SEQ ID NO: 407209 - DNA, 20 bp, Artificial
  CRISPR gRNA sequence
cagagcatctcccaattagg

SEQ ID NO: 407210 - DNA, 20 bp, Artificial
  CRISPR gRNA sequence
ccaattagggtttgtctgat

SEQ ID NO: 407211 - DNA, 20 bp, Artificial
  CRISPR gRNA sequence
gggtttgtctgatgtttcac

SEQ ID NO: 407212 - DNA, 20 bp, Artificial
  CRISPR gRNA sequence
gtctgatgtttcactcatga

SEQ ID NO: 407213 - DNA, 20 bp, Artificial
  CRISPR gRNA sequence
tctgatgtttcactcatgat

SEQ ID NO: 407214 - DNA, 20 bp, Artificial
  CRISPR gRNA sequence
atgtttcactcatgattaga

SEQ ID NO: 407215 - DNA, 20 bp, Artificial
  CRISPR gRNA sequence
cactcatgattagactggga

SEQ ID NO: 407216 - DNA, 20 bp, Artificial
  CRISPR gRNA sequence
actcatgattagactgggaa

SEQ ID NO: 407217 - DNA, 20 bp, Artificial
  CRISPR gRNA sequence
atgattagactgggaatatg

SEQ ID NO: 407218 - DNA, 20 bp, Artificial
  CRISPR gRNA sequence
gactgggaatatggaatttt

SEQ ID NO: 407219 - DNA, 20 bp, Artificial
  CRISPR gRNA sequence
ggaatatggaattttggaaa

SEQ ID NO: 407220 - DNA, 20 bp, Artificial
  CRISPR gRNA sequence
tggaaagaataccagagtca

SEQ ID NO: 407221 - DNA, 20 bp, Artificial
  CRISPR gRNA sequence
ggaaagaataccagagtcat

SEQ ID NO: 407222 - DNA, 20 bp, Artificial
  CRISPR gRNA sequence
gaaagaataccagagtcatg

SEQ ID NO: 407223 - DNA, 20 bp, Artificial
  CRISPR gRNA sequence
ctcatcacatcatatcaagg

SEQ ID NO: 407224 - DNA, 20 bp, Artificial
  CRISPR gRNA sequence
tcatcacatcatatcaaggg

SEQ ID NO: 407225 - DNA, 20 bp, Artificial
  CRISPR gRNA sequence
atcacatcatatcaaggggt

SEQ ID NO: 407226 - DNA, 20 bp, Artificial
  CRISPR gRNA sequence
atatccacgcagcgtcactg

SEQ ID NO: 407227 - DNA, 20 bp, Artificial
  CRISPR gRNA sequence
agatgttggtctccatcatg

SEQ ID NO: 407228 - DNA, 20 bp, Artificial
  CRISPR gRNA sequence
gtctccatcatgtggttaag

SEQ ID NO: 407229 - DNA, 20 bp, Artificial
  CRISPR gRNA sequence
catcatgtggttaaggtgtg

SEQ ID NO: 407230 - DNA, 20 bp, Artificial
  CRISPR gRNA sequence
aggtgtgtttgccacgtttt

SEQ ID NO: 407231 - DNA, 20 bp, Artificial
  CRISPR gRNA sequence
gccacgttttcccactgtga

SEQ ID NO: 407232 - DNA, 20 bp, Artificial
  CRISPR gRNA sequence
ccacgttttcccactgtgaa

SEQ ID NO: 407233 - DNA, 20 bp, Artificial
  CRISPR gRNA sequence
tcccactgtgaagtcaagtt

SEQ ID NO: 407234 - DNA, 20 bp, Artificial
  CRISPR gRNA sequence
cccactgtgaagtcaagttc

SEQ ID NO: 407235 - DNA, 20 bp, Artificial
  CRISPR gRNA sequence
ccactgtgaagtcaagttcc

SEQ ID NO: 407236 - DNA, 20 bp, Artificial
  CRISPR gRNA sequence
tgaagtcaagttcctatttc

SEQ ID NO: 407237 - DNA, 20 bp, Artificial
  CRISPR gRNA sequence
ctatttctcctttctgtgtt

SEQ ID NO: 407238 - DNA, 20 bp, Artificial
  CRISPR gRNA sequence
tttctcctttctgtgttcta

SEQ ID NO: 407239 - DNA, 20 bp, Artificial
  CRISPR gRNA sequence
ctcctttctgtgttctagtc

SEQ ID NO: 407240 - DNA, 20 bp, Artificial
  CRISPR gRNA sequence
tcctttctgtgttctagtct

SEQ ID NO: 407241 - DNA, 20 bp, Artificial
  CRISPR gRNA sequence
ctttctgtgttctagtcttt

SEQ ID NO: 407242 - DNA, 20 bp, Artificial
  CRISPR gRNA sequence
tctgtgttctagtctttgga

SEQ ID NO: 407243 - DNA, 20 bp, Artificial
  CRISPR gRNA sequence
ctgtgttctagtctttggac

SEQ ID NO: 407244 - DNA, 20 bp, Artificial
  CRISPR gRNA sequence
tgtgttctagtctttggacg

SEQ ID NO: 407245 - DNA, 20 bp, Artificial
  CRISPR gRNA sequence
tgttctagtctttggacgca

SEQ ID NO: 407246 - DNA, 20 bp, Artificial
  CRISPR gRNA sequence
tagtctttggacgcaagtct

SEQ ID NO: 407247 - DNA, 20 bp, Artificial
  CRISPR gRNA sequence
gtctttggacgcaagtctcc

SEQ ID NO: 407248 - DNA, 20 bp, Artificial
  CRISPR gRNA sequence
tggacgcaagtctccaaggt

SEQ ID NO: 407249 - DNA, 20 bp, Artificial
  CRISPR gRNA sequence
ggacgcaagtctccaaggtg

SEQ ID NO: 407250 - DNA, 20 bp, Artificial
  CRISPR gRNA sequence
gacgcaagtctccaaggtgt

SEQ ID NO: 407251 - DNA, 20 bp, Artificial
  CRISPR gRNA sequence
caaggtgtgcccatcctcac

SEQ ID NO: 407252 - DNA, 20 bp, Artificial
  CRISPR gRNA sequence
acagggctgcctccttcttt

SEQ ID NO: 407253 - DNA, 20 bp, Artificial
  CRISPR gRNA sequence
cctccttctttagaaaacta

SEQ ID NO: 407254 - DNA, 20 bp, Artificial
  CRISPR gRNA sequence
cttctttagaaaactactaa

SEQ ID NO: 407255 - DNA, 20 bp, Artificial
  CRISPR gRNA sequence
ctttagaaaactactaacac

SEQ ID NO: 407256 - DNA, 20 bp, Artificial
  CRISPR gRNA sequence
tttagaaaactactaacaca

SEQ ID NO: 407257 - DNA, 20 bp, Artificial
  CRISPR gRNA sequence
tagaaaactactaacacagt

SEQ ID NO: 407258 - DNA, 20 bp, Artificial
  CRISPR gRNA sequence
agaaaactactaacacagtg

SEQ ID NO: 407259 - DNA, 20 bp, Artificial
  CRISPR gRNA sequence
gaaaactactaacacagtgc

SEQ ID NO: 407260 - DNA, 20 bp, Artificial
  CRISPR gRNA sequence
ctaacacagtgcaccaagag

SEQ ID NO: 407261 - DNA, 20 bp, Artificial
  CRISPR gRNA sequence
acacagtgcaccaagagtat

SEQ ID NO: 407262 - DNA, 20 bp, Artificial
  CRISPR gRNA sequence
acagaaattttaaaatgcat

SEQ ID NO: 407263 - DNA, 20 bp, Artificial
  CRISPR gRNA sequence
cagaaattttaaaatgcata

SEQ ID NO: 407264 - DNA, 20 bp, Artificial
  CRISPR gRNA sequence
taaaatgcataagagaaata

SEQ ID NO: 407265 - DNA, 20 bp, Artificial
  CRISPR gRNA sequence
aaaatgcataagagaaataa

SEQ ID NO: 407266 - DNA, 20 bp, Artificial
  CRISPR gRNA sequence
aaatgcataagagaaataaa

SEQ ID NO: 407267 - DNA, 20 bp, Artificial
  CRISPR gRNA sequence
aggctgccgttcttgtgttt

SEQ ID NO: 407268 - DNA, 20 bp, Artificial
  CRISPR gRNA sequence
ccgttcttgtgtttcctctt

SEQ ID NO: 407269 - DNA, 20 bp, Artificial
  CRISPR gRNA sequence
ttgtgtttcctcttcccgtt

SEQ ID NO: 407270 - DNA, 20 bp, Artificial
  CRISPR gRNA sequence
gtgtttcctcttcccgtttc

SEQ ID NO: 407271 - DNA, 20 bp, Artificial
  CRISPR gRNA sequence
tgtttcctcttcccgtttcc

SEQ ID NO: 407272 - DNA, 20 bp, Artificial
  CRISPR gRNA sequence
cctcttcccgtttcctgttc

SEQ ID NO: 407273 - DNA, 20 bp, Artificial
  CRISPR gRNA sequence
ctcttcccgtttcctgttca

SEQ ID NO: 407274 - DNA, 20 bp, Artificial
  CRISPR gRNA sequence
ttcccgtttcctgttcaact

SEQ ID NO: 407275 - DNA, 20 bp, Artificial
  CRISPR gRNA sequence
cccgtttcctgttcaactct

SEQ ID NO: 407276 - DNA, 20 bp, Artificial
  CRISPR gRNA sequence
ccgtttcctgttcaactctc

SEQ ID NO: 407277 - DNA, 20 bp, Artificial
  CRISPR gRNA sequence
cctgttcaactctcattcag

SEQ ID NO: 407278 - DNA, 20 bp, Artificial
  CRISPR gRNA sequence
ctgttcaactctcattcaga

SEQ ID NO: 407279 - DNA, 20 bp, Artificial
  CRISPR gRNA sequence
ttcaactctcattcagagca

SEQ ID NO: 407280 - DNA, 20 bp, Artificial
  CRISPR gRNA sequence
aactctcattcagagcacac

SEQ ID NO: 407281 - DNA, 20 bp, Artificial
  CRISPR gRNA sequence
tcattcagagcacacacatg

SEQ ID NO: 407282 - DNA, 20 bp, Artificial
  CRISPR gRNA sequence
attcagagcacacacatgtt

SEQ ID NO: 407283 - DNA, 20 bp, Artificial
  CRISPR gRNA sequence
agagcacacacatgttctaa

SEQ ID NO: 407284 - DNA, 20 bp, Artificial
  CRISPR gRNA sequence
taactgttagcaaagtgtac

SEQ ID NO: 407285 - DNA, 20 bp, Artificial
  CRISPR gRNA sequence
actgttagcaaagtgtacat

SEQ ID NO: 407286 - DNA, 20 bp, Artificial
  CRISPR gRNA sequence
ttagcaaagtgtacatacat

SEQ ID NO: 407287 - DNA, 20 bp, Artificial
  CRISPR gRNA sequence
gcaaagtgtacatacatgtc

SEQ ID NO: 407288 - DNA, 20 bp, Artificial
  CRISPR gRNA sequence
ataatttttttctgtacatt

SEQ ID NO: 407289 - DNA, 20 bp, Artificial
  CRISPR gRNA sequence
ttttctgtacattatgtcat

SEQ ID NO: 407290 - DNA, 20 bp, Artificial
  CRISPR gRNA sequence
tttctgtacattatgtcata

SEQ ID NO: 407291 - DNA, 20 bp, Artificial
  CRISPR gRNA sequence
ttctgtacattatgtcataa

SEQ ID NO: 407292 - DNA, 20 bp, Artificial
  CRISPR gRNA sequence
tctgtacattatgtcataag

SEQ ID NO: 407293 - DNA, 20 bp, Artificial
  CRISPR gRNA sequence
ctgtacattatgtcataagc

SEQ ID NO: 407294 - DNA, 20 bp, Artificial
  CRISPR gRNA sequence
tgtacattatgtcataagca

SEQ ID NO: 407295 - DNA, 20 bp, Artificial
  CRISPR gRNA sequence
tacattatgtcataagcatt

SEQ ID NO: 407296 - DNA, 20 bp, Artificial
  CRISPR gRNA sequence
tgtcataagcatttccaata

SEQ ID NO: 407297 - DNA, 20 bp, Artificial
  CRISPR gRNA sequence
ccaatactgatagactgatc

SEQ ID NO: 407298 - DNA, 20 bp, Artificial
  CRISPR gRNA sequence
caatactgatagactgatct

SEQ ID NO: 407299 - DNA, 20 bp, Artificial
  CRISPR gRNA sequence
atagactgatctttactttt

SEQ ID NO: 407300 - DNA, 20 bp, Artificial
  CRISPR gRNA sequence
atctttacttttcatgattt

SEQ ID NO: 407301 - DNA, 20 bp, Artificial
  CRISPR gRNA sequence
tacttttcatgatttgcttc

SEQ ID NO: 407302 - DNA, 20 bp, Artificial
  CRISPR gRNA sequence
acttttcatgatttgcttca

SEQ ID NO: 407303 - DNA, 20 bp, Artificial
  CRISPR gRNA sequence
cttttcatgatttgcttcac

SEQ ID NO: 407304 - DNA, 20 bp, Artificial
  CRISPR gRNA sequence
ttcatgatttgcttcacctt

SEQ ID NO: 407305 - DNA, 20 bp, Artificial
  CRISPR gRNA sequence
tcatgatttgcttcaccttg

SEQ ID NO: 407306 - DNA, 20 bp, Artificial
  CRISPR gRNA sequence
catgatttgcttcaccttgt

SEQ ID NO: 407307 - DNA, 20 bp, Artificial
  CRISPR gRNA sequence
atgatttgcttcaccttgtt

SEQ ID NO: 407308 - DNA, 20 bp, Artificial
  CRISPR gRNA sequence
gcttcaccttgttaagtttc

SEQ ID NO: 407309 - DNA, 20 bp, Artificial
  CRISPR gRNA sequence
cttcaccttgttaagtttct

SEQ ID NO: 407310 - DNA, 20 bp, Artificial
  CRISPR gRNA sequence
caccttgttaagtttctgga

SEQ ID NO: 407311 - DNA, 20 bp, Artificial
  CRISPR gRNA sequence
accttgttaagtttctggac

SEQ ID NO: 407312 - DNA, 20 bp, Artificial
  CRISPR gRNA sequence
gttaagtttctggacattta

SEQ ID NO: 407313 - DNA, 20 bp, Artificial
  CRISPR gRNA sequence
ttaagtttctggacatttag

SEQ ID NO: 407314 - DNA, 20 bp, Artificial
  CRISPR gRNA sequence
agtttctggacatttagatt

SEQ ID NO: 407315 - DNA, 20 bp, Artificial
  CRISPR gRNA sequence
ctggacatttagattctttc

SEQ ID NO: 407316 - DNA, 20 bp, Artificial
  CRISPR gRNA sequence
tggacatttagattctttcc

SEQ ID NO: 407317 - DNA, 20 bp, Artificial
  CRISPR gRNA sequence
gacatttagattctttccaa

SEQ ID NO: 407318 - DNA, 20 bp, Artificial
  CRISPR gRNA sequence
agattctttccaatattctc

SEQ ID NO: 407319 - DNA, 20 bp, Artificial
  CRISPR gRNA sequence
gattctttccaatattctct

SEQ ID NO: 407320 - DNA, 20 bp, Artificial
  CRISPR gRNA sequence
tttccaatattctctatttc

SEQ ID NO: 407321 - DNA, 20 bp, Artificial
  CRISPR gRNA sequence
tccaatattctctatttcaa

SEQ ID NO: 407322 - DNA, 20 bp, Artificial
  CRISPR gRNA sequence
ccaatattctctatttcaac

SEQ ID NO: 407323 - DNA, 20 bp, Artificial
  CRISPR gRNA sequence
caatattctctatttcaact

SEQ ID NO: 407324 - DNA, 20 bp, Artificial
  CRISPR gRNA sequence
tctatttcaactaatgcttg

SEQ ID NO: 407325 - DNA, 20 bp, Artificial
  CRISPR gRNA sequence
tatttcaactaatgcttggt

SEQ ID NO: 407326 - DNA, 20 bp, Artificial
  CRISPR gRNA sequence
tttcaactaatgcttggtgt

SEQ ID NO: 407327 - DNA, 20 bp, Artificial
  CRISPR gRNA sequence
caactaatgcttggtgtagt

SEQ ID NO: 407328 - DNA, 20 bp, Artificial
  CRISPR gRNA sequence
aactaatgcttggtgtagtc

SEQ ID NO: 407329 - DNA, 20 bp, Artificial
  CRISPR gRNA sequence
atgcttggtgtagtcatctt

SEQ ID NO: 407330 - DNA, 20 bp, Artificial
  CRISPR gRNA sequence
ggtgtagtcatcttcacata

SEQ ID NO: 407331 - DNA, 20 bp, Artificial
  CRISPR gRNA sequence
gtgtagtcatcttcacatat

SEQ ID NO: 407332 - DNA, 20 bp, Artificial
  CRISPR gRNA sequence
cacatatgtaatgctttaca

SEQ ID NO: 407333 - DNA, 20 bp, Artificial
  CRISPR gRNA sequence
acatatgtaatgctttacag

SEQ ID NO: 407334 - DNA, 20 bp, Artificial
  CRISPR gRNA sequence
tacagaattattgttgcgta

SEQ ID NO: 407335 - DNA, 20 bp, Artificial
  CRISPR gRNA sequence
acagaattattgttgcgtag

SEQ ID NO: 407336 - DNA, 20 bp, Artificial
  CRISPR gRNA sequence
cagaattattgttgcgtagg

SEQ ID NO: 407337 - DNA, 20 bp, Artificial
  CRISPR gRNA sequence
ttgttgcgtaggattaattt

SEQ ID NO: 407338 - DNA, 20 bp, Artificial
  CRISPR gRNA sequence
ttgcgtaggattaatttgca

SEQ ID NO: 407339 - DNA, 20 bp, Artificial
  CRISPR gRNA sequence
cgtaggattaatttgcagac

SEQ ID NO: 407340 - DNA, 20 bp, Artificial
  CRISPR gRNA sequence
atttgcagacatttcctctg

SEQ ID NO: 407341 - DNA, 20 bp, Artificial
  CRISPR gRNA sequence
gcagacatttcctctgacgt

SEQ ID NO: 407342 - DNA, 20 bp, Artificial
  CRISPR gRNA sequence
cagacatttcctctgacgta

SEQ ID NO: 407343 - DNA, 20 bp, Artificial
  CRISPR gRNA sequence
cctctgacgtataaagaaca

SEQ ID NO: 407344 - DNA, 20 bp, Artificial
  CRISPR gRNA sequence
ctctgacgtataaagaacac

SEQ ID NO: 407345 - DNA, 20 bp, Artificial
  CRISPR gRNA sequence
tgacgtataaagaacacaaa

SEQ ID NO: 407346 - DNA, 20 bp, Artificial
  CRISPR gRNA sequence
acgtataaagaacacaaatt

SEQ ID NO: 407347 - DNA, 20 bp, Artificial
  CRISPR gRNA sequence
aatgctgaatacatgtatta

SEQ ID NO: 407348 - DNA, 20 bp, Artificial
  CRISPR gRNA sequence
aatacatgtattattatctc

SEQ ID NO: 407349 - DNA, 20 bp, Artificial
  CRISPR gRNA sequence
ttatctcctttaattcccaa

SEQ ID NO: 407350 - DNA, 20 bp, Artificial
  CRISPR gRNA sequence
tctcctttaattcccaaatt

SEQ ID NO: 407351 - DNA, 20 bp, Artificial
  CRISPR gRNA sequence
ctttaattcccaaatttcat

SEQ ID NO: 407352 - DNA, 20 bp, Artificial
  CRISPR gRNA sequence
taattcccaaatttcattgc

SEQ ID NO: 407353 - DNA, 20 bp, Artificial
  CRISPR gRNA sequence
aattcccaaatttcattgca

SEQ ID NO: 407354 - DNA, 20 bp, Artificial
  CRISPR gRNA sequence
attcccaaatttcattgcaa

SEQ ID NO: 407355 - DNA, 20 bp, Artificial
  CRISPR gRNA sequence
ccaaatttcattgcaaatcc

SEQ ID NO: 407356 - DNA, 20 bp, Artificial
  CRISPR gRNA sequence
cattgcaaatccaaaataaa

SEQ ID NO: 407357 - DNA, 20 bp, Artificial
  CRISPR gRNA sequence
attgcaaatccaaaataaat

SEQ ID NO: 407358 - DNA, 20 bp, Artificial
  CRISPR gRNA sequence
caaatccaaaataaatacca

SEQ ID NO: 407359 - DNA, 20 bp, Artificial
  CRISPR gRNA sequence
ttgtttccctcttgctgtta

SEQ ID NO: 407360 - DNA, 20 bp, Artificial
  CRISPR gRNA sequence
gtttccctcttgctgttagt

SEQ ID NO: 407361 - DNA, 20 bp, Artificial
  CRISPR gRNA sequence
tttccctcttgctgttagtt

SEQ ID NO: 407362 - DNA, 20 bp, Artificial
  CRISPR gRNA sequence
ccctcttgctgttagttttt

SEQ ID NO: 407363 - DNA, 20 bp, Artificial
  CRISPR gRNA sequence
cctcttgctgttagtttttt

SEQ ID NO: 407364 - DNA, 20 bp, Artificial
  CRISPR gRNA sequence
ttgctgttagttttttctgg

SEQ ID NO: 407365 - DNA, 20 bp, Artificial
  CRISPR gRNA sequence
gctgttagttttttctgggc

SEQ ID NO: 407366 - DNA, 20 bp, Artificial
  CRISPR gRNA sequence
ctgttagttttttctgggct

SEQ ID NO: 407367 - DNA, 20 bp, Artificial
  CRISPR gRNA sequence
ttagttttttctgggctact

SEQ ID NO: 407368 - DNA, 20 bp, Artificial
  CRISPR gRNA sequence
gttttttctgggctacttgc

SEQ ID NO: 407369 - DNA, 20 bp, Artificial
  CRISPR gRNA sequence
tttctgggctacttgctttt

SEQ ID NO: 407370 - DNA, 20 bp, Artificial
  CRISPR gRNA sequence
ttctgggctacttgcttttc

SEQ ID NO: 407371 - DNA, 20 bp, Artificial
  CRISPR gRNA sequence
tctgggctacttgcttttct

SEQ ID NO: 407372 - DNA, 20 bp, Artificial
  CRISPR gRNA sequence
ctgggctacttgcttttctg

SEQ ID NO: 407373 - DNA, 20 bp, Artificial
  CRISPR gRNA sequence
tgggctacttgcttttctga

SEQ ID NO: 407374 - DNA, 20 bp, Artificial
  CRISPR gRNA sequence
ggctacttgcttttctgaat

SEQ ID NO: 407375 - DNA, 20 bp, Artificial
  CRISPR gRNA sequence
cttgcttttctgaatcgatg

SEQ ID NO: 407376 - DNA, 20 bp, Artificial
  CRISPR gRNA sequence
gcttttctgaatcgatgtga

SEQ ID NO: 407377 - DNA, 20 bp, Artificial
  CRISPR gRNA sequence
cttttctgaatcgatgtgat

SEQ ID NO: 407378 - DNA, 20 bp, Artificial
  CRISPR gRNA sequence
ttctgaatcgatgtgatgat

SEQ ID NO: 407379 - DNA, 20 bp, Artificial
  CRISPR gRNA sequence
tctgaatcgatgtgatgatt

SEQ ID NO: 407380 - DNA, 20 bp, Artificial
  CRISPR gRNA sequence
ctgaatcgatgtgatgatta

SEQ ID NO: 407381 - DNA, 20 bp, Artificial
  CRISPR gRNA sequence
tgaatcgatgtgatgattac

SEQ ID NO: 407382 - DNA, 20 bp, Artificial
  CRISPR gRNA sequence
aatcgatgtgatgattacaa

SEQ ID NO: 407383 - DNA, 20 bp, Artificial
  CRISPR gRNA sequence
caactatccctgctaatagc

SEQ ID NO: 407384 - DNA, 20 bp, Artificial
  CRISPR gRNA sequence
tccctgctaatagctgtact

SEQ ID NO: 407385 - DNA, 20 bp, Artificial
  CRISPR gRNA sequence
ctaatagctgtactcacact

SEQ ID NO: 407386 - DNA, 20 bp, Artificial
  CRISPR gRNA sequence
atagctgtactcacactggt

SEQ ID NO: 407387 - DNA, 20 bp, Artificial
  CRISPR gRNA sequence
tactcacactggttttttaa

SEQ ID NO: 407388 - DNA, 20 bp, Artificial
  CRISPR gRNA sequence
acactggttttttaatattg

SEQ ID NO: 407389 - DNA, 20 bp, Artificial
  CRISPR gRNA sequence
gttttttaatattgttatat

SEQ ID NO: 407390 - DNA, 20 bp, Artificial
  CRISPR gRNA sequence
tttaatattgttatattttt

SEQ ID NO: 407391 - DNA, 20 bp, Artificial
  CRISPR gRNA sequence
ttaatattgttatatttttc

SEQ ID NO: 407392 - DNA, 20 bp, Artificial
  CRISPR gRNA sequence
taatattgttatatttttca

SEQ ID NO: 407393 - DNA, 20 bp, Artificial
  CRISPR gRNA sequence
aatattgttatatttttcat

SEQ ID NO: 407394 - DNA, 20 bp, Artificial
  CRISPR gRNA sequence
atattgttatatttttcatt

SEQ ID NO: 407395 - DNA, 20 bp, Artificial
  CRISPR gRNA sequence
ttatatttttcattttaact

SEQ ID NO: 407396 - DNA, 20 bp, Artificial
  CRISPR gRNA sequence
tatttttcattttaacttca

SEQ ID NO: 407397 - DNA, 20 bp, Artificial
  CRISPR gRNA sequence
ttcattttaacttcattatg

SEQ ID NO: 407398 - DNA, 20 bp, Artificial
  CRISPR gRNA sequence
tcattttaacttcattatgg

SEQ ID NO: 407399 - DNA, 20 bp, Artificial
  CRISPR gRNA sequence
cattttaacttcattatggt

SEQ ID NO: 407400 - DNA, 20 bp, Artificial
  CRISPR gRNA sequence
attttaacttcattatggtt

SEQ ID NO: 407401 - DNA, 20 bp, Artificial
  CRISPR gRNA sequence
taacttcattatggtttgaa

SEQ ID NO: 407402 - DNA, 20 bp, Artificial
  CRISPR gRNA sequence
aacttcattatggtttgaac

SEQ ID NO: 407403 - DNA, 20 bp, Artificial
  CRISPR gRNA sequence
acttcattatggtttgaact

SEQ ID NO: 407404 - DNA, 20 bp, Artificial
  CRISPR gRNA sequence
cattatggtttgaactaaat

SEQ ID NO: 407405 - DNA, 20 bp, Artificial
  CRISPR gRNA sequence
attatggtttgaactaaata

SEQ ID NO: 407406 - DNA, 20 bp, Artificial
  CRISPR gRNA sequence
tggtttgaactaaataattt

SEQ ID NO: 407407 - DNA, 20 bp, Artificial
  CRISPR gRNA sequence
gaactaaataatttcagcct

SEQ ID NO: 407408 - DNA, 20 bp, Artificial
  CRISPR gRNA sequence
aactaaataatttcagcctc

SEQ ID NO: 407409 - DNA, 20 bp, Artificial
  CRISPR gRNA sequence
aataatttcagcctcttcta

SEQ ID NO: 407410 - DNA, 20 bp, Artificial
  CRISPR gRNA sequence
cagcctcttctacctcaggg

SEQ ID NO: 407411 - DNA, 20 bp, Artificial
  CRISPR gRNA sequence
agcctcttctacctcaggga

SEQ ID NO: 407412 - DNA, 20 bp, Artificial
  CRISPR gRNA sequence
ttctacctcagggagttgtg

SEQ ID NO: 407413 - DNA, 20 bp, Artificial
  CRISPR gRNA sequence
ctacctcagggagttgtgag

SEQ ID NO: 407414 - DNA, 20 bp, Artificial
  CRISPR gRNA sequence
tacctcagggagttgtgaga

SEQ ID NO: 407415 - DNA, 20 bp, Artificial
  CRISPR gRNA sequence
cctcagggagttgtgagaaa

SEQ ID NO: 407416 - DNA, 20 bp, Artificial
  CRISPR gRNA sequence
agggagttgtgagaaatact

SEQ ID NO: 407417 - DNA, 20 bp, Artificial
  CRISPR gRNA sequence
tgagaaatactgttgatctt

SEQ ID NO: 407418 - DNA, 20 bp, Artificial
  CRISPR gRNA sequence
ttgatctttctgtggtttga

SEQ ID NO: 407419 - DNA, 20 bp, Artificial
  CRISPR gRNA sequence
atctttctgtggtttgaaaa

SEQ ID NO: 407420 - DNA, 20 bp, Artificial
  CRISPR gRNA sequence
tctgtggtttgaaaagcacc

SEQ ID NO: 407421 - DNA, 20 bp, Artificial
  CRISPR gRNA sequence
ctgtggtttgaaaagcacct

SEQ ID NO: 407422 - DNA, 20 bp, Artificial
  CRISPR gRNA sequence
tgtggtttgaaaagcacctg

SEQ ID NO: 407423 - DNA, 20 bp, Artificial
  CRISPR gRNA sequence
tggtttgaaaagcacctgga

SEQ ID NO: 407424 - DNA, 20 bp, Artificial
  CRISPR gRNA sequence
gaaaagcacctggagctctt

SEQ ID NO: 407425 - DNA, 20 bp, Artificial
  CRISPR gRNA sequence
aaaagcacctggagctcttt

SEQ ID NO: 407426 - DNA, 20 bp, Artificial
  CRISPR gRNA sequence
gagctctttggagagttggt

SEQ ID NO: 407427 - DNA, 20 bp, Artificial
  CRISPR gRNA sequence
tttggagagttggtattaaa

SEQ ID NO: 407428 - DNA, 20 bp, Artificial
  CRISPR gRNA sequence
tggagagttggtattaaaac

SEQ ID NO: 407429 - DNA, 20 bp, Artificial
  CRISPR gRNA sequence
ggagagttggtattaaaacc

SEQ ID NO: 407430 - DNA, 20 bp, Artificial
  CRISPR gRNA sequence
gagagttggtattaaaacca

SEQ ID NO: 407431 - DNA, 20 bp, Artificial
  CRISPR gRNA sequence
gtattaaaaccataaatttg

SEQ ID NO: 407432 - DNA, 20 bp, Artificial
  CRISPR gRNA sequence
aaaccataaatttgcagtgc

SEQ ID NO: 407433 - DNA, 20 bp, Artificial
  CRISPR gRNA sequence
gcagtgctggctgatgctca

SEQ ID NO: 407434 - DNA, 20 bp, Artificial
  CRISPR gRNA sequence
cagtgctggctgatgctcag

SEQ ID NO: 407435 - DNA, 20 bp, Artificial
  CRISPR gRNA sequence
gctgatgctcaggggtgagt

SEQ ID NO: 407436 - DNA, 20 bp, Artificial
  CRISPR gRNA sequence
atgctcaggggtgagtggtg

SEQ ID NO: 407437 - DNA, 20 bp, Artificial
  CRISPR gRNA sequence
aggggtgagtggtgccagga

SEQ ID NO: 407438 - DNA, 20 bp, Artificial
  CRISPR gRNA sequence
ctgtgtgggtttccatttgg

SEQ ID NO: 407439 - DNA, 20 bp, Artificial
  CRISPR gRNA sequence
tgtgggtttccatttggcag

SEQ ID NO: 407440 - DNA, 20 bp, Artificial
  CRISPR gRNA sequence
ccatttggcagaagtgggaa

SEQ ID NO: 407441 - DNA, 20 bp, Artificial
  CRISPR gRNA sequence
catttggcagaagtgggaat

SEQ ID NO: 407442 - DNA, 20 bp, Artificial
  CRISPR gRNA sequence
ggcagaagtgggaatggaga

SEQ ID NO: 407443 - DNA, 20 bp, Artificial
  CRISPR gRNA sequence
gcagaagtgggaatggagac

SEQ ID NO: 407444 - DNA, 20 bp, Artificial
  CRISPR gRNA sequence
atgtagggcctggactggaa

SEQ ID NO: 407445 - DNA, 20 bp, Artificial
  CRISPR gRNA sequence
gactggaaaatattgctctg

SEQ ID NO: 407446 - DNA, 20 bp, Artificial
  CRISPR gRNA sequence
gaaaatattgctctgagttc

SEQ ID NO: 407447 - DNA, 20 bp, Artificial
  CRISPR gRNA sequence
ctctgagttcctggtatcat

SEQ ID NO: 407448 - DNA, 20 bp, Artificial
  CRISPR gRNA sequence
tgagttcctggtatcattca

SEQ ID NO: 407449 - DNA, 20 bp, Artificial
  CRISPR gRNA sequence
agttcctggtatcattcact

SEQ ID NO: 407450 - DNA, 20 bp, Artificial
  CRISPR gRNA sequence
ctggtatcattcactaaatt

SEQ ID NO: 407451 - DNA, 20 bp, Artificial
  CRISPR gRNA sequence
gtatcattcactaaatttac

SEQ ID NO: 407452 - DNA, 20 bp, Artificial
  CRISPR gRNA sequence
actaaatttacaacacatca

SEQ ID NO: 407453 - DNA, 20 bp, Artificial
  CRISPR gRNA sequence
aatttacaacacatcatctt

SEQ ID NO: 407454 - DNA, 20 bp, Artificial
  CRISPR gRNA sequence
acaacacatcatctttggag

SEQ ID NO: 407455 - DNA, 20 bp, Artificial
  CRISPR gRNA sequence
caacacatcatctttggaga

SEQ ID NO: 407456 - DNA, 20 bp, Artificial
  CRISPR gRNA sequence
tggagatgttttctcatcca

SEQ ID NO: 407457 - DNA, 20 bp, Artificial
  CRISPR gRNA sequence
ggagatgttttctcatccat

SEQ ID NO: 407458 - DNA, 20 bp, Artificial
  CRISPR gRNA sequence
gagatgttttctcatccatg

SEQ ID NO: 407459 - DNA, 20 bp, Artificial
  CRISPR gRNA sequence
tctcatccatgtagtccccc

SEQ ID NO: 407460 - DNA, 20 bp, Artificial
  CRISPR gRNA sequence
ctcatccatgtagtcccccc

SEQ ID NO: 407461 - DNA, 20 bp, Artificial
  CRISPR gRNA sequence
tcatccatgtagtcccccca

SEQ ID NO: 407462 - DNA, 20 bp, Artificial
  CRISPR gRNA sequence
atccatgtagtccccccaaa

SEQ ID NO: 407463 - DNA, 20 bp, Artificial
  CRISPR gRNA sequence
ttgggaaacttaatgtgcct

SEQ ID NO: 407464 - DNA, 20 bp, Artificial
  CRISPR gRNA sequence
ggaaacttaatgtgcctggc

SEQ ID NO: 407465 - DNA, 20 bp, Artificial
  CRISPR gRNA sequence
aatgtgcctggcattttgct

SEQ ID NO: 407466 - DNA, 20 bp, Artificial
  CRISPR gRNA sequence
atgtgcctggcattttgcta

SEQ ID NO: 407467 - DNA, 20 bp, Artificial
  CRISPR gRNA sequence
gcattttgctaagattagac

SEQ ID NO: 407468 - DNA, 20 bp, Artificial
  CRISPR gRNA sequence
tgctaagattagacatactg

SEQ ID NO: 407469 - DNA, 20 bp, Artificial
  CRISPR gRNA sequence
gctaagattagacatactga

SEQ ID NO: 407470 - DNA, 20 bp, Artificial
  CRISPR gRNA sequence
ctaagattagacatactgaa

SEQ ID NO: 407471 - DNA, 20 bp, Artificial
  CRISPR gRNA sequence
agattagacatactgaaggt

SEQ ID NO: 407472 - DNA, 20 bp, Artificial
  CRISPR gRNA sequence
gacatactgaaggtacaatg

SEQ ID NO: 407473 - DNA, 20 bp, Artificial
  CRISPR gRNA sequence
aaggtacaatgtctttaagg

SEQ ID NO: 407474 - DNA, 20 bp, Artificial
  CRISPR gRNA sequence
taaggagtggatagtttctt

SEQ ID NO: 407475 - DNA, 20 bp, Artificial
  CRISPR gRNA sequence
aaggagtggatagtttctta

SEQ ID NO: 407476 - DNA, 20 bp, Artificial
  CRISPR gRNA sequence
aggagtggatagtttcttag

SEQ ID NO: 407477 - DNA, 20 bp, Artificial
  CRISPR gRNA sequence
cttagggcaggaagtaaatg

SEQ ID NO: 407478 - DNA, 20 bp, Artificial
  CRISPR gRNA sequence
ttagggcaggaagtaaatga

SEQ ID NO: 407479 - DNA, 20 bp, Artificial
  CRISPR gRNA sequence
agggcaggaagtaaatgaca

SEQ ID NO: 407480 - DNA, 20 bp, Artificial
  CRISPR gRNA sequence
gggcaggaagtaaatgacaa

SEQ ID NO: 407481 - DNA, 20 bp, Artificial
  CRISPR gRNA sequence
gcctattttgaaatgagtaa

SEQ ID NO: 407482 - DNA, 20 bp, Artificial
  CRISPR gRNA sequence
ttttgaaatgagtaagaaaa

SEQ ID NO: 407483 - DNA, 20 bp, Artificial
  CRISPR gRNA sequence
tgaaatgagtaagaaaatac

SEQ ID NO: 407484 - DNA, 20 bp, Artificial
  CRISPR gRNA sequence
gaaatgagtaagaaaatact

SEQ ID NO: 407485 - DNA, 20 bp, Artificial
  CRISPR gRNA sequence
aaatgagtaagaaaatactt

SEQ ID NO: 407486 - DNA, 20 bp, Artificial
  CRISPR gRNA sequence
ccttgaaataggtgatgtca

SEQ ID NO: 407487 - DNA, 20 bp, Artificial
  CRISPR gRNA sequence
cttgaaataggtgatgtcac

SEQ ID NO: 407488 - DNA, 20 bp, Artificial
  CRISPR gRNA sequence
gaaataggtgatgtcacaga

SEQ ID NO: 407489 - DNA, 20 bp, Artificial
  CRISPR gRNA sequence
aaataggtgatgtcacagaa

SEQ ID NO: 407490 - DNA, 20 bp, Artificial
  CRISPR gRNA sequence
tgaaggataaatagcagtgt

SEQ ID NO: 407491 - DNA, 20 bp, Artificial
  CRISPR gRNA sequence
gaaggataaatagcagtgtt

SEQ ID NO: 407492 - DNA, 20 bp, Artificial
  CRISPR gRNA sequence
aaggataaatagcagtgttc

SEQ ID NO: 407493 - DNA, 20 bp, Artificial
  CRISPR gRNA sequence
ttggaatgaagtggaaggat

SEQ ID NO: 407494 - DNA, 20 bp, Artificial
  CRISPR gRNA sequence
ggaatgaagtggaaggatta

SEQ ID NO: 407495 - DNA, 20 bp, Artificial
  CRISPR gRNA sequence
gaatgaagtggaaggattat

SEQ ID NO: 407496 - DNA, 20 bp, Artificial
  CRISPR gRNA sequence
tatgaaggcattccagaaga

SEQ ID NO: 407497 - DNA, 20 bp, Artificial
  CRISPR gRNA sequence
cagaagaagagatagctgat

SEQ ID NO: 407498 - DNA, 20 bp, Artificial
  CRISPR gRNA sequence
atgcaagatcataaaggtga

SEQ ID NO: 407499 - DNA, 20 bp, Artificial
  CRISPR gRNA sequence
ttggggaaactggagtatat

SEQ ID NO: 407500 - DNA, 20 bp, Artificial
  CRISPR gRNA sequence
ggggaaactggagtatatgg

SEQ ID NO: 407501 - DNA, 20 bp, Artificial
  CRISPR gRNA sequence
gggaaactggagtatatggc

SEQ ID NO: 407502 - DNA, 20 bp, Artificial
  CRISPR gRNA sequence
gagtatatggcagattctag

SEQ ID NO: 407503 - DNA, 20 bp, Artificial
  CRISPR gRNA sequence
tagtaggagatgagaatgga

SEQ ID NO: 407504 - DNA, 20 bp, Artificial
  CRISPR gRNA sequence
gtaggagatgagaatggaga

SEQ ID NO: 407505 - DNA, 20 bp, Artificial
  CRISPR gRNA sequence
tgctaaagaacatgtgcttt

SEQ ID NO: 407506 - DNA, 20 bp, Artificial
  CRISPR gRNA sequence
gctaaagaacatgtgctttg

SEQ ID NO: 407507 - DNA, 20 bp, Artificial
  CRISPR gRNA sequence
ctaaagaacatgtgctttgt

SEQ ID NO: 407508 - DNA, 20 bp, Artificial
  CRISPR gRNA sequence
aagaacatgtgctttgtcct

SEQ ID NO: 407509 - DNA, 20 bp, Artificial
  CRISPR gRNA sequence
tgtcctgtagtaggaatagg

SEQ ID NO: 407510 - DNA, 20 bp, Artificial
  CRISPR gRNA sequence
gtcctgtagtaggaatagga

SEQ ID NO: 407511 - DNA, 20 bp, Artificial
  CRISPR gRNA sequence
tcctgtagtaggaataggaa

SEQ ID NO: 407512 - DNA, 20 bp, Artificial
  CRISPR gRNA sequence
tagtaggaataggaaacgtc

SEQ ID NO: 407513 - DNA, 20 bp, Artificial
  CRISPR gRNA sequence
aacctttcaaagtacagctg

SEQ ID NO: 407514 - DNA, 20 bp, Artificial
  CRISPR gRNA sequence
tcaaagtacagctgtagcct

SEQ ID NO: 407515 - DNA, 20 bp, Artificial
  CRISPR gRNA sequence
caaagtacagctgtagcctg

SEQ ID NO: 407516 - DNA, 20 bp, Artificial
  CRISPR gRNA sequence
aaagtacagctgtagcctga

SEQ ID NO: 407517 - DNA, 20 bp, Artificial
  CRISPR gRNA sequence
tagcctgataagatttatat

SEQ ID NO: 407518 - DNA, 20 bp, Artificial
  CRISPR gRNA sequence
ataagatttatatgttagtt

SEQ ID NO: 407519 - DNA, 20 bp, Artificial
  CRISPR gRNA sequence
atatgttagttatatagtct

SEQ ID NO: 407520 - DNA, 20 bp, Artificial
  CRISPR gRNA sequence
tatgttagttatatagtctt

SEQ ID NO: 407521 - DNA, 20 bp, Artificial
  CRISPR gRNA sequence
gttatatagtctttgatgca

SEQ ID NO: 407522 - DNA, 20 bp, Artificial
  CRISPR gRNA sequence
tatagtctttgatgcaatat

SEQ ID NO: 407523 - DNA, 20 bp, Artificial
  CRISPR gRNA sequence
tgatgcaatatgaattggag

SEQ ID NO: 407524 - DNA, 20 bp, Artificial
  CRISPR gRNA sequence
gatgcaatatgaattggagg

SEQ ID NO: 407525 - DNA, 20 bp, Artificial
  CRISPR gRNA sequence
atgcaatatgaattggaggg

SEQ ID NO: 407526 - DNA, 20 bp, Artificial
  CRISPR gRNA sequence
gagggaaaaggggctacaat

SEQ ID NO: 407527 - DNA, 20 bp, Artificial
  CRISPR gRNA sequence
caattagagttcattttgac

SEQ ID NO: 407528 - DNA, 20 bp, Artificial
  CRISPR gRNA sequence
gagttcattttgacaactat

SEQ ID NO: 407529 - DNA, 20 bp, Artificial
  CRISPR gRNA sequence
attttgacaactattttaat

SEQ ID NO: 407530 - DNA, 20 bp, Artificial
  CRISPR gRNA sequence
tgacaactattttaatagtc

SEQ ID NO: 407531 - DNA, 20 bp, Artificial
  CRISPR gRNA sequence
gacaactattttaatagtcc

SEQ ID NO: 407532 - DNA, 20 bp, Artificial
  CRISPR gRNA sequence
acaactattttaatagtcca

SEQ ID NO: 407533 - DNA, 20 bp, Artificial
  CRISPR gRNA sequence
ttttaatagtccagttgaaa

SEQ ID NO: 407534 - DNA, 20 bp, Artificial
  CRISPR gRNA sequence
taatagtccagttgaaaaaa

SEQ ID NO: 407535 - DNA, 20 bp, Artificial
  CRISPR gRNA sequence
aatagtccagttgaaaaaat

SEQ ID NO: 407536 - DNA, 20 bp, Artificial
  CRISPR gRNA sequence
atagtccagttgaaaaaatg

SEQ ID NO: 407537 - DNA, 20 bp, Artificial
  CRISPR gRNA sequence
aaaaaatgtagggaagcctc

SEQ ID NO: 407538 - DNA, 20 bp, Artificial
  CRISPR gRNA sequence
taataaccatatctcaaatt

SEQ ID NO: 407539 - DNA, 20 bp, Artificial
  CRISPR gRNA sequence
ataaccatatctcaaatttt

SEQ ID NO: 407540 - DNA, 20 bp, Artificial
  CRISPR gRNA sequence
aaattttcattctgtttggt

SEQ ID NO: 407541 - DNA, 20 bp, Artificial
  CRISPR gRNA sequence
tcattctgtttggttaagaa

SEQ ID NO: 407542 - DNA, 20 bp, Artificial
  CRISPR gRNA sequence
cattctgtttggttaagaac

SEQ ID NO: 407543 - DNA, 20 bp, Artificial
  CRISPR gRNA sequence
attctgtttggttaagaaca

SEQ ID NO: 407544 - DNA, 20 bp, Artificial
  CRISPR gRNA sequence
tgtttggttaagaacactgt

SEQ ID NO: 407545 - DNA, 20 bp, Artificial
  CRISPR gRNA sequence
tttggttaagaacactgttc

SEQ ID NO: 407546 - DNA, 20 bp, Artificial
  CRISPR gRNA sequence
ggttaagaacactgttcatc

SEQ ID NO: 407547 - DNA, 20 bp, Artificial
  CRISPR gRNA sequence
gttaagaacactgttcatca

SEQ ID NO: 407548 - DNA, 20 bp, Artificial
  CRISPR gRNA sequence
agaacactgttcatcatctt

SEQ ID NO: 407549 - DNA, 20 bp, Artificial
  CRISPR gRNA sequence
ttcatcatctttgtgttagt

SEQ ID NO: 407550 - DNA, 20 bp, Artificial
  CRISPR gRNA sequence
atcatctttgtgttagtcat

SEQ ID NO: 407551 - DNA, 20 bp, Artificial
  CRISPR gRNA sequence
tgtgttagtcattcttgctg

SEQ ID NO: 407552 - DNA, 20 bp, Artificial
  CRISPR gRNA sequence
gtgttagtcattcttgctgt

SEQ ID NO: 407553 - DNA, 20 bp, Artificial
  CRISPR gRNA sequence
tgttagtcattcttgctgtt

SEQ ID NO: 407554 - DNA, 20 bp, Artificial
  CRISPR gRNA sequence
gtcattcttgctgttgtgca

SEQ ID NO: 407555 - DNA, 20 bp, Artificial
  CRISPR gRNA sequence
ttgctgttgtgcagatttct

SEQ ID NO: 407556 - DNA, 20 bp, Artificial
  CRISPR gRNA sequence
gctgttgtgcagatttcttt

SEQ ID NO: 407557 - DNA, 20 bp, Artificial
  CRISPR gRNA sequence
ctgttgtgcagatttctttg

SEQ ID NO: 407558 - DNA, 20 bp, Artificial
  CRISPR gRNA sequence
ttgtgcagatttctttgaga

SEQ ID NO: 407559 - DNA, 20 bp, Artificial
  CRISPR gRNA sequence
tgcagatttctttgagattg

SEQ ID NO: 407560 - DNA, 20 bp, Artificial
  CRISPR gRNA sequence
ctttgagattgtgcttaact

SEQ ID NO: 407561 - DNA, 20 bp, Artificial
  CRISPR gRNA sequence
tttgagattgtgcttaactc

SEQ ID NO: 407562 - DNA, 20 bp, Artificial
  CRISPR gRNA sequence
tgagattgtgcttaactcct

SEQ ID NO: 407563 - DNA, 20 bp, Artificial
  CRISPR gRNA sequence
gagattgtgcttaactccta

SEQ ID NO: 407564 - DNA, 20 bp, Artificial
  CRISPR gRNA sequence
agattgtgcttaactcctac

SEQ ID NO: 407565 - DNA, 20 bp, Artificial
  CRISPR gRNA sequence
tgcttaactcctacagatgt

SEQ ID NO: 407566 - DNA, 20 bp, Artificial
  CRISPR gRNA sequence
aactcctacagatgtagtaa

SEQ ID NO: 407567 - DNA, 20 bp, Artificial
  CRISPR gRNA sequence
actcctacagatgtagtaaa

SEQ ID NO: 407568 - DNA, 20 bp, Artificial
  CRISPR gRNA sequence
ctacagatgtagtaaatgaa

SEQ ID NO: 407569 - DNA, 20 bp, Artificial
  CRISPR gRNA sequence
cagatgtagtaaatgaattc

SEQ ID NO: 407570 - DNA, 20 bp, Artificial
  CRISPR gRNA sequence
tcaagtatttattaatcatc

SEQ ID NO: 407571 - DNA, 20 bp, Artificial
  CRISPR gRNA sequence
aagtatttattaatcatcca

SEQ ID NO: 407572 - DNA, 20 bp, Artificial
  CRISPR gRNA sequence
attaatcatccaatatgtac

SEQ ID NO: 407573 - DNA, 20 bp, Artificial
  CRISPR gRNA sequence
ttaatcatccaatatgtaca

SEQ ID NO: 407574 - DNA, 20 bp, Artificial
  CRISPR gRNA sequence
atcatccaatatgtacaagc

SEQ ID NO: 407575 - DNA, 20 bp, Artificial
  CRISPR gRNA sequence
ttatataaggtttttcctga

SEQ ID NO: 407576 - DNA, 20 bp, Artificial
  CRISPR gRNA sequence
tataaggtttttcctgagat

SEQ ID NO: 407577 - DNA, 20 bp, Artificial
  CRISPR gRNA sequence
ttcctgagattagaaggagt

SEQ ID NO: 407578 - DNA, 20 bp, Artificial
  CRISPR gRNA sequence
tcctgagattagaaggagta

SEQ ID NO: 407579 - DNA, 20 bp, Artificial
  CRISPR gRNA sequence
cctgagattagaaggagtac

SEQ ID NO: 407580 - DNA, 20 bp, Artificial
  CRISPR gRNA sequence
ctgagattagaaggagtaca

SEQ ID NO: 407581 - DNA, 20 bp, Artificial
  CRISPR gRNA sequence
agattagaaggagtacaatt

SEQ ID NO: 407582 - DNA, 20 bp, Artificial
  CRISPR gRNA sequence
gaaggagtacaattcaccct

SEQ ID NO: 407583 - DNA, 20 bp, Artificial
  CRISPR gRNA sequence
accctacaattaactggcaa

SEQ ID NO: 407584 - DNA, 20 bp, Artificial
  CRISPR gRNA sequence
caattaactggcaagctttt

SEQ ID NO: 407585 - DNA, 20 bp, Artificial
  CRISPR gRNA sequence
actggcaagcttttgaaaca

SEQ ID NO: 407586 - DNA, 20 bp, Artificial
  CRISPR gRNA sequence
gcaagcttttgaaacatggt

SEQ ID NO: 407587 - DNA, 20 bp, Artificial
  CRISPR gRNA sequence
ttgaaacatggtggagtaac

SEQ ID NO: 407588 - DNA, 20 bp, Artificial
  CRISPR gRNA sequence
tgaaacatggtggagtaaca

SEQ ID NO: 407589 - DNA, 20 bp, Artificial
  CRISPR gRNA sequence
gaaacatggtggagtaacaa

SEQ ID NO: 407590 - DNA, 20 bp, Artificial
  CRISPR gRNA sequence
aaacatggtggagtaacaag

SEQ ID NO: 407591 - DNA, 20 bp, Artificial
  CRISPR gRNA sequence
tagaaattatttttgcctcc

SEQ ID NO: 407592 - DNA, 20 bp, Artificial
  CRISPR gRNA sequence
agaaattatttttgcctcca

SEQ ID NO: 407593 - DNA, 20 bp, Artificial
  CRISPR gRNA sequence
gaaattatttttgcctccaa

SEQ ID NO: 407594 - DNA, 20 bp, Artificial
  CRISPR gRNA sequence
tttttgcctccaaggagctt

SEQ ID NO: 407595 - DNA, 20 bp, Artificial
  CRISPR gRNA sequence
ttgcctccaaggagcttggc

SEQ ID NO: 407596 - DNA, 20 bp, Artificial
  CRISPR gRNA sequence
tgcctccaaggagcttggca

SEQ ID NO: 407597 - DNA, 20 bp, Artificial
  CRISPR gRNA sequence
gcctccaaggagcttggcat

SEQ ID NO: 407598 - DNA, 20 bp, Artificial
  CRISPR gRNA sequence
cctccaaggagcttggcata

SEQ ID NO: 407599 - DNA, 20 bp, Artificial
  CRISPR gRNA sequence
caaggagcttggcataactg

SEQ ID NO: 407600 - DNA, 20 bp, Artificial
  CRISPR gRNA sequence
ggcataactgagaaaagcaa

SEQ ID NO: 407601 - DNA, 20 bp, Artificial
  CRISPR gRNA sequence
gcataactgagaaaagcaag

SEQ ID NO: 407602 - DNA, 20 bp, Artificial
  CRISPR gRNA sequence
agaaaagcaagacatagcca

SEQ ID NO: 407603 - DNA, 20 bp, Artificial
  CRISPR gRNA sequence
atattttgcaagtgcagtac

SEQ ID NO: 407604 - DNA, 20 bp, Artificial
  CRISPR gRNA sequence
tattttgcaagtgcagtact

SEQ ID NO: 407605 - DNA, 20 bp, Artificial
  CRISPR gRNA sequence
tgcaagtgcagtactttgtt

SEQ ID NO: 407606 - DNA, 20 bp, Artificial
  CRISPR gRNA sequence
gcaagtgcagtactttgtta

SEQ ID NO: 407607 - DNA, 20 bp, Artificial
  CRISPR gRNA sequence
caagtgcagtactttgttat

SEQ ID NO: 407608 - DNA, 20 bp, Artificial
  CRISPR gRNA sequence
tgttatatccaattacacaa

SEQ ID NO: 407609 - DNA, 20 bp, Artificial
  CRISPR gRNA sequence
gttatatccaattacacaaa

SEQ ID NO: 407610 - DNA, 20 bp, Artificial
  CRISPR gRNA sequence
ttatatccaattacacaaaa

SEQ ID NO: 407611 - DNA, 20 bp, Artificial
  CRISPR gRNA sequence
tatccaattacacaaaaatg

SEQ ID NO: 407612 - DNA, 20 bp, Artificial
  CRISPR gRNA sequence
cacaaaaatgtggaaagaga

SEQ ID NO: 407613 - DNA, 20 bp, Artificial
  CRISPR gRNA sequence
agtggctgagagattactgt

SEQ ID NO: 407614 - DNA, 20 bp, Artificial
  CRISPR gRNA sequence
agagattactgtgggtaagt

SEQ ID NO: 407615 - DNA, 20 bp, Artificial
  CRISPR gRNA sequence
ctgtgggtaagtcctgggag

SEQ ID NO: 407616 - DNA, 20 bp, Artificial
  CRISPR gRNA sequence
tgggtaagtcctgggagaga

SEQ ID NO: 407617 - DNA, 20 bp, Artificial
  CRISPR gRNA sequence
ggagagagataggtcaagct

SEQ ID NO: 407618 - DNA, 20 bp, Artificial
  CRISPR gRNA sequence
ggacttgagagagtgataga

SEQ ID NO: 407619 - DNA, 20 bp, Artificial
  CRISPR gRNA sequence
gagagagtgatagagccaaa

SEQ ID NO: 407620 - DNA, 20 bp, Artificial
  CRISPR gRNA sequence
agagagtgatagagccaaac

SEQ ID NO: 407621 - DNA, 20 bp, Artificial
  CRISPR gRNA sequence
tgttttgttattaattttta

SEQ ID NO: 407622 - DNA, 20 bp, Artificial
  CRISPR gRNA sequence
gttttgttattaatttttaa

SEQ ID NO: 407623 - DNA, 20 bp, Artificial
  CRISPR gRNA sequence
ttttgttattaatttttaaa

SEQ ID NO: 407624 - DNA, 20 bp, Artificial
  CRISPR gRNA sequence
tgttattaatttttaaattg

SEQ ID NO: 407625 - DNA, 20 bp, Artificial
  CRISPR gRNA sequence
gttattaatttttaaattgt

SEQ ID NO: 407626 - DNA, 20 bp, Artificial
  CRISPR gRNA sequence
ttattaatttttaaattgta

SEQ ID NO: 407627 - DNA, 20 bp, Artificial
  CRISPR gRNA sequence
ttaatttttaaattgtaatt

SEQ ID NO: 407628 - DNA, 20 bp, Artificial
  CRISPR gRNA sequence
atttttaaattgtaatttga

SEQ ID NO: 407629 - DNA, 20 bp, Artificial
  CRISPR gRNA sequence
ttaaattgtaatttgacaat

SEQ ID NO: 407630 - DNA, 20 bp, Artificial
  CRISPR gRNA sequence
taaattgtaatttgacaatt

SEQ ID NO: 407631 - DNA, 20 bp, Artificial
  CRISPR gRNA sequence
aaattgtaatttgacaattt

SEQ ID NO: 407632 - DNA, 20 bp, Artificial
  CRISPR gRNA sequence
aattgtaatttgacaattta

SEQ ID NO: 407633 - DNA, 20 bp, Artificial
  CRISPR gRNA sequence
taatttgacaatttataatt

SEQ ID NO: 407634 - DNA, 20 bp, Artificial
  CRISPR gRNA sequence
gacaatttataattctataa

SEQ ID NO: 407635 - DNA, 20 bp, Artificial
  CRISPR gRNA sequence
acaatttataattctataaa

SEQ ID NO: 407636 - DNA, 20 bp, Artificial
  CRISPR gRNA sequence
ataattctataaatttatag

SEQ ID NO: 407637 - DNA, 20 bp, Artificial
  CRISPR gRNA sequence
taattctataaatttatagg

SEQ ID NO: 407638 - DNA, 20 bp, Artificial
  CRISPR gRNA sequence
tataaatttatagggtacaa

SEQ ID NO: 407639 - DNA, 20 bp, Artificial
  CRISPR gRNA sequence
taaatttatagggtacaaac

SEQ ID NO: 407640 - DNA, 20 bp, Artificial
  CRISPR gRNA sequence
atagggtacaaacagaggtt

SEQ ID NO: 407641 - DNA, 20 bp, Artificial
  CRISPR gRNA sequence
tagggtacaaacagaggtta

SEQ ID NO: 407642 - DNA, 20 bp, Artificial
  CRISPR gRNA sequence
taacttataaatataatgtg

SEQ ID NO: 407643 - DNA, 20 bp, Artificial
  CRISPR gRNA sequence
ataaatataatgtgtaataa

SEQ ID NO: 407644 - DNA, 20 bp, Artificial
  CRISPR gRNA sequence
taaatataatgtgtaataat

SEQ ID NO: 407645 - DNA, 20 bp, Artificial
  CRISPR gRNA sequence
aatcaagctagttcatgtat

SEQ ID NO: 407646 - DNA, 20 bp, Artificial
  CRISPR gRNA sequence
gttcatgtatccatcctctc

SEQ ID NO: 407647 - DNA, 20 bp, Artificial
  CRISPR gRNA sequence
atgtatccatcctctcaaat

SEQ ID NO: 407648 - DNA, 20 bp, Artificial
  CRISPR gRNA sequence
tcaaatacttaacttttttt

SEQ ID NO: 407649 - DNA, 20 bp, Artificial
  CRISPR gRNA sequence
aaatacttaactttttttgt

SEQ ID NO: 407650 - DNA, 20 bp, Artificial
  CRISPR gRNA sequence
aactttttttgtggtgagaa

SEQ ID NO: 407651 - DNA, 20 bp, Artificial
  CRISPR gRNA sequence
actttttttgtggtgagaat

SEQ ID NO: 407652 - DNA, 20 bp, Artificial
  CRISPR gRNA sequence
tttttgtggtgagaatattt

SEQ ID NO: 407653 - DNA, 20 bp, Artificial
  CRISPR gRNA sequence
ttttgtggtgagaatatttg

SEQ ID NO: 407654 - DNA, 20 bp, Artificial
  CRISPR gRNA sequence
tttgtggtgagaatatttga

SEQ ID NO: 407655 - DNA, 20 bp, Artificial
  CRISPR gRNA sequence
ttgtggtgagaatatttgaa

SEQ ID NO: 407656 - DNA, 20 bp, Artificial
  CRISPR gRNA sequence
tgtggtgagaatatttgaaa

SEQ ID NO: 407657 - DNA, 20 bp, Artificial
  CRISPR gRNA sequence
gtggtgagaatatttgaaat

SEQ ID NO: 407658 - DNA, 20 bp, Artificial
  CRISPR gRNA sequence
tggtgagaatatttgaaatt

SEQ ID NO: 407659 - DNA, 20 bp, Artificial
  CRISPR gRNA sequence
gaaattcactctctagaaat

SEQ ID NO: 407660 - DNA, 20 bp, Artificial
  CRISPR gRNA sequence
aaattcactctctagaaatt

SEQ ID NO: 407661 - DNA, 20 bp, Artificial
  CRISPR gRNA sequence
actctctagaaattttgaaa

SEQ ID NO: 407662 - DNA, 20 bp, Artificial
  CRISPR gRNA sequence
tctagaaattttgaaatggg

SEQ ID NO: 407663 - DNA, 20 bp, Artificial
  CRISPR gRNA sequence
tagaaattttgaaatgggca

SEQ ID NO: 407664 - DNA, 20 bp, Artificial
  CRISPR gRNA sequence
gaaattttgaaatgggcaat

SEQ ID NO: 407665 - DNA, 20 bp, Artificial
  CRISPR gRNA sequence
tgaaatgggcaatactctct

SEQ ID NO: 407666 - DNA, 20 bp, Artificial
  CRISPR gRNA sequence
gaaatgggcaatactctctt

SEQ ID NO: 407667 - DNA, 20 bp, Artificial
  CRISPR gRNA sequence
aaatgggcaatactctctta

SEQ ID NO: 407668 - DNA, 20 bp, Artificial
  CRISPR gRNA sequence
tcttatttatatgcatcaag

SEQ ID NO: 407669 - DNA, 20 bp, Artificial
  CRISPR gRNA sequence
ttatttatatgcatcaagct

SEQ ID NO: 407670 - DNA, 20 bp, Artificial
  CRISPR gRNA sequence
atttatatgcatcaagctgt

SEQ ID NO: 407671 - DNA, 20 bp, Artificial
  CRISPR gRNA sequence
tttatatgcatcaagctgtg

SEQ ID NO: 407672 - DNA, 20 bp, Artificial
  CRISPR gRNA sequence
atatgcatcaagctgtgtga

SEQ ID NO: 407673 - DNA, 20 bp, Artificial
  CRISPR gRNA sequence
tatgcatcaagctgtgtgac

SEQ ID NO: 407674 - DNA, 20 bp, Artificial
  CRISPR gRNA sequence
tgtgacggagctcaaaaaag

SEQ ID NO: 407675 - DNA, 20 bp, Artificial
  CRISPR gRNA sequence
aaaaaaggaagaatcctatg

SEQ ID NO: 407676 - DNA, 20 bp, Artificial
  CRISPR gRNA sequence
tgtcttctgtctgactgagg

SEQ ID NO: 407677 - DNA, 20 bp, Artificial
  CRISPR gRNA sequence
ctgtctgactgaggttttgt

SEQ ID NO: 407678 - DNA, 20 bp, Artificial
  CRISPR gRNA sequence
tgtctgactgaggttttgta

SEQ ID NO: 407679 - DNA, 20 bp, Artificial
  CRISPR gRNA sequence
tctgactgaggttttgtacc

SEQ ID NO: 407680 - DNA, 20 bp, Artificial
  CRISPR gRNA sequence
actgaggttttgtaccctct

SEQ ID NO: 407681 - DNA, 20 bp, Artificial
  CRISPR gRNA sequence
aggttttgtaccctcttaac

SEQ ID NO: 407682 - DNA, 20 bp, Artificial
  CRISPR gRNA sequence
tgtaccctcttaaccgttat

SEQ ID NO: 407683 - DNA, 20 bp, Artificial
  CRISPR gRNA sequence
gtaccctcttaaccgttatc

SEQ ID NO: 407684 - DNA, 20 bp, Artificial
  CRISPR gRNA sequence
taccctcttaaccgttatcc

SEQ ID NO: 407685 - DNA, 20 bp, Artificial
  CRISPR gRNA sequence
ttaaccgttatcccctcatt

SEQ ID NO: 407686 - DNA, 20 bp, Artificial
  CRISPR gRNA sequence
aaccgttatcccctcattct

SEQ ID NO: 407687 - DNA, 20 bp, Artificial
  CRISPR gRNA sequence
accgttatcccctcattctc

SEQ ID NO: 407688 - DNA, 20 bp, Artificial
  CRISPR gRNA sequence
tcccctcattctcccaatcc

SEQ ID NO: 407689 - DNA, 20 bp, Artificial
  CRISPR gRNA sequence
attctcccaatccccagcca

SEQ ID NO: 407690 - DNA, 20 bp, Artificial
  CRISPR gRNA sequence
tcccaatccccagccactgt

SEQ ID NO: 407691 - DNA, 20 bp, Artificial
  CRISPR gRNA sequence
ccaatccccagccactgtaa

SEQ ID NO: 407692 - DNA, 20 bp, Artificial
  CRISPR gRNA sequence
taagcaccatcctaccctct

SEQ ID NO: 407693 - DNA, 20 bp, Artificial
  CRISPR gRNA sequence
ccctctgcttctatgagaga

SEQ ID NO: 407694 - DNA, 20 bp, Artificial
  CRISPR gRNA sequence
tgcttctatgagagagattt

SEQ ID NO: 407695 - DNA, 20 bp, Artificial
  CRISPR gRNA sequence
cttctatgagagagatttca

SEQ ID NO: 407696 - DNA, 20 bp, Artificial
  CRISPR gRNA sequence
ctatgagagagatttcattg

SEQ ID NO: 407697 - DNA, 20 bp, Artificial
  CRISPR gRNA sequence
tatgagagagatttcattga

SEQ ID NO: 407698 - DNA, 20 bp, Artificial
  CRISPR gRNA sequence
tgagagagatttcattgact

SEQ ID NO: 407699 - DNA, 20 bp, Artificial
  CRISPR gRNA sequence
cattgactcaggtcatgtta

SEQ ID NO: 407700 - DNA, 20 bp, Artificial
  CRISPR gRNA sequence
attgactcaggtcatgttat

SEQ ID NO: 407701 - DNA, 20 bp, Artificial
  CRISPR gRNA sequence
actcaggtcatgttatcaag

SEQ ID NO: 407702 - DNA, 20 bp, Artificial
  CRISPR gRNA sequence
aggtcatgttatcaagaaga

SEQ ID NO: 407703 - DNA, 20 bp, Artificial
  CRISPR gRNA sequence
tcaagaagacattcaagggc

SEQ ID NO: 407704 - DNA, 20 bp, Artificial
  CRISPR gRNA sequence
aagggccaggtgtggtggca

SEQ ID NO: 407705 - DNA, 20 bp, Artificial
  CRISPR gRNA sequence
taatcccagcactttgggag

SEQ ID NO: 407706 - DNA, 20 bp, Artificial
  CRISPR gRNA sequence
tgggaggccgaggtgggcgg

SEQ ID NO: 407707 - DNA, 20 bp, Artificial
  CRISPR gRNA sequence
gggaggccgaggtgggcgga

SEQ ID NO: 407708 - DNA, 20 bp, Artificial
  CRISPR gRNA sequence
ggaggccgaggtgggcggac

SEQ ID NO: 407709 - DNA, 20 bp, Artificial
  CRISPR gRNA sequence
gagatcaggagttcgagacc

SEQ ID NO: 407710 - DNA, 20 bp, Artificial
  CRISPR gRNA sequence
agatcaggagttcgagacca

SEQ ID NO: 407711 - DNA, 20 bp, Artificial
  CRISPR gRNA sequence
gagaccagcctggccaacat

SEQ ID NO: 407712 - DNA, 20 bp, Artificial
  CRISPR gRNA sequence
gccaacatggcaaaacccca

SEQ ID NO: 407713 - DNA, 20 bp, Artificial
  CRISPR gRNA sequence
tactaaaaatacaaaaaatt

SEQ ID NO: 407714 - DNA, 20 bp, Artificial
  CRISPR gRNA sequence
ctaaaaatacaaaaaattta

SEQ ID NO: 407715 - DNA, 20 bp, Artificial
  CRISPR gRNA sequence
aaaatacaaaaaatttagct

SEQ ID NO: 407716 - DNA, 20 bp, Artificial
  CRISPR gRNA sequence
agctgggcatggtggtgtgt

SEQ ID NO: 407717 - DNA, 20 bp, Artificial
  CRISPR gRNA sequence
gctgggcatggtggtgtgtg

SEQ ID NO: 407718 - DNA, 20 bp, Artificial
  CRISPR gRNA sequence
ggcatggtggtgtgtgcctg

SEQ ID NO: 407719 - DNA, 20 bp, Artificial
  CRISPR gRNA sequence
taatcccagttactcgggag

SEQ ID NO: 407720 - DNA, 20 bp, Artificial
  CRISPR gRNA sequence
ctcgggaggctgaggcagca

SEQ ID NO: 407721 - DNA, 20 bp, Artificial
  CRISPR gRNA sequence
gggaggctgaggcagcagaa

SEQ ID NO: 407722 - DNA, 20 bp, Artificial
  CRISPR gRNA sequence
aggcagcagaattgcttgaa

SEQ ID NO: 407723 - DNA, 20 bp, Artificial
  CRISPR gRNA sequence
cttgaacccaggaggtgctg

SEQ ID NO: 407724 - DNA, 20 bp, Artificial
  CRISPR gRNA sequence
gaacccaggaggtgctgagt

SEQ ID NO: 407725 - DNA, 20 bp, Artificial
  CRISPR gRNA sequence
aacccaggaggtgctgagtc

SEQ ID NO: 407726 - DNA, 20 bp, Artificial
  CRISPR gRNA sequence
agtcaagataccatcactgc

SEQ ID NO: 407727 - DNA, 20 bp, Artificial
  CRISPR gRNA sequence
cactccagcctgggcaacag

SEQ ID NO: 407728 - DNA, 20 bp, Artificial
  CRISPR gRNA sequence
cagcctgggcaacagagtgg

SEQ ID NO: 407729 - DNA, 20 bp, Artificial
  CRISPR gRNA sequence
ggcaacagagtgggactcca

SEQ ID NO: 407730 - DNA, 20 bp, Artificial
  CRISPR gRNA sequence
catctgaaaaacaaacaaaa

SEQ ID NO: 407731 - DNA, 20 bp, Artificial
  CRISPR gRNA sequence
aaaaacaaacaaaaaagaca

SEQ ID NO: 407732 - DNA, 20 bp, Artificial
  CRISPR gRNA sequence
aggaatctggttccaggcac

SEQ ID NO: 407733 - DNA, 20 bp, Artificial
  CRISPR gRNA sequence
ggaatctggttccaggcaca

SEQ ID NO: 407734 - DNA, 20 bp, Artificial
  CRISPR gRNA sequence
gttccaggcacactgatgga

SEQ ID NO: 407735 - DNA, 20 bp, Artificial
  CRISPR gRNA sequence
caggcacactgatggaaatt

SEQ ID NO: 407736 - DNA, 20 bp, Artificial
  CRISPR gRNA sequence
atggaaatttagattctagg

SEQ ID NO: 407737 - DNA, 20 bp, Artificial
  CRISPR gRNA sequence
agattctaggctccaagtac

SEQ ID NO: 407738 - DNA, 20 bp, Artificial
  CRISPR gRNA sequence
gattctaggctccaagtaca

SEQ ID NO: 407739 - DNA, 20 bp, Artificial
  CRISPR gRNA sequence
taggctccaagtacaattta

SEQ ID NO: 407740 - DNA, 20 bp, Artificial
  CRISPR gRNA sequence
ggctccaagtacaatttagt

SEQ ID NO: 407741 - DNA, 20 bp, Artificial
  CRISPR gRNA sequence
caagtacaatttagtaaagt

SEQ ID NO: 407742 - DNA, 20 bp, Artificial
  CRISPR gRNA sequence
agtaaagttctacaattgtg

SEQ ID NO: 407743 - DNA, 20 bp, Artificial
  CRISPR gRNA sequence
gtaaagttctacaattgtgc

SEQ ID NO: 407744 - DNA, 20 bp, Artificial
  CRISPR gRNA sequence
tacaattgtgcttgctttag

SEQ ID NO: 407745 - DNA, 20 bp, Artificial
  CRISPR gRNA sequence
caattgtgcttgctttagat

SEQ ID NO: 407746 - DNA, 20 bp, Artificial
  CRISPR gRNA sequence
tgcttgctttagattgcatt

SEQ ID NO: 407747 - DNA, 20 bp, Artificial
  CRISPR gRNA sequence
gctttagattgcattcacca

SEQ ID NO: 407748 - DNA, 20 bp, Artificial
  CRISPR gRNA sequence
ctttagattgcattcaccag

SEQ ID NO: 407749 - DNA, 20 bp, Artificial
  CRISPR gRNA sequence
tagattgcattcaccagaag

SEQ ID NO: 407750 - DNA, 20 bp, Artificial
  CRISPR gRNA sequence
agattgcattcaccagaagc

SEQ ID NO: 407751 - DNA, 20 bp, Artificial
  CRISPR gRNA sequence
gattgcattcaccagaagca

SEQ ID NO: 407752 - DNA, 20 bp, Artificial
  CRISPR gRNA sequence
cattcaccagaagcagtccc

SEQ ID NO: 407753 - DNA, 20 bp, Artificial
  CRISPR gRNA sequence
accagaagcagtccctgaga

SEQ ID NO: 407754 - DNA, 20 bp, Artificial
  CRISPR gRNA sequence
agaagaggataaatgtgaaa

SEQ ID NO: 407755 - DNA, 20 bp, Artificial
  CRISPR gRNA sequence
ggaagtgttcgcagggaaac

SEQ ID NO: 407756 - DNA, 20 bp, Artificial
  CRISPR gRNA sequence
gcagggaaacccatcagggg

SEQ ID NO: 407757 - DNA, 20 bp, Artificial
  CRISPR gRNA sequence
gattggaaagggaaggagag

SEQ ID NO: 407758 - DNA, 20 bp, Artificial
  CRISPR gRNA sequence
gaaagggaaggagagatcca

SEQ ID NO: 407759 - DNA, 20 bp, Artificial
  CRISPR gRNA sequence
gggaagctgcctggtcagga

SEQ ID NO: 407760 - DNA, 20 bp, Artificial
  CRISPR gRNA sequence
cctggtcaggaaaagcaaac

SEQ ID NO: 407761 - DNA, 20 bp, Artificial
  CRISPR gRNA sequence
gtcaggaaaagcaaactcta

SEQ ID NO: 407762 - DNA, 20 bp, Artificial
  CRISPR gRNA sequence
taccagggtcagtcactgga

SEQ ID NO: 407763 - DNA, 20 bp, Artificial
  CRISPR gRNA sequence
ccagggtcagtcactggatc

SEQ ID NO: 407764 - DNA, 20 bp, Artificial
  CRISPR gRNA sequence
gatcagggtcccttgatcag

SEQ ID NO: 407765 - DNA, 20 bp, Artificial
  CRISPR gRNA sequence
gatcagtgtgtgcattctca

SEQ ID NO: 407766 - DNA, 20 bp, Artificial
  CRISPR gRNA sequence
atcagtgtgtgcattctcag

SEQ ID NO: 407767 - DNA, 20 bp, Artificial
  CRISPR gRNA sequence
tcaggcaggctccagccacc

SEQ ID NO: 407768 - DNA, 20 bp, Artificial
  CRISPR gRNA sequence
aggcaggctccagccaccct

SEQ ID NO: 407769 - DNA, 20 bp, Artificial
  CRISPR gRNA sequence
cagccaccctgggcagtgct

SEQ ID NO: 407770 - DNA, 20 bp, Artificial
  CRISPR gRNA sequence
ggcagtgctccaacctagcg

SEQ ID NO: 407771 - DNA, 20 bp, Artificial
  CRISPR gRNA sequence
caacctagcggggcaggtgc

SEQ ID NO: 407772 - DNA, 20 bp, Artificial
  CRISPR gRNA sequence
gcggggcaggtgctggctgt

SEQ ID NO: 407773 - DNA, 20 bp, Artificial
  CRISPR gRNA sequence
gctgttaggggagaagagag

SEQ ID NO: 407774 - DNA, 20 bp, Artificial
  CRISPR gRNA sequence
ttaggggagaagagagcaca

SEQ ID NO: 407775 - DNA, 20 bp, Artificial
  CRISPR gRNA sequence
ggggagaagagagcacagaa

SEQ ID NO: 407776 - DNA, 20 bp, Artificial
  CRISPR gRNA sequence
gggtgcttcaagaaggcaga

SEQ ID NO: 407777 - DNA, 20 bp, Artificial
  CRISPR gRNA sequence
caagaaggcagaaaggtccc

SEQ ID NO: 407778 - DNA, 20 bp, Artificial
  CRISPR gRNA sequence
aagaaggcagaaaggtccca

SEQ ID NO: 407779 - DNA, 20 bp, Artificial
  CRISPR gRNA sequence
acagcatctgctcactgtcc

SEQ ID NO: 407780 - DNA, 20 bp, Artificial
  CRISPR gRNA sequence
ctcactgtccgagtcaagcc

SEQ ID NO: 407781 - DNA, 20 bp, Artificial
  CRISPR gRNA sequence
actgtccgagtcaagcccgg

SEQ ID NO: 407782 - DNA, 20 bp, Artificial
  CRISPR gRNA sequence
tccgagtcaagcccggctcc

SEQ ID NO: 407783 - DNA, 20 bp, Artificial
  CRISPR gRNA sequence
ctgctccatttttatggagt

SEQ ID NO: 407784 - DNA, 20 bp, Artificial
  CRISPR gRNA sequence
ctccatttttatggagttcc

SEQ ID NO: 407785 - DNA, 20 bp, Artificial
  CRISPR gRNA sequence
catttttatggagttccctg

SEQ ID NO: 407786 - DNA, 20 bp, Artificial
  CRISPR gRNA sequence
ttatggagttccctgcattg

SEQ ID NO: 407787 - DNA, 20 bp, Artificial
  CRISPR gRNA sequence
tatggagttccctgcattgc

SEQ ID NO: 407788 - DNA, 20 bp, Artificial
  CRISPR gRNA sequence
atggagttccctgcattgca

SEQ ID NO: 407789 - DNA, 20 bp, Artificial
  CRISPR gRNA sequence
tggagttccctgcattgcag

SEQ ID NO: 407790 - DNA, 20 bp, Artificial
  CRISPR gRNA sequence
cctgcattgcagggtgtttg

SEQ ID NO: 407791 - DNA, 20 bp, Artificial
  CRISPR gRNA sequence
cattgcagggtgtttggaac

SEQ ID NO: 407792 - DNA, 20 bp, Artificial
  CRISPR gRNA sequence
cagggtgtttggaacttatt

SEQ ID NO: 407793 - DNA, 20 bp, Artificial
  CRISPR gRNA sequence
ggaacttattgcttagcgaa

SEQ ID NO: 407794 - DNA, 20 bp, Artificial
  CRISPR gRNA sequence
gaacttattgcttagcgaaa

SEQ ID NO: 407795 - DNA, 20 bp, Artificial
  CRISPR gRNA sequence
attgcttagcgaaacccaag

SEQ ID NO: 407796 - DNA, 20 bp, Artificial
  CRISPR gRNA sequence
ttgcttagcgaaacccaagc

SEQ ID NO: 407797 - DNA, 20 bp, Artificial
  CRISPR gRNA sequence
cttagcgaaacccaagcaaa

SEQ ID NO: 407798 - DNA, 20 bp, Artificial
  CRISPR gRNA sequence
agcgaaacccaagcaaagat

SEQ ID NO: 407799 - DNA, 20 bp, Artificial
  CRISPR gRNA sequence
gcgaaacccaagcaaagatt

SEQ ID NO: 407800 - DNA, 20 bp, Artificial
  CRISPR gRNA sequence
catctttcagttcttcccat

SEQ ID NO: 407801 - DNA, 20 bp, Artificial
  CRISPR gRNA sequence
atctttcagttcttcccatt

SEQ ID NO: 407802 - DNA, 20 bp, Artificial
  CRISPR gRNA sequence
tcagttcttcccattcgtca

SEQ ID NO: 407803 - DNA, 20 bp, Artificial
  CRISPR gRNA sequence
cagttcttcccattcgtcat

SEQ ID NO: 407804 - DNA, 20 bp, Artificial
  CRISPR gRNA sequence
agttcttcccattcgtcatt

SEQ ID NO: 407805 - DNA, 20 bp, Artificial
  CRISPR gRNA sequence
ttcccattcgtcatttgcca

SEQ ID NO: 407806 - DNA, 20 bp, Artificial
  CRISPR gRNA sequence
cccattcgtcatttgccatt

SEQ ID NO: 407807 - DNA, 20 bp, Artificial
  CRISPR gRNA sequence
ccattcgtcatttgccattt

SEQ ID NO: 407808 - DNA, 20 bp, Artificial
  CRISPR gRNA sequence
gtcatttgccattttccctt

SEQ ID NO: 407809 - DNA, 20 bp, Artificial
  CRISPR gRNA sequence
gccattttcccttacaacga

SEQ ID NO: 407810 - DNA, 20 bp, Artificial
  CRISPR gRNA sequence
ccattttcccttacaacgaa

SEQ ID NO: 407811 - DNA, 20 bp, Artificial
  CRISPR gRNA sequence
tcccttacaacgaacgtgaa

SEQ ID NO: 407812 - DNA, 20 bp, Artificial
  CRISPR gRNA sequence
cccttacaacgaacgtgaat

SEQ ID NO: 407813 - DNA, 20 bp, Artificial
  CRISPR gRNA sequence
ccttacaacgaacgtgaata

SEQ ID NO: 407814 - DNA, 20 bp, Artificial
  CRISPR gRNA sequence
acaacgaacgtgaatattgt

SEQ ID NO: 407815 - DNA, 20 bp, Artificial
  CRISPR gRNA sequence
caacgaacgtgaatattgtc

SEQ ID NO: 407816 - DNA, 20 bp, Artificial
  CRISPR gRNA sequence
tctgaaactcgaagtcctcc

SEQ ID NO: 407817 - DNA, 20 bp, Artificial
  CRISPR gRNA sequence
aaactcgaagtcctccaaga

SEQ ID NO: 407818 - DNA, 20 bp, Artificial
  CRISPR gRNA sequence
gaagtcctccaagaaatcct

SEQ ID NO: 407819 - DNA, 20 bp, Artificial
  CRISPR gRNA sequence
caagaaatcctcacctttct

SEQ ID NO: 407820 - DNA, 20 bp, Artificial
  CRISPR gRNA sequence
acctttcttgcctgcggcca

SEQ ID NO: 407821 - DNA, 20 bp, Artificial
  CRISPR gRNA sequence
tcttgcctgcggccagttaa

SEQ ID NO: 407822 - DNA, 20 bp, Artificial
  CRISPR gRNA sequence
cttgcctgcggccagttaaa

SEQ ID NO: 407823 - DNA, 20 bp, Artificial
  CRISPR gRNA sequence
ttgcctgcggccagttaaag

SEQ ID NO: 407824 - DNA, 20 bp, Artificial
  CRISPR gRNA sequence
gcctgcggccagttaaagcg

SEQ ID NO: 407825 - DNA, 20 bp, Artificial
  CRISPR gRNA sequence
cctgcggccagttaaagcgt

SEQ ID NO: 407826 - DNA, 20 bp, Artificial
  CRISPR gRNA sequence
cggccagttaaagcgtgaaa

SEQ ID NO: 407827 - DNA, 20 bp, Artificial
  CRISPR gRNA sequence
aagcgtgaaatattttgcta

SEQ ID NO: 407828 - DNA, 20 bp, Artificial
  CRISPR gRNA sequence
tgctaggcaaaatagggctc

SEQ ID NO: 407829 - DNA, 20 bp, Artificial
  CRISPR gRNA sequence
gctaggcaaaatagggctca

SEQ ID NO: 407830 - DNA, 20 bp, Artificial
  CRISPR gRNA sequence
ctaggcaaaatagggctcat

SEQ ID NO: 407831 - DNA, 20 bp, Artificial
  CRISPR gRNA sequence
ggcaaaatagggctcatatt

SEQ ID NO: 407832 - DNA, 20 bp, Artificial
  CRISPR gRNA sequence
atattcacattttcaggaga

SEQ ID NO: 407833 - DNA, 20 bp, Artificial
  CRISPR gRNA sequence
acattttcaggagagagcca

SEQ ID NO: 407834 - DNA, 20 bp, Artificial
  CRISPR gRNA sequence
tcaggagagagccataaggg

SEQ ID NO: 407835 - DNA, 20 bp, Artificial
  CRISPR gRNA sequence
caggagagagccataagggt

SEQ ID NO: 407836 - DNA, 20 bp, Artificial
  CRISPR gRNA sequence
aggagagagccataagggtg

SEQ ID NO: 407837 - DNA, 20 bp, Artificial
  CRISPR gRNA sequence
ttagtttgcttttctttgag

SEQ ID NO: 407838 - DNA, 20 bp, Artificial
  CRISPR gRNA sequence
tagtttgcttttctttgagt

SEQ ID NO: 407839 - DNA, 20 bp, Artificial
  CRISPR gRNA sequence
agtttgcttttctttgagtc

SEQ ID NO: 407840 - DNA, 20 bp, Artificial
  CRISPR gRNA sequence
gtttgcttttctttgagtcc

SEQ ID NO: 407841 - DNA, 20 bp, Artificial
  CRISPR gRNA sequence
gcttttctttgagtcctgtt

SEQ ID NO: 407842 - DNA, 20 bp, Artificial
  CRISPR gRNA sequence
cttttctttgagtcctgttg

SEQ ID NO: 407843 - DNA, 20 bp, Artificial
  CRISPR gRNA sequence
ttctttgagtcctgttgcta

SEQ ID NO: 407844 - DNA, 20 bp, Artificial
  CRISPR gRNA sequence
tctttgagtcctgttgctat

SEQ ID NO: 407845 - DNA, 20 bp, Artificial
  CRISPR gRNA sequence
ctttgagtcctgttgctatt

SEQ ID NO: 407846 - DNA, 20 bp, Artificial
  CRISPR gRNA sequence
tttgagtcctgttgctattc

SEQ ID NO: 407847 - DNA, 20 bp, Artificial
  CRISPR gRNA sequence
tgagtcctgttgctattcct

SEQ ID NO: 407848 - DNA, 20 bp, Artificial
  CRISPR gRNA sequence
gagtcctgttgctattcctg

SEQ ID NO: 407849 - DNA, 20 bp, Artificial
  CRISPR gRNA sequence
agtcctgttgctattcctga

SEQ ID NO: 407850 - DNA, 20 bp, Artificial
  CRISPR gRNA sequence
ttgctattcctgacgagatt

SEQ ID NO: 407851 - DNA, 20 bp, Artificial
  CRISPR gRNA sequence
ctattcctgacgagattttt

SEQ ID NO: 407852 - DNA, 20 bp, Artificial
  CRISPR gRNA sequence
ttcctgacgagatttttgca

SEQ ID NO: 407853 - DNA, 20 bp, Artificial
  CRISPR gRNA sequence
ctgacgagatttttgcagcg

SEQ ID NO: 407854 - DNA, 20 bp, Artificial
  CRISPR gRNA sequence
acgagatttttgcagcgctg

SEQ ID NO: 407855 - DNA, 20 bp, Artificial
  CRISPR gRNA sequence
ttgcagcgctgagcaagacc

SEQ ID NO: 407856 - DNA, 20 bp, Artificial
  CRISPR gRNA sequence
tgcagcgctgagcaagacca

SEQ ID NO: 407857 - DNA, 20 bp, Artificial
  CRISPR gRNA sequence
gcagcgctgagcaagaccag

SEQ ID NO: 407858 - DNA, 20 bp, Artificial
  CRISPR gRNA sequence
cagcgctgagcaagaccaga

SEQ ID NO: 407859 - DNA, 20 bp, Artificial
  CRISPR gRNA sequence
agcaagaccagaggaccttg

SEQ ID NO: 407860 - DNA, 20 bp, Artificial
  CRISPR gRNA sequence
gtgttctcctttccctacag

SEQ ID NO: 407861 - DNA, 20 bp, Artificial
  CRISPR gRNA sequence
tgttctcctttccctacaga

SEQ ID NO: 407862 - DNA, 20 bp, Artificial
  CRISPR gRNA sequence
tcctttccctacagaaaatg

SEQ ID NO: 407863 - DNA, 20 bp, Artificial
  CRISPR gRNA sequence
ctttccctacagaaaatggc

SEQ ID NO: 407864 - DNA, 20 bp, Artificial
  CRISPR gRNA sequence
tccctacagaaaatggcttc

SEQ ID NO: 407865 - DNA, 20 bp, Artificial
  CRISPR gRNA sequence
ccctacagaaaatggcttct

SEQ ID NO: 407866 - DNA, 20 bp, Artificial
  CRISPR gRNA sequence
cctacagaaaatggcttcta

SEQ ID NO: 407867 - DNA, 20 bp, Artificial
  CRISPR gRNA sequence
cagaaaatggcttctatttc

SEQ ID NO: 407868 - DNA, 20 bp, Artificial
  CRISPR gRNA sequence
ctatttcataggtcatgtct

SEQ ID NO: 407869 - DNA, 20 bp, Artificial
  CRISPR gRNA sequence
tatttcataggtcatgtctt

SEQ ID NO: 407870 - DNA, 20 bp, Artificial
  CRISPR gRNA sequence
tttcataggtcatgtctttt

SEQ ID NO: 407871 - DNA, 20 bp, Artificial
  CRISPR gRNA sequence
cataggtcatgtcttttgcc

SEQ ID NO: 407872 - DNA, 20 bp, Artificial
  CRISPR gRNA sequence
ataggtcatgtcttttgcct

SEQ ID NO: 407873 - DNA, 20 bp, Artificial
  CRISPR gRNA sequence
ttgcctgcagaaatttgcag

SEQ ID NO: 407874 - DNA, 20 bp, Artificial
  CRISPR gRNA sequence
tgcctgcagaaatttgcaga

SEQ ID NO: 407875 - DNA, 20 bp, Artificial
  CRISPR gRNA sequence
gcctgcagaaatttgcagaa

SEQ ID NO: 407876 - DNA, 20 bp, Artificial
  CRISPR gRNA sequence
cctgcagaaatttgcagaaa

SEQ ID NO: 407877 - DNA, 20 bp, Artificial
  CRISPR gRNA sequence
cagaaatttgcagaaattat

SEQ ID NO: 407878 - DNA, 20 bp, Artificial
  CRISPR gRNA sequence
gcagaaattatcttccaatt

SEQ ID NO: 407879 - DNA, 20 bp, Artificial
  CRISPR gRNA sequence
cagaaattatcttccaattt

SEQ ID NO: 407880 - DNA, 20 bp, Artificial
  CRISPR gRNA sequence
tcttccaattttcagagcaa

SEQ ID NO: 407881 - DNA, 20 bp, Artificial
  CRISPR gRNA sequence
ccaattttcagagcaatttt

SEQ ID NO: 407882 - DNA, 20 bp, Artificial
  CRISPR gRNA sequence
caattttcagagcaatttta

SEQ ID NO: 407883 - DNA, 20 bp, Artificial
  CRISPR gRNA sequence
tcagagcaattttaattgga

SEQ ID NO: 407884 - DNA, 20 bp, Artificial
  CRISPR gRNA sequence
cagagcaattttaattggat

SEQ ID NO: 407885 - DNA, 20 bp, Artificial
  CRISPR gRNA sequence
agagcaattttaattggata

SEQ ID NO: 407886 - DNA, 20 bp, Artificial
  CRISPR gRNA sequence
taattggataggaatcacac

SEQ ID NO: 407887 - DNA, 20 bp, Artificial
  CRISPR gRNA sequence
aattggataggaatcacact

SEQ ID NO: 407888 - DNA, 20 bp, Artificial
  CRISPR gRNA sequence
attggataggaatcacactg

SEQ ID NO: 407889 - DNA, 20 bp, Artificial
  CRISPR gRNA sequence
gataggaatcacactgttag

SEQ ID NO: 407890 - DNA, 20 bp, Artificial
  CRISPR gRNA sequence
ttagcaatggtgaacctctg

SEQ ID NO: 407891 - DNA, 20 bp, Artificial
  CRISPR gRNA sequence
gcaatggtgaacctctgatt

SEQ ID NO: 407892 - DNA, 20 bp, Artificial
  CRISPR gRNA sequence
tgatttcctgagcagtgtgt

SEQ ID NO: 407893 - DNA, 20 bp, Artificial
  CRISPR gRNA sequence
atttcctgagcagtgtgttt

SEQ ID NO: 407894 - DNA, 20 bp, Artificial
  CRISPR gRNA sequence
cctgagcagtgtgttttaaa

SEQ ID NO: 407895 - DNA, 20 bp, Artificial
  CRISPR gRNA sequence
ctgagcagtgtgttttaaaa

SEQ ID NO: 407896 - DNA, 20 bp, Artificial
  CRISPR gRNA sequence
agcagtgtgttttaaaactt

SEQ ID NO: 407897 - DNA, 20 bp, Artificial
  CRISPR gRNA sequence
taaaacttagttttagaatt

SEQ ID NO: 407898 - DNA, 20 bp, Artificial
  CRISPR gRNA sequence
aaaacttagttttagaatta

SEQ ID NO: 407899 - DNA, 20 bp, Artificial
  CRISPR gRNA sequence
aaacttagttttagaattaa

SEQ ID NO: 407900 - DNA, 20 bp, Artificial
  CRISPR gRNA sequence
agttttagaattaacttaat

SEQ ID NO: 407901 - DNA, 20 bp, Artificial
  CRISPR gRNA sequence
gttttagaattaacttaatt

SEQ ID NO: 407902 - DNA, 20 bp, Artificial
  CRISPR gRNA sequence
tagaattaacttaattttat

SEQ ID NO: 407903 - DNA, 20 bp, Artificial
  CRISPR gRNA sequence
agaattaacttaattttatt

SEQ ID NO: 407904 - DNA, 20 bp, Artificial
  CRISPR gRNA sequence
gaattaacttaattttatta

SEQ ID NO: 407905 - DNA, 20 bp, Artificial
  CRISPR gRNA sequence
acttaattttattacatctt

SEQ ID NO: 407906 - DNA, 20 bp, Artificial
  CRISPR gRNA sequence
aattttattacatctttttt

SEQ ID NO: 407907 - DNA, 20 bp, Artificial
  CRISPR gRNA sequence
attttattacatcttttttt

SEQ ID NO: 407908 - DNA, 20 bp, Artificial
  CRISPR gRNA sequence
tattacatcttttttttcaa

SEQ ID NO: 407909 - DNA, 20 bp, Artificial
  CRISPR gRNA sequence
attacatcttttttttcaat

SEQ ID NO: 407910 - DNA, 20 bp, Artificial
  CRISPR gRNA sequence
ttacatcttttttttcaatg

SEQ ID NO: 407911 - DNA, 20 bp, Artificial
  CRISPR gRNA sequence
catcttttttttcaatggaa

SEQ ID NO: 407912 - DNA, 20 bp, Artificial
  CRISPR gRNA sequence
ttttttcaatggaagtcaaa

SEQ ID NO: 407913 - DNA, 20 bp, Artificial
  CRISPR gRNA sequence
tttttcaatggaagtcaaaa

SEQ ID NO: 407914 - DNA, 20 bp, Artificial
  CRISPR gRNA sequence
ttttcaatggaagtcaaaat

SEQ ID NO: 407915 - DNA, 20 bp, Artificial
  CRISPR gRNA sequence
tttcaatggaagtcaaaata

SEQ ID NO: 407916 - DNA, 20 bp, Artificial
  CRISPR gRNA sequence
ttcaatggaagtcaaaatat

SEQ ID NO: 407917 - DNA, 20 bp, Artificial
  CRISPR gRNA sequence
tcaatggaagtcaaaatatg

SEQ ID NO: 407918 - DNA, 20 bp, Artificial
  CRISPR gRNA sequence
caatggaagtcaaaatatgt

SEQ ID NO: 407919 - DNA, 20 bp, Artificial
  CRISPR gRNA sequence
aatggaagtcaaaatatgta

SEQ ID NO: 407920 - DNA, 20 bp, Artificial
  CRISPR gRNA sequence
acatctaggcgtatatagta

SEQ ID NO: 407921 - DNA, 20 bp, Artificial
  CRISPR gRNA sequence
ggcgtatatagtatgtgtag

SEQ ID NO: 407922 - DNA, 20 bp, Artificial
  CRISPR gRNA sequence
tgagggtgtgcaggtactgt

SEQ ID NO: 407923 - DNA, 20 bp, Artificial
  CRISPR gRNA sequence
tttcttggtttcccatttct

SEQ ID NO: 407924 - DNA, 20 bp, Artificial
  CRISPR gRNA sequence
cttggtttcccatttctaac

SEQ ID NO: 407925 - DNA, 20 bp, Artificial
  CRISPR gRNA sequence
ttggtttcccatttctaaca

SEQ ID NO: 407926 - DNA, 20 bp, Artificial
  CRISPR gRNA sequence
ggtttcccatttctaacatt

SEQ ID NO: 407927 - DNA, 20 bp, Artificial
  CRISPR gRNA sequence
gtttcccatttctaacatta

SEQ ID NO: 407928 - DNA, 20 bp, Artificial
  CRISPR gRNA sequence
cccatttctaacattatatc

SEQ ID NO: 407929 - DNA, 20 bp, Artificial
  CRISPR gRNA sequence
ccatttctaacattatatca

SEQ ID NO: 407930 - DNA, 20 bp, Artificial
  CRISPR gRNA sequence
ctaacattatatcagttggt

SEQ ID NO: 407931 - DNA, 20 bp, Artificial
  CRISPR gRNA sequence
taacattatatcagttggtt

SEQ ID NO: 407932 - DNA, 20 bp, Artificial
  CRISPR gRNA sequence
acattatatcagttggttct

SEQ ID NO: 407933 - DNA, 20 bp, Artificial
  CRISPR gRNA sequence
tatcagttggttcttagtca

SEQ ID NO: 407934 - DNA, 20 bp, Artificial
  CRISPR gRNA sequence
gttcttagtcatttttcata

SEQ ID NO: 407935 - DNA, 20 bp, Artificial
  CRISPR gRNA sequence
ttagtcatttttcatatgtc

SEQ ID NO: 407936 - DNA, 20 bp, Artificial
  CRISPR gRNA sequence
agtcatttttcatatgtcat

SEQ ID NO: 407937 - DNA, 20 bp, Artificial
  CRISPR gRNA sequence
gtcatttttcatatgtcatg

SEQ ID NO: 407938 - DNA, 20 bp, Artificial
  CRISPR gRNA sequence
ttcatatgtcatgcatcaca

SEQ ID NO: 407939 - DNA, 20 bp, Artificial
  CRISPR gRNA sequence
tcatatgtcatgcatcacaa

SEQ ID NO: 407940 - DNA, 20 bp, Artificial
  CRISPR gRNA sequence
catatgtcatgcatcacaaa

SEQ ID NO: 407941 - DNA, 20 bp, Artificial
  CRISPR gRNA sequence
atatgtcatgcatcacaaat

SEQ ID NO: 407942 - DNA, 20 bp, Artificial
  CRISPR gRNA sequence
atttgttctccacaaagcca

SEQ ID NO: 407943 - DNA, 20 bp, Artificial
  CRISPR gRNA sequence
tttgttctccacaaagccat

SEQ ID NO: 407944 - DNA, 20 bp, Artificial
  CRISPR gRNA sequence
gttctccacaaagccatctg

SEQ ID NO: 407945 - DNA, 20 bp, Artificial
  CRISPR gRNA sequence
ttctccacaaagccatctgg

SEQ ID NO: 407946 - DNA, 20 bp, Artificial
  CRISPR gRNA sequence
tccacaaagccatctggaaa

SEQ ID NO: 407947 - DNA, 20 bp, Artificial
  CRISPR gRNA sequence
cacaaagccatctggaaata

SEQ ID NO: 407948 - DNA, 20 bp, Artificial
  CRISPR gRNA sequence
gaaataccaaagaaatgtaa

SEQ ID NO: 407949 - DNA, 20 bp, Artificial
  CRISPR gRNA sequence
aaatagtgacatggtcagaa

SEQ ID NO: 407950 - DNA, 20 bp, Artificial
  CRISPR gRNA sequence
aacctggagtagatgctcta

SEQ ID NO: 407951 - DNA, 20 bp, Artificial
  CRISPR gRNA sequence
gagtagatgctctaaaggca

SEQ ID NO: 407952 - DNA, 20 bp, Artificial
  CRISPR gRNA sequence
taaaggcatcaaacttatgc

SEQ ID NO: 407953 - DNA, 20 bp, Artificial
  CRISPR gRNA sequence
aaggcatcaaacttatgcaa

SEQ ID NO: 407954 - DNA, 20 bp, Artificial
  CRISPR gRNA sequence
atgcaatcgaacagcttaag

SEQ ID NO: 407955 - DNA, 20 bp, Artificial
  CRISPR gRNA sequence
tgcaatcgaacagcttaagt

SEQ ID NO: 407956 - DNA, 20 bp, Artificial
  CRISPR gRNA sequence
aagtttggagtcctaaatag

SEQ ID NO: 407957 - DNA, 20 bp, Artificial
  CRISPR gRNA sequence
agtttggagtcctaaataga

SEQ ID NO: 407958 - DNA, 20 bp, Artificial
  CRISPR gRNA sequence
ggagtcctaaatagattttc

SEQ ID NO: 407959 - DNA, 20 bp, Artificial
  CRISPR gRNA sequence
gagtcctaaatagattttct

SEQ ID NO: 407960 - DNA, 20 bp, Artificial
  CRISPR gRNA sequence
aatagattttcttctggcaa

SEQ ID NO: 407961 - DNA, 20 bp, Artificial
  CRISPR gRNA sequence
tcttctggcaaatacccttg

SEQ ID NO: 407962 - DNA, 20 bp, Artificial
  CRISPR gRNA sequence
cttctggcaaatacccttgt

SEQ ID NO: 407963 - DNA, 20 bp, Artificial
  CRISPR gRNA sequence
ttctggcaaatacccttgtg

SEQ ID NO: 407964 - DNA, 20 bp, Artificial
  CRISPR gRNA sequence
ctggcaaatacccttgtgtt

SEQ ID NO: 407965 - DNA, 20 bp, Artificial
  CRISPR gRNA sequence
tggcaaatacccttgtgttt

SEQ ID NO: 407966 - DNA, 20 bp, Artificial
  CRISPR gRNA sequence
gcaaatacccttgtgtttgg

SEQ ID NO: 407967 - DNA, 20 bp, Artificial
  CRISPR gRNA sequence
gtgtttggtgagagaatctt

SEQ ID NO: 407968 - DNA, 20 bp, Artificial
  CRISPR gRNA sequence
tgtttggtgagagaatcttt

SEQ ID NO: 407969 - DNA, 20 bp, Artificial
  CRISPR gRNA sequence
ggtgagagaatctttgacag

SEQ ID NO: 407970 - DNA, 20 bp, Artificial
  CRISPR gRNA sequence
gtgagagaatctttgacaga

SEQ ID NO: 407971 - DNA, 20 bp, Artificial
  CRISPR gRNA sequence
tgacagaccttggtgagcac

SEQ ID NO: 407972 - DNA, 20 bp, Artificial
  CRISPR gRNA sequence
gacagaccttggtgagcacc

SEQ ID NO: 407973 - DNA, 20 bp, Artificial
  CRISPR gRNA sequence
acagaccttggtgagcaccg

SEQ ID NO: 407974 - DNA, 20 bp, Artificial
  CRISPR gRNA sequence
ggtgagcaccgtcgggcaat

SEQ ID NO: 407975 - DNA, 20 bp, Artificial
  CRISPR gRNA sequence
gtgagcaccgtcgggcaata

SEQ ID NO: 407976 - DNA, 20 bp, Artificial
  CRISPR gRNA sequence
cttctgaaactcacagctct

SEQ ID NO: 407977 - DNA, 20 bp, Artificial
  CRISPR gRNA sequence
ctgaaactcacagctctgtc

SEQ ID NO: 407978 - DNA, 20 bp, Artificial
  CRISPR gRNA sequence
tgaaactcacagctctgtct

SEQ ID NO: 407979 - DNA, 20 bp, Artificial
  CRISPR gRNA sequence
aaactcacagctctgtctct

SEQ ID NO: 407980 - DNA, 20 bp, Artificial
  CRISPR gRNA sequence
acagctctgtctctttgggt

SEQ ID NO: 407981 - DNA, 20 bp, Artificial
  CRISPR gRNA sequence
tgtctctttgggtctctgca

SEQ ID NO: 407982 - DNA, 20 bp, Artificial
  CRISPR gRNA sequence
tctctttgggtctctgcaga

SEQ ID NO: 407983 - DNA, 20 bp, Artificial
  CRISPR gRNA sequence
tttgggtctctgcagatgcc

SEQ ID NO: 407984 - DNA, 20 bp, Artificial
  CRISPR gRNA sequence
tgggtctctgcagatgccat

SEQ ID NO: 407985 - DNA, 20 bp, Artificial
  CRISPR gRNA sequence
gggtctctgcagatgccatc

SEQ ID NO: 407986 - DNA, 20 bp, Artificial
  CRISPR gRNA sequence
ggtctctgcagatgccatca

SEQ ID NO: 407987 - DNA, 20 bp, Artificial
  CRISPR gRNA sequence
tgcagatgccatcagggcct

SEQ ID NO: 407988 - DNA, 20 bp, Artificial
  CRISPR gRNA sequence
cagatgccatcagggcctca

SEQ ID NO: 407989 - DNA, 20 bp, Artificial
  CRISPR gRNA sequence
agtggggaatttctacaggc

SEQ ID NO: 407990 - DNA, 20 bp, Artificial
  CRISPR gRNA sequence
ctacaggctctctttgtgct

SEQ ID NO: 407991 - DNA, 20 bp, Artificial
  CRISPR gRNA sequence
tacaggctctctttgtgctt

SEQ ID NO: 407992 - DNA, 20 bp, Artificial
  CRISPR gRNA sequence
caggctctctttgtgctttc

SEQ ID NO: 407993 - DNA, 20 bp, Artificial
  CRISPR gRNA sequence
tctttgtgctttcatcactt

SEQ ID NO: 407994 - DNA, 20 bp, Artificial
  CRISPR gRNA sequence
tttgtgctttcatcactttg

SEQ ID NO: 407995 - DNA, 20 bp, Artificial
  CRISPR gRNA sequence
tgtgctttcatcactttgtt

SEQ ID NO: 407996 - DNA, 20 bp, Artificial
  CRISPR gRNA sequence
gtgctttcatcactttgttc

SEQ ID NO: 407997 - DNA, 20 bp, Artificial
  CRISPR gRNA sequence
tgctttcatcactttgttct

SEQ ID NO: 407998 - DNA, 20 bp, Artificial
  CRISPR gRNA sequence
tcatcactttgttctttgga

SEQ ID NO: 407999 - DNA, 20 bp, Artificial
  CRISPR gRNA sequence
catcactttgttctttggag

SEQ ID NO: 408000 - DNA, 20 bp, Artificial
  CRISPR gRNA sequence
atcactttgttctttggagg

SEQ ID NO: 408001 - DNA, 20 bp, Artificial
  CRISPR gRNA sequence
tgttctttggaggacttatc

SEQ ID NO: 408002 - DNA, 20 bp, Artificial
  CRISPR gRNA sequence
gttctttggaggacttatcg

SEQ ID NO: 408003 - DNA, 20 bp, Artificial
  CRISPR gRNA sequence
ttctttggaggacttatcgt

SEQ ID NO: 408004 - DNA, 20 bp, Artificial
  CRISPR gRNA sequence
tttggaggacttatcgtctt

SEQ ID NO: 408005 - DNA, 20 bp, Artificial
  CRISPR gRNA sequence
tggaggacttatcgtctttt

SEQ ID NO: 408006 - DNA, 20 bp, Artificial
  CRISPR gRNA sequence
ggaggacttatcgtcttttt

SEQ ID NO: 408007 - DNA, 20 bp, Artificial
  CRISPR gRNA sequence
gaggacttatcgtcttttta

SEQ ID NO: 408008 - DNA, 20 bp, Artificial
  CRISPR gRNA sequence
atcgtctttttacagcaatt

SEQ ID NO: 408009 - DNA, 20 bp, Artificial
  CRISPR gRNA sequence
tcgtctttttacagcaatta

SEQ ID NO: 408010 - DNA, 20 bp, Artificial
  CRISPR gRNA sequence
tttacagcaattatctgctt

SEQ ID NO: 408011 - DNA, 20 bp, Artificial
  CRISPR gRNA sequence
ttacagcaattatctgcttg

SEQ ID NO: 408012 - DNA, 20 bp, Artificial
  CRISPR gRNA sequence
tacagcaattatctgcttgt

SEQ ID NO: 408013 - DNA, 20 bp, Artificial
  CRISPR gRNA sequence
acagcaattatctgcttgtg

SEQ ID NO: 408014 - DNA, 20 bp, Artificial
  CRISPR gRNA sequence
cagcaattatctgcttgtgt

SEQ ID NO: 408015 - DNA, 20 bp, Artificial
  CRISPR gRNA sequence
tctgcttgtgtgtctctccc

SEQ ID NO: 408016 - DNA, 20 bp, Artificial
  CRISPR gRNA sequence
cttgtgtgtctctcccctaa

SEQ ID NO: 408017 - DNA, 20 bp, Artificial
  CRISPR gRNA sequence
gtgtgtctctcccctaaccc

SEQ ID NO: 408018 - DNA, 20 bp, Artificial
  CRISPR gRNA sequence
tgtgtctctcccctaaccca

SEQ ID NO: 408019 - DNA, 20 bp, Artificial
  CRISPR gRNA sequence
tcccctaacccagtctgtgt

SEQ ID NO: 408020 - DNA, 20 bp, Artificial
  CRISPR gRNA sequence
ccctaacccagtctgtgttt

SEQ ID NO: 408021 - DNA, 20 bp, Artificial
  CRISPR gRNA sequence
acccagtctgtgttttattt

SEQ ID NO: 408022 - DNA, 20 bp, Artificial
  CRISPR gRNA sequence
tgttttatttacacccagta

SEQ ID NO: 408023 - DNA, 20 bp, Artificial
  CRISPR gRNA sequence
tatttacacccagtaatctt

SEQ ID NO: 408024 - DNA, 20 bp, Artificial
  CRISPR gRNA sequence
atttacacccagtaatcttt

SEQ ID NO: 408025 - DNA, 20 bp, Artificial
  CRISPR gRNA sequence
tttacacccagtaatctttg

SEQ ID NO: 408026 - DNA, 20 bp, Artificial
  CRISPR gRNA sequence
acacccagtaatctttgtgg

SEQ ID NO: 408027 - DNA, 20 bp, Artificial
  CRISPR gRNA sequence
cacccagtaatctttgtgga

SEQ ID NO: 408028 - DNA, 20 bp, Artificial
  CRISPR gRNA sequence
tgtggatgaaggaatgaatg

SEQ ID NO: 408029 - DNA, 20 bp, Artificial
  CRISPR gRNA sequence
gtggatgaaggaatgaatgt

SEQ ID NO: 408030 - DNA, 20 bp, Artificial
  CRISPR gRNA sequence
tggatgaaggaatgaatgtt

SEQ ID NO: 408031 - DNA, 20 bp, Artificial
  CRISPR gRNA sequence
aatgaataaaggaaggaaaa

SEQ ID NO: 408032 - DNA, 20 bp, Artificial
  CRISPR gRNA sequence
caccgcctctggtttgcagt

SEQ ID NO: 408033 - DNA, 20 bp, Artificial
  CRISPR gRNA sequence
accgcctctggtttgcagtc

SEQ ID NO: 408034 - DNA, 20 bp, Artificial
  CRISPR gRNA sequence
tggtttgcagtccatctttc

SEQ ID NO: 408035 - DNA, 20 bp, Artificial
  CRISPR gRNA sequence
gtttgcagtccatctttctg

SEQ ID NO: 408036 - DNA, 20 bp, Artificial
  CRISPR gRNA sequence
gcagtccatctttctgcatg

SEQ ID NO: 408037 - DNA, 20 bp, Artificial
  CRISPR gRNA sequence
cagtccatctttctgcatga

SEQ ID NO: 408038 - DNA, 20 bp, Artificial
  CRISPR gRNA sequence
tctgcatgagtctcccacca

SEQ ID NO: 408039 - DNA, 20 bp, Artificial
  CRISPR gRNA sequence
ctgcatgagtctcccaccaa

SEQ ID NO: 408040 - DNA, 20 bp, Artificial
  CRISPR gRNA sequence
tgcatgagtctcccaccaat

SEQ ID NO: 408041 - DNA, 20 bp, Artificial
  CRISPR gRNA sequence
catgagtctcccaccaatcc

SEQ ID NO: 408042 - DNA, 20 bp, Artificial
  CRISPR gRNA sequence
ccaccaatcccgcacttcca

SEQ ID NO: 408043 - DNA, 20 bp, Artificial
  CRISPR gRNA sequence
ccactcactctccttctctg

SEQ ID NO: 408044 - DNA, 20 bp, Artificial
  CRISPR gRNA sequence
cactcactctccttctctgc

SEQ ID NO: 408045 - DNA, 20 bp, Artificial
  CRISPR gRNA sequence
actctccttctctgccctct

SEQ ID NO: 408046 - DNA, 20 bp, Artificial
  CRISPR gRNA sequence
tccttctctgccctctgccc

SEQ ID NO: 408047 - DNA, 20 bp, Artificial
  CRISPR gRNA sequence
cttctctgccctctgccccg

SEQ ID NO: 408048 - DNA, 20 bp, Artificial
  CRISPR gRNA sequence
ctctgccctctgccccgcgg

SEQ ID NO: 408049 - DNA, 20 bp, Artificial
  CRISPR gRNA sequence
tctgccctctgccccgcggt

SEQ ID NO: 408050 - DNA, 20 bp, Artificial
  CRISPR gRNA sequence
tgccctctgccccgcggtgc

SEQ ID NO: 408051 - DNA, 20 bp, Artificial
  CRISPR gRNA sequence
ccctctgccccgcggtgcac

SEQ ID NO: 408052 - DNA, 20 bp, Artificial
  CRISPR gRNA sequence
tgccccgcggtgcactcacc

SEQ ID NO: 408053 - DNA, 20 bp, Artificial
  CRISPR gRNA sequence
ccccgcggtgcactcacctt

SEQ ID NO: 408054 - DNA, 20 bp, Artificial
  CRISPR gRNA sequence
accttggcagggacaaggct

SEQ ID NO: 408055 - DNA, 20 bp, Artificial
  CRISPR gRNA sequence
ggcagggacaaggctagttc

SEQ ID NO: 408056 - DNA, 20 bp, Artificial
  CRISPR gRNA sequence
gcagggacaaggctagttct

SEQ ID NO: 408057 - DNA, 20 bp, Artificial
  CRISPR gRNA sequence
gttctgggctctcctctctc

SEQ ID NO: 408058 - DNA, 20 bp, Artificial
  CRISPR gRNA sequence
tgggctctcctctctctcct

SEQ ID NO: 408059 - DNA, 20 bp, Artificial
  CRISPR gRNA sequence
ggctctcctctctctccttt

SEQ ID NO: 408060 - DNA, 20 bp, Artificial
  CRISPR gRNA sequence
tcctctctctcctttgccac

SEQ ID NO: 408061 - DNA, 20 bp, Artificial
  CRISPR gRNA sequence
ctctctctcctttgccacag

SEQ ID NO: 408062 - DNA, 20 bp, Artificial
  CRISPR gRNA sequence
tctctcctttgccacagcaa

SEQ ID NO: 408063 - DNA, 20 bp, Artificial
  CRISPR gRNA sequence
tctcctttgccacagcaagt

SEQ ID NO: 408064 - DNA, 20 bp, Artificial
  CRISPR gRNA sequence
tcctttgccacagcaagtct

SEQ ID NO: 408065 - DNA, 20 bp, Artificial
  CRISPR gRNA sequence
ctttgccacagcaagtctat

SEQ ID NO: 408066 - DNA, 20 bp, Artificial
  CRISPR gRNA sequence
tgccacagcaagtctattgc

SEQ ID NO: 408067 - DNA, 20 bp, Artificial
  CRISPR gRNA sequence
gccacagcaagtctattgct

SEQ ID NO: 408068 - DNA, 20 bp, Artificial
  CRISPR gRNA sequence
ccacagcaagtctattgctg

SEQ ID NO: 408069 - DNA, 20 bp, Artificial
  CRISPR gRNA sequence
ttgctggccactctcctgtg

SEQ ID NO: 408070 - DNA, 20 bp, Artificial
  CRISPR gRNA sequence
ctggccactctcctgtggga

SEQ ID NO: 408071 - DNA, 20 bp, Artificial
  CRISPR gRNA sequence
gccactctcctgtgggaaac

SEQ ID NO: 408072 - DNA, 20 bp, Artificial
  CRISPR gRNA sequence
tcctgtgggaaacatcttcc

SEQ ID NO: 408073 - DNA, 20 bp, Artificial
  CRISPR gRNA sequence
ctgtgggaaacatcttcctt

SEQ ID NO: 408074 - DNA, 20 bp, Artificial
  CRISPR gRNA sequence
tgggaaacatcttccttgct

SEQ ID NO: 408075 - DNA, 20 bp, Artificial
  CRISPR gRNA sequence
ccttgctttctacttggaaa

SEQ ID NO: 408076 - DNA, 20 bp, Artificial
  CRISPR gRNA sequence
cttgctttctacttggaaaa

SEQ ID NO: 408077 - DNA, 20 bp, Artificial
  CRISPR gRNA sequence
gctttctacttggaaaacaa

SEQ ID NO: 408078 - DNA, 20 bp, Artificial
  CRISPR gRNA sequence
ctttctacttggaaaacaat

SEQ ID NO: 408079 - DNA, 20 bp, Artificial
  CRISPR gRNA sequence
tctacttggaaaacaatcta

SEQ ID NO: 408080 - DNA, 20 bp, Artificial
  CRISPR gRNA sequence
ctacttggaaaacaatctaa

SEQ ID NO: 408081 - DNA, 20 bp, Artificial
  CRISPR gRNA sequence
tacttggaaaacaatctaat

SEQ ID NO: 408082 - DNA, 20 bp, Artificial
  CRISPR gRNA sequence
cttggaaaacaatctaatgg

SEQ ID NO: 408083 - DNA, 20 bp, Artificial
  CRISPR gRNA sequence
ggaaaacaatctaatggaca

SEQ ID NO: 408084 - DNA, 20 bp, Artificial
  CRISPR gRNA sequence
gaaaacaatctaatggacaa

SEQ ID NO: 408085 - DNA, 20 bp, Artificial
  CRISPR gRNA sequence
atggacaatttcacactaat

SEQ ID NO: 408086 - DNA, 20 bp, Artificial
  CRISPR gRNA sequence
cacactaatgtgttggtgcc

SEQ ID NO: 408087 - DNA, 20 bp, Artificial
  CRISPR gRNA sequence
acactaatgtgttggtgcct

SEQ ID NO: 408088 - DNA, 20 bp, Artificial
  CRISPR gRNA sequence
atgtgttggtgcctgccggg

SEQ ID NO: 408089 - DNA, 20 bp, Artificial
  CRISPR gRNA sequence
gtgcctgccgggaattgaaa

SEQ ID NO: 408090 - DNA, 20 bp, Artificial
  CRISPR gRNA sequence
ccgggaattgaaaattttat

SEQ ID NO: 408091 - DNA, 20 bp, Artificial
  CRISPR gRNA sequence
aaaattttatatgcatttta

SEQ ID NO: 408092 - DNA, 20 bp, Artificial
  CRISPR gRNA sequence
tatatgcattttaacaagga

SEQ ID NO: 408093 - DNA, 20 bp, Artificial
  CRISPR gRNA sequence
atatgcattttaacaaggac

SEQ ID NO: 408094 - DNA, 20 bp, Artificial
  CRISPR gRNA sequence
tatgcattttaacaaggaca

SEQ ID NO: 408095 - DNA, 20 bp, Artificial
  CRISPR gRNA sequence
taacaaggacaagtgcagaa

SEQ ID NO: 408096 - DNA, 20 bp, Artificial
  CRISPR gRNA sequence
aacaaggacaagtgcagaaa

SEQ ID NO: 408097 - DNA, 20 bp, Artificial
  CRISPR gRNA sequence
acaaggacaagtgcagaaat

SEQ ID NO: 408098 - DNA, 20 bp, Artificial
  CRISPR gRNA sequence
atttctaattataagagtta

SEQ ID NO: 408099 - DNA, 20 bp, Artificial
  CRISPR gRNA sequence
ctaattataagagttaaggc

SEQ ID NO: 408100 - DNA, 20 bp, Artificial
  CRISPR gRNA sequence
taattataagagttaaggca

SEQ ID NO: 408101 - DNA, 20 bp, Artificial
  CRISPR gRNA sequence
attataagagttaaggcatc

SEQ ID NO: 408102 - DNA, 20 bp, Artificial
  CRISPR gRNA sequence
taagagttaaggcatcagaa

SEQ ID NO: 408103 - DNA, 20 bp, Artificial
  CRISPR gRNA sequence
aggcatcagaaaataagcta

SEQ ID NO: 408104 - DNA, 20 bp, Artificial
  CRISPR gRNA sequence
tctaggagcagaggcatcct

SEQ ID NO: 408105 - DNA, 20 bp, Artificial
  CRISPR gRNA sequence
ggagcagaggcatccttgga

SEQ ID NO: 408106 - DNA, 20 bp, Artificial
  CRISPR gRNA sequence
ggagctgatgttgcctctga

SEQ ID NO: 408107 - DNA, 20 bp, Artificial
  CRISPR gRNA sequence
gagctgatgttgcctctgag

SEQ ID NO: 408108 - DNA, 20 bp, Artificial
  CRISPR gRNA sequence
atgttgcctctgagatcctg

SEQ ID NO: 408109 - DNA, 20 bp, Artificial
  CRISPR gRNA sequence
cctctgagatcctgccctgc

SEQ ID NO: 408110 - DNA, 20 bp, Artificial
  CRISPR gRNA sequence
tgagatcctgccctgctgca

SEQ ID NO: 408111 - DNA, 20 bp, Artificial
  CRISPR gRNA sequence
agatcctgccctgctgcagg

SEQ ID NO: 408112 - DNA, 20 bp, Artificial
  CRISPR gRNA sequence
ccctgctgcagggtggaaaa

SEQ ID NO: 408113 - DNA, 20 bp, Artificial
  CRISPR gRNA sequence
ctgcagggtggaaaagaaaa

SEQ ID NO: 408114 - DNA, 20 bp, Artificial
  CRISPR gRNA sequence
cagggtggaaaagaaaactc

SEQ ID NO: 408115 - DNA, 20 bp, Artificial
  CRISPR gRNA sequence
tggctgtcaccggagtccct

SEQ ID NO: 408116 - DNA, 20 bp, Artificial
  CRISPR gRNA sequence
gctgtcaccggagtcccttc

SEQ ID NO: 408117 - DNA, 20 bp, Artificial
  CRISPR gRNA sequence
tcaccggagtcccttctcag

SEQ ID NO: 408118 - DNA, 20 bp, Artificial
  CRISPR gRNA sequence
ctcagggctggtttgagact

SEQ ID NO: 408119 - DNA, 20 bp, Artificial
  CRISPR gRNA sequence
tcagggctggtttgagactg

SEQ ID NO: 408120 - DNA, 20 bp, Artificial
  CRISPR gRNA sequence
agggctggtttgagactggc

SEQ ID NO: 408121 - DNA, 20 bp, Artificial
  CRISPR gRNA sequence
gtttgagactggctccctag

SEQ ID NO: 408122 - DNA, 20 bp, Artificial
  CRISPR gRNA sequence
gagactggctccctagacgc

SEQ ID NO: 408123 - DNA, 20 bp, Artificial
  CRISPR gRNA sequence
agactggctccctagacgcc

SEQ ID NO: 408124 - DNA, 20 bp, Artificial
  CRISPR gRNA sequence
gctccctagacgccctgcct

SEQ ID NO: 408125 - DNA, 20 bp, Artificial
  CRISPR gRNA sequence
cctagacgccctgcctaggt

SEQ ID NO: 408126 - DNA, 20 bp, Artificial
  CRISPR gRNA sequence
gacgccctgcctaggtaaga

SEQ ID NO: 408127 - DNA, 20 bp, Artificial
  CRISPR gRNA sequence
cctaggtaagaatgtcctgc

SEQ ID NO: 408128 - DNA, 20 bp, Artificial
  CRISPR gRNA sequence
ggtaagaatgtcctgccatt

SEQ ID NO: 408129 - DNA, 20 bp, Artificial
  CRISPR gRNA sequence
ccattcacagctgggtgact

SEQ ID NO: 408130 - DNA, 20 bp, Artificial
  CRISPR gRNA sequence
acagctgggtgacttatttg

SEQ ID NO: 408131 - DNA, 20 bp, Artificial
  CRISPR gRNA sequence
ggtgacttatttgtggggac

SEQ ID NO: 408132 - DNA, 20 bp, Artificial
  CRISPR gRNA sequence
atttgtggggactaaatgca

SEQ ID NO: 408133 - DNA, 20 bp, Artificial
  CRISPR gRNA sequence
tttgtggggactaaatgcac

SEQ ID NO: 408134 - DNA, 20 bp, Artificial
  CRISPR gRNA sequence
gtggggactaaatgcactag

SEQ ID NO: 408135 - DNA, 20 bp, Artificial
  CRISPR gRNA sequence
tggggactaaatgcactagc

SEQ ID NO: 408136 - DNA, 20 bp, Artificial
  CRISPR gRNA sequence
aatgcactagcttaggtaat

SEQ ID NO: 408137 - DNA, 20 bp, Artificial
  CRISPR gRNA sequence
gcttaggtaatgcatttaat

SEQ ID NO: 408138 - DNA, 20 bp, Artificial
  CRISPR gRNA sequence
aggtaatgcatttaatgctg

SEQ ID NO: 408139 - DNA, 20 bp, Artificial
  CRISPR gRNA sequence
ggtaatgcatttaatgctgg

SEQ ID NO: 408140 - DNA, 20 bp, Artificial
  CRISPR gRNA sequence
aatgctggcacttagtaagg

SEQ ID NO: 408141 - DNA, 20 bp, Artificial
  CRISPR gRNA sequence
atgctggcacttagtaagga

SEQ ID NO: 408142 - DNA, 20 bp, Artificial
  CRISPR gRNA sequence
gcacttagtaaggactcgtt

SEQ ID NO: 408143 - DNA, 20 bp, Artificial
  CRISPR gRNA sequence
agtaaggactcgttcaaggc

SEQ ID NO: 408144 - DNA, 20 bp, Artificial
  CRISPR gRNA sequence
gtaaggactcgttcaaggct

SEQ ID NO: 408145 - DNA, 20 bp, Artificial
  CRISPR gRNA sequence
gttcaaggcttattatttta

SEQ ID NO: 408146 - DNA, 20 bp, Artificial
  CRISPR gRNA sequence
aaggcttattattttacttt

SEQ ID NO: 408147 - DNA, 20 bp, Artificial
  CRISPR gRNA sequence
attattttactttaaaaata

SEQ ID NO: 408148 - DNA, 20 bp, Artificial
  CRISPR gRNA sequence
ttattttactttaaaaatat

SEQ ID NO: 408149 - DNA, 20 bp, Artificial
  CRISPR gRNA sequence
ttttactttaaaaatatact

SEQ ID NO: 408150 - DNA, 20 bp, Artificial
  CRISPR gRNA sequence
tactttaaaaatatactgaa

SEQ ID NO: 408151 - DNA, 20 bp, Artificial
  CRISPR gRNA sequence
actttaaaaatatactgaaa

SEQ ID NO: 408152 - DNA, 20 bp, Artificial
  CRISPR gRNA sequence
ctttaaaaatatactgaaaa

SEQ ID NO: 408153 - DNA, 20 bp, Artificial
  CRISPR gRNA sequence
taaaaatatactgaaaatat

SEQ ID NO: 408154 - DNA, 20 bp, Artificial
  CRISPR gRNA sequence
aaaaatatactgaaaatatt

SEQ ID NO: 408155 - DNA, 20 bp, Artificial
  CRISPR gRNA sequence
aaaatatactgaaaatattt

SEQ ID NO: 408156 - DNA, 20 bp, Artificial
  CRISPR gRNA sequence
aaaatatttttaagtatatg

SEQ ID NO: 408157 - DNA, 20 bp, Artificial
  CRISPR gRNA sequence
ttaagtatatgggacaaaat

SEQ ID NO: 408158 - DNA, 20 bp, Artificial
  CRISPR gRNA sequence
taagtatatgggacaaaatg

SEQ ID NO: 408159 - DNA, 20 bp, Artificial
  CRISPR gRNA sequence
aagtatatgggacaaaatgc

SEQ ID NO: 408160 - DNA, 20 bp, Artificial
  CRISPR gRNA sequence
agtatatgggacaaaatgct

SEQ ID NO: 408161 - DNA, 20 bp, Artificial
  CRISPR gRNA sequence
aatgtagtctccagggacca

SEQ ID NO: 408162 - DNA, 20 bp, Artificial
  CRISPR gRNA sequence
atgtagtctccagggaccat

SEQ ID NO: 408163 - DNA, 20 bp, Artificial
  CRISPR gRNA sequence
cagggaccatcactaacaat

SEQ ID NO: 408164 - DNA, 20 bp, Artificial
  CRISPR gRNA sequence
acaatctattctctagtaca

SEQ ID NO: 408165 - DNA, 20 bp, Artificial
  CRISPR gRNA sequence
ttctctagtacagaatcatt

SEQ ID NO: 408166 - DNA, 20 bp, Artificial
  CRISPR gRNA sequence
tctagtacagaatcattaga

SEQ ID NO: 408167 - DNA, 20 bp, Artificial
  CRISPR gRNA sequence
tagtacagaatcattagaga

SEQ ID NO: 408168 - DNA, 20 bp, Artificial
  CRISPR gRNA sequence
gtacagaatcattagagatg

SEQ ID NO: 408169 - DNA, 20 bp, Artificial
  CRISPR gRNA sequence
gagatggtgttaatctcttg

SEQ ID NO: 408170 - DNA, 20 bp, Artificial
  CRISPR gRNA sequence
atctcttgatgtctttttct

SEQ ID NO: 408171 - DNA, 20 bp, Artificial
  CRISPR gRNA sequence
ttgatgtctttttctgttaa

SEQ ID NO: 408172 - DNA, 20 bp, Artificial
  CRISPR gRNA sequence
gatgtctttttctgttaaaa

SEQ ID NO: 408173 - DNA, 20 bp, Artificial
  CRISPR gRNA sequence
atgtctttttctgttaaaaa

SEQ ID NO: 408174 - DNA, 20 bp, Artificial
  CRISPR gRNA sequence
tttctgttaaaaacctgcca

SEQ ID NO: 408175 - DNA, 20 bp, Artificial
  CRISPR gRNA sequence
ttctgttaaaaacctgccat

SEQ ID NO: 408176 - DNA, 20 bp, Artificial
  CRISPR gRNA sequence
tctgttaaaaacctgccatg

SEQ ID NO: 408177 - DNA, 20 bp, Artificial
  CRISPR gRNA sequence
ctgttaaaaacctgccatgc

SEQ ID NO: 408178 - DNA, 20 bp, Artificial
  CRISPR gRNA sequence
tgttaaaaacctgccatgca

SEQ ID NO: 408179 - DNA, 20 bp, Artificial
  CRISPR gRNA sequence
ttaaaaacctgccatgcaga

SEQ ID NO: 408180 - DNA, 20 bp, Artificial
  CRISPR gRNA sequence
aaaacctgccatgcagaaag

SEQ ID NO: 408181 - DNA, 20 bp, Artificial
  CRISPR gRNA sequence
ccatgcagaaagtctacatt

SEQ ID NO: 408182 - DNA, 20 bp, Artificial
  CRISPR gRNA sequence
cattaaattgtctaacctgg

SEQ ID NO: 408183 - DNA, 20 bp, Artificial
  CRISPR gRNA sequence
aattgtctaacctggggggc

SEQ ID NO: 408184 - DNA, 20 bp, Artificial
  CRISPR gRNA sequence
tctaacctggggggccaatt

SEQ ID NO: 408185 - DNA, 20 bp, Artificial
  CRISPR gRNA sequence
acctggggggccaattggta

SEQ ID NO: 408186 - DNA, 20 bp, Artificial
  CRISPR gRNA sequence
gggggccaattggtaacatt

SEQ ID NO: 408187 - DNA, 20 bp, Artificial
  CRISPR gRNA sequence
gtaacattttagtagaagaa

SEQ ID NO: 408188 - DNA, 20 bp, Artificial
  CRISPR gRNA sequence
tagtagaagaaacagaccaa

SEQ ID NO: 408189 - DNA, 20 bp, Artificial
  CRISPR gRNA sequence
agtagaagaaacagaccaat

SEQ ID NO: 408190 - DNA, 20 bp, Artificial
  CRISPR gRNA sequence
gtagaagaaacagaccaatg

SEQ ID NO: 408191 - DNA, 20 bp, Artificial
  CRISPR gRNA sequence
ttgggcattttattttttgg

SEQ ID NO: 408192 - DNA, 20 bp, Artificial
  CRISPR gRNA sequence
gggcattttattttttggtt

SEQ ID NO: 408193 - DNA, 20 bp, Artificial
  CRISPR gRNA sequence
ggcattttattttttggttt

SEQ ID NO: 408194 - DNA, 20 bp, Artificial
  CRISPR gRNA sequence
tattttttggttttatgaga

SEQ ID NO: 408195 - DNA, 20 bp, Artificial
  CRISPR gRNA sequence
attttttggttttatgagac

SEQ ID NO: 408196 - DNA, 20 bp, Artificial
  CRISPR gRNA sequence
ttttttggttttatgagacc

SEQ ID NO: 408197 - DNA, 20 bp, Artificial
  CRISPR gRNA sequence
tttggttttatgagacctca

SEQ ID NO: 408198 - DNA, 20 bp, Artificial
  CRISPR gRNA sequence
ttggttttatgagacctcag

SEQ ID NO: 408199 - DNA, 20 bp, Artificial
  CRISPR gRNA sequence
tggttttatgagacctcaga

SEQ ID NO: 408200 - DNA, 20 bp, Artificial
  CRISPR gRNA sequence
ggttttatgagacctcagag

SEQ ID NO: 408201 - DNA, 20 bp, Artificial
  CRISPR gRNA sequence
gttttatgagacctcagaga

SEQ ID NO: 408202 - DNA, 20 bp, Artificial
  CRISPR gRNA sequence
tatgagacctcagagatgta

SEQ ID NO: 408203 - DNA, 20 bp, Artificial
  CRISPR gRNA sequence
atgagacctcagagatgtac

SEQ ID NO: 408204 - DNA, 20 bp, Artificial
  CRISPR gRNA sequence
tgagacctcagagatgtact

SEQ ID NO: 408205 - DNA, 20 bp, Artificial
  CRISPR gRNA sequence
agagatgtactacctatatt

SEQ ID NO: 408206 - DNA, 20 bp, Artificial
  CRISPR gRNA sequence
cctatatttaaaattcttat

SEQ ID NO: 408207 - DNA, 20 bp, Artificial
  CRISPR gRNA sequence
tatttaaaattcttatatcc

SEQ ID NO: 408208 - DNA, 20 bp, Artificial
  CRISPR gRNA sequence
aaaattcttatatcccatta

SEQ ID NO: 408209 - DNA, 20 bp, Artificial
  CRISPR gRNA sequence
aaattcttatatcccattag

SEQ ID NO: 408210 - DNA, 20 bp, Artificial
  CRISPR gRNA sequence
ttatatcccattagtcagta

SEQ ID NO: 408211 - DNA, 20 bp, Artificial
  CRISPR gRNA sequence
atatcccattagtcagtaat

SEQ ID NO: 408212 - DNA, 20 bp, Artificial
  CRISPR gRNA sequence
tatcccattagtcagtaatt

SEQ ID NO: 408213 - DNA, 20 bp, Artificial
  CRISPR gRNA sequence
gtcagtaatttttctggttg

SEQ ID NO: 408214 - DNA, 20 bp, Artificial
  CRISPR gRNA sequence
ttctggttgagagaaactgc

SEQ ID NO: 408215 - DNA, 20 bp, Artificial
  CRISPR gRNA sequence
tctggttgagagaaactgca

SEQ ID NO: 408216 - DNA, 20 bp, Artificial
  CRISPR gRNA sequence
ctggttgagagaaactgcag

SEQ ID NO: 408217 - DNA, 20 bp, Artificial
  CRISPR gRNA sequence
tggttgagagaaactgcaga

SEQ ID NO: 408218 - DNA, 20 bp, Artificial
  CRISPR gRNA sequence
gttgagagaaactgcagaat

SEQ ID NO: 408219 - DNA, 20 bp, Artificial
  CRISPR gRNA sequence
agagaaactgcagaatggct

SEQ ID NO: 408220 - DNA, 20 bp, Artificial
  CRISPR gRNA sequence
cagaatggctcaaaagtttg

SEQ ID NO: 408221 - DNA, 20 bp, Artificial
  CRISPR gRNA sequence
aaaagtttgacttttccatg

SEQ ID NO: 408222 - DNA, 20 bp, Artificial
  CRISPR gRNA sequence
gacttttccatgtgattcag

SEQ ID NO: 408223 - DNA, 20 bp, Artificial
  CRISPR gRNA sequence
acttttccatgtgattcagc

SEQ ID NO: 408224 - DNA, 20 bp, Artificial
  CRISPR gRNA sequence
ttccatgtgattcagcaaat

SEQ ID NO: 408225 - DNA, 20 bp, Artificial
  CRISPR gRNA sequence
tccatgtgattcagcaaatc

SEQ ID NO: 408226 - DNA, 20 bp, Artificial
  CRISPR gRNA sequence
ccatgtgattcagcaaatct

SEQ ID NO: 408227 - DNA, 20 bp, Artificial
  CRISPR gRNA sequence
catgtgattcagcaaatctt

SEQ ID NO: 408228 - DNA, 20 bp, Artificial
  CRISPR gRNA sequence
agcaaatcttatgatactga

SEQ ID NO: 408229 - DNA, 20 bp, Artificial
  CRISPR gRNA sequence
atgatactgactataataaa

SEQ ID NO: 408230 - DNA, 20 bp, Artificial
  CRISPR gRNA sequence
tgatactgactataataaaa

SEQ ID NO: 408231 - DNA, 20 bp, Artificial
  CRISPR gRNA sequence
actataataaaaacatcatt

SEQ ID NO: 408232 - DNA, 20 bp, Artificial
  CRISPR gRNA sequence
taataaaaacatcattctca

SEQ ID NO: 408233 - DNA, 20 bp, Artificial
  CRISPR gRNA sequence
tcattgtaccatggtggaga

SEQ ID NO: 408234 - DNA, 20 bp, Artificial
  CRISPR gRNA sequence
attgtaccatggtggagaga

SEQ ID NO: 408235 - DNA, 20 bp, Artificial
  CRISPR gRNA sequence
taccatggtggagagattga

SEQ ID NO: 408236 - DNA, 20 bp, Artificial
  CRISPR gRNA sequence
aaagttattttttttaacaa

SEQ ID NO: 408237 - DNA, 20 bp, Artificial
  CRISPR gRNA sequence
ttttttttaacaattagaac

SEQ ID NO: 408238 - DNA, 20 bp, Artificial
  CRISPR gRNA sequence
tttttaacaattagaacctg

SEQ ID NO: 408239 - DNA, 20 bp, Artificial
  CRISPR gRNA sequence
ttttaacaattagaacctga

SEQ ID NO: 408240 - DNA, 20 bp, Artificial
  CRISPR gRNA sequence
tttaacaattagaacctgaa

SEQ ID NO: 408241 - DNA, 20 bp, Artificial
  CRISPR gRNA sequence
ttaacaattagaacctgaac

SEQ ID NO: 408242 - DNA, 20 bp, Artificial
  CRISPR gRNA sequence
taacaattagaacctgaaca

SEQ ID NO: 408243 - DNA, 20 bp, Artificial
  CRISPR gRNA sequence
aacaattagaacctgaacaa

SEQ ID NO: 408244 - DNA, 20 bp, Artificial
  CRISPR gRNA sequence
acaattagaacctgaacaaa

SEQ ID NO: 408245 - DNA, 20 bp, Artificial
  CRISPR gRNA sequence
gaacctgaacaaacattaca

SEQ ID NO: 408246 - DNA, 20 bp, Artificial
  CRISPR gRNA sequence
aacaaacattacaccaaggg

SEQ ID NO: 408247 - DNA, 20 bp, Artificial
  CRISPR gRNA sequence
caccaaggggacccacggtt

SEQ ID NO: 408248 - DNA, 20 bp, Artificial
  CRISPR gRNA sequence
cctttcaggagccaatctca

SEQ ID NO: 408249 - DNA, 20 bp, Artificial
  CRISPR gRNA sequence
tcaggagccaatctcaagat

SEQ ID NO: 408250 - DNA, 20 bp, Artificial
  CRISPR gRNA sequence
caggagccaatctcaagatt

SEQ ID NO: 408251 - DNA, 20 bp, Artificial
  CRISPR gRNA sequence
aggagccaatctcaagattc

SEQ ID NO: 408252 - DNA, 20 bp, Artificial
  CRISPR gRNA sequence
aagattctggagctccacgg

SEQ ID NO: 408253 - DNA, 20 bp, Artificial
  CRISPR gRNA sequence
tggagctccacggagctgcc

SEQ ID NO: 408254 - DNA, 20 bp, Artificial
  CRISPR gRNA sequence
gagctccacggagctgcccc

SEQ ID NO: 408255 - DNA, 20 bp, Artificial
  CRISPR gRNA sequence
cacggagctgcccctggagg

SEQ ID NO: 408256 - DNA, 20 bp, Artificial
  CRISPR gRNA sequence
cccctggaggcagcctgggc

SEQ ID NO: 408257 - DNA, 20 bp, Artificial
  CRISPR gRNA sequence
gaggcagcctgggctctgaa

SEQ ID NO: 408258 - DNA, 20 bp, Artificial
  CRISPR gRNA sequence
ggctctgaagctggggaggc

SEQ ID NO: 408259 - DNA, 20 bp, Artificial
  CRISPR gRNA sequence
tgaagctggggaggccggtg

SEQ ID NO: 408260 - DNA, 20 bp, Artificial
  CRISPR gRNA sequence
aagctggggaggccggtggt

SEQ ID NO: 408261 - DNA, 20 bp, Artificial
  CRISPR gRNA sequence
gggaggccggtggtctcagc

SEQ ID NO: 408262 - DNA, 20 bp, Artificial
  CRISPR gRNA sequence
agcagttgctttgactcctg

SEQ ID NO: 408263 - DNA, 20 bp, Artificial
  CRISPR gRNA sequence
ctttgactcctgggtaatct

SEQ ID NO: 408264 - DNA, 20 bp, Artificial
  CRISPR gRNA sequence
tgactcctgggtaatctgaa

SEQ ID NO: 408265 - DNA, 20 bp, Artificial
  CRISPR gRNA sequence
gactcctgggtaatctgaat

SEQ ID NO: 408266 - DNA, 20 bp, Artificial
  CRISPR gRNA sequence
actcctgggtaatctgaatc

SEQ ID NO: 408267 - DNA, 20 bp, Artificial
  CRISPR gRNA sequence
ctgggtaatctgaatcacaa

SEQ ID NO: 408268 - DNA, 20 bp, Artificial
  CRISPR gRNA sequence
ggtaatctgaatcacaaagc

SEQ ID NO: 408269 - DNA, 20 bp, Artificial
  CRISPR gRNA sequence
aatcacaaagctgccggggc

SEQ ID NO: 408270 - DNA, 20 bp, Artificial
  CRISPR gRNA sequence
ccggggcctgcattgcaagt

SEQ ID NO: 408271 - DNA, 20 bp, Artificial
  CRISPR gRNA sequence
cattgcaagtcctttgctgt

SEQ ID NO: 408272 - DNA, 20 bp, Artificial
  CRISPR gRNA sequence
caagtcctttgctgttcagt

SEQ ID NO: 408273 - DNA, 20 bp, Artificial
  CRISPR gRNA sequence
tgctgttcagtgcttagaca

SEQ ID NO: 408274 - DNA, 20 bp, Artificial
  CRISPR gRNA sequence
gctgttcagtgcttagacag

SEQ ID NO: 408275 - DNA, 20 bp, Artificial
  CRISPR gRNA sequence
ctgttcagtgcttagacagg

SEQ ID NO: 408276 - DNA, 20 bp, Artificial
  CRISPR gRNA sequence
ttcagtgcttagacagggga

SEQ ID NO: 408277 - DNA, 20 bp, Artificial
  CRISPR gRNA sequence
agtgcttagacaggggaatc

SEQ ID NO: 408278 - DNA, 20 bp, Artificial
  CRISPR gRNA sequence
agacaggggaatcgctcttt

SEQ ID NO: 408279 - DNA, 20 bp, Artificial
  CRISPR gRNA sequence
gacaggggaatcgctctttg

SEQ ID NO: 408280 - DNA, 20 bp, Artificial
  CRISPR gRNA sequence
tttggacatactgcaaatca

SEQ ID NO: 408281 - DNA, 20 bp, Artificial
  CRISPR gRNA sequence
tggacatactgcaaatcatc

SEQ ID NO: 408282 - DNA, 20 bp, Artificial
  CRISPR gRNA sequence
ggacatactgcaaatcatct

SEQ ID NO: 408283 - DNA, 20 bp, Artificial
  CRISPR gRNA sequence
gacatactgcaaatcatctc

SEQ ID NO: 408284 - DNA, 20 bp, Artificial
  CRISPR gRNA sequence
caaatcatctcttaatatgg

SEQ ID NO: 408285 - DNA, 20 bp, Artificial
  CRISPR gRNA sequence
ttaatatggattttctgggc

SEQ ID NO: 408286 - DNA, 20 bp, Artificial
  CRISPR gRNA sequence
aatatggattttctgggctg

SEQ ID NO: 408287 - DNA, 20 bp, Artificial
  CRISPR gRNA sequence
atatggattttctgggctga

SEQ ID NO: 408288 - DNA, 20 bp, Artificial
  CRISPR gRNA sequence
tctgggctgaatcctgattt

SEQ ID NO: 408289 - DNA, 20 bp, Artificial
  CRISPR gRNA sequence
ctgggctgaatcctgatttg

SEQ ID NO: 408290 - DNA, 20 bp, Artificial
  CRISPR gRNA sequence
tgggctgaatcctgatttgc

SEQ ID NO: 408291 - DNA, 20 bp, Artificial
  CRISPR gRNA sequence
ggctgaatcctgatttgcca

SEQ ID NO: 408292 - DNA, 20 bp, Artificial
  CRISPR gRNA sequence
aatcctgatttgccatgcag

SEQ ID NO: 408293 - DNA, 20 bp, Artificial
  CRISPR gRNA sequence
atttgccatgcaggacacgc

SEQ ID NO: 408294 - DNA, 20 bp, Artificial
  CRISPR gRNA sequence
gccatgcaggacacgcagcc

SEQ ID NO: 408295 - DNA, 20 bp, Artificial
  CRISPR gRNA sequence
ccatgcaggacacgcagcct

SEQ ID NO: 408296 - DNA, 20 bp, Artificial
  CRISPR gRNA sequence
aatctagtcccttcattttt

SEQ ID NO: 408297 - DNA, 20 bp, Artificial
  CRISPR gRNA sequence
gtcccttcatttttttattt

SEQ ID NO: 408298 - DNA, 20 bp, Artificial
  CRISPR gRNA sequence
catttttttatttccacaaa

SEQ ID NO: 408299 - DNA, 20 bp, Artificial
  CRISPR gRNA sequence
atttttttatttccacaaat

SEQ ID NO: 408300 - DNA, 20 bp, Artificial
  CRISPR gRNA sequence
ttttatttccacaaatggcc

SEQ ID NO: 408301 - DNA, 20 bp, Artificial
  CRISPR gRNA sequence
tttatttccacaaatggcct

SEQ ID NO: 408302 - DNA, 20 bp, Artificial
  CRISPR gRNA sequence
ttatttccacaaatggcctt

SEQ ID NO: 408303 - DNA, 20 bp, Artificial
  CRISPR gRNA sequence
tatttccacaaatggccttg

SEQ ID NO: 408304 - DNA, 20 bp, Artificial
  CRISPR gRNA sequence
atttccacaaatggccttgc

SEQ ID NO: 408305 - DNA, 20 bp, Artificial
  CRISPR gRNA sequence
tttccacaaatggccttgcc

SEQ ID NO: 408306 - DNA, 20 bp, Artificial
  CRISPR gRNA sequence
ccacaaatggccttgcctgg

SEQ ID NO: 408307 - DNA, 20 bp, Artificial
  CRISPR gRNA sequence
cacaaatggccttgcctggc

SEQ ID NO: 408308 - DNA, 20 bp, Artificial
  CRISPR gRNA sequence
gcctggctttccttcatgat

SEQ ID NO: 408309 - DNA, 20 bp, Artificial
  CRISPR gRNA sequence
cctggctttccttcatgatg

SEQ ID NO: 408310 - DNA, 20 bp, Artificial
  CRISPR gRNA sequence
gctttccttcatgatggctt

SEQ ID NO: 408311 - DNA, 20 bp, Artificial
  CRISPR gRNA sequence
tccttcatgatggctttgtc

SEQ ID NO: 408312 - DNA, 20 bp, Artificial
  CRISPR gRNA sequence
ccttcatgatggctttgtcg

SEQ ID NO: 408313 - DNA, 20 bp, Artificial
  CRISPR gRNA sequence
cttcatgatggctttgtcgg

SEQ ID NO: 408314 - DNA, 20 bp, Artificial
  CRISPR gRNA sequence
catgatggctttgtcgggtt

SEQ ID NO: 408315 - DNA, 20 bp, Artificial
  CRISPR gRNA sequence
atgatggctttgtcgggttg

SEQ ID NO: 408316 - DNA, 20 bp, Artificial
  CRISPR gRNA sequence
tgtcgggttgtgtttttatc

SEQ ID NO: 408317 - DNA, 20 bp, Artificial
  CRISPR gRNA sequence
gtcgggttgtgtttttatct

SEQ ID NO: 408318 - DNA, 20 bp, Artificial
  CRISPR gRNA sequence
tcgggttgtgtttttatctc

SEQ ID NO: 408319 - DNA, 20 bp, Artificial
  CRISPR gRNA sequence
tgtttttatctctttattgt

SEQ ID NO: 408320 - DNA, 20 bp, Artificial
  CRISPR gRNA sequence
ttatctctttattgtaactc

SEQ ID NO: 408321 - DNA, 20 bp, Artificial
  CRISPR gRNA sequence
tatctctttattgtaactca

SEQ ID NO: 408322 - DNA, 20 bp, Artificial
  CRISPR gRNA sequence
atctctttattgtaactcac

SEQ ID NO: 408323 - DNA, 20 bp, Artificial
  CRISPR gRNA sequence
tctctttattgtaactcact

SEQ ID NO: 408324 - DNA, 20 bp, Artificial
  CRISPR gRNA sequence
tttattgtaactcactcttc

SEQ ID NO: 408325 - DNA, 20 bp, Artificial
  CRISPR gRNA sequence
tattgtaactcactcttccc

SEQ ID NO: 408326 - DNA, 20 bp, Artificial
  CRISPR gRNA sequence
attgtaactcactcttccca

SEQ ID NO: 408327 - DNA, 20 bp, Artificial
  CRISPR gRNA sequence
ttgtaactcactcttcccac

SEQ ID NO: 408328 - DNA, 20 bp, Artificial
  CRISPR gRNA sequence
taactcactcttcccacttt

SEQ ID NO: 408329 - DNA, 20 bp, Artificial
  CRISPR gRNA sequence
actcttcccactttatctgt

SEQ ID NO: 408330 - DNA, 20 bp, Artificial
  CRISPR gRNA sequence
ttcccactttatctgtgcct

SEQ ID NO: 408331 - DNA, 20 bp, Artificial
  CRISPR gRNA sequence
cccactttatctgtgccttt

SEQ ID NO: 408332 - DNA, 20 bp, Artificial
  CRISPR gRNA sequence
ccactttatctgtgcctttc

SEQ ID NO: 408333 - DNA, 20 bp, Artificial
  CRISPR gRNA sequence
tatctgtgcctttcagttaa

SEQ ID NO: 408334 - DNA, 20 bp, Artificial
  CRISPR gRNA sequence
atctgtgcctttcagttaag

SEQ ID NO: 408335 - DNA, 20 bp, Artificial
  CRISPR gRNA sequence
tctgtgcctttcagttaagc

SEQ ID NO: 408336 - DNA, 20 bp, Artificial
  CRISPR gRNA sequence
tgcctttcagttaagcggtc

SEQ ID NO: 408337 - DNA, 20 bp, Artificial
  CRISPR gRNA sequence
tcagttaagcggtcttttag

SEQ ID NO: 408338 - DNA, 20 bp, Artificial
  CRISPR gRNA sequence
cagttaagcggtcttttagc

SEQ ID NO: 408339 - DNA, 20 bp, Artificial
  CRISPR gRNA sequence
agttaagcggtcttttagct

SEQ ID NO: 408340 - DNA, 20 bp, Artificial
  CRISPR gRNA sequence
agcggtcttttagcttattt

SEQ ID NO: 408341 - DNA, 20 bp, Artificial
  CRISPR gRNA sequence
ttagcttattttttatcttg

SEQ ID NO: 408342 - DNA, 20 bp, Artificial
  CRISPR gRNA sequence
tagcttattttttatcttgt

SEQ ID NO: 408343 - DNA, 20 bp, Artificial
  CRISPR gRNA sequence
agcttattttttatcttgtt

SEQ ID NO: 408344 - DNA, 20 bp, Artificial
  CRISPR gRNA sequence
gcttattttttatcttgttt

SEQ ID NO: 408345 - DNA, 20 bp, Artificial
  CRISPR gRNA sequence
attttttatcttgtttggtc

SEQ ID NO: 408346 - DNA, 20 bp, Artificial
  CRISPR gRNA sequence
ttttttatcttgtttggtcc

SEQ ID NO: 408347 - DNA, 20 bp, Artificial
  CRISPR gRNA sequence
tttatcttgtttggtccttt

SEQ ID NO: 408348 - DNA, 20 bp, Artificial
  CRISPR gRNA sequence
ttatcttgtttggtccttta

SEQ ID NO: 408349 - DNA, 20 bp, Artificial
  CRISPR gRNA sequence
tatcttgtttggtcctttac

SEQ ID NO: 408350 - DNA, 20 bp, Artificial
  CRISPR gRNA sequence
atcttgtttggtcctttacc

SEQ ID NO: 408351 - DNA, 20 bp, Artificial
  CRISPR gRNA sequence
tcttgtttggtcctttacct

SEQ ID NO: 408352 - DNA, 20 bp, Artificial
  CRISPR gRNA sequence
gtttggtcctttacctttta

SEQ ID NO: 408353 - DNA, 20 bp, Artificial
  CRISPR gRNA sequence
tttggtcctttaccttttat

SEQ ID NO: 408354 - DNA, 20 bp, Artificial
  CRISPR gRNA sequence
ggtcctttaccttttatctg

SEQ ID NO: 408355 - DNA, 20 bp, Artificial
  CRISPR gRNA sequence
gtcctttaccttttatctgc

SEQ ID NO: 408356 - DNA, 20 bp, Artificial
  CRISPR gRNA sequence
taccttttatctgcacttta

SEQ ID NO: 408357 - DNA, 20 bp, Artificial
  CRISPR gRNA sequence
accttttatctgcactttag

SEQ ID NO: 408358 - DNA, 20 bp, Artificial
  CRISPR gRNA sequence
ccttttatctgcactttaga

SEQ ID NO: 408359 - DNA, 20 bp, Artificial
  CRISPR gRNA sequence
ttatctgcactttagatgaa

SEQ ID NO: 408360 - DNA, 20 bp, Artificial
  CRISPR gRNA sequence
tatctgcactttagatgaaa

SEQ ID NO: 408361 - DNA, 20 bp, Artificial
  CRISPR gRNA sequence
atctgcactttagatgaaag

SEQ ID NO: 408362 - DNA, 20 bp, Artificial
  CRISPR gRNA sequence
tctgcactttagatgaaaga

SEQ ID NO: 408363 - DNA, 20 bp, Artificial
  CRISPR gRNA sequence
cactttagatgaaagacaga

SEQ ID NO: 408364 - DNA, 20 bp, Artificial
  CRISPR gRNA sequence
tagatgaaagacagaaaatg

SEQ ID NO: 408365 - DNA, 20 bp, Artificial
  CRISPR gRNA sequence
agatgaaagacagaaaatgg

SEQ ID NO: 408366 - DNA, 20 bp, Artificial
  CRISPR gRNA sequence
gatgaaagacagaaaatggc

SEQ ID NO: 408367 - DNA, 20 bp, Artificial
  CRISPR gRNA sequence
tgaagacggccgattttctc

SEQ ID NO: 408368 - DNA, 20 bp, Artificial
  CRISPR gRNA sequence
tctcagcaggatggacttgc

SEQ ID NO: 408369 - DNA, 20 bp, Artificial
  CRISPR gRNA sequence
ctcagcaggatggacttgct

SEQ ID NO: 408370 - DNA, 20 bp, Artificial
  CRISPR gRNA sequence
tcagcaggatggacttgctg

SEQ ID NO: 408371 - DNA, 20 bp, Artificial
  CRISPR gRNA sequence
agcaggatggacttgctgct

SEQ ID NO: 408372 - DNA, 20 bp, Artificial
  CRISPR gRNA sequence
gctgcttctgatgggtgctg

SEQ ID NO: 408373 - DNA, 20 bp, Artificial
  CRISPR gRNA sequence
ctgcttctgatgggtgctgg

SEQ ID NO: 408374 - DNA, 20 bp, Artificial
  CRISPR gRNA sequence
cttctgatgggtgctggcga

SEQ ID NO: 408375 - DNA, 20 bp, Artificial
  CRISPR gRNA sequence
ctgatgggtgctggcgaggc

SEQ ID NO: 408376 - DNA, 20 bp, Artificial
  CRISPR gRNA sequence
tgatgggtgctggcgaggcc

SEQ ID NO: 408377 - DNA, 20 bp, Artificial
  CRISPR gRNA sequence
atgggtgctggcgaggccca

SEQ ID NO: 408378 - DNA, 20 bp, Artificial
  CRISPR gRNA sequence
gcgaggcccagactgtaccc

SEQ ID NO: 408379 - DNA, 20 bp, Artificial
  CRISPR gRNA sequence
tacccaagatgtcgtcctga

SEQ ID NO: 408380 - DNA, 20 bp, Artificial
  CRISPR gRNA sequence
atggtccttactccctatta

SEQ ID NO: 408381 - DNA, 20 bp, Artificial
  CRISPR gRNA sequence
actccctattagtgtcctag

SEQ ID NO: 408382 - DNA, 20 bp, Artificial
  CRISPR gRNA sequence
ctccctattagtgtcctaga

SEQ ID NO: 408383 - DNA, 20 bp, Artificial
  CRISPR gRNA sequence
cctattagtgtcctagagct

SEQ ID NO: 408384 - DNA, 20 bp, Artificial
  CRISPR gRNA sequence
ttagtgtcctagagctgctg

SEQ ID NO: 408385 - DNA, 20 bp, Artificial
  CRISPR gRNA sequence
gtgtcctagagctgctggca

SEQ ID NO: 408386 - DNA, 20 bp, Artificial
  CRISPR gRNA sequence
gagctgctggcacatgatac

SEQ ID NO: 408387 - DNA, 20 bp, Artificial
  CRISPR gRNA sequence
ctggcacatgataccaaaag

SEQ ID NO: 408388 - DNA, 20 bp, Artificial
  CRISPR gRNA sequence
gcacatgataccaaaagctg

SEQ ID NO: 408389 - DNA, 20 bp, Artificial
  CRISPR gRNA sequence
ggtaacttaacagaaatgtg

SEQ ID NO: 408390 - DNA, 20 bp, Artificial
  CRISPR gRNA sequence
aacagaaatgtgttgtcttg

SEQ ID NO: 408391 - DNA, 20 bp, Artificial
  CRISPR gRNA sequence
acagaaatgtgttgtcttgc

SEQ ID NO: 408392 - DNA, 20 bp, Artificial
  CRISPR gRNA sequence
tcttgcagtttgaagtccaa

SEQ ID NO: 408393 - DNA, 20 bp, Artificial
  CRISPR gRNA sequence
gcagtttgaagtccaaagtg

SEQ ID NO: 408394 - DNA, 20 bp, Artificial
  CRISPR gRNA sequence
cagtttgaagtccaaagtga

SEQ ID NO: 408395 - DNA, 20 bp, Artificial
  CRISPR gRNA sequence
gaagtccaaagtgaaggtat

SEQ ID NO: 408396 - DNA, 20 bp, Artificial
  CRISPR gRNA sequence
aagtccaaagtgaaggtatc

SEQ ID NO: 408397 - DNA, 20 bp, Artificial
  CRISPR gRNA sequence
gttccctctgggggttgcaa

SEQ ID NO: 408398 - DNA, 20 bp, Artificial
  CRISPR gRNA sequence
cctctgggggttgcaaggag

SEQ ID NO: 408399 - DNA, 20 bp, Artificial
  CRISPR gRNA sequence
tgggggttgcaaggagaggt

SEQ ID NO: 408400 - DNA, 20 bp, Artificial
  CRISPR gRNA sequence
ggggttgcaaggagaggtct

SEQ ID NO: 408401 - DNA, 20 bp, Artificial
  CRISPR gRNA sequence
caaggagaggtctcacctag

SEQ ID NO: 408402 - DNA, 20 bp, Artificial
  CRISPR gRNA sequence
acctagcttctggcaatttc

SEQ ID NO: 408403 - DNA, 20 bp, Artificial
  CRISPR gRNA sequence
gcttctggcaatttctggca

SEQ ID NO: 408404 - DNA, 20 bp, Artificial
  CRISPR gRNA sequence
ctggcaatttctggcaatct

SEQ ID NO: 408405 - DNA, 20 bp, Artificial
  CRISPR gRNA sequence
tggcaatttctggcaatctt

SEQ ID NO: 408406 - DNA, 20 bp, Artificial
  CRISPR gRNA sequence
gcaatttctggcaatctttg

SEQ ID NO: 408407 - DNA, 20 bp, Artificial
  CRISPR gRNA sequence
ctggcaatctttggccttcc

SEQ ID NO: 408408 - DNA, 20 bp, Artificial
  CRISPR gRNA sequence
tggcaatctttggccttcct

SEQ ID NO: 408409 - DNA, 20 bp, Artificial
  CRISPR gRNA sequence
gcaatctttggccttccttg

SEQ ID NO: 408410 - DNA, 20 bp, Artificial
  CRISPR gRNA sequence
tggccttccttggctcgtgg

SEQ ID NO: 408411 - DNA, 20 bp, Artificial
  CRISPR gRNA sequence
ggccttccttggctcgtgga

SEQ ID NO: 408412 - DNA, 20 bp, Artificial
  CRISPR gRNA sequence
gccttccttggctcgtggaa

SEQ ID NO: 408413 - DNA, 20 bp, Artificial
  CRISPR gRNA sequence
ccttggctcgtggaagcatc

SEQ ID NO: 408414 - DNA, 20 bp, Artificial
  CRISPR gRNA sequence
cttggctcgtggaagcatca

SEQ ID NO: 408415 - DNA, 20 bp, Artificial
  CRISPR gRNA sequence
ggctcgtggaagcatcaacc

SEQ ID NO: 408416 - DNA, 20 bp, Artificial
  CRISPR gRNA sequence
gctcgtggaagcatcaaccc

SEQ ID NO: 408417 - DNA, 20 bp, Artificial
  CRISPR gRNA sequence
gtggaagcatcaacccaatc

SEQ ID NO: 408418 - DNA, 20 bp, Artificial
  CRISPR gRNA sequence
tgcattcatcttcacatggc

SEQ ID NO: 408419 - DNA, 20 bp, Artificial
  CRISPR gRNA sequence
cattcatcttcacatggcgt

SEQ ID NO: 408420 - DNA, 20 bp, Artificial
  CRISPR gRNA sequence
atcttcacatggcgttctgc

SEQ ID NO: 408421 - DNA, 20 bp, Artificial
  CRISPR gRNA sequence
cacatggcgttctgcttgta

SEQ ID NO: 408422 - DNA, 20 bp, Artificial
  CRISPR gRNA sequence
acatggcgttctgcttgtat

SEQ ID NO: 408423 - DNA, 20 bp, Artificial
  CRISPR gRNA sequence
tgcttgtattcatgcctgtg

SEQ ID NO: 408424 - DNA, 20 bp, Artificial
  CRISPR gRNA sequence
cttgtattcatgcctgtgtc

SEQ ID NO: 408425 - DNA, 20 bp, Artificial
  CRISPR gRNA sequence
gtattcatgcctgtgtcaga

SEQ ID NO: 408426 - DNA, 20 bp, Artificial
  CRISPR gRNA sequence
tattcatgcctgtgtcagaa

SEQ ID NO: 408427 - DNA, 20 bp, Artificial
  CRISPR gRNA sequence
atgcctgtgtcagaatttcc

SEQ ID NO: 408428 - DNA, 20 bp, Artificial
  CRISPR gRNA sequence
tgtcagaatttccccttttt

SEQ ID NO: 408429 - DNA, 20 bp, Artificial
  CRISPR gRNA sequence
cccctttttataaggacacg

SEQ ID NO: 408430 - DNA, 20 bp, Artificial
  CRISPR gRNA sequence
ccctttttataaggacacgg

SEQ ID NO: 408431 - DNA, 20 bp, Artificial
  CRISPR gRNA sequence
tttataaggacacggtcata

SEQ ID NO: 408432 - DNA, 20 bp, Artificial
  CRISPR gRNA sequence
ttataaggacacggtcatat

SEQ ID NO: 408433 - DNA, 20 bp, Artificial
  CRISPR gRNA sequence
tataaggacacggtcatatt

SEQ ID NO: 408434 - DNA, 20 bp, Artificial
  CRISPR gRNA sequence
ataaggacacggtcatattg

SEQ ID NO: 408435 - DNA, 20 bp, Artificial
  CRISPR gRNA sequence
taaggacacggtcatattgg

SEQ ID NO: 408436 - DNA, 20 bp, Artificial
  CRISPR gRNA sequence
gattaggggccaccctattc

SEQ ID NO: 408437 - DNA, 20 bp, Artificial
  CRISPR gRNA sequence
ggggccaccctattccagga

SEQ ID NO: 408438 - DNA, 20 bp, Artificial
  CRISPR gRNA sequence
ttccaggatgacttcatgtt

SEQ ID NO: 408439 - DNA, 20 bp, Artificial
  CRISPR gRNA sequence
caggatgacttcatgttaac

SEQ ID NO: 408440 - DNA, 20 bp, Artificial
  CRISPR gRNA sequence
catgttaactaattgtatct

SEQ ID NO: 408441 - DNA, 20 bp, Artificial
  CRISPR gRNA sequence
atgttaactaattgtatctg

SEQ ID NO: 408442 - DNA, 20 bp, Artificial
  CRISPR gRNA sequence
actaattgtatctgcaacag

SEQ ID NO: 408443 - DNA, 20 bp, Artificial
  CRISPR gRNA sequence
attgtatctgcaacagccct

SEQ ID NO: 408444 - DNA, 20 bp, Artificial
  CRISPR gRNA sequence
tatctgcaacagccctattt

SEQ ID NO: 408445 - DNA, 20 bp, Artificial
  CRISPR gRNA sequence
caacagccctatttccaaat

SEQ ID NO: 408446 - DNA, 20 bp, Artificial
  CRISPR gRNA sequence
tttccaaatcagatcaggtt

SEQ ID NO: 408447 - DNA, 20 bp, Artificial
  CRISPR gRNA sequence
ccaaatcagatcaggttgtg

SEQ ID NO: 408448 - DNA, 20 bp, Artificial
  CRISPR gRNA sequence
caaatcagatcaggttgtga

SEQ ID NO: 408449 - DNA, 20 bp, Artificial
  CRISPR gRNA sequence
tgaagtactggaggctagga

SEQ ID NO: 408450 - DNA, 20 bp, Artificial
  CRISPR gRNA sequence
gaggctaggacttcaccata

SEQ ID NO: 408451 - DNA, 20 bp, Artificial
  CRISPR gRNA sequence
ggacttcaccataggaatgt

SEQ ID NO: 408452 - DNA, 20 bp, Artificial
  CRISPR gRNA sequence
caccataggaatgttggggg

SEQ ID NO: 408453 - DNA, 20 bp, Artificial
  CRISPR gRNA sequence
accataggaatgttggggga

SEQ ID NO: 408454 - DNA, 20 bp, Artificial
  CRISPR gRNA sequence
ggggacacaattccacctgt

SEQ ID NO: 408455 - DNA, 20 bp, Artificial
  CRISPR gRNA sequence
cacctgtaacatccccaaac

SEQ ID NO: 408456 - DNA, 20 bp, Artificial
  CRISPR gRNA sequence
taacatccccaaacttggcc

SEQ ID NO: 408457 - DNA, 20 bp, Artificial
  CRISPR gRNA sequence
ggccatctgggaacattgca

SEQ ID NO: 408458 - DNA, 20 bp, Artificial
  CRISPR gRNA sequence
gccatctgggaacattgcag

SEQ ID NO: 408459 - DNA, 20 bp, Artificial
  CRISPR gRNA sequence
ggaacattgcagctttttag

SEQ ID NO: 408460 - DNA, 20 bp, Artificial
  CRISPR gRNA sequence
cagctttttagagaaatgcc

SEQ ID NO: 408461 - DNA, 20 bp, Artificial
  CRISPR gRNA sequence
tttagagaaatgccatccaa

SEQ ID NO: 408462 - DNA, 20 bp, Artificial
  CRISPR gRNA sequence
ttagagaaatgccatccaat

SEQ ID NO: 408463 - DNA, 20 bp, Artificial
  CRISPR gRNA sequence
tagagaaatgccatccaata

SEQ ID NO: 408464 - DNA, 20 bp, Artificial
  CRISPR gRNA sequence
agagaaatgccatccaatac

SEQ ID NO: 408465 - DNA, 20 bp, Artificial
  CRISPR gRNA sequence
gagaaatgccatccaatact

SEQ ID NO: 408466 - DNA, 20 bp, Artificial
  CRISPR gRNA sequence
tcattgctgtctatgtttga

SEQ ID NO: 408467 - DNA, 20 bp, Artificial
  CRISPR gRNA sequence
ctgtctatgtttgaaatgaa

SEQ ID NO: 408468 - DNA, 20 bp, Artificial
  CRISPR gRNA sequence
tctatgtttgaaatgaatgc

SEQ ID NO: 408469 - DNA, 20 bp, Artificial
  CRISPR gRNA sequence
tgtttgaaatgaatgcacac

SEQ ID NO: 408470 - DNA, 20 bp, Artificial
  CRISPR gRNA sequence
gaaatgaatgcacacaggga

SEQ ID NO: 408471 - DNA, 20 bp, Artificial
  CRISPR gRNA sequence
aaatgaatgcacacagggag

SEQ ID NO: 408472 - DNA, 20 bp, Artificial
  CRISPR gRNA sequence
cagtgtaggcaggagcttgc

SEQ ID NO: 408473 - DNA, 20 bp, Artificial
  CRISPR gRNA sequence
gcattctctttctgggaatg

SEQ ID NO: 408474 - DNA, 20 bp, Artificial
  CRISPR gRNA sequence
cattctctttctgggaatgc

SEQ ID NO: 408475 - DNA, 20 bp, Artificial
  CRISPR gRNA sequence
tctttctgggaatgctgatg

SEQ ID NO: 408476 - DNA, 20 bp, Artificial
  CRISPR gRNA sequence
tttctgggaatgctgatgcg

SEQ ID NO: 408477 - DNA, 20 bp, Artificial
  CRISPR gRNA sequence
tctgggaatgctgatgcgtt

SEQ ID NO: 408478 - DNA, 20 bp, Artificial
  CRISPR gRNA sequence
ctgggaatgctgatgcgttc

SEQ ID NO: 408479 - DNA, 20 bp, Artificial
  CRISPR gRNA sequence
tgggaatgctgatgcgttct

SEQ ID NO: 408480 - DNA, 20 bp, Artificial
  CRISPR gRNA sequence
ggaatgctgatgcgttctag

SEQ ID NO: 408481 - DNA, 20 bp, Artificial
  CRISPR gRNA sequence
atgcgttctagggaagaggc

SEQ ID NO: 408482 - DNA, 20 bp, Artificial
  CRISPR gRNA sequence
tagggaagaggcttctgttt

SEQ ID NO: 408483 - DNA, 20 bp, Artificial
  CRISPR gRNA sequence
gggaagaggcttctgtttct

SEQ ID NO: 408484 - DNA, 20 bp, Artificial
  CRISPR gRNA sequence
ctgtttctattctgcttgaa

SEQ ID NO: 408485 - DNA, 20 bp, Artificial
  CRISPR gRNA sequence
tgtttctattctgcttgaag

SEQ ID NO: 408486 - DNA, 20 bp, Artificial
  CRISPR gRNA sequence
tttctattctgcttgaagct

SEQ ID NO: 408487 - DNA, 20 bp, Artificial
  CRISPR gRNA sequence
ctattctgcttgaagctgcc

SEQ ID NO: 408488 - DNA, 20 bp, Artificial
  CRISPR gRNA sequence
tattctgcttgaagctgcct

SEQ ID NO: 408489 - DNA, 20 bp, Artificial
  CRISPR gRNA sequence
ttctgcttgaagctgcctga

SEQ ID NO: 408490 - DNA, 20 bp, Artificial
  CRISPR gRNA sequence
tgcttgaagctgcctgacag

SEQ ID NO: 408491 - DNA, 20 bp, Artificial
  CRISPR gRNA sequence
cttgaagctgcctgacagct

SEQ ID NO: 408492 - DNA, 20 bp, Artificial
  CRISPR gRNA sequence
gaagctgcctgacagctcag

SEQ ID NO: 408493 - DNA, 20 bp, Artificial
  CRISPR gRNA sequence
aagctgcctgacagctcagt

SEQ ID NO: 408494 - DNA, 20 bp, Artificial
  CRISPR gRNA sequence
cctgacagctcagttcagtg

SEQ ID NO: 408495 - DNA, 20 bp, Artificial
  CRISPR gRNA sequence
acagctcagttcagtgtcca

SEQ ID NO: 408496 - DNA, 20 bp, Artificial
  CRISPR gRNA sequence
agttcagtgtccaccacgac

SEQ ID NO: 408497 - DNA, 20 bp, Artificial
  CRISPR gRNA sequence
agtgtccaccacgactgtct

SEQ ID NO: 408498 - DNA, 20 bp, Artificial
  CRISPR gRNA sequence
tctttttcactttttggctg

SEQ ID NO: 408499 - DNA, 20 bp, Artificial
  CRISPR gRNA sequence
tttcactttttggctgtcac

SEQ ID NO: 408500 - DNA, 20 bp, Artificial
  CRISPR gRNA sequence
ttcactttttggctgtcaca

SEQ ID NO: 408501 - DNA, 20 bp, Artificial
  CRISPR gRNA sequence
tcactttttggctgtcacag

SEQ ID NO: 408502 - DNA, 20 bp, Artificial
  CRISPR gRNA sequence
cactttttggctgtcacagc

SEQ ID NO: 408503 - DNA, 20 bp, Artificial
  CRISPR gRNA sequence
actttttggctgtcacagcc

SEQ ID NO: 408504 - DNA, 20 bp, Artificial
  CRISPR gRNA sequence
tttggctgtcacagccagaa

SEQ ID NO: 408505 - DNA, 20 bp, Artificial
  CRISPR gRNA sequence
ttggctgtcacagccagaac

SEQ ID NO: 408506 - DNA, 20 bp, Artificial
  CRISPR gRNA sequence
tggctgtcacagccagaact

SEQ ID NO: 408507 - DNA, 20 bp, Artificial
  CRISPR gRNA sequence
ggctgtcacagccagaacta

SEQ ID NO: 408508 - DNA, 20 bp, Artificial
  CRISPR gRNA sequence
gctgtcacagccagaactat

SEQ ID NO: 408509 - DNA, 20 bp, Artificial
  CRISPR gRNA sequence
tcacagccagaactatgagg

SEQ ID NO: 408510 - DNA, 20 bp, Artificial
  CRISPR gRNA sequence
tgaggcaggcaaaggcatcc

SEQ ID NO: 408511 - DNA, 20 bp, Artificial
  CRISPR gRNA sequence
ggaaaattctgccttttgtg

SEQ ID NO: 408512 - DNA, 20 bp, Artificial
  CRISPR gRNA sequence
gaaaattctgccttttgtgt

SEQ ID NO: 408513 - DNA, 20 bp, Artificial
  CRISPR gRNA sequence
tgccttttgtgtctgtgttt

SEQ ID NO: 408514 - DNA, 20 bp, Artificial
  CRISPR gRNA sequence
ccttttgtgtctgtgtttct

SEQ ID NO: 408515 - DNA, 20 bp, Artificial
  CRISPR gRNA sequence
ttgtgtctgtgtttctcctt

SEQ ID NO: 408516 - DNA, 20 bp, Artificial
  CRISPR gRNA sequence
tgtgtctgtgtttctccttc

SEQ ID NO: 408517 - DNA, 20 bp, Artificial
  CRISPR gRNA sequence
gtgtctgtgtttctccttct

SEQ ID NO: 408518 - DNA, 20 bp, Artificial
  CRISPR gRNA sequence
tgtctgtgtttctccttctg

SEQ ID NO: 408519 - DNA, 20 bp, Artificial
  CRISPR gRNA sequence
tgtttctccttctgtcctca

SEQ ID NO: 408520 - DNA, 20 bp, Artificial
  CRISPR gRNA sequence
ctccttctgtcctcagtatg

SEQ ID NO: 408521 - DNA, 20 bp, Artificial
  CRISPR gRNA sequence
tccttctgtcctcagtatgt

SEQ ID NO: 408522 - DNA, 20 bp, Artificial
  CRISPR gRNA sequence
cttctgtcctcagtatgtcc

SEQ ID NO: 408523 - DNA, 20 bp, Artificial
  CRISPR gRNA sequence
ctgtcctcagtatgtcctcc

SEQ ID NO: 408524 - DNA, 20 bp, Artificial
  CRISPR gRNA sequence
tgtcctcagtatgtcctccc

SEQ ID NO: 408525 - DNA, 20 bp, Artificial
  CRISPR gRNA sequence
tcctcagtatgtcctcccac

SEQ ID NO: 408526 - DNA, 20 bp, Artificial
  CRISPR gRNA sequence
agtatgtcctcccacactgc

SEQ ID NO: 408527 - DNA, 20 bp, Artificial
  CRISPR gRNA sequence
ccacactgcatgccctatga

SEQ ID NO: 408528 - DNA, 20 bp, Artificial
  CRISPR gRNA sequence
catgccctatgagcttcaaa

SEQ ID NO: 408529 - DNA, 20 bp, Artificial
  CRISPR gRNA sequence
tgagcttcaaaagtgccatt

SEQ ID NO: 408530 - DNA, 20 bp, Artificial
  CRISPR gRNA sequence
caaaagtgccatttttccac

SEQ ID NO: 408531 - DNA, 20 bp, Artificial
  CRISPR gRNA sequence
aaaagtgccatttttccact

SEQ ID NO: 408532 - DNA, 20 bp, Artificial
  CRISPR gRNA sequence
ttccactttctggactttgt

SEQ ID NO: 408533 - DNA, 20 bp, Artificial
  CRISPR gRNA sequence
tccactttctggactttgtt

SEQ ID NO: 408534 - DNA, 20 bp, Artificial
  CRISPR gRNA sequence
ccactttctggactttgttg

SEQ ID NO: 408535 - DNA, 20 bp, Artificial
  CRISPR gRNA sequence
cactttctggactttgttgc

SEQ ID NO: 408536 - DNA, 20 bp, Artificial
  CRISPR gRNA sequence
tctggactttgttgcttgct

SEQ ID NO: 408537 - DNA, 20 bp, Artificial
  CRISPR gRNA sequence
ctggactttgttgcttgctt

SEQ ID NO: 408538 - DNA, 20 bp, Artificial
  CRISPR gRNA sequence
tggactttgttgcttgcttg

SEQ ID NO: 408539 - DNA, 20 bp, Artificial
  CRISPR gRNA sequence
gactttgttgcttgcttgta

SEQ ID NO: 408540 - DNA, 20 bp, Artificial
  CRISPR gRNA sequence
tgttgcttgcttgtaactgg

SEQ ID NO: 408541 - DNA, 20 bp, Artificial
  CRISPR gRNA sequence
gttgcttgcttgtaactggg

SEQ ID NO: 408542 - DNA, 20 bp, Artificial
  CRISPR gRNA sequence
ttgcttgcttgtaactggga

SEQ ID NO: 408543 - DNA, 20 bp, Artificial
  CRISPR gRNA sequence
cttgcttgtaactgggaact

SEQ ID NO: 408544 - DNA, 20 bp, Artificial
  CRISPR gRNA sequence
gcttgtaactgggaacttgc

SEQ ID NO: 408545 - DNA, 20 bp, Artificial
  CRISPR gRNA sequence
cttgtaactgggaacttgcc

SEQ ID NO: 408546 - DNA, 20 bp, Artificial
  CRISPR gRNA sequence
gtaactgggaacttgccttt

SEQ ID NO: 408547 - DNA, 20 bp, Artificial
  CRISPR gRNA sequence
taactgggaacttgcctttc

SEQ ID NO: 408548 - DNA, 20 bp, Artificial
  CRISPR gRNA sequence
ggaacttgcctttctatttc

SEQ ID NO: 408549 - DNA, 20 bp, Artificial
  CRISPR gRNA sequence
gcctttctatttcttttgct

SEQ ID NO: 408550 - DNA, 20 bp, Artificial
  CRISPR gRNA sequence
cctttctatttcttttgctt

SEQ ID NO: 408551 - DNA, 20 bp, Artificial
  CRISPR gRNA sequence
tctatttcttttgcttgctt

SEQ ID NO: 408552 - DNA, 20 bp, Artificial
  CRISPR gRNA sequence
ctatttcttttgcttgctta

SEQ ID NO: 408553 - DNA, 20 bp, Artificial
  CRISPR gRNA sequence
tatttcttttgcttgcttat

SEQ ID NO: 408554 - DNA, 20 bp, Artificial
  CRISPR gRNA sequence
tttcttttgcttgcttattt

SEQ ID NO: 408555 - DNA, 20 bp, Artificial
  CRISPR gRNA sequence
cttttgcttgcttatttttg

SEQ ID NO: 408556 - DNA, 20 bp, Artificial
  CRISPR gRNA sequence
ttttgcttgcttatttttga

SEQ ID NO: 408557 - DNA, 20 bp, Artificial
  CRISPR gRNA sequence
ttgcttgcttatttttgaga

SEQ ID NO: 408558 - DNA, 20 bp, Artificial
  CRISPR gRNA sequence
tgcttgcttatttttgagaa

SEQ ID NO: 408559 - DNA, 20 bp, Artificial
  CRISPR gRNA sequence
gcttgcttatttttgagaac

SEQ ID NO: 408560 - DNA, 20 bp, Artificial
  CRISPR gRNA sequence
cttgcttatttttgagaact

SEQ ID NO: 408561 - DNA, 20 bp, Artificial
  CRISPR gRNA sequence
gcttatttttgagaacttta

SEQ ID NO: 408562 - DNA, 20 bp, Artificial
  CRISPR gRNA sequence
cttatttttgagaactttat

SEQ ID NO: 408563 - DNA, 20 bp, Artificial
  CRISPR gRNA sequence
atttttgagaactttatctc

SEQ ID NO: 408564 - DNA, 20 bp, Artificial
  CRISPR gRNA sequence
tttttgagaactttatctca

SEQ ID NO: 408565 - DNA, 20 bp, Artificial
  CRISPR gRNA sequence
ttgagaactttatctcaggc

SEQ ID NO: 408566 - DNA, 20 bp, Artificial
  CRISPR gRNA sequence
tgagaactttatctcaggca

SEQ ID NO: 408567 - DNA, 20 bp, Artificial
  CRISPR gRNA sequence
gagaactttatctcaggcac

SEQ ID NO: 408568 - DNA, 20 bp, Artificial
  CRISPR gRNA sequence
agaactttatctcaggcact

SEQ ID NO: 408569 - DNA, 20 bp, Artificial
  CRISPR gRNA sequence
tatctcaggcactttaggag

SEQ ID NO: 408570 - DNA, 20 bp, Artificial
  CRISPR gRNA sequence
atctcaggcactttaggaga

SEQ ID NO: 408571 - DNA, 20 bp, Artificial
  CRISPR gRNA sequence
tctcaggcactttaggagac

SEQ ID NO: 408572 - DNA, 20 bp, Artificial
  CRISPR gRNA sequence
aggcactttaggagacctcc

SEQ ID NO: 408573 - DNA, 20 bp, Artificial
  CRISPR gRNA sequence
taggagacctccttagtcat

SEQ ID NO: 408574 - DNA, 20 bp, Artificial
  CRISPR gRNA sequence
aggagacctccttagtcatc

SEQ ID NO: 408575 - DNA, 20 bp, Artificial
  CRISPR gRNA sequence
ggagacctccttagtcatca

SEQ ID NO: 408576 - DNA, 20 bp, Artificial
  CRISPR gRNA sequence
cttagtcatcatgcagtcaa

SEQ ID NO: 408577 - DNA, 20 bp, Artificial
  CRISPR gRNA sequence
agtcatcatgcagtcaacat

SEQ ID NO: 408578 - DNA, 20 bp, Artificial
  CRISPR gRNA sequence
gtcatcatgcagtcaacatt

SEQ ID NO: 408579 - DNA, 20 bp, Artificial
  CRISPR gRNA sequence
cattttgcatttatttgggt

SEQ ID NO: 408580 - DNA, 20 bp, Artificial
  CRISPR gRNA sequence
attttgcatttatttgggtg

SEQ ID NO: 408581 - DNA, 20 bp, Artificial
  CRISPR gRNA sequence
tgcatttatttgggtgacta

SEQ ID NO: 408582 - DNA, 20 bp, Artificial
  CRISPR gRNA sequence
gcatttatttgggtgactag

SEQ ID NO: 408583 - DNA, 20 bp, Artificial
  CRISPR gRNA sequence
catttatttgggtgactagt

SEQ ID NO: 408584 - DNA, 20 bp, Artificial
  CRISPR gRNA sequence
atttgggtgactagtaagag

SEQ ID NO: 408585 - DNA, 20 bp, Artificial
  CRISPR gRNA sequence
tttgggtgactagtaagagt

SEQ ID NO: 408586 - DNA, 20 bp, Artificial
  CRISPR gRNA sequence
gggtgactagtaagagtttg

SEQ ID NO: 408587 - DNA, 20 bp, Artificial
  CRISPR gRNA sequence
ggtgactagtaagagtttgt

SEQ ID NO: 408588 - DNA, 20 bp, Artificial
  CRISPR gRNA sequence
gtaagagtttgtagaaaagt

SEQ ID NO: 408589 - DNA, 20 bp, Artificial
  CRISPR gRNA sequence
gtagaaaagttcttaattga

SEQ ID NO: 408590 - DNA, 20 bp, Artificial
  CRISPR gRNA sequence
tagaaaagttcttaattgag

SEQ ID NO: 408591 - DNA, 20 bp, Artificial
  CRISPR gRNA sequence
ttaattgagcatattcatag

SEQ ID NO: 408592 - DNA, 20 bp, Artificial
  CRISPR gRNA sequence
aattgagcatattcatagtc

SEQ ID NO: 408593 - DNA, 20 bp, Artificial
  CRISPR gRNA sequence
attgagcatattcatagtct

SEQ ID NO: 408594 - DNA, 20 bp, Artificial
  CRISPR gRNA sequence
agcatattcatagtctaggc

SEQ ID NO: 408595 - DNA, 20 bp, Artificial
  CRISPR gRNA sequence
atagtctaggcacagttggg

SEQ ID NO: 408596 - DNA, 20 bp, Artificial
  CRISPR gRNA sequence
ggcacagttgggaatacgtg

SEQ ID NO: 408597 - DNA, 20 bp, Artificial
  CRISPR gRNA sequence
ggaatacgtgaagctactgg

SEQ ID NO: 408598 - DNA, 20 bp, Artificial
  CRISPR gRNA sequence
ctggagctactactatcatc

SEQ ID NO: 408599 - DNA, 20 bp, Artificial
  CRISPR gRNA sequence
gagctactactatcatcatt

SEQ ID NO: 408600 - DNA, 20 bp, Artificial
  CRISPR gRNA sequence
ctactatcatcatttctaat

SEQ ID NO: 408601 - DNA, 20 bp, Artificial
  CRISPR gRNA sequence
ctatcatcatttctaattag

SEQ ID NO: 408602 - DNA, 20 bp, Artificial
  CRISPR gRNA sequence
tcatcatttctaattagcta

SEQ ID NO: 408603 - DNA, 20 bp, Artificial
  CRISPR gRNA sequence
ctaattagctagtgtaataa

SEQ ID NO: 408604 - DNA, 20 bp, Artificial
  CRISPR gRNA sequence
taattagctagtgtaataat

SEQ ID NO: 408605 - DNA, 20 bp, Artificial
  CRISPR gRNA sequence
attagctagtgtaataatag

SEQ ID NO: 408606 - DNA, 20 bp, Artificial
  CRISPR gRNA sequence
gctagtgtaataatagtgct

SEQ ID NO: 408607 - DNA, 20 bp, Artificial
  CRISPR gRNA sequence
gtgtaataatagtgctcctg

SEQ ID NO: 408608 - DNA, 20 bp, Artificial
  CRISPR gRNA sequence
ctgcagatggcttagggcaa

SEQ ID NO: 408609 - DNA, 20 bp, Artificial
  CRISPR gRNA sequence
cagatggcttagggcaatgc

SEQ ID NO: 408610 - DNA, 20 bp, Artificial
  CRISPR gRNA sequence
agggcaatgctgggctgttt

SEQ ID NO: 408611 - DNA, 20 bp, Artificial
  CRISPR gRNA sequence
gggcaatgctgggctgttta

SEQ ID NO: 408612 - DNA, 20 bp, Artificial
  CRISPR gRNA sequence
ggctgtttaatttttagtct

SEQ ID NO: 408613 - DNA, 20 bp, Artificial
  CRISPR gRNA sequence
tttaatttttagtctatttg

SEQ ID NO: 408614 - DNA, 20 bp, Artificial
  CRISPR gRNA sequence
aatttttagtctatttgaag

SEQ ID NO: 408615 - DNA, 20 bp, Artificial
  CRISPR gRNA sequence
atttttagtctatttgaagc

SEQ ID NO: 408616 - DNA, 20 bp, Artificial
  CRISPR gRNA sequence
ttagtctatttgaagcatcg

SEQ ID NO: 408617 - DNA, 20 bp, Artificial
  CRISPR gRNA sequence
tagtctatttgaagcatcgt

SEQ ID NO: 408618 - DNA, 20 bp, Artificial
  CRISPR gRNA sequence
agtctatttgaagcatcgta

SEQ ID NO: 408619 - DNA, 20 bp, Artificial
  CRISPR gRNA sequence
gtctatttgaagcatcgtaa

SEQ ID NO: 408620 - DNA, 20 bp, Artificial
  CRISPR gRNA sequence
tttgaagcatcgtaagaaca

SEQ ID NO: 408621 - DNA, 20 bp, Artificial
  CRISPR gRNA sequence
gaagcatcgtaagaacaagt

SEQ ID NO: 408622 - DNA, 20 bp, Artificial
  CRISPR gRNA sequence
aagcatcgtaagaacaagtt

SEQ ID NO: 408623 - DNA, 20 bp, Artificial
  CRISPR gRNA sequence
tcgtctcgtgctttagaaac

SEQ ID NO: 408624 - DNA, 20 bp, Artificial
  CRISPR gRNA sequence
gtgctttagaaaccctgggg

SEQ ID NO: 408625 - DNA, 20 bp, Artificial
  CRISPR gRNA sequence
tagaaaccctggggagaggt

SEQ ID NO: 408626 - DNA, 20 bp, Artificial
  CRISPR gRNA sequence
agaaaccctggggagaggtc

SEQ ID NO: 408627 - DNA, 20 bp, Artificial
  CRISPR gRNA sequence
gaaaccctggggagaggtct

SEQ ID NO: 408628 - DNA, 20 bp, Artificial
  CRISPR gRNA sequence
gggagaggtctgactgagca

SEQ ID NO: 408629 - DNA, 20 bp, Artificial
  CRISPR gRNA sequence
actgagcaggcgctattgat

SEQ ID NO: 408630 - DNA, 20 bp, Artificial
  CRISPR gRNA sequence
agcaggcgctattgatttgc

SEQ ID NO: 408631 - DNA, 20 bp, Artificial
  CRISPR gRNA sequence
ttgatttgcacttgatctgc

SEQ ID NO: 408632 - DNA, 20 bp, Artificial
  CRISPR gRNA sequence
atttgcacttgatctgcacc

SEQ ID NO: 408633 - DNA, 20 bp, Artificial
  CRISPR gRNA sequence
gcacttgatctgcacctaag

SEQ ID NO: 408634 - DNA, 20 bp, Artificial
  CRISPR gRNA sequence
cacttgatctgcacctaaga

SEQ ID NO: 408635 - DNA, 20 bp, Artificial
  CRISPR gRNA sequence
gatctgcacctaagagatgg

SEQ ID NO: 408636 - DNA, 20 bp, Artificial
  CRISPR gRNA sequence
atctgcacctaagagatggt

SEQ ID NO: 408637 - DNA, 20 bp, Artificial
  CRISPR gRNA sequence
cacctaagagatggttgaac

SEQ ID NO: 408638 - DNA, 20 bp, Artificial
  CRISPR gRNA sequence
agagatggttgaacaaggag

SEQ ID NO: 408639 - DNA, 20 bp, Artificial
  CRISPR gRNA sequence
aacaaggagagtagataggc

SEQ ID NO: 408640 - DNA, 20 bp, Artificial
  CRISPR gRNA sequence
actcagcgatggtgagtaga

SEQ ID NO: 408641 - DNA, 20 bp, Artificial
  CRISPR gRNA sequence
agcgatggtgagtagacagg

SEQ ID NO: 408642 - DNA, 20 bp, Artificial
  CRISPR gRNA sequence
ctgggggcacaacacacatt

SEQ ID NO: 408643 - DNA, 20 bp, Artificial
  CRISPR gRNA sequence
ggggcacaacacacattttt

SEQ ID NO: 408644 - DNA, 20 bp, Artificial
  CRISPR gRNA sequence
ttttttagggacaagcagaa

SEQ ID NO: 408645 - DNA, 20 bp, Artificial
  CRISPR gRNA sequence
tttttagggacaagcagaag

SEQ ID NO: 408646 - DNA, 20 bp, Artificial
  CRISPR gRNA sequence
ttttagggacaagcagaaga

SEQ ID NO: 408647 - DNA, 20 bp, Artificial
  CRISPR gRNA sequence
tttagggacaagcagaagaa

SEQ ID NO: 408648 - DNA, 20 bp, Artificial
  CRISPR gRNA sequence
ttagggacaagcagaagaag

SEQ ID NO: 408649 - DNA, 20 bp, Artificial
  CRISPR gRNA sequence
tagggacaagcagaagaaga

SEQ ID NO: 408650 - DNA, 20 bp, Artificial
  CRISPR gRNA sequence
agggacaagcagaagaagag

SEQ ID NO: 408651 - DNA, 20 bp, Artificial
  CRISPR gRNA sequence
gggacaagcagaagaagaga

SEQ ID NO: 408652 - DNA, 20 bp, Artificial
  CRISPR gRNA sequence
ccaggagggctggacatcca

SEQ ID NO: 408653 - DNA, 20 bp, Artificial
  CRISPR gRNA sequence
caggagggctggacatccag

SEQ ID NO: 408654 - DNA, 20 bp, Artificial
  CRISPR gRNA sequence
gacatccagcattcaggtca

SEQ ID NO: 408655 - DNA, 20 bp, Artificial
  CRISPR gRNA sequence
aggtcaagaacactgatgac

SEQ ID NO: 408656 - DNA, 20 bp, Artificial
  CRISPR gRNA sequence
atgacatttgcagtcttggt

SEQ ID NO: 408657 - DNA, 20 bp, Artificial
  CRISPR gRNA sequence
gcagtcttggtagaagggtg

SEQ ID NO: 408658 - DNA, 20 bp, Artificial
  CRISPR gRNA sequence
cagtcttggtagaagggtgg

SEQ ID NO: 408659 - DNA, 20 bp, Artificial
  CRISPR gRNA sequence
ggtagaagggtggaaatgga

SEQ ID NO: 408660 - DNA, 20 bp, Artificial
  CRISPR gRNA sequence
gtagaagggtggaaatggat

SEQ ID NO: 408661 - DNA, 20 bp, Artificial
  CRISPR gRNA sequence
gattgtgtcgaagcacacat

SEQ ID NO: 408662 - DNA, 20 bp, Artificial
  CRISPR gRNA sequence
tgtcgaagcacacatgggaa

SEQ ID NO: 408663 - DNA, 20 bp, Artificial
  CRISPR gRNA sequence
ctggaattttgaatgaatag

SEQ ID NO: 408664 - DNA, 20 bp, Artificial
  CRISPR gRNA sequence
gaattttgaatgaataggga

SEQ ID NO: 408665 - DNA, 20 bp, Artificial
  CRISPR gRNA sequence
tgaatgaatagggaagaaga

SEQ ID NO: 408666 - DNA, 20 bp, Artificial
  CRISPR gRNA sequence
gaatgaatagggaagaagaa

SEQ ID NO: 408667 - DNA, 20 bp, Artificial
  CRISPR gRNA sequence
aatgaatagggaagaagaaa

SEQ ID NO: 408668 - DNA, 20 bp, Artificial
  CRISPR gRNA sequence
gatggcgccaaaaggtccaa

SEQ ID NO: 408669 - DNA, 20 bp, Artificial
  CRISPR gRNA sequence
gttttcaggaatgggagaaa

SEQ ID NO: 408670 - DNA, 20 bp, Artificial
  CRISPR gRNA sequence
tcaggaatgggagaaagatc

SEQ ID NO: 408671 - DNA, 20 bp, Artificial
  CRISPR gRNA sequence
caggaatgggagaaagatcc

SEQ ID NO: 408672 - DNA, 20 bp, Artificial
  CRISPR gRNA sequence
aggaatgggagaaagatccc

SEQ ID NO: 408673 - DNA, 20 bp, Artificial
  CRISPR gRNA sequence
agaggtgagagagagaacag

SEQ ID NO: 408674 - DNA, 20 bp, Artificial
  CRISPR gRNA sequence
gaggtgagagagagaacagt

SEQ ID NO: 408675 - DNA, 20 bp, Artificial
  CRISPR gRNA sequence
agaattggaggttaaagata

SEQ ID NO: 408676 - DNA, 20 bp, Artificial
  CRISPR gRNA sequence
gaattggaggttaaagatac

SEQ ID NO: 408677 - DNA, 20 bp, Artificial
  CRISPR gRNA sequence
gaggttaaagatacaggaga

SEQ ID NO: 408678 - DNA, 20 bp, Artificial
  CRISPR gRNA sequence
aagatacaggagagagttta

SEQ ID NO: 408679 - DNA, 20 bp, Artificial
  CRISPR gRNA sequence
agcatttgtggtgttctggc

SEQ ID NO: 408680 - DNA, 20 bp, Artificial
  CRISPR gRNA sequence
gcatttgtggtgttctggca

SEQ ID NO: 408681 - DNA, 20 bp, Artificial
  CRISPR gRNA sequence
gtggtgttctggcatgaaaa

SEQ ID NO: 408682 - DNA, 20 bp, Artificial
  CRISPR gRNA sequence
tggtgttctggcatgaaaaa

SEQ ID NO: 408683 - DNA, 20 bp, Artificial
  CRISPR gRNA sequence
tggcatgaaaaatgtatgag

SEQ ID NO: 408684 - DNA, 20 bp, Artificial
  CRISPR gRNA sequence
gcatgaaaaatgtatgagct

SEQ ID NO: 408685 - DNA, 20 bp, Artificial
  CRISPR gRNA sequence
taaaaccaaattagtttctt

SEQ ID NO: 408686 - DNA, 20 bp, Artificial
  CRISPR gRNA sequence
aaaaccaaattagtttcttg

SEQ ID NO: 408687 - DNA, 20 bp, Artificial
  CRISPR gRNA sequence
aaaccaaattagtttcttgc

SEQ ID NO: 408688 - DNA, 20 bp, Artificial
  CRISPR gRNA sequence
gtttcttgcgtttctgattc

SEQ ID NO: 408689 - DNA, 20 bp, Artificial
  CRISPR gRNA sequence
cttgcgtttctgattctgtt

SEQ ID NO: 408690 - DNA, 20 bp, Artificial
  CRISPR gRNA sequence
ttgcgtttctgattctgttc

SEQ ID NO: 408691 - DNA, 20 bp, Artificial
  CRISPR gRNA sequence
gcgtttctgattctgttctt

SEQ ID NO: 408692 - DNA, 20 bp, Artificial
  CRISPR gRNA sequence
cgtttctgattctgttcttt

SEQ ID NO: 408693 - DNA, 20 bp, Artificial
  CRISPR gRNA sequence
ctgattctgttctttgccag

SEQ ID NO: 408694 - DNA, 20 bp, Artificial
  CRISPR gRNA sequence
tgattctgttctttgccagc

SEQ ID NO: 408695 - DNA, 20 bp, Artificial
  CRISPR gRNA sequence
attctgttctttgccagctc

SEQ ID NO: 408696 - DNA, 20 bp, Artificial
  CRISPR gRNA sequence
tgttctttgccagctcagct

SEQ ID NO: 408697 - DNA, 20 bp, Artificial
  CRISPR gRNA sequence
ttctttgccagctcagctct

SEQ ID NO: 408698 - DNA, 20 bp, Artificial
  CRISPR gRNA sequence
tttgccagctcagctctttg

SEQ ID NO: 408699 - DNA, 20 bp, Artificial
  CRISPR gRNA sequence
tgccagctcagctctttggg

SEQ ID NO: 408700 - DNA, 20 bp, Artificial
  CRISPR gRNA sequence
gccagctcagctctttggga

SEQ ID NO: 408701 - DNA, 20 bp, Artificial
  CRISPR gRNA sequence
ccagctcagctctttgggaa

SEQ ID NO: 408702 - DNA, 20 bp, Artificial
  CRISPR gRNA sequence
agctctttgggaaagctact

SEQ ID NO: 408703 - DNA, 20 bp, Artificial
  CRISPR gRNA sequence
tttgggaaagctacttcagt

SEQ ID NO: 408704 - DNA, 20 bp, Artificial
  CRISPR gRNA sequence
tgggaaagctacttcagtat

SEQ ID NO: 408705 - DNA, 20 bp, Artificial
  CRISPR gRNA sequence
gggaaagctacttcagtata

SEQ ID NO: 408706 - DNA, 20 bp, Artificial
  CRISPR gRNA sequence
ggaaagctacttcagtatat

SEQ ID NO: 408707 - DNA, 20 bp, Artificial
  CRISPR gRNA sequence
cttcagtatatttatttttt

SEQ ID NO: 408708 - DNA, 20 bp, Artificial
  CRISPR gRNA sequence
cagtatatttattttttcaa

SEQ ID NO: 408709 - DNA, 20 bp, Artificial
  CRISPR gRNA sequence
agtatatttattttttcaac

SEQ ID NO: 408710 - DNA, 20 bp, Artificial
  CRISPR gRNA sequence
attttttcaactgtgaaaca

SEQ ID NO: 408711 - DNA, 20 bp, Artificial
  CRISPR gRNA sequence
ttttttcaactgtgaaacag

SEQ ID NO: 408712 - DNA, 20 bp, Artificial
  CRISPR gRNA sequence
tttcaactgtgaaacaggca

SEQ ID NO: 408713 - DNA, 20 bp, Artificial
  CRISPR gRNA sequence
ttcaactgtgaaacaggcac

SEQ ID NO: 408714 - DNA, 20 bp, Artificial
  CRISPR gRNA sequence
tcaactgtgaaacaggcaca

SEQ ID NO: 408715 - DNA, 20 bp, Artificial
  CRISPR gRNA sequence
caactgtgaaacaggcacat

SEQ ID NO: 408716 - DNA, 20 bp, Artificial
  CRISPR gRNA sequence
aactgtgaaacaggcacatt

SEQ ID NO: 408717 - DNA, 20 bp, Artificial
  CRISPR gRNA sequence
tgaaacaggcacattaatac

SEQ ID NO: 408718 - DNA, 20 bp, Artificial
  CRISPR gRNA sequence
atactgattggatgttattg

SEQ ID NO: 408719 - DNA, 20 bp, Artificial
  CRISPR gRNA sequence
attggatgttattgttagga

SEQ ID NO: 408720 - DNA, 20 bp, Artificial
  CRISPR gRNA sequence
gatgttattgttaggattag

SEQ ID NO: 408721 - DNA, 20 bp, Artificial
  CRISPR gRNA sequence
ttgttaggattagagattgg

SEQ ID NO: 408722 - DNA, 20 bp, Artificial
  CRISPR gRNA sequence
ttaggattagagattgggtg

SEQ ID NO: 408723 - DNA, 20 bp, Artificial
  CRISPR gRNA sequence
ggattagagattgggtgtgt

SEQ ID NO: 408724 - DNA, 20 bp, Artificial
  CRISPR gRNA sequence
gagattgggtgtgtgaagta

SEQ ID NO: 408725 - DNA, 20 bp, Artificial
  CRISPR gRNA sequence
ggtgtgtgaagtacctttca

SEQ ID NO: 408726 - DNA, 20 bp, Artificial
  CRISPR gRNA sequence
tcacaagcagggactccaat

SEQ ID NO: 408727 - DNA, 20 bp, Artificial
  CRISPR gRNA sequence
cacaagcagggactccaatt

SEQ ID NO: 408728 - DNA, 20 bp, Artificial
  CRISPR gRNA sequence
acaagcagggactccaattt

SEQ ID NO: 408729 - DNA, 20 bp, Artificial
  CRISPR gRNA sequence
caatttaggttccttctctt

SEQ ID NO: 408730 - DNA, 20 bp, Artificial
  CRISPR gRNA sequence
aggttccttctcttgcttct

SEQ ID NO: 408731 - DNA, 20 bp, Artificial
  CRISPR gRNA sequence
ggttccttctcttgcttctc

SEQ ID NO: 408732 - DNA, 20 bp, Artificial
  CRISPR gRNA sequence
cttctcttgcttctcaaatc

SEQ ID NO: 408733 - DNA, 20 bp, Artificial
  CRISPR gRNA sequence
ctcttgcttctcaaatcttg

SEQ ID NO: 408734 - DNA, 20 bp, Artificial
  CRISPR gRNA sequence
tcttgcttctcaaatcttgt

SEQ ID NO: 408735 - DNA, 20 bp, Artificial
  CRISPR gRNA sequence
ttgcttctcaaatcttgtac

SEQ ID NO: 408736 - DNA, 20 bp, Artificial
  CRISPR gRNA sequence
gcttctcaaatcttgtacta

SEQ ID NO: 408737 - DNA, 20 bp, Artificial
  CRISPR gRNA sequence
cttctcaaatcttgtactaa

SEQ ID NO: 408738 - DNA, 20 bp, Artificial
  CRISPR gRNA sequence
ctcaaatcttgtactaacaa

SEQ ID NO: 408739 - DNA, 20 bp, Artificial
  CRISPR gRNA sequence
tcaaatcttgtactaacaaa

SEQ ID NO: 408740 - DNA, 20 bp, Artificial
  CRISPR gRNA sequence
aaatcttgtactaacaaata

SEQ ID NO: 408741 - DNA, 20 bp, Artificial
  CRISPR gRNA sequence
gtactaacaaatactttttt

SEQ ID NO: 408742 - DNA, 20 bp, Artificial
  CRISPR gRNA sequence
tactaacaaatacttttttt

SEQ ID NO: 408743 - DNA, 20 bp, Artificial
  CRISPR gRNA sequence
acaaatactttttttttttt

SEQ ID NO: 408744 - DNA, 20 bp, Artificial
  CRISPR gRNA sequence
ttttttttttttttgagtca

SEQ ID NO: 408745 - DNA, 20 bp, Artificial
  CRISPR gRNA sequence
tttttttttttttgagtcag

SEQ ID NO: 408746 - DNA, 20 bp, Artificial
  CRISPR gRNA sequence
ttttttttttttgagtcaga

SEQ ID NO: 408747 - DNA, 20 bp, Artificial
  CRISPR gRNA sequence
tttttttttttgagtcagag

SEQ ID NO: 408748 - DNA, 20 bp, Artificial
  CRISPR gRNA sequence
ttttttttttgagtcagagt

SEQ ID NO: 408749 - DNA, 20 bp, Artificial
  CRISPR gRNA sequence
tttttttttgagtcagagtc

SEQ ID NO: 408750 - DNA, 20 bp, Artificial
  CRISPR gRNA sequence
ttttttttgagtcagagtct

SEQ ID NO: 408751 - DNA, 20 bp, Artificial
  CRISPR gRNA sequence
tttttttgagtcagagtctt

SEQ ID NO: 408752 - DNA, 20 bp, Artificial
  CRISPR gRNA sequence
ttttttgagtcagagtcttg

SEQ ID NO: 408753 - DNA, 20 bp, Artificial
  CRISPR gRNA sequence
tttttgagtcagagtcttgc

SEQ ID NO: 408754 - DNA, 20 bp, Artificial
  CRISPR gRNA sequence
ttttgagtcagagtcttgct

SEQ ID NO: 408755 - DNA, 20 bp, Artificial
  CRISPR gRNA sequence
tttgagtcagagtcttgctc

SEQ ID NO: 408756 - DNA, 20 bp, Artificial
  CRISPR gRNA sequence
ttgagtcagagtcttgctct

SEQ ID NO: 408757 - DNA, 20 bp, Artificial
  CRISPR gRNA sequence
tgagtcagagtcttgctctg

SEQ ID NO: 408758 - DNA, 20 bp, Artificial
  CRISPR gRNA sequence
gagtcagagtcttgctctgt

SEQ ID NO: 408759 - DNA, 20 bp, Artificial
  CRISPR gRNA sequence
agtcagagtcttgctctgtc

SEQ ID NO: 408760 - DNA, 20 bp, Artificial
  CRISPR gRNA sequence
gctctgtcgcccaggctgga

SEQ ID NO: 408761 - DNA, 20 bp, Artificial
  CRISPR gRNA sequence
ctctgtcgcccaggctggag

SEQ ID NO: 408762 - DNA, 20 bp, Artificial
  CRISPR gRNA sequence
tgtcgcccaggctggagtgc

SEQ ID NO: 408763 - DNA, 20 bp, Artificial
  CRISPR gRNA sequence
tcgcccaggctggagtgcag

SEQ ID NO: 408764 - DNA, 20 bp, Artificial
  CRISPR gRNA sequence
gagtgcagtggtgcgatctc

SEQ ID NO: 408765 - DNA, 20 bp, Artificial
  CRISPR gRNA sequence
ggctcactgcaagctctgcc

SEQ ID NO: 408766 - DNA, 20 bp, Artificial
  CRISPR gRNA sequence
actgcaagctctgcctcccg

SEQ ID NO: 408767 - DNA, 20 bp, Artificial
  CRISPR gRNA sequence
caagctctgcctcccgggtt

SEQ ID NO: 408768 - DNA, 20 bp, Artificial
  CRISPR gRNA sequence
tgcctcccgggttcacgcca

SEQ ID NO: 408769 - DNA, 20 bp, Artificial
  CRISPR gRNA sequence
cctcccgggttcacgccatt

SEQ ID NO: 408770 - DNA, 20 bp, Artificial
  CRISPR gRNA sequence
ccgggttcacgccattcttc

SEQ ID NO: 408771 - DNA, 20 bp, Artificial
  CRISPR gRNA sequence
acgccattcttctgcctcag

SEQ ID NO: 408772 - DNA, 20 bp, Artificial
  CRISPR gRNA sequence
ttctgcctcagcctcctgag

SEQ ID NO: 408773 - DNA, 20 bp, Artificial
  CRISPR gRNA sequence
ctgcctcagcctcctgagta

SEQ ID NO: 408774 - DNA, 20 bp, Artificial
  CRISPR gRNA sequence
tgcctcagcctcctgagtag

SEQ ID NO: 408775 - DNA, 20 bp, Artificial
  CRISPR gRNA sequence
cctcagcctcctgagtagct

SEQ ID NO: 408776 - DNA, 20 bp, Artificial
  CRISPR gRNA sequence
agcctcctgagtagctggga

SEQ ID NO: 408777 - DNA, 20 bp, Artificial
  CRISPR gRNA sequence
ctgagtagctgggactacag

SEQ ID NO: 408778 - DNA, 20 bp, Artificial
  CRISPR gRNA sequence
agtagctgggactacaggca

SEQ ID NO: 408779 - DNA, 20 bp, Artificial
  CRISPR gRNA sequence
ggactacaggcacctgccac

SEQ ID NO: 408780 - DNA, 20 bp, Artificial
  CRISPR gRNA sequence
caggcacctgccaccacgcc

SEQ ID NO: 408781 - DNA, 20 bp, Artificial
  CRISPR gRNA sequence
ccaccacgcccggctaattt

SEQ ID NO: 408782 - DNA, 20 bp, Artificial
  CRISPR gRNA sequence
attttttgtatttttagtag

SEQ ID NO: 408783 - DNA, 20 bp, Artificial
  CRISPR gRNA sequence
tttgtatttttagtagagac

SEQ ID NO: 408784 - DNA, 20 bp, Artificial
  CRISPR gRNA sequence
ttgtatttttagtagagacg

SEQ ID NO: 408785 - DNA, 20 bp, Artificial
  CRISPR gRNA sequence
tgtatttttagtagagacgg

SEQ ID NO: 408786 - DNA, 20 bp, Artificial
  CRISPR gRNA sequence
gtatttttagtagagacggg

SEQ ID NO: 408787 - DNA, 20 bp, Artificial
  CRISPR gRNA sequence
tatttttagtagagacgggg

SEQ ID NO: 408788 - DNA, 20 bp, Artificial
  CRISPR gRNA sequence
ttagtagagacggggtttca

SEQ ID NO: 408789 - DNA, 20 bp, Artificial
  CRISPR gRNA sequence
tagtagagacggggtttcac

SEQ ID NO: 408790 - DNA, 20 bp, Artificial
  CRISPR gRNA sequence
agtagagacggggtttcacc

SEQ ID NO: 408791 - DNA, 20 bp, Artificial
  CRISPR gRNA sequence
gtagagacggggtttcacca

SEQ ID NO: 408792 - DNA, 20 bp, Artificial
  CRISPR gRNA sequence
caccatgttagccaggatgg

SEQ ID NO: 408793 - DNA, 20 bp, Artificial
  CRISPR gRNA sequence
accatgttagccaggatggt

SEQ ID NO: 408794 - DNA, 20 bp, Artificial
  CRISPR gRNA sequence
gccaggatggtcttgatctc

SEQ ID NO: 408795 - DNA, 20 bp, Artificial
  CRISPR gRNA sequence
gatctcctgacctcgtgatc

SEQ ID NO: 408796 - DNA, 20 bp, Artificial
  CRISPR gRNA sequence
atctcctgacctcgtgatct

SEQ ID NO: 408797 - DNA, 20 bp, Artificial
  CRISPR gRNA sequence
ctgacctcgtgatctgcctg

SEQ ID NO: 408798 - DNA, 20 bp, Artificial
  CRISPR gRNA sequence
acctcgtgatctgcctgcct

SEQ ID NO: 408799 - DNA, 20 bp, Artificial
  CRISPR gRNA sequence
gtgatctgcctgcctcggcc

SEQ ID NO: 408800 - DNA, 20 bp, Artificial
  CRISPR gRNA sequence
cctgcctcggcctcccaaag

SEQ ID NO: 408801 - DNA, 20 bp, Artificial
  CRISPR gRNA sequence
cctcggcctcccaaagtgct

SEQ ID NO: 408802 - DNA, 20 bp, Artificial
  CRISPR gRNA sequence
ggcctcccaaagtgctggat

SEQ ID NO: 408803 - DNA, 20 bp, Artificial
  CRISPR gRNA sequence
ccaaagtgctggattacagg

SEQ ID NO: 408804 - DNA, 20 bp, Artificial
  CRISPR gRNA sequence
gattacaggtgtgagccact

SEQ ID NO: 408805 - DNA, 20 bp, Artificial
  CRISPR gRNA sequence
caggtgtgagccactgtgcc

SEQ ID NO: 408806 - DNA, 20 bp, Artificial
  CRISPR gRNA sequence
tgcccgggcacaaataaata

SEQ ID NO: 408807 - DNA, 20 bp, Artificial
  CRISPR gRNA sequence
ttaaagcttttttaatggaa

SEQ ID NO: 408808 - DNA, 20 bp, Artificial
  CRISPR gRNA sequence
taaagcttttttaatggaag

SEQ ID NO: 408809 - DNA, 20 bp, Artificial
  CRISPR gRNA sequence
aaagcttttttaatggaagt

SEQ ID NO: 408810 - DNA, 20 bp, Artificial
  CRISPR gRNA sequence
aagcttttttaatggaagtt

SEQ ID NO: 408811 - DNA, 20 bp, Artificial
  CRISPR gRNA sequence
ttttaatggaagtttcaaac

SEQ ID NO: 408812 - DNA, 20 bp, Artificial
  CRISPR gRNA sequence
tttaatggaagtttcaaaca

SEQ ID NO: 408813 - DNA, 20 bp, Artificial
  CRISPR gRNA sequence
ttaatggaagtttcaaacat

SEQ ID NO: 408814 - DNA, 20 bp, Artificial
  CRISPR gRNA sequence
taatggaagtttcaaacata

SEQ ID NO: 408815 - DNA, 20 bp, Artificial
  CRISPR gRNA sequence
aatggaagtttcaaacatat

SEQ ID NO: 408816 - DNA, 20 bp, Artificial
  CRISPR gRNA sequence
atggaagtttcaaacatata

SEQ ID NO: 408817 - DNA, 20 bp, Artificial
  CRISPR gRNA sequence
caaacatatacaaaaataga

SEQ ID NO: 408818 - DNA, 20 bp, Artificial
  CRISPR gRNA sequence
aaacatatacaaaaatagaa

SEQ ID NO: 408819 - DNA, 20 bp, Artificial
  CRISPR gRNA sequence
ccctgtgaccagtatatagc

SEQ ID NO: 408820 - DNA, 20 bp, Artificial
  CRISPR gRNA sequence
tgaccagtatatagcttcgc

SEQ ID NO: 408821 - DNA, 20 bp, Artificial
  CRISPR gRNA sequence
cgccgactatcaagtttggg

SEQ ID NO: 408822 - DNA, 20 bp, Artificial
  CRISPR gRNA sequence
gccgactatcaagtttgggt

SEQ ID NO: 408823 - DNA, 20 bp, Artificial
  CRISPR gRNA sequence
tcaagtttgggtcagtgtta

SEQ ID NO: 408824 - DNA, 20 bp, Artificial
  CRISPR gRNA sequence
gggtcagtgttattgttctc

SEQ ID NO: 408825 - DNA, 20 bp, Artificial
  CRISPR gRNA sequence
ggtcagtgttattgttctct

SEQ ID NO: 408826 - DNA, 20 bp, Artificial
  CRISPR gRNA sequence
ttgttctctatttctcacac

SEQ ID NO: 408827 - DNA, 20 bp, Artificial
  CRISPR gRNA sequence
ttctctatttctcacactct

SEQ ID NO: 408828 - DNA, 20 bp, Artificial
  CRISPR gRNA sequence
tctatttctcacactctctc

SEQ ID NO: 408829 - DNA, 20 bp, Artificial
  CRISPR gRNA sequence
tatttctcacactctctctt

SEQ ID NO: 408830 - DNA, 20 bp, Artificial
  CRISPR gRNA sequence
tttctcacactctctctttc

SEQ ID NO: 408831 - DNA, 20 bp, Artificial
  CRISPR gRNA sequence
ctcacactctctctttccct

SEQ ID NO: 408832 - DNA, 20 bp, Artificial
  CRISPR gRNA sequence
tcacactctctctttccctt

SEQ ID NO: 408833 - DNA, 20 bp, Artificial
  CRISPR gRNA sequence
acactctctctttcccttga

SEQ ID NO: 408834 - DNA, 20 bp, Artificial
  CRISPR gRNA sequence
tctctttcccttgattaatt

SEQ ID NO: 408835 - DNA, 20 bp, Artificial
  CRISPR gRNA sequence
tctttcccttgattaatttg

SEQ ID NO: 408836 - DNA, 20 bp, Artificial
  CRISPR gRNA sequence
tttcccttgattaatttgaa

SEQ ID NO: 408837 - DNA, 20 bp, Artificial
  CRISPR gRNA sequence
tcccttgattaatttgaagc

SEQ ID NO: 408838 - DNA, 20 bp, Artificial
  CRISPR gRNA sequence
cccttgattaatttgaagca

SEQ ID NO: 408839 - DNA, 20 bp, Artificial
  CRISPR gRNA sequence
ccttgattaatttgaagcaa

SEQ ID NO: 408840 - DNA, 20 bp, Artificial
  CRISPR gRNA sequence
gattaatttgaagcaaattc

SEQ ID NO: 408841 - DNA, 20 bp, Artificial
  CRISPR gRNA sequence
attaatttgaagcaaattcc

SEQ ID NO: 408842 - DNA, 20 bp, Artificial
  CRISPR gRNA sequence
atttgaagcaaattccagcc

SEQ ID NO: 408843 - DNA, 20 bp, Artificial
  CRISPR gRNA sequence
gaagcaaattccagccatta

SEQ ID NO: 408844 - DNA, 20 bp, Artificial
  CRISPR gRNA sequence
aagcaaattccagccattaa

SEQ ID NO: 408845 - DNA, 20 bp, Artificial
  CRISPR gRNA sequence
cagccattaagtcatctcat

SEQ ID NO: 408846 - DNA, 20 bp, Artificial
  CRISPR gRNA sequence
agtcatctcatcaataaata

SEQ ID NO: 408847 - DNA, 20 bp, Artificial
  CRISPR gRNA sequence
atcaataaatattttagcct

SEQ ID NO: 408848 - DNA, 20 bp, Artificial
  CRISPR gRNA sequence
tagcctgaatctcaaaagat

SEQ ID NO: 408849 - DNA, 20 bp, Artificial
  CRISPR gRNA sequence
agcctgaatctcaaaagatg

SEQ ID NO: 408850 - DNA, 20 bp, Artificial
  CRISPR gRNA sequence
gcctgaatctcaaaagatga

SEQ ID NO: 408851 - DNA, 20 bp, Artificial
  CRISPR gRNA sequence
aatctcaaaagatgagtttt

SEQ ID NO: 408852 - DNA, 20 bp, Artificial
  CRISPR gRNA sequence
aaaagatgagttttcttttt

SEQ ID NO: 408853 - DNA, 20 bp, Artificial
  CRISPR gRNA sequence
tctttttaacataaacatga

SEQ ID NO: 408854 - DNA, 20 bp, Artificial
  CRISPR gRNA sequence
ctttttaacataaacatgat

SEQ ID NO: 408855 - DNA, 20 bp, Artificial
  CRISPR gRNA sequence
tttttaacataaacatgata

SEQ ID NO: 408856 - DNA, 20 bp, Artificial
  CRISPR gRNA sequence
tttaacataaacatgatacc

SEQ ID NO: 408857 - DNA, 20 bp, Artificial
  CRISPR gRNA sequence
ttaacataaacatgatacca

SEQ ID NO: 408858 - DNA, 20 bp, Artificial
  CRISPR gRNA sequence
taacataaacatgataccat

SEQ ID NO: 408859 - DNA, 20 bp, Artificial
  CRISPR gRNA sequence
aacataaacatgataccatc

SEQ ID NO: 408860 - DNA, 20 bp, Artificial
  CRISPR gRNA sequence
acataaacatgataccatca

SEQ ID NO: 408861 - DNA, 20 bp, Artificial
  CRISPR gRNA sequence
ccttcacccctcacaaaaca

SEQ ID NO: 408862 - DNA, 20 bp, Artificial
  CRISPR gRNA sequence
cacccctcacaaaacagcaa

SEQ ID NO: 408863 - DNA, 20 bp, Artificial
  CRISPR gRNA sequence
acccctcacaaaacagcaat

SEQ ID NO: 408864 - DNA, 20 bp, Artificial
  CRISPR gRNA sequence
acaaaacagcaataatttct

SEQ ID NO: 408865 - DNA, 20 bp, Artificial
  CRISPR gRNA sequence
cttaaaattattaagtgtct

SEQ ID NO: 408866 - DNA, 20 bp, Artificial
  CRISPR gRNA sequence
ttaaaattattaagtgtcta

SEQ ID NO: 408867 - DNA, 20 bp, Artificial
  CRISPR gRNA sequence
aaaattattaagtgtctact

SEQ ID NO: 408868 - DNA, 20 bp, Artificial
  CRISPR gRNA sequence
aaattattaagtgtctactt

SEQ ID NO: 408869 - DNA, 20 bp, Artificial
  CRISPR gRNA sequence
ttaagtgtctactttgcatt

SEQ ID NO: 408870 - DNA, 20 bp, Artificial
  CRISPR gRNA sequence
agtgtctactttgcatttct

SEQ ID NO: 408871 - DNA, 20 bp, Artificial
  CRISPR gRNA sequence
ctttgcatttctccagttct

SEQ ID NO: 408872 - DNA, 20 bp, Artificial
  CRISPR gRNA sequence
tgcatttctccagttctatg

SEQ ID NO: 408873 - DNA, 20 bp, Artificial
  CRISPR gRNA sequence
gcatttctccagttctatga

SEQ ID NO: 408874 - DNA, 20 bp, Artificial
  CRISPR gRNA sequence
catttctccagttctatgaa

SEQ ID NO: 408875 - DNA, 20 bp, Artificial
  CRISPR gRNA sequence
ctccagttctatgaattttt

SEQ ID NO: 408876 - DNA, 20 bp, Artificial
  CRISPR gRNA sequence
tccagttctatgaatttttc

SEQ ID NO: 408877 - DNA, 20 bp, Artificial
  CRISPR gRNA sequence
cagttctatgaatttttcct

SEQ ID NO: 408878 - DNA, 20 bp, Artificial
  CRISPR gRNA sequence
tatgaatttttcctttttaa

SEQ ID NO: 408879 - DNA, 20 bp, Artificial
  CRISPR gRNA sequence
tgaatttttcctttttaagt

SEQ ID NO: 408880 - DNA, 20 bp, Artificial
  CRISPR gRNA sequence
ttcctttttaagttccacac

SEQ ID NO: 408881 - DNA, 20 bp, Artificial
  CRISPR gRNA sequence
tcctttttaagttccacaca

SEQ ID NO: 408882 - DNA, 20 bp, Artificial
  CRISPR gRNA sequence
cctttttaagttccacacat

SEQ ID NO: 408883 - DNA, 20 bp, Artificial
  CRISPR gRNA sequence
ctttttaagttccacacatt

SEQ ID NO: 408884 - DNA, 20 bp, Artificial
  CRISPR gRNA sequence
tttaagttccacacattgtt

SEQ ID NO: 408885 - DNA, 20 bp, Artificial
  CRISPR gRNA sequence
ttaagttccacacattgtta

SEQ ID NO: 408886 - DNA, 20 bp, Artificial
  CRISPR gRNA sequence
taagttccacacattgttac

SEQ ID NO: 408887 - DNA, 20 bp, Artificial
  CRISPR gRNA sequence
aagttccacacattgttact

SEQ ID NO: 408888 - DNA, 20 bp, Artificial
  CRISPR gRNA sequence
agttccacacattgttactg

SEQ ID NO: 408889 - DNA, 20 bp, Artificial
  CRISPR gRNA sequence
cacacattgttactgtgtaa

SEQ ID NO: 408890 - DNA, 20 bp, Artificial
  CRISPR gRNA sequence
ttactgtgtaatacctccct

SEQ ID NO: 408891 - DNA, 20 bp, Artificial
  CRISPR gRNA sequence
ctgtgtaatacctcccttta

SEQ ID NO: 408892 - DNA, 20 bp, Artificial
  CRISPR gRNA sequence
tgtaatacctccctttaacc

SEQ ID NO: 408893 - DNA, 20 bp, Artificial
  CRISPR gRNA sequence
cctttaacctgtaggttgat

SEQ ID NO: 408894 - DNA, 20 bp, Artificial
  CRISPR gRNA sequence
taacctgtaggttgattcct

SEQ ID NO: 408895 - DNA, 20 bp, Artificial
  CRISPR gRNA sequence
aacctgtaggttgattcctc

SEQ ID NO: 408896 - DNA, 20 bp, Artificial
  CRISPR gRNA sequence
acctgtaggttgattcctct

SEQ ID NO: 408897 - DNA, 20 bp, Artificial
  CRISPR gRNA sequence
taggttgattcctctccacc

SEQ ID NO: 408898 - DNA, 20 bp, Artificial
  CRISPR gRNA sequence
attcctctccacctttcatt

SEQ ID NO: 408899 - DNA, 20 bp, Artificial
  CRISPR gRNA sequence
ctctccacctttcatttttt

SEQ ID NO: 408900 - DNA, 20 bp, Artificial
  CRISPR gRNA sequence
tccacctttcatttttttgt

SEQ ID NO: 408901 - DNA, 20 bp, Artificial
  CRISPR gRNA sequence
cacctttcatttttttgttg

SEQ ID NO: 408902 - DNA, 20 bp, Artificial
  CRISPR gRNA sequence
tcatttttttgttgttgttg

SEQ ID NO: 408903 - DNA, 20 bp, Artificial
  CRISPR gRNA sequence
catttttttgttgttgttgt

SEQ ID NO: 408904 - DNA, 20 bp, Artificial
  CRISPR gRNA sequence
atttttttgttgttgttgtc

SEQ ID NO: 408905 - DNA, 20 bp, Artificial
  CRISPR gRNA sequence
ttttgttgttgttgtcacct

SEQ ID NO: 408906 - DNA, 20 bp, Artificial
  CRISPR gRNA sequence
tttgttgttgttgtcacctt

SEQ ID NO: 408907 - DNA, 20 bp, Artificial
  CRISPR gRNA sequence
ttgttgttgttgtcaccttg

SEQ ID NO: 408908 - DNA, 20 bp, Artificial
  CRISPR gRNA sequence
tgttgttgttgtcaccttga

SEQ ID NO: 408909 - DNA, 20 bp, Artificial
  CRISPR gRNA sequence
gttgttgttgtcaccttgag

SEQ ID NO: 408910 - DNA, 20 bp, Artificial
  CRISPR gRNA sequence
ttgttgttgtcaccttgagt

SEQ ID NO: 408911 - DNA, 20 bp, Artificial
  CRISPR gRNA sequence
ttgttgtcaccttgagtttt

SEQ ID NO: 408912 - DNA, 20 bp, Artificial
  CRISPR gRNA sequence
ttgtcaccttgagtttttca

SEQ ID NO: 408913 - DNA, 20 bp, Artificial
  CRISPR gRNA sequence
tcaccttgagtttttcatat

SEQ ID NO: 408914 - DNA, 20 bp, Artificial
  CRISPR gRNA sequence
gagtttttcatattcccgtg

SEQ ID NO: 408915 - DNA, 20 bp, Artificial
  CRISPR gRNA sequence
agtttttcatattcccgtgg

SEQ ID NO: 408916 - DNA, 20 bp, Artificial
  CRISPR gRNA sequence
ttcatattcccgtgggctgc

SEQ ID NO: 408917 - DNA, 20 bp, Artificial
  CRISPR gRNA sequence
tcatattcccgtgggctgct

SEQ ID NO: 408918 - DNA, 20 bp, Artificial
  CRISPR gRNA sequence
catattcccgtgggctgctt

SEQ ID NO: 408919 - DNA, 20 bp, Artificial
  CRISPR gRNA sequence
atattcccgtgggctgcttt

SEQ ID NO: 408920 - DNA, 20 bp, Artificial
  CRISPR gRNA sequence
ccgtgggctgctttcccatg

SEQ ID NO: 408921 - DNA, 20 bp, Artificial
  CRISPR gRNA sequence
ctttcccatggtggcatttg

SEQ ID NO: 408922 - DNA, 20 bp, Artificial
  CRISPR gRNA sequence
tcccatggtggcatttgata

SEQ ID NO: 408923 - DNA, 20 bp, Artificial
  CRISPR gRNA sequence
cccatggtggcatttgatac

SEQ ID NO: 408924 - DNA, 20 bp, Artificial
  CRISPR gRNA sequence
ccatggtggcatttgatacg

SEQ ID NO: 408925 - DNA, 20 bp, Artificial
  CRISPR gRNA sequence
gatacgtttctctgctcttt

SEQ ID NO: 408926 - DNA, 20 bp, Artificial
  CRISPR gRNA sequence
atacgtttctctgctctttg

SEQ ID NO: 408927 - DNA, 20 bp, Artificial
  CRISPR gRNA sequence
ctctgctctttgcagttctg

SEQ ID NO: 408928 - DNA, 20 bp, Artificial
  CRISPR gRNA sequence
tctgctctttgcagttctgt

SEQ ID NO: 408929 - DNA, 20 bp, Artificial
  CRISPR gRNA sequence
tgctctttgcagttctgtaa

SEQ ID NO: 408930 - DNA, 20 bp, Artificial
  CRISPR gRNA sequence
ctctttgcagttctgtaagt

SEQ ID NO: 408931 - DNA, 20 bp, Artificial
  CRISPR gRNA sequence
tttgcagttctgtaagttgg

SEQ ID NO: 408932 - DNA, 20 bp, Artificial
  CRISPR gRNA sequence
tgcagttctgtaagttggtg

SEQ ID NO: 408933 - DNA, 20 bp, Artificial
  CRISPR gRNA sequence
gcagttctgtaagttggtgg

SEQ ID NO: 408934 - DNA, 20 bp, Artificial
  CRISPR gRNA sequence
cagttctgtaagttggtggt

SEQ ID NO: 408935 - DNA, 20 bp, Artificial
  CRISPR gRNA sequence
tgtaagttggtggttagatt

SEQ ID NO: 408936 - DNA, 20 bp, Artificial
  CRISPR gRNA sequence
taagttggtggttagatttg

SEQ ID NO: 408937 - DNA, 20 bp, Artificial
  CRISPR gRNA sequence
gtggttagatttggaggctt

SEQ ID NO: 408938 - DNA, 20 bp, Artificial
  CRISPR gRNA sequence
gatttggaggcttgattagc

SEQ ID NO: 408939 - DNA, 20 bp, Artificial
  CRISPR gRNA sequence
ggaggcttgattagcatcag

SEQ ID NO: 408940 - DNA, 20 bp, Artificial
  CRISPR gRNA sequence
gaggcttgattagcatcagg

SEQ ID NO: 408941 - DNA, 20 bp, Artificial
  CRISPR gRNA sequence
gattagcatcaggtttgatt

SEQ ID NO: 408942 - DNA, 20 bp, Artificial
  CRISPR gRNA sequence
attagcatcaggtttgatta

SEQ ID NO: 408943 - DNA, 20 bp, Artificial
  CRISPR gRNA sequence
gcatcaggtttgattatttt

SEQ ID NO: 408944 - DNA, 20 bp, Artificial
  CRISPR gRNA sequence
gattattttgacaaggctat

SEQ ID NO: 408945 - DNA, 20 bp, Artificial
  CRISPR gRNA sequence
attattttgacaaggctatg

SEQ ID NO: 408946 - DNA, 20 bp, Artificial
  CRISPR gRNA sequence
ttttgacaaggctatgactt

SEQ ID NO: 408947 - DNA, 20 bp, Artificial
  CRISPR gRNA sequence
tgacaaggctatgacttcca

SEQ ID NO: 408948 - DNA, 20 bp, Artificial
  CRISPR gRNA sequence
gacaaggctatgacttccaa

SEQ ID NO: 408949 - DNA, 20 bp, Artificial
  CRISPR gRNA sequence
acaaggctatgacttccaag

SEQ ID NO: 408950 - DNA, 20 bp, Artificial
  CRISPR gRNA sequence
tgacttccaaggtggtactg

SEQ ID NO: 408951 - DNA, 20 bp, Artificial
  CRISPR gRNA sequence
ccaaggtggtactgtggaaa

SEQ ID NO: 408952 - DNA, 20 bp, Artificial
  CRISPR gRNA sequence
caaggtggtactgtggaaac

SEQ ID NO: 408953 - DNA, 20 bp, Artificial
  CRISPR gRNA sequence
tggaaacataaatggcattt

SEQ ID NO: 408954 - DNA, 20 bp, Artificial
  CRISPR gRNA sequence
gtgaatttgcagacactgag

SEQ ID NO: 408955 - DNA, 20 bp, Artificial
  CRISPR gRNA sequence
tgaatttgcagacactgagg

SEQ ID NO: 408956 - DNA, 20 bp, Artificial
  CRISPR gRNA sequence
gcagacactgaggattgttg

SEQ ID NO: 408957 - DNA, 20 bp, Artificial
  CRISPR gRNA sequence
cagacactgaggattgttgc

SEQ ID NO: 408958 - DNA, 20 bp, Artificial
  CRISPR gRNA sequence
aggattgttgcctagaactc

SEQ ID NO: 408959 - DNA, 20 bp, Artificial
  CRISPR gRNA sequence
ttgcctagaactctcaattc

SEQ ID NO: 408960 - DNA, 20 bp, Artificial
  CRISPR gRNA sequence
cctagaactctcaattcgtt

SEQ ID NO: 408961 - DNA, 20 bp, Artificial
  CRISPR gRNA sequence
gaactctcaattcgtttagg

SEQ ID NO: 408962 - DNA, 20 bp, Artificial
  CRISPR gRNA sequence
tcaattcgtttaggcatgac

SEQ ID NO: 408963 - DNA, 20 bp, Artificial
  CRISPR gRNA sequence
aattcgtttaggcatgacta

SEQ ID NO: 408964 - DNA, 20 bp, Artificial
  CRISPR gRNA sequence
gtttaggcatgactaatact

SEQ ID NO: 408965 - DNA, 20 bp, Artificial
  CRISPR gRNA sequence
aggcatgactaatactattt

SEQ ID NO: 408966 - DNA, 20 bp, Artificial
  CRISPR gRNA sequence
ggcatgactaatactatttt

SEQ ID NO: 408967 - DNA, 20 bp, Artificial
  CRISPR gRNA sequence
atactattttaaatatattt

SEQ ID NO: 408968 - DNA, 20 bp, Artificial
  CRISPR gRNA sequence
ttttaaatatatttcttaat

SEQ ID NO: 408969 - DNA, 20 bp, Artificial
  CRISPR gRNA sequence
taaatatatttcttaatatt

SEQ ID NO: 408970 - DNA, 20 bp, Artificial
  CRISPR gRNA sequence
aaatatatttcttaatatta

SEQ ID NO: 408971 - DNA, 20 bp, Artificial
  CRISPR gRNA sequence
aatatatttcttaatattag

SEQ ID NO: 408972 - DNA, 20 bp, Artificial
  CRISPR gRNA sequence
cttaatattagggttattat

SEQ ID NO: 408973 - DNA, 20 bp, Artificial
  CRISPR gRNA sequence
ttaatattagggttattata

SEQ ID NO: 408974 - DNA, 20 bp, Artificial
  CRISPR gRNA sequence
aatattagggttattataga

SEQ ID NO: 408975 - DNA, 20 bp, Artificial
  CRISPR gRNA sequence
atattagggttattatagat

SEQ ID NO: 408976 - DNA, 20 bp, Artificial
  CRISPR gRNA sequence
gggttattatagatgtaaat

SEQ ID NO: 408977 - DNA, 20 bp, Artificial
  CRISPR gRNA sequence
ttatagatgtaaatctcccc

SEQ ID NO: 408978 - DNA, 20 bp, Artificial
  CRISPR gRNA sequence
tagatgtaaatctcccccaa

SEQ ID NO: 408979 - DNA, 20 bp, Artificial
  CRISPR gRNA sequence
ccccaaaatcaataaaaata

SEQ ID NO: 408980 - DNA, 20 bp, Artificial
  CRISPR gRNA sequence
agtgcaaatgaattgcaaat

SEQ ID NO: 408981 - DNA, 20 bp, Artificial
  CRISPR gRNA sequence
caaattaattttttcaagtg

SEQ ID NO: 408982 - DNA, 20 bp, Artificial
  CRISPR gRNA sequence
attttttcaagtgtttaaag

SEQ ID NO: 408983 - DNA, 20 bp, Artificial
  CRISPR gRNA sequence
tttcaagtgtttaaagtcag

SEQ ID NO: 408984 - DNA, 20 bp, Artificial
  CRISPR gRNA sequence
ttcaagtgtttaaagtcaga

SEQ ID NO: 408985 - DNA, 20 bp, Artificial
  CRISPR gRNA sequence
tcaagtgtttaaagtcagaa

SEQ ID NO: 408986 - DNA, 20 bp, Artificial
  CRISPR gRNA sequence
caagtgtttaaagtcagaaa

SEQ ID NO: 408987 - DNA, 20 bp, Artificial
  CRISPR gRNA sequence
aagtgtttaaagtcagaaat

SEQ ID NO: 408988 - DNA, 20 bp, Artificial
  CRISPR gRNA sequence
aaagtcagaaatacagtttt

SEQ ID NO: 408989 - DNA, 20 bp, Artificial
  CRISPR gRNA sequence
aagtcagaaatacagtttta

SEQ ID NO: 408990 - DNA, 20 bp, Artificial
  CRISPR gRNA sequence
tattttattagaaatttttt

SEQ ID NO: 408991 - DNA, 20 bp, Artificial
  CRISPR gRNA sequence
attttattagaaattttttt

SEQ ID NO: 408992 - DNA, 20 bp, Artificial
  CRISPR gRNA sequence
ttttattagaaatttttttt

SEQ ID NO: 408993 - DNA, 20 bp, Artificial
  CRISPR gRNA sequence
tattagaaattttttttttt

SEQ ID NO: 408994 - DNA, 20 bp, Artificial
  CRISPR gRNA sequence
attagaaatttttttttttt

SEQ ID NO: 408995 - DNA, 20 bp, Artificial
  CRISPR gRNA sequence
ttagaaattttttttttttt

SEQ ID NO: 408996 - DNA, 20 bp, Artificial
  CRISPR gRNA sequence
gaaatttttttttttttttt

SEQ ID NO: 408997 - DNA, 20 bp, Artificial
  CRISPR gRNA sequence
tttttttttttttttgagac

SEQ ID NO: 408998 - DNA, 20 bp, Artificial
  CRISPR gRNA sequence
ttttttttttttttgagacg

SEQ ID NO: 408999 - DNA, 20 bp, Artificial
  CRISPR gRNA sequence
tttttttttttttgagacgg

SEQ ID NO: 409000 - DNA, 20 bp, Artificial
  CRISPR gRNA sequence
ttttttttttttgagacgga

SEQ ID NO: 409001 - DNA, 20 bp, Artificial
  CRISPR gRNA sequence
tttttttttttgagacggag

SEQ ID NO: 409002 - DNA, 20 bp, Artificial
  CRISPR gRNA sequence
ttttttttttgagacggagt

SEQ ID NO: 409003 - DNA, 20 bp, Artificial
  CRISPR gRNA sequence
tttttttttgagacggagtc

SEQ ID NO: 409004 - DNA, 20 bp, Artificial
  CRISPR gRNA sequence
ttttttttgagacggagtct

SEQ ID NO: 409005 - DNA, 20 bp, Artificial
  CRISPR gRNA sequence
tttttttgagacggagtctc

SEQ ID NO: 409006 - DNA, 20 bp, Artificial
  CRISPR gRNA sequence
ttttttgagacggagtctcg

SEQ ID NO: 409007 - DNA, 20 bp, Artificial
  CRISPR gRNA sequence
tttttgagacggagtctcgc

SEQ ID NO: 409008 - DNA, 20 bp, Artificial
  CRISPR gRNA sequence
ttttgagacggagtctcgct

SEQ ID NO: 409009 - DNA, 20 bp, Artificial
  CRISPR gRNA sequence
tttgagacggagtctcgctc

SEQ ID NO: 409010 - DNA, 20 bp, Artificial
  CRISPR gRNA sequence
ttgagacggagtctcgctct

SEQ ID NO: 409011 - DNA, 20 bp, Artificial
  CRISPR gRNA sequence
tgagacggagtctcgctctg

SEQ ID NO: 409012 - DNA, 20 bp, Artificial
  CRISPR gRNA sequence
gagacggagtctcgctctgt

SEQ ID NO: 409013 - DNA, 20 bp, Artificial
  CRISPR gRNA sequence
agacggagtctcgctctgtc

SEQ ID NO: 409014 - DNA, 20 bp, Artificial
  CRISPR gRNA sequence
gctctgtcgcccaggccgga

SEQ ID NO: 409015 - DNA, 20 bp, Artificial
  CRISPR gRNA sequence
tgtcgcccaggccggactgc

SEQ ID NO: 409016 - DNA, 20 bp, Artificial
  CRISPR gRNA sequence
tcgcccaggccggactgcgg

SEQ ID NO: 409017 - DNA, 20 bp, Artificial
  CRISPR gRNA sequence
cggactgcagtggcgcaatc

SEQ ID NO: 409018 - DNA, 20 bp, Artificial
  CRISPR gRNA sequence
cagtggcgcaatctcggctc

SEQ ID NO: 409019 - DNA, 20 bp, Artificial
  CRISPR gRNA sequence
ggctcactgcaagctccgcc

SEQ ID NO: 409020 - DNA, 20 bp, Artificial
  CRISPR gRNA sequence
actgcaagctccgcctcccg

SEQ ID NO: 409021 - DNA, 20 bp, Artificial
  CRISPR gRNA sequence
caagctccgcctcccgggtt

SEQ ID NO: 409022 - DNA, 20 bp, Artificial
  CRISPR gRNA sequence
cgcctcccgggttcacgcca

SEQ ID NO: 409023 - DNA, 20 bp, Artificial
  CRISPR gRNA sequence
ccgggttcacgccattctcc

SEQ ID NO: 409024 - DNA, 20 bp, Artificial
  CRISPR gRNA sequence
acgccattctcctgcctcag

SEQ ID NO: 409025 - DNA, 20 bp, Artificial
  CRISPR gRNA sequence
tcctgcctcagcctcccgag

SEQ ID NO: 409026 - DNA, 20 bp, Artificial
  CRISPR gRNA sequence
ctgcctcagcctcccgagta

SEQ ID NO: 409027 - DNA, 20 bp, Artificial
  CRISPR gRNA sequence
cctcagcctcccgagtagct

SEQ ID NO: 409028 - DNA, 20 bp, Artificial
  CRISPR gRNA sequence
agcctcccgagtagctggga

SEQ ID NO: 409029 - DNA, 20 bp, Artificial
  CRISPR gRNA sequence
ccgagtagctgggactacag

SEQ ID NO: 409030 - DNA, 20 bp, Artificial
  CRISPR gRNA sequence
ggactacaggcgcccgccac

SEQ ID NO: 409031 - DNA, 20 bp, Artificial
  CRISPR gRNA sequence
caggcgcccgccaccgcgcc

SEQ ID NO: 409032 - DNA, 20 bp, Artificial
  CRISPR gRNA sequence
attttttgtatttttagtag

SEQ ID NO: 409033 - DNA, 20 bp, Artificial
  CRISPR gRNA sequence
tttgtatttttagtagagac

SEQ ID NO: 409034 - DNA, 20 bp, Artificial
  CRISPR gRNA sequence
ttgtatttttagtagagacg

SEQ ID NO: 409035 - DNA, 20 bp, Artificial
  CRISPR gRNA sequence
tgtatttttagtagagacgg

SEQ ID NO: 409036 - DNA, 20 bp, Artificial
  CRISPR gRNA sequence
gtatttttagtagagacggg

SEQ ID NO: 409037 - DNA, 20 bp, Artificial
  CRISPR gRNA sequence
tatttttagtagagacgggg

SEQ ID NO: 409038 - DNA, 20 bp, Artificial
  CRISPR gRNA sequence
ttagtagagacggggtttca

SEQ ID NO: 409039 - DNA, 20 bp, Artificial
  CRISPR gRNA sequence
tagtagagacggggtttcac

SEQ ID NO: 409040 - DNA, 20 bp, Artificial
  CRISPR gRNA sequence
agtagagacggggtttcacc

SEQ ID NO: 409041 - DNA, 20 bp, Artificial
  CRISPR gRNA sequence
gtagagacggggtttcacct

SEQ ID NO: 409042 - DNA, 20 bp, Artificial
  CRISPR gRNA sequence
caccttgttagccaggatgg

SEQ ID NO: 409043 - DNA, 20 bp, Artificial
  CRISPR gRNA sequence
accttgttagccaggatggt

SEQ ID NO: 409044 - DNA, 20 bp, Artificial
  CRISPR gRNA sequence
gttagccaggatggtctcga

SEQ ID NO: 409045 - DNA, 20 bp, Artificial
  CRISPR gRNA sequence
ttagccaggatggtctcgat

SEQ ID NO: 409046 - DNA, 20 bp, Artificial
  CRISPR gRNA sequence
gccaggatggtctcgatctc

SEQ ID NO: 409047 - DNA, 20 bp, Artificial
  CRISPR gRNA sequence
gatctcctgacctcgtgatc

SEQ ID NO: 409048 - DNA, 20 bp, Artificial
  CRISPR gRNA sequence
ctgacctcgtgatccgcccg

SEQ ID NO: 409049 - DNA, 20 bp, Artificial
  CRISPR gRNA sequence
acctcgtgatccgcccgcct

SEQ ID NO: 409050 - DNA, 20 bp, Artificial
  CRISPR gRNA sequence
gtgatccgcccgcctcggcc

SEQ ID NO: 409051 - DNA, 20 bp, Artificial
  CRISPR gRNA sequence
ggcctcgcaaagtgctggga

SEQ ID NO: 409052 - DNA, 20 bp, Artificial
  CRISPR gRNA sequence
gcaaagtgctgggattacag

SEQ ID NO: 409053 - DNA, 20 bp, Artificial
  CRISPR gRNA sequence
ggattacaggcgtgagccac

SEQ ID NO: 409054 - DNA, 20 bp, Artificial
  CRISPR gRNA sequence
caggcgtgagccaccgcgcc

SEQ ID NO: 409055 - DNA, 20 bp, Artificial
  CRISPR gRNA sequence
ttaaaaaaacttttaggttt

SEQ ID NO: 409056 - DNA, 20 bp, Artificial
  CRISPR gRNA sequence
taaaaaaacttttaggtttg

SEQ ID NO: 409057 - DNA, 20 bp, Artificial
  CRISPR gRNA sequence
aaaaaaacttttaggtttgt

SEQ ID NO: 409058 - DNA, 20 bp, Artificial
  CRISPR gRNA sequence
aaaaaacttttaggtttgtg

SEQ ID NO: 409059 - DNA, 20 bp, Artificial
  CRISPR gRNA sequence
ttaggtttgtgggtacatgt

SEQ ID NO: 409060 - DNA, 20 bp, Artificial
  CRISPR gRNA sequence
taggtttgtgggtacatgtg

SEQ ID NO: 409061 - DNA, 20 bp, Artificial
  CRISPR gRNA sequence
aggtttgtgggtacatgtga

SEQ ID NO: 409062 - DNA, 20 bp, Artificial
  CRISPR gRNA sequence
ggtttgtgggtacatgtgaa

SEQ ID NO: 409063 - DNA, 20 bp, Artificial
  CRISPR gRNA sequence
gtgggtacatgtgaaggttt

SEQ ID NO: 409064 - DNA, 20 bp, Artificial
  CRISPR gRNA sequence
tgggtacatgtgaaggtttg

SEQ ID NO: 409065 - DNA, 20 bp, Artificial
  CRISPR gRNA sequence
gttgcataggtaaatatgtg

SEQ ID NO: 409066 - DNA, 20 bp, Artificial
  CRISPR gRNA sequence
ttgcataggtaaatatgtgt

SEQ ID NO: 409067 - DNA, 20 bp, Artificial
  CRISPR gRNA sequence
cataggtaaatatgtgtcac

SEQ ID NO: 409068 - DNA, 20 bp, Artificial
  CRISPR gRNA sequence
attgtacatattatttcatc

SEQ ID NO: 409069 - DNA, 20 bp, Artificial
  CRISPR gRNA sequence
tacatattatttcatcacca

SEQ ID NO: 409070 - DNA, 20 bp, Artificial
  CRISPR gRNA sequence
tttcatcaccagttattaag

SEQ ID NO: 409071 - DNA, 20 bp, Artificial
  CRISPR gRNA sequence
catcaccagttattaagctc

SEQ ID NO: 409072 - DNA, 20 bp, Artificial
  CRISPR gRNA sequence
atcaccagttattaagctca

SEQ ID NO: 409073 - DNA, 20 bp, Artificial
  CRISPR gRNA sequence
ttaagctcagtaactaagag

SEQ ID NO: 409074 - DNA, 20 bp, Artificial
  CRISPR gRNA sequence
agctcagtaactaagagttc

SEQ ID NO: 409075 - DNA, 20 bp, Artificial
  CRISPR gRNA sequence
agtaactaagagttctcttt

SEQ ID NO: 409076 - DNA, 20 bp, Artificial
  CRISPR gRNA sequence
agagttctcttttctgcttc

SEQ ID NO: 409077 - DNA, 20 bp, Artificial
  CRISPR gRNA sequence
tcttttctgcttctctccct

SEQ ID NO: 409078 - DNA, 20 bp, Artificial
  CRISPR gRNA sequence
ttttctgcttctctccctcc

SEQ ID NO: 409079 - DNA, 20 bp, Artificial
  CRISPR gRNA sequence
ttctgcttctctccctcctc

SEQ ID NO: 409080 - DNA, 20 bp, Artificial
  CRISPR gRNA sequence
tctgcttctctccctcctcc

SEQ ID NO: 409081 - DNA, 20 bp, Artificial
  CRISPR gRNA sequence
ctgcttctctccctcctccc

SEQ ID NO: 409082 - DNA, 20 bp, Artificial
  CRISPR gRNA sequence
tgcttctctccctcctccca

SEQ ID NO: 409083 - DNA, 20 bp, Artificial
  CRISPR gRNA sequence
cttctctccctcctcccacc

SEQ ID NO: 409084 - DNA, 20 bp, Artificial
  CRISPR gRNA sequence
ctctccctcctcccaccctc

SEQ ID NO: 409085 - DNA, 20 bp, Artificial
  CRISPR gRNA sequence
tctccctcctcccaccctcc

SEQ ID NO: 409086 - DNA, 20 bp, Artificial
  CRISPR gRNA sequence
tccctcctcccaccctccgc

SEQ ID NO: 409087 - DNA, 20 bp, Artificial
  CRISPR gRNA sequence
cctcctcccaccctccgctc

SEQ ID NO: 409088 - DNA, 20 bp, Artificial
  CRISPR gRNA sequence
ctcccaccctccgctctcaa

SEQ ID NO: 409089 - DNA, 20 bp, Artificial
  CRISPR gRNA sequence
ccaccctccgctctcaacta

SEQ ID NO: 409090 - DNA, 20 bp, Artificial
  CRISPR gRNA sequence
cgctctcaactagacccagt

SEQ ID NO: 409091 - DNA, 20 bp, Artificial
  CRISPR gRNA sequence
tcaactagacccagtgtctg

SEQ ID NO: 409092 - DNA, 20 bp, Artificial
  CRISPR gRNA sequence
aactagacccagtgtctgtt

SEQ ID NO: 409093 - DNA, 20 bp, Artificial
  CRISPR gRNA sequence
gacccagtgtctgttgtttc

SEQ ID NO: 409094 - DNA, 20 bp, Artificial
  CRISPR gRNA sequence
ttgtttccttctttatgttc

SEQ ID NO: 409095 - DNA, 20 bp, Artificial
  CRISPR gRNA sequence
tttccttctttatgttccta

SEQ ID NO: 409096 - DNA, 20 bp, Artificial
  CRISPR gRNA sequence
ccttctttatgttcctaact

SEQ ID NO: 409097 - DNA, 20 bp, Artificial
  CRISPR gRNA sequence
cttctttatgttcctaactt

SEQ ID NO: 409098 - DNA, 20 bp, Artificial
  CRISPR gRNA sequence
ctttatgttcctaacttctt

SEQ ID NO: 409099 - DNA, 20 bp, Artificial
  CRISPR gRNA sequence
tttatgttcctaacttctta

SEQ ID NO: 409100 - DNA, 20 bp, Artificial
  CRISPR gRNA sequence
tatgttcctaacttcttatc

SEQ ID NO: 409101 - DNA, 20 bp, Artificial
  CRISPR gRNA sequence
atgttcctaacttcttatcc

SEQ ID NO: 409102 - DNA, 20 bp, Artificial
  CRISPR gRNA sequence
tgttcctaacttcttatcct

SEQ ID NO: 409103 - DNA, 20 bp, Artificial
  CRISPR gRNA sequence
ctaacttcttatcctttagc

SEQ ID NO: 409104 - DNA, 20 bp, Artificial
  CRISPR gRNA sequence
acttcttatcctttagctcc

SEQ ID NO: 409105 - DNA, 20 bp, Artificial
  CRISPR gRNA sequence
cttatcctttagctcccatt

SEQ ID NO: 409106 - DNA, 20 bp, Artificial
  CRISPR gRNA sequence
ttatcctttagctcccattt

SEQ ID NO: 409107 - DNA, 20 bp, Artificial
  CRISPR gRNA sequence
atcctttagctcccatttga

SEQ ID NO: 409108 - DNA, 20 bp, Artificial
  CRISPR gRNA sequence
tcctttagctcccatttgaa

SEQ ID NO: 409109 - DNA, 20 bp, Artificial
  CRISPR gRNA sequence
tagctcccatttgaaagtga

SEQ ID NO: 409110 - DNA, 20 bp, Artificial
  CRISPR gRNA sequence
agctcccatttgaaagtgag

SEQ ID NO: 409111 - DNA, 20 bp, Artificial
  CRISPR gRNA sequence
gctcccatttgaaagtgaga

SEQ ID NO: 409112 - DNA, 20 bp, Artificial
  CRISPR gRNA sequence
ccatttgaaagtgagaacat

SEQ ID NO: 409113 - DNA, 20 bp, Artificial
  CRISPR gRNA sequence
gaaagtgagaacatgtggta

SEQ ID NO: 409114 - DNA, 20 bp, Artificial
  CRISPR gRNA sequence
aaagtgagaacatgtggtat

SEQ ID NO: 409115 - DNA, 20 bp, Artificial
  CRISPR gRNA sequence
ggttttcaattcctgcatta

SEQ ID NO: 409116 - DNA, 20 bp, Artificial
  CRISPR gRNA sequence
gttttcaattcctgcattag

SEQ ID NO: 409117 - DNA, 20 bp, Artificial
  CRISPR gRNA sequence
tcaattcctgcattagttta

SEQ ID NO: 409118 - DNA, 20 bp, Artificial
  CRISPR gRNA sequence
caattcctgcattagtttac

SEQ ID NO: 409119 - DNA, 20 bp, Artificial
  CRISPR gRNA sequence
aattcctgcattagtttact

SEQ ID NO: 409120 - DNA, 20 bp, Artificial
  CRISPR gRNA sequence
ctgcattagtttactgagga

SEQ ID NO: 409121 - DNA, 20 bp, Artificial
  CRISPR gRNA sequence
cattagtttactgaggataa

SEQ ID NO: 409122 - DNA, 20 bp, Artificial
  CRISPR gRNA sequence
gtttactgaggataatagcc

SEQ ID NO: 409123 - DNA, 20 bp, Artificial
  CRISPR gRNA sequence
actgaggataatagcctcca

SEQ ID NO: 409124 - DNA, 20 bp, Artificial
  CRISPR gRNA sequence
ctgaggataatagcctccag

SEQ ID NO: 409125 - DNA, 20 bp, Artificial
  CRISPR gRNA sequence
aggataatagcctccagctg

SEQ ID NO: 409126 - DNA, 20 bp, Artificial
  CRISPR gRNA sequence
cagctgcatccatgttccca

SEQ ID NO: 409127 - DNA, 20 bp, Artificial
  CRISPR gRNA sequence
catccatgttcccacaaaac

SEQ ID NO: 409128 - DNA, 20 bp, Artificial
  CRISPR gRNA sequence
ccacaaaacatatgatctca

SEQ ID NO: 409129 - DNA, 20 bp, Artificial
  CRISPR gRNA sequence
attcttttttatggctgcat

SEQ ID NO: 409130 - DNA, 20 bp, Artificial
  CRISPR gRNA sequence
ttttttatggctgcatagta

SEQ ID NO: 409131 - DNA, 20 bp, Artificial
  CRISPR gRNA sequence
ttttatggctgcatagtatt

SEQ ID NO: 409132 - DNA, 20 bp, Artificial
  CRISPR gRNA sequence
tttatggctgcatagtattc

SEQ ID NO: 409133 - DNA, 20 bp, Artificial
  CRISPR gRNA sequence
ttatggctgcatagtattcc

SEQ ID NO: 409134 - DNA, 20 bp, Artificial
  CRISPR gRNA sequence
tatggctgcatagtattcca

SEQ ID NO: 409135 - DNA, 20 bp, Artificial
  CRISPR gRNA sequence
atggctgcatagtattccat

SEQ ID NO: 409136 - DNA, 20 bp, Artificial
  CRISPR gRNA sequence
tggctgcatagtattccatg

SEQ ID NO: 409137 - DNA, 20 bp, Artificial
  CRISPR gRNA sequence
catagtattccatgatgaat

SEQ ID NO: 409138 - DNA, 20 bp, Artificial
  CRISPR gRNA sequence
catgatgaatatgtaacaca

SEQ ID NO: 409139 - DNA, 20 bp, Artificial
  CRISPR gRNA sequence
tctttatcccatctgtcact

SEQ ID NO: 409140 - DNA, 20 bp, Artificial
  CRISPR gRNA sequence
ctttatcccatctgtcactg

SEQ ID NO: 409141 - DNA, 20 bp, Artificial
  CRISPR gRNA sequence
tttatcccatctgtcactga

SEQ ID NO: 409142 - DNA, 20 bp, Artificial
  CRISPR gRNA sequence
tatcccatctgtcactgatg

SEQ ID NO: 409143 - DNA, 20 bp, Artificial
  CRISPR gRNA sequence
atcccatctgtcactgatgg

SEQ ID NO: 409144 - DNA, 20 bp, Artificial
  CRISPR gRNA sequence
tcccatctgtcactgatgga

SEQ ID NO: 409145 - DNA, 20 bp, Artificial
  CRISPR gRNA sequence
tcactgatggacgtttaggt

SEQ ID NO: 409146 - DNA, 20 bp, Artificial
  CRISPR gRNA sequence
atggacgtttaggttgattt

SEQ ID NO: 409147 - DNA, 20 bp, Artificial
  CRISPR gRNA sequence
aggttgatttcatgtctttg

SEQ ID NO: 409148 - DNA, 20 bp, Artificial
  CRISPR gRNA sequence
ggttgatttcatgtctttgc

SEQ ID NO: 409149 - DNA, 20 bp, Artificial
  CRISPR gRNA sequence
atttcatgtctttgctattg

SEQ ID NO: 409150 - DNA, 20 bp, Artificial
  CRISPR gRNA sequence
catgtctttgctattgtgat

SEQ ID NO: 409151 - DNA, 20 bp, Artificial
  CRISPR gRNA sequence
atgtctttgctattgtgatt

SEQ ID NO: 409152 - DNA, 20 bp, Artificial
  CRISPR gRNA sequence
tgctattgtgattagtgctg

SEQ ID NO: 409153 - DNA, 20 bp, Artificial
  CRISPR gRNA sequence
gctattgtgattagtgctgc

SEQ ID NO: 409154 - DNA, 20 bp, Artificial
  CRISPR gRNA sequence
ctattgtgattagtgctgca

SEQ ID NO: 409155 - DNA, 20 bp, Artificial
  CRISPR gRNA sequence
ttgtgattagtgctgcagtg

SEQ ID NO: 409156 - DNA, 20 bp, Artificial
  CRISPR gRNA sequence
tgattagtgctgcagtgaac

SEQ ID NO: 409157 - DNA, 20 bp, Artificial
  CRISPR gRNA sequence
gtgctgcagtgaacattcat

SEQ ID NO: 409158 - DNA, 20 bp, Artificial
  CRISPR gRNA sequence
cagtgaacattcatgtacat

SEQ ID NO: 409159 - DNA, 20 bp, Artificial
  CRISPR gRNA sequence
atgtacatatgtgtctttat

SEQ ID NO: 409160 - DNA, 20 bp, Artificial
  CRISPR gRNA sequence
tatagtgggatgatttatat

SEQ ID NO: 409161 - DNA, 20 bp, Artificial
  CRISPR gRNA sequence
atagtgggatgatttatatt

SEQ ID NO: 409162 - DNA, 20 bp, Artificial
  CRISPR gRNA sequence
tagtgggatgatttatattc

SEQ ID NO: 409163 - DNA, 20 bp, Artificial
  CRISPR gRNA sequence
atattcctctgggtatatgc

SEQ ID NO: 409164 - DNA, 20 bp, Artificial
  CRISPR gRNA sequence
tattcctctgggtatatgcc

SEQ ID NO: 409165 - DNA, 20 bp, Artificial
  CRISPR gRNA sequence
ctctgggtatatgcccagga

SEQ ID NO: 409166 - DNA, 20 bp, Artificial
  CRISPR gRNA sequence
tgggtatatgcccaggaatg

SEQ ID NO: 409167 - DNA, 20 bp, Artificial
  CRISPR gRNA sequence
ggtatatgcccaggaatggg

SEQ ID NO: 409168 - DNA, 20 bp, Artificial
  CRISPR gRNA sequence
ctgggtcaaatggtagttct

SEQ ID NO: 409169 - DNA, 20 bp, Artificial
  CRISPR gRNA sequence
ggtcaaatggtagttctgct

SEQ ID NO: 409170 - DNA, 20 bp, Artificial
  CRISPR gRNA sequence
tgcttttatctctttgagga

SEQ ID NO: 409171 - DNA, 20 bp, Artificial
  CRISPR gRNA sequence
cttttatctctttgaggaat

SEQ ID NO: 409172 - DNA, 20 bp, Artificial
  CRISPR gRNA sequence
ttatctctttgaggaattgc

SEQ ID NO: 409173 - DNA, 20 bp, Artificial
  CRISPR gRNA sequence
tatctctttgaggaattgcc

SEQ ID NO: 409174 - DNA, 20 bp, Artificial
  CRISPR gRNA sequence
atctctttgaggaattgcca

SEQ ID NO: 409175 - DNA, 20 bp, Artificial
  CRISPR gRNA sequence
tctctttgaggaattgccat

SEQ ID NO: 409176 - DNA, 20 bp, Artificial
  CRISPR gRNA sequence
tttgaggaattgccatactg

SEQ ID NO: 409177 - DNA, 20 bp, Artificial
  CRISPR gRNA sequence
tgaggaattgccatactgct

SEQ ID NO: 409178 - DNA, 20 bp, Artificial
  CRISPR gRNA sequence
gaggaattgccatactgctt

SEQ ID NO: 409179 - DNA, 20 bp, Artificial
  CRISPR gRNA sequence
aggaattgccatactgcttt

SEQ ID NO: 409180 - DNA, 20 bp, Artificial
  CRISPR gRNA sequence
ccatactgctttccacaatg

SEQ ID NO: 409181 - DNA, 20 bp, Artificial
  CRISPR gRNA sequence
ctttccacaatggttgaatt

SEQ ID NO: 409182 - DNA, 20 bp, Artificial
  CRISPR gRNA sequence
tccacaatggttgaattaat

SEQ ID NO: 409183 - DNA, 20 bp, Artificial
  CRISPR gRNA sequence
ccacaatggttgaattaatt

SEQ ID NO: 409184 - DNA, 20 bp, Artificial
  CRISPR gRNA sequence
cacaatggttgaattaattt

SEQ ID NO: 409185 - DNA, 20 bp, Artificial
  CRISPR gRNA sequence
aattaatttacactcccacc

SEQ ID NO: 409186 - DNA, 20 bp, Artificial
  CRISPR gRNA sequence
atttacactcccaccaacag

SEQ ID NO: 409187 - DNA, 20 bp, Artificial
  CRISPR gRNA sequence
acactcccaccaacagtgta

SEQ ID NO: 409188 - DNA, 20 bp, Artificial
  CRISPR gRNA sequence
cactcccaccaacagtgtat

SEQ ID NO: 409189 - DNA, 20 bp, Artificial
  CRISPR gRNA sequence
ccaccaacagtgtataagtg

SEQ ID NO: 409190 - DNA, 20 bp, Artificial
  CRISPR gRNA sequence
ccttttctctgcaacctcac

SEQ ID NO: 409191 - DNA, 20 bp, Artificial
  CRISPR gRNA sequence
ttctctgcaacctcaccagc

SEQ ID NO: 409192 - DNA, 20 bp, Artificial
  CRISPR gRNA sequence
tctctgcaacctcaccagca

SEQ ID NO: 409193 - DNA, 20 bp, Artificial
  CRISPR gRNA sequence
ctctgcaacctcaccagcat

SEQ ID NO: 409194 - DNA, 20 bp, Artificial
  CRISPR gRNA sequence
tctgcaacctcaccagcatc

SEQ ID NO: 409195 - DNA, 20 bp, Artificial
  CRISPR gRNA sequence
tgcaacctcaccagcatctg

SEQ ID NO: 409196 - DNA, 20 bp, Artificial
  CRISPR gRNA sequence
caacctcaccagcatctgta

SEQ ID NO: 409197 - DNA, 20 bp, Artificial
  CRISPR gRNA sequence
accagcatctgtaatgtttt

SEQ ID NO: 409198 - DNA, 20 bp, Artificial
  CRISPR gRNA sequence
taatgttttgcctttttagt

SEQ ID NO: 409199 - DNA, 20 bp, Artificial
  CRISPR gRNA sequence
tgcctttttagtaatagcca

SEQ ID NO: 409200 - DNA, 20 bp, Artificial
  CRISPR gRNA sequence
gcctttttagtaatagccat

SEQ ID NO: 409201 - DNA, 20 bp, Artificial
  CRISPR gRNA sequence
cctttttagtaatagccatt

SEQ ID NO: 409202 - DNA, 20 bp, Artificial
  CRISPR gRNA sequence
tttagtaatagccattctga

SEQ ID NO: 409203 - DNA, 20 bp, Artificial
  CRISPR gRNA sequence
ttagtaatagccattctgac

SEQ ID NO: 409204 - DNA, 20 bp, Artificial
  CRISPR gRNA sequence
tagtaatagccattctgact

SEQ ID NO: 409205 - DNA, 20 bp, Artificial
  CRISPR gRNA sequence
agtaatagccattctgactg

SEQ ID NO: 409206 - DNA, 20 bp, Artificial
  CRISPR gRNA sequence
gtaatagccattctgactgg

SEQ ID NO: 409207 - DNA, 20 bp, Artificial
  CRISPR gRNA sequence
tgactggtatgagatggtgt

SEQ ID NO: 409208 - DNA, 20 bp, Artificial
  CRISPR gRNA sequence
actggtatgagatggtgtct

SEQ ID NO: 409209 - DNA, 20 bp, Artificial
  CRISPR gRNA sequence
gtatgagatggtgtctcatt

SEQ ID NO: 409210 - DNA, 20 bp, Artificial
  CRISPR gRNA sequence
attgtcattttggtttgcct

SEQ ID NO: 409211 - DNA, 20 bp, Artificial
  CRISPR gRNA sequence
tcattttggtttgcctttct

SEQ ID NO: 409212 - DNA, 20 bp, Artificial
  CRISPR gRNA sequence
tggtttgcctttctgtaatg

SEQ ID NO: 409213 - DNA, 20 bp, Artificial
  CRISPR gRNA sequence
ggtttgcctttctgtaatga

SEQ ID NO: 409214 - DNA, 20 bp, Artificial
  CRISPR gRNA sequence
gtttgcctttctgtaatgat

SEQ ID NO: 409215 - DNA, 20 bp, Artificial
  CRISPR gRNA sequence
gcctttctgtaatgatgagt

SEQ ID NO: 409216 - DNA, 20 bp, Artificial
  CRISPR gRNA sequence
cctttctgtaatgatgagtg

SEQ ID NO: 409217 - DNA, 20 bp, Artificial
  CRISPR gRNA sequence
tctgtaatgatgagtgatat

SEQ ID NO: 409218 - DNA, 20 bp, Artificial
  CRISPR gRNA sequence
ctgtaatgatgagtgatatt

SEQ ID NO: 409219 - DNA, 20 bp, Artificial
  CRISPR gRNA sequence
tgtaatgatgagtgatattg

SEQ ID NO: 409220 - DNA, 20 bp, Artificial
  CRISPR gRNA sequence
taatgatgagtgatattgag

SEQ ID NO: 409221 - DNA, 20 bp, Artificial
  CRISPR gRNA sequence
agctttttgtcatatgcttg

SEQ ID NO: 409222 - DNA, 20 bp, Artificial
  CRISPR gRNA sequence
tttgtcatatgcttgttggc

SEQ ID NO: 409223 - DNA, 20 bp, Artificial
  CRISPR gRNA sequence
ttgtcatatgcttgttggcc

SEQ ID NO: 409224 - DNA, 20 bp, Artificial
  CRISPR gRNA sequence
tgtcatatgcttgttggcca

SEQ ID NO: 409225 - DNA, 20 bp, Artificial
  CRISPR gRNA sequence
gtcatatgcttgttggccac

SEQ ID NO: 409226 - DNA, 20 bp, Artificial
  CRISPR gRNA sequence
tcatatgcttgttggccacg

SEQ ID NO: 409227 - DNA, 20 bp, Artificial
  CRISPR gRNA sequence
gttggccacgtatatgtctt

SEQ ID NO: 409228 - DNA, 20 bp, Artificial
  CRISPR gRNA sequence
ttggccacgtatatgtcttc

SEQ ID NO: 409229 - DNA, 20 bp, Artificial
  CRISPR gRNA sequence
gccacgtatatgtcttcttt

SEQ ID NO: 409230 - DNA, 20 bp, Artificial
  CRISPR gRNA sequence
cttttgagaagtgtctgttt

SEQ ID NO: 409231 - DNA, 20 bp, Artificial
  CRISPR gRNA sequence
ttttgagaagtgtctgtttg

SEQ ID NO: 409232 - DNA, 20 bp, Artificial
  CRISPR gRNA sequence
ttgagaagtgtctgtttgtg

SEQ ID NO: 409233 - DNA, 20 bp, Artificial
  CRISPR gRNA sequence
tgagaagtgtctgtttgtgt

SEQ ID NO: 409234 - DNA, 20 bp, Artificial
  CRISPR gRNA sequence
gagaagtgtctgtttgtgtc

SEQ ID NO: 409235 - DNA, 20 bp, Artificial
  CRISPR gRNA sequence
agaagtgtctgtttgtgtcc

SEQ ID NO: 409236 - DNA, 20 bp, Artificial
  CRISPR gRNA sequence
tttgtgtcctttacccactt

SEQ ID NO: 409237 - DNA, 20 bp, Artificial
  CRISPR gRNA sequence
gtgtcctttacccacttttt

SEQ ID NO: 409238 - DNA, 20 bp, Artificial
  CRISPR gRNA sequence
tgtcctttacccacttttta

SEQ ID NO: 409239 - DNA, 20 bp, Artificial
  CRISPR gRNA sequence
tacccactttttaatggggt

SEQ ID NO: 409240 - DNA, 20 bp, Artificial
  CRISPR gRNA sequence
acccactttttaatggggtc

SEQ ID NO: 409241 - DNA, 20 bp, Artificial
  CRISPR gRNA sequence
cccactttttaatggggtcg

SEQ ID NO: 409242 - DNA, 20 bp, Artificial
  CRISPR gRNA sequence
tttaatggggtcgttttcct

SEQ ID NO: 409243 - DNA, 20 bp, Artificial
  CRISPR gRNA sequence
ttaatggggtcgttttcctc

SEQ ID NO: 409244 - DNA, 20 bp, Artificial
  CRISPR gRNA sequence
taatggggtcgttttcctct

SEQ ID NO: 409245 - DNA, 20 bp, Artificial
  CRISPR gRNA sequence
aatggggtcgttttcctctt

SEQ ID NO: 409246 - DNA, 20 bp, Artificial
  CRISPR gRNA sequence
atggggtcgttttcctcttg

SEQ ID NO: 409247 - DNA, 20 bp, Artificial
  CRISPR gRNA sequence
tcctcttgtaaatttgctta

SEQ ID NO: 409248 - DNA, 20 bp, Artificial
  CRISPR gRNA sequence
cctcttgtaaatttgcttaa

SEQ ID NO: 409249 - DNA, 20 bp, Artificial
  CRISPR gRNA sequence
ctcttgtaaatttgcttaac

SEQ ID NO: 409250 - DNA, 20 bp, Artificial
  CRISPR gRNA sequence
ttgtaaatttgcttaacttc

SEQ ID NO: 409251 - DNA, 20 bp, Artificial
  CRISPR gRNA sequence
gtaaatttgcttaacttcct

SEQ ID NO: 409252 - DNA, 20 bp, Artificial
  CRISPR gRNA sequence
taaatttgcttaacttcctt

SEQ ID NO: 409253 - DNA, 20 bp, Artificial
  CRISPR gRNA sequence
gcttaacttccttatagatg

SEQ ID NO: 409254 - DNA, 20 bp, Artificial
  CRISPR gRNA sequence
cttaacttccttatagatgc

SEQ ID NO: 409255 - DNA, 20 bp, Artificial
  CRISPR gRNA sequence
aacttccttatagatgctgg

SEQ ID NO: 409256 - DNA, 20 bp, Artificial
  CRISPR gRNA sequence
acttccttatagatgctgga

SEQ ID NO: 409257 - DNA, 20 bp, Artificial
  CRISPR gRNA sequence
ccttatagatgctggatatt

SEQ ID NO: 409258 - DNA, 20 bp, Artificial
  CRISPR gRNA sequence
cttatagatgctggatatta

SEQ ID NO: 409259 - DNA, 20 bp, Artificial
  CRISPR gRNA sequence
atagatgctggatattagac

SEQ ID NO: 409260 - DNA, 20 bp, Artificial
  CRISPR gRNA sequence
tagatgctggatattagacc

SEQ ID NO: 409261 - DNA, 20 bp, Artificial
  CRISPR gRNA sequence
gatattagacctttgtcaga

SEQ ID NO: 409262 - DNA, 20 bp, Artificial
  CRISPR gRNA sequence
gacctttgtcagatgcatag

SEQ ID NO: 409263 - DNA, 20 bp, Artificial
  CRISPR gRNA sequence
tgtcagatgcatagtttgca

SEQ ID NO: 409264 - DNA, 20 bp, Artificial
  CRISPR gRNA sequence
gtcagatgcatagtttgcaa

SEQ ID NO: 409265 - DNA, 20 bp, Artificial
  CRISPR gRNA sequence
tcagatgcatagtttgcaaa

SEQ ID NO: 409266 - DNA, 20 bp, Artificial
  CRISPR gRNA sequence
gcaaatatttcctcccattc

SEQ ID NO: 409267 - DNA, 20 bp, Artificial
  CRISPR gRNA sequence
caaatatttcctcccattct

SEQ ID NO: 409268 - DNA, 20 bp, Artificial
  CRISPR gRNA sequence
cctcccattctttaggttgg

SEQ ID NO: 409269 - DNA, 20 bp, Artificial
  CRISPR gRNA sequence
ctcccattctttaggttggc

SEQ ID NO: 409270 - DNA, 20 bp, Artificial
  CRISPR gRNA sequence
ccattctttaggttggcaaa

SEQ ID NO: 409271 - DNA, 20 bp, Artificial
  CRISPR gRNA sequence
tttaggttggcaaatttttt

SEQ ID NO: 409272 - DNA, 20 bp, Artificial
  CRISPR gRNA sequence
taggttggcaaattttttat

SEQ ID NO: 409273 - DNA, 20 bp, Artificial
  CRISPR gRNA sequence
aggttggcaaattttttatc

SEQ ID NO: 409274 - DNA, 20 bp, Artificial
  CRISPR gRNA sequence
ggttggcaaattttttatcc

SEQ ID NO: 409275 - DNA, 20 bp, Artificial
  CRISPR gRNA sequence
gcaaattttttatccaaaaa

SEQ ID NO: 409276 - DNA, 20 bp, Artificial
  CRISPR gRNA sequence
tttatccaaaaaatattgat

SEQ ID NO: 409277 - DNA, 20 bp, Artificial
  CRISPR gRNA sequence
ttatccaaaaaatattgatt

SEQ ID NO: 409278 - DNA, 20 bp, Artificial
  CRISPR gRNA sequence
tatccaaaaaatattgattg

SEQ ID NO: 409279 - DNA, 20 bp, Artificial
  CRISPR gRNA sequence
atccaaaaaatattgattga

SEQ ID NO: 409280 - DNA, 20 bp, Artificial
  CRISPR gRNA sequence
tccaaaaaatattgattgac

SEQ ID NO: 409281 - DNA, 20 bp, Artificial
  CRISPR gRNA sequence
attgacttctctactttatg

SEQ ID NO: 409282 - DNA, 20 bp, Artificial
  CRISPR gRNA sequence
acttctctactttatgccaa

SEQ ID NO: 409283 - DNA, 20 bp, Artificial
  CRISPR gRNA sequence
ctctactttatgccaagcat

SEQ ID NO: 409284 - DNA, 20 bp, Artificial
  CRISPR gRNA sequence
tctactttatgccaagcatg

SEQ ID NO: 409285 - DNA, 20 bp, Artificial
  CRISPR gRNA sequence
tactttatgccaagcatggt

SEQ ID NO: 409286 - DNA, 20 bp, Artificial
  CRISPR gRNA sequence
ctttatgccaagcatggttc

SEQ ID NO: 409287 - DNA, 20 bp, Artificial
  CRISPR gRNA sequence
tatgccaagcatggttctag

SEQ ID NO: 409288 - DNA, 20 bp, Artificial
  CRISPR gRNA sequence
atgccaagcatggttctagg

SEQ ID NO: 409289 - DNA, 20 bp, Artificial
  CRISPR gRNA sequence
tgccaagcatggttctaggt

SEQ ID NO: 409290 - DNA, 20 bp, Artificial
  CRISPR gRNA sequence
taggtgctaagtacagagca

SEQ ID NO: 409291 - DNA, 20 bp, Artificial
  CRISPR gRNA sequence
ggtgctaagtacagagcagt

SEQ ID NO: 409292 - DNA, 20 bp, Artificial
  CRISPR gRNA sequence
agtacagagcagtgtaaaat

SEQ ID NO: 409293 - DNA, 20 bp, Artificial
  CRISPR gRNA sequence
gctatacagaggcttgggtt

SEQ ID NO: 409294 - DNA, 20 bp, Artificial
  CRISPR gRNA sequence
tacagaggcttgggtttacg

SEQ ID NO: 409295 - DNA, 20 bp, Artificial
  CRISPR gRNA sequence
gggtttacgaagctgacagt

SEQ ID NO: 409296 - DNA, 20 bp, Artificial
  CRISPR gRNA sequence
ggtttacgaagctgacagta

SEQ ID NO: 409297 - DNA, 20 bp, Artificial
  CRISPR gRNA sequence
acgaagctgacagtaaaatg

SEQ ID NO: 409298 - DNA, 20 bp, Artificial
  CRISPR gRNA sequence
cgaagctgacagtaaaatga

SEQ ID NO: 409299 - DNA, 20 bp, Artificial
  CRISPR gRNA sequence
acagtaaaatgactcagggt

SEQ ID NO: 409300 - DNA, 20 bp, Artificial
  CRISPR gRNA sequence
agggttttgtgaagtgggtg

SEQ ID NO: 409301 - DNA, 20 bp, Artificial
  CRISPR gRNA sequence
tgtgaagtgggtgaaggatt

SEQ ID NO: 409302 - DNA, 20 bp, Artificial
  CRISPR gRNA sequence
gtgaagtgggtgaaggattt

SEQ ID NO: 409303 - DNA, 20 bp, Artificial
  CRISPR gRNA sequence
tgaagtgggtgaaggatttt

SEQ ID NO: 409304 - DNA, 20 bp, Artificial
  CRISPR gRNA sequence
tgcagagctgctcaaactgc

SEQ ID NO: 409305 - DNA, 20 bp, Artificial
  CRISPR gRNA sequence
gcagagctgctcaaactgca

SEQ ID NO: 409306 - DNA, 20 bp, Artificial
  CRISPR gRNA sequence
cagagctgctcaaactgcat

SEQ ID NO: 409307 - DNA, 20 bp, Artificial
  CRISPR gRNA sequence
ctcaaactgcatatgcagaa

SEQ ID NO: 409308 - DNA, 20 bp, Artificial
  CRISPR gRNA sequence
aaactgcatatgcagaactg

SEQ ID NO: 409309 - DNA, 20 bp, Artificial
  CRISPR gRNA sequence
catatgcagaactgttgacc

SEQ ID NO: 409310 - DNA, 20 bp, Artificial
  CRISPR gRNA sequence
ttgaccagtgaggatggtga

SEQ ID NO: 409311 - DNA, 20 bp, Artificial
  CRISPR gRNA sequence
accagtgaggatggtgagga

SEQ ID NO: 409312 - DNA, 20 bp, Artificial
  CRISPR gRNA sequence
gtgggcaggggcagtggcat

SEQ ID NO: 409313 - DNA, 20 bp, Artificial
  CRISPR gRNA sequence
ggggtacccaggacatgagc

SEQ ID NO: 409314 - DNA, 20 bp, Artificial
  CRISPR gRNA sequence
gggtacccaggacatgagca

SEQ ID NO: 409315 - DNA, 20 bp, Artificial
  CRISPR gRNA sequence
gaaaagtgatgaagcactga

SEQ ID NO: 409316 - DNA, 20 bp, Artificial
  CRISPR gRNA sequence
aaataatttccaaggatgat

SEQ ID NO: 409317 - DNA, 20 bp, Artificial
  CRISPR gRNA sequence
ccaaggatgatttgtggtca

SEQ ID NO: 409318 - DNA, 20 bp, Artificial
  CRISPR gRNA sequence
caaggatgatttgtggtcaa

SEQ ID NO: 409319 - DNA, 20 bp, Artificial
  CRISPR gRNA sequence
gtggtcaagccagagaagcc

SEQ ID NO: 409320 - DNA, 20 bp, Artificial
  CRISPR gRNA sequence
tggtcaagccagagaagcca

SEQ ID NO: 409321 - DNA, 20 bp, Artificial
  CRISPR gRNA sequence
aatcatgatatcctgcaata

SEQ ID NO: 409322 - DNA, 20 bp, Artificial
  CRISPR gRNA sequence
atcatgatatcctgcaataa

SEQ ID NO: 409323 - DNA, 20 bp, Artificial
  CRISPR gRNA sequence
caataaaaatcatgggaaaa

SEQ ID NO: 409324 - DNA, 20 bp, Artificial
  CRISPR gRNA sequence
ttcaatgtttattctaagta

SEQ ID NO: 409325 - DNA, 20 bp, Artificial
  CRISPR gRNA sequence
aatgtttattctaagtatta

SEQ ID NO: 409326 - DNA, 20 bp, Artificial
  CRISPR gRNA sequence
attctaagtattaatacgta

SEQ ID NO: 409327 - DNA, 20 bp, Artificial
  CRISPR gRNA sequence
ttctaagtattaatacgtag

SEQ ID NO: 409328 - DNA, 20 bp, Artificial
  CRISPR gRNA sequence
taagtattaatacgtagcta

SEQ ID NO: 409329 - DNA, 20 bp, Artificial
  CRISPR gRNA sequence
agtattaatacgtagctaca

SEQ ID NO: 409330 - DNA, 20 bp, Artificial
  CRISPR gRNA sequence
atacgtagctacatataagt

SEQ ID NO: 409331 - DNA, 20 bp, Artificial
  CRISPR gRNA sequence
catataagtataagctggtt

SEQ ID NO: 409332 - DNA, 20 bp, Artificial
  CRISPR gRNA sequence
gttttcattatttgtatttg

SEQ ID NO: 409333 - DNA, 20 bp, Artificial
  CRISPR gRNA sequence
tcattatttgtatttgtttt

SEQ ID NO: 409334 - DNA, 20 bp, Artificial
  CRISPR gRNA sequence
cattatttgtatttgtttta

SEQ ID NO: 409335 - DNA, 20 bp, Artificial
  CRISPR gRNA sequence
attatttgtatttgttttat

SEQ ID NO: 409336 - DNA, 20 bp, Artificial
  CRISPR gRNA sequence
tttgtatttgttttattgaa

SEQ ID NO: 409337 - DNA, 20 bp, Artificial
  CRISPR gRNA sequence
gtatttgttttattgaaatc

SEQ ID NO: 409338 - DNA, 20 bp, Artificial
  CRISPR gRNA sequence
tatttgttttattgaaatca

SEQ ID NO: 409339 - DNA, 20 bp, Artificial
  CRISPR gRNA sequence
gttttattgaaatcaaattt

SEQ ID NO: 409340 - DNA, 20 bp, Artificial
  CRISPR gRNA sequence
ttttattgaaatcaaatttt

SEQ ID NO: 409341 - DNA, 20 bp, Artificial
  CRISPR gRNA sequence
tattgaaatcaaattttttt

SEQ ID NO: 409342 - DNA, 20 bp, Artificial
  CRISPR gRNA sequence
attgaaatcaaatttttttc

SEQ ID NO: 409343 - DNA, 20 bp, Artificial
  CRISPR gRNA sequence
ttgaaatcaaatttttttct

SEQ ID NO: 409344 - DNA, 20 bp, Artificial
  CRISPR gRNA sequence
aaatcaaatttttttcttcc

SEQ ID NO: 409345 - DNA, 20 bp, Artificial
  CRISPR gRNA sequence
ttttcttcccaattaactac

SEQ ID NO: 409346 - DNA, 20 bp, Artificial
  CRISPR gRNA sequence
tttcttcccaattaactacg

SEQ ID NO: 409347 - DNA, 20 bp, Artificial
  CRISPR gRNA sequence
ttcttcccaattaactacga

SEQ ID NO: 409348 - DNA, 20 bp, Artificial
  CRISPR gRNA sequence
tcttcccaattaactacgac

SEQ ID NO: 409349 - DNA, 20 bp, Artificial
  CRISPR gRNA sequence
cttcccaattaactacgaca

SEQ ID NO: 409350 - DNA, 20 bp, Artificial
  CRISPR gRNA sequence
ttcccaattaactacgacat

SEQ ID NO: 409351 - DNA, 20 bp, Artificial
  CRISPR gRNA sequence
cccaattaactacgacattt

SEQ ID NO: 409352 - DNA, 20 bp, Artificial
  CRISPR gRNA sequence
ccaattaactacgacatttt

SEQ ID NO: 409353 - DNA, 20 bp, Artificial
  CRISPR gRNA sequence
actacgacattttggtctgt

SEQ ID NO: 409354 - DNA, 20 bp, Artificial
  CRISPR gRNA sequence
cgacattttggtctgtttca

SEQ ID NO: 409355 - DNA, 20 bp, Artificial
  CRISPR gRNA sequence
tggtctgtttcacgtgaatc

SEQ ID NO: 409356 - DNA, 20 bp, Artificial
  CRISPR gRNA sequence
ggtctgtttcacgtgaatcc

SEQ ID NO: 409357 - DNA, 20 bp, Artificial
  CRISPR gRNA sequence
gtctgtttcacgtgaatcca

SEQ ID NO: 409358 - DNA, 20 bp, Artificial
  CRISPR gRNA sequence
tttcacgtgaatccactttc

SEQ ID NO: 409359 - DNA, 20 bp, Artificial
  CRISPR gRNA sequence
cacgtgaatccactttccaa

SEQ ID NO: 409360 - DNA, 20 bp, Artificial
  CRISPR gRNA sequence
acgtgaatccactttccaat

SEQ ID NO: 409361 - DNA, 20 bp, Artificial
  CRISPR gRNA sequence
tccaattccaagttcatcag

SEQ ID NO: 409362 - DNA, 20 bp, Artificial
  CRISPR gRNA sequence
ccaattccaagttcatcagg

SEQ ID NO: 409363 - DNA, 20 bp, Artificial
  CRISPR gRNA sequence
caattccaagttcatcagga

SEQ ID NO: 409364 - DNA, 20 bp, Artificial
  CRISPR gRNA sequence
caagttcatcaggatcccac

SEQ ID NO: 409365 - DNA, 20 bp, Artificial
  CRISPR gRNA sequence
atcaggatcccacggttctc

SEQ ID NO: 409366 - DNA, 20 bp, Artificial
  CRISPR gRNA sequence
tcttgtttgtgtgggctctt

SEQ ID NO: 409367 - DNA, 20 bp, Artificial
  CRISPR gRNA sequence
ttgtttgtgtgggctctttc

SEQ ID NO: 409368 - DNA, 20 bp, Artificial
  CRISPR gRNA sequence
gtttgtgtgggctctttctg

SEQ ID NO: 409369 - DNA, 20 bp, Artificial
  CRISPR gRNA sequence
tttgtgtgggctctttctgg

SEQ ID NO: 409370 - DNA, 20 bp, Artificial
  CRISPR gRNA sequence
gtgtgggctctttctggcag

SEQ ID NO: 409371 - DNA, 20 bp, Artificial
  CRISPR gRNA sequence
tgtgggctctttctggcagt

SEQ ID NO: 409372 - DNA, 20 bp, Artificial
  CRISPR gRNA sequence
tttctggcagttcttttcaa

SEQ ID NO: 409373 - DNA, 20 bp, Artificial
  CRISPR gRNA sequence
tctggcagttcttttcaagg

SEQ ID NO: 409374 - DNA, 20 bp, Artificial
  CRISPR gRNA sequence
ctggcagttcttttcaaggt

SEQ ID NO: 409375 - DNA, 20 bp, Artificial
  CRISPR gRNA sequence
tggcagttcttttcaaggtc

SEQ ID NO: 409376 - DNA, 20 bp, Artificial
  CRISPR gRNA sequence
gcagttcttttcaaggtcat

SEQ ID NO: 409377 - DNA, 20 bp, Artificial
  CRISPR gRNA sequence
ttttcaaggtcattttgagc

SEQ ID NO: 409378 - DNA, 20 bp, Artificial
  CRISPR gRNA sequence
ttcaaggtcattttgagctg

SEQ ID NO: 409379 - DNA, 20 bp, Artificial
  CRISPR gRNA sequence
tcaaggtcattttgagctgc

SEQ ID NO: 409380 - DNA, 20 bp, Artificial
  CRISPR gRNA sequence
caaggtcattttgagctgcc

SEQ ID NO: 409381 - DNA, 20 bp, Artificial
  CRISPR gRNA sequence
aaggtcattttgagctgcct

SEQ ID NO: 409382 - DNA, 20 bp, Artificial
  CRISPR gRNA sequence
tgagctgccttccactgagc

SEQ ID NO: 409383 - DNA, 20 bp, Artificial
  CRISPR gRNA sequence
gagctgccttccactgagct

SEQ ID NO: 409384 - DNA, 20 bp, Artificial
  CRISPR gRNA sequence
agctgccttccactgagctt

SEQ ID NO: 409385 - DNA, 20 bp, Artificial
  CRISPR gRNA sequence
ccttccactgagctttgcag

SEQ ID NO: 409386 - DNA, 20 bp, Artificial
  CRISPR gRNA sequence
ccactgagctttgcaggaag

SEQ ID NO: 409387 - DNA, 20 bp, Artificial
  CRISPR gRNA sequence
cactgagctttgcaggaaga

SEQ ID NO: 409388 - DNA, 20 bp, Artificial
  CRISPR gRNA sequence
agctttgcaggaagagcctg

SEQ ID NO: 409389 - DNA, 20 bp, Artificial
  CRISPR gRNA sequence
tgcaggaagagcctgtggtc

SEQ ID NO: 409390 - DNA, 20 bp, Artificial
  CRISPR gRNA sequence
gcaggaagagcctgtggtct

SEQ ID NO: 409391 - DNA, 20 bp, Artificial
  CRISPR gRNA sequence
caggaagagcctgtggtctg

SEQ ID NO: 409392 - DNA, 20 bp, Artificial
  CRISPR gRNA sequence
tggtctgagaagccacaagc

SEQ ID NO: 409393 - DNA, 20 bp, Artificial
  CRISPR gRNA sequence
agaagccacaagcaatatct

SEQ ID NO: 409394 - DNA, 20 bp, Artificial
  CRISPR gRNA sequence
aggcaaggcaggtttggccg

SEQ ID NO: 409395 - DNA, 20 bp, Artificial
  CRISPR gRNA sequence
ggccgacctcgtaataggtc

SEQ ID NO: 409396 - DNA, 20 bp, Artificial
  CRISPR gRNA sequence
gccgacctcgtaataggtct

SEQ ID NO: 409397 - DNA, 20 bp, Artificial
  CRISPR gRNA sequence
gtaataggtcttgattttca

SEQ ID NO: 409398 - DNA, 20 bp, Artificial
  CRISPR gRNA sequence
gattttcatctaacaccaat

SEQ ID NO: 409399 - DNA, 20 bp, Artificial
  CRISPR gRNA sequence
attttcatctaacaccaatc

SEQ ID NO: 409400 - DNA, 20 bp, Artificial
  CRISPR gRNA sequence
tcatctaacaccaatcagtt

SEQ ID NO: 409401 - DNA, 20 bp, Artificial
  CRISPR gRNA sequence
catctaacaccaatcagtta

SEQ ID NO: 409402 - DNA, 20 bp, Artificial
  CRISPR gRNA sequence
atctaacaccaatcagttac

SEQ ID NO: 409403 - DNA, 20 bp, Artificial
  CRISPR gRNA sequence
acaccaatcagttactctgt

SEQ ID NO: 409404 - DNA, 20 bp, Artificial
  CRISPR gRNA sequence
ctctgtttgtcaggaaaggt

SEQ ID NO: 409405 - DNA, 20 bp, Artificial
  CRISPR gRNA sequence
tgtttgtcaggaaaggttaa

SEQ ID NO: 409406 - DNA, 20 bp, Artificial
  CRISPR gRNA sequence
tttgtcaggaaaggttaatc

SEQ ID NO: 409407 - DNA, 20 bp, Artificial
  CRISPR gRNA sequence
gtcaggaaaggttaatcagg

SEQ ID NO: 409408 - DNA, 20 bp, Artificial
  CRISPR gRNA sequence
tcaggaaaggttaatcaggg

SEQ ID NO: 409409 - DNA, 20 bp, Artificial
  CRISPR gRNA sequence
atcaggggctactctgagct

SEQ ID NO: 409410 - DNA, 20 bp, Artificial
  CRISPR gRNA sequence
ctctgagcttctgaaccacc

SEQ ID NO: 409411 - DNA, 20 bp, Artificial
  CRISPR gRNA sequence
tgagcttctgaaccacctgg

SEQ ID NO: 409412 - DNA, 20 bp, Artificial
  CRISPR gRNA sequence
agcttctgaaccacctggct

SEQ ID NO: 409413 - DNA, 20 bp, Artificial
  CRISPR gRNA sequence
ctgaaccacctggctctagg

SEQ ID NO: 409414 - DNA, 20 bp, Artificial
  CRISPR gRNA sequence
tgaaccacctggctctaggg

SEQ ID NO: 409415 - DNA, 20 bp, Artificial
  CRISPR gRNA sequence
aaccacctggctctagggtt

SEQ ID NO: 409416 - DNA, 20 bp, Artificial
  CRISPR gRNA sequence
gctctagggttgggaaccac

SEQ ID NO: 409417 - DNA, 20 bp, Artificial
  CRISPR gRNA sequence
tagggttgggaaccacttct

SEQ ID NO: 409418 - DNA, 20 bp, Artificial
  CRISPR gRNA sequence
gggttgggaaccacttcttt

SEQ ID NO: 409419 - DNA, 20 bp, Artificial
  CRISPR gRNA sequence
ggaaccacttctttcacctc

SEQ ID NO: 409420 - DNA, 20 bp, Artificial
  CRISPR gRNA sequence
ctttcacctccaggctgagt

SEQ ID NO: 409421 - DNA, 20 bp, Artificial
  CRISPR gRNA sequence
tttcacctccaggctgagtc

SEQ ID NO: 409422 - DNA, 20 bp, Artificial
  CRISPR gRNA sequence
tcacctccaggctgagtcta

SEQ ID NO: 409423 - DNA, 20 bp, Artificial
  CRISPR gRNA sequence
cacctccaggctgagtctat

SEQ ID NO: 409424 - DNA, 20 bp, Artificial
  CRISPR gRNA sequence
acctccaggctgagtctatt

SEQ ID NO: 409425 - DNA, 20 bp, Artificial
  CRISPR gRNA sequence
caggctgagtctattgagag

SEQ ID NO: 409426 - DNA, 20 bp, Artificial
  CRISPR gRNA sequence
agtctattgagaggcgggtc

SEQ ID NO: 409427 - DNA, 20 bp, Artificial
  CRISPR gRNA sequence
ttgagaggcgggtctaggtc

SEQ ID NO: 409428 - DNA, 20 bp, Artificial
  CRISPR gRNA sequence
agaggcgggtctaggtcctc

SEQ ID NO: 409429 - DNA, 20 bp, Artificial
  CRISPR gRNA sequence
ggtcctcacatggagcctct

SEQ ID NO: 409430 - DNA, 20 bp, Artificial
  CRISPR gRNA sequence
acatggagcctctgctgtaa

SEQ ID NO: 409431 - DNA, 20 bp, Artificial
  CRISPR gRNA sequence
tgctgtaacctccctgcact

SEQ ID NO: 409432 - DNA, 20 bp, Artificial
  CRISPR gRNA sequence
ctgtaacctccctgcacttt

SEQ ID NO: 409433 - DNA, 20 bp, Artificial
  CRISPR gRNA sequence
taacctccctgcactttgct

SEQ ID NO: 409434 - DNA, 20 bp, Artificial
  CRISPR gRNA sequence
cctgcactttgctccccaaa

SEQ ID NO: 409435 - DNA, 20 bp, Artificial
  CRISPR gRNA sequence
cactttgctccccaaagaca

SEQ ID NO: 409436 - DNA, 20 bp, Artificial
  CRISPR gRNA sequence
tgctccccaaagacagctgc

SEQ ID NO: 409437 - DNA, 20 bp, Artificial
  CRISPR gRNA sequence
gctccccaaagacagctgca

SEQ ID NO: 409438 - DNA, 20 bp, Artificial
  CRISPR gRNA sequence
ctccccaaagacagctgcat

SEQ ID NO: 409439 - DNA, 20 bp, Artificial
  CRISPR gRNA sequence
cccaaagacagctgcatccc

SEQ ID NO: 409440 - DNA, 20 bp, Artificial
  CRISPR gRNA sequence
catcccctctaggattttcc

SEQ ID NO: 409441 - DNA, 20 bp, Artificial
  CRISPR gRNA sequence
taggattttccccattgctt

SEQ ID NO: 409442 - DNA, 20 bp, Artificial
  CRISPR gRNA sequence
ggattttccccattgcttcc

SEQ ID NO: 409443 - DNA, 20 bp, Artificial
  CRISPR gRNA sequence
tccccattgcttcctgcatt

SEQ ID NO: 409444 - DNA, 20 bp, Artificial
  CRISPR gRNA sequence
ccccattgcttcctgcattg

SEQ ID NO: 409445 - DNA, 20 bp, Artificial
  CRISPR gRNA sequence
cccattgcttcctgcattgt

SEQ ID NO: 409446 - DNA, 20 bp, Artificial
  CRISPR gRNA sequence
cttcctgcattgtcctttgt

SEQ ID NO: 409447 - DNA, 20 bp, Artificial
  CRISPR gRNA sequence
cctgcattgtcctttgtgaa

SEQ ID NO: 409448 - DNA, 20 bp, Artificial
  CRISPR gRNA sequence
ctgcattgtcctttgtgaaa

SEQ ID NO: 409449 - DNA, 20 bp, Artificial
  CRISPR gRNA sequence
cattgtcctttgtgaaaatg

SEQ ID NO: 409450 - DNA, 20 bp, Artificial
  CRISPR gRNA sequence
tcctttgtgaaaatgcagac

SEQ ID NO: 409451 - DNA, 20 bp, Artificial
  CRISPR gRNA sequence
tgtgaaaatgcagacacggc

SEQ ID NO: 409452 - DNA, 20 bp, Artificial
  CRISPR gRNA sequence
gtgaaaatgcagacacggct

SEQ ID NO: 409453 - DNA, 20 bp, Artificial
  CRISPR gRNA sequence
tgaaaatgcagacacggcta

SEQ ID NO: 409454 - DNA, 20 bp, Artificial
  CRISPR gRNA sequence
tgagtagacccctgtttcta

SEQ ID NO: 409455 - DNA, 20 bp, Artificial
  CRISPR gRNA sequence
tttctacctgagtcggcagg

SEQ ID NO: 409456 - DNA, 20 bp, Artificial
  CRISPR gRNA sequence
ctacctgagtcggcaggttc

SEQ ID NO: 409457 - DNA, 20 bp, Artificial
  CRISPR gRNA sequence
tacctgagtcggcaggttca

SEQ ID NO: 409458 - DNA, 20 bp, Artificial
  CRISPR gRNA sequence
cctgagtcggcaggttcacg

SEQ ID NO: 409459 - DNA, 20 bp, Artificial
  CRISPR gRNA sequence
agtcggcaggttcacggggg

SEQ ID NO: 409460 - DNA, 20 bp, Artificial
  CRISPR gRNA sequence
acgggggcctgacagcatgg

SEQ ID NO: 409461 - DNA, 20 bp, Artificial
  CRISPR gRNA sequence
acagcatggttttggttaga

SEQ ID NO: 409462 - DNA, 20 bp, Artificial
  CRISPR gRNA sequence
tggttagataggcagacaaa

SEQ ID NO: 409463 - DNA, 20 bp, Artificial
  CRISPR gRNA sequence
ggttagataggcagacaaag

SEQ ID NO: 409464 - DNA, 20 bp, Artificial
  CRISPR gRNA sequence
gttagataggcagacaaagg

SEQ ID NO: 409465 - DNA, 20 bp, Artificial
  CRISPR gRNA sequence
gataggcagacaaaggaaac

SEQ ID NO: 409466 - DNA, 20 bp, Artificial
  CRISPR gRNA sequence
ctgagattggacggggcggc

SEQ ID NO: 409467 - DNA, 20 bp, Artificial
  CRISPR gRNA sequence
agattggacggggcggcatc

SEQ ID NO: 409468 - DNA, 20 bp, Artificial
  CRISPR gRNA sequence
gacggggcggcatccagaga

SEQ ID NO: 409469 - DNA, 20 bp, Artificial
  CRISPR gRNA sequence
tgcgtgtgagcactgaggac

SEQ ID NO: 409470 - DNA, 20 bp, Artificial
  CRISPR gRNA sequence
aggacacgcattcacgctgc

SEQ ID NO: 409471 - DNA, 20 bp, Artificial
  CRISPR gRNA sequence
acgctgcctcttacttccca

SEQ ID NO: 409472 - DNA, 20 bp, Artificial
  CRISPR gRNA sequence
cctcttacttcccagggacc

SEQ ID NO: 409473 - DNA, 20 bp, Artificial
  CRISPR gRNA sequence
ttacttcccagggaccagaa

SEQ ID NO: 409474 - DNA, 20 bp, Artificial
  CRISPR gRNA sequence
acttcccagggaccagaagg

SEQ ID NO: 409475 - DNA, 20 bp, Artificial
  CRISPR gRNA sequence
cttcccagggaccagaaggg

SEQ ID NO: 409476 - DNA, 20 bp, Artificial
  CRISPR gRNA sequence
cccagggaccagaagggctc

SEQ ID NO: 409477 - DNA, 20 bp, Artificial
  CRISPR gRNA sequence
ccagggaccagaagggctca

SEQ ID NO: 409478 - DNA, 20 bp, Artificial
  CRISPR gRNA sequence
acatgaaagtcgatttctcc

SEQ ID NO: 409479 - DNA, 20 bp, Artificial
  CRISPR gRNA sequence
ctcctcctttttttcatttc

SEQ ID NO: 409480 - DNA, 20 bp, Artificial
  CRISPR gRNA sequence
tcctcctttttttcatttct

SEQ ID NO: 409481 - DNA, 20 bp, Artificial
  CRISPR gRNA sequence
ctcctttttttcatttcttt

SEQ ID NO: 409482 - DNA, 20 bp, Artificial
  CRISPR gRNA sequence
ctttttttcatttcttttat

SEQ ID NO: 409483 - DNA, 20 bp, Artificial
  CRISPR gRNA sequence
tttttcatttcttttatgtt

SEQ ID NO: 409484 - DNA, 20 bp, Artificial
  CRISPR gRNA sequence
ttttcatttcttttatgttc

SEQ ID NO: 409485 - DNA, 20 bp, Artificial
  CRISPR gRNA sequence
tttcatttcttttatgttct

SEQ ID NO: 409486 - DNA, 20 bp, Artificial
  CRISPR gRNA sequence
ttcatttcttttatgttctt

SEQ ID NO: 409487 - DNA, 20 bp, Artificial
  CRISPR gRNA sequence
tcatttcttttatgttcttt

SEQ ID NO: 409488 - DNA, 20 bp, Artificial
  CRISPR gRNA sequence
catttcttttatgttctttc

SEQ ID NO: 409489 - DNA, 20 bp, Artificial
  CRISPR gRNA sequence
atttcttttatgttctttca

SEQ ID NO: 409490 - DNA, 20 bp, Artificial
  CRISPR gRNA sequence
cttttatgttctttcatttc

SEQ ID NO: 409491 - DNA, 20 bp, Artificial
  CRISPR gRNA sequence
ttttatgttctttcatttct

SEQ ID NO: 409492 - DNA, 20 bp, Artificial
  CRISPR gRNA sequence
ttatgttctttcatttctcc

SEQ ID NO: 409493 - DNA, 20 bp, Artificial
  CRISPR gRNA sequence
tatgttctttcatttctcca

SEQ ID NO: 409494 - DNA, 20 bp, Artificial
  CRISPR gRNA sequence
atgttctttcatttctccac

SEQ ID NO: 409495 - DNA, 20 bp, Artificial
  CRISPR gRNA sequence
tgttctttcatttctccaca

SEQ ID NO: 409496 - DNA, 20 bp, Artificial
  CRISPR gRNA sequence
tttcatttctccacatggtg

SEQ ID NO: 409497 - DNA, 20 bp, Artificial
  CRISPR gRNA sequence
tcatttctccacatggtgtg

SEQ ID NO: 409498 - DNA, 20 bp, Artificial
  CRISPR gRNA sequence
catttctccacatggtgtgc

SEQ ID NO: 409499 - DNA, 20 bp, Artificial
  CRISPR gRNA sequence
atttctccacatggtgtgct

SEQ ID NO: 409500 - DNA, 20 bp, Artificial
  CRISPR gRNA sequence
ctccacatggtgtgctagca

SEQ ID NO: 409501 - DNA, 20 bp, Artificial
  CRISPR gRNA sequence
tccacatggtgtgctagcat

SEQ ID NO: 409502 - DNA, 20 bp, Artificial
  CRISPR gRNA sequence
cacatggtgtgctagcatct

SEQ ID NO: 409503 - DNA, 20 bp, Artificial
  CRISPR gRNA sequence
gcatctgattttatgttgtc

SEQ ID NO: 409504 - DNA, 20 bp, Artificial
  CRISPR gRNA sequence
attttatgttgtcacgcatt

SEQ ID NO: 409505 - DNA, 20 bp, Artificial
  CRISPR gRNA sequence
tatgttgtcacgcatttcct

SEQ ID NO: 409506 - DNA, 20 bp, Artificial
  CRISPR gRNA sequence
atgttgtcacgcatttcctt

SEQ ID NO: 409507 - DNA, 20 bp, Artificial
  CRISPR gRNA sequence
tgttgtcacgcatttccttc

SEQ ID NO: 409508 - DNA, 20 bp, Artificial
  CRISPR gRNA sequence
tcacgcatttccttcttttc

SEQ ID NO: 409509 - DNA, 20 bp, Artificial
  CRISPR gRNA sequence
ccttcttttctcacgtcttc

SEQ ID NO: 409510 - DNA, 20 bp, Artificial
  CRISPR gRNA sequence
cttcttttctcacgtcttcc

SEQ ID NO: 409511 - DNA, 20 bp, Artificial
  CRISPR gRNA sequence
cttttctcacgtcttccttt

SEQ ID NO: 409512 - DNA, 20 bp, Artificial
  CRISPR gRNA sequence
ttttctcacgtcttcctttc

SEQ ID NO: 409513 - DNA, 20 bp, Artificial
  CRISPR gRNA sequence
ttctcacgtcttcctttccc

SEQ ID NO: 409514 - DNA, 20 bp, Artificial
  CRISPR gRNA sequence
tctcacgtcttcctttccct

SEQ ID NO: 409515 - DNA, 20 bp, Artificial
  CRISPR gRNA sequence
ctcacgtcttcctttccctg

SEQ ID NO: 409516 - DNA, 20 bp, Artificial
  CRISPR gRNA sequence
tcacgtcttcctttccctgt

SEQ ID NO: 409517 - DNA, 20 bp, Artificial
  CRISPR gRNA sequence
acgtcttcctttccctgttt

SEQ ID NO: 409518 - DNA, 20 bp, Artificial
  CRISPR gRNA sequence
cctttccctgttttaatttt

SEQ ID NO: 409519 - DNA, 20 bp, Artificial
  CRISPR gRNA sequence
ctttccctgttttaattttt

SEQ ID NO: 409520 - DNA, 20 bp, Artificial
  CRISPR gRNA sequence
tccctgttttaatttttatt

SEQ ID NO: 409521 - DNA, 20 bp, Artificial
  CRISPR gRNA sequence
ccctgttttaatttttattt

SEQ ID NO: 409522 - DNA, 20 bp, Artificial
  CRISPR gRNA sequence
cctgttttaatttttatttt

SEQ ID NO: 409523 - DNA, 20 bp, Artificial
  CRISPR gRNA sequence
ttttaatttttattttaatt

SEQ ID NO: 409524 - DNA, 20 bp, Artificial
  CRISPR gRNA sequence
taatttttattttaattttc

SEQ ID NO: 409525 - DNA, 20 bp, Artificial
  CRISPR gRNA sequence
aatttttattttaattttcc

SEQ ID NO: 409526 - DNA, 20 bp, Artificial
  CRISPR gRNA sequence
atttttattttaattttcct

SEQ ID NO: 409527 - DNA, 20 bp, Artificial
  CRISPR gRNA sequence
ttattttaattttccttttg

SEQ ID NO: 409528 - DNA, 20 bp, Artificial
  CRISPR gRNA sequence
tattttaattttccttttgt

SEQ ID NO: 409529 - DNA, 20 bp, Artificial
  CRISPR gRNA sequence
attttaattttccttttgtt

SEQ ID NO: 409530 - DNA, 20 bp, Artificial
  CRISPR gRNA sequence
ttttaattttccttttgttt

SEQ ID NO: 409531 - DNA, 20 bp, Artificial
  CRISPR gRNA sequence
taattttccttttgtttctt

SEQ ID NO: 409532 - DNA, 20 bp, Artificial
  CRISPR gRNA sequence
aattttccttttgtttcttt

SEQ ID NO: 409533 - DNA, 20 bp, Artificial
  CRISPR gRNA sequence
attttccttttgtttctttt

SEQ ID NO: 409534 - DNA, 20 bp, Artificial
  CRISPR gRNA sequence
tccttttgtttcttttaagc

SEQ ID NO: 409535 - DNA, 20 bp, Artificial
  CRISPR gRNA sequence
ccttttgtttcttttaagct

SEQ ID NO: 409536 - DNA, 20 bp, Artificial
  CRISPR gRNA sequence
cttttgtttcttttaagctt

SEQ ID NO: 409537 - DNA, 20 bp, Artificial
  CRISPR gRNA sequence
ttgtttcttttaagctttta

SEQ ID NO: 409538 - DNA, 20 bp, Artificial
  CRISPR gRNA sequence
tgtttcttttaagcttttat

SEQ ID NO: 409539 - DNA, 20 bp, Artificial
  CRISPR gRNA sequence
gtttcttttaagcttttatt

SEQ ID NO: 409540 - DNA, 20 bp, Artificial
  CRISPR gRNA sequence
tttcttttaagcttttattt

SEQ ID NO: 409541 - DNA, 20 bp, Artificial
  CRISPR gRNA sequence
cttttaagcttttatttcct

SEQ ID NO: 409542 - DNA, 20 bp, Artificial
  CRISPR gRNA sequence
ttttaagcttttatttcctt

SEQ ID NO: 409543 - DNA, 20 bp, Artificial
  CRISPR gRNA sequence
ttaagcttttatttcctttt

SEQ ID NO: 409544 - DNA, 20 bp, Artificial
  CRISPR gRNA sequence
taagcttttatttccttttt

SEQ ID NO: 409545 - DNA, 20 bp, Artificial
  CRISPR gRNA sequence
aagcttttatttcctttttt

SEQ ID NO: 409546 - DNA, 20 bp, Artificial
  CRISPR gRNA sequence
agcttttatttccttttttc

SEQ ID NO: 409547 - DNA, 20 bp, Artificial
  CRISPR gRNA sequence
ttatttccttttttcccttt

SEQ ID NO: 409548 - DNA, 20 bp, Artificial
  CRISPR gRNA sequence
tatttccttttttccctttt

SEQ ID NO: 409549 - DNA, 20 bp, Artificial
  CRISPR gRNA sequence
atttccttttttcccttttt

SEQ ID NO: 409550 - DNA, 20 bp, Artificial
  CRISPR gRNA sequence
tttccttttttccctttttt

SEQ ID NO: 409551 - DNA, 20 bp, Artificial
  CRISPR gRNA sequence
ccttttttcccttttttaat

SEQ ID NO: 409552 - DNA, 20 bp, Artificial
  CRISPR gRNA sequence
cttttttcccttttttaatg

SEQ ID NO: 409553 - DNA, 20 bp, Artificial
  CRISPR gRNA sequence
ttttcccttttttaatgaat

SEQ ID NO: 409554 - DNA, 20 bp, Artificial
  CRISPR gRNA sequence
tttcccttttttaatgaatt

SEQ ID NO: 409555 - DNA, 20 bp, Artificial
  CRISPR gRNA sequence
ttcccttttttaatgaattt

SEQ ID NO: 409556 - DNA, 20 bp, Artificial
  CRISPR gRNA sequence
tcccttttttaatgaatttt

SEQ ID NO: 409557 - DNA, 20 bp, Artificial
  CRISPR gRNA sequence
cccttttttaatgaattttc

SEQ ID NO: 409558 - DNA, 20 bp, Artificial
  CRISPR gRNA sequence
ccttttttaatgaattttct

SEQ ID NO: 409559 - DNA, 20 bp, Artificial
  CRISPR gRNA sequence
ttttaatgaattttcttcct

SEQ ID NO: 409560 - DNA, 20 bp, Artificial
  CRISPR gRNA sequence
tttaatgaattttcttcctt

SEQ ID NO: 409561 - DNA, 20 bp, Artificial
  CRISPR gRNA sequence
ttaatgaattttcttccttt

SEQ ID NO: 409562 - DNA, 20 bp, Artificial
  CRISPR gRNA sequence
taatgaattttcttcctttg

SEQ ID NO: 409563 - DNA, 20 bp, Artificial
  CRISPR gRNA sequence
aatgaattttcttcctttgc

SEQ ID NO: 409564 - DNA, 20 bp, Artificial
  CRISPR gRNA sequence
atgaattttcttcctttgct

SEQ ID NO: 409565 - DNA, 20 bp, Artificial
  CRISPR gRNA sequence
tcttcctttgcttttctttc

SEQ ID NO: 409566 - DNA, 20 bp, Artificial
  CRISPR gRNA sequence
cttcctttgcttttctttct

SEQ ID NO: 409567 - DNA, 20 bp, Artificial
  CRISPR gRNA sequence
ttcctttgcttttctttctt

SEQ ID NO: 409568 - DNA, 20 bp, Artificial
  CRISPR gRNA sequence
cctttgcttttctttcttcc

SEQ ID NO: 409569 - DNA, 20 bp, Artificial
  CRISPR gRNA sequence
ctttgcttttctttcttccc

SEQ ID NO: 409570 - DNA, 20 bp, Artificial
  CRISPR gRNA sequence
tgcttttctttcttcccctt

SEQ ID NO: 409571 - DNA, 20 bp, Artificial
  CRISPR gRNA sequence
gcttttctttcttccccttt

SEQ ID NO: 409572 - DNA, 20 bp, Artificial
  CRISPR gRNA sequence
cttttctttcttcccctttt

SEQ ID NO: 409573 - DNA, 20 bp, Artificial
  CRISPR gRNA sequence
ttctttcttccccttttctt

SEQ ID NO: 409574 - DNA, 20 bp, Artificial
  CRISPR gRNA sequence
tctttcttccccttttcttg

SEQ ID NO: 409575 - DNA, 20 bp, Artificial
  CRISPR gRNA sequence
ctttcttccccttttcttgt

SEQ ID NO: 409576 - DNA, 20 bp, Artificial
  CRISPR gRNA sequence
tttcttccccttttcttgtg

SEQ ID NO: 409577 - DNA, 20 bp, Artificial
  CRISPR gRNA sequence
tcttccccttttcttgtgtt

SEQ ID NO: 409578 - DNA, 20 bp, Artificial
  CRISPR gRNA sequence
cttccccttttcttgtgttg

SEQ ID NO: 409579 - DNA, 20 bp, Artificial
  CRISPR gRNA sequence
ttccccttttcttgtgttgc

SEQ ID NO: 409580 - DNA, 20 bp, Artificial
  CRISPR gRNA sequence
ccccttttcttgtgttgctt

SEQ ID NO: 409581 - DNA, 20 bp, Artificial
  CRISPR gRNA sequence
cccttttcttgtgttgcttt

SEQ ID NO: 409582 - DNA, 20 bp, Artificial
  CRISPR gRNA sequence
ttcttgtgttgctttattac

SEQ ID NO: 409583 - DNA, 20 bp, Artificial
  CRISPR gRNA sequence
tcttgtgttgctttattact

SEQ ID NO: 409584 - DNA, 20 bp, Artificial
  CRISPR gRNA sequence
cttgtgttgctttattactt

SEQ ID NO: 409585 - DNA, 20 bp, Artificial
  CRISPR gRNA sequence
ttgtgttgctttattactta

SEQ ID NO: 409586 - DNA, 20 bp, Artificial
  CRISPR gRNA sequence
gtgttgctttattacttaga

SEQ ID NO: 409587 - DNA, 20 bp, Artificial
  CRISPR gRNA sequence
tgttgctttattacttagag

SEQ ID NO: 409588 - DNA, 20 bp, Artificial
  CRISPR gRNA sequence
ctttattacttagagacgaa

SEQ ID NO: 409589 - DNA, 20 bp, Artificial
  CRISPR gRNA sequence
tattacttagagacgaaatg

SEQ ID NO: 409590 - DNA, 20 bp, Artificial
  CRISPR gRNA sequence
attacttagagacgaaatgt

SEQ ID NO: 409591 - DNA, 20 bp, Artificial
  CRISPR gRNA sequence
ttacttagagacgaaatgtt

SEQ ID NO: 409592 - DNA, 20 bp, Artificial
  CRISPR gRNA sequence
cttagagacgaaatgttttc

SEQ ID NO: 409593 - DNA, 20 bp, Artificial
  CRISPR gRNA sequence
agagacgaaatgttttccgg

SEQ ID NO: 409594 - DNA, 20 bp, Artificial
  CRISPR gRNA sequence
gagacgaaatgttttccggg

SEQ ID NO: 409595 - DNA, 20 bp, Artificial
  CRISPR gRNA sequence
tccgggtgtgtgttatgtgg

SEQ ID NO: 409596 - DNA, 20 bp, Artificial
  CRISPR gRNA sequence
ccgggtgtgtgttatgtggg

SEQ ID NO: 409597 - DNA, 20 bp, Artificial
  CRISPR gRNA sequence
cgggtgtgtgttatgtgggt

SEQ ID NO: 409598 - DNA, 20 bp, Artificial
  CRISPR gRNA sequence
tgtgggtaaagtgctacctt

SEQ ID NO: 409599 - DNA, 20 bp, Artificial
  CRISPR gRNA sequence
cctttggtaaacggttgtac

SEQ ID NO: 409600 - DNA, 20 bp, Artificial
  CRISPR gRNA sequence
tggtaaacggttgtacagag

SEQ ID NO: 409601 - DNA, 20 bp, Artificial
  CRISPR gRNA sequence
ggtaaacggttgtacagagg

SEQ ID NO: 409602 - DNA, 20 bp, Artificial
  CRISPR gRNA sequence
gtaaacggttgtacagagga

SEQ ID NO: 409603 - DNA, 20 bp, Artificial
  CRISPR gRNA sequence
tacagaggagaaagctggag

SEQ ID NO: 409604 - DNA, 20 bp, Artificial
  CRISPR gRNA sequence
gagtgctgtggttttctttt

SEQ ID NO: 409605 - DNA, 20 bp, Artificial
  CRISPR gRNA sequence
tggttttctttttacaacat

SEQ ID NO: 409606 - DNA, 20 bp, Artificial
  CRISPR gRNA sequence
tctttttacaacattttgac

SEQ ID NO: 409607 - DNA, 20 bp, Artificial
  CRISPR gRNA sequence
ctttttacaacattttgaca

SEQ ID NO: 409608 - DNA, 20 bp, Artificial
  CRISPR gRNA sequence
tttttacaacattttgacac

SEQ ID NO: 409609 - DNA, 20 bp, Artificial
  CRISPR gRNA sequence
tttacaacattttgacacat

SEQ ID NO: 409610 - DNA, 20 bp, Artificial
  CRISPR gRNA sequence
ttacaacattttgacacatg

SEQ ID NO: 409611 - DNA, 20 bp, Artificial
  CRISPR gRNA sequence
tacaacattttgacacatgg

SEQ ID NO: 409612 - DNA, 20 bp, Artificial
  CRISPR gRNA sequence
acaacattttgacacatgga

SEQ ID NO: 409613 - DNA, 20 bp, Artificial
  CRISPR gRNA sequence
caacattttgacacatggaa

SEQ ID NO: 409614 - DNA, 20 bp, Artificial
  CRISPR gRNA sequence
tgacacatggaaccgcatgc

SEQ ID NO: 409615 - DNA, 20 bp, Artificial
  CRISPR gRNA sequence
gacacatggaaccgcatgct

SEQ ID NO: 409616 - DNA, 20 bp, Artificial
  CRISPR gRNA sequence
acacatggaaccgcatgctg

SEQ ID NO: 409617 - DNA, 20 bp, Artificial
  CRISPR gRNA sequence
aagatgagaagctagttttt

SEQ ID NO: 409618 - DNA, 20 bp, Artificial
  CRISPR gRNA sequence
gtttttggtgcggctgaaac

SEQ ID NO: 409619 - DNA, 20 bp, Artificial
  CRISPR gRNA sequence
ttggtgcggctgaaactatc

SEQ ID NO: 409620 - DNA, 20 bp, Artificial
  CRISPR gRNA sequence
tggtgcggctgaaactatcg

SEQ ID NO: 409621 - DNA, 20 bp, Artificial
  CRISPR gRNA sequence
ggtgcggctgaaactatcgt

SEQ ID NO: 409622 - DNA, 20 bp, Artificial
  CRISPR gRNA sequence
gtgcggctgaaactatcgta

SEQ ID NO: 409623 - DNA, 20 bp, Artificial
  CRISPR gRNA sequence
aaactatcgtagccatgata

SEQ ID NO: 409624 - DNA, 20 bp, Artificial
  CRISPR gRNA sequence
tcgtagccatgatattctag

SEQ ID NO: 409625 - DNA, 20 bp, Artificial
  CRISPR gRNA sequence
tagttcaatagatggcaaat

SEQ ID NO: 409626 - DNA, 20 bp, Artificial
  CRISPR gRNA sequence
gttcaatagatggcaaatct

SEQ ID NO: 409627 - DNA, 20 bp, Artificial
  CRISPR gRNA sequence
aatagatggcaaatcttact

SEQ ID NO: 409628 - DNA, 20 bp, Artificial
  CRISPR gRNA sequence
actgcactttagacttgctt

SEQ ID NO: 409629 - DNA, 20 bp, Artificial
  CRISPR gRNA sequence
ctgcactttagacttgcttt

SEQ ID NO: 409630 - DNA, 20 bp, Artificial
  CRISPR gRNA sequence
cactttagacttgctttcat

SEQ ID NO: 409631 - DNA, 20 bp, Artificial
  CRISPR gRNA sequence
tagacttgctttcattctct

SEQ ID NO: 409632 - DNA, 20 bp, Artificial
  CRISPR gRNA sequence
agacttgctttcattctctc

SEQ ID NO: 409633 - DNA, 20 bp, Artificial
  CRISPR gRNA sequence
gacttgctttcattctctct

SEQ ID NO: 409634 - DNA, 20 bp, Artificial
  CRISPR gRNA sequence
gctttcattctctctttcga

SEQ ID NO: 409635 - DNA, 20 bp, Artificial
  CRISPR gRNA sequence
ctttcattctctctttcgaa

SEQ ID NO: 409636 - DNA, 20 bp, Artificial
  CRISPR gRNA sequence
tcattctctctttcgaaatg

SEQ ID NO: 409637 - DNA, 20 bp, Artificial
  CRISPR gRNA sequence
cattctctctttcgaaatgt

SEQ ID NO: 409638 - DNA, 20 bp, Artificial
  CRISPR gRNA sequence
attctctctttcgaaatgtg

SEQ ID NO: 409639 - DNA, 20 bp, Artificial
  CRISPR gRNA sequence
tctctttcgaaatgtgacat

SEQ ID NO: 409640 - DNA, 20 bp, Artificial
  CRISPR gRNA sequence
tctttcgaaatgtgacatct

SEQ ID NO: 409641 - DNA, 20 bp, Artificial
  CRISPR gRNA sequence
tttcgaaatgtgacatctct

SEQ ID NO: 409642 - DNA, 20 bp, Artificial
  CRISPR gRNA sequence
tcgaaatgtgacatctcttt

SEQ ID NO: 409643 - DNA, 20 bp, Artificial
  CRISPR gRNA sequence
cgaaatgtgacatctctttt

SEQ ID NO: 409644 - DNA, 20 bp, Artificial
  CRISPR gRNA sequence
gaaatgtgacatctcttttg

SEQ ID NO: 409645 - DNA, 20 bp, Artificial
  CRISPR gRNA sequence
ttttgtttctctgtctcctt

SEQ ID NO: 409646 - DNA, 20 bp, Artificial
  CRISPR gRNA sequence
ttgtttctctgtctcctttc

SEQ ID NO: 409647 - DNA, 20 bp, Artificial
  CRISPR gRNA sequence
tgtttctctgtctcctttcc

SEQ ID NO: 409648 - DNA, 20 bp, Artificial
  CRISPR gRNA sequence
gtttctctgtctcctttcct

SEQ ID NO: 409649 - DNA, 20 bp, Artificial
  CRISPR gRNA sequence
tttctctgtctcctttcctt

SEQ ID NO: 409650 - DNA, 20 bp, Artificial
  CRISPR gRNA sequence
ctctgtctcctttccttcct

SEQ ID NO: 409651 - DNA, 20 bp, Artificial
  CRISPR gRNA sequence
tctgtctcctttccttcctt

SEQ ID NO: 409652 - DNA, 20 bp, Artificial
  CRISPR gRNA sequence
tgtctcctttccttcctttt

SEQ ID NO: 409653 - DNA, 20 bp, Artificial
  CRISPR gRNA sequence
tctcctttccttcctttttt

SEQ ID NO: 409654 - DNA, 20 bp, Artificial
  CRISPR gRNA sequence
ctttccttccttttttcttc

SEQ ID NO: 409655 - DNA, 20 bp, Artificial
  CRISPR gRNA sequence
tccttccttttttcttcctc

SEQ ID NO: 409656 - DNA, 20 bp, Artificial
  CRISPR gRNA sequence
ccttccttttttcttcctcc

SEQ ID NO: 409657 - DNA, 20 bp, Artificial
  CRISPR gRNA sequence
cttccttttttcttcctccc

SEQ ID NO: 409658 - DNA, 20 bp, Artificial
  CRISPR gRNA sequence
ccttttttcttcctccctcc

SEQ ID NO: 409659 - DNA, 20 bp, Artificial
  CRISPR gRNA sequence
cttttttcttcctccctcct

SEQ ID NO: 409660 - DNA, 20 bp, Artificial
  CRISPR gRNA sequence
ttttcttcctccctcctttt

SEQ ID NO: 409661 - DNA, 20 bp, Artificial
  CRISPR gRNA sequence
tttcttcctccctccttttt

SEQ ID NO: 409662 - DNA, 20 bp, Artificial
  CRISPR gRNA sequence
ttcttcctccctcctttttt

SEQ ID NO: 409663 - DNA, 20 bp, Artificial
  CRISPR gRNA sequence
tcttcctccctccttttttc

SEQ ID NO: 409664 - DNA, 20 bp, Artificial
  CRISPR gRNA sequence
cttcctccctccttttttct

SEQ ID NO: 409665 - DNA, 20 bp, Artificial
  CRISPR gRNA sequence
ttcctccctccttttttctt

SEQ ID NO: 409666 - DNA, 20 bp, Artificial
  CRISPR gRNA sequence
cctccctccttttttctttt

SEQ ID NO: 409667 - DNA, 20 bp, Artificial
  CRISPR gRNA sequence
ctccctccttttttcttttt

SEQ ID NO: 409668 - DNA, 20 bp, Artificial
  CRISPR gRNA sequence
cctccttttttctttttctc

SEQ ID NO: 409669 - DNA, 20 bp, Artificial
  CRISPR gRNA sequence
cttttttctttttctctctt

SEQ ID NO: 409670 - DNA, 20 bp, Artificial
  CRISPR gRNA sequence
ttttctttttctctcttctt

SEQ ID NO: 409671 - DNA, 20 bp, Artificial
  CRISPR gRNA sequence
tttctttttctctcttcttt

SEQ ID NO: 409672 - DNA, 20 bp, Artificial
  CRISPR gRNA sequence
ttctttttctctcttctttt

SEQ ID NO: 409673 - DNA, 20 bp, Artificial
  CRISPR gRNA sequence
tctttttctctcttcttttt

SEQ ID NO: 409674 - DNA, 20 bp, Artificial
  CRISPR gRNA sequence
ctttttctctcttctttttc

SEQ ID NO: 409675 - DNA, 20 bp, Artificial
  CRISPR gRNA sequence
tttttctctcttctttttct

SEQ ID NO: 409676 - DNA, 20 bp, Artificial
  CRISPR gRNA sequence
tttctctcttctttttctcc

SEQ ID NO: 409677 - DNA, 20 bp, Artificial
  CRISPR gRNA sequence
ttctctcttctttttctcct

SEQ ID NO: 409678 - DNA, 20 bp, Artificial
  CRISPR gRNA sequence
tctctcttctttttctcctt

SEQ ID NO: 409679 - DNA, 20 bp, Artificial
  CRISPR gRNA sequence
ctctcttctttttctccttc

SEQ ID NO: 409680 - DNA, 20 bp, Artificial
  CRISPR gRNA sequence
tctcttctttttctccttcc

SEQ ID NO: 409681 - DNA, 20 bp, Artificial
  CRISPR gRNA sequence
tcttctttttctccttccct

SEQ ID NO: 409682 - DNA, 20 bp, Artificial
  CRISPR gRNA sequence
ttctttttctccttccctcc

SEQ ID NO: 409683 - DNA, 20 bp, Artificial
  CRISPR gRNA sequence
ctttttctccttccctcctt

SEQ ID NO: 409684 - DNA, 20 bp, Artificial
  CRISPR gRNA sequence
tttttctccttccctccttc

SEQ ID NO: 409685 - DNA, 20 bp, Artificial
  CRISPR gRNA sequence
tttctccttccctccttcct

SEQ ID NO: 409686 - DNA, 20 bp, Artificial
  CRISPR gRNA sequence
ttctccttccctccttcctt

SEQ ID NO: 409687 - DNA, 20 bp, Artificial
  CRISPR gRNA sequence
tctccttccctccttccttt

SEQ ID NO: 409688 - DNA, 20 bp, Artificial
  CRISPR gRNA sequence
ctccttccctccttcctttc

SEQ ID NO: 409689 - DNA, 20 bp, Artificial
  CRISPR gRNA sequence
tccttccctccttcctttct

SEQ ID NO: 409690 - DNA, 20 bp, Artificial
  CRISPR gRNA sequence
cttccctccttcctttctct

SEQ ID NO: 409691 - DNA, 20 bp, Artificial
  CRISPR gRNA sequence
ccctccttcctttctctctt

SEQ ID NO: 409692 - DNA, 20 bp, Artificial
  CRISPR gRNA sequence
cctccttcctttctctcttt

SEQ ID NO: 409693 - DNA, 20 bp, Artificial
  CRISPR gRNA sequence
cttcctttctctctttctct

SEQ ID NO: 409694 - DNA, 20 bp, Artificial
  CRISPR gRNA sequence
cctttctctctttctctatt

SEQ ID NO: 409695 - DNA, 20 bp, Artificial
  CRISPR gRNA sequence
ctttctctctttctctattt

SEQ ID NO: 409696 - DNA, 20 bp, Artificial
  CRISPR gRNA sequence
tctctctttctctatttctt

SEQ ID NO: 409697 - DNA, 20 bp, Artificial
  CRISPR gRNA sequence
ctctctttctctatttcttt

SEQ ID NO: 409698 - DNA, 20 bp, Artificial
  CRISPR gRNA sequence
tctctttctctatttctttt

SEQ ID NO: 409699 - DNA, 20 bp, Artificial
  CRISPR gRNA sequence
tctttctctatttctttttt

SEQ ID NO: 409700 - DNA, 20 bp, Artificial
  CRISPR gRNA sequence
tttctctatttcttttttct

SEQ ID NO: 409701 - DNA, 20 bp, Artificial
  CRISPR gRNA sequence
tctctatttcttttttcttt

SEQ ID NO: 409702 - DNA, 20 bp, Artificial
  CRISPR gRNA sequence
ctctatttcttttttctttt

SEQ ID NO: 409703 - DNA, 20 bp, Artificial
  CRISPR gRNA sequence
tctatttcttttttcttttg

SEQ ID NO: 409704 - DNA, 20 bp, Artificial
  CRISPR gRNA sequence
tatttcttttttcttttgtt

SEQ ID NO: 409705 - DNA, 20 bp, Artificial
  CRISPR gRNA sequence
tttcttttttcttttgtttg

SEQ ID NO: 409706 - DNA, 20 bp, Artificial
  CRISPR gRNA sequence
cttttttcttttgtttgtat

SEQ ID NO: 409707 - DNA, 20 bp, Artificial
  CRISPR gRNA sequence
ttttttcttttgtttgtatg

SEQ ID NO: 409708 - DNA, 20 bp, Artificial
  CRISPR gRNA sequence
ttttcttttgtttgtatgcc

SEQ ID NO: 409709 - DNA, 20 bp, Artificial
  CRISPR gRNA sequence
tttcttttgtttgtatgcca

SEQ ID NO: 409710 - DNA, 20 bp, Artificial
  CRISPR gRNA sequence
ttcttttgtttgtatgccaa

SEQ ID NO: 409711 - DNA, 20 bp, Artificial
  CRISPR gRNA sequence
tcttttgtttgtatgccaag

SEQ ID NO: 409712 - DNA, 20 bp, Artificial
  CRISPR gRNA sequence
cttttgtttgtatgccaaga

SEQ ID NO: 409713 - DNA, 20 bp, Artificial
  CRISPR gRNA sequence
ttttgtttgtatgccaagac

SEQ ID NO: 409714 - DNA, 20 bp, Artificial
  CRISPR gRNA sequence
ttgtttgtatgccaagacaa

SEQ ID NO: 409715 - DNA, 20 bp, Artificial
  CRISPR gRNA sequence
tgtttgtatgccaagacaat

SEQ ID NO: 409716 - DNA, 20 bp, Artificial
  CRISPR gRNA sequence
gtttgtatgccaagacaatg

SEQ ID NO: 409717 - DNA, 20 bp, Artificial
  CRISPR gRNA sequence
tttgtatgccaagacaatgg

SEQ ID NO: 409718 - DNA, 20 bp, Artificial
  CRISPR gRNA sequence
gtatgccaagacaatggctc

SEQ ID NO: 409719 - DNA, 20 bp, Artificial
  CRISPR gRNA sequence
tatgccaagacaatggctcc

SEQ ID NO: 409720 - DNA, 20 bp, Artificial
  CRISPR gRNA sequence
ctgggccagtcctgagtgaa

SEQ ID NO: 409721 - DNA, 20 bp, Artificial
  CRISPR gRNA sequence
ggccagtcctgagtgaaact

SEQ ID NO: 409722 - DNA, 20 bp, Artificial
  CRISPR gRNA sequence
agtgaaactgtcacatagtt

SEQ ID NO: 409723 - DNA, 20 bp, Artificial
  CRISPR gRNA sequence
tcacatagttgaagtgacag

SEQ ID NO: 409724 - DNA, 20 bp, Artificial
  CRISPR gRNA sequence
aagtgacagatgacttccca

SEQ ID NO: 409725 - DNA, 20 bp, Artificial
  CRISPR gRNA sequence
cccactttttgcatttctcc

SEQ ID NO: 409726 - DNA, 20 bp, Artificial
  CRISPR gRNA sequence
ccactttttgcatttctccc

SEQ ID NO: 409727 - DNA, 20 bp, Artificial
  CRISPR gRNA sequence
tttgcatttctcccttagtg

SEQ ID NO: 409728 - DNA, 20 bp, Artificial
  CRISPR gRNA sequence
ttgcatttctcccttagtgc

SEQ ID NO: 409729 - DNA, 20 bp, Artificial
  CRISPR gRNA sequence
tgcatttctcccttagtgcc

SEQ ID NO: 409730 - DNA, 20 bp, Artificial
  CRISPR gRNA sequence
gcatttctcccttagtgcca

SEQ ID NO: 409731 - DNA, 20 bp, Artificial
  CRISPR gRNA sequence
catttctcccttagtgccag

SEQ ID NO: 409732 - DNA, 20 bp, Artificial
  CRISPR gRNA sequence
ctcccttagtgccagagagt

SEQ ID NO: 409733 - DNA, 20 bp, Artificial
  CRISPR gRNA sequence
tcccttagtgccagagagtt

SEQ ID NO: 409734 - DNA, 20 bp, Artificial
  CRISPR gRNA sequence
ccttagtgccagagagtttt

SEQ ID NO: 409735 - DNA, 20 bp, Artificial
  CRISPR gRNA sequence
agtgccagagagttttgtga

SEQ ID NO: 409736 - DNA, 20 bp, Artificial
  CRISPR gRNA sequence
gtgccagagagttttgtgac

SEQ ID NO: 409737 - DNA, 20 bp, Artificial
  CRISPR gRNA sequence
tgtgacatcattactgccca

SEQ ID NO: 409738 - DNA, 20 bp, Artificial
  CRISPR gRNA sequence
gtgacatcattactgcccag

SEQ ID NO: 409739 - DNA, 20 bp, Artificial
  CRISPR gRNA sequence
tgacatcattactgcccagg

SEQ ID NO: 409740 - DNA, 20 bp, Artificial
  CRISPR gRNA sequence
ctgcccaggcctcactctac

SEQ ID NO: 409741 - DNA, 20 bp, Artificial
  CRISPR gRNA sequence
cccaggcctcactctactga

SEQ ID NO: 409742 - DNA, 20 bp, Artificial
  CRISPR gRNA sequence
actctactgaaatagcaggt

SEQ ID NO: 409743 - DNA, 20 bp, Artificial
  CRISPR gRNA sequence
tactgaaatagcaggtcagg

SEQ ID NO: 409744 - DNA, 20 bp, Artificial
  CRISPR gRNA sequence
ctgaaatagcaggtcaggat

SEQ ID NO: 409745 - DNA, 20 bp, Artificial
  CRISPR gRNA sequence
aaatagcaggtcaggatttg

SEQ ID NO: 409746 - DNA, 20 bp, Artificial
  CRISPR gRNA sequence
gttggcattagtgatgccat

SEQ ID NO: 409747 - DNA, 20 bp, Artificial
  CRISPR gRNA sequence
ttggcattagtgatgccatc

SEQ ID NO: 409748 - DNA, 20 bp, Artificial
  CRISPR gRNA sequence
gcattagtgatgccatcaga

SEQ ID NO: 409749 - DNA, 20 bp, Artificial
  CRISPR gRNA sequence
gtgatgccatcagaagaaag

SEQ ID NO: 409750 - DNA, 20 bp, Artificial
  CRISPR gRNA sequence
atcactaataaatagatcca

SEQ ID NO: 409751 - DNA, 20 bp, Artificial
  CRISPR gRNA sequence
ataaatagatccacttgtta

SEQ ID NO: 409752 - DNA, 20 bp, Artificial
  CRISPR gRNA sequence
gttaccttgctgggttatct

SEQ ID NO: 409753 - DNA, 20 bp, Artificial
  CRISPR gRNA sequence
ttaccttgctgggttatctt

SEQ ID NO: 409754 - DNA, 20 bp, Artificial
  CRISPR gRNA sequence
ccttgctgggttatcttaat

SEQ ID NO: 409755 - DNA, 20 bp, Artificial
  CRISPR gRNA sequence
gctgggttatcttaatttta

SEQ ID NO: 409756 - DNA, 20 bp, Artificial
  CRISPR gRNA sequence
ctgggttatcttaattttaa

SEQ ID NO: 409757 - DNA, 20 bp, Artificial
  CRISPR gRNA sequence
ggttatcttaattttaagaa

SEQ ID NO: 409758 - DNA, 20 bp, Artificial
  CRISPR gRNA sequence
tcttaattttaagaaagagt

SEQ ID NO: 409759 - DNA, 20 bp, Artificial
  CRISPR gRNA sequence
aattttaagaaagagttacc

SEQ ID NO: 409760 - DNA, 20 bp, Artificial
  CRISPR gRNA sequence
attttaagaaagagttacca

SEQ ID NO: 409761 - DNA, 20 bp, Artificial
  CRISPR gRNA sequence
taagaaagagttaccacagt

SEQ ID NO: 409762 - DNA, 20 bp, Artificial
  CRISPR gRNA sequence
aagaaagagttaccacagtt

SEQ ID NO: 409763 - DNA, 20 bp, Artificial
  CRISPR gRNA sequence
agaaagagttaccacagttt

SEQ ID NO: 409764 - DNA, 20 bp, Artificial
  CRISPR gRNA sequence
ccacagtttattctttagat

SEQ ID NO: 409765 - DNA, 20 bp, Artificial
  CRISPR gRNA sequence
attctttagatcgggttccc

SEQ ID NO: 409766 - DNA, 20 bp, Artificial
  CRISPR gRNA sequence
ttctttagatcgggttccca

SEQ ID NO: 409767 - DNA, 20 bp, Artificial
  CRISPR gRNA sequence
tttagatcgggttcccaaac

SEQ ID NO: 409768 - DNA, 20 bp, Artificial
  CRISPR gRNA sequence
tagatcgggttcccaaactt

SEQ ID NO: 409769 - DNA, 20 bp, Artificial
  CRISPR gRNA sequence
agatcgggttcccaaacttt

SEQ ID NO: 409770 - DNA, 20 bp, Artificial
  CRISPR gRNA sequence
gatcgggttcccaaactttt

SEQ ID NO: 409771 - DNA, 20 bp, Artificial
  CRISPR gRNA sequence
ccaaactttttggtctcaag

SEQ ID NO: 409772 - DNA, 20 bp, Artificial
  CRISPR gRNA sequence
tttggtctcaagaccccttt

SEQ ID NO: 409773 - DNA, 20 bp, Artificial
  CRISPR gRNA sequence
ttggtctcaagaccccttta

SEQ ID NO: 409774 - DNA, 20 bp, Artificial
  CRISPR gRNA sequence
tggtctcaagacccctttat

SEQ ID NO: 409775 - DNA, 20 bp, Artificial
  CRISPR gRNA sequence
ggtctcaagacccctttatg

SEQ ID NO: 409776 - DNA, 20 bp, Artificial
  CRISPR gRNA sequence
gtctcaagacccctttatgc

SEQ ID NO: 409777 - DNA, 20 bp, Artificial
  CRISPR gRNA sequence
aagacccctttatgctattt

SEQ ID NO: 409778 - DNA, 20 bp, Artificial
  CRISPR gRNA sequence
tatgctattttaaaaattac

SEQ ID NO: 409779 - DNA, 20 bp, Artificial
  CRISPR gRNA sequence
atgctattttaaaaattact

SEQ ID NO: 409780 - DNA, 20 bp, Artificial
  CRISPR gRNA sequence
tgctattttaaaaattactg

SEQ ID NO: 409781 - DNA, 20 bp, Artificial
  CRISPR gRNA sequence
ttttaaaaattactgaaggc

SEQ ID NO: 409782 - DNA, 20 bp, Artificial
  CRISPR gRNA sequence
taaaaattactgaaggccct

SEQ ID NO: 409783 - DNA, 20 bp, Artificial
  CRISPR gRNA sequence
aaaaattactgaaggccctc

SEQ ID NO: 409784 - DNA, 20 bp, Artificial
  CRISPR gRNA sequence
aaaattactgaaggccctca

SEQ ID NO: 409785 - DNA, 20 bp, Artificial
  CRISPR gRNA sequence
ctgaaggccctcagggagtg

SEQ ID NO: 409786 - DNA, 20 bp, Artificial
  CRISPR gRNA sequence
aaggccctcagggagtgttt

SEQ ID NO: 409787 - DNA, 20 bp, Artificial
  CRISPR gRNA sequence
agggagtgtttgtttatgta

SEQ ID NO: 409788 - DNA, 20 bp, Artificial
  CRISPR gRNA sequence
gtttatgtacgctatatctg

SEQ ID NO: 409789 - DNA, 20 bp, Artificial
  CRISPR gRNA sequence
tttatgtacgctatatctgt

SEQ ID NO: 409790 - DNA, 20 bp, Artificial
  CRISPR gRNA sequence
atgtacgctatatctgtcat

SEQ ID NO: 409791 - DNA, 20 bp, Artificial
  CRISPR gRNA sequence
tgtacgctatatctgtcatg

SEQ ID NO: 409792 - DNA, 20 bp, Artificial
  CRISPR gRNA sequence
tatctgtcatgtttactgta

SEQ ID NO: 409793 - DNA, 20 bp, Artificial
  CRISPR gRNA sequence
tcatgtttactgtattagaa

SEQ ID NO: 409794 - DNA, 20 bp, Artificial
  CRISPR gRNA sequence
actgtattagaaatcaatat

SEQ ID NO: 409795 - DNA, 20 bp, Artificial
  CRISPR gRNA sequence
ctgtattagaaatcaatatt

SEQ ID NO: 409796 - DNA, 20 bp, Artificial
  CRISPR gRNA sequence
tattagaaatcaatattgag

SEQ ID NO: 409797 - DNA, 20 bp, Artificial
  CRISPR gRNA sequence
gaaatcaatattgagcaaaa

SEQ ID NO: 409798 - DNA, 20 bp, Artificial
  CRISPR gRNA sequence
agcaaaatttaaaacacaag

SEQ ID NO: 409799 - DNA, 20 bp, Artificial
  CRISPR gRNA sequence
aaaacacaagaattttcaag

SEQ ID NO: 409800 - DNA, 20 bp, Artificial
  CRISPR gRNA sequence
aaacacaagaattttcaagc

SEQ ID NO: 409801 - DNA, 20 bp, Artificial
  CRISPR gRNA sequence
tcaagcatgcataccactag

SEQ ID NO: 409802 - DNA, 20 bp, Artificial
  CRISPR gRNA sequence
caagcatgcataccactagc

SEQ ID NO: 409803 - DNA, 20 bp, Artificial
  CRISPR gRNA sequence
aagcatgcataccactagct

SEQ ID NO: 409804 - DNA, 20 bp, Artificial
  CRISPR gRNA sequence
gctggcagagcctctggaaa

SEQ ID NO: 409805 - DNA, 20 bp, Artificial
  CRISPR gRNA sequence
gcagagcctctggaaatatc

SEQ ID NO: 409806 - DNA, 20 bp, Artificial
  CRISPR gRNA sequence
tggaaatatctactgtatac

SEQ ID NO: 409807 - DNA, 20 bp, Artificial
  CRISPR gRNA sequence
gaaatatctactgtatacct

SEQ ID NO: 409808 - DNA, 20 bp, Artificial
  CRISPR gRNA sequence
ctgtatacctgtgagagaac

SEQ ID NO: 409809 - DNA, 20 bp, Artificial
  CRISPR gRNA sequence
tatacctgtgagagaactgg

SEQ ID NO: 409810 - DNA, 20 bp, Artificial
  CRISPR gRNA sequence
tgagagaactggagtgaaga

SEQ ID NO: 409811 - DNA, 20 bp, Artificial
  CRISPR gRNA sequence
gagtgaagagggggaatttc

SEQ ID NO: 409812 - DNA, 20 bp, Artificial
  CRISPR gRNA sequence
cctctcaatatcactaggaa

SEQ ID NO: 409813 - DNA, 20 bp, Artificial
  CRISPR gRNA sequence
ctctcaatatcactaggaaa

SEQ ID NO: 409814 - DNA, 20 bp, Artificial
  CRISPR gRNA sequence
tcaatatcactaggaaaata

SEQ ID NO: 409815 - DNA, 20 bp, Artificial
  CRISPR gRNA sequence
aatatcactaggaaaataga

SEQ ID NO: 409816 - DNA, 20 bp, Artificial
  CRISPR gRNA sequence
ggaaaatagatttgaactgg

SEQ ID NO: 409817 - DNA, 20 bp, Artificial
  CRISPR gRNA sequence
gaactggcatatcccctaaa

SEQ ID NO: 409818 - DNA, 20 bp, Artificial
  CRISPR gRNA sequence
aactggcatatcccctaaag

SEQ ID NO: 409819 - DNA, 20 bp, Artificial
  CRISPR gRNA sequence
gcatatcccctaaagggaca

SEQ ID NO: 409820 - DNA, 20 bp, Artificial
  CRISPR gRNA sequence
aagggacacagagatgccca

SEQ ID NO: 409821 - DNA, 20 bp, Artificial
  CRISPR gRNA sequence
taaggaccatggacttagat

SEQ ID NO: 409822 - DNA, 20 bp, Artificial
  CRISPR gRNA sequence
aggaccatggacttagatat

SEQ ID NO: 409823 - DNA, 20 bp, Artificial
  CRISPR gRNA sequence
agatatttagtgacaattac

SEQ ID NO: 409824 - DNA, 20 bp, Artificial
  CRISPR gRNA sequence
gatatttagtgacaattact

SEQ ID NO: 409825 - DNA, 20 bp, Artificial
  CRISPR gRNA sequence
agtgacaattactgagtact

SEQ ID NO: 409826 - DNA, 20 bp, Artificial
  CRISPR gRNA sequence
gtgacaattactgagtactt

SEQ ID NO: 409827 - DNA, 20 bp, Artificial
  CRISPR gRNA sequence
ctgagtactttatggtagga

SEQ ID NO: 409828 - DNA, 20 bp, Artificial
  CRISPR gRNA sequence
agtactttatggtaggaatt

SEQ ID NO: 409829 - DNA, 20 bp, Artificial
  CRISPR gRNA sequence
tatggtaggaattccagaaa

SEQ ID NO: 409830 - DNA, 20 bp, Artificial
  CRISPR gRNA sequence
atggtaggaattccagaaat

SEQ ID NO: 409831 - DNA, 20 bp, Artificial
  CRISPR gRNA sequence
tggtaggaattccagaaatg

SEQ ID NO: 409832 - DNA, 20 bp, Artificial
  CRISPR gRNA sequence
cagaaatggtgtgaggaagg

SEQ ID NO: 409833 - DNA, 20 bp, Artificial
  CRISPR gRNA sequence
gactttcatggtatcaagaa

SEQ ID NO: 409834 - DNA, 20 bp, Artificial
  CRISPR gRNA sequence
tcatggtatcaagaattgat

SEQ ID NO: 409835 - DNA, 20 bp, Artificial
  CRISPR gRNA sequence
catggtatcaagaattgata

SEQ ID NO: 409836 - DNA, 20 bp, Artificial
  CRISPR gRNA sequence
atggtatcaagaattgatac

SEQ ID NO: 409837 - DNA, 20 bp, Artificial
  CRISPR gRNA sequence
ataccacatgtggggcccta

SEQ ID NO: 409838 - DNA, 20 bp, Artificial
  CRISPR gRNA sequence
ctctacccatgtgtaagaca

SEQ ID NO: 409839 - DNA, 20 bp, Artificial
  CRISPR gRNA sequence
tacccatgtgtaagacaacc

SEQ ID NO: 409840 - DNA, 20 bp, Artificial
  CRISPR gRNA sequence
cccatgtgtaagacaaccct

SEQ ID NO: 409841 - DNA, 20 bp, Artificial
  CRISPR gRNA sequence
tatatctgaagaatgagatc

SEQ ID NO: 409842 - DNA, 20 bp, Artificial
  CRISPR gRNA sequence
aagaatgagatcatgtgtat

SEQ ID NO: 409843 - DNA, 20 bp, Artificial
  CRISPR gRNA sequence
agtgagaatgatttggtatc

SEQ ID NO: 409844 - DNA, 20 bp, Artificial
  CRISPR gRNA sequence
ggtatctttttcataactgt

SEQ ID NO: 409845 - DNA, 20 bp, Artificial
  CRISPR gRNA sequence
gtatctttttcataactgtc

SEQ ID NO: 409846 - DNA, 20 bp, Artificial
  CRISPR gRNA sequence
tttcataactgtcagaatct

SEQ ID NO: 409847 - DNA, 20 bp, Artificial
  CRISPR gRNA sequence
ttcataactgtcagaatctt

SEQ ID NO: 409848 - DNA, 20 bp, Artificial
  CRISPR gRNA sequence
tcataactgtcagaatctta

SEQ ID NO: 409849 - DNA, 20 bp, Artificial
  CRISPR gRNA sequence
cataactgtcagaatcttag

SEQ ID NO: 409850 - DNA, 20 bp, Artificial
  CRISPR gRNA sequence
ataactgtcagaatcttagc

SEQ ID NO: 409851 - DNA, 20 bp, Artificial
  CRISPR gRNA sequence
tcagaatcttagccagaatg

SEQ ID NO: 409852 - DNA, 20 bp, Artificial
  CRISPR gRNA sequence
agccagaatgattataacct

SEQ ID NO: 409853 - DNA, 20 bp, Artificial
  CRISPR gRNA sequence
gccagaatgattataacctg

SEQ ID NO: 409854 - DNA, 20 bp, Artificial
  CRISPR gRNA sequence
taacctgaacatttgatact

SEQ ID NO: 409855 - DNA, 20 bp, Artificial
  CRISPR gRNA sequence
aacatttgatactgtaggtc

SEQ ID NO: 409856 - DNA, 20 bp, Artificial
  CRISPR gRNA sequence
gatactgtaggtcagtgtca

SEQ ID NO: 409857 - DNA, 20 bp, Artificial
  CRISPR gRNA sequence
atactgtaggtcagtgtcag

SEQ ID NO: 409858 - DNA, 20 bp, Artificial
  CRISPR gRNA sequence
taggtcagtgtcagagacac

SEQ ID NO: 409859 - DNA, 20 bp, Artificial
  CRISPR gRNA sequence
ttgcctaacagtctctttgt

SEQ ID NO: 409860 - DNA, 20 bp, Artificial
  CRISPR gRNA sequence
cctaacagtctctttgtaaa

SEQ ID NO: 409861 - DNA, 20 bp, Artificial
  CRISPR gRNA sequence
acagtctctttgtaaaattc

SEQ ID NO: 409862 - DNA, 20 bp, Artificial
  CRISPR gRNA sequence
tttgtaaaattcagcctctt

SEQ ID NO: 409863 - DNA, 20 bp, Artificial
  CRISPR gRNA sequence
tgtaaaattcagcctcttga

SEQ ID NO: 409864 - DNA, 20 bp, Artificial
  CRISPR gRNA sequence
gtaaaattcagcctcttgat

SEQ ID NO: 409865 - DNA, 20 bp, Artificial
  CRISPR gRNA sequence
taaaattcagcctcttgata

SEQ ID NO: 409866 - DNA, 20 bp, Artificial
  CRISPR gRNA sequence
agcctcttgatatgatacca

SEQ ID NO: 409867 - DNA, 20 bp, Artificial
  CRISPR gRNA sequence
ttgatatgataccaagaaaa

SEQ ID NO: 409868 - DNA, 20 bp, Artificial
  CRISPR gRNA sequence
gatatgataccaagaaaagc

SEQ ID NO: 409869 - DNA, 20 bp, Artificial
  CRISPR gRNA sequence
atatgataccaagaaaagca

SEQ ID NO: 409870 - DNA, 20 bp, Artificial
  CRISPR gRNA sequence
tggctgtgtttctcactaca

SEQ ID NO: 409871 - DNA, 20 bp, Artificial
  CRISPR gRNA sequence
ggctgtgtttctcactacat

SEQ ID NO: 409872 - DNA, 20 bp, Artificial
  CRISPR gRNA sequence
gctgtgtttctcactacatg

SEQ ID NO: 409873 - DNA, 20 bp, Artificial
  CRISPR gRNA sequence
tgtttctcactacatggtta

SEQ ID NO: 409874 - DNA, 20 bp, Artificial
  CRISPR gRNA sequence
ctcactacatggttaaccaa

SEQ ID NO: 409875 - DNA, 20 bp, Artificial
  CRISPR gRNA sequence
tcactacatggttaaccaag

SEQ ID NO: 409876 - DNA, 20 bp, Artificial
  CRISPR gRNA sequence
actacatggttaaccaagta

SEQ ID NO: 409877 - DNA, 20 bp, Artificial
  CRISPR gRNA sequence
catggttaaccaagtaacac

SEQ ID NO: 409878 - DNA, 20 bp, Artificial
  CRISPR gRNA sequence
accaagtaacacttatggaa

SEQ ID NO: 409879 - DNA, 20 bp, Artificial
  CRISPR gRNA sequence
atggaactatgtgtgaacaa

SEQ ID NO: 409880 - DNA, 20 bp, Artificial
  CRISPR gRNA sequence
tggaactatgtgtgaacaat

SEQ ID NO: 409881 - DNA, 20 bp, Artificial
  CRISPR gRNA sequence
tgtgtgaacaatcatatcct

SEQ ID NO: 409882 - DNA, 20 bp, Artificial
  CRISPR gRNA sequence
ttttctatttatctcccgga

SEQ ID NO: 409883 - DNA, 20 bp, Artificial
  CRISPR gRNA sequence
ttctatttatctcccggact

SEQ ID NO: 409884 - DNA, 20 bp, Artificial
  CRISPR gRNA sequence
tctatttatctcccggactt

SEQ ID NO: 409885 - DNA, 20 bp, Artificial
  CRISPR gRNA sequence
ctatttatctcccggactta

SEQ ID NO: 409886 - DNA, 20 bp, Artificial
  CRISPR gRNA sequence
tatttatctcccggacttaa

SEQ ID NO: 409887 - DNA, 20 bp, Artificial
  CRISPR gRNA sequence
tttatctcccggacttaaaa

SEQ ID NO: 409888 - DNA, 20 bp, Artificial
  CRISPR gRNA sequence
atctcccggacttaaaaaca

SEQ ID NO: 409889 - DNA, 20 bp, Artificial
  CRISPR gRNA sequence
tctcccggacttaaaaacaa

SEQ ID NO: 409890 - DNA, 20 bp, Artificial
  CRISPR gRNA sequence
ccggacttaaaaacaaaaaa

SEQ ID NO: 409891 - DNA, 20 bp, Artificial
  CRISPR gRNA sequence
aaaaacaaaaaacaaaaaac

SEQ ID NO: 409892 - DNA, 20 bp, Artificial
  CRISPR gRNA sequence
aaaacaaaaaacaaaaaaca

SEQ ID NO: 409893 - DNA, 20 bp, Artificial
  CRISPR gRNA sequence
tctcttacaagaatgtgtca

SEQ ID NO: 409894 - DNA, 20 bp, Artificial
  CRISPR gRNA sequence
ctcttacaagaatgtgtcat

SEQ ID NO: 409895 - DNA, 20 bp, Artificial
  CRISPR gRNA sequence
tcttacaagaatgtgtcatt

SEQ ID NO: 409896 - DNA, 20 bp, Artificial
  CRISPR gRNA sequence
ttacaagaatgtgtcattca

SEQ ID NO: 409897 - DNA, 20 bp, Artificial
  CRISPR gRNA sequence
acaagaatgtgtcattcaca

SEQ ID NO: 409898 - DNA, 20 bp, Artificial
  CRISPR gRNA sequence
caagaatgtgtcattcacaa

SEQ ID NO: 409899 - DNA, 20 bp, Artificial
  CRISPR gRNA sequence
acaactgggtgcggtggctc

SEQ ID NO: 409900 - DNA, 20 bp, Artificial
  CRISPR gRNA sequence
ggtgcggtggctcatgcctg

SEQ ID NO: 409901 - DNA, 20 bp, Artificial
  CRISPR gRNA sequence
atgcctgtaatcccagcact

SEQ ID NO: 409902 - DNA, 20 bp, Artificial
  CRISPR gRNA sequence
taatcccagcactttgggag

SEQ ID NO: 409903 - DNA, 20 bp, Artificial
  CRISPR gRNA sequence
tgggaggccgaggtgggcgg

SEQ ID NO: 409904 - DNA, 20 bp, Artificial
  CRISPR gRNA sequence
gggaggccgaggtgggcgga

SEQ ID NO: 409905 - DNA, 20 bp, Artificial
  CRISPR gRNA sequence
ggaggccgaggtgggcggat

SEQ ID NO: 409906 - DNA, 20 bp, Artificial
  CRISPR gRNA sequence
agaccatcctggctaacacg

SEQ ID NO: 409907 - DNA, 20 bp, Artificial
  CRISPR gRNA sequence
gctaacacggtgaaagcccg

SEQ ID NO: 409908 - DNA, 20 bp, Artificial
  CRISPR gRNA sequence
acacggtgaaagcccgtctc

SEQ ID NO: 409909 - DNA, 20 bp, Artificial
  CRISPR gRNA sequence
tactaaaaatacaaaaaatt

SEQ ID NO: 409910 - DNA, 20 bp, Artificial
  CRISPR gRNA sequence
ctaaaaatacaaaaaattag

SEQ ID NO: 409911 - DNA, 20 bp, Artificial
  CRISPR gRNA sequence
aaaatacaaaaaattagccg

SEQ ID NO: 409912 - DNA, 20 bp, Artificial
  CRISPR gRNA sequence
gccgggcgcggtggcgggcg

SEQ ID NO: 409913 - DNA, 20 bp, Artificial
  CRISPR gRNA sequence
tagtcccagctactcaggag

SEQ ID NO: 409914 - DNA, 20 bp, Artificial
  CRISPR gRNA sequence
ctcaggaggctgaggcagga

SEQ ID NO: 409915 - DNA, 20 bp, Artificial
  CRISPR gRNA sequence
aggaggctgaggcaggagaa

SEQ ID NO: 409916 - DNA, 20 bp, Artificial
  CRISPR gRNA sequence
aggcaggagaatggcgtgaa

SEQ ID NO: 409917 - DNA, 20 bp, Artificial
  CRISPR gRNA sequence
ggaggtggaggttgcattga

SEQ ID NO: 409918 - DNA, 20 bp, Artificial
  CRISPR gRNA sequence
cattgagccgagatcacacc

SEQ ID NO: 409919 - DNA, 20 bp, Artificial
  CRISPR gRNA sequence
agccgagatcacaccactgc

SEQ ID NO: 409920 - DNA, 20 bp, Artificial
  CRISPR gRNA sequence
cactctagtctgggtgacag

SEQ ID NO: 409921 - DNA, 20 bp, Artificial
  CRISPR gRNA sequence
tagtctgggtgacagagcaa

SEQ ID NO: 409922 - DNA, 20 bp, Artificial
  CRISPR gRNA sequence
gtctgggtgacagagcaaga

SEQ ID NO: 409923 - DNA, 20 bp, Artificial
  CRISPR gRNA sequence
ggtgacagagcaagactccg

SEQ ID NO: 409924 - DNA, 20 bp, Artificial
  CRISPR gRNA sequence
cgtctcaggaaaaaaaaaaa

SEQ ID NO: 409925 - DNA, 20 bp, Artificial
  CRISPR gRNA sequence
aggaaaaaaaaaaaaaaagt

SEQ ID NO: 409926 - DNA, 20 bp, Artificial
  CRISPR gRNA sequence
acaacggaagaactgtgtta

SEQ ID NO: 409927 - DNA, 20 bp, Artificial
  CRISPR gRNA sequence
tgttaggtaacatcaccaat

SEQ ID NO: 409928 - DNA, 20 bp, Artificial
  CRISPR gRNA sequence
ggtaacatcaccaattattt

SEQ ID NO: 409929 - DNA, 20 bp, Artificial
  CRISPR gRNA sequence
tttttatgattaagtatctt

SEQ ID NO: 409930 - DNA, 20 bp, Artificial
  CRISPR gRNA sequence
ttatgattaagtatcttcca

SEQ ID NO: 409931 - DNA, 20 bp, Artificial
  CRISPR gRNA sequence
tatgattaagtatcttccag

SEQ ID NO: 409932 - DNA, 20 bp, Artificial
  CRISPR gRNA sequence
atgattaagtatcttccagt

SEQ ID NO: 409933 - DNA, 20 bp, Artificial
  CRISPR gRNA sequence
tgattaagtatcttccagtt

SEQ ID NO: 409934 - DNA, 20 bp, Artificial
  CRISPR gRNA sequence
agtatcttccagttgggtgt

SEQ ID NO: 409935 - DNA, 20 bp, Artificial
  CRISPR gRNA sequence
ccagttgggtgtcccaaaat

SEQ ID NO: 409936 - DNA, 20 bp, Artificial
  CRISPR gRNA sequence
cagttgggtgtcccaaaatt

SEQ ID NO: 409937 - DNA, 20 bp, Artificial
  CRISPR gRNA sequence
ggtgtcccaaaatttgacaa

SEQ ID NO: 409938 - DNA, 20 bp, Artificial
  CRISPR gRNA sequence
gacaacctgtatctaatcat

SEQ ID NO: 409939 - DNA, 20 bp, Artificial
  CRISPR gRNA sequence
acaacctgtatctaatcatt

SEQ ID NO: 409940 - DNA, 20 bp, Artificial
  CRISPR gRNA sequence
tatctaatcatttgcttctt

SEQ ID NO: 409941 - DNA, 20 bp, Artificial
  CRISPR gRNA sequence
atcatttgcttcttcttttc

SEQ ID NO: 409942 - DNA, 20 bp, Artificial
  CRISPR gRNA sequence
gcttcttcttttcagatagt

SEQ ID NO: 409943 - DNA, 20 bp, Artificial
  CRISPR gRNA sequence
cttcttcttttcagatagtt

SEQ ID NO: 409944 - DNA, 20 bp, Artificial
  CRISPR gRNA sequence
cttcttttcagatagttttg

SEQ ID NO: 409945 - DNA, 20 bp, Artificial
  CRISPR gRNA sequence
ttcttttcagatagttttga

SEQ ID NO: 409946 - DNA, 20 bp, Artificial
  CRISPR gRNA sequence
cttttcagatagttttgagg

SEQ ID NO: 409947 - DNA, 20 bp, Artificial
  CRISPR gRNA sequence
ttttcagatagttttgaggc

SEQ ID NO: 409948 - DNA, 20 bp, Artificial
  CRISPR gRNA sequence
ttcagatagttttgaggcag

SEQ ID NO: 409949 - DNA, 20 bp, Artificial
  CRISPR gRNA sequence
tcagatagttttgaggcagc

SEQ ID NO: 409950 - DNA, 20 bp, Artificial
  CRISPR gRNA sequence
cagatagttttgaggcagct

SEQ ID NO: 409951 - DNA, 20 bp, Artificial
  CRISPR gRNA sequence
agatagttttgaggcagctg

SEQ ID NO: 409952 - DNA, 20 bp, Artificial
  CRISPR gRNA sequence
tgaggcagctgtgccatcaa

SEQ ID NO: 409953 - DNA, 20 bp, Artificial
  CRISPR gRNA sequence
gaggcagctgtgccatcaaa

SEQ ID NO: 409954 - DNA, 20 bp, Artificial
  CRISPR gRNA sequence
aggcagctgtgccatcaaat

SEQ ID NO: 409955 - DNA, 20 bp, Artificial
  CRISPR gRNA sequence
tgccatcaaatagccacatt

SEQ ID NO: 409956 - DNA, 20 bp, Artificial
  CRISPR gRNA sequence
tttcggaacctggaaagaat

SEQ ID NO: 409957 - DNA, 20 bp, Artificial
  CRISPR gRNA sequence
cggaacctggaaagaatgtc

SEQ ID NO: 409958 - DNA, 20 bp, Artificial
  CRISPR gRNA sequence
ggaacctggaaagaatgtca

SEQ ID NO: 409959 - DNA, 20 bp, Artificial
  CRISPR gRNA sequence
gaaagaatgtcacactcact

SEQ ID NO: 409960 - DNA, 20 bp, Artificial
  CRISPR gRNA sequence
acttgtcagcctcagatgac

SEQ ID NO: 409961 - DNA, 20 bp, Artificial
  CRISPR gRNA sequence
gtcagcctcagatgacgtgg

SEQ ID NO: 409962 - DNA, 20 bp, Artificial
  CRISPR gRNA sequence
tcagcctcagatgacgtggc

SEQ ID NO: 409963 - DNA, 20 bp, Artificial
  CRISPR gRNA sequence
agatgacgtggcctgtgcag

SEQ ID NO: 409964 - DNA, 20 bp, Artificial
  CRISPR gRNA sequence
tgcaggcagtgaggtgggaa

SEQ ID NO: 409965 - DNA, 20 bp, Artificial
  CRISPR gRNA sequence
ttaacttactgcaacttggt

SEQ ID NO: 409966 - DNA, 20 bp, Artificial
  CRISPR gRNA sequence
aacttactgcaacttggtcc

SEQ ID NO: 409967 - DNA, 20 bp, Artificial
  CRISPR gRNA sequence
acttactgcaacttggtcca

SEQ ID NO: 409968 - DNA, 20 bp, Artificial
  CRISPR gRNA sequence
actgcaacttggtccatggc

SEQ ID NO: 409969 - DNA, 20 bp, Artificial
  CRISPR gRNA sequence
ctgcaacttggtccatggca

SEQ ID NO: 409970 - DNA, 20 bp, Artificial
  CRISPR gRNA sequence
caacttggtccatggcagaa

SEQ ID NO: 409971 - DNA, 20 bp, Artificial
  CRISPR gRNA sequence
ggtccatggcagaaatttca

SEQ ID NO: 409972 - DNA, 20 bp, Artificial
  CRISPR gRNA sequence
gtccatggcagaaatttcac

SEQ ID NO: 409973 - DNA, 20 bp, Artificial
  CRISPR gRNA sequence
cacctccaagttcccaagac

SEQ ID NO: 409974 - DNA, 20 bp, Artificial
  CRISPR gRNA sequence
acctccaagttcccaagaca

SEQ ID NO: 409975 - DNA, 20 bp, Artificial
  CRISPR gRNA sequence
caagttcccaagacaaatag

SEQ ID NO: 409976 - DNA, 20 bp, Artificial
  CRISPR gRNA sequence
ccaagacaaatagtgagcaa

SEQ ID NO: 409977 - DNA, 20 bp, Artificial
  CRISPR gRNA sequence
cagccacggaaggtggagcg

SEQ ID NO: 409978 - DNA, 20 bp, Artificial
  CRISPR gRNA sequence
agactcggggctttaccgct

SEQ ID NO: 409979 - DNA, 20 bp, Artificial
  CRISPR gRNA sequence
ggggctttaccgctgctact

SEQ ID NO: 409980 - DNA, 20 bp, Artificial
  CRISPR gRNA sequence
taccgctgctacttgcaggc

SEQ ID NO: 409981 - DNA, 20 bp, Artificial
  CRISPR gRNA sequence
accgctgctacttgcaggcc

SEQ ID NO: 409982 - DNA, 20 bp, Artificial
  CRISPR gRNA sequence
ccgctgctacttgcaggcca

SEQ ID NO: 409983 - DNA, 20 bp, Artificial
  CRISPR gRNA sequence
ctacttgcaggccagcgcag

SEQ ID NO: 409984 - DNA, 20 bp, Artificial
  CRISPR gRNA sequence
cttgcaggccagcgcaggag

SEQ ID NO: 409985 - DNA, 20 bp, Artificial
  CRISPR gRNA sequence
gcaggccagcgcaggagaaa

SEQ ID NO: 409986 - DNA, 20 bp, Artificial
  CRISPR gRNA sequence
caggccagcgcaggagaaaa

SEQ ID NO: 409987 - DNA, 20 bp, Artificial
  CRISPR gRNA sequence
cgtgatgagattgactgtag

SEQ ID NO: 409988 - DNA, 20 bp, Artificial
  CRISPR gRNA sequence
gtgatgagattgactgtagc

SEQ ID NO: 409989 - DNA, 20 bp, Artificial
  CRISPR gRNA sequence
actgtagccgagggtgagtg

SEQ ID NO: 409990 - DNA, 20 bp, Artificial
  CRISPR gRNA sequence
tagccgagggtgagtgagca

SEQ ID NO: 409991 - DNA, 20 bp, Artificial
  CRISPR gRNA sequence
ctggtatcaaacatggaaaa

SEQ ID NO: 409992 - DNA, 20 bp, Artificial
  CRISPR gRNA sequence
tggtatcaaacatggaaaaa

SEQ ID NO: 409993 - DNA, 20 bp, Artificial
  CRISPR gRNA sequence
gtatcaaacatggaaaaagc

SEQ ID NO: 409994 - DNA, 20 bp, Artificial
  CRISPR gRNA sequence
gtctctgtttttatttatgg

SEQ ID NO: 409995 - DNA, 20 bp, Artificial
  CRISPR gRNA sequence
tgtttttatttatggtaaac

SEQ ID NO: 409996 - DNA, 20 bp, Artificial
  CRISPR gRNA sequence
tttttatttatggtaaacat

SEQ ID NO: 409997 - DNA, 20 bp, Artificial
  CRISPR gRNA sequence
ttatttatggtaaacatgtt

SEQ ID NO: 409998 - DNA, 20 bp, Artificial
  CRISPR gRNA sequence
tatttatggtaaacatgttc

SEQ ID NO: 409999 - DNA, 20 bp, Artificial
  CRISPR gRNA sequence
atttatggtaaacatgttca

SEQ ID NO: 410000 - DNA, 20 bp, Artificial
  CRISPR gRNA sequence
tttatggtaaacatgttcat

SEQ ID NO: 410001 - DNA, 20 bp, Artificial
  CRISPR gRNA sequence
atggtaaacatgttcattta

SEQ ID NO: 410002 - DNA, 20 bp, Artificial
  CRISPR gRNA sequence
tggtaaacatgttcatttaa

SEQ ID NO: 410003 - DNA, 20 bp, Artificial
  CRISPR gRNA sequence
atttaatgcgcatattcagc

SEQ ID NO: 410004 - DNA, 20 bp, Artificial
  CRISPR gRNA sequence
aatgcgcatattcagcattt

SEQ ID NO: 410005 - DNA, 20 bp, Artificial
  CRISPR gRNA sequence
atgcgcatattcagcatttt

SEQ ID NO: 410006 - DNA, 20 bp, Artificial
  CRISPR gRNA sequence
agcatttttttaaatggctg

SEQ ID NO: 410007 - DNA, 20 bp, Artificial
  CRISPR gRNA sequence
ttttaaatggctgaatttag

SEQ ID NO: 410008 - DNA, 20 bp, Artificial
  CRISPR gRNA sequence
tttaaatggctgaatttagg

SEQ ID NO: 410009 - DNA, 20 bp, Artificial
  CRISPR gRNA sequence
ttaaatggctgaatttaggt

SEQ ID NO: 410010 - DNA, 20 bp, Artificial
  CRISPR gRNA sequence
taaatggctgaatttaggtg

SEQ ID NO: 410011 - DNA, 20 bp, Artificial
  CRISPR gRNA sequence
aaatggctgaatttaggtga

SEQ ID NO: 410012 - DNA, 20 bp, Artificial
  CRISPR gRNA sequence
aatggctgaatttaggtgag

SEQ ID NO: 410013 - DNA, 20 bp, Artificial
  CRISPR gRNA sequence
aatttaggtgagttggccat

SEQ ID NO: 410014 - DNA, 20 bp, Artificial
  CRISPR gRNA sequence
aggtgagttggccattattc

SEQ ID NO: 410015 - DNA, 20 bp, Artificial
  CRISPR gRNA sequence
ggtgagttggccattattct

SEQ ID NO: 410016 - DNA, 20 bp, Artificial
  CRISPR gRNA sequence
gccattattctagtattgag

SEQ ID NO: 410017 - DNA, 20 bp, Artificial
  CRISPR gRNA sequence
ttctagtattgagggtttct

SEQ ID NO: 410018 - DNA, 20 bp, Artificial
  CRISPR gRNA sequence
tagtattgagggtttcttta

SEQ ID NO: 410019 - DNA, 20 bp, Artificial
  CRISPR gRNA sequence
gtattgagggtttctttatc

SEQ ID NO: 410020 - DNA, 20 bp, Artificial
  CRISPR gRNA sequence
agggtttctttatcttgtga

SEQ ID NO: 410021 - DNA, 20 bp, Artificial
  CRISPR gRNA sequence
ctttatcttgtgaatccatc

SEQ ID NO: 410022 - DNA, 20 bp, Artificial
  CRISPR gRNA sequence
tttatcttgtgaatccatca

SEQ ID NO: 410023 - DNA, 20 bp, Artificial
  CRISPR gRNA sequence
tatcttgtgaatccatcaat

SEQ ID NO: 410024 - DNA, 20 bp, Artificial
  CRISPR gRNA sequence
atcttgtgaatccatcaatc

SEQ ID NO: 410025 - DNA, 20 bp, Artificial
  CRISPR gRNA sequence
tcttgtgaatccatcaatca

SEQ ID NO: 410026 - DNA, 20 bp, Artificial
  CRISPR gRNA sequence
gtgaatccatcaatcagata

SEQ ID NO: 410027 - DNA, 20 bp, Artificial
  CRISPR gRNA sequence
tgaatccatcaatcagatac

SEQ ID NO: 410028 - DNA, 20 bp, Artificial
  CRISPR gRNA sequence
tccaattttcttatctgcca

SEQ ID NO: 410029 - DNA, 20 bp, Artificial
  CRISPR gRNA sequence
ccaattttcttatctgccac

SEQ ID NO: 410030 - DNA, 20 bp, Artificial
  CRISPR gRNA sequence
caattttcttatctgccacc

SEQ ID NO: 410031 - DNA, 20 bp, Artificial
  CRISPR gRNA sequence
tcttatctgccaccatcctg

SEQ ID NO: 410032 - DNA, 20 bp, Artificial
  CRISPR gRNA sequence
cttatctgccaccatcctga

SEQ ID NO: 410033 - DNA, 20 bp, Artificial
  CRISPR gRNA sequence
ttatctgccaccatcctgaa

SEQ ID NO: 410034 - DNA, 20 bp, Artificial
  CRISPR gRNA sequence
atctgccaccatcctgaagc

SEQ ID NO: 410035 - DNA, 20 bp, Artificial
  CRISPR gRNA sequence
tctgccaccatcctgaagct

SEQ ID NO: 410036 - DNA, 20 bp, Artificial
  CRISPR gRNA sequence
ccaccatcctgaagcttaaa

SEQ ID NO: 410037 - DNA, 20 bp, Artificial
  CRISPR gRNA sequence
aagcttaaaaaagaaattcg

SEQ ID NO: 410038 - DNA, 20 bp, Artificial
  CRISPR gRNA sequence
aaaaaagaaattcgtaaagg

SEQ ID NO: 410039 - DNA, 20 bp, Artificial
  CRISPR gRNA sequence
aaaaagaaattcgtaaaggg

SEQ ID NO: 410040 - DNA, 20 bp, Artificial
  CRISPR gRNA sequence
gtaaagggctgaaaaacata

SEQ ID NO: 410041 - DNA, 20 bp, Artificial
  CRISPR gRNA sequence
aaaaacatatggtattacca

SEQ ID NO: 410042 - DNA, 20 bp, Artificial
  CRISPR gRNA sequence
ccagccttcaggtttcagct

SEQ ID NO: 410043 - DNA, 20 bp, Artificial
  CRISPR gRNA sequence
caggtttcagctgtagaact

SEQ ID NO: 410044 - DNA, 20 bp, Artificial
  CRISPR gRNA sequence
aggtttcagctgtagaactc

SEQ ID NO: 410045 - DNA, 20 bp, Artificial
  CRISPR gRNA sequence
cagctgtagaactcctatct

SEQ ID NO: 410046 - DNA, 20 bp, Artificial
  CRISPR gRNA sequence
agctgtagaactcctatctt

SEQ ID NO: 410047 - DNA, 20 bp, Artificial
  CRISPR gRNA sequence
tagaactcctatcttcccaa

SEQ ID NO: 410048 - DNA, 20 bp, Artificial
  CRISPR gRNA sequence
ctatcttcccaattacatga

SEQ ID NO: 410049 - DNA, 20 bp, Artificial
  CRISPR gRNA sequence
tcttcccaattacatgaata

SEQ ID NO: 410050 - DNA, 20 bp, Artificial
  CRISPR gRNA sequence
cccaattacatgaatatttt

SEQ ID NO: 410051 - DNA, 20 bp, Artificial
  CRISPR gRNA sequence
ccaattacatgaatattttt

SEQ ID NO: 410052 - DNA, 20 bp, Artificial
  CRISPR gRNA sequence
catgaatatttttgatggtg

SEQ ID NO: 410053 - DNA, 20 bp, Artificial
  CRISPR gRNA sequence
ttgatggtggtgataaggtg

SEQ ID NO: 410054 - DNA, 20 bp, Artificial
  CRISPR gRNA sequence
tgatggtggtgataaggtgt

SEQ ID NO: 410055 - DNA, 20 bp, Artificial
  CRISPR gRNA sequence
gatggtggtgataaggtgtt

SEQ ID NO: 410056 - DNA, 20 bp, Artificial
  CRISPR gRNA sequence
atggtggtgataaggtgtta

SEQ ID NO: 410057 - DNA, 20 bp, Artificial
  CRISPR gRNA sequence
gaatccccacataccccagc

SEQ ID NO: 410058 - DNA, 20 bp, Artificial
  CRISPR gRNA sequence
ggttgatatggctgaagcag

SEQ ID NO: 410059 - DNA, 20 bp, Artificial
  CRISPR gRNA sequence
atatggctgaagcagggctg

SEQ ID NO: 410060 - DNA, 20 bp, Artificial
  CRISPR gRNA sequence
aagcagggctgcgttgagtg

SEQ ID NO: 410061 - DNA, 20 bp, Artificial
  CRISPR gRNA sequence
cgttgagtgcatttcagcag

SEQ ID NO: 410062 - DNA, 20 bp, Artificial
  CRISPR gRNA sequence
agtgcatttcagcaggtgtt

SEQ ID NO: 410063 - DNA, 20 bp, Artificial
  CRISPR gRNA sequence
cagcaggtgtttgagaatgc

SEQ ID NO: 410064 - DNA, 20 bp, Artificial
  CRISPR gRNA sequence
agcaggtgtttgagaatgcg

SEQ ID NO: 410065 - DNA, 20 bp, Artificial
  CRISPR gRNA sequence
gagaatgcggttgccagttt

SEQ ID NO: 410066 - DNA, 20 bp, Artificial
  CRISPR gRNA sequence
agaatgcggttgccagtttg

SEQ ID NO: 410067 - DNA, 20 bp, Artificial
  CRISPR gRNA sequence
ccagtttgccagacaggagc

SEQ ID NO: 410068 - DNA, 20 bp, Artificial
  CRISPR gRNA sequence
gccagacaggagcctttttt

SEQ ID NO: 410069 - DNA, 20 bp, Artificial
  CRISPR gRNA sequence
ccagacaggagccttttttt

SEQ ID NO: 410070 - DNA, 20 bp, Artificial
  CRISPR gRNA sequence
tttttctctcagtctttttc

SEQ ID NO: 410071 - DNA, 20 bp, Artificial
  CRISPR gRNA sequence
ttttctctcagtctttttca

SEQ ID NO: 410072 - DNA, 20 bp, Artificial
  CRISPR gRNA sequence
tttctctcagtctttttcag

SEQ ID NO: 410073 - DNA, 20 bp, Artificial
  CRISPR gRNA sequence
ttctctcagtctttttcaga

SEQ ID NO: 410074 - DNA, 20 bp, Artificial
  CRISPR gRNA sequence
tctctcagtctttttcagat

SEQ ID NO: 410075 - DNA, 20 bp, Artificial
  CRISPR gRNA sequence
ctctcagtctttttcagatg

SEQ ID NO: 410076 - DNA, 20 bp, Artificial
  CRISPR gRNA sequence
tctcagtctttttcagatgt

SEQ ID NO: 410077 - DNA, 20 bp, Artificial
  CRISPR gRNA sequence
tcagtctttttcagatgtgg

SEQ ID NO: 410078 - DNA, 20 bp, Artificial
  CRISPR gRNA sequence
agtctttttcagatgtggat

SEQ ID NO: 410079 - DNA, 20 bp, Artificial
  CRISPR gRNA sequence
tttcagatgtggatgcagaa

SEQ ID NO: 410080 - DNA, 20 bp, Artificial
  CRISPR gRNA sequence
ttcagatgtggatgcagaaa

SEQ ID NO: 410081 - DNA, 20 bp, Artificial
  CRISPR gRNA sequence
tcagatgtggatgcagaaac

SEQ ID NO: 410082 - DNA, 20 bp, Artificial
  CRISPR gRNA sequence
cagatgtggatgcagaaaca

SEQ ID NO: 410083 - DNA, 20 bp, Artificial
  CRISPR gRNA sequence
agatgtggatgcagaaacag

SEQ ID NO: 410084 - DNA, 20 bp, Artificial
  CRISPR gRNA sequence
atgttgcatcttaatattac

SEQ ID NO: 410085 - DNA, 20 bp, Artificial
  CRISPR gRNA sequence
catcttaatattactaggaa

SEQ ID NO: 410086 - DNA, 20 bp, Artificial
  CRISPR gRNA sequence
aatattactaggaaaatagg

SEQ ID NO: 410087 - DNA, 20 bp, Artificial
  CRISPR gRNA sequence
atattactaggaaaataggt

SEQ ID NO: 410088 - DNA, 20 bp, Artificial
  CRISPR gRNA sequence
ctaggaaaataggtttgacc

SEQ ID NO: 410089 - DNA, 20 bp, Artificial
  CRISPR gRNA sequence
ggaaaataggtttgaccttg

SEQ ID NO: 410090 - DNA, 20 bp, Artificial
  CRISPR gRNA sequence
gaccttgcagatccccaaaa

SEQ ID NO: 410091 - DNA, 20 bp, Artificial
  CRISPR gRNA sequence
accttgcagatccccaaaag

SEQ ID NO: 410092 - DNA, 20 bp, Artificial
  CRISPR gRNA sequence
gcagatccccaaaagggaca

SEQ ID NO: 410093 - DNA, 20 bp, Artificial
  CRISPR gRNA sequence
cagatccccaaaagggacac

SEQ ID NO: 410094 - DNA, 20 bp, Artificial
  CRISPR gRNA sequence
agggacccccaaacatacta

SEQ ID NO: 410095 - DNA, 20 bp, Artificial
  CRISPR gRNA sequence
taagaaccactgacttagat

SEQ ID NO: 410096 - DNA, 20 bp, Artificial
  CRISPR gRNA sequence
acttagatctttggtgacca

SEQ ID NO: 410097 - DNA, 20 bp, Artificial
  CRISPR gRNA sequence
agatctttggtgaccattac

SEQ ID NO: 410098 - DNA, 20 bp, Artificial
  CRISPR gRNA sequence
gatctttggtgaccattact

SEQ ID NO: 410099 - DNA, 20 bp, Artificial
  CRISPR gRNA sequence
tggtgaccattactgagtat

SEQ ID NO: 410100 - DNA, 20 bp, Artificial
  CRISPR gRNA sequence
ggtgaccattactgagtata

SEQ ID NO: 410101 - DNA, 20 bp, Artificial
  CRISPR gRNA sequence
gtgaccattactgagtataa

SEQ ID NO: 410102 - DNA, 20 bp, Artificial
  CRISPR gRNA sequence
ctgagtataatctttgtgct

SEQ ID NO: 410103 - DNA, 20 bp, Artificial
  CRISPR gRNA sequence
agtataatctttgtgctggt

SEQ ID NO: 410104 - DNA, 20 bp, Artificial
  CRISPR gRNA sequence
tgtgctggtgaaattggcct

SEQ ID NO: 410105 - DNA, 20 bp, Artificial
  CRISPR gRNA sequence
gtgctggtgaaattggcctt

SEQ ID NO: 410106 - DNA, 20 bp, Artificial
  CRISPR gRNA sequence
tgctggtgaaattggccttt

SEQ ID NO: 410107 - DNA, 20 bp, Artificial
  CRISPR gRNA sequence
gtgaaattggcctttggggc

SEQ ID NO: 410108 - DNA, 20 bp, Artificial
  CRISPR gRNA sequence
gcctttggggcttccacctc

SEQ ID NO: 410109 - DNA, 20 bp, Artificial
  CRISPR gRNA sequence
tggggcttccacctcctcca

SEQ ID NO: 410110 - DNA, 20 bp, Artificial
  CRISPR gRNA sequence
ggggcttccacctcctccaa

SEQ ID NO: 410111 - DNA, 20 bp, Artificial
  CRISPR gRNA sequence
gggcttccacctcctccaag

SEQ ID NO: 410112 - DNA, 20 bp, Artificial
  CRISPR gRNA sequence
ccacctcctccaaggcctcc

SEQ ID NO: 410113 - DNA, 20 bp, Artificial
  CRISPR gRNA sequence
cacctcctccaaggcctcct

SEQ ID NO: 410114 - DNA, 20 bp, Artificial
  CRISPR gRNA sequence
ctccaaggcctcctccaagg

SEQ ID NO: 410115 - DNA, 20 bp, Artificial
  CRISPR gRNA sequence
caaggcctcctccaaggcac

SEQ ID NO: 410116 - DNA, 20 bp, Artificial
  CRISPR gRNA sequence
ctccaaggcaccacactatt

SEQ ID NO: 410117 - DNA, 20 bp, Artificial
  CRISPR gRNA sequence
caaggcaccacactatttgt

SEQ ID NO: 410118 - DNA, 20 bp, Artificial
  CRISPR gRNA sequence
tttgtatattaggcatttgt

SEQ ID NO: 410119 - DNA, 20 bp, Artificial
  CRISPR gRNA sequence
gtatattaggcatttgtctt

SEQ ID NO: 410120 - DNA, 20 bp, Artificial
  CRISPR gRNA sequence
tatattaggcatttgtcttt

SEQ ID NO: 410121 - DNA, 20 bp, Artificial
  CRISPR gRNA sequence
ggcatttgtcttttttttgt

SEQ ID NO: 410122 - DNA, 20 bp, Artificial
  CRISPR gRNA sequence
gtcttttttttgtcacaatg

SEQ ID NO: 410123 - DNA, 20 bp, Artificial
  CRISPR gRNA sequence
tcttttttttgtcacaatga

SEQ ID NO: 410124 - DNA, 20 bp, Artificial
  CRISPR gRNA sequence
ttttttgtcacaatgaagcc

SEQ ID NO: 410125 - DNA, 20 bp, Artificial
  CRISPR gRNA sequence
tttttgtcacaatgaagcct

SEQ ID NO: 410126 - DNA, 20 bp, Artificial
  CRISPR gRNA sequence
ttttgtcacaatgaagcctt

SEQ ID NO: 410127 - DNA, 20 bp, Artificial
  CRISPR gRNA sequence
tttgtcacaatgaagccttt

SEQ ID NO: 410128 - DNA, 20 bp, Artificial
  CRISPR gRNA sequence
ttgtcacaatgaagcctttc

SEQ ID NO: 410129 - DNA, 20 bp, Artificial
  CRISPR gRNA sequence
tgtcacaatgaagcctttca

SEQ ID NO: 410130 - DNA, 20 bp, Artificial
  CRISPR gRNA sequence
gtcacaatgaagcctttcat

SEQ ID NO: 410131 - DNA, 20 bp, Artificial
  CRISPR gRNA sequence
tcacaatgaagcctttcatt

SEQ ID NO: 410132 - DNA, 20 bp, Artificial
  CRISPR gRNA sequence
tcattgtgtttcaggacctg

SEQ ID NO: 410133 - DNA, 20 bp, Artificial
  CRISPR gRNA sequence
cattgtgtttcaggacctgc

SEQ ID NO: 410134 - DNA, 20 bp, Artificial
  CRISPR gRNA sequence
attgtgtttcaggacctgca

SEQ ID NO: 410135 - DNA, 20 bp, Artificial
  CRISPR gRNA sequence
tgtttcaggacctgcaaaac

SEQ ID NO: 410136 - DNA, 20 bp, Artificial
  CRISPR gRNA sequence
caggacctgcaaaacctaga

SEQ ID NO: 410137 - DNA, 20 bp, Artificial
  CRISPR gRNA sequence
aggacctgcaaaacctagat

SEQ ID NO: 410138 - DNA, 20 bp, Artificial
  CRISPR gRNA sequence
caaaacctagatccactttg

SEQ ID NO: 410139 - DNA, 20 bp, Artificial
  CRISPR gRNA sequence
gatccactttgcatgagtat

SEQ ID NO: 410140 - DNA, 20 bp, Artificial
  CRISPR gRNA sequence
tgcatgagtatgagaaaaag

SEQ ID NO: 410141 - DNA, 20 bp, Artificial
  CRISPR gRNA sequence
gcatgagtatgagaaaaagt

SEQ ID NO: 410142 - DNA, 20 bp, Artificial
  CRISPR gRNA sequence
catgagtatgagaaaaagta

SEQ ID NO: 410143 - DNA, 20 bp, Artificial
  CRISPR gRNA sequence
ctttcacttacagaagtgct

SEQ ID NO: 410144 - DNA, 20 bp, Artificial
  CRISPR gRNA sequence
tttcacttacagaagtgcta

SEQ ID NO: 410145 - DNA, 20 bp, Artificial
  CRISPR gRNA sequence
tcacttacagaagtgctaat

SEQ ID NO: 410146 - DNA, 20 bp, Artificial
  CRISPR gRNA sequence
cacttacagaagtgctaata

SEQ ID NO: 410147 - DNA, 20 bp, Artificial
  CRISPR gRNA sequence
acttacagaagtgctaatat

SEQ ID NO: 410148 - DNA, 20 bp, Artificial
  CRISPR gRNA sequence
acagaagtgctaatatagag

SEQ ID NO: 410149 - DNA, 20 bp, Artificial
  CRISPR gRNA sequence
cagaagtgctaatatagaga

SEQ ID NO: 410150 - DNA, 20 bp, Artificial
  CRISPR gRNA sequence
atatagagaggcccatatag

SEQ ID NO: 410151 - DNA, 20 bp, Artificial
  CRISPR gRNA sequence
tgtagaggcctgcattacag

SEQ ID NO: 410152 - DNA, 20 bp, Artificial
  CRISPR gRNA sequence
cattacagttgagagagagg

SEQ ID NO: 410153 - DNA, 20 bp, Artificial
  CRISPR gRNA sequence
cagttgagagagaggaaggc

SEQ ID NO: 410154 - DNA, 20 bp, Artificial
  CRISPR gRNA sequence
agagagaggaaggccatccc

SEQ ID NO: 410155 - DNA, 20 bp, Artificial
  CRISPR gRNA sequence
tcccagctctgcctctgggc

SEQ ID NO: 410156 - DNA, 20 bp, Artificial
  CRISPR gRNA sequence
ccagctctgcctctgggcca

SEQ ID NO: 410157 - DNA, 20 bp, Artificial
  CRISPR gRNA sequence
tgcctctgggccagcttcct

SEQ ID NO: 410158 - DNA, 20 bp, Artificial
  CRISPR gRNA sequence
cctctgggccagcttcctca

SEQ ID NO: 410159 - DNA, 20 bp, Artificial
  CRISPR gRNA sequence
tgggccagcttcctcactgt

SEQ ID NO: 410160 - DNA, 20 bp, Artificial
  CRISPR gRNA sequence
ggccagcttcctcactgtcg

SEQ ID NO: 410161 - DNA, 20 bp, Artificial
  CRISPR gRNA sequence
cctcactgtcgggacacgga

SEQ ID NO: 410162 - DNA, 20 bp, Artificial
  CRISPR gRNA sequence
ctcactgtcgggacacggaa

SEQ ID NO: 410163 - DNA, 20 bp, Artificial
  CRISPR gRNA sequence
actgtcgggacacggaagag

SEQ ID NO: 410164 - DNA, 20 bp, Artificial
  CRISPR gRNA sequence
tcgggacacggaagagaaaa

SEQ ID NO: 410165 - DNA, 20 bp, Artificial
  CRISPR gRNA sequence
atttttacctttcactttgt

SEQ ID NO: 410166 - DNA, 20 bp, Artificial
  CRISPR gRNA sequence
tttttacctttcactttgtt

SEQ ID NO: 410167 - DNA, 20 bp, Artificial
  CRISPR gRNA sequence
ttacctttcactttgttctc

SEQ ID NO: 410168 - DNA, 20 bp, Artificial
  CRISPR gRNA sequence
tacctttcactttgttctcc

SEQ ID NO: 410169 - DNA, 20 bp, Artificial
  CRISPR gRNA sequence
acctttcactttgttctccc

SEQ ID NO: 410170 - DNA, 20 bp, Artificial
  CRISPR gRNA sequence
cctttcactttgttctccct

SEQ ID NO: 410171 - DNA, 20 bp, Artificial
  CRISPR gRNA sequence
tcactttgttctcccttctt

SEQ ID NO: 410172 - DNA, 20 bp, Artificial
  CRISPR gRNA sequence
cactttgttctcccttcttc

SEQ ID NO: 410173 - DNA, 20 bp, Artificial
  CRISPR gRNA sequence
actttgttctcccttcttcc

SEQ ID NO: 410174 - DNA, 20 bp, Artificial
  CRISPR gRNA sequence
tgttctcccttcttcctttc

SEQ ID NO: 410175 - DNA, 20 bp, Artificial
  CRISPR gRNA sequence
gttctcccttcttcctttcc

SEQ ID NO: 410176 - DNA, 20 bp, Artificial
  CRISPR gRNA sequence
ttctcccttcttcctttcct

SEQ ID NO: 410177 - DNA, 20 bp, Artificial
  CRISPR gRNA sequence
tcccttcttcctttccttcc

SEQ ID NO: 410178 - DNA, 20 bp, Artificial
  CRISPR gRNA sequence
ccttcttcctttccttcctc

SEQ ID NO: 410179 - DNA, 20 bp, Artificial
  CRISPR gRNA sequence
cttcctttccttcctccctc

SEQ ID NO: 410180 - DNA, 20 bp, Artificial
  CRISPR gRNA sequence
ttcctttccttcctccctcc

SEQ ID NO: 410181 - DNA, 20 bp, Artificial
  CRISPR gRNA sequence
cctttccttcctccctcccc

SEQ ID NO: 410182 - DNA, 20 bp, Artificial
  CRISPR gRNA sequence
ctttccttcctccctcccct

SEQ ID NO: 410183 - DNA, 20 bp, Artificial
  CRISPR gRNA sequence
tccttcctccctcccctccc

SEQ ID NO: 410184 - DNA, 20 bp, Artificial
  CRISPR gRNA sequence
ccttcctccctcccctcccc

SEQ ID NO: 410185 - DNA, 20 bp, Artificial
  CRISPR gRNA sequence
cttcctccctcccctcccct

SEQ ID NO: 410186 - DNA, 20 bp, Artificial
  CRISPR gRNA sequence
cctccctcccctcccctcct

SEQ ID NO: 410187 - DNA, 20 bp, Artificial
  CRISPR gRNA sequence
ctccctcccctcccctcctc

SEQ ID NO: 410188 - DNA, 20 bp, Artificial
  CRISPR gRNA sequence
cctcccctcccctcctcccc

SEQ ID NO: 410189 - DNA, 20 bp, Artificial
  CRISPR gRNA sequence
ccctcccctcctcccctccc

SEQ ID NO: 410190 - DNA, 20 bp, Artificial
  CRISPR gRNA sequence
ccctcctcccctccccttcc

SEQ ID NO: 410191 - DNA, 20 bp, Artificial
  CRISPR gRNA sequence
ctcccctccccttccttccc

SEQ ID NO: 410192 - DNA, 20 bp, Artificial
  CRISPR gRNA sequence
ccctccccttccttccctcc

SEQ ID NO: 410193 - DNA, 20 bp, Artificial
  CRISPR gRNA sequence
cccttccttccctcccctac

SEQ ID NO: 410194 - DNA, 20 bp, Artificial
  CRISPR gRNA sequence
ccttccctcccctaccttcc

SEQ ID NO: 410195 - DNA, 20 bp, Artificial
  CRISPR gRNA sequence
cttccctcccctaccttccc

SEQ ID NO: 410196 - DNA, 20 bp, Artificial
  CRISPR gRNA sequence
ccctcccctaccttccccct

SEQ ID NO: 410197 - DNA, 20 bp, Artificial
  CRISPR gRNA sequence
cctcccctaccttccccctc

SEQ ID NO: 410198 - DNA, 20 bp, Artificial
  CRISPR gRNA sequence
ccctaccttccccctcccct

SEQ ID NO: 410199 - DNA, 20 bp, Artificial
  CRISPR gRNA sequence
ccttccccctcccctgccct

SEQ ID NO: 410200 - DNA, 20 bp, Artificial
  CRISPR gRNA sequence
ccccctcccctgccctcccc

SEQ ID NO: 410201 - DNA, 20 bp, Artificial
  CRISPR gRNA sequence
cccctcccctgccctccccc

SEQ ID NO: 410202 - DNA, 20 bp, Artificial
  CRISPR gRNA sequence
ccctgccctccccctcccca

SEQ ID NO: 410203 - DNA, 20 bp, Artificial
  CRISPR gRNA sequence
ccctccccctccccatctcc

SEQ ID NO: 410204 - DNA, 20 bp, Artificial
  CRISPR gRNA sequence
cccctccccatctccctccc

SEQ ID NO: 410205 - DNA, 20 bp, Artificial
  CRISPR gRNA sequence
cccatctccctccccttccc

SEQ ID NO: 410206 - DNA, 20 bp, Artificial
  CRISPR gRNA sequence
cctccccttccctccccccc

SEQ ID NO: 410207 - DNA, 20 bp, Artificial
  CRISPR gRNA sequence
cccttccctcccccccctcc

SEQ ID NO: 410208 - DNA, 20 bp, Artificial
  CRISPR gRNA sequence
ccctcccccccctcccctcc

SEQ ID NO: 410209 - DNA, 20 bp, Artificial
  CRISPR gRNA sequence
cctcccccccctcccctccc

SEQ ID NO: 410210 - DNA, 20 bp, Artificial
  CRISPR gRNA sequence
ccccccctcccctcccctcc

SEQ ID NO: 410211 - DNA, 20 bp, Artificial
  CRISPR gRNA sequence
ccctcccctcccctcctgtc

SEQ ID NO: 410212 - DNA, 20 bp, Artificial
  CRISPR gRNA sequence
ccctcccctcctgtctctcc

SEQ ID NO: 410213 - DNA, 20 bp, Artificial
  CRISPR gRNA sequence
ccctcctgtctctcccctcc

SEQ ID NO: 410214 - DNA, 20 bp, Artificial
  CRISPR gRNA sequence
ctgtctctcccctcccctcc

SEQ ID NO: 410215 - DNA, 20 bp, Artificial
  CRISPR gRNA sequence
tctctcccctcccctcccct

SEQ ID NO: 410216 - DNA, 20 bp, Artificial
  CRISPR gRNA sequence
tcccctcccctcccctcctt

SEQ ID NO: 410217 - DNA, 20 bp, Artificial
  CRISPR gRNA sequence
ccctcccctcccctcctttc

SEQ ID NO: 410218 - DNA, 20 bp, Artificial
  CRISPR gRNA sequence
ccctcccctcctttctctcc

SEQ ID NO: 410219 - DNA, 20 bp, Artificial
  CRISPR gRNA sequence
ccctcctttctctcccctcc

SEQ ID NO: 410220 - DNA, 20 bp, Artificial
  CRISPR gRNA sequence
ctttctctcccctcccctcc

SEQ ID NO: 410221 - DNA, 20 bp, Artificial
  CRISPR gRNA sequence
tctctcccctcccctccctt

SEQ ID NO: 410222 - DNA, 20 bp, Artificial
  CRISPR gRNA sequence
ctctcccctcccctcccttc

SEQ ID NO: 410223 - DNA, 20 bp, Artificial
  CRISPR gRNA sequence
tctcccctcccctcccttcc

SEQ ID NO: 410224 - DNA, 20 bp, Artificial
  CRISPR gRNA sequence
tcccctcccctcccttccct

SEQ ID NO: 410225 - DNA, 20 bp, Artificial
  CRISPR gRNA sequence
ccctcccctcccttcccttc

SEQ ID NO: 410226 - DNA, 20 bp, Artificial
  CRISPR gRNA sequence
ccctcccttcccttctctcc

SEQ ID NO: 410227 - DNA, 20 bp, Artificial
  CRISPR gRNA sequence
ccttcccttctctcccctcc

SEQ ID NO: 410228 - DNA, 20 bp, Artificial
  CRISPR gRNA sequence
cccttctctcccctcccttc

SEQ ID NO: 410229 - DNA, 20 bp, Artificial
  CRISPR gRNA sequence
ccttctctcccctcccttcc

SEQ ID NO: 410230 - DNA, 20 bp, Artificial
  CRISPR gRNA sequence
ctctcccctcccttcccttc

SEQ ID NO: 410231 - DNA, 20 bp, Artificial
  CRISPR gRNA sequence
tctcccctcccttcccttcc

SEQ ID NO: 410232 - DNA, 20 bp, Artificial
  CRISPR gRNA sequence
tcccctcccttcccttccct

SEQ ID NO: 410233 - DNA, 20 bp, Artificial
  CRISPR gRNA sequence
ccctcccttcccttccctcc

SEQ ID NO: 410234 - DNA, 20 bp, Artificial
  CRISPR gRNA sequence
ccttcccttccctcccctcc

SEQ ID NO: 410235 - DNA, 20 bp, Artificial
  CRISPR gRNA sequence
cccttccctcccctcccctc

SEQ ID NO: 410236 - DNA, 20 bp, Artificial
  CRISPR gRNA sequence
ccttccctcccctcccctcc

SEQ ID NO: 410237 - DNA, 20 bp, Artificial
  CRISPR gRNA sequence
ccctcccctcccctcccctc

SEQ ID NO: 410238 - DNA, 20 bp, Artificial
  CRISPR gRNA sequence
cctcccctcccctcccctcc

SEQ ID NO: 410239 - DNA, 20 bp, Artificial
  CRISPR gRNA sequence
ccctcccctcccctcccttc

SEQ ID NO: 410240 - DNA, 20 bp, Artificial
  CRISPR gRNA sequence
ccctcccctcccttccctcc

SEQ ID NO: 410241 - DNA, 20 bp, Artificial
  CRISPR gRNA sequence
ccctcccttccctccctccc

SEQ ID NO: 410242 - DNA, 20 bp, Artificial
  CRISPR gRNA sequence
ccttccctccctccctccct

SEQ ID NO: 410243 - DNA, 20 bp, Artificial
  CRISPR gRNA sequence
ccctccctccctccctccct

SEQ ID NO: 410244 - DNA, 20 bp, Artificial
  CRISPR gRNA sequence
cctccctccctccctccctt

SEQ ID NO: 410245 - DNA, 20 bp, Artificial
  CRISPR gRNA sequence
cctccctccctcccttcctt

SEQ ID NO: 410246 - DNA, 20 bp, Artificial
  CRISPR gRNA sequence
cctccctcccttccttcctt

SEQ ID NO: 410247 - DNA, 20 bp, Artificial
  CRISPR gRNA sequence
cctcccttccttccttcctt

SEQ ID NO: 410248 - DNA, 20 bp, Artificial
  CRISPR gRNA sequence
ccttccttccttccttcctt

SEQ ID NO: 410249 - DNA, 20 bp, Artificial
  CRISPR gRNA sequence
ccttccttccttccttcctt

SEQ ID NO: 410250 - DNA, 20 bp, Artificial
  CRISPR gRNA sequence
cttccttccttccttccttc

SEQ ID NO: 410251 - DNA, 20 bp, Artificial
  CRISPR gRNA sequence
ccttccttccttccttcctt

SEQ ID NO: 410252 - DNA, 20 bp, Artificial
  CRISPR gRNA sequence
cttccttccttccttccttc

SEQ ID NO: 410253 - DNA, 20 bp, Artificial
  CRISPR gRNA sequence
ccttccttccttccttcctt

SEQ ID NO: 410254 - DNA, 20 bp, Artificial
  CRISPR gRNA sequence
cttccttccttccttccttc

SEQ ID NO: 410255 - DNA, 20 bp, Artificial
  CRISPR gRNA sequence
ccttccttccttccttcctt

SEQ ID NO: 410256 - DNA, 20 bp, Artificial
  CRISPR gRNA sequence
cttccttccttccttccttc

SEQ ID NO: 410257 - DNA, 20 bp, Artificial
  CRISPR gRNA sequence
ccttccttccttccttcctt

SEQ ID NO: 410258 - DNA, 20 bp, Artificial
  CRISPR gRNA sequence
cttccttccttccttccttc

SEQ ID NO: 410259 - DNA, 20 bp, Artificial
  CRISPR gRNA sequence
ccttccttccttccttcctt

SEQ ID NO: 410260 - DNA, 20 bp, Artificial
  CRISPR gRNA sequence
cttccttccttccttccttc

SEQ ID NO: 410261 - DNA, 20 bp, Artificial
  CRISPR gRNA sequence
ccttccttccttccttcctc

SEQ ID NO: 410262 - DNA, 20 bp, Artificial
  CRISPR gRNA sequence
cttccttccttccttcctcc

SEQ ID NO: 410263 - DNA, 20 bp, Artificial
  CRISPR gRNA sequence
ccttccttccttcctcccac

SEQ ID NO: 410264 - DNA, 20 bp, Artificial
  CRISPR gRNA sequence
cttccttccttcctcccact

SEQ ID NO: 410265 - DNA, 20 bp, Artificial
  CRISPR gRNA sequence
ccttccttcctcccacttga

SEQ ID NO: 410266 - DNA, 20 bp, Artificial
  CRISPR gRNA sequence
cttccttcctcccacttgag

SEQ ID NO: 410267 - DNA, 20 bp, Artificial
  CRISPR gRNA sequence
ccttcctcccacttgagcag

SEQ ID NO: 410268 - DNA, 20 bp, Artificial
  CRISPR gRNA sequence
cttcctcccacttgagcagg

SEQ ID NO: 410269 - DNA, 20 bp, Artificial
  CRISPR gRNA sequence
cctcccacttgagcaggccc

SEQ ID NO: 410270 - DNA, 20 bp, Artificial
  CRISPR gRNA sequence
ctcccacttgagcaggcccc

SEQ ID NO: 410271 - DNA, 20 bp, Artificial
  CRISPR gRNA sequence
ccacttgagcaggccccttc

SEQ ID NO: 410272 - DNA, 20 bp, Artificial
  CRISPR gRNA sequence
gagcaggccccttccaaagc

SEQ ID NO: 410273 - DNA, 20 bp, Artificial
  CRISPR gRNA sequence
agcaggccccttccaaagca

SEQ ID NO: 410274 - DNA, 20 bp, Artificial
  CRISPR gRNA sequence
ccaaagcactgcactatttg

SEQ ID NO: 410275 - DNA, 20 bp, Artificial
  CRISPR gRNA sequence
caaagcactgcactatttgt

SEQ ID NO: 410276 - DNA, 20 bp, Artificial
  CRISPR gRNA sequence
cactatttgtgtattaggca

SEQ ID NO: 410277 - DNA, 20 bp, Artificial
  CRISPR gRNA sequence
tttgtgtattaggcatttgt

SEQ ID NO: 410278 - DNA, 20 bp, Artificial
  CRISPR gRNA sequence
gtgtattaggcatttgtctc

SEQ ID NO: 410279 - DNA, 20 bp, Artificial
  CRISPR gRNA sequence
tgtattaggcatttgtctct

SEQ ID NO: 410280 - DNA, 20 bp, Artificial
  CRISPR gRNA sequence
ggcatttgtctcttttgtca

SEQ ID NO: 410281 - DNA, 20 bp, Artificial
  CRISPR gRNA sequence
gtctcttttgtcacaatgaa

SEQ ID NO: 410282 - DNA, 20 bp, Artificial
  CRISPR gRNA sequence
tctcttttgtcacaatgaat

SEQ ID NO: 410283 - DNA, 20 bp, Artificial
  CRISPR gRNA sequence
ttttgtcacaatgaatcctt

SEQ ID NO: 410284 - DNA, 20 bp, Artificial
  CRISPR gRNA sequence
ttgtcacaatgaatccttaa

SEQ ID NO: 410285 - DNA, 20 bp, Artificial
  CRISPR gRNA sequence
tgtcacaatgaatccttaaa

SEQ ID NO: 410286 - DNA, 20 bp, Artificial
  CRISPR gRNA sequence
gtcacaatgaatccttaaat

SEQ ID NO: 410287 - DNA, 20 bp, Artificial
  CRISPR gRNA sequence
tcacaatgaatccttaaatt

SEQ ID NO: 410288 - DNA, 20 bp, Artificial
  CRISPR gRNA sequence
aaattgtgtaagattccagc

SEQ ID NO: 410289 - DNA, 20 bp, Artificial
  CRISPR gRNA sequence
aattgtgtaagattccagcc

SEQ ID NO: 410290 - DNA, 20 bp, Artificial
  CRISPR gRNA sequence
tgtaagattccagcccccac

SEQ ID NO: 410291 - DNA, 20 bp, Artificial
  CRISPR gRNA sequence
cagcccccacaaaacctaga

SEQ ID NO: 410292 - DNA, 20 bp, Artificial
  CRISPR gRNA sequence
gatccactttgtatgattgt

SEQ ID NO: 410293 - DNA, 20 bp, Artificial
  CRISPR gRNA sequence
tgtatgattgtgagaaaaag

SEQ ID NO: 410294 - DNA, 20 bp, Artificial
  CRISPR gRNA sequence
gtatgattgtgagaaaaagt

SEQ ID NO: 410295 - DNA, 20 bp, Artificial
  CRISPR gRNA sequence
tatgattgtgagaaaaagtg

SEQ ID NO: 410296 - DNA, 20 bp, Artificial
  CRISPR gRNA sequence
tgagaaaaagtgattttttt

SEQ ID NO: 410297 - DNA, 20 bp, Artificial
  CRISPR gRNA sequence
tttttttatttacagaagta

SEQ ID NO: 410298 - DNA, 20 bp, Artificial
  CRISPR gRNA sequence
ttttttatttacagaagtac

SEQ ID NO: 410299 - DNA, 20 bp, Artificial
  CRISPR gRNA sequence
tttttatttacagaagtaca

SEQ ID NO: 410300 - DNA, 20 bp, Artificial
  CRISPR gRNA sequence
ttttatttacagaagtacaa

SEQ ID NO: 410301 - DNA, 20 bp, Artificial
  CRISPR gRNA sequence
tttatttacagaagtacaaa

SEQ ID NO: 410302 - DNA, 20 bp, Artificial
  CRISPR gRNA sequence
ttatttacagaagtacaaat

SEQ ID NO: 410303 - DNA, 20 bp, Artificial
  CRISPR gRNA sequence
tatttacagaagtacaaata

SEQ ID NO: 410304 - DNA, 20 bp, Artificial
  CRISPR gRNA sequence
atttacagaagtacaaatat

SEQ ID NO: 410305 - DNA, 20 bp, Artificial
  CRISPR gRNA sequence
tttacagaagtacaaatata

SEQ ID NO: 410306 - DNA, 20 bp, Artificial
  CRISPR gRNA sequence
acagaagtacaaatatagag

SEQ ID NO: 410307 - DNA, 20 bp, Artificial
  CRISPR gRNA sequence
cagaagtacaaatatagagg

SEQ ID NO: 410308 - DNA, 20 bp, Artificial
  CRISPR gRNA sequence
tgtgtagaggcctgtattac

SEQ ID NO: 410309 - DNA, 20 bp, Artificial
  CRISPR gRNA sequence
tgtagaggcctgtattacag

SEQ ID NO: 410310 - DNA, 20 bp, Artificial
  CRISPR gRNA sequence
tattacagttccctccctcc

SEQ ID NO: 410311 - DNA, 20 bp, Artificial
  CRISPR gRNA sequence
cagttccctccctccctttc

SEQ ID NO: 410312 - DNA, 20 bp, Artificial
  CRISPR gRNA sequence
cctccctccctttctccctc

SEQ ID NO: 410313 - DNA, 20 bp, Artificial
  CRISPR gRNA sequence
cctccctttctccctcactc

SEQ ID NO: 410314 - DNA, 20 bp, Artificial
  CRISPR gRNA sequence
cctttctccctcactctctt

SEQ ID NO: 410315 - DNA, 20 bp, Artificial
  CRISPR gRNA sequence
tctccctcactctcttccat

SEQ ID NO: 410316 - DNA, 20 bp, Artificial
  CRISPR gRNA sequence
ctccctcactctcttccatc

SEQ ID NO: 410317 - DNA, 20 bp, Artificial
  CRISPR gRNA sequence
tccctcactctcttccatct

SEQ ID NO: 410318 - DNA, 20 bp, Artificial
  CRISPR gRNA sequence
cctcactctcttccatcttt

SEQ ID NO: 410319 - DNA, 20 bp, Artificial
  CRISPR gRNA sequence
actctcttccatctttcctt

SEQ ID NO: 410320 - DNA, 20 bp, Artificial
  CRISPR gRNA sequence
tcttccatctttccttccct

SEQ ID NO: 410321 - DNA, 20 bp, Artificial
  CRISPR gRNA sequence
ttccatctttccttcccttc

SEQ ID NO: 410322 - DNA, 20 bp, Artificial
  CRISPR gRNA sequence
ccatctttccttcccttcct

SEQ ID NO: 410323 - DNA, 20 bp, Artificial
  CRISPR gRNA sequence
catctttccttcccttcctt

SEQ ID NO: 410324 - DNA, 20 bp, Artificial
  CRISPR gRNA sequence
tccttcccttccttccttct

SEQ ID NO: 410325 - DNA, 20 bp, Artificial
  CRISPR gRNA sequence
ccttcccttccttccttctt

SEQ ID NO: 410326 - DNA, 20 bp, Artificial
  CRISPR gRNA sequence
cttcccttccttccttcttt

SEQ ID NO: 410327 - DNA, 20 bp, Artificial
  CRISPR gRNA sequence
cccttccttccttctttcac

SEQ ID NO: 410328 - DNA, 20 bp, Artificial
  CRISPR gRNA sequence
ccttccttccttctttcact

SEQ ID NO: 410329 - DNA, 20 bp, Artificial
  CRISPR gRNA sequence
ccttccttctttcactctgt

SEQ ID NO: 410330 - DNA, 20 bp, Artificial
  CRISPR gRNA sequence
cttccttctttcactctgtt

SEQ ID NO: 410331 - DNA, 20 bp, Artificial
  CRISPR gRNA sequence
ccttctttcactctgttcca

SEQ ID NO: 410332 - DNA, 20 bp, Artificial
  CRISPR gRNA sequence
cttctttcactctgttccat

SEQ ID NO: 410333 - DNA, 20 bp, Artificial
  CRISPR gRNA sequence
ctttcactctgttccattcc

SEQ ID NO: 410334 - DNA, 20 bp, Artificial
  CRISPR gRNA sequence
tttcactctgttccattccc

SEQ ID NO: 410335 - DNA, 20 bp, Artificial
  CRISPR gRNA sequence
tcactctgttccattccctt

SEQ ID NO: 410336 - DNA, 20 bp, Artificial
  CRISPR gRNA sequence
cactctgttccattcccttt

SEQ ID NO: 410337 - DNA, 20 bp, Artificial
  CRISPR gRNA sequence
actctgttccattccctttt

SEQ ID NO: 410338 - DNA, 20 bp, Artificial
  CRISPR gRNA sequence
tgttccattcccttttcttt

SEQ ID NO: 410339 - DNA, 20 bp, Artificial
  CRISPR gRNA sequence
ttccattcccttttcttttc

SEQ ID NO: 410340 - DNA, 20 bp, Artificial
  CRISPR gRNA sequence
cattcccttttcttttcttc

SEQ ID NO: 410341 - DNA, 20 bp, Artificial
  CRISPR gRNA sequence
ccttttcttttcttccttcc

SEQ ID NO: 410342 - DNA, 20 bp, Artificial
  CRISPR gRNA sequence
ttcttttcttccttcccttc

SEQ ID NO: 410343 - DNA, 20 bp, Artificial
  CRISPR gRNA sequence
tcttttcttccttcccttct

SEQ ID NO: 410344 - DNA, 20 bp, Artificial
  CRISPR gRNA sequence
cttttcttccttcccttctc

SEQ ID NO: 410345 - DNA, 20 bp, Artificial
  CRISPR gRNA sequence
ttttcttccttcccttctcc

SEQ ID NO: 410346 - DNA, 20 bp, Artificial
  CRISPR gRNA sequence
ttcttccttcccttctccct

SEQ ID NO: 410347 - DNA, 20 bp, Artificial
  CRISPR gRNA sequence
tcttccttcccttctccctt

SEQ ID NO: 410348 - DNA, 20 bp, Artificial
  CRISPR gRNA sequence
cttccttcccttctcccttc

SEQ ID NO: 410349 - DNA, 20 bp, Artificial
  CRISPR gRNA sequence
ttccttcccttctcccttcc

SEQ ID NO: 410350 - DNA, 20 bp, Artificial
  CRISPR gRNA sequence
ccttcccttctcccttccac

SEQ ID NO: 410351 - DNA, 20 bp, Artificial
  CRISPR gRNA sequence
cttcccttctcccttccaca

SEQ ID NO: 410352 - DNA, 20 bp, Artificial
  CRISPR gRNA sequence
cccttctcccttccacatgc

SEQ ID NO: 410353 - DNA, 20 bp, Artificial
  CRISPR gRNA sequence
ccttctcccttccacatgct

SEQ ID NO: 410354 - DNA, 20 bp, Artificial
  CRISPR gRNA sequence
ctcccttccacatgctttca

SEQ ID NO: 410355 - DNA, 20 bp, Artificial
  CRISPR gRNA sequence
tcccttccacatgctttcag

SEQ ID NO: 410356 - DNA, 20 bp, Artificial
  CRISPR gRNA sequence
ccttccacatgctttcagcc

SEQ ID NO: 410357 - DNA, 20 bp, Artificial
  CRISPR gRNA sequence
ccacatgctttcagccagct

SEQ ID NO: 410358 - DNA, 20 bp, Artificial
  CRISPR gRNA sequence
cacatgctttcagccagcta

SEQ ID NO: 410359 - DNA, 20 bp, Artificial
  CRISPR gRNA sequence
tcagccagctaatttacctt

SEQ ID NO: 410360 - DNA, 20 bp, Artificial
  CRISPR gRNA sequence
cagccagctaatttaccttt

SEQ ID NO: 410361 - DNA, 20 bp, Artificial
  CRISPR gRNA sequence
agccagctaatttacctttg

SEQ ID NO: 410362 - DNA, 20 bp, Artificial
  CRISPR gRNA sequence
atttacctttgacttatgtt

SEQ ID NO: 410363 - DNA, 20 bp, Artificial
  CRISPR gRNA sequence
acctttgacttatgttagac

SEQ ID NO: 410364 - DNA, 20 bp, Artificial
  CRISPR gRNA sequence
cctttgacttatgttagact

SEQ ID NO: 410365 - DNA, 20 bp, Artificial
  CRISPR gRNA sequence
tgacttatgttagacttgta

SEQ ID NO: 410366 - DNA, 20 bp, Artificial
  CRISPR gRNA sequence
gacttatgttagacttgtag

SEQ ID NO: 410367 - DNA, 20 bp, Artificial
  CRISPR gRNA sequence
acttatgttagacttgtaga

SEQ ID NO: 410368 - DNA, 20 bp, Artificial
  CRISPR gRNA sequence
atgttagacttgtagagcca

SEQ ID NO: 410369 - DNA, 20 bp, Artificial
  CRISPR gRNA sequence
tgttagacttgtagagccaa

SEQ ID NO: 410370 - DNA, 20 bp, Artificial
  CRISPR gRNA sequence
gacttgtagagccaacgctt

SEQ ID NO: 410371 - DNA, 20 bp, Artificial
  CRISPR gRNA sequence
gtagagccaacgcttgctag

SEQ ID NO: 410372 - DNA, 20 bp, Artificial
  CRISPR gRNA sequence
tagagccaacgcttgctagg

SEQ ID NO: 410373 - DNA, 20 bp, Artificial
  CRISPR gRNA sequence
gctaggctttggctgtccct

SEQ ID NO: 410374 - DNA, 20 bp, Artificial
  CRISPR gRNA sequence
ctaggctttggctgtccctt

SEQ ID NO: 410375 - DNA, 20 bp, Artificial
  CRISPR gRNA sequence
ggctttggctgtccctttat

SEQ ID NO: 410376 - DNA, 20 bp, Artificial
  CRISPR gRNA sequence
tggctgtccctttatagact

SEQ ID NO: 410377 - DNA, 20 bp, Artificial
  CRISPR gRNA sequence
ggctgtccctttatagactt

SEQ ID NO: 410378 - DNA, 20 bp, Artificial
  CRISPR gRNA sequence
gctgtccctttatagacttt

SEQ ID NO: 410379 - DNA, 20 bp, Artificial
  CRISPR gRNA sequence
tccctttatagactttgctc

SEQ ID NO: 410380 - DNA, 20 bp, Artificial
  CRISPR gRNA sequence
tatagactttgctcatattg

SEQ ID NO: 410381 - DNA, 20 bp, Artificial
  CRISPR gRNA sequence
atagactttgctcatattgc

SEQ ID NO: 410382 - DNA, 20 bp, Artificial
  CRISPR gRNA sequence
tagactttgctcatattgca

SEQ ID NO: 410383 - DNA, 20 bp, Artificial
  CRISPR gRNA sequence
tgctcatattgcaaactgat

SEQ ID NO: 410384 - DNA, 20 bp, Artificial
  CRISPR gRNA sequence
gctcatattgcaaactgata

SEQ ID NO: 410385 - DNA, 20 bp, Artificial
  CRISPR gRNA sequence
ctcatattgcaaactgatat

SEQ ID NO: 410386 - DNA, 20 bp, Artificial
  CRISPR gRNA sequence
atattgcaaactgatatttc

SEQ ID NO: 410387 - DNA, 20 bp, Artificial
  CRISPR gRNA sequence
caaactgatatttcttcctg

SEQ ID NO: 410388 - DNA, 20 bp, Artificial
  CRISPR gRNA sequence
atatttcttcctgtgttgaa

SEQ ID NO: 410389 - DNA, 20 bp, Artificial
  CRISPR gRNA sequence
cttcctgtgttgaaaatgaa

SEQ ID NO: 410390 - DNA, 20 bp, Artificial
  CRISPR gRNA sequence
ttcctgtgttgaaaatgaag

SEQ ID NO: 410391 - DNA, 20 bp, Artificial
  CRISPR gRNA sequence
cctgtgttgaaaatgaagaa

SEQ ID NO: 410392 - DNA, 20 bp, Artificial
  CRISPR gRNA sequence
ctgtgttgaaaatgaagaag

SEQ ID NO: 410393 - DNA, 20 bp, Artificial
  CRISPR gRNA sequence
tgttgaaaatgaagaagaaa

SEQ ID NO: 410394 - DNA, 20 bp, Artificial
  CRISPR gRNA sequence
aaaatgaagaagaaaaggtc

SEQ ID NO: 410395 - DNA, 20 bp, Artificial
  CRISPR gRNA sequence
gtataaacagaagcttccac

SEQ ID NO: 410396 - DNA, 20 bp, Artificial
  CRISPR gRNA sequence
tataaacagaagcttccact

SEQ ID NO: 410397 - DNA, 20 bp, Artificial
  CRISPR gRNA sequence
ccactatagctctgtgtata

SEQ ID NO: 410398 - DNA, 20 bp, Artificial
  CRISPR gRNA sequence
cactatagctctgtgtataa

SEQ ID NO: 410399 - DNA, 20 bp, Artificial
  CRISPR gRNA sequence
tagctctgtgtataataagg

SEQ ID NO: 410400 - DNA, 20 bp, Artificial
  CRISPR gRNA sequence
tgtgtataataaggagagca

SEQ ID NO: 410401 - DNA, 20 bp, Artificial
  CRISPR gRNA sequence
tgtataataaggagagcatt

SEQ ID NO: 410402 - DNA, 20 bp, Artificial
  CRISPR gRNA sequence
tcagggaataacatcttttc

SEQ ID NO: 410403 - DNA, 20 bp, Artificial
  CRISPR gRNA sequence
cagggaataacatcttttca

SEQ ID NO: 410404 - DNA, 20 bp, Artificial
  CRISPR gRNA sequence
agggaataacatcttttcat

SEQ ID NO: 410405 - DNA, 20 bp, Artificial
  CRISPR gRNA sequence
ttcatacacaatcaccttgg

SEQ ID NO: 410406 - DNA, 20 bp, Artificial
  CRISPR gRNA sequence
tcatacacaatcaccttgga

SEQ ID NO: 410407 - DNA, 20 bp, Artificial
  CRISPR gRNA sequence
catacacaatcaccttggac

SEQ ID NO: 410408 - DNA, 20 bp, Artificial
  CRISPR gRNA sequence
atacacaatcaccttggacc

SEQ ID NO: 410409 - DNA, 20 bp, Artificial
  CRISPR gRNA sequence
ggaccacatcaagcctccct

SEQ ID NO: 410410 - DNA, 20 bp, Artificial
  CRISPR gRNA sequence
gaccacatcaagcctccctt

SEQ ID NO: 410411 - DNA, 20 bp, Artificial
  CRISPR gRNA sequence
ccttgttcctctaggaactg

SEQ ID NO: 410412 - DNA, 20 bp, Artificial
  CRISPR gRNA sequence
gttcctctaggaactgtggt

SEQ ID NO: 410413 - DNA, 20 bp, Artificial
  CRISPR gRNA sequence
ttcctctaggaactgtggtg

SEQ ID NO: 410414 - DNA, 20 bp, Artificial
  CRISPR gRNA sequence
ctctaggaactgtggtgaga

SEQ ID NO: 410415 - DNA, 20 bp, Artificial
  CRISPR gRNA sequence
taggaactgtggtgagacat

SEQ ID NO: 410416 - DNA, 20 bp, Artificial
  CRISPR gRNA sequence
ggaactgtggtgagacatac

SEQ ID NO: 410417 - DNA, 20 bp, Artificial
  CRISPR gRNA sequence
tggtgagacatacattggac

SEQ ID NO: 410418 - DNA, 20 bp, Artificial
  CRISPR gRNA sequence
gacttagaatttaatgaaaa

SEQ ID NO: 410419 - DNA, 20 bp, Artificial
  CRISPR gRNA sequence
agaatttaatgaaaatgatg

SEQ ID NO: 410420 - DNA, 20 bp, Artificial
  CRISPR gRNA sequence
gaatttaatgaaaatgatga

SEQ ID NO: 410421 - DNA, 20 bp, Artificial
  CRISPR gRNA sequence
aatgaaaatgatgagtggtt

SEQ ID NO: 410422 - DNA, 20 bp, Artificial
  CRISPR gRNA sequence
atgaaaatgatgagtggttg

SEQ ID NO: 410423 - DNA, 20 bp, Artificial
  CRISPR gRNA sequence
gtgaaatatttgggggagga

SEQ ID NO: 410424 - DNA, 20 bp, Artificial
  CRISPR gRNA sequence
gggggaggaaaaattagcag

SEQ ID NO: 410425 - DNA, 20 bp, Artificial
  CRISPR gRNA sequence
ggggaggaaaaattagcaga

SEQ ID NO: 410426 - DNA, 20 bp, Artificial
  CRISPR gRNA sequence
gcagagactcctcattttaa

SEQ ID NO: 410427 - DNA, 20 bp, Artificial
  CRISPR gRNA sequence
ctcattttaaatgttgactc

SEQ ID NO: 410428 - DNA, 20 bp, Artificial
  CRISPR gRNA sequence
attttaaatgttgactctgt

SEQ ID NO: 410429 - DNA, 20 bp, Artificial
  CRISPR gRNA sequence
taaatgttgactctgttcct

SEQ ID NO: 410430 - DNA, 20 bp, Artificial
  CRISPR gRNA sequence
aaatgttgactctgttcctt

SEQ ID NO: 410431 - DNA, 20 bp, Artificial
  CRISPR gRNA sequence
aatgttgactctgttccttc

SEQ ID NO: 410432 - DNA, 20 bp, Artificial
  CRISPR gRNA sequence
actctgttccttcagacaca

SEQ ID NO: 410433 - DNA, 20 bp, Artificial
  CRISPR gRNA sequence
tgttccttcagacacagaca

SEQ ID NO: 410434 - DNA, 20 bp, Artificial
  CRISPR gRNA sequence
ttccttcagacacagacaaa

SEQ ID NO: 410435 - DNA, 20 bp, Artificial
  CRISPR gRNA sequence
cttcagacacagacaaaaag

SEQ ID NO: 410436 - DNA, 20 bp, Artificial
  CRISPR gRNA sequence
cagacacagacaaaaagaac

SEQ ID NO: 410437 - DNA, 20 bp, Artificial
  CRISPR gRNA sequence
agacacagacaaaaagaact

SEQ ID NO: 410438 - DNA, 20 bp, Artificial
  CRISPR gRNA sequence
cttacctaaaaatcccttgc

SEQ ID NO: 410439 - DNA, 20 bp, Artificial
  CRISPR gRNA sequence
ttacctaaaaatcccttgca

SEQ ID NO: 410440 - DNA, 20 bp, Artificial
  CRISPR gRNA sequence
acctaaaaatcccttgcatt

SEQ ID NO: 410441 - DNA, 20 bp, Artificial
  CRISPR gRNA sequence
cctaaaaatcccttgcatta

SEQ ID NO: 410442 - DNA, 20 bp, Artificial
  CRISPR gRNA sequence
aaaatcccttgcattatgga

SEQ ID NO: 410443 - DNA, 20 bp, Artificial
  CRISPR gRNA sequence
gcattatggaagtatttttt

SEQ ID NO: 410444 - DNA, 20 bp, Artificial
  CRISPR gRNA sequence
cattatggaagtattttttg

SEQ ID NO: 410445 - DNA, 20 bp, Artificial
  CRISPR gRNA sequence
tggaagtattttttgaaact

SEQ ID NO: 410446 - DNA, 20 bp, Artificial
  CRISPR gRNA sequence
tttgaaactggtcaggaaaa

SEQ ID NO: 410447 - DNA, 20 bp, Artificial
  CRISPR gRNA sequence
ttgaaactggtcaggaaaaa

SEQ ID NO: 410448 - DNA, 20 bp, Artificial
  CRISPR gRNA sequence
tgaaactggtcaggaaaaag

SEQ ID NO: 410449 - DNA, 20 bp, Artificial
  CRISPR gRNA sequence
gaaactggtcaggaaaaaga

SEQ ID NO: 410450 - DNA, 20 bp, Artificial
  CRISPR gRNA sequence
aaactggtcaggaaaaagaa

SEQ ID NO: 410451 - DNA, 20 bp, Artificial
  CRISPR gRNA sequence
gtcaggaaaaagaaacagtg

SEQ ID NO: 410452 - DNA, 20 bp, Artificial
  CRISPR gRNA sequence
gagaccaaggcaagaaaaaa

SEQ ID NO: 410453 - DNA, 20 bp, Artificial
  CRISPR gRNA sequence
tattcagaaaagtgtcataa

SEQ ID NO: 410454 - DNA, 20 bp, Artificial
  CRISPR gRNA sequence
ttcagaaaagtgtcataaag

SEQ ID NO: 410455 - DNA, 20 bp, Artificial
  CRISPR gRNA sequence
agaaaagtgtcataaagaat

SEQ ID NO: 410456 - DNA, 20 bp, Artificial
  CRISPR gRNA sequence
tcaaacacgtataagatttt

SEQ ID NO: 410457 - DNA, 20 bp, Artificial
  CRISPR gRNA sequence
caaacacgtataagattttg

SEQ ID NO: 410458 - DNA, 20 bp, Artificial
  CRISPR gRNA sequence
aaacacgtataagattttgc

SEQ ID NO: 410459 - DNA, 20 bp, Artificial
  CRISPR gRNA sequence
tgcccattatatgctgaaaa

SEQ ID NO: 410460 - DNA, 20 bp, Artificial
  CRISPR gRNA sequence
gcccattatatgctgaaaaa

SEQ ID NO: 410461 - DNA, 20 bp, Artificial
  CRISPR gRNA sequence
cccattatatgctgaaaaag

SEQ ID NO: 410462 - DNA, 20 bp, Artificial
  CRISPR gRNA sequence
tatgctgaaaaagtaattgt

SEQ ID NO: 410463 - DNA, 20 bp, Artificial
  CRISPR gRNA sequence
aaaaagtaattgtaaacatc

SEQ ID NO: 410464 - DNA, 20 bp, Artificial
  CRISPR gRNA sequence
taaacatcttaaattataga

SEQ ID NO: 410465 - DNA, 20 bp, Artificial
  CRISPR gRNA sequence
aaattatagagaaaatgaag

SEQ ID NO: 410466 - DNA, 20 bp, Artificial
  CRISPR gRNA sequence
aattatagagaaaatgaagg

SEQ ID NO: 410467 - DNA, 20 bp, Artificial
  CRISPR gRNA sequence
tagagaaaatgaaggtaaca

SEQ ID NO: 410468 - DNA, 20 bp, Artificial
  CRISPR gRNA sequence
ttaggagatatggttattta

SEQ ID NO: 410469 - DNA, 20 bp, Artificial
  CRISPR gRNA sequence
taggagatatggttatttaa

SEQ ID NO: 410470 - DNA, 20 bp, Artificial
  CRISPR gRNA sequence
aggagatatggttatttaac

SEQ ID NO: 410471 - DNA, 20 bp, Artificial
  CRISPR gRNA sequence
ggagatatggttatttaact

SEQ ID NO: 410472 - DNA, 20 bp, Artificial
  CRISPR gRNA sequence
tttaactcttattaattaat

SEQ ID NO: 410473 - DNA, 20 bp, Artificial
  CRISPR gRNA sequence
aactcttattaattaataaa

SEQ ID NO: 410474 - DNA, 20 bp, Artificial
  CRISPR gRNA sequence
actcttattaattaataaaa

SEQ ID NO: 410475 - DNA, 20 bp, Artificial
  CRISPR gRNA sequence
ttattaattaataaaaatgt

SEQ ID NO: 410476 - DNA, 20 bp, Artificial
  CRISPR gRNA sequence
attaattaataaaaatgtca

SEQ ID NO: 410477 - DNA, 20 bp, Artificial
  CRISPR gRNA sequence
ttaattaataaaaatgtcat

SEQ ID NO: 410478 - DNA, 20 bp, Artificial
  CRISPR gRNA sequence
attaataaaaatgtcattca

SEQ ID NO: 410479 - DNA, 20 bp, Artificial
  CRISPR gRNA sequence
ataaaaatgtcattcatctg

SEQ ID NO: 410480 - DNA, 20 bp, Artificial
  CRISPR gRNA sequence
atctgtccaaagatgactaa

SEQ ID NO: 410481 - DNA, 20 bp, Artificial
  CRISPR gRNA sequence
tccaaagatgactaagtttc

SEQ ID NO: 410482 - DNA, 20 bp, Artificial
  CRISPR gRNA sequence
agtttcttgcacaaaactat

SEQ ID NO: 410483 - DNA, 20 bp, Artificial
  CRISPR gRNA sequence
cttgcacaaaactatttctt

SEQ ID NO: 410484 - DNA, 20 bp, Artificial
  CRISPR gRNA sequence
ttgcacaaaactatttcttt

SEQ ID NO: 410485 - DNA, 20 bp, Artificial
  CRISPR gRNA sequence
gcacaaaactatttctttgt

SEQ ID NO: 410486 - DNA, 20 bp, Artificial
  CRISPR gRNA sequence
cacaaaactatttctttgta

SEQ ID NO: 410487 - DNA, 20 bp, Artificial
  CRISPR gRNA sequence
tttctttgtatgtaaattat

SEQ ID NO: 410488 - DNA, 20 bp, Artificial
  CRISPR gRNA sequence
ctttgtatgtaaattataaa

SEQ ID NO: 410489 - DNA, 20 bp, Artificial
  CRISPR gRNA sequence
tttgtatgtaaattataaac

SEQ ID NO: 410490 - DNA, 20 bp, Artificial
  CRISPR gRNA sequence
tgtatgtaaattataaacag

SEQ ID NO: 410491 - DNA, 20 bp, Artificial
  CRISPR gRNA sequence
gtatgtaaattataaacagc

SEQ ID NO: 410492 - DNA, 20 bp, Artificial
  CRISPR gRNA sequence
tatgtaaattataaacagcg

SEQ ID NO: 410493 - DNA, 20 bp, Artificial
  CRISPR gRNA sequence
taaacagcgtcaaactctgc

SEQ ID NO: 410494 - DNA, 20 bp, Artificial
  CRISPR gRNA sequence
tgccaatgaaatgaagatga

SEQ ID NO: 410495 - DNA, 20 bp, Artificial
  CRISPR gRNA sequence
ccaatgaaatgaagatgact

SEQ ID NO: 410496 - DNA, 20 bp, Artificial
  CRISPR gRNA sequence
aatgtaatggtcagtagtgt

SEQ ID NO: 410497 - DNA, 20 bp, Artificial
  CRISPR gRNA sequence
gtgtccatgtgttttgaaca

SEQ ID NO: 410498 - DNA, 20 bp, Artificial
  CRISPR gRNA sequence
tgaacagttgcaaatggctt

SEQ ID NO: 410499 - DNA, 20 bp, Artificial
  CRISPR gRNA sequence
gaacagttgcaaatggcttt

SEQ ID NO: 410500 - DNA, 20 bp, Artificial
  CRISPR gRNA sequence
aacagttgcaaatggctttt

SEQ ID NO: 410501 - DNA, 20 bp, Artificial
  CRISPR gRNA sequence
caaatggctttttgacattc

SEQ ID NO: 410502 - DNA, 20 bp, Artificial
  CRISPR gRNA sequence
tttgacattcagttgacaga

SEQ ID NO: 410503 - DNA, 20 bp, Artificial
  CRISPR gRNA sequence
ttgacattcagttgacagat

SEQ ID NO: 410504 - DNA, 20 bp, Artificial
  CRISPR gRNA sequence
tgacattcagttgacagatt

SEQ ID NO: 410505 - DNA, 20 bp, Artificial
  CRISPR gRNA sequence
gacattcagttgacagattg

SEQ ID NO: 410506 - DNA, 20 bp, Artificial
  CRISPR gRNA sequence
acattcagttgacagattga

SEQ ID NO: 410507 - DNA, 20 bp, Artificial
  CRISPR gRNA sequence
agttgacagattgaaagaat

SEQ ID NO: 410508 - DNA, 20 bp, Artificial
  CRISPR gRNA sequence
acagattgaaagaatgtcaa

SEQ ID NO: 410509 - DNA, 20 bp, Artificial
  CRISPR gRNA sequence
aaagaatgtcaactggacct

SEQ ID NO: 410510 - DNA, 20 bp, Artificial
  CRISPR gRNA sequence
gaccttgtatccattagtaa

SEQ ID NO: 410511 - DNA, 20 bp, Artificial
  CRISPR gRNA sequence
gtatccattagtaaaaagtt

SEQ ID NO: 410512 - DNA, 20 bp, Artificial
  CRISPR gRNA sequence
tatccattagtaaaaagtta

SEQ ID NO: 410513 - DNA, 20 bp, Artificial
  CRISPR gRNA sequence
gtaaaaagttatcattgaca

SEQ ID NO: 410514 - DNA, 20 bp, Artificial
  CRISPR gRNA sequence
tcattgacagaagatgacag

SEQ ID NO: 410515 - DNA, 20 bp, Artificial
  CRISPR gRNA sequence
acagaagatgacagccattg

SEQ ID NO: 410516 - DNA, 20 bp, Artificial
  CRISPR gRNA sequence
actgtatgtttcagtttaat

SEQ ID NO: 410517 - DNA, 20 bp, Artificial
  CRISPR gRNA sequence
tatgtttcagtttaattcct

SEQ ID NO: 410518 - DNA, 20 bp, Artificial
  CRISPR gRNA sequence
cagtttaattccttttttca

SEQ ID NO: 410519 - DNA, 20 bp, Artificial
  CRISPR gRNA sequence
agtttaattccttttttcaa

SEQ ID NO: 410520 - DNA, 20 bp, Artificial
  CRISPR gRNA sequence
aattccttttttcaattttt

SEQ ID NO: 410521 - DNA, 20 bp, Artificial
  CRISPR gRNA sequence
attccttttttcaattttta

SEQ ID NO: 410522 - DNA, 20 bp, Artificial
  CRISPR gRNA sequence
cttttttcaatttttataag

SEQ ID NO: 410523 - DNA, 20 bp, Artificial
  CRISPR gRNA sequence
ttttcaatttttataagtga

SEQ ID NO: 410524 - DNA, 20 bp, Artificial
  CRISPR gRNA sequence
tttcaatttttataagtgaa

SEQ ID NO: 410525 - DNA, 20 bp, Artificial
  CRISPR gRNA sequence
ttcaatttttataagtgaaa

SEQ ID NO: 410526 - DNA, 20 bp, Artificial
  CRISPR gRNA sequence
tcaatttttataagtgaaag

SEQ ID NO: 410527 - DNA, 20 bp, Artificial
  CRISPR gRNA sequence
caatttttataagtgaaaga

SEQ ID NO: 410528 - DNA, 20 bp, Artificial
  CRISPR gRNA sequence
aatttttataagtgaaagat

SEQ ID NO: 410529 - DNA, 20 bp, Artificial
  CRISPR gRNA sequence
ttataagtgaaagattgaat

SEQ ID NO: 410530 - DNA, 20 bp, Artificial
  CRISPR gRNA sequence
tataagtgaaagattgaata

SEQ ID NO: 410531 - DNA, 20 bp, Artificial
  CRISPR gRNA sequence
ataagtgaaagattgaatat

SEQ ID NO: 410532 - DNA, 20 bp, Artificial
  CRISPR gRNA sequence
taagtgaaagattgaatata

SEQ ID NO: 410533 - DNA, 20 bp, Artificial
  CRISPR gRNA sequence
aatataaaacttagatgcaa

SEQ ID NO: 410534 - DNA, 20 bp, Artificial
  CRISPR gRNA sequence
agatgcaaagcaaaacagat

SEQ ID NO: 410535 - DNA, 20 bp, Artificial
  CRISPR gRNA sequence
gatgcaaagcaaaacagatc

SEQ ID NO: 410536 - DNA, 20 bp, Artificial
  CRISPR gRNA sequence
gtgttttctctggtgcaatt

SEQ ID NO: 410537 - DNA, 20 bp, Artificial
  CRISPR gRNA sequence
tgttttctctggtgcaattt

SEQ ID NO: 410538 - DNA, 20 bp, Artificial
  CRISPR gRNA sequence
tctctggtgcaatttgatta

SEQ ID NO: 410539 - DNA, 20 bp, Artificial
  CRISPR gRNA sequence
ctctggtgcaatttgattat

SEQ ID NO: 410540 - DNA, 20 bp, Artificial
  CRISPR gRNA sequence
tctggtgcaatttgattatt

SEQ ID NO: 410541 - DNA, 20 bp, Artificial
  CRISPR gRNA sequence
tggtgcaatttgattatttc

SEQ ID NO: 410542 - DNA, 20 bp, Artificial
  CRISPR gRNA sequence
gtgcaatttgattatttcac

SEQ ID NO: 410543 - DNA, 20 bp, Artificial
  CRISPR gRNA sequence
gattatttcacgtcttgagg

SEQ ID NO: 410544 - DNA, 20 bp, Artificial
  CRISPR gRNA sequence
attatttcacgtcttgaggc

SEQ ID NO: 410545 - DNA, 20 bp, Artificial
  CRISPR gRNA sequence
tttcacgtcttgaggctctt

SEQ ID NO: 410546 - DNA, 20 bp, Artificial
  CRISPR gRNA sequence
cacgtcttgaggctctttgg

SEQ ID NO: 410547 - DNA, 20 bp, Artificial
  CRISPR gRNA sequence
acgtcttgaggctctttggt

SEQ ID NO: 410548 - DNA, 20 bp, Artificial
  CRISPR gRNA sequence
gaggctctttggtcaaaaat

SEQ ID NO: 410549 - DNA, 20 bp, Artificial
  CRISPR gRNA sequence
aggctctttggtcaaaaatc

SEQ ID NO: 410550 - DNA, 20 bp, Artificial
  CRISPR gRNA sequence
tttggtcaaaaatcaatgtg

SEQ ID NO: 410551 - DNA, 20 bp, Artificial
  CRISPR gRNA sequence
tggtcaaaaatcaatgtgga

SEQ ID NO: 410552 - DNA, 20 bp, Artificial
  CRISPR gRNA sequence
ggtcaaaaatcaatgtggag

SEQ ID NO: 410553 - DNA, 20 bp, Artificial
  CRISPR gRNA sequence
gtcaaaaatcaatgtggaga

SEQ ID NO: 410554 - DNA, 20 bp, Artificial
  CRISPR gRNA sequence
aagcagagagacagatataa

SEQ ID NO: 410555 - DNA, 20 bp, Artificial
  CRISPR gRNA sequence
aatttatttcaactgccaag

SEQ ID NO: 410556 - DNA, 20 bp, Artificial
  CRISPR gRNA sequence
atttatttcaactgccaagg

SEQ ID NO: 410557 - DNA, 20 bp, Artificial
  CRISPR gRNA sequence
atttcaactgccaagggaaa

SEQ ID NO: 410558 - DNA, 20 bp, Artificial
  CRISPR gRNA sequence
tttcaactgccaagggaaag

SEQ ID NO: 410559 - DNA, 20 bp, Artificial
  CRISPR gRNA sequence
caactgccaagggaaaggtg

SEQ ID NO: 410560 - DNA, 20 bp, Artificial
  CRISPR gRNA sequence
aactgccaagggaaaggtga

SEQ ID NO: 410561 - DNA, 20 bp, Artificial
  CRISPR gRNA sequence
ccaagggaaaggtgattgtg

SEQ ID NO: 410562 - DNA, 20 bp, Artificial
  CRISPR gRNA sequence
tggcagattttataaattgc

SEQ ID NO: 410563 - DNA, 20 bp, Artificial
  CRISPR gRNA sequence
tataaattgctgtacatact

SEQ ID NO: 410564 - DNA, 20 bp, Artificial
  CRISPR gRNA sequence
ataaattgctgtacatactt

SEQ ID NO: 410565 - DNA, 20 bp, Artificial
  CRISPR gRNA sequence
taaattgctgtacatacttt

SEQ ID NO: 410566 - DNA, 20 bp, Artificial
  CRISPR gRNA sequence
ctgtacatacttttgttagt

SEQ ID NO: 410567 - DNA, 20 bp, Artificial
  CRISPR gRNA sequence
tacatacttttgttagttct

SEQ ID NO: 410568 - DNA, 20 bp, Artificial
  CRISPR gRNA sequence
ttgttagttctcaatgactt

SEQ ID NO: 410569 - DNA, 20 bp, Artificial
  CRISPR gRNA sequence
tgttagttctcaatgacttc

SEQ ID NO: 410570 - DNA, 20 bp, Artificial
  CRISPR gRNA sequence
gttagttctcaatgacttct

SEQ ID NO: 410571 - DNA, 20 bp, Artificial
  CRISPR gRNA sequence
ttagttctcaatgacttctt

SEQ ID NO: 410572 - DNA, 20 bp, Artificial
  CRISPR gRNA sequence
gttctcaatgacttctttta

SEQ ID NO: 410573 - DNA, 20 bp, Artificial
  CRISPR gRNA sequence
tcaatgacttcttttatagc

SEQ ID NO: 410574 - DNA, 20 bp, Artificial
  CRISPR gRNA sequence
aatgacttcttttatagcac

SEQ ID NO: 410575 - DNA, 20 bp, Artificial
  CRISPR gRNA sequence
cttttatagcacatagtatt

SEQ ID NO: 410576 - DNA, 20 bp, Artificial
  CRISPR gRNA sequence
ttttatagcacatagtattg

SEQ ID NO: 410577 - DNA, 20 bp, Artificial
  CRISPR gRNA sequence
ttatagcacatagtattgga

SEQ ID NO: 410578 - DNA, 20 bp, Artificial
  CRISPR gRNA sequence
tatagcacatagtattggat

SEQ ID NO: 410579 - DNA, 20 bp, Artificial
  CRISPR gRNA sequence
atagcacatagtattggatc

SEQ ID NO: 410580 - DNA, 20 bp, Artificial
  CRISPR gRNA sequence
tagcacatagtattggatct

SEQ ID NO: 410581 - DNA, 20 bp, Artificial
  CRISPR gRNA sequence
gatctaaaagagagattttt

SEQ ID NO: 410582 - DNA, 20 bp, Artificial
  CRISPR gRNA sequence
aaagagagatttttaggact

SEQ ID NO: 410583 - DNA, 20 bp, Artificial
  CRISPR gRNA sequence
ttaggactctcatattcata

SEQ ID NO: 410584 - DNA, 20 bp, Artificial
  CRISPR gRNA sequence
taggactctcatattcatac

SEQ ID NO: 410585 - DNA, 20 bp, Artificial
  CRISPR gRNA sequence
aggactctcatattcataca

SEQ ID NO: 410586 - DNA, 20 bp, Artificial
  CRISPR gRNA sequence
ggactctcatattcatacac

SEQ ID NO: 410587 - DNA, 20 bp, Artificial
  CRISPR gRNA sequence
tcatattcatacacacacac

SEQ ID NO: 410588 - DNA, 20 bp, Artificial
  CRISPR gRNA sequence
atattcatacacacacacac

SEQ ID NO: 410589 - DNA, 20 bp, Artificial
  CRISPR gRNA sequence
atacacacacacacacatgc

SEQ ID NO: 410590 - DNA, 20 bp, Artificial
  CRISPR gRNA sequence
ttcccctgactcctacctgc

SEQ ID NO: 410591 - DNA, 20 bp, Artificial
  CRISPR gRNA sequence
cccctgactcctacctgcct

SEQ ID NO: 410592 - DNA, 20 bp, Artificial
  CRISPR gRNA sequence
ccctgactcctacctgcctg

SEQ ID NO: 410593 - DNA, 20 bp, Artificial
  CRISPR gRNA sequence
actcctacctgcctgcattc

SEQ ID NO: 410594 - DNA, 20 bp, Artificial
  CRISPR gRNA sequence
ctacctgcctgcattcatct

SEQ ID NO: 410595 - DNA, 20 bp, Artificial
  CRISPR gRNA sequence
cctgcctgcattcatcttca

SEQ ID NO: 410596 - DNA, 20 bp, Artificial
  CRISPR gRNA sequence
cctgcattcatcttcagaca

SEQ ID NO: 410597 - DNA, 20 bp, Artificial
  CRISPR gRNA sequence
cattcatcttcagacaagta

SEQ ID NO: 410598 - DNA, 20 bp, Artificial
  CRISPR gRNA sequence
atcttcagacaagtaccagg

SEQ ID NO: 410599 - DNA, 20 bp, Artificial
  CRISPR gRNA sequence
cagacaagtaccaggtcact

SEQ ID NO: 410600 - DNA, 20 bp, Artificial
  CRISPR gRNA sequence
agacaagtaccaggtcactc

SEQ ID NO: 410601 - DNA, 20 bp, Artificial
  CRISPR gRNA sequence
aacagaggacccctgccaac

SEQ ID NO: 410602 - DNA, 20 bp, Artificial
  CRISPR gRNA sequence
ccaaccagcaggtcaagtat

SEQ ID NO: 410603 - DNA, 20 bp, Artificial
  CRISPR gRNA sequence
gattggttttgaacagagga

SEQ ID NO: 410604 - DNA, 20 bp, Artificial
  CRISPR gRNA sequence
attggttttgaacagaggag

SEQ ID NO: 410605 - DNA, 20 bp, Artificial
  CRISPR gRNA sequence
gttttgaacagaggagaaaa

SEQ ID NO: 410606 - DNA, 20 bp, Artificial
  CRISPR gRNA sequence
tgaacagaggagaaaatggc

SEQ ID NO: 410607 - DNA, 20 bp, Artificial
  CRISPR gRNA sequence
gaacagaggagaaaatggca

SEQ ID NO: 410608 - DNA, 20 bp, Artificial
  CRISPR gRNA sequence
aacagaggagaaaatggcag

SEQ ID NO: 410609 - DNA, 20 bp, Artificial
  CRISPR gRNA sequence
aactcacatttaccactgac

SEQ ID NO: 410610 - DNA, 20 bp, Artificial
  CRISPR gRNA sequence
acatttaccactgactttct

SEQ ID NO: 410611 - DNA, 20 bp, Artificial
  CRISPR gRNA sequence
accactgactttctttgctg

SEQ ID NO: 410612 - DNA, 20 bp, Artificial
  CRISPR gRNA sequence
ccactgactttctttgctga

SEQ ID NO: 410613 - DNA, 20 bp, Artificial
  CRISPR gRNA sequence
actttctttgctgagtgaaa

SEQ ID NO: 410614 - DNA, 20 bp, Artificial
  CRISPR gRNA sequence
tctttgctgagtgaaaagaa

SEQ ID NO: 410615 - DNA, 20 bp, Artificial
  CRISPR gRNA sequence
ctttgctgagtgaaaagaaa

SEQ ID NO: 410616 - DNA, 20 bp, Artificial
  CRISPR gRNA sequence
tttgctgagtgaaaagaaat

SEQ ID NO: 410617 - DNA, 20 bp, Artificial
  CRISPR gRNA sequence
tgctgagtgaaaagaaatac

SEQ ID NO: 410618 - DNA, 20 bp, Artificial
  CRISPR gRNA sequence
gctgagtgaaaagaaataca

SEQ ID NO: 410619 - DNA, 20 bp, Artificial
  CRISPR gRNA sequence
ctgagtgaaaagaaatacat

SEQ ID NO: 410620 - DNA, 20 bp, Artificial
  CRISPR gRNA sequence
agtgaaaagaaatacatttc

SEQ ID NO: 410621 - DNA, 20 bp, Artificial
  CRISPR gRNA sequence
ctcttgtcctttgcacttat

SEQ ID NO: 410622 - DNA, 20 bp, Artificial
  CRISPR gRNA sequence
tcttgtcctttgcacttatg

SEQ ID NO: 410623 - DNA, 20 bp, Artificial
  CRISPR gRNA sequence
ttgtcctttgcacttatgtc

SEQ ID NO: 410624 - DNA, 20 bp, Artificial
  CRISPR gRNA sequence
gtcctttgcacttatgtcct

SEQ ID NO: 410625 - DNA, 20 bp, Artificial
  CRISPR gRNA sequence
tcctttgcacttatgtcctg

SEQ ID NO: 410626 - DNA, 20 bp, Artificial
  CRISPR gRNA sequence
tgcacttatgtcctgaaatg

SEQ ID NO: 410627 - DNA, 20 bp, Artificial
  CRISPR gRNA sequence
gcacttatgtcctgaaatgt

SEQ ID NO: 410628 - DNA, 20 bp, Artificial
  CRISPR gRNA sequence
cacttatgtcctgaaatgta

SEQ ID NO: 410629 - DNA, 20 bp, Artificial
  CRISPR gRNA sequence
atgtcctgaaatgtagaatg

SEQ ID NO: 410630 - DNA, 20 bp, Artificial
  CRISPR gRNA sequence
tgtcctgaaatgtagaatga

SEQ ID NO: 410631 - DNA, 20 bp, Artificial
  CRISPR gRNA sequence
aaatgtagaatgaaataatt

SEQ ID NO: 410632 - DNA, 20 bp, Artificial
  CRISPR gRNA sequence
cagactgacttttctgaatt

SEQ ID NO: 410633 - DNA, 20 bp, Artificial
  CRISPR gRNA sequence
acttttctgaatttgaaact

SEQ ID NO: 410634 - DNA, 20 bp, Artificial
  CRISPR gRNA sequence
ttctgaatttgaaacttgcc

SEQ ID NO: 410635 - DNA, 20 bp, Artificial
  CRISPR gRNA sequence
tctgaatttgaaacttgcct

SEQ ID NO: 410636 - DNA, 20 bp, Artificial
  CRISPR gRNA sequence
ctgaatttgaaacttgcctg

SEQ ID NO: 410637 - DNA, 20 bp, Artificial
  CRISPR gRNA sequence
tgaatttgaaacttgcctgg

SEQ ID NO: 410638 - DNA, 20 bp, Artificial
  CRISPR gRNA sequence
aatttgaaacttgcctggac

SEQ ID NO: 410639 - DNA, 20 bp, Artificial
  CRISPR gRNA sequence
gaaacttgcctggaccgaag

SEQ ID NO: 410640 - DNA, 20 bp, Artificial
  CRISPR gRNA sequence
aaacttgcctggaccgaagg

SEQ ID NO: 410641 - DNA, 20 bp, Artificial
  CRISPR gRNA sequence
gcctggaccgaagggcaagg

SEQ ID NO: 410642 - DNA, 20 bp, Artificial
  CRISPR gRNA sequence
cctggaccgaagggcaagga

SEQ ID NO: 410643 - DNA, 20 bp, Artificial
  CRISPR gRNA sequence
gaccgaagggcaaggaaagt

SEQ ID NO: 410644 - DNA, 20 bp, Artificial
  CRISPR gRNA sequence
tttattgacagtgactacag

SEQ ID NO: 410645 - DNA, 20 bp, Artificial
  CRISPR gRNA sequence
attgacagtgactacagtta

SEQ ID NO: 410646 - DNA, 20 bp, Artificial
  CRISPR gRNA sequence
ttgacagtgactacagttat

SEQ ID NO: 410647 - DNA, 20 bp, Artificial
  CRISPR gRNA sequence
acagtgactacagttatttt

SEQ ID NO: 410648 - DNA, 20 bp, Artificial
  CRISPR gRNA sequence
cagttatttttggcccttaa

SEQ ID NO: 410649 - DNA, 20 bp, Artificial
  CRISPR gRNA sequence
tttttggcccttaacatcct

SEQ ID NO: 410650 - DNA, 20 bp, Artificial
  CRISPR gRNA sequence
ttggcccttaacatcctctg

SEQ ID NO: 410651 - DNA, 20 bp, Artificial
  CRISPR gRNA sequence
tggcccttaacatcctctgg

SEQ ID NO: 410652 - DNA, 20 bp, Artificial
  CRISPR gRNA sequence
ggcccttaacatcctctgga

SEQ ID NO: 410653 - DNA, 20 bp, Artificial
  CRISPR gRNA sequence
gcccttaacatcctctggat

SEQ ID NO: 410654 - DNA, 20 bp, Artificial
  CRISPR gRNA sequence
aacatcctctggattttcat

SEQ ID NO: 410655 - DNA, 20 bp, Artificial
  CRISPR gRNA sequence
acatcctctggattttcatt

SEQ ID NO: 410656 - DNA, 20 bp, Artificial
  CRISPR gRNA sequence
tggattttcatttgtcataa

SEQ ID NO: 410657 - DNA, 20 bp, Artificial
  CRISPR gRNA sequence
gattttcatttgtcataaga

SEQ ID NO: 410658 - DNA, 20 bp, Artificial
  CRISPR gRNA sequence
tcatttgtcataagagaagt

SEQ ID NO: 410659 - DNA, 20 bp, Artificial
  CRISPR gRNA sequence
catttgtcataagagaagta

SEQ ID NO: 410660 - DNA, 20 bp, Artificial
  CRISPR gRNA sequence
atttgtcataagagaagtat

SEQ ID NO: 410661 - DNA, 20 bp, Artificial
  CRISPR gRNA sequence
gtcataagagaagtatttta

SEQ ID NO: 410662 - DNA, 20 bp, Artificial
  CRISPR gRNA sequence
tcataagagaagtattttag

SEQ ID NO: 410663 - DNA, 20 bp, Artificial
  CRISPR gRNA sequence
taggtgccactaaaataatt

SEQ ID NO: 410664 - DNA, 20 bp, Artificial
  CRISPR gRNA sequence
aggtgccactaaaataattt

SEQ ID NO: 410665 - DNA, 20 bp, Artificial
  CRISPR gRNA sequence
ggtgccactaaaataatttg

SEQ ID NO: 410666 - DNA, 20 bp, Artificial
  CRISPR gRNA sequence
aaataatttgtcaaatattt

SEQ ID NO: 410667 - DNA, 20 bp, Artificial
  CRISPR gRNA sequence
gtcaaatattttaatattag

SEQ ID NO: 410668 - DNA, 20 bp, Artificial
  CRISPR gRNA sequence
tcaaatattttaatattagc

SEQ ID NO: 410669 - DNA, 20 bp, Artificial
  CRISPR gRNA sequence
taatattagctaaatgattt

SEQ ID NO: 410670 - DNA, 20 bp, Artificial
  CRISPR gRNA sequence
aatattagctaaatgatttg

SEQ ID NO: 410671 - DNA, 20 bp, Artificial
  CRISPR gRNA sequence
atattagctaaatgatttgc

SEQ ID NO: 410672 - DNA, 20 bp, Artificial
  CRISPR gRNA sequence
gctaaatgatttgcagacta

SEQ ID NO: 410673 - DNA, 20 bp, Artificial
  CRISPR gRNA sequence
aatgatttgcagactactat

SEQ ID NO: 410674 - DNA, 20 bp, Artificial
  CRISPR gRNA sequence
gcagactactattgtttaaa

SEQ ID NO: 410675 - DNA, 20 bp, Artificial
  CRISPR gRNA sequence
cagactactattgtttaaac

SEQ ID NO: 410676 - DNA, 20 bp, Artificial
  CRISPR gRNA sequence
ctattgtttaaactgacctt

SEQ ID NO: 410677 - DNA, 20 bp, Artificial
  CRISPR gRNA sequence
ttgtttaaactgaccttatt

SEQ ID NO: 410678 - DNA, 20 bp, Artificial
  CRISPR gRNA sequence
tttaaactgaccttattggc

SEQ ID NO: 410679 - DNA, 20 bp, Artificial
  CRISPR gRNA sequence
aaactgaccttattggctat

SEQ ID NO: 410680 - DNA, 20 bp, Artificial
  CRISPR gRNA sequence
aactgaccttattggctata

SEQ ID NO: 410681 - DNA, 20 bp, Artificial
  CRISPR gRNA sequence
accttattggctataaaaag

SEQ ID NO: 410682 - DNA, 20 bp, Artificial
  CRISPR gRNA sequence
attggctataaaaagaatga

SEQ ID NO: 410683 - DNA, 20 bp, Artificial
  CRISPR gRNA sequence
ttggctataaaaagaatgaa

SEQ ID NO: 410684 - DNA, 20 bp, Artificial
  CRISPR gRNA sequence
gctataaaaagaatgaaggc

SEQ ID NO: 410685 - DNA, 20 bp, Artificial
  CRISPR gRNA sequence
taaaaagaatgaaggcaaaa

SEQ ID NO: 410686 - DNA, 20 bp, Artificial
  CRISPR gRNA sequence
ttgcagaaagtttctggagg

SEQ ID NO: 410687 - DNA, 20 bp, Artificial
  CRISPR gRNA sequence
gcagaaagtttctggaggag

SEQ ID NO: 410688 - DNA, 20 bp, Artificial
  CRISPR gRNA sequence
cagaaagtttctggaggagg

SEQ ID NO: 410689 - DNA, 20 bp, Artificial
  CRISPR gRNA sequence
ctggaggaggctaatattga

SEQ ID NO: 410690 - DNA, 20 bp, Artificial
  CRISPR gRNA sequence
tggaggaggctaatattgaa

SEQ ID NO: 410691 - DNA, 20 bp, Artificial
  CRISPR gRNA sequence
gaggaggctaatattgaaaa

SEQ ID NO: 410692 - DNA, 20 bp, Artificial
  CRISPR gRNA sequence
atattgaaaaaacttctgtt

SEQ ID NO: 410693 - DNA, 20 bp, Artificial
  CRISPR gRNA sequence
aaaaaacttctgtttgctat

SEQ ID NO: 410694 - DNA, 20 bp, Artificial
  CRISPR gRNA sequence
ctgtttgctattgataagta

SEQ ID NO: 410695 - DNA, 20 bp, Artificial
  CRISPR gRNA sequence
tgtttgctattgataagtat

SEQ ID NO: 410696 - DNA, 20 bp, Artificial
  CRISPR gRNA sequence
tttgctattgataagtataa

SEQ ID NO: 410697 - DNA, 20 bp, Artificial
  CRISPR gRNA sequence
gctattgataagtataatta

SEQ ID NO: 410698 - DNA, 20 bp, Artificial
  CRISPR gRNA sequence
ctattgataagtataattac

SEQ ID NO: 410699 - DNA, 20 bp, Artificial
  CRISPR gRNA sequence
ttgataagtataattactca

SEQ ID NO: 410700 - DNA, 20 bp, Artificial
  CRISPR gRNA sequence
ataagtataattactcatgt

SEQ ID NO: 410701 - DNA, 20 bp, Artificial
  CRISPR gRNA sequence
ctcatgtccttgtataatcg

SEQ ID NO: 410702 - DNA, 20 bp, Artificial
  CRISPR gRNA sequence
atgtccttgtataatcgtct

SEQ ID NO: 410703 - DNA, 20 bp, Artificial
  CRISPR gRNA sequence
gtataatcgtcttccaccag

SEQ ID NO: 410704 - DNA, 20 bp, Artificial
  CRISPR gRNA sequence
tataatcgtcttccaccagt

SEQ ID NO: 410705 - DNA, 20 bp, Artificial
  CRISPR gRNA sequence
ccaccagtgagaccactcag

SEQ ID NO: 410706 - DNA, 20 bp, Artificial
  CRISPR gRNA sequence
caccagtgagaccactcagg

SEQ ID NO: 410707 - DNA, 20 bp, Artificial
  CRISPR gRNA sequence
aggcgggaccatcaaggttc

SEQ ID NO: 410708 - DNA, 20 bp, Artificial
  CRISPR gRNA sequence
aaatgaggcattgatgatta

SEQ ID NO: 410709 - DNA, 20 bp, Artificial
  CRISPR gRNA sequence
atgattagagctgaggaatg

SEQ ID NO: 410710 - DNA, 20 bp, Artificial
  CRISPR gRNA sequence
gagctgaggaatgacatgaa

SEQ ID NO: 410711 - DNA, 20 bp, Artificial
  CRISPR gRNA sequence
aggaatgacatgaaacaggt

SEQ ID NO: 410712 - DNA, 20 bp, Artificial
  CRISPR gRNA sequence
tgaagagtaaccccaaatat

SEQ ID NO: 410713 - DNA, 20 bp, Artificial
  CRISPR gRNA sequence
tagtcaaatgactaggttgg

SEQ ID NO: 410714 - DNA, 20 bp, Artificial
  CRISPR gRNA sequence
ggttggtatggagagtctaa

SEQ ID NO: 410715 - DNA, 20 bp, Artificial
  CRISPR gRNA sequence
gtatggagagtctaagttat

SEQ ID NO: 410716 - DNA, 20 bp, Artificial
  CRISPR gRNA sequence
agttatgtattaatatggga

SEQ ID NO: 410717 - DNA, 20 bp, Artificial
  CRISPR gRNA sequence
tgtattaatatgggacgagg

SEQ ID NO: 410718 - DNA, 20 bp, Artificial
  CRISPR gRNA sequence
atatgggacgaggtaggtta

SEQ ID NO: 410719 - DNA, 20 bp, Artificial
  CRISPR gRNA sequence
aattaagtgatgacagtgaa

SEQ ID NO: 410720 - DNA, 20 bp, Artificial
  CRISPR gRNA sequence
agtgatgacagtgaaaacct

SEQ ID NO: 410721 - DNA, 20 bp, Artificial
  CRISPR gRNA sequence
catctcatataattgtcaag

SEQ ID NO: 410722 - DNA, 20 bp, Artificial
  CRISPR gRNA sequence
atataattgtcaagcaaagc

SEQ ID NO: 410723 - DNA, 20 bp, Artificial
  CRISPR gRNA sequence
tcaagcaaagctaccattag

SEQ ID NO: 410724 - DNA, 20 bp, Artificial
  CRISPR gRNA sequence
ccattagttcttgagcaaag

SEQ ID NO: 410725 - DNA, 20 bp, Artificial
  CRISPR gRNA sequence
gttcttgagcaaagatggca

SEQ ID NO: 410726 - DNA, 20 bp, Artificial
  CRISPR gRNA sequence
ttgagcaaagatggcaaaac

SEQ ID NO: 410727 - DNA, 20 bp, Artificial
  CRISPR gRNA sequence
gagcaaagatggcaaaacaa

SEQ ID NO: 410728 - DNA, 20 bp, Artificial
  CRISPR gRNA sequence
agcaaagatggcaaaacaat

SEQ ID NO: 410729 - DNA, 20 bp, Artificial
  CRISPR gRNA sequence
ctatatgattttcagtgtgc

SEQ ID NO: 410730 - DNA, 20 bp, Artificial
  CRISPR gRNA sequence
tatgattttcagtgtgcaag

SEQ ID NO: 410731 - DNA, 20 bp, Artificial
  CRISPR gRNA sequence
tcagtgtgcaagtctttaac

SEQ ID NO: 410732 - DNA, 20 bp, Artificial
  CRISPR gRNA sequence
cagtgtgcaagtctttaaca

SEQ ID NO: 410733 - DNA, 20 bp, Artificial
  CRISPR gRNA sequence
agtgtgcaagtctttaacat

SEQ ID NO: 410734 - DNA, 20 bp, Artificial
  CRISPR gRNA sequence
taacatttttggttaagttt

SEQ ID NO: 410735 - DNA, 20 bp, Artificial
  CRISPR gRNA sequence
aacatttttggttaagttta

SEQ ID NO: 410736 - DNA, 20 bp, Artificial
  CRISPR gRNA sequence
acatttttggttaagtttat

SEQ ID NO: 410737 - DNA, 20 bp, Artificial
  CRISPR gRNA sequence
ttggttaagtttattcttaa

SEQ ID NO: 410738 - DNA, 20 bp, Artificial
  CRISPR gRNA sequence
tggttaagtttattcttaaa

SEQ ID NO: 410739 - DNA, 20 bp, Artificial
  CRISPR gRNA sequence
ggttaagtttattcttaaat

SEQ ID NO: 410740 - DNA, 20 bp, Artificial
  CRISPR gRNA sequence
gttaagtttattcttaaata

SEQ ID NO: 410741 - DNA, 20 bp, Artificial
  CRISPR gRNA sequence
agtttattcttaaatacttt

SEQ ID NO: 410742 - DNA, 20 bp, Artificial
  CRISPR gRNA sequence
attcttaaatactttattcc

SEQ ID NO: 410743 - DNA, 20 bp, Artificial
  CRISPR gRNA sequence
ttcttaaatactttattcct

SEQ ID NO: 410744 - DNA, 20 bp, Artificial
  CRISPR gRNA sequence
ttaaatactttattcctttt

SEQ ID NO: 410745 - DNA, 20 bp, Artificial
  CRISPR gRNA sequence
aaatactttattccttttat

SEQ ID NO: 410746 - DNA, 20 bp, Artificial
  CRISPR gRNA sequence
aatactttattccttttatt

SEQ ID NO: 410747 - DNA, 20 bp, Artificial
  CRISPR gRNA sequence
tattccttttattgttattg

SEQ ID NO: 410748 - DNA, 20 bp, Artificial
  CRISPR gRNA sequence
attccttttattgttattgg

SEQ ID NO: 410749 - DNA, 20 bp, Artificial
  CRISPR gRNA sequence
ttccttttattgttattggg

SEQ ID NO: 410750 - DNA, 20 bp, Artificial
  CRISPR gRNA sequence
cttttattgttattggggat

SEQ ID NO: 410751 - DNA, 20 bp, Artificial
  CRISPR gRNA sequence
ttattgttattggggatggg

SEQ ID NO: 410752 - DNA, 20 bp, Artificial
  CRISPR gRNA sequence
tattgttattggggatggga

SEQ ID NO: 410753 - DNA, 20 bp, Artificial
  CRISPR gRNA sequence
attgttattggggatgggat

SEQ ID NO: 410754 - DNA, 20 bp, Artificial
  CRISPR gRNA sequence
ttgttattggggatgggatt

SEQ ID NO: 410755 - DNA, 20 bp, Artificial
  CRISPR gRNA sequence
ttattggggatgggattttg

SEQ ID NO: 410756 - DNA, 20 bp, Artificial
  CRISPR gRNA sequence
ttggggatgggattttgttt

SEQ ID NO: 410757 - DNA, 20 bp, Artificial
  CRISPR gRNA sequence
gggatgggattttgttttaa

SEQ ID NO: 410758 - DNA, 20 bp, Artificial
  CRISPR gRNA sequence
tgttttaattccttttttgg

SEQ ID NO: 410759 - DNA, 20 bp, Artificial
  CRISPR gRNA sequence
gttttaattccttttttgga

SEQ ID NO: 410760 - DNA, 20 bp, Artificial
  CRISPR gRNA sequence
ttttaattccttttttggat

SEQ ID NO: 410761 - DNA, 20 bp, Artificial
  CRISPR gRNA sequence
taattccttttttggatagt

SEQ ID NO: 410762 - DNA, 20 bp, Artificial
  CRISPR gRNA sequence
aattccttttttggatagtt

SEQ ID NO: 410763 - DNA, 20 bp, Artificial
  CRISPR gRNA sequence
attccttttttggatagttt

SEQ ID NO: 410764 - DNA, 20 bp, Artificial
  CRISPR gRNA sequence
cttttttggatagtttgctg

SEQ ID NO: 410765 - DNA, 20 bp, Artificial
  CRISPR gRNA sequence
ttttggatagtttgctgttt

SEQ ID NO: 410766 - DNA, 20 bp, Artificial
  CRISPR gRNA sequence
tttggatagtttgctgtttg

SEQ ID NO: 410767 - DNA, 20 bp, Artificial
  CRISPR gRNA sequence
ttggatagtttgctgtttgt

SEQ ID NO: 410768 - DNA, 20 bp, Artificial
  CRISPR gRNA sequence
tggatagtttgctgtttgtg

SEQ ID NO: 410769 - DNA, 20 bp, Artificial
  CRISPR gRNA sequence
ggatagtttgctgtttgtgt

SEQ ID NO: 410770 - DNA, 20 bp, Artificial
  CRISPR gRNA sequence
gatagtttgctgtttgtgta

SEQ ID NO: 410771 - DNA, 20 bp, Artificial
  CRISPR gRNA sequence
gctgtttgtgtacagaaacc

SEQ ID NO: 410772 - DNA, 20 bp, Artificial
  CRISPR gRNA sequence
ctgtttgtgtacagaaacct

SEQ ID NO: 410773 - DNA, 20 bp, Artificial
  CRISPR gRNA sequence
tttgtgtacagaaacctgac

SEQ ID NO: 410774 - DNA, 20 bp, Artificial
  CRISPR gRNA sequence
gtgtacagaaacctgactga

SEQ ID NO: 410775 - DNA, 20 bp, Artificial
  CRISPR gRNA sequence
tgtacagaaacctgactgat

SEQ ID NO: 410776 - DNA, 20 bp, Artificial
  CRISPR gRNA sequence
actgatattttatatgttga

SEQ ID NO: 410777 - DNA, 20 bp, Artificial
  CRISPR gRNA sequence
atattttatatgttgatttt

SEQ ID NO: 410778 - DNA, 20 bp, Artificial
  CRISPR gRNA sequence
tatatgttgatttttgtatc

SEQ ID NO: 410779 - DNA, 20 bp, Artificial
  CRISPR gRNA sequence
atatgttgatttttgtatcc

SEQ ID NO: 410780 - DNA, 20 bp, Artificial
  CRISPR gRNA sequence
tatgttgatttttgtatcct

SEQ ID NO: 410781 - DNA, 20 bp, Artificial
  CRISPR gRNA sequence
atttttgtatcctgcctctt

SEQ ID NO: 410782 - DNA, 20 bp, Artificial
  CRISPR gRNA sequence
ttgtatcctgcctcttaact

SEQ ID NO: 410783 - DNA, 20 bp, Artificial
  CRISPR gRNA sequence
tgtatcctgcctcttaactg

SEQ ID NO: 410784 - DNA, 20 bp, Artificial
  CRISPR gRNA sequence
gtatcctgcctcttaactga

SEQ ID NO: 410785 - DNA, 20 bp, Artificial
  CRISPR gRNA sequence
tatcctgcctcttaactgaa

SEQ ID NO: 410786 - DNA, 20 bp, Artificial
  CRISPR gRNA sequence
cctcttaactgaattcattt

SEQ ID NO: 410787 - DNA, 20 bp, Artificial
  CRISPR gRNA sequence
ttaactgaattcatttatta

SEQ ID NO: 410788 - DNA, 20 bp, Artificial
  CRISPR gRNA sequence
aactgaattcatttattagt

SEQ ID NO: 410789 - DNA, 20 bp, Artificial
  CRISPR gRNA sequence
actgaattcatttattagtt

SEQ ID NO: 410790 - DNA, 20 bp, Artificial
  CRISPR gRNA sequence
aattcatttattagtttgaa

SEQ ID NO: 410791 - DNA, 20 bp, Artificial
  CRISPR gRNA sequence
atttattagtttgaacaggt

SEQ ID NO: 410792 - DNA, 20 bp, Artificial
  CRISPR gRNA sequence
attagtttgaacaggttttt

SEQ ID NO: 410793 - DNA, 20 bp, Artificial
  CRISPR gRNA sequence
ttagtttgaacaggtttttt

SEQ ID NO: 410794 - DNA, 20 bp, Artificial
  CRISPR gRNA sequence
gtttgaacaggtttttttgt

SEQ ID NO: 410795 - DNA, 20 bp, Artificial
  CRISPR gRNA sequence
gaacaggtttttttgtggca

SEQ ID NO: 410796 - DNA, 20 bp, Artificial
  CRISPR gRNA sequence
aacaggtttttttgtggcac

SEQ ID NO: 410797 - DNA, 20 bp, Artificial
  CRISPR gRNA sequence
ttttgtggcacttttagggt

SEQ ID NO: 410798 - DNA, 20 bp, Artificial
  CRISPR gRNA sequence
tttgtggcacttttagggtt

SEQ ID NO: 410799 - DNA, 20 bp, Artificial
  CRISPR gRNA sequence
ttgtggcacttttagggttt

SEQ ID NO: 410800 - DNA, 20 bp, Artificial
  CRISPR gRNA sequence
tgtggcacttttagggtttt

SEQ ID NO: 410801 - DNA, 20 bp, Artificial
  CRISPR gRNA sequence
gtggcacttttagggtttta

SEQ ID NO: 410802 - DNA, 20 bp, Artificial
  CRISPR gRNA sequence
tggcacttttagggttttat

SEQ ID NO: 410803 - DNA, 20 bp, Artificial
  CRISPR gRNA sequence
ttagggttttatacatatat

SEQ ID NO: 410804 - DNA, 20 bp, Artificial
  CRISPR gRNA sequence
tagggttttatacatatatg

SEQ ID NO: 410805 - DNA, 20 bp, Artificial
  CRISPR gRNA sequence
agggttttatacatatatga

SEQ ID NO: 410806 - DNA, 20 bp, Artificial
  CRISPR gRNA sequence
gggttttatacatatatgat

SEQ ID NO: 410807 - DNA, 20 bp, Artificial
  CRISPR gRNA sequence
tatacatatatgattatgtc

SEQ ID NO: 410808 - DNA, 20 bp, Artificial
  CRISPR gRNA sequence
atacatatatgattatgtca

SEQ ID NO: 410809 - DNA, 20 bp, Artificial
  CRISPR gRNA sequence
tacatatatgattatgtcat

SEQ ID NO: 410810 - DNA, 20 bp, Artificial
  CRISPR gRNA sequence
tgtcatcggcaaacagagat

SEQ ID NO: 410811 - DNA, 20 bp, Artificial
  CRISPR gRNA sequence
cttcttcctttctgatttga

SEQ ID NO: 410812 - DNA, 20 bp, Artificial
  CRISPR gRNA sequence
cttcctttctgatttgaatg

SEQ ID NO: 410813 - DNA, 20 bp, Artificial
  CRISPR gRNA sequence
ttcctttctgatttgaatgc

SEQ ID NO: 410814 - DNA, 20 bp, Artificial
  CRISPR gRNA sequence
cctttctgatttgaatgcct

SEQ ID NO: 410815 - DNA, 20 bp, Artificial
  CRISPR gRNA sequence
ctttctgatttgaatgcctt

SEQ ID NO: 410816 - DNA, 20 bp, Artificial
  CRISPR gRNA sequence
tctgatttgaatgccttttg

SEQ ID NO: 410817 - DNA, 20 bp, Artificial
  CRISPR gRNA sequence
ctgatttgaatgccttttgt

SEQ ID NO: 410818 - DNA, 20 bp, Artificial
  CRISPR gRNA sequence
tgatttgaatgccttttgtt

SEQ ID NO: 410819 - DNA, 20 bp, Artificial
  CRISPR gRNA sequence
atttgaatgccttttgtttt

SEQ ID NO: 410820 - DNA, 20 bp, Artificial
  CRISPR gRNA sequence
gaatgccttttgttttcttt

SEQ ID NO: 410821 - DNA, 20 bp, Artificial
  CRISPR gRNA sequence
aatgccttttgttttctttt

SEQ ID NO: 410822 - DNA, 20 bp, Artificial
  CRISPR gRNA sequence
ttgttttctttttcttgttt

SEQ ID NO: 410823 - DNA, 20 bp, Artificial
  CRISPR gRNA sequence
tgttttctttttcttgttta

SEQ ID NO: 410824 - DNA, 20 bp, Artificial
  CRISPR gRNA sequence
gttttctttttcttgtttaa

SEQ ID NO: 410825 - DNA, 20 bp, Artificial
  CRISPR gRNA sequence
ttttctttttcttgtttaat

SEQ ID NO: 410826 - DNA, 20 bp, Artificial
  CRISPR gRNA sequence
tctttttcttgtttaatggc

SEQ ID NO: 410827 - DNA, 20 bp, Artificial
  CRISPR gRNA sequence
ctttttcttgtttaatggct

SEQ ID NO: 410828 - DNA, 20 bp, Artificial
  CRISPR gRNA sequence
tttttcttgtttaatggctc

SEQ ID NO: 410829 - DNA, 20 bp, Artificial
  CRISPR gRNA sequence
tttcttgtttaatggctctg

SEQ ID NO: 410830 - DNA, 20 bp, Artificial
  CRISPR gRNA sequence
ttcttgtttaatggctctga

SEQ ID NO: 410831 - DNA, 20 bp, Artificial
  CRISPR gRNA sequence
tcttgtttaatggctctgat

SEQ ID NO: 410832 - DNA, 20 bp, Artificial
  CRISPR gRNA sequence
cttgtttaatggctctgatt

SEQ ID NO: 410833 - DNA, 20 bp, Artificial
  CRISPR gRNA sequence
ttgtttaatggctctgatta

SEQ ID NO: 410834 - DNA, 20 bp, Artificial
  CRISPR gRNA sequence
gtttaatggctctgattaag

SEQ ID NO: 410835 - DNA, 20 bp, Artificial
  CRISPR gRNA sequence
tttaatggctctgattaaga

SEQ ID NO: 410836 - DNA, 20 bp, Artificial
  CRISPR gRNA sequence
aatggctctgattaagactt

SEQ ID NO: 410837 - DNA, 20 bp, Artificial
  CRISPR gRNA sequence
atggctctgattaagacttc

SEQ ID NO: 410838 - DNA, 20 bp, Artificial
  CRISPR gRNA sequence
tgattaagacttcttgtact

SEQ ID NO: 410839 - DNA, 20 bp, Artificial
  CRISPR gRNA sequence
attaagacttcttgtactat

SEQ ID NO: 410840 - DNA, 20 bp, Artificial
  CRISPR gRNA sequence
agacttcttgtactatgtta

SEQ ID NO: 410841 - DNA, 20 bp, Artificial
  CRISPR gRNA sequence
cttgtactatgttaagcaga

SEQ ID NO: 410842 - DNA, 20 bp, Artificial
  CRISPR gRNA sequence
ttgtactatgttaagcagag

SEQ ID NO: 410843 - DNA, 20 bp, Artificial
  CRISPR gRNA sequence
gtactatgttaagcagaggt

SEQ ID NO: 410844 - DNA, 20 bp, Artificial
  CRISPR gRNA sequence
tactatgttaagcagaggtg

SEQ ID NO: 410845 - DNA, 20 bp, Artificial
  CRISPR gRNA sequence
tgttaagcagaggtgttgaa

SEQ ID NO: 410846 - DNA, 20 bp, Artificial
  CRISPR gRNA sequence
agcagaggtgttgaaagtgg

SEQ ID NO: 410847 - DNA, 20 bp, Artificial
  CRISPR gRNA sequence
aaagtggccacctttgtctt

SEQ ID NO: 410848 - DNA, 20 bp, Artificial
  CRISPR gRNA sequence
tgtctttttcctgatcttag

SEQ ID NO: 410849 - DNA, 20 bp, Artificial
  CRISPR gRNA sequence
gtctttttcctgatcttaga

SEQ ID NO: 410850 - DNA, 20 bp, Artificial
  CRISPR gRNA sequence
tctttttcctgatcttagag

SEQ ID NO: 410851 - DNA, 20 bp, Artificial
  CRISPR gRNA sequence
tttcctgatcttagagcaaa

SEQ ID NO: 410852 - DNA, 20 bp, Artificial
  CRISPR gRNA sequence
ttcctgatcttagagcaaaa

SEQ ID NO: 410853 - DNA, 20 bp, Artificial
  CRISPR gRNA sequence
tcctgatcttagagcaaaag

SEQ ID NO: 410854 - DNA, 20 bp, Artificial
  CRISPR gRNA sequence
cctgatcttagagcaaaagt

SEQ ID NO: 410855 - DNA, 20 bp, Artificial
  CRISPR gRNA sequence
ctgatcttagagcaaaagtt

SEQ ID NO: 410856 - DNA, 20 bp, Artificial
  CRISPR gRNA sequence
atcttagagcaaaagttctc

SEQ ID NO: 410857 - DNA, 20 bp, Artificial
  CRISPR gRNA sequence
agagcaaaagttctcagtct

SEQ ID NO: 410858 - DNA, 20 bp, Artificial
  CRISPR gRNA sequence
gagcaaaagttctcagtctt

SEQ ID NO: 410859 - DNA, 20 bp, Artificial
  CRISPR gRNA sequence
tcagtcttacatgacttggt

SEQ ID NO: 410860 - DNA, 20 bp, Artificial
  CRISPR gRNA sequence
agtcttacatgacttggtat

SEQ ID NO: 410861 - DNA, 20 bp, Artificial
  CRISPR gRNA sequence
acatgacttggtatgatgtt

SEQ ID NO: 410862 - DNA, 20 bp, Artificial
  CRISPR gRNA sequence
catgacttggtatgatgtta

SEQ ID NO: 410863 - DNA, 20 bp, Artificial
  CRISPR gRNA sequence
ggtatgatgttagctgtggg

SEQ ID NO: 410864 - DNA, 20 bp, Artificial
  CRISPR gRNA sequence
gtatgatgttagctgtgggc

SEQ ID NO: 410865 - DNA, 20 bp, Artificial
  CRISPR gRNA sequence
gctgtgggcttttcatagat

SEQ ID NO: 410866 - DNA, 20 bp, Artificial
  CRISPR gRNA sequence
tgggcttttcatagatggcc

SEQ ID NO: 410867 - DNA, 20 bp, Artificial
  CRISPR gRNA sequence
ttcatagatggcctttattg

SEQ ID NO: 410868 - DNA, 20 bp, Artificial
  CRISPR gRNA sequence
tcatagatggcctttattgt

SEQ ID NO: 410869 - DNA, 20 bp, Artificial
  CRISPR gRNA sequence
catagatggcctttattgtg

SEQ ID NO: 410870 - DNA, 20 bp, Artificial
  CRISPR gRNA sequence
atagatggcctttattgtgt

SEQ ID NO: 410871 - DNA, 20 bp, Artificial
  CRISPR gRNA sequence
tattgtgttggggtaaattc

SEQ ID NO: 410872 - DNA, 20 bp, Artificial
  CRISPR gRNA sequence
attgtgttggggtaaattct

SEQ ID NO: 410873 - DNA, 20 bp, Artificial
  CRISPR gRNA sequence
ttgtgttggggtaaattctt

SEQ ID NO: 410874 - DNA, 20 bp, Artificial
  CRISPR gRNA sequence
tgttggggtaaattctttct

SEQ ID NO: 410875 - DNA, 20 bp, Artificial
  CRISPR gRNA sequence
gggtaaattctttctgtacc

SEQ ID NO: 410876 - DNA, 20 bp, Artificial
  CRISPR gRNA sequence
tttctgtacctaatttgttg

SEQ ID NO: 410877 - DNA, 20 bp, Artificial
  CRISPR gRNA sequence
tctgtacctaatttgttgag

SEQ ID NO: 410878 - DNA, 20 bp, Artificial
  CRISPR gRNA sequence
ctgtacctaatttgttgaga

SEQ ID NO: 410879 - DNA, 20 bp, Artificial
  CRISPR gRNA sequence
tgtacctaatttgttgagag

SEQ ID NO: 410880 - DNA, 20 bp, Artificial
  CRISPR gRNA sequence
tacctaatttgttgagagtt

SEQ ID NO: 410881 - DNA, 20 bp, Artificial
  CRISPR gRNA sequence
atttgttgagagtttttttt

SEQ ID NO: 410882 - DNA, 20 bp, Artificial
  CRISPR gRNA sequence
gttgagagtttttttttttt

SEQ ID NO: 410883 - DNA, 20 bp, Artificial
  CRISPR gRNA sequence
ttgagagtttttttttttta

SEQ ID NO: 410884 - DNA, 20 bp, Artificial
  CRISPR gRNA sequence
agagttttttttttttaatc

SEQ ID NO: 410885 - DNA, 20 bp, Artificial
  CRISPR gRNA sequence
tttttttttaatcacacaag

SEQ ID NO: 410886 - DNA, 20 bp, Artificial
  CRISPR gRNA sequence
ttttttttaatcacacaagg

SEQ ID NO: 410887 - DNA, 20 bp, Artificial
  CRISPR gRNA sequence
tttttttaatcacacaagga

SEQ ID NO: 410888 - DNA, 20 bp, Artificial
  CRISPR gRNA sequence
ttttttaatcacacaaggat

SEQ ID NO: 410889 - DNA, 20 bp, Artificial
  CRISPR gRNA sequence
tttttaatcacacaaggatg

SEQ ID NO: 410890 - DNA, 20 bp, Artificial
  CRISPR gRNA sequence
ttttaatcacacaaggatgt

SEQ ID NO: 410891 - DNA, 20 bp, Artificial
  CRISPR gRNA sequence
tttaatcacacaaggatgtt

SEQ ID NO: 410892 - DNA, 20 bp, Artificial
  CRISPR gRNA sequence
ttaatcacacaaggatgttg

SEQ ID NO: 410893 - DNA, 20 bp, Artificial
  CRISPR gRNA sequence
taatcacacaaggatgttga

SEQ ID NO: 410894 - DNA, 20 bp, Artificial
  CRISPR gRNA sequence
aatcacacaaggatgttgaa

SEQ ID NO: 410895 - DNA, 20 bp, Artificial
  CRISPR gRNA sequence
atcacacaaggatgttgaat

SEQ ID NO: 410896 - DNA, 20 bp, Artificial
  CRISPR gRNA sequence
aatttgtcaaatgcttttta

SEQ ID NO: 410897 - DNA, 20 bp, Artificial
  CRISPR gRNA sequence
gtcaaatgctttttatgctc

SEQ ID NO: 410898 - DNA, 20 bp, Artificial
  CRISPR gRNA sequence
tcaaatgctttttatgctct

SEQ ID NO: 410899 - DNA, 20 bp, Artificial
  CRISPR gRNA sequence
tttatgctctattttgatga

SEQ ID NO: 410900 - DNA, 20 bp, Artificial
  CRISPR gRNA sequence
ttatgctctattttgatgat

SEQ ID NO: 410901 - DNA, 20 bp, Artificial
  CRISPR gRNA sequence
tatgctctattttgatgatc

SEQ ID NO: 410902 - DNA, 20 bp, Artificial
  CRISPR gRNA sequence
atgctctattttgatgatca

SEQ ID NO: 410903 - DNA, 20 bp, Artificial
  CRISPR gRNA sequence
tgctctattttgatgatcat

SEQ ID NO: 410904 - DNA, 20 bp, Artificial
  CRISPR gRNA sequence
tattttgatgatcatgtggc

SEQ ID NO: 410905 - DNA, 20 bp, Artificial
  CRISPR gRNA sequence
ttttgatgatcatgtggcct

SEQ ID NO: 410906 - DNA, 20 bp, Artificial
  CRISPR gRNA sequence
tgatgatcatgtggcctttt

SEQ ID NO: 410907 - DNA, 20 bp, Artificial
  CRISPR gRNA sequence
gatgatcatgtggccttttt

SEQ ID NO: 410908 - DNA, 20 bp, Artificial
  CRISPR gRNA sequence
atgatcatgtggccttttta

SEQ ID NO: 410909 - DNA, 20 bp, Artificial
  CRISPR gRNA sequence
tttatatcactttgttaatg

SEQ ID NO: 410910 - DNA, 20 bp, Artificial
  CRISPR gRNA sequence
ttatatcactttgttaatgt

SEQ ID NO: 410911 - DNA, 20 bp, Artificial
  CRISPR gRNA sequence
tatatcactttgttaatgtg

SEQ ID NO: 410912 - DNA, 20 bp, Artificial
  CRISPR gRNA sequence
atatcactttgttaatgtgg

SEQ ID NO: 410913 - DNA, 20 bp, Artificial
  CRISPR gRNA sequence
tatcactttgttaatgtggt

SEQ ID NO: 410914 - DNA, 20 bp, Artificial
  CRISPR gRNA sequence
tgttaatgtggtgtattaca

SEQ ID NO: 410915 - DNA, 20 bp, Artificial
  CRISPR gRNA sequence
gttaatgtggtgtattacat

SEQ ID NO: 410916 - DNA, 20 bp, Artificial
  CRISPR gRNA sequence
ttaatgtggtgtattacatt

SEQ ID NO: 410917 - DNA, 20 bp, Artificial
  CRISPR gRNA sequence
atgtggtgtattacattgat

SEQ ID NO: 410918 - DNA, 20 bp, Artificial
  CRISPR gRNA sequence
cattgattgatttacatatg

SEQ ID NO: 410919 - DNA, 20 bp, Artificial
  CRISPR gRNA sequence
attgatttacatatgttgaa

SEQ ID NO: 410920 - DNA, 20 bp, Artificial
  CRISPR gRNA sequence
atttacatatgttgaaccat

SEQ ID NO: 410921 - DNA, 20 bp, Artificial
  CRISPR gRNA sequence
acatatgttgaaccatcttt

SEQ ID NO: 410922 - DNA, 20 bp, Artificial
  CRISPR gRNA sequence
catatgttgaaccatctttg

SEQ ID NO: 410923 - DNA, 20 bp, Artificial
  CRISPR gRNA sequence
aaccatctttgcatgccagg

SEQ ID NO: 410924 - DNA, 20 bp, Artificial
  CRISPR gRNA sequence
tgcatgccagggataaatca

SEQ ID NO: 410925 - DNA, 20 bp, Artificial
  CRISPR gRNA sequence
gcatgccagggataaatcag

SEQ ID NO: 410926 - DNA, 20 bp, Artificial
  CRISPR gRNA sequence
catgccagggataaatcaga

SEQ ID NO: 410927 - DNA, 20 bp, Artificial
  CRISPR gRNA sequence
attagaatatacaatccatt

SEQ ID NO: 410928 - DNA, 20 bp, Artificial
  CRISPR gRNA sequence
gaatatacaatccatttaat

SEQ ID NO: 410929 - DNA, 20 bp, Artificial
  CRISPR gRNA sequence
aatgtgatggtgaatttagt

SEQ ID NO: 410930 - DNA, 20 bp, Artificial
  CRISPR gRNA sequence
atgtgatggtgaatttagtt

SEQ ID NO: 410931 - DNA, 20 bp, Artificial
  CRISPR gRNA sequence
agtttgctagtattttgttg

SEQ ID NO: 410932 - DNA, 20 bp, Artificial
  CRISPR gRNA sequence
gtttgctagtattttgttga

SEQ ID NO: 410933 - DNA, 20 bp, Artificial
  CRISPR gRNA sequence
gctagtattttgttgaggat

SEQ ID NO: 410934 - DNA, 20 bp, Artificial
  CRISPR gRNA sequence
ctagtattttgttgaggatt

SEQ ID NO: 410935 - DNA, 20 bp, Artificial
  CRISPR gRNA sequence
gtattttgttgaggattttt

SEQ ID NO: 410936 - DNA, 20 bp, Artificial
  CRISPR gRNA sequence
tgttgaggattttttcatct

SEQ ID NO: 410937 - DNA, 20 bp, Artificial
  CRISPR gRNA sequence
gttgaggattttttcatctg

SEQ ID NO: 410938 - DNA, 20 bp, Artificial
  CRISPR gRNA sequence
ttgaggattttttcatctgt

SEQ ID NO: 410939 - DNA, 20 bp, Artificial
  CRISPR gRNA sequence
aggattttttcatctgtgtt

SEQ ID NO: 410940 - DNA, 20 bp, Artificial
  CRISPR gRNA sequence
tttcatctgtgttcattagg

SEQ ID NO: 410941 - DNA, 20 bp, Artificial
  CRISPR gRNA sequence
ttcatctgtgttcattaggg

SEQ ID NO: 410942 - DNA, 20 bp, Artificial
  CRISPR gRNA sequence
tcatctgtgttcattaggga

SEQ ID NO: 410943 - DNA, 20 bp, Artificial
  CRISPR gRNA sequence
catctgtgttcattagggat

SEQ ID NO: 410944 - DNA, 20 bp, Artificial
  CRISPR gRNA sequence
atctgtgttcattagggatg

SEQ ID NO: 410945 - DNA, 20 bp, Artificial
  CRISPR gRNA sequence
tgttcattagggatgtcagc

SEQ ID NO: 410946 - DNA, 20 bp, Artificial
  CRISPR gRNA sequence
attagggatgtcagcctgta

SEQ ID NO: 410947 - DNA, 20 bp, Artificial
  CRISPR gRNA sequence
gggatgtcagcctgtaggtt

SEQ ID NO: 410948 - DNA, 20 bp, Artificial
  CRISPR gRNA sequence
taggtttttttttttttttt

SEQ ID NO: 410949 - DNA, 20 bp, Artificial
  CRISPR gRNA sequence
tttttttttttttgtggtgt

SEQ ID NO: 410950 - DNA, 20 bp, Artificial
  CRISPR gRNA sequence
ttttttttttttgtggtgtc

SEQ ID NO: 410951 - DNA, 20 bp, Artificial
  CRISPR gRNA sequence
tttttttttttgtggtgtct

SEQ ID NO: 410952 - DNA, 20 bp, Artificial
  CRISPR gRNA sequence
ttttttttttgtggtgtctt

SEQ ID NO: 410953 - DNA, 20 bp, Artificial
  CRISPR gRNA sequence
tttttttttgtggtgtcttt

SEQ ID NO: 410954 - DNA, 20 bp, Artificial
  CRISPR gRNA sequence
ttttttttgtggtgtctttg

SEQ ID NO: 410955 - DNA, 20 bp, Artificial
  CRISPR gRNA sequence
tttttttgtggtgtctttgt

SEQ ID NO: 410956 - DNA, 20 bp, Artificial
  CRISPR gRNA sequence
ttttttgtggtgtctttgtc

SEQ ID NO: 410957 - DNA, 20 bp, Artificial
  CRISPR gRNA sequence
tttttgtggtgtctttgtct

SEQ ID NO: 410958 - DNA, 20 bp, Artificial
  CRISPR gRNA sequence
ttttgtggtgtctttgtctg

SEQ ID NO: 410959 - DNA, 20 bp, Artificial
  CRISPR gRNA sequence
tttgtggtgtctttgtctgg

SEQ ID NO: 410960 - DNA, 20 bp, Artificial
  CRISPR gRNA sequence
ttgtggtgtctttgtctggt

SEQ ID NO: 410961 - DNA, 20 bp, Artificial
  CRISPR gRNA sequence
tgtggtgtctttgtctggtt

SEQ ID NO: 410962 - DNA, 20 bp, Artificial
  CRISPR gRNA sequence
gtggtgtctttgtctggttt

SEQ ID NO: 410963 - DNA, 20 bp, Artificial
  CRISPR gRNA sequence
tggtgtctttgtctggtttt

SEQ ID NO: 410964 - DNA, 20 bp, Artificial
  CRISPR gRNA sequence
tgtctggttttggtatcagg

SEQ ID NO: 410965 - DNA, 20 bp, Artificial
  CRISPR gRNA sequence
gtctggttttggtatcaggg

SEQ ID NO: 410966 - DNA, 20 bp, Artificial
  CRISPR gRNA sequence
tctggttttggtatcagggt

SEQ ID NO: 410967 - DNA, 20 bp, Artificial
  CRISPR gRNA sequence
gttttggtatcagggtgatg

SEQ ID NO: 410968 - DNA, 20 bp, Artificial
  CRISPR gRNA sequence
tggtatcagggtgatgctgg

SEQ ID NO: 410969 - DNA, 20 bp, Artificial
  CRISPR gRNA sequence
ggtatcagggtgatgctggt

SEQ ID NO: 410970 - DNA, 20 bp, Artificial
  CRISPR gRNA sequence
gtatcagggtgatgctggtc

SEQ ID NO: 410971 - DNA, 20 bp, Artificial
  CRISPR gRNA sequence
gtctcataaactgagtttag

SEQ ID NO: 410972 - DNA, 20 bp, Artificial
  CRISPR gRNA sequence
ataaactgagtttagaactg

SEQ ID NO: 410973 - DNA, 20 bp, Artificial
  CRISPR gRNA sequence
agtttagaactgcttctttt

SEQ ID NO: 410974 - DNA, 20 bp, Artificial
  CRISPR gRNA sequence
agaactgcttctttttttaa

SEQ ID NO: 410975 - DNA, 20 bp, Artificial
  CRISPR gRNA sequence
gaactgcttctttttttaaa

SEQ ID NO: 410976 - DNA, 20 bp, Artificial
  CRISPR gRNA sequence
cttctttttttaaaaaagaa

SEQ ID NO: 410977 - DNA, 20 bp, Artificial
  CRISPR gRNA sequence
ctttttttaaaaaagaatta

SEQ ID NO: 410978 - DNA, 20 bp, Artificial
  CRISPR gRNA sequence
tttttttaaaaaagaattaa

SEQ ID NO: 410979 - DNA, 20 bp, Artificial
  CRISPR gRNA sequence
tttttaaaaaagaattaaat

SEQ ID NO: 410980 - DNA, 20 bp, Artificial
  CRISPR gRNA sequence
ttttaaaaaagaattaaatc

SEQ ID NO: 410981 - DNA, 20 bp, Artificial
  CRISPR gRNA sequence
tttaaaaaagaattaaatca

SEQ ID NO: 410982 - DNA, 20 bp, Artificial
  CRISPR gRNA sequence
ttaaaaaagaattaaatcat

SEQ ID NO: 410983 - DNA, 20 bp, Artificial
  CRISPR gRNA sequence
taaaaaagaattaaatcatt

SEQ ID NO: 410984 - DNA, 20 bp, Artificial
  CRISPR gRNA sequence
aaaaaagaattaaatcattt

SEQ ID NO: 410985 - DNA, 20 bp, Artificial
  CRISPR gRNA sequence
aaaaagaattaaatcattta

SEQ ID NO: 410986 - DNA, 20 bp, Artificial
  CRISPR gRNA sequence
aatcatttattgattacaca

SEQ ID NO: 410987 - DNA, 20 bp, Artificial
  CRISPR gRNA sequence
attgattacacatgataatg

SEQ ID NO: 410988 - DNA, 20 bp, Artificial
  CRISPR gRNA sequence
ttgattacacatgataatgt

SEQ ID NO: 410989 - DNA, 20 bp, Artificial
  CRISPR gRNA sequence
attacacatgataatgtaga

SEQ ID NO: 410990 - DNA, 20 bp, Artificial
  CRISPR gRNA sequence
cacatgataatgtagaactg

SEQ ID NO: 410991 - DNA, 20 bp, Artificial
  CRISPR gRNA sequence
tttctaaactcaggattggc

SEQ ID NO: 410992 - DNA, 20 bp, Artificial
  CRISPR gRNA sequence
ctaaactcaggattggcatt

SEQ ID NO: 410993 - DNA, 20 bp, Artificial
  CRISPR gRNA sequence
taaactcaggattggcatta

SEQ ID NO: 410994 - DNA, 20 bp, Artificial
  CRISPR gRNA sequence
aactcaggattggcattaat

SEQ ID NO: 410995 - DNA, 20 bp, Artificial
  CRISPR gRNA sequence
aggattggcattaattccta

SEQ ID NO: 410996 - DNA, 20 bp, Artificial
  CRISPR gRNA sequence
gcattaattcctagaatgtt

SEQ ID NO: 410997 - DNA, 20 bp, Artificial
  CRISPR gRNA sequence
attcctagaatgtttgatag

SEQ ID NO: 410998 - DNA, 20 bp, Artificial
  CRISPR gRNA sequence
ctagaatgtttgatagaatt

SEQ ID NO: 410999 - DNA, 20 bp, Artificial
  CRISPR gRNA sequence
gaatgtttgatagaattcat

SEQ ID NO: 411000 - DNA, 20 bp, Artificial
  CRISPR gRNA sequence
gatagaattcatctgtgaag

SEQ ID NO: 411001 - DNA, 20 bp, Artificial
  CRISPR gRNA sequence
atagaattcatctgtgaagc

SEQ ID NO: 411002 - DNA, 20 bp, Artificial
  CRISPR gRNA sequence
atctgtgaagccacctggtc

SEQ ID NO: 411003 - DNA, 20 bp, Artificial
  CRISPR gRNA sequence
tgaagccacctggtcctggg

SEQ ID NO: 411004 - DNA, 20 bp, Artificial
  CRISPR gRNA sequence
gtcctgggatcagtgatggg

SEQ ID NO: 411005 - DNA, 20 bp, Artificial
  CRISPR gRNA sequence
ggatcagtgatgggtcatag

SEQ ID NO: 411006 - DNA, 20 bp, Artificial
  CRISPR gRNA sequence
atccacctacctttgtaggc

SEQ ID NO: 411007 - DNA, 20 bp, Artificial
  CRISPR gRNA sequence
cctttgtaggcacaaaggtg

SEQ ID NO: 411008 - DNA, 20 bp, Artificial
  CRISPR gRNA sequence
tgtaggcacaaaggtgtcct

SEQ ID NO: 411009 - DNA, 20 bp, Artificial
  CRISPR gRNA sequence
gtaggcacaaaggtgtccta

SEQ ID NO: 411010 - DNA, 20 bp, Artificial
  CRISPR gRNA sequence
taggcacaaaggtgtcctac

SEQ ID NO: 411011 - DNA, 20 bp, Artificial
  CRISPR gRNA sequence
cacagggtagagagatactg

SEQ ID NO: 411012 - DNA, 20 bp, Artificial
  CRISPR gRNA sequence
tcagcatgatttgaatctca

SEQ ID NO: 411013 - DNA, 20 bp, Artificial
  CRISPR gRNA sequence
gaatctcagtttgtgctttc

SEQ ID NO: 411014 - DNA, 20 bp, Artificial
  CRISPR gRNA sequence
aatctcagtttgtgctttcc

SEQ ID NO: 411015 - DNA, 20 bp, Artificial
  CRISPR gRNA sequence
agtttgtgctttccactgcc

SEQ ID NO: 411016 - DNA, 20 bp, Artificial
  CRISPR gRNA sequence
gtgctttccactgcctcaaa

SEQ ID NO: 411017 - DNA, 20 bp, Artificial
  CRISPR gRNA sequence
tgctttccactgcctcaaaa

SEQ ID NO: 411018 - DNA, 20 bp, Artificial
  CRISPR gRNA sequence
tccactgcctcaaaacactc

SEQ ID NO: 411019 - DNA, 20 bp, Artificial
  CRISPR gRNA sequence
ccactgcctcaaaacactca

SEQ ID NO: 411020 - DNA, 20 bp, Artificial
  CRISPR gRNA sequence
cactgcctcaaaacactcac

SEQ ID NO: 411021 - DNA, 20 bp, Artificial
  CRISPR gRNA sequence
cctcaaaacactcacacttt

SEQ ID NO: 411022 - DNA, 20 bp, Artificial
  CRISPR gRNA sequence
aaaacactcacactttccta

SEQ ID NO: 411023 - DNA, 20 bp, Artificial
  CRISPR gRNA sequence
acactttcctactttctcct

SEQ ID NO: 411024 - DNA, 20 bp, Artificial
  CRISPR gRNA sequence
tcctactttctcctttttct

SEQ ID NO: 411025 - DNA, 20 bp, Artificial
  CRISPR gRNA sequence
cctactttctcctttttcta

SEQ ID NO: 411026 - DNA, 20 bp, Artificial
  CRISPR gRNA sequence
ctactttctcctttttctaa

SEQ ID NO: 411027 - DNA, 20 bp, Artificial
  CRISPR gRNA sequence
ctttctcctttttctaactg

SEQ ID NO: 411028 - DNA, 20 bp, Artificial
  CRISPR gRNA sequence
tctcctttttctaactgact

SEQ ID NO: 411029 - DNA, 20 bp, Artificial
  CRISPR gRNA sequence
ctcctttttctaactgacta

SEQ ID NO: 411030 - DNA, 20 bp, Artificial
  CRISPR gRNA sequence
tcctttttctaactgactaa

SEQ ID NO: 411031 - DNA, 20 bp, Artificial
  CRISPR gRNA sequence
ctttttctaactgactaagt

SEQ ID NO: 411032 - DNA, 20 bp, Artificial
  CRISPR gRNA sequence
tttctaactgactaagtttc

SEQ ID NO: 411033 - DNA, 20 bp, Artificial
  CRISPR gRNA sequence
ttctaactgactaagtttcc

SEQ ID NO: 411034 - DNA, 20 bp, Artificial
  CRISPR gRNA sequence
tctaactgactaagtttcca

SEQ ID NO: 411035 - DNA, 20 bp, Artificial
  CRISPR gRNA sequence
ctaactgactaagtttccat

SEQ ID NO: 411036 - DNA, 20 bp, Artificial
  CRISPR gRNA sequence
taactgactaagtttccatc

SEQ ID NO: 411037 - DNA, 20 bp, Artificial
  CRISPR gRNA sequence
actgactaagtttccatcac

SEQ ID NO: 411038 - DNA, 20 bp, Artificial
  CRISPR gRNA sequence
actaagtttccatcacattt

SEQ ID NO: 411039 - DNA, 20 bp, Artificial
  CRISPR gRNA sequence
agtttccatcacatttgctt

SEQ ID NO: 411040 - DNA, 20 bp, Artificial
  CRISPR gRNA sequence
ccatcacatttgctttcttt

SEQ ID NO: 411041 - DNA, 20 bp, Artificial
  CRISPR gRNA sequence
catcacatttgctttctttc

SEQ ID NO: 411042 - DNA, 20 bp, Artificial
  CRISPR gRNA sequence
gctttctttcctatagagtt

SEQ ID NO: 411043 - DNA, 20 bp, Artificial
  CRISPR gRNA sequence
ctttctttcctatagagttt

SEQ ID NO: 411044 - DNA, 20 bp, Artificial
  CRISPR gRNA sequence
tctttcctatagagtttcag

SEQ ID NO: 411045 - DNA, 20 bp, Artificial
  CRISPR gRNA sequence
ctttcctatagagtttcagc

SEQ ID NO: 411046 - DNA, 20 bp, Artificial
  CRISPR gRNA sequence
tttcctatagagtttcagcc

SEQ ID NO: 411047 - DNA, 20 bp, Artificial
  CRISPR gRNA sequence
tcctatagagtttcagccgt

SEQ ID NO: 411048 - DNA, 20 bp, Artificial
  CRISPR gRNA sequence
cctatagagtttcagccgtc

SEQ ID NO: 411049 - DNA, 20 bp, Artificial
  CRISPR gRNA sequence
ctatagagtttcagccgtct

SEQ ID NO: 411050 - DNA, 20 bp, Artificial
  CRISPR gRNA sequence
tagagtttcagccgtctcaa

SEQ ID NO: 411051 - DNA, 20 bp, Artificial
  CRISPR gRNA sequence
cagccgtctcaatgtctatg

SEQ ID NO: 411052 - DNA, 20 bp, Artificial
  CRISPR gRNA sequence
agccgtctcaatgtctatgt

SEQ ID NO: 411053 - DNA, 20 bp, Artificial
  CRISPR gRNA sequence
aatgtctatgtttttttcca

SEQ ID NO: 411054 - DNA, 20 bp, Artificial
  CRISPR gRNA sequence
tgtttttttccacatcagac

SEQ ID NO: 411055 - DNA, 20 bp, Artificial
  CRISPR gRNA sequence
ttttccacatcagaccaaac

SEQ ID NO: 411056 - DNA, 20 bp, Artificial
  CRISPR gRNA sequence
tttccacatcagaccaaact

SEQ ID NO: 411057 - DNA, 20 bp, Artificial
  CRISPR gRNA sequence
ttccacatcagaccaaactg

SEQ ID NO: 411058 - DNA, 20 bp, Artificial
  CRISPR gRNA sequence
tccacatcagaccaaactgc

SEQ ID NO: 411059 - DNA, 20 bp, Artificial
  CRISPR gRNA sequence
ccacatcagaccaaactgct

SEQ ID NO: 411060 - DNA, 20 bp, Artificial
  CRISPR gRNA sequence
cacatcagaccaaactgctt

SEQ ID NO: 411061 - DNA, 20 bp, Artificial
  CRISPR gRNA sequence
cttccccatcattgaaatat

SEQ ID NO: 411062 - DNA, 20 bp, Artificial
  CRISPR gRNA sequence
ccccatcattgaaatattaa

SEQ ID NO: 411063 - DNA, 20 bp, Artificial
  CRISPR gRNA sequence
cccatcattgaaatattaag

SEQ ID NO: 411064 - DNA, 20 bp, Artificial
  CRISPR gRNA sequence
aaatattaagcatcttggat

SEQ ID NO: 411065 - DNA, 20 bp, Artificial
  CRISPR gRNA sequence
agcatcttggatttctcaaa

SEQ ID NO: 411066 - DNA, 20 bp, Artificial
  CRISPR gRNA sequence
ggatttctcaaacttttata

SEQ ID NO: 411067 - DNA, 20 bp, Artificial
  CRISPR gRNA sequence
gatttctcaaacttttatag

SEQ ID NO: 411068 - DNA, 20 bp, Artificial
  CRISPR gRNA sequence
ctcaaacttttatagtctga

SEQ ID NO: 411069 - DNA, 20 bp, Artificial
  CRISPR gRNA sequence
tcaaacttttatagtctgaa

SEQ ID NO: 411070 - DNA, 20 bp, Artificial
  CRISPR gRNA sequence
aaacttttatagtctgaaaa

SEQ ID NO: 411071 - DNA, 20 bp, Artificial
  CRISPR gRNA sequence
ttatagtctgaaaattgcta

SEQ ID NO: 411072 - DNA, 20 bp, Artificial
  CRISPR gRNA sequence
tatagtctgaaaattgctac

SEQ ID NO: 411073 - DNA, 20 bp, Artificial
  CRISPR gRNA sequence
atagtctgaaaattgctacc

SEQ ID NO: 411074 - DNA, 20 bp, Artificial
  CRISPR gRNA sequence
tagtctgaaaattgctaccc

SEQ ID NO: 411075 - DNA, 20 bp, Artificial
  CRISPR gRNA sequence
aaaattgctaccctcgagtg

SEQ ID NO: 411076 - DNA, 20 bp, Artificial
  CRISPR gRNA sequence
ctaccctcgagtgacttatt

SEQ ID NO: 411077 - DNA, 20 bp, Artificial
  CRISPR gRNA sequence
ccctcgagtgacttattaac

SEQ ID NO: 411078 - DNA, 20 bp, Artificial
  CRISPR gRNA sequence
gagtgacttattaacttcca

SEQ ID NO: 411079 - DNA, 20 bp, Artificial
  CRISPR gRNA sequence
attaacttccatctatttgt

SEQ ID NO: 411080 - DNA, 20 bp, Artificial
  CRISPR gRNA sequence
ttaacttccatctatttgta

SEQ ID NO: 411081 - DNA, 20 bp, Artificial
  CRISPR gRNA sequence
acttccatctatttgtattt

SEQ ID NO: 411082 - DNA, 20 bp, Artificial
  CRISPR gRNA sequence
ccatctatttgtatttattt

SEQ ID NO: 411083 - DNA, 20 bp, Artificial
  CRISPR gRNA sequence
catctatttgtatttattta

SEQ ID NO: 411084 - DNA, 20 bp, Artificial
  CRISPR gRNA sequence
tttgtatttatttatttatt

SEQ ID NO: 411085 - DNA, 20 bp, Artificial
  CRISPR gRNA sequence
gtatttatttatttatttat

SEQ ID NO: 411086 - DNA, 20 bp, Artificial
  CRISPR gRNA sequence
tatttatttatttatttatt

SEQ ID NO: 411087 - DNA, 20 bp, Artificial
  CRISPR gRNA sequence
atttatttatttattttttg

SEQ ID NO: 411088 - DNA, 20 bp, Artificial
  CRISPR gRNA sequence
tttatttatttattttttga

SEQ ID NO: 411089 - DNA, 20 bp, Artificial
  CRISPR gRNA sequence
atttatttattttttgagac

SEQ ID NO: 411090 - DNA, 20 bp, Artificial
  CRISPR gRNA sequence
tttatttattttttgagacc

SEQ ID NO: 411091 - DNA, 20 bp, Artificial
  CRISPR gRNA sequence
atttattttttgagaccggg

SEQ ID NO: 411092 - DNA, 20 bp, Artificial
  CRISPR gRNA sequence
tttattttttgagaccgggt

SEQ ID NO: 411093 - DNA, 20 bp, Artificial
  CRISPR gRNA sequence
attttttgagaccgggttat

SEQ ID NO: 411094 - DNA, 20 bp, Artificial
  CRISPR gRNA sequence
ttttttgagaccgggttatg

SEQ ID NO: 411095 - DNA, 20 bp, Artificial
  CRISPR gRNA sequence
tttgagaccgggttatgaga

SEQ ID NO: 411096 - DNA, 20 bp, Artificial
  CRISPR gRNA sequence
ttgagaccgggttatgagac

SEQ ID NO: 411097 - DNA, 20 bp, Artificial
  CRISPR gRNA sequence
tgagaccgggttatgagact

SEQ ID NO: 411098 - DNA, 20 bp, Artificial
  CRISPR gRNA sequence
gagaccgggttatgagactg

SEQ ID NO: 411099 - DNA, 20 bp, Artificial
  CRISPR gRNA sequence
agaccgggttatgagactgg

SEQ ID NO: 411100 - DNA, 20 bp, Artificial
  CRISPR gRNA sequence
tgagactggctaatttttgt

SEQ ID NO: 411101 - DNA, 20 bp, Artificial
  CRISPR gRNA sequence
gctaatttttgtatttttgg

SEQ ID NO: 411102 - DNA, 20 bp, Artificial
  CRISPR gRNA sequence
atttttgtatttttggtaga

SEQ ID NO: 411103 - DNA, 20 bp, Artificial
  CRISPR gRNA sequence
ttgtatttttggtagagatg

SEQ ID NO: 411104 - DNA, 20 bp, Artificial
  CRISPR gRNA sequence
tgtatttttggtagagatgg

SEQ ID NO: 411105 - DNA, 20 bp, Artificial
  CRISPR gRNA sequence
gtatttttggtagagatggg

SEQ ID NO: 411106 - DNA, 20 bp, Artificial
  CRISPR gRNA sequence
tatttttggtagagatgggg

SEQ ID NO: 411107 - DNA, 20 bp, Artificial
  CRISPR gRNA sequence
ttggtagagatggggtttca

SEQ ID NO: 411108 - DNA, 20 bp, Artificial
  CRISPR gRNA sequence
tggtagagatggggtttcaa

SEQ ID NO: 411109 - DNA, 20 bp, Artificial
  CRISPR gRNA sequence
ggtagagatggggtttcaag

SEQ ID NO: 411110 - DNA, 20 bp, Artificial
  CRISPR gRNA sequence
gtagagatggggtttcaagg

SEQ ID NO: 411111 - DNA, 20 bp, Artificial
  CRISPR gRNA sequence
caaggatggtcctgggctca

SEQ ID NO: 411112 - DNA, 20 bp, Artificial
  CRISPR gRNA sequence
aaggatggtcctgggctcaa

SEQ ID NO: 411113 - DNA, 20 bp, Artificial
  CRISPR gRNA sequence
ggctcaagcaatcccctgcc

SEQ ID NO: 411114 - DNA, 20 bp, Artificial
  CRISPR gRNA sequence
aagcaatcccctgcctcagc

SEQ ID NO: 411115 - DNA, 20 bp, Artificial
  CRISPR gRNA sequence
cctcagcctcctaaagtgct

SEQ ID NO: 411116 - DNA, 20 bp, Artificial
  CRISPR gRNA sequence
agcctcctaaagtgctggga

SEQ ID NO: 411117 - DNA, 20 bp, Artificial
  CRISPR gRNA sequence
ctaaagtgctgggattggta

SEQ ID NO: 411118 - DNA, 20 bp, Artificial
  CRISPR gRNA sequence
aagtgctgggattggtagtg

SEQ ID NO: 411119 - DNA, 20 bp, Artificial
  CRISPR gRNA sequence
ggattggtagtgtgaaccac

SEQ ID NO: 411120 - DNA, 20 bp, Artificial
  CRISPR gRNA sequence
gtagtgtgaaccaccacacc

SEQ ID NO: 411121 - DNA, 20 bp, Artificial
  CRISPR gRNA sequence
gcctgcatctatttgtaatg

SEQ ID NO: 411122 - DNA, 20 bp, Artificial
  CRISPR gRNA sequence
catctatttgtaatgttcca

SEQ ID NO: 411123 - DNA, 20 bp, Artificial
  CRISPR gRNA sequence
tttgtaatgttccaaactct

SEQ ID NO: 411124 - DNA, 20 bp, Artificial
  CRISPR gRNA sequence
gtaatgttccaaactctggt

SEQ ID NO: 411125 - DNA, 20 bp, Artificial
  CRISPR gRNA sequence
taatgttccaaactctggtt

SEQ ID NO: 411126 - DNA, 20 bp, Artificial
  CRISPR gRNA sequence
caaactctggttatcagaaa

SEQ ID NO: 411127 - DNA, 20 bp, Artificial
  CRISPR gRNA sequence
tggttatcagaaattaattg

SEQ ID NO: 411128 - DNA, 20 bp, Artificial
  CRISPR gRNA sequence
gttatcagaaattaattgag

SEQ ID NO: 411129 - DNA, 20 bp, Artificial
  CRISPR gRNA sequence
tcagaaattaattgagatta

SEQ ID NO: 411130 - DNA, 20 bp, Artificial
  CRISPR gRNA sequence
attgagattaaggattatgg

SEQ ID NO: 411131 - DNA, 20 bp, Artificial
  CRISPR gRNA sequence
agattaaggattatggcatc

SEQ ID NO: 411132 - DNA, 20 bp, Artificial
  CRISPR gRNA sequence
aggattatggcatctgctta

SEQ ID NO: 411133 - DNA, 20 bp, Artificial
  CRISPR gRNA sequence
tggcatctgcttaaagttgt

SEQ ID NO: 411134 - DNA, 20 bp, Artificial
  CRISPR gRNA sequence
cttaaagttgtcaaagcatc

SEQ ID NO: 411135 - DNA, 20 bp, Artificial
  CRISPR gRNA sequence
aaagttgtcaaagcatcttt

SEQ ID NO: 411136 - DNA, 20 bp, Artificial
  CRISPR gRNA sequence
aagttgtcaaagcatctttt

SEQ ID NO: 411137 - DNA, 20 bp, Artificial
  CRISPR gRNA sequence
tcaaagcatcttttcagaat

SEQ ID NO: 411138 - DNA, 20 bp, Artificial
  CRISPR gRNA sequence
ttcagaatatgcccagtaag

SEQ ID NO: 411139 - DNA, 20 bp, Artificial
  CRISPR gRNA sequence
tcagaatatgcccagtaagt

SEQ ID NO: 411140 - DNA, 20 bp, Artificial
  CRISPR gRNA sequence
cagaatatgcccagtaagtg

SEQ ID NO: 411141 - DNA, 20 bp, Artificial
  CRISPR gRNA sequence
agaatatgcccagtaagtgt

SEQ ID NO: 411142 - DNA, 20 bp, Artificial
  CRISPR gRNA sequence
ttgaccgattatgttaatgt

SEQ ID NO: 411143 - DNA, 20 bp, Artificial
  CRISPR gRNA sequence
gaccgattatgttaatgttt

SEQ ID NO: 411144 - DNA, 20 bp, Artificial
  CRISPR gRNA sequence
accgattatgttaatgtttc

SEQ ID NO: 411145 - DNA, 20 bp, Artificial
  CRISPR gRNA sequence
tgttaatgtttctattcatt

SEQ ID NO: 411146 - DNA, 20 bp, Artificial
  CRISPR gRNA sequence
atgtttctattcattctagt

SEQ ID NO: 411147 - DNA, 20 bp, Artificial
  CRISPR gRNA sequence
ctattcattctagtaggggc

SEQ ID NO: 411148 - DNA, 20 bp, Artificial
  CRISPR gRNA sequence
tattcattctagtaggggct

SEQ ID NO: 411149 - DNA, 20 bp, Artificial
  CRISPR gRNA sequence
ttcattctagtaggggctgt

SEQ ID NO: 411150 - DNA, 20 bp, Artificial
  CRISPR gRNA sequence
attctagtaggggctgtgtc

SEQ ID NO: 411151 - DNA, 20 bp, Artificial
  CRISPR gRNA sequence
tagtaggggctgtgtccatt

SEQ ID NO: 411152 - DNA, 20 bp, Artificial
  CRISPR gRNA sequence
gtaggggctgtgtccatttt

SEQ ID NO: 411153 - DNA, 20 bp, Artificial
  CRISPR gRNA sequence
tgtccattttaattttaagt

SEQ ID NO: 411154 - DNA, 20 bp, Artificial
  CRISPR gRNA sequence
taattttaagttttctacct

SEQ ID NO: 411155 - DNA, 20 bp, Artificial
  CRISPR gRNA sequence
aattttaagttttctacctc

SEQ ID NO: 411156 - DNA, 20 bp, Artificial
  CRISPR gRNA sequence
attttaagttttctacctct

SEQ ID NO: 411157 - DNA, 20 bp, Artificial
  CRISPR gRNA sequence
taagttttctacctcttttc

SEQ ID NO: 411158 - DNA, 20 bp, Artificial
  CRISPR gRNA sequence
aagttttctacctcttttct

SEQ ID NO: 411159 - DNA, 20 bp, Artificial
  CRISPR gRNA sequence
agttttctacctcttttctt

SEQ ID NO: 411160 - DNA, 20 bp, Artificial
  CRISPR gRNA sequence
tctacctcttttctttccag

SEQ ID NO: 411161 - DNA, 20 bp, Artificial
  CRISPR gRNA sequence
ctacctcttttctttccaga

SEQ ID NO: 411162 - DNA, 20 bp, Artificial
  CRISPR gRNA sequence
tacctcttttctttccagat

SEQ ID NO: 411163 - DNA, 20 bp, Artificial
  CRISPR gRNA sequence
cctcttttctttccagattt

SEQ ID NO: 411164 - DNA, 20 bp, Artificial
  CRISPR gRNA sequence
ttttctttccagattttttt

SEQ ID NO: 411165 - DNA, 20 bp, Artificial
  CRISPR gRNA sequence
ttctttccagattttttttc

SEQ ID NO: 411166 - DNA, 20 bp, Artificial
  CRISPR gRNA sequence
tctttccagattttttttct

SEQ ID NO: 411167 - DNA, 20 bp, Artificial
  CRISPR gRNA sequence
ctttccagattttttttctt

SEQ ID NO: 411168 - DNA, 20 bp, Artificial
  CRISPR gRNA sequence
tttccagattttttttcttc

SEQ ID NO: 411169 - DNA, 20 bp, Artificial
  CRISPR gRNA sequence
tccagattttttttcttcaa

SEQ ID NO: 411170 - DNA, 20 bp, Artificial
  CRISPR gRNA sequence
ccagattttttttcttcaac

SEQ ID NO: 411171 - DNA, 20 bp, Artificial
  CRISPR gRNA sequence
cagattttttttcttcaacg

SEQ ID NO: 411172 - DNA, 20 bp, Artificial
  CRISPR gRNA sequence
tttttcttcaacgtttaacc

SEQ ID NO: 411173 - DNA, 20 bp, Artificial
  CRISPR gRNA sequence
ttttcttcaacgtttaacct

SEQ ID NO: 411174 - DNA, 20 bp, Artificial
  CRISPR gRNA sequence
tttcttcaacgtttaacctt

SEQ ID NO: 411175 - DNA, 20 bp, Artificial
  CRISPR gRNA sequence
ttcttcaacgtttaaccttt

SEQ ID NO: 411176 - DNA, 20 bp, Artificial
  CRISPR gRNA sequence
tcttcaacgtttaacctttg

SEQ ID NO: 411177 - DNA, 20 bp, Artificial
  CRISPR gRNA sequence
cttcaacgtttaacctttga

SEQ ID NO: 411178 - DNA, 20 bp, Artificial
  CRISPR gRNA sequence
ttcaacgtttaacctttgag

SEQ ID NO: 411179 - DNA, 20 bp, Artificial
  CRISPR gRNA sequence
caacgtttaacctttgaggt

SEQ ID NO: 411180 - DNA, 20 bp, Artificial
  CRISPR gRNA sequence
aacgtttaacctttgaggtt

SEQ ID NO: 411181 - DNA, 20 bp, Artificial
  CRISPR gRNA sequence
aacctttgaggtttactgat

SEQ ID NO: 411182 - DNA, 20 bp, Artificial
  CRISPR gRNA sequence
acctttgaggtttactgatt

SEQ ID NO: 411183 - DNA, 20 bp, Artificial
  CRISPR gRNA sequence
tgaggtttactgattgttga

SEQ ID NO: 411184 - DNA, 20 bp, Artificial
  CRISPR gRNA sequence
gaggtttactgattgttgat

SEQ ID NO: 411185 - DNA, 20 bp, Artificial
  CRISPR gRNA sequence
aggtttactgattgttgatc

SEQ ID NO: 411186 - DNA, 20 bp, Artificial
  CRISPR gRNA sequence
actgattgttgatcaaagaa

SEQ ID NO: 411187 - DNA, 20 bp, Artificial
  CRISPR gRNA sequence
ctgattgttgatcaaagaaa

SEQ ID NO: 411188 - DNA, 20 bp, Artificial
  CRISPR gRNA sequence
attgttgatcaaagaaactg

SEQ ID NO: 411189 - DNA, 20 bp, Artificial
  CRISPR gRNA sequence
ttgatcaaagaaactgaact

SEQ ID NO: 411190 - DNA, 20 bp, Artificial
  CRISPR gRNA sequence
atcaaagaaactgaactttc

SEQ ID NO: 411191 - DNA, 20 bp, Artificial
  CRISPR gRNA sequence
aactttcaaaagatcaacta

SEQ ID NO: 411192 - DNA, 20 bp, Artificial
  CRISPR gRNA sequence
tcaaaagatcaactacagtg

SEQ ID NO: 411193 - DNA, 20 bp, Artificial
  CRISPR gRNA sequence
caaaagatcaactacagtga

SEQ ID NO: 411194 - DNA, 20 bp, Artificial
  CRISPR gRNA sequence
aaaagatcaactacagtgat

SEQ ID NO: 411195 - DNA, 20 bp, Artificial
  CRISPR gRNA sequence
cagtgattggagaaaaaact

SEQ ID NO: 411196 - DNA, 20 bp, Artificial
  CRISPR gRNA sequence
gagaaaaaactttcatgaac

SEQ ID NO: 411197 - DNA, 20 bp, Artificial
  CRISPR gRNA sequence
tcatgaactcttgtttacat

SEQ ID NO: 411198 - DNA, 20 bp, Artificial
  CRISPR gRNA sequence
catgaactcttgtttacata

SEQ ID NO: 411199 - DNA, 20 bp, Artificial
  CRISPR gRNA sequence
atgaactcttgtttacatat

SEQ ID NO: 411200 - DNA, 20 bp, Artificial
  CRISPR gRNA sequence
ttgtttacatatataacttt

SEQ ID NO: 411201 - DNA, 20 bp, Artificial
  CRISPR gRNA sequence
gtttacatatataactttca

SEQ ID NO: 411202 - DNA, 20 bp, Artificial
  CRISPR gRNA sequence
tttacatatataactttcag

SEQ ID NO: 411203 - DNA, 20 bp, Artificial
  CRISPR gRNA sequence
acatatataactttcagata

SEQ ID NO: 411204 - DNA, 20 bp, Artificial
  CRISPR gRNA sequence
catatataactttcagatag

SEQ ID NO: 411205 - DNA, 20 bp, Artificial
  CRISPR gRNA sequence
tcagatagggctatttactt

SEQ ID NO: 411206 - DNA, 20 bp, Artificial
  CRISPR gRNA sequence
cagatagggctatttacttt

SEQ ID NO: 411207 - DNA, 20 bp, Artificial
  CRISPR gRNA sequence
agatagggctatttactttt

SEQ ID NO: 411208 - DNA, 20 bp, Artificial
  CRISPR gRNA sequence
tttacttttttaactttcat

SEQ ID NO: 411209 - DNA, 20 bp, Artificial
  CRISPR gRNA sequence
acttttttaactttcatttt

SEQ ID NO: 411210 - DNA, 20 bp, Artificial
  CRISPR gRNA sequence
cttttttaactttcattttc

SEQ ID NO: 411211 - DNA, 20 bp, Artificial
  CRISPR gRNA sequence
ttttaactttcattttctta

SEQ ID NO: 411212 - DNA, 20 bp, Artificial
  CRISPR gRNA sequence
tttaactttcattttcttat

SEQ ID NO: 411213 - DNA, 20 bp, Artificial
  CRISPR gRNA sequence
ttaactttcattttcttatt

SEQ ID NO: 411214 - DNA, 20 bp, Artificial
  CRISPR gRNA sequence
taactttcattttcttattt

SEQ ID NO: 411215 - DNA, 20 bp, Artificial
  CRISPR gRNA sequence
aactttcattttcttatttt

SEQ ID NO: 411216 - DNA, 20 bp, Artificial
  CRISPR gRNA sequence
actttcattttcttattttg

SEQ ID NO: 411217 - DNA, 20 bp, Artificial
  CRISPR gRNA sequence
tcattttcttattttgaatt

SEQ ID NO: 411218 - DNA, 20 bp, Artificial
  CRISPR gRNA sequence
cattttcttattttgaattt

SEQ ID NO: 411219 - DNA, 20 bp, Artificial
  CRISPR gRNA sequence
attttcttattttgaatttt

SEQ ID NO: 411220 - DNA, 20 bp, Artificial
  CRISPR gRNA sequence
tcttattttgaatttttaat

SEQ ID NO: 411221 - DNA, 20 bp, Artificial
  CRISPR gRNA sequence
cttattttgaatttttaata

SEQ ID NO: 411222 - DNA, 20 bp, Artificial
  CRISPR gRNA sequence
ttattttgaatttttaatat

SEQ ID NO: 411223 - DNA, 20 bp, Artificial
  CRISPR gRNA sequence
attttgaatttttaatataa

SEQ ID NO: 411224 - DNA, 20 bp, Artificial
  CRISPR gRNA sequence
ttttgaatttttaatataag

SEQ ID NO: 411225 - DNA, 20 bp, Artificial
  CRISPR gRNA sequence
tgaatttttaatataagtgg

SEQ ID NO: 411226 - DNA, 20 bp, Artificial
  CRISPR gRNA sequence
gaatttttaatataagtggc

SEQ ID NO: 411227 - DNA, 20 bp, Artificial
  CRISPR gRNA sequence
aatttttaatataagtggca

SEQ ID NO: 411228 - DNA, 20 bp, Artificial
  CRISPR gRNA sequence
ttaatataagtggcacataa

SEQ ID NO: 411229 - DNA, 20 bp, Artificial
  CRISPR gRNA sequence
taatataagtggcacataat

SEQ ID NO: 411230 - DNA, 20 bp, Artificial
  CRISPR gRNA sequence
aatataagtggcacataatt

SEQ ID NO: 411231 - DNA, 20 bp, Artificial
  CRISPR gRNA sequence
atataagtggcacataattg

SEQ ID NO: 411232 - DNA, 20 bp, Artificial
  CRISPR gRNA sequence
ctggtcatctgaatagaagg

SEQ ID NO: 411233 - DNA, 20 bp, Artificial
  CRISPR gRNA sequence
gtcatctgaatagaaggatg

SEQ ID NO: 411234 - DNA, 20 bp, Artificial
  CRISPR gRNA sequence
aatagaaggatgggattagt

SEQ ID NO: 411235 - DNA, 20 bp, Artificial
  CRISPR gRNA sequence
gtaaattaagattacaaaac

SEQ ID NO: 411236 - DNA, 20 bp, Artificial
  CRISPR gRNA sequence
agattacaaaactattcact

SEQ ID NO: 411237 - DNA, 20 bp, Artificial
  CRISPR gRNA sequence
caaaactattcactaggaaa

SEQ ID NO: 411238 - DNA, 20 bp, Artificial
  CRISPR gRNA sequence
ttcactaggaaatcatagtg

SEQ ID NO: 411239 - DNA, 20 bp, Artificial
  CRISPR gRNA sequence
actaggaaatcatagtgcca

SEQ ID NO: 411240 - DNA, 20 bp, Artificial
  CRISPR gRNA sequence
ggaaatcatagtgccacagc

SEQ ID NO: 411241 - DNA, 20 bp, Artificial
  CRISPR gRNA sequence
agagaatcttcccagatatt

SEQ ID NO: 411242 - DNA, 20 bp, Artificial
  CRISPR gRNA sequence
cccagatatttcctctggga

SEQ ID NO: 411243 - DNA, 20 bp, Artificial
  CRISPR gRNA sequence
ccagatatttcctctgggac

SEQ ID NO: 411244 - DNA, 20 bp, Artificial
  CRISPR gRNA sequence
cctctgggacgatgtgaggt

SEQ ID NO: 411245 - DNA, 20 bp, Artificial
  CRISPR gRNA sequence
ctctgggacgatgtgaggta

SEQ ID NO: 411246 - DNA, 20 bp, Artificial
  CRISPR gRNA sequence
tgggacgatgtgaggtatag

SEQ ID NO: 411247 - DNA, 20 bp, Artificial
  CRISPR gRNA sequence
ggacgatgtgaggtatagga

SEQ ID NO: 411248 - DNA, 20 bp, Artificial
  CRISPR gRNA sequence
acaaggaggaaggacagggg

SEQ ID NO: 411249 - DNA, 20 bp, Artificial
  CRISPR gRNA sequence
taagttataaatacatccgt

SEQ ID NO: 411250 - DNA, 20 bp, Artificial
  CRISPR gRNA sequence
taaatacatccgtatataga

SEQ ID NO: 411251 - DNA, 20 bp, Artificial
  CRISPR gRNA sequence
atttatacagattataaatc

SEQ ID NO: 411252 - DNA, 20 bp, Artificial
  CRISPR gRNA sequence
tttatacagattataaatct

SEQ ID NO: 411253 - DNA, 20 bp, Artificial
  CRISPR gRNA sequence
atacagattataaatcttgc

SEQ ID NO: 411254 - DNA, 20 bp, Artificial
  CRISPR gRNA sequence
tacagattataaatcttgcc

SEQ ID NO: 411255 - DNA, 20 bp, Artificial
  CRISPR gRNA sequence
taaatcttgcctgtagatgg

SEQ ID NO: 411256 - DNA, 20 bp, Artificial
  CRISPR gRNA sequence
gcctgtagatggcttgtggg

SEQ ID NO: 411257 - DNA, 20 bp, Artificial
  CRISPR gRNA sequence
cctgtagatggcttgtggga

SEQ ID NO: 411258 - DNA, 20 bp, Artificial
  CRISPR gRNA sequence
tagatggcttgtgggaggtt

SEQ ID NO: 411259 - DNA, 20 bp, Artificial
  CRISPR gRNA sequence
gtgggaggttactgactttg

SEQ ID NO: 411260 - DNA, 20 bp, Artificial
  CRISPR gRNA sequence
tgggaggttactgactttga

SEQ ID NO: 411261 - DNA, 20 bp, Artificial
  CRISPR gRNA sequence
ctgactttgagactctgtgc

SEQ ID NO: 411262 - DNA, 20 bp, Artificial
  CRISPR gRNA sequence
actttgagactctgtgctcc

SEQ ID NO: 411263 - DNA, 20 bp, Artificial
  CRISPR gRNA sequence
tgagactctgtgctcctgag

SEQ ID NO: 411264 - DNA, 20 bp, Artificial
  CRISPR gRNA sequence
gagactctgtgctcctgagt

SEQ ID NO: 411265 - DNA, 20 bp, Artificial
  CRISPR gRNA sequence
agactctgtgctcctgagtt

SEQ ID NO: 411266 - DNA, 20 bp, Artificial
  CRISPR gRNA sequence
tgtgctcctgagttggatta

SEQ ID NO: 411267 - DNA, 20 bp, Artificial
  CRISPR gRNA sequence
tgctcctgagttggattata

SEQ ID NO: 411268 - DNA, 20 bp, Artificial
  CRISPR gRNA sequence
ctgagttggattataaaatt

SEQ ID NO: 411269 - DNA, 20 bp, Artificial
  CRISPR gRNA sequence
agttggattataaaattatt

SEQ ID NO: 411270 - DNA, 20 bp, Artificial
  CRISPR gRNA sequence
gattataaaattattgaaga

SEQ ID NO: 411271 - DNA, 20 bp, Artificial
  CRISPR gRNA sequence
taaaattattgaagaaagga

SEQ ID NO: 411272 - DNA, 20 bp, Artificial
  CRISPR gRNA sequence
ttgaagaaaggaaataaatt

SEQ ID NO: 411273 - DNA, 20 bp, Artificial
  CRISPR gRNA sequence
aagaaaggaaataaattttg

SEQ ID NO: 411274 - DNA, 20 bp, Artificial
  CRISPR gRNA sequence
tgcttatttccttggccttt

SEQ ID NO: 411275 - DNA, 20 bp, Artificial
  CRISPR gRNA sequence
gcttatttccttggcctttt

SEQ ID NO: 411276 - DNA, 20 bp, Artificial
  CRISPR gRNA sequence
cttatttccttggcctttta

SEQ ID NO: 411277 - DNA, 20 bp, Artificial
  CRISPR gRNA sequence
atttccttggccttttattt

SEQ ID NO: 411278 - DNA, 20 bp, Artificial
  CRISPR gRNA sequence
tttccttggccttttatttc

SEQ ID NO: 411279 - DNA, 20 bp, Artificial
  CRISPR gRNA sequence
ccttggccttttatttctgt

SEQ ID NO: 411280 - DNA, 20 bp, Artificial
  CRISPR gRNA sequence
cttggccttttatttctgtc

SEQ ID NO: 411281 - DNA, 20 bp, Artificial
  CRISPR gRNA sequence
ggccttttatttctgtcaaa

SEQ ID NO: 411282 - DNA, 20 bp, Artificial
  CRISPR gRNA sequence
gccttttatttctgtcaaaa

SEQ ID NO: 411283 - DNA, 20 bp, Artificial
  CRISPR gRNA sequence
ttatttctgtcaaaaaccaa

SEQ ID NO: 411284 - DNA, 20 bp, Artificial
  CRISPR gRNA sequence
tatttctgtcaaaaaccaac

SEQ ID NO: 411285 - DNA, 20 bp, Artificial
  CRISPR gRNA sequence
atttctgtcaaaaaccaacc

SEQ ID NO: 411286 - DNA, 20 bp, Artificial
  CRISPR gRNA sequence
tttctgtcaaaaaccaacca

SEQ ID NO: 411287 - DNA, 20 bp, Artificial
  CRISPR gRNA sequence
ctgtcaaaaaccaaccagtt

SEQ ID NO: 411288 - DNA, 20 bp, Artificial
  CRISPR gRNA sequence
tgtcaaaaaccaaccagttt

SEQ ID NO: 411289 - DNA, 20 bp, Artificial
  CRISPR gRNA sequence
tcaaaaaccaaccagtttgc

SEQ ID NO: 411290 - DNA, 20 bp, Artificial
  CRISPR gRNA sequence
gctcccagtccatttggatt

SEQ ID NO: 411291 - DNA, 20 bp, Artificial
  CRISPR gRNA sequence
ctcccagtccatttggattc

SEQ ID NO: 411292 - DNA, 20 bp, Artificial
  CRISPR gRNA sequence
ccagtccatttggattccag

SEQ ID NO: 411293 - DNA, 20 bp, Artificial
  CRISPR gRNA sequence
ggattccagaagagtttcag

SEQ ID NO: 411294 - DNA, 20 bp, Artificial
  CRISPR gRNA sequence
gattccagaagagtttcagg

SEQ ID NO: 411295 - DNA, 20 bp, Artificial
  CRISPR gRNA sequence
cagaagagtttcaggttgta

SEQ ID NO: 411296 - DNA, 20 bp, Artificial
  CRISPR gRNA sequence
caggttgtagacaagacagt

SEQ ID NO: 411297 - DNA, 20 bp, Artificial
  CRISPR gRNA sequence
aggttgtagacaagacagtt

SEQ ID NO: 411298 - DNA, 20 bp, Artificial
  CRISPR gRNA sequence
tagacaagacagtttttttt

SEQ ID NO: 411299 - DNA, 20 bp, Artificial
  CRISPR gRNA sequence
ttttttttttttaaggattc

SEQ ID NO: 411300 - DNA, 20 bp, Artificial
  CRISPR gRNA sequence
tttttttttttaaggattcc

SEQ ID NO: 411301 - DNA, 20 bp, Artificial
  CRISPR gRNA sequence
ttttttttttaaggattcca

SEQ ID NO: 411302 - DNA, 20 bp, Artificial
  CRISPR gRNA sequence
tttttttttaaggattccat

SEQ ID NO: 411303 - DNA, 20 bp, Artificial
  CRISPR gRNA sequence
ttttttttaaggattccatt

SEQ ID NO: 411304 - DNA, 20 bp, Artificial
  CRISPR gRNA sequence
tttttttaaggattccatta

SEQ ID NO: 411305 - DNA, 20 bp, Artificial
  CRISPR gRNA sequence
ttttttaaggattccattaa

SEQ ID NO: 411306 - DNA, 20 bp, Artificial
  CRISPR gRNA sequence
tttttaaggattccattaat

SEQ ID NO: 411307 - DNA, 20 bp, Artificial
  CRISPR gRNA sequence
ttttaaggattccattaatc

SEQ ID NO: 411308 - DNA, 20 bp, Artificial
  CRISPR gRNA sequence
tttaaggattccattaatcc

SEQ ID NO: 411309 - DNA, 20 bp, Artificial
  CRISPR gRNA sequence
ttaaggattccattaatcca

SEQ ID NO: 411310 - DNA, 20 bp, Artificial
  CRISPR gRNA sequence
taaggattccattaatccag

SEQ ID NO: 411311 - DNA, 20 bp, Artificial
  CRISPR gRNA sequence
aaggattccattaatccaga

SEQ ID NO: 411312 - DNA, 20 bp, Artificial
  CRISPR gRNA sequence
aggattccattaatccagaa

SEQ ID NO: 411313 - DNA, 20 bp, Artificial
  CRISPR gRNA sequence
cattaatccagaaccttctg

SEQ ID NO: 411314 - DNA, 20 bp, Artificial
  CRISPR gRNA sequence
atccagaaccttctgtccca

SEQ ID NO: 411315 - DNA, 20 bp, Artificial
  CRISPR gRNA sequence
ctgtcccactcctatgaatt

SEQ ID NO: 411316 - DNA, 20 bp, Artificial
  CRISPR gRNA sequence
tgtcccactcctatgaattt

SEQ ID NO: 411317 - DNA, 20 bp, Artificial
  CRISPR gRNA sequence
tcccactcctatgaatttag

SEQ ID NO: 411318 - DNA, 20 bp, Artificial
  CRISPR gRNA sequence
ctatgaatttagaatagata

SEQ ID NO: 411319 - DNA, 20 bp, Artificial
  CRISPR gRNA sequence
tgaatttagaatagatataa

SEQ ID NO: 411320 - DNA, 20 bp, Artificial
  CRISPR gRNA sequence
agaatagatataaagcttgt

SEQ ID NO: 411321 - DNA, 20 bp, Artificial
  CRISPR gRNA sequence
gaatagatataaagcttgtg

SEQ ID NO: 411322 - DNA, 20 bp, Artificial
  CRISPR gRNA sequence
gtggacatgaggattgtctg

SEQ ID NO: 411323 - DNA, 20 bp, Artificial
  CRISPR gRNA sequence
tggacatgaggattgtctga

SEQ ID NO: 411324 - DNA, 20 bp, Artificial
  CRISPR gRNA sequence
tctgaactggtgtgcactgg

SEQ ID NO: 411325 - DNA, 20 bp, Artificial
  CRISPR gRNA sequence
aactggtgtgcactgggctg

SEQ ID NO: 411326 - DNA, 20 bp, Artificial
  CRISPR gRNA sequence
gtgtgcactgggctgacaga

SEQ ID NO: 411327 - DNA, 20 bp, Artificial
  CRISPR gRNA sequence
ggctgacagatatgtccctt

SEQ ID NO: 411328 - DNA, 20 bp, Artificial
  CRISPR gRNA sequence
acagatatgtccctttccat

SEQ ID NO: 411329 - DNA, 20 bp, Artificial
  CRISPR gRNA sequence
tccatgacattgtgtggtga

SEQ ID NO: 411330 - DNA, 20 bp, Artificial
  CRISPR gRNA sequence
ccatgacattgtgtggtgaa

SEQ ID NO: 411331 - DNA, 20 bp, Artificial
  CRISPR gRNA sequence
catgacattgtgtggtgaac

SEQ ID NO: 411332 - DNA, 20 bp, Artificial
  CRISPR gRNA sequence
tgtggtgaacctcagccttt

SEQ ID NO: 411333 - DNA, 20 bp, Artificial
  CRISPR gRNA sequence
agccttttattatctttacc

SEQ ID NO: 411334 - DNA, 20 bp, Artificial
  CRISPR gRNA sequence
ttattatctttacctacatg

SEQ ID NO: 411335 - DNA, 20 bp, Artificial
  CRISPR gRNA sequence
tattatctttacctacatgg

SEQ ID NO: 411336 - DNA, 20 bp, Artificial
  CRISPR gRNA sequence
attatctttacctacatgga

SEQ ID NO: 411337 - DNA, 20 bp, Artificial
  CRISPR gRNA sequence
ttatctttacctacatggaa

SEQ ID NO: 411338 - DNA, 20 bp, Artificial
  CRISPR gRNA sequence
tctttacctacatggaaagt

SEQ ID NO: 411339 - DNA, 20 bp, Artificial
  CRISPR gRNA sequence
tacctacatggaaagtaaaa

SEQ ID NO: 411340 - DNA, 20 bp, Artificial
  CRISPR gRNA sequence
acctacatggaaagtaaaat

SEQ ID NO: 411341 - DNA, 20 bp, Artificial
  CRISPR gRNA sequence
cctacatggaaagtaaaatg

SEQ ID NO: 411342 - DNA, 20 bp, Artificial
  CRISPR gRNA sequence
catggaaagtaaaatgtcca

SEQ ID NO: 411343 - DNA, 20 bp, Artificial
  CRISPR gRNA sequence
atttatatgatggagcaaca

SEQ ID NO: 411344 - DNA, 20 bp, Artificial
  CRISPR gRNA sequence
atatgatggagcaacacgac

SEQ ID NO: 411345 - DNA, 20 bp, Artificial
  CRISPR gRNA sequence
tatgatggagcaacacgacc

SEQ ID NO: 411346 - DNA, 20 bp, Artificial
  CRISPR gRNA sequence
ctcacaagctaaaataacct

SEQ ID NO: 411347 - DNA, 20 bp, Artificial
  CRISPR gRNA sequence
acaagctaaaataacctcta

SEQ ID NO: 411348 - DNA, 20 bp, Artificial
  CRISPR gRNA sequence
aaataacctctactcaaaca

SEQ ID NO: 411349 - DNA, 20 bp, Artificial
  CRISPR gRNA sequence
tactcaaacagatcaaccac

SEQ ID NO: 411350 - DNA, 20 bp, Artificial
  CRISPR gRNA sequence
ctcaaacagatcaaccacaa

SEQ ID NO: 411351 - DNA, 20 bp, Artificial
  CRISPR gRNA sequence
aaacagatcaaccacaattt

SEQ ID NO: 411352 - DNA, 20 bp, Artificial
  CRISPR gRNA sequence
tcagcccaatttagttttct

SEQ ID NO: 411353 - DNA, 20 bp, Artificial
  CRISPR gRNA sequence
cagcccaatttagttttctc

SEQ ID NO: 411354 - DNA, 20 bp, Artificial
  CRISPR gRNA sequence
agcccaatttagttttctcg

SEQ ID NO: 411355 - DNA, 20 bp, Artificial
  CRISPR gRNA sequence
agttttctcggtgaaactgg

SEQ ID NO: 411356 - DNA, 20 bp, Artificial
  CRISPR gRNA sequence
gttttctcggtgaaactggg

SEQ ID NO: 411357 - DNA, 20 bp, Artificial
  CRISPR gRNA sequence
tctcggtgaaactgggtatc

SEQ ID NO: 411358 - DNA, 20 bp, Artificial
  CRISPR gRNA sequence
ctcggtgaaactgggtatcc

SEQ ID NO: 411359 - DNA, 20 bp, Artificial
  CRISPR gRNA sequence
tcggtgaaactgggtatcca

SEQ ID NO: 411360 - DNA, 20 bp, Artificial
  CRISPR gRNA sequence
ggtgaaactgggtatccaga

SEQ ID NO: 411361 - DNA, 20 bp, Artificial
  CRISPR gRNA sequence
ggtatccagatgaaacatag

SEQ ID NO: 411362 - DNA, 20 bp, Artificial
  CRISPR gRNA sequence
ccagcatcacaagtgagttg

SEQ ID NO: 411363 - DNA, 20 bp, Artificial
  CRISPR gRNA sequence
cagcatcacaagtgagttga

SEQ ID NO: 411364 - DNA, 20 bp, Artificial
  CRISPR gRNA sequence
attactcaatcatggctatt

SEQ ID NO: 411365 - DNA, 20 bp, Artificial
  CRISPR gRNA sequence
ctcaatcatggctattatgt

SEQ ID NO: 411366 - DNA, 20 bp, Artificial
  CRISPR gRNA sequence
aatcatggctattatgtggt

SEQ ID NO: 411367 - DNA, 20 bp, Artificial
  CRISPR gRNA sequence
ttatgtggttgaatctttac

SEQ ID NO: 411368 - DNA, 20 bp, Artificial
  CRISPR gRNA sequence
tgtggttgaatctttacttt

SEQ ID NO: 411369 - DNA, 20 bp, Artificial
  CRISPR gRNA sequence
aatctttactttactgttgc

SEQ ID NO: 411370 - DNA, 20 bp, Artificial
  CRISPR gRNA sequence
tactttactgttgcctctgc

SEQ ID NO: 411371 - DNA, 20 bp, Artificial
  CRISPR gRNA sequence
actttactgttgcctctgcc

SEQ ID NO: 411372 - DNA, 20 bp, Artificial
  CRISPR gRNA sequence
ctttactgttgcctctgccc

SEQ ID NO: 411373 - DNA, 20 bp, Artificial
  CRISPR gRNA sequence
tactgttgcctctgcccaga

SEQ ID NO: 411374 - DNA, 20 bp, Artificial
  CRISPR gRNA sequence
actgttgcctctgcccagat

SEQ ID NO: 411375 - DNA, 20 bp, Artificial
  CRISPR gRNA sequence
ctgttgcctctgcccagatc

SEQ ID NO: 411376 - DNA, 20 bp, Artificial
  CRISPR gRNA sequence
ttgcctctgcccagatcatt

SEQ ID NO: 411377 - DNA, 20 bp, Artificial
  CRISPR gRNA sequence
cctctgcccagatcattttt

SEQ ID NO: 411378 - DNA, 20 bp, Artificial
  CRISPR gRNA sequence
tgcccagatcatttttttta

SEQ ID NO: 411379 - DNA, 20 bp, Artificial
  CRISPR gRNA sequence
cccagatcattttttttaat

SEQ ID NO: 411380 - DNA, 20 bp, Artificial
  CRISPR gRNA sequence
tttttaatgatctattgcat

SEQ ID NO: 411381 - DNA, 20 bp, Artificial
  CRISPR gRNA sequence
ttttaatgatctattgcatt

SEQ ID NO: 411382 - DNA, 20 bp, Artificial
  CRISPR gRNA sequence
tttaatgatctattgcattc

SEQ ID NO: 411383 - DNA, 20 bp, Artificial
  CRISPR gRNA sequence
ttaatgatctattgcattca

SEQ ID NO: 411384 - DNA, 20 bp, Artificial
  CRISPR gRNA sequence
taatgatctattgcattcaa

SEQ ID NO: 411385 - DNA, 20 bp, Artificial
  CRISPR gRNA sequence
aatgatctattgcattcaaa

SEQ ID NO: 411386 - DNA, 20 bp, Artificial
  CRISPR gRNA sequence
atgatctattgcattcaaaa

SEQ ID NO: 411387 - DNA, 20 bp, Artificial
  CRISPR gRNA sequence
ttgcattcaaaaaaatgcaa

SEQ ID NO: 411388 - DNA, 20 bp, Artificial
  CRISPR gRNA sequence
cattcaaaaaaatgcaaccg

SEQ ID NO: 411389 - DNA, 20 bp, Artificial
  CRISPR gRNA sequence
aaaaaaatgcaaccggtcag

SEQ ID NO: 411390 - DNA, 20 bp, Artificial
  CRISPR gRNA sequence
atttgttttgtaagccctag

SEQ ID NO: 411391 - DNA, 20 bp, Artificial
  CRISPR gRNA sequence
gttttgtaagccctagtatt

SEQ ID NO: 411392 - DNA, 20 bp, Artificial
  CRISPR gRNA sequence
ttttgtaagccctagtattg

SEQ ID NO: 411393 - DNA, 20 bp, Artificial
  CRISPR gRNA sequence
tgtaagccctagtattgatc

SEQ ID NO: 411394 - DNA, 20 bp, Artificial
  CRISPR gRNA sequence
gtaagccctagtattgatct

SEQ ID NO: 411395 - DNA, 20 bp, Artificial
  CRISPR gRNA sequence
taagccctagtattgatcta

SEQ ID NO: 411396 - DNA, 20 bp, Artificial
  CRISPR gRNA sequence
gtattgatctattcattttt

SEQ ID NO: 411397 - DNA, 20 bp, Artificial
  CRISPR gRNA sequence
atctattcattttttgaaca

SEQ ID NO: 411398 - DNA, 20 bp, Artificial
  CRISPR gRNA sequence
ttcattttttgaacacacaa

SEQ ID NO: 411399 - DNA, 20 bp, Artificial
  CRISPR gRNA sequence
attttttgaacacacaaaaa

SEQ ID NO: 411400 - DNA, 20 bp, Artificial
  CRISPR gRNA sequence
tttgaacacacaaaaaccta

SEQ ID NO: 411401 - DNA, 20 bp, Artificial
  CRISPR gRNA sequence
ttgaacacacaaaaacctag

SEQ ID NO: 411402 - DNA, 20 bp, Artificial
  CRISPR gRNA sequence
tgaacacacaaaaacctaga

SEQ ID NO: 411403 - DNA, 20 bp, Artificial
  CRISPR gRNA sequence
gaacacacaaaaacctagaa

SEQ ID NO: 411404 - DNA, 20 bp, Artificial
  CRISPR gRNA sequence
aacacacaaaaacctagaat

SEQ ID NO: 411405 - DNA, 20 bp, Artificial
  CRISPR gRNA sequence
gaatgtttgcctgcagtcat

SEQ ID NO: 411406 - DNA, 20 bp, Artificial
  CRISPR gRNA sequence
gcctgcagtcattttttata

SEQ ID NO: 411407 - DNA, 20 bp, Artificial
  CRISPR gRNA sequence
cctgcagtcattttttatac

SEQ ID NO: 411408 - DNA, 20 bp, Artificial
  CRISPR gRNA sequence
cagtcattttttatacatac

SEQ ID NO: 411409 - DNA, 20 bp, Artificial
  CRISPR gRNA sequence
tttatacatactattattgt

SEQ ID NO: 411410 - DNA, 20 bp, Artificial
  CRISPR gRNA sequence
ttatacatactattattgta

SEQ ID NO: 411411 - DNA, 20 bp, Artificial
  CRISPR gRNA sequence
tatacatactattattgtat

SEQ ID NO: 411412 - DNA, 20 bp, Artificial
  CRISPR gRNA sequence
atacatactattattgtata

SEQ ID NO: 411413 - DNA, 20 bp, Artificial
  CRISPR gRNA sequence
tacatactattattgtatag

SEQ ID NO: 411414 - DNA, 20 bp, Artificial
  CRISPR gRNA sequence
ttattgtatagataagtaag

SEQ ID NO: 411415 - DNA, 20 bp, Artificial
  CRISPR gRNA sequence
ttgtatagataagtaagata

SEQ ID NO: 411416 - DNA, 20 bp, Artificial
  CRISPR gRNA sequence
tatagataagtaagatattg

SEQ ID NO: 411417 - DNA, 20 bp, Artificial
  CRISPR gRNA sequence
aataatagtgataagttatt

SEQ ID NO: 411418 - DNA, 20 bp, Artificial
  CRISPR gRNA sequence
ttgtcagagggaatgaaact

SEQ ID NO: 411419 - DNA, 20 bp, Artificial
  CRISPR gRNA sequence
tcagagggaatgaaactcta

SEQ ID NO: 411420 - DNA, 20 bp, Artificial
  CRISPR gRNA sequence
taaaaggttacatgctgaat

SEQ ID NO: 411421 - DNA, 20 bp, Artificial
  CRISPR gRNA sequence
aaaggttacatgctgaattt

SEQ ID NO: 411422 - DNA, 20 bp, Artificial
  CRISPR gRNA sequence
catgctgaatttatctgatg

SEQ ID NO: 411423 - DNA, 20 bp, Artificial
  CRISPR gRNA sequence
aatttatctgatgacactat

SEQ ID NO: 411424 - DNA, 20 bp, Artificial
  CRISPR gRNA sequence
atctgatgacactattatat

SEQ ID NO: 411425 - DNA, 20 bp, Artificial
  CRISPR gRNA sequence
tctgatgacactattatatt

SEQ ID NO: 411426 - DNA, 20 bp, Artificial
  CRISPR gRNA sequence
atgacactattatattgaag

SEQ ID NO: 411427 - DNA, 20 bp, Artificial
  CRISPR gRNA sequence
ttatattgaagaacattgtt

SEQ ID NO: 411428 - DNA, 20 bp, Artificial
  CRISPR gRNA sequence
tattgaagaacattgttgac

SEQ ID NO: 411429 - DNA, 20 bp, Artificial
  CRISPR gRNA sequence
aagaacattgttgactgtac

SEQ ID NO: 411430 - DNA, 20 bp, Artificial
  CRISPR gRNA sequence
ttgactgtacattgctacct

SEQ ID NO: 411431 - DNA, 20 bp, Artificial
  CRISPR gRNA sequence
actgtacattgctacctcat

SEQ ID NO: 411432 - DNA, 20 bp, Artificial
  CRISPR gRNA sequence
tacattgctacctcatgtac

SEQ ID NO: 411433 - DNA, 20 bp, Artificial
  CRISPR gRNA sequence
ctacctcatgtacataaagc

SEQ ID NO: 411434 - DNA, 20 bp, Artificial
  CRISPR gRNA sequence
cctcatgtacataaagcaag

SEQ ID NO: 411435 - DNA, 20 bp, Artificial
  CRISPR gRNA sequence
atgtacataaagcaagttct

SEQ ID NO: 411436 - DNA, 20 bp, Artificial
  CRISPR gRNA sequence
taacagaacaccactataaa

SEQ ID NO: 411437 - DNA, 20 bp, Artificial
  CRISPR gRNA sequence
acagaacaccactataaaca

SEQ ID NO: 411438 - DNA, 20 bp, Artificial
  CRISPR gRNA sequence
taaacaatgcaagtttgtag

SEQ ID NO: 411439 - DNA, 20 bp, Artificial
  CRISPR gRNA sequence
gtagaattagaaagcagttg

SEQ ID NO: 411440 - DNA, 20 bp, Artificial
  CRISPR gRNA sequence
tagaattagaaagcagttga

SEQ ID NO: 411441 - DNA, 20 bp, Artificial
  CRISPR gRNA sequence
gaaagcagttgatcctagga

SEQ ID NO: 411442 - DNA, 20 bp, Artificial
  CRISPR gRNA sequence
atcctaggaactgctgttct

SEQ ID NO: 411443 - DNA, 20 bp, Artificial
  CRISPR gRNA sequence
ggaactgctgttctacaggt

SEQ ID NO: 411444 - DNA, 20 bp, Artificial
  CRISPR gRNA sequence
ctgttctacaggtggacctt

SEQ ID NO: 411445 - DNA, 20 bp, Artificial
  CRISPR gRNA sequence
ttctacaggtggacctttat

SEQ ID NO: 411446 - DNA, 20 bp, Artificial
  CRISPR gRNA sequence
tacaggtggacctttatctt

SEQ ID NO: 411447 - DNA, 20 bp, Artificial
  CRISPR gRNA sequence
caggtggacctttatcttct

SEQ ID NO: 411448 - DNA, 20 bp, Artificial
  CRISPR gRNA sequence
tatcttctgattgaattttc

SEQ ID NO: 411449 - DNA, 20 bp, Artificial
  CRISPR gRNA sequence
atcttctgattgaattttca

SEQ ID NO: 411450 - DNA, 20 bp, Artificial
  CRISPR gRNA sequence
tcttctgattgaattttcaa

SEQ ID NO: 411451 - DNA, 20 bp, Artificial
  CRISPR gRNA sequence
ctgattgaattttcaactct

SEQ ID NO: 411452 - DNA, 20 bp, Artificial
  CRISPR gRNA sequence
tgattgaattttcaactctt

SEQ ID NO: 411453 - DNA, 20 bp, Artificial
  CRISPR gRNA sequence
attgaattttcaactctttt

SEQ ID NO: 411454 - DNA, 20 bp, Artificial
  CRISPR gRNA sequence
aattttcaactcttttcata

SEQ ID NO: 411455 - DNA, 20 bp, Artificial
  CRISPR gRNA sequence
tcaactcttttcataaagtt

SEQ ID NO: 411456 - DNA, 20 bp, Artificial
  CRISPR gRNA sequence
caactcttttcataaagttt

SEQ ID NO: 411457 - DNA, 20 bp, Artificial
  CRISPR gRNA sequence
aactcttttcataaagtttt

SEQ ID NO: 411458 - DNA, 20 bp, Artificial
  CRISPR gRNA sequence
ttttcataaagtttttctct

SEQ ID NO: 411459 - DNA, 20 bp, Artificial
  CRISPR gRNA sequence
ttcataaagtttttctctcc

SEQ ID NO: 411460 - DNA, 20 bp, Artificial
  CRISPR gRNA sequence
tcataaagtttttctctccc

SEQ ID NO: 411461 - DNA, 20 bp, Artificial
  CRISPR gRNA sequence
cataaagtttttctctccct

SEQ ID NO: 411462 - DNA, 20 bp, Artificial
  CRISPR gRNA sequence
ataaagtttttctctccctg

SEQ ID NO: 411463 - DNA, 20 bp, Artificial
  CRISPR gRNA sequence
ttctctccctgggaacttag

SEQ ID NO: 411464 - DNA, 20 bp, Artificial
  CRISPR gRNA sequence
tctctccctgggaacttaga

SEQ ID NO: 411465 - DNA, 20 bp, Artificial
  CRISPR gRNA sequence
ctctccctgggaacttagac

SEQ ID NO: 411466 - DNA, 20 bp, Artificial
  CRISPR gRNA sequence
tctccctgggaacttagact

SEQ ID NO: 411467 - DNA, 20 bp, Artificial
  CRISPR gRNA sequence
tccctgggaacttagactac

SEQ ID NO: 411468 - DNA, 20 bp, Artificial
  CRISPR gRNA sequence
cctgggaacttagactacaa

SEQ ID NO: 411469 - DNA, 20 bp, Artificial
  CRISPR gRNA sequence
ggaacttagactacaagtca

SEQ ID NO: 411470 - DNA, 20 bp, Artificial
  CRISPR gRNA sequence
agactacaagtcaggattca

SEQ ID NO: 411471 - DNA, 20 bp, Artificial
  CRISPR gRNA sequence
gactacaagtcaggattcac

SEQ ID NO: 411472 - DNA, 20 bp, Artificial
  CRISPR gRNA sequence
caagtcaggattcacattca

SEQ ID NO: 411473 - DNA, 20 bp, Artificial
  CRISPR gRNA sequence
acattcagacaaatgtactg

SEQ ID NO: 411474 - DNA, 20 bp, Artificial
  CRISPR gRNA sequence
agacaaatgtactgattttc

SEQ ID NO: 411475 - DNA, 20 bp, Artificial
  CRISPR gRNA sequence
attttcttcctacttaaaat

SEQ ID NO: 411476 - DNA, 20 bp, Artificial
  CRISPR gRNA sequence
tcttcctacttaaaattcac

SEQ ID NO: 411477 - DNA, 20 bp, Artificial
  CRISPR gRNA sequence
cttcctacttaaaattcaca

SEQ ID NO: 411478 - DNA, 20 bp, Artificial
  CRISPR gRNA sequence
ttcctacttaaaattcacac

SEQ ID NO: 411479 - DNA, 20 bp, Artificial
  CRISPR gRNA sequence
cctacttaaaattcacacat

SEQ ID NO: 411480 - DNA, 20 bp, Artificial
  CRISPR gRNA sequence
ctacttaaaattcacacatg

SEQ ID NO: 411481 - DNA, 20 bp, Artificial
  CRISPR gRNA sequence
cttaaaattcacacatggtg

SEQ ID NO: 411482 - DNA, 20 bp, Artificial
  CRISPR gRNA sequence
aaaattcacacatggtgctt

SEQ ID NO: 411483 - DNA, 20 bp, Artificial
  CRISPR gRNA sequence
aaattcacacatggtgcttt

SEQ ID NO: 411484 - DNA, 20 bp, Artificial
  CRISPR gRNA sequence
acacatggtgctttgggagg

SEQ ID NO: 411485 - DNA, 20 bp, Artificial
  CRISPR gRNA sequence
tgggaggctgaggcggtagg

SEQ ID NO: 411486 - DNA, 20 bp, Artificial
  CRISPR gRNA sequence
gggaggctgaggcggtagga

SEQ ID NO: 411487 - DNA, 20 bp, Artificial
  CRISPR gRNA sequence
ggaggctgaggcggtaggag

SEQ ID NO: 411488 - DNA, 20 bp, Artificial
  CRISPR gRNA sequence
aggcggtaggagtccttgag

SEQ ID NO: 411489 - DNA, 20 bp, Artificial
  CRISPR gRNA sequence
gagcccaagaattagtggct

SEQ ID NO: 411490 - DNA, 20 bp, Artificial
  CRISPR gRNA sequence
agcccaagaattagtggctg

SEQ ID NO: 411491 - DNA, 20 bp, Artificial
  CRISPR gRNA sequence
gtggctgcagtgagctatga

SEQ ID NO: 411492 - DNA, 20 bp, Artificial
  CRISPR gRNA sequence
cagtgagctatgactgcacc

SEQ ID NO: 411493 - DNA, 20 bp, Artificial
  CRISPR gRNA sequence
tgactgcaccattgcactgc

SEQ ID NO: 411494 - DNA, 20 bp, Artificial
  CRISPR gRNA sequence
caccattgcactgcagcctg

SEQ ID NO: 411495 - DNA, 20 bp, Artificial
  CRISPR gRNA sequence
cactgcagcctgggcaacag

SEQ ID NO: 411496 - DNA, 20 bp, Artificial
  CRISPR gRNA sequence
cagcctgggcaacagagcca

SEQ ID NO: 411497 - DNA, 20 bp, Artificial
  CRISPR gRNA sequence
ggcaacagagccagaacctg

SEQ ID NO: 411498 - DNA, 20 bp, Artificial
  CRISPR gRNA sequence
tctccaaaaaaaaaaaaaaa

SEQ ID NO: 411499 - DNA, 20 bp, Artificial
  CRISPR gRNA sequence
caaaaaaaaaaaaaaaaaaa

SEQ ID NO: 411500 - DNA, 20 bp, Artificial
  CRISPR gRNA sequence
catttatttgagacctttca

SEQ ID NO: 411501 - DNA, 20 bp, Artificial
  CRISPR gRNA sequence
atttgagacctttcaaatga

SEQ ID NO: 411502 - DNA, 20 bp, Artificial
  CRISPR gRNA sequence
tttgagacctttcaaatgac

SEQ ID NO: 411503 - DNA, 20 bp, Artificial
  CRISPR gRNA sequence
gagacctttcaaatgactct

SEQ ID NO: 411504 - DNA, 20 bp, Artificial
  CRISPR gRNA sequence
agacctttcaaatgactctg

SEQ ID NO: 411505 - DNA, 20 bp, Artificial
  CRISPR gRNA sequence
tcaaatgactctgactgtga

SEQ ID NO: 411506 - DNA, 20 bp, Artificial
  CRISPR gRNA sequence
caaatgactctgactgtgaa

SEQ ID NO: 411507 - DNA, 20 bp, Artificial
  CRISPR gRNA sequence
aaatgactctgactgtgaaa

SEQ ID NO: 411508 - DNA, 20 bp, Artificial
  CRISPR gRNA sequence
tgactgtgaaataaccattt

SEQ ID NO: 411509 - DNA, 20 bp, Artificial
  CRISPR gRNA sequence
actgtgaaataaccatttat

SEQ ID NO: 411510 - DNA, 20 bp, Artificial
  CRISPR gRNA sequence
tgaaataaccatttatactt

SEQ ID NO: 411511 - DNA, 20 bp, Artificial
  CRISPR gRNA sequence
atactttattgtcgtatatg

SEQ ID NO: 411512 - DNA, 20 bp, Artificial
  CRISPR gRNA sequence
tactttattgtcgtatatgg

SEQ ID NO: 411513 - DNA, 20 bp, Artificial
  CRISPR gRNA sequence
tattgtcgtatatggaattt

SEQ ID NO: 411514 - DNA, 20 bp, Artificial
  CRISPR gRNA sequence
attgtcgtatatggaattta

SEQ ID NO: 411515 - DNA, 20 bp, Artificial
  CRISPR gRNA sequence
ttgtcgtatatggaatttac

SEQ ID NO: 411516 - DNA, 20 bp, Artificial
  CRISPR gRNA sequence
tcgtatatggaatttacatt

SEQ ID NO: 411517 - DNA, 20 bp, Artificial
  CRISPR gRNA sequence
acattctaaaagcacctggg

SEQ ID NO: 411518 - DNA, 20 bp, Artificial
  CRISPR gRNA sequence
cattctaaaagcacctggga

SEQ ID NO: 411519 - DNA, 20 bp, Artificial
  CRISPR gRNA sequence
taaaagcacctgggaattgt

SEQ ID NO: 411520 - DNA, 20 bp, Artificial
  CRISPR gRNA sequence
aaagcacctgggaattgtta

SEQ ID NO: 411521 - DNA, 20 bp, Artificial
  CRISPR gRNA sequence
ggaattgttaacagcttgag

SEQ ID NO: 411522 - DNA, 20 bp, Artificial
  CRISPR gRNA sequence
ttaacagcttgaggttgtct

SEQ ID NO: 411523 - DNA, 20 bp, Artificial
  CRISPR gRNA sequence
acagcttgaggttgtctctt

SEQ ID NO: 411524 - DNA, 20 bp, Artificial
  CRISPR gRNA sequence
gaggttgtctcttagagcct

SEQ ID NO: 411525 - DNA, 20 bp, Artificial
  CRISPR gRNA sequence
aggttgtctcttagagcctt

SEQ ID NO: 411526 - DNA, 20 bp, Artificial
  CRISPR gRNA sequence
tctcttagagccttattaaa

SEQ ID NO: 411527 - DNA, 20 bp, Artificial
  CRISPR gRNA sequence
ttagagccttattaaaaact

SEQ ID NO: 411528 - DNA, 20 bp, Artificial
  CRISPR gRNA sequence
agagccttattaaaaactga

SEQ ID NO: 411529 - DNA, 20 bp, Artificial
  CRISPR gRNA sequence
gagccttattaaaaactgaa

SEQ ID NO: 411530 - DNA, 20 bp, Artificial
  CRISPR gRNA sequence
attaaaaactgaacataaat

SEQ ID NO: 411531 - DNA, 20 bp, Artificial
  CRISPR gRNA sequence
ttaaaaactgaacataaatg

SEQ ID NO: 411532 - DNA, 20 bp, Artificial
  CRISPR gRNA sequence
aaaactgaacataaatgatt

SEQ ID NO: 411533 - DNA, 20 bp, Artificial
  CRISPR gRNA sequence
aacataaatgattgatcaaa

SEQ ID NO: 411534 - DNA, 20 bp, Artificial
  CRISPR gRNA sequence
atcaaagatttctccaaaag

SEQ ID NO: 411535 - DNA, 20 bp, Artificial
  CRISPR gRNA sequence
ctccaaaagcaagtagaaaa

SEQ ID NO: 411536 - DNA, 20 bp, Artificial
  CRISPR gRNA sequence
tccaaaagcaagtagaaaat

SEQ ID NO: 411537 - DNA, 20 bp, Artificial
  CRISPR gRNA sequence
caaaagcaagtagaaaatta

SEQ ID NO: 411538 - DNA, 20 bp, Artificial
  CRISPR gRNA sequence
cttaaaatgtaaaataagtt

SEQ ID NO: 411539 - DNA, 20 bp, Artificial
  CRISPR gRNA sequence
aaaatgtaaaataagttatt

SEQ ID NO: 411540 - DNA, 20 bp, Artificial
  CRISPR gRNA sequence
aaatgtaaaataagttattc

SEQ ID NO: 411541 - DNA, 20 bp, Artificial
  CRISPR gRNA sequence
ttcttataagattaatagca

SEQ ID NO: 411542 - DNA, 20 bp, Artificial
  CRISPR gRNA sequence
ttataagattaatagcattt

SEQ ID NO: 411543 - DNA, 20 bp, Artificial
  CRISPR gRNA sequence
ataagattaatagcatttca

SEQ ID NO: 411544 - DNA, 20 bp, Artificial
  CRISPR gRNA sequence
taagattaatagcatttcat

SEQ ID NO: 411545 - DNA, 20 bp, Artificial
  CRISPR gRNA sequence
atagcatttcattcttaata

SEQ ID NO: 411546 - DNA, 20 bp, Artificial
  CRISPR gRNA sequence
cattcttaatagaaattcta

SEQ ID NO: 411547 - DNA, 20 bp, Artificial
  CRISPR gRNA sequence
attcttaatagaaattctaa

SEQ ID NO: 411548 - DNA, 20 bp, Artificial
  CRISPR gRNA sequence
ttaatagaaattctaattta

SEQ ID NO: 411549 - DNA, 20 bp, Artificial
  CRISPR gRNA sequence
aatagaaattctaatttaag

SEQ ID NO: 411550 - DNA, 20 bp, Artificial
  CRISPR gRNA sequence
atagaaattctaatttaagt

SEQ ID NO: 411551 - DNA, 20 bp, Artificial
  CRISPR gRNA sequence
taatttaagtattacaactc

SEQ ID NO: 411552 - DNA, 20 bp, Artificial
  CRISPR gRNA sequence
atttaagtattacaactcaa

SEQ ID NO: 411553 - DNA, 20 bp, Artificial
  CRISPR gRNA sequence
aagtattacaactcaatcag

SEQ ID NO: 411554 - DNA, 20 bp, Artificial
  CRISPR gRNA sequence
agtattacaactcaatcagt

SEQ ID NO: 411555 - DNA, 20 bp, Artificial
  CRISPR gRNA sequence
caactcaatcagtcgattac

SEQ ID NO: 411556 - DNA, 20 bp, Artificial
  CRISPR gRNA sequence
aatcagtcgattactttgaa

SEQ ID NO: 411557 - DNA, 20 bp, Artificial
  CRISPR gRNA sequence
ctttgaacttcatctgaagt

SEQ ID NO: 411558 - DNA, 20 bp, Artificial
  CRISPR gRNA sequence
tgaacttcatctgaagtatt

SEQ ID NO: 411559 - DNA, 20 bp, Artificial
  CRISPR gRNA sequence
gaacttcatctgaagtattt

SEQ ID NO: 411560 - DNA, 20 bp, Artificial
  CRISPR gRNA sequence
aacttcatctgaagtatttc

SEQ ID NO: 411561 - DNA, 20 bp, Artificial
  CRISPR gRNA sequence
catctgaagtatttcaaaca

SEQ ID NO: 411562 - DNA, 20 bp, Artificial
  CRISPR gRNA sequence
atctgaagtatttcaaacat

SEQ ID NO: 411563 - DNA, 20 bp, Artificial
  CRISPR gRNA sequence
aagtatttcaaacattattg

SEQ ID NO: 411564 - DNA, 20 bp, Artificial
  CRISPR gRNA sequence
caaacattattgacatggat

SEQ ID NO: 411565 - DNA, 20 bp, Artificial
  CRISPR gRNA sequence
aaacattattgacatggatc

SEQ ID NO: 411566 - DNA, 20 bp, Artificial
  CRISPR gRNA sequence
ttgacatggatcctgataaa

SEQ ID NO: 411567 - DNA, 20 bp, Artificial
  CRISPR gRNA sequence
acatggatcctgataaatat

SEQ ID NO: 411568 - DNA, 20 bp, Artificial
  CRISPR gRNA sequence
ataaatattcaaaggcgatg

SEQ ID NO: 411569 - DNA, 20 bp, Artificial
  CRISPR gRNA sequence
aaaggcgatgtactaggttt

SEQ ID NO: 411570 - DNA, 20 bp, Artificial
  CRISPR gRNA sequence
ggtttctggaggactatgtt

SEQ ID NO: 411571 - DNA, 20 bp, Artificial
  CRISPR gRNA sequence
ctggaggactatgttgttta

SEQ ID NO: 411572 - DNA, 20 bp, Artificial
  CRISPR gRNA sequence
tggaggactatgttgtttaa

SEQ ID NO: 411573 - DNA, 20 bp, Artificial
  CRISPR gRNA sequence
gaggactatgttgtttaaga

SEQ ID NO: 411574 - DNA, 20 bp, Artificial
  CRISPR gRNA sequence
tgttgtttaagaggacggaa

SEQ ID NO: 411575 - DNA, 20 bp, Artificial
  CRISPR gRNA sequence
tttaagaggacggaaaatga

SEQ ID NO: 411576 - DNA, 20 bp, Artificial
  CRISPR gRNA sequence
aagaggacggaaaatgaaga

SEQ ID NO: 411577 - DNA, 20 bp, Artificial
  CRISPR gRNA sequence
agaggacggaaaatgaagaa

SEQ ID NO: 411578 - DNA, 20 bp, Artificial
  CRISPR gRNA sequence
tcataagtagaagtatatct

SEQ ID NO: 411579 - DNA, 20 bp, Artificial
  CRISPR gRNA sequence
tgaaccccaatttctatctt

SEQ ID NO: 411580 - DNA, 20 bp, Artificial
  CRISPR gRNA sequence
gaaccccaatttctatcttt

SEQ ID NO: 411581 - DNA, 20 bp, Artificial
  CRISPR gRNA sequence
aaccccaatttctatcttta

SEQ ID NO: 411582 - DNA, 20 bp, Artificial
  CRISPR gRNA sequence
ctatctttaagctattattt

SEQ ID NO: 411583 - DNA, 20 bp, Artificial
  CRISPR gRNA sequence
tatctttaagctattattta

SEQ ID NO: 411584 - DNA, 20 bp, Artificial
  CRISPR gRNA sequence
tctttaagctattatttata

SEQ ID NO: 411585 - DNA, 20 bp, Artificial
  CRISPR gRNA sequence
taagctattatttatactaa

SEQ ID NO: 411586 - DNA, 20 bp, Artificial
  CRISPR gRNA sequence
aagctattatttatactaaa

SEQ ID NO: 411587 - DNA, 20 bp, Artificial
  CRISPR gRNA sequence
agctattatttatactaaaa

SEQ ID NO: 411588 - DNA, 20 bp, Artificial
  CRISPR gRNA sequence
ttatttatactaaaatgatt

SEQ ID NO: 411589 - DNA, 20 bp, Artificial
  CRISPR gRNA sequence
tttatactaaaatgattcag

SEQ ID NO: 411590 - DNA, 20 bp, Artificial
  CRISPR gRNA sequence
atactaaaatgattcaggga

SEQ ID NO: 411591 - DNA, 20 bp, Artificial
  CRISPR gRNA sequence
tactaaaatgattcagggat

SEQ ID NO: 411592 - DNA, 20 bp, Artificial
  CRISPR gRNA sequence
aaatgattcagggattttaa

SEQ ID NO: 411593 - DNA, 20 bp, Artificial
  CRISPR gRNA sequence
agggattttaaaaatacatt

SEQ ID NO: 411594 - DNA, 20 bp, Artificial
  CRISPR gRNA sequence
taaaaatacatttattcaac

SEQ ID NO: 411595 - DNA, 20 bp, Artificial
  CRISPR gRNA sequence
aaaaatacatttattcaaca

SEQ ID NO: 411596 - DNA, 20 bp, Artificial
  CRISPR gRNA sequence
aaaatacatttattcaacag

SEQ ID NO: 411597 - DNA, 20 bp, Artificial
  CRISPR gRNA sequence
attcaacaggaatataagtt

SEQ ID NO: 411598 - DNA, 20 bp, Artificial
  CRISPR gRNA sequence
ttcaacaggaatataagttt

SEQ ID NO: 411599 - DNA, 20 bp, Artificial
  CRISPR gRNA sequence
aacaggaatataagtttttt

SEQ ID NO: 411600 - DNA, 20 bp, Artificial
  CRISPR gRNA sequence
ttttggtgcaacttttataa

SEQ ID NO: 411601 - DNA, 20 bp, Artificial
  CRISPR gRNA sequence
tttggtgcaacttttataaa

SEQ ID NO: 411602 - DNA, 20 bp, Artificial
  CRISPR gRNA sequence
ttggtgcaacttttataaaa

SEQ ID NO: 411603 - DNA, 20 bp, Artificial
  CRISPR gRNA sequence
tggtgcaacttttataaaat

SEQ ID NO: 411604 - DNA, 20 bp, Artificial
  CRISPR gRNA sequence
ggtgcaacttttataaaata

SEQ ID NO: 411605 - DNA, 20 bp, Artificial
  CRISPR gRNA sequence
gtgcaacttttataaaataa

SEQ ID NO: 411606 - DNA, 20 bp, Artificial
  CRISPR gRNA sequence
ttataaaataaatattttgc

SEQ ID NO: 411607 - DNA, 20 bp, Artificial
  CRISPR gRNA sequence
tataaaataaatattttgca

SEQ ID NO: 411608 - DNA, 20 bp, Artificial
  CRISPR gRNA sequence
ataaaataaatattttgcaa

SEQ ID NO: 411609 - DNA, 20 bp, Artificial
  CRISPR gRNA sequence
taaaataaatattttgcaat

SEQ ID NO: 411610 - DNA, 20 bp, Artificial
  CRISPR gRNA sequence
tgcaatcttcattgagcact

SEQ ID NO: 411611 - DNA, 20 bp, Artificial
  CRISPR gRNA sequence
gcaatcttcattgagcactc

SEQ ID NO: 411612 - DNA, 20 bp, Artificial
  CRISPR gRNA sequence
caatcttcattgagcactct

SEQ ID NO: 411613 - DNA, 20 bp, Artificial
  CRISPR gRNA sequence
cattgagcactctaaaattc

SEQ ID NO: 411614 - DNA, 20 bp, Artificial
  CRISPR gRNA sequence
attgagcactctaaaattca

SEQ ID NO: 411615 - DNA, 20 bp, Artificial
  CRISPR gRNA sequence
agcactctaaaattcatttc

SEQ ID NO: 411616 - DNA, 20 bp, Artificial
  CRISPR gRNA sequence
taaaattcatttccaggatt

SEQ ID NO: 411617 - DNA, 20 bp, Artificial
  CRISPR gRNA sequence
aaattcatttccaggattaa

SEQ ID NO: 411618 - DNA, 20 bp, Artificial
  CRISPR gRNA sequence
atttccaggattaattcaat

SEQ ID NO: 411619 - DNA, 20 bp, Artificial
  CRISPR gRNA sequence
ccaggattaattcaatgttt

SEQ ID NO: 411620 - DNA, 20 bp, Artificial
  CRISPR gRNA sequence
caggattaattcaatgtttt

SEQ ID NO: 411621 - DNA, 20 bp, Artificial
  CRISPR gRNA sequence
attcaatgtttttaactttg

SEQ ID NO: 411622 - DNA, 20 bp, Artificial
  CRISPR gRNA sequence
aatgtttttaactttggtag

SEQ ID NO: 411623 - DNA, 20 bp, Artificial
  CRISPR gRNA sequence
ttaactttggtagaactcaa

SEQ ID NO: 411624 - DNA, 20 bp, Artificial
  CRISPR gRNA sequence
taactttggtagaactcaaa

SEQ ID NO: 411625 - DNA, 20 bp, Artificial
  CRISPR gRNA sequence
aactttggtagaactcaaag

SEQ ID NO: 411626 - DNA, 20 bp, Artificial
  CRISPR gRNA sequence
actttggtagaactcaaagg

SEQ ID NO: 411627 - DNA, 20 bp, Artificial
  CRISPR gRNA sequence
tggtagaactcaaaggtagg

SEQ ID NO: 411628 - DNA, 20 bp, Artificial
  CRISPR gRNA sequence
ggtagaactcaaaggtaggc

SEQ ID NO: 411629 - DNA, 20 bp, Artificial
  CRISPR gRNA sequence
gtagaactcaaaggtaggcc

SEQ ID NO: 411630 - DNA, 20 bp, Artificial
  CRISPR gRNA sequence
aaaggtaggccatggtgttc

SEQ ID NO: 411631 - DNA, 20 bp, Artificial
  CRISPR gRNA sequence
acaatcctttagatatgagt

SEQ ID NO: 411632 - DNA, 20 bp, Artificial
  CRISPR gRNA sequence
tagatatgagtggcatttta

SEQ ID NO: 411633 - DNA, 20 bp, Artificial
  CRISPR gRNA sequence
agatatgagtggcattttaa

SEQ ID NO: 411634 - DNA, 20 bp, Artificial
  CRISPR gRNA sequence
gatatgagtggcattttaat

SEQ ID NO: 411635 - DNA, 20 bp, Artificial
  CRISPR gRNA sequence
taattaattaactcacaggg

SEQ ID NO: 411636 - DNA, 20 bp, Artificial
  CRISPR gRNA sequence
aattaattaactcacaggga

SEQ ID NO: 411637 - DNA, 20 bp, Artificial
  CRISPR gRNA sequence
attaattaactcacagggag

SEQ ID NO: 411638 - DNA, 20 bp, Artificial
  CRISPR gRNA sequence
attaactcacagggagagag

SEQ ID NO: 411639 - DNA, 20 bp, Artificial
  CRISPR gRNA sequence
actcacagggagagagtctt

SEQ ID NO: 411640 - DNA, 20 bp, Artificial
  CRISPR gRNA sequence
acagggagagagtctttcac

SEQ ID NO: 411641 - DNA, 20 bp, Artificial
  CRISPR gRNA sequence
tcacaagtatcaagttgaaa

SEQ ID NO: 411642 - DNA, 20 bp, Artificial
  CRISPR gRNA sequence
cacaagtatcaagttgaaat

SEQ ID NO: 411643 - DNA, 20 bp, Artificial
  CRISPR gRNA sequence
acaagtatcaagttgaaatg

SEQ ID NO: 411644 - DNA, 20 bp, Artificial
  CRISPR gRNA sequence
aaatgttaatactctcagtt

SEQ ID NO: 411645 - DNA, 20 bp, Artificial
  CRISPR gRNA sequence
atactctcagttggattggt

SEQ ID NO: 411646 - DNA, 20 bp, Artificial
  CRISPR gRNA sequence
tcagttggattggtggaaag

SEQ ID NO: 411647 - DNA, 20 bp, Artificial
  CRISPR gRNA sequence
agttggattggtggaaagtg

SEQ ID NO: 411648 - DNA, 20 bp, Artificial
  CRISPR gRNA sequence
gattggtggaaagtgaaaat

SEQ ID NO: 411649 - DNA, 20 bp, Artificial
  CRISPR gRNA sequence
gtggaaagtgaaaatggctt

SEQ ID NO: 411650 - DNA, 20 bp, Artificial
  CRISPR gRNA sequence
tagctatgttggacagtgag

SEQ ID NO: 411651 - DNA, 20 bp, Artificial
  CRISPR gRNA sequence
agctatgttggacagtgagt

SEQ ID NO: 411652 - DNA, 20 bp, Artificial
  CRISPR gRNA sequence
gctatgttggacagtgagtg

SEQ ID NO: 411653 - DNA, 20 bp, Artificial
  CRISPR gRNA sequence
tgttggacagtgagtgaaac

SEQ ID NO: 411654 - DNA, 20 bp, Artificial
  CRISPR gRNA sequence
gacagtgagtgaaacaataa

SEQ ID NO: 411655 - DNA, 20 bp, Artificial
  CRISPR gRNA sequence
attgtgatgatgatggacac

SEQ ID NO: 411656 - DNA, 20 bp, Artificial
  CRISPR gRNA sequence
ttgtgatgatgatggacacg

SEQ ID NO: 411657 - DNA, 20 bp, Artificial
  CRISPR gRNA sequence
tgatgatgatggacacgggt

SEQ ID NO: 411658 - DNA, 20 bp, Artificial
  CRISPR gRNA sequence
agttgagaagatttcattaa

SEQ ID NO: 411659 - DNA, 20 bp, Artificial
  CRISPR gRNA sequence
agaagatttcattaacaaag

SEQ ID NO: 411660 - DNA, 20 bp, Artificial
  CRISPR gRNA sequence
cattaacaaagggtggggta

SEQ ID NO: 411661 - DNA, 20 bp, Artificial
  CRISPR gRNA sequence
attaacaaagggtggggtat

SEQ ID NO: 411662 - DNA, 20 bp, Artificial
  CRISPR gRNA sequence
acaaagggtggggtattttc

SEQ ID NO: 411663 - DNA, 20 bp, Artificial
  CRISPR gRNA sequence
tctgtgggacgcaatgtgta

SEQ ID NO: 411664 - DNA, 20 bp, Artificial
  CRISPR gRNA sequence
ctgtgggacgcaatgtgtaa

SEQ ID NO: 411665 - DNA, 20 bp, Artificial
  CRISPR gRNA sequence
tgtgggacgcaatgtgtaaa

SEQ ID NO: 411666 - DNA, 20 bp, Artificial
  CRISPR gRNA sequence
tgggacgcaatgtgtaaatg

SEQ ID NO: 411667 - DNA, 20 bp, Artificial
  CRISPR gRNA sequence
atacagaaaaatacaggctc

SEQ ID NO: 411668 - DNA, 20 bp, Artificial
  CRISPR gRNA sequence
tacagaaaaatacaggctca

SEQ ID NO: 411669 - DNA, 20 bp, Artificial
  CRISPR gRNA sequence
accaagtatagttatcctga

SEQ ID NO: 411670 - DNA, 20 bp, Artificial
  CRISPR gRNA sequence
tcctgatgtcactgtgtctt

SEQ ID NO: 411671 - DNA, 20 bp, Artificial
  CRISPR gRNA sequence
atgtcactgtgtcttcagtt

SEQ ID NO: 411672 - DNA, 20 bp, Artificial
  CRISPR gRNA sequence
tgtcttcagtttttcacatc

SEQ ID NO: 411673 - DNA, 20 bp, Artificial
  CRISPR gRNA sequence
cagtttttcacatcttatgt

SEQ ID NO: 411674 - DNA, 20 bp, Artificial
  CRISPR gRNA sequence
agtttttcacatcttatgtg

SEQ ID NO: 411675 - DNA, 20 bp, Artificial
  CRISPR gRNA sequence
ttcacatcttatgtggagca

SEQ ID NO: 411676 - DNA, 20 bp, Artificial
  CRISPR gRNA sequence
tcacatcttatgtggagcat

SEQ ID NO: 411677 - DNA, 20 bp, Artificial
  CRISPR gRNA sequence
cacatcttatgtggagcatt

SEQ ID NO: 411678 - DNA, 20 bp, Artificial
  CRISPR gRNA sequence
acatcttatgtggagcatta

SEQ ID NO: 411679 - DNA, 20 bp, Artificial
  CRISPR gRNA sequence
atgtggagcattaggattga

SEQ ID NO: 411680 - DNA, 20 bp, Artificial
  CRISPR gRNA sequence
tgtggagcattaggattgat

SEQ ID NO: 411681 - DNA, 20 bp, Artificial
  CRISPR gRNA sequence
ggattgattattcactcttt

SEQ ID NO: 411682 - DNA, 20 bp, Artificial
  CRISPR gRNA sequence
attattcactcttttaattt

SEQ ID NO: 411683 - DNA, 20 bp, Artificial
  CRISPR gRNA sequence
ttcactcttttaatttgtgt

SEQ ID NO: 411684 - DNA, 20 bp, Artificial
  CRISPR gRNA sequence
actcttttaatttgtgtgtg

SEQ ID NO: 411685 - DNA, 20 bp, Artificial
  CRISPR gRNA sequence
ttttaatttgtgtgtgtgtg

SEQ ID NO: 411686 - DNA, 20 bp, Artificial
  CRISPR gRNA sequence
ttaatttgtgtgtgtgtgtg

SEQ ID NO: 411687 - DNA, 20 bp, Artificial
  CRISPR gRNA sequence
taatttgtgtgtgtgtgtgt

SEQ ID NO: 411688 - DNA, 20 bp, Artificial
  CRISPR gRNA sequence
aatttgtgtgtgtgtgtgtg

SEQ ID NO: 411689 - DNA, 20 bp, Artificial
  CRISPR gRNA sequence
atttgtgtgtgtgtgtgtgt

SEQ ID NO: 411690 - DNA, 20 bp, Artificial
  CRISPR gRNA sequence
gtgtgtgtgtgtgtgtgtgt

SEQ ID NO: 411691 - DNA, 20 bp, Artificial
  CRISPR gRNA sequence
tgtgtgtgtgtgtgtgtgta

SEQ ID NO: 411692 - DNA, 20 bp, Artificial
  CRISPR gRNA sequence
agatatctatgaatatttgt

SEQ ID NO: 411693 - DNA, 20 bp, Artificial
  CRISPR gRNA sequence
tgaatatttgttaggaggag

SEQ ID NO: 411694 - DNA, 20 bp, Artificial
  CRISPR gRNA sequence
gttaggaggagtaacaagtt

SEQ ID NO: 411695 - DNA, 20 bp, Artificial
  CRISPR gRNA sequence
ttaggaggagtaacaagttt

SEQ ID NO: 411696 - DNA, 20 bp, Artificial
  CRISPR gRNA sequence
ggaggagtaacaagtttatt

SEQ ID NO: 411697 - DNA, 20 bp, Artificial
  CRISPR gRNA sequence
atttttcaacctgccgtatg

SEQ ID NO: 411698 - DNA, 20 bp, Artificial
  CRISPR gRNA sequence
tttttcaacctgccgtatgg

SEQ ID NO: 411699 - DNA, 20 bp, Artificial
  CRISPR gRNA sequence
ttcaacctgccgtatggtaa

SEQ ID NO: 411700 - DNA, 20 bp, Artificial
  CRISPR gRNA sequence
tcaacctgccgtatggtaaa

SEQ ID NO: 411701 - DNA, 20 bp, Artificial
  CRISPR gRNA sequence
caacctgccgtatggtaaac

SEQ ID NO: 411702 - DNA, 20 bp, Artificial
  CRISPR gRNA sequence
aacctgccgtatggtaaaca

SEQ ID NO: 411703 - DNA, 20 bp, Artificial
  CRISPR gRNA sequence
ccgtatggtaaacactcaac

SEQ ID NO: 411704 - DNA, 20 bp, Artificial
  CRISPR gRNA sequence
aacaaatacacacgattgtg

SEQ ID NO: 411705 - DNA, 20 bp, Artificial
  CRISPR gRNA sequence
tgtgggcaactttataacca

SEQ ID NO: 411706 - DNA, 20 bp, Artificial
  CRISPR gRNA sequence
tataaccacacttaccatat

SEQ ID NO: 411707 - DNA, 20 bp, Artificial
  CRISPR gRNA sequence
ataaccacacttaccatatg

SEQ ID NO: 411708 - DNA, 20 bp, Artificial
  CRISPR gRNA sequence
taaccacacttaccatatgc

SEQ ID NO: 411709 - DNA, 20 bp, Artificial
  CRISPR gRNA sequence
accatatgcacacatgccaa

SEQ ID NO: 411710 - DNA, 20 bp, Artificial
  CRISPR gRNA sequence
ccatatgcacacatgccaaa

SEQ ID NO: 411711 - DNA, 20 bp, Artificial
  CRISPR gRNA sequence
taatccaaacaagtcatttt

SEQ ID NO: 411712 - DNA, 20 bp, Artificial
  CRISPR gRNA sequence
aatccaaacaagtcattttg

SEQ ID NO: 411713 - DNA, 20 bp, Artificial
  CRISPR gRNA sequence
atccaaacaagtcattttgc

SEQ ID NO: 411714 - DNA, 20 bp, Artificial
  CRISPR gRNA sequence
tgcttttatattgactattt

SEQ ID NO: 411715 - DNA, 20 bp, Artificial
  CRISPR gRNA sequence
gcttttatattgactatttt

SEQ ID NO: 411716 - DNA, 20 bp, Artificial
  CRISPR gRNA sequence
cttttatattgactattttc

SEQ ID NO: 411717 - DNA, 20 bp, Artificial
  CRISPR gRNA sequence
ttatattgactattttctct

SEQ ID NO: 411718 - DNA, 20 bp, Artificial
  CRISPR gRNA sequence
tatattgactattttctctt

SEQ ID NO: 411719 - DNA, 20 bp, Artificial
  CRISPR gRNA sequence
atattgactattttctcttc

SEQ ID NO: 411720 - DNA, 20 bp, Artificial
  CRISPR gRNA sequence
tattgactattttctcttcc

SEQ ID NO: 411721 - DNA, 20 bp, Artificial
  CRISPR gRNA sequence
actattttctcttcctgatc

SEQ ID NO: 411722 - DNA, 20 bp, Artificial
  CRISPR gRNA sequence
ttttctcttcctgatccagc

SEQ ID NO: 411723 - DNA, 20 bp, Artificial
  CRISPR gRNA sequence
tctcttcctgatccagcaga

SEQ ID NO: 411724 - DNA, 20 bp, Artificial
  CRISPR gRNA sequence
ctcttcctgatccagcagat

SEQ ID NO: 411725 - DNA, 20 bp, Artificial
  CRISPR gRNA sequence
tcttcctgatccagcagata

SEQ ID NO: 411726 - DNA, 20 bp, Artificial
  CRISPR gRNA sequence
ttcctgatccagcagataaa

SEQ ID NO: 411727 - DNA, 20 bp, Artificial
  CRISPR gRNA sequence
cctgatccagcagataaagg

SEQ ID NO: 411728 - DNA, 20 bp, Artificial
  CRISPR gRNA sequence
ctgatccagcagataaaggt

SEQ ID NO: 411729 - DNA, 20 bp, Artificial
  CRISPR gRNA sequence
atccagcagataaaggtatc

SEQ ID NO: 411730 - DNA, 20 bp, Artificial
  CRISPR gRNA sequence
tgaaatctaatcatataatt

SEQ ID NO: 411731 - DNA, 20 bp, Artificial
  CRISPR gRNA sequence
gaaatctaatcatataattc

SEQ ID NO: 411732 - DNA, 20 bp, Artificial
  CRISPR gRNA sequence
aaatctaatcatataattca

SEQ ID NO: 411733 - DNA, 20 bp, Artificial
  CRISPR gRNA sequence
atcatataattcatttttaa

SEQ ID NO: 411734 - DNA, 20 bp, Artificial
  CRISPR gRNA sequence
atttttaaattattggctct

SEQ ID NO: 411735 - DNA, 20 bp, Artificial
  CRISPR gRNA sequence
ttaaattattggctcttttt

SEQ ID NO: 411736 - DNA, 20 bp, Artificial
  CRISPR gRNA sequence
taaattattggctcttttta

SEQ ID NO: 411737 - DNA, 20 bp, Artificial
  CRISPR gRNA sequence
aaattattggctctttttaa

SEQ ID NO: 411738 - DNA, 20 bp, Artificial
  CRISPR gRNA sequence
aattattggctctttttaaa

SEQ ID NO: 411739 - DNA, 20 bp, Artificial
  CRISPR gRNA sequence
ttggctctttttaaaaaaga

SEQ ID NO: 411740 - DNA, 20 bp, Artificial
  CRISPR gRNA sequence
gctctttttaaaaaagagag

SEQ ID NO: 411741 - DNA, 20 bp, Artificial
  CRISPR gRNA sequence
tttttaaaaaagagagatga

SEQ ID NO: 411742 - DNA, 20 bp, Artificial
  CRISPR gRNA sequence
tttaaaaaagagagatgaga

SEQ ID NO: 411743 - DNA, 20 bp, Artificial
  CRISPR gRNA sequence
ttaaaaaagagagatgagat

SEQ ID NO: 411744 - DNA, 20 bp, Artificial
  CRISPR gRNA sequence
taaaaaagagagatgagatg

SEQ ID NO: 411745 - DNA, 20 bp, Artificial
  CRISPR gRNA sequence
aaaaaagagagatgagatgg

SEQ ID NO: 411746 - DNA, 20 bp, Artificial
  CRISPR gRNA sequence
aaaaagagagatgagatggg

SEQ ID NO: 411747 - DNA, 20 bp, Artificial
  CRISPR gRNA sequence
ttaaactctagagcataaag

SEQ ID NO: 411748 - DNA, 20 bp, Artificial
  CRISPR gRNA sequence
aactctagagcataaagcag

SEQ ID NO: 411749 - DNA, 20 bp, Artificial
  CRISPR gRNA sequence
tagagcataaagcagcagat

SEQ ID NO: 411750 - DNA, 20 bp, Artificial
  CRISPR gRNA sequence
gagcataaagcagcagattt

SEQ ID NO: 411751 - DNA, 20 bp, Artificial
  CRISPR gRNA sequence
tgaaattattcctagttatt

SEQ ID NO: 411752 - DNA, 20 bp, Artificial
  CRISPR gRNA sequence
gaaattattcctagttatta

SEQ ID NO: 411753 - DNA, 20 bp, Artificial
  CRISPR gRNA sequence
aaattattcctagttattat

SEQ ID NO: 411754 - DNA, 20 bp, Artificial
  CRISPR gRNA sequence
ttcctagttattatttctta

SEQ ID NO: 411755 - DNA, 20 bp, Artificial
  CRISPR gRNA sequence
ctagttattatttcttatag

SEQ ID NO: 411756 - DNA, 20 bp, Artificial
  CRISPR gRNA sequence
gttattatttcttatagcca

SEQ ID NO: 411757 - DNA, 20 bp, Artificial
  CRISPR gRNA sequence
ttatttcttatagccaggca

SEQ ID NO: 411758 - DNA, 20 bp, Artificial
  CRISPR gRNA sequence
tttcttatagccaggcatag

SEQ ID NO: 411759 - DNA, 20 bp, Artificial
  CRISPR gRNA sequence
cttatagccaggcataggct

SEQ ID NO: 411760 - DNA, 20 bp, Artificial
  CRISPR gRNA sequence
ttatagccaggcataggctt

SEQ ID NO: 411761 - DNA, 20 bp, Artificial
  CRISPR gRNA sequence
atagccaggcataggctttc

SEQ ID NO: 411762 - DNA, 20 bp, Artificial
  CRISPR gRNA sequence
tagccaggcataggctttca

SEQ ID NO: 411763 - DNA, 20 bp, Artificial
  CRISPR gRNA sequence
tcatgttttgtagagcactt

SEQ ID NO: 411764 - DNA, 20 bp, Artificial
  CRISPR gRNA sequence
catgttttgtagagcactta

SEQ ID NO: 411765 - DNA, 20 bp, Artificial
  CRISPR gRNA sequence
atgttttgtagagcacttag

SEQ ID NO: 411766 - DNA, 20 bp, Artificial
  CRISPR gRNA sequence
tgtagagcacttagggaatt

SEQ ID NO: 411767 - DNA, 20 bp, Artificial
  CRISPR gRNA sequence
gtagagcacttagggaattt

SEQ ID NO: 411768 - DNA, 20 bp, Artificial
  CRISPR gRNA sequence
tagagcacttagggaatttt

SEQ ID NO: 411769 - DNA, 20 bp, Artificial
  CRISPR gRNA sequence
agggaatttttttcataaaa

SEQ ID NO: 411770 - DNA, 20 bp, Artificial
  CRISPR gRNA sequence
gggaatttttttcataaaat

SEQ ID NO: 411771 - DNA, 20 bp, Artificial
  CRISPR gRNA sequence
ttttcataaaatggtttaaa

SEQ ID NO: 411772 - DNA, 20 bp, Artificial
  CRISPR gRNA sequence
tttcataaaatggtttaaaa

SEQ ID NO: 411773 - DNA, 20 bp, Artificial
  CRISPR gRNA sequence
ttcataaaatggtttaaaat

SEQ ID NO: 411774 - DNA, 20 bp, Artificial
  CRISPR gRNA sequence
tcataaaatggtttaaaatt

SEQ ID NO: 411775 - DNA, 20 bp, Artificial
  CRISPR gRNA sequence
cataaaatggtttaaaattg

SEQ ID NO: 411776 - DNA, 20 bp, Artificial
  CRISPR gRNA sequence
ataaaatggtttaaaattgg

SEQ ID NO: 411777 - DNA, 20 bp, Artificial
  CRISPR gRNA sequence
aaaattggatagtctatttg

SEQ ID NO: 411778 - DNA, 20 bp, Artificial
  CRISPR gRNA sequence
aaattggatagtctatttgg

SEQ ID NO: 411779 - DNA, 20 bp, Artificial
  CRISPR gRNA sequence
gatagtctatttggaggtat

SEQ ID NO: 411780 - DNA, 20 bp, Artificial
  CRISPR gRNA sequence
tttggaggtattcagcctaa

SEQ ID NO: 411781 - DNA, 20 bp, Artificial
  CRISPR gRNA sequence
ggaggtattcagcctaaggc

SEQ ID NO: 411782 - DNA, 20 bp, Artificial
  CRISPR gRNA sequence
gaggtattcagcctaaggct

SEQ ID NO: 411783 - DNA, 20 bp, Artificial
  CRISPR gRNA sequence
agcctaaggcttgctgaatt

SEQ ID NO: 411784 - DNA, 20 bp, Artificial
  CRISPR gRNA sequence
aggcttgctgaatttcatat

SEQ ID NO: 411785 - DNA, 20 bp, Artificial
  CRISPR gRNA sequence
gctgaatttcatattctgaa

SEQ ID NO: 411786 - DNA, 20 bp, Artificial
  CRISPR gRNA sequence
ctgaatttcatattctgaaa

SEQ ID NO: 411787 - DNA, 20 bp, Artificial
  CRISPR gRNA sequence
aatttcatattctgaaaaga

SEQ ID NO: 411788 - DNA, 20 bp, Artificial
  CRISPR gRNA sequence
catattctgaaaagatctgt

SEQ ID NO: 411789 - DNA, 20 bp, Artificial
  CRISPR gRNA sequence
atattctgaaaagatctgta

SEQ ID NO: 411790 - DNA, 20 bp, Artificial
  CRISPR gRNA sequence
tgaaaagatctgtacaacat

SEQ ID NO: 411791 - DNA, 20 bp, Artificial
  CRISPR gRNA sequence
aaaagatctgtacaacattt

SEQ ID NO: 411792 - DNA, 20 bp, Artificial
  CRISPR gRNA sequence
tacaacatttataacacctt

SEQ ID NO: 411793 - DNA, 20 bp, Artificial
  CRISPR gRNA sequence
ataacacctttagatataag

SEQ ID NO: 411794 - DNA, 20 bp, Artificial
  CRISPR gRNA sequence
taacacctttagatataagt

SEQ ID NO: 411795 - DNA, 20 bp, Artificial
  CRISPR gRNA sequence
tagatataagtctttgtaaa

SEQ ID NO: 411796 - DNA, 20 bp, Artificial
  CRISPR gRNA sequence
agatataagtctttgtaaat

SEQ ID NO: 411797 - DNA, 20 bp, Artificial
  CRISPR gRNA sequence
gatataagtctttgtaaatg

SEQ ID NO: 411798 - DNA, 20 bp, Artificial
  CRISPR gRNA sequence
tgtaaatgctatatggtttg

SEQ ID NO: 411799 - DNA, 20 bp, Artificial
  CRISPR gRNA sequence
gtaaatgctatatggtttgc

SEQ ID NO: 411800 - DNA, 20 bp, Artificial
  CRISPR gRNA sequence
taaatgctatatggtttgca

SEQ ID NO: 411801 - DNA, 20 bp, Artificial
  CRISPR gRNA sequence
tatggtttgcattttcaagt

SEQ ID NO: 411802 - DNA, 20 bp, Artificial
  CRISPR gRNA sequence
gcattttcaagtttcctttt

SEQ ID NO: 411803 - DNA, 20 bp, Artificial
  CRISPR gRNA sequence
cattttcaagtttccttttt

SEQ ID NO: 411804 - DNA, 20 bp, Artificial
  CRISPR gRNA sequence
tcaagtttcctttttttaaa

SEQ ID NO: 411805 - DNA, 20 bp, Artificial
  CRISPR gRNA sequence
caagtttcctttttttaaaa

SEQ ID NO: 411806 - DNA, 20 bp, Artificial
  CRISPR gRNA sequence
aagtttcctttttttaaaaa

SEQ ID NO: 411807 - DNA, 20 bp, Artificial
  CRISPR gRNA sequence
cctttttttaaaaaattatt

SEQ ID NO: 411808 - DNA, 20 bp, Artificial
  CRISPR gRNA sequence
ctttttttaaaaaattattt

SEQ ID NO: 411809 - DNA, 20 bp, Artificial
  CRISPR gRNA sequence
tttttaaaaaattattttta

SEQ ID NO: 411810 - DNA, 20 bp, Artificial
  CRISPR gRNA sequence
ttttaaaaaattatttttac

SEQ ID NO: 411811 - DNA, 20 bp, Artificial
  CRISPR gRNA sequence
tttaaaaaattatttttact

SEQ ID NO: 411812 - DNA, 20 bp, Artificial
  CRISPR gRNA sequence
ttaaaaaattatttttactt

SEQ ID NO: 411813 - DNA, 20 bp, Artificial
  CRISPR gRNA sequence
taaaaaattatttttacttt

SEQ ID NO: 411814 - DNA, 20 bp, Artificial
  CRISPR gRNA sequence
aaaaaattatttttactttt

SEQ ID NO: 411815 - DNA, 20 bp, Artificial
  CRISPR gRNA sequence
aaaaattatttttactttta

SEQ ID NO: 411816 - DNA, 20 bp, Artificial
  CRISPR gRNA sequence
tttttacttttatttttatt

SEQ ID NO: 411817 - DNA, 20 bp, Artificial
  CRISPR gRNA sequence
ttacttttatttttattttt

SEQ ID NO: 411818 - DNA, 20 bp, Artificial
  CRISPR gRNA sequence
tacttttatttttattttta

SEQ ID NO: 411819 - DNA, 20 bp, Artificial
  CRISPR gRNA sequence
acttttatttttatttttat

SEQ ID NO: 411820 - DNA, 20 bp, Artificial
  CRISPR gRNA sequence
cttttatttttatttttatt

SEQ ID NO: 411821 - DNA, 20 bp, Artificial
  CRISPR gRNA sequence
ttatttttatttttattttt

SEQ ID NO: 411822 - DNA, 20 bp, Artificial
  CRISPR gRNA sequence
tatttttatttttatttttt

SEQ ID NO: 411823 - DNA, 20 bp, Artificial
  CRISPR gRNA sequence
atttttatttttattttttt

SEQ ID NO: 411824 - DNA, 20 bp, Artificial
  CRISPR gRNA sequence
tttttatttttatttttttt

SEQ ID NO: 411825 - DNA, 20 bp, Artificial
  CRISPR gRNA sequence
ttatttttattttttttttg

SEQ ID NO: 411826 - DNA, 20 bp, Artificial
  CRISPR gRNA sequence
tatttttattttttttttga

SEQ ID NO: 411827 - DNA, 20 bp, Artificial
  CRISPR gRNA sequence
atttttattttttttttgag

SEQ ID NO: 411828 - DNA, 20 bp, Artificial
  CRISPR gRNA sequence
tttttattttttttttgaga

SEQ ID NO: 411829 - DNA, 20 bp, Artificial
  CRISPR gRNA sequence
ttattttttttttgagacag

SEQ ID NO: 411830 - DNA, 20 bp, Artificial
  CRISPR gRNA sequence
tattttttttttgagacagg

SEQ ID NO: 411831 - DNA, 20 bp, Artificial
  CRISPR gRNA sequence
attttttttttgagacaggt

SEQ ID NO: 411832 - DNA, 20 bp, Artificial
  CRISPR gRNA sequence
ttttttttttgagacaggtt

SEQ ID NO: 411833 - DNA, 20 bp, Artificial
  CRISPR gRNA sequence
tttttttgagacaggttctc

SEQ ID NO: 411834 - DNA, 20 bp, Artificial
  CRISPR gRNA sequence
ttttttgagacaggttctca

SEQ ID NO: 411835 - DNA, 20 bp, Artificial
  CRISPR gRNA sequence
tttttgagacaggttctcac

SEQ ID NO: 411836 - DNA, 20 bp, Artificial
  CRISPR gRNA sequence
ttttgagacaggttctcact

SEQ ID NO: 411837 - DNA, 20 bp, Artificial
  CRISPR gRNA sequence
tttgagacaggttctcactc

SEQ ID NO: 411838 - DNA, 20 bp, Artificial
  CRISPR gRNA sequence
ttgagacaggttctcactct

SEQ ID NO: 411839 - DNA, 20 bp, Artificial
  CRISPR gRNA sequence
tgagacaggttctcactctg

SEQ ID NO: 411840 - DNA, 20 bp, Artificial
  CRISPR gRNA sequence
gagacaggttctcactctgt

SEQ ID NO: 411841 - DNA, 20 bp, Artificial
  CRISPR gRNA sequence
agacaggttctcactctgtt

SEQ ID NO: 411842 - DNA, 20 bp, Artificial
  CRISPR gRNA sequence
tcactctgttgcccaggctg

SEQ ID NO: 411843 - DNA, 20 bp, Artificial
  CRISPR gRNA sequence
actctgttgcccaggctgga

SEQ ID NO: 411844 - DNA, 20 bp, Artificial
  CRISPR gRNA sequence
tgttgcccaggctggagtgc

SEQ ID NO: 411845 - DNA, 20 bp, Artificial
  CRISPR gRNA sequence
ttgcccaggctggagtgcaa

SEQ ID NO: 411846 - DNA, 20 bp, Artificial
  CRISPR gRNA sequence
cccaggctggagtgcaatgg

SEQ ID NO: 411847 - DNA, 20 bp, Artificial
  CRISPR gRNA sequence
gagtgcaatggcacgatctc

SEQ ID NO: 411848 - DNA, 20 bp, Artificial
  CRISPR gRNA sequence
ggctcactgcaacctcctcc

SEQ ID NO: 411849 - DNA, 20 bp, Artificial
  CRISPR gRNA sequence
actgcaacctcctcctcctg

SEQ ID NO: 411850 - DNA, 20 bp, Artificial
  CRISPR gRNA sequence
caacctcctcctcctgggtt

SEQ ID NO: 411851 - DNA, 20 bp, Artificial
  CRISPR gRNA sequence
ctcctcctgggttcaagcga

SEQ ID NO: 411852 - DNA, 20 bp, Artificial
  CRISPR gRNA sequence
ctcctgggttcaagcgattc

SEQ ID NO: 411853 - DNA, 20 bp, Artificial
  CRISPR gRNA sequence
ctgggttcaagcgattcttc

SEQ ID NO: 411854 - DNA, 20 bp, Artificial
  CRISPR gRNA sequence
ggttcaagcgattcttctgc

SEQ ID NO: 411855 - DNA, 20 bp, Artificial
  CRISPR gRNA sequence
aagcgattcttctgcctcag

SEQ ID NO: 411856 - DNA, 20 bp, Artificial
  CRISPR gRNA sequence
ttctgcctcagcctcccaag

SEQ ID NO: 411857 - DNA, 20 bp, Artificial
  CRISPR gRNA sequence
ctgcctcagcctcccaagca

SEQ ID NO: 411858 - DNA, 20 bp, Artificial
  CRISPR gRNA sequence
tgcctcagcctcccaagcag

SEQ ID NO: 411859 - DNA, 20 bp, Artificial
  CRISPR gRNA sequence
cctcagcctcccaagcagct

SEQ ID NO: 411860 - DNA, 20 bp, Artificial
  CRISPR gRNA sequence
agcctcccaagcagctggga

SEQ ID NO: 411861 - DNA, 20 bp, Artificial
  CRISPR gRNA sequence
ccaagcagctgggattacag

SEQ ID NO: 411862 - DNA, 20 bp, Artificial
  CRISPR gRNA sequence
ggattacaggcacctgccac

SEQ ID NO: 411863 - DNA, 20 bp, Artificial
  CRISPR gRNA sequence
caggcacctgccaccatgcc

SEQ ID NO: 411864 - DNA, 20 bp, Artificial
  CRISPR gRNA sequence
ccaccatgcccagctaattt

SEQ ID NO: 411865 - DNA, 20 bp, Artificial
  CRISPR gRNA sequence
atttttgtatttttagaaga

SEQ ID NO: 411866 - DNA, 20 bp, Artificial
  CRISPR gRNA sequence
ttgtatttttagaagagacg

SEQ ID NO: 411867 - DNA, 20 bp, Artificial
  CRISPR gRNA sequence
tgtatttttagaagagacgg

SEQ ID NO: 411868 - DNA, 20 bp, Artificial
  CRISPR gRNA sequence
gtatttttagaagagacggg

SEQ ID NO: 411869 - DNA, 20 bp, Artificial
  CRISPR gRNA sequence
tatttttagaagagacgggg

SEQ ID NO: 411870 - DNA, 20 bp, Artificial
  CRISPR gRNA sequence
ttagaagagacggggtttca

SEQ ID NO: 411871 - DNA, 20 bp, Artificial
  CRISPR gRNA sequence
tagaagagacggggtttcac

SEQ ID NO: 411872 - DNA, 20 bp, Artificial
  CRISPR gRNA sequence
agaagagacggggtttcacc

SEQ ID NO: 411873 - DNA, 20 bp, Artificial
  CRISPR gRNA sequence
gaagagacggggtttcacca

SEQ ID NO: 411874 - DNA, 20 bp, Artificial
  CRISPR gRNA sequence
caccacattggtcaagctgg

SEQ ID NO: 411875 - DNA, 20 bp, Artificial
  CRISPR gRNA sequence
accacattggtcaagctggt

SEQ ID NO: 411876 - DNA, 20 bp, Artificial
  CRISPR gRNA sequence
gtcaagctggtctcgaagtc

SEQ ID NO: 411877 - DNA, 20 bp, Artificial
  CRISPR gRNA sequence
gtctcgaagtcctgacctca

SEQ ID NO: 411878 - DNA, 20 bp, Artificial
  CRISPR gRNA sequence
gaagtcctgacctcaggtga

SEQ ID NO: 411879 - DNA, 20 bp, Artificial
  CRISPR gRNA sequence
acctcaggtgatccacccac

SEQ ID NO: 411880 - DNA, 20 bp, Artificial
  CRISPR gRNA sequence
aggtgatccacccacctcgg

SEQ ID NO: 411881 - DNA, 20 bp, Artificial
  CRISPR gRNA sequence
ggccttccaaagtgccggga

SEQ ID NO: 411882 - DNA, 20 bp, Artificial
  CRISPR gRNA sequence
ccaaagtgccgggattgcag

SEQ ID NO: 411883 - DNA, 20 bp, Artificial
  CRISPR gRNA sequence
caaagtgccgggattgcaga

SEQ ID NO: 411884 - DNA, 20 bp, Artificial
  CRISPR gRNA sequence
cagacgtgagccactgcacc

SEQ ID NO: 411885 - DNA, 20 bp, Artificial
  CRISPR gRNA sequence
cacctggtcacattttgaag

SEQ ID NO: 411886 - DNA, 20 bp, Artificial
  CRISPR gRNA sequence
gtcacattttgaagttttct

SEQ ID NO: 411887 - DNA, 20 bp, Artificial
  CRISPR gRNA sequence
tgaagttttctaaggaccca

SEQ ID NO: 411888 - DNA, 20 bp, Artificial
  CRISPR gRNA sequence
gaagttttctaaggacccaa

SEQ ID NO: 411889 - DNA, 20 bp, Artificial
  CRISPR gRNA sequence
aagttttctaaggacccaag

SEQ ID NO: 411890 - DNA, 20 bp, Artificial
  CRISPR gRNA sequence
tctaaggacccaaggaaaga

SEQ ID NO: 411891 - DNA, 20 bp, Artificial
  CRISPR gRNA sequence
ctaaggacccaaggaaagag

SEQ ID NO: 411892 - DNA, 20 bp, Artificial
  CRISPR gRNA sequence
taaggacccaaggaaagagt

SEQ ID NO: 411893 - DNA, 20 bp, Artificial
  CRISPR gRNA sequence
aggacccaaggaaagagtta

SEQ ID NO: 411894 - DNA, 20 bp, Artificial
  CRISPR gRNA sequence
taagtagctgttctaagaat

SEQ ID NO: 411895 - DNA, 20 bp, Artificial
  CRISPR gRNA sequence
ttctaagaattacgtgtcac

SEQ ID NO: 411896 - DNA, 20 bp, Artificial
  CRISPR gRNA sequence
taagaattacgtgtcacagg

SEQ ID NO: 411897 - DNA, 20 bp, Artificial
  CRISPR gRNA sequence
agaattacgtgtcacagggc

SEQ ID NO: 411898 - DNA, 20 bp, Artificial
  CRISPR gRNA sequence
cgtgtcacagggctttgtct

SEQ ID NO: 411899 - DNA, 20 bp, Artificial
  CRISPR gRNA sequence
tgtcttggtcgctatatgat

SEQ ID NO: 411900 - DNA, 20 bp, Artificial
  CRISPR gRNA sequence
gtcttggtcgctatatgata

SEQ ID NO: 411901 - DNA, 20 bp, Artificial
  CRISPR gRNA sequence
tcttggtcgctatatgataa

SEQ ID NO: 411902 - DNA, 20 bp, Artificial
  CRISPR gRNA sequence
ggtcgctatatgataaacac

SEQ ID NO: 411903 - DNA, 20 bp, Artificial
  CRISPR gRNA sequence
gtcgctatatgataaacaca

SEQ ID NO: 411904 - DNA, 20 bp, Artificial
  CRISPR gRNA sequence
tatgataaacacacatacca

SEQ ID NO: 411905 - DNA, 20 bp, Artificial
  CRISPR gRNA sequence
ctatgtgtgccagtggctgt

SEQ ID NO: 411906 - DNA, 20 bp, Artificial
  CRISPR gRNA sequence
tatgtgtgccagtggctgtt

SEQ ID NO: 411907 - DNA, 20 bp, Artificial
  CRISPR gRNA sequence
tgtgtgccagtggctgttct

SEQ ID NO: 411908 - DNA, 20 bp, Artificial
  CRISPR gRNA sequence
ttctgagaatttactcgtag

SEQ ID NO: 411909 - DNA, 20 bp, Artificial
  CRISPR gRNA sequence
tgagaatttactcgtagtta

SEQ ID NO: 411910 - DNA, 20 bp, Artificial
  CRISPR gRNA sequence
agaatttactcgtagttact

SEQ ID NO: 411911 - DNA, 20 bp, Artificial
  CRISPR gRNA sequence
actcgtagttactgatttac

SEQ ID NO: 411912 - DNA, 20 bp, Artificial
  CRISPR gRNA sequence
ctcgtagttactgatttact

SEQ ID NO: 411913 - DNA, 20 bp, Artificial
  CRISPR gRNA sequence
gtagttactgatttacttgt

SEQ ID NO: 411914 - DNA, 20 bp, Artificial
  CRISPR gRNA sequence
ctgatttacttgtcacagca

SEQ ID NO: 411915 - DNA, 20 bp, Artificial
  CRISPR gRNA sequence
atttacttgtcacagcagcc

SEQ ID NO: 411916 - DNA, 20 bp, Artificial
  CRISPR gRNA sequence
acttgtcacagcagcctgac

SEQ ID NO: 411917 - DNA, 20 bp, Artificial
  CRISPR gRNA sequence
cttgtcacagcagcctgact

SEQ ID NO: 411918 - DNA, 20 bp, Artificial
  CRISPR gRNA sequence
gtcacagcagcctgactgcc

SEQ ID NO: 411919 - DNA, 20 bp, Artificial
  CRISPR gRNA sequence
tcacagcagcctgactgccc

SEQ ID NO: 411920 - DNA, 20 bp, Artificial
  CRISPR gRNA sequence
actgcccacgtttgacgtct

SEQ ID NO: 411921 - DNA, 20 bp, Artificial
  CRISPR gRNA sequence
cccacgtttgacgtctgtgg

SEQ ID NO: 411922 - DNA, 20 bp, Artificial
  CRISPR gRNA sequence
gacgtctgtggaaagtgagg

SEQ ID NO: 411923 - DNA, 20 bp, Artificial
  CRISPR gRNA sequence
acgtctgtggaaagtgaggt

SEQ ID NO: 411924 - DNA, 20 bp, Artificial
  CRISPR gRNA sequence
tggaaagtgaggtatggaga

SEQ ID NO: 411925 - DNA, 20 bp, Artificial
  CRISPR gRNA sequence
acgggacttatctcaggctt

SEQ ID NO: 411926 - DNA, 20 bp, Artificial
  CRISPR gRNA sequence
atctcaggcttggtaactaa

SEQ ID NO: 411927 - DNA, 20 bp, Artificial
  CRISPR gRNA sequence
tctcaggcttggtaactaat

SEQ ID NO: 411928 - DNA, 20 bp, Artificial
  CRISPR gRNA sequence
aggcttggtaactaataaat

SEQ ID NO: 411929 - DNA, 20 bp, Artificial
  CRISPR gRNA sequence
ggtaactaataaatagaggg

SEQ ID NO: 411930 - DNA, 20 bp, Artificial
  CRISPR gRNA sequence
gtaactaataaatagagggg

SEQ ID NO: 411931 - DNA, 20 bp, Artificial
  CRISPR gRNA sequence
ataaatagaggggcagggat

SEQ ID NO: 411932 - DNA, 20 bp, Artificial
  CRISPR gRNA sequence
agatgcgggctgactggctt

SEQ ID NO: 411933 - DNA, 20 bp, Artificial
  CRISPR gRNA sequence
actggcttcagagttcctat

SEQ ID NO: 411934 - DNA, 20 bp, Artificial
  CRISPR gRNA sequence
gcttcagagttcctattctt

SEQ ID NO: 411935 - DNA, 20 bp, Artificial
  CRISPR gRNA sequence
cagagttcctattcttggcc

SEQ ID NO: 411936 - DNA, 20 bp, Artificial
  CRISPR gRNA sequence
agagttcctattcttggccc

SEQ ID NO: 411937 - DNA, 20 bp, Artificial
  CRISPR gRNA sequence
ctattcttggccccagcact

SEQ ID NO: 411938 - DNA, 20 bp, Artificial
  CRISPR gRNA sequence
ttcttggccccagcactact

SEQ ID NO: 411939 - DNA, 20 bp, Artificial
  CRISPR gRNA sequence
ttggccccagcactactttt

SEQ ID NO: 411940 - DNA, 20 bp, Artificial
  CRISPR gRNA sequence
ggccccagcactacttttct

SEQ ID NO: 411941 - DNA, 20 bp, Artificial
  CRISPR gRNA sequence
gccccagcactacttttctg

SEQ ID NO: 411942 - DNA, 20 bp, Artificial
  CRISPR gRNA sequence
cttttctgctcaaagtggaa

SEQ ID NO: 411943 - DNA, 20 bp, Artificial
  CRISPR gRNA sequence
ttctgctcaaagtggaagag

SEQ ID NO: 411944 - DNA, 20 bp, Artificial
  CRISPR gRNA sequence
tctgctcaaagtggaagaga

SEQ ID NO: 411945 - DNA, 20 bp, Artificial
  CRISPR gRNA sequence
ctgctcaaagtggaagagaa

SEQ ID NO: 411946 - DNA, 20 bp, Artificial
  CRISPR gRNA sequence
tgctcaaagtggaagagaaa

SEQ ID NO: 411947 - DNA, 20 bp, Artificial
  CRISPR gRNA sequence
ctcaaagtggaagagaaaaa

SEQ ID NO: 411948 - DNA, 20 bp, Artificial
  CRISPR gRNA sequence
aaagtggaagagaaaaacta

SEQ ID NO: 411949 - DNA, 20 bp, Artificial
  CRISPR gRNA sequence
ctctcatcaggagactcatc

SEQ ID NO: 411950 - DNA, 20 bp, Artificial
  CRISPR gRNA sequence
tcatcaggagactcatcaca

SEQ ID NO: 411951 - DNA, 20 bp, Artificial
  CRISPR gRNA sequence
atcaggagactcatcacaac

SEQ ID NO: 411952 - DNA, 20 bp, Artificial
  CRISPR gRNA sequence
atcacaacagaagctggtga

SEQ ID NO: 411953 - DNA, 20 bp, Artificial
  CRISPR gRNA sequence
gtgacggtggagctacagag

SEQ ID NO: 411954 - DNA, 20 bp, Artificial
  CRISPR gRNA sequence
cagagcgtccttcttcaaga

SEQ ID NO: 411955 - DNA, 20 bp, Artificial
  CRISPR gRNA sequence
cttcaagaggtttatacaag

SEQ ID NO: 411956 - DNA, 20 bp, Artificial
  CRISPR gRNA sequence
ttcaagaggtttatacaagt

SEQ ID NO: 411957 - DNA, 20 bp, Artificial
  CRISPR gRNA sequence
caagaggtttatacaagtga

SEQ ID NO: 411958 - DNA, 20 bp, Artificial
  CRISPR gRNA sequence
aagaggtttatacaagtgat

SEQ ID NO: 411959 - DNA, 20 bp, Artificial
  CRISPR gRNA sequence
atacaagtgataggtttcag

SEQ ID NO: 411960 - DNA, 20 bp, Artificial
  CRISPR gRNA sequence
tacaagtgataggtttcagg

SEQ ID NO: 411961 - DNA, 20 bp, Artificial
  CRISPR gRNA sequence
caggctgaaccaatgtctag

SEQ ID NO: 411962 - DNA, 20 bp, Artificial
  CRISPR gRNA sequence
aggctgaaccaatgtctaga

SEQ ID NO: 411963 - DNA, 20 bp, Artificial
  CRISPR gRNA sequence
aaccaatgtctagagcaagt

SEQ ID NO: 411964 - DNA, 20 bp, Artificial
  CRISPR gRNA sequence
gagcaagtttaggcaaagga

SEQ ID NO: 411965 - DNA, 20 bp, Artificial
  CRISPR gRNA sequence
aggcaaaggagtcggggagc

SEQ ID NO: 411966 - DNA, 20 bp, Artificial
  CRISPR gRNA sequence
ggcaaaggagtcggggagcg

SEQ ID NO: 411967 - DNA, 20 bp, Artificial
  CRISPR gRNA sequence
gtggtctcccgctactttat

SEQ ID NO: 411968 - DNA, 20 bp, Artificial
  CRISPR gRNA sequence
ccgctactttatttcagctc

SEQ ID NO: 411969 - DNA, 20 bp, Artificial
  CRISPR gRNA sequence
ctttatttcagctcgggatc

SEQ ID NO: 411970 - DNA, 20 bp, Artificial
  CRISPR gRNA sequence
tatttcagctcgggatcctt

SEQ ID NO: 411971 - DNA, 20 bp, Artificial
  CRISPR gRNA sequence
atttcagctcgggatccttc

SEQ ID NO: 411972 - DNA, 20 bp, Artificial
  CRISPR gRNA sequence
tttcagctcgggatccttcg

SEQ ID NO: 411973 - DNA, 20 bp, Artificial
  CRISPR gRNA sequence
cagctcgggatccttcgctg

SEQ ID NO: 411974 - DNA, 20 bp, Artificial
  CRISPR gRNA sequence
agctcgggatccttcgctga

SEQ ID NO: 411975 - DNA, 20 bp, Artificial
  CRISPR gRNA sequence
gggatccttcgctgacgcca

SEQ ID NO: 411976 - DNA, 20 bp, Artificial
  CRISPR gRNA sequence
cgctgacgccaatgctatga

SEQ ID NO: 411977 - DNA, 20 bp, Artificial
  CRISPR gRNA sequence
gctgacgccaatgctatgag

SEQ ID NO: 411978 - DNA, 20 bp, Artificial
  CRISPR gRNA sequence
acgccaatgctatgagggga

SEQ ID NO: 411979 - DNA, 20 bp, Artificial
  CRISPR gRNA sequence
tgaggggaccttctcccctt

SEQ ID NO: 411980 - DNA, 20 bp, Artificial
  CRISPR gRNA sequence
ctccccttccttcctgtctt

SEQ ID NO: 411981 - DNA, 20 bp, Artificial
  CRISPR gRNA sequence
tccccttccttcctgtcttc

SEQ ID NO: 411982 - DNA, 20 bp, Artificial
  CRISPR gRNA sequence
cccttccttcctgtcttcct

SEQ ID NO: 411983 - DNA, 20 bp, Artificial
  CRISPR gRNA sequence
ccttcctgtcttccttctag

SEQ ID NO: 411984 - DNA, 20 bp, Artificial
  CRISPR gRNA sequence
cttcctgtcttccttctagg

SEQ ID NO: 411985 - DNA, 20 bp, Artificial
  CRISPR gRNA sequence
cctgtcttccttctaggggc

SEQ ID NO: 411986 - DNA, 20 bp, Artificial
  CRISPR gRNA sequence
ctgtcttccttctaggggct

SEQ ID NO: 411987 - DNA, 20 bp, Artificial
  CRISPR gRNA sequence
tcttccttctaggggcttgt

SEQ ID NO: 411988 - DNA, 20 bp, Artificial
  CRISPR gRNA sequence
ccttctaggggcttgtgcac

SEQ ID NO: 411989 - DNA, 20 bp, Artificial
  CRISPR gRNA sequence
cttctaggggcttgtgcaca

SEQ ID NO: 411990 - DNA, 20 bp, Artificial
  CRISPR gRNA sequence
ctaggggcttgtgcacatca

SEQ ID NO: 411991 - DNA, 20 bp, Artificial
  CRISPR gRNA sequence
taggggcttgtgcacatcat

SEQ ID NO: 411992 - DNA, 20 bp, Artificial
  CRISPR gRNA sequence
ggggcttgtgcacatcatgg

SEQ ID NO: 411993 - DNA, 20 bp, Artificial
  CRISPR gRNA sequence
gtgcacatcatggagtcacg

SEQ ID NO: 411994 - DNA, 20 bp, Artificial
  CRISPR gRNA sequence
tgcacatcatggagtcacgt

SEQ ID NO: 411995 - DNA, 20 bp, Artificial
  CRISPR gRNA sequence
tccacacagtgccatgaggg

SEQ ID NO: 411996 - DNA, 20 bp, Artificial
  CRISPR gRNA sequence
gaggggaggtgctggttgct

SEQ ID NO: 411997 - DNA, 20 bp, Artificial
  CRISPR gRNA sequence
gttgctggtgaagtcaaatc

SEQ ID NO: 411998 - DNA, 20 bp, Artificial
  CRISPR gRNA sequence
ctggtgaagtcaaatccaca

SEQ ID NO: 411999 - DNA, 20 bp, Artificial
  CRISPR gRNA sequence
gtgaagtcaaatccacacca

SEQ ID NO: 412000 - DNA, 20 bp, Artificial
  CRISPR gRNA sequence
ggggaactttaggagtagcc

SEQ ID NO: 412001 - DNA, 20 bp, Artificial
  CRISPR gRNA sequence
taggagtagcctctgcgcaa

SEQ ID NO: 412002 - DNA, 20 bp, Artificial
  CRISPR gRNA sequence
aggagtagcctctgcgcaaa

SEQ ID NO: 412003 - DNA, 20 bp, Artificial
  CRISPR gRNA sequence
ggagtagcctctgcgcaaag

SEQ ID NO: 412004 - DNA, 20 bp, Artificial
  CRISPR gRNA sequence
tgcgcaaaggagacctggtg

SEQ ID NO: 412005 - DNA, 20 bp, Artificial
  CRISPR gRNA sequence
cgcaaaggagacctggtgat

SEQ ID NO: 412006 - DNA, 20 bp, Artificial
  CRISPR gRNA sequence
gtgatggctcaggtctcata

SEQ ID NO: 412007 - DNA, 20 bp, Artificial
  CRISPR gRNA sequence
aggtctcataggcacagctt

SEQ ID NO: 412008 - DNA, 20 bp, Artificial
  CRISPR gRNA sequence
ataggcacagcttctggcca

SEQ ID NO: 412009 - DNA, 20 bp, Artificial
  CRISPR gRNA sequence
ctggccactacaaagcacct

SEQ ID NO: 412010 - DNA, 20 bp, Artificial
  CRISPR gRNA sequence
tggccactacaaagcacctg

SEQ ID NO: 412011 - DNA, 20 bp, Artificial
  CRISPR gRNA sequence
gccactacaaagcacctgtt

SEQ ID NO: 412012 - DNA, 20 bp, Artificial
  CRISPR gRNA sequence
caaagcacctgttctcatgg

SEQ ID NO: 412013 - DNA, 20 bp, Artificial
  CRISPR gRNA sequence
ttctcatggcctcaccagat

SEQ ID NO: 412014 - DNA, 20 bp, Artificial
  CRISPR gRNA sequence
tcatggcctcaccagatcca

SEQ ID NO: 412015 - DNA, 20 bp, Artificial
  CRISPR gRNA sequence
atggcctcaccagatccacc

SEQ ID NO: 412016 - DNA, 20 bp, Artificial
  CRISPR gRNA sequence
accagatccacccactggac

SEQ ID NO: 412017 - DNA, 20 bp, Artificial
  CRISPR gRNA sequence
gacgcttcctgtgtgggaaa

SEQ ID NO: 412018 - DNA, 20 bp, Artificial
  CRISPR gRNA sequence
cctgtgtgggaaagtccact

SEQ ID NO: 412019 - DNA, 20 bp, Artificial
  CRISPR gRNA sequence
ctgtgtgggaaagtccactc

SEQ ID NO: 412020 - DNA, 20 bp, Artificial
  CRISPR gRNA sequence
tgtgggaaagtccactccct

SEQ ID NO: 412021 - DNA, 20 bp, Artificial
  CRISPR gRNA sequence
ccttgaacagctttccagga

SEQ ID NO: 412022 - DNA, 20 bp, Artificial
  CRISPR gRNA sequence
gaacagctttccaggaatct

SEQ ID NO: 412023 - DNA, 20 bp, Artificial
  CRISPR gRNA sequence
aacagctttccaggaatctg

SEQ ID NO: 412024 - DNA, 20 bp, Artificial
  CRISPR gRNA sequence
tccaggaatctgctaaaagt

SEQ ID NO: 412025 - DNA, 20 bp, Artificial
  CRISPR gRNA sequence
ccaggaatctgctaaaagtt

SEQ ID NO: 412026 - DNA, 20 bp, Artificial
  CRISPR gRNA sequence
caggaatctgctaaaagttc

SEQ ID NO: 412027 - DNA, 20 bp, Artificial
  CRISPR gRNA sequence
ctaaaagttcccaagcacgc

SEQ ID NO: 412028 - DNA, 20 bp, Artificial
  CRISPR gRNA sequence
aaagttcccaagcacgccct

SEQ ID NO: 412029 - DNA, 20 bp, Artificial
  CRISPR gRNA sequence
ccaagcacgcccttccttcc

SEQ ID NO: 412030 - DNA, 20 bp, Artificial
  CRISPR gRNA sequence
ccttcctccttctgaggctt

SEQ ID NO: 412031 - DNA, 20 bp, Artificial
  CRISPR gRNA sequence
cttcctccttctgaggcttc

SEQ ID NO: 412032 - DNA, 20 bp, Artificial
  CRISPR gRNA sequence
cctccttctgaggcttctcc

SEQ ID NO: 412033 - DNA, 20 bp, Artificial
  CRISPR gRNA sequence
ctccttctgaggcttctccc

SEQ ID NO: 412034 - DNA, 20 bp, Artificial
  CRISPR gRNA sequence
cttctgaggcttctcccttc

SEQ ID NO: 412035 - DNA, 20 bp, Artificial
  CRISPR gRNA sequence
ctgaggcttctcccttcttc

SEQ ID NO: 412036 - DNA, 20 bp, Artificial
  CRISPR gRNA sequence
tgaggcttctcccttcttct

SEQ ID NO: 412037 - DNA, 20 bp, Artificial
  CRISPR gRNA sequence
aggcttctcccttcttctct

SEQ ID NO: 412038 - DNA, 20 bp, Artificial
  CRISPR gRNA sequence
ctcccttcttctcttcctgt

SEQ ID NO: 412039 - DNA, 20 bp, Artificial
  CRISPR gRNA sequence
tcccttcttctcttcctgtc

SEQ ID NO: 412040 - DNA, 20 bp, Artificial
  CRISPR gRNA sequence
ccttcttctcttcctgtcaa

SEQ ID NO: 412041 - DNA, 20 bp, Artificial
  CRISPR gRNA sequence
cttctcttcctgtcaaatcc

SEQ ID NO: 412042 - DNA, 20 bp, Artificial
  CRISPR gRNA sequence
ttctcttcctgtcaaatcct

SEQ ID NO: 412043 - DNA, 20 bp, Artificial
  CRISPR gRNA sequence
ctcttcctgtcaaatcctgc

SEQ ID NO: 412044 - DNA, 20 bp, Artificial
  CRISPR gRNA sequence
tcttcctgtcaaatcctgct

SEQ ID NO: 412045 - DNA, 20 bp, Artificial
  CRISPR gRNA sequence
ttcctgtcaaatcctgctct

SEQ ID NO: 412046 - DNA, 20 bp, Artificial
  CRISPR gRNA sequence
cctgtcaaatcctgctctct

SEQ ID NO: 412047 - DNA, 20 bp, Artificial
  CRISPR gRNA sequence
ctgtcaaatcctgctctctt

SEQ ID NO: 412048 - DNA, 20 bp, Artificial
  CRISPR gRNA sequence
tcaaatcctgctctcttgct

SEQ ID NO: 412049 - DNA, 20 bp, Artificial
  CRISPR gRNA sequence
ctctcttgctcttgtgccca

SEQ ID NO: 412050 - DNA, 20 bp, Artificial
  CRISPR gRNA sequence
tcttgctcttgtgcccagac

SEQ ID NO: 412051 - DNA, 20 bp, Artificial
  CRISPR gRNA sequence
ttgctcttgtgcccagaccg

SEQ ID NO: 412052 - DNA, 20 bp, Artificial
  CRISPR gRNA sequence
gctcttgtgcccagaccgta

SEQ ID NO: 412053 - DNA, 20 bp, Artificial
  CRISPR gRNA sequence
ctcttgtgcccagaccgtaa

SEQ ID NO: 412054 - DNA, 20 bp, Artificial
  CRISPR gRNA sequence
ttgtgcccagaccgtaatgg

SEQ ID NO: 412055 - DNA, 20 bp, Artificial
  CRISPR gRNA sequence
gtgcccagaccgtaatggct

SEQ ID NO: 412056 - DNA, 20 bp, Artificial
  CRISPR gRNA sequence
tgcccagaccgtaatggctt

SEQ ID NO: 412057 - DNA, 20 bp, Artificial
  CRISPR gRNA sequence
cttgaaaccagagctggagt

SEQ ID NO: 412058 - DNA, 20 bp, Artificial
  CRISPR gRNA sequence
ttgaaaccagagctggagta

SEQ ID NO: 412059 - DNA, 20 bp, Artificial
  CRISPR gRNA sequence
gaaaccagagctggagtaat

SEQ ID NO: 412060 - DNA, 20 bp, Artificial
  CRISPR gRNA sequence
aaaccagagctggagtaatc

SEQ ID NO: 412061 - DNA, 20 bp, Artificial
  CRISPR gRNA sequence
gagtaatcagaatactagtc

SEQ ID NO: 412062 - DNA, 20 bp, Artificial
  CRISPR gRNA sequence
gtccctccttccttagggac

SEQ ID NO: 412063 - DNA, 20 bp, Artificial
  CRISPR gRNA sequence
cttccttagggacagtgagg

SEQ ID NO: 412064 - DNA, 20 bp, Artificial
  CRISPR gRNA sequence
ccttagggacagtgagggct

SEQ ID NO: 412065 - DNA, 20 bp, Artificial
  CRISPR gRNA sequence
cttagggacagtgagggctt

SEQ ID NO: 412066 - DNA, 20 bp, Artificial
  CRISPR gRNA sequence
agggacagtgagggcttcac

SEQ ID NO: 412067 - DNA, 20 bp, Artificial
  CRISPR gRNA sequence
gggacagtgagggcttcacc

SEQ ID NO: 412068 - DNA, 20 bp, Artificial
  CRISPR gRNA sequence
cacctctaaaatctcccttc

SEQ ID NO: 412069 - DNA, 20 bp, Artificial
  CRISPR gRNA sequence
acctctaaaatctcccttcc

SEQ ID NO: 412070 - DNA, 20 bp, Artificial
  CRISPR gRNA sequence
taaaatctcccttccaaaaa

SEQ ID NO: 412071 - DNA, 20 bp, Artificial
  CRISPR gRNA sequence
aaatctcccttccaaaaaca

SEQ ID NO: 412072 - DNA, 20 bp, Artificial
  CRISPR gRNA sequence
ccttccaaaaacaaaagttt

SEQ ID NO: 412073 - DNA, 20 bp, Artificial
  CRISPR gRNA sequence
ccaaaaacaaaagtttattt

SEQ ID NO: 412074 - DNA, 20 bp, Artificial
  CRISPR gRNA sequence
caaaaacaaaagtttatttt

SEQ ID NO: 412075 - DNA, 20 bp, Artificial
  CRISPR gRNA sequence
attttccatattaaaacatt

SEQ ID NO: 412076 - DNA, 20 bp, Artificial
  CRISPR gRNA sequence
ttttccatattaaaacattc

SEQ ID NO: 412077 - DNA, 20 bp, Artificial
  CRISPR gRNA sequence
tccatattaaaacattctga

SEQ ID NO: 412078 - DNA, 20 bp, Artificial
  CRISPR gRNA sequence
ccatattaaaacattctgaa

SEQ ID NO: 412079 - DNA, 20 bp, Artificial
  CRISPR gRNA sequence
catattaaaacattctgaac

SEQ ID NO: 412080 - DNA, 20 bp, Artificial
  CRISPR gRNA sequence
aaacattctgaacacttatg

SEQ ID NO: 412081 - DNA, 20 bp, Artificial
  CRISPR gRNA sequence
tgaacacttatgttctctca

SEQ ID NO: 412082 - DNA, 20 bp, Artificial
  CRISPR gRNA sequence
aacacttatgttctctcatg

SEQ ID NO: 412083 - DNA, 20 bp, Artificial
  CRISPR gRNA sequence
atgttctctcatgtttatgt

SEQ ID NO: 412084 - DNA, 20 bp, Artificial
  CRISPR gRNA sequence
tgttctctcatgtttatgta

SEQ ID NO: 412085 - DNA, 20 bp, Artificial
  CRISPR gRNA sequence
tctcatgtttatgtagttta

SEQ ID NO: 412086 - DNA, 20 bp, Artificial
  CRISPR gRNA sequence
tcatgtttatgtagtttata

SEQ ID NO: 412087 - DNA, 20 bp, Artificial
  CRISPR gRNA sequence
atgtttatgtagtttatatt

SEQ ID NO: 412088 - DNA, 20 bp, Artificial
  CRISPR gRNA sequence
atgtagtttatattgtacag

SEQ ID NO: 412089 - DNA, 20 bp, Artificial
  CRISPR gRNA sequence
tgtagtttatattgtacagc

SEQ ID NO: 412090 - DNA, 20 bp, Artificial
  CRISPR gRNA sequence
atattgtacagctaaataca

SEQ ID NO: 412091 - DNA, 20 bp, Artificial
  CRISPR gRNA sequence
tattgtacagctaaatacat

SEQ ID NO: 412092 - DNA, 20 bp, Artificial
  CRISPR gRNA sequence
tacagctaaatacataatat

SEQ ID NO: 412093 - DNA, 20 bp, Artificial
  CRISPR gRNA sequence
aatacataatatatttaaat

SEQ ID NO: 412094 - DNA, 20 bp, Artificial
  CRISPR gRNA sequence
aaatggtatggtatgcctat

SEQ ID NO: 412095 - DNA, 20 bp, Artificial
  CRISPR gRNA sequence
aatggtatggtatgcctatt

SEQ ID NO: 412096 - DNA, 20 bp, Artificial
  CRISPR gRNA sequence
ttgtgtgtcctgttgcaacc

SEQ ID NO: 412097 - DNA, 20 bp, Artificial
  CRISPR gRNA sequence
tgtgtcctgttgcaacctgc

SEQ ID NO: 412098 - DNA, 20 bp, Artificial
  CRISPR gRNA sequence
ttgcaacctgcagacaccag

SEQ ID NO: 412099 - DNA, 20 bp, Artificial
  CRISPR gRNA sequence
caacctgcagacaccaggtt

SEQ ID NO: 412100 - DNA, 20 bp, Artificial
  CRISPR gRNA sequence
cagacaccaggttgtttatc

SEQ ID NO: 412101 - DNA, 20 bp, Artificial
  CRISPR gRNA sequence
tttatcttgatttcactaca

SEQ ID NO: 412102 - DNA, 20 bp, Artificial
  CRISPR gRNA sequence
atcttgatttcactacaaca

SEQ ID NO: 412103 - DNA, 20 bp, Artificial
  CRISPR gRNA sequence
tcttgatttcactacaacat

SEQ ID NO: 412104 - DNA, 20 bp, Artificial
  CRISPR gRNA sequence
gatttcactacaacatttga

SEQ ID NO: 412105 - DNA, 20 bp, Artificial
  CRISPR gRNA sequence
atttcactacaacatttgaa

SEQ ID NO: 412106 - DNA, 20 bp, Artificial
  CRISPR gRNA sequence
cactacaacatttgaaaaat

SEQ ID NO: 412107 - DNA, 20 bp, Artificial
  CRISPR gRNA sequence
actacaacatttgaaaaatt

SEQ ID NO: 412108 - DNA, 20 bp, Artificial
  CRISPR gRNA sequence
caacatttgaaaaatttcct

SEQ ID NO: 412109 - DNA, 20 bp, Artificial
  CRISPR gRNA sequence
gaaaaatttcctatttcctg

SEQ ID NO: 412110 - DNA, 20 bp, Artificial
  CRISPR gRNA sequence
aaaaatttcctatttcctga

SEQ ID NO: 412111 - DNA, 20 bp, Artificial
  CRISPR gRNA sequence
cctatttcctgaggataagc

SEQ ID NO: 412112 - DNA, 20 bp, Artificial
  CRISPR gRNA sequence
ctatttcctgaggataagca

SEQ ID NO: 412113 - DNA, 20 bp, Artificial
  CRISPR gRNA sequence
tttcctgaggataagcataa

SEQ ID NO: 412114 - DNA, 20 bp, Artificial
  CRISPR gRNA sequence
cctgaggataagcataatgg

SEQ ID NO: 412115 - DNA, 20 bp, Artificial
  CRISPR gRNA sequence
ctgaggataagcataatggt

SEQ ID NO: 412116 - DNA, 20 bp, Artificial
  CRISPR gRNA sequence
aggataagcataatggtagc

SEQ ID NO: 412117 - DNA, 20 bp, Artificial
  CRISPR gRNA sequence
taatgtagagttatacctga

SEQ ID NO: 412118 - DNA, 20 bp, Artificial
  CRISPR gRNA sequence
tacctgattaaacaacagta

SEQ ID NO: 412119 - DNA, 20 bp, Artificial
  CRISPR gRNA sequence
attaaacaacagtaataata

SEQ ID NO: 412120 - DNA, 20 bp, Artificial
  CRISPR gRNA sequence
aacaacagtaataataaaag

SEQ ID NO: 412121 - DNA, 20 bp, Artificial
  CRISPR gRNA sequence
gaaacaaaatctcctcccta

SEQ ID NO: 412122 - DNA, 20 bp, Artificial
  CRISPR gRNA sequence
ctccctacccagaaaactgc

SEQ ID NO: 412123 - DNA, 20 bp, Artificial
  CRISPR gRNA sequence
cctacccagaaaactgctcc

SEQ ID NO: 412124 - DNA, 20 bp, Artificial
  CRISPR gRNA sequence
cccagaaaactgctccacaa

SEQ ID NO: 412125 - DNA, 20 bp, Artificial
  CRISPR gRNA sequence
ctccacaaaggtagaaaaca

SEQ ID NO: 412126 - DNA, 20 bp, Artificial
  CRISPR gRNA sequence
cacaaaggtagaaaacaaaa

SEQ ID NO: 412127 - DNA, 20 bp, Artificial
  CRISPR gRNA sequence
tgttattgaataagcactaa

SEQ ID NO: 412128 - DNA, 20 bp, Artificial
  CRISPR gRNA sequence
gttattgaataagcactaaa

SEQ ID NO: 412129 - DNA, 20 bp, Artificial
  CRISPR gRNA sequence
ttattgaataagcactaaat

SEQ ID NO: 412130 - DNA, 20 bp, Artificial
  CRISPR gRNA sequence
ttgaataagcactaaatcag

SEQ ID NO: 412131 - DNA, 20 bp, Artificial
  CRISPR gRNA sequence
aataagcactaaatcagaat

SEQ ID NO: 412132 - DNA, 20 bp, Artificial
  CRISPR gRNA sequence
aatcagaatgtaatgcatgt

SEQ ID NO: 412133 - DNA, 20 bp, Artificial
  CRISPR gRNA sequence
ctaagagactgcaaagacaa

SEQ ID NO: 412134 - DNA, 20 bp, Artificial
  CRISPR gRNA sequence
agagactgcaaagacaaaga

SEQ ID NO: 412135 - DNA, 20 bp, Artificial
  CRISPR gRNA sequence
caaagacaaagaaatctcac

SEQ ID NO: 412136 - DNA, 20 bp, Artificial
  CRISPR gRNA sequence
actctctcatacagccaagt

SEQ ID NO: 412137 - DNA, 20 bp, Artificial
  CRISPR gRNA sequence
tctcatacagccaagtagat

SEQ ID NO: 412138 - DNA, 20 bp, Artificial
  CRISPR gRNA sequence
tcatacagccaagtagatac

SEQ ID NO: 412139 - DNA, 20 bp, Artificial
  CRISPR gRNA sequence
atacagccaagtagatacaa

SEQ ID NO: 412140 - DNA, 20 bp, Artificial
  CRISPR gRNA sequence
catacatgctctaaagatga

SEQ ID NO: 412141 - DNA, 20 bp, Artificial
  CRISPR gRNA sequence
taaagatgaatgataactag

SEQ ID NO: 412142 - DNA, 20 bp, Artificial
  CRISPR gRNA sequence
aagatgaatgataactagtc

SEQ ID NO: 412143 - DNA, 20 bp, Artificial
  CRISPR gRNA sequence
gtcttcaagtaagagggctt

SEQ ID NO: 412144 - DNA, 20 bp, Artificial
  CRISPR gRNA sequence
caagtaagagggcttgtcag

SEQ ID NO: 412145 - DNA, 20 bp, Artificial
  CRISPR gRNA sequence
aagtaagagggcttgtcaga

SEQ ID NO: 412146 - DNA, 20 bp, Artificial
  CRISPR gRNA sequence
gtcagacatttgtcacacat

SEQ ID NO: 412147 - DNA, 20 bp, Artificial
  CRISPR gRNA sequence
tcagacatttgtcacacatg

SEQ ID NO: 412148 - DNA, 20 bp, Artificial
  CRISPR gRNA sequence
gtcacacatgcttcatccta

SEQ ID NO: 412149 - DNA, 20 bp, Artificial
  CRISPR gRNA sequence
tcacacatgcttcatcctag

SEQ ID NO: 412150 - DNA, 20 bp, Artificial
  CRISPR gRNA sequence
catcctagattcaactggta

SEQ ID NO: 412151 - DNA, 20 bp, Artificial
  CRISPR gRNA sequence
atcctagattcaactggtaa

SEQ ID NO: 412152 - DNA, 20 bp, Artificial
  CRISPR gRNA sequence
gattcaactggtaattgggg

SEQ ID NO: 412153 - DNA, 20 bp, Artificial
  CRISPR gRNA sequence
aactggtaattggggatgac

SEQ ID NO: 412154 - DNA, 20 bp, Artificial
  CRISPR gRNA sequence
gtaattggggatgactgtgt

SEQ ID NO: 412155 - DNA, 20 bp, Artificial
  CRISPR gRNA sequence
gggatgactgtgtgtgttag

SEQ ID NO: 412156 - DNA, 20 bp, Artificial
  CRISPR gRNA sequence
tgtgtgttagctaataattg

SEQ ID NO: 412157 - DNA, 20 bp, Artificial
  CRISPR gRNA sequence
gctaataattggctttatcc

SEQ ID NO: 412158 - DNA, 20 bp, Artificial
  CRISPR gRNA sequence
ataattggctttatccaaag

SEQ ID NO: 412159 - DNA, 20 bp, Artificial
  CRISPR gRNA sequence
gctttatccaaaggaaaaac

SEQ ID NO: 412160 - DNA, 20 bp, Artificial
  CRISPR gRNA sequence
tatccaaaggaaaaacaaac

SEQ ID NO: 412161 - DNA, 20 bp, Artificial
  CRISPR gRNA sequence
atccaaaggaaaaacaaact

SEQ ID NO: 412162 - DNA, 20 bp, Artificial
  CRISPR gRNA sequence
tccaaaggaaaaacaaactt

SEQ ID NO: 412163 - DNA, 20 bp, Artificial
  CRISPR gRNA sequence
ctcacatctttatgacagga

SEQ ID NO: 412164 - DNA, 20 bp, Artificial
  CRISPR gRNA sequence
tcacatctttatgacaggag

SEQ ID NO: 412165 - DNA, 20 bp, Artificial
  CRISPR gRNA sequence
acatctttatgacaggaggt

SEQ ID NO: 412166 - DNA, 20 bp, Artificial
  CRISPR gRNA sequence
tatgacaggaggtacttttg

SEQ ID NO: 412167 - DNA, 20 bp, Artificial
  CRISPR gRNA sequence
atgacaggaggtacttttgc

SEQ ID NO: 412168 - DNA, 20 bp, Artificial
  CRISPR gRNA sequence
tgacaggaggtacttttgca

SEQ ID NO: 412169 - DNA, 20 bp, Artificial
  CRISPR gRNA sequence
ttgcaccttgagtgaggtgc

SEQ ID NO: 412170 - DNA, 20 bp, Artificial
  CRISPR gRNA sequence
tgcaccttgagtgaggtgct

SEQ ID NO: 412171 - DNA, 20 bp, Artificial
  CRISPR gRNA sequence
gcaccttgagtgaggtgctt

SEQ ID NO: 412172 - DNA, 20 bp, Artificial
  CRISPR gRNA sequence
caccttgagtgaggtgcttg

SEQ ID NO: 412173 - DNA, 20 bp, Artificial
  CRISPR gRNA sequence
gagtgaggtgcttgtggtag

SEQ ID NO: 412174 - DNA, 20 bp, Artificial
  CRISPR gRNA sequence
agtgaggtgcttgtggtagt

SEQ ID NO: 412175 - DNA, 20 bp, Artificial
  CRISPR gRNA sequence
gtggtagttttctaccctct

SEQ ID NO: 412176 - DNA, 20 bp, Artificial
  CRISPR gRNA sequence
tggtagttttctaccctctc

SEQ ID NO: 412177 - DNA, 20 bp, Artificial
  CRISPR gRNA sequence
tctaccctctcagaaattgg

SEQ ID NO: 412178 - DNA, 20 bp, Artificial
  CRISPR gRNA sequence
ctaccctctcagaaattggg

SEQ ID NO: 412179 - DNA, 20 bp, Artificial
  CRISPR gRNA sequence
taccctctcagaaattggga

SEQ ID NO: 412180 - DNA, 20 bp, Artificial
  CRISPR gRNA sequence
ccctctcagaaattgggagg

SEQ ID NO: 412181 - DNA, 20 bp, Artificial
  CRISPR gRNA sequence
tcagaaattgggaggtaagg

SEQ ID NO: 412182 - DNA, 20 bp, Artificial
  CRISPR gRNA sequence
agaaattgggaggtaagggt

SEQ ID NO: 412183 - DNA, 20 bp, Artificial
  CRISPR gRNA sequence
ggaggtaagggtgctgtctt

SEQ ID NO: 412184 - DNA, 20 bp, Artificial
  CRISPR gRNA sequence
tcttccttgatggttacatt

SEQ ID NO: 412185 - DNA, 20 bp, Artificial
  CRISPR gRNA sequence
ccttgatggttacatttcaa

SEQ ID NO: 412186 - DNA, 20 bp, Artificial
  CRISPR gRNA sequence
cttgatggttacatttcaaa

SEQ ID NO: 412187 - DNA, 20 bp, Artificial
  CRISPR gRNA sequence
gatggttacatttcaaaggg

SEQ ID NO: 412188 - DNA, 20 bp, Artificial
  CRISPR gRNA sequence
atggttacatttcaaaggga

SEQ ID NO: 412189 - DNA, 20 bp, Artificial
  CRISPR gRNA sequence
catttcaaagggatggctcc

SEQ ID NO: 412190 - DNA, 20 bp, Artificial
  CRISPR gRNA sequence
caaagggatggctcccaggt

SEQ ID NO: 412191 - DNA, 20 bp, Artificial
  CRISPR gRNA sequence
aaagggatggctcccaggtc

SEQ ID NO: 412192 - DNA, 20 bp, Artificial
  CRISPR gRNA sequence
ccaggtcctcgagaaagaca

SEQ ID NO: 412193 - DNA, 20 bp, Artificial
  CRISPR gRNA sequence
gagaaagacatttctccatc

SEQ ID NO: 412194 - DNA, 20 bp, Artificial
  CRISPR gRNA sequence
ctccatcaaaagctgacaaa

SEQ ID NO: 412195 - DNA, 20 bp, Artificial
  CRISPR gRNA sequence
tccatcaaaagctgacaaaa

SEQ ID NO: 412196 - DNA, 20 bp, Artificial
  CRISPR gRNA sequence
catcaaaagctgacaaaaga

SEQ ID NO: 412197 - DNA, 20 bp, Artificial
  CRISPR gRNA sequence
acaaaagacttatctggccg

SEQ ID NO: 412198 - DNA, 20 bp, Artificial
  CRISPR gRNA sequence
atctggccgttaaaaagatg

SEQ ID NO: 412199 - DNA, 20 bp, Artificial
  CRISPR gRNA sequence
tctggccgttaaaaagatgt

SEQ ID NO: 412200 - DNA, 20 bp, Artificial
  CRISPR gRNA sequence
gccgttaaaaagatgtgcat

SEQ ID NO: 412201 - DNA, 20 bp, Artificial
  CRISPR gRNA sequence
aaaagatgtgcatgtctttc

SEQ ID NO: 412202 - DNA, 20 bp, Artificial
  CRISPR gRNA sequence
tcaaagagacagagacagaa

SEQ ID NO: 412203 - DNA, 20 bp, Artificial
  CRISPR gRNA sequence
caaagagacagagacagaac

SEQ ID NO: 412204 - DNA, 20 bp, Artificial
  CRISPR gRNA sequence
aaagagacagagacagaact

SEQ ID NO: 412205 - DNA, 20 bp, Artificial
  CRISPR gRNA sequence
ccaattacaagttttctaaa

SEQ ID NO: 412206 - DNA, 20 bp, Artificial
  CRISPR gRNA sequence
caagttttctaaagtcaata

SEQ ID NO: 412207 - DNA, 20 bp, Artificial
  CRISPR gRNA sequence
tctaaagtcaataccctaag

SEQ ID NO: 412208 - DNA, 20 bp, Artificial
  CRISPR gRNA sequence
ctaaagtcaataccctaaga

SEQ ID NO: 412209 - DNA, 20 bp, Artificial
  CRISPR gRNA sequence
taaagtcaataccctaagaa

SEQ ID NO: 412210 - DNA, 20 bp, Artificial
  CRISPR gRNA sequence
aagtcaataccctaagaaag

SEQ ID NO: 412211 - DNA, 20 bp, Artificial
  CRISPR gRNA sequence
agaaaggagggaggagaaat

SEQ ID NO: 412212 - DNA, 20 bp, Artificial
  CRISPR gRNA sequence
gcagactggggctcagcagc

SEQ ID NO: 412213 - DNA, 20 bp, Artificial
  CRISPR gRNA sequence
gggctcagcagctggagctc

SEQ ID NO: 412214 - DNA, 20 bp, Artificial
  CRISPR gRNA sequence
agcagctggagctcccctgg

SEQ ID NO: 412215 - DNA, 20 bp, Artificial
  CRISPR gRNA sequence
gagctcccctggaaggtgct

SEQ ID NO: 412216 - DNA, 20 bp, Artificial
  CRISPR gRNA sequence
ccctggaaggtgctttctag

SEQ ID NO: 412217 - DNA, 20 bp, Artificial
  CRISPR gRNA sequence
gaaggtgctttctagagtag

SEQ ID NO: 412218 - DNA, 20 bp, Artificial
  CRISPR gRNA sequence
tctagagtagagcagtgttt

SEQ ID NO: 412219 - DNA, 20 bp, Artificial
  CRISPR gRNA sequence
ctagagtagagcagtgtttc

SEQ ID NO: 412220 - DNA, 20 bp, Artificial
  CRISPR gRNA sequence
tagagtagagcagtgtttct

SEQ ID NO: 412221 - DNA, 20 bp, Artificial
  CRISPR gRNA sequence
gagtagagcagtgtttctca

SEQ ID NO: 412222 - DNA, 20 bp, Artificial
  CRISPR gRNA sequence
ctcaatgccattctgtggaa

SEQ ID NO: 412223 - DNA, 20 bp, Artificial
  CRISPR gRNA sequence
tcaatgccattctgtggaac

SEQ ID NO: 412224 - DNA, 20 bp, Artificial
  CRISPR gRNA sequence
aatgccattctgtggaacac

SEQ ID NO: 412225 - DNA, 20 bp, Artificial
  CRISPR gRNA sequence
tgtggaacaccaacatcagg

SEQ ID NO: 412226 - DNA, 20 bp, Artificial
  CRISPR gRNA sequence
tggaacaccaacatcaggat

SEQ ID NO: 412227 - DNA, 20 bp, Artificial
  CRISPR gRNA sequence
gtatgcttgctgaaagacat

SEQ ID NO: 412228 - DNA, 20 bp, Artificial
  CRISPR gRNA sequence
gctgaaagacatggattcct

SEQ ID NO: 412229 - DNA, 20 bp, Artificial
  CRISPR gRNA sequence
ctgaaagacatggattcctg

SEQ ID NO: 412230 - DNA, 20 bp, Artificial
  CRISPR gRNA sequence
aaagacatggattcctggga

SEQ ID NO: 412231 - DNA, 20 bp, Artificial
  CRISPR gRNA sequence
ctgggacttgttcccaggcc

SEQ ID NO: 412232 - DNA, 20 bp, Artificial
  CRISPR gRNA sequence
ggacttgttcccaggcctag

SEQ ID NO: 412233 - DNA, 20 bp, Artificial
  CRISPR gRNA sequence
gttcccaggcctaggaatca

SEQ ID NO: 412234 - DNA, 20 bp, Artificial
  CRISPR gRNA sequence
ttcccaggcctaggaatcag

SEQ ID NO: 412235 - DNA, 20 bp, Artificial
  CRISPR gRNA sequence
ccaggcctaggaatcagggt

SEQ ID NO: 412236 - DNA, 20 bp, Artificial
  CRISPR gRNA sequence
ggaatcagggtgatattcca

SEQ ID NO: 412237 - DNA, 20 bp, Artificial
  CRISPR gRNA sequence
cacaaggctccatgtggtca

SEQ ID NO: 412238 - DNA, 20 bp, Artificial
  CRISPR gRNA sequence
catgtggtcatttgtattgt

SEQ ID NO: 412239 - DNA, 20 bp, Artificial
  CRISPR gRNA sequence
gtattgttttgttttagaga

SEQ ID NO: 412240 - DNA, 20 bp, Artificial
  CRISPR gRNA sequence
tattgttttgttttagagac

SEQ ID NO: 412241 - DNA, 20 bp, Artificial
  CRISPR gRNA sequence
ttttgttttagagacagggt

SEQ ID NO: 412242 - DNA, 20 bp, Artificial
  CRISPR gRNA sequence
tgttttagagacagggtctt

SEQ ID NO: 412243 - DNA, 20 bp, Artificial
  CRISPR gRNA sequence
gttttagagacagggtcttg

SEQ ID NO: 412244 - DNA, 20 bp, Artificial
  CRISPR gRNA sequence
ttttagagacagggtcttgc

SEQ ID NO: 412245 - DNA, 20 bp, Artificial
  CRISPR gRNA sequence
tagagacagggtcttgctct

SEQ ID NO: 412246 - DNA, 20 bp, Artificial
  CRISPR gRNA sequence
agagacagggtcttgctctg

SEQ ID NO: 412247 - DNA, 20 bp, Artificial
  CRISPR gRNA sequence
gagacagggtcttgctctgt

SEQ ID NO: 412248 - DNA, 20 bp, Artificial
  CRISPR gRNA sequence
gctctgtcatccaggcctgg

SEQ ID NO: 412249 - DNA, 20 bp, Artificial
  CRISPR gRNA sequence
ctctgtcatccaggcctggg

SEQ ID NO: 412250 - DNA, 20 bp, Artificial
  CRISPR gRNA sequence
tgtcatccaggcctgggact

SEQ ID NO: 412251 - DNA, 20 bp, Artificial
  CRISPR gRNA sequence
tcatccaggcctgggactac

SEQ ID NO: 412252 - DNA, 20 bp, Artificial
  CRISPR gRNA sequence
ggactacagtccttaggacg

SEQ ID NO: 412253 - DNA, 20 bp, Artificial
  CRISPR gRNA sequence
cagtccttaggacggcctgc

SEQ ID NO: 412254 - DNA, 20 bp, Artificial
  CRISPR gRNA sequence
aggacggcctgcctgcaagg

SEQ ID NO: 412255 - DNA, 20 bp, Artificial
  CRISPR gRNA sequence
ggacggcctgcctgcaaggt

SEQ ID NO: 412256 - DNA, 20 bp, Artificial
  CRISPR gRNA sequence
cctgcaaggttggctctctg

SEQ ID NO: 412257 - DNA, 20 bp, Artificial
  CRISPR gRNA sequence
caaggttggctctctgtggg

SEQ ID NO: 412258 - DNA, 20 bp, Artificial
  CRISPR gRNA sequence
gctctctgtgggcatgtgag

SEQ ID NO: 412259 - DNA, 20 bp, Artificial
  CRISPR gRNA sequence
tctgtgggcatgtgagaact

SEQ ID NO: 412260 - DNA, 20 bp, Artificial
  CRISPR gRNA sequence
tgtgggcatgtgagaacttg

SEQ ID NO: 412261 - DNA, 20 bp, Artificial
  CRISPR gRNA sequence
tgggcatgtgagaacttgga

SEQ ID NO: 412262 - DNA, 20 bp, Artificial
  CRISPR gRNA sequence
ggatttttggaggctttcaa

SEQ ID NO: 412263 - DNA, 20 bp, Artificial
  CRISPR gRNA sequence
gatttttggaggctttcaac

SEQ ID NO: 412264 - DNA, 20 bp, Artificial
  CRISPR gRNA sequence
ttggaggctttcaacaattc

SEQ ID NO: 412265 - DNA, 20 bp, Artificial
  CRISPR gRNA sequence
tggaggctttcaacaattct

SEQ ID NO: 412266 - DNA, 20 bp, Artificial
  CRISPR gRNA sequence
ggaggctttcaacaattctc

SEQ ID NO: 412267 - DNA, 20 bp, Artificial
  CRISPR gRNA sequence
gaggctttcaacaattctct

SEQ ID NO: 412268 - DNA, 20 bp, Artificial
  CRISPR gRNA sequence
tcaacaattctctgactgct

SEQ ID NO: 412269 - DNA, 20 bp, Artificial
  CRISPR gRNA sequence
caacaattctctgactgctg

SEQ ID NO: 412270 - DNA, 20 bp, Artificial
  CRISPR gRNA sequence
aacaattctctgactgctgg

SEQ ID NO: 412271 - DNA, 20 bp, Artificial
  CRISPR gRNA sequence
tctgactgctggggtggctt

SEQ ID NO: 412272 - DNA, 20 bp, Artificial
  CRISPR gRNA sequence
tgactgctggggtggcttat

SEQ ID NO: 412273 - DNA, 20 bp, Artificial
  CRISPR gRNA sequence
actgctggggtggcttattc

SEQ ID NO: 412274 - DNA, 20 bp, Artificial
  CRISPR gRNA sequence
ctggggtggcttattctgtc

SEQ ID NO: 412275 - DNA, 20 bp, Artificial
  CRISPR gRNA sequence
gggtggcttattctgtctaa

SEQ ID NO: 412276 - DNA, 20 bp, Artificial
  CRISPR gRNA sequence
attctgtctaaatgtttata

SEQ ID NO: 412277 - DNA, 20 bp, Artificial
  CRISPR gRNA sequence
ttctgtctaaatgtttatac

SEQ ID NO: 412278 - DNA, 20 bp, Artificial
  CRISPR gRNA sequence
tgtctaaatgtttatacaac

SEQ ID NO: 412279 - DNA, 20 bp, Artificial
  CRISPR gRNA sequence
tctaaatgtttatacaaccc

SEQ ID NO: 412280 - DNA, 20 bp, Artificial
  CRISPR gRNA sequence
aatgtttatacaacccatgt

SEQ ID NO: 412281 - DNA, 20 bp, Artificial
  CRISPR gRNA sequence
atacaacccatgtggtttat

SEQ ID NO: 412282 - DNA, 20 bp, Artificial
  CRISPR gRNA sequence
tacaacccatgtggtttatg

SEQ ID NO: 412283 - DNA, 20 bp, Artificial
  CRISPR gRNA sequence
atgctaaacacctgcttttc

SEQ ID NO: 412284 - DNA, 20 bp, Artificial
  CRISPR gRNA sequence
tgctaaacacctgcttttct

SEQ ID NO: 412285 - DNA, 20 bp, Artificial
  CRISPR gRNA sequence
aacacctgcttttcttcagg

SEQ ID NO: 412286 - DNA, 20 bp, Artificial
  CRISPR gRNA sequence
cttttcttcagggacatcag

SEQ ID NO: 412287 - DNA, 20 bp, Artificial
  CRISPR gRNA sequence
ttcttcagggacatcagcca

SEQ ID NO: 412288 - DNA, 20 bp, Artificial
  CRISPR gRNA sequence
tcttcagggacatcagccag

SEQ ID NO: 412289 - DNA, 20 bp, Artificial
  CRISPR gRNA sequence
cttcagggacatcagccagt

SEQ ID NO: 412290 - DNA, 20 bp, Artificial
  CRISPR gRNA sequence
ttcagggacatcagccagtc

SEQ ID NO: 412291 - DNA, 20 bp, Artificial
  CRISPR gRNA sequence
cagggacatcagccagtcct

SEQ ID NO: 412292 - DNA, 20 bp, Artificial
  CRISPR gRNA sequence
agggacatcagccagtcctt

SEQ ID NO: 412293 - DNA, 20 bp, Artificial
  CRISPR gRNA sequence
ctgactttgcccaggcagtt

SEQ ID NO: 412294 - DNA, 20 bp, Artificial
  CRISPR gRNA sequence
tgactttgcccaggcagttt

SEQ ID NO: 412295 - DNA, 20 bp, Artificial
  CRISPR gRNA sequence
actttgcccaggcagtttat

SEQ ID NO: 412296 - DNA, 20 bp, Artificial
  CRISPR gRNA sequence
tgcccaggcagtttatccct

SEQ ID NO: 412297 - DNA, 20 bp, Artificial
  CRISPR gRNA sequence
gcccaggcagtttatccctt

SEQ ID NO: 412298 - DNA, 20 bp, Artificial
  CRISPR gRNA sequence
cccaggcagtttatcccttt

SEQ ID NO: 412299 - DNA, 20 bp, Artificial
  CRISPR gRNA sequence
atccctttgctgatttgctt

SEQ ID NO: 412300 - DNA, 20 bp, Artificial
  CRISPR gRNA sequence
tccctttgctgatttgcttt

SEQ ID NO: 412301 - DNA, 20 bp, Artificial
  CRISPR gRNA sequence
tgctgatttgctttggatcc

SEQ ID NO: 412302 - DNA, 20 bp, Artificial
  CRISPR gRNA sequence
gctgatttgctttggatcct

SEQ ID NO: 412303 - DNA, 20 bp, Artificial
  CRISPR gRNA sequence
ctgatttgctttggatcctt

SEQ ID NO: 412304 - DNA, 20 bp, Artificial
  CRISPR gRNA sequence
atttgctttggatccttctg

SEQ ID NO: 412305 - DNA, 20 bp, Artificial
  CRISPR gRNA sequence
gctttggatccttctgctgt

SEQ ID NO: 412306 - DNA, 20 bp, Artificial
  CRISPR gRNA sequence
ctttggatccttctgctgtc

SEQ ID NO: 412307 - DNA, 20 bp, Artificial
  CRISPR gRNA sequence
tggatccttctgctgtcata

SEQ ID NO: 412308 - DNA, 20 bp, Artificial
  CRISPR gRNA sequence
ggatccttctgctgtcataa

SEQ ID NO: 412309 - DNA, 20 bp, Artificial
  CRISPR gRNA sequence
gatccttctgctgtcataaa

SEQ ID NO: 412310 - DNA, 20 bp, Artificial
  CRISPR gRNA sequence
ctgctgtcataaacctgagc

SEQ ID NO: 412311 - DNA, 20 bp, Artificial
  CRISPR gRNA sequence
tgctgtcataaacctgagct

SEQ ID NO: 412312 - DNA, 20 bp, Artificial
  CRISPR gRNA sequence
ctgtcataaacctgagctgt

SEQ ID NO: 412313 - DNA, 20 bp, Artificial
  CRISPR gRNA sequence
tcataaacctgagctgtgac

SEQ ID NO: 412314 - DNA, 20 bp, Artificial
  CRISPR gRNA sequence
agctgtgacgtgggtacagg

SEQ ID NO: 412315 - DNA, 20 bp, Artificial
  CRISPR gRNA sequence
tgacgtgggtacaggctgaa

SEQ ID NO: 412316 - DNA, 20 bp, Artificial
  CRISPR gRNA sequence
aaagctgtgtgtccttccag

SEQ ID NO: 412317 - DNA, 20 bp, Artificial
  CRISPR gRNA sequence
tgtgtccttccagcaaatcc

SEQ ID NO: 412318 - DNA, 20 bp, Artificial
  CRISPR gRNA sequence
ccagcaaatcccagatcctg

SEQ ID NO: 412319 - DNA, 20 bp, Artificial
  CRISPR gRNA sequence
cagcaaatcccagatcctgg

SEQ ID NO: 412320 - DNA, 20 bp, Artificial
  CRISPR gRNA sequence
gggagggggcaccctgaaca

SEQ ID NO: 412321 - DNA, 20 bp, Artificial
  CRISPR gRNA sequence
aacacaaccgtgaaatagtg

SEQ ID NO: 412322 - DNA, 20 bp, Artificial
  CRISPR gRNA sequence
gttgccttttaatactgatg

SEQ ID NO: 412323 - DNA, 20 bp, Artificial
  CRISPR gRNA sequence
ccttttaatactgatggctc

SEQ ID NO: 412324 - DNA, 20 bp, Artificial
  CRISPR gRNA sequence
ttaatactgatggctcattt

SEQ ID NO: 412325 - DNA, 20 bp, Artificial
  CRISPR gRNA sequence
taatactgatggctcatttt

SEQ ID NO: 412326 - DNA, 20 bp, Artificial
  CRISPR gRNA sequence
aatactgatggctcatttta

SEQ ID NO: 412327 - DNA, 20 bp, Artificial
  CRISPR gRNA sequence
atactgatggctcattttaa

SEQ ID NO: 412328 - DNA, 20 bp, Artificial
  CRISPR gRNA sequence
atggctcattttaagatgat

SEQ ID NO: 412329 - DNA, 20 bp, Artificial
  CRISPR gRNA sequence
attttaagatgatatttcta

SEQ ID NO: 412330 - DNA, 20 bp, Artificial
  CRISPR gRNA sequence
taagatgatatttctattgt

SEQ ID NO: 412331 - DNA, 20 bp, Artificial
  CRISPR gRNA sequence
aagatgatatttctattgtt

SEQ ID NO: 412332 - DNA, 20 bp, Artificial
  CRISPR gRNA sequence
agatgatatttctattgtta

SEQ ID NO: 412333 - DNA, 20 bp, Artificial
  CRISPR gRNA sequence
ctattgttataagaacatat

SEQ ID NO: 412334 - DNA, 20 bp, Artificial
  CRISPR gRNA sequence
tattgttataagaacatata

SEQ ID NO: 412335 - DNA, 20 bp, Artificial
  CRISPR gRNA sequence
ttgttataagaacatataca

SEQ ID NO: 412336 - DNA, 20 bp, Artificial
  CRISPR gRNA sequence
ttataagaacatatacattc

SEQ ID NO: 412337 - DNA, 20 bp, Artificial
  CRISPR gRNA sequence
taagaacatatacattctca

SEQ ID NO: 412338 - DNA, 20 bp, Artificial
  CRISPR gRNA sequence
tcatactagttttatttgaa

SEQ ID NO: 412339 - DNA, 20 bp, Artificial
  CRISPR gRNA sequence
atactagttttatttgaaac

SEQ ID NO: 412340 - DNA, 20 bp, Artificial
  CRISPR gRNA sequence
gttttatttgaaacacagtt

SEQ ID NO: 412341 - DNA, 20 bp, Artificial
  CRISPR gRNA sequence
tatttgaaacacagtttgca

SEQ ID NO: 412342 - DNA, 20 bp, Artificial
  CRISPR gRNA sequence
atttgaaacacagtttgcat

SEQ ID NO: 412343 - DNA, 20 bp, Artificial
  CRISPR gRNA sequence
tttgaaacacagtttgcata

SEQ ID NO: 412344 - DNA, 20 bp, Artificial
  CRISPR gRNA sequence
gaaacacagtttgcatatac

SEQ ID NO: 412345 - DNA, 20 bp, Artificial
  CRISPR gRNA sequence
aaacacagtttgcatataca

SEQ ID NO: 412346 - DNA, 20 bp, Artificial
  CRISPR gRNA sequence
gcatatacaataggccttat

SEQ ID NO: 412347 - DNA, 20 bp, Artificial
  CRISPR gRNA sequence
catatacaataggccttatt

SEQ ID NO: 412348 - DNA, 20 bp, Artificial
  CRISPR gRNA sequence
atttctgtaggcaataagta

SEQ ID NO: 412349 - DNA, 20 bp, Artificial
  CRISPR gRNA sequence
tttctgtaggcaataagtaa

SEQ ID NO: 412350 - DNA, 20 bp, Artificial
  CRISPR gRNA sequence
ctgtaggcaataagtaatga

SEQ ID NO: 412351 - DNA, 20 bp, Artificial
  CRISPR gRNA sequence
tgtaggcaataagtaatgac

SEQ ID NO: 412352 - DNA, 20 bp, Artificial
  CRISPR gRNA sequence
taggcaataagtaatgacat

SEQ ID NO: 412353 - DNA, 20 bp, Artificial
  CRISPR gRNA sequence
atatacatacatcttctaag

SEQ ID NO: 412354 - DNA, 20 bp, Artificial
  CRISPR gRNA sequence
tatacatacatcttctaagt

SEQ ID NO: 412355 - DNA, 20 bp, Artificial
  CRISPR gRNA sequence
ctaagtttagtaaagcttat

SEQ ID NO: 412356 - DNA, 20 bp, Artificial
  CRISPR gRNA sequence
taagtttagtaaagcttatt

SEQ ID NO: 412357 - DNA, 20 bp, Artificial
  CRISPR gRNA sequence
agtttagtaaagcttattcc

SEQ ID NO: 412358 - DNA, 20 bp, Artificial
  CRISPR gRNA sequence
agtaaagcttattcctttta

SEQ ID NO: 412359 - DNA, 20 bp, Artificial
  CRISPR gRNA sequence
gtaaagcttattccttttat

SEQ ID NO: 412360 - DNA, 20 bp, Artificial
  CRISPR gRNA sequence
attccttttatgtaccaagt

SEQ ID NO: 412361 - DNA, 20 bp, Artificial
  CRISPR gRNA sequence
ttccttttatgtaccaagtt

SEQ ID NO: 412362 - DNA, 20 bp, Artificial
  CRISPR gRNA sequence
cttttatgtaccaagttttt

SEQ ID NO: 412363 - DNA, 20 bp, Artificial
  CRISPR gRNA sequence
ttatgtaccaagtttttaaa

SEQ ID NO: 412364 - DNA, 20 bp, Artificial
  CRISPR gRNA sequence
tatgtaccaagtttttaaat

SEQ ID NO: 412365 - DNA, 20 bp, Artificial
  CRISPR gRNA sequence
atgtaccaagtttttaaatt

SEQ ID NO: 412366 - DNA, 20 bp, Artificial
  CRISPR gRNA sequence
tgtaccaagtttttaaatta

SEQ ID NO: 412367 - DNA, 20 bp, Artificial
  CRISPR gRNA sequence
ttaaattatcatttttagat

SEQ ID NO: 412368 - DNA, 20 bp, Artificial
  CRISPR gRNA sequence
taaattatcatttttagatg

SEQ ID NO: 412369 - DNA, 20 bp, Artificial
  CRISPR gRNA sequence
aaattatcatttttagatgg

SEQ ID NO: 412370 - DNA, 20 bp, Artificial
  CRISPR gRNA sequence
aattatcatttttagatgga

SEQ ID NO: 412371 - DNA, 20 bp, Artificial
  CRISPR gRNA sequence
tcatttttagatggaaagaa

SEQ ID NO: 412372 - DNA, 20 bp, Artificial
  CRISPR gRNA sequence
ttagatggaaagaattcgaa

SEQ ID NO: 412373 - DNA, 20 bp, Artificial
  CRISPR gRNA sequence
tagatggaaagaattcgaag

SEQ ID NO: 412374 - DNA, 20 bp, Artificial
  CRISPR gRNA sequence
agatggaaagaattcgaagc

SEQ ID NO: 412375 - DNA, 20 bp, Artificial
  CRISPR gRNA sequence
gatggaaagaattcgaagct

SEQ ID NO: 412376 - DNA, 20 bp, Artificial
  CRISPR gRNA sequence
gaagctggatagcatgtttc

SEQ ID NO: 412377 - DNA, 20 bp, Artificial
  CRISPR gRNA sequence
gatagcatgtttctttgcct

SEQ ID NO: 412378 - DNA, 20 bp, Artificial
  CRISPR gRNA sequence
ctttgccttactaaacagag

SEQ ID NO: 412379 - DNA, 20 bp, Artificial
  CRISPR gRNA sequence
tttgccttactaaacagagg

SEQ ID NO: 412380 - DNA, 20 bp, Artificial
  CRISPR gRNA sequence
tgccttactaaacagaggac

SEQ ID NO: 412381 - DNA, 20 bp, Artificial
  CRISPR gRNA sequence
gccttactaaacagaggaca

SEQ ID NO: 412382 - DNA, 20 bp, Artificial
  CRISPR gRNA sequence
ccttactaaacagaggacaa

SEQ ID NO: 412383 - DNA, 20 bp, Artificial
  CRISPR gRNA sequence
actaaacagaggacaataga

SEQ ID NO: 412384 - DNA, 20 bp, Artificial
  CRISPR gRNA sequence
ctaaacagaggacaatagat

SEQ ID NO: 412385 - DNA, 20 bp, Artificial
  CRISPR gRNA sequence
aacagaggacaatagatata

SEQ ID NO: 412386 - DNA, 20 bp, Artificial
  CRISPR gRNA sequence
tggctgtcctggtgtcctct

SEQ ID NO: 412387 - DNA, 20 bp, Artificial
  CRISPR gRNA sequence
tcctggtgtcctctgagcac

SEQ ID NO: 412388 - DNA, 20 bp, Artificial
  CRISPR gRNA sequence
gtgtcctctgagcaccaagt

SEQ ID NO: 412389 - DNA, 20 bp, Artificial
  CRISPR gRNA sequence
tgagcaccaagtcttgcgct

SEQ ID NO: 412390 - DNA, 20 bp, Artificial
  CRISPR gRNA sequence
agcaccaagtcttgcgcttt

SEQ ID NO: 412391 - DNA, 20 bp, Artificial
  CRISPR gRNA sequence
gcgctttgctctatgtggtg

SEQ ID NO: 412392 - DNA, 20 bp, Artificial
  CRISPR gRNA sequence
cgctttgctctatgtggtgg

SEQ ID NO: 412393 - DNA, 20 bp, Artificial
  CRISPR gRNA sequence
tgctctatgtggtgggatat

SEQ ID NO: 412394 - DNA, 20 bp, Artificial
  CRISPR gRNA sequence
gctctatgtggtgggatata

SEQ ID NO: 412395 - DNA, 20 bp, Artificial
  CRISPR gRNA sequence
ctctatgtggtgggatataa

SEQ ID NO: 412396 - DNA, 20 bp, Artificial
  CRISPR gRNA sequence
tatgtggtgggatataatga

SEQ ID NO: 412397 - DNA, 20 bp, Artificial
  CRISPR gRNA sequence
tgtggtgggatataatgaga

SEQ ID NO: 412398 - DNA, 20 bp, Artificial
  CRISPR gRNA sequence
atccccgctttaaattacct

SEQ ID NO: 412399 - DNA, 20 bp, Artificial
  CRISPR gRNA sequence
taaattaccttgtgccatta

SEQ ID NO: 412400 - DNA, 20 bp, Artificial
  CRISPR gRNA sequence
aaattaccttgtgccattat

SEQ ID NO: 412401 - DNA, 20 bp, Artificial
  CRISPR gRNA sequence
aattaccttgtgccattata

SEQ ID NO: 412402 - DNA, 20 bp, Artificial
  CRISPR gRNA sequence
ccttgtgccattatactctt

SEQ ID NO: 412403 - DNA, 20 bp, Artificial
  CRISPR gRNA sequence
gtgccattatactcttgtat

SEQ ID NO: 412404 - DNA, 20 bp, Artificial
  CRISPR gRNA sequence
tgccattatactcttgtatg

SEQ ID NO: 412405 - DNA, 20 bp, Artificial
  CRISPR gRNA sequence
tactcttgtatgtttgtttg

SEQ ID NO: 412406 - DNA, 20 bp, Artificial
  CRISPR gRNA sequence
ttgtatgtttgtttgtttga

SEQ ID NO: 412407 - DNA, 20 bp, Artificial
  CRISPR gRNA sequence
gtatgtttgtttgtttgaat

SEQ ID NO: 412408 - DNA, 20 bp, Artificial
  CRISPR gRNA sequence
tatgtttgtttgtttgaatt

SEQ ID NO: 412409 - DNA, 20 bp, Artificial
  CRISPR gRNA sequence
gtttgtttgaatttggtccc

SEQ ID NO: 412410 - DNA, 20 bp, Artificial
  CRISPR gRNA sequence
tttgtttgaatttggtcccc

SEQ ID NO: 412411 - DNA, 20 bp, Artificial
  CRISPR gRNA sequence
gtttgaatttggtcccctcg

SEQ ID NO: 412412 - DNA, 20 bp, Artificial
  CRISPR gRNA sequence
tttgaatttggtcccctcgc

SEQ ID NO: 412413 - DNA, 20 bp, Artificial
  CRISPR gRNA sequence
gaatttggtcccctcgctca

SEQ ID NO: 412414 - DNA, 20 bp, Artificial
  CRISPR gRNA sequence
aatttggtcccctcgctcac

SEQ ID NO: 412415 - DNA, 20 bp, Artificial
  CRISPR gRNA sequence
ggtcccctcgctcactacaa

SEQ ID NO: 412416 - DNA, 20 bp, Artificial
  CRISPR gRNA sequence
gtcccctcgctcactacaaa

SEQ ID NO: 412417 - DNA, 20 bp, Artificial
  CRISPR gRNA sequence
gctcactacaaagcatcacc

SEQ ID NO: 412418 - DNA, 20 bp, Artificial
  CRISPR gRNA sequence
actacaaagcatcacctacc

SEQ ID NO: 412419 - DNA, 20 bp, Artificial
  CRISPR gRNA sequence
caaagcatcacctacctcgt

SEQ ID NO: 412420 - DNA, 20 bp, Artificial
  CRISPR gRNA sequence
cctcgtttgttttcctcaat

SEQ ID NO: 412421 - DNA, 20 bp, Artificial
  CRISPR gRNA sequence
gtttgttttcctcaatattc

SEQ ID NO: 412422 - DNA, 20 bp, Artificial
  CRISPR gRNA sequence
gttttcctcaatattccata

SEQ ID NO: 412423 - DNA, 20 bp, Artificial
  CRISPR gRNA sequence
ttttcctcaatattccatag

SEQ ID NO: 412424 - DNA, 20 bp, Artificial
  CRISPR gRNA sequence
tcctcaatattccatagtct

SEQ ID NO: 412425 - DNA, 20 bp, Artificial
  CRISPR gRNA sequence
cctcaatattccatagtcta

SEQ ID NO: 412426 - DNA, 20 bp, Artificial
  CRISPR gRNA sequence
ctcaatattccatagtctat

SEQ ID NO: 412427 - DNA, 20 bp, Artificial
  CRISPR gRNA sequence
aatattccatagtctatttt

SEQ ID NO: 412428 - DNA, 20 bp, Artificial
  CRISPR gRNA sequence
catagtctattttttgccat

SEQ ID NO: 412429 - DNA, 20 bp, Artificial
  CRISPR gRNA sequence
ttttttgccatttttctagg

SEQ ID NO: 412430 - DNA, 20 bp, Artificial
  CRISPR gRNA sequence
tttgccatttttctaggttt

SEQ ID NO: 412431 - DNA, 20 bp, Artificial
  CRISPR gRNA sequence
ttgccatttttctaggtttt

SEQ ID NO: 412432 - DNA, 20 bp, Artificial
  CRISPR gRNA sequence
tgccatttttctaggttttt

SEQ ID NO: 412433 - DNA, 20 bp, Artificial
  CRISPR gRNA sequence
gccatttttctaggtttttt

SEQ ID NO: 412434 - DNA, 20 bp, Artificial
  CRISPR gRNA sequence
ccatttttctaggttttttt

SEQ ID NO: 412435 - DNA, 20 bp, Artificial
  CRISPR gRNA sequence
ttctaggttttttttattgt

SEQ ID NO: 412436 - DNA, 20 bp, Artificial
  CRISPR gRNA sequence
tctaggttttttttattgtt

SEQ ID NO: 412437 - DNA, 20 bp, Artificial
  CRISPR gRNA sequence
ctaggttttttttattgtta

SEQ ID NO: 412438 - DNA, 20 bp, Artificial
  CRISPR gRNA sequence
taggttttttttattgttat

SEQ ID NO: 412439 - DNA, 20 bp, Artificial
  CRISPR gRNA sequence
ggttttttttattgttataa

SEQ ID NO: 412440 - DNA, 20 bp, Artificial
  CRISPR gRNA sequence
tttttattgttataaaaaac

SEQ ID NO: 412441 - DNA, 20 bp, Artificial
  CRISPR gRNA sequence
ttttattgttataaaaaaca

SEQ ID NO: 412442 - DNA, 20 bp, Artificial
  CRISPR gRNA sequence
tttattgttataaaaaacaa

SEQ ID NO: 412443 - DNA, 20 bp, Artificial
  CRISPR gRNA sequence
ttattgttataaaaaacaac

SEQ ID NO: 412444 - DNA, 20 bp, Artificial
  CRISPR gRNA sequence
tattgttataaaaaacaacg

SEQ ID NO: 412445 - DNA, 20 bp, Artificial
  CRISPR gRNA sequence
attgttataaaaaacaacgg

SEQ ID NO: 412446 - DNA, 20 bp, Artificial
  CRISPR gRNA sequence
ttgttataaaaaacaacggt

SEQ ID NO: 412447 - DNA, 20 bp, Artificial
  CRISPR gRNA sequence
ttataaaaaacaacggtttt

SEQ ID NO: 412448 - DNA, 20 bp, Artificial
  CRISPR gRNA sequence
taaaaaacaacggttttaaa

SEQ ID NO: 412449 - DNA, 20 bp, Artificial
  CRISPR gRNA sequence
taaagttaaagttaaaaaat

SEQ ID NO: 412450 - DNA, 20 bp, Artificial
  CRISPR gRNA sequence
aaagttaaagttaaaaaata

SEQ ID NO: 412451 - DNA, 20 bp, Artificial
  CRISPR gRNA sequence
aagttaaagttaaaaaataa

SEQ ID NO: 412452 - DNA, 20 bp, Artificial
  CRISPR gRNA sequence
aagttaaaaaataacttctg

SEQ ID NO: 412453 - DNA, 20 bp, Artificial
  CRISPR gRNA sequence
aaaaataacttctgttatga

SEQ ID NO: 412454 - DNA, 20 bp, Artificial
  CRISPR gRNA sequence
ctgttatgacaggaagccag

SEQ ID NO: 412455 - DNA, 20 bp, Artificial
  CRISPR gRNA sequence
tgttatgacaggaagccaga

SEQ ID NO: 412456 - DNA, 20 bp, Artificial
  CRISPR gRNA sequence
ttatgacaggaagccagatt

SEQ ID NO: 412457 - DNA, 20 bp, Artificial
  CRISPR gRNA sequence
tgacaggaagccagattccc

SEQ ID NO: 412458 - DNA, 20 bp, Artificial
  CRISPR gRNA sequence
ccaagagacactttatgagt

SEQ ID NO: 412459 - DNA, 20 bp, Artificial
  CRISPR gRNA sequence
tatgagtcaaaggtgacagt

SEQ ID NO: 412460 - DNA, 20 bp, Artificial
  CRISPR gRNA sequence
atgagtcaaaggtgacagta

SEQ ID NO: 412461 - DNA, 20 bp, Artificial
  CRISPR gRNA sequence
tgagtcaaaggtgacagtat

SEQ ID NO: 412462 - DNA, 20 bp, Artificial
  CRISPR gRNA sequence
tgacagtctcactgctatgc

SEQ ID NO: 412463 - DNA, 20 bp, Artificial
  CRISPR gRNA sequence
actgctatgcttatccaagc

SEQ ID NO: 412464 - DNA, 20 bp, Artificial
  CRISPR gRNA sequence
ctatgcttatccaagcagag

SEQ ID NO: 412465 - DNA, 20 bp, Artificial
  CRISPR gRNA sequence
tgcttatccaagcagagaac

SEQ ID NO: 412466 - DNA, 20 bp, Artificial
  CRISPR gRNA sequence
atccaagcagagaacttgtt

SEQ ID NO: 412467 - DNA, 20 bp, Artificial
  CRISPR gRNA sequence
tccaagcagagaacttgttg

SEQ ID NO: 412468 - DNA, 20 bp, Artificial
  CRISPR gRNA sequence
gttgcatctacttcatcttc

SEQ ID NO: 412469 - DNA, 20 bp, Artificial
  CRISPR gRNA sequence
ttgcatctacttcatcttct

SEQ ID NO: 412470 - DNA, 20 bp, Artificial
  CRISPR gRNA sequence
catctacttcatcttctttt

SEQ ID NO: 412471 - DNA, 20 bp, Artificial
  CRISPR gRNA sequence
cttcatcttcttttttatgg

SEQ ID NO: 412472 - DNA, 20 bp, Artificial
  CRISPR gRNA sequence
catcttcttttttatggact

SEQ ID NO: 412473 - DNA, 20 bp, Artificial
  CRISPR gRNA sequence
atcttcttttttatggactt

SEQ ID NO: 412474 - DNA, 20 bp, Artificial
  CRISPR gRNA sequence
cttttttatggacttggcat

SEQ ID NO: 412475 - DNA, 20 bp, Artificial
  CRISPR gRNA sequence
ttttttatggacttggcatt

SEQ ID NO: 412476 - DNA, 20 bp, Artificial
  CRISPR gRNA sequence
ttttatggacttggcattta

SEQ ID NO: 412477 - DNA, 20 bp, Artificial
  CRISPR gRNA sequence
tttatggacttggcatttaa

SEQ ID NO: 412478 - DNA, 20 bp, Artificial
  CRISPR gRNA sequence
ttatggacttggcatttaat

SEQ ID NO: 412479 - DNA, 20 bp, Artificial
  CRISPR gRNA sequence
tatggacttggcatttaatt

SEQ ID NO: 412480 - DNA, 20 bp, Artificial
  CRISPR gRNA sequence
atggacttggcatttaattt

SEQ ID NO: 412481 - DNA, 20 bp, Artificial
  CRISPR gRNA sequence
tggacttggcatttaatttc

SEQ ID NO: 412482 - DNA, 20 bp, Artificial
  CRISPR gRNA sequence
ggcatttaatttctaattcc

SEQ ID NO: 412483 - DNA, 20 bp, Artificial
  CRISPR gRNA sequence
gcatttaatttctaattcct

SEQ ID NO: 412484 - DNA, 20 bp, Artificial
  CRISPR gRNA sequence
aatttctaattcctgatttc

SEQ ID NO: 412485 - DNA, 20 bp, Artificial
  CRISPR gRNA sequence
atttctaattcctgatttca

SEQ ID NO: 412486 - DNA, 20 bp, Artificial
  CRISPR gRNA sequence
ctaattcctgatttcaatca

SEQ ID NO: 412487 - DNA, 20 bp, Artificial
  CRISPR gRNA sequence
taattcctgatttcaatcaa

SEQ ID NO: 412488 - DNA, 20 bp, Artificial
  CRISPR gRNA sequence
attcctgatttcaatcaaga

SEQ ID NO: 412489 - DNA, 20 bp, Artificial
  CRISPR gRNA sequence
ctgatttcaatcaagacatg

SEQ ID NO: 412490 - DNA, 20 bp, Artificial
  CRISPR gRNA sequence
atttcaatcaagacatgtct

SEQ ID NO: 412491 - DNA, 20 bp, Artificial
  CRISPR gRNA sequence
caatcaagacatgtctacag

SEQ ID NO: 412492 - DNA, 20 bp, Artificial
  CRISPR gRNA sequence
aatcaagacatgtctacaga

SEQ ID NO: 412493 - DNA, 20 bp, Artificial
  CRISPR gRNA sequence
cagacatgaacacaaaagca

SEQ ID NO: 412494 - DNA, 20 bp, Artificial
  CRISPR gRNA sequence
gaaataaagctaaacagaaa

SEQ ID NO: 412495 - DNA, 20 bp, Artificial
  CRISPR gRNA sequence
aacagaaacagtcttggcta

SEQ ID NO: 412496 - DNA, 20 bp, Artificial
  CRISPR gRNA sequence
ggctaggctttgactcagag

SEQ ID NO: 412497 - DNA, 20 bp, Artificial
  CRISPR gRNA sequence
gctaggctttgactcagagt

SEQ ID NO: 412498 - DNA, 20 bp, Artificial
  CRISPR gRNA sequence
ggctttgactcagagtcaag

SEQ ID NO: 412499 - DNA, 20 bp, Artificial
  CRISPR gRNA sequence
tgactcagagtcaagtgtcc

SEQ ID NO: 412500 - DNA, 20 bp, Artificial
  CRISPR gRNA sequence
gactcagagtcaagtgtcca

SEQ ID NO: 412501 - DNA, 20 bp, Artificial
  CRISPR gRNA sequence
actcagagtcaagtgtccat

SEQ ID NO: 412502 - DNA, 20 bp, Artificial
  CRISPR gRNA sequence
agagtcaagtgtccataata

SEQ ID NO: 412503 - DNA, 20 bp, Artificial
  CRISPR gRNA sequence
ggagccaggcgtggtggctc

SEQ ID NO: 412504 - DNA, 20 bp, Artificial
  CRISPR gRNA sequence
gagccaggcgtggtggctcc

SEQ ID NO: 412505 - DNA, 20 bp, Artificial
  CRISPR gRNA sequence
ctgcctgtaatcccaatgct

SEQ ID NO: 412506 - DNA, 20 bp, Artificial
  CRISPR gRNA sequence
cctgtaatcccaatgctttg

SEQ ID NO: 412507 - DNA, 20 bp, Artificial
  CRISPR gRNA sequence
taatcccaatgctttgggag

SEQ ID NO: 412508 - DNA, 20 bp, Artificial
  CRISPR gRNA sequence
tgggaggccatttcagtagg

SEQ ID NO: 412509 - DNA, 20 bp, Artificial
  CRISPR gRNA sequence
gggaggccatttcagtagga

SEQ ID NO: 412510 - DNA, 20 bp, Artificial
  CRISPR gRNA sequence
ggaggccatttcagtaggac

SEQ ID NO: 412511 - DNA, 20 bp, Artificial
  CRISPR gRNA sequence
cagtaggactgcttgaggtc

SEQ ID NO: 412512 - DNA, 20 bp, Artificial
  CRISPR gRNA sequence
agtaggactgcttgaggtct

SEQ ID NO: 412513 - DNA, 20 bp, Artificial
  CRISPR gRNA sequence
cttgaggtctagagttcaac

SEQ ID NO: 412514 - DNA, 20 bp, Artificial
  CRISPR gRNA sequence
gaggtctagagttcaacccc

SEQ ID NO: 412515 - DNA, 20 bp, Artificial
  CRISPR gRNA sequence
aggtctagagttcaacccca

SEQ ID NO: 412516 - DNA, 20 bp, Artificial
  CRISPR gRNA sequence
gagttcaaccccagcctgag

SEQ ID NO: 412517 - DNA, 20 bp, Artificial
  CRISPR gRNA sequence
aaccccagcctgagcaacat

SEQ ID NO: 412518 - DNA, 20 bp, Artificial
  CRISPR gRNA sequence
agcaacatagcgagatcttg

SEQ ID NO: 412519 - DNA, 20 bp, Artificial
  CRISPR gRNA sequence
gtctctacaaacaatttaaa

SEQ ID NO: 412520 - DNA, 20 bp, Artificial
  CRISPR gRNA sequence
tctctacaaacaatttaaaa

SEQ ID NO: 412521 - DNA, 20 bp, Artificial
  CRISPR gRNA sequence
tacaaacaatttaaaaaaat

SEQ ID NO: 412522 - DNA, 20 bp, Artificial
  CRISPR gRNA sequence
caaacaatttaaaaaaatgt

SEQ ID NO: 412523 - DNA, 20 bp, Artificial
  CRISPR gRNA sequence
aaaaaaatgttagctgggcc

SEQ ID NO: 412524 - DNA, 20 bp, Artificial
  CRISPR gRNA sequence
aaaaaatgttagctgggcct

SEQ ID NO: 412525 - DNA, 20 bp, Artificial
  CRISPR gRNA sequence
gctgggcctggtggcatgtg

SEQ ID NO: 412526 - DNA, 20 bp, Artificial
  CRISPR gRNA sequence
ggcctggtggcatgtgcctg

SEQ ID NO: 412527 - DNA, 20 bp, Artificial
  CRISPR gRNA sequence
gtggcatgtgcctgtggtcc

SEQ ID NO: 412528 - DNA, 20 bp, Artificial
  CRISPR gRNA sequence
tggtcccagctacttgggag

SEQ ID NO: 412529 - DNA, 20 bp, Artificial
  CRISPR gRNA sequence
cttgggaggctgaggcagga

SEQ ID NO: 412530 - DNA, 20 bp, Artificial
  CRISPR gRNA sequence
gggaggctgaggcaggagga

SEQ ID NO: 412531 - DNA, 20 bp, Artificial
  CRISPR gRNA sequence
ggaggctgaggcaggaggat

SEQ ID NO: 412532 - DNA, 20 bp, Artificial
  CRISPR gRNA sequence
aggcaggaggatcacccaga

SEQ ID NO: 412533 - DNA, 20 bp, Artificial
  CRISPR gRNA sequence
ctacatgaactcttttctgc

SEQ ID NO: 412534 - DNA, 20 bp, Artificial
  CRISPR gRNA sequence
catgaactcttttctgcaca

SEQ ID NO: 412535 - DNA, 20 bp, Artificial
  CRISPR gRNA sequence
ttttctgcacactaattcac

SEQ ID NO: 412536 - DNA, 20 bp, Artificial
  CRISPR gRNA sequence
ttctgcacactaattcacta

SEQ ID NO: 412537 - DNA, 20 bp, Artificial
  CRISPR gRNA sequence
tctgcacactaattcactaa

SEQ ID NO: 412538 - DNA, 20 bp, Artificial
  CRISPR gRNA sequence
ctgcacactaattcactaag

SEQ ID NO: 412539 - DNA, 20 bp, Artificial
  CRISPR gRNA sequence
tgcacactaattcactaaga

SEQ ID NO: 412540 - DNA, 20 bp, Artificial
  CRISPR gRNA sequence
cacactaattcactaagaca

SEQ ID NO: 412541 - DNA, 20 bp, Artificial
  CRISPR gRNA sequence
attcactaagacagtgagaa

SEQ ID NO: 412542 - DNA, 20 bp, Artificial
  CRISPR gRNA sequence
actaagacagtgagaaaggt

SEQ ID NO: 412543 - DNA, 20 bp, Artificial
  CRISPR gRNA sequence
agacagtgagaaaggtatgt

SEQ ID NO: 412544 - DNA, 20 bp, Artificial
  CRISPR gRNA sequence
ttgacattctgacttttgaa

SEQ ID NO: 412545 - DNA, 20 bp, Artificial
  CRISPR gRNA sequence
gacattctgacttttgaagc

SEQ ID NO: 412546 - DNA, 20 bp, Artificial
  CRISPR gRNA sequence
acattctgacttttgaagca

SEQ ID NO: 412547 - DNA, 20 bp, Artificial
  CRISPR gRNA sequence
tgacttttgaagcatctata

SEQ ID NO: 412548 - DNA, 20 bp, Artificial
  CRISPR gRNA sequence
acttttgaagcatctatata

SEQ ID NO: 412549 - DNA, 20 bp, Artificial
  CRISPR gRNA sequence
ttgaagcatctatatagtct

SEQ ID NO: 412550 - DNA, 20 bp, Artificial
  CRISPR gRNA sequence
tgaagcatctatatagtctc

SEQ ID NO: 412551 - DNA, 20 bp, Artificial
  CRISPR gRNA sequence
gaagcatctatatagtctct

SEQ ID NO: 412552 - DNA, 20 bp, Artificial
  CRISPR gRNA sequence
aagcatctatatagtctctt

SEQ ID NO: 412553 - DNA, 20 bp, Artificial
  CRISPR gRNA sequence
tatagtctctttaaataata

SEQ ID NO: 412554 - DNA, 20 bp, Artificial
  CRISPR gRNA sequence
tttaaataatatgttcataa

SEQ ID NO: 412555 - DNA, 20 bp, Artificial
  CRISPR gRNA sequence
taaataatatgttcataaaa

SEQ ID NO: 412556 - DNA, 20 bp, Artificial
  CRISPR gRNA sequence
aaataatatgttcataaaaa

SEQ ID NO: 412557 - DNA, 20 bp, Artificial
  CRISPR gRNA sequence
aataatatgttcataaaaat

SEQ ID NO: 412558 - DNA, 20 bp, Artificial
  CRISPR gRNA sequence
ataaaaattgaggtaaatgt

SEQ ID NO: 412559 - DNA, 20 bp, Artificial
  CRISPR gRNA sequence
aggtaaatgtgcaagaagta

SEQ ID NO: 412560 - DNA, 20 bp, Artificial
  CRISPR gRNA sequence
agaaatatttgggtaaaaat

SEQ ID NO: 412561 - DNA, 20 bp, Artificial
  CRISPR gRNA sequence
gggtaaaaatatgagatatc

SEQ ID NO: 412562 - DNA, 20 bp, Artificial
  CRISPR gRNA sequence
ggtaaaaatatgagatatct

SEQ ID NO: 412563 - DNA, 20 bp, Artificial
  CRISPR gRNA sequence
atacaaaggagtcagccgta

SEQ ID NO: 412564 - DNA, 20 bp, Artificial
  CRISPR gRNA sequence
ttctcaataaatgtgtcaat

SEQ ID NO: 412565 - DNA, 20 bp, Artificial
  CRISPR gRNA sequence
tctcaataaatgtgtcaatt

SEQ ID NO: 412566 - DNA, 20 bp, Artificial
  CRISPR gRNA sequence
ctcaataaatgtgtcaattt

SEQ ID NO: 412567 - DNA, 20 bp, Artificial
  CRISPR gRNA sequence
tcaataaatgtgtcaatttg

SEQ ID NO: 412568 - DNA, 20 bp, Artificial
  CRISPR gRNA sequence
aataaatgtgtcaatttgaa

SEQ ID NO: 412569 - DNA, 20 bp, Artificial
  CRISPR gRNA sequence
gaagatgttcccatctcttt

SEQ ID NO: 412570 - DNA, 20 bp, Artificial
  CRISPR gRNA sequence
aagatgttcccatctctttg

SEQ ID NO: 412571 - DNA, 20 bp, Artificial
  CRISPR gRNA sequence
ccatctctttgtcctcatgt

SEQ ID NO: 412572 - DNA, 20 bp, Artificial
  CRISPR gRNA sequence
tttgtcctcatgtgctcact

SEQ ID NO: 412573 - DNA, 20 bp, Artificial
  CRISPR gRNA sequence
tgtcctcatgtgctcactta

SEQ ID NO: 412574 - DNA, 20 bp, Artificial
  CRISPR gRNA sequence
gtcctcatgtgctcacttaa

SEQ ID NO: 412575 - DNA, 20 bp, Artificial
  CRISPR gRNA sequence
tcctcatgtgctcacttaaa

SEQ ID NO: 412576 - DNA, 20 bp, Artificial
  CRISPR gRNA sequence
atgtgctcacttaaatatcc

SEQ ID NO: 412577 - DNA, 20 bp, Artificial
  CRISPR gRNA sequence
acttaaatatccttgccata

SEQ ID NO: 412578 - DNA, 20 bp, Artificial
  CRISPR gRNA sequence
aaatatccttgccatacacc

SEQ ID NO: 412579 - DNA, 20 bp, Artificial
  CRISPR gRNA sequence
aatatccttgccatacacca

SEQ ID NO: 412580 - DNA, 20 bp, Artificial
  CRISPR gRNA sequence
gccatacaccaatcactgtg

SEQ ID NO: 412581 - DNA, 20 bp, Artificial
  CRISPR gRNA sequence
ccatacaccaatcactgtgg

SEQ ID NO: 412582 - DNA, 20 bp, Artificial
  CRISPR gRNA sequence
tggagaacttatggcccaca

SEQ ID NO: 412583 - DNA, 20 bp, Artificial
  CRISPR gRNA sequence
atggcccacagtactgaatg

SEQ ID NO: 412584 - DNA, 20 bp, Artificial
  CRISPR gRNA sequence
tggcccacagtactgaatga

SEQ ID NO: 412585 - DNA, 20 bp, Artificial
  CRISPR gRNA sequence
aatgatgctacattatcgca

SEQ ID NO: 412586 - DNA, 20 bp, Artificial
  CRISPR gRNA sequence
cattatcgcaccagaagaag

SEQ ID NO: 412587 - DNA, 20 bp, Artificial
  CRISPR gRNA sequence
tcgcaccagaagaagtagct

SEQ ID NO: 412588 - DNA, 20 bp, Artificial
  CRISPR gRNA sequence
atacagtcattctatattgt

SEQ ID NO: 412589 - DNA, 20 bp, Artificial
  CRISPR gRNA sequence
tatattgtgtaggtaaaacg

SEQ ID NO: 412590 - DNA, 20 bp, Artificial
  CRISPR gRNA sequence
tattgtgtaggtaaaacgta

SEQ ID NO: 412591 - DNA, 20 bp, Artificial
  CRISPR gRNA sequence
tgtaggtaaaacgtacacac

SEQ ID NO: 412592 - DNA, 20 bp, Artificial
  CRISPR gRNA sequence
tcttagggtatatgtttctc

SEQ ID NO: 412593 - DNA, 20 bp, Artificial
  CRISPR gRNA sequence
agggtatatgtttctcaact

SEQ ID NO: 412594 - DNA, 20 bp, Artificial
  CRISPR gRNA sequence
gggtatatgtttctcaactg

SEQ ID NO: 412595 - DNA, 20 bp, Artificial
  CRISPR gRNA sequence
ctcaactgacataaaccttt

SEQ ID NO: 412596 - DNA, 20 bp, Artificial
  CRISPR gRNA sequence
tcaactgacataaaccttta

SEQ ID NO: 412597 - DNA, 20 bp, Artificial
  CRISPR gRNA sequence
aactgacataaacctttaaa

SEQ ID NO: 412598 - DNA, 20 bp, Artificial
  CRISPR gRNA sequence
acataaacctttaaagtgtt

SEQ ID NO: 412599 - DNA, 20 bp, Artificial
  CRISPR gRNA sequence
taaagtgtttaaactatttg

SEQ ID NO: 412600 - DNA, 20 bp, Artificial
  CRISPR gRNA sequence
aaagtgtttaaactatttgg

SEQ ID NO: 412601 - DNA, 20 bp, Artificial
  CRISPR gRNA sequence
aagtgtttaaactatttggg

SEQ ID NO: 412602 - DNA, 20 bp, Artificial
  CRISPR gRNA sequence
aaactatttgggacaagtat

SEQ ID NO: 412603 - DNA, 20 bp, Artificial
  CRISPR gRNA sequence
aactatttgggacaagtatt

SEQ ID NO: 412604 - DNA, 20 bp, Artificial
  CRISPR gRNA sequence
tttgggacaagtattttcaa

SEQ ID NO: 412605 - DNA, 20 bp, Artificial
  CRISPR gRNA sequence
gggacaagtattttcaacat

SEQ ID NO: 412606 - DNA, 20 bp, Artificial
  CRISPR gRNA sequence
ggacaagtattttcaacata

SEQ ID NO: 412607 - DNA, 20 bp, Artificial
  CRISPR gRNA sequence
tcaacataaagaaagtttcc

SEQ ID NO: 412608 - DNA, 20 bp, Artificial
  CRISPR gRNA sequence
caacataaagaaagtttccc

SEQ ID NO: 412609 - DNA, 20 bp, Artificial
  CRISPR gRNA sequence
aacataaagaaagtttccca

SEQ ID NO: 412610 - DNA, 20 bp, Artificial
  CRISPR gRNA sequence
cccacctgatatactaattt

SEQ ID NO: 412611 - DNA, 20 bp, Artificial
  CRISPR gRNA sequence
ccacctgatatactaatttt

SEQ ID NO: 412612 - DNA, 20 bp, Artificial
  CRISPR gRNA sequence
atatactaattttgctataa

SEQ ID NO: 412613 - DNA, 20 bp, Artificial
  CRISPR gRNA sequence
attttgctataatttgccat

SEQ ID NO: 412614 - DNA, 20 bp, Artificial
  CRISPR gRNA sequence
tgctataatttgccatcaag

SEQ ID NO: 412615 - DNA, 20 bp, Artificial
  CRISPR gRNA sequence
gctataatttgccatcaaga

SEQ ID NO: 412616 - DNA, 20 bp, Artificial
  CRISPR gRNA sequence
ctataatttgccatcaagag

SEQ ID NO: 412617 - DNA, 20 bp, Artificial
  CRISPR gRNA sequence
taatttgccatcaagagagg

SEQ ID NO: 412618 - DNA, 20 bp, Artificial
  CRISPR gRNA sequence
gccatcaagagaggcaaatt

SEQ ID NO: 412619 - DNA, 20 bp, Artificial
  CRISPR gRNA sequence
ccatcaagagaggcaaattg

SEQ ID NO: 412620 - DNA, 20 bp, Artificial
  CRISPR gRNA sequence
tagcaaaatttctacatcag

SEQ ID NO: 412621 - DNA, 20 bp, Artificial
  CRISPR gRNA sequence
ctacatcagctaggaagctt

SEQ ID NO: 412622 - DNA, 20 bp, Artificial
  CRISPR gRNA sequence
tacatcagctaggaagcttg

SEQ ID NO: 412623 - DNA, 20 bp, Artificial
  CRISPR gRNA sequence
catcagctaggaagcttgct

SEQ ID NO: 412624 - DNA, 20 bp, Artificial
  CRISPR gRNA sequence
ggaagcttgcttccctcact

SEQ ID NO: 412625 - DNA, 20 bp, Artificial
  CRISPR gRNA sequence
gcttccctcactggtttgct

SEQ ID NO: 412626 - DNA, 20 bp, Artificial
  CRISPR gRNA sequence
cttccctcactggtttgctc

SEQ ID NO: 412627 - DNA, 20 bp, Artificial
  CRISPR gRNA sequence
ccctcactggtttgctctat

SEQ ID NO: 412628 - DNA, 20 bp, Artificial
  CRISPR gRNA sequence
cctcactggtttgctctata

SEQ ID NO: 412629 - DNA, 20 bp, Artificial
  CRISPR gRNA sequence
actggtttgctctataatga

SEQ ID NO: 412630 - DNA, 20 bp, Artificial
  CRISPR gRNA sequence
gtttgctctataatgacaga

SEQ ID NO: 412631 - DNA, 20 bp, Artificial
  CRISPR gRNA sequence
gctctataatgacagaaaaa

SEQ ID NO: 412632 - DNA, 20 bp, Artificial
  CRISPR gRNA sequence
ctctataatgacagaaaaat

SEQ ID NO: 412633 - DNA, 20 bp, Artificial
  CRISPR gRNA sequence
tataatgacagaaaaattat

SEQ ID NO: 412634 - DNA, 20 bp, Artificial
  CRISPR gRNA sequence
taatgacagaaaaattattt

SEQ ID NO: 412635 - DNA, 20 bp, Artificial
  CRISPR gRNA sequence
tttagattctctgggcctta

SEQ ID NO: 412636 - DNA, 20 bp, Artificial
  CRISPR gRNA sequence
agattctctgggccttatgt

SEQ ID NO: 412637 - DNA, 20 bp, Artificial
  CRISPR gRNA sequence
gattctctgggccttatgtt

SEQ ID NO: 412638 - DNA, 20 bp, Artificial
  CRISPR gRNA sequence
tctgggccttatgtttctta

SEQ ID NO: 412639 - DNA, 20 bp, Artificial
  CRISPR gRNA sequence
tgggccttatgtttcttagt

SEQ ID NO: 412640 - DNA, 20 bp, Artificial
  CRISPR gRNA sequence
ggccttatgtttcttagtta

SEQ ID NO: 412641 - DNA, 20 bp, Artificial
  CRISPR gRNA sequence
atgtttcttagttaaaacct

SEQ ID NO: 412642 - DNA, 20 bp, Artificial
  CRISPR gRNA sequence
tgtttcttagttaaaacctg

SEQ ID NO: 412643 - DNA, 20 bp, Artificial
  CRISPR gRNA sequence
cttagttaaaacctgataat

SEQ ID NO: 412644 - DNA, 20 bp, Artificial
  CRISPR gRNA sequence
ttagttaaaacctgataata

SEQ ID NO: 412645 - DNA, 20 bp, Artificial
  CRISPR gRNA sequence
agttaaaacctgataatact

SEQ ID NO: 412646 - DNA, 20 bp, Artificial
  CRISPR gRNA sequence
gttaaaacctgataatactt

SEQ ID NO: 412647 - DNA, 20 bp, Artificial
  CRISPR gRNA sequence
aaacctgataatacttttat

SEQ ID NO: 412648 - DNA, 20 bp, Artificial
  CRISPR gRNA sequence
ataatacttttattttgagg

SEQ ID NO: 412649 - DNA, 20 bp, Artificial
  CRISPR gRNA sequence
ttattttgaggaaaagtagt

SEQ ID NO: 412650 - DNA, 20 bp, Artificial
  CRISPR gRNA sequence
tattttgaggaaaagtagtt

SEQ ID NO: 412651 - DNA, 20 bp, Artificial
  CRISPR gRNA sequence
attttgaggaaaagtagttg

SEQ ID NO: 412652 - DNA, 20 bp, Artificial
  CRISPR gRNA sequence
ttttgaggaaaagtagttgc

SEQ ID NO: 412653 - DNA, 20 bp, Artificial
  CRISPR gRNA sequence
tgaggaaaagtagttgctat

SEQ ID NO: 412654 - DNA, 20 bp, Artificial
  CRISPR gRNA sequence
gaggaaaagtagttgctatt

SEQ ID NO: 412655 - DNA, 20 bp, Artificial
  CRISPR gRNA sequence
aggaaaagtagttgctattt

SEQ ID NO: 412656 - DNA, 20 bp, Artificial
  CRISPR gRNA sequence
ctatttactcagaagaagga

SEQ ID NO: 412657 - DNA, 20 bp, Artificial
  CRISPR gRNA sequence
tttactcagaagaaggatta

SEQ ID NO: 412658 - DNA, 20 bp, Artificial
  CRISPR gRNA sequence
actcagaagaaggattagag

SEQ ID NO: 412659 - DNA, 20 bp, Artificial
  CRISPR gRNA sequence
ctcagaagaaggattagagg

SEQ ID NO: 412660 - DNA, 20 bp, Artificial
  CRISPR gRNA sequence
agaagaaggattagaggttg

SEQ ID NO: 412661 - DNA, 20 bp, Artificial
  CRISPR gRNA sequence
gaggttgaagccatggccct

SEQ ID NO: 412662 - DNA, 20 bp, Artificial
  CRISPR gRNA sequence
aagccatggccctttaattc

SEQ ID NO: 412663 - DNA, 20 bp, Artificial
  CRISPR gRNA sequence
taattctctgaaaataattt

SEQ ID NO: 412664 - DNA, 20 bp, Artificial
  CRISPR gRNA sequence
aattctctgaaaataattta

SEQ ID NO: 412665 - DNA, 20 bp, Artificial
  CRISPR gRNA sequence
attctctgaaaataatttac

SEQ ID NO: 412666 - DNA, 20 bp, Artificial
  CRISPR gRNA sequence
tctgaaaataatttacactc

SEQ ID NO: 412667 - DNA, 20 bp, Artificial
  CRISPR gRNA sequence
tgaaaataatttacactcta

SEQ ID NO: 412668 - DNA, 20 bp, Artificial
  CRISPR gRNA sequence
aaaataatttacactctagg

SEQ ID NO: 412669 - DNA, 20 bp, Artificial
  CRISPR gRNA sequence
acactctaggaccttctagc

SEQ ID NO: 412670 - DNA, 20 bp, Artificial
  CRISPR gRNA sequence
cactctaggaccttctagct

SEQ ID NO: 412671 - DNA, 20 bp, Artificial
  CRISPR gRNA sequence
taggaccttctagctataaa

SEQ ID NO: 412672 - DNA, 20 bp, Artificial
  CRISPR gRNA sequence
ggaccttctagctataaaac

SEQ ID NO: 412673 - DNA, 20 bp, Artificial
  CRISPR gRNA sequence
ctagctataaaacacagaaa

SEQ ID NO: 412674 - DNA, 20 bp, Artificial
  CRISPR gRNA sequence
tagctataaaacacagaaag

SEQ ID NO: 412675 - DNA, 20 bp, Artificial
  CRISPR gRNA sequence
gctataaaacacagaaaggt

SEQ ID NO: 412676 - DNA, 20 bp, Artificial
  CRISPR gRNA sequence
taaaacacagaaaggtttct

SEQ ID NO: 412677 - DNA, 20 bp, Artificial
  CRISPR gRNA sequence
ctgaaatacagagtataaaa

SEQ ID NO: 412678 - DNA, 20 bp, Artificial
  CRISPR gRNA sequence
tgaaatacagagtataaaac

SEQ ID NO: 412679 - DNA, 20 bp, Artificial
  CRISPR gRNA sequence
aaatacagagtataaaactg

SEQ ID NO: 412680 - DNA, 20 bp, Artificial
  CRISPR gRNA sequence
atttatctggacaaagaaag

SEQ ID NO: 412681 - DNA, 20 bp, Artificial
  CRISPR gRNA sequence
atctggacaaagaaagttga

SEQ ID NO: 412682 - DNA, 20 bp, Artificial
  CRISPR gRNA sequence
tctggacaaagaaagttgac

SEQ ID NO: 412683 - DNA, 20 bp, Artificial
  CRISPR gRNA sequence
gacaaagaaagttgaccttt

SEQ ID NO: 412684 - DNA, 20 bp, Artificial
  CRISPR gRNA sequence
acctttgaaaacttggaata

SEQ ID NO: 412685 - DNA, 20 bp, Artificial
  CRISPR gRNA sequence
tgaaaacttggaataatatt

SEQ ID NO: 412686 - DNA, 20 bp, Artificial
  CRISPR gRNA sequence
gaaaacttggaataatatta

SEQ ID NO: 412687 - DNA, 20 bp, Artificial
  CRISPR gRNA sequence
aaaacttggaataatattac

SEQ ID NO: 412688 - DNA, 20 bp, Artificial
  CRISPR gRNA sequence
ggaataatattaccatacca

SEQ ID NO: 412689 - DNA, 20 bp, Artificial
  CRISPR gRNA sequence
gaataatattaccataccaa

SEQ ID NO: 412690 - DNA, 20 bp, Artificial
  CRISPR gRNA sequence
ccataccaatatccacgtga

SEQ ID NO: 412691 - DNA, 20 bp, Artificial
  CRISPR gRNA sequence
caggcatacaggaaagttca

SEQ ID NO: 412692 - DNA, 20 bp, Artificial
  CRISPR gRNA sequence
aggcatacaggaaagttcaa

SEQ ID NO: 412693 - DNA, 20 bp, Artificial
  CRISPR gRNA sequence
aacacactttgtgctactat

SEQ ID NO: 412694 - DNA, 20 bp, Artificial
  CRISPR gRNA sequence
tgtgctactattatttccgg

SEQ ID NO: 412695 - DNA, 20 bp, Artificial
  CRISPR gRNA sequence
gtgctactattatttccggt

SEQ ID NO: 412696 - DNA, 20 bp, Artificial
  CRISPR gRNA sequence
tgctactattatttccggtg

SEQ ID NO: 412697 - DNA, 20 bp, Artificial
  CRISPR gRNA sequence
ctattatttccggtggtctg

SEQ ID NO: 412698 - DNA, 20 bp, Artificial
  CRISPR gRNA sequence
ttatttccggtggtctgcca

SEQ ID NO: 412699 - DNA, 20 bp, Artificial
  CRISPR gRNA sequence
tttccggtggtctgccaagg

SEQ ID NO: 412700 - DNA, 20 bp, Artificial
  CRISPR gRNA sequence
ccggtggtctgccaaggcaa

SEQ ID NO: 412701 - DNA, 20 bp, Artificial
  CRISPR gRNA sequence
cggtggtctgccaaggcaac

SEQ ID NO: 412702 - DNA, 20 bp, Artificial
  CRISPR gRNA sequence
ccaaggcaacagttattgta

SEQ ID NO: 412703 - DNA, 20 bp, Artificial
  CRISPR gRNA sequence
ttgtatagatgtttaccaac

SEQ ID NO: 412704 - DNA, 20 bp, Artificial
  CRISPR gRNA sequence
tatagatgtttaccaacagt

SEQ ID NO: 412705 - DNA, 20 bp, Artificial
  CRISPR gRNA sequence
accaacagtacctgtgcctt

SEQ ID NO: 412706 - DNA, 20 bp, Artificial
  CRISPR gRNA sequence
ccaacagtacctgtgccttt

SEQ ID NO: 412707 - DNA, 20 bp, Artificial
  CRISPR gRNA sequence
tgcctttccccaggaaggcg

SEQ ID NO: 412708 - DNA, 20 bp, Artificial
  CRISPR gRNA sequence
tccccaggaaggcgagtcta

SEQ ID NO: 412709 - DNA, 20 bp, Artificial
  CRISPR gRNA sequence
ccccaggaaggcgagtctag

SEQ ID NO: 412710 - DNA, 20 bp, Artificial
  CRISPR gRNA sequence
cccaggaaggcgagtctagc

SEQ ID NO: 412711 - DNA, 20 bp, Artificial
  CRISPR gRNA sequence
gctgcaggagcaagcatgct

SEQ ID NO: 412712 - DNA, 20 bp, Artificial
  CRISPR gRNA sequence
caggagcaagcatgctctgc

SEQ ID NO: 412713 - DNA, 20 bp, Artificial
  CRISPR gRNA sequence
tgctgtacacgactacttca

SEQ ID NO: 412714 - DNA, 20 bp, Artificial
  CRISPR gRNA sequence
ctgtacacgactacttcaat

SEQ ID NO: 412715 - DNA, 20 bp, Artificial
  CRISPR gRNA sequence
tacacgactacttcaatgtg

SEQ ID NO: 412716 - DNA, 20 bp, Artificial
  CRISPR gRNA sequence
cttcaatgtgacatctcaac

SEQ ID NO: 412717 - DNA, 20 bp, Artificial
  CRISPR gRNA sequence
caatgtgacatctcaacatg

SEQ ID NO: 412718 - DNA, 20 bp, Artificial
  CRISPR gRNA sequence
aatgtgacatctcaacatga

SEQ ID NO: 412719 - DNA, 20 bp, Artificial
  CRISPR gRNA sequence
aacatgaaaaaaatagaaac

SEQ ID NO: 412720 - DNA, 20 bp, Artificial
  CRISPR gRNA sequence
tctgattaaccctcatttgg

SEQ ID NO: 412721 - DNA, 20 bp, Artificial
  CRISPR gRNA sequence
attaaccctcatttggaatg

SEQ ID NO: 412722 - DNA, 20 bp, Artificial
  CRISPR gRNA sequence
accctcatttggaatgtgtc

SEQ ID NO: 412723 - DNA, 20 bp, Artificial
  CRISPR gRNA sequence
atttggaatgtgtctacgta

SEQ ID NO: 412724 - DNA, 20 bp, Artificial
  CRISPR gRNA sequence
ggaatgtgtctacgtaaaat

SEQ ID NO: 412725 - DNA, 20 bp, Artificial
  CRISPR gRNA sequence
gaatgtgtctacgtaaaata

SEQ ID NO: 412726 - DNA, 20 bp, Artificial
  CRISPR gRNA sequence
cgtaaaatataaatgcatat

SEQ ID NO: 412727 - DNA, 20 bp, Artificial
  CRISPR gRNA sequence
aatatgcatgattaataacc

SEQ ID NO: 412728 - DNA, 20 bp, Artificial
  CRISPR gRNA sequence
ataacctaaatcgtttggcg

SEQ ID NO: 412729 - DNA, 20 bp, Artificial
  CRISPR gRNA sequence
aatcgtttggcgcttaaaat

SEQ ID NO: 412730 - DNA, 20 bp, Artificial
  CRISPR gRNA sequence
ggcgcttaaaatgttgaaac

SEQ ID NO: 412731 - DNA, 20 bp, Artificial
  CRISPR gRNA sequence
gcgcttaaaatgttgaaacc

SEQ ID NO: 412732 - DNA, 20 bp, Artificial
  CRISPR gRNA sequence
aaaatgttgaaaccacctct

SEQ ID NO: 412733 - DNA, 20 bp, Artificial
  CRISPR gRNA sequence
aaatgttgaaaccacctctg

SEQ ID NO: 412734 - DNA, 20 bp, Artificial
  CRISPR gRNA sequence
aaaccacctctgcatgcttg

SEQ ID NO: 412735 - DNA, 20 bp, Artificial
  CRISPR gRNA sequence
tgcatgcttgatttaaatct

SEQ ID NO: 412736 - DNA, 20 bp, Artificial
  CRISPR gRNA sequence
catgcttgatttaaatctca

SEQ ID NO: 412737 - DNA, 20 bp, Artificial
  CRISPR gRNA sequence
gatttaaatctcatagctac

SEQ ID NO: 412738 - DNA, 20 bp, Artificial
  CRISPR gRNA sequence
atttaaatctcatagctacc

SEQ ID NO: 412739 - DNA, 20 bp, Artificial
  CRISPR gRNA sequence
aaatctcatagctacccttg

SEQ ID NO: 412740 - DNA, 20 bp, Artificial
  CRISPR gRNA sequence
aatctcatagctacccttgt

SEQ ID NO: 412741 - DNA, 20 bp, Artificial
  CRISPR gRNA sequence
atagctacccttgtggttaa

SEQ ID NO: 412742 - DNA, 20 bp, Artificial
  CRISPR gRNA sequence
cccttgtggttaattttatc

SEQ ID NO: 412743 - DNA, 20 bp, Artificial
  CRISPR gRNA sequence
gtggttaattttatcatcat

SEQ ID NO: 412744 - DNA, 20 bp, Artificial
  CRISPR gRNA sequence
tggttaattttatcatcatt

SEQ ID NO: 412745 - DNA, 20 bp, Artificial
  CRISPR gRNA sequence
attttatcatcattatgcag

SEQ ID NO: 412746 - DNA, 20 bp, Artificial
  CRISPR gRNA sequence
tatcatcattatgcagttgc

SEQ ID NO: 412747 - DNA, 20 bp, Artificial
  CRISPR gRNA sequence
atcatcattatgcagttgcc

SEQ ID NO: 412748 - DNA, 20 bp, Artificial
  CRISPR gRNA sequence
tcatcattatgcagttgcca

SEQ ID NO: 412749 - DNA, 20 bp, Artificial
  CRISPR gRNA sequence
tgcagttgccaaaaaaaact

SEQ ID NO: 412750 - DNA, 20 bp, Artificial
  CRISPR gRNA sequence
ccaaaaaaaactgtttaaaa

SEQ ID NO: 412751 - DNA, 20 bp, Artificial
  CRISPR gRNA sequence
tttaaaacattaagtgtcct

SEQ ID NO: 412752 - DNA, 20 bp, Artificial
  CRISPR gRNA sequence
aaaacattaagtgtcctatg

SEQ ID NO: 412753 - DNA, 20 bp, Artificial
  CRISPR gRNA sequence
aaacattaagtgtcctatgt

SEQ ID NO: 412754 - DNA, 20 bp, Artificial
  CRISPR gRNA sequence
agtgtcctatgtgaagtctt

SEQ ID NO: 412755 - DNA, 20 bp, Artificial
  CRISPR gRNA sequence
tgtgaagtcttccaggggaa

SEQ ID NO: 412756 - DNA, 20 bp, Artificial
  CRISPR gRNA sequence
ccaggggaaagaattagaag

SEQ ID NO: 412757 - DNA, 20 bp, Artificial
  CRISPR gRNA sequence
caggggaaagaattagaaga

SEQ ID NO: 412758 - DNA, 20 bp, Artificial
  CRISPR gRNA sequence
gaagacaggactaggcccca

SEQ ID NO: 412759 - DNA, 20 bp, Artificial
  CRISPR gRNA sequence
ggccccaaggcttttctcct

SEQ ID NO: 412760 - DNA, 20 bp, Artificial
  CRISPR gRNA sequence
ttctcctcagtctctgtttt

SEQ ID NO: 412761 - DNA, 20 bp, Artificial
  CRISPR gRNA sequence
tctcctcagtctctgttttc

SEQ ID NO: 412762 - DNA, 20 bp, Artificial
  CRISPR gRNA sequence
ctcctcagtctctgttttca

SEQ ID NO: 412763 - DNA, 20 bp, Artificial
  CRISPR gRNA sequence
tcctcagtctctgttttcaa

SEQ ID NO: 412764 - DNA, 20 bp, Artificial
  CRISPR gRNA sequence
ctcagtctctgttttcaata

SEQ ID NO: 412765 - DNA, 20 bp, Artificial
  CRISPR gRNA sequence
agtctctgttttcaataaac

SEQ ID NO: 412766 - DNA, 20 bp, Artificial
  CRISPR gRNA sequence
tgttttcaataaaccaatgt

SEQ ID NO: 412767 - DNA, 20 bp, Artificial
  CRISPR gRNA sequence
ttttcaataaaccaatgtct

SEQ ID NO: 412768 - DNA, 20 bp, Artificial
  CRISPR gRNA sequence
tcaataaaccaatgtctaaa

SEQ ID NO: 412769 - DNA, 20 bp, Artificial
  CRISPR gRNA sequence
caataaaccaatgtctaaag

SEQ ID NO: 412770 - DNA, 20 bp, Artificial
  CRISPR gRNA sequence
aataaaccaatgtctaaagt

SEQ ID NO: 412771 - DNA, 20 bp, Artificial
  CRISPR gRNA sequence
aagtgggacaaaggttgaat

SEQ ID NO: 412772 - DNA, 20 bp, Artificial
  CRISPR gRNA sequence
aatatttgtttacattatat

SEQ ID NO: 412773 - DNA, 20 bp, Artificial
  CRISPR gRNA sequence
gtttacattatatagaaggt

SEQ ID NO: 412774 - DNA, 20 bp, Artificial
  CRISPR gRNA sequence
tttacattatatagaaggtc

SEQ ID NO: 412775 - DNA, 20 bp, Artificial
  CRISPR gRNA sequence
acattatatagaaggtcaaa

SEQ ID NO: 412776 - DNA, 20 bp, Artificial
  CRISPR gRNA sequence
cattatatagaaggtcaaaa

SEQ ID NO: 412777 - DNA, 20 bp, Artificial
  CRISPR gRNA sequence
tatagaaggtcaaaactttg

SEQ ID NO: 412778 - DNA, 20 bp, Artificial
  CRISPR gRNA sequence
tgtatgacctgataatgcag

SEQ ID NO: 412779 - DNA, 20 bp, Artificial
  CRISPR gRNA sequence
gtatgacctgataatgcaga

SEQ ID NO: 412780 - DNA, 20 bp, Artificial
  CRISPR gRNA sequence
tatgacctgataatgcagaa

SEQ ID NO: 412781 - DNA, 20 bp, Artificial
  CRISPR gRNA sequence
ataatgcagaatctgtcagc

SEQ ID NO: 412782 - DNA, 20 bp, Artificial
  CRISPR gRNA sequence
tcagctcacccacatctgct

SEQ ID NO: 412783 - DNA, 20 bp, Artificial
  CRISPR gRNA sequence
acccacatctgctctgtgtg

SEQ ID NO: 412784 - DNA, 20 bp, Artificial
  CRISPR gRNA sequence
ctctgtgtgaactcactcat

SEQ ID NO: 412785 - DNA, 20 bp, Artificial
  CRISPR gRNA sequence
tgtgtgaactcactcattat

SEQ ID NO: 412786 - DNA, 20 bp, Artificial
  CRISPR gRNA sequence
tgtgaactcactcattatgg

SEQ ID NO: 412787 - DNA, 20 bp, Artificial
  CRISPR gRNA sequence
actcattatggtccatctgt

SEQ ID NO: 412788 - DNA, 20 bp, Artificial
  CRISPR gRNA sequence
attatggtccatctgtacac

SEQ ID NO: 412789 - DNA, 20 bp, Artificial
  CRISPR gRNA sequence
tggtccatctgtacacaaaa

SEQ ID NO: 412790 - DNA, 20 bp, Artificial
  CRISPR gRNA sequence
tacacaaaacaaggtctaat

SEQ ID NO: 412791 - DNA, 20 bp, Artificial
  CRISPR gRNA sequence
atatttcagtttattttctt

SEQ ID NO: 412792 - DNA, 20 bp, Artificial
  CRISPR gRNA sequence
cagtttattttcttaaaatc

SEQ ID NO: 412793 - DNA, 20 bp, Artificial
  CRISPR gRNA sequence
agtttattttcttaaaatct

SEQ ID NO: 412794 - DNA, 20 bp, Artificial
  CRISPR gRNA sequence
attttcttaaaatctaaaaa

SEQ ID NO: 412795 - DNA, 20 bp, Artificial
  CRISPR gRNA sequence
ttttcttaaaatctaaaaaa

SEQ ID NO: 412796 - DNA, 20 bp, Artificial
  CRISPR gRNA sequence
tcttaaaatctaaaaaaagt

SEQ ID NO: 412797 - DNA, 20 bp, Artificial
  CRISPR gRNA sequence
cttaaaatctaaaaaaagtt

SEQ ID NO: 412798 - DNA, 20 bp, Artificial
  CRISPR gRNA sequence
ttaaaatctaaaaaaagtta

SEQ ID NO: 412799 - DNA, 20 bp, Artificial
  CRISPR gRNA sequence
aaaatctaaaaaaagttaat

SEQ ID NO: 412800 - DNA, 20 bp, Artificial
  CRISPR gRNA sequence
aaatctaaaaaaagttaatt

SEQ ID NO: 412801 - DNA, 20 bp, Artificial
  CRISPR gRNA sequence
aaaaaagttaattttatttt

SEQ ID NO: 412802 - DNA, 20 bp, Artificial
  CRISPR gRNA sequence
attttattttagttgacaaa

SEQ ID NO: 412803 - DNA, 20 bp, Artificial
  CRISPR gRNA sequence
tattttagttgacaaataat

SEQ ID NO: 412804 - DNA, 20 bp, Artificial
  CRISPR gRNA sequence
attttagttgacaaataata

SEQ ID NO: 412805 - DNA, 20 bp, Artificial
  CRISPR gRNA sequence
ttttagttgacaaataatat

SEQ ID NO: 412806 - DNA, 20 bp, Artificial
  CRISPR gRNA sequence
tagttgacaaataatatttg

SEQ ID NO: 412807 - DNA, 20 bp, Artificial
  CRISPR gRNA sequence
agttgacaaataatatttgt

SEQ ID NO: 412808 - DNA, 20 bp, Artificial
  CRISPR gRNA sequence
gttgacaaataatatttgtg

SEQ ID NO: 412809 - DNA, 20 bp, Artificial
  CRISPR gRNA sequence
acaaataatatttgtgcata

SEQ ID NO: 412810 - DNA, 20 bp, Artificial
  CRISPR gRNA sequence
gtgcatattttgggggtacg

SEQ ID NO: 412811 - DNA, 20 bp, Artificial
  CRISPR gRNA sequence
tgcatattttgggggtacgc

SEQ ID NO: 412812 - DNA, 20 bp, Artificial
  CRISPR gRNA sequence
tgggggtacgctgtgatatt

SEQ ID NO: 412813 - DNA, 20 bp, Artificial
  CRISPR gRNA sequence
gggggtacgctgtgatattt

SEQ ID NO: 412814 - DNA, 20 bp, Artificial
  CRISPR gRNA sequence
ggggtacgctgtgatatttt

SEQ ID NO: 412815 - DNA, 20 bp, Artificial
  CRISPR gRNA sequence
tgatattttgacatatgtat

SEQ ID NO: 412816 - DNA, 20 bp, Artificial
  CRISPR gRNA sequence
tgacatatgtatacaatgta

SEQ ID NO: 412817 - DNA, 20 bp, Artificial
  CRISPR gRNA sequence
gacatatgtatacaatgtag

SEQ ID NO: 412818 - DNA, 20 bp, Artificial
  CRISPR gRNA sequence
acatatgtatacaatgtaga

SEQ ID NO: 412819 - DNA, 20 bp, Artificial
  CRISPR gRNA sequence
aatcaagccaattaacatat

SEQ ID NO: 412820 - DNA, 20 bp, Artificial
  CRISPR gRNA sequence
acatatccaccacttcattt

SEQ ID NO: 412821 - DNA, 20 bp, Artificial
  CRISPR gRNA sequence
catttacctatgatttctac

SEQ ID NO: 412822 - DNA, 20 bp, Artificial
  CRISPR gRNA sequence
atttacctatgatttctact

SEQ ID NO: 412823 - DNA, 20 bp, Artificial
  CRISPR gRNA sequence
acctatgatttctactgtga

SEQ ID NO: 412824 - DNA, 20 bp, Artificial
  CRISPR gRNA sequence
cctatgatttctactgtgag

SEQ ID NO: 412825 - DNA, 20 bp, Artificial
  CRISPR gRNA sequence
tgatttctactgtgagatat

SEQ ID NO: 412826 - DNA, 20 bp, Artificial
  CRISPR gRNA sequence
ctactgtgagatatttgaaa

SEQ ID NO: 412827 - DNA, 20 bp, Artificial
  CRISPR gRNA sequence
tactgtgagatatttgaaat

SEQ ID NO: 412828 - DNA, 20 bp, Artificial
  CRISPR gRNA sequence
ctgtgagatatttgaaattt

SEQ ID NO: 412829 - DNA, 20 bp, Artificial
  CRISPR gRNA sequence
tgagatatttgaaatttact

SEQ ID NO: 412830 - DNA, 20 bp, Artificial
  CRISPR gRNA sequence
gaaatttactcagtcacttt

SEQ ID NO: 412831 - DNA, 20 bp, Artificial
  CRISPR gRNA sequence
aaatttactcagtcactttg

SEQ ID NO: 412832 - DNA, 20 bp, Artificial
  CRISPR gRNA sequence
actcagtcactttgaagtat

SEQ ID NO: 412833 - DNA, 20 bp, Artificial
  CRISPR gRNA sequence
ctcagtcactttgaagtata

SEQ ID NO: 412834 - DNA, 20 bp, Artificial
  CRISPR gRNA sequence
agtcactttgaagtatacat

SEQ ID NO: 412835 - DNA, 20 bp, Artificial
  CRISPR gRNA sequence
tgaagtatacattattattg

SEQ ID NO: 412836 - DNA, 20 bp, Artificial
  CRISPR gRNA sequence
gaagtatacattattattga

SEQ ID NO: 412837 - DNA, 20 bp, Artificial
  CRISPR gRNA sequence
aagtatacattattattgac

SEQ ID NO: 412838 - DNA, 20 bp, Artificial
  CRISPR gRNA sequence
ttattgactatagagactct

SEQ ID NO: 412839 - DNA, 20 bp, Artificial
  CRISPR gRNA sequence
ttgactatagagactctgct

SEQ ID NO: 412840 - DNA, 20 bp, Artificial
  CRISPR gRNA sequence
actatagagactctgctgta

SEQ ID NO: 412841 - DNA, 20 bp, Artificial
  CRISPR gRNA sequence
tagagactctgctgtatgat

SEQ ID NO: 412842 - DNA, 20 bp, Artificial
  CRISPR gRNA sequence
tgctgtatgataaatcttaa

SEQ ID NO: 412843 - DNA, 20 bp, Artificial
  CRISPR gRNA sequence
ctgtatgataaatcttaaaa

SEQ ID NO: 412844 - DNA, 20 bp, Artificial
  CRISPR gRNA sequence
tatgataaatcttaaaactt

SEQ ID NO: 412845 - DNA, 20 bp, Artificial
  CRISPR gRNA sequence
aaaacttggctgggtgctgt

SEQ ID NO: 412846 - DNA, 20 bp, Artificial
  CRISPR gRNA sequence
aaacttggctgggtgctgtg

SEQ ID NO: 412847 - DNA, 20 bp, Artificial
  CRISPR gRNA sequence
ggctgggtgctgtggctcac

SEQ ID NO: 412848 - DNA, 20 bp, Artificial
  CRISPR gRNA sequence
gctgggtgctgtggctcacg

SEQ ID NO: 412849 - DNA, 20 bp, Artificial
  CRISPR gRNA sequence
ggtgctgtggctcacgcctg

SEQ ID NO: 412850 - DNA, 20 bp, Artificial
  CRISPR gRNA sequence
tggctcacgcctgtaattcc

SEQ ID NO: 412851 - DNA, 20 bp, Artificial
  CRISPR gRNA sequence
acgcctgtaattccagcact

SEQ ID NO: 412852 - DNA, 20 bp, Artificial
  CRISPR gRNA sequence
taattccagcactttaggag

SEQ ID NO: 412853 - DNA, 20 bp, Artificial
  CRISPR gRNA sequence
cagcactttaggagaccgag

SEQ ID NO: 412854 - DNA, 20 bp, Artificial
  CRISPR gRNA sequence
taggagaccgaggcaggtgg

SEQ ID NO: 412855 - DNA, 20 bp, Artificial
  CRISPR gRNA sequence
aggagaccgaggcaggtgga

SEQ ID NO: 412856 - DNA, 20 bp, Artificial
  CRISPR gRNA sequence
ggagaccgaggcaggtggat

SEQ ID NO: 412857 - DNA, 20 bp, Artificial
  CRISPR gRNA sequence
gaggtcaggagttcgagacc

SEQ ID NO: 412858 - DNA, 20 bp, Artificial
  CRISPR gRNA sequence
gagaccagcatggccaacat

SEQ ID NO: 412859 - DNA, 20 bp, Artificial
  CRISPR gRNA sequence
tactaaaatataaaaattag

SEQ ID NO: 412860 - DNA, 20 bp, Artificial
  CRISPR gRNA sequence
ctaaaatataaaaattagct

SEQ ID NO: 412861 - DNA, 20 bp, Artificial
  CRISPR gRNA sequence
aaatataaaaattagctggg

SEQ ID NO: 412862 - DNA, 20 bp, Artificial
  CRISPR gRNA sequence
gctgggcattgtggcgggcg

SEQ ID NO: 412863 - DNA, 20 bp, Artificial
  CRISPR gRNA sequence
ggcattgtggcgggcgcctg

SEQ ID NO: 412864 - DNA, 20 bp, Artificial
  CRISPR gRNA sequence
tggcgggcgcctgtagtccc

SEQ ID NO: 412865 - DNA, 20 bp, Artificial
  CRISPR gRNA sequence
tagtcccagctactcagggg

SEQ ID NO: 412866 - DNA, 20 bp, Artificial
  CRISPR gRNA sequence
ctcagggggctgaggcagga

SEQ ID NO: 412867 - DNA, 20 bp, Artificial
  CRISPR gRNA sequence
agggggctgaggcaggagaa

SEQ ID NO: 412868 - DNA, 20 bp, Artificial
  CRISPR gRNA sequence
aggcaggagaatcgcttgaa

SEQ ID NO: 412869 - DNA, 20 bp, Artificial
  CRISPR gRNA sequence
gaacccaggaggcggaggtt

SEQ ID NO: 412870 - DNA, 20 bp, Artificial
  CRISPR gRNA sequence
aacccaggaggcggaggttg

SEQ ID NO: 412871 - DNA, 20 bp, Artificial
  CRISPR gRNA sequence
cagtgagccgagatcgtgcc

SEQ ID NO: 412872 - DNA, 20 bp, Artificial
  CRISPR gRNA sequence
cactccagcctgggtgacaa

SEQ ID NO: 412873 - DNA, 20 bp, Artificial
  CRISPR gRNA sequence
cagcctgggtgacaaaacga

SEQ ID NO: 412874 - DNA, 20 bp, Artificial
  CRISPR gRNA sequence
ggtgacaaaacgagactctg

SEQ ID NO: 412875 - DNA, 20 bp, Artificial
  CRISPR gRNA sequence
tgtctcaaaaaaaaaaaaaa

SEQ ID NO: 412876 - DNA, 20 bp, Artificial
  CRISPR gRNA sequence
tctcaaaaaaaaaaaaaaaa

SEQ ID NO: 412877 - DNA, 20 bp, Artificial
  CRISPR gRNA sequence
aaaaaaaaaaaaaaaagaaa

SEQ ID NO: 412878 - DNA, 20 bp, Artificial
  CRISPR gRNA sequence
aagacttattcccctcgtgt

SEQ ID NO: 412879 - DNA, 20 bp, Artificial
  CRISPR gRNA sequence
agacttattcccctcgtgta

SEQ ID NO: 412880 - DNA, 20 bp, Artificial
  CRISPR gRNA sequence
attcccctcgtgtatctgaa

SEQ ID NO: 412881 - DNA, 20 bp, Artificial
  CRISPR gRNA sequence
ttcccctcgtgtatctgaaa

SEQ ID NO: 412882 - DNA, 20 bp, Artificial
  CRISPR gRNA sequence
ccctcgtgtatctgaaattt

SEQ ID NO: 412883 - DNA, 20 bp, Artificial
  CRISPR gRNA sequence
gtgtatctgaaattttgtac

SEQ ID NO: 412884 - DNA, 20 bp, Artificial
  CRISPR gRNA sequence
aaattttgtactctttgacc

SEQ ID NO: 412885 - DNA, 20 bp, Artificial
  CRISPR gRNA sequence
tgtactctttgaccaacaac

SEQ ID NO: 412886 - DNA, 20 bp, Artificial
  CRISPR gRNA sequence
gtactctttgaccaacaact

SEQ ID NO: 412887 - DNA, 20 bp, Artificial
  CRISPR gRNA sequence
tactctttgaccaacaactc

SEQ ID NO: 412888 - DNA, 20 bp, Artificial
  CRISPR gRNA sequence
tttgaccaacaactcccatt

SEQ ID NO: 412889 - DNA, 20 bp, Artificial
  CRISPR gRNA sequence
tgaccaacaactcccattat

SEQ ID NO: 412890 - DNA, 20 bp, Artificial
  CRISPR gRNA sequence
gaccaacaactcccattatc

SEQ ID NO: 412891 - DNA, 20 bp, Artificial
  CRISPR gRNA sequence
accaacaactcccattatct

SEQ ID NO: 412892 - DNA, 20 bp, Artificial
  CRISPR gRNA sequence
ccattatctccctccccatt

SEQ ID NO: 412893 - DNA, 20 bp, Artificial
  CRISPR gRNA sequence
tctccctccccattctcttg

SEQ ID NO: 412894 - DNA, 20 bp, Artificial
  CRISPR gRNA sequence
cctccccattctcttgcaca

SEQ ID NO: 412895 - DNA, 20 bp, Artificial
  CRISPR gRNA sequence
cccattctcttgcacagcct

SEQ ID NO: 412896 - DNA, 20 bp, Artificial
  CRISPR gRNA sequence
tcttgcacagcctctggtaa

SEQ ID NO: 412897 - DNA, 20 bp, Artificial
  CRISPR gRNA sequence
ttgcacagcctctggtaacc

SEQ ID NO: 412898 - DNA, 20 bp, Artificial
  CRISPR gRNA sequence
gcacagcctctggtaaccat

SEQ ID NO: 412899 - DNA, 20 bp, Artificial
  CRISPR gRNA sequence
cacagcctctggtaaccatc

SEQ ID NO: 412900 - DNA, 20 bp, Artificial
  CRISPR gRNA sequence
tggtaaccatcattctactt

SEQ ID NO: 412901 - DNA, 20 bp, Artificial
  CRISPR gRNA sequence
gtaaccatcattctactttc

SEQ ID NO: 412902 - DNA, 20 bp, Artificial
  CRISPR gRNA sequence
tactttctacttctaagaca

SEQ ID NO: 412903 - DNA, 20 bp, Artificial
  CRISPR gRNA sequence
ctttctacttctaagacatt

SEQ ID NO: 412904 - DNA, 20 bp, Artificial
  CRISPR gRNA sequence
tctacttctaagacattaat

SEQ ID NO: 412905 - DNA, 20 bp, Artificial
  CRISPR gRNA sequence
ctacttctaagacattaatt

SEQ ID NO: 412906 - DNA, 20 bp, Artificial
  CRISPR gRNA sequence
tacttctaagacattaattt

SEQ ID NO: 412907 - DNA, 20 bp, Artificial
  CRISPR gRNA sequence
cttctaagacattaattttt

SEQ ID NO: 412908 - DNA, 20 bp, Artificial
  CRISPR gRNA sequence
ctaagacattaattttttta

SEQ ID NO: 412909 - DNA, 20 bp, Artificial
  CRISPR gRNA sequence
taagacattaatttttttag

SEQ ID NO: 412910 - DNA, 20 bp, Artificial
  CRISPR gRNA sequence
agacattaatttttttaggt

SEQ ID NO: 412911 - DNA, 20 bp, Artificial
  CRISPR gRNA sequence
atttttttaggttccatatt

SEQ ID NO: 412912 - DNA, 20 bp, Artificial
  CRISPR gRNA sequence
ttttaggttccatatttaag

SEQ ID NO: 412913 - DNA, 20 bp, Artificial
  CRISPR gRNA sequence
tttaggttccatatttaagt

SEQ ID NO: 412914 - DNA, 20 bp, Artificial
  CRISPR gRNA sequence
ttaggttccatatttaagtg

SEQ ID NO: 412915 - DNA, 20 bp, Artificial
  CRISPR gRNA sequence
taggttccatatttaagtga

SEQ ID NO: 412916 - DNA, 20 bp, Artificial
  CRISPR gRNA sequence
aggttccatatttaagtgag

SEQ ID NO: 412917 - DNA, 20 bp, Artificial
  CRISPR gRNA sequence
ggttccatatttaagtgaga

SEQ ID NO: 412918 - DNA, 20 bp, Artificial
  CRISPR gRNA sequence
catatttaagtgagattatg

SEQ ID NO: 412919 - DNA, 20 bp, Artificial
  CRISPR gRNA sequence
aagtgagattatgtggtatt

SEQ ID NO: 412920 - DNA, 20 bp, Artificial
  CRISPR gRNA sequence
agtgagattatgtggtattt

SEQ ID NO: 412921 - DNA, 20 bp, Artificial
  CRISPR gRNA sequence
tgtggtatttgtctttcaac

SEQ ID NO: 412922 - DNA, 20 bp, Artificial
  CRISPR gRNA sequence
gtctttcaacagtgtgcgag

SEQ ID NO: 412923 - DNA, 20 bp, Artificial
  CRISPR gRNA sequence
tctttcaacagtgtgcgagg

SEQ ID NO: 412924 - DNA, 20 bp, Artificial
  CRISPR gRNA sequence
tcaacagtgtgcgagggttc

SEQ ID NO: 412925 - DNA, 20 bp, Artificial
  CRISPR gRNA sequence
caacagtgtgcgagggttct

SEQ ID NO: 412926 - DNA, 20 bp, Artificial
  CRISPR gRNA sequence
aacagtgtgcgagggttctc

SEQ ID NO: 412927 - DNA, 20 bp, Artificial
  CRISPR gRNA sequence
tctcttctccatacccttgc

SEQ ID NO: 412928 - DNA, 20 bp, Artificial
  CRISPR gRNA sequence
tcttctccatacccttgcca

SEQ ID NO: 412929 - DNA, 20 bp, Artificial
  CRISPR gRNA sequence
ttctccatacccttgccaac

SEQ ID NO: 412930 - DNA, 20 bp, Artificial
  CRISPR gRNA sequence
ctccatacccttgccaactc

SEQ ID NO: 412931 - DNA, 20 bp, Artificial
  CRISPR gRNA sequence
tccatacccttgccaactct

SEQ ID NO: 412932 - DNA, 20 bp, Artificial
  CRISPR gRNA sequence
catacccttgccaactcttt

SEQ ID NO: 412933 - DNA, 20 bp, Artificial
  CRISPR gRNA sequence
gccaactctttcttctttct

SEQ ID NO: 412934 - DNA, 20 bp, Artificial
  CRISPR gRNA sequence
ccaactctttcttctttctc

SEQ ID NO: 412935 - DNA, 20 bp, Artificial
  CRISPR gRNA sequence
tttcttctttctcccctttc

SEQ ID NO: 412936 - DNA, 20 bp, Artificial
  CRISPR gRNA sequence
tcttctttctcccctttcct

SEQ ID NO: 412937 - DNA, 20 bp, Artificial
  CRISPR gRNA sequence
cttctttctcccctttcctt

SEQ ID NO: 412938 - DNA, 20 bp, Artificial
  CRISPR gRNA sequence
ttctttctcccctttccttc

SEQ ID NO: 412939 - DNA, 20 bp, Artificial
  CRISPR gRNA sequence
ctttctcccctttccttccc

SEQ ID NO: 412940 - DNA, 20 bp, Artificial
  CRISPR gRNA sequence
tttctcccctttccttccct

SEQ ID NO: 412941 - DNA, 20 bp, Artificial
  CRISPR gRNA sequence
tctcccctttccttccctcc

SEQ ID NO: 412942 - DNA, 20 bp, Artificial
  CRISPR gRNA sequence
ctcccctttccttccctcct

SEQ ID NO: 412943 - DNA, 20 bp, Artificial
  CRISPR gRNA sequence
tcccctttccttccctcctt

SEQ ID NO: 412944 - DNA, 20 bp, Artificial
  CRISPR gRNA sequence
ccctttccttccctccttct

SEQ ID NO: 412945 - DNA, 20 bp, Artificial
  CRISPR gRNA sequence
tccttccctccttctttctt

SEQ ID NO: 412946 - DNA, 20 bp, Artificial
  CRISPR gRNA sequence
ccttccctccttctttcttt

SEQ ID NO: 412947 - DNA, 20 bp, Artificial
  CRISPR gRNA sequence
cttccctccttctttctttc

SEQ ID NO: 412948 - DNA, 20 bp, Artificial
  CRISPR gRNA sequence
ccctccttctttctttcttt

SEQ ID NO: 412949 - DNA, 20 bp, Artificial
  CRISPR gRNA sequence
cctccttctttctttctttc

SEQ ID NO: 412950 - DNA, 20 bp, Artificial
  CRISPR gRNA sequence
cttctttctttctttcccct

SEQ ID NO: 412951 - DNA, 20 bp, Artificial
  CRISPR gRNA sequence
ctttctttctttccccttcc

SEQ ID NO: 412952 - DNA, 20 bp, Artificial
  CRISPR gRNA sequence
tttctttctttccccttcct

SEQ ID NO: 412953 - DNA, 20 bp, Artificial
  CRISPR gRNA sequence
tctttctttccccttccttc

SEQ ID NO: 412954 - DNA, 20 bp, Artificial
  CRISPR gRNA sequence
ctttctttccccttccttcc

SEQ ID NO: 412955 - DNA, 20 bp, Artificial
  CRISPR gRNA sequence
tttctttccccttccttcct

SEQ ID NO: 412956 - DNA, 20 bp, Artificial
  CRISPR gRNA sequence
tctttccccttccttccttc

SEQ ID NO: 412957 - DNA, 20 bp, Artificial
  CRISPR gRNA sequence
ctttccccttccttccttcc

SEQ ID NO: 412958 - DNA, 20 bp, Artificial
  CRISPR gRNA sequence
tttccccttccttccttcct

SEQ ID NO: 412959 - DNA, 20 bp, Artificial
  CRISPR gRNA sequence
tccccttccttccttccttc

SEQ ID NO: 412960 - DNA, 20 bp, Artificial
  CRISPR gRNA sequence
ccccttccttccttccttcc

SEQ ID NO: 412961 - DNA, 20 bp, Artificial
  CRISPR gRNA sequence
cccttccttccttccttcct

SEQ ID NO: 412962 - DNA, 20 bp, Artificial
  CRISPR gRNA sequence
ccttccttccttccttcctt

SEQ ID NO: 412963 - DNA, 20 bp, Artificial
  CRISPR gRNA sequence
cttccttccttccttccttt

SEQ ID NO: 412964 - DNA, 20 bp, Artificial
  CRISPR gRNA sequence
ccttccttccttcctttctt

SEQ ID NO: 412965 - DNA, 20 bp, Artificial
  CRISPR gRNA sequence
cttccttccttcctttcttt

SEQ ID NO: 412966 - DNA, 20 bp, Artificial
  CRISPR gRNA sequence
ccttccttcctttctttctt

SEQ ID NO: 412967 - DNA, 20 bp, Artificial
  CRISPR gRNA sequence
cttccttcctttctttcttt

SEQ ID NO: 412968 - DNA, 20 bp, Artificial
  CRISPR gRNA sequence
ccttcctttctttctttctt

SEQ ID NO: 412969 - DNA, 20 bp, Artificial
  CRISPR gRNA sequence
cttcctttctttctttcttt

SEQ ID NO: 412970 - DNA, 20 bp, Artificial
  CRISPR gRNA sequence
cctttctttctttctttctt

SEQ ID NO: 412971 - DNA, 20 bp, Artificial
  CRISPR gRNA sequence
ctttctttctttctttcttt

SEQ ID NO: 412972 - DNA, 20 bp, Artificial
  CRISPR gRNA sequence
tctttctttctttctttctt

SEQ ID NO: 412973 - DNA, 20 bp, Artificial
  CRISPR gRNA sequence
ctttctttctttctttcttt

SEQ ID NO: 412974 - DNA, 20 bp, Artificial
  CRISPR gRNA sequence
tttctttctttctttctttc

SEQ ID NO: 412975 - DNA, 20 bp, Artificial
  CRISPR gRNA sequence
tctttctttctttctttctt

SEQ ID NO: 412976 - DNA, 20 bp, Artificial
  CRISPR gRNA sequence
ctttctttctttctttcttt

SEQ ID NO: 412977 - DNA, 20 bp, Artificial
  CRISPR gRNA sequence
tttctttctttctttctttc

SEQ ID NO: 412978 - DNA, 20 bp, Artificial
  CRISPR gRNA sequence
tctttctttctttctttctc

SEQ ID NO: 412979 - DNA, 20 bp, Artificial
  CRISPR gRNA sequence
ctttctttctttctttctct

SEQ ID NO: 412980 - DNA, 20 bp, Artificial
  CRISPR gRNA sequence
tttctttctttctttctctc

SEQ ID NO: 412981 - DNA, 20 bp, Artificial
  CRISPR gRNA sequence
tctttctttctttctctctt

SEQ ID NO: 412982 - DNA, 20 bp, Artificial
  CRISPR gRNA sequence
ctttctttctttctctcttt

SEQ ID NO: 412983 - DNA, 20 bp, Artificial
  CRISPR gRNA sequence
tttctttctttctctctttc

SEQ ID NO: 412984 - DNA, 20 bp, Artificial
  CRISPR gRNA sequence
tctttctttctctctttctt

SEQ ID NO: 412985 - DNA, 20 bp, Artificial
  CRISPR gRNA sequence
ctttctttctctctttcttt

SEQ ID NO: 412986 - DNA, 20 bp, Artificial
  CRISPR gRNA sequence
tttctttctctctttctttt

SEQ ID NO: 412987 - DNA, 20 bp, Artificial
  CRISPR gRNA sequence
tctttctctctttctttttc

SEQ ID NO: 412988 - DNA, 20 bp, Artificial
  CRISPR gRNA sequence
ctttctctctttctttttct

SEQ ID NO: 412989 - DNA, 20 bp, Artificial
  CRISPR gRNA sequence
tttctctctttctttttctt

SEQ ID NO: 412990 - DNA, 20 bp, Artificial
  CRISPR gRNA sequence
tctctctttctttttctttc

SEQ ID NO: 412991 - DNA, 20 bp, Artificial
  CRISPR gRNA sequence
ctctctttctttttctttct

SEQ ID NO: 412992 - DNA, 20 bp, Artificial
  CRISPR gRNA sequence
tctctttctttttctttctt

SEQ ID NO: 412993 - DNA, 20 bp, Artificial
  CRISPR gRNA sequence
tctttctttttctttctttc

SEQ ID NO: 412994 - DNA, 20 bp, Artificial
  CRISPR gRNA sequence
tttctttttctttctttctt

SEQ ID NO: 412995 - DNA, 20 bp, Artificial
  CRISPR gRNA sequence
tctttttctttctttctttc

SEQ ID NO: 412996 - DNA, 20 bp, Artificial
  CRISPR gRNA sequence
ctttttctttctttctttct

SEQ ID NO: 412997 - DNA, 20 bp, Artificial
  CRISPR gRNA sequence
tttttctttctttctttctc

SEQ ID NO: 412998 - DNA, 20 bp, Artificial
  CRISPR gRNA sequence
tttctttctttctttctctt

SEQ ID NO: 412999 - DNA, 20 bp, Artificial
  CRISPR gRNA sequence
ttctttctttctttctcttc

SEQ ID NO: 413000 - DNA, 20 bp, Artificial
  CRISPR gRNA sequence
tctttctttctttctcttct

SEQ ID NO: 413001 - DNA, 20 bp, Artificial
  CRISPR gRNA sequence
ctttctttctttctcttctc

SEQ ID NO: 413002 - DNA, 20 bp, Artificial
  CRISPR gRNA sequence
tttctttctttctcttctct

SEQ ID NO: 413003 - DNA, 20 bp, Artificial
  CRISPR gRNA sequence
tctttctttctcttctcttc

SEQ ID NO: 413004 - DNA, 20 bp, Artificial
  CRISPR gRNA sequence
ctttctttctcttctcttcc

SEQ ID NO: 413005 - DNA, 20 bp, Artificial
  CRISPR gRNA sequence
tttctttctcttctcttcct

SEQ ID NO: 413006 - DNA, 20 bp, Artificial
  CRISPR gRNA sequence
tctttctcttctcttccttt

SEQ ID NO: 413007 - DNA, 20 bp, Artificial
  CRISPR gRNA sequence
ctttctcttctcttcctttc

SEQ ID NO: 413008 - DNA, 20 bp, Artificial
  CRISPR gRNA sequence
tttctcttctcttcctttcc

SEQ ID NO: 413009 - DNA, 20 bp, Artificial
  CRISPR gRNA sequence
tctcttctcttcctttccct

SEQ ID NO: 413010 - DNA, 20 bp, Artificial
  CRISPR gRNA sequence
ctcttctcttcctttccctt

SEQ ID NO: 413011 - DNA, 20 bp, Artificial
  CRISPR gRNA sequence
tcttctcttcctttcccttc

SEQ ID NO: 413012 - DNA, 20 bp, Artificial
  CRISPR gRNA sequence
ttctcttcctttcccttccc

SEQ ID NO: 413013 - DNA, 20 bp, Artificial
  CRISPR gRNA sequence
ctcttcctttcccttccctt

SEQ ID NO: 413014 - DNA, 20 bp, Artificial
  CRISPR gRNA sequence
tcttcctttcccttcccttc

SEQ ID NO: 413015 - DNA, 20 bp, Artificial
  CRISPR gRNA sequence
ttcctttcccttcccttccc

SEQ ID NO: 413016 - DNA, 20 bp, Artificial
  CRISPR gRNA sequence
cctttcccttcccttccctt

SEQ ID NO: 413017 - DNA, 20 bp, Artificial
  CRISPR gRNA sequence
ctttcccttcccttcccttc

SEQ ID NO: 413018 - DNA, 20 bp, Artificial
  CRISPR gRNA sequence
tcccttcccttcccttccct

SEQ ID NO: 413019 - DNA, 20 bp, Artificial
  CRISPR gRNA sequence
cccttcccttcccttccctc

SEQ ID NO: 413020 - DNA, 20 bp, Artificial
  CRISPR gRNA sequence
ccttcccttcccttccctcc

SEQ ID NO: 413021 - DNA, 20 bp, Artificial
  CRISPR gRNA sequence
cccttcccttccctcccctt

SEQ ID NO: 413022 - DNA, 20 bp, Artificial
  CRISPR gRNA sequence
ccttcccttccctccccttc

SEQ ID NO: 413023 - DNA, 20 bp, Artificial
  CRISPR gRNA sequence
cccttccctccccttccttc

SEQ ID NO: 413024 - DNA, 20 bp, Artificial
  CRISPR gRNA sequence
ccttccctccccttccttct

SEQ ID NO: 413025 - DNA, 20 bp, Artificial
  CRISPR gRNA sequence
ccctccccttccttctttcc

SEQ ID NO: 413026 - DNA, 20 bp, Artificial
  CRISPR gRNA sequence
cctccccttccttctttccg

SEQ ID NO: 413027 - DNA, 20 bp, Artificial
  CRISPR gRNA sequence
cccttccttctttccgcctt

SEQ ID NO: 413028 - DNA, 20 bp, Artificial
  CRISPR gRNA sequence
ccttctttccgccttcctta

SEQ ID NO: 413029 - DNA, 20 bp, Artificial
  CRISPR gRNA sequence
cttctttccgccttccttac

SEQ ID NO: 413030 - DNA, 20 bp, Artificial
  CRISPR gRNA sequence
ctttccgccttccttacttc

SEQ ID NO: 413031 - DNA, 20 bp, Artificial
  CRISPR gRNA sequence
tttccgccttccttacttcc

SEQ ID NO: 413032 - DNA, 20 bp, Artificial
  CRISPR gRNA sequence
tccgccttccttacttcctt

SEQ ID NO: 413033 - DNA, 20 bp, Artificial
  CRISPR gRNA sequence
ccgccttccttacttccttt

SEQ ID NO: 413034 - DNA, 20 bp, Artificial
  CRISPR gRNA sequence
cgccttccttacttcctttc

SEQ ID NO: 413035 - DNA, 20 bp, Artificial
  CRISPR gRNA sequence
ccttacttcctttctctttc

SEQ ID NO: 413036 - DNA, 20 bp, Artificial
  CRISPR gRNA sequence
cttacttcctttctctttct

SEQ ID NO: 413037 - DNA, 20 bp, Artificial
  CRISPR gRNA sequence
acttcctttctctttctttc

SEQ ID NO: 413038 - DNA, 20 bp, Artificial
  CRISPR gRNA sequence
cttcctttctctttctttct

SEQ ID NO: 413039 - DNA, 20 bp, Artificial
  CRISPR gRNA sequence
cctttctctttctttctcct

SEQ ID NO: 413040 - DNA, 20 bp, Artificial
  CRISPR gRNA sequence
ctttctctttctttctcctc

SEQ ID NO: 413041 - DNA, 20 bp, Artificial
  CRISPR gRNA sequence
tctctttctttctcctccct

SEQ ID NO: 413042 - DNA, 20 bp, Artificial
  CRISPR gRNA sequence
ctctttctttctcctccctg

SEQ ID NO: 413043 - DNA, 20 bp, Artificial
  CRISPR gRNA sequence
tctttctttctcctccctgc

SEQ ID NO: 413044 - DNA, 20 bp, Artificial
  CRISPR gRNA sequence
tttctttctcctccctgcct

SEQ ID NO: 413045 - DNA, 20 bp, Artificial
  CRISPR gRNA sequence
tctttctcctccctgcctgc

SEQ ID NO: 413046 - DNA, 20 bp, Artificial
  CRISPR gRNA sequence
ctttctcctccctgcctgcc

SEQ ID NO: 413047 - DNA, 20 bp, Artificial
  CRISPR gRNA sequence
tttctcctccctgcctgcct

SEQ ID NO: 413048 - DNA, 20 bp, Artificial
  CRISPR gRNA sequence
tctcctccctgcctgcctgc

SEQ ID NO: 413049 - DNA, 20 bp, Artificial
  CRISPR gRNA sequence
ctcctccctgcctgcctgcc

SEQ ID NO: 413050 - DNA, 20 bp, Artificial
  CRISPR gRNA sequence
tcctccctgcctgcctgcct

SEQ ID NO: 413051 - DNA, 20 bp, Artificial
  CRISPR gRNA sequence
ctccctgcctgcctgcctgc

SEQ ID NO: 413052 - DNA, 20 bp, Artificial
  CRISPR gRNA sequence
cctgcctgcctgcctgcctt

SEQ ID NO: 413053 - DNA, 20 bp, Artificial
  CRISPR gRNA sequence
cctgcctgcctgccttcctc

SEQ ID NO: 413054 - DNA, 20 bp, Artificial
  CRISPR gRNA sequence
cctgcctgccttcctccccc

SEQ ID NO: 413055 - DNA, 20 bp, Artificial
  CRISPR gRNA sequence
cctgccttcctcccccgctt

SEQ ID NO: 413056 - DNA, 20 bp, Artificial
  CRISPR gRNA sequence
ccttcctcccccgctttcct

SEQ ID NO: 413057 - DNA, 20 bp, Artificial
  CRISPR gRNA sequence
cctcccccgctttccttccc

SEQ ID NO: 413058 - DNA, 20 bp, Artificial
  CRISPR gRNA sequence
ctcccccgctttccttccct

SEQ ID NO: 413059 - DNA, 20 bp, Artificial
  CRISPR gRNA sequence
ccccgctttccttcccttcc

SEQ ID NO: 413060 - DNA, 20 bp, Artificial
  CRISPR gRNA sequence
tccttcccttccattccttt

SEQ ID NO: 413061 - DNA, 20 bp, Artificial
  CRISPR gRNA sequence
ccttcccttccattcctttc

SEQ ID NO: 413062 - DNA, 20 bp, Artificial
  CRISPR gRNA sequence
cttcccttccattcctttcc

SEQ ID NO: 413063 - DNA, 20 bp, Artificial
  CRISPR gRNA sequence
cccttccattcctttcctct

SEQ ID NO: 413064 - DNA, 20 bp, Artificial
  CRISPR gRNA sequence
ccttccattcctttcctctt

SEQ ID NO: 413065 - DNA, 20 bp, Artificial
  CRISPR gRNA sequence
ccattcctttcctctttctc

SEQ ID NO: 413066 - DNA, 20 bp, Artificial
  CRISPR gRNA sequence
cattcctttcctctttctct

SEQ ID NO: 413067 - DNA, 20 bp, Artificial
  CRISPR gRNA sequence
ctttcctctttctctctctc

SEQ ID NO: 413068 - DNA, 20 bp, Artificial
  CRISPR gRNA sequence
tcctctttctctctctctct

SEQ ID NO: 413069 - DNA, 20 bp, Artificial
  CRISPR gRNA sequence
cctctttctctctctctctc

SEQ ID NO: 413070 - DNA, 20 bp, Artificial
  CRISPR gRNA sequence
ctctttctctctctctctcc

SEQ ID NO: 413071 - DNA, 20 bp, Artificial
  CRISPR gRNA sequence
tttctctctctctctccttt

SEQ ID NO: 413072 - DNA, 20 bp, Artificial
  CRISPR gRNA sequence
tctctctctctctcctttct

SEQ ID NO: 413073 - DNA, 20 bp, Artificial
  CRISPR gRNA sequence
ctctctctctctcctttctt

SEQ ID NO: 413074 - DNA, 20 bp, Artificial
  CRISPR gRNA sequence
tctctctctctcctttcttt

SEQ ID NO: 413075 - DNA, 20 bp, Artificial
  CRISPR gRNA sequence
tctctctctcctttctttct

SEQ ID NO: 413076 - DNA, 20 bp, Artificial
  CRISPR gRNA sequence
tctctctcctttctttcttt

SEQ ID NO: 413077 - DNA, 20 bp, Artificial
  CRISPR gRNA sequence
tctctcctttctttctttct

SEQ ID NO: 413078 - DNA, 20 bp, Artificial
  CRISPR gRNA sequence
tctcctttctttctttcttc

SEQ ID NO: 413079 - DNA, 20 bp, Artificial
  CRISPR gRNA sequence
tcctttctttctttcttctt

SEQ ID NO: 413080 - DNA, 20 bp, Artificial
  CRISPR gRNA sequence
ctttctttctttcttctttt

SEQ ID NO: 413081 - DNA, 20 bp, Artificial
  CRISPR gRNA sequence
tctttctttcttcttttact

SEQ ID NO: 413082 - DNA, 20 bp, Artificial
  CRISPR gRNA sequence
ctttctttcttcttttactg

SEQ ID NO: 413083 - DNA, 20 bp, Artificial
  CRISPR gRNA sequence
tttctttcttcttttactga

SEQ ID NO: 413084 - DNA, 20 bp, Artificial
  CRISPR gRNA sequence
tctttcttcttttactgaaa

SEQ ID NO: 413085 - DNA, 20 bp, Artificial
  CRISPR gRNA sequence
ctttcttcttttactgaaac

SEQ ID NO: 413086 - DNA, 20 bp, Artificial
  CRISPR gRNA sequence
tttcttcttttactgaaaca

SEQ ID NO: 413087 - DNA, 20 bp, Artificial
  CRISPR gRNA sequence
tcttcttttactgaaacaaa

SEQ ID NO: 413088 - DNA, 20 bp, Artificial
  CRISPR gRNA sequence
cttcttttactgaaacaaaa

SEQ ID NO: 413089 - DNA, 20 bp, Artificial
  CRISPR gRNA sequence
ttcttttactgaaacaaaag

SEQ ID NO: 413090 - DNA, 20 bp, Artificial
  CRISPR gRNA sequence
cttttactgaaacaaaagtt

SEQ ID NO: 413091 - DNA, 20 bp, Artificial
  CRISPR gRNA sequence
ttttactgaaacaaaagttc

SEQ ID NO: 413092 - DNA, 20 bp, Artificial
  CRISPR gRNA sequence
ttactgaaacaaaagttctc

SEQ ID NO: 413093 - DNA, 20 bp, Artificial
  CRISPR gRNA sequence
tactgaaacaaaagttctca

SEQ ID NO: 413094 - DNA, 20 bp, Artificial
  CRISPR gRNA sequence
actgaaacaaaagttctcac

SEQ ID NO: 413095 - DNA, 20 bp, Artificial
  CRISPR gRNA sequence
ctgaaacaaaagttctcaca

SEQ ID NO: 413096 - DNA, 20 bp, Artificial
  CRISPR gRNA sequence
aaacaaaagttctcacatat

SEQ ID NO: 413097 - DNA, 20 bp, Artificial
  CRISPR gRNA sequence
tcacatatttattactgaac

SEQ ID NO: 413098 - DNA, 20 bp, Artificial
  CRISPR gRNA sequence
acatatttattactgaacct

SEQ ID NO: 413099 - DNA, 20 bp, Artificial
  CRISPR gRNA sequence
attactgaacctacctacta

SEQ ID NO: 413100 - DNA, 20 bp, Artificial
  CRISPR gRNA sequence
ttactgaacctacctactag

SEQ ID NO: 413101 - DNA, 20 bp, Artificial
  CRISPR gRNA sequence
ctgaacctacctactagtgc

SEQ ID NO: 413102 - DNA, 20 bp, Artificial
  CRISPR gRNA sequence
aacctacctactagtgcaga

SEQ ID NO: 413103 - DNA, 20 bp, Artificial
  CRISPR gRNA sequence
cctactagtgcagagcatat

SEQ ID NO: 413104 - DNA, 20 bp, Artificial
  CRISPR gRNA sequence
ctagtgcagagcatataaac

SEQ ID NO: 413105 - DNA, 20 bp, Artificial
  CRISPR gRNA sequence
gtgcagagcatataaacaaa

SEQ ID NO: 413106 - DNA, 20 bp, Artificial
  CRISPR gRNA sequence
ccaataaaacatgttcgact

SEQ ID NO: 413107 - DNA, 20 bp, Artificial
  CRISPR gRNA sequence
gactgtccagatagtggtga

SEQ ID NO: 413108 - DNA, 20 bp, Artificial
  CRISPR gRNA sequence
tccagatagtggtgacattc

SEQ ID NO: 413109 - DNA, 20 bp, Artificial
  CRISPR gRNA sequence
acagatcgatatggtgacat

SEQ ID NO: 413110 - DNA, 20 bp, Artificial
  CRISPR gRNA sequence
tgacacagcgtaaacctgtg

SEQ ID NO: 413111 - DNA, 20 bp, Artificial
  CRISPR gRNA sequence
gacacagcgtaaacctgtgt

SEQ ID NO: 413112 - DNA, 20 bp, Artificial
  CRISPR gRNA sequence
acacagcgtaaacctgtgtg

SEQ ID NO: 413113 - DNA, 20 bp, Artificial
  CRISPR gRNA sequence
tgtgccatctcacgtacaat

SEQ ID NO: 413114 - DNA, 20 bp, Artificial
  CRISPR gRNA sequence
acgtacaattccgtataaac

SEQ ID NO: 413115 - DNA, 20 bp, Artificial
  CRISPR gRNA sequence
cgtataaacccagcttggtt

SEQ ID NO: 413116 - DNA, 20 bp, Artificial
  CRISPR gRNA sequence
ggttcttcttcagtggctcc

SEQ ID NO: 413117 - DNA, 20 bp, Artificial
  CRISPR gRNA sequence
gttcttcttcagtggctccg

SEQ ID NO: 413118 - DNA, 20 bp, Artificial
  CRISPR gRNA sequence
ttcttcagtggctccgtttt

SEQ ID NO: 413119 - DNA, 20 bp, Artificial
  CRISPR gRNA sequence
cttcagtggctccgttttgg

SEQ ID NO: 413120 - DNA, 20 bp, Artificial
  CRISPR gRNA sequence
ttcagtggctccgttttgga

SEQ ID NO: 413121 - DNA, 20 bp, Artificial
  CRISPR gRNA sequence
cagtggctccgttttggagc

SEQ ID NO: 413122 - DNA, 20 bp, Artificial
  CRISPR gRNA sequence
agtggctccgttttggagct

SEQ ID NO: 413123 - DNA, 20 bp, Artificial
  CRISPR gRNA sequence
cgttttggagctgtaactgg

SEQ ID NO: 413124 - DNA, 20 bp, Artificial
  CRISPR gRNA sequence
tggagctgtaactggttgta

SEQ ID NO: 413125 - DNA, 20 bp, Artificial
  CRISPR gRNA sequence
ggagctgtaactggttgtat

SEQ ID NO: 413126 - DNA, 20 bp, Artificial
  CRISPR gRNA sequence
gagctgtaactggttgtatt

SEQ ID NO: 413127 - DNA, 20 bp, Artificial
  CRISPR gRNA sequence
taactggttgtattaccagc

SEQ ID NO: 413128 - DNA, 20 bp, Artificial
  CRISPR gRNA sequence
gttgtattaccagctgtcat

SEQ ID NO: 413129 - DNA, 20 bp, Artificial
  CRISPR gRNA sequence
tattaccagctgtcatctga

SEQ ID NO: 413130 - DNA, 20 bp, Artificial
  CRISPR gRNA sequence
ccagctgtcatctgaatcca

SEQ ID NO: 413131 - DNA, 20 bp, Artificial
  CRISPR gRNA sequence
tcatctgaatccactgggaa

SEQ ID NO: 413132 - DNA, 20 bp, Artificial
  CRISPR gRNA sequence
aatccactgggaaatggtgc

SEQ ID NO: 413133 - DNA, 20 bp, Artificial
  CRISPR gRNA sequence
ggaaatggtgctgtgggaag

SEQ ID NO: 413134 - DNA, 20 bp, Artificial
  CRISPR gRNA sequence
tgggaagtcagggaacctga

SEQ ID NO: 413135 - DNA, 20 bp, Artificial
  CRISPR gRNA sequence
aacggagggactggctgaag

SEQ ID NO: 413136 - DNA, 20 bp, Artificial
  CRISPR gRNA sequence
gctgaagccatggcagaaga

SEQ ID NO: 413137 - DNA, 20 bp, Artificial
  CRISPR gRNA sequence
aagccatggcagaagaattt

SEQ ID NO: 413138 - DNA, 20 bp, Artificial
  CRISPR gRNA sequence
aaattgtgaagatttcatgg

SEQ ID NO: 413139 - DNA, 20 bp, Artificial
  CRISPR gRNA sequence
aattgtgaagatttcatgga

SEQ ID NO: 413140 - DNA, 20 bp, Artificial
  CRISPR gRNA sequence
tgaagatttcatggacattt

SEQ ID NO: 413141 - DNA, 20 bp, Artificial
  CRISPR gRNA sequence
catggacatttatcacttcc

SEQ ID NO: 413142 - DNA, 20 bp, Artificial
  CRISPR gRNA sequence
atggacatttatcacttccc

SEQ ID NO: 413143 - DNA, 20 bp, Artificial
  CRISPR gRNA sequence
atcacttccccagtcaatac

SEQ ID NO: 413144 - DNA, 20 bp, Artificial
  CRISPR gRNA sequence
tcacttccccagtcaatact

SEQ ID NO: 413145 - DNA, 20 bp, Artificial
  CRISPR gRNA sequence
ccccagtcaatactcttgtg

SEQ ID NO: 413146 - DNA, 20 bp, Artificial
  CRISPR gRNA sequence
cccagtcaatactcttgtga

SEQ ID NO: 413147 - DNA, 20 bp, Artificial
  CRISPR gRNA sequence
ttgtgatttcctatgcttgt

SEQ ID NO: 413148 - DNA, 20 bp, Artificial
  CRISPR gRNA sequence
gtgatttcctatgcttgtct

SEQ ID NO: 413149 - DNA, 20 bp, Artificial
  CRISPR gRNA sequence
tgatttcctatgcttgtctt

SEQ ID NO: 413150 - DNA, 20 bp, Artificial
  CRISPR gRNA sequence
cctatgcttgtctttacttt

SEQ ID NO: 413151 - DNA, 20 bp, Artificial
  CRISPR gRNA sequence
ctatgcttgtctttacttta

SEQ ID NO: 413152 - DNA, 20 bp, Artificial
  CRISPR gRNA sequence
tgcttgtctttactttaatc

SEQ ID NO: 413153 - DNA, 20 bp, Artificial
  CRISPR gRNA sequence
gtctttactttaatctctta

SEQ ID NO: 413154 - DNA, 20 bp, Artificial
  CRISPR gRNA sequence
tctttactttaatctcttaa

SEQ ID NO: 413155 - DNA, 20 bp, Artificial
  CRISPR gRNA sequence
tactttaatctcttaatccc

SEQ ID NO: 413156 - DNA, 20 bp, Artificial
  CRISPR gRNA sequence
actttaatctcttaatcccg

SEQ ID NO: 413157 - DNA, 20 bp, Artificial
  CRISPR gRNA sequence
ctttaatctcttaatcccgt

SEQ ID NO: 413158 - DNA, 20 bp, Artificial
  CRISPR gRNA sequence
taatctcttaatcccgtcat

SEQ ID NO: 413159 - DNA, 20 bp, Artificial
  CRISPR gRNA sequence
aatctcttaatcccgtcatc

SEQ ID NO: 413160 - DNA, 20 bp, Artificial
  CRISPR gRNA sequence
atctcttaatcccgtcatct

SEQ ID NO: 413161 - DNA, 20 bp, Artificial
  CRISPR gRNA sequence
ttaatcccgtcatcttcgta

SEQ ID NO: 413162 - DNA, 20 bp, Artificial
  CRISPR gRNA sequence
aatcccgtcatcttcgtaag

SEQ ID NO: 413163 - DNA, 20 bp, Artificial
  CRISPR gRNA sequence
atcccgtcatcttcgtaagc

SEQ ID NO: 413164 - DNA, 20 bp, Artificial
  CRISPR gRNA sequence
cgtaagctgaggatgtatgt

SEQ ID NO: 413165 - DNA, 20 bp, Artificial
  CRISPR gRNA sequence
gtaagctgaggatgtatgtc

SEQ ID NO: 413166 - DNA, 20 bp, Artificial
  CRISPR gRNA sequence
aggatgtatgtcacctcagg

SEQ ID NO: 413167 - DNA, 20 bp, Artificial
  CRISPR gRNA sequence
aggaccctgtgatggttgtg

SEQ ID NO: 413168 - DNA, 20 bp, Artificial
  CRISPR gRNA sequence
tgatggttgtgttaactgca

SEQ ID NO: 413169 - DNA, 20 bp, Artificial
  CRISPR gRNA sequence
tgttaactgcacaaattgtt

SEQ ID NO: 413170 - DNA, 20 bp, Artificial
  CRISPR gRNA sequence
actgcacaaattgtttgtaa

SEQ ID NO: 413171 - DNA, 20 bp, Artificial
  CRISPR gRNA sequence
cacaaattgtttgtaaagca

SEQ ID NO: 413172 - DNA, 20 bp, Artificial
  CRISPR gRNA sequence
tttgtaaagcatgtatgttt

SEQ ID NO: 413173 - DNA, 20 bp, Artificial
  CRISPR gRNA sequence
gtaaagcatgtatgtttgaa

SEQ ID NO: 413174 - DNA, 20 bp, Artificial
  CRISPR gRNA sequence
taaagcatgtatgtttgaac

SEQ ID NO: 413175 - DNA, 20 bp, Artificial
  CRISPR gRNA sequence
gaacaatatgaaatctgggc

SEQ ID NO: 413176 - DNA, 20 bp, Artificial
  CRISPR gRNA sequence
aacaatatgaaatctgggca

SEQ ID NO: 413177 - DNA, 20 bp, Artificial
  CRISPR gRNA sequence
ggcaccttaagaacaggata

SEQ ID NO: 413178 - DNA, 20 bp, Artificial
  CRISPR gRNA sequence
aagaacaggataactgtgat

SEQ ID NO: 413179 - DNA, 20 bp, Artificial
  CRISPR gRNA sequence
agaacaggataactgtgatt

SEQ ID NO: 413180 - DNA, 20 bp, Artificial
  CRISPR gRNA sequence
tgattttcagagaacaaggg

SEQ ID NO: 413181 - DNA, 20 bp, Artificial
  CRISPR gRNA sequence
tcagagaacaagggagataa

SEQ ID NO: 413182 - DNA, 20 bp, Artificial
  CRISPR gRNA sequence
cagagaacaagggagataac

SEQ ID NO: 413183 - DNA, 20 bp, Artificial
  CRISPR gRNA sequence
agagaacaagggagataacc

SEQ ID NO: 413184 - DNA, 20 bp, Artificial
  CRISPR gRNA sequence
aaagtctggctgcctgtagg

SEQ ID NO: 413185 - DNA, 20 bp, Artificial
  CRISPR gRNA sequence
aagtctggctgcctgtaggc

SEQ ID NO: 413186 - DNA, 20 bp, Artificial
  CRISPR gRNA sequence
gctgcctgtaggccagtcag

SEQ ID NO: 413187 - DNA, 20 bp, Artificial
  CRISPR gRNA sequence
cctgtaggccagtcaggaca

SEQ ID NO: 413188 - DNA, 20 bp, Artificial
  CRISPR gRNA sequence
taggccagtcaggacagagc

SEQ ID NO: 413189 - DNA, 20 bp, Artificial
  CRISPR gRNA sequence
ctcttattatcgaaaatggg

SEQ ID NO: 413190 - DNA, 20 bp, Artificial
  CRISPR gRNA sequence
tcttattatcgaaaatgggt

SEQ ID NO: 413191 - DNA, 20 bp, Artificial
  CRISPR gRNA sequence
ttattatcgaaaatgggtaa

SEQ ID NO: 413192 - DNA, 20 bp, Artificial
  CRISPR gRNA sequence
attatcgaaaatgggtaaga

SEQ ID NO: 413193 - DNA, 20 bp, Artificial
  CRISPR gRNA sequence
ttatcgaaaatgggtaagag

SEQ ID NO: 413194 - DNA, 20 bp, Artificial
  CRISPR gRNA sequence
tcgaaaatgggtaagagaaa

SEQ ID NO: 413195 - DNA, 20 bp, Artificial
  CRISPR gRNA sequence
aattccttccccagtaagga

SEQ ID NO: 413196 - DNA, 20 bp, Artificial
  CRISPR gRNA sequence
cttccccagtaaggaatatt

SEQ ID NO: 413197 - DNA, 20 bp, Artificial
  CRISPR gRNA sequence
ccccagtaaggaatattaat

SEQ ID NO: 413198 - DNA, 20 bp, Artificial
  CRISPR gRNA sequence
cccagtaaggaatattaata

SEQ ID NO: 413199 - DNA, 20 bp, Artificial
  CRISPR gRNA sequence
ataattcacagccctgggaa

SEQ ID NO: 413200 - DNA, 20 bp, Artificial
  CRISPR gRNA sequence
acagccctgggaaaagaatg

SEQ ID NO: 413201 - DNA, 20 bp, Artificial
  CRISPR gRNA sequence
ggaaaagaatgctttcctgg

SEQ ID NO: 413202 - DNA, 20 bp, Artificial
  CRISPR gRNA sequence
tcctggggggaggagagccc

SEQ ID NO: 413203 - DNA, 20 bp, Artificial
  CRISPR gRNA sequence
cctggggggaggagagccct

SEQ ID NO: 413204 - DNA, 20 bp, Artificial
  CRISPR gRNA sequence
ctggggggaggagagccctc

SEQ ID NO: 413205 - DNA, 20 bp, Artificial
  CRISPR gRNA sequence
gggggaggagagccctctat

SEQ ID NO: 413206 - DNA, 20 bp, Artificial
  CRISPR gRNA sequence
tataatggcctctcagcggg

SEQ ID NO: 413207 - DNA, 20 bp, Artificial
  CRISPR gRNA sequence
taatggcctctcagcggggg

SEQ ID NO: 413208 - DNA, 20 bp, Artificial
  CRISPR gRNA sequence
tcagcggggggtgtctgcct

SEQ ID NO: 413209 - DNA, 20 bp, Artificial
  CRISPR gRNA sequence
agcggggggtgtctgcctta

SEQ ID NO: 413210 - DNA, 20 bp, Artificial
  CRISPR gRNA sequence
ccttatgcagttgcagataa

SEQ ID NO: 413211 - DNA, 20 bp, Artificial
  CRISPR gRNA sequence
atgcagttgcagataaggga

SEQ ID NO: 413212 - DNA, 20 bp, Artificial
  CRISPR gRNA sequence
tgcagttgcagataagggat

SEQ ID NO: 413213 - DNA, 20 bp, Artificial
  CRISPR gRNA sequence
cagataagggatgaaacatg

SEQ ID NO: 413214 - DNA, 20 bp, Artificial
  CRISPR gRNA sequence
gcctcctgcagcacccccag

SEQ ID NO: 413215 - DNA, 20 bp, Artificial
  CRISPR gRNA sequence
ctgcagcacccccaggcttg

SEQ ID NO: 413216 - DNA, 20 bp, Artificial
  CRISPR gRNA sequence
cagcacccccaggcttgcta

SEQ ID NO: 413217 - DNA, 20 bp, Artificial
  CRISPR gRNA sequence
gctaggattaggaaattcca

SEQ ID NO: 413218 - DNA, 20 bp, Artificial
  CRISPR gRNA sequence
ctaggattaggaaattccag

SEQ ID NO: 413219 - DNA, 20 bp, Artificial
  CRISPR gRNA sequence
ggattaggaaattccagcct

SEQ ID NO: 413220 - DNA, 20 bp, Artificial
  CRISPR gRNA sequence
ggaaattccagcctggcgaa

SEQ ID NO: 413221 - DNA, 20 bp, Artificial
  CRISPR gRNA sequence
cagcctggcgaattctagtc

SEQ ID NO: 413222 - DNA, 20 bp, Artificial
  CRISPR gRNA sequence
gcgaattctagtcagactgg

SEQ ID NO: 413223 - DNA, 20 bp, Artificial
  CRISPR gRNA sequence
tagtcagactggttctctgc

SEQ ID NO: 413224 - DNA, 20 bp, Artificial
  CRISPR gRNA sequence
gtcagactggttctctgctc

SEQ ID NO: 413225 - DNA, 20 bp, Artificial
  CRISPR gRNA sequence
gttctctgctcttgaaccct

SEQ ID NO: 413226 - DNA, 20 bp, Artificial
  CRISPR gRNA sequence
tctgctcttgaaccctgtta

SEQ ID NO: 413227 - DNA, 20 bp, Artificial
  CRISPR gRNA sequence
tgctcttgaaccctgttaag

SEQ ID NO: 413228 - DNA, 20 bp, Artificial
  CRISPR gRNA sequence
ctcttgaaccctgttaagat

SEQ ID NO: 413229 - DNA, 20 bp, Artificial
  CRISPR gRNA sequence
ttgaaccctgttaagatgtt

SEQ ID NO: 413230 - DNA, 20 bp, Artificial
  CRISPR gRNA sequence
gaaccctgttaagatgttta

SEQ ID NO: 413231 - DNA, 20 bp, Artificial
  CRISPR gRNA sequence
aaccctgttaagatgtttat

SEQ ID NO: 413232 - DNA, 20 bp, Artificial
  CRISPR gRNA sequence
ttaagatgtttatcagtgac

SEQ ID NO: 413233 - DNA, 20 bp, Artificial
  CRISPR gRNA sequence
agatgtttatcagtgacagt

SEQ ID NO: 413234 - DNA, 20 bp, Artificial
  CRISPR gRNA sequence
atcagtgacagtgtgttcct

SEQ ID NO: 413235 - DNA, 20 bp, Artificial
  CRISPR gRNA sequence
tcagtgacagtgtgttcctg

SEQ ID NO: 413236 - DNA, 20 bp, Artificial
  CRISPR gRNA sequence
ctgaaacttcattagcaatt

SEQ ID NO: 413237 - DNA, 20 bp, Artificial
  CRISPR gRNA sequence
aaacttcattagcaatttta

SEQ ID NO: 413238 - DNA, 20 bp, Artificial
  CRISPR gRNA sequence
cattagcaattttaatttca

SEQ ID NO: 413239 - DNA, 20 bp, Artificial
  CRISPR gRNA sequence
attagcaattttaatttcac

SEQ ID NO: 413240 - DNA, 20 bp, Artificial
  CRISPR gRNA sequence
gcaattttaatttcacccca

SEQ ID NO: 413241 - DNA, 20 bp, Artificial
  CRISPR gRNA sequence
taatttcaccccatcctgtg

SEQ ID NO: 413242 - DNA, 20 bp, Artificial
  CRISPR gRNA sequence
aatttcaccccatcctgtga

SEQ ID NO: 413243 - DNA, 20 bp, Artificial
  CRISPR gRNA sequence
atttcaccccatcctgtgat

SEQ ID NO: 413244 - DNA, 20 bp, Artificial
  CRISPR gRNA sequence
caccccatcctgtgatctcg

SEQ ID NO: 413245 - DNA, 20 bp, Artificial
  CRISPR gRNA sequence
accccatcctgtgatctcgc

SEQ ID NO: 413246 - DNA, 20 bp, Artificial
  CRISPR gRNA sequence
tgatctcgctctgcctccat

SEQ ID NO: 413247 - DNA, 20 bp, Artificial
  CRISPR gRNA sequence
gctctgcctccatttgcctt

SEQ ID NO: 413248 - DNA, 20 bp, Artificial
  CRISPR gRNA sequence
tgcctccatttgccttgtga

SEQ ID NO: 413249 - DNA, 20 bp, Artificial
  CRISPR gRNA sequence
cctccatttgccttgtgatc

SEQ ID NO: 413250 - DNA, 20 bp, Artificial
  CRISPR gRNA sequence
catttgccttgtgatctttt

SEQ ID NO: 413251 - DNA, 20 bp, Artificial
  CRISPR gRNA sequence
gccttgtgatcttttgttgc

SEQ ID NO: 413252 - DNA, 20 bp, Artificial
  CRISPR gRNA sequence
ccttgtgatcttttgttgcc

SEQ ID NO: 413253 - DNA, 20 bp, Artificial
  CRISPR gRNA sequence
gtgatcttttgttgcccttg

SEQ ID NO: 413254 - DNA, 20 bp, Artificial
  CRISPR gRNA sequence
tgatcttttgttgcccttga

SEQ ID NO: 413255 - DNA, 20 bp, Artificial
  CRISPR gRNA sequence
ttgttgcccttgaagcatgt

SEQ ID NO: 413256 - DNA, 20 bp, Artificial
  CRISPR gRNA sequence
tgttgcccttgaagcatgtg

SEQ ID NO: 413257 - DNA, 20 bp, Artificial
  CRISPR gRNA sequence
gttgcccttgaagcatgtga

SEQ ID NO: 413258 - DNA, 20 bp, Artificial
  CRISPR gRNA sequence
ttgcccttgaagcatgtgat

SEQ ID NO: 413259 - DNA, 20 bp, Artificial
  CRISPR gRNA sequence
cccttgaagcatgtgatctc

SEQ ID NO: 413260 - DNA, 20 bp, Artificial
  CRISPR gRNA sequence
gaagcatgtgatctctgtga

SEQ ID NO: 413261 - DNA, 20 bp, Artificial
  CRISPR gRNA sequence
aagcatgtgatctctgtgac

SEQ ID NO: 413262 - DNA, 20 bp, Artificial
  CRISPR gRNA sequence
tgtgacccacaccctattca

SEQ ID NO: 413263 - DNA, 20 bp, Artificial
  CRISPR gRNA sequence
tgacccacaccctattcata

SEQ ID NO: 413264 - DNA, 20 bp, Artificial
  CRISPR gRNA sequence
ttcatacactccctcccctt

SEQ ID NO: 413265 - DNA, 20 bp, Artificial
  CRISPR gRNA sequence
atacactccctcccctttga

SEQ ID NO: 413266 - DNA, 20 bp, Artificial
  CRISPR gRNA sequence
cctcccctttgaaaattgct

SEQ ID NO: 413267 - DNA, 20 bp, Artificial
  CRISPR gRNA sequence
ccctttgaaaattgctaata

SEQ ID NO: 413268 - DNA, 20 bp, Artificial
  CRISPR gRNA sequence
tgaaaattgctaataaaaac

SEQ ID NO: 413269 - DNA, 20 bp, Artificial
  CRISPR gRNA sequence
gaaaattgctaataaaaact

SEQ ID NO: 413270 - DNA, 20 bp, Artificial
  CRISPR gRNA sequence
aaaattgctaataaaaactt

SEQ ID NO: 413271 - DNA, 20 bp, Artificial
  CRISPR gRNA sequence
ctaataaaaacttgctggtt

SEQ ID NO: 413272 - DNA, 20 bp, Artificial
  CRISPR gRNA sequence
ataaaaacttgctggtttta

SEQ ID NO: 413273 - DNA, 20 bp, Artificial
  CRISPR gRNA sequence
gctggttttacggctcagga

SEQ ID NO: 413274 - DNA, 20 bp, Artificial
  CRISPR gRNA sequence
ctggttttacggctcaggag

SEQ ID NO: 413275 - DNA, 20 bp, Artificial
  CRISPR gRNA sequence
gttttacggctcaggaggca

SEQ ID NO: 413276 - DNA, 20 bp, Artificial
  CRISPR gRNA sequence
tacggctcaggaggcatcac

SEQ ID NO: 413277 - DNA, 20 bp, Artificial
  CRISPR gRNA sequence
acggctcaggaggcatcacg

SEQ ID NO: 413278 - DNA, 20 bp, Artificial
  CRISPR gRNA sequence
cggctcaggaggcatcacgg

SEQ ID NO: 413279 - DNA, 20 bp, Artificial
  CRISPR gRNA sequence
aggaggcatcacggaacctg

SEQ ID NO: 413280 - DNA, 20 bp, Artificial
  CRISPR gRNA sequence
ccaacatgtgatgtctcccc

SEQ ID NO: 413281 - DNA, 20 bp, Artificial
  CRISPR gRNA sequence
ccctagacacccagctttaa

SEQ ID NO: 413282 - DNA, 20 bp, Artificial
  CRISPR gRNA sequence
gacacccagctttaaaattt

SEQ ID NO: 413283 - DNA, 20 bp, Artificial
  CRISPR gRNA sequence
taaaatttctgtcttttgta

SEQ ID NO: 413284 - DNA, 20 bp, Artificial
  CRISPR gRNA sequence
aaaatttctgtcttttgtac

SEQ ID NO: 413285 - DNA, 20 bp, Artificial
  CRISPR gRNA sequence
aaatttctgtcttttgtact

SEQ ID NO: 413286 - DNA, 20 bp, Artificial
  CRISPR gRNA sequence
ctgtcttttgtactctttcc

SEQ ID NO: 413287 - DNA, 20 bp, Artificial
  CRISPR gRNA sequence
tgtcttttgtactctttccc

SEQ ID NO: 413288 - DNA, 20 bp, Artificial
  CRISPR gRNA sequence
tcttttgtactctttccctt

SEQ ID NO: 413289 - DNA, 20 bp, Artificial
  CRISPR gRNA sequence
ttgtactctttccctttatt

SEQ ID NO: 413290 - DNA, 20 bp, Artificial
  CRISPR gRNA sequence
tgtactctttccctttattt

SEQ ID NO: 413291 - DNA, 20 bp, Artificial
  CRISPR gRNA sequence
gtactctttccctttatttc

SEQ ID NO: 413292 - DNA, 20 bp, Artificial
  CRISPR gRNA sequence
tactctttccctttatttct

SEQ ID NO: 413293 - DNA, 20 bp, Artificial
  CRISPR gRNA sequence
tttccctttatttctcagac

SEQ ID NO: 413294 - DNA, 20 bp, Artificial
  CRISPR gRNA sequence
tccctttatttctcagactg

SEQ ID NO: 413295 - DNA, 20 bp, Artificial
  CRISPR gRNA sequence
ccctttatttctcagactgg

SEQ ID NO: 413296 - DNA, 20 bp, Artificial
  CRISPR gRNA sequence
cctttatttctcagactggc

SEQ ID NO: 413297 - DNA, 20 bp, Artificial
  CRISPR gRNA sequence
tatttctcagactggccaac

SEQ ID NO: 413298 - DNA, 20 bp, Artificial
  CRISPR gRNA sequence
atttctcagactggccaaca

SEQ ID NO: 413299 - DNA, 20 bp, Artificial
  CRISPR gRNA sequence
tttctcagactggccaacac

SEQ ID NO: 413300 - DNA, 20 bp, Artificial
  CRISPR gRNA sequence
ctcagactggccaacactta

SEQ ID NO: 413301 - DNA, 20 bp, Artificial
  CRISPR gRNA sequence
tcagactggccaacacttag

SEQ ID NO: 413302 - DNA, 20 bp, Artificial
  CRISPR gRNA sequence
agactggccaacacttaggg

SEQ ID NO: 413303 - DNA, 20 bp, Artificial
  CRISPR gRNA sequence
gccaacacttagggaaaata

SEQ ID NO: 413304 - DNA, 20 bp, Artificial
  CRISPR gRNA sequence
agggaaaatagaaaagaacc

SEQ ID NO: 413305 - DNA, 20 bp, Artificial
  CRISPR gRNA sequence
gggaaaatagaaaagaacct

SEQ ID NO: 413306 - DNA, 20 bp, Artificial
  CRISPR gRNA sequence
cattgaattatcaggggcag

SEQ ID NO: 413307 - DNA, 20 bp, Artificial
  CRISPR gRNA sequence
aattatcaggggcaggttcc

SEQ ID NO: 413308 - DNA, 20 bp, Artificial
  CRISPR gRNA sequence
tcaggggcaggttcccccga

SEQ ID NO: 413309 - DNA, 20 bp, Artificial
  CRISPR gRNA sequence
ccccgataaaatgggatgat

SEQ ID NO: 413310 - DNA, 20 bp, Artificial
  CRISPR gRNA sequence
tgcttttgtttcttgaccag

SEQ ID NO: 413311 - DNA, 20 bp, Artificial
  CRISPR gRNA sequence
gcttttgtttcttgaccagg

SEQ ID NO: 413312 - DNA, 20 bp, Artificial
  CRISPR gRNA sequence
cttttgtttcttgaccagga

SEQ ID NO: 413313 - DNA, 20 bp, Artificial
  CRISPR gRNA sequence
ttgtttcttgaccaggaatt

SEQ ID NO: 413314 - DNA, 20 bp, Artificial
  CRISPR gRNA sequence
tgtttcttgaccaggaattg

SEQ ID NO: 413315 - DNA, 20 bp, Artificial
  CRISPR gRNA sequence
gtttcttgaccaggaattgc

SEQ ID NO: 413316 - DNA, 20 bp, Artificial
  CRISPR gRNA sequence
tttcttgaccaggaattgct

SEQ ID NO: 413317 - DNA, 20 bp, Artificial
  CRISPR gRNA sequence
cttgaccaggaattgcttga

SEQ ID NO: 413318 - DNA, 20 bp, Artificial
  CRISPR gRNA sequence
ttgaccaggaattgcttgac

SEQ ID NO: 413319 - DNA, 20 bp, Artificial
  CRISPR gRNA sequence
gaccaggaattgcttgaccc

SEQ ID NO: 413320 - DNA, 20 bp, Artificial
  CRISPR gRNA sequence
accaggaattgcttgaccct

SEQ ID NO: 413321 - DNA, 20 bp, Artificial
  CRISPR gRNA sequence
cttgaccctgaaagtcttgg

SEQ ID NO: 413322 - DNA, 20 bp, Artificial
  CRISPR gRNA sequence
gaccctgaaagtcttgggag

SEQ ID NO: 413323 - DNA, 20 bp, Artificial
  CRISPR gRNA sequence
accctgaaagtcttgggaga

SEQ ID NO: 413324 - DNA, 20 bp, Artificial
  CRISPR gRNA sequence
aaagtcttgggagaagacat

SEQ ID NO: 413325 - DNA, 20 bp, Artificial
  CRISPR gRNA sequence
gggagaagacatggtgagga

SEQ ID NO: 413326 - DNA, 20 bp, Artificial
  CRISPR gRNA sequence
ggagaagacatggtgaggaa

SEQ ID NO: 413327 - DNA, 20 bp, Artificial
  CRISPR gRNA sequence
tctttcatctttttgagaaa

SEQ ID NO: 413328 - DNA, 20 bp, Artificial
  CRISPR gRNA sequence
ctttcatctttttgagaaaa

SEQ ID NO: 413329 - DNA, 20 bp, Artificial
  CRISPR gRNA sequence
tttcatctttttgagaaaag

SEQ ID NO: 413330 - DNA, 20 bp, Artificial
  CRISPR gRNA sequence
tcatctttttgagaaaagcc

SEQ ID NO: 413331 - DNA, 20 bp, Artificial
  CRISPR gRNA sequence
catctttttgagaaaagcca

SEQ ID NO: 413332 - DNA, 20 bp, Artificial
  CRISPR gRNA sequence
atctttttgagaaaagccat

SEQ ID NO: 413333 - DNA, 20 bp, Artificial
  CRISPR gRNA sequence
tttgagaaaagccattcaaa

SEQ ID NO: 413334 - DNA, 20 bp, Artificial
  CRISPR gRNA sequence
ttgagaaaagccattcaaaa

SEQ ID NO: 413335 - DNA, 20 bp, Artificial
  CRISPR gRNA sequence
tgagaaaagccattcaaaaa

SEQ ID NO: 413336 - DNA, 20 bp, Artificial
  CRISPR gRNA sequence
gagaaaagccattcaaaaag

SEQ ID NO: 413337 - DNA, 20 bp, Artificial
  CRISPR gRNA sequence
agaaaagccattcaaaaagg

SEQ ID NO: 413338 - DNA, 20 bp, Artificial
  CRISPR gRNA sequence
aaaaaggtgtgaggtggtct

SEQ ID NO: 413339 - DNA, 20 bp, Artificial
  CRISPR gRNA sequence
tcattgtggttttaatttgc

SEQ ID NO: 413340 - DNA, 20 bp, Artificial
  CRISPR gRNA sequence
attgtggttttaatttgcag

SEQ ID NO: 413341 - DNA, 20 bp, Artificial
  CRISPR gRNA sequence
tggttttaatttgcagtttc

SEQ ID NO: 413342 - DNA, 20 bp, Artificial
  CRISPR gRNA sequence
taatttgcagtttccagcct

SEQ ID NO: 413343 - DNA, 20 bp, Artificial
  CRISPR gRNA sequence
aatttgcagtttccagccta

SEQ ID NO: 413344 - DNA, 20 bp, Artificial
  CRISPR gRNA sequence
atttgcagtttccagcctaa

SEQ ID NO: 413345 - DNA, 20 bp, Artificial
  CRISPR gRNA sequence
gcagtttccagcctaacgct

SEQ ID NO: 413346 - DNA, 20 bp, Artificial
  CRISPR gRNA sequence
cagtttccagcctaacgctt

SEQ ID NO: 413347 - DNA, 20 bp, Artificial
  CRISPR gRNA sequence
ccagcctaacgcttgatgtt

SEQ ID NO: 413348 - DNA, 20 bp, Artificial
  CRISPR gRNA sequence
cagcctaacgcttgatgtta

SEQ ID NO: 413349 - DNA, 20 bp, Artificial
  CRISPR gRNA sequence
acgcttgatgttagagagtc

SEQ ID NO: 413350 - DNA, 20 bp, Artificial
  CRISPR gRNA sequence
gatgttagagagtcaggacc

SEQ ID NO: 413351 - DNA, 20 bp, Artificial
  CRISPR gRNA sequence
atgttagagagtcaggacct

SEQ ID NO: 413352 - DNA, 20 bp, Artificial
  CRISPR gRNA sequence
gagagtcaggacctgcgggt

SEQ ID NO: 413353 - DNA, 20 bp, Artificial
  CRISPR gRNA sequence
cgggttttccctggcatatt

SEQ ID NO: 413354 - DNA, 20 bp, Artificial
  CRISPR gRNA sequence
tccctggcatattctttggc

SEQ ID NO: 413355 - DNA, 20 bp, Artificial
  CRISPR gRNA sequence
ccctggcatattctttggcc

SEQ ID NO: 413356 - DNA, 20 bp, Artificial
  CRISPR gRNA sequence
cctggcatattctttggccc

SEQ ID NO: 413357 - DNA, 20 bp, Artificial
  CRISPR gRNA sequence
gcatattctttggcccagtt

SEQ ID NO: 413358 - DNA, 20 bp, Artificial
  CRISPR gRNA sequence
tttggcccagttatttaggt

SEQ ID NO: 413359 - DNA, 20 bp, Artificial
  CRISPR gRNA sequence
tggcccagttatttaggttc

SEQ ID NO: 413360 - DNA, 20 bp, Artificial
  CRISPR gRNA sequence
ggcccagttatttaggttct

SEQ ID NO: 413361 - DNA, 20 bp, Artificial
  CRISPR gRNA sequence
gcccagttatttaggttcta

SEQ ID NO: 413362 - DNA, 20 bp, Artificial
  CRISPR gRNA sequence
tttaggttctaagtgacttg

SEQ ID NO: 413363 - DNA, 20 bp, Artificial
  CRISPR gRNA sequence
aggttctaagtgacttgctt

SEQ ID NO: 413364 - DNA, 20 bp, Artificial
  CRISPR gRNA sequence
ggttctaagtgacttgcttt

SEQ ID NO: 413365 - DNA, 20 bp, Artificial
  CRISPR gRNA sequence
taagtgacttgctttcttca

SEQ ID NO: 413366 - DNA, 20 bp, Artificial
  CRISPR gRNA sequence
agtgacttgctttcttcact

SEQ ID NO: 413367 - DNA, 20 bp, Artificial
  CRISPR gRNA sequence
gctttcttcactccctaact

SEQ ID NO: 413368 - DNA, 20 bp, Artificial
  CRISPR gRNA sequence
ctttcttcactccctaactc

SEQ ID NO: 413369 - DNA, 20 bp, Artificial
  CRISPR gRNA sequence
tcttcactccctaactccac

SEQ ID NO: 413370 - DNA, 20 bp, Artificial
  CRISPR gRNA sequence
cttcactccctaactccacc

SEQ ID NO: 413371 - DNA, 20 bp, Artificial
  CRISPR gRNA sequence
ttcactccctaactccaccc

SEQ ID NO: 413372 - DNA, 20 bp, Artificial
  CRISPR gRNA sequence
cactccctaactccaccccc

SEQ ID NO: 413373 - DNA, 20 bp, Artificial
  CRISPR gRNA sequence
actccctaactccaccccca

SEQ ID NO: 413374 - DNA, 20 bp, Artificial
  CRISPR gRNA sequence
cctaactccacccccaccct

SEQ ID NO: 413375 - DNA, 20 bp, Artificial
  CRISPR gRNA sequence
actccacccccaccctaata

SEQ ID NO: 413376 - DNA, 20 bp, Artificial
  CRISPR gRNA sequence
cacccccaccctaatagagg

SEQ ID NO: 413377 - DNA, 20 bp, Artificial
  CRISPR gRNA sequence
atagaggataaactatagac

SEQ ID NO: 413378 - DNA, 20 bp, Artificial
  CRISPR gRNA sequence
tagacattaatggccactct

SEQ ID NO: 413379 - DNA, 20 bp, Artificial
  CRISPR gRNA sequence
atggccactcttgcctgccg

SEQ ID NO: 413380 - DNA, 20 bp, Artificial
  CRISPR gRNA sequence
ttgcctgccgaactctgagg

SEQ ID NO: 413381 - DNA, 20 bp, Artificial
  CRISPR gRNA sequence
gcctgccgaactctgaggga

SEQ ID NO: 413382 - DNA, 20 bp, Artificial
  CRISPR gRNA sequence
cctgccgaactctgagggaa

SEQ ID NO: 413383 - DNA, 20 bp, Artificial
  CRISPR gRNA sequence
ccgaactctgagggaagaag

SEQ ID NO: 413384 - DNA, 20 bp, Artificial
  CRISPR gRNA sequence
tgagggaagaagggactggc

SEQ ID NO: 413385 - DNA, 20 bp, Artificial
  CRISPR gRNA sequence
agggaagaagggactggcaa

SEQ ID NO: 413386 - DNA, 20 bp, Artificial
  CRISPR gRNA sequence
gcaatatttctatcatgagc

SEQ ID NO: 413387 - DNA, 20 bp, Artificial
  CRISPR gRNA sequence
ctatcatgagccttttctaa

SEQ ID NO: 413388 - DNA, 20 bp, Artificial
  CRISPR gRNA sequence
tatcatgagccttttctaag

SEQ ID NO: 413389 - DNA, 20 bp, Artificial
  CRISPR gRNA sequence
tcatgagccttttctaagag

SEQ ID NO: 413390 - DNA, 20 bp, Artificial
  CRISPR gRNA sequence
ttctaagagtgtataactca

SEQ ID NO: 413391 - DNA, 20 bp, Artificial
  CRISPR gRNA sequence
tctaagagtgtataactcag

SEQ ID NO: 413392 - DNA, 20 bp, Artificial
  CRISPR gRNA sequence
ctaagagtgtataactcagc

SEQ ID NO: 413393 - DNA, 20 bp, Artificial
  CRISPR gRNA sequence
taagagtgtataactcagcc

SEQ ID NO: 413394 - DNA, 20 bp, Artificial
  CRISPR gRNA sequence
agagtgtataactcagccat

SEQ ID NO: 413395 - DNA, 20 bp, Artificial
  CRISPR gRNA sequence
agccataaatacttgtcatt

SEQ ID NO: 413396 - DNA, 20 bp, Artificial
  CRISPR gRNA sequence
gtcattgccagaaacttagc

SEQ ID NO: 413397 - DNA, 20 bp, Artificial
  CRISPR gRNA sequence
tcattgccagaaacttagcc

SEQ ID NO: 413398 - DNA, 20 bp, Artificial
  CRISPR gRNA sequence
ccagaaacttagcctagagg

SEQ ID NO: 413399 - DNA, 20 bp, Artificial
  CRISPR gRNA sequence
agcctagagggtcacaatcc

SEQ ID NO: 413400 - DNA, 20 bp, Artificial
  CRISPR gRNA sequence
gcctagagggtcacaatcct

SEQ ID NO: 413401 - DNA, 20 bp, Artificial
  CRISPR gRNA sequence
gagggtcacaatcctggagt

SEQ ID NO: 413402 - DNA, 20 bp, Artificial
  CRISPR gRNA sequence
gagtaaattattcttttata

SEQ ID NO: 413403 - DNA, 20 bp, Artificial
  CRISPR gRNA sequence
ttcttttatatatttcactg

SEQ ID NO: 413404 - DNA, 20 bp, Artificial
  CRISPR gRNA sequence
ttttatatatttcactgact

SEQ ID NO: 413405 - DNA, 20 bp, Artificial
  CRISPR gRNA sequence
ttatatatttcactgacttg

SEQ ID NO: 413406 - DNA, 20 bp, Artificial
  CRISPR gRNA sequence
tatatatttcactgacttgc

SEQ ID NO: 413407 - DNA, 20 bp, Artificial
  CRISPR gRNA sequence
atatatttcactgacttgct

SEQ ID NO: 413408 - DNA, 20 bp, Artificial
  CRISPR gRNA sequence
tatatttcactgacttgctt

SEQ ID NO: 413409 - DNA, 20 bp, Artificial
  CRISPR gRNA sequence
cactgacttgctttaaattg

SEQ ID NO: 413410 - DNA, 20 bp, Artificial
  CRISPR gRNA sequence
actgacttgctttaaattgt

SEQ ID NO: 413411 - DNA, 20 bp, Artificial
  CRISPR gRNA sequence
acttgctttaaattgtttta

SEQ ID NO: 413412 - DNA, 20 bp, Artificial
  CRISPR gRNA sequence
gctttaaattgttttaactg

SEQ ID NO: 413413 - DNA, 20 bp, Artificial
  CRISPR gRNA sequence
ctttaaattgttttaactgt

SEQ ID NO: 413414 - DNA, 20 bp, Artificial
  CRISPR gRNA sequence
taaattgttttaactgtatt

SEQ ID NO: 413415 - DNA, 20 bp, Artificial
  CRISPR gRNA sequence
aaattgttttaactgtattt

SEQ ID NO: 413416 - DNA, 20 bp, Artificial
  CRISPR gRNA sequence
aattgttttaactgtattta

SEQ ID NO: 413417 - DNA, 20 bp, Artificial
  CRISPR gRNA sequence
ttttaactgtatttatcttc

SEQ ID NO: 413418 - DNA, 20 bp, Artificial
  CRISPR gRNA sequence
taactgtatttatcttctgt

SEQ ID NO: 413419 - DNA, 20 bp, Artificial
  CRISPR gRNA sequence
aactgtatttatcttctgtg

SEQ ID NO: 413420 - DNA, 20 bp, Artificial
  CRISPR gRNA sequence
actgtatttatcttctgtga

SEQ ID NO: 413421 - DNA, 20 bp, Artificial
  CRISPR gRNA sequence
tatttatcttctgtgatgta

SEQ ID NO: 413422 - DNA, 20 bp, Artificial
  CRISPR gRNA sequence
atcttctgtgatgtaaggta

SEQ ID NO: 413423 - DNA, 20 bp, Artificial
  CRISPR gRNA sequence
tcttctgtgatgtaaggtaa

SEQ ID NO: 413424 - DNA, 20 bp, Artificial
  CRISPR gRNA sequence
ctgtgatgtaaggtaatggt

SEQ ID NO: 413425 - DNA, 20 bp, Artificial
  CRISPR gRNA sequence
tgtgatgtaaggtaatggtt

SEQ ID NO: 413426 - DNA, 20 bp, Artificial
  CRISPR gRNA sequence
tgatgtaaggtaatggtttt

SEQ ID NO: 413427 - DNA, 20 bp, Artificial
  CRISPR gRNA sequence
tacagttcaagacacttctc

SEQ ID NO: 413428 - DNA, 20 bp, Artificial
  CRISPR gRNA sequence
acagttcaagacacttctcc

SEQ ID NO: 413429 - DNA, 20 bp, Artificial
  CRISPR gRNA sequence
cagttcaagacacttctcct

SEQ ID NO: 413430 - DNA, 20 bp, Artificial
  CRISPR gRNA sequence
aagacacttctcctcctatg

SEQ ID NO: 413431 - DNA, 20 bp, Artificial
  CRISPR gRNA sequence
ctcctcctatgaatcaacac

SEQ ID NO: 413432 - DNA, 20 bp, Artificial
  CRISPR gRNA sequence
tcctcctatgaatcaacaca

SEQ ID NO: 413433 - DNA, 20 bp, Artificial
  CRISPR gRNA sequence
ctcctatgaatcaacacagc

SEQ ID NO: 413434 - DNA, 20 bp, Artificial
  CRISPR gRNA sequence
ctatgaatcaacacagcatt

SEQ ID NO: 413435 - DNA, 20 bp, Artificial
  CRISPR gRNA sequence
tgaatcaacacagcattggg

SEQ ID NO: 413436 - DNA, 20 bp, Artificial
  CRISPR gRNA sequence
ggatataagtgaaaaaagtt

SEQ ID NO: 413437 - DNA, 20 bp, Artificial
  CRISPR gRNA sequence
gcaaaaaaatggcttctgga

SEQ ID NO: 413438 - DNA, 20 bp, Artificial
  CRISPR gRNA sequence
ctggaaacaattcttctttt

SEQ ID NO: 413439 - DNA, 20 bp, Artificial
  CRISPR gRNA sequence
tggaaacaattcttcttttt

SEQ ID NO: 413440 - DNA, 20 bp, Artificial
  CRISPR gRNA sequence
gaaacaattcttctttttta

SEQ ID NO: 413441 - DNA, 20 bp, Artificial
  CRISPR gRNA sequence
ttcttttttaaagaaaaggg

SEQ ID NO: 413442 - DNA, 20 bp, Artificial
  CRISPR gRNA sequence
cttttttaaagaaaagggct

SEQ ID NO: 413443 - DNA, 20 bp, Artificial
  CRISPR gRNA sequence
ttttttaaagaaaagggctt

SEQ ID NO: 413444 - DNA, 20 bp, Artificial
  CRISPR gRNA sequence
ttttaaagaaaagggcttcc

SEQ ID NO: 413445 - DNA, 20 bp, Artificial
  CRISPR gRNA sequence
tttaaagaaaagggcttcct

SEQ ID NO: 413446 - DNA, 20 bp, Artificial
  CRISPR gRNA sequence
ttaaagaaaagggcttcctt

SEQ ID NO: 413447 - DNA, 20 bp, Artificial
  CRISPR gRNA sequence
taaagaaaagggcttccttt

SEQ ID NO: 413448 - DNA, 20 bp, Artificial
  CRISPR gRNA sequence
aaagaaaagggcttcctttt

SEQ ID NO: 413449 - DNA, 20 bp, Artificial
  CRISPR gRNA sequence
aagaaaagggcttccttttt

SEQ ID NO: 413450 - DNA, 20 bp, Artificial
  CRISPR gRNA sequence
cctttttaaagaaaagggct

SEQ ID NO: 413451 - DNA, 20 bp, Artificial
  CRISPR gRNA sequence
ctttttaaagaaaagggctt

SEQ ID NO: 413452 - DNA, 20 bp, Artificial
  CRISPR gRNA sequence
tttaaagaaaagggcttcag

SEQ ID NO: 413453 - DNA, 20 bp, Artificial
  CRISPR gRNA sequence
ttaaagaaaagggcttcagg

SEQ ID NO: 413454 - DNA, 20 bp, Artificial
  CRISPR gRNA sequence
taaagaaaagggcttcaggg

SEQ ID NO: 413455 - DNA, 20 bp, Artificial
  CRISPR gRNA sequence
aaagaaaagggcttcagggc

SEQ ID NO: 413456 - DNA, 20 bp, Artificial
  CRISPR gRNA sequence
aagaaaagggcttcagggct

SEQ ID NO: 413457 - DNA, 20 bp, Artificial
  CRISPR gRNA sequence
cagggctgacattactcaat

SEQ ID NO: 413458 - DNA, 20 bp, Artificial
  CRISPR gRNA sequence
agggctgacattactcaatc

SEQ ID NO: 413459 - DNA, 20 bp, Artificial
  CRISPR gRNA sequence
acattactcaatctgacatc

SEQ ID NO: 413460 - DNA, 20 bp, Artificial
  CRISPR gRNA sequence
ctcaatctgacatctattag

SEQ ID NO: 413461 - DNA, 20 bp, Artificial
  CRISPR gRNA sequence
aatctgacatctattagcaa

SEQ ID NO: 413462 - DNA, 20 bp, Artificial
  CRISPR gRNA sequence
acatctattagcaaaactta

SEQ ID NO: 413463 - DNA, 20 bp, Artificial
  CRISPR gRNA sequence
ttagcaaaacttaaaaaact

SEQ ID NO: 413464 - DNA, 20 bp, Artificial
  CRISPR gRNA sequence
gcaaaacttaaaaaactaaa

SEQ ID NO: 413465 - DNA, 20 bp, Artificial
  CRISPR gRNA sequence
aaaaaactaaatgttatgaa

SEQ ID NO: 413466 - DNA, 20 bp, Artificial
  CRISPR gRNA sequence
aaaaactaaatgttatgaac

SEQ ID NO: 413467 - DNA, 20 bp, Artificial
  CRISPR gRNA sequence
aatgttatgaactgttgatt

SEQ ID NO: 413468 - DNA, 20 bp, Artificial
  CRISPR gRNA sequence
tgaactgttgattaactccc

SEQ ID NO: 413469 - DNA, 20 bp, Artificial
  CRISPR gRNA sequence
ttgattaactcccaaagcat

SEQ ID NO: 413470 - DNA, 20 bp, Artificial
  CRISPR gRNA sequence
attaactcccaaagcatccg

SEQ ID NO: 413471 - DNA, 20 bp, Artificial
  CRISPR gRNA sequence
actcccaaagcatccgtacc

SEQ ID NO: 413472 - DNA, 20 bp, Artificial
  CRISPR gRNA sequence
ccaaagcatccgtacccatt

SEQ ID NO: 413473 - DNA, 20 bp, Artificial
  CRISPR gRNA sequence
gcttttcctttttattttcc

SEQ ID NO: 413474 - DNA, 20 bp, Artificial
  CRISPR gRNA sequence
cttttcctttttattttccc

SEQ ID NO: 413475 - DNA, 20 bp, Artificial
  CRISPR gRNA sequence
ttcctttttattttccccag

SEQ ID NO: 413476 - DNA, 20 bp, Artificial
  CRISPR gRNA sequence
tcctttttattttccccagc

SEQ ID NO: 413477 - DNA, 20 bp, Artificial
  CRISPR gRNA sequence
cctttttattttccccagcc

SEQ ID NO: 413478 - DNA, 20 bp, Artificial
  CRISPR gRNA sequence
ctttttattttccccagcca

SEQ ID NO: 413479 - DNA, 20 bp, Artificial
  CRISPR gRNA sequence
tttattttccccagccatac

SEQ ID NO: 413480 - DNA, 20 bp, Artificial
  CRISPR gRNA sequence
ttattttccccagccataca

SEQ ID NO: 413481 - DNA, 20 bp, Artificial
  CRISPR gRNA sequence
tattttccccagccatacag

SEQ ID NO: 413482 - DNA, 20 bp, Artificial
  CRISPR gRNA sequence
attttccccagccatacagg

SEQ ID NO: 413483 - DNA, 20 bp, Artificial
  CRISPR gRNA sequence
ttttccccagccatacaggg

SEQ ID NO: 413484 - DNA, 20 bp, Artificial
  CRISPR gRNA sequence
tccccagccatacagggccc

SEQ ID NO: 413485 - DNA, 20 bp, Artificial
  CRISPR gRNA sequence
ccccagccatacagggccca

SEQ ID NO: 413486 - DNA, 20 bp, Artificial
  CRISPR gRNA sequence
cccagccatacagggcccag

SEQ ID NO: 413487 - DNA, 20 bp, Artificial
  CRISPR gRNA sequence
tataggccagtggtcattca

SEQ ID NO: 413488 - DNA, 20 bp, Artificial
  CRISPR gRNA sequence
atgtggaagctgcaggcaag

SEQ ID NO: 413489 - DNA, 20 bp, Artificial
  CRISPR gRNA sequence
caggcaaggcagggaatgga

SEQ ID NO: 413490 - DNA, 20 bp, Artificial
  CRISPR gRNA sequence
agaagccatgtcagctacag

SEQ ID NO: 413491 - DNA, 20 bp, Artificial
  CRISPR gRNA sequence
caggctgggccactctagat

SEQ ID NO: 413492 - DNA, 20 bp, Artificial
  CRISPR gRNA sequence
ggccactctagattgaaatg

SEQ ID NO: 413493 - DNA, 20 bp, Artificial
  CRISPR gRNA sequence
tagattgaaatgtctctgga

SEQ ID NO: 413494 - DNA, 20 bp, Artificial
  CRISPR gRNA sequence
gattgaaatgtctctggatt

SEQ ID NO: 413495 - DNA, 20 bp, Artificial
  CRISPR gRNA sequence
aaatgtctctggattgaatc

SEQ ID NO: 413496 - DNA, 20 bp, Artificial
  CRISPR gRNA sequence
tggattgaatctctacctga

SEQ ID NO: 413497 - DNA, 20 bp, Artificial
  CRISPR gRNA sequence
gattgaatctctacctgact

SEQ ID NO: 413498 - DNA, 20 bp, Artificial
  CRISPR gRNA sequence
aatctctacctgactccatg

SEQ ID NO: 413499 - DNA, 20 bp, Artificial
  CRISPR gRNA sequence
tacctgactccatgctttat

SEQ ID NO: 413500 - DNA, 20 bp, Artificial
  CRISPR gRNA sequence
cctgactccatgctttattt

SEQ ID NO: 413501 - DNA, 20 bp, Artificial
  CRISPR gRNA sequence
actccatgctttatttcacc

SEQ ID NO: 413502 - DNA, 20 bp, Artificial
  CRISPR gRNA sequence
catgctttatttcaccttta

SEQ ID NO: 413503 - DNA, 20 bp, Artificial
  CRISPR gRNA sequence
tatttcacctttatttctta

SEQ ID NO: 413504 - DNA, 20 bp, Artificial
  CRISPR gRNA sequence
atttcacctttatttcttaa

SEQ ID NO: 413505 - DNA, 20 bp, Artificial
  CRISPR gRNA sequence
tttcacctttatttcttaag

SEQ ID NO: 413506 - DNA, 20 bp, Artificial
  CRISPR gRNA sequence
cacctttatttcttaagaaa

SEQ ID NO: 413507 - DNA, 20 bp, Artificial
  CRISPR gRNA sequence
acctttatttcttaagaaaa

SEQ ID NO: 413508 - DNA, 20 bp, Artificial
  CRISPR gRNA sequence
tatttcttaagaaaaaatcc

SEQ ID NO: 413509 - DNA, 20 bp, Artificial
  CRISPR gRNA sequence
atttcttaagaaaaaatcct

SEQ ID NO: 413510 - DNA, 20 bp, Artificial
  CRISPR gRNA sequence
tttcttaagaaaaaatcctt

SEQ ID NO: 413511 - DNA, 20 bp, Artificial
  CRISPR gRNA sequence
cttaagaaaaaatccttttt

SEQ ID NO: 413512 - DNA, 20 bp, Artificial
  CRISPR gRNA sequence
ttaagaaaaaatcctttttc

SEQ ID NO: 413513 - DNA, 20 bp, Artificial
  CRISPR gRNA sequence
aagaaaaaatcctttttccc

SEQ ID NO: 413514 - DNA, 20 bp, Artificial
  CRISPR gRNA sequence
agaaaaaatcctttttccct

SEQ ID NO: 413515 - DNA, 20 bp, Artificial
  CRISPR gRNA sequence
tttccctaactatttttaaa

SEQ ID NO: 413516 - DNA, 20 bp, Artificial
  CRISPR gRNA sequence
ttccctaactatttttaaat

SEQ ID NO: 413517 - DNA, 20 bp, Artificial
  CRISPR gRNA sequence
tccctaactatttttaaatt

SEQ ID NO: 413518 - DNA, 20 bp, Artificial
  CRISPR gRNA sequence
ccctaactatttttaaattg

SEQ ID NO: 413519 - DNA, 20 bp, Artificial
  CRISPR gRNA sequence
cctaactatttttaaattgt

SEQ ID NO: 413520 - DNA, 20 bp, Artificial
  CRISPR gRNA sequence
actatttttaaattgtctag

SEQ ID NO: 413521 - DNA, 20 bp, Artificial
  CRISPR gRNA sequence
tttttaaattgtctaggact

SEQ ID NO: 413522 - DNA, 20 bp, Artificial
  CRISPR gRNA sequence
ttaaattgtctaggactttt

SEQ ID NO: 413523 - DNA, 20 bp, Artificial
  CRISPR gRNA sequence
taaattgtctaggacttttc

SEQ ID NO: 413524 - DNA, 20 bp, Artificial
  CRISPR gRNA sequence
aaattgtctaggacttttca

SEQ ID NO: 413525 - DNA, 20 bp, Artificial
  CRISPR gRNA sequence
aattgtctaggacttttcaa

SEQ ID NO: 413526 - DNA, 20 bp, Artificial
  CRISPR gRNA sequence
tctaggacttttcaaaacaa

SEQ ID NO: 413527 - DNA, 20 bp, Artificial
  CRISPR gRNA sequence
ggacttttcaaaacaatata

SEQ ID NO: 413528 - DNA, 20 bp, Artificial
  CRISPR gRNA sequence
ttcaaaacaatatatgttcc

SEQ ID NO: 413529 - DNA, 20 bp, Artificial
  CRISPR gRNA sequence
tcaaaacaatatatgttcca

SEQ ID NO: 413530 - DNA, 20 bp, Artificial
  CRISPR gRNA sequence
caaaacaatatatgttccac

SEQ ID NO: 413531 - DNA, 20 bp, Artificial
  CRISPR gRNA sequence
aaaacaatatatgttccact

SEQ ID NO: 413532 - DNA, 20 bp, Artificial
  CRISPR gRNA sequence
cactaaatcaggtattgtgg

SEQ ID NO: 413533 - DNA, 20 bp, Artificial
  CRISPR gRNA sequence
aatcaggtattgtggtatta

SEQ ID NO: 413534 - DNA, 20 bp, Artificial
  CRISPR gRNA sequence
tggtattaggatatgcagat

SEQ ID NO: 413535 - DNA, 20 bp, Artificial
  CRISPR gRNA sequence
ggatatgcagatctataggt

SEQ ID NO: 413536 - DNA, 20 bp, Artificial
  CRISPR gRNA sequence
taggttttcatccacgggtc

SEQ ID NO: 413537 - DNA, 20 bp, Artificial
  CRISPR gRNA sequence
tcatccacgggtcctggctc

SEQ ID NO: 413538 - DNA, 20 bp, Artificial
  CRISPR gRNA sequence
catccacgggtcctggctca

SEQ ID NO: 413539 - DNA, 20 bp, Artificial
  CRISPR gRNA sequence
atccacgggtcctggctcaa

SEQ ID NO: 413540 - DNA, 20 bp, Artificial
  CRISPR gRNA sequence
gctcaaaattcacatggtcc

SEQ ID NO: 413541 - DNA, 20 bp, Artificial
  CRISPR gRNA sequence
aaaattcacatggtccttgt

SEQ ID NO: 413542 - DNA, 20 bp, Artificial
  CRISPR gRNA sequence
acatggtccttgttataatg

SEQ ID NO: 413543 - DNA, 20 bp, Artificial
  CRISPR gRNA sequence
gttataatgttggggcactt

SEQ ID NO: 413544 - DNA, 20 bp, Artificial
  CRISPR gRNA sequence
ttataatgttggggcacttc

SEQ ID NO: 413545 - DNA, 20 bp, Artificial
  CRISPR gRNA sequence
taatgttggggcacttcagg

SEQ ID NO: 413546 - DNA, 20 bp, Artificial
  CRISPR gRNA sequence
gggcacttcaggcctcagga

SEQ ID NO: 413547 - DNA, 20 bp, Artificial
  CRISPR gRNA sequence
caggcctcaggaaacagaag

SEQ ID NO: 413548 - DNA, 20 bp, Artificial
  CRISPR gRNA sequence
aggcctcaggaaacagaagt

SEQ ID NO: 413549 - DNA, 20 bp, Artificial
  CRISPR gRNA sequence
aggaaacagaagttctctct

SEQ ID NO: 413550 - DNA, 20 bp, Artificial
  CRISPR gRNA sequence
tctctgaccttctcctgtcc

SEQ ID NO: 413551 - DNA, 20 bp, Artificial
  CRISPR gRNA sequence
tctgaccttctcctgtcctt

SEQ ID NO: 413552 - DNA, 20 bp, Artificial
  CRISPR gRNA sequence
tgaccttctcctgtcctttc

SEQ ID NO: 413553 - DNA, 20 bp, Artificial
  CRISPR gRNA sequence
accttctcctgtcctttctc

SEQ ID NO: 413554 - DNA, 20 bp, Artificial
  CRISPR gRNA sequence
ctcctgtcctttctcctgac

SEQ ID NO: 413555 - DNA, 20 bp, Artificial
  CRISPR gRNA sequence
tcctgtcctttctcctgacc

SEQ ID NO: 413556 - DNA, 20 bp, Artificial
  CRISPR gRNA sequence
ctgtcctttctcctgaccaa

SEQ ID NO: 413557 - DNA, 20 bp, Artificial
  CRISPR gRNA sequence
tcctttctcctgaccaaggt

SEQ ID NO: 413558 - DNA, 20 bp, Artificial
  CRISPR gRNA sequence
tctcctgaccaaggtaagac

SEQ ID NO: 413559 - DNA, 20 bp, Artificial
  CRISPR gRNA sequence
ctcctgaccaaggtaagact

SEQ ID NO: 413560 - DNA, 20 bp, Artificial
  CRISPR gRNA sequence
tcctgaccaaggtaagactc

SEQ ID NO: 413561 - DNA, 20 bp, Artificial
  CRISPR gRNA sequence
ctgaccaaggtaagactcta

SEQ ID NO: 413562 - DNA, 20 bp, Artificial
  CRISPR gRNA sequence
accaaggtaagactctaatc

SEQ ID NO: 413563 - DNA, 20 bp, Artificial
  CRISPR gRNA sequence
taatctgaatgtgggtcaaa

SEQ ID NO: 413564 - DNA, 20 bp, Artificial
  CRISPR gRNA sequence
atctgaatgtgggtcaaaag

SEQ ID NO: 413565 - DNA, 20 bp, Artificial
  CRISPR gRNA sequence
aatgtgggtcaaaagaccct

SEQ ID NO: 413566 - DNA, 20 bp, Artificial
  CRISPR gRNA sequence
attccagagaggatcccacc

SEQ ID NO: 413567 - DNA, 20 bp, Artificial
  CRISPR gRNA sequence
cagagaggatcccaccccat

SEQ ID NO: 413568 - DNA, 20 bp, Artificial
  CRISPR gRNA sequence
aagtctggacaggacttgct

SEQ ID NO: 413569 - DNA, 20 bp, Artificial
  CRISPR gRNA sequence
gacaggacttgctgggttta

SEQ ID NO: 413570 - DNA, 20 bp, Artificial
  CRISPR gRNA sequence
gctgggtttagatgatatgc

SEQ ID NO: 413571 - DNA, 20 bp, Artificial
  CRISPR gRNA sequence
ctgggtttagatgatatgct

SEQ ID NO: 413572 - DNA, 20 bp, Artificial
  CRISPR gRNA sequence
ggtttagatgatatgctttt

SEQ ID NO: 413573 - DNA, 20 bp, Artificial
  CRISPR gRNA sequence
agatgatatgctttttgccc

SEQ ID NO: 413574 - DNA, 20 bp, Artificial
  CRISPR gRNA sequence
gatgatatgctttttgccca

SEQ ID NO: 413575 - DNA, 20 bp, Artificial
  CRISPR gRNA sequence
tttgcccagtcccatttcta

SEQ ID NO: 413576 - DNA, 20 bp, Artificial
  CRISPR gRNA sequence
ttgcccagtcccatttctac

SEQ ID NO: 413577 - DNA, 20 bp, Artificial
  CRISPR gRNA sequence
tgcccagtcccatttctaca

SEQ ID NO: 413578 - DNA, 20 bp, Artificial
  CRISPR gRNA sequence
gcccagtcccatttctacaa

SEQ ID NO: 413579 - DNA, 20 bp, Artificial
  CRISPR gRNA sequence
cccagtcccatttctacaag

SEQ ID NO: 413580 - DNA, 20 bp, Artificial
  CRISPR gRNA sequence
ctacaaggttgtcagtcata

SEQ ID NO: 413581 - DNA, 20 bp, Artificial
  CRISPR gRNA sequence
tacaaggttgtcagtcatac

SEQ ID NO: 413582 - DNA, 20 bp, Artificial
  CRISPR gRNA sequence
caaggttgtcagtcatacct

SEQ ID NO: 413583 - DNA, 20 bp, Artificial
  CRISPR gRNA sequence
tcagtcatacctacgtaatg

SEQ ID NO: 413584 - DNA, 20 bp, Artificial
  CRISPR gRNA sequence
cgtaatgaagcctccataaa

SEQ ID NO: 413585 - DNA, 20 bp, Artificial
  CRISPR gRNA sequence
cataaaaatccaagaggatg

SEQ ID NO: 413586 - DNA, 20 bp, Artificial
  CRISPR gRNA sequence
ggagagtttctggacagctg

SEQ ID NO: 413587 - DNA, 20 bp, Artificial
  CRISPR gRNA sequence
gagagtttctggacagctga

SEQ ID NO: 413588 - DNA, 20 bp, Artificial
  CRISPR gRNA sequence
ctggacagctgaacatgtgg

SEQ ID NO: 413589 - DNA, 20 bp, Artificial
  CRISPR gRNA sequence
tggacagctgaacatgtgga

SEQ ID NO: 413590 - DNA, 20 bp, Artificial
  CRISPR gRNA sequence
gacagctgaacatgtggagc

SEQ ID NO: 413591 - DNA, 20 bp, Artificial
  CRISPR gRNA sequence
aacatgtggagcctcctgga

SEQ ID NO: 413592 - DNA, 20 bp, Artificial
  CRISPR gRNA sequence
ctggagggtgatgtggacag

SEQ ID NO: 413593 - DNA, 20 bp, Artificial
  CRISPR gRNA sequence
gagggtgatgtggacaggga

SEQ ID NO: 413594 - DNA, 20 bp, Artificial
  CRISPR gRNA sequence
tgtgcccctttacacatgcc

SEQ ID NO: 413595 - DNA, 20 bp, Artificial
  CRISPR gRNA sequence
tgcccctttacacatgcctc

SEQ ID NO: 413596 - DNA, 20 bp, Artificial
  CRISPR gRNA sequence
tacacatgcctcaccctacc

SEQ ID NO: 413597 - DNA, 20 bp, Artificial
  CRISPR gRNA sequence
acacatgcctcaccctacca

SEQ ID NO: 413598 - DNA, 20 bp, Artificial
  CRISPR gRNA sequence
cacatgcctcaccctaccaa

SEQ ID NO: 413599 - DNA, 20 bp, Artificial
  CRISPR gRNA sequence
accctaccaatctcttcatc

SEQ ID NO: 413600 - DNA, 20 bp, Artificial
  CRISPR gRNA sequence
ccaatctcttcatctgtatc

SEQ ID NO: 413601 - DNA, 20 bp, Artificial
  CRISPR gRNA sequence
ttcatctgtatcccttgcaa

SEQ ID NO: 413602 - DNA, 20 bp, Artificial
  CRISPR gRNA sequence
catctgtatcccttgcaata

SEQ ID NO: 413603 - DNA, 20 bp, Artificial
  CRISPR gRNA sequence
atctgtatcccttgcaatat

SEQ ID NO: 413604 - DNA, 20 bp, Artificial
  CRISPR gRNA sequence
tatcccttgcaatatccttg

SEQ ID NO: 413605 - DNA, 20 bp, Artificial
  CRISPR gRNA sequence
gcaatatccttgatattaaa

SEQ ID NO: 413606 - DNA, 20 bp, Artificial
  CRISPR gRNA sequence
caatatccttgatattaaac

SEQ ID NO: 413607 - DNA, 20 bp, Artificial
  CRISPR gRNA sequence
gatattaaactgacaaatgt

SEQ ID NO: 413608 - DNA, 20 bp, Artificial
  CRISPR gRNA sequence
atattaaactgacaaatgtg

SEQ ID NO: 413609 - DNA, 20 bp, Artificial
  CRISPR gRNA sequence
aactgacaaatgtgttttct

SEQ ID NO: 413610 - DNA, 20 bp, Artificial
  CRISPR gRNA sequence
acaaatgtgttttcttgagc

SEQ ID NO: 413611 - DNA, 20 bp, Artificial
  CRISPR gRNA sequence
tcttgagctctataactggc

SEQ ID NO: 413612 - DNA, 20 bp, Artificial
  CRISPR gRNA sequence
cttgagctctataactggct

SEQ ID NO: 413613 - DNA, 20 bp, Artificial
  CRISPR gRNA sequence
ttgagctctataactggctc

SEQ ID NO: 413614 - DNA, 20 bp, Artificial
  CRISPR gRNA sequence
gagctctataactggctcca

SEQ ID NO: 413615 - DNA, 20 bp, Artificial
  CRISPR gRNA sequence
agctctataactggctccac

SEQ ID NO: 413616 - DNA, 20 bp, Artificial
  CRISPR gRNA sequence
tataactggctccaccagat

SEQ ID NO: 413617 - DNA, 20 bp, Artificial
  CRISPR gRNA sequence
taactggctccaccagatta

SEQ ID NO: 413618 - DNA, 20 bp, Artificial
  CRISPR gRNA sequence
gctccaccagattaaccaaa

SEQ ID NO: 413619 - DNA, 20 bp, Artificial
  CRISPR gRNA sequence
caccagattaaccaaacctg

SEQ ID NO: 413620 - DNA, 20 bp, Artificial
  CRISPR gRNA sequence
accaaacctgaaaaaggggt

SEQ ID NO: 413621 - DNA, 20 bp, Artificial
  CRISPR gRNA sequence
aaaaaggggtcttgggaacc

SEQ ID NO: 413622 - DNA, 20 bp, Artificial
  CRISPR gRNA sequence
gggaaccccagcttgaggcc

SEQ ID NO: 413623 - DNA, 20 bp, Artificial
  CRISPR gRNA sequence
ggaaccccagcttgaggccc

SEQ ID NO: 413624 - DNA, 20 bp, Artificial
  CRISPR gRNA sequence
gaggcccattggtccgaagt

SEQ ID NO: 413625 - DNA, 20 bp, Artificial
  CRISPR gRNA sequence
aggcccattggtccgaagtt

SEQ ID NO: 413626 - DNA, 20 bp, Artificial
  CRISPR gRNA sequence
gtccgaagttctagaggcct

SEQ ID NO: 413627 - DNA, 20 bp, Artificial
  CRISPR gRNA sequence
tagaggcctgggactgggca

SEQ ID NO: 413628 - DNA, 20 bp, Artificial
  CRISPR gRNA sequence
gaggcctgggactgggcacg

SEQ ID NO: 413629 - DNA, 20 bp, Artificial
  CRISPR gRNA sequence
ggactgggcacggtggctca

SEQ ID NO: 413630 - DNA, 20 bp, Artificial
  CRISPR gRNA sequence
ggcacggtggctcacgcctg

SEQ ID NO: 413631 - DNA, 20 bp, Artificial
  CRISPR gRNA sequence
acgcctgcaatcccagcact

SEQ ID NO: 413632 - DNA, 20 bp, Artificial
  CRISPR gRNA sequence
caatcccagcactttgggag

SEQ ID NO: 413633 - DNA, 20 bp, Artificial
  CRISPR gRNA sequence
tgggaggccgaggagggcgg

SEQ ID NO: 413634 - DNA, 20 bp, Artificial
  CRISPR gRNA sequence
gggaggccgaggagggcgga

SEQ ID NO: 413635 - DNA, 20 bp, Artificial
  CRISPR gRNA sequence
ggaggccgaggagggcggat

SEQ ID NO: 413636 - DNA, 20 bp, Artificial
  CRISPR gRNA sequence
aggtgaggagttcgagacca

SEQ ID NO: 413637 - DNA, 20 bp, Artificial
  CRISPR gRNA sequence
ggtgaggagttcgagaccag

SEQ ID NO: 413638 - DNA, 20 bp, Artificial
  CRISPR gRNA sequence
gagaccagcctgactaacat

SEQ ID NO: 413639 - DNA, 20 bp, Artificial
  CRISPR gRNA sequence
actaacatggtgaaaccccg

SEQ ID NO: 413640 - DNA, 20 bp, Artificial
  CRISPR gRNA sequence
acatggtgaaaccccgtctc

SEQ ID NO: 413641 - DNA, 20 bp, Artificial
  CRISPR gRNA sequence
tactaaaaatacaaaaatta

SEQ ID NO: 413642 - DNA, 20 bp, Artificial
  CRISPR gRNA sequence
ctaaaaatacaaaaattagc

SEQ ID NO: 413643 - DNA, 20 bp, Artificial
  CRISPR gRNA sequence
aaaatacaaaaattagctgg

SEQ ID NO: 413644 - DNA, 20 bp, Artificial
  CRISPR gRNA sequence
gctggacgtagtggcgggtg

SEQ ID NO: 413645 - DNA, 20 bp, Artificial
  CRISPR gRNA sequence
gacgtagtggcgggtgcctg

SEQ ID NO: 413646 - DNA, 20 bp, Artificial
  CRISPR gRNA sequence
taatcccagctactcaggag

SEQ ID NO: 413647 - DNA, 20 bp, Artificial
  CRISPR gRNA sequence
ctcaggaggctgaggcagga

SEQ ID NO: 413648 - DNA, 20 bp, Artificial
  CRISPR gRNA sequence
aggaggctgaggcaggagaa

SEQ ID NO: 413649 - DNA, 20 bp, Artificial
  CRISPR gRNA sequence
aggcaggagaatcacttgaa

SEQ ID NO: 413650 - DNA, 20 bp, Artificial
  CRISPR gRNA sequence
gaacctgggaggcggagatt

SEQ ID NO: 413651 - DNA, 20 bp, Artificial
  CRISPR gRNA sequence
aacctgggaggcggagattg

SEQ ID NO: 413652 - DNA, 20 bp, Artificial
  CRISPR gRNA sequence
ggaggcggagattgcagcga

SEQ ID NO: 413653 - DNA, 20 bp, Artificial
  CRISPR gRNA sequence
cagcgagccgagatcctgcc

SEQ ID NO: 413654 - DNA, 20 bp, Artificial
  CRISPR gRNA sequence
ccattgtactccagcctggg

SEQ ID NO: 413655 - DNA, 20 bp, Artificial
  CRISPR gRNA sequence
tactccagcctgggtgacag

SEQ ID NO: 413656 - DNA, 20 bp, Artificial
  CRISPR gRNA sequence
cagcctgggtgacagagcga

SEQ ID NO: 413657 - DNA, 20 bp, Artificial
  CRISPR gRNA sequence
ggtgacagagcgagactccg

SEQ ID NO: 413658 - DNA, 20 bp, Artificial
  CRISPR gRNA sequence
cgtctcaaaaaaaaaaaaaa

SEQ ID NO: 413659 - DNA, 20 bp, Artificial
  CRISPR gRNA sequence
aaaaaaaaaaaaaaaaaaaa

SEQ ID NO: 413660 - DNA, 20 bp, Artificial
  CRISPR gRNA sequence
tagaggcctggacttgcaat

SEQ ID NO: 413661 - DNA, 20 bp, Artificial
  CRISPR gRNA sequence
gaggcctggacttgcaattg

SEQ ID NO: 413662 - DNA, 20 bp, Artificial
  CRISPR gRNA sequence
gacttgcaattggtgtctga

SEQ ID NO: 413663 - DNA, 20 bp, Artificial
  CRISPR gRNA sequence
gcaattggtgtctgaagggc

SEQ ID NO: 413664 - DNA, 20 bp, Artificial
  CRISPR gRNA sequence
caattggtgtctgaagggca

SEQ ID NO: 413665 - DNA, 20 bp, Artificial
  CRISPR gRNA sequence
gtgtctgaagggcagggtta

SEQ ID NO: 413666 - DNA, 20 bp, Artificial
  CRISPR gRNA sequence
aagggcagggttagcaatgg

SEQ ID NO: 413667 - DNA, 20 bp, Artificial
  CRISPR gRNA sequence
gcaatggaggagggggtgag

SEQ ID NO: 413668 - DNA, 20 bp, Artificial
  CRISPR gRNA sequence
tgggactgagcccccagcct

SEQ ID NO: 413669 - DNA, 20 bp, Artificial
  CRISPR gRNA sequence
gggactgagcccccagcctg

SEQ ID NO: 413670 - DNA, 20 bp, Artificial
  CRISPR gRNA sequence
ggactgagcccccagcctgt

SEQ ID NO: 413671 - DNA, 20 bp, Artificial
  CRISPR gRNA sequence
agcccccagcctgtgggatc

SEQ ID NO: 413672 - DNA, 20 bp, Artificial
  CRISPR gRNA sequence
tgggatctgatactgtcctt

SEQ ID NO: 413673 - DNA, 20 bp, Artificial
  CRISPR gRNA sequence
atactgtccttgggtagatc

SEQ ID NO: 413674 - DNA, 20 bp, Artificial
  CRISPR gRNA sequence
tccttgggtagatcatgtca

SEQ ID NO: 413675 - DNA, 20 bp, Artificial
  CRISPR gRNA sequence
gggtagatcatgtcagaatt

SEQ ID NO: 413676 - DNA, 20 bp, Artificial
  CRISPR gRNA sequence
ggtagatcatgtcagaattg

SEQ ID NO: 413677 - DNA, 20 bp, Artificial
  CRISPR gRNA sequence
aattggcggacactcagctg

SEQ ID NO: 413678 - DNA, 20 bp, Artificial
  CRISPR gRNA sequence
gcggacactcagctggtgcc

SEQ ID NO: 413679 - DNA, 20 bp, Artificial
  CRISPR gRNA sequence
agctggtgcctgttactgtg

SEQ ID NO: 413680 - DNA, 20 bp, Artificial
  CRISPR gRNA sequence
gtgcctgttactgtggggga

SEQ ID NO: 413681 - DNA, 20 bp, Artificial
  CRISPR gRNA sequence
ttactgtgggggaaaaccac

SEQ ID NO: 413682 - DNA, 20 bp, Artificial
  CRISPR gRNA sequence
ctgtgggggaaaaccaccca

SEQ ID NO: 413683 - DNA, 20 bp, Artificial
  CRISPR gRNA sequence
tgggggaaaaccacccacac

SEQ ID NO: 413684 - DNA, 20 bp, Artificial
  CRISPR gRNA sequence
tggtcacagaagtctgttga

SEQ ID NO: 413685 - DNA, 20 bp, Artificial
  CRISPR gRNA sequence
ggtcacagaagtctgttgac

SEQ ID NO: 413686 - DNA, 20 bp, Artificial
  CRISPR gRNA sequence
gtcacagaagtctgttgacg

SEQ ID NO: 413687 - DNA, 20 bp, Artificial
  CRISPR gRNA sequence
ttgacgattgctgtggtagt

SEQ ID NO: 413688 - DNA, 20 bp, Artificial
  CRISPR gRNA sequence
acgattgctgtggtagtgtg

SEQ ID NO: 413689 - DNA, 20 bp, Artificial
  CRISPR gRNA sequence
ctgtggtagtgtgagagcag

SEQ ID NO: 413690 - DNA, 20 bp, Artificial
  CRISPR gRNA sequence
tggtagtgtgagagcagaga

SEQ ID NO: 413691 - DNA, 20 bp, Artificial
  CRISPR gRNA sequence
gagagttttttttctacaca

SEQ ID NO: 413692 - DNA, 20 bp, Artificial
  CRISPR gRNA sequence
tttttctacacaggtgtcaa

SEQ ID NO: 413693 - DNA, 20 bp, Artificial
  CRISPR gRNA sequence
ttttctacacaggtgtcaaa

SEQ ID NO: 413694 - DNA, 20 bp, Artificial
  CRISPR gRNA sequence
tttctacacaggtgtcaaac

SEQ ID NO: 413695 - DNA, 20 bp, Artificial
  CRISPR gRNA sequence
ttctacacaggtgtcaaact

SEQ ID NO: 413696 - DNA, 20 bp, Artificial
  CRISPR gRNA sequence
tctacacaggtgtcaaactt

SEQ ID NO: 413697 - DNA, 20 bp, Artificial
  CRISPR gRNA sequence
ctacacaggtgtcaaacttg

SEQ ID NO: 413698 - DNA, 20 bp, Artificial
  CRISPR gRNA sequence
tacacaggtgtcaaacttgt

SEQ ID NO: 413699 - DNA, 20 bp, Artificial
  CRISPR gRNA sequence
cacaggtgtcaaacttgttt

SEQ ID NO: 413700 - DNA, 20 bp, Artificial
  CRISPR gRNA sequence
gtttttacctaccactttgt

SEQ ID NO: 413701 - DNA, 20 bp, Artificial
  CRISPR gRNA sequence
tttttacctaccactttgtc

SEQ ID NO: 413702 - DNA, 20 bp, Artificial
  CRISPR gRNA sequence
ttacctaccactttgtctgt

SEQ ID NO: 413703 - DNA, 20 bp, Artificial
  CRISPR gRNA sequence
tacctaccactttgtctgta

SEQ ID NO: 413704 - DNA, 20 bp, Artificial
  CRISPR gRNA sequence
acctaccactttgtctgtag

SEQ ID NO: 413705 - DNA, 20 bp, Artificial
  CRISPR gRNA sequence
cctaccactttgtctgtagt

SEQ ID NO: 413706 - DNA, 20 bp, Artificial
  CRISPR gRNA sequence
ccactttgtctgtagtacca

SEQ ID NO: 413707 - DNA, 20 bp, Artificial
  CRISPR gRNA sequence
tgtctgtagtaccaggcata

SEQ ID NO: 413708 - DNA, 20 bp, Artificial
  CRISPR gRNA sequence
gtctgtagtaccaggcatac

SEQ ID NO: 413709 - DNA, 20 bp, Artificial
  CRISPR gRNA sequence
tctgtagtaccaggcataca

SEQ ID NO: 413710 - DNA, 20 bp, Artificial
  CRISPR gRNA sequence
tagtaccaggcatacagtac

SEQ ID NO: 413711 - DNA, 20 bp, Artificial
  CRISPR gRNA sequence
gaaatactttgtgtttaaag

SEQ ID NO: 413712 - DNA, 20 bp, Artificial
  CRISPR gRNA sequence
aaatactttgtgtttaaaga

SEQ ID NO: 413713 - DNA, 20 bp, Artificial
  CRISPR gRNA sequence
tgtgtttaaagactgagtga

SEQ ID NO: 413714 - DNA, 20 bp, Artificial
  CRISPR gRNA sequence
gtgtttaaagactgagtgaa

SEQ ID NO: 413715 - DNA, 20 bp, Artificial
  CRISPR gRNA sequence
tgtttaaagactgagtgaat

SEQ ID NO: 413716 - DNA, 20 bp, Artificial
  CRISPR gRNA sequence
aaagactgagtgaataaatg

SEQ ID NO: 413717 - DNA, 20 bp, Artificial
  CRISPR gRNA sequence
aagactgagtgaataaatgg

SEQ ID NO: 413718 - DNA, 20 bp, Artificial
  CRISPR gRNA sequence
agtgaataaatggatctgat

SEQ ID NO: 413719 - DNA, 20 bp, Artificial
  CRISPR gRNA sequence
atccaagaggccaaacatta

SEQ ID NO: 413720 - DNA, 20 bp, Artificial
  CRISPR gRNA sequence
ctaaaaacgggttacaaata

SEQ ID NO: 413721 - DNA, 20 bp, Artificial
  CRISPR gRNA sequence
aaaacgggttacaaataggt

SEQ ID NO: 413722 - DNA, 20 bp, Artificial
  CRISPR gRNA sequence
caaataggtaacatatttcc

SEQ ID NO: 413723 - DNA, 20 bp, Artificial
  CRISPR gRNA sequence
cctatgaaacaatgcatctg

SEQ ID NO: 413724 - DNA, 20 bp, Artificial
  CRISPR gRNA sequence
ctatgaaacaatgcatctga

SEQ ID NO: 413725 - DNA, 20 bp, Artificial
  CRISPR gRNA sequence
tgaaacaatgcatctgaaat

SEQ ID NO: 413726 - DNA, 20 bp, Artificial
  CRISPR gRNA sequence
aaatttggatttataattga

SEQ ID NO: 413727 - DNA, 20 bp, Artificial
  CRISPR gRNA sequence
ggatttataattgaacagtg

SEQ ID NO: 413728 - DNA, 20 bp, Artificial
  CRISPR gRNA sequence
gatttataattgaacagtgt

SEQ ID NO: 413729 - DNA, 20 bp, Artificial
  CRISPR gRNA sequence
ataattgaacagtgtgtcac

SEQ ID NO: 413730 - DNA, 20 bp, Artificial
  CRISPR gRNA sequence
taattgaacagtgtgtcaca

SEQ ID NO: 413731 - DNA, 20 bp, Artificial
  CRISPR gRNA sequence
aacagtgtgtcacaagtggt

SEQ ID NO: 413732 - DNA, 20 bp, Artificial
  CRISPR gRNA sequence
tcaagcaggttatactgtta

SEQ ID NO: 413733 - DNA, 20 bp, Artificial
  CRISPR gRNA sequence
caagcaggttatactgttaa

SEQ ID NO: 413734 - DNA, 20 bp, Artificial
  CRISPR gRNA sequence
aagcaggttatactgttaaa

SEQ ID NO: 413735 - DNA, 20 bp, Artificial
  CRISPR gRNA sequence
tactgttaaattcatataaa

SEQ ID NO: 413736 - DNA, 20 bp, Artificial
  CRISPR gRNA sequence
ttaaattcatataaattaga

SEQ ID NO: 413737 - DNA, 20 bp, Artificial
  CRISPR gRNA sequence
aattcatataaattagacct

SEQ ID NO: 413738 - DNA, 20 bp, Artificial
  CRISPR gRNA sequence
atataaattagaccttcata

SEQ ID NO: 413739 - DNA, 20 bp, Artificial
  CRISPR gRNA sequence
gaccttcataaagaaagcca

SEQ ID NO: 413740 - DNA, 20 bp, Artificial
  CRISPR gRNA sequence
cataaagaaagccatcttaa

SEQ ID NO: 413741 - DNA, 20 bp, Artificial
  CRISPR gRNA sequence
ataaagaaagccatcttaat

SEQ ID NO: 413742 - DNA, 20 bp, Artificial
  CRISPR gRNA sequence
aattgttaagtattctattt

SEQ ID NO: 413743 - DNA, 20 bp, Artificial
  CRISPR gRNA sequence
attgttaagtattctatttc

SEQ ID NO: 413744 - DNA, 20 bp, Artificial
  CRISPR gRNA sequence
ttaagtattctatttctaaa

SEQ ID NO: 413745 - DNA, 20 bp, Artificial
  CRISPR gRNA sequence
agtattctatttctaaagaa

SEQ ID NO: 413746 - DNA, 20 bp, Artificial
  CRISPR gRNA sequence
tatttctaaagaaaagattt

SEQ ID NO: 413747 - DNA, 20 bp, Artificial
  CRISPR gRNA sequence
tttctaaagaaaagatttct

SEQ ID NO: 413748 - DNA, 20 bp, Artificial
  CRISPR gRNA sequence
ctaaagaaaagatttctaca

SEQ ID NO: 413749 - DNA, 20 bp, Artificial
  CRISPR gRNA sequence
taaagaaaagatttctacat

SEQ ID NO: 413750 - DNA, 20 bp, Artificial
  CRISPR gRNA sequence
aagaaaagatttctacatcc

SEQ ID NO: 413751 - DNA, 20 bp, Artificial
  CRISPR gRNA sequence
ctacatcctgtactttaacc

SEQ ID NO: 413752 - DNA, 20 bp, Artificial
  CRISPR gRNA sequence
tacatcctgtactttaacca

SEQ ID NO: 413753 - DNA, 20 bp, Artificial
  CRISPR gRNA sequence
catcctgtactttaaccact

SEQ ID NO: 413754 - DNA, 20 bp, Artificial
  CRISPR gRNA sequence
tactttaaccactaagattt

SEQ ID NO: 413755 - DNA, 20 bp, Artificial
  CRISPR gRNA sequence
taaccactaagatttgataa

SEQ ID NO: 413756 - DNA, 20 bp, Artificial
  CRISPR gRNA sequence
aaccactaagatttgataaa

SEQ ID NO: 413757 - DNA, 20 bp, Artificial
  CRISPR gRNA sequence
accactaagatttgataaaa

SEQ ID NO: 413758 - DNA, 20 bp, Artificial
  CRISPR gRNA sequence
agatttgataaaatattctt

SEQ ID NO: 413759 - DNA, 20 bp, Artificial
  CRISPR gRNA sequence
gataaaatattcttttttaa

SEQ ID NO: 413760 - DNA, 20 bp, Artificial
  CRISPR gRNA sequence
ataaaatattcttttttaag

SEQ ID NO: 413761 - DNA, 20 bp, Artificial
  CRISPR gRNA sequence
ttttttaagcctgcagatct

SEQ ID NO: 413762 - DNA, 20 bp, Artificial
  CRISPR gRNA sequence
ttttaagcctgcagatcttt

SEQ ID NO: 413763 - DNA, 20 bp, Artificial
  CRISPR gRNA sequence
tttaagcctgcagatcttta

SEQ ID NO: 413764 - DNA, 20 bp, Artificial
  CRISPR gRNA sequence
ttaagcctgcagatctttat

SEQ ID NO: 413765 - DNA, 20 bp, Artificial
  CRISPR gRNA sequence
taagcctgcagatctttatt

SEQ ID NO: 413766 - DNA, 20 bp, Artificial
  CRISPR gRNA sequence
aagcctgcagatctttattt

SEQ ID NO: 413767 - DNA, 20 bp, Artificial
  CRISPR gRNA sequence
agcctgcagatctttatttt

SEQ ID NO: 413768 - DNA, 20 bp, Artificial
  CRISPR gRNA sequence
cagatctttatttttttggt

SEQ ID NO: 413769 - DNA, 20 bp, Artificial
  CRISPR gRNA sequence
tatttttttggtactgtatt

SEQ ID NO: 413770 - DNA, 20 bp, Artificial
  CRISPR gRNA sequence
atttttttggtactgtattt

SEQ ID NO: 413771 - DNA, 20 bp, Artificial
  CRISPR gRNA sequence
tttttttggtactgtatttg

SEQ ID NO: 413772 - DNA, 20 bp, Artificial
  CRISPR gRNA sequence
ttttggtactgtatttgcct

SEQ ID NO: 413773 - DNA, 20 bp, Artificial
  CRISPR gRNA sequence
tttggtactgtatttgcctg

SEQ ID NO: 413774 - DNA, 20 bp, Artificial
  CRISPR gRNA sequence
ttggtactgtatttgcctga

SEQ ID NO: 413775 - DNA, 20 bp, Artificial
  CRISPR gRNA sequence
tggtactgtatttgcctgat

SEQ ID NO: 413776 - DNA, 20 bp, Artificial
  CRISPR gRNA sequence
ggtactgtatttgcctgatc

SEQ ID NO: 413777 - DNA, 20 bp, Artificial
  CRISPR gRNA sequence
gtactgtatttgcctgatca

SEQ ID NO: 413778 - DNA, 20 bp, Artificial
  CRISPR gRNA sequence
tatttgcctgatcacaaaat

SEQ ID NO: 413779 - DNA, 20 bp, Artificial
  CRISPR gRNA sequence
gcctgatcacaaaatgaaca

SEQ ID NO: 413780 - DNA, 20 bp, Artificial
  CRISPR gRNA sequence
cctgatcacaaaatgaacac

SEQ ID NO: 413781 - DNA, 20 bp, Artificial
  CRISPR gRNA sequence
atcacaaaatgaacacatcg

SEQ ID NO: 413782 - DNA, 20 bp, Artificial
  CRISPR gRNA sequence
gaaaatttggaaaatataaa

SEQ ID NO: 413783 - DNA, 20 bp, Artificial
  CRISPR gRNA sequence
ggaaaatataaaaaagccca

SEQ ID NO: 413784 - DNA, 20 bp, Artificial
  CRISPR gRNA sequence
gaaaatataaaaaagcccaa

SEQ ID NO: 413785 - DNA, 20 bp, Artificial
  CRISPR gRNA sequence
ctttaaatttttttttaaat

SEQ ID NO: 413786 - DNA, 20 bp, Artificial
  CRISPR gRNA sequence
taaatttttttttaaataat

SEQ ID NO: 413787 - DNA, 20 bp, Artificial
  CRISPR gRNA sequence
aaatttttttttaaataatt

SEQ ID NO: 413788 - DNA, 20 bp, Artificial
  CRISPR gRNA sequence
aatttttttttaaataatta

SEQ ID NO: 413789 - DNA, 20 bp, Artificial
  CRISPR gRNA sequence
ttttttaaataattaactgt

SEQ ID NO: 413790 - DNA, 20 bp, Artificial
  CRISPR gRNA sequence
tttttaaataattaactgtc

SEQ ID NO: 413791 - DNA, 20 bp, Artificial
  CRISPR gRNA sequence
ttttaaataattaactgtca

SEQ ID NO: 413792 - DNA, 20 bp, Artificial
  CRISPR gRNA sequence
tttaaataattaactgtcaa

SEQ ID NO: 413793 - DNA, 20 bp, Artificial
  CRISPR gRNA sequence
ttaaataattaactgtcaaa

SEQ ID NO: 413794 - DNA, 20 bp, Artificial
  CRISPR gRNA sequence
taaataattaactgtcaaat

SEQ ID NO: 413795 - DNA, 20 bp, Artificial
  CRISPR gRNA sequence
aaataattaactgtcaaata

SEQ ID NO: 413796 - DNA, 20 bp, Artificial
  CRISPR gRNA sequence
aataattaactgtcaaataa

SEQ ID NO: 413797 - DNA, 20 bp, Artificial
  CRISPR gRNA sequence
actgtcaaataaagattgaa

SEQ ID NO: 413798 - DNA, 20 bp, Artificial
  CRISPR gRNA sequence
tcaaataaagattgaatata

SEQ ID NO: 413799 - DNA, 20 bp, Artificial
  CRISPR gRNA sequence
aatatattcagggcatacag

SEQ ID NO: 413800 - DNA, 20 bp, Artificial
  CRISPR gRNA sequence
agggcatacagtgtgattat

SEQ ID NO: 413801 - DNA, 20 bp, Artificial
  CRISPR gRNA sequence
tttgatgtatataaacatgg

SEQ ID NO: 413802 - DNA, 20 bp, Artificial
  CRISPR gRNA sequence
gatgtatataaacatggtgt

SEQ ID NO: 413803 - DNA, 20 bp, Artificial
  CRISPR gRNA sequence
atgtatataaacatggtgta

SEQ ID NO: 413804 - DNA, 20 bp, Artificial
  CRISPR gRNA sequence
attaactcatgtatcaccat

SEQ ID NO: 413805 - DNA, 20 bp, Artificial
  CRISPR gRNA sequence
actcatgtatcaccatccat

SEQ ID NO: 413806 - DNA, 20 bp, Artificial
  CRISPR gRNA sequence
atgtatcaccatccatactg

SEQ ID NO: 413807 - DNA, 20 bp, Artificial
  CRISPR gRNA sequence
tatagtaggtccccattata

SEQ ID NO: 413808 - DNA, 20 bp, Artificial
  CRISPR gRNA sequence
taaccaaaagttggtaccct

SEQ ID NO: 413809 - DNA, 20 bp, Artificial
  CRISPR gRNA sequence
gtaccctttagccagcgtct

SEQ ID NO: 413810 - DNA, 20 bp, Artificial
  CRISPR gRNA sequence
tagccagcgtctccctatct

SEQ ID NO: 413811 - DNA, 20 bp, Artificial
  CRISPR gRNA sequence
agccagcgtctccctatctt

SEQ ID NO: 413812 - DNA, 20 bp, Artificial
  CRISPR gRNA sequence
gccagcgtctccctatcttc

SEQ ID NO: 413813 - DNA, 20 bp, Artificial
  CRISPR gRNA sequence
cctatcttctgccctcccac

SEQ ID NO: 413814 - DNA, 20 bp, Artificial
  CRISPR gRNA sequence
tcttctgccctcccacctcc

SEQ ID NO: 413815 - DNA, 20 bp, Artificial
  CRISPR gRNA sequence
ctgccctcccacctcctggc

SEQ ID NO: 413816 - DNA, 20 bp, Artificial
  CRISPR gRNA sequence
tgccctcccacctcctggca

SEQ ID NO: 413817 - DNA, 20 bp, Artificial
  CRISPR gRNA sequence
ccctcccacctcctggcaac

SEQ ID NO: 413818 - DNA, 20 bp, Artificial
  CRISPR gRNA sequence
ccacctcctggcaaccactg

SEQ ID NO: 413819 - DNA, 20 bp, Artificial
  CRISPR gRNA sequence
ctggcaaccactgttctatt

SEQ ID NO: 413820 - DNA, 20 bp, Artificial
  CRISPR gRNA sequence
gcaaccactgttctattccc

SEQ ID NO: 413821 - DNA, 20 bp, Artificial
  CRISPR gRNA sequence
ttctattccctgcttctata

SEQ ID NO: 413822 - DNA, 20 bp, Artificial
  CRISPR gRNA sequence
tattccctgcttctataagt

SEQ ID NO: 413823 - DNA, 20 bp, Artificial
  CRISPR gRNA sequence
ttccctgcttctataagttt

SEQ ID NO: 413824 - DNA, 20 bp, Artificial
  CRISPR gRNA sequence
cctgcttctataagtttgac

SEQ ID NO: 413825 - DNA, 20 bp, Artificial
  CRISPR gRNA sequence
cttctataagtttgactttt

SEQ ID NO: 413826 - DNA, 20 bp, Artificial
  CRISPR gRNA sequence
ctataagtttgactttttta

SEQ ID NO: 413827 - DNA, 20 bp, Artificial
  CRISPR gRNA sequence
tataagtttgacttttttag

SEQ ID NO: 413828 - DNA, 20 bp, Artificial
  CRISPR gRNA sequence
taagtttgacttttttagat

SEQ ID NO: 413829 - DNA, 20 bp, Artificial
  CRISPR gRNA sequence
gacttttttagattccacat

SEQ ID NO: 413830 - DNA, 20 bp, Artificial
  CRISPR gRNA sequence
acttttttagattccacata

SEQ ID NO: 413831 - DNA, 20 bp, Artificial
  CRISPR gRNA sequence
ttttagattccacatacagg

SEQ ID NO: 413832 - DNA, 20 bp, Artificial
  CRISPR gRNA sequence
tttagattccacatacaggt

SEQ ID NO: 413833 - DNA, 20 bp, Artificial
  CRISPR gRNA sequence
ttagattccacatacaggtg

SEQ ID NO: 413834 - DNA, 20 bp, Artificial
  CRISPR gRNA sequence
tagattccacatacaggtga

SEQ ID NO: 413835 - DNA, 20 bp, Artificial
  CRISPR gRNA sequence
agattccacatacaggtgag

SEQ ID NO: 413836 - DNA, 20 bp, Artificial
  CRISPR gRNA sequence
gattccacatacaggtgaga

SEQ ID NO: 413837 - DNA, 20 bp, Artificial
  CRISPR gRNA sequence
cacatacaggtgagattata

SEQ ID NO: 413838 - DNA, 20 bp, Artificial
  CRISPR gRNA sequence
tacagtatttgtctttctat

SEQ ID NO: 413839 - DNA, 20 bp, Artificial
  CRISPR gRNA sequence
gtctttctatgtctggctta

SEQ ID NO: 413840 - DNA, 20 bp, Artificial
  CRISPR gRNA sequence
tctttctatgtctggcttat

SEQ ID NO: 413841 - DNA, 20 bp, Artificial
  CRISPR gRNA sequence
tctatgtctggcttatttca

SEQ ID NO: 413842 - DNA, 20 bp, Artificial
  CRISPR gRNA sequence
ctatgtctggcttatttcac

SEQ ID NO: 413843 - DNA, 20 bp, Artificial
  CRISPR gRNA sequence
tatgtctggcttatttcact

SEQ ID NO: 413844 - DNA, 20 bp, Artificial
  CRISPR gRNA sequence
tgtctggcttatttcactta

SEQ ID NO: 413845 - DNA, 20 bp, Artificial
  CRISPR gRNA sequence
gcttatttcacttacataat

SEQ ID NO: 413846 - DNA, 20 bp, Artificial
  CRISPR gRNA sequence
atttcacttacataatgtcc

SEQ ID NO: 413847 - DNA, 20 bp, Artificial
  CRISPR gRNA sequence
tttcacttacataatgtcct

SEQ ID NO: 413848 - DNA, 20 bp, Artificial
  CRISPR gRNA sequence
cacttacataatgtcctcca

SEQ ID NO: 413849 - DNA, 20 bp, Artificial
  CRISPR gRNA sequence
acttacataatgtcctccaa

SEQ ID NO: 413850 - DNA, 20 bp, Artificial
  CRISPR gRNA sequence
acataatgtcctccaaattc

SEQ ID NO: 413851 - DNA, 20 bp, Artificial
  CRISPR gRNA sequence
cataatgtcctccaaattca

SEQ ID NO: 413852 - DNA, 20 bp, Artificial
  CRISPR gRNA sequence
caaattcatccatgctgtcg

SEQ ID NO: 413853 - DNA, 20 bp, Artificial
  CRISPR gRNA sequence
atccatgctgtcgcaaatgg

SEQ ID NO: 413854 - DNA, 20 bp, Artificial
  CRISPR gRNA sequence
tcgcaaatggcaggatttca

SEQ ID NO: 413855 - DNA, 20 bp, Artificial
  CRISPR gRNA sequence
cacagcaaaagagcaaccca

SEQ ID NO: 413856 - DNA, 20 bp, Artificial
  CRISPR gRNA sequence
acagcaaaagagcaacccaa

SEQ ID NO: 413857 - DNA, 20 bp, Artificial
  CRISPR gRNA sequence
aaaagtgggcaaaaacagac

SEQ ID NO: 413858 - DNA, 20 bp, Artificial
  CRISPR gRNA sequence
tccaaagaagacataacact

SEQ ID NO: 413859 - DNA, 20 bp, Artificial
  CRISPR gRNA sequence
ccaaagaagacataacactg

SEQ ID NO: 413860 - DNA, 20 bp, Artificial
  CRISPR gRNA sequence
caaagaagacataacactgg

SEQ ID NO: 413861 - DNA, 20 bp, Artificial
  CRISPR gRNA sequence
gccaataggtatatggaaag

SEQ ID NO: 413862 - DNA, 20 bp, Artificial
  CRISPR gRNA sequence
ctcaacattactggtcatca

SEQ ID NO: 413863 - DNA, 20 bp, Artificial
  CRISPR gRNA sequence
aacattactggtcatcaggg

SEQ ID NO: 413864 - DNA, 20 bp, Artificial
  CRISPR gRNA sequence
ctggtcatcagggaaatgca

SEQ ID NO: 413865 - DNA, 20 bp, Artificial
  CRISPR gRNA sequence
gtcatcagggaaatgcaaat

SEQ ID NO: 413866 - DNA, 20 bp, Artificial
  CRISPR gRNA sequence
tcacctcacacctattagaa

SEQ ID NO: 413867 - DNA, 20 bp, Artificial
  CRISPR gRNA sequence
acctcacacctattagaatg

SEQ ID NO: 413868 - DNA, 20 bp, Artificial
  CRISPR gRNA sequence
acacctattagaatggctgt

SEQ ID NO: 413869 - DNA, 20 bp, Artificial
  CRISPR gRNA sequence
ttagaatggctgttatcaaa

SEQ ID NO: 413870 - DNA, 20 bp, Artificial
  CRISPR gRNA sequence
gaatggctgttatcaaaaag

SEQ ID NO: 413871 - DNA, 20 bp, Artificial
  CRISPR gRNA sequence
ttatcaaaaaggcaagagat

SEQ ID NO: 413872 - DNA, 20 bp, Artificial
  CRISPR gRNA sequence
tcaaaaaggcaagagatagc

SEQ ID NO: 413873 - DNA, 20 bp, Artificial
  CRISPR gRNA sequence
gtgaggatgtggagaaaagg

SEQ ID NO: 413874 - DNA, 20 bp, Artificial
  CRISPR gRNA sequence
gtacactgttggcgggaatg

SEQ ID NO: 413875 - DNA, 20 bp, Artificial
  CRISPR gRNA sequence
tacactgttggcgggaatgt

SEQ ID NO: 413876 - DNA, 20 bp, Artificial
  CRISPR gRNA sequence
ttggcgggaatgtaaatggg

SEQ ID NO: 413877 - DNA, 20 bp, Artificial
  CRISPR gRNA sequence
gcgggaatgtaaatgggtac

SEQ ID NO: 413878 - DNA, 20 bp, Artificial
  CRISPR gRNA sequence
gttattggtacaggtagtag

SEQ ID NO: 413879 - DNA, 20 bp, Artificial
  CRISPR gRNA sequence
ttggtacaggtagtaggttc

SEQ ID NO: 413880 - DNA, 20 bp, Artificial
  CRISPR gRNA sequence
gtacaggtagtaggttcctc

SEQ ID NO: 413881 - DNA, 20 bp, Artificial
  CRISPR gRNA sequence
ctcaagaaattaaaaatagg

SEQ ID NO: 413882 - DNA, 20 bp, Artificial
  CRISPR gRNA sequence
aagaaattaaaaataggcca

SEQ ID NO: 413883 - DNA, 20 bp, Artificial
  CRISPR gRNA sequence
aaaataggccaggtgcggtg

SEQ ID NO: 413884 - DNA, 20 bp, Artificial
  CRISPR gRNA sequence
atgcctgtaatcccagcact

SEQ ID NO: 413885 - DNA, 20 bp, Artificial
  CRISPR gRNA sequence
taatcccagcactttgggag

SEQ ID NO: 413886 - DNA, 20 bp, Artificial
  CRISPR gRNA sequence
tgggaggccaaggcagatgg

SEQ ID NO: 413887 - DNA, 20 bp, Artificial
  CRISPR gRNA sequence
gggaggccaaggcagatgga

SEQ ID NO: 413888 - DNA, 20 bp, Artificial
  CRISPR gRNA sequence
ggaggccaaggcagatggat

SEQ ID NO: 413889 - DNA, 20 bp, Artificial
  CRISPR gRNA sequence
aggtcaggagttcgagacca

SEQ ID NO: 413890 - DNA, 20 bp, Artificial
  CRISPR gRNA sequence
gagaccagcctggccaacag

SEQ ID NO: 413891 - DNA, 20 bp, Artificial
  CRISPR gRNA sequence
gccaacagggtgaaacccca

SEQ ID NO: 413892 - DNA, 20 bp, Artificial
  CRISPR gRNA sequence
tactaaaaatacaaaaatta

SEQ ID NO: 413893 - DNA, 20 bp, Artificial
  CRISPR gRNA sequence
ctaaaaatacaaaaattagc

SEQ ID NO: 413894 - DNA, 20 bp, Artificial
  CRISPR gRNA sequence
aaaatacaaaaattagctgg

SEQ ID NO: 413895 - DNA, 20 bp, Artificial
  CRISPR gRNA sequence
gctgggtgtggtggcaggtg

SEQ ID NO: 413896 - DNA, 20 bp, Artificial
  CRISPR gRNA sequence
ggtgtggtggcaggtgcctg

SEQ ID NO: 413897 - DNA, 20 bp, Artificial
  CRISPR gRNA sequence
taatcccagctacttggagg

SEQ ID NO: 413898 - DNA, 20 bp, Artificial
  CRISPR gRNA sequence
cttggaggctgaggcaggag

SEQ ID NO: 413899 - DNA, 20 bp, Artificial
  CRISPR gRNA sequence
ggaggctgaggcaggagaat

SEQ ID NO: 413900 - DNA, 20 bp, Artificial
  CRISPR gRNA sequence
gaggctgaggcaggagaatt

SEQ ID NO: 413901 - DNA, 20 bp, Artificial
  CRISPR gRNA sequence
aggcaggagaattgcttgaa

SEQ ID NO: 413902 - DNA, 20 bp, Artificial
  CRISPR gRNA sequence
cttgaacctgggaagtggag

SEQ ID NO: 413903 - DNA, 20 bp, Artificial
  CRISPR gRNA sequence
gaacctgggaagtggagctt

SEQ ID NO: 413904 - DNA, 20 bp, Artificial
  CRISPR gRNA sequence
aacctgggaagtggagcttg

SEQ ID NO: 413905 - DNA, 20 bp, Artificial
  CRISPR gRNA sequence
ggaagtggagcttgcagcga

SEQ ID NO: 413906 - DNA, 20 bp, Artificial
  CRISPR gRNA sequence
gcagcgagctgagattgtgc

SEQ ID NO: 413907 - DNA, 20 bp, Artificial
  CRISPR gRNA sequence
cagcgagctgagattgtgcc

SEQ ID NO: 413908 - DNA, 20 bp, Artificial
  CRISPR gRNA sequence
agattgtgccactgcactcc

SEQ ID NO: 413909 - DNA, 20 bp, Artificial
  CRISPR gRNA sequence
tgccactgcactccagcctg

SEQ ID NO: 413910 - DNA, 20 bp, Artificial
  CRISPR gRNA sequence
cactccagcctgggtgacaa

SEQ ID NO: 413911 - DNA, 20 bp, Artificial
  CRISPR gRNA sequence
cagcctgggtgacaagagtg

SEQ ID NO: 413912 - DNA, 20 bp, Artificial
  CRISPR gRNA sequence
ggtgacaagagtgaaactct

SEQ ID NO: 413913 - DNA, 20 bp, Artificial
  CRISPR gRNA sequence
tgtcccaaaaataaaataaa

SEQ ID NO: 413914 - DNA, 20 bp, Artificial
  CRISPR gRNA sequence
tcccaaaaataaaataaaat

SEQ ID NO: 413915 - DNA, 20 bp, Artificial
  CRISPR gRNA sequence
aaataaaataaataaagcta

SEQ ID NO: 413916 - DNA, 20 bp, Artificial
  CRISPR gRNA sequence
tcatatgaaccagcaatctg

SEQ ID NO: 413917 - DNA, 20 bp, Artificial
  CRISPR gRNA sequence
atgggtattatatacaaagg

SEQ ID NO: 413918 - DNA, 20 bp, Artificial
  CRISPR gRNA sequence
tatacaaaggaaatgaggtc

SEQ ID NO: 413919 - DNA, 20 bp, Artificial
  CRISPR gRNA sequence
gaagaaatacctgcaccgtg

SEQ ID NO: 413920 - DNA, 20 bp, Artificial
  CRISPR gRNA sequence
aagaaatacctgcaccgtgt

SEQ ID NO: 413921 - DNA, 20 bp, Artificial
  CRISPR gRNA sequence
caccgtgtatgtattgcatc

SEQ ID NO: 413922 - DNA, 20 bp, Artificial
  CRISPR gRNA sequence
catcattgtctacagtagtc

SEQ ID NO: 413923 - DNA, 20 bp, Artificial
  CRISPR gRNA sequence
tctacagtagtcaagatgtg

SEQ ID NO: 413924 - DNA, 20 bp, Artificial
  CRISPR gRNA sequence
cagtagtcaagatgtggatg

SEQ ID NO: 413925 - DNA, 20 bp, Artificial
  CRISPR gRNA sequence
ggtgtccatcaacagatgaa

SEQ ID NO: 413926 - DNA, 20 bp, Artificial
  CRISPR gRNA sequence
ttaaccctttaaaaaagaag

SEQ ID NO: 413927 - DNA, 20 bp, Artificial
  CRISPR gRNA sequence
accctttaaaaaagaaggaa

SEQ ID NO: 413928 - DNA, 20 bp, Artificial
  CRISPR gRNA sequence
taaaaaagaaggaaatcata

SEQ ID NO: 413929 - DNA, 20 bp, Artificial
  CRISPR gRNA sequence
aaaaaagaaggaaatcatat

SEQ ID NO: 413930 - DNA, 20 bp, Artificial
  CRISPR gRNA sequence
aaaaagaaggaaatcatatc

SEQ ID NO: 413931 - DNA, 20 bp, Artificial
  CRISPR gRNA sequence
gaggacattatgaaaagtga

SEQ ID NO: 413932 - DNA, 20 bp, Artificial
  CRISPR gRNA sequence
aggacattatgaaaagtgaa

SEQ ID NO: 413933 - DNA, 20 bp, Artificial
  CRISPR gRNA sequence
tgaaaagtgaaataagccag

SEQ ID NO: 413934 - DNA, 20 bp, Artificial
  CRISPR gRNA sequence
tgtatgacttcacttatttg

SEQ ID NO: 413935 - DNA, 20 bp, Artificial
  CRISPR gRNA sequence
gtatgacttcacttatttgt

SEQ ID NO: 413936 - DNA, 20 bp, Artificial
  CRISPR gRNA sequence
tatgacttcacttatttgtg

SEQ ID NO: 413937 - DNA, 20 bp, Artificial
  CRISPR gRNA sequence
cacttatttgtggaatctag

SEQ ID NO: 413938 - DNA, 20 bp, Artificial
  CRISPR gRNA sequence
acttatttgtggaatctagg

SEQ ID NO: 413939 - DNA, 20 bp, Artificial
  CRISPR gRNA sequence
atttgtggaatctaggtcta

SEQ ID NO: 413940 - DNA, 20 bp, Artificial
  CRISPR gRNA sequence
tttgtggaatctaggtctaa

SEQ ID NO: 413941 - DNA, 20 bp, Artificial
  CRISPR gRNA sequence
gtggaatctaggtctaaaac

SEQ ID NO: 413942 - DNA, 20 bp, Artificial
  CRISPR gRNA sequence
tggaatctaggtctaaaacg

SEQ ID NO: 413943 - DNA, 20 bp, Artificial
  CRISPR gRNA sequence
ggtctaaaacgtttaaaaat

SEQ ID NO: 413944 - DNA, 20 bp, Artificial
  CRISPR gRNA sequence
aaacgtttaaaaataaaatg

SEQ ID NO: 413945 - DNA, 20 bp, Artificial
  CRISPR gRNA sequence
aaaaataaaatgtttgctta

SEQ ID NO: 413946 - DNA, 20 bp, Artificial
  CRISPR gRNA sequence
aaaataaaatgtttgcttat

SEQ ID NO: 413947 - DNA, 20 bp, Artificial
  CRISPR gRNA sequence
gcttatttgtcttagtttct

SEQ ID NO: 413948 - DNA, 20 bp, Artificial
  CRISPR gRNA sequence
cttatttgtcttagtttctc

SEQ ID NO: 413949 - DNA, 20 bp, Artificial
  CRISPR gRNA sequence
atttgtcttagtttctcttt

SEQ ID NO: 413950 - DNA, 20 bp, Artificial
  CRISPR gRNA sequence
tttgtcttagtttctctttg

SEQ ID NO: 413951 - DNA, 20 bp, Artificial
  CRISPR gRNA sequence
gtcttagtttctctttgcag

SEQ ID NO: 413952 - DNA, 20 bp, Artificial
  CRISPR gRNA sequence
tcttagtttctctttgcagt

SEQ ID NO: 413953 - DNA, 20 bp, Artificial
  CRISPR gRNA sequence
agtttctctttgcagtaaag

SEQ ID NO: 413954 - DNA, 20 bp, Artificial
  CRISPR gRNA sequence
gtttctctttgcagtaaagt

SEQ ID NO: 413955 - DNA, 20 bp, Artificial
  CRISPR gRNA sequence
ctctttgcagtaaagtttgt

SEQ ID NO: 413956 - DNA, 20 bp, Artificial
  CRISPR gRNA sequence
tctttgcagtaaagtttgtg

SEQ ID NO: 413957 - DNA, 20 bp, Artificial
  CRISPR gRNA sequence
tttgcagtaaagtttgtgaa

SEQ ID NO: 413958 - DNA, 20 bp, Artificial
  CRISPR gRNA sequence
tgcagtaaagtttgtgaaag

SEQ ID NO: 413959 - DNA, 20 bp, Artificial
  CRISPR gRNA sequence
gcagtaaagtttgtgaaaga

SEQ ID NO: 413960 - DNA, 20 bp, Artificial
  CRISPR gRNA sequence
cagtaaagtttgtgaaagaa

SEQ ID NO: 413961 - DNA, 20 bp, Artificial
  CRISPR gRNA sequence
gtgaaagaataagtgggtct

SEQ ID NO: 413962 - DNA, 20 bp, Artificial
  CRISPR gRNA sequence
tgaaagaataagtgggtcta

SEQ ID NO: 413963 - DNA, 20 bp, Artificial
  CRISPR gRNA sequence
tactttgagttcttatgaaa

SEQ ID NO: 413964 - DNA, 20 bp, Artificial
  CRISPR gRNA sequence
tgagttcttatgaaaaaaat

SEQ ID NO: 413965 - DNA, 20 bp, Artificial
  CRISPR gRNA sequence
gagttcttatgaaaaaaatg

SEQ ID NO: 413966 - DNA, 20 bp, Artificial
  CRISPR gRNA sequence
agttcttatgaaaaaaatgc

SEQ ID NO: 413967 - DNA, 20 bp, Artificial
  CRISPR gRNA sequence
ttatgaaaaaaatgcagcta

SEQ ID NO: 413968 - DNA, 20 bp, Artificial
  CRISPR gRNA sequence
atgaaaaaaatgcagctaca

SEQ ID NO: 413969 - DNA, 20 bp, Artificial
  CRISPR gRNA sequence
tgaaaaaaatgcagctacat

SEQ ID NO: 413970 - DNA, 20 bp, Artificial
  CRISPR gRNA sequence
catagtggataaagtgagaa

SEQ ID NO: 413971 - DNA, 20 bp, Artificial
  CRISPR gRNA sequence
tctgaggaaaagatggggaa

SEQ ID NO: 413972 - DNA, 20 bp, Artificial
  CRISPR gRNA sequence
ctgaggaaaagatggggaag

SEQ ID NO: 413973 - DNA, 20 bp, Artificial
  CRISPR gRNA sequence
tgaggaaaagatggggaaga

SEQ ID NO: 413974 - DNA, 20 bp, Artificial
  CRISPR gRNA sequence
aggaaaagatggggaagaat

SEQ ID NO: 413975 - DNA, 20 bp, Artificial
  CRISPR gRNA sequence
gttgaaagtcatggttttca

SEQ ID NO: 413976 - DNA, 20 bp, Artificial
  CRISPR gRNA sequence
aaagtcatggttttcaggct

SEQ ID NO: 413977 - DNA, 20 bp, Artificial
  CRISPR gRNA sequence
tcaggctgcaataggattcc

SEQ ID NO: 413978 - DNA, 20 bp, Artificial
  CRISPR gRNA sequence
caggctgcaataggattcca

SEQ ID NO: 413979 - DNA, 20 bp, Artificial
  CRISPR gRNA sequence
aggctgcaataggattccag

SEQ ID NO: 413980 - DNA, 20 bp, Artificial
  CRISPR gRNA sequence
caataggattccagacagcc

SEQ ID NO: 413981 - DNA, 20 bp, Artificial
  CRISPR gRNA sequence
cagacagccggggtgtcaca

SEQ ID NO: 413982 - DNA, 20 bp, Artificial
  CRISPR gRNA sequence
aagctttgatttcaggagga

SEQ ID NO: 413983 - DNA, 20 bp, Artificial
  CRISPR gRNA sequence
tgatttcaggaggaagggaa

SEQ ID NO: 413984 - DNA, 20 bp, Artificial
  CRISPR gRNA sequence
gatttcaggaggaagggaaa

SEQ ID NO: 413985 - DNA, 20 bp, Artificial
  CRISPR gRNA sequence
atttcaggaggaagggaaat

SEQ ID NO: 413986 - DNA, 20 bp, Artificial
  CRISPR gRNA sequence
caggaggaagggaaattgtg

SEQ ID NO: 413987 - DNA, 20 bp, Artificial
  CRISPR gRNA sequence
aggaggaagggaaattgtgc

SEQ ID NO: 413988 - DNA, 20 bp, Artificial
  CRISPR gRNA sequence
tgctgccctctcagagcctg

SEQ ID NO: 413989 - DNA, 20 bp, Artificial
  CRISPR gRNA sequence
ccctctcagagcctggcatc

SEQ ID NO: 413990 - DNA, 20 bp, Artificial
  CRISPR gRNA sequence
tcagagcctggcatcatcct

SEQ ID NO: 413991 - DNA, 20 bp, Artificial
  CRISPR gRNA sequence
agagcctggcatcatcctaa

SEQ ID NO: 413992 - DNA, 20 bp, Artificial
  CRISPR gRNA sequence
gcatcatcctaatggtgggg

SEQ ID NO: 413993 - DNA, 20 bp, Artificial
  CRISPR gRNA sequence
atggtggggtgattgacagg

SEQ ID NO: 413994 - DNA, 20 bp, Artificial
  CRISPR gRNA sequence
acaggttcgctttcccgaag

SEQ ID NO: 413995 - DNA, 20 bp, Artificial
  CRISPR gRNA sequence
gctttcccgaagagagacag

SEQ ID NO: 413996 - DNA, 20 bp, Artificial
  CRISPR gRNA sequence
tcccgaagagagacagcaat

SEQ ID NO: 413997 - DNA, 20 bp, Artificial
  CRISPR gRNA sequence
cccgaagagagacagcaatg

SEQ ID NO: 413998 - DNA, 20 bp, Artificial
  CRISPR gRNA sequence
ccgaagagagacagcaatga

SEQ ID NO: 413999 - DNA, 20 bp, Artificial
  CRISPR gRNA sequence
ggtttcatttcagtcctatt

SEQ ID NO: 414000 - DNA, 20 bp, Artificial
  CRISPR gRNA sequence
catttcagtcctattcccag

SEQ ID NO: 414001 - DNA, 20 bp, Artificial
  CRISPR gRNA sequence
atttcagtcctattcccagc

SEQ ID NO: 414002 - DNA, 20 bp, Artificial
  CRISPR gRNA sequence
cagtcctattcccagcagca

SEQ ID NO: 414003 - DNA, 20 bp, Artificial
  CRISPR gRNA sequence
agtcctattcccagcagcag

SEQ ID NO: 414004 - DNA, 20 bp, Artificial
  CRISPR gRNA sequence
ttcccagcagcagatgttga

SEQ ID NO: 414005 - DNA, 20 bp, Artificial
  CRISPR gRNA sequence
ccagcagcagatgttgatgg

SEQ ID NO: 414006 - DNA, 20 bp, Artificial
  CRISPR gRNA sequence
atgggattcttccctgtggg

SEQ ID NO: 414007 - DNA, 20 bp, Artificial
  CRISPR gRNA sequence
ttccctgtgggaggcactca

SEQ ID NO: 414008 - DNA, 20 bp, Artificial
  CRISPR gRNA sequence
ccctgtgggaggcactcaca

SEQ ID NO: 414009 - DNA, 20 bp, Artificial
  CRISPR gRNA sequence
cctgtgggaggcactcacaa

SEQ ID NO: 414010 - DNA, 20 bp, Artificial
  CRISPR gRNA sequence
tgggaggcactcacaacatg

SEQ ID NO: 414011 - DNA, 20 bp, Artificial
  CRISPR gRNA sequence
acaacatgctctgtgggttg

SEQ ID NO: 414012 - DNA, 20 bp, Artificial
  CRISPR gRNA sequence
tgtgggttgaagggtgagag

SEQ ID NO: 414013 - DNA, 20 bp, Artificial
  CRISPR gRNA sequence
tgggttgaagggtgagaggt

SEQ ID NO: 414014 - DNA, 20 bp, Artificial
  CRISPR gRNA sequence
aagggtgagaggtgtgttgt

SEQ ID NO: 414015 - DNA, 20 bp, Artificial
  CRISPR gRNA sequence
tgggcaggaggatgtaacaa

SEQ ID NO: 414016 - DNA, 20 bp, Artificial
  CRISPR gRNA sequence
tctgacctcactgggctcac

SEQ ID NO: 414017 - DNA, 20 bp, Artificial
  CRISPR gRNA sequence
tgacctcactgggctcacac

SEQ ID NO: 414018 - DNA, 20 bp, Artificial
  CRISPR gRNA sequence
acctcactgggctcacactc

SEQ ID NO: 414019 - DNA, 20 bp, Artificial
  CRISPR gRNA sequence
actgggctcacactccagag

SEQ ID NO: 414020 - DNA, 20 bp, Artificial
  CRISPR gRNA sequence
ggctcacactccagagggga

SEQ ID NO: 414021 - DNA, 20 bp, Artificial
  CRISPR gRNA sequence
acactccagaggggacattt

SEQ ID NO: 414022 - DNA, 20 bp, Artificial
  CRISPR gRNA sequence
cagaggggacatttctctaa

SEQ ID NO: 414023 - DNA, 20 bp, Artificial
  CRISPR gRNA sequence
ctctaatcgcagttgattgt

SEQ ID NO: 414024 - DNA, 20 bp, Artificial
  CRISPR gRNA sequence
tctaatcgcagttgattgtt

SEQ ID NO: 414025 - DNA, 20 bp, Artificial
  CRISPR gRNA sequence
taatcgcagttgattgttct

SEQ ID NO: 414026 - DNA, 20 bp, Artificial
  CRISPR gRNA sequence
atcgcagttgattgttcttg

SEQ ID NO: 414027 - DNA, 20 bp, Artificial
  CRISPR gRNA sequence
attgttcttgtgaatattga

SEQ ID NO: 414028 - DNA, 20 bp, Artificial
  CRISPR gRNA sequence
ttcttgtgaatattgactca

SEQ ID NO: 414029 - DNA, 20 bp, Artificial
  CRISPR gRNA sequence
ttgtgaatattgactcatga

SEQ ID NO: 414030 - DNA, 20 bp, Artificial
  CRISPR gRNA sequence
gtgaatattgactcatgaga

SEQ ID NO: 414031 - DNA, 20 bp, Artificial
  CRISPR gRNA sequence
tgaatattgactcatgagag

SEQ ID NO: 414032 - DNA, 20 bp, Artificial
  CRISPR gRNA sequence
actcatgagagtctcatcac

SEQ ID NO: 414033 - DNA, 20 bp, Artificial
  CRISPR gRNA sequence
atgagagtctcatcacaatt

SEQ ID NO: 414034 - DNA, 20 bp, Artificial
  CRISPR gRNA sequence
atcacaattctgtgatgtaa

SEQ ID NO: 414035 - DNA, 20 bp, Artificial
  CRISPR gRNA sequence
tgtgatgtaattagggctgc

SEQ ID NO: 414036 - DNA, 20 bp, Artificial
  CRISPR gRNA sequence
tgatgtaattagggctgctg

SEQ ID NO: 414037 - DNA, 20 bp, Artificial
  CRISPR gRNA sequence
gggctgctgccattgccatc

SEQ ID NO: 414038 - DNA, 20 bp, Artificial
  CRISPR gRNA sequence
ctgccattgccatcagttga

SEQ ID NO: 414039 - DNA, 20 bp, Artificial
  CRISPR gRNA sequence
ccattgccatcagttgacaa

SEQ ID NO: 414040 - DNA, 20 bp, Artificial
  CRISPR gRNA sequence
ccatcagttgacaaatgaag

SEQ ID NO: 414041 - DNA, 20 bp, Artificial
  CRISPR gRNA sequence
acaaatgaagagacacatcc

SEQ ID NO: 414042 - DNA, 20 bp, Artificial
  CRISPR gRNA sequence
gctggagtcggtcagttgaa

SEQ ID NO: 414043 - DNA, 20 bp, Artificial
  CRISPR gRNA sequence
ctggagtcggtcagttgaat

SEQ ID NO: 414044 - DNA, 20 bp, Artificial
  CRISPR gRNA sequence
gagtcggtcagttgaattgt

SEQ ID NO: 414045 - DNA, 20 bp, Artificial
  CRISPR gRNA sequence
aattgtgaaagatttaggat

SEQ ID NO: 414046 - DNA, 20 bp, Artificial
  CRISPR gRNA sequence
tgaaagatttaggatgagaa

SEQ ID NO: 414047 - DNA, 20 bp, Artificial
  CRISPR gRNA sequence
aggatgagaatttcagatta

SEQ ID NO: 414048 - DNA, 20 bp, Artificial
  CRISPR gRNA sequence
ggatgagaatttcagattac

SEQ ID NO: 414049 - DNA, 20 bp, Artificial
  CRISPR gRNA sequence
cagattactggaccatggta

SEQ ID NO: 414050 - DNA, 20 bp, Artificial
  CRISPR gRNA sequence
agattactggaccatggtaa

SEQ ID NO: 414051 - DNA, 20 bp, Artificial
  CRISPR gRNA sequence
ctggaccatggtaaactttc

SEQ ID NO: 414052 - DNA, 20 bp, Artificial
  CRISPR gRNA sequence
gaccatggtaaactttcaga

SEQ ID NO: 414053 - DNA, 20 bp, Artificial
  CRISPR gRNA sequence
tcagacattgagttggagta

SEQ ID NO: 414054 - DNA, 20 bp, Artificial
  CRISPR gRNA sequence
cagacattgagttggagtaa

SEQ ID NO: 414055 - DNA, 20 bp, Artificial
  CRISPR gRNA sequence
agacattgagttggagtaac

SEQ ID NO: 414056 - DNA, 20 bp, Artificial
  CRISPR gRNA sequence
agttggagtaacattttttt

SEQ ID NO: 414057 - DNA, 20 bp, Artificial
  CRISPR gRNA sequence
gagtaacattttttttttct

SEQ ID NO: 414058 - DNA, 20 bp, Artificial
  CRISPR gRNA sequence
tttttttctgattttttgta

SEQ ID NO: 414059 - DNA, 20 bp, Artificial
  CRISPR gRNA sequence
ttttttctgattttttgtat

SEQ ID NO: 414060 - DNA, 20 bp, Artificial
  CRISPR gRNA sequence
tttttctgattttttgtatc

SEQ ID NO: 414061 - DNA, 20 bp, Artificial
  CRISPR gRNA sequence
ttttctgattttttgtatca

SEQ ID NO: 414062 - DNA, 20 bp, Artificial
  CRISPR gRNA sequence
tttctgattttttgtatcat

SEQ ID NO: 414063 - DNA, 20 bp, Artificial
  CRISPR gRNA sequence
ttctgattttttgtatcatt

SEQ ID NO: 414064 - DNA, 20 bp, Artificial
  CRISPR gRNA sequence
tctgattttttgtatcatta

SEQ ID NO: 414065 - DNA, 20 bp, Artificial
  CRISPR gRNA sequence
ctgattttttgtatcattac

SEQ ID NO: 414066 - DNA, 20 bp, Artificial
  CRISPR gRNA sequence
tgattttttgtatcattacc

SEQ ID NO: 414067 - DNA, 20 bp, Artificial
  CRISPR gRNA sequence
attttttgtatcattaccaa

SEQ ID NO: 414068 - DNA, 20 bp, Artificial
  CRISPR gRNA sequence
tttgtatcattaccaaattg

SEQ ID NO: 414069 - DNA, 20 bp, Artificial
  CRISPR gRNA sequence
ttgtatcattaccaaattga

SEQ ID NO: 414070 - DNA, 20 bp, Artificial
  CRISPR gRNA sequence
tgtatcattaccaaattgaa

SEQ ID NO: 414071 - DNA, 20 bp, Artificial
  CRISPR gRNA sequence
gtatcattaccaaattgaat

SEQ ID NO: 414072 - DNA, 20 bp, Artificial
  CRISPR gRNA sequence
tatcattaccaaattgaata

SEQ ID NO: 414073 - DNA, 20 bp, Artificial
  CRISPR gRNA sequence
ccaaattgaatagaaaatat

SEQ ID NO: 414074 - DNA, 20 bp, Artificial
  CRISPR gRNA sequence
aatagaaaatatctattttt

SEQ ID NO: 414075 - DNA, 20 bp, Artificial
  CRISPR gRNA sequence
tttttcttaaattatactta

SEQ ID NO: 414076 - DNA, 20 bp, Artificial
  CRISPR gRNA sequence
ttcttaaattatacttataa

SEQ ID NO: 414077 - DNA, 20 bp, Artificial
  CRISPR gRNA sequence
tcttaaattatacttataaa

SEQ ID NO: 414078 - DNA, 20 bp, Artificial
  CRISPR gRNA sequence
cttaaattatacttataaac

SEQ ID NO: 414079 - DNA, 20 bp, Artificial
  CRISPR gRNA sequence
ttaaattatacttataaaca

SEQ ID NO: 414080 - DNA, 20 bp, Artificial
  CRISPR gRNA sequence
aaattatacttataaacatc

SEQ ID NO: 414081 - DNA, 20 bp, Artificial
  CRISPR gRNA sequence
aattatacttataaacatca

SEQ ID NO: 414082 - DNA, 20 bp, Artificial
  CRISPR gRNA sequence
tacttataaacatcagagtt

SEQ ID NO: 414083 - DNA, 20 bp, Artificial
  CRISPR gRNA sequence
ataaacatcagagttatatt

SEQ ID NO: 414084 - DNA, 20 bp, Artificial
  CRISPR gRNA sequence
taaacatcagagttatattc

SEQ ID NO: 414085 - DNA, 20 bp, Artificial
  CRISPR gRNA sequence
tattctgttgtatgttgaat

SEQ ID NO: 414086 - DNA, 20 bp, Artificial
  CRISPR gRNA sequence
tgttgtatgttgaatgtact

SEQ ID NO: 414087 - DNA, 20 bp, Artificial
  CRISPR gRNA sequence
ttgtatgttgaatgtactta

SEQ ID NO: 414088 - DNA, 20 bp, Artificial
  CRISPR gRNA sequence
tatgttgaatgtacttaata

SEQ ID NO: 414089 - DNA, 20 bp, Artificial
  CRISPR gRNA sequence
aatgtacttaatatatcagg

SEQ ID NO: 414090 - DNA, 20 bp, Artificial
  CRISPR gRNA sequence
aatatatcaggcataaaaga

SEQ ID NO: 414091 - DNA, 20 bp, Artificial
  CRISPR gRNA sequence
atatatcaggcataaaagat

SEQ ID NO: 414092 - DNA, 20 bp, Artificial
  CRISPR gRNA sequence
tgtttatttactattttatt

SEQ ID NO: 414093 - DNA, 20 bp, Artificial
  CRISPR gRNA sequence
gtttatttactattttattt

SEQ ID NO: 414094 - DNA, 20 bp, Artificial
  CRISPR gRNA sequence
tttatttactattttattta

SEQ ID NO: 414095 - DNA, 20 bp, Artificial
  CRISPR gRNA sequence
atttactattttatttattt

SEQ ID NO: 414096 - DNA, 20 bp, Artificial
  CRISPR gRNA sequence
tttactattttatttatttt

SEQ ID NO: 414097 - DNA, 20 bp, Artificial
  CRISPR gRNA sequence
actattttatttatttttac

SEQ ID NO: 414098 - DNA, 20 bp, Artificial
  CRISPR gRNA sequence
ctattttatttatttttaca

SEQ ID NO: 414099 - DNA, 20 bp, Artificial
  CRISPR gRNA sequence
ttttatttatttttacatag

SEQ ID NO: 414100 - DNA, 20 bp, Artificial
  CRISPR gRNA sequence
tatttatttttacatagagt

SEQ ID NO: 414101 - DNA, 20 bp, Artificial
  CRISPR gRNA sequence
atttatttttacatagagtc

SEQ ID NO: 414102 - DNA, 20 bp, Artificial
  CRISPR gRNA sequence
tttatttttacatagagtct

SEQ ID NO: 414103 - DNA, 20 bp, Artificial
  CRISPR gRNA sequence
atttttacatagagtctctc

SEQ ID NO: 414104 - DNA, 20 bp, Artificial
  CRISPR gRNA sequence
tttttacatagagtctctct

SEQ ID NO: 414105 - DNA, 20 bp, Artificial
  CRISPR gRNA sequence
ttacatagagtctctctctg

SEQ ID NO: 414106 - DNA, 20 bp, Artificial
  CRISPR gRNA sequence
tacatagagtctctctctgt

SEQ ID NO: 414107 - DNA, 20 bp, Artificial
  CRISPR gRNA sequence
acatagagtctctctctgtt

SEQ ID NO: 414108 - DNA, 20 bp, Artificial
  CRISPR gRNA sequence
catagagtctctctctgttg

SEQ ID NO: 414109 - DNA, 20 bp, Artificial
  CRISPR gRNA sequence
tctctgttgcccaggctgga

SEQ ID NO: 414110 - DNA, 20 bp, Artificial
  CRISPR gRNA sequence
tctgttgcccaggctggagt

SEQ ID NO: 414111 - DNA, 20 bp, Artificial
  CRISPR gRNA sequence
tgttgcccaggctggagtgc

SEQ ID NO: 414112 - DNA, 20 bp, Artificial
  CRISPR gRNA sequence
ttgcccaggctggagtgcag

SEQ ID NO: 414113 - DNA, 20 bp, Artificial
  CRISPR gRNA sequence
cccaggctggagtgcagtgg

SEQ ID NO: 414114 - DNA, 20 bp, Artificial
  CRISPR gRNA sequence
gagtgcagtggcaagatccg

SEQ ID NO: 414115 - DNA, 20 bp, Artificial
  CRISPR gRNA sequence
actgcaagctccgcctctgg

SEQ ID NO: 414116 - DNA, 20 bp, Artificial
  CRISPR gRNA sequence
caagctccgcctctggggtt

SEQ ID NO: 414117 - DNA, 20 bp, Artificial
  CRISPR gRNA sequence
cgcctctggggttcaaatga

SEQ ID NO: 414118 - DNA, 20 bp, Artificial
  CRISPR gRNA sequence
tggggttcaaatgagtctcg

SEQ ID NO: 414119 - DNA, 20 bp, Artificial
  CRISPR gRNA sequence
gggttcaaatgagtctcgtg

SEQ ID NO: 414120 - DNA, 20 bp, Artificial
  CRISPR gRNA sequence
aaatgagtctcgtgcctcag

SEQ ID NO: 414121 - DNA, 20 bp, Artificial
  CRISPR gRNA sequence
gtgcctcagcctaatgagta

SEQ ID NO: 414122 - DNA, 20 bp, Artificial
  CRISPR gRNA sequence
agcctaatgagtagctggga

SEQ ID NO: 414123 - DNA, 20 bp, Artificial
  CRISPR gRNA sequence
atgagtagctgggattatag

SEQ ID NO: 414124 - DNA, 20 bp, Artificial
  CRISPR gRNA sequence
ggattataggcatgcaccac

SEQ ID NO: 414125 - DNA, 20 bp, Artificial
  CRISPR gRNA sequence
taggcatgcaccaccacact

SEQ ID NO: 414126 - DNA, 20 bp, Artificial
  CRISPR gRNA sequence
ggatcactttttgtgttttt

SEQ ID NO: 414127 - DNA, 20 bp, Artificial
  CRISPR gRNA sequence
tttgtgtttttagtagagac

SEQ ID NO: 414128 - DNA, 20 bp, Artificial
  CRISPR gRNA sequence
ttgtgtttttagtagagacg

SEQ ID NO: 414129 - DNA, 20 bp, Artificial
  CRISPR gRNA sequence
tgtgtttttagtagagacgg

SEQ ID NO: 414130 - DNA, 20 bp, Artificial
  CRISPR gRNA sequence
gtgtttttagtagagacggg

SEQ ID NO: 414131 - DNA, 20 bp, Artificial
  CRISPR gRNA sequence
tgtttttagtagagacgggg

SEQ ID NO: 414132 - DNA, 20 bp, Artificial
  CRISPR gRNA sequence
ttagtagagacggggtttca

SEQ ID NO: 414133 - DNA, 20 bp, Artificial
  CRISPR gRNA sequence
tagtagagacggggtttcac

SEQ ID NO: 414134 - DNA, 20 bp, Artificial
  CRISPR gRNA sequence
agtagagacggggtttcacc

SEQ ID NO: 414135 - DNA, 20 bp, Artificial
  CRISPR gRNA sequence
gtagagacggggtttcacca

SEQ ID NO: 414136 - DNA, 20 bp, Artificial
  CRISPR gRNA sequence
caccatgttgcccatgctgg

SEQ ID NO: 414137 - DNA, 20 bp, Artificial
  CRISPR gRNA sequence
accatgttgcccatgctggt

SEQ ID NO: 414138 - DNA, 20 bp, Artificial
  CRISPR gRNA sequence
cccatgctggtcttgaactc

SEQ ID NO: 414139 - DNA, 20 bp, Artificial
  CRISPR gRNA sequence
gtcttgaactcctggcctca

SEQ ID NO: 414140 - DNA, 20 bp, Artificial
  CRISPR gRNA sequence
gaactcctggcctcaagtga

SEQ ID NO: 414141 - DNA, 20 bp, Artificial
  CRISPR gRNA sequence
aactcctggcctcaagtgat

SEQ ID NO: 414142 - DNA, 20 bp, Artificial
  CRISPR gRNA sequence
ctggcctcaagtgatcccct

SEQ ID NO: 414143 - DNA, 20 bp, Artificial
  CRISPR gRNA sequence
gcctcaagtgatcccctctc

SEQ ID NO: 414144 - DNA, 20 bp, Artificial
  CRISPR gRNA sequence
aagtgatcccctctcctaaa

SEQ ID NO: 414145 - DNA, 20 bp, Artificial
  CRISPR gRNA sequence
tcctaaacctctgtgattac

SEQ ID NO: 414146 - DNA, 20 bp, Artificial
  CRISPR gRNA sequence
ctaaacctctgtgattacag

SEQ ID NO: 414147 - DNA, 20 bp, Artificial
  CRISPR gRNA sequence
aacctctgtgattacaggcc

SEQ ID NO: 414148 - DNA, 20 bp, Artificial
  CRISPR gRNA sequence
tgtgattacaggcctgagcc

SEQ ID NO: 414149 - DNA, 20 bp, Artificial
  CRISPR gRNA sequence
tgattacaggcctgagccac

SEQ ID NO: 414150 - DNA, 20 bp, Artificial
  CRISPR gRNA sequence
caggcctgagccactacacc

SEQ ID NO: 414151 - DNA, 20 bp, Artificial
  CRISPR gRNA sequence
agccactacacctggcctat

SEQ ID NO: 414152 - DNA, 20 bp, Artificial
  CRISPR gRNA sequence
cacctggcctatttcctatt

SEQ ID NO: 414153 - DNA, 20 bp, Artificial
  CRISPR gRNA sequence
gcctatttcctattttaata

SEQ ID NO: 414154 - DNA, 20 bp, Artificial
  CRISPR gRNA sequence
tttcctattttaatagtttt

SEQ ID NO: 414155 - DNA, 20 bp, Artificial
  CRISPR gRNA sequence
cctattttaatagttttttt

SEQ ID NO: 414156 - DNA, 20 bp, Artificial
  CRISPR gRNA sequence
ctattttaatagtttttttt

SEQ ID NO: 414157 - DNA, 20 bp, Artificial
  CRISPR gRNA sequence
ttttaatagttttttttttt

SEQ ID NO: 414158 - DNA, 20 bp, Artificial
  CRISPR gRNA sequence
taatagtttttttttttcta

SEQ ID NO: 414159 - DNA, 20 bp, Artificial
  CRISPR gRNA sequence
aatagtttttttttttctac

SEQ ID NO: 414160 - DNA, 20 bp, Artificial
  CRISPR gRNA sequence
atagtttttttttttctaca

SEQ ID NO: 414161 - DNA, 20 bp, Artificial
  CRISPR gRNA sequence
ttttttttctacaaaaggtt

SEQ ID NO: 414162 - DNA, 20 bp, Artificial
  CRISPR gRNA sequence
tttttttctacaaaaggttt

SEQ ID NO: 414163 - DNA, 20 bp, Artificial
  CRISPR gRNA sequence
ttttttctacaaaaggtttt

SEQ ID NO: 414164 - DNA, 20 bp, Artificial
  CRISPR gRNA sequence
tttttctacaaaaggttttg

SEQ ID NO: 414165 - DNA, 20 bp, Artificial
  CRISPR gRNA sequence
ttttctacaaaaggttttgt

SEQ ID NO: 414166 - DNA, 20 bp, Artificial
  CRISPR gRNA sequence
tttctacaaaaggttttgtg

SEQ ID NO: 414167 - DNA, 20 bp, Artificial
  CRISPR gRNA sequence
ttctacaaaaggttttgtgt

SEQ ID NO: 414168 - DNA, 20 bp, Artificial
  CRISPR gRNA sequence
tctacaaaaggttttgtgta

SEQ ID NO: 414169 - DNA, 20 bp, Artificial
  CRISPR gRNA sequence
ctacaaaaggttttgtgtat

SEQ ID NO: 414170 - DNA, 20 bp, Artificial
  CRISPR gRNA sequence
tacaaaaggttttgtgtata

SEQ ID NO: 414171 - DNA, 20 bp, Artificial
  CRISPR gRNA sequence
caaaaggttttgtgtatatg

SEQ ID NO: 414172 - DNA, 20 bp, Artificial
  CRISPR gRNA sequence
tgtgtatatgattggcagct

SEQ ID NO: 414173 - DNA, 20 bp, Artificial
  CRISPR gRNA sequence
gtgtatatgattggcagctt

SEQ ID NO: 414174 - DNA, 20 bp, Artificial
  CRISPR gRNA sequence
tgtatatgattggcagctta

SEQ ID NO: 414175 - DNA, 20 bp, Artificial
  CRISPR gRNA sequence
gcagcttatttgaatgaggt

SEQ ID NO: 414176 - DNA, 20 bp, Artificial
  CRISPR gRNA sequence
atttgaatgaggtctttggc

SEQ ID NO: 414177 - DNA, 20 bp, Artificial
  CRISPR gRNA sequence
tttgaatgaggtctttggca

SEQ ID NO: 414178 - DNA, 20 bp, Artificial
  CRISPR gRNA sequence
gaatgaggtctttggcaaac

SEQ ID NO: 414179 - DNA, 20 bp, Artificial
  CRISPR gRNA sequence
aatgaggtctttggcaaacg

SEQ ID NO: 414180 - DNA, 20 bp, Artificial
  CRISPR gRNA sequence
tggcaaacgcatgctcttta

SEQ ID NO: 414181 - DNA, 20 bp, Artificial
  CRISPR gRNA sequence
ggcaaacgcatgctctttat

SEQ ID NO: 414182 - DNA, 20 bp, Artificial
  CRISPR gRNA sequence
gcaaacgcatgctctttata

SEQ ID NO: 414183 - DNA, 20 bp, Artificial
  CRISPR gRNA sequence
tttatattttttttttttgt

SEQ ID NO: 414184 - DNA, 20 bp, Artificial
  CRISPR gRNA sequence
tatattttttttttttgtaa

SEQ ID NO: 414185 - DNA, 20 bp, Artificial
  CRISPR gRNA sequence
atattttttttttttgtaat

SEQ ID NO: 414186 - DNA, 20 bp, Artificial
  CRISPR gRNA sequence
tattttttttttttgtaatg

SEQ ID NO: 414187 - DNA, 20 bp, Artificial
  CRISPR gRNA sequence
tttttttttgtaatgtgtaa

SEQ ID NO: 414188 - DNA, 20 bp, Artificial
  CRISPR gRNA sequence
ttttttttgtaatgtgtaaa

SEQ ID NO: 414189 - DNA, 20 bp, Artificial
  CRISPR gRNA sequence
tttttttgtaatgtgtaaaa

SEQ ID NO: 414190 - DNA, 20 bp, Artificial
  CRISPR gRNA sequence
ttttttgtaatgtgtaaaac

SEQ ID NO: 414191 - DNA, 20 bp, Artificial
  CRISPR gRNA sequence
tttttgtaatgtgtaaaact

SEQ ID NO: 414192 - DNA, 20 bp, Artificial
  CRISPR gRNA sequence
ttttgtaatgtgtaaaactc

SEQ ID NO: 414193 - DNA, 20 bp, Artificial
  CRISPR gRNA sequence
tttgtaatgtgtaaaactca

SEQ ID NO: 414194 - DNA, 20 bp, Artificial
  CRISPR gRNA sequence
ttgtaatgtgtaaaactcag

SEQ ID NO: 414195 - DNA, 20 bp, Artificial
  CRISPR gRNA sequence
tgtaatgtgtaaaactcagc

SEQ ID NO: 414196 - DNA, 20 bp, Artificial
  CRISPR gRNA sequence
gtaatgtgtaaaactcagct

SEQ ID NO: 414197 - DNA, 20 bp, Artificial
  CRISPR gRNA sequence
taatgtgtaaaactcagctt

SEQ ID NO: 414198 - DNA, 20 bp, Artificial
  CRISPR gRNA sequence
agcttaatcaaaaaacaaat

SEQ ID NO: 414199 - DNA, 20 bp, Artificial
  CRISPR gRNA sequence
aatcaaaaaacaaataaaaa

SEQ ID NO: 414200 - DNA, 20 bp, Artificial
  CRISPR gRNA sequence
atcaaaaaacaaataaaaat

SEQ ID NO: 414201 - DNA, 20 bp, Artificial
  CRISPR gRNA sequence
ttaggagttagaaatattta

SEQ ID NO: 414202 - DNA, 20 bp, Artificial
  CRISPR gRNA sequence
ggagttagaaatatttagga

SEQ ID NO: 414203 - DNA, 20 bp, Artificial
  CRISPR gRNA sequence
gaaatatttaggagactcta

SEQ ID NO: 414204 - DNA, 20 bp, Artificial
  CRISPR gRNA sequence
aggagactctaaaagaaaaa

SEQ ID NO: 414205 - DNA, 20 bp, Artificial
  CRISPR gRNA sequence
ggagactctaaaagaaaaat

SEQ ID NO: 414206 - DNA, 20 bp, Artificial
  CRISPR gRNA sequence
taaaagaaaaattctctttt

SEQ ID NO: 414207 - DNA, 20 bp, Artificial
  CRISPR gRNA sequence
aaagaaaaattctctttttc

SEQ ID NO: 414208 - DNA, 20 bp, Artificial
  CRISPR gRNA sequence
tctttttcctgtaactcatt

SEQ ID NO: 414209 - DNA, 20 bp, Artificial
  CRISPR gRNA sequence
tttttcctgtaactcattct

SEQ ID NO: 414210 - DNA, 20 bp, Artificial
  CRISPR gRNA sequence
tttcctgtaactcattctat

SEQ ID NO: 414211 - DNA, 20 bp, Artificial
  CRISPR gRNA sequence
ttcctgtaactcattctatt

SEQ ID NO: 414212 - DNA, 20 bp, Artificial
  CRISPR gRNA sequence
tcctgtaactcattctattt

SEQ ID NO: 414213 - DNA, 20 bp, Artificial
  CRISPR gRNA sequence
cctgtaactcattctatttt

SEQ ID NO: 414214 - DNA, 20 bp, Artificial
  CRISPR gRNA sequence
ctgtaactcattctattttt

SEQ ID NO: 414215 - DNA, 20 bp, Artificial
  CRISPR gRNA sequence
taactcattctatttttttt

SEQ ID NO: 414216 - DNA, 20 bp, Artificial
  CRISPR gRNA sequence
attctattttttttgttgga

SEQ ID NO: 414217 - DNA, 20 bp, Artificial
  CRISPR gRNA sequence
tattttttttgttggattct

SEQ ID NO: 414218 - DNA, 20 bp, Artificial
  CRISPR gRNA sequence
ttttttttgttggattcttt

SEQ ID NO: 414219 - DNA, 20 bp, Artificial
  CRISPR gRNA sequence
tttttgttggattctttgtt

SEQ ID NO: 414220 - DNA, 20 bp, Artificial
  CRISPR gRNA sequence
ttttgttggattctttgttt

SEQ ID NO: 414221 - DNA, 20 bp, Artificial
  CRISPR gRNA sequence
tttgttggattctttgtttt

SEQ ID NO: 414222 - DNA, 20 bp, Artificial
  CRISPR gRNA sequence
ttgttggattctttgttttt

SEQ ID NO: 414223 - DNA, 20 bp, Artificial
  CRISPR gRNA sequence
tgttggattctttgtttttg

SEQ ID NO: 414224 - DNA, 20 bp, Artificial
  CRISPR gRNA sequence
gttggattctttgtttttgt

SEQ ID NO: 414225 - DNA, 20 bp, Artificial
  CRISPR gRNA sequence
ttggattctttgtttttgtt

SEQ ID NO: 414226 - DNA, 20 bp, Artificial
  CRISPR gRNA sequence
gattctttgtttttgttact

SEQ ID NO: 414227 - DNA, 20 bp, Artificial
  CRISPR gRNA sequence
tttgtttttgttactcaata

SEQ ID NO: 414228 - DNA, 20 bp, Artificial
  CRISPR gRNA sequence
tgtttttgttactcaataat

SEQ ID NO: 414229 - DNA, 20 bp, Artificial
  CRISPR gRNA sequence
gtttttgttactcaataatt

SEQ ID NO: 414230 - DNA, 20 bp, Artificial
  CRISPR gRNA sequence
tttttgttactcaataatta

SEQ ID NO: 414231 - DNA, 20 bp, Artificial
  CRISPR gRNA sequence
ttgttactcaataattaatg

SEQ ID NO: 414232 - DNA, 20 bp, Artificial
  CRISPR gRNA sequence
tgttactcaataattaatgt

SEQ ID NO: 414233 - DNA, 20 bp, Artificial
  CRISPR gRNA sequence
gttactcaataattaatgta

SEQ ID NO: 414234 - DNA, 20 bp, Artificial
  CRISPR gRNA sequence
ttactcaataattaatgtat

SEQ ID NO: 414235 - DNA, 20 bp, Artificial
  CRISPR gRNA sequence
ctcaataattaatgtatctt

SEQ ID NO: 414236 - DNA, 20 bp, Artificial
  CRISPR gRNA sequence
aataattaatgtatcttttc

SEQ ID NO: 414237 - DNA, 20 bp, Artificial
  CRISPR gRNA sequence
atgtatcttttctttatttt

SEQ ID NO: 414238 - DNA, 20 bp, Artificial
  CRISPR gRNA sequence
ttctttattttcctgcctta

SEQ ID NO: 414239 - DNA, 20 bp, Artificial
  CRISPR gRNA sequence
tctttattttcctgccttac

SEQ ID NO: 414240 - DNA, 20 bp, Artificial
  CRISPR gRNA sequence
ctttattttcctgccttact

SEQ ID NO: 414241 - DNA, 20 bp, Artificial
  CRISPR gRNA sequence
tttattttcctgccttactt

SEQ ID NO: 414242 - DNA, 20 bp, Artificial
  CRISPR gRNA sequence
tattttcctgccttactttt

SEQ ID NO: 414243 - DNA, 20 bp, Artificial
  CRISPR gRNA sequence
attttcctgccttacttttt

SEQ ID NO: 414244 - DNA, 20 bp, Artificial
  CRISPR gRNA sequence
ttttcctgccttacttttta

SEQ ID NO: 414245 - DNA, 20 bp, Artificial
  CRISPR gRNA sequence
tcctgccttactttttactg

SEQ ID NO: 414246 - DNA, 20 bp, Artificial
  CRISPR gRNA sequence
cctgccttactttttactgc

SEQ ID NO: 414247 - DNA, 20 bp, Artificial
  CRISPR gRNA sequence
ctgccttactttttactgcc

SEQ ID NO: 414248 - DNA, 20 bp, Artificial
  CRISPR gRNA sequence
ccttactttttactgccttt

SEQ ID NO: 414249 - DNA, 20 bp, Artificial
  CRISPR gRNA sequence
actttttactgcctttggct

SEQ ID NO: 414250 - DNA, 20 bp, Artificial
  CRISPR gRNA sequence
ctttttactgcctttggctg

SEQ ID NO: 414251 - DNA, 20 bp, Artificial
  CRISPR gRNA sequence
tttactgcctttggctgaat

SEQ ID NO: 414252 - DNA, 20 bp, Artificial
  CRISPR gRNA sequence
ttactgcctttggctgaatt

SEQ ID NO: 414253 - DNA, 20 bp, Artificial
  CRISPR gRNA sequence
tactgcctttggctgaattc

SEQ ID NO: 414254 - DNA, 20 bp, Artificial
  CRISPR gRNA sequence
actgcctttggctgaattcc

SEQ ID NO: 414255 - DNA, 20 bp, Artificial
  CRISPR gRNA sequence
ctgcctttggctgaattcct

SEQ ID NO: 414256 - DNA, 20 bp, Artificial
  CRISPR gRNA sequence
cctttggctgaattcctaat

SEQ ID NO: 414257 - DNA, 20 bp, Artificial
  CRISPR gRNA sequence
tggctgaattcctaattcct

SEQ ID NO: 414258 - DNA, 20 bp, Artificial
  CRISPR gRNA sequence
ggctgaattcctaattccta

SEQ ID NO: 414259 - DNA, 20 bp, Artificial
  CRISPR gRNA sequence
gctgaattcctaattcctac

SEQ ID NO: 414260 - DNA, 20 bp, Artificial
  CRISPR gRNA sequence
aattcctaattcctacaata

SEQ ID NO: 414261 - DNA, 20 bp, Artificial
  CRISPR gRNA sequence
ctaattcctacaatattttt

SEQ ID NO: 414262 - DNA, 20 bp, Artificial
  CRISPR gRNA sequence
attcctacaatatttttttt

SEQ ID NO: 414263 - DNA, 20 bp, Artificial
  CRISPR gRNA sequence
ctacaatattttttttctct

SEQ ID NO: 414264 - DNA, 20 bp, Artificial
  CRISPR gRNA sequence
caatattttttttctctcct

SEQ ID NO: 414265 - DNA, 20 bp, Artificial
  CRISPR gRNA sequence
tttttctctcctaggtaaaa

SEQ ID NO: 414266 - DNA, 20 bp, Artificial
  CRISPR gRNA sequence
ttttctctcctaggtaaaac

SEQ ID NO: 414267 - DNA, 20 bp, Artificial
  CRISPR gRNA sequence
tttctctcctaggtaaaacc

SEQ ID NO: 414268 - DNA, 20 bp, Artificial
  CRISPR gRNA sequence
ttctctcctaggtaaaaccg

SEQ ID NO: 414269 - DNA, 20 bp, Artificial
  CRISPR gRNA sequence
tctctcctaggtaaaaccga

SEQ ID NO: 414270 - DNA, 20 bp, Artificial
  CRISPR gRNA sequence
ctctcctaggtaaaaccgat

SEQ ID NO: 414271 - DNA, 20 bp, Artificial
  CRISPR gRNA sequence
tctcctaggtaaaaccgata

SEQ ID NO: 414272 - DNA, 20 bp, Artificial
  CRISPR gRNA sequence
tcctaggtaaaaccgataac

SEQ ID NO: 414273 - DNA, 20 bp, Artificial
  CRISPR gRNA sequence
ctaggtaaaaccgataacca

SEQ ID NO: 414274 - DNA, 20 bp, Artificial
  CRISPR gRNA sequence
ggtaaaaccgataaccaata

SEQ ID NO: 414275 - DNA, 20 bp, Artificial
  CRISPR gRNA sequence
tttgtggctggagggacagt

SEQ ID NO: 414276 - DNA, 20 bp, Artificial
  CRISPR gRNA sequence
tgtggctggagggacagttt

SEQ ID NO: 414277 - DNA, 20 bp, Artificial
  CRISPR gRNA sequence
gtggctggagggacagtttt

SEQ ID NO: 414278 - DNA, 20 bp, Artificial
  CRISPR gRNA sequence
tggctggagggacagtttta

SEQ ID NO: 414279 - DNA, 20 bp, Artificial
  CRISPR gRNA sequence
gagggacagttttattgttg

SEQ ID NO: 414280 - DNA, 20 bp, Artificial
  CRISPR gRNA sequence
tattgttgttgtttgttatc

SEQ ID NO: 414281 - DNA, 20 bp, Artificial
  CRISPR gRNA sequence
attgttgttgtttgttatct

SEQ ID NO: 414282 - DNA, 20 bp, Artificial
  CRISPR gRNA sequence
ttgttgttgtttgttatctc

SEQ ID NO: 414283 - DNA, 20 bp, Artificial
  CRISPR gRNA sequence
ttgttgtttgttatctcaat

SEQ ID NO: 414284 - DNA, 20 bp, Artificial
  CRISPR gRNA sequence
ttgtttgttatctcaattac

SEQ ID NO: 414285 - DNA, 20 bp, Artificial
  CRISPR gRNA sequence
tttgttatctcaattaccac

SEQ ID NO: 414286 - DNA, 20 bp, Artificial
  CRISPR gRNA sequence
gttatctcaattaccaccat

SEQ ID NO: 414287 - DNA, 20 bp, Artificial
  CRISPR gRNA sequence
ttatctcaattaccaccatc

SEQ ID NO: 414288 - DNA, 20 bp, Artificial
  CRISPR gRNA sequence
tctcaattaccaccatcatt

SEQ ID NO: 414289 - DNA, 20 bp, Artificial
  CRISPR gRNA sequence
aattaccaccatcattgtca

SEQ ID NO: 414290 - DNA, 20 bp, Artificial
  CRISPR gRNA sequence
ccaccatcattgtcattttc

SEQ ID NO: 414291 - DNA, 20 bp, Artificial
  CRISPR gRNA sequence
tcattttccttaacaggtga

SEQ ID NO: 414292 - DNA, 20 bp, Artificial
  CRISPR gRNA sequence
tccttaacaggtgagtagtg

SEQ ID NO: 414293 - DNA, 20 bp, Artificial
  CRISPR gRNA sequence
ccttaacaggtgagtagtgc

SEQ ID NO: 414294 - DNA, 20 bp, Artificial
  CRISPR gRNA sequence
cttaacaggtgagtagtgca

SEQ ID NO: 414295 - DNA, 20 bp, Artificial
  CRISPR gRNA sequence
aacaggtgagtagtgcaact

SEQ ID NO: 414296 - DNA, 20 bp, Artificial
  CRISPR gRNA sequence
acaggtgagtagtgcaactt

SEQ ID NO: 414297 - DNA, 20 bp, Artificial
  CRISPR gRNA sequence
atgctgaatcttattcacca

SEQ ID NO: 414298 - DNA, 20 bp, Artificial
  CRISPR gRNA sequence
tgctgaatcttattcaccat

SEQ ID NO: 414299 - DNA, 20 bp, Artificial
  CRISPR gRNA sequence
aatcttattcaccatgttag

SEQ ID NO: 414300 - DNA, 20 bp, Artificial
  CRISPR gRNA sequence
attcaccatgttagaggttc

SEQ ID NO: 414301 - DNA, 20 bp, Artificial
  CRISPR gRNA sequence
ttcaccatgttagaggttct

SEQ ID NO: 414302 - DNA, 20 bp, Artificial
  CRISPR gRNA sequence
accatgttagaggttctcta

SEQ ID NO: 414303 - DNA, 20 bp, Artificial
  CRISPR gRNA sequence
gaggttctctattaataacc

SEQ ID NO: 414304 - DNA, 20 bp, Artificial
  CRISPR gRNA sequence
tctattaataacccagtaat

SEQ ID NO: 414305 - DNA, 20 bp, Artificial
  CRISPR gRNA sequence
tattaataacccagtaattt

SEQ ID NO: 414306 - DNA, 20 bp, Artificial
  CRISPR gRNA sequence
ttaataacccagtaatttgt

SEQ ID NO: 414307 - DNA, 20 bp, Artificial
  CRISPR gRNA sequence
ataacccagtaatttgtcaa

SEQ ID NO: 414308 - DNA, 20 bp, Artificial
  CRISPR gRNA sequence
gtcaagctgtctcagcattc

SEQ ID NO: 414309 - DNA, 20 bp, Artificial
  CRISPR gRNA sequence
tcaagctgtctcagcattca

SEQ ID NO: 414310 - DNA, 20 bp, Artificial
  CRISPR gRNA sequence
tctcagcattcacatatata

SEQ ID NO: 414311 - DNA, 20 bp, Artificial
  CRISPR gRNA sequence
agcattcacatatatatttt

SEQ ID NO: 414312 - DNA, 20 bp, Artificial
  CRISPR gRNA sequence
acatatatatttttgtgagt

SEQ ID NO: 414313 - DNA, 20 bp, Artificial
  CRISPR gRNA sequence
ttgtgagtactgttctaaca

SEQ ID NO: 414314 - DNA, 20 bp, Artificial
  CRISPR gRNA sequence
tgtgagtactgttctaacac

SEQ ID NO: 414315 - DNA, 20 bp, Artificial
  CRISPR gRNA sequence
gtgagtactgttctaacaca

SEQ ID NO: 414316 - DNA, 20 bp, Artificial
  CRISPR gRNA sequence
tgagtactgttctaacacaa

SEQ ID NO: 414317 - DNA, 20 bp, Artificial
  CRISPR gRNA sequence
ttctaacacaaaggaggaga

SEQ ID NO: 414318 - DNA, 20 bp, Artificial
  CRISPR gRNA sequence
taacacaaaggaggagaagt

SEQ ID NO: 414319 - DNA, 20 bp, Artificial
  CRISPR gRNA sequence
acacaaaggaggagaagtag

SEQ ID NO: 414320 - DNA, 20 bp, Artificial
  CRISPR gRNA sequence
tggtaatgttacagggagag

SEQ ID NO: 414321 - DNA, 20 bp, Artificial
  CRISPR gRNA sequence
cagggagagctggaatagtt

SEQ ID NO: 414322 - DNA, 20 bp, Artificial
  CRISPR gRNA sequence
gaatagttcatttaagaatt

SEQ ID NO: 414323 - DNA, 20 bp, Artificial
  CRISPR gRNA sequence
atttaagaattggtagaagc

SEQ ID NO: 414324 - DNA, 20 bp, Artificial
  CRISPR gRNA sequence
aagaattggtagaagctggt

SEQ ID NO: 414325 - DNA, 20 bp, Artificial
  CRISPR gRNA sequence
agaattggtagaagctggtg

SEQ ID NO: 414326 - DNA, 20 bp, Artificial
  CRISPR gRNA sequence
gtagaagctggtggtctgcc

SEQ ID NO: 414327 - DNA, 20 bp, Artificial
  CRISPR gRNA sequence
gtggtctgccccttttatat

SEQ ID NO: 414328 - DNA, 20 bp, Artificial
  CRISPR gRNA sequence
ccccttttatattctgcctg

SEQ ID NO: 414329 - DNA, 20 bp, Artificial
  CRISPR gRNA sequence
ttatattctgcctgatgcct

SEQ ID NO: 414330 - DNA, 20 bp, Artificial
  CRISPR gRNA sequence
tatattctgcctgatgcctc

SEQ ID NO: 414331 - DNA, 20 bp, Artificial
  CRISPR gRNA sequence
atattctgcctgatgcctct

SEQ ID NO: 414332 - DNA, 20 bp, Artificial
  CRISPR gRNA sequence
tattctgcctgatgcctctg

SEQ ID NO: 414333 - DNA, 20 bp, Artificial
  CRISPR gRNA sequence
tgcctgatgcctctgctctt

SEQ ID NO: 414334 - DNA, 20 bp, Artificial
  CRISPR gRNA sequence
cctgatgcctctgctcttta

SEQ ID NO: 414335 - DNA, 20 bp, Artificial
  CRISPR gRNA sequence
atgcctctgctctttatcct

SEQ ID NO: 414336 - DNA, 20 bp, Artificial
  CRISPR gRNA sequence
tgctctttatcctgccctgt

SEQ ID NO: 414337 - DNA, 20 bp, Artificial
  CRISPR gRNA sequence
ctctttatcctgccctgtct

SEQ ID NO: 414338 - DNA, 20 bp, Artificial
  CRISPR gRNA sequence
tttatcctgccctgtcttcc

SEQ ID NO: 414339 - DNA, 20 bp, Artificial
  CRISPR gRNA sequence
tatcctgccctgtcttcctc

SEQ ID NO: 414340 - DNA, 20 bp, Artificial
  CRISPR gRNA sequence
atcctgccctgtcttcctcc

SEQ ID NO: 414341 - DNA, 20 bp, Artificial
  CRISPR gRNA sequence
tcctgccctgtcttcctcct

SEQ ID NO: 414342 - DNA, 20 bp, Artificial
  CRISPR gRNA sequence
ccctgtcttcctcctccaag

SEQ ID NO: 414343 - DNA, 20 bp, Artificial
  CRISPR gRNA sequence
tcttcctcctccaaggaaaa

SEQ ID NO: 414344 - DNA, 20 bp, Artificial
  CRISPR gRNA sequence
cctcctccaaggaaaaagct

SEQ ID NO: 414345 - DNA, 20 bp, Artificial
  CRISPR gRNA sequence
ctcctccaaggaaaaagctg

SEQ ID NO: 414346 - DNA, 20 bp, Artificial
  CRISPR gRNA sequence
ctccaaggaaaaagctgaca

SEQ ID NO: 414347 - DNA, 20 bp, Artificial
  CRISPR gRNA sequence
caaggaaaaagctgacagcg

SEQ ID NO: 414348 - DNA, 20 bp, Artificial
  CRISPR gRNA sequence
acagcgagggggtggtgtgt

SEQ ID NO: 414349 - DNA, 20 bp, Artificial
  CRISPR gRNA sequence
tgagaaggggaagaacaagg

SEQ ID NO: 414350 - DNA, 20 bp, Artificial
  CRISPR gRNA sequence
agaaggggaagaacaaggtt

SEQ ID NO: 414351 - DNA, 20 bp, Artificial
  CRISPR gRNA sequence
aacagtgataaagccttcat

SEQ ID NO: 414352 - DNA, 20 bp, Artificial
  CRISPR gRNA sequence
acagtgataaagccttcatt

SEQ ID NO: 414353 - DNA, 20 bp, Artificial
  CRISPR gRNA sequence
catttattcattcatcaaat

SEQ ID NO: 414354 - DNA, 20 bp, Artificial
  CRISPR gRNA sequence
atttattcattcatcaaata

SEQ ID NO: 414355 - DNA, 20 bp, Artificial
  CRISPR gRNA sequence
attcattcatcaaatattta

SEQ ID NO: 414356 - DNA, 20 bp, Artificial
  CRISPR gRNA sequence
ttcattcatcaaatatttat

SEQ ID NO: 414357 - DNA, 20 bp, Artificial
  CRISPR gRNA sequence
attcatcaaatatttattgt

SEQ ID NO: 414358 - DNA, 20 bp, Artificial
  CRISPR gRNA sequence
atcaaatatttattgtgcac

SEQ ID NO: 414359 - DNA, 20 bp, Artificial
  CRISPR gRNA sequence
attgtgcacagcagtgaaca

SEQ ID NO: 414360 - DNA, 20 bp, Artificial
  CRISPR gRNA sequence
ttgtgcacagcagtgaacaa

SEQ ID NO: 414361 - DNA, 20 bp, Artificial
  CRISPR gRNA sequence
tgcacagcagtgaacaagac

SEQ ID NO: 414362 - DNA, 20 bp, Artificial
  CRISPR gRNA sequence
acatcccaataagcaaacag

SEQ ID NO: 414363 - DNA, 20 bp, Artificial
  CRISPR gRNA sequence
caaatagttgtatattctca

SEQ ID NO: 414364 - DNA, 20 bp, Artificial
  CRISPR gRNA sequence
aaatagttgtatattctcag

SEQ ID NO: 414365 - DNA, 20 bp, Artificial
  CRISPR gRNA sequence
tatattctcagaaccaagaa

SEQ ID NO: 414366 - DNA, 20 bp, Artificial
  CRISPR gRNA sequence
tcagaaccaagaaatctagg

SEQ ID NO: 414367 - DNA, 20 bp, Artificial
  CRISPR gRNA sequence
agaaccaagaaatctaggtg

SEQ ID NO: 414368 - DNA, 20 bp, Artificial
  CRISPR gRNA sequence
ggtgcttaaaattactgaga

SEQ ID NO: 414369 - DNA, 20 bp, Artificial
  CRISPR gRNA sequence
aaaattactgagaagaagga

SEQ ID NO: 414370 - DNA, 20 bp, Artificial
  CRISPR gRNA sequence
aaattactgagaagaaggaa

SEQ ID NO: 414371 - DNA, 20 bp, Artificial
  CRISPR gRNA sequence
ctgagaagaaggaattggag

SEQ ID NO: 414372 - DNA, 20 bp, Artificial
  CRISPR gRNA sequence
agaagaaggaattggagggt

SEQ ID NO: 414373 - DNA, 20 bp, Artificial
  CRISPR gRNA sequence
gagggtgctgccttagagac

SEQ ID NO: 414374 - DNA, 20 bp, Artificial
  CRISPR gRNA sequence
ccttagagacagcagggagc

SEQ ID NO: 414375 - DNA, 20 bp, Artificial
  CRISPR gRNA sequence
agagacagcagggagccatt

SEQ ID NO: 414376 - DNA, 20 bp, Artificial
  CRISPR gRNA sequence
gagacagcagggagccattt

SEQ ID NO: 414377 - DNA, 20 bp, Artificial
  CRISPR gRNA sequence
ggcctatactaaattttttt

SEQ ID NO: 414378 - DNA, 20 bp, Artificial
  CRISPR gRNA sequence
gcctatactaaatttttttt

SEQ ID NO: 414379 - DNA, 20 bp, Artificial
  CRISPR gRNA sequence
tactaaattttttttaatct

SEQ ID NO: 414380 - DNA, 20 bp, Artificial
  CRISPR gRNA sequence
aattttttttaatcttttat

SEQ ID NO: 414381 - DNA, 20 bp, Artificial
  CRISPR gRNA sequence
tttttaatcttttattggct

SEQ ID NO: 414382 - DNA, 20 bp, Artificial
  CRISPR gRNA sequence
ttttaatcttttattggctg

SEQ ID NO: 414383 - DNA, 20 bp, Artificial
  CRISPR gRNA sequence
tttaatcttttattggctgg

SEQ ID NO: 414384 - DNA, 20 bp, Artificial
  CRISPR gRNA sequence
ttaatcttttattggctggt

SEQ ID NO: 414385 - DNA, 20 bp, Artificial
  CRISPR gRNA sequence
taatcttttattggctggtc

SEQ ID NO: 414386 - DNA, 20 bp, Artificial
  CRISPR gRNA sequence
aatcttttattggctggtca

SEQ ID NO: 414387 - DNA, 20 bp, Artificial
  CRISPR gRNA sequence
atcttttattggctggtcac

SEQ ID NO: 414388 - DNA, 20 bp, Artificial
  CRISPR gRNA sequence
ttattggctggtcacagtga

SEQ ID NO: 414389 - DNA, 20 bp, Artificial
  CRISPR gRNA sequence
tattggctggtcacagtgat

SEQ ID NO: 414390 - DNA, 20 bp, Artificial
  CRISPR gRNA sequence
attggctggtcacagtgata

SEQ ID NO: 414391 - DNA, 20 bp, Artificial
  CRISPR gRNA sequence
ttggctggtcacagtgatat

SEQ ID NO: 414392 - DNA, 20 bp, Artificial
  CRISPR gRNA sequence
gctggtcacagtgatatgtg

SEQ ID NO: 414393 - DNA, 20 bp, Artificial
  CRISPR gRNA sequence
gtcacagtgatatgtgcctg

SEQ ID NO: 414394 - DNA, 20 bp, Artificial
  CRISPR gRNA sequence
aagttccagctactcaggag

SEQ ID NO: 414395 - DNA, 20 bp, Artificial
  CRISPR gRNA sequence
cagctactcaggaggctgag

SEQ ID NO: 414396 - DNA, 20 bp, Artificial
  CRISPR gRNA sequence
ctcaggaggctgaggctgga

SEQ ID NO: 414397 - DNA, 20 bp, Artificial
  CRISPR gRNA sequence
aggaggctgaggctggagga

SEQ ID NO: 414398 - DNA, 20 bp, Artificial
  CRISPR gRNA sequence
aggctggaggattgcttgag

SEQ ID NO: 414399 - DNA, 20 bp, Artificial
  CRISPR gRNA sequence
gaggattgcttgagtccaag

SEQ ID NO: 414400 - DNA, 20 bp, Artificial
  CRISPR gRNA sequence
cttgagtccaagagttcgag

SEQ ID NO: 414401 - DNA, 20 bp, Artificial
  CRISPR gRNA sequence
gagtccaagagttcgagtcc

SEQ ID NO: 414402 - DNA, 20 bp, Artificial
  CRISPR gRNA sequence
agtccaagagttcgagtcca

SEQ ID NO: 414403 - DNA, 20 bp, Artificial
  CRISPR gRNA sequence
gagtccagcctgggcaacat

SEQ ID NO: 414404 - DNA, 20 bp, Artificial
  CRISPR gRNA sequence
ggcaacatagcaagaccctg

SEQ ID NO: 414405 - DNA, 20 bp, Artificial
  CRISPR gRNA sequence
tcaataacaaaaattaaaaa

SEQ ID NO: 414406 - DNA, 20 bp, Artificial
  CRISPR gRNA sequence
aaaattaaaaaaacctttta

SEQ ID NO: 414407 - DNA, 20 bp, Artificial
  CRISPR gRNA sequence
aaaaaaccttttactgtatt

SEQ ID NO: 414408 - DNA, 20 bp, Artificial
  CRISPR gRNA sequence
ttactgtattgtagcacagt

SEQ ID NO: 414409 - DNA, 20 bp, Artificial
  CRISPR gRNA sequence
tactgtattgtagcacagtt

SEQ ID NO: 414410 - DNA, 20 bp, Artificial
  CRISPR gRNA sequence
actgtattgtagcacagttg

SEQ ID NO: 414411 - DNA, 20 bp, Artificial
  CRISPR gRNA sequence
ctgtattgtagcacagttgg

SEQ ID NO: 414412 - DNA, 20 bp, Artificial
  CRISPR gRNA sequence
tattgtagcacagttgggaa

SEQ ID NO: 414413 - DNA, 20 bp, Artificial
  CRISPR gRNA sequence
tagcacagttgggaattttc

SEQ ID NO: 414414 - DNA, 20 bp, Artificial
  CRISPR gRNA sequence
ggaattttctaggatattct

SEQ ID NO: 414415 - DNA, 20 bp, Artificial
  CRISPR gRNA sequence
tctaggatattcttggctga

SEQ ID NO: 414416 - DNA, 20 bp, Artificial
  CRISPR gRNA sequence
ctaggatattcttggctgag

SEQ ID NO: 414417 - DNA, 20 bp, Artificial
  CRISPR gRNA sequence
taggatattcttggctgagt

SEQ ID NO: 414418 - DNA, 20 bp, Artificial
  CRISPR gRNA sequence
ggatattcttggctgagttt

SEQ ID NO: 414419 - DNA, 20 bp, Artificial
  CRISPR gRNA sequence
ttggctgagtttttcttccc

SEQ ID NO: 414420 - DNA, 20 bp, Artificial
  CRISPR gRNA sequence
ggctgagtttttcttcccct

SEQ ID NO: 414421 - DNA, 20 bp, Artificial
  CRISPR gRNA sequence
gctgagtttttcttcccctt

SEQ ID NO: 414422 - DNA, 20 bp, Artificial
  CRISPR gRNA sequence
agtttttcttccccttctag

SEQ ID NO: 414423 - DNA, 20 bp, Artificial
  CRISPR gRNA sequence
ttcttccccttctagttctc

SEQ ID NO: 414424 - DNA, 20 bp, Artificial
  CRISPR gRNA sequence
tcttccccttctagttctcc

SEQ ID NO: 414425 - DNA, 20 bp, Artificial
  CRISPR gRNA sequence
cttccccttctagttctcct

SEQ ID NO: 414426 - DNA, 20 bp, Artificial
  CRISPR gRNA sequence
ttccccttctagttctcctg

SEQ ID NO: 414427 - DNA, 20 bp, Artificial
  CRISPR gRNA sequence
ccccttctagttctcctgtg

SEQ ID NO: 414428 - DNA, 20 bp, Artificial
  CRISPR gRNA sequence
cccttctagttctcctgtgc

SEQ ID NO: 414429 - DNA, 20 bp, Artificial
  CRISPR gRNA sequence
ctagttctcctgtgcttatc

SEQ ID NO: 414430 - DNA, 20 bp, Artificial
  CRISPR gRNA sequence
tagttctcctgtgcttatca

SEQ ID NO: 414431 - DNA, 20 bp, Artificial
  CRISPR gRNA sequence
gttctcctgtgcttatcagc

SEQ ID NO: 414432 - DNA, 20 bp, Artificial
  CRISPR gRNA sequence
tcctgtgcttatcagctcac

SEQ ID NO: 414433 - DNA, 20 bp, Artificial
  CRISPR gRNA sequence
ctgtgcttatcagctcactt

SEQ ID NO: 414434 - DNA, 20 bp, Artificial
  CRISPR gRNA sequence
tgcttatcagctcacttgtg

SEQ ID NO: 414435 - DNA, 20 bp, Artificial
  CRISPR gRNA sequence
atcagctcacttgtgtaggt

SEQ ID NO: 414436 - DNA, 20 bp, Artificial
  CRISPR gRNA sequence
tcagctcacttgtgtaggta

SEQ ID NO: 414437 - DNA, 20 bp, Artificial
  CRISPR gRNA sequence
acttgtgtaggtatttgtta

SEQ ID NO: 414438 - DNA, 20 bp, Artificial
  CRISPR gRNA sequence
gtgtaggtatttgttacata

SEQ ID NO: 414439 - DNA, 20 bp, Artificial
  CRISPR gRNA sequence
tgtaggtatttgttacatat

SEQ ID NO: 414440 - DNA, 20 bp, Artificial
  CRISPR gRNA sequence
gttacatatctgctgtaatc

SEQ ID NO: 414441 - DNA, 20 bp, Artificial
  CRISPR gRNA sequence
ttacatatctgctgtaatca

SEQ ID NO: 414442 - DNA, 20 bp, Artificial
  CRISPR gRNA sequence
catatctgctgtaatcatag

SEQ ID NO: 414443 - DNA, 20 bp, Artificial
  CRISPR gRNA sequence
ctgtaatcatagcaggttga

SEQ ID NO: 414444 - DNA, 20 bp, Artificial
  CRISPR gRNA sequence
taatcatagcaggttgaaat

SEQ ID NO: 414445 - DNA, 20 bp, Artificial
  CRISPR gRNA sequence
aaattattccttataatgta

SEQ ID NO: 414446 - DNA, 20 bp, Artificial
  CRISPR gRNA sequence
ttccttataatgtattacag

SEQ ID NO: 414447 - DNA, 20 bp, Artificial
  CRISPR gRNA sequence
cttataatgtattacagcta

SEQ ID NO: 414448 - DNA, 20 bp, Artificial
  CRISPR gRNA sequence
ataatgtattacagctaaag

SEQ ID NO: 414449 - DNA, 20 bp, Artificial
  CRISPR gRNA sequence
taatgtattacagctaaagt

SEQ ID NO: 414450 - DNA, 20 bp, Artificial
  CRISPR gRNA sequence
cagctaaagtgttatcttct

SEQ ID NO: 414451 - DNA, 20 bp, Artificial
  CRISPR gRNA sequence
aagtgttatcttcttagggg

SEQ ID NO: 414452 - DNA, 20 bp, Artificial
  CRISPR gRNA sequence
tcttcttaggggaggaaggg

SEQ ID NO: 414453 - DNA, 20 bp, Artificial
  CRISPR gRNA sequence
cttaggggaggaagggacca

SEQ ID NO: 414454 - DNA, 20 bp, Artificial
  CRISPR gRNA sequence
ttaggggaggaagggaccac

SEQ ID NO: 414455 - DNA, 20 bp, Artificial
  CRISPR gRNA sequence
aggggaggaagggaccacac

SEQ ID NO: 414456 - DNA, 20 bp, Artificial
  CRISPR gRNA sequence
ggggaggaagggaccacact

SEQ ID NO: 414457 - DNA, 20 bp, Artificial
  CRISPR gRNA sequence
ttgatgtctatatttttcat

SEQ ID NO: 414458 - DNA, 20 bp, Artificial
  CRISPR gRNA sequence
tgatgtctatatttttcatg

SEQ ID NO: 414459 - DNA, 20 bp, Artificial
  CRISPR gRNA sequence
gatgtctatatttttcatgt

SEQ ID NO: 414460 - DNA, 20 bp, Artificial
  CRISPR gRNA sequence
atgtctatatttttcatgtc

SEQ ID NO: 414461 - DNA, 20 bp, Artificial
  CRISPR gRNA sequence
tatttttcatgtctggcata

SEQ ID NO: 414462 - DNA, 20 bp, Artificial
  CRISPR gRNA sequence
ttcatgtctggcatatcata

SEQ ID NO: 414463 - DNA, 20 bp, Artificial
  CRISPR gRNA sequence
tcatgtctggcatatcatag

SEQ ID NO: 414464 - DNA, 20 bp, Artificial
  CRISPR gRNA sequence
catgtctggcatatcataga

SEQ ID NO: 414465 - DNA, 20 bp, Artificial
  CRISPR gRNA sequence
atgtctggcatatcatagat

SEQ ID NO: 414466 - DNA, 20 bp, Artificial
  CRISPR gRNA sequence
gcatatcatagatacttaat

SEQ ID NO: 414467 - DNA, 20 bp, Artificial
  CRISPR gRNA sequence
aatatatgtttgctgggtag

SEQ ID NO: 414468 - DNA, 20 bp, Artificial
  CRISPR gRNA sequence
atatatgtttgctgggtagg

SEQ ID NO: 414469 - DNA, 20 bp, Artificial
  CRISPR gRNA sequence
gctgggtaggtgaatatgtc

SEQ ID NO: 414470 - DNA, 20 bp, Artificial
  CRISPR gRNA sequence
ctgggtaggtgaatatgtcc

SEQ ID NO: 414471 - DNA, 20 bp, Artificial
  CRISPR gRNA sequence
ggtaggtgaatatgtccatc

SEQ ID NO: 414472 - DNA, 20 bp, Artificial
  CRISPR gRNA sequence
cactcctctccttcagtaat

SEQ ID NO: 414473 - DNA, 20 bp, Artificial
  CRISPR gRNA sequence
ctctccttcagtaatgttac

SEQ ID NO: 414474 - DNA, 20 bp, Artificial
  CRISPR gRNA sequence
tccttcagtaatgttaccaa

SEQ ID NO: 414475 - DNA, 20 bp, Artificial
  CRISPR gRNA sequence
cttcagtaatgttaccaaat

SEQ ID NO: 414476 - DNA, 20 bp, Artificial
  CRISPR gRNA sequence
cagtaatgttaccaaatgca

SEQ ID NO: 414477 - DNA, 20 bp, Artificial
  CRISPR gRNA sequence
agtaatgttaccaaatgcac

SEQ ID NO: 414478 - DNA, 20 bp, Artificial
  CRISPR gRNA sequence
ccaaatgcaccacacacaca

SEQ ID NO: 414479 - DNA, 20 bp, Artificial
  CRISPR gRNA sequence
gttaataggatttccagtgt

SEQ ID NO: 414480 - DNA, 20 bp, Artificial
  CRISPR gRNA sequence
ttaataggatttccagtgtc

SEQ ID NO: 414481 - DNA, 20 bp, Artificial
  CRISPR gRNA sequence
ataggatttccagtgtctct

SEQ ID NO: 414482 - DNA, 20 bp, Artificial
  CRISPR gRNA sequence
ccagtgtctctccatcttgt

SEQ ID NO: 414483 - DNA, 20 bp, Artificial
  CRISPR gRNA sequence
cagtgtctctccatcttgtc

SEQ ID NO: 414484 - DNA, 20 bp, Artificial
  CRISPR gRNA sequence
tccatcttgtctcttcatcc

SEQ ID NO: 414485 - DNA, 20 bp, Artificial
  CRISPR gRNA sequence
catcttgtctcttcatcctt

SEQ ID NO: 414486 - DNA, 20 bp, Artificial
  CRISPR gRNA sequence
gtctcttcatccttgacctc

SEQ ID NO: 414487 - DNA, 20 bp, Artificial
  CRISPR gRNA sequence
tctcttcatccttgacctct

SEQ ID NO: 414488 - DNA, 20 bp, Artificial
  CRISPR gRNA sequence
ttcatccttgacctctggct

SEQ ID NO: 414489 - DNA, 20 bp, Artificial
  CRISPR gRNA sequence
catccttgacctctggctct

SEQ ID NO: 414490 - DNA, 20 bp, Artificial
  CRISPR gRNA sequence
atccttgacctctggctctt

SEQ ID NO: 414491 - DNA, 20 bp, Artificial
  CRISPR gRNA sequence
gacctctggctctttagcag

SEQ ID NO: 414492 - DNA, 20 bp, Artificial
  CRISPR gRNA sequence
acctctggctctttagcagc

SEQ ID NO: 414493 - DNA, 20 bp, Artificial
  CRISPR gRNA sequence
tggctctttagcagctgtca

SEQ ID NO: 414494 - DNA, 20 bp, Artificial
  CRISPR gRNA sequence
gctctttagcagctgtcatc

SEQ ID NO: 414495 - DNA, 20 bp, Artificial
  CRISPR gRNA sequence
tttagcagctgtcatcactg

SEQ ID NO: 414496 - DNA, 20 bp, Artificial
  CRISPR gRNA sequence
tagcagctgtcatcactgct

SEQ ID NO: 414497 - DNA, 20 bp, Artificial
  CRISPR gRNA sequence
agcagctgtcatcactgctc

SEQ ID NO: 414498 - DNA, 20 bp, Artificial
  CRISPR gRNA sequence
gcagctgtcatcactgctcc

SEQ ID NO: 414499 - DNA, 20 bp, Artificial
  CRISPR gRNA sequence
tcatcactgctccctggttt

SEQ ID NO: 414500 - DNA, 20 bp, Artificial
  CRISPR gRNA sequence
ctccctggttttggtaacgt

SEQ ID NO: 414501 - DNA, 20 bp, Artificial
  CRISPR gRNA sequence
cctggttttggtaacgtctc

SEQ ID NO: 414502 - DNA, 20 bp, Artificial
  CRISPR gRNA sequence
gttttggtaacgtctccagc

SEQ ID NO: 414503 - DNA, 20 bp, Artificial
  CRISPR gRNA sequence
tggtaacgtctccagcctgc

SEQ ID NO: 414504 - DNA, 20 bp, Artificial
  CRISPR gRNA sequence
ggtaacgtctccagcctgct

SEQ ID NO: 414505 - DNA, 20 bp, Artificial
  CRISPR gRNA sequence
gtaacgtctccagcctgctc

SEQ ID NO: 414506 - DNA, 20 bp, Artificial
  CRISPR gRNA sequence
cagcctgctctcagctgtag

SEQ ID NO: 414507 - DNA, 20 bp, Artificial
  CRISPR gRNA sequence
ctctcagctgtagcctcttt

SEQ ID NO: 414508 - DNA, 20 bp, Artificial
  CRISPR gRNA sequence
tcagctgtagcctctttctc

SEQ ID NO: 414509 - DNA, 20 bp, Artificial
  CRISPR gRNA sequence
agctgtagcctctttctcta

SEQ ID NO: 414510 - DNA, 20 bp, Artificial
  CRISPR gRNA sequence
tagcctctttctctaaccca

SEQ ID NO: 414511 - DNA, 20 bp, Artificial
  CRISPR gRNA sequence
tttctctaacccatccagtt

SEQ ID NO: 414512 - DNA, 20 bp, Artificial
  CRISPR gRNA sequence
tctctaacccatccagtttc

SEQ ID NO: 414513 - DNA, 20 bp, Artificial
  CRISPR gRNA sequence
ctctaacccatccagtttcc

SEQ ID NO: 414514 - DNA, 20 bp, Artificial
  CRISPR gRNA sequence
tctaacccatccagtttccc

SEQ ID NO: 414515 - DNA, 20 bp, Artificial
  CRISPR gRNA sequence
taacccatccagtttccctg

SEQ ID NO: 414516 - DNA, 20 bp, Artificial
  CRISPR gRNA sequence
acccatccagtttccctggg

SEQ ID NO: 414517 - DNA, 20 bp, Artificial
  CRISPR gRNA sequence
ccctgggtcttcttctgaag

SEQ ID NO: 414518 - DNA, 20 bp, Artificial
  CRISPR gRNA sequence
cctgggtcttcttctgaagg

SEQ ID NO: 414519 - DNA, 20 bp, Artificial
  CRISPR gRNA sequence
ggtcttcttctgaaggctgg

SEQ ID NO: 414520 - DNA, 20 bp, Artificial
  CRISPR gRNA sequence
cttctgaaggctgggttggc

SEQ ID NO: 414521 - DNA, 20 bp, Artificial
  CRISPR gRNA sequence
ttctgaaggctgggttggca

SEQ ID NO: 414522 - DNA, 20 bp, Artificial
  CRISPR gRNA sequence
ctgaaggctgggttggcatg

SEQ ID NO: 414523 - DNA, 20 bp, Artificial
  CRISPR gRNA sequence
tgaaggctgggttggcatgt

SEQ ID NO: 414524 - DNA, 20 bp, Artificial
  CRISPR gRNA sequence
aaggctgggttggcatgtca

SEQ ID NO: 414525 - DNA, 20 bp, Artificial
  CRISPR gRNA sequence
ggttggcatgtcatcttcct

SEQ ID NO: 414526 - DNA, 20 bp, Artificial
  CRISPR gRNA sequence
gcatgtcatcttcctgttca

SEQ ID NO: 414527 - DNA, 20 bp, Artificial
  CRISPR gRNA sequence
cctgttcaatatctttggtt

SEQ ID NO: 414528 - DNA, 20 bp, Artificial
  CRISPR gRNA sequence
ctgttcaatatctttggtta

SEQ ID NO: 414529 - DNA, 20 bp, Artificial
  CRISPR gRNA sequence
ttcaatatctttggttatct

SEQ ID NO: 414530 - DNA, 20 bp, Artificial
  CRISPR gRNA sequence
aatatctttggttatcttcc

SEQ ID NO: 414531 - DNA, 20 bp, Artificial
  CRISPR gRNA sequence
tggttatcttcccactccta

SEQ ID NO: 414532 - DNA, 20 bp, Artificial
  CRISPR gRNA sequence
ggttatcttcccactcctac

SEQ ID NO: 414533 - DNA, 20 bp, Artificial
  CRISPR gRNA sequence
gttatcttcccactcctacc

SEQ ID NO: 414534 - DNA, 20 bp, Artificial
  CRISPR gRNA sequence
tcttcccactcctaccagaa

SEQ ID NO: 414535 - DNA, 20 bp, Artificial
  CRISPR gRNA sequence
cccactcctaccagaataat

SEQ ID NO: 414536 - DNA, 20 bp, Artificial
  CRISPR gRNA sequence
ccactcctaccagaataatg

SEQ ID NO: 414537 - DNA, 20 bp, Artificial
  CRISPR gRNA sequence
ctaccagaataatgttaaaa

SEQ ID NO: 414538 - DNA, 20 bp, Artificial
  CRISPR gRNA sequence
ccagaataatgttaaaactc

SEQ ID NO: 414539 - DNA, 20 bp, Artificial
  CRISPR gRNA sequence
aaactcattaaccctgtcat

SEQ ID NO: 414540 - DNA, 20 bp, Artificial
  CRISPR gRNA sequence
attaaccctgtcattaaccc

SEQ ID NO: 414541 - DNA, 20 bp, Artificial
  CRISPR gRNA sequence
accctgtcattaaccctgac

SEQ ID NO: 414542 - DNA, 20 bp, Artificial
  CRISPR gRNA sequence
tcattaaccctgactgaagc

SEQ ID NO: 414543 - DNA, 20 bp, Artificial
  CRISPR gRNA sequence
accctgactgaagcctaatt

SEQ ID NO: 414544 - DNA, 20 bp, Artificial
  CRISPR gRNA sequence
actgaagcctaatttttatt

SEQ ID NO: 414545 - DNA, 20 bp, Artificial
  CRISPR gRNA sequence
aagcctaatttttattcata

SEQ ID NO: 414546 - DNA, 20 bp, Artificial
  CRISPR gRNA sequence
atttttattcatactttcta

SEQ ID NO: 414547 - DNA, 20 bp, Artificial
  CRISPR gRNA sequence
ttattcatactttctacttt

SEQ ID NO: 414548 - DNA, 20 bp, Artificial
  CRISPR gRNA sequence
tattcatactttctacttta

SEQ ID NO: 414549 - DNA, 20 bp, Artificial
  CRISPR gRNA sequence
attcatactttctactttat

SEQ ID NO: 414550 - DNA, 20 bp, Artificial
  CRISPR gRNA sequence
ttcatactttctactttatt

SEQ ID NO: 414551 - DNA, 20 bp, Artificial
  CRISPR gRNA sequence
atactttctactttatttaa

SEQ ID NO: 414552 - DNA, 20 bp, Artificial
  CRISPR gRNA sequence
tctactttatttaatctccc

SEQ ID NO: 414553 - DNA, 20 bp, Artificial
  CRISPR gRNA sequence
ctactttatttaatctcccg

SEQ ID NO: 414554 - DNA, 20 bp, Artificial
  CRISPR gRNA sequence
tactttatttaatctcccgg

SEQ ID NO: 414555 - DNA, 20 bp, Artificial
  CRISPR gRNA sequence
ctttatttaatctcccggat

SEQ ID NO: 414556 - DNA, 20 bp, Artificial
  CRISPR gRNA sequence
tatttaatctcccggatgtt

SEQ ID NO: 414557 - DNA, 20 bp, Artificial
  CRISPR gRNA sequence
atttaatctcccggatgttg

SEQ ID NO: 414558 - DNA, 20 bp, Artificial
  CRISPR gRNA sequence
tttaatctcccggatgttga

SEQ ID NO: 414559 - DNA, 20 bp, Artificial
  CRISPR gRNA sequence
aatctcccggatgttgataa

SEQ ID NO: 414560 - DNA, 20 bp, Artificial
  CRISPR gRNA sequence
atctcccggatgttgataaa

SEQ ID NO: 414561 - DNA, 20 bp, Artificial
  CRISPR gRNA sequence
ccggatgttgataaattttg

SEQ ID NO: 414562 - DNA, 20 bp, Artificial
  CRISPR gRNA sequence
ataaattttgtggaaactga

SEQ ID NO: 414563 - DNA, 20 bp, Artificial
  CRISPR gRNA sequence
tgtggaaactgaagcacacc

SEQ ID NO: 414564 - DNA, 20 bp, Artificial
  CRISPR gRNA sequence
gtggaaactgaagcacaccc

SEQ ID NO: 414565 - DNA, 20 bp, Artificial
  CRISPR gRNA sequence
tggaaactgaagcacaccca

SEQ ID NO: 414566 - DNA, 20 bp, Artificial
  CRISPR gRNA sequence
aagcacacccattgctctcc

SEQ ID NO: 414567 - DNA, 20 bp, Artificial
  CRISPR gRNA sequence
ctctccccatctggtttgct

SEQ ID NO: 414568 - DNA, 20 bp, Artificial
  CRISPR gRNA sequence
tccccatctggtttgctacc

SEQ ID NO: 414569 - DNA, 20 bp, Artificial
  CRISPR gRNA sequence
cccatctggtttgctaccaa

SEQ ID NO: 414570 - DNA, 20 bp, Artificial
  CRISPR gRNA sequence
gtttgctaccaaagtgctgt

SEQ ID NO: 414571 - DNA, 20 bp, Artificial
  CRISPR gRNA sequence
gctaccaaagtgctgtttcc

SEQ ID NO: 414572 - DNA, 20 bp, Artificial
  CRISPR gRNA sequence
ctaccaaagtgctgtttccc

SEQ ID NO: 414573 - DNA, 20 bp, Artificial
  CRISPR gRNA sequence
ccaaagtgctgtttccccac

SEQ ID NO: 414574 - DNA, 20 bp, Artificial
  CRISPR gRNA sequence
tttccccacatttggctgca

SEQ ID NO: 414575 - DNA, 20 bp, Artificial
  CRISPR gRNA sequence
ccccacatttggctgcattc

SEQ ID NO: 414576 - DNA, 20 bp, Artificial
  CRISPR gRNA sequence
cccacatttggctgcattcc

SEQ ID NO: 414577 - DNA, 20 bp, Artificial
  CRISPR gRNA sequence
ggctgcattcctatgtatca

SEQ ID NO: 414578 - DNA, 20 bp, Artificial
  CRISPR gRNA sequence
gctgcattcctatgtatcat

SEQ ID NO: 414579 - DNA, 20 bp, Artificial
  CRISPR gRNA sequence
cattcctatgtatcattcaa

SEQ ID NO: 414580 - DNA, 20 bp, Artificial
  CRISPR gRNA sequence
ctatgtatcattcaaggtgt

SEQ ID NO: 414581 - DNA, 20 bp, Artificial
  CRISPR gRNA sequence
tgtatcattcaaggtgtgaa

SEQ ID NO: 414582 - DNA, 20 bp, Artificial
  CRISPR gRNA sequence
aaggtgtgaaacacctgtcc

SEQ ID NO: 414583 - DNA, 20 bp, Artificial
  CRISPR gRNA sequence
tcccctctgtgagctctgta

SEQ ID NO: 414584 - DNA, 20 bp, Artificial
  CRISPR gRNA sequence
tgtgagctctgtactgttct

SEQ ID NO: 414585 - DNA, 20 bp, Artificial
  CRISPR gRNA sequence
tgagctctgtactgttctct

SEQ ID NO: 414586 - DNA, 20 bp, Artificial
  CRISPR gRNA sequence
tgtactgttctctgtccctg

SEQ ID NO: 414587 - DNA, 20 bp, Artificial
  CRISPR gRNA sequence
tactgttctctgtccctgca

SEQ ID NO: 414588 - DNA, 20 bp, Artificial
  CRISPR gRNA sequence
ttctctgtccctgcaaatag

SEQ ID NO: 414589 - DNA, 20 bp, Artificial
  CRISPR gRNA sequence
tctgtccctgcaaatagaca

SEQ ID NO: 414590 - DNA, 20 bp, Artificial
  CRISPR gRNA sequence
tgtccctgcaaatagacatg

SEQ ID NO: 414591 - DNA, 20 bp, Artificial
  CRISPR gRNA sequence
tccctgcaaatagacatgat

SEQ ID NO: 414592 - DNA, 20 bp, Artificial
  CRISPR gRNA sequence
caaatagacatgatgtcacc

SEQ ID NO: 414593 - DNA, 20 bp, Artificial
  CRISPR gRNA sequence
gaatcattgtgtacgtctct

SEQ ID NO: 414594 - DNA, 20 bp, Artificial
  CRISPR gRNA sequence
tgtacgtctctgctactcct

SEQ ID NO: 414595 - DNA, 20 bp, Artificial
  CRISPR gRNA sequence
tgctactcctcacatcctgc

SEQ ID NO: 414596 - DNA, 20 bp, Artificial
  CRISPR gRNA sequence
ctactcctcacatcctgctt

SEQ ID NO: 414597 - DNA, 20 bp, Artificial
  CRISPR gRNA sequence
ctcctcacatcctgctttgt

SEQ ID NO: 414598 - DNA, 20 bp, Artificial
  CRISPR gRNA sequence
ctcacatcctgctttgtatt

SEQ ID NO: 414599 - DNA, 20 bp, Artificial
  CRISPR gRNA sequence
acatcctgctttgtatttta

SEQ ID NO: 414600 - DNA, 20 bp, Artificial
  CRISPR gRNA sequence
ctttgtattttaatcacttt

SEQ ID NO: 414601 - DNA, 20 bp, Artificial
  CRISPR gRNA sequence
tgtattttaatcactttcat

SEQ ID NO: 414602 - DNA, 20 bp, Artificial
  CRISPR gRNA sequence
gtattttaatcactttcatg

SEQ ID NO: 414603 - DNA, 20 bp, Artificial
  CRISPR gRNA sequence
tattttaatcactttcatgc

SEQ ID NO: 414604 - DNA, 20 bp, Artificial
  CRISPR gRNA sequence
taatcactttcatgcttgcc

SEQ ID NO: 414605 - DNA, 20 bp, Artificial
  CRISPR gRNA sequence
aatcactttcatgcttgcca

SEQ ID NO: 414606 - DNA, 20 bp, Artificial
  CRISPR gRNA sequence
atcactttcatgcttgccat

SEQ ID NO: 414607 - DNA, 20 bp, Artificial
  CRISPR gRNA sequence
tcatgcttgccatcccttct

SEQ ID NO: 414608 - DNA, 20 bp, Artificial
  CRISPR gRNA sequence
catgcttgccatcccttcta

SEQ ID NO: 414609 - DNA, 20 bp, Artificial
  CRISPR gRNA sequence
atgcttgccatcccttctat

SEQ ID NO: 414610 - DNA, 20 bp, Artificial
  CRISPR gRNA sequence
gccatcccttctattcataa

SEQ ID NO: 414611 - DNA, 20 bp, Artificial
  CRISPR gRNA sequence
ccatcccttctattcataat

SEQ ID NO: 414612 - DNA, 20 bp, Artificial
  CRISPR gRNA sequence
ctattcataatggcagagtt

SEQ ID NO: 414613 - DNA, 20 bp, Artificial
  CRISPR gRNA sequence
tattcataatggcagagttt

SEQ ID NO: 414614 - DNA, 20 bp, Artificial
  CRISPR gRNA sequence
ttcataatggcagagtttgt

SEQ ID NO: 414615 - DNA, 20 bp, Artificial
  CRISPR gRNA sequence
ataatggcagagtttgtgtt

SEQ ID NO: 414616 - DNA, 20 bp, Artificial
  CRISPR gRNA sequence
gtgtttcattcattttttag

SEQ ID NO: 414617 - DNA, 20 bp, Artificial
  CRISPR gRNA sequence
tgtttcattcattttttagc

SEQ ID NO: 414618 - DNA, 20 bp, Artificial
  CRISPR gRNA sequence
cattcattttttagcatttg

SEQ ID NO: 414619 - DNA, 20 bp, Artificial
  CRISPR gRNA sequence
attcattttttagcatttgg

SEQ ID NO: 414620 - DNA, 20 bp, Artificial
  CRISPR gRNA sequence
attttttagcatttggtagc

SEQ ID NO: 414621 - DNA, 20 bp, Artificial
  CRISPR gRNA sequence
tttagcatttggtagcattt

SEQ ID NO: 414622 - DNA, 20 bp, Artificial
  CRISPR gRNA sequence
ttagcatttggtagcattta

SEQ ID NO: 414623 - DNA, 20 bp, Artificial
  CRISPR gRNA sequence
tagcatttggtagcatttag

SEQ ID NO: 414624 - DNA, 20 bp, Artificial
  CRISPR gRNA sequence
agcatttggtagcatttagc

SEQ ID NO: 414625 - DNA, 20 bp, Artificial
  CRISPR gRNA sequence
gcatttggtagcatttagca

SEQ ID NO: 414626 - DNA, 20 bp, Artificial
  CRISPR gRNA sequence
ggtagcatttagcactaatc

SEQ ID NO: 414627 - DNA, 20 bp, Artificial
  CRISPR gRNA sequence
gtagcatttagcactaatct

SEQ ID NO: 414628 - DNA, 20 bp, Artificial
  CRISPR gRNA sequence
agcactaatctgtccaaata

SEQ ID NO: 414629 - DNA, 20 bp, Artificial
  CRISPR gRNA sequence
gcactaatctgtccaaataa

SEQ ID NO: 414630 - DNA, 20 bp, Artificial
  CRISPR gRNA sequence
atctgtccaaataatgaatg

SEQ ID NO: 414631 - DNA, 20 bp, Artificial
  CRISPR gRNA sequence
tccaaataatgaatgctcaa

SEQ ID NO: 414632 - DNA, 20 bp, Artificial
  CRISPR gRNA sequence
aataaacatttgtctaatta

SEQ ID NO: 414633 - DNA, 20 bp, Artificial
  CRISPR gRNA sequence
gtctaattaaactaaaacag

SEQ ID NO: 414634 - DNA, 20 bp, Artificial
  CRISPR gRNA sequence
tctaattaaactaaaacagg

SEQ ID NO: 414635 - DNA, 20 bp, Artificial
  CRISPR gRNA sequence
attaaactaaaacaggaggt

SEQ ID NO: 414636 - DNA, 20 bp, Artificial
  CRISPR gRNA sequence
aactaaaacaggaggtcagg

SEQ ID NO: 414637 - DNA, 20 bp, Artificial
  CRISPR gRNA sequence
aaacaggaggtcaggtcatt

SEQ ID NO: 414638 - DNA, 20 bp, Artificial
  CRISPR gRNA sequence
cacctttttccccatcacgg

SEQ ID NO: 414639 - DNA, 20 bp, Artificial
  CRISPR gRNA sequence
acctttttccccatcacgga

SEQ ID NO: 414640 - DNA, 20 bp, Artificial
  CRISPR gRNA sequence
tttccccatcacggactgcc

SEQ ID NO: 414641 - DNA, 20 bp, Artificial
  CRISPR gRNA sequence
ttccccatcacggactgccc

SEQ ID NO: 414642 - DNA, 20 bp, Artificial
  CRISPR gRNA sequence
tccccatcacggactgccct

SEQ ID NO: 414643 - DNA, 20 bp, Artificial
  CRISPR gRNA sequence
ccccatcacggactgccctt

SEQ ID NO: 414644 - DNA, 20 bp, Artificial
  CRISPR gRNA sequence
cccatcacggactgccctta

SEQ ID NO: 414645 - DNA, 20 bp, Artificial
  CRISPR gRNA sequence
cccttaagtctttccctgaa

SEQ ID NO: 414646 - DNA, 20 bp, Artificial
  CRISPR gRNA sequence
aagtctttccctgaacagaa

SEQ ID NO: 414647 - DNA, 20 bp, Artificial
  CRISPR gRNA sequence
agtctttccctgaacagaaa

SEQ ID NO: 414648 - DNA, 20 bp, Artificial
  CRISPR gRNA sequence
tccctgaacagaaattagca

SEQ ID NO: 414649 - DNA, 20 bp, Artificial
  CRISPR gRNA sequence
ccctgaacagaaattagcaa

SEQ ID NO: 414650 - DNA, 20 bp, Artificial
  CRISPR gRNA sequence
cctgaacagaaattagcaaa

SEQ ID NO: 414651 - DNA, 20 bp, Artificial
  CRISPR gRNA sequence
aacagaaattagcaaattga

SEQ ID NO: 414652 - DNA, 20 bp, Artificial
  CRISPR gRNA sequence
gcaaattgaagtaaggaacc

SEQ ID NO: 414653 - DNA, 20 bp, Artificial
  CRISPR gRNA sequence
aagtaaggaaccgaggtgtt

SEQ ID NO: 414654 - DNA, 20 bp, Artificial
  CRISPR gRNA sequence
gtagcaccacggactcttcc

SEQ ID NO: 414655 - DNA, 20 bp, Artificial
  CRISPR gRNA sequence
ttccactttttcaccttggc

SEQ ID NO: 414656 - DNA, 20 bp, Artificial
  CRISPR gRNA sequence
ccactttttcaccttggcaa

SEQ ID NO: 414657 - DNA, 20 bp, Artificial
  CRISPR gRNA sequence
cactttttcaccttggcaat

SEQ ID NO: 414658 - DNA, 20 bp, Artificial
  CRISPR gRNA sequence
tttcaccttggcaatgggaa

SEQ ID NO: 414659 - DNA, 20 bp, Artificial
  CRISPR gRNA sequence
ttcaccttggcaatgggaaa

SEQ ID NO: 414660 - DNA, 20 bp, Artificial
  CRISPR gRNA sequence
tcaccttggcaatgggaaac

SEQ ID NO: 414661 - DNA, 20 bp, Artificial
  CRISPR gRNA sequence
caccttggcaatgggaaaca

SEQ ID NO: 414662 - DNA, 20 bp, Artificial
  CRISPR gRNA sequence
accttggcaatgggaaacat

SEQ ID NO: 414663 - DNA, 20 bp, Artificial
  CRISPR gRNA sequence
ggcaatgggaaacatcctgg

SEQ ID NO: 414664 - DNA, 20 bp, Artificial
  CRISPR gRNA sequence
gcaatgggaaacatcctggg

SEQ ID NO: 414665 - DNA, 20 bp, Artificial
  CRISPR gRNA sequence
ggggcagagatggcagaggg

SEQ ID NO: 414666 - DNA, 20 bp, Artificial
  CRISPR gRNA sequence
agagacagcgagtggtgaca

SEQ ID NO: 414667 - DNA, 20 bp, Artificial
  CRISPR gRNA sequence
cacagggtcacagatgttgg

SEQ ID NO: 414668 - DNA, 20 bp, Artificial
  CRISPR gRNA sequence
gacatgatagattttgcttc

SEQ ID NO: 414669 - DNA, 20 bp, Artificial
  CRISPR gRNA sequence
tgcttcatgaaaaattttgc

SEQ ID NO: 414670 - DNA, 20 bp, Artificial
  CRISPR gRNA sequence
gcttcatgaaaaattttgct

SEQ ID NO: 414671 - DNA, 20 bp, Artificial
  CRISPR gRNA sequence
cttcatgaaaaattttgctt

SEQ ID NO: 414672 - DNA, 20 bp, Artificial
  CRISPR gRNA sequence
catgaaaaattttgcttcat

SEQ ID NO: 414673 - DNA, 20 bp, Artificial
  CRISPR gRNA sequence
atgaaaaattttgcttcatg

SEQ ID NO: 414674 - DNA, 20 bp, Artificial
  CRISPR gRNA sequence
tgcttcatgaaaatgcatta

SEQ ID NO: 414675 - DNA, 20 bp, Artificial
  CRISPR gRNA sequence
gcttcatgaaaatgcattat

SEQ ID NO: 414676 - DNA, 20 bp, Artificial
  CRISPR gRNA sequence
cttcatgaaaatgcattatg

SEQ ID NO: 414677 - DNA, 20 bp, Artificial
  CRISPR gRNA sequence
catgaaaatgcattatgcat

SEQ ID NO: 414678 - DNA, 20 bp, Artificial
  CRISPR gRNA sequence
atgaaaatgcattatgcatt

SEQ ID NO: 414679 - DNA, 20 bp, Artificial
  CRISPR gRNA sequence
tgcattacttttacatgaat

SEQ ID NO: 414680 - DNA, 20 bp, Artificial
  CRISPR gRNA sequence
cttttacatgaatagctaaa

SEQ ID NO: 414681 - DNA, 20 bp, Artificial
  CRISPR gRNA sequence
ttacatgaatagctaaattg

SEQ ID NO: 414682 - DNA, 20 bp, Artificial
  CRISPR gRNA sequence
tacatgaatagctaaattga

SEQ ID NO: 414683 - DNA, 20 bp, Artificial
  CRISPR gRNA sequence
acatgaatagctaaattgaa

SEQ ID NO: 414684 - DNA, 20 bp, Artificial
  CRISPR gRNA sequence
catgaatagctaaattgaac

SEQ ID NO: 414685 - DNA, 20 bp, Artificial
  CRISPR gRNA sequence
aattgaacggtagaatacat

SEQ ID NO: 414686 - DNA, 20 bp, Artificial
  CRISPR gRNA sequence
aacggtagaatacattgtcc

SEQ ID NO: 414687 - DNA, 20 bp, Artificial
  CRISPR gRNA sequence
tcccacttggttaaatgtga

SEQ ID NO: 414688 - DNA, 20 bp, Artificial
  CRISPR gRNA sequence
ggttaaatgtgataaaagga

SEQ ID NO: 414689 - DNA, 20 bp, Artificial
  CRISPR gRNA sequence
gttaaatgtgataaaaggag

SEQ ID NO: 414690 - DNA, 20 bp, Artificial
  CRISPR gRNA sequence
aatgtgataaaaggagatta

SEQ ID NO: 414691 - DNA, 20 bp, Artificial
  CRISPR gRNA sequence
gtggacttgaatttgtaatc

SEQ ID NO: 414692 - DNA, 20 bp, Artificial
  CRISPR gRNA sequence
gaatttgtaatcatggatgc

SEQ ID NO: 414693 - DNA, 20 bp, Artificial
  CRISPR gRNA sequence
aatttgtaatcatggatgca

SEQ ID NO: 414694 - DNA, 20 bp, Artificial
  CRISPR gRNA sequence
gtaatcatggatgcacacca

SEQ ID NO: 414695 - DNA, 20 bp, Artificial
  CRISPR gRNA sequence
taatcatggatgcacaccac

SEQ ID NO: 414696 - DNA, 20 bp, Artificial
  CRISPR gRNA sequence
gttccttctgcctcgtcact

SEQ ID NO: 414697 - DNA, 20 bp, Artificial
  CRISPR gRNA sequence
ttccttctgcctcgtcacta

SEQ ID NO: 414698 - DNA, 20 bp, Artificial
  CRISPR gRNA sequence
cttctgcctcgtcactagta

SEQ ID NO: 414699 - DNA, 20 bp, Artificial
  CRISPR gRNA sequence
ctgcctcgtcactagtatca

SEQ ID NO: 414700 - DNA, 20 bp, Artificial
  CRISPR gRNA sequence
tgcctcgtcactagtatcag

SEQ ID NO: 414701 - DNA, 20 bp, Artificial
  CRISPR gRNA sequence
cctcgtcactagtatcagtt

SEQ ID NO: 414702 - DNA, 20 bp, Artificial
  CRISPR gRNA sequence
gtcactagtatcagtttgtg

SEQ ID NO: 414703 - DNA, 20 bp, Artificial
  CRISPR gRNA sequence
gtatcagtttgtggttgtta

SEQ ID NO: 414704 - DNA, 20 bp, Artificial
  CRISPR gRNA sequence
gtggttgttacttccaatag

SEQ ID NO: 414705 - DNA, 20 bp, Artificial
  CRISPR gRNA sequence
tggttgttacttccaataga

SEQ ID NO: 414706 - DNA, 20 bp, Artificial
  CRISPR gRNA sequence
ttacttccaatagaaatgct

SEQ ID NO: 414707 - DNA, 20 bp, Artificial
  CRISPR gRNA sequence
cttccaatagaaatgcttcg

SEQ ID NO: 414708 - DNA, 20 bp, Artificial
  CRISPR gRNA sequence
ccaatagaaatgcttcgaaa

SEQ ID NO: 414709 - DNA, 20 bp, Artificial
  CRISPR gRNA sequence
caatagaaatgcttcgaaag

SEQ ID NO: 414710 - DNA, 20 bp, Artificial
  CRISPR gRNA sequence
cgaaagatgacccaagggct

SEQ ID NO: 414711 - DNA, 20 bp, Artificial
  CRISPR gRNA sequence
gaaagatgacccaagggctc

SEQ ID NO: 414712 - DNA, 20 bp, Artificial
  CRISPR gRNA sequence
caacaatgaccttctgaact

SEQ ID NO: 414713 - DNA, 20 bp, Artificial
  CRISPR gRNA sequence
ctgaactccgttttactgac

SEQ ID NO: 414714 - DNA, 20 bp, Artificial
  CRISPR gRNA sequence
tgaactccgttttactgact

SEQ ID NO: 414715 - DNA, 20 bp, Artificial
  CRISPR gRNA sequence
aactccgttttactgactgt

SEQ ID NO: 414716 - DNA, 20 bp, Artificial
  CRISPR gRNA sequence
cgttttactgactgtttaaa

SEQ ID NO: 414717 - DNA, 20 bp, Artificial
  CRISPR gRNA sequence
tactgactgtttaaaataat

SEQ ID NO: 414718 - DNA, 20 bp, Artificial
  CRISPR gRNA sequence
actgactgtttaaaataatc

SEQ ID NO: 414719 - DNA, 20 bp, Artificial
  CRISPR gRNA sequence
ctgactgtttaaaataatcc

SEQ ID NO: 414720 - DNA, 20 bp, Artificial
  CRISPR gRNA sequence
actgtttaaaataatcctgc

SEQ ID NO: 414721 - DNA, 20 bp, Artificial
  CRISPR gRNA sequence
tttaaaataatcctgcagct

SEQ ID NO: 414722 - DNA, 20 bp, Artificial
  CRISPR gRNA sequence
aaaataatcctgcagcttca

SEQ ID NO: 414723 - DNA, 20 bp, Artificial
  CRISPR gRNA sequence
aaataatcctgcagcttcag

SEQ ID NO: 414724 - DNA, 20 bp, Artificial
  CRISPR gRNA sequence
cagcttcagatgtattgact

SEQ ID NO: 414725 - DNA, 20 bp, Artificial
  CRISPR gRNA sequence
cagatgtattgacttggata

SEQ ID NO: 414726 - DNA, 20 bp, Artificial
  CRISPR gRNA sequence
agatgtattgacttggatag

SEQ ID NO: 414727 - DNA, 20 bp, Artificial
  CRISPR gRNA sequence
acttggatagaagccaacat

SEQ ID NO: 414728 - DNA, 20 bp, Artificial
  CRISPR gRNA sequence
ggatagaagccaacataaat

SEQ ID NO: 414729 - DNA, 20 bp, Artificial
  CRISPR gRNA sequence
gatagaagccaacataaatc

SEQ ID NO: 414730 - DNA, 20 bp, Artificial
  CRISPR gRNA sequence
aacaaaactgaatacttcac

SEQ ID NO: 414731 - DNA, 20 bp, Artificial
  CRISPR gRNA sequence
aatacttcacactcagtgcc

SEQ ID NO: 414732 - DNA, 20 bp, Artificial
  CRISPR gRNA sequence
cacactcagtgcctggtagc

SEQ ID NO: 414733 - DNA, 20 bp, Artificial
  CRISPR gRNA sequence
acactcagtgcctggtagcc

SEQ ID NO: 414734 - DNA, 20 bp, Artificial
  CRISPR gRNA sequence
agtgcctggtagcctgtgtg

SEQ ID NO: 414735 - DNA, 20 bp, Artificial
  CRISPR gRNA sequence
gtagcctgtgtgttggaggg

SEQ ID NO: 414736 - DNA, 20 bp, Artificial
  CRISPR gRNA sequence
tgtgttggagggattggcgg

SEQ ID NO: 414737 - DNA, 20 bp, Artificial
  CRISPR gRNA sequence
gagggattggcggcagcttc

SEQ ID NO: 414738 - DNA, 20 bp, Artificial
  CRISPR gRNA sequence
gcggcagcttctctgctcct

SEQ ID NO: 414739 - DNA, 20 bp, Artificial
  CRISPR gRNA sequence
ctctgctcctggtttgtgct

SEQ ID NO: 414740 - DNA, 20 bp, Artificial
  CRISPR gRNA sequence
tctgctcctggtttgtgctg

SEQ ID NO: 414741 - DNA, 20 bp, Artificial
  CRISPR gRNA sequence
tgctcctggtttgtgctgtt

SEQ ID NO: 414742 - DNA, 20 bp, Artificial
  CRISPR gRNA sequence
ctcctggtttgtgctgtttt

SEQ ID NO: 414743 - DNA, 20 bp, Artificial
  CRISPR gRNA sequence
ctggtttgtgctgttttcat

SEQ ID NO: 414744 - DNA, 20 bp, Artificial
  CRISPR gRNA sequence
gtttgtgctgttttcatgca

SEQ ID NO: 414745 - DNA, 20 bp, Artificial
  CRISPR gRNA sequence
gtgctgttttcatgcagaga

SEQ ID NO: 414746 - DNA, 20 bp, Artificial
  CRISPR gRNA sequence
tgctgttttcatgcagagat

SEQ ID NO: 414747 - DNA, 20 bp, Artificial
  CRISPR gRNA sequence
ttttcatgcagagatagcaa

SEQ ID NO: 414748 - DNA, 20 bp, Artificial
  CRISPR gRNA sequence
tcatgcagagatagcaacag

SEQ ID NO: 414749 - DNA, 20 bp, Artificial
  CRISPR gRNA sequence
catgcagagatagcaacagt

SEQ ID NO: 414750 - DNA, 20 bp, Artificial
  CRISPR gRNA sequence
atgcagagatagcaacagta

SEQ ID NO: 414751 - DNA, 20 bp, Artificial
  CRISPR gRNA sequence
agtgaccatggctagggaaa

SEQ ID NO: 414752 - DNA, 20 bp, Artificial
  CRISPR gRNA sequence
gggaaacagcctcacattgg

SEQ ID NO: 414753 - DNA, 20 bp, Artificial
  CRISPR gRNA sequence
acattggcaagtgtgaaagg

SEQ ID NO: 414754 - DNA, 20 bp, Artificial
  CRISPR gRNA sequence
gcaagtgtgaaaggagccaa

SEQ ID NO: 414755 - DNA, 20 bp, Artificial
  CRISPR gRNA sequence
acgcctgtaatcccagcact

SEQ ID NO: 414756 - DNA, 20 bp, Artificial
  CRISPR gRNA sequence
taatcccagcactttgggag

SEQ ID NO: 414757 - DNA, 20 bp, Artificial
  CRISPR gRNA sequence
tgggaggatgaggtgggtgg

SEQ ID NO: 414758 - DNA, 20 bp, Artificial
  CRISPR gRNA sequence
gggaggatgaggtgggtgga

SEQ ID NO: 414759 - DNA, 20 bp, Artificial
  CRISPR gRNA sequence
ggaggatgaggtgggtggat

SEQ ID NO: 414760 - DNA, 20 bp, Artificial
  CRISPR gRNA sequence
gaggtcaggagttcgagacc

SEQ ID NO: 414761 - DNA, 20 bp, Artificial
  CRISPR gRNA sequence
aggtcaggagttcgagacca

SEQ ID NO: 414762 - DNA, 20 bp, Artificial
  CRISPR gRNA sequence
gagaccagcctggccaacat

SEQ ID NO: 414763 - DNA, 20 bp, Artificial
  CRISPR gRNA sequence
gccaacatggtgaaacccca

SEQ ID NO: 414764 - DNA, 20 bp, Artificial
  CRISPR gRNA sequence
tactaaaactgcaaaaattg

SEQ ID NO: 414765 - DNA, 20 bp, Artificial
  CRISPR gRNA sequence
ctaaaactgcaaaaattggc

SEQ ID NO: 414766 - DNA, 20 bp, Artificial
  CRISPR gRNA sequence
aaactgcaaaaattggctgg

SEQ ID NO: 414767 - DNA, 20 bp, Artificial
  CRISPR gRNA sequence
caaaaattggctgggcgtgg

SEQ ID NO: 414768 - DNA, 20 bp, Artificial
  CRISPR gRNA sequence
gctgggcgtggtggtgggtg

SEQ ID NO: 414769 - DNA, 20 bp, Artificial
  CRISPR gRNA sequence
ggcgtggtggtgggtgcctg

SEQ ID NO: 414770 - DNA, 20 bp, Artificial
  CRISPR gRNA sequence
tagtctcagctactcaggag

SEQ ID NO: 414771 - DNA, 20 bp, Artificial
  CRISPR gRNA sequence
agctactcaggaggctgaga

SEQ ID NO: 414772 - DNA, 20 bp, Artificial
  CRISPR gRNA sequence
ctcaggaggctgagacagga

SEQ ID NO: 414773 - DNA, 20 bp, Artificial
  CRISPR gRNA sequence
aggaggctgagacaggagaa

SEQ ID NO: 414774 - DNA, 20 bp, Artificial
  CRISPR gRNA sequence
agacaggagaatcacttgaa

SEQ ID NO: 414775 - DNA, 20 bp, Artificial
  CRISPR gRNA sequence
gaacccgggagatggaggtt

SEQ ID NO: 414776 - DNA, 20 bp, Artificial
  CRISPR gRNA sequence
aacccgggagatggaggttg

SEQ ID NO: 414777 - DNA, 20 bp, Artificial
  CRISPR gRNA sequence
cagtgagccaagattgcacc

SEQ ID NO: 414778 - DNA, 20 bp, Artificial
  CRISPR gRNA sequence
caccactgtactccagcctg

SEQ ID NO: 414779 - DNA, 20 bp, Artificial
  CRISPR gRNA sequence
tactccagcctgggtaacag

SEQ ID NO: 414780 - DNA, 20 bp, Artificial
  CRISPR gRNA sequence
cagcctgggtaacagagtaa

SEQ ID NO: 414781 - DNA, 20 bp, Artificial
  CRISPR gRNA sequence
ggtaacagagtaagactctg

SEQ ID NO: 414782 - DNA, 20 bp, Artificial
  CRISPR gRNA sequence
tgtctcaaaaaaaaaaaaaa

SEQ ID NO: 414783 - DNA, 20 bp, Artificial
  CRISPR gRNA sequence
tctcaaaaaaaaaaaaaaaa

SEQ ID NO: 414784 - DNA, 20 bp, Artificial
  CRISPR gRNA sequence
aaaaaaaaaaaaaaaaaaaa

SEQ ID NO: 414785 - DNA, 20 bp, Artificial
  CRISPR gRNA sequence
tgttctatagatgtgcacct

SEQ ID NO: 414786 - DNA, 20 bp, Artificial
  CRISPR gRNA sequence
tatagatgtgcacctgagtg

SEQ ID NO: 414787 - DNA, 20 bp, Artificial
  CRISPR gRNA sequence
tagatgtgcacctgagtgta

SEQ ID NO: 414788 - DNA, 20 bp, Artificial
  CRISPR gRNA sequence
agtgtaggaagaaatttaat

SEQ ID NO: 414789 - DNA, 20 bp, Artificial
  CRISPR gRNA sequence
aatatttagggagaaaaatg

SEQ ID NO: 414790 - DNA, 20 bp, Artificial
  CRISPR gRNA sequence
atatttagggagaaaaatgt

SEQ ID NO: 414791 - DNA, 20 bp, Artificial
  CRISPR gRNA sequence
agggagaaaaatgttagata

SEQ ID NO: 414792 - DNA, 20 bp, Artificial
  CRISPR gRNA sequence
gggagaaaaatgttagatat

SEQ ID NO: 414793 - DNA, 20 bp, Artificial
  CRISPR gRNA sequence
gatatatatttttacattcc

SEQ ID NO: 414794 - DNA, 20 bp, Artificial
  CRISPR gRNA sequence
ttacattccttgtgaacact

SEQ ID NO: 414795 - DNA, 20 bp, Artificial
  CRISPR gRNA sequence
tacattccttgtgaacactg

SEQ ID NO: 414796 - DNA, 20 bp, Artificial
  CRISPR gRNA sequence
acattccttgtgaacactgg

SEQ ID NO: 414797 - DNA, 20 bp, Artificial
  CRISPR gRNA sequence
cattccttgtgaacactggc

SEQ ID NO: 414798 - DNA, 20 bp, Artificial
  CRISPR gRNA sequence
cttgtgaacactggcattaa

SEQ ID NO: 414799 - DNA, 20 bp, Artificial
  CRISPR gRNA sequence
gtgaacactggcattaatgg

SEQ ID NO: 414800 - DNA, 20 bp, Artificial
  CRISPR gRNA sequence
tgaacactggcattaatgga

SEQ ID NO: 414801 - DNA, 20 bp, Artificial
  CRISPR gRNA sequence
gcattaatggatagggaacc

SEQ ID NO: 414802 - DNA, 20 bp, Artificial
  CRISPR gRNA sequence
atggatagggaaccttggtt

SEQ ID NO: 414803 - DNA, 20 bp, Artificial
  CRISPR gRNA sequence
ggttttcggggctctctggg

SEQ ID NO: 414804 - DNA, 20 bp, Artificial
  CRISPR gRNA sequence
gttttcggggctctctgggt

SEQ ID NO: 414805 - DNA, 20 bp, Artificial
  CRISPR gRNA sequence
tcggggctctctgggttttg

SEQ ID NO: 414806 - DNA, 20 bp, Artificial
  CRISPR gRNA sequence
cggggctctctgggttttgg

SEQ ID NO: 414807 - DNA, 20 bp, Artificial
  CRISPR gRNA sequence
ggggctctctgggttttggc

SEQ ID NO: 414808 - DNA, 20 bp, Artificial
  CRISPR gRNA sequence
tctgggttttggcattgaaa

SEQ ID NO: 414809 - DNA, 20 bp, Artificial
  CRISPR gRNA sequence
tgggttttggcattgaaaat

SEQ ID NO: 414810 - DNA, 20 bp, Artificial
  CRISPR gRNA sequence
ggttttggcattgaaaatct

SEQ ID NO: 414811 - DNA, 20 bp, Artificial
  CRISPR gRNA sequence
tggcattgaaaatctcttgg

SEQ ID NO: 414812 - DNA, 20 bp, Artificial
  CRISPR gRNA sequence
ggcattgaaaatctcttggc

SEQ ID NO: 414813 - DNA, 20 bp, Artificial
  CRISPR gRNA sequence
gcattgaaaatctcttggct

SEQ ID NO: 414814 - DNA, 20 bp, Artificial
  CRISPR gRNA sequence
aaaatctcttggctgggtgc

SEQ ID NO: 414815 - DNA, 20 bp, Artificial
  CRISPR gRNA sequence
ttggctgggtgcgatggctc

SEQ ID NO: 414816 - DNA, 20 bp, Artificial
  CRISPR gRNA sequence
ggctgggtgcgatggctcac

SEQ ID NO: 414817 - DNA, 20 bp, Artificial
  CRISPR gRNA sequence
gctgggtgcgatggctcacg

SEQ ID NO: 414818 - DNA, 20 bp, Artificial
  CRISPR gRNA sequence
ggtgcgatggctcacgcctg

SEQ ID NO: 414819 - DNA, 20 bp, Artificial
  CRISPR gRNA sequence
acgcctgtaatcccagcact

SEQ ID NO: 414820 - DNA, 20 bp, Artificial
  CRISPR gRNA sequence
taatcccagcactttgggag

SEQ ID NO: 414821 - DNA, 20 bp, Artificial
  CRISPR gRNA sequence
tgggaggccgaggtgggcag

SEQ ID NO: 414822 - DNA, 20 bp, Artificial
  CRISPR gRNA sequence
gggaggccgaggtgggcaga

SEQ ID NO: 414823 - DNA, 20 bp, Artificial
  CRISPR gRNA sequence
ggaggccgaggtgggcagat

SEQ ID NO: 414824 - DNA, 20 bp, Artificial
  CRISPR gRNA sequence
aagaccagcctgaccaacat

SEQ ID NO: 414825 - DNA, 20 bp, Artificial
  CRISPR gRNA sequence
accaacatggtgaaacccca

SEQ ID NO: 414826 - DNA, 20 bp, Artificial
  CRISPR gRNA sequence
tactaaaaataaaaaaaaaa

SEQ ID NO: 414827 - DNA, 20 bp, Artificial
  CRISPR gRNA sequence
ctaaaaataaaaaaaaaatt

SEQ ID NO: 414828 - DNA, 20 bp, Artificial
  CRISPR gRNA sequence
aaaataaaaaaaaaattagc

SEQ ID NO: 414829 - DNA, 20 bp, Artificial
  CRISPR gRNA sequence
gccaggcatggtggcgggcg

SEQ ID NO: 414830 - DNA, 20 bp, Artificial
  CRISPR gRNA sequence
taatcccagctactcaggag

SEQ ID NO: 414831 - DNA, 20 bp, Artificial
  CRISPR gRNA sequence
ctcaggaggctgaggcagga

SEQ ID NO: 414832 - DNA, 20 bp, Artificial
  CRISPR gRNA sequence
aggaggctgaggcaggagaa

SEQ ID NO: 414833 - DNA, 20 bp, Artificial
  CRISPR gRNA sequence
aggcaggagaatcacttgaa

SEQ ID NO: 414834 - DNA, 20 bp, Artificial
  CRISPR gRNA sequence
gaacccgggaggcggaggtt

SEQ ID NO: 414835 - DNA, 20 bp, Artificial
  CRISPR gRNA sequence
aacccgggaggcggaggttg

SEQ ID NO: 414836 - DNA, 20 bp, Artificial
  CRISPR gRNA sequence
cagtgagctgagattgcagc

SEQ ID NO: 414837 - DNA, 20 bp, Artificial
  CRISPR gRNA sequence
agattgcagcattgcatccc

SEQ ID NO: 414838 - DNA, 20 bp, Artificial
  CRISPR gRNA sequence
cagcattgcatcccagcctg

SEQ ID NO: 414839 - DNA, 20 bp, Artificial
  CRISPR gRNA sequence
catcccagcctgggtgacag

SEQ ID NO: 414840 - DNA, 20 bp, Artificial
  CRISPR gRNA sequence
ggtgacagagcgagactcca

SEQ ID NO: 414841 - DNA, 20 bp, Artificial
  CRISPR gRNA sequence
catctcaaaaaaaaaaaaaa

SEQ ID NO: 414842 - DNA, 20 bp, Artificial
  CRISPR gRNA sequence
aaaaaaaaaaaaaaaaaaag

SEQ ID NO: 414843 - DNA, 20 bp, Artificial
  CRISPR gRNA sequence
tcatcctgggaaactcctta

SEQ ID NO: 414844 - DNA, 20 bp, Artificial
  CRISPR gRNA sequence
atcctgggaaactccttagt

SEQ ID NO: 414845 - DNA, 20 bp, Artificial
  CRISPR gRNA sequence
ggaaactccttagtcccagg

SEQ ID NO: 414846 - DNA, 20 bp, Artificial
  CRISPR gRNA sequence
cttagtcccaggcaaaccag

SEQ ID NO: 414847 - DNA, 20 bp, Artificial
  CRISPR gRNA sequence
agtcccaggcaaaccagaat

SEQ ID NO: 414848 - DNA, 20 bp, Artificial
  CRISPR gRNA sequence
gtcccaggcaaaccagaatg

SEQ ID NO: 414849 - DNA, 20 bp, Artificial
  CRISPR gRNA sequence
gtcaacgtaaatccaattgt

SEQ ID NO: 414850 - DNA, 20 bp, Artificial
  CRISPR gRNA sequence
tgatatgtttactctcttta

SEQ ID NO: 414851 - DNA, 20 bp, Artificial
  CRISPR gRNA sequence
actctctttatttttttatt

SEQ ID NO: 414852 - DNA, 20 bp, Artificial
  CRISPR gRNA sequence
ctctctttatttttttattt

SEQ ID NO: 414853 - DNA, 20 bp, Artificial
  CRISPR gRNA sequence
tctttatttttttattttca

SEQ ID NO: 414854 - DNA, 20 bp, Artificial
  CRISPR gRNA sequence
tttatttttttattttcatt

SEQ ID NO: 414855 - DNA, 20 bp, Artificial
  CRISPR gRNA sequence
tatttttttattttcatttt

SEQ ID NO: 414856 - DNA, 20 bp, Artificial
  CRISPR gRNA sequence
atttttttattttcattttt

SEQ ID NO: 414857 - DNA, 20 bp, Artificial
  CRISPR gRNA sequence
tttttttattttcattttta

SEQ ID NO: 414858 - DNA, 20 bp, Artificial
  CRISPR gRNA sequence
ttttattttcatttttattt

SEQ ID NO: 414859 - DNA, 20 bp, Artificial
  CRISPR gRNA sequence
tttattttcatttttatttt

SEQ ID NO: 414860 - DNA, 20 bp, Artificial
  CRISPR gRNA sequence
ttattttcatttttattttc

SEQ ID NO: 414861 - DNA, 20 bp, Artificial
  CRISPR gRNA sequence
tattttcatttttattttct

SEQ ID NO: 414862 - DNA, 20 bp, Artificial
  CRISPR gRNA sequence
attttcatttttattttctt

SEQ ID NO: 414863 - DNA, 20 bp, Artificial
  CRISPR gRNA sequence
ttttcatttttattttctta

SEQ ID NO: 414864 - DNA, 20 bp, Artificial
  CRISPR gRNA sequence
tcatttttattttcttaaca

SEQ ID NO: 414865 - DNA, 20 bp, Artificial
  CRISPR gRNA sequence
catttttattttcttaacat

SEQ ID NO: 414866 - DNA, 20 bp, Artificial
  CRISPR gRNA sequence
atttttattttcttaacatt

SEQ ID NO: 414867 - DNA, 20 bp, Artificial
  CRISPR gRNA sequence
ttattttcttaacatttatt

SEQ ID NO: 414868 - DNA, 20 bp, Artificial
  CRISPR gRNA sequence
tattttcttaacatttattt

SEQ ID NO: 414869 - DNA, 20 bp, Artificial
  CRISPR gRNA sequence
attttcttaacatttatttt

SEQ ID NO: 414870 - DNA, 20 bp, Artificial
  CRISPR gRNA sequence
ttttcttaacatttatttta

SEQ ID NO: 414871 - DNA, 20 bp, Artificial
  CRISPR gRNA sequence
tcttaacatttattttaagt

SEQ ID NO: 414872 - DNA, 20 bp, Artificial
  CRISPR gRNA sequence
cttaacatttattttaagtt

SEQ ID NO: 414873 - DNA, 20 bp, Artificial
  CRISPR gRNA sequence
ttaacatttattttaagttc

SEQ ID NO: 414874 - DNA, 20 bp, Artificial
  CRISPR gRNA sequence
aacatttattttaagttcag

SEQ ID NO: 414875 - DNA, 20 bp, Artificial
  CRISPR gRNA sequence
acatttattttaagttcagg

SEQ ID NO: 414876 - DNA, 20 bp, Artificial
  CRISPR gRNA sequence
attttaagttcagggataca

SEQ ID NO: 414877 - DNA, 20 bp, Artificial
  CRISPR gRNA sequence
ttttaagttcagggatacat

SEQ ID NO: 414878 - DNA, 20 bp, Artificial
  CRISPR gRNA sequence
taagttcagggatacatgtg

SEQ ID NO: 414879 - DNA, 20 bp, Artificial
  CRISPR gRNA sequence
aagttcagggatacatgtgc

SEQ ID NO: 414880 - DNA, 20 bp, Artificial
  CRISPR gRNA sequence
agttcagggatacatgtgca

SEQ ID NO: 414881 - DNA, 20 bp, Artificial
  CRISPR gRNA sequence
agggatacatgtgcaggatg

SEQ ID NO: 414882 - DNA, 20 bp, Artificial
  CRISPR gRNA sequence
gttacataggcaaacatgtg

SEQ ID NO: 414883 - DNA, 20 bp, Artificial
  CRISPR gRNA sequence
ttacataggcaaacatgtgt

SEQ ID NO: 414884 - DNA, 20 bp, Artificial
  CRISPR gRNA sequence
cataggcaaacatgtgtcat

SEQ ID NO: 414885 - DNA, 20 bp, Artificial
  CRISPR gRNA sequence
gttgtatagcatattgcatc

SEQ ID NO: 414886 - DNA, 20 bp, Artificial
  CRISPR gRNA sequence
ttgtatagcatattgcatca

SEQ ID NO: 414887 - DNA, 20 bp, Artificial
  CRISPR gRNA sequence
tatagcatattgcatcaccc

SEQ ID NO: 414888 - DNA, 20 bp, Artificial
  CRISPR gRNA sequence
catcacccaggtattaagcc

SEQ ID NO: 414889 - DNA, 20 bp, Artificial
  CRISPR gRNA sequence
agccttatacccaatagtta

SEQ ID NO: 414890 - DNA, 20 bp, Artificial
  CRISPR gRNA sequence
atacccaatagttatttttc

SEQ ID NO: 414891 - DNA, 20 bp, Artificial
  CRISPR gRNA sequence
tacccaatagttatttttcc

SEQ ID NO: 414892 - DNA, 20 bp, Artificial
  CRISPR gRNA sequence
tttttcctgatcctctccct

SEQ ID NO: 414893 - DNA, 20 bp, Artificial
  CRISPR gRNA sequence
ttcctgatcctctcccttct

SEQ ID NO: 414894 - DNA, 20 bp, Artificial
  CRISPR gRNA sequence
tcctgatcctctcccttctc

SEQ ID NO: 414895 - DNA, 20 bp, Artificial
  CRISPR gRNA sequence
cctgatcctctcccttctcc

SEQ ID NO: 414896 - DNA, 20 bp, Artificial
  CRISPR gRNA sequence
ctgatcctctcccttctccc

SEQ ID NO: 414897 - DNA, 20 bp, Artificial
  CRISPR gRNA sequence
atcctctcccttctcccacc

SEQ ID NO: 414898 - DNA, 20 bp, Artificial
  CRISPR gRNA sequence
tcccttctcccaccctctgc

SEQ ID NO: 414899 - DNA, 20 bp, Artificial
  CRISPR gRNA sequence
ccttctcccaccctctgccc

SEQ ID NO: 414900 - DNA, 20 bp, Artificial
  CRISPR gRNA sequence
ctcccaccctctgccctcca

SEQ ID NO: 414901 - DNA, 20 bp, Artificial
  CRISPR gRNA sequence
tcccaccctctgccctccag

SEQ ID NO: 414902 - DNA, 20 bp, Artificial
  CRISPR gRNA sequence
ccaccctctgccctccagta

SEQ ID NO: 414903 - DNA, 20 bp, Artificial
  CRISPR gRNA sequence
tgccctccagtaggctccag

SEQ ID NO: 414904 - DNA, 20 bp, Artificial
  CRISPR gRNA sequence
ccctccagtaggctccagtg

SEQ ID NO: 414905 - DNA, 20 bp, Artificial
  CRISPR gRNA sequence
cagtaggctccagtgtgtgt

SEQ ID NO: 414906 - DNA, 20 bp, Artificial
  CRISPR gRNA sequence
cagtgtgtgttgttcccgtc

SEQ ID NO: 414907 - DNA, 20 bp, Artificial
  CRISPR gRNA sequence
ttcccgtctatgtgtccatg

SEQ ID NO: 414908 - DNA, 20 bp, Artificial
  CRISPR gRNA sequence
ccgtctatgtgtccatgtgt

SEQ ID NO: 414909 - DNA, 20 bp, Artificial
  CRISPR gRNA sequence
tgtgtccatgtgttctcatc

SEQ ID NO: 414910 - DNA, 20 bp, Artificial
  CRISPR gRNA sequence
tcatcatttagctcccactt

SEQ ID NO: 414911 - DNA, 20 bp, Artificial
  CRISPR gRNA sequence
atcatttagctcccacttat

SEQ ID NO: 414912 - DNA, 20 bp, Artificial
  CRISPR gRNA sequence
agctcccacttataggtgag

SEQ ID NO: 414913 - DNA, 20 bp, Artificial
  CRISPR gRNA sequence
gctcccacttataggtgaga

SEQ ID NO: 414914 - DNA, 20 bp, Artificial
  CRISPR gRNA sequence
ccacttataggtgagaacat

SEQ ID NO: 414915 - DNA, 20 bp, Artificial
  CRISPR gRNA sequence
ataggtgagaacatgtggta

SEQ ID NO: 414916 - DNA, 20 bp, Artificial
  CRISPR gRNA sequence
taggtgagaacatgtggtat

SEQ ID NO: 414917 - DNA, 20 bp, Artificial
  CRISPR gRNA sequence
ggttttctgttcctgcatga

SEQ ID NO: 414918 - DNA, 20 bp, Artificial
  CRISPR gRNA sequence
gttttctgttcctgcatgag

SEQ ID NO: 414919 - DNA, 20 bp, Artificial
  CRISPR gRNA sequence
tctgttcctgcatgagtttg

SEQ ID NO: 414920 - DNA, 20 bp, Artificial
  CRISPR gRNA sequence
ctgttcctgcatgagtttgc

SEQ ID NO: 414921 - DNA, 20 bp, Artificial
  CRISPR gRNA sequence
tgttcctgcatgagtttgct

SEQ ID NO: 414922 - DNA, 20 bp, Artificial
  CRISPR gRNA sequence
ttcctgcatgagtttgctaa

SEQ ID NO: 414923 - DNA, 20 bp, Artificial
  CRISPR gRNA sequence
ctgcatgagtttgctaagga

SEQ ID NO: 414924 - DNA, 20 bp, Artificial
  CRISPR gRNA sequence
catgagtttgctaaggataa

SEQ ID NO: 414925 - DNA, 20 bp, Artificial
  CRISPR gRNA sequence
gctaaggataatggcctcca

SEQ ID NO: 414926 - DNA, 20 bp, Artificial
  CRISPR gRNA sequence
ctaaggataatggcctccag

SEQ ID NO: 414927 - DNA, 20 bp, Artificial
  CRISPR gRNA sequence
aggataatggcctccagctc

SEQ ID NO: 414928 - DNA, 20 bp, Artificial
  CRISPR gRNA sequence
cagctctatccgtgtccctg

SEQ ID NO: 414929 - DNA, 20 bp, Artificial
  CRISPR gRNA sequence
tatccgtgtccctgcaaagg

SEQ ID NO: 414930 - DNA, 20 bp, Artificial
  CRISPR gRNA sequence
tccgtgtccctgcaaaggac

SEQ ID NO: 414931 - DNA, 20 bp, Artificial
  CRISPR gRNA sequence
caaaggacatgatctcattt

SEQ ID NO: 414932 - DNA, 20 bp, Artificial
  CRISPR gRNA sequence
atttctttctgtggctgtat

SEQ ID NO: 414933 - DNA, 20 bp, Artificial
  CRISPR gRNA sequence
ctttctgtggctgtatagtg

SEQ ID NO: 414934 - DNA, 20 bp, Artificial
  CRISPR gRNA sequence
tttctgtggctgtatagtgt

SEQ ID NO: 414935 - DNA, 20 bp, Artificial
  CRISPR gRNA sequence
tctgtggctgtatagtgttc

SEQ ID NO: 414936 - DNA, 20 bp, Artificial
  CRISPR gRNA sequence
ctgtggctgtatagtgttct

SEQ ID NO: 414937 - DNA, 20 bp, Artificial
  CRISPR gRNA sequence
tgtggctgtatagtgttcta

SEQ ID NO: 414938 - DNA, 20 bp, Artificial
  CRISPR gRNA sequence
tggctgtatagtgttctatg

SEQ ID NO: 414939 - DNA, 20 bp, Artificial
  CRISPR gRNA sequence
tatagtgttctatggtatat

SEQ ID NO: 414940 - DNA, 20 bp, Artificial
  CRISPR gRNA sequence
tatggtatatgtgtaccaca

SEQ ID NO: 414941 - DNA, 20 bp, Artificial
  CRISPR gRNA sequence
tggtatatgtgtaccacatt

SEQ ID NO: 414942 - DNA, 20 bp, Artificial
  CRISPR gRNA sequence
tctttatccagtctatcatt

SEQ ID NO: 414943 - DNA, 20 bp, Artificial
  CRISPR gRNA sequence
ctttatccagtctatcattg

SEQ ID NO: 414944 - DNA, 20 bp, Artificial
  CRISPR gRNA sequence
tttatccagtctatcattga

SEQ ID NO: 414945 - DNA, 20 bp, Artificial
  CRISPR gRNA sequence
tatccagtctatcattgacg

SEQ ID NO: 414946 - DNA, 20 bp, Artificial
  CRISPR gRNA sequence
atccagtctatcattgacgg

SEQ ID NO: 414947 - DNA, 20 bp, Artificial
  CRISPR gRNA sequence
tccagtctatcattgacggg

SEQ ID NO: 414948 - DNA, 20 bp, Artificial
  CRISPR gRNA sequence
tcattgacgggtattgaggt

SEQ ID NO: 414949 - DNA, 20 bp, Artificial
  CRISPR gRNA sequence
acgggtattgaggttgattc

SEQ ID NO: 414950 - DNA, 20 bp, Artificial
  CRISPR gRNA sequence
aggttgattccatgtctttg

SEQ ID NO: 414951 - DNA, 20 bp, Artificial
  CRISPR gRNA sequence
attccatgtctttgctatca

SEQ ID NO: 414952 - DNA, 20 bp, Artificial
  CRISPR gRNA sequence
catgtctttgctatcatgaa

SEQ ID NO: 414953 - DNA, 20 bp, Artificial
  CRISPR gRNA sequence
tgctatcatgaatagtgctg

SEQ ID NO: 414954 - DNA, 20 bp, Artificial
  CRISPR gRNA sequence
gctatcatgaatagtgctgc

SEQ ID NO: 414955 - DNA, 20 bp, Artificial
  CRISPR gRNA sequence
ctatcatgaatagtgctgca

SEQ ID NO: 414956 - DNA, 20 bp, Artificial
  CRISPR gRNA sequence
tcatgaatagtgctgcaatg

SEQ ID NO: 414957 - DNA, 20 bp, Artificial
  CRISPR gRNA sequence
caatgaacacatgcttgcat

SEQ ID NO: 414958 - DNA, 20 bp, Artificial
  CRISPR gRNA sequence
gcatgtgtcttatagtagaa

SEQ ID NO: 414959 - DNA, 20 bp, Artificial
  CRISPR gRNA sequence
catgtgtcttatagtagaat

SEQ ID NO: 414960 - DNA, 20 bp, Artificial
  CRISPR gRNA sequence
atagtagaatgatttatatt

SEQ ID NO: 414961 - DNA, 20 bp, Artificial
  CRISPR gRNA sequence
tagtagaatgatttatattc

SEQ ID NO: 414962 - DNA, 20 bp, Artificial
  CRISPR gRNA sequence
atattcctttgggcatatac

SEQ ID NO: 414963 - DNA, 20 bp, Artificial
  CRISPR gRNA sequence
tattcctttgggcatatacc

SEQ ID NO: 414964 - DNA, 20 bp, Artificial
  CRISPR gRNA sequence
ctttgggcatatacccagta

SEQ ID NO: 414965 - DNA, 20 bp, Artificial
  CRISPR gRNA sequence
tgggcatatacccagtaatg

SEQ ID NO: 414966 - DNA, 20 bp, Artificial
  CRISPR gRNA sequence
gggcatatacccagtaatgg

SEQ ID NO: 414967 - DNA, 20 bp, Artificial
  CRISPR gRNA sequence
ggcatatacccagtaatggc

SEQ ID NO: 414968 - DNA, 20 bp, Artificial
  CRISPR gRNA sequence
ctgggtcaaatggtatttct

SEQ ID NO: 414969 - DNA, 20 bp, Artificial
  CRISPR gRNA sequence
ggtcaaatggtatttctgtc

SEQ ID NO: 414970 - DNA, 20 bp, Artificial
  CRISPR gRNA sequence
ctgtctgtaagtttttgagg

SEQ ID NO: 414971 - DNA, 20 bp, Artificial
  CRISPR gRNA sequence
tgtctgtaagtttttgagga

SEQ ID NO: 414972 - DNA, 20 bp, Artificial
  CRISPR gRNA sequence
tctgtaagtttttgaggaat

SEQ ID NO: 414973 - DNA, 20 bp, Artificial
  CRISPR gRNA sequence
taagtttttgaggaatcacc

SEQ ID NO: 414974 - DNA, 20 bp, Artificial
  CRISPR gRNA sequence
ttgaggaatcaccacactgt

SEQ ID NO: 414975 - DNA, 20 bp, Artificial
  CRISPR gRNA sequence
tgaggaatcaccacactgtc

SEQ ID NO: 414976 - DNA, 20 bp, Artificial
  CRISPR gRNA sequence
gaggaatcaccacactgtct

SEQ ID NO: 414977 - DNA, 20 bp, Artificial
  CRISPR gRNA sequence
aggaatcaccacactgtctt

SEQ ID NO: 414978 - DNA, 20 bp, Artificial
  CRISPR gRNA sequence
tcttccacaatgcctgaact

SEQ ID NO: 414979 - DNA, 20 bp, Artificial
  CRISPR gRNA sequence
ccacaatgcctgaactaatt

SEQ ID NO: 414980 - DNA, 20 bp, Artificial
  CRISPR gRNA sequence
cacaatgcctgaactaattt

SEQ ID NO: 414981 - DNA, 20 bp, Artificial
  CRISPR gRNA sequence
aactaatttacattcccacc

SEQ ID NO: 414982 - DNA, 20 bp, Artificial
  CRISPR gRNA sequence
atttacattcccaccaacag

SEQ ID NO: 414983 - DNA, 20 bp, Artificial
  CRISPR gRNA sequence
acattcccaccaacagcgta

SEQ ID NO: 414984 - DNA, 20 bp, Artificial
  CRISPR gRNA sequence
cattcccaccaacagcgtaa

SEQ ID NO: 414985 - DNA, 20 bp, Artificial
  CRISPR gRNA sequence
ccaccaacagcgtaaaagtg

SEQ ID NO: 414986 - DNA, 20 bp, Artificial
  CRISPR gRNA sequence
tttttcctccacaaccttgc

SEQ ID NO: 414987 - DNA, 20 bp, Artificial
  CRISPR gRNA sequence
tttcctccacaaccttgcca

SEQ ID NO: 414988 - DNA, 20 bp, Artificial
  CRISPR gRNA sequence
ttcctccacaaccttgccag

SEQ ID NO: 414989 - DNA, 20 bp, Artificial
  CRISPR gRNA sequence
tcctccacaaccttgccagc

SEQ ID NO: 414990 - DNA, 20 bp, Artificial
  CRISPR gRNA sequence
cctccacaaccttgccagca

SEQ ID NO: 414991 - DNA, 20 bp, Artificial
  CRISPR gRNA sequence
ctccacaaccttgccagcat

SEQ ID NO: 414992 - DNA, 20 bp, Artificial
  CRISPR gRNA sequence
cacaaccttgccagcatcta

SEQ ID NO: 414993 - DNA, 20 bp, Artificial
  CRISPR gRNA sequence
gccagcatctaatatttttt

SEQ ID NO: 414994 - DNA, 20 bp, Artificial
  CRISPR gRNA sequence
ccagcatctaatattttttg

SEQ ID NO: 414995 - DNA, 20 bp, Artificial
  CRISPR gRNA sequence
atattttttgactttttaat

SEQ ID NO: 414996 - DNA, 20 bp, Artificial
  CRISPR gRNA sequence
tttgactttttaataataca

SEQ ID NO: 414997 - DNA, 20 bp, Artificial
  CRISPR gRNA sequence
ttgactttttaataatacag

SEQ ID NO: 414998 - DNA, 20 bp, Artificial
  CRISPR gRNA sequence
tgactttttaataatacaga

SEQ ID NO: 414999 - DNA, 20 bp, Artificial
  CRISPR gRNA sequence
gactttttaataatacagat

SEQ ID NO: 415000 - DNA, 20 bp, Artificial
  CRISPR gRNA sequence
actttttaataatacagatg

SEQ ID NO: 415001 - DNA, 20 bp, Artificial
  CRISPR gRNA sequence
tttaataatacagatgagag

SEQ ID NO: 415002 - DNA, 20 bp, Artificial
  CRISPR gRNA sequence
ttaataatacagatgagagg

SEQ ID NO: 415003 - DNA, 20 bp, Artificial
  CRISPR gRNA sequence
taataatacagatgagagga

SEQ ID NO: 415004 - DNA, 20 bp, Artificial
  CRISPR gRNA sequence
aataatacagatgagaggac

SEQ ID NO: 415005 - DNA, 20 bp, Artificial
  CRISPR gRNA sequence
ataatacagatgagaggact

SEQ ID NO: 415006 - DNA, 20 bp, Artificial
  CRISPR gRNA sequence
aactttaaagacataaataa

SEQ ID NO: 415007 - DNA, 20 bp, Artificial
  CRISPR gRNA sequence
taaagacataaataactcag

SEQ ID NO: 415008 - DNA, 20 bp, Artificial
  CRISPR gRNA sequence
aaagacataaataactcagc

SEQ ID NO: 415009 - DNA, 20 bp, Artificial
  CRISPR gRNA sequence
aagacataaataactcagct

SEQ ID NO: 415010 - DNA, 20 bp, Artificial
  CRISPR gRNA sequence
agctagtaaattgcagagtg

SEQ ID NO: 415011 - DNA, 20 bp, Artificial
  CRISPR gRNA sequence
gtaaattgcagagtgcaagt

SEQ ID NO: 415012 - DNA, 20 bp, Artificial
  CRISPR gRNA sequence
cagagtgcaagttaaacata

SEQ ID NO: 415013 - DNA, 20 bp, Artificial
  CRISPR gRNA sequence
aacatagatcatttgactct

SEQ ID NO: 415014 - DNA, 20 bp, Artificial
  CRISPR gRNA sequence
gactctaagttccatgttct

SEQ ID NO: 415015 - DNA, 20 bp, Artificial
  CRISPR gRNA sequence
actctaagttccatgttctc

SEQ ID NO: 415016 - DNA, 20 bp, Artificial
  CRISPR gRNA sequence
taagttccatgttctctttt

SEQ ID NO: 415017 - DNA, 20 bp, Artificial
  CRISPR gRNA sequence
agttccatgttctcttttgt

SEQ ID NO: 415018 - DNA, 20 bp, Artificial
  CRISPR gRNA sequence
catgttctcttttgtttcat

SEQ ID NO: 415019 - DNA, 20 bp, Artificial
  CRISPR gRNA sequence
tcttttgtttcatcacattg

SEQ ID NO: 415020 - DNA, 20 bp, Artificial
  CRISPR gRNA sequence
ttttgtttcatcacattgta

SEQ ID NO: 415021 - DNA, 20 bp, Artificial
  CRISPR gRNA sequence
ttgtttcatcacattgtatg

SEQ ID NO: 415022 - DNA, 20 bp, Artificial
  CRISPR gRNA sequence
tgtttcatcacattgtatgc

SEQ ID NO: 415023 - DNA, 20 bp, Artificial
  CRISPR gRNA sequence
gtttcatcacattgtatgct

SEQ ID NO: 415024 - DNA, 20 bp, Artificial
  CRISPR gRNA sequence
tttcatcacattgtatgctc

SEQ ID NO: 415025 - DNA, 20 bp, Artificial
  CRISPR gRNA sequence
catcacattgtatgctccag

SEQ ID NO: 415026 - DNA, 20 bp, Artificial
  CRISPR gRNA sequence
atcacattgtatgctccagg

SEQ ID NO: 415027 - DNA, 20 bp, Artificial
  CRISPR gRNA sequence
tatgctccaggcttatttaa

SEQ ID NO: 415028 - DNA, 20 bp, Artificial
  CRISPR gRNA sequence
caggcttatttaaatgtgta

SEQ ID NO: 415029 - DNA, 20 bp, Artificial
  CRISPR gRNA sequence
atttaaatgtgtatgtgtgt

SEQ ID NO: 415030 - DNA, 20 bp, Artificial
  CRISPR gRNA sequence
tttaaatgtgtatgtgtgtg

SEQ ID NO: 415031 - DNA, 20 bp, Artificial
  CRISPR gRNA sequence
aaatgtgtatgtgtgtgtct

SEQ ID NO: 415032 - DNA, 20 bp, Artificial
  CRISPR gRNA sequence
aatgtgtatgtgtgtgtctg

SEQ ID NO: 415033 - DNA, 20 bp, Artificial
  CRISPR gRNA sequence
tgtgtgtgtgtgtgtgtgtg

SEQ ID NO: 415034 - DNA, 20 bp, Artificial
  CRISPR gRNA sequence
gggcctggttgggaacgtta

SEQ ID NO: 415035 - DNA, 20 bp, Artificial
  CRISPR gRNA sequence
ggcctggttgggaacgttaa

SEQ ID NO: 415036 - DNA, 20 bp, Artificial
  CRISPR gRNA sequence
gttgggaacgttaactgcac

SEQ ID NO: 415037 - DNA, 20 bp, Artificial
  CRISPR gRNA sequence
ggaacgttaactgcacgttg

SEQ ID NO: 415038 - DNA, 20 bp, Artificial
  CRISPR gRNA sequence
actgcacgttgtgagatagc

SEQ ID NO: 415039 - DNA, 20 bp, Artificial
  CRISPR gRNA sequence
cacgttgtgagatagcaagc

SEQ ID NO: 415040 - DNA, 20 bp, Artificial
  CRISPR gRNA sequence
tgagatagcaagccttgtga

SEQ ID NO: 415041 - DNA, 20 bp, Artificial
  CRISPR gRNA sequence
gtgaaccacaatttaataaa

SEQ ID NO: 415042 - DNA, 20 bp, Artificial
  CRISPR gRNA sequence
tgaaccacaatttaataaaa

SEQ ID NO: 415043 - DNA, 20 bp, Artificial
  CRISPR gRNA sequence
aataaaaggtcaaagatcat

SEQ ID NO: 415044 - DNA, 20 bp, Artificial
  CRISPR gRNA sequence
ataaaaggtcaaagatcata

SEQ ID NO: 415045 - DNA, 20 bp, Artificial
  CRISPR gRNA sequence
ttccttatctttaaaatgag

SEQ ID NO: 415046 - DNA, 20 bp, Artificial
  CRISPR gRNA sequence
tccttatctttaaaatgagg

SEQ ID NO: 415047 - DNA, 20 bp, Artificial
  CRISPR gRNA sequence
ccttatctttaaaatgagga

SEQ ID NO: 415048 - DNA, 20 bp, Artificial
  CRISPR gRNA sequence
cttatctttaaaatgaggat

SEQ ID NO: 415049 - DNA, 20 bp, Artificial
  CRISPR gRNA sequence
atctttaaaatgaggataat

SEQ ID NO: 415050 - DNA, 20 bp, Artificial
  CRISPR gRNA sequence
tctttaaaatgaggataata

SEQ ID NO: 415051 - DNA, 20 bp, Artificial
  CRISPR gRNA sequence
taaaatgaggataataatag

SEQ ID NO: 415052 - DNA, 20 bp, Artificial
  CRISPR gRNA sequence
aaaatgaggataataatagc

SEQ ID NO: 415053 - DNA, 20 bp, Artificial
  CRISPR gRNA sequence
aaatgaggataataatagca

SEQ ID NO: 415054 - DNA, 20 bp, Artificial
  CRISPR gRNA sequence
tatcatagatttattttgag

SEQ ID NO: 415055 - DNA, 20 bp, Artificial
  CRISPR gRNA sequence
attttgaggagtaaatgatc

SEQ ID NO: 415056 - DNA, 20 bp, Artificial
  CRISPR gRNA sequence
ttttgaggagtaaatgatct

SEQ ID NO: 415057 - DNA, 20 bp, Artificial
  CRISPR gRNA sequence
tgaggagtaaatgatctaat

SEQ ID NO: 415058 - DNA, 20 bp, Artificial
  CRISPR gRNA sequence
gaggagtaaatgatctaatt

SEQ ID NO: 415059 - DNA, 20 bp, Artificial
  CRISPR gRNA sequence
aggagtaaatgatctaattt

SEQ ID NO: 415060 - DNA, 20 bp, Artificial
  CRISPR gRNA sequence
atttatataaaacacctagc

SEQ ID NO: 415061 - DNA, 20 bp, Artificial
  CRISPR gRNA sequence
atataaaacacctagccata

SEQ ID NO: 415062 - DNA, 20 bp, Artificial
  CRISPR gRNA sequence
tataaaacacctagccatat

SEQ ID NO: 415063 - DNA, 20 bp, Artificial
  CRISPR gRNA sequence
gccatatgccttgtgtatag

SEQ ID NO: 415064 - DNA, 20 bp, Artificial
  CRISPR gRNA sequence
gtgtatagtaaatttacaca

SEQ ID NO: 415065 - DNA, 20 bp, Artificial
  CRISPR gRNA sequence
tgtatagtaaatttacacat

SEQ ID NO: 415066 - DNA, 20 bp, Artificial
  CRISPR gRNA sequence
acacatagaataaacaaata

SEQ ID NO: 415067 - DNA, 20 bp, Artificial
  CRISPR gRNA sequence
cacatagaataaacaaataa

SEQ ID NO: 415068 - DNA, 20 bp, Artificial
  CRISPR gRNA sequence
gtcaaaataataataaataa

SEQ ID NO: 415069 - DNA, 20 bp, Artificial
  CRISPR gRNA sequence
tattgacatgataggaggat

SEQ ID NO: 415070 - DNA, 20 bp, Artificial
  CRISPR gRNA sequence
acatgataggaggatttcaa

SEQ ID NO: 415071 - DNA, 20 bp, Artificial
  CRISPR gRNA sequence
caaagcaactagaagagaca

SEQ ID NO: 415072 - DNA, 20 bp, Artificial
  CRISPR gRNA sequence
aaagcaactagaagagacaa

SEQ ID NO: 415073 - DNA, 20 bp, Artificial
  CRISPR gRNA sequence
gaagagacaattggagtcaa

SEQ ID NO: 415074 - DNA, 20 bp, Artificial
  CRISPR gRNA sequence
gagtcaatatccatttcctg

SEQ ID NO: 415075 - DNA, 20 bp, Artificial
  CRISPR gRNA sequence
cctgcataacctttccctgg

SEQ ID NO: 415076 - DNA, 20 bp, Artificial
  CRISPR gRNA sequence
ctgcataacctttccctgga

SEQ ID NO: 415077 - DNA, 20 bp, Artificial
  CRISPR gRNA sequence
cataacctttccctggagaa

SEQ ID NO: 415078 - DNA, 20 bp, Artificial
  CRISPR gRNA sequence
tccctggagaaagaccatct

SEQ ID NO: 415079 - DNA, 20 bp, Artificial
  CRISPR gRNA sequence
ccctggagaaagaccatctt

SEQ ID NO: 415080 - DNA, 20 bp, Artificial
  CRISPR gRNA sequence
cctggagaaagaccatctta

SEQ ID NO: 415081 - DNA, 20 bp, Artificial
  CRISPR gRNA sequence
gagaaagaccatcttatttt

SEQ ID NO: 415082 - DNA, 20 bp, Artificial
  CRISPR gRNA sequence
attttcaagatattcacaaa

SEQ ID NO: 415083 - DNA, 20 bp, Artificial
  CRISPR gRNA sequence
ttttcaagatattcacaaag

SEQ ID NO: 415084 - DNA, 20 bp, Artificial
  CRISPR gRNA sequence
tcaagatattcacaaaggaa

SEQ ID NO: 415085 - DNA, 20 bp, Artificial
  CRISPR gRNA sequence
caagatattcacaaaggaat

SEQ ID NO: 415086 - DNA, 20 bp, Artificial
  CRISPR gRNA sequence
aagatattcacaaaggaatt

SEQ ID NO: 415087 - DNA, 20 bp, Artificial
  CRISPR gRNA sequence
acaaaggaattacaacctca

SEQ ID NO: 415088 - DNA, 20 bp, Artificial
  CRISPR gRNA sequence
caacctcaccttaaagagaa

SEQ ID NO: 415089 - DNA, 20 bp, Artificial
  CRISPR gRNA sequence
accttaaagagaactcccaa

SEQ ID NO: 415090 - DNA, 20 bp, Artificial
  CRISPR gRNA sequence
aaagagaactcccaaaacat

SEQ ID NO: 415091 - DNA, 20 bp, Artificial
  CRISPR gRNA sequence
aagagaactcccaaaacatt

SEQ ID NO: 415092 - DNA, 20 bp, Artificial
  CRISPR gRNA sequence
ccaaaacattacatttctgt

SEQ ID NO: 415093 - DNA, 20 bp, Artificial
  CRISPR gRNA sequence
catttctgtatcttctgtat

SEQ ID NO: 415094 - DNA, 20 bp, Artificial
  CRISPR gRNA sequence
ctgtatcttctgtatctaac

SEQ ID NO: 415095 - DNA, 20 bp, Artificial
  CRISPR gRNA sequence
tgtatcttctgtatctaaca

SEQ ID NO: 415096 - DNA, 20 bp, Artificial
  CRISPR gRNA sequence
tatcttctgtatctaacaga

SEQ ID NO: 415097 - DNA, 20 bp, Artificial
  CRISPR gRNA sequence
ctgtatctaacagaggagtc

SEQ ID NO: 415098 - DNA, 20 bp, Artificial
  CRISPR gRNA sequence
tgtatctaacagaggagtct

SEQ ID NO: 415099 - DNA, 20 bp, Artificial
  CRISPR gRNA sequence
tatctaacagaggagtctgt

SEQ ID NO: 415100 - DNA, 20 bp, Artificial
  CRISPR gRNA sequence
acagaggagtctgttgttca

SEQ ID NO: 415101 - DNA, 20 bp, Artificial
  CRISPR gRNA sequence
ttgttcaataagaatctttt

SEQ ID NO: 415102 - DNA, 20 bp, Artificial
  CRISPR gRNA sequence
ttcaataagaatcttttcct

SEQ ID NO: 415103 - DNA, 20 bp, Artificial
  CRISPR gRNA sequence
aataagaatcttttccttag

SEQ ID NO: 415104 - DNA, 20 bp, Artificial
  CRISPR gRNA sequence
ttccttagggagataaaaag

SEQ ID NO: 415105 - DNA, 20 bp, Artificial
  CRISPR gRNA sequence
tccttagggagataaaaaga

SEQ ID NO: 415106 - DNA, 20 bp, Artificial
  CRISPR gRNA sequence
ccttagggagataaaaagag

SEQ ID NO: 415107 - DNA, 20 bp, Artificial
  CRISPR gRNA sequence
cttagggagataaaaagagt

SEQ ID NO: 415108 - DNA, 20 bp, Artificial
  CRISPR gRNA sequence
agggagataaaaagagtcac

SEQ ID NO: 415109 - DNA, 20 bp, Artificial
  CRISPR gRNA sequence
gggagataaaaagagtcacc

SEQ ID NO: 415110 - DNA, 20 bp, Artificial
  CRISPR gRNA sequence
cctataataactattttata

SEQ ID NO: 415111 - DNA, 20 bp, Artificial
  CRISPR gRNA sequence
taataactattttatatagt

SEQ ID NO: 415112 - DNA, 20 bp, Artificial
  CRISPR gRNA sequence
ttttatatagttggatacag

SEQ ID NO: 415113 - DNA, 20 bp, Artificial
  CRISPR gRNA sequence
tatatagttggatacagtta

SEQ ID NO: 415114 - DNA, 20 bp, Artificial
  CRISPR gRNA sequence
atatagttggatacagttat

SEQ ID NO: 415115 - DNA, 20 bp, Artificial
  CRISPR gRNA sequence
tatagttggatacagttata

SEQ ID NO: 415116 - DNA, 20 bp, Artificial
  CRISPR gRNA sequence
gatacagttatatcagctct

SEQ ID NO: 415117 - DNA, 20 bp, Artificial
  CRISPR gRNA sequence
tatcagctcttgcattcagt

SEQ ID NO: 415118 - DNA, 20 bp, Artificial
  CRISPR gRNA sequence
ttgcattcagttacagtagc

SEQ ID NO: 415119 - DNA, 20 bp, Artificial
  CRISPR gRNA sequence
gcattcagttacagtagcct

SEQ ID NO: 415120 - DNA, 20 bp, Artificial
  CRISPR gRNA sequence
cattcagttacagtagcctc

SEQ ID NO: 415121 - DNA, 20 bp, Artificial
  CRISPR gRNA sequence
agttacagtagcctcttttc

SEQ ID NO: 415122 - DNA, 20 bp, Artificial
  CRISPR gRNA sequence
cagtagcctcttttcttctt

SEQ ID NO: 415123 - DNA, 20 bp, Artificial
  CRISPR gRNA sequence
ttttcttcttctctggtatt

SEQ ID NO: 415124 - DNA, 20 bp, Artificial
  CRISPR gRNA sequence
ttcttcttctctggtatttt

SEQ ID NO: 415125 - DNA, 20 bp, Artificial
  CRISPR gRNA sequence
tcttcttctctggtattttc

SEQ ID NO: 415126 - DNA, 20 bp, Artificial
  CRISPR gRNA sequence
cttcttctctggtattttct

SEQ ID NO: 415127 - DNA, 20 bp, Artificial
  CRISPR gRNA sequence
ttcttctctggtattttctc

SEQ ID NO: 415128 - DNA, 20 bp, Artificial
  CRISPR gRNA sequence
cttctctggtattttctctt

SEQ ID NO: 415129 - DNA, 20 bp, Artificial
  CRISPR gRNA sequence
ttctctggtattttctcttc

SEQ ID NO: 415130 - DNA, 20 bp, Artificial
  CRISPR gRNA sequence
ctctggtattttctcttcta

SEQ ID NO: 415131 - DNA, 20 bp, Artificial
  CRISPR gRNA sequence
tctggtattttctcttctat

SEQ ID NO: 415132 - DNA, 20 bp, Artificial
  CRISPR gRNA sequence
tggtattttctcttctatga

SEQ ID NO: 415133 - DNA, 20 bp, Artificial
  CRISPR gRNA sequence
gtattttctcttctatgatt

SEQ ID NO: 415134 - DNA, 20 bp, Artificial
  CRISPR gRNA sequence
tctcttctatgattcccctg

SEQ ID NO: 415135 - DNA, 20 bp, Artificial
  CRISPR gRNA sequence
ctcttctatgattcccctgg

SEQ ID NO: 415136 - DNA, 20 bp, Artificial
  CRISPR gRNA sequence
tcttctatgattcccctggt

SEQ ID NO: 415137 - DNA, 20 bp, Artificial
  CRISPR gRNA sequence
ttctatgattcccctggtta

SEQ ID NO: 415138 - DNA, 20 bp, Artificial
  CRISPR gRNA sequence
ctatgattcccctggttagg

SEQ ID NO: 415139 - DNA, 20 bp, Artificial
  CRISPR gRNA sequence
tatgattcccctggttaggt

SEQ ID NO: 415140 - DNA, 20 bp, Artificial
  CRISPR gRNA sequence
tgattcccctggttaggttt

SEQ ID NO: 415141 - DNA, 20 bp, Artificial
  CRISPR gRNA sequence
ccctggttaggtttttatgg

SEQ ID NO: 415142 - DNA, 20 bp, Artificial
  CRISPR gRNA sequence
gttaggtttttatgggtttc

SEQ ID NO: 415143 - DNA, 20 bp, Artificial
  CRISPR gRNA sequence
ggtttttatgggtttcattg

SEQ ID NO: 415144 - DNA, 20 bp, Artificial
  CRISPR gRNA sequence
ttatgggtttcattggaact

SEQ ID NO: 415145 - DNA, 20 bp, Artificial
  CRISPR gRNA sequence
tatgggtttcattggaactg

SEQ ID NO: 415146 - DNA, 20 bp, Artificial
  CRISPR gRNA sequence
atgggtttcattggaactgt

SEQ ID NO: 415147 - DNA, 20 bp, Artificial
  CRISPR gRNA sequence
tgggtttcattggaactgtg

SEQ ID NO: 415148 - DNA, 20 bp, Artificial
  CRISPR gRNA sequence
cattggaactgtggagcgtt

SEQ ID NO: 415149 - DNA, 20 bp, Artificial
  CRISPR gRNA sequence
attggaactgtggagcgttt

SEQ ID NO: 415150 - DNA, 20 bp, Artificial
  CRISPR gRNA sequence
gaactgtggagcgtttattg

SEQ ID NO: 415151 - DNA, 20 bp, Artificial
  CRISPR gRNA sequence
tggagcgtttattgaatact

SEQ ID NO: 415152 - DNA, 20 bp, Artificial
  CRISPR gRNA sequence
attgaatactgtggttgcag

SEQ ID NO: 415153 - DNA, 20 bp, Artificial
  CRISPR gRNA sequence
ttgaatactgtggttgcaga

SEQ ID NO: 415154 - DNA, 20 bp, Artificial
  CRISPR gRNA sequence
aatactgtggttgcagatgg

SEQ ID NO: 415155 - DNA, 20 bp, Artificial
  CRISPR gRNA sequence
tggttgcagatggtcctttc

SEQ ID NO: 415156 - DNA, 20 bp, Artificial
  CRISPR gRNA sequence
cagatggtcctttcagtcac

SEQ ID NO: 415157 - DNA, 20 bp, Artificial
  CRISPR gRNA sequence
tcagtcacggcgaagtgatt

SEQ ID NO: 415158 - DNA, 20 bp, Artificial
  CRISPR gRNA sequence
cagtcacggcgaagtgattc

SEQ ID NO: 415159 - DNA, 20 bp, Artificial
  CRISPR gRNA sequence
agtcacggcgaagtgattcc

SEQ ID NO: 415160 - DNA, 20 bp, Artificial
  CRISPR gRNA sequence
cagaagttggagagcttaat

SEQ ID NO: 415161 - DNA, 20 bp, Artificial
  CRISPR gRNA sequence
gagagcttaatagtcaagag

SEQ ID NO: 415162 - DNA, 20 bp, Artificial
  CRISPR gRNA sequence
aatagtcaagagggagggcg

SEQ ID NO: 415163 - DNA, 20 bp, Artificial
  CRISPR gRNA sequence
atagtcaagagggagggcga

SEQ ID NO: 415164 - DNA, 20 bp, Artificial
  CRISPR gRNA sequence
aaattccagcactacaccaa

SEQ ID NO: 415165 - DNA, 20 bp, Artificial
  CRISPR gRNA sequence
aattccagcactacaccaac

SEQ ID NO: 415166 - DNA, 20 bp, Artificial
  CRISPR gRNA sequence
cagcactacaccaaccgatc

SEQ ID NO: 415167 - DNA, 20 bp, Artificial
  CRISPR gRNA sequence
caccaaccgatcatgtgatt

SEQ ID NO: 415168 - DNA, 20 bp, Artificial
  CRISPR gRNA sequence
gggacaagttactcttcctc

SEQ ID NO: 415169 - DNA, 20 bp, Artificial
  CRISPR gRNA sequence
ggacaagttactcttcctct

SEQ ID NO: 415170 - DNA, 20 bp, Artificial
  CRISPR gRNA sequence
ctcttcctcttcacacctta

SEQ ID NO: 415171 - DNA, 20 bp, Artificial
  CRISPR gRNA sequence
ttcctcttcacaccttagtt

SEQ ID NO: 415172 - DNA, 20 bp, Artificial
  CRISPR gRNA sequence
cctcttcacaccttagtttc

SEQ ID NO: 415173 - DNA, 20 bp, Artificial
  CRISPR gRNA sequence
ctcttcacaccttagtttct

SEQ ID NO: 415174 - DNA, 20 bp, Artificial
  CRISPR gRNA sequence
ttcacaccttagtttctaaa

SEQ ID NO: 415175 - DNA, 20 bp, Artificial
  CRISPR gRNA sequence
cacaccttagtttctaaacc

SEQ ID NO: 415176 - DNA, 20 bp, Artificial
  CRISPR gRNA sequence
acaccttagtttctaaacct

SEQ ID NO: 415177 - DNA, 20 bp, Artificial
  CRISPR gRNA sequence
agtttctaaacctgtttata

SEQ ID NO: 415178 - DNA, 20 bp, Artificial
  CRISPR gRNA sequence
gtttctaaacctgtttatat

SEQ ID NO: 415179 - DNA, 20 bp, Artificial
  CRISPR gRNA sequence
ctaaacctgtttatatgaaa

SEQ ID NO: 415180 - DNA, 20 bp, Artificial
  CRISPR gRNA sequence
taaacctgtttatatgaaat

SEQ ID NO: 415181 - DNA, 20 bp, Artificial
  CRISPR gRNA sequence
aacctgtttatatgaaatct

SEQ ID NO: 415182 - DNA, 20 bp, Artificial
  CRISPR gRNA sequence
tttatatgaaatcttaataa

SEQ ID NO: 415183 - DNA, 20 bp, Artificial
  CRISPR gRNA sequence
atatgaaatcttaataaaat

SEQ ID NO: 415184 - DNA, 20 bp, Artificial
  CRISPR gRNA sequence
tatgaaatcttaataaaata

SEQ ID NO: 415185 - DNA, 20 bp, Artificial
  CRISPR gRNA sequence
aataaaataatctacataag

SEQ ID NO: 415186 - DNA, 20 bp, Artificial
  CRISPR gRNA sequence
ataaaataatctacataagt

SEQ ID NO: 415187 - DNA, 20 bp, Artificial
  CRISPR gRNA sequence
cataagtgatttaataaaat

SEQ ID NO: 415188 - DNA, 20 bp, Artificial
  CRISPR gRNA sequence
aataaaataatccatacgag

SEQ ID NO: 415189 - DNA, 20 bp, Artificial
  CRISPR gRNA sequence
ataaaataatccatacgagt

SEQ ID NO: 415190 - DNA, 20 bp, Artificial
  CRISPR gRNA sequence
agaataacacccaaaagatt

SEQ ID NO: 415191 - DNA, 20 bp, Artificial
  CRISPR gRNA sequence
gaataacacccaaaagattt

SEQ ID NO: 415192 - DNA, 20 bp, Artificial
  CRISPR gRNA sequence
tataaagcttcattatattg

SEQ ID NO: 415193 - DNA, 20 bp, Artificial
  CRISPR gRNA sequence
ataaagcttcattatattgt

SEQ ID NO: 415194 - DNA, 20 bp, Artificial
  CRISPR gRNA sequence
taaagcttcattatattgtc

SEQ ID NO: 415195 - DNA, 20 bp, Artificial
  CRISPR gRNA sequence
cattatattgtcatccaaga

SEQ ID NO: 415196 - DNA, 20 bp, Artificial
  CRISPR gRNA sequence
attatattgtcatccaagaa

SEQ ID NO: 415197 - DNA, 20 bp, Artificial
  CRISPR gRNA sequence
tattgtcatccaagaagtta

SEQ ID NO: 415198 - DNA, 20 bp, Artificial
  CRISPR gRNA sequence
tcatccaagaagttacactg

SEQ ID NO: 415199 - DNA, 20 bp, Artificial
  CRISPR gRNA sequence
cactgctggcatttaaaata

SEQ ID NO: 415200 - DNA, 20 bp, Artificial
  CRISPR gRNA sequence
ctggcatttaaaataaattt

SEQ ID NO: 415201 - DNA, 20 bp, Artificial
  CRISPR gRNA sequence
gcatttaaaataaattttaa

SEQ ID NO: 415202 - DNA, 20 bp, Artificial
  CRISPR gRNA sequence
aaaataaattttaattgtgg

SEQ ID NO: 415203 - DNA, 20 bp, Artificial
  CRISPR gRNA sequence
aaataaattttaattgtgga

SEQ ID NO: 415204 - DNA, 20 bp, Artificial
  CRISPR gRNA sequence
taattgtggaaaatgtctta

SEQ ID NO: 415205 - DNA, 20 bp, Artificial
  CRISPR gRNA sequence
aattgtggaaaatgtcttaa

SEQ ID NO: 415206 - DNA, 20 bp, Artificial
  CRISPR gRNA sequence
attgtggaaaatgtcttaaa

SEQ ID NO: 415207 - DNA, 20 bp, Artificial
  CRISPR gRNA sequence
tggaaaatgtcttaaatgtg

SEQ ID NO: 415208 - DNA, 20 bp, Artificial
  CRISPR gRNA sequence
aaatgtgaggttatttggag

SEQ ID NO: 415209 - DNA, 20 bp, Artificial
  CRISPR gRNA sequence
aatgtgaggttatttggaga

SEQ ID NO: 415210 - DNA, 20 bp, Artificial
  CRISPR gRNA sequence
tttggagaaagctataagtc

SEQ ID NO: 415211 - DNA, 20 bp, Artificial
  CRISPR gRNA sequence
ggagaaagctataagtcatt

SEQ ID NO: 415212 - DNA, 20 bp, Artificial
  CRISPR gRNA sequence
gagaaagctataagtcattt

SEQ ID NO: 415213 - DNA, 20 bp, Artificial
  CRISPR gRNA sequence
taagtcatttatgtaataag

SEQ ID NO: 415214 - DNA, 20 bp, Artificial
  CRISPR gRNA sequence
atgtaataagtcactataaa

SEQ ID NO: 415215 - DNA, 20 bp, Artificial
  CRISPR gRNA sequence
tgtaataagtcactataaat

SEQ ID NO: 415216 - DNA, 20 bp, Artificial
  CRISPR gRNA sequence
taaatcattctttagtaaaa

SEQ ID NO: 415217 - DNA, 20 bp, Artificial
  CRISPR gRNA sequence
tttagtaaaatcactgagat

SEQ ID NO: 415218 - DNA, 20 bp, Artificial
  CRISPR gRNA sequence
tagtaaaatcactgagatta

SEQ ID NO: 415219 - DNA, 20 bp, Artificial
  CRISPR gRNA sequence
agtaaaatcactgagattaa

SEQ ID NO: 415220 - DNA, 20 bp, Artificial
  CRISPR gRNA sequence
gtaaaatcactgagattaat

SEQ ID NO: 415221 - DNA, 20 bp, Artificial
  CRISPR gRNA sequence
agattaattactaatgcaca

SEQ ID NO: 415222 - DNA, 20 bp, Artificial
  CRISPR gRNA sequence
attactaatgcacagtggtt

SEQ ID NO: 415223 - DNA, 20 bp, Artificial
  CRISPR gRNA sequence
ctaatgcacagtggttagat

SEQ ID NO: 415224 - DNA, 20 bp, Artificial
  CRISPR gRNA sequence
atgcacagtggttagatatc

SEQ ID NO: 415225 - DNA, 20 bp, Artificial
  CRISPR gRNA sequence
gatatccatttagttgccct

SEQ ID NO: 415226 - DNA, 20 bp, Artificial
  CRISPR gRNA sequence
agttgccctcaccatctggg

SEQ ID NO: 415227 - DNA, 20 bp, Artificial
  CRISPR gRNA sequence
gttgccctcaccatctggga

SEQ ID NO: 415228 - DNA, 20 bp, Artificial
  CRISPR gRNA sequence
ccctcaccatctgggagcaa

SEQ ID NO: 415229 - DNA, 20 bp, Artificial
  CRISPR gRNA sequence
accatctgggagcaatttgg

SEQ ID NO: 415230 - DNA, 20 bp, Artificial
  CRISPR gRNA sequence
ggagcaatttggagaagaca

SEQ ID NO: 415231 - DNA, 20 bp, Artificial
  CRISPR gRNA sequence
ggagaagacagggaaaatga

SEQ ID NO: 415232 - DNA, 20 bp, Artificial
  CRISPR gRNA sequence
gagaagacagggaaaatgaa

SEQ ID NO: 415233 - DNA, 20 bp, Artificial
  CRISPR gRNA sequence
tagggtaacagaattttgga

SEQ ID NO: 415234 - DNA, 20 bp, Artificial
  CRISPR gRNA sequence
tggataaatgtgcataaagc

SEQ ID NO: 415235 - DNA, 20 bp, Artificial
  CRISPR gRNA sequence
ggataaatgtgcataaagct

SEQ ID NO: 415236 - DNA, 20 bp, Artificial
  CRISPR gRNA sequence
gataaatgtgcataaagcta

SEQ ID NO: 415237 - DNA, 20 bp, Artificial
  CRISPR gRNA sequence
cttcaacatattagaaggtg

SEQ ID NO: 415238 - DNA, 20 bp, Artificial
  CRISPR gRNA sequence
caacatattagaaggtgcat

SEQ ID NO: 415239 - DNA, 20 bp, Artificial
  CRISPR gRNA sequence
aacatattagaaggtgcatg

SEQ ID NO: 415240 - DNA, 20 bp, Artificial
  CRISPR gRNA sequence
gaaggtgcatgtgggctagg

SEQ ID NO: 415241 - DNA, 20 bp, Artificial
  CRISPR gRNA sequence
ggggtacagtgaggtataga

SEQ ID NO: 415242 - DNA, 20 bp, Artificial
  CRISPR gRNA sequence
cgaaataatattagtactgg

SEQ ID NO: 415243 - DNA, 20 bp, Artificial
  CRISPR gRNA sequence
gaaataatattagtactgga

SEQ ID NO: 415244 - DNA, 20 bp, Artificial
  CRISPR gRNA sequence
gtactggaatatcatatctt

SEQ ID NO: 415245 - DNA, 20 bp, Artificial
  CRISPR gRNA sequence
gaatatcatatctttatatc

SEQ ID NO: 415246 - DNA, 20 bp, Artificial
  CRISPR gRNA sequence
tatatcctttattgaatatg

SEQ ID NO: 415247 - DNA, 20 bp, Artificial
  CRISPR gRNA sequence
atatcctttattgaatatgc

SEQ ID NO: 415248 - DNA, 20 bp, Artificial
  CRISPR gRNA sequence
tatcctttattgaatatgca

SEQ ID NO: 415249 - DNA, 20 bp, Artificial
  CRISPR gRNA sequence
tattgaatatgcattccaga

SEQ ID NO: 415250 - DNA, 20 bp, Artificial
  CRISPR gRNA sequence
attgaatatgcattccagaa

SEQ ID NO: 415251 - DNA, 20 bp, Artificial
  CRISPR gRNA sequence
ttgaatatgcattccagaag

SEQ ID NO: 415252 - DNA, 20 bp, Artificial
  CRISPR gRNA sequence
aatatgcattccagaaggag

SEQ ID NO: 415253 - DNA, 20 bp, Artificial
  CRISPR gRNA sequence
cagaaggagaaggagagaga

SEQ ID NO: 415254 - DNA, 20 bp, Artificial
  CRISPR gRNA sequence
tttacagagtcctgggatac

SEQ ID NO: 415255 - DNA, 20 bp, Artificial
  CRISPR gRNA sequence
acagagtcctgggatacaca

SEQ ID NO: 415256 - DNA, 20 bp, Artificial
  CRISPR gRNA sequence
cagagtcctgggatacacag

SEQ ID NO: 415257 - DNA, 20 bp, Artificial
  CRISPR gRNA sequence
ggatacacagaaggtaagtt

SEQ ID NO: 415258 - DNA, 20 bp, Artificial
  CRISPR gRNA sequence
atacggaactgtcatttttt

SEQ ID NO: 415259 - DNA, 20 bp, Artificial
  CRISPR gRNA sequence
tacggaactgtcattttttt

SEQ ID NO: 415260 - DNA, 20 bp, Artificial
  CRISPR gRNA sequence
tcatttttttcttttgtaat

SEQ ID NO: 415261 - DNA, 20 bp, Artificial
  CRISPR gRNA sequence
ttttcttttgtaatttacag

SEQ ID NO: 415262 - DNA, 20 bp, Artificial
  CRISPR gRNA sequence
tttcttttgtaatttacaga

SEQ ID NO: 415263 - DNA, 20 bp, Artificial
  CRISPR gRNA sequence
ttcttttgtaatttacagat

SEQ ID NO: 415264 - DNA, 20 bp, Artificial
  CRISPR gRNA sequence
tcttttgtaatttacagatg

SEQ ID NO: 415265 - DNA, 20 bp, Artificial
  CRISPR gRNA sequence
cttttgtaatttacagatgc

SEQ ID NO: 415266 - DNA, 20 bp, Artificial
  CRISPR gRNA sequence
ttttgtaatttacagatgca

SEQ ID NO: 415267 - DNA, 20 bp, Artificial
  CRISPR gRNA sequence
ttgtaatttacagatgcaaa

SEQ ID NO: 415268 - DNA, 20 bp, Artificial
  CRISPR gRNA sequence
tgtaatttacagatgcaaag

SEQ ID NO: 415269 - DNA, 20 bp, Artificial
  CRISPR gRNA sequence
gtaatttacagatgcaaagt

SEQ ID NO: 415270 - DNA, 20 bp, Artificial
  CRISPR gRNA sequence
taatttacagatgcaaagtc

SEQ ID NO: 415271 - DNA, 20 bp, Artificial
  CRISPR gRNA sequence
acagatgcaaagtcagtctc

SEQ ID NO: 415272 - DNA, 20 bp, Artificial
  CRISPR gRNA sequence
cagatgcaaagtcagtctct

SEQ ID NO: 415273 - DNA, 20 bp, Artificial
  CRISPR gRNA sequence
ttttgcagttagcaatctta

SEQ ID NO: 415274 - DNA, 20 bp, Artificial
  CRISPR gRNA sequence
ttgcagttagcaatcttata

SEQ ID NO: 415275 - DNA, 20 bp, Artificial
  CRISPR gRNA sequence
tgcagttagcaatcttatat

SEQ ID NO: 415276 - DNA, 20 bp, Artificial
  CRISPR gRNA sequence
gcagttagcaatcttatatt

SEQ ID NO: 415277 - DNA, 20 bp, Artificial
  CRISPR gRNA sequence
cagttagcaatcttatattt

SEQ ID NO: 415278 - DNA, 20 bp, Artificial
  CRISPR gRNA sequence
gcaatcttatattttattgt

SEQ ID NO: 415279 - DNA, 20 bp, Artificial
  CRISPR gRNA sequence
atattttattgtcctttcag

SEQ ID NO: 415280 - DNA, 20 bp, Artificial
  CRISPR gRNA sequence
tattttattgtcctttcagt

SEQ ID NO: 415281 - DNA, 20 bp, Artificial
  CRISPR gRNA sequence
tattgtcctttcagtaacct

SEQ ID NO: 415282 - DNA, 20 bp, Artificial
  CRISPR gRNA sequence
attgtcctttcagtaacctg

SEQ ID NO: 415283 - DNA, 20 bp, Artificial
  CRISPR gRNA sequence
ttgtcctttcagtaacctga

SEQ ID NO: 415284 - DNA, 20 bp, Artificial
  CRISPR gRNA sequence
tcctttcagtaacctgacca

SEQ ID NO: 415285 - DNA, 20 bp, Artificial
  CRISPR gRNA sequence
tcagtaacctgaccatgcag

SEQ ID NO: 415286 - DNA, 20 bp, Artificial
  CRISPR gRNA sequence
cagtaacctgaccatgcagt

SEQ ID NO: 415287 - DNA, 20 bp, Artificial
  CRISPR gRNA sequence
agtaacctgaccatgcagtt

SEQ ID NO: 415288 - DNA, 20 bp, Artificial
  CRISPR gRNA sequence
accatgcagttgcctgtaat

SEQ ID NO: 415289 - DNA, 20 bp, Artificial
  CRISPR gRNA sequence
cctgtaatttaaatatcagc

SEQ ID NO: 415290 - DNA, 20 bp, Artificial
  CRISPR gRNA sequence
taatttaaatatcagctatt

SEQ ID NO: 415291 - DNA, 20 bp, Artificial
  CRISPR gRNA sequence
aaatatcagctatttggaga

SEQ ID NO: 415292 - DNA, 20 bp, Artificial
  CRISPR gRNA sequence
aatatcagctatttggagaa

SEQ ID NO: 415293 - DNA, 20 bp, Artificial
  CRISPR gRNA sequence
tttggagaaagttattttct

SEQ ID NO: 415294 - DNA, 20 bp, Artificial
  CRISPR gRNA sequence
ggagaaagttattttctgaa

SEQ ID NO: 415295 - DNA, 20 bp, Artificial
  CRISPR gRNA sequence
gagaaagttattttctgaac

SEQ ID NO: 415296 - DNA, 20 bp, Artificial
  CRISPR gRNA sequence
ttttctgaactattctattt

SEQ ID NO: 415297 - DNA, 20 bp, Artificial
  CRISPR gRNA sequence
tctgaactattctattttta

SEQ ID NO: 415298 - DNA, 20 bp, Artificial
  CRISPR gRNA sequence
ctgaactattctatttttaa

SEQ ID NO: 415299 - DNA, 20 bp, Artificial
  CRISPR gRNA sequence
tgaactattctatttttaat

SEQ ID NO: 415300 - DNA, 20 bp, Artificial
  CRISPR gRNA sequence
aactattctatttttaatac

SEQ ID NO: 415301 - DNA, 20 bp, Artificial
  CRISPR gRNA sequence
ttctatttttaatacccttt

SEQ ID NO: 415302 - DNA, 20 bp, Artificial
  CRISPR gRNA sequence
tatttttaataccctttgaa

SEQ ID NO: 415303 - DNA, 20 bp, Artificial
  CRISPR gRNA sequence
tttttaataccctttgaaac

SEQ ID NO: 415304 - DNA, 20 bp, Artificial
  CRISPR gRNA sequence
ttaataccctttgaaactaa

SEQ ID NO: 415305 - DNA, 20 bp, Artificial
  CRISPR gRNA sequence
taataccctttgaaactaag

SEQ ID NO: 415306 - DNA, 20 bp, Artificial
  CRISPR gRNA sequence
aataccctttgaaactaagt

SEQ ID NO: 415307 - DNA, 20 bp, Artificial
  CRISPR gRNA sequence
ataccctttgaaactaagtt

SEQ ID NO: 415308 - DNA, 20 bp, Artificial
  CRISPR gRNA sequence
tgaaactaagttttttatat

SEQ ID NO: 415309 - DNA, 20 bp, Artificial
  CRISPR gRNA sequence
gaaactaagttttttatatg

SEQ ID NO: 415310 - DNA, 20 bp, Artificial
  CRISPR gRNA sequence
aaactaagttttttatatga

SEQ ID NO: 415311 - DNA, 20 bp, Artificial
  CRISPR gRNA sequence
agttttttatatgaatataa

SEQ ID NO: 415312 - DNA, 20 bp, Artificial
  CRISPR gRNA sequence
tttatatgaatataaataaa

SEQ ID NO: 415313 - DNA, 20 bp, Artificial
  CRISPR gRNA sequence
ttatatgaatataaataaag

SEQ ID NO: 415314 - DNA, 20 bp, Artificial
  CRISPR gRNA sequence
tatatgaatataaataaagg

SEQ ID NO: 415315 - DNA, 20 bp, Artificial
  CRISPR gRNA sequence
atatgaatataaataaagga

SEQ ID NO: 415316 - DNA, 20 bp, Artificial
  CRISPR gRNA sequence
tatgaatataaataaaggag

SEQ ID NO: 415317 - DNA, 20 bp, Artificial
  CRISPR gRNA sequence
ccctggcgtaataacaatca

SEQ ID NO: 415318 - DNA, 20 bp, Artificial
  CRISPR gRNA sequence
gcgtaataacaatcaacact

SEQ ID NO: 415319 - DNA, 20 bp, Artificial
  CRISPR gRNA sequence
tgccttccctaaatctttgt

SEQ ID NO: 415320 - DNA, 20 bp, Artificial
  CRISPR gRNA sequence
ccctaaatctttgttccttt

SEQ ID NO: 415321 - DNA, 20 bp, Artificial
  CRISPR gRNA sequence
cctaaatctttgttcctttt

SEQ ID NO: 415322 - DNA, 20 bp, Artificial
  CRISPR gRNA sequence
aatctttgttccttttctag

SEQ ID NO: 415323 - DNA, 20 bp, Artificial
  CRISPR gRNA sequence
tgttccttttctagggctgc

SEQ ID NO: 415324 - DNA, 20 bp, Artificial
  CRISPR gRNA sequence
gttccttttctagggctgct

SEQ ID NO: 415325 - DNA, 20 bp, Artificial
  CRISPR gRNA sequence
ttccttttctagggctgctg

SEQ ID NO: 415326 - DNA, 20 bp, Artificial
  CRISPR gRNA sequence
cttttctagggctgctgtga

SEQ ID NO: 415327 - DNA, 20 bp, Artificial
  CRISPR gRNA sequence
ttctagggctgctgtgacaa

SEQ ID NO: 415328 - DNA, 20 bp, Artificial
  CRISPR gRNA sequence
tctagggctgctgtgacaaa

SEQ ID NO: 415329 - DNA, 20 bp, Artificial
  CRISPR gRNA sequence
ctagggctgctgtgacaaat

SEQ ID NO: 415330 - DNA, 20 bp, Artificial
  CRISPR gRNA sequence
tagggctgctgtgacaaatt

SEQ ID NO: 415331 - DNA, 20 bp, Artificial
  CRISPR gRNA sequence
gggctgctgtgacaaattac

SEQ ID NO: 415332 - DNA, 20 bp, Artificial
  CRISPR gRNA sequence
ctgtgacaaattaccaaaac

SEQ ID NO: 415333 - DNA, 20 bp, Artificial
  CRISPR gRNA sequence
tgacaaattaccaaaacggg

SEQ ID NO: 415334 - DNA, 20 bp, Artificial
  CRISPR gRNA sequence
ccaaaacggggtggcttaaa

SEQ ID NO: 415335 - DNA, 20 bp, Artificial
  CRISPR gRNA sequence
aaaacaacagaaatctattc

SEQ ID NO: 415336 - DNA, 20 bp, Artificial
  CRISPR gRNA sequence
aaacaacagaaatctattct

SEQ ID NO: 415337 - DNA, 20 bp, Artificial
  CRISPR gRNA sequence
ttcttccataattctggagg

SEQ ID NO: 415338 - DNA, 20 bp, Artificial
  CRISPR gRNA sequence
ttccataattctggagggtt

SEQ ID NO: 415339 - DNA, 20 bp, Artificial
  CRISPR gRNA sequence
ccataattctggagggttga

SEQ ID NO: 415340 - DNA, 20 bp, Artificial
  CRISPR gRNA sequence
cataattctggagggttgaa

SEQ ID NO: 415341 - DNA, 20 bp, Artificial
  CRISPR gRNA sequence
tggagggttgaagtacaaga

SEQ ID NO: 415342 - DNA, 20 bp, Artificial
  CRISPR gRNA sequence
gagggttgaagtacaagaaa

SEQ ID NO: 415343 - DNA, 20 bp, Artificial
  CRISPR gRNA sequence
aagtacaagaaacagtgtca

SEQ ID NO: 415344 - DNA, 20 bp, Artificial
  CRISPR gRNA sequence
gtttcttcgtgggatgagaa

SEQ ID NO: 415345 - DNA, 20 bp, Artificial
  CRISPR gRNA sequence
cttcgtgggatgagaatcca

SEQ ID NO: 415346 - DNA, 20 bp, Artificial
  CRISPR gRNA sequence
ttcgtgggatgagaatccat

SEQ ID NO: 415347 - DNA, 20 bp, Artificial
  CRISPR gRNA sequence
cgtgggatgagaatccatcc

SEQ ID NO: 415348 - DNA, 20 bp, Artificial
  CRISPR gRNA sequence
gtgggatgagaatccatccc

SEQ ID NO: 415349 - DNA, 20 bp, Artificial
  CRISPR gRNA sequence
ctatccagcttctagtggag

SEQ ID NO: 415350 - DNA, 20 bp, Artificial
  CRISPR gRNA sequence
tatccagcttctagtggagc

SEQ ID NO: 415351 - DNA, 20 bp, Artificial
  CRISPR gRNA sequence
tccagcttctagtggagctg

SEQ ID NO: 415352 - DNA, 20 bp, Artificial
  CRISPR gRNA sequence
ctagtggagctgtcgatcct

SEQ ID NO: 415353 - DNA, 20 bp, Artificial
  CRISPR gRNA sequence
tagtggagctgtcgatcctt

SEQ ID NO: 415354 - DNA, 20 bp, Artificial
  CRISPR gRNA sequence
gtggagctgtcgatccttgg

SEQ ID NO: 415355 - DNA, 20 bp, Artificial
  CRISPR gRNA sequence
tcgatccttggctggtagac

SEQ ID NO: 415356 - DNA, 20 bp, Artificial
  CRISPR gRNA sequence
ggctggtagacacatcgctc

SEQ ID NO: 415357 - DNA, 20 bp, Artificial
  CRISPR gRNA sequence
gctggtagacacatcgctcc

SEQ ID NO: 415358 - DNA, 20 bp, Artificial
  CRISPR gRNA sequence
gtagacacatcgctccaatc

SEQ ID NO: 415359 - DNA, 20 bp, Artificial
  CRISPR gRNA sequence
caatctctgcccctctcatc

SEQ ID NO: 415360 - DNA, 20 bp, Artificial
  CRISPR gRNA sequence
tgcccctctcatcactgttc

SEQ ID NO: 415361 - DNA, 20 bp, Artificial
  CRISPR gRNA sequence
cccctctcatcactgttctc

SEQ ID NO: 415362 - DNA, 20 bp, Artificial
  CRISPR gRNA sequence
tcatcactgttctcagctgt

SEQ ID NO: 415363 - DNA, 20 bp, Artificial
  CRISPR gRNA sequence
atcactgttctcagctgtgt

SEQ ID NO: 415364 - DNA, 20 bp, Artificial
  CRISPR gRNA sequence
ttctcagctgtgtgtgtgtg

SEQ ID NO: 415365 - DNA, 20 bp, Artificial
  CRISPR gRNA sequence
tcagctgtgtgtgtgtgtct

SEQ ID NO: 415366 - DNA, 20 bp, Artificial
  CRISPR gRNA sequence
agctgtgtgtgtgtgtctgc

SEQ ID NO: 415367 - DNA, 20 bp, Artificial
  CRISPR gRNA sequence
tgtgtgtgtgtctgccttcc

SEQ ID NO: 415368 - DNA, 20 bp, Artificial
  CRISPR gRNA sequence
ccttccttcttttcttatgg

SEQ ID NO: 415369 - DNA, 20 bp, Artificial
  CRISPR gRNA sequence
ccttcttttcttatggagac

SEQ ID NO: 415370 - DNA, 20 bp, Artificial
  CRISPR gRNA sequence
cttcttttcttatggagacc

SEQ ID NO: 415371 - DNA, 20 bp, Artificial
  CRISPR gRNA sequence
cttttcttatggagacccca

SEQ ID NO: 415372 - DNA, 20 bp, Artificial
  CRISPR gRNA sequence
ttttcttatggagaccccag

SEQ ID NO: 415373 - DNA, 20 bp, Artificial
  CRISPR gRNA sequence
ttcttatggagaccccagtt

SEQ ID NO: 415374 - DNA, 20 bp, Artificial
  CRISPR gRNA sequence
tcttatggagaccccagtta

SEQ ID NO: 415375 - DNA, 20 bp, Artificial
  CRISPR gRNA sequence
cttatggagaccccagttat

SEQ ID NO: 415376 - DNA, 20 bp, Artificial
  CRISPR gRNA sequence
ttatggagaccccagttatc

SEQ ID NO: 415377 - DNA, 20 bp, Artificial
  CRISPR gRNA sequence
atggagaccccagttatctt

SEQ ID NO: 415378 - DNA, 20 bp, Artificial
  CRISPR gRNA sequence
tggagaccccagttatcttg

SEQ ID NO: 415379 - DNA, 20 bp, Artificial
  CRISPR gRNA sequence
tcttggacttaaaggcccac

SEQ ID NO: 415380 - DNA, 20 bp, Artificial
  CRISPR gRNA sequence
ggacttaaaggcccacccct

SEQ ID NO: 415381 - DNA, 20 bp, Artificial
  CRISPR gRNA sequence
gacttaaaggcccacccctc

SEQ ID NO: 415382 - DNA, 20 bp, Artificial
  CRISPR gRNA sequence
aaaggcccacccctctccag

SEQ ID NO: 415383 - DNA, 20 bp, Artificial
  CRISPR gRNA sequence
aaggcccacccctctccagc

SEQ ID NO: 415384 - DNA, 20 bp, Artificial
  CRISPR gRNA sequence
tccagcacagcgttgtttga

SEQ ID NO: 415385 - DNA, 20 bp, Artificial
  CRISPR gRNA sequence
cagcacagcgttgtttgagc

SEQ ID NO: 415386 - DNA, 20 bp, Artificial
  CRISPR gRNA sequence
tttgagcttagctaattaca

SEQ ID NO: 415387 - DNA, 20 bp, Artificial
  CRISPR gRNA sequence
gagcttagctaattacaagg

SEQ ID NO: 415388 - DNA, 20 bp, Artificial
  CRISPR gRNA sequence
agcttagctaattacaagga

SEQ ID NO: 415389 - DNA, 20 bp, Artificial
  CRISPR gRNA sequence
agctaattacaaggatccta

SEQ ID NO: 415390 - DNA, 20 bp, Artificial
  CRISPR gRNA sequence
gctaattacaaggatcctat

SEQ ID NO: 415391 - DNA, 20 bp, Artificial
  CRISPR gRNA sequence
attacaaggatcctattttc

SEQ ID NO: 415392 - DNA, 20 bp, Artificial
  CRISPR gRNA sequence
caaggatcctattttcaaat

SEQ ID NO: 415393 - DNA, 20 bp, Artificial
  CRISPR gRNA sequence
ttttcaaatgaggtcacatt

SEQ ID NO: 415394 - DNA, 20 bp, Artificial
  CRISPR gRNA sequence
tcaaatgaggtcacattatg

SEQ ID NO: 415395 - DNA, 20 bp, Artificial
  CRISPR gRNA sequence
caaatgaggtcacattatga

SEQ ID NO: 415396 - DNA, 20 bp, Artificial
  CRISPR gRNA sequence
aaatgaggtcacattatgag

SEQ ID NO: 415397 - DNA, 20 bp, Artificial
  CRISPR gRNA sequence
tgaggttctgaggaggacat

SEQ ID NO: 415398 - DNA, 20 bp, Artificial
  CRISPR gRNA sequence
tgaggaggacatgaatttgc

SEQ ID NO: 415399 - DNA, 20 bp, Artificial
  CRISPR gRNA sequence
aggaggacatgaatttgcag

SEQ ID NO: 415400 - DNA, 20 bp, Artificial
  CRISPR gRNA sequence
gcaggggacagtatccaacc

SEQ ID NO: 415401 - DNA, 20 bp, Artificial
  CRISPR gRNA sequence
caggggacagtatccaaccc

SEQ ID NO: 415402 - DNA, 20 bp, Artificial
  CRISPR gRNA sequence
ttatgtcataaggttattgt

SEQ ID NO: 415403 - DNA, 20 bp, Artificial
  CRISPR gRNA sequence
tatgtcataaggttattgtg

SEQ ID NO: 415404 - DNA, 20 bp, Artificial
  CRISPR gRNA sequence
atgtcataaggttattgtga

SEQ ID NO: 415405 - DNA, 20 bp, Artificial
  CRISPR gRNA sequence
tgtcataaggttattgtgat

SEQ ID NO: 415406 - DNA, 20 bp, Artificial
  CRISPR gRNA sequence
ttgtgatggttaaattgcat

SEQ ID NO: 415407 - DNA, 20 bp, Artificial
  CRISPR gRNA sequence
tgatggttaaattgcataaa

SEQ ID NO: 415408 - DNA, 20 bp, Artificial
  CRISPR gRNA sequence
aattgcataaaagaaccaga

SEQ ID NO: 415409 - DNA, 20 bp, Artificial
  CRISPR gRNA sequence
cataaaagaaccagaagcgt

SEQ ID NO: 415410 - DNA, 20 bp, Artificial
  CRISPR gRNA sequence
attattattattatctttgg

SEQ ID NO: 415411 - DNA, 20 bp, Artificial
  CRISPR gRNA sequence
ttattattatctttggaggt

SEQ ID NO: 415412 - DNA, 20 bp, Artificial
  CRISPR gRNA sequence
ttattatctttggaggtaag

SEQ ID NO: 415413 - DNA, 20 bp, Artificial
  CRISPR gRNA sequence
ttatctttggaggtaagtta

SEQ ID NO: 415414 - DNA, 20 bp, Artificial
  CRISPR gRNA sequence
tctttggaggtaagttatta

SEQ ID NO: 415415 - DNA, 20 bp, Artificial
  CRISPR gRNA sequence
tggaggtaagttattagtgt

SEQ ID NO: 415416 - DNA, 20 bp, Artificial
  CRISPR gRNA sequence
ggaggtaagttattagtgta

SEQ ID NO: 415417 - DNA, 20 bp, Artificial
  CRISPR gRNA sequence
gaggtaagttattagtgtat

SEQ ID NO: 415418 - DNA, 20 bp, Artificial
  CRISPR gRNA sequence
ttagtgtatacttatacaac

SEQ ID NO: 415419 - DNA, 20 bp, Artificial
  CRISPR gRNA sequence
gtgtatacttatacaaccaa

SEQ ID NO: 415420 - DNA, 20 bp, Artificial
  CRISPR gRNA sequence
atacaaccaaagaacttttt

SEQ ID NO: 415421 - DNA, 20 bp, Artificial
  CRISPR gRNA sequence
tacaaccaaagaactttttt

SEQ ID NO: 415422 - DNA, 20 bp, Artificial
  CRISPR gRNA sequence
ttttatttccttatgggctg

SEQ ID NO: 415423 - DNA, 20 bp, Artificial
  CRISPR gRNA sequence
tttatttccttatgggctgc

SEQ ID NO: 415424 - DNA, 20 bp, Artificial
  CRISPR gRNA sequence
ttatttccttatgggctgca

SEQ ID NO: 415425 - DNA, 20 bp, Artificial
  CRISPR gRNA sequence
tatttccttatgggctgcag

SEQ ID NO: 415426 - DNA, 20 bp, Artificial
  CRISPR gRNA sequence
atttccttatgggctgcagg

SEQ ID NO: 415427 - DNA, 20 bp, Artificial
  CRISPR gRNA sequence
tttccttatgggctgcagga

SEQ ID NO: 415428 - DNA, 20 bp, Artificial
  CRISPR gRNA sequence
ccttatgggctgcaggagtt

SEQ ID NO: 415429 - DNA, 20 bp, Artificial
  CRISPR gRNA sequence
cttatgggctgcaggagttt

SEQ ID NO: 415430 - DNA, 20 bp, Artificial
  CRISPR gRNA sequence
atgggctgcaggagtttgat

SEQ ID NO: 415431 - DNA, 20 bp, Artificial
  CRISPR gRNA sequence
tgggctgcaggagtttgatg

SEQ ID NO: 415432 - DNA, 20 bp, Artificial
  CRISPR gRNA sequence
caggagtttgatgagctgta

SEQ ID NO: 415433 - DNA, 20 bp, Artificial
  CRISPR gRNA sequence
gatgagctgtaaaagtttct

SEQ ID NO: 415434 - DNA, 20 bp, Artificial
  CRISPR gRNA sequence
atgagctgtaaaagtttctt

SEQ ID NO: 415435 - DNA, 20 bp, Artificial
  CRISPR gRNA sequence
taaaagtttcttccttattc

SEQ ID NO: 415436 - DNA, 20 bp, Artificial
  CRISPR gRNA sequence
cttccttattctgccttgct

SEQ ID NO: 415437 - DNA, 20 bp, Artificial
  CRISPR gRNA sequence
ttccttattctgccttgctg

SEQ ID NO: 415438 - DNA, 20 bp, Artificial
  CRISPR gRNA sequence
ccttattctgccttgctgct

SEQ ID NO: 415439 - DNA, 20 bp, Artificial
  CRISPR gRNA sequence
cttattctgccttgctgctg

SEQ ID NO: 415440 - DNA, 20 bp, Artificial
  CRISPR gRNA sequence
attctgccttgctgctgccc

SEQ ID NO: 415441 - DNA, 20 bp, Artificial
  CRISPR gRNA sequence
ttctgccttgctgctgcccc

SEQ ID NO: 415442 - DNA, 20 bp, Artificial
  CRISPR gRNA sequence
tgccttgctgctgcccctta

SEQ ID NO: 415443 - DNA, 20 bp, Artificial
  CRISPR gRNA sequence
ccttgctgctgccccttagt

SEQ ID NO: 415444 - DNA, 20 bp, Artificial
  CRISPR gRNA sequence
gctgctgccccttagtgttt

SEQ ID NO: 415445 - DNA, 20 bp, Artificial
  CRISPR gRNA sequence
ctgctgccccttagtgttta

SEQ ID NO: 415446 - DNA, 20 bp, Artificial
  CRISPR gRNA sequence
ctgccccttagtgtttaact

SEQ ID NO: 415447 - DNA, 20 bp, Artificial
  CRISPR gRNA sequence
ccccttagtgtttaactaaa

SEQ ID NO: 415448 - DNA, 20 bp, Artificial
  CRISPR gRNA sequence
agtgtttaactaaaagacta

SEQ ID NO: 415449 - DNA, 20 bp, Artificial
  CRISPR gRNA sequence
gtgtttaactaaaagactag

SEQ ID NO: 415450 - DNA, 20 bp, Artificial
  CRISPR gRNA sequence
aactaaaagactagaaactt

SEQ ID NO: 415451 - DNA, 20 bp, Artificial
  CRISPR gRNA sequence
actaaaagactagaaacttc

SEQ ID NO: 415452 - DNA, 20 bp, Artificial
  CRISPR gRNA sequence
aaagactagaaacttccttc

SEQ ID NO: 415453 - DNA, 20 bp, Artificial
  CRISPR gRNA sequence
gaaacttccttctgggtttg

SEQ ID NO: 415454 - DNA, 20 bp, Artificial
  CRISPR gRNA sequence
ccttctgggtttgcagataa

SEQ ID NO: 415455 - DNA, 20 bp, Artificial
  CRISPR gRNA sequence
cttctgggtttgcagataag

SEQ ID NO: 415456 - DNA, 20 bp, Artificial
  CRISPR gRNA sequence
ctgggtttgcagataagagg

SEQ ID NO: 415457 - DNA, 20 bp, Artificial
  CRISPR gRNA sequence
tgggtttgcagataagaggg

SEQ ID NO: 415458 - DNA, 20 bp, Artificial
  CRISPR gRNA sequence
ggtttgcagataagagggat

SEQ ID NO: 415459 - DNA, 20 bp, Artificial
  CRISPR gRNA sequence
gcagataagagggatatgta

SEQ ID NO: 415460 - DNA, 20 bp, Artificial
  CRISPR gRNA sequence
cagataagagggatatgtat

SEQ ID NO: 415461 - DNA, 20 bp, Artificial
  CRISPR gRNA sequence
tcatgctcgttatccccact

SEQ ID NO: 415462 - DNA, 20 bp, Artificial
  CRISPR gRNA sequence
catgctcgttatccccacta

SEQ ID NO: 415463 - DNA, 20 bp, Artificial
  CRISPR gRNA sequence
atgctcgttatccccactat

SEQ ID NO: 415464 - DNA, 20 bp, Artificial
  CRISPR gRNA sequence
gttatccccactatacttca

SEQ ID NO: 415465 - DNA, 20 bp, Artificial
  CRISPR gRNA sequence
tccccactatacttcaaatc

SEQ ID NO: 415466 - DNA, 20 bp, Artificial
  CRISPR gRNA sequence
tacttcaaatctcttccttt

SEQ ID NO: 415467 - DNA, 20 bp, Artificial
  CRISPR gRNA sequence
caaatctcttcctttaatgc

SEQ ID NO: 415468 - DNA, 20 bp, Artificial
  CRISPR gRNA sequence
aaatctcttcctttaatgca

SEQ ID NO: 415469 - DNA, 20 bp, Artificial
  CRISPR gRNA sequence
ttcctttaatgcatagcatc

SEQ ID NO: 415470 - DNA, 20 bp, Artificial
  CRISPR gRNA sequence
cctttaatgcatagcatcct

SEQ ID NO: 415471 - DNA, 20 bp, Artificial
  CRISPR gRNA sequence
ctttaatgcatagcatcctg

SEQ ID NO: 415472 - DNA, 20 bp, Artificial
  CRISPR gRNA sequence
taatgcatagcatcctgttt

SEQ ID NO: 415473 - DNA, 20 bp, Artificial
  CRISPR gRNA sequence
aatgcatagcatcctgttta

SEQ ID NO: 415474 - DNA, 20 bp, Artificial
  CRISPR gRNA sequence
atgcatagcatcctgtttat

SEQ ID NO: 415475 - DNA, 20 bp, Artificial
  CRISPR gRNA sequence
tttatgaaatttcacaaaaa

SEQ ID NO: 415476 - DNA, 20 bp, Artificial
  CRISPR gRNA sequence
atgaaatttcacaaaaaaag

SEQ ID NO: 415477 - DNA, 20 bp, Artificial
  CRISPR gRNA sequence
tgaaatttcacaaaaaaagt

SEQ ID NO: 415478 - DNA, 20 bp, Artificial
  CRISPR gRNA sequence
cacaaaaaaagttgctatgg

SEQ ID NO: 415479 - DNA, 20 bp, Artificial
  CRISPR gRNA sequence
acaaaaaaagttgctatgga

SEQ ID NO: 415480 - DNA, 20 bp, Artificial
  CRISPR gRNA sequence
ctatggattgaacatttatg

SEQ ID NO: 415481 - DNA, 20 bp, Artificial
  CRISPR gRNA sequence
tggattgaacatttatgtct

SEQ ID NO: 415482 - DNA, 20 bp, Artificial
  CRISPR gRNA sequence
aacatttatgtcttcccaac

SEQ ID NO: 415483 - DNA, 20 bp, Artificial
  CRISPR gRNA sequence
atgtcttcccaacattcata

SEQ ID NO: 415484 - DNA, 20 bp, Artificial
  CRISPR gRNA sequence
tgtcttcccaacattcatat

SEQ ID NO: 415485 - DNA, 20 bp, Artificial
  CRISPR gRNA sequence
cccaacattcatatgttgaa

SEQ ID NO: 415486 - DNA, 20 bp, Artificial
  CRISPR gRNA sequence
ccaacattcatatgttgaaa

SEQ ID NO: 415487 - DNA, 20 bp, Artificial
  CRISPR gRNA sequence
atatgttgaaatcctaatgc

SEQ ID NO: 415488 - DNA, 20 bp, Artificial
  CRISPR gRNA sequence
aaatcctaatgcctaatgcg

SEQ ID NO: 415489 - DNA, 20 bp, Artificial
  CRISPR gRNA sequence
atgcctaatgcgatgatatt

SEQ ID NO: 415490 - DNA, 20 bp, Artificial
  CRISPR gRNA sequence
atgcgatgatattaggaggt

SEQ ID NO: 415491 - DNA, 20 bp, Artificial
  CRISPR gRNA sequence
ggaggtggagactttgggat

SEQ ID NO: 415492 - DNA, 20 bp, Artificial
  CRISPR gRNA sequence
tgggatgtaattagatcatg

SEQ ID NO: 415493 - DNA, 20 bp, Artificial
  CRISPR gRNA sequence
gggatgtaattagatcatga

SEQ ID NO: 415494 - DNA, 20 bp, Artificial
  CRISPR gRNA sequence
ggatgtaattagatcatgag

SEQ ID NO: 415495 - DNA, 20 bp, Artificial
  CRISPR gRNA sequence
gatcatgagggtggcgtctt

SEQ ID NO: 415496 - DNA, 20 bp, Artificial
  CRISPR gRNA sequence
cgtgaatgggatcagtgcct

SEQ ID NO: 415497 - DNA, 20 bp, Artificial
  CRISPR gRNA sequence
gtgaatgggatcagtgcctt

SEQ ID NO: 415498 - DNA, 20 bp, Artificial
  CRISPR gRNA sequence
tttaaggacagaagagcttg

SEQ ID NO: 415499 - DNA, 20 bp, Artificial
  CRISPR gRNA sequence
ttaaggacagaagagcttgc

SEQ ID NO: 415500 - DNA, 20 bp, Artificial
  CRISPR gRNA sequence
taaggacagaagagcttgct

SEQ ID NO: 415501 - DNA, 20 bp, Artificial
  CRISPR gRNA sequence
aaggacagaagagcttgctt

SEQ ID NO: 415502 - DNA, 20 bp, Artificial
  CRISPR gRNA sequence
aggacagaagagcttgcttc

SEQ ID NO: 415503 - DNA, 20 bp, Artificial
  CRISPR gRNA sequence
gcttcctctttctgctcttt

SEQ ID NO: 415504 - DNA, 20 bp, Artificial
  CRISPR gRNA sequence
cttcctctttctgctctttg

SEQ ID NO: 415505 - DNA, 20 bp, Artificial
  CRISPR gRNA sequence
cctctttctgctctttgcaa

SEQ ID NO: 415506 - DNA, 20 bp, Artificial
  CRISPR gRNA sequence
ctctttctgctctttgcaat

SEQ ID NO: 415507 - DNA, 20 bp, Artificial
  CRISPR gRNA sequence
tttctgctctttgcaatgtg

SEQ ID NO: 415508 - DNA, 20 bp, Artificial
  CRISPR gRNA sequence
tctgctctttgcaatgtgag

SEQ ID NO: 415509 - DNA, 20 bp, Artificial
  CRISPR gRNA sequence
ctgctctttgcaatgtgagg

SEQ ID NO: 415510 - DNA, 20 bp, Artificial
  CRISPR gRNA sequence
tgctctttgcaatgtgagga

SEQ ID NO: 415511 - DNA, 20 bp, Artificial
  CRISPR gRNA sequence
ctctttgcaatgtgaggata

SEQ ID NO: 415512 - DNA, 20 bp, Artificial
  CRISPR gRNA sequence
tttgcaatgtgaggatactg

SEQ ID NO: 415513 - DNA, 20 bp, Artificial
  CRISPR gRNA sequence
tgcaatgtgaggatactgag

SEQ ID NO: 415514 - DNA, 20 bp, Artificial
  CRISPR gRNA sequence
gcaatgtgaggatactgaga

SEQ ID NO: 415515 - DNA, 20 bp, Artificial
  CRISPR gRNA sequence
caatgtgaggatactgagaa

SEQ ID NO: 415516 - DNA, 20 bp, Artificial
  CRISPR gRNA sequence
agaagacagttgtctgcaaa

SEQ ID NO: 415517 - DNA, 20 bp, Artificial
  CRISPR gRNA sequence
tctgcaaaccaagaaacagg

SEQ ID NO: 415518 - DNA, 20 bp, Artificial
  CRISPR gRNA sequence
caaaccaagaaacaggcccg

SEQ ID NO: 415519 - DNA, 20 bp, Artificial
  CRISPR gRNA sequence
actggactcttttttttttc

SEQ ID NO: 415520 - DNA, 20 bp, Artificial
  CRISPR gRNA sequence
gactcttttttttttctcaa

SEQ ID NO: 415521 - DNA, 20 bp, Artificial
  CRISPR gRNA sequence
ttttttttttctcaagttag

SEQ ID NO: 415522 - DNA, 20 bp, Artificial
  CRISPR gRNA sequence
ttttttttctcaagttagga

SEQ ID NO: 415523 - DNA, 20 bp, Artificial
  CRISPR gRNA sequence
tttttttctcaagttaggaa

SEQ ID NO: 415524 - DNA, 20 bp, Artificial
  CRISPR gRNA sequence
ttttttctcaagttaggaaa

SEQ ID NO: 415525 - DNA, 20 bp, Artificial
  CRISPR gRNA sequence
tttttctcaagttaggaaaa

SEQ ID NO: 415526 - DNA, 20 bp, Artificial
  CRISPR gRNA sequence
ttttctcaagttaggaaaat

SEQ ID NO: 415527 - DNA, 20 bp, Artificial
  CRISPR gRNA sequence
tttctcaagttaggaaaata

SEQ ID NO: 415528 - DNA, 20 bp, Artificial
  CRISPR gRNA sequence
ttctcaagttaggaaaatat

SEQ ID NO: 415529 - DNA, 20 bp, Artificial
  CRISPR gRNA sequence
tctcaagttaggaaaatatt

SEQ ID NO: 415530 - DNA, 20 bp, Artificial
  CRISPR gRNA sequence
ctcaagttaggaaaatattt

SEQ ID NO: 415531 - DNA, 20 bp, Artificial
  CRISPR gRNA sequence
tcaagttaggaaaatatttt

SEQ ID NO: 415532 - DNA, 20 bp, Artificial
  CRISPR gRNA sequence
aagttaggaaaatattttct

SEQ ID NO: 415533 - DNA, 20 bp, Artificial
  CRISPR gRNA sequence
ggaaaatattttcttaatct

SEQ ID NO: 415534 - DNA, 20 bp, Artificial
  CRISPR gRNA sequence
tcttaatcttggacttccca

SEQ ID NO: 415535 - DNA, 20 bp, Artificial
  CRISPR gRNA sequence
cttaatcttggacttcccag

SEQ ID NO: 415536 - DNA, 20 bp, Artificial
  CRISPR gRNA sequence
ttaatcttggacttcccagc

SEQ ID NO: 415537 - DNA, 20 bp, Artificial
  CRISPR gRNA sequence
aatcttggacttcccagcct

SEQ ID NO: 415538 - DNA, 20 bp, Artificial
  CRISPR gRNA sequence
atcttggacttcccagcctc

SEQ ID NO: 415539 - DNA, 20 bp, Artificial
  CRISPR gRNA sequence
ggacttcccagcctccagaa

SEQ ID NO: 415540 - DNA, 20 bp, Artificial
  CRISPR gRNA sequence
gacttcccagcctccagaac

SEQ ID NO: 415541 - DNA, 20 bp, Artificial
  CRISPR gRNA sequence
cccagcctccagaactgtga

SEQ ID NO: 415542 - DNA, 20 bp, Artificial
  CRISPR gRNA sequence
ccagcctccagaactgtgag

SEQ ID NO: 415543 - DNA, 20 bp, Artificial
  CRISPR gRNA sequence
cagaactgtgaggaataagt

SEQ ID NO: 415544 - DNA, 20 bp, Artificial
  CRISPR gRNA sequence
tgaggaataagtgtttgtgg

SEQ ID NO: 415545 - DNA, 20 bp, Artificial
  CRISPR gRNA sequence
gtggtttaagcaacccagtc

SEQ ID NO: 415546 - DNA, 20 bp, Artificial
  CRISPR gRNA sequence
tggtttaagcaacccagtct

SEQ ID NO: 415547 - DNA, 20 bp, Artificial
  CRISPR gRNA sequence
aagcaacccagtctacagta

SEQ ID NO: 415548 - DNA, 20 bp, Artificial
  CRISPR gRNA sequence
agcaacccagtctacagtat

SEQ ID NO: 415549 - DNA, 20 bp, Artificial
  CRISPR gRNA sequence
cagtattttgttacagcagc

SEQ ID NO: 415550 - DNA, 20 bp, Artificial
  CRISPR gRNA sequence
tgttacagcagcccaaacta

SEQ ID NO: 415551 - DNA, 20 bp, Artificial
  CRISPR gRNA sequence
gttacagcagcccaaactaa

SEQ ID NO: 415552 - DNA, 20 bp, Artificial
  CRISPR gRNA sequence
ttacagcagcccaaactaag

SEQ ID NO: 415553 - DNA, 20 bp, Artificial
  CRISPR gRNA sequence
cagcagcccaaactaagaca

SEQ ID NO: 415554 - DNA, 20 bp, Artificial
  CRISPR gRNA sequence
agacaaaaaattccccaatt

SEQ ID NO: 415555 - DNA, 20 bp, Artificial
  CRISPR gRNA sequence
cccaattcctagccaaaagt

SEQ ID NO: 415556 - DNA, 20 bp, Artificial
  CRISPR gRNA sequence
ctagccaaaagtatataaat

SEQ ID NO: 415557 - DNA, 20 bp, Artificial
  CRISPR gRNA sequence
gccaaaagtatataaatttc

SEQ ID NO: 415558 - DNA, 20 bp, Artificial
  CRISPR gRNA sequence
cttttcattttaactattcg

SEQ ID NO: 415559 - DNA, 20 bp, Artificial
  CRISPR gRNA sequence
ttttcattttaactattcgc

SEQ ID NO: 415560 - DNA, 20 bp, Artificial
  CRISPR gRNA sequence
ttcattttaactattcgcag

SEQ ID NO: 415561 - DNA, 20 bp, Artificial
  CRISPR gRNA sequence
tcattttaactattcgcagt

SEQ ID NO: 415562 - DNA, 20 bp, Artificial
  CRISPR gRNA sequence
cattttaactattcgcagtg

SEQ ID NO: 415563 - DNA, 20 bp, Artificial
  CRISPR gRNA sequence
attttaactattcgcagtgg

SEQ ID NO: 415564 - DNA, 20 bp, Artificial
  CRISPR gRNA sequence
taactattcgcagtggaatt

SEQ ID NO: 415565 - DNA, 20 bp, Artificial
  CRISPR gRNA sequence
aactattcgcagtggaattc

SEQ ID NO: 415566 - DNA, 20 bp, Artificial
  CRISPR gRNA sequence
actattcgcagtggaattct

SEQ ID NO: 415567 - DNA, 20 bp, Artificial
  CRISPR gRNA sequence
ttcgcagtggaattctacat

SEQ ID NO: 415568 - DNA, 20 bp, Artificial
  CRISPR gRNA sequence
gcagtggaattctacatggc

SEQ ID NO: 415569 - DNA, 20 bp, Artificial
  CRISPR gRNA sequence
tacatggccacaagccaagt

SEQ ID NO: 415570 - DNA, 20 bp, Artificial
  CRISPR gRNA sequence
catggccacaagccaagtac

SEQ ID NO: 415571 - DNA, 20 bp, Artificial
  CRISPR gRNA sequence
aaaaggttctgacaatccaa

SEQ ID NO: 415572 - DNA, 20 bp, Artificial
  CRISPR gRNA sequence
tgacaatccaacatgtgttc

SEQ ID NO: 415573 - DNA, 20 bp, Artificial
  CRISPR gRNA sequence
acaatccaacatgtgttcat

SEQ ID NO: 415574 - DNA, 20 bp, Artificial
  CRISPR gRNA sequence
atcagatgccttcataattt

SEQ ID NO: 415575 - DNA, 20 bp, Artificial
  CRISPR gRNA sequence
cataatttatcagtttaact

SEQ ID NO: 415576 - DNA, 20 bp, Artificial
  CRISPR gRNA sequence
ataatttatcagtttaactt

SEQ ID NO: 415577 - DNA, 20 bp, Artificial
  CRISPR gRNA sequence
atcagtttaactttttattt

SEQ ID NO: 415578 - DNA, 20 bp, Artificial
  CRISPR gRNA sequence
tcagtttaactttttattta

SEQ ID NO: 415579 - DNA, 20 bp, Artificial
  CRISPR gRNA sequence
aactttttatttattaagta

SEQ ID NO: 415580 - DNA, 20 bp, Artificial
  CRISPR gRNA sequence
actttttatttattaagtag

SEQ ID NO: 415581 - DNA, 20 bp, Artificial
  CRISPR gRNA sequence
tttatttattaagtagttac

SEQ ID NO: 415582 - DNA, 20 bp, Artificial
  CRISPR gRNA sequence
ttatttattaagtagttact

SEQ ID NO: 415583 - DNA, 20 bp, Artificial
  CRISPR gRNA sequence
tatttattaagtagttactt

SEQ ID NO: 415584 - DNA, 20 bp, Artificial
  CRISPR gRNA sequence
atttattaagtagttacttt

SEQ ID NO: 415585 - DNA, 20 bp, Artificial
  CRISPR gRNA sequence
tttattaagtagttactttt

SEQ ID NO: 415586 - DNA, 20 bp, Artificial
  CRISPR gRNA sequence
attaagtagttacttttgca

SEQ ID NO: 415587 - DNA, 20 bp, Artificial
  CRISPR gRNA sequence
ttaagtagttacttttgcaa

SEQ ID NO: 415588 - DNA, 20 bp, Artificial
  CRISPR gRNA sequence
agtagttacttttgcaaaaa

SEQ ID NO: 415589 - DNA, 20 bp, Artificial
  CRISPR gRNA sequence
cttttgcaaaaaatattttt

SEQ ID NO: 415590 - DNA, 20 bp, Artificial
  CRISPR gRNA sequence
ttgcaaaaaatatttttttt

SEQ ID NO: 415591 - DNA, 20 bp, Artificial
  CRISPR gRNA sequence
tgcaaaaaatattttttttg

SEQ ID NO: 415592 - DNA, 20 bp, Artificial
  CRISPR gRNA sequence
gcaaaaaatattttttttgt

SEQ ID NO: 415593 - DNA, 20 bp, Artificial
  CRISPR gRNA sequence
caaaaaatattttttttgtt

SEQ ID NO: 415594 - DNA, 20 bp, Artificial
  CRISPR gRNA sequence
tttttgtttgttggcaaaaa

SEQ ID NO: 415595 - DNA, 20 bp, Artificial
  CRISPR gRNA sequence
ttttgtttgttggcaaaaaa

SEQ ID NO: 415596 - DNA, 20 bp, Artificial
  CRISPR gRNA sequence
tttgtttgttggcaaaaaac

SEQ ID NO: 415597 - DNA, 20 bp, Artificial
  CRISPR gRNA sequence
ttgtttgttggcaaaaaaca

SEQ ID NO: 415598 - DNA, 20 bp, Artificial
  CRISPR gRNA sequence
tgtttgttggcaaaaaacat

SEQ ID NO: 415599 - DNA, 20 bp, Artificial
  CRISPR gRNA sequence
gtttgttggcaaaaaacatg

SEQ ID NO: 415600 - DNA, 20 bp, Artificial
  CRISPR gRNA sequence
tttgttggcaaaaaacatgg

SEQ ID NO: 415601 - DNA, 20 bp, Artificial
  CRISPR gRNA sequence
gttggcaaaaaacatggatt

SEQ ID NO: 415602 - DNA, 20 bp, Artificial
  CRISPR gRNA sequence
ttggcaaaaaacatggattg

SEQ ID NO: 415603 - DNA, 20 bp, Artificial
  CRISPR gRNA sequence
gcaaaaaacatggattgctt

SEQ ID NO: 415604 - DNA, 20 bp, Artificial
  CRISPR gRNA sequence
cttcttgatgccaactgtag

SEQ ID NO: 415605 - DNA, 20 bp, Artificial
  CRISPR gRNA sequence
cttgatgccaactgtagaat

SEQ ID NO: 415606 - DNA, 20 bp, Artificial
  CRISPR gRNA sequence
ttgatgccaactgtagaatc

SEQ ID NO: 415607 - DNA, 20 bp, Artificial
  CRISPR gRNA sequence
gatgccaactgtagaatcaa

SEQ ID NO: 415608 - DNA, 20 bp, Artificial
  CRISPR gRNA sequence
atgccaactgtagaatcaag

SEQ ID NO: 415609 - DNA, 20 bp, Artificial
  CRISPR gRNA sequence
tagaatcaagaaaccttgct

SEQ ID NO: 415610 - DNA, 20 bp, Artificial
  CRISPR gRNA sequence
gctttatttcatcagccact

SEQ ID NO: 415611 - DNA, 20 bp, Artificial
  CRISPR gRNA sequence
ctttatttcatcagccactt

SEQ ID NO: 415612 - DNA, 20 bp, Artificial
  CRISPR gRNA sequence
tatttcatcagccacttcag

SEQ ID NO: 415613 - DNA, 20 bp, Artificial
  CRISPR gRNA sequence
atttcatcagccacttcagc

SEQ ID NO: 415614 - DNA, 20 bp, Artificial
  CRISPR gRNA sequence
tttcatcagccacttcagca

SEQ ID NO: 415615 - DNA, 20 bp, Artificial
  CRISPR gRNA sequence
catcagccacttcagcaaga

SEQ ID NO: 415616 - DNA, 20 bp, Artificial
  CRISPR gRNA sequence
atcagccacttcagcaagaa

SEQ ID NO: 415617 - DNA, 20 bp, Artificial
  CRISPR gRNA sequence
cagcaagaaataaattggtg

SEQ ID NO: 415618 - DNA, 20 bp, Artificial
  CRISPR gRNA sequence
agcaagaaataaattggtgc

SEQ ID NO: 415619 - DNA, 20 bp, Artificial
  CRISPR gRNA sequence
gtgctctgtcatacacaatt

SEQ ID NO: 415620 - DNA, 20 bp, Artificial
  CRISPR gRNA sequence
tgtcatacacaattttggga

SEQ ID NO: 415621 - DNA, 20 bp, Artificial
  CRISPR gRNA sequence
tcatacacaattttgggatt

SEQ ID NO: 415622 - DNA, 20 bp, Artificial
  CRISPR gRNA sequence
tgggattcccttcttcatcc

SEQ ID NO: 415623 - DNA, 20 bp, Artificial
  CRISPR gRNA sequence
gggattcccttcttcatcct

SEQ ID NO: 415624 - DNA, 20 bp, Artificial
  CRISPR gRNA sequence
ggattcccttcttcatcctt

SEQ ID NO: 415625 - DNA, 20 bp, Artificial
  CRISPR gRNA sequence
ccttcttcatccttagcctt

SEQ ID NO: 415626 - DNA, 20 bp, Artificial
  CRISPR gRNA sequence
cttcatccttagcctttgtc

SEQ ID NO: 415627 - DNA, 20 bp, Artificial
  CRISPR gRNA sequence
ttcatccttagcctttgtct

SEQ ID NO: 415628 - DNA, 20 bp, Artificial
  CRISPR gRNA sequence
catccttagcctttgtctac

SEQ ID NO: 415629 - DNA, 20 bp, Artificial
  CRISPR gRNA sequence
atccttagcctttgtctact

SEQ ID NO: 415630 - DNA, 20 bp, Artificial
  CRISPR gRNA sequence
agcctttgtctactcatgcc

SEQ ID NO: 415631 - DNA, 20 bp, Artificial
  CRISPR gRNA sequence
gcctttgtctactcatgcca

SEQ ID NO: 415632 - DNA, 20 bp, Artificial
  CRISPR gRNA sequence
tgtctactcatgccagtcta

SEQ ID NO: 415633 - DNA, 20 bp, Artificial
  CRISPR gRNA sequence
gtctactcatgccagtctag

SEQ ID NO: 415634 - DNA, 20 bp, Artificial
  CRISPR gRNA sequence
tctactcatgccagtctagt

SEQ ID NO: 415635 - DNA, 20 bp, Artificial
  CRISPR gRNA sequence
ctcatgccagtctagtcaca

SEQ ID NO: 415636 - DNA, 20 bp, Artificial
  CRISPR gRNA sequence
atgccagtctagtcacattt

SEQ ID NO: 415637 - DNA, 20 bp, Artificial
  CRISPR gRNA sequence
gtcacatttattgttgtgaa

SEQ ID NO: 415638 - DNA, 20 bp, Artificial
  CRISPR gRNA sequence
attgttgtgaatttggggaa

SEQ ID NO: 415639 - DNA, 20 bp, Artificial
  CRISPR gRNA sequence
ttgttgtgaatttggggaat

SEQ ID NO: 415640 - DNA, 20 bp, Artificial
  CRISPR gRNA sequence
ttgtgaatttggggaatgaa

SEQ ID NO: 415641 - DNA, 20 bp, Artificial
  CRISPR gRNA sequence
tgaatttggggaatgaaagg

SEQ ID NO: 415642 - DNA, 20 bp, Artificial
  CRISPR gRNA sequence
ggggaatgaaagggagcttt

SEQ ID NO: 415643 - DNA, 20 bp, Artificial
  CRISPR gRNA sequence
gggaatgaaagggagctttg

SEQ ID NO: 415644 - DNA, 20 bp, Artificial
  CRISPR gRNA sequence
tgcaacggtctatattaggt

SEQ ID NO: 415645 - DNA, 20 bp, Artificial
  CRISPR gRNA sequence
gcaacggtctatattaggta

SEQ ID NO: 415646 - DNA, 20 bp, Artificial
  CRISPR gRNA sequence
caacggtctatattaggtat

SEQ ID NO: 415647 - DNA, 20 bp, Artificial
  CRISPR gRNA sequence
tattaggtatccaacttttt

SEQ ID NO: 415648 - DNA, 20 bp, Artificial
  CRISPR gRNA sequence
ggtatccaactttttcaggt

SEQ ID NO: 415649 - DNA, 20 bp, Artificial
  CRISPR gRNA sequence
tttcaggtttttgtagaata

SEQ ID NO: 415650 - DNA, 20 bp, Artificial
  CRISPR gRNA sequence
ttcaggtttttgtagaataa

SEQ ID NO: 415651 - DNA, 20 bp, Artificial
  CRISPR gRNA sequence
tcaggtttttgtagaataat

SEQ ID NO: 415652 - DNA, 20 bp, Artificial
  CRISPR gRNA sequence
caggtttttgtagaataata

SEQ ID NO: 415653 - DNA, 20 bp, Artificial
  CRISPR gRNA sequence
aggtttttgtagaataatat

SEQ ID NO: 415654 - DNA, 20 bp, Artificial
  CRISPR gRNA sequence
ttgtagaataatattttgaa

SEQ ID NO: 415655 - DNA, 20 bp, Artificial
  CRISPR gRNA sequence
tgtagaataatattttgaag

SEQ ID NO: 415656 - DNA, 20 bp, Artificial
  CRISPR gRNA sequence
gtagaataatattttgaagg

SEQ ID NO: 415657 - DNA, 20 bp, Artificial
  CRISPR gRNA sequence
tagaataatattttgaagga

SEQ ID NO: 415658 - DNA, 20 bp, Artificial
  CRISPR gRNA sequence
tgaaggattattaaagagtt

SEQ ID NO: 415659 - DNA, 20 bp, Artificial
  CRISPR gRNA sequence
gaaggattattaaagagtta

SEQ ID NO: 415660 - DNA, 20 bp, Artificial
  CRISPR gRNA sequence
aaggattattaaagagttaa

SEQ ID NO: 415661 - DNA, 20 bp, Artificial
  CRISPR gRNA sequence
ttaaagagttaataggttgg

SEQ ID NO: 415662 - DNA, 20 bp, Artificial
  CRISPR gRNA sequence
aagagttaataggttggact

SEQ ID NO: 415663 - DNA, 20 bp, Artificial
  CRISPR gRNA sequence
ataggttggactgtcaaaaa

SEQ ID NO: 415664 - DNA, 20 bp, Artificial
  CRISPR gRNA sequence
gactgtcaaaaaaagacatt

SEQ ID NO: 415665 - DNA, 20 bp, Artificial
  CRISPR gRNA sequence
tcaaaaaaagacattagaac

SEQ ID NO: 415666 - DNA, 20 bp, Artificial
  CRISPR gRNA sequence
gaactacttcattctctttt

SEQ ID NO: 415667 - DNA, 20 bp, Artificial
  CRISPR gRNA sequence
cttcattctcttttttaaaa

SEQ ID NO: 415668 - DNA, 20 bp, Artificial
  CRISPR gRNA sequence
cattctcttttttaaaagat

SEQ ID NO: 415669 - DNA, 20 bp, Artificial
  CRISPR gRNA sequence
attctcttttttaaaagata

SEQ ID NO: 415670 - DNA, 20 bp, Artificial
  CRISPR gRNA sequence
tcttttttaaaagataacct

SEQ ID NO: 415671 - DNA, 20 bp, Artificial
  CRISPR gRNA sequence
ttttttaaaagataacctct

SEQ ID NO: 415672 - DNA, 20 bp, Artificial
  CRISPR gRNA sequence
ttttaaaagataacctctat

SEQ ID NO: 415673 - DNA, 20 bp, Artificial
  CRISPR gRNA sequence
tttaaaagataacctctata

SEQ ID NO: 415674 - DNA, 20 bp, Artificial
  CRISPR gRNA sequence
ttaaaagataacctctataa

SEQ ID NO: 415675 - DNA, 20 bp, Artificial
  CRISPR gRNA sequence
taaaagataacctctataag

SEQ ID NO: 415676 - DNA, 20 bp, Artificial
  CRISPR gRNA sequence
aaaagataacctctataagt

SEQ ID NO: 415677 - DNA, 20 bp, Artificial
  CRISPR gRNA sequence
aaagataacctctataagta

SEQ ID NO: 415678 - DNA, 20 bp, Artificial
  CRISPR gRNA sequence
tataagtaatcatggcactt

SEQ ID NO: 415679 - DNA, 20 bp, Artificial
  CRISPR gRNA sequence
taagtaatcatggcacttga

SEQ ID NO: 415680 - DNA, 20 bp, Artificial
  CRISPR gRNA sequence
gaattttcattttgctttct

SEQ ID NO: 415681 - DNA, 20 bp, Artificial
  CRISPR gRNA sequence
aattttcattttgctttctt

SEQ ID NO: 415682 - DNA, 20 bp, Artificial
  CRISPR gRNA sequence
tcattttgctttcttcttaa

SEQ ID NO: 415683 - DNA, 20 bp, Artificial
  CRISPR gRNA sequence
cattttgctttcttcttaaa

SEQ ID NO: 415684 - DNA, 20 bp, Artificial
  CRISPR gRNA sequence
attttgctttcttcttaaaa

SEQ ID NO: 415685 - DNA, 20 bp, Artificial
  CRISPR gRNA sequence
tgctttcttcttaaaaacac

SEQ ID NO: 415686 - DNA, 20 bp, Artificial
  CRISPR gRNA sequence
gctttcttcttaaaaacact

SEQ ID NO: 415687 - DNA, 20 bp, Artificial
  CRISPR gRNA sequence
ctttcttcttaaaaacacta

SEQ ID NO: 415688 - DNA, 20 bp, Artificial
  CRISPR gRNA sequence
tcttcttaaaaacactaaca

SEQ ID NO: 415689 - DNA, 20 bp, Artificial
  CRISPR gRNA sequence
cttcttaaaaacactaacat

SEQ ID NO: 415690 - DNA, 20 bp, Artificial
  CRISPR gRNA sequence
ttcttaaaaacactaacatc

SEQ ID NO: 415691 - DNA, 20 bp, Artificial
  CRISPR gRNA sequence
cttaaaaacactaacatctg

SEQ ID NO: 415692 - DNA, 20 bp, Artificial
  CRISPR gRNA sequence
ttaaaaacactaacatctgg

SEQ ID NO: 415693 - DNA, 20 bp, Artificial
  CRISPR gRNA sequence
aaaaacactaacatctggct

SEQ ID NO: 415694 - DNA, 20 bp, Artificial
  CRISPR gRNA sequence
aaaacactaacatctggctg

SEQ ID NO: 415695 - DNA, 20 bp, Artificial
  CRISPR gRNA sequence
acatctggctggtcatggtg

SEQ ID NO: 415696 - DNA, 20 bp, Artificial
  CRISPR gRNA sequence
gctggtcatggtggctcacg

SEQ ID NO: 415697 - DNA, 20 bp, Artificial
  CRISPR gRNA sequence
gtcatggtggctcacgcttg

SEQ ID NO: 415698 - DNA, 20 bp, Artificial
  CRISPR gRNA sequence
acgcttgtaatcccaacact

SEQ ID NO: 415699 - DNA, 20 bp, Artificial
  CRISPR gRNA sequence
gtaatcccaacactttggga

SEQ ID NO: 415700 - DNA, 20 bp, Artificial
  CRISPR gRNA sequence
taatcccaacactttgggag

SEQ ID NO: 415701 - DNA, 20 bp, Artificial
  CRISPR gRNA sequence
tgggaggctgaggtgggcgg

SEQ ID NO: 415702 - DNA, 20 bp, Artificial
  CRISPR gRNA sequence
gggaggctgaggtgggcgga

SEQ ID NO: 415703 - DNA, 20 bp, Artificial
  CRISPR gRNA sequence
ggaggctgaggtgggcggat

SEQ ID NO: 415704 - DNA, 20 bp, Artificial
  CRISPR gRNA sequence
aggtgggcggatcgtctgag

SEQ ID NO: 415705 - DNA, 20 bp, Artificial
  CRISPR gRNA sequence
aggtcaggagtttgagacca

SEQ ID NO: 415706 - DNA, 20 bp, Artificial
  CRISPR gRNA sequence
gagaccagcctggccaacat

SEQ ID NO: 415707 - DNA, 20 bp, Artificial
  CRISPR gRNA sequence
agaccagcctggccaacatg

SEQ ID NO: 415708 - DNA, 20 bp, Artificial
  CRISPR gRNA sequence
gccaacatggcgaaactcca

SEQ ID NO: 415709 - DNA, 20 bp, Artificial
  CRISPR gRNA sequence
catctctactaaaaatacaa

SEQ ID NO: 415710 - DNA, 20 bp, Artificial
  CRISPR gRNA sequence
tactaaaaatacaaaaatta

SEQ ID NO: 415711 - DNA, 20 bp, Artificial
  CRISPR gRNA sequence
ctaaaaatacaaaaattagc

SEQ ID NO: 415712 - DNA, 20 bp, Artificial
  CRISPR gRNA sequence
aaaatacaaaaattagctgg

SEQ ID NO: 415713 - DNA, 20 bp, Artificial
  CRISPR gRNA sequence
gctgggcgtgatggtgcttg

SEQ ID NO: 415714 - DNA, 20 bp, Artificial
  CRISPR gRNA sequence
ggcgtgatggtgcttgcctg

SEQ ID NO: 415715 - DNA, 20 bp, Artificial
  CRISPR gRNA sequence
gcctgtaatcccagctactc

SEQ ID NO: 415716 - DNA, 20 bp, Artificial
  CRISPR gRNA sequence
cctgtaatcccagctactcg

SEQ ID NO: 415717 - DNA, 20 bp, Artificial
  CRISPR gRNA sequence
taatcccagctactcgtgag

SEQ ID NO: 415718 - DNA, 20 bp, Artificial
  CRISPR gRNA sequence
ctcgtgaggctgaggcagaa

SEQ ID NO: 415719 - DNA, 20 bp, Artificial
  CRISPR gRNA sequence
gtgaggctgaggcagaattg

SEQ ID NO: 415720 - DNA, 20 bp, Artificial
  CRISPR gRNA sequence
aggcagaattgcttgaacct

SEQ ID NO: 415721 - DNA, 20 bp, Artificial
  CRISPR gRNA sequence
cttgaacctgggaggtgggg

SEQ ID NO: 415722 - DNA, 20 bp, Artificial
  CRISPR gRNA sequence
gaacctgggaggtgggggtt

SEQ ID NO: 415723 - DNA, 20 bp, Artificial
  CRISPR gRNA sequence
aacctgggaggtgggggttg

SEQ ID NO: 415724 - DNA, 20 bp, Artificial
  CRISPR gRNA sequence
ggaggtgggggttgcagtga

SEQ ID NO: 415725 - DNA, 20 bp, Artificial
  CRISPR gRNA sequence
cagtgagcctagattgcgcc

SEQ ID NO: 415726 - DNA, 20 bp, Artificial
  CRISPR gRNA sequence
gattgcgccactgcactcca

SEQ ID NO: 415727 - DNA, 20 bp, Artificial
  CRISPR gRNA sequence
cgccactgcactccagcttg

SEQ ID NO: 415728 - DNA, 20 bp, Artificial
  CRISPR gRNA sequence
cactccagcttgggcaacag

SEQ ID NO: 415729 - DNA, 20 bp, Artificial
  CRISPR gRNA sequence
cagcttgggcaacagagcga

SEQ ID NO: 415730 - DNA, 20 bp, Artificial
  CRISPR gRNA sequence
gggcaacagagcgagactct

SEQ ID NO: 415731 - DNA, 20 bp, Artificial
  CRISPR gRNA sequence
ggcaacagagcgagactctg

SEQ ID NO: 415732 - DNA, 20 bp, Artificial
  CRISPR gRNA sequence
tgactcaaaaaaaccaacaa

SEQ ID NO: 415733 - DNA, 20 bp, Artificial
  CRISPR gRNA sequence
actcaaaaaaaccaacaaca

SEQ ID NO: 415734 - DNA, 20 bp, Artificial
  CRISPR gRNA sequence
aaaaaaaccaacaacactaa

SEQ ID NO: 415735 - DNA, 20 bp, Artificial
  CRISPR gRNA sequence
aggtcaatctaaatttttaa

SEQ ID NO: 415736 - DNA, 20 bp, Artificial
  CRISPR gRNA sequence
aatttttaaattactcatca

SEQ ID NO: 415737 - DNA, 20 bp, Artificial
  CRISPR gRNA sequence
ttaaattactcatcaaaaga

SEQ ID NO: 415738 - DNA, 20 bp, Artificial
  CRISPR gRNA sequence
taaattactcatcaaaagac

SEQ ID NO: 415739 - DNA, 20 bp, Artificial
  CRISPR gRNA sequence
aaattactcatcaaaagacc

SEQ ID NO: 415740 - DNA, 20 bp, Artificial
  CRISPR gRNA sequence
aattactcatcaaaagacct

SEQ ID NO: 415741 - DNA, 20 bp, Artificial
  CRISPR gRNA sequence
ctcatcaaaagacctttctc

SEQ ID NO: 415742 - DNA, 20 bp, Artificial
  CRISPR gRNA sequence
atcaaaagacctttctctag

SEQ ID NO: 415743 - DNA, 20 bp, Artificial
  CRISPR gRNA sequence
tctctagtttcttttgtctc

SEQ ID NO: 415744 - DNA, 20 bp, Artificial
  CRISPR gRNA sequence
ctctagtttcttttgtctct

SEQ ID NO: 415745 - DNA, 20 bp, Artificial
  CRISPR gRNA sequence
tctagtttcttttgtctctt

SEQ ID NO: 415746 - DNA, 20 bp, Artificial
  CRISPR gRNA sequence
tagtttcttttgtctcttaa

SEQ ID NO: 415747 - DNA, 20 bp, Artificial
  CRISPR gRNA sequence
gtttcttttgtctcttaatt

SEQ ID NO: 415748 - DNA, 20 bp, Artificial
  CRISPR gRNA sequence
cttttgtctcttaatttgtc

SEQ ID NO: 415749 - DNA, 20 bp, Artificial
  CRISPR gRNA sequence
ttttgtctcttaatttgtct

SEQ ID NO: 415750 - DNA, 20 bp, Artificial
  CRISPR gRNA sequence
ttgtctcttaatttgtcttt

SEQ ID NO: 415751 - DNA, 20 bp, Artificial
  CRISPR gRNA sequence
tgtctcttaatttgtctttc

SEQ ID NO: 415752 - DNA, 20 bp, Artificial
  CRISPR gRNA sequence
gtctcttaatttgtctttct

SEQ ID NO: 415753 - DNA, 20 bp, Artificial
  CRISPR gRNA sequence
tctcttaatttgtctttctt

SEQ ID NO: 415754 - DNA, 20 bp, Artificial
  CRISPR gRNA sequence
ttaatttgtctttctttttt

SEQ ID NO: 415755 - DNA, 20 bp, Artificial
  CRISPR gRNA sequence
aatttgtctttcttttttca

SEQ ID NO: 415756 - DNA, 20 bp, Artificial
  CRISPR gRNA sequence
atttgtctttcttttttcac

SEQ ID NO: 415757 - DNA, 20 bp, Artificial
  CRISPR gRNA sequence
gtctttcttttttcacacct

SEQ ID NO: 415758 - DNA, 20 bp, Artificial
  CRISPR gRNA sequence
tctttcttttttcacacctg

SEQ ID NO: 415759 - DNA, 20 bp, Artificial
  CRISPR gRNA sequence
tcttttttcacacctgcata

SEQ ID NO: 415760 - DNA, 20 bp, Artificial
  CRISPR gRNA sequence
cttttttcacacctgcatat

SEQ ID NO: 415761 - DNA, 20 bp, Artificial
  CRISPR gRNA sequence
ttttttcacacctgcatatt

SEQ ID NO: 415762 - DNA, 20 bp, Artificial
  CRISPR gRNA sequence
ttttcacacctgcatatttt

SEQ ID NO: 415763 - DNA, 20 bp, Artificial
  CRISPR gRNA sequence
tttcacacctgcatattttc

SEQ ID NO: 415764 - DNA, 20 bp, Artificial
  CRISPR gRNA sequence
ttcacacctgcatattttct

SEQ ID NO: 415765 - DNA, 20 bp, Artificial
  CRISPR gRNA sequence
tcacacctgcatattttctg

SEQ ID NO: 415766 - DNA, 20 bp, Artificial
  CRISPR gRNA sequence
cacacctgcatattttctgt

SEQ ID NO: 415767 - DNA, 20 bp, Artificial
  CRISPR gRNA sequence
acacctgcatattttctgtt

SEQ ID NO: 415768 - DNA, 20 bp, Artificial
  CRISPR gRNA sequence
catattttctgttacataca

SEQ ID NO: 415769 - DNA, 20 bp, Artificial
  CRISPR gRNA sequence
tctgttacatacatacatat

SEQ ID NO: 415770 - DNA, 20 bp, Artificial
  CRISPR gRNA sequence
ctgttacatacatacatatg

SEQ ID NO: 415771 - DNA, 20 bp, Artificial
  CRISPR gRNA sequence
tgttacatacatacatatgt

SEQ ID NO: 415772 - DNA, 20 bp, Artificial
  CRISPR gRNA sequence
ttacatacatacatatgtgg

SEQ ID NO: 415773 - DNA, 20 bp, Artificial
  CRISPR gRNA sequence
catacatacatatgtggtca

SEQ ID NO: 415774 - DNA, 20 bp, Artificial
  CRISPR gRNA sequence
gattacggtagagaagatta

SEQ ID NO: 415775 - DNA, 20 bp, Artificial
  CRISPR gRNA sequence
attacggtagagaagattaa

SEQ ID NO: 415776 - DNA, 20 bp, Artificial
  CRISPR gRNA sequence
cggtagagaagattaatgat

SEQ ID NO: 415777 - DNA, 20 bp, Artificial
  CRISPR gRNA sequence
atgattatacaatatcatct

SEQ ID NO: 415778 - DNA, 20 bp, Artificial
  CRISPR gRNA sequence
tacaatatcatcttgatgtc

SEQ ID NO: 415779 - DNA, 20 bp, Artificial
  CRISPR gRNA sequence
gatgtcagttttgttaactt

SEQ ID NO: 415780 - DNA, 20 bp, Artificial
  CRISPR gRNA sequence
atgtcagttttgttaacttt

SEQ ID NO: 415781 - DNA, 20 bp, Artificial
  CRISPR gRNA sequence
tgttaactttttatatgtta

SEQ ID NO: 415782 - DNA, 20 bp, Artificial
  CRISPR gRNA sequence
gttaactttttatatgttaa

SEQ ID NO: 415783 - DNA, 20 bp, Artificial
  CRISPR gRNA sequence
ttaactttttatatgttaag

SEQ ID NO: 415784 - DNA, 20 bp, Artificial
  CRISPR gRNA sequence
actttttatatgttaagttg

SEQ ID NO: 415785 - DNA, 20 bp, Artificial
  CRISPR gRNA sequence
tttatatgttaagttgctta

SEQ ID NO: 415786 - DNA, 20 bp, Artificial
  CRISPR gRNA sequence
ttatatgttaagttgcttat

SEQ ID NO: 415787 - DNA, 20 bp, Artificial
  CRISPR gRNA sequence
tatatgttaagttgcttatt

SEQ ID NO: 415788 - DNA, 20 bp, Artificial
  CRISPR gRNA sequence
atatgttaagttgcttattt

SEQ ID NO: 415789 - DNA, 20 bp, Artificial
  CRISPR gRNA sequence
tatgttaagttgcttatttt

SEQ ID NO: 415790 - DNA, 20 bp, Artificial
  CRISPR gRNA sequence
agttgcttattttttaaagt

SEQ ID NO: 415791 - DNA, 20 bp, Artificial
  CRISPR gRNA sequence
cttattttttaaagttcaga

SEQ ID NO: 415792 - DNA, 20 bp, Artificial
  CRISPR gRNA sequence
attttttaaagttcagacac

SEQ ID NO: 415793 - DNA, 20 bp, Artificial
  CRISPR gRNA sequence
ttttttaaagttcagacact

SEQ ID NO: 415794 - DNA, 20 bp, Artificial
  CRISPR gRNA sequence
tttaaagttcagacactgtg

SEQ ID NO: 415795 - DNA, 20 bp, Artificial
  CRISPR gRNA sequence
ttaaagttcagacactgtgt

SEQ ID NO: 415796 - DNA, 20 bp, Artificial
  CRISPR gRNA sequence
taaagttcagacactgtgtt

SEQ ID NO: 415797 - DNA, 20 bp, Artificial
  CRISPR gRNA sequence
aaagttcagacactgtgtta

SEQ ID NO: 415798 - DNA, 20 bp, Artificial
  CRISPR gRNA sequence
aagttcagacactgtgttag

SEQ ID NO: 415799 - DNA, 20 bp, Artificial
  CRISPR gRNA sequence
agacactgtgttagaatttc

SEQ ID NO: 415800 - DNA, 20 bp, Artificial
  CRISPR gRNA sequence
tgttagaatttccatataaa

SEQ ID NO: 415801 - DNA, 20 bp, Artificial
  CRISPR gRNA sequence
gaatttccatataaaaatga

SEQ ID NO: 415802 - DNA, 20 bp, Artificial
  CRISPR gRNA sequence
ccatataaaaatgatagtaa

SEQ ID NO: 415803 - DNA, 20 bp, Artificial
  CRISPR gRNA sequence
catataaaaatgatagtaat

SEQ ID NO: 415804 - DNA, 20 bp, Artificial
  CRISPR gRNA sequence
ttcttatcaaaatagcttaa

SEQ ID NO: 415805 - DNA, 20 bp, Artificial
  CRISPR gRNA sequence
ttatcaaaatagcttaacat

SEQ ID NO: 415806 - DNA, 20 bp, Artificial
  CRISPR gRNA sequence
atcaaaatagcttaacattg

SEQ ID NO: 415807 - DNA, 20 bp, Artificial
  CRISPR gRNA sequence
tcaaaatagcttaacattgg

SEQ ID NO: 415808 - DNA, 20 bp, Artificial
  CRISPR gRNA sequence
aacattgggagagggagttc

SEQ ID NO: 415809 - DNA, 20 bp, Artificial
  CRISPR gRNA sequence
acattgggagagggagttct

SEQ ID NO: 415810 - DNA, 20 bp, Artificial
  CRISPR gRNA sequence
ggagagggagttctacattg

SEQ ID NO: 415811 - DNA, 20 bp, Artificial
  CRISPR gRNA sequence
tacattgaaacaggtaattc

SEQ ID NO: 415812 - DNA, 20 bp, Artificial
  CRISPR gRNA sequence
cattgaaacaggtaattcat

SEQ ID NO: 415813 - DNA, 20 bp, Artificial
  CRISPR gRNA sequence
aaacaggtaattcatagcac

SEQ ID NO: 415814 - DNA, 20 bp, Artificial
  CRISPR gRNA sequence
atagcacaatacagcaagta

SEQ ID NO: 415815 - DNA, 20 bp, Artificial
  CRISPR gRNA sequence
atctagactagatttctgtt

SEQ ID NO: 415816 - DNA, 20 bp, Artificial
  CRISPR gRNA sequence
gactagatttctgttgcatc

SEQ ID NO: 415817 - DNA, 20 bp, Artificial
  CRISPR gRNA sequence
gatttctgttgcatctcagt

SEQ ID NO: 415818 - DNA, 20 bp, Artificial
  CRISPR gRNA sequence
ctgttgcatctcagtcaaga

SEQ ID NO: 415819 - DNA, 20 bp, Artificial
  CRISPR gRNA sequence
tgttgcatctcagtcaagaa

SEQ ID NO: 415820 - DNA, 20 bp, Artificial
  CRISPR gRNA sequence
ttgcatctcagtcaagaata

SEQ ID NO: 415821 - DNA, 20 bp, Artificial
  CRISPR gRNA sequence
catctcagtcaagaatatga

SEQ ID NO: 415822 - DNA, 20 bp, Artificial
  CRISPR gRNA sequence
agtcaagaatatgatttcca

SEQ ID NO: 415823 - DNA, 20 bp, Artificial
  CRISPR gRNA sequence
ccaacagaagttcaatacaa

SEQ ID NO: 415824 - DNA, 20 bp, Artificial
  CRISPR gRNA sequence
caacagaagttcaatacaat

SEQ ID NO: 415825 - DNA, 20 bp, Artificial
  CRISPR gRNA sequence
aatacaatgagaatgtttta

SEQ ID NO: 415826 - DNA, 20 bp, Artificial
  CRISPR gRNA sequence
tatcaaattaattataatgg

SEQ ID NO: 415827 - DNA, 20 bp, Artificial
  CRISPR gRNA sequence
atcaaattaattataatgga

SEQ ID NO: 415828 - DNA, 20 bp, Artificial
  CRISPR gRNA sequence
tcaaattaattataatggaa

SEQ ID NO: 415829 - DNA, 20 bp, Artificial
  CRISPR gRNA sequence
attataatggaaacttgtcc

SEQ ID NO: 415830 - DNA, 20 bp, Artificial
  CRISPR gRNA sequence
taatggaaacttgtcccata

SEQ ID NO: 415831 - DNA, 20 bp, Artificial
  CRISPR gRNA sequence
gtcccatatcatgcctgcat

SEQ ID NO: 415832 - DNA, 20 bp, Artificial
  CRISPR gRNA sequence
tcccatatcatgcctgcatt

SEQ ID NO: 415833 - DNA, 20 bp, Artificial
  CRISPR gRNA sequence
catttatgagaggtatgttt

SEQ ID NO: 415834 - DNA, 20 bp, Artificial
  CRISPR gRNA sequence
atgagaggtatgttttgaat

SEQ ID NO: 415835 - DNA, 20 bp, Artificial
  CRISPR gRNA sequence
tgagaggtatgttttgaatg

SEQ ID NO: 415836 - DNA, 20 bp, Artificial
  CRISPR gRNA sequence
tgaatgtcttcattagttgt

SEQ ID NO: 415837 - DNA, 20 bp, Artificial
  CRISPR gRNA sequence
gaatgtcttcattagttgtt

SEQ ID NO: 415838 - DNA, 20 bp, Artificial
  CRISPR gRNA sequence
aatgtcttcattagttgttg

SEQ ID NO: 415839 - DNA, 20 bp, Artificial
  CRISPR gRNA sequence
cattagttgttgaaatgcag

SEQ ID NO: 415840 - DNA, 20 bp, Artificial
  CRISPR gRNA sequence
attagttgttgaaatgcagt

SEQ ID NO: 415841 - DNA, 20 bp, Artificial
  CRISPR gRNA sequence
gttgttgaaatgcagtgaat

SEQ ID NO: 415842 - DNA, 20 bp, Artificial
  CRISPR gRNA sequence
ttgaaatgcagtgaattatt

SEQ ID NO: 415843 - DNA, 20 bp, Artificial
  CRISPR gRNA sequence
aaatgcagtgaattattgac

SEQ ID NO: 415844 - DNA, 20 bp, Artificial
  CRISPR gRNA sequence
ttgacactctctgctgtttg

SEQ ID NO: 415845 - DNA, 20 bp, Artificial
  CRISPR gRNA sequence
acactctctgctgtttgtct

SEQ ID NO: 415846 - DNA, 20 bp, Artificial
  CRISPR gRNA sequence
tctgctgtttgtctttctag

SEQ ID NO: 415847 - DNA, 20 bp, Artificial
  CRISPR gRNA sequence
tgctgtttgtctttctaggc

SEQ ID NO: 415848 - DNA, 20 bp, Artificial
  CRISPR gRNA sequence
ctgtttgtctttctaggcac

SEQ ID NO: 415849 - DNA, 20 bp, Artificial
  CRISPR gRNA sequence
tttgtctttctaggcaccca

SEQ ID NO: 415850 - DNA, 20 bp, Artificial
  CRISPR gRNA sequence
gtctttctaggcacccaata

SEQ ID NO: 415851 - DNA, 20 bp, Artificial
  CRISPR gRNA sequence
tctttctaggcacccaataa

SEQ ID NO: 415852 - DNA, 20 bp, Artificial
  CRISPR gRNA sequence
tctaggcacccaataactat

SEQ ID NO: 415853 - DNA, 20 bp, Artificial
  CRISPR gRNA sequence
ctaggcacccaataactata

SEQ ID NO: 415854 - DNA, 20 bp, Artificial
  CRISPR gRNA sequence
taggcacccaataactatag

SEQ ID NO: 415855 - DNA, 20 bp, Artificial
  CRISPR gRNA sequence
ggcacccaataactatagaa

SEQ ID NO: 415856 - DNA, 20 bp, Artificial
  CRISPR gRNA sequence
tagaagtcccatctctacca

SEQ ID NO: 415857 - DNA, 20 bp, Artificial
  CRISPR gRNA sequence
taccagtcaacctaccaatc

SEQ ID NO: 415858 - DNA, 20 bp, Artificial
  CRISPR gRNA sequence
ccagtcaacctaccaatcaa

SEQ ID NO: 415859 - DNA, 20 bp, Artificial
  CRISPR gRNA sequence
ccaatcaatccatggatgat

SEQ ID NO: 415860 - DNA, 20 bp, Artificial
  CRISPR gRNA sequence
atgtcaactatccaaccttc

SEQ ID NO: 415861 - DNA, 20 bp, Artificial
  CRISPR gRNA sequence
tgtcaactatccaaccttct

SEQ ID NO: 415862 - DNA, 20 bp, Artificial
  CRISPR gRNA sequence
tccaaccttctctcgcagac

SEQ ID NO: 415863 - DNA, 20 bp, Artificial
  CRISPR gRNA sequence
ctctcgcagaccaaagacta

SEQ ID NO: 415864 - DNA, 20 bp, Artificial
  CRISPR gRNA sequence
tctcgcagaccaaagactag

SEQ ID NO: 415865 - DNA, 20 bp, Artificial
  CRISPR gRNA sequence
tcgcagaccaaagactagag

SEQ ID NO: 415866 - DNA, 20 bp, Artificial
  CRISPR gRNA sequence
gcagaccaaagactagagtt

SEQ ID NO: 415867 - DNA, 20 bp, Artificial
  CRISPR gRNA sequence
gagtttaagcttattcttga

SEQ ID NO: 415868 - DNA, 20 bp, Artificial
  CRISPR gRNA sequence
aagcttattcttgacatgag

SEQ ID NO: 415869 - DNA, 20 bp, Artificial
  CRISPR gRNA sequence
agcttattcttgacatgagt

SEQ ID NO: 415870 - DNA, 20 bp, Artificial
  CRISPR gRNA sequence
attcttgacatgagtgcatt

SEQ ID NO: 415871 - DNA, 20 bp, Artificial
  CRISPR gRNA sequence
ttcttgacatgagtgcatta

SEQ ID NO: 415872 - DNA, 20 bp, Artificial
  CRISPR gRNA sequence
ttgacatgagtgcattagta

SEQ ID NO: 415873 - DNA, 20 bp, Artificial
  CRISPR gRNA sequence
gacatgagtgcattagtaat

SEQ ID NO: 415874 - DNA, 20 bp, Artificial
  CRISPR gRNA sequence
acatgagtgcattagtaatg

SEQ ID NO: 415875 - DNA, 20 bp, Artificial
  CRISPR gRNA sequence
gtaatgactcttatgtactc

SEQ ID NO: 415876 - DNA, 20 bp, Artificial
  CRISPR gRNA sequence
ttatgtactcatgcatggat

SEQ ID NO: 415877 - DNA, 20 bp, Artificial
  CRISPR gRNA sequence
atgtactcatgcatggatct

SEQ ID NO: 415878 - DNA, 20 bp, Artificial
  CRISPR gRNA sequence
tgtactcatgcatggatctt

SEQ ID NO: 415879 - DNA, 20 bp, Artificial
  CRISPR gRNA sequence
atgcatggatctttatgcaa

SEQ ID NO: 415880 - DNA, 20 bp, Artificial
  CRISPR gRNA sequence
tatgcaatttttttccacta

SEQ ID NO: 415881 - DNA, 20 bp, Artificial
  CRISPR gRNA sequence
atgcaatttttttccactac

SEQ ID NO: 415882 - DNA, 20 bp, Artificial
  CRISPR gRNA sequence
tgcaatttttttccactacc

SEQ ID NO: 415883 - DNA, 20 bp, Artificial
  CRISPR gRNA sequence
ttttccactacccaaggtct

SEQ ID NO: 415884 - DNA, 20 bp, Artificial
  CRISPR gRNA sequence
tttccactacccaaggtcta

SEQ ID NO: 415885 - DNA, 20 bp, Artificial
  CRISPR gRNA sequence
ttccactacccaaggtctac

SEQ ID NO: 415886 - DNA, 20 bp, Artificial
  CRISPR gRNA sequence
tccactacccaaggtctacc

SEQ ID NO: 415887 - DNA, 20 bp, Artificial
  CRISPR gRNA sequence
ccactacccaaggtctacct

SEQ ID NO: 415888 - DNA, 20 bp, Artificial
  CRISPR gRNA sequence
cactacccaaggtctacctt

SEQ ID NO: 415889 - DNA, 20 bp, Artificial
  CRISPR gRNA sequence
cccaaggtctaccttagata

SEQ ID NO: 415890 - DNA, 20 bp, Artificial
  CRISPR gRNA sequence
ccttagatactagttgtctg

SEQ ID NO: 415891 - DNA, 20 bp, Artificial
  CRISPR gRNA sequence
agatactagttgtctgaatt

SEQ ID NO: 415892 - DNA, 20 bp, Artificial
  CRISPR gRNA sequence
gatactagttgtctgaattg

SEQ ID NO: 415893 - DNA, 20 bp, Artificial
  CRISPR gRNA sequence
gttgtctgaattgagttact

SEQ ID NO: 415894 - DNA, 20 bp, Artificial
  CRISPR gRNA sequence
tctgaattgagttactttga

SEQ ID NO: 415895 - DNA, 20 bp, Artificial
  CRISPR gRNA sequence
aattgagttactttgatagg

SEQ ID NO: 415896 - DNA, 20 bp, Artificial
  CRISPR gRNA sequence
agttactttgataggaaaaa

SEQ ID NO: 415897 - DNA, 20 bp, Artificial
  CRISPR gRNA sequence
ctttgataggaaaaatactt

SEQ ID NO: 415898 - DNA, 20 bp, Artificial
  CRISPR gRNA sequence
tgataggaaaaatacttcat

SEQ ID NO: 415899 - DNA, 20 bp, Artificial
  CRISPR gRNA sequence
gataggaaaaatacttcatt

SEQ ID NO: 415900 - DNA, 20 bp, Artificial
  CRISPR gRNA sequence
ataggaaaaatacttcatta

SEQ ID NO: 415901 - DNA, 20 bp, Artificial
  CRISPR gRNA sequence
cattacctaaaatcattttt

SEQ ID NO: 415902 - DNA, 20 bp, Artificial
  CRISPR gRNA sequence
attacctaaaatcatttttc

SEQ ID NO: 415903 - DNA, 20 bp, Artificial
  CRISPR gRNA sequence
cctaaaatcatttttcatag

SEQ ID NO: 415904 - DNA, 20 bp, Artificial
  CRISPR gRNA sequence
aaatcatttttcatagaact

SEQ ID NO: 415905 - DNA, 20 bp, Artificial
  CRISPR gRNA sequence
ttcatagaactgtttcagaa

SEQ ID NO: 415906 - DNA, 20 bp, Artificial
  CRISPR gRNA sequence
tcatagaactgtttcagaaa

SEQ ID NO: 415907 - DNA, 20 bp, Artificial
  CRISPR gRNA sequence
catagaactgtttcagaaaa

SEQ ID NO: 415908 - DNA, 20 bp, Artificial
  CRISPR gRNA sequence
atagaactgtttcagaaaac

SEQ ID NO: 415909 - DNA, 20 bp, Artificial
  CRISPR gRNA sequence
tttcagaaaacctgactcta

SEQ ID NO: 415910 - DNA, 20 bp, Artificial
  CRISPR gRNA sequence
cagaaaacctgactctaact

SEQ ID NO: 415911 - DNA, 20 bp, Artificial
  CRISPR gRNA sequence
agaaaacctgactctaactg

SEQ ID NO: 415912 - DNA, 20 bp, Artificial
  CRISPR gRNA sequence
actctaactggtttatatac

SEQ ID NO: 415913 - DNA, 20 bp, Artificial
  CRISPR gRNA sequence
taactggtttatatacaaaa

SEQ ID NO: 415914 - DNA, 20 bp, Artificial
  CRISPR gRNA sequence
actggtttatatacaaaaga

SEQ ID NO: 415915 - DNA, 20 bp, Artificial
  CRISPR gRNA sequence
gtttatatacaaaagaaaac

SEQ ID NO: 415916 - DNA, 20 bp, Artificial
  CRISPR gRNA sequence
atatacaaaagaaaacttac

SEQ ID NO: 415917 - DNA, 20 bp, Artificial
  CRISPR gRNA sequence
tatacaaaagaaaacttact

SEQ ID NO: 415918 - DNA, 20 bp, Artificial
  CRISPR gRNA sequence
actgtatcatataacagaat

SEQ ID NO: 415919 - DNA, 20 bp, Artificial
  CRISPR gRNA sequence
ctgtatcatataacagaatg

SEQ ID NO: 415920 - DNA, 20 bp, Artificial
  CRISPR gRNA sequence
tatcatataacagaatgatc

SEQ ID NO: 415921 - DNA, 20 bp, Artificial
  CRISPR gRNA sequence
agctttgggcaagggctatt

SEQ ID NO: 415922 - DNA, 20 bp, Artificial
  CRISPR gRNA sequence
tgggcaagggctatttacca

SEQ ID NO: 415923 - DNA, 20 bp, Artificial
  CRISPR gRNA sequence
gggcaagggctatttaccag

SEQ ID NO: 415924 - DNA, 20 bp, Artificial
  CRISPR gRNA sequence
ggcaagggctatttaccagg

SEQ ID NO: 415925 - DNA, 20 bp, Artificial
  CRISPR gRNA sequence
tttaccagggcttaaatgtt

SEQ ID NO: 415926 - DNA, 20 bp, Artificial
  CRISPR gRNA sequence
accagggcttaaatgttgtg

SEQ ID NO: 415927 - DNA, 20 bp, Artificial
  CRISPR gRNA sequence
ccagggcttaaatgttgtgt

SEQ ID NO: 415928 - DNA, 20 bp, Artificial
  CRISPR gRNA sequence
aaatgttgtgtctagaatta

SEQ ID NO: 415929 - DNA, 20 bp, Artificial
  CRISPR gRNA sequence
aatgttgtgtctagaattaa

SEQ ID NO: 415930 - DNA, 20 bp, Artificial
  CRISPR gRNA sequence
tgtctagaattaagtatggg

SEQ ID NO: 415931 - DNA, 20 bp, Artificial
  CRISPR gRNA sequence
gaattaagtatgggcataaa

SEQ ID NO: 415932 - DNA, 20 bp, Artificial
  CRISPR gRNA sequence
agtatgggcataaactggct

SEQ ID NO: 415933 - DNA, 20 bp, Artificial
  CRISPR gRNA sequence
gcttctgaatccctttccag

SEQ ID NO: 415934 - DNA, 20 bp, Artificial
  CRISPR gRNA sequence
ctgaatccctttccagagtg

SEQ ID NO: 415935 - DNA, 20 bp, Artificial
  CRISPR gRNA sequence
tgaatccctttccagagtgt

SEQ ID NO: 415936 - DNA, 20 bp, Artificial
  CRISPR gRNA sequence
aatccctttccagagtgttg

SEQ ID NO: 415937 - DNA, 20 bp, Artificial
  CRISPR gRNA sequence
tccagagtgttggatccatt

SEQ ID NO: 415938 - DNA, 20 bp, Artificial
  CRISPR gRNA sequence
ccagagtgttggatccattt

SEQ ID NO: 415939 - DNA, 20 bp, Artificial
  CRISPR gRNA sequence
cagagtgttggatccatttc

SEQ ID NO: 415940 - DNA, 20 bp, Artificial
  CRISPR gRNA sequence
gatccatttccctggtcttg

SEQ ID NO: 415941 - DNA, 20 bp, Artificial
  CRISPR gRNA sequence
ccctggtcttggcctcactc

SEQ ID NO: 415942 - DNA, 20 bp, Artificial
  CRISPR gRNA sequence
cctggtcttggcctcactct

SEQ ID NO: 415943 - DNA, 20 bp, Artificial
  CRISPR gRNA sequence
gtcttggcctcactctcatg

SEQ ID NO: 415944 - DNA, 20 bp, Artificial
  CRISPR gRNA sequence
ggcctcactctcatgcaggc

SEQ ID NO: 415945 - DNA, 20 bp, Artificial
  CRISPR gRNA sequence
gcctcactctcatgcaggct

SEQ ID NO: 415946 - DNA, 20 bp, Artificial
  CRISPR gRNA sequence
actctcatgcaggctttcct

SEQ ID NO: 415947 - DNA, 20 bp, Artificial
  CRISPR gRNA sequence
tcatgcaggctttcctcttg

SEQ ID NO: 415948 - DNA, 20 bp, Artificial
  CRISPR gRNA sequence
atgcaggctttcctcttgtg

SEQ ID NO: 415949 - DNA, 20 bp, Artificial
  CRISPR gRNA sequence
tcctcttgtgttggcaagat

SEQ ID NO: 415950 - DNA, 20 bp, Artificial
  CRISPR gRNA sequence
cctcttgtgttggcaagatg

SEQ ID NO: 415951 - DNA, 20 bp, Artificial
  CRISPR gRNA sequence
ctcttgtgttggcaagatgg

SEQ ID NO: 415952 - DNA, 20 bp, Artificial
  CRISPR gRNA sequence
ttgtgttggcaagatggctg

SEQ ID NO: 415953 - DNA, 20 bp, Artificial
  CRISPR gRNA sequence
gtgttggcaagatggctgcc

SEQ ID NO: 415954 - DNA, 20 bp, Artificial
  CRISPR gRNA sequence
tgttggcaagatggctgcca

SEQ ID NO: 415955 - DNA, 20 bp, Artificial
  CRISPR gRNA sequence
gcaagatggctgccaactct

SEQ ID NO: 415956 - DNA, 20 bp, Artificial
  CRISPR gRNA sequence
ccaactcttggcaattcata

SEQ ID NO: 415957 - DNA, 20 bp, Artificial
  CRISPR gRNA sequence
ttggcaattcatacatcctt

SEQ ID NO: 415958 - DNA, 20 bp, Artificial
  CRISPR gRNA sequence
ggcaattcatacatccttgt

SEQ ID NO: 415959 - DNA, 20 bp, Artificial
  CRISPR gRNA sequence
gcaattcatacatccttgtt

SEQ ID NO: 415960 - DNA, 20 bp, Artificial
  CRISPR gRNA sequence
atacatccttgtttctgtct

SEQ ID NO: 415961 - DNA, 20 bp, Artificial
  CRISPR gRNA sequence
gtttctgtctggtagagagt

SEQ ID NO: 415962 - DNA, 20 bp, Artificial
  CRISPR gRNA sequence
tttctgtctggtagagagtt

SEQ ID NO: 415963 - DNA, 20 bp, Artificial
  CRISPR gRNA sequence
ctgtctggtagagagtttgc

SEQ ID NO: 415964 - DNA, 20 bp, Artificial
  CRISPR gRNA sequence
tgtctggtagagagtttgct

SEQ ID NO: 415965 - DNA, 20 bp, Artificial
  CRISPR gRNA sequence
tctggtagagagtttgcttc

SEQ ID NO: 415966 - DNA, 20 bp, Artificial
  CRISPR gRNA sequence
gtagagagtttgcttctcaa

SEQ ID NO: 415967 - DNA, 20 bp, Artificial
  CRISPR gRNA sequence
gcttctcaaatggagcaaac

SEQ ID NO: 415968 - DNA, 20 bp, Artificial
  CRISPR gRNA sequence
cttctcaaatggagcaaaca

SEQ ID NO: 415969 - DNA, 20 bp, Artificial
  CRISPR gRNA sequence
ctcaaatggagcaaacaaat

SEQ ID NO: 415970 - DNA, 20 bp, Artificial
  CRISPR gRNA sequence
tcaaatggagcaaacaaatt

SEQ ID NO: 415971 - DNA, 20 bp, Artificial
  CRISPR gRNA sequence
aaatggagcaaacaaatttg

SEQ ID NO: 415972 - DNA, 20 bp, Artificial
  CRISPR gRNA sequence
gattattttttcattgttaa

SEQ ID NO: 415973 - DNA, 20 bp, Artificial
  CRISPR gRNA sequence
attattttttcattgttaaa

SEQ ID NO: 415974 - DNA, 20 bp, Artificial
  CRISPR gRNA sequence
ttttttcattgttaaatagg

SEQ ID NO: 415975 - DNA, 20 bp, Artificial
  CRISPR gRNA sequence
tttcattgttaaataggcaa

SEQ ID NO: 415976 - DNA, 20 bp, Artificial
  CRISPR gRNA sequence
ttcattgttaaataggcaac

SEQ ID NO: 415977 - DNA, 20 bp, Artificial
  CRISPR gRNA sequence
tcattgttaaataggcaaca

SEQ ID NO: 415978 - DNA, 20 bp, Artificial
  CRISPR gRNA sequence
cattgttaaataggcaacat

SEQ ID NO: 415979 - DNA, 20 bp, Artificial
  CRISPR gRNA sequence
attgttaaataggcaacatg

SEQ ID NO: 415980 - DNA, 20 bp, Artificial
  CRISPR gRNA sequence
ttaaataggcaacatgacca

SEQ ID NO: 415981 - DNA, 20 bp, Artificial
  CRISPR gRNA sequence
aataggcaacatgaccagaa

SEQ ID NO: 415982 - DNA, 20 bp, Artificial
  CRISPR gRNA sequence
aagtaaactaagggttcact

SEQ ID NO: 415983 - DNA, 20 bp, Artificial
  CRISPR gRNA sequence
agtaaactaagggttcactt

SEQ ID NO: 415984 - DNA, 20 bp, Artificial
  CRISPR gRNA sequence
agggttcacttctagagctg

SEQ ID NO: 415985 - DNA, 20 bp, Artificial
  CRISPR gRNA sequence
acttctagagctgagaagca

SEQ ID NO: 415986 - DNA, 20 bp, Artificial
  CRISPR gRNA sequence
ctagagctgagaagcagggt

SEQ ID NO: 415987 - DNA, 20 bp, Artificial
  CRISPR gRNA sequence
tagagctgagaagcagggtc

SEQ ID NO: 415988 - DNA, 20 bp, Artificial
  CRISPR gRNA sequence
gagctgagaagcagggtcaa

SEQ ID NO: 415989 - DNA, 20 bp, Artificial
  CRISPR gRNA sequence
agaagcagggtcaaagcaca

SEQ ID NO: 415990 - DNA, 20 bp, Artificial
  CRISPR gRNA sequence
ggcaattcagagcatggtta

SEQ ID NO: 415991 - DNA, 20 bp, Artificial
  CRISPR gRNA sequence
agagcatggttagaagagga

SEQ ID NO: 415992 - DNA, 20 bp, Artificial
  CRISPR gRNA sequence
gaagaggaaaggggagtctc

SEQ ID NO: 415993 - DNA, 20 bp, Artificial
  CRISPR gRNA sequence
aaagctggagagtttaccaa

SEQ ID NO: 415994 - DNA, 20 bp, Artificial
  CRISPR gRNA sequence
gagagtttaccaacaaatat

SEQ ID NO: 415995 - DNA, 20 bp, Artificial
  CRISPR gRNA sequence
accaacaaatattgactgca

SEQ ID NO: 415996 - DNA, 20 bp, Artificial
  CRISPR gRNA sequence
ccaacaaatattgactgcag

SEQ ID NO: 415997 - DNA, 20 bp, Artificial
  CRISPR gRNA sequence
actgcagtgattaaccaaga

SEQ ID NO: 415998 - DNA, 20 bp, Artificial
  CRISPR gRNA sequence
cagtgattaaccaagacatt

SEQ ID NO: 415999 - DNA, 20 bp, Artificial
  CRISPR gRNA sequence
accaagacatttttgttaac

SEQ ID NO: 416000 - DNA, 20 bp, Artificial
  CRISPR gRNA sequence
ttgttaactaaaaagtgaaa

SEQ ID NO: 416001 - DNA, 20 bp, Artificial
  CRISPR gRNA sequence
tgttaactaaaaagtgaaat

SEQ ID NO: 416002 - DNA, 20 bp, Artificial
  CRISPR gRNA sequence
gttaactaaaaagtgaaata

SEQ ID NO: 416003 - DNA, 20 bp, Artificial
  CRISPR gRNA sequence
ttaactaaaaagtgaaatat

SEQ ID NO: 416004 - DNA, 20 bp, Artificial
  CRISPR gRNA sequence
actaaaaagtgaaatatggg

SEQ ID NO: 416005 - DNA, 20 bp, Artificial
  CRISPR gRNA sequence
aaaagtgaaatatgggatgg

SEQ ID NO: 416006 - DNA, 20 bp, Artificial
  CRISPR gRNA sequence
tagaaatggggtatctctgt

SEQ ID NO: 416007 - DNA, 20 bp, Artificial
  CRISPR gRNA sequence
gaaatggggtatctctgtcc

SEQ ID NO: 416008 - DNA, 20 bp, Artificial
  CRISPR gRNA sequence
tgtccatacttctagaatcc

SEQ ID NO: 416009 - DNA, 20 bp, Artificial
  CRISPR gRNA sequence
tccatacttctagaatccac

SEQ ID NO: 416010 - DNA, 20 bp, Artificial
  CRISPR gRNA sequence
ctagaatccactctatcagc

SEQ ID NO: 416011 - DNA, 20 bp, Artificial
  CRISPR gRNA sequence
tagaatccactctatcagca

SEQ ID NO: 416012 - DNA, 20 bp, Artificial
  CRISPR gRNA sequence
gaatccactctatcagcata

SEQ ID NO: 416013 - DNA, 20 bp, Artificial
  CRISPR gRNA sequence
tatcagcatagtccagaaga

SEQ ID NO: 416014 - DNA, 20 bp, Artificial
  CRISPR gRNA sequence
tcagcatagtccagaagaat

SEQ ID NO: 416015 - DNA, 20 bp, Artificial
  CRISPR gRNA sequence
gcagtagaagaaatgaatat

SEQ ID NO: 416016 - DNA, 20 bp, Artificial
  CRISPR gRNA sequence
aagaggaagataaatgcgag

SEQ ID NO: 416017 - DNA, 20 bp, Artificial
  CRISPR gRNA sequence
tactattctcatatttattt

SEQ ID NO: 416018 - DNA, 20 bp, Artificial
  CRISPR gRNA sequence
actattctcatatttattta

SEQ ID NO: 416019 - DNA, 20 bp, Artificial
  CRISPR gRNA sequence
ctattctcatatttatttat

SEQ ID NO: 416020 - DNA, 20 bp, Artificial
  CRISPR gRNA sequence
ttctcatatttatttatctc

SEQ ID NO: 416021 - DNA, 20 bp, Artificial
  CRISPR gRNA sequence
tcatatttatttatctctca

SEQ ID NO: 416022 - DNA, 20 bp, Artificial
  CRISPR gRNA sequence
atatttatttatctctcatt

SEQ ID NO: 416023 - DNA, 20 bp, Artificial
  CRISPR gRNA sequence
atttatctctcattctgtat

SEQ ID NO: 416024 - DNA, 20 bp, Artificial
  CRISPR gRNA sequence
tttatctctcattctgtata

SEQ ID NO: 416025 - DNA, 20 bp, Artificial
  CRISPR gRNA sequence
atctctcattctgtatagaa

SEQ ID NO: 416026 - DNA, 20 bp, Artificial
  CRISPR gRNA sequence
tctctcattctgtatagaat

SEQ ID NO: 416027 - DNA, 20 bp, Artificial
  CRISPR gRNA sequence
tcattctgtatagaattctt

SEQ ID NO: 416028 - DNA, 20 bp, Artificial
  CRISPR gRNA sequence
attctgtatagaattcttgc

SEQ ID NO: 416029 - DNA, 20 bp, Artificial
  CRISPR gRNA sequence
tgtatagaattcttgccgcc

SEQ ID NO: 416030 - DNA, 20 bp, Artificial
  CRISPR gRNA sequence
tatagaattcttgccgccat

SEQ ID NO: 416031 - DNA, 20 bp, Artificial
  CRISPR gRNA sequence
ttgccgccatcccaggtcta

SEQ ID NO: 416032 - DNA, 20 bp, Artificial
  CRISPR gRNA sequence
gccgccatcccaggtctagc

SEQ ID NO: 416033 - DNA, 20 bp, Artificial
  CRISPR gRNA sequence
ccgccatcccaggtctagcc

SEQ ID NO: 416034 - DNA, 20 bp, Artificial
  CRISPR gRNA sequence
gccttaggagcaaatgtagt

SEQ ID NO: 416035 - DNA, 20 bp, Artificial
  CRISPR gRNA sequence
aggagcaaatgtagtagata

SEQ ID NO: 416036 - DNA, 20 bp, Artificial
  CRISPR gRNA sequence
ggagcaaatgtagtagatag

SEQ ID NO: 416037 - DNA, 20 bp, Artificial
  CRISPR gRNA sequence
aatgttttggacatattttg

SEQ ID NO: 416038 - DNA, 20 bp, Artificial
  CRISPR gRNA sequence
atgttttggacatattttgt

SEQ ID NO: 416039 - DNA, 20 bp, Artificial
  CRISPR gRNA sequence
tggacatattttgtctactt

SEQ ID NO: 416040 - DNA, 20 bp, Artificial
  CRISPR gRNA sequence
ggacatattttgtctacttt

SEQ ID NO: 416041 - DNA, 20 bp, Artificial
  CRISPR gRNA sequence
gacatattttgtctactttt

SEQ ID NO: 416042 - DNA, 20 bp, Artificial
  CRISPR gRNA sequence
tgtctacttttgagaattat

SEQ ID NO: 416043 - DNA, 20 bp, Artificial
  CRISPR gRNA sequence
gtctacttttgagaattatt

SEQ ID NO: 416044 - DNA, 20 bp, Artificial
  CRISPR gRNA sequence
tctacttttgagaattattt

SEQ ID NO: 416045 - DNA, 20 bp, Artificial
  CRISPR gRNA sequence
cttttgagaattatttttaa

SEQ ID NO: 416046 - DNA, 20 bp, Artificial
  CRISPR gRNA sequence
ttgagaattatttttaatat

SEQ ID NO: 416047 - DNA, 20 bp, Artificial
  CRISPR gRNA sequence
tgagaattatttttaatatg

SEQ ID NO: 416048 - DNA, 20 bp, Artificial
  CRISPR gRNA sequence
gagaattatttttaatatgt

SEQ ID NO: 416049 - DNA, 20 bp, Artificial
  CRISPR gRNA sequence
agaattatttttaatatgta

SEQ ID NO: 416050 - DNA, 20 bp, Artificial
  CRISPR gRNA sequence
tttttaatatgtaaattctc

SEQ ID NO: 416051 - DNA, 20 bp, Artificial
  CRISPR gRNA sequence
ttaatatgtaaattctctca

SEQ ID NO: 416052 - DNA, 20 bp, Artificial
  CRISPR gRNA sequence
taatatgtaaattctctcaa

SEQ ID NO: 416053 - DNA, 20 bp, Artificial
  CRISPR gRNA sequence
aatatgtaaattctctcaaa

SEQ ID NO: 416054 - DNA, 20 bp, Artificial
  CRISPR gRNA sequence
atatgtaaattctctcaaaa

SEQ ID NO: 416055 - DNA, 20 bp, Artificial
  CRISPR gRNA sequence
tctcaaaagggtcaggcacc

SEQ ID NO: 416056 - DNA, 20 bp, Artificial
  CRISPR gRNA sequence
tcaaaagggtcaggcaccta

SEQ ID NO: 416057 - DNA, 20 bp, Artificial
  CRISPR gRNA sequence
aaaagggtcaggcacctagt

SEQ ID NO: 416058 - DNA, 20 bp, Artificial
  CRISPR gRNA sequence
gttattattttttaatgatt

SEQ ID NO: 416059 - DNA, 20 bp, Artificial
  CRISPR gRNA sequence
ttattttttaatgattatgt

SEQ ID NO: 416060 - DNA, 20 bp, Artificial
  CRISPR gRNA sequence
ttttttaatgattatgtgaa

SEQ ID NO: 416061 - DNA, 20 bp, Artificial
  CRISPR gRNA sequence
tttaatgattatgtgaaagt

SEQ ID NO: 416062 - DNA, 20 bp, Artificial
  CRISPR gRNA sequence
ttaatgattatgtgaaagtt

SEQ ID NO: 416063 - DNA, 20 bp, Artificial
  CRISPR gRNA sequence
taatgattatgtgaaagttg

SEQ ID NO: 416064 - DNA, 20 bp, Artificial
  CRISPR gRNA sequence
aatgattatgtgaaagttga

SEQ ID NO: 416065 - DNA, 20 bp, Artificial
  CRISPR gRNA sequence
atgattatgtgaaagttgaa

SEQ ID NO: 416066 - DNA, 20 bp, Artificial
  CRISPR gRNA sequence
tgtgaaagttgaatataata

SEQ ID NO: 416067 - DNA, 20 bp, Artificial
  CRISPR gRNA sequence
aatataatataccactaaaa

SEQ ID NO: 416068 - DNA, 20 bp, Artificial
  CRISPR gRNA sequence
aaagtgacagttgaaagtgg

SEQ ID NO: 416069 - DNA, 20 bp, Artificial
  CRISPR gRNA sequence
aaagtggtggcataggacgg

SEQ ID NO: 416070 - DNA, 20 bp, Artificial
  CRISPR gRNA sequence
gggagggaaaaaagaaattg

SEQ ID NO: 416071 - DNA, 20 bp, Artificial
  CRISPR gRNA sequence
ggagggaaaaaagaaattgg

SEQ ID NO: 416072 - DNA, 20 bp, Artificial
  CRISPR gRNA sequence
ggagggtacaggcaacagga

SEQ ID NO: 416073 - DNA, 20 bp, Artificial
  CRISPR gRNA sequence
ctgcttcactattcagacaa

SEQ ID NO: 416074 - DNA, 20 bp, Artificial
  CRISPR gRNA sequence
tgcttcactattcagacaaa

SEQ ID NO: 416075 - DNA, 20 bp, Artificial
  CRISPR gRNA sequence
cttcactattcagacaaaga

SEQ ID NO: 416076 - DNA, 20 bp, Artificial
  CRISPR gRNA sequence
cactattcagacaaagacag

SEQ ID NO: 416077 - DNA, 20 bp, Artificial
  CRISPR gRNA sequence
actattcagacaaagacagc

SEQ ID NO: 416078 - DNA, 20 bp, Artificial
  CRISPR gRNA sequence
ttcagacaaagacagcccta

SEQ ID NO: 416079 - DNA, 20 bp, Artificial
  CRISPR gRNA sequence
agacaaagacagccctaatg

SEQ ID NO: 416080 - DNA, 20 bp, Artificial
  CRISPR gRNA sequence
atgacatcaccaacagtcaa

SEQ ID NO: 416081 - DNA, 20 bp, Artificial
  CRISPR gRNA sequence
gagaccatacctaatattgt

SEQ ID NO: 416082 - DNA, 20 bp, Artificial
  CRISPR gRNA sequence
atattgtttaaattctagat

SEQ ID NO: 416083 - DNA, 20 bp, Artificial
  CRISPR gRNA sequence
tttaaattctagatgtaggc

SEQ ID NO: 416084 - DNA, 20 bp, Artificial
  CRISPR gRNA sequence
aaattctagatgtaggctaa

SEQ ID NO: 416085 - DNA, 20 bp, Artificial
  CRISPR gRNA sequence
aattctagatgtaggctaac

SEQ ID NO: 416086 - DNA, 20 bp, Artificial
  CRISPR gRNA sequence
tagatgtaggctaacaatga

SEQ ID NO: 416087 - DNA, 20 bp, Artificial
  CRISPR gRNA sequence
gatgtaggctaacaatgaaa

SEQ ID NO: 416088 - DNA, 20 bp, Artificial
  CRISPR gRNA sequence
acaatgaaaagtatttgcca

SEQ ID NO: 416089 - DNA, 20 bp, Artificial
  CRISPR gRNA sequence
gccaaactgaataaaactgt

SEQ ID NO: 416090 - DNA, 20 bp, Artificial
  CRISPR gRNA sequence
ccaaactgaataaaactgtc

SEQ ID NO: 416091 - DNA, 20 bp, Artificial
  CRISPR gRNA sequence
aataaaactgtcatggttac

SEQ ID NO: 416092 - DNA, 20 bp, Artificial
  CRISPR gRNA sequence
tcatggttaccttgaaagga

SEQ ID NO: 416093 - DNA, 20 bp, Artificial
  CRISPR gRNA sequence
ccttgaaaggacaatggtta

SEQ ID NO: 416094 - DNA, 20 bp, Artificial
  CRISPR gRNA sequence
gaaaggacaatggttattgt

SEQ ID NO: 416095 - DNA, 20 bp, Artificial
  CRISPR gRNA sequence
aaaggacaatggttattgtt

SEQ ID NO: 416096 - DNA, 20 bp, Artificial
  CRISPR gRNA sequence
ttgttaaatatagtgatcat

SEQ ID NO: 416097 - DNA, 20 bp, Artificial
  CRISPR gRNA sequence
ttaaatatagtgatcattca

SEQ ID NO: 416098 - DNA, 20 bp, Artificial
  CRISPR gRNA sequence
aatatagtgatcattcatgt

SEQ ID NO: 416099 - DNA, 20 bp, Artificial
  CRISPR gRNA sequence
atgtctaaaagattcattat

SEQ ID NO: 416100 - DNA, 20 bp, Artificial
  CRISPR gRNA sequence
aaagattcattatttatctc

SEQ ID NO: 416101 - DNA, 20 bp, Artificial
  CRISPR gRNA sequence
attatttatctctaaagatt

SEQ ID NO: 416102 - DNA, 20 bp, Artificial
  CRISPR gRNA sequence
tttatctctaaagatttcta

SEQ ID NO: 416103 - DNA, 20 bp, Artificial
  CRISPR gRNA sequence
atctctaaagatttctaaag

SEQ ID NO: 416104 - DNA, 20 bp, Artificial
  CRISPR gRNA sequence
tctctaaagatttctaaaga

SEQ ID NO: 416105 - DNA, 20 bp, Artificial
  CRISPR gRNA sequence
taaagatttctaaagaccac

SEQ ID NO: 416106 - DNA, 20 bp, Artificial
  CRISPR gRNA sequence
aagatttctaaagaccacca

SEQ ID NO: 416107 - DNA, 20 bp, Artificial
  CRISPR gRNA sequence
ctaaagaccaccatctagaa

SEQ ID NO: 416108 - DNA, 20 bp, Artificial
  CRISPR gRNA sequence
taaagaccaccatctagaaa

SEQ ID NO: 416109 - DNA, 20 bp, Artificial
  CRISPR gRNA sequence
aagaccaccatctagaaaag

SEQ ID NO: 416110 - DNA, 20 bp, Artificial
  CRISPR gRNA sequence
gaaaagattcattatgaagg

SEQ ID NO: 416111 - DNA, 20 bp, Artificial
  CRISPR gRNA sequence
attatgaaggctgtatttaa

SEQ ID NO: 416112 - DNA, 20 bp, Artificial
  CRISPR gRNA sequence
tgaaggctgtatttaaatat

SEQ ID NO: 416113 - DNA, 20 bp, Artificial
  CRISPR gRNA sequence
tatttaaatatcaaagttgt

SEQ ID NO: 416114 - DNA, 20 bp, Artificial
  CRISPR gRNA sequence
aaatatcaaagttgtggact

SEQ ID NO: 416115 - DNA, 20 bp, Artificial
  CRISPR gRNA sequence
aatatcaaagttgtggactt

SEQ ID NO: 416116 - DNA, 20 bp, Artificial
  CRISPR gRNA sequence
tggacttcatgataatctta

SEQ ID NO: 416117 - DNA, 20 bp, Artificial
  CRISPR gRNA sequence
catgataatcttaaataaag

SEQ ID NO: 416118 - DNA, 20 bp, Artificial
  CRISPR gRNA sequence
atgataatcttaaataaagc

SEQ ID NO: 416119 - DNA, 20 bp, Artificial
  CRISPR gRNA sequence
aaataaagcaaatccaaatt

SEQ ID NO: 416120 - DNA, 20 bp, Artificial
  CRISPR gRNA sequence
aataaagcaaatccaaattc

SEQ ID NO: 416121 - DNA, 20 bp, Artificial
  CRISPR gRNA sequence
tcctgttgcctagacagatt

SEQ ID NO: 416122 - DNA, 20 bp, Artificial
  CRISPR gRNA sequence
ctgttgcctagacagattct

SEQ ID NO: 416123 - DNA, 20 bp, Artificial
  CRISPR gRNA sequence
ttgcctagacagattctaag

SEQ ID NO: 416124 - DNA, 20 bp, Artificial
  CRISPR gRNA sequence
cctagacagattctaagatg

SEQ ID NO: 416125 - DNA, 20 bp, Artificial
  CRISPR gRNA sequence
gacagattctaagatgtaat

SEQ ID NO: 416126 - DNA, 20 bp, Artificial
  CRISPR gRNA sequence
taagatgtaatttacacttt

SEQ ID NO: 416127 - DNA, 20 bp, Artificial
  CRISPR gRNA sequence
agatgtaatttacactttta

SEQ ID NO: 416128 - DNA, 20 bp, Artificial
  CRISPR gRNA sequence
acacttttaagctaattagt

SEQ ID NO: 416129 - DNA, 20 bp, Artificial
  CRISPR gRNA sequence
cacttttaagctaattagtg

SEQ ID NO: 416130 - DNA, 20 bp, Artificial
  CRISPR gRNA sequence
ttaagctaattagtgagtat

SEQ ID NO: 416131 - DNA, 20 bp, Artificial
  CRISPR gRNA sequence
taagctaattagtgagtatt

SEQ ID NO: 416132 - DNA, 20 bp, Artificial
  CRISPR gRNA sequence
aagctaattagtgagtattt

SEQ ID NO: 416133 - DNA, 20 bp, Artificial
  CRISPR gRNA sequence
agctaattagtgagtatttt

SEQ ID NO: 416134 - DNA, 20 bp, Artificial
  CRISPR gRNA sequence
attagtgagtattttatgat

SEQ ID NO: 416135 - DNA, 20 bp, Artificial
  CRISPR gRNA sequence
gtgagtattttatgatttta

SEQ ID NO: 416136 - DNA, 20 bp, Artificial
  CRISPR gRNA sequence
tatgattttagccttaaaca

SEQ ID NO: 416137 - DNA, 20 bp, Artificial
  CRISPR gRNA sequence
atgattttagccttaaacac

SEQ ID NO: 416138 - DNA, 20 bp, Artificial
  CRISPR gRNA sequence
tgattttagccttaaacacc

SEQ ID NO: 416139 - DNA, 20 bp, Artificial
  CRISPR gRNA sequence
tagccttaaacaccatgtat

SEQ ID NO: 416140 - DNA, 20 bp, Artificial
  CRISPR gRNA sequence
agccttaaacaccatgtatg

SEQ ID NO: 416141 - DNA, 20 bp, Artificial
  CRISPR gRNA sequence
gccttaaacaccatgtatgc

SEQ ID NO: 416142 - DNA, 20 bp, Artificial
  CRISPR gRNA sequence
aaacaccatgtatgccaaat

SEQ ID NO: 416143 - DNA, 20 bp, Artificial
  CRISPR gRNA sequence
aacaccatgtatgccaaata

SEQ ID NO: 416144 - DNA, 20 bp, Artificial
  CRISPR gRNA sequence
gttttgtgaattacagaaat

SEQ ID NO: 416145 - DNA, 20 bp, Artificial
  CRISPR gRNA sequence
ttttgtgaattacagaaatg

SEQ ID NO: 416146 - DNA, 20 bp, Artificial
  CRISPR gRNA sequence
tgtgaattacagaaatggta

SEQ ID NO: 416147 - DNA, 20 bp, Artificial
  CRISPR gRNA sequence
gtgaattacagaaatggtaa

SEQ ID NO: 416148 - DNA, 20 bp, Artificial
  CRISPR gRNA sequence
tgaattacagaaatggtaag

SEQ ID NO: 416149 - DNA, 20 bp, Artificial
  CRISPR gRNA sequence
cagaaatggtaagtgcccac

SEQ ID NO: 416150 - DNA, 20 bp, Artificial
  CRISPR gRNA sequence
ctgtgaattataaaatttgt

SEQ ID NO: 416151 - DNA, 20 bp, Artificial
  CRISPR gRNA sequence
tgtgaattataaaatttgtg

SEQ ID NO: 416152 - DNA, 20 bp, Artificial
  CRISPR gRNA sequence
tgaattataaaatttgtgag

SEQ ID NO: 416153 - DNA, 20 bp, Artificial
  CRISPR gRNA sequence
taaaatttgtgagtttcttt

SEQ ID NO: 416154 - DNA, 20 bp, Artificial
  CRISPR gRNA sequence
gtgagtttcttttaaccctt

SEQ ID NO: 416155 - DNA, 20 bp, Artificial
  CRISPR gRNA sequence
tgagtttcttttaacccttt

SEQ ID NO: 416156 - DNA, 20 bp, Artificial
  CRISPR gRNA sequence
cttttaacccttttcaggag

SEQ ID NO: 416157 - DNA, 20 bp, Artificial
  CRISPR gRNA sequence
ttttaacccttttcaggagt

SEQ ID NO: 416158 - DNA, 20 bp, Artificial
  CRISPR gRNA sequence
ttaacccttttcaggagtga

SEQ ID NO: 416159 - DNA, 20 bp, Artificial
  CRISPR gRNA sequence
taacccttttcaggagtgaa

SEQ ID NO: 416160 - DNA, 20 bp, Artificial
  CRISPR gRNA sequence
aacccttttcaggagtgaaa

SEQ ID NO: 416161 - DNA, 20 bp, Artificial
  CRISPR gRNA sequence
acccttttcaggagtgaaaa

SEQ ID NO: 416162 - DNA, 20 bp, Artificial
  CRISPR gRNA sequence
ttcaggagtgaaaaaataaa

SEQ ID NO: 416163 - DNA, 20 bp, Artificial
  CRISPR gRNA sequence
tcaggagtgaaaaaataaaa

SEQ ID NO: 416164 - DNA, 20 bp, Artificial
  CRISPR gRNA sequence
caggagtgaaaaaataaaaa

SEQ ID NO: 416165 - DNA, 20 bp, Artificial
  CRISPR gRNA sequence
aggagtgaaaaaataaaaac

SEQ ID NO: 416166 - DNA, 20 bp, Artificial
  CRISPR gRNA sequence
cctggttgtgcttaagtata

SEQ ID NO: 416167 - DNA, 20 bp, Artificial
  CRISPR gRNA sequence
ctggttgtgcttaagtatat

SEQ ID NO: 416168 - DNA, 20 bp, Artificial
  CRISPR gRNA sequence
gttgtgcttaagtatatgca

SEQ ID NO: 416169 - DNA, 20 bp, Artificial
  CRISPR gRNA sequence
tgcttaagtatatgcaagaa

SEQ ID NO: 416170 - DNA, 20 bp, Artificial
  CRISPR gRNA sequence
aagtatatgcaagaagggta

SEQ ID NO: 416171 - DNA, 20 bp, Artificial
  CRISPR gRNA sequence
agtatatgcaagaagggtaa

SEQ ID NO: 416172 - DNA, 20 bp, Artificial
  CRISPR gRNA sequence
tcatttttattatgtttgct

SEQ ID NO: 416173 - DNA, 20 bp, Artificial
  CRISPR gRNA sequence
atttttattatgtttgctta

SEQ ID NO: 416174 - DNA, 20 bp, Artificial
  CRISPR gRNA sequence
ttattatgtttgcttaaaga

SEQ ID NO: 416175 - DNA, 20 bp, Artificial
  CRISPR gRNA sequence
tattatgtttgcttaaagat

SEQ ID NO: 416176 - DNA, 20 bp, Artificial
  CRISPR gRNA sequence
attatgtttgcttaaagatc

SEQ ID NO: 416177 - DNA, 20 bp, Artificial
  CRISPR gRNA sequence
ttatgtttgcttaaagatct

SEQ ID NO: 416178 - DNA, 20 bp, Artificial
  CRISPR gRNA sequence
tgtttgcttaaagatctttt

SEQ ID NO: 416179 - DNA, 20 bp, Artificial
  CRISPR gRNA sequence
gcttaaagatctttttatac

SEQ ID NO: 416180 - DNA, 20 bp, Artificial
  CRISPR gRNA sequence
cttaaagatctttttatacc

SEQ ID NO: 416181 - DNA, 20 bp, Artificial
  CRISPR gRNA sequence
aaagatctttttatacctgg

SEQ ID NO: 416182 - DNA, 20 bp, Artificial
  CRISPR gRNA sequence
aagatctttttatacctgga

SEQ ID NO: 416183 - DNA, 20 bp, Artificial
  CRISPR gRNA sequence
tttatacctggattcatgaa

SEQ ID NO: 416184 - DNA, 20 bp, Artificial
  CRISPR gRNA sequence
ttatacctggattcatgaaa

SEQ ID NO: 416185 - DNA, 20 bp, Artificial
  CRISPR gRNA sequence
tatacctggattcatgaaat

SEQ ID NO: 416186 - DNA, 20 bp, Artificial
  CRISPR gRNA sequence
atacctggattcatgaaatg

SEQ ID NO: 416187 - DNA, 20 bp, Artificial
  CRISPR gRNA sequence
tacctggattcatgaaatgt

SEQ ID NO: 416188 - DNA, 20 bp, Artificial
  CRISPR gRNA sequence
gattcatgaaatgtttccac

SEQ ID NO: 416189 - DNA, 20 bp, Artificial
  CRISPR gRNA sequence
atgaaatgtttccacaaata

SEQ ID NO: 416190 - DNA, 20 bp, Artificial
  CRISPR gRNA sequence
ccacaaatatattagtgtaa

SEQ ID NO: 416191 - DNA, 20 bp, Artificial
  CRISPR gRNA sequence
cacaaatatattagtgtaac

SEQ ID NO: 416192 - DNA, 20 bp, Artificial
  CRISPR gRNA sequence
gtgtaacaaacttgaaaggc

SEQ ID NO: 416193 - DNA, 20 bp, Artificial
  CRISPR gRNA sequence
gaaaggcagtttacaagaaa

SEQ ID NO: 416194 - DNA, 20 bp, Artificial
  CRISPR gRNA sequence
aaaggcagtttacaagaaag

SEQ ID NO: 416195 - DNA, 20 bp, Artificial
  CRISPR gRNA sequence
acaagaaagcactctactat

SEQ ID NO: 416196 - DNA, 20 bp, Artificial
  CRISPR gRNA sequence
caagaaagcactctactatc

SEQ ID NO: 416197 - DNA, 20 bp, Artificial
  CRISPR gRNA sequence
tactatcagatcaatcaaag

SEQ ID NO: 416198 - DNA, 20 bp, Artificial
  CRISPR gRNA sequence
ctatcagatcaatcaaagat

SEQ ID NO: 416199 - DNA, 20 bp, Artificial
  CRISPR gRNA sequence
tcagatcaatcaaagattct

SEQ ID NO: 416200 - DNA, 20 bp, Artificial
  CRISPR gRNA sequence
tgtgagtgaatttattggtt

SEQ ID NO: 416201 - DNA, 20 bp, Artificial
  CRISPR gRNA sequence
tgagtgaatttattggtttg

SEQ ID NO: 416202 - DNA, 20 bp, Artificial
  CRISPR gRNA sequence
attggtttgcatggtgaagc

SEQ ID NO: 416203 - DNA, 20 bp, Artificial
  CRISPR gRNA sequence
ttggtttgcatggtgaagca

SEQ ID NO: 416204 - DNA, 20 bp, Artificial
  CRISPR gRNA sequence
gtttgcatggtgaagcaagc

SEQ ID NO: 416205 - DNA, 20 bp, Artificial
  CRISPR gRNA sequence
gcatggtgaagcaagcttag

SEQ ID NO: 416206 - DNA, 20 bp, Artificial
  CRISPR gRNA sequence
catggtgaagcaagcttagc

SEQ ID NO: 416207 - DNA, 20 bp, Artificial
  CRISPR gRNA sequence
agcatcaattaaaaggtaaa

SEQ ID NO: 416208 - DNA, 20 bp, Artificial
  CRISPR gRNA sequence
gcatcaattaaaaggtaaat

SEQ ID NO: 416209 - DNA, 20 bp, Artificial
  CRISPR gRNA sequence
aaaggtaaataatttctttt

SEQ ID NO: 416210 - DNA, 20 bp, Artificial
  CRISPR gRNA sequence
cttttctgaatggtaaagac

SEQ ID NO: 416211 - DNA, 20 bp, Artificial
  CRISPR gRNA sequence
ttttctgaatggtaaagaca

SEQ ID NO: 416212 - DNA, 20 bp, Artificial
  CRISPR gRNA sequence
ttctgaatggtaaagacaat

SEQ ID NO: 416213 - DNA, 20 bp, Artificial
  CRISPR gRNA sequence
tctgaatggtaaagacaatc

SEQ ID NO: 416214 - DNA, 20 bp, Artificial
  CRISPR gRNA sequence
ctgaatggtaaagacaatca

SEQ ID NO: 416215 - DNA, 20 bp, Artificial
  CRISPR gRNA sequence
tgaatggtaaagacaatcaa

SEQ ID NO: 416216 - DNA, 20 bp, Artificial
  CRISPR gRNA sequence
aatggtaaagacaatcaaaa

SEQ ID NO: 416217 - DNA, 20 bp, Artificial
  CRISPR gRNA sequence
ctttctggaaaactccaata

SEQ ID NO: 416218 - DNA, 20 bp, Artificial
  CRISPR gRNA sequence
tctggaaaactccaataacc

SEQ ID NO: 416219 - DNA, 20 bp, Artificial
  CRISPR gRNA sequence
ctggaaaactccaataacca

SEQ ID NO: 416220 - DNA, 20 bp, Artificial
  CRISPR gRNA sequence
tggaaaactccaataaccaa

SEQ ID NO: 416221 - DNA, 20 bp, Artificial
  CRISPR gRNA sequence
gaaaactccaataaccaaat

SEQ ID NO: 416222 - DNA, 20 bp, Artificial
  CRISPR gRNA sequence
caataaccaaattctcaatg

SEQ ID NO: 416223 - DNA, 20 bp, Artificial
  CRISPR gRNA sequence
tcaatgattagtgtatgtga

SEQ ID NO: 416224 - DNA, 20 bp, Artificial
  CRISPR gRNA sequence
aatgattagtgtatgtgagc

SEQ ID NO: 416225 - DNA, 20 bp, Artificial
  CRISPR gRNA sequence
gtgtatgtgagcaggaaaac

SEQ ID NO: 416226 - DNA, 20 bp, Artificial
  CRISPR gRNA sequence
ttacagttgtagtatgggga

SEQ ID NO: 416227 - DNA, 20 bp, Artificial
  CRISPR gRNA sequence
tacagttgtagtatggggaa

SEQ ID NO: 416228 - DNA, 20 bp, Artificial
  CRISPR gRNA sequence
acagttgtagtatggggaaa

SEQ ID NO: 416229 - DNA, 20 bp, Artificial
  CRISPR gRNA sequence
cagttgtagtatggggaaat

SEQ ID NO: 416230 - DNA, 20 bp, Artificial
  CRISPR gRNA sequence
tagtatggggaaatataaat

SEQ ID NO: 416231 - DNA, 20 bp, Artificial
  CRISPR gRNA sequence
taagagagaaaattatgact

SEQ ID NO: 416232 - DNA, 20 bp, Artificial
  CRISPR gRNA sequence
aagagagaaaattatgactg

SEQ ID NO: 416233 - DNA, 20 bp, Artificial
  CRISPR gRNA sequence
agagagaaaattatgactgg

SEQ ID NO: 416234 - DNA, 20 bp, Artificial
  CRISPR gRNA sequence
tgactgggtgtggaagggac

SEQ ID NO: 416235 - DNA, 20 bp, Artificial
  CRISPR gRNA sequence
ggtgtggaagggacagtata

SEQ ID NO: 416236 - DNA, 20 bp, Artificial
  CRISPR gRNA sequence
tcatggtggtttttactggg

SEQ ID NO: 416237 - DNA, 20 bp, Artificial
  CRISPR gRNA sequence
ttactgggaacttcatgaaa

SEQ ID NO: 416238 - DNA, 20 bp, Artificial
  CRISPR gRNA sequence
tactgggaacttcatgaaag

SEQ ID NO: 416239 - DNA, 20 bp, Artificial
  CRISPR gRNA sequence
actgggaacttcatgaaaga

SEQ ID NO: 416240 - DNA, 20 bp, Artificial
  CRISPR gRNA sequence
ctgggaacttcatgaaagac

SEQ ID NO: 416241 - DNA, 20 bp, Artificial
  CRISPR gRNA sequence
ggaacttcatgaaagacttt

SEQ ID NO: 416242 - DNA, 20 bp, Artificial
  CRISPR gRNA sequence
catgaaagacttttgtagca

SEQ ID NO: 416243 - DNA, 20 bp, Artificial
  CRISPR gRNA sequence
atgaaagacttttgtagcaa

SEQ ID NO: 416244 - DNA, 20 bp, Artificial
  CRISPR gRNA sequence
ttgtagcaaaccactgcagt

SEQ ID NO: 416245 - DNA, 20 bp, Artificial
  CRISPR gRNA sequence
tgtagcaaaccactgcagta

SEQ ID NO: 416246 - DNA, 20 bp, Artificial
  CRISPR gRNA sequence
gtagcaaaccactgcagtat

SEQ ID NO: 416247 - DNA, 20 bp, Artificial
  CRISPR gRNA sequence
tagcaaaccactgcagtatt

SEQ ID NO: 416248 - DNA, 20 bp, Artificial
  CRISPR gRNA sequence
cagtattgcaaagcctccag

SEQ ID NO: 416249 - DNA, 20 bp, Artificial
  CRISPR gRNA sequence
caaagcctccagaacatttg

SEQ ID NO: 416250 - DNA, 20 bp, Artificial
  CRISPR gRNA sequence
cagaacatttggaacttgtc

SEQ ID NO: 416251 - DNA, 20 bp, Artificial
  CRISPR gRNA sequence
ggaacttgtctctttttcct

SEQ ID NO: 416252 - DNA, 20 bp, Artificial
  CRISPR gRNA sequence
gaacttgtctctttttcctt

SEQ ID NO: 416253 - DNA, 20 bp, Artificial
  CRISPR gRNA sequence
gtctctttttccttgtgtgt

SEQ ID NO: 416254 - DNA, 20 bp, Artificial
  CRISPR gRNA sequence
tctctttttccttgtgtgtg

SEQ ID NO: 416255 - DNA, 20 bp, Artificial
  CRISPR gRNA sequence
tttttccttgtgtgtgtttg

SEQ ID NO: 416256 - DNA, 20 bp, Artificial
  CRISPR gRNA sequence
tttccttgtgtgtgtttgtg

SEQ ID NO: 416257 - DNA, 20 bp, Artificial
  CRISPR gRNA sequence
ttccttgtgtgtgtttgtgt

SEQ ID NO: 416258 - DNA, 20 bp, Artificial
  CRISPR gRNA sequence
tccttgtgtgtgtttgtgtt

SEQ ID NO: 416259 - DNA, 20 bp, Artificial
  CRISPR gRNA sequence
ccttgtgtgtgtttgtgttt

SEQ ID NO: 416260 - DNA, 20 bp, Artificial
  CRISPR gRNA sequence
cttgtgtgtgtttgtgtttt

SEQ ID NO: 416261 - DNA, 20 bp, Artificial
  CRISPR gRNA sequence
gtgtgtgtttgtgtttttgg

SEQ ID NO: 416262 - DNA, 20 bp, Artificial
  CRISPR gRNA sequence
tgtgtgtttgtgtttttggt

SEQ ID NO: 416263 - DNA, 20 bp, Artificial
  CRISPR gRNA sequence
gtgtttttggtctctcattc

SEQ ID NO: 416264 - DNA, 20 bp, Artificial
  CRISPR gRNA sequence
tgtttttggtctctcattca

SEQ ID NO: 416265 - DNA, 20 bp, Artificial
  CRISPR gRNA sequence
ttggtctctcattcaaaata

SEQ ID NO: 416266 - DNA, 20 bp, Artificial
  CRISPR gRNA sequence
tggtctctcattcaaaatat

SEQ ID NO: 416267 - DNA, 20 bp, Artificial
  CRISPR gRNA sequence
ggtctctcattcaaaatatt

SEQ ID NO: 416268 - DNA, 20 bp, Artificial
  CRISPR gRNA sequence
gtctctcattcaaaatattg

SEQ ID NO: 416269 - DNA, 20 bp, Artificial
  CRISPR gRNA sequence
tcattcaaaatattgatgag

SEQ ID NO: 416270 - DNA, 20 bp, Artificial
  CRISPR gRNA sequence
attcaaaatattgatgagaa

SEQ ID NO: 416271 - DNA, 20 bp, Artificial
  CRISPR gRNA sequence
aaaatattgatgagaactat

SEQ ID NO: 416272 - DNA, 20 bp, Artificial
  CRISPR gRNA sequence
atgagaactatttactctgt

SEQ ID NO: 416273 - DNA, 20 bp, Artificial
  CRISPR gRNA sequence
tttactctgtcctttcttct

SEQ ID NO: 416274 - DNA, 20 bp, Artificial
  CRISPR gRNA sequence
actctgtcctttcttctcta

SEQ ID NO: 416275 - DNA, 20 bp, Artificial
  CRISPR gRNA sequence
ctctgtcctttcttctctat

SEQ ID NO: 416276 - DNA, 20 bp, Artificial
  CRISPR gRNA sequence
tgtcctttcttctctatata

SEQ ID NO: 416277 - DNA, 20 bp, Artificial
  CRISPR gRNA sequence
tcctttcttctctatatatt

SEQ ID NO: 416278 - DNA, 20 bp, Artificial
  CRISPR gRNA sequence
tcttctctatatattcttcc

SEQ ID NO: 416279 - DNA, 20 bp, Artificial
  CRISPR gRNA sequence
cttctctatatattcttcct

SEQ ID NO: 416280 - DNA, 20 bp, Artificial
  CRISPR gRNA sequence
ttctctatatattcttcctc

SEQ ID NO: 416281 - DNA, 20 bp, Artificial
  CRISPR gRNA sequence
ctctatatattcttcctcta

SEQ ID NO: 416282 - DNA, 20 bp, Artificial
  CRISPR gRNA sequence
tctatatattcttcctctac

SEQ ID NO: 416283 - DNA, 20 bp, Artificial
  CRISPR gRNA sequence
tatatattcttcctctacag

SEQ ID NO: 416284 - DNA, 20 bp, Artificial
  CRISPR gRNA sequence
tatattcttcctctacagag

SEQ ID NO: 416285 - DNA, 20 bp, Artificial
  CRISPR gRNA sequence
ttcctctacagagtgtaggg

SEQ ID NO: 416286 - DNA, 20 bp, Artificial
  CRISPR gRNA sequence
cctctacagagtgtagggtt

SEQ ID NO: 416287 - DNA, 20 bp, Artificial
  CRISPR gRNA sequence
ctctacagagtgtagggttt

SEQ ID NO: 416288 - DNA, 20 bp, Artificial
  CRISPR gRNA sequence
tacagagtgtagggtttttt

SEQ ID NO: 416289 - DNA, 20 bp, Artificial
  CRISPR gRNA sequence
cagagtgtagggttttttca

SEQ ID NO: 416290 - DNA, 20 bp, Artificial
  CRISPR gRNA sequence
tttcaggaatttggagccat

SEQ ID NO: 416291 - DNA, 20 bp, Artificial
  CRISPR gRNA sequence
ttcaggaatttggagccatc

SEQ ID NO: 416292 - DNA, 20 bp, Artificial
  CRISPR gRNA sequence
tcaggaatttggagccatct

SEQ ID NO: 416293 - DNA, 20 bp, Artificial
  CRISPR gRNA sequence
caggaatttggagccatctg

SEQ ID NO: 416294 - DNA, 20 bp, Artificial
  CRISPR gRNA sequence
aggaatttggagccatctga

SEQ ID NO: 416295 - DNA, 20 bp, Artificial
  CRISPR gRNA sequence
ggagccatctgaagtcctcc

SEQ ID NO: 416296 - DNA, 20 bp, Artificial
  CRISPR gRNA sequence
gagccatctgaagtcctccc

SEQ ID NO: 416297 - DNA, 20 bp, Artificial
  CRISPR gRNA sequence
aagtcctcccaaaaattctc

SEQ ID NO: 416298 - DNA, 20 bp, Artificial
  CRISPR gRNA sequence
ccaaaaattctctgacgtct

SEQ ID NO: 416299 - DNA, 20 bp, Artificial
  CRISPR gRNA sequence
tctgacgtcttctgatgctc

SEQ ID NO: 416300 - DNA, 20 bp, Artificial
  CRISPR gRNA sequence
tgacgtcttctgatgctcct

SEQ ID NO: 416301 - DNA, 20 bp, Artificial
  CRISPR gRNA sequence
acgtcttctgatgctcctgt

SEQ ID NO: 416302 - DNA, 20 bp, Artificial
  CRISPR gRNA sequence
ctgatgctcctgttataccc

SEQ ID NO: 416303 - DNA, 20 bp, Artificial
  CRISPR gRNA sequence
tgatgctcctgttataccct

SEQ ID NO: 416304 - DNA, 20 bp, Artificial
  CRISPR gRNA sequence
atgctcctgttataccctca

SEQ ID NO: 416305 - DNA, 20 bp, Artificial
  CRISPR gRNA sequence
ctgttataccctcaggggta

SEQ ID NO: 416306 - DNA, 20 bp, Artificial
  CRISPR gRNA sequence
ttataccctcaggggtaatg

SEQ ID NO: 416307 - DNA, 20 bp, Artificial
  CRISPR gRNA sequence
taccctcaggggtaatgctt

SEQ ID NO: 416308 - DNA, 20 bp, Artificial
  CRISPR gRNA sequence
aggggtaatgcttgtgaaat

SEQ ID NO: 416309 - DNA, 20 bp, Artificial
  CRISPR gRNA sequence
gtgaaattccattcattcat

SEQ ID NO: 416310 - DNA, 20 bp, Artificial
  CRISPR gRNA sequence
tgaaattccattcattcatt

SEQ ID NO: 416311 - DNA, 20 bp, Artificial
  CRISPR gRNA sequence
cattcattcattttctttct

SEQ ID NO: 416312 - DNA, 20 bp, Artificial
  CRISPR gRNA sequence
attcattttctttctctgga

SEQ ID NO: 416313 - DNA, 20 bp, Artificial
  CRISPR gRNA sequence
attttctttctctggacatc

SEQ ID NO: 416314 - DNA, 20 bp, Artificial
  CRISPR gRNA sequence
tctttctctggacatcttta

SEQ ID NO: 416315 - DNA, 20 bp, Artificial
  CRISPR gRNA sequence
ctttctctggacatctttac

SEQ ID NO: 416316 - DNA, 20 bp, Artificial
  CRISPR gRNA sequence
tttctctggacatctttact

SEQ ID NO: 416317 - DNA, 20 bp, Artificial
  CRISPR gRNA sequence
tctctggacatctttactta

SEQ ID NO: 416318 - DNA, 20 bp, Artificial
  CRISPR gRNA sequence
ctctggacatctttacttac

SEQ ID NO: 416319 - DNA, 20 bp, Artificial
  CRISPR gRNA sequence
tctggacatctttacttacc

SEQ ID NO: 416320 - DNA, 20 bp, Artificial
  CRISPR gRNA sequence
tggacatctttacttaccaa

SEQ ID NO: 416321 - DNA, 20 bp, Artificial
  CRISPR gRNA sequence
gacatctttacttaccaaag

SEQ ID NO: 416322 - DNA, 20 bp, Artificial
  CRISPR gRNA sequence
tacttaccaaagcactttca

SEQ ID NO: 416323 - DNA, 20 bp, Artificial
  CRISPR gRNA sequence
acttaccaaagcactttcat

SEQ ID NO: 416324 - DNA, 20 bp, Artificial
  CRISPR gRNA sequence
cttaccaaagcactttcatt

SEQ ID NO: 416325 - DNA, 20 bp, Artificial
  CRISPR gRNA sequence
accaaagcactttcattgtc

SEQ ID NO: 416326 - DNA, 20 bp, Artificial
  CRISPR gRNA sequence
ccaaagcactttcattgtca

SEQ ID NO: 416327 - DNA, 20 bp, Artificial
  CRISPR gRNA sequence
tcattgtcatctttttaaca

SEQ ID NO: 416328 - DNA, 20 bp, Artificial
  CRISPR gRNA sequence
cattgtcatctttttaacat

SEQ ID NO: 416329 - DNA, 20 bp, Artificial
  CRISPR gRNA sequence
attgtcatctttttaacatc

SEQ ID NO: 416330 - DNA, 20 bp, Artificial
  CRISPR gRNA sequence
tcatctttttaacatcattc

SEQ ID NO: 416331 - DNA, 20 bp, Artificial
  CRISPR gRNA sequence
tttaacatcattcttaattc

SEQ ID NO: 416332 - DNA, 20 bp, Artificial
  CRISPR gRNA sequence
ttaacatcattcttaattcg

SEQ ID NO: 416333 - DNA, 20 bp, Artificial
  CRISPR gRNA sequence
taacatcattcttaattcgt

SEQ ID NO: 416334 - DNA, 20 bp, Artificial
  CRISPR gRNA sequence
aacatcattcttaattcgtg

SEQ ID NO: 416335 - DNA, 20 bp, Artificial
  CRISPR gRNA sequence
acatcattcttaattcgtga

SEQ ID NO: 416336 - DNA, 20 bp, Artificial
  CRISPR gRNA sequence
ttaattcgtgatagttttgg

SEQ ID NO: 416337 - DNA, 20 bp, Artificial
  CRISPR gRNA sequence
aattcgtgatagttttggga

SEQ ID NO: 416338 - DNA, 20 bp, Artificial
  CRISPR gRNA sequence
attcgtgatagttttgggac

SEQ ID NO: 416339 - DNA, 20 bp, Artificial
  CRISPR gRNA sequence
gtgatagttttgggactctc

SEQ ID NO: 416340 - DNA, 20 bp, Artificial
  CRISPR gRNA sequence
tgggactctccctagtgtat

SEQ ID NO: 416341 - DNA, 20 bp, Artificial
  CRISPR gRNA sequence
gggactctccctagtgtatg

SEQ ID NO: 416342 - DNA, 20 bp, Artificial
  CRISPR gRNA sequence
ggactctccctagtgtatgt

SEQ ID NO: 416343 - DNA, 20 bp, Artificial
  CRISPR gRNA sequence
tccctagtgtatgtttctcc

SEQ ID NO: 416344 - DNA, 20 bp, Artificial
  CRISPR gRNA sequence
cctagtgtatgtttctcccc

SEQ ID NO: 416345 - DNA, 20 bp, Artificial
  CRISPR gRNA sequence
gtgtatgtttctccccctct

SEQ ID NO: 416346 - DNA, 20 bp, Artificial
  CRISPR gRNA sequence
ctccccctctactcttttgc

SEQ ID NO: 416347 - DNA, 20 bp, Artificial
  CRISPR gRNA sequence
tccccctctactcttttgca

SEQ ID NO: 416348 - DNA, 20 bp, Artificial
  CRISPR gRNA sequence
cccctctactcttttgcacc

SEQ ID NO: 416349 - DNA, 20 bp, Artificial
  CRISPR gRNA sequence
tactcttttgcacctatgat

SEQ ID NO: 416350 - DNA, 20 bp, Artificial
  CRISPR gRNA sequence
ctcttttgcacctatgattc

SEQ ID NO: 416351 - DNA, 20 bp, Artificial
  CRISPR gRNA sequence
ttttgcacctatgattctga

SEQ ID NO: 416352 - DNA, 20 bp, Artificial
  CRISPR gRNA sequence
ttgcacctatgattctgatt

SEQ ID NO: 416353 - DNA, 20 bp, Artificial
  CRISPR gRNA sequence
tgcacctatgattctgattg

SEQ ID NO: 416354 - DNA, 20 bp, Artificial
  CRISPR gRNA sequence
gcacctatgattctgattgt

SEQ ID NO: 416355 - DNA, 20 bp, Artificial
  CRISPR gRNA sequence
cacctatgattctgattgtt

SEQ ID NO: 416356 - DNA, 20 bp, Artificial
  CRISPR gRNA sequence
tgattctgattgttactaag

SEQ ID NO: 416357 - DNA, 20 bp, Artificial
  CRISPR gRNA sequence
tgattgttactaagaaagca

SEQ ID NO: 416358 - DNA, 20 bp, Artificial
  CRISPR gRNA sequence
attgttactaagaaagcaga

SEQ ID NO: 416359 - DNA, 20 bp, Artificial
  CRISPR gRNA sequence
ttactaagaaagcagatgaa

SEQ ID NO: 416360 - DNA, 20 bp, Artificial
  CRISPR gRNA sequence
ctaagaaagcagatgaaaaa

SEQ ID NO: 416361 - DNA, 20 bp, Artificial
  CRISPR gRNA sequence
agaaagcagatgaaaaacag

SEQ ID NO: 416362 - DNA, 20 bp, Artificial
  CRISPR gRNA sequence
cagtaaattctattttaaat

SEQ ID NO: 416363 - DNA, 20 bp, Artificial
  CRISPR gRNA sequence
tattttaaatacagatactt

SEQ ID NO: 416364 - DNA, 20 bp, Artificial
  CRISPR gRNA sequence
ttttaaatacagatactttt

SEQ ID NO: 416365 - DNA, 20 bp, Artificial
  CRISPR gRNA sequence
taaatacagatactttttac

SEQ ID NO: 416366 - DNA, 20 bp, Artificial
  CRISPR gRNA sequence
aaatacagatactttttaca

SEQ ID NO: 416367 - DNA, 20 bp, Artificial
  CRISPR gRNA sequence
aatacagatactttttacaa

SEQ ID NO: 416368 - DNA, 20 bp, Artificial
  CRISPR gRNA sequence
tttacaagttgctgctttgg

SEQ ID NO: 416369 - DNA, 20 bp, Artificial
  CRISPR gRNA sequence
ttacaagttgctgctttgga

SEQ ID NO: 416370 - DNA, 20 bp, Artificial
  CRISPR gRNA sequence
tacaagttgctgctttggaa

SEQ ID NO: 416371 - DNA, 20 bp, Artificial
  CRISPR gRNA sequence
acaagttgctgctttggaag

SEQ ID NO: 416372 - DNA, 20 bp, Artificial
  CRISPR gRNA sequence
caagttgctgctttggaagc

SEQ ID NO: 416373 - DNA, 20 bp, Artificial
  CRISPR gRNA sequence
ctgctttggaagcaaaatgc

SEQ ID NO: 416374 - DNA, 20 bp, Artificial
  CRISPR gRNA sequence
ctttggaagcaaaatgcttc

SEQ ID NO: 416375 - DNA, 20 bp, Artificial
  CRISPR gRNA sequence
tggaagcaaaatgcttctta

SEQ ID NO: 416376 - DNA, 20 bp, Artificial
  CRISPR gRNA sequence
ggaagcaaaatgcttcttaa

SEQ ID NO: 416377 - DNA, 20 bp, Artificial
  CRISPR gRNA sequence
gaagcaaaatgcttcttaag

SEQ ID NO: 416378 - DNA, 20 bp, Artificial
  CRISPR gRNA sequence
cttaagttttacatatatat

SEQ ID NO: 416379 - DNA, 20 bp, Artificial
  CRISPR gRNA sequence
ttaagttttacatatatata

SEQ ID NO: 416380 - DNA, 20 bp, Artificial
  CRISPR gRNA sequence
aagttttacatatatatata

SEQ ID NO: 416381 - DNA, 20 bp, Artificial
  CRISPR gRNA sequence
agttttacatatatatatat

SEQ ID NO: 416382 - DNA, 20 bp, Artificial
  CRISPR gRNA sequence
tacatatatatatatatata

SEQ ID NO: 416383 - DNA, 20 bp, Artificial
  CRISPR gRNA sequence
acatatatatatatatatat

SEQ ID NO: 416384 - DNA, 20 bp, Artificial
  CRISPR gRNA sequence
catatatatatatatatata

SEQ ID NO: 416385 - DNA, 20 bp, Artificial
  CRISPR gRNA sequence
atatcgatggataatacatt

SEQ ID NO: 416386 - DNA, 20 bp, Artificial
  CRISPR gRNA sequence
tatcgatggataatacatta

SEQ ID NO: 416387 - DNA, 20 bp, Artificial
  CRISPR gRNA sequence
agaatctatgcttcctttga

SEQ ID NO: 416388 - DNA, 20 bp, Artificial
  CRISPR gRNA sequence
tgcttcctttgaatgccatt

SEQ ID NO: 416389 - DNA, 20 bp, Artificial
  CRISPR gRNA sequence
cctttgaatgccattaatat

SEQ ID NO: 416390 - DNA, 20 bp, Artificial
  CRISPR gRNA sequence
ctttgaatgccattaatatt

SEQ ID NO: 416391 - DNA, 20 bp, Artificial
  CRISPR gRNA sequence
tgaatgccattaatatttat

SEQ ID NO: 416392 - DNA, 20 bp, Artificial
  CRISPR gRNA sequence
gaatgccattaatatttatg

SEQ ID NO: 416393 - DNA, 20 bp, Artificial
  CRISPR gRNA sequence
aatgccattaatatttatgt

SEQ ID NO: 416394 - DNA, 20 bp, Artificial
  CRISPR gRNA sequence
atatttatgttaaagtaacc

SEQ ID NO: 416395 - DNA, 20 bp, Artificial
  CRISPR gRNA sequence
atgttaaagtaaccaatgaa

SEQ ID NO: 416396 - DNA, 20 bp, Artificial
  CRISPR gRNA sequence
tgttaaagtaaccaatgaaa

SEQ ID NO: 416397 - DNA, 20 bp, Artificial
  CRISPR gRNA sequence
aagtaaccaatgaaaggaaa

SEQ ID NO: 416398 - DNA, 20 bp, Artificial
  CRISPR gRNA sequence
ctttgttataataagatagg

SEQ ID NO: 416399 - DNA, 20 bp, Artificial
  CRISPR gRNA sequence
tgttataataagataggaag

SEQ ID NO: 416400 - DNA, 20 bp, Artificial
  CRISPR gRNA sequence
gttataataagataggaaga

SEQ ID NO: 416401 - DNA, 20 bp, Artificial
  CRISPR gRNA sequence
ttataataagataggaagac

SEQ ID NO: 416402 - DNA, 20 bp, Artificial
  CRISPR gRNA sequence
taataagataggaagacttg

SEQ ID NO: 416403 - DNA, 20 bp, Artificial
  CRISPR gRNA sequence
gttaatggagtacacagttt

SEQ ID NO: 416404 - DNA, 20 bp, Artificial
  CRISPR gRNA sequence
ttaatggagtacacagtttt

SEQ ID NO: 416405 - DNA, 20 bp, Artificial
  CRISPR gRNA sequence
atggagtacacagttttgtc

SEQ ID NO: 416406 - DNA, 20 bp, Artificial
  CRISPR gRNA sequence
tgtcagggaaagaacacatc

SEQ ID NO: 416407 - DNA, 20 bp, Artificial
  CRISPR gRNA sequence
gtcagggaaagaacacatct

SEQ ID NO: 416408 - DNA, 20 bp, Artificial
  CRISPR gRNA sequence
tcagggaaagaacacatctt

SEQ ID NO: 416409 - DNA, 20 bp, Artificial
  CRISPR gRNA sequence
attgaactatgatgactatg

SEQ ID NO: 416410 - DNA, 20 bp, Artificial
  CRISPR gRNA sequence
ttgaactatgatgactatgc

SEQ ID NO: 416411 - DNA, 20 bp, Artificial
  CRISPR gRNA sequence
aactatgatgactatgcatt

SEQ ID NO: 416412 - DNA, 20 bp, Artificial
  CRISPR gRNA sequence
tgatgactatgcattgacta

SEQ ID NO: 416413 - DNA, 20 bp, Artificial
  CRISPR gRNA sequence
tgcattgactatattattat

SEQ ID NO: 416414 - DNA, 20 bp, Artificial
  CRISPR gRNA sequence
actatattattataagagat

SEQ ID NO: 416415 - DNA, 20 bp, Artificial
  CRISPR gRNA sequence
tattattataagagatacct

SEQ ID NO: 416416 - DNA, 20 bp, Artificial
  CRISPR gRNA sequence
ttataagagataccttcaaa

SEQ ID NO: 416417 - DNA, 20 bp, Artificial
  CRISPR gRNA sequence
taagagataccttcaaactt

SEQ ID NO: 416418 - DNA, 20 bp, Artificial
  CRISPR gRNA sequence
caaactttatttaaagaact

SEQ ID NO: 416419 - DNA, 20 bp, Artificial
  CRISPR gRNA sequence
aaactttatttaaagaactt

SEQ ID NO: 416420 - DNA, 20 bp, Artificial
  CRISPR gRNA sequence
tatttaaagaactttaggta

SEQ ID NO: 416421 - DNA, 20 bp, Artificial
  CRISPR gRNA sequence
atttaaagaactttaggtat

SEQ ID NO: 416422 - DNA, 20 bp, Artificial
  CRISPR gRNA sequence
tttaaagaactttaggtata

SEQ ID NO: 416423 - DNA, 20 bp, Artificial
  CRISPR gRNA sequence
aaagaactttaggtataata

SEQ ID NO: 416424 - DNA, 20 bp, Artificial
  CRISPR gRNA sequence
aagaactttaggtataatat

SEQ ID NO: 416425 - DNA, 20 bp, Artificial
  CRISPR gRNA sequence
taggtataatatgttgagaa

SEQ ID NO: 416426 - DNA, 20 bp, Artificial
  CRISPR gRNA sequence
aggtataatatgttgagaaa

SEQ ID NO: 416427 - DNA, 20 bp, Artificial
  CRISPR gRNA sequence
ggtataatatgttgagaaaa

SEQ ID NO: 416428 - DNA, 20 bp, Artificial
  CRISPR gRNA sequence
agaaaataaaatagaaattt

SEQ ID NO: 416429 - DNA, 20 bp, Artificial
  CRISPR gRNA sequence
catttacttgtaatcatgct

SEQ ID NO: 416430 - DNA, 20 bp, Artificial
  CRISPR gRNA sequence
atttacttgtaatcatgctt

SEQ ID NO: 416431 - DNA, 20 bp, Artificial
  CRISPR gRNA sequence
acttgtaatcatgcttaaaa

SEQ ID NO: 416432 - DNA, 20 bp, Artificial
  CRISPR gRNA sequence
cttgtaatcatgcttaaaat

SEQ ID NO: 416433 - DNA, 20 bp, Artificial
  CRISPR gRNA sequence
gtaatcatgcttaaaatggg

SEQ ID NO: 416434 - DNA, 20 bp, Artificial
  CRISPR gRNA sequence
taatcatgcttaaaatggga

SEQ ID NO: 416435 - DNA, 20 bp, Artificial
  CRISPR gRNA sequence
aaaatgggaggcaggtaggt

SEQ ID NO: 416436 - DNA, 20 bp, Artificial
  CRISPR gRNA sequence
aaatgggaggcaggtaggtg

SEQ ID NO: 416437 - DNA, 20 bp, Artificial
  CRISPR gRNA sequence
ttagtaaaaactccaattta

SEQ ID NO: 416438 - DNA, 20 bp, Artificial
  CRISPR gRNA sequence
tagtaaaaactccaatttat

SEQ ID NO: 416439 - DNA, 20 bp, Artificial
  CRISPR gRNA sequence
agtaaaaactccaatttatg

SEQ ID NO: 416440 - DNA, 20 bp, Artificial
  CRISPR gRNA sequence
gtaaaaactccaatttatgt

SEQ ID NO: 416441 - DNA, 20 bp, Artificial
  CRISPR gRNA sequence
caatttatgttttaagtaat

SEQ ID NO: 416442 - DNA, 20 bp, Artificial
  CRISPR gRNA sequence
atgttttaagtaattcagtg

SEQ ID NO: 416443 - DNA, 20 bp, Artificial
  CRISPR gRNA sequence
tgttttaagtaattcagtgt

SEQ ID NO: 416444 - DNA, 20 bp, Artificial
  CRISPR gRNA sequence
taagtaattcagtgtattac

SEQ ID NO: 416445 - DNA, 20 bp, Artificial
  CRISPR gRNA sequence
aagtaattcagtgtattact

SEQ ID NO: 416446 - DNA, 20 bp, Artificial
  CRISPR gRNA sequence
agtaattcagtgtattacta

SEQ ID NO: 416447 - DNA, 20 bp, Artificial
  CRISPR gRNA sequence
agtgtattactaaaatacta

SEQ ID NO: 416448 - DNA, 20 bp, Artificial
  CRISPR gRNA sequence
ctaaaatactatatatataa

SEQ ID NO: 416449 - DNA, 20 bp, Artificial
  CRISPR gRNA sequence
aaatactatatatataaact

SEQ ID NO: 416450 - DNA, 20 bp, Artificial
  CRISPR gRNA sequence
tatatataaacttaaaatac

SEQ ID NO: 416451 - DNA, 20 bp, Artificial
  CRISPR gRNA sequence
aaaatacatgggttatcaat

SEQ ID NO: 416452 - DNA, 20 bp, Artificial
  CRISPR gRNA sequence
aaatacatgggttatcaatt

SEQ ID NO: 416453 - DNA, 20 bp, Artificial
  CRISPR gRNA sequence
tcaatttaaaagacaaagta

SEQ ID NO: 416454 - DNA, 20 bp, Artificial
  CRISPR gRNA sequence
aaaagacaaagtaagtaaaa

SEQ ID NO: 416455 - DNA, 20 bp, Artificial
  CRISPR gRNA sequence
aaagacaaagtaagtaaaaa

SEQ ID NO: 416456 - DNA, 20 bp, Artificial
  CRISPR gRNA sequence
ttagtaggcattcgtggatt

SEQ ID NO: 416457 - DNA, 20 bp, Artificial
  CRISPR gRNA sequence
tagtaggcattcgtggattg

SEQ ID NO: 416458 - DNA, 20 bp, Artificial
  CRISPR gRNA sequence
agtaggcattcgtggattgt

SEQ ID NO: 416459 - DNA, 20 bp, Artificial
  CRISPR gRNA sequence
gtaggcattcgtggattgtg

SEQ ID NO: 416460 - DNA, 20 bp, Artificial
  CRISPR gRNA sequence
gtggattgtgaacatccaag

SEQ ID NO: 416461 - DNA, 20 bp, Artificial
  CRISPR gRNA sequence
tgaacatccaagttatattg

SEQ ID NO: 416462 - DNA, 20 bp, Artificial
  CRISPR gRNA sequence
tattggtttgtatagaatgg

SEQ ID NO: 416463 - DNA, 20 bp, Artificial
  CRISPR gRNA sequence
gtttgtatagaatggcatta

SEQ ID NO: 416464 - DNA, 20 bp, Artificial
  CRISPR gRNA sequence
gtatagaatggcattaagta

SEQ ID NO: 416465 - DNA, 20 bp, Artificial
  CRISPR gRNA sequence
tatagaatggcattaagtaa

SEQ ID NO: 416466 - DNA, 20 bp, Artificial
  CRISPR gRNA sequence
agtaaaaattacagctgtat

SEQ ID NO: 416467 - DNA, 20 bp, Artificial
  CRISPR gRNA sequence
cagctgtataacagtagttt

SEQ ID NO: 416468 - DNA, 20 bp, Artificial
  CRISPR gRNA sequence
tataacagtagttttctaaa

SEQ ID NO: 416469 - DNA, 20 bp, Artificial
  CRISPR gRNA sequence
tctaaattgagagagtccac

SEQ ID NO: 416470 - DNA, 20 bp, Artificial
  CRISPR gRNA sequence
ctaaattgagagagtccaca

SEQ ID NO: 416471 - DNA, 20 bp, Artificial
  CRISPR gRNA sequence
taaattgagagagtccacat

SEQ ID NO: 416472 - DNA, 20 bp, Artificial
  CRISPR gRNA sequence
aattgagagagtccacattg

SEQ ID NO: 416473 - DNA, 20 bp, Artificial
  CRISPR gRNA sequence
agagagtccacattgtaatt

SEQ ID NO: 416474 - DNA, 20 bp, Artificial
  CRISPR gRNA sequence
taattagagatcactgtgac

SEQ ID NO: 416475 - DNA, 20 bp, Artificial
  CRISPR gRNA sequence
gagatcactgtgaccaaaat

SEQ ID NO: 416476 - DNA, 20 bp, Artificial
  CRISPR gRNA sequence
tgaccaaaatgcttctcctt

SEQ ID NO: 416477 - DNA, 20 bp, Artificial
  CRISPR gRNA sequence
ctccttgatttataatgatg

SEQ ID NO: 416478 - DNA, 20 bp, Artificial
  CRISPR gRNA sequence
tccttgatttataatgatgt

SEQ ID NO: 416479 - DNA, 20 bp, Artificial
  CRISPR gRNA sequence
cttgatttataatgatgtac

SEQ ID NO: 416480 - DNA, 20 bp, Artificial
  CRISPR gRNA sequence
gatttataatgatgtactgt

SEQ ID NO: 416481 - DNA, 20 bp, Artificial
  CRISPR gRNA sequence
atttataatgatgtactgta

SEQ ID NO: 416482 - DNA, 20 bp, Artificial
  CRISPR gRNA sequence
ataatgatgtactgtatttt

SEQ ID NO: 416483 - DNA, 20 bp, Artificial
  CRISPR gRNA sequence
taatgatgtactgtattttg

SEQ ID NO: 416484 - DNA, 20 bp, Artificial
  CRISPR gRNA sequence
tattttgtactgcttatatg

SEQ ID NO: 416485 - DNA, 20 bp, Artificial
  CRISPR gRNA sequence
tgtactgcttatatgaaatt

SEQ ID NO: 416486 - DNA, 20 bp, Artificial
  CRISPR gRNA sequence
gtactgcttatatgaaattt

SEQ ID NO: 416487 - DNA, 20 bp, Artificial
  CRISPR gRNA sequence
tactgcttatatgaaatttc

SEQ ID NO: 416488 - DNA, 20 bp, Artificial
  CRISPR gRNA sequence
cttatatgaaatttcagcaa

SEQ ID NO: 416489 - DNA, 20 bp, Artificial
  CRISPR gRNA sequence
atatgaaatttcagcaagat

SEQ ID NO: 416490 - DNA, 20 bp, Artificial
  CRISPR gRNA sequence
tatgaaatttcagcaagatt

SEQ ID NO: 416491 - DNA, 20 bp, Artificial
  CRISPR gRNA sequence
cagcaagattgacgatatta

SEQ ID NO: 416492 - DNA, 20 bp, Artificial
  CRISPR gRNA sequence
agcaagattgacgatattat

SEQ ID NO: 416493 - DNA, 20 bp, Artificial
  CRISPR gRNA sequence
acgatattataaagatgctt

SEQ ID NO: 416494 - DNA, 20 bp, Artificial
  CRISPR gRNA sequence
taaagatgcttataaagtgt

SEQ ID NO: 416495 - DNA, 20 bp, Artificial
  CRISPR gRNA sequence
ataaagtgtaagtggagacg

SEQ ID NO: 416496 - DNA, 20 bp, Artificial
  CRISPR gRNA sequence
taaagtgtaagtggagacgc

SEQ ID NO: 416497 - DNA, 20 bp, Artificial
  CRISPR gRNA sequence
aattgtgagtacaaagtttc

SEQ ID NO: 416498 - DNA, 20 bp, Artificial
  CRISPR gRNA sequence
tgagtacaaagtttcttttt

SEQ ID NO: 416499 - DNA, 20 bp, Artificial
  CRISPR gRNA sequence
ctttttcacaacagtgataa

SEQ ID NO: 416500 - DNA, 20 bp, Artificial
  CRISPR gRNA sequence
tttttcacaacagtgataag

SEQ ID NO: 416501 - DNA, 20 bp, Artificial
  CRISPR gRNA sequence
tttcacaacagtgataagaa

SEQ ID NO: 416502 - DNA, 20 bp, Artificial
  CRISPR gRNA sequence
ttcacaacagtgataagaaa

SEQ ID NO: 416503 - DNA, 20 bp, Artificial
  CRISPR gRNA sequence
tcacaacagtgataagaaaa

SEQ ID NO: 416504 - DNA, 20 bp, Artificial
  CRISPR gRNA sequence
cacaacagtgataagaaaat

SEQ ID NO: 416505 - DNA, 20 bp, Artificial
  CRISPR gRNA sequence
acaacagtgataagaaaata

SEQ ID NO: 416506 - DNA, 20 bp, Artificial
  CRISPR gRNA sequence
taaaaaatataagacaatat

SEQ ID NO: 416507 - DNA, 20 bp, Artificial
  CRISPR gRNA sequence
aaaaaatataagacaatata

SEQ ID NO: 416508 - DNA, 20 bp, Artificial
  CRISPR gRNA sequence
aaaaatataagacaatataa

SEQ ID NO: 416509 - DNA, 20 bp, Artificial
  CRISPR gRNA sequence
gtttagctactattaaaatg

SEQ ID NO: 416510 - DNA, 20 bp, Artificial
  CRISPR gRNA sequence
agctactattaaaatgtaac

SEQ ID NO: 416511 - DNA, 20 bp, Artificial
  CRISPR gRNA sequence
gctactattaaaatgtaaca

SEQ ID NO: 416512 - DNA, 20 bp, Artificial
  CRISPR gRNA sequence
ctattaaaatgtaacatcta

SEQ ID NO: 416513 - DNA, 20 bp, Artificial
  CRISPR gRNA sequence
ttaaaatgtaacatctagaa

SEQ ID NO: 416514 - DNA, 20 bp, Artificial
  CRISPR gRNA sequence
aaatgtaacatctagaaagt

SEQ ID NO: 416515 - DNA, 20 bp, Artificial
  CRISPR gRNA sequence
gaaagtactgatctccacct

SEQ ID NO: 416516 - DNA, 20 bp, Artificial
  CRISPR gRNA sequence
atctccaccttcagacttct

SEQ ID NO: 416517 - DNA, 20 bp, Artificial
  CRISPR gRNA sequence
caccttcagacttctgtata

SEQ ID NO: 416518 - DNA, 20 bp, Artificial
  CRISPR gRNA sequence
cagacttctgtataagtata

SEQ ID NO: 416519 - DNA, 20 bp, Artificial
  CRISPR gRNA sequence
agacttctgtataagtatat

SEQ ID NO: 416520 - DNA, 20 bp, Artificial
  CRISPR gRNA sequence
ctgtataagtatattttttc

SEQ ID NO: 416521 - DNA, 20 bp, Artificial
  CRISPR gRNA sequence
tgtataagtatattttttca

SEQ ID NO: 416522 - DNA, 20 bp, Artificial
  CRISPR gRNA sequence
tataagtatattttttcact

SEQ ID NO: 416523 - DNA, 20 bp, Artificial
  CRISPR gRNA sequence
tttcactgatctgttcatta

SEQ ID NO: 416524 - DNA, 20 bp, Artificial
  CRISPR gRNA sequence
ttcactgatctgttcattag

SEQ ID NO: 416525 - DNA, 20 bp, Artificial
  CRISPR gRNA sequence
tcactgatctgttcattaga

SEQ ID NO: 416526 - DNA, 20 bp, Artificial
  CRISPR gRNA sequence
cactgatctgttcattagag

SEQ ID NO: 416527 - DNA, 20 bp, Artificial
  CRISPR gRNA sequence
actgatctgttcattagagt

SEQ ID NO: 416528 - DNA, 20 bp, Artificial
  CRISPR gRNA sequence
atctgttcattagagttctt

SEQ ID NO: 416529 - DNA, 20 bp, Artificial
  CRISPR gRNA sequence
ttcattagagttcttccagc

SEQ ID NO: 416530 - DNA, 20 bp, Artificial
  CRISPR gRNA sequence
attagagttcttccagccaa

SEQ ID NO: 416531 - DNA, 20 bp, Artificial
  CRISPR gRNA sequence
gagttcttccagccaagact

SEQ ID NO: 416532 - DNA, 20 bp, Artificial
  CRISPR gRNA sequence
ttccagccaagactctgggc

SEQ ID NO: 416533 - DNA, 20 bp, Artificial
  CRISPR gRNA sequence
ccagccaagactctgggctc

SEQ ID NO: 416534 - DNA, 20 bp, Artificial
  CRISPR gRNA sequence
cagccaagactctgggctct

SEQ ID NO: 416535 - DNA, 20 bp, Artificial
  CRISPR gRNA sequence
tgggctcttaaaacatgtat

SEQ ID NO: 416536 - DNA, 20 bp, Artificial
  CRISPR gRNA sequence
ggctcttaaaacatgtatct

SEQ ID NO: 416537 - DNA, 20 bp, Artificial
  CRISPR gRNA sequence
ttaaaacatgtatctgaaaa

SEQ ID NO: 416538 - DNA, 20 bp, Artificial
  CRISPR gRNA sequence
aaaacatgtatctgaaaact

SEQ ID NO: 416539 - DNA, 20 bp, Artificial
  CRISPR gRNA sequence
aaacatgtatctgaaaacta

SEQ ID NO: 416540 - DNA, 20 bp, Artificial
  CRISPR gRNA sequence
aaaactaaaaacaagttaat

SEQ ID NO: 416541 - DNA, 20 bp, Artificial
  CRISPR gRNA sequence
aaaacaagttaattttttta

SEQ ID NO: 416542 - DNA, 20 bp, Artificial
  CRISPR gRNA sequence
atttttttaaaagcttctct

SEQ ID NO: 416543 - DNA, 20 bp, Artificial
  CRISPR gRNA sequence
ttttaaaagcttctctattt

SEQ ID NO: 416544 - DNA, 20 bp, Artificial
  CRISPR gRNA sequence
tttaaaagcttctctatttc

SEQ ID NO: 416545 - DNA, 20 bp, Artificial
  CRISPR gRNA sequence
ttaaaagcttctctatttct

SEQ ID NO: 416546 - DNA, 20 bp, Artificial
  CRISPR gRNA sequence
taaaagcttctctatttcta

SEQ ID NO: 416547 - DNA, 20 bp, Artificial
  CRISPR gRNA sequence
aaaagcttctctatttctag

SEQ ID NO: 416548 - DNA, 20 bp, Artificial
  CRISPR gRNA sequence
aaagcttctctatttctagt

SEQ ID NO: 416549 - DNA, 20 bp, Artificial
  CRISPR gRNA sequence
ctctatttctagtgattcaa

SEQ ID NO: 416550 - DNA, 20 bp, Artificial
  CRISPR gRNA sequence
tctatttctagtgattcaat

SEQ ID NO: 416551 - DNA, 20 bp, Artificial
  CRISPR gRNA sequence
tatttctagtgattcaatag

SEQ ID NO: 416552 - DNA, 20 bp, Artificial
  CRISPR gRNA sequence
tttctagtgattcaataggt

SEQ ID NO: 416553 - DNA, 20 bp, Artificial
  CRISPR gRNA sequence
ctagtgattcaataggtaga

SEQ ID NO: 416554 - DNA, 20 bp, Artificial
  CRISPR gRNA sequence
tagtgattcaataggtagaa

SEQ ID NO: 416555 - DNA, 20 bp, Artificial
  CRISPR gRNA sequence
gtgattcaataggtagaaaa

SEQ ID NO: 416556 - DNA, 20 bp, Artificial
  CRISPR gRNA sequence
aataggtagaaaaatagctt

SEQ ID NO: 416557 - DNA, 20 bp, Artificial
  CRISPR gRNA sequence
ctagaattaactgcaatgct

SEQ ID NO: 416558 - DNA, 20 bp, Artificial
  CRISPR gRNA sequence
tagaattaactgcaatgctt

SEQ ID NO: 416559 - DNA, 20 bp, Artificial
  CRISPR gRNA sequence
gaattaactgcaatgctttc

SEQ ID NO: 416560 - DNA, 20 bp, Artificial
  CRISPR gRNA sequence
actgcaatgctttctaagga

SEQ ID NO: 416561 - DNA, 20 bp, Artificial
  CRISPR gRNA sequence
caatgctttctaaggaaatt

SEQ ID NO: 416562 - DNA, 20 bp, Artificial
  CRISPR gRNA sequence
tctaaggaaattttataaat

SEQ ID NO: 416563 - DNA, 20 bp, Artificial
  CRISPR gRNA sequence
ctaaggaaattttataaatc

SEQ ID NO: 416564 - DNA, 20 bp, Artificial
  CRISPR gRNA sequence
taaggaaattttataaatcc

SEQ ID NO: 416565 - DNA, 20 bp, Artificial
  CRISPR gRNA sequence
aggaaattttataaatcctc

SEQ ID NO: 416566 - DNA, 20 bp, Artificial
  CRISPR gRNA sequence
tataaatcctcaaggtcggt

SEQ ID NO: 416567 - DNA, 20 bp, Artificial
  CRISPR gRNA sequence
ataaatcctcaaggtcggtt

SEQ ID NO: 416568 - DNA, 20 bp, Artificial
  CRISPR gRNA sequence
taaatcctcaaggtcggttt

SEQ ID NO: 416569 - DNA, 20 bp, Artificial
  CRISPR gRNA sequence
aaggtcggtttacacatatt

SEQ ID NO: 416570 - DNA, 20 bp, Artificial
  CRISPR gRNA sequence
acacatatttttccagattc

SEQ ID NO: 416571 - DNA, 20 bp, Artificial
  CRISPR gRNA sequence
cacatatttttccagattca

SEQ ID NO: 416572 - DNA, 20 bp, Artificial
  CRISPR gRNA sequence
ttccagattcagagcactaa

SEQ ID NO: 416573 - DNA, 20 bp, Artificial
  CRISPR gRNA sequence
tccagattcagagcactaac

SEQ ID NO: 416574 - DNA, 20 bp, Artificial
  CRISPR gRNA sequence
ccagattcagagcactaact

SEQ ID NO: 416575 - DNA, 20 bp, Artificial
  CRISPR gRNA sequence
cagattcagagcactaacta

SEQ ID NO: 416576 - DNA, 20 bp, Artificial
  CRISPR gRNA sequence
agagcactaactatcttgta

SEQ ID NO: 416577 - DNA, 20 bp, Artificial
  CRISPR gRNA sequence
actatcttgtaagatgtaag

SEQ ID NO: 416578 - DNA, 20 bp, Artificial
  CRISPR gRNA sequence
tcttgtaagatgtaagaaaa

SEQ ID NO: 416579 - DNA, 20 bp, Artificial
  CRISPR gRNA sequence
gtaagatgtaagaaaaggtc

SEQ ID NO: 416580 - DNA, 20 bp, Artificial
  CRISPR gRNA sequence
taagatgtaagaaaaggtcc

SEQ ID NO: 416581 - DNA, 20 bp, Artificial
  CRISPR gRNA sequence
ggaagtatgagtaataaatg

SEQ ID NO: 416582 - DNA, 20 bp, Artificial
  CRISPR gRNA sequence
gaagtatgagtaataaatgt

SEQ ID NO: 416583 - DNA, 20 bp, Artificial
  CRISPR gRNA sequence
ggataattctggtttatttc

SEQ ID NO: 416584 - DNA, 20 bp, Artificial
  CRISPR gRNA sequence
tggtttatttcgtattatcc

SEQ ID NO: 416585 - DNA, 20 bp, Artificial
  CRISPR gRNA sequence
gtttatttcgtattatcctt

SEQ ID NO: 416586 - DNA, 20 bp, Artificial
  CRISPR gRNA sequence
atttcgtattatccttgtta

SEQ ID NO: 416587 - DNA, 20 bp, Artificial
  CRISPR gRNA sequence
tttcgtattatccttgttag

SEQ ID NO: 416588 - DNA, 20 bp, Artificial
  CRISPR gRNA sequence
cgtattatccttgttagaat

SEQ ID NO: 416589 - DNA, 20 bp, Artificial
  CRISPR gRNA sequence
gtattatccttgttagaata

SEQ ID NO: 416590 - DNA, 20 bp, Artificial
  CRISPR gRNA sequence
tccttgttagaataagttat

SEQ ID NO: 416591 - DNA, 20 bp, Artificial
  CRISPR gRNA sequence
gttagaataagttatatggt

SEQ ID NO: 416592 - DNA, 20 bp, Artificial
  CRISPR gRNA sequence
ttagaataagttatatggtc

SEQ ID NO: 416593 - DNA, 20 bp, Artificial
  CRISPR gRNA sequence
gaataagttatatggtcaac

SEQ ID NO: 416594 - DNA, 20 bp, Artificial
  CRISPR gRNA sequence
tatggtcaacctgttcagaa

SEQ ID NO: 416595 - DNA, 20 bp, Artificial
  CRISPR gRNA sequence
ttcagaacactttttctagt

SEQ ID NO: 416596 - DNA, 20 bp, Artificial
  CRISPR gRNA sequence
agaacactttttctagtgtt

SEQ ID NO: 416597 - DNA, 20 bp, Artificial
  CRISPR gRNA sequence
tttctagtgttagtgtgtac

SEQ ID NO: 416598 - DNA, 20 bp, Artificial
  CRISPR gRNA sequence
ttctagtgttagtgtgtact

SEQ ID NO: 416599 - DNA, 20 bp, Artificial
  CRISPR gRNA sequence
tctagtgttagtgtgtactt

SEQ ID NO: 416600 - DNA, 20 bp, Artificial
  CRISPR gRNA sequence
ctagtgttagtgtgtacttt

SEQ ID NO: 416601 - DNA, 20 bp, Artificial
  CRISPR gRNA sequence
tagtgttagtgtgtactttt

SEQ ID NO: 416602 - DNA, 20 bp, Artificial
  CRISPR gRNA sequence
gtgttagtgtgtacttttgg

SEQ ID NO: 416603 - DNA, 20 bp, Artificial
  CRISPR gRNA sequence
gtgtgtacttttggattttt

SEQ ID NO: 416604 - DNA, 20 bp, Artificial
  CRISPR gRNA sequence
ttggatttttggttcttgta

SEQ ID NO: 416605 - DNA, 20 bp, Artificial
  CRISPR gRNA sequence
tggatttttggttcttgtag

SEQ ID NO: 416606 - DNA, 20 bp, Artificial
  CRISPR gRNA sequence
ggatttttggttcttgtagg

SEQ ID NO: 416607 - DNA, 20 bp, Artificial
  CRISPR gRNA sequence
gatttttggttcttgtaggg

SEQ ID NO: 416608 - DNA, 20 bp, Artificial
  CRISPR gRNA sequence
ttggttcttgtagggtatag

SEQ ID NO: 416609 - DNA, 20 bp, Artificial
  CRISPR gRNA sequence
tggttcttgtagggtataga

SEQ ID NO: 416610 - DNA, 20 bp, Artificial
  CRISPR gRNA sequence
ggttcttgtagggtatagaa

SEQ ID NO: 416611 - DNA, 20 bp, Artificial
  CRISPR gRNA sequence
gttcttgtagggtatagaaa

SEQ ID NO: 416612 - DNA, 20 bp, Artificial
  CRISPR gRNA sequence
ttgtagggtatagaaatatt

SEQ ID NO: 416613 - DNA, 20 bp, Artificial
  CRISPR gRNA sequence
gtagggtatagaaatatttt

SEQ ID NO: 416614 - DNA, 20 bp, Artificial
  CRISPR gRNA sequence
tagggtatagaaatattttc

SEQ ID NO: 416615 - DNA, 20 bp, Artificial
  CRISPR gRNA sequence
tcctttgtcttgtattctgt

SEQ ID NO: 416616 - DNA, 20 bp, Artificial
  CRISPR gRNA sequence
cctttgtcttgtattctgtt

SEQ ID NO: 416617 - DNA, 20 bp, Artificial
  CRISPR gRNA sequence
ctttgtcttgtattctgttg

SEQ ID NO: 416618 - DNA, 20 bp, Artificial
  CRISPR gRNA sequence
tgtcttgtattctgttgttt

SEQ ID NO: 416619 - DNA, 20 bp, Artificial
  CRISPR gRNA sequence
gtcttgtattctgttgtttt

SEQ ID NO: 416620 - DNA, 20 bp, Artificial
  CRISPR gRNA sequence
tcttgtattctgttgttttg

SEQ ID NO: 416621 - DNA, 20 bp, Artificial
  CRISPR gRNA sequence
gtattctgttgttttgaatg

SEQ ID NO: 416622 - DNA, 20 bp, Artificial
  CRISPR gRNA sequence
tattctgttgttttgaatga

SEQ ID NO: 416623 - DNA, 20 bp, Artificial
  CRISPR gRNA sequence
tgttgttttgaatgaataaa

SEQ ID NO: 416624 - DNA, 20 bp, Artificial
  CRISPR gRNA sequence
ttgttttgaatgaataaaac

SEQ ID NO: 416625 - DNA, 20 bp, Artificial
  CRISPR gRNA sequence
ttttgaatgaataaaacaca

SEQ ID NO: 416626 - DNA, 20 bp, Artificial
  CRISPR gRNA sequence
tgaatgaataaaacacaatg

SEQ ID NO: 416627 - DNA, 20 bp, Artificial
  CRISPR gRNA sequence
gaatgaataaaacacaatgt

SEQ ID NO: 416628 - DNA, 20 bp, Artificial
  CRISPR gRNA sequence
aatgaataaaacacaatgtt

SEQ ID NO: 416629 - DNA, 20 bp, Artificial
  CRISPR gRNA sequence
cacgatcactactttcattt

SEQ ID NO: 416630 - DNA, 20 bp, Artificial
  CRISPR gRNA sequence
acgatcactactttcatttg

SEQ ID NO: 416631 - DNA, 20 bp, Artificial
  CRISPR gRNA sequence
ctttcatttgccatggagaa

SEQ ID NO: 416632 - DNA, 20 bp, Artificial
  CRISPR gRNA sequence
tcatttgccatggagaaata

SEQ ID NO: 416633 - DNA, 20 bp, Artificial
  CRISPR gRNA sequence
catttgccatggagaaatag

SEQ ID NO: 416634 - DNA, 20 bp, Artificial
  CRISPR gRNA sequence
atttgccatggagaaatagc

SEQ ID NO: 416635 - DNA, 20 bp, Artificial
  CRISPR gRNA sequence
gccatggagaaatagcaggg

SEQ ID NO: 416636 - DNA, 20 bp, Artificial
  CRISPR gRNA sequence
ccatggagaaatagcaggga

SEQ ID NO: 416637 - DNA, 20 bp, Artificial
  CRISPR gRNA sequence
ctacagaataaaattaactg

SEQ ID NO: 416638 - DNA, 20 bp, Artificial
  CRISPR gRNA sequence
tacagaataaaattaactga

SEQ ID NO: 416639 - DNA, 20 bp, Artificial
  CRISPR gRNA sequence
cagaataaaattaactgatg

SEQ ID NO: 416640 - DNA, 20 bp, Artificial
  CRISPR gRNA sequence
actgatgaattacatgcaga

SEQ ID NO: 416641 - DNA, 20 bp, Artificial
  CRISPR gRNA sequence
atgaattacatgcagaaaaa

SEQ ID NO: 416642 - DNA, 20 bp, Artificial
  CRISPR gRNA sequence
catgcagaaaaaattcaaat

SEQ ID NO: 416643 - DNA, 20 bp, Artificial
  CRISPR gRNA sequence
aaatcaatgatacattgtaa

SEQ ID NO: 416644 - DNA, 20 bp, Artificial
  CRISPR gRNA sequence
taatttttatctcaatgcaa

SEQ ID NO: 416645 - DNA, 20 bp, Artificial
  CRISPR gRNA sequence
ttatctcaatgcaatgttct

SEQ ID NO: 416646 - DNA, 20 bp, Artificial
  CRISPR gRNA sequence
tatctcaatgcaatgttctt

SEQ ID NO: 416647 - DNA, 20 bp, Artificial
  CRISPR gRNA sequence
atctcaatgcaatgttcttt

SEQ ID NO: 416648 - DNA, 20 bp, Artificial
  CRISPR gRNA sequence
tctcaatgcaatgttctttg

SEQ ID NO: 416649 - DNA, 20 bp, Artificial
  CRISPR gRNA sequence
aatgcaatgttctttgtatt

SEQ ID NO: 416650 - DNA, 20 bp, Artificial
  CRISPR gRNA sequence
tttgtattttattttattat

SEQ ID NO: 416651 - DNA, 20 bp, Artificial
  CRISPR gRNA sequence
tgtattttattttattatta

SEQ ID NO: 416652 - DNA, 20 bp, Artificial
  CRISPR gRNA sequence
gtattttattttattattat

SEQ ID NO: 416653 - DNA, 20 bp, Artificial
  CRISPR gRNA sequence
tattttattttattattatt

SEQ ID NO: 416654 - DNA, 20 bp, Artificial
  CRISPR gRNA sequence
tattttattattattttttt

SEQ ID NO: 416655 - DNA, 20 bp, Artificial
  CRISPR gRNA sequence
attttattattatttttttg

SEQ ID NO: 416656 - DNA, 20 bp, Artificial
  CRISPR gRNA sequence
ttttattattatttttttga

SEQ ID NO: 416657 - DNA, 20 bp, Artificial
  CRISPR gRNA sequence
tattattatttttttgagac

SEQ ID NO: 416658 - DNA, 20 bp, Artificial
  CRISPR gRNA sequence
attattatttttttgagacg

SEQ ID NO: 416659 - DNA, 20 bp, Artificial
  CRISPR gRNA sequence
ttattatttttttgagacgg

SEQ ID NO: 416660 - DNA, 20 bp, Artificial
  CRISPR gRNA sequence
ttatttttttgagacggagt

SEQ ID NO: 416661 - DNA, 20 bp, Artificial
  CRISPR gRNA sequence
tttttttgagacggagtttc

SEQ ID NO: 416662 - DNA, 20 bp, Artificial
  CRISPR gRNA sequence
ttttgagacggagtttcact

SEQ ID NO: 416663 - DNA, 20 bp, Artificial
  CRISPR gRNA sequence
tttgagacggagtttcactt

SEQ ID NO: 416664 - DNA, 20 bp, Artificial
  CRISPR gRNA sequence
ttgagacggagtttcacttt

SEQ ID NO: 416665 - DNA, 20 bp, Artificial
  CRISPR gRNA sequence
tgagacggagtttcactttt

SEQ ID NO: 416666 - DNA, 20 bp, Artificial
  CRISPR gRNA sequence
gagacggagtttcacttttg

SEQ ID NO: 416667 - DNA, 20 bp, Artificial
  CRISPR gRNA sequence
agacggagtttcacttttgt

SEQ ID NO: 416668 - DNA, 20 bp, Artificial
  CRISPR gRNA sequence
cacttttgttgcccgggctg

SEQ ID NO: 416669 - DNA, 20 bp, Artificial
  CRISPR gRNA sequence
acttttgttgcccgggctgg

SEQ ID NO: 416670 - DNA, 20 bp, Artificial
  CRISPR gRNA sequence
ttgttgcccgggctggagtg

SEQ ID NO: 416671 - DNA, 20 bp, Artificial
  CRISPR gRNA sequence
tgttgcccgggctggagtgc

SEQ ID NO: 416672 - DNA, 20 bp, Artificial
  CRISPR gRNA sequence
gttgcccgggctggagtgca

SEQ ID NO: 416673 - DNA, 20 bp, Artificial
  CRISPR gRNA sequence
ttgcccgggctggagtgcaa

SEQ ID NO: 416674 - DNA, 20 bp, Artificial
  CRISPR gRNA sequence
cccgggctggagtgcaatgg

SEQ ID NO: 416675 - DNA, 20 bp, Artificial
  CRISPR gRNA sequence
gagtgcaatggcacaatctc

SEQ ID NO: 416676 - DNA, 20 bp, Artificial
  CRISPR gRNA sequence
ggctcaccacaacctctgcc

SEQ ID NO: 416677 - DNA, 20 bp, Artificial
  CRISPR gRNA sequence
accacaacctctgcctcccg

SEQ ID NO: 416678 - DNA, 20 bp, Artificial
  CRISPR gRNA sequence
tgcctcccggattcaagtga

SEQ ID NO: 416679 - DNA, 20 bp, Artificial
  CRISPR gRNA sequence
cctcccggattcaagtgatt

SEQ ID NO: 416680 - DNA, 20 bp, Artificial
  CRISPR gRNA sequence
ccggattcaagtgattctcc

SEQ ID NO: 416681 - DNA, 20 bp, Artificial
  CRISPR gRNA sequence
aagtgattctcctgcctcag

SEQ ID NO: 416682 - DNA, 20 bp, Artificial
  CRISPR gRNA sequence
tcctgcctcagcctcctgaa

SEQ ID NO: 416683 - DNA, 20 bp, Artificial
  CRISPR gRNA sequence
ctgcctcagcctcctgaata

SEQ ID NO: 416684 - DNA, 20 bp, Artificial
  CRISPR gRNA sequence
cctcagcctcctgaatagct

SEQ ID NO: 416685 - DNA, 20 bp, Artificial
  CRISPR gRNA sequence
agcctcctgaatagctggga

SEQ ID NO: 416686 - DNA, 20 bp, Artificial
  CRISPR gRNA sequence
ctgaatagctgggattacag

SEQ ID NO: 416687 - DNA, 20 bp, Artificial
  CRISPR gRNA sequence
aatagctgggattacaggca

SEQ ID NO: 416688 - DNA, 20 bp, Artificial
  CRISPR gRNA sequence
ggattacaggcatatgccaa

SEQ ID NO: 416689 - DNA, 20 bp, Artificial
  CRISPR gRNA sequence
caggcatatgccaacatgcc

SEQ ID NO: 416690 - DNA, 20 bp, Artificial
  CRISPR gRNA sequence
gctaattttgtatttttagt

SEQ ID NO: 416691 - DNA, 20 bp, Artificial
  CRISPR gRNA sequence
attttgtatttttagtggag

SEQ ID NO: 416692 - DNA, 20 bp, Artificial
  CRISPR gRNA sequence
tgtatttttagtggagacgg

SEQ ID NO: 416693 - DNA, 20 bp, Artificial
  CRISPR gRNA sequence
gtatttttagtggagacggg

SEQ ID NO: 416694 - DNA, 20 bp, Artificial
  CRISPR gRNA sequence
tatttttagtggagacgggg

SEQ ID NO: 416695 - DNA, 20 bp, Artificial
  CRISPR gRNA sequence
ttagtggagacggggtttct

SEQ ID NO: 416696 - DNA, 20 bp, Artificial
  CRISPR gRNA sequence
tagtggagacggggtttctc

SEQ ID NO: 416697 - DNA, 20 bp, Artificial
  CRISPR gRNA sequence
agtggagacggggtttctcc

SEQ ID NO: 416698 - DNA, 20 bp, Artificial
  CRISPR gRNA sequence
gtggagacggggtttctcca

SEQ ID NO: 416699 - DNA, 20 bp, Artificial
  CRISPR gRNA sequence
ctccacgttggtcagacttg

SEQ ID NO: 416700 - DNA, 20 bp, Artificial
  CRISPR gRNA sequence
tccacgttggtcagacttgt

SEQ ID NO: 416701 - DNA, 20 bp, Artificial
  CRISPR gRNA sequence
cacgttggtcagacttgtct

SEQ ID NO: 416702 - DNA, 20 bp, Artificial
  CRISPR gRNA sequence
gtcagacttgtcttgaactc

SEQ ID NO: 416703 - DNA, 20 bp, Artificial
  CRISPR gRNA sequence
gtcttgaactctggacctca

SEQ ID NO: 416704 - DNA, 20 bp, Artificial
  CRISPR gRNA sequence
tcttgaactctggacctcag

SEQ ID NO: 416705 - DNA, 20 bp, Artificial
  CRISPR gRNA sequence
gaactctggacctcaggtga

SEQ ID NO: 416706 - DNA, 20 bp, Artificial
  CRISPR gRNA sequence
aactctggacctcaggtgat

SEQ ID NO: 416707 - DNA, 20 bp, Artificial
  CRISPR gRNA sequence
tggacctcaggtgatccacc

SEQ ID NO: 416708 - DNA, 20 bp, Artificial
  CRISPR gRNA sequence
gacctcaggtgatccacctg

SEQ ID NO: 416709 - DNA, 20 bp, Artificial
  CRISPR gRNA sequence
aggtgatccacctgcctcag

SEQ ID NO: 416710 - DNA, 20 bp, Artificial
  CRISPR gRNA sequence
cctcagcctcctaaattgct

SEQ ID NO: 416711 - DNA, 20 bp, Artificial
  CRISPR gRNA sequence
agcctcctaaattgctggga

SEQ ID NO: 416712 - DNA, 20 bp, Artificial
  CRISPR gRNA sequence
ctaaattgctgggattacag

SEQ ID NO: 416713 - DNA, 20 bp, Artificial
  CRISPR gRNA sequence
aattgctgggattacaggca

SEQ ID NO: 416714 - DNA, 20 bp, Artificial
  CRISPR gRNA sequence
ctgggattacaggcatgagc

SEQ ID NO: 416715 - DNA, 20 bp, Artificial
  CRISPR gRNA sequence
ggattacaggcatgagcgac

SEQ ID NO: 416716 - DNA, 20 bp, Artificial
  CRISPR gRNA sequence
caggcatgagcgaccactcc

SEQ ID NO: 416717 - DNA, 20 bp, Artificial
  CRISPR gRNA sequence
ctggccttgttctttgtatt

SEQ ID NO: 416718 - DNA, 20 bp, Artificial
  CRISPR gRNA sequence
gccttgttctttgtatttta

SEQ ID NO: 416719 - DNA, 20 bp, Artificial
  CRISPR gRNA sequence
gttctttgtattttataagt

SEQ ID NO: 416720 - DNA, 20 bp, Artificial
  CRISPR gRNA sequence
ttctttgtattttataagtg

SEQ ID NO: 416721 - DNA, 20 bp, Artificial
  CRISPR gRNA sequence
tttgtattttataagtgcat

SEQ ID NO: 416722 - DNA, 20 bp, Artificial
  CRISPR gRNA sequence
tgtattttataagtgcatgt

SEQ ID NO: 416723 - DNA, 20 bp, Artificial
  CRISPR gRNA sequence
gtattttataagtgcatgta

SEQ ID NO: 416724 - DNA, 20 bp, Artificial
  CRISPR gRNA sequence
tattttataagtgcatgtag

SEQ ID NO: 416725 - DNA, 20 bp, Artificial
  CRISPR gRNA sequence
tataagtgcatgtagtgcaa

SEQ ID NO: 416726 - DNA, 20 bp, Artificial
  CRISPR gRNA sequence
ataagtgcatgtagtgcaaa

SEQ ID NO: 416727 - DNA, 20 bp, Artificial
  CRISPR gRNA sequence
taagtgcatgtagtgcaaag

SEQ ID NO: 416728 - DNA, 20 bp, Artificial
  CRISPR gRNA sequence
tacaggttttttgtttgttt

SEQ ID NO: 416729 - DNA, 20 bp, Artificial
  CRISPR gRNA sequence
acaggttttttgtttgtttg

SEQ ID NO: 416730 - DNA, 20 bp, Artificial
  CRISPR gRNA sequence
caggttttttgtttgtttgt

SEQ ID NO: 416731 - DNA, 20 bp, Artificial
  CRISPR gRNA sequence
tttgtttgtttgtttttgtt

SEQ ID NO: 416732 - DNA, 20 bp, Artificial
  CRISPR gRNA sequence
ttgtttgtttgtttttgttt

SEQ ID NO: 416733 - DNA, 20 bp, Artificial
  CRISPR gRNA sequence
tgtttgtttgtttttgtttt

SEQ ID NO: 416734 - DNA, 20 bp, Artificial
  CRISPR gRNA sequence
gtttgtttgtttttgttttt

SEQ ID NO: 416735 - DNA, 20 bp, Artificial
  CRISPR gRNA sequence
tttgtttgtttttgtttttc

SEQ ID NO: 416736 - DNA, 20 bp, Artificial
  CRISPR gRNA sequence
gtttgtttttgtttttcccg

SEQ ID NO: 416737 - DNA, 20 bp, Artificial
  CRISPR gRNA sequence
tttgtttttgtttttcccga

SEQ ID NO: 416738 - DNA, 20 bp, Artificial
  CRISPR gRNA sequence
gtttttgtttttcccgaaac

SEQ ID NO: 416739 - DNA, 20 bp, Artificial
  CRISPR gRNA sequence
tttttgtttttcccgaaaca

SEQ ID NO: 416740 - DNA, 20 bp, Artificial
  CRISPR gRNA sequence
ttgtttttcccgaaacatag

SEQ ID NO: 416741 - DNA, 20 bp, Artificial
  CRISPR gRNA sequence
tgtttttcccgaaacatagt

SEQ ID NO: 416742 - DNA, 20 bp, Artificial
  CRISPR gRNA sequence
gtttttcccgaaacatagta

SEQ ID NO: 416743 - DNA, 20 bp, Artificial
  CRISPR gRNA sequence
tttttcccgaaacatagtag

SEQ ID NO: 416744 - DNA, 20 bp, Artificial
  CRISPR gRNA sequence
ttcccgaaacatagtagtcc

SEQ ID NO: 416745 - DNA, 20 bp, Artificial
  CRISPR gRNA sequence
tcccgaaacatagtagtccc

SEQ ID NO: 416746 - DNA, 20 bp, Artificial
  CRISPR gRNA sequence
cccgaaacatagtagtccct

SEQ ID NO: 416747 - DNA, 20 bp, Artificial
  CRISPR gRNA sequence
ccgaaacatagtagtccctt

SEQ ID NO: 416748 - DNA, 20 bp, Artificial
  CRISPR gRNA sequence
gcccttcctcatttttgtta

SEQ ID NO: 416749 - DNA, 20 bp, Artificial
  CRISPR gRNA sequence
cccttcctcatttttgttac

SEQ ID NO: 416750 - DNA, 20 bp, Artificial
  CRISPR gRNA sequence
cctcatttttgttaccttga

SEQ ID NO: 416751 - DNA, 20 bp, Artificial
  CRISPR gRNA sequence
ctcatttttgttaccttgag

SEQ ID NO: 416752 - DNA, 20 bp, Artificial
  CRISPR gRNA sequence
atttttgttaccttgagaca

SEQ ID NO: 416753 - DNA, 20 bp, Artificial
  CRISPR gRNA sequence
ttgttaccttgagacaacaa

SEQ ID NO: 416754 - DNA, 20 bp, Artificial
  CRISPR gRNA sequence
tgttaccttgagacaacaaa

SEQ ID NO: 416755 - DNA, 20 bp, Artificial
  CRISPR gRNA sequence
gttaccttgagacaacaaat

SEQ ID NO: 416756 - DNA, 20 bp, Artificial
  CRISPR gRNA sequence
ttaccttgagacaacaaatt

SEQ ID NO: 416757 - DNA, 20 bp, Artificial
  CRISPR gRNA sequence
ccttgagacaacaaatttta

SEQ ID NO: 416758 - DNA, 20 bp, Artificial
  CRISPR gRNA sequence
gagacaacaaattttactac

SEQ ID NO: 416759 - DNA, 20 bp, Artificial
  CRISPR gRNA sequence
agacaacaaattttactact

SEQ ID NO: 416760 - DNA, 20 bp, Artificial
  CRISPR gRNA sequence
tactacttctaactcattat

SEQ ID NO: 416761 - DNA, 20 bp, Artificial
  CRISPR gRNA sequence
actacttctaactcattatt

SEQ ID NO: 416762 - DNA, 20 bp, Artificial
  CRISPR gRNA sequence
ctacttctaactcattattt

SEQ ID NO: 416763 - DNA, 20 bp, Artificial
  CRISPR gRNA sequence
cttctaactcattattttat

SEQ ID NO: 416764 - DNA, 20 bp, Artificial
  CRISPR gRNA sequence
ctaactcattattttattta

SEQ ID NO: 416765 - DNA, 20 bp, Artificial
  CRISPR gRNA sequence
taactcattattttatttat

SEQ ID NO: 416766 - DNA, 20 bp, Artificial
  CRISPR gRNA sequence
actcattattttatttatgt

SEQ ID NO: 416767 - DNA, 20 bp, Artificial
  CRISPR gRNA sequence
attattttatttatgttcac

SEQ ID NO: 416768 - DNA, 20 bp, Artificial
  CRISPR gRNA sequence
ttttatttatgttcactttt

SEQ ID NO: 416769 - DNA, 20 bp, Artificial
  CRISPR gRNA sequence
tatttatgttcacttttctg

SEQ ID NO: 416770 - DNA, 20 bp, Artificial
  CRISPR gRNA sequence
atttatgttcacttttctga

SEQ ID NO: 416771 - DNA, 20 bp, Artificial
  CRISPR gRNA sequence
tttatgttcacttttctgaa

SEQ ID NO: 416772 - DNA, 20 bp, Artificial
  CRISPR gRNA sequence
atgttcacttttctgaatag

SEQ ID NO: 416773 - DNA, 20 bp, Artificial
  CRISPR gRNA sequence
tgttcacttttctgaatagc

SEQ ID NO: 416774 - DNA, 20 bp, Artificial
  CRISPR gRNA sequence
acttttctgaatagcatgct

SEQ ID NO: 416775 - DNA, 20 bp, Artificial
  CRISPR gRNA sequence
ttctgaatagcatgcttatg

SEQ ID NO: 416776 - DNA, 20 bp, Artificial
  CRISPR gRNA sequence
tctgaatagcatgcttatga

SEQ ID NO: 416777 - DNA, 20 bp, Artificial
  CRISPR gRNA sequence
ctgaatagcatgcttatgac

SEQ ID NO: 416778 - DNA, 20 bp, Artificial
  CRISPR gRNA sequence
tgaatagcatgcttatgaca

SEQ ID NO: 416779 - DNA, 20 bp, Artificial
  CRISPR gRNA sequence
aatagcatgcttatgacact

SEQ ID NO: 416780 - DNA, 20 bp, Artificial
  CRISPR gRNA sequence
atgacactaatacttttttt

SEQ ID NO: 416781 - DNA, 20 bp, Artificial
  CRISPR gRNA sequence
tgacactaatactttttttt

SEQ ID NO: 416782 - DNA, 20 bp, Artificial
  CRISPR gRNA sequence
atactttttttttcaatttt

SEQ ID NO: 416783 - DNA, 20 bp, Artificial
  CRISPR gRNA sequence
tttttttcaattttagacat

SEQ ID NO: 416784 - DNA, 20 bp, Artificial
  CRISPR gRNA sequence
ttttttcaattttagacatt

SEQ ID NO: 416785 - DNA, 20 bp, Artificial
  CRISPR gRNA sequence
tttttcaattttagacattc

SEQ ID NO: 416786 - DNA, 20 bp, Artificial
  CRISPR gRNA sequence
ttttcaattttagacattca

SEQ ID NO: 416787 - DNA, 20 bp, Artificial
  CRISPR gRNA sequence
tttcaattttagacattcat

SEQ ID NO: 416788 - DNA, 20 bp, Artificial
  CRISPR gRNA sequence
ttcaattttagacattcatt

SEQ ID NO: 416789 - DNA, 20 bp, Artificial
  CRISPR gRNA sequence
tcaattttagacattcatta

SEQ ID NO: 416790 - DNA, 20 bp, Artificial
  CRISPR gRNA sequence
caattttagacattcattat

SEQ ID NO: 416791 - DNA, 20 bp, Artificial
  CRISPR gRNA sequence
aattttagacattcattatt

SEQ ID NO: 416792 - DNA, 20 bp, Artificial
  CRISPR gRNA sequence
tagacattcattattcattt

SEQ ID NO: 416793 - DNA, 20 bp, Artificial
  CRISPR gRNA sequence
agacattcattattcattta

SEQ ID NO: 416794 - DNA, 20 bp, Artificial
  CRISPR gRNA sequence
gacattcattattcatttag

SEQ ID NO: 416795 - DNA, 20 bp, Artificial
  CRISPR gRNA sequence
attattcatttagatgtctt

SEQ ID NO: 416796 - DNA, 20 bp, Artificial
  CRISPR gRNA sequence
ttcatttagatgtctttctc

SEQ ID NO: 416797 - DNA, 20 bp, Artificial
  CRISPR gRNA sequence
atttagatgtctttctctcc

SEQ ID NO: 416798 - DNA, 20 bp, Artificial
  CRISPR gRNA sequence
agatgtctttctctccccaa

SEQ ID NO: 416799 - DNA, 20 bp, Artificial
  CRISPR gRNA sequence
gatgtctttctctccccaaa

SEQ ID NO: 416800 - DNA, 20 bp, Artificial
  CRISPR gRNA sequence
tctctccccaaactcaccac

SEQ ID NO: 416801 - DNA, 20 bp, Artificial
  CRISPR gRNA sequence
ctctccccaaactcaccaca

SEQ ID NO: 416802 - DNA, 20 bp, Artificial
  CRISPR gRNA sequence
tctccccaaactcaccacat

SEQ ID NO: 416803 - DNA, 20 bp, Artificial
  CRISPR gRNA sequence
tccccaaactcaccacataa

SEQ ID NO: 416804 - DNA, 20 bp, Artificial
  CRISPR gRNA sequence
cccaaactcaccacataaaa

SEQ ID NO: 416805 - DNA, 20 bp, Artificial
  CRISPR gRNA sequence
accacataaaatactcttct

SEQ ID NO: 416806 - DNA, 20 bp, Artificial
  CRISPR gRNA sequence
ttctcatgtctctttcagaa

SEQ ID NO: 416807 - DNA, 20 bp, Artificial
  CRISPR gRNA sequence
ctcatgtctctttcagaaat

SEQ ID NO: 416808 - DNA, 20 bp, Artificial
  CRISPR gRNA sequence
tcatgtctctttcagaaata

SEQ ID NO: 416809 - DNA, 20 bp, Artificial
  CRISPR gRNA sequence
atgtctctttcagaaatatt

SEQ ID NO: 416810 - DNA, 20 bp, Artificial
  CRISPR gRNA sequence
tttcagaaatatttgtatta

SEQ ID NO: 416811 - DNA, 20 bp, Artificial
  CRISPR gRNA sequence
tcagaaatatttgtattaaa

SEQ ID NO: 416812 - DNA, 20 bp, Artificial
  CRISPR gRNA sequence
cagaaatatttgtattaaaa

SEQ ID NO: 416813 - DNA, 20 bp, Artificial
  CRISPR gRNA sequence
agaaatatttgtattaaaat

SEQ ID NO: 416814 - DNA, 20 bp, Artificial
  CRISPR gRNA sequence
gtattaaaatatgattatat

SEQ ID NO: 416815 - DNA, 20 bp, Artificial
  CRISPR gRNA sequence
tattaaaatatgattatatc

SEQ ID NO: 416816 - DNA, 20 bp, Artificial
  CRISPR gRNA sequence
aaatatgattatatcaatat

SEQ ID NO: 416817 - DNA, 20 bp, Artificial
  CRISPR gRNA sequence
tatcaatatttggcatttat

SEQ ID NO: 416818 - DNA, 20 bp, Artificial
  CRISPR gRNA sequence
ggcatttatttcttatgacc

SEQ ID NO: 416819 - DNA, 20 bp, Artificial
  CRISPR gRNA sequence
gcatttatttcttatgacct

SEQ ID NO: 416820 - DNA, 20 bp, Artificial
  CRISPR gRNA sequence
atttcttatgaccttgccag

SEQ ID NO: 416821 - DNA, 20 bp, Artificial
  CRISPR gRNA sequence
tttcttatgaccttgccagt

SEQ ID NO: 416822 - DNA, 20 bp, Artificial
  CRISPR gRNA sequence
cttatgaccttgccagtact

SEQ ID NO: 416823 - DNA, 20 bp, Artificial
  CRISPR gRNA sequence
ttatgaccttgccagtactc

SEQ ID NO: 416824 - DNA, 20 bp, Artificial
  CRISPR gRNA sequence
atgaccttgccagtactctt

SEQ ID NO: 416825 - DNA, 20 bp, Artificial
  CRISPR gRNA sequence
tgaccttgccagtactctta

SEQ ID NO: 416826 - DNA, 20 bp, Artificial
  CRISPR gRNA sequence
gccagtactcttagttaaac

SEQ ID NO: 416827 - DNA, 20 bp, Artificial
  CRISPR gRNA sequence
ccagtactcttagttaaact

SEQ ID NO: 416828 - DNA, 20 bp, Artificial
  CRISPR gRNA sequence
ttagttaaactacatggtaa

SEQ ID NO: 416829 - DNA, 20 bp, Artificial
  CRISPR gRNA sequence
agttaaactacatggtaaaa

SEQ ID NO: 416830 - DNA, 20 bp, Artificial
  CRISPR gRNA sequence
gttaaactacatggtaaaaa

SEQ ID NO: 416831 - DNA, 20 bp, Artificial
  CRISPR gRNA sequence
aactacatggtaaaaatgat

SEQ ID NO: 416832 - DNA, 20 bp, Artificial
  CRISPR gRNA sequence
catggtaaaaatgattttgc

SEQ ID NO: 416833 - DNA, 20 bp, Artificial
  CRISPR gRNA sequence
tgctttccctcctacataac

SEQ ID NO: 416834 - DNA, 20 bp, Artificial
  CRISPR gRNA sequence
gctttccctcctacataact

SEQ ID NO: 416835 - DNA, 20 bp, Artificial
  CRISPR gRNA sequence
ctttccctcctacataactt

SEQ ID NO: 416836 - DNA, 20 bp, Artificial
  CRISPR gRNA sequence
tccctcctacataacttttt

SEQ ID NO: 416837 - DNA, 20 bp, Artificial
  CRISPR gRNA sequence
ccctcctacataactttttt

SEQ ID NO: 416838 - DNA, 20 bp, Artificial
  CRISPR gRNA sequence
cctcctacataacttttttt

SEQ ID NO: 416839 - DNA, 20 bp, Artificial
  CRISPR gRNA sequence
ctacataactttttttccac

SEQ ID NO: 416840 - DNA, 20 bp, Artificial
  CRISPR gRNA sequence
cataactttttttccaccta

SEQ ID NO: 416841 - DNA, 20 bp, Artificial
  CRISPR gRNA sequence
ccctcagactttccactgcg

SEQ ID NO: 416842 - DNA, 20 bp, Artificial
  CRISPR gRNA sequence
ccactgcgaagcgaaaccgt

SEQ ID NO: 416843 - DNA, 20 bp, Artificial
  CRISPR gRNA sequence
cgaagcgaaaccgtaagccc

SEQ ID NO: 416844 - DNA, 20 bp, Artificial
  CRISPR gRNA sequence
gaagcgaaaccgtaagccct

SEQ ID NO: 416845 - DNA, 20 bp, Artificial
  CRISPR gRNA sequence
aagcgaaaccgtaagccctg

SEQ ID NO: 416846 - DNA, 20 bp, Artificial
  CRISPR gRNA sequence
aaaccgtaagccctggggtg

SEQ ID NO: 416847 - DNA, 20 bp, Artificial
  CRISPR gRNA sequence
aaccgtaagccctggggtgc

SEQ ID NO: 416848 - DNA, 20 bp, Artificial
  CRISPR gRNA sequence
accgtaagccctggggtgcg

SEQ ID NO: 416849 - DNA, 20 bp, Artificial
  CRISPR gRNA sequence
ccgtaagccctggggtgcgg

SEQ ID NO: 416850 - DNA, 20 bp, Artificial
  CRISPR gRNA sequence
cgtaagccctggggtgcggg

SEQ ID NO: 416851 - DNA, 20 bp, Artificial
  CRISPR gRNA sequence
aagccctggggtgcgggggg

SEQ ID NO: 416852 - DNA, 20 bp, Artificial
  CRISPR gRNA sequence
agccctggggtgcggggggc

SEQ ID NO: 416853 - DNA, 20 bp, Artificial
  CRISPR gRNA sequence
ctggggtgcggggggcgggc

SEQ ID NO: 416854 - DNA, 20 bp, Artificial
  CRISPR gRNA sequence
tggggtgcggggggcgggcc

SEQ ID NO: 416855 - DNA, 20 bp, Artificial
  CRISPR gRNA sequence
gggtgcggggggcgggccgg

SEQ ID NO: 416856 - DNA, 20 bp, Artificial
  CRISPR gRNA sequence
ggtgcggggggcgggccggg

SEQ ID NO: 416857 - DNA, 20 bp, Artificial
  CRISPR gRNA sequence
tgcggggggcgggccgggag

SEQ ID NO: 416858 - DNA, 20 bp, Artificial
  CRISPR gRNA sequence
gcggggggcgggccgggagg

SEQ ID NO: 416859 - DNA, 20 bp, Artificial
  CRISPR gRNA sequence
cggggggcgggccgggagga

SEQ ID NO: 416860 - DNA, 20 bp, Artificial
  CRISPR gRNA sequence
ggggggcgggccgggaggag

SEQ ID NO: 416861 - DNA, 20 bp, Artificial
  CRISPR gRNA sequence
gggcgggccgggaggagggg

SEQ ID NO: 416862 - DNA, 20 bp, Artificial
  CRISPR gRNA sequence
cgggccgggaggaggggaag

SEQ ID NO: 416863 - DNA, 20 bp, Artificial
  CRISPR gRNA sequence
gggccgggaggaggggaagt

SEQ ID NO: 416864 - DNA, 20 bp, Artificial
  CRISPR gRNA sequence
ggccgggaggaggggaagtg

SEQ ID NO: 416865 - DNA, 20 bp, Artificial
  CRISPR gRNA sequence
cgggaggaggggaagtgggg

SEQ ID NO: 416866 - DNA, 20 bp, Artificial
  CRISPR gRNA sequence
gggaggaggggaagtgggga

SEQ ID NO: 416867 - DNA, 20 bp, Artificial
  CRISPR gRNA sequence
aggaggggaagtggggaagg

SEQ ID NO: 416868 - DNA, 20 bp, Artificial
  CRISPR gRNA sequence
gaggggaagtggggaaggtg

SEQ ID NO: 416869 - DNA, 20 bp, Artificial
  CRISPR gRNA sequence
aggggaagtggggaaggtgg

SEQ ID NO: 416870 - DNA, 20 bp, Artificial
  CRISPR gRNA sequence
ggggaagtggggaaggtgga

SEQ ID NO: 416871 - DNA, 20 bp, Artificial
  CRISPR gRNA sequence
gaagtggggaaggtggaggg

SEQ ID NO: 416872 - DNA, 20 bp, Artificial
  CRISPR gRNA sequence
aagtggggaaggtggaggga

SEQ ID NO: 416873 - DNA, 20 bp, Artificial
  CRISPR gRNA sequence
ggggaaggtggagggaaggc

SEQ ID NO: 416874 - DNA, 20 bp, Artificial
  CRISPR gRNA sequence
gggaaggtggagggaaggcc

SEQ ID NO: 416875 - DNA, 20 bp, Artificial
  CRISPR gRNA sequence
ggtggagggaaggccgggca

SEQ ID NO: 416876 - DNA, 20 bp, Artificial
  CRISPR gRNA sequence
gtggagggaaggccgggcac

SEQ ID NO: 416877 - DNA, 20 bp, Artificial
  CRISPR gRNA sequence
tggagggaaggccgggcaca

SEQ ID NO: 416878 - DNA, 20 bp, Artificial
  CRISPR gRNA sequence
ggagggaaggccgggcacag

SEQ ID NO: 416879 - DNA, 20 bp, Artificial
  CRISPR gRNA sequence
gaaggccgggcacaggggtg

SEQ ID NO: 416880 - DNA, 20 bp, Artificial
  CRISPR gRNA sequence
aaggccgggcacaggggtga

SEQ ID NO: 416881 - DNA, 20 bp, Artificial
  CRISPR gRNA sequence
cgggcacaggggtgaaggcc

SEQ ID NO: 416882 - DNA, 20 bp, Artificial
  CRISPR gRNA sequence
ggcacaggggtgaaggccca

SEQ ID NO: 416883 - DNA, 20 bp, Artificial
  CRISPR gRNA sequence
aggggtgaaggcccagagac

SEQ ID NO: 416884 - DNA, 20 bp, Artificial
  CRISPR gRNA sequence
ggtgaaggcccagagaccag

SEQ ID NO: 416885 - DNA, 20 bp, Artificial
  CRISPR gRNA sequence
aggcccagagaccagcagaa

SEQ ID NO: 416886 - DNA, 20 bp, Artificial
  CRISPR gRNA sequence
agaccagcagaacggcatcc

SEQ ID NO: 416887 - DNA, 20 bp, Artificial
  CRISPR gRNA sequence
gaacggcatcccagccacga

SEQ ID NO: 416888 - DNA, 20 bp, Artificial
  CRISPR gRNA sequence
gctctgtctgctctccgcca

SEQ ID NO: 416889 - DNA, 20 bp, Artificial
  CRISPR gRNA sequence
cacggccctgctctgttccc

SEQ ID NO: 416890 - DNA, 20 bp, Artificial
  CRISPR gRNA sequence
acggccctgctctgttccct

SEQ ID NO: 416891 - DNA, 20 bp, Artificial
  CRISPR gRNA sequence
cacccccgcccccacctcct

SEQ ID NO: 416892 - DNA, 20 bp, Artificial
  CRISPR gRNA sequence
acccccgcccccacctcctc

SEQ ID NO: 416893 - DNA, 20 bp, Artificial
  CRISPR gRNA sequence
ctcaggctgcctgatctgcc

SEQ ID NO: 416894 - DNA, 20 bp, Artificial
  CRISPR gRNA sequence
gcctgatctgcccagctttc

SEQ ID NO: 416895 - DNA, 20 bp, Artificial
  CRISPR gRNA sequence
ccagctttccagctttcctc

SEQ ID NO: 416896 - DNA, 20 bp, Artificial
  CRISPR gRNA sequence
tccagctttcctctggattc

SEQ ID NO: 416897 - DNA, 20 bp, Artificial
  CRISPR gRNA sequence
ttcctctggattccggcctc

SEQ ID NO: 416898 - DNA, 20 bp, Artificial
  CRISPR gRNA sequence
tccctccccaccctctctcc

SEQ ID NO: 416899 - DNA, 20 bp, Artificial
  CRISPR gRNA sequence
ccctccccaccctctctcca

SEQ ID NO: 416900 - DNA, 20 bp, Artificial
  CRISPR gRNA sequence
ctctctccaaggccctctcc

SEQ ID NO: 416901 - DNA, 20 bp, Artificial
  CRISPR gRNA sequence
tctcctggtctcccttcttc

SEQ ID NO: 416902 - DNA, 20 bp, Artificial
  CRISPR gRNA sequence
ttcctccacctccctctctg

SEQ ID NO: 416903 - DNA, 20 bp, Artificial
  CRISPR gRNA sequence
ttccttttctgacctccttt

SEQ ID NO: 416904 - DNA, 20 bp, Artificial
  CRISPR gRNA sequence
ccttttctgacctccttttg

SEQ ID NO: 416905 - DNA, 20 bp, Artificial
  CRISPR gRNA sequence
cttttctgacctccttttgg

SEQ ID NO: 416906 - DNA, 20 bp, Artificial
  CRISPR gRNA sequence
ttttctgacctccttttgga

SEQ ID NO: 416907 - DNA, 20 bp, Artificial
  CRISPR gRNA sequence
tgacctccttttggagggct

SEQ ID NO: 416908 - DNA, 20 bp, Artificial
  CRISPR gRNA sequence
ttggagggctcagcgctgcc

SEQ ID NO: 416909 - DNA, 20 bp, Artificial
  CRISPR gRNA sequence
gctcagcgctgcccagacca

SEQ ID NO: 416910 - DNA, 20 bp, Artificial
  CRISPR gRNA sequence
ctcagcgctgcccagaccat

SEQ ID NO: 416911 - DNA, 20 bp, Artificial
  CRISPR gRNA sequence
cagcgctgcccagaccatag

SEQ ID NO: 416912 - DNA, 20 bp, Artificial
  CRISPR gRNA sequence
gcgctgcccagaccatagga

SEQ ID NO: 416913 - DNA, 20 bp, Artificial
  CRISPR gRNA sequence
cccagaccataggagagatg

SEQ ID NO: 416914 - DNA, 20 bp, Artificial
  CRISPR gRNA sequence
ccagaccataggagagatgt

SEQ ID NO: 416915 - DNA, 20 bp, Artificial
  CRISPR gRNA sequence
agaccataggagagatgtgg

SEQ ID NO: 416916 - DNA, 20 bp, Artificial
  CRISPR gRNA sequence
gaccataggagagatgtggg

SEQ ID NO: 416917 - DNA, 20 bp, Artificial
  CRISPR gRNA sequence
taggagagatgtgggaggct

SEQ ID NO: 416918 - DNA, 20 bp, Artificial
  CRISPR gRNA sequence
gatgtgggaggctcagttcc

SEQ ID NO: 416919 - DNA, 20 bp, Artificial
  CRISPR gRNA sequence
atgtgggaggctcagttcct

SEQ ID NO: 416920 - DNA, 20 bp, Artificial
  CRISPR gRNA sequence
tcctgggcttgctgtttctg

SEQ ID NO: 416921 - DNA, 20 bp, Artificial
  CRISPR gRNA sequence
tgctgtttctgcagccgctt

SEQ ID NO: 416922 - DNA, 20 bp, Artificial
  CRISPR gRNA sequence
gctgtttctgcagccgcttt

SEQ ID NO: 416923 - DNA, 20 bp, Artificial
  CRISPR gRNA sequence
gtttctgcagccgctttggg

SEQ ID NO: 416924 - DNA, 20 bp, Artificial
  CRISPR gRNA sequence
gcagccgctttgggtggctc

SEQ ID NO: 416925 - DNA, 20 bp, Artificial
  CRISPR gRNA sequence
cagccgctttgggtggctcc

SEQ ID NO: 416926 - DNA, 20 bp, Artificial
  CRISPR gRNA sequence
ttgggtggctccaggtaaaa

SEQ ID NO: 416927 - DNA, 20 bp, Artificial
  CRISPR gRNA sequence
tgggtggctccaggtaaaac

SEQ ID NO: 416928 - DNA, 20 bp, Artificial
  CRISPR gRNA sequence
gggtggctccaggtaaaacg

SEQ ID NO: 416929 - DNA, 20 bp, Artificial
  CRISPR gRNA sequence
ggctccaggtaaaacgggga

SEQ ID NO: 416930 - DNA, 20 bp, Artificial
  CRISPR gRNA sequence
tccaggtaaaacggggatgg

SEQ ID NO: 416931 - DNA, 20 bp, Artificial
  CRISPR gRNA sequence
ccaggtaaaacggggatggc

SEQ ID NO: 416932 - DNA, 20 bp, Artificial
  CRISPR gRNA sequence
aggtaaaacggggatggcgg

SEQ ID NO: 416933 - DNA, 20 bp, Artificial
  CRISPR gRNA sequence
ggtaaaacggggatggcggg

SEQ ID NO: 416934 - DNA, 20 bp, Artificial
  CRISPR gRNA sequence
gtaaaacggggatggcggga

SEQ ID NO: 416935 - DNA, 20 bp, Artificial
  CRISPR gRNA sequence
atggcgggagggttgacctc

SEQ ID NO: 416936 - DNA, 20 bp, Artificial
  CRISPR gRNA sequence
agggttgacctccagcccca

SEQ ID NO: 416937 - DNA, 20 bp, Artificial
  CRISPR gRNA sequence
gggttgacctccagccccac

SEQ ID NO: 416938 - DNA, 20 bp, Artificial
  CRISPR gRNA sequence
gttgacctccagccccacag

SEQ ID NO: 416939 - DNA, 20 bp, Artificial
  CRISPR gRNA sequence
ttgacctccagccccacagg

SEQ ID NO: 416940 - DNA, 20 bp, Artificial
  CRISPR gRNA sequence
tgacctccagccccacagga

SEQ ID NO: 416941 - DNA, 20 bp, Artificial
  CRISPR gRNA sequence
gacctccagccccacaggag

SEQ ID NO: 416942 - DNA, 20 bp, Artificial
  CRISPR gRNA sequence
ccagccccacaggaggggac

SEQ ID NO: 416943 - DNA, 20 bp, Artificial
  CRISPR gRNA sequence
gccccacaggaggggaccag

SEQ ID NO: 416944 - DNA, 20 bp, Artificial
  CRISPR gRNA sequence
ccccacaggaggggaccagc

SEQ ID NO: 416945 - DNA, 20 bp, Artificial
  CRISPR gRNA sequence
cccacaggaggggaccagca

SEQ ID NO: 416946 - DNA, 20 bp, Artificial
  CRISPR gRNA sequence
gggaccagcagggatctctg

SEQ ID NO: 416947 - DNA, 20 bp, Artificial
  CRISPR gRNA sequence
cagggatctctgtggccaca

SEQ ID NO: 416948 - DNA, 20 bp, Artificial
  CRISPR gRNA sequence
agggatctctgtggccacaa

SEQ ID NO: 416949 - DNA, 20 bp, Artificial
  CRISPR gRNA sequence
tctgtggccacaaaggtcct

SEQ ID NO: 416950 - DNA, 20 bp, Artificial
  CRISPR gRNA sequence
ctgtggccacaaaggtcctg

SEQ ID NO: 416951 - DNA, 20 bp, Artificial
  CRISPR gRNA sequence
cacaaaggtcctgaggtcct

SEQ ID NO: 416952 - DNA, 20 bp, Artificial
  CRISPR gRNA sequence
tcctgaggtccttagctctg

SEQ ID NO: 416953 - DNA, 20 bp, Artificial
  CRISPR gRNA sequence
gattcttctaatcccttttt

SEQ ID NO: 416954 - DNA, 20 bp, Artificial
  CRISPR gRNA sequence
attcttctaatccctttttt

SEQ ID NO: 416955 - DNA, 20 bp, Artificial
  CRISPR gRNA sequence
cttctaatcccttttttggg

SEQ ID NO: 416956 - DNA, 20 bp, Artificial
  CRISPR gRNA sequence
gggcagtccttccaccccga

SEQ ID NO: 416957 - DNA, 20 bp, Artificial
  CRISPR gRNA sequence
ttccaccccgaaagcctctc

SEQ ID NO: 416958 - DNA, 20 bp, Artificial
  CRISPR gRNA sequence
tccaccccgaaagcctctct

SEQ ID NO: 416959 - DNA, 20 bp, Artificial
  CRISPR gRNA sequence
accccgaaagcctctctggg

SEQ ID NO: 416960 - DNA, 20 bp, Artificial
  CRISPR gRNA sequence
cccgaaagcctctctgggca

SEQ ID NO: 416961 - DNA, 20 bp, Artificial
  CRISPR gRNA sequence
gaaagcctctctgggcagag

SEQ ID NO: 416962 - DNA, 20 bp, Artificial
  CRISPR gRNA sequence
ctctctgggcagagaagaaa

SEQ ID NO: 416963 - DNA, 20 bp, Artificial
  CRISPR gRNA sequence
cagagaagaaacagaaaccc

SEQ ID NO: 416964 - DNA, 20 bp, Artificial
  CRISPR gRNA sequence
cctgcaccctgtttctccct

SEQ ID NO: 416965 - DNA, 20 bp, Artificial
  CRISPR gRNA sequence
ctgcaccctgtttctccctc

SEQ ID NO: 416966 - DNA, 20 bp, Artificial
  CRISPR gRNA sequence
tttctccctcgggaaacacc

SEQ ID NO: 416967 - DNA, 20 bp, Artificial
  CRISPR gRNA sequence
ttctccctcgggaaacaccc

SEQ ID NO: 416968 - DNA, 20 bp, Artificial
  CRISPR gRNA sequence
ccttctctacccctgcctct

SEQ ID NO: 416969 - DNA, 20 bp, Artificial
  CRISPR gRNA sequence
cggctcacgccccctcccct

SEQ ID NO: 416970 - DNA, 20 bp, Artificial
  CRISPR gRNA sequence
tggcctctcttttgctcacc

SEQ ID NO: 416971 - DNA, 20 bp, Artificial
  CRISPR gRNA sequence
tctcttttgctcacctagtg

SEQ ID NO: 416972 - DNA, 20 bp, Artificial
  CRISPR gRNA sequence
ctcacctagtgaagcctctc

SEQ ID NO: 416973 - DNA, 20 bp, Artificial
  CRISPR gRNA sequence
cctagtgaagcctctccagc

SEQ ID NO: 416974 - DNA, 20 bp, Artificial
  CRISPR gRNA sequence
ctagtgaagcctctccagcc

SEQ ID NO: 416975 - DNA, 20 bp, Artificial
  CRISPR gRNA sequence
tagtgaagcctctccagcca

SEQ ID NO: 416976 - DNA, 20 bp, Artificial
  CRISPR gRNA sequence
agtgaagcctctccagccag

SEQ ID NO: 416977 - DNA, 20 bp, Artificial
  CRISPR gRNA sequence
agcctctccagccaggggct

SEQ ID NO: 416978 - DNA, 20 bp, Artificial
  CRISPR gRNA sequence
gcctctccagccaggggctg

SEQ ID NO: 416979 - DNA, 20 bp, Artificial
  CRISPR gRNA sequence
ccagccaggggctgaggtcc

SEQ ID NO: 416980 - DNA, 20 bp, Artificial
  CRISPR gRNA sequence
gccaggggctgaggtcccgg

SEQ ID NO: 416981 - DNA, 20 bp, Artificial
  CRISPR gRNA sequence
gggctgaggtcccggtggtg

SEQ ID NO: 416982 - DNA, 20 bp, Artificial
  CRISPR gRNA sequence
ggctgaggtcccggtggtgt

SEQ ID NO: 416983 - DNA, 20 bp, Artificial
  CRISPR gRNA sequence
aggtcccggtggtgtgggcc

SEQ ID NO: 416984 - DNA, 20 bp, Artificial
  CRISPR gRNA sequence
ggtcccggtggtgtgggccc

SEQ ID NO: 416985 - DNA, 20 bp, Artificial
  CRISPR gRNA sequence
tcccggtggtgtgggcccag

SEQ ID NO: 416986 - DNA, 20 bp, Artificial
  CRISPR gRNA sequence
cccggtggtgtgggcccagg

SEQ ID NO: 416987 - DNA, 20 bp, Artificial
  CRISPR gRNA sequence
ccggtggtgtgggcccagga

SEQ ID NO: 416988 - DNA, 20 bp, Artificial
  CRISPR gRNA sequence
cggtggtgtgggcccaggag

SEQ ID NO: 416989 - DNA, 20 bp, Artificial
  CRISPR gRNA sequence
ggtggtgtgggcccaggagg

SEQ ID NO: 416990 - DNA, 20 bp, Artificial
  CRISPR gRNA sequence
cccaggagggggctcctgcc

SEQ ID NO: 416991 - DNA, 20 bp, Artificial
  CRISPR gRNA sequence
gctcctgcccagctcccctg

SEQ ID NO: 416992 - DNA, 20 bp, Artificial
  CRISPR gRNA sequence
gcagccccacaatccccctc

SEQ ID NO: 416993 - DNA, 20 bp, Artificial
  CRISPR gRNA sequence
cagccccacaatccccctcc

SEQ ID NO: 416994 - DNA, 20 bp, Artificial
  CRISPR gRNA sequence
acaatccccctccaggatct

SEQ ID NO: 416995 - DNA, 20 bp, Artificial
  CRISPR gRNA sequence
caggatctcagccttctgcg

SEQ ID NO: 416996 - DNA, 20 bp, Artificial
  CRISPR gRNA sequence
ggatctcagccttctgcgaa

SEQ ID NO: 416997 - DNA, 20 bp, Artificial
  CRISPR gRNA sequence
tctcagccttctgcgaagag

SEQ ID NO: 416998 - DNA, 20 bp, Artificial
  CRISPR gRNA sequence
ctcagccttctgcgaagagc

SEQ ID NO: 416999 - DNA, 20 bp, Artificial
  CRISPR gRNA sequence
tcagccttctgcgaagagca

SEQ ID NO: 417000 - DNA, 20 bp, Artificial
  CRISPR gRNA sequence
cagccttctgcgaagagcag

SEQ ID NO: 417001 - DNA, 20 bp, Artificial
  CRISPR gRNA sequence
tgcgaagagcaggggtcact

SEQ ID NO: 417002 - DNA, 20 bp, Artificial
  CRISPR gRNA sequence
gaagagcaggggtcacttgg

SEQ ID NO: 417003 - DNA, 20 bp, Artificial
  CRISPR gRNA sequence
caggggtcacttggcagcat

SEQ ID NO: 417004 - DNA, 20 bp, Artificial
  CRISPR gRNA sequence
ggtcacttggcagcatcagc

SEQ ID NO: 417005 - DNA, 20 bp, Artificial
  CRISPR gRNA sequence
acttggcagcatcagccaga

SEQ ID NO: 417006 - DNA, 20 bp, Artificial
  CRISPR gRNA sequence
cttggcagcatcagccagac

SEQ ID NO: 417007 - DNA, 20 bp, Artificial
  CRISPR gRNA sequence
acaggtatgcaccccaaact

SEQ ID NO: 417008 - DNA, 20 bp, Artificial
  CRISPR gRNA sequence
caggtatgcaccccaaactt

SEQ ID NO: 417009 - DNA, 20 bp, Artificial
  CRISPR gRNA sequence
tgcaccccaaacttgggcaa

SEQ ID NO: 417010 - DNA, 20 bp, Artificial
  CRISPR gRNA sequence
gcaccccaaacttgggcaac

SEQ ID NO: 417011 - DNA, 20 bp, Artificial
  CRISPR gRNA sequence
ggcaacaggacctccgaatc

SEQ ID NO: 417012 - DNA, 20 bp, Artificial
  CRISPR gRNA sequence
actcaaccccacacccgtgc

SEQ ID NO: 417013 - DNA, 20 bp, Artificial
  CRISPR gRNA sequence
ggtcctctgtcccctgccct

SEQ ID NO: 417014 - DNA, 20 bp, Artificial
  CRISPR gRNA sequence
gtcctctgtcccctgccctg

SEQ ID NO: 417015 - DNA, 20 bp, Artificial
  CRISPR gRNA sequence
ctgaggtgtcactccctctg

SEQ ID NO: 417016 - DNA, 20 bp, Artificial
  CRISPR gRNA sequence
ggtgtcactccctctgaagc

SEQ ID NO: 417017 - DNA, 20 bp, Artificial
  CRISPR gRNA sequence
tccctctgaagccagtgacc

SEQ ID NO: 417018 - DNA, 20 bp, Artificial
  CRISPR gRNA sequence
tcctgcccttgctctgcaat

SEQ ID NO: 417019 - DNA, 20 bp, Artificial
  CRISPR gRNA sequence
gcaatcagcgaccctcacgc

SEQ ID NO: 417020 - DNA, 20 bp, Artificial
  CRISPR gRNA sequence
acgccagcatcccttctctc

SEQ ID NO: 417021 - DNA, 20 bp, Artificial
  CRISPR gRNA sequence
ccagcatcccttctctccag

SEQ ID NO: 417022 - DNA, 20 bp, Artificial
  CRISPR gRNA sequence
gcatcccttctctccagaag

SEQ ID NO: 417023 - DNA, 20 bp, Artificial
  CRISPR gRNA sequence
cttctctccagaagtggatg

SEQ ID NO: 417024 - DNA, 20 bp, Artificial
  CRISPR gRNA sequence
tctccagaagtggatgcggc

SEQ ID NO: 417025 - DNA, 20 bp, Artificial
  CRISPR gRNA sequence
agtggatgcggccagtccaa

SEQ ID NO: 417026 - DNA, 20 bp, Artificial
  CRISPR gRNA sequence
tggatgcggccagtccaaca

SEQ ID NO: 417027 - DNA, 20 bp, Artificial
  CRISPR gRNA sequence
ggatgcggccagtccaacag

SEQ ID NO: 417028 - DNA, 20 bp, Artificial
  CRISPR gRNA sequence
gatgcggccagtccaacaga

SEQ ID NO: 417029 - DNA, 20 bp, Artificial
  CRISPR gRNA sequence
atgcggccagtccaacagag

SEQ ID NO: 417030 - DNA, 20 bp, Artificial
  CRISPR gRNA sequence
ggccagtccaacagaggggt

SEQ ID NO: 417031 - DNA, 20 bp, Artificial
  CRISPR gRNA sequence
gccagtccaacagaggggtc

SEQ ID NO: 417032 - DNA, 20 bp, Artificial
  CRISPR gRNA sequence
ccaacagaggggtcgggcgt

SEQ ID NO: 417033 - DNA, 20 bp, Artificial
  CRISPR gRNA sequence
caacagaggggtcgggcgtg

SEQ ID NO: 417034 - DNA, 20 bp, Artificial
  CRISPR gRNA sequence
aacagaggggtcgggcgtga

SEQ ID NO: 417035 - DNA, 20 bp, Artificial
  CRISPR gRNA sequence
acagaggggtcgggcgtgag

SEQ ID NO: 417036 - DNA, 20 bp, Artificial
  CRISPR gRNA sequence
aggggtcgggcgtgagggga

SEQ ID NO: 417037 - DNA, 20 bp, Artificial
  CRISPR gRNA sequence
gtcgggcgtgaggggacggt

SEQ ID NO: 417038 - DNA, 20 bp, Artificial
  CRISPR gRNA sequence
gggcgtgaggggacggttgg

SEQ ID NO: 417039 - DNA, 20 bp, Artificial
  CRISPR gRNA sequence
tgaggggacggttggtggtc

SEQ ID NO: 417040 - DNA, 20 bp, Artificial
  CRISPR gRNA sequence
aggggacggttggtggtcaa

SEQ ID NO: 417041 - DNA, 20 bp, Artificial
  CRISPR gRNA sequence
ttggtggtcaagagaactct

SEQ ID NO: 417042 - DNA, 20 bp, Artificial
  CRISPR gRNA sequence
tggtggtcaagagaactctt

SEQ ID NO: 417043 - DNA, 20 bp, Artificial
  CRISPR gRNA sequence
ggtggtcaagagaactcttg

SEQ ID NO: 417044 - DNA, 20 bp, Artificial
  CRISPR gRNA sequence
ggtcaagagaactcttgggg

SEQ ID NO: 417045 - DNA, 20 bp, Artificial
  CRISPR gRNA sequence
gtcaagagaactcttggggc

SEQ ID NO: 417046 - DNA, 20 bp, Artificial
  CRISPR gRNA sequence
gcgggctttctcatcctcaa

SEQ ID NO: 417047 - DNA, 20 bp, Artificial
  CRISPR gRNA sequence
cgggctttctcatcctcaac

SEQ ID NO: 417048 - DNA, 20 bp, Artificial
  CRISPR gRNA sequence
gctttctcatcctcaacggg

SEQ ID NO: 417049 - DNA, 20 bp, Artificial
  CRISPR gRNA sequence
ggtggctgcctgcatcctcc

SEQ ID NO: 417050 - DNA, 20 bp, Artificial
  CRISPR gRNA sequence
gtggctgcctgcatcctccc

SEQ ID NO: 417051 - DNA, 20 bp, Artificial
  CRISPR gRNA sequence
cctcccgggcttcctacccc

SEQ ID NO: 417052 - DNA, 20 bp, Artificial
  CRISPR gRNA sequence
tcccgggcttcctacccctg

SEQ ID NO: 417053 - DNA, 20 bp, Artificial
  CRISPR gRNA sequence
actccattctctttcccgcc

SEQ ID NO: 417054 - DNA, 20 bp, Artificial
  CRISPR gRNA sequence
ccattctctttcccgcccag

SEQ ID NO: 417055 - DNA, 20 bp, Artificial
  CRISPR gRNA sequence
ggcccgcccgctgccgcccc

SEQ ID NO: 417056 - DNA, 20 bp, Artificial
  CRISPR gRNA sequence
tgccgcccccggccatcccc

SEQ ID NO: 417057 - DNA, 20 bp, Artificial
  CRISPR gRNA sequence
cccggccatcccctggcccc

SEQ ID NO: 417058 - DNA, 20 bp, Artificial
  CRISPR gRNA sequence
cctggcccccggccctcacc

SEQ ID NO: 417059 - DNA, 20 bp, Artificial
  CRISPR gRNA sequence
ggcccccggccctcacccgg

SEQ ID NO: 417060 - DNA, 20 bp, Artificial
  CRISPR gRNA sequence
acccggcggcgccctcctcc

SEQ ID NO: 417061 - DNA, 20 bp, Artificial
  CRISPR gRNA sequence
cccggcggcgccctcctcct

SEQ ID NO: 417062 - DNA, 20 bp, Artificial
  CRISPR gRNA sequence
ccggcggcgccctcctcctg

SEQ ID NO: 417063 - DNA, 20 bp, Artificial
  CRISPR gRNA sequence
cggcggcgccctcctcctgg

SEQ ID NO: 417064 - DNA, 20 bp, Artificial
  CRISPR gRNA sequence
gcgccctcctcctgggggcc

SEQ ID NO: 417065 - DNA, 20 bp, Artificial
  CRISPR gRNA sequence
cgccctcctcctgggggccc

SEQ ID NO: 417066 - DNA, 20 bp, Artificial
  CRISPR gRNA sequence
gcccaggccccgccgctaca

SEQ ID NO: 417067 - DNA, 20 bp, Artificial
  CRISPR gRNA sequence
ccccgccgctacacggtgct

SEQ ID NO: 417068 - DNA, 20 bp, Artificial
  CRISPR gRNA sequence
ccgctacacggtgctgagcg

SEQ ID NO: 417069 - DNA, 20 bp, Artificial
  CRISPR gRNA sequence
cgctacacggtgctgagcgt

SEQ ID NO: 417070 - DNA, 20 bp, Artificial
  CRISPR gRNA sequence
acggtgctgagcgtgggtcc

SEQ ID NO: 417071 - DNA, 20 bp, Artificial
  CRISPR gRNA sequence
ggtgctgagcgtgggtcccg

SEQ ID NO: 417072 - DNA, 20 bp, Artificial
  CRISPR gRNA sequence
gtgctgagcgtgggtcccgg

SEQ ID NO: 417073 - DNA, 20 bp, Artificial
  CRISPR gRNA sequence
gtgggtcccggaggcctgcg

SEQ ID NO: 417074 - DNA, 20 bp, Artificial
  CRISPR gRNA sequence
ggtcccggaggcctgcgcag

SEQ ID NO: 417075 - DNA, 20 bp, Artificial
  CRISPR gRNA sequence
gtcccggaggcctgcgcagc

SEQ ID NO: 417076 - DNA, 20 bp, Artificial
  CRISPR gRNA sequence
cccggaggcctgcgcagcgg

SEQ ID NO: 417077 - DNA, 20 bp, Artificial
  CRISPR gRNA sequence
ccggaggcctgcgcagcggg

SEQ ID NO: 417078 - DNA, 20 bp, Artificial
  CRISPR gRNA sequence
gcagcgggaggctgcccctg

SEQ ID NO: 417079 - DNA, 20 bp, Artificial
  CRISPR gRNA sequence
tgcccctgcagccccgcgtc

SEQ ID NO: 417080 - DNA, 20 bp, Artificial
  CRISPR gRNA sequence
cctgcagccccgcgtccagc

SEQ ID NO: 417081 - DNA, 20 bp, Artificial
  CRISPR gRNA sequence
agccccgcgtccagctggat

SEQ ID NO: 417082 - DNA, 20 bp, Artificial
  CRISPR gRNA sequence
cgcgtccagctggatgagcg

SEQ ID NO: 417083 - DNA, 20 bp, Artificial
  CRISPR gRNA sequence
tccagctggatgagcgcggc

SEQ ID NO: 417084 - DNA, 20 bp, Artificial
  CRISPR gRNA sequence
agctggatgagcgcggccgg

SEQ ID NO: 417085 - DNA, 20 bp, Artificial
  CRISPR gRNA sequence
gatgagcgcggccggcagcg

SEQ ID NO: 417086 - DNA, 20 bp, Artificial
  CRISPR gRNA sequence
atgagcgcggccggcagcgc

SEQ ID NO: 417087 - DNA, 20 bp, Artificial
  CRISPR gRNA sequence
tgagcgcggccggcagcgcg

SEQ ID NO: 417088 - DNA, 20 bp, Artificial
  CRISPR gRNA sequence
agcgcggggacttctcgcta

SEQ ID NO: 417089 - DNA, 20 bp, Artificial
  CRISPR gRNA sequence
cttctcgctatggctgcgcc

SEQ ID NO: 417090 - DNA, 20 bp, Artificial
  CRISPR gRNA sequence
cgctatggctgcgcccagcc

SEQ ID NO: 417091 - DNA, 20 bp, Artificial
  CRISPR gRNA sequence
gctgcgcccagcccggcgcg

SEQ ID NO: 417092 - DNA, 20 bp, Artificial
  CRISPR gRNA sequence
ccagcccggcgcgcggacgc

SEQ ID NO: 417093 - DNA, 20 bp, Artificial
  CRISPR gRNA sequence
cccggcgcgcggacgccggc

SEQ ID NO: 417094 - DNA, 20 bp, Artificial
  CRISPR gRNA sequence
cgccggcgagtaccgcgccg

SEQ ID NO: 417095 - DNA, 20 bp, Artificial
  CRISPR gRNA sequence
taccgcgccgcggtgcacct

SEQ ID NO: 417096 - DNA, 20 bp, Artificial
  CRISPR gRNA sequence
accgcgccgcggtgcacctc

SEQ ID NO: 417097 - DNA, 20 bp, Artificial
  CRISPR gRNA sequence
ccgcgccgcggtgcacctca

SEQ ID NO: 417098 - DNA, 20 bp, Artificial
  CRISPR gRNA sequence
ctgccgcctccgtctgcgcc

SEQ ID NO: 417099 - DNA, 20 bp, Artificial
  CRISPR gRNA sequence
tgccgcctccgtctgcgcct

SEQ ID NO: 417100 - DNA, 20 bp, Artificial
  CRISPR gRNA sequence
gcctccgtctgcgcctgggc

SEQ ID NO: 417101 - DNA, 20 bp, Artificial
  CRISPR gRNA sequence
cctccgtctgcgcctgggcc

SEQ ID NO: 417102 - DNA, 20 bp, Artificial
  CRISPR gRNA sequence
ctgcgcctgggccaggcctc

SEQ ID NO: 417103 - DNA, 20 bp, Artificial
  CRISPR gRNA sequence
tgggccaggcctcgagtatg

SEQ ID NO: 417104 - DNA, 20 bp, Artificial
  CRISPR gRNA sequence
gggccaggcctcgagtatgt

SEQ ID NO: 417105 - DNA, 20 bp, Artificial
  CRISPR gRNA sequence
ggccaggcctcgagtatgtg

SEQ ID NO: 417106 - DNA, 20 bp, Artificial
  CRISPR gRNA sequence
caggcctcgagtatgtgggg

SEQ ID NO: 417107 - DNA, 20 bp, Artificial
  CRISPR gRNA sequence
aggcctcgagtatgtggggc

SEQ ID NO: 417108 - DNA, 20 bp, Artificial
  CRISPR gRNA sequence
gagtatgtggggcgggacga

SEQ ID NO: 417109 - DNA, 20 bp, Artificial
  CRISPR gRNA sequence
agtatgtggggcgggacgat

SEQ ID NO: 417110 - DNA, 20 bp, Artificial
  CRISPR gRNA sequence
tatgtggggcgggacgatgg

SEQ ID NO: 417111 - DNA, 20 bp, Artificial
  CRISPR gRNA sequence
gtggggcgggacgatgggag

SEQ ID NO: 417112 - DNA, 20 bp, Artificial
  CRISPR gRNA sequence
tggggcgggacgatgggaga

SEQ ID NO: 417113 - DNA, 20 bp, Artificial
  CRISPR gRNA sequence
ggggcgggacgatgggagaa

SEQ ID NO: 417114 - DNA, 20 bp, Artificial
  CRISPR gRNA sequence
cgggacgatgggagaagggc

SEQ ID NO: 417115 - DNA, 20 bp, Artificial
  CRISPR gRNA sequence
gggacgatgggagaagggct

SEQ ID NO: 417116 - DNA, 20 bp, Artificial
  CRISPR gRNA sequence
gacgatgggagaagggctgg

SEQ ID NO: 417117 - DNA, 20 bp, Artificial
  CRISPR gRNA sequence
acgatgggagaagggctggg

SEQ ID NO: 417118 - DNA, 20 bp, Artificial
  CRISPR gRNA sequence
atgggagaagggctgggagg

SEQ ID NO: 417119 - DNA, 20 bp, Artificial
  CRISPR gRNA sequence
tgggagaagggctgggaggt

SEQ ID NO: 417120 - DNA, 20 bp, Artificial
  CRISPR gRNA sequence
ggtccccatcccctgcctcc

SEQ ID NO: 417121 - DNA, 20 bp, Artificial
  CRISPR gRNA sequence
gtccccatcccctgcctccc

SEQ ID NO: 417122 - DNA, 20 bp, Artificial
  CRISPR gRNA sequence
atcccctgcctcccgggacg

SEQ ID NO: 417123 - DNA, 20 bp, Artificial
  CRISPR gRNA sequence
tcccctgcctcccgggacgc

SEQ ID NO: 417124 - DNA, 20 bp, Artificial
  CRISPR gRNA sequence
cctgcctcccgggacgcagg

SEQ ID NO: 417125 - DNA, 20 bp, Artificial
  CRISPR gRNA sequence
ctgcctcccgggacgcagga

SEQ ID NO: 417126 - DNA, 20 bp, Artificial
  CRISPR gRNA sequence
tgcctcccgggacgcaggaa

SEQ ID NO: 417127 - DNA, 20 bp, Artificial
  CRISPR gRNA sequence
tcccgggacgcaggaagggc

SEQ ID NO: 417128 - DNA, 20 bp, Artificial
  CRISPR gRNA sequence
cccgggacgcaggaagggct

SEQ ID NO: 417129 - DNA, 20 bp, Artificial
  CRISPR gRNA sequence
ccgggacgcaggaagggctg

SEQ ID NO: 417130 - DNA, 20 bp, Artificial
  CRISPR gRNA sequence
ggacgcaggaagggctgggg

SEQ ID NO: 417131 - DNA, 20 bp, Artificial
  CRISPR gRNA sequence
acgcaggaagggctggggca

SEQ ID NO: 417132 - DNA, 20 bp, Artificial
  CRISPR gRNA sequence
cgcaggaagggctggggcag

SEQ ID NO: 417133 - DNA, 20 bp, Artificial
  CRISPR gRNA sequence
ctggggcagaggctgcgccc

SEQ ID NO: 417134 - DNA, 20 bp, Artificial
  CRISPR gRNA sequence
tggggcagaggctgcgccct

SEQ ID NO: 417135 - DNA, 20 bp, Artificial
  CRISPR gRNA sequence
ggctgcgccctaggccctgt

SEQ ID NO: 417136 - DNA, 20 bp, Artificial
  CRISPR gRNA sequence
ctgcgccctaggccctgtcg

SEQ ID NO: 417137 - DNA, 20 bp, Artificial
  CRISPR gRNA sequence
gcgccctaggccctgtcgga

SEQ ID NO: 417138 - DNA, 20 bp, Artificial
  CRISPR gRNA sequence
aggccctgtcggagagctcc

SEQ ID NO: 417139 - DNA, 20 bp, Artificial
  CRISPR gRNA sequence
ccctgtcggagagctcccag

SEQ ID NO: 417140 - DNA, 20 bp, Artificial
  CRISPR gRNA sequence
ctgtcggagagctcccagaa

SEQ ID NO: 417141 - DNA, 20 bp, Artificial
  CRISPR gRNA sequence
tcggagagctcccagaagag

SEQ ID NO: 417142 - DNA, 20 bp, Artificial
  CRISPR gRNA sequence
ggagagctcccagaagagta

SEQ ID NO: 417143 - DNA, 20 bp, Artificial
  CRISPR gRNA sequence
gagagctcccagaagagtag

SEQ ID NO: 417144 - DNA, 20 bp, Artificial
  CRISPR gRNA sequence
agctcccagaagagtagagg

SEQ ID NO: 417145 - DNA, 20 bp, Artificial
  CRISPR gRNA sequence
gctcccagaagagtagagga

SEQ ID NO: 417146 - DNA, 20 bp, Artificial
  CRISPR gRNA sequence
ctcccagaagagtagaggaa

SEQ ID NO: 417147 - DNA, 20 bp, Artificial
  CRISPR gRNA sequence
tcccagaagagtagaggaag

SEQ ID NO: 417148 - DNA, 20 bp, Artificial
  CRISPR gRNA sequence
cccagaagagtagaggaagg

SEQ ID NO: 417149 - DNA, 20 bp, Artificial
  CRISPR gRNA sequence
agaagagtagaggaaggggg

SEQ ID NO: 417150 - DNA, 20 bp, Artificial
  CRISPR gRNA sequence
gaagagtagaggaagggggt

SEQ ID NO: 417151 - DNA, 20 bp, Artificial
  CRISPR gRNA sequence
gagtagaggaagggggtggg

SEQ ID NO: 417152 - DNA, 20 bp, Artificial
  CRISPR gRNA sequence
gaagggggtgggcggcctgc

SEQ ID NO: 417153 - DNA, 20 bp, Artificial
  CRISPR gRNA sequence
agggggtgggcggcctgctg

SEQ ID NO: 417154 - DNA, 20 bp, Artificial
  CRISPR gRNA sequence
gggtgggcggcctgctggag

SEQ ID NO: 417155 - DNA, 20 bp, Artificial
  CRISPR gRNA sequence
tgggcggcctgctggagtgg

SEQ ID NO: 417156 - DNA, 20 bp, Artificial
  CRISPR gRNA sequence
gggcggcctgctggagtgga

SEQ ID NO: 417157 - DNA, 20 bp, Artificial
  CRISPR gRNA sequence
tggagtggaaggtgcccccg

SEQ ID NO: 417158 - DNA, 20 bp, Artificial
  CRISPR gRNA sequence
gtgcccccgaagcacgtgta

SEQ ID NO: 417159 - DNA, 20 bp, Artificial
  CRISPR gRNA sequence
tgcccccgaagcacgtgtat

SEQ ID NO: 417160 - DNA, 20 bp, Artificial
  CRISPR gRNA sequence
gcccccgaagcacgtgtatg

SEQ ID NO: 417161 - DNA, 20 bp, Artificial
  CRISPR gRNA sequence
cccccgaagcacgtgtatgg

SEQ ID NO: 417162 - DNA, 20 bp, Artificial
  CRISPR gRNA sequence
ccccgaagcacgtgtatggg

SEQ ID NO: 417163 - DNA, 20 bp, Artificial
  CRISPR gRNA sequence
cacgtgtatggggggccctg

SEQ ID NO: 417164 - DNA, 20 bp, Artificial
  CRISPR gRNA sequence
cgtgtatggggggccctgtg

SEQ ID NO: 417165 - DNA, 20 bp, Artificial
  CRISPR gRNA sequence
tgtatggggggccctgtgga

SEQ ID NO: 417166 - DNA, 20 bp, Artificial
  CRISPR gRNA sequence
ggagagattgtgtcaccccc

SEQ ID NO: 417167 - DNA, 20 bp, Artificial
  CRISPR gRNA sequence
ctccccttctcccacccacg

SEQ ID NO: 417168 - DNA, 20 bp, Artificial
  CRISPR gRNA sequence
tccccttctcccacccacgc

SEQ ID NO: 417169 - DNA, 20 bp, Artificial
  CRISPR gRNA sequence
cccttctcccacccacgcgg

SEQ ID NO: 417170 - DNA, 20 bp, Artificial
  CRISPR gRNA sequence
cccacccacgcgggagtgcc

SEQ ID NO: 417171 - DNA, 20 bp, Artificial
  CRISPR gRNA sequence
cacccacgcgggagtgccca

SEQ ID NO: 417172 - DNA, 20 bp, Artificial
  CRISPR gRNA sequence
acccacgcgggagtgcccag

SEQ ID NO: 417173 - DNA, 20 bp, Artificial
  CRISPR gRNA sequence
cccacgcgggagtgcccaga

SEQ ID NO: 417174 - DNA, 20 bp, Artificial
  CRISPR gRNA sequence
cacgcgggagtgcccagagg

SEQ ID NO: 417175 - DNA, 20 bp, Artificial
  CRISPR gRNA sequence
acgcgggagtgcccagaggg

SEQ ID NO: 417176 - DNA, 20 bp, Artificial
  CRISPR gRNA sequence
cgcgggagtgcccagaggga

SEQ ID NO: 417177 - DNA, 20 bp, Artificial
  CRISPR gRNA sequence
gcgggagtgcccagagggag

SEQ ID NO: 417178 - DNA, 20 bp, Artificial
  CRISPR gRNA sequence
cgggagtgcccagagggagg

SEQ ID NO: 417179 - DNA, 20 bp, Artificial
  CRISPR gRNA sequence
ggagtgcccagagggagggg

SEQ ID NO: 417180 - DNA, 20 bp, Artificial
  CRISPR gRNA sequence
gagtgcccagagggaggggg

SEQ ID NO: 417181 - DNA, 20 bp, Artificial
  CRISPR gRNA sequence
agtgcccagagggaggggga

SEQ ID NO: 417182 - DNA, 20 bp, Artificial
  CRISPR gRNA sequence
gtgcccagagggagggggag

SEQ ID NO: 417183 - DNA, 20 bp, Artificial
  CRISPR gRNA sequence
tgcccagagggagggggagg

SEQ ID NO: 417184 - DNA, 20 bp, Artificial
  CRISPR gRNA sequence
gcccagagggagggggaggg

SEQ ID NO: 417185 - DNA, 20 bp, Artificial
  CRISPR gRNA sequence
cccagagggagggggagggg

SEQ ID NO: 417186 - DNA, 20 bp, Artificial
  CRISPR gRNA sequence
cagagggagggggagggggg

SEQ ID NO: 417187 - DNA, 20 bp, Artificial
  CRISPR gRNA sequence
gagggagggggaggggggga

SEQ ID NO: 417188 - DNA, 20 bp, Artificial
  CRISPR gRNA sequence
agggggagggggggagagca

SEQ ID NO: 417189 - DNA, 20 bp, Artificial
  CRISPR gRNA sequence
gggggagggggggagagcat

SEQ ID NO: 417190 - DNA, 20 bp, Artificial
  CRISPR gRNA sequence
ggggagggggggagagcatg

SEQ ID NO: 417191 - DNA, 20 bp, Artificial
  CRISPR gRNA sequence
ggggggagagcatggggcta

SEQ ID NO: 417192 - DNA, 20 bp, Artificial
  CRISPR gRNA sequence
ggggctaaagtgattcattt

SEQ ID NO: 417193 - DNA, 20 bp, Artificial
  CRISPR gRNA sequence
tgattcatttcagatatctg

SEQ ID NO: 417194 - DNA, 20 bp, Artificial
  CRISPR gRNA sequence
catttcagatatctgtagct

SEQ ID NO: 417195 - DNA, 20 bp, Artificial
  CRISPR gRNA sequence
atttcagatatctgtagctc

SEQ ID NO: 417196 - DNA, 20 bp, Artificial
  CRISPR gRNA sequence
tttcagatatctgtagctca

SEQ ID NO: 417197 - DNA, 20 bp, Artificial
  CRISPR gRNA sequence
ttcagatatctgtagctcag

SEQ ID NO: 417198 - DNA, 20 bp, Artificial
  CRISPR gRNA sequence
tcagatatctgtagctcagg

SEQ ID NO: 417199 - DNA, 20 bp, Artificial
  CRISPR gRNA sequence
gatatctgtagctcaggggg

SEQ ID NO: 417200 - DNA, 20 bp, Artificial
  CRISPR gRNA sequence
atatctgtagctcagggggt

SEQ ID NO: 417201 - DNA, 20 bp, Artificial
  CRISPR gRNA sequence
agctcagggggtgggcttcg

SEQ ID NO: 417202 - DNA, 20 bp, Artificial
  CRISPR gRNA sequence
gctcagggggtgggcttcgc

SEQ ID NO: 417203 - DNA, 20 bp, Artificial
  CRISPR gRNA sequence
ctcagggggtgggcttcgcg

SEQ ID NO: 417204 - DNA, 20 bp, Artificial
  CRISPR gRNA sequence
gggtgggcttcgcggggttc

SEQ ID NO: 417205 - DNA, 20 bp, Artificial
  CRISPR gRNA sequence
ggtgggcttcgcggggttcc

SEQ ID NO: 417206 - DNA, 20 bp, Artificial
  CRISPR gRNA sequence
ggcttcgcggggttccaggc

SEQ ID NO: 417207 - DNA, 20 bp, Artificial
  CRISPR gRNA sequence
gcttcgcggggttccaggcc

SEQ ID NO: 417208 - DNA, 20 bp, Artificial
  CRISPR gRNA sequence
ggggttccaggccaggaaaa

SEQ ID NO: 417209 - DNA, 20 bp, Artificial
  CRISPR gRNA sequence
ttccaggccaggaaaacggc

SEQ ID NO: 417210 - DNA, 20 bp, Artificial
  CRISPR gRNA sequence
tccaggccaggaaaacggca

SEQ ID NO: 417211 - DNA, 20 bp, Artificial
  CRISPR gRNA sequence
ccaggccaggaaaacggcaa

SEQ ID NO: 417212 - DNA, 20 bp, Artificial
  CRISPR gRNA sequence
ggccaggaaaacggcaaggg

SEQ ID NO: 417213 - DNA, 20 bp, Artificial
  CRISPR gRNA sequence
cggcaagggtggctgatgcc

SEQ ID NO: 417214 - DNA, 20 bp, Artificial
  CRISPR gRNA sequence
ggctgatgccaagtaaactc

SEQ ID NO: 417215 - DNA, 20 bp, Artificial
  CRISPR gRNA sequence
gctgatgccaagtaaactcc

SEQ ID NO: 417216 - DNA, 20 bp, Artificial
  CRISPR gRNA sequence
atgccaagtaaactccaggc

SEQ ID NO: 417217 - DNA, 20 bp, Artificial
  CRISPR gRNA sequence
tgccaagtaaactccaggcc

SEQ ID NO: 417218 - DNA, 20 bp, Artificial
  CRISPR gRNA sequence
gccaagtaaactccaggcca

SEQ ID NO: 417219 - DNA, 20 bp, Artificial
  CRISPR gRNA sequence
agtaaactccaggccaggga

SEQ ID NO: 417220 - DNA, 20 bp, Artificial
  CRISPR gRNA sequence
gtaaactccaggccagggac

SEQ ID NO: 417221 - DNA, 20 bp, Artificial
  CRISPR gRNA sequence
taaactccaggccagggacg

SEQ ID NO: 417222 - DNA, 20 bp, Artificial
  CRISPR gRNA sequence
ctccaggccagggacgggga

SEQ ID NO: 417223 - DNA, 20 bp, Artificial
  CRISPR gRNA sequence
caggccagggacggggaaag

SEQ ID NO: 417224 - DNA, 20 bp, Artificial
  CRISPR gRNA sequence
agggacggggaaagtggtcc

SEQ ID NO: 417225 - DNA, 20 bp, Artificial
  CRISPR gRNA sequence
gggacggggaaagtggtcct

SEQ ID NO: 417226 - DNA, 20 bp, Artificial
  CRISPR gRNA sequence
ggacggggaaagtggtcctg

SEQ ID NO: 417227 - DNA, 20 bp, Artificial
  CRISPR gRNA sequence
acggggaaagtggtcctggg

SEQ ID NO: 417228 - DNA, 20 bp, Artificial
  CRISPR gRNA sequence
aaagtggtcctggggagtct

SEQ ID NO: 417229 - DNA, 20 bp, Artificial
  CRISPR gRNA sequence
aagtggtcctggggagtctt

SEQ ID NO: 417230 - DNA, 20 bp, Artificial
  CRISPR gRNA sequence
agtggtcctggggagtcttg

SEQ ID NO: 417231 - DNA, 20 bp, Artificial
  CRISPR gRNA sequence
ggatccactttatgcacctc

SEQ ID NO: 417232 - DNA, 20 bp, Artificial
  CRISPR gRNA sequence
gatccactttatgcacctcc

SEQ ID NO: 417233 - DNA, 20 bp, Artificial
  CRISPR gRNA sequence
ctttatgcacctccaggtgc

SEQ ID NO: 417234 - DNA, 20 bp, Artificial
  CRISPR gRNA sequence
tatgcacctccaggtgctgg

SEQ ID NO: 417235 - DNA, 20 bp, Artificial
  CRISPR gRNA sequence
acctccaggtgctggaagct

SEQ ID NO: 417236 - DNA, 20 bp, Artificial
  CRISPR gRNA sequence
ccaggtgctggaagctgaga

SEQ ID NO: 417237 - DNA, 20 bp, Artificial
  CRISPR gRNA sequence
caggtgctggaagctgagat

SEQ ID NO: 417238 - DNA, 20 bp, Artificial
  CRISPR gRNA sequence
aggtgctggaagctgagatg

SEQ ID NO: 417239 - DNA, 20 bp, Artificial
  CRISPR gRNA sequence
gtgctggaagctgagatggg

SEQ ID NO: 417240 - DNA, 20 bp, Artificial
  CRISPR gRNA sequence
gctggaagctgagatgggga

SEQ ID NO: 417241 - DNA, 20 bp, Artificial
  CRISPR gRNA sequence
ctggaagctgagatggggag

SEQ ID NO: 417242 - DNA, 20 bp, Artificial
  CRISPR gRNA sequence
tggaagctgagatggggaga

SEQ ID NO: 417243 - DNA, 20 bp, Artificial
  CRISPR gRNA sequence
gagatggggagagggtgatg

SEQ ID NO: 417244 - DNA, 20 bp, Artificial
  CRISPR gRNA sequence
agatggggagagggtgatgt

SEQ ID NO: 417245 - DNA, 20 bp, Artificial
  CRISPR gRNA sequence
atggggagagggtgatgtgg

SEQ ID NO: 417246 - DNA, 20 bp, Artificial
  CRISPR gRNA sequence
ggggagagggtgatgtggga

SEQ ID NO: 417247 - DNA, 20 bp, Artificial
  CRISPR gRNA sequence
gggagagggtgatgtgggag

SEQ ID NO: 417248 - DNA, 20 bp, Artificial
  CRISPR gRNA sequence
gagagggtgatgtgggagag

SEQ ID NO: 417249 - DNA, 20 bp, Artificial
  CRISPR gRNA sequence
agggtgatgtgggagaggag

SEQ ID NO: 417250 - DNA, 20 bp, Artificial
  CRISPR gRNA sequence
gatgtgggagaggagaagac

SEQ ID NO: 417251 - DNA, 20 bp, Artificial
  CRISPR gRNA sequence
gagaggagaagacaagtcta

SEQ ID NO: 417252 - DNA, 20 bp, Artificial
  CRISPR gRNA sequence
ggagaagacaagtctaaagc

SEQ ID NO: 417253 - DNA, 20 bp, Artificial
  CRISPR gRNA sequence
gagaagacaagtctaaagcc

SEQ ID NO: 417254 - DNA, 20 bp, Artificial
  CRISPR gRNA sequence
taaagccaggtgcctgtttc

SEQ ID NO: 417255 - DNA, 20 bp, Artificial
  CRISPR gRNA sequence
aaagccaggtgcctgtttcc

SEQ ID NO: 417256 - DNA, 20 bp, Artificial
  CRISPR gRNA sequence
agccaggtgcctgtttccag

SEQ ID NO: 417257 - DNA, 20 bp, Artificial
  CRISPR gRNA sequence
tgcctgtttccaggagcttc

SEQ ID NO: 417258 - DNA, 20 bp, Artificial
  CRISPR gRNA sequence
gtttccaggagcttccggct

SEQ ID NO: 417259 - DNA, 20 bp, Artificial
  CRISPR gRNA sequence
tccaggagcttccggcttgg

SEQ ID NO: 417260 - DNA, 20 bp, Artificial
  CRISPR gRNA sequence
gcttggcagccctgctgtgt

SEQ ID NO: 417261 - DNA, 20 bp, Artificial
  CRISPR gRNA sequence
cttggcagccctgctgtgtt

SEQ ID NO: 417262 - DNA, 20 bp, Artificial
  CRISPR gRNA sequence
ctgtgttgggaaattgtttc

SEQ ID NO: 417263 - DNA, 20 bp, Artificial
  CRISPR gRNA sequence
tgttgggaaattgtttccag

SEQ ID NO: 417264 - DNA, 20 bp, Artificial
  CRISPR gRNA sequence
gttgggaaattgtttccagt

SEQ ID NO: 417265 - DNA, 20 bp, Artificial
  CRISPR gRNA sequence
ttgtttccagtgggctgatg

SEQ ID NO: 417266 - DNA, 20 bp, Artificial
  CRISPR gRNA sequence
aagtcttctttatccttgca

SEQ ID NO: 417267 - DNA, 20 bp, Artificial
  CRISPR gRNA sequence
tatccttgcacagtgactgc

SEQ ID NO: 417268 - DNA, 20 bp, Artificial
  CRISPR gRNA sequence
cacagtgactgccagccccc

SEQ ID NO: 417269 - DNA, 20 bp, Artificial
  CRISPR gRNA sequence
acagtgactgccagcccccc

SEQ ID NO: 417270 - DNA, 20 bp, Artificial
  CRISPR gRNA sequence
gccagccccccaggatctct

SEQ ID NO: 417271 - DNA, 20 bp, Artificial
  CRISPR gRNA sequence
cagccccccaggatctctca

SEQ ID NO: 417272 - DNA, 20 bp, Artificial
  CRISPR gRNA sequence
gatctctcagagcctccgac

SEQ ID NO: 417273 - DNA, 20 bp, Artificial
  CRISPR gRNA sequence
atctctcagagcctccgact

SEQ ID NO: 417274 - DNA, 20 bp, Artificial
  CRISPR gRNA sequence
gtcattttgaactgctcctt

SEQ ID NO: 417275 - DNA, 20 bp, Artificial
  CRISPR gRNA sequence
cttcagccgccctgaccgcc

SEQ ID NO: 417276 - DNA, 20 bp, Artificial
  CRISPR gRNA sequence
accgcccagcctctgtgcat

SEQ ID NO: 417277 - DNA, 20 bp, Artificial
  CRISPR gRNA sequence
cagcctctgtgcattggttc

SEQ ID NO: 417278 - DNA, 20 bp, Artificial
  CRISPR gRNA sequence
ctgtgcattggttccggaac

SEQ ID NO: 417279 - DNA, 20 bp, Artificial
  CRISPR gRNA sequence
tgtgcattggttccggaacc

SEQ ID NO: 417280 - DNA, 20 bp, Artificial
  CRISPR gRNA sequence
gtgcattggttccggaaccg

SEQ ID NO: 417281 - DNA, 20 bp, Artificial
  CRISPR gRNA sequence
attggttccggaaccggggc

SEQ ID NO: 417282 - DNA, 20 bp, Artificial
  CRISPR gRNA sequence
ttggttccggaaccggggcc

SEQ ID NO: 417283 - DNA, 20 bp, Artificial
  CRISPR gRNA sequence
tggttccggaaccggggcca

SEQ ID NO: 417284 - DNA, 20 bp, Artificial
  CRISPR gRNA sequence
ccggaaccggggccagggcc

SEQ ID NO: 417285 - DNA, 20 bp, Artificial
  CRISPR gRNA sequence
gccagggccgagtccctgtc

SEQ ID NO: 417286 - DNA, 20 bp, Artificial
  CRISPR gRNA sequence
ccagggccgagtccctgtcc

SEQ ID NO: 417287 - DNA, 20 bp, Artificial
  CRISPR gRNA sequence
agggccgagtccctgtccgg

SEQ ID NO: 417288 - DNA, 20 bp, Artificial
  CRISPR gRNA sequence
ggagtccccccatcaccact

SEQ ID NO: 417289 - DNA, 20 bp, Artificial
  CRISPR gRNA sequence
gtccccccatcaccacttag

SEQ ID NO: 417290 - DNA, 20 bp, Artificial
  CRISPR gRNA sequence
ccccatcaccacttagcgga

SEQ ID NO: 417291 - DNA, 20 bp, Artificial
  CRISPR gRNA sequence
aagcttcctcttcctgcccc

SEQ ID NO: 417292 - DNA, 20 bp, Artificial
  CRISPR gRNA sequence
ttcctcttcctgccccaagt

SEQ ID NO: 417293 - DNA, 20 bp, Artificial
  CRISPR gRNA sequence
cctgccccaagtcagcccca

SEQ ID NO: 417294 - DNA, 20 bp, Artificial
  CRISPR gRNA sequence
caagtcagccccatggactc

SEQ ID NO: 417295 - DNA, 20 bp, Artificial
  CRISPR gRNA sequence
aagtcagccccatggactct

SEQ ID NO: 417296 - DNA, 20 bp, Artificial
  CRISPR gRNA sequence
gccccatggactctgggccc

SEQ ID NO: 417297 - DNA, 20 bp, Artificial
  CRISPR gRNA sequence
ccccatggactctgggccct

SEQ ID NO: 417298 - DNA, 20 bp, Artificial
  CRISPR gRNA sequence
cccatggactctgggccctg

SEQ ID NO: 417299 - DNA, 20 bp, Artificial
  CRISPR gRNA sequence
tggggctgcatcctcaccta

SEQ ID NO: 417300 - DNA, 20 bp, Artificial
  CRISPR gRNA sequence
gggctgcatcctcacctaca

SEQ ID NO: 417301 - DNA, 20 bp, Artificial
  CRISPR gRNA sequence
tgcatcctcacctacagaga

SEQ ID NO: 417302 - DNA, 20 bp, Artificial
  CRISPR gRNA sequence
catgtataacctcactgttc

SEQ ID NO: 417303 - DNA, 20 bp, Artificial
  CRISPR gRNA sequence
atgtataacctcactgttct

SEQ ID NO: 417304 - DNA, 20 bp, Artificial
  CRISPR gRNA sequence
cttgtcacctcccctaacta

SEQ ID NO: 417305 - DNA, 20 bp, Artificial
  CRISPR gRNA sequence
ttgtcacctcccctaactat

SEQ ID NO: 417306 - DNA, 20 bp, Artificial
  CRISPR gRNA sequence
ctaactatgggtccccaaac

SEQ ID NO: 417307 - DNA, 20 bp, Artificial
  CRISPR gRNA sequence
taactatgggtccccaaacc

SEQ ID NO: 417308 - DNA, 20 bp, Artificial
  CRISPR gRNA sequence
gggtccccaaaccaggttct

SEQ ID NO: 417309 - DNA, 20 bp, Artificial
  CRISPR gRNA sequence
tccccaaaccaggttctcgg

SEQ ID NO: 417310 - DNA, 20 bp, Artificial
  CRISPR gRNA sequence
caaaccaggttctcggcagc

SEQ ID NO: 417311 - DNA, 20 bp, Artificial
  CRISPR gRNA sequence
accaggttctcggcagcgag

SEQ ID NO: 417312 - DNA, 20 bp, Artificial
  CRISPR gRNA sequence
agtggcctacgtcattgctg

SEQ ID NO: 417313 - DNA, 20 bp, Artificial
  CRISPR gRNA sequence
gtggcctacgtcattgctgt

SEQ ID NO: 417314 - DNA, 20 bp, Artificial
  CRISPR gRNA sequence
gttcgacccctttatattgc

SEQ ID NO: 417315 - DNA, 20 bp, Artificial
  CRISPR gRNA sequence
cgacccctttatattgctgg

SEQ ID NO: 417316 - DNA, 20 bp, Artificial
  CRISPR gRNA sequence
ttatattgctggcagcctca

SEQ ID NO: 417317 - DNA, 20 bp, Artificial
  CRISPR gRNA sequence
accccttcttgcttctcccg

SEQ ID NO: 417318 - DNA, 20 bp, Artificial
  CRISPR gRNA sequence
ttgcttctcccgtggccttc

SEQ ID NO: 417319 - DNA, 20 bp, Artificial
  CRISPR gRNA sequence
tggccttccagcgtcattgc

SEQ ID NO: 417320 - DNA, 20 bp, Artificial
  CRISPR gRNA sequence
gccggccttccctctccttc

SEQ ID NO: 417321 - DNA, 20 bp, Artificial
  CRISPR gRNA sequence
ccttccctctccttccggct

SEQ ID NO: 417322 - DNA, 20 bp, Artificial
  CRISPR gRNA sequence
ttccggctaagcccacttgc

SEQ ID NO: 417323 - DNA, 20 bp, Artificial
  CRISPR gRNA sequence
tccggctaagcccacttgct

SEQ ID NO: 417324 - DNA, 20 bp, Artificial
  CRISPR gRNA sequence
agcccacttgctgggtttct

SEQ ID NO: 417325 - DNA, 20 bp, Artificial
  CRISPR gRNA sequence
gctgggtttctgagcctcct

SEQ ID NO: 417326 - DNA, 20 bp, Artificial
  CRISPR gRNA sequence
catcaccttattctgctcct

SEQ ID NO: 417327 - DNA, 20 bp, Artificial
  CRISPR gRNA sequence
ctgctccttagcactcttat

SEQ ID NO: 417328 - DNA, 20 bp, Artificial
  CRISPR gRNA sequence
tccttagcactcttatgagc

SEQ ID NO: 417329 - DNA, 20 bp, Artificial
  CRISPR gRNA sequence
tcttctgcctcccttccttg

SEQ ID NO: 417330 - DNA, 20 bp, Artificial
  CRISPR gRNA sequence
gcctcccttccttgcagccc

SEQ ID NO: 417331 - DNA, 20 bp, Artificial
  CRISPR gRNA sequence
ccagcactccctccccactg

SEQ ID NO: 417332 - DNA, 20 bp, Artificial
  CRISPR gRNA sequence
tccctccccactgcagcacc

SEQ ID NO: 417333 - DNA, 20 bp, Artificial
  CRISPR gRNA sequence
gcagcacccagctttaactt

SEQ ID NO: 417334 - DNA, 20 bp, Artificial
  CRISPR gRNA sequence
cagcacccagctttaacttt

SEQ ID NO: 417335 - DNA, 20 bp, Artificial
  CRISPR gRNA sequence
tttgggttttcttttctctt

SEQ ID NO: 417336 - DNA, 20 bp, Artificial
  CRISPR gRNA sequence
ttgggttttcttttctcttc

SEQ ID NO: 417337 - DNA, 20 bp, Artificial
  CRISPR gRNA sequence
ttttcttttctcttcaggtc

SEQ ID NO: 417338 - DNA, 20 bp, Artificial
  CRISPR gRNA sequence
ttcttttctcttcaggtctg

SEQ ID NO: 417339 - DNA, 20 bp, Artificial
  CRISPR gRNA sequence
ggagcccccaactcccttga

SEQ ID NO: 417340 - DNA, 20 bp, Artificial
  CRISPR gRNA sequence
actcccttgacagtgtacgc

SEQ ID NO: 417341 - DNA, 20 bp, Artificial
  CRISPR gRNA sequence
tcccttgacagtgtacgctg

SEQ ID NO: 417342 - DNA, 20 bp, Artificial
  CRISPR gRNA sequence
cttgacagtgtacgctggag

SEQ ID NO: 417343 - DNA, 20 bp, Artificial
  CRISPR gRNA sequence
ttgacagtgtacgctggagc

SEQ ID NO: 417344 - DNA, 20 bp, Artificial
  CRISPR gRNA sequence
gtgtacgctggagcaggttc

SEQ ID NO: 417345 - DNA, 20 bp, Artificial
  CRISPR gRNA sequence
tgtacgctggagcaggttcc

SEQ ID NO: 417346 - DNA, 20 bp, Artificial
  CRISPR gRNA sequence
gtacgctggagcaggttcca

SEQ ID NO: 417347 - DNA, 20 bp, Artificial
  CRISPR gRNA sequence
cgctggagcaggttccaggg

SEQ ID NO: 417348 - DNA, 20 bp, Artificial
  CRISPR gRNA sequence
gctggagcaggttccagggt

SEQ ID NO: 417349 - DNA, 20 bp, Artificial
  CRISPR gRNA sequence
ctggagcaggttccagggtg

SEQ ID NO: 417350 - DNA, 20 bp, Artificial
  CRISPR gRNA sequence
ctgccctgccgcctgcctgc

SEQ ID NO: 417351 - DNA, 20 bp, Artificial
  CRISPR gRNA sequence
ctgccgcctgcctgctggtg

SEQ ID NO: 417352 - DNA, 20 bp, Artificial
  CRISPR gRNA sequence
tgccgcctgcctgctggtgt

SEQ ID NO: 417353 - DNA, 20 bp, Artificial
  CRISPR gRNA sequence
gccgcctgcctgctggtgtg

SEQ ID NO: 417354 - DNA, 20 bp, Artificial
  CRISPR gRNA sequence
tgcctgctggtgtggggacc

SEQ ID NO: 417355 - DNA, 20 bp, Artificial
  CRISPR gRNA sequence
cccggtctttcctcactgcc

SEQ ID NO: 417356 - DNA, 20 bp, Artificial
  CRISPR gRNA sequence
ggtctttcctcactgccaag

SEQ ID NO: 417357 - DNA, 20 bp, Artificial
  CRISPR gRNA sequence
actgccaagtggactcctcc

SEQ ID NO: 417358 - DNA, 20 bp, Artificial
  CRISPR gRNA sequence
ctgccaagtggactcctcct

SEQ ID NO: 417359 - DNA, 20 bp, Artificial
  CRISPR gRNA sequence
tgccaagtggactcctcctg

SEQ ID NO: 417360 - DNA, 20 bp, Artificial
  CRISPR gRNA sequence
gccaagtggactcctcctgg

SEQ ID NO: 417361 - DNA, 20 bp, Artificial
  CRISPR gRNA sequence
caagtggactcctcctgggg

SEQ ID NO: 417362 - DNA, 20 bp, Artificial
  CRISPR gRNA sequence
aagtggactcctcctggggg

SEQ ID NO: 417363 - DNA, 20 bp, Artificial
  CRISPR gRNA sequence
tgggggaggccctgacctcc

SEQ ID NO: 417364 - DNA, 20 bp, Artificial
  CRISPR gRNA sequence
ggccctgacctcctggtgac

SEQ ID NO: 417365 - DNA, 20 bp, Artificial
  CRISPR gRNA sequence
ccctgacctcctggtgactg

SEQ ID NO: 417366 - DNA, 20 bp, Artificial
  CRISPR gRNA sequence
ctcctggtgactggagacaa

SEQ ID NO: 417367 - DNA, 20 bp, Artificial
  CRISPR gRNA sequence
tggcgactttacccttcgac

SEQ ID NO: 417368 - DNA, 20 bp, Artificial
  CRISPR gRNA sequence
gcgactttacccttcgacta

SEQ ID NO: 417369 - DNA, 20 bp, Artificial
  CRISPR gRNA sequence
cgactttacccttcgactag

SEQ ID NO: 417370 - DNA, 20 bp, Artificial
  CRISPR gRNA sequence
acccttcgactagaggatgt

SEQ ID NO: 417371 - DNA, 20 bp, Artificial
  CRISPR gRNA sequence
ttcgactagaggatgtgagc

SEQ ID NO: 417372 - DNA, 20 bp, Artificial
  CRISPR gRNA sequence
tcgactagaggatgtgagcc

SEQ ID NO: 417373 - DNA, 20 bp, Artificial
  CRISPR gRNA sequence
tagaggatgtgagccaggcc

SEQ ID NO: 417374 - DNA, 20 bp, Artificial
  CRISPR gRNA sequence
agaggatgtgagccaggccc

SEQ ID NO: 417375 - DNA, 20 bp, Artificial
  CRISPR gRNA sequence
gatgtgagccaggcccaggc

SEQ ID NO: 417376 - DNA, 20 bp, Artificial
  CRISPR gRNA sequence
atgtgagccaggcccaggct

SEQ ID NO: 417377 - DNA, 20 bp, Artificial
  CRISPR gRNA sequence
acacctgccatatccatctg

SEQ ID NO: 417378 - DNA, 20 bp, Artificial
  CRISPR gRNA sequence
cacctgccatatccatctgc

SEQ ID NO: 417379 - DNA, 20 bp, Artificial
  CRISPR gRNA sequence
gccatatccatctgcaggaa

SEQ ID NO: 417380 - DNA, 20 bp, Artificial
  CRISPR gRNA sequence
atatccatctgcaggaacag

SEQ ID NO: 417381 - DNA, 20 bp, Artificial
  CRISPR gRNA sequence
gctcaatgccactgtcacat

SEQ ID NO: 417382 - DNA, 20 bp, Artificial
  CRISPR gRNA sequence
tgtcacattggcaatcatca

SEQ ID NO: 417383 - DNA, 20 bp, Artificial
  CRISPR gRNA sequence
gtcacattggcaatcatcac

SEQ ID NO: 417384 - DNA, 20 bp, Artificial
  CRISPR gRNA sequence
cattggcaatcatcacaggt

SEQ ID NO: 417385 - DNA, 20 bp, Artificial
  CRISPR gRNA sequence
caatcatcacaggtcagcct

SEQ ID NO: 417386 - DNA, 20 bp, Artificial
  CRISPR gRNA sequence
aatcatcacaggtcagcctc

SEQ ID NO: 417387 - DNA, 20 bp, Artificial
  CRISPR gRNA sequence
catcacaggtcagcctcagg

SEQ ID NO: 417388 - DNA, 20 bp, Artificial
  CRISPR gRNA sequence
atcacaggtcagcctcaggt

SEQ ID NO: 417389 - DNA, 20 bp, Artificial
  CRISPR gRNA sequence
caggtcagcctcaggtggga

SEQ ID NO: 417390 - DNA, 20 bp, Artificial
  CRISPR gRNA sequence
aggtcagcctcaggtgggaa

SEQ ID NO: 417391 - DNA, 20 bp, Artificial
  CRISPR gRNA sequence
gtcagcctcaggtgggaaag

SEQ ID NO: 417392 - DNA, 20 bp, Artificial
  CRISPR gRNA sequence
agcctcaggtgggaaaggag

SEQ ID NO: 417393 - DNA, 20 bp, Artificial
  CRISPR gRNA sequence
gaaaggagtagctgccctcc

SEQ ID NO: 417394 - DNA, 20 bp, Artificial
  CRISPR gRNA sequence
aaaggagtagctgccctccc

SEQ ID NO: 417395 - DNA, 20 bp, Artificial
  CRISPR gRNA sequence
aaggagtagctgccctccca

SEQ ID NO: 417396 - DNA, 20 bp, Artificial
  CRISPR gRNA sequence
gagtagctgccctcccaggg

SEQ ID NO: 417397 - DNA, 20 bp, Artificial
  CRISPR gRNA sequence
agctgccctcccagggtaga

SEQ ID NO: 417398 - DNA, 20 bp, Artificial
  CRISPR gRNA sequence
gctgccctcccagggtagaa

SEQ ID NO: 417399 - DNA, 20 bp, Artificial
  CRISPR gRNA sequence
ccctcccagggtagaaagga

SEQ ID NO: 417400 - DNA, 20 bp, Artificial
  CRISPR gRNA sequence
cctcccagggtagaaaggac

SEQ ID NO: 417401 - DNA, 20 bp, Artificial
  CRISPR gRNA sequence
ctcccagggtagaaaggaca

SEQ ID NO: 417402 - DNA, 20 bp, Artificial
  CRISPR gRNA sequence
cccagggtagaaaggacagg

SEQ ID NO: 417403 - DNA, 20 bp, Artificial
  CRISPR gRNA sequence
ccagggtagaaaggacaggg

SEQ ID NO: 417404 - DNA, 20 bp, Artificial
  CRISPR gRNA sequence
gggtagaaaggacagggagg

SEQ ID NO: 417405 - DNA, 20 bp, Artificial
  CRISPR gRNA sequence
ggtagaaaggacagggagga

SEQ ID NO: 417406 - DNA, 20 bp, Artificial
  CRISPR gRNA sequence
gtagaaaggacagggaggaa

SEQ ID NO: 417407 - DNA, 20 bp, Artificial
  CRISPR gRNA sequence
aaaggacagggaggaagggc

SEQ ID NO: 417408 - DNA, 20 bp, Artificial
  CRISPR gRNA sequence
ggacagggaggaagggctgg

SEQ ID NO: 417409 - DNA, 20 bp, Artificial
  CRISPR gRNA sequence
gacagggaggaagggctggc

SEQ ID NO: 417410 - DNA, 20 bp, Artificial
  CRISPR gRNA sequence
acagggaggaagggctggca

SEQ ID NO: 417411 - DNA, 20 bp, Artificial
  CRISPR gRNA sequence
gaggaagggctggcagggca

SEQ ID NO: 417412 - DNA, 20 bp, Artificial
  CRISPR gRNA sequence
agggctggcagggcaaagac

SEQ ID NO: 417413 - DNA, 20 bp, Artificial
  CRISPR gRNA sequence
gggctggcagggcaaagact

SEQ ID NO: 417414 - DNA, 20 bp, Artificial
  CRISPR gRNA sequence
gcaaacccaccctgtgatgc

SEQ ID NO: 417415 - DNA, 20 bp, Artificial
  CRISPR gRNA sequence
caaacccaccctgtgatgcc

SEQ ID NO: 417416 - DNA, 20 bp, Artificial
  CRISPR gRNA sequence
accctgtgatgccaggccac

SEQ ID NO: 417417 - DNA, 20 bp, Artificial
  CRISPR gRNA sequence
ccctgtgatgccaggccact

SEQ ID NO: 417418 - DNA, 20 bp, Artificial
  CRISPR gRNA sequence
gatgccaggccactgggcac

SEQ ID NO: 417419 - DNA, 20 bp, Artificial
  CRISPR gRNA sequence
aggccactgggcacaagttc

SEQ ID NO: 417420 - DNA, 20 bp, Artificial
  CRISPR gRNA sequence
gccactgggcacaagttcca

SEQ ID NO: 417421 - DNA, 20 bp, Artificial
  CRISPR gRNA sequence
gttccagagcctgcccatct

SEQ ID NO: 417422 - DNA, 20 bp, Artificial
  CRISPR gRNA sequence
cttttctcacccccataata

SEQ ID NO: 417423 - DNA, 20 bp, Artificial
  CRISPR gRNA sequence
gaaactgaaaatctcctctt

SEQ ID NO: 417424 - DNA, 20 bp, Artificial
  CRISPR gRNA sequence
aaaatctcctcttgagtcac

SEQ ID NO: 417425 - DNA, 20 bp, Artificial
  CRISPR gRNA sequence
cctcttgagtcacaagataa

SEQ ID NO: 417426 - DNA, 20 bp, Artificial
  CRISPR gRNA sequence
aaaagttccaccgttctcta

SEQ ID NO: 417427 - DNA, 20 bp, Artificial
  CRISPR gRNA sequence
aaagttccaccgttctctat

SEQ ID NO: 417428 - DNA, 20 bp, Artificial
  CRISPR gRNA sequence
gggactcccctgctctcaat

SEQ ID NO: 417429 - DNA, 20 bp, Artificial
  CRISPR gRNA sequence
actcccctgctctcaattgg

SEQ ID NO: 417430 - DNA, 20 bp, Artificial
  CRISPR gRNA sequence
ctcccctgctctcaattggc

SEQ ID NO: 417431 - DNA, 20 bp, Artificial
  CRISPR gRNA sequence
cccctgctctcaattggcgg

SEQ ID NO: 417432 - DNA, 20 bp, Artificial
  CRISPR gRNA sequence
ccctgctctcaattggcggg

SEQ ID NO: 417433 - DNA, 20 bp, Artificial
  CRISPR gRNA sequence
cctgctctcaattggcggga

SEQ ID NO: 417434 - DNA, 20 bp, Artificial
  CRISPR gRNA sequence
tctcaattggcgggagggtc

SEQ ID NO: 417435 - DNA, 20 bp, Artificial
  CRISPR gRNA sequence
ctcaattggcgggagggtct

SEQ ID NO: 417436 - DNA, 20 bp, Artificial
  CRISPR gRNA sequence
aattggcgggagggtctggg

SEQ ID NO: 417437 - DNA, 20 bp, Artificial
  CRISPR gRNA sequence
ggcgggagggtctgggaagt

SEQ ID NO: 417438 - DNA, 20 bp, Artificial
  CRISPR gRNA sequence
gggagggtctgggaagttag

SEQ ID NO: 417439 - DNA, 20 bp, Artificial
  CRISPR gRNA sequence
ggagggtctgggaagttaga

SEQ ID NO: 417440 - DNA, 20 bp, Artificial
  CRISPR gRNA sequence
ggtctgggaagttagaagga

SEQ ID NO: 417441 - DNA, 20 bp, Artificial
  CRISPR gRNA sequence
gtctgggaagttagaaggaa

SEQ ID NO: 417442 - DNA, 20 bp, Artificial
  CRISPR gRNA sequence
aaggtgacaaaaattctgaa

SEQ ID NO: 417443 - DNA, 20 bp, Artificial
  CRISPR gRNA sequence
aaaaattctgaatggttcga

SEQ ID NO: 417444 - DNA, 20 bp, Artificial
  CRISPR gRNA sequence
aaattctgaatggttcgaaa

SEQ ID NO: 417445 - DNA, 20 bp, Artificial
  CRISPR gRNA sequence
aattctgaatggttcgaaag

SEQ ID NO: 417446 - DNA, 20 bp, Artificial
  CRISPR gRNA sequence
tctgaatggttcgaaagagg

SEQ ID NO: 417447 - DNA, 20 bp, Artificial
  CRISPR gRNA sequence
aaagaggtagaatatatttc

SEQ ID NO: 417448 - DNA, 20 bp, Artificial
  CRISPR gRNA sequence
tagaatccttgtctactttg

SEQ ID NO: 417449 - DNA, 20 bp, Artificial
  CRISPR gRNA sequence
atccttgtctactttgcagc

SEQ ID NO: 417450 - DNA, 20 bp, Artificial
  CRISPR gRNA sequence
tccttgtctactttgcagcc

SEQ ID NO: 417451 - DNA, 20 bp, Artificial
  CRISPR gRNA sequence
ccttgtctactttgcagcca

SEQ ID NO: 417452 - DNA, 20 bp, Artificial
  CRISPR gRNA sequence
tctactttgcagccagggct

SEQ ID NO: 417453 - DNA, 20 bp, Artificial
  CRISPR gRNA sequence
ctactttgcagccagggctt

SEQ ID NO: 417454 - DNA, 20 bp, Artificial
  CRISPR gRNA sequence
tttgcagccagggcttgggt

SEQ ID NO: 417455 - DNA, 20 bp, Artificial
  CRISPR gRNA sequence
tgcagccagggcttgggtta

SEQ ID NO: 417456 - DNA, 20 bp, Artificial
  CRISPR gRNA sequence
cagggcttgggttagagttg

SEQ ID NO: 417457 - DNA, 20 bp, Artificial
  CRISPR gRNA sequence
agggcttgggttagagttgc

SEQ ID NO: 417458 - DNA, 20 bp, Artificial
  CRISPR gRNA sequence
gcttgggttagagttgcagg

SEQ ID NO: 417459 - DNA, 20 bp, Artificial
  CRISPR gRNA sequence
tgggttagagttgcaggaag

SEQ ID NO: 417460 - DNA, 20 bp, Artificial
  CRISPR gRNA sequence
tagagttgcaggaagtggcc

SEQ ID NO: 417461 - DNA, 20 bp, Artificial
  CRISPR gRNA sequence
tgcaggaagtggcctggatt

SEQ ID NO: 417462 - DNA, 20 bp, Artificial
  CRISPR gRNA sequence
gcaggaagtggcctggattt

SEQ ID NO: 417463 - DNA, 20 bp, Artificial
  CRISPR gRNA sequence
aggaagtggcctggatttgg

SEQ ID NO: 417464 - DNA, 20 bp, Artificial
  CRISPR gRNA sequence
ggaagtggcctggatttggg

SEQ ID NO: 417465 - DNA, 20 bp, Artificial
  CRISPR gRNA sequence
aagtggcctggatttgggag

SEQ ID NO: 417466 - DNA, 20 bp, Artificial
  CRISPR gRNA sequence
gagtgaataaatccgtccct

SEQ ID NO: 417467 - DNA, 20 bp, Artificial
  CRISPR gRNA sequence
gaataaatccgtcccttggt

SEQ ID NO: 417468 - DNA, 20 bp, Artificial
  CRISPR gRNA sequence
ttggtcagcaaatatttact

SEQ ID NO: 417469 - DNA, 20 bp, Artificial
  CRISPR gRNA sequence
tcagcaaatatttactgagc

SEQ ID NO: 417470 - DNA, 20 bp, Artificial
  CRISPR gRNA sequence
cagcaaatatttactgagca

SEQ ID NO: 417471 - DNA, 20 bp, Artificial
  CRISPR gRNA sequence
agcaaatatttactgagcaa

SEQ ID NO: 417472 - DNA, 20 bp, Artificial
  CRISPR gRNA sequence
ttactgagcaagggttttcc

SEQ ID NO: 417473 - DNA, 20 bp, Artificial
  CRISPR gRNA sequence
tgagcaagggttttccaaga

SEQ ID NO: 417474 - DNA, 20 bp, Artificial
  CRISPR gRNA sequence
aagacagtataaaacaaaca

SEQ ID NO: 417475 - DNA, 20 bp, Artificial
  CRISPR gRNA sequence
tataaaacaaacacagaaaa

SEQ ID NO: 417476 - DNA, 20 bp, Artificial
  CRISPR gRNA sequence
aacacagaaaaaagaatact

SEQ ID NO: 417477 - DNA, 20 bp, Artificial
  CRISPR gRNA sequence
cacagaaaaaagaatactca

SEQ ID NO: 417478 - DNA, 20 bp, Artificial
  CRISPR gRNA sequence
cagaaaaaagaatactcaga

SEQ ID NO: 417479 - DNA, 20 bp, Artificial
  CRISPR gRNA sequence
ctcagagagtatgtgttgac

SEQ ID NO: 417480 - DNA, 20 bp, Artificial
  CRISPR gRNA sequence
gttgactggttgataactat

SEQ ID NO: 417481 - DNA, 20 bp, Artificial
  CRISPR gRNA sequence
ttgataactatcggccatga

SEQ ID NO: 417482 - DNA, 20 bp, Artificial
  CRISPR gRNA sequence
aactatcggccatgacagat

SEQ ID NO: 417483 - DNA, 20 bp, Artificial
  CRISPR gRNA sequence
tgacagattagccatgtctg

SEQ ID NO: 417484 - DNA, 20 bp, Artificial
  CRISPR gRNA sequence
atgtctgcagcacgcacctg

SEQ ID NO: 417485 - DNA, 20 bp, Artificial
  CRISPR gRNA sequence
agcacgcacctgcggccact

SEQ ID NO: 417486 - DNA, 20 bp, Artificial
  CRISPR gRNA sequence
acgcacctgcggccactcag

SEQ ID NO: 417487 - DNA, 20 bp, Artificial
  CRISPR gRNA sequence
cacctgcggccactcagtag

SEQ ID NO: 417488 - DNA, 20 bp, Artificial
  CRISPR gRNA sequence
cactcagtagtagcacccca

SEQ ID NO: 417489 - DNA, 20 bp, Artificial
  CRISPR gRNA sequence
tcagtagtagcaccccacgg

SEQ ID NO: 417490 - DNA, 20 bp, Artificial
  CRISPR gRNA sequence
cagtagtagcaccccacggc

SEQ ID NO: 417491 - DNA, 20 bp, Artificial
  CRISPR gRNA sequence
ggcaggtgcttaataatgta

SEQ ID NO: 417492 - DNA, 20 bp, Artificial
  CRISPR gRNA sequence
caggtgcttaataatgtata

SEQ ID NO: 417493 - DNA, 20 bp, Artificial
  CRISPR gRNA sequence
tgaatacgtgaacatgctaa

SEQ ID NO: 417494 - DNA, 20 bp, Artificial
  CRISPR gRNA sequence
aatggataatacatctcctg

SEQ ID NO: 417495 - DNA, 20 bp, Artificial
  CRISPR gRNA sequence
atggataatacatctcctga

SEQ ID NO: 417496 - DNA, 20 bp, Artificial
  CRISPR gRNA sequence
atctcctgaaggccaatcct

SEQ ID NO: 417497 - DNA, 20 bp, Artificial
  CRISPR gRNA sequence
ctgagttttcacttgctttc

SEQ ID NO: 417498 - DNA, 20 bp, Artificial
  CRISPR gRNA sequence
gctttctggatacctctaac

SEQ ID NO: 417499 - DNA, 20 bp, Artificial
  CRISPR gRNA sequence
ctagatgttataccacctct

SEQ ID NO: 417500 - DNA, 20 bp, Artificial
  CRISPR gRNA sequence
agccgccttaccctgaaccc

SEQ ID NO: 417501 - DNA, 20 bp, Artificial
  CRISPR gRNA sequence
caccaatccccttgctgact

SEQ ID NO: 417502 - DNA, 20 bp, Artificial
  CRISPR gRNA sequence
cccttgctgactcagcctgt

SEQ ID NO: 417503 - DNA, 20 bp, Artificial
  CRISPR gRNA sequence
tcagcctgtcagtaatccac

SEQ ID NO: 417504 - DNA, 20 bp, Artificial
  CRISPR gRNA sequence
tatccatccacctcgaaacc

SEQ ID NO: 417505 - DNA, 20 bp, Artificial
  CRISPR gRNA sequence
tcctcctctctacatcccat

SEQ ID NO: 417506 - DNA, 20 bp, Artificial
  CRISPR gRNA sequence
ctacatcccatcagtcatca

SEQ ID NO: 417507 - DNA, 20 bp, Artificial
  CRISPR gRNA sequence
catcagtcatcaaagtccac

SEQ ID NO: 417508 - DNA, 20 bp, Artificial
  CRISPR gRNA sequence
ttctgtccaatgccctcttg

SEQ ID NO: 417509 - DNA, 20 bp, Artificial
  CRISPR gRNA sequence
tctgtccaatgccctcttga

SEQ ID NO: 417510 - DNA, 20 bp, Artificial
  CRISPR gRNA sequence
tgaaggtcaactgttttatg

SEQ ID NO: 417511 - DNA, 20 bp, Artificial
  CRISPR gRNA sequence
ggtcaactgttttatgtaga

SEQ ID NO: 417512 - DNA, 20 bp, Artificial
  CRISPR gRNA sequence
ttttatgtagacggctcaat

SEQ ID NO: 417513 - DNA, 20 bp, Artificial
  CRISPR gRNA sequence
ttatgtagacggctcaatga

SEQ ID NO: 417514 - DNA, 20 bp, Artificial
  CRISPR gRNA sequence
atgtagacggctcaatgaga

SEQ ID NO: 417515 - DNA, 20 bp, Artificial
  CRISPR gRNA sequence
agagagatactgttaccccg

SEQ ID NO: 417516 - DNA, 20 bp, Artificial
  CRISPR gRNA sequence
ccccgaagactttctcaaaa

SEQ ID NO: 417517 - DNA, 20 bp, Artificial
  CRISPR gRNA sequence
gaagactttctcaaaacagc

SEQ ID NO: 417518 - DNA, 20 bp, Artificial
  CRISPR gRNA sequence
aagactttctcaaaacagct

SEQ ID NO: 417519 - DNA, 20 bp, Artificial
  CRISPR gRNA sequence
actttctcaaaacagctggg

SEQ ID NO: 417520 - DNA, 20 bp, Artificial
  CRISPR gRNA sequence
tcaaaacagctgggaagtgc

SEQ ID NO: 417521 - DNA, 20 bp, Artificial
  CRISPR gRNA sequence
agctgggaagtgccagactc

SEQ ID NO: 417522 - DNA, 20 bp, Artificial
  CRISPR gRNA sequence
gctgggaagtgccagactct

SEQ ID NO: 417523 - DNA, 20 bp, Artificial
  CRISPR gRNA sequence
ccagactctgggtctaaact

SEQ ID NO: 417524 - DNA, 20 bp, Artificial
  CRISPR gRNA sequence
cagactctgggtctaaactc

SEQ ID NO: 417525 - DNA, 20 bp, Artificial
  CRISPR gRNA sequence
tgcatcaccaaatcactctc

SEQ ID NO: 417526 - DNA, 20 bp, Artificial
  CRISPR gRNA sequence
gcatcaccaaatcactctcc

SEQ ID NO: 417527 - DNA, 20 bp, Artificial
  CRISPR gRNA sequence
tcactctccaggacactact

SEQ ID NO: 417528 - DNA, 20 bp, Artificial
  CRISPR gRNA sequence
ccatctctcactttacaact

SEQ ID NO: 417529 - DNA, 20 bp, Artificial
  CRISPR gRNA sequence
atctctcactttacaacttg

SEQ ID NO: 417530 - DNA, 20 bp, Artificial
  CRISPR gRNA sequence
cttggagaatgctctgtctc

SEQ ID NO: 417531 - DNA, 20 bp, Artificial
  CRISPR gRNA sequence
atgctctgtctctagatgaa

SEQ ID NO: 417532 - DNA, 20 bp, Artificial
  CRISPR gRNA sequence
tgctctgtctctagatgaat

SEQ ID NO: 417533 - DNA, 20 bp, Artificial
  CRISPR gRNA sequence
ctgtctctagatgaatgggt

SEQ ID NO: 417534 - DNA, 20 bp, Artificial
  CRISPR gRNA sequence
ttccctgttctctatacctt

SEQ ID NO: 417535 - DNA, 20 bp, Artificial
  CRISPR gRNA sequence
ctgttctctataccttcaga

SEQ ID NO: 417536 - DNA, 20 bp, Artificial
  CRISPR gRNA sequence
tgttctctataccttcagaa

SEQ ID NO: 417537 - DNA, 20 bp, Artificial
  CRISPR gRNA sequence
gttctctataccttcagaaa

SEQ ID NO: 417538 - DNA, 20 bp, Artificial
  CRISPR gRNA sequence
ttctctataccttcagaaag

SEQ ID NO: 417539 - DNA, 20 bp, Artificial
  CRISPR gRNA sequence
tctctataccttcagaaagg

SEQ ID NO: 417540 - DNA, 20 bp, Artificial
  CRISPR gRNA sequence
aaagggggatgatgttcatt

SEQ ID NO: 417541 - DNA, 20 bp, Artificial
  CRISPR gRNA sequence
aagggggatgatgttcattc

SEQ ID NO: 417542 - DNA, 20 bp, Artificial
  CRISPR gRNA sequence
agggggatgatgttcattca

SEQ ID NO: 417543 - DNA, 20 bp, Artificial
  CRISPR gRNA sequence
gggggatgatgttcattcag

SEQ ID NO: 417544 - DNA, 20 bp, Artificial
  CRISPR gRNA sequence
ggggatgatgttcattcagg

SEQ ID NO: 417545 - DNA, 20 bp, Artificial
  CRISPR gRNA sequence
gttcattcagggggcaccac

SEQ ID NO: 417546 - DNA, 20 bp, Artificial
  CRISPR gRNA sequence
ttcattcagggggcaccaca

SEQ ID NO: 417547 - DNA, 20 bp, Artificial
  CRISPR gRNA sequence
attcagggggcaccacaagg

SEQ ID NO: 417548 - DNA, 20 bp, Artificial
  CRISPR gRNA sequence
ttcagggggcaccacaaggc

SEQ ID NO: 417549 - DNA, 20 bp, Artificial
  CRISPR gRNA sequence
tcagggggcaccacaaggca

SEQ ID NO: 417550 - DNA, 20 bp, Artificial
  CRISPR gRNA sequence
cagggggcaccacaaggcag

SEQ ID NO: 417551 - DNA, 20 bp, Artificial
  CRISPR gRNA sequence
aaggcaggggacactgatgt

SEQ ID NO: 417552 - DNA, 20 bp, Artificial
  CRISPR gRNA sequence
cactgatgtgagccgcatca

SEQ ID NO: 417553 - DNA, 20 bp, Artificial
  CRISPR gRNA sequence
tgatgtgagccgcatcatgg

SEQ ID NO: 417554 - DNA, 20 bp, Artificial
  CRISPR gRNA sequence
atggaagttccaaaattgtg

SEQ ID NO: 417555 - DNA, 20 bp, Artificial
  CRISPR gRNA sequence
gaagttccaaaattgtgaag

SEQ ID NO: 417556 - DNA, 20 bp, Artificial
  CRISPR gRNA sequence
ttccaaaattgtgaagtaga

SEQ ID NO: 417557 - DNA, 20 bp, Artificial
  CRISPR gRNA sequence
tccaaaattgtgaagtagat

SEQ ID NO: 417558 - DNA, 20 bp, Artificial
  CRISPR gRNA sequence
ccaaaattgtgaagtagatg

SEQ ID NO: 417559 - DNA, 20 bp, Artificial
  CRISPR gRNA sequence
caaaattgtgaagtagatgg

SEQ ID NO: 417560 - DNA, 20 bp, Artificial
  CRISPR gRNA sequence
attgtgaagtagatgggggt

SEQ ID NO: 417561 - DNA, 20 bp, Artificial
  CRISPR gRNA sequence
cagctcatctgactgatttt

SEQ ID NO: 417562 - DNA, 20 bp, Artificial
  CRISPR gRNA sequence
agctcatctgactgattttg

SEQ ID NO: 417563 - DNA, 20 bp, Artificial
  CRISPR gRNA sequence
gctcatctgactgattttga

SEQ ID NO: 417564 - DNA, 20 bp, Artificial
  CRISPR gRNA sequence
tgactgattttgagggttct

SEQ ID NO: 417565 - DNA, 20 bp, Artificial
  CRISPR gRNA sequence
tttgagggttctgagcattt

SEQ ID NO: 417566 - DNA, 20 bp, Artificial
  CRISPR gRNA sequence
gagggttctgagcatttgag

SEQ ID NO: 417567 - DNA, 20 bp, Artificial
  CRISPR gRNA sequence
gttctgagcatttgagtaga

SEQ ID NO: 417568 - DNA, 20 bp, Artificial
  CRISPR gRNA sequence
ttgagtagaaagtaatgtaa

SEQ ID NO: 417569 - DNA, 20 bp, Artificial
  CRISPR gRNA sequence
taatgtaaaagaatctgtaa

SEQ ID NO: 417570 - DNA, 20 bp, Artificial
  CRISPR gRNA sequence
ctgtaatagtatttattctg

SEQ ID NO: 417571 - DNA, 20 bp, Artificial
  CRISPR gRNA sequence
gtatttattctgtggtctgc

SEQ ID NO: 417572 - DNA, 20 bp, Artificial
  CRISPR gRNA sequence
tatttattctgtggtctgcc

SEQ ID NO: 417573 - DNA, 20 bp, Artificial
  CRISPR gRNA sequence
atttattctgtggtctgcca

SEQ ID NO: 417574 - DNA, 20 bp, Artificial
  CRISPR gRNA sequence
attctgtggtctgccagggc

SEQ ID NO: 417575 - DNA, 20 bp, Artificial
  CRISPR gRNA sequence
tggtctgccagggccagttt

SEQ ID NO: 417576 - DNA, 20 bp, Artificial
  CRISPR gRNA sequence
ccagggccagtttgagtgtg

SEQ ID NO: 417577 - DNA, 20 bp, Artificial
  CRISPR gRNA sequence
cagggccagtttgagtgtga

SEQ ID NO: 417578 - DNA, 20 bp, Artificial
  CRISPR gRNA sequence
ggccagtttgagtgtgaagg

SEQ ID NO: 417579 - DNA, 20 bp, Artificial
  CRISPR gRNA sequence
cagtttgagtgtgaaggcag

SEQ ID NO: 417580 - DNA, 20 bp, Artificial
  CRISPR gRNA sequence
agtttgagtgtgaaggcagt

SEQ ID NO: 417581 - DNA, 20 bp, Artificial
  CRISPR gRNA sequence
gtttgagtgtgaaggcagta

SEQ ID NO: 417582 - DNA, 20 bp, Artificial
  CRISPR gRNA sequence
ttgagtgtgaaggcagtagg

SEQ ID NO: 417583 - DNA, 20 bp, Artificial
  CRISPR gRNA sequence
tgtgaaggcagtagggagcc

SEQ ID NO: 417584 - DNA, 20 bp, Artificial
  CRISPR gRNA sequence
agggagcctggaaatgtttt

SEQ ID NO: 417585 - DNA, 20 bp, Artificial
  CRISPR gRNA sequence
gagcctggaaatgttttgag

SEQ ID NO: 417586 - DNA, 20 bp, Artificial
  CRISPR gRNA sequence
agcctggaaatgttttgagc

SEQ ID NO: 417587 - DNA, 20 bp, Artificial
  CRISPR gRNA sequence
gcctggaaatgttttgagca

SEQ ID NO: 417588 - DNA, 20 bp, Artificial
  CRISPR gRNA sequence
cctggaaatgttttgagcag

SEQ ID NO: 417589 - DNA, 20 bp, Artificial
  CRISPR gRNA sequence
tggaaatgttttgagcaggg

SEQ ID NO: 417590 - DNA, 20 bp, Artificial
  CRISPR gRNA sequence
ggaaatgttttgagcagggg

SEQ ID NO: 417591 - DNA, 20 bp, Artificial
  CRISPR gRNA sequence
gaaatgttttgagcagggga

SEQ ID NO: 417592 - DNA, 20 bp, Artificial
  CRISPR gRNA sequence
aatgttttgagcaggggagg

SEQ ID NO: 417593 - DNA, 20 bp, Artificial
  CRISPR gRNA sequence
gagcaggggagggagctgac

SEQ ID NO: 417594 - DNA, 20 bp, Artificial
  CRISPR gRNA sequence
gcaggggagggagctgacta

SEQ ID NO: 417595 - DNA, 20 bp, Artificial
  CRISPR gRNA sequence
gactagagcattgtctgaat

SEQ ID NO: 417596 - DNA, 20 bp, Artificial
  CRISPR gRNA sequence
ttgtctgaataagataaatg

SEQ ID NO: 417597 - DNA, 20 bp, Artificial
  CRISPR gRNA sequence
ctgaataagataaatgtggc

SEQ ID NO: 417598 - DNA, 20 bp, Artificial
  CRISPR gRNA sequence
aataagataaatgtggccgg

SEQ ID NO: 417599 - DNA, 20 bp, Artificial
  CRISPR gRNA sequence
ataagataaatgtggccggc

SEQ ID NO: 417600 - DNA, 20 bp, Artificial
  CRISPR gRNA sequence
taagataaatgtggccggca

SEQ ID NO: 417601 - DNA, 20 bp, Artificial
  CRISPR gRNA sequence
atgtggccggcagggcatga

SEQ ID NO: 417602 - DNA, 20 bp, Artificial
  CRISPR gRNA sequence
atggctcacacctgtaatcc

SEQ ID NO: 417603 - DNA, 20 bp, Artificial
  CRISPR gRNA sequence
ctgtaatcccagcactttga

SEQ ID NO: 417604 - DNA, 20 bp, Artificial
  CRISPR gRNA sequence
tgtaatcccagcactttgaa

SEQ ID NO: 417605 - DNA, 20 bp, Artificial
  CRISPR gRNA sequence
tcccagcactttgaaaggct

SEQ ID NO: 417606 - DNA, 20 bp, Artificial
  CRISPR gRNA sequence
gcactttgaaaggctgagac

SEQ ID NO: 417607 - DNA, 20 bp, Artificial
  CRISPR gRNA sequence
actttgaaaggctgagacga

SEQ ID NO: 417608 - DNA, 20 bp, Artificial
  CRISPR gRNA sequence
ctttgaaaggctgagacgag

SEQ ID NO: 417609 - DNA, 20 bp, Artificial
  CRISPR gRNA sequence
ttgaaaggctgagacgagag

SEQ ID NO: 417610 - DNA, 20 bp, Artificial
  CRISPR gRNA sequence
ctgagacgagaggagcactt

SEQ ID NO: 417611 - DNA, 20 bp, Artificial
  CRISPR gRNA sequence
acgagaggagcacttgagtc

SEQ ID NO: 417612 - DNA, 20 bp, Artificial
  CRISPR gRNA sequence
cgagaggagcacttgagtcc

SEQ ID NO: 417613 - DNA, 20 bp, Artificial
  CRISPR gRNA sequence
gcacttgagtccaggaattc

SEQ ID NO: 417614 - DNA, 20 bp, Artificial
  CRISPR gRNA sequence
tgagtccaggaattccagac

SEQ ID NO: 417615 - DNA, 20 bp, Artificial
  CRISPR gRNA sequence
ccaggaattccagactagcc

SEQ ID NO: 417616 - DNA, 20 bp, Artificial
  CRISPR gRNA sequence
caggaattccagactagcct

SEQ ID NO: 417617 - DNA, 20 bp, Artificial
  CRISPR gRNA sequence
ccagactagcctgggcaaca

SEQ ID NO: 417618 - DNA, 20 bp, Artificial
  CRISPR gRNA sequence
caatttaataaaaaaataaa

SEQ ID NO: 417619 - DNA, 20 bp, Artificial
  CRISPR gRNA sequence
ttaataaaaaaataaataga

SEQ ID NO: 417620 - DNA, 20 bp, Artificial
  CRISPR gRNA sequence
aaaaaataaatagaaagaaa

SEQ ID NO: 417621 - DNA, 20 bp, Artificial
  CRISPR gRNA sequence
tagaaagaaaaagatgaacg

SEQ ID NO: 417622 - DNA, 20 bp, Artificial
  CRISPR gRNA sequence
tgtccttccccaacctcccc

SEQ ID NO: 417623 - DNA, 20 bp, Artificial
  CRISPR gRNA sequence
cttccccaacctcccctggc

SEQ ID NO: 417624 - DNA, 20 bp, Artificial
  CRISPR gRNA sequence
acctcccctggccagaaccc

SEQ ID NO: 417625 - DNA, 20 bp, Artificial
  CRISPR gRNA sequence
cccctggccagaacccaagt

SEQ ID NO: 417626 - DNA, 20 bp, Artificial
  CRISPR gRNA sequence
ggccagaacccaagtgagtg

SEQ ID NO: 417627 - DNA, 20 bp, Artificial
  CRISPR gRNA sequence
gccagaacccaagtgagtgc

SEQ ID NO: 417628 - DNA, 20 bp, Artificial
  CRISPR gRNA sequence
ccagaacccaagtgagtgca

SEQ ID NO: 417629 - DNA, 20 bp, Artificial
  CRISPR gRNA sequence
caagtgagtgcagggtgatt

SEQ ID NO: 417630 - DNA, 20 bp, Artificial
  CRISPR gRNA sequence
agtgcagggtgattgagact

SEQ ID NO: 417631 - DNA, 20 bp, Artificial
  CRISPR gRNA sequence
gtgcagggtgattgagactt

SEQ ID NO: 417632 - DNA, 20 bp, Artificial
  CRISPR gRNA sequence
tgcagggtgattgagacttg

SEQ ID NO: 417633 - DNA, 20 bp, Artificial
  CRISPR gRNA sequence
ttcaacctgtgatatcacgt

SEQ ID NO: 417634 - DNA, 20 bp, Artificial
  CRISPR gRNA sequence
tcaacctgtgatatcacgta

SEQ ID NO: 417635 - DNA, 20 bp, Artificial
  CRISPR gRNA sequence
caacctgtgatatcacgtaa

SEQ ID NO: 417636 - DNA, 20 bp, Artificial
  CRISPR gRNA sequence
aacctgtgatatcacgtaag

SEQ ID NO: 417637 - DNA, 20 bp, Artificial
  CRISPR gRNA sequence
acctgtgatatcacgtaagg

SEQ ID NO: 417638 - DNA, 20 bp, Artificial
  CRISPR gRNA sequence
cctgtgatatcacgtaaggg

SEQ ID NO: 417639 - DNA, 20 bp, Artificial
  CRISPR gRNA sequence
gtgatatcacgtaagggggg

SEQ ID NO: 417640 - DNA, 20 bp, Artificial
  CRISPR gRNA sequence
taaggggggcagaatcccaa

SEQ ID NO: 417641 - DNA, 20 bp, Artificial
  CRISPR gRNA sequence
tctcttccttctactctttt

SEQ ID NO: 417642 - DNA, 20 bp, Artificial
  CRISPR gRNA sequence
tcagtgactcccaaatcctt

SEQ ID NO: 417643 - DNA, 20 bp, Artificial
  CRISPR gRNA sequence
cagtgactcccaaatccttt

SEQ ID NO: 417644 - DNA, 20 bp, Artificial
  CRISPR gRNA sequence
cccaaatcctttgggtcacc

SEQ ID NO: 417645 - DNA, 20 bp, Artificial
  CRISPR gRNA sequence
ctttgggtcacctggatccc

SEQ ID NO: 417646 - DNA, 20 bp, Artificial
  CRISPR gRNA sequence
tttgggtcacctggatccct

SEQ ID NO: 417647 - DNA, 20 bp, Artificial
  CRISPR gRNA sequence
ttgggtcacctggatccctg

SEQ ID NO: 417648 - DNA, 20 bp, Artificial
  CRISPR gRNA sequence
ggtcacctggatccctgggg

SEQ ID NO: 417649 - DNA, 20 bp, Artificial
  CRISPR gRNA sequence
ccctggggaagctgctttgt

SEQ ID NO: 417650 - DNA, 20 bp, Artificial
  CRISPR gRNA sequence
cctggggaagctgctttgtg

SEQ ID NO: 417651 - DNA, 20 bp, Artificial
  CRISPR gRNA sequence
gctgctttgtgaggtgactc

SEQ ID NO: 417652 - DNA, 20 bp, Artificial
  CRISPR gRNA sequence
tgtgaggtgactccagtatc

SEQ ID NO: 417653 - DNA, 20 bp, Artificial
  CRISPR gRNA sequence
ggtgactccagtatctggac

SEQ ID NO: 417654 - DNA, 20 bp, Artificial
  CRISPR gRNA sequence
ctggacaagaacgctttgtg

SEQ ID NO: 417655 - DNA, 20 bp, Artificial
  CRISPR gRNA sequence
ggacaagaacgctttgtgtg

SEQ ID NO: 417656 - DNA, 20 bp, Artificial
  CRISPR gRNA sequence
acgctttgtgtggagctctc

SEQ ID NO: 417657 - DNA, 20 bp, Artificial
  CRISPR gRNA sequence
gctctctggacaccccatcc

SEQ ID NO: 417658 - DNA, 20 bp, Artificial
  CRISPR gRNA sequence
tctctggacaccccatccca

SEQ ID NO: 417659 - DNA, 20 bp, Artificial
  CRISPR gRNA sequence
ctctggacaccccatcccag

SEQ ID NO: 417660 - DNA, 20 bp, Artificial
  CRISPR gRNA sequence
ctggacaccccatcccagag

SEQ ID NO: 417661 - DNA, 20 bp, Artificial
  CRISPR gRNA sequence
cccatcccagaggagtttct

SEQ ID NO: 417662 - DNA, 20 bp, Artificial
  CRISPR gRNA sequence
ccatcccagaggagtttctc

SEQ ID NO: 417663 - DNA, 20 bp, Artificial
  CRISPR gRNA sequence
agaggagtttctcaggacct

SEQ ID NO: 417664 - DNA, 20 bp, Artificial
  CRISPR gRNA sequence
gagtttctcaggaccttggc

SEQ ID NO: 417665 - DNA, 20 bp, Artificial
  CRISPR gRNA sequence
gtttctcaggaccttggctg

SEQ ID NO: 417666 - DNA, 20 bp, Artificial
  CRISPR gRNA sequence
tttctcaggaccttggctgg

SEQ ID NO: 417667 - DNA, 20 bp, Artificial
  CRISPR gRNA sequence
caggaccttggctggaggca

SEQ ID NO: 417668 - DNA, 20 bp, Artificial
  CRISPR gRNA sequence
aggaccttggctggaggcac

SEQ ID NO: 417669 - DNA, 20 bp, Artificial
  CRISPR gRNA sequence
gaccttggctggaggcacag

SEQ ID NO: 417670 - DNA, 20 bp, Artificial
  CRISPR gRNA sequence
accttggctggaggcacagg

SEQ ID NO: 417671 - DNA, 20 bp, Artificial
  CRISPR gRNA sequence
ggctggaggcacaggaggcc

SEQ ID NO: 417672 - DNA, 20 bp, Artificial
  CRISPR gRNA sequence
aggaggcccagctcctttcc

SEQ ID NO: 417673 - DNA, 20 bp, Artificial
  CRISPR gRNA sequence
cccagctcctttcccagcct

SEQ ID NO: 417674 - DNA, 20 bp, Artificial
  CRISPR gRNA sequence
tttcccagccttggcaatgc

SEQ ID NO: 417675 - DNA, 20 bp, Artificial
  CRISPR gRNA sequence
cttggcaatgccagctgtac

SEQ ID NO: 417676 - DNA, 20 bp, Artificial
  CRISPR gRNA sequence
ttggcaatgccagctgtacc

SEQ ID NO: 417677 - DNA, 20 bp, Artificial
  CRISPR gRNA sequence
tggcaatgccagctgtacca

SEQ ID NO: 417678 - DNA, 20 bp, Artificial
  CRISPR gRNA sequence
ggcaatgccagctgtaccag

SEQ ID NO: 417679 - DNA, 20 bp, Artificial
  CRISPR gRNA sequence
gcaatgccagctgtaccagg

SEQ ID NO: 417680 - DNA, 20 bp, Artificial
  CRISPR gRNA sequence
aatgccagctgtaccagggg

SEQ ID NO: 417681 - DNA, 20 bp, Artificial
  CRISPR gRNA sequence
tgccagctgtaccaggggga

SEQ ID NO: 417682 - DNA, 20 bp, Artificial
  CRISPR gRNA sequence
gccagctgtaccagggggag

SEQ ID NO: 417683 - DNA, 20 bp, Artificial
  CRISPR gRNA sequence
taccagggggagaggcttct

SEQ ID NO: 417684 - DNA, 20 bp, Artificial
  CRISPR gRNA sequence
ccagggggagaggcttcttg

SEQ ID NO: 417685 - DNA, 20 bp, Artificial
  CRISPR gRNA sequence
gggggagaggcttcttggag

SEQ ID NO: 417686 - DNA, 20 bp, Artificial
  CRISPR gRNA sequence
ggagaggcttcttggagcag

SEQ ID NO: 417687 - DNA, 20 bp, Artificial
  CRISPR gRNA sequence
tggagcagcagtgtacttca

SEQ ID NO: 417688 - DNA, 20 bp, Artificial
  CRISPR gRNA sequence
gagcagcagtgtacttcaca

SEQ ID NO: 417689 - DNA, 20 bp, Artificial
  CRISPR gRNA sequence
gtgtacttcacagagctgtc

SEQ ID NO: 417690 - DNA, 20 bp, Artificial
  CRISPR gRNA sequence
cttcacagagctgtctagcc

SEQ ID NO: 417691 - DNA, 20 bp, Artificial
  CRISPR gRNA sequence
ttcacagagctgtctagccc

SEQ ID NO: 417692 - DNA, 20 bp, Artificial
  CRISPR gRNA sequence
gagctgtctagcccaggtcc

SEQ ID NO: 417693 - DNA, 20 bp, Artificial
  CRISPR gRNA sequence
agctgtctagcccaggtccg

SEQ ID NO: 417694 - DNA, 20 bp, Artificial
  CRISPR gRNA sequence
ctagcccaggtccgaggccc

SEQ ID NO: 417695 - DNA, 20 bp, Artificial
  CRISPR gRNA sequence
ggtccgaggccccagaatgc

SEQ ID NO: 417696 - DNA, 20 bp, Artificial
  CRISPR gRNA sequence
gtccgaggccccagaatgcc

SEQ ID NO: 417697 - DNA, 20 bp, Artificial
  CRISPR gRNA sequence
atgccaggacccaaacgcca

SEQ ID NO: 417698 - DNA, 20 bp, Artificial
  CRISPR gRNA sequence
aataatctttatcctccttc

SEQ ID NO: 417699 - DNA, 20 bp, Artificial
  CRISPR gRNA sequence
tctttatcctccttccagaa

SEQ ID NO: 417700 - DNA, 20 bp, Artificial
  CRISPR gRNA sequence
agcccctgccacccccatcc

SEQ ID NO: 417701 - DNA, 20 bp, Artificial
  CRISPR gRNA sequence
catcccagcgcttttctttc

SEQ ID NO: 417702 - DNA, 20 bp, Artificial
  CRISPR gRNA sequence
ccagcgcttttctttccagt

SEQ ID NO: 417703 - DNA, 20 bp, Artificial
  CRISPR gRNA sequence
cagcgcttttctttccagtc

SEQ ID NO: 417704 - DNA, 20 bp, Artificial
  CRISPR gRNA sequence
agcgcttttctttccagtca

SEQ ID NO: 417705 - DNA, 20 bp, Artificial
  CRISPR gRNA sequence
ccagtcagggacctgatctc

SEQ ID NO: 417706 - DNA, 20 bp, Artificial
  CRISPR gRNA sequence
cctgatctctggcttttgcc

SEQ ID NO: 417707 - DNA, 20 bp, Artificial
  CRISPR gRNA sequence
ctgatctctggcttttgcct

SEQ ID NO: 417708 - DNA, 20 bp, Artificial
  CRISPR gRNA sequence
tgatctctggcttttgccta

SEQ ID NO: 417709 - DNA, 20 bp, Artificial
  CRISPR gRNA sequence
gacccgtttccgccactgat

SEQ ID NO: 417710 - DNA, 20 bp, Artificial
  CRISPR gRNA sequence
actgatcagctgaatgaccc

SEQ ID NO: 417711 - DNA, 20 bp, Artificial
  CRISPR gRNA sequence
ctgatcagctgaatgaccct

SEQ ID NO: 417712 - DNA, 20 bp, Artificial
  CRISPR gRNA sequence
cagctgaatgaccctgggac

SEQ ID NO: 417713 - DNA, 20 bp, Artificial
  CRISPR gRNA sequence
gacaagtcccttaaactctc

SEQ ID NO: 417714 - DNA, 20 bp, Artificial
  CRISPR gRNA sequence
tggatctcattgcatctgta

SEQ ID NO: 417715 - DNA, 20 bp, Artificial
  CRISPR gRNA sequence
tcattgcatctgtaaagtct

SEQ ID NO: 417716 - DNA, 20 bp, Artificial
  CRISPR gRNA sequence
attgcatctgtaaagtctga

SEQ ID NO: 417717 - DNA, 20 bp, Artificial
  CRISPR gRNA sequence
taaagtctgagagaatgaca

SEQ ID NO: 417718 - DNA, 20 bp, Artificial
  CRISPR gRNA sequence
gaatgacaaagtgtcctttc

SEQ ID NO: 417719 - DNA, 20 bp, Artificial
  CRISPR gRNA sequence
ctcatcctgtactttctcca

SEQ ID NO: 417720 - DNA, 20 bp, Artificial
  CRISPR gRNA sequence
tcatcctgtactttctccat

SEQ ID NO: 417721 - DNA, 20 bp, Artificial
  CRISPR gRNA sequence
tccataggtgcccaacgctc

SEQ ID NO: 417722 - DNA, 20 bp, Artificial
  CRISPR gRNA sequence
ccataggtgcccaacgctct

SEQ ID NO: 417723 - DNA, 20 bp, Artificial
  CRISPR gRNA sequence
ataggtgcccaacgctctgg

SEQ ID NO: 417724 - DNA, 20 bp, Artificial
  CRISPR gRNA sequence
aggtgcccaacgctctggga

SEQ ID NO: 417725 - DNA, 20 bp, Artificial
  CRISPR gRNA sequence
ccaacgctctgggagagccc

SEQ ID NO: 417726 - DNA, 20 bp, Artificial
  CRISPR gRNA sequence
caacgctctgggagagcccc

SEQ ID NO: 417727 - DNA, 20 bp, Artificial
  CRISPR gRNA sequence
gagagccccaggtgccctcc

SEQ ID NO: 417728 - DNA, 20 bp, Artificial
  CRISPR gRNA sequence
agccccaggtgccctcccag

SEQ ID NO: 417729 - DNA, 20 bp, Artificial
  CRISPR gRNA sequence
gccccaggtgccctcccagc

SEQ ID NO: 417730 - DNA, 20 bp, Artificial
  CRISPR gRNA sequence
ctcctgctgtttctcatcct

SEQ ID NO: 417731 - DNA, 20 bp, Artificial
  CRISPR gRNA sequence
tgtcctttctctgctccttt

SEQ ID NO: 417732 - DNA, 20 bp, Artificial
  CRISPR gRNA sequence
tctctgctccttttggtgac

SEQ ID NO: 417733 - DNA, 20 bp, Artificial
  CRISPR gRNA sequence
tctgctccttttggtgactg

SEQ ID NO: 417734 - DNA, 20 bp, Artificial
  CRISPR gRNA sequence
cttttggtgactggagcctt

SEQ ID NO: 417735 - DNA, 20 bp, Artificial
  CRISPR gRNA sequence
gagcctttggctttcacctt

SEQ ID NO: 417736 - DNA, 20 bp, Artificial
  CRISPR gRNA sequence
gcctttggctttcacctttg

SEQ ID NO: 417737 - DNA, 20 bp, Artificial
  CRISPR gRNA sequence
tttggctttcacctttggag

SEQ ID NO: 417738 - DNA, 20 bp, Artificial
  CRISPR gRNA sequence
gctttcacctttggagaaga

SEQ ID NO: 417739 - DNA, 20 bp, Artificial
  CRISPR gRNA sequence
ctttcacctttggagaagac

SEQ ID NO: 417740 - DNA, 20 bp, Artificial
  CRISPR gRNA sequence
cacctttggagaagacaggt

SEQ ID NO: 417741 - DNA, 20 bp, Artificial
  CRISPR gRNA sequence
tttggagaagacaggtgagc

SEQ ID NO: 417742 - DNA, 20 bp, Artificial
  CRISPR gRNA sequence
ttggagaagacaggtgagcc

SEQ ID NO: 417743 - DNA, 20 bp, Artificial
  CRISPR gRNA sequence
tggagaagacaggtgagcca

SEQ ID NO: 417744 - DNA, 20 bp, Artificial
  CRISPR gRNA sequence
agacaggtgagccagggaca

SEQ ID NO: 417745 - DNA, 20 bp, Artificial
  CRISPR gRNA sequence
gacatggcaaccccgccccc

SEQ ID NO: 417746 - DNA, 20 bp, Artificial
  CRISPR gRNA sequence
atggcaaccccgccccccag

SEQ ID NO: 417747 - DNA, 20 bp, Artificial
  CRISPR gRNA sequence
agctcccgctcttccatcct

SEQ ID NO: 417748 - DNA, 20 bp, Artificial
  CRISPR gRNA sequence
ctcccgctcttccatcctca

SEQ ID NO: 417749 - DNA, 20 bp, Artificial
  CRISPR gRNA sequence
ttccatcctcagagtgctga

SEQ ID NO: 417750 - DNA, 20 bp, Artificial
  CRISPR gRNA sequence
tgctgatggcaccccttcct

SEQ ID NO: 417751 - DNA, 20 bp, Artificial
  CRISPR gRNA sequence
gctgatggcaccccttcctc

SEQ ID NO: 417752 - DNA, 20 bp, Artificial
  CRISPR gRNA sequence
gatggcaccccttcctcagg

SEQ ID NO: 417753 - DNA, 20 bp, Artificial
  CRISPR gRNA sequence
atggcaccccttcctcagga

SEQ ID NO: 417754 - DNA, 20 bp, Artificial
  CRISPR gRNA sequence
tcctcaggaaggtgaccaaa

SEQ ID NO: 417755 - DNA, 20 bp, Artificial
  CRISPR gRNA sequence
cctcaggaaggtgaccaaat

SEQ ID NO: 417756 - DNA, 20 bp, Artificial
  CRISPR gRNA sequence
tgggaccctgaacttgccct

SEQ ID NO: 417757 - DNA, 20 bp, Artificial
  CRISPR gRNA sequence
ggaccctgaacttgccctca

SEQ ID NO: 417758 - DNA, 20 bp, Artificial
  CRISPR gRNA sequence
tcagagccccccttcttcat

SEQ ID NO: 417759 - DNA, 20 bp, Artificial
  CRISPR gRNA sequence
tcttcataagcctctcactc

SEQ ID NO: 417760 - DNA, 20 bp, Artificial
  CRISPR gRNA sequence
cttcataagcctctcactcc

SEQ ID NO: 417761 - DNA, 20 bp, Artificial
  CRISPR gRNA sequence
ttcataagcctctcactcca

SEQ ID NO: 417762 - DNA, 20 bp, Artificial
  CRISPR gRNA sequence
taagcctctcactccaggga

SEQ ID NO: 417763 - DNA, 20 bp, Artificial
  CRISPR gRNA sequence
ctccagggatggcttgtgcc

SEQ ID NO: 417764 - DNA, 20 bp, Artificial
  CRISPR gRNA sequence
tccagggatggcttgtgcct

SEQ ID NO: 417765 - DNA, 20 bp, Artificial
  CRISPR gRNA sequence
agggatggcttgtgcctggg

SEQ ID NO: 417766 - DNA, 20 bp, Artificial
  CRISPR gRNA sequence
gggatggcttgtgcctgggt

SEQ ID NO: 417767 - DNA, 20 bp, Artificial
  CRISPR gRNA sequence
tggcttgtgcctgggtaggc

SEQ ID NO: 417768 - DNA, 20 bp, Artificial
  CRISPR gRNA sequence
cttgtgcctgggtaggctgg

SEQ ID NO: 417769 - DNA, 20 bp, Artificial
  CRISPR gRNA sequence
ttgtgcctgggtaggctgga

SEQ ID NO: 417770 - DNA, 20 bp, Artificial
  CRISPR gRNA sequence
tgtgcctgggtaggctggaa

SEQ ID NO: 417771 - DNA, 20 bp, Artificial
  CRISPR gRNA sequence
gtgcctgggtaggctggaag

SEQ ID NO: 417772 - DNA, 20 bp, Artificial
  CRISPR gRNA sequence
tgcctgggtaggctggaagg

SEQ ID NO: 417773 - DNA, 20 bp, Artificial
  CRISPR gRNA sequence
gcctgggtaggctggaaggg

SEQ ID NO: 417774 - DNA, 20 bp, Artificial
  CRISPR gRNA sequence
gggtaggctggaaggggggt

SEQ ID NO: 417775 - DNA, 20 bp, Artificial
  CRISPR gRNA sequence
ggtaggctggaaggggggtt

SEQ ID NO: 417776 - DNA, 20 bp, Artificial
  CRISPR gRNA sequence
taggctggaaggggggttgg

SEQ ID NO: 417777 - DNA, 20 bp, Artificial
  CRISPR gRNA sequence
ctggaaggggggttgggaga

SEQ ID NO: 417778 - DNA, 20 bp, Artificial
  CRISPR gRNA sequence
aaggggggttgggagaaagc

SEQ ID NO: 417779 - DNA, 20 bp, Artificial
  CRISPR gRNA sequence
aggggggttgggagaaagcc

SEQ ID NO: 417780 - DNA, 20 bp, Artificial
  CRISPR gRNA sequence
ggttgggagaaagccaggac

SEQ ID NO: 417781 - DNA, 20 bp, Artificial
  CRISPR gRNA sequence
gggagaaagccaggaccaga

SEQ ID NO: 417782 - DNA, 20 bp, Artificial
  CRISPR gRNA sequence
ggagaaagccaggaccagat

SEQ ID NO: 417783 - DNA, 20 bp, Artificial
  CRISPR gRNA sequence
gagaaagccaggaccagatg

SEQ ID NO: 417784 - DNA, 20 bp, Artificial
  CRISPR gRNA sequence
gaaagccaggaccagatggg

SEQ ID NO: 417785 - DNA, 20 bp, Artificial
  CRISPR gRNA sequence
aaagccaggaccagatgggg

SEQ ID NO: 417786 - DNA, 20 bp, Artificial
  CRISPR gRNA sequence
aagccaggaccagatgggga

SEQ ID NO: 417787 - DNA, 20 bp, Artificial
  CRISPR gRNA sequence
ccaggaccagatggggaggg

SEQ ID NO: 417788 - DNA, 20 bp, Artificial
  CRISPR gRNA sequence
caggaccagatggggagggc

SEQ ID NO: 417789 - DNA, 20 bp, Artificial
  CRISPR gRNA sequence
aggaccagatggggagggca

SEQ ID NO: 417790 - DNA, 20 bp, Artificial
  CRISPR gRNA sequence
ggaccagatggggagggcag

SEQ ID NO: 417791 - DNA, 20 bp, Artificial
  CRISPR gRNA sequence
atggggagggcaggggcgct

SEQ ID NO: 417792 - DNA, 20 bp, Artificial
  CRISPR gRNA sequence
gcaggggcgctgagaaaaaa

SEQ ID NO: 417793 - DNA, 20 bp, Artificial
  CRISPR gRNA sequence
aggggcgctgagaaaaaata

SEQ ID NO: 417794 - DNA, 20 bp, Artificial
  CRISPR gRNA sequence
ggggcgctgagaaaaaatag

SEQ ID NO: 417795 - DNA, 20 bp, Artificial
  CRISPR gRNA sequence
gggcgctgagaaaaaataga

SEQ ID NO: 417796 - DNA, 20 bp, Artificial
  CRISPR gRNA sequence
tgagaaaaaatagagggact

SEQ ID NO: 417797 - DNA, 20 bp, Artificial
  CRISPR gRNA sequence
tctctctccatctcttctca

SEQ ID NO: 417798 - DNA, 20 bp, Artificial
  CRISPR gRNA sequence
ctctccatctcttctcacag

SEQ ID NO: 417799 - DNA, 20 bp, Artificial
  CRISPR gRNA sequence
ctcttctcacagtggcgacc

SEQ ID NO: 417800 - DNA, 20 bp, Artificial
  CRISPR gRNA sequence
accaagacgattttctgcct

SEQ ID NO: 417801 - DNA, 20 bp, Artificial
  CRISPR gRNA sequence
caagacgattttctgcctta

SEQ ID NO: 417802 - DNA, 20 bp, Artificial
  CRISPR gRNA sequence
acgattttctgccttagagc

SEQ ID NO: 417803 - DNA, 20 bp, Artificial
  CRISPR gRNA sequence
cgattttctgccttagagca

SEQ ID NO: 417804 - DNA, 20 bp, Artificial
  CRISPR gRNA sequence
gattttctgccttagagcaa

SEQ ID NO: 417805 - DNA, 20 bp, Artificial
  CRISPR gRNA sequence
agcaagggattcaccctccg

SEQ ID NO: 417806 - DNA, 20 bp, Artificial
  CRISPR gRNA sequence
gcaagggattcaccctccgc

SEQ ID NO: 417807 - DNA, 20 bp, Artificial
  CRISPR gRNA sequence
ggattcaccctccgcaggct

SEQ ID NO: 417808 - DNA, 20 bp, Artificial
  CRISPR gRNA sequence
attcaccctccgcaggctca

SEQ ID NO: 417809 - DNA, 20 bp, Artificial
  CRISPR gRNA sequence
accctccgcaggctcagagc

SEQ ID NO: 417810 - DNA, 20 bp, Artificial
  CRISPR gRNA sequence
tccgcaggctcagagcaaga

SEQ ID NO: 417811 - DNA, 20 bp, Artificial
  CRISPR gRNA sequence
cgcaggctcagagcaagata

SEQ ID NO: 417812 - DNA, 20 bp, Artificial
  CRISPR gRNA sequence
gcaggctcagagcaagatag

SEQ ID NO: 417813 - DNA, 20 bp, Artificial
  CRISPR gRNA sequence
aggctcagagcaagatagag

SEQ ID NO: 417814 - DNA, 20 bp, Artificial
  CRISPR gRNA sequence
tcagagcaagatagaggagc

SEQ ID NO: 417815 - DNA, 20 bp, Artificial
  CRISPR gRNA sequence
agagcaagatagaggagctg

SEQ ID NO: 417816 - DNA, 20 bp, Artificial
  CRISPR gRNA sequence
caagatagaggagctggagc

SEQ ID NO: 417817 - DNA, 20 bp, Artificial
  CRISPR gRNA sequence
agaggagctggagcaagaac

SEQ ID NO: 417818 - DNA, 20 bp, Artificial
  CRISPR gRNA sequence
aggagctggagcaagaaccg

SEQ ID NO: 417819 - DNA, 20 bp, Artificial
  CRISPR gRNA sequence
gctggagcaagaaccggagc

SEQ ID NO: 417820 - DNA, 20 bp, Artificial
  CRISPR gRNA sequence
tggagcaagaaccggagccg

SEQ ID NO: 417821 - DNA, 20 bp, Artificial
  CRISPR gRNA sequence
gcaagaaccggagccggagc

SEQ ID NO: 417822 - DNA, 20 bp, Artificial
  CRISPR gRNA sequence
aagaaccggagccggagccg

SEQ ID NO: 417823 - DNA, 20 bp, Artificial
  CRISPR gRNA sequence
accggagccggagccggagc

SEQ ID NO: 417824 - DNA, 20 bp, Artificial
  CRISPR gRNA sequence
gccggagccggagccggaac

SEQ ID NO: 417825 - DNA, 20 bp, Artificial
  CRISPR gRNA sequence
cggagccggagccggaaccg

SEQ ID NO: 417826 - DNA, 20 bp, Artificial
  CRISPR gRNA sequence
cggagccggaaccggagccc

SEQ ID NO: 417827 - DNA, 20 bp, Artificial
  CRISPR gRNA sequence
cggaaccggagcccgagccc

SEQ ID NO: 417828 - DNA, 20 bp, Artificial
  CRISPR gRNA sequence
cggagcccgagcccgagccc

SEQ ID NO: 417829 - DNA, 20 bp, Artificial
  CRISPR gRNA sequence
gcccgagcccgagcccgagc

SEQ ID NO: 417830 - DNA, 20 bp, Artificial
  CRISPR gRNA sequence
ccgagcccgagcccgagccg

SEQ ID NO: 417831 - DNA, 20 bp, Artificial
  CRISPR gRNA sequence
agcccgagcccgagccggag

SEQ ID NO: 417832 - DNA, 20 bp, Artificial
  CRISPR gRNA sequence
gagccggagcagctctgacc

SEQ ID NO: 417833 - DNA, 20 bp, Artificial
  CRISPR gRNA sequence
gccggagcagctctgacctg

SEQ ID NO: 417834 - DNA, 20 bp, Artificial
  CRISPR gRNA sequence
agcagctctgacctggagct

SEQ ID NO: 417835 - DNA, 20 bp, Artificial
  CRISPR gRNA sequence
gcagctctgacctggagctg

SEQ ID NO: 417836 - DNA, 20 bp, Artificial
  CRISPR gRNA sequence
gctctgacctggagctgagg

SEQ ID NO: 417837 - DNA, 20 bp, Artificial
  CRISPR gRNA sequence
tgacctggagctgaggcagc

SEQ ID NO: 417838 - DNA, 20 bp, Artificial
  CRISPR gRNA sequence
cctggagctgaggcagccag

SEQ ID NO: 417839 - DNA, 20 bp, Artificial
  CRISPR gRNA sequence
ctgaggcagccagcagatct

SEQ ID NO: 417840 - DNA, 20 bp, Artificial
  CRISPR gRNA sequence
aggcagccagcagatctcag

SEQ ID NO: 417841 - DNA, 20 bp, Artificial
  CRISPR gRNA sequence
gccagcagatctcagcagcc

SEQ ID NO: 417842 - DNA, 20 bp, Artificial
  CRISPR gRNA sequence
agtccaaataaactccctgt

SEQ ID NO: 417843 - DNA, 20 bp, Artificial
  CRISPR gRNA sequence
ccaaataaactccctgtcag

SEQ ID NO: 417844 - DNA, 20 bp, Artificial
  CRISPR gRNA sequence
ataaactccctgtcagcagc

SEQ ID NO: 417845 - DNA, 20 bp, Artificial
  CRISPR gRNA sequence
tccctgtcagcagcaagcct

SEQ ID NO: 417846 - DNA, 20 bp, Artificial
  CRISPR gRNA sequence
gtcagcagcaagcctgagtc

SEQ ID NO: 417847 - DNA, 20 bp, Artificial
  CRISPR gRNA sequence
agtctggctctttcttgtcc

SEQ ID NO: 417848 - DNA, 20 bp, Artificial
  CRISPR gRNA sequence
ggctctttcttgtccaagtg

SEQ ID NO: 417849 - DNA, 20 bp, Artificial
  CRISPR gRNA sequence
gctctttcttgtccaagtga

SEQ ID NO: 417850 - DNA, 20 bp, Artificial
  CRISPR gRNA sequence
tgaaggttcccgtctctccc

SEQ ID NO: 417851 - DNA, 20 bp, Artificial
  CRISPR gRNA sequence
cccgtctctccccagcctct

SEQ ID NO: 417852 - DNA, 20 bp, Artificial
  CRISPR gRNA sequence
ccgtctctccccagcctctg

SEQ ID NO: 417853 - DNA, 20 bp, Artificial
  CRISPR gRNA sequence
cgtctctccccagcctctga

SEQ ID NO: 417854 - DNA, 20 bp, Artificial
  CRISPR gRNA sequence
agggctcccttctcccaccc

SEQ ID NO: 417855 - DNA, 20 bp, Artificial
  CRISPR gRNA sequence
gggaaagtaggttaggaggc

SEQ ID NO: 417856 - DNA, 20 bp, Artificial
  CRISPR gRNA sequence
ggaaagtaggttaggaggct

SEQ ID NO: 417857 - DNA, 20 bp, Artificial
  CRISPR gRNA sequence
gaaagtaggttaggaggcta

SEQ ID NO: 417858 - DNA, 20 bp, Artificial
  CRISPR gRNA sequence
agtaggttaggaggctaggg

SEQ ID NO: 417859 - DNA, 20 bp, Artificial
  CRISPR gRNA sequence
gtaggttaggaggctagggt

SEQ ID NO: 417860 - DNA, 20 bp, Artificial
  CRISPR gRNA sequence
aggttaggaggctagggtgg

SEQ ID NO: 417861 - DNA, 20 bp, Artificial
  CRISPR gRNA sequence
ttaggaggctagggtgggag

SEQ ID NO: 417862 - DNA, 20 bp, Artificial
  CRISPR gRNA sequence
taggaggctagggtgggaga

SEQ ID NO: 417863 - DNA, 20 bp, Artificial
  CRISPR gRNA sequence
aggaggctagggtgggagaa

SEQ ID NO: 417864 - DNA, 20 bp, Artificial
  CRISPR gRNA sequence
gaggctagggtgggagaagg

SEQ ID NO: 417865 - DNA, 20 bp, Artificial
  CRISPR gRNA sequence
gggtgggagaagggagccct

SEQ ID NO: 417866 - DNA, 20 bp, Artificial
  CRISPR gRNA sequence
gtgggagaagggagccctca

SEQ ID NO: 417867 - DNA, 20 bp, Artificial
  CRISPR gRNA sequence
tgggagaagggagccctcag

SEQ ID NO: 417868 - DNA, 20 bp, Artificial
  CRISPR gRNA sequence
agaagggagccctcagaggc

SEQ ID NO: 417869 - DNA, 20 bp, Artificial
  CRISPR gRNA sequence
gaagggagccctcagaggct

SEQ ID NO: 417870 - DNA, 20 bp, Artificial
  CRISPR gRNA sequence
aagggagccctcagaggctg

SEQ ID NO: 417871 - DNA, 20 bp, Artificial
  CRISPR gRNA sequence
gggagccctcagaggctggg

SEQ ID NO: 417872 - DNA, 20 bp, Artificial
  CRISPR gRNA sequence
gagccctcagaggctgggga

SEQ ID NO: 417873 - DNA, 20 bp, Artificial
  CRISPR gRNA sequence
cctcagaggctggggagaga

SEQ ID NO: 417874 - DNA, 20 bp, Artificial
  CRISPR gRNA sequence
ctcagaggctggggagagac

SEQ ID NO: 417875 - DNA, 20 bp, Artificial
  CRISPR gRNA sequence
gagagacgggaaccttcact

SEQ ID NO: 417876 - DNA, 20 bp, Artificial
  CRISPR gRNA sequence
acgggaaccttcacttggac

SEQ ID NO: 417877 - DNA, 20 bp, Artificial
  CRISPR gRNA sequence
gaaccttcacttggacaaga

SEQ ID NO: 417878 - DNA, 20 bp, Artificial
  CRISPR gRNA sequence
accttcacttggacaagaaa

SEQ ID NO: 417879 - DNA, 20 bp, Artificial
  CRISPR gRNA sequence
tcacttggacaagaaagagc

SEQ ID NO: 417880 - DNA, 20 bp, Artificial
  CRISPR gRNA sequence
ggacaagaaagagccagact

SEQ ID NO: 417881 - DNA, 20 bp, Artificial
  CRISPR gRNA sequence
gacaagaaagagccagactc

SEQ ID NO: 417882 - DNA, 20 bp, Artificial
  CRISPR gRNA sequence
agactcaggcttgctgctga

SEQ ID NO: 417883 - DNA, 20 bp, Artificial
  CRISPR gRNA sequence
gactcaggcttgctgctgac

SEQ ID NO: 417884 - DNA, 20 bp, Artificial
  CRISPR gRNA sequence
actcaggcttgctgctgaca

SEQ ID NO: 417885 - DNA, 20 bp, Artificial
  CRISPR gRNA sequence
tcaggcttgctgctgacagg

SEQ ID NO: 417886 - DNA, 20 bp, Artificial
  CRISPR gRNA sequence
ctgctgacagggagtttatt

SEQ ID NO: 417887 - DNA, 20 bp, Artificial
  CRISPR gRNA sequence
gacagggagtttatttggac

SEQ ID NO: 417888 - DNA, 20 bp, Artificial
  CRISPR gRNA sequence
acagggagtttatttggact

SEQ ID NO: 417889 - DNA, 20 bp, Artificial
  CRISPR gRNA sequence
tttatttggactgggctgct

SEQ ID NO: 417890 - DNA, 20 bp, Artificial
  CRISPR gRNA sequence
actgggctgctgagatctgc

SEQ ID NO: 417891 - DNA, 20 bp, Artificial
  CRISPR gRNA sequence
ctgagatctgctggctgcct

SEQ ID NO: 417892 - DNA, 20 bp, Artificial
  CRISPR gRNA sequence
tctgctggctgcctcagctc

SEQ ID NO: 417893 - DNA, 20 bp, Artificial
  CRISPR gRNA sequence
ctgctggctgcctcagctcc

SEQ ID NO: 417894 - DNA, 20 bp, Artificial
  CRISPR gRNA sequence
tggctgcctcagctccaggt

SEQ ID NO: 417895 - DNA, 20 bp, Artificial
  CRISPR gRNA sequence
gctgcctcagctccaggtca

SEQ ID NO: 417896 - DNA, 20 bp, Artificial
  CRISPR gRNA sequence
gctccaggtcagagctgctc

SEQ ID NO: 417897 - DNA, 20 bp, Artificial
  CRISPR gRNA sequence
aggtcagagctgctccggct

SEQ ID NO: 417898 - DNA, 20 bp, Artificial
  CRISPR gRNA sequence
ggtcagagctgctccggctc

SEQ ID NO: 417899 - DNA, 20 bp, Artificial
  CRISPR gRNA sequence
gagctgctccggctcgggct

SEQ ID NO: 417900 - DNA, 20 bp, Artificial
  CRISPR gRNA sequence
agctgctccggctcgggctc

SEQ ID NO: 417901 - DNA, 20 bp, Artificial
  CRISPR gRNA sequence
ctccggctcgggctcgggct

SEQ ID NO: 417902 - DNA, 20 bp, Artificial
  CRISPR gRNA sequence
tccggctcgggctcgggctc

SEQ ID NO: 417903 - DNA, 20 bp, Artificial
  CRISPR gRNA sequence
tcgggctcgggctcgggctc

SEQ ID NO: 417904 - DNA, 20 bp, Artificial
  CRISPR gRNA sequence
tcgggctcgggctccggttc

SEQ ID NO: 417905 - DNA, 20 bp, Artificial
  CRISPR gRNA sequence
tcgggctccggttccggctc

SEQ ID NO: 417906 - DNA, 20 bp, Artificial
  CRISPR gRNA sequence
tccggttccggctccggctc

SEQ ID NO: 417907 - DNA, 20 bp, Artificial
  CRISPR gRNA sequence
tccggctccggctccggctc

SEQ ID NO: 417908 - DNA, 20 bp, Artificial
  CRISPR gRNA sequence
tccggctccggttcttgctc

SEQ ID NO: 417909 - DNA, 20 bp, Artificial
  CRISPR gRNA sequence
cagctcctctatcttgctct

SEQ ID NO: 417910 - DNA, 20 bp, Artificial
  CRISPR gRNA sequence
tctatcttgctctgagcctg

SEQ ID NO: 417911 - DNA, 20 bp, Artificial
  CRISPR gRNA sequence
tatcttgctctgagcctgcg

SEQ ID NO: 417912 - DNA, 20 bp, Artificial
  CRISPR gRNA sequence
atcttgctctgagcctgcgg

SEQ ID NO: 417913 - DNA, 20 bp, Artificial
  CRISPR gRNA sequence
tcttgctctgagcctgcgga

SEQ ID NO: 417914 - DNA, 20 bp, Artificial
  CRISPR gRNA sequence
gagggtgaatcccttgctct

SEQ ID NO: 417915 - DNA, 20 bp, Artificial
  CRISPR gRNA sequence
agggtgaatcccttgctcta

SEQ ID NO: 417916 - DNA, 20 bp, Artificial
  CRISPR gRNA sequence
gtgaatcccttgctctaagg

SEQ ID NO: 417917 - DNA, 20 bp, Artificial
  CRISPR gRNA sequence
tctaaggcagaaaatcgtct

SEQ ID NO: 417918 - DNA, 20 bp, Artificial
  CRISPR gRNA sequence
atcgtcttggtcgccactgt

SEQ ID NO: 417919 - DNA, 20 bp, Artificial
  CRISPR gRNA sequence
gtcttggtcgccactgtgag

SEQ ID NO: 417920 - DNA, 20 bp, Artificial
  CRISPR gRNA sequence
cttggtcgccactgtgagaa

SEQ ID NO: 417921 - DNA, 20 bp, Artificial
  CRISPR gRNA sequence
gtcgccactgtgagaagaga

SEQ ID NO: 417922 - DNA, 20 bp, Artificial
  CRISPR gRNA sequence
cgccactgtgagaagagatg

SEQ ID NO: 417923 - DNA, 20 bp, Artificial
  CRISPR gRNA sequence
ccactgtgagaagagatgga

SEQ ID NO: 417924 - DNA, 20 bp, Artificial
  CRISPR gRNA sequence
actgtgagaagagatggaga

SEQ ID NO: 417925 - DNA, 20 bp, Artificial
  CRISPR gRNA sequence
tgtgagaagagatggagaga

SEQ ID NO: 417926 - DNA, 20 bp, Artificial
  CRISPR gRNA sequence
agaagagatggagagagaga

SEQ ID NO: 417927 - DNA, 20 bp, Artificial
  CRISPR gRNA sequence
aagagatggagagagagacg

SEQ ID NO: 417928 - DNA, 20 bp, Artificial
  CRISPR gRNA sequence
agagatggagagagagacgg

SEQ ID NO: 417929 - DNA, 20 bp, Artificial
  CRISPR gRNA sequence
gagatggagagagagacgga

SEQ ID NO: 417930 - DNA, 20 bp, Artificial
  CRISPR gRNA sequence
atggagagagagacggaggg

SEQ ID NO: 417931 - DNA, 20 bp, Artificial
  CRISPR gRNA sequence
gagagagagacggagggcgg

SEQ ID NO: 417932 - DNA, 20 bp, Artificial
  CRISPR gRNA sequence
agagagagacggagggcgga

SEQ ID NO: 417933 - DNA, 20 bp, Artificial
  CRISPR gRNA sequence
agagagacggagggcggaag

SEQ ID NO: 417934 - DNA, 20 bp, Artificial
  CRISPR gRNA sequence
gagagacggagggcggaagg

SEQ ID NO: 417935 - DNA, 20 bp, Artificial
  CRISPR gRNA sequence
gagacggagggcggaaggag

SEQ ID NO: 417936 - DNA, 20 bp, Artificial
  CRISPR gRNA sequence
acggagggcggaaggaggag

SEQ ID NO: 417937 - DNA, 20 bp, Artificial
  CRISPR gRNA sequence
cggagggcggaaggaggaga

SEQ ID NO: 417938 - DNA, 20 bp, Artificial
  CRISPR gRNA sequence
gcggaaggaggagaaggatg

SEQ ID NO: 417939 - DNA, 20 bp, Artificial
  CRISPR gRNA sequence
cggaaggaggagaaggatga

SEQ ID NO: 417940 - DNA, 20 bp, Artificial
  CRISPR gRNA sequence
ggaaggaggagaaggatgaa

SEQ ID NO: 417941 - DNA, 20 bp, Artificial
  CRISPR gRNA sequence
aggaggagaaggatgaaggg

SEQ ID NO: 417942 - DNA, 20 bp, Artificial
  CRISPR gRNA sequence
aggagaaggatgaagggaag

SEQ ID NO: 417943 - DNA, 20 bp, Artificial
  CRISPR gRNA sequence
aaggatgaagggaagcggat

SEQ ID NO: 417944 - DNA, 20 bp, Artificial
  CRISPR gRNA sequence
aggatgaagggaagcggatg

SEQ ID NO: 417945 - DNA, 20 bp, Artificial
  CRISPR gRNA sequence
gatgaagggaagcggatgag

SEQ ID NO: 417946 - DNA, 20 bp, Artificial
  CRISPR gRNA sequence
atgaagggaagcggatgagg

SEQ ID NO: 417947 - DNA, 20 bp, Artificial
  CRISPR gRNA sequence
tgaagggaagcggatgagga

SEQ ID NO: 417948 - DNA, 20 bp, Artificial
  CRISPR gRNA sequence
agcggatgaggagggacact

SEQ ID NO: 417949 - DNA, 20 bp, Artificial
  CRISPR gRNA sequence
tgagtccctctattttttct

SEQ ID NO: 417950 - DNA, 20 bp, Artificial
  CRISPR gRNA sequence
gcgcccctgccctccccatc

SEQ ID NO: 417951 - DNA, 20 bp, Artificial
  CRISPR gRNA sequence
ctgccctccccatctggtcc

SEQ ID NO: 417952 - DNA, 20 bp, Artificial
  CRISPR gRNA sequence
ctttctcccaaccccccttc

SEQ ID NO: 417953 - DNA, 20 bp, Artificial
  CRISPR gRNA sequence
aaccccccttccagcctacc

SEQ ID NO: 417954 - DNA, 20 bp, Artificial
  CRISPR gRNA sequence
accccccttccagcctaccc

SEQ ID NO: 417955 - DNA, 20 bp, Artificial
  CRISPR gRNA sequence
cttccagcctacccaggcac

SEQ ID NO: 417956 - DNA, 20 bp, Artificial
  CRISPR gRNA sequence
acccaggcacaagccatccc

SEQ ID NO: 417957 - DNA, 20 bp, Artificial
  CRISPR gRNA sequence
ccaggcacaagccatccctg

SEQ ID NO: 417958 - DNA, 20 bp, Artificial
  CRISPR gRNA sequence
gcacaagccatccctggagt

SEQ ID NO: 417959 - DNA, 20 bp, Artificial
  CRISPR gRNA sequence
acaagccatccctggagtga

SEQ ID NO: 417960 - DNA, 20 bp, Artificial
  CRISPR gRNA sequence
caagccatccctggagtgag

SEQ ID NO: 417961 - DNA, 20 bp, Artificial
  CRISPR gRNA sequence
cctggagtgagaggcttatg

SEQ ID NO: 417962 - DNA, 20 bp, Artificial
  CRISPR gRNA sequence
ggagtgagaggcttatgaag

SEQ ID NO: 417963 - DNA, 20 bp, Artificial
  CRISPR gRNA sequence
gagtgagaggcttatgaaga

SEQ ID NO: 417964 - DNA, 20 bp, Artificial
  CRISPR gRNA sequence
agtgagaggcttatgaagaa

SEQ ID NO: 417965 - DNA, 20 bp, Artificial
  CRISPR gRNA sequence
gtgagaggcttatgaagaag

SEQ ID NO: 417966 - DNA, 20 bp, Artificial
  CRISPR gRNA sequence
tgagaggcttatgaagaagg

SEQ ID NO: 417967 - DNA, 20 bp, Artificial
  CRISPR gRNA sequence
gagaggcttatgaagaaggg

SEQ ID NO: 417968 - DNA, 20 bp, Artificial
  CRISPR gRNA sequence
ttatgaagaaggggggctct

SEQ ID NO: 417969 - DNA, 20 bp, Artificial
  CRISPR gRNA sequence
tatgaagaaggggggctctg

SEQ ID NO: 417970 - DNA, 20 bp, Artificial
  CRISPR gRNA sequence
atgaagaaggggggctctga

SEQ ID NO: 417971 - DNA, 20 bp, Artificial
  CRISPR gRNA sequence
agaaggggggctctgagggc

SEQ ID NO: 417972 - DNA, 20 bp, Artificial
  CRISPR gRNA sequence
gggggctctgagggcaagtt

SEQ ID NO: 417973 - DNA, 20 bp, Artificial
  CRISPR gRNA sequence
ggggctctgagggcaagttc

SEQ ID NO: 417974 - DNA, 20 bp, Artificial
  CRISPR gRNA sequence
gggctctgagggcaagttca

SEQ ID NO: 417975 - DNA, 20 bp, Artificial
  CRISPR gRNA sequence
ggcaagttcagggtcccatt

SEQ ID NO: 417976 - DNA, 20 bp, Artificial
  CRISPR gRNA sequence
tcccatttggtcaccttcct

SEQ ID NO: 417977 - DNA, 20 bp, Artificial
  CRISPR gRNA sequence
cccatttggtcaccttcctg

SEQ ID NO: 417978 - DNA, 20 bp, Artificial
  CRISPR gRNA sequence
atttggtcaccttcctgagg

SEQ ID NO: 417979 - DNA, 20 bp, Artificial
  CRISPR gRNA sequence
tttggtcaccttcctgagga

SEQ ID NO: 417980 - DNA, 20 bp, Artificial
  CRISPR gRNA sequence
ttggtcaccttcctgaggaa

SEQ ID NO: 417981 - DNA, 20 bp, Artificial
  CRISPR gRNA sequence
tggtcaccttcctgaggaag

SEQ ID NO: 417982 - DNA, 20 bp, Artificial
  CRISPR gRNA sequence
tcctgaggaaggggtgccat

SEQ ID NO: 417983 - DNA, 20 bp, Artificial
  CRISPR gRNA sequence
aggggtgccatcagcactct

SEQ ID NO: 417984 - DNA, 20 bp, Artificial
  CRISPR gRNA sequence
ggggtgccatcagcactctg

SEQ ID NO: 417985 - DNA, 20 bp, Artificial
  CRISPR gRNA sequence
tgccatcagcactctgagga

SEQ ID NO: 417986 - DNA, 20 bp, Artificial
  CRISPR gRNA sequence
catcagcactctgaggatgg

SEQ ID NO: 417987 - DNA, 20 bp, Artificial
  CRISPR gRNA sequence
tcagcactctgaggatggaa

SEQ ID NO: 417988 - DNA, 20 bp, Artificial
  CRISPR gRNA sequence
gcactctgaggatggaagag

SEQ ID NO: 417989 - DNA, 20 bp, Artificial
  CRISPR gRNA sequence
cactctgaggatggaagagc

SEQ ID NO: 417990 - DNA, 20 bp, Artificial
  CRISPR gRNA sequence
ctctgaggatggaagagcgg

SEQ ID NO: 417991 - DNA, 20 bp, Artificial
  CRISPR gRNA sequence
gatggaagagcgggagctgc

SEQ ID NO: 417992 - DNA, 20 bp, Artificial
  CRISPR gRNA sequence
atggaagagcgggagctgct

SEQ ID NO: 417993 - DNA, 20 bp, Artificial
  CRISPR gRNA sequence
tggaagagcgggagctgctg

SEQ ID NO: 417994 - DNA, 20 bp, Artificial
  CRISPR gRNA sequence
ggaagagcgggagctgctgg

SEQ ID NO: 417995 - DNA, 20 bp, Artificial
  CRISPR gRNA sequence
gaagagcgggagctgctggg

SEQ ID NO: 417996 - DNA, 20 bp, Artificial
  CRISPR gRNA sequence
gagcgggagctgctgggggg

SEQ ID NO: 417997 - DNA, 20 bp, Artificial
  CRISPR gRNA sequence
agcgggagctgctggggggc

SEQ ID NO: 417998 - DNA, 20 bp, Artificial
  CRISPR gRNA sequence
gcgggagctgctggggggcg

SEQ ID NO: 417999 - DNA, 20 bp, Artificial
  CRISPR gRNA sequence
gggcggggttgccatgtccc

SEQ ID NO: 418000 - DNA, 20 bp, Artificial
  CRISPR gRNA sequence
tggctcacctgtcttctcca

SEQ ID NO: 418001 - DNA, 20 bp, Artificial
  CRISPR gRNA sequence
ggctcacctgtcttctccaa

SEQ ID NO: 418002 - DNA, 20 bp, Artificial
  CRISPR gRNA sequence
cctgtcttctccaaaggtga

SEQ ID NO: 418003 - DNA, 20 bp, Artificial
  CRISPR gRNA sequence
ttctccaaaggtgaaagcca

SEQ ID NO: 418004 - DNA, 20 bp, Artificial
  CRISPR gRNA sequence
tctccaaaggtgaaagccaa

SEQ ID NO: 418005 - DNA, 20 bp, Artificial
  CRISPR gRNA sequence
aaggtgaaagccaaaggctc

SEQ ID NO: 418006 - DNA, 20 bp, Artificial
  CRISPR gRNA sequence
ccaaaggctccagtcaccaa

SEQ ID NO: 418007 - DNA, 20 bp, Artificial
  CRISPR gRNA sequence
caaaggctccagtcaccaaa

SEQ ID NO: 418008 - DNA, 20 bp, Artificial
  CRISPR gRNA sequence
aaggctccagtcaccaaaag

SEQ ID NO: 418009 - DNA, 20 bp, Artificial
  CRISPR gRNA sequence
gctccagtcaccaaaaggag

SEQ ID NO: 418010 - DNA, 20 bp, Artificial
  CRISPR gRNA sequence
tccagtcaccaaaaggagca

SEQ ID NO: 418011 - DNA, 20 bp, Artificial
  CRISPR gRNA sequence
gtcaccaaaaggagcagaga

SEQ ID NO: 418012 - DNA, 20 bp, Artificial
  CRISPR gRNA sequence
tcaccaaaaggagcagagaa

SEQ ID NO: 418013 - DNA, 20 bp, Artificial
  CRISPR gRNA sequence
aggagcagagaaaggacacc

SEQ ID NO: 418014 - DNA, 20 bp, Artificial
  CRISPR gRNA sequence
ggagcagagaaaggacacca

SEQ ID NO: 418015 - DNA, 20 bp, Artificial
  CRISPR gRNA sequence
agagaaaggacaccaaggat

SEQ ID NO: 418016 - DNA, 20 bp, Artificial
  CRISPR gRNA sequence
aggacaccaaggatgagaaa

SEQ ID NO: 418017 - DNA, 20 bp, Artificial
  CRISPR gRNA sequence
acaccaaggatgagaaacag

SEQ ID NO: 418018 - DNA, 20 bp, Artificial
  CRISPR gRNA sequence
caccaaggatgagaaacagc

SEQ ID NO: 418019 - DNA, 20 bp, Artificial
  CRISPR gRNA sequence
ccaaggatgagaaacagcag

SEQ ID NO: 418020 - DNA, 20 bp, Artificial
  CRISPR gRNA sequence
caaggatgagaaacagcagg

SEQ ID NO: 418021 - DNA, 20 bp, Artificial
  CRISPR gRNA sequence
ggatgagaaacagcaggagg

SEQ ID NO: 418022 - DNA, 20 bp, Artificial
  CRISPR gRNA sequence
aacagcaggaggtggcctgc

SEQ ID NO: 418023 - DNA, 20 bp, Artificial
  CRISPR gRNA sequence
acagcaggaggtggcctgct

SEQ ID NO: 418024 - DNA, 20 bp, Artificial
  CRISPR gRNA sequence
agcaggaggtggcctgctgg

SEQ ID NO: 418025 - DNA, 20 bp, Artificial
  CRISPR gRNA sequence
gcaggaggtggcctgctggg

SEQ ID NO: 418026 - DNA, 20 bp, Artificial
  CRISPR gRNA sequence
caggaggtggcctgctggga

SEQ ID NO: 418027 - DNA, 20 bp, Artificial
  CRISPR gRNA sequence
tggcctgctgggagggcacc

SEQ ID NO: 418028 - DNA, 20 bp, Artificial
  CRISPR gRNA sequence
ggcctgctgggagggcacct

SEQ ID NO: 418029 - DNA, 20 bp, Artificial
  CRISPR gRNA sequence
gcctgctgggagggcacctg

SEQ ID NO: 418030 - DNA, 20 bp, Artificial
  CRISPR gRNA sequence
gagggcacctggggctctcc

SEQ ID NO: 418031 - DNA, 20 bp, Artificial
  CRISPR gRNA sequence
gggcacctggggctctccca

SEQ ID NO: 418032 - DNA, 20 bp, Artificial
  CRISPR gRNA sequence
ctggggctctcccagagcgt

SEQ ID NO: 418033 - DNA, 20 bp, Artificial
  CRISPR gRNA sequence
tggggctctcccagagcgtt

SEQ ID NO: 418034 - DNA, 20 bp, Artificial
  CRISPR gRNA sequence
cccagagcgttgggcaccta

SEQ ID NO: 418035 - DNA, 20 bp, Artificial
  CRISPR gRNA sequence
cagagcgttgggcacctatg

SEQ ID NO: 418036 - DNA, 20 bp, Artificial
  CRISPR gRNA sequence
gcgttgggcacctatggaga

SEQ ID NO: 418037 - DNA, 20 bp, Artificial
  CRISPR gRNA sequence
gggcacctatggagaaagta

SEQ ID NO: 418038 - DNA, 20 bp, Artificial
  CRISPR gRNA sequence
ggcacctatggagaaagtac

SEQ ID NO: 418039 - DNA, 20 bp, Artificial
  CRISPR gRNA sequence
ctatggagaaagtacaggat

SEQ ID NO: 418040 - DNA, 20 bp, Artificial
  CRISPR gRNA sequence
tatggagaaagtacaggatg

SEQ ID NO: 418041 - DNA, 20 bp, Artificial
  CRISPR gRNA sequence
agaaagtacaggatgaggca

SEQ ID NO: 418042 - DNA, 20 bp, Artificial
  CRISPR gRNA sequence
gaaagtacaggatgaggcat

SEQ ID NO: 418043 - DNA, 20 bp, Artificial
  CRISPR gRNA sequence
aaagtacaggatgaggcata

SEQ ID NO: 418044 - DNA, 20 bp, Artificial
  CRISPR gRNA sequence
tacaggatgaggcatagggt

SEQ ID NO: 418045 - DNA, 20 bp, Artificial
  CRISPR gRNA sequence
acaggatgaggcatagggtc

SEQ ID NO: 418046 - DNA, 20 bp, Artificial
  CRISPR gRNA sequence
atgaggcatagggtcaggac

SEQ ID NO: 418047 - DNA, 20 bp, Artificial
  CRISPR gRNA sequence
ggcatagggtcaggactaga

SEQ ID NO: 418048 - DNA, 20 bp, Artificial
  CRISPR gRNA sequence
gcatagggtcaggactagaa

SEQ ID NO: 418049 - DNA, 20 bp, Artificial
  CRISPR gRNA sequence
aggacactttgtcattctct

SEQ ID NO: 418050 - DNA, 20 bp, Artificial
  CRISPR gRNA sequence
tgtcattctctcagacttta

SEQ ID NO: 418051 - DNA, 20 bp, Artificial
  CRISPR gRNA sequence
tcagactttacagatgcaat

SEQ ID NO: 418052 - DNA, 20 bp, Artificial
  CRISPR gRNA sequence
tttacagatgcaatgagatc

SEQ ID NO: 418053 - DNA, 20 bp, Artificial
  CRISPR gRNA sequence
tacagatgcaatgagatcca

SEQ ID NO: 418054 - DNA, 20 bp, Artificial
  CRISPR gRNA sequence
cagatgcaatgagatccaga

SEQ ID NO: 418055 - DNA, 20 bp, Artificial
  CRISPR gRNA sequence
caatgagatccagagagttt

SEQ ID NO: 418056 - DNA, 20 bp, Artificial
  CRISPR gRNA sequence
aatgagatccagagagttta

SEQ ID NO: 418057 - DNA, 20 bp, Artificial
  CRISPR gRNA sequence
atgagatccagagagtttaa

SEQ ID NO: 418058 - DNA, 20 bp, Artificial
  CRISPR gRNA sequence
agagtttaagggacttgtcc

SEQ ID NO: 418059 - DNA, 20 bp, Artificial
  CRISPR gRNA sequence
gagtttaagggacttgtccc

SEQ ID NO: 418060 - DNA, 20 bp, Artificial
  CRISPR gRNA sequence
agtttaagggacttgtccca

SEQ ID NO: 418061 - DNA, 20 bp, Artificial
  CRISPR gRNA sequence
ggacttgtcccagggtcatt

SEQ ID NO: 418062 - DNA, 20 bp, Artificial
  CRISPR gRNA sequence
cccagggtcattcagctgat

SEQ ID NO: 418063 - DNA, 20 bp, Artificial
  CRISPR gRNA sequence
agggtcattcagctgatcag

SEQ ID NO: 418064 - DNA, 20 bp, Artificial
  CRISPR gRNA sequence
gtcattcagctgatcagtgg

SEQ ID NO: 418065 - DNA, 20 bp, Artificial
  CRISPR gRNA sequence
cagctgatcagtggcggaaa

SEQ ID NO: 418066 - DNA, 20 bp, Artificial
  CRISPR gRNA sequence
agctgatcagtggcggaaac

SEQ ID NO: 418067 - DNA, 20 bp, Artificial
  CRISPR gRNA sequence
tggcggaaacgggtcaaccc

SEQ ID NO: 418068 - DNA, 20 bp, Artificial
  CRISPR gRNA sequence
ggcggaaacgggtcaaccct

SEQ ID NO: 418069 - DNA, 20 bp, Artificial
  CRISPR gRNA sequence
aacgggtcaaccctaggcaa

SEQ ID NO: 418070 - DNA, 20 bp, Artificial
  CRISPR gRNA sequence
ggtcaaccctaggcaaaagc

SEQ ID NO: 418071 - DNA, 20 bp, Artificial
  CRISPR gRNA sequence
tcaaccctaggcaaaagcca

SEQ ID NO: 418072 - DNA, 20 bp, Artificial
  CRISPR gRNA sequence
cctaggcaaaagccagagat

SEQ ID NO: 418073 - DNA, 20 bp, Artificial
  CRISPR gRNA sequence
ctaggcaaaagccagagatc

SEQ ID NO: 418074 - DNA, 20 bp, Artificial
  CRISPR gRNA sequence
ccagagatcaggtccctgac

SEQ ID NO: 418075 - DNA, 20 bp, Artificial
  CRISPR gRNA sequence
agatcaggtccctgactgga

SEQ ID NO: 418076 - DNA, 20 bp, Artificial
  CRISPR gRNA sequence
aggtccctgactggaaagaa

SEQ ID NO: 418077 - DNA, 20 bp, Artificial
  CRISPR gRNA sequence
ctgactggaaagaaaagcgc

SEQ ID NO: 418078 - DNA, 20 bp, Artificial
  CRISPR gRNA sequence
tgactggaaagaaaagcgct

SEQ ID NO: 418079 - DNA, 20 bp, Artificial
  CRISPR gRNA sequence
tggaaagaaaagcgctggga

SEQ ID NO: 418080 - DNA, 20 bp, Artificial
  CRISPR gRNA sequence
ggaaagaaaagcgctgggat

SEQ ID NO: 418081 - DNA, 20 bp, Artificial
  CRISPR gRNA sequence
gaaagaaaagcgctgggatg

SEQ ID NO: 418082 - DNA, 20 bp, Artificial
  CRISPR gRNA sequence
aaagaaaagcgctgggatgg

SEQ ID NO: 418083 - DNA, 20 bp, Artificial
  CRISPR gRNA sequence
gaaaagcgctgggatggggg

SEQ ID NO: 418084 - DNA, 20 bp, Artificial
  CRISPR gRNA sequence
aagcgctgggatgggggtgg

SEQ ID NO: 418085 - DNA, 20 bp, Artificial
  CRISPR gRNA sequence
agcgctgggatgggggtggc

SEQ ID NO: 418086 - DNA, 20 bp, Artificial
  CRISPR gRNA sequence
gcgctgggatgggggtggca

SEQ ID NO: 418087 - DNA, 20 bp, Artificial
  CRISPR gRNA sequence
cgctgggatgggggtggcag

SEQ ID NO: 418088 - DNA, 20 bp, Artificial
  CRISPR gRNA sequence
gggggtggcaggggctgttc

SEQ ID NO: 418089 - DNA, 20 bp, Artificial
  CRISPR gRNA sequence
ggtggcaggggctgttctgg

SEQ ID NO: 418090 - DNA, 20 bp, Artificial
  CRISPR gRNA sequence
gtggcaggggctgttctgga

SEQ ID NO: 418091 - DNA, 20 bp, Artificial
  CRISPR gRNA sequence
ggcaggggctgttctggaag

SEQ ID NO: 418092 - DNA, 20 bp, Artificial
  CRISPR gRNA sequence
gcaggggctgttctggaagg

SEQ ID NO: 418093 - DNA, 20 bp, Artificial
  CRISPR gRNA sequence
gctgttctggaaggaggata

SEQ ID NO: 418094 - DNA, 20 bp, Artificial
  CRISPR gRNA sequence
gaggataaagattattgctg

SEQ ID NO: 418095 - DNA, 20 bp, Artificial
  CRISPR gRNA sequence
aagattattgctgtggcgtt

SEQ ID NO: 418096 - DNA, 20 bp, Artificial
  CRISPR gRNA sequence
agattattgctgtggcgttt

SEQ ID NO: 418097 - DNA, 20 bp, Artificial
  CRISPR gRNA sequence
ttgctgtggcgtttgggtcc

SEQ ID NO: 418098 - DNA, 20 bp, Artificial
  CRISPR gRNA sequence
gcgtttgggtcctggcattc

SEQ ID NO: 418099 - DNA, 20 bp, Artificial
  CRISPR gRNA sequence
cgtttgggtcctggcattct

SEQ ID NO: 418100 - DNA, 20 bp, Artificial
  CRISPR gRNA sequence
gtttgggtcctggcattctg

SEQ ID NO: 418101 - DNA, 20 bp, Artificial
  CRISPR gRNA sequence
gtcctggcattctggggcct

SEQ ID NO: 418102 - DNA, 20 bp, Artificial
  CRISPR gRNA sequence
gcattctggggcctcggacc

SEQ ID NO: 418103 - DNA, 20 bp, Artificial
  CRISPR gRNA sequence
cattctggggcctcggacct

SEQ ID NO: 418104 - DNA, 20 bp, Artificial
  CRISPR gRNA sequence
ctggggcctcggacctgggc

SEQ ID NO: 418105 - DNA, 20 bp, Artificial
  CRISPR gRNA sequence
ggcctcggacctgggctaga

SEQ ID NO: 418106 - DNA, 20 bp, Artificial
  CRISPR gRNA sequence
ctgggctagacagctctgtg

SEQ ID NO: 418107 - DNA, 20 bp, Artificial
  CRISPR gRNA sequence
gtgaagtacactgctgctcc

SEQ ID NO: 418108 - DNA, 20 bp, Artificial
  CRISPR gRNA sequence
aagtacactgctgctccaag

SEQ ID NO: 418109 - DNA, 20 bp, Artificial
  CRISPR gRNA sequence
ctccaagaagcctctccccc

SEQ ID NO: 418110 - DNA, 20 bp, Artificial
  CRISPR gRNA sequence
agaagcctctccccctggta

SEQ ID NO: 418111 - DNA, 20 bp, Artificial
  CRISPR gRNA sequence
gcctctccccctggtacagc

SEQ ID NO: 418112 - DNA, 20 bp, Artificial
  CRISPR gRNA sequence
ctggtacagctggcattgcc

SEQ ID NO: 418113 - DNA, 20 bp, Artificial
  CRISPR gRNA sequence
tggtacagctggcattgcca

SEQ ID NO: 418114 - DNA, 20 bp, Artificial
  CRISPR gRNA sequence
acagctggcattgccaaggc

SEQ ID NO: 418115 - DNA, 20 bp, Artificial
  CRISPR gRNA sequence
cagctggcattgccaaggct

SEQ ID NO: 418116 - DNA, 20 bp, Artificial
  CRISPR gRNA sequence
tggcattgccaaggctggga

SEQ ID NO: 418117 - DNA, 20 bp, Artificial
  CRISPR gRNA sequence
ggcattgccaaggctgggaa

SEQ ID NO: 418118 - DNA, 20 bp, Artificial
  CRISPR gRNA sequence
cattgccaaggctgggaaag

SEQ ID NO: 418119 - DNA, 20 bp, Artificial
  CRISPR gRNA sequence
gccaaggctgggaaaggagc

SEQ ID NO: 418120 - DNA, 20 bp, Artificial
  CRISPR gRNA sequence
ccaaggctgggaaaggagct

SEQ ID NO: 418121 - DNA, 20 bp, Artificial
  CRISPR gRNA sequence
agctgggcctcctgtgcctc

SEQ ID NO: 418122 - DNA, 20 bp, Artificial
  CRISPR gRNA sequence
ggcctcctgtgcctccagcc

SEQ ID NO: 418123 - DNA, 20 bp, Artificial
  CRISPR gRNA sequence
gcctcctgtgcctccagcca

SEQ ID NO: 418124 - DNA, 20 bp, Artificial
  CRISPR gRNA sequence
gtgcctccagccaaggtcct

SEQ ID NO: 418125 - DNA, 20 bp, Artificial
  CRISPR gRNA sequence
aaggtcctgagaaactcctc

SEQ ID NO: 418126 - DNA, 20 bp, Artificial
  CRISPR gRNA sequence
aggtcctgagaaactcctct

SEQ ID NO: 418127 - DNA, 20 bp, Artificial
  CRISPR gRNA sequence
cctgagaaactcctctggga

SEQ ID NO: 418128 - DNA, 20 bp, Artificial
  CRISPR gRNA sequence
ctgagaaactcctctgggat

SEQ ID NO: 418129 - DNA, 20 bp, Artificial
  CRISPR gRNA sequence
tgagaaactcctctgggatg

SEQ ID NO: 418130 - DNA, 20 bp, Artificial
  CRISPR gRNA sequence
ctcctctgggatggggtgtc

SEQ ID NO: 418131 - DNA, 20 bp, Artificial
  CRISPR gRNA sequence
cctctgggatggggtgtcca

SEQ ID NO: 418132 - DNA, 20 bp, Artificial
  CRISPR gRNA sequence
tctgggatggggtgtccaga

SEQ ID NO: 418133 - DNA, 20 bp, Artificial
  CRISPR gRNA sequence
tgtccagagagctccacaca

SEQ ID NO: 418134 - DNA, 20 bp, Artificial
  CRISPR gRNA sequence
ccacacaaagcgttcttgtc

SEQ ID NO: 418135 - DNA, 20 bp, Artificial
  CRISPR gRNA sequence
aagcgttcttgtccagatac

SEQ ID NO: 418136 - DNA, 20 bp, Artificial
  CRISPR gRNA sequence
gcgttcttgtccagatactg

SEQ ID NO: 418137 - DNA, 20 bp, Artificial
  CRISPR gRNA sequence
gatactggagtcacctcaca

SEQ ID NO: 418138 - DNA, 20 bp, Artificial
  CRISPR gRNA sequence
actggagtcacctcacaaag

SEQ ID NO: 418139 - DNA, 20 bp, Artificial
  CRISPR gRNA sequence
acctcacaaagcagcttccc

SEQ ID NO: 418140 - DNA, 20 bp, Artificial
  CRISPR gRNA sequence
cctcacaaagcagcttcccc

SEQ ID NO: 418141 - DNA, 20 bp, Artificial
  CRISPR gRNA sequence
ctcacaaagcagcttcccca

SEQ ID NO: 418142 - DNA, 20 bp, Artificial
  CRISPR gRNA sequence
aagcagcttccccagggatc

SEQ ID NO: 418143 - DNA, 20 bp, Artificial
  CRISPR gRNA sequence
agcagcttccccagggatcc

SEQ ID NO: 418144 - DNA, 20 bp, Artificial
  CRISPR gRNA sequence
ccagggatccaggtgaccca

SEQ ID NO: 418145 - DNA, 20 bp, Artificial
  CRISPR gRNA sequence
cagggatccaggtgacccaa

SEQ ID NO: 418146 - DNA, 20 bp, Artificial
  CRISPR gRNA sequence
tccaggtgacccaaaggatt

SEQ ID NO: 418147 - DNA, 20 bp, Artificial
  CRISPR gRNA sequence
ccaggtgacccaaaggattt

SEQ ID NO: 418148 - DNA, 20 bp, Artificial
  CRISPR gRNA sequence
aggtgacccaaaggatttgg

SEQ ID NO: 418149 - DNA, 20 bp, Artificial
  CRISPR gRNA sequence
aggatttgggagtcactgaa

SEQ ID NO: 418150 - DNA, 20 bp, Artificial
  CRISPR gRNA sequence
gatttgggagtcactgaaaa

SEQ ID NO: 418151 - DNA, 20 bp, Artificial
  CRISPR gRNA sequence
ttgggagtcactgaaaagag

SEQ ID NO: 418152 - DNA, 20 bp, Artificial
  CRISPR gRNA sequence
ggagtcactgaaaagagtag

SEQ ID NO: 418153 - DNA, 20 bp, Artificial
  CRISPR gRNA sequence
gagtcactgaaaagagtaga

SEQ ID NO: 418154 - DNA, 20 bp, Artificial
  CRISPR gRNA sequence
tcactgaaaagagtagaagg

SEQ ID NO: 418155 - DNA, 20 bp, Artificial
  CRISPR gRNA sequence
actgaaaagagtagaaggaa

SEQ ID NO: 418156 - DNA, 20 bp, Artificial
  CRISPR gRNA sequence
agtagaaggaagagatcttt

SEQ ID NO: 418157 - DNA, 20 bp, Artificial
  CRISPR gRNA sequence
gtagaaggaagagatctttt

SEQ ID NO: 418158 - DNA, 20 bp, Artificial
  CRISPR gRNA sequence
gccccccttacgtgatatca

SEQ ID NO: 418159 - DNA, 20 bp, Artificial
  CRISPR gRNA sequence
ccccccttacgtgatatcac

SEQ ID NO: 418160 - DNA, 20 bp, Artificial
  CRISPR gRNA sequence
gatatcacaggttgaacccc

SEQ ID NO: 418161 - DNA, 20 bp, Artificial
  CRISPR gRNA sequence
tcaatcaccctgcactcact

SEQ ID NO: 418162 - DNA, 20 bp, Artificial
  CRISPR gRNA sequence
caatcaccctgcactcactt

SEQ ID NO: 418163 - DNA, 20 bp, Artificial
  CRISPR gRNA sequence
ccctgcactcacttgggttc

SEQ ID NO: 418164 - DNA, 20 bp, Artificial
  CRISPR gRNA sequence
gcactcacttgggttctggc

SEQ ID NO: 418165 - DNA, 20 bp, Artificial
  CRISPR gRNA sequence
cactcacttgggttctggcc

SEQ ID NO: 418166 - DNA, 20 bp, Artificial
  CRISPR gRNA sequence
actcacttgggttctggcca

SEQ ID NO: 418167 - DNA, 20 bp, Artificial
  CRISPR gRNA sequence
ctcacttgggttctggccag

SEQ ID NO: 418168 - DNA, 20 bp, Artificial
  CRISPR gRNA sequence
cacttgggttctggccaggg

SEQ ID NO: 418169 - DNA, 20 bp, Artificial
  CRISPR gRNA sequence
acttgggttctggccagggg

SEQ ID NO: 418170 - DNA, 20 bp, Artificial
  CRISPR gRNA sequence
gggttctggccaggggaggt

SEQ ID NO: 418171 - DNA, 20 bp, Artificial
  CRISPR gRNA sequence
ggttctggccaggggaggtt

SEQ ID NO: 418172 - DNA, 20 bp, Artificial
  CRISPR gRNA sequence
gttctggccaggggaggttg

SEQ ID NO: 418173 - DNA, 20 bp, Artificial
  CRISPR gRNA sequence
ctggccaggggaggttgggg

SEQ ID NO: 418174 - DNA, 20 bp, Artificial
  CRISPR gRNA sequence
tggccaggggaggttgggga

SEQ ID NO: 418175 - DNA, 20 bp, Artificial
  CRISPR gRNA sequence
gaggttggggaaggacatca

SEQ ID NO: 418176 - DNA, 20 bp, Artificial
  CRISPR gRNA sequence
aggttggggaaggacatcat

SEQ ID NO: 418177 - DNA, 20 bp, Artificial
  CRISPR gRNA sequence
gggaaggacatcatgggtca

SEQ ID NO: 418178 - DNA, 20 bp, Artificial
  CRISPR gRNA sequence
tttttttattaaattgtata

SEQ ID NO: 418179 - DNA, 20 bp, Artificial
  CRISPR gRNA sequence
tgcgttttcaccatgttgcc

SEQ ID NO: 418180 - DNA, 20 bp, Artificial
  CRISPR gRNA sequence
gcgttttcaccatgttgccc

SEQ ID NO: 418181 - DNA, 20 bp, Artificial
  CRISPR gRNA sequence
tttcaccatgttgcccaggc

SEQ ID NO: 418182 - DNA, 20 bp, Artificial
  CRISPR gRNA sequence
ccatgttgcccaggctagtc

SEQ ID NO: 418183 - DNA, 20 bp, Artificial
  CRISPR gRNA sequence
ccaggctagtctggaattcc

SEQ ID NO: 418184 - DNA, 20 bp, Artificial
  CRISPR gRNA sequence
agtctggaattcctggactc

SEQ ID NO: 418185 - DNA, 20 bp, Artificial
  CRISPR gRNA sequence
ctcaagtgctcctctcgtct

SEQ ID NO: 418186 - DNA, 20 bp, Artificial
  CRISPR gRNA sequence
cctctcgtctcagcctttca

SEQ ID NO: 418187 - DNA, 20 bp, Artificial
  CRISPR gRNA sequence
gtctcagcctttcaaagtgc

SEQ ID NO: 418188 - DNA, 20 bp, Artificial
  CRISPR gRNA sequence
tctcagcctttcaaagtgct

SEQ ID NO: 418189 - DNA, 20 bp, Artificial
  CRISPR gRNA sequence
ctttcaaagtgctgggatta

SEQ ID NO: 418190 - DNA, 20 bp, Artificial
  CRISPR gRNA sequence
tttcaaagtgctgggattac

SEQ ID NO: 418191 - DNA, 20 bp, Artificial
  CRISPR gRNA sequence
agtgctgggattacaggtgt

SEQ ID NO: 418192 - DNA, 20 bp, Artificial
  CRISPR gRNA sequence
tgtgagccatcatgccctgc

SEQ ID NO: 418193 - DNA, 20 bp, Artificial
  CRISPR gRNA sequence
ccggccacatttatcttatt

SEQ ID NO: 418194 - DNA, 20 bp, Artificial
  CRISPR gRNA sequence
atcttattcagacaatgctc

SEQ ID NO: 418195 - DNA, 20 bp, Artificial
  CRISPR gRNA sequence
tattcagacaatgctctagt

SEQ ID NO: 418196 - DNA, 20 bp, Artificial
  CRISPR gRNA sequence
tcccctgctcaaaacatttc

SEQ ID NO: 418197 - DNA, 20 bp, Artificial
  CRISPR gRNA sequence
cccctgctcaaaacatttcc

SEQ ID NO: 418198 - DNA, 20 bp, Artificial
  CRISPR gRNA sequence
tactgccttcacactcaaac

SEQ ID NO: 418199 - DNA, 20 bp, Artificial
  CRISPR gRNA sequence
cttcacactcaaactggccc

SEQ ID NO: 418200 - DNA, 20 bp, Artificial
  CRISPR gRNA sequence
cacactcaaactggccctgg

SEQ ID NO: 418201 - DNA, 20 bp, Artificial
  CRISPR gRNA sequence
aaactggccctggcagacca

SEQ ID NO: 418202 - DNA, 20 bp, Artificial
  CRISPR gRNA sequence
ccacagaataaatactatta

SEQ ID NO: 418203 - DNA, 20 bp, Artificial
  CRISPR gRNA sequence
ttactttctactcaaatgct

SEQ ID NO: 418204 - DNA, 20 bp, Artificial
  CRISPR gRNA sequence
atgctcagaaccctcaaaat

SEQ ID NO: 418205 - DNA, 20 bp, Artificial
  CRISPR gRNA sequence
tcagaaccctcaaaatcagt

SEQ ID NO: 418206 - DNA, 20 bp, Artificial
  CRISPR gRNA sequence
accctcaaaatcagtcagat

SEQ ID NO: 418207 - DNA, 20 bp, Artificial
  CRISPR gRNA sequence
ccccatctacttcacaattt

SEQ ID NO: 418208 - DNA, 20 bp, Artificial
  CRISPR gRNA sequence
attttggaacttccatgatg

SEQ ID NO: 418209 - DNA, 20 bp, Artificial
  CRISPR gRNA sequence
ttccatgatgcggctcacat

SEQ ID NO: 418210 - DNA, 20 bp, Artificial
  CRISPR gRNA sequence
catcagtgtcccctgccttg

SEQ ID NO: 418211 - DNA, 20 bp, Artificial
  CRISPR gRNA sequence
gaacatcatccccctttctg

SEQ ID NO: 418212 - DNA, 20 bp, Artificial
  CRISPR gRNA sequence
aacatcatccccctttctga

SEQ ID NO: 418213 - DNA, 20 bp, Artificial
  CRISPR gRNA sequence
catccccctttctgaaggta

SEQ ID NO: 418214 - DNA, 20 bp, Artificial
  CRISPR gRNA sequence
tccccctttctgaaggtata

SEQ ID NO: 418215 - DNA, 20 bp, Artificial
  CRISPR gRNA sequence
ctttctgaaggtatagagaa

SEQ ID NO: 418216 - DNA, 20 bp, Artificial
  CRISPR gRNA sequence
tttctgaaggtatagagaac

SEQ ID NO: 418217 - DNA, 20 bp, Artificial
  CRISPR gRNA sequence
ttctgaaggtatagagaaca

SEQ ID NO: 418218 - DNA, 20 bp, Artificial
  CRISPR gRNA sequence
agggaactgacccattcatc

SEQ ID NO: 418219 - DNA, 20 bp, Artificial
  CRISPR gRNA sequence
ggaactgacccattcatcta

SEQ ID NO: 418220 - DNA, 20 bp, Artificial
  CRISPR gRNA sequence
ctgacccattcatctagaga

SEQ ID NO: 418221 - DNA, 20 bp, Artificial
  CRISPR gRNA sequence
gacccattcatctagagaca

SEQ ID NO: 418222 - DNA, 20 bp, Artificial
  CRISPR gRNA sequence
ctagagacagagcattctcc

SEQ ID NO: 418223 - DNA, 20 bp, Artificial
  CRISPR gRNA sequence
agagcattctccaagttgta

SEQ ID NO: 418224 - DNA, 20 bp, Artificial
  CRISPR gRNA sequence
cattctccaagttgtaaagt

SEQ ID NO: 418225 - DNA, 20 bp, Artificial
  CRISPR gRNA sequence
ttctccaagttgtaaagtga

SEQ ID NO: 418226 - DNA, 20 bp, Artificial
  CRISPR gRNA sequence
ccaagttgtaaagtgagaga

SEQ ID NO: 418227 - DNA, 20 bp, Artificial
  CRISPR gRNA sequence
caagttgtaaagtgagagat

SEQ ID NO: 418228 - DNA, 20 bp, Artificial
  CRISPR gRNA sequence
gttgtaaagtgagagatggg

SEQ ID NO: 418229 - DNA, 20 bp, Artificial
  CRISPR gRNA sequence
ttgtaaagtgagagatgggt

SEQ ID NO: 418230 - DNA, 20 bp, Artificial
  CRISPR gRNA sequence
taaagtgagagatgggtggg

SEQ ID NO: 418231 - DNA, 20 bp, Artificial
  CRISPR gRNA sequence
aaagtgagagatgggtgggt

SEQ ID NO: 418232 - DNA, 20 bp, Artificial
  CRISPR gRNA sequence
agtgagagatgggtgggtgg

SEQ ID NO: 418233 - DNA, 20 bp, Artificial
  CRISPR gRNA sequence
gtgagagatgggtgggtggg

SEQ ID NO: 418234 - DNA, 20 bp, Artificial
  CRISPR gRNA sequence
gagagatgggtgggtgggag

SEQ ID NO: 418235 - DNA, 20 bp, Artificial
  CRISPR gRNA sequence
tgggtgggtgggaggagaca

SEQ ID NO: 418236 - DNA, 20 bp, Artificial
  CRISPR gRNA sequence
gggtgggtgggaggagacaa

SEQ ID NO: 418237 - DNA, 20 bp, Artificial
  CRISPR gRNA sequence
ggtgggtgggaggagacaaa

SEQ ID NO: 418238 - DNA, 20 bp, Artificial
  CRISPR gRNA sequence
gtgggaggagacaaagggtg

SEQ ID NO: 418239 - DNA, 20 bp, Artificial
  CRISPR gRNA sequence
tgggaggagacaaagggtga

SEQ ID NO: 418240 - DNA, 20 bp, Artificial
  CRISPR gRNA sequence
gggaggagacaaagggtgaa

SEQ ID NO: 418241 - DNA, 20 bp, Artificial
  CRISPR gRNA sequence
acaaagggtgaagggcatct

SEQ ID NO: 418242 - DNA, 20 bp, Artificial
  CRISPR gRNA sequence
aagggtgaagggcatctgag

SEQ ID NO: 418243 - DNA, 20 bp, Artificial
  CRISPR gRNA sequence
agggcatctgagtagtgtcc

SEQ ID NO: 418244 - DNA, 20 bp, Artificial
  CRISPR gRNA sequence
ggcatctgagtagtgtcctg

SEQ ID NO: 418245 - DNA, 20 bp, Artificial
  CRISPR gRNA sequence
catctgagtagtgtcctgga

SEQ ID NO: 418246 - DNA, 20 bp, Artificial
  CRISPR gRNA sequence
tagtgtcctggagagtgatt

SEQ ID NO: 418247 - DNA, 20 bp, Artificial
  CRISPR gRNA sequence
tggagagtgatttggtgatg

SEQ ID NO: 418248 - DNA, 20 bp, Artificial
  CRISPR gRNA sequence
atttggtgatgcagacacct

SEQ ID NO: 418249 - DNA, 20 bp, Artificial
  CRISPR gRNA sequence
gtgatgcagacacctgagtt

SEQ ID NO: 418250 - DNA, 20 bp, Artificial
  CRISPR gRNA sequence
cagacacctgagtttagacc

SEQ ID NO: 418251 - DNA, 20 bp, Artificial
  CRISPR gRNA sequence
gacacctgagtttagaccca

SEQ ID NO: 418252 - DNA, 20 bp, Artificial
  CRISPR gRNA sequence
ctgagtttagacccagagtc

SEQ ID NO: 418253 - DNA, 20 bp, Artificial
  CRISPR gRNA sequence
acccagagtctggcacttcc

SEQ ID NO: 418254 - DNA, 20 bp, Artificial
  CRISPR gRNA sequence
tggcacttcccagctgtttt

SEQ ID NO: 418255 - DNA, 20 bp, Artificial
  CRISPR gRNA sequence
acttcccagctgttttgaga

SEQ ID NO: 418256 - DNA, 20 bp, Artificial
  CRISPR gRNA sequence
agctgttttgagaaagtctt

SEQ ID NO: 418257 - DNA, 20 bp, Artificial
  CRISPR gRNA sequence
gctgttttgagaaagtcttc

SEQ ID NO: 418258 - DNA, 20 bp, Artificial
  CRISPR gRNA sequence
ctgttttgagaaagtcttcg

SEQ ID NO: 418259 - DNA, 20 bp, Artificial
  CRISPR gRNA sequence
tgagaaagtcttcggggtaa

SEQ ID NO: 418260 - DNA, 20 bp, Artificial
  CRISPR gRNA sequence
gtaacagtatctctctcatt

SEQ ID NO: 418261 - DNA, 20 bp, Artificial
  CRISPR gRNA sequence
attgagccgtctacataaaa

SEQ ID NO: 418262 - DNA, 20 bp, Artificial
  CRISPR gRNA sequence
acataaaacagttgaccttc

SEQ ID NO: 418263 - DNA, 20 bp, Artificial
  CRISPR gRNA sequence
ataaaacagttgaccttcaa

SEQ ID NO: 418264 - DNA, 20 bp, Artificial
  CRISPR gRNA sequence
taaaacagttgaccttcaag

SEQ ID NO: 418265 - DNA, 20 bp, Artificial
  CRISPR gRNA sequence
aaaacagttgaccttcaaga

SEQ ID NO: 418266 - DNA, 20 bp, Artificial
  CRISPR gRNA sequence
gttgaccttcaagagggcat

SEQ ID NO: 418267 - DNA, 20 bp, Artificial
  CRISPR gRNA sequence
accttcaagagggcattgga

SEQ ID NO: 418268 - DNA, 20 bp, Artificial
  CRISPR gRNA sequence
tcaagagggcattggacaga

SEQ ID NO: 418269 - DNA, 20 bp, Artificial
  CRISPR gRNA sequence
gggcattggacagaaagaac

SEQ ID NO: 418270 - DNA, 20 bp, Artificial
  CRISPR gRNA sequence
cattggacagaaagaactgg

SEQ ID NO: 418271 - DNA, 20 bp, Artificial
  CRISPR gRNA sequence
tggtggactttgatgactga

SEQ ID NO: 418272 - DNA, 20 bp, Artificial
  CRISPR gRNA sequence
ggtggactttgatgactgat

SEQ ID NO: 418273 - DNA, 20 bp, Artificial
  CRISPR gRNA sequence
ctttgatgactgatgggatg

SEQ ID NO: 418274 - DNA, 20 bp, Artificial
  CRISPR gRNA sequence
ttgatgactgatgggatgta

SEQ ID NO: 418275 - DNA, 20 bp, Artificial
  CRISPR gRNA sequence
gatgactgatgggatgtaga

SEQ ID NO: 418276 - DNA, 20 bp, Artificial
  CRISPR gRNA sequence
atgactgatgggatgtagag

SEQ ID NO: 418277 - DNA, 20 bp, Artificial
  CRISPR gRNA sequence
gactgatgggatgtagagag

SEQ ID NO: 418278 - DNA, 20 bp, Artificial
  CRISPR gRNA sequence
actgatgggatgtagagagg

SEQ ID NO: 418279 - DNA, 20 bp, Artificial
  CRISPR gRNA sequence
tgatgggatgtagagaggag

SEQ ID NO: 418280 - DNA, 20 bp, Artificial
  CRISPR gRNA sequence
gatgggatgtagagaggagg

SEQ ID NO: 418281 - DNA, 20 bp, Artificial
  CRISPR gRNA sequence
ggatgtagagaggaggaggc

SEQ ID NO: 418282 - DNA, 20 bp, Artificial
  CRISPR gRNA sequence
gatgtagagaggaggaggcc

SEQ ID NO: 418283 - DNA, 20 bp, Artificial
  CRISPR gRNA sequence
agaggaggaggccaggtttc

SEQ ID NO: 418284 - DNA, 20 bp, Artificial
  CRISPR gRNA sequence
gaggaggaggccaggtttcg

SEQ ID NO: 418285 - DNA, 20 bp, Artificial
  CRISPR gRNA sequence
gaggaggccaggtttcgagg

SEQ ID NO: 418286 - DNA, 20 bp, Artificial
  CRISPR gRNA sequence
aggccaggtttcgaggtgga

SEQ ID NO: 418287 - DNA, 20 bp, Artificial
  CRISPR gRNA sequence
gtttcgaggtggatggatac

SEQ ID NO: 418288 - DNA, 20 bp, Artificial
  CRISPR gRNA sequence
tcgaggtggatggataccag

SEQ ID NO: 418289 - DNA, 20 bp, Artificial
  CRISPR gRNA sequence
ggataccagtggattactga

SEQ ID NO: 418290 - DNA, 20 bp, Artificial
  CRISPR gRNA sequence
gataccagtggattactgac

SEQ ID NO: 418291 - DNA, 20 bp, Artificial
  CRISPR gRNA sequence
cagtggattactgacaggct

SEQ ID NO: 418292 - DNA, 20 bp, Artificial
  CRISPR gRNA sequence
ggattactgacaggctgagt

SEQ ID NO: 418293 - DNA, 20 bp, Artificial
  CRISPR gRNA sequence
tactgacaggctgagtcagc

SEQ ID NO: 418294 - DNA, 20 bp, Artificial
  CRISPR gRNA sequence
actgacaggctgagtcagca

SEQ ID NO: 418295 - DNA, 20 bp, Artificial
  CRISPR gRNA sequence
ctgacaggctgagtcagcaa

SEQ ID NO: 418296 - DNA, 20 bp, Artificial
  CRISPR gRNA sequence
tgacaggctgagtcagcaag

SEQ ID NO: 418297 - DNA, 20 bp, Artificial
  CRISPR gRNA sequence
ggctgagtcagcaaggggat

SEQ ID NO: 418298 - DNA, 20 bp, Artificial
  CRISPR gRNA sequence
tgagtcagcaaggggattgg

SEQ ID NO: 418299 - DNA, 20 bp, Artificial
  CRISPR gRNA sequence
gagtcagcaaggggattggt

SEQ ID NO: 418300 - DNA, 20 bp, Artificial
  CRISPR gRNA sequence
gtcagcaaggggattggtgg

SEQ ID NO: 418301 - DNA, 20 bp, Artificial
  CRISPR gRNA sequence
aaggggattggtgggagaaa

SEQ ID NO: 418302 - DNA, 20 bp, Artificial
  CRISPR gRNA sequence
ggattggtgggagaaaaagc

SEQ ID NO: 418303 - DNA, 20 bp, Artificial
  CRISPR gRNA sequence
gattggtgggagaaaaagct

SEQ ID NO: 418304 - DNA, 20 bp, Artificial
  CRISPR gRNA sequence
attggtgggagaaaaagctg

SEQ ID NO: 418305 - DNA, 20 bp, Artificial
  CRISPR gRNA sequence
tgggagaaaaagctggggtt

SEQ ID NO: 418306 - DNA, 20 bp, Artificial
  CRISPR gRNA sequence
gggagaaaaagctggggttc

SEQ ID NO: 418307 - DNA, 20 bp, Artificial
  CRISPR gRNA sequence
ggagaaaaagctggggttca

SEQ ID NO: 418308 - DNA, 20 bp, Artificial
  CRISPR gRNA sequence
aaaaagctggggttcagggt

SEQ ID NO: 418309 - DNA, 20 bp, Artificial
  CRISPR gRNA sequence
aaaagctggggttcagggta

SEQ ID NO: 418310 - DNA, 20 bp, Artificial
  CRISPR gRNA sequence
agctggggttcagggtaagg

SEQ ID NO: 418311 - DNA, 20 bp, Artificial
  CRISPR gRNA sequence
gggttcagggtaaggcggct

SEQ ID NO: 418312 - DNA, 20 bp, Artificial
  CRISPR gRNA sequence
gttcagggtaaggcggctga

SEQ ID NO: 418313 - DNA, 20 bp, Artificial
  CRISPR gRNA sequence
ttcagggtaaggcggctgag

SEQ ID NO: 418314 - DNA, 20 bp, Artificial
  CRISPR gRNA sequence
agggtaaggcggctgagagg

SEQ ID NO: 418315 - DNA, 20 bp, Artificial
  CRISPR gRNA sequence
ctgagaggtggtataacatc

SEQ ID NO: 418316 - DNA, 20 bp, Artificial
  CRISPR gRNA sequence
gaggtggtataacatctagt

SEQ ID NO: 418317 - DNA, 20 bp, Artificial
  CRISPR gRNA sequence
ggtggtataacatctagtta

SEQ ID NO: 418318 - DNA, 20 bp, Artificial
  CRISPR gRNA sequence
gtggtataacatctagttag

SEQ ID NO: 418319 - DNA, 20 bp, Artificial
  CRISPR gRNA sequence
aacatctagttagaggtatc

SEQ ID NO: 418320 - DNA, 20 bp, Artificial
  CRISPR gRNA sequence
tctagttagaggtatccaga

SEQ ID NO: 418321 - DNA, 20 bp, Artificial
  CRISPR gRNA sequence
gttagaggtatccagaaagc

SEQ ID NO: 418322 - DNA, 20 bp, Artificial
  CRISPR gRNA sequence
ccagaaagcaagtgaaaact

SEQ ID NO: 418323 - DNA, 20 bp, Artificial
  CRISPR gRNA sequence
cagaaagcaagtgaaaactc

SEQ ID NO: 418324 - DNA, 20 bp, Artificial
  CRISPR gRNA sequence
agcaagtgaaaactcaggat

SEQ ID NO: 418325 - DNA, 20 bp, Artificial
  CRISPR gRNA sequence
gaaaactcaggattggcctt

SEQ ID NO: 418326 - DNA, 20 bp, Artificial
  CRISPR gRNA sequence
aaaactcaggattggccttc

SEQ ID NO: 418327 - DNA, 20 bp, Artificial
  CRISPR gRNA sequence
aactcaggattggccttcag

SEQ ID NO: 418328 - DNA, 20 bp, Artificial
  CRISPR gRNA sequence
tcaggagatgtattatccat

SEQ ID NO: 418329 - DNA, 20 bp, Artificial
  CRISPR gRNA sequence
ttcaatctctatacattatt

SEQ ID NO: 418330 - DNA, 20 bp, Artificial
  CRISPR gRNA sequence
acattattaagcacctgccg

SEQ ID NO: 418331 - DNA, 20 bp, Artificial
  CRISPR gRNA sequence
cattattaagcacctgccgt

SEQ ID NO: 418332 - DNA, 20 bp, Artificial
  CRISPR gRNA sequence
attattaagcacctgccgtg

SEQ ID NO: 418333 - DNA, 20 bp, Artificial
  CRISPR gRNA sequence
tgccgtggggtgctactact

SEQ ID NO: 418334 - DNA, 20 bp, Artificial
  CRISPR gRNA sequence
cgtggggtgctactactgag

SEQ ID NO: 418335 - DNA, 20 bp, Artificial
  CRISPR gRNA sequence
gtgctactactgagtggccg

SEQ ID NO: 418336 - DNA, 20 bp, Artificial
  CRISPR gRNA sequence
tgctactactgagtggccgc

SEQ ID NO: 418337 - DNA, 20 bp, Artificial
  CRISPR gRNA sequence
gtggccgcaggtgcgtgctg

SEQ ID NO: 418338 - DNA, 20 bp, Artificial
  CRISPR gRNA sequence
gcaggtgcgtgctgcagaca

SEQ ID NO: 418339 - DNA, 20 bp, Artificial
  CRISPR gRNA sequence
cagacatggctaatctgtca

SEQ ID NO: 418340 - DNA, 20 bp, Artificial
  CRISPR gRNA sequence
ggctaatctgtcatggccga

SEQ ID NO: 418341 - DNA, 20 bp, Artificial
  CRISPR gRNA sequence
catggccgatagttatcaac

SEQ ID NO: 418342 - DNA, 20 bp, Artificial
  CRISPR gRNA sequence
ccagtcaacacatactctct

SEQ ID NO: 418343 - DNA, 20 bp, Artificial
  CRISPR gRNA sequence
gtgtttgttttatactgtct

SEQ ID NO: 418344 - DNA, 20 bp, Artificial
  CRISPR gRNA sequence
tgtcttggaaaacccttgct

SEQ ID NO: 418345 - DNA, 20 bp, Artificial
  CRISPR gRNA sequence
tcagtaaatatttgctgacc

SEQ ID NO: 418346 - DNA, 20 bp, Artificial
  CRISPR gRNA sequence
cagtaaatatttgctgacca

SEQ ID NO: 418347 - DNA, 20 bp, Artificial
  CRISPR gRNA sequence
agtaaatatttgctgaccaa

SEQ ID NO: 418348 - DNA, 20 bp, Artificial
  CRISPR gRNA sequence
aatatttgctgaccaaggga

SEQ ID NO: 418349 - DNA, 20 bp, Artificial
  CRISPR gRNA sequence
ttattcactcctcccaaatc

SEQ ID NO: 418350 - DNA, 20 bp, Artificial
  CRISPR gRNA sequence
tattcactcctcccaaatcc

SEQ ID NO: 418351 - DNA, 20 bp, Artificial
  CRISPR gRNA sequence
acttcctgcaactctaaccc

SEQ ID NO: 418352 - DNA, 20 bp, Artificial
  CRISPR gRNA sequence
tgcaactctaacccaagccc

SEQ ID NO: 418353 - DNA, 20 bp, Artificial
  CRISPR gRNA sequence
taacccaagccctggctgca

SEQ ID NO: 418354 - DNA, 20 bp, Artificial
  CRISPR gRNA sequence
cccaagccctggctgcaaag

SEQ ID NO: 418355 - DNA, 20 bp, Artificial
  CRISPR gRNA sequence
gccctggctgcaaagtagac

SEQ ID NO: 418356 - DNA, 20 bp, Artificial
  CRISPR gRNA sequence
ccctggctgcaaagtagaca

SEQ ID NO: 418357 - DNA, 20 bp, Artificial
  CRISPR gRNA sequence
tgcaaagtagacaaggattc

SEQ ID NO: 418358 - DNA, 20 bp, Artificial
  CRISPR gRNA sequence
tctacctctttcgaaccatt

SEQ ID NO: 418359 - DNA, 20 bp, Artificial
  CRISPR gRNA sequence
cacctttccttctaacttcc

SEQ ID NO: 418360 - DNA, 20 bp, Artificial
  CRISPR gRNA sequence
cccagaccctcccgccaatt

SEQ ID NO: 418361 - DNA, 20 bp, Artificial
  CRISPR gRNA sequence
cagaccctcccgccaattga

SEQ ID NO: 418362 - DNA, 20 bp, Artificial
  CRISPR gRNA sequence
accctcccgccaattgagag

SEQ ID NO: 418363 - DNA, 20 bp, Artificial
  CRISPR gRNA sequence
ccctcccgccaattgagagc

SEQ ID NO: 418364 - DNA, 20 bp, Artificial
  CRISPR gRNA sequence
cctcccgccaattgagagca

SEQ ID NO: 418365 - DNA, 20 bp, Artificial
  CRISPR gRNA sequence
ctcccgccaattgagagcag

SEQ ID NO: 418366 - DNA, 20 bp, Artificial
  CRISPR gRNA sequence
cccgccaattgagagcaggg

SEQ ID NO: 418367 - DNA, 20 bp, Artificial
  CRISPR gRNA sequence
ttgagagcaggggagtccca

SEQ ID NO: 418368 - DNA, 20 bp, Artificial
  CRISPR gRNA sequence
gagagcaggggagtcccata

SEQ ID NO: 418369 - DNA, 20 bp, Artificial
  CRISPR gRNA sequence
caggggagtcccatagagaa

SEQ ID NO: 418370 - DNA, 20 bp, Artificial
  CRISPR gRNA sequence
gggagtcccatagagaacgg

SEQ ID NO: 418371 - DNA, 20 bp, Artificial
  CRISPR gRNA sequence
gaacttttatcttgtgactc

SEQ ID NO: 418372 - DNA, 20 bp, Artificial
  CRISPR gRNA sequence
acttttatcttgtgactcaa

SEQ ID NO: 418373 - DNA, 20 bp, Artificial
  CRISPR gRNA sequence
cttttatcttgtgactcaag

SEQ ID NO: 418374 - DNA, 20 bp, Artificial
  CRISPR gRNA sequence
tttatcttgtgactcaagag

SEQ ID NO: 418375 - DNA, 20 bp, Artificial
  CRISPR gRNA sequence
gtgactcaagaggagatttt

SEQ ID NO: 418376 - DNA, 20 bp, Artificial
  CRISPR gRNA sequence
tcagtttcgtttctttatta

SEQ ID NO: 418377 - DNA, 20 bp, Artificial
  CRISPR gRNA sequence
cagtttcgtttctttattat

SEQ ID NO: 418378 - DNA, 20 bp, Artificial
  CRISPR gRNA sequence
agtttcgtttctttattatg

SEQ ID NO: 418379 - DNA, 20 bp, Artificial
  CRISPR gRNA sequence
gtttcgtttctttattatgg

SEQ ID NO: 418380 - DNA, 20 bp, Artificial
  CRISPR gRNA sequence
cgtttctttattatgggggt

SEQ ID NO: 418381 - DNA, 20 bp, Artificial
  CRISPR gRNA sequence
ctttattatgggggtgagaa

SEQ ID NO: 418382 - DNA, 20 bp, Artificial
  CRISPR gRNA sequence
tattatgggggtgagaaaag

SEQ ID NO: 418383 - DNA, 20 bp, Artificial
  CRISPR gRNA sequence
attatgggggtgagaaaagt

SEQ ID NO: 418384 - DNA, 20 bp, Artificial
  CRISPR gRNA sequence
ttatgggggtgagaaaagtg

SEQ ID NO: 418385 - DNA, 20 bp, Artificial
  CRISPR gRNA sequence
tatgggggtgagaaaagtgg

SEQ ID NO: 418386 - DNA, 20 bp, Artificial
  CRISPR gRNA sequence
gggtgagaaaagtgggggcc

SEQ ID NO: 418387 - DNA, 20 bp, Artificial
  CRISPR gRNA sequence
gagaaaagtgggggccgaga

SEQ ID NO: 418388 - DNA, 20 bp, Artificial
  CRISPR gRNA sequence
agaaaagtgggggccgagat

SEQ ID NO: 418389 - DNA, 20 bp, Artificial
  CRISPR gRNA sequence
aaagtgggggccgagatggg

SEQ ID NO: 418390 - DNA, 20 bp, Artificial
  CRISPR gRNA sequence
aagtgggggccgagatgggc

SEQ ID NO: 418391 - DNA, 20 bp, Artificial
  CRISPR gRNA sequence
gggccgagatgggcaggctc

SEQ ID NO: 418392 - DNA, 20 bp, Artificial
  CRISPR gRNA sequence
caggctctggaacttgtgcc

SEQ ID NO: 418393 - DNA, 20 bp, Artificial
  CRISPR gRNA sequence
gctctggaacttgtgcccag

SEQ ID NO: 418394 - DNA, 20 bp, Artificial
  CRISPR gRNA sequence
ggaacttgtgcccagtggcc

SEQ ID NO: 418395 - DNA, 20 bp, Artificial
  CRISPR gRNA sequence
tgcccagtggcctggcatca

SEQ ID NO: 418396 - DNA, 20 bp, Artificial
  CRISPR gRNA sequence
gcccagtggcctggcatcac

SEQ ID NO: 418397 - DNA, 20 bp, Artificial
  CRISPR gRNA sequence
cccagtggcctggcatcaca

SEQ ID NO: 418398 - DNA, 20 bp, Artificial
  CRISPR gRNA sequence
agtggcctggcatcacaggg

SEQ ID NO: 418399 - DNA, 20 bp, Artificial
  CRISPR gRNA sequence
gtggcctggcatcacagggt

SEQ ID NO: 418400 - DNA, 20 bp, Artificial
  CRISPR gRNA sequence
catcacagggtgggtttgcc

SEQ ID NO: 418401 - DNA, 20 bp, Artificial
  CRISPR gRNA sequence
ttgcctagtctttgccctgc

SEQ ID NO: 418402 - DNA, 20 bp, Artificial
  CRISPR gRNA sequence
cctccctgtcctttctaccc

SEQ ID NO: 418403 - DNA, 20 bp, Artificial
  CRISPR gRNA sequence
ctccctgtcctttctaccct

SEQ ID NO: 418404 - DNA, 20 bp, Artificial
  CRISPR gRNA sequence
ccctgtcctttctaccctgg

SEQ ID NO: 418405 - DNA, 20 bp, Artificial
  CRISPR gRNA sequence
cctgtcctttctaccctggg

SEQ ID NO: 418406 - DNA, 20 bp, Artificial
  CRISPR gRNA sequence
ctgtcctttctaccctggga

SEQ ID NO: 418407 - DNA, 20 bp, Artificial
  CRISPR gRNA sequence
tcctttctaccctgggaggg

SEQ ID NO: 418408 - DNA, 20 bp, Artificial
  CRISPR gRNA sequence
cagctactcctttcccacct

SEQ ID NO: 418409 - DNA, 20 bp, Artificial
  CRISPR gRNA sequence
agctactcctttcccacctg

SEQ ID NO: 418410 - DNA, 20 bp, Artificial
  CRISPR gRNA sequence
tgtgatgattgccaatgtga

SEQ ID NO: 418411 - DNA, 20 bp, Artificial
  CRISPR gRNA sequence
gatgattgccaatgtgacag

SEQ ID NO: 418412 - DNA, 20 bp, Artificial
  CRISPR gRNA sequence
gccaatgtgacagtggcatt

SEQ ID NO: 418413 - DNA, 20 bp, Artificial
  CRISPR gRNA sequence
gcattgagctgctgttcctg

SEQ ID NO: 418414 - DNA, 20 bp, Artificial
  CRISPR gRNA sequence
tgagctgctgttcctgcaga

SEQ ID NO: 418415 - DNA, 20 bp, Artificial
  CRISPR gRNA sequence
gctgttcctgcagatggata

SEQ ID NO: 418416 - DNA, 20 bp, Artificial
  CRISPR gRNA sequence
gttcctgcagatggatatgg

SEQ ID NO: 418417 - DNA, 20 bp, Artificial
  CRISPR gRNA sequence
ttcctgcagatggatatggc

SEQ ID NO: 418418 - DNA, 20 bp, Artificial
  CRISPR gRNA sequence
gcagatggatatggcaggtg

SEQ ID NO: 418419 - DNA, 20 bp, Artificial
  CRISPR gRNA sequence
cagatggatatggcaggtgt

SEQ ID NO: 418420 - DNA, 20 bp, Artificial
  CRISPR gRNA sequence
gatatggcaggtgtaggtcc

SEQ ID NO: 418421 - DNA, 20 bp, Artificial
  CRISPR gRNA sequence
ggcaggtgtaggtcccagcc

SEQ ID NO: 418422 - DNA, 20 bp, Artificial
  CRISPR gRNA sequence
gcaggtgtaggtcccagcct

SEQ ID NO: 418423 - DNA, 20 bp, Artificial
  CRISPR gRNA sequence
tgtaggtcccagcctgggcc

SEQ ID NO: 418424 - DNA, 20 bp, Artificial
  CRISPR gRNA sequence
tgggcctggctcacatcctc

SEQ ID NO: 418425 - DNA, 20 bp, Artificial
  CRISPR gRNA sequence
tggctcacatcctctagtcg

SEQ ID NO: 418426 - DNA, 20 bp, Artificial
  CRISPR gRNA sequence
ggctcacatcctctagtcga

SEQ ID NO: 418427 - DNA, 20 bp, Artificial
  CRISPR gRNA sequence
gctcacatcctctagtcgaa

SEQ ID NO: 418428 - DNA, 20 bp, Artificial
  CRISPR gRNA sequence
catcctctagtcgaagggta

SEQ ID NO: 418429 - DNA, 20 bp, Artificial
  CRISPR gRNA sequence
ggtaaagtcgccattgtctc

SEQ ID NO: 418430 - DNA, 20 bp, Artificial
  CRISPR gRNA sequence
tcgccattgtctccagtcac

SEQ ID NO: 418431 - DNA, 20 bp, Artificial
  CRISPR gRNA sequence
cgccattgtctccagtcacc

SEQ ID NO: 418432 - DNA, 20 bp, Artificial
  CRISPR gRNA sequence
ccattgtctccagtcaccag

SEQ ID NO: 418433 - DNA, 20 bp, Artificial
  CRISPR gRNA sequence
cattgtctccagtcaccagg

SEQ ID NO: 418434 - DNA, 20 bp, Artificial
  CRISPR gRNA sequence
gtctccagtcaccaggaggt

SEQ ID NO: 418435 - DNA, 20 bp, Artificial
  CRISPR gRNA sequence
tctccagtcaccaggaggtc

SEQ ID NO: 418436 - DNA, 20 bp, Artificial
  CRISPR gRNA sequence
ctccagtcaccaggaggtca

SEQ ID NO: 418437 - DNA, 20 bp, Artificial
  CRISPR gRNA sequence
caggaggtcagggcctcccc

SEQ ID NO: 418438 - DNA, 20 bp, Artificial
  CRISPR gRNA sequence
aggaggtcagggcctccccc

SEQ ID NO: 418439 - DNA, 20 bp, Artificial
  CRISPR gRNA sequence
gaggtcagggcctcccccag

SEQ ID NO: 418440 - DNA, 20 bp, Artificial
  CRISPR gRNA sequence
aggtcagggcctcccccagg

SEQ ID NO: 418441 - DNA, 20 bp, Artificial
  CRISPR gRNA sequence
gtcagggcctcccccaggag

SEQ ID NO: 418442 - DNA, 20 bp, Artificial
  CRISPR gRNA sequence
tcccccaggaggagtccact

SEQ ID NO: 418443 - DNA, 20 bp, Artificial
  CRISPR gRNA sequence
cccaggaggagtccacttgg

SEQ ID NO: 418444 - DNA, 20 bp, Artificial
  CRISPR gRNA sequence
ggaggagtccacttggcagt

SEQ ID NO: 418445 - DNA, 20 bp, Artificial
  CRISPR gRNA sequence
gaggagtccacttggcagtg

SEQ ID NO: 418446 - DNA, 20 bp, Artificial
  CRISPR gRNA sequence
agtccacttggcagtgagga

SEQ ID NO: 418447 - DNA, 20 bp, Artificial
  CRISPR gRNA sequence
acttggcagtgaggaaagac

SEQ ID NO: 418448 - DNA, 20 bp, Artificial
  CRISPR gRNA sequence
cttggcagtgaggaaagacc

SEQ ID NO: 418449 - DNA, 20 bp, Artificial
  CRISPR gRNA sequence
gaaagaccgggtccccacac

SEQ ID NO: 418450 - DNA, 20 bp, Artificial
  CRISPR gRNA sequence
agaccgggtccccacaccag

SEQ ID NO: 418451 - DNA, 20 bp, Artificial
  CRISPR gRNA sequence
gaccgggtccccacaccagc

SEQ ID NO: 418452 - DNA, 20 bp, Artificial
  CRISPR gRNA sequence
cgggtccccacaccagcagg

SEQ ID NO: 418453 - DNA, 20 bp, Artificial
  CRISPR gRNA sequence
gggtccccacaccagcaggc

SEQ ID NO: 418454 - DNA, 20 bp, Artificial
  CRISPR gRNA sequence
tccccacaccagcaggcagg

SEQ ID NO: 418455 - DNA, 20 bp, Artificial
  CRISPR gRNA sequence
ccacaccagcaggcaggcgg

SEQ ID NO: 418456 - DNA, 20 bp, Artificial
  CRISPR gRNA sequence
cacaccagcaggcaggcggc

SEQ ID NO: 418457 - DNA, 20 bp, Artificial
  CRISPR gRNA sequence
acaccagcaggcaggcggca

SEQ ID NO: 418458 - DNA, 20 bp, Artificial
  CRISPR gRNA sequence
ccagcaggcaggcggcaggg

SEQ ID NO: 418459 - DNA, 20 bp, Artificial
  CRISPR gRNA sequence
gcggcagggcagccccaccc

SEQ ID NO: 418460 - DNA, 20 bp, Artificial
  CRISPR gRNA sequence
ccccaccctggaacctgctc

SEQ ID NO: 418461 - DNA, 20 bp, Artificial
  CRISPR gRNA sequence
ctgctccagcgtacactgtc

SEQ ID NO: 418462 - DNA, 20 bp, Artificial
  CRISPR gRNA sequence
tgctccagcgtacactgtca

SEQ ID NO: 418463 - DNA, 20 bp, Artificial
  CRISPR gRNA sequence
gctccagcgtacactgtcaa

SEQ ID NO: 418464 - DNA, 20 bp, Artificial
  CRISPR gRNA sequence
tccagcgtacactgtcaagg

SEQ ID NO: 418465 - DNA, 20 bp, Artificial
  CRISPR gRNA sequence
gcgtacactgtcaagggagt

SEQ ID NO: 418466 - DNA, 20 bp, Artificial
  CRISPR gRNA sequence
cgtacactgtcaagggagtt

SEQ ID NO: 418467 - DNA, 20 bp, Artificial
  CRISPR gRNA sequence
gtacactgtcaagggagttg

SEQ ID NO: 418468 - DNA, 20 bp, Artificial
  CRISPR gRNA sequence
tacactgtcaagggagttgg

SEQ ID NO: 418469 - DNA, 20 bp, Artificial
  CRISPR gRNA sequence
gtcaagggagttgggggctc

SEQ ID NO: 418470 - DNA, 20 bp, Artificial
  CRISPR gRNA sequence
agttgggggctccagacctg

SEQ ID NO: 418471 - DNA, 20 bp, Artificial
  CRISPR gRNA sequence
ttgggggctccagacctgaa

SEQ ID NO: 418472 - DNA, 20 bp, Artificial
  CRISPR gRNA sequence
ggctccagacctgaagagaa

SEQ ID NO: 418473 - DNA, 20 bp, Artificial
  CRISPR gRNA sequence
tgaagagaaaagaaaaccca

SEQ ID NO: 418474 - DNA, 20 bp, Artificial
  CRISPR gRNA sequence
gaaaagaaaacccaaagtta

SEQ ID NO: 418475 - DNA, 20 bp, Artificial
  CRISPR gRNA sequence
agaaaacccaaagttaaagc

SEQ ID NO: 418476 - DNA, 20 bp, Artificial
  CRISPR gRNA sequence
gaaaacccaaagttaaagct

SEQ ID NO: 418477 - DNA, 20 bp, Artificial
  CRISPR gRNA sequence
aaagttaaagctgggtgctg

SEQ ID NO: 418478 - DNA, 20 bp, Artificial
  CRISPR gRNA sequence
gttaaagctgggtgctgcag

SEQ ID NO: 418479 - DNA, 20 bp, Artificial
  CRISPR gRNA sequence
ttaaagctgggtgctgcagt

SEQ ID NO: 418480 - DNA, 20 bp, Artificial
  CRISPR gRNA sequence
taaagctgggtgctgcagtg

SEQ ID NO: 418481 - DNA, 20 bp, Artificial
  CRISPR gRNA sequence
aagctgggtgctgcagtggg

SEQ ID NO: 418482 - DNA, 20 bp, Artificial
  CRISPR gRNA sequence
agctgggtgctgcagtgggg

SEQ ID NO: 418483 - DNA, 20 bp, Artificial
  CRISPR gRNA sequence
gctgggtgctgcagtgggga

SEQ ID NO: 418484 - DNA, 20 bp, Artificial
  CRISPR gRNA sequence
tgggtgctgcagtggggagg

SEQ ID NO: 418485 - DNA, 20 bp, Artificial
  CRISPR gRNA sequence
ctgcagtggggagggagtgc

SEQ ID NO: 418486 - DNA, 20 bp, Artificial
  CRISPR gRNA sequence
tgcagtggggagggagtgct

SEQ ID NO: 418487 - DNA, 20 bp, Artificial
  CRISPR gRNA sequence
gcagtggggagggagtgctg

SEQ ID NO: 418488 - DNA, 20 bp, Artificial
  CRISPR gRNA sequence
ggagggagtgctggggctgc

SEQ ID NO: 418489 - DNA, 20 bp, Artificial
  CRISPR gRNA sequence
gagggagtgctggggctgca

SEQ ID NO: 418490 - DNA, 20 bp, Artificial
  CRISPR gRNA sequence
ggagtgctggggctgcaagg

SEQ ID NO: 418491 - DNA, 20 bp, Artificial
  CRISPR gRNA sequence
gagtgctggggctgcaagga

SEQ ID NO: 418492 - DNA, 20 bp, Artificial
  CRISPR gRNA sequence
agtgctggggctgcaaggaa

SEQ ID NO: 418493 - DNA, 20 bp, Artificial
  CRISPR gRNA sequence
tgctggggctgcaaggaagg

SEQ ID NO: 418494 - DNA, 20 bp, Artificial
  CRISPR gRNA sequence
gctggggctgcaaggaaggg

SEQ ID NO: 418495 - DNA, 20 bp, Artificial
  CRISPR gRNA sequence
ggggctgcaaggaagggagg

SEQ ID NO: 418496 - DNA, 20 bp, Artificial
  CRISPR gRNA sequence
gctgcaaggaagggaggcag

SEQ ID NO: 418497 - DNA, 20 bp, Artificial
  CRISPR gRNA sequence
ggaagggaggcagaagaatt

SEQ ID NO: 418498 - DNA, 20 bp, Artificial
  CRISPR gRNA sequence
gaagggaggcagaagaattc

SEQ ID NO: 418499 - DNA, 20 bp, Artificial
  CRISPR gRNA sequence
agggaggcagaagaattcag

SEQ ID NO: 418500 - DNA, 20 bp, Artificial
  CRISPR gRNA sequence
aggcagaagaattcaggaga

SEQ ID NO: 418501 - DNA, 20 bp, Artificial
  CRISPR gRNA sequence
gaagaattcaggagatggtc

SEQ ID NO: 418502 - DNA, 20 bp, Artificial
  CRISPR gRNA sequence
caggagatggtctggctcat

SEQ ID NO: 418503 - DNA, 20 bp, Artificial
  CRISPR gRNA sequence
ggagatggtctggctcataa

SEQ ID NO: 418504 - DNA, 20 bp, Artificial
  CRISPR gRNA sequence
gtctggctcataagagtgct

SEQ ID NO: 418505 - DNA, 20 bp, Artificial
  CRISPR gRNA sequence
tctggctcataagagtgcta

SEQ ID NO: 418506 - DNA, 20 bp, Artificial
  CRISPR gRNA sequence
tggctcataagagtgctaag

SEQ ID NO: 418507 - DNA, 20 bp, Artificial
  CRISPR gRNA sequence
ctcataagagtgctaaggag

SEQ ID NO: 418508 - DNA, 20 bp, Artificial
  CRISPR gRNA sequence
agagtgctaaggagcagaat

SEQ ID NO: 418509 - DNA, 20 bp, Artificial
  CRISPR gRNA sequence
gagtgctaaggagcagaata

SEQ ID NO: 418510 - DNA, 20 bp, Artificial
  CRISPR gRNA sequence
aaggagcagaataaggtgat

SEQ ID NO: 418511 - DNA, 20 bp, Artificial
  CRISPR gRNA sequence
gcagaataaggtgatgagct

SEQ ID NO: 418512 - DNA, 20 bp, Artificial
  CRISPR gRNA sequence
cagaataaggtgatgagctg

SEQ ID NO: 418513 - DNA, 20 bp, Artificial
  CRISPR gRNA sequence
gaataaggtgatgagctgag

SEQ ID NO: 418514 - DNA, 20 bp, Artificial
  CRISPR gRNA sequence
aataaggtgatgagctgagg

SEQ ID NO: 418515 - DNA, 20 bp, Artificial
  CRISPR gRNA sequence
ggtgatgagctgaggaggct

SEQ ID NO: 418516 - DNA, 20 bp, Artificial
  CRISPR gRNA sequence
gctgaggaggctcagaaacc

SEQ ID NO: 418517 - DNA, 20 bp, Artificial
  CRISPR gRNA sequence
aggaggctcagaaacccagc

SEQ ID NO: 418518 - DNA, 20 bp, Artificial
  CRISPR gRNA sequence
aggctcagaaacccagcaag

SEQ ID NO: 418519 - DNA, 20 bp, Artificial
  CRISPR gRNA sequence
ggctcagaaacccagcaagt

SEQ ID NO: 418520 - DNA, 20 bp, Artificial
  CRISPR gRNA sequence
agaaacccagcaagtgggct

SEQ ID NO: 418521 - DNA, 20 bp, Artificial
  CRISPR gRNA sequence
acccagcaagtgggcttagc

SEQ ID NO: 418522 - DNA, 20 bp, Artificial
  CRISPR gRNA sequence
cagcaagtgggcttagccgg

SEQ ID NO: 418523 - DNA, 20 bp, Artificial
  CRISPR gRNA sequence
agcaagtgggcttagccgga

SEQ ID NO: 418524 - DNA, 20 bp, Artificial
  CRISPR gRNA sequence
caagtgggcttagccggaag

SEQ ID NO: 418525 - DNA, 20 bp, Artificial
  CRISPR gRNA sequence
agtgggcttagccggaagga

SEQ ID NO: 418526 - DNA, 20 bp, Artificial
  CRISPR gRNA sequence
gtgggcttagccggaaggag

SEQ ID NO: 418527 - DNA, 20 bp, Artificial
  CRISPR gRNA sequence
tgggcttagccggaaggaga

SEQ ID NO: 418528 - DNA, 20 bp, Artificial
  CRISPR gRNA sequence
gcttagccggaaggagaggg

SEQ ID NO: 418529 - DNA, 20 bp, Artificial
  CRISPR gRNA sequence
cttagccggaaggagaggga

SEQ ID NO: 418530 - DNA, 20 bp, Artificial
  CRISPR gRNA sequence
gccggaaggagagggaaggc

SEQ ID NO: 418531 - DNA, 20 bp, Artificial
  CRISPR gRNA sequence
gggaaggccggcaatgacgc

SEQ ID NO: 418532 - DNA, 20 bp, Artificial
  CRISPR gRNA sequence
aaggccggcaatgacgctgg

SEQ ID NO: 418533 - DNA, 20 bp, Artificial
  CRISPR gRNA sequence
aggccggcaatgacgctgga

SEQ ID NO: 418534 - DNA, 20 bp, Artificial
  CRISPR gRNA sequence
gcaatgacgctggaaggcca

SEQ ID NO: 418535 - DNA, 20 bp, Artificial
  CRISPR gRNA sequence
caatgacgctggaaggccac

SEQ ID NO: 418536 - DNA, 20 bp, Artificial
  CRISPR gRNA sequence
atgacgctggaaggccacgg

SEQ ID NO: 418537 - DNA, 20 bp, Artificial
  CRISPR gRNA sequence
acgctggaaggccacgggag

SEQ ID NO: 418538 - DNA, 20 bp, Artificial
  CRISPR gRNA sequence
tggaaggccacgggagaagc

SEQ ID NO: 418539 - DNA, 20 bp, Artificial
  CRISPR gRNA sequence
aaggccacgggagaagcaag

SEQ ID NO: 418540 - DNA, 20 bp, Artificial
  CRISPR gRNA sequence
aggccacgggagaagcaaga

SEQ ID NO: 418541 - DNA, 20 bp, Artificial
  CRISPR gRNA sequence
ggccacgggagaagcaagaa

SEQ ID NO: 418542 - DNA, 20 bp, Artificial
  CRISPR gRNA sequence
gccacgggagaagcaagaag

SEQ ID NO: 418543 - DNA, 20 bp, Artificial
  CRISPR gRNA sequence
ggagaagcaagaaggggtga

SEQ ID NO: 418544 - DNA, 20 bp, Artificial
  CRISPR gRNA sequence
gaagcaagaaggggtgatgg

SEQ ID NO: 418545 - DNA, 20 bp, Artificial
  CRISPR gRNA sequence
gaaggggtgatggcagctgt

SEQ ID NO: 418546 - DNA, 20 bp, Artificial
  CRISPR gRNA sequence
aaggggtgatggcagctgtg

SEQ ID NO: 418547 - DNA, 20 bp, Artificial
  CRISPR gRNA sequence
gatggcagctgtgaggctgc

SEQ ID NO: 418548 - DNA, 20 bp, Artificial
  CRISPR gRNA sequence
gtgaggctgccagcaatata

SEQ ID NO: 418549 - DNA, 20 bp, Artificial
  CRISPR gRNA sequence
tgaggctgccagcaatataa

SEQ ID NO: 418550 - DNA, 20 bp, Artificial
  CRISPR gRNA sequence
gaggctgccagcaatataaa

SEQ ID NO: 418551 - DNA, 20 bp, Artificial
  CRISPR gRNA sequence
aggctgccagcaatataaag

SEQ ID NO: 418552 - DNA, 20 bp, Artificial
  CRISPR gRNA sequence
agcaatataaaggggtcgaa

SEQ ID NO: 418553 - DNA, 20 bp, Artificial
  CRISPR gRNA sequence
atataaaggggtcgaacagt

SEQ ID NO: 418554 - DNA, 20 bp, Artificial
  CRISPR gRNA sequence
gggtcgaacagtgagaccca

SEQ ID NO: 418555 - DNA, 20 bp, Artificial
  CRISPR gRNA sequence
tgagacccacagcaatgacg

SEQ ID NO: 418556 - DNA, 20 bp, Artificial
  CRISPR gRNA sequence
gagacccacagcaatgacgt

SEQ ID NO: 418557 - DNA, 20 bp, Artificial
  CRISPR gRNA sequence
gacgtaggccactcgctgcc

SEQ ID NO: 418558 - DNA, 20 bp, Artificial
  CRISPR gRNA sequence
gccactcgctgccgagaacc

SEQ ID NO: 418559 - DNA, 20 bp, Artificial
  CRISPR gRNA sequence
tcgctgccgagaacctggtt

SEQ ID NO: 418560 - DNA, 20 bp, Artificial
  CRISPR gRNA sequence
cgctgccgagaacctggttt

SEQ ID NO: 418561 - DNA, 20 bp, Artificial
  CRISPR gRNA sequence
gctgccgagaacctggtttg

SEQ ID NO: 418562 - DNA, 20 bp, Artificial
  CRISPR gRNA sequence
gaacctggtttggggaccca

SEQ ID NO: 418563 - DNA, 20 bp, Artificial
  CRISPR gRNA sequence
ctggtttggggacccatagt

SEQ ID NO: 418564 - DNA, 20 bp, Artificial
  CRISPR gRNA sequence
tggtttggggacccatagtt

SEQ ID NO: 418565 - DNA, 20 bp, Artificial
  CRISPR gRNA sequence
ggtttggggacccatagtta

SEQ ID NO: 418566 - DNA, 20 bp, Artificial
  CRISPR gRNA sequence
gtttggggacccatagttag

SEQ ID NO: 418567 - DNA, 20 bp, Artificial
  CRISPR gRNA sequence
ttggggacccatagttaggg

SEQ ID NO: 418568 - DNA, 20 bp, Artificial
  CRISPR gRNA sequence
tggggacccatagttagggg

SEQ ID NO: 418569 - DNA, 20 bp, Artificial
  CRISPR gRNA sequence
ccatagttaggggaggtgac

SEQ ID NO: 418570 - DNA, 20 bp, Artificial
  CRISPR gRNA sequence
catagttaggggaggtgaca

SEQ ID NO: 418571 - DNA, 20 bp, Artificial
  CRISPR gRNA sequence
atagttaggggaggtgacaa

SEQ ID NO: 418572 - DNA, 20 bp, Artificial
  CRISPR gRNA sequence
tagttaggggaggtgacaag

SEQ ID NO: 418573 - DNA, 20 bp, Artificial
  CRISPR gRNA sequence
agttaggggaggtgacaagg

SEQ ID NO: 418574 - DNA, 20 bp, Artificial
  CRISPR gRNA sequence
gttaggggaggtgacaaggg

SEQ ID NO: 418575 - DNA, 20 bp, Artificial
  CRISPR gRNA sequence
aggggaggtgacaagggggg

SEQ ID NO: 418576 - DNA, 20 bp, Artificial
  CRISPR gRNA sequence
ggggaggtgacaaggggggc

SEQ ID NO: 418577 - DNA, 20 bp, Artificial
  CRISPR gRNA sequence
gaggtgacaaggggggcagg

SEQ ID NO: 418578 - DNA, 20 bp, Artificial
  CRISPR gRNA sequence
aggtgacaaggggggcagga

SEQ ID NO: 418579 - DNA, 20 bp, Artificial
  CRISPR gRNA sequence
gtgacaaggggggcaggaag

SEQ ID NO: 418580 - DNA, 20 bp, Artificial
  CRISPR gRNA sequence
aggggggcaggaaggagttg

SEQ ID NO: 418581 - DNA, 20 bp, Artificial
  CRISPR gRNA sequence
aggagttgtggtcaaatgtg

SEQ ID NO: 418582 - DNA, 20 bp, Artificial
  CRISPR gRNA sequence
agttgtggtcaaatgtgaag

SEQ ID NO: 418583 - DNA, 20 bp, Artificial
  CRISPR gRNA sequence
ttgtggtcaaatgtgaagca

SEQ ID NO: 418584 - DNA, 20 bp, Artificial
  CRISPR gRNA sequence
tggtcaaatgtgaagcagag

SEQ ID NO: 418585 - DNA, 20 bp, Artificial
  CRISPR gRNA sequence
ggtcaaatgtgaagcagagt

SEQ ID NO: 418586 - DNA, 20 bp, Artificial
  CRISPR gRNA sequence
gtcaaatgtgaagcagagtg

SEQ ID NO: 418587 - DNA, 20 bp, Artificial
  CRISPR gRNA sequence
tcaaatgtgaagcagagtgg

SEQ ID NO: 418588 - DNA, 20 bp, Artificial
  CRISPR gRNA sequence
aaatgtgaagcagagtgggg

SEQ ID NO: 418589 - DNA, 20 bp, Artificial
  CRISPR gRNA sequence
agcagagtgggggagttacc

SEQ ID NO: 418590 - DNA, 20 bp, Artificial
  CRISPR gRNA sequence
agtgggggagttacccagaa

SEQ ID NO: 418591 - DNA, 20 bp, Artificial
  CRISPR gRNA sequence
ggggagttacccagaacagt

SEQ ID NO: 418592 - DNA, 20 bp, Artificial
  CRISPR gRNA sequence
gggagttacccagaacagtg

SEQ ID NO: 418593 - DNA, 20 bp, Artificial
  CRISPR gRNA sequence
aacagtgaggttatacatga

SEQ ID NO: 418594 - DNA, 20 bp, Artificial
  CRISPR gRNA sequence
cagtgaggttatacatgatg

SEQ ID NO: 418595 - DNA, 20 bp, Artificial
  CRISPR gRNA sequence
tatacatgatggagacgttg

SEQ ID NO: 418596 - DNA, 20 bp, Artificial
  CRISPR gRNA sequence
agacgttgaagccatctctg

SEQ ID NO: 418597 - DNA, 20 bp, Artificial
  CRISPR gRNA sequence
gacgttgaagccatctctgt

SEQ ID NO: 418598 - DNA, 20 bp, Artificial
  CRISPR gRNA sequence
ttgaagccatctctgtaggt

SEQ ID NO: 418599 - DNA, 20 bp, Artificial
  CRISPR gRNA sequence
tgaagccatctctgtaggtg

SEQ ID NO: 418600 - DNA, 20 bp, Artificial
  CRISPR gRNA sequence
catctctgtaggtgaggatg

SEQ ID NO: 418601 - DNA, 20 bp, Artificial
  CRISPR gRNA sequence
tgtaggtgaggatgcagccc

SEQ ID NO: 418602 - DNA, 20 bp, Artificial
  CRISPR gRNA sequence
gtaggtgaggatgcagcccc

SEQ ID NO: 418603 - DNA, 20 bp, Artificial
  CRISPR gRNA sequence
taggtgaggatgcagcccca

SEQ ID NO: 418604 - DNA, 20 bp, Artificial
  CRISPR gRNA sequence
gaggatgcagccccagggcc

SEQ ID NO: 418605 - DNA, 20 bp, Artificial
  CRISPR gRNA sequence
ggatgcagccccagggccca

SEQ ID NO: 418606 - DNA, 20 bp, Artificial
  CRISPR gRNA sequence
gccccagggcccagagtcca

SEQ ID NO: 418607 - DNA, 20 bp, Artificial
  CRISPR gRNA sequence
ccccagggcccagagtccat

SEQ ID NO: 418608 - DNA, 20 bp, Artificial
  CRISPR gRNA sequence
cccagggcccagagtccatg

SEQ ID NO: 418609 - DNA, 20 bp, Artificial
  CRISPR gRNA sequence
cagagtccatggggctgact

SEQ ID NO: 418610 - DNA, 20 bp, Artificial
  CRISPR gRNA sequence
agagtccatggggctgactt

SEQ ID NO: 418611 - DNA, 20 bp, Artificial
  CRISPR gRNA sequence
gagtccatggggctgacttg

SEQ ID NO: 418612 - DNA, 20 bp, Artificial
  CRISPR gRNA sequence
tccatggggctgacttgggg

SEQ ID NO: 418613 - DNA, 20 bp, Artificial
  CRISPR gRNA sequence
ccatggggctgacttggggc

SEQ ID NO: 418614 - DNA, 20 bp, Artificial
  CRISPR gRNA sequence
tggggctgacttggggcagg

SEQ ID NO: 418615 - DNA, 20 bp, Artificial
  CRISPR gRNA sequence
gggctgacttggggcaggaa

SEQ ID NO: 418616 - DNA, 20 bp, Artificial
  CRISPR gRNA sequence
ggctgacttggggcaggaag

SEQ ID NO: 418617 - DNA, 20 bp, Artificial
  CRISPR gRNA sequence
tgacttggggcaggaagagg

SEQ ID NO: 418618 - DNA, 20 bp, Artificial
  CRISPR gRNA sequence
ggaagaggaagctttccgct

SEQ ID NO: 418619 - DNA, 20 bp, Artificial
  CRISPR gRNA sequence
agaggaagctttccgctaag

SEQ ID NO: 418620 - DNA, 20 bp, Artificial
  CRISPR gRNA sequence
agctttccgctaagtggtga

SEQ ID NO: 418621 - DNA, 20 bp, Artificial
  CRISPR gRNA sequence
gctttccgctaagtggtgat

SEQ ID NO: 418622 - DNA, 20 bp, Artificial
  CRISPR gRNA sequence
ctttccgctaagtggtgatg

SEQ ID NO: 418623 - DNA, 20 bp, Artificial
  CRISPR gRNA sequence
tttccgctaagtggtgatgg

SEQ ID NO: 418624 - DNA, 20 bp, Artificial
  CRISPR gRNA sequence
ttccgctaagtggtgatggg

SEQ ID NO: 418625 - DNA, 20 bp, Artificial
  CRISPR gRNA sequence
agtggtgatggggggactcc

SEQ ID NO: 418626 - DNA, 20 bp, Artificial
  CRISPR gRNA sequence
gtgatggggggactcccgga

SEQ ID NO: 418627 - DNA, 20 bp, Artificial
  CRISPR gRNA sequence
tgatggggggactcccggac

SEQ ID NO: 418628 - DNA, 20 bp, Artificial
  CRISPR gRNA sequence
gatggggggactcccggaca

SEQ ID NO: 418629 - DNA, 20 bp, Artificial
  CRISPR gRNA sequence
gggactcccggacagggact

SEQ ID NO: 418630 - DNA, 20 bp, Artificial
  CRISPR gRNA sequence
cccggacagggactcggccc

SEQ ID NO: 418631 - DNA, 20 bp, Artificial
  CRISPR gRNA sequence
cagggactcggccctggccc

SEQ ID NO: 418632 - DNA, 20 bp, Artificial
  CRISPR gRNA sequence
ctcggccctggccccggttc

SEQ ID NO: 418633 - DNA, 20 bp, Artificial
  CRISPR gRNA sequence
ccggttccggaaccaatgca

SEQ ID NO: 418634 - DNA, 20 bp, Artificial
  CRISPR gRNA sequence
ggttccggaaccaatgcaca

SEQ ID NO: 418635 - DNA, 20 bp, Artificial
  CRISPR gRNA sequence
gttccggaaccaatgcacag

SEQ ID NO: 418636 - DNA, 20 bp, Artificial
  CRISPR gRNA sequence
cggaaccaatgcacagaggc

SEQ ID NO: 418637 - DNA, 20 bp, Artificial
  CRISPR gRNA sequence
ggaaccaatgcacagaggct

SEQ ID NO: 418638 - DNA, 20 bp, Artificial
  CRISPR gRNA sequence
accaatgcacagaggctggg

SEQ ID NO: 418639 - DNA, 20 bp, Artificial
  CRISPR gRNA sequence
atgcacagaggctgggcggt

SEQ ID NO: 418640 - DNA, 20 bp, Artificial
  CRISPR gRNA sequence
tgcacagaggctgggcggtc

SEQ ID NO: 418641 - DNA, 20 bp, Artificial
  CRISPR gRNA sequence
gcacagaggctgggcggtca

SEQ ID NO: 418642 - DNA, 20 bp, Artificial
  CRISPR gRNA sequence
cagaggctgggcggtcaggg

SEQ ID NO: 418643 - DNA, 20 bp, Artificial
  CRISPR gRNA sequence
ctgggcggtcagggcggctg

SEQ ID NO: 418644 - DNA, 20 bp, Artificial
  CRISPR gRNA sequence
tgggcggtcagggcggctga

SEQ ID NO: 418645 - DNA, 20 bp, Artificial
  CRISPR gRNA sequence
ggcggtcagggcggctgaag

SEQ ID NO: 418646 - DNA, 20 bp, Artificial
  CRISPR gRNA sequence
ggtcagggcggctgaaggag

SEQ ID NO: 418647 - DNA, 20 bp, Artificial
  CRISPR gRNA sequence
aggagcagttcaaaatgacc

SEQ ID NO: 418648 - DNA, 20 bp, Artificial
  CRISPR gRNA sequence
gcagttcaaaatgacccagt

SEQ ID NO: 418649 - DNA, 20 bp, Artificial
  CRISPR gRNA sequence
agttcaaaatgacccagtcg

SEQ ID NO: 418650 - DNA, 20 bp, Artificial
  CRISPR gRNA sequence
gttcaaaatgacccagtcgg

SEQ ID NO: 418651 - DNA, 20 bp, Artificial
  CRISPR gRNA sequence
atgacccagtcggaggctct

SEQ ID NO: 418652 - DNA, 20 bp, Artificial
  CRISPR gRNA sequence
gacccagtcggaggctctga

SEQ ID NO: 418653 - DNA, 20 bp, Artificial
  CRISPR gRNA sequence
tcggaggctctgagagatcc

SEQ ID NO: 418654 - DNA, 20 bp, Artificial
  CRISPR gRNA sequence
cggaggctctgagagatcct

SEQ ID NO: 418655 - DNA, 20 bp, Artificial
  CRISPR gRNA sequence
ggaggctctgagagatcctg

SEQ ID NO: 418656 - DNA, 20 bp, Artificial
  CRISPR gRNA sequence
gaggctctgagagatcctgg

SEQ ID NO: 418657 - DNA, 20 bp, Artificial
  CRISPR gRNA sequence
aggctctgagagatcctggg

SEQ ID NO: 418658 - DNA, 20 bp, Artificial
  CRISPR gRNA sequence
tctgagagatcctggggggc

SEQ ID NO: 418659 - DNA, 20 bp, Artificial
  CRISPR gRNA sequence
gagagatcctggggggctgg

SEQ ID NO: 418660 - DNA, 20 bp, Artificial
  CRISPR gRNA sequence
ggggctggcagtcactgtgc

SEQ ID NO: 418661 - DNA, 20 bp, Artificial
  CRISPR gRNA sequence
gggctggcagtcactgtgca

SEQ ID NO: 418662 - DNA, 20 bp, Artificial
  CRISPR gRNA sequence
gcagtcactgtgcaaggata

SEQ ID NO: 418663 - DNA, 20 bp, Artificial
  CRISPR gRNA sequence
gtcactgtgcaaggataaag

SEQ ID NO: 418664 - DNA, 20 bp, Artificial
  CRISPR gRNA sequence
aaggataaagaagacttcat

SEQ ID NO: 418665 - DNA, 20 bp, Artificial
  CRISPR gRNA sequence
agaagacttcatcagcccac

SEQ ID NO: 418666 - DNA, 20 bp, Artificial
  CRISPR gRNA sequence
ctggaaacaatttcccaaca

SEQ ID NO: 418667 - DNA, 20 bp, Artificial
  CRISPR gRNA sequence
gaaacaatttcccaacacag

SEQ ID NO: 418668 - DNA, 20 bp, Artificial
  CRISPR gRNA sequence
aaacaatttcccaacacagc

SEQ ID NO: 418669 - DNA, 20 bp, Artificial
  CRISPR gRNA sequence
aacaatttcccaacacagca

SEQ ID NO: 418670 - DNA, 20 bp, Artificial
  CRISPR gRNA sequence
cccaacacagcagggctgcc

SEQ ID NO: 418671 - DNA, 20 bp, Artificial
  CRISPR gRNA sequence
acacagcagggctgccaagc

SEQ ID NO: 418672 - DNA, 20 bp, Artificial
  CRISPR gRNA sequence
cagcagggctgccaagccgg

SEQ ID NO: 418673 - DNA, 20 bp, Artificial
  CRISPR gRNA sequence
gctgccaagccggaagctcc

SEQ ID NO: 418674 - DNA, 20 bp, Artificial
  CRISPR gRNA sequence
aagccggaagctcctggaaa

SEQ ID NO: 418675 - DNA, 20 bp, Artificial
  CRISPR gRNA sequence
agccggaagctcctggaaac

SEQ ID NO: 418676 - DNA, 20 bp, Artificial
  CRISPR gRNA sequence
agctcctggaaacaggcacc

SEQ ID NO: 418677 - DNA, 20 bp, Artificial
  CRISPR gRNA sequence
tggaaacaggcacctggctt

SEQ ID NO: 418678 - DNA, 20 bp, Artificial
  CRISPR gRNA sequence
acatcaccctctccccatct

SEQ ID NO: 418679 - DNA, 20 bp, Artificial
  CRISPR gRNA sequence
cctctccccatctcagcttc

SEQ ID NO: 418680 - DNA, 20 bp, Artificial
  CRISPR gRNA sequence
ccatctcagcttccagcacc

SEQ ID NO: 418681 - DNA, 20 bp, Artificial
  CRISPR gRNA sequence
atctcagcttccagcacctg

SEQ ID NO: 418682 - DNA, 20 bp, Artificial
  CRISPR gRNA sequence
tctcagcttccagcacctgg

SEQ ID NO: 418683 - DNA, 20 bp, Artificial
  CRISPR gRNA sequence
ccagcacctggaggtgcata

SEQ ID NO: 418684 - DNA, 20 bp, Artificial
  CRISPR gRNA sequence
gcacctggaggtgcataaag

SEQ ID NO: 418685 - DNA, 20 bp, Artificial
  CRISPR gRNA sequence
ggtgcataaagtggatcccc

SEQ ID NO: 418686 - DNA, 20 bp, Artificial
  CRISPR gRNA sequence
agtggatccccaagactccc

SEQ ID NO: 418687 - DNA, 20 bp, Artificial
  CRISPR gRNA sequence
gtggatccccaagactcccc

SEQ ID NO: 418688 - DNA, 20 bp, Artificial
  CRISPR gRNA sequence
aggaccactttccccgtccc

SEQ ID NO: 418689 - DNA, 20 bp, Artificial
  CRISPR gRNA sequence
cactttccccgtccctggcc

SEQ ID NO: 418690 - DNA, 20 bp, Artificial
  CRISPR gRNA sequence
ctttccccgtccctggcctg

SEQ ID NO: 418691 - DNA, 20 bp, Artificial
  CRISPR gRNA sequence
tccctggcctggagtttact

SEQ ID NO: 418692 - DNA, 20 bp, Artificial
  CRISPR gRNA sequence
gcctggagtttacttggcat

SEQ ID NO: 418693 - DNA, 20 bp, Artificial
  CRISPR gRNA sequence
agccacccttgccgttttcc

SEQ ID NO: 418694 - DNA, 20 bp, Artificial
  CRISPR gRNA sequence
cccttgccgttttcctggcc

SEQ ID NO: 418695 - DNA, 20 bp, Artificial
  CRISPR gRNA sequence
tcctggcctggaaccccgcg

SEQ ID NO: 418696 - DNA, 20 bp, Artificial
  CRISPR gRNA sequence
ccccgcgaagcccaccccct

SEQ ID NO: 418697 - DNA, 20 bp, Artificial
  CRISPR gRNA sequence
gaagcccaccccctgagcta

SEQ ID NO: 418698 - DNA, 20 bp, Artificial
  CRISPR gRNA sequence
atatctgaaatgaatcactt

SEQ ID NO: 418699 - DNA, 20 bp, Artificial
  CRISPR gRNA sequence
tccccccctccccctccctc

SEQ ID NO: 418700 - DNA, 20 bp, Artificial
  CRISPR gRNA sequence
ccccccctccccctccctct

SEQ ID NO: 418701 - DNA, 20 bp, Artificial
  CRISPR gRNA sequence
tccctctgggcactcccgcg

SEQ ID NO: 418702 - DNA, 20 bp, Artificial
  CRISPR gRNA sequence
ccctctgggcactcccgcgt

SEQ ID NO: 418703 - DNA, 20 bp, Artificial
  CRISPR gRNA sequence
tctgggcactcccgcgtggg

SEQ ID NO: 418704 - DNA, 20 bp, Artificial
  CRISPR gRNA sequence
ctgggcactcccgcgtgggt

SEQ ID NO: 418705 - DNA, 20 bp, Artificial
  CRISPR gRNA sequence
gggcactcccgcgtgggtgg

SEQ ID NO: 418706 - DNA, 20 bp, Artificial
  CRISPR gRNA sequence
cactcccgcgtgggtgggag

SEQ ID NO: 418707 - DNA, 20 bp, Artificial
  CRISPR gRNA sequence
actcccgcgtgggtgggaga

SEQ ID NO: 418708 - DNA, 20 bp, Artificial
  CRISPR gRNA sequence
ctcccgcgtgggtgggagaa

SEQ ID NO: 418709 - DNA, 20 bp, Artificial
  CRISPR gRNA sequence
tcccgcgtgggtgggagaag

SEQ ID NO: 418710 - DNA, 20 bp, Artificial
  CRISPR gRNA sequence
ccgcgtgggtgggagaaggg

SEQ ID NO: 418711 - DNA, 20 bp, Artificial
  CRISPR gRNA sequence
tgggtgggagaaggggagct

SEQ ID NO: 418712 - DNA, 20 bp, Artificial
  CRISPR gRNA sequence
gggtgggagaaggggagctc

SEQ ID NO: 418713 - DNA, 20 bp, Artificial
  CRISPR gRNA sequence
ggtgggagaaggggagctcg

SEQ ID NO: 418714 - DNA, 20 bp, Artificial
  CRISPR gRNA sequence
gtgggagaaggggagctcgg

SEQ ID NO: 418715 - DNA, 20 bp, Artificial
  CRISPR gRNA sequence
ggggtgacacaatctctcca

SEQ ID NO: 418716 - DNA, 20 bp, Artificial
  CRISPR gRNA sequence
gggtgacacaatctctccac

SEQ ID NO: 418717 - DNA, 20 bp, Artificial
  CRISPR gRNA sequence
ggtgacacaatctctccaca

SEQ ID NO: 418718 - DNA, 20 bp, Artificial
  CRISPR gRNA sequence
ggccccccatacacgtgctt

SEQ ID NO: 418719 - DNA, 20 bp, Artificial
  CRISPR gRNA sequence
gccccccatacacgtgcttc

SEQ ID NO: 418720 - DNA, 20 bp, Artificial
  CRISPR gRNA sequence
ccccccatacacgtgcttcg

SEQ ID NO: 418721 - DNA, 20 bp, Artificial
  CRISPR gRNA sequence
cccccatacacgtgcttcgg

SEQ ID NO: 418722 - DNA, 20 bp, Artificial
  CRISPR gRNA sequence
ttcgggggcaccttccactc

SEQ ID NO: 418723 - DNA, 20 bp, Artificial
  CRISPR gRNA sequence
gggggcaccttccactccag

SEQ ID NO: 418724 - DNA, 20 bp, Artificial
  CRISPR gRNA sequence
ggggcaccttccactccagc

SEQ ID NO: 418725 - DNA, 20 bp, Artificial
  CRISPR gRNA sequence
acccccttcctctactcttc

SEQ ID NO: 418726 - DNA, 20 bp, Artificial
  CRISPR gRNA sequence
cccccttcctctactcttct

SEQ ID NO: 418727 - DNA, 20 bp, Artificial
  CRISPR gRNA sequence
cccttcctctactcttctgg

SEQ ID NO: 418728 - DNA, 20 bp, Artificial
  CRISPR gRNA sequence
ctcttctgggagctctccga

SEQ ID NO: 418729 - DNA, 20 bp, Artificial
  CRISPR gRNA sequence
tcttctgggagctctccgac

SEQ ID NO: 418730 - DNA, 20 bp, Artificial
  CRISPR gRNA sequence
cttctgggagctctccgaca

SEQ ID NO: 418731 - DNA, 20 bp, Artificial
  CRISPR gRNA sequence
gggagctctccgacagggcc

SEQ ID NO: 418732 - DNA, 20 bp, Artificial
  CRISPR gRNA sequence
ggagctctccgacagggcct

SEQ ID NO: 418733 - DNA, 20 bp, Artificial
  CRISPR gRNA sequence
gagctctccgacagggccta

SEQ ID NO: 418734 - DNA, 20 bp, Artificial
  CRISPR gRNA sequence
ctccgacagggcctagggcg

SEQ ID NO: 418735 - DNA, 20 bp, Artificial
  CRISPR gRNA sequence
ctagggcgcagcctctgccc

SEQ ID NO: 418736 - DNA, 20 bp, Artificial
  CRISPR gRNA sequence
ccccagcccttcctgcgtcc

SEQ ID NO: 418737 - DNA, 20 bp, Artificial
  CRISPR gRNA sequence
cccagcccttcctgcgtccc

SEQ ID NO: 418738 - DNA, 20 bp, Artificial
  CRISPR gRNA sequence
cagcccttcctgcgtcccgg

SEQ ID NO: 418739 - DNA, 20 bp, Artificial
  CRISPR gRNA sequence
agcccttcctgcgtcccggg

SEQ ID NO: 418740 - DNA, 20 bp, Artificial
  CRISPR gRNA sequence
ccttcctgcgtcccgggagg

SEQ ID NO: 418741 - DNA, 20 bp, Artificial
  CRISPR gRNA sequence
cttcctgcgtcccgggaggc

SEQ ID NO: 418742 - DNA, 20 bp, Artificial
  CRISPR gRNA sequence
ttcctgcgtcccgggaggca

SEQ ID NO: 418743 - DNA, 20 bp, Artificial
  CRISPR gRNA sequence
tcctgcgtcccgggaggcag

SEQ ID NO: 418744 - DNA, 20 bp, Artificial
  CRISPR gRNA sequence
gcgtcccgggaggcagggga

SEQ ID NO: 418745 - DNA, 20 bp, Artificial
  CRISPR gRNA sequence
cgtcccgggaggcaggggat

SEQ ID NO: 418746 - DNA, 20 bp, Artificial
  CRISPR gRNA sequence
gtcccgggaggcaggggatg

SEQ ID NO: 418747 - DNA, 20 bp, Artificial
  CRISPR gRNA sequence
ggggatggggacccacctcc

SEQ ID NO: 418748 - DNA, 20 bp, Artificial
  CRISPR gRNA sequence
tcgtcccgccccacatactc

SEQ ID NO: 418749 - DNA, 20 bp, Artificial
  CRISPR gRNA sequence
cgtcccgccccacatactcg

SEQ ID NO: 418750 - DNA, 20 bp, Artificial
  CRISPR gRNA sequence
cgccccacatactcgaggcc

SEQ ID NO: 418751 - DNA, 20 bp, Artificial
  CRISPR gRNA sequence
cacatactcgaggcctggcc

SEQ ID NO: 418752 - DNA, 20 bp, Artificial
  CRISPR gRNA sequence
acatactcgaggcctggccc

SEQ ID NO: 418753 - DNA, 20 bp, Artificial
  CRISPR gRNA sequence
ctcgaggcctggcccaggcg

SEQ ID NO: 418754 - DNA, 20 bp, Artificial
  CRISPR gRNA sequence
aggcctggcccaggcgcaga

SEQ ID NO: 418755 - DNA, 20 bp, Artificial
  CRISPR gRNA sequence
gcctggcccaggcgcagacg

SEQ ID NO: 418756 - DNA, 20 bp, Artificial
  CRISPR gRNA sequence
cctggcccaggcgcagacgg

SEQ ID NO: 418757 - DNA, 20 bp, Artificial
  CRISPR gRNA sequence
ggcccaggcgcagacggagg

SEQ ID NO: 418758 - DNA, 20 bp, Artificial
  CRISPR gRNA sequence
ccaggcgcagacggaggcgg

SEQ ID NO: 418759 - DNA, 20 bp, Artificial
  CRISPR gRNA sequence
caggcgcagacggaggcggc

SEQ ID NO: 418760 - DNA, 20 bp, Artificial
  CRISPR gRNA sequence
ggcgcagacggaggcggcag

SEQ ID NO: 418761 - DNA, 20 bp, Artificial
  CRISPR gRNA sequence
cgcagacggaggcggcagga

SEQ ID NO: 418762 - DNA, 20 bp, Artificial
  CRISPR gRNA sequence
gcagacggaggcggcaggag

SEQ ID NO: 418763 - DNA, 20 bp, Artificial
  CRISPR gRNA sequence
cagacggaggcggcaggaga

SEQ ID NO: 418764 - DNA, 20 bp, Artificial
  CRISPR gRNA sequence
ggaggcggcaggagagggcg

SEQ ID NO: 418765 - DNA, 20 bp, Artificial
  CRISPR gRNA sequence
caggagagggcgcggtccct

SEQ ID NO: 418766 - DNA, 20 bp, Artificial
  CRISPR gRNA sequence
aggagagggcgcggtccctg

SEQ ID NO: 418767 - DNA, 20 bp, Artificial
  CRISPR gRNA sequence
gcggtccctgaggtgcaccg

SEQ ID NO: 418768 - DNA, 20 bp, Artificial
  CRISPR gRNA sequence
ccctgaggtgcaccgcggcg

SEQ ID NO: 418769 - DNA, 20 bp, Artificial
  CRISPR gRNA sequence
caccgcggcgcggtactcgc

SEQ ID NO: 418770 - DNA, 20 bp, Artificial
  CRISPR gRNA sequence
actcgccggcgtccgcgcgc

SEQ ID NO: 418771 - DNA, 20 bp, Artificial
  CRISPR gRNA sequence
ctcgccggcgtccgcgcgcc

SEQ ID NO: 418772 - DNA, 20 bp, Artificial
  CRISPR gRNA sequence
ccggcgtccgcgcgccgggc

SEQ ID NO: 418773 - DNA, 20 bp, Artificial
  CRISPR gRNA sequence
cggcgtccgcgcgccgggct

SEQ ID NO: 418774 - DNA, 20 bp, Artificial
  CRISPR gRNA sequence
tccgcgcgccgggctgggcg

SEQ ID NO: 418775 - DNA, 20 bp, Artificial
  CRISPR gRNA sequence
cgccgggctgggcgcagcca

SEQ ID NO: 418776 - DNA, 20 bp, Artificial
  CRISPR gRNA sequence
gggctgggcgcagccatagc

SEQ ID NO: 418777 - DNA, 20 bp, Artificial
  CRISPR gRNA sequence
ctgggcgcagccatagcgag

SEQ ID NO: 418778 - DNA, 20 bp, Artificial
  CRISPR gRNA sequence
gcgagaagtccccgcgctgc

SEQ ID NO: 418779 - DNA, 20 bp, Artificial
  CRISPR gRNA sequence
cgctgccggccgcgctcatc

SEQ ID NO: 418780 - DNA, 20 bp, Artificial
  CRISPR gRNA sequence
gccggccgcgctcatccagc

SEQ ID NO: 418781 - DNA, 20 bp, Artificial
  CRISPR gRNA sequence
cgcgctcatccagctggacg

SEQ ID NO: 418782 - DNA, 20 bp, Artificial
  CRISPR gRNA sequence
gcgctcatccagctggacgc

SEQ ID NO: 418783 - DNA, 20 bp, Artificial
  CRISPR gRNA sequence
cgctcatccagctggacgcg

SEQ ID NO: 418784 - DNA, 20 bp, Artificial
  CRISPR gRNA sequence
tccagctggacgcggggctg

SEQ ID NO: 418785 - DNA, 20 bp, Artificial
  CRISPR gRNA sequence
ccagctggacgcggggctgc

SEQ ID NO: 418786 - DNA, 20 bp, Artificial
  CRISPR gRNA sequence
cagctggacgcggggctgca

SEQ ID NO: 418787 - DNA, 20 bp, Artificial
  CRISPR gRNA sequence
agctggacgcggggctgcag

SEQ ID NO: 418788 - DNA, 20 bp, Artificial
  CRISPR gRNA sequence
tggacgcggggctgcagggg

SEQ ID NO: 418789 - DNA, 20 bp, Artificial
  CRISPR gRNA sequence
aggggcagcctcccgctgcg

SEQ ID NO: 418790 - DNA, 20 bp, Artificial
  CRISPR gRNA sequence
ggggcagcctcccgctgcgc

SEQ ID NO: 418791 - DNA, 20 bp, Artificial
  CRISPR gRNA sequence
cctcccgctgcgcaggcctc

SEQ ID NO: 418792 - DNA, 20 bp, Artificial
  CRISPR gRNA sequence
ctcccgctgcgcaggcctcc

SEQ ID NO: 418793 - DNA, 20 bp, Artificial
  CRISPR gRNA sequence
aggcctccgggacccacgct

SEQ ID NO: 418794 - DNA, 20 bp, Artificial
  CRISPR gRNA sequence
gacccacgctcagcaccgtg

SEQ ID NO: 418795 - DNA, 20 bp, Artificial
  CRISPR gRNA sequence
ccacgctcagcaccgtgtag

SEQ ID NO: 418796 - DNA, 20 bp, Artificial
  CRISPR gRNA sequence
cgctcagcaccgtgtagcgg

SEQ ID NO: 418797 - DNA, 20 bp, Artificial
  CRISPR gRNA sequence
gctcagcaccgtgtagcggc

SEQ ID NO: 418798 - DNA, 20 bp, Artificial
  CRISPR gRNA sequence
ctcagcaccgtgtagcggcg

SEQ ID NO: 418799 - DNA, 20 bp, Artificial
  CRISPR gRNA sequence
caccgtgtagcggcggggcc

SEQ ID NO: 418800 - DNA, 20 bp, Artificial
  CRISPR gRNA sequence
accgtgtagcggcggggcct

SEQ ID NO: 418801 - DNA, 20 bp, Artificial
  CRISPR gRNA sequence
agcggcggggcctgggcccc

SEQ ID NO: 418802 - DNA, 20 bp, Artificial
  CRISPR gRNA sequence
gcggcggggcctgggccccc

SEQ ID NO: 418803 - DNA, 20 bp, Artificial
  CRISPR gRNA sequence
ggcggggcctgggcccccag

SEQ ID NO: 418804 - DNA, 20 bp, Artificial
  CRISPR gRNA sequence
gcggggcctgggcccccagg

SEQ ID NO: 418805 - DNA, 20 bp, Artificial
  CRISPR gRNA sequence
ggggcctgggcccccaggag

SEQ ID NO: 418806 - DNA, 20 bp, Artificial
  CRISPR gRNA sequence
gggcctgggcccccaggagg

SEQ ID NO: 418807 - DNA, 20 bp, Artificial
  CRISPR gRNA sequence
ggcctgggcccccaggagga

SEQ ID NO: 418808 - DNA, 20 bp, Artificial
  CRISPR gRNA sequence
ccccaggaggagggcgccgc

SEQ ID NO: 418809 - DNA, 20 bp, Artificial
  CRISPR gRNA sequence
cccaggaggagggcgccgcc

SEQ ID NO: 418810 - DNA, 20 bp, Artificial
  CRISPR gRNA sequence
ggaggagggcgccgccgggt

SEQ ID NO: 418811 - DNA, 20 bp, Artificial
  CRISPR gRNA sequence
gaggagggcgccgccgggtg

SEQ ID NO: 418812 - DNA, 20 bp, Artificial
  CRISPR gRNA sequence
aggagggcgccgccgggtga

SEQ ID NO: 418813 - DNA, 20 bp, Artificial
  CRISPR gRNA sequence
gggcgccgccgggtgagggc

SEQ ID NO: 418814 - DNA, 20 bp, Artificial
  CRISPR gRNA sequence
ggcgccgccgggtgagggcc

SEQ ID NO: 418815 - DNA, 20 bp, Artificial
  CRISPR gRNA sequence
gcgccgccgggtgagggccg

SEQ ID NO: 418816 - DNA, 20 bp, Artificial
  CRISPR gRNA sequence
cgccgccgggtgagggccgg

SEQ ID NO: 418817 - DNA, 20 bp, Artificial
  CRISPR gRNA sequence
gccgggtgagggccgggggc

SEQ ID NO: 418818 - DNA, 20 bp, Artificial
  CRISPR gRNA sequence
ccgggtgagggccgggggcc

SEQ ID NO: 418819 - DNA, 20 bp, Artificial
  CRISPR gRNA sequence
cgggtgagggccgggggcca

SEQ ID NO: 418820 - DNA, 20 bp, Artificial
  CRISPR gRNA sequence
gggtgagggccgggggccag

SEQ ID NO: 418821 - DNA, 20 bp, Artificial
  CRISPR gRNA sequence
gagggccgggggccagggga

SEQ ID NO: 418822 - DNA, 20 bp, Artificial
  CRISPR gRNA sequence
gccgggggccaggggatggc

SEQ ID NO: 418823 - DNA, 20 bp, Artificial
  CRISPR gRNA sequence
ccgggggccaggggatggcc

SEQ ID NO: 418824 - DNA, 20 bp, Artificial
  CRISPR gRNA sequence
cgggggccaggggatggccg

SEQ ID NO: 418825 - DNA, 20 bp, Artificial
  CRISPR gRNA sequence
gggggccaggggatggccgg

SEQ ID NO: 418826 - DNA, 20 bp, Artificial
  CRISPR gRNA sequence
ggccaggggatggccggggg

SEQ ID NO: 418827 - DNA, 20 bp, Artificial
  CRISPR gRNA sequence
caggggatggccgggggcgg

SEQ ID NO: 418828 - DNA, 20 bp, Artificial
  CRISPR gRNA sequence
gggatggccgggggcggcag

SEQ ID NO: 418829 - DNA, 20 bp, Artificial
  CRISPR gRNA sequence
ggatggccgggggcggcagc

SEQ ID NO: 418830 - DNA, 20 bp, Artificial
  CRISPR gRNA sequence
tggccgggggcggcagcggg

SEQ ID NO: 418831 - DNA, 20 bp, Artificial
  CRISPR gRNA sequence
ggccgggggcggcagcgggc

SEQ ID NO: 418832 - DNA, 20 bp, Artificial
  CRISPR gRNA sequence
ggcggcagcgggcgggccac

SEQ ID NO: 418833 - DNA, 20 bp, Artificial
  CRISPR gRNA sequence
gcggcagcgggcgggccact

SEQ ID NO: 418834 - DNA, 20 bp, Artificial
  CRISPR gRNA sequence
gcagcgggcgggccactggg

SEQ ID NO: 418835 - DNA, 20 bp, Artificial
  CRISPR gRNA sequence
cagcgggcgggccactgggc

SEQ ID NO: 418836 - DNA, 20 bp, Artificial
  CRISPR gRNA sequence
gggcgggccactgggcggga

SEQ ID NO: 418837 - DNA, 20 bp, Artificial
  CRISPR gRNA sequence
gcgggccactgggcgggaaa

SEQ ID NO: 418838 - DNA, 20 bp, Artificial
  CRISPR gRNA sequence
ccactgggcgggaaagagaa

SEQ ID NO: 418839 - DNA, 20 bp, Artificial
  CRISPR gRNA sequence
actgggcgggaaagagaatg

SEQ ID NO: 418840 - DNA, 20 bp, Artificial
  CRISPR gRNA sequence
gcgggaaagagaatggagtt

SEQ ID NO: 418841 - DNA, 20 bp, Artificial
  CRISPR gRNA sequence
ggaaagagaatggagttgag

SEQ ID NO: 418842 - DNA, 20 bp, Artificial
  CRISPR gRNA sequence
agaatggagttgagaagctc

SEQ ID NO: 418843 - DNA, 20 bp, Artificial
  CRISPR gRNA sequence
gaatggagttgagaagctcc

SEQ ID NO: 418844 - DNA, 20 bp, Artificial
  CRISPR gRNA sequence
aatggagttgagaagctcca

SEQ ID NO: 418845 - DNA, 20 bp, Artificial
  CRISPR gRNA sequence
atggagttgagaagctccag

SEQ ID NO: 418846 - DNA, 20 bp, Artificial
  CRISPR gRNA sequence
gagttgagaagctccagggg

SEQ ID NO: 418847 - DNA, 20 bp, Artificial
  CRISPR gRNA sequence
agttgagaagctccaggggt

SEQ ID NO: 418848 - DNA, 20 bp, Artificial
  CRISPR gRNA sequence
tgagaagctccaggggtagg

SEQ ID NO: 418849 - DNA, 20 bp, Artificial
  CRISPR gRNA sequence
agctccaggggtaggaagcc

SEQ ID NO: 418850 - DNA, 20 bp, Artificial
  CRISPR gRNA sequence
gctccaggggtaggaagccc

SEQ ID NO: 418851 - DNA, 20 bp, Artificial
  CRISPR gRNA sequence
tccaggggtaggaagcccgg

SEQ ID NO: 418852 - DNA, 20 bp, Artificial
  CRISPR gRNA sequence
ccaggggtaggaagcccggg

SEQ ID NO: 418853 - DNA, 20 bp, Artificial
  CRISPR gRNA sequence
gtaggaagcccgggaggatg

SEQ ID NO: 418854 - DNA, 20 bp, Artificial
  CRISPR gRNA sequence
taggaagcccgggaggatgc

SEQ ID NO: 418855 - DNA, 20 bp, Artificial
  CRISPR gRNA sequence
gaagcccgggaggatgcagg

SEQ ID NO: 418856 - DNA, 20 bp, Artificial
  CRISPR gRNA sequence
gatgcaggcagccacccgtt

SEQ ID NO: 418857 - DNA, 20 bp, Artificial
  CRISPR gRNA sequence
atgcaggcagccacccgttg

SEQ ID NO: 418858 - DNA, 20 bp, Artificial
  CRISPR gRNA sequence
ggcagccacccgttgaggat

SEQ ID NO: 418859 - DNA, 20 bp, Artificial
  CRISPR gRNA sequence
gccacccgttgaggatgaga

SEQ ID NO: 418860 - DNA, 20 bp, Artificial
  CRISPR gRNA sequence
aggatgagaaagcccgcccc

SEQ ID NO: 418861 - DNA, 20 bp, Artificial
  CRISPR gRNA sequence
gatgagaaagcccgccccaa

SEQ ID NO: 418862 - DNA, 20 bp, Artificial
  CRISPR gRNA sequence
ctcacgcccgacccctctgt

SEQ ID NO: 418863 - DNA, 20 bp, Artificial
  CRISPR gRNA sequence
gcccgacccctctgttggac

SEQ ID NO: 418864 - DNA, 20 bp, Artificial
  CRISPR gRNA sequence
ggactggccgcatccacttc

SEQ ID NO: 418865 - DNA, 20 bp, Artificial
  CRISPR gRNA sequence
actggccgcatccacttctg

SEQ ID NO: 418866 - DNA, 20 bp, Artificial
  CRISPR gRNA sequence
tggccgcatccacttctgga

SEQ ID NO: 418867 - DNA, 20 bp, Artificial
  CRISPR gRNA sequence
ccgcatccacttctggagag

SEQ ID NO: 418868 - DNA, 20 bp, Artificial
  CRISPR gRNA sequence
cgcatccacttctggagaga

SEQ ID NO: 418869 - DNA, 20 bp, Artificial
  CRISPR gRNA sequence
gcatccacttctggagagaa

SEQ ID NO: 418870 - DNA, 20 bp, Artificial
  CRISPR gRNA sequence
cttctggagagaagggatgc

SEQ ID NO: 418871 - DNA, 20 bp, Artificial
  CRISPR gRNA sequence
gagagaagggatgctggcgt

SEQ ID NO: 418872 - DNA, 20 bp, Artificial
  CRISPR gRNA sequence
agagaagggatgctggcgtg

SEQ ID NO: 418873 - DNA, 20 bp, Artificial
  CRISPR gRNA sequence
gagaagggatgctggcgtga

SEQ ID NO: 418874 - DNA, 20 bp, Artificial
  CRISPR gRNA sequence
ggcgtgagggtcgctgattg

SEQ ID NO: 418875 - DNA, 20 bp, Artificial
  CRISPR gRNA sequence
cgtgagggtcgctgattgca

SEQ ID NO: 418876 - DNA, 20 bp, Artificial
  CRISPR gRNA sequence
agggtcgctgattgcagagc

SEQ ID NO: 418877 - DNA, 20 bp, Artificial
  CRISPR gRNA sequence
gggtcgctgattgcagagca

SEQ ID NO: 418878 - DNA, 20 bp, Artificial
  CRISPR gRNA sequence
ggtcgctgattgcagagcaa

SEQ ID NO: 418879 - DNA, 20 bp, Artificial
  CRISPR gRNA sequence
cgctgattgcagagcaaggg

SEQ ID NO: 418880 - DNA, 20 bp, Artificial
  CRISPR gRNA sequence
gctgattgcagagcaagggc

SEQ ID NO: 418881 - DNA, 20 bp, Artificial
  CRISPR gRNA sequence
ttgcagagcaagggcaggaa

SEQ ID NO: 418882 - DNA, 20 bp, Artificial
  CRISPR gRNA sequence
agcaagggcaggaacggtgc

SEQ ID NO: 418883 - DNA, 20 bp, Artificial
  CRISPR gRNA sequence
agggcaggaacggtgcaagc

SEQ ID NO: 418884 - DNA, 20 bp, Artificial
  CRISPR gRNA sequence
gggcaggaacggtgcaagcg

SEQ ID NO: 418885 - DNA, 20 bp, Artificial
  CRISPR gRNA sequence
ggcaggaacggtgcaagcga

SEQ ID NO: 418886 - DNA, 20 bp, Artificial
  CRISPR gRNA sequence
aggaacggtgcaagcgaggg

SEQ ID NO: 418887 - DNA, 20 bp, Artificial
  CRISPR gRNA sequence
ggaacggtgcaagcgagggc

SEQ ID NO: 418888 - DNA, 20 bp, Artificial
  CRISPR gRNA sequence
gaacggtgcaagcgagggca

SEQ ID NO: 418889 - DNA, 20 bp, Artificial
  CRISPR gRNA sequence
acggtgcaagcgagggcagg

SEQ ID NO: 418890 - DNA, 20 bp, Artificial
  CRISPR gRNA sequence
gcaagcgagggcagggagac

SEQ ID NO: 418891 - DNA, 20 bp, Artificial
  CRISPR gRNA sequence
caagcgagggcagggagact

SEQ ID NO: 418892 - DNA, 20 bp, Artificial
  CRISPR gRNA sequence
gggcagggagactgggtcac

SEQ ID NO: 418893 - DNA, 20 bp, Artificial
  CRISPR gRNA sequence
ggagactgggtcactggctt

SEQ ID NO: 418894 - DNA, 20 bp, Artificial
  CRISPR gRNA sequence
agactgggtcactggcttca

SEQ ID NO: 418895 - DNA, 20 bp, Artificial
  CRISPR gRNA sequence
gactgggtcactggcttcag

SEQ ID NO: 418896 - DNA, 20 bp, Artificial
  CRISPR gRNA sequence
actgggtcactggcttcaga

SEQ ID NO: 418897 - DNA, 20 bp, Artificial
  CRISPR gRNA sequence
tgggtcactggcttcagagg

SEQ ID NO: 418898 - DNA, 20 bp, Artificial
  CRISPR gRNA sequence
cttcagagggagtgacacct

SEQ ID NO: 418899 - DNA, 20 bp, Artificial
  CRISPR gRNA sequence
ttcagagggagtgacacctc

SEQ ID NO: 418900 - DNA, 20 bp, Artificial
  CRISPR gRNA sequence
tcagagggagtgacacctca

SEQ ID NO: 418901 - DNA, 20 bp, Artificial
  CRISPR gRNA sequence
gagggagtgacacctcaggg

SEQ ID NO: 418902 - DNA, 20 bp, Artificial
  CRISPR gRNA sequence
agggagtgacacctcagggc

SEQ ID NO: 418903 - DNA, 20 bp, Artificial
  CRISPR gRNA sequence
gggagtgacacctcagggca

SEQ ID NO: 418904 - DNA, 20 bp, Artificial
  CRISPR gRNA sequence
ggagtgacacctcagggcag

SEQ ID NO: 418905 - DNA, 20 bp, Artificial
  CRISPR gRNA sequence
tgacacctcagggcagggga

SEQ ID NO: 418906 - DNA, 20 bp, Artificial
  CRISPR gRNA sequence
acacctcagggcaggggaca

SEQ ID NO: 418907 - DNA, 20 bp, Artificial
  CRISPR gRNA sequence
cacctcagggcaggggacag

SEQ ID NO: 418908 - DNA, 20 bp, Artificial
  CRISPR gRNA sequence
cagggcaggggacagaggac

SEQ ID NO: 418909 - DNA, 20 bp, Artificial
  CRISPR gRNA sequence
caggggacagaggaccggca

SEQ ID NO: 418910 - DNA, 20 bp, Artificial
  CRISPR gRNA sequence
aggggacagaggaccggcac

SEQ ID NO: 418911 - DNA, 20 bp, Artificial
  CRISPR gRNA sequence
acagaggaccggcacgggtg

SEQ ID NO: 418912 - DNA, 20 bp, Artificial
  CRISPR gRNA sequence
cagaggaccggcacgggtgt

SEQ ID NO: 418913 - DNA, 20 bp, Artificial
  CRISPR gRNA sequence
agaggaccggcacgggtgtg

SEQ ID NO: 418914 - DNA, 20 bp, Artificial
  CRISPR gRNA sequence
accggcacgggtgtggggtt

SEQ ID NO: 418915 - DNA, 20 bp, Artificial
  CRISPR gRNA sequence
acgggtgtggggttgagtgc

SEQ ID NO: 418916 - DNA, 20 bp, Artificial
  CRISPR gRNA sequence
gtggggttgagtgctggatt

SEQ ID NO: 418917 - DNA, 20 bp, Artificial
  CRISPR gRNA sequence
ggggttgagtgctggattcg

SEQ ID NO: 418918 - DNA, 20 bp, Artificial
  CRISPR gRNA sequence
gggttgagtgctggattcgg

SEQ ID NO: 418919 - DNA, 20 bp, Artificial
  CRISPR gRNA sequence
attcggaggtcctgttgccc

SEQ ID NO: 418920 - DNA, 20 bp, Artificial
  CRISPR gRNA sequence
gaggtcctgttgcccaagtt

SEQ ID NO: 418921 - DNA, 20 bp, Artificial
  CRISPR gRNA sequence
aggtcctgttgcccaagttt

SEQ ID NO: 418922 - DNA, 20 bp, Artificial
  CRISPR gRNA sequence
ggtcctgttgcccaagtttg

SEQ ID NO: 418923 - DNA, 20 bp, Artificial
  CRISPR gRNA sequence
gtttggggtgcatacctgtc

SEQ ID NO: 418924 - DNA, 20 bp, Artificial
  CRISPR gRNA sequence
cctgtctggctgatgctgcc

SEQ ID NO: 418925 - DNA, 20 bp, Artificial
  CRISPR gRNA sequence
caagtgacccctgctcttcg

SEQ ID NO: 418926 - DNA, 20 bp, Artificial
  CRISPR gRNA sequence
gtgacccctgctcttcgcag

SEQ ID NO: 418927 - DNA, 20 bp, Artificial
  CRISPR gRNA sequence
tgacccctgctcttcgcaga

SEQ ID NO: 418928 - DNA, 20 bp, Artificial
  CRISPR gRNA sequence
cctgctcttcgcagaaggct

SEQ ID NO: 418929 - DNA, 20 bp, Artificial
  CRISPR gRNA sequence
ttcgcagaaggctgagatcc

SEQ ID NO: 418930 - DNA, 20 bp, Artificial
  CRISPR gRNA sequence
cgcagaaggctgagatcctg

SEQ ID NO: 418931 - DNA, 20 bp, Artificial
  CRISPR gRNA sequence
gcagaaggctgagatcctgg

SEQ ID NO: 418932 - DNA, 20 bp, Artificial
  CRISPR gRNA sequence
cagaaggctgagatcctgga

SEQ ID NO: 418933 - DNA, 20 bp, Artificial
  CRISPR gRNA sequence
agaaggctgagatcctggag

SEQ ID NO: 418934 - DNA, 20 bp, Artificial
  CRISPR gRNA sequence
gaaggctgagatcctggagg

SEQ ID NO: 418935 - DNA, 20 bp, Artificial
  CRISPR gRNA sequence
gagatcctggagggggattg

SEQ ID NO: 418936 - DNA, 20 bp, Artificial
  CRISPR gRNA sequence
agatcctggagggggattgt

SEQ ID NO: 418937 - DNA, 20 bp, Artificial
  CRISPR gRNA sequence
gatcctggagggggattgtg

SEQ ID NO: 418938 - DNA, 20 bp, Artificial
  CRISPR gRNA sequence
ggagggggattgtggggctg

SEQ ID NO: 418939 - DNA, 20 bp, Artificial
  CRISPR gRNA sequence
gagggggattgtggggctgc

SEQ ID NO: 418940 - DNA, 20 bp, Artificial
  CRISPR gRNA sequence
agggggattgtggggctgca

SEQ ID NO: 418941 - DNA, 20 bp, Artificial
  CRISPR gRNA sequence
gggggattgtggggctgcag

SEQ ID NO: 418942 - DNA, 20 bp, Artificial
  CRISPR gRNA sequence
gggattgtggggctgcaggg

SEQ ID NO: 418943 - DNA, 20 bp, Artificial
  CRISPR gRNA sequence
ttgtggggctgcaggggagc

SEQ ID NO: 418944 - DNA, 20 bp, Artificial
  CRISPR gRNA sequence
tgtggggctgcaggggagct

SEQ ID NO: 418945 - DNA, 20 bp, Artificial
  CRISPR gRNA sequence
ggggctgcaggggagctggg

SEQ ID NO: 418946 - DNA, 20 bp, Artificial
  CRISPR gRNA sequence
gggctgcaggggagctgggc

SEQ ID NO: 418947 - DNA, 20 bp, Artificial
  CRISPR gRNA sequence
gctgcaggggagctgggcag

SEQ ID NO: 418948 - DNA, 20 bp, Artificial
  CRISPR gRNA sequence
gctgggcaggagccccctcc

SEQ ID NO: 418949 - DNA, 20 bp, Artificial
  CRISPR gRNA sequence
ctgggcaggagccccctcct

SEQ ID NO: 418950 - DNA, 20 bp, Artificial
  CRISPR gRNA sequence
ccctcctgggcccacaccac

SEQ ID NO: 418951 - DNA, 20 bp, Artificial
  CRISPR gRNA sequence
cctcctgggcccacaccacc

SEQ ID NO: 418952 - DNA, 20 bp, Artificial
  CRISPR gRNA sequence
ggcccacaccaccgggacct

SEQ ID NO: 418953 - DNA, 20 bp, Artificial
  CRISPR gRNA sequence
accaccgggacctcagcccc

SEQ ID NO: 418954 - DNA, 20 bp, Artificial
  CRISPR gRNA sequence
ccgggacctcagcccctggc

SEQ ID NO: 418955 - DNA, 20 bp, Artificial
  CRISPR gRNA sequence
gggacctcagcccctggctg

SEQ ID NO: 418956 - DNA, 20 bp, Artificial
  CRISPR gRNA sequence
gacctcagcccctggctgga

SEQ ID NO: 418957 - DNA, 20 bp, Artificial
  CRISPR gRNA sequence
acctcagcccctggctggag

SEQ ID NO: 418958 - DNA, 20 bp, Artificial
  CRISPR gRNA sequence
cctggctggagaggcttcac

SEQ ID NO: 418959 - DNA, 20 bp, Artificial
  CRISPR gRNA sequence
ctggctggagaggcttcact

SEQ ID NO: 418960 - DNA, 20 bp, Artificial
  CRISPR gRNA sequence
ctggagaggcttcactaggt

SEQ ID NO: 418961 - DNA, 20 bp, Artificial
  CRISPR gRNA sequence
aggcttcactaggtgagcaa

SEQ ID NO: 418962 - DNA, 20 bp, Artificial
  CRISPR gRNA sequence
gcttcactaggtgagcaaaa

SEQ ID NO: 418963 - DNA, 20 bp, Artificial
  CRISPR gRNA sequence
ttcactaggtgagcaaaaga

SEQ ID NO: 418964 - DNA, 20 bp, Artificial
  CRISPR gRNA sequence
tcactaggtgagcaaaagag

SEQ ID NO: 418965 - DNA, 20 bp, Artificial
  CRISPR gRNA sequence
aggtgagcaaaagagaggcc

SEQ ID NO: 418966 - DNA, 20 bp, Artificial
  CRISPR gRNA sequence
ggtgagcaaaagagaggcca

SEQ ID NO: 418967 - DNA, 20 bp, Artificial
  CRISPR gRNA sequence
gtgagcaaaagagaggccaa

SEQ ID NO: 418968 - DNA, 20 bp, Artificial
  CRISPR gRNA sequence
tgagcaaaagagaggccaag

SEQ ID NO: 418969 - DNA, 20 bp, Artificial
  CRISPR gRNA sequence
agcaaaagagaggccaaggg

SEQ ID NO: 418970 - DNA, 20 bp, Artificial
  CRISPR gRNA sequence
gcaaaagagaggccaagggg

SEQ ID NO: 418971 - DNA, 20 bp, Artificial
  CRISPR gRNA sequence
caaaagagaggccaagggga

SEQ ID NO: 418972 - DNA, 20 bp, Artificial
  CRISPR gRNA sequence
aaaagagaggccaaggggag

SEQ ID NO: 418973 - DNA, 20 bp, Artificial
  CRISPR gRNA sequence
aaagagaggccaaggggagg

SEQ ID NO: 418974 - DNA, 20 bp, Artificial
  CRISPR gRNA sequence
aggccaaggggagggggcgt

SEQ ID NO: 418975 - DNA, 20 bp, Artificial
  CRISPR gRNA sequence
aaggggagggggcgtgagcc

SEQ ID NO: 418976 - DNA, 20 bp, Artificial
  CRISPR gRNA sequence
ggggagggggcgtgagccga

SEQ ID NO: 418977 - DNA, 20 bp, Artificial
  CRISPR gRNA sequence
gggagggggcgtgagccgag

SEQ ID NO: 418978 - DNA, 20 bp, Artificial
  CRISPR gRNA sequence
agggggcgtgagccgagagg

SEQ ID NO: 418979 - DNA, 20 bp, Artificial
  CRISPR gRNA sequence
gggggcgtgagccgagaggc

SEQ ID NO: 418980 - DNA, 20 bp, Artificial
  CRISPR gRNA sequence
ggggcgtgagccgagaggca

SEQ ID NO: 418981 - DNA, 20 bp, Artificial
  CRISPR gRNA sequence
gggcgtgagccgagaggcag

SEQ ID NO: 418982 - DNA, 20 bp, Artificial
  CRISPR gRNA sequence
cgtgagccgagaggcagggg

SEQ ID NO: 418983 - DNA, 20 bp, Artificial
  CRISPR gRNA sequence
tgagccgagaggcaggggta

SEQ ID NO: 418984 - DNA, 20 bp, Artificial
  CRISPR gRNA sequence
gccgagaggcaggggtagag

SEQ ID NO: 418985 - DNA, 20 bp, Artificial
  CRISPR gRNA sequence
ccgagaggcaggggtagaga

SEQ ID NO: 418986 - DNA, 20 bp, Artificial
  CRISPR gRNA sequence
gagaggcaggggtagagaag

SEQ ID NO: 418987 - DNA, 20 bp, Artificial
  CRISPR gRNA sequence
gcaggggtagagaaggagcc

SEQ ID NO: 418988 - DNA, 20 bp, Artificial
  CRISPR gRNA sequence
caggggtagagaaggagcct

SEQ ID NO: 418989 - DNA, 20 bp, Artificial
  CRISPR gRNA sequence
aaggagcctgggtgtttccc

SEQ ID NO: 418990 - DNA, 20 bp, Artificial
  CRISPR gRNA sequence
aggagcctgggtgtttcccg

SEQ ID NO: 418991 - DNA, 20 bp, Artificial
  CRISPR gRNA sequence
ggagcctgggtgtttcccga

SEQ ID NO: 418992 - DNA, 20 bp, Artificial
  CRISPR gRNA sequence
agcctgggtgtttcccgagg

SEQ ID NO: 418993 - DNA, 20 bp, Artificial
  CRISPR gRNA sequence
ggtgtttcccgagggagaaa

SEQ ID NO: 418994 - DNA, 20 bp, Artificial
  CRISPR gRNA sequence
gtgtttcccgagggagaaac

SEQ ID NO: 418995 - DNA, 20 bp, Artificial
  CRISPR gRNA sequence
tgtttcccgagggagaaaca

SEQ ID NO: 418996 - DNA, 20 bp, Artificial
  CRISPR gRNA sequence
cccgagggagaaacagggtg

SEQ ID NO: 418997 - DNA, 20 bp, Artificial
  CRISPR gRNA sequence
ccgagggagaaacagggtgc

SEQ ID NO: 418998 - DNA, 20 bp, Artificial
  CRISPR gRNA sequence
agggagaaacagggtgcagg

SEQ ID NO: 418999 - DNA, 20 bp, Artificial
  CRISPR gRNA sequence
aacagggtgcaggaagaact

SEQ ID NO: 419000 - DNA, 20 bp, Artificial
  CRISPR gRNA sequence
acagggtgcaggaagaactt

SEQ ID NO: 419001 - DNA, 20 bp, Artificial
  CRISPR gRNA sequence
gtttctgtttcttctctgcc

SEQ ID NO: 419002 - DNA, 20 bp, Artificial
  CRISPR gRNA sequence
ttctgtttcttctctgccca

SEQ ID NO: 419003 - DNA, 20 bp, Artificial
  CRISPR gRNA sequence
ctgtttcttctctgcccaga

SEQ ID NO: 419004 - DNA, 20 bp, Artificial
  CRISPR gRNA sequence
tgtttcttctctgcccagag

SEQ ID NO: 419005 - DNA, 20 bp, Artificial
  CRISPR gRNA sequence
tctctgcccagagaggcttt

SEQ ID NO: 419006 - DNA, 20 bp, Artificial
  CRISPR gRNA sequence
ctctgcccagagaggctttc

SEQ ID NO: 419007 - DNA, 20 bp, Artificial
  CRISPR gRNA sequence
tctgcccagagaggctttcg

SEQ ID NO: 419008 - DNA, 20 bp, Artificial
  CRISPR gRNA sequence
gcccagagaggctttcgggg

SEQ ID NO: 419009 - DNA, 20 bp, Artificial
  CRISPR gRNA sequence
cagagaggctttcggggtgg

SEQ ID NO: 419010 - DNA, 20 bp, Artificial
  CRISPR gRNA sequence
agagaggctttcggggtgga

SEQ ID NO: 419011 - DNA, 20 bp, Artificial
  CRISPR gRNA sequence
ggtggaaggactgcccaaaa

SEQ ID NO: 419012 - DNA, 20 bp, Artificial
  CRISPR gRNA sequence
gtggaaggactgcccaaaaa

SEQ ID NO: 419013 - DNA, 20 bp, Artificial
  CRISPR gRNA sequence
tggaaggactgcccaaaaaa

SEQ ID NO: 419014 - DNA, 20 bp, Artificial
  CRISPR gRNA sequence
ggactgcccaaaaaagggat

SEQ ID NO: 419015 - DNA, 20 bp, Artificial
  CRISPR gRNA sequence
ctgcccaaaaaagggattag

SEQ ID NO: 419016 - DNA, 20 bp, Artificial
  CRISPR gRNA sequence
aaagggattagaagaatcca

SEQ ID NO: 419017 - DNA, 20 bp, Artificial
  CRISPR gRNA sequence
agggattagaagaatccaca

SEQ ID NO: 419018 - DNA, 20 bp, Artificial
  CRISPR gRNA sequence
ttagaagaatccacagagct

SEQ ID NO: 419019 - DNA, 20 bp, Artificial
  CRISPR gRNA sequence
tagaagaatccacagagcta

SEQ ID NO: 419020 - DNA, 20 bp, Artificial
  CRISPR gRNA sequence
atccacagagctaaggacct

SEQ ID NO: 419021 - DNA, 20 bp, Artificial
  CRISPR gRNA sequence
tccacagagctaaggacctc

SEQ ID NO: 419022 - DNA, 20 bp, Artificial
  CRISPR gRNA sequence
taaggacctcaggacctttg

SEQ ID NO: 419023 - DNA, 20 bp, Artificial
  CRISPR gRNA sequence
cctcaggacctttgtggcca

SEQ ID NO: 419024 - DNA, 20 bp, Artificial
  CRISPR gRNA sequence
tcaggacctttgtggccaca

SEQ ID NO: 419025 - DNA, 20 bp, Artificial
  CRISPR gRNA sequence
gtggccacagagatccctgc

SEQ ID NO: 419026 - DNA, 20 bp, Artificial
  CRISPR gRNA sequence
tccctgctggtcccctcctg

SEQ ID NO: 419027 - DNA, 20 bp, Artificial
  CRISPR gRNA sequence
ccctgctggtcccctcctgt

SEQ ID NO: 419028 - DNA, 20 bp, Artificial
  CRISPR gRNA sequence
cctgctggtcccctcctgtg

SEQ ID NO: 419029 - DNA, 20 bp, Artificial
  CRISPR gRNA sequence
ctggtcccctcctgtggggc

SEQ ID NO: 419030 - DNA, 20 bp, Artificial
  CRISPR gRNA sequence
ggtcccctcctgtggggctg

SEQ ID NO: 419031 - DNA, 20 bp, Artificial
  CRISPR gRNA sequence
gtcccctcctgtggggctgg

SEQ ID NO: 419032 - DNA, 20 bp, Artificial
  CRISPR gRNA sequence
cccgccatccccgttttacc

SEQ ID NO: 419033 - DNA, 20 bp, Artificial
  CRISPR gRNA sequence
cgccatccccgttttacctg

SEQ ID NO: 419034 - DNA, 20 bp, Artificial
  CRISPR gRNA sequence
gttttacctggagccaccca

SEQ ID NO: 419035 - DNA, 20 bp, Artificial
  CRISPR gRNA sequence
ttacctggagccacccaaag

SEQ ID NO: 419036 - DNA, 20 bp, Artificial
  CRISPR gRNA sequence
ggagccacccaaagcggctg

SEQ ID NO: 419037 - DNA, 20 bp, Artificial
  CRISPR gRNA sequence
acccaaagcggctgcagaaa

SEQ ID NO: 419038 - DNA, 20 bp, Artificial
  CRISPR gRNA sequence
aaagcggctgcagaaacagc

SEQ ID NO: 419039 - DNA, 20 bp, Artificial
  CRISPR gRNA sequence
ggctgcagaaacagcaagcc

SEQ ID NO: 419040 - DNA, 20 bp, Artificial
  CRISPR gRNA sequence
gctgcagaaacagcaagccc

SEQ ID NO: 419041 - DNA, 20 bp, Artificial
  CRISPR gRNA sequence
aaacagcaagcccaggaact

SEQ ID NO: 419042 - DNA, 20 bp, Artificial
  CRISPR gRNA sequence
agcctcccacatctctccta

SEQ ID NO: 419043 - DNA, 20 bp, Artificial
  CRISPR gRNA sequence
cccacatctctcctatggtc

SEQ ID NO: 419044 - DNA, 20 bp, Artificial
  CRISPR gRNA sequence
ccacatctctcctatggtct

SEQ ID NO: 419045 - DNA, 20 bp, Artificial
  CRISPR gRNA sequence
catctctcctatggtctggg

SEQ ID NO: 419046 - DNA, 20 bp, Artificial
  CRISPR gRNA sequence
cctatggtctgggcagcgct

SEQ ID NO: 419047 - DNA, 20 bp, Artificial
  CRISPR gRNA sequence
ggcagcgctgagccctccaa

SEQ ID NO: 419048 - DNA, 20 bp, Artificial
  CRISPR gRNA sequence
gcagcgctgagccctccaaa

SEQ ID NO: 419049 - DNA, 20 bp, Artificial
  CRISPR gRNA sequence
agcgctgagccctccaaaag

SEQ ID NO: 419050 - DNA, 20 bp, Artificial
  CRISPR gRNA sequence
gcgctgagccctccaaaagg

SEQ ID NO: 419051 - DNA, 20 bp, Artificial
  CRISPR gRNA sequence
tgagccctccaaaaggaggt

SEQ ID NO: 419052 - DNA, 20 bp, Artificial
  CRISPR gRNA sequence
cctccaaaaggaggtcagaa

SEQ ID NO: 419053 - DNA, 20 bp, Artificial
  CRISPR gRNA sequence
ctccaaaaggaggtcagaaa

SEQ ID NO: 419054 - DNA, 20 bp, Artificial
  CRISPR gRNA sequence
aaaaggaggtcagaaaagga

SEQ ID NO: 419055 - DNA, 20 bp, Artificial
  CRISPR gRNA sequence
aaaggaggtcagaaaaggaa

SEQ ID NO: 419056 - DNA, 20 bp, Artificial
  CRISPR gRNA sequence
aaggaggtcagaaaaggaaa

SEQ ID NO: 419057 - DNA, 20 bp, Artificial
  CRISPR gRNA sequence
aggaggtcagaaaaggaaag

SEQ ID NO: 419058 - DNA, 20 bp, Artificial
  CRISPR gRNA sequence
ggaggtcagaaaaggaaagg

SEQ ID NO: 419059 - DNA, 20 bp, Artificial
  CRISPR gRNA sequence
ggtcagaaaaggaaaggggg

SEQ ID NO: 419060 - DNA, 20 bp, Artificial
  CRISPR gRNA sequence
cagaaaaggaaagggggcag

SEQ ID NO: 419061 - DNA, 20 bp, Artificial
  CRISPR gRNA sequence
aaaaggaaagggggcagtgg

SEQ ID NO: 419062 - DNA, 20 bp, Artificial
  CRISPR gRNA sequence
aaaggaaagggggcagtggt

SEQ ID NO: 419063 - DNA, 20 bp, Artificial
  CRISPR gRNA sequence
aaggaaagggggcagtggtg

SEQ ID NO: 419064 - DNA, 20 bp, Artificial
  CRISPR gRNA sequence
aggaaagggggcagtggtgg

SEQ ID NO: 419065 - DNA, 20 bp, Artificial
  CRISPR gRNA sequence
ggaaagggggcagtggtggg

SEQ ID NO: 419066 - DNA, 20 bp, Artificial
  CRISPR gRNA sequence
aagggggcagtggtgggggg

SEQ ID NO: 419067 - DNA, 20 bp, Artificial
  CRISPR gRNA sequence
agggggcagtggtggggggt

SEQ ID NO: 419068 - DNA, 20 bp, Artificial
  CRISPR gRNA sequence
gggggcagtggtggggggtg

SEQ ID NO: 419069 - DNA, 20 bp, Artificial
  CRISPR gRNA sequence
ggggcagtggtggggggtgg

SEQ ID NO: 419070 - DNA, 20 bp, Artificial
  CRISPR gRNA sequence
gggcagtggtggggggtggg

SEQ ID NO: 419071 - DNA, 20 bp, Artificial
  CRISPR gRNA sequence
gtggtggggggtggggggta

SEQ ID NO: 419072 - DNA, 20 bp, Artificial
  CRISPR gRNA sequence
tggtggggggtggggggtaa

SEQ ID NO: 419073 - DNA, 20 bp, Artificial
  CRISPR gRNA sequence
gtggggggtggggggtaaag

SEQ ID NO: 419074 - DNA, 20 bp, Artificial
  CRISPR gRNA sequence
gggggtggggggtaaaggag

SEQ ID NO: 419075 - DNA, 20 bp, Artificial
  CRISPR gRNA sequence
ggggtaaaggagaagttctg

SEQ ID NO: 419076 - DNA, 20 bp, Artificial
  CRISPR gRNA sequence
ggtaaaggagaagttctgca

SEQ ID NO: 419077 - DNA, 20 bp, Artificial
  CRISPR gRNA sequence
taaaggagaagttctgcaga

SEQ ID NO: 419078 - DNA, 20 bp, Artificial
  CRISPR gRNA sequence
aaaggagaagttctgcagag

SEQ ID NO: 419079 - DNA, 20 bp, Artificial
  CRISPR gRNA sequence
aaggagaagttctgcagaga

SEQ ID NO: 419080 - DNA, 20 bp, Artificial
  CRISPR gRNA sequence
ggagaagttctgcagagagg

SEQ ID NO: 419081 - DNA, 20 bp, Artificial
  CRISPR gRNA sequence
gagaagttctgcagagaggg

SEQ ID NO: 419082 - DNA, 20 bp, Artificial
  CRISPR gRNA sequence
aagttctgcagagagggagg

SEQ ID NO: 419083 - DNA, 20 bp, Artificial
  CRISPR gRNA sequence
gttctgcagagagggaggtg

SEQ ID NO: 419084 - DNA, 20 bp, Artificial
  CRISPR gRNA sequence
ttctgcagagagggaggtgg

SEQ ID NO: 419085 - DNA, 20 bp, Artificial
  CRISPR gRNA sequence
tgcagagagggaggtggagg

SEQ ID NO: 419086 - DNA, 20 bp, Artificial
  CRISPR gRNA sequence
gcagagagggaggtggagga

SEQ ID NO: 419087 - DNA, 20 bp, Artificial
  CRISPR gRNA sequence
cagagagggaggtggaggaa

SEQ ID NO: 419088 - DNA, 20 bp, Artificial
  CRISPR gRNA sequence
agagagggaggtggaggaag

SEQ ID NO: 419089 - DNA, 20 bp, Artificial
  CRISPR gRNA sequence
ggaggtggaggaaggggttc

SEQ ID NO: 419090 - DNA, 20 bp, Artificial
  CRISPR gRNA sequence
ggtggaggaaggggttctag

SEQ ID NO: 419091 - DNA, 20 bp, Artificial
  CRISPR gRNA sequence
ggaggaaggggttctagaag

SEQ ID NO: 419092 - DNA, 20 bp, Artificial
  CRISPR gRNA sequence
gaggaaggggttctagaaga

SEQ ID NO: 419093 - DNA, 20 bp, Artificial
  CRISPR gRNA sequence
aggaaggggttctagaagaa

SEQ ID NO: 419094 - DNA, 20 bp, Artificial
  CRISPR gRNA sequence
gaaggggttctagaagaagg

SEQ ID NO: 419095 - DNA, 20 bp, Artificial
  CRISPR gRNA sequence
ggttctagaagaagggagac

SEQ ID NO: 419096 - DNA, 20 bp, Artificial
  CRISPR gRNA sequence
gttctagaagaagggagacc

SEQ ID NO: 419097 - DNA, 20 bp, Artificial
  CRISPR gRNA sequence
tctagaagaagggagaccag

SEQ ID NO: 419098 - DNA, 20 bp, Artificial
  CRISPR gRNA sequence
tagaagaagggagaccagga

SEQ ID NO: 419099 - DNA, 20 bp, Artificial
  CRISPR gRNA sequence
agaagaagggagaccaggag

SEQ ID NO: 419100 - DNA, 20 bp, Artificial
  CRISPR gRNA sequence
gaagaagggagaccaggaga

SEQ ID NO: 419101 - DNA, 20 bp, Artificial
  CRISPR gRNA sequence
gggagaccaggagagggcct

SEQ ID NO: 419102 - DNA, 20 bp, Artificial
  CRISPR gRNA sequence
gagaccaggagagggccttg

SEQ ID NO: 419103 - DNA, 20 bp, Artificial
  CRISPR gRNA sequence
gaccaggagagggccttgga

SEQ ID NO: 419104 - DNA, 20 bp, Artificial
  CRISPR gRNA sequence
ccaggagagggccttggaga

SEQ ID NO: 419105 - DNA, 20 bp, Artificial
  CRISPR gRNA sequence
caggagagggccttggagag

SEQ ID NO: 419106 - DNA, 20 bp, Artificial
  CRISPR gRNA sequence
aggagagggccttggagaga

SEQ ID NO: 419107 - DNA, 20 bp, Artificial
  CRISPR gRNA sequence
agagggccttggagagaggg

SEQ ID NO: 419108 - DNA, 20 bp, Artificial
  CRISPR gRNA sequence
gagggccttggagagagggt

SEQ ID NO: 419109 - DNA, 20 bp, Artificial
  CRISPR gRNA sequence
agggccttggagagagggtg

SEQ ID NO: 419110 - DNA, 20 bp, Artificial
  CRISPR gRNA sequence
ggccttggagagagggtggg

SEQ ID NO: 419111 - DNA, 20 bp, Artificial
  CRISPR gRNA sequence
gccttggagagagggtgggg

SEQ ID NO: 419112 - DNA, 20 bp, Artificial
  CRISPR gRNA sequence
ccttggagagagggtgggga

SEQ ID NO: 419113 - DNA, 20 bp, Artificial
  CRISPR gRNA sequence
agagggtggggagggatgac

SEQ ID NO: 419114 - DNA, 20 bp, Artificial
  CRISPR gRNA sequence
agggtggggagggatgacca

SEQ ID NO: 419115 - DNA, 20 bp, Artificial
  CRISPR gRNA sequence
gggtggggagggatgaccag

SEQ ID NO: 419116 - DNA, 20 bp, Artificial
  CRISPR gRNA sequence
ggggagggatgaccagaggc

SEQ ID NO: 419117 - DNA, 20 bp, Artificial
  CRISPR gRNA sequence
gatgaccagaggccggaatc

SEQ ID NO: 419118 - DNA, 20 bp, Artificial
  CRISPR gRNA sequence
tgaccagaggccggaatcca

SEQ ID NO: 419119 - DNA, 20 bp, Artificial
  CRISPR gRNA sequence
gaccagaggccggaatccag

SEQ ID NO: 419120 - DNA, 20 bp, Artificial
  CRISPR gRNA sequence
agaggccggaatccagagga

SEQ ID NO: 419121 - DNA, 20 bp, Artificial
  CRISPR gRNA sequence
gccggaatccagaggaaagc

SEQ ID NO: 419122 - DNA, 20 bp, Artificial
  CRISPR gRNA sequence
gaatccagaggaaagctgga

SEQ ID NO: 419123 - DNA, 20 bp, Artificial
  CRISPR gRNA sequence
ccagaggaaagctggaaagc

SEQ ID NO: 419124 - DNA, 20 bp, Artificial
  CRISPR gRNA sequence
cagaggaaagctggaaagct

SEQ ID NO: 419125 - DNA, 20 bp, Artificial
  CRISPR gRNA sequence
aggaaagctggaaagctggg

SEQ ID NO: 419126 - DNA, 20 bp, Artificial
  CRISPR gRNA sequence
agctggaaagctgggcagat

SEQ ID NO: 419127 - DNA, 20 bp, Artificial
  CRISPR gRNA sequence
gctggaaagctgggcagatc

SEQ ID NO: 419128 - DNA, 20 bp, Artificial
  CRISPR gRNA sequence
ggaaagctgggcagatcagg

SEQ ID NO: 419129 - DNA, 20 bp, Artificial
  CRISPR gRNA sequence
ctgggcagatcaggcagcct

SEQ ID NO: 419130 - DNA, 20 bp, Artificial
  CRISPR gRNA sequence
tgggcagatcaggcagcctg

SEQ ID NO: 419131 - DNA, 20 bp, Artificial
  CRISPR gRNA sequence
ggcagatcaggcagcctgag

SEQ ID NO: 419132 - DNA, 20 bp, Artificial
  CRISPR gRNA sequence
gcagatcaggcagcctgagg

SEQ ID NO: 419133 - DNA, 20 bp, Artificial
  CRISPR gRNA sequence
gatcaggcagcctgaggagg

SEQ ID NO: 419134 - DNA, 20 bp, Artificial
  CRISPR gRNA sequence
atcaggcagcctgaggaggt

SEQ ID NO: 419135 - DNA, 20 bp, Artificial
  CRISPR gRNA sequence
tcaggcagcctgaggaggtg

SEQ ID NO: 419136 - DNA, 20 bp, Artificial
  CRISPR gRNA sequence
caggcagcctgaggaggtgg

SEQ ID NO: 419137 - DNA, 20 bp, Artificial
  CRISPR gRNA sequence
gcagcctgaggaggtggggg

SEQ ID NO: 419138 - DNA, 20 bp, Artificial
  CRISPR gRNA sequence
cagcctgaggaggtgggggc

SEQ ID NO: 419139 - DNA, 20 bp, Artificial
  CRISPR gRNA sequence
agcctgaggaggtgggggcg

SEQ ID NO: 419140 - DNA, 20 bp, Artificial
  CRISPR gRNA sequence
gcctgaggaggtgggggcgg

SEQ ID NO: 419141 - DNA, 20 bp, Artificial
  CRISPR gRNA sequence
aggtgggggcgggggtgtcc

SEQ ID NO: 419142 - DNA, 20 bp, Artificial
  CRISPR gRNA sequence
ggtgggggcgggggtgtccc

SEQ ID NO: 419143 - DNA, 20 bp, Artificial
  CRISPR gRNA sequence
gtgggggcgggggtgtccca

SEQ ID NO: 419144 - DNA, 20 bp, Artificial
  CRISPR gRNA sequence
ggcgggggtgtcccagggaa

SEQ ID NO: 419145 - DNA, 20 bp, Artificial
  CRISPR gRNA sequence
cgggggtgtcccagggaaca

SEQ ID NO: 419146 - DNA, 20 bp, Artificial
  CRISPR gRNA sequence
gggtgtcccagggaacagag

SEQ ID NO: 419147 - DNA, 20 bp, Artificial
  CRISPR gRNA sequence
ggtgtcccagggaacagagc

SEQ ID NO: 419148 - DNA, 20 bp, Artificial
  CRISPR gRNA sequence
gtgtcccagggaacagagca

SEQ ID NO: 419149 - DNA, 20 bp, Artificial
  CRISPR gRNA sequence
cagggaacagagcagggccg

SEQ ID NO: 419150 - DNA, 20 bp, Artificial
  CRISPR gRNA sequence
ggaacagagcagggccgtgg

SEQ ID NO: 419151 - DNA, 20 bp, Artificial
  CRISPR gRNA sequence
aacagagcagggccgtggcg

SEQ ID NO: 419152 - DNA, 20 bp, Artificial
  CRISPR gRNA sequence
cagagcagggccgtggcgga

SEQ ID NO: 419153 - DNA, 20 bp, Artificial
  CRISPR gRNA sequence
agcagggccgtggcggagag

SEQ ID NO: 419154 - DNA, 20 bp, Artificial
  CRISPR gRNA sequence
gggccgtggcggagagcaga

SEQ ID NO: 419155 - DNA, 20 bp, Artificial
  CRISPR gRNA sequence
gccgtggcggagagcagaca

SEQ ID NO: 419156 - DNA, 20 bp, Artificial
  CRISPR gRNA sequence
ggcggagagcagacagagca

SEQ ID NO: 419157 - DNA, 20 bp, Artificial
  CRISPR gRNA sequence
ggagagcagacagagcaaag

SEQ ID NO: 419158 - DNA, 20 bp, Artificial
  CRISPR gRNA sequence
acagagcaaagtggccgtcg

SEQ ID NO: 419159 - DNA, 20 bp, Artificial
  CRISPR gRNA sequence
agcaaagtggccgtcgtggc

SEQ ID NO: 419160 - DNA, 20 bp, Artificial
  CRISPR gRNA sequence
gcaaagtggccgtcgtggct

SEQ ID NO: 419161 - DNA, 20 bp, Artificial
  CRISPR gRNA sequence
tggctgggatgccgttctgc

SEQ ID NO: 419162 - DNA, 20 bp, Artificial
  CRISPR gRNA sequence
gatgccgttctgctggtctc

SEQ ID NO: 419163 - DNA, 20 bp, Artificial
  CRISPR gRNA sequence
atgccgttctgctggtctct

SEQ ID NO: 419164 - DNA, 20 bp, Artificial
  CRISPR gRNA sequence
tgggccttcacccctgtgcc

SEQ ID NO: 419165 - DNA, 20 bp, Artificial
  CRISPR gRNA sequence
ttccccacttcccctcctcc

SEQ ID NO: 419166 - DNA, 20 bp, Artificial
  CRISPR gRNA sequence
ccggcccgccccccgcaccc

SEQ ID NO: 419167 - DNA, 20 bp, Artificial
  CRISPR gRNA sequence
cggcccgccccccgcacccc

SEQ ID NO: 419168 - DNA, 20 bp, Artificial
  CRISPR gRNA sequence
ggcccgccccccgcacccca

SEQ ID NO: 419169 - DNA, 20 bp, Artificial
  CRISPR gRNA sequence
cccccgcaccccagggctta

SEQ ID NO: 419170 - DNA, 20 bp, Artificial
  CRISPR gRNA sequence
gggcttacggtttcgcttcg

SEQ ID NO: 419171 - DNA, 20 bp, Artificial
  CRISPR gRNA sequence
cttacggtttcgcttcgcag

SEQ ID NO: 419172 - DNA, 20 bp, Artificial
  CRISPR gRNA sequence
cggtttcgcttcgcagtgga

SEQ ID NO: 419173 - DNA, 20 bp, Artificial
  CRISPR gRNA sequence
cgcttcgcagtggaaagtct

SEQ ID NO: 419174 - DNA, 20 bp, Artificial
  CRISPR gRNA sequence
gcttcgcagtggaaagtctg

SEQ ID NO: 419175 - DNA, 20 bp, Artificial
  CRISPR gRNA sequence
cttcgcagtggaaagtctga

SEQ ID NO: 419176 - DNA, 20 bp, Artificial
  CRISPR gRNA sequence
ttcgcagtggaaagtctgag

SEQ ID NO: 419177 - DNA, 20 bp, Artificial
  CRISPR gRNA sequence
tcgcagtggaaagtctgagg

SEQ ID NO: 419178 - DNA, 20 bp, Artificial
  CRISPR gRNA sequence
cgaagcgaaaccgtaagccc

SEQ ID NO: 419179 - DNA, 20 bp, Artificial
  CRISPR gRNA sequence
gtggagggaaggccgggcac

SEQ ID NO: 419180 - DNA, 20 bp, Artificial
  CRISPR gRNA sequence
cccagctttccagctttcct

SEQ ID NO: 419181 - DNA, 20 bp, Artificial
  CRISPR gRNA sequence
ttgctgtttctgcagccgct

SEQ ID NO: 419182 - DNA, 20 bp, Artificial
  CRISPR gRNA sequence
tgggtggctccaggtaaaac

SEQ ID NO: 419183 - DNA, 20 bp, Artificial
  CRISPR gRNA sequence
aggtaaaacggggatggcgg

SEQ ID NO: 419184 - DNA, 20 bp, Artificial
  CRISPR gRNA sequence
ccccacaggaggggaccagc

SEQ ID NO: 419185 - DNA, 20 bp, Artificial
  CRISPR gRNA sequence
gtcctgaggtccttagctct

SEQ ID NO: 419186 - DNA, 20 bp, Artificial
  CRISPR gRNA sequence
gcagccccacaatccccctc

SEQ ID NO: 419187 - DNA, 20 bp, Artificial
  CRISPR gRNA sequence
ctcagccttctgcgaagagc

SEQ ID NO: 419188 - DNA, 20 bp, Artificial
  CRISPR gRNA sequence
aaacttgggcaacaggacct

SEQ ID NO: 419189 - DNA, 20 bp, Artificial
  CRISPR gRNA sequence
agcatcccttctctccagaa

SEQ ID NO: 419190 - DNA, 20 bp, Artificial
  CRISPR gRNA sequence
ggatgcggccagtccaacag

SEQ ID NO: 419191 - DNA, 20 bp, Artificial
  CRISPR gRNA sequence
ggcgggctttctcatcctca

SEQ ID NO: 419192 - DNA, 20 bp, Artificial
  CRISPR gRNA sequence
gccgctacacggtgctgagc

SEQ ID NO: 419193 - DNA, 20 bp, Artificial
  CRISPR gRNA sequence
ccctgcagccccgcgtccag

SEQ ID NO: 419194 - DNA, 20 bp, Artificial
  CRISPR gRNA sequence
agcccggcgcgcggacgccg

SEQ ID NO: 419195 - DNA, 20 bp, Artificial
  CRISPR gRNA sequence
gtctgcgcctgggccaggcc

SEQ ID NO: 419196 - DNA, 20 bp, Artificial
  CRISPR gRNA sequence
gatgggagaagggctgggag

SEQ ID NO: 419197 - DNA, 20 bp, Artificial
  CRISPR gRNA sequence
ccctgtcggagagctcccag

SEQ ID NO: 419198 - DNA, 20 bp, Artificial
  CRISPR gRNA sequence
ctcccagaagagtagaggaa

SEQ ID NO: 419199 - DNA, 20 bp, Artificial
  CRISPR gRNA sequence
gaagggggtgggcggcctgc

SEQ ID NO: 419200 - DNA, 20 bp, Artificial
  CRISPR gRNA sequence
tccccttctcccacccacgc

SEQ ID NO: 419201 - DNA, 20 bp, Artificial
  CRISPR gRNA sequence
tttcagatatctgtagctca

SEQ ID NO: 419202 - DNA, 20 bp, Artificial
  CRISPR gRNA sequence
agctcagggggtgggcttcg

SEQ ID NO: 419203 - DNA, 20 bp, Artificial
  CRISPR gRNA sequence
ttccaggccaggaaaacggc

SEQ ID NO: 419204 - DNA, 20 bp, Artificial
  CRISPR gRNA sequence
ggacggggaaagtggtcctg

SEQ ID NO: 419205 - DNA, 20 bp, Artificial
  CRISPR gRNA sequence
aagtggtcctggggagtctt

SEQ ID NO: 419206 - DNA, 20 bp, Artificial
  CRISPR gRNA sequence
gctggaagctgagatgggga

SEQ ID NO: 419207 - DNA, 20 bp, Artificial
  CRISPR gRNA sequence
cacagtgactgccagccccc

SEQ ID NO: 419208 - DNA, 20 bp, Artificial
  CRISPR gRNA sequence
ggatctctcagagcctccga

SEQ ID NO: 419209 - DNA, 20 bp, Artificial
  CRISPR gRNA sequence
ttccggaaccggggccaggg

SEQ ID NO: 419210 - DNA, 20 bp, Artificial
  CRISPR gRNA sequence
ccagggccgagtccctgtcc

SEQ ID NO: 419211 - DNA, 20 bp, Artificial
  CRISPR gRNA sequence
tcatgtataacctcactgtt

SEQ ID NO: 419212 - DNA, 20 bp, Artificial
  CRISPR gRNA sequence
ccttgtcacctcccctaact

SEQ ID NO: 419213 - DNA, 20 bp, Artificial
  CRISPR gRNA sequence
cccaaaccaggttctcggca

SEQ ID NO: 419214 - DNA, 20 bp, Artificial
  CRISPR gRNA sequence
gagtggcctacgtcattgct

SEQ ID NO: 419215 - DNA, 20 bp, Artificial
  CRISPR gRNA sequence
cttccggctaagcccacttg

SEQ ID NO: 419216 - DNA, 20 bp, Artificial
  CRISPR gRNA sequence
cttatgagccagaccatctc

SEQ ID NO: 419217 - DNA, 20 bp, Artificial
  CRISPR gRNA sequence
tgcagcacccagctttaact

SEQ ID NO: 419218 - DNA, 20 bp, Artificial
  CRISPR gRNA sequence
gtgtacgctggagcaggttc

SEQ ID NO: 419219 - DNA, 20 bp, Artificial
  CRISPR gRNA sequence
gcgactttacccttcgacta

SEQ ID NO: 419220 - DNA, 20 bp, Artificial
  CRISPR gRNA sequence
aggtcagcctcaggtgggaa

SEQ ID NO: 419221 - DNA, 20 bp, Artificial
  CRISPR gRNA sequence
gaaaggagtagctgccctcc

SEQ ID NO: 419222 - DNA, 20 bp, Artificial
  CRISPR gRNA sequence
acgaaactgaaaatctcctc

SEQ ID NO: 419223 - DNA, 20 bp, Artificial
  CRISPR gRNA sequence
cccctgctctcaattggcgg

SEQ ID NO: 419224 - DNA, 20 bp, Artificial
  CRISPR gRNA sequence
aaggaaaggtgacaaaaatt

SEQ ID NO: 419225 - DNA, 20 bp, Artificial
  CRISPR gRNA sequence
tctgaatggttcgaaagagg

SEQ ID NO: 419226 - DNA, 20 bp, Artificial
  CRISPR gRNA sequence
aaagaggtagaatatatttc

SEQ ID NO: 419227 - DNA, 20 bp, Artificial
  CRISPR gRNA sequence
gtctactttgcagccagggc

SEQ ID NO: 419228 - DNA, 20 bp, Artificial
  CRISPR gRNA sequence
tttgcagccagggcttgggt

SEQ ID NO: 419229 - DNA, 20 bp, Artificial
  CRISPR gRNA sequence
ttagagttgcaggaagtggc

SEQ ID NO: 419230 - DNA, 20 bp, Artificial
  CRISPR gRNA sequence
ggaagtggcctggatttggg

SEQ ID NO: 419231 - DNA, 20 bp, Artificial
  CRISPR gRNA sequence
gtggcctggatttgggagga

SEQ ID NO: 419232 - DNA, 20 bp, Artificial
  CRISPR gRNA sequence
tcagcaaatatttactgagc

SEQ ID NO: 419233 - DNA, 20 bp, Artificial
  CRISPR gRNA sequence
tataaaacaaacacagaaaa

SEQ ID NO: 419234 - DNA, 20 bp, Artificial
  CRISPR gRNA sequence
cacagaaaaaagaatactca

SEQ ID NO: 419235 - DNA, 20 bp, Artificial
  CRISPR gRNA sequence
tgcttaataatgtatagaga

SEQ ID NO: 419236 - DNA, 20 bp, Artificial
  CRISPR gRNA sequence
taataatgtatagagattga

SEQ ID NO: 419237 - DNA, 20 bp, Artificial
  CRISPR gRNA sequence
atgaatacgtgaacatgcta

SEQ ID NO: 419238 - DNA, 20 bp, Artificial
  CRISPR gRNA sequence
acatctcctgaaggccaatc

SEQ ID NO: 419239 - DNA, 20 bp, Artificial
  CRISPR gRNA sequence
cctgagttttcacttgcttt

SEQ ID NO: 419240 - DNA, 20 bp, Artificial
  CRISPR gRNA sequence
cagctgggaagtgccagact

SEQ ID NO: 419241 - DNA, 20 bp, Artificial
  CRISPR gRNA sequence
atctctcactttacaacttg

SEQ ID NO: 419242 - DNA, 20 bp, Artificial
  CRISPR gRNA sequence
ggagaatgctctgtctctag

SEQ ID NO: 419243 - DNA, 20 bp, Artificial
  CRISPR gRNA sequence
aatgctctgtctctagatga

SEQ ID NO: 419244 - DNA, 20 bp, Artificial
  CRISPR gRNA sequence
ttctctataccttcagaaag

SEQ ID NO: 419245 - DNA, 20 bp, Artificial
  CRISPR gRNA sequence
tccaaaattgtgaagtagat

SEQ ID NO: 419246 - DNA, 20 bp, Artificial
  CRISPR gRNA sequence
cagctcatctgactgatttt

SEQ ID NO: 419247 - DNA, 20 bp, Artificial
  CRISPR gRNA sequence
attttgagggttctgagcat

SEQ ID NO: 419248 - DNA, 20 bp, Artificial
  CRISPR gRNA sequence
ttgagtagaaagtaatgtaa

SEQ ID NO: 419249 - DNA, 20 bp, Artificial
  CRISPR gRNA sequence
tgtggtctgccagggccagt

SEQ ID NO: 419250 - DNA, 20 bp, Artificial
  CRISPR gRNA sequence
ggagctgactagagcattgt

SEQ ID NO: 419251 - DNA, 20 bp, Artificial
  CRISPR gRNA sequence
ggctgagacgagaggagcac

SEQ ID NO: 419252 - DNA, 20 bp, Artificial
  CRISPR gRNA sequence
cgagaggagcacttgagtcc

SEQ ID NO: 419253 - DNA, 20 bp, Artificial
  CRISPR gRNA sequence
ctcccctggccagaacccaa

SEQ ID NO: 419254 - DNA, 20 bp, Artificial
  CRISPR gRNA sequence
ggccagaacccaagtgagtg

SEQ ID NO: 419255 - DNA, 20 bp, Artificial
  CRISPR gRNA sequence
agtgcagggtgattgagact

SEQ ID NO: 419256 - DNA, 20 bp, Artificial
  CRISPR gRNA sequence
gtgatatcacgtaagggggg

SEQ ID NO: 419257 - DNA, 20 bp, Artificial
  CRISPR gRNA sequence
ttcagtgactcccaaatcct

SEQ ID NO: 419258 - DNA, 20 bp, Artificial
  CRISPR gRNA sequence
tcccaaatcctttgggtcac

SEQ ID NO: 419259 - DNA, 20 bp, Artificial
  CRISPR gRNA sequence
ctctggacaccccatcccag

SEQ ID NO: 419260 - DNA, 20 bp, Artificial
  CRISPR gRNA sequence
ctagcccaggtccgaggccc

SEQ ID NO: 419261 - DNA, 20 bp, Artificial
  CRISPR gRNA sequence
cctgatctctggcttttgcc

SEQ ID NO: 419262 - DNA, 20 bp, Artificial
  CRISPR gRNA sequence
ccgtttccgccactgatcag

SEQ ID NO: 419263 - DNA, 20 bp, Artificial
  CRISPR gRNA sequence
ggacaagtcccttaaactct

SEQ ID NO: 419264 - DNA, 20 bp, Artificial
  CRISPR gRNA sequence
attgcatctgtaaagtctga

SEQ ID NO: 419265 - DNA, 20 bp, Artificial
  CRISPR gRNA sequence
agctcccgctcttccatcct

SEQ ID NO: 419266 - DNA, 20 bp, Artificial
  CRISPR gRNA sequence
cttcataagcctctcactcc

SEQ ID NO: 419267 - DNA, 20 bp, Artificial
  CRISPR gRNA sequence
actccagggatggcttgtgc

SEQ ID NO: 419268 - DNA, 20 bp, Artificial
  CRISPR gRNA sequence
gtgcctgggtaggctggaag

SEQ ID NO: 419269 - DNA, 20 bp, Artificial
  CRISPR gRNA sequence
cgattttctgccttagagca

SEQ ID NO: 419270 - DNA, 20 bp, Artificial
  CRISPR gRNA sequence
actccctgtcagcagcaagc

SEQ ID NO: 419271 - DNA, 20 bp, Artificial
  CRISPR gRNA sequence
gggaaagtaggttaggaggc

SEQ ID NO: 419272 - DNA, 20 bp, Artificial
  CRISPR gRNA sequence
actcaggcttgctgctgaca

SEQ ID NO: 419273 - DNA, 20 bp, Artificial
  CRISPR gRNA sequence
tatcttgctctgagcctgcg

SEQ ID NO: 419274 - DNA, 20 bp, Artificial
  CRISPR gRNA sequence
ttgctctgagcctgcggagg

SEQ ID NO: 419275 - DNA, 20 bp, Artificial
  CRISPR gRNA sequence
acggagggcggaaggaggag

SEQ ID NO: 419276 - DNA, 20 bp, Artificial
  CRISPR gRNA sequence
gaggagaaggatgaagggaa

SEQ ID NO: 419277 - DNA, 20 bp, Artificial
  CRISPR gRNA sequence
gaagcggatgaggagggaca

SEQ ID NO: 419278 - DNA, 20 bp, Artificial
  CRISPR gRNA sequence
acccaggcacaagccatccc

SEQ ID NO: 419279 - DNA, 20 bp, Artificial
  CRISPR gRNA sequence
gggggctctgagggcaagtt

SEQ ID NO: 419280 - DNA, 20 bp, Artificial
  CRISPR gRNA sequence
tttggtcaccttcctgagga

SEQ ID NO: 419281 - DNA, 20 bp, Artificial
  CRISPR gRNA sequence
aggggtgccatcagcactct

SEQ ID NO: 419282 - DNA, 20 bp, Artificial
  CRISPR gRNA sequence
gagcgggagctgctgggggg

SEQ ID NO: 419283 - DNA, 20 bp, Artificial
  CRISPR gRNA sequence
aggagcagagaaaggacacc

SEQ ID NO: 419284 - DNA, 20 bp, Artificial
  CRISPR gRNA sequence
gggcacctatggagaaagta

SEQ ID NO: 419285 - DNA, 20 bp, Artificial
  CRISPR gRNA sequence
agaaagtacaggatgaggca

SEQ ID NO: 419286 - DNA, 20 bp, Artificial
  CRISPR gRNA sequence
tacagatgcaatgagatcca

SEQ ID NO: 419287 - DNA, 20 bp, Artificial
  CRISPR gRNA sequence
agagtttaagggacttgtcc

SEQ ID NO: 419288 - DNA, 20 bp, Artificial
  CRISPR gRNA sequence
tcagctgatcagtggcggaa

SEQ ID NO: 419289 - DNA, 20 bp, Artificial
  CRISPR gRNA sequence
ctgactggaaagaaaagcgc

SEQ ID NO: 419290 - DNA, 20 bp, Artificial
  CRISPR gRNA sequence
ggaaagaaaagcgctgggat

SEQ ID NO: 419291 - DNA, 20 bp, Artificial
  CRISPR gRNA sequence
ggcaggggctgttctggaag

SEQ ID NO: 419292 - DNA, 20 bp, Artificial
  CRISPR gRNA sequence
aaagattattgctgtggcgt

SEQ ID NO: 419293 - DNA, 20 bp, Artificial
  CRISPR gRNA sequence
aaggtcctgagaaactcctc

SEQ ID NO: 419294 - DNA, 20 bp, Artificial
  CRISPR gRNA sequence
cctgagaaactcctctggga

SEQ ID NO: 419295 - DNA, 20 bp, Artificial
  CRISPR gRNA sequence
aagcgttcttgtccagatac

SEQ ID NO: 419296 - DNA, 20 bp, Artificial
  CRISPR gRNA sequence
cctcacaaagcagcttcccc

SEQ ID NO: 419297 - DNA, 20 bp, Artificial
  CRISPR gRNA sequence
ccagggatccaggtgaccca

SEQ ID NO: 419298 - DNA, 20 bp, Artificial
  CRISPR gRNA sequence
ccaggtgacccaaaggattt

SEQ ID NO: 419299 - DNA, 20 bp, Artificial
  CRISPR gRNA sequence
aggatttgggagtcactgaa

SEQ ID NO: 419300 - DNA, 20 bp, Artificial
  CRISPR gRNA sequence
agtagaaggaagagatcttt

SEQ ID NO: 419301 - DNA, 20 bp, Artificial
  CRISPR gRNA sequence
ctcaatcaccctgcactcac

SEQ ID NO: 419302 - DNA, 20 bp, Artificial
  CRISPR gRNA sequence
ggaggttggggaaggacatc

SEQ ID NO: 419303 - DNA, 20 bp, Artificial
  CRISPR gRNA sequence
ccatgttgcccaggctagtc

SEQ ID NO: 419304 - DNA, 20 bp, Artificial
  CRISPR gRNA sequence
gtctcagcctttcaaagtgc

SEQ ID NO: 419305 - DNA, 20 bp, Artificial
  CRISPR gRNA sequence
aaactggccctggcagacca

SEQ ID NO: 419306 - DNA, 20 bp, Artificial
  CRISPR gRNA sequence
cccctgccttgtggtgcccc

SEQ ID NO: 419307 - DNA, 20 bp, Artificial
  CRISPR gRNA sequence
tccaagttgtaaagtgagag

SEQ ID NO: 419308 - DNA, 20 bp, Artificial
  CRISPR gRNA sequence
agttgtaaagtgagagatgg

SEQ ID NO: 419309 - DNA, 20 bp, Artificial
  CRISPR gRNA sequence
tgggtgggtgggaggagaca

SEQ ID NO: 419310 - DNA, 20 bp, Artificial
  CRISPR gRNA sequence
agacaaagggtgaagggcat

SEQ ID NO: 419311 - DNA, 20 bp, Artificial
  CRISPR gRNA sequence
ggcatctgagtagtgtcctg

SEQ ID NO: 419312 - DNA, 20 bp, Artificial
  CRISPR gRNA sequence
tgatttggtgatgcagacac

SEQ ID NO: 419313 - DNA, 20 bp, Artificial
  CRISPR gRNA sequence
cagacacctgagtttagacc

SEQ ID NO: 419314 - DNA, 20 bp, Artificial
  CRISPR gRNA sequence
agctgttttgagaaagtctt

SEQ ID NO: 419315 - DNA, 20 bp, Artificial
  CRISPR gRNA sequence
tggtggactttgatgactga

SEQ ID NO: 419316 - DNA, 20 bp, Artificial
  CRISPR gRNA sequence
ggaggaggccaggtttcgag

SEQ ID NO: 419317 - DNA, 20 bp, Artificial
  CRISPR gRNA sequence
gaggccaggtttcgaggtgg

SEQ ID NO: 419318 - DNA, 20 bp, Artificial
  CRISPR gRNA sequence
ttcgaggtggatggatacca

SEQ ID NO: 419319 - DNA, 20 bp, Artificial
  CRISPR gRNA sequence
accagtggattactgacagg

SEQ ID NO: 419320 - DNA, 20 bp, Artificial
  CRISPR gRNA sequence
ctgacaggctgagtcagcaa

SEQ ID NO: 419321 - DNA, 20 bp, Artificial
  CRISPR gRNA sequence
ggattggtgggagaaaaagc

SEQ ID NO: 419322 - DNA, 20 bp, Artificial
  CRISPR gRNA sequence
tgggagaaaaagctggggtt

SEQ ID NO: 419323 - DNA, 20 bp, Artificial
  CRISPR gRNA sequence
ccagaaagcaagtgaaaact

SEQ ID NO: 419324 - DNA, 20 bp, Artificial
  CRISPR gRNA sequence
acattattaagcacctgccg

SEQ ID NO: 419325 - DNA, 20 bp, Artificial
  CRISPR gRNA sequence
cctgccgtggggtgctacta

SEQ ID NO: 419326 - DNA, 20 bp, Artificial
  CRISPR gRNA sequence
aaccagtcaacacatactct

SEQ ID NO: 419327 - DNA, 20 bp, Artificial
  CRISPR gRNA sequence
aaatatttgctgaccaaggg

SEQ ID NO: 419328 - DNA, 20 bp, Artificial
  CRISPR gRNA sequence
gccctggctgcaaagtagac

SEQ ID NO: 419329 - DNA, 20 bp, Artificial
  CRISPR gRNA sequence
tctacctctttcgaaccatt

SEQ ID NO: 419330 - DNA, 20 bp, Artificial
  CRISPR gRNA sequence
ctcccgccaattgagagcag

SEQ ID NO: 419331 - DNA, 20 bp, Artificial
  CRISPR gRNA sequence
cagtttcgtttctttattat

SEQ ID NO: 419332 - DNA, 20 bp, Artificial
  CRISPR gRNA sequence
tgcccagtggcctggcatca

SEQ ID NO: 419333 - DNA, 20 bp, Artificial
  CRISPR gRNA sequence
cagtggcctggcatcacagg

SEQ ID NO: 419334 - DNA, 20 bp, Artificial
  CRISPR gRNA sequence
ttgagctgctgttcctgcag

SEQ ID NO: 419335 - DNA, 20 bp, Artificial
  CRISPR gRNA sequence
tggctcacatcctctagtcg

SEQ ID NO: 419336 - DNA, 20 bp, Artificial
  CRISPR gRNA sequence
aggtcagggcctcccccagg

SEQ ID NO: 419337 - DNA, 20 bp, Artificial
  CRISPR gRNA sequence
cacttggcagtgaggaaaga

SEQ ID NO: 419338 - DNA, 20 bp, Artificial
  CRISPR gRNA sequence
gctccagcgtacactgtcaa

SEQ ID NO: 419339 - DNA, 20 bp, Artificial
  CRISPR gRNA sequence
aagaaaacccaaagttaaag

SEQ ID NO: 419340 - DNA, 20 bp, Artificial
  CRISPR gRNA sequence
gctgggtgctgcagtgggga

SEQ ID NO: 419341 - DNA, 20 bp, Artificial
  CRISPR gRNA sequence
gctgcaaggaagggaggcag

SEQ ID NO: 419342 - DNA, 20 bp, Artificial
  CRISPR gRNA sequence
caggagatggtctggctcat

SEQ ID NO: 419343 - DNA, 20 bp, Artificial
  CRISPR gRNA sequence
ctcataagagtgctaaggag

SEQ ID NO: 419344 - DNA, 20 bp, Artificial
  CRISPR gRNA sequence
aggccacgggagaagcaaga

SEQ ID NO: 419345 - DNA, 20 bp, Artificial
  CRISPR gRNA sequence
tgaggctgccagcaatataa

SEQ ID NO: 419346 - DNA, 20 bp, Artificial
  CRISPR gRNA sequence
aggtgacaaggggggcagga

SEQ ID NO: 419347 - DNA, 20 bp, Artificial
  CRISPR gRNA sequence
agttgtggtcaaatgtgaag

SEQ ID NO: 419348 - DNA, 20 bp, Artificial
  CRISPR gRNA sequence
tcaaatgtgaagcagagtgg

SEQ ID NO: 419349 - DNA, 20 bp, Artificial
  CRISPR gRNA sequence
ttgaagccatctctgtaggt

SEQ ID NO: 419350 - DNA, 20 bp, Artificial
  CRISPR gRNA sequence
gaggatgcagccccagggcc

SEQ ID NO: 419351 - DNA, 20 bp, Artificial
  CRISPR gRNA sequence
ggggctggcagtcactgtgc

SEQ ID NO: 419352 - DNA, 20 bp, Artificial
  CRISPR gRNA sequence
agcacctggaggtgcataaa

SEQ ID NO: 419353 - DNA, 20 bp, Artificial
  CRISPR gRNA sequence
cactttccccgtccctggcc

SEQ ID NO: 419354 - DNA, 20 bp, Artificial
  CRISPR gRNA sequence
ctgagctacagatatctgaa

SEQ ID NO: 419355 - DNA, 20 bp, Artificial
  CRISPR gRNA sequence
ctccctctgggcactcccgc

SEQ ID NO: 419356 - DNA, 20 bp, Artificial
  CRISPR gRNA sequence
gggtgggagaaggggagctc

SEQ ID NO: 419357 - DNA, 20 bp, Artificial
  CRISPR gRNA sequence
ttcctgcgtcccgggaggca

SEQ ID NO: 419358 - DNA, 20 bp, Artificial
  CRISPR gRNA sequence
cccccaggaggagggcgccg

SEQ ID NO: 419359 - DNA, 20 bp, Artificial
  CRISPR gRNA sequence
cgggtgagggccgggggcca

SEQ ID NO: 419360 - DNA, 20 bp, Artificial
  CRISPR gRNA sequence
gcgggccactgggcgggaaa

SEQ ID NO: 419361 - DNA, 20 bp, Artificial
  CRISPR gRNA sequence
ccactgggcgggaaagagaa

SEQ ID NO: 419362 - DNA, 20 bp, Artificial
  CRISPR gRNA sequence
gaatggagttgagaagctcc

SEQ ID NO: 419363 - DNA, 20 bp, Artificial
  CRISPR gRNA sequence
tccaggggtaggaagcccgg

SEQ ID NO: 419364 - DNA, 20 bp, Artificial
  CRISPR gRNA sequence
gatgcaggcagccacccgtt

SEQ ID NO: 419365 - DNA, 20 bp, Artificial
  CRISPR gRNA sequence
aggatgagaaagcccgcccc

SEQ ID NO: 419366 - DNA, 20 bp, Artificial
  CRISPR gRNA sequence
cgcatccacttctggagaga

SEQ ID NO: 419367 - DNA, 20 bp, Artificial
  CRISPR gRNA sequence
gagagaagggatgctggcgt

SEQ ID NO: 419368 - DNA, 20 bp, Artificial
  CRISPR gRNA sequence
tgcaagcgagggcagggaga

SEQ ID NO: 419369 - DNA, 20 bp, Artificial
  CRISPR gRNA sequence
actgggtcactggcttcaga

SEQ ID NO: 419370 - DNA, 20 bp, Artificial
  CRISPR gRNA sequence
gcaggggacagaggaccggc

SEQ ID NO: 419371 - DNA, 20 bp, Artificial
  CRISPR gRNA sequence
acagaggaccggcacgggtg

SEQ ID NO: 419372 - DNA, 20 bp, Artificial
  CRISPR gRNA sequence
ggaccggcacgggtgtgggg

SEQ ID NO: 419373 - DNA, 20 bp, Artificial
  CRISPR gRNA sequence
cacgggtgtggggttgagtg

SEQ ID NO: 419374 - DNA, 20 bp, Artificial
  CRISPR gRNA sequence
gaggtcctgttgcccaagtt

SEQ ID NO: 419375 - DNA, 20 bp, Artificial
  CRISPR gRNA sequence
agaaggctgagatcctggag

SEQ ID NO: 419376 - DNA, 20 bp, Artificial
  CRISPR gRNA sequence
gggggcgtgagccgagaggc

SEQ ID NO: 419377 - DNA, 20 bp, Artificial
  CRISPR gRNA sequence
ggcaggggtagagaaggagc

SEQ ID NO: 419378 - DNA, 20 bp, Artificial
  CRISPR gRNA sequence
ggtgtttcccgagggagaaa

SEQ ID NO: 419379 - DNA, 20 bp, Artificial
  CRISPR gRNA sequence
aaacagggtgcaggaagaac

SEQ ID NO: 419380 - DNA, 20 bp, Artificial
  CRISPR gRNA sequence
tctctgcccagagaggcttt

SEQ ID NO: 419381 - DNA, 20 bp, Artificial
  CRISPR gRNA sequence
gtggaaggactgcccaaaaa

SEQ ID NO: 419382 - DNA, 20 bp, Artificial
  CRISPR gRNA sequence
ctgcccaaaaaagggattag

SEQ ID NO: 419383 - DNA, 20 bp, Artificial
  CRISPR gRNA sequence
aaggaaagggggcagtggtg

SEQ ID NO: 419384 - DNA, 20 bp, Artificial
  CRISPR gRNA sequence
gggggcagtggtggggggtg

SEQ ID NO: 419385 - DNA, 20 bp, Artificial
  CRISPR gRNA sequence
gcagagagggaggtggagga

SEQ ID NO: 419386 - DNA, 20 bp, Artificial
  CRISPR gRNA sequence
ccaggagagggccttggaga

SEQ ID NO: 419387 - DNA, 20 bp, Artificial
  CRISPR gRNA sequence
gccttggagagagggtgggg

SEQ ID NO: 419388 - DNA, 20 bp, Artificial
  CRISPR gRNA sequence
ggggagggatgaccagaggc

SEQ ID NO: 419389 - DNA, 20 bp, Artificial
  CRISPR gRNA sequence
cagcctgaggaggtgggggc

SEQ ID NO: 419390 - DNA, 20 bp, Artificial
  CRISPR gRNA sequence
agcaaagtggccgtcgtggc

SEQ ID NO: 419391 - DNA, 20 bp, Artificial
  CRISPR gRNA sequence
tcctcaggctgcctgatctg

SEQ ID NO: 419392 - DNA, 20 bp, Artificial
  CRISPR gRNA sequence
ctgcctgatctgcccagctt

SEQ ID NO: 419393 - DNA, 20 bp, Artificial
  CRISPR gRNA sequence
gcccagctttccagctttcc

SEQ ID NO: 419394 - DNA, 20 bp, Artificial
  CRISPR gRNA sequence
agatgtgggaggctcagttc

SEQ ID NO: 419395 - DNA, 20 bp, Artificial
  CRISPR gRNA sequence
ggaggctcagttcctgggct

SEQ ID NO: 419396 - DNA, 20 bp, Artificial
  CRISPR gRNA sequence
cctgggcttgctgtttctgc

SEQ ID NO: 419397 - DNA, 20 bp, Artificial
  CRISPR gRNA sequence
ggtcctgaggtccttagctc

SEQ ID NO: 419398 - DNA, 20 bp, Artificial
  CRISPR gRNA sequence
aaacccaagttcttcctgca

SEQ ID NO: 419399 - DNA, 20 bp, Artificial
  CRISPR gRNA sequence
cagtgacccagtctccctgc

SEQ ID NO: 419400 - DNA, 20 bp, Artificial
  CRISPR gRNA sequence
tggtcaagagaactcttggg

SEQ ID NO: 419401 - DNA, 20 bp, Artificial
  CRISPR gRNA sequence
gggtggctgcctgcatcctc

SEQ ID NO: 419402 - DNA, 20 bp, Artificial
  CRISPR gRNA sequence
cctcccgggcttcctacccc

SEQ ID NO: 419403 - DNA, 20 bp, Artificial
  CRISPR gRNA sequence
cgtgtatggggggccctgtg

SEQ ID NO: 419404 - DNA, 20 bp, Artificial
  CRISPR gRNA sequence
ggggggagagcatggggcta

SEQ ID NO: 419405 - DNA, 20 bp, Artificial
  CRISPR gRNA sequence
agatatctgtagctcagggg

SEQ ID NO: 419406 - DNA, 20 bp, Artificial
  CRISPR gRNA sequence
agacaagtctaaagccaggt

SEQ ID NO: 419407 - DNA, 20 bp, Artificial
  CRISPR gRNA sequence
aaagccaggtgcctgtttcc

SEQ ID NO: 419408 - DNA, 20 bp, Artificial
  CRISPR gRNA sequence
ggtgcctgtttccaggagct

SEQ ID NO: 419409 - DNA, 20 bp, Artificial
  CRISPR gRNA sequence
gcagccctgctgtgttggga

SEQ ID NO: 419410 - DNA, 20 bp, Artificial
  CRISPR gRNA sequence
ccccccatcaccacttagcg

SEQ ID NO: 419411 - DNA, 20 bp, Artificial
  CRISPR gRNA sequence
gctgcatcctcacctacaga

SEQ ID NO: 419412 - DNA, 20 bp, Artificial
  CRISPR gRNA sequence
tgttctgggtaactccccca

SEQ ID NO: 419413 - DNA, 20 bp, Artificial
  CRISPR gRNA sequence
tcacagctgccatcacccct

SEQ ID NO: 419414 - DNA, 20 bp, Artificial
  CRISPR gRNA sequence
cttccggctaagcccacttg

SEQ ID NO: 419415 - DNA, 20 bp, Artificial
  CRISPR gRNA sequence
actccctccccactgcagca

SEQ ID NO: 419416 - DNA, 20 bp, Artificial
  CRISPR gRNA sequence
tgcagcacccagctttaact

SEQ ID NO: 419417 - DNA, 20 bp, Artificial
  CRISPR gRNA sequence
atccttgtctactttgcagc

SEQ ID NO: 419418 - DNA, 20 bp, Artificial
  CRISPR gRNA sequence
gttagagttgcaggaagtgg

SEQ ID NO: 419419 - DNA, 20 bp, Artificial
  CRISPR gRNA sequence
tcagcaaatatttactgagc

SEQ ID NO: 419420 - DNA, 20 bp, Artificial
  CRISPR gRNA sequence
ggttgataactatcggccat

SEQ ID NO: 419421 - DNA, 20 bp, Artificial
  CRISPR gRNA sequence
cagtagtagcaccccacggc

SEQ ID NO: 419422 - DNA, 20 bp, Artificial
  CRISPR gRNA sequence
ggcaggtgcttaataatgta

SEQ ID NO: 419423 - DNA, 20 bp, Artificial
  CRISPR gRNA sequence
acatctcctgaaggccaatc

SEQ ID NO: 419424 - DNA, 20 bp, Artificial
  CRISPR gRNA sequence
aaggccaatcctgagttttc

SEQ ID NO: 419425 - DNA, 20 bp, Artificial
  CRISPR gRNA sequence
tcagccgccttaccctgaac

SEQ ID NO: 419426 - DNA, 20 bp, Artificial
  CRISPR gRNA sequence
ccaatgccctcttgaaggtc

SEQ ID NO: 419427 - DNA, 20 bp, Artificial
  CRISPR gRNA sequence
agatgggggtcagctcatct

SEQ ID NO: 419428 - DNA, 20 bp, Artificial
  CRISPR gRNA sequence
ttattctgtggtctgccagg

SEQ ID NO: 419429 - DNA, 20 bp, Artificial
  CRISPR gRNA sequence
gaaggcagtagggagcctgg

SEQ ID NO: 419430 - DNA, 20 bp, Artificial
  CRISPR gRNA sequence
ccagaacccaagtgagtgca

SEQ ID NO: 419431 - DNA, 20 bp, Artificial
  CRISPR gRNA sequence
gtcacctggatccctgggga

SEQ ID NO: 419432 - DNA, 20 bp, Artificial
  CRISPR gRNA sequence
tgactccagtatctggacaa

SEQ ID NO: 419433 - DNA, 20 bp, Artificial
  CRISPR gRNA sequence
ctctggacaccccatcccag

SEQ ID NO: 419434 - DNA, 20 bp, Artificial
  CRISPR gRNA sequence
atgccagctgtaccaggggg

SEQ ID NO: 419435 - DNA, 20 bp, Artificial
  CRISPR gRNA sequence
agcccctgccacccccatcc

SEQ ID NO: 419436 - DNA, 20 bp, Artificial
  CRISPR gRNA sequence
ttccagtcagggacctgatc

SEQ ID NO: 419437 - DNA, 20 bp, Artificial
  CRISPR gRNA sequence
ctggcttttgcctagggttg

SEQ ID NO: 419438 - DNA, 20 bp, Artificial
  CRISPR gRNA sequence
cctcccagcaggccacctcc

SEQ ID NO: 419439 - DNA, 20 bp, Artificial
  CRISPR gRNA sequence
tccttttggtgactggagcc

SEQ ID NO: 419440 - DNA, 20 bp, Artificial
  CRISPR gRNA sequence
cataagcctctcactccagg

SEQ ID NO: 419441 - DNA, 20 bp, Artificial
  CRISPR gRNA sequence
gggactcagtgtccctcctc

SEQ ID NO: 419442 - DNA, 20 bp, Artificial
  CRISPR gRNA sequence
tcttctcacagtggcgacca

SEQ ID NO: 419443 - DNA, 20 bp, Artificial
  CRISPR gRNA sequence
acgattttctgccttagagc

SEQ ID NO: 419444 - DNA, 20 bp, Artificial
  CRISPR gRNA sequence
tggacaagaaagagccagac

SEQ ID NO: 419445 - DNA, 20 bp, Artificial
  CRISPR gRNA sequence
actcaggcttgctgctgaca

SEQ ID NO: 419446 - DNA, 20 bp, Artificial
  CRISPR gRNA sequence
ccctgccctccccatctggt

SEQ ID NO: 419447 - DNA, 20 bp, Artificial
  CRISPR gRNA sequence
cacaagccatccctggagtg

SEQ ID NO: 419448 - DNA, 20 bp, Artificial
  CRISPR gRNA sequence
tacagatgcaatgagatcca

SEQ ID NO: 419449 - DNA, 20 bp, Artificial
  CRISPR gRNA sequence
gggctgttctggaaggagga

SEQ ID NO: 419450 - DNA, 20 bp, Artificial
  CRISPR gRNA sequence
gaggataaagattattgctg

SEQ ID NO: 419451 - DNA, 20 bp, Artificial
  CRISPR gRNA sequence
atactggagtcacctcacaa

SEQ ID NO: 419452 - DNA, 20 bp, Artificial
  CRISPR gRNA sequence
cccagggatccaggtgaccc

SEQ ID NO: 419453 - DNA, 20 bp, Artificial
  CRISPR gRNA sequence
gagtagaaggaagagatctt

SEQ ID NO: 419454 - DNA, 20 bp, Artificial
  CRISPR gRNA sequence
ttttattaaattgtatacag

SEQ ID NO: 419455 - DNA, 20 bp, Artificial
  CRISPR gRNA sequence
cgtctcagcctttcaaagtg

SEQ ID NO: 419456 - DNA, 20 bp, Artificial
  CRISPR gRNA sequence
gaccacagaataaatactat

SEQ ID NO: 419457 - DNA, 20 bp, Artificial
  CRISPR gRNA sequence
catctgagtagtgtcctgga

SEQ ID NO: 419458 - DNA, 20 bp, Artificial
  CRISPR gRNA sequence
tgatttggtgatgcagacac

SEQ ID NO: 419459 - DNA, 20 bp, Artificial
  CRISPR gRNA sequence
cccagagtctggcacttccc

SEQ ID NO: 419460 - DNA, 20 bp, Artificial
  CRISPR gRNA sequence
gggatgtagagaggaggagg

SEQ ID NO: 419461 - DNA, 20 bp, Artificial
  CRISPR gRNA sequence
tttcgaggtggatggatacc

SEQ ID NO: 419462 - DNA, 20 bp, Artificial
  CRISPR gRNA sequence
actgacaggctgagtcagca

SEQ ID NO: 419463 - DNA, 20 bp, Artificial
  CRISPR gRNA sequence
tccagaaagcaagtgaaaac

SEQ ID NO: 419464 - DNA, 20 bp, Artificial
  CRISPR gRNA sequence
ctctctgagtattctttttt

SEQ ID NO: 419465 - DNA, 20 bp, Artificial
  CRISPR gRNA sequence
ctgagtattcttttttctgt

SEQ ID NO: 419466 - DNA, 20 bp, Artificial
  CRISPR gRNA sequence
taaatatttgctgaccaagg

SEQ ID NO: 419467 - DNA, 20 bp, Artificial
  CRISPR gRNA sequence
agccctggctgcaaagtaga

SEQ ID NO: 419468 - DNA, 20 bp, Artificial
  CRISPR gRNA sequence
cttttatcttgtgactcaag

SEQ ID NO: 419469 - DNA, 20 bp, Artificial
  CRISPR gRNA sequence
ttgtgactcaagaggagatt

SEQ ID NO: 419470 - DNA, 20 bp, Artificial
  CRISPR gRNA sequence
actcaagaggagattttcag

SEQ ID NO: 419471 - DNA, 20 bp, Artificial
  CRISPR gRNA sequence
cagtggcctggcatcacagg

SEQ ID NO: 419472 - DNA, 20 bp, Artificial
  CRISPR gRNA sequence
tcccacctgaggctgacctg

SEQ ID NO: 419473 - DNA, 20 bp, Artificial
  CRISPR gRNA sequence
gaggctcagaaacccagcaa

SEQ ID NO: 419474 - DNA, 20 bp, Artificial
  CRISPR gRNA sequence
aggccactcgctgccgagaa

SEQ ID NO: 419475 - DNA, 20 bp, Artificial
  CRISPR gRNA sequence
gctgacttggggcaggaaga

SEQ ID NO: 419476 - DNA, 20 bp, Artificial
  CRISPR gRNA sequence
gaagctcctggaaacaggca

SEQ ID NO: 419477 - DNA, 20 bp, Artificial
  CRISPR gRNA sequence
ccacatcaccctctccccat

SEQ ID NO: 419478 - DNA, 20 bp, Artificial
  CRISPR gRNA sequence
cactttccccgtccctggcc

SEQ ID NO: 419479 - DNA, 20 bp, Artificial
  CRISPR gRNA sequence
tacttggcatcagccaccct

SEQ ID NO: 419480 - DNA, 20 bp, Artificial
  CRISPR gRNA sequence
ctccacagggccccccatac

SEQ ID NO: 419481 - DNA, 20 bp, Artificial
  CRISPR gRNA sequence
agggatgctggcgtgagggt

SEQ ID NO: 419482 - DNA, 20 bp, Artificial
  CRISPR gRNA sequence
gagggcagggagactgggtc

SEQ ID NO: 419483 - DNA, 20 bp, Artificial
  CRISPR gRNA sequence
gcacgggtgtggggttgagt

SEQ ID NO: 419484 - DNA, 20 bp, Artificial
  CRISPR gRNA sequence
ggattcggaggtcctgttgc

SEQ ID NO: 419485 - DNA, 20 bp, Artificial
  CRISPR gRNA sequence
cagaaggctgagatcctgga

SEQ ID NO: 419486 - DNA, 20 bp, Artificial
  CRISPR gRNA sequence
ggacctcagcccctggctgg

SEQ ID NO: 419487 - DNA, 20 bp, Artificial
  CRISPR gRNA sequence
caggggtagagaaggagcct

SEQ ID NO: 419488 - DNA, 20 bp, Artificial
  CRISPR gRNA sequence
aaacagggtgcaggaagaac

SEQ ID NO: 419489 - DNA, 20 bp, Artificial
  CRISPR gRNA sequence
ggtgcaggaagaacttgggt

SEQ ID NO: 419490 - DNA, 20 bp, Artificial
  CRISPR gRNA sequence
tctgtttcttctctgcccag

SEQ ID NO: 419491 - DNA, 20 bp, Artificial
  CRISPR gRNA sequence
ggtggaaggactgcccaaaa

SEQ ID NO: 419492 - DNA, 20 bp, Artificial
  CRISPR gRNA sequence
gaggtcaaccctcccgccat

SEQ ID NO: 419493 - DNA, 20 bp, Artificial
  CRISPR gRNA sequence
ccggcccgccccccgcaccc

SEQ ID NO: 419494 - DNA, 20 bp, Artificial
  CRISPR gRNA sequence
gccccccgcaccccagggct

SEQ ID NO: 419495 - DNA, 20 bp, Artificial
  CRISPR gRNA sequence
ccgcaccccagggcttacgg

SEQ ID NO: 419496 - DNA, 20 bp, Artificial
  CRISPR gRNA sequence
cgaaagcctctctgggcaga

SEQ ID NO: 419497 - DNA, 20 bp, Artificial
  CRISPR gRNA sequence
cctctctgggcagagaagaa

SEQ ID NO: 419498 - DNA, 20 bp, Artificial
  CRISPR gRNA sequence
ggagtagctgccctcccagg

SEQ ID NO: 419499 - DNA, 20 bp, Artificial
  CRISPR gRNA sequence
acttttctcacccccataat

SEQ ID NO: 419500 - DNA, 20 bp, Artificial
  CRISPR gRNA sequence
ttctgaatggttcgaaagag

SEQ ID NO: 419501 - DNA, 20 bp, Artificial
  CRISPR gRNA sequence
gaaagaggtagaatatattt

SEQ ID NO: 419502 - DNA, 20 bp, Artificial
  CRISPR gRNA sequence
caagacagtataaaacaaac

SEQ ID NO: 419503 - DNA, 20 bp, Artificial
  CRISPR gRNA sequence
gtataaaacaaacacagaaa

SEQ ID NO: 419504 - DNA, 20 bp, Artificial
  CRISPR gRNA sequence
catctctcactttacaactt

SEQ ID NO: 419505 - DNA, 20 bp, Artificial
  CRISPR gRNA sequence
gttccctgttctctatacct

SEQ ID NO: 419506 - DNA, 20 bp, Artificial
  CRISPR gRNA sequence
tgagggttctgagcatttga

SEQ ID NO: 419507 - DNA, 20 bp, Artificial
  CRISPR gRNA sequence
tttgagtagaaagtaatgta

SEQ ID NO: 419508 - DNA, 20 bp, Artificial
  CRISPR gRNA sequence
acaatttaataaaaaaataa

SEQ ID NO: 419509 - DNA, 20 bp, Artificial
  CRISPR gRNA sequence
tttaataaaaaaataaatag

SEQ ID NO: 419510 - DNA, 20 bp, Artificial
  CRISPR gRNA sequence
tgtgatatcacgtaaggggg

SEQ ID NO: 419511 - DNA, 20 bp, Artificial
  CRISPR gRNA sequence
tctagcccaggtccgaggcc

SEQ ID NO: 419512 - DNA, 20 bp, Artificial
  CRISPR gRNA sequence
cattgcatctgtaaagtctg

SEQ ID NO: 419513 - DNA, 20 bp, Artificial
  CRISPR gRNA sequence
gtaggctggaaggggggttg

SEQ ID NO: 419514 - DNA, 20 bp, Artificial
  CRISPR gRNA sequence
gatggggagggcaggggcgc

SEQ ID NO: 419515 - DNA, 20 bp, Artificial
  CRISPR gRNA sequence
gacgggaaccttcacttgga

SEQ ID NO: 419516 - DNA, 20 bp, Artificial
  CRISPR gRNA sequence
ggtgaatcccttgctctaag

SEQ ID NO: 419517 - DNA, 20 bp, Artificial
  CRISPR gRNA sequence
ctccagtcaccaaaaggagc

SEQ ID NO: 419518 - DNA, 20 bp, Artificial
  CRISPR gRNA sequence
cagagaaaggacaccaagga

SEQ ID NO: 419519 - DNA, 20 bp, Artificial
  CRISPR gRNA sequence
ccagagcgttgggcacctat

SEQ ID NO: 419520 - DNA, 20 bp, Artificial
  CRISPR gRNA sequence
gatgaggcatagggtcagga

SEQ ID NO: 419521 - DNA, 20 bp, Artificial
  CRISPR gRNA sequence
gagatcaggtccctgactgg

SEQ ID NO: 419522 - DNA, 20 bp, Artificial
  CRISPR gRNA sequence
tgtgcctccagccaaggtcc

SEQ ID NO: 419523 - DNA, 20 bp, Artificial
  CRISPR gRNA sequence
caaactggccctggcagacc

SEQ ID NO: 419524 - DNA, 20 bp, Artificial
  CRISPR gRNA sequence
ctggcacttcccagctgttt

SEQ ID NO: 419525 - DNA, 20 bp, Artificial
  CRISPR gRNA sequence
gaccttcaagagggcattgg

SEQ ID NO: 419526 - DNA, 20 bp, Artificial
  CRISPR gRNA sequence
agtcagcaaggggattggtg

SEQ ID NO: 419527 - DNA, 20 bp, Artificial
  CRISPR gRNA sequence
taacatctagttagaggtat

SEQ ID NO: 419528 - DNA, 20 bp, Artificial
  CRISPR gRNA sequence
ctgcaaagtagacaaggatt

SEQ ID NO: 419529 - DNA, 20 bp, Artificial
  CRISPR gRNA sequence
ttctacctctttcgaaccat

SEQ ID NO: 419530 - DNA, 20 bp, Artificial
  CRISPR gRNA sequence
tcgtttctttattatggggg

SEQ ID NO: 419531 - DNA, 20 bp, Artificial
  CRISPR gRNA sequence
gttgggggctccagacctga

SEQ ID NO: 419532 - DNA, 20 bp, Artificial
  CRISPR gRNA sequence
gggctccagacctgaagaga

SEQ ID NO: 419533 - DNA, 20 bp, Artificial
  CRISPR gRNA sequence
ggctgcaaggaagggaggca

SEQ ID NO: 419534 - DNA, 20 bp, Artificial
  CRISPR gRNA sequence
gctcataagagtgctaagga

SEQ ID NO: 419535 - DNA, 20 bp, Artificial
  CRISPR gRNA sequence
aggtgatgagctgaggaggc

SEQ ID NO: 419536 - DNA, 20 bp, Artificial
  CRISPR gRNA sequence
ggcgggccactgggcgggaa

SEQ ID NO: 419537 - DNA, 20 bp, Artificial
  CRISPR gRNA sequence
aggcagccacccgttgagga

SEQ ID NO: 419538 - DNA, 20 bp, Artificial
  CRISPR gRNA sequence
gagcctgggtgtttcccgag

SEQ ID NO: 419539 - DNA, 20 bp, Artificial
  CRISPR gRNA sequence
actgcccaaaaaagggatta

SEQ ID NO: 419540 - DNA, 20 bp, Artificial
  CRISPR gRNA sequence
tggagccacccaaagcggct

SEQ ID NO: 419541 - DNA, 20 bp, Artificial
  CRISPR gRNA sequence
ctgagccctccaaaaggagg

SEQ ID NO: 419542 - DNA, 20 bp, Artificial
  CRISPR gRNA sequence
ccgctttgggtggctccagg

SEQ ID NO: 419543 - DNA, 20 bp, Artificial
  CRISPR gRNA sequence
ttcgcggggttccaggccag

SEQ ID NO: 419544 - DNA, 20 bp, Artificial
  CRISPR gRNA sequence
aagggttttccaagacagta

SEQ ID NO: 419545 - DNA, 20 bp, Artificial
  CRISPR gRNA sequence
tgttaccccgaagactttct

SEQ ID NO: 419546 - DNA, 20 bp, Artificial
  CRISPR gRNA sequence
actagcctgggcaacatggt

SEQ ID NO: 419547 - DNA, 20 bp, Artificial
  CRISPR gRNA sequence
agtcagctccctcccctgct

SEQ ID NO: 419548 - DNA, 20 bp, Artificial
  CRISPR gRNA sequence
ctctcattgagccgtctaca

SEQ ID NO: 419549 - DNA, 20 bp, Artificial
  CRISPR gRNA sequence
gaggtatccagaaagcaagt

SEQ ID NO: 419550 - DNA, 20 bp, Artificial
  CRISPR gRNA sequence
gtttgttttatactgtcttg

SEQ ID NO: 419551 - DNA, 20 bp, Artificial
  CRISPR gRNA sequence
ctccagacctgaagagaaaa

SEQ ID NO: 419552 - DNA, 20 bp, Artificial
  CRISPR gRNA sequence
agactttccactgcgaagcg

SEQ ID NO: 419553 - DNA, 20 bp, Artificial
  CRISPR gRNA sequence
tccactgcgaagcgaaaccg

SEQ ID NO: 419554 - DNA, 20 bp, Artificial
  CRISPR gRNA sequence
ccactgcgaagcgaaaccgt

SEQ ID NO: 419555 - DNA, 20 bp, Artificial
  CRISPR gRNA sequence
cactgcgaagcgaaaccgta

SEQ ID NO: 419556 - DNA, 20 bp, Artificial
  CRISPR gRNA sequence
cgaagcgaaaccgtaagccc

SEQ ID NO: 419557 - DNA, 20 bp, Artificial
  CRISPR gRNA sequence
gggtgcggggggcgggccgg

SEQ ID NO: 419558 - DNA, 20 bp, Artificial
  CRISPR gRNA sequence
tgctctgtctgctctccgcc

SEQ ID NO: 419559 - DNA, 20 bp, Artificial
  CRISPR gRNA sequence
gctctgtctgctctccgcca

SEQ ID NO: 419560 - DNA, 20 bp, Artificial
  CRISPR gRNA sequence
ctctgtctgctctccgccac

SEQ ID NO: 419561 - DNA, 20 bp, Artificial
  CRISPR gRNA sequence
tgtctgctctccgccacggc

SEQ ID NO: 419562 - DNA, 20 bp, Artificial
  CRISPR gRNA sequence
tctgctctccgccacggccc

SEQ ID NO: 419563 - DNA, 20 bp, Artificial
  CRISPR gRNA sequence
ctctccgccacggccctgct

SEQ ID NO: 419564 - DNA, 20 bp, Artificial
  CRISPR gRNA sequence
tccgccacggccctgctctg

SEQ ID NO: 419565 - DNA, 20 bp, Artificial
  CRISPR gRNA sequence
cgccacggccctgctctgtt

SEQ ID NO: 419566 - DNA, 20 bp, Artificial
  CRISPR gRNA sequence
ctctgttccctgggacaccc

SEQ ID NO: 419567 - DNA, 20 bp, Artificial
  CRISPR gRNA sequence
tgttccctgggacacccccg

SEQ ID NO: 419568 - DNA, 20 bp, Artificial
  CRISPR gRNA sequence
ttccctgggacacccccgcc

SEQ ID NO: 419569 - DNA, 20 bp, Artificial
  CRISPR gRNA sequence
cctgggacacccccgccccc

SEQ ID NO: 419570 - DNA, 20 bp, Artificial
  CRISPR gRNA sequence
ggacacccccgcccccacct

SEQ ID NO: 419571 - DNA, 20 bp, Artificial
  CRISPR gRNA sequence
ctcaggctgcctgatctgcc

SEQ ID NO: 419572 - DNA, 20 bp, Artificial
  CRISPR gRNA sequence
aggctgcctgatctgcccag

SEQ ID NO: 419573 - DNA, 20 bp, Artificial
  CRISPR gRNA sequence
cctgatctgcccagctttcc

SEQ ID NO: 419574 - DNA, 20 bp, Artificial
  CRISPR gRNA sequence
atctgcccagctttccagct

SEQ ID NO: 419575 - DNA, 20 bp, Artificial
  CRISPR gRNA sequence
cccagctttccagctttcct

SEQ ID NO: 419576 - DNA, 20 bp, Artificial
  CRISPR gRNA sequence
tccagctttcctctggattc

SEQ ID NO: 419577 - DNA, 20 bp, Artificial
  CRISPR gRNA sequence
ccagctttcctctggattcc

SEQ ID NO: 419578 - DNA, 20 bp, Artificial
  CRISPR gRNA sequence
cagctttcctctggattccg

SEQ ID NO: 419579 - DNA, 20 bp, Artificial
  CRISPR gRNA sequence
tcctctggattccggcctct

SEQ ID NO: 419580 - DNA, 20 bp, Artificial
  CRISPR gRNA sequence
cctctggattccggcctctg

SEQ ID NO: 419581 - DNA, 20 bp, Artificial
  CRISPR gRNA sequence
ctctggattccggcctctgg

SEQ ID NO: 419582 - DNA, 20 bp, Artificial
  CRISPR gRNA sequence
tggattccggcctctggtca

SEQ ID NO: 419583 - DNA, 20 bp, Artificial
  CRISPR gRNA sequence
gattccggcctctggtcatc

SEQ ID NO: 419584 - DNA, 20 bp, Artificial
  CRISPR gRNA sequence
cggcctctggtcatccctcc

SEQ ID NO: 419585 - DNA, 20 bp, Artificial
  CRISPR gRNA sequence
tggtcatccctccccaccct

SEQ ID NO: 419586 - DNA, 20 bp, Artificial
  CRISPR gRNA sequence
gtcatccctccccaccctct

SEQ ID NO: 419587 - DNA, 20 bp, Artificial
  CRISPR gRNA sequence
cccaccctctctccaaggcc

SEQ ID NO: 419588 - DNA, 20 bp, Artificial
  CRISPR gRNA sequence
tctccaaggccctctcctgg

SEQ ID NO: 419589 - DNA, 20 bp, Artificial
  CRISPR gRNA sequence
tccaaggccctctcctggtc

SEQ ID NO: 419590 - DNA, 20 bp, Artificial
  CRISPR gRNA sequence
caaggccctctcctggtctc

SEQ ID NO: 419591 - DNA, 20 bp, Artificial
  CRISPR gRNA sequence
tcctggtctcccttcttcta

SEQ ID NO: 419592 - DNA, 20 bp, Artificial
  CRISPR gRNA sequence
ctggtctcccttcttctaga

SEQ ID NO: 419593 - DNA, 20 bp, Artificial
  CRISPR gRNA sequence
gtctcccttcttctagaacc

SEQ ID NO: 419594 - DNA, 20 bp, Artificial
  CRISPR gRNA sequence
ccttcttctagaaccccttc

SEQ ID NO: 419595 - DNA, 20 bp, Artificial
  CRISPR gRNA sequence
cttctagaaccccttcctcc

SEQ ID NO: 419596 - DNA, 20 bp, Artificial
  CRISPR gRNA sequence
ttctagaaccccttcctcca

SEQ ID NO: 419597 - DNA, 20 bp, Artificial
  CRISPR gRNA sequence
ctagaaccccttcctccacc

SEQ ID NO: 419598 - DNA, 20 bp, Artificial
  CRISPR gRNA sequence
tagaaccccttcctccacct

SEQ ID NO: 419599 - DNA, 20 bp, Artificial
  CRISPR gRNA sequence
gaaccccttcctccacctcc

SEQ ID NO: 419600 - DNA, 20 bp, Artificial
  CRISPR gRNA sequence
cctccacctccctctctgca

SEQ ID NO: 419601 - DNA, 20 bp, Artificial
  CRISPR gRNA sequence
ctccacctccctctctgcag

SEQ ID NO: 419602 - DNA, 20 bp, Artificial
  CRISPR gRNA sequence
cacctccctctctgcagaac

SEQ ID NO: 419603 - DNA, 20 bp, Artificial
  CRISPR gRNA sequence
cctctctgcagaacttctcc

SEQ ID NO: 419604 - DNA, 20 bp, Artificial
  CRISPR gRNA sequence
tctgcagaacttctccttta

SEQ ID NO: 419605 - DNA, 20 bp, Artificial
  CRISPR gRNA sequence
tgcagaacttctcctttacc

SEQ ID NO: 419606 - DNA, 20 bp, Artificial
  CRISPR gRNA sequence
cagaacttctcctttacccc

SEQ ID NO: 419607 - DNA, 20 bp, Artificial
  CRISPR gRNA sequence
ctcctttaccccccaccccc

SEQ ID NO: 419608 - DNA, 20 bp, Artificial
  CRISPR gRNA sequence
tcctttaccccccacccccc

SEQ ID NO: 419609 - DNA, 20 bp, Artificial
  CRISPR gRNA sequence
ctttaccccccaccccccac

SEQ ID NO: 419610 - DNA, 20 bp, Artificial
  CRISPR gRNA sequence
taccccccaccccccaccac

SEQ ID NO: 419611 - DNA, 20 bp, Artificial
  CRISPR gRNA sequence
accccccaccccccaccact

SEQ ID NO: 419612 - DNA, 20 bp, Artificial
  CRISPR gRNA sequence
ccccccaccccccaccactg

SEQ ID NO: 419613 - DNA, 20 bp, Artificial
  CRISPR gRNA sequence
ccccctttccttttctgacc

SEQ ID NO: 419614 - DNA, 20 bp, Artificial
  CRISPR gRNA sequence
tccttttctgacctcctttt

SEQ ID NO: 419615 - DNA, 20 bp, Artificial
  CRISPR gRNA sequence
ccttttctgacctccttttg

SEQ ID NO: 419616 - DNA, 20 bp, Artificial
  CRISPR gRNA sequence
cttttctgacctccttttgg

SEQ ID NO: 419617 - DNA, 20 bp, Artificial
  CRISPR gRNA sequence
ttctgacctccttttggagg

SEQ ID NO: 419618 - DNA, 20 bp, Artificial
  CRISPR gRNA sequence
tctgacctccttttggaggg

SEQ ID NO: 419619 - DNA, 20 bp, Artificial
  CRISPR gRNA sequence
ctgacctccttttggagggc

SEQ ID NO: 419620 - DNA, 20 bp, Artificial
  CRISPR gRNA sequence
tgacctccttttggagggct

SEQ ID NO: 419621 - DNA, 20 bp, Artificial
  CRISPR gRNA sequence
acctccttttggagggctca

SEQ ID NO: 419622 - DNA, 20 bp, Artificial
  CRISPR gRNA sequence
cttttggagggctcagcgct

SEQ ID NO: 419623 - DNA, 20 bp, Artificial
  CRISPR gRNA sequence
ttggagggctcagcgctgcc

SEQ ID NO: 419624 - DNA, 20 bp, Artificial
  CRISPR gRNA sequence
tggagggctcagcgctgccc

SEQ ID NO: 419625 - DNA, 20 bp, Artificial
  CRISPR gRNA sequence
ggagggctcagcgctgccca

SEQ ID NO: 419626 - DNA, 20 bp, Artificial
  CRISPR gRNA sequence
gagggctcagcgctgcccag

SEQ ID NO: 419627 - DNA, 20 bp, Artificial
  CRISPR gRNA sequence
agcgctgcccagaccatagg

SEQ ID NO: 419628 - DNA, 20 bp, Artificial
  CRISPR gRNA sequence
cccagaccataggagagatg

SEQ ID NO: 419629 - DNA, 20 bp, Artificial
  CRISPR gRNA sequence
agttcctgggcttgctgttt

SEQ ID NO: 419630 - DNA, 20 bp, Artificial
  CRISPR gRNA sequence
ctgggcttgctgtttctgca

SEQ ID NO: 419631 - DNA, 20 bp, Artificial
  CRISPR gRNA sequence
ggcttgctgtttctgcagcc

SEQ ID NO: 419632 - DNA, 20 bp, Artificial
  CRISPR gRNA sequence
gctgtttctgcagccgcttt

SEQ ID NO: 419633 - DNA, 20 bp, Artificial
  CRISPR gRNA sequence
ctgtttctgcagccgctttg

SEQ ID NO: 419634 - DNA, 20 bp, Artificial
  CRISPR gRNA sequence
tttctgcagccgctttgggt

SEQ ID NO: 419635 - DNA, 20 bp, Artificial
  CRISPR gRNA sequence
ctgcagccgctttgggtggc

SEQ ID NO: 419636 - DNA, 20 bp, Artificial
  CRISPR gRNA sequence
tgcagccgctttgggtggct

SEQ ID NO: 419637 - DNA, 20 bp, Artificial
  CRISPR gRNA sequence
cagccgctttgggtggctcc

SEQ ID NO: 419638 - DNA, 20 bp, Artificial
  CRISPR gRNA sequence
tgggtggctccaggtaaaac

SEQ ID NO: 419639 - DNA, 20 bp, Artificial
  CRISPR gRNA sequence
gggtggctccaggtaaaacg

SEQ ID NO: 419640 - DNA, 20 bp, Artificial
  CRISPR gRNA sequence
ggtggctccaggtaaaacgg

SEQ ID NO: 419641 - DNA, 20 bp, Artificial
  CRISPR gRNA sequence
caggtaaaacggggatggcg

SEQ ID NO: 419642 - DNA, 20 bp, Artificial
  CRISPR gRNA sequence
acctccagccccacaggagg

SEQ ID NO: 419643 - DNA, 20 bp, Artificial
  CRISPR gRNA sequence
cagccccacaggaggggacc

SEQ ID NO: 419644 - DNA, 20 bp, Artificial
  CRISPR gRNA sequence
tgtggccacaaaggtcctga

SEQ ID NO: 419645 - DNA, 20 bp, Artificial
  CRISPR gRNA sequence
tggccacaaaggtcctgagg

SEQ ID NO: 419646 - DNA, 20 bp, Artificial
  CRISPR gRNA sequence
aggtccttagctctgtggat

SEQ ID NO: 419647 - DNA, 20 bp, Artificial
  CRISPR gRNA sequence
agctctgtggattcttctaa

SEQ ID NO: 419648 - DNA, 20 bp, Artificial
  CRISPR gRNA sequence
gctctgtggattcttctaat

SEQ ID NO: 419649 - DNA, 20 bp, Artificial
  CRISPR gRNA sequence
tgtggattcttctaatccct

SEQ ID NO: 419650 - DNA, 20 bp, Artificial
  CRISPR gRNA sequence
tggattcttctaatcccttt

SEQ ID NO: 419651 - DNA, 20 bp, Artificial
  CRISPR gRNA sequence
ttctaatcccttttttgggc

SEQ ID NO: 419652 - DNA, 20 bp, Artificial
  CRISPR gRNA sequence
ctaatcccttttttgggcag

SEQ ID NO: 419653 - DNA, 20 bp, Artificial
  CRISPR gRNA sequence
taatcccttttttgggcagt

SEQ ID NO: 419654 - DNA, 20 bp, Artificial
  CRISPR gRNA sequence
atcccttttttgggcagtcc

SEQ ID NO: 419655 - DNA, 20 bp, Artificial
  CRISPR gRNA sequence
ttttgggcagtccttccacc

SEQ ID NO: 419656 - DNA, 20 bp, Artificial
  CRISPR gRNA sequence
tttgggcagtccttccaccc

SEQ ID NO: 419657 - DNA, 20 bp, Artificial
  CRISPR gRNA sequence
ttgggcagtccttccacccc

SEQ ID NO: 419658 - DNA, 20 bp, Artificial
  CRISPR gRNA sequence
tgggcagtccttccaccccg

SEQ ID NO: 419659 - DNA, 20 bp, Artificial
  CRISPR gRNA sequence
gggcagtccttccaccccga

SEQ ID NO: 419660 - DNA, 20 bp, Artificial
  CRISPR gRNA sequence
ggcagtccttccaccccgaa

SEQ ID NO: 419661 - DNA, 20 bp, Artificial
  CRISPR gRNA sequence
ccaccccgaaagcctctctg

SEQ ID NO: 419662 - DNA, 20 bp, Artificial
  CRISPR gRNA sequence
caccccgaaagcctctctgg

SEQ ID NO: 419663 - DNA, 20 bp, Artificial
  CRISPR gRNA sequence
tctgggcagagaagaaacag

SEQ ID NO: 419664 - DNA, 20 bp, Artificial
  CRISPR gRNA sequence
tgggcagagaagaaacagaa

SEQ ID NO: 419665 - DNA, 20 bp, Artificial
  CRISPR gRNA sequence
ggcagagaagaaacagaaac

SEQ ID NO: 419666 - DNA, 20 bp, Artificial
  CRISPR gRNA sequence
ttcctgcaccctgtttctcc

SEQ ID NO: 419667 - DNA, 20 bp, Artificial
  CRISPR gRNA sequence
cctgcaccctgtttctccct

SEQ ID NO: 419668 - DNA, 20 bp, Artificial
  CRISPR gRNA sequence
ctgcaccctgtttctccctc

SEQ ID NO: 419669 - DNA, 20 bp, Artificial
  CRISPR gRNA sequence
caccctgtttctccctcggg

SEQ ID NO: 419670 - DNA, 20 bp, Artificial
  CRISPR gRNA sequence
tttctccctcgggaaacacc

SEQ ID NO: 419671 - DNA, 20 bp, Artificial
  CRISPR gRNA sequence
ctccctcgggaaacacccag

SEQ ID NO: 419672 - DNA, 20 bp, Artificial
  CRISPR gRNA sequence
tccctcgggaaacacccagg

SEQ ID NO: 419673 - DNA, 20 bp, Artificial
  CRISPR gRNA sequence
cctcgggaaacacccaggct

SEQ ID NO: 419674 - DNA, 20 bp, Artificial
  CRISPR gRNA sequence
gggaaacacccaggctcctt

SEQ ID NO: 419675 - DNA, 20 bp, Artificial
  CRISPR gRNA sequence
cttctctacccctgcctctc

SEQ ID NO: 419676 - DNA, 20 bp, Artificial
  CRISPR gRNA sequence
ctctacccctgcctctcggc

SEQ ID NO: 419677 - DNA, 20 bp, Artificial
  CRISPR gRNA sequence
tctacccctgcctctcggct

SEQ ID NO: 419678 - DNA, 20 bp, Artificial
  CRISPR gRNA sequence
tacccctgcctctcggctca

SEQ ID NO: 419679 - DNA, 20 bp, Artificial
  CRISPR gRNA sequence
cccctgcctctcggctcacg

SEQ ID NO: 419680 - DNA, 20 bp, Artificial
  CRISPR gRNA sequence
cctctcggctcacgccccct

SEQ ID NO: 419681 - DNA, 20 bp, Artificial
  CRISPR gRNA sequence
tcggctcacgccccctcccc

SEQ ID NO: 419682 - DNA, 20 bp, Artificial
  CRISPR gRNA sequence
ggctcacgccccctcccctt

SEQ ID NO: 419683 - DNA, 20 bp, Artificial
  CRISPR gRNA sequence
acgccccctccccttggcct

SEQ ID NO: 419684 - DNA, 20 bp, Artificial
  CRISPR gRNA sequence
cccttggcctctcttttgct

SEQ ID NO: 419685 - DNA, 20 bp, Artificial
  CRISPR gRNA sequence
ggcctctcttttgctcacct

SEQ ID NO: 419686 - DNA, 20 bp, Artificial
  CRISPR gRNA sequence
gcctctcttttgctcaccta

SEQ ID NO: 419687 - DNA, 20 bp, Artificial
  CRISPR gRNA sequence
tcttttgctcacctagtgaa

SEQ ID NO: 419688 - DNA, 20 bp, Artificial
  CRISPR gRNA sequence
ttttgctcacctagtgaagc

SEQ ID NO: 419689 - DNA, 20 bp, Artificial
  CRISPR gRNA sequence
ttgctcacctagtgaagcct

SEQ ID NO: 419690 - DNA, 20 bp, Artificial
  CRISPR gRNA sequence
tgctcacctagtgaagcctc

SEQ ID NO: 419691 - DNA, 20 bp, Artificial
  CRISPR gRNA sequence
gctcacctagtgaagcctct

SEQ ID NO: 419692 - DNA, 20 bp, Artificial
  CRISPR gRNA sequence
ctcacctagtgaagcctctc

SEQ ID NO: 419693 - DNA, 20 bp, Artificial
  CRISPR gRNA sequence
acctagtgaagcctctccag

SEQ ID NO: 419694 - DNA, 20 bp, Artificial
  CRISPR gRNA sequence
gtgaagcctctccagccagg

SEQ ID NO: 419695 - DNA, 20 bp, Artificial
  CRISPR gRNA sequence
tccagccaggggctgaggtc

SEQ ID NO: 419696 - DNA, 20 bp, Artificial
  CRISPR gRNA sequence
cagccaggggctgaggtccc

SEQ ID NO: 419697 - DNA, 20 bp, Artificial
  CRISPR gRNA sequence
aggtcccggtggtgtgggcc

SEQ ID NO: 419698 - DNA, 20 bp, Artificial
  CRISPR gRNA sequence
ctgcccagctcccctgcagc

SEQ ID NO: 419699 - DNA, 20 bp, Artificial
  CRISPR gRNA sequence
cccagctcccctgcagcccc

SEQ ID NO: 419700 - DNA, 20 bp, Artificial
  CRISPR gRNA sequence
ccctgcagccccacaatccc

SEQ ID NO: 419701 - DNA, 20 bp, Artificial
  CRISPR gRNA sequence
cagccccacaatccccctcc

SEQ ID NO: 419702 - DNA, 20 bp, Artificial
  CRISPR gRNA sequence
caggatctcagccttctgcg

SEQ ID NO: 419703 - DNA, 20 bp, Artificial
  CRISPR gRNA sequence
agccttctgcgaagagcagg

SEQ ID NO: 419704 - DNA, 20 bp, Artificial
  CRISPR gRNA sequence
ctgcgaagagcaggggtcac

SEQ ID NO: 419705 - DNA, 20 bp, Artificial
  CRISPR gRNA sequence
tgcgaagagcaggggtcact

SEQ ID NO: 419706 - DNA, 20 bp, Artificial
  CRISPR gRNA sequence
cgaagagcaggggtcacttg

SEQ ID NO: 419707 - DNA, 20 bp, Artificial
  CRISPR gRNA sequence
ggcagcatcagccagacagg

SEQ ID NO: 419708 - DNA, 20 bp, Artificial
  CRISPR gRNA sequence
gcagcatcagccagacaggt

SEQ ID NO: 419709 - DNA, 20 bp, Artificial
  CRISPR gRNA sequence
gggcaacaggacctccgaat

SEQ ID NO: 419710 - DNA, 20 bp, Artificial
  CRISPR gRNA sequence
ggcaacaggacctccgaatc

SEQ ID NO: 419711 - DNA, 20 bp, Artificial
  CRISPR gRNA sequence
cgaatccagcactcaacccc

SEQ ID NO: 419712 - DNA, 20 bp, Artificial
  CRISPR gRNA sequence
aaccccacacccgtgccggt

SEQ ID NO: 419713 - DNA, 20 bp, Artificial
  CRISPR gRNA sequence
tgtcccctgccctgaggtgt

SEQ ID NO: 419714 - DNA, 20 bp, Artificial
  CRISPR gRNA sequence
tcccctgccctgaggtgtca

SEQ ID NO: 419715 - DNA, 20 bp, Artificial
  CRISPR gRNA sequence
ccctgaggtgtcactccctc

SEQ ID NO: 419716 - DNA, 20 bp, Artificial
  CRISPR gRNA sequence
aggtgtcactccctctgaag

SEQ ID NO: 419717 - DNA, 20 bp, Artificial
  CRISPR gRNA sequence
cctctgaagccagtgaccca

SEQ ID NO: 419718 - DNA, 20 bp, Artificial
  CRISPR gRNA sequence
tgaagccagtgacccagtct

SEQ ID NO: 419719 - DNA, 20 bp, Artificial
  CRISPR gRNA sequence
aagccagtgacccagtctcc

SEQ ID NO: 419720 - DNA, 20 bp, Artificial
  CRISPR gRNA sequence
cctgccctcgcttgcaccgt

SEQ ID NO: 419721 - DNA, 20 bp, Artificial
  CRISPR gRNA sequence
ccctcgcttgcaccgttcct

SEQ ID NO: 419722 - DNA, 20 bp, Artificial
  CRISPR gRNA sequence
gcttgcaccgttcctgccct

SEQ ID NO: 419723 - DNA, 20 bp, Artificial
  CRISPR gRNA sequence
gcaccgttcctgcccttgct

SEQ ID NO: 419724 - DNA, 20 bp, Artificial
  CRISPR gRNA sequence
caccgttcctgcccttgctc

SEQ ID NO: 419725 - DNA, 20 bp, Artificial
  CRISPR gRNA sequence
ctgcccttgctctgcaatca

SEQ ID NO: 419726 - DNA, 20 bp, Artificial
  CRISPR gRNA sequence
cccttgctctgcaatcagcg

SEQ ID NO: 419727 - DNA, 20 bp, Artificial
  CRISPR gRNA sequence
gctctgcaatcagcgaccct

SEQ ID NO: 419728 - DNA, 20 bp, Artificial
  CRISPR gRNA sequence
ctctgcaatcagcgaccctc

SEQ ID NO: 419729 - DNA, 20 bp, Artificial
  CRISPR gRNA sequence
tgcaatcagcgaccctcacg

SEQ ID NO: 419730 - DNA, 20 bp, Artificial
  CRISPR gRNA sequence
caatcagcgaccctcacgcc

SEQ ID NO: 419731 - DNA, 20 bp, Artificial
  CRISPR gRNA sequence
acgccagcatcccttctctc

SEQ ID NO: 419732 - DNA, 20 bp, Artificial
  CRISPR gRNA sequence
ctctccagaagtggatgcgg

SEQ ID NO: 419733 - DNA, 20 bp, Artificial
  CRISPR gRNA sequence
tctccagaagtggatgcggc

SEQ ID NO: 419734 - DNA, 20 bp, Artificial
  CRISPR gRNA sequence
tccagaagtggatgcggcca

SEQ ID NO: 419735 - DNA, 20 bp, Artificial
  CRISPR gRNA sequence
cagaagtggatgcggccagt

SEQ ID NO: 419736 - DNA, 20 bp, Artificial
  CRISPR gRNA sequence
gtggtcaagagaactcttgg

SEQ ID NO: 419737 - DNA, 20 bp, Artificial
  CRISPR gRNA sequence
ttggggcgggctttctcatc

SEQ ID NO: 419738 - DNA, 20 bp, Artificial
  CRISPR gRNA sequence
ggggcgggctttctcatcct

SEQ ID NO: 419739 - DNA, 20 bp, Artificial
  CRISPR gRNA sequence
gggcgggctttctcatcctc

SEQ ID NO: 419740 - DNA, 20 bp, Artificial
  CRISPR gRNA sequence
tctcatcctcaacgggtggc

SEQ ID NO: 419741 - DNA, 20 bp, Artificial
  CRISPR gRNA sequence
ctcatcctcaacgggtggct

SEQ ID NO: 419742 - DNA, 20 bp, Artificial
  CRISPR gRNA sequence
tcatcctcaacgggtggctg

SEQ ID NO: 419743 - DNA, 20 bp, Artificial
  CRISPR gRNA sequence
atcctcaacgggtggctgcc

SEQ ID NO: 419744 - DNA, 20 bp, Artificial
  CRISPR gRNA sequence
aacgggtggctgcctgcatc

SEQ ID NO: 419745 - DNA, 20 bp, Artificial
  CRISPR gRNA sequence
cctgcatcctcccgggcttc

SEQ ID NO: 419746 - DNA, 20 bp, Artificial
  CRISPR gRNA sequence
catcctcccgggcttcctac

SEQ ID NO: 419747 - DNA, 20 bp, Artificial
  CRISPR gRNA sequence
ccgggcttcctacccctgga

SEQ ID NO: 419748 - DNA, 20 bp, Artificial
  CRISPR gRNA sequence
cctacccctggagcttctca

SEQ ID NO: 419749 - DNA, 20 bp, Artificial
  CRISPR gRNA sequence
ctacccctggagcttctcaa

SEQ ID NO: 419750 - DNA, 20 bp, Artificial
  CRISPR gRNA sequence
cccctggagcttctcaactc

SEQ ID NO: 419751 - DNA, 20 bp, Artificial
  CRISPR gRNA sequence
gagcttctcaactccattct

SEQ ID NO: 419752 - DNA, 20 bp, Artificial
  CRISPR gRNA sequence
ctcaactccattctctttcc

SEQ ID NO: 419753 - DNA, 20 bp, Artificial
  CRISPR gRNA sequence
tcaactccattctctttccc

SEQ ID NO: 419754 - DNA, 20 bp, Artificial
  CRISPR gRNA sequence
aactccattctctttcccgc

SEQ ID NO: 419755 - DNA, 20 bp, Artificial
  CRISPR gRNA sequence
cattctctttcccgcccagt

SEQ ID NO: 419756 - DNA, 20 bp, Artificial
  CRISPR gRNA sequence
tctttcccgcccagtggccc

SEQ ID NO: 419757 - DNA, 20 bp, Artificial
  CRISPR gRNA sequence
tttcccgcccagtggcccgc

SEQ ID NO: 419758 - DNA, 20 bp, Artificial
  CRISPR gRNA sequence
tcccgcccagtggcccgccc

SEQ ID NO: 419759 - DNA, 20 bp, Artificial
  CRISPR gRNA sequence
cccgcccagtggcccgcccg

SEQ ID NO: 419760 - DNA, 20 bp, Artificial
  CRISPR gRNA sequence
ccgcccagtggcccgcccgc

SEQ ID NO: 419761 - DNA, 20 bp, Artificial
  CRISPR gRNA sequence
ccgcccccggccatcccctg

SEQ ID NO: 419762 - DNA, 20 bp, Artificial
  CRISPR gRNA sequence
gcccccggccctcacccggc

SEQ ID NO: 419763 - DNA, 20 bp, Artificial
  CRISPR gRNA sequence
acccggcggcgccctcctcc

SEQ ID NO: 419764 - DNA, 20 bp, Artificial
  CRISPR gRNA sequence
ctcctgggggcccaggcccc

SEQ ID NO: 419765 - DNA, 20 bp, Artificial
  CRISPR gRNA sequence
ctgggggcccaggccccgcc

SEQ ID NO: 419766 - DNA, 20 bp, Artificial
  CRISPR gRNA sequence
ggggcccaggccccgccgct

SEQ ID NO: 419767 - DNA, 20 bp, Artificial
  CRISPR gRNA sequence
cacggtgctgagcgtgggtc

SEQ ID NO: 419768 - DNA, 20 bp, Artificial
  CRISPR gRNA sequence
agcgtgggtcccggaggcct

SEQ ID NO: 419769 - DNA, 20 bp, Artificial
  CRISPR gRNA sequence
cgcagcgggaggctgcccct

SEQ ID NO: 419770 - DNA, 20 bp, Artificial
  CRISPR gRNA sequence
cccctgcagccccgcgtcca

SEQ ID NO: 419771 - DNA, 20 bp, Artificial
  CRISPR gRNA sequence
cagccccgcgtccagctgga

SEQ ID NO: 419772 - DNA, 20 bp, Artificial
  CRISPR gRNA sequence
gatgagcgcggccggcagcg

SEQ ID NO: 419773 - DNA, 20 bp, Artificial
  CRISPR gRNA sequence
ctcgctatggctgcgcccag

SEQ ID NO: 419774 - DNA, 20 bp, Artificial
  CRISPR gRNA sequence
tcgctatggctgcgcccagc

SEQ ID NO: 419775 - DNA, 20 bp, Artificial
  CRISPR gRNA sequence
gctatggctgcgcccagccc

SEQ ID NO: 419776 - DNA, 20 bp, Artificial
  CRISPR gRNA sequence
tggctgcgcccagcccggcg

SEQ ID NO: 419777 - DNA, 20 bp, Artificial
  CRISPR gRNA sequence
cgcccagcccggcgcgcgga

SEQ ID NO: 419778 - DNA, 20 bp, Artificial
  CRISPR gRNA sequence
agggaccgcgccctctcctg

SEQ ID NO: 419779 - DNA, 20 bp, Artificial
  CRISPR gRNA sequence
tcctgccgcctccgtctgcg

SEQ ID NO: 419780 - DNA, 20 bp, Artificial
  CRISPR gRNA sequence
ctgccgcctccgtctgcgcc

SEQ ID NO: 419781 - DNA, 20 bp, Artificial
  CRISPR gRNA sequence
ccgcctccgtctgcgcctgg

SEQ ID NO: 419782 - DNA, 20 bp, Artificial
  CRISPR gRNA sequence
cgtctgcgcctgggccaggc

SEQ ID NO: 419783 - DNA, 20 bp, Artificial
  CRISPR gRNA sequence
cgcctgggccaggcctcgag

SEQ ID NO: 419784 - DNA, 20 bp, Artificial
  CRISPR gRNA sequence
ggccaggcctcgagtatgtg

SEQ ID NO: 419785 - DNA, 20 bp, Artificial
  CRISPR gRNA sequence
gagtatgtggggcgggacga

SEQ ID NO: 419786 - DNA, 20 bp, Artificial
  CRISPR gRNA sequence
ggaggtgggtccccatcccc

SEQ ID NO: 419787 - DNA, 20 bp, Artificial
  CRISPR gRNA sequence
cctcccgggacgcaggaagg

SEQ ID NO: 419788 - DNA, 20 bp, Artificial
  CRISPR gRNA sequence
ccgggacgcaggaagggctg

SEQ ID NO: 419789 - DNA, 20 bp, Artificial
  CRISPR gRNA sequence
gggcagaggctgcgccctag

SEQ ID NO: 419790 - DNA, 20 bp, Artificial
  CRISPR gRNA sequence
cgccctaggccctgtcggag

SEQ ID NO: 419791 - DNA, 20 bp, Artificial
  CRISPR gRNA sequence
ggccctgtcggagagctccc

SEQ ID NO: 419792 - DNA, 20 bp, Artificial
  CRISPR gRNA sequence
tcggagagctcccagaagag

SEQ ID NO: 419793 - DNA, 20 bp, Artificial
  CRISPR gRNA sequence
ccagaagagtagaggaaggg

SEQ ID NO: 419794 - DNA, 20 bp, Artificial
  CRISPR gRNA sequence
ctggagtggaaggtgccccc

SEQ ID NO: 419795 - DNA, 20 bp, Artificial
  CRISPR gRNA sequence
gagtggaaggtgcccccgaa

SEQ ID NO: 419796 - DNA, 20 bp, Artificial
  CRISPR gRNA sequence
tggagagattgtgtcacccc

SEQ ID NO: 419797 - DNA, 20 bp, Artificial
  CRISPR gRNA sequence
tgtcacccccgagctcccct

SEQ ID NO: 419798 - DNA, 20 bp, Artificial
  CRISPR gRNA sequence
cccttctcccacccacgcgg

SEQ ID NO: 419799 - DNA, 20 bp, Artificial
  CRISPR gRNA sequence
ctcccacccacgcgggagtg

SEQ ID NO: 419800 - DNA, 20 bp, Artificial
  CRISPR gRNA sequence
tcccacccacgcgggagtgc

SEQ ID NO: 419801 - DNA, 20 bp, Artificial
  CRISPR gRNA sequence
ccacccacgcgggagtgccc

SEQ ID NO: 419802 - DNA, 20 bp, Artificial
  CRISPR gRNA sequence
aagtgattcatttcagatat

SEQ ID NO: 419803 - DNA, 20 bp, Artificial
  CRISPR gRNA sequence
atttcagatatctgtagctc

SEQ ID NO: 419804 - DNA, 20 bp, Artificial
  CRISPR gRNA sequence
cagatatctgtagctcaggg

SEQ ID NO: 419805 - DNA, 20 bp, Artificial
  CRISPR gRNA sequence
agatatctgtagctcagggg

SEQ ID NO: 419806 - DNA, 20 bp, Artificial
  CRISPR gRNA sequence
tagctcagggggtgggcttc

SEQ ID NO: 419807 - DNA, 20 bp, Artificial
  CRISPR gRNA sequence
agggggtgggcttcgcgggg

SEQ ID NO: 419808 - DNA, 20 bp, Artificial
  CRISPR gRNA sequence
cgcggggttccaggccagga

SEQ ID NO: 419809 - DNA, 20 bp, Artificial
  CRISPR gRNA sequence
gcggggttccaggccaggaa

SEQ ID NO: 419810 - DNA, 20 bp, Artificial
  CRISPR gRNA sequence
caggccaggaaaacggcaag

SEQ ID NO: 419811 - DNA, 20 bp, Artificial
  CRISPR gRNA sequence
atgccaagtaaactccaggc

SEQ ID NO: 419812 - DNA, 20 bp, Artificial
  CRISPR gRNA sequence
caggccagggacggggaaag

SEQ ID NO: 419813 - DNA, 20 bp, Artificial
  CRISPR gRNA sequence
gggagtcttggggatccact

SEQ ID NO: 419814 - DNA, 20 bp, Artificial
  CRISPR gRNA sequence
ggggatccactttatgcacc

SEQ ID NO: 419815 - DNA, 20 bp, Artificial
  CRISPR gRNA sequence
gggatccactttatgcacct

SEQ ID NO: 419816 - DNA, 20 bp, Artificial
  CRISPR gRNA sequence
tatgcacctccaggtgctgg

SEQ ID NO: 419817 - DNA, 20 bp, Artificial
  CRISPR gRNA sequence
atgcacctccaggtgctgga

SEQ ID NO: 419818 - DNA, 20 bp, Artificial
  CRISPR gRNA sequence
tgcacctccaggtgctggaa

SEQ ID NO: 419819 - DNA, 20 bp, Artificial
  CRISPR gRNA sequence
caggtgctggaagctgagat

SEQ ID NO: 419820 - DNA, 20 bp, Artificial
  CRISPR gRNA sequence
gaagctgagatggggagagg

SEQ ID NO: 419821 - DNA, 20 bp, Artificial
  CRISPR gRNA sequence
agatggggagagggtgatgt

SEQ ID NO: 419822 - DNA, 20 bp, Artificial
  CRISPR gRNA sequence
aagccaggtgcctgtttcca

SEQ ID NO: 419823 - DNA, 20 bp, Artificial
  CRISPR gRNA sequence
tttccaggagcttccggctt

SEQ ID NO: 419824 - DNA, 20 bp, Artificial
  CRISPR gRNA sequence
ccaggagcttccggcttggc

SEQ ID NO: 419825 - DNA, 20 bp, Artificial
  CRISPR gRNA sequence
caggagcttccggcttggca

SEQ ID NO: 419826 - DNA, 20 bp, Artificial
  CRISPR gRNA sequence
ccggcttggcagccctgctg

SEQ ID NO: 419827 - DNA, 20 bp, Artificial
  CRISPR gRNA sequence
cggcttggcagccctgctgt

SEQ ID NO: 419828 - DNA, 20 bp, Artificial
  CRISPR gRNA sequence
ggcagccctgctgtgttggg

SEQ ID NO: 419829 - DNA, 20 bp, Artificial
  CRISPR gRNA sequence
gcagccctgctgtgttggga

SEQ ID NO: 419830 - DNA, 20 bp, Artificial
  CRISPR gRNA sequence
ctgtgttgggaaattgtttc

SEQ ID NO: 419831 - DNA, 20 bp, Artificial
  CRISPR gRNA sequence
tgttgggaaattgtttccag

SEQ ID NO: 419832 - DNA, 20 bp, Artificial
  CRISPR gRNA sequence
ggaaattgtttccagtgggc

SEQ ID NO: 419833 - DNA, 20 bp, Artificial
  CRISPR gRNA sequence
tttccagtgggctgatgaag

SEQ ID NO: 419834 - DNA, 20 bp, Artificial
  CRISPR gRNA sequence
ccagtgggctgatgaagtct

SEQ ID NO: 419835 - DNA, 20 bp, Artificial
  CRISPR gRNA sequence
cagtgggctgatgaagtctt

SEQ ID NO: 419836 - DNA, 20 bp, Artificial
  CRISPR gRNA sequence
atgaagtcttctttatcctt

SEQ ID NO: 419837 - DNA, 20 bp, Artificial
  CRISPR gRNA sequence
ctttatccttgcacagtgac

SEQ ID NO: 419838 - DNA, 20 bp, Artificial
  CRISPR gRNA sequence
tttatccttgcacagtgact

SEQ ID NO: 419839 - DNA, 20 bp, Artificial
  CRISPR gRNA sequence
tatccttgcacagtgactgc

SEQ ID NO: 419840 - DNA, 20 bp, Artificial
  CRISPR gRNA sequence
atccttgcacagtgactgcc

SEQ ID NO: 419841 - DNA, 20 bp, Artificial
  CRISPR gRNA sequence
tccttgcacagtgactgcca

SEQ ID NO: 419842 - DNA, 20 bp, Artificial
  CRISPR gRNA sequence
gcacagtgactgccagcccc

SEQ ID NO: 419843 - DNA, 20 bp, Artificial
  CRISPR gRNA sequence
cacagtgactgccagccccc

SEQ ID NO: 419844 - DNA, 20 bp, Artificial
  CRISPR gRNA sequence
ccagccccccaggatctctc

SEQ ID NO: 419845 - DNA, 20 bp, Artificial
  CRISPR gRNA sequence
tcagagcctccgactgggtc

SEQ ID NO: 419846 - DNA, 20 bp, Artificial
  CRISPR gRNA sequence
agagcctccgactgggtcat

SEQ ID NO: 419847 - DNA, 20 bp, Artificial
  CRISPR gRNA sequence
cgactgggtcattttgaact

SEQ ID NO: 419848 - DNA, 20 bp, Artificial
  CRISPR gRNA sequence
ggtcattttgaactgctcct

SEQ ID NO: 419849 - DNA, 20 bp, Artificial
  CRISPR gRNA sequence
tgaactgctccttcagccgc

SEQ ID NO: 419850 - DNA, 20 bp, Artificial
  CRISPR gRNA sequence
gaactgctccttcagccgcc

SEQ ID NO: 419851 - DNA, 20 bp, Artificial
  CRISPR gRNA sequence
aactgctccttcagccgccc

SEQ ID NO: 419852 - DNA, 20 bp, Artificial
  CRISPR gRNA sequence
ctccttcagccgccctgacc

SEQ ID NO: 419853 - DNA, 20 bp, Artificial
  CRISPR gRNA sequence
cttcagccgccctgaccgcc

SEQ ID NO: 419854 - DNA, 20 bp, Artificial
  CRISPR gRNA sequence
cagccgccctgaccgcccag

SEQ ID NO: 419855 - DNA, 20 bp, Artificial
  CRISPR gRNA sequence
agccgccctgaccgcccagc

SEQ ID NO: 419856 - DNA, 20 bp, Artificial
  CRISPR gRNA sequence
accgcccagcctctgtgcat

SEQ ID NO: 419857 - DNA, 20 bp, Artificial
  CRISPR gRNA sequence
tgtgcattggttccggaacc

SEQ ID NO: 419858 - DNA, 20 bp, Artificial
  CRISPR gRNA sequence
tgcattggttccggaaccgg

SEQ ID NO: 419859 - DNA, 20 bp, Artificial
  CRISPR gRNA sequence
gttccggaaccggggccagg

SEQ ID NO: 419860 - DNA, 20 bp, Artificial
  CRISPR gRNA sequence
cggaaccggggccagggccg

SEQ ID NO: 419861 - DNA, 20 bp, Artificial
  CRISPR gRNA sequence
tccgggagtccccccatcac

SEQ ID NO: 419862 - DNA, 20 bp, Artificial
  CRISPR gRNA sequence
agcggaaagcttcctcttcc

SEQ ID NO: 419863 - DNA, 20 bp, Artificial
  CRISPR gRNA sequence
gcggaaagcttcctcttcct

SEQ ID NO: 419864 - DNA, 20 bp, Artificial
  CRISPR gRNA sequence
cctcttcctgccccaagtca

SEQ ID NO: 419865 - DNA, 20 bp, Artificial
  CRISPR gRNA sequence
ctcttcctgccccaagtcag

SEQ ID NO: 419866 - DNA, 20 bp, Artificial
  CRISPR gRNA sequence
ttcctgccccaagtcagccc

SEQ ID NO: 419867 - DNA, 20 bp, Artificial
  CRISPR gRNA sequence
cctgccccaagtcagcccca

SEQ ID NO: 419868 - DNA, 20 bp, Artificial
  CRISPR gRNA sequence
ctgccccaagtcagccccat

SEQ ID NO: 419869 - DNA, 20 bp, Artificial
  CRISPR gRNA sequence
ccccaagtcagccccatgga

SEQ ID NO: 419870 - DNA, 20 bp, Artificial
  CRISPR gRNA sequence
tgggccctggggctgcatcc

SEQ ID NO: 419871 - DNA, 20 bp, Artificial
  CRISPR gRNA sequence
ggccctggggctgcatcctc

SEQ ID NO: 419872 - DNA, 20 bp, Artificial
  CRISPR gRNA sequence
gggctgcatcctcacctaca

SEQ ID NO: 419873 - DNA, 20 bp, Artificial
  CRISPR gRNA sequence
catcctcacctacagagatg

SEQ ID NO: 419874 - DNA, 20 bp, Artificial
  CRISPR gRNA sequence
acctacagagatggcttcaa

SEQ ID NO: 419875 - DNA, 20 bp, Artificial
  CRISPR gRNA sequence
cagagatggcttcaacgtct

SEQ ID NO: 419876 - DNA, 20 bp, Artificial
  CRISPR gRNA sequence
caacgtctccatcatgtata

SEQ ID NO: 419877 - DNA, 20 bp, Artificial
  CRISPR gRNA sequence
aacgtctccatcatgtataa

SEQ ID NO: 419878 - DNA, 20 bp, Artificial
  CRISPR gRNA sequence
catcatgtataacctcactg

SEQ ID NO: 419879 - DNA, 20 bp, Artificial
  CRISPR gRNA sequence
actgttctgggtaactcccc

SEQ ID NO: 419880 - DNA, 20 bp, Artificial
  CRISPR gRNA sequence
ttctgggtaactcccccact

SEQ ID NO: 419881 - DNA, 20 bp, Artificial
  CRISPR gRNA sequence
tgggtaactcccccactctg

SEQ ID NO: 419882 - DNA, 20 bp, Artificial
  CRISPR gRNA sequence
ggtaactcccccactctgct

SEQ ID NO: 419883 - DNA, 20 bp, Artificial
  CRISPR gRNA sequence
ccccactctgcttcacattt

SEQ ID NO: 419884 - DNA, 20 bp, Artificial
  CRISPR gRNA sequence
tgcttcacatttgaccacaa

SEQ ID NO: 419885 - DNA, 20 bp, Artificial
  CRISPR gRNA sequence
cttcacatttgaccacaact

SEQ ID NO: 419886 - DNA, 20 bp, Artificial
  CRISPR gRNA sequence
cacatttgaccacaactcct

SEQ ID NO: 419887 - DNA, 20 bp, Artificial
  CRISPR gRNA sequence
acatttgaccacaactcctt

SEQ ID NO: 419888 - DNA, 20 bp, Artificial
  CRISPR gRNA sequence
gaccacaactccttcctgcc

SEQ ID NO: 419889 - DNA, 20 bp, Artificial
  CRISPR gRNA sequence
accacaactccttcctgccc

SEQ ID NO: 419890 - DNA, 20 bp, Artificial
  CRISPR gRNA sequence
cttcctgccccccttgtcac

SEQ ID NO: 419891 - DNA, 20 bp, Artificial
  CRISPR gRNA sequence
cctgccccccttgtcacctc

SEQ ID NO: 419892 - DNA, 20 bp, Artificial
  CRISPR gRNA sequence
ctgccccccttgtcacctcc

SEQ ID NO: 419893 - DNA, 20 bp, Artificial
  CRISPR gRNA sequence
ccccccttgtcacctcccct

SEQ ID NO: 419894 - DNA, 20 bp, Artificial
  CRISPR gRNA sequence
gtcacctcccctaactatgg

SEQ ID NO: 419895 - DNA, 20 bp, Artificial
  CRISPR gRNA sequence
tcacctcccctaactatggg

SEQ ID NO: 419896 - DNA, 20 bp, Artificial
  CRISPR gRNA sequence
ccctaactatgggtccccaa

SEQ ID NO: 419897 - DNA, 20 bp, Artificial
  CRISPR gRNA sequence
actatgggtccccaaaccag

SEQ ID NO: 419898 - DNA, 20 bp, Artificial
  CRISPR gRNA sequence
tgggtccccaaaccaggttc

SEQ ID NO: 419899 - DNA, 20 bp, Artificial
  CRISPR gRNA sequence
tcggcagcgagtggcctacg

SEQ ID NO: 419900 - DNA, 20 bp, Artificial
  CRISPR gRNA sequence
ggcagcgagtggcctacgtc

SEQ ID NO: 419901 - DNA, 20 bp, Artificial
  CRISPR gRNA sequence
cgtcattgctgtgggtctca

SEQ ID NO: 419902 - DNA, 20 bp, Artificial
  CRISPR gRNA sequence
ctgtgggtctcactgttcga

SEQ ID NO: 419903 - DNA, 20 bp, Artificial
  CRISPR gRNA sequence
tgggtctcactgttcgaccc

SEQ ID NO: 419904 - DNA, 20 bp, Artificial
  CRISPR gRNA sequence
actgttcgacccctttatat

SEQ ID NO: 419905 - DNA, 20 bp, Artificial
  CRISPR gRNA sequence
ttcgacccctttatattgct

SEQ ID NO: 419906 - DNA, 20 bp, Artificial
  CRISPR gRNA sequence
gacccctttatattgctggc

SEQ ID NO: 419907 - DNA, 20 bp, Artificial
  CRISPR gRNA sequence
tatattgctggcagcctcac

SEQ ID NO: 419908 - DNA, 20 bp, Artificial
  CRISPR gRNA sequence
atattgctggcagcctcaca

SEQ ID NO: 419909 - DNA, 20 bp, Artificial
  CRISPR gRNA sequence
tattgctggcagcctcacag

SEQ ID NO: 419910 - DNA, 20 bp, Artificial
  CRISPR gRNA sequence
ctggcagcctcacagctgcc

SEQ ID NO: 419911 - DNA, 20 bp, Artificial
  CRISPR gRNA sequence
gcagcctcacagctgccatc

SEQ ID NO: 419912 - DNA, 20 bp, Artificial
  CRISPR gRNA sequence
acagctgccatcaccccttc

SEQ ID NO: 419913 - DNA, 20 bp, Artificial
  CRISPR gRNA sequence
ccatcaccccttcttgcttc

SEQ ID NO: 419914 - DNA, 20 bp, Artificial
  CRISPR gRNA sequence
cttgcttctcccgtggcctt

SEQ ID NO: 419915 - DNA, 20 bp, Artificial
  CRISPR gRNA sequence
ttgcttctcccgtggccttc

SEQ ID NO: 419916 - DNA, 20 bp, Artificial
  CRISPR gRNA sequence
gcttctcccgtggccttcca

SEQ ID NO: 419917 - DNA, 20 bp, Artificial
  CRISPR gRNA sequence
cttctcccgtggccttccag

SEQ ID NO: 419918 - DNA, 20 bp, Artificial
  CRISPR gRNA sequence
ctcccgtggccttccagcgt

SEQ ID NO: 419919 - DNA, 20 bp, Artificial
  CRISPR gRNA sequence
tcccgtggccttccagcgtc

SEQ ID NO: 419920 - DNA, 20 bp, Artificial
  CRISPR gRNA sequence
ccgtggccttccagcgtcat

SEQ ID NO: 419921 - DNA, 20 bp, Artificial
  CRISPR gRNA sequence
ccagcgtcattgccggcctt

SEQ ID NO: 419922 - DNA, 20 bp, Artificial
  CRISPR gRNA sequence
cagcgtcattgccggccttc

SEQ ID NO: 419923 - DNA, 20 bp, Artificial
  CRISPR gRNA sequence
ccggccttccctctccttcc

SEQ ID NO: 419924 - DNA, 20 bp, Artificial
  CRISPR gRNA sequence
ccctctccttccggctaagc

SEQ ID NO: 419925 - DNA, 20 bp, Artificial
  CRISPR gRNA sequence
cctctccttccggctaagcc

SEQ ID NO: 419926 - DNA, 20 bp, Artificial
  CRISPR gRNA sequence
tccttccggctaagcccact

SEQ ID NO: 419927 - DNA, 20 bp, Artificial
  CRISPR gRNA sequence
cttccggctaagcccacttg

SEQ ID NO: 419928 - DNA, 20 bp, Artificial
  CRISPR gRNA sequence
ccggctaagcccacttgctg

SEQ ID NO: 419929 - DNA, 20 bp, Artificial
  CRISPR gRNA sequence
cggctaagcccacttgctgg

SEQ ID NO: 419930 - DNA, 20 bp, Artificial
  CRISPR gRNA sequence
agcccacttgctgggtttct

SEQ ID NO: 419931 - DNA, 20 bp, Artificial
  CRISPR gRNA sequence
gctgggtttctgagcctcct

SEQ ID NO: 419932 - DNA, 20 bp, Artificial
  CRISPR gRNA sequence
ctgggtttctgagcctcctc

SEQ ID NO: 419933 - DNA, 20 bp, Artificial
  CRISPR gRNA sequence
ggtttctgagcctcctcagc

SEQ ID NO: 419934 - DNA, 20 bp, Artificial
  CRISPR gRNA sequence
ctgagcctcctcagctcatc

SEQ ID NO: 419935 - DNA, 20 bp, Artificial
  CRISPR gRNA sequence
tgagcctcctcagctcatca

SEQ ID NO: 419936 - DNA, 20 bp, Artificial
  CRISPR gRNA sequence
agcctcctcagctcatcacc

SEQ ID NO: 419937 - DNA, 20 bp, Artificial
  CRISPR gRNA sequence
ctcagctcatcaccttattc

SEQ ID NO: 419938 - DNA, 20 bp, Artificial
  CRISPR gRNA sequence
agctcatcaccttattctgc

SEQ ID NO: 419939 - DNA, 20 bp, Artificial
  CRISPR gRNA sequence
atcaccttattctgctcctt

SEQ ID NO: 419940 - DNA, 20 bp, Artificial
  CRISPR gRNA sequence
attctgctccttagcactct

SEQ ID NO: 419941 - DNA, 20 bp, Artificial
  CRISPR gRNA sequence
ttctgctccttagcactctt

SEQ ID NO: 419942 - DNA, 20 bp, Artificial
  CRISPR gRNA sequence
tgctccttagcactcttatg

SEQ ID NO: 419943 - DNA, 20 bp, Artificial
  CRISPR gRNA sequence
ctccttagcactcttatgag

SEQ ID NO: 419944 - DNA, 20 bp, Artificial
  CRISPR gRNA sequence
cttagcactcttatgagcca

SEQ ID NO: 419945 - DNA, 20 bp, Artificial
  CRISPR gRNA sequence
agcactcttatgagccagac

SEQ ID NO: 419946 - DNA, 20 bp, Artificial
  CRISPR gRNA sequence
gcactcttatgagccagacc

SEQ ID NO: 419947 - DNA, 20 bp, Artificial
  CRISPR gRNA sequence
ttatgagccagaccatctcc

SEQ ID NO: 419948 - DNA, 20 bp, Artificial
  CRISPR gRNA sequence
atgagccagaccatctcctg

SEQ ID NO: 419949 - DNA, 20 bp, Artificial
  CRISPR gRNA sequence
tgagccagaccatctcctga

SEQ ID NO: 419950 - DNA, 20 bp, Artificial
  CRISPR gRNA sequence
ctgaattcttctgcctccct

SEQ ID NO: 419951 - DNA, 20 bp, Artificial
  CRISPR gRNA sequence
aattcttctgcctcccttcc

SEQ ID NO: 419952 - DNA, 20 bp, Artificial
  CRISPR gRNA sequence
ttctgcctcccttccttgca

SEQ ID NO: 419953 - DNA, 20 bp, Artificial
  CRISPR gRNA sequence
ctgcctcccttccttgcagc

SEQ ID NO: 419954 - DNA, 20 bp, Artificial
  CRISPR gRNA sequence
tgcctcccttccttgcagcc

SEQ ID NO: 419955 - DNA, 20 bp, Artificial
  CRISPR gRNA sequence
cctcccttccttgcagcccc

SEQ ID NO: 419956 - DNA, 20 bp, Artificial
  CRISPR gRNA sequence
ccttccttgcagccccagca

SEQ ID NO: 419957 - DNA, 20 bp, Artificial
  CRISPR gRNA sequence
ccttgcagccccagcactcc

SEQ ID NO: 419958 - DNA, 20 bp, Artificial
  CRISPR gRNA sequence
cttgcagccccagcactccc

SEQ ID NO: 419959 - DNA, 20 bp, Artificial
  CRISPR gRNA sequence
gcagccccagcactccctcc

SEQ ID NO: 419960 - DNA, 20 bp, Artificial
  CRISPR gRNA sequence
cagccccagcactccctccc

SEQ ID NO: 419961 - DNA, 20 bp, Artificial
  CRISPR gRNA sequence
cctccccactgcagcaccca

SEQ ID NO: 419962 - DNA, 20 bp, Artificial
  CRISPR gRNA sequence
cccactgcagcacccagctt

SEQ ID NO: 419963 - DNA, 20 bp, Artificial
  CRISPR gRNA sequence
cagcacccagctttaacttt

SEQ ID NO: 419964 - DNA, 20 bp, Artificial
  CRISPR gRNA sequence
taactttgggttttcttttc

SEQ ID NO: 419965 - DNA, 20 bp, Artificial
  CRISPR gRNA sequence
aactttgggttttcttttct

SEQ ID NO: 419966 - DNA, 20 bp, Artificial
  CRISPR gRNA sequence
actttgggttttcttttctc

SEQ ID NO: 419967 - DNA, 20 bp, Artificial
  CRISPR gRNA sequence
tgggttttcttttctcttca

SEQ ID NO: 419968 - DNA, 20 bp, Artificial
  CRISPR gRNA sequence
gggttttcttttctcttcag

SEQ ID NO: 419969 - DNA, 20 bp, Artificial
  CRISPR gRNA sequence
ggttttcttttctcttcagg

SEQ ID NO: 419970 - DNA, 20 bp, Artificial
  CRISPR gRNA sequence
tcttttctcttcaggtctgg

SEQ ID NO: 419971 - DNA, 20 bp, Artificial
  CRISPR gRNA sequence
cttttctcttcaggtctgga

SEQ ID NO: 419972 - DNA, 20 bp, Artificial
  CRISPR gRNA sequence
ttttctcttcaggtctggag

SEQ ID NO: 419973 - DNA, 20 bp, Artificial
  CRISPR gRNA sequence
ttctcttcaggtctggagcc

SEQ ID NO: 419974 - DNA, 20 bp, Artificial
  CRISPR gRNA sequence
tctcttcaggtctggagccc

SEQ ID NO: 419975 - DNA, 20 bp, Artificial
  CRISPR gRNA sequence
ctcttcaggtctggagcccc

SEQ ID NO: 419976 - DNA, 20 bp, Artificial
  CRISPR gRNA sequence
tcttcaggtctggagccccc

SEQ ID NO: 419977 - DNA, 20 bp, Artificial
  CRISPR gRNA sequence
ttcaggtctggagcccccaa

SEQ ID NO: 419978 - DNA, 20 bp, Artificial
  CRISPR gRNA sequence
caggtctggagcccccaact

SEQ ID NO: 419979 - DNA, 20 bp, Artificial
  CRISPR gRNA sequence
aggtctggagcccccaactc

SEQ ID NO: 419980 - DNA, 20 bp, Artificial
  CRISPR gRNA sequence
gagcccccaactcccttgac

SEQ ID NO: 419981 - DNA, 20 bp, Artificial
  CRISPR gRNA sequence
ccttgacagtgtacgctgga

SEQ ID NO: 419982 - DNA, 20 bp, Artificial
  CRISPR gRNA sequence
gacagtgtacgctggagcag

SEQ ID NO: 419983 - DNA, 20 bp, Artificial
  CRISPR gRNA sequence
acagtgtacgctggagcagg

SEQ ID NO: 419984 - DNA, 20 bp, Artificial
  CRISPR gRNA sequence
gagcaggttccagggtgggg

SEQ ID NO: 419985 - DNA, 20 bp, Artificial
  CRISPR gRNA sequence
cagggtggggctgccctgcc

SEQ ID NO: 419986 - DNA, 20 bp, Artificial
  CRISPR gRNA sequence
ccctgccgcctgcctgctgg

SEQ ID NO: 419987 - DNA, 20 bp, Artificial
  CRISPR gRNA sequence
ccgcctgcctgctggtgtgg

SEQ ID NO: 419988 - DNA, 20 bp, Artificial
  CRISPR gRNA sequence
cctgctggtgtggggacccg

SEQ ID NO: 419989 - DNA, 20 bp, Artificial
  CRISPR gRNA sequence
ctggtgtggggacccggtct

SEQ ID NO: 419990 - DNA, 20 bp, Artificial
  CRISPR gRNA sequence
gtgtggggacccggtctttc

SEQ ID NO: 419991 - DNA, 20 bp, Artificial
  CRISPR gRNA sequence
tcctcactgccaagtggact

SEQ ID NO: 419992 - DNA, 20 bp, Artificial
  CRISPR gRNA sequence
cctcactgccaagtggactc

SEQ ID NO: 419993 - DNA, 20 bp, Artificial
  CRISPR gRNA sequence
ctcactgccaagtggactcc

SEQ ID NO: 419994 - DNA, 20 bp, Artificial
  CRISPR gRNA sequence
actgccaagtggactcctcc

SEQ ID NO: 419995 - DNA, 20 bp, Artificial
  CRISPR gRNA sequence
ccaagtggactcctcctggg

SEQ ID NO: 419996 - DNA, 20 bp, Artificial
  CRISPR gRNA sequence
ctcctgggggaggccctgac

SEQ ID NO: 419997 - DNA, 20 bp, Artificial
  CRISPR gRNA sequence
ctgggggaggccctgacctc

SEQ ID NO: 419998 - DNA, 20 bp, Artificial
  CRISPR gRNA sequence
ggggaggccctgacctcctg

SEQ ID NO: 419999 - DNA, 20 bp, Artificial
  CRISPR gRNA sequence
acctcctggtgactggagac

SEQ ID NO: 420000 - DNA, 20 bp, Artificial
  CRISPR gRNA sequence
ctggtgactggagacaatgg

SEQ ID NO: 420001 - DNA, 20 bp, Artificial
  CRISPR gRNA sequence
gtgactggagacaatggcga

SEQ ID NO: 420002 - DNA, 20 bp, Artificial
  CRISPR gRNA sequence
gagacaatggcgactttacc

SEQ ID NO: 420003 - DNA, 20 bp, Artificial
  CRISPR gRNA sequence
tacccttcgactagaggatg

SEQ ID NO: 420004 - DNA, 20 bp, Artificial
  CRISPR gRNA sequence
acccttcgactagaggatgt

SEQ ID NO: 420005 - DNA, 20 bp, Artificial
  CRISPR gRNA sequence
cccttcgactagaggatgtg

SEQ ID NO: 420006 - DNA, 20 bp, Artificial
  CRISPR gRNA sequence
cgactagaggatgtgagcca

SEQ ID NO: 420007 - DNA, 20 bp, Artificial
  CRISPR gRNA sequence
gactagaggatgtgagccag

SEQ ID NO: 420008 - DNA, 20 bp, Artificial
  CRISPR gRNA sequence
gaggatgtgagccaggccca

SEQ ID NO: 420009 - DNA, 20 bp, Artificial
  CRISPR gRNA sequence
ggacctacacctgccatatc

SEQ ID NO: 420010 - DNA, 20 bp, Artificial
  CRISPR gRNA sequence
cacctgccatatccatctgc

SEQ ID NO: 420011 - DNA, 20 bp, Artificial
  CRISPR gRNA sequence
ccatatccatctgcaggaac

SEQ ID NO: 420012 - DNA, 20 bp, Artificial
  CRISPR gRNA sequence
caggaacagcagctcaatgc

SEQ ID NO: 420013 - DNA, 20 bp, Artificial
  CRISPR gRNA sequence
aatgccactgtcacattggc

SEQ ID NO: 420014 - DNA, 20 bp, Artificial
  CRISPR gRNA sequence
tcacattggcaatcatcaca

SEQ ID NO: 420015 - DNA, 20 bp, Artificial
  CRISPR gRNA sequence
gcaatcatcacaggtcagcc

SEQ ID NO: 420016 - DNA, 20 bp, Artificial
  CRISPR gRNA sequence
aggtgggaaaggagtagctg

SEQ ID NO: 420017 - DNA, 20 bp, Artificial
  CRISPR gRNA sequence
ccctcccagggtagaaagga

SEQ ID NO: 420018 - DNA, 20 bp, Artificial
  CRISPR gRNA sequence
ccagggtagaaaggacaggg

SEQ ID NO: 420019 - DNA, 20 bp, Artificial
  CRISPR gRNA sequence
gcagggcaaagactaggcaa

SEQ ID NO: 420020 - DNA, 20 bp, Artificial
  CRISPR gRNA sequence
ggcaaacccaccctgtgatg

SEQ ID NO: 420021 - DNA, 20 bp, Artificial
  CRISPR gRNA sequence
tgatgccaggccactgggca

SEQ ID NO: 420022 - DNA, 20 bp, Artificial
  CRISPR gRNA sequence
ggcacaagttccagagcctg

SEQ ID NO: 420023 - DNA, 20 bp, Artificial
  CRISPR gRNA sequence
cagagcctgcccatctcggc

SEQ ID NO: 420024 - DNA, 20 bp, Artificial
  CRISPR gRNA sequence
cccatctcggcccccacttt

SEQ ID NO: 420025 - DNA, 20 bp, Artificial
  CRISPR gRNA sequence
ggcccccacttttctcaccc

SEQ ID NO: 420026 - DNA, 20 bp, Artificial
  CRISPR gRNA sequence
ttctcacccccataataaag

SEQ ID NO: 420027 - DNA, 20 bp, Artificial
  CRISPR gRNA sequence
tctcacccccataataaaga

SEQ ID NO: 420028 - DNA, 20 bp, Artificial
  CRISPR gRNA sequence
ctcacccccataataaagaa

SEQ ID NO: 420029 - DNA, 20 bp, Artificial
  CRISPR gRNA sequence
tcacccccataataaagaaa

SEQ ID NO: 420030 - DNA, 20 bp, Artificial
  CRISPR gRNA sequence
acccccataataaagaaacg

SEQ ID NO: 420031 - DNA, 20 bp, Artificial
  CRISPR gRNA sequence
aaaatctcctcttgagtcac

SEQ ID NO: 420032 - DNA, 20 bp, Artificial
  CRISPR gRNA sequence
ctcttgagtcacaagataaa

SEQ ID NO: 420033 - DNA, 20 bp, Artificial
  CRISPR gRNA sequence
ttgagtcacaagataaaagt

SEQ ID NO: 420034 - DNA, 20 bp, Artificial
  CRISPR gRNA sequence
gagtcacaagataaaagttc

SEQ ID NO: 420035 - DNA, 20 bp, Artificial
  CRISPR gRNA sequence
agtcacaagataaaagttcc

SEQ ID NO: 420036 - DNA, 20 bp, Artificial
  CRISPR gRNA sequence
caccgttctctatgggactc

SEQ ID NO: 420037 - DNA, 20 bp, Artificial
  CRISPR gRNA sequence
tctatgggactcccctgctc

SEQ ID NO: 420038 - DNA, 20 bp, Artificial
  CRISPR gRNA sequence
tatgggactcccctgctctc

SEQ ID NO: 420039 - DNA, 20 bp, Artificial
  CRISPR gRNA sequence
tgggactcccctgctctcaa

SEQ ID NO: 420040 - DNA, 20 bp, Artificial
  CRISPR gRNA sequence
ccctgctctcaattggcggg

SEQ ID NO: 420041 - DNA, 20 bp, Artificial
  CRISPR gRNA sequence
ctctcaattggcgggagggt

SEQ ID NO: 420042 - DNA, 20 bp, Artificial
  CRISPR gRNA sequence
tcaattggcgggagggtctg

SEQ ID NO: 420043 - DNA, 20 bp, Artificial
  CRISPR gRNA sequence
aattggcgggagggtctggg

SEQ ID NO: 420044 - DNA, 20 bp, Artificial
  CRISPR gRNA sequence
gcgggagggtctgggaagtt

SEQ ID NO: 420045 - DNA, 20 bp, Artificial
  CRISPR gRNA sequence
ggaagttagaaggaaaggtg

SEQ ID NO: 420046 - DNA, 20 bp, Artificial
  CRISPR gRNA sequence
gaaggaaaggtgacaaaaat

SEQ ID NO: 420047 - DNA, 20 bp, Artificial
  CRISPR gRNA sequence
tgaatggttcgaaagaggta

SEQ ID NO: 420048 - DNA, 20 bp, Artificial
  CRISPR gRNA sequence
aatggttcgaaagaggtaga

SEQ ID NO: 420049 - DNA, 20 bp, Artificial
  CRISPR gRNA sequence
gaaagaggtagaatatattt

SEQ ID NO: 420050 - DNA, 20 bp, Artificial
  CRISPR gRNA sequence
ctagaatccttgtctacttt

SEQ ID NO: 420051 - DNA, 20 bp, Artificial
  CRISPR gRNA sequence
tagaatccttgtctactttg

SEQ ID NO: 420052 - DNA, 20 bp, Artificial
  CRISPR gRNA sequence
gaatccttgtctactttgca

SEQ ID NO: 420053 - DNA, 20 bp, Artificial
  CRISPR gRNA sequence
gtctactttgcagccagggc

SEQ ID NO: 420054 - DNA, 20 bp, Artificial
  CRISPR gRNA sequence
tctactttgcagccagggct

SEQ ID NO: 420055 - DNA, 20 bp, Artificial
  CRISPR gRNA sequence
ctttgcagccagggcttggg

SEQ ID NO: 420056 - DNA, 20 bp, Artificial
  CRISPR gRNA sequence
tgcagccagggcttgggtta

SEQ ID NO: 420057 - DNA, 20 bp, Artificial
  CRISPR gRNA sequence
gcagccagggcttgggttag

SEQ ID NO: 420058 - DNA, 20 bp, Artificial
  CRISPR gRNA sequence
cagccagggcttgggttaga

SEQ ID NO: 420059 - DNA, 20 bp, Artificial
  CRISPR gRNA sequence
gggttagagttgcaggaagt

SEQ ID NO: 420060 - DNA, 20 bp, Artificial
  CRISPR gRNA sequence
ggttagagttgcaggaagtg

SEQ ID NO: 420061 - DNA, 20 bp, Artificial
  CRISPR gRNA sequence
gagttgcaggaagtggcctg

SEQ ID NO: 420062 - DNA, 20 bp, Artificial
  CRISPR gRNA sequence
caggaagtggcctggatttg

SEQ ID NO: 420063 - DNA, 20 bp, Artificial
  CRISPR gRNA sequence
gatttgggaggagtgaataa

SEQ ID NO: 420064 - DNA, 20 bp, Artificial
  CRISPR gRNA sequence
gggaggagtgaataaatccg

SEQ ID NO: 420065 - DNA, 20 bp, Artificial
  CRISPR gRNA sequence
ggaggagtgaataaatccgt

SEQ ID NO: 420066 - DNA, 20 bp, Artificial
  CRISPR gRNA sequence
ggtcagcaaatatttactga

SEQ ID NO: 420067 - DNA, 20 bp, Artificial
  CRISPR gRNA sequence
gtcagcaaatatttactgag

SEQ ID NO: 420068 - DNA, 20 bp, Artificial
  CRISPR gRNA sequence
actgagcaagggttttccaa

SEQ ID NO: 420069 - DNA, 20 bp, Artificial
  CRISPR gRNA sequence
ctgagcaagggttttccaag

SEQ ID NO: 420070 - DNA, 20 bp, Artificial
  CRISPR gRNA sequence
agcaagggttttccaagaca

SEQ ID NO: 420071 - DNA, 20 bp, Artificial
  CRISPR gRNA sequence
tccaagacagtataaaacaa

SEQ ID NO: 420072 - DNA, 20 bp, Artificial
  CRISPR gRNA sequence
ccaagacagtataaaacaaa

SEQ ID NO: 420073 - DNA, 20 bp, Artificial
  CRISPR gRNA sequence
caagacagtataaaacaaac

SEQ ID NO: 420074 - DNA, 20 bp, Artificial
  CRISPR gRNA sequence
agagagtatgtgttgactgg

SEQ ID NO: 420075 - DNA, 20 bp, Artificial
  CRISPR gRNA sequence
actggttgataactatcggc

SEQ ID NO: 420076 - DNA, 20 bp, Artificial
  CRISPR gRNA sequence
gttgataactatcggccatg

SEQ ID NO: 420077 - DNA, 20 bp, Artificial
  CRISPR gRNA sequence
ataactatcggccatgacag

SEQ ID NO: 420078 - DNA, 20 bp, Artificial
  CRISPR gRNA sequence
tcggccatgacagattagcc

SEQ ID NO: 420079 - DNA, 20 bp, Artificial
  CRISPR gRNA sequence
gccatgtctgcagcacgcac

SEQ ID NO: 420080 - DNA, 20 bp, Artificial
  CRISPR gRNA sequence
cagcacgcacctgcggccac

SEQ ID NO: 420081 - DNA, 20 bp, Artificial
  CRISPR gRNA sequence
cggccactcagtagtagcac

SEQ ID NO: 420082 - DNA, 20 bp, Artificial
  CRISPR gRNA sequence
agtagtagcaccccacggca

SEQ ID NO: 420083 - DNA, 20 bp, Artificial
  CRISPR gRNA sequence
aataatgtatagagattgaa

SEQ ID NO: 420084 - DNA, 20 bp, Artificial
  CRISPR gRNA sequence
ataatgtatagagattgaat

SEQ ID NO: 420085 - DNA, 20 bp, Artificial
  CRISPR gRNA sequence
aatgaatacgtgaacatgct

SEQ ID NO: 420086 - DNA, 20 bp, Artificial
  CRISPR gRNA sequence
atggataatacatctcctga

SEQ ID NO: 420087 - DNA, 20 bp, Artificial
  CRISPR gRNA sequence
ctgaaggccaatcctgagtt

SEQ ID NO: 420088 - DNA, 20 bp, Artificial
  CRISPR gRNA sequence
aaggccaatcctgagttttc

SEQ ID NO: 420089 - DNA, 20 bp, Artificial
  CRISPR gRNA sequence
agttttcacttgctttctgg

SEQ ID NO: 420090 - DNA, 20 bp, Artificial
  CRISPR gRNA sequence
tcacttgctttctggatacc

SEQ ID NO: 420091 - DNA, 20 bp, Artificial
  CRISPR gRNA sequence
cacttgctttctggatacct

SEQ ID NO: 420092 - DNA, 20 bp, Artificial
  CRISPR gRNA sequence
acttgctttctggatacctc

SEQ ID NO: 420093 - DNA, 20 bp, Artificial
  CRISPR gRNA sequence
gctttctggatacctctaac

SEQ ID NO: 420094 - DNA, 20 bp, Artificial
  CRISPR gRNA sequence
ctttctggatacctctaact

SEQ ID NO: 420095 - DNA, 20 bp, Artificial
  CRISPR gRNA sequence
tctggatacctctaactaga

SEQ ID NO: 420096 - DNA, 20 bp, Artificial
  CRISPR gRNA sequence
ctggatacctctaactagat

SEQ ID NO: 420097 - DNA, 20 bp, Artificial
  CRISPR gRNA sequence
tggatacctctaactagatg

SEQ ID NO: 420098 - DNA, 20 bp, Artificial
  CRISPR gRNA sequence
gatacctctaactagatgtt

SEQ ID NO: 420099 - DNA, 20 bp, Artificial
  CRISPR gRNA sequence
taactagatgttataccacc

SEQ ID NO: 420100 - DNA, 20 bp, Artificial
  CRISPR gRNA sequence
actagatgttataccacctc

SEQ ID NO: 420101 - DNA, 20 bp, Artificial
  CRISPR gRNA sequence
gatgttataccacctctcag

SEQ ID NO: 420102 - DNA, 20 bp, Artificial
  CRISPR gRNA sequence
taccacctctcagccgcctt

SEQ ID NO: 420103 - DNA, 20 bp, Artificial
  CRISPR gRNA sequence
tcagccgccttaccctgaac

SEQ ID NO: 420104 - DNA, 20 bp, Artificial
  CRISPR gRNA sequence
agccgccttaccctgaaccc

SEQ ID NO: 420105 - DNA, 20 bp, Artificial
  CRISPR gRNA sequence
accctgaaccccagcttttt

SEQ ID NO: 420106 - DNA, 20 bp, Artificial
  CRISPR gRNA sequence
ccctgaaccccagctttttc

SEQ ID NO: 420107 - DNA, 20 bp, Artificial
  CRISPR gRNA sequence
aaccccagctttttctccca

SEQ ID NO: 420108 - DNA, 20 bp, Artificial
  CRISPR gRNA sequence
tttctcccaccaatcccctt

SEQ ID NO: 420109 - DNA, 20 bp, Artificial
  CRISPR gRNA sequence
ttctcccaccaatccccttg

SEQ ID NO: 420110 - DNA, 20 bp, Artificial
  CRISPR gRNA sequence
tctcccaccaatccccttgc

SEQ ID NO: 420111 - DNA, 20 bp, Artificial
  CRISPR gRNA sequence
ctcccaccaatccccttgct

SEQ ID NO: 420112 - DNA, 20 bp, Artificial
  CRISPR gRNA sequence
tcccaccaatccccttgctg

SEQ ID NO: 420113 - DNA, 20 bp, Artificial
  CRISPR gRNA sequence
ccaccaatccccttgctgac

SEQ ID NO: 420114 - DNA, 20 bp, Artificial
  CRISPR gRNA sequence
gctgactcagcctgtcagta

SEQ ID NO: 420115 - DNA, 20 bp, Artificial
  CRISPR gRNA sequence
ctgactcagcctgtcagtaa

SEQ ID NO: 420116 - DNA, 20 bp, Artificial
  CRISPR gRNA sequence
actcagcctgtcagtaatcc

SEQ ID NO: 420117 - DNA, 20 bp, Artificial
  CRISPR gRNA sequence
agcctgtcagtaatccactg

SEQ ID NO: 420118 - DNA, 20 bp, Artificial
  CRISPR gRNA sequence
tcagtaatccactggtatcc

SEQ ID NO: 420119 - DNA, 20 bp, Artificial
  CRISPR gRNA sequence
gtatccatccacctcgaaac

SEQ ID NO: 420120 - DNA, 20 bp, Artificial
  CRISPR gRNA sequence
gaaacctggcctcctcctct

SEQ ID NO: 420121 - DNA, 20 bp, Artificial
  CRISPR gRNA sequence
gcctcctcctctctacatcc

SEQ ID NO: 420122 - DNA, 20 bp, Artificial
  CRISPR gRNA sequence
ctcctctctacatcccatca

SEQ ID NO: 420123 - DNA, 20 bp, Artificial
  CRISPR gRNA sequence
ctctctacatcccatcagtc

SEQ ID NO: 420124 - DNA, 20 bp, Artificial
  CRISPR gRNA sequence
tctacatcccatcagtcatc

SEQ ID NO: 420125 - DNA, 20 bp, Artificial
  CRISPR gRNA sequence
tacatcccatcagtcatcaa

SEQ ID NO: 420126 - DNA, 20 bp, Artificial
  CRISPR gRNA sequence
catcccatcagtcatcaaag

SEQ ID NO: 420127 - DNA, 20 bp, Artificial
  CRISPR gRNA sequence
tttctgtccaatgccctctt

SEQ ID NO: 420128 - DNA, 20 bp, Artificial
  CRISPR gRNA sequence
tctgtccaatgccctcttga

SEQ ID NO: 420129 - DNA, 20 bp, Artificial
  CRISPR gRNA sequence
ctgtccaatgccctcttgaa

SEQ ID NO: 420130 - DNA, 20 bp, Artificial
  CRISPR gRNA sequence
tgtccaatgccctcttgaag

SEQ ID NO: 420131 - DNA, 20 bp, Artificial
  CRISPR gRNA sequence
tccaatgccctcttgaaggt

SEQ ID NO: 420132 - DNA, 20 bp, Artificial
  CRISPR gRNA sequence
ttgaaggtcaactgttttat

SEQ ID NO: 420133 - DNA, 20 bp, Artificial
  CRISPR gRNA sequence
gaaggtcaactgttttatgt

SEQ ID NO: 420134 - DNA, 20 bp, Artificial
  CRISPR gRNA sequence
aaggtcaactgttttatgta

SEQ ID NO: 420135 - DNA, 20 bp, Artificial
  CRISPR gRNA sequence
ttttatgtagacggctcaat

SEQ ID NO: 420136 - DNA, 20 bp, Artificial
  CRISPR gRNA sequence
tatgtagacggctcaatgag

SEQ ID NO: 420137 - DNA, 20 bp, Artificial
  CRISPR gRNA sequence
atgtagacggctcaatgaga

SEQ ID NO: 420138 - DNA, 20 bp, Artificial
  CRISPR gRNA sequence
tgtagacggctcaatgagag

SEQ ID NO: 420139 - DNA, 20 bp, Artificial
  CRISPR gRNA sequence
aatgagagagatactgttac

SEQ ID NO: 420140 - DNA, 20 bp, Artificial
  CRISPR gRNA sequence
ttaccccgaagactttctca

SEQ ID NO: 420141 - DNA, 20 bp, Artificial
  CRISPR gRNA sequence
ccccgaagactttctcaaaa

SEQ ID NO: 420142 - DNA, 20 bp, Artificial
  CRISPR gRNA sequence
tctcaaaacagctgggaagt

SEQ ID NO: 420143 - DNA, 20 bp, Artificial
  CRISPR gRNA sequence
ctcaaaacagctgggaagtg

SEQ ID NO: 420144 - DNA, 20 bp, Artificial
  CRISPR gRNA sequence
tcaaaacagctgggaagtgc

SEQ ID NO: 420145 - DNA, 20 bp, Artificial
  CRISPR gRNA sequence
aaaacagctgggaagtgcca

SEQ ID NO: 420146 - DNA, 20 bp, Artificial
  CRISPR gRNA sequence
ggaagtgccagactctgggt

SEQ ID NO: 420147 - DNA, 20 bp, Artificial
  CRISPR gRNA sequence
tgggtctaaactcaggtgtc

SEQ ID NO: 420148 - DNA, 20 bp, Artificial
  CRISPR gRNA sequence
ggtctaaactcaggtgtctg

SEQ ID NO: 420149 - DNA, 20 bp, Artificial
  CRISPR gRNA sequence
aactcaggtgtctgcatcac

SEQ ID NO: 420150 - DNA, 20 bp, Artificial
  CRISPR gRNA sequence
aggtgtctgcatcaccaaat

SEQ ID NO: 420151 - DNA, 20 bp, Artificial
  CRISPR gRNA sequence
catcaccaaatcactctcca

SEQ ID NO: 420152 - DNA, 20 bp, Artificial
  CRISPR gRNA sequence
tccaggacactactcagatg

SEQ ID NO: 420153 - DNA, 20 bp, Artificial
  CRISPR gRNA sequence
caggacactactcagatgcc

SEQ ID NO: 420154 - DNA, 20 bp, Artificial
  CRISPR gRNA sequence
ctcagatgcccttcaccctt

SEQ ID NO: 420155 - DNA, 20 bp, Artificial
  CRISPR gRNA sequence
agatgcccttcaccctttgt

SEQ ID NO: 420156 - DNA, 20 bp, Artificial
  CRISPR gRNA sequence
caccctttgtctcctcccac

SEQ ID NO: 420157 - DNA, 20 bp, Artificial
  CRISPR gRNA sequence
accctttgtctcctcccacc

SEQ ID NO: 420158 - DNA, 20 bp, Artificial
  CRISPR gRNA sequence
tgtctcctcccacccaccca

SEQ ID NO: 420159 - DNA, 20 bp, Artificial
  CRISPR gRNA sequence
gtctcctcccacccacccat

SEQ ID NO: 420160 - DNA, 20 bp, Artificial
  CRISPR gRNA sequence
tctcctcccacccacccatc

SEQ ID NO: 420161 - DNA, 20 bp, Artificial
  CRISPR gRNA sequence
ctcccacccacccatctctc

SEQ ID NO: 420162 - DNA, 20 bp, Artificial
  CRISPR gRNA sequence
ccacccacccatctctcact

SEQ ID NO: 420163 - DNA, 20 bp, Artificial
  CRISPR gRNA sequence
tcactttacaacttggagaa

SEQ ID NO: 420164 - DNA, 20 bp, Artificial
  CRISPR gRNA sequence
actttacaacttggagaatg

SEQ ID NO: 420165 - DNA, 20 bp, Artificial
  CRISPR gRNA sequence
tacaacttggagaatgctct

SEQ ID NO: 420166 - DNA, 20 bp, Artificial
  CRISPR gRNA sequence
acaacttggagaatgctctg

SEQ ID NO: 420167 - DNA, 20 bp, Artificial
  CRISPR gRNA sequence
caacttggagaatgctctgt

SEQ ID NO: 420168 - DNA, 20 bp, Artificial
  CRISPR gRNA sequence
ggagaatgctctgtctctag

SEQ ID NO: 420169 - DNA, 20 bp, Artificial
  CRISPR gRNA sequence
gagaatgctctgtctctaga

SEQ ID NO: 420170 - DNA, 20 bp, Artificial
  CRISPR gRNA sequence
tgtctctagatgaatgggtc

SEQ ID NO: 420171 - DNA, 20 bp, Artificial
  CRISPR gRNA sequence
tctctagatgaatgggtcag

SEQ ID NO: 420172 - DNA, 20 bp, Artificial
  CRISPR gRNA sequence
tagatgaatgggtcagttcc

SEQ ID NO: 420173 - DNA, 20 bp, Artificial
  CRISPR gRNA sequence
gatgaatgggtcagttccct

SEQ ID NO: 420174 - DNA, 20 bp, Artificial
  CRISPR gRNA sequence
cctgttctctataccttcag

SEQ ID NO: 420175 - DNA, 20 bp, Artificial
  CRISPR gRNA sequence
ttctctataccttcagaaag

SEQ ID NO: 420176 - DNA, 20 bp, Artificial
  CRISPR gRNA sequence
tctataccttcagaaagggg

SEQ ID NO: 420177 - DNA, 20 bp, Artificial
  CRISPR gRNA sequence
tataccttcagaaaggggga

SEQ ID NO: 420178 - DNA, 20 bp, Artificial
  CRISPR gRNA sequence
taccttcagaaagggggatg

SEQ ID NO: 420179 - DNA, 20 bp, Artificial
  CRISPR gRNA sequence
cagaaagggggatgatgttc

SEQ ID NO: 420180 - DNA, 20 bp, Artificial
  CRISPR gRNA sequence
agaaagggggatgatgttca

SEQ ID NO: 420181 - DNA, 20 bp, Artificial
  CRISPR gRNA sequence
attcagggggcaccacaagg

SEQ ID NO: 420182 - DNA, 20 bp, Artificial
  CRISPR gRNA sequence
agggggcaccacaaggcagg

SEQ ID NO: 420183 - DNA, 20 bp, Artificial
  CRISPR gRNA sequence
atgtgagccgcatcatggaa

SEQ ID NO: 420184 - DNA, 20 bp, Artificial
  CRISPR gRNA sequence
caaaattgtgaagtagatgg

SEQ ID NO: 420185 - DNA, 20 bp, Artificial
  CRISPR gRNA sequence
tgaagtagatgggggtcagc

SEQ ID NO: 420186 - DNA, 20 bp, Artificial
  CRISPR gRNA sequence
atctgactgattttgagggt

SEQ ID NO: 420187 - DNA, 20 bp, Artificial
  CRISPR gRNA sequence
actgattttgagggttctga

SEQ ID NO: 420188 - DNA, 20 bp, Artificial
  CRISPR gRNA sequence
attttgagggttctgagcat

SEQ ID NO: 420189 - DNA, 20 bp, Artificial
  CRISPR gRNA sequence
tgagggttctgagcatttga

SEQ ID NO: 420190 - DNA, 20 bp, Artificial
  CRISPR gRNA sequence
gagggttctgagcatttgag

SEQ ID NO: 420191 - DNA, 20 bp, Artificial
  CRISPR gRNA sequence
agggttctgagcatttgagt

SEQ ID NO: 420192 - DNA, 20 bp, Artificial
  CRISPR gRNA sequence
tgagcatttgagtagaaagt

SEQ ID NO: 420193 - DNA, 20 bp, Artificial
  CRISPR gRNA sequence
agcatttgagtagaaagtaa

SEQ ID NO: 420194 - DNA, 20 bp, Artificial
  CRISPR gRNA sequence
gagtagaaagtaatgtaaaa

SEQ ID NO: 420195 - DNA, 20 bp, Artificial
  CRISPR gRNA sequence
agtagaaagtaatgtaaaag

SEQ ID NO: 420196 - DNA, 20 bp, Artificial
  CRISPR gRNA sequence
taatagtatttattctgtgg

SEQ ID NO: 420197 - DNA, 20 bp, Artificial
  CRISPR gRNA sequence
attctgtggtctgccagggc

SEQ ID NO: 420198 - DNA, 20 bp, Artificial
  CRISPR gRNA sequence
ttctgtggtctgccagggcc

SEQ ID NO: 420199 - DNA, 20 bp, Artificial
  CRISPR gRNA sequence
tgtggtctgccagggccagt

SEQ ID NO: 420200 - DNA, 20 bp, Artificial
  CRISPR gRNA sequence
tggtctgccagggccagttt

SEQ ID NO: 420201 - DNA, 20 bp, Artificial
  CRISPR gRNA sequence
ccagggccagtttgagtgtg

SEQ ID NO: 420202 - DNA, 20 bp, Artificial
  CRISPR gRNA sequence
gagtgtgaaggcagtaggga

SEQ ID NO: 420203 - DNA, 20 bp, Artificial
  CRISPR gRNA sequence
agtgtgaaggcagtagggag

SEQ ID NO: 420204 - DNA, 20 bp, Artificial
  CRISPR gRNA sequence
gaaatgttttgagcagggga

SEQ ID NO: 420205 - DNA, 20 bp, Artificial
  CRISPR gRNA sequence
tgagcaggggagggagctga

SEQ ID NO: 420206 - DNA, 20 bp, Artificial
  CRISPR gRNA sequence
gagcaggggagggagctgac

SEQ ID NO: 420207 - DNA, 20 bp, Artificial
  CRISPR gRNA sequence
agcaggggagggagctgact

SEQ ID NO: 420208 - DNA, 20 bp, Artificial
  CRISPR gRNA sequence
actagagcattgtctgaata

SEQ ID NO: 420209 - DNA, 20 bp, Artificial
  CRISPR gRNA sequence
gagcattgtctgaataagat

SEQ ID NO: 420210 - DNA, 20 bp, Artificial
  CRISPR gRNA sequence
tctgaataagataaatgtgg

SEQ ID NO: 420211 - DNA, 20 bp, Artificial
  CRISPR gRNA sequence
aataagataaatgtggccgg

SEQ ID NO: 420212 - DNA, 20 bp, Artificial
  CRISPR gRNA sequence
acacctgtaatcccagcact

SEQ ID NO: 420213 - DNA, 20 bp, Artificial
  CRISPR gRNA sequence
taatcccagcactttgaaag

SEQ ID NO: 420214 - DNA, 20 bp, Artificial
  CRISPR gRNA sequence
tgaaaggctgagacgagagg

SEQ ID NO: 420215 - DNA, 20 bp, Artificial
  CRISPR gRNA sequence
gaaaggctgagacgagagga

SEQ ID NO: 420216 - DNA, 20 bp, Artificial
  CRISPR gRNA sequence
aaaggctgagacgagaggag

SEQ ID NO: 420217 - DNA, 20 bp, Artificial
  CRISPR gRNA sequence
agacgagaggagcacttgag

SEQ ID NO: 420218 - DNA, 20 bp, Artificial
  CRISPR gRNA sequence
gagtccaggaattccagact

SEQ ID NO: 420219 - DNA, 20 bp, Artificial
  CRISPR gRNA sequence
agtccaggaattccagacta

SEQ ID NO: 420220 - DNA, 20 bp, Artificial
  CRISPR gRNA sequence
cagactagcctgggcaacat

SEQ ID NO: 420221 - DNA, 20 bp, Artificial
  CRISPR gRNA sequence
gcctgggcaacatggtgaaa

SEQ ID NO: 420222 - DNA, 20 bp, Artificial
  CRISPR gRNA sequence
ggcaacatggtgaaaacgca

SEQ ID NO: 420223 - DNA, 20 bp, Artificial
  CRISPR gRNA sequence
tatacaatttaataaaaaaa

SEQ ID NO: 420224 - DNA, 20 bp, Artificial
  CRISPR gRNA sequence
aataaaaaaataaatagaaa

SEQ ID NO: 420225 - DNA, 20 bp, Artificial
  CRISPR gRNA sequence
ataaaaaaataaatagaaag

SEQ ID NO: 420226 - DNA, 20 bp, Artificial
  CRISPR gRNA sequence
ccccaacctcccctggccag

SEQ ID NO: 420227 - DNA, 20 bp, Artificial
  CRISPR gRNA sequence
cccaacctcccctggccaga

SEQ ID NO: 420228 - DNA, 20 bp, Artificial
  CRISPR gRNA sequence
ccctggccagaacccaagtg

SEQ ID NO: 420229 - DNA, 20 bp, Artificial
  CRISPR gRNA sequence
gccagaacccaagtgagtgc

SEQ ID NO: 420230 - DNA, 20 bp, Artificial
  CRISPR gRNA sequence
agacttggggttcaacctgt

SEQ ID NO: 420231 - DNA, 20 bp, Artificial
  CRISPR gRNA sequence
ggggttcaacctgtgatatc

SEQ ID NO: 420232 - DNA, 20 bp, Artificial
  CRISPR gRNA sequence
gggttcaacctgtgatatca

SEQ ID NO: 420233 - DNA, 20 bp, Artificial
  CRISPR gRNA sequence
aacctgtgatatcacgtaag

SEQ ID NO: 420234 - DNA, 20 bp, Artificial
  CRISPR gRNA sequence
tgatatcacgtaaggggggc

SEQ ID NO: 420235 - DNA, 20 bp, Artificial
  CRISPR gRNA sequence
ttccttctactcttttcagt

SEQ ID NO: 420236 - DNA, 20 bp, Artificial
  CRISPR gRNA sequence
ccttctactcttttcagtga

SEQ ID NO: 420237 - DNA, 20 bp, Artificial
  CRISPR gRNA sequence
cttctactcttttcagtgac

SEQ ID NO: 420238 - DNA, 20 bp, Artificial
  CRISPR gRNA sequence
ctactcttttcagtgactcc

SEQ ID NO: 420239 - DNA, 20 bp, Artificial
  CRISPR gRNA sequence
tactcttttcagtgactccc

SEQ ID NO: 420240 - DNA, 20 bp, Artificial
  CRISPR gRNA sequence
ctcttttcagtgactcccaa

SEQ ID NO: 420241 - DNA, 20 bp, Artificial
  CRISPR gRNA sequence
ttttcagtgactcccaaatc

SEQ ID NO: 420242 - DNA, 20 bp, Artificial
  CRISPR gRNA sequence
ttcagtgactcccaaatcct

SEQ ID NO: 420243 - DNA, 20 bp, Artificial
  CRISPR gRNA sequence
tcagtgactcccaaatcctt

SEQ ID NO: 420244 - DNA, 20 bp, Artificial
  CRISPR gRNA sequence
cagtgactcccaaatccttt

SEQ ID NO: 420245 - DNA, 20 bp, Artificial
  CRISPR gRNA sequence
agtgactcccaaatcctttg

SEQ ID NO: 420246 - DNA, 20 bp, Artificial
  CRISPR gRNA sequence
ccaaatcctttgggtcacct

SEQ ID NO: 420247 - DNA, 20 bp, Artificial
  CRISPR gRNA sequence
tgggtcacctggatccctgg

SEQ ID NO: 420248 - DNA, 20 bp, Artificial
  CRISPR gRNA sequence
gggtcacctggatccctggg

SEQ ID NO: 420249 - DNA, 20 bp, Artificial
  CRISPR gRNA sequence
ggtcacctggatccctgggg

SEQ ID NO: 420250 - DNA, 20 bp, Artificial
  CRISPR gRNA sequence
gatccctggggaagctgctt

SEQ ID NO: 420251 - DNA, 20 bp, Artificial
  CRISPR gRNA sequence
gggaagctgctttgtgaggt

SEQ ID NO: 420252 - DNA, 20 bp, Artificial
  CRISPR gRNA sequence
ctttgtgaggtgactccagt

SEQ ID NO: 420253 - DNA, 20 bp, Artificial
  CRISPR gRNA sequence
tgtgaggtgactccagtatc

SEQ ID NO: 420254 - DNA, 20 bp, Artificial
  CRISPR gRNA sequence
gtgaggtgactccagtatct

SEQ ID NO: 420255 - DNA, 20 bp, Artificial
  CRISPR gRNA sequence
tgaggtgactccagtatctg

SEQ ID NO: 420256 - DNA, 20 bp, Artificial
  CRISPR gRNA sequence
cagtatctggacaagaacgc

SEQ ID NO: 420257 - DNA, 20 bp, Artificial
  CRISPR gRNA sequence
gacaagaacgctttgtgtgg

SEQ ID NO: 420258 - DNA, 20 bp, Artificial
  CRISPR gRNA sequence
tgtgtggagctctctggaca

SEQ ID NO: 420259 - DNA, 20 bp, Artificial
  CRISPR gRNA sequence
gtgtggagctctctggacac

SEQ ID NO: 420260 - DNA, 20 bp, Artificial
  CRISPR gRNA sequence
tgtggagctctctggacacc

SEQ ID NO: 420261 - DNA, 20 bp, Artificial
  CRISPR gRNA sequence
tctggacaccccatcccaga

SEQ ID NO: 420262 - DNA, 20 bp, Artificial
  CRISPR gRNA sequence
tggacaccccatcccagagg

SEQ ID NO: 420263 - DNA, 20 bp, Artificial
  CRISPR gRNA sequence
gacaccccatcccagaggag

SEQ ID NO: 420264 - DNA, 20 bp, Artificial
  CRISPR gRNA sequence
ctcaggaccttggctggagg

SEQ ID NO: 420265 - DNA, 20 bp, Artificial
  CRISPR gRNA sequence
tcaggaccttggctggaggc

SEQ ID NO: 420266 - DNA, 20 bp, Artificial
  CRISPR gRNA sequence
aggaccttggctggaggcac

SEQ ID NO: 420267 - DNA, 20 bp, Artificial
  CRISPR gRNA sequence
ggctggaggcacaggaggcc

SEQ ID NO: 420268 - DNA, 20 bp, Artificial
  CRISPR gRNA sequence
gctggaggcacaggaggccc

SEQ ID NO: 420269 - DNA, 20 bp, Artificial
  CRISPR gRNA sequence
gaggcacaggaggcccagct

SEQ ID NO: 420270 - DNA, 20 bp, Artificial
  CRISPR gRNA sequence
ctttcccagccttggcaatg

SEQ ID NO: 420271 - DNA, 20 bp, Artificial
  CRISPR gRNA sequence
tcccagccttggcaatgcca

SEQ ID NO: 420272 - DNA, 20 bp, Artificial
  CRISPR gRNA sequence
cccagccttggcaatgccag

SEQ ID NO: 420273 - DNA, 20 bp, Artificial
  CRISPR gRNA sequence
ccagccttggcaatgccagc

SEQ ID NO: 420274 - DNA, 20 bp, Artificial
  CRISPR gRNA sequence
ggcaatgccagctgtaccag

SEQ ID NO: 420275 - DNA, 20 bp, Artificial
  CRISPR gRNA sequence
gcaatgccagctgtaccagg

SEQ ID NO: 420276 - DNA, 20 bp, Artificial
  CRISPR gRNA sequence
taccagggggagaggcttct

SEQ ID NO: 420277 - DNA, 20 bp, Artificial
  CRISPR gRNA sequence
cttggagcagcagtgtactt

SEQ ID NO: 420278 - DNA, 20 bp, Artificial
  CRISPR gRNA sequence
ttggagcagcagtgtacttc

SEQ ID NO: 420279 - DNA, 20 bp, Artificial
  CRISPR gRNA sequence
ggagcagcagtgtacttcac

SEQ ID NO: 420280 - DNA, 20 bp, Artificial
  CRISPR gRNA sequence
gagcagcagtgtacttcaca

SEQ ID NO: 420281 - DNA, 20 bp, Artificial
  CRISPR gRNA sequence
cacagagctgtctagcccag

SEQ ID NO: 420282 - DNA, 20 bp, Artificial
  CRISPR gRNA sequence
acagagctgtctagcccagg

SEQ ID NO: 420283 - DNA, 20 bp, Artificial
  CRISPR gRNA sequence
tctagcccaggtccgaggcc

SEQ ID NO: 420284 - DNA, 20 bp, Artificial
  CRISPR gRNA sequence
gcccaggtccgaggccccag

SEQ ID NO: 420285 - DNA, 20 bp, Artificial
  CRISPR gRNA sequence
tatcctccttccagaacagc

SEQ ID NO: 420286 - DNA, 20 bp, Artificial
  CRISPR gRNA sequence
atcctccttccagaacagcc

SEQ ID NO: 420287 - DNA, 20 bp, Artificial
  CRISPR gRNA sequence
tcctccttccagaacagccc

SEQ ID NO: 420288 - DNA, 20 bp, Artificial
  CRISPR gRNA sequence
cttccagaacagcccctgcc

SEQ ID NO: 420289 - DNA, 20 bp, Artificial
  CRISPR gRNA sequence
ccagaacagcccctgccacc

SEQ ID NO: 420290 - DNA, 20 bp, Artificial
  CRISPR gRNA sequence
cagaacagcccctgccaccc

SEQ ID NO: 420291 - DNA, 20 bp, Artificial
  CRISPR gRNA sequence
ccacccccatcccagcgctt

SEQ ID NO: 420292 - DNA, 20 bp, Artificial
  CRISPR gRNA sequence
ttctttccagtcagggacct

SEQ ID NO: 420293 - DNA, 20 bp, Artificial
  CRISPR gRNA sequence
tctttccagtcagggacctg

SEQ ID NO: 420294 - DNA, 20 bp, Artificial
  CRISPR gRNA sequence
ctttccagtcagggacctga

SEQ ID NO: 420295 - DNA, 20 bp, Artificial
  CRISPR gRNA sequence
tttccagtcagggacctgat

SEQ ID NO: 420296 - DNA, 20 bp, Artificial
  CRISPR gRNA sequence
tccagtcagggacctgatct

SEQ ID NO: 420297 - DNA, 20 bp, Artificial
  CRISPR gRNA sequence
ccagtcagggacctgatctc

SEQ ID NO: 420298 - DNA, 20 bp, Artificial
  CRISPR gRNA sequence
cagtcagggacctgatctct

SEQ ID NO: 420299 - DNA, 20 bp, Artificial
  CRISPR gRNA sequence
atctctggcttttgcctagg

SEQ ID NO: 420300 - DNA, 20 bp, Artificial
  CRISPR gRNA sequence
tggcttttgcctagggttga

SEQ ID NO: 420301 - DNA, 20 bp, Artificial
  CRISPR gRNA sequence
gcttttgcctagggttgacc

SEQ ID NO: 420302 - DNA, 20 bp, Artificial
  CRISPR gRNA sequence
ttgcctagggttgacccgtt

SEQ ID NO: 420303 - DNA, 20 bp, Artificial
  CRISPR gRNA sequence
tgcctagggttgacccgttt

SEQ ID NO: 420304 - DNA, 20 bp, Artificial
  CRISPR gRNA sequence
gcctagggttgacccgtttc

SEQ ID NO: 420305 - DNA, 20 bp, Artificial
  CRISPR gRNA sequence
cctagggttgacccgtttcc

SEQ ID NO: 420306 - DNA, 20 bp, Artificial
  CRISPR gRNA sequence
gggttgacccgtttccgcca

SEQ ID NO: 420307 - DNA, 20 bp, Artificial
  CRISPR gRNA sequence
acccgtttccgccactgatc

SEQ ID NO: 420308 - DNA, 20 bp, Artificial
  CRISPR gRNA sequence
ccgccactgatcagctgaat

SEQ ID NO: 420309 - DNA, 20 bp, Artificial
  CRISPR gRNA sequence
cgccactgatcagctgaatg

SEQ ID NO: 420310 - DNA, 20 bp, Artificial
  CRISPR gRNA sequence
atcagctgaatgaccctggg

SEQ ID NO: 420311 - DNA, 20 bp, Artificial
  CRISPR gRNA sequence
aatgaccctgggacaagtcc

SEQ ID NO: 420312 - DNA, 20 bp, Artificial
  CRISPR gRNA sequence
ggacaagtcccttaaactct

SEQ ID NO: 420313 - DNA, 20 bp, Artificial
  CRISPR gRNA sequence
aaactctctggatctcattg

SEQ ID NO: 420314 - DNA, 20 bp, Artificial
  CRISPR gRNA sequence
aactctctggatctcattgc

SEQ ID NO: 420315 - DNA, 20 bp, Artificial
  CRISPR gRNA sequence
tctggatctcattgcatctg

SEQ ID NO: 420316 - DNA, 20 bp, Artificial
  CRISPR gRNA sequence
tggatctcattgcatctgta

SEQ ID NO: 420317 - DNA, 20 bp, Artificial
  CRISPR gRNA sequence
gatctcattgcatctgtaaa

SEQ ID NO: 420318 - DNA, 20 bp, Artificial
  CRISPR gRNA sequence
attgcatctgtaaagtctga

SEQ ID NO: 420319 - DNA, 20 bp, Artificial
  CRISPR gRNA sequence
catctgtaaagtctgagaga

SEQ ID NO: 420320 - DNA, 20 bp, Artificial
  CRISPR gRNA sequence
taaagtctgagagaatgaca

SEQ ID NO: 420321 - DNA, 20 bp, Artificial
  CRISPR gRNA sequence
agagaatgacaaagtgtcct

SEQ ID NO: 420322 - DNA, 20 bp, Artificial
  CRISPR gRNA sequence
tctagtcctgaccctatgcc

SEQ ID NO: 420323 - DNA, 20 bp, Artificial
  CRISPR gRNA sequence
ctagtcctgaccctatgcct

SEQ ID NO: 420324 - DNA, 20 bp, Artificial
  CRISPR gRNA sequence
tagtcctgaccctatgcctc

SEQ ID NO: 420325 - DNA, 20 bp, Artificial
  CRISPR gRNA sequence
gtcctgaccctatgcctcat

SEQ ID NO: 420326 - DNA, 20 bp, Artificial
  CRISPR gRNA sequence
accctatgcctcatcctgta

SEQ ID NO: 420327 - DNA, 20 bp, Artificial
  CRISPR gRNA sequence
tgcctcatcctgtactttct

SEQ ID NO: 420328 - DNA, 20 bp, Artificial
  CRISPR gRNA sequence
atcctgtactttctccatag

SEQ ID NO: 420329 - DNA, 20 bp, Artificial
  CRISPR gRNA sequence
tactttctccataggtgccc

SEQ ID NO: 420330 - DNA, 20 bp, Artificial
  CRISPR gRNA sequence
tctccataggtgcccaacgc

SEQ ID NO: 420331 - DNA, 20 bp, Artificial
  CRISPR gRNA sequence
ctccataggtgcccaacgct

SEQ ID NO: 420332 - DNA, 20 bp, Artificial
  CRISPR gRNA sequence
tccataggtgcccaacgctc

SEQ ID NO: 420333 - DNA, 20 bp, Artificial
  CRISPR gRNA sequence
cataggtgcccaacgctctg

SEQ ID NO: 420334 - DNA, 20 bp, Artificial
  CRISPR gRNA sequence
tgggagagccccaggtgccc

SEQ ID NO: 420335 - DNA, 20 bp, Artificial
  CRISPR gRNA sequence
ggagagccccaggtgccctc

SEQ ID NO: 420336 - DNA, 20 bp, Artificial
  CRISPR gRNA sequence
ccagcaggccacctcctgct

SEQ ID NO: 420337 - DNA, 20 bp, Artificial
  CRISPR gRNA sequence
ctgctgtttctcatccttgg

SEQ ID NO: 420338 - DNA, 20 bp, Artificial
  CRISPR gRNA sequence
ctgtttctcatccttggtgt

SEQ ID NO: 420339 - DNA, 20 bp, Artificial
  CRISPR gRNA sequence
tttctcatccttggtgtcct

SEQ ID NO: 420340 - DNA, 20 bp, Artificial
  CRISPR gRNA sequence
ctcatccttggtgtcctttc

SEQ ID NO: 420341 - DNA, 20 bp, Artificial
  CRISPR gRNA sequence
tcatccttggtgtcctttct

SEQ ID NO: 420342 - DNA, 20 bp, Artificial
  CRISPR gRNA sequence
atccttggtgtcctttctct

SEQ ID NO: 420343 - DNA, 20 bp, Artificial
  CRISPR gRNA sequence
ggtgtcctttctctgctcct

SEQ ID NO: 420344 - DNA, 20 bp, Artificial
  CRISPR gRNA sequence
gtgtcctttctctgctcctt

SEQ ID NO: 420345 - DNA, 20 bp, Artificial
  CRISPR gRNA sequence
tctctgctccttttggtgac

SEQ ID NO: 420346 - DNA, 20 bp, Artificial
  CRISPR gRNA sequence
ctctgctccttttggtgact

SEQ ID NO: 420347 - DNA, 20 bp, Artificial
  CRISPR gRNA sequence
tctgctccttttggtgactg

SEQ ID NO: 420348 - DNA, 20 bp, Artificial
  CRISPR gRNA sequence
tgctccttttggtgactgga

SEQ ID NO: 420349 - DNA, 20 bp, Artificial
  CRISPR gRNA sequence
ctccttttggtgactggagc

SEQ ID NO: 420350 - DNA, 20 bp, Artificial
  CRISPR gRNA sequence
cttttggtgactggagcctt

SEQ ID NO: 420351 - DNA, 20 bp, Artificial
  CRISPR gRNA sequence
ttggtgactggagcctttgg

SEQ ID NO: 420352 - DNA, 20 bp, Artificial
  CRISPR gRNA sequence
tggtgactggagcctttggc

SEQ ID NO: 420353 - DNA, 20 bp, Artificial
  CRISPR gRNA sequence
ggtgactggagcctttggct

SEQ ID NO: 420354 - DNA, 20 bp, Artificial
  CRISPR gRNA sequence
gtgactggagcctttggctt

SEQ ID NO: 420355 - DNA, 20 bp, Artificial
  CRISPR gRNA sequence
gagcctttggctttcacctt

SEQ ID NO: 420356 - DNA, 20 bp, Artificial
  CRISPR gRNA sequence
tggctttcacctttggagaa

SEQ ID NO: 420357 - DNA, 20 bp, Artificial
  CRISPR gRNA sequence
ggctttcacctttggagaag

SEQ ID NO: 420358 - DNA, 20 bp, Artificial
  CRISPR gRNA sequence
gctttcacctttggagaaga

SEQ ID NO: 420359 - DNA, 20 bp, Artificial
  CRISPR gRNA sequence
tcacctttggagaagacagg

SEQ ID NO: 420360 - DNA, 20 bp, Artificial
  CRISPR gRNA sequence
cacctttggagaagacaggt

SEQ ID NO: 420361 - DNA, 20 bp, Artificial
  CRISPR gRNA sequence
acctttggagaagacaggtg

SEQ ID NO: 420362 - DNA, 20 bp, Artificial
  CRISPR gRNA sequence
tggagaagacaggtgagcca

SEQ ID NO: 420363 - DNA, 20 bp, Artificial
  CRISPR gRNA sequence
ggagaagacaggtgagccag

SEQ ID NO: 420364 - DNA, 20 bp, Artificial
  CRISPR gRNA sequence
gagaagacaggtgagccagg

SEQ ID NO: 420365 - DNA, 20 bp, Artificial
  CRISPR gRNA sequence
ccgctcttccatcctcagag

SEQ ID NO: 420366 - DNA, 20 bp, Artificial
  CRISPR gRNA sequence
ttccatcctcagagtgctga

SEQ ID NO: 420367 - DNA, 20 bp, Artificial
  CRISPR gRNA sequence
ccatcctcagagtgctgatg

SEQ ID NO: 420368 - DNA, 20 bp, Artificial
  CRISPR gRNA sequence
catcctcagagtgctgatgg

SEQ ID NO: 420369 - DNA, 20 bp, Artificial
  CRISPR gRNA sequence
agagtgctgatggcacccct

SEQ ID NO: 420370 - DNA, 20 bp, Artificial
  CRISPR gRNA sequence
atggcaccccttcctcagga

SEQ ID NO: 420371 - DNA, 20 bp, Artificial
  CRISPR gRNA sequence
cctcaggaaggtgaccaaat

SEQ ID NO: 420372 - DNA, 20 bp, Artificial
  CRISPR gRNA sequence
ctcaggaaggtgaccaaatg

SEQ ID NO: 420373 - DNA, 20 bp, Artificial
  CRISPR gRNA sequence
aggaaggtgaccaaatggga

SEQ ID NO: 420374 - DNA, 20 bp, Artificial
  CRISPR gRNA sequence
aacttgccctcagagccccc

SEQ ID NO: 420375 - DNA, 20 bp, Artificial
  CRISPR gRNA sequence
gccctcagagccccccttct

SEQ ID NO: 420376 - DNA, 20 bp, Artificial
  CRISPR gRNA sequence
ccctcagagccccccttctt

SEQ ID NO: 420377 - DNA, 20 bp, Artificial
  CRISPR gRNA sequence
agagccccccttcttcataa

SEQ ID NO: 420378 - DNA, 20 bp, Artificial
  CRISPR gRNA sequence
cttcataagcctctcactcc

SEQ ID NO: 420379 - DNA, 20 bp, Artificial
  CRISPR gRNA sequence
ttcataagcctctcactcca

SEQ ID NO: 420380 - DNA, 20 bp, Artificial
  CRISPR gRNA sequence
cataagcctctcactccagg

SEQ ID NO: 420381 - DNA, 20 bp, Artificial
  CRISPR gRNA sequence
ataagcctctcactccaggg

SEQ ID NO: 420382 - DNA, 20 bp, Artificial
  CRISPR gRNA sequence
tcactccagggatggcttgt

SEQ ID NO: 420383 - DNA, 20 bp, Artificial
  CRISPR gRNA sequence
actccagggatggcttgtgc

SEQ ID NO: 420384 - DNA, 20 bp, Artificial
  CRISPR gRNA sequence
cagggatggcttgtgcctgg

SEQ ID NO: 420385 - DNA, 20 bp, Artificial
  CRISPR gRNA sequence
gtgcctgggtaggctggaag

SEQ ID NO: 420386 - DNA, 20 bp, Artificial
  CRISPR gRNA sequence
tgcctgggtaggctggaagg

SEQ ID NO: 420387 - DNA, 20 bp, Artificial
  CRISPR gRNA sequence
ggtaggctggaaggggggtt

SEQ ID NO: 420388 - DNA, 20 bp, Artificial
  CRISPR gRNA sequence
gaaggggggttgggagaaag

SEQ ID NO: 420389 - DNA, 20 bp, Artificial
  CRISPR gRNA sequence
ggagaaagccaggaccagat

SEQ ID NO: 420390 - DNA, 20 bp, Artificial
  CRISPR gRNA sequence
agaaaaaatagagggactca

SEQ ID NO: 420391 - DNA, 20 bp, Artificial
  CRISPR gRNA sequence
agtgtccctcctcatccgct

SEQ ID NO: 420392 - DNA, 20 bp, Artificial
  CRISPR gRNA sequence
ctcatccgcttcccttcatc

SEQ ID NO: 420393 - DNA, 20 bp, Artificial
  CRISPR gRNA sequence
atccgcttcccttcatcctt

SEQ ID NO: 420394 - DNA, 20 bp, Artificial
  CRISPR gRNA sequence
cccttcatccttctcctcct

SEQ ID NO: 420395 - DNA, 20 bp, Artificial
  CRISPR gRNA sequence
ccttcatccttctcctcctt

SEQ ID NO: 420396 - DNA, 20 bp, Artificial
  CRISPR gRNA sequence
catccttctcctccttccgc

SEQ ID NO: 420397 - DNA, 20 bp, Artificial
  CRISPR gRNA sequence
atccttctcctccttccgcc

SEQ ID NO: 420398 - DNA, 20 bp, Artificial
  CRISPR gRNA sequence
ctcctccttccgccctccgt

SEQ ID NO: 420399 - DNA, 20 bp, Artificial
  CRISPR gRNA sequence
tcctccttccgccctccgtc

SEQ ID NO: 420400 - DNA, 20 bp, Artificial
  CRISPR gRNA sequence
ctccttccgccctccgtctc

SEQ ID NO: 420401 - DNA, 20 bp, Artificial
  CRISPR gRNA sequence
cttccgccctccgtctctct

SEQ ID NO: 420402 - DNA, 20 bp, Artificial
  CRISPR gRNA sequence
ccgccctccgtctctctctc

SEQ ID NO: 420403 - DNA, 20 bp, Artificial
  CRISPR gRNA sequence
cgccctccgtctctctctcc

SEQ ID NO: 420404 - DNA, 20 bp, Artificial
  CRISPR gRNA sequence
cgtctctctctccatctctt

SEQ ID NO: 420405 - DNA, 20 bp, Artificial
  CRISPR gRNA sequence
tctctccatctcttctcaca

SEQ ID NO: 420406 - DNA, 20 bp, Artificial
  CRISPR gRNA sequence
tctccatctcttctcacagt

SEQ ID NO: 420407 - DNA, 20 bp, Artificial
  CRISPR gRNA sequence
tccatctcttctcacagtgg

SEQ ID NO: 420408 - DNA, 20 bp, Artificial
  CRISPR gRNA sequence
catctcttctcacagtggcg

SEQ ID NO: 420409 - DNA, 20 bp, Artificial
  CRISPR gRNA sequence
ttctcacagtggcgaccaag

SEQ ID NO: 420410 - DNA, 20 bp, Artificial
  CRISPR gRNA sequence
ctcacagtggcgaccaagac

SEQ ID NO: 420411 - DNA, 20 bp, Artificial
  CRISPR gRNA sequence
tcacagtggcgaccaagacg

SEQ ID NO: 420412 - DNA, 20 bp, Artificial
  CRISPR gRNA sequence
acagtggcgaccaagacgat

SEQ ID NO: 420413 - DNA, 20 bp, Artificial
  CRISPR gRNA sequence
tctgccttagagcaagggat

SEQ ID NO: 420414 - DNA, 20 bp, Artificial
  CRISPR gRNA sequence
ctgccttagagcaagggatt

SEQ ID NO: 420415 - DNA, 20 bp, Artificial
  CRISPR gRNA sequence
tgccttagagcaagggattc

SEQ ID NO: 420416 - DNA, 20 bp, Artificial
  CRISPR gRNA sequence
ccttagagcaagggattcac

SEQ ID NO: 420417 - DNA, 20 bp, Artificial
  CRISPR gRNA sequence
agagcaagggattcaccctc

SEQ ID NO: 420418 - DNA, 20 bp, Artificial
  CRISPR gRNA sequence
gagcaagggattcaccctcc

SEQ ID NO: 420419 - DNA, 20 bp, Artificial
  CRISPR gRNA sequence
accctccgcaggctcagagc

SEQ ID NO: 420420 - DNA, 20 bp, Artificial
  CRISPR gRNA sequence
cgcaggctcagagcaagata

SEQ ID NO: 420421 - DNA, 20 bp, Artificial
  CRISPR gRNA sequence
agagcaagatagaggagctg

SEQ ID NO: 420422 - DNA, 20 bp, Artificial
  CRISPR gRNA sequence
gagcaagaaccggagccgga

SEQ ID NO: 420423 - DNA, 20 bp, Artificial
  CRISPR gRNA sequence
tgacctggagctgaggcagc

SEQ ID NO: 420424 - DNA, 20 bp, Artificial
  CRISPR gRNA sequence
acctggagctgaggcagcca

SEQ ID NO: 420425 - DNA, 20 bp, Artificial
  CRISPR gRNA sequence
gagctgaggcagccagcaga

SEQ ID NO: 420426 - DNA, 20 bp, Artificial
  CRISPR gRNA sequence
aggcagccagcagatctcag

SEQ ID NO: 420427 - DNA, 20 bp, Artificial
  CRISPR gRNA sequence
agcagcccagtccaaataaa

SEQ ID NO: 420428 - DNA, 20 bp, Artificial
  CRISPR gRNA sequence
cctgtcagcagcaagcctga

SEQ ID NO: 420429 - DNA, 20 bp, Artificial
  CRISPR gRNA sequence
tcagcagcaagcctgagtct

SEQ ID NO: 420430 - DNA, 20 bp, Artificial
  CRISPR gRNA sequence
agtctggctctttcttgtcc

SEQ ID NO: 420431 - DNA, 20 bp, Artificial
  CRISPR gRNA sequence
gctctttcttgtccaagtga

SEQ ID NO: 420432 - DNA, 20 bp, Artificial
  CRISPR gRNA sequence
tttcttgtccaagtgaaggt

SEQ ID NO: 420433 - DNA, 20 bp, Artificial
  CRISPR gRNA sequence
tcttgtccaagtgaaggttc

SEQ ID NO: 420434 - DNA, 20 bp, Artificial
  CRISPR gRNA sequence
cttgtccaagtgaaggttcc

SEQ ID NO: 420435 - DNA, 20 bp, Artificial
  CRISPR gRNA sequence
ttgtccaagtgaaggttccc

SEQ ID NO: 420436 - DNA, 20 bp, Artificial
  CRISPR gRNA sequence
gtccaagtgaaggttcccgt

SEQ ID NO: 420437 - DNA, 20 bp, Artificial
  CRISPR gRNA sequence
tccaagtgaaggttcccgtc

SEQ ID NO: 420438 - DNA, 20 bp, Artificial
  CRISPR gRNA sequence
ccgtctctccccagcctctg

SEQ ID NO: 420439 - DNA, 20 bp, Artificial
  CRISPR gRNA sequence
tccccagcctctgagggctc

SEQ ID NO: 420440 - DNA, 20 bp, Artificial
  CRISPR gRNA sequence
cccagcctctgagggctccc

SEQ ID NO: 420441 - DNA, 20 bp, Artificial
  CRISPR gRNA sequence
tgagggctcccttctcccac

SEQ ID NO: 420442 - DNA, 20 bp, Artificial
  CRISPR gRNA sequence
agggctcccttctcccaccc

SEQ ID NO: 420443 - DNA, 20 bp, Artificial
  CRISPR gRNA sequence
ccttctcccaccctagcctc

SEQ ID NO: 420444 - DNA, 20 bp, Artificial
  CRISPR gRNA sequence
ctcccaccctagcctcctaa

SEQ ID NO: 420445 - DNA, 20 bp, Artificial
  CRISPR gRNA sequence
tcccaccctagcctcctaac

SEQ ID NO: 420446 - DNA, 20 bp, Artificial
  CRISPR gRNA sequence
ccaccctagcctcctaacct

SEQ ID NO: 420447 - DNA, 20 bp, Artificial
  CRISPR gRNA sequence
gcctcctaacctactttccc

SEQ ID NO: 420448 - DNA, 20 bp, Artificial
  CRISPR gRNA sequence
ggaggctagggtgggagaag

SEQ ID NO: 420449 - DNA, 20 bp, Artificial
  CRISPR gRNA sequence
gggtgggagaagggagccct

SEQ ID NO: 420450 - DNA, 20 bp, Artificial
  CRISPR gRNA sequence
agaggctggggagagacggg

SEQ ID NO: 420451 - DNA, 20 bp, Artificial
  CRISPR gRNA sequence
gggagagacgggaaccttca

SEQ ID NO: 420452 - DNA, 20 bp, Artificial
  CRISPR gRNA sequence
cacttggacaagaaagagcc

SEQ ID NO: 420453 - DNA, 20 bp, Artificial
  CRISPR gRNA sequence
acttggacaagaaagagcca

SEQ ID NO: 420454 - DNA, 20 bp, Artificial
  CRISPR gRNA sequence
ggacaagaaagagccagact

SEQ ID NO: 420455 - DNA, 20 bp, Artificial
  CRISPR gRNA sequence
gacaagaaagagccagactc

SEQ ID NO: 420456 - DNA, 20 bp, Artificial
  CRISPR gRNA sequence
aggcttgctgctgacaggga

SEQ ID NO: 420457 - DNA, 20 bp, Artificial
  CRISPR gRNA sequence
gctgctgacagggagtttat

SEQ ID NO: 420458 - DNA, 20 bp, Artificial
  CRISPR gRNA sequence
ctgctgacagggagtttatt

SEQ ID NO: 420459 - DNA, 20 bp, Artificial
  CRISPR gRNA sequence
ctgacagggagtttatttgg

SEQ ID NO: 420460 - DNA, 20 bp, Artificial
  CRISPR gRNA sequence
acagggagtttatttggact

SEQ ID NO: 420461 - DNA, 20 bp, Artificial
  CRISPR gRNA sequence
atttggactgggctgctgag

SEQ ID NO: 420462 - DNA, 20 bp, Artificial
  CRISPR gRNA sequence
tttggactgggctgctgaga

SEQ ID NO: 420463 - DNA, 20 bp, Artificial
  CRISPR gRNA sequence
ggactgggctgctgagatct

SEQ ID NO: 420464 - DNA, 20 bp, Artificial
  CRISPR gRNA sequence
gactgggctgctgagatctg

SEQ ID NO: 420465 - DNA, 20 bp, Artificial
  CRISPR gRNA sequence
ggctgctgagatctgctggc

SEQ ID NO: 420466 - DNA, 20 bp, Artificial
  CRISPR gRNA sequence
ctgagatctgctggctgcct

SEQ ID NO: 420467 - DNA, 20 bp, Artificial
  CRISPR gRNA sequence
agatctgctggctgcctcag

SEQ ID NO: 420468 - DNA, 20 bp, Artificial
  CRISPR gRNA sequence
ctggctgcctcagctccagg

SEQ ID NO: 420469 - DNA, 20 bp, Artificial
  CRISPR gRNA sequence
gctgcctcagctccaggtca

SEQ ID NO: 420470 - DNA, 20 bp, Artificial
  CRISPR gRNA sequence
cctcagctccaggtcagagc

SEQ ID NO: 420471 - DNA, 20 bp, Artificial
  CRISPR gRNA sequence
agctccaggtcagagctgct

SEQ ID NO: 420472 - DNA, 20 bp, Artificial
  CRISPR gRNA sequence
caggtcagagctgctccggc

SEQ ID NO: 420473 - DNA, 20 bp, Artificial
  CRISPR gRNA sequence
ctccggctcgggctcgggct

SEQ ID NO: 420474 - DNA, 20 bp, Artificial
  CRISPR gRNA sequence
cggctcgggctcgggctcgg

SEQ ID NO: 420475 - DNA, 20 bp, Artificial
  CRISPR gRNA sequence
gggctcgggctcgggctccg

SEQ ID NO: 420476 - DNA, 20 bp, Artificial
  CRISPR gRNA sequence
gggctcgggctccggttccg

SEQ ID NO: 420477 - DNA, 20 bp, Artificial
  CRISPR gRNA sequence
gggctccggttccggctccg

SEQ ID NO: 420478 - DNA, 20 bp, Artificial
  CRISPR gRNA sequence
cggttccggctccggctccg

SEQ ID NO: 420479 - DNA, 20 bp, Artificial
  CRISPR gRNA sequence
cggctccggctccggctccg

SEQ ID NO: 420480 - DNA, 20 bp, Artificial
  CRISPR gRNA sequence
cggctccggctccggttctt

SEQ ID NO: 420481 - DNA, 20 bp, Artificial
  CRISPR gRNA sequence
cggctccggttcttgctcca

SEQ ID NO: 420482 - DNA, 20 bp, Artificial
  CRISPR gRNA sequence
cggttcttgctccagctcct

SEQ ID NO: 420483 - DNA, 20 bp, Artificial
  CRISPR gRNA sequence
ttgctccagctcctctatct

SEQ ID NO: 420484 - DNA, 20 bp, Artificial
  CRISPR gRNA sequence
gctccagctcctctatcttg

SEQ ID NO: 420485 - DNA, 20 bp, Artificial
  CRISPR gRNA sequence
ctccagctcctctatcttgc

SEQ ID NO: 420486 - DNA, 20 bp, Artificial
  CRISPR gRNA sequence
cagctcctctatcttgctct

SEQ ID NO: 420487 - DNA, 20 bp, Artificial
  CRISPR gRNA sequence
ctctatcttgctctgagcct

SEQ ID NO: 420488 - DNA, 20 bp, Artificial
  CRISPR gRNA sequence
tatcttgctctgagcctgcg

SEQ ID NO: 420489 - DNA, 20 bp, Artificial
  CRISPR gRNA sequence
tcttgctctgagcctgcgga

SEQ ID NO: 420490 - DNA, 20 bp, Artificial
  CRISPR gRNA sequence
gctctgagcctgcggagggt

SEQ ID NO: 420491 - DNA, 20 bp, Artificial
  CRISPR gRNA sequence
ctctgagcctgcggagggtg

SEQ ID NO: 420492 - DNA, 20 bp, Artificial
  CRISPR gRNA sequence
tgagcctgcggagggtgaat

SEQ ID NO: 420493 - DNA, 20 bp, Artificial
  CRISPR gRNA sequence
agcctgcggagggtgaatcc

SEQ ID NO: 420494 - DNA, 20 bp, Artificial
  CRISPR gRNA sequence
cggagggtgaatcccttgct

SEQ ID NO: 420495 - DNA, 20 bp, Artificial
  CRISPR gRNA sequence
gctctaaggcagaaaatcgt

SEQ ID NO: 420496 - DNA, 20 bp, Artificial
  CRISPR gRNA sequence
ctctaaggcagaaaatcgtc

SEQ ID NO: 420497 - DNA, 20 bp, Artificial
  CRISPR gRNA sequence
taaggcagaaaatcgtcttg

SEQ ID NO: 420498 - DNA, 20 bp, Artificial
  CRISPR gRNA sequence
aggcagaaaatcgtcttggt

SEQ ID NO: 420499 - DNA, 20 bp, Artificial
  CRISPR gRNA sequence
ggtcgccactgtgagaagag

SEQ ID NO: 420500 - DNA, 20 bp, Artificial
  CRISPR gRNA sequence
gtcgccactgtgagaagaga

SEQ ID NO: 420501 - DNA, 20 bp, Artificial
  CRISPR gRNA sequence
tgagaagagatggagagaga

SEQ ID NO: 420502 - DNA, 20 bp, Artificial
  CRISPR gRNA sequence
agtccctctattttttctca

SEQ ID NO: 420503 - DNA, 20 bp, Artificial
  CRISPR gRNA sequence
tattttttctcagcgcccct

SEQ ID NO: 420504 - DNA, 20 bp, Artificial
  CRISPR gRNA sequence
ttttttctcagcgcccctgc

SEQ ID NO: 420505 - DNA, 20 bp, Artificial
  CRISPR gRNA sequence
tttctcagcgcccctgccct

SEQ ID NO: 420506 - DNA, 20 bp, Artificial
  CRISPR gRNA sequence
ttctcagcgcccctgccctc

SEQ ID NO: 420507 - DNA, 20 bp, Artificial
  CRISPR gRNA sequence
tctcagcgcccctgccctcc

SEQ ID NO: 420508 - DNA, 20 bp, Artificial
  CRISPR gRNA sequence
ctcagcgcccctgccctccc

SEQ ID NO: 420509 - DNA, 20 bp, Artificial
  CRISPR gRNA sequence
tcagcgcccctgccctcccc

SEQ ID NO: 420510 - DNA, 20 bp, Artificial
  CRISPR gRNA sequence
agcgcccctgccctccccat

SEQ ID NO: 420511 - DNA, 20 bp, Artificial
  CRISPR gRNA sequence
ccctccccatctggtcctgg

SEQ ID NO: 420512 - DNA, 20 bp, Artificial
  CRISPR gRNA sequence
cccatctggtcctggctttc

SEQ ID NO: 420513 - DNA, 20 bp, Artificial
  CRISPR gRNA sequence
gtcctggctttctcccaacc

SEQ ID NO: 420514 - DNA, 20 bp, Artificial
  CRISPR gRNA sequence
gctttctcccaacccccctt

SEQ ID NO: 420515 - DNA, 20 bp, Artificial
  CRISPR gRNA sequence
tctcccaaccccccttccag

SEQ ID NO: 420516 - DNA, 20 bp, Artificial
  CRISPR gRNA sequence
ctcccaaccccccttccagc

SEQ ID NO: 420517 - DNA, 20 bp, Artificial
  CRISPR gRNA sequence
tcccaaccccccttccagcc

SEQ ID NO: 420518 - DNA, 20 bp, Artificial
  CRISPR gRNA sequence
ccaaccccccttccagccta

SEQ ID NO: 420519 - DNA, 20 bp, Artificial
  CRISPR gRNA sequence
ccagcctacccaggcacaag

SEQ ID NO: 420520 - DNA, 20 bp, Artificial
  CRISPR gRNA sequence
cagcctacccaggcacaagc

SEQ ID NO: 420521 - DNA, 20 bp, Artificial
  CRISPR gRNA sequence
cccaggcacaagccatccct

SEQ ID NO: 420522 - DNA, 20 bp, Artificial
  CRISPR gRNA sequence
gagtgagaggcttatgaaga

SEQ ID NO: 420523 - DNA, 20 bp, Artificial
  CRISPR gRNA sequence
atgaagaaggggggctctga

SEQ ID NO: 420524 - DNA, 20 bp, Artificial
  CRISPR gRNA sequence
tgaagaaggggggctctgag

SEQ ID NO: 420525 - DNA, 20 bp, Artificial
  CRISPR gRNA sequence
tgagggcaagttcagggtcc

SEQ ID NO: 420526 - DNA, 20 bp, Artificial
  CRISPR gRNA sequence
agggcaagttcagggtccca

SEQ ID NO: 420527 - DNA, 20 bp, Artificial
  CRISPR gRNA sequence
agggtcccatttggtcacct

SEQ ID NO: 420528 - DNA, 20 bp, Artificial
  CRISPR gRNA sequence
ggtcaccttcctgaggaagg

SEQ ID NO: 420529 - DNA, 20 bp, Artificial
  CRISPR gRNA sequence
gtcaccttcctgaggaaggg

SEQ ID NO: 420530 - DNA, 20 bp, Artificial
  CRISPR gRNA sequence
cctgaggaaggggtgccatc

SEQ ID NO: 420531 - DNA, 20 bp, Artificial
  CRISPR gRNA sequence
ctgaggaaggggtgccatca

SEQ ID NO: 420532 - DNA, 20 bp, Artificial
  CRISPR gRNA sequence
aggaaggggtgccatcagca

SEQ ID NO: 420533 - DNA, 20 bp, Artificial
  CRISPR gRNA sequence
tgaggatggaagagcgggag

SEQ ID NO: 420534 - DNA, 20 bp, Artificial
  CRISPR gRNA sequence
aggatggaagagcgggagct

SEQ ID NO: 420535 - DNA, 20 bp, Artificial
  CRISPR gRNA sequence
ctggggggcggggttgccat

SEQ ID NO: 420536 - DNA, 20 bp, Artificial
  CRISPR gRNA sequence
gggggcggggttgccatgtc

SEQ ID NO: 420537 - DNA, 20 bp, Artificial
  CRISPR gRNA sequence
ccatgtccctggctcacctg

SEQ ID NO: 420538 - DNA, 20 bp, Artificial
  CRISPR gRNA sequence
gctcacctgtcttctccaaa

SEQ ID NO: 420539 - DNA, 20 bp, Artificial
  CRISPR gRNA sequence
acctgtcttctccaaaggtg

SEQ ID NO: 420540 - DNA, 20 bp, Artificial
  CRISPR gRNA sequence
tcttctccaaaggtgaaagc

SEQ ID NO: 420541 - DNA, 20 bp, Artificial
  CRISPR gRNA sequence
ctccaaaggtgaaagccaaa

SEQ ID NO: 420542 - DNA, 20 bp, Artificial
  CRISPR gRNA sequence
tccaaaggtgaaagccaaag

SEQ ID NO: 420543 - DNA, 20 bp, Artificial
  CRISPR gRNA sequence
caaaggtgaaagccaaaggc

SEQ ID NO: 420544 - DNA, 20 bp, Artificial
  CRISPR gRNA sequence
cagtcaccaaaaggagcaga

SEQ ID NO: 420545 - DNA, 20 bp, Artificial
  CRISPR gRNA sequence
ctgggagggcacctggggct

SEQ ID NO: 420546 - DNA, 20 bp, Artificial
  CRISPR gRNA sequence
ggagggcacctggggctctc

SEQ ID NO: 420547 - DNA, 20 bp, Artificial
  CRISPR gRNA sequence
gggctctcccagagcgttgg

SEQ ID NO: 420548 - DNA, 20 bp, Artificial
  CRISPR gRNA sequence
tcccagagcgttgggcacct

SEQ ID NO: 420549 - DNA, 20 bp, Artificial
  CRISPR gRNA sequence
ccagagcgttgggcacctat

SEQ ID NO: 420550 - DNA, 20 bp, Artificial
  CRISPR gRNA sequence
ggcacctatggagaaagtac

SEQ ID NO: 420551 - DNA, 20 bp, Artificial
  CRISPR gRNA sequence
tggagaaagtacaggatgag

SEQ ID NO: 420552 - DNA, 20 bp, Artificial
  CRISPR gRNA sequence
gaaaggacactttgtcattc

SEQ ID NO: 420553 - DNA, 20 bp, Artificial
  CRISPR gRNA sequence
tgtcattctctcagacttta

SEQ ID NO: 420554 - DNA, 20 bp, Artificial
  CRISPR gRNA sequence
gtcattctctcagactttac

SEQ ID NO: 420555 - DNA, 20 bp, Artificial
  CRISPR gRNA sequence
tcattctctcagactttaca

SEQ ID NO: 420556 - DNA, 20 bp, Artificial
  CRISPR gRNA sequence
tctcagactttacagatgca

SEQ ID NO: 420557 - DNA, 20 bp, Artificial
  CRISPR gRNA sequence
tcagactttacagatgcaat

SEQ ID NO: 420558 - DNA, 20 bp, Artificial
  CRISPR gRNA sequence
agactttacagatgcaatga

SEQ ID NO: 420559 - DNA, 20 bp, Artificial
  CRISPR gRNA sequence
tacagatgcaatgagatcca

SEQ ID NO: 420560 - DNA, 20 bp, Artificial
  CRISPR gRNA sequence
acagatgcaatgagatccag

SEQ ID NO: 420561 - DNA, 20 bp, Artificial
  CRISPR gRNA sequence
cagatgcaatgagatccaga

SEQ ID NO: 420562 - DNA, 20 bp, Artificial
  CRISPR gRNA sequence
aagggacttgtcccagggtc

SEQ ID NO: 420563 - DNA, 20 bp, Artificial
  CRISPR gRNA sequence
agggacttgtcccagggtca

SEQ ID NO: 420564 - DNA, 20 bp, Artificial
  CRISPR gRNA sequence
gtcccagggtcattcagctg

SEQ ID NO: 420565 - DNA, 20 bp, Artificial
  CRISPR gRNA sequence
tcccagggtcattcagctga

SEQ ID NO: 420566 - DNA, 20 bp, Artificial
  CRISPR gRNA sequence
agctgatcagtggcggaaac

SEQ ID NO: 420567 - DNA, 20 bp, Artificial
  CRISPR gRNA sequence
atcagtggcggaaacgggtc

SEQ ID NO: 420568 - DNA, 20 bp, Artificial
  CRISPR gRNA sequence
ggcaaaagccagagatcagg

SEQ ID NO: 420569 - DNA, 20 bp, Artificial
  CRISPR gRNA sequence
actggaaagaaaagcgctgg

SEQ ID NO: 420570 - DNA, 20 bp, Artificial
  CRISPR gRNA sequence
gaaagaaaagcgctgggatg

SEQ ID NO: 420571 - DNA, 20 bp, Artificial
  CRISPR gRNA sequence
ggatgggggtggcaggggct

SEQ ID NO: 420572 - DNA, 20 bp, Artificial
  CRISPR gRNA sequence
ttctggaaggaggataaaga

SEQ ID NO: 420573 - DNA, 20 bp, Artificial
  CRISPR gRNA sequence
tggaaggaggataaagatta

SEQ ID NO: 420574 - DNA, 20 bp, Artificial
  CRISPR gRNA sequence
gaaggaggataaagattatt

SEQ ID NO: 420575 - DNA, 20 bp, Artificial
  CRISPR gRNA sequence
ttgctgtggcgtttgggtcc

SEQ ID NO: 420576 - DNA, 20 bp, Artificial
  CRISPR gRNA sequence
ctgtggcgtttgggtcctgg

SEQ ID NO: 420577 - DNA, 20 bp, Artificial
  CRISPR gRNA sequence
tggcgtttgggtcctggcat

SEQ ID NO: 420578 - DNA, 20 bp, Artificial
  CRISPR gRNA sequence
gggtcctggcattctggggc

SEQ ID NO: 420579 - DNA, 20 bp, Artificial
  CRISPR gRNA sequence
ggtcctggcattctggggcc

SEQ ID NO: 420580 - DNA, 20 bp, Artificial
  CRISPR gRNA sequence
gcattctggggcctcggacc

SEQ ID NO: 420581 - DNA, 20 bp, Artificial
  CRISPR gRNA sequence
tggggcctcggacctgggct

SEQ ID NO: 420582 - DNA, 20 bp, Artificial
  CRISPR gRNA sequence
gggcctcggacctgggctag

SEQ ID NO: 420583 - DNA, 20 bp, Artificial
  CRISPR gRNA sequence
ggacctgggctagacagctc

SEQ ID NO: 420584 - DNA, 20 bp, Artificial
  CRISPR gRNA sequence
ggctagacagctctgtgaag

SEQ ID NO: 420585 - DNA, 20 bp, Artificial
  CRISPR gRNA sequence
gacagctctgtgaagtacac

SEQ ID NO: 420586 - DNA, 20 bp, Artificial
  CRISPR gRNA sequence
tgtgaagtacactgctgctc

SEQ ID NO: 420587 - DNA, 20 bp, Artificial
  CRISPR gRNA sequence
tgaagtacactgctgctcca

SEQ ID NO: 420588 - DNA, 20 bp, Artificial
  CRISPR gRNA sequence
ctgctccaagaagcctctcc

SEQ ID NO: 420589 - DNA, 20 bp, Artificial
  CRISPR gRNA sequence
ctccaagaagcctctccccc

SEQ ID NO: 420590 - DNA, 20 bp, Artificial
  CRISPR gRNA sequence
caagaagcctctccccctgg

SEQ ID NO: 420591 - DNA, 20 bp, Artificial
  CRISPR gRNA sequence
tccccctggtacagctggca

SEQ ID NO: 420592 - DNA, 20 bp, Artificial
  CRISPR gRNA sequence
cccctggtacagctggcatt

SEQ ID NO: 420593 - DNA, 20 bp, Artificial
  CRISPR gRNA sequence
gtacagctggcattgccaag

SEQ ID NO: 420594 - DNA, 20 bp, Artificial
  CRISPR gRNA sequence
gcattgccaaggctgggaaa

SEQ ID NO: 420595 - DNA, 20 bp, Artificial
  CRISPR gRNA sequence
ccaaggctgggaaaggagct

SEQ ID NO: 420596 - DNA, 20 bp, Artificial
  CRISPR gRNA sequence
ggaaaggagctgggcctcct

SEQ ID NO: 420597 - DNA, 20 bp, Artificial
  CRISPR gRNA sequence
ggcctcctgtgcctccagcc

SEQ ID NO: 420598 - DNA, 20 bp, Artificial
  CRISPR gRNA sequence
ctgtgcctccagccaaggtc

SEQ ID NO: 420599 - DNA, 20 bp, Artificial
  CRISPR gRNA sequence
tgcctccagccaaggtcctg

SEQ ID NO: 420600 - DNA, 20 bp, Artificial
  CRISPR gRNA sequence
cagccaaggtcctgagaaac

SEQ ID NO: 420601 - DNA, 20 bp, Artificial
  CRISPR gRNA sequence
agaaactcctctgggatggg

SEQ ID NO: 420602 - DNA, 20 bp, Artificial
  CRISPR gRNA sequence
ctctgggatggggtgtccag

SEQ ID NO: 420603 - DNA, 20 bp, Artificial
  CRISPR gRNA sequence
tgggatggggtgtccagaga

SEQ ID NO: 420604 - DNA, 20 bp, Artificial
  CRISPR gRNA sequence
ggatggggtgtccagagagc

SEQ ID NO: 420605 - DNA, 20 bp, Artificial
  CRISPR gRNA sequence
cacacaaagcgttcttgtcc

SEQ ID NO: 420606 - DNA, 20 bp, Artificial
  CRISPR gRNA sequence
ttgtccagatactggagtca

SEQ ID NO: 420607 - DNA, 20 bp, Artificial
  CRISPR gRNA sequence
gtccagatactggagtcacc

SEQ ID NO: 420608 - DNA, 20 bp, Artificial
  CRISPR gRNA sequence
tccagatactggagtcacct

SEQ ID NO: 420609 - DNA, 20 bp, Artificial
  CRISPR gRNA sequence
gagtcacctcacaaagcagc

SEQ ID NO: 420610 - DNA, 20 bp, Artificial
  CRISPR gRNA sequence
acaaagcagcttccccaggg

SEQ ID NO: 420611 - DNA, 20 bp, Artificial
  CRISPR gRNA sequence
ccccagggatccaggtgacc

SEQ ID NO: 420612 - DNA, 20 bp, Artificial
  CRISPR gRNA sequence
cccagggatccaggtgaccc

SEQ ID NO: 420613 - DNA, 20 bp, Artificial
  CRISPR gRNA sequence
gggagtcactgaaaagagta

SEQ ID NO: 420614 - DNA, 20 bp, Artificial
  CRISPR gRNA sequence
ggagtcactgaaaagagtag

SEQ ID NO: 420615 - DNA, 20 bp, Artificial
  CRISPR gRNA sequence
aaaagagtagaaggaagaga

SEQ ID NO: 420616 - DNA, 20 bp, Artificial
  CRISPR gRNA sequence
ttgggattctgcccccctta

SEQ ID NO: 420617 - DNA, 20 bp, Artificial
  CRISPR gRNA sequence
tgggattctgccccccttac

SEQ ID NO: 420618 - DNA, 20 bp, Artificial
  CRISPR gRNA sequence
gggattctgccccccttacg

SEQ ID NO: 420619 - DNA, 20 bp, Artificial
  CRISPR gRNA sequence
ggattctgccccccttacgt

SEQ ID NO: 420620 - DNA, 20 bp, Artificial
  CRISPR gRNA sequence
tgccccccttacgtgatatc

SEQ ID NO: 420621 - DNA, 20 bp, Artificial
  CRISPR gRNA sequence
ccccccttacgtgatatcac

SEQ ID NO: 420622 - DNA, 20 bp, Artificial
  CRISPR gRNA sequence
acgtgatatcacaggttgaa

SEQ ID NO: 420623 - DNA, 20 bp, Artificial
  CRISPR gRNA sequence
cgtgatatcacaggttgaac

SEQ ID NO: 420624 - DNA, 20 bp, Artificial
  CRISPR gRNA sequence
aaccccaagtctcaatcacc

SEQ ID NO: 420625 - DNA, 20 bp, Artificial
  CRISPR gRNA sequence
aatcaccctgcactcacttg

SEQ ID NO: 420626 - DNA, 20 bp, Artificial
  CRISPR gRNA sequence
cactcacttgggttctggcc

SEQ ID NO: 420627 - DNA, 20 bp, Artificial
  CRISPR gRNA sequence
acttgggttctggccagggg

SEQ ID NO: 420628 - DNA, 20 bp, Artificial
  CRISPR gRNA sequence
gggttctggccaggggaggt

SEQ ID NO: 420629 - DNA, 20 bp, Artificial
  CRISPR gRNA sequence
ggttctggccaggggaggtt

SEQ ID NO: 420630 - DNA, 20 bp, Artificial
  CRISPR gRNA sequence
tggccaggggaggttgggga

SEQ ID NO: 420631 - DNA, 20 bp, Artificial
  CRISPR gRNA sequence
gccaggggaggttggggaag

SEQ ID NO: 420632 - DNA, 20 bp, Artificial
  CRISPR gRNA sequence
gggaaggacatcatgggtca

SEQ ID NO: 420633 - DNA, 20 bp, Artificial
  CRISPR gRNA sequence
atctttttctttctatttat

SEQ ID NO: 420634 - DNA, 20 bp, Artificial
  CRISPR gRNA sequence
tttctttctatttatttttt

SEQ ID NO: 420635 - DNA, 20 bp, Artificial
  CRISPR gRNA sequence
ttctttctatttattttttt

SEQ ID NO: 420636 - DNA, 20 bp, Artificial
  CRISPR gRNA sequence
tctttctatttattttttta

SEQ ID NO: 420637 - DNA, 20 bp, Artificial
  CRISPR gRNA sequence
ctttctatttatttttttat

SEQ ID NO: 420638 - DNA, 20 bp, Artificial
  CRISPR gRNA sequence
tttctatttatttttttatt

SEQ ID NO: 420639 - DNA, 20 bp, Artificial
  CRISPR gRNA sequence
tctatttatttttttattaa

SEQ ID NO: 420640 - DNA, 20 bp, Artificial
  CRISPR gRNA sequence
ctatttatttttttattaaa

SEQ ID NO: 420641 - DNA, 20 bp, Artificial
  CRISPR gRNA sequence
tatttatttttttattaaat

SEQ ID NO: 420642 - DNA, 20 bp, Artificial
  CRISPR gRNA sequence
tttatttttttattaaattg

SEQ ID NO: 420643 - DNA, 20 bp, Artificial
  CRISPR gRNA sequence
atttttttattaaattgtat

SEQ ID NO: 420644 - DNA, 20 bp, Artificial
  CRISPR gRNA sequence
tttttttattaaattgtata

SEQ ID NO: 420645 - DNA, 20 bp, Artificial
  CRISPR gRNA sequence
ttttattaaattgtatacag

SEQ ID NO: 420646 - DNA, 20 bp, Artificial
  CRISPR gRNA sequence
tttattaaattgtatacaga

SEQ ID NO: 420647 - DNA, 20 bp, Artificial
  CRISPR gRNA sequence
ttattaaattgtatacagat

SEQ ID NO: 420648 - DNA, 20 bp, Artificial
  CRISPR gRNA sequence
tattaaattgtatacagatg

SEQ ID NO: 420649 - DNA, 20 bp, Artificial
  CRISPR gRNA sequence
attaaattgtatacagatgc

SEQ ID NO: 420650 - DNA, 20 bp, Artificial
  CRISPR gRNA sequence
ttaaattgtatacagatgcg

SEQ ID NO: 420651 - DNA, 20 bp, Artificial
  CRISPR gRNA sequence
aattgtatacagatgcgttt

SEQ ID NO: 420652 - DNA, 20 bp, Artificial
  CRISPR gRNA sequence
tatacagatgcgttttcacc

SEQ ID NO: 420653 - DNA, 20 bp, Artificial
  CRISPR gRNA sequence
tcaccatgttgcccaggcta

SEQ ID NO: 420654 - DNA, 20 bp, Artificial
  CRISPR gRNA sequence
caccatgttgcccaggctag

SEQ ID NO: 420655 - DNA, 20 bp, Artificial
  CRISPR gRNA sequence
accatgttgcccaggctagt

SEQ ID NO: 420656 - DNA, 20 bp, Artificial
  CRISPR gRNA sequence
cccaggctagtctggaattc

SEQ ID NO: 420657 - DNA, 20 bp, Artificial
  CRISPR gRNA sequence
gtctggaattcctggactca

SEQ ID NO: 420658 - DNA, 20 bp, Artificial
  CRISPR gRNA sequence
gaattcctggactcaagtgc

SEQ ID NO: 420659 - DNA, 20 bp, Artificial
  CRISPR gRNA sequence
ctggactcaagtgctcctct

SEQ ID NO: 420660 - DNA, 20 bp, Artificial
  CRISPR gRNA sequence
gactcaagtgctcctctcgt

SEQ ID NO: 420661 - DNA, 20 bp, Artificial
  CRISPR gRNA sequence
aagtgctcctctcgtctcag

SEQ ID NO: 420662 - DNA, 20 bp, Artificial
  CRISPR gRNA sequence
ctctcgtctcagcctttcaa

SEQ ID NO: 420663 - DNA, 20 bp, Artificial
  CRISPR gRNA sequence
tcgtctcagcctttcaaagt

SEQ ID NO: 420664 - DNA, 20 bp, Artificial
  CRISPR gRNA sequence
gtctcagcctttcaaagtgc

SEQ ID NO: 420665 - DNA, 20 bp, Artificial
  CRISPR gRNA sequence
agcctttcaaagtgctggga

SEQ ID NO: 420666 - DNA, 20 bp, Artificial
  CRISPR gRNA sequence
tcaaagtgctgggattacag

SEQ ID NO: 420667 - DNA, 20 bp, Artificial
  CRISPR gRNA sequence
caaagtgctgggattacagg

SEQ ID NO: 420668 - DNA, 20 bp, Artificial
  CRISPR gRNA sequence
aaagtgctgggattacaggt

SEQ ID NO: 420669 - DNA, 20 bp, Artificial
  CRISPR gRNA sequence
ggattacaggtgtgagccat

SEQ ID NO: 420670 - DNA, 20 bp, Artificial
  CRISPR gRNA sequence
caggtgtgagccatcatgcc

SEQ ID NO: 420671 - DNA, 20 bp, Artificial
  CRISPR gRNA sequence
ccggccacatttatcttatt

SEQ ID NO: 420672 - DNA, 20 bp, Artificial
  CRISPR gRNA sequence
atcttattcagacaatgctc

SEQ ID NO: 420673 - DNA, 20 bp, Artificial
  CRISPR gRNA sequence
tcttattcagacaatgctct

SEQ ID NO: 420674 - DNA, 20 bp, Artificial
  CRISPR gRNA sequence
attcagacaatgctctagtc

SEQ ID NO: 420675 - DNA, 20 bp, Artificial
  CRISPR gRNA sequence
ttcagacaatgctctagtca

SEQ ID NO: 420676 - DNA, 20 bp, Artificial
  CRISPR gRNA sequence
agacaatgctctagtcagct

SEQ ID NO: 420677 - DNA, 20 bp, Artificial
  CRISPR gRNA sequence
tagtcagctccctcccctgc

SEQ ID NO: 420678 - DNA, 20 bp, Artificial
  CRISPR gRNA sequence
gtcagctccctcccctgctc

SEQ ID NO: 420679 - DNA, 20 bp, Artificial
  CRISPR gRNA sequence
cctcccctgctcaaaacatt

SEQ ID NO: 420680 - DNA, 20 bp, Artificial
  CRISPR gRNA sequence
ccctgctcaaaacatttcca

SEQ ID NO: 420681 - DNA, 20 bp, Artificial
  CRISPR gRNA sequence
ctcaaaacatttccaggctc

SEQ ID NO: 420682 - DNA, 20 bp, Artificial
  CRISPR gRNA sequence
aaaacatttccaggctccct

SEQ ID NO: 420683 - DNA, 20 bp, Artificial
  CRISPR gRNA sequence
ccaggctccctactgccttc

SEQ ID NO: 420684 - DNA, 20 bp, Artificial
  CRISPR gRNA sequence
caggctccctactgccttca

SEQ ID NO: 420685 - DNA, 20 bp, Artificial
  CRISPR gRNA sequence
cctactgccttcacactcaa

SEQ ID NO: 420686 - DNA, 20 bp, Artificial
  CRISPR gRNA sequence
ctgccttcacactcaaactg

SEQ ID NO: 420687 - DNA, 20 bp, Artificial
  CRISPR gRNA sequence
ccttcacactcaaactggcc

SEQ ID NO: 420688 - DNA, 20 bp, Artificial
  CRISPR gRNA sequence
cacactcaaactggccctgg

SEQ ID NO: 420689 - DNA, 20 bp, Artificial
  CRISPR gRNA sequence
acactcaaactggccctggc

SEQ ID NO: 420690 - DNA, 20 bp, Artificial
  CRISPR gRNA sequence
aaactggccctggcagacca

SEQ ID NO: 420691 - DNA, 20 bp, Artificial
  CRISPR gRNA sequence
gccctggcagaccacagaat

SEQ ID NO: 420692 - DNA, 20 bp, Artificial
  CRISPR gRNA sequence
gcagaccacagaataaatac

SEQ ID NO: 420693 - DNA, 20 bp, Artificial
  CRISPR gRNA sequence
ttacagattcttttacatta

SEQ ID NO: 420694 - DNA, 20 bp, Artificial
  CRISPR gRNA sequence
cagattcttttacattactt

SEQ ID NO: 420695 - DNA, 20 bp, Artificial
  CRISPR gRNA sequence
ttttacattactttctactc

SEQ ID NO: 420696 - DNA, 20 bp, Artificial
  CRISPR gRNA sequence
ttacattactttctactcaa

SEQ ID NO: 420697 - DNA, 20 bp, Artificial
  CRISPR gRNA sequence
tacattactttctactcaaa

SEQ ID NO: 420698 - DNA, 20 bp, Artificial
  CRISPR gRNA sequence
acattactttctactcaaat

SEQ ID NO: 420699 - DNA, 20 bp, Artificial
  CRISPR gRNA sequence
cattactttctactcaaatg

SEQ ID NO: 420700 - DNA, 20 bp, Artificial
  CRISPR gRNA sequence
ctttctactcaaatgctcag

SEQ ID NO: 420701 - DNA, 20 bp, Artificial
  CRISPR gRNA sequence
tctactcaaatgctcagaac

SEQ ID NO: 420702 - DNA, 20 bp, Artificial
  CRISPR gRNA sequence
ctactcaaatgctcagaacc

SEQ ID NO: 420703 - DNA, 20 bp, Artificial
  CRISPR gRNA sequence
tactcaaatgctcagaaccc

SEQ ID NO: 420704 - DNA, 20 bp, Artificial
  CRISPR gRNA sequence
ctcaaatgctcagaaccctc

SEQ ID NO: 420705 - DNA, 20 bp, Artificial
  CRISPR gRNA sequence
aaatgctcagaaccctcaaa

SEQ ID NO: 420706 - DNA, 20 bp, Artificial
  CRISPR gRNA sequence
agaaccctcaaaatcagtca

SEQ ID NO: 420707 - DNA, 20 bp, Artificial
  CRISPR gRNA sequence
aaaatcagtcagatgagctg

SEQ ID NO: 420708 - DNA, 20 bp, Artificial
  CRISPR gRNA sequence
acccccatctacttcacaat

SEQ ID NO: 420709 - DNA, 20 bp, Artificial
  CRISPR gRNA sequence
cttcacaattttggaacttc

SEQ ID NO: 420710 - DNA, 20 bp, Artificial
  CRISPR gRNA sequence
cacaattttggaacttccat

SEQ ID NO: 420711 - DNA, 20 bp, Artificial
  CRISPR gRNA sequence
acaattttggaacttccatg

SEQ ID NO: 420712 - DNA, 20 bp, Artificial
  CRISPR gRNA sequence
tggaacttccatgatgcggc

SEQ ID NO: 420713 - DNA, 20 bp, Artificial
  CRISPR gRNA sequence
ggaacttccatgatgcggct

SEQ ID NO: 420714 - DNA, 20 bp, Artificial
  CRISPR gRNA sequence
gaacttccatgatgcggctc

SEQ ID NO: 420715 - DNA, 20 bp, Artificial
  CRISPR gRNA sequence
ccatgatgcggctcacatca

SEQ ID NO: 420716 - DNA, 20 bp, Artificial
  CRISPR gRNA sequence
catgatgcggctcacatcag

SEQ ID NO: 420717 - DNA, 20 bp, Artificial
  CRISPR gRNA sequence
acatcagtgtcccctgcctt

SEQ ID NO: 420718 - DNA, 20 bp, Artificial
  CRISPR gRNA sequence
ccttgtggtgccccctgaat

SEQ ID NO: 420719 - DNA, 20 bp, Artificial
  CRISPR gRNA sequence
gtggtgccccctgaatgaac

SEQ ID NO: 420720 - DNA, 20 bp, Artificial
  CRISPR gRNA sequence
tggtgccccctgaatgaaca

SEQ ID NO: 420721 - DNA, 20 bp, Artificial
  CRISPR gRNA sequence
aatgaacatcatcccccttt

SEQ ID NO: 420722 - DNA, 20 bp, Artificial
  CRISPR gRNA sequence
tctgaaggtatagagaacag

SEQ ID NO: 420723 - DNA, 20 bp, Artificial
  CRISPR gRNA sequence
ctgaaggtatagagaacagg

SEQ ID NO: 420724 - DNA, 20 bp, Artificial
  CRISPR gRNA sequence
tgaaggtatagagaacaggg

SEQ ID NO: 420725 - DNA, 20 bp, Artificial
  CRISPR gRNA sequence
aaggtatagagaacagggaa

SEQ ID NO: 420726 - DNA, 20 bp, Artificial
  CRISPR gRNA sequence
acccattcatctagagacag

SEQ ID NO: 420727 - DNA, 20 bp, Artificial
  CRISPR gRNA sequence
atctagagacagagcattct

SEQ ID NO: 420728 - DNA, 20 bp, Artificial
  CRISPR gRNA sequence
gagacagagcattctccaag

SEQ ID NO: 420729 - DNA, 20 bp, Artificial
  CRISPR gRNA sequence
tccaagttgtaaagtgagag

SEQ ID NO: 420730 - DNA, 20 bp, Artificial
  CRISPR gRNA sequence
caagttgtaaagtgagagat

SEQ ID NO: 420731 - DNA, 20 bp, Artificial
  CRISPR gRNA sequence
taaagtgagagatgggtggg

SEQ ID NO: 420732 - DNA, 20 bp, Artificial
  CRISPR gRNA sequence
agtagtgtcctggagagtga

SEQ ID NO: 420733 - DNA, 20 bp, Artificial
  CRISPR gRNA sequence
gagagtgatttggtgatgca

SEQ ID NO: 420734 - DNA, 20 bp, Artificial
  CRISPR gRNA sequence
ggtgatgcagacacctgagt

SEQ ID NO: 420735 - DNA, 20 bp, Artificial
  CRISPR gRNA sequence
gtgatgcagacacctgagtt

SEQ ID NO: 420736 - DNA, 20 bp, Artificial
  CRISPR gRNA sequence
agtttagacccagagtctgg

SEQ ID NO: 420737 - DNA, 20 bp, Artificial
  CRISPR gRNA sequence
agacccagagtctggcactt

SEQ ID NO: 420738 - DNA, 20 bp, Artificial
  CRISPR gRNA sequence
gacccagagtctggcacttc

SEQ ID NO: 420739 - DNA, 20 bp, Artificial
  CRISPR gRNA sequence
gcacttcccagctgttttga

SEQ ID NO: 420740 - DNA, 20 bp, Artificial
  CRISPR gRNA sequence
cccagctgttttgagaaagt

SEQ ID NO: 420741 - DNA, 20 bp, Artificial
  CRISPR gRNA sequence
ccagctgttttgagaaagtc

SEQ ID NO: 420742 - DNA, 20 bp, Artificial
  CRISPR gRNA sequence
ttttgagaaagtcttcgggg

SEQ ID NO: 420743 - DNA, 20 bp, Artificial
  CRISPR gRNA sequence
tgagaaagtcttcggggtaa

SEQ ID NO: 420744 - DNA, 20 bp, Artificial
  CRISPR gRNA sequence
gagaaagtcttcggggtaac

SEQ ID NO: 420745 - DNA, 20 bp, Artificial
  CRISPR gRNA sequence
agaaagtcttcggggtaaca

SEQ ID NO: 420746 - DNA, 20 bp, Artificial
  CRISPR gRNA sequence
cggggtaacagtatctctct

SEQ ID NO: 420747 - DNA, 20 bp, Artificial
  CRISPR gRNA sequence
ggggtaacagtatctctctc

SEQ ID NO: 420748 - DNA, 20 bp, Artificial
  CRISPR gRNA sequence
tctcattgagccgtctacat

SEQ ID NO: 420749 - DNA, 20 bp, Artificial
  CRISPR gRNA sequence
tcattgagccgtctacataa

SEQ ID NO: 420750 - DNA, 20 bp, Artificial
  CRISPR gRNA sequence
attgagccgtctacataaaa

SEQ ID NO: 420751 - DNA, 20 bp, Artificial
  CRISPR gRNA sequence
agccgtctacataaaacagt

SEQ ID NO: 420752 - DNA, 20 bp, Artificial
  CRISPR gRNA sequence
cataaaacagttgaccttca

SEQ ID NO: 420753 - DNA, 20 bp, Artificial
  CRISPR gRNA sequence
accttcaagagggcattgga

SEQ ID NO: 420754 - DNA, 20 bp, Artificial
  CRISPR gRNA sequence
caagagggcattggacagaa

SEQ ID NO: 420755 - DNA, 20 bp, Artificial
  CRISPR gRNA sequence
aagagggcattggacagaaa

SEQ ID NO: 420756 - DNA, 20 bp, Artificial
  CRISPR gRNA sequence
gacagaaagaactggtggac

SEQ ID NO: 420757 - DNA, 20 bp, Artificial
  CRISPR gRNA sequence
gtggactttgatgactgatg

SEQ ID NO: 420758 - DNA, 20 bp, Artificial
  CRISPR gRNA sequence
tgatgactgatgggatgtag

SEQ ID NO: 420759 - DNA, 20 bp, Artificial
  CRISPR gRNA sequence
gatgactgatgggatgtaga

SEQ ID NO: 420760 - DNA, 20 bp, Artificial
  CRISPR gRNA sequence
atgactgatgggatgtagag

SEQ ID NO: 420761 - DNA, 20 bp, Artificial
  CRISPR gRNA sequence
atgggatgtagagaggagga

SEQ ID NO: 420762 - DNA, 20 bp, Artificial
  CRISPR gRNA sequence
cgaggtggatggataccagt

SEQ ID NO: 420763 - DNA, 20 bp, Artificial
  CRISPR gRNA sequence
gaggtggatggataccagtg

SEQ ID NO: 420764 - DNA, 20 bp, Artificial
  CRISPR gRNA sequence
ctgacaggctgagtcagcaa

SEQ ID NO: 420765 - DNA, 20 bp, Artificial
  CRISPR gRNA sequence
acaggctgagtcagcaaggg

SEQ ID NO: 420766 - DNA, 20 bp, Artificial
  CRISPR gRNA sequence
agtcagcaaggggattggtg

SEQ ID NO: 420767 - DNA, 20 bp, Artificial
  CRISPR gRNA sequence
gtgggagaaaaagctggggt

SEQ ID NO: 420768 - DNA, 20 bp, Artificial
  CRISPR gRNA sequence
gggttcagggtaaggcggct

SEQ ID NO: 420769 - DNA, 20 bp, Artificial
  CRISPR gRNA sequence
agggtaaggcggctgagagg

SEQ ID NO: 420770 - DNA, 20 bp, Artificial
  CRISPR gRNA sequence
agaggtggtataacatctag

SEQ ID NO: 420771 - DNA, 20 bp, Artificial
  CRISPR gRNA sequence
gttagaggtatccagaaagc

SEQ ID NO: 420772 - DNA, 20 bp, Artificial
  CRISPR gRNA sequence
gaggtatccagaaagcaagt

SEQ ID NO: 420773 - DNA, 20 bp, Artificial
  CRISPR gRNA sequence
aggattggccttcaggagat

SEQ ID NO: 420774 - DNA, 20 bp, Artificial
  CRISPR gRNA sequence
gccttcaggagatgtattat

SEQ ID NO: 420775 - DNA, 20 bp, Artificial
  CRISPR gRNA sequence
caggagatgtattatccatt

SEQ ID NO: 420776 - DNA, 20 bp, Artificial
  CRISPR gRNA sequence
aggagatgtattatccatta

SEQ ID NO: 420777 - DNA, 20 bp, Artificial
  CRISPR gRNA sequence
tccattagcatgttcacgta

SEQ ID NO: 420778 - DNA, 20 bp, Artificial
  CRISPR gRNA sequence
gcatgttcacgtattcattc

SEQ ID NO: 420779 - DNA, 20 bp, Artificial
  CRISPR gRNA sequence
acgtattcattcaatctcta

SEQ ID NO: 420780 - DNA, 20 bp, Artificial
  CRISPR gRNA sequence
attcaatctctatacattat

SEQ ID NO: 420781 - DNA, 20 bp, Artificial
  CRISPR gRNA sequence
aatctctatacattattaag

SEQ ID NO: 420782 - DNA, 20 bp, Artificial
  CRISPR gRNA sequence
tatacattattaagcacctg

SEQ ID NO: 420783 - DNA, 20 bp, Artificial
  CRISPR gRNA sequence
tacattattaagcacctgcc

SEQ ID NO: 420784 - DNA, 20 bp, Artificial
  CRISPR gRNA sequence
ttaagcacctgccgtggggt

SEQ ID NO: 420785 - DNA, 20 bp, Artificial
  CRISPR gRNA sequence
agcacctgccgtggggtgct

SEQ ID NO: 420786 - DNA, 20 bp, Artificial
  CRISPR gRNA sequence
ccgtggggtgctactactga

SEQ ID NO: 420787 - DNA, 20 bp, Artificial
  CRISPR gRNA sequence
ctactgagtggccgcaggtg

SEQ ID NO: 420788 - DNA, 20 bp, Artificial
  CRISPR gRNA sequence
ctgagtggccgcaggtgcgt

SEQ ID NO: 420789 - DNA, 20 bp, Artificial
  CRISPR gRNA sequence
agtggccgcaggtgcgtgct

SEQ ID NO: 420790 - DNA, 20 bp, Artificial
  CRISPR gRNA sequence
cagacatggctaatctgtca

SEQ ID NO: 420791 - DNA, 20 bp, Artificial
  CRISPR gRNA sequence
atctgtcatggccgatagtt

SEQ ID NO: 420792 - DNA, 20 bp, Artificial
  CRISPR gRNA sequence
tcatggccgatagttatcaa

SEQ ID NO: 420793 - DNA, 20 bp, Artificial
  CRISPR gRNA sequence
tcaaccagtcaacacatact

SEQ ID NO: 420794 - DNA, 20 bp, Artificial
  CRISPR gRNA sequence
tctgagtattcttttttctg

SEQ ID NO: 420795 - DNA, 20 bp, Artificial
  CRISPR gRNA sequence
tgagtattcttttttctgtg

SEQ ID NO: 420796 - DNA, 20 bp, Artificial
  CRISPR gRNA sequence
agtattcttttttctgtgtt

SEQ ID NO: 420797 - DNA, 20 bp, Artificial
  CRISPR gRNA sequence
ttttttctgtgtttgtttta

SEQ ID NO: 420798 - DNA, 20 bp, Artificial
  CRISPR gRNA sequence
ttttctgtgtttgttttata

SEQ ID NO: 420799 - DNA, 20 bp, Artificial
  CRISPR gRNA sequence
tttctgtgtttgttttatac

SEQ ID NO: 420800 - DNA, 20 bp, Artificial
  CRISPR gRNA sequence
ttctgtgtttgttttatact

SEQ ID NO: 420801 - DNA, 20 bp, Artificial
  CRISPR gRNA sequence
tctgtgtttgttttatactg

SEQ ID NO: 420802 - DNA, 20 bp, Artificial
  CRISPR gRNA sequence
ctgtgtttgttttatactgt

SEQ ID NO: 420803 - DNA, 20 bp, Artificial
  CRISPR gRNA sequence
tgtgtttgttttatactgtc

SEQ ID NO: 420804 - DNA, 20 bp, Artificial
  CRISPR gRNA sequence
tgtttgttttatactgtctt

SEQ ID NO: 420805 - DNA, 20 bp, Artificial
  CRISPR gRNA sequence
gttttatactgtcttggaaa

SEQ ID NO: 420806 - DNA, 20 bp, Artificial
  CRISPR gRNA sequence
ttttatactgtcttggaaaa

SEQ ID NO: 420807 - DNA, 20 bp, Artificial
  CRISPR gRNA sequence
tatactgtcttggaaaaccc

SEQ ID NO: 420808 - DNA, 20 bp, Artificial
  CRISPR gRNA sequence
atactgtcttggaaaaccct

SEQ ID NO: 420809 - DNA, 20 bp, Artificial
  CRISPR gRNA sequence
tactgtcttggaaaaccctt

SEQ ID NO: 420810 - DNA, 20 bp, Artificial
  CRISPR gRNA sequence
tcttggaaaacccttgctca

SEQ ID NO: 420811 - DNA, 20 bp, Artificial
  CRISPR gRNA sequence
ggaaaacccttgctcagtaa

SEQ ID NO: 420812 - DNA, 20 bp, Artificial
  CRISPR gRNA sequence
gaaaacccttgctcagtaaa

SEQ ID NO: 420813 - DNA, 20 bp, Artificial
  CRISPR gRNA sequence
gctcagtaaatatttgctga

SEQ ID NO: 420814 - DNA, 20 bp, Artificial
  CRISPR gRNA sequence
ctcagtaaatatttgctgac

SEQ ID NO: 420815 - DNA, 20 bp, Artificial
  CRISPR gRNA sequence
agtaaatatttgctgaccaa

SEQ ID NO: 420816 - DNA, 20 bp, Artificial
  CRISPR gRNA sequence
gctgaccaagggacggattt

SEQ ID NO: 420817 - DNA, 20 bp, Artificial
  CRISPR gRNA sequence
ctgaccaagggacggattta

SEQ ID NO: 420818 - DNA, 20 bp, Artificial
  CRISPR gRNA sequence
accaagggacggatttattc

SEQ ID NO: 420819 - DNA, 20 bp, Artificial
  CRISPR gRNA sequence
attcactcctcccaaatcca

SEQ ID NO: 420820 - DNA, 20 bp, Artificial
  CRISPR gRNA sequence
ttcactcctcccaaatccag

SEQ ID NO: 420821 - DNA, 20 bp, Artificial
  CRISPR gRNA sequence
actcctcccaaatccaggcc

SEQ ID NO: 420822 - DNA, 20 bp, Artificial
  CRISPR gRNA sequence
ctcccaaatccaggccactt

SEQ ID NO: 420823 - DNA, 20 bp, Artificial
  CRISPR gRNA sequence
ccaaatccaggccacttcct

SEQ ID NO: 420824 - DNA, 20 bp, Artificial
  CRISPR gRNA sequence
cctgcaactctaacccaagc

SEQ ID NO: 420825 - DNA, 20 bp, Artificial
  CRISPR gRNA sequence
ctgcaactctaacccaagcc

SEQ ID NO: 420826 - DNA, 20 bp, Artificial
  CRISPR gRNA sequence
caactctaacccaagccctg

SEQ ID NO: 420827 - DNA, 20 bp, Artificial
  CRISPR gRNA sequence
taacccaagccctggctgca

SEQ ID NO: 420828 - DNA, 20 bp, Artificial
  CRISPR gRNA sequence
acccaagccctggctgcaaa

SEQ ID NO: 420829 - DNA, 20 bp, Artificial
  CRISPR gRNA sequence
gctgcaaagtagacaaggat

SEQ ID NO: 420830 - DNA, 20 bp, Artificial
  CRISPR gRNA sequence
caaagtagacaaggattcta

SEQ ID NO: 420831 - DNA, 20 bp, Artificial
  CRISPR gRNA sequence
tagaaatatattctacctct

SEQ ID NO: 420832 - DNA, 20 bp, Artificial
  CRISPR gRNA sequence
gaaatatattctacctcttt

SEQ ID NO: 420833 - DNA, 20 bp, Artificial
  CRISPR gRNA sequence
tacctctttcgaaccattca

SEQ ID NO: 420834 - DNA, 20 bp, Artificial
  CRISPR gRNA sequence
cctctttcgaaccattcaga

SEQ ID NO: 420835 - DNA, 20 bp, Artificial
  CRISPR gRNA sequence
tttcgaaccattcagaattt

SEQ ID NO: 420836 - DNA, 20 bp, Artificial
  CRISPR gRNA sequence
tcgaaccattcagaattttt

SEQ ID NO: 420837 - DNA, 20 bp, Artificial
  CRISPR gRNA sequence
cgaaccattcagaatttttg

SEQ ID NO: 420838 - DNA, 20 bp, Artificial
  CRISPR gRNA sequence
gaaccattcagaatttttgt

SEQ ID NO: 420839 - DNA, 20 bp, Artificial
  CRISPR gRNA sequence
agaatttttgtcacctttcc

SEQ ID NO: 420840 - DNA, 20 bp, Artificial
  CRISPR gRNA sequence
ttgtcacctttccttctaac

SEQ ID NO: 420841 - DNA, 20 bp, Artificial
  CRISPR gRNA sequence
tgtcacctttccttctaact

SEQ ID NO: 420842 - DNA, 20 bp, Artificial
  CRISPR gRNA sequence
gtcacctttccttctaactt

SEQ ID NO: 420843 - DNA, 20 bp, Artificial
  CRISPR gRNA sequence
tcacctttccttctaacttc

SEQ ID NO: 420844 - DNA, 20 bp, Artificial
  CRISPR gRNA sequence
tccttctaacttcccagacc

SEQ ID NO: 420845 - DNA, 20 bp, Artificial
  CRISPR gRNA sequence
ccttctaacttcccagaccc

SEQ ID NO: 420846 - DNA, 20 bp, Artificial
  CRISPR gRNA sequence
cttctaacttcccagaccct

SEQ ID NO: 420847 - DNA, 20 bp, Artificial
  CRISPR gRNA sequence
ctaacttcccagaccctccc

SEQ ID NO: 420848 - DNA, 20 bp, Artificial
  CRISPR gRNA sequence
taacttcccagaccctcccg

SEQ ID NO: 420849 - DNA, 20 bp, Artificial
  CRISPR gRNA sequence
acttcccagaccctcccgcc

SEQ ID NO: 420850 - DNA, 20 bp, Artificial
  CRISPR gRNA sequence
cccagaccctcccgccaatt

SEQ ID NO: 420851 - DNA, 20 bp, Artificial
  CRISPR gRNA sequence
ccagaccctcccgccaattg

SEQ ID NO: 420852 - DNA, 20 bp, Artificial
  CRISPR gRNA sequence
ccgccaattgagagcagggg

SEQ ID NO: 420853 - DNA, 20 bp, Artificial
  CRISPR gRNA sequence
agagcaggggagtcccatag

SEQ ID NO: 420854 - DNA, 20 bp, Artificial
  CRISPR gRNA sequence
ttatcttgtgactcaagagg

SEQ ID NO: 420855 - DNA, 20 bp, Artificial
  CRISPR gRNA sequence
tatcttgtgactcaagagga

SEQ ID NO: 420856 - DNA, 20 bp, Artificial
  CRISPR gRNA sequence
atcttgtgactcaagaggag

SEQ ID NO: 420857 - DNA, 20 bp, Artificial
  CRISPR gRNA sequence
tcttgtgactcaagaggaga

SEQ ID NO: 420858 - DNA, 20 bp, Artificial
  CRISPR gRNA sequence
gtgactcaagaggagatttt

SEQ ID NO: 420859 - DNA, 20 bp, Artificial
  CRISPR gRNA sequence
tgactcaagaggagattttc

SEQ ID NO: 420860 - DNA, 20 bp, Artificial
  CRISPR gRNA sequence
aagaggagattttcagtttc

SEQ ID NO: 420861 - DNA, 20 bp, Artificial
  CRISPR gRNA sequence
tcagtttcgtttctttatta

SEQ ID NO: 420862 - DNA, 20 bp, Artificial
  CRISPR gRNA sequence
cagtttcgtttctttattat

SEQ ID NO: 420863 - DNA, 20 bp, Artificial
  CRISPR gRNA sequence
agtttcgtttctttattatg

SEQ ID NO: 420864 - DNA, 20 bp, Artificial
  CRISPR gRNA sequence
cgtttctttattatgggggt

SEQ ID NO: 420865 - DNA, 20 bp, Artificial
  CRISPR gRNA sequence
gtttctttattatgggggtg

SEQ ID NO: 420866 - DNA, 20 bp, Artificial
  CRISPR gRNA sequence
ctttattatgggggtgagaa

SEQ ID NO: 420867 - DNA, 20 bp, Artificial
  CRISPR gRNA sequence
tttattatgggggtgagaaa

SEQ ID NO: 420868 - DNA, 20 bp, Artificial
  CRISPR gRNA sequence
tattatgggggtgagaaaag

SEQ ID NO: 420869 - DNA, 20 bp, Artificial
  CRISPR gRNA sequence
attatgggggtgagaaaagt

SEQ ID NO: 420870 - DNA, 20 bp, Artificial
  CRISPR gRNA sequence
ttatgggggtgagaaaagtg

SEQ ID NO: 420871 - DNA, 20 bp, Artificial
  CRISPR gRNA sequence
tgggggtgagaaaagtgggg

SEQ ID NO: 420872 - DNA, 20 bp, Artificial
  CRISPR gRNA sequence
tggaacttgtgcccagtggc

SEQ ID NO: 420873 - DNA, 20 bp, Artificial
  CRISPR gRNA sequence
gaacttgtgcccagtggcct

SEQ ID NO: 420874 - DNA, 20 bp, Artificial
  CRISPR gRNA sequence
gtgcccagtggcctggcatc

SEQ ID NO: 420875 - DNA, 20 bp, Artificial
  CRISPR gRNA sequence
tgcccagtggcctggcatca

SEQ ID NO: 420876 - DNA, 20 bp, Artificial
  CRISPR gRNA sequence
gcatcacagggtgggtttgc

SEQ ID NO: 420877 - DNA, 20 bp, Artificial
  CRISPR gRNA sequence
gcctagtctttgccctgcca

SEQ ID NO: 420878 - DNA, 20 bp, Artificial
  CRISPR gRNA sequence
cctagtctttgccctgccag

SEQ ID NO: 420879 - DNA, 20 bp, Artificial
  CRISPR gRNA sequence
gtctttgccctgccagccct

SEQ ID NO: 420880 - DNA, 20 bp, Artificial
  CRISPR gRNA sequence
tgccctgccagcccttcctc

SEQ ID NO: 420881 - DNA, 20 bp, Artificial
  CRISPR gRNA sequence
gccctgccagcccttcctcc

SEQ ID NO: 420882 - DNA, 20 bp, Artificial
  CRISPR gRNA sequence
ccctgccagcccttcctccc

SEQ ID NO: 420883 - DNA, 20 bp, Artificial
  CRISPR gRNA sequence
ccagcccttcctccctgtcc

SEQ ID NO: 420884 - DNA, 20 bp, Artificial
  CRISPR gRNA sequence
cctccctgtcctttctaccc

SEQ ID NO: 420885 - DNA, 20 bp, Artificial
  CRISPR gRNA sequence
ctccctgtcctttctaccct

SEQ ID NO: 420886 - DNA, 20 bp, Artificial
  CRISPR gRNA sequence
cctgtcctttctaccctggg

SEQ ID NO: 420887 - DNA, 20 bp, Artificial
  CRISPR gRNA sequence
tcctttctaccctgggaggg

SEQ ID NO: 420888 - DNA, 20 bp, Artificial
  CRISPR gRNA sequence
tctaccctgggagggcagct

SEQ ID NO: 420889 - DNA, 20 bp, Artificial
  CRISPR gRNA sequence
ctaccctgggagggcagcta

SEQ ID NO: 420890 - DNA, 20 bp, Artificial
  CRISPR gRNA sequence
taccctgggagggcagctac

SEQ ID NO: 420891 - DNA, 20 bp, Artificial
  CRISPR gRNA sequence
ccctgggagggcagctactc

SEQ ID NO: 420892 - DNA, 20 bp, Artificial
  CRISPR gRNA sequence
ggagggcagctactcctttc

SEQ ID NO: 420893 - DNA, 20 bp, Artificial
  CRISPR gRNA sequence
ctcctttcccacctgaggct

SEQ ID NO: 420894 - DNA, 20 bp, Artificial
  CRISPR gRNA sequence
ctttcccacctgaggctgac

SEQ ID NO: 420895 - DNA, 20 bp, Artificial
  CRISPR gRNA sequence
tcccacctgaggctgacctg

SEQ ID NO: 420896 - DNA, 20 bp, Artificial
  CRISPR gRNA sequence
cccacctgaggctgacctgt

SEQ ID NO: 420897 - DNA, 20 bp, Artificial
  CRISPR gRNA sequence
ccacctgaggctgacctgtg

SEQ ID NO: 420898 - DNA, 20 bp, Artificial
  CRISPR gRNA sequence
aggctgacctgtgatgattg

SEQ ID NO: 420899 - DNA, 20 bp, Artificial
  CRISPR gRNA sequence
acctgtgatgattgccaatg

SEQ ID NO: 420900 - DNA, 20 bp, Artificial
  CRISPR gRNA sequence
tgatgattgccaatgtgaca

SEQ ID NO: 420901 - DNA, 20 bp, Artificial
  CRISPR gRNA sequence
ccaatgtgacagtggcattg

SEQ ID NO: 420902 - DNA, 20 bp, Artificial
  CRISPR gRNA sequence
agctgctgttcctgcagatg

SEQ ID NO: 420903 - DNA, 20 bp, Artificial
  CRISPR gRNA sequence
ctgttcctgcagatggatat

SEQ ID NO: 420904 - DNA, 20 bp, Artificial
  CRISPR gRNA sequence
ttcctgcagatggatatggc

SEQ ID NO: 420905 - DNA, 20 bp, Artificial
  CRISPR gRNA sequence
ctgcagatggatatggcagg

SEQ ID NO: 420906 - DNA, 20 bp, Artificial
  CRISPR gRNA sequence
cagatggatatggcaggtgt

SEQ ID NO: 420907 - DNA, 20 bp, Artificial
  CRISPR gRNA sequence
ggcctggctcacatcctcta

SEQ ID NO: 420908 - DNA, 20 bp, Artificial
  CRISPR gRNA sequence
gctcacatcctctagtcgaa

SEQ ID NO: 420909 - DNA, 20 bp, Artificial
  CRISPR gRNA sequence
acatcctctagtcgaagggt

SEQ ID NO: 420910 - DNA, 20 bp, Artificial
  CRISPR gRNA sequence
tagtcgaagggtaaagtcgc

SEQ ID NO: 420911 - DNA, 20 bp, Artificial
  CRISPR gRNA sequence
gtcgaagggtaaagtcgcca

SEQ ID NO: 420912 - DNA, 20 bp, Artificial
  CRISPR gRNA sequence
tctccagtcaccaggaggtc

SEQ ID NO: 420913 - DNA, 20 bp, Artificial
  CRISPR gRNA sequence
cagtcaccaggaggtcaggg

SEQ ID NO: 420914 - DNA, 20 bp, Artificial
  CRISPR gRNA sequence
ccccaggaggagtccacttg

SEQ ID NO: 420915 - DNA, 20 bp, Artificial
  CRISPR gRNA sequence
ggcagtgaggaaagaccggg

SEQ ID NO: 420916 - DNA, 20 bp, Artificial
  CRISPR gRNA sequence
gcagtgaggaaagaccgggt

SEQ ID NO: 420917 - DNA, 20 bp, Artificial
  CRISPR gRNA sequence
gaacctgctccagcgtacac

SEQ ID NO: 420918 - DNA, 20 bp, Artificial
  CRISPR gRNA sequence
ctccagcgtacactgtcaag

SEQ ID NO: 420919 - DNA, 20 bp, Artificial
  CRISPR gRNA sequence
cagcgtacactgtcaaggga

SEQ ID NO: 420920 - DNA, 20 bp, Artificial
  CRISPR gRNA sequence
tcaagggagttgggggctcc

SEQ ID NO: 420921 - DNA, 20 bp, Artificial
  CRISPR gRNA sequence
ggggctccagacctgaagag

SEQ ID NO: 420922 - DNA, 20 bp, Artificial
  CRISPR gRNA sequence
cagacctgaagagaaaagaa

SEQ ID NO: 420923 - DNA, 20 bp, Artificial
  CRISPR gRNA sequence
aagagaaaagaaaacccaaa

SEQ ID NO: 420924 - DNA, 20 bp, Artificial
  CRISPR gRNA sequence
aagctgggtgctgcagtggg

SEQ ID NO: 420925 - DNA, 20 bp, Artificial
  CRISPR gRNA sequence
ggtgctgcagtggggaggga

SEQ ID NO: 420926 - DNA, 20 bp, Artificial
  CRISPR gRNA sequence
cagtggggagggagtgctgg

SEQ ID NO: 420927 - DNA, 20 bp, Artificial
  CRISPR gRNA sequence
gggctgcaaggaagggaggc

SEQ ID NO: 420928 - DNA, 20 bp, Artificial
  CRISPR gRNA sequence
caaggaagggaggcagaaga

SEQ ID NO: 420929 - DNA, 20 bp, Artificial
  CRISPR gRNA sequence
aggagatggtctggctcata

SEQ ID NO: 420930 - DNA, 20 bp, Artificial
  CRISPR gRNA sequence
gctcataagagtgctaagga

SEQ ID NO: 420931 - DNA, 20 bp, Artificial
  CRISPR gRNA sequence
ataagagtgctaaggagcag

SEQ ID NO: 420932 - DNA, 20 bp, Artificial
  CRISPR gRNA sequence
aggagcagaataaggtgatg

SEQ ID NO: 420933 - DNA, 20 bp, Artificial
  CRISPR gRNA sequence
aggaggctcagaaacccagc

SEQ ID NO: 420934 - DNA, 20 bp, Artificial
  CRISPR gRNA sequence
agaaacccagcaagtgggct

SEQ ID NO: 420935 - DNA, 20 bp, Artificial
  CRISPR gRNA sequence
agccggaaggagagggaagg

SEQ ID NO: 420936 - DNA, 20 bp, Artificial
  CRISPR gRNA sequence
gccggaaggagagggaaggc

SEQ ID NO: 420937 - DNA, 20 bp, Artificial
  CRISPR gRNA sequence
gaaggccacgggagaagcaa

SEQ ID NO: 420938 - DNA, 20 bp, Artificial
  CRISPR gRNA sequence
tgaggctgccagcaatataa

SEQ ID NO: 420939 - DNA, 20 bp, Artificial
  CRISPR gRNA sequence
ccagcaatataaaggggtcg

SEQ ID NO: 420940 - DNA, 20 bp, Artificial
  CRISPR gRNA sequence
gctgccgagaacctggtttg

SEQ ID NO: 420941 - DNA, 20 bp, Artificial
  CRISPR gRNA sequence
ccgagaacctggtttgggga

SEQ ID NO: 420942 - DNA, 20 bp, Artificial
  CRISPR gRNA sequence
gtttggggacccatagttag

SEQ ID NO: 420943 - DNA, 20 bp, Artificial
  CRISPR gRNA sequence
ggggacccatagttagggga

SEQ ID NO: 420944 - DNA, 20 bp, Artificial
  CRISPR gRNA sequence
gggacccatagttaggggag

SEQ ID NO: 420945 - DNA, 20 bp, Artificial
  CRISPR gRNA sequence
ggggaggtgacaaggggggc

SEQ ID NO: 420946 - DNA, 20 bp, Artificial
  CRISPR gRNA sequence
tggtcaaatgtgaagcagag

SEQ ID NO: 420947 - DNA, 20 bp, Artificial
  CRISPR gRNA sequence
cccagaacagtgaggttata

SEQ ID NO: 420948 - DNA, 20 bp, Artificial
  CRISPR gRNA sequence
tacatgatggagacgttgaa

SEQ ID NO: 420949 - DNA, 20 bp, Artificial
  CRISPR gRNA sequence
aagccatctctgtaggtgag

SEQ ID NO: 420950 - DNA, 20 bp, Artificial
  CRISPR gRNA sequence
tgtaggtgaggatgcagccc

SEQ ID NO: 420951 - DNA, 20 bp, Artificial
  CRISPR gRNA sequence
taggtgaggatgcagcccca

SEQ ID NO: 420952 - DNA, 20 bp, Artificial
  CRISPR gRNA sequence
acttggggcaggaagaggaa

SEQ ID NO: 420953 - DNA, 20 bp, Artificial
  CRISPR gRNA sequence
ggggcaggaagaggaagctt

SEQ ID NO: 420954 - DNA, 20 bp, Artificial
  CRISPR gRNA sequence
gggcaggaagaggaagcttt

SEQ ID NO: 420955 - DNA, 20 bp, Artificial
  CRISPR gRNA sequence
tccgctaagtggtgatgggg

SEQ ID NO: 420956 - DNA, 20 bp, Artificial
  CRISPR gRNA sequence
ccgctaagtggtgatggggg

SEQ ID NO: 420957 - DNA, 20 bp, Artificial
  CRISPR gRNA sequence
cgctaagtggtgatgggggg

SEQ ID NO: 420958 - DNA, 20 bp, Artificial
  CRISPR gRNA sequence
agtggtgatggggggactcc

SEQ ID NO: 420959 - DNA, 20 bp, Artificial
  CRISPR gRNA sequence
ccggacagggactcggccct

SEQ ID NO: 420960 - DNA, 20 bp, Artificial
  CRISPR gRNA sequence
ggccctggccccggttccgg

SEQ ID NO: 420961 - DNA, 20 bp, Artificial
  CRISPR gRNA sequence
gccccggttccggaaccaat

SEQ ID NO: 420962 - DNA, 20 bp, Artificial
  CRISPR gRNA sequence
cggaaccaatgcacagaggc

SEQ ID NO: 420963 - DNA, 20 bp, Artificial
  CRISPR gRNA sequence
ggcggtcagggcggctgaag

SEQ ID NO: 420964 - DNA, 20 bp, Artificial
  CRISPR gRNA sequence
aaggagcagttcaaaatgac

SEQ ID NO: 420965 - DNA, 20 bp, Artificial
  CRISPR gRNA sequence
aaaatgacccagtcggaggc

SEQ ID NO: 420966 - DNA, 20 bp, Artificial
  CRISPR gRNA sequence
tgagagatcctggggggctg

SEQ ID NO: 420967 - DNA, 20 bp, Artificial
  CRISPR gRNA sequence
agagatcctggggggctggc

SEQ ID NO: 420968 - DNA, 20 bp, Artificial
  CRISPR gRNA sequence
gggggctggcagtcactgtg

SEQ ID NO: 420969 - DNA, 20 bp, Artificial
  CRISPR gRNA sequence
gcagtcactgtgcaaggata

SEQ ID NO: 420970 - DNA, 20 bp, Artificial
  CRISPR gRNA sequence
tgcaaggataaagaagactt

SEQ ID NO: 420971 - DNA, 20 bp, Artificial
  CRISPR gRNA sequence
catcagcccactggaaacaa

SEQ ID NO: 420972 - DNA, 20 bp, Artificial
  CRISPR gRNA sequence
atcagcccactggaaacaat

SEQ ID NO: 420973 - DNA, 20 bp, Artificial
  CRISPR gRNA sequence
gaaacaatttcccaacacag

SEQ ID NO: 420974 - DNA, 20 bp, Artificial
  CRISPR gRNA sequence
cccaacacagcagggctgcc

SEQ ID NO: 420975 - DNA, 20 bp, Artificial
  CRISPR gRNA sequence
ccaacacagcagggctgcca

SEQ ID NO: 420976 - DNA, 20 bp, Artificial
  CRISPR gRNA sequence
ccaagccggaagctcctgga

SEQ ID NO: 420977 - DNA, 20 bp, Artificial
  CRISPR gRNA sequence
ctggaaacaggcacctggct

SEQ ID NO: 420978 - DNA, 20 bp, Artificial
  CRISPR gRNA sequence
gaaacaggcacctggcttta

SEQ ID NO: 420979 - DNA, 20 bp, Artificial
  CRISPR gRNA sequence
gctttagacttgtcttctcc

SEQ ID NO: 420980 - DNA, 20 bp, Artificial
  CRISPR gRNA sequence
tagacttgtcttctcctctc

SEQ ID NO: 420981 - DNA, 20 bp, Artificial
  CRISPR gRNA sequence
agacttgtcttctcctctcc

SEQ ID NO: 420982 - DNA, 20 bp, Artificial
  CRISPR gRNA sequence
gacttgtcttctcctctccc

SEQ ID NO: 420983 - DNA, 20 bp, Artificial
  CRISPR gRNA sequence
gtcttctcctctcccacatc

SEQ ID NO: 420984 - DNA, 20 bp, Artificial
  CRISPR gRNA sequence
tcttctcctctcccacatca

SEQ ID NO: 420985 - DNA, 20 bp, Artificial
  CRISPR gRNA sequence
ctcctctcccacatcaccct

SEQ ID NO: 420986 - DNA, 20 bp, Artificial
  CRISPR gRNA sequence
tcctctcccacatcaccctc

SEQ ID NO: 420987 - DNA, 20 bp, Artificial
  CRISPR gRNA sequence
ctctcccacatcaccctctc

SEQ ID NO: 420988 - DNA, 20 bp, Artificial
  CRISPR gRNA sequence
tcccacatcaccctctcccc

SEQ ID NO: 420989 - DNA, 20 bp, Artificial
  CRISPR gRNA sequence
ccacatcaccctctccccat

SEQ ID NO: 420990 - DNA, 20 bp, Artificial
  CRISPR gRNA sequence
tccccatctcagcttccagc

SEQ ID NO: 420991 - DNA, 20 bp, Artificial
  CRISPR gRNA sequence
cccatctcagcttccagcac

SEQ ID NO: 420992 - DNA, 20 bp, Artificial
  CRISPR gRNA sequence
agcttccagcacctggaggt

SEQ ID NO: 420993 - DNA, 20 bp, Artificial
  CRISPR gRNA sequence
ccagcacctggaggtgcata

SEQ ID NO: 420994 - DNA, 20 bp, Artificial
  CRISPR gRNA sequence
cagcacctggaggtgcataa

SEQ ID NO: 420995 - DNA, 20 bp, Artificial
  CRISPR gRNA sequence
gaggtgcataaagtggatcc

SEQ ID NO: 420996 - DNA, 20 bp, Artificial
  CRISPR gRNA sequence
cccaggaccactttccccgt

SEQ ID NO: 420997 - DNA, 20 bp, Artificial
  CRISPR gRNA sequence
tccccgtccctggcctggag

SEQ ID NO: 420998 - DNA, 20 bp, Artificial
  CRISPR gRNA sequence
ccccgtccctggcctggagt

SEQ ID NO: 420999 - DNA, 20 bp, Artificial
  CRISPR gRNA sequence
cccgtccctggcctggagtt

SEQ ID NO: 421000 - DNA, 20 bp, Artificial
  CRISPR gRNA sequence
gcctggagtttacttggcat

SEQ ID NO: 421001 - DNA, 20 bp, Artificial
  CRISPR gRNA sequence
gagtttacttggcatcagcc

SEQ ID NO: 421002 - DNA, 20 bp, Artificial
  CRISPR gRNA sequence
acttggcatcagccaccctt

SEQ ID NO: 421003 - DNA, 20 bp, Artificial
  CRISPR gRNA sequence
cttggcatcagccacccttg

SEQ ID NO: 421004 - DNA, 20 bp, Artificial
  CRISPR gRNA sequence
ggcatcagccacccttgccg

SEQ ID NO: 421005 - DNA, 20 bp, Artificial
  CRISPR gRNA sequence
gcatcagccacccttgccgt

SEQ ID NO: 421006 - DNA, 20 bp, Artificial
  CRISPR gRNA sequence
gccgttttcctggcctggaa

SEQ ID NO: 421007 - DNA, 20 bp, Artificial
  CRISPR gRNA sequence
ccgttttcctggcctggaac

SEQ ID NO: 421008 - DNA, 20 bp, Artificial
  CRISPR gRNA sequence
tcctggcctggaaccccgcg

SEQ ID NO: 421009 - DNA, 20 bp, Artificial
  CRISPR gRNA sequence
cctggcctggaaccccgcga

SEQ ID NO: 421010 - DNA, 20 bp, Artificial
  CRISPR gRNA sequence
ctggcctggaaccccgcgaa

SEQ ID NO: 421011 - DNA, 20 bp, Artificial
  CRISPR gRNA sequence
gcctggaaccccgcgaagcc

SEQ ID NO: 421012 - DNA, 20 bp, Artificial
  CRISPR gRNA sequence
gaaccccgcgaagcccaccc

SEQ ID NO: 421013 - DNA, 20 bp, Artificial
  CRISPR gRNA sequence
agctacagatatctgaaatg

SEQ ID NO: 421014 - DNA, 20 bp, Artificial
  CRISPR gRNA sequence
cagatatctgaaatgaatca

SEQ ID NO: 421015 - DNA, 20 bp, Artificial
  CRISPR gRNA sequence
aaatgaatcactttagcccc

SEQ ID NO: 421016 - DNA, 20 bp, Artificial
  CRISPR gRNA sequence
tagccccatgctctcccccc

SEQ ID NO: 421017 - DNA, 20 bp, Artificial
  CRISPR gRNA sequence
agccccatgctctccccccc

SEQ ID NO: 421018 - DNA, 20 bp, Artificial
  CRISPR gRNA sequence
gccccatgctctccccccct

SEQ ID NO: 421019 - DNA, 20 bp, Artificial
  CRISPR gRNA sequence
tccccccctccccctccctc

SEQ ID NO: 421020 - DNA, 20 bp, Artificial
  CRISPR gRNA sequence
cccccctccccctccctctg

SEQ ID NO: 421021 - DNA, 20 bp, Artificial
  CRISPR gRNA sequence
cccctccctctgggcactcc

SEQ ID NO: 421022 - DNA, 20 bp, Artificial
  CRISPR gRNA sequence
cctctgggcactcccgcgtg

SEQ ID NO: 421023 - DNA, 20 bp, Artificial
  CRISPR gRNA sequence
tgggcactcccgcgtgggtg

SEQ ID NO: 421024 - DNA, 20 bp, Artificial
  CRISPR gRNA sequence
ggcactcccgcgtgggtggg

SEQ ID NO: 421025 - DNA, 20 bp, Artificial
  CRISPR gRNA sequence
ccgcgtgggtgggagaaggg

SEQ ID NO: 421026 - DNA, 20 bp, Artificial
  CRISPR gRNA sequence
gggggtgacacaatctctcc

SEQ ID NO: 421027 - DNA, 20 bp, Artificial
  CRISPR gRNA sequence
tccacagggccccccataca

SEQ ID NO: 421028 - DNA, 20 bp, Artificial
  CRISPR gRNA sequence
cacagggccccccatacacg

SEQ ID NO: 421029 - DNA, 20 bp, Artificial
  CRISPR gRNA sequence
cgggggcaccttccactcca

SEQ ID NO: 421030 - DNA, 20 bp, Artificial
  CRISPR gRNA sequence
gggggcaccttccactccag

SEQ ID NO: 421031 - DNA, 20 bp, Artificial
  CRISPR gRNA sequence
ccactccagcaggccgccca

SEQ ID NO: 421032 - DNA, 20 bp, Artificial
  CRISPR gRNA sequence
cactccagcaggccgcccac

SEQ ID NO: 421033 - DNA, 20 bp, Artificial
  CRISPR gRNA sequence
cagcaggccgcccaccccct

SEQ ID NO: 421034 - DNA, 20 bp, Artificial
  CRISPR gRNA sequence
cctctactcttctgggagct

SEQ ID NO: 421035 - DNA, 20 bp, Artificial
  CRISPR gRNA sequence
ctctactcttctgggagctc

SEQ ID NO: 421036 - DNA, 20 bp, Artificial
  CRISPR gRNA sequence
tactcttctgggagctctcc

SEQ ID NO: 421037 - DNA, 20 bp, Artificial
  CRISPR gRNA sequence
ctcttctgggagctctccga

SEQ ID NO: 421038 - DNA, 20 bp, Artificial
  CRISPR gRNA sequence
ttctgggagctctccgacag

SEQ ID NO: 421039 - DNA, 20 bp, Artificial
  CRISPR gRNA sequence
ctgggagctctccgacaggg

SEQ ID NO: 421040 - DNA, 20 bp, Artificial
  CRISPR gRNA sequence
tgggagctctccgacagggc

SEQ ID NO: 421041 - DNA, 20 bp, Artificial
  CRISPR gRNA sequence
ggagctctccgacagggcct

SEQ ID NO: 421042 - DNA, 20 bp, Artificial
  CRISPR gRNA sequence
tccgacagggcctagggcgc

SEQ ID NO: 421043 - DNA, 20 bp, Artificial
  CRISPR gRNA sequence
cgacagggcctagggcgcag

SEQ ID NO: 421044 - DNA, 20 bp, Artificial
  CRISPR gRNA sequence
gggcgcagcctctgccccag

SEQ ID NO: 421045 - DNA, 20 bp, Artificial
  CRISPR gRNA sequence
tgccccagcccttcctgcgt

SEQ ID NO: 421046 - DNA, 20 bp, Artificial
  CRISPR gRNA sequence
ccccagcccttcctgcgtcc

SEQ ID NO: 421047 - DNA, 20 bp, Artificial
  CRISPR gRNA sequence
cctgcgtcccgggaggcagg

SEQ ID NO: 421048 - DNA, 20 bp, Artificial
  CRISPR gRNA sequence
ctgcgtcccgggaggcaggg

SEQ ID NO: 421049 - DNA, 20 bp, Artificial
  CRISPR gRNA sequence
cgtcccgggaggcaggggat

SEQ ID NO: 421050 - DNA, 20 bp, Artificial
  CRISPR gRNA sequence
ccagcccttctcccatcgtc

SEQ ID NO: 421051 - DNA, 20 bp, Artificial
  CRISPR gRNA sequence
ctcccatcgtcccgccccac

SEQ ID NO: 421052 - DNA, 20 bp, Artificial
  CRISPR gRNA sequence
tcccatcgtcccgccccaca

SEQ ID NO: 421053 - DNA, 20 bp, Artificial
  CRISPR gRNA sequence
ccatcgtcccgccccacata

SEQ ID NO: 421054 - DNA, 20 bp, Artificial
  CRISPR gRNA sequence
gaggcctggcccaggcgcag

SEQ ID NO: 421055 - DNA, 20 bp, Artificial
  CRISPR gRNA sequence
gcccaggcgcagacggaggc

SEQ ID NO: 421056 - DNA, 20 bp, Artificial
  CRISPR gRNA sequence
aggtgcaccgcggcgcggta

SEQ ID NO: 421057 - DNA, 20 bp, Artificial
  CRISPR gRNA sequence
gccggcgtccgcgcgccggg

SEQ ID NO: 421058 - DNA, 20 bp, Artificial
  CRISPR gRNA sequence
ggcgcagccatagcgagaag

SEQ ID NO: 421059 - DNA, 20 bp, Artificial
  CRISPR gRNA sequence
ccggccgcgctcatccagct

SEQ ID NO: 421060 - DNA, 20 bp, Artificial
  CRISPR gRNA sequence
atccagctggacgcggggct

SEQ ID NO: 421061 - DNA, 20 bp, Artificial
  CRISPR gRNA sequence
gacgcggggctgcaggggca

SEQ ID NO: 421062 - DNA, 20 bp, Artificial
  CRISPR gRNA sequence
caggggcagcctcccgctgc

SEQ ID NO: 421063 - DNA, 20 bp, Artificial
  CRISPR gRNA sequence
ccgctgcgcaggcctccggg

SEQ ID NO: 421064 - DNA, 20 bp, Artificial
  CRISPR gRNA sequence
cgcaggcctccgggacccac

SEQ ID NO: 421065 - DNA, 20 bp, Artificial
  CRISPR gRNA sequence
cgggacccacgctcagcacc

SEQ ID NO: 421066 - DNA, 20 bp, Artificial
  CRISPR gRNA sequence
agcaccgtgtagcggcgggg

SEQ ID NO: 421067 - DNA, 20 bp, Artificial
  CRISPR gRNA sequence
ggcccccaggaggagggcgc

SEQ ID NO: 421068 - DNA, 20 bp, Artificial
  CRISPR gRNA sequence
ggcgggaaagagaatggagt

SEQ ID NO: 421069 - DNA, 20 bp, Artificial
  CRISPR gRNA sequence
agaagctccaggggtaggaa

SEQ ID NO: 421070 - DNA, 20 bp, Artificial
  CRISPR gRNA sequence
caggggtaggaagcccggga

SEQ ID NO: 421071 - DNA, 20 bp, Artificial
  CRISPR gRNA sequence
aggatgagaaagcccgcccc

SEQ ID NO: 421072 - DNA, 20 bp, Artificial
  CRISPR gRNA sequence
tcttgaccaccaaccgtccc

SEQ ID NO: 421073 - DNA, 20 bp, Artificial
  CRISPR gRNA sequence
ttgaccaccaaccgtcccct

SEQ ID NO: 421074 - DNA, 20 bp, Artificial
  CRISPR gRNA sequence
gaccaccaaccgtcccctca

SEQ ID NO: 421075 - DNA, 20 bp, Artificial
  CRISPR gRNA sequence
accaccaaccgtcccctcac

SEQ ID NO: 421076 - DNA, 20 bp, Artificial
  CRISPR gRNA sequence
acgcccgacccctctgttgg

SEQ ID NO: 421077 - DNA, 20 bp, Artificial
  CRISPR gRNA sequence
tgttggactggccgcatcca

SEQ ID NO: 421078 - DNA, 20 bp, Artificial
  CRISPR gRNA sequence
ttggactggccgcatccact

SEQ ID NO: 421079 - DNA, 20 bp, Artificial
  CRISPR gRNA sequence
gactggccgcatccacttct

SEQ ID NO: 421080 - DNA, 20 bp, Artificial
  CRISPR gRNA sequence
gccgcatccacttctggaga

SEQ ID NO: 421081 - DNA, 20 bp, Artificial
  CRISPR gRNA sequence
ctggagagaagggatgctgg

SEQ ID NO: 421082 - DNA, 20 bp, Artificial
  CRISPR gRNA sequence
tggagagaagggatgctggc

SEQ ID NO: 421083 - DNA, 20 bp, Artificial
  CRISPR gRNA sequence
gagagaagggatgctggcgt

SEQ ID NO: 421084 - DNA, 20 bp, Artificial
  CRISPR gRNA sequence
gcgtgagggtcgctgattgc

SEQ ID NO: 421085 - DNA, 20 bp, Artificial
  CRISPR gRNA sequence
attgcagagcaagggcagga

SEQ ID NO: 421086 - DNA, 20 bp, Artificial
  CRISPR gRNA sequence
cagagcaagggcaggaacgg

SEQ ID NO: 421087 - DNA, 20 bp, Artificial
  CRISPR gRNA sequence
ggtcactggcttcagaggga

SEQ ID NO: 421088 - DNA, 20 bp, Artificial
  CRISPR gRNA sequence
gcttcagagggagtgacacc

SEQ ID NO: 421089 - DNA, 20 bp, Artificial
  CRISPR gRNA sequence
cagagggagtgacacctcag

SEQ ID NO: 421090 - DNA, 20 bp, Artificial
  CRISPR gRNA sequence
agagggagtgacacctcagg

SEQ ID NO: 421091 - DNA, 20 bp, Artificial
  CRISPR gRNA sequence
agggcaggggacagaggacc

SEQ ID NO: 421092 - DNA, 20 bp, Artificial
  CRISPR gRNA sequence
agtgctggattcggaggtcc

SEQ ID NO: 421093 - DNA, 20 bp, Artificial
  CRISPR gRNA sequence
gattcggaggtcctgttgcc

SEQ ID NO: 421094 - DNA, 20 bp, Artificial
  CRISPR gRNA sequence
ggaggtcctgttgcccaagt

SEQ ID NO: 421095 - DNA, 20 bp, Artificial
  CRISPR gRNA sequence
ttgcccaagtttggggtgca

SEQ ID NO: 421096 - DNA, 20 bp, Artificial
  CRISPR gRNA sequence
cccaagtttggggtgcatac

SEQ ID NO: 421097 - DNA, 20 bp, Artificial
  CRISPR gRNA sequence
ggggtgcatacctgtctggc

SEQ ID NO: 421098 - DNA, 20 bp, Artificial
  CRISPR gRNA sequence
gggtgcatacctgtctggct

SEQ ID NO: 421099 - DNA, 20 bp, Artificial
  CRISPR gRNA sequence
tctggctgatgctgccaagt

SEQ ID NO: 421100 - DNA, 20 bp, Artificial
  CRISPR gRNA sequence
gctgatgctgccaagtgacc

SEQ ID NO: 421101 - DNA, 20 bp, Artificial
  CRISPR gRNA sequence
atgctgccaagtgacccctg

SEQ ID NO: 421102 - DNA, 20 bp, Artificial
  CRISPR gRNA sequence
ccaagtgacccctgctcttc

SEQ ID NO: 421103 - DNA, 20 bp, Artificial
  CRISPR gRNA sequence
ctcttcgcagaaggctgaga

SEQ ID NO: 421104 - DNA, 20 bp, Artificial
  CRISPR gRNA sequence
ttcgcagaaggctgagatcc

SEQ ID NO: 421105 - DNA, 20 bp, Artificial
  CRISPR gRNA sequence
cgcagaaggctgagatcctg

SEQ ID NO: 421106 - DNA, 20 bp, Artificial
  CRISPR gRNA sequence
gcagaaggctgagatcctgg

SEQ ID NO: 421107 - DNA, 20 bp, Artificial
  CRISPR gRNA sequence
agatcctggagggggattgt

SEQ ID NO: 421108 - DNA, 20 bp, Artificial
  CRISPR gRNA sequence
gagggggattgtggggctgc

SEQ ID NO: 421109 - DNA, 20 bp, Artificial
  CRISPR gRNA sequence
tggggctgcaggggagctgg

SEQ ID NO: 421110 - DNA, 20 bp, Artificial
  CRISPR gRNA sequence
caggggagctgggcaggagc

SEQ ID NO: 421111 - DNA, 20 bp, Artificial
  CRISPR gRNA sequence
ggcaggagccccctcctggg

SEQ ID NO: 421112 - DNA, 20 bp, Artificial
  CRISPR gRNA sequence
ctgggcccacaccaccggga

SEQ ID NO: 421113 - DNA, 20 bp, Artificial
  CRISPR gRNA sequence
ggcccacaccaccgggacct

SEQ ID NO: 421114 - DNA, 20 bp, Artificial
  CRISPR gRNA sequence
agcccctggctggagaggct

SEQ ID NO: 421115 - DNA, 20 bp, Artificial
  CRISPR gRNA sequence
gctggagaggcttcactagg

SEQ ID NO: 421116 - DNA, 20 bp, Artificial
  CRISPR gRNA sequence
gagaggcttcactaggtgag

SEQ ID NO: 421117 - DNA, 20 bp, Artificial
  CRISPR gRNA sequence
cactaggtgagcaaaagaga

SEQ ID NO: 421118 - DNA, 20 bp, Artificial
  CRISPR gRNA sequence
actaggtgagcaaaagagag

SEQ ID NO: 421119 - DNA, 20 bp, Artificial
  CRISPR gRNA sequence
ggtgagcaaaagagaggcca

SEQ ID NO: 421120 - DNA, 20 bp, Artificial
  CRISPR gRNA sequence
ggtgtttcccgagggagaaa

SEQ ID NO: 421121 - DNA, 20 bp, Artificial
  CRISPR gRNA sequence
cccgagggagaaacagggtg

SEQ ID NO: 421122 - DNA, 20 bp, Artificial
  CRISPR gRNA sequence
ccgagggagaaacagggtgc

SEQ ID NO: 421123 - DNA, 20 bp, Artificial
  CRISPR gRNA sequence
gggtttctgtttcttctctg

SEQ ID NO: 421124 - DNA, 20 bp, Artificial
  CRISPR gRNA sequence
ggtttctgtttcttctctgc

SEQ ID NO: 421125 - DNA, 20 bp, Artificial
  CRISPR gRNA sequence
ctgtttcttctctgcccaga

SEQ ID NO: 421126 - DNA, 20 bp, Artificial
  CRISPR gRNA sequence
tgtttcttctctgcccagag

SEQ ID NO: 421127 - DNA, 20 bp, Artificial
  CRISPR gRNA sequence
tttcttctctgcccagagag

SEQ ID NO: 421128 - DNA, 20 bp, Artificial
  CRISPR gRNA sequence
cttctctgcccagagaggct

SEQ ID NO: 421129 - DNA, 20 bp, Artificial
  CRISPR gRNA sequence
ttctctgcccagagaggctt

SEQ ID NO: 421130 - DNA, 20 bp, Artificial
  CRISPR gRNA sequence
ctctgcccagagaggctttc

SEQ ID NO: 421131 - DNA, 20 bp, Artificial
  CRISPR gRNA sequence
tctgcccagagaggctttcg

SEQ ID NO: 421132 - DNA, 20 bp, Artificial
  CRISPR gRNA sequence
tgcccagagaggctttcggg

SEQ ID NO: 421133 - DNA, 20 bp, Artificial
  CRISPR gRNA sequence
cccagagaggctttcggggt

SEQ ID NO: 421134 - DNA, 20 bp, Artificial
  CRISPR gRNA sequence
tcggggtggaaggactgccc

SEQ ID NO: 421135 - DNA, 20 bp, Artificial
  CRISPR gRNA sequence
cggggtggaaggactgccca

SEQ ID NO: 421136 - DNA, 20 bp, Artificial
  CRISPR gRNA sequence
ggggtggaaggactgcccaa

SEQ ID NO: 421137 - DNA, 20 bp, Artificial
  CRISPR gRNA sequence
cccaaaaaagggattagaag

SEQ ID NO: 421138 - DNA, 20 bp, Artificial
  CRISPR gRNA sequence
gaagaatccacagagctaag

SEQ ID NO: 421139 - DNA, 20 bp, Artificial
  CRISPR gRNA sequence
aggacctcaggacctttgtg

SEQ ID NO: 421140 - DNA, 20 bp, Artificial
  CRISPR gRNA sequence
aggacctttgtggccacaga

SEQ ID NO: 421141 - DNA, 20 bp, Artificial
  CRISPR gRNA sequence
tgtggccacagagatccctg

SEQ ID NO: 421142 - DNA, 20 bp, Artificial
  CRISPR gRNA sequence
gtggccacagagatccctgc

SEQ ID NO: 421143 - DNA, 20 bp, Artificial
  CRISPR gRNA sequence
tggccacagagatccctgct

SEQ ID NO: 421144 - DNA, 20 bp, Artificial
  CRISPR gRNA sequence
ctggtcccctcctgtggggc

SEQ ID NO: 421145 - DNA, 20 bp, Artificial
  CRISPR gRNA sequence
gtcccctcctgtggggctgg

SEQ ID NO: 421146 - DNA, 20 bp, Artificial
  CRISPR gRNA sequence
ctgtggggctggaggtcaac

SEQ ID NO: 421147 - DNA, 20 bp, Artificial
  CRISPR gRNA sequence
tggggctggaggtcaaccct

SEQ ID NO: 421148 - DNA, 20 bp, Artificial
  CRISPR gRNA sequence
gaggtcaaccctcccgccat

SEQ ID NO: 421149 - DNA, 20 bp, Artificial
  CRISPR gRNA sequence
ccgccatccccgttttacct

SEQ ID NO: 421150 - DNA, 20 bp, Artificial
  CRISPR gRNA sequence
tacctggagccacccaaagc

SEQ ID NO: 421151 - DNA, 20 bp, Artificial
  CRISPR gRNA sequence
acctggagccacccaaagcg

SEQ ID NO: 421152 - DNA, 20 bp, Artificial
  CRISPR gRNA sequence
cctggagccacccaaagcgg

SEQ ID NO: 421153 - DNA, 20 bp, Artificial
  CRISPR gRNA sequence
gagccacccaaagcggctgc

SEQ ID NO: 421154 - DNA, 20 bp, Artificial
  CRISPR gRNA sequence
cagaaacagcaagcccagga

SEQ ID NO: 421155 - DNA, 20 bp, Artificial
  CRISPR gRNA sequence
agcctcccacatctctccta

SEQ ID NO: 421156 - DNA, 20 bp, Artificial
  CRISPR gRNA sequence
ccacatctctcctatggtct

SEQ ID NO: 421157 - DNA, 20 bp, Artificial
  CRISPR gRNA sequence
tcctatggtctgggcagcgc

SEQ ID NO: 421158 - DNA, 20 bp, Artificial
  CRISPR gRNA sequence
ctatggtctgggcagcgctg

SEQ ID NO: 421159 - DNA, 20 bp, Artificial
  CRISPR gRNA sequence
tggtctgggcagcgctgagc

SEQ ID NO: 421160 - DNA, 20 bp, Artificial
  CRISPR gRNA sequence
ggcagcgctgagccctccaa

SEQ ID NO: 421161 - DNA, 20 bp, Artificial
  CRISPR gRNA sequence
agccctccaaaaggaggtca

SEQ ID NO: 421162 - DNA, 20 bp, Artificial
  CRISPR gRNA sequence
caaaaggaggtcagaaaagg

SEQ ID NO: 421163 - DNA, 20 bp, Artificial
  CRISPR gRNA sequence
tgcagagagggaggtggagg

SEQ ID NO: 421164 - DNA, 20 bp, Artificial
  CRISPR gRNA sequence
cagagagggaggtggaggaa

SEQ ID NO: 421165 - DNA, 20 bp, Artificial
  CRISPR gRNA sequence
tagaagaagggagaccagga

SEQ ID NO: 421166 - DNA, 20 bp, Artificial
  CRISPR gRNA sequence
gaagaagggagaccaggaga

SEQ ID NO: 421167 - DNA, 20 bp, Artificial
  CRISPR gRNA sequence
ggagagagggtggggaggga

SEQ ID NO: 421168 - DNA, 20 bp, Artificial
  CRISPR gRNA sequence
gagagagggtggggagggat

SEQ ID NO: 421169 - DNA, 20 bp, Artificial
  CRISPR gRNA sequence
gaaagctgggcagatcaggc

SEQ ID NO: 421170 - DNA, 20 bp, Artificial
  CRISPR gRNA sequence
ggcagatcaggcagcctgag

SEQ ID NO: 421171 - DNA, 20 bp, Artificial
  CRISPR gRNA sequence
aggaggtgggggcgggggtg

SEQ ID NO: 421172 - DNA, 20 bp, Artificial
  CRISPR gRNA sequence
ggatgccgttctgctggtct

SEQ ID NO: 421173 - DNA, 20 bp, Artificial
  CRISPR gRNA sequence
tgctggtctctgggccttca

SEQ ID NO: 421174 - DNA, 20 bp, Artificial
  CRISPR gRNA sequence
ctggtctctgggccttcacc

SEQ ID NO: 421175 - DNA, 20 bp, Artificial
  CRISPR gRNA sequence
gtctctgggccttcacccct

SEQ ID NO: 421176 - DNA, 20 bp, Artificial
  CRISPR gRNA sequence
tgggccttcacccctgtgcc

SEQ ID NO: 421177 - DNA, 20 bp, Artificial
  CRISPR gRNA sequence
ggccttcacccctgtgcccg

SEQ ID NO: 421178 - DNA, 20 bp, Artificial
  CRISPR gRNA sequence
cacccctgtgcccggccttc

SEQ ID NO: 421179 - DNA, 20 bp, Artificial
  CRISPR gRNA sequence
acccctgtgcccggccttcc

SEQ ID NO: 421180 - DNA, 20 bp, Artificial
  CRISPR gRNA sequence
tgcccggccttccctccacc

SEQ ID NO: 421181 - DNA, 20 bp, Artificial
  CRISPR gRNA sequence
ccctccaccttccccacttc

SEQ ID NO: 421182 - DNA, 20 bp, Artificial
  CRISPR gRNA sequence
cctccaccttccccacttcc

SEQ ID NO: 421183 - DNA, 20 bp, Artificial
  CRISPR gRNA sequence
caccttccccacttcccctc

SEQ ID NO: 421184 - DNA, 20 bp, Artificial
  CRISPR gRNA sequence
ccccacttcccctcctcccg

SEQ ID NO: 421185 - DNA, 20 bp, Artificial
  CRISPR gRNA sequence
cccacttcccctcctcccgg

SEQ ID NO: 421186 - DNA, 20 bp, Artificial
  CRISPR gRNA sequence
cccctcctcccggcccgccc

SEQ ID NO: 421187 - DNA, 20 bp, Artificial
  CRISPR gRNA sequence
ccctcctcccggcccgcccc

SEQ ID NO: 421188 - DNA, 20 bp, Artificial
  CRISPR gRNA sequence
ctcccggcccgccccccgca

SEQ ID NO: 421189 - DNA, 20 bp, Artificial
  CRISPR gRNA sequence
ccggcccgccccccgcaccc

SEQ ID NO: 421190 - DNA, 20 bp, Artificial
  CRISPR gRNA sequence
acggtttcgcttcgcagtgg

SEQ ID NO: 421191 - DNA, 20 bp, Artificial
  CRISPR gRNA sequence
cggtttcgcttcgcagtgga

SEQ ID NO: 421192 - DNA, 20 bp, Artificial
  CRISPR gRNA sequence
cgcttcgcagtggaaagtct

SEQ ID NO: 421193 - DNA, 20 bp, Artificial
  CRISPR gRNA sequence
gcttcgcagtggaaagtctg

SEQ ID NO: 421194 - DNA, 20 bp, Artificial
  CRISPR gRNA sequence
cgcagtggaaagtctgaggg

SEQ ID NO: 421195 - DNA, 20 bp, Artificial
  CRISPR gRNA sequence
gcagtggaaagtctgagggg

SEQ ID NO: 421196 - DNA, 20 bp, Artificial
  CRISPR gRNA sequence
aactttatgtgtttttaata

SEQ ID NO: 421197 - DNA, 20 bp, Artificial
  CRISPR gRNA sequence
aatatggtttttgccaaact

SEQ ID NO: 421198 - DNA, 20 bp, Artificial
  CRISPR gRNA sequence
ttgccaaacttggtttttcc

SEQ ID NO: 421199 - DNA, 20 bp, Artificial
  CRISPR gRNA sequence
tttccgagaccgtcttttct

SEQ ID NO: 421200 - DNA, 20 bp, Artificial
  CRISPR gRNA sequence
tccgagaccgtcttttctca

SEQ ID NO: 421201 - DNA, 20 bp, Artificial
  CRISPR gRNA sequence
ccgagaccgtcttttctcag

SEQ ID NO: 421202 - DNA, 20 bp, Artificial
  CRISPR gRNA sequence
accgtcttttctcagaggct

SEQ ID NO: 421203 - DNA, 20 bp, Artificial
  CRISPR gRNA sequence
cagttttaccgtcctatctg

SEQ ID NO: 421204 - DNA, 20 bp, Artificial
  CRISPR gRNA sequence
tttaccgtcctatctgcagt

SEQ ID NO: 421205 - DNA, 20 bp, Artificial
  CRISPR gRNA sequence
tatctgcagtcggctacttt

SEQ ID NO: 421206 - DNA, 20 bp, Artificial
  CRISPR gRNA sequence
ctgcagtcggctactttcag

SEQ ID NO: 421207 - DNA, 20 bp, Artificial
  CRISPR gRNA sequence
cagtcggctactttcagtgg

SEQ ID NO: 421208 - DNA, 20 bp, Artificial
  CRISPR gRNA sequence
tcggctactttcagtggcag

SEQ ID NO: 421209 - DNA, 20 bp, Artificial
  CRISPR gRNA sequence
ggctactttcagtggcagaa

SEQ ID NO: 421210 - DNA, 20 bp, Artificial
  CRISPR gRNA sequence
gctactttcagtggcagaag

SEQ ID NO: 421211 - DNA, 20 bp, Artificial
  CRISPR gRNA sequence
gaggccacatctgcttcctg

SEQ ID NO: 421212 - DNA, 20 bp, Artificial
  CRISPR gRNA sequence
aggccacatctgcttcctgt

SEQ ID NO: 421213 - DNA, 20 bp, Artificial
  CRISPR gRNA sequence
tctgcttcctgtaggccctc

SEQ ID NO: 421214 - DNA, 20 bp, Artificial
  CRISPR gRNA sequence
ctgcttcctgtaggccctct

SEQ ID NO: 421215 - DNA, 20 bp, Artificial
  CRISPR gRNA sequence
cttcctgtaggccctctggg

SEQ ID NO: 421216 - DNA, 20 bp, Artificial
  CRISPR gRNA sequence
cctgtaggccctctgggcag

SEQ ID NO: 421217 - DNA, 20 bp, Artificial
  CRISPR gRNA sequence
ctctgggcagaagcatgcgc

SEQ ID NO: 421218 - DNA, 20 bp, Artificial
  CRISPR gRNA sequence
gctggtgtctcctcctgatc

SEQ ID NO: 421219 - DNA, 20 bp, Artificial
  CRISPR gRNA sequence
ctggtgtctcctcctgatct

SEQ ID NO: 421220 - DNA, 20 bp, Artificial
  CRISPR gRNA sequence
gtctcctcctgatctgggcc

SEQ ID NO: 421221 - DNA, 20 bp, Artificial
  CRISPR gRNA sequence
tctcctcctgatctgggccc

SEQ ID NO: 421222 - DNA, 20 bp, Artificial
  CRISPR gRNA sequence
ctcctcctgatctgggccca

SEQ ID NO: 421223 - DNA, 20 bp, Artificial
  CRISPR gRNA sequence
tcctcctgatctgggcccag

SEQ ID NO: 421224 - DNA, 20 bp, Artificial
  CRISPR gRNA sequence
ctgatctgggcccaggggct

SEQ ID NO: 421225 - DNA, 20 bp, Artificial
  CRISPR gRNA sequence
tgatctgggcccaggggctg

SEQ ID NO: 421226 - DNA, 20 bp, Artificial
  CRISPR gRNA sequence
tctgggcccaggggctgagg

SEQ ID NO: 421227 - DNA, 20 bp, Artificial
  CRISPR gRNA sequence
ctgggcccaggggctgaggc

SEQ ID NO: 421228 - DNA, 20 bp, Artificial
  CRISPR gRNA sequence
gaggcaggctcccctcgcct

SEQ ID NO: 421229 - DNA, 20 bp, Artificial
  CRISPR gRNA sequence
aggcaggctcccctcgcctc

SEQ ID NO: 421230 - DNA, 20 bp, Artificial
  CRISPR gRNA sequence
aggctcccctcgcctcaggt

SEQ ID NO: 421231 - DNA, 20 bp, Artificial
  CRISPR gRNA sequence
ggctcccctcgcctcaggta

SEQ ID NO: 421232 - DNA, 20 bp, Artificial
  CRISPR gRNA sequence
ctcaggtaaggcctgaaacc

SEQ ID NO: 421233 - DNA, 20 bp, Artificial
  CRISPR gRNA sequence
aggtaaggcctgaaacccag

SEQ ID NO: 421234 - DNA, 20 bp, Artificial
  CRISPR gRNA sequence
gtaaggcctgaaacccagca

SEQ ID NO: 421235 - DNA, 20 bp, Artificial
  CRISPR gRNA sequence
aggcctgaaacccagcagag

SEQ ID NO: 421236 - DNA, 20 bp, Artificial
  CRISPR gRNA sequence
cctgaaacccagcagagcag

SEQ ID NO: 421237 - DNA, 20 bp, Artificial
  CRISPR gRNA sequence
ctgaaacccagcagagcagc

SEQ ID NO: 421238 - DNA, 20 bp, Artificial
  CRISPR gRNA sequence
tgaaacccagcagagcagca

SEQ ID NO: 421239 - DNA, 20 bp, Artificial
  CRISPR gRNA sequence
aaacccagcagagcagcagg

SEQ ID NO: 421240 - DNA, 20 bp, Artificial
  CRISPR gRNA sequence
aacccagcagagcagcaggg

SEQ ID NO: 421241 - DNA, 20 bp, Artificial
  CRISPR gRNA sequence
gagcagcagggaggaaaaac

SEQ ID NO: 421242 - DNA, 20 bp, Artificial
  CRISPR gRNA sequence
agcagcagggaggaaaaaca

SEQ ID NO: 421243 - DNA, 20 bp, Artificial
  CRISPR gRNA sequence
cagggaggaaaaacaaggct

SEQ ID NO: 421244 - DNA, 20 bp, Artificial
  CRISPR gRNA sequence
aggaaaaacaaggctaagct

SEQ ID NO: 421245 - DNA, 20 bp, Artificial
  CRISPR gRNA sequence
aaaacaaggctaagcttggt

SEQ ID NO: 421246 - DNA, 20 bp, Artificial
  CRISPR gRNA sequence
aacaaggctaagcttggttg

SEQ ID NO: 421247 - DNA, 20 bp, Artificial
  CRISPR gRNA sequence
gctaagcttggttggagact

SEQ ID NO: 421248 - DNA, 20 bp, Artificial
  CRISPR gRNA sequence
ctaagcttggttggagactt

SEQ ID NO: 421249 - DNA, 20 bp, Artificial
  CRISPR gRNA sequence
tggagacttgggtgcttgtg

SEQ ID NO: 421250 - DNA, 20 bp, Artificial
  CRISPR gRNA sequence
ggagacttgggtgcttgtgt

SEQ ID NO: 421251 - DNA, 20 bp, Artificial
  CRISPR gRNA sequence
gagacttgggtgcttgtgta

SEQ ID NO: 421252 - DNA, 20 bp, Artificial
  CRISPR gRNA sequence
acttgggtgcttgtgtaggg

SEQ ID NO: 421253 - DNA, 20 bp, Artificial
  CRISPR gRNA sequence
gcttgtgtagggaagactcc

SEQ ID NO: 421254 - DNA, 20 bp, Artificial
  CRISPR gRNA sequence
ttgtgtagggaagactccaa

SEQ ID NO: 421255 - DNA, 20 bp, Artificial
  CRISPR gRNA sequence
aagactccaagagcatgcca

SEQ ID NO: 421256 - DNA, 20 bp, Artificial
  CRISPR gRNA sequence
agagcatgccacagctgctt

SEQ ID NO: 421257 - DNA, 20 bp, Artificial
  CRISPR gRNA sequence
agcatgccacagctgcttga

SEQ ID NO: 421258 - DNA, 20 bp, Artificial
  CRISPR gRNA sequence
tgccacagctgcttgagaga

SEQ ID NO: 421259 - DNA, 20 bp, Artificial
  CRISPR gRNA sequence
gagaaagaaattgcaacttt

SEQ ID NO: 421260 - DNA, 20 bp, Artificial
  CRISPR gRNA sequence
gaaagaaattgcaactttta

SEQ ID NO: 421261 - DNA, 20 bp, Artificial
  CRISPR gRNA sequence
agtcctgtgtactcttattt

SEQ ID NO: 421262 - DNA, 20 bp, Artificial
  CRISPR gRNA sequence
ctgtgtactcttatttaaga

SEQ ID NO: 421263 - DNA, 20 bp, Artificial
  CRISPR gRNA sequence
tgtgtactcttatttaagaa

SEQ ID NO: 421264 - DNA, 20 bp, Artificial
  CRISPR gRNA sequence
tttaagaaaggacaatctct

SEQ ID NO: 421265 - DNA, 20 bp, Artificial
  CRISPR gRNA sequence
aaaggacaatctctgagaat

SEQ ID NO: 421266 - DNA, 20 bp, Artificial
  CRISPR gRNA sequence
aaggacaatctctgagaatg

SEQ ID NO: 421267 - DNA, 20 bp, Artificial
  CRISPR gRNA sequence
gacaatctctgagaatgagg

SEQ ID NO: 421268 - DNA, 20 bp, Artificial
  CRISPR gRNA sequence
acaatctctgagaatgaggt

SEQ ID NO: 421269 - DNA, 20 bp, Artificial
  CRISPR gRNA sequence
caatctctgagaatgaggtg

SEQ ID NO: 421270 - DNA, 20 bp, Artificial
  CRISPR gRNA sequence
atgaggtggggttctgtttt

SEQ ID NO: 421271 - DNA, 20 bp, Artificial
  CRISPR gRNA sequence
aggtggggttctgtttttgg

SEQ ID NO: 421272 - DNA, 20 bp, Artificial
  CRISPR gRNA sequence
tggggttctgtttttggtgg

SEQ ID NO: 421273 - DNA, 20 bp, Artificial
  CRISPR gRNA sequence
tctgtttttggtggcagatg

SEQ ID NO: 421274 - DNA, 20 bp, Artificial
  CRISPR gRNA sequence
ctgtttttggtggcagatga

SEQ ID NO: 421275 - DNA, 20 bp, Artificial
  CRISPR gRNA sequence
gtggcagatgaaggactttg

SEQ ID NO: 421276 - DNA, 20 bp, Artificial
  CRISPR gRNA sequence
tgaaggactttgcagacttc

SEQ ID NO: 421277 - DNA, 20 bp, Artificial
  CRISPR gRNA sequence
gaaggactttgcagacttcc

SEQ ID NO: 421278 - DNA, 20 bp, Artificial
  CRISPR gRNA sequence
aaggactttgcagacttccg

SEQ ID NO: 421279 - DNA, 20 bp, Artificial
  CRISPR gRNA sequence
actttgcagacttccggggt

SEQ ID NO: 421280 - DNA, 20 bp, Artificial
  CRISPR gRNA sequence
tttgcagacttccggggttg

SEQ ID NO: 421281 - DNA, 20 bp, Artificial
  CRISPR gRNA sequence
ttgcagacttccggggttgg

SEQ ID NO: 421282 - DNA, 20 bp, Artificial
  CRISPR gRNA sequence
gcagacttccggggttggag

SEQ ID NO: 421283 - DNA, 20 bp, Artificial
  CRISPR gRNA sequence
cggggttggaggagcctgac

SEQ ID NO: 421284 - DNA, 20 bp, Artificial
  CRISPR gRNA sequence
gttggaggagcctgactggc

SEQ ID NO: 421285 - DNA, 20 bp, Artificial
  CRISPR gRNA sequence
ggagcctgactggccagcac

SEQ ID NO: 421286 - DNA, 20 bp, Artificial
  CRISPR gRNA sequence
gcctgactggccagcacaag

SEQ ID NO: 421287 - DNA, 20 bp, Artificial
  CRISPR gRNA sequence
cctgactggccagcacaaga

SEQ ID NO: 421288 - DNA, 20 bp, Artificial
  CRISPR gRNA sequence
tgactggccagcacaagaag

SEQ ID NO: 421289 - DNA, 20 bp, Artificial
  CRISPR gRNA sequence
ctggccagcacaagaaggag

SEQ ID NO: 421290 - DNA, 20 bp, Artificial
  CRISPR gRNA sequence
tggccagcacaagaaggagc

SEQ ID NO: 421291 - DNA, 20 bp, Artificial
  CRISPR gRNA sequence
cacaagaaggagcaggactg

SEQ ID NO: 421292 - DNA, 20 bp, Artificial
  CRISPR gRNA sequence
agaaggagcaggactgcagt

SEQ ID NO: 421293 - DNA, 20 bp, Artificial
  CRISPR gRNA sequence
ggactgcagtcggctacttt

SEQ ID NO: 421294 - DNA, 20 bp, Artificial
  CRISPR gRNA sequence
gactgcagtcggctactttc

SEQ ID NO: 421295 - DNA, 20 bp, Artificial
  CRISPR gRNA sequence
tgcagtcggctactttcagg

SEQ ID NO: 421296 - DNA, 20 bp, Artificial
  CRISPR gRNA sequence
agtcggctactttcaggaag

SEQ ID NO: 421297 - DNA, 20 bp, Artificial
  CRISPR gRNA sequence
cggctactttcaggaagaag

SEQ ID NO: 421298 - DNA, 20 bp, Artificial
  CRISPR gRNA sequence
ggctactttcaggaagaaga

SEQ ID NO: 421299 - DNA, 20 bp, Artificial
  CRISPR gRNA sequence
gctactttcaggaagaagaa

SEQ ID NO: 421300 - DNA, 20 bp, Artificial
  CRISPR gRNA sequence
ctttcaggaagaagaagggc

SEQ ID NO: 421301 - DNA, 20 bp, Artificial
  CRISPR gRNA sequence
tttcaggaagaagaagggct

SEQ ID NO: 421302 - DNA, 20 bp, Artificial
  CRISPR gRNA sequence
caggaagaagaagggctggg

SEQ ID NO: 421303 - DNA, 20 bp, Artificial
  CRISPR gRNA sequence
aggaagaagaagggctgggc

SEQ ID NO: 421304 - DNA, 20 bp, Artificial
  CRISPR gRNA sequence
gaagaagaagggctgggcag

SEQ ID NO: 421305 - DNA, 20 bp, Artificial
  CRISPR gRNA sequence
aagaagaagggctgggcagg

SEQ ID NO: 421306 - DNA, 20 bp, Artificial
  CRISPR gRNA sequence
ggctgggcaggaggcattgc

SEQ ID NO: 421307 - DNA, 20 bp, Artificial
  CRISPR gRNA sequence
aggcattgccagtttgcttt

SEQ ID NO: 421308 - DNA, 20 bp, Artificial
  CRISPR gRNA sequence
cattgccagtttgcttttag

SEQ ID NO: 421309 - DNA, 20 bp, Artificial
  CRISPR gRNA sequence
ttagaagctcattcctgctc

SEQ ID NO: 421310 - DNA, 20 bp, Artificial
  CRISPR gRNA sequence
gcttcttttctgttgccttt

SEQ ID NO: 421311 - DNA, 20 bp, Artificial
  CRISPR gRNA sequence
cttcttttctgttgcctttc

SEQ ID NO: 421312 - DNA, 20 bp, Artificial
  CRISPR gRNA sequence
gttgcctttcaggaactttc

SEQ ID NO: 421313 - DNA, 20 bp, Artificial
  CRISPR gRNA sequence
ttgcctttcaggaactttcc

SEQ ID NO: 421314 - DNA, 20 bp, Artificial
  CRISPR gRNA sequence
actttccaggaaaacattat

SEQ ID NO: 421315 - DNA, 20 bp, Artificial
  CRISPR gRNA sequence
aattgaaaatgtctttttca

SEQ ID NO: 421316 - DNA, 20 bp, Artificial
  CRISPR gRNA sequence
aatgtctttttcacagattc

SEQ ID NO: 421317 - DNA, 20 bp, Artificial
  CRISPR gRNA sequence
tgtctttttcacagattcca

SEQ ID NO: 421318 - DNA, 20 bp, Artificial
  CRISPR gRNA sequence
gtctttttcacagattccag

SEQ ID NO: 421319 - DNA, 20 bp, Artificial
  CRISPR gRNA sequence
gattccagaggttctaccac

SEQ ID NO: 421320 - DNA, 20 bp, Artificial
  CRISPR gRNA sequence
ttccagaggttctaccacta

SEQ ID NO: 421321 - DNA, 20 bp, Artificial
  CRISPR gRNA sequence
atttcttctatattaaaaat

SEQ ID NO: 421322 - DNA, 20 bp, Artificial
  CRISPR gRNA sequence
ttcttctatattaaaaatca

SEQ ID NO: 421323 - DNA, 20 bp, Artificial
  CRISPR gRNA sequence
aatcagagtcaaatatttct

SEQ ID NO: 421324 - DNA, 20 bp, Artificial
  CRISPR gRNA sequence
atcagagtcaaatatttctg

SEQ ID NO: 421325 - DNA, 20 bp, Artificial
  CRISPR gRNA sequence
tcagagtcaaatatttctga

SEQ ID NO: 421326 - DNA, 20 bp, Artificial
  CRISPR gRNA sequence
agagtcaaatatttctgagg

SEQ ID NO: 421327 - DNA, 20 bp, Artificial
  CRISPR gRNA sequence
gagtcaaatatttctgaggg

SEQ ID NO: 421328 - DNA, 20 bp, Artificial
  CRISPR gRNA sequence
agtcaaatatttctgaggga

SEQ ID NO: 421329 - DNA, 20 bp, Artificial
  CRISPR gRNA sequence
gtcaaatatttctgagggag

SEQ ID NO: 421330 - DNA, 20 bp, Artificial
  CRISPR gRNA sequence
acacaaatatttaaaaactg

SEQ ID NO: 421331 - DNA, 20 bp, Artificial
  CRISPR gRNA sequence
ttaaaaactgtggtataaat

SEQ ID NO: 421332 - DNA, 20 bp, Artificial
  CRISPR gRNA sequence
tgttgccttctgaactatct

SEQ ID NO: 421333 - DNA, 20 bp, Artificial
  CRISPR gRNA sequence
gttgccttctgaactatctg

SEQ ID NO: 421334 - DNA, 20 bp, Artificial
  CRISPR gRNA sequence
ccttctgaactatctgagga

SEQ ID NO: 421335 - DNA, 20 bp, Artificial
  CRISPR gRNA sequence
ttctgaactatctgaggatg

SEQ ID NO: 421336 - DNA, 20 bp, Artificial
  CRISPR gRNA sequence
tctgaggatggagatgtgcc

SEQ ID NO: 421337 - DNA, 20 bp, Artificial
  CRISPR gRNA sequence
ctgaggatggagatgtgccc

SEQ ID NO: 421338 - DNA, 20 bp, Artificial
  CRISPR gRNA sequence
tgaggatggagatgtgccca

SEQ ID NO: 421339 - DNA, 20 bp, Artificial
  CRISPR gRNA sequence
ggagatgtgcccagggttgc

SEQ ID NO: 421340 - DNA, 20 bp, Artificial
  CRISPR gRNA sequence
gagatgtgcccagggttgct

SEQ ID NO: 421341 - DNA, 20 bp, Artificial
  CRISPR gRNA sequence
agatgtgcccagggttgctg

SEQ ID NO: 421342 - DNA, 20 bp, Artificial
  CRISPR gRNA sequence
atgtgcccagggttgctggg

SEQ ID NO: 421343 - DNA, 20 bp, Artificial
  CRISPR gRNA sequence
gtgcccagggttgctgggga

SEQ ID NO: 421344 - DNA, 20 bp, Artificial
  CRISPR gRNA sequence
tgcccagggttgctggggag

SEQ ID NO: 421345 - DNA, 20 bp, Artificial
  CRISPR gRNA sequence
agggttgctggggagaggtt

SEQ ID NO: 421346 - DNA, 20 bp, Artificial
  CRISPR gRNA sequence
ctggggagaggttaagtgct

SEQ ID NO: 421347 - DNA, 20 bp, Artificial
  CRISPR gRNA sequence
ggggagaggttaagtgctga

SEQ ID NO: 421348 - DNA, 20 bp, Artificial
  CRISPR gRNA sequence
gggagaggttaagtgctgag

SEQ ID NO: 421349 - DNA, 20 bp, Artificial
  CRISPR gRNA sequence
ggagaggttaagtgctgaga

SEQ ID NO: 421350 - DNA, 20 bp, Artificial
  CRISPR gRNA sequence
gaggttaagtgctgagaggg

SEQ ID NO: 421351 - DNA, 20 bp, Artificial
  CRISPR gRNA sequence
gctgagagggtggttatgcc

SEQ ID NO: 421352 - DNA, 20 bp, Artificial
  CRISPR gRNA sequence
ctgagagggtggttatgcct

SEQ ID NO: 421353 - DNA, 20 bp, Artificial
  CRISPR gRNA sequence
gagagggtggttatgcctgg

SEQ ID NO: 421354 - DNA, 20 bp, Artificial
  CRISPR gRNA sequence
agggtggttatgcctgggag

SEQ ID NO: 421355 - DNA, 20 bp, Artificial
  CRISPR gRNA sequence
gtggttatgcctgggagaag

SEQ ID NO: 421356 - DNA, 20 bp, Artificial
  CRISPR gRNA sequence
tggttatgcctgggagaagc

SEQ ID NO: 421357 - DNA, 20 bp, Artificial
  CRISPR gRNA sequence
ggttatgcctgggagaagca

SEQ ID NO: 421358 - DNA, 20 bp, Artificial
  CRISPR gRNA sequence
gagaagcagggtttcctgct

SEQ ID NO: 421359 - DNA, 20 bp, Artificial
  CRISPR gRNA sequence
tgctaagcttcctttgctat

SEQ ID NO: 421360 - DNA, 20 bp, Artificial
  CRISPR gRNA sequence
tcctttgctattggatttct

SEQ ID NO: 421361 - DNA, 20 bp, Artificial
  CRISPR gRNA sequence
tggatttcttggctttcctg

SEQ ID NO: 421362 - DNA, 20 bp, Artificial
  CRISPR gRNA sequence
ggatttcttggctttcctga

SEQ ID NO: 421363 - DNA, 20 bp, Artificial
  CRISPR gRNA sequence
ggctttcctgaaggtttttt

SEQ ID NO: 421364 - DNA, 20 bp, Artificial
  CRISPR gRNA sequence
gctttcctgaaggttttttc

SEQ ID NO: 421365 - DNA, 20 bp, Artificial
  CRISPR gRNA sequence
gcaaatgacaatcaaccaaa

SEQ ID NO: 421366 - DNA, 20 bp, Artificial
  CRISPR gRNA sequence
atgacaatcaaccaaacagc

SEQ ID NO: 421367 - DNA, 20 bp, Artificial
  CRISPR gRNA sequence
tgacaatcaaccaaacagca

SEQ ID NO: 421368 - DNA, 20 bp, Artificial
  CRISPR gRNA sequence
aacagcaaggttttatttca

SEQ ID NO: 421369 - DNA, 20 bp, Artificial
  CRISPR gRNA sequence
acagcaaggttttatttcaa

SEQ ID NO: 421370 - DNA, 20 bp, Artificial
  CRISPR gRNA sequence
atttcaaaggataatgcatc

SEQ ID NO: 421371 - DNA, 20 bp, Artificial
  CRISPR gRNA sequence
aaaggataatgcatccagca

SEQ ID NO: 421372 - DNA, 20 bp, Artificial
  CRISPR gRNA sequence
taatgcatccagcatagaac

SEQ ID NO: 421373 - DNA, 20 bp, Artificial
  CRISPR gRNA sequence
aatgcatccagcatagaact

SEQ ID NO: 421374 - DNA, 20 bp, Artificial
  CRISPR gRNA sequence
tccagcatagaactaggccg

SEQ ID NO: 421375 - DNA, 20 bp, Artificial
  CRISPR gRNA sequence
ccagcatagaactaggccgc

SEQ ID NO: 421376 - DNA, 20 bp, Artificial
  CRISPR gRNA sequence
gcatagaactaggccgcagg

SEQ ID NO: 421377 - DNA, 20 bp, Artificial
  CRISPR gRNA sequence
aaaacaaaacaaaataaaaa

SEQ ID NO: 421378 - DNA, 20 bp, Artificial
  CRISPR gRNA sequence
acaaaacaaaataaaaacag

SEQ ID NO: 421379 - DNA, 20 bp, Artificial
  CRISPR gRNA sequence
aaaacaaaataaaaacagaa

SEQ ID NO: 421380 - DNA, 20 bp, Artificial
  CRISPR gRNA sequence
aaacaaaataaaaacagaag

SEQ ID NO: 421381 - DNA, 20 bp, Artificial
  CRISPR gRNA sequence
caaaataaaaacagaagagg

SEQ ID NO: 421382 - DNA, 20 bp, Artificial
  CRISPR gRNA sequence
aaaaacagaagaggtggtat

SEQ ID NO: 421383 - DNA, 20 bp, Artificial
  CRISPR gRNA sequence
aagaggtggtatcagctgac

SEQ ID NO: 421384 - DNA, 20 bp, Artificial
  CRISPR gRNA sequence
agaggtggtatcagctgaca

SEQ ID NO: 421385 - DNA, 20 bp, Artificial
  CRISPR gRNA sequence
gaggtggtatcagctgacaa

SEQ ID NO: 421386 - DNA, 20 bp, Artificial
  CRISPR gRNA sequence
ctgacaagggcttatattct

SEQ ID NO: 421387 - DNA, 20 bp, Artificial
  CRISPR gRNA sequence
acaagggcttatattctaag

SEQ ID NO: 421388 - DNA, 20 bp, Artificial
  CRISPR gRNA sequence
caagggcttatattctaagt

SEQ ID NO: 421389 - DNA, 20 bp, Artificial
  CRISPR gRNA sequence
gggcttatattctaagtggg

SEQ ID NO: 421390 - DNA, 20 bp, Artificial
  CRISPR gRNA sequence
ttctaagtgggtagacaaaa

SEQ ID NO: 421391 - DNA, 20 bp, Artificial
  CRISPR gRNA sequence
tctaagtgggtagacaaaat

SEQ ID NO: 421392 - DNA, 20 bp, Artificial
  CRISPR gRNA sequence
aataggcctacgaaaataac

SEQ ID NO: 421393 - DNA, 20 bp, Artificial
  CRISPR gRNA sequence
ggcctacgaaaataacaagc

SEQ ID NO: 421394 - DNA, 20 bp, Artificial
  CRISPR gRNA sequence
aaaataacaagctggccatg

SEQ ID NO: 421395 - DNA, 20 bp, Artificial
  CRISPR gRNA sequence
aagctggccatgaagctaca

SEQ ID NO: 421396 - DNA, 20 bp, Artificial
  CRISPR gRNA sequence
ctggccatgaagctacatag

SEQ ID NO: 421397 - DNA, 20 bp, Artificial
  CRISPR gRNA sequence
agctacatagcagaatatgc

SEQ ID NO: 421398 - DNA, 20 bp, Artificial
  CRISPR gRNA sequence
gctacatagcagaatatgcg

SEQ ID NO: 421399 - DNA, 20 bp, Artificial
  CRISPR gRNA sequence
ctacatagcagaatatgcga

SEQ ID NO: 421400 - DNA, 20 bp, Artificial
  CRISPR gRNA sequence
tacatagcagaatatgcgag

SEQ ID NO: 421401 - DNA, 20 bp, Artificial
  CRISPR gRNA sequence
acatagcagaatatgcgagg

SEQ ID NO: 421402 - DNA, 20 bp, Artificial
  CRISPR gRNA sequence
atgcgagggggcaacgtgct

SEQ ID NO: 421403 - DNA, 20 bp, Artificial
  CRISPR gRNA sequence
gggcaacgtgctaagttgtg

SEQ ID NO: 421404 - DNA, 20 bp, Artificial
  CRISPR gRNA sequence
gtgctaagttgtgtagtcat

SEQ ID NO: 421405 - DNA, 20 bp, Artificial
  CRISPR gRNA sequence
taagttgtgtagtcataagc

SEQ ID NO: 421406 - DNA, 20 bp, Artificial
  CRISPR gRNA sequence
aagttgtgtagtcataagcc

SEQ ID NO: 421407 - DNA, 20 bp, Artificial
  CRISPR gRNA sequence
gtagtcataagccaggcatt

SEQ ID NO: 421408 - DNA, 20 bp, Artificial
  CRISPR gRNA sequence
tcataagccaggcatttagt

SEQ ID NO: 421409 - DNA, 20 bp, Artificial
  CRISPR gRNA sequence
cataagccaggcatttagta

SEQ ID NO: 421410 - DNA, 20 bp, Artificial
  CRISPR gRNA sequence
aaggtgctaattatacaata

SEQ ID NO: 421411 - DNA, 20 bp, Artificial
  CRISPR gRNA sequence
aggtgctaattatacaatac

SEQ ID NO: 421412 - DNA, 20 bp, Artificial
  CRISPR gRNA sequence
tgctaattatacaatacagg

SEQ ID NO: 421413 - DNA, 20 bp, Artificial
  CRISPR gRNA sequence
aatacaggcagtgaatgtga

SEQ ID NO: 421414 - DNA, 20 bp, Artificial
  CRISPR gRNA sequence
atacaggcagtgaatgtgaa

SEQ ID NO: 421415 - DNA, 20 bp, Artificial
  CRISPR gRNA sequence
ggcagtgaatgtgaaaggaa

SEQ ID NO: 421416 - DNA, 20 bp, Artificial
  CRISPR gRNA sequence
gcagtgaatgtgaaaggaaa

SEQ ID NO: 421417 - DNA, 20 bp, Artificial
  CRISPR gRNA sequence
cagtgaatgtgaaaggaaaa

SEQ ID NO: 421418 - DNA, 20 bp, Artificial
  CRISPR gRNA sequence
gtgaatgtgaaaggaaaagg

SEQ ID NO: 421419 - DNA, 20 bp, Artificial
  CRISPR gRNA sequence
tgaatgtgaaaggaaaaggg

SEQ ID NO: 421420 - DNA, 20 bp, Artificial
  CRISPR gRNA sequence
gtgaaaggaaaagggaggtt

SEQ ID NO: 421421 - DNA, 20 bp, Artificial
  CRISPR gRNA sequence
aaggaaaagggaggttgaga

SEQ ID NO: 421422 - DNA, 20 bp, Artificial
  CRISPR gRNA sequence
aggaaaagggaggttgagat

SEQ ID NO: 421423 - DNA, 20 bp, Artificial
  CRISPR gRNA sequence
aagggaggttgagatgggct

SEQ ID NO: 421424 - DNA, 20 bp, Artificial
  CRISPR gRNA sequence
agggaggttgagatgggctg

SEQ ID NO: 421425 - DNA, 20 bp, Artificial
  CRISPR gRNA sequence
tgagatgggctgaggtcttc

SEQ ID NO: 421426 - DNA, 20 bp, Artificial
  CRISPR gRNA sequence
gagatgggctgaggtcttct

SEQ ID NO: 421427 - DNA, 20 bp, Artificial
  CRISPR gRNA sequence
gatgggctgaggtcttctag

SEQ ID NO: 421428 - DNA, 20 bp, Artificial
  CRISPR gRNA sequence
atgggctgaggtcttctagg

SEQ ID NO: 421429 - DNA, 20 bp, Artificial
  CRISPR gRNA sequence
ggctgaggtcttctaggagg

SEQ ID NO: 421430 - DNA, 20 bp, Artificial
  CRISPR gRNA sequence
gctgaggtcttctaggaggc

SEQ ID NO: 421431 - DNA, 20 bp, Artificial
  CRISPR gRNA sequence
ctgaggtcttctaggaggcg

SEQ ID NO: 421432 - DNA, 20 bp, Artificial
  CRISPR gRNA sequence
gaggtcttctaggaggcggg

SEQ ID NO: 421433 - DNA, 20 bp, Artificial
  CRISPR gRNA sequence
aggtcttctaggaggcgggg

SEQ ID NO: 421434 - DNA, 20 bp, Artificial
  CRISPR gRNA sequence
ggtcttctaggaggcgggga

SEQ ID NO: 421435 - DNA, 20 bp, Artificial
  CRISPR gRNA sequence
tcttctaggaggcggggagg

SEQ ID NO: 421436 - DNA, 20 bp, Artificial
  CRISPR gRNA sequence
taggaggcggggagggagtg

SEQ ID NO: 421437 - DNA, 20 bp, Artificial
  CRISPR gRNA sequence
ggagggagtgcagccttgac

SEQ ID NO: 421438 - DNA, 20 bp, Artificial
  CRISPR gRNA sequence
agccttgacaagcctccctg

SEQ ID NO: 421439 - DNA, 20 bp, Artificial
  CRISPR gRNA sequence
gccttgacaagcctccctgt

SEQ ID NO: 421440 - DNA, 20 bp, Artificial
  CRISPR gRNA sequence
tgacaagcctccctgtgggc

SEQ ID NO: 421441 - DNA, 20 bp, Artificial
  CRISPR gRNA sequence
gacaagcctccctgtgggcg

SEQ ID NO: 421442 - DNA, 20 bp, Artificial
  CRISPR gRNA sequence
ctccctgtgggcgaggtgta

SEQ ID NO: 421443 - DNA, 20 bp, Artificial
  CRISPR gRNA sequence
ccctgtgggcgaggtgtaaa

SEQ ID NO: 421444 - DNA, 20 bp, Artificial
  CRISPR gRNA sequence
cctgtgggcgaggtgtaaag

SEQ ID NO: 421445 - DNA, 20 bp, Artificial
  CRISPR gRNA sequence
ctgtgggcgaggtgtaaaga

SEQ ID NO: 421446 - DNA, 20 bp, Artificial
  CRISPR gRNA sequence
tgtgggcgaggtgtaaagag

SEQ ID NO: 421447 - DNA, 20 bp, Artificial
  CRISPR gRNA sequence
gggcgaggtgtaaagagggg

SEQ ID NO: 421448 - DNA, 20 bp, Artificial
  CRISPR gRNA sequence
cgaggtgtaaagaggggcag

SEQ ID NO: 421449 - DNA, 20 bp, Artificial
  CRISPR gRNA sequence
gtgtaaagaggggcagaagt

SEQ ID NO: 421450 - DNA, 20 bp, Artificial
  CRISPR gRNA sequence
agaggggcagaagtcagctc

SEQ ID NO: 421451 - DNA, 20 bp, Artificial
  CRISPR gRNA sequence
ggggcagaagtcagctctgg

SEQ ID NO: 421452 - DNA, 20 bp, Artificial
  CRISPR gRNA sequence
agaagtcagctctggaagca

SEQ ID NO: 421453 - DNA, 20 bp, Artificial
  CRISPR gRNA sequence
gaagtcagctctggaagcat

SEQ ID NO: 421454 - DNA, 20 bp, Artificial
  CRISPR gRNA sequence
aagtcagctctggaagcata

SEQ ID NO: 421455 - DNA, 20 bp, Artificial
  CRISPR gRNA sequence
tcagctctggaagcataggg

SEQ ID NO: 421456 - DNA, 20 bp, Artificial
  CRISPR gRNA sequence
gctctggaagcatagggcag

SEQ ID NO: 421457 - DNA, 20 bp, Artificial
  CRISPR gRNA sequence
ctctggaagcatagggcagt

SEQ ID NO: 421458 - DNA, 20 bp, Artificial
  CRISPR gRNA sequence
tggaagcatagggcagtggg

SEQ ID NO: 421459 - DNA, 20 bp, Artificial
  CRISPR gRNA sequence
ggaagcatagggcagtgggt

SEQ ID NO: 421460 - DNA, 20 bp, Artificial
  CRISPR gRNA sequence
gaagcatagggcagtgggtg

SEQ ID NO: 421461 - DNA, 20 bp, Artificial
  CRISPR gRNA sequence
agcatagggcagtgggtggg

SEQ ID NO: 421462 - DNA, 20 bp, Artificial
  CRISPR gRNA sequence
gcatagggcagtgggtgggg

SEQ ID NO: 421463 - DNA, 20 bp, Artificial
  CRISPR gRNA sequence
atagggcagtgggtggggag

SEQ ID NO: 421464 - DNA, 20 bp, Artificial
  CRISPR gRNA sequence
ggcagtgggtggggaggaga

SEQ ID NO: 421465 - DNA, 20 bp, Artificial
  CRISPR gRNA sequence
gcagtgggtggggaggagat

SEQ ID NO: 421466 - DNA, 20 bp, Artificial
  CRISPR gRNA sequence
tgggtggggaggagatgggc

SEQ ID NO: 421467 - DNA, 20 bp, Artificial
  CRISPR gRNA sequence
gggtggggaggagatgggct

SEQ ID NO: 421468 - DNA, 20 bp, Artificial
  CRISPR gRNA sequence
ggggaggagatgggctgggc

SEQ ID NO: 421469 - DNA, 20 bp, Artificial
  CRISPR gRNA sequence
gggaggagatgggctgggct

SEQ ID NO: 421470 - DNA, 20 bp, Artificial
  CRISPR gRNA sequence
ggagatgggctgggctgggc

SEQ ID NO: 421471 - DNA, 20 bp, Artificial
  CRISPR gRNA sequence
agatgggctgggctgggctg

SEQ ID NO: 421472 - DNA, 20 bp, Artificial
  CRISPR gRNA sequence
tgggctgggctgggctggag

SEQ ID NO: 421473 - DNA, 20 bp, Artificial
  CRISPR gRNA sequence
ggctgggctgggctggagta

SEQ ID NO: 421474 - DNA, 20 bp, Artificial
  CRISPR gRNA sequence
tgggctggagtagagatgtg

SEQ ID NO: 421475 - DNA, 20 bp, Artificial
  CRISPR gRNA sequence
ggctggagtagagatgtgtg

SEQ ID NO: 421476 - DNA, 20 bp, Artificial
  CRISPR gRNA sequence
tggagtagagatgtgtggag

SEQ ID NO: 421477 - DNA, 20 bp, Artificial
  CRISPR gRNA sequence
ggagtagagatgtgtggaga

SEQ ID NO: 421478 - DNA, 20 bp, Artificial
  CRISPR gRNA sequence
gagtagagatgtgtggagaa

SEQ ID NO: 421479 - DNA, 20 bp, Artificial
  CRISPR gRNA sequence
agagatgtgtggagaagggt

SEQ ID NO: 421480 - DNA, 20 bp, Artificial
  CRISPR gRNA sequence
gatgtgtggagaagggtgag

SEQ ID NO: 421481 - DNA, 20 bp, Artificial
  CRISPR gRNA sequence
gtggagaagggtgagaagac

SEQ ID NO: 421482 - DNA, 20 bp, Artificial
  CRISPR gRNA sequence
agaagggtgagaagactgga

SEQ ID NO: 421483 - DNA, 20 bp, Artificial
  CRISPR gRNA sequence
gactggaaagacaacctgaa

SEQ ID NO: 421484 - DNA, 20 bp, Artificial
  CRISPR gRNA sequence
actggaaagacaacctgaat

SEQ ID NO: 421485 - DNA, 20 bp, Artificial
  CRISPR gRNA sequence
ctggaaagacaacctgaatg

SEQ ID NO: 421486 - DNA, 20 bp, Artificial
  CRISPR gRNA sequence
tggaaagacaacctgaatgg

SEQ ID NO: 421487 - DNA, 20 bp, Artificial
  CRISPR gRNA sequence
agacaacctgaatgggggac

SEQ ID NO: 421488 - DNA, 20 bp, Artificial
  CRISPR gRNA sequence
gacaacctgaatgggggact

SEQ ID NO: 421489 - DNA, 20 bp, Artificial
  CRISPR gRNA sequence
caacctgaatgggggactgg

SEQ ID NO: 421490 - DNA, 20 bp, Artificial
  CRISPR gRNA sequence
ggactgggagccttgaataa

SEQ ID NO: 421491 - DNA, 20 bp, Artificial
  CRISPR gRNA sequence
gactgggagccttgaataac

SEQ ID NO: 421492 - DNA, 20 bp, Artificial
  CRISPR gRNA sequence
ggagccttgaataacaggca

SEQ ID NO: 421493 - DNA, 20 bp, Artificial
  CRISPR gRNA sequence
agccttgaataacaggcatg

SEQ ID NO: 421494 - DNA, 20 bp, Artificial
  CRISPR gRNA sequence
ccttgaataacaggcatgga

SEQ ID NO: 421495 - DNA, 20 bp, Artificial
  CRISPR gRNA sequence
cttgaataacaggcatggag

SEQ ID NO: 421496 - DNA, 20 bp, Artificial
  CRISPR gRNA sequence
tgaataacaggcatggagag

SEQ ID NO: 421497 - DNA, 20 bp, Artificial
  CRISPR gRNA sequence
gagaggagcgtctcttgaaa

SEQ ID NO: 421498 - DNA, 20 bp, Artificial
  CRISPR gRNA sequence
aggagcgtctcttgaaatgg

SEQ ID NO: 421499 - DNA, 20 bp, Artificial
  CRISPR gRNA sequence
gtctcttgaaatggaagaaa

SEQ ID NO: 421500 - DNA, 20 bp, Artificial
  CRISPR gRNA sequence
tctcttgaaatggaagaaac

SEQ ID NO: 421501 - DNA, 20 bp, Artificial
  CRISPR gRNA sequence
gaagaaacaggaaataatta

SEQ ID NO: 421502 - DNA, 20 bp, Artificial
  CRISPR gRNA sequence
ggaaataattacagcctcta

SEQ ID NO: 421503 - DNA, 20 bp, Artificial
  CRISPR gRNA sequence
aaataattacagcctctatg

SEQ ID NO: 421504 - DNA, 20 bp, Artificial
  CRISPR gRNA sequence
aataattacagcctctatgg

SEQ ID NO: 421505 - DNA, 20 bp, Artificial
  CRISPR gRNA sequence
taattacagcctctatggag

SEQ ID NO: 421506 - DNA, 20 bp, Artificial
  CRISPR gRNA sequence
cagcctctatggaggagcaa

SEQ ID NO: 421507 - DNA, 20 bp, Artificial
  CRISPR gRNA sequence
agcctctatggaggagcaac

SEQ ID NO: 421508 - DNA, 20 bp, Artificial
  CRISPR gRNA sequence
tctatggaggagcaacagga

SEQ ID NO: 421509 - DNA, 20 bp, Artificial
  CRISPR gRNA sequence
ggaggagcaacaggatggac

SEQ ID NO: 421510 - DNA, 20 bp, Artificial
  CRISPR gRNA sequence
aggagcaacaggatggactg

SEQ ID NO: 421511 - DNA, 20 bp, Artificial
  CRISPR gRNA sequence
gaaactatcattccaaaatc

SEQ ID NO: 421512 - DNA, 20 bp, Artificial
  CRISPR gRNA sequence
ctatcattccaaaatccagt

SEQ ID NO: 421513 - DNA, 20 bp, Artificial
  CRISPR gRNA sequence
tatcattccaaaatccagtt

SEQ ID NO: 421514 - DNA, 20 bp, Artificial
  CRISPR gRNA sequence
atcattccaaaatccagttg

SEQ ID NO: 421515 - DNA, 20 bp, Artificial
  CRISPR gRNA sequence
aaaatccagttggggcctca

SEQ ID NO: 421516 - DNA, 20 bp, Artificial
  CRISPR gRNA sequence
aaatccagttggggcctcaa

SEQ ID NO: 421517 - DNA, 20 bp, Artificial
  CRISPR gRNA sequence
gttggggcctcaaaggccct

SEQ ID NO: 421518 - DNA, 20 bp, Artificial
  CRISPR gRNA sequence
aaaggcccttagaatttttc

SEQ ID NO: 421519 - DNA, 20 bp, Artificial
  CRISPR gRNA sequence
aaggcccttagaatttttct

SEQ ID NO: 421520 - DNA, 20 bp, Artificial
  CRISPR gRNA sequence
gcccttagaatttttctagg

SEQ ID NO: 421521 - DNA, 20 bp, Artificial
  CRISPR gRNA sequence
cccttagaatttttctagga

SEQ ID NO: 421522 - DNA, 20 bp, Artificial
  CRISPR gRNA sequence
gaatttttctaggaaggttg

SEQ ID NO: 421523 - DNA, 20 bp, Artificial
  CRISPR gRNA sequence
aatttttctaggaaggttga

SEQ ID NO: 421524 - DNA, 20 bp, Artificial
  CRISPR gRNA sequence
tttctaggaaggttgaaggc

SEQ ID NO: 421525 - DNA, 20 bp, Artificial
  CRISPR gRNA sequence
ttgaaggccagctgctgacc

SEQ ID NO: 421526 - DNA, 20 bp, Artificial
  CRISPR gRNA sequence
tgaaggccagctgctgaccc

SEQ ID NO: 421527 - DNA, 20 bp, Artificial
  CRISPR gRNA sequence
atgtgcttcgtcctcttccc

SEQ ID NO: 421528 - DNA, 20 bp, Artificial
  CRISPR gRNA sequence
tgtgcttcgtcctcttccct

SEQ ID NO: 421529 - DNA, 20 bp, Artificial
  CRISPR gRNA sequence
ctcttccctaggaatgatga

SEQ ID NO: 421530 - DNA, 20 bp, Artificial
  CRISPR gRNA sequence
tcttccctaggaatgatgac

SEQ ID NO: 421531 - DNA, 20 bp, Artificial
  CRISPR gRNA sequence
aggaatgatgacaggcacaa

SEQ ID NO: 421532 - DNA, 20 bp, Artificial
  CRISPR gRNA sequence
gacaggcacaatagaaacaa

SEQ ID NO: 421533 - DNA, 20 bp, Artificial
  CRISPR gRNA sequence
acaggcacaatagaaacaac

SEQ ID NO: 421534 - DNA, 20 bp, Artificial
  CRISPR gRNA sequence
caggcacaatagaaacaacg

SEQ ID NO: 421535 - DNA, 20 bp, Artificial
  CRISPR gRNA sequence
aacaacggggaacatttctg

SEQ ID NO: 421536 - DNA, 20 bp, Artificial
  CRISPR gRNA sequence
caacggggaacatttctgca

SEQ ID NO: 421537 - DNA, 20 bp, Artificial
  CRISPR gRNA sequence
ggggaacatttctgcagaga

SEQ ID NO: 421538 - DNA, 20 bp, Artificial
  CRISPR gRNA sequence
gggaacatttctgcagagaa

SEQ ID NO: 421539 - DNA, 20 bp, Artificial
  CRISPR gRNA sequence
aacatttctgcagagaaagg

SEQ ID NO: 421540 - DNA, 20 bp, Artificial
  CRISPR gRNA sequence
atgtcacctctcctccacca

SEQ ID NO: 421541 - DNA, 20 bp, Artificial
  CRISPR gRNA sequence
cctctcctccaccacggcac

SEQ ID NO: 421542 - DNA, 20 bp, Artificial
  CRISPR gRNA sequence
ccaccacggcacaagtgacc

SEQ ID NO: 421543 - DNA, 20 bp, Artificial
  CRISPR gRNA sequence
caccacggcacaagtgaccc

SEQ ID NO: 421544 - DNA, 20 bp, Artificial
  CRISPR gRNA sequence
cacaagtgacccaggtcaac

SEQ ID NO: 421545 - DNA, 20 bp, Artificial
  CRISPR gRNA sequence
acaagtgacccaggtcaact

SEQ ID NO: 421546 - DNA, 20 bp, Artificial
  CRISPR gRNA sequence
aagtgacccaggtcaactgg

SEQ ID NO: 421547 - DNA, 20 bp, Artificial
  CRISPR gRNA sequence
tgacccaggtcaactgggag

SEQ ID NO: 421548 - DNA, 20 bp, Artificial
  CRISPR gRNA sequence
cccaggtcaactgggagcag

SEQ ID NO: 421549 - DNA, 20 bp, Artificial
  CRISPR gRNA sequence
ccaggtcaactgggagcagc

SEQ ID NO: 421550 - DNA, 20 bp, Artificial
  CRISPR gRNA sequence
tcaactgggagcagcaggac

SEQ ID NO: 421551 - DNA, 20 bp, Artificial
  CRISPR gRNA sequence
ggagcagcaggaccagcttc

SEQ ID NO: 421552 - DNA, 20 bp, Artificial
  CRISPR gRNA sequence
ggccatttgtaatgctgact

SEQ ID NO: 421553 - DNA, 20 bp, Artificial
  CRISPR gRNA sequence
gccatttgtaatgctgactt

SEQ ID NO: 421554 - DNA, 20 bp, Artificial
  CRISPR gRNA sequence
ccatttgtaatgctgacttg

SEQ ID NO: 421555 - DNA, 20 bp, Artificial
  CRISPR gRNA sequence
tttgtaatgctgacttgggg

SEQ ID NO: 421556 - DNA, 20 bp, Artificial
  CRISPR gRNA sequence
ggcacatctccccatccttc

SEQ ID NO: 421557 - DNA, 20 bp, Artificial
  CRISPR gRNA sequence
gcacatctccccatccttca

SEQ ID NO: 421558 - DNA, 20 bp, Artificial
  CRISPR gRNA sequence
ctccccatccttcaaggatc

SEQ ID NO: 421559 - DNA, 20 bp, Artificial
  CRISPR gRNA sequence
cccatccttcaaggatcgag

SEQ ID NO: 421560 - DNA, 20 bp, Artificial
  CRISPR gRNA sequence
cttcaaggatcgagtggccc

SEQ ID NO: 421561 - DNA, 20 bp, Artificial
  CRISPR gRNA sequence
ttcaaggatcgagtggcccc

SEQ ID NO: 421562 - DNA, 20 bp, Artificial
  CRISPR gRNA sequence
gatcgagtggccccaggtcc

SEQ ID NO: 421563 - DNA, 20 bp, Artificial
  CRISPR gRNA sequence
agtggccccaggtcccggcc

SEQ ID NO: 421564 - DNA, 20 bp, Artificial
  CRISPR gRNA sequence
gtggccccaggtcccggcct

SEQ ID NO: 421565 - DNA, 20 bp, Artificial
  CRISPR gRNA sequence
ccggcctgggcctcaccctc

SEQ ID NO: 421566 - DNA, 20 bp, Artificial
  CRISPR gRNA sequence
gtcgctgaccgtgaacgata

SEQ ID NO: 421567 - DNA, 20 bp, Artificial
  CRISPR gRNA sequence
tcgctgaccgtgaacgatac

SEQ ID NO: 421568 - DNA, 20 bp, Artificial
  CRISPR gRNA sequence
cgctgaccgtgaacgataca

SEQ ID NO: 421569 - DNA, 20 bp, Artificial
  CRISPR gRNA sequence
gctgaccgtgaacgatacag

SEQ ID NO: 421570 - DNA, 20 bp, Artificial
  CRISPR gRNA sequence
tgaccgtgaacgatacaggg

SEQ ID NO: 421571 - DNA, 20 bp, Artificial
  CRISPR gRNA sequence
atctatcacacctaccctga

SEQ ID NO: 421572 - DNA, 20 bp, Artificial
  CRISPR gRNA sequence
tctatcacacctaccctgat

SEQ ID NO: 421573 - DNA, 20 bp, Artificial
  CRISPR gRNA sequence
taccctgatgggacgtacac

SEQ ID NO: 421574 - DNA, 20 bp, Artificial
  CRISPR gRNA sequence
accctgatgggacgtacact

SEQ ID NO: 421575 - DNA, 20 bp, Artificial
  CRISPR gRNA sequence
cctgatgggacgtacactgg

SEQ ID NO: 421576 - DNA, 20 bp, Artificial
  CRISPR gRNA sequence
gtacactgggagaatcttcc

SEQ ID NO: 421577 - DNA, 20 bp, Artificial
  CRISPR gRNA sequence
acactgggagaatcttcctg

SEQ ID NO: 421578 - DNA, 20 bp, Artificial
  CRISPR gRNA sequence
cactgggagaatcttcctgg

SEQ ID NO: 421579 - DNA, 20 bp, Artificial
  CRISPR gRNA sequence
gagaatcttcctggaggtcc

SEQ ID NO: 421580 - DNA, 20 bp, Artificial
  CRISPR gRNA sequence
atcttcctggaggtcctaga

SEQ ID NO: 421581 - DNA, 20 bp, Artificial
  CRISPR gRNA sequence
cctggaggtcctagaaagct

SEQ ID NO: 421582 - DNA, 20 bp, Artificial
  CRISPR gRNA sequence
ctggaggtcctagaaagctc

SEQ ID NO: 421583 - DNA, 20 bp, Artificial
  CRISPR gRNA sequence
gaaagctcaggtattcctgc

SEQ ID NO: 421584 - DNA, 20 bp, Artificial
  CRISPR gRNA sequence
aagctcaggtattcctgctg

SEQ ID NO: 421585 - DNA, 20 bp, Artificial
  CRISPR gRNA sequence
tcaggtattcctgctggagc

SEQ ID NO: 421586 - DNA, 20 bp, Artificial
  CRISPR gRNA sequence
gtattcctgctggagcaagt

SEQ ID NO: 421587 - DNA, 20 bp, Artificial
  CRISPR gRNA sequence
ttcctgctggagcaagttgg

SEQ ID NO: 421588 - DNA, 20 bp, Artificial
  CRISPR gRNA sequence
ggtggataaacctctccctc

SEQ ID NO: 421589 - DNA, 20 bp, Artificial
  CRISPR gRNA sequence
ataaacctctccctctagca

SEQ ID NO: 421590 - DNA, 20 bp, Artificial
  CRISPR gRNA sequence
tgcaatcctgaaacactgca

SEQ ID NO: 421591 - DNA, 20 bp, Artificial
  CRISPR gRNA sequence
aatcctgaaacactgcacag

SEQ ID NO: 421592 - DNA, 20 bp, Artificial
  CRISPR gRNA sequence
atcctgaaacactgcacagc

SEQ ID NO: 421593 - DNA, 20 bp, Artificial
  CRISPR gRNA sequence
tcctgaaacactgcacagca

SEQ ID NO: 421594 - DNA, 20 bp, Artificial
  CRISPR gRNA sequence
cacagcagggcttctcaatt

SEQ ID NO: 421595 - DNA, 20 bp, Artificial
  CRISPR gRNA sequence
acagcagggcttctcaattc

SEQ ID NO: 421596 - DNA, 20 bp, Artificial
  CRISPR gRNA sequence
ggatcacatttgaatcacct

SEQ ID NO: 421597 - DNA, 20 bp, Artificial
  CRISPR gRNA sequence
gatcacatttgaatcacctg

SEQ ID NO: 421598 - DNA, 20 bp, Artificial
  CRISPR gRNA sequence
tcacatttgaatcacctgag

SEQ ID NO: 421599 - DNA, 20 bp, Artificial
  CRISPR gRNA sequence
ttttaaatcatactgatgcc

SEQ ID NO: 421600 - DNA, 20 bp, Artificial
  CRISPR gRNA sequence
tttaaatcatactgatgccg

SEQ ID NO: 421601 - DNA, 20 bp, Artificial
  CRISPR gRNA sequence
actgatgccgaggcctcacc

SEQ ID NO: 421602 - DNA, 20 bp, Artificial
  CRISPR gRNA sequence
ctcacccagaccaattcaat

SEQ ID NO: 421603 - DNA, 20 bp, Artificial
  CRISPR gRNA sequence
aattcaatcagaatccctaa

SEQ ID NO: 421604 - DNA, 20 bp, Artificial
  CRISPR gRNA sequence
tcaatcagaatccctaatag

SEQ ID NO: 421605 - DNA, 20 bp, Artificial
  CRISPR gRNA sequence
aatcagaatccctaatagca

SEQ ID NO: 421606 - DNA, 20 bp, Artificial
  CRISPR gRNA sequence
ccctaatagcagagctaaac

SEQ ID NO: 421607 - DNA, 20 bp, Artificial
  CRISPR gRNA sequence
cctaatagcagagctaaaca

SEQ ID NO: 421608 - DNA, 20 bp, Artificial
  CRISPR gRNA sequence
ctaatagcagagctaaacaa

SEQ ID NO: 421609 - DNA, 20 bp, Artificial
  CRISPR gRNA sequence
tagcagagctaaacaagggt

SEQ ID NO: 421610 - DNA, 20 bp, Artificial
  CRISPR gRNA sequence
agcagagctaaacaagggta

SEQ ID NO: 421611 - DNA, 20 bp, Artificial
  CRISPR gRNA sequence
taaacaagggtaaggtctaa

SEQ ID NO: 421612 - DNA, 20 bp, Artificial
  CRISPR gRNA sequence
gtaaggtctaaaagcatttc

SEQ ID NO: 421613 - DNA, 20 bp, Artificial
  CRISPR gRNA sequence
taaggtctaaaagcatttcc

SEQ ID NO: 421614 - DNA, 20 bp, Artificial
  CRISPR gRNA sequence
gcatttccaggtgattctaa

SEQ ID NO: 421615 - DNA, 20 bp, Artificial
  CRISPR gRNA sequence
catttccaggtgattctaat

SEQ ID NO: 421616 - DNA, 20 bp, Artificial
  CRISPR gRNA sequence
ttccaggtgattctaatggg

SEQ ID NO: 421617 - DNA, 20 bp, Artificial
  CRISPR gRNA sequence
tctaatgggcagccaatact

SEQ ID NO: 421618 - DNA, 20 bp, Artificial
  CRISPR gRNA sequence
gagaaccactgttcttatgt

SEQ ID NO: 421619 - DNA, 20 bp, Artificial
  CRISPR gRNA sequence
aaccactgttcttatgtaag

SEQ ID NO: 421620 - DNA, 20 bp, Artificial
  CRISPR gRNA sequence
cacatcttacctatatttcc

SEQ ID NO: 421621 - DNA, 20 bp, Artificial
  CRISPR gRNA sequence
acatcttacctatatttcct

SEQ ID NO: 421622 - DNA, 20 bp, Artificial
  CRISPR gRNA sequence
tcttacctatatttcctagg

SEQ ID NO: 421623 - DNA, 20 bp, Artificial
  CRISPR gRNA sequence
cctatatttcctaggaagac

SEQ ID NO: 421624 - DNA, 20 bp, Artificial
  CRISPR gRNA sequence
tcctaggaagaccagttgat

SEQ ID NO: 421625 - DNA, 20 bp, Artificial
  CRISPR gRNA sequence
cctaggaagaccagttgatg

SEQ ID NO: 421626 - DNA, 20 bp, Artificial
  CRISPR gRNA sequence
gttgatgaggtcatatgcaa

SEQ ID NO: 421627 - DNA, 20 bp, Artificial
  CRISPR gRNA sequence
atgcaaaagttcccatttat

SEQ ID NO: 421628 - DNA, 20 bp, Artificial
  CRISPR gRNA sequence
aaagttcccatttattggtt

SEQ ID NO: 421629 - DNA, 20 bp, Artificial
  CRISPR gRNA sequence
tttagtataattgtgcaaat

SEQ ID NO: 421630 - DNA, 20 bp, Artificial
  CRISPR gRNA sequence
gcaaattagaattaacccct

SEQ ID NO: 421631 - DNA, 20 bp, Artificial
  CRISPR gRNA sequence
aattaacccctaagtgtata

SEQ ID NO: 421632 - DNA, 20 bp, Artificial
  CRISPR gRNA sequence
ttaacccctaagtgtataaa

SEQ ID NO: 421633 - DNA, 20 bp, Artificial
  CRISPR gRNA sequence
acccctaagtgtataaagag

SEQ ID NO: 421634 - DNA, 20 bp, Artificial
  CRISPR gRNA sequence
ccctaagtgtataaagagta

SEQ ID NO: 421635 - DNA, 20 bp, Artificial
  CRISPR gRNA sequence
aagtgtataaagagtagagc

SEQ ID NO: 421636 - DNA, 20 bp, Artificial
  CRISPR gRNA sequence
agtagagctggttaaaaaca

SEQ ID NO: 421637 - DNA, 20 bp, Artificial
  CRISPR gRNA sequence
ttaaaaacatagcctgtgct

SEQ ID NO: 421638 - DNA, 20 bp, Artificial
  CRISPR gRNA sequence
ctgtgctaagtttaattgta

SEQ ID NO: 421639 - DNA, 20 bp, Artificial
  CRISPR gRNA sequence
tacagtaatttacatttgtg

SEQ ID NO: 421640 - DNA, 20 bp, Artificial
  CRISPR gRNA sequence
tacatttgtgtggtacttcc

SEQ ID NO: 421641 - DNA, 20 bp, Artificial
  CRISPR gRNA sequence
tgtacatttaaaccaattcc

SEQ ID NO: 421642 - DNA, 20 bp, Artificial
  CRISPR gRNA sequence
tacatttaaaccaattccca

SEQ ID NO: 421643 - DNA, 20 bp, Artificial
  CRISPR gRNA sequence
acatttaaaccaattcccag

SEQ ID NO: 421644 - DNA, 20 bp, Artificial
  CRISPR gRNA sequence
ttaaaccaattcccagaggt

SEQ ID NO: 421645 - DNA, 20 bp, Artificial
  CRISPR gRNA sequence
ccaattcccagaggttagaa

SEQ ID NO: 421646 - DNA, 20 bp, Artificial
  CRISPR gRNA sequence
caattcccagaggttagaaa

SEQ ID NO: 421647 - DNA, 20 bp, Artificial
  CRISPR gRNA sequence
aaaggattcttatcttatct

SEQ ID NO: 421648 - DNA, 20 bp, Artificial
  CRISPR gRNA sequence
aggattcttatcttatctga

SEQ ID NO: 421649 - DNA, 20 bp, Artificial
  CRISPR gRNA sequence
ttcttatcttatctgagaga

SEQ ID NO: 421650 - DNA, 20 bp, Artificial
  CRISPR gRNA sequence
atcttatctgagagacagta

SEQ ID NO: 421651 - DNA, 20 bp, Artificial
  CRISPR gRNA sequence
tgagagacagtatagcacca

SEQ ID NO: 421652 - DNA, 20 bp, Artificial
  CRISPR gRNA sequence
cagtatagcaccatggttaa

SEQ ID NO: 421653 - DNA, 20 bp, Artificial
  CRISPR gRNA sequence
tagcaccatggttaaaagct

SEQ ID NO: 421654 - DNA, 20 bp, Artificial
  CRISPR gRNA sequence
aaaagctcagactctgacac

SEQ ID NO: 421655 - DNA, 20 bp, Artificial
  CRISPR gRNA sequence
gctcagactctgacaccaga

SEQ ID NO: 421656 - DNA, 20 bp, Artificial
  CRISPR gRNA sequence
gactctgacaccagacagtc

SEQ ID NO: 421657 - DNA, 20 bp, Artificial
  CRISPR gRNA sequence
actctgacaccagacagtct

SEQ ID NO: 421658 - DNA, 20 bp, Artificial
  CRISPR gRNA sequence
gacagtctgggtgcaaatcc

SEQ ID NO: 421659 - DNA, 20 bp, Artificial
  CRISPR gRNA sequence
cctggctctgctgttgccct

SEQ ID NO: 421660 - DNA, 20 bp, Artificial
  CRISPR gRNA sequence
gctctgctgttgccctcaga

SEQ ID NO: 421661 - DNA, 20 bp, Artificial
  CRISPR gRNA sequence
ctctgctgttgccctcagac

SEQ ID NO: 421662 - DNA, 20 bp, Artificial
  CRISPR gRNA sequence
tgccctcagacaggatttct

SEQ ID NO: 421663 - DNA, 20 bp, Artificial
  CRISPR gRNA sequence
ttcttagcttctctgtgtat

SEQ ID NO: 421664 - DNA, 20 bp, Artificial
  CRISPR gRNA sequence
atcagttttctcatctgtga

SEQ ID NO: 421665 - DNA, 20 bp, Artificial
  CRISPR gRNA sequence
tcagttttctcatctgtgaa

SEQ ID NO: 421666 - DNA, 20 bp, Artificial
  CRISPR gRNA sequence
agttttctcatctgtgaaag

SEQ ID NO: 421667 - DNA, 20 bp, Artificial
  CRISPR gRNA sequence
gttttctcatctgtgaaagg

SEQ ID NO: 421668 - DNA, 20 bp, Artificial
  CRISPR gRNA sequence
tgtgaaaggaggatgaatat

SEQ ID NO: 421669 - DNA, 20 bp, Artificial
  CRISPR gRNA sequence
gaccttatgcgatgctaatg

SEQ ID NO: 421670 - DNA, 20 bp, Artificial
  CRISPR gRNA sequence
accttatgcgatgctaatgt

SEQ ID NO: 421671 - DNA, 20 bp, Artificial
  CRISPR gRNA sequence
aggattaaattccctactac

SEQ ID NO: 421672 - DNA, 20 bp, Artificial
  CRISPR gRNA sequence
aattccctactacaagaaaa

SEQ ID NO: 421673 - DNA, 20 bp, Artificial
  CRISPR gRNA sequence
ctactacaagaaaatggtct

SEQ ID NO: 421674 - DNA, 20 bp, Artificial
  CRISPR gRNA sequence
aatggtcttagaacaatgcc

SEQ ID NO: 421675 - DNA, 20 bp, Artificial
  CRISPR gRNA sequence
ttagaacaatgcctggaaca

SEQ ID NO: 421676 - DNA, 20 bp, Artificial
  CRISPR gRNA sequence
aacaatgcctggaacatggt

SEQ ID NO: 421677 - DNA, 20 bp, Artificial
  CRISPR gRNA sequence
gaacatggtaagtgctgtat

SEQ ID NO: 421678 - DNA, 20 bp, Artificial
  CRISPR gRNA sequence
gctgtataagtgttaactat

SEQ ID NO: 421679 - DNA, 20 bp, Artificial
  CRISPR gRNA sequence
tgattcccatttgtttgatg

SEQ ID NO: 421680 - DNA, 20 bp, Artificial
  CRISPR gRNA sequence
gattcccatttgtttgatgc

SEQ ID NO: 421681 - DNA, 20 bp, Artificial
  CRISPR gRNA sequence
tcccatttgtttgatgcagg

SEQ ID NO: 421682 - DNA, 20 bp, Artificial
  CRISPR gRNA sequence
catttgtttgatgcaggcag

SEQ ID NO: 421683 - DNA, 20 bp, Artificial
  CRISPR gRNA sequence
tgtttgatgcaggcagaagc

SEQ ID NO: 421684 - DNA, 20 bp, Artificial
  CRISPR gRNA sequence
tttgatgcaggcagaagctg

SEQ ID NO: 421685 - DNA, 20 bp, Artificial
  CRISPR gRNA sequence
tgcaggcagaagctggagct

SEQ ID NO: 421686 - DNA, 20 bp, Artificial
  CRISPR gRNA sequence
caggcagaagctggagcttg

SEQ ID NO: 421687 - DNA, 20 bp, Artificial
  CRISPR gRNA sequence
agctggagcttggagttgct

SEQ ID NO: 421688 - DNA, 20 bp, Artificial
  CRISPR gRNA sequence
ctggagcttggagttgctca

SEQ ID NO: 421689 - DNA, 20 bp, Artificial
  CRISPR gRNA sequence
gagcttggagttgctcagag

SEQ ID NO: 421690 - DNA, 20 bp, Artificial
  CRISPR gRNA sequence
cttggagttgctcagagtgg

SEQ ID NO: 421691 - DNA, 20 bp, Artificial
  CRISPR gRNA sequence
tggagttgctcagagtggta

SEQ ID NO: 421692 - DNA, 20 bp, Artificial
  CRISPR gRNA sequence
tggtagagctgattttaaca

SEQ ID NO: 421693 - DNA, 20 bp, Artificial
  CRISPR gRNA sequence
gttctactaaactgcatcct

SEQ ID NO: 421694 - DNA, 20 bp, Artificial
  CRISPR gRNA sequence
gaactcctatttactgctgt

SEQ ID NO: 421695 - DNA, 20 bp, Artificial
  CRISPR gRNA sequence
tactgctgtcagttatgttg

SEQ ID NO: 421696 - DNA, 20 bp, Artificial
  CRISPR gRNA sequence
tgtcagttatgttgaagatt

SEQ ID NO: 421697 - DNA, 20 bp, Artificial
  CRISPR gRNA sequence
atgttgaagattaagttata

SEQ ID NO: 421698 - DNA, 20 bp, Artificial
  CRISPR gRNA sequence
ttgcaaaatatgtgtaaact

SEQ ID NO: 421699 - DNA, 20 bp, Artificial
  CRISPR gRNA sequence
caaaatatgtgtaaactgag

SEQ ID NO: 421700 - DNA, 20 bp, Artificial
  CRISPR gRNA sequence
tgtgtaaactgagaagataa

SEQ ID NO: 421701 - DNA, 20 bp, Artificial
  CRISPR gRNA sequence
gtgtaaactgagaagataaa

SEQ ID NO: 421702 - DNA, 20 bp, Artificial
  CRISPR gRNA sequence
gaagataaaaggttacctta

SEQ ID NO: 421703 - DNA, 20 bp, Artificial
  CRISPR gRNA sequence
tttttttttttttttttttt

SEQ ID NO: 421704 - DNA, 20 bp, Artificial
  CRISPR gRNA sequence
ttttttttttttttttgaga

SEQ ID NO: 421705 - DNA, 20 bp, Artificial
  CRISPR gRNA sequence
ttttttttttttttgagacg

SEQ ID NO: 421706 - DNA, 20 bp, Artificial
  CRISPR gRNA sequence
ggagtttcgctcttgttgcc

SEQ ID NO: 421707 - DNA, 20 bp, Artificial
  CRISPR gRNA sequence
gagtttcgctcttgttgccc

SEQ ID NO: 421708 - DNA, 20 bp, Artificial
  CRISPR gRNA sequence
ttcgctcttgttgcccaggc

SEQ ID NO: 421709 - DNA, 20 bp, Artificial
  CRISPR gRNA sequence
cgctcttgttgcccaggctg

SEQ ID NO: 421710 - DNA, 20 bp, Artificial
  CRISPR gRNA sequence
ttgcccaggctggagtgcaa

SEQ ID NO: 421711 - DNA, 20 bp, Artificial
  CRISPR gRNA sequence
ggagtgcaatggcgcaatct

SEQ ID NO: 421712 - DNA, 20 bp, Artificial
  CRISPR gRNA sequence
cactgcaacttccgcctcct

SEQ ID NO: 421713 - DNA, 20 bp, Artificial
  CRISPR gRNA sequence
aacttccgcctcctgagttc

SEQ ID NO: 421714 - DNA, 20 bp, Artificial
  CRISPR gRNA sequence
caagcgattctctcctgcct

SEQ ID NO: 421715 - DNA, 20 bp, Artificial
  CRISPR gRNA sequence
ctctcctgcctcagcctcct

SEQ ID NO: 421716 - DNA, 20 bp, Artificial
  CRISPR gRNA sequence
gcctcagcctcctgagtatc

SEQ ID NO: 421717 - DNA, 20 bp, Artificial
  CRISPR gRNA sequence
cctcagcctcctgagtatct

SEQ ID NO: 421718 - DNA, 20 bp, Artificial
  CRISPR gRNA sequence
ctcctgagtatctgggatta

SEQ ID NO: 421719 - DNA, 20 bp, Artificial
  CRISPR gRNA sequence
tcctgagtatctgggattac

SEQ ID NO: 421720 - DNA, 20 bp, Artificial
  CRISPR gRNA sequence
caggcacccaccaccatgcc

SEQ ID NO: 421721 - DNA, 20 bp, Artificial
  CRISPR gRNA sequence
cccggctaattttgtatttt

SEQ ID NO: 421722 - DNA, 20 bp, Artificial
  CRISPR gRNA sequence
ggctaattttgtatttttag

SEQ ID NO: 421723 - DNA, 20 bp, Artificial
  CRISPR gRNA sequence
ctaattttgtatttttagta

SEQ ID NO: 421724 - DNA, 20 bp, Artificial
  CRISPR gRNA sequence
ttttgtatttttagtagaga

SEQ ID NO: 421725 - DNA, 20 bp, Artificial
  CRISPR gRNA sequence
tttgtatttttagtagagac

SEQ ID NO: 421726 - DNA, 20 bp, Artificial
  CRISPR gRNA sequence
ttgtatttttagtagagaca

SEQ ID NO: 421727 - DNA, 20 bp, Artificial
  CRISPR gRNA sequence
gagacagggtttcttcacgt

SEQ ID NO: 421728 - DNA, 20 bp, Artificial
  CRISPR gRNA sequence
cagggtttcttcacgttggt

SEQ ID NO: 421729 - DNA, 20 bp, Artificial
  CRISPR gRNA sequence
agggtttcttcacgttggtc

SEQ ID NO: 421730 - DNA, 20 bp, Artificial
  CRISPR gRNA sequence
tttcttcacgttggtcaggc

SEQ ID NO: 421731 - DNA, 20 bp, Artificial
  CRISPR gRNA sequence
ggtctcaaactcccgacctc

SEQ ID NO: 421732 - DNA, 20 bp, Artificial
  CRISPR gRNA sequence
ctccagtgatctgcccgcct

SEQ ID NO: 421733 - DNA, 20 bp, Artificial
  CRISPR gRNA sequence
ctgcccgcctcagcctccca

SEQ ID NO: 421734 - DNA, 20 bp, Artificial
  CRISPR gRNA sequence
acttcttaactgatttcaca

SEQ ID NO: 421735 - DNA, 20 bp, Artificial
  CRISPR gRNA sequence
cttcttaactgatttcacat

SEQ ID NO: 421736 - DNA, 20 bp, Artificial
  CRISPR gRNA sequence
gatttcacataggccaaaca

SEQ ID NO: 421737 - DNA, 20 bp, Artificial
  CRISPR gRNA sequence
cacataggccaaacaaagac

SEQ ID NO: 421738 - DNA, 20 bp, Artificial
  CRISPR gRNA sequence
aggccaaacaaagactggtt

SEQ ID NO: 421739 - DNA, 20 bp, Artificial
  CRISPR gRNA sequence
gccaaacaaagactggttaa

SEQ ID NO: 421740 - DNA, 20 bp, Artificial
  CRISPR gRNA sequence
acaaagactggttaagagtt

SEQ ID NO: 421741 - DNA, 20 bp, Artificial
  CRISPR gRNA sequence
caaagactggttaagagttg

SEQ ID NO: 421742 - DNA, 20 bp, Artificial
  CRISPR gRNA sequence
ctggttaagagttgaggctc

SEQ ID NO: 421743 - DNA, 20 bp, Artificial
  CRISPR gRNA sequence
ggctctggaattgcactgtc

SEQ ID NO: 421744 - DNA, 20 bp, Artificial
  CRISPR gRNA sequence
gctctggaattgcactgtct

SEQ ID NO: 421745 - DNA, 20 bp, Artificial
  CRISPR gRNA sequence
ctctggaattgcactgtctg

SEQ ID NO: 421746 - DNA, 20 bp, Artificial
  CRISPR gRNA sequence
ctgtctggggttgactattg

SEQ ID NO: 421747 - DNA, 20 bp, Artificial
  CRISPR gRNA sequence
ctattgcagttgaccccacg

SEQ ID NO: 421748 - DNA, 20 bp, Artificial
  CRISPR gRNA sequence
gcagttgaccccacgaagtc

SEQ ID NO: 421749 - DNA, 20 bp, Artificial
  CRISPR gRNA sequence
cagttgaccccacgaagtct

SEQ ID NO: 421750 - DNA, 20 bp, Artificial
  CRISPR gRNA sequence
aaattatgtactttttttct

SEQ ID NO: 421751 - DNA, 20 bp, Artificial
  CRISPR gRNA sequence
gttttcttgtcgataaaatg

SEQ ID NO: 421752 - DNA, 20 bp, Artificial
  CRISPR gRNA sequence
aatgtggcaaataatttcat

SEQ ID NO: 421753 - DNA, 20 bp, Artificial
  CRISPR gRNA sequence
ataatttcatgagctgatac

SEQ ID NO: 421754 - DNA, 20 bp, Artificial
  CRISPR gRNA sequence
tttcatgagctgatacaagt

SEQ ID NO: 421755 - DNA, 20 bp, Artificial
  CRISPR gRNA sequence
ttcatgagctgatacaagta

SEQ ID NO: 421756 - DNA, 20 bp, Artificial
  CRISPR gRNA sequence
atacaagtaaggtcttacaa

SEQ ID NO: 421757 - DNA, 20 bp, Artificial
  CRISPR gRNA sequence
gtaaggtcttacaacagtgc

SEQ ID NO: 421758 - DNA, 20 bp, Artificial
  CRISPR gRNA sequence
ggtcttacaacagtgctaga

SEQ ID NO: 421759 - DNA, 20 bp, Artificial
  CRISPR gRNA sequence
gtcttacaacagtgctagat

SEQ ID NO: 421760 - DNA, 20 bp, Artificial
  CRISPR gRNA sequence
aacagtgctagataggtaat

SEQ ID NO: 421761 - DNA, 20 bp, Artificial
  CRISPR gRNA sequence
ggtaataagcttaacttcat

SEQ ID NO: 421762 - DNA, 20 bp, Artificial
  CRISPR gRNA sequence
gtaataagcttaacttcata

SEQ ID NO: 421763 - DNA, 20 bp, Artificial
  CRISPR gRNA sequence
taataagcttaacttcataa

SEQ ID NO: 421764 - DNA, 20 bp, Artificial
  CRISPR gRNA sequence
aagcttaacttcataagggc

SEQ ID NO: 421765 - DNA, 20 bp, Artificial
  CRISPR gRNA sequence
ctagtttttatgctatttat

SEQ ID NO: 421766 - DNA, 20 bp, Artificial
  CRISPR gRNA sequence
ttatgctatttattggttca

SEQ ID NO: 421767 - DNA, 20 bp, Artificial
  CRISPR gRNA sequence
gctatttattggttcatggt

SEQ ID NO: 421768 - DNA, 20 bp, Artificial
  CRISPR gRNA sequence
tatttattggttcatggtta

SEQ ID NO: 421769 - DNA, 20 bp, Artificial
  CRISPR gRNA sequence
atttattggttcatggttag

SEQ ID NO: 421770 - DNA, 20 bp, Artificial
  CRISPR gRNA sequence
ttattggttcatggttagag

SEQ ID NO: 421771 - DNA, 20 bp, Artificial
  CRISPR gRNA sequence
tattggttcatggttagagg

SEQ ID NO: 421772 - DNA, 20 bp, Artificial
  CRISPR gRNA sequence
gttcatggttagaggaggcc

SEQ ID NO: 421773 - DNA, 20 bp, Artificial
  CRISPR gRNA sequence
ttcatggttagaggaggcct

SEQ ID NO: 421774 - DNA, 20 bp, Artificial
  CRISPR gRNA sequence
tagaggaggcctgggacaat

SEQ ID NO: 421775 - DNA, 20 bp, Artificial
  CRISPR gRNA sequence
aggaggcctgggacaataag

SEQ ID NO: 421776 - DNA, 20 bp, Artificial
  CRISPR gRNA sequence
ggaggcctgggacaataagc

SEQ ID NO: 421777 - DNA, 20 bp, Artificial
  CRISPR gRNA sequence
gaggcctgggacaataagca

SEQ ID NO: 421778 - DNA, 20 bp, Artificial
  CRISPR gRNA sequence
gcctgggacaataagcaggg

SEQ ID NO: 421779 - DNA, 20 bp, Artificial
  CRISPR gRNA sequence
cctgggacaataagcagggc

SEQ ID NO: 421780 - DNA, 20 bp, Artificial
  CRISPR gRNA sequence
ctgggacaataagcagggca

SEQ ID NO: 421781 - DNA, 20 bp, Artificial
  CRISPR gRNA sequence
tgggacaataagcagggcag

SEQ ID NO: 421782 - DNA, 20 bp, Artificial
  CRISPR gRNA sequence
aataagcagggcaggggacc

SEQ ID NO: 421783 - DNA, 20 bp, Artificial
  CRISPR gRNA sequence
agggcaggggacctagattc

SEQ ID NO: 421784 - DNA, 20 bp, Artificial
  CRISPR gRNA sequence
aggggacctagattctggca

SEQ ID NO: 421785 - DNA, 20 bp, Artificial
  CRISPR gRNA sequence
tagattctggcaaagtaacc

SEQ ID NO: 421786 - DNA, 20 bp, Artificial
  CRISPR gRNA sequence
ctggcaaagtaaccaagtga

SEQ ID NO: 421787 - DNA, 20 bp, Artificial
  CRISPR gRNA sequence
agtgatggccttgaccattc

SEQ ID NO: 421788 - DNA, 20 bp, Artificial
  CRISPR gRNA sequence
gtgatggccttgaccattct

SEQ ID NO: 421789 - DNA, 20 bp, Artificial
  CRISPR gRNA sequence
ccattctgggctctttaccc

SEQ ID NO: 421790 - DNA, 20 bp, Artificial
  CRISPR gRNA sequence
tttaccccagtgtcatatgc

SEQ ID NO: 421791 - DNA, 20 bp, Artificial
  CRISPR gRNA sequence
taccccagtgtcatatgcca

SEQ ID NO: 421792 - DNA, 20 bp, Artificial
  CRISPR gRNA sequence
accccagtgtcatatgccag

SEQ ID NO: 421793 - DNA, 20 bp, Artificial
  CRISPR gRNA sequence
tatgccagaggacccatcac

SEQ ID NO: 421794 - DNA, 20 bp, Artificial
  CRISPR gRNA sequence
ccagaggacccatcaccaga

SEQ ID NO: 421795 - DNA, 20 bp, Artificial
  CRISPR gRNA sequence
gaggacccatcaccagacgg

SEQ ID NO: 421796 - DNA, 20 bp, Artificial
  CRISPR gRNA sequence
aggacccatcaccagacggc

SEQ ID NO: 421797 - DNA, 20 bp, Artificial
  CRISPR gRNA sequence
ccatcaccagacggcaggac

SEQ ID NO: 421798 - DNA, 20 bp, Artificial
  CRISPR gRNA sequence
catcaccagacggcaggacc

SEQ ID NO: 421799 - DNA, 20 bp, Artificial
  CRISPR gRNA sequence
ccagacggcaggaccgggaa

SEQ ID NO: 421800 - DNA, 20 bp, Artificial
  CRISPR gRNA sequence
cagacggcaggaccgggaac

SEQ ID NO: 421801 - DNA, 20 bp, Artificial
  CRISPR gRNA sequence
agacggcaggaccgggaaca

SEQ ID NO: 421802 - DNA, 20 bp, Artificial
  CRISPR gRNA sequence
acggcaggaccgggaacagg

SEQ ID NO: 421803 - DNA, 20 bp, Artificial
  CRISPR gRNA sequence
cggcaggaccgggaacaggg

SEQ ID NO: 421804 - DNA, 20 bp, Artificial
  CRISPR gRNA sequence
ggcaggaccgggaacaggga

SEQ ID NO: 421805 - DNA, 20 bp, Artificial
  CRISPR gRNA sequence
caggaccgggaacagggagg

SEQ ID NO: 421806 - DNA, 20 bp, Artificial
  CRISPR gRNA sequence
ggaacagggagggagttcat

SEQ ID NO: 421807 - DNA, 20 bp, Artificial
  CRISPR gRNA sequence
gaacagggagggagttcatc

SEQ ID NO: 421808 - DNA, 20 bp, Artificial
  CRISPR gRNA sequence
cagggagggagttcatcagg

SEQ ID NO: 421809 - DNA, 20 bp, Artificial
  CRISPR gRNA sequence
ggagggagttcatcaggcag

SEQ ID NO: 421810 - DNA, 20 bp, Artificial
  CRISPR gRNA sequence
gagggagttcatcaggcaga

SEQ ID NO: 421811 - DNA, 20 bp, Artificial
  CRISPR gRNA sequence
catcaggcagaaggcccctg

SEQ ID NO: 421812 - DNA, 20 bp, Artificial
  CRISPR gRNA sequence
tcaggcagaaggcccctgtg

SEQ ID NO: 421813 - DNA, 20 bp, Artificial
  CRISPR gRNA sequence
ggcagaaggcccctgtggag

SEQ ID NO: 421814 - DNA, 20 bp, Artificial
  CRISPR gRNA sequence
agaaggcccctgtggagtgg

SEQ ID NO: 421815 - DNA, 20 bp, Artificial
  CRISPR gRNA sequence
cccctgtggagtggtagtac

SEQ ID NO: 421816 - DNA, 20 bp, Artificial
  CRISPR gRNA sequence
agtggtagtaccagcaactg

SEQ ID NO: 421817 - DNA, 20 bp, Artificial
  CRISPR gRNA sequence
accagcaactgaagaccaaa

SEQ ID NO: 421818 - DNA, 20 bp, Artificial
  CRISPR gRNA sequence
ccagcaactgaagaccaaat

SEQ ID NO: 421819 - DNA, 20 bp, Artificial
  CRISPR gRNA sequence
agcaactgaagaccaaatgg

SEQ ID NO: 421820 - DNA, 20 bp, Artificial
  CRISPR gRNA sequence
gaccaaatgggagctatgtc

SEQ ID NO: 421821 - DNA, 20 bp, Artificial
  CRISPR gRNA sequence
tatgtctggttgctaatctc

SEQ ID NO: 421822 - DNA, 20 bp, Artificial
  CRISPR gRNA sequence
atgtctggttgctaatctcc

SEQ ID NO: 421823 - DNA, 20 bp, Artificial
  CRISPR gRNA sequence
ctggttgctaatctccaggc

SEQ ID NO: 421824 - DNA, 20 bp, Artificial
  CRISPR gRNA sequence
tggttgctaatctccaggcc

SEQ ID NO: 421825 - DNA, 20 bp, Artificial
  CRISPR gRNA sequence
tctccaggccaggccattca

SEQ ID NO: 421826 - DNA, 20 bp, Artificial
  CRISPR gRNA sequence
tccaggccaggccattcatg

SEQ ID NO: 421827 - DNA, 20 bp, Artificial
  CRISPR gRNA sequence
gccaggccattcatggagat

SEQ ID NO: 421828 - DNA, 20 bp, Artificial
  CRISPR gRNA sequence
aggccattcatggagatcgg

SEQ ID NO: 421829 - DNA, 20 bp, Artificial
  CRISPR gRNA sequence
tgacatgcacactcctcccc

SEQ ID NO: 421830 - DNA, 20 bp, Artificial
  CRISPR gRNA sequence
cacactcctccccaagacca

SEQ ID NO: 421831 - DNA, 20 bp, Artificial
  CRISPR gRNA sequence
actcctccccaagaccacag

SEQ ID NO: 421832 - DNA, 20 bp, Artificial
  CRISPR gRNA sequence
tccccaagaccacagtggca

SEQ ID NO: 421833 - DNA, 20 bp, Artificial
  CRISPR gRNA sequence
acagtggcacggctatttcc

SEQ ID NO: 421834 - DNA, 20 bp, Artificial
  CRISPR gRNA sequence
gctatttcccagcctgaacc

SEQ ID NO: 421835 - DNA, 20 bp, Artificial
  CRISPR gRNA sequence
ctatttcccagcctgaacct

SEQ ID NO: 421836 - DNA, 20 bp, Artificial
  CRISPR gRNA sequence
tatttcccagcctgaacctg

SEQ ID NO: 421837 - DNA, 20 bp, Artificial
  CRISPR gRNA sequence
agcctgaacctggggaaatg

SEQ ID NO: 421838 - DNA, 20 bp, Artificial
  CRISPR gRNA sequence
gcctgaacctggggaaatga

SEQ ID NO: 421839 - DNA, 20 bp, Artificial
  CRISPR gRNA sequence
aggtgcaaatttcttctctg

SEQ ID NO: 421840 - DNA, 20 bp, Artificial
  CRISPR gRNA sequence
aatttcttctctgtggctca

SEQ ID NO: 421841 - DNA, 20 bp, Artificial
  CRISPR gRNA sequence
ctctgtggctcatggacccc

SEQ ID NO: 421842 - DNA, 20 bp, Artificial
  CRISPR gRNA sequence
tctgtggctcatggacccct

SEQ ID NO: 421843 - DNA, 20 bp, Artificial
  CRISPR gRNA sequence
ctgtggctcatggacccctg

SEQ ID NO: 421844 - DNA, 20 bp, Artificial
  CRISPR gRNA sequence
gtggctcatggacccctggg

SEQ ID NO: 421845 - DNA, 20 bp, Artificial
  CRISPR gRNA sequence
ggctcatggacccctgggga

SEQ ID NO: 421846 - DNA, 20 bp, Artificial
  CRISPR gRNA sequence
ctcatggacccctggggaga

SEQ ID NO: 421847 - DNA, 20 bp, Artificial
  CRISPR gRNA sequence
ggacccctggggagagagat

SEQ ID NO: 421848 - DNA, 20 bp, Artificial
  CRISPR gRNA sequence
cccctggggagagagatcag

SEQ ID NO: 421849 - DNA, 20 bp, Artificial
  CRISPR gRNA sequence
gagatcagaagatgttctat

SEQ ID NO: 421850 - DNA, 20 bp, Artificial
  CRISPR gRNA sequence
tgttctattggacccctgtg

SEQ ID NO: 421851 - DNA, 20 bp, Artificial
  CRISPR gRNA sequence
ccctgtgcagcctccccaca

SEQ ID NO: 421852 - DNA, 20 bp, Artificial
  CRISPR gRNA sequence
tttccacccttttgccattg

SEQ ID NO: 421853 - DNA, 20 bp, Artificial
  CRISPR gRNA sequence
ccttttgccattgcagactc

SEQ ID NO: 421854 - DNA, 20 bp, Artificial
  CRISPR gRNA sequence
cttttgccattgcagactcc

SEQ ID NO: 421855 - DNA, 20 bp, Artificial
  CRISPR gRNA sequence
ttttgccattgcagactcca

SEQ ID NO: 421856 - DNA, 20 bp, Artificial
  CRISPR gRNA sequence
cagactccagggaacaccat

SEQ ID NO: 421857 - DNA, 20 bp, Artificial
  CRISPR gRNA sequence
agggaacaccattggtcact

SEQ ID NO: 421858 - DNA, 20 bp, Artificial
  CRISPR gRNA sequence
gctcttccctcttgtttccc

SEQ ID NO: 421859 - DNA, 20 bp, Artificial
  CRISPR gRNA sequence
cttccctcttgtttcccaag

SEQ ID NO: 421860 - DNA, 20 bp, Artificial
  CRISPR gRNA sequence
cctcttgtttcccaagtggt

SEQ ID NO: 421861 - DNA, 20 bp, Artificial
  CRISPR gRNA sequence
caagtggtcagttgcttatg

SEQ ID NO: 421862 - DNA, 20 bp, Artificial
  CRISPR gRNA sequence
ctctccttaattacttgcat

SEQ ID NO: 421863 - DNA, 20 bp, Artificial
  CRISPR gRNA sequence
acttgcattagcacaaaccc

SEQ ID NO: 421864 - DNA, 20 bp, Artificial
  CRISPR gRNA sequence
ttgaacctaatctcaaacct

SEQ ID NO: 421865 - DNA, 20 bp, Artificial
  CRISPR gRNA sequence
ctaatctcaaaccttagtcc

SEQ ID NO: 421866 - DNA, 20 bp, Artificial
  CRISPR gRNA sequence
taatactatctgtaatattt

SEQ ID NO: 421867 - DNA, 20 bp, Artificial
  CRISPR gRNA sequence
taaaattgtacttaacccca

SEQ ID NO: 421868 - DNA, 20 bp, Artificial
  CRISPR gRNA sequence
acttaaccccaaagtcaacc

SEQ ID NO: 421869 - DNA, 20 bp, Artificial
  CRISPR gRNA sequence
cccaaagtcaacctggttaa

SEQ ID NO: 421870 - DNA, 20 bp, Artificial
  CRISPR gRNA sequence
ccaaagtcaacctggttaat

SEQ ID NO: 421871 - DNA, 20 bp, Artificial
  CRISPR gRNA sequence
aagtcaacctggttaatagg

SEQ ID NO: 421872 - DNA, 20 bp, Artificial
  CRISPR gRNA sequence
tcaacctggttaataggcag

SEQ ID NO: 421873 - DNA, 20 bp, Artificial
  CRISPR gRNA sequence
ggttaataggcagaagtttt

SEQ ID NO: 421874 - DNA, 20 bp, Artificial
  CRISPR gRNA sequence
agttttaagtaacccttata

SEQ ID NO: 421875 - DNA, 20 bp, Artificial
  CRISPR gRNA sequence
ttttaagtaacccttataca

SEQ ID NO: 421876 - DNA, 20 bp, Artificial
  CRISPR gRNA sequence
ccccttccccaccctgcatg

SEQ ID NO: 421877 - DNA, 20 bp, Artificial
  CRISPR gRNA sequence
gtagtgatgtcatgcttact

SEQ ID NO: 421878 - DNA, 20 bp, Artificial
  CRISPR gRNA sequence
tagtgatgtcatgcttactc

SEQ ID NO: 421879 - DNA, 20 bp, Artificial
  CRISPR gRNA sequence
agtgatgtcatgcttactca

SEQ ID NO: 421880 - DNA, 20 bp, Artificial
  CRISPR gRNA sequence
tcagggctgcttctgtttca

SEQ ID NO: 421881 - DNA, 20 bp, Artificial
  CRISPR gRNA sequence
tctatgaccataactgtgaa

SEQ ID NO: 421882 - DNA, 20 bp, Artificial
  CRISPR gRNA sequence
tatgaccataactgtgaatg

SEQ ID NO: 421883 - DNA, 20 bp, Artificial
  CRISPR gRNA sequence
ataactgtgaatggagacat

SEQ ID NO: 421884 - DNA, 20 bp, Artificial
  CRISPR gRNA sequence
attgatacatctaatatccc

SEQ ID NO: 421885 - DNA, 20 bp, Artificial
  CRISPR gRNA sequence
taatatcccaagttccactc

SEQ ID NO: 421886 - DNA, 20 bp, Artificial
  CRISPR gRNA sequence
atctatcttcatctgtcccc

SEQ ID NO: 421887 - DNA, 20 bp, Artificial
  CRISPR gRNA sequence
tctatcttcatctgtcccca

SEQ ID NO: 421888 - DNA, 20 bp, Artificial
  CRISPR gRNA sequence
ttcatctgtccccaaggtgt

SEQ ID NO: 421889 - DNA, 20 bp, Artificial
  CRISPR gRNA sequence
catctgtccccaaggtgtaa

SEQ ID NO: 421890 - DNA, 20 bp, Artificial
  CRISPR gRNA sequence
ccccaaggtgtaagagaacc

SEQ ID NO: 421891 - DNA, 20 bp, Artificial
  CRISPR gRNA sequence
cccaaggtgtaagagaaccc

SEQ ID NO: 421892 - DNA, 20 bp, Artificial
  CRISPR gRNA sequence
gcctaaccctgcctccaatc

SEQ ID NO: 421893 - DNA, 20 bp, Artificial
  CRISPR gRNA sequence
actgatcatatatcctttcc

SEQ ID NO: 421894 - DNA, 20 bp, Artificial
  CRISPR gRNA sequence
tatatcctttcctggtttta

SEQ ID NO: 421895 - DNA, 20 bp, Artificial
  CRISPR gRNA sequence
tcctttcctggttttatgga

SEQ ID NO: 421896 - DNA, 20 bp, Artificial
  CRISPR gRNA sequence
gttttatggatagccctctg

SEQ ID NO: 421897 - DNA, 20 bp, Artificial
  CRISPR gRNA sequence
gcagcccctcttacctgctg

SEQ ID NO: 421898 - DNA, 20 bp, Artificial
  CRISPR gRNA sequence
tccatctgtcctctttactc

SEQ ID NO: 421899 - DNA, 20 bp, Artificial
  CRISPR gRNA sequence
catctgtcctctttactcca

SEQ ID NO: 421900 - DNA, 20 bp, Artificial
  CRISPR gRNA sequence
ttactccagagctaactgta

SEQ ID NO: 421901 - DNA, 20 bp, Artificial
  CRISPR gRNA sequence
cagagctaactgtatggcta

SEQ ID NO: 421902 - DNA, 20 bp, Artificial
  CRISPR gRNA sequence
actgtatggctatggctaac

SEQ ID NO: 421903 - DNA, 20 bp, Artificial
  CRISPR gRNA sequence
gtatggctatggctaaccag

SEQ ID NO: 421904 - DNA, 20 bp, Artificial
  CRISPR gRNA sequence
tggctaaccagaagccgtcc

SEQ ID NO: 421905 - DNA, 20 bp, Artificial
  CRISPR gRNA sequence
cgtcctggccaactgtgact

SEQ ID NO: 421906 - DNA, 20 bp, Artificial
  CRISPR gRNA sequence
caactgtgactgagtccctc

SEQ ID NO: 421907 - DNA, 20 bp, Artificial
  CRISPR gRNA sequence
aactgtgactgagtccctca

SEQ ID NO: 421908 - DNA, 20 bp, Artificial
  CRISPR gRNA sequence
tgtgactgagtccctcaagg

SEQ ID NO: 421909 - DNA, 20 bp, Artificial
  CRISPR gRNA sequence
gtgactgagtccctcaaggc

SEQ ID NO: 421910 - DNA, 20 bp, Artificial
  CRISPR gRNA sequence
gactgagtccctcaaggcag

SEQ ID NO: 421911 - DNA, 20 bp, Artificial
  CRISPR gRNA sequence
actgagtccctcaaggcagg

SEQ ID NO: 421912 - DNA, 20 bp, Artificial
  CRISPR gRNA sequence
aaggcaggaggaacatgttc

SEQ ID NO: 421913 - DNA, 20 bp, Artificial
  CRISPR gRNA sequence
aggcaggaggaacatgttct

SEQ ID NO: 421914 - DNA, 20 bp, Artificial
  CRISPR gRNA sequence
ggcaggaggaacatgttctg

SEQ ID NO: 421915 - DNA, 20 bp, Artificial
  CRISPR gRNA sequence
tctggggaatttgaattgtg

SEQ ID NO: 421916 - DNA, 20 bp, Artificial
  CRISPR gRNA sequence
ctggggaatttgaattgtgc

SEQ ID NO: 421917 - DNA, 20 bp, Artificial
  CRISPR gRNA sequence
caggcaccacccttgtctta

SEQ ID NO: 421918 - DNA, 20 bp, Artificial
  CRISPR gRNA sequence
accacccttgtcttatggat

SEQ ID NO: 421919 - DNA, 20 bp, Artificial
  CRISPR gRNA sequence
gtcttatggattggattcct

SEQ ID NO: 421920 - DNA, 20 bp, Artificial
  CRISPR gRNA sequence
tggattcctaagccaccttt

SEQ ID NO: 421921 - DNA, 20 bp, Artificial
  CRISPR gRNA sequence
taagccaccttttagcaacc

SEQ ID NO: 421922 - DNA, 20 bp, Artificial
  CRISPR gRNA sequence
cttttagcaacccagaccct

SEQ ID NO: 421923 - DNA, 20 bp, Artificial
  CRISPR gRNA sequence
ttttagcaacccagaccctt

SEQ ID NO: 421924 - DNA, 20 bp, Artificial
  CRISPR gRNA sequence
tagcaacccagacccttagg

SEQ ID NO: 421925 - DNA, 20 bp, Artificial
  CRISPR gRNA sequence
gcaacccagacccttaggta

SEQ ID NO: 421926 - DNA, 20 bp, Artificial
  CRISPR gRNA sequence
caacccagacccttaggtag

SEQ ID NO: 421927 - DNA, 20 bp, Artificial
  CRISPR gRNA sequence
aacccagacccttaggtaga

SEQ ID NO: 421928 - DNA, 20 bp, Artificial
  CRISPR gRNA sequence
agacccttaggtagagggat

SEQ ID NO: 421929 - DNA, 20 bp, Artificial
  CRISPR gRNA sequence
taggtagagggatgagatgt

SEQ ID NO: 421930 - DNA, 20 bp, Artificial
  CRISPR gRNA sequence
aggtagagggatgagatgtg

SEQ ID NO: 421931 - DNA, 20 bp, Artificial
  CRISPR gRNA sequence
ggcttctgctgcatcctttg

SEQ ID NO: 421932 - DNA, 20 bp, Artificial
  CRISPR gRNA sequence
gcatcctttgaagactcccc

SEQ ID NO: 421933 - DNA, 20 bp, Artificial
  CRISPR gRNA sequence
gaagactcccctggatacct

SEQ ID NO: 421934 - DNA, 20 bp, Artificial
  CRISPR gRNA sequence
tggatacctgagccctacct

SEQ ID NO: 421935 - DNA, 20 bp, Artificial
  CRISPR gRNA sequence
ctgagccctacctgagctgc

SEQ ID NO: 421936 - DNA, 20 bp, Artificial
  CRISPR gRNA sequence
tgagccctacctgagctgct

SEQ ID NO: 421937 - DNA, 20 bp, Artificial
  CRISPR gRNA sequence
gagccctacctgagctgctg

SEQ ID NO: 421938 - DNA, 20 bp, Artificial
  CRISPR gRNA sequence
ccctacctgagctgctgggg

SEQ ID NO: 421939 - DNA, 20 bp, Artificial
  CRISPR gRNA sequence
cctgagctgctggggcagac

SEQ ID NO: 421940 - DNA, 20 bp, Artificial
  CRISPR gRNA sequence
gcagactggaaacctaccta

SEQ ID NO: 421941 - DNA, 20 bp, Artificial
  CRISPR gRNA sequence
ctggaaacctacctacagcg

SEQ ID NO: 421942 - DNA, 20 bp, Artificial
  CRISPR gRNA sequence
tacctacagcgcagcatgca

SEQ ID NO: 421943 - DNA, 20 bp, Artificial
  CRISPR gRNA sequence
acctacagcgcagcatgcat

SEQ ID NO: 421944 - DNA, 20 bp, Artificial
  CRISPR gRNA sequence
cctacagcgcagcatgcatg

SEQ ID NO: 421945 - DNA, 20 bp, Artificial
  CRISPR gRNA sequence
ctacagcgcagcatgcatgg

SEQ ID NO: 421946 - DNA, 20 bp, Artificial
  CRISPR gRNA sequence
cgcagcatgcatgggggtga

SEQ ID NO: 421947 - DNA, 20 bp, Artificial
  CRISPR gRNA sequence
tctttttctcacattcttct

SEQ ID NO: 421948 - DNA, 20 bp, Artificial
  CRISPR gRNA sequence
ctttttctcacattcttctt

SEQ ID NO: 421949 - DNA, 20 bp, Artificial
  CRISPR gRNA sequence
ttctcacattcttcttgggt

SEQ ID NO: 421950 - DNA, 20 bp, Artificial
  CRISPR gRNA sequence
tatctcttaatgaaatgcac

SEQ ID NO: 421951 - DNA, 20 bp, Artificial
  CRISPR gRNA sequence
cacaaatatttatatttact

SEQ ID NO: 421952 - DNA, 20 bp, Artificial
  CRISPR gRNA sequence
actgagcattcgctatgtgt

SEQ ID NO: 421953 - DNA, 20 bp, Artificial
  CRISPR gRNA sequence
ttcgctatgtgtcagatgct

SEQ ID NO: 421954 - DNA, 20 bp, Artificial
  CRISPR gRNA sequence
tgtgtcagatgctgagaaaa

SEQ ID NO: 421955 - DNA, 20 bp, Artificial
  CRISPR gRNA sequence
cagatgctgagaaaacagca

SEQ ID NO: 421956 - DNA, 20 bp, Artificial
  CRISPR gRNA sequence
agatgctgagaaaacagcaa

SEQ ID NO: 421957 - DNA, 20 bp, Artificial
  CRISPR gRNA sequence
ctgagaaaacagcaaaggat

SEQ ID NO: 421958 - DNA, 20 bp, Artificial
  CRISPR gRNA sequence
gagaaaacagcaaaggataa

SEQ ID NO: 421959 - DNA, 20 bp, Artificial
  CRISPR gRNA sequence
aacagcaaaggataagagtc

SEQ ID NO: 421960 - DNA, 20 bp, Artificial
  CRISPR gRNA sequence
cagcaaaggataagagtcca

SEQ ID NO: 421961 - DNA, 20 bp, Artificial
  CRISPR gRNA sequence
gtccagagcctcatgccctc

SEQ ID NO: 421962 - DNA, 20 bp, Artificial
  CRISPR gRNA sequence
tccagagcctcatgccctcc

SEQ ID NO: 421963 - DNA, 20 bp, Artificial
  CRISPR gRNA sequence
ccagagcctcatgccctcca

SEQ ID NO: 421964 - DNA, 20 bp, Artificial
  CRISPR gRNA sequence
tcatgccctccagggtttca

SEQ ID NO: 421965 - DNA, 20 bp, Artificial
  CRISPR gRNA sequence
ccctccagggtttcacagcc

SEQ ID NO: 421966 - DNA, 20 bp, Artificial
  CRISPR gRNA sequence
ccagggtttcacagcctagc

SEQ ID NO: 421967 - DNA, 20 bp, Artificial
  CRISPR gRNA sequence
ttcacagcctagctggaaat

SEQ ID NO: 421968 - DNA, 20 bp, Artificial
  CRISPR gRNA sequence
ctagctggaaataagtgtta

SEQ ID NO: 421969 - DNA, 20 bp, Artificial
  CRISPR gRNA sequence
tagctggaaataagtgttat

SEQ ID NO: 421970 - DNA, 20 bp, Artificial
  CRISPR gRNA sequence
gaaataagtgttataggctt

SEQ ID NO: 421971 - DNA, 20 bp, Artificial
  CRISPR gRNA sequence
aaataagtgttataggctta

SEQ ID NO: 421972 - DNA, 20 bp, Artificial
  CRISPR gRNA sequence
aataagtgttataggcttaa

SEQ ID NO: 421973 - DNA, 20 bp, Artificial
  CRISPR gRNA sequence
gtgttataggcttaagggaa

SEQ ID NO: 421974 - DNA, 20 bp, Artificial
  CRISPR gRNA sequence
tgttataggcttaagggaaa

SEQ ID NO: 421975 - DNA, 20 bp, Artificial
  CRISPR gRNA sequence
ttgatatgatttcatatttg

SEQ ID NO: 421976 - DNA, 20 bp, Artificial
  CRISPR gRNA sequence
tcatatttgaagttcaataa

SEQ ID NO: 421977 - DNA, 20 bp, Artificial
  CRISPR gRNA sequence
aaagaaaatattcactttct

SEQ ID NO: 421978 - DNA, 20 bp, Artificial
  CRISPR gRNA sequence
tcactttctgagtttttttc

SEQ ID NO: 421979 - DNA, 20 bp, Artificial
  CRISPR gRNA sequence
ccaaaaatgattttgtcaaa

SEQ ID NO: 421980 - DNA, 20 bp, Artificial
  CRISPR gRNA sequence
aaaatgattttgtcaaatag

SEQ ID NO: 421981 - DNA, 20 bp, Artificial
  CRISPR gRNA sequence
aatgttaaaatgacctgctc

SEQ ID NO: 421982 - DNA, 20 bp, Artificial
  CRISPR gRNA sequence
tgctctggtatcaaatatac

SEQ ID NO: 421983 - DNA, 20 bp, Artificial
  CRISPR gRNA sequence
gctctggtatcaaatataca

SEQ ID NO: 421984 - DNA, 20 bp, Artificial
  CRISPR gRNA sequence
tacaccactgctgaaaatat

SEQ ID NO: 421985 - DNA, 20 bp, Artificial
  CRISPR gRNA sequence
atcagtcattgatttcatga

SEQ ID NO: 421986 - DNA, 20 bp, Artificial
  CRISPR gRNA sequence
tcagtcattgatttcatgat

SEQ ID NO: 421987 - DNA, 20 bp, Artificial
  CRISPR gRNA sequence
tcattgatttcatgatgggc

SEQ ID NO: 421988 - DNA, 20 bp, Artificial
  CRISPR gRNA sequence
tgatttcatgatgggccaga

SEQ ID NO: 421989 - DNA, 20 bp, Artificial
  CRISPR gRNA sequence
gatggatactctgctgttca

SEQ ID NO: 421990 - DNA, 20 bp, Artificial
  CRISPR gRNA sequence
tactctgctgttcaaagtgt

SEQ ID NO: 421991 - DNA, 20 bp, Artificial
  CRISPR gRNA sequence
actctgctgttcaaagtgtt

SEQ ID NO: 421992 - DNA, 20 bp, Artificial
  CRISPR gRNA sequence
tgttcaaagtgttgggctta

SEQ ID NO: 421993 - DNA, 20 bp, Artificial
  CRISPR gRNA sequence
gttcaaagtgttgggcttaa

SEQ ID NO: 421994 - DNA, 20 bp, Artificial
  CRISPR gRNA sequence
agtgttgggcttaaaggctc

SEQ ID NO: 421995 - DNA, 20 bp, Artificial
  CRISPR gRNA sequence
gcttaaaggctccagtccca

SEQ ID NO: 421996 - DNA, 20 bp, Artificial
  CRISPR gRNA sequence
tccagtcccatggttacaca

SEQ ID NO: 421997 - DNA, 20 bp, Artificial
  CRISPR gRNA sequence
ccagtcccatggttacacaa

SEQ ID NO: 421998 - DNA, 20 bp, Artificial
  CRISPR gRNA sequence
cagtcccatggttacacaaa

SEQ ID NO: 421999 - DNA, 20 bp, Artificial
  CRISPR gRNA sequence
ccatggttacacaaagggct

SEQ ID NO: 422000 - DNA, 20 bp, Artificial
  CRISPR gRNA sequence
atcctcccctctctgccgtg

SEQ ID NO: 422001 - DNA, 20 bp, Artificial
  CRISPR gRNA sequence
cccctctctgccgtgaagct

SEQ ID NO: 422002 - DNA, 20 bp, Artificial
  CRISPR gRNA sequence
ccctctctgccgtgaagctc

SEQ ID NO: 422003 - DNA, 20 bp, Artificial
  CRISPR gRNA sequence
ccgtgaagctcaggctgccc

SEQ ID NO: 422004 - DNA, 20 bp, Artificial
  CRISPR gRNA sequence
cgtgaagctcaggctgccct

SEQ ID NO: 422005 - DNA, 20 bp, Artificial
  CRISPR gRNA sequence
gtgaagctcaggctgccctg

SEQ ID NO: 422006 - DNA, 20 bp, Artificial
  CRISPR gRNA sequence
tcaggctgccctggggaaat

SEQ ID NO: 422007 - DNA, 20 bp, Artificial
  CRISPR gRNA sequence
ggggaaatcagcttcacttc

SEQ ID NO: 422008 - DNA, 20 bp, Artificial
  CRISPR gRNA sequence
tctctgttttgtcctccctc

SEQ ID NO: 422009 - DNA, 20 bp, Artificial
  CRISPR gRNA sequence
ctgttttgtcctccctctag

SEQ ID NO: 422010 - DNA, 20 bp, Artificial
  CRISPR gRNA sequence
ttgtcctccctctagtggct

SEQ ID NO: 422011 - DNA, 20 bp, Artificial
  CRISPR gRNA sequence
ctccctctagtggctgagca

SEQ ID NO: 422012 - DNA, 20 bp, Artificial
  CRISPR gRNA sequence
ctagtggctgagcacggtgc

SEQ ID NO: 422013 - DNA, 20 bp, Artificial
  CRISPR gRNA sequence
tagtggctgagcacggtgcc

SEQ ID NO: 422014 - DNA, 20 bp, Artificial
  CRISPR gRNA sequence
ctgagcacggtgccaggttc

SEQ ID NO: 422015 - DNA, 20 bp, Artificial
  CRISPR gRNA sequence
aggttccagattccattgct

SEQ ID NO: 422016 - DNA, 20 bp, Artificial
  CRISPR gRNA sequence
gttccagattccattgcttg

SEQ ID NO: 422017 - DNA, 20 bp, Artificial
  CRISPR gRNA sequence
gattccattgcttggagcca

SEQ ID NO: 422018 - DNA, 20 bp, Artificial
  CRISPR gRNA sequence
tggagccatggccgcgacgc

SEQ ID NO: 422019 - DNA, 20 bp, Artificial
  CRISPR gRNA sequence
agccatggccgcgacgctgg

SEQ ID NO: 422020 - DNA, 20 bp, Artificial
  CRISPR gRNA sequence
gacgctggtggtcatctgca

SEQ ID NO: 422021 - DNA, 20 bp, Artificial
  CRISPR gRNA sequence
gctggtggtcatctgcacag

SEQ ID NO: 422022 - DNA, 20 bp, Artificial
  CRISPR gRNA sequence
catctgcacagcagtcatcg

SEQ ID NO: 422023 - DNA, 20 bp, Artificial
  CRISPR gRNA sequence
ctgcacagcagtcatcgtgg

SEQ ID NO: 422024 - DNA, 20 bp, Artificial
  CRISPR gRNA sequence
atcgtggtggtcgcgttgac

SEQ ID NO: 422025 - DNA, 20 bp, Artificial
  CRISPR gRNA sequence
tggtggtcgcgttgactaga

SEQ ID NO: 422026 - DNA, 20 bp, Artificial
  CRISPR gRNA sequence
ggtggtcgcgttgactagaa

SEQ ID NO: 422027 - DNA, 20 bp, Artificial
  CRISPR gRNA sequence
cgcgttgactagaaaggtaa

SEQ ID NO: 422028 - DNA, 20 bp, Artificial
  CRISPR gRNA sequence
gactagaaaggtaatggctc

SEQ ID NO: 422029 - DNA, 20 bp, Artificial
  CRISPR gRNA sequence
atggctccggctgcacaccg

SEQ ID NO: 422030 - DNA, 20 bp, Artificial
  CRISPR gRNA sequence
ccggctgcacaccgcagtca

SEQ ID NO: 422031 - DNA, 20 bp, Artificial
  CRISPR gRNA sequence
cggctgcacaccgcagtcat

SEQ ID NO: 422032 - DNA, 20 bp, Artificial
  CRISPR gRNA sequence
gtcatgggcacccccacgtc

SEQ ID NO: 422033 - DNA, 20 bp, Artificial
  CRISPR gRNA sequence
gcacccccacgtctggcacc

SEQ ID NO: 422034 - DNA, 20 bp, Artificial
  CRISPR gRNA sequence
cacccccacgtctggcaccc

SEQ ID NO: 422035 - DNA, 20 bp, Artificial
  CRISPR gRNA sequence
gtctggcacccgggtccttt

SEQ ID NO: 422036 - DNA, 20 bp, Artificial
  CRISPR gRNA sequence
tctggcacccgggtcctttc

SEQ ID NO: 422037 - DNA, 20 bp, Artificial
  CRISPR gRNA sequence
tttcaggttctctttccacc

SEQ ID NO: 422038 - DNA, 20 bp, Artificial
  CRISPR gRNA sequence
tcaggttctctttccaccca

SEQ ID NO: 422039 - DNA, 20 bp, Artificial
  CRISPR gRNA sequence
aggttctctttccacccaga

SEQ ID NO: 422040 - DNA, 20 bp, Artificial
  CRISPR gRNA sequence
gttctctttccacccagaga

SEQ ID NO: 422041 - DNA, 20 bp, Artificial
  CRISPR gRNA sequence
tttccacccagagagagacc

SEQ ID NO: 422042 - DNA, 20 bp, Artificial
  CRISPR gRNA sequence
gacccagatgtgatcttccc

SEQ ID NO: 422043 - DNA, 20 bp, Artificial
  CRISPR gRNA sequence
tgctctttgtgcctttttcc

SEQ ID NO: 422044 - DNA, 20 bp, Artificial
  CRISPR gRNA sequence
ctggcatttgttctgcctat

SEQ ID NO: 422045 - DNA, 20 bp, Artificial
  CRISPR gRNA sequence
atttgttctgcctattagtg

SEQ ID NO: 422046 - DNA, 20 bp, Artificial
  CRISPR gRNA sequence
ctcttccgttgtccctctca

SEQ ID NO: 422047 - DNA, 20 bp, Artificial
  CRISPR gRNA sequence
tcttccgttgtccctctcat

SEQ ID NO: 422048 - DNA, 20 bp, Artificial
  CRISPR gRNA sequence
cttccgttgtccctctcata

SEQ ID NO: 422049 - DNA, 20 bp, Artificial
  CRISPR gRNA sequence
tccgttgtccctctcatagg

SEQ ID NO: 422050 - DNA, 20 bp, Artificial
  CRISPR gRNA sequence
ccgttgtccctctcataggg

SEQ ID NO: 422051 - DNA, 20 bp, Artificial
  CRISPR gRNA sequence
cgttgtccctctcataggga

SEQ ID NO: 422052 - DNA, 20 bp, Artificial
  CRISPR gRNA sequence
tctcatagggagggaccccc

SEQ ID NO: 422053 - DNA, 20 bp, Artificial
  CRISPR gRNA sequence
atagggagggaccccctgga

SEQ ID NO: 422054 - DNA, 20 bp, Artificial
  CRISPR gRNA sequence
ggagggaccccctggacagc

SEQ ID NO: 422055 - DNA, 20 bp, Artificial
  CRISPR gRNA sequence
ttgctgtcatttgtaactcc

SEQ ID NO: 422056 - DNA, 20 bp, Artificial
  CRISPR gRNA sequence
ctggtttctgcttatccctt

SEQ ID NO: 422057 - DNA, 20 bp, Artificial
  CRISPR gRNA sequence
atcccttaagccactgctct

SEQ ID NO: 422058 - DNA, 20 bp, Artificial
  CRISPR gRNA sequence
cccttaagccactgctctga

SEQ ID NO: 422059 - DNA, 20 bp, Artificial
  CRISPR gRNA sequence
actatgattttgatgcatcg

SEQ ID NO: 422060 - DNA, 20 bp, Artificial
  CRISPR gRNA sequence
ctatgattttgatgcatcgt

SEQ ID NO: 422061 - DNA, 20 bp, Artificial
  CRISPR gRNA sequence
tcgtgggcatctatatatgc

SEQ ID NO: 422062 - DNA, 20 bp, Artificial
  CRISPR gRNA sequence
gtgggcatctatatatgcta

SEQ ID NO: 422063 - DNA, 20 bp, Artificial
  CRISPR gRNA sequence
tgctagagctttctgcacat

SEQ ID NO: 422064 - DNA, 20 bp, Artificial
  CRISPR gRNA sequence
ttttgattattacaactctc

SEQ ID NO: 422065 - DNA, 20 bp, Artificial
  CRISPR gRNA sequence
tgattattacaactctctgg

SEQ ID NO: 422066 - DNA, 20 bp, Artificial
  CRISPR gRNA sequence
ttacaactctctggtagtgc

SEQ ID NO: 422067 - DNA, 20 bp, Artificial
  CRISPR gRNA sequence
tacaactctctggtagtgct

SEQ ID NO: 422068 - DNA, 20 bp, Artificial
  CRISPR gRNA sequence
tctggtagtgctaggttacc

SEQ ID NO: 422069 - DNA, 20 bp, Artificial
  CRISPR gRNA sequence
taggttacccagcatgtctg

SEQ ID NO: 422070 - DNA, 20 bp, Artificial
  CRISPR gRNA sequence
acccagcatgtctgtagaat

SEQ ID NO: 422071 - DNA, 20 bp, Artificial
  CRISPR gRNA sequence
aaataaacactccaaaaatg

SEQ ID NO: 422072 - DNA, 20 bp, Artificial
  CRISPR gRNA sequence
aataaacactccaaaaatgt

SEQ ID NO: 422073 - DNA, 20 bp, Artificial
  CRISPR gRNA sequence
ataaacactccaaaaatgta

SEQ ID NO: 422074 - DNA, 20 bp, Artificial
  CRISPR gRNA sequence
acactccaaaaatgtagggt

SEQ ID NO: 422075 - DNA, 20 bp, Artificial
  CRISPR gRNA sequence
cactccaaaaatgtagggtt

SEQ ID NO: 422076 - DNA, 20 bp, Artificial
  CRISPR gRNA sequence
ccaaaaatgtagggttaggc

SEQ ID NO: 422077 - DNA, 20 bp, Artificial
  CRISPR gRNA sequence
caaaaatgtagggttaggcc

SEQ ID NO: 422078 - DNA, 20 bp, Artificial
  CRISPR gRNA sequence
aaaatgtagggttaggccag

SEQ ID NO: 422079 - DNA, 20 bp, Artificial
  CRISPR gRNA sequence
tagggttaggccaggagctg

SEQ ID NO: 422080 - DNA, 20 bp, Artificial
  CRISPR gRNA sequence
aggagctgtggctcacacct

SEQ ID NO: 422081 - DNA, 20 bp, Artificial
  CRISPR gRNA sequence
agctgtggctcacacctcag

SEQ ID NO: 422082 - DNA, 20 bp, Artificial
  CRISPR gRNA sequence
ggctcacacctcagaagcca

SEQ ID NO: 422083 - DNA, 20 bp, Artificial
  CRISPR gRNA sequence
cacctcagaagccacagata

SEQ ID NO: 422084 - DNA, 20 bp, Artificial
  CRISPR gRNA sequence
tcagaagccacagatatggc

SEQ ID NO: 422085 - DNA, 20 bp, Artificial
  CRISPR gRNA sequence
acagatatggctggtgctat

SEQ ID NO: 422086 - DNA, 20 bp, Artificial
  CRISPR gRNA sequence
cagatatggctggtgctatt

SEQ ID NO: 422087 - DNA, 20 bp, Artificial
  CRISPR gRNA sequence
tatggctggtgctattggga

SEQ ID NO: 422088 - DNA, 20 bp, Artificial
  CRISPR gRNA sequence
taatattttcatttatgtgt

SEQ ID NO: 422089 - DNA, 20 bp, Artificial
  CRISPR gRNA sequence
ttatgtgttggctatcacaa

SEQ ID NO: 422090 - DNA, 20 bp, Artificial
  CRISPR gRNA sequence
tagacataattccacccact

SEQ ID NO: 422091 - DNA, 20 bp, Artificial
  CRISPR gRNA sequence
agacataattccacccactc

SEQ ID NO: 422092 - DNA, 20 bp, Artificial
  CRISPR gRNA sequence
acataattccacccactcgg

SEQ ID NO: 422093 - DNA, 20 bp, Artificial
  CRISPR gRNA sequence
tccacccactcgggagactg

SEQ ID NO: 422094 - DNA, 20 bp, Artificial
  CRISPR gRNA sequence
acccactcgggagactgtgg

SEQ ID NO: 422095 - DNA, 20 bp, Artificial
  CRISPR gRNA sequence
cccactcgggagactgtggc

SEQ ID NO: 422096 - DNA, 20 bp, Artificial
  CRISPR gRNA sequence
cactcgggagactgtggcgg

SEQ ID NO: 422097 - DNA, 20 bp, Artificial
  CRISPR gRNA sequence
actcgggagactgtggcggg

SEQ ID NO: 422098 - DNA, 20 bp, Artificial
  CRISPR gRNA sequence
gcgggaggatcacttgactc

SEQ ID NO: 422099 - DNA, 20 bp, Artificial
  CRISPR gRNA sequence
cgggaggatcacttgactct

SEQ ID NO: 422100 - DNA, 20 bp, Artificial
  CRISPR gRNA sequence
ggaggatcacttgactctag

SEQ ID NO: 422101 - DNA, 20 bp, Artificial
  CRISPR gRNA sequence
tcacttgactctaggagttc

SEQ ID NO: 422102 - DNA, 20 bp, Artificial
  CRISPR gRNA sequence
cacttgactctaggagttca

SEQ ID NO: 422103 - DNA, 20 bp, Artificial
  CRISPR gRNA sequence
actctaggagttcaaggctg

SEQ ID NO: 422104 - DNA, 20 bp, Artificial
  CRISPR gRNA sequence
taggagttcaaggctgcagt

SEQ ID NO: 422105 - DNA, 20 bp, Artificial
  CRISPR gRNA sequence
agtgagctatgactgcactc

SEQ ID NO: 422106 - DNA, 20 bp, Artificial
  CRISPR gRNA sequence
gctatgactgcactccagcg

SEQ ID NO: 422107 - DNA, 20 bp, Artificial
  CRISPR gRNA sequence
ctatgactgcactccagcgt

SEQ ID NO: 422108 - DNA, 20 bp, Artificial
  CRISPR gRNA sequence
ctgcactccagcgtgggcaa

SEQ ID NO: 422109 - DNA, 20 bp, Artificial
  CRISPR gRNA sequence
gcactccagcgtgggcaaca

SEQ ID NO: 422110 - DNA, 20 bp, Artificial
  CRISPR gRNA sequence
tccagcgtgggcaacagagc

SEQ ID NO: 422111 - DNA, 20 bp, Artificial
  CRISPR gRNA sequence
ctctaaaaaaaaaaaaaaat

SEQ ID NO: 422112 - DNA, 20 bp, Artificial
  CRISPR gRNA sequence
taaaaaaaaaaaaaaattgg

SEQ ID NO: 422113 - DNA, 20 bp, Artificial
  CRISPR gRNA sequence
aaaaaaaaaaattggtggta

SEQ ID NO: 422114 - DNA, 20 bp, Artificial
  CRISPR gRNA sequence
aaaaaaaattggtggtaaag

SEQ ID NO: 422115 - DNA, 20 bp, Artificial
  CRISPR gRNA sequence
aaaaaaattggtggtaaagt

SEQ ID NO: 422116 - DNA, 20 bp, Artificial
  CRISPR gRNA sequence
aattggtggtaaagtgggca

SEQ ID NO: 422117 - DNA, 20 bp, Artificial
  CRISPR gRNA sequence
ggtggtaaagtgggcatggc

SEQ ID NO: 422118 - DNA, 20 bp, Artificial
  CRISPR gRNA sequence
taaagtgggcatggcaagat

SEQ ID NO: 422119 - DNA, 20 bp, Artificial
  CRISPR gRNA sequence
agtgggcatggcaagatcag

SEQ ID NO: 422120 - DNA, 20 bp, Artificial
  CRISPR gRNA sequence
gtgggcatggcaagatcagc

SEQ ID NO: 422121 - DNA, 20 bp, Artificial
  CRISPR gRNA sequence
caggttgtaaatcctctgtt

SEQ ID NO: 422122 - DNA, 20 bp, Artificial
  CRISPR gRNA sequence
gtaaatcctctgtttagctt

SEQ ID NO: 422123 - DNA, 20 bp, Artificial
  CRISPR gRNA sequence
aaatcctctgtttagcttaa

SEQ ID NO: 422124 - DNA, 20 bp, Artificial
  CRISPR gRNA sequence
gtttagcttaagagcttatg

SEQ ID NO: 422125 - DNA, 20 bp, Artificial
  CRISPR gRNA sequence
ttaagagcttatgtggctga

SEQ ID NO: 422126 - DNA, 20 bp, Artificial
  CRISPR gRNA sequence
aagagcttatgtggctgaaa

SEQ ID NO: 422127 - DNA, 20 bp, Artificial
  CRISPR gRNA sequence
gtggctgaaagagtaatgaa

SEQ ID NO: 422128 - DNA, 20 bp, Artificial
  CRISPR gRNA sequence
tggctgaaagagtaatgaat

SEQ ID NO: 422129 - DNA, 20 bp, Artificial
  CRISPR gRNA sequence
ggctgaaagagtaatgaatg

SEQ ID NO: 422130 - DNA, 20 bp, Artificial
  CRISPR gRNA sequence
agtaatgaatggggaattga

SEQ ID NO: 422131 - DNA, 20 bp, Artificial
  CRISPR gRNA sequence
gaatggggaattgaaagatc

SEQ ID NO: 422132 - DNA, 20 bp, Artificial
  CRISPR gRNA sequence
gaattgaaagatctagtttc

SEQ ID NO: 422133 - DNA, 20 bp, Artificial
  CRISPR gRNA sequence
aaagatctagtttctagttt

SEQ ID NO: 422134 - DNA, 20 bp, Artificial
  CRISPR gRNA sequence
tagtttctagttttggcact

SEQ ID NO: 422135 - DNA, 20 bp, Artificial
  CRISPR gRNA sequence
tggcactgagtgtatgcttt

SEQ ID NO: 422136 - DNA, 20 bp, Artificial
  CRISPR gRNA sequence
ggcactgagtgtatgctttt

SEQ ID NO: 422137 - DNA, 20 bp, Artificial
  CRISPR gRNA sequence
ctgagtgtatgcttttagga

SEQ ID NO: 422138 - DNA, 20 bp, Artificial
  CRISPR gRNA sequence
ggaaagttacttaatctttc

SEQ ID NO: 422139 - DNA, 20 bp, Artificial
  CRISPR gRNA sequence
gaaagttacttaatctttca

SEQ ID NO: 422140 - DNA, 20 bp, Artificial
  CRISPR gRNA sequence
tcatttccttatatataaaa

SEQ ID NO: 422141 - DNA, 20 bp, Artificial
  CRISPR gRNA sequence
catttccttatatataaaat

SEQ ID NO: 422142 - DNA, 20 bp, Artificial
  CRISPR gRNA sequence
atttccttatatataaaatg

SEQ ID NO: 422143 - DNA, 20 bp, Artificial
  CRISPR gRNA sequence
tataaaatggggatttgtct

SEQ ID NO: 422144 - DNA, 20 bp, Artificial
  CRISPR gRNA sequence
tctattttctgccgctgtaa

SEQ ID NO: 422145 - DNA, 20 bp, Artificial
  CRISPR gRNA sequence
ctgtaacagaatacaattat

SEQ ID NO: 422146 - DNA, 20 bp, Artificial
  CRISPR gRNA sequence
tgtaacagaatacaattatt

SEQ ID NO: 422147 - DNA, 20 bp, Artificial
  CRISPR gRNA sequence
caattattgggaaatttata

SEQ ID NO: 422148 - DNA, 20 bp, Artificial
  CRISPR gRNA sequence
attgggaaatttataaagaa

SEQ ID NO: 422149 - DNA, 20 bp, Artificial
  CRISPR gRNA sequence
gggaaatttataaagaaaag

SEQ ID NO: 422150 - DNA, 20 bp, Artificial
  CRISPR gRNA sequence
ataaagaaaagaagtttatt

SEQ ID NO: 422151 - DNA, 20 bp, Artificial
  CRISPR gRNA sequence
aaagaagtttatttggctca

SEQ ID NO: 422152 - DNA, 20 bp, Artificial
  CRISPR gRNA sequence
gtttatttggctcatggttc

SEQ ID NO: 422153 - DNA, 20 bp, Artificial
  CRISPR gRNA sequence
ttatttggctcatggttctg

SEQ ID NO: 422154 - DNA, 20 bp, Artificial
  CRISPR gRNA sequence
tatttggctcatggttctgg

SEQ ID NO: 422155 - DNA, 20 bp, Artificial
  CRISPR gRNA sequence
tggctcatggttctggaggc

SEQ ID NO: 422156 - DNA, 20 bp, Artificial
  CRISPR gRNA sequence
ggctcatggttctggaggct

SEQ ID NO: 422157 - DNA, 20 bp, Artificial
  CRISPR gRNA sequence
tcatggttctggaggctggg

SEQ ID NO: 422158 - DNA, 20 bp, Artificial
  CRISPR gRNA sequence
gttctggaggctgggaagtc

SEQ ID NO: 422159 - DNA, 20 bp, Artificial
  CRISPR gRNA sequence
ttctggaggctgggaagtcc

SEQ ID NO: 422160 - DNA, 20 bp, Artificial
  CRISPR gRNA sequence
ctggaggctgggaagtccag

SEQ ID NO: 422161 - DNA, 20 bp, Artificial
  CRISPR gRNA sequence
ggctgggaagtccaggagca

SEQ ID NO: 422162 - DNA, 20 bp, Artificial
  CRISPR gRNA sequence
gtccaggagcatggtgtatt

SEQ ID NO: 422163 - DNA, 20 bp, Artificial
  CRISPR gRNA sequence
aggagcatggtgtatttggc

SEQ ID NO: 422164 - DNA, 20 bp, Artificial
  CRISPR gRNA sequence
ggagcatggtgtatttggcg

SEQ ID NO: 422165 - DNA, 20 bp, Artificial
  CRISPR gRNA sequence
atttggcgaggttcatccca

SEQ ID NO: 422166 - DNA, 20 bp, Artificial
  CRISPR gRNA sequence
tggcgaggttcatcccacgg

SEQ ID NO: 422167 - DNA, 20 bp, Artificial
  CRISPR gRNA sequence
cgaggttcatcccacggcag

SEQ ID NO: 422168 - DNA, 20 bp, Artificial
  CRISPR gRNA sequence
gaggttcatcccacggcaga

SEQ ID NO: 422169 - DNA, 20 bp, Artificial
  CRISPR gRNA sequence
ggcagaaggcatcatgtgat

SEQ ID NO: 422170 - DNA, 20 bp, Artificial
  CRISPR gRNA sequence
tgtgatgagtgcatgcatgt

SEQ ID NO: 422171 - DNA, 20 bp, Artificial
  CRISPR gRNA sequence
tgatgagtgcatgcatgtga

SEQ ID NO: 422172 - DNA, 20 bp, Artificial
  CRISPR gRNA sequence
atgagtgcatgcatgtgaga

SEQ ID NO: 422173 - DNA, 20 bp, Artificial
  CRISPR gRNA sequence
gagtgcatgcatgtgagaga

SEQ ID NO: 422174 - DNA, 20 bp, Artificial
  CRISPR gRNA sequence
gtgcatgcatgtgagagaga

SEQ ID NO: 422175 - DNA, 20 bp, Artificial
  CRISPR gRNA sequence
gcatgcatgtgagagagaga

SEQ ID NO: 422176 - DNA, 20 bp, Artificial
  CRISPR gRNA sequence
tgtgagagagagagagaaat

SEQ ID NO: 422177 - DNA, 20 bp, Artificial
  CRISPR gRNA sequence
gtgagagagagagagaaatg

SEQ ID NO: 422178 - DNA, 20 bp, Artificial
  CRISPR gRNA sequence
gccaaattcatccttttaat

SEQ ID NO: 422179 - DNA, 20 bp, Artificial
  CRISPR gRNA sequence
ccaaattcatccttttaatt

SEQ ID NO: 422180 - DNA, 20 bp, Artificial
  CRISPR gRNA sequence
atgatacctaacccactcct

SEQ ID NO: 422181 - DNA, 20 bp, Artificial
  CRISPR gRNA sequence
ctaacccactcctgagataa

SEQ ID NO: 422182 - DNA, 20 bp, Artificial
  CRISPR gRNA sequence
aatggcattaatcccttcat

SEQ ID NO: 422183 - DNA, 20 bp, Artificial
  CRISPR gRNA sequence
atggcattaatcccttcatg

SEQ ID NO: 422184 - DNA, 20 bp, Artificial
  CRISPR gRNA sequence
tggcattaatcccttcatga

SEQ ID NO: 422185 - DNA, 20 bp, Artificial
  CRISPR gRNA sequence
cattaatcccttcatgaggg

SEQ ID NO: 422186 - DNA, 20 bp, Artificial
  CRISPR gRNA sequence
ttcatgagggcagatcttca

SEQ ID NO: 422187 - DNA, 20 bp, Artificial
  CRISPR gRNA sequence
atggcctaatcacctcttaa

SEQ ID NO: 422188 - DNA, 20 bp, Artificial
  CRISPR gRNA sequence
accacttaatactattacaa

SEQ ID NO: 422189 - DNA, 20 bp, Artificial
  CRISPR gRNA sequence
atactattacaatggtaatt

SEQ ID NO: 422190 - DNA, 20 bp, Artificial
  CRISPR gRNA sequence
gtaattaagtttccaacaca

SEQ ID NO: 422191 - DNA, 20 bp, Artificial
  CRISPR gRNA sequence
gtttccaacacatggccttt

SEQ ID NO: 422192 - DNA, 20 bp, Artificial
  CRISPR gRNA sequence
tttccaacacatggcctttt

SEQ ID NO: 422193 - DNA, 20 bp, Artificial
  CRISPR gRNA sequence
ttccaacacatggccttttg

SEQ ID NO: 422194 - DNA, 20 bp, Artificial
  CRISPR gRNA sequence
tccaacacatggccttttgg

SEQ ID NO: 422195 - DNA, 20 bp, Artificial
  CRISPR gRNA sequence
tgggggacacattaaaacca

SEQ ID NO: 422196 - DNA, 20 bp, Artificial
  CRISPR gRNA sequence
accatagctgtattataatt

SEQ ID NO: 422197 - DNA, 20 bp, Artificial
  CRISPR gRNA sequence
attcggcttactctatatca

SEQ ID NO: 422198 - DNA, 20 bp, Artificial
  CRISPR gRNA sequence
tcggcttactctatatcata

SEQ ID NO: 422199 - DNA, 20 bp, Artificial
  CRISPR gRNA sequence
atcatagagttgtgatgaac

SEQ ID NO: 422200 - DNA, 20 bp, Artificial
  CRISPR gRNA sequence
atagagttgtgatgaacaag

SEQ ID NO: 422201 - DNA, 20 bp, Artificial
  CRISPR gRNA sequence
taaaatctttataaataaca

SEQ ID NO: 422202 - DNA, 20 bp, Artificial
  CRISPR gRNA sequence
taaataacaaagaattatat

SEQ ID NO: 422203 - DNA, 20 bp, Artificial
  CRISPR gRNA sequence
atcagtgaaatttatgtcat

SEQ ID NO: 422204 - DNA, 20 bp, Artificial
  CRISPR gRNA sequence
aaatttatgtcatcagctac

SEQ ID NO: 422205 - DNA, 20 bp, Artificial
  CRISPR gRNA sequence
catcagctactggtattgat

SEQ ID NO: 422206 - DNA, 20 bp, Artificial
  CRISPR gRNA sequence
atcagctactggtattgatt

SEQ ID NO: 422207 - DNA, 20 bp, Artificial
  CRISPR gRNA sequence
cagctactggtattgattgg

SEQ ID NO: 422208 - DNA, 20 bp, Artificial
  CRISPR gRNA sequence
agctactggtattgattggg

SEQ ID NO: 422209 - DNA, 20 bp, Artificial
  CRISPR gRNA sequence
ctactggtattgattgggag

SEQ ID NO: 422210 - DNA, 20 bp, Artificial
  CRISPR gRNA sequence
gtattgattgggaggagtga

SEQ ID NO: 422211 - DNA, 20 bp, Artificial
  CRISPR gRNA sequence
ccttgttttgtctgatctct

SEQ ID NO: 422212 - DNA, 20 bp, Artificial
  CRISPR gRNA sequence
cttgttttgtctgatctctt

SEQ ID NO: 422213 - DNA, 20 bp, Artificial
  CRISPR gRNA sequence
tctgatctcttgggcccttt

SEQ ID NO: 422214 - DNA, 20 bp, Artificial
  CRISPR gRNA sequence
atctcttgggccctttaagt

SEQ ID NO: 422215 - DNA, 20 bp, Artificial
  CRISPR gRNA sequence
ttgggccctttaagtcagct

SEQ ID NO: 422216 - DNA, 20 bp, Artificial
  CRISPR gRNA sequence
ccctttaagtcagctcagcc

SEQ ID NO: 422217 - DNA, 20 bp, Artificial
  CRISPR gRNA sequence
cctttaagtcagctcagccc

SEQ ID NO: 422218 - DNA, 20 bp, Artificial
  CRISPR gRNA sequence
agcccaggtcaccttaattc

SEQ ID NO: 422219 - DNA, 20 bp, Artificial
  CRISPR gRNA sequence
aagtcaccacataaatattt

SEQ ID NO: 422220 - DNA, 20 bp, Artificial
  CRISPR gRNA sequence
agtcaccacataaatatttt

SEQ ID NO: 422221 - DNA, 20 bp, Artificial
  CRISPR gRNA sequence
ataaatattttgggaaacac

SEQ ID NO: 422222 - DNA, 20 bp, Artificial
  CRISPR gRNA sequence
tgtaatttctacctttaccc

SEQ ID NO: 422223 - DNA, 20 bp, Artificial
  CRISPR gRNA sequence
ttaccccagaccctccacct

SEQ ID NO: 422224 - DNA, 20 bp, Artificial
  CRISPR gRNA sequence
attccattcaattaacaact

SEQ ID NO: 422225 - DNA, 20 bp, Artificial
  CRISPR gRNA sequence
caattaacaactcagttctg

SEQ ID NO: 422226 - DNA, 20 bp, Artificial
  CRISPR gRNA sequence
aacaactcagttctgcagcc

SEQ ID NO: 422227 - DNA, 20 bp, Artificial
  CRISPR gRNA sequence
tctgcagcctggttgaactg

SEQ ID NO: 422228 - DNA, 20 bp, Artificial
  CRISPR gRNA sequence
gcagcctggttgaactgcag

SEQ ID NO: 422229 - DNA, 20 bp, Artificial
  CRISPR gRNA sequence
ctggttgaactgcagtggct

SEQ ID NO: 422230 - DNA, 20 bp, Artificial
  CRISPR gRNA sequence
gaactgcagtggctgagaca

SEQ ID NO: 422231 - DNA, 20 bp, Artificial
  CRISPR gRNA sequence
tgcagtggctgagacatggc

SEQ ID NO: 422232 - DNA, 20 bp, Artificial
  CRISPR gRNA sequence
tgagacatggctggtgctat

SEQ ID NO: 422233 - DNA, 20 bp, Artificial
  CRISPR gRNA sequence
gagacatggctggtgctatt

SEQ ID NO: 422234 - DNA, 20 bp, Artificial
  CRISPR gRNA sequence
catggctggtgctattggga

SEQ ID NO: 422235 - DNA, 20 bp, Artificial
  CRISPR gRNA sequence
taatattttcatttatgtgt

SEQ ID NO: 422236 - DNA, 20 bp, Artificial
  CRISPR gRNA sequence
ttatgtgttggctatcacaa

SEQ ID NO: 422237 - DNA, 20 bp, Artificial
  CRISPR gRNA sequence
gctatcacaatagacataat

SEQ ID NO: 422238 - DNA, 20 bp, Artificial
  CRISPR gRNA sequence
ctatcacaatagacataatg

SEQ ID NO: 422239 - DNA, 20 bp, Artificial
  CRISPR gRNA sequence
atgaggaaatgaaccctcta

SEQ ID NO: 422240 - DNA, 20 bp, Artificial
  CRISPR gRNA sequence
tgaggaaatgaaccctctat

SEQ ID NO: 422241 - DNA, 20 bp, Artificial
  CRISPR gRNA sequence
ggaaatgaaccctctatggg

SEQ ID NO: 422242 - DNA, 20 bp, Artificial
  CRISPR gRNA sequence
gaaatgaaccctctatggga

SEQ ID NO: 422243 - DNA, 20 bp, Artificial
  CRISPR gRNA sequence
tgaaccctctatgggaaggt

SEQ ID NO: 422244 - DNA, 20 bp, Artificial
  CRISPR gRNA sequence
gaaccctctatgggaaggtg

SEQ ID NO: 422245 - DNA, 20 bp, Artificial
  CRISPR gRNA sequence
ctctatgggaaggtgaggac

SEQ ID NO: 422246 - DNA, 20 bp, Artificial
  CRISPR gRNA sequence
ctatgggaaggtgaggacaa

SEQ ID NO: 422247 - DNA, 20 bp, Artificial
  CRISPR gRNA sequence
ggacaagagaaatgattgaa

SEQ ID NO: 422248 - DNA, 20 bp, Artificial
  CRISPR gRNA sequence
acaagagaaatgattgaata

SEQ ID NO: 422249 - DNA, 20 bp, Artificial
  CRISPR gRNA sequence
caagagaaatgattgaatag

SEQ ID NO: 422250 - DNA, 20 bp, Artificial
  CRISPR gRNA sequence
aagagaaatgattgaataga

SEQ ID NO: 422251 - DNA, 20 bp, Artificial
  CRISPR gRNA sequence
agagaaatgattgaatagag

SEQ ID NO: 422252 - DNA, 20 bp, Artificial
  CRISPR gRNA sequence
gagaaatgattgaatagagg

SEQ ID NO: 422253 - DNA, 20 bp, Artificial
  CRISPR gRNA sequence
agaaatgattgaatagaggg

SEQ ID NO: 422254 - DNA, 20 bp, Artificial
  CRISPR gRNA sequence
aaatgattgaatagaggggg

SEQ ID NO: 422255 - DNA, 20 bp, Artificial
  CRISPR gRNA sequence
aatgattgaatagagggggg

SEQ ID NO: 422256 - DNA, 20 bp, Artificial
  CRISPR gRNA sequence
ttgaatagaggggggaggtg

SEQ ID NO: 422257 - DNA, 20 bp, Artificial
  CRISPR gRNA sequence
aatagaggggggaggtgaag

SEQ ID NO: 422258 - DNA, 20 bp, Artificial
  CRISPR gRNA sequence
gggggaggtgaagaagatga

SEQ ID NO: 422259 - DNA, 20 bp, Artificial
  CRISPR gRNA sequence
gaagatgaaagttgatctct

SEQ ID NO: 422260 - DNA, 20 bp, Artificial
  CRISPR gRNA sequence
atgaaagttgatctcttagc

SEQ ID NO: 422261 - DNA, 20 bp, Artificial
  CRISPR gRNA sequence
tgaaagttgatctcttagct

SEQ ID NO: 422262 - DNA, 20 bp, Artificial
  CRISPR gRNA sequence
aagttgatctcttagctggg

SEQ ID NO: 422263 - DNA, 20 bp, Artificial
  CRISPR gRNA sequence
agttgatctcttagctggga

SEQ ID NO: 422264 - DNA, 20 bp, Artificial
  CRISPR gRNA sequence
gttgatctcttagctgggaa

SEQ ID NO: 422265 - DNA, 20 bp, Artificial
  CRISPR gRNA sequence
tgatctcttagctgggaagg

SEQ ID NO: 422266 - DNA, 20 bp, Artificial
  CRISPR gRNA sequence
agctgggaagggagctgcta

SEQ ID NO: 422267 - DNA, 20 bp, Artificial
  CRISPR gRNA sequence
tgggaagggagctgctatgg

SEQ ID NO: 422268 - DNA, 20 bp, Artificial
  CRISPR gRNA sequence
aagggagctgctatggtggt

SEQ ID NO: 422269 - DNA, 20 bp, Artificial
  CRISPR gRNA sequence
ctgctatggtggttggtgaa

SEQ ID NO: 422270 - DNA, 20 bp, Artificial
  CRISPR gRNA sequence
tgctatggtggttggtgaac

SEQ ID NO: 422271 - DNA, 20 bp, Artificial
  CRISPR gRNA sequence
gtgaacaggttctctgctgt

SEQ ID NO: 422272 - DNA, 20 bp, Artificial
  CRISPR gRNA sequence
aacaggttctctgctgttag

SEQ ID NO: 422273 - DNA, 20 bp, Artificial
  CRISPR gRNA sequence
tgctgttagcagtgtcctga

SEQ ID NO: 422274 - DNA, 20 bp, Artificial
  CRISPR gRNA sequence
ttagcagtgtcctgatggtc

SEQ ID NO: 422275 - DNA, 20 bp, Artificial
  CRISPR gRNA sequence
gtcctgatggtctggaataa

SEQ ID NO: 422276 - DNA, 20 bp, Artificial
  CRISPR gRNA sequence
ggtctggaataaaagaatca

SEQ ID NO: 422277 - DNA, 20 bp, Artificial
  CRISPR gRNA sequence
gtctggaataaaagaatcaa

SEQ ID NO: 422278 - DNA, 20 bp, Artificial
  CRISPR gRNA sequence
taaaagaatcaaaggctctt

SEQ ID NO: 422279 - DNA, 20 bp, Artificial
  CRISPR gRNA sequence
aagaatcaaaggctctttag

SEQ ID NO: 422280 - DNA, 20 bp, Artificial
  CRISPR gRNA sequence
agaatcaaaggctctttaga

SEQ ID NO: 422281 - DNA, 20 bp, Artificial
  CRISPR gRNA sequence
aatcaaaggctctttagaag

SEQ ID NO: 422282 - DNA, 20 bp, Artificial
  CRISPR gRNA sequence
gctgaacaacttttcctgtt

SEQ ID NO: 422283 - DNA, 20 bp, Artificial
  CRISPR gRNA sequence
ctgaacaacttttcctgtta

SEQ ID NO: 422284 - DNA, 20 bp, Artificial
  CRISPR gRNA sequence
acttttcctgttaaggattc

SEQ ID NO: 422285 - DNA, 20 bp, Artificial
  CRISPR gRNA sequence
tcctgttaaggattcaagac

SEQ ID NO: 422286 - DNA, 20 bp, Artificial
  CRISPR gRNA sequence
agactggttaattttcattc

SEQ ID NO: 422287 - DNA, 20 bp, Artificial
  CRISPR gRNA sequence
gactggttaattttcattct

SEQ ID NO: 422288 - DNA, 20 bp, Artificial
  CRISPR gRNA sequence
taattttcattctgggcacc

SEQ ID NO: 422289 - DNA, 20 bp, Artificial
  CRISPR gRNA sequence
ctgggcacctggactaactt

SEQ ID NO: 422290 - DNA, 20 bp, Artificial
  CRISPR gRNA sequence
ctggactaactttggtcatc

SEQ ID NO: 422291 - DNA, 20 bp, Artificial
  CRISPR gRNA sequence
ggactaactttggtcatctg

SEQ ID NO: 422292 - DNA, 20 bp, Artificial
  CRISPR gRNA sequence
gactaactttggtcatctgg

SEQ ID NO: 422293 - DNA, 20 bp, Artificial
  CRISPR gRNA sequence
actaactttggtcatctgga

SEQ ID NO: 422294 - DNA, 20 bp, Artificial
  CRISPR gRNA sequence
aactttggtcatctggaggg

SEQ ID NO: 422295 - DNA, 20 bp, Artificial
  CRISPR gRNA sequence
ctttggtcatctggagggta

SEQ ID NO: 422296 - DNA, 20 bp, Artificial
  CRISPR gRNA sequence
ggtcatctggagggtagaga

SEQ ID NO: 422297 - DNA, 20 bp, Artificial
  CRISPR gRNA sequence
tcatctggagggtagagaaa

SEQ ID NO: 422298 - DNA, 20 bp, Artificial
  CRISPR gRNA sequence
ggagggtagagaaagagaaa

SEQ ID NO: 422299 - DNA, 20 bp, Artificial
  CRISPR gRNA sequence
gagggtagagaaagagaaaa

SEQ ID NO: 422300 - DNA, 20 bp, Artificial
  CRISPR gRNA sequence
tagagaaagagaaaaaggtg

SEQ ID NO: 422301 - DNA, 20 bp, Artificial
  CRISPR gRNA sequence
gagaaagagaaaaaggtgaa

SEQ ID NO: 422302 - DNA, 20 bp, Artificial
  CRISPR gRNA sequence
aaaaggtgaagagacctatt

SEQ ID NO: 422303 - DNA, 20 bp, Artificial
  CRISPR gRNA sequence
gtcctgttgctccctttcta

SEQ ID NO: 422304 - DNA, 20 bp, Artificial
  CRISPR gRNA sequence
ttctacagtgtttgattccc

SEQ ID NO: 422305 - DNA, 20 bp, Artificial
  CRISPR gRNA sequence
catttccactgcttcctgtg

SEQ ID NO: 422306 - DNA, 20 bp, Artificial
  CRISPR gRNA sequence
ccactgcttcctgtgtagtg

SEQ ID NO: 422307 - DNA, 20 bp, Artificial
  CRISPR gRNA sequence
cactgcttcctgtgtagtgt

SEQ ID NO: 422308 - DNA, 20 bp, Artificial
  CRISPR gRNA sequence
tctgcatctttcctgtgctt

SEQ ID NO: 422309 - DNA, 20 bp, Artificial
  CRISPR gRNA sequence
tctttcctgtgctttggata

SEQ ID NO: 422310 - DNA, 20 bp, Artificial
  CRISPR gRNA sequence
tgtgctttggatatagttgt

SEQ ID NO: 422311 - DNA, 20 bp, Artificial
  CRISPR gRNA sequence
tgtctctctctccttgctca

SEQ ID NO: 422312 - DNA, 20 bp, Artificial
  CRISPR gRNA sequence
tccttgctcaaagcatttta

SEQ ID NO: 422313 - DNA, 20 bp, Artificial
  CRISPR gRNA sequence
cattttatagttgcattatt

SEQ ID NO: 422314 - DNA, 20 bp, Artificial
  CRISPR gRNA sequence
attttatagttgcattattc

SEQ ID NO: 422315 - DNA, 20 bp, Artificial
  CRISPR gRNA sequence
ttttatagttgcattattca

SEQ ID NO: 422316 - DNA, 20 bp, Artificial
  CRISPR gRNA sequence
agttgcattattcagggttc

SEQ ID NO: 422317 - DNA, 20 bp, Artificial
  CRISPR gRNA sequence
tgcattattcagggttccag

SEQ ID NO: 422318 - DNA, 20 bp, Artificial
  CRISPR gRNA sequence
gcattattcagggttccagc

SEQ ID NO: 422319 - DNA, 20 bp, Artificial
  CRISPR gRNA sequence
cattattcagggttccagca

SEQ ID NO: 422320 - DNA, 20 bp, Artificial
  CRISPR gRNA sequence
gggttccagcagggaacatg

SEQ ID NO: 422321 - DNA, 20 bp, Artificial
  CRISPR gRNA sequence
ggaacatgtagtactcaaac

SEQ ID NO: 422322 - DNA, 20 bp, Artificial
  CRISPR gRNA sequence
gaacatgtagtactcaaact

SEQ ID NO: 422323 - DNA, 20 bp, Artificial
  CRISPR gRNA sequence
tactcaaactgggttgtttg

SEQ ID NO: 422324 - DNA, 20 bp, Artificial
  CRISPR gRNA sequence
caaactgggttgtttgaaga

SEQ ID NO: 422325 - DNA, 20 bp, Artificial
  CRISPR gRNA sequence
gtttgaagacagtttaataa

SEQ ID NO: 422326 - DNA, 20 bp, Artificial
  CRISPR gRNA sequence
tttgaagacagtttaataat

SEQ ID NO: 422327 - DNA, 20 bp, Artificial
  CRISPR gRNA sequence
cagtttaataataggatttc

SEQ ID NO: 422328 - DNA, 20 bp, Artificial
  CRISPR gRNA sequence
tttaataataggatttccag

SEQ ID NO: 422329 - DNA, 20 bp, Artificial
  CRISPR gRNA sequence
taataggatttccagaagtc

SEQ ID NO: 422330 - DNA, 20 bp, Artificial
  CRISPR gRNA sequence
taggatttccagaagtctag

SEQ ID NO: 422331 - DNA, 20 bp, Artificial
  CRISPR gRNA sequence
aggatttccagaagtctagt

SEQ ID NO: 422332 - DNA, 20 bp, Artificial
  CRISPR gRNA sequence
ccagaagtctagtaggatgt

SEQ ID NO: 422333 - DNA, 20 bp, Artificial
  CRISPR gRNA sequence
cagaagtctagtaggatgta

SEQ ID NO: 422334 - DNA, 20 bp, Artificial
  CRISPR gRNA sequence
gtaggatgtaaggacaccac

SEQ ID NO: 422335 - DNA, 20 bp, Artificial
  CRISPR gRNA sequence
taggatgtaaggacaccaca

SEQ ID NO: 422336 - DNA, 20 bp, Artificial
  CRISPR gRNA sequence
ggatgtaaggacaccacaag

SEQ ID NO: 422337 - DNA, 20 bp, Artificial
  CRISPR gRNA sequence
gatgtaaggacaccacaagg

SEQ ID NO: 422338 - DNA, 20 bp, Artificial
  CRISPR gRNA sequence
tgtaaggacaccacaaggag

SEQ ID NO: 422339 - DNA, 20 bp, Artificial
  CRISPR gRNA sequence
aaggacaccacaaggaggag

SEQ ID NO: 422340 - DNA, 20 bp, Artificial
  CRISPR gRNA sequence
acaccacaaggaggagtagc

SEQ ID NO: 422341 - DNA, 20 bp, Artificial
  CRISPR gRNA sequence
caccacaaggaggagtagca

SEQ ID NO: 422342 - DNA, 20 bp, Artificial
  CRISPR gRNA sequence
caaggtgctgtaaccattcc

SEQ ID NO: 422343 - DNA, 20 bp, Artificial
  CRISPR gRNA sequence
taaccattcctagttcttca

SEQ ID NO: 422344 - DNA, 20 bp, Artificial
  CRISPR gRNA sequence
aaccattcctagttcttcaa

SEQ ID NO: 422345 - DNA, 20 bp, Artificial
  CRISPR gRNA sequence
accattcctagttcttcaaa

SEQ ID NO: 422346 - DNA, 20 bp, Artificial
  CRISPR gRNA sequence
attcctagttcttcaaaggg

SEQ ID NO: 422347 - DNA, 20 bp, Artificial
  CRISPR gRNA sequence
ttcctagttcttcaaagggt

SEQ ID NO: 422348 - DNA, 20 bp, Artificial
  CRISPR gRNA sequence
tcctagttcttcaaagggta

SEQ ID NO: 422349 - DNA, 20 bp, Artificial
  CRISPR gRNA sequence
cctagttcttcaaagggtag

SEQ ID NO: 422350 - DNA, 20 bp, Artificial
  CRISPR gRNA sequence
tagttcttcaaagggtaggg

SEQ ID NO: 422351 - DNA, 20 bp, Artificial
  CRISPR gRNA sequence
agttcttcaaagggtagggg

SEQ ID NO: 422352 - DNA, 20 bp, Artificial
  CRISPR gRNA sequence
gttcttcaaagggtagggga

SEQ ID NO: 422353 - DNA, 20 bp, Artificial
  CRISPR gRNA sequence
ttcttcaaagggtaggggag

SEQ ID NO: 422354 - DNA, 20 bp, Artificial
  CRISPR gRNA sequence
gtaggggaggggctaattat

SEQ ID NO: 422355 - DNA, 20 bp, Artificial
  CRISPR gRNA sequence
aggggaggggctaattattg

SEQ ID NO: 422356 - DNA, 20 bp, Artificial
  CRISPR gRNA sequence
aggggctaattattggagcc

SEQ ID NO: 422357 - DNA, 20 bp, Artificial
  CRISPR gRNA sequence
ggctaattattggagcctgg

SEQ ID NO: 422358 - DNA, 20 bp, Artificial
  CRISPR gRNA sequence
gctaattattggagcctgga

SEQ ID NO: 422359 - DNA, 20 bp, Artificial
  CRISPR gRNA sequence
taattattggagcctggaag

SEQ ID NO: 422360 - DNA, 20 bp, Artificial
  CRISPR gRNA sequence
attattggagcctggaagga

SEQ ID NO: 422361 - DNA, 20 bp, Artificial
  CRISPR gRNA sequence
tattggagcctggaaggaga

SEQ ID NO: 422362 - DNA, 20 bp, Artificial
  CRISPR gRNA sequence
cctggaaggagagagttatg

SEQ ID NO: 422363 - DNA, 20 bp, Artificial
  CRISPR gRNA sequence
tggaaggagagagttatgtg

SEQ ID NO: 422364 - DNA, 20 bp, Artificial
  CRISPR gRNA sequence
ggaaggagagagttatgtgg

SEQ ID NO: 422365 - DNA, 20 bp, Artificial
  CRISPR gRNA sequence
gaaggagagagttatgtgga

SEQ ID NO: 422366 - DNA, 20 bp, Artificial
  CRISPR gRNA sequence
aaggagagagttatgtggag

SEQ ID NO: 422367 - DNA, 20 bp, Artificial
  CRISPR gRNA sequence
ttatgtggaggggtctcctt

SEQ ID NO: 422368 - DNA, 20 bp, Artificial
  CRISPR gRNA sequence
tgtggaggggtctccttcag

SEQ ID NO: 422369 - DNA, 20 bp, Artificial
  CRISPR gRNA sequence
ggtctccttcagaagtgctg

SEQ ID NO: 422370 - DNA, 20 bp, Artificial
  CRISPR gRNA sequence
agaagtgctgtagtctttgc

SEQ ID NO: 422371 - DNA, 20 bp, Artificial
  CRISPR gRNA sequence
aagtgctgtagtctttgctg

SEQ ID NO: 422372 - DNA, 20 bp, Artificial
  CRISPR gRNA sequence
agtgctgtagtctttgctgg

SEQ ID NO: 422373 - DNA, 20 bp, Artificial
  CRISPR gRNA sequence
gtgctgtagtctttgctgga

SEQ ID NO: 422374 - DNA, 20 bp, Artificial
  CRISPR gRNA sequence
ctttgctggagggtcacaac

SEQ ID NO: 422375 - DNA, 20 bp, Artificial
  CRISPR gRNA sequence
tggagggtcacaaccagtcc

SEQ ID NO: 422376 - DNA, 20 bp, Artificial
  CRISPR gRNA sequence
ggagggtcacaaccagtcca

SEQ ID NO: 422377 - DNA, 20 bp, Artificial
  CRISPR gRNA sequence
accagtccaaggccaccctg

SEQ ID NO: 422378 - DNA, 20 bp, Artificial
  CRISPR gRNA sequence
gtccaaggccaccctgcaga

SEQ ID NO: 422379 - DNA, 20 bp, Artificial
  CRISPR gRNA sequence
gccaccctgcagaaagaaca

SEQ ID NO: 422380 - DNA, 20 bp, Artificial
  CRISPR gRNA sequence
ccaccctgcagaaagaacaa

SEQ ID NO: 422381 - DNA, 20 bp, Artificial
  CRISPR gRNA sequence
caccctgcagaaagaacaaa

SEQ ID NO: 422382 - DNA, 20 bp, Artificial
  CRISPR gRNA sequence
cccctactgttgctttgcat

SEQ ID NO: 422383 - DNA, 20 bp, Artificial
  CRISPR gRNA sequence
gcattggctgacctcaaact

SEQ ID NO: 422384 - DNA, 20 bp, Artificial
  CRISPR gRNA sequence
cattggctgacctcaaactt

SEQ ID NO: 422385 - DNA, 20 bp, Artificial
  CRISPR gRNA sequence
ggctgacctcaaacttagga

SEQ ID NO: 422386 - DNA, 20 bp, Artificial
  CRISPR gRNA sequence
ctgacctcaaacttaggatg

SEQ ID NO: 422387 - DNA, 20 bp, Artificial
  CRISPR gRNA sequence
tgacctcaaacttaggatgg

SEQ ID NO: 422388 - DNA, 20 bp, Artificial
  CRISPR gRNA sequence
tcaaacttaggatggaggat

SEQ ID NO: 422389 - DNA, 20 bp, Artificial
  CRISPR gRNA sequence
caaacttaggatggaggata

SEQ ID NO: 422390 - DNA, 20 bp, Artificial
  CRISPR gRNA sequence
aaacttaggatggaggataa

SEQ ID NO: 422391 - DNA, 20 bp, Artificial
  CRISPR gRNA sequence
aacttaggatggaggataag

SEQ ID NO: 422392 - DNA, 20 bp, Artificial
  CRISPR gRNA sequence
gataaggggactcattgatg

SEQ ID NO: 422393 - DNA, 20 bp, Artificial
  CRISPR gRNA sequence
actcattgatgtagtacatt

SEQ ID NO: 422394 - DNA, 20 bp, Artificial
  CRISPR gRNA sequence
ttgatgtagtacatttagta

SEQ ID NO: 422395 - DNA, 20 bp, Artificial
  CRISPR gRNA sequence
tacatttagtacagtcttca

SEQ ID NO: 422396 - DNA, 20 bp, Artificial
  CRISPR gRNA sequence
acatttagtacagtcttcat

SEQ ID NO: 422397 - DNA, 20 bp, Artificial
  CRISPR gRNA sequence
catttagtacagtcttcata

SEQ ID NO: 422398 - DNA, 20 bp, Artificial
  CRISPR gRNA sequence
agtacagtcttcatagggca

SEQ ID NO: 422399 - DNA, 20 bp, Artificial
  CRISPR gRNA sequence
agtcttcatagggcacagaa

SEQ ID NO: 422400 - DNA, 20 bp, Artificial
  CRISPR gRNA sequence
gtcttcatagggcacagaat

SEQ ID NO: 422401 - DNA, 20 bp, Artificial
  CRISPR gRNA sequence
tcttcatagggcacagaata

SEQ ID NO: 422402 - DNA, 20 bp, Artificial
  CRISPR gRNA sequence
tcatagggcacagaataggg

SEQ ID NO: 422403 - DNA, 20 bp, Artificial
  CRISPR gRNA sequence
atagggcacagaatagggtg

SEQ ID NO: 422404 - DNA, 20 bp, Artificial
  CRISPR gRNA sequence
gggcacagaatagggtggag

SEQ ID NO: 422405 - DNA, 20 bp, Artificial
  CRISPR gRNA sequence
ggcacagaatagggtggaga

SEQ ID NO: 422406 - DNA, 20 bp, Artificial
  CRISPR gRNA sequence
cagaatagggtggagaaggt

SEQ ID NO: 422407 - DNA, 20 bp, Artificial
  CRISPR gRNA sequence
gaatagggtggagaaggtta

SEQ ID NO: 422408 - DNA, 20 bp, Artificial
  CRISPR gRNA sequence
atagggtggagaaggttaga

SEQ ID NO: 422409 - DNA, 20 bp, Artificial
  CRISPR gRNA sequence
gggtggagaaggttagagag

SEQ ID NO: 422410 - DNA, 20 bp, Artificial
  CRISPR gRNA sequence
gtggagaaggttagagagca

SEQ ID NO: 422411 - DNA, 20 bp, Artificial
  CRISPR gRNA sequence
gaaggttagagagcagagcc

SEQ ID NO: 422412 - DNA, 20 bp, Artificial
  CRISPR gRNA sequence
aggttagagagcagagccaa

SEQ ID NO: 422413 - DNA, 20 bp, Artificial
  CRISPR gRNA sequence
ggttagagagcagagccaag

SEQ ID NO: 422414 - DNA, 20 bp, Artificial
  CRISPR gRNA sequence
gagcagagccaagaggcaaa

SEQ ID NO: 422415 - DNA, 20 bp, Artificial
  CRISPR gRNA sequence
agagccaagaggcaaatggc

SEQ ID NO: 422416 - DNA, 20 bp, Artificial
  CRISPR gRNA sequence
caaatggctggtatccattc

SEQ ID NO: 422417 - DNA, 20 bp, Artificial
  CRISPR gRNA sequence
atggctggtatccattcaag

SEQ ID NO: 422418 - DNA, 20 bp, Artificial
  CRISPR gRNA sequence
atccattcaagtagtgctca

SEQ ID NO: 422419 - DNA, 20 bp, Artificial
  CRISPR gRNA sequence
gtgctcatagacatgaacac

SEQ ID NO: 422420 - DNA, 20 bp, Artificial
  CRISPR gRNA sequence
atagacatgaacactggaca

SEQ ID NO: 422421 - DNA, 20 bp, Artificial
  CRISPR gRNA sequence
tagacatgaacactggacaa

SEQ ID NO: 422422 - DNA, 20 bp, Artificial
  CRISPR gRNA sequence
caaaggatcttgactttcca

SEQ ID NO: 422423 - DNA, 20 bp, Artificial
  CRISPR gRNA sequence
aaaggatcttgactttccac

SEQ ID NO: 422424 - DNA, 20 bp, Artificial
  CRISPR gRNA sequence
aaggatcttgactttccaca

SEQ ID NO: 422425 - DNA, 20 bp, Artificial
  CRISPR gRNA sequence
atcttgactttccacagggt

SEQ ID NO: 422426 - DNA, 20 bp, Artificial
  CRISPR gRNA sequence
tgactttccacagggttggc

SEQ ID NO: 422427 - DNA, 20 bp, Artificial
  CRISPR gRNA sequence
tccacagggttggctggctt

SEQ ID NO: 422428 - DNA, 20 bp, Artificial
  CRISPR gRNA sequence
ggcttcagccttctctcttg

SEQ ID NO: 422429 - DNA, 20 bp, Artificial
  CRISPR gRNA sequence
cctcttttgattatgtatgt

SEQ ID NO: 422430 - DNA, 20 bp, Artificial
  CRISPR gRNA sequence
tatgtaagcaatacccttct

SEQ ID NO: 422431 - DNA, 20 bp, Artificial
  CRISPR gRNA sequence
caatacccttcttggctgcc

SEQ ID NO: 422432 - DNA, 20 bp, Artificial
  CRISPR gRNA sequence
ctgcccagctgtatctctcc

SEQ ID NO: 422433 - DNA, 20 bp, Artificial
  CRISPR gRNA sequence
tgcccagctgtatctctcct

SEQ ID NO: 422434 - DNA, 20 bp, Artificial
  CRISPR gRNA sequence
taaccattttaatattccca

SEQ ID NO: 422435 - DNA, 20 bp, Artificial
  CRISPR gRNA sequence
attttaatattcccatggat

SEQ ID NO: 422436 - DNA, 20 bp, Artificial
  CRISPR gRNA sequence
ttttaatattcccatggatc

SEQ ID NO: 422437 - DNA, 20 bp, Artificial
  CRISPR gRNA sequence
tcccatggatcaggctttct

SEQ ID NO: 422438 - DNA, 20 bp, Artificial
  CRISPR gRNA sequence
ggctttcttggctcccattg

SEQ ID NO: 422439 - DNA, 20 bp, Artificial
  CRISPR gRNA sequence
tacatccattttgtttcttt

SEQ ID NO: 422440 - DNA, 20 bp, Artificial
  CRISPR gRNA sequence
ctatctgttctgtactattt

SEQ ID NO: 422441 - DNA, 20 bp, Artificial
  CRISPR gRNA sequence
tatctgttctgtactatttt

SEQ ID NO: 422442 - DNA, 20 bp, Artificial
  CRISPR gRNA sequence
ctcctcatcctcattgctac

SEQ ID NO: 422443 - DNA, 20 bp, Artificial
  CRISPR gRNA sequence
tcctcatcctcattgctact

SEQ ID NO: 422444 - DNA, 20 bp, Artificial
  CRISPR gRNA sequence
cctcattgctactaggaatc

SEQ ID NO: 422445 - DNA, 20 bp, Artificial
  CRISPR gRNA sequence
ctaggaatccagttctgtaa

SEQ ID NO: 422446 - DNA, 20 bp, Artificial
  CRISPR gRNA sequence
tgtaaaagcatctcctattt

SEQ ID NO: 422447 - DNA, 20 bp, Artificial
  CRISPR gRNA sequence
agcatctcctattttagccc

SEQ ID NO: 422448 - DNA, 20 bp, Artificial
  CRISPR gRNA sequence
cctattttagccctagccta

SEQ ID NO: 422449 - DNA, 20 bp, Artificial
  CRISPR gRNA sequence
tattttagccctagcctata

SEQ ID NO: 422450 - DNA, 20 bp, Artificial
  CRISPR gRNA sequence
attttagccctagcctatag

SEQ ID NO: 422451 - DNA, 20 bp, Artificial
  CRISPR gRNA sequence
tttagccctagcctatagag

SEQ ID NO: 422452 - DNA, 20 bp, Artificial
  CRISPR gRNA sequence
tagccctagcctatagagga

SEQ ID NO: 422453 - DNA, 20 bp, Artificial
  CRISPR gRNA sequence
accaaacttctcaatgatgc

SEQ ID NO: 422454 - DNA, 20 bp, Artificial
  CRISPR gRNA sequence
caaacttctcaatgatgctg

SEQ ID NO: 422455 - DNA, 20 bp, Artificial
  CRISPR gRNA sequence
caatgatgctggagctcccc

SEQ ID NO: 422456 - DNA, 20 bp, Artificial
  CRISPR gRNA sequence
tcccctagcacattcttttc

SEQ ID NO: 422457 - DNA, 20 bp, Artificial
  CRISPR gRNA sequence
tagcacattcttttccagct

SEQ ID NO: 422458 - DNA, 20 bp, Artificial
  CRISPR gRNA sequence
attcttttccagcttagtaa

SEQ ID NO: 422459 - DNA, 20 bp, Artificial
  CRISPR gRNA sequence
ttcttttccagcttagtaaa

SEQ ID NO: 422460 - DNA, 20 bp, Artificial
  CRISPR gRNA sequence
tcttttccagcttagtaaaa

SEQ ID NO: 422461 - DNA, 20 bp, Artificial
  CRISPR gRNA sequence
tttattgttgctattatctt

SEQ ID NO: 422462 - DNA, 20 bp, Artificial
  CRISPR gRNA sequence
ttattgttgctattatctta

SEQ ID NO: 422463 - DNA, 20 bp, Artificial
  CRISPR gRNA sequence
tattgttgctattatcttaa

SEQ ID NO: 422464 - DNA, 20 bp, Artificial
  CRISPR gRNA sequence
ttatcttaagggatgttctc

SEQ ID NO: 422465 - DNA, 20 bp, Artificial
  CRISPR gRNA sequence
gatgttctctggatcttccc

SEQ ID NO: 422466 - DNA, 20 bp, Artificial
  CRISPR gRNA sequence
tctctggatcttccctagaa

SEQ ID NO: 422467 - DNA, 20 bp, Artificial
  CRISPR gRNA sequence
cctagaaaagtcaatataat

SEQ ID NO: 422468 - DNA, 20 bp, Artificial
  CRISPR gRNA sequence
aagtcaatataatcagctat

SEQ ID NO: 422469 - DNA, 20 bp, Artificial
  CRISPR gRNA sequence
tataatcagctattggattt

SEQ ID NO: 422470 - DNA, 20 bp, Artificial
  CRISPR gRNA sequence
attggattttggaaattatt

SEQ ID NO: 422471 - DNA, 20 bp, Artificial
  CRISPR gRNA sequence
attttggaaattattcagta

SEQ ID NO: 422472 - DNA, 20 bp, Artificial
  CRISPR gRNA sequence
ttttggaaattattcagtac

SEQ ID NO: 422473 - DNA, 20 bp, Artificial
  CRISPR gRNA sequence
tttggaaattattcagtaca

SEQ ID NO: 422474 - DNA, 20 bp, Artificial
  CRISPR gRNA sequence
aaattattcagtacagggat

SEQ ID NO: 422475 - DNA, 20 bp, Artificial
  CRISPR gRNA sequence
attggcaaaatttctctgta

SEQ ID NO: 422476 - DNA, 20 bp, Artificial
  CRISPR gRNA sequence
tggcaaaatttctctgtaaa

SEQ ID NO: 422477 - DNA, 20 bp, Artificial
  CRISPR gRNA sequence
ggcaaaatttctctgtaaag

SEQ ID NO: 422478 - DNA, 20 bp, Artificial
  CRISPR gRNA sequence
aaaatttctctgtaaagagg

SEQ ID NO: 422479 - DNA, 20 bp, Artificial
  CRISPR gRNA sequence
tttctctgtaaagaggcaga

SEQ ID NO: 422480 - DNA, 20 bp, Artificial
  CRISPR gRNA sequence
aggcagatagtatatctttt

SEQ ID NO: 422481 - DNA, 20 bp, Artificial
  CRISPR gRNA sequence
ggcagatagtatatcttttt

SEQ ID NO: 422482 - DNA, 20 bp, Artificial
  CRISPR gRNA sequence
agtatatctttttgggtttg

SEQ ID NO: 422483 - DNA, 20 bp, Artificial
  CRISPR gRNA sequence
gtatatctttttgggtttgt

SEQ ID NO: 422484 - DNA, 20 bp, Artificial
  CRISPR gRNA sequence
ttttgggtttgtaggtcata

SEQ ID NO: 422485 - DNA, 20 bp, Artificial
  CRISPR gRNA sequence
acaattcaactctgccattg

SEQ ID NO: 422486 - DNA, 20 bp, Artificial
  CRISPR gRNA sequence
actctgccattgtagtgtga

SEQ ID NO: 422487 - DNA, 20 bp, Artificial
  CRISPR gRNA sequence
attgtagtgtgaaagtgcta

SEQ ID NO: 422488 - DNA, 20 bp, Artificial
  CRISPR gRNA sequence
ttatatattttttatttcaa

SEQ ID NO: 422489 - DNA, 20 bp, Artificial
  CRISPR gRNA sequence
tatatattttttatttcaat

SEQ ID NO: 422490 - DNA, 20 bp, Artificial
  CRISPR gRNA sequence
tttttatttcaataggtttt

SEQ ID NO: 422491 - DNA, 20 bp, Artificial
  CRISPR gRNA sequence
ttttatttcaataggttttt

SEQ ID NO: 422492 - DNA, 20 bp, Artificial
  CRISPR gRNA sequence
tttatttcaataggtttttg

SEQ ID NO: 422493 - DNA, 20 bp, Artificial
  CRISPR gRNA sequence
tcaataggtttttggggaat

SEQ ID NO: 422494 - DNA, 20 bp, Artificial
  CRISPR gRNA sequence
tttttggggaataagtcctt

SEQ ID NO: 422495 - DNA, 20 bp, Artificial
  CRISPR gRNA sequence
ttggggaataagtcctttag

SEQ ID NO: 422496 - DNA, 20 bp, Artificial
  CRISPR gRNA sequence
gtcctttagtggtgatttct

SEQ ID NO: 422497 - DNA, 20 bp, Artificial
  CRISPR gRNA sequence
agtggtgatttctgagattt

SEQ ID NO: 422498 - DNA, 20 bp, Artificial
  CRISPR gRNA sequence
tggtgcacccatcacccgaa

SEQ ID NO: 422499 - DNA, 20 bp, Artificial
  CRISPR gRNA sequence
cgaacagtgtacactgtacc

SEQ ID NO: 422500 - DNA, 20 bp, Artificial
  CRISPR gRNA sequence
tgtacactgtacccagtgtg

SEQ ID NO: 422501 - DNA, 20 bp, Artificial
  CRISPR gRNA sequence
gtgtgtagtcctttatccct

SEQ ID NO: 422502 - DNA, 20 bp, Artificial
  CRISPR gRNA sequence
cctctcccactcttttccct

SEQ ID NO: 422503 - DNA, 20 bp, Artificial
  CRISPR gRNA sequence
ctcttttccctgagtcccca

SEQ ID NO: 422504 - DNA, 20 bp, Artificial
  CRISPR gRNA sequence
cctgagtccccaaagtccat

SEQ ID NO: 422505 - DNA, 20 bp, Artificial
  CRISPR gRNA sequence
ttaacgcctttgcgtcctca

SEQ ID NO: 422506 - DNA, 20 bp, Artificial
  CRISPR gRNA sequence
gcctttgcgtcctcatagct

SEQ ID NO: 422507 - DNA, 20 bp, Artificial
  CRISPR gRNA sequence
atagcttagctcccacttct

SEQ ID NO: 422508 - DNA, 20 bp, Artificial
  CRISPR gRNA sequence
cttagctcccacttctgagt

SEQ ID NO: 422509 - DNA, 20 bp, Artificial
  CRISPR gRNA sequence
gagtgagaacatacaatgtt

SEQ ID NO: 422510 - DNA, 20 bp, Artificial
  CRISPR gRNA sequence
atgtttggtttttcattcct

SEQ ID NO: 422511 - DNA, 20 bp, Artificial
  CRISPR gRNA sequence
ttcctgagttacttcactta

SEQ ID NO: 422512 - DNA, 20 bp, Artificial
  CRISPR gRNA sequence
ctgagttacttcacttatag

SEQ ID NO: 422513 - DNA, 20 bp, Artificial
  CRISPR gRNA sequence
agttacttcacttatagtag

SEQ ID NO: 422514 - DNA, 20 bp, Artificial
  CRISPR gRNA sequence
tagtggtttccaattccatc

SEQ ID NO: 422515 - DNA, 20 bp, Artificial
  CRISPR gRNA sequence
agtggtttccaattccatcc

SEQ ID NO: 422516 - DNA, 20 bp, Artificial
  CRISPR gRNA sequence
cattattttgttccttttta

SEQ ID NO: 422517 - DNA, 20 bp, Artificial
  CRISPR gRNA sequence
ttttgttcctttttatggct

SEQ ID NO: 422518 - DNA, 20 bp, Artificial
  CRISPR gRNA sequence
tgttcctttttatggctgag

SEQ ID NO: 422519 - DNA, 20 bp, Artificial
  CRISPR gRNA sequence
tatggctgagtagtattcca

SEQ ID NO: 422520 - DNA, 20 bp, Artificial
  CRISPR gRNA sequence
cacacacacacacacacaca

SEQ ID NO: 422521 - DNA, 20 bp, Artificial
  CRISPR gRNA sequence
tttatccactcattgattga

SEQ ID NO: 422522 - DNA, 20 bp, Artificial
  CRISPR gRNA sequence
ttatccactcattgattgat

SEQ ID NO: 422523 - DNA, 20 bp, Artificial
  CRISPR gRNA sequence
ctcattgattgatgggcatt

SEQ ID NO: 422524 - DNA, 20 bp, Artificial
  CRISPR gRNA sequence
tcattgattgatgggcattt

SEQ ID NO: 422525 - DNA, 20 bp, Artificial
  CRISPR gRNA sequence
tgattgatgggcatttgggc

SEQ ID NO: 422526 - DNA, 20 bp, Artificial
  CRISPR gRNA sequence
tataatgacttcttttcctc

SEQ ID NO: 422527 - DNA, 20 bp, Artificial
  CRISPR gRNA sequence
atgacttcttttcctctgga

SEQ ID NO: 422528 - DNA, 20 bp, Artificial
  CRISPR gRNA sequence
ttttcctctggatagatacc

SEQ ID NO: 422529 - DNA, 20 bp, Artificial
  CRISPR gRNA sequence
tcctctggatagatacccag

SEQ ID NO: 422530 - DNA, 20 bp, Artificial
  CRISPR gRNA sequence
tctggatagatacccagtag

SEQ ID NO: 422531 - DNA, 20 bp, Artificial
  CRISPR gRNA sequence
ctggatagatacccagtagt

SEQ ID NO: 422532 - DNA, 20 bp, Artificial
  CRISPR gRNA sequence
atacccagtagtgggattac

SEQ ID NO: 422533 - DNA, 20 bp, Artificial
  CRISPR gRNA sequence
gggattactggattaaatca

SEQ ID NO: 422534 - DNA, 20 bp, Artificial
  CRISPR gRNA sequence
ttaaatcatagttctacttt

SEQ ID NO: 422535 - DNA, 20 bp, Artificial
  CRISPR gRNA sequence
agttctacttttagttcctt

SEQ ID NO: 422536 - DNA, 20 bp, Artificial
  CRISPR gRNA sequence
gttctacttttagttcctta

SEQ ID NO: 422537 - DNA, 20 bp, Artificial
  CRISPR gRNA sequence
aatctccacactgttttcca

SEQ ID NO: 422538 - DNA, 20 bp, Artificial
  CRISPR gRNA sequence
actgttttccatagtcatac

SEQ ID NO: 422539 - DNA, 20 bp, Artificial
  CRISPR gRNA sequence
atactagtttacattcccac

SEQ ID NO: 422540 - DNA, 20 bp, Artificial
  CRISPR gRNA sequence
ctagtttacattcccacaag

SEQ ID NO: 422541 - DNA, 20 bp, Artificial
  CRISPR gRNA sequence
cattcccacaagcagtgtaa

SEQ ID NO: 422542 - DNA, 20 bp, Artificial
  CRISPR gRNA sequence
tcaccacatccatgccaaca

SEQ ID NO: 422543 - DNA, 20 bp, Artificial
  CRISPR gRNA sequence
caccacatccatgccaacat

SEQ ID NO: 422544 - DNA, 20 bp, Artificial
  CRISPR gRNA sequence
tatttttttattttttgatt

SEQ ID NO: 422545 - DNA, 20 bp, Artificial
  CRISPR gRNA sequence
atttttttattttttgatta

SEQ ID NO: 422546 - DNA, 20 bp, Artificial
  CRISPR gRNA sequence
ttgattaaggccattcttac

SEQ ID NO: 422547 - DNA, 20 bp, Artificial
  CRISPR gRNA sequence
gattaaggccattcttacaa

SEQ ID NO: 422548 - DNA, 20 bp, Artificial
  CRISPR gRNA sequence
aaggccattcttacaagagt

SEQ ID NO: 422549 - DNA, 20 bp, Artificial
  CRISPR gRNA sequence
aggccattcttacaagagta

SEQ ID NO: 422550 - DNA, 20 bp, Artificial
  CRISPR gRNA sequence
ccattcttacaagagtaagg

SEQ ID NO: 422551 - DNA, 20 bp, Artificial
  CRISPR gRNA sequence
atttgcgtttccctgataat

SEQ ID NO: 422552 - DNA, 20 bp, Artificial
  CRISPR gRNA sequence
ccctgataattagtgatgtt

SEQ ID NO: 422553 - DNA, 20 bp, Artificial
  CRISPR gRNA sequence
gcattttttcatatgtttgt

SEQ ID NO: 422554 - DNA, 20 bp, Artificial
  CRISPR gRNA sequence
ccatttgtatatccttttct

SEQ ID NO: 422555 - DNA, 20 bp, Artificial
  CRISPR gRNA sequence
gaattgtctttttatgtcct

SEQ ID NO: 422556 - DNA, 20 bp, Artificial
  CRISPR gRNA sequence
gtccttagcccactttttga

SEQ ID NO: 422557 - DNA, 20 bp, Artificial
  CRISPR gRNA sequence
tccttagcccactttttgat

SEQ ID NO: 422558 - DNA, 20 bp, Artificial
  CRISPR gRNA sequence
ttttgatgggattttttttt

SEQ ID NO: 422559 - DNA, 20 bp, Artificial
  CRISPR gRNA sequence
ttttttcagctgatttgttt

SEQ ID NO: 422560 - DNA, 20 bp, Artificial
  CRISPR gRNA sequence
tgatttgtttgagttccttg

SEQ ID NO: 422561 - DNA, 20 bp, Artificial
  CRISPR gRNA sequence
tttgagttccttgtagattc

SEQ ID NO: 422562 - DNA, 20 bp, Artificial
  CRISPR gRNA sequence
tccttgtagattctggatat

SEQ ID NO: 422563 - DNA, 20 bp, Artificial
  CRISPR gRNA sequence
tctggatattagtcctttgt

SEQ ID NO: 422564 - DNA, 20 bp, Artificial
  CRISPR gRNA sequence
aaatattttctcccaatctg

SEQ ID NO: 422565 - DNA, 20 bp, Artificial
  CRISPR gRNA sequence
aatattttctcccaatctgt

SEQ ID NO: 422566 - DNA, 20 bp, Artificial
  CRISPR gRNA sequence
tgattatttcttttgctgtg

SEQ ID NO: 422567 - DNA, 20 bp, Artificial
  CRISPR gRNA sequence
ttatttcttttgctgtgcag

SEQ ID NO: 422568 - DNA, 20 bp, Artificial
  CRISPR gRNA sequence
aaaaaacacttaaaatataa

SEQ ID NO: 422569 - DNA, 20 bp, Artificial
  CRISPR gRNA sequence
taaaatataaaagccatctt

SEQ ID NO: 422570 - DNA, 20 bp, Artificial
  CRISPR gRNA sequence
ataaaagccatctttagttc

SEQ ID NO: 422571 - DNA, 20 bp, Artificial
  CRISPR gRNA sequence
taaaagccatctttagttca

SEQ ID NO: 422572 - DNA, 20 bp, Artificial
  CRISPR gRNA sequence
aaaagccatctttagttcaa

SEQ ID NO: 422573 - DNA, 20 bp, Artificial
  CRISPR gRNA sequence
gttcaagggctgtaaaaaac

SEQ ID NO: 422574 - DNA, 20 bp, Artificial
  CRISPR gRNA sequence
caagggctgtaaaaaaccag

SEQ ID NO: 422575 - DNA, 20 bp, Artificial
  CRISPR gRNA sequence
gggctgtaaaaaaccagcag

SEQ ID NO: 422576 - DNA, 20 bp, Artificial
  CRISPR gRNA sequence
ggctgtaaaaaaccagcagt

SEQ ID NO: 422577 - DNA, 20 bp, Artificial
  CRISPR gRNA sequence
catatttgacccacaaaact

SEQ ID NO: 422578 - DNA, 20 bp, Artificial
  CRISPR gRNA sequence
tcagtttgccatttctgatt

SEQ ID NO: 422579 - DNA, 20 bp, Artificial
  CRISPR gRNA sequence
gtttgccatttctgatttag

SEQ ID NO: 422580 - DNA, 20 bp, Artificial
  CRISPR gRNA sequence
tttgccatttctgatttagt

SEQ ID NO: 422581 - DNA, 20 bp, Artificial
  CRISPR gRNA sequence
atttagtaggtttattctct

SEQ ID NO: 422582 - DNA, 20 bp, Artificial
  CRISPR gRNA sequence
cattttgttccccttttcca

SEQ ID NO: 422583 - DNA, 20 bp, Artificial
  CRISPR gRNA sequence
cccttttccatagtttgcca

SEQ ID NO: 422584 - DNA, 20 bp, Artificial
  CRISPR gRNA sequence
ttttccatagtttgccaaag

SEQ ID NO: 422585 - DNA, 20 bp, Artificial
  CRISPR gRNA sequence
agtgttgtcatctctattga

SEQ ID NO: 422586 - DNA, 20 bp, Artificial
  CRISPR gRNA sequence
gttgtcatctctattgacag

SEQ ID NO: 422587 - DNA, 20 bp, Artificial
  CRISPR gRNA sequence
ctctattgacagcagtatat

SEQ ID NO: 422588 - DNA, 20 bp, Artificial
  CRISPR gRNA sequence
agtatatcagaatcatctcc

SEQ ID NO: 422589 - DNA, 20 bp, Artificial
  CRISPR gRNA sequence
gtatatcagaatcatctcct

SEQ ID NO: 422590 - DNA, 20 bp, Artificial
  CRISPR gRNA sequence
tatatcagaatcatctcctg

SEQ ID NO: 422591 - DNA, 20 bp, Artificial
  CRISPR gRNA sequence
tcatctcctggggcccttgt

SEQ ID NO: 422592 - DNA, 20 bp, Artificial
  CRISPR gRNA sequence
catctcctggggcccttgtg

SEQ ID NO: 422593 - DNA, 20 bp, Artificial
  CRISPR gRNA sequence
atctcctggggcccttgtga

SEQ ID NO: 422594 - DNA, 20 bp, Artificial
  CRISPR gRNA sequence
ttgtgagggtgttaaatatt

SEQ ID NO: 422595 - DNA, 20 bp, Artificial
  CRISPR gRNA sequence
ttgacgcattatccctcatc

SEQ ID NO: 422596 - DNA, 20 bp, Artificial
  CRISPR gRNA sequence
tgacgcattatccctcatcc

SEQ ID NO: 422597 - DNA, 20 bp, Artificial
  CRISPR gRNA sequence
ctaccacaatccatcacctt

SEQ ID NO: 422598 - DNA, 20 bp, Artificial
  CRISPR gRNA sequence
tcaccttcagaattcatgcc

SEQ ID NO: 422599 - DNA, 20 bp, Artificial
  CRISPR gRNA sequence
caccttcagaattcatgcct

SEQ ID NO: 422600 - DNA, 20 bp, Artificial
  CRISPR gRNA sequence
catgcctaggcatcttctcc

SEQ ID NO: 422601 - DNA, 20 bp, Artificial
  CRISPR gRNA sequence
catcttctcccagtccctgc

SEQ ID NO: 422602 - DNA, 20 bp, Artificial
  CRISPR gRNA sequence
cttctcccagtccctgccag

SEQ ID NO: 422603 - DNA, 20 bp, Artificial
  CRISPR gRNA sequence
cagtccctgccagtagatgt

SEQ ID NO: 422604 - DNA, 20 bp, Artificial
  CRISPR gRNA sequence
ccctgccagtagatgttagc

SEQ ID NO: 422605 - DNA, 20 bp, Artificial
  CRISPR gRNA sequence
cctgccagtagatgttagcc

SEQ ID NO: 422606 - DNA, 20 bp, Artificial
  CRISPR gRNA sequence
tagatgttagccaggtcctg

SEQ ID NO: 422607 - DNA, 20 bp, Artificial
  CRISPR gRNA sequence
atataacctttctattctct

SEQ ID NO: 422608 - DNA, 20 bp, Artificial
  CRISPR gRNA sequence
taacctttctattctcttag

SEQ ID NO: 422609 - DNA, 20 bp, Artificial
  CRISPR gRNA sequence
ttctattctcttagcagacc

SEQ ID NO: 422610 - DNA, 20 bp, Artificial
  CRISPR gRNA sequence
agacccagcacttcctccat

SEQ ID NO: 422611 - DNA, 20 bp, Artificial
  CRISPR gRNA sequence
cagcacttcctccattagca

SEQ ID NO: 422612 - DNA, 20 bp, Artificial
  CRISPR gRNA sequence
agcacttcctccattagcat

SEQ ID NO: 422613 - DNA, 20 bp, Artificial
  CRISPR gRNA sequence
ttcctccattagcatgggct

SEQ ID NO: 422614 - DNA, 20 bp, Artificial
  CRISPR gRNA sequence
ctgagattttatcctaatta

SEQ ID NO: 422615 - DNA, 20 bp, Artificial
  CRISPR gRNA sequence
tgagattttatcctaattac

SEQ ID NO: 422616 - DNA, 20 bp, Artificial
  CRISPR gRNA sequence
tatcctaattacgggcctga

SEQ ID NO: 422617 - DNA, 20 bp, Artificial
  CRISPR gRNA sequence
ctaattacgggcctgatgga

SEQ ID NO: 422618 - DNA, 20 bp, Artificial
  CRISPR gRNA sequence
attacgggcctgatggacag

SEQ ID NO: 422619 - DNA, 20 bp, Artificial
  CRISPR gRNA sequence
ttacgggcctgatggacagt

SEQ ID NO: 422620 - DNA, 20 bp, Artificial
  CRISPR gRNA sequence
tacgggcctgatggacagta

SEQ ID NO: 422621 - DNA, 20 bp, Artificial
  CRISPR gRNA sequence
acgggcctgatggacagtag

SEQ ID NO: 422622 - DNA, 20 bp, Artificial
  CRISPR gRNA sequence
gggcctgatggacagtaggg

SEQ ID NO: 422623 - DNA, 20 bp, Artificial
  CRISPR gRNA sequence
ggcctgatggacagtagggg

SEQ ID NO: 422624 - DNA, 20 bp, Artificial
  CRISPR gRNA sequence
ctgatggacagtaggggagg

SEQ ID NO: 422625 - DNA, 20 bp, Artificial
  CRISPR gRNA sequence
gatggacagtaggggaggca

SEQ ID NO: 422626 - DNA, 20 bp, Artificial
  CRISPR gRNA sequence
atggacagtaggggaggcag

SEQ ID NO: 422627 - DNA, 20 bp, Artificial
  CRISPR gRNA sequence
gacagtaggggaggcagagg

SEQ ID NO: 422628 - DNA, 20 bp, Artificial
  CRISPR gRNA sequence
acagtaggggaggcagaggc

SEQ ID NO: 422629 - DNA, 20 bp, Artificial
  CRISPR gRNA sequence
cagtaggggaggcagaggca

SEQ ID NO: 422630 - DNA, 20 bp, Artificial
  CRISPR gRNA sequence
ggggaggcagaggcagggcc

SEQ ID NO: 422631 - DNA, 20 bp, Artificial
  CRISPR gRNA sequence
gaggcagaggcagggcccag

SEQ ID NO: 422632 - DNA, 20 bp, Artificial
  CRISPR gRNA sequence
aggcagaggcagggcccagc

SEQ ID NO: 422633 - DNA, 20 bp, Artificial
  CRISPR gRNA sequence
ggcagaggcagggcccagca

SEQ ID NO: 422634 - DNA, 20 bp, Artificial
  CRISPR gRNA sequence
agcagggattcttttccatc

SEQ ID NO: 422635 - DNA, 20 bp, Artificial
  CRISPR gRNA sequence
gcagggattcttttccatca

SEQ ID NO: 422636 - DNA, 20 bp, Artificial
  CRISPR gRNA sequence
cagggattcttttccatcaa

SEQ ID NO: 422637 - DNA, 20 bp, Artificial
  CRISPR gRNA sequence
agggattcttttccatcaag

SEQ ID NO: 422638 - DNA, 20 bp, Artificial
  CRISPR gRNA sequence
gattcttttccatcaagggg

SEQ ID NO: 422639 - DNA, 20 bp, Artificial
  CRISPR gRNA sequence
tcttttccatcaaggggaag

SEQ ID NO: 422640 - DNA, 20 bp, Artificial
  CRISPR gRNA sequence
cttttccatcaaggggaagt

SEQ ID NO: 422641 - DNA, 20 bp, Artificial
  CRISPR gRNA sequence
ggggaagtgggccacttctg

SEQ ID NO: 422642 - DNA, 20 bp, Artificial
  CRISPR gRNA sequence
gtgggccacttctgcagctc

SEQ ID NO: 422643 - DNA, 20 bp, Artificial
  CRISPR gRNA sequence
gccacttctgcagctccaga

SEQ ID NO: 422644 - DNA, 20 bp, Artificial
  CRISPR gRNA sequence
tctgcagctccagatggtat

SEQ ID NO: 422645 - DNA, 20 bp, Artificial
  CRISPR gRNA sequence
tgcagctccagatggtataa

SEQ ID NO: 422646 - DNA, 20 bp, Artificial
  CRISPR gRNA sequence
agctccagatggtataagag

SEQ ID NO: 422647 - DNA, 20 bp, Artificial
  CRISPR gRNA sequence
tccagatggtataagagaag

SEQ ID NO: 422648 - DNA, 20 bp, Artificial
  CRISPR gRNA sequence
ccagatggtataagagaagc

SEQ ID NO: 422649 - DNA, 20 bp, Artificial
  CRISPR gRNA sequence
gatggtataagagaagcagg

SEQ ID NO: 422650 - DNA, 20 bp, Artificial
  CRISPR gRNA sequence
taagagaagcaggtggttcc

SEQ ID NO: 422651 - DNA, 20 bp, Artificial
  CRISPR gRNA sequence
ggctctcaaatgcatctttc

SEQ ID NO: 422652 - DNA, 20 bp, Artificial
  CRISPR gRNA sequence
ctctcaaatgcatctttcca

SEQ ID NO: 422653 - DNA, 20 bp, Artificial
  CRISPR gRNA sequence
tttccagagatcctcattcc

SEQ ID NO: 422654 - DNA, 20 bp, Artificial
  CRISPR gRNA sequence
gagatcctcattccaagttt

SEQ ID NO: 422655 - DNA, 20 bp, Artificial
  CRISPR gRNA sequence
agatcctcattccaagtttc

SEQ ID NO: 422656 - DNA, 20 bp, Artificial
  CRISPR gRNA sequence
atcctcattccaagtttcag

SEQ ID NO: 422657 - DNA, 20 bp, Artificial
  CRISPR gRNA sequence
gagactcctcctctactatc

SEQ ID NO: 422658 - DNA, 20 bp, Artificial
  CRISPR gRNA sequence
ctcctctactatcaagatgc

SEQ ID NO: 422659 - DNA, 20 bp, Artificial
  CRISPR gRNA sequence
tactatcaagatgctagctt

SEQ ID NO: 422660 - DNA, 20 bp, Artificial
  CRISPR gRNA sequence
tcaagatgctagctttggca

SEQ ID NO: 422661 - DNA, 20 bp, Artificial
  CRISPR gRNA sequence
tttggcatagaaaatttacc

SEQ ID NO: 422662 - DNA, 20 bp, Artificial
  CRISPR gRNA sequence
ttggcatagaaaatttacct

SEQ ID NO: 422663 - DNA, 20 bp, Artificial
  CRISPR gRNA sequence
atagaaaatttacctaggct

SEQ ID NO: 422664 - DNA, 20 bp, Artificial
  CRISPR gRNA sequence
aatttacctaggcttagaat

SEQ ID NO: 422665 - DNA, 20 bp, Artificial
  CRISPR gRNA sequence
cttagaatcagccttcttta

SEQ ID NO: 422666 - DNA, 20 bp, Artificial
  CRISPR gRNA sequence
agtcctgtccctcttacaat

SEQ ID NO: 422667 - DNA, 20 bp, Artificial
  CRISPR gRNA sequence
ttacaattagcttatgtacc

SEQ ID NO: 422668 - DNA, 20 bp, Artificial
  CRISPR gRNA sequence
tagcttatgtacctggtctt

SEQ ID NO: 422669 - DNA, 20 bp, Artificial
  CRISPR gRNA sequence
atgtacctggtcttcagctg

SEQ ID NO: 422670 - DNA, 20 bp, Artificial
  CRISPR gRNA sequence
acctggtcttcagctgtgga

SEQ ID NO: 422671 - DNA, 20 bp, Artificial
  CRISPR gRNA sequence
gtcttcagctgtggatagac

SEQ ID NO: 422672 - DNA, 20 bp, Artificial
  CRISPR gRNA sequence
agtgtcttttaaatgctgcc

SEQ ID NO: 422673 - DNA, 20 bp, Artificial
  CRISPR gRNA sequence
gtgtcttttaaatgctgcca

SEQ ID NO: 422674 - DNA, 20 bp, Artificial
  CRISPR gRNA sequence
gtcttttaaatgctgccaag

SEQ ID NO: 422675 - DNA, 20 bp, Artificial
  CRISPR gRNA sequence
tcttttaaatgctgccaagg

SEQ ID NO: 422676 - DNA, 20 bp, Artificial
  CRISPR gRNA sequence
ttttaaatgctgccaaggag

SEQ ID NO: 422677 - DNA, 20 bp, Artificial
  CRISPR gRNA sequence
agctttaactctcacacttt

SEQ ID NO: 422678 - DNA, 20 bp, Artificial
  CRISPR gRNA sequence
ctcacactttgagttgctga

SEQ ID NO: 422679 - DNA, 20 bp, Artificial
  CRISPR gRNA sequence
tttgagttgctgatagatct

SEQ ID NO: 422680 - DNA, 20 bp, Artificial
  CRISPR gRNA sequence
ttgagttgctgatagatctg

SEQ ID NO: 422681 - DNA, 20 bp, Artificial
  CRISPR gRNA sequence
aggctgtcattttctcactt

SEQ ID NO: 422682 - DNA, 20 bp, Artificial
  CRISPR gRNA sequence
attttctcacttcagtccat

SEQ ID NO: 422683 - DNA, 20 bp, Artificial
  CRISPR gRNA sequence
ttcagtccatcggtgcaatt

SEQ ID NO: 422684 - DNA, 20 bp, Artificial
  CRISPR gRNA sequence
ccatcggtgcaatttagcaa

SEQ ID NO: 422685 - DNA, 20 bp, Artificial
  CRISPR gRNA sequence
atttagcaaaagtcaatttt

SEQ ID NO: 422686 - DNA, 20 bp, Artificial
  CRISPR gRNA sequence
ctatactgttgacccaattc

SEQ ID NO: 422687 - DNA, 20 bp, Artificial
  CRISPR gRNA sequence
atactgttgacccaattcca

SEQ ID NO: 422688 - DNA, 20 bp, Artificial
  CRISPR gRNA sequence
accctatacacctcaaatgt

SEQ ID NO: 422689 - DNA, 20 bp, Artificial
  CRISPR gRNA sequence
cctatacacctcaaatgtta

SEQ ID NO: 422690 - DNA, 20 bp, Artificial
  CRISPR gRNA sequence
tacacctcaaatgttagagt

SEQ ID NO: 422691 - DNA, 20 bp, Artificial
  CRISPR gRNA sequence
aaatgttagagtcagtgcac

SEQ ID NO: 422692 - DNA, 20 bp, Artificial
  CRISPR gRNA sequence
agagtcagtgcaccagctca

SEQ ID NO: 422693 - DNA, 20 bp, Artificial
  CRISPR gRNA sequence
gtcccatctcatttcaccac

SEQ ID NO: 422694 - DNA, 20 bp, Artificial
  CRISPR gRNA sequence
tctcatttcaccaccagtca

SEQ ID NO: 422695 - DNA, 20 bp, Artificial
  CRISPR gRNA sequence
ctcatttcaccaccagtcat

SEQ ID NO: 422696 - DNA, 20 bp, Artificial
  CRISPR gRNA sequence
tcatttcaccaccagtcatg

SEQ ID NO: 422697 - DNA, 20 bp, Artificial
  CRISPR gRNA sequence
atggggtttgtgttgccatc

SEQ ID NO: 422698 - DNA, 20 bp, Artificial
  CRISPR gRNA sequence
gggtttgtgttgccatctag

SEQ ID NO: 422699 - DNA, 20 bp, Artificial
  CRISPR gRNA sequence
ggtttgtgttgccatctagc

SEQ ID NO: 422700 - DNA, 20 bp, Artificial
  CRISPR gRNA sequence
attccacaatcctgttctta

SEQ ID NO: 422701 - DNA, 20 bp, Artificial
  CRISPR gRNA sequence
ttccacaatcctgttcttac

SEQ ID NO: 422702 - DNA, 20 bp, Artificial
  CRISPR gRNA sequence
tgttcttacaggctgccttc

SEQ ID NO: 422703 - DNA, 20 bp, Artificial
  CRISPR gRNA sequence
gttcttacaggctgccttct

SEQ ID NO: 422704 - DNA, 20 bp, Artificial
  CRISPR gRNA sequence
ctgccttctaggactattcc

SEQ ID NO: 422705 - DNA, 20 bp, Artificial
  CRISPR gRNA sequence
ccttctaggactattcccag

SEQ ID NO: 422706 - DNA, 20 bp, Artificial
  CRISPR gRNA sequence
attcccagcagcaactgttt

SEQ ID NO: 422707 - DNA, 20 bp, Artificial
  CRISPR gRNA sequence
cagcagcaactgttttagat

SEQ ID NO: 422708 - DNA, 20 bp, Artificial
  CRISPR gRNA sequence
agcagcaactgttttagatc

SEQ ID NO: 422709 - DNA, 20 bp, Artificial
  CRISPR gRNA sequence
actgttttagatcaggtccc

SEQ ID NO: 422710 - DNA, 20 bp, Artificial
  CRISPR gRNA sequence
ttagatcaggtccccggaaa

SEQ ID NO: 422711 - DNA, 20 bp, Artificial
  CRISPR gRNA sequence
agatcaggtccccggaaata

SEQ ID NO: 422712 - DNA, 20 bp, Artificial
  CRISPR gRNA sequence
agagcctgacatgcaaattt

SEQ ID NO: 422713 - DNA, 20 bp, Artificial
  CRISPR gRNA sequence
cctgacatgcaaattttggt

SEQ ID NO: 422714 - DNA, 20 bp, Artificial
  CRISPR gRNA sequence
tgacatgcaaattttggtga

SEQ ID NO: 422715 - DNA, 20 bp, Artificial
  CRISPR gRNA sequence
ttttggtgagagtgacttat

SEQ ID NO: 422716 - DNA, 20 bp, Artificial
  CRISPR gRNA sequence
tttggtgagagtgacttatt

SEQ ID NO: 422717 - DNA, 20 bp, Artificial
  CRISPR gRNA sequence
gtgagagtgacttattggga

SEQ ID NO: 422718 - DNA, 20 bp, Artificial
  CRISPR gRNA sequence
tgacttattgggacagctct

SEQ ID NO: 422719 - DNA, 20 bp, Artificial
  CRISPR gRNA sequence
tgggacagctctcagatgaa

SEQ ID NO: 422720 - DNA, 20 bp, Artificial
  CRISPR gRNA sequence
gacagctctcagatgaaaag

SEQ ID NO: 422721 - DNA, 20 bp, Artificial
  CRISPR gRNA sequence
ctctcagatgaaaagtagtg

SEQ ID NO: 422722 - DNA, 20 bp, Artificial
  CRISPR gRNA sequence
tctcagatgaaaagtagtga

SEQ ID NO: 422723 - DNA, 20 bp, Artificial
  CRISPR gRNA sequence
cagatgaaaagtagtgaagg

SEQ ID NO: 422724 - DNA, 20 bp, Artificial
  CRISPR gRNA sequence
atgaaaagtagtgaaggaag

SEQ ID NO: 422725 - DNA, 20 bp, Artificial
  CRISPR gRNA sequence
aagtagtgaaggaagcagta

SEQ ID NO: 422726 - DNA, 20 bp, Artificial
  CRISPR gRNA sequence
agtagtgaaggaagcagtat

SEQ ID NO: 422727 - DNA, 20 bp, Artificial
  CRISPR gRNA sequence
gtagtgaaggaagcagtata

SEQ ID NO: 422728 - DNA, 20 bp, Artificial
  CRISPR gRNA sequence
agtgaaggaagcagtatagg

SEQ ID NO: 422729 - DNA, 20 bp, Artificial
  CRISPR gRNA sequence
gtgaaggaagcagtataggg

SEQ ID NO: 422730 - DNA, 20 bp, Artificial
  CRISPR gRNA sequence
tgaaggaagcagtataggga

SEQ ID NO: 422731 - DNA, 20 bp, Artificial
  CRISPR gRNA sequence
gaagcagtatagggagggct

SEQ ID NO: 422732 - DNA, 20 bp, Artificial
  CRISPR gRNA sequence
aagcagtatagggagggcta

SEQ ID NO: 422733 - DNA, 20 bp, Artificial
  CRISPR gRNA sequence
agcagtatagggagggctaa

SEQ ID NO: 422734 - DNA, 20 bp, Artificial
  CRISPR gRNA sequence
agtatagggagggctaaggg

SEQ ID NO: 422735 - DNA, 20 bp, Artificial
  CRISPR gRNA sequence
tagggagggctaagggaaga

SEQ ID NO: 422736 - DNA, 20 bp, Artificial
  CRISPR gRNA sequence
agggctaagggaagaaagct

SEQ ID NO: 422737 - DNA, 20 bp, Artificial
  CRISPR gRNA sequence
taagggaagaaagctcagca

SEQ ID NO: 422738 - DNA, 20 bp, Artificial
  CRISPR gRNA sequence
aagaaagctcagcatggata

SEQ ID NO: 422739 - DNA, 20 bp, Artificial
  CRISPR gRNA sequence
gctcagcatggatatggtct

SEQ ID NO: 422740 - DNA, 20 bp, Artificial
  CRISPR gRNA sequence
agcatggatatggtctcagc

SEQ ID NO: 422741 - DNA, 20 bp, Artificial
  CRISPR gRNA sequence
catggatatggtctcagctg

SEQ ID NO: 422742 - DNA, 20 bp, Artificial
  CRISPR gRNA sequence
tatggtctcagctggagact

SEQ ID NO: 422743 - DNA, 20 bp, Artificial
  CRISPR gRNA sequence
ctcagctggagacttggctg

SEQ ID NO: 422744 - DNA, 20 bp, Artificial
  CRISPR gRNA sequence
gctggagacttggctgaagc

SEQ ID NO: 422745 - DNA, 20 bp, Artificial
  CRISPR gRNA sequence
tggctgaagcaagaattgta

SEQ ID NO: 422746 - DNA, 20 bp, Artificial
  CRISPR gRNA sequence
gctgaagcaagaattgtaca

SEQ ID NO: 422747 - DNA, 20 bp, Artificial
  CRISPR gRNA sequence
aagcaagaattgtacagagt

SEQ ID NO: 422748 - DNA, 20 bp, Artificial
  CRISPR gRNA sequence
tacagagtcggttgaacctt

SEQ ID NO: 422749 - DNA, 20 bp, Artificial
  CRISPR gRNA sequence
acagagtcggttgaaccttt

SEQ ID NO: 422750 - DNA, 20 bp, Artificial
  CRISPR gRNA sequence
gagtcggttgaacctttagg

SEQ ID NO: 422751 - DNA, 20 bp, Artificial
  CRISPR gRNA sequence
agtcggttgaacctttaggc

SEQ ID NO: 422752 - DNA, 20 bp, Artificial
  CRISPR gRNA sequence
gtcggttgaacctttaggca

SEQ ID NO: 422753 - DNA, 20 bp, Artificial
  CRISPR gRNA sequence
cggttgaacctttaggcagg

SEQ ID NO: 422754 - DNA, 20 bp, Artificial
  CRISPR gRNA sequence
tgaacctttaggcagggagc

SEQ ID NO: 422755 - DNA, 20 bp, Artificial
  CRISPR gRNA sequence
taggcagggagctggcattt

SEQ ID NO: 422756 - DNA, 20 bp, Artificial
  CRISPR gRNA sequence
tggcattttggaaatccacc

SEQ ID NO: 422757 - DNA, 20 bp, Artificial
  CRISPR gRNA sequence
ggcattttggaaatccacct

SEQ ID NO: 422758 - DNA, 20 bp, Artificial
  CRISPR gRNA sequence
ttttggaaatccacctaggt

SEQ ID NO: 422759 - DNA, 20 bp, Artificial
  CRISPR gRNA sequence
cctaggtcagtcattacttc

SEQ ID NO: 422760 - DNA, 20 bp, Artificial
  CRISPR gRNA sequence
cattacttctggctgctcac

SEQ ID NO: 422761 - DNA, 20 bp, Artificial
  CRISPR gRNA sequence
acttctggctgctcaccagc

SEQ ID NO: 422762 - DNA, 20 bp, Artificial
  CRISPR gRNA sequence
cttctggctgctcaccagcg

SEQ ID NO: 422763 - DNA, 20 bp, Artificial
  CRISPR gRNA sequence
ttctggctgctcaccagcga

SEQ ID NO: 422764 - DNA, 20 bp, Artificial
  CRISPR gRNA sequence
ctgctcaccagcgagggccc

SEQ ID NO: 422765 - DNA, 20 bp, Artificial
  CRISPR gRNA sequence
gctcaccagcgagggcccaa

SEQ ID NO: 422766 - DNA, 20 bp, Artificial
  CRISPR gRNA sequence
agggcccaagagcaattctc

SEQ ID NO: 422767 - DNA, 20 bp, Artificial
  CRISPR gRNA sequence
ggcccaagagcaattctcca

SEQ ID NO: 422768 - DNA, 20 bp, Artificial
  CRISPR gRNA sequence
ccaagagcaattctccagag

SEQ ID NO: 422769 - DNA, 20 bp, Artificial
  CRISPR gRNA sequence
caagagcaattctccagaga

SEQ ID NO: 422770 - DNA, 20 bp, Artificial
  CRISPR gRNA sequence
aagagcaattctccagagaa

SEQ ID NO: 422771 - DNA, 20 bp, Artificial
  CRISPR gRNA sequence
agagcaattctccagagaag

SEQ ID NO: 422772 - DNA, 20 bp, Artificial
  CRISPR gRNA sequence
tccagagaaggggctgctgt

SEQ ID NO: 422773 - DNA, 20 bp, Artificial
  CRISPR gRNA sequence
aaggggctgctgtgagctca

SEQ ID NO: 422774 - DNA, 20 bp, Artificial
  CRISPR gRNA sequence
gagctcacagcgtacactcc

SEQ ID NO: 422775 - DNA, 20 bp, Artificial
  CRISPR gRNA sequence
cagcgtacactcccagcatc

SEQ ID NO: 422776 - DNA, 20 bp, Artificial
  CRISPR gRNA sequence
cactcccagcatctggaaaa

SEQ ID NO: 422777 - DNA, 20 bp, Artificial
  CRISPR gRNA sequence
actcccagcatctggaaaat

SEQ ID NO: 422778 - DNA, 20 bp, Artificial
  CRISPR gRNA sequence
tcccagcatctggaaaatgg

SEQ ID NO: 422779 - DNA, 20 bp, Artificial
  CRISPR gRNA sequence
catctggaaaatgggagtgc

SEQ ID NO: 422780 - DNA, 20 bp, Artificial
  CRISPR gRNA sequence
tggaaaatgggagtgctggt

SEQ ID NO: 422781 - DNA, 20 bp, Artificial
  CRISPR gRNA sequence
ggaaaatgggagtgctggtc

SEQ ID NO: 422782 - DNA, 20 bp, Artificial
  CRISPR gRNA sequence
aaatgggagtgctggtcagg

SEQ ID NO: 422783 - DNA, 20 bp, Artificial
  CRISPR gRNA sequence
atgggagtgctggtcaggta

SEQ ID NO: 422784 - DNA, 20 bp, Artificial
  CRISPR gRNA sequence
gggagtgctggtcaggtaga

SEQ ID NO: 422785 - DNA, 20 bp, Artificial
  CRISPR gRNA sequence
ctggtcaggtagagagatct

SEQ ID NO: 422786 - DNA, 20 bp, Artificial
  CRISPR gRNA sequence
gtcaggtagagagatctgag

SEQ ID NO: 422787 - DNA, 20 bp, Artificial
  CRISPR gRNA sequence
tcaggtagagagatctgagc

SEQ ID NO: 422788 - DNA, 20 bp, Artificial
  CRISPR gRNA sequence
tctgagcaggaactgtacat

SEQ ID NO: 422789 - DNA, 20 bp, Artificial
  CRISPR gRNA sequence
caggaactgtacattagtta

SEQ ID NO: 422790 - DNA, 20 bp, Artificial
  CRISPR gRNA sequence
aggaactgtacattagttat

SEQ ID NO: 422791 - DNA, 20 bp, Artificial
  CRISPR gRNA sequence
gtacattagttatgggtctc

SEQ ID NO: 422792 - DNA, 20 bp, Artificial
  CRISPR gRNA sequence
acattagttatgggtctccg

SEQ ID NO: 422793 - DNA, 20 bp, Artificial
  CRISPR gRNA sequence
cattagttatgggtctccgg

SEQ ID NO: 422794 - DNA, 20 bp, Artificial
  CRISPR gRNA sequence
attagttatgggtctccgga

SEQ ID NO: 422795 - DNA, 20 bp, Artificial
  CRISPR gRNA sequence
gttatgggtctccggaggga

SEQ ID NO: 422796 - DNA, 20 bp, Artificial
  CRISPR gRNA sequence
ctccggagggacagaaccaa

SEQ ID NO: 422797 - DNA, 20 bp, Artificial
  CRISPR gRNA sequence
tccggagggacagaaccaat

SEQ ID NO: 422798 - DNA, 20 bp, Artificial
  CRISPR gRNA sequence
cggagggacagaaccaatag

SEQ ID NO: 422799 - DNA, 20 bp, Artificial
  CRISPR gRNA sequence
gacagaaccaataggagata

SEQ ID NO: 422800 - DNA, 20 bp, Artificial
  CRISPR gRNA sequence
gaaccaataggagatataga

SEQ ID NO: 422801 - DNA, 20 bp, Artificial
  CRISPR gRNA sequence
caataggagatatagatgga

SEQ ID NO: 422802 - DNA, 20 bp, Artificial
  CRISPR gRNA sequence
aggagatatagatggatgga

SEQ ID NO: 422803 - DNA, 20 bp, Artificial
  CRISPR gRNA sequence
gatatagatggatggatgga

SEQ ID NO: 422804 - DNA, 20 bp, Artificial
  CRISPR gRNA sequence
tagatggatggatggatgga

SEQ ID NO: 422805 - DNA, 20 bp, Artificial
  CRISPR gRNA sequence
tggatggatggatggatgga

SEQ ID NO: 422806 - DNA, 20 bp, Artificial
  CRISPR gRNA sequence
tggatggatggatggatgga

SEQ ID NO: 422807 - DNA, 20 bp, Artificial
  CRISPR gRNA sequence
tggatggatggatggatgga

SEQ ID NO: 422808 - DNA, 20 bp, Artificial
  CRISPR gRNA sequence
tggatggatggatggatgga

SEQ ID NO: 422809 - DNA, 20 bp, Artificial
  CRISPR gRNA sequence
tggatggatggatggatgga

SEQ ID NO: 422810 - DNA, 20 bp, Artificial
  CRISPR gRNA sequence
tggatggatggatggatgga

SEQ ID NO: 422811 - DNA, 20 bp, Artificial
  CRISPR gRNA sequence
tggatggatggatggatgga

SEQ ID NO: 422812 - DNA, 20 bp, Artificial
  CRISPR gRNA sequence
tggatggatggatggatggt

SEQ ID NO: 422813 - DNA, 20 bp, Artificial
  CRISPR gRNA sequence
tggatggatggatggttgga

SEQ ID NO: 422814 - DNA, 20 bp, Artificial
  CRISPR gRNA sequence
tggatggatggttggatgga

SEQ ID NO: 422815 - DNA, 20 bp, Artificial
  CRISPR gRNA sequence
tggatggttggatggatgga

SEQ ID NO: 422816 - DNA, 20 bp, Artificial
  CRISPR gRNA sequence
ggatggttggatggatggat

SEQ ID NO: 422817 - DNA, 20 bp, Artificial
  CRISPR gRNA sequence
tggttggatggatggatggg

SEQ ID NO: 422818 - DNA, 20 bp, Artificial
  CRISPR gRNA sequence
ggttggatggatggatgggt

SEQ ID NO: 422819 - DNA, 20 bp, Artificial
  CRISPR gRNA sequence
tggatggatggatgggtggg

SEQ ID NO: 422820 - DNA, 20 bp, Artificial
  CRISPR gRNA sequence
tggatggatgggtgggtgga

SEQ ID NO: 422821 - DNA, 20 bp, Artificial
  CRISPR gRNA sequence
tggatgggtgggtggatgga

SEQ ID NO: 422822 - DNA, 20 bp, Artificial
  CRISPR gRNA sequence
tgggtgggtggatggatgga

SEQ ID NO: 422823 - DNA, 20 bp, Artificial
  CRISPR gRNA sequence
tgggtggatggatggatgga

SEQ ID NO: 422824 - DNA, 20 bp, Artificial
  CRISPR gRNA sequence
tggatggatggatggataga

SEQ ID NO: 422825 - DNA, 20 bp, Artificial
  CRISPR gRNA sequence
tggatggatggatagataga

SEQ ID NO: 422826 - DNA, 20 bp, Artificial
  CRISPR gRNA sequence
tggatggatagatagataga

SEQ ID NO: 422827 - DNA, 20 bp, Artificial
  CRISPR gRNA sequence
tggatagatagatagataga

SEQ ID NO: 422828 - DNA, 20 bp, Artificial
  CRISPR gRNA sequence
tagatagatagatagataga

SEQ ID NO: 422829 - DNA, 20 bp, Artificial
  CRISPR gRNA sequence
tagatagatagatagataga

SEQ ID NO: 422830 - DNA, 20 bp, Artificial
  CRISPR gRNA sequence
tagatagatagatagataga

SEQ ID NO: 422831 - DNA, 20 bp, Artificial
  CRISPR gRNA sequence
tagatagatagatagataga

SEQ ID NO: 422832 - DNA, 20 bp, Artificial
  CRISPR gRNA sequence
tagatagatagatagataga

SEQ ID NO: 422833 - DNA, 20 bp, Artificial
  CRISPR gRNA sequence
agatagatagatagatagat

SEQ ID NO: 422834 - DNA, 20 bp, Artificial
  CRISPR gRNA sequence
gatagatagatagatagatg

SEQ ID NO: 422835 - DNA, 20 bp, Artificial
  CRISPR gRNA sequence
tagatagatagatagatgag

SEQ ID NO: 422836 - DNA, 20 bp, Artificial
  CRISPR gRNA sequence
agatagatagatagatgagg

SEQ ID NO: 422837 - DNA, 20 bp, Artificial
  CRISPR gRNA sequence
gatagatagatagatgagga

SEQ ID NO: 422838 - DNA, 20 bp, Artificial
  CRISPR gRNA sequence
atagatgaggagggatttgt

SEQ ID NO: 422839 - DNA, 20 bp, Artificial
  CRISPR gRNA sequence
tagatgaggagggatttgtt

SEQ ID NO: 422840 - DNA, 20 bp, Artificial
  CRISPR gRNA sequence
agatgaggagggatttgtta

SEQ ID NO: 422841 - DNA, 20 bp, Artificial
  CRISPR gRNA sequence
gatgaggagggatttgttag

SEQ ID NO: 422842 - DNA, 20 bp, Artificial
  CRISPR gRNA sequence
atttgttaggggaatttgtt

SEQ ID NO: 422843 - DNA, 20 bp, Artificial
  CRISPR gRNA sequence
tttgttaggggaatttgttc

SEQ ID NO: 422844 - DNA, 20 bp, Artificial
  CRISPR gRNA sequence
aatttgttcaggtgattgta

SEQ ID NO: 422845 - DNA, 20 bp, Artificial
  CRISPR gRNA sequence
atttgttcaggtgattgtaa

SEQ ID NO: 422846 - DNA, 20 bp, Artificial
  CRISPR gRNA sequence
ttcaggtgattgtaaaggct

SEQ ID NO: 422847 - DNA, 20 bp, Artificial
  CRISPR gRNA sequence
aggtgattgtaaaggctgag

SEQ ID NO: 422848 - DNA, 20 bp, Artificial
  CRISPR gRNA sequence
aaggctgagaagtctcacca

SEQ ID NO: 422849 - DNA, 20 bp, Artificial
  CRISPR gRNA sequence
aggctgagaagtctcaccac

SEQ ID NO: 422850 - DNA, 20 bp, Artificial
  CRISPR gRNA sequence
tctcaccacaggctgtctgc

SEQ ID NO: 422851 - DNA, 20 bp, Artificial
  CRISPR gRNA sequence
accacaggctgtctgcaagc

SEQ ID NO: 422852 - DNA, 20 bp, Artificial
  CRISPR gRNA sequence
cacaggctgtctgcaagctg

SEQ ID NO: 422853 - DNA, 20 bp, Artificial
  CRISPR gRNA sequence
tgtctgcaagctggagacct

SEQ ID NO: 422854 - DNA, 20 bp, Artificial
  CRISPR gRNA sequence
gtctgcaagctggagacctt

SEQ ID NO: 422855 - DNA, 20 bp, Artificial
  CRISPR gRNA sequence
agctggagaccttgggatgc

SEQ ID NO: 422856 - DNA, 20 bp, Artificial
  CRISPR gRNA sequence
tggagaccttgggatgctgg

SEQ ID NO: 422857 - DNA, 20 bp, Artificial
  CRISPR gRNA sequence
accttgggatgctggtagca

SEQ ID NO: 422858 - DNA, 20 bp, Artificial
  CRISPR gRNA sequence
gggatgctggtagcatggct

SEQ ID NO: 422859 - DNA, 20 bp, Artificial
  CRISPR gRNA sequence
ctggtagcatggctcagttc

SEQ ID NO: 422860 - DNA, 20 bp, Artificial
  CRISPR gRNA sequence
atggctcagttcaagtccaa

SEQ ID NO: 422861 - DNA, 20 bp, Artificial
  CRISPR gRNA sequence
cagttcaagtccaacagcct

SEQ ID NO: 422862 - DNA, 20 bp, Artificial
  CRISPR gRNA sequence
ccaacagcctcagaaccact

SEQ ID NO: 422863 - DNA, 20 bp, Artificial
  CRISPR gRNA sequence
caacagcctcagaaccactg

SEQ ID NO: 422864 - DNA, 20 bp, Artificial
  CRISPR gRNA sequence
ctcagaaccactgaggctgt

SEQ ID NO: 422865 - DNA, 20 bp, Artificial
  CRISPR gRNA sequence
gaggctgttggtgtaattct

SEQ ID NO: 422866 - DNA, 20 bp, Artificial
  CRISPR gRNA sequence
gttggtgtaattctcagtcc

SEQ ID NO: 422867 - DNA, 20 bp, Artificial
  CRISPR gRNA sequence
ttggtgtaattctcagtcca

SEQ ID NO: 422868 - DNA, 20 bp, Artificial
  CRISPR gRNA sequence
gtaattctcagtccaaggct

SEQ ID NO: 422869 - DNA, 20 bp, Artificial
  CRISPR gRNA sequence
taattctcagtccaaggcta

SEQ ID NO: 422870 - DNA, 20 bp, Artificial
  CRISPR gRNA sequence
aattctcagtccaaggctaa

SEQ ID NO: 422871 - DNA, 20 bp, Artificial
  CRISPR gRNA sequence
aggctaagggcctgaaaacc

SEQ ID NO: 422872 - DNA, 20 bp, Artificial
  CRISPR gRNA sequence
ggctaagggcctgaaaaccc

SEQ ID NO: 422873 - DNA, 20 bp, Artificial
  CRISPR gRNA sequence
gctaagggcctgaaaaccca

SEQ ID NO: 422874 - DNA, 20 bp, Artificial
  CRISPR gRNA sequence
agggcctgaaaacccagggt

SEQ ID NO: 422875 - DNA, 20 bp, Artificial
  CRISPR gRNA sequence
gggcctgaaaacccagggtc

SEQ ID NO: 422876 - DNA, 20 bp, Artificial
  CRISPR gRNA sequence
gcctgaaaacccagggtcag

SEQ ID NO: 422877 - DNA, 20 bp, Artificial
  CRISPR gRNA sequence
aaacccagggtcaggagcac

SEQ ID NO: 422878 - DNA, 20 bp, Artificial
  CRISPR gRNA sequence
agggtcaggagcactggttt

SEQ ID NO: 422879 - DNA, 20 bp, Artificial
  CRISPR gRNA sequence
aggagcactggtttaagtcc

SEQ ID NO: 422880 - DNA, 20 bp, Artificial
  CRISPR gRNA sequence
gagcactggtttaagtcctg

SEQ ID NO: 422881 - DNA, 20 bp, Artificial
  CRISPR gRNA sequence
gtttaagtcctggagtccga

SEQ ID NO: 422882 - DNA, 20 bp, Artificial
  CRISPR gRNA sequence
aagtcctggagtccgaaagc

SEQ ID NO: 422883 - DNA, 20 bp, Artificial
  CRISPR gRNA sequence
agtcctggagtccgaaagcc

SEQ ID NO: 422884 - DNA, 20 bp, Artificial
  CRISPR gRNA sequence
gtcctggagtccgaaagcca

SEQ ID NO: 422885 - DNA, 20 bp, Artificial
  CRISPR gRNA sequence
cctggagtccgaaagccagg

SEQ ID NO: 422886 - DNA, 20 bp, Artificial
  CRISPR gRNA sequence
agtccgaaagccagggagcc

SEQ ID NO: 422887 - DNA, 20 bp, Artificial
  CRISPR gRNA sequence
agcctggtgtcctgatgtcc

SEQ ID NO: 422888 - DNA, 20 bp, Artificial
  CRISPR gRNA sequence
gcctggtgtcctgatgtcca

SEQ ID NO: 422889 - DNA, 20 bp, Artificial
  CRISPR gRNA sequence
ggtgtcctgatgtccaagga

SEQ ID NO: 422890 - DNA, 20 bp, Artificial
  CRISPR gRNA sequence
gtgtcctgatgtccaaggac

SEQ ID NO: 422891 - DNA, 20 bp, Artificial
  CRISPR gRNA sequence
ctgatgtccaaggacaggat

SEQ ID NO: 422892 - DNA, 20 bp, Artificial
  CRISPR gRNA sequence
atgtccaaggacaggatgag

SEQ ID NO: 422893 - DNA, 20 bp, Artificial
  CRISPR gRNA sequence
gtccaaggacaggatgagaa

SEQ ID NO: 422894 - DNA, 20 bp, Artificial
  CRISPR gRNA sequence
aagagtgtgtcccaactcca

SEQ ID NO: 422895 - DNA, 20 bp, Artificial
  CRISPR gRNA sequence
gagtgtgtcccaactccaaa

SEQ ID NO: 422896 - DNA, 20 bp, Artificial
  CRISPR gRNA sequence
gtgtgtcccaactccaaaga

SEQ ID NO: 422897 - DNA, 20 bp, Artificial
  CRISPR gRNA sequence
gtcccaactccaaagagaga

SEQ ID NO: 422898 - DNA, 20 bp, Artificial
  CRISPR gRNA sequence
attttgcctctcttctgttt

SEQ ID NO: 422899 - DNA, 20 bp, Artificial
  CRISPR gRNA sequence
ttttgcctctcttctgtttt

SEQ ID NO: 422900 - DNA, 20 bp, Artificial
  CRISPR gRNA sequence
gcctctcttctgttttggga

SEQ ID NO: 422901 - DNA, 20 bp, Artificial
  CRISPR gRNA sequence
cctctcttctgttttgggaa

SEQ ID NO: 422902 - DNA, 20 bp, Artificial
  CRISPR gRNA sequence
ctcttctgttttgggaaagg

SEQ ID NO: 422903 - DNA, 20 bp, Artificial
  CRISPR gRNA sequence
tcttctgttttgggaaaggc

SEQ ID NO: 422904 - DNA, 20 bp, Artificial
  CRISPR gRNA sequence
ttttgggaaaggcaggcctc

SEQ ID NO: 422905 - DNA, 20 bp, Artificial
  CRISPR gRNA sequence
tttgggaaaggcaggcctcc

SEQ ID NO: 422906 - DNA, 20 bp, Artificial
  CRISPR gRNA sequence
ggaaaggcaggcctccaggt

SEQ ID NO: 422907 - DNA, 20 bp, Artificial
  CRISPR gRNA sequence
aaggcaggcctccaggtgag

SEQ ID NO: 422908 - DNA, 20 bp, Artificial
  CRISPR gRNA sequence
caggcctccaggtgagtgga

SEQ ID NO: 422909 - DNA, 20 bp, Artificial
  CRISPR gRNA sequence
ccaggtgagtggatggtgct

SEQ ID NO: 422910 - DNA, 20 bp, Artificial
  CRISPR gRNA sequence
ggatggtgcttggctacatt

SEQ ID NO: 422911 - DNA, 20 bp, Artificial
  CRISPR gRNA sequence
atggtgcttggctacattta

SEQ ID NO: 422912 - DNA, 20 bp, Artificial
  CRISPR gRNA sequence
tcttacctactcacttcact

SEQ ID NO: 422913 - DNA, 20 bp, Artificial
  CRISPR gRNA sequence
actgacatgccaatctcctt

SEQ ID NO: 422914 - DNA, 20 bp, Artificial
  CRISPR gRNA sequence
ctcctttggaaacaccctca

SEQ ID NO: 422915 - DNA, 20 bp, Artificial
  CRISPR gRNA sequence
cctcacagacacacccaaaa

SEQ ID NO: 422916 - DNA, 20 bp, Artificial
  CRISPR gRNA sequence
ctcacagacacacccaaaat

SEQ ID NO: 422917 - DNA, 20 bp, Artificial
  CRISPR gRNA sequence
acacccaaaatgggctttac

SEQ ID NO: 422918 - DNA, 20 bp, Artificial
  CRISPR gRNA sequence
atgggctttactagctctct

SEQ ID NO: 422919 - DNA, 20 bp, Artificial
  CRISPR gRNA sequence
ctctctcagctcccttaatc

SEQ ID NO: 422920 - DNA, 20 bp, Artificial
  CRISPR gRNA sequence
tcagctcccttaatccagtt

SEQ ID NO: 422921 - DNA, 20 bp, Artificial
  CRISPR gRNA sequence
gttaagatgatacctaaaat

SEQ ID NO: 422922 - DNA, 20 bp, Artificial
  CRISPR gRNA sequence
atacctaaaattagctatga

SEQ ID NO: 422923 - DNA, 20 bp, Artificial
  CRISPR gRNA sequence
tacctaaaattagctatgac

SEQ ID NO: 422924 - DNA, 20 bp, Artificial
  CRISPR gRNA sequence
attagctatgacaggcacaa

SEQ ID NO: 422925 - DNA, 20 bp, Artificial
  CRISPR gRNA sequence
aggcacaacagcattcacta

SEQ ID NO: 422926 - DNA, 20 bp, Artificial
  CRISPR gRNA sequence
cagcattcactacagacctt

SEQ ID NO: 422927 - DNA, 20 bp, Artificial
  CRISPR gRNA sequence
gcattcactacagaccttga

SEQ ID NO: 422928 - DNA, 20 bp, Artificial
  CRISPR gRNA sequence
ctacagaccttgagagccca

SEQ ID NO: 422929 - DNA, 20 bp, Artificial
  CRISPR gRNA sequence
agcccatagactgtgttatt

SEQ ID NO: 422930 - DNA, 20 bp, Artificial
  CRISPR gRNA sequence
gcccatagactgtgttattt

SEQ ID NO: 422931 - DNA, 20 bp, Artificial
  CRISPR gRNA sequence
ccatagactgtgttatttag

SEQ ID NO: 422932 - DNA, 20 bp, Artificial
  CRISPR gRNA sequence
ttatttaggagcatgttctt

SEQ ID NO: 422933 - DNA, 20 bp, Artificial
  CRISPR gRNA sequence
aggagcatgttctttggaat

SEQ ID NO: 422934 - DNA, 20 bp, Artificial
  CRISPR gRNA sequence
gcatgttctttggaatcaga

SEQ ID NO: 422935 - DNA, 20 bp, Artificial
  CRISPR gRNA sequence
tctttggaatcagacagtcc

SEQ ID NO: 422936 - DNA, 20 bp, Artificial
  CRISPR gRNA sequence
ctttggaatcagacagtcct

SEQ ID NO: 422937 - DNA, 20 bp, Artificial
  CRISPR gRNA sequence
gaatcagacagtcctaggtt

SEQ ID NO: 422938 - DNA, 20 bp, Artificial
  CRISPR gRNA sequence
aatcagacagtcctaggttt

SEQ ID NO: 422939 - DNA, 20 bp, Artificial
  CRISPR gRNA sequence
gggtcccaactcaaccactt

SEQ ID NO: 422940 - DNA, 20 bp, Artificial
  CRISPR gRNA sequence
tcccaactcaaccacttgag

SEQ ID NO: 422941 - DNA, 20 bp, Artificial
  CRISPR gRNA sequence
cacctaactttgatgaacct

SEQ ID NO: 422942 - DNA, 20 bp, Artificial
  CRISPR gRNA sequence
ctgtaaaatgccgataatta

SEQ ID NO: 422943 - DNA, 20 bp, Artificial
  CRISPR gRNA sequence
aattatggcattgccttcat

SEQ ID NO: 422944 - DNA, 20 bp, Artificial
  CRISPR gRNA sequence
attatggcattgccttcata

SEQ ID NO: 422945 - DNA, 20 bp, Artificial
  CRISPR gRNA sequence
cattgccttcataaggtcat

SEQ ID NO: 422946 - DNA, 20 bp, Artificial
  CRISPR gRNA sequence
ataaggtcatgagaaaactt

SEQ ID NO: 422947 - DNA, 20 bp, Artificial
  CRISPR gRNA sequence
agtcaaataataattaatgt

SEQ ID NO: 422948 - DNA, 20 bp, Artificial
  CRISPR gRNA sequence
gtcaaataataattaatgta

SEQ ID NO: 422949 - DNA, 20 bp, Artificial
  CRISPR gRNA sequence
aataattaatgtaaggcact

SEQ ID NO: 422950 - DNA, 20 bp, Artificial
  CRISPR gRNA sequence
aaggcacttagcatttttcc

SEQ ID NO: 422951 - DNA, 20 bp, Artificial
  CRISPR gRNA sequence
tagcatttttcctagcatgt

SEQ ID NO: 422952 - DNA, 20 bp, Artificial
  CRISPR gRNA sequence
atttttcctagcatgtaagc

SEQ ID NO: 422953 - DNA, 20 bp, Artificial
  CRISPR gRNA sequence
ttcctagcatgtaagctgga

SEQ ID NO: 422954 - DNA, 20 bp, Artificial
  CRISPR gRNA sequence
tcctagcatgtaagctggaa

SEQ ID NO: 422955 - DNA, 20 bp, Artificial
  CRISPR gRNA sequence
agcatgtaagctggaaaggt

SEQ ID NO: 422956 - DNA, 20 bp, Artificial
  CRISPR gRNA sequence
atgtaagctggaaaggtgag

SEQ ID NO: 422957 - DNA, 20 bp, Artificial
  CRISPR gRNA sequence
tgtaagctggaaaggtgagt

SEQ ID NO: 422958 - DNA, 20 bp, Artificial
  CRISPR gRNA sequence
aaggtgagtgggaccatcac

SEQ ID NO: 422959 - DNA, 20 bp, Artificial
  CRISPR gRNA sequence
aggtgagtgggaccatcaca

SEQ ID NO: 422960 - DNA, 20 bp, Artificial
  CRISPR gRNA sequence
ggtgagtgggaccatcacaa

SEQ ID NO: 422961 - DNA, 20 bp, Artificial
  CRISPR gRNA sequence
accatcacaagggatgtttt

SEQ ID NO: 422962 - DNA, 20 bp, Artificial
  CRISPR gRNA sequence
ccatcacaagggatgttttt

SEQ ID NO: 422963 - DNA, 20 bp, Artificial
  CRISPR gRNA sequence
gatgtttttgggatcatcac

SEQ ID NO: 422964 - DNA, 20 bp, Artificial
  CRISPR gRNA sequence
atgtttttgggatcatcaca

SEQ ID NO: 422965 - DNA, 20 bp, Artificial
  CRISPR gRNA sequence
tgtttttgggatcatcacaa

SEQ ID NO: 422966 - DNA, 20 bp, Artificial
  CRISPR gRNA sequence
gatcatcacaagggatgttt

SEQ ID NO: 422967 - DNA, 20 bp, Artificial
  CRISPR gRNA sequence
atcatcacaagggatgtttt

SEQ ID NO: 422968 - DNA, 20 bp, Artificial
  CRISPR gRNA sequence
tcatcacaagggatgttttg

SEQ ID NO: 422969 - DNA, 20 bp, Artificial
  CRISPR gRNA sequence
ggatgttttggggatcatca

SEQ ID NO: 422970 - DNA, 20 bp, Artificial
  CRISPR gRNA sequence
ggatcatcacagtttcttat

SEQ ID NO: 422971 - DNA, 20 bp, Artificial
  CRISPR gRNA sequence
gatcatcacagtttcttatg

SEQ ID NO: 422972 - DNA, 20 bp, Artificial
  CRISPR gRNA sequence
acagtttcttatgaggaatg

SEQ ID NO: 422973 - DNA, 20 bp, Artificial
  CRISPR gRNA sequence
tgaggaatgtagtgaaatta

SEQ ID NO: 422974 - DNA, 20 bp, Artificial
  CRISPR gRNA sequence
gaaattatggattttcttct

SEQ ID NO: 422975 - DNA, 20 bp, Artificial
  CRISPR gRNA sequence
aaattatggattttcttctt

SEQ ID NO: 422976 - DNA, 20 bp, Artificial
  CRISPR gRNA sequence
tttacaaatcccctgaaatc

SEQ ID NO: 422977 - DNA, 20 bp, Artificial
  CRISPR gRNA sequence
tgaaatccagctgtgcatct

SEQ ID NO: 422978 - DNA, 20 bp, Artificial
  CRISPR gRNA sequence
gaaatccagctgtgcatctc

SEQ ID NO: 422979 - DNA, 20 bp, Artificial
  CRISPR gRNA sequence
ccagctgtgcatctcaggtt

SEQ ID NO: 422980 - DNA, 20 bp, Artificial
  CRISPR gRNA sequence
gttaagcaccctcctatata

SEQ ID NO: 422981 - DNA, 20 bp, Artificial
  CRISPR gRNA sequence
aagcaccctcctatatacag

SEQ ID NO: 422982 - DNA, 20 bp, Artificial
  CRISPR gRNA sequence
gcaccctcctatatacagtg

SEQ ID NO: 422983 - DNA, 20 bp, Artificial
  CRISPR gRNA sequence
tatatacagtggagccattg

SEQ ID NO: 422984 - DNA, 20 bp, Artificial
  CRISPR gRNA sequence
tatacagtggagccattgaa

SEQ ID NO: 422985 - DNA, 20 bp, Artificial
  CRISPR gRNA sequence
gtggagccattgaagagttt

SEQ ID NO: 422986 - DNA, 20 bp, Artificial
  CRISPR gRNA sequence
tggagccattgaagagtttt

SEQ ID NO: 422987 - DNA, 20 bp, Artificial
  CRISPR gRNA sequence
agccattgaagagttttagg

SEQ ID NO: 422988 - DNA, 20 bp, Artificial
  CRISPR gRNA sequence
aagagttttaggcagaaata

SEQ ID NO: 422989 - DNA, 20 bp, Artificial
  CRISPR gRNA sequence
gtttttgaaaatcactctgc

SEQ ID NO: 422990 - DNA, 20 bp, Artificial
  CRISPR gRNA sequence
tcactctgctggcgaccatg

SEQ ID NO: 422991 - DNA, 20 bp, Artificial
  CRISPR gRNA sequence
actctgctggcgaccatgtg

SEQ ID NO: 422992 - DNA, 20 bp, Artificial
  CRISPR gRNA sequence
tgctggcgaccatgtggagt

SEQ ID NO: 422993 - DNA, 20 bp, Artificial
  CRISPR gRNA sequence
gcgaccatgtggagttggac

SEQ ID NO: 422994 - DNA, 20 bp, Artificial
  CRISPR gRNA sequence
accatgtggagttggactag

SEQ ID NO: 422995 - DNA, 20 bp, Artificial
  CRISPR gRNA sequence
tgtggagttggactagaagt

SEQ ID NO: 422996 - DNA, 20 bp, Artificial
  CRISPR gRNA sequence
tggagttggactagaagtaa

SEQ ID NO: 422997 - DNA, 20 bp, Artificial
  CRISPR gRNA sequence
ggagttggactagaagtaag

SEQ ID NO: 422998 - DNA, 20 bp, Artificial
  CRISPR gRNA sequence
gagttggactagaagtaaga

SEQ ID NO: 422999 - DNA, 20 bp, Artificial
  CRISPR gRNA sequence
gttggactagaagtaagagg

SEQ ID NO: 423000 - DNA, 20 bp, Artificial
  CRISPR gRNA sequence
actagaagtaagagggagtc

SEQ ID NO: 423001 - DNA, 20 bp, Artificial
  CRISPR gRNA sequence
tagaagtaagagggagtcca

SEQ ID NO: 423002 - DNA, 20 bp, Artificial
  CRISPR gRNA sequence
agtaagagggagtccagaga

SEQ ID NO: 423003 - DNA, 20 bp, Artificial
  CRISPR gRNA sequence
agagggagtccagagacagt

SEQ ID NO: 423004 - DNA, 20 bp, Artificial
  CRISPR gRNA sequence
gagggagtccagagacagtg

SEQ ID NO: 423005 - DNA, 20 bp, Artificial
  CRISPR gRNA sequence
gtccagagacagtgaggatg

SEQ ID NO: 423006 - DNA, 20 bp, Artificial
  CRISPR gRNA sequence
gagacagtgaggatgaagcc

SEQ ID NO: 423007 - DNA, 20 bp, Artificial
  CRISPR gRNA sequence
agacagtgaggatgaagccc

SEQ ID NO: 423008 - DNA, 20 bp, Artificial
  CRISPR gRNA sequence
tgaggatgaagcccaggtgt

SEQ ID NO: 423009 - DNA, 20 bp, Artificial
  CRISPR gRNA sequence
aggatgaagcccaggtgtga

SEQ ID NO: 423010 - DNA, 20 bp, Artificial
  CRISPR gRNA sequence
atgaagcccaggtgtgagag

SEQ ID NO: 423011 - DNA, 20 bp, Artificial
  CRISPR gRNA sequence
cccaggtgtgagagaagaca

SEQ ID NO: 423012 - DNA, 20 bp, Artificial
  CRISPR gRNA sequence
tgtgagagaagacatggata

SEQ ID NO: 423013 - DNA, 20 bp, Artificial
  CRISPR gRNA sequence
tgagagaagacatggatata

SEQ ID NO: 423014 - DNA, 20 bp, Artificial
  CRISPR gRNA sequence
agaagacatggatatagaga

SEQ ID NO: 423015 - DNA, 20 bp, Artificial
  CRISPR gRNA sequence
acatggatatagagatggaa

SEQ ID NO: 423016 - DNA, 20 bp, Artificial
  CRISPR gRNA sequence
atggatatagagatggaaaa

SEQ ID NO: 423017 - DNA, 20 bp, Artificial
  CRISPR gRNA sequence
tggatatagagatggaaaag

SEQ ID NO: 423018 - DNA, 20 bp, Artificial
  CRISPR gRNA sequence
ggatatagagatggaaaaga

SEQ ID NO: 423019 - DNA, 20 bp, Artificial
  CRISPR gRNA sequence
atatagagatggaaaagagg

SEQ ID NO: 423020 - DNA, 20 bp, Artificial
  CRISPR gRNA sequence
tagagatggaaaagagggag

SEQ ID NO: 423021 - DNA, 20 bp, Artificial
  CRISPR gRNA sequence
ggaaaagagggagtagattt

SEQ ID NO: 423022 - DNA, 20 bp, Artificial
  CRISPR gRNA sequence
gagtagatttcagaactgcc

SEQ ID NO: 423023 - DNA, 20 bp, Artificial
  CRISPR gRNA sequence
agtagatttcagaactgcct

SEQ ID NO: 423024 - DNA, 20 bp, Artificial
  CRISPR gRNA sequence
gaactgcctaggattaaaat

SEQ ID NO: 423025 - DNA, 20 bp, Artificial
  CRISPR gRNA sequence
cctaggattaaaattggatg

SEQ ID NO: 423026 - DNA, 20 bp, Artificial
  CRISPR gRNA sequence
taaaattggatgaagtttta

SEQ ID NO: 423027 - DNA, 20 bp, Artificial
  CRISPR gRNA sequence
tgaagttttacagataaatt

SEQ ID NO: 423028 - DNA, 20 bp, Artificial
  CRISPR gRNA sequence
agataaattgagttgaacat

SEQ ID NO: 423029 - DNA, 20 bp, Artificial
  CRISPR gRNA sequence
ttgagttgaacattagcctc

SEQ ID NO: 423030 - DNA, 20 bp, Artificial
  CRISPR gRNA sequence
ttagcctccagatttctgct

SEQ ID NO: 423031 - DNA, 20 bp, Artificial
  CRISPR gRNA sequence
cctccagatttctgctcagc

SEQ ID NO: 423032 - DNA, 20 bp, Artificial
  CRISPR gRNA sequence
gctcagctggtgccataaac

SEQ ID NO: 423033 - DNA, 20 bp, Artificial
  CRISPR gRNA sequence
ctcagctggtgccataaacc

SEQ ID NO: 423034 - DNA, 20 bp, Artificial
  CRISPR gRNA sequence
tcagctggtgccataaacca

SEQ ID NO: 423035 - DNA, 20 bp, Artificial
  CRISPR gRNA sequence
gctggtgccataaaccaggg

SEQ ID NO: 423036 - DNA, 20 bp, Artificial
  CRISPR gRNA sequence
ataaaccagggcagtgaata

SEQ ID NO: 423037 - DNA, 20 bp, Artificial
  CRISPR gRNA sequence
taaaccagggcagtgaatat

SEQ ID NO: 423038 - DNA, 20 bp, Artificial
  CRISPR gRNA sequence
aaaccagggcagtgaatata

SEQ ID NO: 423039 - DNA, 20 bp, Artificial
  CRISPR gRNA sequence
aaccagggcagtgaatatag

SEQ ID NO: 423040 - DNA, 20 bp, Artificial
  CRISPR gRNA sequence
cagggcagtgaatatagggg

SEQ ID NO: 423041 - DNA, 20 bp, Artificial
  CRISPR gRNA sequence
agggcagtgaatataggggc

SEQ ID NO: 423042 - DNA, 20 bp, Artificial
  CRISPR gRNA sequence
ggcagtgaatataggggcag

SEQ ID NO: 423043 - DNA, 20 bp, Artificial
  CRISPR gRNA sequence
agtgaatataggggcaggag

SEQ ID NO: 423044 - DNA, 20 bp, Artificial
  CRISPR gRNA sequence
taggggcaggagtggtttgt

SEQ ID NO: 423045 - DNA, 20 bp, Artificial
  CRISPR gRNA sequence
aggggcaggagtggtttgtt

SEQ ID NO: 423046 - DNA, 20 bp, Artificial
  CRISPR gRNA sequence
ggggcaggagtggtttgttg

SEQ ID NO: 423047 - DNA, 20 bp, Artificial
  CRISPR gRNA sequence
gcaggagtggtttgttgggg

SEQ ID NO: 423048 - DNA, 20 bp, Artificial
  CRISPR gRNA sequence
caggagtggtttgttggggc

SEQ ID NO: 423049 - DNA, 20 bp, Artificial
  CRISPR gRNA sequence
ttgttggggcaggaatgtga

SEQ ID NO: 423050 - DNA, 20 bp, Artificial
  CRISPR gRNA sequence
ggaatgtgatggtgtcgttt

SEQ ID NO: 423051 - DNA, 20 bp, Artificial
  CRISPR gRNA sequence
ggtgtcgtttgagacaattt

SEQ ID NO: 423052 - DNA, 20 bp, Artificial
  CRISPR gRNA sequence
gtttgagacaatttgagtct

SEQ ID NO: 423053 - DNA, 20 bp, Artificial
  CRISPR gRNA sequence
atttgagtctgagcttgccg

SEQ ID NO: 423054 - DNA, 20 bp, Artificial
  CRISPR gRNA sequence
tttgagtctgagcttgccgt

SEQ ID NO: 423055 - DNA, 20 bp, Artificial
  CRISPR gRNA sequence
ctgagcttgccgtgggtcat

SEQ ID NO: 423056 - DNA, 20 bp, Artificial
  CRISPR gRNA sequence
tgagcttgccgtgggtcatc

SEQ ID NO: 423057 - DNA, 20 bp, Artificial
  CRISPR gRNA sequence
ggtcatcaggtgatgatgcc

SEQ ID NO: 423058 - DNA, 20 bp, Artificial
  CRISPR gRNA sequence
catcaggtgatgatgcccag

SEQ ID NO: 423059 - DNA, 20 bp, Artificial
  CRISPR gRNA sequence
aggtgatgatgcccagtgga

SEQ ID NO: 423060 - DNA, 20 bp, Artificial
  CRISPR gRNA sequence
ggtgatgatgcccagtggac

SEQ ID NO: 423061 - DNA, 20 bp, Artificial
  CRISPR gRNA sequence
gatgatgcccagtggacagg

SEQ ID NO: 423062 - DNA, 20 bp, Artificial
  CRISPR gRNA sequence
gacaggtggacacctgcatc

SEQ ID NO: 423063 - DNA, 20 bp, Artificial
  CRISPR gRNA sequence
caggtggacacctgcatctg

SEQ ID NO: 423064 - DNA, 20 bp, Artificial
  CRISPR gRNA sequence
ggacacctgcatctggagct

SEQ ID NO: 423065 - DNA, 20 bp, Artificial
  CRISPR gRNA sequence
gacacctgcatctggagctc

SEQ ID NO: 423066 - DNA, 20 bp, Artificial
  CRISPR gRNA sequence
acacctgcatctggagctca

SEQ ID NO: 423067 - DNA, 20 bp, Artificial
  CRISPR gRNA sequence
cctgcatctggagctcaggg

SEQ ID NO: 423068 - DNA, 20 bp, Artificial
  CRISPR gRNA sequence
gcatctggagctcagggcag

SEQ ID NO: 423069 - DNA, 20 bp, Artificial
  CRISPR gRNA sequence
tggagctcagggcagaagcc

SEQ ID NO: 423070 - DNA, 20 bp, Artificial
  CRISPR gRNA sequence
ggagctcagggcagaagcct

SEQ ID NO: 423071 - DNA, 20 bp, Artificial
  CRISPR gRNA sequence
ctcagggcagaagcctgggc

SEQ ID NO: 423072 - DNA, 20 bp, Artificial
  CRISPR gRNA sequence
ggcagaagcctgggctagtt

SEQ ID NO: 423073 - DNA, 20 bp, Artificial
  CRISPR gRNA sequence
gaagcctgggctagtttaga

SEQ ID NO: 423074 - DNA, 20 bp, Artificial
  CRISPR gRNA sequence
agcctgggctagtttagata

SEQ ID NO: 423075 - DNA, 20 bp, Artificial
  CRISPR gRNA sequence
ggctagtttagatagagatt

SEQ ID NO: 423076 - DNA, 20 bp, Artificial
  CRISPR gRNA sequence
gctagtttagatagagattt

SEQ ID NO: 423077 - DNA, 20 bp, Artificial
  CRISPR gRNA sequence
gatagagatttgggcatctt

SEQ ID NO: 423078 - DNA, 20 bp, Artificial
  CRISPR gRNA sequence
tagagatttgggcatcttca

SEQ ID NO: 423079 - DNA, 20 bp, Artificial
  CRISPR gRNA sequence
agagatttgggcatcttcag

SEQ ID NO: 423080 - DNA, 20 bp, Artificial
  CRISPR gRNA sequence
atttgggcatcttcagagga

SEQ ID NO: 423081 - DNA, 20 bp, Artificial
  CRISPR gRNA sequence
gggcatcttcagaggacaga

SEQ ID NO: 423082 - DNA, 20 bp, Artificial
  CRISPR gRNA sequence
catcttcagaggacagatgg

SEQ ID NO: 423083 - DNA, 20 bp, Artificial
  CRISPR gRNA sequence
cagaggacagatggtggttg

SEQ ID NO: 423084 - DNA, 20 bp, Artificial
  CRISPR gRNA sequence
cagatggtggttgtagatgt

SEQ ID NO: 423085 - DNA, 20 bp, Artificial
  CRISPR gRNA sequence
tggtggttgtagatgtaaga

SEQ ID NO: 423086 - DNA, 20 bp, Artificial
  CRISPR gRNA sequence
tggttgtagatgtaagaaag

SEQ ID NO: 423087 - DNA, 20 bp, Artificial
  CRISPR gRNA sequence
tagatgctcatgaaatcact

SEQ ID NO: 423088 - DNA, 20 bp, Artificial
  CRISPR gRNA sequence
gatgctcatgaaatcactca

SEQ ID NO: 423089 - DNA, 20 bp, Artificial
  CRISPR gRNA sequence
tgctcatgaaatcactcaga

SEQ ID NO: 423090 - DNA, 20 bp, Artificial
  CRISPR gRNA sequence
aatcactcagagagcatgtt

SEQ ID NO: 423091 - DNA, 20 bp, Artificial
  CRISPR gRNA sequence
tcagagagcatgtttagcgt

SEQ ID NO: 423092 - DNA, 20 bp, Artificial
  CRISPR gRNA sequence
agagagcatgtttagcgtga

SEQ ID NO: 423093 - DNA, 20 bp, Artificial
  CRISPR gRNA sequence
agcatgtttagcgtgagaga

SEQ ID NO: 423094 - DNA, 20 bp, Artificial
  CRISPR gRNA sequence
atgtttagcgtgagagaaag

SEQ ID NO: 423095 - DNA, 20 bp, Artificial
  CRISPR gRNA sequence
gtttagcgtgagagaaagca

SEQ ID NO: 423096 - DNA, 20 bp, Artificial
  CRISPR gRNA sequence
ttagcgtgagagaaagcaga

SEQ ID NO: 423097 - DNA, 20 bp, Artificial
  CRISPR gRNA sequence
gcgtgagagaaagcagagag

SEQ ID NO: 423098 - DNA, 20 bp, Artificial
  CRISPR gRNA sequence
gaaagcagagagcagaaccc

SEQ ID NO: 423099 - DNA, 20 bp, Artificial
  CRISPR gRNA sequence
aaagcagagagcagaaccct

SEQ ID NO: 423100 - DNA, 20 bp, Artificial
  CRISPR gRNA sequence
aagcagagagcagaaccctg

SEQ ID NO: 423101 - DNA, 20 bp, Artificial
  CRISPR gRNA sequence
cagaaccctggggaacccca

SEQ ID NO: 423102 - DNA, 20 bp, Artificial
  CRISPR gRNA sequence
ccctggggaaccccacggtt

SEQ ID NO: 423103 - DNA, 20 bp, Artificial
  CRISPR gRNA sequence
cctggggaaccccacggttt

SEQ ID NO: 423104 - DNA, 20 bp, Artificial
  CRISPR gRNA sequence
ctggggaaccccacggtttg

SEQ ID NO: 423105 - DNA, 20 bp, Artificial
  CRISPR gRNA sequence
ggggaaccccacggtttggg

SEQ ID NO: 423106 - DNA, 20 bp, Artificial
  CRISPR gRNA sequence
gtttggggagctgatgtgca

SEQ ID NO: 423107 - DNA, 20 bp, Artificial
  CRISPR gRNA sequence
ttggggagctgatgtgcaaa

SEQ ID NO: 423108 - DNA, 20 bp, Artificial
  CRISPR gRNA sequence
gagctgatgtgcaaagagaa

SEQ ID NO: 423109 - DNA, 20 bp, Artificial
  CRISPR gRNA sequence
agctgatgtgcaaagagaaa

SEQ ID NO: 423110 - DNA, 20 bp, Artificial
  CRISPR gRNA sequence
gctgatgtgcaaagagaaaa

SEQ ID NO: 423111 - DNA, 20 bp, Artificial
  CRISPR gRNA sequence
ctgatgtgcaaagagaaaag

SEQ ID NO: 423112 - DNA, 20 bp, Artificial
  CRISPR gRNA sequence
atgtgcaaagagaaaagggg

SEQ ID NO: 423113 - DNA, 20 bp, Artificial
  CRISPR gRNA sequence
tgtgcaaagagaaaaggggc

SEQ ID NO: 423114 - DNA, 20 bp, Artificial
  CRISPR gRNA sequence
aaagagaaaaggggcaggcc

SEQ ID NO: 423115 - DNA, 20 bp, Artificial
  CRISPR gRNA sequence
aaaaggggcaggcctggctg

SEQ ID NO: 423116 - DNA, 20 bp, Artificial
  CRISPR gRNA sequence
ggcaggcctggctgaagacg

SEQ ID NO: 423117 - DNA, 20 bp, Artificial
  CRISPR gRNA sequence
gcaggcctggctgaagacga

SEQ ID NO: 423118 - DNA, 20 bp, Artificial
  CRISPR gRNA sequence
ggcctggctgaagacgaagg

SEQ ID NO: 423119 - DNA, 20 bp, Artificial
  CRISPR gRNA sequence
gcctggctgaagacgaaggt

SEQ ID NO: 423120 - DNA, 20 bp, Artificial
  CRISPR gRNA sequence
cctggctgaagacgaaggtg

SEQ ID NO: 423121 - DNA, 20 bp, Artificial
  CRISPR gRNA sequence
ctggctgaagacgaaggtgg

SEQ ID NO: 423122 - DNA, 20 bp, Artificial
  CRISPR gRNA sequence
aagacgaaggtgggggttca

SEQ ID NO: 423123 - DNA, 20 bp, Artificial
  CRISPR gRNA sequence
agacgaaggtgggggttcaa

SEQ ID NO: 423124 - DNA, 20 bp, Artificial
  CRISPR gRNA sequence
acgaaggtgggggttcaaag

SEQ ID NO: 423125 - DNA, 20 bp, Artificial
  CRISPR gRNA sequence
cgaaggtgggggttcaaagg

SEQ ID NO: 423126 - DNA, 20 bp, Artificial
  CRISPR gRNA sequence
aaggtgggggttcaaaggag

SEQ ID NO: 423127 - DNA, 20 bp, Artificial
  CRISPR gRNA sequence
gtgggggttcaaaggaggag

SEQ ID NO: 423128 - DNA, 20 bp, Artificial
  CRISPR gRNA sequence
tcaaaggaggagaagaaaat

SEQ ID NO: 423129 - DNA, 20 bp, Artificial
  CRISPR gRNA sequence
caaaggaggagaagaaaatc

SEQ ID NO: 423130 - DNA, 20 bp, Artificial
  CRISPR gRNA sequence
aaggaggagaagaaaatcag

SEQ ID NO: 423131 - DNA, 20 bp, Artificial
  CRISPR gRNA sequence
ggaggagaagaaaatcagga

SEQ ID NO: 423132 - DNA, 20 bp, Artificial
  CRISPR gRNA sequence
aggagaagaaaatcaggaga

SEQ ID NO: 423133 - DNA, 20 bp, Artificial
  CRISPR gRNA sequence
atcaggagagagtgatgcca

SEQ ID NO: 423134 - DNA, 20 bp, Artificial
  CRISPR gRNA sequence
tcaggagagagtgatgccaa

SEQ ID NO: 423135 - DNA, 20 bp, Artificial
  CRISPR gRNA sequence
gagagtgatgccaaaggatc

SEQ ID NO: 423136 - DNA, 20 bp, Artificial
  CRISPR gRNA sequence
gagtgatgccaaaggatcca

SEQ ID NO: 423137 - DNA, 20 bp, Artificial
  CRISPR gRNA sequence
gatgccaaaggatccagaga

SEQ ID NO: 423138 - DNA, 20 bp, Artificial
  CRISPR gRNA sequence
tgccaaaggatccagagaaa

SEQ ID NO: 423139 - DNA, 20 bp, Artificial
  CRISPR gRNA sequence
tccagagaaagagaacattt

SEQ ID NO: 423140 - DNA, 20 bp, Artificial
  CRISPR gRNA sequence
gagaaagagaacatttcaga

SEQ ID NO: 423141 - DNA, 20 bp, Artificial
  CRISPR gRNA sequence
aagagaacatttcagaaagt

SEQ ID NO: 423142 - DNA, 20 bp, Artificial
  CRISPR gRNA sequence
gagaacatttcagaaagtaa

SEQ ID NO: 423143 - DNA, 20 bp, Artificial
  CRISPR gRNA sequence
agaacatttcagaaagtaag

SEQ ID NO: 423144 - DNA, 20 bp, Artificial
  CRISPR gRNA sequence
ttcagaaagtaagaggtcga

SEQ ID NO: 423145 - DNA, 20 bp, Artificial
  CRISPR gRNA sequence
cagaaagtaagaggtcgaca

SEQ ID NO: 423146 - DNA, 20 bp, Artificial
  CRISPR gRNA sequence
agtaagaggtcgacagagtc

SEQ ID NO: 423147 - DNA, 20 bp, Artificial
  CRISPR gRNA sequence
gaggtcgacagagtcaagtg

SEQ ID NO: 423148 - DNA, 20 bp, Artificial
  CRISPR gRNA sequence
acagagtcaagtgcagtaaa

SEQ ID NO: 423149 - DNA, 20 bp, Artificial
  CRISPR gRNA sequence
tcaagtgcagtaaacagtac

SEQ ID NO: 423150 - DNA, 20 bp, Artificial
  CRISPR gRNA sequence
cagtaaacagtacaagaaaa

SEQ ID NO: 423151 - DNA, 20 bp, Artificial
  CRISPR gRNA sequence
gtaaacagtacaagaaaata

SEQ ID NO: 423152 - DNA, 20 bp, Artificial
  CRISPR gRNA sequence
cagtacaagaaaatagagaa

SEQ ID NO: 423153 - DNA, 20 bp, Artificial
  CRISPR gRNA sequence
acaagaaaatagagaatgga

SEQ ID NO: 423154 - DNA, 20 bp, Artificial
  CRISPR gRNA sequence
gaatggaaagctgcctcact

SEQ ID NO: 423155 - DNA, 20 bp, Artificial
  CRISPR gRNA sequence
gaaagctgcctcactaagct

SEQ ID NO: 423156 - DNA, 20 bp, Artificial
  CRISPR gRNA sequence
gcctcactaagcttagtgaa

SEQ ID NO: 423157 - DNA, 20 bp, Artificial
  CRISPR gRNA sequence
cctcactaagcttagtgaac

SEQ ID NO: 423158 - DNA, 20 bp, Artificial
  CRISPR gRNA sequence
cactaagcttagtgaacagg

SEQ ID NO: 423159 - DNA, 20 bp, Artificial
  CRISPR gRNA sequence
cttagtgaacaggaagtaac

SEQ ID NO: 423160 - DNA, 20 bp, Artificial
  CRISPR gRNA sequence
ttagtgaacaggaagtaaca

SEQ ID NO: 423161 - DNA, 20 bp, Artificial
  CRISPR gRNA sequence
acaggaagtaacaaggtgtg

SEQ ID NO: 423162 - DNA, 20 bp, Artificial
  CRISPR gRNA sequence
gtaacaaggtgtgtggcacg

SEQ ID NO: 423163 - DNA, 20 bp, Artificial
  CRISPR gRNA sequence
tgtgtggcacgtggtatatg

SEQ ID NO: 423164 - DNA, 20 bp, Artificial
  CRISPR gRNA sequence
tggcacgtggtatatgtagt

SEQ ID NO: 423165 - DNA, 20 bp, Artificial
  CRISPR gRNA sequence
cgtggtatatgtagtaagtg

SEQ ID NO: 423166 - DNA, 20 bp, Artificial
  CRISPR gRNA sequence
tgtagtaagtgcagtttcca

SEQ ID NO: 423167 - DNA, 20 bp, Artificial
  CRISPR gRNA sequence
taagtgcagtttccatggac

SEQ ID NO: 423168 - DNA, 20 bp, Artificial
  CRISPR gRNA sequence
tgcagtttccatggactagt

SEQ ID NO: 423169 - DNA, 20 bp, Artificial
  CRISPR gRNA sequence
gactagttagcatttaaatc

SEQ ID NO: 423170 - DNA, 20 bp, Artificial
  CRISPR gRNA sequence
atttaaatctagctgtaacg

SEQ ID NO: 423171 - DNA, 20 bp, Artificial
  CRISPR gRNA sequence
aatctagctgtaacgcggtt

SEQ ID NO: 423172 - DNA, 20 bp, Artificial
  CRISPR gRNA sequence
tgtaacgcggttgagaaatt

SEQ ID NO: 423173 - DNA, 20 bp, Artificial
  CRISPR gRNA sequence
gtaacgcggttgagaaatta

SEQ ID NO: 423174 - DNA, 20 bp, Artificial
  CRISPR gRNA sequence
taacgcggttgagaaattaa

SEQ ID NO: 423175 - DNA, 20 bp, Artificial
  CRISPR gRNA sequence
cggttgagaaattaagggct

SEQ ID NO: 423176 - DNA, 20 bp, Artificial
  CRISPR gRNA sequence
ggttgagaaattaagggcta

SEQ ID NO: 423177 - DNA, 20 bp, Artificial
  CRISPR gRNA sequence
gaaattaagggctaaggaat

SEQ ID NO: 423178 - DNA, 20 bp, Artificial
  CRISPR gRNA sequence
aagggctaaggaattggtgt

SEQ ID NO: 423179 - DNA, 20 bp, Artificial
  CRISPR gRNA sequence
gctaaggaattggtgttggt

SEQ ID NO: 423180 - DNA, 20 bp, Artificial
  CRISPR gRNA sequence
attggtgttggtaagaacat

SEQ ID NO: 423181 - DNA, 20 bp, Artificial
  CRISPR gRNA sequence
tggtaagaacataagtttgc

SEQ ID NO: 423182 - DNA, 20 bp, Artificial
  CRISPR gRNA sequence
ttgctggtgtgcatgtgtgt

SEQ ID NO: 423183 - DNA, 20 bp, Artificial
  CRISPR gRNA sequence
tggtgtgcatgtgtgtaaga

SEQ ID NO: 423184 - DNA, 20 bp, Artificial
  CRISPR gRNA sequence
ggtgtgcatgtgtgtaagaa

SEQ ID NO: 423185 - DNA, 20 bp, Artificial
  CRISPR gRNA sequence
gtgcatgtgtgtaagaaagg

SEQ ID NO: 423186 - DNA, 20 bp, Artificial
  CRISPR gRNA sequence
gcatgtgtgtaagaaaggaa

SEQ ID NO: 423187 - DNA, 20 bp, Artificial
  CRISPR gRNA sequence
atgtgtgtaagaaaggaaga

SEQ ID NO: 423188 - DNA, 20 bp, Artificial
  CRISPR gRNA sequence
gtgtgtaagaaaggaagaga

SEQ ID NO: 423189 - DNA, 20 bp, Artificial
  CRISPR gRNA sequence
ggaagagagagatgtcatat

SEQ ID NO: 423190 - DNA, 20 bp, Artificial
  CRISPR gRNA sequence
gaagagagagatgtcatatt

SEQ ID NO: 423191 - DNA, 20 bp, Artificial
  CRISPR gRNA sequence
aagagagagatgtcatattg

SEQ ID NO: 423192 - DNA, 20 bp, Artificial
  CRISPR gRNA sequence
atccccacatactcactttg

SEQ ID NO: 423193 - DNA, 20 bp, Artificial
  CRISPR gRNA sequence
ctttgtagtttgtttgtttt

SEQ ID NO: 423194 - DNA, 20 bp, Artificial
  CRISPR gRNA sequence
tgtagtttgtttgtttttag

SEQ ID NO: 423195 - DNA, 20 bp, Artificial
  CRISPR gRNA sequence
gtttgtttgtttttagaaga

SEQ ID NO: 423196 - DNA, 20 bp, Artificial
  CRISPR gRNA sequence
tgtttttagaagaaagccct

SEQ ID NO: 423197 - DNA, 20 bp, Artificial
  CRISPR gRNA sequence
agccctcagaatccattctg

SEQ ID NO: 423198 - DNA, 20 bp, Artificial
  CRISPR gRNA sequence
cctcagaatccattctgtgg

SEQ ID NO: 423199 - DNA, 20 bp, Artificial
  CRISPR gRNA sequence
ctcagaatccattctgtgga

SEQ ID NO: 423200 - DNA, 20 bp, Artificial
  CRISPR gRNA sequence
cattctgtggaaggtgacct

SEQ ID NO: 423201 - DNA, 20 bp, Artificial
  CRISPR gRNA sequence
attctgtggaaggtgacctc

SEQ ID NO: 423202 - DNA, 20 bp, Artificial
  CRISPR gRNA sequence
tctgtggaaggtgacctcag

SEQ ID NO: 423203 - DNA, 20 bp, Artificial
  CRISPR gRNA sequence
aggtgacctcaggagaaaat

SEQ ID NO: 423204 - DNA, 20 bp, Artificial
  CRISPR gRNA sequence
gacctcaggagaaaatcagc

SEQ ID NO: 423205 - DNA, 20 bp, Artificial
  CRISPR gRNA sequence
tcaggagaaaatcagctgga

SEQ ID NO: 423206 - DNA, 20 bp, Artificial
  CRISPR gRNA sequence
caggagaaaatcagctggac

SEQ ID NO: 423207 - DNA, 20 bp, Artificial
  CRISPR gRNA sequence
ggagaaaatcagctggacag

SEQ ID NO: 423208 - DNA, 20 bp, Artificial
  CRISPR gRNA sequence
gagaaaatcagctggacagg

SEQ ID NO: 423209 - DNA, 20 bp, Artificial
  CRISPR gRNA sequence
aatcagctggacaggaggaa

SEQ ID NO: 423210 - DNA, 20 bp, Artificial
  CRISPR gRNA sequence
tcagctggacaggaggaatg

SEQ ID NO: 423211 - DNA, 20 bp, Artificial
  CRISPR gRNA sequence
ggacaggaggaatggagccc

SEQ ID NO: 423212 - DNA, 20 bp, Artificial
  CRISPR gRNA sequence
ccccagtgctccctcacccc

SEQ ID NO: 423213 - DNA, 20 bp, Artificial
  CRISPR gRNA sequence
cccagtgctccctcaccccc

SEQ ID NO: 423214 - DNA, 20 bp, Artificial
  CRISPR gRNA sequence
agtgctccctcacccccagg

SEQ ID NO: 423215 - DNA, 20 bp, Artificial
  CRISPR gRNA sequence
cacccccaggaagctgtgtc

SEQ ID NO: 423216 - DNA, 20 bp, Artificial
  CRISPR gRNA sequence
acccccaggaagctgtgtcc

SEQ ID NO: 423217 - DNA, 20 bp, Artificial
  CRISPR gRNA sequence
cccaggaagctgtgtccagg

SEQ ID NO: 423218 - DNA, 20 bp, Artificial
  CRISPR gRNA sequence
aggaagctgtgtccaggcag

SEQ ID NO: 423219 - DNA, 20 bp, Artificial
  CRISPR gRNA sequence
caggcagaagctgcacctgc

SEQ ID NO: 423220 - DNA, 20 bp, Artificial
  CRISPR gRNA sequence
aggcagaagctgcacctgct

SEQ ID NO: 423221 - DNA, 20 bp, Artificial
  CRISPR gRNA sequence
gctgcacctgctgggctctg

SEQ ID NO: 423222 - DNA, 20 bp, Artificial
  CRISPR gRNA sequence
tgcacctgctgggctctgtg

SEQ ID NO: 423223 - DNA, 20 bp, Artificial
  CRISPR gRNA sequence
cacctgctgggctctgtgga

SEQ ID NO: 423224 - DNA, 20 bp, Artificial
  CRISPR gRNA sequence
ctgctgggctctgtggagag

SEQ ID NO: 423225 - DNA, 20 bp, Artificial
  CRISPR gRNA sequence
ctgggctctgtggagagcag

SEQ ID NO: 423226 - DNA, 20 bp, Artificial
  CRISPR gRNA sequence
tgggctctgtggagagcagc

SEQ ID NO: 423227 - DNA, 20 bp, Artificial
  CRISPR gRNA sequence
gggctctgtggagagcagcg

SEQ ID NO: 423228 - DNA, 20 bp, Artificial
  CRISPR gRNA sequence
gctctgtggagagcagcggg

SEQ ID NO: 423229 - DNA, 20 bp, Artificial
  CRISPR gRNA sequence
tctgtggagagcagcgggga

SEQ ID NO: 423230 - DNA, 20 bp, Artificial
  CRISPR gRNA sequence
ctgtggagagcagcggggag

SEQ ID NO: 423231 - DNA, 20 bp, Artificial
  CRISPR gRNA sequence
agcggggagaggactgtgcc

SEQ ID NO: 423232 - DNA, 20 bp, Artificial
  CRISPR gRNA sequence
catgactacttcaatgtcct

SEQ ID NO: 423233 - DNA, 20 bp, Artificial
  CRISPR gRNA sequence
tacttcaatgtcctgagtta

SEQ ID NO: 423234 - DNA, 20 bp, Artificial
  CRISPR gRNA sequence
ttcaatgtcctgagttacag

SEQ ID NO: 423235 - DNA, 20 bp, Artificial
  CRISPR gRNA sequence
tgtcctgagttacagaagcc

SEQ ID NO: 423236 - DNA, 20 bp, Artificial
  CRISPR gRNA sequence
gtcctgagttacagaagcct

SEQ ID NO: 423237 - DNA, 20 bp, Artificial
  CRISPR gRNA sequence
tacagaagcctgggtaactg

SEQ ID NO: 423238 - DNA, 20 bp, Artificial
  CRISPR gRNA sequence
gggtaactgcagcttcttca

SEQ ID NO: 423239 - DNA, 20 bp, Artificial
  CRISPR gRNA sequence
gtaactgcagcttcttcaca

SEQ ID NO: 423240 - DNA, 20 bp, Artificial
  CRISPR gRNA sequence
tgcagcttcttcacagagac

SEQ ID NO: 423241 - DNA, 20 bp, Artificial
  CRISPR gRNA sequence
gcttcttcacagagactggt

SEQ ID NO: 423242 - DNA, 20 bp, Artificial
  CRISPR gRNA sequence
cacagagactggttagcaac

SEQ ID NO: 423243 - DNA, 20 bp, Artificial
  CRISPR gRNA sequence
cagagactggttagcaacca

SEQ ID NO: 423244 - DNA, 20 bp, Artificial
  CRISPR gRNA sequence
agagactggttagcaaccag

SEQ ID NO: 423245 - DNA, 20 bp, Artificial
  CRISPR gRNA sequence
tagcaaccagaggcatcttc

SEQ ID NO: 423246 - DNA, 20 bp, Artificial
  CRISPR gRNA sequence
caaccagaggcatcttctgg

SEQ ID NO: 423247 - DNA, 20 bp, Artificial
  CRISPR gRNA sequence
cacttttgtctttgctatta

SEQ ID NO: 423248 - DNA, 20 bp, Artificial
  CRISPR gRNA sequence
gctattatagatgaatatat

SEQ ID NO: 423249 - DNA, 20 bp, Artificial
  CRISPR gRNA sequence
attatagatgaatatataag

SEQ ID NO: 423250 - DNA, 20 bp, Artificial
  CRISPR gRNA sequence
taagcagctgtactctccat

SEQ ID NO: 423251 - DNA, 20 bp, Artificial
  CRISPR gRNA sequence
tgtgtatgtgtgtgtgtgtt

SEQ ID NO: 423252 - DNA, 20 bp, Artificial
  CRISPR gRNA sequence
atgtgtgtgtgtgttcagtt

SEQ ID NO: 423253 - DNA, 20 bp, Artificial
  CRISPR gRNA sequence
cttctccatcttcatttcct

SEQ ID NO: 423254 - DNA, 20 bp, Artificial
  CRISPR gRNA sequence
ttctattccattttgcatta

SEQ ID NO: 423255 - DNA, 20 bp, Artificial
  CRISPR gRNA sequence
tattccattttgcattatgg

SEQ ID NO: 423256 - DNA, 20 bp, Artificial
  CRISPR gRNA sequence
attccattttgcattatggc

SEQ ID NO: 423257 - DNA, 20 bp, Artificial
  CRISPR gRNA sequence
attttgcattatggcaggcc

SEQ ID NO: 423258 - DNA, 20 bp, Artificial
  CRISPR gRNA sequence
ttttgcattatggcaggcct

SEQ ID NO: 423259 - DNA, 20 bp, Artificial
  CRISPR gRNA sequence
tttgcattatggcaggccta

SEQ ID NO: 423260 - DNA, 20 bp, Artificial
  CRISPR gRNA sequence
cattatggcaggcctagggt

SEQ ID NO: 423261 - DNA, 20 bp, Artificial
  CRISPR gRNA sequence
caggcctagggtgagtaacg

SEQ ID NO: 423262 - DNA, 20 bp, Artificial
  CRISPR gRNA sequence
aattaaaaaatatcttgacc

SEQ ID NO: 423263 - DNA, 20 bp, Artificial
  CRISPR gRNA sequence
tcttgacctggttttaaatc

SEQ ID NO: 423264 - DNA, 20 bp, Artificial
  CRISPR gRNA sequence
tgacctggttttaaatctgg

SEQ ID NO: 423265 - DNA, 20 bp, Artificial
  CRISPR gRNA sequence
ggttttaaatctggcagttt

SEQ ID NO: 423266 - DNA, 20 bp, Artificial
  CRISPR gRNA sequence
tttaaatctggcagtttgag

SEQ ID NO: 423267 - DNA, 20 bp, Artificial
  CRISPR gRNA sequence
tgagcagatcctatgtctct

SEQ ID NO: 423268 - DNA, 20 bp, Artificial
  CRISPR gRNA sequence
agcagatcctatgtctctga

SEQ ID NO: 423269 - DNA, 20 bp, Artificial
  CRISPR gRNA sequence
gagagacacattcctcataa

SEQ ID NO: 423270 - DNA, 20 bp, Artificial
  CRISPR gRNA sequence
gacacattcctcataatggc

SEQ ID NO: 423271 - DNA, 20 bp, Artificial
  CRISPR gRNA sequence
cctcataatggccagcattt

SEQ ID NO: 423272 - DNA, 20 bp, Artificial
  CRISPR gRNA sequence
ctcataatggccagcatttt

SEQ ID NO: 423273 - DNA, 20 bp, Artificial
  CRISPR gRNA sequence
tggccagcattttgggctac

SEQ ID NO: 423274 - DNA, 20 bp, Artificial
  CRISPR gRNA sequence
ggccagcattttgggctaca

SEQ ID NO: 423275 - DNA, 20 bp, Artificial
  CRISPR gRNA sequence
ttttgggctacaaggttttg

SEQ ID NO: 423276 - DNA, 20 bp, Artificial
  CRISPR gRNA sequence
aaggttttgtggttgatgat

SEQ ID NO: 423277 - DNA, 20 bp, Artificial
  CRISPR gRNA sequence
aggttttgtggttgatgatg

SEQ ID NO: 423278 - DNA, 20 bp, Artificial
  CRISPR gRNA sequence
tttgtggttgatgatgagga

SEQ ID NO: 423279 - DNA, 20 bp, Artificial
  CRISPR gRNA sequence
tgatgaggatggcatgactg

SEQ ID NO: 423280 - DNA, 20 bp, Artificial
  CRISPR gRNA sequence
atgaggatggcatgactgca

SEQ ID NO: 423281 - DNA, 20 bp, Artificial
  CRISPR gRNA sequence
tcattttttcacgtcatttt

SEQ ID NO: 423282 - DNA, 20 bp, Artificial
  CRISPR gRNA sequence
cagtaactttcactcattca

SEQ ID NO: 423283 - DNA, 20 bp, Artificial
  CRISPR gRNA sequence
agtaactttcactcattcaa

SEQ ID NO: 423284 - DNA, 20 bp, Artificial
  CRISPR gRNA sequence
aactttcactcattcaaagg

SEQ ID NO: 423285 - DNA, 20 bp, Artificial
  CRISPR gRNA sequence
actttcactcattcaaaggc

SEQ ID NO: 423286 - DNA, 20 bp, Artificial
  CRISPR gRNA sequence
ctcattcaaaggcaggttat

SEQ ID NO: 423287 - DNA, 20 bp, Artificial
  CRISPR gRNA sequence
ttcaaaggcaggttataagt

SEQ ID NO: 423288 - DNA, 20 bp, Artificial
  CRISPR gRNA sequence
ggcaggttataagtaagtcc

SEQ ID NO: 423289 - DNA, 20 bp, Artificial
  CRISPR gRNA sequence
aggttataagtaagtcctgg

SEQ ID NO: 423290 - DNA, 20 bp, Artificial
  CRISPR gRNA sequence
ttataagtaagtcctggtag

SEQ ID NO: 423291 - DNA, 20 bp, Artificial
  CRISPR gRNA sequence
agtcctggtagcagcctcta

SEQ ID NO: 423292 - DNA, 20 bp, Artificial
  CRISPR gRNA sequence
gtcctggtagcagcctctat

SEQ ID NO: 423293 - DNA, 20 bp, Artificial
  CRISPR gRNA sequence
tcctggtagcagcctctatg

SEQ ID NO: 423294 - DNA, 20 bp, Artificial
  CRISPR gRNA sequence
ctggtagcagcctctatggg

SEQ ID NO: 423295 - DNA, 20 bp, Artificial
  CRISPR gRNA sequence
cagcctctatggggagattt

SEQ ID NO: 423296 - DNA, 20 bp, Artificial
  CRISPR gRNA sequence
gcctctatggggagatttga

SEQ ID NO: 423297 - DNA, 20 bp, Artificial
  CRISPR gRNA sequence
atttgagagtgactaaatct

SEQ ID NO: 423298 - DNA, 20 bp, Artificial
  CRISPR gRNA sequence
aaatcttggtatctgccctc

SEQ ID NO: 423299 - DNA, 20 bp, Artificial
  CRISPR gRNA sequence
tatctgccctcaagaactta

SEQ ID NO: 423300 - DNA, 20 bp, Artificial
  CRISPR gRNA sequence
ctcaagaacttacagttaaa

SEQ ID NO: 423301 - DNA, 20 bp, Artificial
  CRISPR gRNA sequence
tcaagaacttacagttaaat

SEQ ID NO: 423302 - DNA, 20 bp, Artificial
  CRISPR gRNA sequence
caagaacttacagttaaatg

SEQ ID NO: 423303 - DNA, 20 bp, Artificial
  CRISPR gRNA sequence
agaacttacagttaaatggg

SEQ ID NO: 423304 - DNA, 20 bp, Artificial
  CRISPR gRNA sequence
ggagacaatgttgtcatgaa

SEQ ID NO: 423305 - DNA, 20 bp, Artificial
  CRISPR gRNA sequence
gagacaatgttgtcatgaaa

SEQ ID NO: 423306 - DNA, 20 bp, Artificial
  CRISPR gRNA sequence
gttgtcatgaaaaggtatta

SEQ ID NO: 423307 - DNA, 20 bp, Artificial
  CRISPR gRNA sequence
tcatgaaaaggtattatagt

SEQ ID NO: 423308 - DNA, 20 bp, Artificial
  CRISPR gRNA sequence
catgaaaaggtattatagta

SEQ ID NO: 423309 - DNA, 20 bp, Artificial
  CRISPR gRNA sequence
tgaaaaggtattatagtaag

SEQ ID NO: 423310 - DNA, 20 bp, Artificial
  CRISPR gRNA sequence
aaaaggtattatagtaagga

SEQ ID NO: 423311 - DNA, 20 bp, Artificial
  CRISPR gRNA sequence
aggtattatagtaaggagag

SEQ ID NO: 423312 - DNA, 20 bp, Artificial
  CRISPR gRNA sequence
ggtattatagtaaggagaga

SEQ ID NO: 423313 - DNA, 20 bp, Artificial
  CRISPR gRNA sequence
tattatagtaaggagagaag

SEQ ID NO: 423314 - DNA, 20 bp, Artificial
  CRISPR gRNA sequence
aggagagaaggagacataca

SEQ ID NO: 423315 - DNA, 20 bp, Artificial
  CRISPR gRNA sequence
ggagagaaggagacatacac

SEQ ID NO: 423316 - DNA, 20 bp, Artificial
  CRISPR gRNA sequence
aggagacatacacaggcctt

SEQ ID NO: 423317 - DNA, 20 bp, Artificial
  CRISPR gRNA sequence
ggagacatacacaggccttc

SEQ ID NO: 423318 - DNA, 20 bp, Artificial
  CRISPR gRNA sequence
gacatacacaggccttcagg

SEQ ID NO: 423319 - DNA, 20 bp, Artificial
  CRISPR gRNA sequence
catacacaggccttcaggaa

SEQ ID NO: 423320 - DNA, 20 bp, Artificial
  CRISPR gRNA sequence
aggccttcaggaagagacga

SEQ ID NO: 423321 - DNA, 20 bp, Artificial
  CRISPR gRNA sequence
ttcaggaagagacgacagtt

SEQ ID NO: 423322 - DNA, 20 bp, Artificial
  CRISPR gRNA sequence
tcaggaagagacgacagttt

SEQ ID NO: 423323 - DNA, 20 bp, Artificial
  CRISPR gRNA sequence
caggaagagacgacagtttg

SEQ ID NO: 423324 - DNA, 20 bp, Artificial
  CRISPR gRNA sequence
aagagacgacagtttggggt

SEQ ID NO: 423325 - DNA, 20 bp, Artificial
  CRISPR gRNA sequence
agagacgacagtttggggtg

SEQ ID NO: 423326 - DNA, 20 bp, Artificial
  CRISPR gRNA sequence
gacgacagtttggggtgagg

SEQ ID NO: 423327 - DNA, 20 bp, Artificial
  CRISPR gRNA sequence
acagtttggggtgaggtagt

SEQ ID NO: 423328 - DNA, 20 bp, Artificial
  CRISPR gRNA sequence
ttggggtgaggtagttggca

SEQ ID NO: 423329 - DNA, 20 bp, Artificial
  CRISPR gRNA sequence
tggggtgaggtagttggcat

SEQ ID NO: 423330 - DNA, 20 bp, Artificial
  CRISPR gRNA sequence
gcataggcttatctgtgatg

SEQ ID NO: 423331 - DNA, 20 bp, Artificial
  CRISPR gRNA sequence
taggcttatctgtgatgaag

SEQ ID NO: 423332 - DNA, 20 bp, Artificial
  CRISPR gRNA sequence
ttatctgtgatgaagtggcc

SEQ ID NO: 423333 - DNA, 20 bp, Artificial
  CRISPR gRNA sequence
tatctgtgatgaagtggcct

SEQ ID NO: 423334 - DNA, 20 bp, Artificial
  CRISPR gRNA sequence
tctgtgatgaagtggcctgg

SEQ ID NO: 423335 - DNA, 20 bp, Artificial
  CRISPR gRNA sequence
tgaagtggcctgggagcacc

SEQ ID NO: 423336 - DNA, 20 bp, Artificial
  CRISPR gRNA sequence
gaagtggcctgggagcacca

SEQ ID NO: 423337 - DNA, 20 bp, Artificial
  CRISPR gRNA sequence
aagtggcctgggagcaccaa

SEQ ID NO: 423338 - DNA, 20 bp, Artificial
  CRISPR gRNA sequence
agtggcctgggagcaccaag

SEQ ID NO: 423339 - DNA, 20 bp, Artificial
  CRISPR gRNA sequence
gggagcaccaaggggatgtt

SEQ ID NO: 423340 - DNA, 20 bp, Artificial
  CRISPR gRNA sequence
ggagcaccaaggggatgttg

SEQ ID NO: 423341 - DNA, 20 bp, Artificial
  CRISPR gRNA sequence
caccaaggggatgttgaggc

SEQ ID NO: 423342 - DNA, 20 bp, Artificial
  CRISPR gRNA sequence
aggggatgttgaggctagtc

SEQ ID NO: 423343 - DNA, 20 bp, Artificial
  CRISPR gRNA sequence
ggggatgttgaggctagtct

SEQ ID NO: 423344 - DNA, 20 bp, Artificial
  CRISPR gRNA sequence
ggatgttgaggctagtctgg

SEQ ID NO: 423345 - DNA, 20 bp, Artificial
  CRISPR gRNA sequence
gatgttgaggctagtctggg

SEQ ID NO: 423346 - DNA, 20 bp, Artificial
  CRISPR gRNA sequence
tgttgaggctagtctgggag

SEQ ID NO: 423347 - DNA, 20 bp, Artificial
  CRISPR gRNA sequence
tgaggctagtctgggaggag

SEQ ID NO: 423348 - DNA, 20 bp, Artificial
  CRISPR gRNA sequence
gaggctagtctgggaggagc

SEQ ID NO: 423349 - DNA, 20 bp, Artificial
  CRISPR gRNA sequence
ggctagtctgggaggagcag

SEQ ID NO: 423350 - DNA, 20 bp, Artificial
  CRISPR gRNA sequence
ggaggagcaggagttttgtc

SEQ ID NO: 423351 - DNA, 20 bp, Artificial
  CRISPR gRNA sequence
gaggagcaggagttttgtct

SEQ ID NO: 423352 - DNA, 20 bp, Artificial
  CRISPR gRNA sequence
aggagcaggagttttgtcta

SEQ ID NO: 423353 - DNA, 20 bp, Artificial
  CRISPR gRNA sequence
agttttgtctagggaacttg

SEQ ID NO: 423354 - DNA, 20 bp, Artificial
  CRISPR gRNA sequence
gttttgtctagggaacttgt

SEQ ID NO: 423355 - DNA, 20 bp, Artificial
  CRISPR gRNA sequence
gggaacttgtaggaaattct

SEQ ID NO: 423356 - DNA, 20 bp, Artificial
  CRISPR gRNA sequence
gaacttgtaggaaattcttg

SEQ ID NO: 423357 - DNA, 20 bp, Artificial
  CRISPR gRNA sequence
taggaaattcttggagctga

SEQ ID NO: 423358 - DNA, 20 bp, Artificial
  CRISPR gRNA sequence
ttggagctgaaagtcccaca

SEQ ID NO: 423359 - DNA, 20 bp, Artificial
  CRISPR gRNA sequence
gagctgaaagtcccacaaag

SEQ ID NO: 423360 - DNA, 20 bp, Artificial
  CRISPR gRNA sequence
agctgaaagtcccacaaaga

SEQ ID NO: 423361 - DNA, 20 bp, Artificial
  CRISPR gRNA sequence
aagtcccacaaagaaggccc

SEQ ID NO: 423362 - DNA, 20 bp, Artificial
  CRISPR gRNA sequence
acaaagaaggccctggcacc

SEQ ID NO: 423363 - DNA, 20 bp, Artificial
  CRISPR gRNA sequence
caaagaaggccctggcacca

SEQ ID NO: 423364 - DNA, 20 bp, Artificial
  CRISPR gRNA sequence
aaagaaggccctggcaccaa

SEQ ID NO: 423365 - DNA, 20 bp, Artificial
  CRISPR gRNA sequence
agaaggccctggcaccaagg

SEQ ID NO: 423366 - DNA, 20 bp, Artificial
  CRISPR gRNA sequence
ggccctggcaccaagggagt

SEQ ID NO: 423367 - DNA, 20 bp, Artificial
  CRISPR gRNA sequence
ccaagggagtcagcaaactt

SEQ ID NO: 423368 - DNA, 20 bp, Artificial
  CRISPR gRNA sequence
aaacttcagattttattctc

SEQ ID NO: 423369 - DNA, 20 bp, Artificial
  CRISPR gRNA sequence
aacttcagattttattctct

SEQ ID NO: 423370 - DNA, 20 bp, Artificial
  CRISPR gRNA sequence
ttcagattttattctctggg

SEQ ID NO: 423371 - DNA, 20 bp, Artificial
  CRISPR gRNA sequence
tcagattttattctctgggc

SEQ ID NO: 423372 - DNA, 20 bp, Artificial
  CRISPR gRNA sequence
attctctgggcaggcatttc

SEQ ID NO: 423373 - DNA, 20 bp, Artificial
  CRISPR gRNA sequence
gctgtgacatactcatccat

SEQ ID NO: 423374 - DNA, 20 bp, Artificial
  CRISPR gRNA sequence
tgacatactcatccattaga

SEQ ID NO: 423375 - DNA, 20 bp, Artificial
  CRISPR gRNA sequence
atccattagacagcctgata

SEQ ID NO: 423376 - DNA, 20 bp, Artificial
  CRISPR gRNA sequence
tccattagacagcctgatac

SEQ ID NO: 423377 - DNA, 20 bp, Artificial
  CRISPR gRNA sequence
gacagcctgatacaggcctg

SEQ ID NO: 423378 - DNA, 20 bp, Artificial
  CRISPR gRNA sequence
tacaggcctgtagcctcttc

SEQ ID NO: 423379 - DNA, 20 bp, Artificial
  CRISPR gRNA sequence
cctcttccggccgtgtgtgc

SEQ ID NO: 423380 - DNA, 20 bp, Artificial
  CRISPR gRNA sequence
ctcttccggccgtgtgtgct

SEQ ID NO: 423381 - DNA, 20 bp, Artificial
  CRISPR gRNA sequence
tcttccggccgtgtgtgctg

SEQ ID NO: 423382 - DNA, 20 bp, Artificial
  CRISPR gRNA sequence
tccggccgtgtgtgctgggg

SEQ ID NO: 423383 - DNA, 20 bp, Artificial
  CRISPR gRNA sequence
cgtgtgtgctggggaagccc

SEQ ID NO: 423384 - DNA, 20 bp, Artificial
  CRISPR gRNA sequence
gtgtgtgctggggaagcccc

SEQ ID NO: 423385 - DNA, 20 bp, Artificial
  CRISPR gRNA sequence
aggaaacgcacatgcccaca

SEQ ID NO: 423386 - DNA, 20 bp, Artificial
  CRISPR gRNA sequence
ggaaacgcacatgcccacac

SEQ ID NO: 423387 - DNA, 20 bp, Artificial
  CRISPR gRNA sequence
gaaacgcacatgcccacaca

SEQ ID NO: 423388 - DNA, 20 bp, Artificial
  CRISPR gRNA sequence
aacgcacatgcccacacagg

SEQ ID NO: 423389 - DNA, 20 bp, Artificial
  CRISPR gRNA sequence
acatgcccacacagggagcc

SEQ ID NO: 423390 - DNA, 20 bp, Artificial
  CRISPR gRNA sequence
ccacacagggagccaagtcg

SEQ ID NO: 423391 - DNA, 20 bp, Artificial
  CRISPR gRNA sequence
gggagccaagtcgtagcatt

SEQ ID NO: 423392 - DNA, 20 bp, Artificial
  CRISPR gRNA sequence
ggagccaagtcgtagcattt

SEQ ID NO: 423393 - DNA, 20 bp, Artificial
  CRISPR gRNA sequence
ttctgcatcaatacactctt

SEQ ID NO: 423394 - DNA, 20 bp, Artificial
  CRISPR gRNA sequence
cactcttgagcctttgaaaa

SEQ ID NO: 423395 - DNA, 20 bp, Artificial
  CRISPR gRNA sequence
aaagaacgtttcccactaaa

SEQ ID NO: 423396 - DNA, 20 bp, Artificial
  CRISPR gRNA sequence
ttcccactaaaaagaaaatg

SEQ ID NO: 423397 - DNA, 20 bp, Artificial
  CRISPR gRNA sequence
gaaaatgtggatttttaaaa

SEQ ID NO: 423398 - DNA, 20 bp, Artificial
  CRISPR gRNA sequence
aaaatgtggatttttaaaat

SEQ ID NO: 423399 - DNA, 20 bp, Artificial
  CRISPR gRNA sequence
aaatgtggatttttaaaata

SEQ ID NO: 423400 - DNA, 20 bp, Artificial
  CRISPR gRNA sequence
tttaaaatagggactcttcc

SEQ ID NO: 423401 - DNA, 20 bp, Artificial
  CRISPR gRNA sequence
ttaaaatagggactcttcct

SEQ ID NO: 423402 - DNA, 20 bp, Artificial
  CRISPR gRNA sequence
taaaatagggactcttccta

SEQ ID NO: 423403 - DNA, 20 bp, Artificial
  CRISPR gRNA sequence
aaaatagggactcttcctag

SEQ ID NO: 423404 - DNA, 20 bp, Artificial
  CRISPR gRNA sequence
gggactcttcctaggggaaa

SEQ ID NO: 423405 - DNA, 20 bp, Artificial
  CRISPR gRNA sequence
ggactcttcctaggggaaaa

SEQ ID NO: 423406 - DNA, 20 bp, Artificial
  CRISPR gRNA sequence
gactcttcctaggggaaaaa

SEQ ID NO: 423407 - DNA, 20 bp, Artificial
  CRISPR gRNA sequence
actcttcctaggggaaaaag

SEQ ID NO: 423408 - DNA, 20 bp, Artificial
  CRISPR gRNA sequence
ctcttcctaggggaaaaagg

SEQ ID NO: 423409 - DNA, 20 bp, Artificial
  CRISPR gRNA sequence
tcttcctaggggaaaaaggg

SEQ ID NO: 423410 - DNA, 20 bp, Artificial
  CRISPR gRNA sequence
cctaggggaaaaaggggggc

SEQ ID NO: 423411 - DNA, 20 bp, Artificial
  CRISPR gRNA sequence
ctaggggaaaaaggggggct

SEQ ID NO: 423412 - DNA, 20 bp, Artificial
  CRISPR gRNA sequence
aggggaaaaaggggggctgg

SEQ ID NO: 423413 - DNA, 20 bp, Artificial
  CRISPR gRNA sequence
aaaaggggggctgggagtga

SEQ ID NO: 423414 - DNA, 20 bp, Artificial
  CRISPR gRNA sequence
aaggggggctgggagtgata

SEQ ID NO: 423415 - DNA, 20 bp, Artificial
  CRISPR gRNA sequence
aggggggctgggagtgatag

SEQ ID NO: 423416 - DNA, 20 bp, Artificial
  CRISPR gRNA sequence
ggggggctgggagtgataga

SEQ ID NO: 423417 - DNA, 20 bp, Artificial
  CRISPR gRNA sequence
actccctgacgactttgtgc

SEQ ID NO: 423418 - DNA, 20 bp, Artificial
  CRISPR gRNA sequence
ctccctgacgactttgtgct

SEQ ID NO: 423419 - DNA, 20 bp, Artificial
  CRISPR gRNA sequence
tccctgacgactttgtgctg

SEQ ID NO: 423420 - DNA, 20 bp, Artificial
  CRISPR gRNA sequence
tgacgactttgtgctggggt

SEQ ID NO: 423421 - DNA, 20 bp, Artificial
  CRISPR gRNA sequence
gacgactttgtgctggggtt

SEQ ID NO: 423422 - DNA, 20 bp, Artificial
  CRISPR gRNA sequence
acgactttgtgctggggttg

SEQ ID NO: 423423 - DNA, 20 bp, Artificial
  CRISPR gRNA sequence
tatttctgtttaattgcatt

SEQ ID NO: 423424 - DNA, 20 bp, Artificial
  CRISPR gRNA sequence
atttctgtttaattgcattc

SEQ ID NO: 423425 - DNA, 20 bp, Artificial
  CRISPR gRNA sequence
ctgtttaattgcattcaggc

SEQ ID NO: 423426 - DNA, 20 bp, Artificial
  CRISPR gRNA sequence
attgcattcaggctggatct

SEQ ID NO: 423427 - DNA, 20 bp, Artificial
  CRISPR gRNA sequence
gcattcaggctggatcttag

SEQ ID NO: 423428 - DNA, 20 bp, Artificial
  CRISPR gRNA sequence
tatccttccaccatctctct

SEQ ID NO: 423429 - DNA, 20 bp, Artificial
  CRISPR gRNA sequence
tccttccaccatctctctca

SEQ ID NO: 423430 - DNA, 20 bp, Artificial
  CRISPR gRNA sequence
ccttccaccatctctctcag

SEQ ID NO: 423431 - DNA, 20 bp, Artificial
  CRISPR gRNA sequence
accatctctctcagaggaat

SEQ ID NO: 423432 - DNA, 20 bp, Artificial
  CRISPR gRNA sequence
atctctctcagaggaatgag

SEQ ID NO: 423433 - DNA, 20 bp, Artificial
  CRISPR gRNA sequence
tctctctcagaggaatgagc

SEQ ID NO: 423434 - DNA, 20 bp, Artificial
  CRISPR gRNA sequence
ctctctcagaggaatgagcg

SEQ ID NO: 423435 - DNA, 20 bp, Artificial
  CRISPR gRNA sequence
ctctcagaggaatgagcggg

SEQ ID NO: 423436 - DNA, 20 bp, Artificial
  CRISPR gRNA sequence
tctcagaggaatgagcgggg

SEQ ID NO: 423437 - DNA, 20 bp, Artificial
  CRISPR gRNA sequence
agaggaatgagcggggaggt

SEQ ID NO: 423438 - DNA, 20 bp, Artificial
  CRISPR gRNA sequence
agcggggaggttggatttac

SEQ ID NO: 423439 - DNA, 20 bp, Artificial
  CRISPR gRNA sequence
tggtgactgattttctttca

SEQ ID NO: 423440 - DNA, 20 bp, Artificial
  CRISPR gRNA sequence
ggtgactgattttctttcat

SEQ ID NO: 423441 - DNA, 20 bp, Artificial
  CRISPR gRNA sequence
ctgattttctttcatgggcc

SEQ ID NO: 423442 - DNA, 20 bp, Artificial
  CRISPR gRNA sequence
tgattttctttcatgggcca

SEQ ID NO: 423443 - DNA, 20 bp, Artificial
  CRISPR gRNA sequence
ttcatgggccaaggaactga

SEQ ID NO: 423444 - DNA, 20 bp, Artificial
  CRISPR gRNA sequence
catgggccaaggaactgaaa

SEQ ID NO: 423445 - DNA, 20 bp, Artificial
  CRISPR gRNA sequence
aggaactgaaagagaatgtg

SEQ ID NO: 423446 - DNA, 20 bp, Artificial
  CRISPR gRNA sequence
actgaaagagaatgtgaagc

SEQ ID NO: 423447 - DNA, 20 bp, Artificial
  CRISPR gRNA sequence
ctgaaagagaatgtgaagca

SEQ ID NO: 423448 - DNA, 20 bp, Artificial
  CRISPR gRNA sequence
gcaaggttgtgtcttgcgca

SEQ ID NO: 423449 - DNA, 20 bp, Artificial
  CRISPR gRNA sequence
cttgcgcatggttaaaaata

SEQ ID NO: 423450 - DNA, 20 bp, Artificial
  CRISPR gRNA sequence
aaagcattgtcctgcttcct

SEQ ID NO: 423451 - DNA, 20 bp, Artificial
  CRISPR gRNA sequence
ttgtcctgcttcctaagact

SEQ ID NO: 423452 - DNA, 20 bp, Artificial
  CRISPR gRNA sequence
ctgcttcctaagacttagac

SEQ ID NO: 423453 - DNA, 20 bp, Artificial
  CRISPR gRNA sequence
tgcttcctaagacttagact

SEQ ID NO: 423454 - DNA, 20 bp, Artificial
  CRISPR gRNA sequence
gcttcctaagacttagactg

SEQ ID NO: 423455 - DNA, 20 bp, Artificial
  CRISPR gRNA sequence
actggggttgacaattgttt

SEQ ID NO: 423456 - DNA, 20 bp, Artificial
  CRISPR gRNA sequence
ttgacaattgttttagcaac

SEQ ID NO: 423457 - DNA, 20 bp, Artificial
  CRISPR gRNA sequence
gacaattcaactatttctcc

SEQ ID NO: 423458 - DNA, 20 bp, Artificial
  CRISPR gRNA sequence
acaattcaactatttctcct

SEQ ID NO: 423459 - DNA, 20 bp, Artificial
  CRISPR gRNA sequence
tttttcacttttctaccaaa

SEQ ID NO: 423460 - DNA, 20 bp, Artificial
  CRISPR gRNA sequence
ttttcacttttctaccaaat

SEQ ID NO: 423461 - DNA, 20 bp, Artificial
  CRISPR gRNA sequence
tttctaccaaatgggttaca

SEQ ID NO: 423462 - DNA, 20 bp, Artificial
  CRISPR gRNA sequence
ttctaccaaatgggttacat

SEQ ID NO: 423463 - DNA, 20 bp, Artificial
  CRISPR gRNA sequence
taccaaatgggttacatagg

SEQ ID NO: 423464 - DNA, 20 bp, Artificial
  CRISPR gRNA sequence
agaatgaactgaaatctgtc

SEQ ID NO: 423465 - DNA, 20 bp, Artificial
  CRISPR gRNA sequence
aatgaactgaaatctgtcca

SEQ ID NO: 423466 - DNA, 20 bp, Artificial
  CRISPR gRNA sequence
tgaaatctgtccagagctcc

SEQ ID NO: 423467 - DNA, 20 bp, Artificial
  CRISPR gRNA sequence
gtccagagctccaagtcctt

SEQ ID NO: 423468 - DNA, 20 bp, Artificial
  CRISPR gRNA sequence
cagagctccaagtcctttgg

SEQ ID NO: 423469 - DNA, 20 bp, Artificial
  CRISPR gRNA sequence
gctccaagtcctttggaaga

SEQ ID NO: 423470 - DNA, 20 bp, Artificial
  CRISPR gRNA sequence
aagtcctttggaagaaagat

SEQ ID NO: 423471 - DNA, 20 bp, Artificial
  CRISPR gRNA sequence
aaaaatgttgttgtttgctg

SEQ ID NO: 423472 - DNA, 20 bp, Artificial
  CRISPR gRNA sequence
aatgttgttgtttgctgtgg

SEQ ID NO: 423473 - DNA, 20 bp, Artificial
  CRISPR gRNA sequence
ttgtttgctgtggcagttta

SEQ ID NO: 423474 - DNA, 20 bp, Artificial
  CRISPR gRNA sequence
cagcatttttcttgcaaaat

SEQ ID NO: 423475 - DNA, 20 bp, Artificial
  CRISPR gRNA sequence
caaaattagtgcaaatctgt

SEQ ID NO: 423476 - DNA, 20 bp, Artificial
  CRISPR gRNA sequence
tagtgcaaatctgttggaaa

SEQ ID NO: 423477 - DNA, 20 bp, Artificial
  CRISPR gRNA sequence
atagaacacaattcacaaat

SEQ ID NO: 423478 - DNA, 20 bp, Artificial
  CRISPR gRNA sequence
gaacacaattcacaaattgg

SEQ ID NO: 423479 - DNA, 20 bp, Artificial
  CRISPR gRNA sequence
aactaaaatgtaatgacgaa

SEQ ID NO: 423480 - DNA, 20 bp, Artificial
  CRISPR gRNA sequence
actaaaatgtaatgacgaaa

SEQ ID NO: 423481 - DNA, 20 bp, Artificial
  CRISPR gRNA sequence
ctaaaatgtaatgacgaaaa

SEQ ID NO: 423482 - DNA, 20 bp, Artificial
  CRISPR gRNA sequence
aaaatgtaatgacgaaaagg

SEQ ID NO: 423483 - DNA, 20 bp, Artificial
  CRISPR gRNA sequence
atgtaatgacgaaaagggag

SEQ ID NO: 423484 - DNA, 20 bp, Artificial
  CRISPR gRNA sequence
aagggagtagtgttttgatt

SEQ ID NO: 423485 - DNA, 20 bp, Artificial
  CRISPR gRNA sequence
gggagtagtgttttgatttg

SEQ ID NO: 423486 - DNA, 20 bp, Artificial
  CRISPR gRNA sequence
ggagtagtgttttgatttgg

SEQ ID NO: 423487 - DNA, 20 bp, Artificial
  CRISPR gRNA sequence
agtagtgttttgatttggag

SEQ ID NO: 423488 - DNA, 20 bp, Artificial
  CRISPR gRNA sequence
gtagtgttttgatttggagg

SEQ ID NO: 423489 - DNA, 20 bp, Artificial
  CRISPR gRNA sequence
atttggaggaggtgtatatt

SEQ ID NO: 423490 - DNA, 20 bp, Artificial
  CRISPR gRNA sequence
tggaggaggtgtatattcgg

SEQ ID NO: 423491 - DNA, 20 bp, Artificial
  CRISPR gRNA sequence
gaggaggtgtatattcggca

SEQ ID NO: 423492 - DNA, 20 bp, Artificial
  CRISPR gRNA sequence
aggaggtgtatattcggcag

SEQ ID NO: 423493 - DNA, 20 bp, Artificial
  CRISPR gRNA sequence
ggtgtatattcggcagaggt

SEQ ID NO: 423494 - DNA, 20 bp, Artificial
  CRISPR gRNA sequence
tattcggcagaggttggact

SEQ ID NO: 423495 - DNA, 20 bp, Artificial
  CRISPR gRNA sequence
ttcggcagaggttggactga

SEQ ID NO: 423496 - DNA, 20 bp, Artificial
  CRISPR gRNA sequence
gcagaggttggactgagagt

SEQ ID NO: 423497 - DNA, 20 bp, Artificial
  CRISPR gRNA sequence
cagaggttggactgagagtt

SEQ ID NO: 423498 - DNA, 20 bp, Artificial
  CRISPR gRNA sequence
ggtgttatttaacataatta

SEQ ID NO: 423499 - DNA, 20 bp, Artificial
  CRISPR gRNA sequence
tttaacataattatggtaat

SEQ ID NO: 423500 - DNA, 20 bp, Artificial
  CRISPR gRNA sequence
ttaacataattatggtaatt

SEQ ID NO: 423501 - DNA, 20 bp, Artificial
  CRISPR gRNA sequence
gaaacatttataaacactat

SEQ ID NO: 423502 - DNA, 20 bp, Artificial
  CRISPR gRNA sequence
aaacatttataaacactatt

SEQ ID NO: 423503 - DNA, 20 bp, Artificial
  CRISPR gRNA sequence
atttataaacactattggga

SEQ ID NO: 423504 - DNA, 20 bp, Artificial
  CRISPR gRNA sequence
gggatggtgataaaatacaa

SEQ ID NO: 423505 - DNA, 20 bp, Artificial
  CRISPR gRNA sequence
ggatggtgataaaatacaaa

SEQ ID NO: 423506 - DNA, 20 bp, Artificial
  CRISPR gRNA sequence
gatggtgataaaatacaaaa

SEQ ID NO: 423507 - DNA, 20 bp, Artificial
  CRISPR gRNA sequence
ataaaatacaaaagggccta

SEQ ID NO: 423508 - DNA, 20 bp, Artificial
  CRISPR gRNA sequence
acaaaagggcctatagatgt

SEQ ID NO: 423509 - DNA, 20 bp, Artificial
  CRISPR gRNA sequence
gggcctatagatgttagaaa

SEQ ID NO: 423510 - DNA, 20 bp, Artificial
  CRISPR gRNA sequence
ggcctatagatgttagaaat

SEQ ID NO: 423511 - DNA, 20 bp, Artificial
  CRISPR gRNA sequence
tatagatgttagaaatgggt

SEQ ID NO: 423512 - DNA, 20 bp, Artificial
  CRISPR gRNA sequence
atagatgttagaaatgggtc

SEQ ID NO: 423513 - DNA, 20 bp, Artificial
  CRISPR gRNA sequence
aatgggtcaggttactgaaa

SEQ ID NO: 423514 - DNA, 20 bp, Artificial
  CRISPR gRNA sequence
atgggtcaggttactgaaat

SEQ ID NO: 423515 - DNA, 20 bp, Artificial
  CRISPR gRNA sequence
ttgaaaaaaatttttttaaa

SEQ ID NO: 423516 - DNA, 20 bp, Artificial
  CRISPR gRNA sequence
ttaaatagaactcactgaac

SEQ ID NO: 423517 - DNA, 20 bp, Artificial
  CRISPR gRNA sequence
actgaactagattctcctct

SEQ ID NO: 423518 - DNA, 20 bp, Artificial
  CRISPR gRNA sequence
ctagattctcctctgagaac

SEQ ID NO: 423519 - DNA, 20 bp, Artificial
  CRISPR gRNA sequence
agattctcctctgagaacca

SEQ ID NO: 423520 - DNA, 20 bp, Artificial
  CRISPR gRNA sequence
ttctcctctgagaaccagag

SEQ ID NO: 423521 - DNA, 20 bp, Artificial
  CRISPR gRNA sequence
aaccagagaagaccatttca

SEQ ID NO: 423522 - DNA, 20 bp, Artificial
  CRISPR gRNA sequence
agagaagaccatttcatagt

SEQ ID NO: 423523 - DNA, 20 bp, Artificial
  CRISPR gRNA sequence
ccatttcatagttggattcc

SEQ ID NO: 423524 - DNA, 20 bp, Artificial
  CRISPR gRNA sequence
atttcatagttggattcctg

SEQ ID NO: 423525 - DNA, 20 bp, Artificial
  CRISPR gRNA sequence
gacatgcgctatccaccacg

SEQ ID NO: 423526 - DNA, 20 bp, Artificial
  CRISPR gRNA sequence
acgtagccactttccacatg

SEQ ID NO: 423527 - DNA, 20 bp, Artificial
  CRISPR gRNA sequence
catgtggccatcaaccactt

SEQ ID NO: 423528 - DNA, 20 bp, Artificial
  CRISPR gRNA sequence
tggccatcaaccacttaaga

SEQ ID NO: 423529 - DNA, 20 bp, Artificial
  CRISPR gRNA sequence
ggccatcaaccacttaagat

SEQ ID NO: 423530 - DNA, 20 bp, Artificial
  CRISPR gRNA sequence
gccatcaaccacttaagatg

SEQ ID NO: 423531 - DNA, 20 bp, Artificial
  CRISPR gRNA sequence
tcaaccacttaagatggggt

SEQ ID NO: 423532 - DNA, 20 bp, Artificial
  CRISPR gRNA sequence
agatggggttagtttaaatc

SEQ ID NO: 423533 - DNA, 20 bp, Artificial
  CRISPR gRNA sequence
tcaagatgtgctgttataat

SEQ ID NO: 423534 - DNA, 20 bp, Artificial
  CRISPR gRNA sequence
tgtgctgttataattggtat

SEQ ID NO: 423535 - DNA, 20 bp, Artificial
  CRISPR gRNA sequence
gtataagcataaaatcacac

SEQ ID NO: 423536 - DNA, 20 bp, Artificial
  CRISPR gRNA sequence
cataaaatcacactagattc

SEQ ID NO: 423537 - DNA, 20 bp, Artificial
  CRISPR gRNA sequence
taaaatcacactagattctg

SEQ ID NO: 423538 - DNA, 20 bp, Artificial
  CRISPR gRNA sequence
ggagatttaatatgaataat

SEQ ID NO: 423539 - DNA, 20 bp, Artificial
  CRISPR gRNA sequence
gaataataagaatactattt

SEQ ID NO: 423540 - DNA, 20 bp, Artificial
  CRISPR gRNA sequence
taataagaatactatttcag

SEQ ID NO: 423541 - DNA, 20 bp, Artificial
  CRISPR gRNA sequence
gaatactatttcagtagttt

SEQ ID NO: 423542 - DNA, 20 bp, Artificial
  CRISPR gRNA sequence
tgtcaaaaatgataatattt

SEQ ID NO: 423543 - DNA, 20 bp, Artificial
  CRISPR gRNA sequence
tgataatattttggatgtat

SEQ ID NO: 423544 - DNA, 20 bp, Artificial
  CRISPR gRNA sequence
gataatattttggatgtatt

SEQ ID NO: 423545 - DNA, 20 bp, Artificial
  CRISPR gRNA sequence
gtgaaataaaatattaacat

SEQ ID NO: 423546 - DNA, 20 bp, Artificial
  CRISPR gRNA sequence
ttctttttatctttttaacg

SEQ ID NO: 423547 - DNA, 20 bp, Artificial
  CRISPR gRNA sequence
tatctttttaacgtggctac

SEQ ID NO: 423548 - DNA, 20 bp, Artificial
  CRISPR gRNA sequence
tttttaacgtggctactgga

SEQ ID NO: 423549 - DNA, 20 bp, Artificial
  CRISPR gRNA sequence
aaagtctaaaattgcatatg

SEQ ID NO: 423550 - DNA, 20 bp, Artificial
  CRISPR gRNA sequence
tctatgtgactgtgctgctc

SEQ ID NO: 423551 - DNA, 20 bp, Artificial
  CRISPR gRNA sequence
atgtgactgtgctgctctag

SEQ ID NO: 423552 - DNA, 20 bp, Artificial
  CRISPR gRNA sequence
actagagcagcacagtcaca

SEQ ID NO: 423553 - DNA, 20 bp, Artificial
  CRISPR gRNA sequence
gcacagtcacatagaaatat

SEQ ID NO: 423554 - DNA, 20 bp, Artificial
  CRISPR gRNA sequence
acagtcacatagaaatatga

SEQ ID NO: 423555 - DNA, 20 bp, Artificial
  CRISPR gRNA sequence
gagagccacatatgcaattt

SEQ ID NO: 423556 - DNA, 20 bp, Artificial
  CRISPR gRNA sequence
atatgcaattttagactttc

SEQ ID NO: 423557 - DNA, 20 bp, Artificial
  CRISPR gRNA sequence
tgcaattttagactttccag

SEQ ID NO: 423558 - DNA, 20 bp, Artificial
  CRISPR gRNA sequence
tttccagtagccacgttaaa

SEQ ID NO: 423559 - DNA, 20 bp, Artificial
  CRISPR gRNA sequence
agccacgttaaaaagataaa

SEQ ID NO: 423560 - DNA, 20 bp, Artificial
  CRISPR gRNA sequence
cacgttaaaaagataaaaag

SEQ ID NO: 423561 - DNA, 20 bp, Artificial
  CRISPR gRNA sequence
atataccaaaactactgaaa

SEQ ID NO: 423562 - DNA, 20 bp, Artificial
  CRISPR gRNA sequence
tattattcatattaaatctc

SEQ ID NO: 423563 - DNA, 20 bp, Artificial
  CRISPR gRNA sequence
catattaaatctccagaatc

SEQ ID NO: 423564 - DNA, 20 bp, Artificial
  CRISPR gRNA sequence
tatgcttataccaattataa

SEQ ID NO: 423565 - DNA, 20 bp, Artificial
  CRISPR gRNA sequence
atttaaactaaccccatctt

SEQ ID NO: 423566 - DNA, 20 bp, Artificial
  CRISPR gRNA sequence
taaactaaccccatcttaag

SEQ ID NO: 423567 - DNA, 20 bp, Artificial
  CRISPR gRNA sequence
accccatcttaagtggttga

SEQ ID NO: 423568 - DNA, 20 bp, Artificial
  CRISPR gRNA sequence
aagtggttgatggccacatg

SEQ ID NO: 423569 - DNA, 20 bp, Artificial
  CRISPR gRNA sequence
ggttgatggccacatgtgga

SEQ ID NO: 423570 - DNA, 20 bp, Artificial
  CRISPR gRNA sequence
tgatggccacatgtggaaag

SEQ ID NO: 423571 - DNA, 20 bp, Artificial
  CRISPR gRNA sequence
acatgtggaaagtggctacg

SEQ ID NO: 423572 - DNA, 20 bp, Artificial
  CRISPR gRNA sequence
tgtggaaagtggctacgtgg

SEQ ID NO: 423573 - DNA, 20 bp, Artificial
  CRISPR gRNA sequence
gaaagtggctacgtggtgga

SEQ ID NO: 423574 - DNA, 20 bp, Artificial
  CRISPR gRNA sequence
tggtggatagcgcatgtctc

SEQ ID NO: 423575 - DNA, 20 bp, Artificial
  CRISPR gRNA sequence
ggtggatagcgcatgtctcc

SEQ ID NO: 423576 - DNA, 20 bp, Artificial
  CRISPR gRNA sequence
ccaggaatccaactatgaaa

SEQ ID NO: 423577 - DNA, 20 bp, Artificial
  CRISPR gRNA sequence
aactatgaaatggtcttctc

SEQ ID NO: 423578 - DNA, 20 bp, Artificial
  CRISPR gRNA sequence
aaatggtcttctctggttct

SEQ ID NO: 423579 - DNA, 20 bp, Artificial
  CRISPR gRNA sequence
atggtcttctctggttctca

SEQ ID NO: 423580 - DNA, 20 bp, Artificial
  CRISPR gRNA sequence
tggtcttctctggttctcag

SEQ ID NO: 423581 - DNA, 20 bp, Artificial
  CRISPR gRNA sequence
gtcttctctggttctcagag

SEQ ID NO: 423582 - DNA, 20 bp, Artificial
  CRISPR gRNA sequence
ctggttctcagaggagaatc

SEQ ID NO: 423583 - DNA, 20 bp, Artificial
  CRISPR gRNA sequence
tctcagaggagaatctagtt

SEQ ID NO: 423584 - DNA, 20 bp, Artificial
  CRISPR gRNA sequence
agaggagaatctagttcagt

SEQ ID NO: 423585 - DNA, 20 bp, Artificial
  CRISPR gRNA sequence
tttcaaattgaatcccattt

SEQ ID NO: 423586 - DNA, 20 bp, Artificial
  CRISPR gRNA sequence
tgacccatttctaacatcta

SEQ ID NO: 423587 - DNA, 20 bp, Artificial
  CRISPR gRNA sequence
gacccatttctaacatctat

SEQ ID NO: 423588 - DNA, 20 bp, Artificial
  CRISPR gRNA sequence
gtattttatcaccatcccaa

SEQ ID NO: 423589 - DNA, 20 bp, Artificial
  CRISPR gRNA sequence
gttaaataacacccaactct

SEQ ID NO: 423590 - DNA, 20 bp, Artificial
  CRISPR gRNA sequence
cccttttcgtcattacattt

SEQ ID NO: 423591 - DNA, 20 bp, Artificial
  CRISPR gRNA sequence
gaattgtgttctatttccaa

SEQ ID NO: 423592 - DNA, 20 bp, Artificial
  CRISPR gRNA sequence
cagatttgcactaattttgc

SEQ ID NO: 423593 - DNA, 20 bp, Artificial
  CRISPR gRNA sequence
aaaaatgctgtaaactgcca

SEQ ID NO: 423594 - DNA, 20 bp, Artificial
  CRISPR gRNA sequence
ttcatctaatctttcttcca

SEQ ID NO: 423595 - DNA, 20 bp, Artificial
  CRISPR gRNA sequence
tcatctaatctttcttccaa

SEQ ID NO: 423596 - DNA, 20 bp, Artificial
  CRISPR gRNA sequence
aatctttcttccaaaggact

SEQ ID NO: 423597 - DNA, 20 bp, Artificial
  CRISPR gRNA sequence
tctttcttccaaaggacttg

SEQ ID NO: 423598 - DNA, 20 bp, Artificial
  CRISPR gRNA sequence
ttccaaaggacttggagctc

SEQ ID NO: 423599 - DNA, 20 bp, Artificial
  CRISPR gRNA sequence
aaaggacttggagctctgga

SEQ ID NO: 423600 - DNA, 20 bp, Artificial
  CRISPR gRNA sequence
ttggagctctggacagattt

SEQ ID NO: 423601 - DNA, 20 bp, Artificial
  CRISPR gRNA sequence
ttcttcctatgtaacccatt

SEQ ID NO: 423602 - DNA, 20 bp, Artificial
  CRISPR gRNA sequence
ttcctatgtaacccatttgg

SEQ ID NO: 423603 - DNA, 20 bp, Artificial
  CRISPR gRNA sequence
atgtaacccatttggtagaa

SEQ ID NO: 423604 - DNA, 20 bp, Artificial
  CRISPR gRNA sequence
aataataataataaaaatcc

SEQ ID NO: 423605 - DNA, 20 bp, Artificial
  CRISPR gRNA sequence
ataataataataaaaatcct

SEQ ID NO: 423606 - DNA, 20 bp, Artificial
  CRISPR gRNA sequence
aataataataaaaatcctag

SEQ ID NO: 423607 - DNA, 20 bp, Artificial
  CRISPR gRNA sequence
aataaaaatcctaggagaaa

SEQ ID NO: 423608 - DNA, 20 bp, Artificial
  CRISPR gRNA sequence
gctaaaacaattgtcaaccc

SEQ ID NO: 423609 - DNA, 20 bp, Artificial
  CRISPR gRNA sequence
acaattgtcaaccccagtct

SEQ ID NO: 423610 - DNA, 20 bp, Artificial
  CRISPR gRNA sequence
gtcaaccccagtctaagtct

SEQ ID NO: 423611 - DNA, 20 bp, Artificial
  CRISPR gRNA sequence
tcaaccccagtctaagtctt

SEQ ID NO: 423612 - DNA, 20 bp, Artificial
  CRISPR gRNA sequence
accccagtctaagtcttagg

SEQ ID NO: 423613 - DNA, 20 bp, Artificial
  CRISPR gRNA sequence
ccagtctaagtcttaggaag

SEQ ID NO: 423614 - DNA, 20 bp, Artificial
  CRISPR gRNA sequence
cagtctaagtcttaggaagc

SEQ ID NO: 423615 - DNA, 20 bp, Artificial
  CRISPR gRNA sequence
ctttatttttaaccatgcgc

SEQ ID NO: 423616 - DNA, 20 bp, Artificial
  CRISPR gRNA sequence
ccttgcttcacattctcttt

SEQ ID NO: 423617 - DNA, 20 bp, Artificial
  CRISPR gRNA sequence
cacattctctttcagttcct

SEQ ID NO: 423618 - DNA, 20 bp, Artificial
  CRISPR gRNA sequence
ttcagttccttggcccatga

SEQ ID NO: 423619 - DNA, 20 bp, Artificial
  CRISPR gRNA sequence
cttggcccatgaaagaaaat

SEQ ID NO: 423620 - DNA, 20 bp, Artificial
  CRISPR gRNA sequence
catgaaagaaaatcagtcac

SEQ ID NO: 423621 - DNA, 20 bp, Artificial
  CRISPR gRNA sequence
acctccccgctcattcctct

SEQ ID NO: 423622 - DNA, 20 bp, Artificial
  CRISPR gRNA sequence
ctccccgctcattcctctga

SEQ ID NO: 423623 - DNA, 20 bp, Artificial
  CRISPR gRNA sequence
ccccgctcattcctctgaga

SEQ ID NO: 423624 - DNA, 20 bp, Artificial
  CRISPR gRNA sequence
gctcattcctctgagagaga

SEQ ID NO: 423625 - DNA, 20 bp, Artificial
  CRISPR gRNA sequence
cattcctctgagagagatgg

SEQ ID NO: 423626 - DNA, 20 bp, Artificial
  CRISPR gRNA sequence
tcctctgagagagatggtgg

SEQ ID NO: 423627 - DNA, 20 bp, Artificial
  CRISPR gRNA sequence
cctctgagagagatggtgga

SEQ ID NO: 423628 - DNA, 20 bp, Artificial
  CRISPR gRNA sequence
gagagatggtggaaggataa

SEQ ID NO: 423629 - DNA, 20 bp, Artificial
  CRISPR gRNA sequence
tggaaggataaaagtcttct

SEQ ID NO: 423630 - DNA, 20 bp, Artificial
  CRISPR gRNA sequence
gataaaagtcttctaagatc

SEQ ID NO: 423631 - DNA, 20 bp, Artificial
  CRISPR gRNA sequence
ccagcctgaatgcaattaaa

SEQ ID NO: 423632 - DNA, 20 bp, Artificial
  CRISPR gRNA sequence
gaatgcaattaaacagaaat

SEQ ID NO: 423633 - DNA, 20 bp, Artificial
  CRISPR gRNA sequence
tgcaattaaacagaaataag

SEQ ID NO: 423634 - DNA, 20 bp, Artificial
  CRISPR gRNA sequence
ttaaacagaaataagcggtt

SEQ ID NO: 423635 - DNA, 20 bp, Artificial
  CRISPR gRNA sequence
cggttcagttaccccaaccc

SEQ ID NO: 423636 - DNA, 20 bp, Artificial
  CRISPR gRNA sequence
gttaccccaaccccagcaca

SEQ ID NO: 423637 - DNA, 20 bp, Artificial
  CRISPR gRNA sequence
caaccccagcacaaagtcgt

SEQ ID NO: 423638 - DNA, 20 bp, Artificial
  CRISPR gRNA sequence
aaccccagcacaaagtcgtc

SEQ ID NO: 423639 - DNA, 20 bp, Artificial
  CRISPR gRNA sequence
accccagcacaaagtcgtca

SEQ ID NO: 423640 - DNA, 20 bp, Artificial
  CRISPR gRNA sequence
cccagcacaaagtcgtcagg

SEQ ID NO: 423641 - DNA, 20 bp, Artificial
  CRISPR gRNA sequence
agtcgtcagggagtgaataa

SEQ ID NO: 423642 - DNA, 20 bp, Artificial
  CRISPR gRNA sequence
gtcgtcagggagtgaataaa

SEQ ID NO: 423643 - DNA, 20 bp, Artificial
  CRISPR gRNA sequence
tcgtcagggagtgaataaaa

SEQ ID NO: 423644 - DNA, 20 bp, Artificial
  CRISPR gRNA sequence
ggagtgaataaaagggttcg

SEQ ID NO: 423645 - DNA, 20 bp, Artificial
  CRISPR gRNA sequence
gtgaataaaagggttcgaag

SEQ ID NO: 423646 - DNA, 20 bp, Artificial
  CRISPR gRNA sequence
ataaaagggttcgaagaagt

SEQ ID NO: 423647 - DNA, 20 bp, Artificial
  CRISPR gRNA sequence
ggttcgaagaagttagtttg

SEQ ID NO: 423648 - DNA, 20 bp, Artificial
  CRISPR gRNA sequence
gttcgaagaagttagtttga

SEQ ID NO: 423649 - DNA, 20 bp, Artificial
  CRISPR gRNA sequence
tttaaaccctctatcactcc

SEQ ID NO: 423650 - DNA, 20 bp, Artificial
  CRISPR gRNA sequence
cccagcccccctttttcccc

SEQ ID NO: 423651 - DNA, 20 bp, Artificial
  CRISPR gRNA sequence
ccagcccccctttttcccct

SEQ ID NO: 423652 - DNA, 20 bp, Artificial
  CRISPR gRNA sequence
gcccccctttttcccctagg

SEQ ID NO: 423653 - DNA, 20 bp, Artificial
  CRISPR gRNA sequence
ccccctttttcccctaggaa

SEQ ID NO: 423654 - DNA, 20 bp, Artificial
  CRISPR gRNA sequence
aaaaatccacattttctttt

SEQ ID NO: 423655 - DNA, 20 bp, Artificial
  CRISPR gRNA sequence
aatccacattttctttttag

SEQ ID NO: 423656 - DNA, 20 bp, Artificial
  CRISPR gRNA sequence
atccacattttctttttagt

SEQ ID NO: 423657 - DNA, 20 bp, Artificial
  CRISPR gRNA sequence
tgggaaacgttcttttttca

SEQ ID NO: 423658 - DNA, 20 bp, Artificial
  CRISPR gRNA sequence
gggaaacgttcttttttcaa

SEQ ID NO: 423659 - DNA, 20 bp, Artificial
  CRISPR gRNA sequence
cgttcttttttcaaaggctc

SEQ ID NO: 423660 - DNA, 20 bp, Artificial
  CRISPR gRNA sequence
ttcttttttcaaaggctcaa

SEQ ID NO: 423661 - DNA, 20 bp, Artificial
  CRISPR gRNA sequence
ggctcaagagtgtattgatg

SEQ ID NO: 423662 - DNA, 20 bp, Artificial
  CRISPR gRNA sequence
aagagtgtattgatgcagaa

SEQ ID NO: 423663 - DNA, 20 bp, Artificial
  CRISPR gRNA sequence
agagtgtattgatgcagaaa

SEQ ID NO: 423664 - DNA, 20 bp, Artificial
  CRISPR gRNA sequence
gtgtattgatgcagaaaagg

SEQ ID NO: 423665 - DNA, 20 bp, Artificial
  CRISPR gRNA sequence
tgatgcagaaaaggtagatc

SEQ ID NO: 423666 - DNA, 20 bp, Artificial
  CRISPR gRNA sequence
gatgcagaaaaggtagatca

SEQ ID NO: 423667 - DNA, 20 bp, Artificial
  CRISPR gRNA sequence
aaggcccaaatgctacgact

SEQ ID NO: 423668 - DNA, 20 bp, Artificial
  CRISPR gRNA sequence
ctacgacttggctccctgtg

SEQ ID NO: 423669 - DNA, 20 bp, Artificial
  CRISPR gRNA sequence
tacgacttggctccctgtgt

SEQ ID NO: 423670 - DNA, 20 bp, Artificial
  CRISPR gRNA sequence
gtgtgggcatgtgcgtttcc

SEQ ID NO: 423671 - DNA, 20 bp, Artificial
  CRISPR gRNA sequence
tgtgggcatgtgcgtttcct

SEQ ID NO: 423672 - DNA, 20 bp, Artificial
  CRISPR gRNA sequence
gtgggcatgtgcgtttcctg

SEQ ID NO: 423673 - DNA, 20 bp, Artificial
  CRISPR gRNA sequence
tgcgtttcctggggcttccc

SEQ ID NO: 423674 - DNA, 20 bp, Artificial
  CRISPR gRNA sequence
tggggcttccccagcacaca

SEQ ID NO: 423675 - DNA, 20 bp, Artificial
  CRISPR gRNA sequence
gcttccccagcacacacggc

SEQ ID NO: 423676 - DNA, 20 bp, Artificial
  CRISPR gRNA sequence
tccccagcacacacggccgg

SEQ ID NO: 423677 - DNA, 20 bp, Artificial
  CRISPR gRNA sequence
cccagcacacacggccggaa

SEQ ID NO: 423678 - DNA, 20 bp, Artificial
  CRISPR gRNA sequence
ccagcacacacggccggaag

SEQ ID NO: 423679 - DNA, 20 bp, Artificial
  CRISPR gRNA sequence
cacacggccggaagaggcta

SEQ ID NO: 423680 - DNA, 20 bp, Artificial
  CRISPR gRNA sequence
acacggccggaagaggctac

SEQ ID NO: 423681 - DNA, 20 bp, Artificial
  CRISPR gRNA sequence
aagaggctacaggcctgtat

SEQ ID NO: 423682 - DNA, 20 bp, Artificial
  CRISPR gRNA sequence
agaggctacaggcctgtatc

SEQ ID NO: 423683 - DNA, 20 bp, Artificial
  CRISPR gRNA sequence
gcctgtatcaggctgtctaa

SEQ ID NO: 423684 - DNA, 20 bp, Artificial
  CRISPR gRNA sequence
tatcaggctgtctaatggat

SEQ ID NO: 423685 - DNA, 20 bp, Artificial
  CRISPR gRNA sequence
tctaatggatgagtatgtca

SEQ ID NO: 423686 - DNA, 20 bp, Artificial
  CRISPR gRNA sequence
ggatgagtatgtcacagcaa

SEQ ID NO: 423687 - DNA, 20 bp, Artificial
  CRISPR gRNA sequence
gatgagtatgtcacagcaaa

SEQ ID NO: 423688 - DNA, 20 bp, Artificial
  CRISPR gRNA sequence
ggaaacttgaaatgcctgcc

SEQ ID NO: 423689 - DNA, 20 bp, Artificial
  CRISPR gRNA sequence
aaacttgaaatgcctgccca

SEQ ID NO: 423690 - DNA, 20 bp, Artificial
  CRISPR gRNA sequence
tgcccagagaataaaatctg

SEQ ID NO: 423691 - DNA, 20 bp, Artificial
  CRISPR gRNA sequence
ctgaagtttgctgactccct

SEQ ID NO: 423692 - DNA, 20 bp, Artificial
  CRISPR gRNA sequence
tttgctgactcccttggtgc

SEQ ID NO: 423693 - DNA, 20 bp, Artificial
  CRISPR gRNA sequence
ttgctgactcccttggtgcc

SEQ ID NO: 423694 - DNA, 20 bp, Artificial
  CRISPR gRNA sequence
tgctgactcccttggtgcca

SEQ ID NO: 423695 - DNA, 20 bp, Artificial
  CRISPR gRNA sequence
tggtgccagggccttctttg

SEQ ID NO: 423696 - DNA, 20 bp, Artificial
  CRISPR gRNA sequence
ggtgccagggccttctttgt

SEQ ID NO: 423697 - DNA, 20 bp, Artificial
  CRISPR gRNA sequence
ggccttctttgtgggacttt

SEQ ID NO: 423698 - DNA, 20 bp, Artificial
  CRISPR gRNA sequence
tttgtgggactttcagctcc

SEQ ID NO: 423699 - DNA, 20 bp, Artificial
  CRISPR gRNA sequence
cagctccaagaatttcctac

SEQ ID NO: 423700 - DNA, 20 bp, Artificial
  CRISPR gRNA sequence
agaatttcctacaagttccc

SEQ ID NO: 423701 - DNA, 20 bp, Artificial
  CRISPR gRNA sequence
gacaaaactcctgctcctcc

SEQ ID NO: 423702 - DNA, 20 bp, Artificial
  CRISPR gRNA sequence
aactcctgctcctcccagac

SEQ ID NO: 423703 - DNA, 20 bp, Artificial
  CRISPR gRNA sequence
gactagcctcaacatcccct

SEQ ID NO: 423704 - DNA, 20 bp, Artificial
  CRISPR gRNA sequence
caacatccccttggtgctcc

SEQ ID NO: 423705 - DNA, 20 bp, Artificial
  CRISPR gRNA sequence
aacatccccttggtgctccc

SEQ ID NO: 423706 - DNA, 20 bp, Artificial
  CRISPR gRNA sequence
gctcccaggccacttcatca

SEQ ID NO: 423707 - DNA, 20 bp, Artificial
  CRISPR gRNA sequence
caggccacttcatcacagat

SEQ ID NO: 423708 - DNA, 20 bp, Artificial
  CRISPR gRNA sequence
caaactgtcgtctcttcctg

SEQ ID NO: 423709 - DNA, 20 bp, Artificial
  CRISPR gRNA sequence
aaactgtcgtctcttcctga

SEQ ID NO: 423710 - DNA, 20 bp, Artificial
  CRISPR gRNA sequence
ttgtctccccatttaactgt

SEQ ID NO: 423711 - DNA, 20 bp, Artificial
  CRISPR gRNA sequence
ccatttaactgtaagttctt

SEQ ID NO: 423712 - DNA, 20 bp, Artificial
  CRISPR gRNA sequence
catttaactgtaagttcttg

SEQ ID NO: 423713 - DNA, 20 bp, Artificial
  CRISPR gRNA sequence
atttaactgtaagttcttga

SEQ ID NO: 423714 - DNA, 20 bp, Artificial
  CRISPR gRNA sequence
taactgtaagttcttgaggg

SEQ ID NO: 423715 - DNA, 20 bp, Artificial
  CRISPR gRNA sequence
agttcttgagggcagatacc

SEQ ID NO: 423716 - DNA, 20 bp, Artificial
  CRISPR gRNA sequence
tgagggcagataccaagatt

SEQ ID NO: 423717 - DNA, 20 bp, Artificial
  CRISPR gRNA sequence
gtcactctcaaatctcccca

SEQ ID NO: 423718 - DNA, 20 bp, Artificial
  CRISPR gRNA sequence
cactctcaaatctccccata

SEQ ID NO: 423719 - DNA, 20 bp, Artificial
  CRISPR gRNA sequence
actctcaaatctccccatag

SEQ ID NO: 423720 - DNA, 20 bp, Artificial
  CRISPR gRNA sequence
ctccccatagaggctgctac

SEQ ID NO: 423721 - DNA, 20 bp, Artificial
  CRISPR gRNA sequence
tccccatagaggctgctacc

SEQ ID NO: 423722 - DNA, 20 bp, Artificial
  CRISPR gRNA sequence
cttataacctgcctttgaat

SEQ ID NO: 423723 - DNA, 20 bp, Artificial
  CRISPR gRNA sequence
acctgcctttgaatgagtga

SEQ ID NO: 423724 - DNA, 20 bp, Artificial
  CRISPR gRNA sequence
tgaaaatgacgtgaaaaaat

SEQ ID NO: 423725 - DNA, 20 bp, Artificial
  CRISPR gRNA sequence
atgacgtgaaaaaatgagat

SEQ ID NO: 423726 - DNA, 20 bp, Artificial
  CRISPR gRNA sequence
tgacgtgaaaaaatgagatg

SEQ ID NO: 423727 - DNA, 20 bp, Artificial
  CRISPR gRNA sequence
gtgaaaaaatgagatgagga

SEQ ID NO: 423728 - DNA, 20 bp, Artificial
  CRISPR gRNA sequence
atgagatgaggatggctctg

SEQ ID NO: 423729 - DNA, 20 bp, Artificial
  CRISPR gRNA sequence
tcatcaaccacaaaaccttg

SEQ ID NO: 423730 - DNA, 20 bp, Artificial
  CRISPR gRNA sequence
aaccttgtagcccaaaatgc

SEQ ID NO: 423731 - DNA, 20 bp, Artificial
  CRISPR gRNA sequence
cccaaaatgctggccattat

SEQ ID NO: 423732 - DNA, 20 bp, Artificial
  CRISPR gRNA sequence
ccaaaatgctggccattatg

SEQ ID NO: 423733 - DNA, 20 bp, Artificial
  CRISPR gRNA sequence
attatgaggaatgtgtctct

SEQ ID NO: 423734 - DNA, 20 bp, Artificial
  CRISPR gRNA sequence
tatgaggaatgtgtctctca

SEQ ID NO: 423735 - DNA, 20 bp, Artificial
  CRISPR gRNA sequence
gaatgtgtctctcagagaca

SEQ ID NO: 423736 - DNA, 20 bp, Artificial
  CRISPR gRNA sequence
aatgtgtctctcagagacat

SEQ ID NO: 423737 - DNA, 20 bp, Artificial
  CRISPR gRNA sequence
ataggatctgctcaaactgc

SEQ ID NO: 423738 - DNA, 20 bp, Artificial
  CRISPR gRNA sequence
caaactgccagatttaaaac

SEQ ID NO: 423739 - DNA, 20 bp, Artificial
  CRISPR gRNA sequence
aaactgccagatttaaaacc

SEQ ID NO: 423740 - DNA, 20 bp, Artificial
  CRISPR gRNA sequence
gccagatttaaaaccaggtc

SEQ ID NO: 423741 - DNA, 20 bp, Artificial
  CRISPR gRNA sequence
ttaattttgcatttatgatc

SEQ ID NO: 423742 - DNA, 20 bp, Artificial
  CRISPR gRNA sequence
aagatccacgttactcaccc

SEQ ID NO: 423743 - DNA, 20 bp, Artificial
  CRISPR gRNA sequence
agatccacgttactcaccct

SEQ ID NO: 423744 - DNA, 20 bp, Artificial
  CRISPR gRNA sequence
aggcctgccataatgcaaaa

SEQ ID NO: 423745 - DNA, 20 bp, Artificial
  CRISPR gRNA sequence
tgccataatgcaaaatggaa

SEQ ID NO: 423746 - DNA, 20 bp, Artificial
  CRISPR gRNA sequence
gcaaaatggaatagaacgaa

SEQ ID NO: 423747 - DNA, 20 bp, Artificial
  CRISPR gRNA sequence
caaaatggaatagaacgaaa

SEQ ID NO: 423748 - DNA, 20 bp, Artificial
  CRISPR gRNA sequence
tggaatagaacgaaaaggcc

SEQ ID NO: 423749 - DNA, 20 bp, Artificial
  CRISPR gRNA sequence
ggaatagaacgaaaaggcca

SEQ ID NO: 423750 - DNA, 20 bp, Artificial
  CRISPR gRNA sequence
acgaaaaggccaaggaaatg

SEQ ID NO: 423751 - DNA, 20 bp, Artificial
  CRISPR gRNA sequence
aaaggccaaggaaatgaaga

SEQ ID NO: 423752 - DNA, 20 bp, Artificial
  CRISPR gRNA sequence
aggccaaggaaatgaagatg

SEQ ID NO: 423753 - DNA, 20 bp, Artificial
  CRISPR gRNA sequence
ccaaggaaatgaagatggag

SEQ ID NO: 423754 - DNA, 20 bp, Artificial
  CRISPR gRNA sequence
aaggaaatgaagatggagaa

SEQ ID NO: 423755 - DNA, 20 bp, Artificial
  CRISPR gRNA sequence
aggaaatgaagatggagaag

SEQ ID NO: 423756 - DNA, 20 bp, Artificial
  CRISPR gRNA sequence
tacacacacacacacacacg

SEQ ID NO: 423757 - DNA, 20 bp, Artificial
  CRISPR gRNA sequence
acacacacacgcagcactga

SEQ ID NO: 423758 - DNA, 20 bp, Artificial
  CRISPR gRNA sequence
acacacacgcagcactgatg

SEQ ID NO: 423759 - DNA, 20 bp, Artificial
  CRISPR gRNA sequence
acacacgcagcactgatgga

SEQ ID NO: 423760 - DNA, 20 bp, Artificial
  CRISPR gRNA sequence
cgcagcactgatggagagta

SEQ ID NO: 423761 - DNA, 20 bp, Artificial
  CRISPR gRNA sequence
gcttatatattcatctataa

SEQ ID NO: 423762 - DNA, 20 bp, Artificial
  CRISPR gRNA sequence
tatattcatctataatagca

SEQ ID NO: 423763 - DNA, 20 bp, Artificial
  CRISPR gRNA sequence
atctataatagcaaagacaa

SEQ ID NO: 423764 - DNA, 20 bp, Artificial
  CRISPR gRNA sequence
aaagacaaaagtgtatcttc

SEQ ID NO: 423765 - DNA, 20 bp, Artificial
  CRISPR gRNA sequence
gacaaaagtgtatcttccag

SEQ ID NO: 423766 - DNA, 20 bp, Artificial
  CRISPR gRNA sequence
tatcttccagaagatgcctc

SEQ ID NO: 423767 - DNA, 20 bp, Artificial
  CRISPR gRNA sequence
agatgcctctggttgctaac

SEQ ID NO: 423768 - DNA, 20 bp, Artificial
  CRISPR gRNA sequence
gttgctaaccagtctctgtg

SEQ ID NO: 423769 - DNA, 20 bp, Artificial
  CRISPR gRNA sequence
gctaaccagtctctgtgaag

SEQ ID NO: 423770 - DNA, 20 bp, Artificial
  CRISPR gRNA sequence
cagtctctgtgaagaagctg

SEQ ID NO: 423771 - DNA, 20 bp, Artificial
  CRISPR gRNA sequence
gtgaagaagctgcagttacc

SEQ ID NO: 423772 - DNA, 20 bp, Artificial
  CRISPR gRNA sequence
tgaagaagctgcagttaccc

SEQ ID NO: 423773 - DNA, 20 bp, Artificial
  CRISPR gRNA sequence
ttacccaggcttctgtaact

SEQ ID NO: 423774 - DNA, 20 bp, Artificial
  CRISPR gRNA sequence
tacccaggcttctgtaactc

SEQ ID NO: 423775 - DNA, 20 bp, Artificial
  CRISPR gRNA sequence
ttctgtaactcaggacattg

SEQ ID NO: 423776 - DNA, 20 bp, Artificial
  CRISPR gRNA sequence
tgtaactcaggacattgaag

SEQ ID NO: 423777 - DNA, 20 bp, Artificial
  CRISPR gRNA sequence
aggacattgaagtagtcatg

SEQ ID NO: 423778 - DNA, 20 bp, Artificial
  CRISPR gRNA sequence
attgaagtagtcatgcagct

SEQ ID NO: 423779 - DNA, 20 bp, Artificial
  CRISPR gRNA sequence
agtagtcatgcagctcggca

SEQ ID NO: 423780 - DNA, 20 bp, Artificial
  CRISPR gRNA sequence
cctctccccgctgctctcca

SEQ ID NO: 423781 - DNA, 20 bp, Artificial
  CRISPR gRNA sequence
tctccccgctgctctccaca

SEQ ID NO: 423782 - DNA, 20 bp, Artificial
  CRISPR gRNA sequence
ccgctgctctccacagagcc

SEQ ID NO: 423783 - DNA, 20 bp, Artificial
  CRISPR gRNA sequence
ctgctctccacagagcccag

SEQ ID NO: 423784 - DNA, 20 bp, Artificial
  CRISPR gRNA sequence
tgctctccacagagcccagc

SEQ ID NO: 423785 - DNA, 20 bp, Artificial
  CRISPR gRNA sequence
tccacagagcccagcaggtg

SEQ ID NO: 423786 - DNA, 20 bp, Artificial
  CRISPR gRNA sequence
cagcaggtgcagcttctgcc

SEQ ID NO: 423787 - DNA, 20 bp, Artificial
  CRISPR gRNA sequence
gtgcagcttctgcctggaca

SEQ ID NO: 423788 - DNA, 20 bp, Artificial
  CRISPR gRNA sequence
tctgcctggacacagcttcc

SEQ ID NO: 423789 - DNA, 20 bp, Artificial
  CRISPR gRNA sequence
ctgcctggacacagcttcct

SEQ ID NO: 423790 - DNA, 20 bp, Artificial
  CRISPR gRNA sequence
tgcctggacacagcttcctg

SEQ ID NO: 423791 - DNA, 20 bp, Artificial
  CRISPR gRNA sequence
gcctggacacagcttcctgg

SEQ ID NO: 423792 - DNA, 20 bp, Artificial
  CRISPR gRNA sequence
ggacacagcttcctgggggt

SEQ ID NO: 423793 - DNA, 20 bp, Artificial
  CRISPR gRNA sequence
gacacagcttcctgggggtg

SEQ ID NO: 423794 - DNA, 20 bp, Artificial
  CRISPR gRNA sequence
acacagcttcctgggggtga

SEQ ID NO: 423795 - DNA, 20 bp, Artificial
  CRISPR gRNA sequence
acagcttcctgggggtgagg

SEQ ID NO: 423796 - DNA, 20 bp, Artificial
  CRISPR gRNA sequence
tcctgggggtgagggagcac

SEQ ID NO: 423797 - DNA, 20 bp, Artificial
  CRISPR gRNA sequence
cctgggggtgagggagcact

SEQ ID NO: 423798 - DNA, 20 bp, Artificial
  CRISPR gRNA sequence
ctgggggtgagggagcactg

SEQ ID NO: 423799 - DNA, 20 bp, Artificial
  CRISPR gRNA sequence
ggggctccattcctcctgtc

SEQ ID NO: 423800 - DNA, 20 bp, Artificial
  CRISPR gRNA sequence
tgtccagctgattttctcct

SEQ ID NO: 423801 - DNA, 20 bp, Artificial
  CRISPR gRNA sequence
gtccagctgattttctcctg

SEQ ID NO: 423802 - DNA, 20 bp, Artificial
  CRISPR gRNA sequence
tctcctgaggtcaccttcca

SEQ ID NO: 423803 - DNA, 20 bp, Artificial
  CRISPR gRNA sequence
tgaggtcaccttccacagaa

SEQ ID NO: 423804 - DNA, 20 bp, Artificial
  CRISPR gRNA sequence
ccttccacagaatggattct

SEQ ID NO: 423805 - DNA, 20 bp, Artificial
  CRISPR gRNA sequence
cttccacagaatggattctg

SEQ ID NO: 423806 - DNA, 20 bp, Artificial
  CRISPR gRNA sequence
ttccacagaatggattctga

SEQ ID NO: 423807 - DNA, 20 bp, Artificial
  CRISPR gRNA sequence
ctaaaaacaaacaaactaca

SEQ ID NO: 423808 - DNA, 20 bp, Artificial
  CRISPR gRNA sequence
aaacaaacaaactacaaagt

SEQ ID NO: 423809 - DNA, 20 bp, Artificial
  CRISPR gRNA sequence
caaactacaaagtgagtatg

SEQ ID NO: 423810 - DNA, 20 bp, Artificial
  CRISPR gRNA sequence
aaactacaaagtgagtatgt

SEQ ID NO: 423811 - DNA, 20 bp, Artificial
  CRISPR gRNA sequence
aactacaaagtgagtatgtg

SEQ ID NO: 423812 - DNA, 20 bp, Artificial
  CRISPR gRNA sequence
tatgtggggatgttattcaa

SEQ ID NO: 423813 - DNA, 20 bp, Artificial
  CRISPR gRNA sequence
tttcttacacacatgcacac

SEQ ID NO: 423814 - DNA, 20 bp, Artificial
  CRISPR gRNA sequence
tcttaccaacaccaattcct

SEQ ID NO: 423815 - DNA, 20 bp, Artificial
  CRISPR gRNA sequence
ttaatttctcaaccgcgtta

SEQ ID NO: 423816 - DNA, 20 bp, Artificial
  CRISPR gRNA sequence
tttctcaaccgcgttacagc

SEQ ID NO: 423817 - DNA, 20 bp, Artificial
  CRISPR gRNA sequence
agctagatttaaatgctaac

SEQ ID NO: 423818 - DNA, 20 bp, Artificial
  CRISPR gRNA sequence
tttaaatgctaactagtcca

SEQ ID NO: 423819 - DNA, 20 bp, Artificial
  CRISPR gRNA sequence
cttgttacttcctgttcact

SEQ ID NO: 423820 - DNA, 20 bp, Artificial
  CRISPR gRNA sequence
tacttcctgttcactaagct

SEQ ID NO: 423821 - DNA, 20 bp, Artificial
  CRISPR gRNA sequence
tcctgttcactaagcttagt

SEQ ID NO: 423822 - DNA, 20 bp, Artificial
  CRISPR gRNA sequence
cctgttcactaagcttagtg

SEQ ID NO: 423823 - DNA, 20 bp, Artificial
  CRISPR gRNA sequence
gttcactaagcttagtgagg

SEQ ID NO: 423824 - DNA, 20 bp, Artificial
  CRISPR gRNA sequence
tctgaaatgttctctttctc

SEQ ID NO: 423825 - DNA, 20 bp, Artificial
  CRISPR gRNA sequence
ttctctttctctggatcctt

SEQ ID NO: 423826 - DNA, 20 bp, Artificial
  CRISPR gRNA sequence
tgaacccccaccttcgtctt

SEQ ID NO: 423827 - DNA, 20 bp, Artificial
  CRISPR gRNA sequence
cccccaccttcgtcttcagc

SEQ ID NO: 423828 - DNA, 20 bp, Artificial
  CRISPR gRNA sequence
ccccaccttcgtcttcagcc

SEQ ID NO: 423829 - DNA, 20 bp, Artificial
  CRISPR gRNA sequence
ccccttttctctttgcacat

SEQ ID NO: 423830 - DNA, 20 bp, Artificial
  CRISPR gRNA sequence
cacatcagctccccaaaccg

SEQ ID NO: 423831 - DNA, 20 bp, Artificial
  CRISPR gRNA sequence
acatcagctccccaaaccgt

SEQ ID NO: 423832 - DNA, 20 bp, Artificial
  CRISPR gRNA sequence
catcagctccccaaaccgtg

SEQ ID NO: 423833 - DNA, 20 bp, Artificial
  CRISPR gRNA sequence
ccccaaaccgtggggttccc

SEQ ID NO: 423834 - DNA, 20 bp, Artificial
  CRISPR gRNA sequence
cccaaaccgtggggttcccc

SEQ ID NO: 423835 - DNA, 20 bp, Artificial
  CRISPR gRNA sequence
ccaaaccgtggggttcccca

SEQ ID NO: 423836 - DNA, 20 bp, Artificial
  CRISPR gRNA sequence
tcacgctaaacatgctctct

SEQ ID NO: 423837 - DNA, 20 bp, Artificial
  CRISPR gRNA sequence
tgctctctgagtgatttcat

SEQ ID NO: 423838 - DNA, 20 bp, Artificial
  CRISPR gRNA sequence
caaccaccatctgtcctctg

SEQ ID NO: 423839 - DNA, 20 bp, Artificial
  CRISPR gRNA sequence
gcccaaatctctatctaaac

SEQ ID NO: 423840 - DNA, 20 bp, Artificial
  CRISPR gRNA sequence
aatctctatctaaactagcc

SEQ ID NO: 423841 - DNA, 20 bp, Artificial
  CRISPR gRNA sequence
atctctatctaaactagccc

SEQ ID NO: 423842 - DNA, 20 bp, Artificial
  CRISPR gRNA sequence
ctagcccaggcttctgccct

SEQ ID NO: 423843 - DNA, 20 bp, Artificial
  CRISPR gRNA sequence
caggcttctgccctgagctc

SEQ ID NO: 423844 - DNA, 20 bp, Artificial
  CRISPR gRNA sequence
tctgccctgagctccagatg

SEQ ID NO: 423845 - DNA, 20 bp, Artificial
  CRISPR gRNA sequence
ctgccctgagctccagatgc

SEQ ID NO: 423846 - DNA, 20 bp, Artificial
  CRISPR gRNA sequence
gcaggtgtccacctgtccac

SEQ ID NO: 423847 - DNA, 20 bp, Artificial
  CRISPR gRNA sequence
caggtgtccacctgtccact

SEQ ID NO: 423848 - DNA, 20 bp, Artificial
  CRISPR gRNA sequence
catcatcacctgatgaccca

SEQ ID NO: 423849 - DNA, 20 bp, Artificial
  CRISPR gRNA sequence
atcacctgatgacccacggc

SEQ ID NO: 423850 - DNA, 20 bp, Artificial
  CRISPR gRNA sequence
ctgatgacccacggcaagct

SEQ ID NO: 423851 - DNA, 20 bp, Artificial
  CRISPR gRNA sequence
tgcccctatattcactgccc

SEQ ID NO: 423852 - DNA, 20 bp, Artificial
  CRISPR gRNA sequence
atattcactgccctggttta

SEQ ID NO: 423853 - DNA, 20 bp, Artificial
  CRISPR gRNA sequence
actgccctggtttatggcac

SEQ ID NO: 423854 - DNA, 20 bp, Artificial
  CRISPR gRNA sequence
cctggtttatggcaccagct

SEQ ID NO: 423855 - DNA, 20 bp, Artificial
  CRISPR gRNA sequence
ggtttatggcaccagctgag

SEQ ID NO: 423856 - DNA, 20 bp, Artificial
  CRISPR gRNA sequence
gcaccagctgagcagaaatc

SEQ ID NO: 423857 - DNA, 20 bp, Artificial
  CRISPR gRNA sequence
accagctgagcagaaatctg

SEQ ID NO: 423858 - DNA, 20 bp, Artificial
  CRISPR gRNA sequence
ccagctgagcagaaatctgg

SEQ ID NO: 423859 - DNA, 20 bp, Artificial
  CRISPR gRNA sequence
acttcatccaattttaatcc

SEQ ID NO: 423860 - DNA, 20 bp, Artificial
  CRISPR gRNA sequence
cttcatccaattttaatcct

SEQ ID NO: 423861 - DNA, 20 bp, Artificial
  CRISPR gRNA sequence
catccaattttaatcctagg

SEQ ID NO: 423862 - DNA, 20 bp, Artificial
  CRISPR gRNA sequence
tccatgtcttctctcacacc

SEQ ID NO: 423863 - DNA, 20 bp, Artificial
  CRISPR gRNA sequence
ccatgtcttctctcacacct

SEQ ID NO: 423864 - DNA, 20 bp, Artificial
  CRISPR gRNA sequence
ggcttcatcctcactgtctc

SEQ ID NO: 423865 - DNA, 20 bp, Artificial
  CRISPR gRNA sequence
tctggactccctcttacttc

SEQ ID NO: 423866 - DNA, 20 bp, Artificial
  CRISPR gRNA sequence
acttctagtccaactccaca

SEQ ID NO: 423867 - DNA, 20 bp, Artificial
  CRISPR gRNA sequence
gtccaactccacatggtcgc

SEQ ID NO: 423868 - DNA, 20 bp, Artificial
  CRISPR gRNA sequence
caactccacatggtcgccag

SEQ ID NO: 423869 - DNA, 20 bp, Artificial
  CRISPR gRNA sequence
actccacatggtcgccagca

SEQ ID NO: 423870 - DNA, 20 bp, Artificial
  CRISPR gRNA sequence
agagtgattttcaaaaacaa

SEQ ID NO: 423871 - DNA, 20 bp, Artificial
  CRISPR gRNA sequence
ttcaaaaacaaaagttgtgt

SEQ ID NO: 423872 - DNA, 20 bp, Artificial
  CRISPR gRNA sequence
ttctgcctaaaactcttcaa

SEQ ID NO: 423873 - DNA, 20 bp, Artificial
  CRISPR gRNA sequence
ttcaatggctccactgtata

SEQ ID NO: 423874 - DNA, 20 bp, Artificial
  CRISPR gRNA sequence
tcaatggctccactgtatat

SEQ ID NO: 423875 - DNA, 20 bp, Artificial
  CRISPR gRNA sequence
aatggctccactgtatatag

SEQ ID NO: 423876 - DNA, 20 bp, Artificial
  CRISPR gRNA sequence
atggctccactgtatatagg

SEQ ID NO: 423877 - DNA, 20 bp, Artificial
  CRISPR gRNA sequence
tggctccactgtatatagga

SEQ ID NO: 423878 - DNA, 20 bp, Artificial
  CRISPR gRNA sequence
tataggagggtgcttaacct

SEQ ID NO: 423879 - DNA, 20 bp, Artificial
  CRISPR gRNA sequence
ggtgcttaacctgagatgca

SEQ ID NO: 423880 - DNA, 20 bp, Artificial
  CRISPR gRNA sequence
cttaacctgagatgcacagc

SEQ ID NO: 423881 - DNA, 20 bp, Artificial
  CRISPR gRNA sequence
tgagatgcacagctggattt

SEQ ID NO: 423882 - DNA, 20 bp, Artificial
  CRISPR gRNA sequence
gagatgcacagctggatttc

SEQ ID NO: 423883 - DNA, 20 bp, Artificial
  CRISPR gRNA sequence
agatgcacagctggatttca

SEQ ID NO: 423884 - DNA, 20 bp, Artificial
  CRISPR gRNA sequence
gatgcacagctggatttcag

SEQ ID NO: 423885 - DNA, 20 bp, Artificial
  CRISPR gRNA sequence
caggggatttgtaaattgta

SEQ ID NO: 423886 - DNA, 20 bp, Artificial
  CRISPR gRNA sequence
ttgtatagaaaattttgccc

SEQ ID NO: 423887 - DNA, 20 bp, Artificial
  CRISPR gRNA sequence
tatagaaaattttgcccaag

SEQ ID NO: 423888 - DNA, 20 bp, Artificial
  CRISPR gRNA sequence
aatttcactacattcctcat

SEQ ID NO: 423889 - DNA, 20 bp, Artificial
  CRISPR gRNA sequence
cccaaaaacatcccttgtga

SEQ ID NO: 423890 - DNA, 20 bp, Artificial
  CRISPR gRNA sequence
gatggtcccactcacctttc

SEQ ID NO: 423891 - DNA, 20 bp, Artificial
  CRISPR gRNA sequence
cacctttccagcttacatgc

SEQ ID NO: 423892 - DNA, 20 bp, Artificial
  CRISPR gRNA sequence
acctttccagcttacatgct

SEQ ID NO: 423893 - DNA, 20 bp, Artificial
  CRISPR gRNA sequence
tacatgctaggaaaaatgct

SEQ ID NO: 423894 - DNA, 20 bp, Artificial
  CRISPR gRNA sequence
cattaattattatttgactg

SEQ ID NO: 423895 - DNA, 20 bp, Artificial
  CRISPR gRNA sequence
agttttctcatgaccttatg

SEQ ID NO: 423896 - DNA, 20 bp, Artificial
  CRISPR gRNA sequence
gttttctcatgaccttatga

SEQ ID NO: 423897 - DNA, 20 bp, Artificial
  CRISPR gRNA sequence
gaaggcaatgccataattat

SEQ ID NO: 423898 - DNA, 20 bp, Artificial
  CRISPR gRNA sequence
ccataattatcggcatttta

SEQ ID NO: 423899 - DNA, 20 bp, Artificial
  CRISPR gRNA sequence
attatcggcattttacagat

SEQ ID NO: 423900 - DNA, 20 bp, Artificial
  CRISPR gRNA sequence
attttacagatgagaaaact

SEQ ID NO: 423901 - DNA, 20 bp, Artificial
  CRISPR gRNA sequence
ttttacagatgagaaaactg

SEQ ID NO: 423902 - DNA, 20 bp, Artificial
  CRISPR gRNA sequence
gagaaaactgaggttcatca

SEQ ID NO: 423903 - DNA, 20 bp, Artificial
  CRISPR gRNA sequence
aaactgaggttcatcaaagt

SEQ ID NO: 423904 - DNA, 20 bp, Artificial
  CRISPR gRNA sequence
aactgaggttcatcaaagtt

SEQ ID NO: 423905 - DNA, 20 bp, Artificial
  CRISPR gRNA sequence
tgaggttcatcaaagttagg

SEQ ID NO: 423906 - DNA, 20 bp, Artificial
  CRISPR gRNA sequence
ttcatcaaagttaggtggta

SEQ ID NO: 423907 - DNA, 20 bp, Artificial
  CRISPR gRNA sequence
gttaggtggtacagctactc

SEQ ID NO: 423908 - DNA, 20 bp, Artificial
  CRISPR gRNA sequence
aggtggtacagctactcaag

SEQ ID NO: 423909 - DNA, 20 bp, Artificial
  CRISPR gRNA sequence
gtacagctactcaagtggtt

SEQ ID NO: 423910 - DNA, 20 bp, Artificial
  CRISPR gRNA sequence
agctactcaagtggttgagt

SEQ ID NO: 423911 - DNA, 20 bp, Artificial
  CRISPR gRNA sequence
gctactcaagtggttgagtt

SEQ ID NO: 423912 - DNA, 20 bp, Artificial
  CRISPR gRNA sequence
gttgagttgggacccaaacc

SEQ ID NO: 423913 - DNA, 20 bp, Artificial
  CRISPR gRNA sequence
ttgagttgggacccaaacct

SEQ ID NO: 423914 - DNA, 20 bp, Artificial
  CRISPR gRNA sequence
cctaggactgtctgattcca

SEQ ID NO: 423915 - DNA, 20 bp, Artificial
  CRISPR gRNA sequence
gaacatgctcctaaataaca

SEQ ID NO: 423916 - DNA, 20 bp, Artificial
  CRISPR gRNA sequence
ctcctaaataacacagtcta

SEQ ID NO: 423917 - DNA, 20 bp, Artificial
  CRISPR gRNA sequence
tcctaaataacacagtctat

SEQ ID NO: 423918 - DNA, 20 bp, Artificial
  CRISPR gRNA sequence
aacacagtctatgggctctc

SEQ ID NO: 423919 - DNA, 20 bp, Artificial
  CRISPR gRNA sequence
acacagtctatgggctctca

SEQ ID NO: 423920 - DNA, 20 bp, Artificial
  CRISPR gRNA sequence
ctatgggctctcaaggtctg

SEQ ID NO: 423921 - DNA, 20 bp, Artificial
  CRISPR gRNA sequence
gaatgctgttgtgcctgtca

SEQ ID NO: 423922 - DNA, 20 bp, Artificial
  CRISPR gRNA sequence
gtgcctgtcatagctaattt

SEQ ID NO: 423923 - DNA, 20 bp, Artificial
  CRISPR gRNA sequence
tgcctgtcatagctaatttt

SEQ ID NO: 423924 - DNA, 20 bp, Artificial
  CRISPR gRNA sequence
attttaggtatcatcttaac

SEQ ID NO: 423925 - DNA, 20 bp, Artificial
  CRISPR gRNA sequence
ggtatcatcttaactggatt

SEQ ID NO: 423926 - DNA, 20 bp, Artificial
  CRISPR gRNA sequence
gtatcatcttaactggatta

SEQ ID NO: 423927 - DNA, 20 bp, Artificial
  CRISPR gRNA sequence
tatcatcttaactggattaa

SEQ ID NO: 423928 - DNA, 20 bp, Artificial
  CRISPR gRNA sequence
tcatcttaactggattaagg

SEQ ID NO: 423929 - DNA, 20 bp, Artificial
  CRISPR gRNA sequence
ttaactggattaagggagct

SEQ ID NO: 423930 - DNA, 20 bp, Artificial
  CRISPR gRNA sequence
aactggattaagggagctga

SEQ ID NO: 423931 - DNA, 20 bp, Artificial
  CRISPR gRNA sequence
ctggattaagggagctgaga

SEQ ID NO: 423932 - DNA, 20 bp, Artificial
  CRISPR gRNA sequence
attaagggagctgagagagc

SEQ ID NO: 423933 - DNA, 20 bp, Artificial
  CRISPR gRNA sequence
gggagctgagagagctagta

SEQ ID NO: 423934 - DNA, 20 bp, Artificial
  CRISPR gRNA sequence
agagctagtaaagcccattt

SEQ ID NO: 423935 - DNA, 20 bp, Artificial
  CRISPR gRNA sequence
gagctagtaaagcccatttt

SEQ ID NO: 423936 - DNA, 20 bp, Artificial
  CRISPR gRNA sequence
cccattttgggtgtgtctgt

SEQ ID NO: 423937 - DNA, 20 bp, Artificial
  CRISPR gRNA sequence
ccattttgggtgtgtctgtg

SEQ ID NO: 423938 - DNA, 20 bp, Artificial
  CRISPR gRNA sequence
cattttgggtgtgtctgtga

SEQ ID NO: 423939 - DNA, 20 bp, Artificial
  CRISPR gRNA sequence
tgtctgtgagggtgtttcca

SEQ ID NO: 423940 - DNA, 20 bp, Artificial
  CRISPR gRNA sequence
gtctgtgagggtgtttccaa

SEQ ID NO: 423941 - DNA, 20 bp, Artificial
  CRISPR gRNA sequence
ctgtgagggtgtttccaaag

SEQ ID NO: 423942 - DNA, 20 bp, Artificial
  CRISPR gRNA sequence
agggtgtttccaaaggagat

SEQ ID NO: 423943 - DNA, 20 bp, Artificial
  CRISPR gRNA sequence
tccaaaggagattggcatgt

SEQ ID NO: 423944 - DNA, 20 bp, Artificial
  CRISPR gRNA sequence
ggagattggcatgtcagtct

SEQ ID NO: 423945 - DNA, 20 bp, Artificial
  CRISPR gRNA sequence
ttggcatgtcagtctgagtg

SEQ ID NO: 423946 - DNA, 20 bp, Artificial
  CRISPR gRNA sequence
catgtcagtctgagtgaagt

SEQ ID NO: 423947 - DNA, 20 bp, Artificial
  CRISPR gRNA sequence
gtcagtctgagtgaagtgag

SEQ ID NO: 423948 - DNA, 20 bp, Artificial
  CRISPR gRNA sequence
tcagtctgagtgaagtgagt

SEQ ID NO: 423949 - DNA, 20 bp, Artificial
  CRISPR gRNA sequence
tctgagtgaagtgagtaggt

SEQ ID NO: 423950 - DNA, 20 bp, Artificial
  CRISPR gRNA sequence
ggtaagatacactctaaatg

SEQ ID NO: 423951 - DNA, 20 bp, Artificial
  CRISPR gRNA sequence
gatacactctaaatgtagcc

SEQ ID NO: 423952 - DNA, 20 bp, Artificial
  CRISPR gRNA sequence
ccaagcaccatccactcacc

SEQ ID NO: 423953 - DNA, 20 bp, Artificial
  CRISPR gRNA sequence
aagcaccatccactcacctg

SEQ ID NO: 423954 - DNA, 20 bp, Artificial
  CRISPR gRNA sequence
agcaccatccactcacctgg

SEQ ID NO: 423955 - DNA, 20 bp, Artificial
  CRISPR gRNA sequence
gaggcctgcctttcccaaaa

SEQ ID NO: 423956 - DNA, 20 bp, Artificial
  CRISPR gRNA sequence
gcctgcctttcccaaaacag

SEQ ID NO: 423957 - DNA, 20 bp, Artificial
  CRISPR gRNA sequence
ctgcctttcccaaaacagaa

SEQ ID NO: 423958 - DNA, 20 bp, Artificial
  CRISPR gRNA sequence
gcctttcccaaaacagaaga

SEQ ID NO: 423959 - DNA, 20 bp, Artificial
  CRISPR gRNA sequence
cctttcccaaaacagaagag

SEQ ID NO: 423960 - DNA, 20 bp, Artificial
  CRISPR gRNA sequence
aaaattgtactttctctctt

SEQ ID NO: 423961 - DNA, 20 bp, Artificial
  CRISPR gRNA sequence
aattgtactttctctctttg

SEQ ID NO: 423962 - DNA, 20 bp, Artificial
  CRISPR gRNA sequence
gtactttctctctttggagt

SEQ ID NO: 423963 - DNA, 20 bp, Artificial
  CRISPR gRNA sequence
tactttctctctttggagtt

SEQ ID NO: 423964 - DNA, 20 bp, Artificial
  CRISPR gRNA sequence
cactcttctcatcctgtcct

SEQ ID NO: 423965 - DNA, 20 bp, Artificial
  CRISPR gRNA sequence
ctcatcctgtccttggacat

SEQ ID NO: 423966 - DNA, 20 bp, Artificial
  CRISPR gRNA sequence
tcatcctgtccttggacatc

SEQ ID NO: 423967 - DNA, 20 bp, Artificial
  CRISPR gRNA sequence
gtccttggacatcaggacac

SEQ ID NO: 423968 - DNA, 20 bp, Artificial
  CRISPR gRNA sequence
tccttggacatcaggacacc

SEQ ID NO: 423969 - DNA, 20 bp, Artificial
  CRISPR gRNA sequence
catcaggacaccaggctccc

SEQ ID NO: 423970 - DNA, 20 bp, Artificial
  CRISPR gRNA sequence
acaccaggctccctggcttt

SEQ ID NO: 423971 - DNA, 20 bp, Artificial
  CRISPR gRNA sequence
gctccctggctttcggactc

SEQ ID NO: 423972 - DNA, 20 bp, Artificial
  CRISPR gRNA sequence
ctccctggctttcggactcc

SEQ ID NO: 423973 - DNA, 20 bp, Artificial
  CRISPR gRNA sequence
tcggactccaggacttaaac

SEQ ID NO: 423974 - DNA, 20 bp, Artificial
  CRISPR gRNA sequence
taaaccagtgctcctgaccc

SEQ ID NO: 423975 - DNA, 20 bp, Artificial
  CRISPR gRNA sequence
aaaccagtgctcctgaccct

SEQ ID NO: 423976 - DNA, 20 bp, Artificial
  CRISPR gRNA sequence
tgctcctgaccctgggtttt

SEQ ID NO: 423977 - DNA, 20 bp, Artificial
  CRISPR gRNA sequence
gctcctgaccctgggttttc

SEQ ID NO: 423978 - DNA, 20 bp, Artificial
  CRISPR gRNA sequence
accctgggttttcaggccct

SEQ ID NO: 423979 - DNA, 20 bp, Artificial
  CRISPR gRNA sequence
ggttttcaggcccttagcct

SEQ ID NO: 423980 - DNA, 20 bp, Artificial
  CRISPR gRNA sequence
caggcccttagccttggact

SEQ ID NO: 423981 - DNA, 20 bp, Artificial
  CRISPR gRNA sequence
tggactgagaattacaccaa

SEQ ID NO: 423982 - DNA, 20 bp, Artificial
  CRISPR gRNA sequence
gagaattacaccaacagcct

SEQ ID NO: 423983 - DNA, 20 bp, Artificial
  CRISPR gRNA sequence
aattacaccaacagcctcag

SEQ ID NO: 423984 - DNA, 20 bp, Artificial
  CRISPR gRNA sequence
ccaacagcctcagtggttct

SEQ ID NO: 423985 - DNA, 20 bp, Artificial
  CRISPR gRNA sequence
caacagcctcagtggttctg

SEQ ID NO: 423986 - DNA, 20 bp, Artificial
  CRISPR gRNA sequence
ctcagtggttctgaggctgt

SEQ ID NO: 423987 - DNA, 20 bp, Artificial
  CRISPR gRNA sequence
gaggctgttggacttgaact

SEQ ID NO: 423988 - DNA, 20 bp, Artificial
  CRISPR gRNA sequence
cttgaactgagccatgctac

SEQ ID NO: 423989 - DNA, 20 bp, Artificial
  CRISPR gRNA sequence
agccatgctaccagcatccc

SEQ ID NO: 423990 - DNA, 20 bp, Artificial
  CRISPR gRNA sequence
gccatgctaccagcatccca

SEQ ID NO: 423991 - DNA, 20 bp, Artificial
  CRISPR gRNA sequence
taccagcatcccaaggtctc

SEQ ID NO: 423992 - DNA, 20 bp, Artificial
  CRISPR gRNA sequence
atcccaaggtctccagcttg

SEQ ID NO: 423993 - DNA, 20 bp, Artificial
  CRISPR gRNA sequence
caaggtctccagcttgcaga

SEQ ID NO: 423994 - DNA, 20 bp, Artificial
  CRISPR gRNA sequence
tccagcttgcagacagcctg

SEQ ID NO: 423995 - DNA, 20 bp, Artificial
  CRISPR gRNA sequence
gcttgcagacagcctgtggt

SEQ ID NO: 423996 - DNA, 20 bp, Artificial
  CRISPR gRNA sequence
cagcctgtggtgagacttct

SEQ ID NO: 423997 - DNA, 20 bp, Artificial
  CRISPR gRNA sequence
catccatctatatctcctat

SEQ ID NO: 423998 - DNA, 20 bp, Artificial
  CRISPR gRNA sequence
tcctattggttctgtccctc

SEQ ID NO: 423999 - DNA, 20 bp, Artificial
  CRISPR gRNA sequence
ctattggttctgtccctccg

SEQ ID NO: 424000 - DNA, 20 bp, Artificial
  CRISPR gRNA sequence
ggagacccataactaatgta

SEQ ID NO: 424001 - DNA, 20 bp, Artificial
  CRISPR gRNA sequence
actaatgtacagttcctgct

SEQ ID NO: 424002 - DNA, 20 bp, Artificial
  CRISPR gRNA sequence
ctcagatctctctacctgac

SEQ ID NO: 424003 - DNA, 20 bp, Artificial
  CRISPR gRNA sequence
tgaccagcactcccattttc

SEQ ID NO: 424004 - DNA, 20 bp, Artificial
  CRISPR gRNA sequence
cactcccattttccagatgc

SEQ ID NO: 424005 - DNA, 20 bp, Artificial
  CRISPR gRNA sequence
actcccattttccagatgct

SEQ ID NO: 424006 - DNA, 20 bp, Artificial
  CRISPR gRNA sequence
tcccattttccagatgctgg

SEQ ID NO: 424007 - DNA, 20 bp, Artificial
  CRISPR gRNA sequence
atgctgggagtgtacgctgt

SEQ ID NO: 424008 - DNA, 20 bp, Artificial
  CRISPR gRNA sequence
gagtgtacgctgtgagctca

SEQ ID NO: 424009 - DNA, 20 bp, Artificial
  CRISPR gRNA sequence
tgtacgctgtgagctcacag

SEQ ID NO: 424010 - DNA, 20 bp, Artificial
  CRISPR gRNA sequence
gctcacagcagccccttctc

SEQ ID NO: 424011 - DNA, 20 bp, Artificial
  CRISPR gRNA sequence
tcacagcagccccttctctg

SEQ ID NO: 424012 - DNA, 20 bp, Artificial
  CRISPR gRNA sequence
cttctctggagaattgctct

SEQ ID NO: 424013 - DNA, 20 bp, Artificial
  CRISPR gRNA sequence
ttctctggagaattgctctt

SEQ ID NO: 424014 - DNA, 20 bp, Artificial
  CRISPR gRNA sequence
aattgctcttgggccctcgc

SEQ ID NO: 424015 - DNA, 20 bp, Artificial
  CRISPR gRNA sequence
gctcttgggccctcgctggt

SEQ ID NO: 424016 - DNA, 20 bp, Artificial
  CRISPR gRNA sequence
cttgggccctcgctggtgag

SEQ ID NO: 424017 - DNA, 20 bp, Artificial
  CRISPR gRNA sequence
ggccctcgctggtgagcagc

SEQ ID NO: 424018 - DNA, 20 bp, Artificial
  CRISPR gRNA sequence
cctcgctggtgagcagccag

SEQ ID NO: 424019 - DNA, 20 bp, Artificial
  CRISPR gRNA sequence
gccagaagtaatgactgacc

SEQ ID NO: 424020 - DNA, 20 bp, Artificial
  CRISPR gRNA sequence
ccagaagtaatgactgacct

SEQ ID NO: 424021 - DNA, 20 bp, Artificial
  CRISPR gRNA sequence
gaagtaatgactgacctagg

SEQ ID NO: 424022 - DNA, 20 bp, Artificial
  CRISPR gRNA sequence
taggtggatttccaaaatgc

SEQ ID NO: 424023 - DNA, 20 bp, Artificial
  CRISPR gRNA sequence
aaatgccagctccctgccta

SEQ ID NO: 424024 - DNA, 20 bp, Artificial
  CRISPR gRNA sequence
aatgccagctccctgcctaa

SEQ ID NO: 424025 - DNA, 20 bp, Artificial
  CRISPR gRNA sequence
actctgtacaattcttgctt

SEQ ID NO: 424026 - DNA, 20 bp, Artificial
  CRISPR gRNA sequence
gtacaattcttgcttcagcc

SEQ ID NO: 424027 - DNA, 20 bp, Artificial
  CRISPR gRNA sequence
tcttgcttcagccaagtctc

SEQ ID NO: 424028 - DNA, 20 bp, Artificial
  CRISPR gRNA sequence
cttcagccaagtctccagct

SEQ ID NO: 424029 - DNA, 20 bp, Artificial
  CRISPR gRNA sequence
gctgagaccatatccatgct

SEQ ID NO: 424030 - DNA, 20 bp, Artificial
  CRISPR gRNA sequence
catgctgagctttcttccct

SEQ ID NO: 424031 - DNA, 20 bp, Artificial
  CRISPR gRNA sequence
tccttcactacttttcatct

SEQ ID NO: 424032 - DNA, 20 bp, Artificial
  CRISPR gRNA sequence
cttcactacttttcatctga

SEQ ID NO: 424033 - DNA, 20 bp, Artificial
  CRISPR gRNA sequence
catctgagagctgtcccaat

SEQ ID NO: 424034 - DNA, 20 bp, Artificial
  CRISPR gRNA sequence
tctcaccaaaatttgcatgt

SEQ ID NO: 424035 - DNA, 20 bp, Artificial
  CRISPR gRNA sequence
ctcaccaaaatttgcatgtc

SEQ ID NO: 424036 - DNA, 20 bp, Artificial
  CRISPR gRNA sequence
tgcatgtcaggctctatttc

SEQ ID NO: 424037 - DNA, 20 bp, Artificial
  CRISPR gRNA sequence
gcatgtcaggctctatttcc

SEQ ID NO: 424038 - DNA, 20 bp, Artificial
  CRISPR gRNA sequence
catgtcaggctctatttccg

SEQ ID NO: 424039 - DNA, 20 bp, Artificial
  CRISPR gRNA sequence
tccggggacctgatctaaaa

SEQ ID NO: 424040 - DNA, 20 bp, Artificial
  CRISPR gRNA sequence
tgatctaaaacagttgctgc

SEQ ID NO: 424041 - DNA, 20 bp, Artificial
  CRISPR gRNA sequence
gatctaaaacagttgctgct

SEQ ID NO: 424042 - DNA, 20 bp, Artificial
  CRISPR gRNA sequence
aaaacagttgctgctgggaa

SEQ ID NO: 424043 - DNA, 20 bp, Artificial
  CRISPR gRNA sequence
gttgctgctgggaatagtcc

SEQ ID NO: 424044 - DNA, 20 bp, Artificial
  CRISPR gRNA sequence
gctgctgggaatagtcctag

SEQ ID NO: 424045 - DNA, 20 bp, Artificial
  CRISPR gRNA sequence
ctgctgggaatagtcctaga

SEQ ID NO: 424046 - DNA, 20 bp, Artificial
  CRISPR gRNA sequence
ctgggaatagtcctagaagg

SEQ ID NO: 424047 - DNA, 20 bp, Artificial
  CRISPR gRNA sequence
agtcctagaaggcagcctgt

SEQ ID NO: 424048 - DNA, 20 bp, Artificial
  CRISPR gRNA sequence
tagaaggcagcctgtaagaa

SEQ ID NO: 424049 - DNA, 20 bp, Artificial
  CRISPR gRNA sequence
agaaggcagcctgtaagaac

SEQ ID NO: 424050 - DNA, 20 bp, Artificial
  CRISPR gRNA sequence
agcctgtaagaacaggattg

SEQ ID NO: 424051 - DNA, 20 bp, Artificial
  CRISPR gRNA sequence
gtaagaacaggattgtggaa

SEQ ID NO: 424052 - DNA, 20 bp, Artificial
  CRISPR gRNA sequence
taagaacaggattgtggaat

SEQ ID NO: 424053 - DNA, 20 bp, Artificial
  CRISPR gRNA sequence
gaatgggatcattcacctgc

SEQ ID NO: 424054 - DNA, 20 bp, Artificial
  CRISPR gRNA sequence
gggatcattcacctgctaga

SEQ ID NO: 424055 - DNA, 20 bp, Artificial
  CRISPR gRNA sequence
ggcaacacaaaccccatgac

SEQ ID NO: 424056 - DNA, 20 bp, Artificial
  CRISPR gRNA sequence
aacacaaaccccatgactgg

SEQ ID NO: 424057 - DNA, 20 bp, Artificial
  CRISPR gRNA sequence
cccatgactggtggtgaaat

SEQ ID NO: 424058 - DNA, 20 bp, Artificial
  CRISPR gRNA sequence
tgactggtggtgaaatgaga

SEQ ID NO: 424059 - DNA, 20 bp, Artificial
  CRISPR gRNA sequence
gactggtggtgaaatgagat

SEQ ID NO: 424060 - DNA, 20 bp, Artificial
  CRISPR gRNA sequence
tggtgaaatgagatgggaca

SEQ ID NO: 424061 - DNA, 20 bp, Artificial
  CRISPR gRNA sequence
gaaatgagatgggacacaga

SEQ ID NO: 424062 - DNA, 20 bp, Artificial
  CRISPR gRNA sequence
tgagatgggacacagatgga

SEQ ID NO: 424063 - DNA, 20 bp, Artificial
  CRISPR gRNA sequence
cacagatggatggaaactat

SEQ ID NO: 424064 - DNA, 20 bp, Artificial
  CRISPR gRNA sequence
gatggatggaaactatgagc

SEQ ID NO: 424065 - DNA, 20 bp, Artificial
  CRISPR gRNA sequence
gtgcactgactctaacattt

SEQ ID NO: 424066 - DNA, 20 bp, Artificial
  CRISPR gRNA sequence
tgcactgactctaacatttg

SEQ ID NO: 424067 - DNA, 20 bp, Artificial
  CRISPR gRNA sequence
actctaacatttgaggtgta

SEQ ID NO: 424068 - DNA, 20 bp, Artificial
  CRISPR gRNA sequence
ctctaacatttgaggtgtat

SEQ ID NO: 424069 - DNA, 20 bp, Artificial
  CRISPR gRNA sequence
tctaacatttgaggtgtata

SEQ ID NO: 424070 - DNA, 20 bp, Artificial
  CRISPR gRNA sequence
tttgaggtgtatagggtaaa

SEQ ID NO: 424071 - DNA, 20 bp, Artificial
  CRISPR gRNA sequence
aggtgtatagggtaaatagt

SEQ ID NO: 424072 - DNA, 20 bp, Artificial
  CRISPR gRNA sequence
atagggtaaatagttagtgt

SEQ ID NO: 424073 - DNA, 20 bp, Artificial
  CRISPR gRNA sequence
aatagttagtgttagaactc

SEQ ID NO: 424074 - DNA, 20 bp, Artificial
  CRISPR gRNA sequence
tagtgttagaactctggaat

SEQ ID NO: 424075 - DNA, 20 bp, Artificial
  CRISPR gRNA sequence
agtgttagaactctggaatt

SEQ ID NO: 424076 - DNA, 20 bp, Artificial
  CRISPR gRNA sequence
gaactctggaattgggtcaa

SEQ ID NO: 424077 - DNA, 20 bp, Artificial
  CRISPR gRNA sequence
ctggaattgggtcaacagta

SEQ ID NO: 424078 - DNA, 20 bp, Artificial
  CRISPR gRNA sequence
tggaattgggtcaacagtat

SEQ ID NO: 424079 - DNA, 20 bp, Artificial
  CRISPR gRNA sequence
ggaattgggtcaacagtata

SEQ ID NO: 424080 - DNA, 20 bp, Artificial
  CRISPR gRNA sequence
gggtcaacagtatagggtaa

SEQ ID NO: 424081 - DNA, 20 bp, Artificial
  CRISPR gRNA sequence
tatagggtaatagttaatat

SEQ ID NO: 424082 - DNA, 20 bp, Artificial
  CRISPR gRNA sequence
atagggtaatagttaatatt

SEQ ID NO: 424083 - DNA, 20 bp, Artificial
  CRISPR gRNA sequence
cttttgctaaattgcaccga

SEQ ID NO: 424084 - DNA, 20 bp, Artificial
  CRISPR gRNA sequence
taaattgcaccgatggactg

SEQ ID NO: 424085 - DNA, 20 bp, Artificial
  CRISPR gRNA sequence
ttgcaccgatggactgaagt

SEQ ID NO: 424086 - DNA, 20 bp, Artificial
  CRISPR gRNA sequence
ggactgaagtgagaaaatga

SEQ ID NO: 424087 - DNA, 20 bp, Artificial
  CRISPR gRNA sequence
aagtgagaaaatgacagcct

SEQ ID NO: 424088 - DNA, 20 bp, Artificial
  CRISPR gRNA sequence
aatgacagcctcagatctat

SEQ ID NO: 424089 - DNA, 20 bp, Artificial
  CRISPR gRNA sequence
tcagatctatcagcaactca

SEQ ID NO: 424090 - DNA, 20 bp, Artificial
  CRISPR gRNA sequence
ctatcagcaactcaaagtgt

SEQ ID NO: 424091 - DNA, 20 bp, Artificial
  CRISPR gRNA sequence
atcagcaactcaaagtgtga

SEQ ID NO: 424092 - DNA, 20 bp, Artificial
  CRISPR gRNA sequence
aactcaaagtgtgagagtta

SEQ ID NO: 424093 - DNA, 20 bp, Artificial
  CRISPR gRNA sequence
tgagagttaaagctcctcct

SEQ ID NO: 424094 - DNA, 20 bp, Artificial
  CRISPR gRNA sequence
gagttaaagctcctccttgg

SEQ ID NO: 424095 - DNA, 20 bp, Artificial
  CRISPR gRNA sequence
tcctccttggcagcatttaa

SEQ ID NO: 424096 - DNA, 20 bp, Artificial
  CRISPR gRNA sequence
aaaagacactcgtctatcca

SEQ ID NO: 424097 - DNA, 20 bp, Artificial
  CRISPR gRNA sequence
cactcgtctatccacagctg

SEQ ID NO: 424098 - DNA, 20 bp, Artificial
  CRISPR gRNA sequence
gtctatccacagctgaagac

SEQ ID NO: 424099 - DNA, 20 bp, Artificial
  CRISPR gRNA sequence
tctatccacagctgaagacc

SEQ ID NO: 424100 - DNA, 20 bp, Artificial
  CRISPR gRNA sequence
cagctgaagaccaggtacat

SEQ ID NO: 424101 - DNA, 20 bp, Artificial
  CRISPR gRNA sequence
caggtacataagctaattgt

SEQ ID NO: 424102 - DNA, 20 bp, Artificial
  CRISPR gRNA sequence
ggtacataagctaattgtaa

SEQ ID NO: 424103 - DNA, 20 bp, Artificial
  CRISPR gRNA sequence
gtacataagctaattgtaag

SEQ ID NO: 424104 - DNA, 20 bp, Artificial
  CRISPR gRNA sequence
tacataagctaattgtaaga

SEQ ID NO: 424105 - DNA, 20 bp, Artificial
  CRISPR gRNA sequence
taagctaattgtaagaggga

SEQ ID NO: 424106 - DNA, 20 bp, Artificial
  CRISPR gRNA sequence
aagctaattgtaagagggac

SEQ ID NO: 424107 - DNA, 20 bp, Artificial
  CRISPR gRNA sequence
gtaagagggacaggacttta

SEQ ID NO: 424108 - DNA, 20 bp, Artificial
  CRISPR gRNA sequence
agagggacaggactttaaag

SEQ ID NO: 424109 - DNA, 20 bp, Artificial
  CRISPR gRNA sequence
gagggacaggactttaaaga

SEQ ID NO: 424110 - DNA, 20 bp, Artificial
  CRISPR gRNA sequence
ctttaaagaaggctgattct

SEQ ID NO: 424111 - DNA, 20 bp, Artificial
  CRISPR gRNA sequence
aagaaggctgattctaagcc

SEQ ID NO: 424112 - DNA, 20 bp, Artificial
  CRISPR gRNA sequence
agaaggctgattctaagcct

SEQ ID NO: 424113 - DNA, 20 bp, Artificial
  CRISPR gRNA sequence
taggtaaattttctatgcca

SEQ ID NO: 424114 - DNA, 20 bp, Artificial
  CRISPR gRNA sequence
taaattttctatgccaaagc

SEQ ID NO: 424115 - DNA, 20 bp, Artificial
  CRISPR gRNA sequence
tgccaaagctagcatcttga

SEQ ID NO: 424116 - DNA, 20 bp, Artificial
  CRISPR gRNA sequence
caaagctagcatcttgatag

SEQ ID NO: 424117 - DNA, 20 bp, Artificial
  CRISPR gRNA sequence
aagctagcatcttgatagta

SEQ ID NO: 424118 - DNA, 20 bp, Artificial
  CRISPR gRNA sequence
agctagcatcttgatagtag

SEQ ID NO: 424119 - DNA, 20 bp, Artificial
  CRISPR gRNA sequence
ctagcatcttgatagtagag

SEQ ID NO: 424120 - DNA, 20 bp, Artificial
  CRISPR gRNA sequence
tagcatcttgatagtagagg

SEQ ID NO: 424121 - DNA, 20 bp, Artificial
  CRISPR gRNA sequence
gcatcttgatagtagaggag

SEQ ID NO: 424122 - DNA, 20 bp, Artificial
  CRISPR gRNA sequence
aggaggagtctcctgaaact

SEQ ID NO: 424123 - DNA, 20 bp, Artificial
  CRISPR gRNA sequence
agtctcctgaaacttggaat

SEQ ID NO: 424124 - DNA, 20 bp, Artificial
  CRISPR gRNA sequence
gtctcctgaaacttggaatg

SEQ ID NO: 424125 - DNA, 20 bp, Artificial
  CRISPR gRNA sequence
aaacttggaatgaggatctc

SEQ ID NO: 424126 - DNA, 20 bp, Artificial
  CRISPR gRNA sequence
ttggaatgaggatctctgga

SEQ ID NO: 424127 - DNA, 20 bp, Artificial
  CRISPR gRNA sequence
atctctggaaagatgcattt

SEQ ID NO: 424128 - DNA, 20 bp, Artificial
  CRISPR gRNA sequence
ctctggaaagatgcatttga

SEQ ID NO: 424129 - DNA, 20 bp, Artificial
  CRISPR gRNA sequence
ggaaagatgcatttgagagc

SEQ ID NO: 424130 - DNA, 20 bp, Artificial
  CRISPR gRNA sequence
gaaagatgcatttgagagcc

SEQ ID NO: 424131 - DNA, 20 bp, Artificial
  CRISPR gRNA sequence
cctgcttctcttataccatc

SEQ ID NO: 424132 - DNA, 20 bp, Artificial
  CRISPR gRNA sequence
tgcttctcttataccatctg

SEQ ID NO: 424133 - DNA, 20 bp, Artificial
  CRISPR gRNA sequence
tcttataccatctggagctg

SEQ ID NO: 424134 - DNA, 20 bp, Artificial
  CRISPR gRNA sequence
tataccatctggagctgcag

SEQ ID NO: 424135 - DNA, 20 bp, Artificial
  CRISPR gRNA sequence
accatctggagctgcagaag

SEQ ID NO: 424136 - DNA, 20 bp, Artificial
  CRISPR gRNA sequence
agtggcccacttccccttga

SEQ ID NO: 424137 - DNA, 20 bp, Artificial
  CRISPR gRNA sequence
cccacttccccttgatggaa

SEQ ID NO: 424138 - DNA, 20 bp, Artificial
  CRISPR gRNA sequence
tgatggaaaagaatccctgc

SEQ ID NO: 424139 - DNA, 20 bp, Artificial
  CRISPR gRNA sequence
gatggaaaagaatccctgct

SEQ ID NO: 424140 - DNA, 20 bp, Artificial
  CRISPR gRNA sequence
ctgcctcccctactgtccat

SEQ ID NO: 424141 - DNA, 20 bp, Artificial
  CRISPR gRNA sequence
tgcctcccctactgtccatc

SEQ ID NO: 424142 - DNA, 20 bp, Artificial
  CRISPR gRNA sequence
ctgtccatcaggcccgtaat

SEQ ID NO: 424143 - DNA, 20 bp, Artificial
  CRISPR gRNA sequence
tgtccatcaggcccgtaatt

SEQ ID NO: 424144 - DNA, 20 bp, Artificial
  CRISPR gRNA sequence
ccgtaattaggataaaatct

SEQ ID NO: 424145 - DNA, 20 bp, Artificial
  CRISPR gRNA sequence
aaaatctcagcccatgctaa

SEQ ID NO: 424146 - DNA, 20 bp, Artificial
  CRISPR gRNA sequence
aatctcagcccatgctaatg

SEQ ID NO: 424147 - DNA, 20 bp, Artificial
  CRISPR gRNA sequence
atctcagcccatgctaatgg

SEQ ID NO: 424148 - DNA, 20 bp, Artificial
  CRISPR gRNA sequence
tcagcccatgctaatggagg

SEQ ID NO: 424149 - DNA, 20 bp, Artificial
  CRISPR gRNA sequence
catgctaatggaggaagtgc

SEQ ID NO: 424150 - DNA, 20 bp, Artificial
  CRISPR gRNA sequence
atgctaatggaggaagtgct

SEQ ID NO: 424151 - DNA, 20 bp, Artificial
  CRISPR gRNA sequence
gaggaagtgctgggtctgct

SEQ ID NO: 424152 - DNA, 20 bp, Artificial
  CRISPR gRNA sequence
ggaagtgctgggtctgctaa

SEQ ID NO: 424153 - DNA, 20 bp, Artificial
  CRISPR gRNA sequence
tgctgggtctgctaagagaa

SEQ ID NO: 424154 - DNA, 20 bp, Artificial
  CRISPR gRNA sequence
gggtctgctaagagaataga

SEQ ID NO: 424155 - DNA, 20 bp, Artificial
  CRISPR gRNA sequence
ggtctgctaagagaatagaa

SEQ ID NO: 424156 - DNA, 20 bp, Artificial
  CRISPR gRNA sequence
aatagaaaggttatatacta

SEQ ID NO: 424157 - DNA, 20 bp, Artificial
  CRISPR gRNA sequence
atagaaaggttatatactac

SEQ ID NO: 424158 - DNA, 20 bp, Artificial
  CRISPR gRNA sequence
aggttatatactacaggacc

SEQ ID NO: 424159 - DNA, 20 bp, Artificial
  CRISPR gRNA sequence
aggacctggctaacatctac

SEQ ID NO: 424160 - DNA, 20 bp, Artificial
  CRISPR gRNA sequence
acctggctaacatctactgg

SEQ ID NO: 424161 - DNA, 20 bp, Artificial
  CRISPR gRNA sequence
cctggctaacatctactggc

SEQ ID NO: 424162 - DNA, 20 bp, Artificial
  CRISPR gRNA sequence
ctggctaacatctactggca

SEQ ID NO: 424163 - DNA, 20 bp, Artificial
  CRISPR gRNA sequence
taacatctactggcagggac

SEQ ID NO: 424164 - DNA, 20 bp, Artificial
  CRISPR gRNA sequence
aacatctactggcagggact

SEQ ID NO: 424165 - DNA, 20 bp, Artificial
  CRISPR gRNA sequence
catctactggcagggactgg

SEQ ID NO: 424166 - DNA, 20 bp, Artificial
  CRISPR gRNA sequence
ctactggcagggactgggag

SEQ ID NO: 424167 - DNA, 20 bp, Artificial
  CRISPR gRNA sequence
agggactgggagaagatgcc

SEQ ID NO: 424168 - DNA, 20 bp, Artificial
  CRISPR gRNA sequence
gggactgggagaagatgcct

SEQ ID NO: 424169 - DNA, 20 bp, Artificial
  CRISPR gRNA sequence
atgcctaggcatgaattctg

SEQ ID NO: 424170 - DNA, 20 bp, Artificial
  CRISPR gRNA sequence
tgcctaggcatgaattctga

SEQ ID NO: 424171 - DNA, 20 bp, Artificial
  CRISPR gRNA sequence
ggcatgaattctgaaggtga

SEQ ID NO: 424172 - DNA, 20 bp, Artificial
  CRISPR gRNA sequence
attctgaaggtgatggattg

SEQ ID NO: 424173 - DNA, 20 bp, Artificial
  CRISPR gRNA sequence
ctgaaggtgatggattgtgg

SEQ ID NO: 424174 - DNA, 20 bp, Artificial
  CRISPR gRNA sequence
tgaaggtgatggattgtggt

SEQ ID NO: 424175 - DNA, 20 bp, Artificial
  CRISPR gRNA sequence
gaaggtgatggattgtggta

SEQ ID NO: 424176 - DNA, 20 bp, Artificial
  CRISPR gRNA sequence
aaggtgatggattgtggtag

SEQ ID NO: 424177 - DNA, 20 bp, Artificial
  CRISPR gRNA sequence
aggtgatggattgtggtagg

SEQ ID NO: 424178 - DNA, 20 bp, Artificial
  CRISPR gRNA sequence
tgatggattgtggtaggggg

SEQ ID NO: 424179 - DNA, 20 bp, Artificial
  CRISPR gRNA sequence
tgtggtagggggtagaacat

SEQ ID NO: 424180 - DNA, 20 bp, Artificial
  CRISPR gRNA sequence
tagggggtagaacataagcc

SEQ ID NO: 424181 - DNA, 20 bp, Artificial
  CRISPR gRNA sequence
ggtagaacataagcctggat

SEQ ID NO: 424182 - DNA, 20 bp, Artificial
  CRISPR gRNA sequence
gtagaacataagcctggatg

SEQ ID NO: 424183 - DNA, 20 bp, Artificial
  CRISPR gRNA sequence
tagaacataagcctggatga

SEQ ID NO: 424184 - DNA, 20 bp, Artificial
  CRISPR gRNA sequence
gagggataatgcgtcaatat

SEQ ID NO: 424185 - DNA, 20 bp, Artificial
  CRISPR gRNA sequence
tcaatatttaacaccctcac

SEQ ID NO: 424186 - DNA, 20 bp, Artificial
  CRISPR gRNA sequence
caatatttaacaccctcaca

SEQ ID NO: 424187 - DNA, 20 bp, Artificial
  CRISPR gRNA sequence
aatatttaacaccctcacaa

SEQ ID NO: 424188 - DNA, 20 bp, Artificial
  CRISPR gRNA sequence
taacaccctcacaagggccc

SEQ ID NO: 424189 - DNA, 20 bp, Artificial
  CRISPR gRNA sequence
aacaccctcacaagggcccc

SEQ ID NO: 424190 - DNA, 20 bp, Artificial
  CRISPR gRNA sequence
caccctcacaagggccccag

SEQ ID NO: 424191 - DNA, 20 bp, Artificial
  CRISPR gRNA sequence
ttctgatatactgctgtcaa

SEQ ID NO: 424192 - DNA, 20 bp, Artificial
  CRISPR gRNA sequence
ctgatatactgctgtcaata

SEQ ID NO: 424193 - DNA, 20 bp, Artificial
  CRISPR gRNA sequence
tagagatgacaacactgctt

SEQ ID NO: 424194 - DNA, 20 bp, Artificial
  CRISPR gRNA sequence
aacactgctttggcaaacta

SEQ ID NO: 424195 - DNA, 20 bp, Artificial
  CRISPR gRNA sequence
tgctttggcaaactatggaa

SEQ ID NO: 424196 - DNA, 20 bp, Artificial
  CRISPR gRNA sequence
gctttggcaaactatggaaa

SEQ ID NO: 424197 - DNA, 20 bp, Artificial
  CRISPR gRNA sequence
ctttggcaaactatggaaaa

SEQ ID NO: 424198 - DNA, 20 bp, Artificial
  CRISPR gRNA sequence
tttggcaaactatggaaaag

SEQ ID NO: 424199 - DNA, 20 bp, Artificial
  CRISPR gRNA sequence
gaaaaggggaacaaaatgct

SEQ ID NO: 424200 - DNA, 20 bp, Artificial
  CRISPR gRNA sequence
aaaggggaacaaaatgctca

SEQ ID NO: 424201 - DNA, 20 bp, Artificial
  CRISPR gRNA sequence
agagaataaacctactaaat

SEQ ID NO: 424202 - DNA, 20 bp, Artificial
  CRISPR gRNA sequence
taaacctactaaatcagaaa

SEQ ID NO: 424203 - DNA, 20 bp, Artificial
  CRISPR gRNA sequence
taaatcagaaatggcaaact

SEQ ID NO: 424204 - DNA, 20 bp, Artificial
  CRISPR gRNA sequence
aaatggcaaactgagttttg

SEQ ID NO: 424205 - DNA, 20 bp, Artificial
  CRISPR gRNA sequence
aatggcaaactgagttttgt

SEQ ID NO: 424206 - DNA, 20 bp, Artificial
  CRISPR gRNA sequence
tgagttttgtgggtcaaata

SEQ ID NO: 424207 - DNA, 20 bp, Artificial
  CRISPR gRNA sequence
ggtcaaatatggcccactgc

SEQ ID NO: 424208 - DNA, 20 bp, Artificial
  CRISPR gRNA sequence
ggcccactgctggtttttta

SEQ ID NO: 424209 - DNA, 20 bp, Artificial
  CRISPR gRNA sequence
tttttacagcccttgaacta

SEQ ID NO: 424210 - DNA, 20 bp, Artificial
  CRISPR gRNA sequence
tacagcccttgaactaaaga

SEQ ID NO: 424211 - DNA, 20 bp, Artificial
  CRISPR gRNA sequence
aaagatggcttttatatttt

SEQ ID NO: 424212 - DNA, 20 bp, Artificial
  CRISPR gRNA sequence
gtgtttttttaaaacaaaaa

SEQ ID NO: 424213 - DNA, 20 bp, Artificial
  CRISPR gRNA sequence
aaaacaaaaatagttttaaa

SEQ ID NO: 424214 - DNA, 20 bp, Artificial
  CRISPR gRNA sequence
aaaaagtaatatcttctgca

SEQ ID NO: 424215 - DNA, 20 bp, Artificial
  CRISPR gRNA sequence
taatatcttctgcacagcaa

SEQ ID NO: 424216 - DNA, 20 bp, Artificial
  CRISPR gRNA sequence
tgcacagcaaaagaaataat

SEQ ID NO: 424217 - DNA, 20 bp, Artificial
  CRISPR gRNA sequence
acagcaaaagaaataatcag

SEQ ID NO: 424218 - DNA, 20 bp, Artificial
  CRISPR gRNA sequence
agcaaaagaaataatcagca

SEQ ID NO: 424219 - DNA, 20 bp, Artificial
  CRISPR gRNA sequence
gaaataatcagcagagtaaa

SEQ ID NO: 424220 - DNA, 20 bp, Artificial
  CRISPR gRNA sequence
tcagcagagtaaacagccca

SEQ ID NO: 424221 - DNA, 20 bp, Artificial
  CRISPR gRNA sequence
agagtaaacagcccacagat

SEQ ID NO: 424222 - DNA, 20 bp, Artificial
  CRISPR gRNA sequence
gagtaaacagcccacagatt

SEQ ID NO: 424223 - DNA, 20 bp, Artificial
  CRISPR gRNA sequence
gtaaacagcccacagattgg

SEQ ID NO: 424224 - DNA, 20 bp, Artificial
  CRISPR gRNA sequence
tgtaaattatatatccaaca

SEQ ID NO: 424225 - DNA, 20 bp, Artificial
  CRISPR gRNA sequence
gtaaattatatatccaacaa

SEQ ID NO: 424226 - DNA, 20 bp, Artificial
  CRISPR gRNA sequence
tccaacaaaggactaatatc

SEQ ID NO: 424227 - DNA, 20 bp, Artificial
  CRISPR gRNA sequence
gactaatatccagaatctac

SEQ ID NO: 424228 - DNA, 20 bp, Artificial
  CRISPR gRNA sequence
actaatatccagaatctaca

SEQ ID NO: 424229 - DNA, 20 bp, Artificial
  CRISPR gRNA sequence
tacaaggaactcaaacaaat

SEQ ID NO: 424230 - DNA, 20 bp, Artificial
  CRISPR gRNA sequence
gaaaaaaaaatcccatcaaa

SEQ ID NO: 424231 - DNA, 20 bp, Artificial
  CRISPR gRNA sequence
aaaaaaatcccatcaaaaag

SEQ ID NO: 424232 - DNA, 20 bp, Artificial
  CRISPR gRNA sequence
aaaaaatcccatcaaaaagt

SEQ ID NO: 424233 - DNA, 20 bp, Artificial
  CRISPR gRNA sequence
atcccatcaaaaagtgggct

SEQ ID NO: 424234 - DNA, 20 bp, Artificial
  CRISPR gRNA sequence
tcccatcaaaaagtgggcta

SEQ ID NO: 424235 - DNA, 20 bp, Artificial
  CRISPR gRNA sequence
aagtgggctaaggacataaa

SEQ ID NO: 424236 - DNA, 20 bp, Artificial
  CRISPR gRNA sequence
ggacataaaaagacaattct

SEQ ID NO: 424237 - DNA, 20 bp, Artificial
  CRISPR gRNA sequence
taaaaagacaattctcagaa

SEQ ID NO: 424238 - DNA, 20 bp, Artificial
  CRISPR gRNA sequence
aaaaagacaattctcagaaa

SEQ ID NO: 424239 - DNA, 20 bp, Artificial
  CRISPR gRNA sequence
ctcagaaaaggatatacaaa

SEQ ID NO: 424240 - DNA, 20 bp, Artificial
  CRISPR gRNA sequence
tgctcaacatcactaattat

SEQ ID NO: 424241 - DNA, 20 bp, Artificial
  CRISPR gRNA sequence
gctcaacatcactaattatc

SEQ ID NO: 424242 - DNA, 20 bp, Artificial
  CRISPR gRNA sequence
ctcaacatcactaattatca

SEQ ID NO: 424243 - DNA, 20 bp, Artificial
  CRISPR gRNA sequence
caataccaccttactcttgt

SEQ ID NO: 424244 - DNA, 20 bp, Artificial
  CRISPR gRNA sequence
ccaccttactcttgtaagaa

SEQ ID NO: 424245 - DNA, 20 bp, Artificial
  CRISPR gRNA sequence
aataaaaaaataacccatgt

SEQ ID NO: 424246 - DNA, 20 bp, Artificial
  CRISPR gRNA sequence
aaaaataacccatgttggca

SEQ ID NO: 424247 - DNA, 20 bp, Artificial
  CRISPR gRNA sequence
aacccatgttggcatggatg

SEQ ID NO: 424248 - DNA, 20 bp, Artificial
  CRISPR gRNA sequence
tgttggcatggatgtggtga

SEQ ID NO: 424249 - DNA, 20 bp, Artificial
  CRISPR gRNA sequence
gttggcatggatgtggtgaa

SEQ ID NO: 424250 - DNA, 20 bp, Artificial
  CRISPR gRNA sequence
ttggcatggatgtggtgaaa

SEQ ID NO: 424251 - DNA, 20 bp, Artificial
  CRISPR gRNA sequence
tggcatggatgtggtgaaag

SEQ ID NO: 424252 - DNA, 20 bp, Artificial
  CRISPR gRNA sequence
gaacacttttacactgcttg

SEQ ID NO: 424253 - DNA, 20 bp, Artificial
  CRISPR gRNA sequence
aacacttttacactgcttgt

SEQ ID NO: 424254 - DNA, 20 bp, Artificial
  CRISPR gRNA sequence
ctgcttgtgggaatgtaaac

SEQ ID NO: 424255 - DNA, 20 bp, Artificial
  CRISPR gRNA sequence
aatgtaaactagtatgacta

SEQ ID NO: 424256 - DNA, 20 bp, Artificial
  CRISPR gRNA sequence
actagtatgactatggaaaa

SEQ ID NO: 424257 - DNA, 20 bp, Artificial
  CRISPR gRNA sequence
tatgactatggaaaacagtg

SEQ ID NO: 424258 - DNA, 20 bp, Artificial
  CRISPR gRNA sequence
tgactatggaaaacagtgtg

SEQ ID NO: 424259 - DNA, 20 bp, Artificial
  CRISPR gRNA sequence
aaacagtgtggagattcctt

SEQ ID NO: 424260 - DNA, 20 bp, Artificial
  CRISPR gRNA sequence
aacagtgtggagattcctta

SEQ ID NO: 424261 - DNA, 20 bp, Artificial
  CRISPR gRNA sequence
gagattccttaaggaactaa

SEQ ID NO: 424262 - DNA, 20 bp, Artificial
  CRISPR gRNA sequence
attccttaaggaactaaaag

SEQ ID NO: 424263 - DNA, 20 bp, Artificial
  CRISPR gRNA sequence
agtagaactatgatttaatc

SEQ ID NO: 424264 - DNA, 20 bp, Artificial
  CRISPR gRNA sequence
taatccagtaatcccactac

SEQ ID NO: 424265 - DNA, 20 bp, Artificial
  CRISPR gRNA sequence
aatccagtaatcccactact

SEQ ID NO: 424266 - DNA, 20 bp, Artificial
  CRISPR gRNA sequence
cccactactgggtatctatc

SEQ ID NO: 424267 - DNA, 20 bp, Artificial
  CRISPR gRNA sequence
cactactgggtatctatcca

SEQ ID NO: 424268 - DNA, 20 bp, Artificial
  CRISPR gRNA sequence
actactgggtatctatccag

SEQ ID NO: 424269 - DNA, 20 bp, Artificial
  CRISPR gRNA sequence
tgggtatctatccagaggaa

SEQ ID NO: 424270 - DNA, 20 bp, Artificial
  CRISPR gRNA sequence
gtatctatccagaggaaaag

SEQ ID NO: 424271 - DNA, 20 bp, Artificial
  CRISPR gRNA sequence
aaaagaagtcattatacaaa

SEQ ID NO: 424272 - DNA, 20 bp, Artificial
  CRISPR gRNA sequence
agaagtcattatacaaaaag

SEQ ID NO: 424273 - DNA, 20 bp, Artificial
  CRISPR gRNA sequence
aatttgcaattgcaaaaata

SEQ ID NO: 424274 - DNA, 20 bp, Artificial
  CRISPR gRNA sequence
caattgcaaaaatatggaac

SEQ ID NO: 424275 - DNA, 20 bp, Artificial
  CRISPR gRNA sequence
ccaaatgcccatcaatcaat

SEQ ID NO: 424276 - DNA, 20 bp, Artificial
  CRISPR gRNA sequence
aatgcccatcaatcaatgag

SEQ ID NO: 424277 - DNA, 20 bp, Artificial
  CRISPR gRNA sequence
catcaatcaatgagtggata

SEQ ID NO: 424278 - DNA, 20 bp, Artificial
  CRISPR gRNA sequence
acatatatatatacacacca

SEQ ID NO: 424279 - DNA, 20 bp, Artificial
  CRISPR gRNA sequence
acacaccatggaatactact

SEQ ID NO: 424280 - DNA, 20 bp, Artificial
  CRISPR gRNA sequence
gaatactactcagccataaa

SEQ ID NO: 424281 - DNA, 20 bp, Artificial
  CRISPR gRNA sequence
aatactactcagccataaaa

SEQ ID NO: 424282 - DNA, 20 bp, Artificial
  CRISPR gRNA sequence
cataaaaaggaacaaaataa

SEQ ID NO: 424283 - DNA, 20 bp, Artificial
  CRISPR gRNA sequence
gaacaaaataatggcatttg

SEQ ID NO: 424284 - DNA, 20 bp, Artificial
  CRISPR gRNA sequence
caaaataatggcatttgcag

SEQ ID NO: 424285 - DNA, 20 bp, Artificial
  CRISPR gRNA sequence
taatggcatttgcagcagcc

SEQ ID NO: 424286 - DNA, 20 bp, Artificial
  CRISPR gRNA sequence
ggcatttgcagcagcctgga

SEQ ID NO: 424287 - DNA, 20 bp, Artificial
  CRISPR gRNA sequence
tgcagcagcctggatggaat

SEQ ID NO: 424288 - DNA, 20 bp, Artificial
  CRISPR gRNA sequence
gaattggaaaccactactat

SEQ ID NO: 424289 - DNA, 20 bp, Artificial
  CRISPR gRNA sequence
ggaaaccactactataagtg

SEQ ID NO: 424290 - DNA, 20 bp, Artificial
  CRISPR gRNA sequence
ctactataagtgaagtaact

SEQ ID NO: 424291 - DNA, 20 bp, Artificial
  CRISPR gRNA sequence
tactataagtgaagtaactc

SEQ ID NO: 424292 - DNA, 20 bp, Artificial
  CRISPR gRNA sequence
aaacattgtatgttctcact

SEQ ID NO: 424293 - DNA, 20 bp, Artificial
  CRISPR gRNA sequence
cattgtatgttctcactcag

SEQ ID NO: 424294 - DNA, 20 bp, Artificial
  CRISPR gRNA sequence
tgtatgttctcactcagaag

SEQ ID NO: 424295 - DNA, 20 bp, Artificial
  CRISPR gRNA sequence
gtatgttctcactcagaagt

SEQ ID NO: 424296 - DNA, 20 bp, Artificial
  CRISPR gRNA sequence
atgttctcactcagaagtgg

SEQ ID NO: 424297 - DNA, 20 bp, Artificial
  CRISPR gRNA sequence
ctcactcagaagtgggagct

SEQ ID NO: 424298 - DNA, 20 bp, Artificial
  CRISPR gRNA sequence
agaagtgggagctaagctat

SEQ ID NO: 424299 - DNA, 20 bp, Artificial
  CRISPR gRNA sequence
gaagtgggagctaagctatg

SEQ ID NO: 424300 - DNA, 20 bp, Artificial
  CRISPR gRNA sequence
agctaagctatgaggacgca

SEQ ID NO: 424301 - DNA, 20 bp, Artificial
  CRISPR gRNA sequence
gctaagctatgaggacgcaa

SEQ ID NO: 424302 - DNA, 20 bp, Artificial
  CRISPR gRNA sequence
tatgaggacgcaaaggcgtt

SEQ ID NO: 424303 - DNA, 20 bp, Artificial
  CRISPR gRNA sequence
aaaggcgttaagaatgatac

SEQ ID NO: 424304 - DNA, 20 bp, Artificial
  CRISPR gRNA sequence
aaggcgttaagaatgataca

SEQ ID NO: 424305 - DNA, 20 bp, Artificial
  CRISPR gRNA sequence
aggcgttaagaatgatacaa

SEQ ID NO: 424306 - DNA, 20 bp, Artificial
  CRISPR gRNA sequence
agaatgatacaagggactaa

SEQ ID NO: 424307 - DNA, 20 bp, Artificial
  CRISPR gRNA sequence
tacaagggactaatggactt

SEQ ID NO: 424308 - DNA, 20 bp, Artificial
  CRISPR gRNA sequence
acaagggactaatggacttt

SEQ ID NO: 424309 - DNA, 20 bp, Artificial
  CRISPR gRNA sequence
caagggactaatggactttg

SEQ ID NO: 424310 - DNA, 20 bp, Artificial
  CRISPR gRNA sequence
actaatggactttggggact

SEQ ID NO: 424311 - DNA, 20 bp, Artificial
  CRISPR gRNA sequence
ctaatggactttggggactc

SEQ ID NO: 424312 - DNA, 20 bp, Artificial
  CRISPR gRNA sequence
taatggactttggggactca

SEQ ID NO: 424313 - DNA, 20 bp, Artificial
  CRISPR gRNA sequence
gactttggggactcagggaa

SEQ ID NO: 424314 - DNA, 20 bp, Artificial
  CRISPR gRNA sequence
ctttggggactcagggaaaa

SEQ ID NO: 424315 - DNA, 20 bp, Artificial
  CRISPR gRNA sequence
tggggactcagggaaaagag

SEQ ID NO: 424316 - DNA, 20 bp, Artificial
  CRISPR gRNA sequence
ggggactcagggaaaagagt

SEQ ID NO: 424317 - DNA, 20 bp, Artificial
  CRISPR gRNA sequence
ggactcagggaaaagagtgg

SEQ ID NO: 424318 - DNA, 20 bp, Artificial
  CRISPR gRNA sequence
actcagggaaaagagtggga

SEQ ID NO: 424319 - DNA, 20 bp, Artificial
  CRISPR gRNA sequence
ctcagggaaaagagtgggag

SEQ ID NO: 424320 - DNA, 20 bp, Artificial
  CRISPR gRNA sequence
tcagggaaaagagtgggaga

SEQ ID NO: 424321 - DNA, 20 bp, Artificial
  CRISPR gRNA sequence
gaaaagagtgggagagggct

SEQ ID NO: 424322 - DNA, 20 bp, Artificial
  CRISPR gRNA sequence
aaaagagtgggagagggctg

SEQ ID NO: 424323 - DNA, 20 bp, Artificial
  CRISPR gRNA sequence
aaagagtgggagagggctga

SEQ ID NO: 424324 - DNA, 20 bp, Artificial
  CRISPR gRNA sequence
tgggagagggctgagggata

SEQ ID NO: 424325 - DNA, 20 bp, Artificial
  CRISPR gRNA sequence
gggagagggctgagggataa

SEQ ID NO: 424326 - DNA, 20 bp, Artificial
  CRISPR gRNA sequence
agggataaaggactacacac

SEQ ID NO: 424327 - DNA, 20 bp, Artificial
  CRISPR gRNA sequence
gggataaaggactacacact

SEQ ID NO: 424328 - DNA, 20 bp, Artificial
  CRISPR gRNA sequence
aaaggactacacactgggta

SEQ ID NO: 424329 - DNA, 20 bp, Artificial
  CRISPR gRNA sequence
tgggtacagtgtacactgtt

SEQ ID NO: 424330 - DNA, 20 bp, Artificial
  CRISPR gRNA sequence
gggtacagtgtacactgttc

SEQ ID NO: 424331 - DNA, 20 bp, Artificial
  CRISPR gRNA sequence
agtgtacactgttcgggtga

SEQ ID NO: 424332 - DNA, 20 bp, Artificial
  CRISPR gRNA sequence
gtgtacactgttcgggtgat

SEQ ID NO: 424333 - DNA, 20 bp, Artificial
  CRISPR gRNA sequence
tgatgggtgcaccaaaatct

SEQ ID NO: 424334 - DNA, 20 bp, Artificial
  CRISPR gRNA sequence
aatctcagaaatcaccacta

SEQ ID NO: 424335 - DNA, 20 bp, Artificial
  CRISPR gRNA sequence
atctcagaaatcaccactaa

SEQ ID NO: 424336 - DNA, 20 bp, Artificial
  CRISPR gRNA sequence
aattaaaacataaaaattta

SEQ ID NO: 424337 - DNA, 20 bp, Artificial
  CRISPR gRNA sequence
aaaacataaaaatttataga

SEQ ID NO: 424338 - DNA, 20 bp, Artificial
  CRISPR gRNA sequence
attatatgaaattaacattt

SEQ ID NO: 424339 - DNA, 20 bp, Artificial
  CRISPR gRNA sequence
cattttagtgtttataaata

SEQ ID NO: 424340 - DNA, 20 bp, Artificial
  CRISPR gRNA sequence
attttagtgtttataaataa

SEQ ID NO: 424341 - DNA, 20 bp, Artificial
  CRISPR gRNA sequence
gtttataaataaaggtttgt

SEQ ID NO: 424342 - DNA, 20 bp, Artificial
  CRISPR gRNA sequence
taaataaaggtttgttggaa

SEQ ID NO: 424343 - DNA, 20 bp, Artificial
  CRISPR gRNA sequence
aataaaggtttgttggaaca

SEQ ID NO: 424344 - DNA, 20 bp, Artificial
  CRISPR gRNA sequence
ggtttgttggaacagagtca

SEQ ID NO: 424345 - DNA, 20 bp, Artificial
  CRISPR gRNA sequence
attcatttgtatataatcta

SEQ ID NO: 424346 - DNA, 20 bp, Artificial
  CRISPR gRNA sequence
atagcactttcacactacaa

SEQ ID NO: 424347 - DNA, 20 bp, Artificial
  CRISPR gRNA sequence
gcactttcacactacaatgg

SEQ ID NO: 424348 - DNA, 20 bp, Artificial
  CRISPR gRNA sequence
actttcacactacaatggca

SEQ ID NO: 424349 - DNA, 20 bp, Artificial
  CRISPR gRNA sequence
gcagagttgaattgttgcaa

SEQ ID NO: 424350 - DNA, 20 bp, Artificial
  CRISPR gRNA sequence
agagttgaattgttgcaaca

SEQ ID NO: 424351 - DNA, 20 bp, Artificial
  CRISPR gRNA sequence
atatgacctacaaacccaaa

SEQ ID NO: 424352 - DNA, 20 bp, Artificial
  CRISPR gRNA sequence
atatactatctgcctcttta

SEQ ID NO: 424353 - DNA, 20 bp, Artificial
  CRISPR gRNA sequence
atactatctgcctctttaca

SEQ ID NO: 424354 - DNA, 20 bp, Artificial
  CRISPR gRNA sequence
gaataatttccaaaatccaa

SEQ ID NO: 424355 - DNA, 20 bp, Artificial
  CRISPR gRNA sequence
gctgattatattgacttttc

SEQ ID NO: 424356 - DNA, 20 bp, Artificial
  CRISPR gRNA sequence
ctgattatattgacttttct

SEQ ID NO: 424357 - DNA, 20 bp, Artificial
  CRISPR gRNA sequence
tgattatattgacttttcta

SEQ ID NO: 424358 - DNA, 20 bp, Artificial
  CRISPR gRNA sequence
ttatattgacttttctaggg

SEQ ID NO: 424359 - DNA, 20 bp, Artificial
  CRISPR gRNA sequence
tgacttttctagggaagatc

SEQ ID NO: 424360 - DNA, 20 bp, Artificial
  CRISPR gRNA sequence
acttttctagggaagatcca

SEQ ID NO: 424361 - DNA, 20 bp, Artificial
  CRISPR gRNA sequence
agatccagagaacatccctt

SEQ ID NO: 424362 - DNA, 20 bp, Artificial
  CRISPR gRNA sequence
gagaacatcccttaagataa

SEQ ID NO: 424363 - DNA, 20 bp, Artificial
  CRISPR gRNA sequence
ttaagataatagcaacaata

SEQ ID NO: 424364 - DNA, 20 bp, Artificial
  CRISPR gRNA sequence
taagataatagcaacaataa

SEQ ID NO: 424365 - DNA, 20 bp, Artificial
  CRISPR gRNA sequence
aagataatagcaacaataaa

SEQ ID NO: 424366 - DNA, 20 bp, Artificial
  CRISPR gRNA sequence
agataatagcaacaataaag

SEQ ID NO: 424367 - DNA, 20 bp, Artificial
  CRISPR gRNA sequence
tagcaacaataaaggggaaa

SEQ ID NO: 424368 - DNA, 20 bp, Artificial
  CRISPR gRNA sequence
agcaacaataaaggggaaaa

SEQ ID NO: 424369 - DNA, 20 bp, Artificial
  CRISPR gRNA sequence
aataaaggggaaaaaggaaa

SEQ ID NO: 424370 - DNA, 20 bp, Artificial
  CRISPR gRNA sequence
ggggaaaaaggaaaaagaaa

SEQ ID NO: 424371 - DNA, 20 bp, Artificial
  CRISPR gRNA sequence
aaaagaatatcccttttact

SEQ ID NO: 424372 - DNA, 20 bp, Artificial
  CRISPR gRNA sequence
gaatatcccttttactaagc

SEQ ID NO: 424373 - DNA, 20 bp, Artificial
  CRISPR gRNA sequence
tcccttttactaagctggaa

SEQ ID NO: 424374 - DNA, 20 bp, Artificial
  CRISPR gRNA sequence
taagctggaaaagaatgtgc

SEQ ID NO: 424375 - DNA, 20 bp, Artificial
  CRISPR gRNA sequence
aagctggaaaagaatgtgct

SEQ ID NO: 424376 - DNA, 20 bp, Artificial
  CRISPR gRNA sequence
agctggaaaagaatgtgcta

SEQ ID NO: 424377 - DNA, 20 bp, Artificial
  CRISPR gRNA sequence
gctggaaaagaatgtgctag

SEQ ID NO: 424378 - DNA, 20 bp, Artificial
  CRISPR gRNA sequence
tggaaaagaatgtgctaggg

SEQ ID NO: 424379 - DNA, 20 bp, Artificial
  CRISPR gRNA sequence
agaatgtgctaggggagctc

SEQ ID NO: 424380 - DNA, 20 bp, Artificial
  CRISPR gRNA sequence
aggggagctccagcatcatt

SEQ ID NO: 424381 - DNA, 20 bp, Artificial
  CRISPR gRNA sequence
ggagctccagcatcattgag

SEQ ID NO: 424382 - DNA, 20 bp, Artificial
  CRISPR gRNA sequence
tccagcatcattgagaagtt

SEQ ID NO: 424383 - DNA, 20 bp, Artificial
  CRISPR gRNA sequence
agcatcattgagaagtttgg

SEQ ID NO: 424384 - DNA, 20 bp, Artificial
  CRISPR gRNA sequence
ttggtggcatctctcctcta

SEQ ID NO: 424385 - DNA, 20 bp, Artificial
  CRISPR gRNA sequence
tggtggcatctctcctctat

SEQ ID NO: 424386 - DNA, 20 bp, Artificial
  CRISPR gRNA sequence
ggcatctctcctctataggc

SEQ ID NO: 424387 - DNA, 20 bp, Artificial
  CRISPR gRNA sequence
gcatctctcctctataggct

SEQ ID NO: 424388 - DNA, 20 bp, Artificial
  CRISPR gRNA sequence
catctctcctctataggcta

SEQ ID NO: 424389 - DNA, 20 bp, Artificial
  CRISPR gRNA sequence
tctataggctagggctaaaa

SEQ ID NO: 424390 - DNA, 20 bp, Artificial
  CRISPR gRNA sequence
ctataggctagggctaaaat

SEQ ID NO: 424391 - DNA, 20 bp, Artificial
  CRISPR gRNA sequence
ataggctagggctaaaatag

SEQ ID NO: 424392 - DNA, 20 bp, Artificial
  CRISPR gRNA sequence
taaaataggagatgctttta

SEQ ID NO: 424393 - DNA, 20 bp, Artificial
  CRISPR gRNA sequence
aggagatgcttttacagaac

SEQ ID NO: 424394 - DNA, 20 bp, Artificial
  CRISPR gRNA sequence
cttttacagaactggattcc

SEQ ID NO: 424395 - DNA, 20 bp, Artificial
  CRISPR gRNA sequence
ttacagaactggattcctag

SEQ ID NO: 424396 - DNA, 20 bp, Artificial
  CRISPR gRNA sequence
actggattcctagtagcaat

SEQ ID NO: 424397 - DNA, 20 bp, Artificial
  CRISPR gRNA sequence
ctggattcctagtagcaatg

SEQ ID NO: 424398 - DNA, 20 bp, Artificial
  CRISPR gRNA sequence
ttcctagtagcaatgaggat

SEQ ID NO: 424399 - DNA, 20 bp, Artificial
  CRISPR gRNA sequence
tcctagtagcaatgaggatg

SEQ ID NO: 424400 - DNA, 20 bp, Artificial
  CRISPR gRNA sequence
ctagtagcaatgaggatgag

SEQ ID NO: 424401 - DNA, 20 bp, Artificial
  CRISPR gRNA sequence
aggatgaggagatcccaaaa

SEQ ID NO: 424402 - DNA, 20 bp, Artificial
  CRISPR gRNA sequence
gaggagatcccaaaatagta

SEQ ID NO: 424403 - DNA, 20 bp, Artificial
  CRISPR gRNA sequence
gatcccaaaatagtacagaa

SEQ ID NO: 424404 - DNA, 20 bp, Artificial
  CRISPR gRNA sequence
ccaaaatagtacagaacaga

SEQ ID NO: 424405 - DNA, 20 bp, Artificial
  CRISPR gRNA sequence
aaatagtacagaacagatag

SEQ ID NO: 424406 - DNA, 20 bp, Artificial
  CRISPR gRNA sequence
agaacagatagcagcactta

SEQ ID NO: 424407 - DNA, 20 bp, Artificial
  CRISPR gRNA sequence
cagcacttaaagaaacaaaa

SEQ ID NO: 424408 - DNA, 20 bp, Artificial
  CRISPR gRNA sequence
aatggatgtaattacttcaa

SEQ ID NO: 424409 - DNA, 20 bp, Artificial
  CRISPR gRNA sequence
atggatgtaattacttcaat

SEQ ID NO: 424410 - DNA, 20 bp, Artificial
  CRISPR gRNA sequence
ggatgtaattacttcaatgg

SEQ ID NO: 424411 - DNA, 20 bp, Artificial
  CRISPR gRNA sequence
taattacttcaatgggagcc

SEQ ID NO: 424412 - DNA, 20 bp, Artificial
  CRISPR gRNA sequence
tacttcaatgggagccaaga

SEQ ID NO: 424413 - DNA, 20 bp, Artificial
  CRISPR gRNA sequence
agccaagaaagcctgatcca

SEQ ID NO: 424414 - DNA, 20 bp, Artificial
  CRISPR gRNA sequence
gccaagaaagcctgatccat

SEQ ID NO: 424415 - DNA, 20 bp, Artificial
  CRISPR gRNA sequence
gatccatgggaatattaaaa

SEQ ID NO: 424416 - DNA, 20 bp, Artificial
  CRISPR gRNA sequence
gggaatattaaaatggttaa

SEQ ID NO: 424417 - DNA, 20 bp, Artificial
  CRISPR gRNA sequence
gaatattaaaatggttaata

SEQ ID NO: 424418 - DNA, 20 bp, Artificial
  CRISPR gRNA sequence
ttaaaatggttaatagagca

SEQ ID NO: 424419 - DNA, 20 bp, Artificial
  CRISPR gRNA sequence
ttaatagagcacagtgtgcc

SEQ ID NO: 424420 - DNA, 20 bp, Artificial
  CRISPR gRNA sequence
taatagagcacagtgtgccc

SEQ ID NO: 424421 - DNA, 20 bp, Artificial
  CRISPR gRNA sequence
atagagcacagtgtgcccag

SEQ ID NO: 424422 - DNA, 20 bp, Artificial
  CRISPR gRNA sequence
agagcacagtgtgcccagga

SEQ ID NO: 424423 - DNA, 20 bp, Artificial
  CRISPR gRNA sequence
cagtgtgcccaggagagata

SEQ ID NO: 424424 - DNA, 20 bp, Artificial
  CRISPR gRNA sequence
gtgcccaggagagatacagc

SEQ ID NO: 424425 - DNA, 20 bp, Artificial
  CRISPR gRNA sequence
tgcccaggagagatacagct

SEQ ID NO: 424426 - DNA, 20 bp, Artificial
  CRISPR gRNA sequence
ccaggagagatacagctggg

SEQ ID NO: 424427 - DNA, 20 bp, Artificial
  CRISPR gRNA sequence
agagatacagctgggcagcc

SEQ ID NO: 424428 - DNA, 20 bp, Artificial
  CRISPR gRNA sequence
gatacagctgggcagccaag

SEQ ID NO: 424429 - DNA, 20 bp, Artificial
  CRISPR gRNA sequence
atacagctgggcagccaaga

SEQ ID NO: 424430 - DNA, 20 bp, Artificial
  CRISPR gRNA sequence
tacagctgggcagccaagaa

SEQ ID NO: 424431 - DNA, 20 bp, Artificial
  CRISPR gRNA sequence
ttgcttacatacataatcaa

SEQ ID NO: 424432 - DNA, 20 bp, Artificial
  CRISPR gRNA sequence
gcttacatacataatcaaaa

SEQ ID NO: 424433 - DNA, 20 bp, Artificial
  CRISPR gRNA sequence
cttacatacataatcaaaag

SEQ ID NO: 424434 - DNA, 20 bp, Artificial
  CRISPR gRNA sequence
atacataatcaaaagaggtc

SEQ ID NO: 424435 - DNA, 20 bp, Artificial
  CRISPR gRNA sequence
tcaaaagaggtcaagactac

SEQ ID NO: 424436 - DNA, 20 bp, Artificial
  CRISPR gRNA sequence
aaaagaggtcaagactacaa

SEQ ID NO: 424437 - DNA, 20 bp, Artificial
  CRISPR gRNA sequence
aagaggtcaagactacaaga

SEQ ID NO: 424438 - DNA, 20 bp, Artificial
  CRISPR gRNA sequence
aggtcaagactacaagagag

SEQ ID NO: 424439 - DNA, 20 bp, Artificial
  CRISPR gRNA sequence
ggtcaagactacaagagaga

SEQ ID NO: 424440 - DNA, 20 bp, Artificial
  CRISPR gRNA sequence
gactacaagagagaaggctg

SEQ ID NO: 424441 - DNA, 20 bp, Artificial
  CRISPR gRNA sequence
acaagagagaaggctgaagc

SEQ ID NO: 424442 - DNA, 20 bp, Artificial
  CRISPR gRNA sequence
gctgaagccagccaaccctg

SEQ ID NO: 424443 - DNA, 20 bp, Artificial
  CRISPR gRNA sequence
aagccagccaaccctgtgga

SEQ ID NO: 424444 - DNA, 20 bp, Artificial
  CRISPR gRNA sequence
agccaaccctgtggaaagtc

SEQ ID NO: 424445 - DNA, 20 bp, Artificial
  CRISPR gRNA sequence
gaaagtcaagatcctttgtc

SEQ ID NO: 424446 - DNA, 20 bp, Artificial
  CRISPR gRNA sequence
tgtccagtgttcatgtctat

SEQ ID NO: 424447 - DNA, 20 bp, Artificial
  CRISPR gRNA sequence
gtctatgagcactacttgaa

SEQ ID NO: 424448 - DNA, 20 bp, Artificial
  CRISPR gRNA sequence
agcactacttgaatggatac

SEQ ID NO: 424449 - DNA, 20 bp, Artificial
  CRISPR gRNA sequence
gataccagccatttgcctct

SEQ ID NO: 424450 - DNA, 20 bp, Artificial
  CRISPR gRNA sequence
accctattctgtgccctatg

SEQ ID NO: 424451 - DNA, 20 bp, Artificial
  CRISPR gRNA sequence
actaaatgtactacatcaat

SEQ ID NO: 424452 - DNA, 20 bp, Artificial
  CRISPR gRNA sequence
gtccccttatcctccatcct

SEQ ID NO: 424453 - DNA, 20 bp, Artificial
  CRISPR gRNA sequence
ttatcctccatcctaagttt

SEQ ID NO: 424454 - DNA, 20 bp, Artificial
  CRISPR gRNA sequence
tatcctccatcctaagtttg

SEQ ID NO: 424455 - DNA, 20 bp, Artificial
  CRISPR gRNA sequence
ctccatcctaagtttgaggt

SEQ ID NO: 424456 - DNA, 20 bp, Artificial
  CRISPR gRNA sequence
gtttgaggtcagccaatgca

SEQ ID NO: 424457 - DNA, 20 bp, Artificial
  CRISPR gRNA sequence
ggtcagccaatgcaaagcaa

SEQ ID NO: 424458 - DNA, 20 bp, Artificial
  CRISPR gRNA sequence
cagccaatgcaaagcaacag

SEQ ID NO: 424459 - DNA, 20 bp, Artificial
  CRISPR gRNA sequence
agccaatgcaaagcaacagt

SEQ ID NO: 424460 - DNA, 20 bp, Artificial
  CRISPR gRNA sequence
gccaatgcaaagcaacagta

SEQ ID NO: 424461 - DNA, 20 bp, Artificial
  CRISPR gRNA sequence
ccaatgcaaagcaacagtag

SEQ ID NO: 424462 - DNA, 20 bp, Artificial
  CRISPR gRNA sequence
gcaaagcaacagtaggggaa

SEQ ID NO: 424463 - DNA, 20 bp, Artificial
  CRISPR gRNA sequence
aaagcaacagtaggggaatg

SEQ ID NO: 424464 - DNA, 20 bp, Artificial
  CRISPR gRNA sequence
agcaacagtaggggaatgga

SEQ ID NO: 424465 - DNA, 20 bp, Artificial
  CRISPR gRNA sequence
caacagtaggggaatggaga

SEQ ID NO: 424466 - DNA, 20 bp, Artificial
  CRISPR gRNA sequence
aacagtaggggaatggagag

SEQ ID NO: 424467 - DNA, 20 bp, Artificial
  CRISPR gRNA sequence
aggggaatggagagaggaat

SEQ ID NO: 424468 - DNA, 20 bp, Artificial
  CRISPR gRNA sequence
aatggagagaggaatgagat

SEQ ID NO: 424469 - DNA, 20 bp, Artificial
  CRISPR gRNA sequence
atggagagaggaatgagatg

SEQ ID NO: 424470 - DNA, 20 bp, Artificial
  CRISPR gRNA sequence
tggagagaggaatgagatga

SEQ ID NO: 424471 - DNA, 20 bp, Artificial
  CRISPR gRNA sequence
aggaatgagatgagggtatg

SEQ ID NO: 424472 - DNA, 20 bp, Artificial
  CRISPR gRNA sequence
agttccctttgttctttctg

SEQ ID NO: 424473 - DNA, 20 bp, Artificial
  CRISPR gRNA sequence
gttccctttgttctttctgc

SEQ ID NO: 424474 - DNA, 20 bp, Artificial
  CRISPR gRNA sequence
ttccctttgttctttctgca

SEQ ID NO: 424475 - DNA, 20 bp, Artificial
  CRISPR gRNA sequence
cctttgttctttctgcaggg

SEQ ID NO: 424476 - DNA, 20 bp, Artificial
  CRISPR gRNA sequence
ttctttctgcagggtggcct

SEQ ID NO: 424477 - DNA, 20 bp, Artificial
  CRISPR gRNA sequence
tctgcagggtggccttggac

SEQ ID NO: 424478 - DNA, 20 bp, Artificial
  CRISPR gRNA sequence
ttggactggttgtgaccctc

SEQ ID NO: 424479 - DNA, 20 bp, Artificial
  CRISPR gRNA sequence
ctggttgtgaccctccagca

SEQ ID NO: 424480 - DNA, 20 bp, Artificial
  CRISPR gRNA sequence
tgaccctccagcaaagacta

SEQ ID NO: 424481 - DNA, 20 bp, Artificial
  CRISPR gRNA sequence
caaagactacagcacttctg

SEQ ID NO: 424482 - DNA, 20 bp, Artificial
  CRISPR gRNA sequence
aaagactacagcacttctga

SEQ ID NO: 424483 - DNA, 20 bp, Artificial
  CRISPR gRNA sequence
agactacagcacttctgaag

SEQ ID NO: 424484 - DNA, 20 bp, Artificial
  CRISPR gRNA sequence
tccacataactctctccttc

SEQ ID NO: 424485 - DNA, 20 bp, Artificial
  CRISPR gRNA sequence
ccacataactctctccttcc

SEQ ID NO: 424486 - DNA, 20 bp, Artificial
  CRISPR gRNA sequence
tccttccaggctccaataat

SEQ ID NO: 424487 - DNA, 20 bp, Artificial
  CRISPR gRNA sequence
agcccctcccctaccctttg

SEQ ID NO: 424488 - DNA, 20 bp, Artificial
  CRISPR gRNA sequence
tcccctaccctttgaagaac

SEQ ID NO: 424489 - DNA, 20 bp, Artificial
  CRISPR gRNA sequence
cccctaccctttgaagaact

SEQ ID NO: 424490 - DNA, 20 bp, Artificial
  CRISPR gRNA sequence
accctttgaagaactaggaa

SEQ ID NO: 424491 - DNA, 20 bp, Artificial
  CRISPR gRNA sequence
tgaagaactaggaatggtta

SEQ ID NO: 424492 - DNA, 20 bp, Artificial
  CRISPR gRNA sequence
caccttgctactcctccttg

SEQ ID NO: 424493 - DNA, 20 bp, Artificial
  CRISPR gRNA sequence
gtggtgtccttacatcctac

SEQ ID NO: 424494 - DNA, 20 bp, Artificial
  CRISPR gRNA sequence
cttacatcctactagacttc

SEQ ID NO: 424495 - DNA, 20 bp, Artificial
  CRISPR gRNA sequence
taaactgtcttcaaacaacc

SEQ ID NO: 424496 - DNA, 20 bp, Artificial
  CRISPR gRNA sequence
gtcttcaaacaacccagttt

SEQ ID NO: 424497 - DNA, 20 bp, Artificial
  CRISPR gRNA sequence
gagtactacatgttccctgc

SEQ ID NO: 424498 - DNA, 20 bp, Artificial
  CRISPR gRNA sequence
atgcaactataaaatgcttt

SEQ ID NO: 424499 - DNA, 20 bp, Artificial
  CRISPR gRNA sequence
aactataaaatgctttgagc

SEQ ID NO: 424500 - DNA, 20 bp, Artificial
  CRISPR gRNA sequence
actataaaatgctttgagca

SEQ ID NO: 424501 - DNA, 20 bp, Artificial
  CRISPR gRNA sequence
tataaaatgctttgagcaag

SEQ ID NO: 424502 - DNA, 20 bp, Artificial
  CRISPR gRNA sequence
taaaatgctttgagcaagga

SEQ ID NO: 424503 - DNA, 20 bp, Artificial
  CRISPR gRNA sequence
aaatgctttgagcaaggaga

SEQ ID NO: 424504 - DNA, 20 bp, Artificial
  CRISPR gRNA sequence
atgctttgagcaaggagaga

SEQ ID NO: 424505 - DNA, 20 bp, Artificial
  CRISPR gRNA sequence
tttgagcaaggagagagaga

SEQ ID NO: 424506 - DNA, 20 bp, Artificial
  CRISPR gRNA sequence
gagcaaggagagagagacag

SEQ ID NO: 424507 - DNA, 20 bp, Artificial
  CRISPR gRNA sequence
aagactgacaactatatcca

SEQ ID NO: 424508 - DNA, 20 bp, Artificial
  CRISPR gRNA sequence
tgacaactatatccaaagca

SEQ ID NO: 424509 - DNA, 20 bp, Artificial
  CRISPR gRNA sequence
gacaactatatccaaagcac

SEQ ID NO: 424510 - DNA, 20 bp, Artificial
  CRISPR gRNA sequence
actatatccaaagcacagga

SEQ ID NO: 424511 - DNA, 20 bp, Artificial
  CRISPR gRNA sequence
tccaaagcacaggaaagatg

SEQ ID NO: 424512 - DNA, 20 bp, Artificial
  CRISPR gRNA sequence
caaagcacaggaaagatgca

SEQ ID NO: 424513 - DNA, 20 bp, Artificial
  CRISPR gRNA sequence
aagcacaggaaagatgcaga

SEQ ID NO: 424514 - DNA, 20 bp, Artificial
  CRISPR gRNA sequence
agcacaggaaagatgcagag

SEQ ID NO: 424515 - DNA, 20 bp, Artificial
  CRISPR gRNA sequence
cagagaggacccacactaca

SEQ ID NO: 424516 - DNA, 20 bp, Artificial
  CRISPR gRNA sequence
agagaggacccacactacac

SEQ ID NO: 424517 - DNA, 20 bp, Artificial
  CRISPR gRNA sequence
gaggacccacactacacagg

SEQ ID NO: 424518 - DNA, 20 bp, Artificial
  CRISPR gRNA sequence
gacccacactacacaggaag

SEQ ID NO: 424519 - DNA, 20 bp, Artificial
  CRISPR gRNA sequence
ccacactacacaggaagcag

SEQ ID NO: 424520 - DNA, 20 bp, Artificial
  CRISPR gRNA sequence
acaggaagcagtggaaatgt

SEQ ID NO: 424521 - DNA, 20 bp, Artificial
  CRISPR gRNA sequence
aggaagcagtggaaatgtca

SEQ ID NO: 424522 - DNA, 20 bp, Artificial
  CRISPR gRNA sequence
gaagcagtggaaatgtcaga

SEQ ID NO: 424523 - DNA, 20 bp, Artificial
  CRISPR gRNA sequence
aagcagtggaaatgtcagag

SEQ ID NO: 424524 - DNA, 20 bp, Artificial
  CRISPR gRNA sequence
agcagtggaaatgtcagaga

SEQ ID NO: 424525 - DNA, 20 bp, Artificial
  CRISPR gRNA sequence
gtggaaatgtcagagagggc

SEQ ID NO: 424526 - DNA, 20 bp, Artificial
  CRISPR gRNA sequence
tggaaatgtcagagagggct

SEQ ID NO: 424527 - DNA, 20 bp, Artificial
  CRISPR gRNA sequence
ggaaatgtcagagagggctg

SEQ ID NO: 424528 - DNA, 20 bp, Artificial
  CRISPR gRNA sequence
ggctggggaatcaaacactg

SEQ ID NO: 424529 - DNA, 20 bp, Artificial
  CRISPR gRNA sequence
ggggaatcaaacactgtaga

SEQ ID NO: 424530 - DNA, 20 bp, Artificial
  CRISPR gRNA sequence
gggaatcaaacactgtagaa

SEQ ID NO: 424531 - DNA, 20 bp, Artificial
  CRISPR gRNA sequence
ggaatcaaacactgtagaaa

SEQ ID NO: 424532 - DNA, 20 bp, Artificial
  CRISPR gRNA sequence
aatcaaacactgtagaaagg

SEQ ID NO: 424533 - DNA, 20 bp, Artificial
  CRISPR gRNA sequence
acactgtagaaagggagcaa

SEQ ID NO: 424534 - DNA, 20 bp, Artificial
  CRISPR gRNA sequence
cactgtagaaagggagcaac

SEQ ID NO: 424535 - DNA, 20 bp, Artificial
  CRISPR gRNA sequence
aagggagcaacaggactcaa

SEQ ID NO: 424536 - DNA, 20 bp, Artificial
  CRISPR gRNA sequence
agggagcaacaggactcaat

SEQ ID NO: 424537 - DNA, 20 bp, Artificial
  CRISPR gRNA sequence
ttttctctttctctaccctc

SEQ ID NO: 424538 - DNA, 20 bp, Artificial
  CRISPR gRNA sequence
ctctaccctccagatgacca

SEQ ID NO: 424539 - DNA, 20 bp, Artificial
  CRISPR gRNA sequence
accctccagatgaccaaagt

SEQ ID NO: 424540 - DNA, 20 bp, Artificial
  CRISPR gRNA sequence
ccagatgaccaaagttagtc

SEQ ID NO: 424541 - DNA, 20 bp, Artificial
  CRISPR gRNA sequence
cagatgaccaaagttagtcc

SEQ ID NO: 424542 - DNA, 20 bp, Artificial
  CRISPR gRNA sequence
ccaaagttagtccaggtgcc

SEQ ID NO: 424543 - DNA, 20 bp, Artificial
  CRISPR gRNA sequence
tgcccagaatgaaaattaac

SEQ ID NO: 424544 - DNA, 20 bp, Artificial
  CRISPR gRNA sequence
aaccagtcttgaatccttaa

SEQ ID NO: 424545 - DNA, 20 bp, Artificial
  CRISPR gRNA sequence
accagtcttgaatccttaac

SEQ ID NO: 424546 - DNA, 20 bp, Artificial
  CRISPR gRNA sequence
tcttgaatccttaacaggaa

SEQ ID NO: 424547 - DNA, 20 bp, Artificial
  CRISPR gRNA sequence
ccttaacaggaaaagttgtt

SEQ ID NO: 424548 - DNA, 20 bp, Artificial
  CRISPR gRNA sequence
aagttgttcagctccttcta

SEQ ID NO: 424549 - DNA, 20 bp, Artificial
  CRISPR gRNA sequence
gttgttcagctccttctaaa

SEQ ID NO: 424550 - DNA, 20 bp, Artificial
  CRISPR gRNA sequence
agcctttgattcttttattc

SEQ ID NO: 424551 - DNA, 20 bp, Artificial
  CRISPR gRNA sequence
attcttttattccagaccat

SEQ ID NO: 424552 - DNA, 20 bp, Artificial
  CRISPR gRNA sequence
ttcttttattccagaccatc

SEQ ID NO: 424553 - DNA, 20 bp, Artificial
  CRISPR gRNA sequence
gaccatcaggacactgctaa

SEQ ID NO: 424554 - DNA, 20 bp, Artificial
  CRISPR gRNA sequence
catcaggacactgctaacag

SEQ ID NO: 424555 - DNA, 20 bp, Artificial
  CRISPR gRNA sequence
tcaggacactgctaacagca

SEQ ID NO: 424556 - DNA, 20 bp, Artificial
  CRISPR gRNA sequence
aacctgttcaccaaccacca

SEQ ID NO: 424557 - DNA, 20 bp, Artificial
  CRISPR gRNA sequence
ctgttcaccaaccaccatag

SEQ ID NO: 424558 - DNA, 20 bp, Artificial
  CRISPR gRNA sequence
caccatagcagctcccttcc

SEQ ID NO: 424559 - DNA, 20 bp, Artificial
  CRISPR gRNA sequence
tagcagctcccttcccagct

SEQ ID NO: 424560 - DNA, 20 bp, Artificial
  CRISPR gRNA sequence
gcagctcccttcccagctaa

SEQ ID NO: 424561 - DNA, 20 bp, Artificial
  CRISPR gRNA sequence
ctcttgtcctcaccttccca

SEQ ID NO: 424562 - DNA, 20 bp, Artificial
  CRISPR gRNA sequence
cttgtcctcaccttcccata

SEQ ID NO: 424563 - DNA, 20 bp, Artificial
  CRISPR gRNA sequence
ttgtcctcaccttcccatag

SEQ ID NO: 424564 - DNA, 20 bp, Artificial
  CRISPR gRNA sequence
tgtcctcaccttcccataga

SEQ ID NO: 424565 - DNA, 20 bp, Artificial
  CRISPR gRNA sequence
cctcattatgtctattgtga

SEQ ID NO: 424566 - DNA, 20 bp, Artificial
  CRISPR gRNA sequence
acacataaatgaaaatatta

SEQ ID NO: 424567 - DNA, 20 bp, Artificial
  CRISPR gRNA sequence
tagatcattgactttcccaa

SEQ ID NO: 424568 - DNA, 20 bp, Artificial
  CRISPR gRNA sequence
attgactttcccaatagcac

SEQ ID NO: 424569 - DNA, 20 bp, Artificial
  CRISPR gRNA sequence
caatagcaccagccatgtct

SEQ ID NO: 424570 - DNA, 20 bp, Artificial
  CRISPR gRNA sequence
cagccatgtctcagccactg

SEQ ID NO: 424571 - DNA, 20 bp, Artificial
  CRISPR gRNA sequence
ctcagccactgcagttcaac

SEQ ID NO: 424572 - DNA, 20 bp, Artificial
  CRISPR gRNA sequence
tcagccactgcagttcaacc

SEQ ID NO: 424573 - DNA, 20 bp, Artificial
  CRISPR gRNA sequence
actgcagttcaaccaggctg

SEQ ID NO: 424574 - DNA, 20 bp, Artificial
  CRISPR gRNA sequence
ttcaaccaggctgcagaact

SEQ ID NO: 424575 - DNA, 20 bp, Artificial
  CRISPR gRNA sequence
gaactgagttgttaattgaa

SEQ ID NO: 424576 - DNA, 20 bp, Artificial
  CRISPR gRNA sequence
agttgttaattgaatggaat

SEQ ID NO: 424577 - DNA, 20 bp, Artificial
  CRISPR gRNA sequence
ttgttaattgaatggaatta

SEQ ID NO: 424578 - DNA, 20 bp, Artificial
  CRISPR gRNA sequence
taattgaatggaattagagt

SEQ ID NO: 424579 - DNA, 20 bp, Artificial
  CRISPR gRNA sequence
attgaatggaattagagttg

SEQ ID NO: 424580 - DNA, 20 bp, Artificial
  CRISPR gRNA sequence
ttgaatggaattagagttgg

SEQ ID NO: 424581 - DNA, 20 bp, Artificial
  CRISPR gRNA sequence
tggaattagagttggaggaa

SEQ ID NO: 424582 - DNA, 20 bp, Artificial
  CRISPR gRNA sequence
aattagagttggaggaaaag

SEQ ID NO: 424583 - DNA, 20 bp, Artificial
  CRISPR gRNA sequence
attagagttggaggaaaagt

SEQ ID NO: 424584 - DNA, 20 bp, Artificial
  CRISPR gRNA sequence
gagttggaggaaaagtgggt

SEQ ID NO: 424585 - DNA, 20 bp, Artificial
  CRISPR gRNA sequence
agttggaggaaaagtgggtt

SEQ ID NO: 424586 - DNA, 20 bp, Artificial
  CRISPR gRNA sequence
ggaaaagtgggttaggatct

SEQ ID NO: 424587 - DNA, 20 bp, Artificial
  CRISPR gRNA sequence
gaaaagtgggttaggatctc

SEQ ID NO: 424588 - DNA, 20 bp, Artificial
  CRISPR gRNA sequence
aagtgggttaggatctcagg

SEQ ID NO: 424589 - DNA, 20 bp, Artificial
  CRISPR gRNA sequence
gtgggttaggatctcaggtg

SEQ ID NO: 424590 - DNA, 20 bp, Artificial
  CRISPR gRNA sequence
tgggttaggatctcaggtgg

SEQ ID NO: 424591 - DNA, 20 bp, Artificial
  CRISPR gRNA sequence
gggttaggatctcaggtgga

SEQ ID NO: 424592 - DNA, 20 bp, Artificial
  CRISPR gRNA sequence
aggatctcaggtggagggtc

SEQ ID NO: 424593 - DNA, 20 bp, Artificial
  CRISPR gRNA sequence
ggatctcaggtggagggtct

SEQ ID NO: 424594 - DNA, 20 bp, Artificial
  CRISPR gRNA sequence
gatctcaggtggagggtctg

SEQ ID NO: 424595 - DNA, 20 bp, Artificial
  CRISPR gRNA sequence
caggtggagggtctggggta

SEQ ID NO: 424596 - DNA, 20 bp, Artificial
  CRISPR gRNA sequence
aggtggagggtctggggtaa

SEQ ID NO: 424597 - DNA, 20 bp, Artificial
  CRISPR gRNA sequence
tggagggtctggggtaaagg

SEQ ID NO: 424598 - DNA, 20 bp, Artificial
  CRISPR gRNA sequence
tgtttcccaaaatatttatg

SEQ ID NO: 424599 - DNA, 20 bp, Artificial
  CRISPR gRNA sequence
tttatgtggtgacttgaatt

SEQ ID NO: 424600 - DNA, 20 bp, Artificial
  CRISPR gRNA sequence
ttatgtggtgacttgaatta

SEQ ID NO: 424601 - DNA, 20 bp, Artificial
  CRISPR gRNA sequence
tgacttgaattaaggtgacc

SEQ ID NO: 424602 - DNA, 20 bp, Artificial
  CRISPR gRNA sequence
gacttgaattaaggtgacct

SEQ ID NO: 424603 - DNA, 20 bp, Artificial
  CRISPR gRNA sequence
gaattaaggtgacctgggct

SEQ ID NO: 424604 - DNA, 20 bp, Artificial
  CRISPR gRNA sequence
acctgggctgagctgactta

SEQ ID NO: 424605 - DNA, 20 bp, Artificial
  CRISPR gRNA sequence
cctgggctgagctgacttaa

SEQ ID NO: 424606 - DNA, 20 bp, Artificial
  CRISPR gRNA sequence
ctgggctgagctgacttaaa

SEQ ID NO: 424607 - DNA, 20 bp, Artificial
  CRISPR gRNA sequence
tgagctgacttaaagggccc

SEQ ID NO: 424608 - DNA, 20 bp, Artificial
  CRISPR gRNA sequence
agctgacttaaagggcccaa

SEQ ID NO: 424609 - DNA, 20 bp, Artificial
  CRISPR gRNA sequence
acttaaagggcccaagagat

SEQ ID NO: 424610 - DNA, 20 bp, Artificial
  CRISPR gRNA sequence
cccaagagatcagacaaaac

SEQ ID NO: 424611 - DNA, 20 bp, Artificial
  CRISPR gRNA sequence
ccaagagatcagacaaaaca

SEQ ID NO: 424612 - DNA, 20 bp, Artificial
  CRISPR gRNA sequence
aagagatcagacaaaacaag

SEQ ID NO: 424613 - DNA, 20 bp, Artificial
  CRISPR gRNA sequence
agatcagacaaaacaaggag

SEQ ID NO: 424614 - DNA, 20 bp, Artificial
  CRISPR gRNA sequence
tcactcctcccaatcaatac

SEQ ID NO: 424615 - DNA, 20 bp, Artificial
  CRISPR gRNA sequence
ctcctcccaatcaataccag

SEQ ID NO: 424616 - DNA, 20 bp, Artificial
  CRISPR gRNA sequence
ataattctttgttatttata

SEQ ID NO: 424617 - DNA, 20 bp, Artificial
  CRISPR gRNA sequence
ttcatcacaactctatgata

SEQ ID NO: 424618 - DNA, 20 bp, Artificial
  CRISPR gRNA sequence
catcacaactctatgatata

SEQ ID NO: 424619 - DNA, 20 bp, Artificial
  CRISPR gRNA sequence
acaactctatgatatagagt

SEQ ID NO: 424620 - DNA, 20 bp, Artificial
  CRISPR gRNA sequence
gagtaagccgaattataata

SEQ ID NO: 424621 - DNA, 20 bp, Artificial
  CRISPR gRNA sequence
gccgaattataatacagcta

SEQ ID NO: 424622 - DNA, 20 bp, Artificial
  CRISPR gRNA sequence
ggttttaatgtgtcccccaa

SEQ ID NO: 424623 - DNA, 20 bp, Artificial
  CRISPR gRNA sequence
gttttaatgtgtcccccaaa

SEQ ID NO: 424624 - DNA, 20 bp, Artificial
  CRISPR gRNA sequence
tcccccaaaaggccatgtgt

SEQ ID NO: 424625 - DNA, 20 bp, Artificial
  CRISPR gRNA sequence
aaacttaattaccattgtaa

SEQ ID NO: 424626 - DNA, 20 bp, Artificial
  CRISPR gRNA sequence
attaccattgtaatagtatt

SEQ ID NO: 424627 - DNA, 20 bp, Artificial
  CRISPR gRNA sequence
accattgtaatagtattaag

SEQ ID NO: 424628 - DNA, 20 bp, Artificial
  CRISPR gRNA sequence
tattaagtggtaatgctttt

SEQ ID NO: 424629 - DNA, 20 bp, Artificial
  CRISPR gRNA sequence
ttaagtggtaatgcttttaa

SEQ ID NO: 424630 - DNA, 20 bp, Artificial
  CRISPR gRNA sequence
taagtggtaatgcttttaag

SEQ ID NO: 424631 - DNA, 20 bp, Artificial
  CRISPR gRNA sequence
taatgcttttaagaggtgat

SEQ ID NO: 424632 - DNA, 20 bp, Artificial
  CRISPR gRNA sequence
aatgcttttaagaggtgatt

SEQ ID NO: 424633 - DNA, 20 bp, Artificial
  CRISPR gRNA sequence
taagaggtgattaggccatg

SEQ ID NO: 424634 - DNA, 20 bp, Artificial
  CRISPR gRNA sequence
catgaagatctgccctcatg

SEQ ID NO: 424635 - DNA, 20 bp, Artificial
  CRISPR gRNA sequence
atgaagatctgccctcatga

SEQ ID NO: 424636 - DNA, 20 bp, Artificial
  CRISPR gRNA sequence
tgaagatctgccctcatgaa

SEQ ID NO: 424637 - DNA, 20 bp, Artificial
  CRISPR gRNA sequence
agggattaatgccattatct

SEQ ID NO: 424638 - DNA, 20 bp, Artificial
  CRISPR gRNA sequence
gggattaatgccattatctc

SEQ ID NO: 424639 - DNA, 20 bp, Artificial
  CRISPR gRNA sequence
gattaatgccattatctcag

SEQ ID NO: 424640 - DNA, 20 bp, Artificial
  CRISPR gRNA sequence
taatgccattatctcaggag

SEQ ID NO: 424641 - DNA, 20 bp, Artificial
  CRISPR gRNA sequence
aatgccattatctcaggagt

SEQ ID NO: 424642 - DNA, 20 bp, Artificial
  CRISPR gRNA sequence
ccattatctcaggagtgggt

SEQ ID NO: 424643 - DNA, 20 bp, Artificial
  CRISPR gRNA sequence
cattatctcaggagtgggtt

SEQ ID NO: 424644 - DNA, 20 bp, Artificial
  CRISPR gRNA sequence
caggagtgggttaggtatca

SEQ ID NO: 424645 - DNA, 20 bp, Artificial
  CRISPR gRNA sequence
aggagtgggttaggtatcat

SEQ ID NO: 424646 - DNA, 20 bp, Artificial
  CRISPR gRNA sequence
gagtgggttaggtatcatgg

SEQ ID NO: 424647 - DNA, 20 bp, Artificial
  CRISPR gRNA sequence
gggttaggtatcatgggagt

SEQ ID NO: 424648 - DNA, 20 bp, Artificial
  CRISPR gRNA sequence
gggagtaagttcctaattaa

SEQ ID NO: 424649 - DNA, 20 bp, Artificial
  CRISPR gRNA sequence
ggagtaagttcctaattaaa

SEQ ID NO: 424650 - DNA, 20 bp, Artificial
  CRISPR gRNA sequence
cctaattaaaaggatgaatt

SEQ ID NO: 424651 - DNA, 20 bp, Artificial
  CRISPR gRNA sequence
tcacatgatgccttctgccg

SEQ ID NO: 424652 - DNA, 20 bp, Artificial
  CRISPR gRNA sequence
cacatgatgccttctgccgt

SEQ ID NO: 424653 - DNA, 20 bp, Artificial
  CRISPR gRNA sequence
cgccaaatacaccatgctcc

SEQ ID NO: 424654 - DNA, 20 bp, Artificial
  CRISPR gRNA sequence
caccatgctcctggacttcc

SEQ ID NO: 424655 - DNA, 20 bp, Artificial
  CRISPR gRNA sequence
ctcctggacttcccagcctc

SEQ ID NO: 424656 - DNA, 20 bp, Artificial
  CRISPR gRNA sequence
ttcccagcctccagaaccat

SEQ ID NO: 424657 - DNA, 20 bp, Artificial
  CRISPR gRNA sequence
ccaataattgtattctgtta

SEQ ID NO: 424658 - DNA, 20 bp, Artificial
  CRISPR gRNA sequence
ataattgtattctgttacag

SEQ ID NO: 424659 - DNA, 20 bp, Artificial
  CRISPR gRNA sequence
attgtattctgttacagcgg

SEQ ID NO: 424660 - DNA, 20 bp, Artificial
  CRISPR gRNA sequence
tctgttacagcggcagaaaa

SEQ ID NO: 424661 - DNA, 20 bp, Artificial
  CRISPR gRNA sequence
acagcggcagaaaatagact

SEQ ID NO: 424662 - DNA, 20 bp, Artificial
  CRISPR gRNA sequence
caaatccccattttatatat

SEQ ID NO: 424663 - DNA, 20 bp, Artificial
  CRISPR gRNA sequence
aaatccccattttatatata

SEQ ID NO: 424664 - DNA, 20 bp, Artificial
  CRISPR gRNA sequence
attttatatataaggaaatg

SEQ ID NO: 424665 - DNA, 20 bp, Artificial
  CRISPR gRNA sequence
taaggaaatgaagaccttga

SEQ ID NO: 424666 - DNA, 20 bp, Artificial
  CRISPR gRNA sequence
aatgaagaccttgaaagatt

SEQ ID NO: 424667 - DNA, 20 bp, Artificial
  CRISPR gRNA sequence
agattaagtaactttcctaa

SEQ ID NO: 424668 - DNA, 20 bp, Artificial
  CRISPR gRNA sequence
ctttcctaaaagcatacact

SEQ ID NO: 424669 - DNA, 20 bp, Artificial
  CRISPR gRNA sequence
catacactcagtgccaaaac

SEQ ID NO: 424670 - DNA, 20 bp, Artificial
  CRISPR gRNA sequence
tcagtgccaaaactagaaac

SEQ ID NO: 424671 - DNA, 20 bp, Artificial
  CRISPR gRNA sequence
ttccccattcattactcttt

SEQ ID NO: 424672 - DNA, 20 bp, Artificial
  CRISPR gRNA sequence
cattactctttcagccacat

SEQ ID NO: 424673 - DNA, 20 bp, Artificial
  CRISPR gRNA sequence
tttcagccacataagctctt

SEQ ID NO: 424674 - DNA, 20 bp, Artificial
  CRISPR gRNA sequence
acataagctcttaagctaaa

SEQ ID NO: 424675 - DNA, 20 bp, Artificial
  CRISPR gRNA sequence
ataagctcttaagctaaaca

SEQ ID NO: 424676 - DNA, 20 bp, Artificial
  CRISPR gRNA sequence
taagctcttaagctaaacag

SEQ ID NO: 424677 - DNA, 20 bp, Artificial
  CRISPR gRNA sequence
caccaatttttttttttttt

SEQ ID NO: 424678 - DNA, 20 bp, Artificial
  CRISPR gRNA sequence
ccaattttttttttttttta

SEQ ID NO: 424679 - DNA, 20 bp, Artificial
  CRISPR gRNA sequence
tttttttttttttttagaga

SEQ ID NO: 424680 - DNA, 20 bp, Artificial
  CRISPR gRNA sequence
tttttttttttttagagata

SEQ ID NO: 424681 - DNA, 20 bp, Artificial
  CRISPR gRNA sequence
tcttgctctgttgcccacgc

SEQ ID NO: 424682 - DNA, 20 bp, Artificial
  CRISPR gRNA sequence
ttgctctgttgcccacgctg

SEQ ID NO: 424683 - DNA, 20 bp, Artificial
  CRISPR gRNA sequence
ctgttgcccacgctggagtg

SEQ ID NO: 424684 - DNA, 20 bp, Artificial
  CRISPR gRNA sequence
cccacgctggagtgcagtca

SEQ ID NO: 424685 - DNA, 20 bp, Artificial
  CRISPR gRNA sequence
agtgcagtcatagctcactg

SEQ ID NO: 424686 - DNA, 20 bp, Artificial
  CRISPR gRNA sequence
tcactgcagccttgaactcc

SEQ ID NO: 424687 - DNA, 20 bp, Artificial
  CRISPR gRNA sequence
actgcagccttgaactccta

SEQ ID NO: 424688 - DNA, 20 bp, Artificial
  CRISPR gRNA sequence
agccttgaactcctagagtc

SEQ ID NO: 424689 - DNA, 20 bp, Artificial
  CRISPR gRNA sequence
gtcaagtgatcctcccgcca

SEQ ID NO: 424690 - DNA, 20 bp, Artificial
  CRISPR gRNA sequence
tcctcccgccacagtctccc

SEQ ID NO: 424691 - DNA, 20 bp, Artificial
  CRISPR gRNA sequence
tcccgccacagtctcccgag

SEQ ID NO: 424692 - DNA, 20 bp, Artificial
  CRISPR gRNA sequence
cccgccacagtctcccgagt

SEQ ID NO: 424693 - DNA, 20 bp, Artificial
  CRISPR gRNA sequence
gccacagtctcccgagtggg

SEQ ID NO: 424694 - DNA, 20 bp, Artificial
  CRISPR gRNA sequence
tggaattatgtctattgtga

SEQ ID NO: 424695 - DNA, 20 bp, Artificial
  CRISPR gRNA sequence
acacataaatgaaaatatta

SEQ ID NO: 424696 - DNA, 20 bp, Artificial
  CRISPR gRNA sequence
cagatcattgactttcccaa

SEQ ID NO: 424697 - DNA, 20 bp, Artificial
  CRISPR gRNA sequence
attgactttcccaatagcac

SEQ ID NO: 424698 - DNA, 20 bp, Artificial
  CRISPR gRNA sequence
aatagcaccagccatatctg

SEQ ID NO: 424699 - DNA, 20 bp, Artificial
  CRISPR gRNA sequence
cagccatatctgtggcttct

SEQ ID NO: 424700 - DNA, 20 bp, Artificial
  CRISPR gRNA sequence
agccatatctgtggcttctg

SEQ ID NO: 424701 - DNA, 20 bp, Artificial
  CRISPR gRNA sequence
atctgtggcttctgaggtgt

SEQ ID NO: 424702 - DNA, 20 bp, Artificial
  CRISPR gRNA sequence
ggcttctgaggtgtgagcca

SEQ ID NO: 424703 - DNA, 20 bp, Artificial
  CRISPR gRNA sequence
gaggtgtgagccacagctcc

SEQ ID NO: 424704 - DNA, 20 bp, Artificial
  CRISPR gRNA sequence
ctggcctaaccctacatttt

SEQ ID NO: 424705 - DNA, 20 bp, Artificial
  CRISPR gRNA sequence
ggcctaaccctacatttttg

SEQ ID NO: 424706 - DNA, 20 bp, Artificial
  CRISPR gRNA sequence
agtgtttatttctcattcta

SEQ ID NO: 424707 - DNA, 20 bp, Artificial
  CRISPR gRNA sequence
ttctcattctacagacatgc

SEQ ID NO: 424708 - DNA, 20 bp, Artificial
  CRISPR gRNA sequence
tctcattctacagacatgct

SEQ ID NO: 424709 - DNA, 20 bp, Artificial
  CRISPR gRNA sequence
tacagacatgctgggtaacc

SEQ ID NO: 424710 - DNA, 20 bp, Artificial
  CRISPR gRNA sequence
gctgggtaacctagcactac

SEQ ID NO: 424711 - DNA, 20 bp, Artificial
  CRISPR gRNA sequence
tgggtaacctagcactacca

SEQ ID NO: 424712 - DNA, 20 bp, Artificial
  CRISPR gRNA sequence
ggtaacctagcactaccaga

SEQ ID NO: 424713 - DNA, 20 bp, Artificial
  CRISPR gRNA sequence
cagagagttgtaataatcaa

SEQ ID NO: 424714 - DNA, 20 bp, Artificial
  CRISPR gRNA sequence
gagagttgtaataatcaaaa

SEQ ID NO: 424715 - DNA, 20 bp, Artificial
  CRISPR gRNA sequence
taatcaaaagagctaatgtg

SEQ ID NO: 424716 - DNA, 20 bp, Artificial
  CRISPR gRNA sequence
caaaagagctaatgtgcaga

SEQ ID NO: 424717 - DNA, 20 bp, Artificial
  CRISPR gRNA sequence
agctaatgtgcagaaagctc

SEQ ID NO: 424718 - DNA, 20 bp, Artificial
  CRISPR gRNA sequence
gcagaaagctctagcatata

SEQ ID NO: 424719 - DNA, 20 bp, Artificial
  CRISPR gRNA sequence
cccacgatgcatcaaaatca

SEQ ID NO: 424720 - DNA, 20 bp, Artificial
  CRISPR gRNA sequence
acgatgcatcaaaatcatag

SEQ ID NO: 424721 - DNA, 20 bp, Artificial
  CRISPR gRNA sequence
tagtagataaattaaactct

SEQ ID NO: 424722 - DNA, 20 bp, Artificial
  CRISPR gRNA sequence
gtagataaattaaactctca

SEQ ID NO: 424723 - DNA, 20 bp, Artificial
  CRISPR gRNA sequence
gataaattaaactctcagag

SEQ ID NO: 424724 - DNA, 20 bp, Artificial
  CRISPR gRNA sequence
aaattaaactctcagagcag

SEQ ID NO: 424725 - DNA, 20 bp, Artificial
  CRISPR gRNA sequence
aactctcagagcagtggctt

SEQ ID NO: 424726 - DNA, 20 bp, Artificial
  CRISPR gRNA sequence
actctcagagcagtggctta

SEQ ID NO: 424727 - DNA, 20 bp, Artificial
  CRISPR gRNA sequence
ctctcagagcagtggcttaa

SEQ ID NO: 424728 - DNA, 20 bp, Artificial
  CRISPR gRNA sequence
agagcagtggcttaagggat

SEQ ID NO: 424729 - DNA, 20 bp, Artificial
  CRISPR gRNA sequence
gcagtggcttaagggataag

SEQ ID NO: 424730 - DNA, 20 bp, Artificial
  CRISPR gRNA sequence
cttaagggataagcagaaac

SEQ ID NO: 424731 - DNA, 20 bp, Artificial
  CRISPR gRNA sequence
ttaagggataagcagaaacc

SEQ ID NO: 424732 - DNA, 20 bp, Artificial
  CRISPR gRNA sequence
aagggataagcagaaaccag

SEQ ID NO: 424733 - DNA, 20 bp, Artificial
  CRISPR gRNA sequence
aaaccaggagttacaaatga

SEQ ID NO: 424734 - DNA, 20 bp, Artificial
  CRISPR gRNA sequence
caggagttacaaatgacagc

SEQ ID NO: 424735 - DNA, 20 bp, Artificial
  CRISPR gRNA sequence
agttacaaatgacagcaaga

SEQ ID NO: 424736 - DNA, 20 bp, Artificial
  CRISPR gRNA sequence
gttacaaatgacagcaagat

SEQ ID NO: 424737 - DNA, 20 bp, Artificial
  CRISPR gRNA sequence
acaaatgacagcaagatggg

SEQ ID NO: 424738 - DNA, 20 bp, Artificial
  CRISPR gRNA sequence
caaatgacagcaagatgggt

SEQ ID NO: 424739 - DNA, 20 bp, Artificial
  CRISPR gRNA sequence
acagcaagatgggtaggaaa

SEQ ID NO: 424740 - DNA, 20 bp, Artificial
  CRISPR gRNA sequence
cagcaagatgggtaggaaac

SEQ ID NO: 424741 - DNA, 20 bp, Artificial
  CRISPR gRNA sequence
agatgggtaggaaacaggtc

SEQ ID NO: 424742 - DNA, 20 bp, Artificial
  CRISPR gRNA sequence
aggaaacaggtccagctgtc

SEQ ID NO: 424743 - DNA, 20 bp, Artificial
  CRISPR gRNA sequence
ggaaacaggtccagctgtcc

SEQ ID NO: 424744 - DNA, 20 bp, Artificial
  CRISPR gRNA sequence
gaaacaggtccagctgtcca

SEQ ID NO: 424745 - DNA, 20 bp, Artificial
  CRISPR gRNA sequence
aaacaggtccagctgtccag

SEQ ID NO: 424746 - DNA, 20 bp, Artificial
  CRISPR gRNA sequence
aacaggtccagctgtccagg

SEQ ID NO: 424747 - DNA, 20 bp, Artificial
  CRISPR gRNA sequence
tccagggggtccctccctat

SEQ ID NO: 424748 - DNA, 20 bp, Artificial
  CRISPR gRNA sequence
cagggggtccctccctatga

SEQ ID NO: 424749 - DNA, 20 bp, Artificial
  CRISPR gRNA sequence
agggggtccctccctatgag

SEQ ID NO: 424750 - DNA, 20 bp, Artificial
  CRISPR gRNA sequence
gggggtccctccctatgaga

SEQ ID NO: 424751 - DNA, 20 bp, Artificial
  CRISPR gRNA sequence
cctccctatgagagggacaa

SEQ ID NO: 424752 - DNA, 20 bp, Artificial
  CRISPR gRNA sequence
ccctatgagagggacaacgg

SEQ ID NO: 424753 - DNA, 20 bp, Artificial
  CRISPR gRNA sequence
ctatgagagggacaacggaa

SEQ ID NO: 424754 - DNA, 20 bp, Artificial
  CRISPR gRNA sequence
agcataaataactgcactaa

SEQ ID NO: 424755 - DNA, 20 bp, Artificial
  CRISPR gRNA sequence
gcataaataactgcactaat

SEQ ID NO: 424756 - DNA, 20 bp, Artificial
  CRISPR gRNA sequence
taaataactgcactaatagg

SEQ ID NO: 424757 - DNA, 20 bp, Artificial
  CRISPR gRNA sequence
ctaataggcagaacaaatgc

SEQ ID NO: 424758 - DNA, 20 bp, Artificial
  CRISPR gRNA sequence
taataggcagaacaaatgcc

SEQ ID NO: 424759 - DNA, 20 bp, Artificial
  CRISPR gRNA sequence
gcagaacaaatgccaggaaa

SEQ ID NO: 424760 - DNA, 20 bp, Artificial
  CRISPR gRNA sequence
cagaacaaatgccaggaaaa

SEQ ID NO: 424761 - DNA, 20 bp, Artificial
  CRISPR gRNA sequence
aatgccaggaaaaaggcaca

SEQ ID NO: 424762 - DNA, 20 bp, Artificial
  CRISPR gRNA sequence
tgccaggaaaaaggcacaaa

SEQ ID NO: 424763 - DNA, 20 bp, Artificial
  CRISPR gRNA sequence
aaaaaggcacaaagagcact

SEQ ID NO: 424764 - DNA, 20 bp, Artificial
  CRISPR gRNA sequence
aaaaggcacaaagagcactc

SEQ ID NO: 424765 - DNA, 20 bp, Artificial
  CRISPR gRNA sequence
aggcacaaagagcactcggg

SEQ ID NO: 424766 - DNA, 20 bp, Artificial
  CRISPR gRNA sequence
gcactcgggaagatcacatc

SEQ ID NO: 424767 - DNA, 20 bp, Artificial
  CRISPR gRNA sequence
cactcgggaagatcacatct

SEQ ID NO: 424768 - DNA, 20 bp, Artificial
  CRISPR gRNA sequence
atcacatctgggtctctctc

SEQ ID NO: 424769 - DNA, 20 bp, Artificial
  CRISPR gRNA sequence
tcacatctgggtctctctct

SEQ ID NO: 424770 - DNA, 20 bp, Artificial
  CRISPR gRNA sequence
catctgggtctctctctggg

SEQ ID NO: 424771 - DNA, 20 bp, Artificial
  CRISPR gRNA sequence
tgggtctctctctgggtgga

SEQ ID NO: 424772 - DNA, 20 bp, Artificial
  CRISPR gRNA sequence
ggtctctctctgggtggaaa

SEQ ID NO: 424773 - DNA, 20 bp, Artificial
  CRISPR gRNA sequence
tgggtggaaagagaacctga

SEQ ID NO: 424774 - DNA, 20 bp, Artificial
  CRISPR gRNA sequence
gggtggaaagagaacctgaa

SEQ ID NO: 424775 - DNA, 20 bp, Artificial
  CRISPR gRNA sequence
aaagagaacctgaaaggacc

SEQ ID NO: 424776 - DNA, 20 bp, Artificial
  CRISPR gRNA sequence
aagagaacctgaaaggaccc

SEQ ID NO: 424777 - DNA, 20 bp, Artificial
  CRISPR gRNA sequence
acctgaaaggacccgggtgc

SEQ ID NO: 424778 - DNA, 20 bp, Artificial
  CRISPR gRNA sequence
aaggacccgggtgccagacg

SEQ ID NO: 424779 - DNA, 20 bp, Artificial
  CRISPR gRNA sequence
aggacccgggtgccagacgt

SEQ ID NO: 424780 - DNA, 20 bp, Artificial
  CRISPR gRNA sequence
ggacccgggtgccagacgtg

SEQ ID NO: 424781 - DNA, 20 bp, Artificial
  CRISPR gRNA sequence
gacccgggtgccagacgtgg

SEQ ID NO: 424782 - DNA, 20 bp, Artificial
  CRISPR gRNA sequence
cgtgggggtgcccatgactg

SEQ ID NO: 424783 - DNA, 20 bp, Artificial
  CRISPR gRNA sequence
gtgcccatgactgcggtgtg

SEQ ID NO: 424784 - DNA, 20 bp, Artificial
  CRISPR gRNA sequence
ccatgactgcggtgtgcagc

SEQ ID NO: 424785 - DNA, 20 bp, Artificial
  CRISPR gRNA sequence
atgactgcggtgtgcagccg

SEQ ID NO: 424786 - DNA, 20 bp, Artificial
  CRISPR gRNA sequence
agccggagccattacctttc

SEQ ID NO: 424787 - DNA, 20 bp, Artificial
  CRISPR gRNA sequence
ccaccacgatgactgctgtg

SEQ ID NO: 424788 - DNA, 20 bp, Artificial
  CRISPR gRNA sequence
actgctgtgcagatgaccac

SEQ ID NO: 424789 - DNA, 20 bp, Artificial
  CRISPR gRNA sequence
gcagatgaccaccagcgtcg

SEQ ID NO: 424790 - DNA, 20 bp, Artificial
  CRISPR gRNA sequence
gaccaccagcgtcgcggcca

SEQ ID NO: 424791 - DNA, 20 bp, Artificial
  CRISPR gRNA sequence
agcgtcgcggccatggctcc

SEQ ID NO: 424792 - DNA, 20 bp, Artificial
  CRISPR gRNA sequence
gcggccatggctccaagcaa

SEQ ID NO: 424793 - DNA, 20 bp, Artificial
  CRISPR gRNA sequence
tggctccaagcaatggaatc

SEQ ID NO: 424794 - DNA, 20 bp, Artificial
  CRISPR gRNA sequence
aagcaatggaatctggaacc

SEQ ID NO: 424795 - DNA, 20 bp, Artificial
  CRISPR gRNA sequence
ctggaacctggcaccgtgct

SEQ ID NO: 424796 - DNA, 20 bp, Artificial
  CRISPR gRNA sequence
ctggcaccgtgctcagccac

SEQ ID NO: 424797 - DNA, 20 bp, Artificial
  CRISPR gRNA sequence
ggcaccgtgctcagccacta

SEQ ID NO: 424798 - DNA, 20 bp, Artificial
  CRISPR gRNA sequence
gcaccgtgctcagccactag

SEQ ID NO: 424799 - DNA, 20 bp, Artificial
  CRISPR gRNA sequence
caccgtgctcagccactaga

SEQ ID NO: 424800 - DNA, 20 bp, Artificial
  CRISPR gRNA sequence
ccgtgctcagccactagagg

SEQ ID NO: 424801 - DNA, 20 bp, Artificial
  CRISPR gRNA sequence
cgtgctcagccactagaggg

SEQ ID NO: 424802 - DNA, 20 bp, Artificial
  CRISPR gRNA sequence
ccactagagggaggacaaaa

SEQ ID NO: 424803 - DNA, 20 bp, Artificial
  CRISPR gRNA sequence
actagagggaggacaaaaca

SEQ ID NO: 424804 - DNA, 20 bp, Artificial
  CRISPR gRNA sequence
agggaggacaaaacagagat

SEQ ID NO: 424805 - DNA, 20 bp, Artificial
  CRISPR gRNA sequence
gaggacaaaacagagatgag

SEQ ID NO: 424806 - DNA, 20 bp, Artificial
  CRISPR gRNA sequence
gacaaaacagagatgagtgg

SEQ ID NO: 424807 - DNA, 20 bp, Artificial
  CRISPR gRNA sequence
aaaacagagatgagtggcag

SEQ ID NO: 424808 - DNA, 20 bp, Artificial
  CRISPR gRNA sequence
cagagatgagtggcagaagc

SEQ ID NO: 424809 - DNA, 20 bp, Artificial
  CRISPR gRNA sequence
agatgagtggcagaagccag

SEQ ID NO: 424810 - DNA, 20 bp, Artificial
  CRISPR gRNA sequence
agtggcagaagccagaagtg

SEQ ID NO: 424811 - DNA, 20 bp, Artificial
  CRISPR gRNA sequence
agaagtgaagctgatttccc

SEQ ID NO: 424812 - DNA, 20 bp, Artificial
  CRISPR gRNA sequence
gaagtgaagctgatttcccc

SEQ ID NO: 424813 - DNA, 20 bp, Artificial
  CRISPR gRNA sequence
aagtgaagctgatttcccca

SEQ ID NO: 424814 - DNA, 20 bp, Artificial
  CRISPR gRNA sequence
tgaagctgatttccccaggg

SEQ ID NO: 424815 - DNA, 20 bp, Artificial
  CRISPR gRNA sequence
tgatttccccagggcagcct

SEQ ID NO: 424816 - DNA, 20 bp, Artificial
  CRISPR gRNA sequence
ccagggcagcctgagcttca

SEQ ID NO: 424817 - DNA, 20 bp, Artificial
  CRISPR gRNA sequence
gggcagcctgagcttcacgg

SEQ ID NO: 424818 - DNA, 20 bp, Artificial
  CRISPR gRNA sequence
gcagcctgagcttcacggca

SEQ ID NO: 424819 - DNA, 20 bp, Artificial
  CRISPR gRNA sequence
agcctgagcttcacggcaga

SEQ ID NO: 424820 - DNA, 20 bp, Artificial
  CRISPR gRNA sequence
gcctgagcttcacggcagag

SEQ ID NO: 424821 - DNA, 20 bp, Artificial
  CRISPR gRNA sequence
cctgagcttcacggcagaga

SEQ ID NO: 424822 - DNA, 20 bp, Artificial
  CRISPR gRNA sequence
ctgagcttcacggcagagag

SEQ ID NO: 424823 - DNA, 20 bp, Artificial
  CRISPR gRNA sequence
gagcttcacggcagagaggg

SEQ ID NO: 424824 - DNA, 20 bp, Artificial
  CRISPR gRNA sequence
agcttcacggcagagagggg

SEQ ID NO: 424825 - DNA, 20 bp, Artificial
  CRISPR gRNA sequence
cacggcagagaggggaggat

SEQ ID NO: 424826 - DNA, 20 bp, Artificial
  CRISPR gRNA sequence
cagagaggggaggattggcc

SEQ ID NO: 424827 - DNA, 20 bp, Artificial
  CRISPR gRNA sequence
ccaagccctttgtgtaacca

SEQ ID NO: 424828 - DNA, 20 bp, Artificial
  CRISPR gRNA sequence
caagccctttgtgtaaccat

SEQ ID NO: 424829 - DNA, 20 bp, Artificial
  CRISPR gRNA sequence
cctttgtgtaaccatgggac

SEQ ID NO: 424830 - DNA, 20 bp, Artificial
  CRISPR gRNA sequence
tttgtgtaaccatgggactg

SEQ ID NO: 424831 - DNA, 20 bp, Artificial
  CRISPR gRNA sequence
accatgggactggagccttt

SEQ ID NO: 424832 - DNA, 20 bp, Artificial
  CRISPR gRNA sequence
tttaagcccaacactttgaa

SEQ ID NO: 424833 - DNA, 20 bp, Artificial
  CRISPR gRNA sequence
aagcccaacactttgaacag

SEQ ID NO: 424834 - DNA, 20 bp, Artificial
  CRISPR gRNA sequence
gcccaacactttgaacagca

SEQ ID NO: 424835 - DNA, 20 bp, Artificial
  CRISPR gRNA sequence
tgaacagcagagtatccatc

SEQ ID NO: 424836 - DNA, 20 bp, Artificial
  CRISPR gRNA sequence
aaatcaatgactgatatttt

SEQ ID NO: 424837 - DNA, 20 bp, Artificial
  CRISPR gRNA sequence
tcaatgactgatattttcag

SEQ ID NO: 424838 - DNA, 20 bp, Artificial
  CRISPR gRNA sequence
atgactgatattttcagcag

SEQ ID NO: 424839 - DNA, 20 bp, Artificial
  CRISPR gRNA sequence
gtaccttgtatatttgatac

SEQ ID NO: 424840 - DNA, 20 bp, Artificial
  CRISPR gRNA sequence
accttgtatatttgatacca

SEQ ID NO: 424841 - DNA, 20 bp, Artificial
  CRISPR gRNA sequence
ttgtatatttgataccagag

SEQ ID NO: 424842 - DNA, 20 bp, Artificial
  CRISPR gRNA sequence
tgtatatttgataccagagc

SEQ ID NO: 424843 - DNA, 20 bp, Artificial
  CRISPR gRNA sequence
ctatttgacaaaatcatttt

SEQ ID NO: 424844 - DNA, 20 bp, Artificial
  CRISPR gRNA sequence
taatcatgaaatgaaacaaa

SEQ ID NO: 424845 - DNA, 20 bp, Artificial
  CRISPR gRNA sequence
tcatgaaatgaaacaaatag

SEQ ID NO: 424846 - DNA, 20 bp, Artificial
  CRISPR gRNA sequence
aatgaaacaaatagtagttc

SEQ ID NO: 424847 - DNA, 20 bp, Artificial
  CRISPR gRNA sequence
agtagttccagaaaaaaact

SEQ ID NO: 424848 - DNA, 20 bp, Artificial
  CRISPR gRNA sequence
gttccagaaaaaaactcaga

SEQ ID NO: 424849 - DNA, 20 bp, Artificial
  CRISPR gRNA sequence
tttaattcaaaattaaaata

SEQ ID NO: 424850 - DNA, 20 bp, Artificial
  CRISPR gRNA sequence
taaattacaaaaatgaaaaa

SEQ ID NO: 424851 - DNA, 20 bp, Artificial
  CRISPR gRNA sequence
agtatgtaaccttttccctt

SEQ ID NO: 424852 - DNA, 20 bp, Artificial
  CRISPR gRNA sequence
aagcctataacacttatttc

SEQ ID NO: 424853 - DNA, 20 bp, Artificial
  CRISPR gRNA sequence
ctataacacttatttccagc

SEQ ID NO: 424854 - DNA, 20 bp, Artificial
  CRISPR gRNA sequence
tataacacttatttccagct

SEQ ID NO: 424855 - DNA, 20 bp, Artificial
  CRISPR gRNA sequence
ccagctaggctgtgaaaccc

SEQ ID NO: 424856 - DNA, 20 bp, Artificial
  CRISPR gRNA sequence
agctaggctgtgaaaccctg

SEQ ID NO: 424857 - DNA, 20 bp, Artificial
  CRISPR gRNA sequence
gctaggctgtgaaaccctgg

SEQ ID NO: 424858 - DNA, 20 bp, Artificial
  CRISPR gRNA sequence
ctaggctgtgaaaccctgga

SEQ ID NO: 424859 - DNA, 20 bp, Artificial
  CRISPR gRNA sequence
tgtgaaaccctggagggcat

SEQ ID NO: 424860 - DNA, 20 bp, Artificial
  CRISPR gRNA sequence
gtgaaaccctggagggcatg

SEQ ID NO: 424861 - DNA, 20 bp, Artificial
  CRISPR gRNA sequence
ccctggagggcatgaggctc

SEQ ID NO: 424862 - DNA, 20 bp, Artificial
  CRISPR gRNA sequence
cttatcctttgctgttttct

SEQ ID NO: 424863 - DNA, 20 bp, Artificial
  CRISPR gRNA sequence
ttttctcagcatctgacaca

SEQ ID NO: 424864 - DNA, 20 bp, Artificial
  CRISPR gRNA sequence
tctgacacatagcgaatgct

SEQ ID NO: 424865 - DNA, 20 bp, Artificial
  CRISPR gRNA sequence
tcagtaaatataaatatttg

SEQ ID NO: 424866 - DNA, 20 bp, Artificial
  CRISPR gRNA sequence
aatataaatatttgtggcat

SEQ ID NO: 424867 - DNA, 20 bp, Artificial
  CRISPR gRNA sequence
gcataagtgaaatcatgaac

SEQ ID NO: 424868 - DNA, 20 bp, Artificial
  CRISPR gRNA sequence
atgaactagtgcatttcatt

SEQ ID NO: 424869 - DNA, 20 bp, Artificial
  CRISPR gRNA sequence
gaactagtgcatttcattaa

SEQ ID NO: 424870 - DNA, 20 bp, Artificial
  CRISPR gRNA sequence
ttcattaagagataacatgt

SEQ ID NO: 424871 - DNA, 20 bp, Artificial
  CRISPR gRNA sequence
attaagagataacatgtaag

SEQ ID NO: 424872 - DNA, 20 bp, Artificial
  CRISPR gRNA sequence
aagagataacatgtaagtgg

SEQ ID NO: 424873 - DNA, 20 bp, Artificial
  CRISPR gRNA sequence
gataacatgtaagtggaagc

SEQ ID NO: 424874 - DNA, 20 bp, Artificial
  CRISPR gRNA sequence
aacatgtaagtggaagcaag

SEQ ID NO: 424875 - DNA, 20 bp, Artificial
  CRISPR gRNA sequence
taagtggaagcaagaagatg

SEQ ID NO: 424876 - DNA, 20 bp, Artificial
  CRISPR gRNA sequence
aagtggaagcaagaagatgc

SEQ ID NO: 424877 - DNA, 20 bp, Artificial
  CRISPR gRNA sequence
gtggaagcaagaagatgcag

SEQ ID NO: 424878 - DNA, 20 bp, Artificial
  CRISPR gRNA sequence
tggaagcaagaagatgcagg

SEQ ID NO: 424879 - DNA, 20 bp, Artificial
  CRISPR gRNA sequence
ggaagcaagaagatgcagga

SEQ ID NO: 424880 - DNA, 20 bp, Artificial
  CRISPR gRNA sequence
gaagcaagaagatgcaggag

SEQ ID NO: 424881 - DNA, 20 bp, Artificial
  CRISPR gRNA sequence
agcaagaagatgcaggaggg

SEQ ID NO: 424882 - DNA, 20 bp, Artificial
  CRISPR gRNA sequence
gatgcaggaggggagttttg

SEQ ID NO: 424883 - DNA, 20 bp, Artificial
  CRISPR gRNA sequence
tgcaggaggggagttttgaa

SEQ ID NO: 424884 - DNA, 20 bp, Artificial
  CRISPR gRNA sequence
gaggggagttttgaagagat

SEQ ID NO: 424885 - DNA, 20 bp, Artificial
  CRISPR gRNA sequence
ggagttttgaagagatgagt

SEQ ID NO: 424886 - DNA, 20 bp, Artificial
  CRISPR gRNA sequence
agatgagtaagatctgaccc

SEQ ID NO: 424887 - DNA, 20 bp, Artificial
  CRISPR gRNA sequence
tgagtaagatctgacccaag

SEQ ID NO: 424888 - DNA, 20 bp, Artificial
  CRISPR gRNA sequence
atctgacccaagaagaatgt

SEQ ID NO: 424889 - DNA, 20 bp, Artificial
  CRISPR gRNA sequence
cccaagaagaatgtgagaaa

SEQ ID NO: 424890 - DNA, 20 bp, Artificial
  CRISPR gRNA sequence
cccccatgcatgctgcgctg

SEQ ID NO: 424891 - DNA, 20 bp, Artificial
  CRISPR gRNA sequence
ccccatgcatgctgcgctgt

SEQ ID NO: 424892 - DNA, 20 bp, Artificial
  CRISPR gRNA sequence
catgcatgctgcgctgtagg

SEQ ID NO: 424893 - DNA, 20 bp, Artificial
  CRISPR gRNA sequence
atgcatgctgcgctgtaggt

SEQ ID NO: 424894 - DNA, 20 bp, Artificial
  CRISPR gRNA sequence
ctgcgctgtaggtaggtttc

SEQ ID NO: 424895 - DNA, 20 bp, Artificial
  CRISPR gRNA sequence
ggtaggtttccagtctgccc

SEQ ID NO: 424896 - DNA, 20 bp, Artificial
  CRISPR gRNA sequence
aggtttccagtctgccccag

SEQ ID NO: 424897 - DNA, 20 bp, Artificial
  CRISPR gRNA sequence
tccagtctgccccagcagct

SEQ ID NO: 424898 - DNA, 20 bp, Artificial
  CRISPR gRNA sequence
ccagtctgccccagcagctc

SEQ ID NO: 424899 - DNA, 20 bp, Artificial
  CRISPR gRNA sequence
gtctgccccagcagctcagg

SEQ ID NO: 424900 - DNA, 20 bp, Artificial
  CRISPR gRNA sequence
tctgccccagcagctcaggt

SEQ ID NO: 424901 - DNA, 20 bp, Artificial
  CRISPR gRNA sequence
ctgccccagcagctcaggta

SEQ ID NO: 424902 - DNA, 20 bp, Artificial
  CRISPR gRNA sequence
ccagcagctcaggtagggct

SEQ ID NO: 424903 - DNA, 20 bp, Artificial
  CRISPR gRNA sequence
cagcagctcaggtagggctc

SEQ ID NO: 424904 - DNA, 20 bp, Artificial
  CRISPR gRNA sequence
tcaggtagggctcaggtatc

SEQ ID NO: 424905 - DNA, 20 bp, Artificial
  CRISPR gRNA sequence
caggtagggctcaggtatcc

SEQ ID NO: 424906 - DNA, 20 bp, Artificial
  CRISPR gRNA sequence
aggtagggctcaggtatcca

SEQ ID NO: 424907 - DNA, 20 bp, Artificial
  CRISPR gRNA sequence
ggtagggctcaggtatccag

SEQ ID NO: 424908 - DNA, 20 bp, Artificial
  CRISPR gRNA sequence
tagggctcaggtatccaggg

SEQ ID NO: 424909 - DNA, 20 bp, Artificial
  CRISPR gRNA sequence
ggtatccaggggagtcttca

SEQ ID NO: 424910 - DNA, 20 bp, Artificial
  CRISPR gRNA sequence
gtatccaggggagtcttcaa

SEQ ID NO: 424911 - DNA, 20 bp, Artificial
  CRISPR gRNA sequence
aggggagtcttcaaaggatg

SEQ ID NO: 424912 - DNA, 20 bp, Artificial
  CRISPR gRNA sequence
ggagtcttcaaaggatgcag

SEQ ID NO: 424913 - DNA, 20 bp, Artificial
  CRISPR gRNA sequence
gtcttcaaaggatgcagcag

SEQ ID NO: 424914 - DNA, 20 bp, Artificial
  CRISPR gRNA sequence
cacatctcatccctctacct

SEQ ID NO: 424915 - DNA, 20 bp, Artificial
  CRISPR gRNA sequence
acatctcatccctctaccta

SEQ ID NO: 424916 - DNA, 20 bp, Artificial
  CRISPR gRNA sequence
catctcatccctctacctaa

SEQ ID NO: 424917 - DNA, 20 bp, Artificial
  CRISPR gRNA sequence
catccctctacctaagggtc

SEQ ID NO: 424918 - DNA, 20 bp, Artificial
  CRISPR gRNA sequence
atccctctacctaagggtct

SEQ ID NO: 424919 - DNA, 20 bp, Artificial
  CRISPR gRNA sequence
ctaagggtctgggttgctaa

SEQ ID NO: 424920 - DNA, 20 bp, Artificial
  CRISPR gRNA sequence
taagggtctgggttgctaaa

SEQ ID NO: 424921 - DNA, 20 bp, Artificial
  CRISPR gRNA sequence
gggtctgggttgctaaaagg

SEQ ID NO: 424922 - DNA, 20 bp, Artificial
  CRISPR gRNA sequence
tgggttgctaaaaggtggct

SEQ ID NO: 424923 - DNA, 20 bp, Artificial
  CRISPR gRNA sequence
gggttgctaaaaggtggctt

SEQ ID NO: 424924 - DNA, 20 bp, Artificial
  CRISPR gRNA sequence
ggcttaggaatccaatccat

SEQ ID NO: 424925 - DNA, 20 bp, Artificial
  CRISPR gRNA sequence
aggaatccaatccataagac

SEQ ID NO: 424926 - DNA, 20 bp, Artificial
  CRISPR gRNA sequence
ggaatccaatccataagaca

SEQ ID NO: 424927 - DNA, 20 bp, Artificial
  CRISPR gRNA sequence
gaatccaatccataagacaa

SEQ ID NO: 424928 - DNA, 20 bp, Artificial
  CRISPR gRNA sequence
tccaatccataagacaaggg

SEQ ID NO: 424929 - DNA, 20 bp, Artificial
  CRISPR gRNA sequence
cctgcacaattcaaattccc

SEQ ID NO: 424930 - DNA, 20 bp, Artificial
  CRISPR gRNA sequence
gaacatgttcctcctgcctt

SEQ ID NO: 424931 - DNA, 20 bp, Artificial
  CRISPR gRNA sequence
aacatgttcctcctgccttg

SEQ ID NO: 424932 - DNA, 20 bp, Artificial
  CRISPR gRNA sequence
acatgttcctcctgccttga

SEQ ID NO: 424933 - DNA, 20 bp, Artificial
  CRISPR gRNA sequence
tcctcctgccttgagggact

SEQ ID NO: 424934 - DNA, 20 bp, Artificial
  CRISPR gRNA sequence
tgccttgagggactcagtca

SEQ ID NO: 424935 - DNA, 20 bp, Artificial
  CRISPR gRNA sequence
ttgagggactcagtcacagt

SEQ ID NO: 424936 - DNA, 20 bp, Artificial
  CRISPR gRNA sequence
gggactcagtcacagttggc

SEQ ID NO: 424937 - DNA, 20 bp, Artificial
  CRISPR gRNA sequence
ggactcagtcacagttggcc

SEQ ID NO: 424938 - DNA, 20 bp, Artificial
  CRISPR gRNA sequence
tcagtcacagttggccagga

SEQ ID NO: 424939 - DNA, 20 bp, Artificial
  CRISPR gRNA sequence
cagttggccaggacggcttc

SEQ ID NO: 424940 - DNA, 20 bp, Artificial
  CRISPR gRNA sequence
tggccaggacggcttctggt

SEQ ID NO: 424941 - DNA, 20 bp, Artificial
  CRISPR gRNA sequence
ggacggcttctggttagcca

SEQ ID NO: 424942 - DNA, 20 bp, Artificial
  CRISPR gRNA sequence
tctggttagccatagccata

SEQ ID NO: 424943 - DNA, 20 bp, Artificial
  CRISPR gRNA sequence
gttagccatagccatacagt

SEQ ID NO: 424944 - DNA, 20 bp, Artificial
  CRISPR gRNA sequence
catagccatacagttagctc

SEQ ID NO: 424945 - DNA, 20 bp, Artificial
  CRISPR gRNA sequence
tagccatacagttagctctg

SEQ ID NO: 424946 - DNA, 20 bp, Artificial
  CRISPR gRNA sequence
atacagttagctctggagta

SEQ ID NO: 424947 - DNA, 20 bp, Artificial
  CRISPR gRNA sequence
acagttagctctggagtaaa

SEQ ID NO: 424948 - DNA, 20 bp, Artificial
  CRISPR gRNA sequence
cagttagctctggagtaaag

SEQ ID NO: 424949 - DNA, 20 bp, Artificial
  CRISPR gRNA sequence
tagctctggagtaaagagga

SEQ ID NO: 424950 - DNA, 20 bp, Artificial
  CRISPR gRNA sequence
tctggagtaaagaggacaga

SEQ ID NO: 424951 - DNA, 20 bp, Artificial
  CRISPR gRNA sequence
gagtaaagaggacagatgga

SEQ ID NO: 424952 - DNA, 20 bp, Artificial
  CRISPR gRNA sequence
aagaggacagatggaaagca

SEQ ID NO: 424953 - DNA, 20 bp, Artificial
  CRISPR gRNA sequence
agaggacagatggaaagcac

SEQ ID NO: 424954 - DNA, 20 bp, Artificial
  CRISPR gRNA sequence
gaggacagatggaaagcaca

SEQ ID NO: 424955 - DNA, 20 bp, Artificial
  CRISPR gRNA sequence
aggacagatggaaagcacag

SEQ ID NO: 424956 - DNA, 20 bp, Artificial
  CRISPR gRNA sequence
gatggaaagcacaggggtca

SEQ ID NO: 424957 - DNA, 20 bp, Artificial
  CRISPR gRNA sequence
tggaaagcacaggggtcata

SEQ ID NO: 424958 - DNA, 20 bp, Artificial
  CRISPR gRNA sequence
gggtcatagagaacacactg

SEQ ID NO: 424959 - DNA, 20 bp, Artificial
  CRISPR gRNA sequence
tcatagagaacacactgcag

SEQ ID NO: 424960 - DNA, 20 bp, Artificial
  CRISPR gRNA sequence
catagagaacacactgcagc

SEQ ID NO: 424961 - DNA, 20 bp, Artificial
  CRISPR gRNA sequence
gagaacacactgcagcaggt

SEQ ID NO: 424962 - DNA, 20 bp, Artificial
  CRISPR gRNA sequence
gaacacactgcagcaggtaa

SEQ ID NO: 424963 - DNA, 20 bp, Artificial
  CRISPR gRNA sequence
aacacactgcagcaggtaag

SEQ ID NO: 424964 - DNA, 20 bp, Artificial
  CRISPR gRNA sequence
acacactgcagcaggtaaga

SEQ ID NO: 424965 - DNA, 20 bp, Artificial
  CRISPR gRNA sequence
cacactgcagcaggtaagag

SEQ ID NO: 424966 - DNA, 20 bp, Artificial
  CRISPR gRNA sequence
gcagcaggtaagaggggctg

SEQ ID NO: 424967 - DNA, 20 bp, Artificial
  CRISPR gRNA sequence
agcaggtaagaggggctgca

SEQ ID NO: 424968 - DNA, 20 bp, Artificial
  CRISPR gRNA sequence
gcaggtaagaggggctgcag

SEQ ID NO: 424969 - DNA, 20 bp, Artificial
  CRISPR gRNA sequence
caggtaagaggggctgcaga

SEQ ID NO: 424970 - DNA, 20 bp, Artificial
  CRISPR gRNA sequence
cagagggctatccataaaac

SEQ ID NO: 424971 - DNA, 20 bp, Artificial
  CRISPR gRNA sequence
agagggctatccataaaacc

SEQ ID NO: 424972 - DNA, 20 bp, Artificial
  CRISPR gRNA sequence
ggctatccataaaaccagga

SEQ ID NO: 424973 - DNA, 20 bp, Artificial
  CRISPR gRNA sequence
gctatccataaaaccaggaa

SEQ ID NO: 424974 - DNA, 20 bp, Artificial
  CRISPR gRNA sequence
accaggaaaggatatatgat

SEQ ID NO: 424975 - DNA, 20 bp, Artificial
  CRISPR gRNA sequence
gaaaggatatatgatcagtt

SEQ ID NO: 424976 - DNA, 20 bp, Artificial
  CRISPR gRNA sequence
aaaggatatatgatcagttt

SEQ ID NO: 424977 - DNA, 20 bp, Artificial
  CRISPR gRNA sequence
aaggatatatgatcagtttg

SEQ ID NO: 424978 - DNA, 20 bp, Artificial
  CRISPR gRNA sequence
atatatgatcagtttgggga

SEQ ID NO: 424979 - DNA, 20 bp, Artificial
  CRISPR gRNA sequence
atatgatcagtttggggaca

SEQ ID NO: 424980 - DNA, 20 bp, Artificial
  CRISPR gRNA sequence
gatcagtttggggacagagc

SEQ ID NO: 424981 - DNA, 20 bp, Artificial
  CRISPR gRNA sequence
gtttggggacagagccagat

SEQ ID NO: 424982 - DNA, 20 bp, Artificial
  CRISPR gRNA sequence
ttggggacagagccagattg

SEQ ID NO: 424983 - DNA, 20 bp, Artificial
  CRISPR gRNA sequence
tggggacagagccagattgg

SEQ ID NO: 424984 - DNA, 20 bp, Artificial
  CRISPR gRNA sequence
ggacagagccagattggagg

SEQ ID NO: 424985 - DNA, 20 bp, Artificial
  CRISPR gRNA sequence
gacagagccagattggaggc

SEQ ID NO: 424986 - DNA, 20 bp, Artificial
  CRISPR gRNA sequence
acagagccagattggaggca

SEQ ID NO: 424987 - DNA, 20 bp, Artificial
  CRISPR gRNA sequence
agccagattggaggcagggt

SEQ ID NO: 424988 - DNA, 20 bp, Artificial
  CRISPR gRNA sequence
gccagattggaggcagggtt

SEQ ID NO: 424989 - DNA, 20 bp, Artificial
  CRISPR gRNA sequence
attggaggcagggttaggcc

SEQ ID NO: 424990 - DNA, 20 bp, Artificial
  CRISPR gRNA sequence
ttggaggcagggttaggcct

SEQ ID NO: 424991 - DNA, 20 bp, Artificial
  CRISPR gRNA sequence
gcctgggttctcttacacct

SEQ ID NO: 424992 - DNA, 20 bp, Artificial
  CRISPR gRNA sequence
cctgggttctcttacacctt

SEQ ID NO: 424993 - DNA, 20 bp, Artificial
  CRISPR gRNA sequence
ctgggttctcttacaccttg

SEQ ID NO: 424994 - DNA, 20 bp, Artificial
  CRISPR gRNA sequence
gttctcttacaccttgggga

SEQ ID NO: 424995 - DNA, 20 bp, Artificial
  CRISPR gRNA sequence
ttacaccttggggacagatg

SEQ ID NO: 424996 - DNA, 20 bp, Artificial
  CRISPR gRNA sequence
accttggggacagatgaaga

SEQ ID NO: 424997 - DNA, 20 bp, Artificial
  CRISPR gRNA sequence
tggggacagatgaagataga

SEQ ID NO: 424998 - DNA, 20 bp, Artificial
  CRISPR gRNA sequence
gggacagatgaagatagatg

SEQ ID NO: 424999 - DNA, 20 bp, Artificial
  CRISPR gRNA sequence
atgaagatagatggagtgaa

SEQ ID NO: 425000 - DNA, 20 bp, Artificial
  CRISPR gRNA sequence
gatggagtgaaaagcatgtt

SEQ ID NO: 425001 - DNA, 20 bp, Artificial
  CRISPR gRNA sequence
atggagtgaaaagcatgttg

SEQ ID NO: 425002 - DNA, 20 bp, Artificial
  CRISPR gRNA sequence
gtgaaaagcatgttgaggtt

SEQ ID NO: 425003 - DNA, 20 bp, Artificial
  CRISPR gRNA sequence
tgaaaagcatgttgaggttt

SEQ ID NO: 425004 - DNA, 20 bp, Artificial
  CRISPR gRNA sequence
gaaaagcatgttgaggttta

SEQ ID NO: 425005 - DNA, 20 bp, Artificial
  CRISPR gRNA sequence
aagcatgttgaggtttaggg

SEQ ID NO: 425006 - DNA, 20 bp, Artificial
  CRISPR gRNA sequence
ttagggaagattatgataat

SEQ ID NO: 425007 - DNA, 20 bp, Artificial
  CRISPR gRNA sequence
gaagattatgataatgagtt

SEQ ID NO: 425008 - DNA, 20 bp, Artificial
  CRISPR gRNA sequence
attatgataatgagtttggt

SEQ ID NO: 425009 - DNA, 20 bp, Artificial
  CRISPR gRNA sequence
ttatgataatgagtttggtt

SEQ ID NO: 425010 - DNA, 20 bp, Artificial
  CRISPR gRNA sequence
taatgagtttggttaggttt

SEQ ID NO: 425011 - DNA, 20 bp, Artificial
  CRISPR gRNA sequence
aatgagtttggttaggttta

SEQ ID NO: 425012 - DNA, 20 bp, Artificial
  CRISPR gRNA sequence
gtttggttaggtttaaggat

SEQ ID NO: 425013 - DNA, 20 bp, Artificial
  CRISPR gRNA sequence
ttaggtttaaggataagttc

SEQ ID NO: 425014 - DNA, 20 bp, Artificial
  CRISPR gRNA sequence
ggataagttcgagatacaat

SEQ ID NO: 425015 - DNA, 20 bp, Artificial
  CRISPR gRNA sequence
gataagttcgagatacaatt

SEQ ID NO: 425016 - DNA, 20 bp, Artificial
  CRISPR gRNA sequence
gttcgagatacaattgggac

SEQ ID NO: 425017 - DNA, 20 bp, Artificial
  CRISPR gRNA sequence
tcgagatacaattgggacca

SEQ ID NO: 425018 - DNA, 20 bp, Artificial
  CRISPR gRNA sequence
agatacaattgggaccagag

SEQ ID NO: 425019 - DNA, 20 bp, Artificial
  CRISPR gRNA sequence
attgggaccagagtggaact

SEQ ID NO: 425020 - DNA, 20 bp, Artificial
  CRISPR gRNA sequence
ttgggaccagagtggaactt

SEQ ID NO: 425021 - DNA, 20 bp, Artificial
  CRISPR gRNA sequence
cagagtggaacttgggatat

SEQ ID NO: 425022 - DNA, 20 bp, Artificial
  CRISPR gRNA sequence
ttagatgtatcaatttcatt

SEQ ID NO: 425023 - DNA, 20 bp, Artificial
  CRISPR gRNA sequence
tcaatttcatttggaatttt

SEQ ID NO: 425024 - DNA, 20 bp, Artificial
  CRISPR gRNA sequence
gaatttttggtttgaaataa

SEQ ID NO: 425025 - DNA, 20 bp, Artificial
  CRISPR gRNA sequence
agcaccaatgtctccattca

SEQ ID NO: 425026 - DNA, 20 bp, Artificial
  CRISPR gRNA sequence
aatgtctccattcacagtta

SEQ ID NO: 425027 - DNA, 20 bp, Artificial
  CRISPR gRNA sequence
tccattcacagttatggtca

SEQ ID NO: 425028 - DNA, 20 bp, Artificial
  CRISPR gRNA sequence
acagttatggtcatagaaca

SEQ ID NO: 425029 - DNA, 20 bp, Artificial
  CRISPR gRNA sequence
ggtcatagaacaaagatatc

SEQ ID NO: 425030 - DNA, 20 bp, Artificial
  CRISPR gRNA sequence
gtcatagaacaaagatatca

SEQ ID NO: 425031 - DNA, 20 bp, Artificial
  CRISPR gRNA sequence
agatatcaaggtctttgaaa

SEQ ID NO: 425032 - DNA, 20 bp, Artificial
  CRISPR gRNA sequence
tatcaaggtctttgaaacag

SEQ ID NO: 425033 - DNA, 20 bp, Artificial
  CRISPR gRNA sequence
caaggtctttgaaacagaag

SEQ ID NO: 425034 - DNA, 20 bp, Artificial
  CRISPR gRNA sequence
tttgaaacagaagcagccct

SEQ ID NO: 425035 - DNA, 20 bp, Artificial
  CRISPR gRNA sequence
aaacagaagcagccctgagt

SEQ ID NO: 425036 - DNA, 20 bp, Artificial
  CRISPR gRNA sequence
aagcatgacatcactacatg

SEQ ID NO: 425037 - DNA, 20 bp, Artificial
  CRISPR gRNA sequence
agcatgacatcactacatgc

SEQ ID NO: 425038 - DNA, 20 bp, Artificial
  CRISPR gRNA sequence
gcatgacatcactacatgca

SEQ ID NO: 425039 - DNA, 20 bp, Artificial
  CRISPR gRNA sequence
tgacatcactacatgcaggg

SEQ ID NO: 425040 - DNA, 20 bp, Artificial
  CRISPR gRNA sequence
gacatcactacatgcagggt

SEQ ID NO: 425041 - DNA, 20 bp, Artificial
  CRISPR gRNA sequence
acatcactacatgcagggtg

SEQ ID NO: 425042 - DNA, 20 bp, Artificial
  CRISPR gRNA sequence
tcactacatgcagggtgggg

SEQ ID NO: 425043 - DNA, 20 bp, Artificial
  CRISPR gRNA sequence
cactacatgcagggtgggga

SEQ ID NO: 425044 - DNA, 20 bp, Artificial
  CRISPR gRNA sequence
actacatgcagggtggggaa

SEQ ID NO: 425045 - DNA, 20 bp, Artificial
  CRISPR gRNA sequence
ctacatgcagggtggggaag

SEQ ID NO: 425046 - DNA, 20 bp, Artificial
  CRISPR gRNA sequence
catgcagggtggggaagggg

SEQ ID NO: 425047 - DNA, 20 bp, Artificial
  CRISPR gRNA sequence
ggaaggggcagactctgtat

SEQ ID NO: 425048 - DNA, 20 bp, Artificial
  CRISPR gRNA sequence
gaaggggcagactctgtata

SEQ ID NO: 425049 - DNA, 20 bp, Artificial
  CRISPR gRNA sequence
aaggggcagactctgtataa

SEQ ID NO: 425050 - DNA, 20 bp, Artificial
  CRISPR gRNA sequence
taaaacttctgcctattaac

SEQ ID NO: 425051 - DNA, 20 bp, Artificial
  CRISPR gRNA sequence
aaaacttctgcctattaacc

SEQ ID NO: 425052 - DNA, 20 bp, Artificial
  CRISPR gRNA sequence
cctattaaccaggttgactt

SEQ ID NO: 425053 - DNA, 20 bp, Artificial
  CRISPR gRNA sequence
ctattaaccaggttgacttt

SEQ ID NO: 425054 - DNA, 20 bp, Artificial
  CRISPR gRNA sequence
tattaaccaggttgactttg

SEQ ID NO: 425055 - DNA, 20 bp, Artificial
  CRISPR gRNA sequence
accaggttgactttggggtt

SEQ ID NO: 425056 - DNA, 20 bp, Artificial
  CRISPR gRNA sequence
tttggggttaagtacaattt

SEQ ID NO: 425057 - DNA, 20 bp, Artificial
  CRISPR gRNA sequence
ttaagtacaattttagcatt

SEQ ID NO: 425058 - DNA, 20 bp, Artificial
  CRISPR gRNA sequence
taagtacaattttagcatta

SEQ ID NO: 425059 - DNA, 20 bp, Artificial
  CRISPR gRNA sequence
tacaattttagcattaaggt

SEQ ID NO: 425060 - DNA, 20 bp, Artificial
  CRISPR gRNA sequence
acaattttagcattaaggtt

SEQ ID NO: 425061 - DNA, 20 bp, Artificial
  CRISPR gRNA sequence
tttagcattaaggttaggaa

SEQ ID NO: 425062 - DNA, 20 bp, Artificial
  CRISPR gRNA sequence
taggaatagcttaaatatta

SEQ ID NO: 425063 - DNA, 20 bp, Artificial
  CRISPR gRNA sequence
aatagcttaaatattacaga

SEQ ID NO: 425064 - DNA, 20 bp, Artificial
  CRISPR gRNA sequence
ttaaatattacagatagtat

SEQ ID NO: 425065 - DNA, 20 bp, Artificial
  CRISPR gRNA sequence
taaatattacagatagtatt

SEQ ID NO: 425066 - DNA, 20 bp, Artificial
  CRISPR gRNA sequence
tattacagatagtattagga

SEQ ID NO: 425067 - DNA, 20 bp, Artificial
  CRISPR gRNA sequence
attacagatagtattaggat

SEQ ID NO: 425068 - DNA, 20 bp, Artificial
  CRISPR gRNA sequence
ttacagatagtattaggata

SEQ ID NO: 425069 - DNA, 20 bp, Artificial
  CRISPR gRNA sequence
atagtattaggatagggact

SEQ ID NO: 425070 - DNA, 20 bp, Artificial
  CRISPR gRNA sequence
ttaggatagggacttggact

SEQ ID NO: 425071 - DNA, 20 bp, Artificial
  CRISPR gRNA sequence
taggatagggacttggacta

SEQ ID NO: 425072 - DNA, 20 bp, Artificial
  CRISPR gRNA sequence
agggacttggactaaggttt

SEQ ID NO: 425073 - DNA, 20 bp, Artificial
  CRISPR gRNA sequence
cttggactaaggtttgagat

SEQ ID NO: 425074 - DNA, 20 bp, Artificial
  CRISPR gRNA sequence
ttggactaaggtttgagatt

SEQ ID NO: 425075 - DNA, 20 bp, Artificial
  CRISPR gRNA sequence
ggtttgagattaggttcaaa

SEQ ID NO: 425076 - DNA, 20 bp, Artificial
  CRISPR gRNA sequence
ttgagattaggttcaaaaag

SEQ ID NO: 425077 - DNA, 20 bp, Artificial
  CRISPR gRNA sequence
gattaggttcaaaaagaagc

SEQ ID NO: 425078 - DNA, 20 bp, Artificial
  CRISPR gRNA sequence
attaggttcaaaaagaagcc

SEQ ID NO: 425079 - DNA, 20 bp, Artificial
  CRISPR gRNA sequence
ttaggttcaaaaagaagcca

SEQ ID NO: 425080 - DNA, 20 bp, Artificial
  CRISPR gRNA sequence
gccagggtttgtgctaatgc

SEQ ID NO: 425081 - DNA, 20 bp, Artificial
  CRISPR gRNA sequence
ttgtgctaatgcaagtaatt

SEQ ID NO: 425082 - DNA, 20 bp, Artificial
  CRISPR gRNA sequence
tgtgctaatgcaagtaatta

SEQ ID NO: 425083 - DNA, 20 bp, Artificial
  CRISPR gRNA sequence
tgctaatgcaagtaattaag

SEQ ID NO: 425084 - DNA, 20 bp, Artificial
  CRISPR gRNA sequence
ctaatgcaagtaattaagga

SEQ ID NO: 425085 - DNA, 20 bp, Artificial
  CRISPR gRNA sequence
ggagagtttgcattccacat

SEQ ID NO: 425086 - DNA, 20 bp, Artificial
  CRISPR gRNA sequence
cacataagcaactgaccact

SEQ ID NO: 425087 - DNA, 20 bp, Artificial
  CRISPR gRNA sequence
acataagcaactgaccactt

SEQ ID NO: 425088 - DNA, 20 bp, Artificial
  CRISPR gRNA sequence
caactgaccacttgggaaac

SEQ ID NO: 425089 - DNA, 20 bp, Artificial
  CRISPR gRNA sequence
actgaccacttgggaaacaa

SEQ ID NO: 425090 - DNA, 20 bp, Artificial
  CRISPR gRNA sequence
ctgaccacttgggaaacaag

SEQ ID NO: 425091 - DNA, 20 bp, Artificial
  CRISPR gRNA sequence
tgaccacttgggaaacaaga

SEQ ID NO: 425092 - DNA, 20 bp, Artificial
  CRISPR gRNA sequence
ccacttgggaaacaagaggg

SEQ ID NO: 425093 - DNA, 20 bp, Artificial
  CRISPR gRNA sequence
acttgggaaacaagagggaa

SEQ ID NO: 425094 - DNA, 20 bp, Artificial
  CRISPR gRNA sequence
ggaaacaagagggaagagcc

SEQ ID NO: 425095 - DNA, 20 bp, Artificial
  CRISPR gRNA sequence
gggaagagccgagtgaccaa

SEQ ID NO: 425096 - DNA, 20 bp, Artificial
  CRISPR gRNA sequence
gagtgaccaatggtgttccc

SEQ ID NO: 425097 - DNA, 20 bp, Artificial
  CRISPR gRNA sequence
gtgaccaatggtgttccctg

SEQ ID NO: 425098 - DNA, 20 bp, Artificial
  CRISPR gRNA sequence
gtgttccctggagtctgcaa

SEQ ID NO: 425099 - DNA, 20 bp, Artificial
  CRISPR gRNA sequence
cctggagtctgcaatggcaa

SEQ ID NO: 425100 - DNA, 20 bp, Artificial
  CRISPR gRNA sequence
ctggagtctgcaatggcaaa

SEQ ID NO: 425101 - DNA, 20 bp, Artificial
  CRISPR gRNA sequence
tggagtctgcaatggcaaaa

SEQ ID NO: 425102 - DNA, 20 bp, Artificial
  CRISPR gRNA sequence
agtctgcaatggcaaaaggg

SEQ ID NO: 425103 - DNA, 20 bp, Artificial
  CRISPR gRNA sequence
ggcaaaagggtggaaacata

SEQ ID NO: 425104 - DNA, 20 bp, Artificial
  CRISPR gRNA sequence
gcaaaagggtggaaacatac

SEQ ID NO: 425105 - DNA, 20 bp, Artificial
  CRISPR gRNA sequence
gtggaaacatacaggctttg

SEQ ID NO: 425106 - DNA, 20 bp, Artificial
  CRISPR gRNA sequence
tggaaacatacaggctttgt

SEQ ID NO: 425107 - DNA, 20 bp, Artificial
  CRISPR gRNA sequence
ggaaacatacaggctttgtg

SEQ ID NO: 425108 - DNA, 20 bp, Artificial
  CRISPR gRNA sequence
aaacatacaggctttgtggg

SEQ ID NO: 425109 - DNA, 20 bp, Artificial
  CRISPR gRNA sequence
aacatacaggctttgtgggg

SEQ ID NO: 425110 - DNA, 20 bp, Artificial
  CRISPR gRNA sequence
ggctttgtggggaggctgca

SEQ ID NO: 425111 - DNA, 20 bp, Artificial
  CRISPR gRNA sequence
gctttgtggggaggctgcac

SEQ ID NO: 425112 - DNA, 20 bp, Artificial
  CRISPR gRNA sequence
ctttgtggggaggctgcaca

SEQ ID NO: 425113 - DNA, 20 bp, Artificial
  CRISPR gRNA sequence
tttgtggggaggctgcacag

SEQ ID NO: 425114 - DNA, 20 bp, Artificial
  CRISPR gRNA sequence
gaggctgcacaggggtccaa

SEQ ID NO: 425115 - DNA, 20 bp, Artificial
  CRISPR gRNA sequence
catcttctgatctctctccc

SEQ ID NO: 425116 - DNA, 20 bp, Artificial
  CRISPR gRNA sequence
atcttctgatctctctcccc

SEQ ID NO: 425117 - DNA, 20 bp, Artificial
  CRISPR gRNA sequence
tcttctgatctctctcccca

SEQ ID NO: 425118 - DNA, 20 bp, Artificial
  CRISPR gRNA sequence
cttctgatctctctccccag

SEQ ID NO: 425119 - DNA, 20 bp, Artificial
  CRISPR gRNA sequence
ctctctccccaggggtccat

SEQ ID NO: 425120 - DNA, 20 bp, Artificial
  CRISPR gRNA sequence
ccccaggggtccatgagcca

SEQ ID NO: 425121 - DNA, 20 bp, Artificial
  CRISPR gRNA sequence
ccaggggtccatgagccaca

SEQ ID NO: 425122 - DNA, 20 bp, Artificial
  CRISPR gRNA sequence
ggggtccatgagccacagag

SEQ ID NO: 425123 - DNA, 20 bp, Artificial
  CRISPR gRNA sequence
aatttgcaccttcatttccc

SEQ ID NO: 425124 - DNA, 20 bp, Artificial
  CRISPR gRNA sequence
atttgcaccttcatttcccc

SEQ ID NO: 425125 - DNA, 20 bp, Artificial
  CRISPR gRNA sequence
caccttcatttccccaggtt

SEQ ID NO: 425126 - DNA, 20 bp, Artificial
  CRISPR gRNA sequence
accttcatttccccaggttc

SEQ ID NO: 425127 - DNA, 20 bp, Artificial
  CRISPR gRNA sequence
tcatttccccaggttcaggc

SEQ ID NO: 425128 - DNA, 20 bp, Artificial
  CRISPR gRNA sequence
catttccccaggttcaggct

SEQ ID NO: 425129 - DNA, 20 bp, Artificial
  CRISPR gRNA sequence
cccaggttcaggctgggaaa

SEQ ID NO: 425130 - DNA, 20 bp, Artificial
  CRISPR gRNA sequence
gggaaatagccgtgccactg

SEQ ID NO: 425131 - DNA, 20 bp, Artificial
  CRISPR gRNA sequence
tagccgtgccactgtggtct

SEQ ID NO: 425132 - DNA, 20 bp, Artificial
  CRISPR gRNA sequence
agccgtgccactgtggtctt

SEQ ID NO: 425133 - DNA, 20 bp, Artificial
  CRISPR gRNA sequence
gccgtgccactgtggtcttg

SEQ ID NO: 425134 - DNA, 20 bp, Artificial
  CRISPR gRNA sequence
cgtgccactgtggtcttggg

SEQ ID NO: 425135 - DNA, 20 bp, Artificial
  CRISPR gRNA sequence
gtgccactgtggtcttgggg

SEQ ID NO: 425136 - DNA, 20 bp, Artificial
  CRISPR gRNA sequence
gccactgtggtcttggggag

SEQ ID NO: 425137 - DNA, 20 bp, Artificial
  CRISPR gRNA sequence
ttggggaggagtgtgcatgt

SEQ ID NO: 425138 - DNA, 20 bp, Artificial
  CRISPR gRNA sequence
tggggaggagtgtgcatgtc

SEQ ID NO: 425139 - DNA, 20 bp, Artificial
  CRISPR gRNA sequence
ggaccaccgatctccatgaa

SEQ ID NO: 425140 - DNA, 20 bp, Artificial
  CRISPR gRNA sequence
accgatctccatgaatggcc

SEQ ID NO: 425141 - DNA, 20 bp, Artificial
  CRISPR gRNA sequence
tctccatgaatggcctggcc

SEQ ID NO: 425142 - DNA, 20 bp, Artificial
  CRISPR gRNA sequence
tccatgaatggcctggcctg

SEQ ID NO: 425143 - DNA, 20 bp, Artificial
  CRISPR gRNA sequence
gaatggcctggcctggagat

SEQ ID NO: 425144 - DNA, 20 bp, Artificial
  CRISPR gRNA sequence
ctggcctggagattagcaac

SEQ ID NO: 425145 - DNA, 20 bp, Artificial
  CRISPR gRNA sequence
tggagattagcaaccagaca

SEQ ID NO: 425146 - DNA, 20 bp, Artificial
  CRISPR gRNA sequence
aaccagacatagctcccatt

SEQ ID NO: 425147 - DNA, 20 bp, Artificial
  CRISPR gRNA sequence
catagctcccatttggtctt

SEQ ID NO: 425148 - DNA, 20 bp, Artificial
  CRISPR gRNA sequence
cccatttggtcttcagttgc

SEQ ID NO: 425149 - DNA, 20 bp, Artificial
  CRISPR gRNA sequence
ttgctggtactaccactcca

SEQ ID NO: 425150 - DNA, 20 bp, Artificial
  CRISPR gRNA sequence
tgctggtactaccactccac

SEQ ID NO: 425151 - DNA, 20 bp, Artificial
  CRISPR gRNA sequence
gctggtactaccactccaca

SEQ ID NO: 425152 - DNA, 20 bp, Artificial
  CRISPR gRNA sequence
ctggtactaccactccacag

SEQ ID NO: 425153 - DNA, 20 bp, Artificial
  CRISPR gRNA sequence
atgaactccctccctgttcc

SEQ ID NO: 425154 - DNA, 20 bp, Artificial
  CRISPR gRNA sequence
ctgttcccggtcctgccgtc

SEQ ID NO: 425155 - DNA, 20 bp, Artificial
  CRISPR gRNA sequence
ccggtcctgccgtctggtga

SEQ ID NO: 425156 - DNA, 20 bp, Artificial
  CRISPR gRNA sequence
cggtcctgccgtctggtgat

SEQ ID NO: 425157 - DNA, 20 bp, Artificial
  CRISPR gRNA sequence
ccgtctggtgatgggtcctc

SEQ ID NO: 425158 - DNA, 20 bp, Artificial
  CRISPR gRNA sequence
ggtcctctggcatatgacac

SEQ ID NO: 425159 - DNA, 20 bp, Artificial
  CRISPR gRNA sequence
gtcctctggcatatgacact

SEQ ID NO: 425160 - DNA, 20 bp, Artificial
  CRISPR gRNA sequence
tcctctggcatatgacactg

SEQ ID NO: 425161 - DNA, 20 bp, Artificial
  CRISPR gRNA sequence
tggcatatgacactggggta

SEQ ID NO: 425162 - DNA, 20 bp, Artificial
  CRISPR gRNA sequence
gcatatgacactggggtaaa

SEQ ID NO: 425163 - DNA, 20 bp, Artificial
  CRISPR gRNA sequence
tgacactggggtaaagagcc

SEQ ID NO: 425164 - DNA, 20 bp, Artificial
  CRISPR gRNA sequence
ctggggtaaagagcccagaa

SEQ ID NO: 425165 - DNA, 20 bp, Artificial
  CRISPR gRNA sequence
gtaaagagcccagaatggtc

SEQ ID NO: 425166 - DNA, 20 bp, Artificial
  CRISPR gRNA sequence
taaagagcccagaatggtca

SEQ ID NO: 425167 - DNA, 20 bp, Artificial
  CRISPR gRNA sequence
gaatggtcaaggccatcact

SEQ ID NO: 425168 - DNA, 20 bp, Artificial
  CRISPR gRNA sequence
ccatcacttggttactttgc

SEQ ID NO: 425169 - DNA, 20 bp, Artificial
  CRISPR gRNA sequence
ttggttactttgccagaatc

SEQ ID NO: 425170 - DNA, 20 bp, Artificial
  CRISPR gRNA sequence
tggttactttgccagaatct

SEQ ID NO: 425171 - DNA, 20 bp, Artificial
  CRISPR gRNA sequence
ccctgccctgcttattgtcc

SEQ ID NO: 425172 - DNA, 20 bp, Artificial
  CRISPR gRNA sequence
cctgccctgcttattgtccc

SEQ ID NO: 425173 - DNA, 20 bp, Artificial
  CRISPR gRNA sequence
tctaaccatgaaccaataaa

SEQ ID NO: 425174 - DNA, 20 bp, Artificial
  CRISPR gRNA sequence
ccaataaatagcataaaaac

SEQ ID NO: 425175 - DNA, 20 bp, Artificial
  CRISPR gRNA sequence
cataaaaactagcccttatg

SEQ ID NO: 425176 - DNA, 20 bp, Artificial
  CRISPR gRNA sequence
aaactagcccttatgaagtt

SEQ ID NO: 425177 - DNA, 20 bp, Artificial
  CRISPR gRNA sequence
agttaagcttattacctatc

SEQ ID NO: 425178 - DNA, 20 bp, Artificial
  CRISPR gRNA sequence
tacctatctagcactgttgt

SEQ ID NO: 425179 - DNA, 20 bp, Artificial
  CRISPR gRNA sequence
ttgtaagaccttacttgtat

SEQ ID NO: 425180 - DNA, 20 bp, Artificial
  CRISPR gRNA sequence
atttgccacattttatcgac

SEQ ID NO: 425181 - DNA, 20 bp, Artificial
  CRISPR gRNA sequence
attttatcgacaagaaaact

SEQ ID NO: 425182 - DNA, 20 bp, Artificial
  CRISPR gRNA sequence
gacaagaaaactgagaaaaa

SEQ ID NO: 425183 - DNA, 20 bp, Artificial
  CRISPR gRNA sequence
aaaaaagtacataatttacc

SEQ ID NO: 425184 - DNA, 20 bp, Artificial
  CRISPR gRNA sequence
cataatttacccagacttcg

SEQ ID NO: 425185 - DNA, 20 bp, Artificial
  CRISPR gRNA sequence
ataatttacccagacttcgt

SEQ ID NO: 425186 - DNA, 20 bp, Artificial
  CRISPR gRNA sequence
taatttacccagacttcgtg

SEQ ID NO: 425187 - DNA, 20 bp, Artificial
  CRISPR gRNA sequence
cttcgtggggtcaactgcaa

SEQ ID NO: 425188 - DNA, 20 bp, Artificial
  CRISPR gRNA sequence
tcaactgcaatagtcaaccc

SEQ ID NO: 425189 - DNA, 20 bp, Artificial
  CRISPR gRNA sequence
ctgcaatagtcaaccccaga

SEQ ID NO: 425190 - DNA, 20 bp, Artificial
  CRISPR gRNA sequence
aaccccagacagtgcaattc

SEQ ID NO: 425191 - DNA, 20 bp, Artificial
  CRISPR gRNA sequence
ccccagacagtgcaattcca

SEQ ID NO: 425192 - DNA, 20 bp, Artificial
  CRISPR gRNA sequence
ccagagcctcaactcttaac

SEQ ID NO: 425193 - DNA, 20 bp, Artificial
  CRISPR gRNA sequence
actcttaaccagtctttgtt

SEQ ID NO: 425194 - DNA, 20 bp, Artificial
  CRISPR gRNA sequence
ttgtttggcctatgtgaaat

SEQ ID NO: 425195 - DNA, 20 bp, Artificial
  CRISPR gRNA sequence
tggcctatgtgaaatcagtt

SEQ ID NO: 425196 - DNA, 20 bp, Artificial
  CRISPR gRNA sequence
cctatgtgaaatcagttaag

SEQ ID NO: 425197 - DNA, 20 bp, Artificial
  CRISPR gRNA sequence
tcagttaagaagtaacactt

SEQ ID NO: 425198 - DNA, 20 bp, Artificial
  CRISPR gRNA sequence
cagttaagaagtaacacttt

SEQ ID NO: 425199 - DNA, 20 bp, Artificial
  CRISPR gRNA sequence
gttaagaagtaacactttgg

SEQ ID NO: 425200 - DNA, 20 bp, Artificial
  CRISPR gRNA sequence
ttaagaagtaacactttggg

SEQ ID NO: 425201 - DNA, 20 bp, Artificial
  CRISPR gRNA sequence
aagtaacactttgggaggct

SEQ ID NO: 425202 - DNA, 20 bp, Artificial
  CRISPR gRNA sequence
agtaacactttgggaggctg

SEQ ID NO: 425203 - DNA, 20 bp, Artificial
  CRISPR gRNA sequence
aacactttgggaggctgagg

SEQ ID NO: 425204 - DNA, 20 bp, Artificial
  CRISPR gRNA sequence
acactttgggaggctgaggc

SEQ ID NO: 425205 - DNA, 20 bp, Artificial
  CRISPR gRNA sequence
ctttgggaggctgaggcggg

SEQ ID NO: 425206 - DNA, 20 bp, Artificial
  CRISPR gRNA sequence
ggctgaggcgggcagatcac

SEQ ID NO: 425207 - DNA, 20 bp, Artificial
  CRISPR gRNA sequence
ctgaggcgggcagatcactg

SEQ ID NO: 425208 - DNA, 20 bp, Artificial
  CRISPR gRNA sequence
tgaggcgggcagatcactgg

SEQ ID NO: 425209 - DNA, 20 bp, Artificial
  CRISPR gRNA sequence
gcgggcagatcactggaggt

SEQ ID NO: 425210 - DNA, 20 bp, Artificial
  CRISPR gRNA sequence
cgggcagatcactggaggtc

SEQ ID NO: 425211 - DNA, 20 bp, Artificial
  CRISPR gRNA sequence
ggcagatcactggaggtcgg

SEQ ID NO: 425212 - DNA, 20 bp, Artificial
  CRISPR gRNA sequence
tcactggaggtcgggagttt

SEQ ID NO: 425213 - DNA, 20 bp, Artificial
  CRISPR gRNA sequence
ggaggtcgggagtttgagac

SEQ ID NO: 425214 - DNA, 20 bp, Artificial
  CRISPR gRNA sequence
agaccagcctgaccaacgtg

SEQ ID NO: 425215 - DNA, 20 bp, Artificial
  CRISPR gRNA sequence
ctctactaaaaatacaaaat

SEQ ID NO: 425216 - DNA, 20 bp, Artificial
  CRISPR gRNA sequence
actaaaaatacaaaattagc

SEQ ID NO: 425217 - DNA, 20 bp, Artificial
  CRISPR gRNA sequence
ctaaaaatacaaaattagcc

SEQ ID NO: 425218 - DNA, 20 bp, Artificial
  CRISPR gRNA sequence
aatacaaaattagccgggca

SEQ ID NO: 425219 - DNA, 20 bp, Artificial
  CRISPR gRNA sequence
acaaaattagccgggcatgg

SEQ ID NO: 425220 - DNA, 20 bp, Artificial
  CRISPR gRNA sequence
aaattagccgggcatggtgg

SEQ ID NO: 425221 - DNA, 20 bp, Artificial
  CRISPR gRNA sequence
aattagccgggcatggtggt

SEQ ID NO: 425222 - DNA, 20 bp, Artificial
  CRISPR gRNA sequence
gtggtgggtgcctgtaatcc

SEQ ID NO: 425223 - DNA, 20 bp, Artificial
  CRISPR gRNA sequence
tgcctgtaatcccagatact

SEQ ID NO: 425224 - DNA, 20 bp, Artificial
  CRISPR gRNA sequence
gcctgtaatcccagatactc

SEQ ID NO: 425225 - DNA, 20 bp, Artificial
  CRISPR gRNA sequence
ctgtaatcccagatactcag

SEQ ID NO: 425226 - DNA, 20 bp, Artificial
  CRISPR gRNA sequence
tgtaatcccagatactcagg

SEQ ID NO: 425227 - DNA, 20 bp, Artificial
  CRISPR gRNA sequence
tcccagatactcaggaggct

SEQ ID NO: 425228 - DNA, 20 bp, Artificial
  CRISPR gRNA sequence
cccagatactcaggaggctg

SEQ ID NO: 425229 - DNA, 20 bp, Artificial
  CRISPR gRNA sequence
agatactcaggaggctgagg

SEQ ID NO: 425230 - DNA, 20 bp, Artificial
  CRISPR gRNA sequence
gatactcaggaggctgaggc

SEQ ID NO: 425231 - DNA, 20 bp, Artificial
  CRISPR gRNA sequence
tactcaggaggctgaggcag

SEQ ID NO: 425232 - DNA, 20 bp, Artificial
  CRISPR gRNA sequence
ctcaggaggctgaggcagga

SEQ ID NO: 425233 - DNA, 20 bp, Artificial
  CRISPR gRNA sequence
aggagagaatcgcttgaact

SEQ ID NO: 425234 - DNA, 20 bp, Artificial
  CRISPR gRNA sequence
ggagagaatcgcttgaactc

SEQ ID NO: 425235 - DNA, 20 bp, Artificial
  CRISPR gRNA sequence
agagaatcgcttgaactcag

SEQ ID NO: 425236 - DNA, 20 bp, Artificial
  CRISPR gRNA sequence
gagaatcgcttgaactcagg

SEQ ID NO: 425237 - DNA, 20 bp, Artificial
  CRISPR gRNA sequence
aatcgcttgaactcaggagg

SEQ ID NO: 425238 - DNA, 20 bp, Artificial
  CRISPR gRNA sequence
cgcttgaactcaggaggcgg

SEQ ID NO: 425239 - DNA, 20 bp, Artificial
  CRISPR gRNA sequence
aactcaggaggcggaagttg

SEQ ID NO: 425240 - DNA, 20 bp, Artificial
  CRISPR gRNA sequence
caggaggcggaagttgcagt

SEQ ID NO: 425241 - DNA, 20 bp, Artificial
  CRISPR gRNA sequence
ggcggaagttgcagtgagct

SEQ ID NO: 425242 - DNA, 20 bp, Artificial
  CRISPR gRNA sequence
gagattgcgccattgcactc

SEQ ID NO: 425243 - DNA, 20 bp, Artificial
  CRISPR gRNA sequence
tgcgccattgcactccagcc

SEQ ID NO: 425244 - DNA, 20 bp, Artificial
  CRISPR gRNA sequence
gcgccattgcactccagcct

SEQ ID NO: 425245 - DNA, 20 bp, Artificial
  CRISPR gRNA sequence
tgcactccagcctgggcaac

SEQ ID NO: 425246 - DNA, 20 bp, Artificial
  CRISPR gRNA sequence
cactccagcctgggcaacaa

SEQ ID NO: 425247 - DNA, 20 bp, Artificial
  CRISPR gRNA sequence
caaaaaaaaaaaaaaaaaaa

SEQ ID NO: 425248 - DNA, 20 bp, Artificial
  CRISPR gRNA sequence
aaaaaaaaaaaaaaaaaaag

SEQ ID NO: 425249 - DNA, 20 bp, Artificial
  CRISPR gRNA sequence
aaaaaagaagtaacatttga

SEQ ID NO: 425250 - DNA, 20 bp, Artificial
  CRISPR gRNA sequence
aaaaagaagtaacatttgaa

SEQ ID NO: 425251 - DNA, 20 bp, Artificial
  CRISPR gRNA sequence
aacatttgaaaggaaacttt

SEQ ID NO: 425252 - DNA, 20 bp, Artificial
  CRISPR gRNA sequence
acatttgaaaggaaacttta

SEQ ID NO: 425253 - DNA, 20 bp, Artificial
  CRISPR gRNA sequence
aaggtaaccttttatcttct

SEQ ID NO: 425254 - DNA, 20 bp, Artificial
  CRISPR gRNA sequence
ttaatcttcaacataactga

SEQ ID NO: 425255 - DNA, 20 bp, Artificial
  CRISPR gRNA sequence
atcttcaacataactgacag

SEQ ID NO: 425256 - DNA, 20 bp, Artificial
  CRISPR gRNA sequence
acataactgacagcagtaaa

SEQ ID NO: 425257 - DNA, 20 bp, Artificial
  CRISPR gRNA sequence
cataactgacagcagtaaat

SEQ ID NO: 425258 - DNA, 20 bp, Artificial
  CRISPR gRNA sequence
taactgacagcagtaaatag

SEQ ID NO: 425259 - DNA, 20 bp, Artificial
  CRISPR gRNA sequence
cagcagtaaataggagttct

SEQ ID NO: 425260 - DNA, 20 bp, Artificial
  CRISPR gRNA sequence
agcagtaaataggagttctg

SEQ ID NO: 425261 - DNA, 20 bp, Artificial
  CRISPR gRNA sequence
aaataggagttctgaggatg

SEQ ID NO: 425262 - DNA, 20 bp, Artificial
  CRISPR gRNA sequence
ggagttctgaggatgcagtt

SEQ ID NO: 425263 - DNA, 20 bp, Artificial
  CRISPR gRNA sequence
gttctgaggatgcagtttag

SEQ ID NO: 425264 - DNA, 20 bp, Artificial
  CRISPR gRNA sequence
aaaaacatctgtgttaaaat

SEQ ID NO: 425265 - DNA, 20 bp, Artificial
  CRISPR gRNA sequence
aaaatcagctctaccactct

SEQ ID NO: 425266 - DNA, 20 bp, Artificial
  CRISPR gRNA sequence
ctaccactctgagcaactcc

SEQ ID NO: 425267 - DNA, 20 bp, Artificial
  CRISPR gRNA sequence
ctctgagcaactccaagctc

SEQ ID NO: 425268 - DNA, 20 bp, Artificial
  CRISPR gRNA sequence
ttctgcctgcatcaaacaaa

SEQ ID NO: 425269 - DNA, 20 bp, Artificial
  CRISPR gRNA sequence
tctgcctgcatcaaacaaat

SEQ ID NO: 425270 - DNA, 20 bp, Artificial
  CRISPR gRNA sequence
acaaatgggaatcatactaa

SEQ ID NO: 425271 - DNA, 20 bp, Artificial
  CRISPR gRNA sequence
actaatagttaacacttata

SEQ ID NO: 425272 - DNA, 20 bp, Artificial
  CRISPR gRNA sequence
atacagcacttaccatgttc

SEQ ID NO: 425273 - DNA, 20 bp, Artificial
  CRISPR gRNA sequence
tacagcacttaccatgttcc

SEQ ID NO: 425274 - DNA, 20 bp, Artificial
  CRISPR gRNA sequence
catgttccaggcattgttct

SEQ ID NO: 425275 - DNA, 20 bp, Artificial
  CRISPR gRNA sequence
gttctaagaccattttcttg

SEQ ID NO: 425276 - DNA, 20 bp, Artificial
  CRISPR gRNA sequence
ctaagaccattttcttgtag

SEQ ID NO: 425277 - DNA, 20 bp, Artificial
  CRISPR gRNA sequence
taagaccattttcttgtagt

SEQ ID NO: 425278 - DNA, 20 bp, Artificial
  CRISPR gRNA sequence
aagaccattttcttgtagta

SEQ ID NO: 425279 - DNA, 20 bp, Artificial
  CRISPR gRNA sequence
tagggaatttaatcctacat

SEQ ID NO: 425280 - DNA, 20 bp, Artificial
  CRISPR gRNA sequence
atcctacattagcatcgcat

SEQ ID NO: 425281 - DNA, 20 bp, Artificial
  CRISPR gRNA sequence
tcctacattagcatcgcata

SEQ ID NO: 425282 - DNA, 20 bp, Artificial
  CRISPR gRNA sequence
ttatattcatcctcctttca

SEQ ID NO: 425283 - DNA, 20 bp, Artificial
  CRISPR gRNA sequence
ttcatcctcctttcacagat

SEQ ID NO: 425284 - DNA, 20 bp, Artificial
  CRISPR gRNA sequence
cagatgagaaaactgataca

SEQ ID NO: 425285 - DNA, 20 bp, Artificial
  CRISPR gRNA sequence
gatgagaaaactgatacaca

SEQ ID NO: 425286 - DNA, 20 bp, Artificial
  CRISPR gRNA sequence
gagaaaactgatacacagag

SEQ ID NO: 425287 - DNA, 20 bp, Artificial
  CRISPR gRNA sequence
aactgatacacagagaagct

SEQ ID NO: 425288 - DNA, 20 bp, Artificial
  CRISPR gRNA sequence
gaagctaagaaatcctgtct

SEQ ID NO: 425289 - DNA, 20 bp, Artificial
  CRISPR gRNA sequence
aagctaagaaatcctgtctg

SEQ ID NO: 425290 - DNA, 20 bp, Artificial
  CRISPR gRNA sequence
agctaagaaatcctgtctga

SEQ ID NO: 425291 - DNA, 20 bp, Artificial
  CRISPR gRNA sequence
gaaatcctgtctgagggcaa

SEQ ID NO: 425292 - DNA, 20 bp, Artificial
  CRISPR gRNA sequence
atcctgtctgagggcaacag

SEQ ID NO: 425293 - DNA, 20 bp, Artificial
  CRISPR gRNA sequence
cctgtctgagggcaacagca

SEQ ID NO: 425294 - DNA, 20 bp, Artificial
  CRISPR gRNA sequence
tctgagggcaacagcagagc

SEQ ID NO: 425295 - DNA, 20 bp, Artificial
  CRISPR gRNA sequence
ctgagggcaacagcagagcc

SEQ ID NO: 425296 - DNA, 20 bp, Artificial
  CRISPR gRNA sequence
gcagagccaggatttgcacc

SEQ ID NO: 425297 - DNA, 20 bp, Artificial
  CRISPR gRNA sequence
ggatttgcacccagactgtc

SEQ ID NO: 425298 - DNA, 20 bp, Artificial
  CRISPR gRNA sequence
gcacccagactgtctggtgt

SEQ ID NO: 425299 - DNA, 20 bp, Artificial
  CRISPR gRNA sequence
acccagactgtctggtgtca

SEQ ID NO: 425300 - DNA, 20 bp, Artificial
  CRISPR gRNA sequence
actgtctggtgtcagagtct

SEQ ID NO: 425301 - DNA, 20 bp, Artificial
  CRISPR gRNA sequence
agagtctgagcttttaacca

SEQ ID NO: 425302 - DNA, 20 bp, Artificial
  CRISPR gRNA sequence
catggtgctatactgtctct

SEQ ID NO: 425303 - DNA, 20 bp, Artificial
  CRISPR gRNA sequence
tgctatactgtctctcagat

SEQ ID NO: 425304 - DNA, 20 bp, Artificial
  CRISPR gRNA sequence
tactgtctctcagataagat

SEQ ID NO: 425305 - DNA, 20 bp, Artificial
  CRISPR gRNA sequence
aagaatccttttctaacctc

SEQ ID NO: 425306 - DNA, 20 bp, Artificial
  CRISPR gRNA sequence
agaatccttttctaacctct

SEQ ID NO: 425307 - DNA, 20 bp, Artificial
  CRISPR gRNA sequence
cttttctaacctctgggaat

SEQ ID NO: 425308 - DNA, 20 bp, Artificial
  CRISPR gRNA sequence
tgggaattggtttaaatgta

SEQ ID NO: 425309 - DNA, 20 bp, Artificial
  CRISPR gRNA sequence
gggaattggtttaaatgtac

SEQ ID NO: 425310 - DNA, 20 bp, Artificial
  CRISPR gRNA sequence
aattggtttaaatgtacagg

SEQ ID NO: 425311 - DNA, 20 bp, Artificial
  CRISPR gRNA sequence
tacaggtggataacaaatat

SEQ ID NO: 425312 - DNA, 20 bp, Artificial
  CRISPR gRNA sequence
acaggtggataacaaatatg

SEQ ID NO: 425313 - DNA, 20 bp, Artificial
  CRISPR gRNA sequence
caggtggataacaaatatga

SEQ ID NO: 425314 - DNA, 20 bp, Artificial
  CRISPR gRNA sequence
ataacaaatatgagggcatt

SEQ ID NO: 425315 - DNA, 20 bp, Artificial
  CRISPR gRNA sequence
taacaaatatgagggcattt

SEQ ID NO: 425316 - DNA, 20 bp, Artificial
  CRISPR gRNA sequence
atgagggcatttgggaaact

SEQ ID NO: 425317 - DNA, 20 bp, Artificial
  CRISPR gRNA sequence
agggcatttgggaaacttgg

SEQ ID NO: 425318 - DNA, 20 bp, Artificial
  CRISPR gRNA sequence
aattactgtacaattaaact

SEQ ID NO: 425319 - DNA, 20 bp, Artificial
  CRISPR gRNA sequence
ctgtacaattaaacttagca

SEQ ID NO: 425320 - DNA, 20 bp, Artificial
  CRISPR gRNA sequence
tgtacaattaaacttagcac

SEQ ID NO: 425321 - DNA, 20 bp, Artificial
  CRISPR gRNA sequence
gcacaggctatgtttttaac

SEQ ID NO: 425322 - DNA, 20 bp, Artificial
  CRISPR gRNA sequence
agctctactctttatacact

SEQ ID NO: 425323 - DNA, 20 bp, Artificial
  CRISPR gRNA sequence
gctctactctttatacactt

SEQ ID NO: 425324 - DNA, 20 bp, Artificial
  CRISPR gRNA sequence
ctctactctttatacactta

SEQ ID NO: 425325 - DNA, 20 bp, Artificial
  CRISPR gRNA sequence
tctactctttatacacttag

SEQ ID NO: 425326 - DNA, 20 bp, Artificial
  CRISPR gRNA sequence
aattatactaaaccaataaa

SEQ ID NO: 425327 - DNA, 20 bp, Artificial
  CRISPR gRNA sequence
attatactaaaccaataaat

SEQ ID NO: 425328 - DNA, 20 bp, Artificial
  CRISPR gRNA sequence
ttgcatatgacctcatcaac

SEQ ID NO: 425329 - DNA, 20 bp, Artificial
  CRISPR gRNA sequence
acctcatcaactggtcttcc

SEQ ID NO: 425330 - DNA, 20 bp, Artificial
  CRISPR gRNA sequence
cctcatcaactggtcttcct

SEQ ID NO: 425331 - DNA, 20 bp, Artificial
  CRISPR gRNA sequence
actggtcttcctaggaaata

SEQ ID NO: 425332 - DNA, 20 bp, Artificial
  CRISPR gRNA sequence
ctggtcttcctaggaaatat

SEQ ID NO: 425333 - DNA, 20 bp, Artificial
  CRISPR gRNA sequence
tcttcctaggaaatataggt

SEQ ID NO: 425334 - DNA, 20 bp, Artificial
  CRISPR gRNA sequence
gtaagatgtgcttcttacat

SEQ ID NO: 425335 - DNA, 20 bp, Artificial
  CRISPR gRNA sequence
atgtgcttcttacataagaa

SEQ ID NO: 425336 - DNA, 20 bp, Artificial
  CRISPR gRNA sequence
tgcttcttacataagaacag

SEQ ID NO: 425337 - DNA, 20 bp, Artificial
  CRISPR gRNA sequence
tacataagaacagtggttct

SEQ ID NO: 425338 - DNA, 20 bp, Artificial
  CRISPR gRNA sequence
agaacagtggttctcagtat

SEQ ID NO: 425339 - DNA, 20 bp, Artificial
  CRISPR gRNA sequence
tctcagtattggctgcccat

SEQ ID NO: 425340 - DNA, 20 bp, Artificial
  CRISPR gRNA sequence
ggctgcccattagaatcacc

SEQ ID NO: 425341 - DNA, 20 bp, Artificial
  CRISPR gRNA sequence
gaatcacctggaaatgcttt

SEQ ID NO: 425342 - DNA, 20 bp, Artificial
  CRISPR gRNA sequence
ttttagaccttacccttgtt

SEQ ID NO: 425343 - DNA, 20 bp, Artificial
  CRISPR gRNA sequence
cccttgtttagctctgctat

SEQ ID NO: 425344 - DNA, 20 bp, Artificial
  CRISPR gRNA sequence
ccttgtttagctctgctatt

SEQ ID NO: 425345 - DNA, 20 bp, Artificial
  CRISPR gRNA sequence
cttgtttagctctgctatta

SEQ ID NO: 425346 - DNA, 20 bp, Artificial
  CRISPR gRNA sequence
attagggattctgattgaat

SEQ ID NO: 425347 - DNA, 20 bp, Artificial
  CRISPR gRNA sequence
ggattctgattgaattggtc

SEQ ID NO: 425348 - DNA, 20 bp, Artificial
  CRISPR gRNA sequence
gattctgattgaattggtct

SEQ ID NO: 425349 - DNA, 20 bp, Artificial
  CRISPR gRNA sequence
ctgattgaattggtctgggt

SEQ ID NO: 425350 - DNA, 20 bp, Artificial
  CRISPR gRNA sequence
tgattgaattggtctgggtg

SEQ ID NO: 425351 - DNA, 20 bp, Artificial
  CRISPR gRNA sequence
aattggtctgggtgaggcct

SEQ ID NO: 425352 - DNA, 20 bp, Artificial
  CRISPR gRNA sequence
tctgggtgaggcctcggcat

SEQ ID NO: 425353 - DNA, 20 bp, Artificial
  CRISPR gRNA sequence
agtatgatttaaaatctcct

SEQ ID NO: 425354 - DNA, 20 bp, Artificial
  CRISPR gRNA sequence
gtatgatttaaaatctcctc

SEQ ID NO: 425355 - DNA, 20 bp, Artificial
  CRISPR gRNA sequence
ttcaaatgtgatcccgaatt

SEQ ID NO: 425356 - DNA, 20 bp, Artificial
  CRISPR gRNA sequence
aaatgtgatcccgaattgag

SEQ ID NO: 425357 - DNA, 20 bp, Artificial
  CRISPR gRNA sequence
aattgagaagccctgctgtg

SEQ ID NO: 425358 - DNA, 20 bp, Artificial
  CRISPR gRNA sequence
agccctgctgtgcagtgttt

SEQ ID NO: 425359 - DNA, 20 bp, Artificial
  CRISPR gRNA sequence
gccctgctgtgcagtgtttc

SEQ ID NO: 425360 - DNA, 20 bp, Artificial
  CRISPR gRNA sequence
caggattgcattttctatgc

SEQ ID NO: 425361 - DNA, 20 bp, Artificial
  CRISPR gRNA sequence
ggattgcattttctatgcta

SEQ ID NO: 425362 - DNA, 20 bp, Artificial
  CRISPR gRNA sequence
gattgcattttctatgctag

SEQ ID NO: 425363 - DNA, 20 bp, Artificial
  CRISPR gRNA sequence
attgcattttctatgctaga

SEQ ID NO: 425364 - DNA, 20 bp, Artificial
  CRISPR gRNA sequence
tgcattttctatgctagagg

SEQ ID NO: 425365 - DNA, 20 bp, Artificial
  CRISPR gRNA sequence
cattttctatgctagaggga

SEQ ID NO: 425366 - DNA, 20 bp, Artificial
  CRISPR gRNA sequence
attttctatgctagagggag

SEQ ID NO: 425367 - DNA, 20 bp, Artificial
  CRISPR gRNA sequence
gtttatccaccaacttgctc

SEQ ID NO: 425368 - DNA, 20 bp, Artificial
  CRISPR gRNA sequence
tatccaccaacttgctccag

SEQ ID NO: 425369 - DNA, 20 bp, Artificial
  CRISPR gRNA sequence
atccaccaacttgctccagc

SEQ ID NO: 425370 - DNA, 20 bp, Artificial
  CRISPR gRNA sequence
ttgctccagcaggaatacct

SEQ ID NO: 425371 - DNA, 20 bp, Artificial
  CRISPR gRNA sequence
gcaggaatacctgagctttc

SEQ ID NO: 425372 - DNA, 20 bp, Artificial
  CRISPR gRNA sequence
caggaatacctgagctttct

SEQ ID NO: 425373 - DNA, 20 bp, Artificial
  CRISPR gRNA sequence
cctgagctttctaggacctc

SEQ ID NO: 425374 - DNA, 20 bp, Artificial
  CRISPR gRNA sequence
ctgagctttctaggacctcc

SEQ ID NO: 425375 - DNA, 20 bp, Artificial
  CRISPR gRNA sequence
agctttctaggacctccagg

SEQ ID NO: 425376 - DNA, 20 bp, Artificial
  CRISPR gRNA sequence
gacctccaggaagattctcc

SEQ ID NO: 425377 - DNA, 20 bp, Artificial
  CRISPR gRNA sequence
tctcccagtgtacgtcccat

SEQ ID NO: 425378 - DNA, 20 bp, Artificial
  CRISPR gRNA sequence
ctcccagtgtacgtcccatc

SEQ ID NO: 425379 - DNA, 20 bp, Artificial
  CRISPR gRNA sequence
tcccagtgtacgtcccatca

SEQ ID NO: 425380 - DNA, 20 bp, Artificial
  CRISPR gRNA sequence
cagtgtacgtcccatcaggg

SEQ ID NO: 425381 - DNA, 20 bp, Artificial
  CRISPR gRNA sequence
agtgtacgtcccatcagggt

SEQ ID NO: 425382 - DNA, 20 bp, Artificial
  CRISPR gRNA sequence
tcccatcagggtaggtgtga

SEQ ID NO: 425383 - DNA, 20 bp, Artificial
  CRISPR gRNA sequence
cagggtaggtgtgatagatg

SEQ ID NO: 425384 - DNA, 20 bp, Artificial
  CRISPR gRNA sequence
ggtaggtgtgatagatgcag

SEQ ID NO: 425385 - DNA, 20 bp, Artificial
  CRISPR gRNA sequence
gtactcccctgtatcgttca

SEQ ID NO: 425386 - DNA, 20 bp, Artificial
  CRISPR gRNA sequence
tcccctgtatcgttcacggt

SEQ ID NO: 425387 - DNA, 20 bp, Artificial
  CRISPR gRNA sequence
tatcgttcacggtcagcgac

SEQ ID NO: 425388 - DNA, 20 bp, Artificial
  CRISPR gRNA sequence
tcgttcacggtcagcgactg

SEQ ID NO: 425389 - DNA, 20 bp, Artificial
  CRISPR gRNA sequence
cgttcacggtcagcgactgg

SEQ ID NO: 425390 - DNA, 20 bp, Artificial
  CRISPR gRNA sequence
gttcacggtcagcgactgga

SEQ ID NO: 425391 - DNA, 20 bp, Artificial
  CRISPR gRNA sequence
acggtcagcgactggagggt

SEQ ID NO: 425392 - DNA, 20 bp, Artificial
  CRISPR gRNA sequence
cggtcagcgactggagggtg

SEQ ID NO: 425393 - DNA, 20 bp, Artificial
  CRISPR gRNA sequence
agcgactggagggtgaggcc

SEQ ID NO: 425394 - DNA, 20 bp, Artificial
  CRISPR gRNA sequence
gcgactggagggtgaggccc

SEQ ID NO: 425395 - DNA, 20 bp, Artificial
  CRISPR gRNA sequence
ctggagggtgaggcccaggc

SEQ ID NO: 425396 - DNA, 20 bp, Artificial
  CRISPR gRNA sequence
tggagggtgaggcccaggcc

SEQ ID NO: 425397 - DNA, 20 bp, Artificial
  CRISPR gRNA sequence
gtgaggcccaggccgggacc

SEQ ID NO: 425398 - DNA, 20 bp, Artificial
  CRISPR gRNA sequence
tgaggcccaggccgggacct

SEQ ID NO: 425399 - DNA, 20 bp, Artificial
  CRISPR gRNA sequence
gaggcccaggccgggacctg

SEQ ID NO: 425400 - DNA, 20 bp, Artificial
  CRISPR gRNA sequence
ctggggccactcgatccttg

SEQ ID NO: 425401 - DNA, 20 bp, Artificial
  CRISPR gRNA sequence
tggggccactcgatccttga

SEQ ID NO: 425402 - DNA, 20 bp, Artificial
  CRISPR gRNA sequence
gccactcgatccttgaagga

SEQ ID NO: 425403 - DNA, 20 bp, Artificial
  CRISPR gRNA sequence
ccactcgatccttgaaggat

SEQ ID NO: 425404 - DNA, 20 bp, Artificial
  CRISPR gRNA sequence
cactcgatccttgaaggatg

SEQ ID NO: 425405 - DNA, 20 bp, Artificial
  CRISPR gRNA sequence
ctcgatccttgaaggatggg

SEQ ID NO: 425406 - DNA, 20 bp, Artificial
  CRISPR gRNA sequence
atggggagatgtgccacccc

SEQ ID NO: 425407 - DNA, 20 bp, Artificial
  CRISPR gRNA sequence
ggagatgtgccaccccaagt

SEQ ID NO: 425408 - DNA, 20 bp, Artificial
  CRISPR gRNA sequence
ccccaagtcagcattacaaa

SEQ ID NO: 425409 - DNA, 20 bp, Artificial
  CRISPR gRNA sequence
aagtcagcattacaaatggc

SEQ ID NO: 425410 - DNA, 20 bp, Artificial
  CRISPR gRNA sequence
tcagcattacaaatggccag

SEQ ID NO: 425411 - DNA, 20 bp, Artificial
  CRISPR gRNA sequence
cattacaaatggccagaagc

SEQ ID NO: 425412 - DNA, 20 bp, Artificial
  CRISPR gRNA sequence
gaagctggtcctgctgctcc

SEQ ID NO: 425413 - DNA, 20 bp, Artificial
  CRISPR gRNA sequence
cctgctgctcccagttgacc

SEQ ID NO: 425414 - DNA, 20 bp, Artificial
  CRISPR gRNA sequence
ctgctgctcccagttgacct

SEQ ID NO: 425415 - DNA, 20 bp, Artificial
  CRISPR gRNA sequence
gacctgggtcacttgtgccg

SEQ ID NO: 425416 - DNA, 20 bp, Artificial
  CRISPR gRNA sequence
ctgggtcacttgtgccgtgg

SEQ ID NO: 425417 - DNA, 20 bp, Artificial
  CRISPR gRNA sequence
gggtcacttgtgccgtggtg

SEQ ID NO: 425418 - DNA, 20 bp, Artificial
  CRISPR gRNA sequence
ggtcacttgtgccgtggtgg

SEQ ID NO: 425419 - DNA, 20 bp, Artificial
  CRISPR gRNA sequence
tcacttgtgccgtggtggag

SEQ ID NO: 425420 - DNA, 20 bp, Artificial
  CRISPR gRNA sequence
acttgtgccgtggtggagga

SEQ ID NO: 425421 - DNA, 20 bp, Artificial
  CRISPR gRNA sequence
cttgtgccgtggtggaggag

SEQ ID NO: 425422 - DNA, 20 bp, Artificial
  CRISPR gRNA sequence
tggaggagaggtgacattgt

SEQ ID NO: 425423 - DNA, 20 bp, Artificial
  CRISPR gRNA sequence
gaggtgacattgtaagatga

SEQ ID NO: 425424 - DNA, 20 bp, Artificial
  CRISPR gRNA sequence
ggtgacattgtaagatgata

SEQ ID NO: 425425 - DNA, 20 bp, Artificial
  CRISPR gRNA sequence
gatagagccacctttctctg

SEQ ID NO: 425426 - DNA, 20 bp, Artificial
  CRISPR gRNA sequence
attgtgcctgtcatcattcc

SEQ ID NO: 425427 - DNA, 20 bp, Artificial
  CRISPR gRNA sequence
ttgtgcctgtcatcattcct

SEQ ID NO: 425428 - DNA, 20 bp, Artificial
  CRISPR gRNA sequence
tgtgcctgtcatcattccta

SEQ ID NO: 425429 - DNA, 20 bp, Artificial
  CRISPR gRNA sequence
gcctgtcatcattcctaggg

SEQ ID NO: 425430 - DNA, 20 bp, Artificial
  CRISPR gRNA sequence
ctgtcatcattcctagggaa

SEQ ID NO: 425431 - DNA, 20 bp, Artificial
  CRISPR gRNA sequence
tgtcatcattcctagggaag

SEQ ID NO: 425432 - DNA, 20 bp, Artificial
  CRISPR gRNA sequence
cattcctagggaagaggacg

SEQ ID NO: 425433 - DNA, 20 bp, Artificial
  CRISPR gRNA sequence
gaagaggacgaagcacatgt

SEQ ID NO: 425434 - DNA, 20 bp, Artificial
  CRISPR gRNA sequence
gacgaagcacatgtgagtcc

SEQ ID NO: 425435 - DNA, 20 bp, Artificial
  CRISPR gRNA sequence
acgaagcacatgtgagtcct

SEQ ID NO: 425436 - DNA, 20 bp, Artificial
  CRISPR gRNA sequence
agcacatgtgagtcctgggt

SEQ ID NO: 425437 - DNA, 20 bp, Artificial
  CRISPR gRNA sequence
acatgtgagtcctgggtcag

SEQ ID NO: 425438 - DNA, 20 bp, Artificial
  CRISPR gRNA sequence
gtgagtcctgggtcagcagc

SEQ ID NO: 425439 - DNA, 20 bp, Artificial
  CRISPR gRNA sequence
cagctggccttcaaccttcc

SEQ ID NO: 425440 - DNA, 20 bp, Artificial
  CRISPR gRNA sequence
aaccttcctagaaaaattct

SEQ ID NO: 425441 - DNA, 20 bp, Artificial
  CRISPR gRNA sequence
accttcctagaaaaattcta

SEQ ID NO: 425442 - DNA, 20 bp, Artificial
  CRISPR gRNA sequence
ccttcctagaaaaattctaa

SEQ ID NO: 425443 - DNA, 20 bp, Artificial
  CRISPR gRNA sequence
gaaaaattctaagggccttt

SEQ ID NO: 425444 - DNA, 20 bp, Artificial
  CRISPR gRNA sequence
aaaaattctaagggcctttg

SEQ ID NO: 425445 - DNA, 20 bp, Artificial
  CRISPR gRNA sequence
agggcctttgaggccccaac

SEQ ID NO: 425446 - DNA, 20 bp, Artificial
  CRISPR gRNA sequence
ttgaggccccaactggattt

SEQ ID NO: 425447 - DNA, 20 bp, Artificial
  CRISPR gRNA sequence
ccaactggattttggaatga

SEQ ID NO: 425448 - DNA, 20 bp, Artificial
  CRISPR gRNA sequence
ttttggaatgatagtttctc

SEQ ID NO: 425449 - DNA, 20 bp, Artificial
  CRISPR gRNA sequence
tccatcctgttgctcctcca

SEQ ID NO: 425450 - DNA, 20 bp, Artificial
  CRISPR gRNA sequence
catcctgttgctcctccata

SEQ ID NO: 425451 - DNA, 20 bp, Artificial
  CRISPR gRNA sequence
atcctgttgctcctccatag

SEQ ID NO: 425452 - DNA, 20 bp, Artificial
  CRISPR gRNA sequence
tttcctgtttcttccatttc

SEQ ID NO: 425453 - DNA, 20 bp, Artificial
  CRISPR gRNA sequence
tcctgtttcttccatttcaa

SEQ ID NO: 425454 - DNA, 20 bp, Artificial
  CRISPR gRNA sequence
cctctccatgcctgttattc

SEQ ID NO: 425455 - DNA, 20 bp, Artificial
  CRISPR gRNA sequence
ctctccatgcctgttattca

SEQ ID NO: 425456 - DNA, 20 bp, Artificial
  CRISPR gRNA sequence
tgcctgttattcaaggctcc

SEQ ID NO: 425457 - DNA, 20 bp, Artificial
  CRISPR gRNA sequence
aaggctcccagtcccccatt

SEQ ID NO: 425458 - DNA, 20 bp, Artificial
  CRISPR gRNA sequence
aggctcccagtcccccattc

SEQ ID NO: 425459 - DNA, 20 bp, Artificial
  CRISPR gRNA sequence
ccccattcaggttgtctttc

SEQ ID NO: 425460 - DNA, 20 bp, Artificial
  CRISPR gRNA sequence
ttctccacacatctctactc

SEQ ID NO: 425461 - DNA, 20 bp, Artificial
  CRISPR gRNA sequence
cacacatctctactccagcc

SEQ ID NO: 425462 - DNA, 20 bp, Artificial
  CRISPR gRNA sequence
atctctactccagcccagcc

SEQ ID NO: 425463 - DNA, 20 bp, Artificial
  CRISPR gRNA sequence
cacccactgccctatgcttc

SEQ ID NO: 425464 - DNA, 20 bp, Artificial
  CRISPR gRNA sequence
cccactgccctatgcttcca

SEQ ID NO: 425465 - DNA, 20 bp, Artificial
  CRISPR gRNA sequence
ccctctttacacctcgccca

SEQ ID NO: 425466 - DNA, 20 bp, Artificial
  CRISPR gRNA sequence
cctctttacacctcgcccac

SEQ ID NO: 425467 - DNA, 20 bp, Artificial
  CRISPR gRNA sequence
ctctttacacctcgcccaca

SEQ ID NO: 425468 - DNA, 20 bp, Artificial
  CRISPR gRNA sequence
ctttacacctcgcccacagg

SEQ ID NO: 425469 - DNA, 20 bp, Artificial
  CRISPR gRNA sequence
tttacacctcgcccacaggg

SEQ ID NO: 425470 - DNA, 20 bp, Artificial
  CRISPR gRNA sequence
cgcccacagggaggcttgtc

SEQ ID NO: 425471 - DNA, 20 bp, Artificial
  CRISPR gRNA sequence
gcccacagggaggcttgtca

SEQ ID NO: 425472 - DNA, 20 bp, Artificial
  CRISPR gRNA sequence
tgcactccctccccgcctcc

SEQ ID NO: 425473 - DNA, 20 bp, Artificial
  CRISPR gRNA sequence
actccctccccgcctcctag

SEQ ID NO: 425474 - DNA, 20 bp, Artificial
  CRISPR gRNA sequence
ccccgcctcctagaagacct

SEQ ID NO: 425475 - DNA, 20 bp, Artificial
  CRISPR gRNA sequence
cactgcctgtattgtataat

SEQ ID NO: 425476 - DNA, 20 bp, Artificial
  CRISPR gRNA sequence
ttagcaccttactaaatgcc

SEQ ID NO: 425477 - DNA, 20 bp, Artificial
  CRISPR gRNA sequence
tggcttatgactacacaact

SEQ ID NO: 425478 - DNA, 20 bp, Artificial
  CRISPR gRNA sequence
ccctcgcatattctgctatg

SEQ ID NO: 425479 - DNA, 20 bp, Artificial
  CRISPR gRNA sequence
tattctgctatgtagcttca

SEQ ID NO: 425480 - DNA, 20 bp, Artificial
  CRISPR gRNA sequence
ctgctatgtagcttcatggc

SEQ ID NO: 425481 - DNA, 20 bp, Artificial
  CRISPR gRNA sequence
tggccagcttgttattttcg

SEQ ID NO: 425482 - DNA, 20 bp, Artificial
  CRISPR gRNA sequence
ggccagcttgttattttcgt

SEQ ID NO: 425483 - DNA, 20 bp, Artificial
  CRISPR gRNA sequence
gcctattttgtctacccact

SEQ ID NO: 425484 - DNA, 20 bp, Artificial
  CRISPR gRNA sequence
tgtctacccacttagaatat

SEQ ID NO: 425485 - DNA, 20 bp, Artificial
  CRISPR gRNA sequence
cttagaatataagcccttgt

SEQ ID NO: 425486 - DNA, 20 bp, Artificial
  CRISPR gRNA sequence
tgtttttatgtttcttcctg

SEQ ID NO: 425487 - DNA, 20 bp, Artificial
  CRISPR gRNA sequence
ttatgtttcttcctgcggcc

SEQ ID NO: 425488 - DNA, 20 bp, Artificial
  CRISPR gRNA sequence
cctgcggcctagttctatgc

SEQ ID NO: 425489 - DNA, 20 bp, Artificial
  CRISPR gRNA sequence
tgaaataaaaccttgctgtt

SEQ ID NO: 425490 - DNA, 20 bp, Artificial
  CRISPR gRNA sequence
gtttggttgattgtcatttg

SEQ ID NO: 425491 - DNA, 20 bp, Artificial
  CRISPR gRNA sequence
gcagtgcctgaaaaaacctt

SEQ ID NO: 425492 - DNA, 20 bp, Artificial
  CRISPR gRNA sequence
cagtgcctgaaaaaaccttc

SEQ ID NO: 425493 - DNA, 20 bp, Artificial
  CRISPR gRNA sequence
gcctgaaaaaaccttcagga

SEQ ID NO: 425494 - DNA, 20 bp, Artificial
  CRISPR gRNA sequence
aaaaaaccttcaggaaagcc

SEQ ID NO: 425495 - DNA, 20 bp, Artificial
  CRISPR gRNA sequence
aggaaagccaagaaatccaa

SEQ ID NO: 425496 - DNA, 20 bp, Artificial
  CRISPR gRNA sequence
agccaagaaatccaatagca

SEQ ID NO: 425497 - DNA, 20 bp, Artificial
  CRISPR gRNA sequence
gccaagaaatccaatagcaa

SEQ ID NO: 425498 - DNA, 20 bp, Artificial
  CRISPR gRNA sequence
aagaaatccaatagcaaagg

SEQ ID NO: 425499 - DNA, 20 bp, Artificial
  CRISPR gRNA sequence
atccaatagcaaaggaagct

SEQ ID NO: 425500 - DNA, 20 bp, Artificial
  CRISPR gRNA sequence
caatagcaaaggaagcttag

SEQ ID NO: 425501 - DNA, 20 bp, Artificial
  CRISPR gRNA sequence
aatagcaaaggaagcttagc

SEQ ID NO: 425502 - DNA, 20 bp, Artificial
  CRISPR gRNA sequence
gcaggaaaccctgcttctcc

SEQ ID NO: 425503 - DNA, 20 bp, Artificial
  CRISPR gRNA sequence
caggaaaccctgcttctccc

SEQ ID NO: 425504 - DNA, 20 bp, Artificial
  CRISPR gRNA sequence
cccaggcataaccaccctct

SEQ ID NO: 425505 - DNA, 20 bp, Artificial
  CRISPR gRNA sequence
ctcagcacttaacctctccc

SEQ ID NO: 425506 - DNA, 20 bp, Artificial
  CRISPR gRNA sequence
taacctctccccagcaaccc

SEQ ID NO: 425507 - DNA, 20 bp, Artificial
  CRISPR gRNA sequence
aacctctccccagcaaccct

SEQ ID NO: 425508 - DNA, 20 bp, Artificial
  CRISPR gRNA sequence
cctgggcacatctccatcct

SEQ ID NO: 425509 - DNA, 20 bp, Artificial
  CRISPR gRNA sequence
ggcacatctccatcctcaga

SEQ ID NO: 425510 - DNA, 20 bp, Artificial
  CRISPR gRNA sequence
atctccatcctcagatagtt

SEQ ID NO: 425511 - DNA, 20 bp, Artificial
  CRISPR gRNA sequence
tccatcctcagatagttcag

SEQ ID NO: 425512 - DNA, 20 bp, Artificial
  CRISPR gRNA sequence
ccatcctcagatagttcaga

SEQ ID NO: 425513 - DNA, 20 bp, Artificial
  CRISPR gRNA sequence
ataaaaactaatttatacca

SEQ ID NO: 425514 - DNA, 20 bp, Artificial
  CRISPR gRNA sequence
atatttgtgttcccctccct

SEQ ID NO: 425515 - DNA, 20 bp, Artificial
  CRISPR gRNA sequence
tttgactctgatttttaata

SEQ ID NO: 425516 - DNA, 20 bp, Artificial
  CRISPR gRNA sequence
gactctgatttttaatatag

SEQ ID NO: 425517 - DNA, 20 bp, Artificial
  CRISPR gRNA sequence
aaataaatttaacaaaaaat

SEQ ID NO: 425518 - DNA, 20 bp, Artificial
  CRISPR gRNA sequence
tttaacaaaaaatcagtctc

SEQ ID NO: 425519 - DNA, 20 bp, Artificial
  CRISPR gRNA sequence
aacaaaaaatcagtctctag

SEQ ID NO: 425520 - DNA, 20 bp, Artificial
  CRISPR gRNA sequence
aaaaaatcagtctctagtgg

SEQ ID NO: 425521 - DNA, 20 bp, Artificial
  CRISPR gRNA sequence
gtctctagtggtagaacctc

SEQ ID NO: 425522 - DNA, 20 bp, Artificial
  CRISPR gRNA sequence
aacctctggaatctgtgaaa

SEQ ID NO: 425523 - DNA, 20 bp, Artificial
  CRISPR gRNA sequence
aaaaagacattttcaattca

SEQ ID NO: 425524 - DNA, 20 bp, Artificial
  CRISPR gRNA sequence
aaagacattttcaattcaca

SEQ ID NO: 425525 - DNA, 20 bp, Artificial
  CRISPR gRNA sequence
gagaacttataatgttttcc

SEQ ID NO: 425526 - DNA, 20 bp, Artificial
  CRISPR gRNA sequence
acttataatgttttcctgga

SEQ ID NO: 425527 - DNA, 20 bp, Artificial
  CRISPR gRNA sequence
ttttcctggaaagttcctga

SEQ ID NO: 425528 - DNA, 20 bp, Artificial
  CRISPR gRNA sequence
tttcctggaaagttcctgaa

SEQ ID NO: 425529 - DNA, 20 bp, Artificial
  CRISPR gRNA sequence
ggaaagttcctgaaaggcaa

SEQ ID NO: 425530 - DNA, 20 bp, Artificial
  CRISPR gRNA sequence
gttcctgaaaggcaacagaa

SEQ ID NO: 425531 - DNA, 20 bp, Artificial
  CRISPR gRNA sequence
cctgaaaggcaacagaaaag

SEQ ID NO: 425532 - DNA, 20 bp, Artificial
  CRISPR gRNA sequence
aaaggcaacagaaaagaagc

SEQ ID NO: 425533 - DNA, 20 bp, Artificial
  CRISPR gRNA sequence
aggcaacagaaaagaagctg

SEQ ID NO: 425534 - DNA, 20 bp, Artificial
  CRISPR gRNA sequence
caacagaaaagaagctggag

SEQ ID NO: 425535 - DNA, 20 bp, Artificial
  CRISPR gRNA sequence
aacagaaaagaagctggagc

SEQ ID NO: 425536 - DNA, 20 bp, Artificial
  CRISPR gRNA sequence
aaagaagctggagcaggaat

SEQ ID NO: 425537 - DNA, 20 bp, Artificial
  CRISPR gRNA sequence
gagcaggaatgagcttctaa

SEQ ID NO: 425538 - DNA, 20 bp, Artificial
  CRISPR gRNA sequence
atgagcttctaaaagcaaac

SEQ ID NO: 425539 - DNA, 20 bp, Artificial
  CRISPR gRNA sequence
aactggcaatgcctcctgcc

SEQ ID NO: 425540 - DNA, 20 bp, Artificial
  CRISPR gRNA sequence
ccagcccttcttcttcctga

SEQ ID NO: 425541 - DNA, 20 bp, Artificial
  CRISPR gRNA sequence
gcccttcttcttcctgaaag

SEQ ID NO: 425542 - DNA, 20 bp, Artificial
  CRISPR gRNA sequence
ttcctgaaagtagccgactg

SEQ ID NO: 425543 - DNA, 20 bp, Artificial
  CRISPR gRNA sequence
agtcctgctccttcttgtgc

SEQ ID NO: 425544 - DNA, 20 bp, Artificial
  CRISPR gRNA sequence
ctgctccttcttgtgctggc

SEQ ID NO: 425545 - DNA, 20 bp, Artificial
  CRISPR gRNA sequence
tccttcttgtgctggccagt

SEQ ID NO: 425546 - DNA, 20 bp, Artificial
  CRISPR gRNA sequence
ccttcttgtgctggccagtc

SEQ ID NO: 425547 - DNA, 20 bp, Artificial
  CRISPR gRNA sequence
cagtcaggctcctccaaccc

SEQ ID NO: 425548 - DNA, 20 bp, Artificial
  CRISPR gRNA sequence
tcaggctcctccaaccccgg

SEQ ID NO: 425549 - DNA, 20 bp, Artificial
  CRISPR gRNA sequence
tccaaccccggaagtctgca

SEQ ID NO: 425550 - DNA, 20 bp, Artificial
  CRISPR gRNA sequence
ccttcatctgccaccaaaaa

SEQ ID NO: 425551 - DNA, 20 bp, Artificial
  CRISPR gRNA sequence
acagaaccccacctcattct

SEQ ID NO: 425552 - DNA, 20 bp, Artificial
  CRISPR gRNA sequence
agaaccccacctcattctca

SEQ ID NO: 425553 - DNA, 20 bp, Artificial
  CRISPR gRNA sequence
gagattgtcctttcttaaat

SEQ ID NO: 425554 - DNA, 20 bp, Artificial
  CRISPR gRNA sequence
gattgtcctttcttaaataa

SEQ ID NO: 425555 - DNA, 20 bp, Artificial
  CRISPR gRNA sequence
ctttcttaaataagagtaca

SEQ ID NO: 425556 - DNA, 20 bp, Artificial
  CRISPR gRNA sequence
tttcttaaataagagtacac

SEQ ID NO: 425557 - DNA, 20 bp, Artificial
  CRISPR gRNA sequence
aagagtacacaggactctaa

SEQ ID NO: 425558 - DNA, 20 bp, Artificial
  CRISPR gRNA sequence
agttgcaatttctttctctc

SEQ ID NO: 425559 - DNA, 20 bp, Artificial
  CRISPR gRNA sequence
tgcaatttctttctctcaag

SEQ ID NO: 425560 - DNA, 20 bp, Artificial
  CRISPR gRNA sequence
ttctttctctcaagcagctg

SEQ ID NO: 425561 - DNA, 20 bp, Artificial
  CRISPR gRNA sequence
aagcagctgtggcatgctct

SEQ ID NO: 425562 - DNA, 20 bp, Artificial
  CRISPR gRNA sequence
gcagctgtggcatgctcttg

SEQ ID NO: 425563 - DNA, 20 bp, Artificial
  CRISPR gRNA sequence
tcttggagtcttccctacac

SEQ ID NO: 425564 - DNA, 20 bp, Artificial
  CRISPR gRNA sequence
tcttccctacacaagcaccc

SEQ ID NO: 425565 - DNA, 20 bp, Artificial
  CRISPR gRNA sequence
aagcacccaagtctccaacc

SEQ ID NO: 425566 - DNA, 20 bp, Artificial
  CRISPR gRNA sequence
cccaagtctccaaccaagct

SEQ ID NO: 425567 - DNA, 20 bp, Artificial
  CRISPR gRNA sequence
tttcctccctgctgctctgc

SEQ ID NO: 425568 - DNA, 20 bp, Artificial
  CRISPR gRNA sequence
ttcctccctgctgctctgct

SEQ ID NO: 425569 - DNA, 20 bp, Artificial
  CRISPR gRNA sequence
cctgctgctctgctgggttt

SEQ ID NO: 425570 - DNA, 20 bp, Artificial
  CRISPR gRNA sequence
ctgctgctctgctgggtttc

SEQ ID NO: 425571 - DNA, 20 bp, Artificial
  CRISPR gRNA sequence
ctgggtttcaggccttacct

SEQ ID NO: 425572 - DNA, 20 bp, Artificial
  CRISPR gRNA sequence
tgggtttcaggccttacctg

SEQ ID NO: 425573 - DNA, 20 bp, Artificial
  CRISPR gRNA sequence
tttcaggccttacctgaggc

SEQ ID NO: 425574 - DNA, 20 bp, Artificial
  CRISPR gRNA sequence
ttcaggccttacctgaggcg

SEQ ID NO: 425575 - DNA, 20 bp, Artificial
  CRISPR gRNA sequence
tcaggccttacctgaggcga

SEQ ID NO: 425576 - DNA, 20 bp, Artificial
  CRISPR gRNA sequence
caggccttacctgaggcgag

SEQ ID NO: 425577 - DNA, 20 bp, Artificial
  CRISPR gRNA sequence
ggccttacctgaggcgaggg

SEQ ID NO: 425578 - DNA, 20 bp, Artificial
  CRISPR gRNA sequence
gaggcgaggggagcctgcct

SEQ ID NO: 425579 - DNA, 20 bp, Artificial
  CRISPR gRNA sequence
ggggagcctgcctcagcccc

SEQ ID NO: 425580 - DNA, 20 bp, Artificial
  CRISPR gRNA sequence
gggagcctgcctcagcccct

SEQ ID NO: 425581 - DNA, 20 bp, Artificial
  CRISPR gRNA sequence
cctgcctcagcccctgggcc

SEQ ID NO: 425582 - DNA, 20 bp, Artificial
  CRISPR gRNA sequence
ctcagcccctgggcccagat

SEQ ID NO: 425583 - DNA, 20 bp, Artificial
  CRISPR gRNA sequence
tcagcccctgggcccagatc

SEQ ID NO: 425584 - DNA, 20 bp, Artificial
  CRISPR gRNA sequence
agcccctgggcccagatcag

SEQ ID NO: 425585 - DNA, 20 bp, Artificial
  CRISPR gRNA sequence
gcccctgggcccagatcagg

SEQ ID NO: 425586 - DNA, 20 bp, Artificial
  CRISPR gRNA sequence
ccctgggcccagatcaggag

SEQ ID NO: 425587 - DNA, 20 bp, Artificial
  CRISPR gRNA sequence
cccagatcaggaggagacac

SEQ ID NO: 425588 - DNA, 20 bp, Artificial
  CRISPR gRNA sequence
caccagcgcatgcttctgcc

SEQ ID NO: 425589 - DNA, 20 bp, Artificial
  CRISPR gRNA sequence
ccagcgcatgcttctgccca

SEQ ID NO: 425590 - DNA, 20 bp, Artificial
  CRISPR gRNA sequence
cagcgcatgcttctgcccag

SEQ ID NO: 425591 - DNA, 20 bp, Artificial
  CRISPR gRNA sequence
agcgcatgcttctgcccaga

SEQ ID NO: 425592 - DNA, 20 bp, Artificial
  CRISPR gRNA sequence
gcttctgcccagagggccta

SEQ ID NO: 425593 - DNA, 20 bp, Artificial
  CRISPR gRNA sequence
cttctgcccagagggcctac

SEQ ID NO: 425594 - DNA, 20 bp, Artificial
  CRISPR gRNA sequence
ctgcccagagggcctacagg

SEQ ID NO: 425595 - DNA, 20 bp, Artificial
  CRISPR gRNA sequence
cccagagggcctacaggaag

SEQ ID NO: 425596 - DNA, 20 bp, Artificial
  CRISPR gRNA sequence
gggcctacaggaagcagatg

SEQ ID NO: 425597 - DNA, 20 bp, Artificial
  CRISPR gRNA sequence
gtggcctcttctgccactga

SEQ ID NO: 425598 - DNA, 20 bp, Artificial
  CRISPR gRNA sequence
gcctcttctgccactgaaag

SEQ ID NO: 425599 - DNA, 20 bp, Artificial
  CRISPR gRNA sequence
ccactgaaagtagccgactg

SEQ ID NO: 425600 - DNA, 20 bp, Artificial
  CRISPR gRNA sequence
tgaaagtagccgactgcaga

SEQ ID NO: 425601 - DNA, 20 bp, Artificial
  CRISPR gRNA sequence
gaaagtagccgactgcagat

SEQ ID NO: 425602 - DNA, 20 bp, Artificial
  CRISPR gRNA sequence
gtagccgactgcagatagga

SEQ ID NO: 425603 - DNA, 20 bp, Artificial
  CRISPR gRNA sequence
gcagataggacggtaaaact

SEQ ID NO: 425604 - DNA, 20 bp, Artificial
  CRISPR gRNA sequence
gacggtaaaactgagcctct

SEQ ID NO: 425605 - DNA, 20 bp, Artificial
  CRISPR gRNA sequence
taaaactgagcctctgagaa

SEQ ID NO: 425606 - DNA, 20 bp, Artificial
  CRISPR gRNA sequence
actgagcctctgagaaaaga

SEQ ID NO: 425607 - DNA, 20 bp, Artificial
  CRISPR gRNA sequence
cctctgagaaaagacggtct

SEQ ID NO: 425608 - DNA, 20 bp, Artificial
  CRISPR gRNA sequence
aagacggtctcggaaaaacc

SEQ ID NO: 425609 - DNA, 20 bp, Artificial
  CRISPR gRNA sequence
ggtctcggaaaaaccaagtt

SEQ ID NO: 425610 - DNA, 20 bp, Artificial
  CRISPR gRNA sequence
aaccatattaaaaacacata

SEQ ID NO: 425611 - DNA, 20 bp, Artificial
  CRISPR gRNA sequence
ggctaagcttggttggagac

SEQ ID NO: 425612 - DNA, 20 bp, Artificial
  CRISPR gRNA sequence
gagaaagaaattgcaacttt

SEQ ID NO: 425613 - DNA, 20 bp, Artificial
  CRISPR gRNA sequence
tttaagaaaggacaatctct

SEQ ID NO: 425614 - DNA, 20 bp, Artificial
  CRISPR gRNA sequence
gacaatctctgagaatgagg

SEQ ID NO: 425615 - DNA, 20 bp, Artificial
  CRISPR gRNA sequence
tgaaggactttgcagacttc

SEQ ID NO: 425616 - DNA, 20 bp, Artificial
  CRISPR gRNA sequence
gaaaacattataagttctct

SEQ ID NO: 425617 - DNA, 20 bp, Artificial
  CRISPR gRNA sequence
atttcttctatattaaaaat

SEQ ID NO: 425618 - DNA, 20 bp, Artificial
  CRISPR gRNA sequence
tgttgccttctgaactatct

SEQ ID NO: 425619 - DNA, 20 bp, Artificial
  CRISPR gRNA sequence
tctgaggatggagatgtgcc

SEQ ID NO: 425620 - DNA, 20 bp, Artificial
  CRISPR gRNA sequence
ggggagaggttaagtgctga

SEQ ID NO: 425621 - DNA, 20 bp, Artificial
  CRISPR gRNA sequence
gtggttatgcctgggagaag

SEQ ID NO: 425622 - DNA, 20 bp, Artificial
  CRISPR gRNA sequence
ctgctaagcttcctttgcta

SEQ ID NO: 425623 - DNA, 20 bp, Artificial
  CRISPR gRNA sequence
aacagcaaggttttatttca

SEQ ID NO: 425624 - DNA, 20 bp, Artificial
  CRISPR gRNA sequence
gacaagggcttatattctaa

SEQ ID NO: 425625 - DNA, 20 bp, Artificial
  CRISPR gRNA sequence
ctggccatgaagctacatag

SEQ ID NO: 425626 - DNA, 20 bp, Artificial
  CRISPR gRNA sequence
ctaattatacaatacaggca

SEQ ID NO: 425627 - DNA, 20 bp, Artificial
  CRISPR gRNA sequence
ggtcttctaggaggcgggga

SEQ ID NO: 425628 - DNA, 20 bp, Artificial
  CRISPR gRNA sequence
agctctggaagcatagggca

SEQ ID NO: 425629 - DNA, 20 bp, Artificial
  CRISPR gRNA sequence
ggagatgggctgggctgggc

SEQ ID NO: 425630 - DNA, 20 bp, Artificial
  CRISPR gRNA sequence
tggagtagagatgtgtggag

SEQ ID NO: 425631 - DNA, 20 bp, Artificial
  CRISPR gRNA sequence
gagaagactggaaagacaac

SEQ ID NO: 425632 - DNA, 20 bp, Artificial
  CRISPR gRNA sequence
tgaatgggggactgggagcc

SEQ ID NO: 425633 - DNA, 20 bp, Artificial
  CRISPR gRNA sequence
cagcctctatggaggagcaa

SEQ ID NO: 425634 - DNA, 20 bp, Artificial
  CRISPR gRNA sequence
gttggggcctcaaaggccct

SEQ ID NO: 425635 - DNA, 20 bp, Artificial
  CRISPR gRNA sequence
tgtgcttcgtcctcttccct

SEQ ID NO: 425636 - DNA, 20 bp, Artificial
  CRISPR gRNA sequence
ggccatttgtaatgctgact

SEQ ID NO: 425637 - DNA, 20 bp, Artificial
  CRISPR gRNA sequence
ggcacatctccccatccttc

SEQ ID NO: 425638 - DNA, 20 bp, Artificial
  CRISPR gRNA sequence
atctccccatccttcaagga

SEQ ID NO: 425639 - DNA, 20 bp, Artificial
  CRISPR gRNA sequence
gctgaccgtgaacgatacag

SEQ ID NO: 425640 - DNA, 20 bp, Artificial
  CRISPR gRNA sequence
cctgatgggacgtacactgg

SEQ ID NO: 425641 - DNA, 20 bp, Artificial
  CRISPR gRNA sequence
attcctgctggagcaagttg

SEQ ID NO: 425642 - DNA, 20 bp, Artificial
  CRISPR gRNA sequence
cacagcagggcttctcaatt

SEQ ID NO: 425643 - DNA, 20 bp, Artificial
  CRISPR gRNA sequence
ttctcaattcgggatcacat

SEQ ID NO: 425644 - DNA, 20 bp, Artificial
  CRISPR gRNA sequence
ctcacccagaccaattcaat

SEQ ID NO: 425645 - DNA, 20 bp, Artificial
  CRISPR gRNA sequence
ccctaatagcagagctaaac

SEQ ID NO: 425646 - DNA, 20 bp, Artificial
  CRISPR gRNA sequence
tttagtataattgtgcaaat

SEQ ID NO: 425647 - DNA, 20 bp, Artificial
  CRISPR gRNA sequence
aattaacccctaagtgtata

SEQ ID NO: 425648 - DNA, 20 bp, Artificial
  CRISPR gRNA sequence
ccaattcccagaggttagaa

SEQ ID NO: 425649 - DNA, 20 bp, Artificial
  CRISPR gRNA sequence
agactctgacaccagacagt

SEQ ID NO: 425650 - DNA, 20 bp, Artificial
  CRISPR gRNA sequence
gctctgctgttgccctcaga

SEQ ID NO: 425651 - DNA, 20 bp, Artificial
  CRISPR gRNA sequence
agttttctcatctgtgaaag

SEQ ID NO: 425652 - DNA, 20 bp, Artificial
  CRISPR gRNA sequence
ttctcatctgtgaaaggagg

SEQ ID NO: 425653 - DNA, 20 bp, Artificial
  CRISPR gRNA sequence
gaccttatgcgatgctaatg

SEQ ID NO: 425654 - DNA, 20 bp, Artificial
  CRISPR gRNA sequence
tgcaggcagaagctggagct

SEQ ID NO: 425655 - DNA, 20 bp, Artificial
  CRISPR gRNA sequence
agctggagcttggagttgct

SEQ ID NO: 425656 - DNA, 20 bp, Artificial
  CRISPR gRNA sequence
ttttttttttttttttgaga

SEQ ID NO: 425657 - DNA, 20 bp, Artificial
  CRISPR gRNA sequence
ttcgctcttgttgcccaggc

SEQ ID NO: 425658 - DNA, 20 bp, Artificial
  CRISPR gRNA sequence
ctcactgcaacttccgcctc

SEQ ID NO: 425659 - DNA, 20 bp, Artificial
  CRISPR gRNA sequence
ttctctcctgcctcagcctc

SEQ ID NO: 425660 - DNA, 20 bp, Artificial
  CRISPR gRNA sequence
gcctcagcctcctgagtatc

SEQ ID NO: 425661 - DNA, 20 bp, Artificial
  CRISPR gRNA sequence
ttttgtatttttagtagaga

SEQ ID NO: 425662 - DNA, 20 bp, Artificial
  CRISPR gRNA sequence
aggccaaacaaagactggtt

SEQ ID NO: 425663 - DNA, 20 bp, Artificial
  CRISPR gRNA sequence
ctggttaagagttgaggctc

SEQ ID NO: 425664 - DNA, 20 bp, Artificial
  CRISPR gRNA sequence
ggctctggaattgcactgtc

SEQ ID NO: 425665 - DNA, 20 bp, Artificial
  CRISPR gRNA sequence
tgcagttgaccccacgaagt

SEQ ID NO: 425666 - DNA, 20 bp, Artificial
  CRISPR gRNA sequence
ggcaggaccgggaacaggga

SEQ ID NO: 425667 - DNA, 20 bp, Artificial
  CRISPR gRNA sequence
catcaggcagaaggcccctg

SEQ ID NO: 425668 - DNA, 20 bp, Artificial
  CRISPR gRNA sequence
caagtggtcagttgcttatg

SEQ ID NO: 425669 - DNA, 20 bp, Artificial
  CRISPR gRNA sequence
agttttaagtaacccttata

SEQ ID NO: 425670 - DNA, 20 bp, Artificial
  CRISPR gRNA sequence
tttgttctatgaccataact

SEQ ID NO: 425671 - DNA, 20 bp, Artificial
  CRISPR gRNA sequence
atatatcctttcctggtttt

SEQ ID NO: 425672 - DNA, 20 bp, Artificial
  CRISPR gRNA sequence
gccgtcctggccaactgtga

SEQ ID NO: 425673 - DNA, 20 bp, Artificial
  CRISPR gRNA sequence
ggcaggaggaacatgttctg

SEQ ID NO: 425674 - DNA, 20 bp, Artificial
  CRISPR gRNA sequence
aggaacatgttctggggaat

SEQ ID NO: 425675 - DNA, 20 bp, Artificial
  CRISPR gRNA sequence
gcaggcaccacccttgtctt

SEQ ID NO: 425676 - DNA, 20 bp, Artificial
  CRISPR gRNA sequence
caccacccttgtcttatgga

SEQ ID NO: 425677 - DNA, 20 bp, Artificial
  CRISPR gRNA sequence
caacccagacccttaggtag

SEQ ID NO: 425678 - DNA, 20 bp, Artificial
  CRISPR gRNA sequence
tgcatcctttgaagactccc

SEQ ID NO: 425679 - DNA, 20 bp, Artificial
  CRISPR gRNA sequence
acctacagcgcagcatgcat

SEQ ID NO: 425680 - DNA, 20 bp, Artificial
  CRISPR gRNA sequence
ttctttttctcacattcttc

SEQ ID NO: 425681 - DNA, 20 bp, Artificial
  CRISPR gRNA sequence
cagatgctgagaaaacagca

SEQ ID NO: 425682 - DNA, 20 bp, Artificial
  CRISPR gRNA sequence
ctgagaaaacagcaaaggat

SEQ ID NO: 425683 - DNA, 20 bp, Artificial
  CRISPR gRNA sequence
gtccagagcctcatgccctc

SEQ ID NO: 425684 - DNA, 20 bp, Artificial
  CRISPR gRNA sequence
atgttaactttattttaatt

SEQ ID NO: 425685 - DNA, 20 bp, Artificial
  CRISPR gRNA sequence
taaaagaaaatattcacttt

SEQ ID NO: 425686 - DNA, 20 bp, Artificial
  CRISPR gRNA sequence
gattttgtcaaatagaagaa

SEQ ID NO: 425687 - DNA, 20 bp, Artificial
  CRISPR gRNA sequence
ttgatttcatgatgggccag

SEQ ID NO: 425688 - DNA, 20 bp, Artificial
  CRISPR gRNA sequence
ggcacccccacgtctggcac

SEQ ID NO: 425689 - DNA, 20 bp, Artificial
  CRISPR gRNA sequence
gagacccagatgtgatcttc

SEQ ID NO: 425690 - DNA, 20 bp, Artificial
  CRISPR gRNA sequence
atcccttaagccactgctct

SEQ ID NO: 425691 - DNA, 20 bp, Artificial
  CRISPR gRNA sequence
taggttacccagcatgtctg

SEQ ID NO: 425692 - DNA, 20 bp, Artificial
  CRISPR gRNA sequence
aaataaacactccaaaaatg

SEQ ID NO: 425693 - DNA, 20 bp, Artificial
  CRISPR gRNA sequence
cactcgggagactgtggcgg

SEQ ID NO: 425694 - DNA, 20 bp, Artificial
  CRISPR gRNA sequence
cgggaggatcacttgactct

SEQ ID NO: 425695 - DNA, 20 bp, Artificial
  CRISPR gRNA sequence
ttaagagcttatgtggctga

SEQ ID NO: 425696 - DNA, 20 bp, Artificial
  CRISPR gRNA sequence
cttatgtggctgaaagagta

SEQ ID NO: 425697 - DNA, 20 bp, Artificial
  CRISPR gRNA sequence
ggctgaaagagtaatgaatg

SEQ ID NO: 425698 - DNA, 20 bp, Artificial
  CRISPR gRNA sequence
tctagtttctagttttggca

SEQ ID NO: 425699 - DNA, 20 bp, Artificial
  CRISPR gRNA sequence
catttccttatatataaaat

SEQ ID NO: 425700 - DNA, 20 bp, Artificial
  CRISPR gRNA sequence
tctattttctgccgctgtaa

SEQ ID NO: 425701 - DNA, 20 bp, Artificial
  CRISPR gRNA sequence
acggcagaaggcatcatgtg

SEQ ID NO: 425702 - DNA, 20 bp, Artificial
  CRISPR gRNA sequence
attcggcttactctatatca

SEQ ID NO: 425703 - DNA, 20 bp, Artificial
  CRISPR gRNA sequence
taaaatctttataaataaca

SEQ ID NO: 425704 - DNA, 20 bp, Artificial
  CRISPR gRNA sequence
agctactggtattgattggg

SEQ ID NO: 425705 - DNA, 20 bp, Artificial
  CRISPR gRNA sequence
gtattgattgggaggagtga

SEQ ID NO: 425706 - DNA, 20 bp, Artificial
  CRISPR gRNA sequence
ggtgaggacaagagaaatga

SEQ ID NO: 425707 - DNA, 20 bp, Artificial
  CRISPR gRNA sequence
ttagcagtgtcctgatggtc

SEQ ID NO: 425708 - DNA, 20 bp, Artificial
  CRISPR gRNA sequence
gtcctgatggtctggaataa

SEQ ID NO: 425709 - DNA, 20 bp, Artificial
  CRISPR gRNA sequence
gctgaacaacttttcctgtt

SEQ ID NO: 425710 - DNA, 20 bp, Artificial
  CRISPR gRNA sequence
ggactaactttggtcatctg

SEQ ID NO: 425711 - DNA, 20 bp, Artificial
  CRISPR gRNA sequence
gaaaaaggtgaagagaccta

SEQ ID NO: 425712 - DNA, 20 bp, Artificial
  CRISPR gRNA sequence
tccactgcttcctgtgtagt

SEQ ID NO: 425713 - DNA, 20 bp, Artificial
  CRISPR gRNA sequence
ctctgcatctttcctgtgct

SEQ ID NO: 425714 - DNA, 20 bp, Artificial
  CRISPR gRNA sequence
cattttatagttgcattatt

SEQ ID NO: 425715 - DNA, 20 bp, Artificial
  CRISPR gRNA sequence
gggaacatgtagtactcaaa

SEQ ID NO: 425716 - DNA, 20 bp, Artificial
  CRISPR gRNA sequence
gtttgaagacagtttaataa

SEQ ID NO: 425717 - DNA, 20 bp, Artificial
  CRISPR gRNA sequence
taggatttccagaagtctag

SEQ ID NO: 425718 - DNA, 20 bp, Artificial
  CRISPR gRNA sequence
gatgtaaggacaccacaagg

SEQ ID NO: 425719 - DNA, 20 bp, Artificial
  CRISPR gRNA sequence
taaccattcctagttcttca

SEQ ID NO: 425720 - DNA, 20 bp, Artificial
  CRISPR gRNA sequence
attattggagcctggaagga

SEQ ID NO: 425721 - DNA, 20 bp, Artificial
  CRISPR gRNA sequence
ggaaggagagagttatgtgg

SEQ ID NO: 425722 - DNA, 20 bp, Artificial
  CRISPR gRNA sequence
aagtgctgtagtctttgctg

SEQ ID NO: 425723 - DNA, 20 bp, Artificial
  CRISPR gRNA sequence
gcattggctgacctcaaact

SEQ ID NO: 425724 - DNA, 20 bp, Artificial
  CRISPR gRNA sequence
ctgacctcaaacttaggatg

SEQ ID NO: 425725 - DNA, 20 bp, Artificial
  CRISPR gRNA sequence
agtacagtcttcatagggca

SEQ ID NO: 425726 - DNA, 20 bp, Artificial
  CRISPR gRNA sequence
agtcttcatagggcacagaa

SEQ ID NO: 425727 - DNA, 20 bp, Artificial
  CRISPR gRNA sequence
atagacatgaacactggaca

SEQ ID NO: 425728 - DNA, 20 bp, Artificial
  CRISPR gRNA sequence
caaaggatcttgactttcca

SEQ ID NO: 425729 - DNA, 20 bp, Artificial
  CRISPR gRNA sequence
ttaaccattttaatattccc

SEQ ID NO: 425730 - DNA, 20 bp, Artificial
  CRISPR gRNA sequence
ctatctgttctgtactattt

SEQ ID NO: 425731 - DNA, 20 bp, Artificial
  CRISPR gRNA sequence
tcctcatcctcattgctact

SEQ ID NO: 425732 - DNA, 20 bp, Artificial
  CRISPR gRNA sequence
ttcttttccagcttagtaaa

SEQ ID NO: 425733 - DNA, 20 bp, Artificial
  CRISPR gRNA sequence
ttattgttgctattatctta

SEQ ID NO: 425734 - DNA, 20 bp, Artificial
  CRISPR gRNA sequence
attatcttaagggatgttct

SEQ ID NO: 425735 - DNA, 20 bp, Artificial
  CRISPR gRNA sequence
aaagtcaatataatcagcta

SEQ ID NO: 425736 - DNA, 20 bp, Artificial
  CRISPR gRNA sequence
ttttggaaattattcagtac

SEQ ID NO: 425737 - DNA, 20 bp, Artificial
  CRISPR gRNA sequence
gaggcagatagtatatcttt

SEQ ID NO: 425738 - DNA, 20 bp, Artificial
  CRISPR gRNA sequence
gtgctatagattatatacaa

SEQ ID NO: 425739 - DNA, 20 bp, Artificial
  CRISPR gRNA sequence
tttatttcaataggtttttg

SEQ ID NO: 425740 - DNA, 20 bp, Artificial
  CRISPR gRNA sequence
gccctctcccactcttttcc

SEQ ID NO: 425741 - DNA, 20 bp, Artificial
  CRISPR gRNA sequence
tcatagcttagctcccactt

SEQ ID NO: 425742 - DNA, 20 bp, Artificial
  CRISPR gRNA sequence
caatgtttggtttttcattc

SEQ ID NO: 425743 - DNA, 20 bp, Artificial
  CRISPR gRNA sequence
tattttgttcctttttatgg

SEQ ID NO: 425744 - DNA, 20 bp, Artificial
  CRISPR gRNA sequence
gtataatgacttcttttcct

SEQ ID NO: 425745 - DNA, 20 bp, Artificial
  CRISPR gRNA sequence
tctggatagatacccagtag

SEQ ID NO: 425746 - DNA, 20 bp, Artificial
  CRISPR gRNA sequence
gatacccagtagtgggatta

SEQ ID NO: 425747 - DNA, 20 bp, Artificial
  CRISPR gRNA sequence
gttctacttttagttcctta

SEQ ID NO: 425748 - DNA, 20 bp, Artificial
  CRISPR gRNA sequence
ttcaccacatccatgccaac

SEQ ID NO: 425749 - DNA, 20 bp, Artificial
  CRISPR gRNA sequence
ttgattaaggccattcttac

SEQ ID NO: 425750 - DNA, 20 bp, Artificial
  CRISPR gRNA sequence
ccatttgtatatccttttct

SEQ ID NO: 425751 - DNA, 20 bp, Artificial
  CRISPR gRNA sequence
gtccttagcccactttttga

SEQ ID NO: 425752 - DNA, 20 bp, Artificial
  CRISPR gRNA sequence
ttttttttcagctgatttgt

SEQ ID NO: 425753 - DNA, 20 bp, Artificial
  CRISPR gRNA sequence
gtttgagttccttgtagatt

SEQ ID NO: 425754 - DNA, 20 bp, Artificial
  CRISPR gRNA sequence
ttctggatattagtcctttg

SEQ ID NO: 425755 - DNA, 20 bp, Artificial
  CRISPR gRNA sequence
ctctattgacagcagtatat

SEQ ID NO: 425756 - DNA, 20 bp, Artificial
  CRISPR gRNA sequence
tcatctcctggggcccttgt

SEQ ID NO: 425757 - DNA, 20 bp, Artificial
  CRISPR gRNA sequence
ctaccacaatccatcacctt

SEQ ID NO: 425758 - DNA, 20 bp, Artificial
  CRISPR gRNA sequence
aggcagaggcagggcccagc

SEQ ID NO: 425759 - DNA, 20 bp, Artificial
  CRISPR gRNA sequence
atagaaaatttacctaggct

SEQ ID NO: 425760 - DNA, 20 bp, Artificial
  CRISPR gRNA sequence
tatgtacctggtcttcagct

SEQ ID NO: 425761 - DNA, 20 bp, Artificial
  CRISPR gRNA sequence
tggtcttcagctgtggatag

SEQ ID NO: 425762 - DNA, 20 bp, Artificial
  CRISPR gRNA sequence
ggagctttaactctcacact

SEQ ID NO: 425763 - DNA, 20 bp, Artificial
  CRISPR gRNA sequence
caatttagcaaaagtcaatt

SEQ ID NO: 425764 - DNA, 20 bp, Artificial
  CRISPR gRNA sequence
ctatactgttgacccaattc

SEQ ID NO: 425765 - DNA, 20 bp, Artificial
  CRISPR gRNA sequence
accctatacacctcaaatgt

SEQ ID NO: 425766 - DNA, 20 bp, Artificial
  CRISPR gRNA sequence
tctcatttcaccaccagtca

SEQ ID NO: 425767 - DNA, 20 bp, Artificial
  CRISPR gRNA sequence
tttgtgttgccatctagcag

SEQ ID NO: 425768 - DNA, 20 bp, Artificial
  CRISPR gRNA sequence
cctgacatgcaaattttggt

SEQ ID NO: 425769 - DNA, 20 bp, Artificial
  CRISPR gRNA sequence
ctaagggaagaaagctcagc

SEQ ID NO: 425770 - DNA, 20 bp, Artificial
  CRISPR gRNA sequence
gctggagacttggctgaagc

SEQ ID NO: 425771 - DNA, 20 bp, Artificial
  CRISPR gRNA sequence
tggctgaagcaagaattgta

SEQ ID NO: 425772 - DNA, 20 bp, Artificial
  CRISPR gRNA sequence
actcccagcatctggaaaat

SEQ ID NO: 425773 - DNA, 20 bp, Artificial
  CRISPR gRNA sequence
gcaggaactgtacattagtt

SEQ ID NO: 425774 - DNA, 20 bp, Artificial
  CRISPR gRNA sequence
agaaccaataggagatatag

SEQ ID NO: 425775 - DNA, 20 bp, Artificial
  CRISPR gRNA sequence
ccaataggagatatagatgg

SEQ ID NO: 425776 - DNA, 20 bp, Artificial
  CRISPR gRNA sequence
taggagatatagatggatgg

SEQ ID NO: 425777 - DNA, 20 bp, Artificial
  CRISPR gRNA sequence
agatatagatggatggatgg

SEQ ID NO: 425778 - DNA, 20 bp, Artificial
  CRISPR gRNA sequence
atagatggatggatggatgg

SEQ ID NO: 425779 - DNA, 20 bp, Artificial
  CRISPR gRNA sequence
atggatggatggatggatgg

SEQ ID NO: 425780 - DNA, 20 bp, Artificial
  CRISPR gRNA sequence
atggatggatggatggatgg

SEQ ID NO: 425781 - DNA, 20 bp, Artificial
  CRISPR gRNA sequence
atggatggatggatggatgg

SEQ ID NO: 425782 - DNA, 20 bp, Artificial
  CRISPR gRNA sequence
atggatggatggatggatgg

SEQ ID NO: 425783 - DNA, 20 bp, Artificial
  CRISPR gRNA sequence
atggatggatggatggatgg

SEQ ID NO: 425784 - DNA, 20 bp, Artificial
  CRISPR gRNA sequence
atggatggatggatggatgg

SEQ ID NO: 425785 - DNA, 20 bp, Artificial
  CRISPR gRNA sequence
atggatggatggatggatgg

SEQ ID NO: 425786 - DNA, 20 bp, Artificial
  CRISPR gRNA sequence
atggatggatggatggttgg

SEQ ID NO: 425787 - DNA, 20 bp, Artificial
  CRISPR gRNA sequence
atggatggatggttggatgg

SEQ ID NO: 425788 - DNA, 20 bp, Artificial
  CRISPR gRNA sequence
atggatggttggatggatgg

SEQ ID NO: 425789 - DNA, 20 bp, Artificial
  CRISPR gRNA sequence
atggttggatggatggatgg

SEQ ID NO: 425790 - DNA, 20 bp, Artificial
  CRISPR gRNA sequence
ttggatggatggatgggtgg

SEQ ID NO: 425791 - DNA, 20 bp, Artificial
  CRISPR gRNA sequence
atggatggatgggtgggtgg

SEQ ID NO: 425792 - DNA, 20 bp, Artificial
  CRISPR gRNA sequence
atggatgggtgggtggatgg

SEQ ID NO: 425793 - DNA, 20 bp, Artificial
  CRISPR gRNA sequence
atgggtgggtggatggatgg

SEQ ID NO: 425794 - DNA, 20 bp, Artificial
  CRISPR gRNA sequence
agatagatagatagatgagg

SEQ ID NO: 425795 - DNA, 20 bp, Artificial
  CRISPR gRNA sequence
gatgaggagggatttgttag

SEQ ID NO: 425796 - DNA, 20 bp, Artificial
  CRISPR gRNA sequence
tgtctgcaagctggagacct

SEQ ID NO: 425797 - DNA, 20 bp, Artificial
  CRISPR gRNA sequence
aggctaagggcctgaaaacc

SEQ ID NO: 425798 - DNA, 20 bp, Artificial
  CRISPR gRNA sequence
aggagcactggtttaagtcc

SEQ ID NO: 425799 - DNA, 20 bp, Artificial
  CRISPR gRNA sequence
ggtgtcctgatgtccaagga

SEQ ID NO: 425800 - DNA, 20 bp, Artificial
  CRISPR gRNA sequence
atgtccaaggacaggatgag

SEQ ID NO: 425801 - DNA, 20 bp, Artificial
  CRISPR gRNA sequence
tgggaaaggcaggcctccag

SEQ ID NO: 425802 - DNA, 20 bp, Artificial
  CRISPR gRNA sequence
aaaggcaggcctccaggtga

SEQ ID NO: 425803 - DNA, 20 bp, Artificial
  CRISPR gRNA sequence
ggatggtgcttggctacatt

SEQ ID NO: 425804 - DNA, 20 bp, Artificial
  CRISPR gRNA sequence
ttatttaggagcatgttctt

SEQ ID NO: 425805 - DNA, 20 bp, Artificial
  CRISPR gRNA sequence
ggaatcagacagtcctaggt

SEQ ID NO: 425806 - DNA, 20 bp, Artificial
  CRISPR gRNA sequence
ttgggtcccaactcaaccac

SEQ ID NO: 425807 - DNA, 20 bp, Artificial
  CRISPR gRNA sequence
ctagcatgtaagctggaaag

SEQ ID NO: 425808 - DNA, 20 bp, Artificial
  CRISPR gRNA sequence
aggtgagtgggaccatcaca

SEQ ID NO: 425809 - DNA, 20 bp, Artificial
  CRISPR gRNA sequence
accatcacaagggatgtttt

SEQ ID NO: 425810 - DNA, 20 bp, Artificial
  CRISPR gRNA sequence
atgtttttgggatcatcaca

SEQ ID NO: 425811 - DNA, 20 bp, Artificial
  CRISPR gRNA sequence
atcatcacaagggatgtttt

SEQ ID NO: 425812 - DNA, 20 bp, Artificial
  CRISPR gRNA sequence
gatcatcacagtttcttatg

SEQ ID NO: 425813 - DNA, 20 bp, Artificial
  CRISPR gRNA sequence
atgaggaatgtagtgaaatt

SEQ ID NO: 425814 - DNA, 20 bp, Artificial
  CRISPR gRNA sequence
tatatacagtggagccattg

SEQ ID NO: 425815 - DNA, 20 bp, Artificial
  CRISPR gRNA sequence
tcactctgctggcgaccatg

SEQ ID NO: 425816 - DNA, 20 bp, Artificial
  CRISPR gRNA sequence
gagttggactagaagtaaga

SEQ ID NO: 425817 - DNA, 20 bp, Artificial
  CRISPR gRNA sequence
agagggagtccagagacagt

SEQ ID NO: 425818 - DNA, 20 bp, Artificial
  CRISPR gRNA sequence
gcccaggtgtgagagaagac

SEQ ID NO: 425819 - DNA, 20 bp, Artificial
  CRISPR gRNA sequence
ggatatagagatggaaaaga

SEQ ID NO: 425820 - DNA, 20 bp, Artificial
  CRISPR gRNA sequence
gagtagatttcagaactgcc

SEQ ID NO: 425821 - DNA, 20 bp, Artificial
  CRISPR gRNA sequence
agaactgcctaggattaaaa

SEQ ID NO: 425822 - DNA, 20 bp, Artificial
  CRISPR gRNA sequence
gatgaagttttacagataaa

SEQ ID NO: 425823 - DNA, 20 bp, Artificial
  CRISPR gRNA sequence
tggtgccataaaccagggca

SEQ ID NO: 425824 - DNA, 20 bp, Artificial
  CRISPR gRNA sequence
agggcagtgaatataggggc

SEQ ID NO: 425825 - DNA, 20 bp, Artificial
  CRISPR gRNA sequence
caggagtggtttgttggggc

SEQ ID NO: 425826 - DNA, 20 bp, Artificial
  CRISPR gRNA sequence
atggtgtcgtttgagacaat

SEQ ID NO: 425827 - DNA, 20 bp, Artificial
  CRISPR gRNA sequence
aatttgagtctgagcttgcc

SEQ ID NO: 425828 - DNA, 20 bp, Artificial
  CRISPR gRNA sequence
gcctggctgaagacgaaggt

SEQ ID NO: 425829 - DNA, 20 bp, Artificial
  CRISPR gRNA sequence
ggaggagaagaaaatcagga

SEQ ID NO: 425830 - DNA, 20 bp, Artificial
  CRISPR gRNA sequence
atcaggagagagtgatgcca

SEQ ID NO: 425831 - DNA, 20 bp, Artificial
  CRISPR gRNA sequence
ttcagaaagtaagaggtcga

SEQ ID NO: 425832 - DNA, 20 bp, Artificial
  CRISPR gRNA sequence
gtaaacagtacaagaaaata

SEQ ID NO: 425833 - DNA, 20 bp, Artificial
  CRISPR gRNA sequence
ggttgagaaattaagggcta

SEQ ID NO: 425834 - DNA, 20 bp, Artificial
  CRISPR gRNA sequence
gaagagagagatgtcatatt

SEQ ID NO: 425835 - DNA, 20 bp, Artificial
  CRISPR gRNA sequence
gtcatattggggattaactg

SEQ ID NO: 425836 - DNA, 20 bp, Artificial
  CRISPR gRNA sequence
tgtttttagaagaaagccct

SEQ ID NO: 425837 - DNA, 20 bp, Artificial
  CRISPR gRNA sequence
gagaaaatcagctggacagg

SEQ ID NO: 425838 - DNA, 20 bp, Artificial
  CRISPR gRNA sequence
tgcatgactacttcaatgtc

SEQ ID NO: 425839 - DNA, 20 bp, Artificial
  CRISPR gRNA sequence
atgtcctgagttacagaagc

SEQ ID NO: 425840 - DNA, 20 bp, Artificial
  CRISPR gRNA sequence
ttttgtctttgctattatag

SEQ ID NO: 425841 - DNA, 20 bp, Artificial
  CRISPR gRNA sequence
gtatgtgtgtgtgtgttcag

SEQ ID NO: 425842 - DNA, 20 bp, Artificial
  CRISPR gRNA sequence
gtgtgtgtgtgttcagttga

SEQ ID NO: 425843 - DNA, 20 bp, Artificial
  CRISPR gRNA sequence
attttgcattatggcaggcc

SEQ ID NO: 425844 - DNA, 20 bp, Artificial
  CRISPR gRNA sequence
tgcattatggcaggcctagg

SEQ ID NO: 425845 - DNA, 20 bp, Artificial
  CRISPR gRNA sequence
gcaggcctagggtgagtaac

SEQ ID NO: 425846 - DNA, 20 bp, Artificial
  CRISPR gRNA sequence
aaggttttgtggttgatgat

SEQ ID NO: 425847 - DNA, 20 bp, Artificial
  CRISPR gRNA sequence
cagcctctatggggagattt

SEQ ID NO: 425848 - DNA, 20 bp, Artificial
  CRISPR gRNA sequence
ttcaggaagagacgacagtt

SEQ ID NO: 425849 - DNA, 20 bp, Artificial
  CRISPR gRNA sequence
aagtggcctgggagcaccaa

SEQ ID NO: 425850 - DNA, 20 bp, Artificial
  CRISPR gRNA sequence
gaggctagtctgggaggagc

SEQ ID NO: 425851 - DNA, 20 bp, Artificial
  CRISPR gRNA sequence
aaagaaggccctggcaccaa

SEQ ID NO: 425852 - DNA, 20 bp, Artificial
  CRISPR gRNA sequence
tttcccactaaaaagaaaat

SEQ ID NO: 425853 - DNA, 20 bp, Artificial
  CRISPR gRNA sequence
ctaggggaaaaaggggggct

SEQ ID NO: 425854 - DNA, 20 bp, Artificial
  CRISPR gRNA sequence
aaggggggctgggagtgata

SEQ ID NO: 425855 - DNA, 20 bp, Artificial
  CRISPR gRNA sequence
actccctgacgactttgtgc

SEQ ID NO: 425856 - DNA, 20 bp, Artificial
  CRISPR gRNA sequence
tgacgactttgtgctggggt

SEQ ID NO: 425857 - DNA, 20 bp, Artificial
  CRISPR gRNA sequence
tctgtttaattgcattcagg

SEQ ID NO: 425858 - DNA, 20 bp, Artificial
  CRISPR gRNA sequence
ccttccaccatctctctcag

SEQ ID NO: 425859 - DNA, 20 bp, Artificial
  CRISPR gRNA sequence
cagaggaatgagcggggagg

SEQ ID NO: 425860 - DNA, 20 bp, Artificial
  CRISPR gRNA sequence
catgggccaaggaactgaaa

SEQ ID NO: 425861 - DNA, 20 bp, Artificial
  CRISPR gRNA sequence
ctgcttcctaagacttagac

SEQ ID NO: 425862 - DNA, 20 bp, Artificial
  CRISPR gRNA sequence
gacaattcaactatttctcc

SEQ ID NO: 425863 - DNA, 20 bp, Artificial
  CRISPR gRNA sequence
ttttttcacttttctaccaa

SEQ ID NO: 425864 - DNA, 20 bp, Artificial
  CRISPR gRNA sequence
taccaaatgggttacatagg

SEQ ID NO: 425865 - DNA, 20 bp, Artificial
  CRISPR gRNA sequence
ctaaaatgtaatgacgaaaa

SEQ ID NO: 425866 - DNA, 20 bp, Artificial
  CRISPR gRNA sequence
tattcggcagaggttggact

SEQ ID NO: 425867 - DNA, 20 bp, Artificial
  CRISPR gRNA sequence
ggcagaggttggactgagag

SEQ ID NO: 425868 - DNA, 20 bp, Artificial
  CRISPR gRNA sequence
gaaacatttataaacactat

SEQ ID NO: 425869 - DNA, 20 bp, Artificial
  CRISPR gRNA sequence
agggcctatagatgttagaa

SEQ ID NO: 425870 - DNA, 20 bp, Artificial
  CRISPR gRNA sequence
aatgggtcaggttactgaaa

SEQ ID NO: 425871 - DNA, 20 bp, Artificial
  CRISPR gRNA sequence
cagagaagaccatttcatag

SEQ ID NO: 425872 - DNA, 20 bp, Artificial
  CRISPR gRNA sequence
tggccatcaaccacttaaga

SEQ ID NO: 425873 - DNA, 20 bp, Artificial
  CRISPR gRNA sequence
ctagattctggagatttaat

SEQ ID NO: 425874 - DNA, 20 bp, Artificial
  CRISPR gRNA sequence
ggagatttaatatgaataat

SEQ ID NO: 425875 - DNA, 20 bp, Artificial
  CRISPR gRNA sequence
gtgtcaaaaatgataatatt

SEQ ID NO: 425876 - DNA, 20 bp, Artificial
  CRISPR gRNA sequence
atgataatattttggatgta

SEQ ID NO: 425877 - DNA, 20 bp, Artificial
  CRISPR gRNA sequence
tattattcatattaaatctc

SEQ ID NO: 425878 - DNA, 20 bp, Artificial
  CRISPR gRNA sequence
atgtggaaagtggctacgtg

SEQ ID NO: 425879 - DNA, 20 bp, Artificial
  CRISPR gRNA sequence
ggtggatagcgcatgtctcc

SEQ ID NO: 425880 - DNA, 20 bp, Artificial
  CRISPR gRNA sequence
gtcttctctggttctcagag

SEQ ID NO: 425881 - DNA, 20 bp, Artificial
  CRISPR gRNA sequence
tcagaggagaatctagttca

SEQ ID NO: 425882 - DNA, 20 bp, Artificial
  CRISPR gRNA sequence
ttaaaaaaatttttttcaaa

SEQ ID NO: 425883 - DNA, 20 bp, Artificial
  CRISPR gRNA sequence
aactctcagtccaacctctg

SEQ ID NO: 425884 - DNA, 20 bp, Artificial
  CRISPR gRNA sequence
ttttagttcacttccaattt

SEQ ID NO: 425885 - DNA, 20 bp, Artificial
  CRISPR gRNA sequence
aaaaatcctaggagaaatag

SEQ ID NO: 425886 - DNA, 20 bp, Artificial
  CRISPR gRNA sequence
tcctctgagagagatggtgg

SEQ ID NO: 425887 - DNA, 20 bp, Artificial
  CRISPR gRNA sequence
aaagtcttctaagatccagc

SEQ ID NO: 425888 - DNA, 20 bp, Artificial
  CRISPR gRNA sequence
accccagcacaaagtcgtca

SEQ ID NO: 425889 - DNA, 20 bp, Artificial
  CRISPR gRNA sequence
cagcacaaagtcgtcaggga

SEQ ID NO: 425890 - DNA, 20 bp, Artificial
  CRISPR gRNA sequence
agtcgtcagggagtgaataa

SEQ ID NO: 425891 - DNA, 20 bp, Artificial
  CRISPR gRNA sequence
gcccccctttttcccctagg

SEQ ID NO: 425892 - DNA, 20 bp, Artificial
  CRISPR gRNA sequence
cgttcttttttcaaaggctc

SEQ ID NO: 425893 - DNA, 20 bp, Artificial
  CRISPR gRNA sequence
ggcctgtatcaggctgtcta

SEQ ID NO: 425894 - DNA, 20 bp, Artificial
  CRISPR gRNA sequence
tgtatcaggctgtctaatgg

SEQ ID NO: 425895 - DNA, 20 bp, Artificial
  CRISPR gRNA sequence
aaacttgaaatgcctgccca

SEQ ID NO: 425896 - DNA, 20 bp, Artificial
  CRISPR gRNA sequence
tttgtgggactttcagctcc

SEQ ID NO: 425897 - DNA, 20 bp, Artificial
  CRISPR gRNA sequence
gacttacttataacctgcct

SEQ ID NO: 425898 - DNA, 20 bp, Artificial
  CRISPR gRNA sequence
tacttataacctgcctttga

SEQ ID NO: 425899 - DNA, 20 bp, Artificial
  CRISPR gRNA sequence
atgacgtgaaaaaatgagat

SEQ ID NO: 425900 - DNA, 20 bp, Artificial
  CRISPR gRNA sequence
ccaaaatgctggccattatg

SEQ ID NO: 425901 - DNA, 20 bp, Artificial
  CRISPR gRNA sequence
gaatgtgtctctcagagaca

SEQ ID NO: 425902 - DNA, 20 bp, Artificial
  CRISPR gRNA sequence
aggcctgccataatgcaaaa

SEQ ID NO: 425903 - DNA, 20 bp, Artificial
  CRISPR gRNA sequence
aaggaaatgaagatggagaa

SEQ ID NO: 425904 - DNA, 20 bp, Artificial
  CRISPR gRNA sequence
acacacacgcagcactgatg

SEQ ID NO: 425905 - DNA, 20 bp, Artificial
  CRISPR gRNA sequence
ctgcctggacacagcttcct

SEQ ID NO: 425906 - DNA, 20 bp, Artificial
  CRISPR gRNA sequence
tctcctgaggtcaccttcca

SEQ ID NO: 425907 - DNA, 20 bp, Artificial
  CRISPR gRNA sequence
ctgaggtcaccttccacaga

SEQ ID NO: 425908 - DNA, 20 bp, Artificial
  CRISPR gRNA sequence
aaaaacaaacaaactacaaa

SEQ ID NO: 425909 - DNA, 20 bp, Artificial
  CRISPR gRNA sequence
aaactacaaagtgagtatgt

SEQ ID NO: 425910 - DNA, 20 bp, Artificial
  CRISPR gRNA sequence
ttctgaaatgttctctttct

SEQ ID NO: 425911 - DNA, 20 bp, Artificial
  CRISPR gRNA sequence
cacatcagctccccaaaccg

SEQ ID NO: 425912 - DNA, 20 bp, Artificial
  CRISPR gRNA sequence
ccccaaaccgtggggttccc

SEQ ID NO: 425913 - DNA, 20 bp, Artificial
  CRISPR gRNA sequence
tctcacgctaaacatgctct

SEQ ID NO: 425914 - DNA, 20 bp, Artificial
  CRISPR gRNA sequence
caactccacatggtcgccag

SEQ ID NO: 425915 - DNA, 20 bp, Artificial
  CRISPR gRNA sequence
aatggctccactgtatatag

SEQ ID NO: 425916 - DNA, 20 bp, Artificial
  CRISPR gRNA sequence
gcttaacctgagatgcacag

SEQ ID NO: 425917 - DNA, 20 bp, Artificial
  CRISPR gRNA sequence
agatgcacagctggatttca

SEQ ID NO: 425918 - DNA, 20 bp, Artificial
  CRISPR gRNA sequence
tggtacagctactcaagtgg

SEQ ID NO: 425919 - DNA, 20 bp, Artificial
  CRISPR gRNA sequence
atgggctctcaaggtctgta

SEQ ID NO: 425920 - DNA, 20 bp, Artificial
  CRISPR gRNA sequence
aattttaggtatcatcttaa

SEQ ID NO: 425921 - DNA, 20 bp, Artificial
  CRISPR gRNA sequence
gagagctagtaaagcccatt

SEQ ID NO: 425922 - DNA, 20 bp, Artificial
  CRISPR gRNA sequence
cccattttgggtgtgtctgt

SEQ ID NO: 425923 - DNA, 20 bp, Artificial
  CRISPR gRNA sequence
aaggagattggcatgtcagt

SEQ ID NO: 425924 - DNA, 20 bp, Artificial
  CRISPR gRNA sequence
ggcatgtcagtctgagtgaa

SEQ ID NO: 425925 - DNA, 20 bp, Artificial
  CRISPR gRNA sequence
aaaattgtactttctctctt

SEQ ID NO: 425926 - DNA, 20 bp, Artificial
  CRISPR gRNA sequence
ttaaaccagtgctcctgacc

SEQ ID NO: 425927 - DNA, 20 bp, Artificial
  CRISPR gRNA sequence
caggcccttagccttggact

SEQ ID NO: 425928 - DNA, 20 bp, Artificial
  CRISPR gRNA sequence
actcccattttccagatgct

SEQ ID NO: 425929 - DNA, 20 bp, Artificial
  CRISPR gRNA sequence
tcacagcagccccttctctg

SEQ ID NO: 425930 - DNA, 20 bp, Artificial
  CRISPR gRNA sequence
agaagtaatgactgacctag

SEQ ID NO: 425931 - DNA, 20 bp, Artificial
  CRISPR gRNA sequence
gatctaaaacagttgctgct

SEQ ID NO: 425932 - DNA, 20 bp, Artificial
  CRISPR gRNA sequence
tagaaggcagcctgtaagaa

SEQ ID NO: 425933 - DNA, 20 bp, Artificial
  CRISPR gRNA sequence
agcctgtaagaacaggattg

SEQ ID NO: 425934 - DNA, 20 bp, Artificial
  CRISPR gRNA sequence
gtaagaacaggattgtggaa

SEQ ID NO: 425935 - DNA, 20 bp, Artificial
  CRISPR gRNA sequence
tgaaatgagatgggacacag

SEQ ID NO: 425936 - DNA, 20 bp, Artificial
  CRISPR gRNA sequence
actctaacatttgaggtgta

SEQ ID NO: 425937 - DNA, 20 bp, Artificial
  CRISPR gRNA sequence
aatagttagtgttagaactc

SEQ ID NO: 425938 - DNA, 20 bp, Artificial
  CRISPR gRNA sequence
ttagtgttagaactctggaa

SEQ ID NO: 425939 - DNA, 20 bp, Artificial
  CRISPR gRNA sequence
ctggaattgggtcaacagta

SEQ ID NO: 425940 - DNA, 20 bp, Artificial
  CRISPR gRNA sequence
ctatcagcaactcaaagtgt

SEQ ID NO: 425941 - DNA, 20 bp, Artificial
  CRISPR gRNA sequence
tagcatcttgatagtagagg

SEQ ID NO: 425942 - DNA, 20 bp, Artificial
  CRISPR gRNA sequence
aggaggagtctcctgaaact

SEQ ID NO: 425943 - DNA, 20 bp, Artificial
  CRISPR gRNA sequence
agtctcctgaaacttggaat

SEQ ID NO: 425944 - DNA, 20 bp, Artificial
  CRISPR gRNA sequence
cccacttccccttgatggaa

SEQ ID NO: 425945 - DNA, 20 bp, Artificial
  CRISPR gRNA sequence
ctgtccatcaggcccgtaat

SEQ ID NO: 425946 - DNA, 20 bp, Artificial
  CRISPR gRNA sequence
ccatgctaatggaggaagtg

SEQ ID NO: 425947 - DNA, 20 bp, Artificial
  CRISPR gRNA sequence
ggaagtgctgggtctgctaa

SEQ ID NO: 425948 - DNA, 20 bp, Artificial
  CRISPR gRNA sequence
ctgggagaagatgcctaggc

SEQ ID NO: 425949 - DNA, 20 bp, Artificial
  CRISPR gRNA sequence
aggcatgaattctgaaggtg

SEQ ID NO: 425950 - DNA, 20 bp, Artificial
  CRISPR gRNA sequence
gaaggtgatggattgtggta

SEQ ID NO: 425951 - DNA, 20 bp, Artificial
  CRISPR gRNA sequence
gtagggggtagaacataagc

SEQ ID NO: 425952 - DNA, 20 bp, Artificial
  CRISPR gRNA sequence
gtagaacataagcctggatg

SEQ ID NO: 425953 - DNA, 20 bp, Artificial
  CRISPR gRNA sequence
aaaggggaacaaaatgctca

SEQ ID NO: 425954 - DNA, 20 bp, Artificial
  CRISPR gRNA sequence
actaaatcagaaatggcaaa

SEQ ID NO: 425955 - DNA, 20 bp, Artificial
  CRISPR gRNA sequence
gaaatggcaaactgagtttt

SEQ ID NO: 425956 - DNA, 20 bp, Artificial
  CRISPR gRNA sequence
acagcaaaagaaataatcag

SEQ ID NO: 425957 - DNA, 20 bp, Artificial
  CRISPR gRNA sequence
tccaacaaaggactaatatc

SEQ ID NO: 425958 - DNA, 20 bp, Artificial
  CRISPR gRNA sequence
taaaaagacaattctcagaa

SEQ ID NO: 425959 - DNA, 20 bp, Artificial
  CRISPR gRNA sequence
caataccaccttactcttgt

SEQ ID NO: 425960 - DNA, 20 bp, Artificial
  CRISPR gRNA sequence
aaaaaataacccatgttggc

SEQ ID NO: 425961 - DNA, 20 bp, Artificial
  CRISPR gRNA sequence
aacacttttacactgcttgt

SEQ ID NO: 425962 - DNA, 20 bp, Artificial
  CRISPR gRNA sequence
ttaatccagtaatcccacta

SEQ ID NO: 425963 - DNA, 20 bp, Artificial
  CRISPR gRNA sequence
gcccaaatgcccatcaatca

SEQ ID NO: 425964 - DNA, 20 bp, Artificial
  CRISPR gRNA sequence
aaatgcccatcaatcaatga

SEQ ID NO: 425965 - DNA, 20 bp, Artificial
  CRISPR gRNA sequence
acatatatatatacacacca

SEQ ID NO: 425966 - DNA, 20 bp, Artificial
  CRISPR gRNA sequence
ataatggcatttgcagcagc

SEQ ID NO: 425967 - DNA, 20 bp, Artificial
  CRISPR gRNA sequence
ggcatttgcagcagcctgga

SEQ ID NO: 425968 - DNA, 20 bp, Artificial
  CRISPR gRNA sequence
tactataagtgaagtaactc

SEQ ID NO: 425969 - DNA, 20 bp, Artificial
  CRISPR gRNA sequence
tatgaggacgcaaaggcgtt

SEQ ID NO: 425970 - DNA, 20 bp, Artificial
  CRISPR gRNA sequence
gactttggggactcagggaa

SEQ ID NO: 425971 - DNA, 20 bp, Artificial
  CRISPR gRNA sequence
aaaagagtgggagagggctg

SEQ ID NO: 425972 - DNA, 20 bp, Artificial
  CRISPR gRNA sequence
gagggataaaggactacaca

SEQ ID NO: 425973 - DNA, 20 bp, Artificial
  CRISPR gRNA sequence
ctgggtacagtgtacactgt

SEQ ID NO: 425974 - DNA, 20 bp, Artificial
  CRISPR gRNA sequence
cagtgtacactgttcgggtg

SEQ ID NO: 425975 - DNA, 20 bp, Artificial
  CRISPR gRNA sequence
aaaaatttatagaaagaaaa

SEQ ID NO: 425976 - DNA, 20 bp, Artificial
  CRISPR gRNA sequence
taaataaaggtttgttggaa

SEQ ID NO: 425977 - DNA, 20 bp, Artificial
  CRISPR gRNA sequence
gcactttcacactacaatgg

SEQ ID NO: 425978 - DNA, 20 bp, Artificial
  CRISPR gRNA sequence
ttcacactacaatggcagag

SEQ ID NO: 425979 - DNA, 20 bp, Artificial
  CRISPR gRNA sequence
aaattttgccaatccctgta

SEQ ID NO: 425980 - DNA, 20 bp, Artificial
  CRISPR gRNA sequence
ggggaaaaaggaaaaagaaa

SEQ ID NO: 425981 - DNA, 20 bp, Artificial
  CRISPR gRNA sequence
tcccttttactaagctggaa

SEQ ID NO: 425982 - DNA, 20 bp, Artificial
  CRISPR gRNA sequence
taggagatgcttttacagaa

SEQ ID NO: 425983 - DNA, 20 bp, Artificial
  CRISPR gRNA sequence
actggattcctagtagcaat

SEQ ID NO: 425984 - DNA, 20 bp, Artificial
  CRISPR gRNA sequence
gcagcacttaaagaaacaaa

SEQ ID NO: 425985 - DNA, 20 bp, Artificial
  CRISPR gRNA sequence
gccaagaaagcctgatccat

SEQ ID NO: 425986 - DNA, 20 bp, Artificial
  CRISPR gRNA sequence
gatacagctgggcagccaag

SEQ ID NO: 425987 - DNA, 20 bp, Artificial
  CRISPR gRNA sequence
ttcatgtctatgagcactac

SEQ ID NO: 425988 - DNA, 20 bp, Artificial
  CRISPR gRNA sequence
tgtctatgagcactacttga

SEQ ID NO: 425989 - DNA, 20 bp, Artificial
  CRISPR gRNA sequence
gtactaaatgtactacatca

SEQ ID NO: 425990 - DNA, 20 bp, Artificial
  CRISPR gRNA sequence
ccaatgcaaagcaacagtag

SEQ ID NO: 425991 - DNA, 20 bp, Artificial
  CRISPR gRNA sequence
aacagtaggggaatggagag

SEQ ID NO: 425992 - DNA, 20 bp, Artificial
  CRISPR gRNA sequence
aatggagagaggaatgagat

SEQ ID NO: 425993 - DNA, 20 bp, Artificial
  CRISPR gRNA sequence
agttccctttgttctttctg

SEQ ID NO: 425994 - DNA, 20 bp, Artificial
  CRISPR gRNA sequence
cccctaccctttgaagaact

SEQ ID NO: 425995 - DNA, 20 bp, Artificial
  CRISPR gRNA sequence
ctgtcttcaaacaacccagt

SEQ ID NO: 425996 - DNA, 20 bp, Artificial
  CRISPR gRNA sequence
acatgttccctgctggaacc

SEQ ID NO: 425997 - DNA, 20 bp, Artificial
  CRISPR gRNA sequence
ggaaatgtcagagagggctg

SEQ ID NO: 425998 - DNA, 20 bp, Artificial
  CRISPR gRNA sequence
ccaaagttagtccaggtgcc

SEQ ID NO: 425999 - DNA, 20 bp, Artificial
  CRISPR gRNA sequence
agaatgaaaattaaccagtc

SEQ ID NO: 426000 - DNA, 20 bp, Artificial
  CRISPR gRNA sequence
cttgtcctcaccttcccata

SEQ ID NO: 426001 - DNA, 20 bp, Artificial
  CRISPR gRNA sequence
agttcaaccaggctgcagaa

SEQ ID NO: 426002 - DNA, 20 bp, Artificial
  CRISPR gRNA sequence
ctgcagaactgagttgttaa

SEQ ID NO: 426003 - DNA, 20 bp, Artificial
  CRISPR gRNA sequence
gaactgagttgttaattgaa

SEQ ID NO: 426004 - DNA, 20 bp, Artificial
  CRISPR gRNA sequence
agttgttaattgaatggaat

SEQ ID NO: 426005 - DNA, 20 bp, Artificial
  CRISPR gRNA sequence
gaattagagttggaggaaaa

SEQ ID NO: 426006 - DNA, 20 bp, Artificial
  CRISPR gRNA sequence
gagttggaggaaaagtgggt

SEQ ID NO: 426007 - DNA, 20 bp, Artificial
  CRISPR gRNA sequence
gtgggttaggatctcaggtg

SEQ ID NO: 426008 - DNA, 20 bp, Artificial
  CRISPR gRNA sequence
aggatctcaggtggagggtc

SEQ ID NO: 426009 - DNA, 20 bp, Artificial
  CRISPR gRNA sequence
caaaatatttatgtggtgac

SEQ ID NO: 426010 - DNA, 20 bp, Artificial
  CRISPR gRNA sequence
ccaagagatcagacaaaaca

SEQ ID NO: 426011 - DNA, 20 bp, Artificial
  CRISPR gRNA sequence
ttcatcacaactctatgata

SEQ ID NO: 426012 - DNA, 20 bp, Artificial
  CRISPR gRNA sequence
actctatgatatagagtaag

SEQ ID NO: 426013 - DNA, 20 bp, Artificial
  CRISPR gRNA sequence
atgaagatctgccctcatga

SEQ ID NO: 426014 - DNA, 20 bp, Artificial
  CRISPR gRNA sequence
gggattaatgccattatctc

SEQ ID NO: 426015 - DNA, 20 bp, Artificial
  CRISPR gRNA sequence
ttaatgccattatctcagga

SEQ ID NO: 426016 - DNA, 20 bp, Artificial
  CRISPR gRNA sequence
aggagtgggttaggtatcat

SEQ ID NO: 426017 - DNA, 20 bp, Artificial
  CRISPR gRNA sequence
gggagtaagttcctaattaa

SEQ ID NO: 426018 - DNA, 20 bp, Artificial
  CRISPR gRNA sequence
gtaagttcctaattaaaagg

SEQ ID NO: 426019 - DNA, 20 bp, Artificial
  CRISPR gRNA sequence
tcacatgatgccttctgccg

SEQ ID NO: 426020 - DNA, 20 bp, Artificial
  CRISPR gRNA sequence
ataagctcttaagctaaaca

SEQ ID NO: 426021 - DNA, 20 bp, Artificial
  CRISPR gRNA sequence
tttttttttttttttagaga

SEQ ID NO: 426022 - DNA, 20 bp, Artificial
  CRISPR gRNA sequence
tcttgctctgttgcccacgc

SEQ ID NO: 426023 - DNA, 20 bp, Artificial
  CRISPR gRNA sequence
tcactgcagccttgaactcc

SEQ ID NO: 426024 - DNA, 20 bp, Artificial
  CRISPR gRNA sequence
gatcctcccgccacagtctc

SEQ ID NO: 426025 - DNA, 20 bp, Artificial
  CRISPR gRNA sequence
ctcccgccacagtctcccga

SEQ ID NO: 426026 - DNA, 20 bp, Artificial
  CRISPR gRNA sequence
gccacagtctcccgagtggg

SEQ ID NO: 426027 - DNA, 20 bp, Artificial
  CRISPR gRNA sequence
ctggcctaaccctacatttt

SEQ ID NO: 426028 - DNA, 20 bp, Artificial
  CRISPR gRNA sequence
tttctcattctacagacatg

SEQ ID NO: 426029 - DNA, 20 bp, Artificial
  CRISPR gRNA sequence
tgggtaacctagcactacca

SEQ ID NO: 426030 - DNA, 20 bp, Artificial
  CRISPR gRNA sequence
actctcagagcagtggctta

SEQ ID NO: 426031 - DNA, 20 bp, Artificial
  CRISPR gRNA sequence
ttaagggataagcagaaacc

SEQ ID NO: 426032 - DNA, 20 bp, Artificial
  CRISPR gRNA sequence
gagttacaaatgacagcaag

SEQ ID NO: 426033 - DNA, 20 bp, Artificial
  CRISPR gRNA sequence
gaaacaggtccagctgtcca

SEQ ID NO: 426034 - DNA, 20 bp, Artificial
  CRISPR gRNA sequence
agcactcgggaagatcacat

SEQ ID NO: 426035 - DNA, 20 bp, Artificial
  CRISPR gRNA sequence
gatcacatctgggtctctct

SEQ ID NO: 426036 - DNA, 20 bp, Artificial
  CRISPR gRNA sequence
gaaagagaacctgaaaggac

SEQ ID NO: 426037 - DNA, 20 bp, Artificial
  CRISPR gRNA sequence
aggacccgggtgccagacgt

SEQ ID NO: 426038 - DNA, 20 bp, Artificial
  CRISPR gRNA sequence
gcggccatggctccaagcaa

SEQ ID NO: 426039 - DNA, 20 bp, Artificial
  CRISPR gRNA sequence
agagggaggacaaaacagag

SEQ ID NO: 426040 - DNA, 20 bp, Artificial
  CRISPR gRNA sequence
gagcttcacggcagagaggg

SEQ ID NO: 426041 - DNA, 20 bp, Artificial
  CRISPR gRNA sequence
aagcccaacactttgaacag

SEQ ID NO: 426042 - DNA, 20 bp, Artificial
  CRISPR gRNA sequence
tccagaaaaaaactcagaaa

SEQ ID NO: 426043 - DNA, 20 bp, Artificial
  CRISPR gRNA sequence
ttctcagcatctgacacata

SEQ ID NO: 426044 - DNA, 20 bp, Artificial
  CRISPR gRNA sequence
gaagcaagaagatgcaggag

SEQ ID NO: 426045 - DNA, 20 bp, Artificial
  CRISPR gRNA sequence
aggaggggagttttgaagag

SEQ ID NO: 426046 - DNA, 20 bp, Artificial
  CRISPR gRNA sequence
tgagtaagatctgacccaag

SEQ ID NO: 426047 - DNA, 20 bp, Artificial
  CRISPR gRNA sequence
ggtagggctcaggtatccag

SEQ ID NO: 426048 - DNA, 20 bp, Artificial
  CRISPR gRNA sequence
ggtatccaggggagtcttca

SEQ ID NO: 426049 - DNA, 20 bp, Artificial
  CRISPR gRNA sequence
cacatctcatccctctacct

SEQ ID NO: 426050 - DNA, 20 bp, Artificial
  CRISPR gRNA sequence
tcatccctctacctaagggt

SEQ ID NO: 426051 - DNA, 20 bp, Artificial
  CRISPR gRNA sequence
gggttgctaaaaggtggctt

SEQ ID NO: 426052 - DNA, 20 bp, Artificial
  CRISPR gRNA sequence
aggaatccaatccataagac

SEQ ID NO: 426053 - DNA, 20 bp, Artificial
  CRISPR gRNA sequence
catagccatacagttagctc

SEQ ID NO: 426054 - DNA, 20 bp, Artificial
  CRISPR gRNA sequence
agaggacagatggaaagcac

SEQ ID NO: 426055 - DNA, 20 bp, Artificial
  CRISPR gRNA sequence
ggctatccataaaaccagga

SEQ ID NO: 426056 - DNA, 20 bp, Artificial
  CRISPR gRNA sequence
ggacagagccagattggagg

SEQ ID NO: 426057 - DNA, 20 bp, Artificial
  CRISPR gRNA sequence
gattggaggcagggttaggc

SEQ ID NO: 426058 - DNA, 20 bp, Artificial
  CRISPR gRNA sequence
tggggacagatgaagataga

SEQ ID NO: 426059 - DNA, 20 bp, Artificial
  CRISPR gRNA sequence
gtttagggaagattatgata

SEQ ID NO: 426060 - DNA, 20 bp, Artificial
  CRISPR gRNA sequence
taatgagtttggttaggttt

SEQ ID NO: 426061 - DNA, 20 bp, Artificial
  CRISPR gRNA sequence
gttcgagatacaattgggac

SEQ ID NO: 426062 - DNA, 20 bp, Artificial
  CRISPR gRNA sequence
attgggaccagagtggaact

SEQ ID NO: 426063 - DNA, 20 bp, Artificial
  CRISPR gRNA sequence
ttagatgtatcaatttcatt

SEQ ID NO: 426064 - DNA, 20 bp, Artificial
  CRISPR gRNA sequence
tctttgaaacagaagcagcc

SEQ ID NO: 426065 - DNA, 20 bp, Artificial
  CRISPR gRNA sequence
aagcatgacatcactacatg

SEQ ID NO: 426066 - DNA, 20 bp, Artificial
  CRISPR gRNA sequence
ggaaggggcagactctgtat

SEQ ID NO: 426067 - DNA, 20 bp, Artificial
  CRISPR gRNA sequence
cctattaaccaggttgactt

SEQ ID NO: 426068 - DNA, 20 bp, Artificial
  CRISPR gRNA sequence
acaattttagcattaaggtt

SEQ ID NO: 426069 - DNA, 20 bp, Artificial
  CRISPR gRNA sequence
ttaaatattacagatagtat

SEQ ID NO: 426070 - DNA, 20 bp, Artificial
  CRISPR gRNA sequence
gattaggttcaaaaagaagc

SEQ ID NO: 426071 - DNA, 20 bp, Artificial
  CRISPR gRNA sequence
tgctaatgcaagtaattaag

SEQ ID NO: 426072 - DNA, 20 bp, Artificial
  CRISPR gRNA sequence
tgggaaacaagagggaagag

SEQ ID NO: 426073 - DNA, 20 bp, Artificial
  CRISPR gRNA sequence
gagtgaccaatggtgttccc

SEQ ID NO: 426074 - DNA, 20 bp, Artificial
  CRISPR gRNA sequence
cctggagtctgcaatggcaa

SEQ ID NO: 426075 - DNA, 20 bp, Artificial
  CRISPR gRNA sequence
gctttgtggggaggctgcac

SEQ ID NO: 426076 - DNA, 20 bp, Artificial
  CRISPR gRNA sequence
atcttctgatctctctcccc

SEQ ID NO: 426077 - DNA, 20 bp, Artificial
  CRISPR gRNA sequence
gtgccactgtggtcttgggg

SEQ ID NO: 426078 - DNA, 20 bp, Artificial
  CRISPR gRNA sequence
tgtcaggaccaccgatctcc

SEQ ID NO: 426079 - DNA, 20 bp, Artificial
  CRISPR gRNA sequence
cccggtcctgccgtctggtg

SEQ ID NO: 426080 - DNA, 20 bp, Artificial
  CRISPR gRNA sequence
ggtcctctggcatatgacac

SEQ ID NO: 426081 - DNA, 20 bp, Artificial
  CRISPR gRNA sequence
tgacactggggtaaagagcc

SEQ ID NO: 426082 - DNA, 20 bp, Artificial
  CRISPR gRNA sequence
ccatcacttggttactttgc

SEQ ID NO: 426083 - DNA, 20 bp, Artificial
  CRISPR gRNA sequence
cataatttacccagacttcg

SEQ ID NO: 426084 - DNA, 20 bp, Artificial
  CRISPR gRNA sequence
cgggcagatcactggaggtc

SEQ ID NO: 426085 - DNA, 20 bp, Artificial
  CRISPR gRNA sequence
aaaattagccgggcatggtg

SEQ ID NO: 426086 - DNA, 20 bp, Artificial
  CRISPR gRNA sequence
ctcaggaggctgaggcagga

SEQ ID NO: 426087 - DNA, 20 bp, Artificial
  CRISPR gRNA sequence
cataactgacagcagtaaat

SEQ ID NO: 426088 - DNA, 20 bp, Artificial
  CRISPR gRNA sequence
cagcagtaaataggagttct

SEQ ID NO: 426089 - DNA, 20 bp, Artificial
  CRISPR gRNA sequence
tctgcctgcatcaaacaaat

SEQ ID NO: 426090 - DNA, 20 bp, Artificial
  CRISPR gRNA sequence
aagaccattttcttgtagta

SEQ ID NO: 426091 - DNA, 20 bp, Artificial
  CRISPR gRNA sequence
tctgagggcaacagcagagc

SEQ ID NO: 426092 - DNA, 20 bp, Artificial
  CRISPR gRNA sequence
gcacccagactgtctggtgt

SEQ ID NO: 426093 - DNA, 20 bp, Artificial
  CRISPR gRNA sequence
tactgtctctcagataagat

SEQ ID NO: 426094 - DNA, 20 bp, Artificial
  CRISPR gRNA sequence
agaatccttttctaacctct

SEQ ID NO: 426095 - DNA, 20 bp, Artificial
  CRISPR gRNA sequence
gaattggtttaaatgtacag

SEQ ID NO: 426096 - DNA, 20 bp, Artificial
  CRISPR gRNA sequence
gctctactctttatacactt

SEQ ID NO: 426097 - DNA, 20 bp, Artificial
  CRISPR gRNA sequence
tctcagtattggctgcccat

SEQ ID NO: 426098 - DNA, 20 bp, Artificial
  CRISPR gRNA sequence
ccttgtttagctctgctatt

SEQ ID NO: 426099 - DNA, 20 bp, Artificial
  CRISPR gRNA sequence
tctgctattagggattctga

SEQ ID NO: 426100 - DNA, 20 bp, Artificial
  CRISPR gRNA sequence
gggattctgattgaattggt

SEQ ID NO: 426101 - DNA, 20 bp, Artificial
  CRISPR gRNA sequence
caggtgattcaaatgtgatc

SEQ ID NO: 426102 - DNA, 20 bp, Artificial
  CRISPR gRNA sequence
agccctgctgtgcagtgttt

SEQ ID NO: 426103 - DNA, 20 bp, Artificial
  CRISPR gRNA sequence
atccaccaacttgctccagc

SEQ ID NO: 426104 - DNA, 20 bp, Artificial
  CRISPR gRNA sequence
tctcccagtgtacgtcccat

SEQ ID NO: 426105 - DNA, 20 bp, Artificial
  CRISPR gRNA sequence
tcgttcacggtcagcgactg

SEQ ID NO: 426106 - DNA, 20 bp, Artificial
  CRISPR gRNA sequence
ctggggccactcgatccttg

SEQ ID NO: 426107 - DNA, 20 bp, Artificial
  CRISPR gRNA sequence
tcctgctgctcccagttgac

SEQ ID NO: 426108 - DNA, 20 bp, Artificial
  CRISPR gRNA sequence
gggaagaggacgaagcacat

SEQ ID NO: 426109 - DNA, 20 bp, Artificial
  CRISPR gRNA sequence
ggacgaagcacatgtgagtc

SEQ ID NO: 426110 - DNA, 20 bp, Artificial
  CRISPR gRNA sequence
aagggcctttgaggccccaa

SEQ ID NO: 426111 - DNA, 20 bp, Artificial
  CRISPR gRNA sequence
ttgaggccccaactggattt

SEQ ID NO: 426112 - DNA, 20 bp, Artificial
  CRISPR gRNA sequence
gcctattttgtctacccact

SEQ ID NO: 426113 - DNA, 20 bp, Artificial
  CRISPR gRNA sequence
tcctgcggcctagttctatg

SEQ ID NO: 426114 - DNA, 20 bp, Artificial
  CRISPR gRNA sequence
gtctctagtggtagaacctc

SEQ ID NO: 426115 - DNA, 20 bp, Artificial
  CRISPR gRNA sequence
aacagaaaagaagctggagc

SEQ ID NO: 426116 - DNA, 20 bp, Artificial
  CRISPR gRNA sequence
gagattgtcctttcttaaat

SEQ ID NO: 426117 - DNA, 20 bp, Artificial
  CRISPR gRNA sequence
aagcagctgtggcatgctct

SEQ ID NO: 426118 - DNA, 20 bp, Artificial
  CRISPR gRNA sequence
ttttcctccctgctgctctg

SEQ ID NO: 426119 - DNA, 20 bp, Artificial
  CRISPR gRNA sequence
gtgtatttgttgacaacttt

SEQ ID NO: 426120 - DNA, 20 bp, Artificial
  CRISPR gRNA sequence
acaactttatgtgtttttaa

SEQ ID NO: 426121 - DNA, 20 bp, Artificial
  CRISPR gRNA sequence
ttaatatggtttttgccaaa

SEQ ID NO: 426122 - DNA, 20 bp, Artificial
  CRISPR gRNA sequence
agaccgtcttttctcagagg

SEQ ID NO: 426123 - DNA, 20 bp, Artificial
  CRISPR gRNA sequence
tcagtggcagaagaggccac

SEQ ID NO: 426124 - DNA, 20 bp, Artificial
  CRISPR gRNA sequence
agcagggaggaaaaacaagg

SEQ ID NO: 426125 - DNA, 20 bp, Artificial
  CRISPR gRNA sequence
ctaagcttggttggagactt

SEQ ID NO: 426126 - DNA, 20 bp, Artificial
  CRISPR gRNA sequence
agactccaagagcatgccac

SEQ ID NO: 426127 - DNA, 20 bp, Artificial
  CRISPR gRNA sequence
tctctgagaatgaggtgggg

SEQ ID NO: 426128 - DNA, 20 bp, Artificial
  CRISPR gRNA sequence
agggctgggcaggaggcatt

SEQ ID NO: 426129 - DNA, 20 bp, Artificial
  CRISPR gRNA sequence
ctgggcaggaggcattgcca

SEQ ID NO: 426130 - DNA, 20 bp, Artificial
  CRISPR gRNA sequence
ttttagaagctcattcctgc

SEQ ID NO: 426131 - DNA, 20 bp, Artificial
  CRISPR gRNA sequence
tgaattgaaaatgtcttttt

SEQ ID NO: 426132 - DNA, 20 bp, Artificial
  CRISPR gRNA sequence
ccagaggttctaccactaga

SEQ ID NO: 426133 - DNA, 20 bp, Artificial
  CRISPR gRNA sequence
atttaaaaactgtggtataa

SEQ ID NO: 426134 - DNA, 20 bp, Artificial
  CRISPR gRNA sequence
gtggttatgcctgggagaag

SEQ ID NO: 426135 - DNA, 20 bp, Artificial
  CRISPR gRNA sequence
gggagaagcagggtttcctg

SEQ ID NO: 426136 - DNA, 20 bp, Artificial
  CRISPR gRNA sequence
cctgctaagcttcctttgct

SEQ ID NO: 426137 - DNA, 20 bp, Artificial
  CRISPR gRNA sequence
cttcctttgctattggattt

SEQ ID NO: 426138 - DNA, 20 bp, Artificial
  CRISPR gRNA sequence
ttggatttcttggctttcct

SEQ ID NO: 426139 - DNA, 20 bp, Artificial
  CRISPR gRNA sequence
aatgacaatcaaccaaacag

SEQ ID NO: 426140 - DNA, 20 bp, Artificial
  CRISPR gRNA sequence
aagaggtggtatcagctgac

SEQ ID NO: 426141 - DNA, 20 bp, Artificial
  CRISPR gRNA sequence
gctgctgacccaggactcac

SEQ ID NO: 426142 - DNA, 20 bp, Artificial
  CRISPR gRNA sequence
ggtcaactgggagcagcagg

SEQ ID NO: 426143 - DNA, 20 bp, Artificial
  CRISPR gRNA sequence
aatcctgaaacactgcacag

SEQ ID NO: 426144 - DNA, 20 bp, Artificial
  CRISPR gRNA sequence
gatcacatttgaatcacctg

SEQ ID NO: 426145 - DNA, 20 bp, Artificial
  CRISPR gRNA sequence
taaggtctaaaagcatttcc

SEQ ID NO: 426146 - DNA, 20 bp, Artificial
  CRISPR gRNA sequence
atatgcaaaagttcccattt

SEQ ID NO: 426147 - DNA, 20 bp, Artificial
  CRISPR gRNA sequence
ggttaaaaacatagcctgtg

SEQ ID NO: 426148 - DNA, 20 bp, Artificial
  CRISPR gRNA sequence
tttacatttgtgtggtactt

SEQ ID NO: 426149 - DNA, 20 bp, Artificial
  CRISPR gRNA sequence
accaattcccagaggttaga

SEQ ID NO: 426150 - DNA, 20 bp, Artificial
  CRISPR gRNA sequence
ggctctgctgttgccctcag

SEQ ID NO: 426151 - DNA, 20 bp, Artificial
  CRISPR gRNA sequence
gttgccctcagacaggattt

SEQ ID NO: 426152 - DNA, 20 bp, Artificial
  CRISPR gRNA sequence
atttcttagcttctctgtgt

SEQ ID NO: 426153 - DNA, 20 bp, Artificial
  CRISPR gRNA sequence
agaccttatgcgatgctaat

SEQ ID NO: 426154 - DNA, 20 bp, Artificial
  CRISPR gRNA sequence
tgtataagtgttaactatta

SEQ ID NO: 426155 - DNA, 20 bp, Artificial
  CRISPR gRNA sequence
taactattagtatgattccc

SEQ ID NO: 426156 - DNA, 20 bp, Artificial
  CRISPR gRNA sequence
tgtttgatgcaggcagaagc

SEQ ID NO: 426157 - DNA, 20 bp, Artificial
  CRISPR gRNA sequence
ggagttgctcagagtggtag

SEQ ID NO: 426158 - DNA, 20 bp, Artificial
  CRISPR gRNA sequence
ggtagagctgattttaacac

SEQ ID NO: 426159 - DNA, 20 bp, Artificial
  CRISPR gRNA sequence
tttactgctgtcagttatgt

SEQ ID NO: 426160 - DNA, 20 bp, Artificial
  CRISPR gRNA sequence
gagaagataaaaggttacct

SEQ ID NO: 426161 - DNA, 20 bp, Artificial
  CRISPR gRNA sequence
ttttttttttttttttgaga

SEQ ID NO: 426162 - DNA, 20 bp, Artificial
  CRISPR gRNA sequence
aacttccgcctcctgagttc

SEQ ID NO: 426163 - DNA, 20 bp, Artificial
  CRISPR gRNA sequence
tgcctcagcctcctgagtat

SEQ ID NO: 426164 - DNA, 20 bp, Artificial
  CRISPR gRNA sequence
ttttgtatttttagtagaga

SEQ ID NO: 426165 - DNA, 20 bp, Artificial
  CRISPR gRNA sequence
ctcccaaagtgttacttctt

SEQ ID NO: 426166 - DNA, 20 bp, Artificial
  CRISPR gRNA sequence
gtaaattatgtacttttttt

SEQ ID NO: 426167 - DNA, 20 bp, Artificial
  CRISPR gRNA sequence
acaacagtgctagataggta

SEQ ID NO: 426168 - DNA, 20 bp, Artificial
  CRISPR gRNA sequence
ataagcttaacttcataagg

SEQ ID NO: 426169 - DNA, 20 bp, Artificial
  CRISPR gRNA sequence
acaataagcagggcagggga

SEQ ID NO: 426170 - DNA, 20 bp, Artificial
  CRISPR gRNA sequence
gcagcctccccacaaagcct

SEQ ID NO: 426171 - DNA, 20 bp, Artificial
  CRISPR gRNA sequence
ttggtcactcggctcttccc

SEQ ID NO: 426172 - DNA, 20 bp, Artificial
  CRISPR gRNA sequence
ctcttgtttcccaagtggtc

SEQ ID NO: 426173 - DNA, 20 bp, Artificial
  CRISPR gRNA sequence
ttacttgcattagcacaaac

SEQ ID NO: 426174 - DNA, 20 bp, Artificial
  CRISPR gRNA sequence
agtcaacctggttaataggc

SEQ ID NO: 426175 - DNA, 20 bp, Artificial
  CRISPR gRNA sequence
ccaccctgcatgtagtgatg

SEQ ID NO: 426176 - DNA, 20 bp, Artificial
  CRISPR gRNA sequence
gtgatgtcatgcttactcag

SEQ ID NO: 426177 - DNA, 20 bp, Artificial
  CRISPR gRNA sequence
tcatgcttactcagggctgc

SEQ ID NO: 426178 - DNA, 20 bp, Artificial
  CRISPR gRNA sequence
ataactgtgaatggagacat

SEQ ID NO: 426179 - DNA, 20 bp, Artificial
  CRISPR gRNA sequence
ataatcttccctaaacctca

SEQ ID NO: 426180 - DNA, 20 bp, Artificial
  CRISPR gRNA sequence
aaactgatcatatatccttt

SEQ ID NO: 426181 - DNA, 20 bp, Artificial
  CRISPR gRNA sequence
cagtgtgttctctatgaccc

SEQ ID NO: 426182 - DNA, 20 bp, Artificial
  CRISPR gRNA sequence
tgcaggcaccacccttgtct

SEQ ID NO: 426183 - DNA, 20 bp, Artificial
  CRISPR gRNA sequence
gcaccacccttgtcttatgg

SEQ ID NO: 426184 - DNA, 20 bp, Artificial
  CRISPR gRNA sequence
ttaggtagagggatgagatg

SEQ ID NO: 426185 - DNA, 20 bp, Artificial
  CRISPR gRNA sequence
aaaactcccctcctgcatct

SEQ ID NO: 426186 - DNA, 20 bp, Artificial
  CRISPR gRNA sequence
tcttaatgaaatgcactagt

SEQ ID NO: 426187 - DNA, 20 bp, Artificial
  CRISPR gRNA sequence
gtccagagcctcatgccctc

SEQ ID NO: 426188 - DNA, 20 bp, Artificial
  CRISPR gRNA sequence
cctagctggaaataagtgtt

SEQ ID NO: 426189 - DNA, 20 bp, Artificial
  CRISPR gRNA sequence
tgaattaaatatttttattg

SEQ ID NO: 426190 - DNA, 20 bp, Artificial
  CRISPR gRNA sequence
taaaagaaaatattcacttt

SEQ ID NO: 426191 - DNA, 20 bp, Artificial
  CRISPR gRNA sequence
agtttttttctggaactact

SEQ ID NO: 426192 - DNA, 20 bp, Artificial
  CRISPR gRNA sequence
gaactactatttgtttcatt

SEQ ID NO: 426193 - DNA, 20 bp, Artificial
  CRISPR gRNA sequence
tttcatttcatgattaccaa

SEQ ID NO: 426194 - DNA, 20 bp, Artificial
  CRISPR gRNA sequence
ccactgctgaaaatatcagt

SEQ ID NO: 426195 - DNA, 20 bp, Artificial
  CRISPR gRNA sequence
atactctgctgttcaaagtg

SEQ ID NO: 426196 - DNA, 20 bp, Artificial
  CRISPR gRNA sequence
tccagtcccatggttacaca

SEQ ID NO: 426197 - DNA, 20 bp, Artificial
  CRISPR gRNA sequence
gctcaggctgccctggggaa

SEQ ID NO: 426198 - DNA, 20 bp, Artificial
  CRISPR gRNA sequence
ctggggaaatcagcttcact

SEQ ID NO: 426199 - DNA, 20 bp, Artificial
  CRISPR gRNA sequence
ttctggcttctgccactcat

SEQ ID NO: 426200 - DNA, 20 bp, Artificial
  CRISPR gRNA sequence
ggctgagcacggtgccaggt

SEQ ID NO: 426201 - DNA, 20 bp, Artificial
  CRISPR gRNA sequence
cggtgccaggttccagattc

SEQ ID NO: 426202 - DNA, 20 bp, Artificial
  CRISPR gRNA sequence
gggaccccctggacagctgg

SEQ ID NO: 426203 - DNA, 20 bp, Artificial
  CRISPR gRNA sequence
tcttgctgtcatttgtaact

SEQ ID NO: 426204 - DNA, 20 bp, Artificial
  CRISPR gRNA sequence
tgtcatttgtaactcctggt

SEQ ID NO: 426205 - DNA, 20 bp, Artificial
  CRISPR gRNA sequence
atcccttaagccactgctct

SEQ ID NO: 426206 - DNA, 20 bp, Artificial
  CRISPR gRNA sequence
ctgagagtttaatttatcta

SEQ ID NO: 426207 - DNA, 20 bp, Artificial
  CRISPR gRNA sequence
tcgtgggcatctatatatgc

SEQ ID NO: 426208 - DNA, 20 bp, Artificial
  CRISPR gRNA sequence
agctttctgcacattagctc

SEQ ID NO: 426209 - DNA, 20 bp, Artificial
  CRISPR gRNA sequence
agatcagcaggttgtaaatc

SEQ ID NO: 426210 - DNA, 20 bp, Artificial
  CRISPR gRNA sequence
agcaggttgtaaatcctctg

SEQ ID NO: 426211 - DNA, 20 bp, Artificial
  CRISPR gRNA sequence
gtaaatcctctgtttagctt

SEQ ID NO: 426212 - DNA, 20 bp, Artificial
  CRISPR gRNA sequence
atgaatggggaattgaaaga

SEQ ID NO: 426213 - DNA, 20 bp, Artificial
  CRISPR gRNA sequence
gggaattgaaagatctagtt

SEQ ID NO: 426214 - DNA, 20 bp, Artificial
  CRISPR gRNA sequence
ttctagttttggcactgagt

SEQ ID NO: 426215 - DNA, 20 bp, Artificial
  CRISPR gRNA sequence
tcatttccttatatataaaa

SEQ ID NO: 426216 - DNA, 20 bp, Artificial
  CRISPR gRNA sequence
ttgggaaatttataaagaaa

SEQ ID NO: 426217 - DNA, 20 bp, Artificial
  CRISPR gRNA sequence
taatactattacaatggtaa

SEQ ID NO: 426218 - DNA, 20 bp, Artificial
  CRISPR gRNA sequence
aaaccatagctgtattataa

SEQ ID NO: 426219 - DNA, 20 bp, Artificial
  CRISPR gRNA sequence
tttatgtcatcagctactgg

SEQ ID NO: 426220 - DNA, 20 bp, Artificial
  CRISPR gRNA sequence
ggagtgaaagaatttccact

SEQ ID NO: 426221 - DNA, 20 bp, Artificial
  CRISPR gRNA sequence
acataaatattttgggaaac

SEQ ID NO: 426222 - DNA, 20 bp, Artificial
  CRISPR gRNA sequence
tgggaaggtgaggacaagag

SEQ ID NO: 426223 - DNA, 20 bp, Artificial
  CRISPR gRNA sequence
agctgaacaacttttcctgt

SEQ ID NO: 426224 - DNA, 20 bp, Artificial
  CRISPR gRNA sequence
gtcctgttgctccctttcta

SEQ ID NO: 426225 - DNA, 20 bp, Artificial
  CRISPR gRNA sequence
tgttgctccctttctacagt

SEQ ID NO: 426226 - DNA, 20 bp, Artificial
  CRISPR gRNA sequence
ccagccctctctgacatttc

SEQ ID NO: 426227 - DNA, 20 bp, Artificial
  CRISPR gRNA sequence
gggtcctctctgcatctttc

SEQ ID NO: 426228 - DNA, 20 bp, Artificial
  CRISPR gRNA sequence
aacatgtagtactcaaactg

SEQ ID NO: 426229 - DNA, 20 bp, Artificial
  CRISPR gRNA sequence
ctcaaactgggttgtttgaa

SEQ ID NO: 426230 - DNA, 20 bp, Artificial
  CRISPR gRNA sequence
tgtttgaagacagtttaata

SEQ ID NO: 426231 - DNA, 20 bp, Artificial
  CRISPR gRNA sequence
tcctctctccattcccctac

SEQ ID NO: 426232 - DNA, 20 bp, Artificial
  CRISPR gRNA sequence
cttgactttccacagggttg

SEQ ID NO: 426233 - DNA, 20 bp, Artificial
  CRISPR gRNA sequence
tctcttgtagtcttgacctc

SEQ ID NO: 426234 - DNA, 20 bp, Artificial
  CRISPR gRNA sequence
cattttaatattcccatgga

SEQ ID NO: 426235 - DNA, 20 bp, Artificial
  CRISPR gRNA sequence
cattgaagtaattacatcca

SEQ ID NO: 426236 - DNA, 20 bp, Artificial
  CRISPR gRNA sequence
gctcccctagcacattcttt

SEQ ID NO: 426237 - DNA, 20 bp, Artificial
  CRISPR gRNA sequence
aaaagtcaatataatcagct

SEQ ID NO: 426238 - DNA, 20 bp, Artificial
  CRISPR gRNA sequence
attttggaaattattcagta

SEQ ID NO: 426239 - DNA, 20 bp, Artificial
  CRISPR gRNA sequence
gaggcagatagtatatcttt

SEQ ID NO: 426240 - DNA, 20 bp, Artificial
  CRISPR gRNA sequence
ccattgtagtgtgaaagtgc

SEQ ID NO: 426241 - DNA, 20 bp, Artificial
  CRISPR gRNA sequence
atttttatgtgtaataaaat

SEQ ID NO: 426242 - DNA, 20 bp, Artificial
  CRISPR gRNA sequence
gtttttctttctataaattt

SEQ ID NO: 426243 - DNA, 20 bp, Artificial
  CRISPR gRNA sequence
tttatatattttttatttca

SEQ ID NO: 426244 - DNA, 20 bp, Artificial
  CRISPR gRNA sequence
ttggggaataagtcctttag

SEQ ID NO: 426245 - DNA, 20 bp, Artificial
  CRISPR gRNA sequence
aagtcctttagtggtgattt

SEQ ID NO: 426246 - DNA, 20 bp, Artificial
  CRISPR gRNA sequence
tcttaacgcctttgcgtcct

SEQ ID NO: 426247 - DNA, 20 bp, Artificial
  CRISPR gRNA sequence
cacttctgagtgagaacata

SEQ ID NO: 426248 - DNA, 20 bp, Artificial
  CRISPR gRNA sequence
ctgagtgagaacatacaatg

SEQ ID NO: 426249 - DNA, 20 bp, Artificial
  CRISPR gRNA sequence
tgagttacttcacttatagt

SEQ ID NO: 426250 - DNA, 20 bp, Artificial
  CRISPR gRNA sequence
ttacaatttctttatccact

SEQ ID NO: 426251 - DNA, 20 bp, Artificial
  CRISPR gRNA sequence
atttttgcaattgcaaattg

SEQ ID NO: 426252 - DNA, 20 bp, Artificial
  CRISPR gRNA sequence
ctctggatagatacccagta

SEQ ID NO: 426253 - DNA, 20 bp, Artificial
  CRISPR gRNA sequence
agatacccagtagtgggatt

SEQ ID NO: 426254 - DNA, 20 bp, Artificial
  CRISPR gRNA sequence
agttccttaaggaatctcca

SEQ ID NO: 426255 - DNA, 20 bp, Artificial
  CRISPR gRNA sequence
acactgttttccatagtcat

SEQ ID NO: 426256 - DNA, 20 bp, Artificial
  CRISPR gRNA sequence
acatgggttatttttttatt

SEQ ID NO: 426257 - DNA, 20 bp, Artificial
  CRISPR gRNA sequence
cttacaagagtaaggtggta

SEQ ID NO: 426258 - DNA, 20 bp, Artificial
  CRISPR gRNA sequence
aagagtaaggtggtattgtg

SEQ ID NO: 426259 - DNA, 20 bp, Artificial
  CRISPR gRNA sequence
aggtggtattgtgttttgat

SEQ ID NO: 426260 - DNA, 20 bp, Artificial
  CRISPR gRNA sequence
gtgatgttgagcattttttc

SEQ ID NO: 426261 - DNA, 20 bp, Artificial
  CRISPR gRNA sequence
tgtccttagcccactttttg

SEQ ID NO: 426262 - DNA, 20 bp, Artificial
  CRISPR gRNA sequence
tttgatgggatttttttttc

SEQ ID NO: 426263 - DNA, 20 bp, Artificial
  CRISPR gRNA sequence
tgggatttttttttcagctg

SEQ ID NO: 426264 - DNA, 20 bp, Artificial
  CRISPR gRNA sequence
gctgatttgtttgagttcct

SEQ ID NO: 426265 - DNA, 20 bp, Artificial
  CRISPR gRNA sequence
atattttctcccaatctgtg

SEQ ID NO: 426266 - DNA, 20 bp, Artificial
  CRISPR gRNA sequence
aatctgtgggctgtttactc

SEQ ID NO: 426267 - DNA, 20 bp, Artificial
  CRISPR gRNA sequence
atattactttttaaaactat

SEQ ID NO: 426268 - DNA, 20 bp, Artificial
  CRISPR gRNA sequence
gccatatttgacccacaaaa

SEQ ID NO: 426269 - DNA, 20 bp, Artificial
  CRISPR gRNA sequence
cacaaaactcagtttgccat

SEQ ID NO: 426270 - DNA, 20 bp, Artificial
  CRISPR gRNA sequence
agtttgccatttctgattta

SEQ ID NO: 426271 - DNA, 20 bp, Artificial
  CRISPR gRNA sequence
agcattttgttccccttttc

SEQ ID NO: 426272 - DNA, 20 bp, Artificial
  CRISPR gRNA sequence
attgacgcattatccctcat

SEQ ID NO: 426273 - DNA, 20 bp, Artificial
  CRISPR gRNA sequence
acttcctccattagcatggg

SEQ ID NO: 426274 - DNA, 20 bp, Artificial
  CRISPR gRNA sequence
gaggcagaggcagggcccag

SEQ ID NO: 426275 - DNA, 20 bp, Artificial
  CRISPR gRNA sequence
tctttccagagatcctcatt

SEQ ID NO: 426276 - DNA, 20 bp, Artificial
  CRISPR gRNA sequence
tcctcctctactatcaagat

SEQ ID NO: 426277 - DNA, 20 bp, Artificial
  CRISPR gRNA sequence
ctttggcatagaaaatttac

SEQ ID NO: 426278 - DNA, 20 bp, Artificial
  CRISPR gRNA sequence
aaagtcctgtccctcttaca

SEQ ID NO: 426279 - DNA, 20 bp, Artificial
  CRISPR gRNA sequence
tcttttaaatgctgccaagg

SEQ ID NO: 426280 - DNA, 20 bp, Artificial
  CRISPR gRNA sequence
ttagagtcagtgcaccagct

SEQ ID NO: 426281 - DNA, 20 bp, Artificial
  CRISPR gRNA sequence
tctcatttcaccaccagtca

SEQ ID NO: 426282 - DNA, 20 bp, Artificial
  CRISPR gRNA sequence
ctaggactattcccagcagc

SEQ ID NO: 426283 - DNA, 20 bp, Artificial
  CRISPR gRNA sequence
tagatagatagatagatgag

SEQ ID NO: 426284 - DNA, 20 bp, Artificial
  CRISPR gRNA sequence
tttgttaggggaatttgttc

SEQ ID NO: 426285 - DNA, 20 bp, Artificial
  CRISPR gRNA sequence
gaaaacccagggtcaggagc

SEQ ID NO: 426286 - DNA, 20 bp, Artificial
  CRISPR gRNA sequence
aaagtacaattttgcctctc

SEQ ID NO: 426287 - DNA, 20 bp, Artificial
  CRISPR gRNA sequence
caggcctccaggtgagtgga

SEQ ID NO: 426288 - DNA, 20 bp, Artificial
  CRISPR gRNA sequence
ccctcacagacacacccaaa

SEQ ID NO: 426289 - DNA, 20 bp, Artificial
  CRISPR gRNA sequence
ttctttggaatcagacagtc

SEQ ID NO: 426290 - DNA, 20 bp, Artificial
  CRISPR gRNA sequence
accacctaactttgatgaac

SEQ ID NO: 426291 - DNA, 20 bp, Artificial
  CRISPR gRNA sequence
gtgagtgggaccatcacaag

SEQ ID NO: 426292 - DNA, 20 bp, Artificial
  CRISPR gRNA sequence
gtttttgggatcatcacaag

SEQ ID NO: 426293 - DNA, 20 bp, Artificial
  CRISPR gRNA sequence
agggatgttttggggatcat

SEQ ID NO: 426294 - DNA, 20 bp, Artificial
  CRISPR gRNA sequence
tatgaggaatgtagtgaaat

SEQ ID NO: 426295 - DNA, 20 bp, Artificial
  CRISPR gRNA sequence
tatatacagtggagccattg

SEQ ID NO: 426296 - DNA, 20 bp, Artificial
  CRISPR gRNA sequence
gaaatatggactgacacaac

SEQ ID NO: 426297 - DNA, 20 bp, Artificial
  CRISPR gRNA sequence
tatagagatggaaaagaggg

SEQ ID NO: 426298 - DNA, 20 bp, Artificial
  CRISPR gRNA sequence
ggagtagatttcagaactgc

SEQ ID NO: 426299 - DNA, 20 bp, Artificial
  CRISPR gRNA sequence
tgcctaggattaaaattgga

SEQ ID NO: 426300 - DNA, 20 bp, Artificial
  CRISPR gRNA sequence
aattgagttgaacattagcc

SEQ ID NO: 426301 - DNA, 20 bp, Artificial
  CRISPR gRNA sequence
gcagtgaatataggggcagg

SEQ ID NO: 426302 - DNA, 20 bp, Artificial
  CRISPR gRNA sequence
ttggggcaggaatgtgatgg

SEQ ID NO: 426303 - DNA, 20 bp, Artificial
  CRISPR gRNA sequence
tcgtttgagacaatttgagt

SEQ ID NO: 426304 - DNA, 20 bp, Artificial
  CRISPR gRNA sequence
agctcagggcagaagcctgg

SEQ ID NO: 426305 - DNA, 20 bp, Artificial
  CRISPR gRNA sequence
gaagcctgggctagtttaga

SEQ ID NO: 426306 - DNA, 20 bp, Artificial
  CRISPR gRNA sequence
ctcatgaaatcactcagaga

SEQ ID NO: 426307 - DNA, 20 bp, Artificial
  CRISPR gRNA sequence
agcagaaccctggggaaccc

SEQ ID NO: 426308 - DNA, 20 bp, Artificial
  CRISPR gRNA sequence
gagaatggaaagctgcctca

SEQ ID NO: 426309 - DNA, 20 bp, Artificial
  CRISPR gRNA sequence
cacgtggtatatgtagtaag

SEQ ID NO: 426310 - DNA, 20 bp, Artificial
  CRISPR gRNA sequence
gaattggtgttggtaagaac

SEQ ID NO: 426311 - DNA, 20 bp, Artificial
  CRISPR gRNA sequence
ggaagagagagatgtcatat

SEQ ID NO: 426312 - DNA, 20 bp, Artificial
  CRISPR gRNA sequence
acatccccacatactcactt

SEQ ID NO: 426313 - DNA, 20 bp, Artificial
  CRISPR gRNA sequence
ccccacatactcactttgta

SEQ ID NO: 426314 - DNA, 20 bp, Artificial
  CRISPR gRNA sequence
acatactcactttgtagttt

SEQ ID NO: 426315 - DNA, 20 bp, Artificial
  CRISPR gRNA sequence
gttacagaagcctgggtaac

SEQ ID NO: 426316 - DNA, 20 bp, Artificial
  CRISPR gRNA sequence
aaaattaaaaaatatcttga

SEQ ID NO: 426317 - DNA, 20 bp, Artificial
  CRISPR gRNA sequence
cttgacctggttttaaatct

SEQ ID NO: 426318 - DNA, 20 bp, Artificial
  CRISPR gRNA sequence
atggccagcattttgggcta

SEQ ID NO: 426319 - DNA, 20 bp, Artificial
  CRISPR gRNA sequence
tcctggtagcagcctctatg

SEQ ID NO: 426320 - DNA, 20 bp, Artificial
  CRISPR gRNA sequence
acaggccttcaggaagagac

SEQ ID NO: 426321 - DNA, 20 bp, Artificial
  CRISPR gRNA sequence
tttggggtgaggtagttggc

SEQ ID NO: 426322 - DNA, 20 bp, Artificial
  CRISPR gRNA sequence
gaggctagtctgggaggagc

SEQ ID NO: 426323 - DNA, 20 bp, Artificial
  CRISPR gRNA sequence
caccaagggagtcagcaaac

SEQ ID NO: 426324 - DNA, 20 bp, Artificial
  CRISPR gRNA sequence
ttattctctgggcaggcatt

SEQ ID NO: 426325 - DNA, 20 bp, Artificial
  CRISPR gRNA sequence
ctcttgagcctttgaaaaaa

SEQ ID NO: 426326 - DNA, 20 bp, Artificial
  CRISPR gRNA sequence
gtttcccactaaaaagaaaa

SEQ ID NO: 426327 - DNA, 20 bp, Artificial
  CRISPR gRNA sequence
aaggggggctgggagtgata

SEQ ID NO: 426328 - DNA, 20 bp, Artificial
  CRISPR gRNA sequence
tgctggggttggggtaactg

SEQ ID NO: 426329 - DNA, 20 bp, Artificial
  CRISPR gRNA sequence
ggggtaactgaaccgcttat

SEQ ID NO: 426330 - DNA, 20 bp, Artificial
  CRISPR gRNA sequence
tcagaggaatgagcggggag

SEQ ID NO: 426331 - DNA, 20 bp, Artificial
  CRISPR gRNA sequence
gggaggttggatttactggt

SEQ ID NO: 426332 - DNA, 20 bp, Artificial
  CRISPR gRNA sequence
tggttaaaaataaagcattg

SEQ ID NO: 426333 - DNA, 20 bp, Artificial
  CRISPR gRNA sequence
agacttagactggggttgac

SEQ ID NO: 426334 - DNA, 20 bp, Artificial
  CRISPR gRNA sequence
agacaattcaactatttctc

SEQ ID NO: 426335 - DNA, 20 bp, Artificial
  CRISPR gRNA sequence
gagctccaagtcctttggaa

SEQ ID NO: 426336 - DNA, 20 bp, Artificial
  CRISPR gRNA sequence
ttagatgaacgtaaaaatgt

SEQ ID NO: 426337 - DNA, 20 bp, Artificial
  CRISPR gRNA sequence
aaaatgttgttgtttgctgt

SEQ ID NO: 426338 - DNA, 20 bp, Artificial
  CRISPR gRNA sequence
atgtaatgacgaaaagggag

SEQ ID NO: 426339 - DNA, 20 bp, Artificial
  CRISPR gRNA sequence
atgacgaaaagggagtagtg

SEQ ID NO: 426340 - DNA, 20 bp, Artificial
  CRISPR gRNA sequence
aaatgggtcaggttactgaa

SEQ ID NO: 426341 - DNA, 20 bp, Artificial
  CRISPR gRNA sequence
ttttaaatagaactcactga

SEQ ID NO: 426342 - DNA, 20 bp, Artificial
  CRISPR gRNA sequence
ccagagaagaccatttcata

SEQ ID NO: 426343 - DNA, 20 bp, Artificial
  CRISPR gRNA sequence
catcaaccacttaagatggg

SEQ ID NO: 426344 - DNA, 20 bp, Artificial
  CRISPR gRNA sequence
tggtataagcataaaatcac

SEQ ID NO: 426345 - DNA, 20 bp, Artificial
  CRISPR gRNA sequence
cataaaatcacactagattc

SEQ ID NO: 426346 - DNA, 20 bp, Artificial
  CRISPR gRNA sequence
aataataagaatactatttc

SEQ ID NO: 426347 - DNA, 20 bp, Artificial
  CRISPR gRNA sequence
gggtgaaataaaatattaac

SEQ ID NO: 426348 - DNA, 20 bp, Artificial
  CRISPR gRNA sequence
ataaaatattaacattagtt

SEQ ID NO: 426349 - DNA, 20 bp, Artificial
  CRISPR gRNA sequence
tattaaatctccagaatcta

SEQ ID NO: 426350 - DNA, 20 bp, Artificial
  CRISPR gRNA sequence
ctccagaatctagtgtgatt

SEQ ID NO: 426351 - DNA, 20 bp, Artificial
  CRISPR gRNA sequence
ataccaattataacagcaca

SEQ ID NO: 426352 - DNA, 20 bp, Artificial
  CRISPR gRNA sequence
gtattttatcaccatcccaa

SEQ ID NO: 426353 - DNA, 20 bp, Artificial
  CRISPR gRNA sequence
accatcccaatagtgtttat

SEQ ID NO: 426354 - DNA, 20 bp, Artificial
  CRISPR gRNA sequence
gtgaattgtgttctatttcc

SEQ ID NO: 426355 - DNA, 20 bp, Artificial
  CRISPR gRNA sequence
ccaaaggacttggagctctg

SEQ ID NO: 426356 - DNA, 20 bp, Artificial
  CRISPR gRNA sequence
ctaagtcttaggaagcagga

SEQ ID NO: 426357 - DNA, 20 bp, Artificial
  CRISPR gRNA sequence
taaccatgcgcaagacacaa

SEQ ID NO: 426358 - DNA, 20 bp, Artificial
  CRISPR gRNA sequence
gaataaaagggttcgaagaa

SEQ ID NO: 426359 - DNA, 20 bp, Artificial
  CRISPR gRNA sequence
gttcgaagaagttagtttga

SEQ ID NO: 426360 - DNA, 20 bp, Artificial
  CRISPR gRNA sequence
ttggctccctgtgtgggcat

SEQ ID NO: 426361 - DNA, 20 bp, Artificial
  CRISPR gRNA sequence
gtgtgggcatgtgcgtttcc

SEQ ID NO: 426362 - DNA, 20 bp, Artificial
  CRISPR gRNA sequence
cctgcccagagaataaaatc

SEQ ID NO: 426363 - DNA, 20 bp, Artificial
  CRISPR gRNA sequence
taagttcttgagggcagata

SEQ ID NO: 426364 - DNA, 20 bp, Artificial
  CRISPR gRNA sequence
acataggatctgctcaaact

SEQ ID NO: 426365 - DNA, 20 bp, Artificial
  CRISPR gRNA sequence
gcagcactgatggagagtac

SEQ ID NO: 426366 - DNA, 20 bp, Artificial
  CRISPR gRNA sequence
tgtgaagaagctgcagttac

SEQ ID NO: 426367 - DNA, 20 bp, Artificial
  CRISPR gRNA sequence
tctccacagagcccagcagg

SEQ ID NO: 426368 - DNA, 20 bp, Artificial
  CRISPR gRNA sequence
aggtgcagcttctgcctgga

SEQ ID NO: 426369 - DNA, 20 bp, Artificial
  CRISPR gRNA sequence
gggctccattcctcctgtcc

SEQ ID NO: 426370 - DNA, 20 bp, Artificial
  CRISPR gRNA sequence
cctgaggtcaccttccacag

SEQ ID NO: 426371 - DNA, 20 bp, Artificial
  CRISPR gRNA sequence
ccttccacagaatggattct

SEQ ID NO: 426372 - DNA, 20 bp, Artificial
  CRISPR gRNA sequence
aatttctcaaccgcgttaca

SEQ ID NO: 426373 - DNA, 20 bp, Artificial
  CRISPR gRNA sequence
accttgttacttcctgttca

SEQ ID NO: 426374 - DNA, 20 bp, Artificial
  CRISPR gRNA sequence
ctgttcactaagcttagtga

SEQ ID NO: 426375 - DNA, 20 bp, Artificial
  CRISPR gRNA sequence
ttccattctctattttcttg

SEQ ID NO: 426376 - DNA, 20 bp, Artificial
  CRISPR gRNA sequence
gatcctttggcatcactctc

SEQ ID NO: 426377 - DNA, 20 bp, Artificial
  CRISPR gRNA sequence
gggttccccagggttctgct

SEQ ID NO: 426378 - DNA, 20 bp, Artificial
  CRISPR gRNA sequence
tcacgctaaacatgctctct

SEQ ID NO: 426379 - DNA, 20 bp, Artificial
  CRISPR gRNA sequence
aaatctctatctaaactagc

SEQ ID NO: 426380 - DNA, 20 bp, Artificial
  CRISPR gRNA sequence
cctgcccctatattcactgc

SEQ ID NO: 426381 - DNA, 20 bp, Artificial
  CRISPR gRNA sequence
atccatgtcttctctcacac

SEQ ID NO: 426382 - DNA, 20 bp, Artificial
  CRISPR gRNA sequence
actccacatggtcgccagca

SEQ ID NO: 426383 - DNA, 20 bp, Artificial
  CRISPR gRNA sequence
tggctccactgtatatagga

SEQ ID NO: 426384 - DNA, 20 bp, Artificial
  CRISPR gRNA sequence
tgcttaacctgagatgcaca

SEQ ID NO: 426385 - DNA, 20 bp, Artificial
  CRISPR gRNA sequence
gagatgcacagctggatttc

SEQ ID NO: 426386 - DNA, 20 bp, Artificial
  CRISPR gRNA sequence
gtgatggtcccactcacctt

SEQ ID NO: 426387 - DNA, 20 bp, Artificial
  CRISPR gRNA sequence
tacattaattattatttgac

SEQ ID NO: 426388 - DNA, 20 bp, Artificial
  CRISPR gRNA sequence
tgggacccaaacctaggact

SEQ ID NO: 426389 - DNA, 20 bp, Artificial
  CRISPR gRNA sequence
taattttaggtatcatctta

SEQ ID NO: 426390 - DNA, 20 bp, Artificial
  CRISPR gRNA sequence
cattttgggtgtgtctgtga

SEQ ID NO: 426391 - DNA, 20 bp, Artificial
  CRISPR gRNA sequence
gtctgtgagggtgtttccaa

SEQ ID NO: 426392 - DNA, 20 bp, Artificial
  CRISPR gRNA sequence
gacatcaggacaccaggctc

SEQ ID NO: 426393 - DNA, 20 bp, Artificial
  CRISPR gRNA sequence
ttaaaccagtgctcctgacc

SEQ ID NO: 426394 - DNA, 20 bp, Artificial
  CRISPR gRNA sequence
gctaccagcatcccaaggtc

SEQ ID NO: 426395 - DNA, 20 bp, Artificial
  CRISPR gRNA sequence
cagaagtaatgactgaccta

SEQ ID NO: 426396 - DNA, 20 bp, Artificial
  CRISPR gRNA sequence
ttcaaccgactctgtacaat

SEQ ID NO: 426397 - DNA, 20 bp, Artificial
  CRISPR gRNA sequence
cagctgagaccatatccatg

SEQ ID NO: 426398 - DNA, 20 bp, Artificial
  CRISPR gRNA sequence
tcttcccttagccctcccta

SEQ ID NO: 426399 - DNA, 20 bp, Artificial
  CRISPR gRNA sequence
ctagaaggcagcctgtaaga

SEQ ID NO: 426400 - DNA, 20 bp, Artificial
  CRISPR gRNA sequence
agggacaggactttaaagaa

SEQ ID NO: 426401 - DNA, 20 bp, Artificial
  CRISPR gRNA sequence
gcatttgagagccaggaacc

SEQ ID NO: 426402 - DNA, 20 bp, Artificial
  CRISPR gRNA sequence
taggcatgaattctgaaggt

SEQ ID NO: 426403 - DNA, 20 bp, Artificial
  CRISPR gRNA sequence
accctcacaagggccccagg

SEQ ID NO: 426404 - DNA, 20 bp, Artificial
  CRISPR gRNA sequence
gctgtcaatagagatgacaa

SEQ ID NO: 426405 - DNA, 20 bp, Artificial
  CRISPR gRNA sequence
actaaatcagaaatggcaaa

SEQ ID NO: 426406 - DNA, 20 bp, Artificial
  CRISPR gRNA sequence
tgggtcaaatatggcccact

SEQ ID NO: 426407 - DNA, 20 bp, Artificial
  CRISPR gRNA sequence
tttacagcccttgaactaaa

SEQ ID NO: 426408 - DNA, 20 bp, Artificial
  CRISPR gRNA sequence
aaagatggcttttatatttt

SEQ ID NO: 426409 - DNA, 20 bp, Artificial
  CRISPR gRNA sequence
aagtgtttttttaaaacaaa

SEQ ID NO: 426410 - DNA, 20 bp, Artificial
  CRISPR gRNA sequence
aatcagcagagtaaacagcc

SEQ ID NO: 426411 - DNA, 20 bp, Artificial
  CRISPR gRNA sequence
gtgaaaggggaacactttta

SEQ ID NO: 426412 - DNA, 20 bp, Artificial
  CRISPR gRNA sequence
tatgactatggaaaacagtg

SEQ ID NO: 426413 - DNA, 20 bp, Artificial
  CRISPR gRNA sequence
ttaaggaactaaaagtagaa

SEQ ID NO: 426414 - DNA, 20 bp, Artificial
  CRISPR gRNA sequence
attatatgaaattaacattt

SEQ ID NO: 426415 - DNA, 20 bp, Artificial
  CRISPR gRNA sequence
acattttagtgtttataaat

SEQ ID NO: 426416 - DNA, 20 bp, Artificial
  CRISPR gRNA sequence
aataatttccaaaatccaat

SEQ ID NO: 426417 - DNA, 20 bp, Artificial
  CRISPR gRNA sequence
ggggagctccagcatcattg

SEQ ID NO: 426418 - DNA, 20 bp, Artificial
  CRISPR gRNA sequence
taggctagggctaaaatagg

SEQ ID NO: 426419 - DNA, 20 bp, Artificial
  CRISPR gRNA sequence
ataggagatgcttttacaga

SEQ ID NO: 426420 - DNA, 20 bp, Artificial
  CRISPR gRNA sequence
agctgggcagccaagaaggg

SEQ ID NO: 426421 - DNA, 20 bp, Artificial
  CRISPR gRNA sequence
gagtccccttatcctccatc

SEQ ID NO: 426422 - DNA, 20 bp, Artificial
  CRISPR gRNA sequence
attaaactgtcttcaaacaa

SEQ ID NO: 426423 - DNA, 20 bp, Artificial
  CRISPR gRNA sequence
ccctgaataatgcaactata

SEQ ID NO: 426424 - DNA, 20 bp, Artificial
  CRISPR gRNA sequence
ttcagctccttctaaagagc

SEQ ID NO: 426425 - DNA, 20 bp, Artificial
  CRISPR gRNA sequence
taaaggtagaaattacaaac

SEQ ID NO: 426426 - DNA, 20 bp, Artificial
  CRISPR gRNA sequence
atataattctttgttattta

SEQ ID NO: 426427 - DNA, 20 bp, Artificial
  CRISPR gRNA sequence
aagccgaattataatacagc

SEQ ID NO: 426428 - DNA, 20 bp, Artificial
  CRISPR gRNA sequence
attgtaatagtattaagtgg

SEQ ID NO: 426429 - DNA, 20 bp, Artificial
  CRISPR gRNA sequence
taagtggtaatgcttttaag

SEQ ID NO: 426430 - DNA, 20 bp, Artificial
  CRISPR gRNA sequence
catgaagatctgccctcatg

SEQ ID NO: 426431 - DNA, 20 bp, Artificial
  CRISPR gRNA sequence
tataaggaaatgaagacctt

SEQ ID NO: 426432 - DNA, 20 bp, Artificial
  CRISPR gRNA sequence
cataagctcttaagctaaac

SEQ ID NO: 426433 - DNA, 20 bp, Artificial
  CRISPR gRNA sequence
ccaatagcaccagccatatc

SEQ ID NO: 426434 - DNA, 20 bp, Artificial
  CRISPR gRNA sequence
ggcctaaccctacatttttg

SEQ ID NO: 426435 - DNA, 20 bp, Artificial
  CRISPR gRNA sequence
ataaattaaactctcagagc

SEQ ID NO: 426436 - DNA, 20 bp, Artificial
  CRISPR gRNA sequence
gtggcagaagccagaagtga

SEQ ID NO: 426437 - DNA, 20 bp, Artificial
  CRISPR gRNA sequence
gctgatttccccagggcagc

SEQ ID NO: 426438 - DNA, 20 bp, Artificial
  CRISPR gRNA sequence
tgagcttcacggcagagagg

SEQ ID NO: 426439 - DNA, 20 bp, Artificial
  CRISPR gRNA sequence
ccagagcaggtcattttaac

SEQ ID NO: 426440 - DNA, 20 bp, Artificial
  CRISPR gRNA sequence
ggctctggactcttatcctt

SEQ ID NO: 426441 - DNA, 20 bp, Artificial
  CRISPR gRNA sequence
gaagcaagaagatgcaggag

SEQ ID NO: 426442 - DNA, 20 bp, Artificial
  CRISPR gRNA sequence
ccatgcatgctgcgctgtag

SEQ ID NO: 426443 - DNA, 20 bp, Artificial
  CRISPR gRNA sequence
aagggtctgggttgctaaaa

SEQ ID NO: 426444 - DNA, 20 bp, Artificial
  CRISPR gRNA sequence
actcagtcacagttggccag

SEQ ID NO: 426445 - DNA, 20 bp, Artificial
  CRISPR gRNA sequence
aaaccaggaaaggatatatg

SEQ ID NO: 426446 - DNA, 20 bp, Artificial
  CRISPR gRNA sequence
atgatcagtttggggacaga

SEQ ID NO: 426447 - DNA, 20 bp, Artificial
  CRISPR gRNA sequence
agatggagtgaaaagcatgt

SEQ ID NO: 426448 - DNA, 20 bp, Artificial
  CRISPR gRNA sequence
aaaagcatgttgaggtttag

SEQ ID NO: 426449 - DNA, 20 bp, Artificial
  CRISPR gRNA sequence
gtttagggaagattatgata

SEQ ID NO: 426450 - DNA, 20 bp, Artificial
  CRISPR gRNA sequence
gattatgataatgagtttgg

SEQ ID NO: 426451 - DNA, 20 bp, Artificial
  CRISPR gRNA sequence
tatcaatttcatttggaatt

SEQ ID NO: 426452 - DNA, 20 bp, Artificial
  CRISPR gRNA sequence
attttagcattaaggttagg

SEQ ID NO: 426453 - DNA, 20 bp, Artificial
  CRISPR gRNA sequence
attaggatagggacttggac

SEQ ID NO: 426454 - DNA, 20 bp, Artificial
  CRISPR gRNA sequence
atagggacttggactaaggt

SEQ ID NO: 426455 - DNA, 20 bp, Artificial
  CRISPR gRNA sequence
gattaggttcaaaaagaagc

SEQ ID NO: 426456 - DNA, 20 bp, Artificial
  CRISPR gRNA sequence
tgctaatgcaagtaattaag

SEQ ID NO: 426457 - DNA, 20 bp, Artificial
  CRISPR gRNA sequence
tggcaaaagggtggaaacat

SEQ ID NO: 426458 - DNA, 20 bp, Artificial
  CRISPR gRNA sequence
tctccatgaatggcctggcc

SEQ ID NO: 426459 - DNA, 20 bp, Artificial
  CRISPR gRNA sequence
gccagaatctaggtcccctg

SEQ ID NO: 426460 - DNA, 20 bp, Artificial
  CRISPR gRNA sequence
aaaaactagcccttatgaag

SEQ ID NO: 426461 - DNA, 20 bp, Artificial
  CRISPR gRNA sequence
agcctcaactcttaaccagt

SEQ ID NO: 426462 - DNA, 20 bp, Artificial
  CRISPR gRNA sequence
cgggcagatcactggaggtc

SEQ ID NO: 426463 - DNA, 20 bp, Artificial
  CRISPR gRNA sequence
aggaggctgaggcaggagag

SEQ ID NO: 426464 - DNA, 20 bp, Artificial
  CRISPR gRNA sequence
gaggcggaagttgcagtgag

SEQ ID NO: 426465 - DNA, 20 bp, Artificial
  CRISPR gRNA sequence
ttaaggtaaccttttatctt

SEQ ID NO: 426466 - DNA, 20 bp, Artificial
  CRISPR gRNA sequence
gtaaataggagttctgagga

SEQ ID NO: 426467 - DNA, 20 bp, Artificial
  CRISPR gRNA sequence
cactctgagcaactccaagc

SEQ ID NO: 426468 - DNA, 20 bp, Artificial
  CRISPR gRNA sequence
gtctgagggcaacagcagag

SEQ ID NO: 426469 - DNA, 20 bp, Artificial
  CRISPR gRNA sequence
agactgtctggtgtcagagt

SEQ ID NO: 426470 - DNA, 20 bp, Artificial
  CRISPR gRNA sequence
tccttttctaacctctggga

SEQ ID NO: 426471 - DNA, 20 bp, Artificial
  CRISPR gRNA sequence
acaattaaacttagcacagg

SEQ ID NO: 426472 - DNA, 20 bp, Artificial
  CRISPR gRNA sequence
tcctaggaaatataggtaag

SEQ ID NO: 426473 - DNA, 20 bp, Artificial
  CRISPR gRNA sequence
tgcccattagaatcacctgg

SEQ ID NO: 426474 - DNA, 20 bp, Artificial
  CRISPR gRNA sequence
gaaatgcttttagaccttac

SEQ ID NO: 426475 - DNA, 20 bp, Artificial
  CRISPR gRNA sequence
cccttgtttagctctgctat

SEQ ID NO: 426476 - DNA, 20 bp, Artificial
  CRISPR gRNA sequence
tttagctctgctattaggga

SEQ ID NO: 426477 - DNA, 20 bp, Artificial
  CRISPR gRNA sequence
tgggtgaggcctcggcatca

SEQ ID NO: 426478 - DNA, 20 bp, Artificial
  CRISPR gRNA sequence
gtatgatttaaaatctcctc

SEQ ID NO: 426479 - DNA, 20 bp, Artificial
  CRISPR gRNA sequence
aattgagaagccctgctgtg

SEQ ID NO: 426480 - DNA, 20 bp, Artificial
  CRISPR gRNA sequence
aagccctgctgtgcagtgtt

SEQ ID NO: 426481 - DNA, 20 bp, Artificial
  CRISPR gRNA sequence
gcattttctatgctagaggg

SEQ ID NO: 426482 - DNA, 20 bp, Artificial
  CRISPR gRNA sequence
acttgctccagcaggaatac

SEQ ID NO: 426483 - DNA, 20 bp, Artificial
  CRISPR gRNA sequence
tgagctttctaggacctcca

SEQ ID NO: 426484 - DNA, 20 bp, Artificial
  CRISPR gRNA sequence
ttctctgcagaaatgttccc

SEQ ID NO: 426485 - DNA, 20 bp, Artificial
  CRISPR gRNA sequence
taagggcctttgaggcccca

SEQ ID NO: 426486 - DNA, 20 bp, Artificial
  CRISPR gRNA sequence
ccccaactggattttggaat

SEQ ID NO: 426487 - DNA, 20 bp, Artificial
  CRISPR gRNA sequence
ccatagaggctgtaattatt

SEQ ID NO: 426488 - DNA, 20 bp, Artificial
  CRISPR gRNA sequence
tctcctccccacccactgcc

SEQ ID NO: 426489 - DNA, 20 bp, Artificial
  CRISPR gRNA sequence
tctttacacctcgcccacag

SEQ ID NO: 426490 - DNA, 20 bp, Artificial
  CRISPR gRNA sequence
aattagcaccttactaaatg

SEQ ID NO: 426491 - DNA, 20 bp, Artificial
  CRISPR gRNA sequence
ccccctcgcatattctgcta

SEQ ID NO: 426492 - DNA, 20 bp, Artificial
  CRISPR gRNA sequence
ttctgctatgtagcttcatg

SEQ ID NO: 426493 - DNA, 20 bp, Artificial
  CRISPR gRNA sequence
ttgtcagctgataccacctc

SEQ ID NO: 426494 - DNA, 20 bp, Artificial
  CRISPR gRNA sequence
taccacctcttctgttttta

SEQ ID NO: 426495 - DNA, 20 bp, Artificial
  CRISPR gRNA sequence
cctcttctgtttttattttg

SEQ ID NO: 426496 - DNA, 20 bp, Artificial
  CRISPR gRNA sequence
gtttttattttgttttgttt

SEQ ID NO: 426497 - DNA, 20 bp, Artificial
  CRISPR gRNA sequence
tatcctttgaaataaaacct

SEQ ID NO: 426498 - DNA, 20 bp, Artificial
  CRISPR gRNA sequence
gaaataaaaccttgctgttt

SEQ ID NO: 426499 - DNA, 20 bp, Artificial
  CRISPR gRNA sequence
ccaagaaatccaatagcaaa

SEQ ID NO: 426500 - DNA, 20 bp, Artificial
  CRISPR gRNA sequence
aaaggaagcttagcaggaaa

SEQ ID NO: 426501 - DNA, 20 bp, Artificial
  CRISPR gRNA sequence
acataaaaactaatttatac

SEQ ID NO: 426502 - DNA, 20 bp, Artificial
  CRISPR gRNA sequence
cctccctcagaaatatttga

SEQ ID NO: 426503 - DNA, 20 bp, Artificial
  CRISPR gRNA sequence
ttcaattcacagagaactta

SEQ ID NO: 426504 - DNA, 20 bp, Artificial
  CRISPR gRNA sequence
gaaaagaagctggagcagga

SEQ ID NO: 426505 - DNA, 20 bp, Artificial
  CRISPR gRNA sequence
acagaaccccacctcattct

SEQ ID NO: 426506 - DNA, 20 bp, Artificial
  CRISPR gRNA sequence
acaagcacccaagtctccaa

SEQ ID NO: 426507 - DNA, 20 bp, Artificial
  CRISPR gRNA sequence
aagtctccaaccaagcttag

SEQ ID NO: 426508 - DNA, 20 bp, Artificial
  CRISPR gRNA sequence
ttttcctccctgctgctctg

SEQ ID NO: 426509 - DNA, 20 bp, Artificial
  CRISPR gRNA sequence
gatcaggaggagacaccagc

SEQ ID NO: 426510 - DNA, 20 bp, Artificial
  CRISPR gRNA sequence
aaaagacggtctcggaaaaa

SEQ ID NO: 426511 - DNA, 20 bp, Artificial
  CRISPR gRNA sequence
gagcatgccacagctgcttg

SEQ ID NO: 426512 - DNA, 20 bp, Artificial
  CRISPR gRNA sequence
atgccacagctgcttgagag

SEQ ID NO: 426513 - DNA, 20 bp, Artificial
  CRISPR gRNA sequence
gagtcctgtgtactcttatt

SEQ ID NO: 426514 - DNA, 20 bp, Artificial
  CRISPR gRNA sequence
atttaagaaaggacaatctc

SEQ ID NO: 426515 - DNA, 20 bp, Artificial
  CRISPR gRNA sequence
agcatagaactaggccgcag

SEQ ID NO: 426516 - DNA, 20 bp, Artificial
  CRISPR gRNA sequence
gctggccatgaagctacata

SEQ ID NO: 426517 - DNA, 20 bp, Artificial
  CRISPR gRNA sequence
gaggagcgtctcttgaaatg

SEQ ID NO: 426518 - DNA, 20 bp, Artificial
  CRISPR gRNA sequence
gaggagcaacaggatggact

SEQ ID NO: 426519 - DNA, 20 bp, Artificial
  CRISPR gRNA sequence
agttggggcctcaaaggccc

SEQ ID NO: 426520 - DNA, 20 bp, Artificial
  CRISPR gRNA sequence
taggaatgatgacaggcaca

SEQ ID NO: 426521 - DNA, 20 bp, Artificial
  CRISPR gRNA sequence
acaacggggaacatttctgc

SEQ ID NO: 426522 - DNA, 20 bp, Artificial
  CRISPR gRNA sequence
ccctgatgggacgtacactg

SEQ ID NO: 426523 - DNA, 20 bp, Artificial
  CRISPR gRNA sequence
ggagaatcttcctggaggtc

SEQ ID NO: 426524 - DNA, 20 bp, Artificial
  CRISPR gRNA sequence
gataaacctctccctctagc

SEQ ID NO: 426525 - DNA, 20 bp, Artificial
  CRISPR gRNA sequence
cctcacccagaccaattcaa

SEQ ID NO: 426526 - DNA, 20 bp, Artificial
  CRISPR gRNA sequence
gtttagtataattgtgcaaa

SEQ ID NO: 426527 - DNA, 20 bp, Artificial
  CRISPR gRNA sequence
tttaaaccaattcccagagg

SEQ ID NO: 426528 - DNA, 20 bp, Artificial
  CRISPR gRNA sequence
taggattaaattccctacta

SEQ ID NO: 426529 - DNA, 20 bp, Artificial
  CRISPR gRNA sequence
attcgctatgtgtcagatgc

SEQ ID NO: 426530 - DNA, 20 bp, Artificial
  CRISPR gRNA sequence
ttcatatttgaagttcaata

SEQ ID NO: 426531 - DNA, 20 bp, Artificial
  CRISPR gRNA sequence
aaaaatgattttgtcaaata

SEQ ID NO: 426532 - DNA, 20 bp, Artificial
  CRISPR gRNA sequence
catcgtggtggtcgcgttga

SEQ ID NO: 426533 - DNA, 20 bp, Artificial
  CRISPR gRNA sequence
ctaggttacccagcatgtct

SEQ ID NO: 426534 - DNA, 20 bp, Artificial
  CRISPR gRNA sequence
tacccagcatgtctgtagaa

SEQ ID NO: 426535 - DNA, 20 bp, Artificial
  CRISPR gRNA sequence
gtctattttctgccgctgta

SEQ ID NO: 426536 - DNA, 20 bp, Artificial
  CRISPR gRNA sequence
acaattattgggaaatttat

SEQ ID NO: 426537 - DNA, 20 bp, Artificial
  CRISPR gRNA sequence
tgcatgcatgtgagagagag

SEQ ID NO: 426538 - DNA, 20 bp, Artificial
  CRISPR gRNA sequence
gtaaaatctttataaataac

SEQ ID NO: 426539 - DNA, 20 bp, Artificial
  CRISPR gRNA sequence
ggtattgattgggaggagtg

SEQ ID NO: 426540 - DNA, 20 bp, Artificial
  CRISPR gRNA sequence
tctatgggaaggtgaggaca

SEQ ID NO: 426541 - DNA, 20 bp, Artificial
  CRISPR gRNA sequence
tgtcctgatggtctggaata

SEQ ID NO: 426542 - DNA, 20 bp, Artificial
  CRISPR gRNA sequence
actttggtcatctggagggt

SEQ ID NO: 426543 - DNA, 20 bp, Artificial
  CRISPR gRNA sequence
gtcatctggagggtagagaa

SEQ ID NO: 426544 - DNA, 20 bp, Artificial
  CRISPR gRNA sequence
aaccagtccaaggccaccct

SEQ ID NO: 426545 - DNA, 20 bp, Artificial
  CRISPR gRNA sequence
tagtacagtcttcatagggc

SEQ ID NO: 426546 - DNA, 20 bp, Artificial
  CRISPR gRNA sequence
ggatgttctctggatcttcc

SEQ ID NO: 426547 - DNA, 20 bp, Artificial
  CRISPR gRNA sequence
gccatttgtatatccttttc

SEQ ID NO: 426548 - DNA, 20 bp, Artificial
  CRISPR gRNA sequence
tctctattgacagcagtata

SEQ ID NO: 426549 - DNA, 20 bp, Artificial
  CRISPR gRNA sequence
cctaccacaatccatcacct

SEQ ID NO: 426550 - DNA, 20 bp, Artificial
  CRISPR gRNA sequence
atcaagatgctagctttggc

SEQ ID NO: 426551 - DNA, 20 bp, Artificial
  CRISPR gRNA sequence
catagaaaatttacctaggc

SEQ ID NO: 426552 - DNA, 20 bp, Artificial
  CRISPR gRNA sequence
cagtatagggagggctaagg

SEQ ID NO: 426553 - DNA, 20 bp, Artificial
  CRISPR gRNA sequence
agctggagacttggctgaag

SEQ ID NO: 426554 - DNA, 20 bp, Artificial
  CRISPR gRNA sequence
agtgtgtcccaactccaaag

SEQ ID NO: 426555 - DNA, 20 bp, Artificial
  CRISPR gRNA sequence
gcattgccttcataaggtca

SEQ ID NO: 426556 - DNA, 20 bp, Artificial
  CRISPR gRNA sequence
gagccattgaagagttttag

SEQ ID NO: 426557 - DNA, 20 bp, Artificial
  CRISPR gRNA sequence
acagatggtggttgtagatg

SEQ ID NO: 426558 - DNA, 20 bp, Artificial
  CRISPR gRNA sequence
cagagagcatgtttagcgtg

SEQ ID NO: 426559 - DNA, 20 bp, Artificial
  CRISPR gRNA sequence
tttggggagctgatgtgcaa

SEQ ID NO: 426560 - DNA, 20 bp, Artificial
  CRISPR gRNA sequence
ggtgggggttcaaaggagga

SEQ ID NO: 426561 - DNA, 20 bp, Artificial
  CRISPR gRNA sequence
agagtgatgccaaaggatcc

SEQ ID NO: 426562 - DNA, 20 bp, Artificial
  CRISPR gRNA sequence
atccagagaaagagaacatt

SEQ ID NO: 426563 - DNA, 20 bp, Artificial
  CRISPR gRNA sequence
gtcaagtgcagtaaacagta

SEQ ID NO: 426564 - DNA, 20 bp, Artificial
  CRISPR gRNA sequence
agtaaacagtacaagaaaat

SEQ ID NO: 426565 - DNA, 20 bp, Artificial
  CRISPR gRNA sequence
aaatctagctgtaacgcggt

SEQ ID NO: 426566 - DNA, 20 bp, Artificial
  CRISPR gRNA sequence
tttgctggtgtgcatgtgtg

SEQ ID NO: 426567 - DNA, 20 bp, Artificial
  CRISPR gRNA sequence
ttgtagtttgtttgttttta

SEQ ID NO: 426568 - DNA, 20 bp, Artificial
  CRISPR gRNA sequence
ttgtttttagaagaaagccc

SEQ ID NO: 426569 - DNA, 20 bp, Artificial
  CRISPR gRNA sequence
ttctgtggaaggtgacctca

SEQ ID NO: 426570 - DNA, 20 bp, Artificial
  CRISPR gRNA sequence
aaaagaacgtttcccactaa

SEQ ID NO: 426571 - DNA, 20 bp, Artificial
  CRISPR gRNA sequence
tcatgggccaaggaactgaa

SEQ ID NO: 426572 - DNA, 20 bp, Artificial
  CRISPR gRNA sequence
ctaccaaatgggttacatag

SEQ ID NO: 426573 - DNA, 20 bp, Artificial
  CRISPR gRNA sequence
ccagagctccaagtcctttg

SEQ ID NO: 426574 - DNA, 20 bp, Artificial
  CRISPR gRNA sequence
tacaaaagggcctatagatg

SEQ ID NO: 426575 - DNA, 20 bp, Artificial
  CRISPR gRNA sequence
tggagatttaatatgaataa

SEQ ID NO: 426576 - DNA, 20 bp, Artificial
  CRISPR gRNA sequence
tactagagcagcacagtcac

SEQ ID NO: 426577 - DNA, 20 bp, Artificial
  CRISPR gRNA sequence
ttattattcatattaaatct

SEQ ID NO: 426578 - DNA, 20 bp, Artificial
  CRISPR gRNA sequence
ggtcttctctggttctcaga

SEQ ID NO: 426579 - DNA, 20 bp, Artificial
  CRISPR gRNA sequence
acagatttgcactaattttg

SEQ ID NO: 426580 - DNA, 20 bp, Artificial
  CRISPR gRNA sequence
cttcctatgtaacccatttg

SEQ ID NO: 426581 - DNA, 20 bp, Artificial
  CRISPR gRNA sequence
taataataataaaaatccta

SEQ ID NO: 426582 - DNA, 20 bp, Artificial
  CRISPR gRNA sequence
tttcagttccttggcccatg

SEQ ID NO: 426583 - DNA, 20 bp, Artificial
  CRISPR gRNA sequence
tccagcctgaatgcaattaa

SEQ ID NO: 426584 - DNA, 20 bp, Artificial
  CRISPR gRNA sequence
aggctcaagagtgtattgat

SEQ ID NO: 426585 - DNA, 20 bp, Artificial
  CRISPR gRNA sequence
gaaacttgaaatgcctgccc

SEQ ID NO: 426586 - DNA, 20 bp, Artificial
  CRISPR gRNA sequence
ctttgtgggactttcagctc

SEQ ID NO: 426587 - DNA, 20 bp, Artificial
  CRISPR gRNA sequence
ttctcctgaggtcaccttcc

SEQ ID NO: 426588 - DNA, 20 bp, Artificial
  CRISPR gRNA sequence
tggtttatggcaccagctga

SEQ ID NO: 426589 - DNA, 20 bp, Artificial
  CRISPR gRNA sequence
tcaggggatttgtaaattgt

SEQ ID NO: 426590 - DNA, 20 bp, Artificial
  CRISPR gRNA sequence
gtatagaaaattttgcccaa

SEQ ID NO: 426591 - DNA, 20 bp, Artificial
  CRISPR gRNA sequence
taatttcactacattcctca

SEQ ID NO: 426592 - DNA, 20 bp, Artificial
  CRISPR gRNA sequence
aattatcggcattttacaga

SEQ ID NO: 426593 - DNA, 20 bp, Artificial
  CRISPR gRNA sequence
tcaggcccttagccttggac

SEQ ID NO: 426594 - DNA, 20 bp, Artificial
  CRISPR gRNA sequence
ctcacagcagccccttctct

SEQ ID NO: 426595 - DNA, 20 bp, Artificial
  CRISPR gRNA sequence
attgcaccgatggactgaag

SEQ ID NO: 426596 - DNA, 20 bp, Artificial
  CRISPR gRNA sequence
gcccacttccccttgatgga

SEQ ID NO: 426597 - DNA, 20 bp, Artificial
  CRISPR gRNA sequence
aggaagtgctgggtctgcta

SEQ ID NO: 426598 - DNA, 20 bp, Artificial
  CRISPR gRNA sequence
gtgctgggtctgctaagaga

SEQ ID NO: 426599 - DNA, 20 bp, Artificial
  CRISPR gRNA sequence
aaaaggggaacaaaatgctc

SEQ ID NO: 426600 - DNA, 20 bp, Artificial
  CRISPR gRNA sequence
cagagaataaacctactaaa

SEQ ID NO: 426601 - DNA, 20 bp, Artificial
  CRISPR gRNA sequence
gtaatatcttctgcacagca

SEQ ID NO: 426602 - DNA, 20 bp, Artificial
  CRISPR gRNA sequence
agtaaacagcccacagattg

SEQ ID NO: 426603 - DNA, 20 bp, Artificial
  CRISPR gRNA sequence
atccaacaaaggactaatat

SEQ ID NO: 426604 - DNA, 20 bp, Artificial
  CRISPR gRNA sequence
aggacataaaaagacaattc

SEQ ID NO: 426605 - DNA, 20 bp, Artificial
  CRISPR gRNA sequence
acaataccaccttactcttg

SEQ ID NO: 426606 - DNA, 20 bp, Artificial
  CRISPR gRNA sequence
ccatcaatcaatgagtggat

SEQ ID NO: 426607 - DNA, 20 bp, Artificial
  CRISPR gRNA sequence
ctatgaggacgcaaaggcgt

SEQ ID NO: 426608 - DNA, 20 bp, Artificial
  CRISPR gRNA sequence
gtgatgggtgcaccaaaatc

SEQ ID NO: 426609 - DNA, 20 bp, Artificial
  CRISPR gRNA sequence
aaattaaaacataaaaattt

SEQ ID NO: 426610 - DNA, 20 bp, Artificial
  CRISPR gRNA sequence
taaaacataaaaatttatag

SEQ ID NO: 426611 - DNA, 20 bp, Artificial
  CRISPR gRNA sequence
tatactatctgcctctttac

SEQ ID NO: 426612 - DNA, 20 bp, Artificial
  CRISPR gRNA sequence
caataaaggggaaaaaggaa

SEQ ID NO: 426613 - DNA, 20 bp, Artificial
  CRISPR gRNA sequence
aggggaaaaaggaaaaagaa

SEQ ID NO: 426614 - DNA, 20 bp, Artificial
  CRISPR gRNA sequence
atcccttttactaagctgga

SEQ ID NO: 426615 - DNA, 20 bp, Artificial
  CRISPR gRNA sequence
cagaacagatagcagcactt

SEQ ID NO: 426616 - DNA, 20 bp, Artificial
  CRISPR gRNA sequence
gtaattacttcaatgggagc

SEQ ID NO: 426617 - DNA, 20 bp, Artificial
  CRISPR gRNA sequence
gggctggggaatcaaacact

SEQ ID NO: 426618 - DNA, 20 bp, Artificial
  CRISPR gRNA sequence
accaaagttagtccaggtgc

SEQ ID NO: 426619 - DNA, 20 bp, Artificial
  CRISPR gRNA sequence
gtggagggtctggggtaaag

SEQ ID NO: 426620 - DNA, 20 bp, Artificial
  CRISPR gRNA sequence
aattgtattctgttacagcg

SEQ ID NO: 426621 - DNA, 20 bp, Artificial
  CRISPR gRNA sequence
gcatacactcagtgccaaaa

SEQ ID NO: 426622 - DNA, 20 bp, Artificial
  CRISPR gRNA sequence
ataatcaaaagagctaatgt

SEQ ID NO: 426623 - DNA, 20 bp, Artificial
  CRISPR gRNA sequence
agcagtggcttaagggataa

SEQ ID NO: 426624 - DNA, 20 bp, Artificial
  CRISPR gRNA sequence
aaatgaaacaaatagtagtt

SEQ ID NO: 426625 - DNA, 20 bp, Artificial
  CRISPR gRNA sequence
tagtagttccagaaaaaaac

SEQ ID NO: 426626 - DNA, 20 bp, Artificial
  CRISPR gRNA sequence
atgagtaagatctgacccaa

SEQ ID NO: 426627 - DNA, 20 bp, Artificial
  CRISPR gRNA sequence
gatctgacccaagaagaatg

SEQ ID NO: 426628 - DNA, 20 bp, Artificial
  CRISPR gRNA sequence
aggggtccatgagccacaga

SEQ ID NO: 426629 - DNA, 20 bp, Artificial
  CRISPR gRNA sequence
atgacactggggtaaagagc

SEQ ID NO: 426630 - DNA, 20 bp, Artificial
  CRISPR gRNA sequence
gccatcacttggttactttg

SEQ ID NO: 426631 - DNA, 20 bp, Artificial
  CRISPR gRNA sequence
tatttgccacattttatcga

SEQ ID NO: 426632 - DNA, 20 bp, Artificial
  CRISPR gRNA sequence
cattttatcgacaagaaaac

SEQ ID NO: 426633 - DNA, 20 bp, Artificial
  CRISPR gRNA sequence
gagaccagcctgaccaacgt

SEQ ID NO: 426634 - DNA, 20 bp, Artificial
  CRISPR gRNA sequence
actcaggaggctgaggcagg

SEQ ID NO: 426635 - DNA, 20 bp, Artificial
  CRISPR gRNA sequence
attcatcctcctttcacaga

SEQ ID NO: 426636 - DNA, 20 bp, Artificial
  CRISPR gRNA sequence
aaactgatacacagagaagc

SEQ ID NO: 426637 - DNA, 20 bp, Artificial
  CRISPR gRNA sequence
atactgtctctcagataaga

SEQ ID NO: 426638 - DNA, 20 bp, Artificial
  CRISPR gRNA sequence
ttctcagtattggctgccca

SEQ ID NO: 426639 - DNA, 20 bp, Artificial
  CRISPR gRNA sequence
tgatagagccacctttctct

SEQ ID NO: 426640 - DNA, 20 bp, Artificial
  CRISPR gRNA sequence
gcagctggccttcaaccttc

SEQ ID NO: 426641 - DNA, 20 bp, Artificial
  CRISPR gRNA sequence
ggcctattttgtctacccac

SEQ ID NO: 426642 - DNA, 20 bp, Artificial
  CRISPR gRNA sequence
gaaaaaaccttcaggaaagc

SEQ ID NO: 426643 - DNA, 20 bp, Artificial
  CRISPR gRNA sequence
aatatttgtgttcccctccc

SEQ ID NO: 426644 - DNA, 20 bp, Artificial
  CRISPR gRNA sequence
tgactctgatttttaatata

SEQ ID NO: 426645 - DNA, 20 bp, Artificial
  CRISPR gRNA sequence
tggaaagttcctgaaaggca

SEQ ID NO: 426646 - DNA, 20 bp, Artificial
  CRISPR gRNA sequence
ggacggtaaaactgagcctc

SEQ ID NO: 426647 - DNA, 20 bp, Artificial
  CRISPR gRNA sequence
ccagcagagcagcagggagg

SEQ ID NO: 426648 - DNA, 20 bp, Artificial
  CRISPR gRNA sequence
gcctttcaggaactttccag

SEQ ID NO: 426649 - DNA, 20 bp, Artificial
  CRISPR gRNA sequence
ggaggggaacacaaatattt

SEQ ID NO: 426650 - DNA, 20 bp, Artificial
  CRISPR gRNA sequence
taggccgcaggaagaaacat

SEQ ID NO: 426651 - DNA, 20 bp, Artificial
  CRISPR gRNA sequence
cgcaggaagaaacataaaaa

SEQ ID NO: 426652 - DNA, 20 bp, Artificial
  CRISPR gRNA sequence
acataaaaacaaaacaaaat

SEQ ID NO: 426653 - DNA, 20 bp, Artificial
  CRISPR gRNA sequence
tataaagagtagagctggtt

SEQ ID NO: 426654 - DNA, 20 bp, Artificial
  CRISPR gRNA sequence
tcagatcttactcatctctt

SEQ ID NO: 426655 - DNA, 20 bp, Artificial
  CRISPR gRNA sequence
cgctatgtgtcagatgctga

SEQ ID NO: 426656 - DNA, 20 bp, Artificial
  CRISPR gRNA sequence
tggccttttgggggacacat

SEQ ID NO: 426657 - DNA, 20 bp, Artificial
  CRISPR gRNA sequence
gtgcagaagatattactttt

SEQ ID NO: 426658 - DNA, 20 bp, Artificial
  CRISPR gRNA sequence
taaaactatttttgttttaa

SEQ ID NO: 426659 - DNA, 20 bp, Artificial
  CRISPR gRNA sequence
tctttagttcaagggctgta

SEQ ID NO: 426660 - DNA, 20 bp, Artificial
  CRISPR gRNA sequence
agtgggccatatttgaccca

SEQ ID NO: 426661 - DNA, 20 bp, Artificial
  CRISPR gRNA sequence
cagtccaaggctaagggcct

SEQ ID NO: 426662 - DNA, 20 bp, Artificial
  CRISPR gRNA sequence
ttgccttcataaggtcatga

SEQ ID NO: 426663 - DNA, 20 bp, Artificial
  CRISPR gRNA sequence
atttttgacacacaatatac

SEQ ID NO: 426664 - DNA, 20 bp, Artificial
  CRISPR gRNA sequence
aatatacacctcctccaaat

SEQ ID NO: 426665 - DNA, 20 bp, Artificial
  CRISPR gRNA sequence
tagttgaattgtcttgttgc

SEQ ID NO: 426666 - DNA, 20 bp, Artificial
  CRISPR gRNA sequence
tttcctacaagttccctaga

SEQ ID NO: 426667 - DNA, 20 bp, Artificial
  CRISPR gRNA sequence
gccatcctcatcatcaacca

SEQ ID NO: 426668 - DNA, 20 bp, Artificial
  CRISPR gRNA sequence
tctgctcaaactgccagatt

SEQ ID NO: 426669 - DNA, 20 bp, Artificial
  CRISPR gRNA sequence
gattctgagggctttcttct

SEQ ID NO: 426670 - DNA, 20 bp, Artificial
  CRISPR gRNA sequence
tgttcaactcaatttatctg

SEQ ID NO: 426671 - DNA, 20 bp, Artificial
  CRISPR gRNA sequence
tcgccagcagagtgattttc

SEQ ID NO: 426672 - DNA, 20 bp, Artificial
  CRISPR gRNA sequence
tgtcagtccatatttctgcc

SEQ ID NO: 426673 - DNA, 20 bp, Artificial
  CRISPR gRNA sequence
taagaaactgtgatgatccc

SEQ ID NO: 426674 - DNA, 20 bp, Artificial
  CRISPR gRNA sequence
acatcccttgtgatgatccc

SEQ ID NO: 426675 - DNA, 20 bp, Artificial
  CRISPR gRNA sequence
tatcggcattttacagatga

SEQ ID NO: 426676 - DNA, 20 bp, Artificial
  CRISPR gRNA sequence
acctggaggcctgcctttcc

SEQ ID NO: 426677 - DNA, 20 bp, Artificial
  CRISPR gRNA sequence
ctatttccggggacctgatc

SEQ ID NO: 426678 - DNA, 20 bp, Artificial
  CRISPR gRNA sequence
ttatattttaagtgtttttt

SEQ ID NO: 426679 - DNA, 20 bp, Artificial
  CRISPR gRNA sequence
attatcagggaaacgcaaat

SEQ ID NO: 426680 - DNA, 20 bp, Artificial
  CRISPR gRNA sequence
tgtaaactagtatgactatg

SEQ ID NO: 426681 - DNA, 20 bp, Artificial
  CRISPR gRNA sequence
agtgaagtaactcaggaatg

SEQ ID NO: 426682 - DNA, 20 bp, Artificial
  CRISPR gRNA sequence
cactaaaggacttattcccc

SEQ ID NO: 426683 - DNA, 20 bp, Artificial
  CRISPR gRNA sequence
ataaaaaatatataaaaaat

SEQ ID NO: 426684 - DNA, 20 bp, Artificial
  CRISPR gRNA sequence
acataaaaatttatagaaag

SEQ ID NO: 426685 - DNA, 20 bp, Artificial
  CRISPR gRNA sequence
aaagggcccaagagatcaga

SEQ ID NO: 426686 - DNA, 20 bp, Artificial
  CRISPR gRNA sequence
taaaagcatacactcagtgc

SEQ ID NO: 426687 - DNA, 20 bp, Artificial
  CRISPR gRNA sequence
ctcagccactagagggagga

SEQ ID NO: 426688 - DNA, 20 bp, Artificial
  CRISPR gRNA sequence
aacaaatagtagttccagaa

SEQ ID NO: 426689 - DNA, 20 bp, Artificial
  CRISPR gRNA sequence
gggctgcagagggctatcca

SEQ ID NO: 426690 - DNA, 20 bp, Artificial
  CRISPR gRNA sequence
gactctgtataagggttact

SEQ ID NO: 426691 - DNA, 20 bp, Artificial
  CRISPR gRNA sequence
catgaaccaataaatagcat

SEQ ID NO: 426692 - DNA, 20 bp, Artificial
  CRISPR gRNA sequence
ttgccacattttatcgacaa

SEQ ID NO: 426693 - DNA, 20 bp, Artificial
  CRISPR gRNA sequence
aggatgcagtttagtagaac

SEQ ID NO: 426694 - DNA, 20 bp, Artificial
  CRISPR gRNA sequence
catcctcctttcacagatga

SEQ ID NO: 426695 - DNA, 20 bp, Artificial
  CRISPR gRNA sequence
ggatgcattatcctttgaaa

SEQ ID NO: 426696 - DNA, 20 bp, Artificial
  CRISPR gRNA sequence
ttgtcatttgcagtgcctga

SEQ ID NO: 426697 - DNA, 20 bp, Artificial
  CRISPR gRNA sequence
gatagttcagaaggcaacat

SEQ ID NO: 426698 - DNA, 20 bp, Artificial
  CRISPR gRNA sequence
aaagtccttcatctgccacc

SEQ ID NO: 426699 - DNA, 20 bp, Artificial
  CRISPR gRNA sequence
gccgactgcagataggacgg

SEQ ID NO: 426700 - DNA, 20 bp, Artificial
  CRISPR gRNA sequence
ctgagaaaagacggtctcgg

SEQ ID NO: 426701 - DNA, 20 bp, Artificial
  CRISPR gRNA sequence
tcggaaaaaccaagtttggc

SEQ ID NO: 426702 - DNA, 20 bp, Artificial
  CRISPR gRNA sequence
agtttggcaaaaaccatatt

SEQ ID NO: 426703 - DNA, 20 bp, Artificial
  CRISPR gRNA sequence
gtgtatttgttgacaacttt

SEQ ID NO: 426704 - DNA, 20 bp, Artificial
  CRISPR gRNA sequence
tgtatttgttgacaacttta

SEQ ID NO: 426705 - DNA, 20 bp, Artificial
  CRISPR gRNA sequence
gttgacaactttatgtgttt

SEQ ID NO: 426706 - DNA, 20 bp, Artificial
  CRISPR gRNA sequence
ttgacaactttatgtgtttt

SEQ ID NO: 426707 - DNA, 20 bp, Artificial
  CRISPR gRNA sequence
acaactttatgtgtttttaa

SEQ ID NO: 426708 - DNA, 20 bp, Artificial
  CRISPR gRNA sequence
tatgtgtttttaatatggtt

SEQ ID NO: 426709 - DNA, 20 bp, Artificial
  CRISPR gRNA sequence
atgtgtttttaatatggttt

SEQ ID NO: 426710 - DNA, 20 bp, Artificial
  CRISPR gRNA sequence
tgtgtttttaatatggtttt

SEQ ID NO: 426711 - DNA, 20 bp, Artificial
  CRISPR gRNA sequence
ttaatatggtttttgccaaa

SEQ ID NO: 426712 - DNA, 20 bp, Artificial
  CRISPR gRNA sequence
taatatggtttttgccaaac

SEQ ID NO: 426713 - DNA, 20 bp, Artificial
  CRISPR gRNA sequence
aatatggtttttgccaaact

SEQ ID NO: 426714 - DNA, 20 bp, Artificial
  CRISPR gRNA sequence
atatggtttttgccaaactt

SEQ ID NO: 426715 - DNA, 20 bp, Artificial
  CRISPR gRNA sequence
ttgccaaacttggtttttcc

SEQ ID NO: 426716 - DNA, 20 bp, Artificial
  CRISPR gRNA sequence
tgccaaacttggtttttccg

SEQ ID NO: 426717 - DNA, 20 bp, Artificial
  CRISPR gRNA sequence
gccaaacttggtttttccga

SEQ ID NO: 426718 - DNA, 20 bp, Artificial
  CRISPR gRNA sequence
ccaaacttggtttttccgag

SEQ ID NO: 426719 - DNA, 20 bp, Artificial
  CRISPR gRNA sequence
ggtttttccgagaccgtctt

SEQ ID NO: 426720 - DNA, 20 bp, Artificial
  CRISPR gRNA sequence
gtttttccgagaccgtcttt

SEQ ID NO: 426721 - DNA, 20 bp, Artificial
  CRISPR gRNA sequence
ttccgagaccgtcttttctc

SEQ ID NO: 426722 - DNA, 20 bp, Artificial
  CRISPR gRNA sequence
tccgagaccgtcttttctca

SEQ ID NO: 426723 - DNA, 20 bp, Artificial
  CRISPR gRNA sequence
ccgagaccgtcttttctcag

SEQ ID NO: 426724 - DNA, 20 bp, Artificial
  CRISPR gRNA sequence
cgagaccgtcttttctcaga

SEQ ID NO: 426725 - DNA, 20 bp, Artificial
  CRISPR gRNA sequence
ttctcagaggctcagtttta

SEQ ID NO: 426726 - DNA, 20 bp, Artificial
  CRISPR gRNA sequence
tctcagaggctcagttttac

SEQ ID NO: 426727 - DNA, 20 bp, Artificial
  CRISPR gRNA sequence
ctcagaggctcagttttacc

SEQ ID NO: 426728 - DNA, 20 bp, Artificial
  CRISPR gRNA sequence
tcagaggctcagttttaccg

SEQ ID NO: 426729 - DNA, 20 bp, Artificial
  CRISPR gRNA sequence
agaggctcagttttaccgtc

SEQ ID NO: 426730 - DNA, 20 bp, Artificial
  CRISPR gRNA sequence
agttttaccgtcctatctgc

SEQ ID NO: 426731 - DNA, 20 bp, Artificial
  CRISPR gRNA sequence
taccgtcctatctgcagtcg

SEQ ID NO: 426732 - DNA, 20 bp, Artificial
  CRISPR gRNA sequence
accgtcctatctgcagtcgg

SEQ ID NO: 426733 - DNA, 20 bp, Artificial
  CRISPR gRNA sequence
ccgtcctatctgcagtcggc

SEQ ID NO: 426734 - DNA, 20 bp, Artificial
  CRISPR gRNA sequence
tctgcagtcggctactttca

SEQ ID NO: 426735 - DNA, 20 bp, Artificial
  CRISPR gRNA sequence
cagtcggctactttcagtgg

SEQ ID NO: 426736 - DNA, 20 bp, Artificial
  CRISPR gRNA sequence
ctttcagtggcagaagaggc

SEQ ID NO: 426737 - DNA, 20 bp, Artificial
  CRISPR gRNA sequence
tcagtggcagaagaggccac

SEQ ID NO: 426738 - DNA, 20 bp, Artificial
  CRISPR gRNA sequence
cagtggcagaagaggccaca

SEQ ID NO: 426739 - DNA, 20 bp, Artificial
  CRISPR gRNA sequence
agtggcagaagaggccacat

SEQ ID NO: 426740 - DNA, 20 bp, Artificial
  CRISPR gRNA sequence
cttcctgtaggccctctggg

SEQ ID NO: 426741 - DNA, 20 bp, Artificial
  CRISPR gRNA sequence
cctgtaggccctctgggcag

SEQ ID NO: 426742 - DNA, 20 bp, Artificial
  CRISPR gRNA sequence
ctgtaggccctctgggcaga

SEQ ID NO: 426743 - DNA, 20 bp, Artificial
  CRISPR gRNA sequence
taggccctctgggcagaagc

SEQ ID NO: 426744 - DNA, 20 bp, Artificial
  CRISPR gRNA sequence
tgggcagaagcatgcgctgg

SEQ ID NO: 426745 - DNA, 20 bp, Artificial
  CRISPR gRNA sequence
ggcagaagcatgcgctggtg

SEQ ID NO: 426746 - DNA, 20 bp, Artificial
  CRISPR gRNA sequence
gtgtctcctcctgatctggg

SEQ ID NO: 426747 - DNA, 20 bp, Artificial
  CRISPR gRNA sequence
ctcctgatctgggcccaggg

SEQ ID NO: 426748 - DNA, 20 bp, Artificial
  CRISPR gRNA sequence
ctgatctgggcccaggggct

SEQ ID NO: 426749 - DNA, 20 bp, Artificial
  CRISPR gRNA sequence
atctgggcccaggggctgag

SEQ ID NO: 426750 - DNA, 20 bp, Artificial
  CRISPR gRNA sequence
ggcccaggggctgaggcagg

SEQ ID NO: 426751 - DNA, 20 bp, Artificial
  CRISPR gRNA sequence
aggcaggctcccctcgcctc

SEQ ID NO: 426752 - DNA, 20 bp, Artificial
  CRISPR gRNA sequence
ccctcgcctcaggtaaggcc

SEQ ID NO: 426753 - DNA, 20 bp, Artificial
  CRISPR gRNA sequence
gcctcaggtaaggcctgaaa

SEQ ID NO: 426754 - DNA, 20 bp, Artificial
  CRISPR gRNA sequence
aggtaaggcctgaaacccag

SEQ ID NO: 426755 - DNA, 20 bp, Artificial
  CRISPR gRNA sequence
aaacccagcagagcagcagg

SEQ ID NO: 426756 - DNA, 20 bp, Artificial
  CRISPR gRNA sequence
agcttggttggagacttggg

SEQ ID NO: 426757 - DNA, 20 bp, Artificial
  CRISPR gRNA sequence
ggttggagacttgggtgctt

SEQ ID NO: 426758 - DNA, 20 bp, Artificial
  CRISPR gRNA sequence
gttggagacttgggtgcttg

SEQ ID NO: 426759 - DNA, 20 bp, Artificial
  CRISPR gRNA sequence
gagacttgggtgcttgtgta

SEQ ID NO: 426760 - DNA, 20 bp, Artificial
  CRISPR gRNA sequence
gggtgcttgtgtagggaaga

SEQ ID NO: 426761 - DNA, 20 bp, Artificial
  CRISPR gRNA sequence
ggtgcttgtgtagggaagac

SEQ ID NO: 426762 - DNA, 20 bp, Artificial
  CRISPR gRNA sequence
gtgtagggaagactccaaga

SEQ ID NO: 426763 - DNA, 20 bp, Artificial
  CRISPR gRNA sequence
tgtagggaagactccaagag

SEQ ID NO: 426764 - DNA, 20 bp, Artificial
  CRISPR gRNA sequence
caagagcatgccacagctgc

SEQ ID NO: 426765 - DNA, 20 bp, Artificial
  CRISPR gRNA sequence
cttgagagaaagaaattgca

SEQ ID NO: 426766 - DNA, 20 bp, Artificial
  CRISPR gRNA sequence
gagagaaagaaattgcaact

SEQ ID NO: 426767 - DNA, 20 bp, Artificial
  CRISPR gRNA sequence
agagaaagaaattgcaactt

SEQ ID NO: 426768 - DNA, 20 bp, Artificial
  CRISPR gRNA sequence
caacttttagagtcctgtgt

SEQ ID NO: 426769 - DNA, 20 bp, Artificial
  CRISPR gRNA sequence
ttagagtcctgtgtactctt

SEQ ID NO: 426770 - DNA, 20 bp, Artificial
  CRISPR gRNA sequence
tagagtcctgtgtactctta

SEQ ID NO: 426771 - DNA, 20 bp, Artificial
  CRISPR gRNA sequence
agagtcctgtgtactcttat

SEQ ID NO: 426772 - DNA, 20 bp, Artificial
  CRISPR gRNA sequence
gagtcctgtgtactcttatt

SEQ ID NO: 426773 - DNA, 20 bp, Artificial
  CRISPR gRNA sequence
tgtactcttatttaagaaag

SEQ ID NO: 426774 - DNA, 20 bp, Artificial
  CRISPR gRNA sequence
ttatttaagaaaggacaatc

SEQ ID NO: 426775 - DNA, 20 bp, Artificial
  CRISPR gRNA sequence
atttaagaaaggacaatctc

SEQ ID NO: 426776 - DNA, 20 bp, Artificial
  CRISPR gRNA sequence
tttaagaaaggacaatctct

SEQ ID NO: 426777 - DNA, 20 bp, Artificial
  CRISPR gRNA sequence
aagaaaggacaatctctgag

SEQ ID NO: 426778 - DNA, 20 bp, Artificial
  CRISPR gRNA sequence
agaaaggacaatctctgaga

SEQ ID NO: 426779 - DNA, 20 bp, Artificial
  CRISPR gRNA sequence
tgagaatgaggtggggttct

SEQ ID NO: 426780 - DNA, 20 bp, Artificial
  CRISPR gRNA sequence
agaatgaggtggggttctgt

SEQ ID NO: 426781 - DNA, 20 bp, Artificial
  CRISPR gRNA sequence
tgtttttggtggcagatgaa

SEQ ID NO: 426782 - DNA, 20 bp, Artificial
  CRISPR gRNA sequence
tttttggtggcagatgaagg

SEQ ID NO: 426783 - DNA, 20 bp, Artificial
  CRISPR gRNA sequence
ttggtggcagatgaaggact

SEQ ID NO: 426784 - DNA, 20 bp, Artificial
  CRISPR gRNA sequence
tggtggcagatgaaggactt

SEQ ID NO: 426785 - DNA, 20 bp, Artificial
  CRISPR gRNA sequence
ggtggcagatgaaggacttt

SEQ ID NO: 426786 - DNA, 20 bp, Artificial
  CRISPR gRNA sequence
gtggcagatgaaggactttg

SEQ ID NO: 426787 - DNA, 20 bp, Artificial
  CRISPR gRNA sequence
tgcagacttccggggttgga

SEQ ID NO: 426788 - DNA, 20 bp, Artificial
  CRISPR gRNA sequence
gcagacttccggggttggag

SEQ ID NO: 426789 - DNA, 20 bp, Artificial
  CRISPR gRNA sequence
cagacttccggggttggagg

SEQ ID NO: 426790 - DNA, 20 bp, Artificial
  CRISPR gRNA sequence
ccggggttggaggagcctga

SEQ ID NO: 426791 - DNA, 20 bp, Artificial
  CRISPR gRNA sequence
cggggttggaggagcctgac

SEQ ID NO: 426792 - DNA, 20 bp, Artificial
  CRISPR gRNA sequence
gaggagcctgactggccagc

SEQ ID NO: 426793 - DNA, 20 bp, Artificial
  CRISPR gRNA sequence
actggccagcacaagaagga

SEQ ID NO: 426794 - DNA, 20 bp, Artificial
  CRISPR gRNA sequence
gccagcacaagaaggagcag

SEQ ID NO: 426795 - DNA, 20 bp, Artificial
  CRISPR gRNA sequence
cagtcggctactttcaggaa

SEQ ID NO: 426796 - DNA, 20 bp, Artificial
  CRISPR gRNA sequence
ctttcaggaagaagaagggc

SEQ ID NO: 426797 - DNA, 20 bp, Artificial
  CRISPR gRNA sequence
tcaggaagaagaagggctgg

SEQ ID NO: 426798 - DNA, 20 bp, Artificial
  CRISPR gRNA sequence
caggaagaagaagggctggg

SEQ ID NO: 426799 - DNA, 20 bp, Artificial
  CRISPR gRNA sequence
aggaagaagaagggctgggc

SEQ ID NO: 426800 - DNA, 20 bp, Artificial
  CRISPR gRNA sequence
ggcaggaggcattgccagtt

SEQ ID NO: 426801 - DNA, 20 bp, Artificial
  CRISPR gRNA sequence
ccagtttgcttttagaagct

SEQ ID NO: 426802 - DNA, 20 bp, Artificial
  CRISPR gRNA sequence
gcttttagaagctcattcct

SEQ ID NO: 426803 - DNA, 20 bp, Artificial
  CRISPR gRNA sequence
cttttagaagctcattcctg

SEQ ID NO: 426804 - DNA, 20 bp, Artificial
  CRISPR gRNA sequence
ttagaagctcattcctgctc

SEQ ID NO: 426805 - DNA, 20 bp, Artificial
  CRISPR gRNA sequence
tagaagctcattcctgctcc

SEQ ID NO: 426806 - DNA, 20 bp, Artificial
  CRISPR gRNA sequence
agaagctcattcctgctcca

SEQ ID NO: 426807 - DNA, 20 bp, Artificial
  CRISPR gRNA sequence
gaagctcattcctgctccag

SEQ ID NO: 426808 - DNA, 20 bp, Artificial
  CRISPR gRNA sequence
attcctgctccagcttcttt

SEQ ID NO: 426809 - DNA, 20 bp, Artificial
  CRISPR gRNA sequence
ctgctccagcttcttttctg

SEQ ID NO: 426810 - DNA, 20 bp, Artificial
  CRISPR gRNA sequence
ctccagcttcttttctgttg

SEQ ID NO: 426811 - DNA, 20 bp, Artificial
  CRISPR gRNA sequence
cagcttcttttctgttgcct

SEQ ID NO: 426812 - DNA, 20 bp, Artificial
  CRISPR gRNA sequence
cttttctgttgcctttcagg

SEQ ID NO: 426813 - DNA, 20 bp, Artificial
  CRISPR gRNA sequence
ttttctgttgcctttcagga

SEQ ID NO: 426814 - DNA, 20 bp, Artificial
  CRISPR gRNA sequence
ttctgttgcctttcaggaac

SEQ ID NO: 426815 - DNA, 20 bp, Artificial
  CRISPR gRNA sequence
tctgttgcctttcaggaact

SEQ ID NO: 426816 - DNA, 20 bp, Artificial
  CRISPR gRNA sequence
ctgttgcctttcaggaactt

SEQ ID NO: 426817 - DNA, 20 bp, Artificial
  CRISPR gRNA sequence
tgttgcctttcaggaacttt

SEQ ID NO: 426818 - DNA, 20 bp, Artificial
  CRISPR gRNA sequence
ttgcctttcaggaactttcc

SEQ ID NO: 426819 - DNA, 20 bp, Artificial
  CRISPR gRNA sequence
cctttcaggaactttccagg

SEQ ID NO: 426820 - DNA, 20 bp, Artificial
  CRISPR gRNA sequence
tcaggaactttccaggaaaa

SEQ ID NO: 426821 - DNA, 20 bp, Artificial
  CRISPR gRNA sequence
caggaactttccaggaaaac

SEQ ID NO: 426822 - DNA, 20 bp, Artificial
  CRISPR gRNA sequence
aggaactttccaggaaaaca

SEQ ID NO: 426823 - DNA, 20 bp, Artificial
  CRISPR gRNA sequence
tccaggaaaacattataagt

SEQ ID NO: 426824 - DNA, 20 bp, Artificial
  CRISPR gRNA sequence
ccaggaaaacattataagtt

SEQ ID NO: 426825 - DNA, 20 bp, Artificial
  CRISPR gRNA sequence
caggaaaacattataagttc

SEQ ID NO: 426826 - DNA, 20 bp, Artificial
  CRISPR gRNA sequence
taagttctctgtgaattgaa

SEQ ID NO: 426827 - DNA, 20 bp, Artificial
  CRISPR gRNA sequence
tctgtgaattgaaaatgtct

SEQ ID NO: 426828 - DNA, 20 bp, Artificial
  CRISPR gRNA sequence
tgtgaattgaaaatgtcttt

SEQ ID NO: 426829 - DNA, 20 bp, Artificial
  CRISPR gRNA sequence
tgaattgaaaatgtcttttt

SEQ ID NO: 426830 - DNA, 20 bp, Artificial
  CRISPR gRNA sequence
aaaatgtctttttcacagat

SEQ ID NO: 426831 - DNA, 20 bp, Artificial
  CRISPR gRNA sequence
tttcacagattccagaggtt

SEQ ID NO: 426832 - DNA, 20 bp, Artificial
  CRISPR gRNA sequence
ttcacagattccagaggttc

SEQ ID NO: 426833 - DNA, 20 bp, Artificial
  CRISPR gRNA sequence
tcacagattccagaggttct

SEQ ID NO: 426834 - DNA, 20 bp, Artificial
  CRISPR gRNA sequence
cacagattccagaggttcta

SEQ ID NO: 426835 - DNA, 20 bp, Artificial
  CRISPR gRNA sequence
acagattccagaggttctac

SEQ ID NO: 426836 - DNA, 20 bp, Artificial
  CRISPR gRNA sequence
cagaggttctaccactagag

SEQ ID NO: 426837 - DNA, 20 bp, Artificial
  CRISPR gRNA sequence
taccactagagactgatttt

SEQ ID NO: 426838 - DNA, 20 bp, Artificial
  CRISPR gRNA sequence
ccactagagactgatttttt

SEQ ID NO: 426839 - DNA, 20 bp, Artificial
  CRISPR gRNA sequence
gagactgattttttgttaaa

SEQ ID NO: 426840 - DNA, 20 bp, Artificial
  CRISPR gRNA sequence
attttttgttaaatttattt

SEQ ID NO: 426841 - DNA, 20 bp, Artificial
  CRISPR gRNA sequence
tttgttaaatttatttcttc

SEQ ID NO: 426842 - DNA, 20 bp, Artificial
  CRISPR gRNA sequence
ttgttaaatttatttcttct

SEQ ID NO: 426843 - DNA, 20 bp, Artificial
  CRISPR gRNA sequence
tgttaaatttatttcttcta

SEQ ID NO: 426844 - DNA, 20 bp, Artificial
  CRISPR gRNA sequence
gttaaatttatttcttctat

SEQ ID NO: 426845 - DNA, 20 bp, Artificial
  CRISPR gRNA sequence
ttaaatttatttcttctata

SEQ ID NO: 426846 - DNA, 20 bp, Artificial
  CRISPR gRNA sequence
aatttatttcttctatatta

SEQ ID NO: 426847 - DNA, 20 bp, Artificial
  CRISPR gRNA sequence
atttcttctatattaaaaat

SEQ ID NO: 426848 - DNA, 20 bp, Artificial
  CRISPR gRNA sequence
tttcttctatattaaaaatc

SEQ ID NO: 426849 - DNA, 20 bp, Artificial
  CRISPR gRNA sequence
cttctatattaaaaatcaga

SEQ ID NO: 426850 - DNA, 20 bp, Artificial
  CRISPR gRNA sequence
ttctatattaaaaatcagag

SEQ ID NO: 426851 - DNA, 20 bp, Artificial
  CRISPR gRNA sequence
ctatattaaaaatcagagtc

SEQ ID NO: 426852 - DNA, 20 bp, Artificial
  CRISPR gRNA sequence
tatattaaaaatcagagtca

SEQ ID NO: 426853 - DNA, 20 bp, Artificial
  CRISPR gRNA sequence
tattaaaaatcagagtcaaa

SEQ ID NO: 426854 - DNA, 20 bp, Artificial
  CRISPR gRNA sequence
aaaatcagagtcaaatattt

SEQ ID NO: 426855 - DNA, 20 bp, Artificial
  CRISPR gRNA sequence
ctgagggaggggaacacaaa

SEQ ID NO: 426856 - DNA, 20 bp, Artificial
  CRISPR gRNA sequence
tgagggaggggaacacaaat

SEQ ID NO: 426857 - DNA, 20 bp, Artificial
  CRISPR gRNA sequence
agggaggggaacacaaatat

SEQ ID NO: 426858 - DNA, 20 bp, Artificial
  CRISPR gRNA sequence
aaaaactgtggtataaatta

SEQ ID NO: 426859 - DNA, 20 bp, Artificial
  CRISPR gRNA sequence
aaaactgtggtataaattag

SEQ ID NO: 426860 - DNA, 20 bp, Artificial
  CRISPR gRNA sequence
tggtataaattagtttttat

SEQ ID NO: 426861 - DNA, 20 bp, Artificial
  CRISPR gRNA sequence
gtttttatgttgccttctga

SEQ ID NO: 426862 - DNA, 20 bp, Artificial
  CRISPR gRNA sequence
ttatgttgccttctgaacta

SEQ ID NO: 426863 - DNA, 20 bp, Artificial
  CRISPR gRNA sequence
tatgttgccttctgaactat

SEQ ID NO: 426864 - DNA, 20 bp, Artificial
  CRISPR gRNA sequence
atgttgccttctgaactatc

SEQ ID NO: 426865 - DNA, 20 bp, Artificial
  CRISPR gRNA sequence
tgttgccttctgaactatct

SEQ ID NO: 426866 - DNA, 20 bp, Artificial
  CRISPR gRNA sequence
ccttctgaactatctgagga

SEQ ID NO: 426867 - DNA, 20 bp, Artificial
  CRISPR gRNA sequence
ctgaactatctgaggatgga

SEQ ID NO: 426868 - DNA, 20 bp, Artificial
  CRISPR gRNA sequence
tgaactatctgaggatggag

SEQ ID NO: 426869 - DNA, 20 bp, Artificial
  CRISPR gRNA sequence
aactatctgaggatggagat

SEQ ID NO: 426870 - DNA, 20 bp, Artificial
  CRISPR gRNA sequence
tctgaggatggagatgtgcc

SEQ ID NO: 426871 - DNA, 20 bp, Artificial
  CRISPR gRNA sequence
aggatggagatgtgcccagg

SEQ ID NO: 426872 - DNA, 20 bp, Artificial
  CRISPR gRNA sequence
ctggggagaggttaagtgct

SEQ ID NO: 426873 - DNA, 20 bp, Artificial
  CRISPR gRNA sequence
gggagaggttaagtgctgag

SEQ ID NO: 426874 - DNA, 20 bp, Artificial
  CRISPR gRNA sequence
agtgctgagagggtggttat

SEQ ID NO: 426875 - DNA, 20 bp, Artificial
  CRISPR gRNA sequence
agagggtggttatgcctggg

SEQ ID NO: 426876 - DNA, 20 bp, Artificial
  CRISPR gRNA sequence
tgcctgggagaagcagggtt

SEQ ID NO: 426877 - DNA, 20 bp, Artificial
  CRISPR gRNA sequence
ggagaagcagggtttcctgc

SEQ ID NO: 426878 - DNA, 20 bp, Artificial
  CRISPR gRNA sequence
cctgctaagcttcctttgct

SEQ ID NO: 426879 - DNA, 20 bp, Artificial
  CRISPR gRNA sequence
ctgctaagcttcctttgcta

SEQ ID NO: 426880 - DNA, 20 bp, Artificial
  CRISPR gRNA sequence
ctaagcttcctttgctattg

SEQ ID NO: 426881 - DNA, 20 bp, Artificial
  CRISPR gRNA sequence
agcttcctttgctattggat

SEQ ID NO: 426882 - DNA, 20 bp, Artificial
  CRISPR gRNA sequence
cctttgctattggatttctt

SEQ ID NO: 426883 - DNA, 20 bp, Artificial
  CRISPR gRNA sequence
ctttgctattggatttcttg

SEQ ID NO: 426884 - DNA, 20 bp, Artificial
  CRISPR gRNA sequence
tgctattggatttcttggct

SEQ ID NO: 426885 - DNA, 20 bp, Artificial
  CRISPR gRNA sequence
gctattggatttcttggctt

SEQ ID NO: 426886 - DNA, 20 bp, Artificial
  CRISPR gRNA sequence
ctattggatttcttggcttt

SEQ ID NO: 426887 - DNA, 20 bp, Artificial
  CRISPR gRNA sequence
ttggatttcttggctttcct

SEQ ID NO: 426888 - DNA, 20 bp, Artificial
  CRISPR gRNA sequence
gatttcttggctttcctgaa

SEQ ID NO: 426889 - DNA, 20 bp, Artificial
  CRISPR gRNA sequence
cttggctttcctgaaggttt

SEQ ID NO: 426890 - DNA, 20 bp, Artificial
  CRISPR gRNA sequence
ttggctttcctgaaggtttt

SEQ ID NO: 426891 - DNA, 20 bp, Artificial
  CRISPR gRNA sequence
ggctttcctgaaggtttttt

SEQ ID NO: 426892 - DNA, 20 bp, Artificial
  CRISPR gRNA sequence
gctttcctgaaggttttttc

SEQ ID NO: 426893 - DNA, 20 bp, Artificial
  CRISPR gRNA sequence
tcctgaaggttttttcaggc

SEQ ID NO: 426894 - DNA, 20 bp, Artificial
  CRISPR gRNA sequence
cctgaaggttttttcaggca

SEQ ID NO: 426895 - DNA, 20 bp, Artificial
  CRISPR gRNA sequence
ctgaaggttttttcaggcac

SEQ ID NO: 426896 - DNA, 20 bp, Artificial
  CRISPR gRNA sequence
aaggttttttcaggcactgc

SEQ ID NO: 426897 - DNA, 20 bp, Artificial
  CRISPR gRNA sequence
tttcaggcactgcaaatgac

SEQ ID NO: 426898 - DNA, 20 bp, Artificial
  CRISPR gRNA sequence
ttcaggcactgcaaatgaca

SEQ ID NO: 426899 - DNA, 20 bp, Artificial
  CRISPR gRNA sequence
tcaggcactgcaaatgacaa

SEQ ID NO: 426900 - DNA, 20 bp, Artificial
  CRISPR gRNA sequence
caggcactgcaaatgacaat

SEQ ID NO: 426901 - DNA, 20 bp, Artificial
  CRISPR gRNA sequence
aggcactgcaaatgacaatc

SEQ ID NO: 426902 - DNA, 20 bp, Artificial
  CRISPR gRNA sequence
caaatgacaatcaaccaaac

SEQ ID NO: 426903 - DNA, 20 bp, Artificial
  CRISPR gRNA sequence
tatttcaaaggataatgcat

SEQ ID NO: 426904 - DNA, 20 bp, Artificial
  CRISPR gRNA sequence
atttcaaaggataatgcatc

SEQ ID NO: 426905 - DNA, 20 bp, Artificial
  CRISPR gRNA sequence
tttcaaaggataatgcatcc

SEQ ID NO: 426906 - DNA, 20 bp, Artificial
  CRISPR gRNA sequence
caaaggataatgcatccagc

SEQ ID NO: 426907 - DNA, 20 bp, Artificial
  CRISPR gRNA sequence
aaaggataatgcatccagca

SEQ ID NO: 426908 - DNA, 20 bp, Artificial
  CRISPR gRNA sequence
ggccgcaggaagaaacataa

SEQ ID NO: 426909 - DNA, 20 bp, Artificial
  CRISPR gRNA sequence
acaagggcttatattctaag

SEQ ID NO: 426910 - DNA, 20 bp, Artificial
  CRISPR gRNA sequence
atattctaagtgggtagaca

SEQ ID NO: 426911 - DNA, 20 bp, Artificial
  CRISPR gRNA sequence
tattctaagtgggtagacaa

SEQ ID NO: 426912 - DNA, 20 bp, Artificial
  CRISPR gRNA sequence
taagtgggtagacaaaatag

SEQ ID NO: 426913 - DNA, 20 bp, Artificial
  CRISPR gRNA sequence
agtgggtagacaaaataggc

SEQ ID NO: 426914 - DNA, 20 bp, Artificial
  CRISPR gRNA sequence
cgaaaataacaagctggcca

SEQ ID NO: 426915 - DNA, 20 bp, Artificial
  CRISPR gRNA sequence
gccatgaagctacatagcag

SEQ ID NO: 426916 - DNA, 20 bp, Artificial
  CRISPR gRNA sequence
catagcagaatatgcgaggg

SEQ ID NO: 426917 - DNA, 20 bp, Artificial
  CRISPR gRNA sequence
agttgtgtagtcataagcca

SEQ ID NO: 426918 - DNA, 20 bp, Artificial
  CRISPR gRNA sequence
tgtagtcataagccaggcat

SEQ ID NO: 426919 - DNA, 20 bp, Artificial
  CRISPR gRNA sequence
agtaaggtgctaattataca

SEQ ID NO: 426920 - DNA, 20 bp, Artificial
  CRISPR gRNA sequence
gtaaggtgctaattatacaa

SEQ ID NO: 426921 - DNA, 20 bp, Artificial
  CRISPR gRNA sequence
attatacaatacaggcagtg

SEQ ID NO: 426922 - DNA, 20 bp, Artificial
  CRISPR gRNA sequence
tacaatacaggcagtgaatg

SEQ ID NO: 426923 - DNA, 20 bp, Artificial
  CRISPR gRNA sequence
agatgggctgaggtcttcta

SEQ ID NO: 426924 - DNA, 20 bp, Artificial
  CRISPR gRNA sequence
aggtcttctaggaggcgggg

SEQ ID NO: 426925 - DNA, 20 bp, Artificial
  CRISPR gRNA sequence
ctaggaggcggggagggagt

SEQ ID NO: 426926 - DNA, 20 bp, Artificial
  CRISPR gRNA sequence
taggaggcggggagggagtg

SEQ ID NO: 426927 - DNA, 20 bp, Artificial
  CRISPR gRNA sequence
ggaggcggggagggagtgca

SEQ ID NO: 426928 - DNA, 20 bp, Artificial
  CRISPR gRNA sequence
gacaagcctccctgtgggcg

SEQ ID NO: 426929 - DNA, 20 bp, Artificial
  CRISPR gRNA sequence
acaagcctccctgtgggcga

SEQ ID NO: 426930 - DNA, 20 bp, Artificial
  CRISPR gRNA sequence
cctgtgggcgaggtgtaaag

SEQ ID NO: 426931 - DNA, 20 bp, Artificial
  CRISPR gRNA sequence
tgggcgaggtgtaaagaggg

SEQ ID NO: 426932 - DNA, 20 bp, Artificial
  CRISPR gRNA sequence
tggaagcatagggcagtggg

SEQ ID NO: 426933 - DNA, 20 bp, Artificial
  CRISPR gRNA sequence
gaagcatagggcagtgggtg

SEQ ID NO: 426934 - DNA, 20 bp, Artificial
  CRISPR gRNA sequence
ggctgggctggagtagagat

SEQ ID NO: 426935 - DNA, 20 bp, Artificial
  CRISPR gRNA sequence
ggctggagtagagatgtgtg

SEQ ID NO: 426936 - DNA, 20 bp, Artificial
  CRISPR gRNA sequence
gagtagagatgtgtggagaa

SEQ ID NO: 426937 - DNA, 20 bp, Artificial
  CRISPR gRNA sequence
gaaagacaacctgaatgggg

SEQ ID NO: 426938 - DNA, 20 bp, Artificial
  CRISPR gRNA sequence
aatgggggactgggagcctt

SEQ ID NO: 426939 - DNA, 20 bp, Artificial
  CRISPR gRNA sequence
ggagccttgaataacaggca

SEQ ID NO: 426940 - DNA, 20 bp, Artificial
  CRISPR gRNA sequence
gaataacaggcatggagagg

SEQ ID NO: 426941 - DNA, 20 bp, Artificial
  CRISPR gRNA sequence
aataacaggcatggagagga

SEQ ID NO: 426942 - DNA, 20 bp, Artificial
  CRISPR gRNA sequence
ttgaaatggaagaaacagga

SEQ ID NO: 426943 - DNA, 20 bp, Artificial
  CRISPR gRNA sequence
gaaatggaagaaacaggaaa

SEQ ID NO: 426944 - DNA, 20 bp, Artificial
  CRISPR gRNA sequence
aaatggaagaaacaggaaat

SEQ ID NO: 426945 - DNA, 20 bp, Artificial
  CRISPR gRNA sequence
cagcctctatggaggagcaa

SEQ ID NO: 426946 - DNA, 20 bp, Artificial
  CRISPR gRNA sequence
tatggaggagcaacaggatg

SEQ ID NO: 426947 - DNA, 20 bp, Artificial
  CRISPR gRNA sequence
tggaggagcaacaggatgga

SEQ ID NO: 426948 - DNA, 20 bp, Artificial
  CRISPR gRNA sequence
gagaaactatcattccaaaa

SEQ ID NO: 426949 - DNA, 20 bp, Artificial
  CRISPR gRNA sequence
tcattccaaaatccagttgg

SEQ ID NO: 426950 - DNA, 20 bp, Artificial
  CRISPR gRNA sequence
caaaatccagttggggcctc

SEQ ID NO: 426951 - DNA, 20 bp, Artificial
  CRISPR gRNA sequence
gggcctcaaaggcccttaga

SEQ ID NO: 426952 - DNA, 20 bp, Artificial
  CRISPR gRNA sequence
aaaggcccttagaatttttc

SEQ ID NO: 426953 - DNA, 20 bp, Artificial
  CRISPR gRNA sequence
agaatttttctaggaaggtt

SEQ ID NO: 426954 - DNA, 20 bp, Artificial
  CRISPR gRNA sequence
gaatttttctaggaaggttg

SEQ ID NO: 426955 - DNA, 20 bp, Artificial
  CRISPR gRNA sequence
ttctaggaaggttgaaggcc

SEQ ID NO: 426956 - DNA, 20 bp, Artificial
  CRISPR gRNA sequence
tctaggaaggttgaaggcca

SEQ ID NO: 426957 - DNA, 20 bp, Artificial
  CRISPR gRNA sequence
ctaggaaggttgaaggccag

SEQ ID NO: 426958 - DNA, 20 bp, Artificial
  CRISPR gRNA sequence
taggaaggttgaaggccagc

SEQ ID NO: 426959 - DNA, 20 bp, Artificial
  CRISPR gRNA sequence
ggaaggttgaaggccagctg

SEQ ID NO: 426960 - DNA, 20 bp, Artificial
  CRISPR gRNA sequence
aaggccagctgctgacccag

SEQ ID NO: 426961 - DNA, 20 bp, Artificial
  CRISPR gRNA sequence
ctgacccaggactcacatgt

SEQ ID NO: 426962 - DNA, 20 bp, Artificial
  CRISPR gRNA sequence
acccaggactcacatgtgct

SEQ ID NO: 426963 - DNA, 20 bp, Artificial
  CRISPR gRNA sequence
acatgtgcttcgtcctcttc

SEQ ID NO: 426964 - DNA, 20 bp, Artificial
  CRISPR gRNA sequence
cgtcctcttccctaggaatg

SEQ ID NO: 426965 - DNA, 20 bp, Artificial
  CRISPR gRNA sequence
gtcctcttccctaggaatga

SEQ ID NO: 426966 - DNA, 20 bp, Artificial
  CRISPR gRNA sequence
ttccctaggaatgatgacag

SEQ ID NO: 426967 - DNA, 20 bp, Artificial
  CRISPR gRNA sequence
ccctaggaatgatgacaggc

SEQ ID NO: 426968 - DNA, 20 bp, Artificial
  CRISPR gRNA sequence
cctaggaatgatgacaggca

SEQ ID NO: 426969 - DNA, 20 bp, Artificial
  CRISPR gRNA sequence
ggaatgatgacaggcacaat

SEQ ID NO: 426970 - DNA, 20 bp, Artificial
  CRISPR gRNA sequence
ctgcagagaaaggtggctct

SEQ ID NO: 426971 - DNA, 20 bp, Artificial
  CRISPR gRNA sequence
tgcagagaaaggtggctcta

SEQ ID NO: 426972 - DNA, 20 bp, Artificial
  CRISPR gRNA sequence
cagagaaaggtggctctatc

SEQ ID NO: 426973 - DNA, 20 bp, Artificial
  CRISPR gRNA sequence
tatcatcttacaatgtcacc

SEQ ID NO: 426974 - DNA, 20 bp, Artificial
  CRISPR gRNA sequence
tcatcttacaatgtcacctc

SEQ ID NO: 426975 - DNA, 20 bp, Artificial
  CRISPR gRNA sequence
acaatgtcacctctcctcca

SEQ ID NO: 426976 - DNA, 20 bp, Artificial
  CRISPR gRNA sequence
caatgtcacctctcctccac

SEQ ID NO: 426977 - DNA, 20 bp, Artificial
  CRISPR gRNA sequence
tcctccaccacggcacaagt

SEQ ID NO: 426978 - DNA, 20 bp, Artificial
  CRISPR gRNA sequence
ctccaccacggcacaagtga

SEQ ID NO: 426979 - DNA, 20 bp, Artificial
  CRISPR gRNA sequence
caccacggcacaagtgaccc

SEQ ID NO: 426980 - DNA, 20 bp, Artificial
  CRISPR gRNA sequence
ggagcagcaggaccagcttc

SEQ ID NO: 426981 - DNA, 20 bp, Artificial
  CRISPR gRNA sequence
ctggccatttgtaatgctga

SEQ ID NO: 426982 - DNA, 20 bp, Artificial
  CRISPR gRNA sequence
tggccatttgtaatgctgac

SEQ ID NO: 426983 - DNA, 20 bp, Artificial
  CRISPR gRNA sequence
gccatttgtaatgctgactt

SEQ ID NO: 426984 - DNA, 20 bp, Artificial
  CRISPR gRNA sequence
gtaatgctgacttggggtgg

SEQ ID NO: 426985 - DNA, 20 bp, Artificial
  CRISPR gRNA sequence
taatgctgacttggggtggc

SEQ ID NO: 426986 - DNA, 20 bp, Artificial
  CRISPR gRNA sequence
acttggggtggcacatctcc

SEQ ID NO: 426987 - DNA, 20 bp, Artificial
  CRISPR gRNA sequence
ggggtggcacatctccccat

SEQ ID NO: 426988 - DNA, 20 bp, Artificial
  CRISPR gRNA sequence
gggtggcacatctccccatc

SEQ ID NO: 426989 - DNA, 20 bp, Artificial
  CRISPR gRNA sequence
cccatccttcaaggatcgag

SEQ ID NO: 426990 - DNA, 20 bp, Artificial
  CRISPR gRNA sequence
caaggatcgagtggccccag

SEQ ID NO: 426991 - DNA, 20 bp, Artificial
  CRISPR gRNA sequence
aaggatcgagtggccccagg

SEQ ID NO: 426992 - DNA, 20 bp, Artificial
  CRISPR gRNA sequence
ggcctcaccctccagtcgct

SEQ ID NO: 426993 - DNA, 20 bp, Artificial
  CRISPR gRNA sequence
accctccagtcgctgaccgt

SEQ ID NO: 426994 - DNA, 20 bp, Artificial
  CRISPR gRNA sequence
cagtcgctgaccgtgaacga

SEQ ID NO: 426995 - DNA, 20 bp, Artificial
  CRISPR gRNA sequence
accgtgaacgatacagggga

SEQ ID NO: 426996 - DNA, 20 bp, Artificial
  CRISPR gRNA sequence
ctgcatctatcacacctacc

SEQ ID NO: 426997 - DNA, 20 bp, Artificial
  CRISPR gRNA sequence
tgcatctatcacacctaccc

SEQ ID NO: 426998 - DNA, 20 bp, Artificial
  CRISPR gRNA sequence
catctatcacacctaccctg

SEQ ID NO: 426999 - DNA, 20 bp, Artificial
  CRISPR gRNA sequence
tcacacctaccctgatggga

SEQ ID NO: 427000 - DNA, 20 bp, Artificial
  CRISPR gRNA sequence
ccctgatgggacgtacactg

SEQ ID NO: 427001 - DNA, 20 bp, Artificial
  CRISPR gRNA sequence
atgggacgtacactgggaga

SEQ ID NO: 427002 - DNA, 20 bp, Artificial
  CRISPR gRNA sequence
ggagaatcttcctggaggtc

SEQ ID NO: 427003 - DNA, 20 bp, Artificial
  CRISPR gRNA sequence
cctggaggtcctagaaagct

SEQ ID NO: 427004 - DNA, 20 bp, Artificial
  CRISPR gRNA sequence
ctggaggtcctagaaagctc

SEQ ID NO: 427005 - DNA, 20 bp, Artificial
  CRISPR gRNA sequence
gaggtcctagaaagctcagg

SEQ ID NO: 427006 - DNA, 20 bp, Artificial
  CRISPR gRNA sequence
gaaagctcaggtattcctgc

SEQ ID NO: 427007 - DNA, 20 bp, Artificial
  CRISPR gRNA sequence
aggtattcctgctggagcaa

SEQ ID NO: 427008 - DNA, 20 bp, Artificial
  CRISPR gRNA sequence
ctgctggagcaagttggtgg

SEQ ID NO: 427009 - DNA, 20 bp, Artificial
  CRISPR gRNA sequence
ctggagcaagttggtggata

SEQ ID NO: 427010 - DNA, 20 bp, Artificial
  CRISPR gRNA sequence
gagcaagttggtggataaac

SEQ ID NO: 427011 - DNA, 20 bp, Artificial
  CRISPR gRNA sequence
gtggataaacctctccctct

SEQ ID NO: 427012 - DNA, 20 bp, Artificial
  CRISPR gRNA sequence
tccctctagcatagaaaatg

SEQ ID NO: 427013 - DNA, 20 bp, Artificial
  CRISPR gRNA sequence
cctctagcatagaaaatgca

SEQ ID NO: 427014 - DNA, 20 bp, Artificial
  CRISPR gRNA sequence
tagcatagaaaatgcaatcc

SEQ ID NO: 427015 - DNA, 20 bp, Artificial
  CRISPR gRNA sequence
gcatagaaaatgcaatcctg

SEQ ID NO: 427016 - DNA, 20 bp, Artificial
  CRISPR gRNA sequence
aaacactgcacagcagggct

SEQ ID NO: 427017 - DNA, 20 bp, Artificial
  CRISPR gRNA sequence
cacagcagggcttctcaatt

SEQ ID NO: 427018 - DNA, 20 bp, Artificial
  CRISPR gRNA sequence
ctcaattcgggatcacattt

SEQ ID NO: 427019 - DNA, 20 bp, Artificial
  CRISPR gRNA sequence
tcaattcgggatcacatttg

SEQ ID NO: 427020 - DNA, 20 bp, Artificial
  CRISPR gRNA sequence
aattcgggatcacatttgaa

SEQ ID NO: 427021 - DNA, 20 bp, Artificial
  CRISPR gRNA sequence
gggatcacatttgaatcacc

SEQ ID NO: 427022 - DNA, 20 bp, Artificial
  CRISPR gRNA sequence
gaatcacctgaggagatttt

SEQ ID NO: 427023 - DNA, 20 bp, Artificial
  CRISPR gRNA sequence
aatcacctgaggagatttta

SEQ ID NO: 427024 - DNA, 20 bp, Artificial
  CRISPR gRNA sequence
aggagattttaaatcatact

SEQ ID NO: 427025 - DNA, 20 bp, Artificial
  CRISPR gRNA sequence
taaatcatactgatgccgag

SEQ ID NO: 427026 - DNA, 20 bp, Artificial
  CRISPR gRNA sequence
aaatcatactgatgccgagg

SEQ ID NO: 427027 - DNA, 20 bp, Artificial
  CRISPR gRNA sequence
aatcatactgatgccgaggc

SEQ ID NO: 427028 - DNA, 20 bp, Artificial
  CRISPR gRNA sequence
atgccgaggcctcacccaga

SEQ ID NO: 427029 - DNA, 20 bp, Artificial
  CRISPR gRNA sequence
acccagaccaattcaatcag

SEQ ID NO: 427030 - DNA, 20 bp, Artificial
  CRISPR gRNA sequence
aatcagaatccctaatagca

SEQ ID NO: 427031 - DNA, 20 bp, Artificial
  CRISPR gRNA sequence
atagcagagctaaacaaggg

SEQ ID NO: 427032 - DNA, 20 bp, Artificial
  CRISPR gRNA sequence
aacaagggtaaggtctaaaa

SEQ ID NO: 427033 - DNA, 20 bp, Artificial
  CRISPR gRNA sequence
aaagcatttccaggtgattc

SEQ ID NO: 427034 - DNA, 20 bp, Artificial
  CRISPR gRNA sequence
ccaggtgattctaatgggca

SEQ ID NO: 427035 - DNA, 20 bp, Artificial
  CRISPR gRNA sequence
caggtgattctaatgggcag

SEQ ID NO: 427036 - DNA, 20 bp, Artificial
  CRISPR gRNA sequence
taatgggcagccaatactga

SEQ ID NO: 427037 - DNA, 20 bp, Artificial
  CRISPR gRNA sequence
atgggcagccaatactgaga

SEQ ID NO: 427038 - DNA, 20 bp, Artificial
  CRISPR gRNA sequence
agaaccactgttcttatgta

SEQ ID NO: 427039 - DNA, 20 bp, Artificial
  CRISPR gRNA sequence
ttcttatgtaagaagcacat

SEQ ID NO: 427040 - DNA, 20 bp, Artificial
  CRISPR gRNA sequence
ttatgtaagaagcacatctt

SEQ ID NO: 427041 - DNA, 20 bp, Artificial
  CRISPR gRNA sequence
atgtaagaagcacatcttac

SEQ ID NO: 427042 - DNA, 20 bp, Artificial
  CRISPR gRNA sequence
tgtaagaagcacatcttacc

SEQ ID NO: 427043 - DNA, 20 bp, Artificial
  CRISPR gRNA sequence
acctatatttcctaggaaga

SEQ ID NO: 427044 - DNA, 20 bp, Artificial
  CRISPR gRNA sequence
cctatatttcctaggaagac

SEQ ID NO: 427045 - DNA, 20 bp, Artificial
  CRISPR gRNA sequence
tatttcctaggaagaccagt

SEQ ID NO: 427046 - DNA, 20 bp, Artificial
  CRISPR gRNA sequence
cctaggaagaccagttgatg

SEQ ID NO: 427047 - DNA, 20 bp, Artificial
  CRISPR gRNA sequence
ctaggaagaccagttgatga

SEQ ID NO: 427048 - DNA, 20 bp, Artificial
  CRISPR gRNA sequence
ggaagaccagttgatgaggt

SEQ ID NO: 427049 - DNA, 20 bp, Artificial
  CRISPR gRNA sequence
atgaggtcatatgcaaaagt

SEQ ID NO: 427050 - DNA, 20 bp, Artificial
  CRISPR gRNA sequence
ccatttattggtttagtata

SEQ ID NO: 427051 - DNA, 20 bp, Artificial
  CRISPR gRNA sequence
attggtttagtataattgtg

SEQ ID NO: 427052 - DNA, 20 bp, Artificial
  CRISPR gRNA sequence
ttggtttagtataattgtgc

SEQ ID NO: 427053 - DNA, 20 bp, Artificial
  CRISPR gRNA sequence
gtttagtataattgtgcaaa

SEQ ID NO: 427054 - DNA, 20 bp, Artificial
  CRISPR gRNA sequence
agtataattgtgcaaattag

SEQ ID NO: 427055 - DNA, 20 bp, Artificial
  CRISPR gRNA sequence
gtataattgtgcaaattaga

SEQ ID NO: 427056 - DNA, 20 bp, Artificial
  CRISPR gRNA sequence
tgcaaattagaattaacccc

SEQ ID NO: 427057 - DNA, 20 bp, Artificial
  CRISPR gRNA sequence
gaattaacccctaagtgtat

SEQ ID NO: 427058 - DNA, 20 bp, Artificial
  CRISPR gRNA sequence
acccctaagtgtataaagag

SEQ ID NO: 427059 - DNA, 20 bp, Artificial
  CRISPR gRNA sequence
agtgtataaagagtagagct

SEQ ID NO: 427060 - DNA, 20 bp, Artificial
  CRISPR gRNA sequence
gttaaaaacatagcctgtgc

SEQ ID NO: 427061 - DNA, 20 bp, Artificial
  CRISPR gRNA sequence
aaaacatagcctgtgctaag

SEQ ID NO: 427062 - DNA, 20 bp, Artificial
  CRISPR gRNA sequence
tgctaagtttaattgtacag

SEQ ID NO: 427063 - DNA, 20 bp, Artificial
  CRISPR gRNA sequence
agtttaattgtacagtaatt

SEQ ID NO: 427064 - DNA, 20 bp, Artificial
  CRISPR gRNA sequence
aattgtacagtaatttacat

SEQ ID NO: 427065 - DNA, 20 bp, Artificial
  CRISPR gRNA sequence
attgtacagtaatttacatt

SEQ ID NO: 427066 - DNA, 20 bp, Artificial
  CRISPR gRNA sequence
tacagtaatttacatttgtg

SEQ ID NO: 427067 - DNA, 20 bp, Artificial
  CRISPR gRNA sequence
acatttgtgtggtacttcca

SEQ ID NO: 427068 - DNA, 20 bp, Artificial
  CRISPR gRNA sequence
catttgtgtggtacttccaa

SEQ ID NO: 427069 - DNA, 20 bp, Artificial
  CRISPR gRNA sequence
gtgtggtacttccaagtttc

SEQ ID NO: 427070 - DNA, 20 bp, Artificial
  CRISPR gRNA sequence
tgtggtacttccaagtttcc

SEQ ID NO: 427071 - DNA, 20 bp, Artificial
  CRISPR gRNA sequence
ccaagtttcccaaatgccct

SEQ ID NO: 427072 - DNA, 20 bp, Artificial
  CRISPR gRNA sequence
caagtttcccaaatgccctc

SEQ ID NO: 427073 - DNA, 20 bp, Artificial
  CRISPR gRNA sequence
cccaaatgccctcatatttg

SEQ ID NO: 427074 - DNA, 20 bp, Artificial
  CRISPR gRNA sequence
ccaaatgccctcatatttgt

SEQ ID NO: 427075 - DNA, 20 bp, Artificial
  CRISPR gRNA sequence
atatttgttatccacctgta

SEQ ID NO: 427076 - DNA, 20 bp, Artificial
  CRISPR gRNA sequence
gttatccacctgtacattta

SEQ ID NO: 427077 - DNA, 20 bp, Artificial
  CRISPR gRNA sequence
ttatccacctgtacatttaa

SEQ ID NO: 427078 - DNA, 20 bp, Artificial
  CRISPR gRNA sequence
tccacctgtacatttaaacc

SEQ ID NO: 427079 - DNA, 20 bp, Artificial
  CRISPR gRNA sequence
tacatttaaaccaattccca

SEQ ID NO: 427080 - DNA, 20 bp, Artificial
  CRISPR gRNA sequence
aaaccaattcccagaggtta

SEQ ID NO: 427081 - DNA, 20 bp, Artificial
  CRISPR gRNA sequence
aaccaattcccagaggttag

SEQ ID NO: 427082 - DNA, 20 bp, Artificial
  CRISPR gRNA sequence
ccagaggttagaaaaggatt

SEQ ID NO: 427083 - DNA, 20 bp, Artificial
  CRISPR gRNA sequence
gaaaaggattcttatcttat

SEQ ID NO: 427084 - DNA, 20 bp, Artificial
  CRISPR gRNA sequence
ttatcttatctgagagacag

SEQ ID NO: 427085 - DNA, 20 bp, Artificial
  CRISPR gRNA sequence
atcttatctgagagacagta

SEQ ID NO: 427086 - DNA, 20 bp, Artificial
  CRISPR gRNA sequence
tcttatctgagagacagtat

SEQ ID NO: 427087 - DNA, 20 bp, Artificial
  CRISPR gRNA sequence
atctgagagacagtatagca

SEQ ID NO: 427088 - DNA, 20 bp, Artificial
  CRISPR gRNA sequence
tctgagagacagtatagcac

SEQ ID NO: 427089 - DNA, 20 bp, Artificial
  CRISPR gRNA sequence
agagacagtatagcaccatg

SEQ ID NO: 427090 - DNA, 20 bp, Artificial
  CRISPR gRNA sequence
aaagctcagactctgacacc

SEQ ID NO: 427091 - DNA, 20 bp, Artificial
  CRISPR gRNA sequence
agactctgacaccagacagt

SEQ ID NO: 427092 - DNA, 20 bp, Artificial
  CRISPR gRNA sequence
tgacaccagacagtctgggt

SEQ ID NO: 427093 - DNA, 20 bp, Artificial
  CRISPR gRNA sequence
acaccagacagtctgggtgc

SEQ ID NO: 427094 - DNA, 20 bp, Artificial
  CRISPR gRNA sequence
ggtgcaaatcctggctctgc

SEQ ID NO: 427095 - DNA, 20 bp, Artificial
  CRISPR gRNA sequence
gctctgctgttgccctcaga

SEQ ID NO: 427096 - DNA, 20 bp, Artificial
  CRISPR gRNA sequence
tgctgttgccctcagacagg

SEQ ID NO: 427097 - DNA, 20 bp, Artificial
  CRISPR gRNA sequence
ctgttgccctcagacaggat

SEQ ID NO: 427098 - DNA, 20 bp, Artificial
  CRISPR gRNA sequence
ttgccctcagacaggatttc

SEQ ID NO: 427099 - DNA, 20 bp, Artificial
  CRISPR gRNA sequence
ccctcagacaggatttctta

SEQ ID NO: 427100 - DNA, 20 bp, Artificial
  CRISPR gRNA sequence
agacaggatttcttagcttc

SEQ ID NO: 427101 - DNA, 20 bp, Artificial
  CRISPR gRNA sequence
cttagcttctctgtgtatca

SEQ ID NO: 427102 - DNA, 20 bp, Artificial
  CRISPR gRNA sequence
ttagcttctctgtgtatcag

SEQ ID NO: 427103 - DNA, 20 bp, Artificial
  CRISPR gRNA sequence
agcttctctgtgtatcagtt

SEQ ID NO: 427104 - DNA, 20 bp, Artificial
  CRISPR gRNA sequence
gcttctctgtgtatcagttt

SEQ ID NO: 427105 - DNA, 20 bp, Artificial
  CRISPR gRNA sequence
ctctgtgtatcagttttctc

SEQ ID NO: 427106 - DNA, 20 bp, Artificial
  CRISPR gRNA sequence
tctgtgtatcagttttctca

SEQ ID NO: 427107 - DNA, 20 bp, Artificial
  CRISPR gRNA sequence
tgtgtatcagttttctcatc

SEQ ID NO: 427108 - DNA, 20 bp, Artificial
  CRISPR gRNA sequence
tgtatcagttttctcatctg

SEQ ID NO: 427109 - DNA, 20 bp, Artificial
  CRISPR gRNA sequence
tctcatctgtgaaaggagga

SEQ ID NO: 427110 - DNA, 20 bp, Artificial
  CRISPR gRNA sequence
ctcatctgtgaaaggaggat

SEQ ID NO: 427111 - DNA, 20 bp, Artificial
  CRISPR gRNA sequence
tcatctgtgaaaggaggatg

SEQ ID NO: 427112 - DNA, 20 bp, Artificial
  CRISPR gRNA sequence
atctgtgaaaggaggatgaa

SEQ ID NO: 427113 - DNA, 20 bp, Artificial
  CRISPR gRNA sequence
tgaaaggaggatgaatataa

SEQ ID NO: 427114 - DNA, 20 bp, Artificial
  CRISPR gRNA sequence
atgcgatgctaatgtaggat

SEQ ID NO: 427115 - DNA, 20 bp, Artificial
  CRISPR gRNA sequence
tgcgatgctaatgtaggatt

SEQ ID NO: 427116 - DNA, 20 bp, Artificial
  CRISPR gRNA sequence
atgtaggattaaattcccta

SEQ ID NO: 427117 - DNA, 20 bp, Artificial
  CRISPR gRNA sequence
aattccctactacaagaaaa

SEQ ID NO: 427118 - DNA, 20 bp, Artificial
  CRISPR gRNA sequence
cctactacaagaaaatggtc

SEQ ID NO: 427119 - DNA, 20 bp, Artificial
  CRISPR gRNA sequence
ctacaagaaaatggtcttag

SEQ ID NO: 427120 - DNA, 20 bp, Artificial
  CRISPR gRNA sequence
caagaaaatggtcttagaac

SEQ ID NO: 427121 - DNA, 20 bp, Artificial
  CRISPR gRNA sequence
agaacaatgcctggaacatg

SEQ ID NO: 427122 - DNA, 20 bp, Artificial
  CRISPR gRNA sequence
gaacaatgcctggaacatgg

SEQ ID NO: 427123 - DNA, 20 bp, Artificial
  CRISPR gRNA sequence
gaacatggtaagtgctgtat

SEQ ID NO: 427124 - DNA, 20 bp, Artificial
  CRISPR gRNA sequence
tataagtgttaactattagt

SEQ ID NO: 427125 - DNA, 20 bp, Artificial
  CRISPR gRNA sequence
actattagtatgattcccat

SEQ ID NO: 427126 - DNA, 20 bp, Artificial
  CRISPR gRNA sequence
ttagtatgattcccatttgt

SEQ ID NO: 427127 - DNA, 20 bp, Artificial
  CRISPR gRNA sequence
gtatgattcccatttgtttg

SEQ ID NO: 427128 - DNA, 20 bp, Artificial
  CRISPR gRNA sequence
ccatttgtttgatgcaggca

SEQ ID NO: 427129 - DNA, 20 bp, Artificial
  CRISPR gRNA sequence
gtttgatgcaggcagaagct

SEQ ID NO: 427130 - DNA, 20 bp, Artificial
  CRISPR gRNA sequence
tttgatgcaggcagaagctg

SEQ ID NO: 427131 - DNA, 20 bp, Artificial
  CRISPR gRNA sequence
gatgcaggcagaagctggag

SEQ ID NO: 427132 - DNA, 20 bp, Artificial
  CRISPR gRNA sequence
atgcaggcagaagctggagc

SEQ ID NO: 427133 - DNA, 20 bp, Artificial
  CRISPR gRNA sequence
gagcttggagttgctcagag

SEQ ID NO: 427134 - DNA, 20 bp, Artificial
  CRISPR gRNA sequence
ggagttgctcagagtggtag

SEQ ID NO: 427135 - DNA, 20 bp, Artificial
  CRISPR gRNA sequence
gagttgctcagagtggtaga

SEQ ID NO: 427136 - DNA, 20 bp, Artificial
  CRISPR gRNA sequence
ctcagagtggtagagctgat

SEQ ID NO: 427137 - DNA, 20 bp, Artificial
  CRISPR gRNA sequence
agagtggtagagctgatttt

SEQ ID NO: 427138 - DNA, 20 bp, Artificial
  CRISPR gRNA sequence
attttaacacagatgttttt

SEQ ID NO: 427139 - DNA, 20 bp, Artificial
  CRISPR gRNA sequence
taacacagatgtttttgttc

SEQ ID NO: 427140 - DNA, 20 bp, Artificial
  CRISPR gRNA sequence
aacacagatgtttttgttct

SEQ ID NO: 427141 - DNA, 20 bp, Artificial
  CRISPR gRNA sequence
acacagatgtttttgttcta

SEQ ID NO: 427142 - DNA, 20 bp, Artificial
  CRISPR gRNA sequence
ttgttctactaaactgcatc

SEQ ID NO: 427143 - DNA, 20 bp, Artificial
  CRISPR gRNA sequence
tgttctactaaactgcatcc

SEQ ID NO: 427144 - DNA, 20 bp, Artificial
  CRISPR gRNA sequence
gttctactaaactgcatcct

SEQ ID NO: 427145 - DNA, 20 bp, Artificial
  CRISPR gRNA sequence
ttctactaaactgcatcctc

SEQ ID NO: 427146 - DNA, 20 bp, Artificial
  CRISPR gRNA sequence
tactaaactgcatcctcaga

SEQ ID NO: 427147 - DNA, 20 bp, Artificial
  CRISPR gRNA sequence
ctaaactgcatcctcagaac

SEQ ID NO: 427148 - DNA, 20 bp, Artificial
  CRISPR gRNA sequence
aactgcatcctcagaactcc

SEQ ID NO: 427149 - DNA, 20 bp, Artificial
  CRISPR gRNA sequence
catcctcagaactcctattt

SEQ ID NO: 427150 - DNA, 20 bp, Artificial
  CRISPR gRNA sequence
agaactcctatttactgctg

SEQ ID NO: 427151 - DNA, 20 bp, Artificial
  CRISPR gRNA sequence
ctatttactgctgtcagtta

SEQ ID NO: 427152 - DNA, 20 bp, Artificial
  CRISPR gRNA sequence
tttactgctgtcagttatgt

SEQ ID NO: 427153 - DNA, 20 bp, Artificial
  CRISPR gRNA sequence
actgctgtcagttatgttga

SEQ ID NO: 427154 - DNA, 20 bp, Artificial
  CRISPR gRNA sequence
ctgctgtcagttatgttgaa

SEQ ID NO: 427155 - DNA, 20 bp, Artificial
  CRISPR gRNA sequence
ctgtcagttatgttgaagat

SEQ ID NO: 427156 - DNA, 20 bp, Artificial
  CRISPR gRNA sequence
tcagttatgttgaagattaa

SEQ ID NO: 427157 - DNA, 20 bp, Artificial
  CRISPR gRNA sequence
tgttgaagattaagttatat

SEQ ID NO: 427158 - DNA, 20 bp, Artificial
  CRISPR gRNA sequence
aagattaagttatatggttg

SEQ ID NO: 427159 - DNA, 20 bp, Artificial
  CRISPR gRNA sequence
agttatatggttgcaaaata

SEQ ID NO: 427160 - DNA, 20 bp, Artificial
  CRISPR gRNA sequence
tatggttgcaaaatatgtgt

SEQ ID NO: 427161 - DNA, 20 bp, Artificial
  CRISPR gRNA sequence
caaaatatgtgtaaactgag

SEQ ID NO: 427162 - DNA, 20 bp, Artificial
  CRISPR gRNA sequence
agaagataaaaggttacctt

SEQ ID NO: 427163 - DNA, 20 bp, Artificial
  CRISPR gRNA sequence
ccttaaagtttcctttcaaa

SEQ ID NO: 427164 - DNA, 20 bp, Artificial
  CRISPR gRNA sequence
aaagtttcctttcaaatgtt

SEQ ID NO: 427165 - DNA, 20 bp, Artificial
  CRISPR gRNA sequence
aagtttcctttcaaatgtta

SEQ ID NO: 427166 - DNA, 20 bp, Artificial
  CRISPR gRNA sequence
cctttcaaatgttacttctt

SEQ ID NO: 427167 - DNA, 20 bp, Artificial
  CRISPR gRNA sequence
ctttcaaatgttacttcttt

SEQ ID NO: 427168 - DNA, 20 bp, Artificial
  CRISPR gRNA sequence
tcaaatgttacttctttttt

SEQ ID NO: 427169 - DNA, 20 bp, Artificial
  CRISPR gRNA sequence
caaatgttacttcttttttt

SEQ ID NO: 427170 - DNA, 20 bp, Artificial
  CRISPR gRNA sequence
aaatgttacttctttttttt

SEQ ID NO: 427171 - DNA, 20 bp, Artificial
  CRISPR gRNA sequence
cttctttttttttttttttt

SEQ ID NO: 427172 - DNA, 20 bp, Artificial
  CRISPR gRNA sequence
cttttttttttttttttttt

SEQ ID NO: 427173 - DNA, 20 bp, Artificial
  CRISPR gRNA sequence
tttttttttttttttttttt

SEQ ID NO: 427174 - DNA, 20 bp, Artificial
  CRISPR gRNA sequence
tttttttttttttttttttg

SEQ ID NO: 427175 - DNA, 20 bp, Artificial
  CRISPR gRNA sequence
ttttttttttttttttttga

SEQ ID NO: 427176 - DNA, 20 bp, Artificial
  CRISPR gRNA sequence
tttttttttttttttttgag

SEQ ID NO: 427177 - DNA, 20 bp, Artificial
  CRISPR gRNA sequence
ttttttttttttttttgaga

SEQ ID NO: 427178 - DNA, 20 bp, Artificial
  CRISPR gRNA sequence
tttttttttttttttgagac

SEQ ID NO: 427179 - DNA, 20 bp, Artificial
  CRISPR gRNA sequence
ttttttttttttttgagacg

SEQ ID NO: 427180 - DNA, 20 bp, Artificial
  CRISPR gRNA sequence
tttttttttttttgagacgg

SEQ ID NO: 427181 - DNA, 20 bp, Artificial
  CRISPR gRNA sequence
ttttttttttttgagacgga

SEQ ID NO: 427182 - DNA, 20 bp, Artificial
  CRISPR gRNA sequence
tttttttttttgagacggag

SEQ ID NO: 427183 - DNA, 20 bp, Artificial
  CRISPR gRNA sequence
ttttttttttgagacggagt

SEQ ID NO: 427184 - DNA, 20 bp, Artificial
  CRISPR gRNA sequence
tttttttttgagacggagtt

SEQ ID NO: 427185 - DNA, 20 bp, Artificial
  CRISPR gRNA sequence
ttttttttgagacggagttt

SEQ ID NO: 427186 - DNA, 20 bp, Artificial
  CRISPR gRNA sequence
tttttttgagacggagtttc

SEQ ID NO: 427187 - DNA, 20 bp, Artificial
  CRISPR gRNA sequence
ttttttgagacggagtttcg

SEQ ID NO: 427188 - DNA, 20 bp, Artificial
  CRISPR gRNA sequence
tttttgagacggagtttcgc

SEQ ID NO: 427189 - DNA, 20 bp, Artificial
  CRISPR gRNA sequence
ttttgagacggagtttcgct

SEQ ID NO: 427190 - DNA, 20 bp, Artificial
  CRISPR gRNA sequence
tttgagacggagtttcgctc

SEQ ID NO: 427191 - DNA, 20 bp, Artificial
  CRISPR gRNA sequence
ttgagacggagtttcgctct

SEQ ID NO: 427192 - DNA, 20 bp, Artificial
  CRISPR gRNA sequence
tgagacggagtttcgctctt

SEQ ID NO: 427193 - DNA, 20 bp, Artificial
  CRISPR gRNA sequence
gagacggagtttcgctcttg

SEQ ID NO: 427194 - DNA, 20 bp, Artificial
  CRISPR gRNA sequence
agacggagtttcgctcttgt

SEQ ID NO: 427195 - DNA, 20 bp, Artificial
  CRISPR gRNA sequence
cgctcttgttgcccaggctg

SEQ ID NO: 427196 - DNA, 20 bp, Artificial
  CRISPR gRNA sequence
gctcttgttgcccaggctgg

SEQ ID NO: 427197 - DNA, 20 bp, Artificial
  CRISPR gRNA sequence
ttgttgcccaggctggagtg

SEQ ID NO: 427198 - DNA, 20 bp, Artificial
  CRISPR gRNA sequence
gttgcccaggctggagtgca

SEQ ID NO: 427199 - DNA, 20 bp, Artificial
  CRISPR gRNA sequence
ttgcccaggctggagtgcaa

SEQ ID NO: 427200 - DNA, 20 bp, Artificial
  CRISPR gRNA sequence
cccaggctggagtgcaatgg

SEQ ID NO: 427201 - DNA, 20 bp, Artificial
  CRISPR gRNA sequence
gagtgcaatggcgcaatctc

SEQ ID NO: 427202 - DNA, 20 bp, Artificial
  CRISPR gRNA sequence
agctcactgcaacttccgcc

SEQ ID NO: 427203 - DNA, 20 bp, Artificial
  CRISPR gRNA sequence
actgcaacttccgcctcctg

SEQ ID NO: 427204 - DNA, 20 bp, Artificial
  CRISPR gRNA sequence
caacttccgcctcctgagtt

SEQ ID NO: 427205 - DNA, 20 bp, Artificial
  CRISPR gRNA sequence
ccgcctcctgagttcaagcg

SEQ ID NO: 427206 - DNA, 20 bp, Artificial
  CRISPR gRNA sequence
cgcctcctgagttcaagcga

SEQ ID NO: 427207 - DNA, 20 bp, Artificial
  CRISPR gRNA sequence
ctgagttcaagcgattctct

SEQ ID NO: 427208 - DNA, 20 bp, Artificial
  CRISPR gRNA sequence
agttcaagcgattctctcct

SEQ ID NO: 427209 - DNA, 20 bp, Artificial
  CRISPR gRNA sequence
aagcgattctctcctgcctc

SEQ ID NO: 427210 - DNA, 20 bp, Artificial
  CRISPR gRNA sequence
tctcctgcctcagcctcctg

SEQ ID NO: 427211 - DNA, 20 bp, Artificial
  CRISPR gRNA sequence
tcctgcctcagcctcctgag

SEQ ID NO: 427212 - DNA, 20 bp, Artificial
  CRISPR gRNA sequence
ctgcctcagcctcctgagta

SEQ ID NO: 427213 - DNA, 20 bp, Artificial
  CRISPR gRNA sequence
cctcagcctcctgagtatct

SEQ ID NO: 427214 - DNA, 20 bp, Artificial
  CRISPR gRNA sequence
agcctcctgagtatctggga

SEQ ID NO: 427215 - DNA, 20 bp, Artificial
  CRISPR gRNA sequence
ctgagtatctgggattacag

SEQ ID NO: 427216 - DNA, 20 bp, Artificial
  CRISPR gRNA sequence
agtatctgggattacaggca

SEQ ID NO: 427217 - DNA, 20 bp, Artificial
  CRISPR gRNA sequence
ggattacaggcacccaccac

SEQ ID NO: 427218 - DNA, 20 bp, Artificial
  CRISPR gRNA sequence
caggcacccaccaccatgcc

SEQ ID NO: 427219 - DNA, 20 bp, Artificial
  CRISPR gRNA sequence
attttgtatttttagtagag

SEQ ID NO: 427220 - DNA, 20 bp, Artificial
  CRISPR gRNA sequence
tgtatttttagtagagacag

SEQ ID NO: 427221 - DNA, 20 bp, Artificial
  CRISPR gRNA sequence
gtatttttagtagagacagg

SEQ ID NO: 427222 - DNA, 20 bp, Artificial
  CRISPR gRNA sequence
tatttttagtagagacaggg

SEQ ID NO: 427223 - DNA, 20 bp, Artificial
  CRISPR gRNA sequence
ttagtagagacagggtttct

SEQ ID NO: 427224 - DNA, 20 bp, Artificial
  CRISPR gRNA sequence
tagtagagacagggtttctt

SEQ ID NO: 427225 - DNA, 20 bp, Artificial
  CRISPR gRNA sequence
agtagagacagggtttcttc

SEQ ID NO: 427226 - DNA, 20 bp, Artificial
  CRISPR gRNA sequence
gtagagacagggtttcttca

SEQ ID NO: 427227 - DNA, 20 bp, Artificial
  CRISPR gRNA sequence
cttcacgttggtcaggctgg

SEQ ID NO: 427228 - DNA, 20 bp, Artificial
  CRISPR gRNA sequence
ttcacgttggtcaggctggt

SEQ ID NO: 427229 - DNA, 20 bp, Artificial
  CRISPR gRNA sequence
cacgttggtcaggctggtct

SEQ ID NO: 427230 - DNA, 20 bp, Artificial
  CRISPR gRNA sequence
acgttggtcaggctggtctc

SEQ ID NO: 427231 - DNA, 20 bp, Artificial
  CRISPR gRNA sequence
gtcaggctggtctcaaactc

SEQ ID NO: 427232 - DNA, 20 bp, Artificial
  CRISPR gRNA sequence
gtctcaaactcccgacctcc

SEQ ID NO: 427233 - DNA, 20 bp, Artificial
  CRISPR gRNA sequence
aaactcccgacctccagtga

SEQ ID NO: 427234 - DNA, 20 bp, Artificial
  CRISPR gRNA sequence
ccgacctccagtgatctgcc

SEQ ID NO: 427235 - DNA, 20 bp, Artificial
  CRISPR gRNA sequence
cagtgatctgcccgcctcag

SEQ ID NO: 427236 - DNA, 20 bp, Artificial
  CRISPR gRNA sequence
cccgcctcagcctcccaaag

SEQ ID NO: 427237 - DNA, 20 bp, Artificial
  CRISPR gRNA sequence
agcctcccaaagtgttactt

SEQ ID NO: 427238 - DNA, 20 bp, Artificial
  CRISPR gRNA sequence
ccaaagtgttacttcttaac

SEQ ID NO: 427239 - DNA, 20 bp, Artificial
  CRISPR gRNA sequence
cttcttaactgatttcacat

SEQ ID NO: 427240 - DNA, 20 bp, Artificial
  CRISPR gRNA sequence
cttaactgatttcacatagg

SEQ ID NO: 427241 - DNA, 20 bp, Artificial
  CRISPR gRNA sequence
ttaactgatttcacataggc

SEQ ID NO: 427242 - DNA, 20 bp, Artificial
  CRISPR gRNA sequence
aactgatttcacataggcca

SEQ ID NO: 427243 - DNA, 20 bp, Artificial
  CRISPR gRNA sequence
actgatttcacataggccaa

SEQ ID NO: 427244 - DNA, 20 bp, Artificial
  CRISPR gRNA sequence
atttcacataggccaaacaa

SEQ ID NO: 427245 - DNA, 20 bp, Artificial
  CRISPR gRNA sequence
cacataggccaaacaaagac

SEQ ID NO: 427246 - DNA, 20 bp, Artificial
  CRISPR gRNA sequence
acataggccaaacaaagact

SEQ ID NO: 427247 - DNA, 20 bp, Artificial
  CRISPR gRNA sequence
gttaagagttgaggctctgg

SEQ ID NO: 427248 - DNA, 20 bp, Artificial
  CRISPR gRNA sequence
agagttgaggctctggaatt

SEQ ID NO: 427249 - DNA, 20 bp, Artificial
  CRISPR gRNA sequence
aggctctggaattgcactgt

SEQ ID NO: 427250 - DNA, 20 bp, Artificial
  CRISPR gRNA sequence
tggaattgcactgtctgggg

SEQ ID NO: 427251 - DNA, 20 bp, Artificial
  CRISPR gRNA sequence
gaattgcactgtctggggtt

SEQ ID NO: 427252 - DNA, 20 bp, Artificial
  CRISPR gRNA sequence
cactgtctggggttgactat

SEQ ID NO: 427253 - DNA, 20 bp, Artificial
  CRISPR gRNA sequence
tctggggttgactattgcag

SEQ ID NO: 427254 - DNA, 20 bp, Artificial
  CRISPR gRNA sequence
gggttgactattgcagttga

SEQ ID NO: 427255 - DNA, 20 bp, Artificial
  CRISPR gRNA sequence
actattgcagttgaccccac

SEQ ID NO: 427256 - DNA, 20 bp, Artificial
  CRISPR gRNA sequence
ttgcagttgaccccacgaag

SEQ ID NO: 427257 - DNA, 20 bp, Artificial
  CRISPR gRNA sequence
cagttgaccccacgaagtct

SEQ ID NO: 427258 - DNA, 20 bp, Artificial
  CRISPR gRNA sequence
accccacgaagtctgggtaa

SEQ ID NO: 427259 - DNA, 20 bp, Artificial
  CRISPR gRNA sequence
ggtaaattatgtactttttt

SEQ ID NO: 427260 - DNA, 20 bp, Artificial
  CRISPR gRNA sequence
tgtactttttttctcagttt

SEQ ID NO: 427261 - DNA, 20 bp, Artificial
  CRISPR gRNA sequence
tttttctcagttttcttgtc

SEQ ID NO: 427262 - DNA, 20 bp, Artificial
  CRISPR gRNA sequence
ttttctcagttttcttgtcg

SEQ ID NO: 427263 - DNA, 20 bp, Artificial
  CRISPR gRNA sequence
tttctcagttttcttgtcga

SEQ ID NO: 427264 - DNA, 20 bp, Artificial
  CRISPR gRNA sequence
ttctcagttttcttgtcgat

SEQ ID NO: 427265 - DNA, 20 bp, Artificial
  CRISPR gRNA sequence
tctcagttttcttgtcgata

SEQ ID NO: 427266 - DNA, 20 bp, Artificial
  CRISPR gRNA sequence
ctcagttttcttgtcgataa

SEQ ID NO: 427267 - DNA, 20 bp, Artificial
  CRISPR gRNA sequence
tcagttttcttgtcgataaa

SEQ ID NO: 427268 - DNA, 20 bp, Artificial
  CRISPR gRNA sequence
agttttcttgtcgataaaat

SEQ ID NO: 427269 - DNA, 20 bp, Artificial
  CRISPR gRNA sequence
tcttgtcgataaaatgtggc

SEQ ID NO: 427270 - DNA, 20 bp, Artificial
  CRISPR gRNA sequence
cttgtcgataaaatgtggca

SEQ ID NO: 427271 - DNA, 20 bp, Artificial
  CRISPR gRNA sequence
ttgtcgataaaatgtggcaa

SEQ ID NO: 427272 - DNA, 20 bp, Artificial
  CRISPR gRNA sequence
gtcgataaaatgtggcaaat

SEQ ID NO: 427273 - DNA, 20 bp, Artificial
  CRISPR gRNA sequence
tcgataaaatgtggcaaata

SEQ ID NO: 427274 - DNA, 20 bp, Artificial
  CRISPR gRNA sequence
catgagctgatacaagtaag

SEQ ID NO: 427275 - DNA, 20 bp, Artificial
  CRISPR gRNA sequence
atgagctgatacaagtaagg

SEQ ID NO: 427276 - DNA, 20 bp, Artificial
  CRISPR gRNA sequence
atacaagtaaggtcttacaa

SEQ ID NO: 427277 - DNA, 20 bp, Artificial
  CRISPR gRNA sequence
acaacagtgctagataggta

SEQ ID NO: 427278 - DNA, 20 bp, Artificial
  CRISPR gRNA sequence
caacagtgctagataggtaa

SEQ ID NO: 427279 - DNA, 20 bp, Artificial
  CRISPR gRNA sequence
gataggtaataagcttaact

SEQ ID NO: 427280 - DNA, 20 bp, Artificial
  CRISPR gRNA sequence
aacttcataagggctagttt

SEQ ID NO: 427281 - DNA, 20 bp, Artificial
  CRISPR gRNA sequence
acttcataagggctagtttt

SEQ ID NO: 427282 - DNA, 20 bp, Artificial
  CRISPR gRNA sequence
cataagggctagtttttatg

SEQ ID NO: 427283 - DNA, 20 bp, Artificial
  CRISPR gRNA sequence
ataagggctagtttttatgc

SEQ ID NO: 427284 - DNA, 20 bp, Artificial
  CRISPR gRNA sequence
gtttttatgctatttattgg

SEQ ID NO: 427285 - DNA, 20 bp, Artificial
  CRISPR gRNA sequence
ttatgctatttattggttca

SEQ ID NO: 427286 - DNA, 20 bp, Artificial
  CRISPR gRNA sequence
tatgctatttattggttcat

SEQ ID NO: 427287 - DNA, 20 bp, Artificial
  CRISPR gRNA sequence
atgctatttattggttcatg

SEQ ID NO: 427288 - DNA, 20 bp, Artificial
  CRISPR gRNA sequence
tgctatttattggttcatgg

SEQ ID NO: 427289 - DNA, 20 bp, Artificial
  CRISPR gRNA sequence
tttattggttcatggttaga

SEQ ID NO: 427290 - DNA, 20 bp, Artificial
  CRISPR gRNA sequence
attggttcatggttagagga

SEQ ID NO: 427291 - DNA, 20 bp, Artificial
  CRISPR gRNA sequence
ttggttcatggttagaggag

SEQ ID NO: 427292 - DNA, 20 bp, Artificial
  CRISPR gRNA sequence
gttcatggttagaggaggcc

SEQ ID NO: 427293 - DNA, 20 bp, Artificial
  CRISPR gRNA sequence
atggttagaggaggcctggg

SEQ ID NO: 427294 - DNA, 20 bp, Artificial
  CRISPR gRNA sequence
gaggaggcctgggacaataa

SEQ ID NO: 427295 - DNA, 20 bp, Artificial
  CRISPR gRNA sequence
ggacaataagcagggcaggg

SEQ ID NO: 427296 - DNA, 20 bp, Artificial
  CRISPR gRNA sequence
gattctggcaaagtaaccaa

SEQ ID NO: 427297 - DNA, 20 bp, Artificial
  CRISPR gRNA sequence
tggcaaagtaaccaagtgat

SEQ ID NO: 427298 - DNA, 20 bp, Artificial
  CRISPR gRNA sequence
gcaaagtaaccaagtgatgg

SEQ ID NO: 427299 - DNA, 20 bp, Artificial
  CRISPR gRNA sequence
gaccattctgggctctttac

SEQ ID NO: 427300 - DNA, 20 bp, Artificial
  CRISPR gRNA sequence
accattctgggctctttacc

SEQ ID NO: 427301 - DNA, 20 bp, Artificial
  CRISPR gRNA sequence
tgggctctttaccccagtgt

SEQ ID NO: 427302 - DNA, 20 bp, Artificial
  CRISPR gRNA sequence
ggctctttaccccagtgtca

SEQ ID NO: 427303 - DNA, 20 bp, Artificial
  CRISPR gRNA sequence
tttaccccagtgtcatatgc

SEQ ID NO: 427304 - DNA, 20 bp, Artificial
  CRISPR gRNA sequence
taccccagtgtcatatgcca

SEQ ID NO: 427305 - DNA, 20 bp, Artificial
  CRISPR gRNA sequence
accccagtgtcatatgccag

SEQ ID NO: 427306 - DNA, 20 bp, Artificial
  CRISPR gRNA sequence
ccccagtgtcatatgccaga

SEQ ID NO: 427307 - DNA, 20 bp, Artificial
  CRISPR gRNA sequence
atcaggcagaaggcccctgt

SEQ ID NO: 427308 - DNA, 20 bp, Artificial
  CRISPR gRNA sequence
tggagtggtagtaccagcaa

SEQ ID NO: 427309 - DNA, 20 bp, Artificial
  CRISPR gRNA sequence
aagaccaaatgggagctatg

SEQ ID NO: 427310 - DNA, 20 bp, Artificial
  CRISPR gRNA sequence
tgtctggttgctaatctcca

SEQ ID NO: 427311 - DNA, 20 bp, Artificial
  CRISPR gRNA sequence
gttgctaatctccaggccag

SEQ ID NO: 427312 - DNA, 20 bp, Artificial
  CRISPR gRNA sequence
ctaatctccaggccaggcca

SEQ ID NO: 427313 - DNA, 20 bp, Artificial
  CRISPR gRNA sequence
atctccaggccaggccattc

SEQ ID NO: 427314 - DNA, 20 bp, Artificial
  CRISPR gRNA sequence
caggccaggccattcatgga

SEQ ID NO: 427315 - DNA, 20 bp, Artificial
  CRISPR gRNA sequence
atggagatcggtggtcctga

SEQ ID NO: 427316 - DNA, 20 bp, Artificial
  CRISPR gRNA sequence
acatgcacactcctccccaa

SEQ ID NO: 427317 - DNA, 20 bp, Artificial
  CRISPR gRNA sequence
ctccccaagaccacagtggc

SEQ ID NO: 427318 - DNA, 20 bp, Artificial
  CRISPR gRNA sequence
cccaagaccacagtggcacg

SEQ ID NO: 427319 - DNA, 20 bp, Artificial
  CRISPR gRNA sequence
tttcccagcctgaacctggg

SEQ ID NO: 427320 - DNA, 20 bp, Artificial
  CRISPR gRNA sequence
cccagcctgaacctggggaa

SEQ ID NO: 427321 - DNA, 20 bp, Artificial
  CRISPR gRNA sequence
ccagcctgaacctggggaaa

SEQ ID NO: 427322 - DNA, 20 bp, Artificial
  CRISPR gRNA sequence
aacctggggaaatgaaggtg

SEQ ID NO: 427323 - DNA, 20 bp, Artificial
  CRISPR gRNA sequence
gggaaatgaaggtgcaaatt

SEQ ID NO: 427324 - DNA, 20 bp, Artificial
  CRISPR gRNA sequence
cttctctgtggctcatggac

SEQ ID NO: 427325 - DNA, 20 bp, Artificial
  CRISPR gRNA sequence
ttctctgtggctcatggacc

SEQ ID NO: 427326 - DNA, 20 bp, Artificial
  CRISPR gRNA sequence
ctctgtggctcatggacccc

SEQ ID NO: 427327 - DNA, 20 bp, Artificial
  CRISPR gRNA sequence
tctgtggctcatggacccct

SEQ ID NO: 427328 - DNA, 20 bp, Artificial
  CRISPR gRNA sequence
tgtggctcatggacccctgg

SEQ ID NO: 427329 - DNA, 20 bp, Artificial
  CRISPR gRNA sequence
tggctcatggacccctgggg

SEQ ID NO: 427330 - DNA, 20 bp, Artificial
  CRISPR gRNA sequence
atggacccctggggagagag

SEQ ID NO: 427331 - DNA, 20 bp, Artificial
  CRISPR gRNA sequence
gggagagagatcagaagatg

SEQ ID NO: 427332 - DNA, 20 bp, Artificial
  CRISPR gRNA sequence
tattggacccctgtgcagcc

SEQ ID NO: 427333 - DNA, 20 bp, Artificial
  CRISPR gRNA sequence
ttggacccctgtgcagcctc

SEQ ID NO: 427334 - DNA, 20 bp, Artificial
  CRISPR gRNA sequence
gacccctgtgcagcctcccc

SEQ ID NO: 427335 - DNA, 20 bp, Artificial
  CRISPR gRNA sequence
tgcagcctccccacaaagcc

SEQ ID NO: 427336 - DNA, 20 bp, Artificial
  CRISPR gRNA sequence
cccacaaagcctgtatgttt

SEQ ID NO: 427337 - DNA, 20 bp, Artificial
  CRISPR gRNA sequence
tatgtttccacccttttgcc

SEQ ID NO: 427338 - DNA, 20 bp, Artificial
  CRISPR gRNA sequence
ccacccttttgccattgcag

SEQ ID NO: 427339 - DNA, 20 bp, Artificial
  CRISPR gRNA sequence
cacccttttgccattgcaga

SEQ ID NO: 427340 - DNA, 20 bp, Artificial
  CRISPR gRNA sequence
ttgccattgcagactccagg

SEQ ID NO: 427341 - DNA, 20 bp, Artificial
  CRISPR gRNA sequence
tgccattgcagactccaggg

SEQ ID NO: 427342 - DNA, 20 bp, Artificial
  CRISPR gRNA sequence
gccattgcagactccaggga

SEQ ID NO: 427343 - DNA, 20 bp, Artificial
  CRISPR gRNA sequence
ccattgcagactccagggaa

SEQ ID NO: 427344 - DNA, 20 bp, Artificial
  CRISPR gRNA sequence
cagactccagggaacaccat

SEQ ID NO: 427345 - DNA, 20 bp, Artificial
  CRISPR gRNA sequence
cagggaacaccattggtcac

SEQ ID NO: 427346 - DNA, 20 bp, Artificial
  CRISPR gRNA sequence
gtcactcggctcttccctct

SEQ ID NO: 427347 - DNA, 20 bp, Artificial
  CRISPR gRNA sequence
ggctcttccctcttgtttcc

SEQ ID NO: 427348 - DNA, 20 bp, Artificial
  CRISPR gRNA sequence
ttccctcttgtttcccaagt

SEQ ID NO: 427349 - DNA, 20 bp, Artificial
  CRISPR gRNA sequence
ccctcttgtttcccaagtgg

SEQ ID NO: 427350 - DNA, 20 bp, Artificial
  CRISPR gRNA sequence
cctcttgtttcccaagtggt

SEQ ID NO: 427351 - DNA, 20 bp, Artificial
  CRISPR gRNA sequence
ttgtttcccaagtggtcagt

SEQ ID NO: 427352 - DNA, 20 bp, Artificial
  CRISPR gRNA sequence
gtttcccaagtggtcagttg

SEQ ID NO: 427353 - DNA, 20 bp, Artificial
  CRISPR gRNA sequence
tttcccaagtggtcagttgc

SEQ ID NO: 427354 - DNA, 20 bp, Artificial
  CRISPR gRNA sequence
cccaagtggtcagttgctta

SEQ ID NO: 427355 - DNA, 20 bp, Artificial
  CRISPR gRNA sequence
ccaagtggtcagttgcttat

SEQ ID NO: 427356 - DNA, 20 bp, Artificial
  CRISPR gRNA sequence
cttatgtggaatgcaaactc

SEQ ID NO: 427357 - DNA, 20 bp, Artificial
  CRISPR gRNA sequence
atgtggaatgcaaactctcc

SEQ ID NO: 427358 - DNA, 20 bp, Artificial
  CRISPR gRNA sequence
tgtggaatgcaaactctcct

SEQ ID NO: 427359 - DNA, 20 bp, Artificial
  CRISPR gRNA sequence
tccttaattacttgcattag

SEQ ID NO: 427360 - DNA, 20 bp, Artificial
  CRISPR gRNA sequence
cttaattacttgcattagca

SEQ ID NO: 427361 - DNA, 20 bp, Artificial
  CRISPR gRNA sequence
aattacttgcattagcacaa

SEQ ID NO: 427362 - DNA, 20 bp, Artificial
  CRISPR gRNA sequence
attacttgcattagcacaaa

SEQ ID NO: 427363 - DNA, 20 bp, Artificial
  CRISPR gRNA sequence
cttgcattagcacaaaccct

SEQ ID NO: 427364 - DNA, 20 bp, Artificial
  CRISPR gRNA sequence
gcattagcacaaaccctggc

SEQ ID NO: 427365 - DNA, 20 bp, Artificial
  CRISPR gRNA sequence
cattagcacaaaccctggct

SEQ ID NO: 427366 - DNA, 20 bp, Artificial
  CRISPR gRNA sequence
gcacaaaccctggcttcttt

SEQ ID NO: 427367 - DNA, 20 bp, Artificial
  CRISPR gRNA sequence
gcttctttttgaacctaatc

SEQ ID NO: 427368 - DNA, 20 bp, Artificial
  CRISPR gRNA sequence
ctttttgaacctaatctcaa

SEQ ID NO: 427369 - DNA, 20 bp, Artificial
  CRISPR gRNA sequence
tttttgaacctaatctcaaa

SEQ ID NO: 427370 - DNA, 20 bp, Artificial
  CRISPR gRNA sequence
tttgaacctaatctcaaacc

SEQ ID NO: 427371 - DNA, 20 bp, Artificial
  CRISPR gRNA sequence
ttgaacctaatctcaaacct

SEQ ID NO: 427372 - DNA, 20 bp, Artificial
  CRISPR gRNA sequence
tgaacctaatctcaaacctt

SEQ ID NO: 427373 - DNA, 20 bp, Artificial
  CRISPR gRNA sequence
gaacctaatctcaaacctta

SEQ ID NO: 427374 - DNA, 20 bp, Artificial
  CRISPR gRNA sequence
aacctaatctcaaaccttag

SEQ ID NO: 427375 - DNA, 20 bp, Artificial
  CRISPR gRNA sequence
atctcaaaccttagtccaag

SEQ ID NO: 427376 - DNA, 20 bp, Artificial
  CRISPR gRNA sequence
aaaccttagtccaagtccct

SEQ ID NO: 427377 - DNA, 20 bp, Artificial
  CRISPR gRNA sequence
agtccaagtccctatcctaa

SEQ ID NO: 427378 - DNA, 20 bp, Artificial
  CRISPR gRNA sequence
gtccaagtccctatcctaat

SEQ ID NO: 427379 - DNA, 20 bp, Artificial
  CRISPR gRNA sequence
tcctaatactatctgtaata

SEQ ID NO: 427380 - DNA, 20 bp, Artificial
  CRISPR gRNA sequence
atactatctgtaatatttaa

SEQ ID NO: 427381 - DNA, 20 bp, Artificial
  CRISPR gRNA sequence
tctgtaatatttaagctatt

SEQ ID NO: 427382 - DNA, 20 bp, Artificial
  CRISPR gRNA sequence
taatatttaagctattccta

SEQ ID NO: 427383 - DNA, 20 bp, Artificial
  CRISPR gRNA sequence
aagctattcctaaccttaat

SEQ ID NO: 427384 - DNA, 20 bp, Artificial
  CRISPR gRNA sequence
agctattcctaaccttaatg

SEQ ID NO: 427385 - DNA, 20 bp, Artificial
  CRISPR gRNA sequence
ttcctaaccttaatgctaaa

SEQ ID NO: 427386 - DNA, 20 bp, Artificial
  CRISPR gRNA sequence
ctaaccttaatgctaaaatt

SEQ ID NO: 427387 - DNA, 20 bp, Artificial
  CRISPR gRNA sequence
accttaatgctaaaattgta

SEQ ID NO: 427388 - DNA, 20 bp, Artificial
  CRISPR gRNA sequence
aatgctaaaattgtacttaa

SEQ ID NO: 427389 - DNA, 20 bp, Artificial
  CRISPR gRNA sequence
atgctaaaattgtacttaac

SEQ ID NO: 427390 - DNA, 20 bp, Artificial
  CRISPR gRNA sequence
aaattgtacttaaccccaaa

SEQ ID NO: 427391 - DNA, 20 bp, Artificial
  CRISPR gRNA sequence
tacttaaccccaaagtcaac

SEQ ID NO: 427392 - DNA, 20 bp, Artificial
  CRISPR gRNA sequence
aaccccaaagtcaacctggt

SEQ ID NO: 427393 - DNA, 20 bp, Artificial
  CRISPR gRNA sequence
accccaaagtcaacctggtt

SEQ ID NO: 427394 - DNA, 20 bp, Artificial
  CRISPR gRNA sequence
gttaataggcagaagtttta

SEQ ID NO: 427395 - DNA, 20 bp, Artificial
  CRISPR gRNA sequence
ataggcagaagttttaagta

SEQ ID NO: 427396 - DNA, 20 bp, Artificial
  CRISPR gRNA sequence
taagtaacccttatacagag

SEQ ID NO: 427397 - DNA, 20 bp, Artificial
  CRISPR gRNA sequence
aagtaacccttatacagagt

SEQ ID NO: 427398 - DNA, 20 bp, Artificial
  CRISPR gRNA sequence
agtaacccttatacagagtc

SEQ ID NO: 427399 - DNA, 20 bp, Artificial
  CRISPR gRNA sequence
atacagagtctgccccttcc

SEQ ID NO: 427400 - DNA, 20 bp, Artificial
  CRISPR gRNA sequence
tacagagtctgccccttccc

SEQ ID NO: 427401 - DNA, 20 bp, Artificial
  CRISPR gRNA sequence
ccccttccccaccctgcatg

SEQ ID NO: 427402 - DNA, 20 bp, Artificial
  CRISPR gRNA sequence
ccccaccctgcatgtagtga

SEQ ID NO: 427403 - DNA, 20 bp, Artificial
  CRISPR gRNA sequence
cccaccctgcatgtagtgat

SEQ ID NO: 427404 - DNA, 20 bp, Artificial
  CRISPR gRNA sequence
catgtagtgatgtcatgctt

SEQ ID NO: 427405 - DNA, 20 bp, Artificial
  CRISPR gRNA sequence
actcagggctgcttctgttt

SEQ ID NO: 427406 - DNA, 20 bp, Artificial
  CRISPR gRNA sequence
ctcagggctgcttctgtttc

SEQ ID NO: 427407 - DNA, 20 bp, Artificial
  CRISPR gRNA sequence
agggctgcttctgtttcaaa

SEQ ID NO: 427408 - DNA, 20 bp, Artificial
  CRISPR gRNA sequence
cttctgtttcaaagaccttg

SEQ ID NO: 427409 - DNA, 20 bp, Artificial
  CRISPR gRNA sequence
ctgtttcaaagaccttgata

SEQ ID NO: 427410 - DNA, 20 bp, Artificial
  CRISPR gRNA sequence
tgtttcaaagaccttgatat

SEQ ID NO: 427411 - DNA, 20 bp, Artificial
  CRISPR gRNA sequence
tttcaaagaccttgatatct

SEQ ID NO: 427412 - DNA, 20 bp, Artificial
  CRISPR gRNA sequence
caaagaccttgatatctttg

SEQ ID NO: 427413 - DNA, 20 bp, Artificial
  CRISPR gRNA sequence
aaagaccttgatatctttgt

SEQ ID NO: 427414 - DNA, 20 bp, Artificial
  CRISPR gRNA sequence
gatatctttgttctatgacc

SEQ ID NO: 427415 - DNA, 20 bp, Artificial
  CRISPR gRNA sequence
atatctttgttctatgacca

SEQ ID NO: 427416 - DNA, 20 bp, Artificial
  CRISPR gRNA sequence
tgttctatgaccataactgt

SEQ ID NO: 427417 - DNA, 20 bp, Artificial
  CRISPR gRNA sequence
gttctatgaccataactgtg

SEQ ID NO: 427418 - DNA, 20 bp, Artificial
  CRISPR gRNA sequence
ttctatgaccataactgtga

SEQ ID NO: 427419 - DNA, 20 bp, Artificial
  CRISPR gRNA sequence
tatgaccataactgtgaatg

SEQ ID NO: 427420 - DNA, 20 bp, Artificial
  CRISPR gRNA sequence
tgaccataactgtgaatgga

SEQ ID NO: 427421 - DNA, 20 bp, Artificial
  CRISPR gRNA sequence
tgaatggagacattggtgct

SEQ ID NO: 427422 - DNA, 20 bp, Artificial
  CRISPR gRNA sequence
gtgcttttatttcaaaccaa

SEQ ID NO: 427423 - DNA, 20 bp, Artificial
  CRISPR gRNA sequence
ttatttcaaaccaaaaattc

SEQ ID NO: 427424 - DNA, 20 bp, Artificial
  CRISPR gRNA sequence
tatttcaaaccaaaaattcc

SEQ ID NO: 427425 - DNA, 20 bp, Artificial
  CRISPR gRNA sequence
atttcaaaccaaaaattcca

SEQ ID NO: 427426 - DNA, 20 bp, Artificial
  CRISPR gRNA sequence
tttcaaaccaaaaattccaa

SEQ ID NO: 427427 - DNA, 20 bp, Artificial
  CRISPR gRNA sequence
caaaccaaaaattccaaatg

SEQ ID NO: 427428 - DNA, 20 bp, Artificial
  CRISPR gRNA sequence
aaaccaaaaattccaaatga

SEQ ID NO: 427429 - DNA, 20 bp, Artificial
  CRISPR gRNA sequence
caaatgaaattgatacatct

SEQ ID NO: 427430 - DNA, 20 bp, Artificial
  CRISPR gRNA sequence
atacatctaatatcccaagt

SEQ ID NO: 427431 - DNA, 20 bp, Artificial
  CRISPR gRNA sequence
atatcccaagttccactctg

SEQ ID NO: 427432 - DNA, 20 bp, Artificial
  CRISPR gRNA sequence
cactctggtcccaattgtat

SEQ ID NO: 427433 - DNA, 20 bp, Artificial
  CRISPR gRNA sequence
tggtcccaattgtatctcga

SEQ ID NO: 427434 - DNA, 20 bp, Artificial
  CRISPR gRNA sequence
gtcccaattgtatctcgaac

SEQ ID NO: 427435 - DNA, 20 bp, Artificial
  CRISPR gRNA sequence
tatctcgaacttatccttaa

SEQ ID NO: 427436 - DNA, 20 bp, Artificial
  CRISPR gRNA sequence
gaacttatccttaaacctaa

SEQ ID NO: 427437 - DNA, 20 bp, Artificial
  CRISPR gRNA sequence
atccttaaacctaaccaaac

SEQ ID NO: 427438 - DNA, 20 bp, Artificial
  CRISPR gRNA sequence
tccttaaacctaaccaaact

SEQ ID NO: 427439 - DNA, 20 bp, Artificial
  CRISPR gRNA sequence
aaacctaaccaaactcatta

SEQ ID NO: 427440 - DNA, 20 bp, Artificial
  CRISPR gRNA sequence
aacctaaccaaactcattat

SEQ ID NO: 427441 - DNA, 20 bp, Artificial
  CRISPR gRNA sequence
accaaactcattatcataat

SEQ ID NO: 427442 - DNA, 20 bp, Artificial
  CRISPR gRNA sequence
attatcataatcttccctaa

SEQ ID NO: 427443 - DNA, 20 bp, Artificial
  CRISPR gRNA sequence
tcataatcttccctaaacct

SEQ ID NO: 427444 - DNA, 20 bp, Artificial
  CRISPR gRNA sequence
ccctaaacctcaacatgctt

SEQ ID NO: 427445 - DNA, 20 bp, Artificial
  CRISPR gRNA sequence
cctaaacctcaacatgcttt

SEQ ID NO: 427446 - DNA, 20 bp, Artificial
  CRISPR gRNA sequence
aacctcaacatgcttttcac

SEQ ID NO: 427447 - DNA, 20 bp, Artificial
  CRISPR gRNA sequence
aacatgcttttcactccatc

SEQ ID NO: 427448 - DNA, 20 bp, Artificial
  CRISPR gRNA sequence
ttcactccatctatcttcat

SEQ ID NO: 427449 - DNA, 20 bp, Artificial
  CRISPR gRNA sequence
tcactccatctatcttcatc

SEQ ID NO: 427450 - DNA, 20 bp, Artificial
  CRISPR gRNA sequence
cactccatctatcttcatct

SEQ ID NO: 427451 - DNA, 20 bp, Artificial
  CRISPR gRNA sequence
actccatctatcttcatctg

SEQ ID NO: 427452 - DNA, 20 bp, Artificial
  CRISPR gRNA sequence
catctatcttcatctgtccc

SEQ ID NO: 427453 - DNA, 20 bp, Artificial
  CRISPR gRNA sequence
tcttcatctgtccccaaggt

SEQ ID NO: 427454 - DNA, 20 bp, Artificial
  CRISPR gRNA sequence
catctgtccccaaggtgtaa

SEQ ID NO: 427455 - DNA, 20 bp, Artificial
  CRISPR gRNA sequence
atctgtccccaaggtgtaag

SEQ ID NO: 427456 - DNA, 20 bp, Artificial
  CRISPR gRNA sequence
tccccaaggtgtaagagaac

SEQ ID NO: 427457 - DNA, 20 bp, Artificial
  CRISPR gRNA sequence
accctgcctccaatctggct

SEQ ID NO: 427458 - DNA, 20 bp, Artificial
  CRISPR gRNA sequence
cctccaatctggctctgtcc

SEQ ID NO: 427459 - DNA, 20 bp, Artificial
  CRISPR gRNA sequence
caatctggctctgtccccaa

SEQ ID NO: 427460 - DNA, 20 bp, Artificial
  CRISPR gRNA sequence
gctctgtccccaaactgatc

SEQ ID NO: 427461 - DNA, 20 bp, Artificial
  CRISPR gRNA sequence
tgtccccaaactgatcatat

SEQ ID NO: 427462 - DNA, 20 bp, Artificial
  CRISPR gRNA sequence
tccccaaactgatcatatat

SEQ ID NO: 427463 - DNA, 20 bp, Artificial
  CRISPR gRNA sequence
atcatatatcctttcctggt

SEQ ID NO: 427464 - DNA, 20 bp, Artificial
  CRISPR gRNA sequence
tcctggttttatggatagcc

SEQ ID NO: 427465 - DNA, 20 bp, Artificial
  CRISPR gRNA sequence
cctggttttatggatagccc

SEQ ID NO: 427466 - DNA, 20 bp, Artificial
  CRISPR gRNA sequence
ctggttttatggatagccct

SEQ ID NO: 427467 - DNA, 20 bp, Artificial
  CRISPR gRNA sequence
gttttatggatagccctctg

SEQ ID NO: 427468 - DNA, 20 bp, Artificial
  CRISPR gRNA sequence
tatggatagccctctgcagc

SEQ ID NO: 427469 - DNA, 20 bp, Artificial
  CRISPR gRNA sequence
atggatagccctctgcagcc

SEQ ID NO: 427470 - DNA, 20 bp, Artificial
  CRISPR gRNA sequence
tggatagccctctgcagccc

SEQ ID NO: 427471 - DNA, 20 bp, Artificial
  CRISPR gRNA sequence
tgcagcccctcttacctgct

SEQ ID NO: 427472 - DNA, 20 bp, Artificial
  CRISPR gRNA sequence
cagcccctcttacctgctgc

SEQ ID NO: 427473 - DNA, 20 bp, Artificial
  CRISPR gRNA sequence
ttacctgctgcagtgtgttc

SEQ ID NO: 427474 - DNA, 20 bp, Artificial
  CRISPR gRNA sequence
acctgctgcagtgtgttctc

SEQ ID NO: 427475 - DNA, 20 bp, Artificial
  CRISPR gRNA sequence
cctgctgcagtgtgttctct

SEQ ID NO: 427476 - DNA, 20 bp, Artificial
  CRISPR gRNA sequence
ctgcagtgtgttctctatga

SEQ ID NO: 427477 - DNA, 20 bp, Artificial
  CRISPR gRNA sequence
cagtgtgttctctatgaccc

SEQ ID NO: 427478 - DNA, 20 bp, Artificial
  CRISPR gRNA sequence
tctatgacccctgtgctttc

SEQ ID NO: 427479 - DNA, 20 bp, Artificial
  CRISPR gRNA sequence
tatgacccctgtgctttcca

SEQ ID NO: 427480 - DNA, 20 bp, Artificial
  CRISPR gRNA sequence
tgacccctgtgctttccatc

SEQ ID NO: 427481 - DNA, 20 bp, Artificial
  CRISPR gRNA sequence
tgctttccatctgtcctctt

SEQ ID NO: 427482 - DNA, 20 bp, Artificial
  CRISPR gRNA sequence
tccatctgtcctctttactc

SEQ ID NO: 427483 - DNA, 20 bp, Artificial
  CRISPR gRNA sequence
ccatctgtcctctttactcc

SEQ ID NO: 427484 - DNA, 20 bp, Artificial
  CRISPR gRNA sequence
catctgtcctctttactcca

SEQ ID NO: 427485 - DNA, 20 bp, Artificial
  CRISPR gRNA sequence
tcctctttactccagagcta

SEQ ID NO: 427486 - DNA, 20 bp, Artificial
  CRISPR gRNA sequence
tttactccagagctaactgt

SEQ ID NO: 427487 - DNA, 20 bp, Artificial
  CRISPR gRNA sequence
tactccagagctaactgtat

SEQ ID NO: 427488 - DNA, 20 bp, Artificial
  CRISPR gRNA sequence
actccagagctaactgtatg

SEQ ID NO: 427489 - DNA, 20 bp, Artificial
  CRISPR gRNA sequence
ctccagagctaactgtatgg

SEQ ID NO: 427490 - DNA, 20 bp, Artificial
  CRISPR gRNA sequence
cagagctaactgtatggcta

SEQ ID NO: 427491 - DNA, 20 bp, Artificial
  CRISPR gRNA sequence
actgtatggctatggctaac

SEQ ID NO: 427492 - DNA, 20 bp, Artificial
  CRISPR gRNA sequence
tatggctatggctaaccaga

SEQ ID NO: 427493 - DNA, 20 bp, Artificial
  CRISPR gRNA sequence
tggctaaccagaagccgtcc

SEQ ID NO: 427494 - DNA, 20 bp, Artificial
  CRISPR gRNA sequence
accagaagccgtcctggcca

SEQ ID NO: 427495 - DNA, 20 bp, Artificial
  CRISPR gRNA sequence
gccaactgtgactgagtccc

SEQ ID NO: 427496 - DNA, 20 bp, Artificial
  CRISPR gRNA sequence
tgactgagtccctcaaggca

SEQ ID NO: 427497 - DNA, 20 bp, Artificial
  CRISPR gRNA sequence
agtccctcaaggcaggagga

SEQ ID NO: 427498 - DNA, 20 bp, Artificial
  CRISPR gRNA sequence
aaggcaggaggaacatgttc

SEQ ID NO: 427499 - DNA, 20 bp, Artificial
  CRISPR gRNA sequence
tggggaatttgaattgtgca

SEQ ID NO: 427500 - DNA, 20 bp, Artificial
  CRISPR gRNA sequence
gggaatttgaattgtgcagg

SEQ ID NO: 427501 - DNA, 20 bp, Artificial
  CRISPR gRNA sequence
gaattgtgcaggcaccaccc

SEQ ID NO: 427502 - DNA, 20 bp, Artificial
  CRISPR gRNA sequence
aattgtgcaggcaccaccct

SEQ ID NO: 427503 - DNA, 20 bp, Artificial
  CRISPR gRNA sequence
tgcaggcaccacccttgtct

SEQ ID NO: 427504 - DNA, 20 bp, Artificial
  CRISPR gRNA sequence
gtcttatggattggattcct

SEQ ID NO: 427505 - DNA, 20 bp, Artificial
  CRISPR gRNA sequence
tcttatggattggattccta

SEQ ID NO: 427506 - DNA, 20 bp, Artificial
  CRISPR gRNA sequence
atggattggattcctaagcc

SEQ ID NO: 427507 - DNA, 20 bp, Artificial
  CRISPR gRNA sequence
tggattggattcctaagcca

SEQ ID NO: 427508 - DNA, 20 bp, Artificial
  CRISPR gRNA sequence
gattcctaagccacctttta

SEQ ID NO: 427509 - DNA, 20 bp, Artificial
  CRISPR gRNA sequence
ctaagccaccttttagcaac

SEQ ID NO: 427510 - DNA, 20 bp, Artificial
  CRISPR gRNA sequence
agccaccttttagcaaccca

SEQ ID NO: 427511 - DNA, 20 bp, Artificial
  CRISPR gRNA sequence
ttagcaacccagacccttag

SEQ ID NO: 427512 - DNA, 20 bp, Artificial
  CRISPR gRNA sequence
tagcaacccagacccttagg

SEQ ID NO: 427513 - DNA, 20 bp, Artificial
  CRISPR gRNA sequence
agcaacccagacccttaggt

SEQ ID NO: 427514 - DNA, 20 bp, Artificial
  CRISPR gRNA sequence
gcaacccagacccttaggta

SEQ ID NO: 427515 - DNA, 20 bp, Artificial
  CRISPR gRNA sequence
aggtagagggatgagatgtg

SEQ ID NO: 427516 - DNA, 20 bp, Artificial
  CRISPR gRNA sequence
ggtagagggatgagatgtga

SEQ ID NO: 427517 - DNA, 20 bp, Artificial
  CRISPR gRNA sequence
ctgctgcatcctttgaagac

SEQ ID NO: 427518 - DNA, 20 bp, Artificial
  CRISPR gRNA sequence
tgctgcatcctttgaagact

SEQ ID NO: 427519 - DNA, 20 bp, Artificial
  CRISPR gRNA sequence
ctgcatcctttgaagactcc

SEQ ID NO: 427520 - DNA, 20 bp, Artificial
  CRISPR gRNA sequence
catcctttgaagactcccct

SEQ ID NO: 427521 - DNA, 20 bp, Artificial
  CRISPR gRNA sequence
tgaagactcccctggatacc

SEQ ID NO: 427522 - DNA, 20 bp, Artificial
  CRISPR gRNA sequence
gaagactcccctggatacct

SEQ ID NO: 427523 - DNA, 20 bp, Artificial
  CRISPR gRNA sequence
aagactcccctggatacctg

SEQ ID NO: 427524 - DNA, 20 bp, Artificial
  CRISPR gRNA sequence
ccctggatacctgagcccta

SEQ ID NO: 427525 - DNA, 20 bp, Artificial
  CRISPR gRNA sequence
gatacctgagccctacctga

SEQ ID NO: 427526 - DNA, 20 bp, Artificial
  CRISPR gRNA sequence
agccctacctgagctgctgg

SEQ ID NO: 427527 - DNA, 20 bp, Artificial
  CRISPR gRNA sequence
cctgagctgctggggcagac

SEQ ID NO: 427528 - DNA, 20 bp, Artificial
  CRISPR gRNA sequence
agctgctggggcagactgga

SEQ ID NO: 427529 - DNA, 20 bp, Artificial
  CRISPR gRNA sequence
ctggggcagactggaaacct

SEQ ID NO: 427530 - DNA, 20 bp, Artificial
  CRISPR gRNA sequence
gggcagactggaaacctacc

SEQ ID NO: 427531 - DNA, 20 bp, Artificial
  CRISPR gRNA sequence
gaaacctacctacagcgcag

SEQ ID NO: 427532 - DNA, 20 bp, Artificial
  CRISPR gRNA sequence
cctacagcgcagcatgcatg

SEQ ID NO: 427533 - DNA, 20 bp, Artificial
  CRISPR gRNA sequence
cagcgcagcatgcatggggg

SEQ ID NO: 427534 - DNA, 20 bp, Artificial
  CRISPR gRNA sequence
tttttctcacattcttcttg

SEQ ID NO: 427535 - DNA, 20 bp, Artificial
  CRISPR gRNA sequence
tttctcacattcttcttggg

SEQ ID NO: 427536 - DNA, 20 bp, Artificial
  CRISPR gRNA sequence
ttctcacattcttcttgggt

SEQ ID NO: 427537 - DNA, 20 bp, Artificial
  CRISPR gRNA sequence
tctcacattcttcttgggtc

SEQ ID NO: 427538 - DNA, 20 bp, Artificial
  CRISPR gRNA sequence
ctcacattcttcttgggtca

SEQ ID NO: 427539 - DNA, 20 bp, Artificial
  CRISPR gRNA sequence
tcacattcttcttgggtcag

SEQ ID NO: 427540 - DNA, 20 bp, Artificial
  CRISPR gRNA sequence
acattcttcttgggtcagat

SEQ ID NO: 427541 - DNA, 20 bp, Artificial
  CRISPR gRNA sequence
ttcttgggtcagatcttact

SEQ ID NO: 427542 - DNA, 20 bp, Artificial
  CRISPR gRNA sequence
cttgggtcagatcttactca

SEQ ID NO: 427543 - DNA, 20 bp, Artificial
  CRISPR gRNA sequence
ttgggtcagatcttactcat

SEQ ID NO: 427544 - DNA, 20 bp, Artificial
  CRISPR gRNA sequence
gggtcagatcttactcatct

SEQ ID NO: 427545 - DNA, 20 bp, Artificial
  CRISPR gRNA sequence
ggtcagatcttactcatctc

SEQ ID NO: 427546 - DNA, 20 bp, Artificial
  CRISPR gRNA sequence
actcatctcttcaaaactcc

SEQ ID NO: 427547 - DNA, 20 bp, Artificial
  CRISPR gRNA sequence
ctcatctcttcaaaactccc

SEQ ID NO: 427548 - DNA, 20 bp, Artificial
  CRISPR gRNA sequence
atctcttcaaaactcccctc

SEQ ID NO: 427549 - DNA, 20 bp, Artificial
  CRISPR gRNA sequence
ttcaaaactcccctcctgca

SEQ ID NO: 427550 - DNA, 20 bp, Artificial
  CRISPR gRNA sequence
caaaactcccctcctgcatc

SEQ ID NO: 427551 - DNA, 20 bp, Artificial
  CRISPR gRNA sequence
aaaactcccctcctgcatct

SEQ ID NO: 427552 - DNA, 20 bp, Artificial
  CRISPR gRNA sequence
ccctcctgcatcttcttgct

SEQ ID NO: 427553 - DNA, 20 bp, Artificial
  CRISPR gRNA sequence
ctgcatcttcttgcttccac

SEQ ID NO: 427554 - DNA, 20 bp, Artificial
  CRISPR gRNA sequence
catcttcttgcttccactta

SEQ ID NO: 427555 - DNA, 20 bp, Artificial
  CRISPR gRNA sequence
cttgcttccacttacatgtt

SEQ ID NO: 427556 - DNA, 20 bp, Artificial
  CRISPR gRNA sequence
ttgcttccacttacatgtta

SEQ ID NO: 427557 - DNA, 20 bp, Artificial
  CRISPR gRNA sequence
gcttccacttacatgttatc

SEQ ID NO: 427558 - DNA, 20 bp, Artificial
  CRISPR gRNA sequence
cttccacttacatgttatct

SEQ ID NO: 427559 - DNA, 20 bp, Artificial
  CRISPR gRNA sequence
ccacttacatgttatctctt

SEQ ID NO: 427560 - DNA, 20 bp, Artificial
  CRISPR gRNA sequence
cacttacatgttatctctta

SEQ ID NO: 427561 - DNA, 20 bp, Artificial
  CRISPR gRNA sequence
acatgttatctcttaatgaa

SEQ ID NO: 427562 - DNA, 20 bp, Artificial
  CRISPR gRNA sequence
catgttatctcttaatgaaa

SEQ ID NO: 427563 - DNA, 20 bp, Artificial
  CRISPR gRNA sequence
tctcttaatgaaatgcacta

SEQ ID NO: 427564 - DNA, 20 bp, Artificial
  CRISPR gRNA sequence
ttaatgaaatgcactagttc

SEQ ID NO: 427565 - DNA, 20 bp, Artificial
  CRISPR gRNA sequence
aatgaaatgcactagttcat

SEQ ID NO: 427566 - DNA, 20 bp, Artificial
  CRISPR gRNA sequence
atgaaatgcactagttcatg

SEQ ID NO: 427567 - DNA, 20 bp, Artificial
  CRISPR gRNA sequence
gttcatgatttcacttatgc

SEQ ID NO: 427568 - DNA, 20 bp, Artificial
  CRISPR gRNA sequence
atgatttcacttatgccaca

SEQ ID NO: 427569 - DNA, 20 bp, Artificial
  CRISPR gRNA sequence
cacttatgccacaaatattt

SEQ ID NO: 427570 - DNA, 20 bp, Artificial
  CRISPR gRNA sequence
acttatgccacaaatattta

SEQ ID NO: 427571 - DNA, 20 bp, Artificial
  CRISPR gRNA sequence
atgccacaaatatttatatt

SEQ ID NO: 427572 - DNA, 20 bp, Artificial
  CRISPR gRNA sequence
tgccacaaatatttatattt

SEQ ID NO: 427573 - DNA, 20 bp, Artificial
  CRISPR gRNA sequence
atatttactgagcattcgct

SEQ ID NO: 427574 - DNA, 20 bp, Artificial
  CRISPR gRNA sequence
tatttactgagcattcgcta

SEQ ID NO: 427575 - DNA, 20 bp, Artificial
  CRISPR gRNA sequence
actgagcattcgctatgtgt

SEQ ID NO: 427576 - DNA, 20 bp, Artificial
  CRISPR gRNA sequence
ctgagcattcgctatgtgtc

SEQ ID NO: 427577 - DNA, 20 bp, Artificial
  CRISPR gRNA sequence
agcattcgctatgtgtcaga

SEQ ID NO: 427578 - DNA, 20 bp, Artificial
  CRISPR gRNA sequence
gctatgtgtcagatgctgag

SEQ ID NO: 427579 - DNA, 20 bp, Artificial
  CRISPR gRNA sequence
tgtgtcagatgctgagaaaa

SEQ ID NO: 427580 - DNA, 20 bp, Artificial
  CRISPR gRNA sequence
agaaaacagcaaaggataag

SEQ ID NO: 427581 - DNA, 20 bp, Artificial
  CRISPR gRNA sequence
atgccctccagggtttcaca

SEQ ID NO: 427582 - DNA, 20 bp, Artificial
  CRISPR gRNA sequence
cagggtttcacagcctagct

SEQ ID NO: 427583 - DNA, 20 bp, Artificial
  CRISPR gRNA sequence
cacagcctagctggaaataa

SEQ ID NO: 427584 - DNA, 20 bp, Artificial
  CRISPR gRNA sequence
acagcctagctggaaataag

SEQ ID NO: 427585 - DNA, 20 bp, Artificial
  CRISPR gRNA sequence
gctggaaataagtgttatag

SEQ ID NO: 427586 - DNA, 20 bp, Artificial
  CRISPR gRNA sequence
gaaataagtgttataggctt

SEQ ID NO: 427587 - DNA, 20 bp, Artificial
  CRISPR gRNA sequence
taggcttaagggaaaaggtt

SEQ ID NO: 427588 - DNA, 20 bp, Artificial
  CRISPR gRNA sequence
aagggaaaaggttacatact

SEQ ID NO: 427589 - DNA, 20 bp, Artificial
  CRISPR gRNA sequence
agggaaaaggttacatactt

SEQ ID NO: 427590 - DNA, 20 bp, Artificial
  CRISPR gRNA sequence
catactttttttcatttttg

SEQ ID NO: 427591 - DNA, 20 bp, Artificial
  CRISPR gRNA sequence
tttttcatttttgtaattta

SEQ ID NO: 427592 - DNA, 20 bp, Artificial
  CRISPR gRNA sequence
ttttcatttttgtaatttaa

SEQ ID NO: 427593 - DNA, 20 bp, Artificial
  CRISPR gRNA sequence
tttcatttttgtaatttaat

SEQ ID NO: 427594 - DNA, 20 bp, Artificial
  CRISPR gRNA sequence
ttcatttttgtaatttaatg

SEQ ID NO: 427595 - DNA, 20 bp, Artificial
  CRISPR gRNA sequence
tcatttttgtaatttaatgt

SEQ ID NO: 427596 - DNA, 20 bp, Artificial
  CRISPR gRNA sequence
catttttgtaatttaatgtt

SEQ ID NO: 427597 - DNA, 20 bp, Artificial
  CRISPR gRNA sequence
atttttgtaatttaatgtta

SEQ ID NO: 427598 - DNA, 20 bp, Artificial
  CRISPR gRNA sequence
ttgtaatttaatgttaactt

SEQ ID NO: 427599 - DNA, 20 bp, Artificial
  CRISPR gRNA sequence
tgtaatttaatgttaacttt

SEQ ID NO: 427600 - DNA, 20 bp, Artificial
  CRISPR gRNA sequence
gtaatttaatgttaacttta

SEQ ID NO: 427601 - DNA, 20 bp, Artificial
  CRISPR gRNA sequence
taatttaatgttaactttat

SEQ ID NO: 427602 - DNA, 20 bp, Artificial
  CRISPR gRNA sequence
aatgttaactttattttaat

SEQ ID NO: 427603 - DNA, 20 bp, Artificial
  CRISPR gRNA sequence
atgttaactttattttaatt

SEQ ID NO: 427604 - DNA, 20 bp, Artificial
  CRISPR gRNA sequence
actttattttaattttgaat

SEQ ID NO: 427605 - DNA, 20 bp, Artificial
  CRISPR gRNA sequence
tattttaattttgaattaaa

SEQ ID NO: 427606 - DNA, 20 bp, Artificial
  CRISPR gRNA sequence
attttaattttgaattaaat

SEQ ID NO: 427607 - DNA, 20 bp, Artificial
  CRISPR gRNA sequence
ttttaattttgaattaaata

SEQ ID NO: 427608 - DNA, 20 bp, Artificial
  CRISPR gRNA sequence
taattttgaattaaatattt

SEQ ID NO: 427609 - DNA, 20 bp, Artificial
  CRISPR gRNA sequence
aattttgaattaaatatttt

SEQ ID NO: 427610 - DNA, 20 bp, Artificial
  CRISPR gRNA sequence
attttgaattaaatattttt

SEQ ID NO: 427611 - DNA, 20 bp, Artificial
  CRISPR gRNA sequence
tgaattaaatatttttattg

SEQ ID NO: 427612 - DNA, 20 bp, Artificial
  CRISPR gRNA sequence
gaattaaatatttttattga

SEQ ID NO: 427613 - DNA, 20 bp, Artificial
  CRISPR gRNA sequence
aattaaatatttttattgat

SEQ ID NO: 427614 - DNA, 20 bp, Artificial
  CRISPR gRNA sequence
aatatttttattgatatgat

SEQ ID NO: 427615 - DNA, 20 bp, Artificial
  CRISPR gRNA sequence
ttattgatatgatttcatat

SEQ ID NO: 427616 - DNA, 20 bp, Artificial
  CRISPR gRNA sequence
tattgatatgatttcatatt

SEQ ID NO: 427617 - DNA, 20 bp, Artificial
  CRISPR gRNA sequence
attgatatgatttcatattt

SEQ ID NO: 427618 - DNA, 20 bp, Artificial
  CRISPR gRNA sequence
ttgatatgatttcatatttg

SEQ ID NO: 427619 - DNA, 20 bp, Artificial
  CRISPR gRNA sequence
atatgatttcatatttgaag

SEQ ID NO: 427620 - DNA, 20 bp, Artificial
  CRISPR gRNA sequence
catatttgaagttcaataaa

SEQ ID NO: 427621 - DNA, 20 bp, Artificial
  CRISPR gRNA sequence
atatttgaagttcaataaaa

SEQ ID NO: 427622 - DNA, 20 bp, Artificial
  CRISPR gRNA sequence
gaagttcaataaaagaaaat

SEQ ID NO: 427623 - DNA, 20 bp, Artificial
  CRISPR gRNA sequence
aagttcaataaaagaaaata

SEQ ID NO: 427624 - DNA, 20 bp, Artificial
  CRISPR gRNA sequence
aataaaagaaaatattcact

SEQ ID NO: 427625 - DNA, 20 bp, Artificial
  CRISPR gRNA sequence
actttctgagtttttttctg

SEQ ID NO: 427626 - DNA, 20 bp, Artificial
  CRISPR gRNA sequence
tctgagtttttttctggaac

SEQ ID NO: 427627 - DNA, 20 bp, Artificial
  CRISPR gRNA sequence
ctgagtttttttctggaact

SEQ ID NO: 427628 - DNA, 20 bp, Artificial
  CRISPR gRNA sequence
tgagtttttttctggaacta

SEQ ID NO: 427629 - DNA, 20 bp, Artificial
  CRISPR gRNA sequence
agtttttttctggaactact

SEQ ID NO: 427630 - DNA, 20 bp, Artificial
  CRISPR gRNA sequence
ttttctggaactactatttg

SEQ ID NO: 427631 - DNA, 20 bp, Artificial
  CRISPR gRNA sequence
tttctggaactactatttgt

SEQ ID NO: 427632 - DNA, 20 bp, Artificial
  CRISPR gRNA sequence
ttctggaactactatttgtt

SEQ ID NO: 427633 - DNA, 20 bp, Artificial
  CRISPR gRNA sequence
tctggaactactatttgttt

SEQ ID NO: 427634 - DNA, 20 bp, Artificial
  CRISPR gRNA sequence
ctggaactactatttgtttc

SEQ ID NO: 427635 - DNA, 20 bp, Artificial
  CRISPR gRNA sequence
tggaactactatttgtttca

SEQ ID NO: 427636 - DNA, 20 bp, Artificial
  CRISPR gRNA sequence
gaactactatttgtttcatt

SEQ ID NO: 427637 - DNA, 20 bp, Artificial
  CRISPR gRNA sequence
ctatttgtttcatttcatga

SEQ ID NO: 427638 - DNA, 20 bp, Artificial
  CRISPR gRNA sequence
tttgtttcatttcatgatta

SEQ ID NO: 427639 - DNA, 20 bp, Artificial
  CRISPR gRNA sequence
gtttcatttcatgattacca

SEQ ID NO: 427640 - DNA, 20 bp, Artificial
  CRISPR gRNA sequence
tttcatttcatgattaccaa

SEQ ID NO: 427641 - DNA, 20 bp, Artificial
  CRISPR gRNA sequence
catttcatgattaccaaaaa

SEQ ID NO: 427642 - DNA, 20 bp, Artificial
  CRISPR gRNA sequence
atttcatgattaccaaaaat

SEQ ID NO: 427643 - DNA, 20 bp, Artificial
  CRISPR gRNA sequence
catgattaccaaaaatgatt

SEQ ID NO: 427644 - DNA, 20 bp, Artificial
  CRISPR gRNA sequence
atgattaccaaaaatgattt

SEQ ID NO: 427645 - DNA, 20 bp, Artificial
  CRISPR gRNA sequence
ccaaaaatgattttgtcaaa

SEQ ID NO: 427646 - DNA, 20 bp, Artificial
  CRISPR gRNA sequence
tgtcaaatagaagaaacgaa

SEQ ID NO: 427647 - DNA, 20 bp, Artificial
  CRISPR gRNA sequence
gtcaaatagaagaaacgaat

SEQ ID NO: 427648 - DNA, 20 bp, Artificial
  CRISPR gRNA sequence
tcaaatagaagaaacgaatg

SEQ ID NO: 427649 - DNA, 20 bp, Artificial
  CRISPR gRNA sequence
aaatgacctgctctggtatc

SEQ ID NO: 427650 - DNA, 20 bp, Artificial
  CRISPR gRNA sequence
ctctggtatcaaatatacaa

SEQ ID NO: 427651 - DNA, 20 bp, Artificial
  CRISPR gRNA sequence
tggtatcaaatatacaaggt

SEQ ID NO: 427652 - DNA, 20 bp, Artificial
  CRISPR gRNA sequence
gtatcaaatatacaaggtac

SEQ ID NO: 427653 - DNA, 20 bp, Artificial
  CRISPR gRNA sequence
ctgaaaatatcagtcattga

SEQ ID NO: 427654 - DNA, 20 bp, Artificial
  CRISPR gRNA sequence
aaaatatcagtcattgattt

SEQ ID NO: 427655 - DNA, 20 bp, Artificial
  CRISPR gRNA sequence
atttcatgatgggccagatg

SEQ ID NO: 427656 - DNA, 20 bp, Artificial
  CRISPR gRNA sequence
catgatgggccagatggata

SEQ ID NO: 427657 - DNA, 20 bp, Artificial
  CRISPR gRNA sequence
atgatgggccagatggatac

SEQ ID NO: 427658 - DNA, 20 bp, Artificial
  CRISPR gRNA sequence
tgctgttcaaagtgttgggc

SEQ ID NO: 427659 - DNA, 20 bp, Artificial
  CRISPR gRNA sequence
ctgttcaaagtgttgggctt

SEQ ID NO: 427660 - DNA, 20 bp, Artificial
  CRISPR gRNA sequence
ttcaaagtgttgggcttaaa

SEQ ID NO: 427661 - DNA, 20 bp, Artificial
  CRISPR gRNA sequence
aaagtgttgggcttaaaggc

SEQ ID NO: 427662 - DNA, 20 bp, Artificial
  CRISPR gRNA sequence
ggcttaaaggctccagtccc

SEQ ID NO: 427663 - DNA, 20 bp, Artificial
  CRISPR gRNA sequence
aaaggctccagtcccatggt

SEQ ID NO: 427664 - DNA, 20 bp, Artificial
  CRISPR gRNA sequence
aaggctccagtcccatggtt

SEQ ID NO: 427665 - DNA, 20 bp, Artificial
  CRISPR gRNA sequence
cagtcccatggttacacaaa

SEQ ID NO: 427666 - DNA, 20 bp, Artificial
  CRISPR gRNA sequence
cacaaagggcttggccaatc

SEQ ID NO: 427667 - DNA, 20 bp, Artificial
  CRISPR gRNA sequence
ggccaatcctcccctctctg

SEQ ID NO: 427668 - DNA, 20 bp, Artificial
  CRISPR gRNA sequence
gccaatcctcccctctctgc

SEQ ID NO: 427669 - DNA, 20 bp, Artificial
  CRISPR gRNA sequence
ccctctctgccgtgaagctc

SEQ ID NO: 427670 - DNA, 20 bp, Artificial
  CRISPR gRNA sequence
tctgccgtgaagctcaggct

SEQ ID NO: 427671 - DNA, 20 bp, Artificial
  CRISPR gRNA sequence
tgccgtgaagctcaggctgc

SEQ ID NO: 427672 - DNA, 20 bp, Artificial
  CRISPR gRNA sequence
ccgtgaagctcaggctgccc

SEQ ID NO: 427673 - DNA, 20 bp, Artificial
  CRISPR gRNA sequence
aggctgccctggggaaatca

SEQ ID NO: 427674 - DNA, 20 bp, Artificial
  CRISPR gRNA sequence
ccctggggaaatcagcttca

SEQ ID NO: 427675 - DNA, 20 bp, Artificial
  CRISPR gRNA sequence
gggaaatcagcttcacttct

SEQ ID NO: 427676 - DNA, 20 bp, Artificial
  CRISPR gRNA sequence
cacttctggcttctgccact

SEQ ID NO: 427677 - DNA, 20 bp, Artificial
  CRISPR gRNA sequence
acttctggcttctgccactc

SEQ ID NO: 427678 - DNA, 20 bp, Artificial
  CRISPR gRNA sequence
ctggcttctgccactcatct

SEQ ID NO: 427679 - DNA, 20 bp, Artificial
  CRISPR gRNA sequence
tggcttctgccactcatctc

SEQ ID NO: 427680 - DNA, 20 bp, Artificial
  CRISPR gRNA sequence
gcttctgccactcatctctg

SEQ ID NO: 427681 - DNA, 20 bp, Artificial
  CRISPR gRNA sequence
ctgccactcatctctgtttt

SEQ ID NO: 427682 - DNA, 20 bp, Artificial
  CRISPR gRNA sequence
tgccactcatctctgttttg

SEQ ID NO: 427683 - DNA, 20 bp, Artificial
  CRISPR gRNA sequence
ccactcatctctgttttgtc

SEQ ID NO: 427684 - DNA, 20 bp, Artificial
  CRISPR gRNA sequence
atctctgttttgtcctccct

SEQ ID NO: 427685 - DNA, 20 bp, Artificial
  CRISPR gRNA sequence
tgttttgtcctccctctagt

SEQ ID NO: 427686 - DNA, 20 bp, Artificial
  CRISPR gRNA sequence
ttttgtcctccctctagtgg

SEQ ID NO: 427687 - DNA, 20 bp, Artificial
  CRISPR gRNA sequence
tgtcctccctctagtggctg

SEQ ID NO: 427688 - DNA, 20 bp, Artificial
  CRISPR gRNA sequence
gtcctccctctagtggctga

SEQ ID NO: 427689 - DNA, 20 bp, Artificial
  CRISPR gRNA sequence
tcctccctctagtggctgag

SEQ ID NO: 427690 - DNA, 20 bp, Artificial
  CRISPR gRNA sequence
cctctagtggctgagcacgg

SEQ ID NO: 427691 - DNA, 20 bp, Artificial
  CRISPR gRNA sequence
tagtggctgagcacggtgcc

SEQ ID NO: 427692 - DNA, 20 bp, Artificial
  CRISPR gRNA sequence
gtggctgagcacggtgccag

SEQ ID NO: 427693 - DNA, 20 bp, Artificial
  CRISPR gRNA sequence
agcacggtgccaggttccag

SEQ ID NO: 427694 - DNA, 20 bp, Artificial
  CRISPR gRNA sequence
cagattccattgcttggagc

SEQ ID NO: 427695 - DNA, 20 bp, Artificial
  CRISPR gRNA sequence
cattgcttggagccatggcc

SEQ ID NO: 427696 - DNA, 20 bp, Artificial
  CRISPR gRNA sequence
cttggagccatggccgcgac

SEQ ID NO: 427697 - DNA, 20 bp, Artificial
  CRISPR gRNA sequence
ggagccatggccgcgacgct

SEQ ID NO: 427698 - DNA, 20 bp, Artificial
  CRISPR gRNA sequence
gagccatggccgcgacgctg

SEQ ID NO: 427699 - DNA, 20 bp, Artificial
  CRISPR gRNA sequence
gtggtcatctgcacagcagt

SEQ ID NO: 427700 - DNA, 20 bp, Artificial
  CRISPR gRNA sequence
cacagcagtcatcgtggtgg

SEQ ID NO: 427701 - DNA, 20 bp, Artificial
  CRISPR gRNA sequence
actagaaaggtaatggctcc

SEQ ID NO: 427702 - DNA, 20 bp, Artificial
  CRISPR gRNA sequence
gaaaggtaatggctccggct

SEQ ID NO: 427703 - DNA, 20 bp, Artificial
  CRISPR gRNA sequence
cggctgcacaccgcagtcat

SEQ ID NO: 427704 - DNA, 20 bp, Artificial
  CRISPR gRNA sequence
cacaccgcagtcatgggcac

SEQ ID NO: 427705 - DNA, 20 bp, Artificial
  CRISPR gRNA sequence
gcacccgggtcctttcaggt

SEQ ID NO: 427706 - DNA, 20 bp, Artificial
  CRISPR gRNA sequence
tcaggttctctttccaccca

SEQ ID NO: 427707 - DNA, 20 bp, Artificial
  CRISPR gRNA sequence
caggttctctttccacccag

SEQ ID NO: 427708 - DNA, 20 bp, Artificial
  CRISPR gRNA sequence
aggttctctttccacccaga

SEQ ID NO: 427709 - DNA, 20 bp, Artificial
  CRISPR gRNA sequence
tctttccacccagagagaga

SEQ ID NO: 427710 - DNA, 20 bp, Artificial
  CRISPR gRNA sequence
tttccacccagagagagacc

SEQ ID NO: 427711 - DNA, 20 bp, Artificial
  CRISPR gRNA sequence
tccacccagagagagaccca

SEQ ID NO: 427712 - DNA, 20 bp, Artificial
  CRISPR gRNA sequence
ccacccagagagagacccag

SEQ ID NO: 427713 - DNA, 20 bp, Artificial
  CRISPR gRNA sequence
cacccagagagagacccaga

SEQ ID NO: 427714 - DNA, 20 bp, Artificial
  CRISPR gRNA sequence
cccgagtgctctttgtgcct

SEQ ID NO: 427715 - DNA, 20 bp, Artificial
  CRISPR gRNA sequence
ccgagtgctctttgtgcctt

SEQ ID NO: 427716 - DNA, 20 bp, Artificial
  CRISPR gRNA sequence
tttgtgcctttttcctggca

SEQ ID NO: 427717 - DNA, 20 bp, Artificial
  CRISPR gRNA sequence
tgtgcctttttcctggcatt

SEQ ID NO: 427718 - DNA, 20 bp, Artificial
  CRISPR gRNA sequence
gtgcctttttcctggcattt

SEQ ID NO: 427719 - DNA, 20 bp, Artificial
  CRISPR gRNA sequence
tgcctttttcctggcatttg

SEQ ID NO: 427720 - DNA, 20 bp, Artificial
  CRISPR gRNA sequence
tttcctggcatttgttctgc

SEQ ID NO: 427721 - DNA, 20 bp, Artificial
  CRISPR gRNA sequence
ttcctggcatttgttctgcc

SEQ ID NO: 427722 - DNA, 20 bp, Artificial
  CRISPR gRNA sequence
tcctggcatttgttctgcct

SEQ ID NO: 427723 - DNA, 20 bp, Artificial
  CRISPR gRNA sequence
cctggcatttgttctgccta

SEQ ID NO: 427724 - DNA, 20 bp, Artificial
  CRISPR gRNA sequence
ctggcatttgttctgcctat

SEQ ID NO: 427725 - DNA, 20 bp, Artificial
  CRISPR gRNA sequence
gcatttgttctgcctattag

SEQ ID NO: 427726 - DNA, 20 bp, Artificial
  CRISPR gRNA sequence
gttctgcctattagtgcagt

SEQ ID NO: 427727 - DNA, 20 bp, Artificial
  CRISPR gRNA sequence
ttctgcctattagtgcagtt

SEQ ID NO: 427728 - DNA, 20 bp, Artificial
  CRISPR gRNA sequence
tgcctattagtgcagttatt

SEQ ID NO: 427729 - DNA, 20 bp, Artificial
  CRISPR gRNA sequence
cctattagtgcagttattta

SEQ ID NO: 427730 - DNA, 20 bp, Artificial
  CRISPR gRNA sequence
ttagtgcagttatttatgct

SEQ ID NO: 427731 - DNA, 20 bp, Artificial
  CRISPR gRNA sequence
gtgcagttatttatgctctt

SEQ ID NO: 427732 - DNA, 20 bp, Artificial
  CRISPR gRNA sequence
tttatgctcttccgttgtcc

SEQ ID NO: 427733 - DNA, 20 bp, Artificial
  CRISPR gRNA sequence
atgctcttccgttgtccctc

SEQ ID NO: 427734 - DNA, 20 bp, Artificial
  CRISPR gRNA sequence
tgctcttccgttgtccctct

SEQ ID NO: 427735 - DNA, 20 bp, Artificial
  CRISPR gRNA sequence
ttccgttgtccctctcatag

SEQ ID NO: 427736 - DNA, 20 bp, Artificial
  CRISPR gRNA sequence
ccgttgtccctctcataggg

SEQ ID NO: 427737 - DNA, 20 bp, Artificial
  CRISPR gRNA sequence
cgttgtccctctcataggga

SEQ ID NO: 427738 - DNA, 20 bp, Artificial
  CRISPR gRNA sequence
tccctctcatagggagggac

SEQ ID NO: 427739 - DNA, 20 bp, Artificial
  CRISPR gRNA sequence
tcatagggagggaccccctg

SEQ ID NO: 427740 - DNA, 20 bp, Artificial
  CRISPR gRNA sequence
atagggagggaccccctgga

SEQ ID NO: 427741 - DNA, 20 bp, Artificial
  CRISPR gRNA sequence
gacagctggacctgtttcct

SEQ ID NO: 427742 - DNA, 20 bp, Artificial
  CRISPR gRNA sequence
gacctgtttcctacccatct

SEQ ID NO: 427743 - DNA, 20 bp, Artificial
  CRISPR gRNA sequence
tttcctacccatcttgctgt

SEQ ID NO: 427744 - DNA, 20 bp, Artificial
  CRISPR gRNA sequence
cctacccatcttgctgtcat

SEQ ID NO: 427745 - DNA, 20 bp, Artificial
  CRISPR gRNA sequence
ctacccatcttgctgtcatt

SEQ ID NO: 427746 - DNA, 20 bp, Artificial
  CRISPR gRNA sequence
cccatcttgctgtcatttgt

SEQ ID NO: 427747 - DNA, 20 bp, Artificial
  CRISPR gRNA sequence
gctgtcatttgtaactcctg

SEQ ID NO: 427748 - DNA, 20 bp, Artificial
  CRISPR gRNA sequence
ctgtcatttgtaactcctgg

SEQ ID NO: 427749 - DNA, 20 bp, Artificial
  CRISPR gRNA sequence
tcatttgtaactcctggttt

SEQ ID NO: 427750 - DNA, 20 bp, Artificial
  CRISPR gRNA sequence
gtaactcctggtttctgctt

SEQ ID NO: 427751 - DNA, 20 bp, Artificial
  CRISPR gRNA sequence
taactcctggtttctgctta

SEQ ID NO: 427752 - DNA, 20 bp, Artificial
  CRISPR gRNA sequence
ctggtttctgcttatccctt

SEQ ID NO: 427753 - DNA, 20 bp, Artificial
  CRISPR gRNA sequence
gtttctgcttatcccttaag

SEQ ID NO: 427754 - DNA, 20 bp, Artificial
  CRISPR gRNA sequence
ctgcttatcccttaagccac

SEQ ID NO: 427755 - DNA, 20 bp, Artificial
  CRISPR gRNA sequence
tgcttatcccttaagccact

SEQ ID NO: 427756 - DNA, 20 bp, Artificial
  CRISPR gRNA sequence
cttatcccttaagccactgc

SEQ ID NO: 427757 - DNA, 20 bp, Artificial
  CRISPR gRNA sequence
atcccttaagccactgctct

SEQ ID NO: 427758 - DNA, 20 bp, Artificial
  CRISPR gRNA sequence
tcccttaagccactgctctg

SEQ ID NO: 427759 - DNA, 20 bp, Artificial
  CRISPR gRNA sequence
aagccactgctctgagagtt

SEQ ID NO: 427760 - DNA, 20 bp, Artificial
  CRISPR gRNA sequence
agccactgctctgagagttt

SEQ ID NO: 427761 - DNA, 20 bp, Artificial
  CRISPR gRNA sequence
ctctgagagtttaatttatc

SEQ ID NO: 427762 - DNA, 20 bp, Artificial
  CRISPR gRNA sequence
tgagagtttaatttatctac

SEQ ID NO: 427763 - DNA, 20 bp, Artificial
  CRISPR gRNA sequence
agagtttaatttatctacta

SEQ ID NO: 427764 - DNA, 20 bp, Artificial
  CRISPR gRNA sequence
aatttatctactatgatttt

SEQ ID NO: 427765 - DNA, 20 bp, Artificial
  CRISPR gRNA sequence
atttatctactatgattttg

SEQ ID NO: 427766 - DNA, 20 bp, Artificial
  CRISPR gRNA sequence
atctactatgattttgatgc

SEQ ID NO: 427767 - DNA, 20 bp, Artificial
  CRISPR gRNA sequence
tctactatgattttgatgca

SEQ ID NO: 427768 - DNA, 20 bp, Artificial
  CRISPR gRNA sequence
ctatgattttgatgcatcgt

SEQ ID NO: 427769 - DNA, 20 bp, Artificial
  CRISPR gRNA sequence
tgattttgatgcatcgtggg

SEQ ID NO: 427770 - DNA, 20 bp, Artificial
  CRISPR gRNA sequence
tgatgcatcgtgggcatcta

SEQ ID NO: 427771 - DNA, 20 bp, Artificial
  CRISPR gRNA sequence
gatgcatcgtgggcatctat

SEQ ID NO: 427772 - DNA, 20 bp, Artificial
  CRISPR gRNA sequence
atgcatcgtgggcatctata

SEQ ID NO: 427773 - DNA, 20 bp, Artificial
  CRISPR gRNA sequence
tatatgctagagctttctgc

SEQ ID NO: 427774 - DNA, 20 bp, Artificial
  CRISPR gRNA sequence
gagctttctgcacattagct

SEQ ID NO: 427775 - DNA, 20 bp, Artificial
  CRISPR gRNA sequence
tctgcacattagctcttttg

SEQ ID NO: 427776 - DNA, 20 bp, Artificial
  CRISPR gRNA sequence
ctgcacattagctcttttga

SEQ ID NO: 427777 - DNA, 20 bp, Artificial
  CRISPR gRNA sequence
tgcacattagctcttttgat

SEQ ID NO: 427778 - DNA, 20 bp, Artificial
  CRISPR gRNA sequence
cacattagctcttttgatta

SEQ ID NO: 427779 - DNA, 20 bp, Artificial
  CRISPR gRNA sequence
gctcttttgattattacaac

SEQ ID NO: 427780 - DNA, 20 bp, Artificial
  CRISPR gRNA sequence
ttttgattattacaactctc

SEQ ID NO: 427781 - DNA, 20 bp, Artificial
  CRISPR gRNA sequence
ttgattattacaactctctg

SEQ ID NO: 427782 - DNA, 20 bp, Artificial
  CRISPR gRNA sequence
tgattattacaactctctgg

SEQ ID NO: 427783 - DNA, 20 bp, Artificial
  CRISPR gRNA sequence
gattattacaactctctggt

SEQ ID NO: 427784 - DNA, 20 bp, Artificial
  CRISPR gRNA sequence
attattacaactctctggta

SEQ ID NO: 427785 - DNA, 20 bp, Artificial
  CRISPR gRNA sequence
ttacaactctctggtagtgc

SEQ ID NO: 427786 - DNA, 20 bp, Artificial
  CRISPR gRNA sequence
caactctctggtagtgctag

SEQ ID NO: 427787 - DNA, 20 bp, Artificial
  CRISPR gRNA sequence
tctggtagtgctaggttacc

SEQ ID NO: 427788 - DNA, 20 bp, Artificial
  CRISPR gRNA sequence
tggtagtgctaggttaccca

SEQ ID NO: 427789 - DNA, 20 bp, Artificial
  CRISPR gRNA sequence
gtagtgctaggttacccagc

SEQ ID NO: 427790 - DNA, 20 bp, Artificial
  CRISPR gRNA sequence
ggttacccagcatgtctgta

SEQ ID NO: 427791 - DNA, 20 bp, Artificial
  CRISPR gRNA sequence
cccagcatgtctgtagaatg

SEQ ID NO: 427792 - DNA, 20 bp, Artificial
  CRISPR gRNA sequence
tagaatgagaaataaacact

SEQ ID NO: 427793 - DNA, 20 bp, Artificial
  CRISPR gRNA sequence
caaaaatgtagggttaggcc

SEQ ID NO: 427794 - DNA, 20 bp, Artificial
  CRISPR gRNA sequence
ggccaggagctgtggctcac

SEQ ID NO: 427795 - DNA, 20 bp, Artificial
  CRISPR gRNA sequence
tggctcacacctcagaagcc

SEQ ID NO: 427796 - DNA, 20 bp, Artificial
  CRISPR gRNA sequence
acacctcagaagccacagat

SEQ ID NO: 427797 - DNA, 20 bp, Artificial
  CRISPR gRNA sequence
agaagccacagatatggctg

SEQ ID NO: 427798 - DNA, 20 bp, Artificial
  CRISPR gRNA sequence
gtgctattgggaaagtcaat

SEQ ID NO: 427799 - DNA, 20 bp, Artificial
  CRISPR gRNA sequence
ttgggaaagtcaatgatctg

SEQ ID NO: 427800 - DNA, 20 bp, Artificial
  CRISPR gRNA sequence
ggaaagtcaatgatctgtaa

SEQ ID NO: 427801 - DNA, 20 bp, Artificial
  CRISPR gRNA sequence
taatattttcatttatgtgt

SEQ ID NO: 427802 - DNA, 20 bp, Artificial
  CRISPR gRNA sequence
tcatttatgtgttggctatc

SEQ ID NO: 427803 - DNA, 20 bp, Artificial
  CRISPR gRNA sequence
catttatgtgttggctatca

SEQ ID NO: 427804 - DNA, 20 bp, Artificial
  CRISPR gRNA sequence
atttatgtgttggctatcac

SEQ ID NO: 427805 - DNA, 20 bp, Artificial
  CRISPR gRNA sequence
atgtgttggctatcacaata

SEQ ID NO: 427806 - DNA, 20 bp, Artificial
  CRISPR gRNA sequence
tgtgttggctatcacaatag

SEQ ID NO: 427807 - DNA, 20 bp, Artificial
  CRISPR gRNA sequence
gctatcacaatagacataat

SEQ ID NO: 427808 - DNA, 20 bp, Artificial
  CRISPR gRNA sequence
tcacaatagacataattcca

SEQ ID NO: 427809 - DNA, 20 bp, Artificial
  CRISPR gRNA sequence
cacccactcgggagactgtg

SEQ ID NO: 427810 - DNA, 20 bp, Artificial
  CRISPR gRNA sequence
gggagactgtggcgggagga

SEQ ID NO: 427811 - DNA, 20 bp, Artificial
  CRISPR gRNA sequence
tggcgggaggatcacttgac

SEQ ID NO: 427812 - DNA, 20 bp, Artificial
  CRISPR gRNA sequence
gactctaggagttcaaggct

SEQ ID NO: 427813 - DNA, 20 bp, Artificial
  CRISPR gRNA sequence
actctaggagttcaaggctg

SEQ ID NO: 427814 - DNA, 20 bp, Artificial
  CRISPR gRNA sequence
taggagttcaaggctgcagt

SEQ ID NO: 427815 - DNA, 20 bp, Artificial
  CRISPR gRNA sequence
ggagttcaaggctgcagtga

SEQ ID NO: 427816 - DNA, 20 bp, Artificial
  CRISPR gRNA sequence
aaggctgcagtgagctatga

SEQ ID NO: 427817 - DNA, 20 bp, Artificial
  CRISPR gRNA sequence
cagtgagctatgactgcact

SEQ ID NO: 427818 - DNA, 20 bp, Artificial
  CRISPR gRNA sequence
tgactgcactccagcgtggg

SEQ ID NO: 427819 - DNA, 20 bp, Artificial
  CRISPR gRNA sequence
cactccagcgtgggcaacag

SEQ ID NO: 427820 - DNA, 20 bp, Artificial
  CRISPR gRNA sequence
cagcgtgggcaacagagcaa

SEQ ID NO: 427821 - DNA, 20 bp, Artificial
  CRISPR gRNA sequence
tatctctaaaaaaaaaaaaa

SEQ ID NO: 427822 - DNA, 20 bp, Artificial
  CRISPR gRNA sequence
tctctaaaaaaaaaaaaaaa

SEQ ID NO: 427823 - DNA, 20 bp, Artificial
  CRISPR gRNA sequence
taaaaaaaaaaaaaaattgg

SEQ ID NO: 427824 - DNA, 20 bp, Artificial
  CRISPR gRNA sequence
aaaaaaaaaaaaaattggtg

SEQ ID NO: 427825 - DNA, 20 bp, Artificial
  CRISPR gRNA sequence
gtggtaaagtgggcatggca

SEQ ID NO: 427826 - DNA, 20 bp, Artificial
  CRISPR gRNA sequence
taaatcctctgtttagctta

SEQ ID NO: 427827 - DNA, 20 bp, Artificial
  CRISPR gRNA sequence
tgtttagcttaagagcttat

SEQ ID NO: 427828 - DNA, 20 bp, Artificial
  CRISPR gRNA sequence
tttagcttaagagcttatgt

SEQ ID NO: 427829 - DNA, 20 bp, Artificial
  CRISPR gRNA sequence
agcttaagagcttatgtggc

SEQ ID NO: 427830 - DNA, 20 bp, Artificial
  CRISPR gRNA sequence
gcttaagagcttatgtggct

SEQ ID NO: 427831 - DNA, 20 bp, Artificial
  CRISPR gRNA sequence
aagagcttatgtggctgaaa

SEQ ID NO: 427832 - DNA, 20 bp, Artificial
  CRISPR gRNA sequence
agagcttatgtggctgaaag

SEQ ID NO: 427833 - DNA, 20 bp, Artificial
  CRISPR gRNA sequence
atgtggctgaaagagtaatg

SEQ ID NO: 427834 - DNA, 20 bp, Artificial
  CRISPR gRNA sequence
tgtggctgaaagagtaatga

SEQ ID NO: 427835 - DNA, 20 bp, Artificial
  CRISPR gRNA sequence
aaagagtaatgaatggggaa

SEQ ID NO: 427836 - DNA, 20 bp, Artificial
  CRISPR gRNA sequence
aaagatctagtttctagttt

SEQ ID NO: 427837 - DNA, 20 bp, Artificial
  CRISPR gRNA sequence
gtttctagttttggcactga

SEQ ID NO: 427838 - DNA, 20 bp, Artificial
  CRISPR gRNA sequence
ctagttttggcactgagtgt

SEQ ID NO: 427839 - DNA, 20 bp, Artificial
  CRISPR gRNA sequence
tagttttggcactgagtgta

SEQ ID NO: 427840 - DNA, 20 bp, Artificial
  CRISPR gRNA sequence
gttttggcactgagtgtatg

SEQ ID NO: 427841 - DNA, 20 bp, Artificial
  CRISPR gRNA sequence
tggcactgagtgtatgcttt

SEQ ID NO: 427842 - DNA, 20 bp, Artificial
  CRISPR gRNA sequence
ggcactgagtgtatgctttt

SEQ ID NO: 427843 - DNA, 20 bp, Artificial
  CRISPR gRNA sequence
gcactgagtgtatgctttta

SEQ ID NO: 427844 - DNA, 20 bp, Artificial
  CRISPR gRNA sequence
agtgtatgcttttaggaaag

SEQ ID NO: 427845 - DNA, 20 bp, Artificial
  CRISPR gRNA sequence
ttaggaaagttacttaatct

SEQ ID NO: 427846 - DNA, 20 bp, Artificial
  CRISPR gRNA sequence
taggaaagttacttaatctt

SEQ ID NO: 427847 - DNA, 20 bp, Artificial
  CRISPR gRNA sequence
aggaaagttacttaatcttt

SEQ ID NO: 427848 - DNA, 20 bp, Artificial
  CRISPR gRNA sequence
ggaaagttacttaatctttc

SEQ ID NO: 427849 - DNA, 20 bp, Artificial
  CRISPR gRNA sequence
cttaatctttcaaggtcttc

SEQ ID NO: 427850 - DNA, 20 bp, Artificial
  CRISPR gRNA sequence
aatctttcaaggtcttcatt

SEQ ID NO: 427851 - DNA, 20 bp, Artificial
  CRISPR gRNA sequence
atctttcaaggtcttcattt

SEQ ID NO: 427852 - DNA, 20 bp, Artificial
  CRISPR gRNA sequence
tcaaggtcttcatttcctta

SEQ ID NO: 427853 - DNA, 20 bp, Artificial
  CRISPR gRNA sequence
caaggtcttcatttccttat

SEQ ID NO: 427854 - DNA, 20 bp, Artificial
  CRISPR gRNA sequence
aaggtcttcatttccttata

SEQ ID NO: 427855 - DNA, 20 bp, Artificial
  CRISPR gRNA sequence
catttccttatatataaaat

SEQ ID NO: 427856 - DNA, 20 bp, Artificial
  CRISPR gRNA sequence
atttccttatatataaaatg

SEQ ID NO: 427857 - DNA, 20 bp, Artificial
  CRISPR gRNA sequence
ccttatatataaaatgggga

SEQ ID NO: 427858 - DNA, 20 bp, Artificial
  CRISPR gRNA sequence
cttatatataaaatggggat

SEQ ID NO: 427859 - DNA, 20 bp, Artificial
  CRISPR gRNA sequence
atatataaaatggggatttg

SEQ ID NO: 427860 - DNA, 20 bp, Artificial
  CRISPR gRNA sequence
tatataaaatggggatttgt

SEQ ID NO: 427861 - DNA, 20 bp, Artificial
  CRISPR gRNA sequence
gtcttagtctattttctgcc

SEQ ID NO: 427862 - DNA, 20 bp, Artificial
  CRISPR gRNA sequence
tcttagtctattttctgccg

SEQ ID NO: 427863 - DNA, 20 bp, Artificial
  CRISPR gRNA sequence
agtctattttctgccgctgt

SEQ ID NO: 427864 - DNA, 20 bp, Artificial
  CRISPR gRNA sequence
gtctattttctgccgctgta

SEQ ID NO: 427865 - DNA, 20 bp, Artificial
  CRISPR gRNA sequence
ttttctgccgctgtaacaga

SEQ ID NO: 427866 - DNA, 20 bp, Artificial
  CRISPR gRNA sequence
tctgccgctgtaacagaata

SEQ ID NO: 427867 - DNA, 20 bp, Artificial
  CRISPR gRNA sequence
ctgccgctgtaacagaatac

SEQ ID NO: 427868 - DNA, 20 bp, Artificial
  CRISPR gRNA sequence
tgccgctgtaacagaataca

SEQ ID NO: 427869 - DNA, 20 bp, Artificial
  CRISPR gRNA sequence
ccgctgtaacagaatacaat

SEQ ID NO: 427870 - DNA, 20 bp, Artificial
  CRISPR gRNA sequence
taacagaatacaattattgg

SEQ ID NO: 427871 - DNA, 20 bp, Artificial
  CRISPR gRNA sequence
ttgggaaatttataaagaaa

SEQ ID NO: 427872 - DNA, 20 bp, Artificial
  CRISPR gRNA sequence
ggaaatttataaagaaaaga

SEQ ID NO: 427873 - DNA, 20 bp, Artificial
  CRISPR gRNA sequence
ataaagaaaagaagtttatt

SEQ ID NO: 427874 - DNA, 20 bp, Artificial
  CRISPR gRNA sequence
taaagaaaagaagtttattt

SEQ ID NO: 427875 - DNA, 20 bp, Artificial
  CRISPR gRNA sequence
atttggctcatggttctgga

SEQ ID NO: 427876 - DNA, 20 bp, Artificial
  CRISPR gRNA sequence
tttggctcatggttctggag

SEQ ID NO: 427877 - DNA, 20 bp, Artificial
  CRISPR gRNA sequence
ggctcatggttctggaggct

SEQ ID NO: 427878 - DNA, 20 bp, Artificial
  CRISPR gRNA sequence
gctcatggttctggaggctg

SEQ ID NO: 427879 - DNA, 20 bp, Artificial
  CRISPR gRNA sequence
atggttctggaggctgggaa

SEQ ID NO: 427880 - DNA, 20 bp, Artificial
  CRISPR gRNA sequence
tggaggctgggaagtccagg

SEQ ID NO: 427881 - DNA, 20 bp, Artificial
  CRISPR gRNA sequence
gaggctgggaagtccaggag

SEQ ID NO: 427882 - DNA, 20 bp, Artificial
  CRISPR gRNA sequence
ggaagtccaggagcatggtg

SEQ ID NO: 427883 - DNA, 20 bp, Artificial
  CRISPR gRNA sequence
ggcgaggttcatcccacggc

SEQ ID NO: 427884 - DNA, 20 bp, Artificial
  CRISPR gRNA sequence
gcgaggttcatcccacggca

SEQ ID NO: 427885 - DNA, 20 bp, Artificial
  CRISPR gRNA sequence
atcccacggcagaaggcatc

SEQ ID NO: 427886 - DNA, 20 bp, Artificial
  CRISPR gRNA sequence
atccttttaattaggaactt

SEQ ID NO: 427887 - DNA, 20 bp, Artificial
  CRISPR gRNA sequence
ttaattaggaacttactccc

SEQ ID NO: 427888 - DNA, 20 bp, Artificial
  CRISPR gRNA sequence
taattaggaacttactccca

SEQ ID NO: 427889 - DNA, 20 bp, Artificial
  CRISPR gRNA sequence
aattaggaacttactcccat

SEQ ID NO: 427890 - DNA, 20 bp, Artificial
  CRISPR gRNA sequence
attaggaacttactcccatg

SEQ ID NO: 427891 - DNA, 20 bp, Artificial
  CRISPR gRNA sequence
ggaacttactcccatgatac

SEQ ID NO: 427892 - DNA, 20 bp, Artificial
  CRISPR gRNA sequence
actcccatgatacctaaccc

SEQ ID NO: 427893 - DNA, 20 bp, Artificial
  CRISPR gRNA sequence
ctcccatgatacctaaccca

SEQ ID NO: 427894 - DNA, 20 bp, Artificial
  CRISPR gRNA sequence
ccatgatacctaacccactc

SEQ ID NO: 427895 - DNA, 20 bp, Artificial
  CRISPR gRNA sequence
acccactcctgagataatgg

SEQ ID NO: 427896 - DNA, 20 bp, Artificial
  CRISPR gRNA sequence
ctgagataatggcattaatc

SEQ ID NO: 427897 - DNA, 20 bp, Artificial
  CRISPR gRNA sequence
agataatggcattaatccct

SEQ ID NO: 427898 - DNA, 20 bp, Artificial
  CRISPR gRNA sequence
atcccttcatgagggcagat

SEQ ID NO: 427899 - DNA, 20 bp, Artificial
  CRISPR gRNA sequence
catgagggcagatcttcatg

SEQ ID NO: 427900 - DNA, 20 bp, Artificial
  CRISPR gRNA sequence
atgagggcagatcttcatgg

SEQ ID NO: 427901 - DNA, 20 bp, Artificial
  CRISPR gRNA sequence
catggcctaatcacctctta

SEQ ID NO: 427902 - DNA, 20 bp, Artificial
  CRISPR gRNA sequence
atggcctaatcacctcttaa

SEQ ID NO: 427903 - DNA, 20 bp, Artificial
  CRISPR gRNA sequence
atcacctcttaaaagcatta

SEQ ID NO: 427904 - DNA, 20 bp, Artificial
  CRISPR gRNA sequence
ttaaaagcattaccacttaa

SEQ ID NO: 427905 - DNA, 20 bp, Artificial
  CRISPR gRNA sequence
aaaagcattaccacttaata

SEQ ID NO: 427906 - DNA, 20 bp, Artificial
  CRISPR gRNA sequence
aaagcattaccacttaatac

SEQ ID NO: 427907 - DNA, 20 bp, Artificial
  CRISPR gRNA sequence
ccacttaatactattacaat

SEQ ID NO: 427908 - DNA, 20 bp, Artificial
  CRISPR gRNA sequence
aatactattacaatggtaat

SEQ ID NO: 427909 - DNA, 20 bp, Artificial
  CRISPR gRNA sequence
atactattacaatggtaatt

SEQ ID NO: 427910 - DNA, 20 bp, Artificial
  CRISPR gRNA sequence
ttacaatggtaattaagttt

SEQ ID NO: 427911 - DNA, 20 bp, Artificial
  CRISPR gRNA sequence
caatggtaattaagtttcca

SEQ ID NO: 427912 - DNA, 20 bp, Artificial
  CRISPR gRNA sequence
agtttccaacacatggcctt

SEQ ID NO: 427913 - DNA, 20 bp, Artificial
  CRISPR gRNA sequence
ccaacacatggccttttggg

SEQ ID NO: 427914 - DNA, 20 bp, Artificial
  CRISPR gRNA sequence
caacacatggccttttgggg

SEQ ID NO: 427915 - DNA, 20 bp, Artificial
  CRISPR gRNA sequence
ttgggggacacattaaaacc

SEQ ID NO: 427916 - DNA, 20 bp, Artificial
  CRISPR gRNA sequence
tgggggacacattaaaacca

SEQ ID NO: 427917 - DNA, 20 bp, Artificial
  CRISPR gRNA sequence
gggggacacattaaaaccat

SEQ ID NO: 427918 - DNA, 20 bp, Artificial
  CRISPR gRNA sequence
ggggacacattaaaaccata

SEQ ID NO: 427919 - DNA, 20 bp, Artificial
  CRISPR gRNA sequence
aaaccatagctgtattataa

SEQ ID NO: 427920 - DNA, 20 bp, Artificial
  CRISPR gRNA sequence
tattataattcggcttactc

SEQ ID NO: 427921 - DNA, 20 bp, Artificial
  CRISPR gRNA sequence
taattcggcttactctatat

SEQ ID NO: 427922 - DNA, 20 bp, Artificial
  CRISPR gRNA sequence
ggcttactctatatcataga

SEQ ID NO: 427923 - DNA, 20 bp, Artificial
  CRISPR gRNA sequence
actctatatcatagagttgt

SEQ ID NO: 427924 - DNA, 20 bp, Artificial
  CRISPR gRNA sequence
ctctatatcatagagttgtg

SEQ ID NO: 427925 - DNA, 20 bp, Artificial
  CRISPR gRNA sequence
tatatcatagagttgtgatg

SEQ ID NO: 427926 - DNA, 20 bp, Artificial
  CRISPR gRNA sequence
tatcatagagttgtgatgaa

SEQ ID NO: 427927 - DNA, 20 bp, Artificial
  CRISPR gRNA sequence
tgatgaacaagtggcatatt

SEQ ID NO: 427928 - DNA, 20 bp, Artificial
  CRISPR gRNA sequence
catgtaaaatctttataaat

SEQ ID NO: 427929 - DNA, 20 bp, Artificial
  CRISPR gRNA sequence
atgtaaaatctttataaata

SEQ ID NO: 427930 - DNA, 20 bp, Artificial
  CRISPR gRNA sequence
tataaataacaaagaattat

SEQ ID NO: 427931 - DNA, 20 bp, Artificial
  CRISPR gRNA sequence
ataaataacaaagaattata

SEQ ID NO: 427932 - DNA, 20 bp, Artificial
  CRISPR gRNA sequence
taaataacaaagaattatat

SEQ ID NO: 427933 - DNA, 20 bp, Artificial
  CRISPR gRNA sequence
tatcagtgaaatttatgtca

SEQ ID NO: 427934 - DNA, 20 bp, Artificial
  CRISPR gRNA sequence
atgtcatcagctactggtat

SEQ ID NO: 427935 - DNA, 20 bp, Artificial
  CRISPR gRNA sequence
tgtcatcagctactggtatt

SEQ ID NO: 427936 - DNA, 20 bp, Artificial
  CRISPR gRNA sequence
ctggtattgattgggaggag

SEQ ID NO: 427937 - DNA, 20 bp, Artificial
  CRISPR gRNA sequence
gtattgattgggaggagtga

SEQ ID NO: 427938 - DNA, 20 bp, Artificial
  CRISPR gRNA sequence
attgggaggagtgaaagaat

SEQ ID NO: 427939 - DNA, 20 bp, Artificial
  CRISPR gRNA sequence
ggaggagtgaaagaatttcc

SEQ ID NO: 427940 - DNA, 20 bp, Artificial
  CRISPR gRNA sequence
ccactccttgttttgtctga

SEQ ID NO: 427941 - DNA, 20 bp, Artificial
  CRISPR gRNA sequence
cactccttgttttgtctgat

SEQ ID NO: 427942 - DNA, 20 bp, Artificial
  CRISPR gRNA sequence
cttgttttgtctgatctctt

SEQ ID NO: 427943 - DNA, 20 bp, Artificial
  CRISPR gRNA sequence
gttttgtctgatctcttggg

SEQ ID NO: 427944 - DNA, 20 bp, Artificial
  CRISPR gRNA sequence
ttttgtctgatctcttgggc

SEQ ID NO: 427945 - DNA, 20 bp, Artificial
  CRISPR gRNA sequence
tgtctgatctcttgggccct

SEQ ID NO: 427946 - DNA, 20 bp, Artificial
  CRISPR gRNA sequence
gtctgatctcttgggccctt

SEQ ID NO: 427947 - DNA, 20 bp, Artificial
  CRISPR gRNA sequence
tctgatctcttgggcccttt

SEQ ID NO: 427948 - DNA, 20 bp, Artificial
  CRISPR gRNA sequence
atctcttgggccctttaagt

SEQ ID NO: 427949 - DNA, 20 bp, Artificial
  CRISPR gRNA sequence
ttgggccctttaagtcagct

SEQ ID NO: 427950 - DNA, 20 bp, Artificial
  CRISPR gRNA sequence
gggccctttaagtcagctca

SEQ ID NO: 427951 - DNA, 20 bp, Artificial
  CRISPR gRNA sequence
ggccctttaagtcagctcag

SEQ ID NO: 427952 - DNA, 20 bp, Artificial
  CRISPR gRNA sequence
taagtcagctcagcccaggt

SEQ ID NO: 427953 - DNA, 20 bp, Artificial
  CRISPR gRNA sequence
aagtcagctcagcccaggtc

SEQ ID NO: 427954 - DNA, 20 bp, Artificial
  CRISPR gRNA sequence
agtcagctcagcccaggtca

SEQ ID NO: 427955 - DNA, 20 bp, Artificial
  CRISPR gRNA sequence
agcccaggtcaccttaattc

SEQ ID NO: 427956 - DNA, 20 bp, Artificial
  CRISPR gRNA sequence
aattcaagtcaccacataaa

SEQ ID NO: 427957 - DNA, 20 bp, Artificial
  CRISPR gRNA sequence
attcaagtcaccacataaat

SEQ ID NO: 427958 - DNA, 20 bp, Artificial
  CRISPR gRNA sequence
aagtcaccacataaatattt

SEQ ID NO: 427959 - DNA, 20 bp, Artificial
  CRISPR gRNA sequence
tgggaaacacaagtttgtaa

SEQ ID NO: 427960 - DNA, 20 bp, Artificial
  CRISPR gRNA sequence
gggaaacacaagtttgtaat

SEQ ID NO: 427961 - DNA, 20 bp, Artificial
  CRISPR gRNA sequence
ggaaacacaagtttgtaatt

SEQ ID NO: 427962 - DNA, 20 bp, Artificial
  CRISPR gRNA sequence
gtaatttctacctttacccc

SEQ ID NO: 427963 - DNA, 20 bp, Artificial
  CRISPR gRNA sequence
taatttctacctttacccca

SEQ ID NO: 427964 - DNA, 20 bp, Artificial
  CRISPR gRNA sequence
ctacctttaccccagaccct

SEQ ID NO: 427965 - DNA, 20 bp, Artificial
  CRISPR gRNA sequence
tacctttaccccagaccctc

SEQ ID NO: 427966 - DNA, 20 bp, Artificial
  CRISPR gRNA sequence
cctttaccccagaccctcca

SEQ ID NO: 427967 - DNA, 20 bp, Artificial
  CRISPR gRNA sequence
taccccagaccctccacctg

SEQ ID NO: 427968 - DNA, 20 bp, Artificial
  CRISPR gRNA sequence
accccagaccctccacctga

SEQ ID NO: 427969 - DNA, 20 bp, Artificial
  CRISPR gRNA sequence
ccccagaccctccacctgag

SEQ ID NO: 427970 - DNA, 20 bp, Artificial
  CRISPR gRNA sequence
cacctgagatcctaacccac

SEQ ID NO: 427971 - DNA, 20 bp, Artificial
  CRISPR gRNA sequence
agatcctaacccacttttcc

SEQ ID NO: 427972 - DNA, 20 bp, Artificial
  CRISPR gRNA sequence
acccacttttcctccaactc

SEQ ID NO: 427973 - DNA, 20 bp, Artificial
  CRISPR gRNA sequence
ttcctccaactctaattcca

SEQ ID NO: 427974 - DNA, 20 bp, Artificial
  CRISPR gRNA sequence
tcctccaactctaattccat

SEQ ID NO: 427975 - DNA, 20 bp, Artificial
  CRISPR gRNA sequence
cctccaactctaattccatt

SEQ ID NO: 427976 - DNA, 20 bp, Artificial
  CRISPR gRNA sequence
ctccaactctaattccattc

SEQ ID NO: 427977 - DNA, 20 bp, Artificial
  CRISPR gRNA sequence
caactctaattccattcaat

SEQ ID NO: 427978 - DNA, 20 bp, Artificial
  CRISPR gRNA sequence
taattccattcaattaacaa

SEQ ID NO: 427979 - DNA, 20 bp, Artificial
  CRISPR gRNA sequence
attccattcaattaacaact

SEQ ID NO: 427980 - DNA, 20 bp, Artificial
  CRISPR gRNA sequence
cattcaattaacaactcagt

SEQ ID NO: 427981 - DNA, 20 bp, Artificial
  CRISPR gRNA sequence
aattaacaactcagttctgc

SEQ ID NO: 427982 - DNA, 20 bp, Artificial
  CRISPR gRNA sequence
acaactcagttctgcagcct

SEQ ID NO: 427983 - DNA, 20 bp, Artificial
  CRISPR gRNA sequence
agttctgcagcctggttgaa

SEQ ID NO: 427984 - DNA, 20 bp, Artificial
  CRISPR gRNA sequence
tgcagcctggttgaactgca

SEQ ID NO: 427985 - DNA, 20 bp, Artificial
  CRISPR gRNA sequence
cagcctggttgaactgcagt

SEQ ID NO: 427986 - DNA, 20 bp, Artificial
  CRISPR gRNA sequence
gttgaactgcagtggctgag

SEQ ID NO: 427987 - DNA, 20 bp, Artificial
  CRISPR gRNA sequence
aactgcagtggctgagacat

SEQ ID NO: 427988 - DNA, 20 bp, Artificial
  CRISPR gRNA sequence
cagtggctgagacatggctg

SEQ ID NO: 427989 - DNA, 20 bp, Artificial
  CRISPR gRNA sequence
agacatggctggtgctattg

SEQ ID NO: 427990 - DNA, 20 bp, Artificial
  CRISPR gRNA sequence
gtgctattgggaaagtcaat

SEQ ID NO: 427991 - DNA, 20 bp, Artificial
  CRISPR gRNA sequence
ttgggaaagtcaatgatcta

SEQ ID NO: 427992 - DNA, 20 bp, Artificial
  CRISPR gRNA sequence
ggaaagtcaatgatctataa

SEQ ID NO: 427993 - DNA, 20 bp, Artificial
  CRISPR gRNA sequence
taatattttcatttatgtgt

SEQ ID NO: 427994 - DNA, 20 bp, Artificial
  CRISPR gRNA sequence
tcatttatgtgttggctatc

SEQ ID NO: 427995 - DNA, 20 bp, Artificial
  CRISPR gRNA sequence
catttatgtgttggctatca

SEQ ID NO: 427996 - DNA, 20 bp, Artificial
  CRISPR gRNA sequence
atttatgtgttggctatcac

SEQ ID NO: 427997 - DNA, 20 bp, Artificial
  CRISPR gRNA sequence
atgtgttggctatcacaata

SEQ ID NO: 427998 - DNA, 20 bp, Artificial
  CRISPR gRNA sequence
tgtgttggctatcacaatag

SEQ ID NO: 427999 - DNA, 20 bp, Artificial
  CRISPR gRNA sequence
gctatcacaatagacataat

SEQ ID NO: 428000 - DNA, 20 bp, Artificial
  CRISPR gRNA sequence
tcacaatagacataatgagg

SEQ ID NO: 428001 - DNA, 20 bp, Artificial
  CRISPR gRNA sequence
tatgggaaggtgaggacaag

SEQ ID NO: 428002 - DNA, 20 bp, Artificial
  CRISPR gRNA sequence
tgggaaggtgaggacaagag

SEQ ID NO: 428003 - DNA, 20 bp, Artificial
  CRISPR gRNA sequence
aatagaggggggaggtgaag

SEQ ID NO: 428004 - DNA, 20 bp, Artificial
  CRISPR gRNA sequence
atctcttagctgggaaggga

SEQ ID NO: 428005 - DNA, 20 bp, Artificial
  CRISPR gRNA sequence
ttagctgggaagggagctgc

SEQ ID NO: 428006 - DNA, 20 bp, Artificial
  CRISPR gRNA sequence
agctgggaagggagctgcta

SEQ ID NO: 428007 - DNA, 20 bp, Artificial
  CRISPR gRNA sequence
gctgggaagggagctgctat

SEQ ID NO: 428008 - DNA, 20 bp, Artificial
  CRISPR gRNA sequence
ggaagggagctgctatggtg

SEQ ID NO: 428009 - DNA, 20 bp, Artificial
  CRISPR gRNA sequence
ctatggtggttggtgaacag

SEQ ID NO: 428010 - DNA, 20 bp, Artificial
  CRISPR gRNA sequence
tggtggttggtgaacaggtt

SEQ ID NO: 428011 - DNA, 20 bp, Artificial
  CRISPR gRNA sequence
gtgaacaggttctctgctgt

SEQ ID NO: 428012 - DNA, 20 bp, Artificial
  CRISPR gRNA sequence
tctgctgttagcagtgtcct

SEQ ID NO: 428013 - DNA, 20 bp, Artificial
  CRISPR gRNA sequence
tgctgttagcagtgtcctga

SEQ ID NO: 428014 - DNA, 20 bp, Artificial
  CRISPR gRNA sequence
ctgttagcagtgtcctgatg

SEQ ID NO: 428015 - DNA, 20 bp, Artificial
  CRISPR gRNA sequence
ttagcagtgtcctgatggtc

SEQ ID NO: 428016 - DNA, 20 bp, Artificial
  CRISPR gRNA sequence
gcagtgtcctgatggtctgg

SEQ ID NO: 428017 - DNA, 20 bp, Artificial
  CRISPR gRNA sequence
atggtctggaataaaagaat

SEQ ID NO: 428018 - DNA, 20 bp, Artificial
  CRISPR gRNA sequence
gaataaaagaatcaaaggct

SEQ ID NO: 428019 - DNA, 20 bp, Artificial
  CRISPR gRNA sequence
tttagaaggagctgaacaac

SEQ ID NO: 428020 - DNA, 20 bp, Artificial
  CRISPR gRNA sequence
tagaaggagctgaacaactt

SEQ ID NO: 428021 - DNA, 20 bp, Artificial
  CRISPR gRNA sequence
agaaggagctgaacaacttt

SEQ ID NO: 428022 - DNA, 20 bp, Artificial
  CRISPR gRNA sequence
gaaggagctgaacaactttt

SEQ ID NO: 428023 - DNA, 20 bp, Artificial
  CRISPR gRNA sequence
aacaacttttcctgttaagg

SEQ ID NO: 428024 - DNA, 20 bp, Artificial
  CRISPR gRNA sequence
ttcctgttaaggattcaaga

SEQ ID NO: 428025 - DNA, 20 bp, Artificial
  CRISPR gRNA sequence
tcctgttaaggattcaagac

SEQ ID NO: 428026 - DNA, 20 bp, Artificial
  CRISPR gRNA sequence
cctgttaaggattcaagact

SEQ ID NO: 428027 - DNA, 20 bp, Artificial
  CRISPR gRNA sequence
ctgttaaggattcaagactg

SEQ ID NO: 428028 - DNA, 20 bp, Artificial
  CRISPR gRNA sequence
ttaaggattcaagactggtt

SEQ ID NO: 428029 - DNA, 20 bp, Artificial
  CRISPR gRNA sequence
aggattcaagactggttaat

SEQ ID NO: 428030 - DNA, 20 bp, Artificial
  CRISPR gRNA sequence
aagactggttaattttcatt

SEQ ID NO: 428031 - DNA, 20 bp, Artificial
  CRISPR gRNA sequence
gttaattttcattctgggca

SEQ ID NO: 428032 - DNA, 20 bp, Artificial
  CRISPR gRNA sequence
attttcattctgggcacctg

SEQ ID NO: 428033 - DNA, 20 bp, Artificial
  CRISPR gRNA sequence
tcattctgggcacctggact

SEQ ID NO: 428034 - DNA, 20 bp, Artificial
  CRISPR gRNA sequence
cattctgggcacctggacta

SEQ ID NO: 428035 - DNA, 20 bp, Artificial
  CRISPR gRNA sequence
attctgggcacctggactaa

SEQ ID NO: 428036 - DNA, 20 bp, Artificial
  CRISPR gRNA sequence
tgggcacctggactaacttt

SEQ ID NO: 428037 - DNA, 20 bp, Artificial
  CRISPR gRNA sequence
ggcacctggactaactttgg

SEQ ID NO: 428038 - DNA, 20 bp, Artificial
  CRISPR gRNA sequence
gactaactttggtcatctgg

SEQ ID NO: 428039 - DNA, 20 bp, Artificial
  CRISPR gRNA sequence
actttggtcatctggagggt

SEQ ID NO: 428040 - DNA, 20 bp, Artificial
  CRISPR gRNA sequence
tggtcatctggagggtagag

SEQ ID NO: 428041 - DNA, 20 bp, Artificial
  CRISPR gRNA sequence
ggtcatctggagggtagaga

SEQ ID NO: 428042 - DNA, 20 bp, Artificial
  CRISPR gRNA sequence
gtcatctggagggtagagaa

SEQ ID NO: 428043 - DNA, 20 bp, Artificial
  CRISPR gRNA sequence
gagggtagagaaagagaaaa

SEQ ID NO: 428044 - DNA, 20 bp, Artificial
  CRISPR gRNA sequence
ttgagtcctgttgctccctt

SEQ ID NO: 428045 - DNA, 20 bp, Artificial
  CRISPR gRNA sequence
agtcctgttgctccctttct

SEQ ID NO: 428046 - DNA, 20 bp, Artificial
  CRISPR gRNA sequence
ttgctccctttctacagtgt

SEQ ID NO: 428047 - DNA, 20 bp, Artificial
  CRISPR gRNA sequence
ctccctttctacagtgtttg

SEQ ID NO: 428048 - DNA, 20 bp, Artificial
  CRISPR gRNA sequence
cctttctacagtgtttgatt

SEQ ID NO: 428049 - DNA, 20 bp, Artificial
  CRISPR gRNA sequence
tctacagtgtttgattcccc

SEQ ID NO: 428050 - DNA, 20 bp, Artificial
  CRISPR gRNA sequence
ctacagtgtttgattcccca

SEQ ID NO: 428051 - DNA, 20 bp, Artificial
  CRISPR gRNA sequence
tacagtgtttgattccccag

SEQ ID NO: 428052 - DNA, 20 bp, Artificial
  CRISPR gRNA sequence
cagtgtttgattccccagcc

SEQ ID NO: 428053 - DNA, 20 bp, Artificial
  CRISPR gRNA sequence
gattccccagccctctctga

SEQ ID NO: 428054 - DNA, 20 bp, Artificial
  CRISPR gRNA sequence
attccccagccctctctgac

SEQ ID NO: 428055 - DNA, 20 bp, Artificial
  CRISPR gRNA sequence
cccagccctctctgacattt

SEQ ID NO: 428056 - DNA, 20 bp, Artificial
  CRISPR gRNA sequence
tctgacatttccactgcttc

SEQ ID NO: 428057 - DNA, 20 bp, Artificial
  CRISPR gRNA sequence
tgacatttccactgcttcct

SEQ ID NO: 428058 - DNA, 20 bp, Artificial
  CRISPR gRNA sequence
acatttccactgcttcctgt

SEQ ID NO: 428059 - DNA, 20 bp, Artificial
  CRISPR gRNA sequence
ccactgcttcctgtgtagtg

SEQ ID NO: 428060 - DNA, 20 bp, Artificial
  CRISPR gRNA sequence
cactgcttcctgtgtagtgt

SEQ ID NO: 428061 - DNA, 20 bp, Artificial
  CRISPR gRNA sequence
cttcctgtgtagtgtgggtc

SEQ ID NO: 428062 - DNA, 20 bp, Artificial
  CRISPR gRNA sequence
cctgtgtagtgtgggtcctc

SEQ ID NO: 428063 - DNA, 20 bp, Artificial
  CRISPR gRNA sequence
ctgtgtagtgtgggtcctct

SEQ ID NO: 428064 - DNA, 20 bp, Artificial
  CRISPR gRNA sequence
tgtagtgtgggtcctctctg

SEQ ID NO: 428065 - DNA, 20 bp, Artificial
  CRISPR gRNA sequence
tctgcatctttcctgtgctt

SEQ ID NO: 428066 - DNA, 20 bp, Artificial
  CRISPR gRNA sequence
tgcatctttcctgtgctttg

SEQ ID NO: 428067 - DNA, 20 bp, Artificial
  CRISPR gRNA sequence
catctttcctgtgctttgga

SEQ ID NO: 428068 - DNA, 20 bp, Artificial
  CRISPR gRNA sequence
tcctgtgctttggatatagt

SEQ ID NO: 428069 - DNA, 20 bp, Artificial
  CRISPR gRNA sequence
cctgtgctttggatatagtt

SEQ ID NO: 428070 - DNA, 20 bp, Artificial
  CRISPR gRNA sequence
ctgtgctttggatatagttg

SEQ ID NO: 428071 - DNA, 20 bp, Artificial
  CRISPR gRNA sequence
tgctttggatatagttgtca

SEQ ID NO: 428072 - DNA, 20 bp, Artificial
  CRISPR gRNA sequence
tggatatagttgtcagtctt

SEQ ID NO: 428073 - DNA, 20 bp, Artificial
  CRISPR gRNA sequence
ggatatagttgtcagtcttc

SEQ ID NO: 428074 - DNA, 20 bp, Artificial
  CRISPR gRNA sequence
gatatagttgtcagtcttct

SEQ ID NO: 428075 - DNA, 20 bp, Artificial
  CRISPR gRNA sequence
tcagtcttctgtctctctct

SEQ ID NO: 428076 - DNA, 20 bp, Artificial
  CRISPR gRNA sequence
ctgtctctctctccttgctc

SEQ ID NO: 428077 - DNA, 20 bp, Artificial
  CRISPR gRNA sequence
tgtctctctctccttgctca

SEQ ID NO: 428078 - DNA, 20 bp, Artificial
  CRISPR gRNA sequence
tctctctctccttgctcaaa

SEQ ID NO: 428079 - DNA, 20 bp, Artificial
  CRISPR gRNA sequence
tctctccttgctcaaagcat

SEQ ID NO: 428080 - DNA, 20 bp, Artificial
  CRISPR gRNA sequence
tctccttgctcaaagcattt

SEQ ID NO: 428081 - DNA, 20 bp, Artificial
  CRISPR gRNA sequence
tccttgctcaaagcatttta

SEQ ID NO: 428082 - DNA, 20 bp, Artificial
  CRISPR gRNA sequence
cttgctcaaagcattttata

SEQ ID NO: 428083 - DNA, 20 bp, Artificial
  CRISPR gRNA sequence
gctcaaagcattttatagtt

SEQ ID NO: 428084 - DNA, 20 bp, Artificial
  CRISPR gRNA sequence
ctcaaagcattttatagttg

SEQ ID NO: 428085 - DNA, 20 bp, Artificial
  CRISPR gRNA sequence
aaagcattttatagttgcat

SEQ ID NO: 428086 - DNA, 20 bp, Artificial
  CRISPR gRNA sequence
tatagttgcattattcaggg

SEQ ID NO: 428087 - DNA, 20 bp, Artificial
  CRISPR gRNA sequence
atagttgcattattcagggt

SEQ ID NO: 428088 - DNA, 20 bp, Artificial
  CRISPR gRNA sequence
tagttgcattattcagggtt

SEQ ID NO: 428089 - DNA, 20 bp, Artificial
  CRISPR gRNA sequence
cattattcagggttccagca

SEQ ID NO: 428090 - DNA, 20 bp, Artificial
  CRISPR gRNA sequence
ttcagggttccagcagggaa

SEQ ID NO: 428091 - DNA, 20 bp, Artificial
  CRISPR gRNA sequence
agggttccagcagggaacat

SEQ ID NO: 428092 - DNA, 20 bp, Artificial
  CRISPR gRNA sequence
cagcagggaacatgtagtac

SEQ ID NO: 428093 - DNA, 20 bp, Artificial
  CRISPR gRNA sequence
aaactgggttgtttgaagac

SEQ ID NO: 428094 - DNA, 20 bp, Artificial
  CRISPR gRNA sequence
ggttgtttgaagacagttta

SEQ ID NO: 428095 - DNA, 20 bp, Artificial
  CRISPR gRNA sequence
tttgaagacagtttaataat

SEQ ID NO: 428096 - DNA, 20 bp, Artificial
  CRISPR gRNA sequence
gaagacagtttaataatagg

SEQ ID NO: 428097 - DNA, 20 bp, Artificial
  CRISPR gRNA sequence
aagacagtttaataatagga

SEQ ID NO: 428098 - DNA, 20 bp, Artificial
  CRISPR gRNA sequence
aataataggatttccagaag

SEQ ID NO: 428099 - DNA, 20 bp, Artificial
  CRISPR gRNA sequence
ataataggatttccagaagt

SEQ ID NO: 428100 - DNA, 20 bp, Artificial
  CRISPR gRNA sequence
ccagaagtctagtaggatgt

SEQ ID NO: 428101 - DNA, 20 bp, Artificial
  CRISPR gRNA sequence
cagaagtctagtaggatgta

SEQ ID NO: 428102 - DNA, 20 bp, Artificial
  CRISPR gRNA sequence
gtaggatgtaaggacaccac

SEQ ID NO: 428103 - DNA, 20 bp, Artificial
  CRISPR gRNA sequence
taaccattcctagttcttca

SEQ ID NO: 428104 - DNA, 20 bp, Artificial
  CRISPR gRNA sequence
ctagttcttcaaagggtagg

SEQ ID NO: 428105 - DNA, 20 bp, Artificial
  CRISPR gRNA sequence
gttcttcaaagggtagggga

SEQ ID NO: 428106 - DNA, 20 bp, Artificial
  CRISPR gRNA sequence
ttcaaagggtaggggagggg

SEQ ID NO: 428107 - DNA, 20 bp, Artificial
  CRISPR gRNA sequence
caaagggtaggggaggggct

SEQ ID NO: 428108 - DNA, 20 bp, Artificial
  CRISPR gRNA sequence
aaagggtaggggaggggcta

SEQ ID NO: 428109 - DNA, 20 bp, Artificial
  CRISPR gRNA sequence
attattggagcctggaagga

SEQ ID NO: 428110 - DNA, 20 bp, Artificial
  CRISPR gRNA sequence
ttggagcctggaaggagaga

SEQ ID NO: 428111 - DNA, 20 bp, Artificial
  CRISPR gRNA sequence
gagcctggaaggagagagtt

SEQ ID NO: 428112 - DNA, 20 bp, Artificial
  CRISPR gRNA sequence
gaaggagagagttatgtgga

SEQ ID NO: 428113 - DNA, 20 bp, Artificial
  CRISPR gRNA sequence
tgtggaggggtctccttcag

SEQ ID NO: 428114 - DNA, 20 bp, Artificial
  CRISPR gRNA sequence
cttcagaagtgctgtagtct

SEQ ID NO: 428115 - DNA, 20 bp, Artificial
  CRISPR gRNA sequence
cagaagtgctgtagtctttg

SEQ ID NO: 428116 - DNA, 20 bp, Artificial
  CRISPR gRNA sequence
agaagtgctgtagtctttgc

SEQ ID NO: 428117 - DNA, 20 bp, Artificial
  CRISPR gRNA sequence
tagtctttgctggagggtca

SEQ ID NO: 428118 - DNA, 20 bp, Artificial
  CRISPR gRNA sequence
tgctggagggtcacaaccag

SEQ ID NO: 428119 - DNA, 20 bp, Artificial
  CRISPR gRNA sequence
gctggagggtcacaaccagt

SEQ ID NO: 428120 - DNA, 20 bp, Artificial
  CRISPR gRNA sequence
ctggagggtcacaaccagtc

SEQ ID NO: 428121 - DNA, 20 bp, Artificial
  CRISPR gRNA sequence
gagggtcacaaccagtccaa

SEQ ID NO: 428122 - DNA, 20 bp, Artificial
  CRISPR gRNA sequence
cagaaagaacaaagggaact

SEQ ID NO: 428123 - DNA, 20 bp, Artificial
  CRISPR gRNA sequence
cataccctcatctcattcct

SEQ ID NO: 428124 - DNA, 20 bp, Artificial
  CRISPR gRNA sequence
atctcattcctctctccatt

SEQ ID NO: 428125 - DNA, 20 bp, Artificial
  CRISPR gRNA sequence
attcctctctccattcccct

SEQ ID NO: 428126 - DNA, 20 bp, Artificial
  CRISPR gRNA sequence
ctctctccattcccctactg

SEQ ID NO: 428127 - DNA, 20 bp, Artificial
  CRISPR gRNA sequence
tctccattcccctactgttg

SEQ ID NO: 428128 - DNA, 20 bp, Artificial
  CRISPR gRNA sequence
tccattcccctactgttgct

SEQ ID NO: 428129 - DNA, 20 bp, Artificial
  CRISPR gRNA sequence
cattcccctactgttgcttt

SEQ ID NO: 428130 - DNA, 20 bp, Artificial
  CRISPR gRNA sequence
ccctactgttgctttgcatt

SEQ ID NO: 428131 - DNA, 20 bp, Artificial
  CRISPR gRNA sequence
ctgttgctttgcattggctg

SEQ ID NO: 428132 - DNA, 20 bp, Artificial
  CRISPR gRNA sequence
ttgctttgcattggctgacc

SEQ ID NO: 428133 - DNA, 20 bp, Artificial
  CRISPR gRNA sequence
ctttgcattggctgacctca

SEQ ID NO: 428134 - DNA, 20 bp, Artificial
  CRISPR gRNA sequence
tgcattggctgacctcaaac

SEQ ID NO: 428135 - DNA, 20 bp, Artificial
  CRISPR gRNA sequence
gcattggctgacctcaaact

SEQ ID NO: 428136 - DNA, 20 bp, Artificial
  CRISPR gRNA sequence
cattggctgacctcaaactt

SEQ ID NO: 428137 - DNA, 20 bp, Artificial
  CRISPR gRNA sequence
gctgacctcaaacttaggat

SEQ ID NO: 428138 - DNA, 20 bp, Artificial
  CRISPR gRNA sequence
acctcaaacttaggatggag

SEQ ID NO: 428139 - DNA, 20 bp, Artificial
  CRISPR gRNA sequence
aaacttaggatggaggataa

SEQ ID NO: 428140 - DNA, 20 bp, Artificial
  CRISPR gRNA sequence
aggatggaggataaggggac

SEQ ID NO: 428141 - DNA, 20 bp, Artificial
  CRISPR gRNA sequence
ggatggaggataaggggact

SEQ ID NO: 428142 - DNA, 20 bp, Artificial
  CRISPR gRNA sequence
attgatgtagtacatttagt

SEQ ID NO: 428143 - DNA, 20 bp, Artificial
  CRISPR gRNA sequence
atgtagtacatttagtacag

SEQ ID NO: 428144 - DNA, 20 bp, Artificial
  CRISPR gRNA sequence
agtacagtcttcatagggca

SEQ ID NO: 428145 - DNA, 20 bp, Artificial
  CRISPR gRNA sequence
gtacagtcttcatagggcac

SEQ ID NO: 428146 - DNA, 20 bp, Artificial
  CRISPR gRNA sequence
catagggcacagaatagggt

SEQ ID NO: 428147 - DNA, 20 bp, Artificial
  CRISPR gRNA sequence
atagggcacagaatagggtg

SEQ ID NO: 428148 - DNA, 20 bp, Artificial
  CRISPR gRNA sequence
gagagcagagccaagaggca

SEQ ID NO: 428149 - DNA, 20 bp, Artificial
  CRISPR gRNA sequence
gtatccattcaagtagtgct

SEQ ID NO: 428150 - DNA, 20 bp, Artificial
  CRISPR gRNA sequence
aagtagtgctcatagacatg

SEQ ID NO: 428151 - DNA, 20 bp, Artificial
  CRISPR gRNA sequence
atagacatgaacactggaca

SEQ ID NO: 428152 - DNA, 20 bp, Artificial
  CRISPR gRNA sequence
gacaaaggatcttgactttc

SEQ ID NO: 428153 - DNA, 20 bp, Artificial
  CRISPR gRNA sequence
gactttccacagggttggct

SEQ ID NO: 428154 - DNA, 20 bp, Artificial
  CRISPR gRNA sequence
actttccacagggttggctg

SEQ ID NO: 428155 - DNA, 20 bp, Artificial
  CRISPR gRNA sequence
tccacagggttggctggctt

SEQ ID NO: 428156 - DNA, 20 bp, Artificial
  CRISPR gRNA sequence
ccacagggttggctggcttc

SEQ ID NO: 428157 - DNA, 20 bp, Artificial
  CRISPR gRNA sequence
cacagggttggctggcttca

SEQ ID NO: 428158 - DNA, 20 bp, Artificial
  CRISPR gRNA sequence
gctggcttcagccttctctc

SEQ ID NO: 428159 - DNA, 20 bp, Artificial
  CRISPR gRNA sequence
gcttcagccttctctcttgt

SEQ ID NO: 428160 - DNA, 20 bp, Artificial
  CRISPR gRNA sequence
cagccttctctcttgtagtc

SEQ ID NO: 428161 - DNA, 20 bp, Artificial
  CRISPR gRNA sequence
agccttctctcttgtagtct

SEQ ID NO: 428162 - DNA, 20 bp, Artificial
  CRISPR gRNA sequence
ctctcttgtagtcttgacct

SEQ ID NO: 428163 - DNA, 20 bp, Artificial
  CRISPR gRNA sequence
tctcttgtagtcttgacctc

SEQ ID NO: 428164 - DNA, 20 bp, Artificial
  CRISPR gRNA sequence
tcttgtagtcttgacctctt

SEQ ID NO: 428165 - DNA, 20 bp, Artificial
  CRISPR gRNA sequence
ttgtagtcttgacctctttt

SEQ ID NO: 428166 - DNA, 20 bp, Artificial
  CRISPR gRNA sequence
gtagtcttgacctcttttga

SEQ ID NO: 428167 - DNA, 20 bp, Artificial
  CRISPR gRNA sequence
tagtcttgacctcttttgat

SEQ ID NO: 428168 - DNA, 20 bp, Artificial
  CRISPR gRNA sequence
gacctcttttgattatgtat

SEQ ID NO: 428169 - DNA, 20 bp, Artificial
  CRISPR gRNA sequence
acctcttttgattatgtatg

SEQ ID NO: 428170 - DNA, 20 bp, Artificial
  CRISPR gRNA sequence
ttttgattatgtatgtaagc

SEQ ID NO: 428171 - DNA, 20 bp, Artificial
  CRISPR gRNA sequence
ttgattatgtatgtaagcaa

SEQ ID NO: 428172 - DNA, 20 bp, Artificial
  CRISPR gRNA sequence
tgattatgtatgtaagcaat

SEQ ID NO: 428173 - DNA, 20 bp, Artificial
  CRISPR gRNA sequence
gattatgtatgtaagcaata

SEQ ID NO: 428174 - DNA, 20 bp, Artificial
  CRISPR gRNA sequence
attatgtatgtaagcaatac

SEQ ID NO: 428175 - DNA, 20 bp, Artificial
  CRISPR gRNA sequence
tgtatgtaagcaataccctt

SEQ ID NO: 428176 - DNA, 20 bp, Artificial
  CRISPR gRNA sequence
cttggctgcccagctgtatc

SEQ ID NO: 428177 - DNA, 20 bp, Artificial
  CRISPR gRNA sequence
ttggctgcccagctgtatct

SEQ ID NO: 428178 - DNA, 20 bp, Artificial
  CRISPR gRNA sequence
ggctgcccagctgtatctct

SEQ ID NO: 428179 - DNA, 20 bp, Artificial
  CRISPR gRNA sequence
gctgcccagctgtatctctc

SEQ ID NO: 428180 - DNA, 20 bp, Artificial
  CRISPR gRNA sequence
cccagctgtatctctcctgg

SEQ ID NO: 428181 - DNA, 20 bp, Artificial
  CRISPR gRNA sequence
tatctctcctgggcacactg

SEQ ID NO: 428182 - DNA, 20 bp, Artificial
  CRISPR gRNA sequence
tcctgggcacactgtgctct

SEQ ID NO: 428183 - DNA, 20 bp, Artificial
  CRISPR gRNA sequence
ctgggcacactgtgctctat

SEQ ID NO: 428184 - DNA, 20 bp, Artificial
  CRISPR gRNA sequence
ggcacactgtgctctattaa

SEQ ID NO: 428185 - DNA, 20 bp, Artificial
  CRISPR gRNA sequence
tgctctattaaccattttaa

SEQ ID NO: 428186 - DNA, 20 bp, Artificial
  CRISPR gRNA sequence
tattaaccattttaatattc

SEQ ID NO: 428187 - DNA, 20 bp, Artificial
  CRISPR gRNA sequence
ttaaccattttaatattccc

SEQ ID NO: 428188 - DNA, 20 bp, Artificial
  CRISPR gRNA sequence
accattttaatattcccatg

SEQ ID NO: 428189 - DNA, 20 bp, Artificial
  CRISPR gRNA sequence
taatattcccatggatcagg

SEQ ID NO: 428190 - DNA, 20 bp, Artificial
  CRISPR gRNA sequence
aatattcccatggatcaggc

SEQ ID NO: 428191 - DNA, 20 bp, Artificial
  CRISPR gRNA sequence
atattcccatggatcaggct

SEQ ID NO: 428192 - DNA, 20 bp, Artificial
  CRISPR gRNA sequence
ccatggatcaggctttcttg

SEQ ID NO: 428193 - DNA, 20 bp, Artificial
  CRISPR gRNA sequence
tcttggctcccattgaagta

SEQ ID NO: 428194 - DNA, 20 bp, Artificial
  CRISPR gRNA sequence
cttggctcccattgaagtaa

SEQ ID NO: 428195 - DNA, 20 bp, Artificial
  CRISPR gRNA sequence
ttggctcccattgaagtaat

SEQ ID NO: 428196 - DNA, 20 bp, Artificial
  CRISPR gRNA sequence
ggctcccattgaagtaatta

SEQ ID NO: 428197 - DNA, 20 bp, Artificial
  CRISPR gRNA sequence
gctcccattgaagtaattac

SEQ ID NO: 428198 - DNA, 20 bp, Artificial
  CRISPR gRNA sequence
ccattgaagtaattacatcc

SEQ ID NO: 428199 - DNA, 20 bp, Artificial
  CRISPR gRNA sequence
aagtaattacatccattttg

SEQ ID NO: 428200 - DNA, 20 bp, Artificial
  CRISPR gRNA sequence
catccattttgtttctttaa

SEQ ID NO: 428201 - DNA, 20 bp, Artificial
  CRISPR gRNA sequence
tgtttctttaagtgctgcta

SEQ ID NO: 428202 - DNA, 20 bp, Artificial
  CRISPR gRNA sequence
gtttctttaagtgctgctat

SEQ ID NO: 428203 - DNA, 20 bp, Artificial
  CRISPR gRNA sequence
tttctttaagtgctgctatc

SEQ ID NO: 428204 - DNA, 20 bp, Artificial
  CRISPR gRNA sequence
ctttaagtgctgctatctgt

SEQ ID NO: 428205 - DNA, 20 bp, Artificial
  CRISPR gRNA sequence
tttaagtgctgctatctgtt

SEQ ID NO: 428206 - DNA, 20 bp, Artificial
  CRISPR gRNA sequence
taagtgctgctatctgttct

SEQ ID NO: 428207 - DNA, 20 bp, Artificial
  CRISPR gRNA sequence
aagtgctgctatctgttctg

SEQ ID NO: 428208 - DNA, 20 bp, Artificial
  CRISPR gRNA sequence
agtgctgctatctgttctgt

SEQ ID NO: 428209 - DNA, 20 bp, Artificial
  CRISPR gRNA sequence
ctatctgttctgtactattt

SEQ ID NO: 428210 - DNA, 20 bp, Artificial
  CRISPR gRNA sequence
tctgttctgtactattttgg

SEQ ID NO: 428211 - DNA, 20 bp, Artificial
  CRISPR gRNA sequence
ttctgtactattttgggatc

SEQ ID NO: 428212 - DNA, 20 bp, Artificial
  CRISPR gRNA sequence
tgtactattttgggatctcc

SEQ ID NO: 428213 - DNA, 20 bp, Artificial
  CRISPR gRNA sequence
tactattttgggatctcctc

SEQ ID NO: 428214 - DNA, 20 bp, Artificial
  CRISPR gRNA sequence
ttttgggatctcctcatcct

SEQ ID NO: 428215 - DNA, 20 bp, Artificial
  CRISPR gRNA sequence
tgggatctcctcatcctcat

SEQ ID NO: 428216 - DNA, 20 bp, Artificial
  CRISPR gRNA sequence
gggatctcctcatcctcatt

SEQ ID NO: 428217 - DNA, 20 bp, Artificial
  CRISPR gRNA sequence
ggatctcctcatcctcattg

SEQ ID NO: 428218 - DNA, 20 bp, Artificial
  CRISPR gRNA sequence
ctcatcctcattgctactag

SEQ ID NO: 428219 - DNA, 20 bp, Artificial
  CRISPR gRNA sequence
atcctcattgctactaggaa

SEQ ID NO: 428220 - DNA, 20 bp, Artificial
  CRISPR gRNA sequence
attgctactaggaatccagt

SEQ ID NO: 428221 - DNA, 20 bp, Artificial
  CRISPR gRNA sequence
ctactaggaatccagttctg

SEQ ID NO: 428222 - DNA, 20 bp, Artificial
  CRISPR gRNA sequence
ctaggaatccagttctgtaa

SEQ ID NO: 428223 - DNA, 20 bp, Artificial
  CRISPR gRNA sequence
ggaatccagttctgtaaaag

SEQ ID NO: 428224 - DNA, 20 bp, Artificial
  CRISPR gRNA sequence
tgtaaaagcatctcctattt

SEQ ID NO: 428225 - DNA, 20 bp, Artificial
  CRISPR gRNA sequence
taaaagcatctcctatttta

SEQ ID NO: 428226 - DNA, 20 bp, Artificial
  CRISPR gRNA sequence
ctattttagccctagcctat

SEQ ID NO: 428227 - DNA, 20 bp, Artificial
  CRISPR gRNA sequence
ttttagccctagcctataga

SEQ ID NO: 428228 - DNA, 20 bp, Artificial
  CRISPR gRNA sequence
tagccctagcctatagagga

SEQ ID NO: 428229 - DNA, 20 bp, Artificial
  CRISPR gRNA sequence
agccctagcctatagaggag

SEQ ID NO: 428230 - DNA, 20 bp, Artificial
  CRISPR gRNA sequence
gccctagcctatagaggaga

SEQ ID NO: 428231 - DNA, 20 bp, Artificial
  CRISPR gRNA sequence
gcctatagaggagagatgcc

SEQ ID NO: 428232 - DNA, 20 bp, Artificial
  CRISPR gRNA sequence
tagaggagagatgccaccaa

SEQ ID NO: 428233 - DNA, 20 bp, Artificial
  CRISPR gRNA sequence
ctcaatgatgctggagctcc

SEQ ID NO: 428234 - DNA, 20 bp, Artificial
  CRISPR gRNA sequence
tcaatgatgctggagctccc

SEQ ID NO: 428235 - DNA, 20 bp, Artificial
  CRISPR gRNA sequence
aatgatgctggagctcccct

SEQ ID NO: 428236 - DNA, 20 bp, Artificial
  CRISPR gRNA sequence
gagctcccctagcacattct

SEQ ID NO: 428237 - DNA, 20 bp, Artificial
  CRISPR gRNA sequence
ccctagcacattcttttcca

SEQ ID NO: 428238 - DNA, 20 bp, Artificial
  CRISPR gRNA sequence
gcacattcttttccagctta

SEQ ID NO: 428239 - DNA, 20 bp, Artificial
  CRISPR gRNA sequence
ttttccagcttagtaaaagg

SEQ ID NO: 428240 - DNA, 20 bp, Artificial
  CRISPR gRNA sequence
ttccagcttagtaaaaggga

SEQ ID NO: 428241 - DNA, 20 bp, Artificial
  CRISPR gRNA sequence
tccagcttagtaaaagggat

SEQ ID NO: 428242 - DNA, 20 bp, Artificial
  CRISPR gRNA sequence
ccagcttagtaaaagggata

SEQ ID NO: 428243 - DNA, 20 bp, Artificial
  CRISPR gRNA sequence
cagcttagtaaaagggatat

SEQ ID NO: 428244 - DNA, 20 bp, Artificial
  CRISPR gRNA sequence
agtaaaagggatattctttt

SEQ ID NO: 428245 - DNA, 20 bp, Artificial
  CRISPR gRNA sequence
gtaaaagggatattcttttt

SEQ ID NO: 428246 - DNA, 20 bp, Artificial
  CRISPR gRNA sequence
tttttctttttcctttttcc

SEQ ID NO: 428247 - DNA, 20 bp, Artificial
  CRISPR gRNA sequence
tttctttttcctttttcccc

SEQ ID NO: 428248 - DNA, 20 bp, Artificial
  CRISPR gRNA sequence
ttctttttcctttttcccct

SEQ ID NO: 428249 - DNA, 20 bp, Artificial
  CRISPR gRNA sequence
tctttttcctttttcccctt

SEQ ID NO: 428250 - DNA, 20 bp, Artificial
  CRISPR gRNA sequence
ctttttcctttttccccttt

SEQ ID NO: 428251 - DNA, 20 bp, Artificial
  CRISPR gRNA sequence
tttttcctttttccccttta

SEQ ID NO: 428252 - DNA, 20 bp, Artificial
  CRISPR gRNA sequence
tttcctttttcccctttatt

SEQ ID NO: 428253 - DNA, 20 bp, Artificial
  CRISPR gRNA sequence
ttcctttttcccctttattg

SEQ ID NO: 428254 - DNA, 20 bp, Artificial
  CRISPR gRNA sequence
tcctttttcccctttattgt

SEQ ID NO: 428255 - DNA, 20 bp, Artificial
  CRISPR gRNA sequence
cctttttcccctttattgtt

SEQ ID NO: 428256 - DNA, 20 bp, Artificial
  CRISPR gRNA sequence
ctttttcccctttattgttg

SEQ ID NO: 428257 - DNA, 20 bp, Artificial
  CRISPR gRNA sequence
tttcccctttattgttgcta

SEQ ID NO: 428258 - DNA, 20 bp, Artificial
  CRISPR gRNA sequence
ttcccctttattgttgctat

SEQ ID NO: 428259 - DNA, 20 bp, Artificial
  CRISPR gRNA sequence
tcccctttattgttgctatt

SEQ ID NO: 428260 - DNA, 20 bp, Artificial
  CRISPR gRNA sequence
cccctttattgttgctatta

SEQ ID NO: 428261 - DNA, 20 bp, Artificial
  CRISPR gRNA sequence
ccctttattgttgctattat

SEQ ID NO: 428262 - DNA, 20 bp, Artificial
  CRISPR gRNA sequence
tattgttgctattatcttaa

SEQ ID NO: 428263 - DNA, 20 bp, Artificial
  CRISPR gRNA sequence
attgttgctattatcttaag

SEQ ID NO: 428264 - DNA, 20 bp, Artificial
  CRISPR gRNA sequence
ttgttgctattatcttaagg

SEQ ID NO: 428265 - DNA, 20 bp, Artificial
  CRISPR gRNA sequence
ttgctattatcttaagggat

SEQ ID NO: 428266 - DNA, 20 bp, Artificial
  CRISPR gRNA sequence
ctattatcttaagggatgtt

SEQ ID NO: 428267 - DNA, 20 bp, Artificial
  CRISPR gRNA sequence
ttatcttaagggatgttctc

SEQ ID NO: 428268 - DNA, 20 bp, Artificial
  CRISPR gRNA sequence
tcttaagggatgttctctgg

SEQ ID NO: 428269 - DNA, 20 bp, Artificial
  CRISPR gRNA sequence
aagggatgttctctggatct

SEQ ID NO: 428270 - DNA, 20 bp, Artificial
  CRISPR gRNA sequence
agggatgttctctggatctt

SEQ ID NO: 428271 - DNA, 20 bp, Artificial
  CRISPR gRNA sequence
tctggatcttccctagaaaa

SEQ ID NO: 428272 - DNA, 20 bp, Artificial
  CRISPR gRNA sequence
tggatcttccctagaaaagt

SEQ ID NO: 428273 - DNA, 20 bp, Artificial
  CRISPR gRNA sequence
gatcttccctagaaaagtca

SEQ ID NO: 428274 - DNA, 20 bp, Artificial
  CRISPR gRNA sequence
ccctagaaaagtcaatataa

SEQ ID NO: 428275 - DNA, 20 bp, Artificial
  CRISPR gRNA sequence
cctagaaaagtcaatataat

SEQ ID NO: 428276 - DNA, 20 bp, Artificial
  CRISPR gRNA sequence
gaaaagtcaatataatcagc

SEQ ID NO: 428277 - DNA, 20 bp, Artificial
  CRISPR gRNA sequence
ttggattttggaaattattc

SEQ ID NO: 428278 - DNA, 20 bp, Artificial
  CRISPR gRNA sequence
gattttggaaattattcagt

SEQ ID NO: 428279 - DNA, 20 bp, Artificial
  CRISPR gRNA sequence
tggaaattattcagtacagg

SEQ ID NO: 428280 - DNA, 20 bp, Artificial
  CRISPR gRNA sequence
ggaaattattcagtacaggg

SEQ ID NO: 428281 - DNA, 20 bp, Artificial
  CRISPR gRNA sequence
gaaattattcagtacaggga

SEQ ID NO: 428282 - DNA, 20 bp, Artificial
  CRISPR gRNA sequence
ttcagtacagggattggcaa

SEQ ID NO: 428283 - DNA, 20 bp, Artificial
  CRISPR gRNA sequence
agtacagggattggcaaaat

SEQ ID NO: 428284 - DNA, 20 bp, Artificial
  CRISPR gRNA sequence
gcaaaatttctctgtaaaga

SEQ ID NO: 428285 - DNA, 20 bp, Artificial
  CRISPR gRNA sequence
ctctgtaaagaggcagatag

SEQ ID NO: 428286 - DNA, 20 bp, Artificial
  CRISPR gRNA sequence
tctgtaaagaggcagatagt

SEQ ID NO: 428287 - DNA, 20 bp, Artificial
  CRISPR gRNA sequence
tgtaaagaggcagatagtat

SEQ ID NO: 428288 - DNA, 20 bp, Artificial
  CRISPR gRNA sequence
taaagaggcagatagtatat

SEQ ID NO: 428289 - DNA, 20 bp, Artificial
  CRISPR gRNA sequence
tttgggtttgtaggtcatat

SEQ ID NO: 428290 - DNA, 20 bp, Artificial
  CRISPR gRNA sequence
ttgggtttgtaggtcatatg

SEQ ID NO: 428291 - DNA, 20 bp, Artificial
  CRISPR gRNA sequence
tgggtttgtaggtcatatgg

SEQ ID NO: 428292 - DNA, 20 bp, Artificial
  CRISPR gRNA sequence
gggtttgtaggtcatatggt

SEQ ID NO: 428293 - DNA, 20 bp, Artificial
  CRISPR gRNA sequence
ggtttgtaggtcatatggtc

SEQ ID NO: 428294 - DNA, 20 bp, Artificial
  CRISPR gRNA sequence
gtaggtcatatggtctctgt

SEQ ID NO: 428295 - DNA, 20 bp, Artificial
  CRISPR gRNA sequence
taggtcatatggtctctgtt

SEQ ID NO: 428296 - DNA, 20 bp, Artificial
  CRISPR gRNA sequence
tgttgcaacaattcaactct

SEQ ID NO: 428297 - DNA, 20 bp, Artificial
  CRISPR gRNA sequence
ttgcaacaattcaactctgc

SEQ ID NO: 428298 - DNA, 20 bp, Artificial
  CRISPR gRNA sequence
caacaattcaactctgccat

SEQ ID NO: 428299 - DNA, 20 bp, Artificial
  CRISPR gRNA sequence
aactctgccattgtagtgtg

SEQ ID NO: 428300 - DNA, 20 bp, Artificial
  CRISPR gRNA sequence
tgccattgtagtgtgaaagt

SEQ ID NO: 428301 - DNA, 20 bp, Artificial
  CRISPR gRNA sequence
ccattgtagtgtgaaagtgc

SEQ ID NO: 428302 - DNA, 20 bp, Artificial
  CRISPR gRNA sequence
tagtgtgaaagtgctataga

SEQ ID NO: 428303 - DNA, 20 bp, Artificial
  CRISPR gRNA sequence
tagattatatacaaatgaat

SEQ ID NO: 428304 - DNA, 20 bp, Artificial
  CRISPR gRNA sequence
tatacaaatgaatgactatg

SEQ ID NO: 428305 - DNA, 20 bp, Artificial
  CRISPR gRNA sequence
tgactctgttccaacaaacc

SEQ ID NO: 428306 - DNA, 20 bp, Artificial
  CRISPR gRNA sequence
tgttccaacaaacctttatt

SEQ ID NO: 428307 - DNA, 20 bp, Artificial
  CRISPR gRNA sequence
ttccaacaaacctttattta

SEQ ID NO: 428308 - DNA, 20 bp, Artificial
  CRISPR gRNA sequence
caacaaacctttatttataa

SEQ ID NO: 428309 - DNA, 20 bp, Artificial
  CRISPR gRNA sequence
tatttataaacactaaaatg

SEQ ID NO: 428310 - DNA, 20 bp, Artificial
  CRISPR gRNA sequence
atttataaacactaaaatgt

SEQ ID NO: 428311 - DNA, 20 bp, Artificial
  CRISPR gRNA sequence
tttataaacactaaaatgtt

SEQ ID NO: 428312 - DNA, 20 bp, Artificial
  CRISPR gRNA sequence
ataaacactaaaatgttaat

SEQ ID NO: 428313 - DNA, 20 bp, Artificial
  CRISPR gRNA sequence
taaacactaaaatgttaatt

SEQ ID NO: 428314 - DNA, 20 bp, Artificial
  CRISPR gRNA sequence
aaatgttaatttcatataat

SEQ ID NO: 428315 - DNA, 20 bp, Artificial
  CRISPR gRNA sequence
atttcatataatttttatgt

SEQ ID NO: 428316 - DNA, 20 bp, Artificial
  CRISPR gRNA sequence
catataatttttatgtgtaa

SEQ ID NO: 428317 - DNA, 20 bp, Artificial
  CRISPR gRNA sequence
atataatttttatgtgtaat

SEQ ID NO: 428318 - DNA, 20 bp, Artificial
  CRISPR gRNA sequence
ttatgtgtaataaaatattc

SEQ ID NO: 428319 - DNA, 20 bp, Artificial
  CRISPR gRNA sequence
tatgtgtaataaaatattcg

SEQ ID NO: 428320 - DNA, 20 bp, Artificial
  CRISPR gRNA sequence
atgtgtaataaaatattcgt

SEQ ID NO: 428321 - DNA, 20 bp, Artificial
  CRISPR gRNA sequence
tgtgtaataaaatattcgtt

SEQ ID NO: 428322 - DNA, 20 bp, Artificial
  CRISPR gRNA sequence
gtttttctttctataaattt

SEQ ID NO: 428323 - DNA, 20 bp, Artificial
  CRISPR gRNA sequence
ttctttctataaatttttat

SEQ ID NO: 428324 - DNA, 20 bp, Artificial
  CRISPR gRNA sequence
tctttctataaatttttatg

SEQ ID NO: 428325 - DNA, 20 bp, Artificial
  CRISPR gRNA sequence
ctttctataaatttttatgt

SEQ ID NO: 428326 - DNA, 20 bp, Artificial
  CRISPR gRNA sequence
tttctataaatttttatgtt

SEQ ID NO: 428327 - DNA, 20 bp, Artificial
  CRISPR gRNA sequence
tctataaatttttatgtttt

SEQ ID NO: 428328 - DNA, 20 bp, Artificial
  CRISPR gRNA sequence
ctataaatttttatgtttta

SEQ ID NO: 428329 - DNA, 20 bp, Artificial
  CRISPR gRNA sequence
tataaatttttatgttttaa

SEQ ID NO: 428330 - DNA, 20 bp, Artificial
  CRISPR gRNA sequence
taaatttttatgttttaatt

SEQ ID NO: 428331 - DNA, 20 bp, Artificial
  CRISPR gRNA sequence
ttatgttttaattttttata

SEQ ID NO: 428332 - DNA, 20 bp, Artificial
  CRISPR gRNA sequence
tatgttttaattttttatat

SEQ ID NO: 428333 - DNA, 20 bp, Artificial
  CRISPR gRNA sequence
atgttttaattttttatata

SEQ ID NO: 428334 - DNA, 20 bp, Artificial
  CRISPR gRNA sequence
tgttttaattttttatatat

SEQ ID NO: 428335 - DNA, 20 bp, Artificial
  CRISPR gRNA sequence
taattttttatatatttttt

SEQ ID NO: 428336 - DNA, 20 bp, Artificial
  CRISPR gRNA sequence
aattttttatatatttttta

SEQ ID NO: 428337 - DNA, 20 bp, Artificial
  CRISPR gRNA sequence
attttttatatattttttat

SEQ ID NO: 428338 - DNA, 20 bp, Artificial
  CRISPR gRNA sequence
tttatatattttttatttca

SEQ ID NO: 428339 - DNA, 20 bp, Artificial
  CRISPR gRNA sequence
ttatatattttttatttcaa

SEQ ID NO: 428340 - DNA, 20 bp, Artificial
  CRISPR gRNA sequence
tatatattttttatttcaat

SEQ ID NO: 428341 - DNA, 20 bp, Artificial
  CRISPR gRNA sequence
atatattttttatttcaata

SEQ ID NO: 428342 - DNA, 20 bp, Artificial
  CRISPR gRNA sequence
tatattttttatttcaatag

SEQ ID NO: 428343 - DNA, 20 bp, Artificial
  CRISPR gRNA sequence
tttatttcaataggtttttg

SEQ ID NO: 428344 - DNA, 20 bp, Artificial
  CRISPR gRNA sequence
ttatttcaataggtttttgg

SEQ ID NO: 428345 - DNA, 20 bp, Artificial
  CRISPR gRNA sequence
tatttcaataggtttttggg

SEQ ID NO: 428346 - DNA, 20 bp, Artificial
  CRISPR gRNA sequence
atttcaataggtttttgggg

SEQ ID NO: 428347 - DNA, 20 bp, Artificial
  CRISPR gRNA sequence
tttcaataggtttttgggga

SEQ ID NO: 428348 - DNA, 20 bp, Artificial
  CRISPR gRNA sequence
caataggtttttggggaata

SEQ ID NO: 428349 - DNA, 20 bp, Artificial
  CRISPR gRNA sequence
aataggtttttggggaataa

SEQ ID NO: 428350 - DNA, 20 bp, Artificial
  CRISPR gRNA sequence
ttggggaataagtcctttag

SEQ ID NO: 428351 - DNA, 20 bp, Artificial
  CRISPR gRNA sequence
tggggaataagtcctttagt

SEQ ID NO: 428352 - DNA, 20 bp, Artificial
  CRISPR gRNA sequence
ggggaataagtcctttagtg

SEQ ID NO: 428353 - DNA, 20 bp, Artificial
  CRISPR gRNA sequence
gggaataagtcctttagtgg

SEQ ID NO: 428354 - DNA, 20 bp, Artificial
  CRISPR gRNA sequence
tagtggtgatttctgagatt

SEQ ID NO: 428355 - DNA, 20 bp, Artificial
  CRISPR gRNA sequence
agtggtgatttctgagattt

SEQ ID NO: 428356 - DNA, 20 bp, Artificial
  CRISPR gRNA sequence
gtggtgatttctgagatttt

SEQ ID NO: 428357 - DNA, 20 bp, Artificial
  CRISPR gRNA sequence
ctgagattttggtgcaccca

SEQ ID NO: 428358 - DNA, 20 bp, Artificial
  CRISPR gRNA sequence
tgagattttggtgcacccat

SEQ ID NO: 428359 - DNA, 20 bp, Artificial
  CRISPR gRNA sequence
agattttggtgcacccatca

SEQ ID NO: 428360 - DNA, 20 bp, Artificial
  CRISPR gRNA sequence
tggtgcacccatcacccgaa

SEQ ID NO: 428361 - DNA, 20 bp, Artificial
  CRISPR gRNA sequence
ggtgcacccatcacccgaac

SEQ ID NO: 428362 - DNA, 20 bp, Artificial
  CRISPR gRNA sequence
gtgcacccatcacccgaaca

SEQ ID NO: 428363 - DNA, 20 bp, Artificial
  CRISPR gRNA sequence
tacccagtgtgtagtccttt

SEQ ID NO: 428364 - DNA, 20 bp, Artificial
  CRISPR gRNA sequence
tatccctcagccctctccca

SEQ ID NO: 428365 - DNA, 20 bp, Artificial
  CRISPR gRNA sequence
atccctcagccctctcccac

SEQ ID NO: 428366 - DNA, 20 bp, Artificial
  CRISPR gRNA sequence
tccctcagccctctcccact

SEQ ID NO: 428367 - DNA, 20 bp, Artificial
  CRISPR gRNA sequence
agccctctcccactcttttc

SEQ ID NO: 428368 - DNA, 20 bp, Artificial
  CRISPR gRNA sequence
tcccactcttttccctgagt

SEQ ID NO: 428369 - DNA, 20 bp, Artificial
  CRISPR gRNA sequence
ccactcttttccctgagtcc

SEQ ID NO: 428370 - DNA, 20 bp, Artificial
  CRISPR gRNA sequence
ttttccctgagtccccaaag

SEQ ID NO: 428371 - DNA, 20 bp, Artificial
  CRISPR gRNA sequence
ttccctgagtccccaaagtc

SEQ ID NO: 428372 - DNA, 20 bp, Artificial
  CRISPR gRNA sequence
tccctgagtccccaaagtcc

SEQ ID NO: 428373 - DNA, 20 bp, Artificial
  CRISPR gRNA sequence
ccctgagtccccaaagtcca

SEQ ID NO: 428374 - DNA, 20 bp, Artificial
  CRISPR gRNA sequence
cctgagtccccaaagtccat

SEQ ID NO: 428375 - DNA, 20 bp, Artificial
  CRISPR gRNA sequence
agtccccaaagtccattagt

SEQ ID NO: 428376 - DNA, 20 bp, Artificial
  CRISPR gRNA sequence
gtcccttgtatcattcttaa

SEQ ID NO: 428377 - DNA, 20 bp, Artificial
  CRISPR gRNA sequence
gtatcattcttaacgccttt

SEQ ID NO: 428378 - DNA, 20 bp, Artificial
  CRISPR gRNA sequence
tatcattcttaacgcctttg

SEQ ID NO: 428379 - DNA, 20 bp, Artificial
  CRISPR gRNA sequence
ttaacgcctttgcgtcctca

SEQ ID NO: 428380 - DNA, 20 bp, Artificial
  CRISPR gRNA sequence
aacgcctttgcgtcctcata

SEQ ID NO: 428381 - DNA, 20 bp, Artificial
  CRISPR gRNA sequence
acgcctttgcgtcctcatag

SEQ ID NO: 428382 - DNA, 20 bp, Artificial
  CRISPR gRNA sequence
tgcgtcctcatagcttagct

SEQ ID NO: 428383 - DNA, 20 bp, Artificial
  CRISPR gRNA sequence
gcgtcctcatagcttagctc

SEQ ID NO: 428384 - DNA, 20 bp, Artificial
  CRISPR gRNA sequence
cgtcctcatagcttagctcc

SEQ ID NO: 428385 - DNA, 20 bp, Artificial
  CRISPR gRNA sequence
atagcttagctcccacttct

SEQ ID NO: 428386 - DNA, 20 bp, Artificial
  CRISPR gRNA sequence
agctcccacttctgagtgag

SEQ ID NO: 428387 - DNA, 20 bp, Artificial
  CRISPR gRNA sequence
gctcccacttctgagtgaga

SEQ ID NO: 428388 - DNA, 20 bp, Artificial
  CRISPR gRNA sequence
ccacttctgagtgagaacat

SEQ ID NO: 428389 - DNA, 20 bp, Artificial
  CRISPR gRNA sequence
ctgagtgagaacatacaatg

SEQ ID NO: 428390 - DNA, 20 bp, Artificial
  CRISPR gRNA sequence
tgagtgagaacatacaatgt

SEQ ID NO: 428391 - DNA, 20 bp, Artificial
  CRISPR gRNA sequence
agtgagaacatacaatgttt

SEQ ID NO: 428392 - DNA, 20 bp, Artificial
  CRISPR gRNA sequence
ggtttttcattcctgagtta

SEQ ID NO: 428393 - DNA, 20 bp, Artificial
  CRISPR gRNA sequence
gtttttcattcctgagttac

SEQ ID NO: 428394 - DNA, 20 bp, Artificial
  CRISPR gRNA sequence
ttcattcctgagttacttca

SEQ ID NO: 428395 - DNA, 20 bp, Artificial
  CRISPR gRNA sequence
tcattcctgagttacttcac

SEQ ID NO: 428396 - DNA, 20 bp, Artificial
  CRISPR gRNA sequence
cattcctgagttacttcact

SEQ ID NO: 428397 - DNA, 20 bp, Artificial
  CRISPR gRNA sequence
attcctgagttacttcactt

SEQ ID NO: 428398 - DNA, 20 bp, Artificial
  CRISPR gRNA sequence
ctgagttacttcacttatag

SEQ ID NO: 428399 - DNA, 20 bp, Artificial
  CRISPR gRNA sequence
agttacttcacttatagtag

SEQ ID NO: 428400 - DNA, 20 bp, Artificial
  CRISPR gRNA sequence
cttcacttatagtagtggtt

SEQ ID NO: 428401 - DNA, 20 bp, Artificial
  CRISPR gRNA sequence
cacttatagtagtggtttcc

SEQ ID NO: 428402 - DNA, 20 bp, Artificial
  CRISPR gRNA sequence
acttatagtagtggtttcca

SEQ ID NO: 428403 - DNA, 20 bp, Artificial
  CRISPR gRNA sequence
atagtagtggtttccaattc

SEQ ID NO: 428404 - DNA, 20 bp, Artificial
  CRISPR gRNA sequence
tagtagtggtttccaattcc

SEQ ID NO: 428405 - DNA, 20 bp, Artificial
  CRISPR gRNA sequence
ccaattccatccaggctgct

SEQ ID NO: 428406 - DNA, 20 bp, Artificial
  CRISPR gRNA sequence
caattccatccaggctgctg

SEQ ID NO: 428407 - DNA, 20 bp, Artificial
  CRISPR gRNA sequence
catccaggctgctgcaaatg

SEQ ID NO: 428408 - DNA, 20 bp, Artificial
  CRISPR gRNA sequence
ctgcaaatgccattattttg

SEQ ID NO: 428409 - DNA, 20 bp, Artificial
  CRISPR gRNA sequence
caaatgccattattttgttc

SEQ ID NO: 428410 - DNA, 20 bp, Artificial
  CRISPR gRNA sequence
ttttgttcctttttatggct

SEQ ID NO: 428411 - DNA, 20 bp, Artificial
  CRISPR gRNA sequence
tgttcctttttatggctgag

SEQ ID NO: 428412 - DNA, 20 bp, Artificial
  CRISPR gRNA sequence
gttcctttttatggctgagt

SEQ ID NO: 428413 - DNA, 20 bp, Artificial
  CRISPR gRNA sequence
ttcctttttatggctgagta

SEQ ID NO: 428414 - DNA, 20 bp, Artificial
  CRISPR gRNA sequence
ctttttatggctgagtagta

SEQ ID NO: 428415 - DNA, 20 bp, Artificial
  CRISPR gRNA sequence
tttatggctgagtagtattc

SEQ ID NO: 428416 - DNA, 20 bp, Artificial
  CRISPR gRNA sequence
ttatggctgagtagtattcc

SEQ ID NO: 428417 - DNA, 20 bp, Artificial
  CRISPR gRNA sequence
tatggctgagtagtattcca

SEQ ID NO: 428418 - DNA, 20 bp, Artificial
  CRISPR gRNA sequence
atggctgagtagtattccat

SEQ ID NO: 428419 - DNA, 20 bp, Artificial
  CRISPR gRNA sequence
tggctgagtagtattccatg

SEQ ID NO: 428420 - DNA, 20 bp, Artificial
  CRISPR gRNA sequence
agtagtattccatggtgtgt

SEQ ID NO: 428421 - DNA, 20 bp, Artificial
  CRISPR gRNA sequence
catggtgtgtatatatatat

SEQ ID NO: 428422 - DNA, 20 bp, Artificial
  CRISPR gRNA sequence
caatttctttatccactcat

SEQ ID NO: 428423 - DNA, 20 bp, Artificial
  CRISPR gRNA sequence
ctttatccactcattgattg

SEQ ID NO: 428424 - DNA, 20 bp, Artificial
  CRISPR gRNA sequence
tttatccactcattgattga

SEQ ID NO: 428425 - DNA, 20 bp, Artificial
  CRISPR gRNA sequence
tatccactcattgattgatg

SEQ ID NO: 428426 - DNA, 20 bp, Artificial
  CRISPR gRNA sequence
atccactcattgattgatgg

SEQ ID NO: 428427 - DNA, 20 bp, Artificial
  CRISPR gRNA sequence
tccactcattgattgatggg

SEQ ID NO: 428428 - DNA, 20 bp, Artificial
  CRISPR gRNA sequence
attgattgatgggcatttgg

SEQ ID NO: 428429 - DNA, 20 bp, Artificial
  CRISPR gRNA sequence
attgatgggcatttgggctg

SEQ ID NO: 428430 - DNA, 20 bp, Artificial
  CRISPR gRNA sequence
atgggcatttgggctggttc

SEQ ID NO: 428431 - DNA, 20 bp, Artificial
  CRISPR gRNA sequence
gggctggttccatatttttg

SEQ ID NO: 428432 - DNA, 20 bp, Artificial
  CRISPR gRNA sequence
ggctggttccatatttttgc

SEQ ID NO: 428433 - DNA, 20 bp, Artificial
  CRISPR gRNA sequence
gttccatatttttgcaattg

SEQ ID NO: 428434 - DNA, 20 bp, Artificial
  CRISPR gRNA sequence
catatttttgcaattgcaaa

SEQ ID NO: 428435 - DNA, 20 bp, Artificial
  CRISPR gRNA sequence
ttgcaattgcaaattgtgct

SEQ ID NO: 428436 - DNA, 20 bp, Artificial
  CRISPR gRNA sequence
tgcaattgcaaattgtgctg

SEQ ID NO: 428437 - DNA, 20 bp, Artificial
  CRISPR gRNA sequence
gcaattgcaaattgtgctgc

SEQ ID NO: 428438 - DNA, 20 bp, Artificial
  CRISPR gRNA sequence
caattgcaaattgtgctgct

SEQ ID NO: 428439 - DNA, 20 bp, Artificial
  CRISPR gRNA sequence
caaattgtgctgctttttgt

SEQ ID NO: 428440 - DNA, 20 bp, Artificial
  CRISPR gRNA sequence
tgctgctttttgtataatga

SEQ ID NO: 428441 - DNA, 20 bp, Artificial
  CRISPR gRNA sequence
ctttttgtataatgacttct

SEQ ID NO: 428442 - DNA, 20 bp, Artificial
  CRISPR gRNA sequence
tttgtataatgacttctttt

SEQ ID NO: 428443 - DNA, 20 bp, Artificial
  CRISPR gRNA sequence
ttgtataatgacttcttttc

SEQ ID NO: 428444 - DNA, 20 bp, Artificial
  CRISPR gRNA sequence
tgtataatgacttcttttcc

SEQ ID NO: 428445 - DNA, 20 bp, Artificial
  CRISPR gRNA sequence
gtataatgacttcttttcct

SEQ ID NO: 428446 - DNA, 20 bp, Artificial
  CRISPR gRNA sequence
tataatgacttcttttcctc

SEQ ID NO: 428447 - DNA, 20 bp, Artificial
  CRISPR gRNA sequence
cttttcctctggatagatac

SEQ ID NO: 428448 - DNA, 20 bp, Artificial
  CRISPR gRNA sequence
ttttcctctggatagatacc

SEQ ID NO: 428449 - DNA, 20 bp, Artificial
  CRISPR gRNA sequence
ttcctctggatagataccca

SEQ ID NO: 428450 - DNA, 20 bp, Artificial
  CRISPR gRNA sequence
tcctctggatagatacccag

SEQ ID NO: 428451 - DNA, 20 bp, Artificial
  CRISPR gRNA sequence
cctctggatagatacccagt

SEQ ID NO: 428452 - DNA, 20 bp, Artificial
  CRISPR gRNA sequence
ctctggatagatacccagta

SEQ ID NO: 428453 - DNA, 20 bp, Artificial
  CRISPR gRNA sequence
tggatagatacccagtagtg

SEQ ID NO: 428454 - DNA, 20 bp, Artificial
  CRISPR gRNA sequence
gatagatacccagtagtggg

SEQ ID NO: 428455 - DNA, 20 bp, Artificial
  CRISPR gRNA sequence
ctggattaaatcatagttct

SEQ ID NO: 428456 - DNA, 20 bp, Artificial
  CRISPR gRNA sequence
gattaaatcatagttctact

SEQ ID NO: 428457 - DNA, 20 bp, Artificial
  CRISPR gRNA sequence
aatcatagttctacttttag

SEQ ID NO: 428458 - DNA, 20 bp, Artificial
  CRISPR gRNA sequence
tacttttagttccttaagga

SEQ ID NO: 428459 - DNA, 20 bp, Artificial
  CRISPR gRNA sequence
cttttagttccttaaggaat

SEQ ID NO: 428460 - DNA, 20 bp, Artificial
  CRISPR gRNA sequence
ttagttccttaaggaatctc

SEQ ID NO: 428461 - DNA, 20 bp, Artificial
  CRISPR gRNA sequence
tagttccttaaggaatctcc

SEQ ID NO: 428462 - DNA, 20 bp, Artificial
  CRISPR gRNA sequence
agttccttaaggaatctcca

SEQ ID NO: 428463 - DNA, 20 bp, Artificial
  CRISPR gRNA sequence
gttccttaaggaatctccac

SEQ ID NO: 428464 - DNA, 20 bp, Artificial
  CRISPR gRNA sequence
cttaaggaatctccacactg

SEQ ID NO: 428465 - DNA, 20 bp, Artificial
  CRISPR gRNA sequence
aaggaatctccacactgttt

SEQ ID NO: 428466 - DNA, 20 bp, Artificial
  CRISPR gRNA sequence
aggaatctccacactgtttt

SEQ ID NO: 428467 - DNA, 20 bp, Artificial
  CRISPR gRNA sequence
cacactgttttccatagtca

SEQ ID NO: 428468 - DNA, 20 bp, Artificial
  CRISPR gRNA sequence
ttttccatagtcatactagt

SEQ ID NO: 428469 - DNA, 20 bp, Artificial
  CRISPR gRNA sequence
tccatagtcatactagttta

SEQ ID NO: 428470 - DNA, 20 bp, Artificial
  CRISPR gRNA sequence
ccatagtcatactagtttac

SEQ ID NO: 428471 - DNA, 20 bp, Artificial
  CRISPR gRNA sequence
catagtcatactagtttaca

SEQ ID NO: 428472 - DNA, 20 bp, Artificial
  CRISPR gRNA sequence
gtttacattcccacaagcag

SEQ ID NO: 428473 - DNA, 20 bp, Artificial
  CRISPR gRNA sequence
acattcccacaagcagtgta

SEQ ID NO: 428474 - DNA, 20 bp, Artificial
  CRISPR gRNA sequence
cattcccacaagcagtgtaa

SEQ ID NO: 428475 - DNA, 20 bp, Artificial
  CRISPR gRNA sequence
ccacaagcagtgtaaaagtg

SEQ ID NO: 428476 - DNA, 20 bp, Artificial
  CRISPR gRNA sequence
ccctttcaccacatccatgc

SEQ ID NO: 428477 - DNA, 20 bp, Artificial
  CRISPR gRNA sequence
tcaccacatccatgccaaca

SEQ ID NO: 428478 - DNA, 20 bp, Artificial
  CRISPR gRNA sequence
caccacatccatgccaacat

SEQ ID NO: 428479 - DNA, 20 bp, Artificial
  CRISPR gRNA sequence
accacatccatgccaacatg

SEQ ID NO: 428480 - DNA, 20 bp, Artificial
  CRISPR gRNA sequence
tttttttattttttgattaa

SEQ ID NO: 428481 - DNA, 20 bp, Artificial
  CRISPR gRNA sequence
ttttattttttgattaaggc

SEQ ID NO: 428482 - DNA, 20 bp, Artificial
  CRISPR gRNA sequence
tttattttttgattaaggcc

SEQ ID NO: 428483 - DNA, 20 bp, Artificial
  CRISPR gRNA sequence
ttattttttgattaaggcca

SEQ ID NO: 428484 - DNA, 20 bp, Artificial
  CRISPR gRNA sequence
tattttttgattaaggccat

SEQ ID NO: 428485 - DNA, 20 bp, Artificial
  CRISPR gRNA sequence
attttttgattaaggccatt

SEQ ID NO: 428486 - DNA, 20 bp, Artificial
  CRISPR gRNA sequence
ttttttgattaaggccattc

SEQ ID NO: 428487 - DNA, 20 bp, Artificial
  CRISPR gRNA sequence
tttgattaaggccattctta

SEQ ID NO: 428488 - DNA, 20 bp, Artificial
  CRISPR gRNA sequence
ttgattaaggccattcttac

SEQ ID NO: 428489 - DNA, 20 bp, Artificial
  CRISPR gRNA sequence
tgattaaggccattcttaca

SEQ ID NO: 428490 - DNA, 20 bp, Artificial
  CRISPR gRNA sequence
gattaaggccattcttacaa

SEQ ID NO: 428491 - DNA, 20 bp, Artificial
  CRISPR gRNA sequence
attaaggccattcttacaag

SEQ ID NO: 428492 - DNA, 20 bp, Artificial
  CRISPR gRNA sequence
aggccattcttacaagagta

SEQ ID NO: 428493 - DNA, 20 bp, Artificial
  CRISPR gRNA sequence
ttacaagagtaaggtggtat

SEQ ID NO: 428494 - DNA, 20 bp, Artificial
  CRISPR gRNA sequence
acaagagtaaggtggtattg

SEQ ID NO: 428495 - DNA, 20 bp, Artificial
  CRISPR gRNA sequence
caagagtaaggtggtattgt

SEQ ID NO: 428496 - DNA, 20 bp, Artificial
  CRISPR gRNA sequence
tgttttgatttgcgtttccc

SEQ ID NO: 428497 - DNA, 20 bp, Artificial
  CRISPR gRNA sequence
tgatttgcgtttccctgata

SEQ ID NO: 428498 - DNA, 20 bp, Artificial
  CRISPR gRNA sequence
gatttgcgtttccctgataa

SEQ ID NO: 428499 - DNA, 20 bp, Artificial
  CRISPR gRNA sequence
atttgcgtttccctgataat

SEQ ID NO: 428500 - DNA, 20 bp, Artificial
  CRISPR gRNA sequence
gcgtttccctgataattagt

SEQ ID NO: 428501 - DNA, 20 bp, Artificial
  CRISPR gRNA sequence
cgtttccctgataattagtg

SEQ ID NO: 428502 - DNA, 20 bp, Artificial
  CRISPR gRNA sequence
ccctgataattagtgatgtt

SEQ ID NO: 428503 - DNA, 20 bp, Artificial
  CRISPR gRNA sequence
cctgataattagtgatgttg

SEQ ID NO: 428504 - DNA, 20 bp, Artificial
  CRISPR gRNA sequence
ataattagtgatgttgagca

SEQ ID NO: 428505 - DNA, 20 bp, Artificial
  CRISPR gRNA sequence
gtgatgttgagcattttttc

SEQ ID NO: 428506 - DNA, 20 bp, Artificial
  CRISPR gRNA sequence
agcattttttcatatgtttg

SEQ ID NO: 428507 - DNA, 20 bp, Artificial
  CRISPR gRNA sequence
tttcatatgtttgttggcca

SEQ ID NO: 428508 - DNA, 20 bp, Artificial
  CRISPR gRNA sequence
ttcatatgtttgttggccat

SEQ ID NO: 428509 - DNA, 20 bp, Artificial
  CRISPR gRNA sequence
tcatatgtttgttggccatt

SEQ ID NO: 428510 - DNA, 20 bp, Artificial
  CRISPR gRNA sequence
catatgtttgttggccattt

SEQ ID NO: 428511 - DNA, 20 bp, Artificial
  CRISPR gRNA sequence
atatgtttgttggccatttg

SEQ ID NO: 428512 - DNA, 20 bp, Artificial
  CRISPR gRNA sequence
gttggccatttgtatatcct

SEQ ID NO: 428513 - DNA, 20 bp, Artificial
  CRISPR gRNA sequence
ttggccatttgtatatcctt

SEQ ID NO: 428514 - DNA, 20 bp, Artificial
  CRISPR gRNA sequence
gccatttgtatatccttttc

SEQ ID NO: 428515 - DNA, 20 bp, Artificial
  CRISPR gRNA sequence
gtatatccttttctgagaat

SEQ ID NO: 428516 - DNA, 20 bp, Artificial
  CRISPR gRNA sequence
tatatccttttctgagaatt

SEQ ID NO: 428517 - DNA, 20 bp, Artificial
  CRISPR gRNA sequence
ttctgagaattgtcttttta

SEQ ID NO: 428518 - DNA, 20 bp, Artificial
  CRISPR gRNA sequence
tctgagaattgtctttttat

SEQ ID NO: 428519 - DNA, 20 bp, Artificial
  CRISPR gRNA sequence
ctgagaattgtctttttatg

SEQ ID NO: 428520 - DNA, 20 bp, Artificial
  CRISPR gRNA sequence
tgagaattgtctttttatgt

SEQ ID NO: 428521 - DNA, 20 bp, Artificial
  CRISPR gRNA sequence
agaattgtctttttatgtcc

SEQ ID NO: 428522 - DNA, 20 bp, Artificial
  CRISPR gRNA sequence
tctttttatgtccttagccc

SEQ ID NO: 428523 - DNA, 20 bp, Artificial
  CRISPR gRNA sequence
tttatgtccttagcccactt

SEQ ID NO: 428524 - DNA, 20 bp, Artificial
  CRISPR gRNA sequence
ttatgtccttagcccacttt

SEQ ID NO: 428525 - DNA, 20 bp, Artificial
  CRISPR gRNA sequence
tatgtccttagcccactttt

SEQ ID NO: 428526 - DNA, 20 bp, Artificial
  CRISPR gRNA sequence
atgtccttagcccacttttt

SEQ ID NO: 428527 - DNA, 20 bp, Artificial
  CRISPR gRNA sequence
tgtccttagcccactttttg

SEQ ID NO: 428528 - DNA, 20 bp, Artificial
  CRISPR gRNA sequence
agcccactttttgatgggat

SEQ ID NO: 428529 - DNA, 20 bp, Artificial
  CRISPR gRNA sequence
gcccactttttgatgggatt

SEQ ID NO: 428530 - DNA, 20 bp, Artificial
  CRISPR gRNA sequence
tttgatgggatttttttttc

SEQ ID NO: 428531 - DNA, 20 bp, Artificial
  CRISPR gRNA sequence
ttgatgggatttttttttca

SEQ ID NO: 428532 - DNA, 20 bp, Artificial
  CRISPR gRNA sequence
tgatgggatttttttttcag

SEQ ID NO: 428533 - DNA, 20 bp, Artificial
  CRISPR gRNA sequence
gatgggatttttttttcagc

SEQ ID NO: 428534 - DNA, 20 bp, Artificial
  CRISPR gRNA sequence
atgggatttttttttcagct

SEQ ID NO: 428535 - DNA, 20 bp, Artificial
  CRISPR gRNA sequence
ttttttcagctgatttgttt

SEQ ID NO: 428536 - DNA, 20 bp, Artificial
  CRISPR gRNA sequence
tttttcagctgatttgtttg

SEQ ID NO: 428537 - DNA, 20 bp, Artificial
  CRISPR gRNA sequence
ttttcagctgatttgtttga

SEQ ID NO: 428538 - DNA, 20 bp, Artificial
  CRISPR gRNA sequence
tttcagctgatttgtttgag

SEQ ID NO: 428539 - DNA, 20 bp, Artificial
  CRISPR gRNA sequence
ttcagctgatttgtttgagt

SEQ ID NO: 428540 - DNA, 20 bp, Artificial
  CRISPR gRNA sequence
tcagctgatttgtttgagtt

SEQ ID NO: 428541 - DNA, 20 bp, Artificial
  CRISPR gRNA sequence
cagctgatttgtttgagttc

SEQ ID NO: 428542 - DNA, 20 bp, Artificial
  CRISPR gRNA sequence
agctgatttgtttgagttcc

SEQ ID NO: 428543 - DNA, 20 bp, Artificial
  CRISPR gRNA sequence
atttgtttgagttccttgta

SEQ ID NO: 428544 - DNA, 20 bp, Artificial
  CRISPR gRNA sequence
gtttgagttccttgtagatt

SEQ ID NO: 428545 - DNA, 20 bp, Artificial
  CRISPR gRNA sequence
tttgagttccttgtagattc

SEQ ID NO: 428546 - DNA, 20 bp, Artificial
  CRISPR gRNA sequence
gagttccttgtagattctgg

SEQ ID NO: 428547 - DNA, 20 bp, Artificial
  CRISPR gRNA sequence
agttccttgtagattctgga

SEQ ID NO: 428548 - DNA, 20 bp, Artificial
  CRISPR gRNA sequence
cttgtagattctggatatta

SEQ ID NO: 428549 - DNA, 20 bp, Artificial
  CRISPR gRNA sequence
gtagattctggatattagtc

SEQ ID NO: 428550 - DNA, 20 bp, Artificial
  CRISPR gRNA sequence
tagattctggatattagtcc

SEQ ID NO: 428551 - DNA, 20 bp, Artificial
  CRISPR gRNA sequence
tggatattagtcctttgttg

SEQ ID NO: 428552 - DNA, 20 bp, Artificial
  CRISPR gRNA sequence
gatattagtcctttgttgga

SEQ ID NO: 428553 - DNA, 20 bp, Artificial
  CRISPR gRNA sequence
gtcctttgttggatatataa

SEQ ID NO: 428554 - DNA, 20 bp, Artificial
  CRISPR gRNA sequence
tgttggatatataatttaca

SEQ ID NO: 428555 - DNA, 20 bp, Artificial
  CRISPR gRNA sequence
gttggatatataatttacaa

SEQ ID NO: 428556 - DNA, 20 bp, Artificial
  CRISPR gRNA sequence
ttggatatataatttacaaa

SEQ ID NO: 428557 - DNA, 20 bp, Artificial
  CRISPR gRNA sequence
gatatataatttacaaatat

SEQ ID NO: 428558 - DNA, 20 bp, Artificial
  CRISPR gRNA sequence
acaaatattttctcccaatc

SEQ ID NO: 428559 - DNA, 20 bp, Artificial
  CRISPR gRNA sequence
caaatattttctcccaatct

SEQ ID NO: 428560 - DNA, 20 bp, Artificial
  CRISPR gRNA sequence
tctcccaatctgtgggctgt

SEQ ID NO: 428561 - DNA, 20 bp, Artificial
  CRISPR gRNA sequence
ctcccaatctgtgggctgtt

SEQ ID NO: 428562 - DNA, 20 bp, Artificial
  CRISPR gRNA sequence
tcccaatctgtgggctgttt

SEQ ID NO: 428563 - DNA, 20 bp, Artificial
  CRISPR gRNA sequence
ccaatctgtgggctgtttac

SEQ ID NO: 428564 - DNA, 20 bp, Artificial
  CRISPR gRNA sequence
tgggctgtttactctgctga

SEQ ID NO: 428565 - DNA, 20 bp, Artificial
  CRISPR gRNA sequence
tttactctgctgattatttc

SEQ ID NO: 428566 - DNA, 20 bp, Artificial
  CRISPR gRNA sequence
actctgctgattatttcttt

SEQ ID NO: 428567 - DNA, 20 bp, Artificial
  CRISPR gRNA sequence
ctctgctgattatttctttt

SEQ ID NO: 428568 - DNA, 20 bp, Artificial
  CRISPR gRNA sequence
tgctgattatttcttttgct

SEQ ID NO: 428569 - DNA, 20 bp, Artificial
  CRISPR gRNA sequence
ctgattatttcttttgctgt

SEQ ID NO: 428570 - DNA, 20 bp, Artificial
  CRISPR gRNA sequence
attatttcttttgctgtgca

SEQ ID NO: 428571 - DNA, 20 bp, Artificial
  CRISPR gRNA sequence
tttcttttgctgtgcagaag

SEQ ID NO: 428572 - DNA, 20 bp, Artificial
  CRISPR gRNA sequence
cttttgctgtgcagaagata

SEQ ID NO: 428573 - DNA, 20 bp, Artificial
  CRISPR gRNA sequence
ttttgctgtgcagaagatat

SEQ ID NO: 428574 - DNA, 20 bp, Artificial
  CRISPR gRNA sequence
ttgctgtgcagaagatatta

SEQ ID NO: 428575 - DNA, 20 bp, Artificial
  CRISPR gRNA sequence
tgctgtgcagaagatattac

SEQ ID NO: 428576 - DNA, 20 bp, Artificial
  CRISPR gRNA sequence
gctgtgcagaagatattact

SEQ ID NO: 428577 - DNA, 20 bp, Artificial
  CRISPR gRNA sequence
ctgtgcagaagatattactt

SEQ ID NO: 428578 - DNA, 20 bp, Artificial
  CRISPR gRNA sequence
tgcagaagatattacttttt

SEQ ID NO: 428579 - DNA, 20 bp, Artificial
  CRISPR gRNA sequence
ctttttaaaactatttttgt

SEQ ID NO: 428580 - DNA, 20 bp, Artificial
  CRISPR gRNA sequence
tttaaaactatttttgtttt

SEQ ID NO: 428581 - DNA, 20 bp, Artificial
  CRISPR gRNA sequence
ttaaaactatttttgtttta

SEQ ID NO: 428582 - DNA, 20 bp, Artificial
  CRISPR gRNA sequence
taaaactatttttgttttaa

SEQ ID NO: 428583 - DNA, 20 bp, Artificial
  CRISPR gRNA sequence
aaaactatttttgttttaaa

SEQ ID NO: 428584 - DNA, 20 bp, Artificial
  CRISPR gRNA sequence
aaactatttttgttttaaaa

SEQ ID NO: 428585 - DNA, 20 bp, Artificial
  CRISPR gRNA sequence
tttttgttttaaaaaaacac

SEQ ID NO: 428586 - DNA, 20 bp, Artificial
  CRISPR gRNA sequence
ttgttttaaaaaaacactta

SEQ ID NO: 428587 - DNA, 20 bp, Artificial
  CRISPR gRNA sequence
tgttttaaaaaaacacttaa

SEQ ID NO: 428588 - DNA, 20 bp, Artificial
  CRISPR gRNA sequence
gttttaaaaaaacacttaaa

SEQ ID NO: 428589 - DNA, 20 bp, Artificial
  CRISPR gRNA sequence
ttttaaaaaaacacttaaaa

SEQ ID NO: 428590 - DNA, 20 bp, Artificial
  CRISPR gRNA sequence
taaaaaaacacttaaaatat

SEQ ID NO: 428591 - DNA, 20 bp, Artificial
  CRISPR gRNA sequence
aaaaaaacacttaaaatata

SEQ ID NO: 428592 - DNA, 20 bp, Artificial
  CRISPR gRNA sequence
aaaaaacacttaaaatataa

SEQ ID NO: 428593 - DNA, 20 bp, Artificial
  CRISPR gRNA sequence
aaaatataaaagccatcttt

SEQ ID NO: 428594 - DNA, 20 bp, Artificial
  CRISPR gRNA sequence
aaatataaaagccatcttta

SEQ ID NO: 428595 - DNA, 20 bp, Artificial
  CRISPR gRNA sequence
tagttcaagggctgtaaaaa

SEQ ID NO: 428596 - DNA, 20 bp, Artificial
  CRISPR gRNA sequence
agttcaagggctgtaaaaaa

SEQ ID NO: 428597 - DNA, 20 bp, Artificial
  CRISPR gRNA sequence
gttcaagggctgtaaaaaac

SEQ ID NO: 428598 - DNA, 20 bp, Artificial
  CRISPR gRNA sequence
aagggctgtaaaaaaccagc

SEQ ID NO: 428599 - DNA, 20 bp, Artificial
  CRISPR gRNA sequence
taaaaaaccagcagtgggcc

SEQ ID NO: 428600 - DNA, 20 bp, Artificial
  CRISPR gRNA sequence
gacccacaaaactcagtttg

SEQ ID NO: 428601 - DNA, 20 bp, Artificial
  CRISPR gRNA sequence
acccacaaaactcagtttgc

SEQ ID NO: 428602 - DNA, 20 bp, Artificial
  CRISPR gRNA sequence
agtttgccatttctgattta

SEQ ID NO: 428603 - DNA, 20 bp, Artificial
  CRISPR gRNA sequence
gccatttctgatttagtagg

SEQ ID NO: 428604 - DNA, 20 bp, Artificial
  CRISPR gRNA sequence
ccatttctgatttagtaggt

SEQ ID NO: 428605 - DNA, 20 bp, Artificial
  CRISPR gRNA sequence
ctgatttagtaggtttattc

SEQ ID NO: 428606 - DNA, 20 bp, Artificial
  CRISPR gRNA sequence
tgatttagtaggtttattct

SEQ ID NO: 428607 - DNA, 20 bp, Artificial
  CRISPR gRNA sequence
atttagtaggtttattctct

SEQ ID NO: 428608 - DNA, 20 bp, Artificial
  CRISPR gRNA sequence
agtaggtttattctctgagc

SEQ ID NO: 428609 - DNA, 20 bp, Artificial
  CRISPR gRNA sequence
gtaggtttattctctgagca

SEQ ID NO: 428610 - DNA, 20 bp, Artificial
  CRISPR gRNA sequence
attctctgagcattttgttc

SEQ ID NO: 428611 - DNA, 20 bp, Artificial
  CRISPR gRNA sequence
ttctctgagcattttgttcc

SEQ ID NO: 428612 - DNA, 20 bp, Artificial
  CRISPR gRNA sequence
tctgagcattttgttcccct

SEQ ID NO: 428613 - DNA, 20 bp, Artificial
  CRISPR gRNA sequence
tgagcattttgttccccttt

SEQ ID NO: 428614 - DNA, 20 bp, Artificial
  CRISPR gRNA sequence
agcattttgttccccttttc

SEQ ID NO: 428615 - DNA, 20 bp, Artificial
  CRISPR gRNA sequence
tgttccccttttccatagtt

SEQ ID NO: 428616 - DNA, 20 bp, Artificial
  CRISPR gRNA sequence
gttccccttttccatagttt

SEQ ID NO: 428617 - DNA, 20 bp, Artificial
  CRISPR gRNA sequence
ttccccttttccatagtttg

SEQ ID NO: 428618 - DNA, 20 bp, Artificial
  CRISPR gRNA sequence
cccttttccatagtttgcca

SEQ ID NO: 428619 - DNA, 20 bp, Artificial
  CRISPR gRNA sequence
ttccatagtttgccaaagca

SEQ ID NO: 428620 - DNA, 20 bp, Artificial
  CRISPR gRNA sequence
tccatagtttgccaaagcag

SEQ ID NO: 428621 - DNA, 20 bp, Artificial
  CRISPR gRNA sequence
ccatagtttgccaaagcagt

SEQ ID NO: 428622 - DNA, 20 bp, Artificial
  CRISPR gRNA sequence
catagtttgccaaagcagtg

SEQ ID NO: 428623 - DNA, 20 bp, Artificial
  CRISPR gRNA sequence
gccaaagcagtgttgtcatc

SEQ ID NO: 428624 - DNA, 20 bp, Artificial
  CRISPR gRNA sequence
ccaaagcagtgttgtcatct

SEQ ID NO: 428625 - DNA, 20 bp, Artificial
  CRISPR gRNA sequence
tcatctctattgacagcagt

SEQ ID NO: 428626 - DNA, 20 bp, Artificial
  CRISPR gRNA sequence
tattgacagcagtatatcag

SEQ ID NO: 428627 - DNA, 20 bp, Artificial
  CRISPR gRNA sequence
ttgacagcagtatatcagaa

SEQ ID NO: 428628 - DNA, 20 bp, Artificial
  CRISPR gRNA sequence
acagcagtatatcagaatca

SEQ ID NO: 428629 - DNA, 20 bp, Artificial
  CRISPR gRNA sequence
ctggggcccttgtgagggtg

SEQ ID NO: 428630 - DNA, 20 bp, Artificial
  CRISPR gRNA sequence
gggcccttgtgagggtgtta

SEQ ID NO: 428631 - DNA, 20 bp, Artificial
  CRISPR gRNA sequence
gtgagggtgttaaatattga

SEQ ID NO: 428632 - DNA, 20 bp, Artificial
  CRISPR gRNA sequence
tgagggtgttaaatattgag

SEQ ID NO: 428633 - DNA, 20 bp, Artificial
  CRISPR gRNA sequence
aatattgagcgttccaatat

SEQ ID NO: 428634 - DNA, 20 bp, Artificial
  CRISPR gRNA sequence
agcgttccaatattgacgca

SEQ ID NO: 428635 - DNA, 20 bp, Artificial
  CRISPR gRNA sequence
caatattgacgcattatccc

SEQ ID NO: 428636 - DNA, 20 bp, Artificial
  CRISPR gRNA sequence
acgcattatccctcatccag

SEQ ID NO: 428637 - DNA, 20 bp, Artificial
  CRISPR gRNA sequence
tccctcatccaggcttatgt

SEQ ID NO: 428638 - DNA, 20 bp, Artificial
  CRISPR gRNA sequence
atccaggcttatgttctacc

SEQ ID NO: 428639 - DNA, 20 bp, Artificial
  CRISPR gRNA sequence
atgttctaccccctaccaca

SEQ ID NO: 428640 - DNA, 20 bp, Artificial
  CRISPR gRNA sequence
tgttctaccccctaccacaa

SEQ ID NO: 428641 - DNA, 20 bp, Artificial
  CRISPR gRNA sequence
taccccctaccacaatccat

SEQ ID NO: 428642 - DNA, 20 bp, Artificial
  CRISPR gRNA sequence
ccccctaccacaatccatca

SEQ ID NO: 428643 - DNA, 20 bp, Artificial
  CRISPR gRNA sequence
ccacaatccatcaccttcag

SEQ ID NO: 428644 - DNA, 20 bp, Artificial
  CRISPR gRNA sequence
cagaattcatgcctaggcat

SEQ ID NO: 428645 - DNA, 20 bp, Artificial
  CRISPR gRNA sequence
agaattcatgcctaggcatc

SEQ ID NO: 428646 - DNA, 20 bp, Artificial
  CRISPR gRNA sequence
atgcctaggcatcttctccc

SEQ ID NO: 428647 - DNA, 20 bp, Artificial
  CRISPR gRNA sequence
ggcatcttctcccagtccct

SEQ ID NO: 428648 - DNA, 20 bp, Artificial
  CRISPR gRNA sequence
ctcccagtccctgccagtag

SEQ ID NO: 428649 - DNA, 20 bp, Artificial
  CRISPR gRNA sequence
tcccagtccctgccagtaga

SEQ ID NO: 428650 - DNA, 20 bp, Artificial
  CRISPR gRNA sequence
ccagtccctgccagtagatg

SEQ ID NO: 428651 - DNA, 20 bp, Artificial
  CRISPR gRNA sequence
ccagtagatgttagccaggt

SEQ ID NO: 428652 - DNA, 20 bp, Artificial
  CRISPR gRNA sequence
gccaggtcctgtagtatata

SEQ ID NO: 428653 - DNA, 20 bp, Artificial
  CRISPR gRNA sequence
tagtatataacctttctatt

SEQ ID NO: 428654 - DNA, 20 bp, Artificial
  CRISPR gRNA sequence
tctattctcttagcagaccc

SEQ ID NO: 428655 - DNA, 20 bp, Artificial
  CRISPR gRNA sequence
ctattctcttagcagaccca

SEQ ID NO: 428656 - DNA, 20 bp, Artificial
  CRISPR gRNA sequence
tattctcttagcagacccag

SEQ ID NO: 428657 - DNA, 20 bp, Artificial
  CRISPR gRNA sequence
ttctcttagcagacccagca

SEQ ID NO: 428658 - DNA, 20 bp, Artificial
  CRISPR gRNA sequence
tcttagcagacccagcactt

SEQ ID NO: 428659 - DNA, 20 bp, Artificial
  CRISPR gRNA sequence
ttagcagacccagcacttcc

SEQ ID NO: 428660 - DNA, 20 bp, Artificial
  CRISPR gRNA sequence
agcagacccagcacttcctc

SEQ ID NO: 428661 - DNA, 20 bp, Artificial
  CRISPR gRNA sequence
gcagacccagcacttcctcc

SEQ ID NO: 428662 - DNA, 20 bp, Artificial
  CRISPR gRNA sequence
cctccattagcatgggctga

SEQ ID NO: 428663 - DNA, 20 bp, Artificial
  CRISPR gRNA sequence
ctccattagcatgggctgag

SEQ ID NO: 428664 - DNA, 20 bp, Artificial
  CRISPR gRNA sequence
cattagcatgggctgagatt

SEQ ID NO: 428665 - DNA, 20 bp, Artificial
  CRISPR gRNA sequence
gcatgggctgagattttatc

SEQ ID NO: 428666 - DNA, 20 bp, Artificial
  CRISPR gRNA sequence
agattttatcctaattacgg

SEQ ID NO: 428667 - DNA, 20 bp, Artificial
  CRISPR gRNA sequence
tatcctaattacgggcctga

SEQ ID NO: 428668 - DNA, 20 bp, Artificial
  CRISPR gRNA sequence
atcctaattacgggcctgat

SEQ ID NO: 428669 - DNA, 20 bp, Artificial
  CRISPR gRNA sequence
tcctaattacgggcctgatg

SEQ ID NO: 428670 - DNA, 20 bp, Artificial
  CRISPR gRNA sequence
attacgggcctgatggacag

SEQ ID NO: 428671 - DNA, 20 bp, Artificial
  CRISPR gRNA sequence
cgggcctgatggacagtagg

SEQ ID NO: 428672 - DNA, 20 bp, Artificial
  CRISPR gRNA sequence
atggacagtaggggaggcag

SEQ ID NO: 428673 - DNA, 20 bp, Artificial
  CRISPR gRNA sequence
ttttccatcaaggggaagtg

SEQ ID NO: 428674 - DNA, 20 bp, Artificial
  CRISPR gRNA sequence
ttccatcaaggggaagtggg

SEQ ID NO: 428675 - DNA, 20 bp, Artificial
  CRISPR gRNA sequence
tccatcaaggggaagtgggc

SEQ ID NO: 428676 - DNA, 20 bp, Artificial
  CRISPR gRNA sequence
ccatcaaggggaagtgggcc

SEQ ID NO: 428677 - DNA, 20 bp, Artificial
  CRISPR gRNA sequence
catcaaggggaagtgggcca

SEQ ID NO: 428678 - DNA, 20 bp, Artificial
  CRISPR gRNA sequence
ctgcagctccagatggtata

SEQ ID NO: 428679 - DNA, 20 bp, Artificial
  CRISPR gRNA sequence
tgcagctccagatggtataa

SEQ ID NO: 428680 - DNA, 20 bp, Artificial
  CRISPR gRNA sequence
cagctccagatggtataaga

SEQ ID NO: 428681 - DNA, 20 bp, Artificial
  CRISPR gRNA sequence
cagatggtataagagaagca

SEQ ID NO: 428682 - DNA, 20 bp, Artificial
  CRISPR gRNA sequence
ctggctctcaaatgcatctt

SEQ ID NO: 428683 - DNA, 20 bp, Artificial
  CRISPR gRNA sequence
gctctcaaatgcatctttcc

SEQ ID NO: 428684 - DNA, 20 bp, Artificial
  CRISPR gRNA sequence
tcaaatgcatctttccagag

SEQ ID NO: 428685 - DNA, 20 bp, Artificial
  CRISPR gRNA sequence
aaatgcatctttccagagat

SEQ ID NO: 428686 - DNA, 20 bp, Artificial
  CRISPR gRNA sequence
tccagagatcctcattccaa

SEQ ID NO: 428687 - DNA, 20 bp, Artificial
  CRISPR gRNA sequence
ccagagatcctcattccaag

SEQ ID NO: 428688 - DNA, 20 bp, Artificial
  CRISPR gRNA sequence
cagagatcctcattccaagt

SEQ ID NO: 428689 - DNA, 20 bp, Artificial
  CRISPR gRNA sequence
attccaagtttcaggagact

SEQ ID NO: 428690 - DNA, 20 bp, Artificial
  CRISPR gRNA sequence
caagtttcaggagactcctc

SEQ ID NO: 428691 - DNA, 20 bp, Artificial
  CRISPR gRNA sequence
caggagactcctcctctact

SEQ ID NO: 428692 - DNA, 20 bp, Artificial
  CRISPR gRNA sequence
aggagactcctcctctacta

SEQ ID NO: 428693 - DNA, 20 bp, Artificial
  CRISPR gRNA sequence
ctcctctactatcaagatgc

SEQ ID NO: 428694 - DNA, 20 bp, Artificial
  CRISPR gRNA sequence
ctctactatcaagatgctag

SEQ ID NO: 428695 - DNA, 20 bp, Artificial
  CRISPR gRNA sequence
tactatcaagatgctagctt

SEQ ID NO: 428696 - DNA, 20 bp, Artificial
  CRISPR gRNA sequence
ctatcaagatgctagctttg

SEQ ID NO: 428697 - DNA, 20 bp, Artificial
  CRISPR gRNA sequence
tcaagatgctagctttggca

SEQ ID NO: 428698 - DNA, 20 bp, Artificial
  CRISPR gRNA sequence
gctttggcatagaaaattta

SEQ ID NO: 428699 - DNA, 20 bp, Artificial
  CRISPR gRNA sequence
tggcatagaaaatttaccta

SEQ ID NO: 428700 - DNA, 20 bp, Artificial
  CRISPR gRNA sequence
ggcatagaaaatttacctag

SEQ ID NO: 428701 - DNA, 20 bp, Artificial
  CRISPR gRNA sequence
gcatagaaaatttacctagg

SEQ ID NO: 428702 - DNA, 20 bp, Artificial
  CRISPR gRNA sequence
acctaggcttagaatcagcc

SEQ ID NO: 428703 - DNA, 20 bp, Artificial
  CRISPR gRNA sequence
cctaggcttagaatcagcct

SEQ ID NO: 428704 - DNA, 20 bp, Artificial
  CRISPR gRNA sequence
ggcttagaatcagccttctt

SEQ ID NO: 428705 - DNA, 20 bp, Artificial
  CRISPR gRNA sequence
agaatcagccttctttaaag

SEQ ID NO: 428706 - DNA, 20 bp, Artificial
  CRISPR gRNA sequence
gaatcagccttctttaaagt

SEQ ID NO: 428707 - DNA, 20 bp, Artificial
  CRISPR gRNA sequence
ctttaaagtcctgtccctct

SEQ ID NO: 428708 - DNA, 20 bp, Artificial
  CRISPR gRNA sequence
tttaaagtcctgtccctctt

SEQ ID NO: 428709 - DNA, 20 bp, Artificial
  CRISPR gRNA sequence
taaagtcctgtccctcttac

SEQ ID NO: 428710 - DNA, 20 bp, Artificial
  CRISPR gRNA sequence
aaagtcctgtccctcttaca

SEQ ID NO: 428711 - DNA, 20 bp, Artificial
  CRISPR gRNA sequence
aagtcctgtccctcttacaa

SEQ ID NO: 428712 - DNA, 20 bp, Artificial
  CRISPR gRNA sequence
tccctcttacaattagctta

SEQ ID NO: 428713 - DNA, 20 bp, Artificial
  CRISPR gRNA sequence
ttacaattagcttatgtacc

SEQ ID NO: 428714 - DNA, 20 bp, Artificial
  CRISPR gRNA sequence
acaattagcttatgtacctg

SEQ ID NO: 428715 - DNA, 20 bp, Artificial
  CRISPR gRNA sequence
caattagcttatgtacctgg

SEQ ID NO: 428716 - DNA, 20 bp, Artificial
  CRISPR gRNA sequence
gcttatgtacctggtcttca

SEQ ID NO: 428717 - DNA, 20 bp, Artificial
  CRISPR gRNA sequence
atgtacctggtcttcagctg

SEQ ID NO: 428718 - DNA, 20 bp, Artificial
  CRISPR gRNA sequence
tgtacctggtcttcagctgt

SEQ ID NO: 428719 - DNA, 20 bp, Artificial
  CRISPR gRNA sequence
gtcttcagctgtggatagac

SEQ ID NO: 428720 - DNA, 20 bp, Artificial
  CRISPR gRNA sequence
cagctgtggatagacgagtg

SEQ ID NO: 428721 - DNA, 20 bp, Artificial
  CRISPR gRNA sequence
agctgtggatagacgagtgt

SEQ ID NO: 428722 - DNA, 20 bp, Artificial
  CRISPR gRNA sequence
tggatagacgagtgtctttt

SEQ ID NO: 428723 - DNA, 20 bp, Artificial
  CRISPR gRNA sequence
ttaaatgctgccaaggagga

SEQ ID NO: 428724 - DNA, 20 bp, Artificial
  CRISPR gRNA sequence
taaatgctgccaaggaggag

SEQ ID NO: 428725 - DNA, 20 bp, Artificial
  CRISPR gRNA sequence
aaatgctgccaaggaggagc

SEQ ID NO: 428726 - DNA, 20 bp, Artificial
  CRISPR gRNA sequence
aatgctgccaaggaggagct

SEQ ID NO: 428727 - DNA, 20 bp, Artificial
  CRISPR gRNA sequence
ccaaggaggagctttaactc

SEQ ID NO: 428728 - DNA, 20 bp, Artificial
  CRISPR gRNA sequence
taactctcacactttgagtt

SEQ ID NO: 428729 - DNA, 20 bp, Artificial
  CRISPR gRNA sequence
aactctcacactttgagttg

SEQ ID NO: 428730 - DNA, 20 bp, Artificial
  CRISPR gRNA sequence
actctcacactttgagttgc

SEQ ID NO: 428731 - DNA, 20 bp, Artificial
  CRISPR gRNA sequence
tcacactttgagttgctgat

SEQ ID NO: 428732 - DNA, 20 bp, Artificial
  CRISPR gRNA sequence
acactttgagttgctgatag

SEQ ID NO: 428733 - DNA, 20 bp, Artificial
  CRISPR gRNA sequence
tgagttgctgatagatctga

SEQ ID NO: 428734 - DNA, 20 bp, Artificial
  CRISPR gRNA sequence
gagttgctgatagatctgag

SEQ ID NO: 428735 - DNA, 20 bp, Artificial
  CRISPR gRNA sequence
agttgctgatagatctgagg

SEQ ID NO: 428736 - DNA, 20 bp, Artificial
  CRISPR gRNA sequence
ctgatagatctgaggctgtc

SEQ ID NO: 428737 - DNA, 20 bp, Artificial
  CRISPR gRNA sequence
atagatctgaggctgtcatt

SEQ ID NO: 428738 - DNA, 20 bp, Artificial
  CRISPR gRNA sequence
aggctgtcattttctcactt

SEQ ID NO: 428739 - DNA, 20 bp, Artificial
  CRISPR gRNA sequence
tcattttctcacttcagtcc

SEQ ID NO: 428740 - DNA, 20 bp, Artificial
  CRISPR gRNA sequence
tctcacttcagtccatcggt

SEQ ID NO: 428741 - DNA, 20 bp, Artificial
  CRISPR gRNA sequence
ctcacttcagtccatcggtg

SEQ ID NO: 428742 - DNA, 20 bp, Artificial
  CRISPR gRNA sequence
tcacttcagtccatcggtgc

SEQ ID NO: 428743 - DNA, 20 bp, Artificial
  CRISPR gRNA sequence
acttcagtccatcggtgcaa

SEQ ID NO: 428744 - DNA, 20 bp, Artificial
  CRISPR gRNA sequence
cagtccatcggtgcaattta

SEQ ID NO: 428745 - DNA, 20 bp, Artificial
  CRISPR gRNA sequence
agtccatcggtgcaatttag

SEQ ID NO: 428746 - DNA, 20 bp, Artificial
  CRISPR gRNA sequence
agcaaaagtcaattttgagt

SEQ ID NO: 428747 - DNA, 20 bp, Artificial
  CRISPR gRNA sequence
gcaaaagtcaattttgagtc

SEQ ID NO: 428748 - DNA, 20 bp, Artificial
  CRISPR gRNA sequence
tgagtcctaatattaactat

SEQ ID NO: 428749 - DNA, 20 bp, Artificial
  CRISPR gRNA sequence
gagtcctaatattaactatt

SEQ ID NO: 428750 - DNA, 20 bp, Artificial
  CRISPR gRNA sequence
agtcctaatattaactatta

SEQ ID NO: 428751 - DNA, 20 bp, Artificial
  CRISPR gRNA sequence
atattaactattaccctata

SEQ ID NO: 428752 - DNA, 20 bp, Artificial
  CRISPR gRNA sequence
actattaccctatactgttg

SEQ ID NO: 428753 - DNA, 20 bp, Artificial
  CRISPR gRNA sequence
ttaccctatactgttgaccc

SEQ ID NO: 428754 - DNA, 20 bp, Artificial
  CRISPR gRNA sequence
ccctatactgttgacccaat

SEQ ID NO: 428755 - DNA, 20 bp, Artificial
  CRISPR gRNA sequence
tactgttgacccaattccag

SEQ ID NO: 428756 - DNA, 20 bp, Artificial
  CRISPR gRNA sequence
ttgacccaattccagagttc

SEQ ID NO: 428757 - DNA, 20 bp, Artificial
  CRISPR gRNA sequence
acccaattccagagttctaa

SEQ ID NO: 428758 - DNA, 20 bp, Artificial
  CRISPR gRNA sequence
cagagttctaacactaacta

SEQ ID NO: 428759 - DNA, 20 bp, Artificial
  CRISPR gRNA sequence
taacactaactatttaccct

SEQ ID NO: 428760 - DNA, 20 bp, Artificial
  CRISPR gRNA sequence
acactaactatttaccctat

SEQ ID NO: 428761 - DNA, 20 bp, Artificial
  CRISPR gRNA sequence
actatttaccctatacacct

SEQ ID NO: 428762 - DNA, 20 bp, Artificial
  CRISPR gRNA sequence
tttaccctatacacctcaaa

SEQ ID NO: 428763 - DNA, 20 bp, Artificial
  CRISPR gRNA sequence
accctatacacctcaaatgt

SEQ ID NO: 428764 - DNA, 20 bp, Artificial
  CRISPR gRNA sequence
ccctatacacctcaaatgtt

SEQ ID NO: 428765 - DNA, 20 bp, Artificial
  CRISPR gRNA sequence
tacacctcaaatgttagagt

SEQ ID NO: 428766 - DNA, 20 bp, Artificial
  CRISPR gRNA sequence
aaatgttagagtcagtgcac

SEQ ID NO: 428767 - DNA, 20 bp, Artificial
  CRISPR gRNA sequence
gagtcagtgcaccagctcat

SEQ ID NO: 428768 - DNA, 20 bp, Artificial
  CRISPR gRNA sequence
atagtttccatccatctgtg

SEQ ID NO: 428769 - DNA, 20 bp, Artificial
  CRISPR gRNA sequence
ccatccatctgtgtcccatc

SEQ ID NO: 428770 - DNA, 20 bp, Artificial
  CRISPR gRNA sequence
catccatctgtgtcccatct

SEQ ID NO: 428771 - DNA, 20 bp, Artificial
  CRISPR gRNA sequence
tgtcccatctcatttcacca

SEQ ID NO: 428772 - DNA, 20 bp, Artificial
  CRISPR gRNA sequence
atttcaccaccagtcatggg

SEQ ID NO: 428773 - DNA, 20 bp, Artificial
  CRISPR gRNA sequence
caccaccagtcatggggttt

SEQ ID NO: 428774 - DNA, 20 bp, Artificial
  CRISPR gRNA sequence
accaccagtcatggggtttg

SEQ ID NO: 428775 - DNA, 20 bp, Artificial
  CRISPR gRNA sequence
gtgttgccatctagcaggtg

SEQ ID NO: 428776 - DNA, 20 bp, Artificial
  CRISPR gRNA sequence
tgttgccatctagcaggtga

SEQ ID NO: 428777 - DNA, 20 bp, Artificial
  CRISPR gRNA sequence
ccatctagcaggtgaatgat

SEQ ID NO: 428778 - DNA, 20 bp, Artificial
  CRISPR gRNA sequence
gcaggtgaatgatcccattc

SEQ ID NO: 428779 - DNA, 20 bp, Artificial
  CRISPR gRNA sequence
cacaatcctgttcttacagg

SEQ ID NO: 428780 - DNA, 20 bp, Artificial
  CRISPR gRNA sequence
ttcttacaggctgccttcta

SEQ ID NO: 428781 - DNA, 20 bp, Artificial
  CRISPR gRNA sequence
ttacaggctgccttctagga

SEQ ID NO: 428782 - DNA, 20 bp, Artificial
  CRISPR gRNA sequence
acaggctgccttctaggact

SEQ ID NO: 428783 - DNA, 20 bp, Artificial
  CRISPR gRNA sequence
caggctgccttctaggacta

SEQ ID NO: 428784 - DNA, 20 bp, Artificial
  CRISPR gRNA sequence
ccttctaggactattcccag

SEQ ID NO: 428785 - DNA, 20 bp, Artificial
  CRISPR gRNA sequence
ctaggactattcccagcagc

SEQ ID NO: 428786 - DNA, 20 bp, Artificial
  CRISPR gRNA sequence
taggactattcccagcagca

SEQ ID NO: 428787 - DNA, 20 bp, Artificial
  CRISPR gRNA sequence
ggactattcccagcagcaac

SEQ ID NO: 428788 - DNA, 20 bp, Artificial
  CRISPR gRNA sequence
ttcccagcagcaactgtttt

SEQ ID NO: 428789 - DNA, 20 bp, Artificial
  CRISPR gRNA sequence
ccagcagcaactgttttaga

SEQ ID NO: 428790 - DNA, 20 bp, Artificial
  CRISPR gRNA sequence
ttttagatcaggtccccgga

SEQ ID NO: 428791 - DNA, 20 bp, Artificial
  CRISPR gRNA sequence
tagatcaggtccccggaaat

SEQ ID NO: 428792 - DNA, 20 bp, Artificial
  CRISPR gRNA sequence
agatcaggtccccggaaata

SEQ ID NO: 428793 - DNA, 20 bp, Artificial
  CRISPR gRNA sequence
gatcaggtccccggaaatag

SEQ ID NO: 428794 - DNA, 20 bp, Artificial
  CRISPR gRNA sequence
acatgcaaattttggtgaga

SEQ ID NO: 428795 - DNA, 20 bp, Artificial
  CRISPR gRNA sequence
tggtgagagtgacttattgg

SEQ ID NO: 428796 - DNA, 20 bp, Artificial
  CRISPR gRNA sequence
ggtgagagtgacttattggg

SEQ ID NO: 428797 - DNA, 20 bp, Artificial
  CRISPR gRNA sequence
gtgagagtgacttattggga

SEQ ID NO: 428798 - DNA, 20 bp, Artificial
  CRISPR gRNA sequence
attgggacagctctcagatg

SEQ ID NO: 428799 - DNA, 20 bp, Artificial
  CRISPR gRNA sequence
ttgggacagctctcagatga

SEQ ID NO: 428800 - DNA, 20 bp, Artificial
  CRISPR gRNA sequence
ggacagctctcagatgaaaa

SEQ ID NO: 428801 - DNA, 20 bp, Artificial
  CRISPR gRNA sequence
tcagatgaaaagtagtgaag

SEQ ID NO: 428802 - DNA, 20 bp, Artificial
  CRISPR gRNA sequence
agatgaaaagtagtgaagga

SEQ ID NO: 428803 - DNA, 20 bp, Artificial
  CRISPR gRNA sequence
agggaagaaagctcagcatg

SEQ ID NO: 428804 - DNA, 20 bp, Artificial
  CRISPR gRNA sequence
agcatggatatggtctcagc

SEQ ID NO: 428805 - DNA, 20 bp, Artificial
  CRISPR gRNA sequence
agctggagacttggctgaag

SEQ ID NO: 428806 - DNA, 20 bp, Artificial
  CRISPR gRNA sequence
gagacttggctgaagcaaga

SEQ ID NO: 428807 - DNA, 20 bp, Artificial
  CRISPR gRNA sequence
ggctgaagcaagaattgtac

SEQ ID NO: 428808 - DNA, 20 bp, Artificial
  CRISPR gRNA sequence
gctgaagcaagaattgtaca

SEQ ID NO: 428809 - DNA, 20 bp, Artificial
  CRISPR gRNA sequence
aagcaagaattgtacagagt

SEQ ID NO: 428810 - DNA, 20 bp, Artificial
  CRISPR gRNA sequence
tacagagtcggttgaacctt

SEQ ID NO: 428811 - DNA, 20 bp, Artificial
  CRISPR gRNA sequence
aacctttaggcagggagctg

SEQ ID NO: 428812 - DNA, 20 bp, Artificial
  CRISPR gRNA sequence
taggcagggagctggcattt

SEQ ID NO: 428813 - DNA, 20 bp, Artificial
  CRISPR gRNA sequence
aggcagggagctggcatttt

SEQ ID NO: 428814 - DNA, 20 bp, Artificial
  CRISPR gRNA sequence
ggcagggagctggcattttg

SEQ ID NO: 428815 - DNA, 20 bp, Artificial
  CRISPR gRNA sequence
gcattttggaaatccaccta

SEQ ID NO: 428816 - DNA, 20 bp, Artificial
  CRISPR gRNA sequence
tggaaatccacctaggtcag

SEQ ID NO: 428817 - DNA, 20 bp, Artificial
  CRISPR gRNA sequence
ggaaatccacctaggtcagt

SEQ ID NO: 428818 - DNA, 20 bp, Artificial
  CRISPR gRNA sequence
gaaatccacctaggtcagtc

SEQ ID NO: 428819 - DNA, 20 bp, Artificial
  CRISPR gRNA sequence
ggtcagtcattacttctggc

SEQ ID NO: 428820 - DNA, 20 bp, Artificial
  CRISPR gRNA sequence
cttctggctgctcaccagcg

SEQ ID NO: 428821 - DNA, 20 bp, Artificial
  CRISPR gRNA sequence
ctggctgctcaccagcgagg

SEQ ID NO: 428822 - DNA, 20 bp, Artificial
  CRISPR gRNA sequence
tggctgctcaccagcgaggg

SEQ ID NO: 428823 - DNA, 20 bp, Artificial
  CRISPR gRNA sequence
gctgctcaccagcgagggcc

SEQ ID NO: 428824 - DNA, 20 bp, Artificial
  CRISPR gRNA sequence
ctcaccagcgagggcccaag

SEQ ID NO: 428825 - DNA, 20 bp, Artificial
  CRISPR gRNA sequence
accagcgagggcccaagagc

SEQ ID NO: 428826 - DNA, 20 bp, Artificial
  CRISPR gRNA sequence
tccagagaaggggctgctgt

SEQ ID NO: 428827 - DNA, 20 bp, Artificial
  CRISPR gRNA sequence
cagagaaggggctgctgtga

SEQ ID NO: 428828 - DNA, 20 bp, Artificial
  CRISPR gRNA sequence
ctgtgagctcacagcgtaca

SEQ ID NO: 428829 - DNA, 20 bp, Artificial
  CRISPR gRNA sequence
tgagctcacagcgtacactc

SEQ ID NO: 428830 - DNA, 20 bp, Artificial
  CRISPR gRNA sequence
acagcgtacactcccagcat

SEQ ID NO: 428831 - DNA, 20 bp, Artificial
  CRISPR gRNA sequence
ccagcatctggaaaatggga

SEQ ID NO: 428832 - DNA, 20 bp, Artificial
  CRISPR gRNA sequence
gaaaatgggagtgctggtca

SEQ ID NO: 428833 - DNA, 20 bp, Artificial
  CRISPR gRNA sequence
gtcaggtagagagatctgag

SEQ ID NO: 428834 - DNA, 20 bp, Artificial
  CRISPR gRNA sequence
agcaggaactgtacattagt

SEQ ID NO: 428835 - DNA, 20 bp, Artificial
  CRISPR gRNA sequence
tacattagttatgggtctcc

SEQ ID NO: 428836 - DNA, 20 bp, Artificial
  CRISPR gRNA sequence
gttatgggtctccggaggga

SEQ ID NO: 428837 - DNA, 20 bp, Artificial
  CRISPR gRNA sequence
tgggtctccggagggacaga

SEQ ID NO: 428838 - DNA, 20 bp, Artificial
  CRISPR gRNA sequence
cggagggacagaaccaatag

SEQ ID NO: 428839 - DNA, 20 bp, Artificial
  CRISPR gRNA sequence
gatggatggatgggtgggtg

SEQ ID NO: 428840 - DNA, 20 bp, Artificial
  CRISPR gRNA sequence
gttaggggaatttgttcagg

SEQ ID NO: 428841 - DNA, 20 bp, Artificial
  CRISPR gRNA sequence
ttaggggaatttgttcaggt

SEQ ID NO: 428842 - DNA, 20 bp, Artificial
  CRISPR gRNA sequence
ggggaatttgttcaggtgat

SEQ ID NO: 428843 - DNA, 20 bp, Artificial
  CRISPR gRNA sequence
gttcaggtgattgtaaaggc

SEQ ID NO: 428844 - DNA, 20 bp, Artificial
  CRISPR gRNA sequence
ttcaggtgattgtaaaggct

SEQ ID NO: 428845 - DNA, 20 bp, Artificial
  CRISPR gRNA sequence
aggtgattgtaaaggctgag

SEQ ID NO: 428846 - DNA, 20 bp, Artificial
  CRISPR gRNA sequence
taaaggctgagaagtctcac

SEQ ID NO: 428847 - DNA, 20 bp, Artificial
  CRISPR gRNA sequence
agaagtctcaccacaggctg

SEQ ID NO: 428848 - DNA, 20 bp, Artificial
  CRISPR gRNA sequence
accacaggctgtctgcaagc

SEQ ID NO: 428849 - DNA, 20 bp, Artificial
  CRISPR gRNA sequence
tctgcaagctggagaccttg

SEQ ID NO: 428850 - DNA, 20 bp, Artificial
  CRISPR gRNA sequence
caagctggagaccttgggat

SEQ ID NO: 428851 - DNA, 20 bp, Artificial
  CRISPR gRNA sequence
gagaccttgggatgctggta

SEQ ID NO: 428852 - DNA, 20 bp, Artificial
  CRISPR gRNA sequence
gggatgctggtagcatggct

SEQ ID NO: 428853 - DNA, 20 bp, Artificial
  CRISPR gRNA sequence
ggatgctggtagcatggctc

SEQ ID NO: 428854 - DNA, 20 bp, Artificial
  CRISPR gRNA sequence
gtagcatggctcagttcaag

SEQ ID NO: 428855 - DNA, 20 bp, Artificial
  CRISPR gRNA sequence
agttcaagtccaacagcctc

SEQ ID NO: 428856 - DNA, 20 bp, Artificial
  CRISPR gRNA sequence
aagtccaacagcctcagaac

SEQ ID NO: 428857 - DNA, 20 bp, Artificial
  CRISPR gRNA sequence
agaaccactgaggctgttgg

SEQ ID NO: 428858 - DNA, 20 bp, Artificial
  CRISPR gRNA sequence
aggctgttggtgtaattctc

SEQ ID NO: 428859 - DNA, 20 bp, Artificial
  CRISPR gRNA sequence
ttggtgtaattctcagtcca

SEQ ID NO: 428860 - DNA, 20 bp, Artificial
  CRISPR gRNA sequence
gtgtaattctcagtccaagg

SEQ ID NO: 428861 - DNA, 20 bp, Artificial
  CRISPR gRNA sequence
tcagtccaaggctaagggcc

SEQ ID NO: 428862 - DNA, 20 bp, Artificial
  CRISPR gRNA sequence
agtccaaggctaagggcctg

SEQ ID NO: 428863 - DNA, 20 bp, Artificial
  CRISPR gRNA sequence
agggcctgaaaacccagggt

SEQ ID NO: 428864 - DNA, 20 bp, Artificial
  CRISPR gRNA sequence
aaaacccagggtcaggagca

SEQ ID NO: 428865 - DNA, 20 bp, Artificial
  CRISPR gRNA sequence
gtttaagtcctggagtccga

SEQ ID NO: 428866 - DNA, 20 bp, Artificial
  CRISPR gRNA sequence
aagtcctggagtccgaaagc

SEQ ID NO: 428867 - DNA, 20 bp, Artificial
  CRISPR gRNA sequence
agtcctggagtccgaaagcc

SEQ ID NO: 428868 - DNA, 20 bp, Artificial
  CRISPR gRNA sequence
gagtccgaaagccagggagc

SEQ ID NO: 428869 - DNA, 20 bp, Artificial
  CRISPR gRNA sequence
gtgtcctgatgtccaaggac

SEQ ID NO: 428870 - DNA, 20 bp, Artificial
  CRISPR gRNA sequence
atgtccaaggacaggatgag

SEQ ID NO: 428871 - DNA, 20 bp, Artificial
  CRISPR gRNA sequence
caaagagagaaagtacaatt

SEQ ID NO: 428872 - DNA, 20 bp, Artificial
  CRISPR gRNA sequence
tgcctctcttctgttttggg

SEQ ID NO: 428873 - DNA, 20 bp, Artificial
  CRISPR gRNA sequence
gcctctcttctgttttggga

SEQ ID NO: 428874 - DNA, 20 bp, Artificial
  CRISPR gRNA sequence
cctctcttctgttttgggaa

SEQ ID NO: 428875 - DNA, 20 bp, Artificial
  CRISPR gRNA sequence
tcttctgttttgggaaaggc

SEQ ID NO: 428876 - DNA, 20 bp, Artificial
  CRISPR gRNA sequence
ttctgttttgggaaaggcag

SEQ ID NO: 428877 - DNA, 20 bp, Artificial
  CRISPR gRNA sequence
ctgttttgggaaaggcaggc

SEQ ID NO: 428878 - DNA, 20 bp, Artificial
  CRISPR gRNA sequence
tgttttgggaaaggcaggcc

SEQ ID NO: 428879 - DNA, 20 bp, Artificial
  CRISPR gRNA sequence
ttttgggaaaggcaggcctc

SEQ ID NO: 428880 - DNA, 20 bp, Artificial
  CRISPR gRNA sequence
tgggaaaggcaggcctccag

SEQ ID NO: 428881 - DNA, 20 bp, Artificial
  CRISPR gRNA sequence
gggaaaggcaggcctccagg

SEQ ID NO: 428882 - DNA, 20 bp, Artificial
  CRISPR gRNA sequence
ggaaaggcaggcctccaggt

SEQ ID NO: 428883 - DNA, 20 bp, Artificial
  CRISPR gRNA sequence
caggtgagtggatggtgctt

SEQ ID NO: 428884 - DNA, 20 bp, Artificial
  CRISPR gRNA sequence
ggctacatttagagtgtatc

SEQ ID NO: 428885 - DNA, 20 bp, Artificial
  CRISPR gRNA sequence
gctacatttagagtgtatct

SEQ ID NO: 428886 - DNA, 20 bp, Artificial
  CRISPR gRNA sequence
catttagagtgtatcttacc

SEQ ID NO: 428887 - DNA, 20 bp, Artificial
  CRISPR gRNA sequence
agagtgtatcttacctactc

SEQ ID NO: 428888 - DNA, 20 bp, Artificial
  CRISPR gRNA sequence
gagtgtatcttacctactca

SEQ ID NO: 428889 - DNA, 20 bp, Artificial
  CRISPR gRNA sequence
acctactcacttcactcaga

SEQ ID NO: 428890 - DNA, 20 bp, Artificial
  CRISPR gRNA sequence
cctactcacttcactcagac

SEQ ID NO: 428891 - DNA, 20 bp, Artificial
  CRISPR gRNA sequence
ctcacttcactcagactgac

SEQ ID NO: 428892 - DNA, 20 bp, Artificial
  CRISPR gRNA sequence
acttcactcagactgacatg

SEQ ID NO: 428893 - DNA, 20 bp, Artificial
  CRISPR gRNA sequence
cactcagactgacatgccaa

SEQ ID NO: 428894 - DNA, 20 bp, Artificial
  CRISPR gRNA sequence
actcagactgacatgccaat

SEQ ID NO: 428895 - DNA, 20 bp, Artificial
  CRISPR gRNA sequence
agactgacatgccaatctcc

SEQ ID NO: 428896 - DNA, 20 bp, Artificial
  CRISPR gRNA sequence
acatgccaatctcctttgga

SEQ ID NO: 428897 - DNA, 20 bp, Artificial
  CRISPR gRNA sequence
ctttggaaacaccctcacag

SEQ ID NO: 428898 - DNA, 20 bp, Artificial
  CRISPR gRNA sequence
tggaaacaccctcacagaca

SEQ ID NO: 428899 - DNA, 20 bp, Artificial
  CRISPR gRNA sequence
ggaaacaccctcacagacac

SEQ ID NO: 428900 - DNA, 20 bp, Artificial
  CRISPR gRNA sequence
gaaacaccctcacagacaca

SEQ ID NO: 428901 - DNA, 20 bp, Artificial
  CRISPR gRNA sequence
acagacacacccaaaatggg

SEQ ID NO: 428902 - DNA, 20 bp, Artificial
  CRISPR gRNA sequence
tactagctctctcagctccc

SEQ ID NO: 428903 - DNA, 20 bp, Artificial
  CRISPR gRNA sequence
actagctctctcagctccct

SEQ ID NO: 428904 - DNA, 20 bp, Artificial
  CRISPR gRNA sequence
ctagctctctcagctccctt

SEQ ID NO: 428905 - DNA, 20 bp, Artificial
  CRISPR gRNA sequence
gctctctcagctcccttaat

SEQ ID NO: 428906 - DNA, 20 bp, Artificial
  CRISPR gRNA sequence
tctcagctcccttaatccag

SEQ ID NO: 428907 - DNA, 20 bp, Artificial
  CRISPR gRNA sequence
tcagctcccttaatccagtt

SEQ ID NO: 428908 - DNA, 20 bp, Artificial
  CRISPR gRNA sequence
agctcccttaatccagttaa

SEQ ID NO: 428909 - DNA, 20 bp, Artificial
  CRISPR gRNA sequence
ccttaatccagttaagatga

SEQ ID NO: 428910 - DNA, 20 bp, Artificial
  CRISPR gRNA sequence
aatccagttaagatgatacc

SEQ ID NO: 428911 - DNA, 20 bp, Artificial
  CRISPR gRNA sequence
atccagttaagatgatacct

SEQ ID NO: 428912 - DNA, 20 bp, Artificial
  CRISPR gRNA sequence
agatgatacctaaaattagc

SEQ ID NO: 428913 - DNA, 20 bp, Artificial
  CRISPR gRNA sequence
aaattagctatgacaggcac

SEQ ID NO: 428914 - DNA, 20 bp, Artificial
  CRISPR gRNA sequence
gctatgacaggcacaacagc

SEQ ID NO: 428915 - DNA, 20 bp, Artificial
  CRISPR gRNA sequence
tgacaggcacaacagcattc

SEQ ID NO: 428916 - DNA, 20 bp, Artificial
  CRISPR gRNA sequence
actacagaccttgagagccc

SEQ ID NO: 428917 - DNA, 20 bp, Artificial
  CRISPR gRNA sequence
cagaccttgagagcccatag

SEQ ID NO: 428918 - DNA, 20 bp, Artificial
  CRISPR gRNA sequence
gagagcccatagactgtgtt

SEQ ID NO: 428919 - DNA, 20 bp, Artificial
  CRISPR gRNA sequence
agagcccatagactgtgtta

SEQ ID NO: 428920 - DNA, 20 bp, Artificial
  CRISPR gRNA sequence
tgttatttaggagcatgttc

SEQ ID NO: 428921 - DNA, 20 bp, Artificial
  CRISPR gRNA sequence
tttaggagcatgttctttgg

SEQ ID NO: 428922 - DNA, 20 bp, Artificial
  CRISPR gRNA sequence
aggagcatgttctttggaat

SEQ ID NO: 428923 - DNA, 20 bp, Artificial
  CRISPR gRNA sequence
ggagcatgttctttggaatc

SEQ ID NO: 428924 - DNA, 20 bp, Artificial
  CRISPR gRNA sequence
tttggaatcagacagtccta

SEQ ID NO: 428925 - DNA, 20 bp, Artificial
  CRISPR gRNA sequence
tggaatcagacagtcctagg

SEQ ID NO: 428926 - DNA, 20 bp, Artificial
  CRISPR gRNA sequence
ggaatcagacagtcctaggt

SEQ ID NO: 428927 - DNA, 20 bp, Artificial
  CRISPR gRNA sequence
gaatcagacagtcctaggtt

SEQ ID NO: 428928 - DNA, 20 bp, Artificial
  CRISPR gRNA sequence
ggtttgggtcccaactcaac

SEQ ID NO: 428929 - DNA, 20 bp, Artificial
  CRISPR gRNA sequence
gggtcccaactcaaccactt

SEQ ID NO: 428930 - DNA, 20 bp, Artificial
  CRISPR gRNA sequence
ggtcccaactcaaccacttg

SEQ ID NO: 428931 - DNA, 20 bp, Artificial
  CRISPR gRNA sequence
aaccacttgagtagctgtac

SEQ ID NO: 428932 - DNA, 20 bp, Artificial
  CRISPR gRNA sequence
gagtagctgtaccacctaac

SEQ ID NO: 428933 - DNA, 20 bp, Artificial
  CRISPR gRNA sequence
agtagctgtaccacctaact

SEQ ID NO: 428934 - DNA, 20 bp, Artificial
  CRISPR gRNA sequence
taccacctaactttgatgaa

SEQ ID NO: 428935 - DNA, 20 bp, Artificial
  CRISPR gRNA sequence
actttgatgaacctcagttt

SEQ ID NO: 428936 - DNA, 20 bp, Artificial
  CRISPR gRNA sequence
tgatgaacctcagttttctc

SEQ ID NO: 428937 - DNA, 20 bp, Artificial
  CRISPR gRNA sequence
gatgaacctcagttttctca

SEQ ID NO: 428938 - DNA, 20 bp, Artificial
  CRISPR gRNA sequence
atgaacctcagttttctcat

SEQ ID NO: 428939 - DNA, 20 bp, Artificial
  CRISPR gRNA sequence
agttttctcatctgtaaaat

SEQ ID NO: 428940 - DNA, 20 bp, Artificial
  CRISPR gRNA sequence
tctcatctgtaaaatgccga

SEQ ID NO: 428941 - DNA, 20 bp, Artificial
  CRISPR gRNA sequence
ctcatctgtaaaatgccgat

SEQ ID NO: 428942 - DNA, 20 bp, Artificial
  CRISPR gRNA sequence
tcatctgtaaaatgccgata

SEQ ID NO: 428943 - DNA, 20 bp, Artificial
  CRISPR gRNA sequence
atctgtaaaatgccgataat

SEQ ID NO: 428944 - DNA, 20 bp, Artificial
  CRISPR gRNA sequence
taaaatgccgataattatgg

SEQ ID NO: 428945 - DNA, 20 bp, Artificial
  CRISPR gRNA sequence
tggcattgccttcataaggt

SEQ ID NO: 428946 - DNA, 20 bp, Artificial
  CRISPR gRNA sequence
ccttcataaggtcatgagaa

SEQ ID NO: 428947 - DNA, 20 bp, Artificial
  CRISPR gRNA sequence
cataaggtcatgagaaaact

SEQ ID NO: 428948 - DNA, 20 bp, Artificial
  CRISPR gRNA sequence
ataaggtcatgagaaaactt

SEQ ID NO: 428949 - DNA, 20 bp, Artificial
  CRISPR gRNA sequence
cagtcaaataataattaatg

SEQ ID NO: 428950 - DNA, 20 bp, Artificial
  CRISPR gRNA sequence
agtcaaataataattaatgt

SEQ ID NO: 428951 - DNA, 20 bp, Artificial
  CRISPR gRNA sequence
atgtaaggcacttagcattt

SEQ ID NO: 428952 - DNA, 20 bp, Artificial
  CRISPR gRNA sequence
agcatttttcctagcatgta

SEQ ID NO: 428953 - DNA, 20 bp, Artificial
  CRISPR gRNA sequence
gcatttttcctagcatgtaa

SEQ ID NO: 428954 - DNA, 20 bp, Artificial
  CRISPR gRNA sequence
ttcctagcatgtaagctgga

SEQ ID NO: 428955 - DNA, 20 bp, Artificial
  CRISPR gRNA sequence
tcctagcatgtaagctggaa

SEQ ID NO: 428956 - DNA, 20 bp, Artificial
  CRISPR gRNA sequence
cctagcatgtaagctggaaa

SEQ ID NO: 428957 - DNA, 20 bp, Artificial
  CRISPR gRNA sequence
ctagcatgtaagctggaaag

SEQ ID NO: 428958 - DNA, 20 bp, Artificial
  CRISPR gRNA sequence
gcatgtaagctggaaaggtg

SEQ ID NO: 428959 - DNA, 20 bp, Artificial
  CRISPR gRNA sequence
gaaaggtgagtgggaccatc

SEQ ID NO: 428960 - DNA, 20 bp, Artificial
  CRISPR gRNA sequence
ttgggatcatcacaagggat

SEQ ID NO: 428961 - DNA, 20 bp, Artificial
  CRISPR gRNA sequence
tgggatcatcacaagggatg

SEQ ID NO: 428962 - DNA, 20 bp, Artificial
  CRISPR gRNA sequence
gggatcatcacaagggatgt

SEQ ID NO: 428963 - DNA, 20 bp, Artificial
  CRISPR gRNA sequence
ggatcatcacaagggatgtt

SEQ ID NO: 428964 - DNA, 20 bp, Artificial
  CRISPR gRNA sequence
tggggatcatcacagtttct

SEQ ID NO: 428965 - DNA, 20 bp, Artificial
  CRISPR gRNA sequence
ggggatcatcacagtttctt

SEQ ID NO: 428966 - DNA, 20 bp, Artificial
  CRISPR gRNA sequence
gggatcatcacagtttctta

SEQ ID NO: 428967 - DNA, 20 bp, Artificial
  CRISPR gRNA sequence
cttatgaggaatgtagtgaa

SEQ ID NO: 428968 - DNA, 20 bp, Artificial
  CRISPR gRNA sequence
ttatgaggaatgtagtgaaa

SEQ ID NO: 428969 - DNA, 20 bp, Artificial
  CRISPR gRNA sequence
atgaggaatgtagtgaaatt

SEQ ID NO: 428970 - DNA, 20 bp, Artificial
  CRISPR gRNA sequence
tgaggaatgtagtgaaatta

SEQ ID NO: 428971 - DNA, 20 bp, Artificial
  CRISPR gRNA sequence
tggattttcttcttgggcaa

SEQ ID NO: 428972 - DNA, 20 bp, Artificial
  CRISPR gRNA sequence
tcttcttgggcaaaattttc

SEQ ID NO: 428973 - DNA, 20 bp, Artificial
  CRISPR gRNA sequence
cttcttgggcaaaattttct

SEQ ID NO: 428974 - DNA, 20 bp, Artificial
  CRISPR gRNA sequence
ttcttgggcaaaattttcta

SEQ ID NO: 428975 - DNA, 20 bp, Artificial
  CRISPR gRNA sequence
cttgggcaaaattttctata

SEQ ID NO: 428976 - DNA, 20 bp, Artificial
  CRISPR gRNA sequence
ttgggcaaaattttctatac

SEQ ID NO: 428977 - DNA, 20 bp, Artificial
  CRISPR gRNA sequence
gggcaaaattttctatacaa

SEQ ID NO: 428978 - DNA, 20 bp, Artificial
  CRISPR gRNA sequence
ggcaaaattttctatacaat

SEQ ID NO: 428979 - DNA, 20 bp, Artificial
  CRISPR gRNA sequence
tctatacaatttacaaatcc

SEQ ID NO: 428980 - DNA, 20 bp, Artificial
  CRISPR gRNA sequence
ctatacaatttacaaatccc

SEQ ID NO: 428981 - DNA, 20 bp, Artificial
  CRISPR gRNA sequence
tatacaatttacaaatcccc

SEQ ID NO: 428982 - DNA, 20 bp, Artificial
  CRISPR gRNA sequence
tacaatttacaaatcccctg

SEQ ID NO: 428983 - DNA, 20 bp, Artificial
  CRISPR gRNA sequence
acaaatcccctgaaatccag

SEQ ID NO: 428984 - DNA, 20 bp, Artificial
  CRISPR gRNA sequence
caaatcccctgaaatccagc

SEQ ID NO: 428985 - DNA, 20 bp, Artificial
  CRISPR gRNA sequence
aaatccagctgtgcatctca

SEQ ID NO: 428986 - DNA, 20 bp, Artificial
  CRISPR gRNA sequence
tgcatctcaggttaagcacc

SEQ ID NO: 428987 - DNA, 20 bp, Artificial
  CRISPR gRNA sequence
aggttaagcaccctcctata

SEQ ID NO: 428988 - DNA, 20 bp, Artificial
  CRISPR gRNA sequence
agcaccctcctatatacagt

SEQ ID NO: 428989 - DNA, 20 bp, Artificial
  CRISPR gRNA sequence
ctatatacagtggagccatt

SEQ ID NO: 428990 - DNA, 20 bp, Artificial
  CRISPR gRNA sequence
tatacagtggagccattgaa

SEQ ID NO: 428991 - DNA, 20 bp, Artificial
  CRISPR gRNA sequence
aagagttttaggcagaaata

SEQ ID NO: 428992 - DNA, 20 bp, Artificial
  CRISPR gRNA sequence
taggcagaaatatggactga

SEQ ID NO: 428993 - DNA, 20 bp, Artificial
  CRISPR gRNA sequence
aggcagaaatatggactgac

SEQ ID NO: 428994 - DNA, 20 bp, Artificial
  CRISPR gRNA sequence
ggcagaaatatggactgaca

SEQ ID NO: 428995 - DNA, 20 bp, Artificial
  CRISPR gRNA sequence
acacaacttttgtttttgaa

SEQ ID NO: 428996 - DNA, 20 bp, Artificial
  CRISPR gRNA sequence
ttgtttttgaaaatcactct

SEQ ID NO: 428997 - DNA, 20 bp, Artificial
  CRISPR gRNA sequence
tgtttttgaaaatcactctg

SEQ ID NO: 428998 - DNA, 20 bp, Artificial
  CRISPR gRNA sequence
gtttttgaaaatcactctgc

SEQ ID NO: 428999 - DNA, 20 bp, Artificial
  CRISPR gRNA sequence
tttttgaaaatcactctgct

SEQ ID NO: 429000 - DNA, 20 bp, Artificial
  CRISPR gRNA sequence
ttgaaaatcactctgctggc

SEQ ID NO: 429001 - DNA, 20 bp, Artificial
  CRISPR gRNA sequence
tgaaaatcactctgctggcg

SEQ ID NO: 429002 - DNA, 20 bp, Artificial
  CRISPR gRNA sequence
gaaaatcactctgctggcga

SEQ ID NO: 429003 - DNA, 20 bp, Artificial
  CRISPR gRNA sequence
aaaatcactctgctggcgac

SEQ ID NO: 429004 - DNA, 20 bp, Artificial
  CRISPR gRNA sequence
tgctggcgaccatgtggagt

SEQ ID NO: 429005 - DNA, 20 bp, Artificial
  CRISPR gRNA sequence
ctggcgaccatgtggagttg

SEQ ID NO: 429006 - DNA, 20 bp, Artificial
  CRISPR gRNA sequence
gcgaccatgtggagttggac

SEQ ID NO: 429007 - DNA, 20 bp, Artificial
  CRISPR gRNA sequence
gactagaagtaagagggagt

SEQ ID NO: 429008 - DNA, 20 bp, Artificial
  CRISPR gRNA sequence
gaagtaagagggagtccaga

SEQ ID NO: 429009 - DNA, 20 bp, Artificial
  CRISPR gRNA sequence
cagaactgcctaggattaaa

SEQ ID NO: 429010 - DNA, 20 bp, Artificial
  CRISPR gRNA sequence
agaactgcctaggattaaaa

SEQ ID NO: 429011 - DNA, 20 bp, Artificial
  CRISPR gRNA sequence
cctaggattaaaattggatg

SEQ ID NO: 429012 - DNA, 20 bp, Artificial
  CRISPR gRNA sequence
ggattaaaattggatgaagt

SEQ ID NO: 429013 - DNA, 20 bp, Artificial
  CRISPR gRNA sequence
aaattggatgaagttttaca

SEQ ID NO: 429014 - DNA, 20 bp, Artificial
  CRISPR gRNA sequence
gatgaagttttacagataaa

SEQ ID NO: 429015 - DNA, 20 bp, Artificial
  CRISPR gRNA sequence
tacagataaattgagttgaa

SEQ ID NO: 429016 - DNA, 20 bp, Artificial
  CRISPR gRNA sequence
acagataaattgagttgaac

SEQ ID NO: 429017 - DNA, 20 bp, Artificial
  CRISPR gRNA sequence
cagataaattgagttgaaca

SEQ ID NO: 429018 - DNA, 20 bp, Artificial
  CRISPR gRNA sequence
agttgaacattagcctccag

SEQ ID NO: 429019 - DNA, 20 bp, Artificial
  CRISPR gRNA sequence
aacattagcctccagatttc

SEQ ID NO: 429020 - DNA, 20 bp, Artificial
  CRISPR gRNA sequence
gcctccagatttctgctcag

SEQ ID NO: 429021 - DNA, 20 bp, Artificial
  CRISPR gRNA sequence
cagatttctgctcagctggt

SEQ ID NO: 429022 - DNA, 20 bp, Artificial
  CRISPR gRNA sequence
ctgctcagctggtgccataa

SEQ ID NO: 429023 - DNA, 20 bp, Artificial
  CRISPR gRNA sequence
tgctcagctggtgccataaa

SEQ ID NO: 429024 - DNA, 20 bp, Artificial
  CRISPR gRNA sequence
ctcagctggtgccataaacc

SEQ ID NO: 429025 - DNA, 20 bp, Artificial
  CRISPR gRNA sequence
agctggtgccataaaccagg

SEQ ID NO: 429026 - DNA, 20 bp, Artificial
  CRISPR gRNA sequence
gtgccataaaccagggcagt

SEQ ID NO: 429027 - DNA, 20 bp, Artificial
  CRISPR gRNA sequence
gttggggcaggaatgtgatg

SEQ ID NO: 429028 - DNA, 20 bp, Artificial
  CRISPR gRNA sequence
ttggggcaggaatgtgatgg

SEQ ID NO: 429029 - DNA, 20 bp, Artificial
  CRISPR gRNA sequence
gggcaggaatgtgatggtgt

SEQ ID NO: 429030 - DNA, 20 bp, Artificial
  CRISPR gRNA sequence
gagacaatttgagtctgagc

SEQ ID NO: 429031 - DNA, 20 bp, Artificial
  CRISPR gRNA sequence
agacaatttgagtctgagct

SEQ ID NO: 429032 - DNA, 20 bp, Artificial
  CRISPR gRNA sequence
gagtctgagcttgccgtggg

SEQ ID NO: 429033 - DNA, 20 bp, Artificial
  CRISPR gRNA sequence
agtctgagcttgccgtgggt

SEQ ID NO: 429034 - DNA, 20 bp, Artificial
  CRISPR gRNA sequence
agcttgccgtgggtcatcag

SEQ ID NO: 429035 - DNA, 20 bp, Artificial
  CRISPR gRNA sequence
gccgtgggtcatcaggtgat

SEQ ID NO: 429036 - DNA, 20 bp, Artificial
  CRISPR gRNA sequence
ccgtgggtcatcaggtgatg

SEQ ID NO: 429037 - DNA, 20 bp, Artificial
  CRISPR gRNA sequence
catctggagctcagggcaga

SEQ ID NO: 429038 - DNA, 20 bp, Artificial
  CRISPR gRNA sequence
gagctcagggcagaagcctg

SEQ ID NO: 429039 - DNA, 20 bp, Artificial
  CRISPR gRNA sequence
agggcagaagcctgggctag

SEQ ID NO: 429040 - DNA, 20 bp, Artificial
  CRISPR gRNA sequence
ggctagtttagatagagatt

SEQ ID NO: 429041 - DNA, 20 bp, Artificial
  CRISPR gRNA sequence
gtttagatagagatttgggc

SEQ ID NO: 429042 - DNA, 20 bp, Artificial
  CRISPR gRNA sequence
agatagagatttgggcatct

SEQ ID NO: 429043 - DNA, 20 bp, Artificial
  CRISPR gRNA sequence
gatagagatttgggcatctt

SEQ ID NO: 429044 - DNA, 20 bp, Artificial
  CRISPR gRNA sequence
gggcatcttcagaggacaga

SEQ ID NO: 429045 - DNA, 20 bp, Artificial
  CRISPR gRNA sequence
ggcatcttcagaggacagat

SEQ ID NO: 429046 - DNA, 20 bp, Artificial
  CRISPR gRNA sequence
cagaggacagatggtggttg

SEQ ID NO: 429047 - DNA, 20 bp, Artificial
  CRISPR gRNA sequence
agaggacagatggtggttgt

SEQ ID NO: 429048 - DNA, 20 bp, Artificial
  CRISPR gRNA sequence
tagatgtaagaaagtagatg

SEQ ID NO: 429049 - DNA, 20 bp, Artificial
  CRISPR gRNA sequence
atgaaatcactcagagagca

SEQ ID NO: 429050 - DNA, 20 bp, Artificial
  CRISPR gRNA sequence
agagagcatgtttagcgtga

SEQ ID NO: 429051 - DNA, 20 bp, Artificial
  CRISPR gRNA sequence
agcgtgagagaaagcagaga

SEQ ID NO: 429052 - DNA, 20 bp, Artificial
  CRISPR gRNA sequence
gcgtgagagaaagcagagag

SEQ ID NO: 429053 - DNA, 20 bp, Artificial
  CRISPR gRNA sequence
gggaaccccacggtttgggg

SEQ ID NO: 429054 - DNA, 20 bp, Artificial
  CRISPR gRNA sequence
ggggagctgatgtgcaaaga

SEQ ID NO: 429055 - DNA, 20 bp, Artificial
  CRISPR gRNA sequence
gggagctgatgtgcaaagag

SEQ ID NO: 429056 - DNA, 20 bp, Artificial
  CRISPR gRNA sequence
atgtgcaaagagaaaagggg

SEQ ID NO: 429057 - DNA, 20 bp, Artificial
  CRISPR gRNA sequence
gctgaagacgaaggtggggg

SEQ ID NO: 429058 - DNA, 20 bp, Artificial
  CRISPR gRNA sequence
aagacgaaggtgggggttca

SEQ ID NO: 429059 - DNA, 20 bp, Artificial
  CRISPR gRNA sequence
aaaggaggagaagaaaatca

SEQ ID NO: 429060 - DNA, 20 bp, Artificial
  CRISPR gRNA sequence
cagaaagtaagaggtcgaca

SEQ ID NO: 429061 - DNA, 20 bp, Artificial
  CRISPR gRNA sequence
agaaagtaagaggtcgacag

SEQ ID NO: 429062 - DNA, 20 bp, Artificial
  CRISPR gRNA sequence
cctcactaagcttagtgaac

SEQ ID NO: 429063 - DNA, 20 bp, Artificial
  CRISPR gRNA sequence
actaagcttagtgaacagga

SEQ ID NO: 429064 - DNA, 20 bp, Artificial
  CRISPR gRNA sequence
agcttagtgaacaggaagta

SEQ ID NO: 429065 - DNA, 20 bp, Artificial
  CRISPR gRNA sequence
agtgaacaggaagtaacaag

SEQ ID NO: 429066 - DNA, 20 bp, Artificial
  CRISPR gRNA sequence
gtgaacaggaagtaacaagg

SEQ ID NO: 429067 - DNA, 20 bp, Artificial
  CRISPR gRNA sequence
ccatggactagttagcattt

SEQ ID NO: 429068 - DNA, 20 bp, Artificial
  CRISPR gRNA sequence
catggactagttagcattta

SEQ ID NO: 429069 - DNA, 20 bp, Artificial
  CRISPR gRNA sequence
gttagcatttaaatctagct

SEQ ID NO: 429070 - DNA, 20 bp, Artificial
  CRISPR gRNA sequence
gcatttaaatctagctgtaa

SEQ ID NO: 429071 - DNA, 20 bp, Artificial
  CRISPR gRNA sequence
aaatctagctgtaacgcggt

SEQ ID NO: 429072 - DNA, 20 bp, Artificial
  CRISPR gRNA sequence
aatctagctgtaacgcggtt

SEQ ID NO: 429073 - DNA, 20 bp, Artificial
  CRISPR gRNA sequence
gctgtaacgcggttgagaaa

SEQ ID NO: 429074 - DNA, 20 bp, Artificial
  CRISPR gRNA sequence
taacgcggttgagaaattaa

SEQ ID NO: 429075 - DNA, 20 bp, Artificial
  CRISPR gRNA sequence
agaaattaagggctaaggaa

SEQ ID NO: 429076 - DNA, 20 bp, Artificial
  CRISPR gRNA sequence
agggctaaggaattggtgtt

SEQ ID NO: 429077 - DNA, 20 bp, Artificial
  CRISPR gRNA sequence
aggaattggtgttggtaaga

SEQ ID NO: 429078 - DNA, 20 bp, Artificial
  CRISPR gRNA sequence
gtgttggtaagaacataagt

SEQ ID NO: 429079 - DNA, 20 bp, Artificial
  CRISPR gRNA sequence
gtaagaacataagtttgctg

SEQ ID NO: 429080 - DNA, 20 bp, Artificial
  CRISPR gRNA sequence
gctggtgtgcatgtgtgtaa

SEQ ID NO: 429081 - DNA, 20 bp, Artificial
  CRISPR gRNA sequence
ctggtgtgcatgtgtgtaag

SEQ ID NO: 429082 - DNA, 20 bp, Artificial
  CRISPR gRNA sequence
gtgtgcatgtgtgtaagaaa

SEQ ID NO: 429083 - DNA, 20 bp, Artificial
  CRISPR gRNA sequence
gggattaactgttgaataac

SEQ ID NO: 429084 - DNA, 20 bp, Artificial
  CRISPR gRNA sequence
actgttgaataacatcccca

SEQ ID NO: 429085 - DNA, 20 bp, Artificial
  CRISPR gRNA sequence
ttgaataacatccccacata

SEQ ID NO: 429086 - DNA, 20 bp, Artificial
  CRISPR gRNA sequence
aataacatccccacatactc

SEQ ID NO: 429087 - DNA, 20 bp, Artificial
  CRISPR gRNA sequence
actttgtagtttgtttgttt

SEQ ID NO: 429088 - DNA, 20 bp, Artificial
  CRISPR gRNA sequence
tgtagtttgtttgtttttag

SEQ ID NO: 429089 - DNA, 20 bp, Artificial
  CRISPR gRNA sequence
gtagtttgtttgtttttaga

SEQ ID NO: 429090 - DNA, 20 bp, Artificial
  CRISPR gRNA sequence
tagtttgtttgtttttagaa

SEQ ID NO: 429091 - DNA, 20 bp, Artificial
  CRISPR gRNA sequence
gtttgtttttagaagaaagc

SEQ ID NO: 429092 - DNA, 20 bp, Artificial
  CRISPR gRNA sequence
tttgtttttagaagaaagcc

SEQ ID NO: 429093 - DNA, 20 bp, Artificial
  CRISPR gRNA sequence
gtttttagaagaaagccctc

SEQ ID NO: 429094 - DNA, 20 bp, Artificial
  CRISPR gRNA sequence
tttttagaagaaagccctca

SEQ ID NO: 429095 - DNA, 20 bp, Artificial
  CRISPR gRNA sequence
ttagaagaaagccctcagaa

SEQ ID NO: 429096 - DNA, 20 bp, Artificial
  CRISPR gRNA sequence
tagaagaaagccctcagaat

SEQ ID NO: 429097 - DNA, 20 bp, Artificial
  CRISPR gRNA sequence
agaagaaagccctcagaatc

SEQ ID NO: 429098 - DNA, 20 bp, Artificial
  CRISPR gRNA sequence
gaagaaagccctcagaatcc

SEQ ID NO: 429099 - DNA, 20 bp, Artificial
  CRISPR gRNA sequence
agaatccattctgtggaagg

SEQ ID NO: 429100 - DNA, 20 bp, Artificial
  CRISPR gRNA sequence
tgtggaaggtgacctcagga

SEQ ID NO: 429101 - DNA, 20 bp, Artificial
  CRISPR gRNA sequence
tggaaggtgacctcaggaga

SEQ ID NO: 429102 - DNA, 20 bp, Artificial
  CRISPR gRNA sequence
aggagaaaatcagctggaca

SEQ ID NO: 429103 - DNA, 20 bp, Artificial
  CRISPR gRNA sequence
gacaggaggaatggagcccc

SEQ ID NO: 429104 - DNA, 20 bp, Artificial
  CRISPR gRNA sequence
cctcacccccaggaagctgt

SEQ ID NO: 429105 - DNA, 20 bp, Artificial
  CRISPR gRNA sequence
acccccaggaagctgtgtcc

SEQ ID NO: 429106 - DNA, 20 bp, Artificial
  CRISPR gRNA sequence
tgtccaggcagaagctgcac

SEQ ID NO: 429107 - DNA, 20 bp, Artificial
  CRISPR gRNA sequence
cacctgctgggctctgtgga

SEQ ID NO: 429108 - DNA, 20 bp, Artificial
  CRISPR gRNA sequence
ctgggctctgtggagagcag

SEQ ID NO: 429109 - DNA, 20 bp, Artificial
  CRISPR gRNA sequence
ggctctgtggagagcagcgg

SEQ ID NO: 429110 - DNA, 20 bp, Artificial
  CRISPR gRNA sequence
tgtggagagcagcggggaga

SEQ ID NO: 429111 - DNA, 20 bp, Artificial
  CRISPR gRNA sequence
tggagagcagcggggagagg

SEQ ID NO: 429112 - DNA, 20 bp, Artificial
  CRISPR gRNA sequence
tgccgagctgcatgactact

SEQ ID NO: 429113 - DNA, 20 bp, Artificial
  CRISPR gRNA sequence
catgactacttcaatgtcct

SEQ ID NO: 429114 - DNA, 20 bp, Artificial
  CRISPR gRNA sequence
cttcaatgtcctgagttaca

SEQ ID NO: 429115 - DNA, 20 bp, Artificial
  CRISPR gRNA sequence
caatgtcctgagttacagaa

SEQ ID NO: 429116 - DNA, 20 bp, Artificial
  CRISPR gRNA sequence
aatgtcctgagttacagaag

SEQ ID NO: 429117 - DNA, 20 bp, Artificial
  CRISPR gRNA sequence
agttacagaagcctgggtaa

SEQ ID NO: 429118 - DNA, 20 bp, Artificial
  CRISPR gRNA sequence
cagaagcctgggtaactgca

SEQ ID NO: 429119 - DNA, 20 bp, Artificial
  CRISPR gRNA sequence
ggtaactgcagcttcttcac

SEQ ID NO: 429120 - DNA, 20 bp, Artificial
  CRISPR gRNA sequence
cagcttcttcacagagactg

SEQ ID NO: 429121 - DNA, 20 bp, Artificial
  CRISPR gRNA sequence
cttcacagagactggttagc

SEQ ID NO: 429122 - DNA, 20 bp, Artificial
  CRISPR gRNA sequence
ttcacagagactggttagca

SEQ ID NO: 429123 - DNA, 20 bp, Artificial
  CRISPR gRNA sequence
cacagagactggttagcaac

SEQ ID NO: 429124 - DNA, 20 bp, Artificial
  CRISPR gRNA sequence
acagagactggttagcaacc

SEQ ID NO: 429125 - DNA, 20 bp, Artificial
  CRISPR gRNA sequence
gttagcaaccagaggcatct

SEQ ID NO: 429126 - DNA, 20 bp, Artificial
  CRISPR gRNA sequence
gcaaccagaggcatcttctg

SEQ ID NO: 429127 - DNA, 20 bp, Artificial
  CRISPR gRNA sequence
ctggaagatacacttttgtc

SEQ ID NO: 429128 - DNA, 20 bp, Artificial
  CRISPR gRNA sequence
tggaagatacacttttgtct

SEQ ID NO: 429129 - DNA, 20 bp, Artificial
  CRISPR gRNA sequence
gaagatacacttttgtcttt

SEQ ID NO: 429130 - DNA, 20 bp, Artificial
  CRISPR gRNA sequence
ttgtctttgctattatagat

SEQ ID NO: 429131 - DNA, 20 bp, Artificial
  CRISPR gRNA sequence
tgtctttgctattatagatg

SEQ ID NO: 429132 - DNA, 20 bp, Artificial
  CRISPR gRNA sequence
gtctttgctattatagatga

SEQ ID NO: 429133 - DNA, 20 bp, Artificial
  CRISPR gRNA sequence
tctttgctattatagatgaa

SEQ ID NO: 429134 - DNA, 20 bp, Artificial
  CRISPR gRNA sequence
tgctattatagatgaatata

SEQ ID NO: 429135 - DNA, 20 bp, Artificial
  CRISPR gRNA sequence
gctattatagatgaatatat

SEQ ID NO: 429136 - DNA, 20 bp, Artificial
  CRISPR gRNA sequence
ctattatagatgaatatata

SEQ ID NO: 429137 - DNA, 20 bp, Artificial
  CRISPR gRNA sequence
ttatagatgaatatataagc

SEQ ID NO: 429138 - DNA, 20 bp, Artificial
  CRISPR gRNA sequence
tagatgaatatataagcagc

SEQ ID NO: 429139 - DNA, 20 bp, Artificial
  CRISPR gRNA sequence
tactctccatcagtgctgcg

SEQ ID NO: 429140 - DNA, 20 bp, Artificial
  CRISPR gRNA sequence
tccatcagtgctgcgtgtgt

SEQ ID NO: 429141 - DNA, 20 bp, Artificial
  CRISPR gRNA sequence
catcagtgctgcgtgtgtgt

SEQ ID NO: 429142 - DNA, 20 bp, Artificial
  CRISPR gRNA sequence
cgtgtgtgtgtgtgtgtgta

SEQ ID NO: 429143 - DNA, 20 bp, Artificial
  CRISPR gRNA sequence
agttgagtgaataaatgtca

SEQ ID NO: 429144 - DNA, 20 bp, Artificial
  CRISPR gRNA sequence
agtgaataaatgtcatcctc

SEQ ID NO: 429145 - DNA, 20 bp, Artificial
  CRISPR gRNA sequence
ttctccatcttcatttcctt

SEQ ID NO: 429146 - DNA, 20 bp, Artificial
  CRISPR gRNA sequence
ctccatcttcatttccttgg

SEQ ID NO: 429147 - DNA, 20 bp, Artificial
  CRISPR gRNA sequence
tccatcttcatttccttggc

SEQ ID NO: 429148 - DNA, 20 bp, Artificial
  CRISPR gRNA sequence
catcttcatttccttggcct

SEQ ID NO: 429149 - DNA, 20 bp, Artificial
  CRISPR gRNA sequence
catttccttggccttttcgt

SEQ ID NO: 429150 - DNA, 20 bp, Artificial
  CRISPR gRNA sequence
atttccttggccttttcgtt

SEQ ID NO: 429151 - DNA, 20 bp, Artificial
  CRISPR gRNA sequence
ccttggccttttcgttctat

SEQ ID NO: 429152 - DNA, 20 bp, Artificial
  CRISPR gRNA sequence
cttggccttttcgttctatt

SEQ ID NO: 429153 - DNA, 20 bp, Artificial
  CRISPR gRNA sequence
ggccttttcgttctattcca

SEQ ID NO: 429154 - DNA, 20 bp, Artificial
  CRISPR gRNA sequence
gccttttcgttctattccat

SEQ ID NO: 429155 - DNA, 20 bp, Artificial
  CRISPR gRNA sequence
ttcgttctattccattttgc

SEQ ID NO: 429156 - DNA, 20 bp, Artificial
  CRISPR gRNA sequence
tcgttctattccattttgca

SEQ ID NO: 429157 - DNA, 20 bp, Artificial
  CRISPR gRNA sequence
cgttctattccattttgcat

SEQ ID NO: 429158 - DNA, 20 bp, Artificial
  CRISPR gRNA sequence
gttctattccattttgcatt

SEQ ID NO: 429159 - DNA, 20 bp, Artificial
  CRISPR gRNA sequence
tattccattttgcattatgg

SEQ ID NO: 429160 - DNA, 20 bp, Artificial
  CRISPR gRNA sequence
ttccattttgcattatggca

SEQ ID NO: 429161 - DNA, 20 bp, Artificial
  CRISPR gRNA sequence
cattttgcattatggcaggc

SEQ ID NO: 429162 - DNA, 20 bp, Artificial
  CRISPR gRNA sequence
tgcattatggcaggcctagg

SEQ ID NO: 429163 - DNA, 20 bp, Artificial
  CRISPR gRNA sequence
gcattatggcaggcctaggg

SEQ ID NO: 429164 - DNA, 20 bp, Artificial
  CRISPR gRNA sequence
cattatggcaggcctagggt

SEQ ID NO: 429165 - DNA, 20 bp, Artificial
  CRISPR gRNA sequence
tggcaggcctagggtgagta

SEQ ID NO: 429166 - DNA, 20 bp, Artificial
  CRISPR gRNA sequence
gggtgagtaacgtggatctt

SEQ ID NO: 429167 - DNA, 20 bp, Artificial
  CRISPR gRNA sequence
gatcataaatgcaaaattaa

SEQ ID NO: 429168 - DNA, 20 bp, Artificial
  CRISPR gRNA sequence
atcataaatgcaaaattaaa

SEQ ID NO: 429169 - DNA, 20 bp, Artificial
  CRISPR gRNA sequence
aaaaatatcttgacctggtt

SEQ ID NO: 429170 - DNA, 20 bp, Artificial
  CRISPR gRNA sequence
gacctggttttaaatctggc

SEQ ID NO: 429171 - DNA, 20 bp, Artificial
  CRISPR gRNA sequence
acctggttttaaatctggca

SEQ ID NO: 429172 - DNA, 20 bp, Artificial
  CRISPR gRNA sequence
gttttaaatctggcagtttg

SEQ ID NO: 429173 - DNA, 20 bp, Artificial
  CRISPR gRNA sequence
taaatctggcagtttgagca

SEQ ID NO: 429174 - DNA, 20 bp, Artificial
  CRISPR gRNA sequence
aaatctggcagtttgagcag

SEQ ID NO: 429175 - DNA, 20 bp, Artificial
  CRISPR gRNA sequence
aatctggcagtttgagcaga

SEQ ID NO: 429176 - DNA, 20 bp, Artificial
  CRISPR gRNA sequence
gcagtttgagcagatcctat

SEQ ID NO: 429177 - DNA, 20 bp, Artificial
  CRISPR gRNA sequence
gagcagatcctatgtctctg

SEQ ID NO: 429178 - DNA, 20 bp, Artificial
  CRISPR gRNA sequence
agcagatcctatgtctctga

SEQ ID NO: 429179 - DNA, 20 bp, Artificial
  CRISPR gRNA sequence
tgtctctgagagacacattc

SEQ ID NO: 429180 - DNA, 20 bp, Artificial
  CRISPR gRNA sequence
tgagagacacattcctcata

SEQ ID NO: 429181 - DNA, 20 bp, Artificial
  CRISPR gRNA sequence
agagacacattcctcataat

SEQ ID NO: 429182 - DNA, 20 bp, Artificial
  CRISPR gRNA sequence
ctcataatggccagcatttt

SEQ ID NO: 429183 - DNA, 20 bp, Artificial
  CRISPR gRNA sequence
ataatggccagcattttggg

SEQ ID NO: 429184 - DNA, 20 bp, Artificial
  CRISPR gRNA sequence
tgggctacaaggttttgtgg

SEQ ID NO: 429185 - DNA, 20 bp, Artificial
  CRISPR gRNA sequence
gggctacaaggttttgtggt

SEQ ID NO: 429186 - DNA, 20 bp, Artificial
  CRISPR gRNA sequence
ggctacaaggttttgtggtt

SEQ ID NO: 429187 - DNA, 20 bp, Artificial
  CRISPR gRNA sequence
caaggttttgtggttgatga

SEQ ID NO: 429188 - DNA, 20 bp, Artificial
  CRISPR gRNA sequence
tgtggttgatgatgaggatg

SEQ ID NO: 429189 - DNA, 20 bp, Artificial
  CRISPR gRNA sequence
gtggttgatgatgaggatgg

SEQ ID NO: 429190 - DNA, 20 bp, Artificial
  CRISPR gRNA sequence
tggttgatgatgaggatggc

SEQ ID NO: 429191 - DNA, 20 bp, Artificial
  CRISPR gRNA sequence
atgatgaggatggcatgact

SEQ ID NO: 429192 - DNA, 20 bp, Artificial
  CRISPR gRNA sequence
cagagccatcctcatctcat

SEQ ID NO: 429193 - DNA, 20 bp, Artificial
  CRISPR gRNA sequence
atctcattttttcacgtcat

SEQ ID NO: 429194 - DNA, 20 bp, Artificial
  CRISPR gRNA sequence
attttttcacgtcattttca

SEQ ID NO: 429195 - DNA, 20 bp, Artificial
  CRISPR gRNA sequence
tttcacgtcattttcagtaa

SEQ ID NO: 429196 - DNA, 20 bp, Artificial
  CRISPR gRNA sequence
ttcacgtcattttcagtaac

SEQ ID NO: 429197 - DNA, 20 bp, Artificial
  CRISPR gRNA sequence
tcacgtcattttcagtaact

SEQ ID NO: 429198 - DNA, 20 bp, Artificial
  CRISPR gRNA sequence
cacgtcattttcagtaactt

SEQ ID NO: 429199 - DNA, 20 bp, Artificial
  CRISPR gRNA sequence
acgtcattttcagtaacttt

SEQ ID NO: 429200 - DNA, 20 bp, Artificial
  CRISPR gRNA sequence
tcagtaactttcactcattc

SEQ ID NO: 429201 - DNA, 20 bp, Artificial
  CRISPR gRNA sequence
cagtaactttcactcattca

SEQ ID NO: 429202 - DNA, 20 bp, Artificial
  CRISPR gRNA sequence
agtaactttcactcattcaa

SEQ ID NO: 429203 - DNA, 20 bp, Artificial
  CRISPR gRNA sequence
tcactcattcaaaggcaggt

SEQ ID NO: 429204 - DNA, 20 bp, Artificial
  CRISPR gRNA sequence
cactcattcaaaggcaggtt

SEQ ID NO: 429205 - DNA, 20 bp, Artificial
  CRISPR gRNA sequence
actcattcaaaggcaggtta

SEQ ID NO: 429206 - DNA, 20 bp, Artificial
  CRISPR gRNA sequence
attcaaaggcaggttataag

SEQ ID NO: 429207 - DNA, 20 bp, Artificial
  CRISPR gRNA sequence
aaaggcaggttataagtaag

SEQ ID NO: 429208 - DNA, 20 bp, Artificial
  CRISPR gRNA sequence
taagtaagtcctggtagcag

SEQ ID NO: 429209 - DNA, 20 bp, Artificial
  CRISPR gRNA sequence
gtagcagcctctatggggag

SEQ ID NO: 429210 - DNA, 20 bp, Artificial
  CRISPR gRNA sequence
tatggggagatttgagagtg

SEQ ID NO: 429211 - DNA, 20 bp, Artificial
  CRISPR gRNA sequence
tggggagatttgagagtgac

SEQ ID NO: 429212 - DNA, 20 bp, Artificial
  CRISPR gRNA sequence
gagagtgactaaatcttggt

SEQ ID NO: 429213 - DNA, 20 bp, Artificial
  CRISPR gRNA sequence
agagtgactaaatcttggta

SEQ ID NO: 429214 - DNA, 20 bp, Artificial
  CRISPR gRNA sequence
aatcttggtatctgccctca

SEQ ID NO: 429215 - DNA, 20 bp, Artificial
  CRISPR gRNA sequence
ggtatctgccctcaagaact

SEQ ID NO: 429216 - DNA, 20 bp, Artificial
  CRISPR gRNA sequence
gtatctgccctcaagaactt

SEQ ID NO: 429217 - DNA, 20 bp, Artificial
  CRISPR gRNA sequence
ccctcaagaacttacagtta

SEQ ID NO: 429218 - DNA, 20 bp, Artificial
  CRISPR gRNA sequence
aagaacttacagttaaatgg

SEQ ID NO: 429219 - DNA, 20 bp, Artificial
  CRISPR gRNA sequence
acagttaaatggggagacaa

SEQ ID NO: 429220 - DNA, 20 bp, Artificial
  CRISPR gRNA sequence
cagttaaatggggagacaat

SEQ ID NO: 429221 - DNA, 20 bp, Artificial
  CRISPR gRNA sequence
aatggggagacaatgttgtc

SEQ ID NO: 429222 - DNA, 20 bp, Artificial
  CRISPR gRNA sequence
tcatgaaaaggtattatagt

SEQ ID NO: 429223 - DNA, 20 bp, Artificial
  CRISPR gRNA sequence
tagtaaggagagaaggagac

SEQ ID NO: 429224 - DNA, 20 bp, Artificial
  CRISPR gRNA sequence
caggaagagacgacagtttg

SEQ ID NO: 429225 - DNA, 20 bp, Artificial
  CRISPR gRNA sequence
aggaagagacgacagtttgg

SEQ ID NO: 429226 - DNA, 20 bp, Artificial
  CRISPR gRNA sequence
ggggtgaggtagttggcata

SEQ ID NO: 429227 - DNA, 20 bp, Artificial
  CRISPR gRNA sequence
gggtgaggtagttggcatag

SEQ ID NO: 429228 - DNA, 20 bp, Artificial
  CRISPR gRNA sequence
gcataggcttatctgtgatg

SEQ ID NO: 429229 - DNA, 20 bp, Artificial
  CRISPR gRNA sequence
atctgtgatgaagtggcctg

SEQ ID NO: 429230 - DNA, 20 bp, Artificial
  CRISPR gRNA sequence
tctgtgatgaagtggcctgg

SEQ ID NO: 429231 - DNA, 20 bp, Artificial
  CRISPR gRNA sequence
tgatgaagtggcctgggagc

SEQ ID NO: 429232 - DNA, 20 bp, Artificial
  CRISPR gRNA sequence
ggagcaccaaggggatgttg

SEQ ID NO: 429233 - DNA, 20 bp, Artificial
  CRISPR gRNA sequence
aggctagtctgggaggagca

SEQ ID NO: 429234 - DNA, 20 bp, Artificial
  CRISPR gRNA sequence
gtctgggaggagcaggagtt

SEQ ID NO: 429235 - DNA, 20 bp, Artificial
  CRISPR gRNA sequence
ggaggagcaggagttttgtc

SEQ ID NO: 429236 - DNA, 20 bp, Artificial
  CRISPR gRNA sequence
tgtctagggaacttgtagga

SEQ ID NO: 429237 - DNA, 20 bp, Artificial
  CRISPR gRNA sequence
gtctagggaacttgtaggaa

SEQ ID NO: 429238 - DNA, 20 bp, Artificial
  CRISPR gRNA sequence
tctagggaacttgtaggaaa

SEQ ID NO: 429239 - DNA, 20 bp, Artificial
  CRISPR gRNA sequence
gggaacttgtaggaaattct

SEQ ID NO: 429240 - DNA, 20 bp, Artificial
  CRISPR gRNA sequence
gtaggaaattcttggagctg

SEQ ID NO: 429241 - DNA, 20 bp, Artificial
  CRISPR gRNA sequence
taggaaattcttggagctga

SEQ ID NO: 429242 - DNA, 20 bp, Artificial
  CRISPR gRNA sequence
ttggagctgaaagtcccaca

SEQ ID NO: 429243 - DNA, 20 bp, Artificial
  CRISPR gRNA sequence
ggagctgaaagtcccacaaa

SEQ ID NO: 429244 - DNA, 20 bp, Artificial
  CRISPR gRNA sequence
gagctgaaagtcccacaaag

SEQ ID NO: 429245 - DNA, 20 bp, Artificial
  CRISPR gRNA sequence
aaagtcccacaaagaaggcc

SEQ ID NO: 429246 - DNA, 20 bp, Artificial
  CRISPR gRNA sequence
gcaccaagggagtcagcaaa

SEQ ID NO: 429247 - DNA, 20 bp, Artificial
  CRISPR gRNA sequence
cagattttattctctgggca

SEQ ID NO: 429248 - DNA, 20 bp, Artificial
  CRISPR gRNA sequence
agattttattctctgggcag

SEQ ID NO: 429249 - DNA, 20 bp, Artificial
  CRISPR gRNA sequence
tattctctgggcaggcattt

SEQ ID NO: 429250 - DNA, 20 bp, Artificial
  CRISPR gRNA sequence
attctctgggcaggcatttc

SEQ ID NO: 429251 - DNA, 20 bp, Artificial
  CRISPR gRNA sequence
ttctctgggcaggcatttca

SEQ ID NO: 429252 - DNA, 20 bp, Artificial
  CRISPR gRNA sequence
tctgggcaggcatttcaagt

SEQ ID NO: 429253 - DNA, 20 bp, Artificial
  CRISPR gRNA sequence
tgggcaggcatttcaagttt

SEQ ID NO: 429254 - DNA, 20 bp, Artificial
  CRISPR gRNA sequence
ggcaggcatttcaagtttcc

SEQ ID NO: 429255 - DNA, 20 bp, Artificial
  CRISPR gRNA sequence
caagtttccttttgctgtga

SEQ ID NO: 429256 - DNA, 20 bp, Artificial
  CRISPR gRNA sequence
aagtttccttttgctgtgac

SEQ ID NO: 429257 - DNA, 20 bp, Artificial
  CRISPR gRNA sequence
ccttttgctgtgacatactc

SEQ ID NO: 429258 - DNA, 20 bp, Artificial
  CRISPR gRNA sequence
cttttgctgtgacatactca

SEQ ID NO: 429259 - DNA, 20 bp, Artificial
  CRISPR gRNA sequence
ttgctgtgacatactcatcc

SEQ ID NO: 429260 - DNA, 20 bp, Artificial
  CRISPR gRNA sequence
tgctgtgacatactcatcca

SEQ ID NO: 429261 - DNA, 20 bp, Artificial
  CRISPR gRNA sequence
gctgtgacatactcatccat

SEQ ID NO: 429262 - DNA, 20 bp, Artificial
  CRISPR gRNA sequence
ctgtgacatactcatccatt

SEQ ID NO: 429263 - DNA, 20 bp, Artificial
  CRISPR gRNA sequence
tgacatactcatccattaga

SEQ ID NO: 429264 - DNA, 20 bp, Artificial
  CRISPR gRNA sequence
atccattagacagcctgata

SEQ ID NO: 429265 - DNA, 20 bp, Artificial
  CRISPR gRNA sequence
gacagcctgatacaggcctg

SEQ ID NO: 429266 - DNA, 20 bp, Artificial
  CRISPR gRNA sequence
atacaggcctgtagcctctt

SEQ ID NO: 429267 - DNA, 20 bp, Artificial
  CRISPR gRNA sequence
tagcctcttccggccgtgtg

SEQ ID NO: 429268 - DNA, 20 bp, Artificial
  CRISPR gRNA sequence
ttccggccgtgtgtgctggg

SEQ ID NO: 429269 - DNA, 20 bp, Artificial
  CRISPR gRNA sequence
ccggccgtgtgtgctgggga

SEQ ID NO: 429270 - DNA, 20 bp, Artificial
  CRISPR gRNA sequence
cggccgtgtgtgctggggaa

SEQ ID NO: 429271 - DNA, 20 bp, Artificial
  CRISPR gRNA sequence
gggaagccccaggaaacgca

SEQ ID NO: 429272 - DNA, 20 bp, Artificial
  CRISPR gRNA sequence
gggccttgatctaccttttc

SEQ ID NO: 429273 - DNA, 20 bp, Artificial
  CRISPR gRNA sequence
ggccttgatctaccttttct

SEQ ID NO: 429274 - DNA, 20 bp, Artificial
  CRISPR gRNA sequence
gatctaccttttctgcatca

SEQ ID NO: 429275 - DNA, 20 bp, Artificial
  CRISPR gRNA sequence
atctaccttttctgcatcaa

SEQ ID NO: 429276 - DNA, 20 bp, Artificial
  CRISPR gRNA sequence
ccttttctgcatcaatacac

SEQ ID NO: 429277 - DNA, 20 bp, Artificial
  CRISPR gRNA sequence
ttctgcatcaatacactctt

SEQ ID NO: 429278 - DNA, 20 bp, Artificial
  CRISPR gRNA sequence
tctgcatcaatacactcttg

SEQ ID NO: 429279 - DNA, 20 bp, Artificial
  CRISPR gRNA sequence
ctgcatcaatacactcttga

SEQ ID NO: 429280 - DNA, 20 bp, Artificial
  CRISPR gRNA sequence
tgcatcaatacactcttgag

SEQ ID NO: 429281 - DNA, 20 bp, Artificial
  CRISPR gRNA sequence
catcaatacactcttgagcc

SEQ ID NO: 429282 - DNA, 20 bp, Artificial
  CRISPR gRNA sequence
ttgagcctttgaaaaaagaa

SEQ ID NO: 429283 - DNA, 20 bp, Artificial
  CRISPR gRNA sequence
gagcctttgaaaaaagaacg

SEQ ID NO: 429284 - DNA, 20 bp, Artificial
  CRISPR gRNA sequence
agcctttgaaaaaagaacgt

SEQ ID NO: 429285 - DNA, 20 bp, Artificial
  CRISPR gRNA sequence
tgaaaaaagaacgtttccca

SEQ ID NO: 429286 - DNA, 20 bp, Artificial
  CRISPR gRNA sequence
gaaaaaagaacgtttcccac

SEQ ID NO: 429287 - DNA, 20 bp, Artificial
  CRISPR gRNA sequence
aaaaaagaacgtttcccact

SEQ ID NO: 429288 - DNA, 20 bp, Artificial
  CRISPR gRNA sequence
cccactaaaaagaaaatgtg

SEQ ID NO: 429289 - DNA, 20 bp, Artificial
  CRISPR gRNA sequence
ccactaaaaagaaaatgtgg

SEQ ID NO: 429290 - DNA, 20 bp, Artificial
  CRISPR gRNA sequence
aaaagaaaatgtggattttt

SEQ ID NO: 429291 - DNA, 20 bp, Artificial
  CRISPR gRNA sequence
ttaaaatagggactcttcct

SEQ ID NO: 429292 - DNA, 20 bp, Artificial
  CRISPR gRNA sequence
taaaatagggactcttccta

SEQ ID NO: 429293 - DNA, 20 bp, Artificial
  CRISPR gRNA sequence
aaaatagggactcttcctag

SEQ ID NO: 429294 - DNA, 20 bp, Artificial
  CRISPR gRNA sequence
aaatagggactcttcctagg

SEQ ID NO: 429295 - DNA, 20 bp, Artificial
  CRISPR gRNA sequence
ttcctaggggaaaaaggggg

SEQ ID NO: 429296 - DNA, 20 bp, Artificial
  CRISPR gRNA sequence
cctaggggaaaaaggggggc

SEQ ID NO: 429297 - DNA, 20 bp, Artificial
  CRISPR gRNA sequence
ctaggggaaaaaggggggct

SEQ ID NO: 429298 - DNA, 20 bp, Artificial
  CRISPR gRNA sequence
ggggaaaaaggggggctggg

SEQ ID NO: 429299 - DNA, 20 bp, Artificial
  CRISPR gRNA sequence
ggagtgatagagggtttaaa

SEQ ID NO: 429300 - DNA, 20 bp, Artificial
  CRISPR gRNA sequence
aaaaaataaacaccttcaaa

SEQ ID NO: 429301 - DNA, 20 bp, Artificial
  CRISPR gRNA sequence
aaaaataaacaccttcaaac

SEQ ID NO: 429302 - DNA, 20 bp, Artificial
  CRISPR gRNA sequence
caaactaacttcttcgaacc

SEQ ID NO: 429303 - DNA, 20 bp, Artificial
  CRISPR gRNA sequence
aaactaacttcttcgaaccc

SEQ ID NO: 429304 - DNA, 20 bp, Artificial
  CRISPR gRNA sequence
acttcttcgaacccttttat

SEQ ID NO: 429305 - DNA, 20 bp, Artificial
  CRISPR gRNA sequence
cttcgaacccttttattcac

SEQ ID NO: 429306 - DNA, 20 bp, Artificial
  CRISPR gRNA sequence
ttcgaacccttttattcact

SEQ ID NO: 429307 - DNA, 20 bp, Artificial
  CRISPR gRNA sequence
cgaacccttttattcactcc

SEQ ID NO: 429308 - DNA, 20 bp, Artificial
  CRISPR gRNA sequence
gaacccttttattcactccc

SEQ ID NO: 429309 - DNA, 20 bp, Artificial
  CRISPR gRNA sequence
ttattcactccctgacgact

SEQ ID NO: 429310 - DNA, 20 bp, Artificial
  CRISPR gRNA sequence
tattcactccctgacgactt

SEQ ID NO: 429311 - DNA, 20 bp, Artificial
  CRISPR gRNA sequence
attcactccctgacgacttt

SEQ ID NO: 429312 - DNA, 20 bp, Artificial
  CRISPR gRNA sequence
ttcactccctgacgactttg

SEQ ID NO: 429313 - DNA, 20 bp, Artificial
  CRISPR gRNA sequence
actccctgacgactttgtgc

SEQ ID NO: 429314 - DNA, 20 bp, Artificial
  CRISPR gRNA sequence
cctgacgactttgtgctggg

SEQ ID NO: 429315 - DNA, 20 bp, Artificial
  CRISPR gRNA sequence
acgactttgtgctggggttg

SEQ ID NO: 429316 - DNA, 20 bp, Artificial
  CRISPR gRNA sequence
tgtgctggggttggggtaac

SEQ ID NO: 429317 - DNA, 20 bp, Artificial
  CRISPR gRNA sequence
gtgctggggttggggtaact

SEQ ID NO: 429318 - DNA, 20 bp, Artificial
  CRISPR gRNA sequence
tgctggggttggggtaactg

SEQ ID NO: 429319 - DNA, 20 bp, Artificial
  CRISPR gRNA sequence
gggttggggtaactgaaccg

SEQ ID NO: 429320 - DNA, 20 bp, Artificial
  CRISPR gRNA sequence
gggtaactgaaccgcttatt

SEQ ID NO: 429321 - DNA, 20 bp, Artificial
  CRISPR gRNA sequence
aaccgcttatttctgtttaa

SEQ ID NO: 429322 - DNA, 20 bp, Artificial
  CRISPR gRNA sequence
atttctgtttaattgcattc

SEQ ID NO: 429323 - DNA, 20 bp, Artificial
  CRISPR gRNA sequence
tttctgtttaattgcattca

SEQ ID NO: 429324 - DNA, 20 bp, Artificial
  CRISPR gRNA sequence
ctgtttaattgcattcaggc

SEQ ID NO: 429325 - DNA, 20 bp, Artificial
  CRISPR gRNA sequence
tgtttaattgcattcaggct

SEQ ID NO: 429326 - DNA, 20 bp, Artificial
  CRISPR gRNA sequence
tttaattgcattcaggctgg

SEQ ID NO: 429327 - DNA, 20 bp, Artificial
  CRISPR gRNA sequence
aattgcattcaggctggatc

SEQ ID NO: 429328 - DNA, 20 bp, Artificial
  CRISPR gRNA sequence
attgcattcaggctggatct

SEQ ID NO: 429329 - DNA, 20 bp, Artificial
  CRISPR gRNA sequence
cattcaggctggatcttaga

SEQ ID NO: 429330 - DNA, 20 bp, Artificial
  CRISPR gRNA sequence
aggctggatcttagaagact

SEQ ID NO: 429331 - DNA, 20 bp, Artificial
  CRISPR gRNA sequence
gatcttagaagacttttatc

SEQ ID NO: 429332 - DNA, 20 bp, Artificial
  CRISPR gRNA sequence
agaagacttttatccttcca

SEQ ID NO: 429333 - DNA, 20 bp, Artificial
  CRISPR gRNA sequence
gaagacttttatccttccac

SEQ ID NO: 429334 - DNA, 20 bp, Artificial
  CRISPR gRNA sequence
ttatccttccaccatctctc

SEQ ID NO: 429335 - DNA, 20 bp, Artificial
  CRISPR gRNA sequence
tatccttccaccatctctct

SEQ ID NO: 429336 - DNA, 20 bp, Artificial
  CRISPR gRNA sequence
atccttccaccatctctctc

SEQ ID NO: 429337 - DNA, 20 bp, Artificial
  CRISPR gRNA sequence
tccttccaccatctctctca

SEQ ID NO: 429338 - DNA, 20 bp, Artificial
  CRISPR gRNA sequence
ccaccatctctctcagagga

SEQ ID NO: 429339 - DNA, 20 bp, Artificial
  CRISPR gRNA sequence
caccatctctctcagaggaa

SEQ ID NO: 429340 - DNA, 20 bp, Artificial
  CRISPR gRNA sequence
tctcagaggaatgagcgggg

SEQ ID NO: 429341 - DNA, 20 bp, Artificial
  CRISPR gRNA sequence
tcagaggaatgagcggggag

SEQ ID NO: 429342 - DNA, 20 bp, Artificial
  CRISPR gRNA sequence
agaggaatgagcggggaggt

SEQ ID NO: 429343 - DNA, 20 bp, Artificial
  CRISPR gRNA sequence
gatttactggtgactgattt

SEQ ID NO: 429344 - DNA, 20 bp, Artificial
  CRISPR gRNA sequence
actggtgactgattttcttt

SEQ ID NO: 429345 - DNA, 20 bp, Artificial
  CRISPR gRNA sequence
ctggtgactgattttctttc

SEQ ID NO: 429346 - DNA, 20 bp, Artificial
  CRISPR gRNA sequence
gtgactgattttctttcatg

SEQ ID NO: 429347 - DNA, 20 bp, Artificial
  CRISPR gRNA sequence
attttctttcatgggccaag

SEQ ID NO: 429348 - DNA, 20 bp, Artificial
  CRISPR gRNA sequence
tctttcatgggccaaggaac

SEQ ID NO: 429349 - DNA, 20 bp, Artificial
  CRISPR gRNA sequence
ctttcatgggccaaggaact

SEQ ID NO: 429350 - DNA, 20 bp, Artificial
  CRISPR gRNA sequence
tttcatgggccaaggaactg

SEQ ID NO: 429351 - DNA, 20 bp, Artificial
  CRISPR gRNA sequence
tcatgggccaaggaactgaa

SEQ ID NO: 429352 - DNA, 20 bp, Artificial
  CRISPR gRNA sequence
catgggccaaggaactgaaa

SEQ ID NO: 429353 - DNA, 20 bp, Artificial
  CRISPR gRNA sequence
atgggccaaggaactgaaag

SEQ ID NO: 429354 - DNA, 20 bp, Artificial
  CRISPR gRNA sequence
aaagagaatgtgaagcaagg

SEQ ID NO: 429355 - DNA, 20 bp, Artificial
  CRISPR gRNA sequence
tgtcttgcgcatggttaaaa

SEQ ID NO: 429356 - DNA, 20 bp, Artificial
  CRISPR gRNA sequence
gcgcatggttaaaaataaag

SEQ ID NO: 429357 - DNA, 20 bp, Artificial
  CRISPR gRNA sequence
cgcatggttaaaaataaagc

SEQ ID NO: 429358 - DNA, 20 bp, Artificial
  CRISPR gRNA sequence
aaaataaagcattgtcctgc

SEQ ID NO: 429359 - DNA, 20 bp, Artificial
  CRISPR gRNA sequence
tcctgcttcctaagacttag

SEQ ID NO: 429360 - DNA, 20 bp, Artificial
  CRISPR gRNA sequence
cttcctaagacttagactgg

SEQ ID NO: 429361 - DNA, 20 bp, Artificial
  CRISPR gRNA sequence
cctaagacttagactggggt

SEQ ID NO: 429362 - DNA, 20 bp, Artificial
  CRISPR gRNA sequence
ctaagacttagactggggtt

SEQ ID NO: 429363 - DNA, 20 bp, Artificial
  CRISPR gRNA sequence
agacttagactggggttgac

SEQ ID NO: 429364 - DNA, 20 bp, Artificial
  CRISPR gRNA sequence
agactggggttgacaattgt

SEQ ID NO: 429365 - DNA, 20 bp, Artificial
  CRISPR gRNA sequence
gactggggttgacaattgtt

SEQ ID NO: 429366 - DNA, 20 bp, Artificial
  CRISPR gRNA sequence
gggttgacaattgttttagc

SEQ ID NO: 429367 - DNA, 20 bp, Artificial
  CRISPR gRNA sequence
acaattgttttagcaacaag

SEQ ID NO: 429368 - DNA, 20 bp, Artificial
  CRISPR gRNA sequence
ttttagcaacaagacaattc

SEQ ID NO: 429369 - DNA, 20 bp, Artificial
  CRISPR gRNA sequence
tagcaacaagacaattcaac

SEQ ID NO: 429370 - DNA, 20 bp, Artificial
  CRISPR gRNA sequence
agcaacaagacaattcaact

SEQ ID NO: 429371 - DNA, 20 bp, Artificial
  CRISPR gRNA sequence
gcaacaagacaattcaacta

SEQ ID NO: 429372 - DNA, 20 bp, Artificial
  CRISPR gRNA sequence
aactatttctcctaggattt

SEQ ID NO: 429373 - DNA, 20 bp, Artificial
  CRISPR gRNA sequence
tttctcctaggatttttatt

SEQ ID NO: 429374 - DNA, 20 bp, Artificial
  CRISPR gRNA sequence
ctcctaggatttttattatt

SEQ ID NO: 429375 - DNA, 20 bp, Artificial
  CRISPR gRNA sequence
tcctaggatttttattatta

SEQ ID NO: 429376 - DNA, 20 bp, Artificial
  CRISPR gRNA sequence
ctaggatttttattattatt

SEQ ID NO: 429377 - DNA, 20 bp, Artificial
  CRISPR gRNA sequence
ggatttttattattattatt

SEQ ID NO: 429378 - DNA, 20 bp, Artificial
  CRISPR gRNA sequence
ttattattattattttttca

SEQ ID NO: 429379 - DNA, 20 bp, Artificial
  CRISPR gRNA sequence
tattattattattttttcac

SEQ ID NO: 429380 - DNA, 20 bp, Artificial
  CRISPR gRNA sequence
attattattattttttcact

SEQ ID NO: 429381 - DNA, 20 bp, Artificial
  CRISPR gRNA sequence
ttattattattttttcactt

SEQ ID NO: 429382 - DNA, 20 bp, Artificial
  CRISPR gRNA sequence
ttattattttttcacttttc

SEQ ID NO: 429383 - DNA, 20 bp, Artificial
  CRISPR gRNA sequence
ttattttttcacttttctac

SEQ ID NO: 429384 - DNA, 20 bp, Artificial
  CRISPR gRNA sequence
ttttttcacttttctaccaa

SEQ ID NO: 429385 - DNA, 20 bp, Artificial
  CRISPR gRNA sequence
tttcacttttctaccaaatg

SEQ ID NO: 429386 - DNA, 20 bp, Artificial
  CRISPR gRNA sequence
ttcacttttctaccaaatgg

SEQ ID NO: 429387 - DNA, 20 bp, Artificial
  CRISPR gRNA sequence
tcacttttctaccaaatggg

SEQ ID NO: 429388 - DNA, 20 bp, Artificial
  CRISPR gRNA sequence
cacttttctaccaaatgggt

SEQ ID NO: 429389 - DNA, 20 bp, Artificial
  CRISPR gRNA sequence
acttttctaccaaatgggtt

SEQ ID NO: 429390 - DNA, 20 bp, Artificial
  CRISPR gRNA sequence
ttctaccaaatgggttacat

SEQ ID NO: 429391 - DNA, 20 bp, Artificial
  CRISPR gRNA sequence
tctaccaaatgggttacata

SEQ ID NO: 429392 - DNA, 20 bp, Artificial
  CRISPR gRNA sequence
ctaccaaatgggttacatag

SEQ ID NO: 429393 - DNA, 20 bp, Artificial
  CRISPR gRNA sequence
taccaaatgggttacatagg

SEQ ID NO: 429394 - DNA, 20 bp, Artificial
  CRISPR gRNA sequence
ccaaatgggttacataggaa

SEQ ID NO: 429395 - DNA, 20 bp, Artificial
  CRISPR gRNA sequence
cataggaagaatgaactgaa

SEQ ID NO: 429396 - DNA, 20 bp, Artificial
  CRISPR gRNA sequence
aaatctgtccagagctccaa

SEQ ID NO: 429397 - DNA, 20 bp, Artificial
  CRISPR gRNA sequence
tccagagctccaagtccttt

SEQ ID NO: 429398 - DNA, 20 bp, Artificial
  CRISPR gRNA sequence
caagtcctttggaagaaaga

SEQ ID NO: 429399 - DNA, 20 bp, Artificial
  CRISPR gRNA sequence
tggaagaaagattagatgaa

SEQ ID NO: 429400 - DNA, 20 bp, Artificial
  CRISPR gRNA sequence
ggaagaaagattagatgaac

SEQ ID NO: 429401 - DNA, 20 bp, Artificial
  CRISPR gRNA sequence
gaagaaagattagatgaacg

SEQ ID NO: 429402 - DNA, 20 bp, Artificial
  CRISPR gRNA sequence
gatgaacgtaaaaatgttgt

SEQ ID NO: 429403 - DNA, 20 bp, Artificial
  CRISPR gRNA sequence
ttgtttgctgtggcagttta

SEQ ID NO: 429404 - DNA, 20 bp, Artificial
  CRISPR gRNA sequence
tttgctgtggcagtttacag

SEQ ID NO: 429405 - DNA, 20 bp, Artificial
  CRISPR gRNA sequence
gctgtggcagtttacagcat

SEQ ID NO: 429406 - DNA, 20 bp, Artificial
  CRISPR gRNA sequence
ctgtggcagtttacagcatt

SEQ ID NO: 429407 - DNA, 20 bp, Artificial
  CRISPR gRNA sequence
tggcagtttacagcattttt

SEQ ID NO: 429408 - DNA, 20 bp, Artificial
  CRISPR gRNA sequence
acagcatttttcttgcaaaa

SEQ ID NO: 429409 - DNA, 20 bp, Artificial
  CRISPR gRNA sequence
cagcatttttcttgcaaaat

SEQ ID NO: 429410 - DNA, 20 bp, Artificial
  CRISPR gRNA sequence
ttcttgcaaaattagtgcaa

SEQ ID NO: 429411 - DNA, 20 bp, Artificial
  CRISPR gRNA sequence
tcttgcaaaattagtgcaaa

SEQ ID NO: 429412 - DNA, 20 bp, Artificial
  CRISPR gRNA sequence
cttgcaaaattagtgcaaat

SEQ ID NO: 429413 - DNA, 20 bp, Artificial
  CRISPR gRNA sequence
ttgcaaaattagtgcaaatc

SEQ ID NO: 429414 - DNA, 20 bp, Artificial
  CRISPR gRNA sequence
gcaaaattagtgcaaatctg

SEQ ID NO: 429415 - DNA, 20 bp, Artificial
  CRISPR gRNA sequence
caaaattagtgcaaatctgt

SEQ ID NO: 429416 - DNA, 20 bp, Artificial
  CRISPR gRNA sequence
gtgcaaatctgttggaaata

SEQ ID NO: 429417 - DNA, 20 bp, Artificial
  CRISPR gRNA sequence
ttggaaatagaacacaattc

SEQ ID NO: 429418 - DNA, 20 bp, Artificial
  CRISPR gRNA sequence
gaaatagaacacaattcaca

SEQ ID NO: 429419 - DNA, 20 bp, Artificial
  CRISPR gRNA sequence
acaaattggaagtgaactaa

SEQ ID NO: 429420 - DNA, 20 bp, Artificial
  CRISPR gRNA sequence
gaagtgaactaaaatgtaat

SEQ ID NO: 429421 - DNA, 20 bp, Artificial
  CRISPR gRNA sequence
aaatgtaatgacgaaaaggg

SEQ ID NO: 429422 - DNA, 20 bp, Artificial
  CRISPR gRNA sequence
tgatttggaggaggtgtata

SEQ ID NO: 429423 - DNA, 20 bp, Artificial
  CRISPR gRNA sequence
gatttggaggaggtgtatat

SEQ ID NO: 429424 - DNA, 20 bp, Artificial
  CRISPR gRNA sequence
atttggaggaggtgtatatt

SEQ ID NO: 429425 - DNA, 20 bp, Artificial
  CRISPR gRNA sequence
ggaggaggtgtatattcggc

SEQ ID NO: 429426 - DNA, 20 bp, Artificial
  CRISPR gRNA sequence
gaggaggtgtatattcggca

SEQ ID NO: 429427 - DNA, 20 bp, Artificial
  CRISPR gRNA sequence
ggcagaggttggactgagag

SEQ ID NO: 429428 - DNA, 20 bp, Artificial
  CRISPR gRNA sequence
gactgagagttgggtgttat

SEQ ID NO: 429429 - DNA, 20 bp, Artificial
  CRISPR gRNA sequence
agagttgggtgttatttaac

SEQ ID NO: 429430 - DNA, 20 bp, Artificial
  CRISPR gRNA sequence
ggtgttatttaacataatta

SEQ ID NO: 429431 - DNA, 20 bp, Artificial
  CRISPR gRNA sequence
tttaacataattatggtaat

SEQ ID NO: 429432 - DNA, 20 bp, Artificial
  CRISPR gRNA sequence
aacataattatggtaattgg

SEQ ID NO: 429433 - DNA, 20 bp, Artificial
  CRISPR gRNA sequence
acataattatggtaattggg

SEQ ID NO: 429434 - DNA, 20 bp, Artificial
  CRISPR gRNA sequence
tggtaattgggaaacattta

SEQ ID NO: 429435 - DNA, 20 bp, Artificial
  CRISPR gRNA sequence
ggaaacatttataaacacta

SEQ ID NO: 429436 - DNA, 20 bp, Artificial
  CRISPR gRNA sequence
ataaacactattgggatggt

SEQ ID NO: 429437 - DNA, 20 bp, Artificial
  CRISPR gRNA sequence
taaacactattgggatggtg

SEQ ID NO: 429438 - DNA, 20 bp, Artificial
  CRISPR gRNA sequence
ttgggatggtgataaaatac

SEQ ID NO: 429439 - DNA, 20 bp, Artificial
  CRISPR gRNA sequence
ggatggtgataaaatacaaa

SEQ ID NO: 429440 - DNA, 20 bp, Artificial
  CRISPR gRNA sequence
tagatgttagaaatgggtca

SEQ ID NO: 429441 - DNA, 20 bp, Artificial
  CRISPR gRNA sequence
gaaatgggtcaggttactga

SEQ ID NO: 429442 - DNA, 20 bp, Artificial
  CRISPR gRNA sequence
ctgaaatgggattcaatttg

SEQ ID NO: 429443 - DNA, 20 bp, Artificial
  CRISPR gRNA sequence
aaatgggattcaatttgaaa

SEQ ID NO: 429444 - DNA, 20 bp, Artificial
  CRISPR gRNA sequence
aatttgaaaaaaattttttt

SEQ ID NO: 429445 - DNA, 20 bp, Artificial
  CRISPR gRNA sequence
gaaaaaaatttttttaaata

SEQ ID NO: 429446 - DNA, 20 bp, Artificial
  CRISPR gRNA sequence
aaaaaaatttttttaaatag

SEQ ID NO: 429447 - DNA, 20 bp, Artificial
  CRISPR gRNA sequence
ttttaaatagaactcactga

SEQ ID NO: 429448 - DNA, 20 bp, Artificial
  CRISPR gRNA sequence
tttaaatagaactcactgaa

SEQ ID NO: 429449 - DNA, 20 bp, Artificial
  CRISPR gRNA sequence
ttaaatagaactcactgaac

SEQ ID NO: 429450 - DNA, 20 bp, Artificial
  CRISPR gRNA sequence
taaatagaactcactgaact

SEQ ID NO: 429451 - DNA, 20 bp, Artificial
  CRISPR gRNA sequence
aaatagaactcactgaacta

SEQ ID NO: 429452 - DNA, 20 bp, Artificial
  CRISPR gRNA sequence
aatagaactcactgaactag

SEQ ID NO: 429453 - DNA, 20 bp, Artificial
  CRISPR gRNA sequence
actgaactagattctcctct

SEQ ID NO: 429454 - DNA, 20 bp, Artificial
  CRISPR gRNA sequence
aactagattctcctctgaga

SEQ ID NO: 429455 - DNA, 20 bp, Artificial
  CRISPR gRNA sequence
gattctcctctgagaaccag

SEQ ID NO: 429456 - DNA, 20 bp, Artificial
  CRISPR gRNA sequence
tcctctgagaaccagagaag

SEQ ID NO: 429457 - DNA, 20 bp, Artificial
  CRISPR gRNA sequence
ctctgagaaccagagaagac

SEQ ID NO: 429458 - DNA, 20 bp, Artificial
  CRISPR gRNA sequence
tgagaaccagagaagaccat

SEQ ID NO: 429459 - DNA, 20 bp, Artificial
  CRISPR gRNA sequence
agaaccagagaagaccattt

SEQ ID NO: 429460 - DNA, 20 bp, Artificial
  CRISPR gRNA sequence
catagttggattcctggaga

SEQ ID NO: 429461 - DNA, 20 bp, Artificial
  CRISPR gRNA sequence
atagttggattcctggagac

SEQ ID NO: 429462 - DNA, 20 bp, Artificial
  CRISPR gRNA sequence
gattcctggagacatgcgct

SEQ ID NO: 429463 - DNA, 20 bp, Artificial
  CRISPR gRNA sequence
ctggagacatgcgctatcca

SEQ ID NO: 429464 - DNA, 20 bp, Artificial
  CRISPR gRNA sequence
gagacatgcgctatccacca

SEQ ID NO: 429465 - DNA, 20 bp, Artificial
  CRISPR gRNA sequence
tccaccacgtagccactttc

SEQ ID NO: 429466 - DNA, 20 bp, Artificial
  CRISPR gRNA sequence
tccacatgtggccatcaacc

SEQ ID NO: 429467 - DNA, 20 bp, Artificial
  CRISPR gRNA sequence
ccacatgtggccatcaacca

SEQ ID NO: 429468 - DNA, 20 bp, Artificial
  CRISPR gRNA sequence
cacatgtggccatcaaccac

SEQ ID NO: 429469 - DNA, 20 bp, Artificial
  CRISPR gRNA sequence
aagatggggttagtttaaat

SEQ ID NO: 429470 - DNA, 20 bp, Artificial
  CRISPR gRNA sequence
agatggggttagtttaaatc

SEQ ID NO: 429471 - DNA, 20 bp, Artificial
  CRISPR gRNA sequence
gtttaaatcaagatgtgctg

SEQ ID NO: 429472 - DNA, 20 bp, Artificial
  CRISPR gRNA sequence
aaatcaagatgtgctgttat

SEQ ID NO: 429473 - DNA, 20 bp, Artificial
  CRISPR gRNA sequence
aatcaagatgtgctgttata

SEQ ID NO: 429474 - DNA, 20 bp, Artificial
  CRISPR gRNA sequence
ttataattggtataagcata

SEQ ID NO: 429475 - DNA, 20 bp, Artificial
  CRISPR gRNA sequence
taattggtataagcataaaa

SEQ ID NO: 429476 - DNA, 20 bp, Artificial
  CRISPR gRNA sequence
gtataagcataaaatcacac

SEQ ID NO: 429477 - DNA, 20 bp, Artificial
  CRISPR gRNA sequence
gattctggagatttaatatg

SEQ ID NO: 429478 - DNA, 20 bp, Artificial
  CRISPR gRNA sequence
tggagatttaatatgaataa

SEQ ID NO: 429479 - DNA, 20 bp, Artificial
  CRISPR gRNA sequence
gagatttaatatgaataata

SEQ ID NO: 429480 - DNA, 20 bp, Artificial
  CRISPR gRNA sequence
aatatgaataataagaatac

SEQ ID NO: 429481 - DNA, 20 bp, Artificial
  CRISPR gRNA sequence
atatgaataataagaatact

SEQ ID NO: 429482 - DNA, 20 bp, Artificial
  CRISPR gRNA sequence
tttcagtagttttggtatat

SEQ ID NO: 429483 - DNA, 20 bp, Artificial
  CRISPR gRNA sequence
cagtagttttggtatattgt

SEQ ID NO: 429484 - DNA, 20 bp, Artificial
  CRISPR gRNA sequence
agtagttttggtatattgtg

SEQ ID NO: 429485 - DNA, 20 bp, Artificial
  CRISPR gRNA sequence
tggtatattgtgtgtcaaaa

SEQ ID NO: 429486 - DNA, 20 bp, Artificial
  CRISPR gRNA sequence
ggtatattgtgtgtcaaaaa

SEQ ID NO: 429487 - DNA, 20 bp, Artificial
  CRISPR gRNA sequence
gtatattgtgtgtcaaaaat

SEQ ID NO: 429488 - DNA, 20 bp, Artificial
  CRISPR gRNA sequence
tgtgtcaaaaatgataatat

SEQ ID NO: 429489 - DNA, 20 bp, Artificial
  CRISPR gRNA sequence
tggatgtattgggtgaaata

SEQ ID NO: 429490 - DNA, 20 bp, Artificial
  CRISPR gRNA sequence
ggatgtattgggtgaaataa

SEQ ID NO: 429491 - DNA, 20 bp, Artificial
  CRISPR gRNA sequence
gatgtattgggtgaaataaa

SEQ ID NO: 429492 - DNA, 20 bp, Artificial
  CRISPR gRNA sequence
ggtgaaataaaatattaaca

SEQ ID NO: 429493 - DNA, 20 bp, Artificial
  CRISPR gRNA sequence
acattagtttcatgcttctt

SEQ ID NO: 429494 - DNA, 20 bp, Artificial
  CRISPR gRNA sequence
gtttcatgcttctttttatc

SEQ ID NO: 429495 - DNA, 20 bp, Artificial
  CRISPR gRNA sequence
catgcttctttttatctttt

SEQ ID NO: 429496 - DNA, 20 bp, Artificial
  CRISPR gRNA sequence
atgcttctttttatcttttt

SEQ ID NO: 429497 - DNA, 20 bp, Artificial
  CRISPR gRNA sequence
ctttttatctttttaacgtg

SEQ ID NO: 429498 - DNA, 20 bp, Artificial
  CRISPR gRNA sequence
tttttatctttttaacgtgg

SEQ ID NO: 429499 - DNA, 20 bp, Artificial
  CRISPR gRNA sequence
tttatctttttaacgtggct

SEQ ID NO: 429500 - DNA, 20 bp, Artificial
  CRISPR gRNA sequence
ttatctttttaacgtggcta

SEQ ID NO: 429501 - DNA, 20 bp, Artificial
  CRISPR gRNA sequence
tatctttttaacgtggctac

SEQ ID NO: 429502 - DNA, 20 bp, Artificial
  CRISPR gRNA sequence
atctttttaacgtggctact

SEQ ID NO: 429503 - DNA, 20 bp, Artificial
  CRISPR gRNA sequence
tctttttaacgtggctactg

SEQ ID NO: 429504 - DNA, 20 bp, Artificial
  CRISPR gRNA sequence
tttaacgtggctactggaaa

SEQ ID NO: 429505 - DNA, 20 bp, Artificial
  CRISPR gRNA sequence
ttaacgtggctactggaaag

SEQ ID NO: 429506 - DNA, 20 bp, Artificial
  CRISPR gRNA sequence
taacgtggctactggaaagt

SEQ ID NO: 429507 - DNA, 20 bp, Artificial
  CRISPR gRNA sequence
aacgtggctactggaaagtc

SEQ ID NO: 429508 - DNA, 20 bp, Artificial
  CRISPR gRNA sequence
acgtggctactggaaagtct

SEQ ID NO: 429509 - DNA, 20 bp, Artificial
  CRISPR gRNA sequence
ctggaaagtctaaaattgca

SEQ ID NO: 429510 - DNA, 20 bp, Artificial
  CRISPR gRNA sequence
gaaagtctaaaattgcatat

SEQ ID NO: 429511 - DNA, 20 bp, Artificial
  CRISPR gRNA sequence
aaattgcatatgtggctctc

SEQ ID NO: 429512 - DNA, 20 bp, Artificial
  CRISPR gRNA sequence
catatgtggctctcatattt

SEQ ID NO: 429513 - DNA, 20 bp, Artificial
  CRISPR gRNA sequence
tcatatttctatgtgactgt

SEQ ID NO: 429514 - DNA, 20 bp, Artificial
  CRISPR gRNA sequence
atatttctatgtgactgtgc

SEQ ID NO: 429515 - DNA, 20 bp, Artificial
  CRISPR gRNA sequence
ctatgtgactgtgctgctct

SEQ ID NO: 429516 - DNA, 20 bp, Artificial
  CRISPR gRNA sequence
tatgtgactgtgctgctcta

SEQ ID NO: 429517 - DNA, 20 bp, Artificial
  CRISPR gRNA sequence
tgtgactgtgctgctctagt

SEQ ID NO: 429518 - DNA, 20 bp, Artificial
  CRISPR gRNA sequence
ctagagcagcacagtcacat

SEQ ID NO: 429519 - DNA, 20 bp, Artificial
  CRISPR gRNA sequence
gagcagcacagtcacataga

SEQ ID NO: 429520 - DNA, 20 bp, Artificial
  CRISPR gRNA sequence
tagactttccagtagccacg

SEQ ID NO: 429521 - DNA, 20 bp, Artificial
  CRISPR gRNA sequence
agactttccagtagccacgt

SEQ ID NO: 429522 - DNA, 20 bp, Artificial
  CRISPR gRNA sequence
gactttccagtagccacgtt

SEQ ID NO: 429523 - DNA, 20 bp, Artificial
  CRISPR gRNA sequence
tccagtagccacgttaaaaa

SEQ ID NO: 429524 - DNA, 20 bp, Artificial
  CRISPR gRNA sequence
ccagtagccacgttaaaaag

SEQ ID NO: 429525 - DNA, 20 bp, Artificial
  CRISPR gRNA sequence
cagtagccacgttaaaaaga

SEQ ID NO: 429526 - DNA, 20 bp, Artificial
  CRISPR gRNA sequence
aaaagataaaaagaagcatg

SEQ ID NO: 429527 - DNA, 20 bp, Artificial
  CRISPR gRNA sequence
atgttaatattttatttcac

SEQ ID NO: 429528 - DNA, 20 bp, Artificial
  CRISPR gRNA sequence
atattttatttcacccaata

SEQ ID NO: 429529 - DNA, 20 bp, Artificial
  CRISPR gRNA sequence
tatttcacccaatacatcca

SEQ ID NO: 429530 - DNA, 20 bp, Artificial
  CRISPR gRNA sequence
atttcacccaatacatccaa

SEQ ID NO: 429531 - DNA, 20 bp, Artificial
  CRISPR gRNA sequence
tttcacccaatacatccaaa

SEQ ID NO: 429532 - DNA, 20 bp, Artificial
  CRISPR gRNA sequence
cacccaatacatccaaaata

SEQ ID NO: 429533 - DNA, 20 bp, Artificial
  CRISPR gRNA sequence
acccaatacatccaaaatat

SEQ ID NO: 429534 - DNA, 20 bp, Artificial
  CRISPR gRNA sequence
tcatttttgacacacaatat

SEQ ID NO: 429535 - DNA, 20 bp, Artificial
  CRISPR gRNA sequence
ttgacacacaatataccaaa

SEQ ID NO: 429536 - DNA, 20 bp, Artificial
  CRISPR gRNA sequence
tgacacacaatataccaaaa

SEQ ID NO: 429537 - DNA, 20 bp, Artificial
  CRISPR gRNA sequence
gacacacaatataccaaaac

SEQ ID NO: 429538 - DNA, 20 bp, Artificial
  CRISPR gRNA sequence
acacacaatataccaaaact

SEQ ID NO: 429539 - DNA, 20 bp, Artificial
  CRISPR gRNA sequence
ctgaaatagtattcttatta

SEQ ID NO: 429540 - DNA, 20 bp, Artificial
  CRISPR gRNA sequence
aaatagtattcttattattc

SEQ ID NO: 429541 - DNA, 20 bp, Artificial
  CRISPR gRNA sequence
ttattattcatattaaatct

SEQ ID NO: 429542 - DNA, 20 bp, Artificial
  CRISPR gRNA sequence
attattcatattaaatctcc

SEQ ID NO: 429543 - DNA, 20 bp, Artificial
  CRISPR gRNA sequence
ttattcatattaaatctcca

SEQ ID NO: 429544 - DNA, 20 bp, Artificial
  CRISPR gRNA sequence
ttcatattaaatctccagaa

SEQ ID NO: 429545 - DNA, 20 bp, Artificial
  CRISPR gRNA sequence
atattaaatctccagaatct

SEQ ID NO: 429546 - DNA, 20 bp, Artificial
  CRISPR gRNA sequence
aatctccagaatctagtgtg

SEQ ID NO: 429547 - DNA, 20 bp, Artificial
  CRISPR gRNA sequence
cagaatctagtgtgatttta

SEQ ID NO: 429548 - DNA, 20 bp, Artificial
  CRISPR gRNA sequence
gtgtgattttatgcttatac

SEQ ID NO: 429549 - DNA, 20 bp, Artificial
  CRISPR gRNA sequence
tatgcttataccaattataa

SEQ ID NO: 429550 - DNA, 20 bp, Artificial
  CRISPR gRNA sequence
atgcttataccaattataac

SEQ ID NO: 429551 - DNA, 20 bp, Artificial
  CRISPR gRNA sequence
tgcttataccaattataaca

SEQ ID NO: 429552 - DNA, 20 bp, Artificial
  CRISPR gRNA sequence
ataccaattataacagcaca

SEQ ID NO: 429553 - DNA, 20 bp, Artificial
  CRISPR gRNA sequence
taccaattataacagcacat

SEQ ID NO: 429554 - DNA, 20 bp, Artificial
  CRISPR gRNA sequence
taacagcacatcttgattta

SEQ ID NO: 429555 - DNA, 20 bp, Artificial
  CRISPR gRNA sequence
gatttaaactaaccccatct

SEQ ID NO: 429556 - DNA, 20 bp, Artificial
  CRISPR gRNA sequence
atttaaactaaccccatctt

SEQ ID NO: 429557 - DNA, 20 bp, Artificial
  CRISPR gRNA sequence
aaactaaccccatcttaagt

SEQ ID NO: 429558 - DNA, 20 bp, Artificial
  CRISPR gRNA sequence
aactaaccccatcttaagtg

SEQ ID NO: 429559 - DNA, 20 bp, Artificial
  CRISPR gRNA sequence
accccatcttaagtggttga

SEQ ID NO: 429560 - DNA, 20 bp, Artificial
  CRISPR gRNA sequence
aagtggttgatggccacatg

SEQ ID NO: 429561 - DNA, 20 bp, Artificial
  CRISPR gRNA sequence
agtggttgatggccacatgt

SEQ ID NO: 429562 - DNA, 20 bp, Artificial
  CRISPR gRNA sequence
atggccacatgtggaaagtg

SEQ ID NO: 429563 - DNA, 20 bp, Artificial
  CRISPR gRNA sequence
cgtggtggatagcgcatgtc

SEQ ID NO: 429564 - DNA, 20 bp, Artificial
  CRISPR gRNA sequence
caggaatccaactatgaaat

SEQ ID NO: 429565 - DNA, 20 bp, Artificial
  CRISPR gRNA sequence
tgaaatggtcttctctggtt

SEQ ID NO: 429566 - DNA, 20 bp, Artificial
  CRISPR gRNA sequence
ctctggttctcagaggagaa

SEQ ID NO: 429567 - DNA, 20 bp, Artificial
  CRISPR gRNA sequence
tctggttctcagaggagaat

SEQ ID NO: 429568 - DNA, 20 bp, Artificial
  CRISPR gRNA sequence
tggttctcagaggagaatct

SEQ ID NO: 429569 - DNA, 20 bp, Artificial
  CRISPR gRNA sequence
gttctcagaggagaatctag

SEQ ID NO: 429570 - DNA, 20 bp, Artificial
  CRISPR gRNA sequence
tcagaggagaatctagttca

SEQ ID NO: 429571 - DNA, 20 bp, Artificial
  CRISPR gRNA sequence
agaggagaatctagttcagt

SEQ ID NO: 429572 - DNA, 20 bp, Artificial
  CRISPR gRNA sequence
gttcagtgagttctatttaa

SEQ ID NO: 429573 - DNA, 20 bp, Artificial
  CRISPR gRNA sequence
agtgagttctatttaaaaaa

SEQ ID NO: 429574 - DNA, 20 bp, Artificial
  CRISPR gRNA sequence
tatttaaaaaaatttttttc

SEQ ID NO: 429575 - DNA, 20 bp, Artificial
  CRISPR gRNA sequence
tttaaaaaaatttttttcaa

SEQ ID NO: 429576 - DNA, 20 bp, Artificial
  CRISPR gRNA sequence
aaaaaaatttttttcaaatt

SEQ ID NO: 429577 - DNA, 20 bp, Artificial
  CRISPR gRNA sequence
aaaaaatttttttcaaattg

SEQ ID NO: 429578 - DNA, 20 bp, Artificial
  CRISPR gRNA sequence
ttttcaaattgaatcccatt

SEQ ID NO: 429579 - DNA, 20 bp, Artificial
  CRISPR gRNA sequence
tttcaaattgaatcccattt

SEQ ID NO: 429580 - DNA, 20 bp, Artificial
  CRISPR gRNA sequence
ttcaaattgaatcccatttc

SEQ ID NO: 429581 - DNA, 20 bp, Artificial
  CRISPR gRNA sequence
tcaaattgaatcccatttca

SEQ ID NO: 429582 - DNA, 20 bp, Artificial
  CRISPR gRNA sequence
caaattgaatcccatttcag

SEQ ID NO: 429583 - DNA, 20 bp, Artificial
  CRISPR gRNA sequence
aaattgaatcccatttcagt

SEQ ID NO: 429584 - DNA, 20 bp, Artificial
  CRISPR gRNA sequence
aatcccatttcagtaacctg

SEQ ID NO: 429585 - DNA, 20 bp, Artificial
  CRISPR gRNA sequence
cagtaacctgacccatttct

SEQ ID NO: 429586 - DNA, 20 bp, Artificial
  CRISPR gRNA sequence
agtaacctgacccatttcta

SEQ ID NO: 429587 - DNA, 20 bp, Artificial
  CRISPR gRNA sequence
acccatttctaacatctata

SEQ ID NO: 429588 - DNA, 20 bp, Artificial
  CRISPR gRNA sequence
ctaacatctataggcccttt

SEQ ID NO: 429589 - DNA, 20 bp, Artificial
  CRISPR gRNA sequence
taacatctataggccctttt

SEQ ID NO: 429590 - DNA, 20 bp, Artificial
  CRISPR gRNA sequence
acatctataggcccttttgt

SEQ ID NO: 429591 - DNA, 20 bp, Artificial
  CRISPR gRNA sequence
taggcccttttgtattttat

SEQ ID NO: 429592 - DNA, 20 bp, Artificial
  CRISPR gRNA sequence
ttgtattttatcaccatccc

SEQ ID NO: 429593 - DNA, 20 bp, Artificial
  CRISPR gRNA sequence
tgtattttatcaccatccca

SEQ ID NO: 429594 - DNA, 20 bp, Artificial
  CRISPR gRNA sequence
gtattttatcaccatcccaa

SEQ ID NO: 429595 - DNA, 20 bp, Artificial
  CRISPR gRNA sequence
tattttatcaccatcccaat

SEQ ID NO: 429596 - DNA, 20 bp, Artificial
  CRISPR gRNA sequence
tatcaccatcccaatagtgt

SEQ ID NO: 429597 - DNA, 20 bp, Artificial
  CRISPR gRNA sequence
atcaccatcccaatagtgtt

SEQ ID NO: 429598 - DNA, 20 bp, Artificial
  CRISPR gRNA sequence
tcaccatcccaatagtgttt

SEQ ID NO: 429599 - DNA, 20 bp, Artificial
  CRISPR gRNA sequence
ataaatgtttcccaattacc

SEQ ID NO: 429600 - DNA, 20 bp, Artificial
  CRISPR gRNA sequence
taaatgtttcccaattacca

SEQ ID NO: 429601 - DNA, 20 bp, Artificial
  CRISPR gRNA sequence
cccaattaccataattatgt

SEQ ID NO: 429602 - DNA, 20 bp, Artificial
  CRISPR gRNA sequence
ccaattaccataattatgtt

SEQ ID NO: 429603 - DNA, 20 bp, Artificial
  CRISPR gRNA sequence
ccataattatgttaaataac

SEQ ID NO: 429604 - DNA, 20 bp, Artificial
  CRISPR gRNA sequence
tgttaaataacacccaactc

SEQ ID NO: 429605 - DNA, 20 bp, Artificial
  CRISPR gRNA sequence
aataacacccaactctcagt

SEQ ID NO: 429606 - DNA, 20 bp, Artificial
  CRISPR gRNA sequence
tcagtccaacctctgccgaa

SEQ ID NO: 429607 - DNA, 20 bp, Artificial
  CRISPR gRNA sequence
agtccaacctctgccgaata

SEQ ID NO: 429608 - DNA, 20 bp, Artificial
  CRISPR gRNA sequence
tgccgaatatacacctcctc

SEQ ID NO: 429609 - DNA, 20 bp, Artificial
  CRISPR gRNA sequence
ccgaatatacacctcctcca

SEQ ID NO: 429610 - DNA, 20 bp, Artificial
  CRISPR gRNA sequence
ctccaaatcaaaacactact

SEQ ID NO: 429611 - DNA, 20 bp, Artificial
  CRISPR gRNA sequence
caaatcaaaacactactccc

SEQ ID NO: 429612 - DNA, 20 bp, Artificial
  CRISPR gRNA sequence
ctcccttttcgtcattacat

SEQ ID NO: 429613 - DNA, 20 bp, Artificial
  CRISPR gRNA sequence
ccttttcgtcattacatttt

SEQ ID NO: 429614 - DNA, 20 bp, Artificial
  CRISPR gRNA sequence
ttcgtcattacattttagtt

SEQ ID NO: 429615 - DNA, 20 bp, Artificial
  CRISPR gRNA sequence
tcgtcattacattttagttc

SEQ ID NO: 429616 - DNA, 20 bp, Artificial
  CRISPR gRNA sequence
cgtcattacattttagttca

SEQ ID NO: 429617 - DNA, 20 bp, Artificial
  CRISPR gRNA sequence
gtcattacattttagttcac

SEQ ID NO: 429618 - DNA, 20 bp, Artificial
  CRISPR gRNA sequence
cattttagttcacttccaat

SEQ ID NO: 429619 - DNA, 20 bp, Artificial
  CRISPR gRNA sequence
tagttcacttccaatttgtg

SEQ ID NO: 429620 - DNA, 20 bp, Artificial
  CRISPR gRNA sequence
agttcacttccaatttgtga

SEQ ID NO: 429621 - DNA, 20 bp, Artificial
  CRISPR gRNA sequence
gttcacttccaatttgtgaa

SEQ ID NO: 429622 - DNA, 20 bp, Artificial
  CRISPR gRNA sequence
acttccaatttgtgaattgt

SEQ ID NO: 429623 - DNA, 20 bp, Artificial
  CRISPR gRNA sequence
ccaatttgtgaattgtgttc

SEQ ID NO: 429624 - DNA, 20 bp, Artificial
  CRISPR gRNA sequence
caatttgtgaattgtgttct

SEQ ID NO: 429625 - DNA, 20 bp, Artificial
  CRISPR gRNA sequence
gtgaattgtgttctatttcc

SEQ ID NO: 429626 - DNA, 20 bp, Artificial
  CRISPR gRNA sequence
tgaattgtgttctatttcca

SEQ ID NO: 429627 - DNA, 20 bp, Artificial
  CRISPR gRNA sequence
tgttctatttccaacagatt

SEQ ID NO: 429628 - DNA, 20 bp, Artificial
  CRISPR gRNA sequence
tatttccaacagatttgcac

SEQ ID NO: 429629 - DNA, 20 bp, Artificial
  CRISPR gRNA sequence
tttccaacagatttgcacta

SEQ ID NO: 429630 - DNA, 20 bp, Artificial
  CRISPR gRNA sequence
ccaacagatttgcactaatt

SEQ ID NO: 429631 - DNA, 20 bp, Artificial
  CRISPR gRNA sequence
caacagatttgcactaattt

SEQ ID NO: 429632 - DNA, 20 bp, Artificial
  CRISPR gRNA sequence
gcactaattttgcaagaaaa

SEQ ID NO: 429633 - DNA, 20 bp, Artificial
  CRISPR gRNA sequence
cactaattttgcaagaaaaa

SEQ ID NO: 429634 - DNA, 20 bp, Artificial
  CRISPR gRNA sequence
attttgcaagaaaaatgctg

SEQ ID NO: 429635 - DNA, 20 bp, Artificial
  CRISPR gRNA sequence
tgcaagaaaaatgctgtaaa

SEQ ID NO: 429636 - DNA, 20 bp, Artificial
  CRISPR gRNA sequence
gcaagaaaaatgctgtaaac

SEQ ID NO: 429637 - DNA, 20 bp, Artificial
  CRISPR gRNA sequence
caagaaaaatgctgtaaact

SEQ ID NO: 429638 - DNA, 20 bp, Artificial
  CRISPR gRNA sequence
taaactgccacagcaaacaa

SEQ ID NO: 429639 - DNA, 20 bp, Artificial
  CRISPR gRNA sequence
ccacagcaaacaacaacatt

SEQ ID NO: 429640 - DNA, 20 bp, Artificial
  CRISPR gRNA sequence
ttacgttcatctaatctttc

SEQ ID NO: 429641 - DNA, 20 bp, Artificial
  CRISPR gRNA sequence
tacgttcatctaatctttct

SEQ ID NO: 429642 - DNA, 20 bp, Artificial
  CRISPR gRNA sequence
acgttcatctaatctttctt

SEQ ID NO: 429643 - DNA, 20 bp, Artificial
  CRISPR gRNA sequence
cgttcatctaatctttcttc

SEQ ID NO: 429644 - DNA, 20 bp, Artificial
  CRISPR gRNA sequence
atctaatctttcttccaaag

SEQ ID NO: 429645 - DNA, 20 bp, Artificial
  CRISPR gRNA sequence
atctttcttccaaaggactt

SEQ ID NO: 429646 - DNA, 20 bp, Artificial
  CRISPR gRNA sequence
tcttccaaaggacttggagc

SEQ ID NO: 429647 - DNA, 20 bp, Artificial
  CRISPR gRNA sequence
cttccaaaggacttggagct

SEQ ID NO: 429648 - DNA, 20 bp, Artificial
  CRISPR gRNA sequence
ttccaaaggacttggagctc

SEQ ID NO: 429649 - DNA, 20 bp, Artificial
  CRISPR gRNA sequence
ccaaaggacttggagctctg

SEQ ID NO: 429650 - DNA, 20 bp, Artificial
  CRISPR gRNA sequence
caaaggacttggagctctgg

SEQ ID NO: 429651 - DNA, 20 bp, Artificial
  CRISPR gRNA sequence
ggagctctggacagatttca

SEQ ID NO: 429652 - DNA, 20 bp, Artificial
  CRISPR gRNA sequence
gagctctggacagatttcag

SEQ ID NO: 429653 - DNA, 20 bp, Artificial
  CRISPR gRNA sequence
tggacagatttcagttcatt

SEQ ID NO: 429654 - DNA, 20 bp, Artificial
  CRISPR gRNA sequence
gacagatttcagttcattct

SEQ ID NO: 429655 - DNA, 20 bp, Artificial
  CRISPR gRNA sequence
cagttcattcttcctatgta

SEQ ID NO: 429656 - DNA, 20 bp, Artificial
  CRISPR gRNA sequence
agttcattcttcctatgtaa

SEQ ID NO: 429657 - DNA, 20 bp, Artificial
  CRISPR gRNA sequence
attcttcctatgtaacccat

SEQ ID NO: 429658 - DNA, 20 bp, Artificial
  CRISPR gRNA sequence
ttcctatgtaacccatttgg

SEQ ID NO: 429659 - DNA, 20 bp, Artificial
  CRISPR gRNA sequence
cctatgtaacccatttggta

SEQ ID NO: 429660 - DNA, 20 bp, Artificial
  CRISPR gRNA sequence
ctatgtaacccatttggtag

SEQ ID NO: 429661 - DNA, 20 bp, Artificial
  CRISPR gRNA sequence
tgtaacccatttggtagaaa

SEQ ID NO: 429662 - DNA, 20 bp, Artificial
  CRISPR gRNA sequence
ggtagaaaagtgaaaaaata

SEQ ID NO: 429663 - DNA, 20 bp, Artificial
  CRISPR gRNA sequence
gtagaaaagtgaaaaaataa

SEQ ID NO: 429664 - DNA, 20 bp, Artificial
  CRISPR gRNA sequence
ggagaaatagttgaattgtc

SEQ ID NO: 429665 - DNA, 20 bp, Artificial
  CRISPR gRNA sequence
aattgtcttgttgctaaaac

SEQ ID NO: 429666 - DNA, 20 bp, Artificial
  CRISPR gRNA sequence
tcttgttgctaaaacaattg

SEQ ID NO: 429667 - DNA, 20 bp, Artificial
  CRISPR gRNA sequence
gttgctaaaacaattgtcaa

SEQ ID NO: 429668 - DNA, 20 bp, Artificial
  CRISPR gRNA sequence
ttgctaaaacaattgtcaac

SEQ ID NO: 429669 - DNA, 20 bp, Artificial
  CRISPR gRNA sequence
ctaaaacaattgtcaacccc

SEQ ID NO: 429670 - DNA, 20 bp, Artificial
  CRISPR gRNA sequence
aaacaattgtcaaccccagt

SEQ ID NO: 429671 - DNA, 20 bp, Artificial
  CRISPR gRNA sequence
tcaaccccagtctaagtctt

SEQ ID NO: 429672 - DNA, 20 bp, Artificial
  CRISPR gRNA sequence
agtcttaggaagcaggacaa

SEQ ID NO: 429673 - DNA, 20 bp, Artificial
  CRISPR gRNA sequence
aggaagcaggacaatgcttt

SEQ ID NO: 429674 - DNA, 20 bp, Artificial
  CRISPR gRNA sequence
ggaagcaggacaatgcttta

SEQ ID NO: 429675 - DNA, 20 bp, Artificial
  CRISPR gRNA sequence
tatttttaaccatgcgcaag

SEQ ID NO: 429676 - DNA, 20 bp, Artificial
  CRISPR gRNA sequence
atttttaaccatgcgcaaga

SEQ ID NO: 429677 - DNA, 20 bp, Artificial
  CRISPR gRNA sequence
tttttaaccatgcgcaagac

SEQ ID NO: 429678 - DNA, 20 bp, Artificial
  CRISPR gRNA sequence
ttaaccatgcgcaagacaca

SEQ ID NO: 429679 - DNA, 20 bp, Artificial
  CRISPR gRNA sequence
taaccatgcgcaagacacaa

SEQ ID NO: 429680 - DNA, 20 bp, Artificial
  CRISPR gRNA sequence
aaccatgcgcaagacacaac

SEQ ID NO: 429681 - DNA, 20 bp, Artificial
  CRISPR gRNA sequence
accatgcgcaagacacaacc

SEQ ID NO: 429682 - DNA, 20 bp, Artificial
  CRISPR gRNA sequence
gcttcacattctctttcagt

SEQ ID NO: 429683 - DNA, 20 bp, Artificial
  CRISPR gRNA sequence
cttcacattctctttcagtt

SEQ ID NO: 429684 - DNA, 20 bp, Artificial
  CRISPR gRNA sequence
cacattctctttcagttcct

SEQ ID NO: 429685 - DNA, 20 bp, Artificial
  CRISPR gRNA sequence
acattctctttcagttcctt

SEQ ID NO: 429686 - DNA, 20 bp, Artificial
  CRISPR gRNA sequence
tctttcagttccttggccca

SEQ ID NO: 429687 - DNA, 20 bp, Artificial
  CRISPR gRNA sequence
tttcagttccttggcccatg

SEQ ID NO: 429688 - DNA, 20 bp, Artificial
  CRISPR gRNA sequence
tcagttccttggcccatgaa

SEQ ID NO: 429689 - DNA, 20 bp, Artificial
  CRISPR gRNA sequence
cagttccttggcccatgaaa

SEQ ID NO: 429690 - DNA, 20 bp, Artificial
  CRISPR gRNA sequence
agttccttggcccatgaaag

SEQ ID NO: 429691 - DNA, 20 bp, Artificial
  CRISPR gRNA sequence
cttggcccatgaaagaaaat

SEQ ID NO: 429692 - DNA, 20 bp, Artificial
  CRISPR gRNA sequence
ggcccatgaaagaaaatcag

SEQ ID NO: 429693 - DNA, 20 bp, Artificial
  CRISPR gRNA sequence
gcccatgaaagaaaatcagt

SEQ ID NO: 429694 - DNA, 20 bp, Artificial
  CRISPR gRNA sequence
cccgctcattcctctgagag

SEQ ID NO: 429695 - DNA, 20 bp, Artificial
  CRISPR gRNA sequence
attcctctgagagagatggt

SEQ ID NO: 429696 - DNA, 20 bp, Artificial
  CRISPR gRNA sequence
ctctgagagagatggtggaa

SEQ ID NO: 429697 - DNA, 20 bp, Artificial
  CRISPR gRNA sequence
tgagagagatggtggaagga

SEQ ID NO: 429698 - DNA, 20 bp, Artificial
  CRISPR gRNA sequence
agagagatggtggaaggata

SEQ ID NO: 429699 - DNA, 20 bp, Artificial
  CRISPR gRNA sequence
ctaagatccagcctgaatgc

SEQ ID NO: 429700 - DNA, 20 bp, Artificial
  CRISPR gRNA sequence
taagatccagcctgaatgca

SEQ ID NO: 429701 - DNA, 20 bp, Artificial
  CRISPR gRNA sequence
agatccagcctgaatgcaat

SEQ ID NO: 429702 - DNA, 20 bp, Artificial
  CRISPR gRNA sequence
aatgcaattaaacagaaata

SEQ ID NO: 429703 - DNA, 20 bp, Artificial
  CRISPR gRNA sequence
aacagaaataagcggttcag

SEQ ID NO: 429704 - DNA, 20 bp, Artificial
  CRISPR gRNA sequence
agttaccccaaccccagcac

SEQ ID NO: 429705 - DNA, 20 bp, Artificial
  CRISPR gRNA sequence
ccccaaccccagcacaaagt

SEQ ID NO: 429706 - DNA, 20 bp, Artificial
  CRISPR gRNA sequence
gaagaagttagtttgaaggt

SEQ ID NO: 429707 - DNA, 20 bp, Artificial
  CRISPR gRNA sequence
gtttgaaggtgtttattttt

SEQ ID NO: 429708 - DNA, 20 bp, Artificial
  CRISPR gRNA sequence
gaaggtgtttattttttaaa

SEQ ID NO: 429709 - DNA, 20 bp, Artificial
  CRISPR gRNA sequence
aaggtgtttattttttaaac

SEQ ID NO: 429710 - DNA, 20 bp, Artificial
  CRISPR gRNA sequence
attttttaaaccctctatca

SEQ ID NO: 429711 - DNA, 20 bp, Artificial
  CRISPR gRNA sequence
ttttttaaaccctctatcac

SEQ ID NO: 429712 - DNA, 20 bp, Artificial
  CRISPR gRNA sequence
tttaaaccctctatcactcc

SEQ ID NO: 429713 - DNA, 20 bp, Artificial
  CRISPR gRNA sequence
ttaaaccctctatcactccc

SEQ ID NO: 429714 - DNA, 20 bp, Artificial
  CRISPR gRNA sequence
taaaccctctatcactccca

SEQ ID NO: 429715 - DNA, 20 bp, Artificial
  CRISPR gRNA sequence
aaaccctctatcactcccag

SEQ ID NO: 429716 - DNA, 20 bp, Artificial
  CRISPR gRNA sequence
aaccctctatcactcccagc

SEQ ID NO: 429717 - DNA, 20 bp, Artificial
  CRISPR gRNA sequence
tatcactcccagcccccctt

SEQ ID NO: 429718 - DNA, 20 bp, Artificial
  CRISPR gRNA sequence
tcactcccagcccccctttt

SEQ ID NO: 429719 - DNA, 20 bp, Artificial
  CRISPR gRNA sequence
ccagcccccctttttcccct

SEQ ID NO: 429720 - DNA, 20 bp, Artificial
  CRISPR gRNA sequence
tttcccctaggaagagtccc

SEQ ID NO: 429721 - DNA, 20 bp, Artificial
  CRISPR gRNA sequence
ttcccctaggaagagtccct

SEQ ID NO: 429722 - DNA, 20 bp, Artificial
  CRISPR gRNA sequence
tcccctaggaagagtcccta

SEQ ID NO: 429723 - DNA, 20 bp, Artificial
  CRISPR gRNA sequence
cccctaggaagagtccctat

SEQ ID NO: 429724 - DNA, 20 bp, Artificial
  CRISPR gRNA sequence
ccctaggaagagtccctatt

SEQ ID NO: 429725 - DNA, 20 bp, Artificial
  CRISPR gRNA sequence
ggaagagtccctattttaaa

SEQ ID NO: 429726 - DNA, 20 bp, Artificial
  CRISPR gRNA sequence
ttttaaaaatccacattttc

SEQ ID NO: 429727 - DNA, 20 bp, Artificial
  CRISPR gRNA sequence
taaaaatccacattttcttt

SEQ ID NO: 429728 - DNA, 20 bp, Artificial
  CRISPR gRNA sequence
aaaaatccacattttctttt

SEQ ID NO: 429729 - DNA, 20 bp, Artificial
  CRISPR gRNA sequence
aaaatccacattttcttttt

SEQ ID NO: 429730 - DNA, 20 bp, Artificial
  CRISPR gRNA sequence
tctttttagtgggaaacgtt

SEQ ID NO: 429731 - DNA, 20 bp, Artificial
  CRISPR gRNA sequence
ctttttagtgggaaacgttc

SEQ ID NO: 429732 - DNA, 20 bp, Artificial
  CRISPR gRNA sequence
tttttagtgggaaacgttct

SEQ ID NO: 429733 - DNA, 20 bp, Artificial
  CRISPR gRNA sequence
tttagtgggaaacgttcttt

SEQ ID NO: 429734 - DNA, 20 bp, Artificial
  CRISPR gRNA sequence
ttagtgggaaacgttctttt

SEQ ID NO: 429735 - DNA, 20 bp, Artificial
  CRISPR gRNA sequence
tagtgggaaacgttcttttt

SEQ ID NO: 429736 - DNA, 20 bp, Artificial
  CRISPR gRNA sequence
agtgggaaacgttctttttt

SEQ ID NO: 429737 - DNA, 20 bp, Artificial
  CRISPR gRNA sequence
gtgggaaacgttcttttttc

SEQ ID NO: 429738 - DNA, 20 bp, Artificial
  CRISPR gRNA sequence
ttttttcaaaggctcaagag

SEQ ID NO: 429739 - DNA, 20 bp, Artificial
  CRISPR gRNA sequence
ttttcaaaggctcaagagtg

SEQ ID NO: 429740 - DNA, 20 bp, Artificial
  CRISPR gRNA sequence
tttcaaaggctcaagagtgt

SEQ ID NO: 429741 - DNA, 20 bp, Artificial
  CRISPR gRNA sequence
ttcaaaggctcaagagtgta

SEQ ID NO: 429742 - DNA, 20 bp, Artificial
  CRISPR gRNA sequence
tcaaaggctcaagagtgtat

SEQ ID NO: 429743 - DNA, 20 bp, Artificial
  CRISPR gRNA sequence
caaaggctcaagagtgtatt

SEQ ID NO: 429744 - DNA, 20 bp, Artificial
  CRISPR gRNA sequence
aaaggctcaagagtgtattg

SEQ ID NO: 429745 - DNA, 20 bp, Artificial
  CRISPR gRNA sequence
aagagtgtattgatgcagaa

SEQ ID NO: 429746 - DNA, 20 bp, Artificial
  CRISPR gRNA sequence
atgcagaaaaggtagatcaa

SEQ ID NO: 429747 - DNA, 20 bp, Artificial
  CRISPR gRNA sequence
cgacttggctccctgtgtgg

SEQ ID NO: 429748 - DNA, 20 bp, Artificial
  CRISPR gRNA sequence
ggctccctgtgtgggcatgt

SEQ ID NO: 429749 - DNA, 20 bp, Artificial
  CRISPR gRNA sequence
gctccctgtgtgggcatgtg

SEQ ID NO: 429750 - DNA, 20 bp, Artificial
  CRISPR gRNA sequence
cctgtgtgggcatgtgcgtt

SEQ ID NO: 429751 - DNA, 20 bp, Artificial
  CRISPR gRNA sequence
tgtgggcatgtgcgtttcct

SEQ ID NO: 429752 - DNA, 20 bp, Artificial
  CRISPR gRNA sequence
cctggggcttccccagcaca

SEQ ID NO: 429753 - DNA, 20 bp, Artificial
  CRISPR gRNA sequence
ctggggcttccccagcacac

SEQ ID NO: 429754 - DNA, 20 bp, Artificial
  CRISPR gRNA sequence
gggcttccccagcacacacg

SEQ ID NO: 429755 - DNA, 20 bp, Artificial
  CRISPR gRNA sequence
ccccagcacacacggccgga

SEQ ID NO: 429756 - DNA, 20 bp, Artificial
  CRISPR gRNA sequence
cccagcacacacggccggaa

SEQ ID NO: 429757 - DNA, 20 bp, Artificial
  CRISPR gRNA sequence
caggcctgtatcaggctgtc

SEQ ID NO: 429758 - DNA, 20 bp, Artificial
  CRISPR gRNA sequence
tatcaggctgtctaatggat

SEQ ID NO: 429759 - DNA, 20 bp, Artificial
  CRISPR gRNA sequence
tctaatggatgagtatgtca

SEQ ID NO: 429760 - DNA, 20 bp, Artificial
  CRISPR gRNA sequence
atggatgagtatgtcacagc

SEQ ID NO: 429761 - DNA, 20 bp, Artificial
  CRISPR gRNA sequence
gaaatgcctgcccagagaat

SEQ ID NO: 429762 - DNA, 20 bp, Artificial
  CRISPR gRNA sequence
aaatgcctgcccagagaata

SEQ ID NO: 429763 - DNA, 20 bp, Artificial
  CRISPR gRNA sequence
cccagagaataaaatctgaa

SEQ ID NO: 429764 - DNA, 20 bp, Artificial
  CRISPR gRNA sequence
aagtttgctgactcccttgg

SEQ ID NO: 429765 - DNA, 20 bp, Artificial
  CRISPR gRNA sequence
gctgactcccttggtgccag

SEQ ID NO: 429766 - DNA, 20 bp, Artificial
  CRISPR gRNA sequence
ctgactcccttggtgccagg

SEQ ID NO: 429767 - DNA, 20 bp, Artificial
  CRISPR gRNA sequence
actcccttggtgccagggcc

SEQ ID NO: 429768 - DNA, 20 bp, Artificial
  CRISPR gRNA sequence
ccttggtgccagggccttct

SEQ ID NO: 429769 - DNA, 20 bp, Artificial
  CRISPR gRNA sequence
ggtgccagggccttctttgt

SEQ ID NO: 429770 - DNA, 20 bp, Artificial
  CRISPR gRNA sequence
gtgccagggccttctttgtg

SEQ ID NO: 429771 - DNA, 20 bp, Artificial
  CRISPR gRNA sequence
ctttgtgggactttcagctc

SEQ ID NO: 429772 - DNA, 20 bp, Artificial
  CRISPR gRNA sequence
tttgtgggactttcagctcc

SEQ ID NO: 429773 - DNA, 20 bp, Artificial
  CRISPR gRNA sequence
tgtgggactttcagctccaa

SEQ ID NO: 429774 - DNA, 20 bp, Artificial
  CRISPR gRNA sequence
gtgggactttcagctccaag

SEQ ID NO: 429775 - DNA, 20 bp, Artificial
  CRISPR gRNA sequence
tgggactttcagctccaaga

SEQ ID NO: 429776 - DNA, 20 bp, Artificial
  CRISPR gRNA sequence
tcagctccaagaatttccta

SEQ ID NO: 429777 - DNA, 20 bp, Artificial
  CRISPR gRNA sequence
cagctccaagaatttcctac

SEQ ID NO: 429778 - DNA, 20 bp, Artificial
  CRISPR gRNA sequence
agctccaagaatttcctaca

SEQ ID NO: 429779 - DNA, 20 bp, Artificial
  CRISPR gRNA sequence
caagaatttcctacaagttc

SEQ ID NO: 429780 - DNA, 20 bp, Artificial
  CRISPR gRNA sequence
cctacaagttccctagacaa

SEQ ID NO: 429781 - DNA, 20 bp, Artificial
  CRISPR gRNA sequence
ctacaagttccctagacaaa

SEQ ID NO: 429782 - DNA, 20 bp, Artificial
  CRISPR gRNA sequence
caagttccctagacaaaact

SEQ ID NO: 429783 - DNA, 20 bp, Artificial
  CRISPR gRNA sequence
cctagacaaaactcctgctc

SEQ ID NO: 429784 - DNA, 20 bp, Artificial
  CRISPR gRNA sequence
gacaaaactcctgctcctcc

SEQ ID NO: 429785 - DNA, 20 bp, Artificial
  CRISPR gRNA sequence
ctgctcctcccagactagcc

SEQ ID NO: 429786 - DNA, 20 bp, Artificial
  CRISPR gRNA sequence
ctcctcccagactagcctca

SEQ ID NO: 429787 - DNA, 20 bp, Artificial
  CRISPR gRNA sequence
ctcccagactagcctcaaca

SEQ ID NO: 429788 - DNA, 20 bp, Artificial
  CRISPR gRNA sequence
ccagactagcctcaacatcc

SEQ ID NO: 429789 - DNA, 20 bp, Artificial
  CRISPR gRNA sequence
gcctcaacatccccttggtg

SEQ ID NO: 429790 - DNA, 20 bp, Artificial
  CRISPR gRNA sequence
aacatccccttggtgctccc

SEQ ID NO: 429791 - DNA, 20 bp, Artificial
  CRISPR gRNA sequence
ggtgctcccaggccacttca

SEQ ID NO: 429792 - DNA, 20 bp, Artificial
  CRISPR gRNA sequence
gtgctcccaggccacttcat

SEQ ID NO: 429793 - DNA, 20 bp, Artificial
  CRISPR gRNA sequence
ccaggccacttcatcacaga

SEQ ID NO: 429794 - DNA, 20 bp, Artificial
  CRISPR gRNA sequence
catcacagataagcctatgc

SEQ ID NO: 429795 - DNA, 20 bp, Artificial
  CRISPR gRNA sequence
atcacagataagcctatgcc

SEQ ID NO: 429796 - DNA, 20 bp, Artificial
  CRISPR gRNA sequence
tgccaactacctcaccccaa

SEQ ID NO: 429797 - DNA, 20 bp, Artificial
  CRISPR gRNA sequence
cctcaccccaaactgtcgtc

SEQ ID NO: 429798 - DNA, 20 bp, Artificial
  CRISPR gRNA sequence
accccaaactgtcgtctctt

SEQ ID NO: 429799 - DNA, 20 bp, Artificial
  CRISPR gRNA sequence
tcgtctcttcctgaaggcct

SEQ ID NO: 429800 - DNA, 20 bp, Artificial
  CRISPR gRNA sequence
ttcctgaaggcctgtgtatg

SEQ ID NO: 429801 - DNA, 20 bp, Artificial
  CRISPR gRNA sequence
cctgaaggcctgtgtatgtc

SEQ ID NO: 429802 - DNA, 20 bp, Artificial
  CRISPR gRNA sequence
ctgaaggcctgtgtatgtct

SEQ ID NO: 429803 - DNA, 20 bp, Artificial
  CRISPR gRNA sequence
aaggcctgtgtatgtctcct

SEQ ID NO: 429804 - DNA, 20 bp, Artificial
  CRISPR gRNA sequence
tgtatgtctccttctctcct

SEQ ID NO: 429805 - DNA, 20 bp, Artificial
  CRISPR gRNA sequence
cttctctccttactataata

SEQ ID NO: 429806 - DNA, 20 bp, Artificial
  CRISPR gRNA sequence
ctctccttactataatacct

SEQ ID NO: 429807 - DNA, 20 bp, Artificial
  CRISPR gRNA sequence
tctccttactataatacctt

SEQ ID NO: 429808 - DNA, 20 bp, Artificial
  CRISPR gRNA sequence
tccttactataatacctttt

SEQ ID NO: 429809 - DNA, 20 bp, Artificial
  CRISPR gRNA sequence
cttactataataccttttca

SEQ ID NO: 429810 - DNA, 20 bp, Artificial
  CRISPR gRNA sequence
actataataccttttcatga

SEQ ID NO: 429811 - DNA, 20 bp, Artificial
  CRISPR gRNA sequence
ctataataccttttcatgac

SEQ ID NO: 429812 - DNA, 20 bp, Artificial
  CRISPR gRNA sequence
taataccttttcatgacaac

SEQ ID NO: 429813 - DNA, 20 bp, Artificial
  CRISPR gRNA sequence
ttcatgacaacattgtctcc

SEQ ID NO: 429814 - DNA, 20 bp, Artificial
  CRISPR gRNA sequence
tcatgacaacattgtctccc

SEQ ID NO: 429815 - DNA, 20 bp, Artificial
  CRISPR gRNA sequence
catgacaacattgtctcccc

SEQ ID NO: 429816 - DNA, 20 bp, Artificial
  CRISPR gRNA sequence
atgacaacattgtctcccca

SEQ ID NO: 429817 - DNA, 20 bp, Artificial
  CRISPR gRNA sequence
tctccccatttaactgtaag

SEQ ID NO: 429818 - DNA, 20 bp, Artificial
  CRISPR gRNA sequence
cccatttaactgtaagttct

SEQ ID NO: 429819 - DNA, 20 bp, Artificial
  CRISPR gRNA sequence
aactgtaagttcttgagggc

SEQ ID NO: 429820 - DNA, 20 bp, Artificial
  CRISPR gRNA sequence
actgtaagttcttgagggca

SEQ ID NO: 429821 - DNA, 20 bp, Artificial
  CRISPR gRNA sequence
taagttcttgagggcagata

SEQ ID NO: 429822 - DNA, 20 bp, Artificial
  CRISPR gRNA sequence
ttgagggcagataccaagat

SEQ ID NO: 429823 - DNA, 20 bp, Artificial
  CRISPR gRNA sequence
gagggcagataccaagattt

SEQ ID NO: 429824 - DNA, 20 bp, Artificial
  CRISPR gRNA sequence
agggcagataccaagattta

SEQ ID NO: 429825 - DNA, 20 bp, Artificial
  CRISPR gRNA sequence
agtcactctcaaatctcccc

SEQ ID NO: 429826 - DNA, 20 bp, Artificial
  CRISPR gRNA sequence
gtcactctcaaatctcccca

SEQ ID NO: 429827 - DNA, 20 bp, Artificial
  CRISPR gRNA sequence
tcaaatctccccatagaggc

SEQ ID NO: 429828 - DNA, 20 bp, Artificial
  CRISPR gRNA sequence
aaatctccccatagaggctg

SEQ ID NO: 429829 - DNA, 20 bp, Artificial
  CRISPR gRNA sequence
cccatagaggctgctaccag

SEQ ID NO: 429830 - DNA, 20 bp, Artificial
  CRISPR gRNA sequence
ctaccaggacttacttataa

SEQ ID NO: 429831 - DNA, 20 bp, Artificial
  CRISPR gRNA sequence
ccaggacttacttataacct

SEQ ID NO: 429832 - DNA, 20 bp, Artificial
  CRISPR gRNA sequence
acttataacctgcctttgaa

SEQ ID NO: 429833 - DNA, 20 bp, Artificial
  CRISPR gRNA sequence
cttataacctgcctttgaat

SEQ ID NO: 429834 - DNA, 20 bp, Artificial
  CRISPR gRNA sequence
ataacctgcctttgaatgag

SEQ ID NO: 429835 - DNA, 20 bp, Artificial
  CRISPR gRNA sequence
taacctgcctttgaatgagt

SEQ ID NO: 429836 - DNA, 20 bp, Artificial
  CRISPR gRNA sequence
cctttgaatgagtgaaagtt

SEQ ID NO: 429837 - DNA, 20 bp, Artificial
  CRISPR gRNA sequence
tgaatgagtgaaagttactg

SEQ ID NO: 429838 - DNA, 20 bp, Artificial
  CRISPR gRNA sequence
gaatgagtgaaagttactga

SEQ ID NO: 429839 - DNA, 20 bp, Artificial
  CRISPR gRNA sequence
aatgagtgaaagttactgaa

SEQ ID NO: 429840 - DNA, 20 bp, Artificial
  CRISPR gRNA sequence
ctgaaaatgacgtgaaaaaa

SEQ ID NO: 429841 - DNA, 20 bp, Artificial
  CRISPR gRNA sequence
aaaatgacgtgaaaaaatga

SEQ ID NO: 429842 - DNA, 20 bp, Artificial
  CRISPR gRNA sequence
tgcagtcatgccatcctcat

SEQ ID NO: 429843 - DNA, 20 bp, Artificial
  CRISPR gRNA sequence
cagtcatgccatcctcatca

SEQ ID NO: 429844 - DNA, 20 bp, Artificial
  CRISPR gRNA sequence
atcatcaaccacaaaacctt

SEQ ID NO: 429845 - DNA, 20 bp, Artificial
  CRISPR gRNA sequence
gtagcccaaaatgctggcca

SEQ ID NO: 429846 - DNA, 20 bp, Artificial
  CRISPR gRNA sequence
tagcccaaaatgctggccat

SEQ ID NO: 429847 - DNA, 20 bp, Artificial
  CRISPR gRNA sequence
gccattatgaggaatgtgtc

SEQ ID NO: 429848 - DNA, 20 bp, Artificial
  CRISPR gRNA sequence
tgaggaatgtgtctctcaga

SEQ ID NO: 429849 - DNA, 20 bp, Artificial
  CRISPR gRNA sequence
tcagagacataggatctgct

SEQ ID NO: 429850 - DNA, 20 bp, Artificial
  CRISPR gRNA sequence
agagacataggatctgctca

SEQ ID NO: 429851 - DNA, 20 bp, Artificial
  CRISPR gRNA sequence
ctcaaactgccagatttaaa

SEQ ID NO: 429852 - DNA, 20 bp, Artificial
  CRISPR gRNA sequence
aaactgccagatttaaaacc

SEQ ID NO: 429853 - DNA, 20 bp, Artificial
  CRISPR gRNA sequence
ccagatttaaaaccaggtca

SEQ ID NO: 429854 - DNA, 20 bp, Artificial
  CRISPR gRNA sequence
aaaaccaggtcaagatattt

SEQ ID NO: 429855 - DNA, 20 bp, Artificial
  CRISPR gRNA sequence
aaaccaggtcaagatatttt

SEQ ID NO: 429856 - DNA, 20 bp, Artificial
  CRISPR gRNA sequence
tttaattttgcatttatgat

SEQ ID NO: 429857 - DNA, 20 bp, Artificial
  CRISPR gRNA sequence
ttaattttgcatttatgatc

SEQ ID NO: 429858 - DNA, 20 bp, Artificial
  CRISPR gRNA sequence
taattttgcatttatgatca

SEQ ID NO: 429859 - DNA, 20 bp, Artificial
  CRISPR gRNA sequence
aattttgcatttatgatcaa

SEQ ID NO: 429860 - DNA, 20 bp, Artificial
  CRISPR gRNA sequence
attttgcatttatgatcaag

SEQ ID NO: 429861 - DNA, 20 bp, Artificial
  CRISPR gRNA sequence
tgcatttatgatcaagatcc

SEQ ID NO: 429862 - DNA, 20 bp, Artificial
  CRISPR gRNA sequence
gcatttatgatcaagatcca

SEQ ID NO: 429863 - DNA, 20 bp, Artificial
  CRISPR gRNA sequence
catttatgatcaagatccac

SEQ ID NO: 429864 - DNA, 20 bp, Artificial
  CRISPR gRNA sequence
atgatcaagatccacgttac

SEQ ID NO: 429865 - DNA, 20 bp, Artificial
  CRISPR gRNA sequence
tgatcaagatccacgttact

SEQ ID NO: 429866 - DNA, 20 bp, Artificial
  CRISPR gRNA sequence
ctcaccctaggcctgccata

SEQ ID NO: 429867 - DNA, 20 bp, Artificial
  CRISPR gRNA sequence
accctaggcctgccataatg

SEQ ID NO: 429868 - DNA, 20 bp, Artificial
  CRISPR gRNA sequence
ggcctgccataatgcaaaat

SEQ ID NO: 429869 - DNA, 20 bp, Artificial
  CRISPR gRNA sequence
ccataatgcaaaatggaata

SEQ ID NO: 429870 - DNA, 20 bp, Artificial
  CRISPR gRNA sequence
attcactcaactgaacacac

SEQ ID NO: 429871 - DNA, 20 bp, Artificial
  CRISPR gRNA sequence
ttcactcaactgaacacaca

SEQ ID NO: 429872 - DNA, 20 bp, Artificial
  CRISPR gRNA sequence
actcaactgaacacacacac

SEQ ID NO: 429873 - DNA, 20 bp, Artificial
  CRISPR gRNA sequence
aactgaacacacacacacat

SEQ ID NO: 429874 - DNA, 20 bp, Artificial
  CRISPR gRNA sequence
aacacacacacacatacaca

SEQ ID NO: 429875 - DNA, 20 bp, Artificial
  CRISPR gRNA sequence
atggagagtacagctgctta

SEQ ID NO: 429876 - DNA, 20 bp, Artificial
  CRISPR gRNA sequence
cttatatattcatctataat

SEQ ID NO: 429877 - DNA, 20 bp, Artificial
  CRISPR gRNA sequence
atatattcatctataatagc

SEQ ID NO: 429878 - DNA, 20 bp, Artificial
  CRISPR gRNA sequence
tatattcatctataatagca

SEQ ID NO: 429879 - DNA, 20 bp, Artificial
  CRISPR gRNA sequence
atctataatagcaaagacaa

SEQ ID NO: 429880 - DNA, 20 bp, Artificial
  CRISPR gRNA sequence
taatagcaaagacaaaagtg

SEQ ID NO: 429881 - DNA, 20 bp, Artificial
  CRISPR gRNA sequence
ccagaagatgcctctggttg

SEQ ID NO: 429882 - DNA, 20 bp, Artificial
  CRISPR gRNA sequence
cagaagatgcctctggttgc

SEQ ID NO: 429883 - DNA, 20 bp, Artificial
  CRISPR gRNA sequence
tggttgctaaccagtctctg

SEQ ID NO: 429884 - DNA, 20 bp, Artificial
  CRISPR gRNA sequence
gttgctaaccagtctctgtg

SEQ ID NO: 429885 - DNA, 20 bp, Artificial
  CRISPR gRNA sequence
ctaaccagtctctgtgaaga

SEQ ID NO: 429886 - DNA, 20 bp, Artificial
  CRISPR gRNA sequence
accagtctctgtgaagaagc

SEQ ID NO: 429887 - DNA, 20 bp, Artificial
  CRISPR gRNA sequence
tgtgaagaagctgcagttac

SEQ ID NO: 429888 - DNA, 20 bp, Artificial
  CRISPR gRNA sequence
tgaagaagctgcagttaccc

SEQ ID NO: 429889 - DNA, 20 bp, Artificial
  CRISPR gRNA sequence
cagttacccaggcttctgta

SEQ ID NO: 429890 - DNA, 20 bp, Artificial
  CRISPR gRNA sequence
cccaggcttctgtaactcag

SEQ ID NO: 429891 - DNA, 20 bp, Artificial
  CRISPR gRNA sequence
ctgtaactcaggacattgaa

SEQ ID NO: 429892 - DNA, 20 bp, Artificial
  CRISPR gRNA sequence
tgtaactcaggacattgaag

SEQ ID NO: 429893 - DNA, 20 bp, Artificial
  CRISPR gRNA sequence
taactcaggacattgaagta

SEQ ID NO: 429894 - DNA, 20 bp, Artificial
  CRISPR gRNA sequence
aggacattgaagtagtcatg

SEQ ID NO: 429895 - DNA, 20 bp, Artificial
  CRISPR gRNA sequence
aagtagtcatgcagctcggc

SEQ ID NO: 429896 - DNA, 20 bp, Artificial
  CRISPR gRNA sequence
ggcacagtcctctccccgct

SEQ ID NO: 429897 - DNA, 20 bp, Artificial
  CRISPR gRNA sequence
tccccgctgctctccacaga

SEQ ID NO: 429898 - DNA, 20 bp, Artificial
  CRISPR gRNA sequence
cccgctgctctccacagagc

SEQ ID NO: 429899 - DNA, 20 bp, Artificial
  CRISPR gRNA sequence
ctctccacagagcccagcag

SEQ ID NO: 429900 - DNA, 20 bp, Artificial
  CRISPR gRNA sequence
tccacagagcccagcaggtg

SEQ ID NO: 429901 - DNA, 20 bp, Artificial
  CRISPR gRNA sequence
cacagagcccagcaggtgca

SEQ ID NO: 429902 - DNA, 20 bp, Artificial
  CRISPR gRNA sequence
ctgcctggacacagcttcct

SEQ ID NO: 429903 - DNA, 20 bp, Artificial
  CRISPR gRNA sequence
tgcctggacacagcttcctg

SEQ ID NO: 429904 - DNA, 20 bp, Artificial
  CRISPR gRNA sequence
cctggacacagcttcctggg

SEQ ID NO: 429905 - DNA, 20 bp, Artificial
  CRISPR gRNA sequence
gacacagcttcctgggggtg

SEQ ID NO: 429906 - DNA, 20 bp, Artificial
  CRISPR gRNA sequence
cctgggggtgagggagcact

SEQ ID NO: 429907 - DNA, 20 bp, Artificial
  CRISPR gRNA sequence
ctgggggtgagggagcactg

SEQ ID NO: 429908 - DNA, 20 bp, Artificial
  CRISPR gRNA sequence
ggggtgagggagcactgggg

SEQ ID NO: 429909 - DNA, 20 bp, Artificial
  CRISPR gRNA sequence
gggctccattcctcctgtcc

SEQ ID NO: 429910 - DNA, 20 bp, Artificial
  CRISPR gRNA sequence
cattcctcctgtccagctga

SEQ ID NO: 429911 - DNA, 20 bp, Artificial
  CRISPR gRNA sequence
ctcctgtccagctgattttc

SEQ ID NO: 429912 - DNA, 20 bp, Artificial
  CRISPR gRNA sequence
ctgtccagctgattttctcc

SEQ ID NO: 429913 - DNA, 20 bp, Artificial
  CRISPR gRNA sequence
tccagctgattttctcctga

SEQ ID NO: 429914 - DNA, 20 bp, Artificial
  CRISPR gRNA sequence
attttctcctgaggtcacct

SEQ ID NO: 429915 - DNA, 20 bp, Artificial
  CRISPR gRNA sequence
tctcctgaggtcaccttcca

SEQ ID NO: 429916 - DNA, 20 bp, Artificial
  CRISPR gRNA sequence
ctcctgaggtcaccttccac

SEQ ID NO: 429917 - DNA, 20 bp, Artificial
  CRISPR gRNA sequence
tcctgaggtcaccttccaca

SEQ ID NO: 429918 - DNA, 20 bp, Artificial
  CRISPR gRNA sequence
ctgaggtcaccttccacaga

SEQ ID NO: 429919 - DNA, 20 bp, Artificial
  CRISPR gRNA sequence
aggtcaccttccacagaatg

SEQ ID NO: 429920 - DNA, 20 bp, Artificial
  CRISPR gRNA sequence
ccacagaatggattctgagg

SEQ ID NO: 429921 - DNA, 20 bp, Artificial
  CRISPR gRNA sequence
cacagaatggattctgaggg

SEQ ID NO: 429922 - DNA, 20 bp, Artificial
  CRISPR gRNA sequence
tgagggctttcttctaaaaa

SEQ ID NO: 429923 - DNA, 20 bp, Artificial
  CRISPR gRNA sequence
agggctttcttctaaaaaca

SEQ ID NO: 429924 - DNA, 20 bp, Artificial
  CRISPR gRNA sequence
tcttctaaaaacaaacaaac

SEQ ID NO: 429925 - DNA, 20 bp, Artificial
  CRISPR gRNA sequence
cttctaaaaacaaacaaact

SEQ ID NO: 429926 - DNA, 20 bp, Artificial
  CRISPR gRNA sequence
ttctaaaaacaaacaaacta

SEQ ID NO: 429927 - DNA, 20 bp, Artificial
  CRISPR gRNA sequence
ctaaaaacaaacaaactaca

SEQ ID NO: 429928 - DNA, 20 bp, Artificial
  CRISPR gRNA sequence
taaaaacaaacaaactacaa

SEQ ID NO: 429929 - DNA, 20 bp, Artificial
  CRISPR gRNA sequence
aaaacaaacaaactacaaag

SEQ ID NO: 429930 - DNA, 20 bp, Artificial
  CRISPR gRNA sequence
caaagtgagtatgtggggat

SEQ ID NO: 429931 - DNA, 20 bp, Artificial
  CRISPR gRNA sequence
ttcaacagttaatccccaat

SEQ ID NO: 429932 - DNA, 20 bp, Artificial
  CRISPR gRNA sequence
aacagttaatccccaatatg

SEQ ID NO: 429933 - DNA, 20 bp, Artificial
  CRISPR gRNA sequence
atccccaatatgacatctct

SEQ ID NO: 429934 - DNA, 20 bp, Artificial
  CRISPR gRNA sequence
tctcttcctttcttacacac

SEQ ID NO: 429935 - DNA, 20 bp, Artificial
  CRISPR gRNA sequence
tcttcctttcttacacacat

SEQ ID NO: 429936 - DNA, 20 bp, Artificial
  CRISPR gRNA sequence
ttcctttcttacacacatgc

SEQ ID NO: 429937 - DNA, 20 bp, Artificial
  CRISPR gRNA sequence
cctttcttacacacatgcac

SEQ ID NO: 429938 - DNA, 20 bp, Artificial
  CRISPR gRNA sequence
ctttcttacacacatgcaca

SEQ ID NO: 429939 - DNA, 20 bp, Artificial
  CRISPR gRNA sequence
tcttacacacatgcacacca

SEQ ID NO: 429940 - DNA, 20 bp, Artificial
  CRISPR gRNA sequence
cttacacacatgcacaccag

SEQ ID NO: 429941 - DNA, 20 bp, Artificial
  CRISPR gRNA sequence
ttacacacatgcacaccagc

SEQ ID NO: 429942 - DNA, 20 bp, Artificial
  CRISPR gRNA sequence
acacacatgcacaccagcaa

SEQ ID NO: 429943 - DNA, 20 bp, Artificial
  CRISPR gRNA sequence
cacacatgcacaccagcaaa

SEQ ID NO: 429944 - DNA, 20 bp, Artificial
  CRISPR gRNA sequence
atgttcttaccaacaccaat

SEQ ID NO: 429945 - DNA, 20 bp, Artificial
  CRISPR gRNA sequence
tgttcttaccaacaccaatt

SEQ ID NO: 429946 - DNA, 20 bp, Artificial
  CRISPR gRNA sequence
ttaccaacaccaattcctta

SEQ ID NO: 429947 - DNA, 20 bp, Artificial
  CRISPR gRNA sequence
accaacaccaattccttagc

SEQ ID NO: 429948 - DNA, 20 bp, Artificial
  CRISPR gRNA sequence
ccaacaccaattccttagcc

SEQ ID NO: 429949 - DNA, 20 bp, Artificial
  CRISPR gRNA sequence
cttagcccttaatttctcaa

SEQ ID NO: 429950 - DNA, 20 bp, Artificial
  CRISPR gRNA sequence
agcccttaatttctcaaccg

SEQ ID NO: 429951 - DNA, 20 bp, Artificial
  CRISPR gRNA sequence
gcccttaatttctcaaccgc

SEQ ID NO: 429952 - DNA, 20 bp, Artificial
  CRISPR gRNA sequence
aatttctcaaccgcgttaca

SEQ ID NO: 429953 - DNA, 20 bp, Artificial
  CRISPR gRNA sequence
atttctcaaccgcgttacag

SEQ ID NO: 429954 - DNA, 20 bp, Artificial
  CRISPR gRNA sequence
ctcaaccgcgttacagctag

SEQ ID NO: 429955 - DNA, 20 bp, Artificial
  CRISPR gRNA sequence
tcaaccgcgttacagctaga

SEQ ID NO: 429956 - DNA, 20 bp, Artificial
  CRISPR gRNA sequence
aaccgcgttacagctagatt

SEQ ID NO: 429957 - DNA, 20 bp, Artificial
  CRISPR gRNA sequence
cagctagatttaaatgctaa

SEQ ID NO: 429958 - DNA, 20 bp, Artificial
  CRISPR gRNA sequence
gatttaaatgctaactagtc

SEQ ID NO: 429959 - DNA, 20 bp, Artificial
  CRISPR gRNA sequence
aaatgctaactagtccatgg

SEQ ID NO: 429960 - DNA, 20 bp, Artificial
  CRISPR gRNA sequence
aatgctaactagtccatgga

SEQ ID NO: 429961 - DNA, 20 bp, Artificial
  CRISPR gRNA sequence
actagtccatggaaactgca

SEQ ID NO: 429962 - DNA, 20 bp, Artificial
  CRISPR gRNA sequence
gtccatggaaactgcactta

SEQ ID NO: 429963 - DNA, 20 bp, Artificial
  CRISPR gRNA sequence
cacttactacatataccacg

SEQ ID NO: 429964 - DNA, 20 bp, Artificial
  CRISPR gRNA sequence
actacatataccacgtgcca

SEQ ID NO: 429965 - DNA, 20 bp, Artificial
  CRISPR gRNA sequence
ctacatataccacgtgccac

SEQ ID NO: 429966 - DNA, 20 bp, Artificial
  CRISPR gRNA sequence
catataccacgtgccacaca

SEQ ID NO: 429967 - DNA, 20 bp, Artificial
  CRISPR gRNA sequence
gttacttcctgttcactaag

SEQ ID NO: 429968 - DNA, 20 bp, Artificial
  CRISPR gRNA sequence
ttacttcctgttcactaagc

SEQ ID NO: 429969 - DNA, 20 bp, Artificial
  CRISPR gRNA sequence
cttcctgttcactaagctta

SEQ ID NO: 429970 - DNA, 20 bp, Artificial
  CRISPR gRNA sequence
cctgttcactaagcttagtg

SEQ ID NO: 429971 - DNA, 20 bp, Artificial
  CRISPR gRNA sequence
ctgttcactaagcttagtga

SEQ ID NO: 429972 - DNA, 20 bp, Artificial
  CRISPR gRNA sequence
ttcactaagcttagtgaggc

SEQ ID NO: 429973 - DNA, 20 bp, Artificial
  CRISPR gRNA sequence
actaagcttagtgaggcagc

SEQ ID NO: 429974 - DNA, 20 bp, Artificial
  CRISPR gRNA sequence
agcttagtgaggcagctttc

SEQ ID NO: 429975 - DNA, 20 bp, Artificial
  CRISPR gRNA sequence
agtgaggcagctttccattc

SEQ ID NO: 429976 - DNA, 20 bp, Artificial
  CRISPR gRNA sequence
gtgaggcagctttccattct

SEQ ID NO: 429977 - DNA, 20 bp, Artificial
  CRISPR gRNA sequence
tccattctctattttcttgt

SEQ ID NO: 429978 - DNA, 20 bp, Artificial
  CRISPR gRNA sequence
ccattctctattttcttgta

SEQ ID NO: 429979 - DNA, 20 bp, Artificial
  CRISPR gRNA sequence
cattctctattttcttgtac

SEQ ID NO: 429980 - DNA, 20 bp, Artificial
  CRISPR gRNA sequence
tctattttcttgtactgttt

SEQ ID NO: 429981 - DNA, 20 bp, Artificial
  CRISPR gRNA sequence
tattttcttgtactgtttac

SEQ ID NO: 429982 - DNA, 20 bp, Artificial
  CRISPR gRNA sequence
ttttcttgtactgtttactg

SEQ ID NO: 429983 - DNA, 20 bp, Artificial
  CRISPR gRNA sequence
tcttgtactgtttactgcac

SEQ ID NO: 429984 - DNA, 20 bp, Artificial
  CRISPR gRNA sequence
cttgtactgtttactgcact

SEQ ID NO: 429985 - DNA, 20 bp, Artificial
  CRISPR gRNA sequence
ttgtactgtttactgcactt

SEQ ID NO: 429986 - DNA, 20 bp, Artificial
  CRISPR gRNA sequence
gtactgtttactgcacttga

SEQ ID NO: 429987 - DNA, 20 bp, Artificial
  CRISPR gRNA sequence
tactgtttactgcacttgac

SEQ ID NO: 429988 - DNA, 20 bp, Artificial
  CRISPR gRNA sequence
tttactgcacttgactctgt

SEQ ID NO: 429989 - DNA, 20 bp, Artificial
  CRISPR gRNA sequence
actgcacttgactctgtcga

SEQ ID NO: 429990 - DNA, 20 bp, Artificial
  CRISPR gRNA sequence
ctgcacttgactctgtcgac

SEQ ID NO: 429991 - DNA, 20 bp, Artificial
  CRISPR gRNA sequence
cacttgactctgtcgacctc

SEQ ID NO: 429992 - DNA, 20 bp, Artificial
  CRISPR gRNA sequence
gactctgtcgacctcttact

SEQ ID NO: 429993 - DNA, 20 bp, Artificial
  CRISPR gRNA sequence
actctgtcgacctcttactt

SEQ ID NO: 429994 - DNA, 20 bp, Artificial
  CRISPR gRNA sequence
tgtcgacctcttactttctg

SEQ ID NO: 429995 - DNA, 20 bp, Artificial
  CRISPR gRNA sequence
tcgacctcttactttctgaa

SEQ ID NO: 429996 - DNA, 20 bp, Artificial
  CRISPR gRNA sequence
ttactttctgaaatgttctc

SEQ ID NO: 429997 - DNA, 20 bp, Artificial
  CRISPR gRNA sequence
actttctgaaatgttctctt

SEQ ID NO: 429998 - DNA, 20 bp, Artificial
  CRISPR gRNA sequence
ctttctgaaatgttctcttt

SEQ ID NO: 429999 - DNA, 20 bp, Artificial
  CRISPR gRNA sequence
tctgaaatgttctctttctc

SEQ ID NO: 430000 - DNA, 20 bp, Artificial
  CRISPR gRNA sequence
ctgaaatgttctctttctct

SEQ ID NO: 430001 - DNA, 20 bp, Artificial
  CRISPR gRNA sequence
tgaaatgttctctttctctg

SEQ ID NO: 430002 - DNA, 20 bp, Artificial
  CRISPR gRNA sequence
aaatgttctctttctctgga

SEQ ID NO: 430003 - DNA, 20 bp, Artificial
  CRISPR gRNA sequence
tctttctctggatcctttgg

SEQ ID NO: 430004 - DNA, 20 bp, Artificial
  CRISPR gRNA sequence
tttctctggatcctttggca

SEQ ID NO: 430005 - DNA, 20 bp, Artificial
  CRISPR gRNA sequence
tctctggatcctttggcatc

SEQ ID NO: 430006 - DNA, 20 bp, Artificial
  CRISPR gRNA sequence
ctctggatcctttggcatca

SEQ ID NO: 430007 - DNA, 20 bp, Artificial
  CRISPR gRNA sequence
tctggatcctttggcatcac

SEQ ID NO: 430008 - DNA, 20 bp, Artificial
  CRISPR gRNA sequence
tggatcctttggcatcactc

SEQ ID NO: 430009 - DNA, 20 bp, Artificial
  CRISPR gRNA sequence
gatcctttggcatcactctc

SEQ ID NO: 430010 - DNA, 20 bp, Artificial
  CRISPR gRNA sequence
tggcatcactctctcctgat

SEQ ID NO: 430011 - DNA, 20 bp, Artificial
  CRISPR gRNA sequence
ggcatcactctctcctgatt

SEQ ID NO: 430012 - DNA, 20 bp, Artificial
  CRISPR gRNA sequence
gcatcactctctcctgattt

SEQ ID NO: 430013 - DNA, 20 bp, Artificial
  CRISPR gRNA sequence
tctcctgattttcttctcct

SEQ ID NO: 430014 - DNA, 20 bp, Artificial
  CRISPR gRNA sequence
tcctgattttcttctcctcc

SEQ ID NO: 430015 - DNA, 20 bp, Artificial
  CRISPR gRNA sequence
ctgattttcttctcctcctt

SEQ ID NO: 430016 - DNA, 20 bp, Artificial
  CRISPR gRNA sequence
attttcttctcctcctttga

SEQ ID NO: 430017 - DNA, 20 bp, Artificial
  CRISPR gRNA sequence
tcttctcctcctttgaaccc

SEQ ID NO: 430018 - DNA, 20 bp, Artificial
  CRISPR gRNA sequence
cttctcctcctttgaacccc

SEQ ID NO: 430019 - DNA, 20 bp, Artificial
  CRISPR gRNA sequence
ttctcctcctttgaaccccc

SEQ ID NO: 430020 - DNA, 20 bp, Artificial
  CRISPR gRNA sequence
ctcctcctttgaacccccac

SEQ ID NO: 430021 - DNA, 20 bp, Artificial
  CRISPR gRNA sequence
tcctcctttgaacccccacc

SEQ ID NO: 430022 - DNA, 20 bp, Artificial
  CRISPR gRNA sequence
ctcctttgaacccccacctt

SEQ ID NO: 430023 - DNA, 20 bp, Artificial
  CRISPR gRNA sequence
ctttgaacccccaccttcgt

SEQ ID NO: 430024 - DNA, 20 bp, Artificial
  CRISPR gRNA sequence
tgaacccccaccttcgtctt

SEQ ID NO: 430025 - DNA, 20 bp, Artificial
  CRISPR gRNA sequence
gaacccccaccttcgtcttc

SEQ ID NO: 430026 - DNA, 20 bp, Artificial
  CRISPR gRNA sequence
aacccccaccttcgtcttca

SEQ ID NO: 430027 - DNA, 20 bp, Artificial
  CRISPR gRNA sequence
cgtcttcagccaggcctgcc

SEQ ID NO: 430028 - DNA, 20 bp, Artificial
  CRISPR gRNA sequence
gtcttcagccaggcctgccc

SEQ ID NO: 430029 - DNA, 20 bp, Artificial
  CRISPR gRNA sequence
cagccaggcctgcccctttt

SEQ ID NO: 430030 - DNA, 20 bp, Artificial
  CRISPR gRNA sequence
agccaggcctgccccttttc

SEQ ID NO: 430031 - DNA, 20 bp, Artificial
  CRISPR gRNA sequence
ccccttttctctttgcacat

SEQ ID NO: 430032 - DNA, 20 bp, Artificial
  CRISPR gRNA sequence
ttctctttgcacatcagctc

SEQ ID NO: 430033 - DNA, 20 bp, Artificial
  CRISPR gRNA sequence
tctctttgcacatcagctcc

SEQ ID NO: 430034 - DNA, 20 bp, Artificial
  CRISPR gRNA sequence
ctctttgcacatcagctccc

SEQ ID NO: 430035 - DNA, 20 bp, Artificial
  CRISPR gRNA sequence
tctttgcacatcagctcccc

SEQ ID NO: 430036 - DNA, 20 bp, Artificial
  CRISPR gRNA sequence
tttgcacatcagctccccaa

SEQ ID NO: 430037 - DNA, 20 bp, Artificial
  CRISPR gRNA sequence
tgcacatcagctccccaaac

SEQ ID NO: 430038 - DNA, 20 bp, Artificial
  CRISPR gRNA sequence
gcacatcagctccccaaacc

SEQ ID NO: 430039 - DNA, 20 bp, Artificial
  CRISPR gRNA sequence
cacatcagctccccaaaccg

SEQ ID NO: 430040 - DNA, 20 bp, Artificial
  CRISPR gRNA sequence
cccaaaccgtggggttcccc

SEQ ID NO: 430041 - DNA, 20 bp, Artificial
  CRISPR gRNA sequence
cccagggttctgctctctgc

SEQ ID NO: 430042 - DNA, 20 bp, Artificial
  CRISPR gRNA sequence
tgctctctgctttctctcac

SEQ ID NO: 430043 - DNA, 20 bp, Artificial
  CRISPR gRNA sequence
ctctctgctttctctcacgc

SEQ ID NO: 430044 - DNA, 20 bp, Artificial
  CRISPR gRNA sequence
tctgctttctctcacgctaa

SEQ ID NO: 430045 - DNA, 20 bp, Artificial
  CRISPR gRNA sequence
tgctttctctcacgctaaac

SEQ ID NO: 430046 - DNA, 20 bp, Artificial
  CRISPR gRNA sequence
ctttctctcacgctaaacat

SEQ ID NO: 430047 - DNA, 20 bp, Artificial
  CRISPR gRNA sequence
tctctcacgctaaacatgct

SEQ ID NO: 430048 - DNA, 20 bp, Artificial
  CRISPR gRNA sequence
ctctcacgctaaacatgctc

SEQ ID NO: 430049 - DNA, 20 bp, Artificial
  CRISPR gRNA sequence
tctcacgctaaacatgctct

SEQ ID NO: 430050 - DNA, 20 bp, Artificial
  CRISPR gRNA sequence
tcacgctaaacatgctctct

SEQ ID NO: 430051 - DNA, 20 bp, Artificial
  CRISPR gRNA sequence
acgctaaacatgctctctga

SEQ ID NO: 430052 - DNA, 20 bp, Artificial
  CRISPR gRNA sequence
aacatgctctctgagtgatt

SEQ ID NO: 430053 - DNA, 20 bp, Artificial
  CRISPR gRNA sequence
tctgagtgatttcatgagca

SEQ ID NO: 430054 - DNA, 20 bp, Artificial
  CRISPR gRNA sequence
tgagtgatttcatgagcatc

SEQ ID NO: 430055 - DNA, 20 bp, Artificial
  CRISPR gRNA sequence
agtgatttcatgagcatcta

SEQ ID NO: 430056 - DNA, 20 bp, Artificial
  CRISPR gRNA sequence
catgagcatctactttctta

SEQ ID NO: 430057 - DNA, 20 bp, Artificial
  CRISPR gRNA sequence
atgagcatctactttcttac

SEQ ID NO: 430058 - DNA, 20 bp, Artificial
  CRISPR gRNA sequence
ctttcttacatctacaacca

SEQ ID NO: 430059 - DNA, 20 bp, Artificial
  CRISPR gRNA sequence
tcttacatctacaaccacca

SEQ ID NO: 430060 - DNA, 20 bp, Artificial
  CRISPR gRNA sequence
cttacatctacaaccaccat

SEQ ID NO: 430061 - DNA, 20 bp, Artificial
  CRISPR gRNA sequence
ttacatctacaaccaccatc

SEQ ID NO: 430062 - DNA, 20 bp, Artificial
  CRISPR gRNA sequence
acatctacaaccaccatctg

SEQ ID NO: 430063 - DNA, 20 bp, Artificial
  CRISPR gRNA sequence
catctacaaccaccatctgt

SEQ ID NO: 430064 - DNA, 20 bp, Artificial
  CRISPR gRNA sequence
caaccaccatctgtcctctg

SEQ ID NO: 430065 - DNA, 20 bp, Artificial
  CRISPR gRNA sequence
tcctctgaagatgcccaaat

SEQ ID NO: 430066 - DNA, 20 bp, Artificial
  CRISPR gRNA sequence
tgaagatgcccaaatctcta

SEQ ID NO: 430067 - DNA, 20 bp, Artificial
  CRISPR gRNA sequence
aagatgcccaaatctctatc

SEQ ID NO: 430068 - DNA, 20 bp, Artificial
  CRISPR gRNA sequence
tatctaaactagcccaggct

SEQ ID NO: 430069 - DNA, 20 bp, Artificial
  CRISPR gRNA sequence
tctaaactagcccaggcttc

SEQ ID NO: 430070 - DNA, 20 bp, Artificial
  CRISPR gRNA sequence
aactagcccaggcttctgcc

SEQ ID NO: 430071 - DNA, 20 bp, Artificial
  CRISPR gRNA sequence
gcccaggcttctgccctgag

SEQ ID NO: 430072 - DNA, 20 bp, Artificial
  CRISPR gRNA sequence
ctgccctgagctccagatgc

SEQ ID NO: 430073 - DNA, 20 bp, Artificial
  CRISPR gRNA sequence
tgccctgagctccagatgca

SEQ ID NO: 430074 - DNA, 20 bp, Artificial
  CRISPR gRNA sequence
ccctgagctccagatgcagg

SEQ ID NO: 430075 - DNA, 20 bp, Artificial
  CRISPR gRNA sequence
agctccagatgcaggtgtcc

SEQ ID NO: 430076 - DNA, 20 bp, Artificial
  CRISPR gRNA sequence
cagatgcaggtgtccacctg

SEQ ID NO: 430077 - DNA, 20 bp, Artificial
  CRISPR gRNA sequence
tccactgggcatcatcacct

SEQ ID NO: 430078 - DNA, 20 bp, Artificial
  CRISPR gRNA sequence
ggcatcatcacctgatgacc

SEQ ID NO: 430079 - DNA, 20 bp, Artificial
  CRISPR gRNA sequence
atgacccacggcaagctcag

SEQ ID NO: 430080 - DNA, 20 bp, Artificial
  CRISPR gRNA sequence
agactcaaattgtctcaaac

SEQ ID NO: 430081 - DNA, 20 bp, Artificial
  CRISPR gRNA sequence
aaattgtctcaaacgacacc

SEQ ID NO: 430082 - DNA, 20 bp, Artificial
  CRISPR gRNA sequence
tctcaaacgacaccatcaca

SEQ ID NO: 430083 - DNA, 20 bp, Artificial
  CRISPR gRNA sequence
aaacgacaccatcacattcc

SEQ ID NO: 430084 - DNA, 20 bp, Artificial
  CRISPR gRNA sequence
ctgccccaacaaaccactcc

SEQ ID NO: 430085 - DNA, 20 bp, Artificial
  CRISPR gRNA sequence
ccccaacaaaccactcctgc

SEQ ID NO: 430086 - DNA, 20 bp, Artificial
  CRISPR gRNA sequence
ctgcccctatattcactgcc

SEQ ID NO: 430087 - DNA, 20 bp, Artificial
  CRISPR gRNA sequence
cccctatattcactgccctg

SEQ ID NO: 430088 - DNA, 20 bp, Artificial
  CRISPR gRNA sequence
tattcactgccctggtttat

SEQ ID NO: 430089 - DNA, 20 bp, Artificial
  CRISPR gRNA sequence
actgccctggtttatggcac

SEQ ID NO: 430090 - DNA, 20 bp, Artificial
  CRISPR gRNA sequence
ccctggtttatggcaccagc

SEQ ID NO: 430091 - DNA, 20 bp, Artificial
  CRISPR gRNA sequence
gtttatggcaccagctgagc

SEQ ID NO: 430092 - DNA, 20 bp, Artificial
  CRISPR gRNA sequence
atggcaccagctgagcagaa

SEQ ID NO: 430093 - DNA, 20 bp, Artificial
  CRISPR gRNA sequence
tggcaccagctgagcagaaa

SEQ ID NO: 430094 - DNA, 20 bp, Artificial
  CRISPR gRNA sequence
agcagaaatctggaggctaa

SEQ ID NO: 430095 - DNA, 20 bp, Artificial
  CRISPR gRNA sequence
gaggctaatgttcaactcaa

SEQ ID NO: 430096 - DNA, 20 bp, Artificial
  CRISPR gRNA sequence
atgttcaactcaatttatct

SEQ ID NO: 430097 - DNA, 20 bp, Artificial
  CRISPR gRNA sequence
aactcaatttatctgtaaaa

SEQ ID NO: 430098 - DNA, 20 bp, Artificial
  CRISPR gRNA sequence
aatttatctgtaaaacttca

SEQ ID NO: 430099 - DNA, 20 bp, Artificial
  CRISPR gRNA sequence
atctgtaaaacttcatccaa

SEQ ID NO: 430100 - DNA, 20 bp, Artificial
  CRISPR gRNA sequence
tctgtaaaacttcatccaat

SEQ ID NO: 430101 - DNA, 20 bp, Artificial
  CRISPR gRNA sequence
taaaacttcatccaatttta

SEQ ID NO: 430102 - DNA, 20 bp, Artificial
  CRISPR gRNA sequence
catccaattttaatcctagg

SEQ ID NO: 430103 - DNA, 20 bp, Artificial
  CRISPR gRNA sequence
atccaattttaatcctaggc

SEQ ID NO: 430104 - DNA, 20 bp, Artificial
  CRISPR gRNA sequence
taatcctaggcagttctgaa

SEQ ID NO: 430105 - DNA, 20 bp, Artificial
  CRISPR gRNA sequence
aatcctaggcagttctgaaa

SEQ ID NO: 430106 - DNA, 20 bp, Artificial
  CRISPR gRNA sequence
atcctaggcagttctgaaat

SEQ ID NO: 430107 - DNA, 20 bp, Artificial
  CRISPR gRNA sequence
ggcagttctgaaatctactc

SEQ ID NO: 430108 - DNA, 20 bp, Artificial
  CRISPR gRNA sequence
tgaaatctactccctctttt

SEQ ID NO: 430109 - DNA, 20 bp, Artificial
  CRISPR gRNA sequence
aaatctactccctcttttcc

SEQ ID NO: 430110 - DNA, 20 bp, Artificial
  CRISPR gRNA sequence
ctccctcttttccatctcta

SEQ ID NO: 430111 - DNA, 20 bp, Artificial
  CRISPR gRNA sequence
cctcttttccatctctatat

SEQ ID NO: 430112 - DNA, 20 bp, Artificial
  CRISPR gRNA sequence
ttttccatctctatatccat

SEQ ID NO: 430113 - DNA, 20 bp, Artificial
  CRISPR gRNA sequence
ttccatctctatatccatgt

SEQ ID NO: 430114 - DNA, 20 bp, Artificial
  CRISPR gRNA sequence
tccatctctatatccatgtc

SEQ ID NO: 430115 - DNA, 20 bp, Artificial
  CRISPR gRNA sequence
ccatctctatatccatgtct

SEQ ID NO: 430116 - DNA, 20 bp, Artificial
  CRISPR gRNA sequence
catctctatatccatgtctt

SEQ ID NO: 430117 - DNA, 20 bp, Artificial
  CRISPR gRNA sequence
tatatccatgtcttctctca

SEQ ID NO: 430118 - DNA, 20 bp, Artificial
  CRISPR gRNA sequence
tatccatgtcttctctcaca

SEQ ID NO: 430119 - DNA, 20 bp, Artificial
  CRISPR gRNA sequence
ctctcacacctgggcttcat

SEQ ID NO: 430120 - DNA, 20 bp, Artificial
  CRISPR gRNA sequence
tctcacacctgggcttcatc

SEQ ID NO: 430121 - DNA, 20 bp, Artificial
  CRISPR gRNA sequence
tcacacctgggcttcatcct

SEQ ID NO: 430122 - DNA, 20 bp, Artificial
  CRISPR gRNA sequence
acacctgggcttcatcctca

SEQ ID NO: 430123 - DNA, 20 bp, Artificial
  CRISPR gRNA sequence
ggcttcatcctcactgtctc

SEQ ID NO: 430124 - DNA, 20 bp, Artificial
  CRISPR gRNA sequence
catcctcactgtctctggac

SEQ ID NO: 430125 - DNA, 20 bp, Artificial
  CRISPR gRNA sequence
atcctcactgtctctggact

SEQ ID NO: 430126 - DNA, 20 bp, Artificial
  CRISPR gRNA sequence
actgtctctggactccctct

SEQ ID NO: 430127 - DNA, 20 bp, Artificial
  CRISPR gRNA sequence
tctctggactccctcttact

SEQ ID NO: 430128 - DNA, 20 bp, Artificial
  CRISPR gRNA sequence
tggactccctcttacttcta

SEQ ID NO: 430129 - DNA, 20 bp, Artificial
  CRISPR gRNA sequence
gactccctcttacttctagt

SEQ ID NO: 430130 - DNA, 20 bp, Artificial
  CRISPR gRNA sequence
cctcttacttctagtccaac

SEQ ID NO: 430131 - DNA, 20 bp, Artificial
  CRISPR gRNA sequence
ttacttctagtccaactcca

SEQ ID NO: 430132 - DNA, 20 bp, Artificial
  CRISPR gRNA sequence
acttctagtccaactccaca

SEQ ID NO: 430133 - DNA, 20 bp, Artificial
  CRISPR gRNA sequence
cttctagtccaactccacat

SEQ ID NO: 430134 - DNA, 20 bp, Artificial
  CRISPR gRNA sequence
ctagtccaactccacatggt

SEQ ID NO: 430135 - DNA, 20 bp, Artificial
  CRISPR gRNA sequence
tagtccaactccacatggtc

SEQ ID NO: 430136 - DNA, 20 bp, Artificial
  CRISPR gRNA sequence
gtccaactccacatggtcgc

SEQ ID NO: 430137 - DNA, 20 bp, Artificial
  CRISPR gRNA sequence
cacatggtcgccagcagagt

SEQ ID NO: 430138 - DNA, 20 bp, Artificial
  CRISPR gRNA sequence
tcaaaaacaaaagttgtgtc

SEQ ID NO: 430139 - DNA, 20 bp, Artificial
  CRISPR gRNA sequence
caaaaacaaaagttgtgtca

SEQ ID NO: 430140 - DNA, 20 bp, Artificial
  CRISPR gRNA sequence
aaaaacaaaagttgtgtcag

SEQ ID NO: 430141 - DNA, 20 bp, Artificial
  CRISPR gRNA sequence
tgtcagtccatatttctgcc

SEQ ID NO: 430142 - DNA, 20 bp, Artificial
  CRISPR gRNA sequence
ctgcctaaaactcttcaatg

SEQ ID NO: 430143 - DNA, 20 bp, Artificial
  CRISPR gRNA sequence
tgcctaaaactcttcaatgg

SEQ ID NO: 430144 - DNA, 20 bp, Artificial
  CRISPR gRNA sequence
cctaaaactcttcaatggct

SEQ ID NO: 430145 - DNA, 20 bp, Artificial
  CRISPR gRNA sequence
aaactcttcaatggctccac

SEQ ID NO: 430146 - DNA, 20 bp, Artificial
  CRISPR gRNA sequence
ttcaatggctccactgtata

SEQ ID NO: 430147 - DNA, 20 bp, Artificial
  CRISPR gRNA sequence
caatggctccactgtatata

SEQ ID NO: 430148 - DNA, 20 bp, Artificial
  CRISPR gRNA sequence
aatggctccactgtatatag

SEQ ID NO: 430149 - DNA, 20 bp, Artificial
  CRISPR gRNA sequence
cactgtatataggagggtgc

SEQ ID NO: 430150 - DNA, 20 bp, Artificial
  CRISPR gRNA sequence
tatataggagggtgcttaac

SEQ ID NO: 430151 - DNA, 20 bp, Artificial
  CRISPR gRNA sequence
aacctgagatgcacagctgg

SEQ ID NO: 430152 - DNA, 20 bp, Artificial
  CRISPR gRNA sequence
acctgagatgcacagctgga

SEQ ID NO: 430153 - DNA, 20 bp, Artificial
  CRISPR gRNA sequence
agatgcacagctggatttca

SEQ ID NO: 430154 - DNA, 20 bp, Artificial
  CRISPR gRNA sequence
gatttcaggggatttgtaaa

SEQ ID NO: 430155 - DNA, 20 bp, Artificial
  CRISPR gRNA sequence
caggggatttgtaaattgta

SEQ ID NO: 430156 - DNA, 20 bp, Artificial
  CRISPR gRNA sequence
aggggatttgtaaattgtat

SEQ ID NO: 430157 - DNA, 20 bp, Artificial
  CRISPR gRNA sequence
gtaaattgtatagaaaattt

SEQ ID NO: 430158 - DNA, 20 bp, Artificial
  CRISPR gRNA sequence
taaattgtatagaaaatttt

SEQ ID NO: 430159 - DNA, 20 bp, Artificial
  CRISPR gRNA sequence
tatagaaaattttgcccaag

SEQ ID NO: 430160 - DNA, 20 bp, Artificial
  CRISPR gRNA sequence
tgcccaagaagaaaatccat

SEQ ID NO: 430161 - DNA, 20 bp, Artificial
  CRISPR gRNA sequence
gcccaagaagaaaatccata

SEQ ID NO: 430162 - DNA, 20 bp, Artificial
  CRISPR gRNA sequence
cccaagaagaaaatccataa

SEQ ID NO: 430163 - DNA, 20 bp, Artificial
  CRISPR gRNA sequence
cactacattcctcataagaa

SEQ ID NO: 430164 - DNA, 20 bp, Artificial
  CRISPR gRNA sequence
actacattcctcataagaaa

SEQ ID NO: 430165 - DNA, 20 bp, Artificial
  CRISPR gRNA sequence
cattcctcataagaaactgt

SEQ ID NO: 430166 - DNA, 20 bp, Artificial
  CRISPR gRNA sequence
ctcataagaaactgtgatga

SEQ ID NO: 430167 - DNA, 20 bp, Artificial
  CRISPR gRNA sequence
ataagaaactgtgatgatcc

SEQ ID NO: 430168 - DNA, 20 bp, Artificial
  CRISPR gRNA sequence
tgatgatccccaaaacatcc

SEQ ID NO: 430169 - DNA, 20 bp, Artificial
  CRISPR gRNA sequence
gtgatgatcccaaaaacatc

SEQ ID NO: 430170 - DNA, 20 bp, Artificial
  CRISPR gRNA sequence
tgatgatcccaaaaacatcc

SEQ ID NO: 430171 - DNA, 20 bp, Artificial
  CRISPR gRNA sequence
gtgatggtcccactcacctt

SEQ ID NO: 430172 - DNA, 20 bp, Artificial
  CRISPR gRNA sequence
tgatggtcccactcaccttt

SEQ ID NO: 430173 - DNA, 20 bp, Artificial
  CRISPR gRNA sequence
acctttccagcttacatgct

SEQ ID NO: 430174 - DNA, 20 bp, Artificial
  CRISPR gRNA sequence
tccagcttacatgctaggaa

SEQ ID NO: 430175 - DNA, 20 bp, Artificial
  CRISPR gRNA sequence
ccagcttacatgctaggaaa

SEQ ID NO: 430176 - DNA, 20 bp, Artificial
  CRISPR gRNA sequence
cagcttacatgctaggaaaa

SEQ ID NO: 430177 - DNA, 20 bp, Artificial
  CRISPR gRNA sequence
acatgctaggaaaaatgcta

SEQ ID NO: 430178 - DNA, 20 bp, Artificial
  CRISPR gRNA sequence
catgctaggaaaaatgctaa

SEQ ID NO: 430179 - DNA, 20 bp, Artificial
  CRISPR gRNA sequence
ggaaaaatgctaagtgcctt

SEQ ID NO: 430180 - DNA, 20 bp, Artificial
  CRISPR gRNA sequence
agtgccttacattaattatt

SEQ ID NO: 430181 - DNA, 20 bp, Artificial
  CRISPR gRNA sequence
acattaattattatttgact

SEQ ID NO: 430182 - DNA, 20 bp, Artificial
  CRISPR gRNA sequence
cattaattattatttgactg

SEQ ID NO: 430183 - DNA, 20 bp, Artificial
  CRISPR gRNA sequence
attattatttgactgaagtt

SEQ ID NO: 430184 - DNA, 20 bp, Artificial
  CRISPR gRNA sequence
ttatttgactgaagttttct

SEQ ID NO: 430185 - DNA, 20 bp, Artificial
  CRISPR gRNA sequence
tttgactgaagttttctcat

SEQ ID NO: 430186 - DNA, 20 bp, Artificial
  CRISPR gRNA sequence
gactgaagttttctcatgac

SEQ ID NO: 430187 - DNA, 20 bp, Artificial
  CRISPR gRNA sequence
actgaagttttctcatgacc

SEQ ID NO: 430188 - DNA, 20 bp, Artificial
  CRISPR gRNA sequence
aagttttctcatgaccttat

SEQ ID NO: 430189 - DNA, 20 bp, Artificial
  CRISPR gRNA sequence
tctcatgaccttatgaaggc

SEQ ID NO: 430190 - DNA, 20 bp, Artificial
  CRISPR gRNA sequence
ctcatgaccttatgaaggca

SEQ ID NO: 430191 - DNA, 20 bp, Artificial
  CRISPR gRNA sequence
tcatgaccttatgaaggcaa

SEQ ID NO: 430192 - DNA, 20 bp, Artificial
  CRISPR gRNA sequence
atgaccttatgaaggcaatg

SEQ ID NO: 430193 - DNA, 20 bp, Artificial
  CRISPR gRNA sequence
atgaaggcaatgccataatt

SEQ ID NO: 430194 - DNA, 20 bp, Artificial
  CRISPR gRNA sequence
tgaaggcaatgccataatta

SEQ ID NO: 430195 - DNA, 20 bp, Artificial
  CRISPR gRNA sequence
tcggcattttacagatgaga

SEQ ID NO: 430196 - DNA, 20 bp, Artificial
  CRISPR gRNA sequence
tacagatgagaaaactgagg

SEQ ID NO: 430197 - DNA, 20 bp, Artificial
  CRISPR gRNA sequence
acagatgagaaaactgaggt

SEQ ID NO: 430198 - DNA, 20 bp, Artificial
  CRISPR gRNA sequence
cagatgagaaaactgaggtt

SEQ ID NO: 430199 - DNA, 20 bp, Artificial
  CRISPR gRNA sequence
aggttcatcaaagttaggtg

SEQ ID NO: 430200 - DNA, 20 bp, Artificial
  CRISPR gRNA sequence
atcaaagttaggtggtacag

SEQ ID NO: 430201 - DNA, 20 bp, Artificial
  CRISPR gRNA sequence
ggtggtacagctactcaagt

SEQ ID NO: 430202 - DNA, 20 bp, Artificial
  CRISPR gRNA sequence
ctcaagtggttgagttggga

SEQ ID NO: 430203 - DNA, 20 bp, Artificial
  CRISPR gRNA sequence
aagtggttgagttgggaccc

SEQ ID NO: 430204 - DNA, 20 bp, Artificial
  CRISPR gRNA sequence
agttgggacccaaacctagg

SEQ ID NO: 430205 - DNA, 20 bp, Artificial
  CRISPR gRNA sequence
ggacccaaacctaggactgt

SEQ ID NO: 430206 - DNA, 20 bp, Artificial
  CRISPR gRNA sequence
ggactgtctgattccaaaga

SEQ ID NO: 430207 - DNA, 20 bp, Artificial
  CRISPR gRNA sequence
tctgattccaaagaacatgc

SEQ ID NO: 430208 - DNA, 20 bp, Artificial
  CRISPR gRNA sequence
attccaaagaacatgctcct

SEQ ID NO: 430209 - DNA, 20 bp, Artificial
  CRISPR gRNA sequence
caaagaacatgctcctaaat

SEQ ID NO: 430210 - DNA, 20 bp, Artificial
  CRISPR gRNA sequence
ctaaataacacagtctatgg

SEQ ID NO: 430211 - DNA, 20 bp, Artificial
  CRISPR gRNA sequence
aataacacagtctatgggct

SEQ ID NO: 430212 - DNA, 20 bp, Artificial
  CRISPR gRNA sequence
tgggctctcaaggtctgtag

SEQ ID NO: 430213 - DNA, 20 bp, Artificial
  CRISPR gRNA sequence
tcaaggtctgtagtgaatgc

SEQ ID NO: 430214 - DNA, 20 bp, Artificial
  CRISPR gRNA sequence
aaggtctgtagtgaatgctg

SEQ ID NO: 430215 - DNA, 20 bp, Artificial
  CRISPR gRNA sequence
tagtgaatgctgttgtgcct

SEQ ID NO: 430216 - DNA, 20 bp, Artificial
  CRISPR gRNA sequence
ttgtgcctgtcatagctaat

SEQ ID NO: 430217 - DNA, 20 bp, Artificial
  CRISPR gRNA sequence
tgcctgtcatagctaatttt

SEQ ID NO: 430218 - DNA, 20 bp, Artificial
  CRISPR gRNA sequence
tcatagctaattttaggtat

SEQ ID NO: 430219 - DNA, 20 bp, Artificial
  CRISPR gRNA sequence
attttaggtatcatcttaac

SEQ ID NO: 430220 - DNA, 20 bp, Artificial
  CRISPR gRNA sequence
taggtatcatcttaactgga

SEQ ID NO: 430221 - DNA, 20 bp, Artificial
  CRISPR gRNA sequence
aggtatcatcttaactggat

SEQ ID NO: 430222 - DNA, 20 bp, Artificial
  CRISPR gRNA sequence
ggtatcatcttaactggatt

SEQ ID NO: 430223 - DNA, 20 bp, Artificial
  CRISPR gRNA sequence
aactggattaagggagctga

SEQ ID NO: 430224 - DNA, 20 bp, Artificial
  CRISPR gRNA sequence
actggattaagggagctgag

SEQ ID NO: 430225 - DNA, 20 bp, Artificial
  CRISPR gRNA sequence
gattaagggagctgagagag

SEQ ID NO: 430226 - DNA, 20 bp, Artificial
  CRISPR gRNA sequence
agggagctgagagagctagt

SEQ ID NO: 430227 - DNA, 20 bp, Artificial
  CRISPR gRNA sequence
agagagctagtaaagcccat

SEQ ID NO: 430228 - DNA, 20 bp, Artificial
  CRISPR gRNA sequence
gtaaagcccattttgggtgt

SEQ ID NO: 430229 - DNA, 20 bp, Artificial
  CRISPR gRNA sequence
tgggtgtgtctgtgagggtg

SEQ ID NO: 430230 - DNA, 20 bp, Artificial
  CRISPR gRNA sequence
gggtgtgtctgtgagggtgt

SEQ ID NO: 430231 - DNA, 20 bp, Artificial
  CRISPR gRNA sequence
ggtgtgtctgtgagggtgtt

SEQ ID NO: 430232 - DNA, 20 bp, Artificial
  CRISPR gRNA sequence
tgagggtgtttccaaaggag

SEQ ID NO: 430233 - DNA, 20 bp, Artificial
  CRISPR gRNA sequence
ccaaaggagattggcatgtc

SEQ ID NO: 430234 - DNA, 20 bp, Artificial
  CRISPR gRNA sequence
caaaggagattggcatgtca

SEQ ID NO: 430235 - DNA, 20 bp, Artificial
  CRISPR gRNA sequence
gcatgtcagtctgagtgaag

SEQ ID NO: 430236 - DNA, 20 bp, Artificial
  CRISPR gRNA sequence
agtgaagtgagtaggtaaga

SEQ ID NO: 430237 - DNA, 20 bp, Artificial
  CRISPR gRNA sequence
taaatgtagccaagcaccat

SEQ ID NO: 430238 - DNA, 20 bp, Artificial
  CRISPR gRNA sequence
aatgtagccaagcaccatcc

SEQ ID NO: 430239 - DNA, 20 bp, Artificial
  CRISPR gRNA sequence
acctggaggcctgcctttcc

SEQ ID NO: 430240 - DNA, 20 bp, Artificial
  CRISPR gRNA sequence
gaggcctgcctttcccaaaa

SEQ ID NO: 430241 - DNA, 20 bp, Artificial
  CRISPR gRNA sequence
cctttcccaaaacagaagag

SEQ ID NO: 430242 - DNA, 20 bp, Artificial
  CRISPR gRNA sequence
tcccaaaacagaagagaggc

SEQ ID NO: 430243 - DNA, 20 bp, Artificial
  CRISPR gRNA sequence
cccaaaacagaagagaggca

SEQ ID NO: 430244 - DNA, 20 bp, Artificial
  CRISPR gRNA sequence
ccaaaacagaagagaggcaa

SEQ ID NO: 430245 - DNA, 20 bp, Artificial
  CRISPR gRNA sequence
tactttctctctttggagtt

SEQ ID NO: 430246 - DNA, 20 bp, Artificial
  CRISPR gRNA sequence
tctctctttggagttgggac

SEQ ID NO: 430247 - DNA, 20 bp, Artificial
  CRISPR gRNA sequence
ctctctttggagttgggaca

SEQ ID NO: 430248 - DNA, 20 bp, Artificial
  CRISPR gRNA sequence
tctctttggagttgggacac

SEQ ID NO: 430249 - DNA, 20 bp, Artificial
  CRISPR gRNA sequence
tctttggagttgggacacac

SEQ ID NO: 430250 - DNA, 20 bp, Artificial
  CRISPR gRNA sequence
tttggagttgggacacactc

SEQ ID NO: 430251 - DNA, 20 bp, Artificial
  CRISPR gRNA sequence
tggagttgggacacactctt

SEQ ID NO: 430252 - DNA, 20 bp, Artificial
  CRISPR gRNA sequence
ggagttgggacacactcttc

SEQ ID NO: 430253 - DNA, 20 bp, Artificial
  CRISPR gRNA sequence
gagttgggacacactcttct

SEQ ID NO: 430254 - DNA, 20 bp, Artificial
  CRISPR gRNA sequence
ggacacactcttctcatcct

SEQ ID NO: 430255 - DNA, 20 bp, Artificial
  CRISPR gRNA sequence
ttctcatcctgtccttggac

SEQ ID NO: 430256 - DNA, 20 bp, Artificial
  CRISPR gRNA sequence
ctcatcctgtccttggacat

SEQ ID NO: 430257 - DNA, 20 bp, Artificial
  CRISPR gRNA sequence
tcatcctgtccttggacatc

SEQ ID NO: 430258 - DNA, 20 bp, Artificial
  CRISPR gRNA sequence
atcctgtccttggacatcag

SEQ ID NO: 430259 - DNA, 20 bp, Artificial
  CRISPR gRNA sequence
tccttggacatcaggacacc

SEQ ID NO: 430260 - DNA, 20 bp, Artificial
  CRISPR gRNA sequence
ggacatcaggacaccaggct

SEQ ID NO: 430261 - DNA, 20 bp, Artificial
  CRISPR gRNA sequence
gacatcaggacaccaggctc

SEQ ID NO: 430262 - DNA, 20 bp, Artificial
  CRISPR gRNA sequence
cctggctttcggactccagg

SEQ ID NO: 430263 - DNA, 20 bp, Artificial
  CRISPR gRNA sequence
gctttcggactccaggactt

SEQ ID NO: 430264 - DNA, 20 bp, Artificial
  CRISPR gRNA sequence
tcggactccaggacttaaac

SEQ ID NO: 430265 - DNA, 20 bp, Artificial
  CRISPR gRNA sequence
cggactccaggacttaaacc

SEQ ID NO: 430266 - DNA, 20 bp, Artificial
  CRISPR gRNA sequence
ggactccaggacttaaacca

SEQ ID NO: 430267 - DNA, 20 bp, Artificial
  CRISPR gRNA sequence
caggacttaaaccagtgctc

SEQ ID NO: 430268 - DNA, 20 bp, Artificial
  CRISPR gRNA sequence
aaaccagtgctcctgaccct

SEQ ID NO: 430269 - DNA, 20 bp, Artificial
  CRISPR gRNA sequence
aaccagtgctcctgaccctg

SEQ ID NO: 430270 - DNA, 20 bp, Artificial
  CRISPR gRNA sequence
ctgaccctgggttttcaggc

SEQ ID NO: 430271 - DNA, 20 bp, Artificial
  CRISPR gRNA sequence
accctgggttttcaggccct

SEQ ID NO: 430272 - DNA, 20 bp, Artificial
  CRISPR gRNA sequence
ggttttcaggcccttagcct

SEQ ID NO: 430273 - DNA, 20 bp, Artificial
  CRISPR gRNA sequence
tcaggcccttagccttggac

SEQ ID NO: 430274 - DNA, 20 bp, Artificial
  CRISPR gRNA sequence
caggcccttagccttggact

SEQ ID NO: 430275 - DNA, 20 bp, Artificial
  CRISPR gRNA sequence
aggcccttagccttggactg

SEQ ID NO: 430276 - DNA, 20 bp, Artificial
  CRISPR gRNA sequence
agccttggactgagaattac

SEQ ID NO: 430277 - DNA, 20 bp, Artificial
  CRISPR gRNA sequence
gccttggactgagaattaca

SEQ ID NO: 430278 - DNA, 20 bp, Artificial
  CRISPR gRNA sequence
ggactgagaattacaccaac

SEQ ID NO: 430279 - DNA, 20 bp, Artificial
  CRISPR gRNA sequence
gactgagaattacaccaaca

SEQ ID NO: 430280 - DNA, 20 bp, Artificial
  CRISPR gRNA sequence
agaattacaccaacagcctc

SEQ ID NO: 430281 - DNA, 20 bp, Artificial
  CRISPR gRNA sequence
caccaacagcctcagtggtt

SEQ ID NO: 430282 - DNA, 20 bp, Artificial
  CRISPR gRNA sequence
agtggttctgaggctgttgg

SEQ ID NO: 430283 - DNA, 20 bp, Artificial
  CRISPR gRNA sequence
tgaggctgttggacttgaac

SEQ ID NO: 430284 - DNA, 20 bp, Artificial
  CRISPR gRNA sequence
aggctgttggacttgaactg

SEQ ID NO: 430285 - DNA, 20 bp, Artificial
  CRISPR gRNA sequence
ttggacttgaactgagccat

SEQ ID NO: 430286 - DNA, 20 bp, Artificial
  CRISPR gRNA sequence
gacttgaactgagccatgct

SEQ ID NO: 430287 - DNA, 20 bp, Artificial
  CRISPR gRNA sequence
gaactgagccatgctaccag

SEQ ID NO: 430288 - DNA, 20 bp, Artificial
  CRISPR gRNA sequence
aactgagccatgctaccagc

SEQ ID NO: 430289 - DNA, 20 bp, Artificial
  CRISPR gRNA sequence
agccatgctaccagcatccc

SEQ ID NO: 430290 - DNA, 20 bp, Artificial
  CRISPR gRNA sequence
ccagcatcccaaggtctcca

SEQ ID NO: 430291 - DNA, 20 bp, Artificial
  CRISPR gRNA sequence
cagcttgcagacagcctgtg

SEQ ID NO: 430292 - DNA, 20 bp, Artificial
  CRISPR gRNA sequence
gcagacagcctgtggtgaga

SEQ ID NO: 430293 - DNA, 20 bp, Artificial
  CRISPR gRNA sequence
cagacagcctgtggtgagac

SEQ ID NO: 430294 - DNA, 20 bp, Artificial
  CRISPR gRNA sequence
tggtgagacttctcagcctt

SEQ ID NO: 430295 - DNA, 20 bp, Artificial
  CRISPR gRNA sequence
ctcagcctttacaatcacct

SEQ ID NO: 430296 - DNA, 20 bp, Artificial
  CRISPR gRNA sequence
tcagcctttacaatcacctg

SEQ ID NO: 430297 - DNA, 20 bp, Artificial
  CRISPR gRNA sequence
agcctttacaatcacctgaa

SEQ ID NO: 430298 - DNA, 20 bp, Artificial
  CRISPR gRNA sequence
tacaatcacctgaacaaatt

SEQ ID NO: 430299 - DNA, 20 bp, Artificial
  CRISPR gRNA sequence
acaatcacctgaacaaattc

SEQ ID NO: 430300 - DNA, 20 bp, Artificial
  CRISPR gRNA sequence
caatcacctgaacaaattcc

SEQ ID NO: 430301 - DNA, 20 bp, Artificial
  CRISPR gRNA sequence
aacaaattcccctaacaaat

SEQ ID NO: 430302 - DNA, 20 bp, Artificial
  CRISPR gRNA sequence
ccctaacaaatccctcctca

SEQ ID NO: 430303 - DNA, 20 bp, Artificial
  CRISPR gRNA sequence
acaaatccctcctcatctat

SEQ ID NO: 430304 - DNA, 20 bp, Artificial
  CRISPR gRNA sequence
ctcatctatctatctatcta

SEQ ID NO: 430305 - DNA, 20 bp, Artificial
  CRISPR gRNA sequence
atctatctatctatctatct

SEQ ID NO: 430306 - DNA, 20 bp, Artificial
  CRISPR gRNA sequence
tctatctatctatctatcta

SEQ ID NO: 430307 - DNA, 20 bp, Artificial
  CRISPR gRNA sequence
tctatctatctatctatcta

SEQ ID NO: 430308 - DNA, 20 bp, Artificial
  CRISPR gRNA sequence
tctatctatctatctatcta

SEQ ID NO: 430309 - DNA, 20 bp, Artificial
  CRISPR gRNA sequence
tctatctatctatctatcta

SEQ ID NO: 430310 - DNA, 20 bp, Artificial
  CRISPR gRNA sequence
tctatctatctatctatcta

SEQ ID NO: 430311 - DNA, 20 bp, Artificial
  CRISPR gRNA sequence
tctatctatctatctatcca

SEQ ID NO: 430312 - DNA, 20 bp, Artificial
  CRISPR gRNA sequence
tctatctatctatccatcca

SEQ ID NO: 430313 - DNA, 20 bp, Artificial
  CRISPR gRNA sequence
tctatctatccatccatcca

SEQ ID NO: 430314 - DNA, 20 bp, Artificial
  CRISPR gRNA sequence
tctatccatccatccatcca

SEQ ID NO: 430315 - DNA, 20 bp, Artificial
  CRISPR gRNA sequence
tccatccatccatccaccca

SEQ ID NO: 430316 - DNA, 20 bp, Artificial
  CRISPR gRNA sequence
tatctcctattggttctgtc

SEQ ID NO: 430317 - DNA, 20 bp, Artificial
  CRISPR gRNA sequence
ctattggttctgtccctccg

SEQ ID NO: 430318 - DNA, 20 bp, Artificial
  CRISPR gRNA sequence
ttggttctgtccctccggag

SEQ ID NO: 430319 - DNA, 20 bp, Artificial
  CRISPR gRNA sequence
gttctgtccctccggagacc

SEQ ID NO: 430320 - DNA, 20 bp, Artificial
  CRISPR gRNA sequence
tgtccctccggagacccata

SEQ ID NO: 430321 - DNA, 20 bp, Artificial
  CRISPR gRNA sequence
tccctccggagacccataac

SEQ ID NO: 430322 - DNA, 20 bp, Artificial
  CRISPR gRNA sequence
cggagacccataactaatgt

SEQ ID NO: 430323 - DNA, 20 bp, Artificial
  CRISPR gRNA sequence
atgtacagttcctgctcaga

SEQ ID NO: 430324 - DNA, 20 bp, Artificial
  CRISPR gRNA sequence
ctgctcagatctctctacct

SEQ ID NO: 430325 - DNA, 20 bp, Artificial
  CRISPR gRNA sequence
ctcagatctctctacctgac

SEQ ID NO: 430326 - DNA, 20 bp, Artificial
  CRISPR gRNA sequence
agatctctctacctgaccag

SEQ ID NO: 430327 - DNA, 20 bp, Artificial
  CRISPR gRNA sequence
tctacctgaccagcactccc

SEQ ID NO: 430328 - DNA, 20 bp, Artificial
  CRISPR gRNA sequence
tacctgaccagcactcccat

SEQ ID NO: 430329 - DNA, 20 bp, Artificial
  CRISPR gRNA sequence
cctgaccagcactcccattt

SEQ ID NO: 430330 - DNA, 20 bp, Artificial
  CRISPR gRNA sequence
accagcactcccattttcca

SEQ ID NO: 430331 - DNA, 20 bp, Artificial
  CRISPR gRNA sequence
ccattttccagatgctggga

SEQ ID NO: 430332 - DNA, 20 bp, Artificial
  CRISPR gRNA sequence
tccagatgctgggagtgtac

SEQ ID NO: 430333 - DNA, 20 bp, Artificial
  CRISPR gRNA sequence
ccagatgctgggagtgtacg

SEQ ID NO: 430334 - DNA, 20 bp, Artificial
  CRISPR gRNA sequence
cagatgctgggagtgtacgc

SEQ ID NO: 430335 - DNA, 20 bp, Artificial
  CRISPR gRNA sequence
ggagtgtacgctgtgagctc

SEQ ID NO: 430336 - DNA, 20 bp, Artificial
  CRISPR gRNA sequence
tgagctcacagcagcccctt

SEQ ID NO: 430337 - DNA, 20 bp, Artificial
  CRISPR gRNA sequence
acagcagccccttctctgga

SEQ ID NO: 430338 - DNA, 20 bp, Artificial
  CRISPR gRNA sequence
ctctggagaattgctcttgg

SEQ ID NO: 430339 - DNA, 20 bp, Artificial
  CRISPR gRNA sequence
tctggagaattgctcttggg

SEQ ID NO: 430340 - DNA, 20 bp, Artificial
  CRISPR gRNA sequence
tggagaattgctcttgggcc

SEQ ID NO: 430341 - DNA, 20 bp, Artificial
  CRISPR gRNA sequence
gagaattgctcttgggccct

SEQ ID NO: 430342 - DNA, 20 bp, Artificial
  CRISPR gRNA sequence
ctcttgggccctcgctggtg

SEQ ID NO: 430343 - DNA, 20 bp, Artificial
  CRISPR gRNA sequence
ttgggccctcgctggtgagc

SEQ ID NO: 430344 - DNA, 20 bp, Artificial
  CRISPR gRNA sequence
gggccctcgctggtgagcag

SEQ ID NO: 430345 - DNA, 20 bp, Artificial
  CRISPR gRNA sequence
ggccctcgctggtgagcagc

SEQ ID NO: 430346 - DNA, 20 bp, Artificial
  CRISPR gRNA sequence
gctggtgagcagccagaagt

SEQ ID NO: 430347 - DNA, 20 bp, Artificial
  CRISPR gRNA sequence
gtgagcagccagaagtaatg

SEQ ID NO: 430348 - DNA, 20 bp, Artificial
  CRISPR gRNA sequence
acctaggtggatttccaaaa

SEQ ID NO: 430349 - DNA, 20 bp, Artificial
  CRISPR gRNA sequence
ggtggatttccaaaatgcca

SEQ ID NO: 430350 - DNA, 20 bp, Artificial
  CRISPR gRNA sequence
ccaaaatgccagctccctgc

SEQ ID NO: 430351 - DNA, 20 bp, Artificial
  CRISPR gRNA sequence
caaaatgccagctccctgcc

SEQ ID NO: 430352 - DNA, 20 bp, Artificial
  CRISPR gRNA sequence
cctgcctaaaggttcaaccg

SEQ ID NO: 430353 - DNA, 20 bp, Artificial
  CRISPR gRNA sequence
cctaaaggttcaaccgactc

SEQ ID NO: 430354 - DNA, 20 bp, Artificial
  CRISPR gRNA sequence
aaggttcaaccgactctgta

SEQ ID NO: 430355 - DNA, 20 bp, Artificial
  CRISPR gRNA sequence
aaccgactctgtacaattct

SEQ ID NO: 430356 - DNA, 20 bp, Artificial
  CRISPR gRNA sequence
tgtacaattcttgcttcagc

SEQ ID NO: 430357 - DNA, 20 bp, Artificial
  CRISPR gRNA sequence
tacaattcttgcttcagcca

SEQ ID NO: 430358 - DNA, 20 bp, Artificial
  CRISPR gRNA sequence
ttgcttcagccaagtctcca

SEQ ID NO: 430359 - DNA, 20 bp, Artificial
  CRISPR gRNA sequence
gcttcagccaagtctccagc

SEQ ID NO: 430360 - DNA, 20 bp, Artificial
  CRISPR gRNA sequence
cttcagccaagtctccagct

SEQ ID NO: 430361 - DNA, 20 bp, Artificial
  CRISPR gRNA sequence
cagccaagtctccagctgag

SEQ ID NO: 430362 - DNA, 20 bp, Artificial
  CRISPR gRNA sequence
agccaagtctccagctgaga

SEQ ID NO: 430363 - DNA, 20 bp, Artificial
  CRISPR gRNA sequence
cagctgagaccatatccatg

SEQ ID NO: 430364 - DNA, 20 bp, Artificial
  CRISPR gRNA sequence
agaccatatccatgctgagc

SEQ ID NO: 430365 - DNA, 20 bp, Artificial
  CRISPR gRNA sequence
agctttcttcccttagccct

SEQ ID NO: 430366 - DNA, 20 bp, Artificial
  CRISPR gRNA sequence
tcttcccttagccctcccta

SEQ ID NO: 430367 - DNA, 20 bp, Artificial
  CRISPR gRNA sequence
cttcccttagccctccctat

SEQ ID NO: 430368 - DNA, 20 bp, Artificial
  CRISPR gRNA sequence
ttcccttagccctccctata

SEQ ID NO: 430369 - DNA, 20 bp, Artificial
  CRISPR gRNA sequence
cccttagccctccctatact

SEQ ID NO: 430370 - DNA, 20 bp, Artificial
  CRISPR gRNA sequence
ccttagccctccctatactg

SEQ ID NO: 430371 - DNA, 20 bp, Artificial
  CRISPR gRNA sequence
agccctccctatactgcttc

SEQ ID NO: 430372 - DNA, 20 bp, Artificial
  CRISPR gRNA sequence
gccctccctatactgcttcc

SEQ ID NO: 430373 - DNA, 20 bp, Artificial
  CRISPR gRNA sequence
cctatactgcttccttcact

SEQ ID NO: 430374 - DNA, 20 bp, Artificial
  CRISPR gRNA sequence
tactgcttccttcactactt

SEQ ID NO: 430375 - DNA, 20 bp, Artificial
  CRISPR gRNA sequence
cttccttcactacttttcat

SEQ ID NO: 430376 - DNA, 20 bp, Artificial
  CRISPR gRNA sequence
ccttcactacttttcatctg

SEQ ID NO: 430377 - DNA, 20 bp, Artificial
  CRISPR gRNA sequence
cttcactacttttcatctga

SEQ ID NO: 430378 - DNA, 20 bp, Artificial
  CRISPR gRNA sequence
cactacttttcatctgagag

SEQ ID NO: 430379 - DNA, 20 bp, Artificial
  CRISPR gRNA sequence
actacttttcatctgagagc

SEQ ID NO: 430380 - DNA, 20 bp, Artificial
  CRISPR gRNA sequence
cttttcatctgagagctgtc

SEQ ID NO: 430381 - DNA, 20 bp, Artificial
  CRISPR gRNA sequence
ttcatctgagagctgtccca

SEQ ID NO: 430382 - DNA, 20 bp, Artificial
  CRISPR gRNA sequence
tcatctgagagctgtcccaa

SEQ ID NO: 430383 - DNA, 20 bp, Artificial
  CRISPR gRNA sequence
catctgagagctgtcccaat

SEQ ID NO: 430384 - DNA, 20 bp, Artificial
  CRISPR gRNA sequence
atctgagagctgtcccaata

SEQ ID NO: 430385 - DNA, 20 bp, Artificial
  CRISPR gRNA sequence
agagctgtcccaataagtca

SEQ ID NO: 430386 - DNA, 20 bp, Artificial
  CRISPR gRNA sequence
tcccaataagtcactctcac

SEQ ID NO: 430387 - DNA, 20 bp, Artificial
  CRISPR gRNA sequence
tcaccaaaatttgcatgtca

SEQ ID NO: 430388 - DNA, 20 bp, Artificial
  CRISPR gRNA sequence
accaaaatttgcatgtcagg

SEQ ID NO: 430389 - DNA, 20 bp, Artificial
  CRISPR gRNA sequence
gcatgtcaggctctatttcc

SEQ ID NO: 430390 - DNA, 20 bp, Artificial
  CRISPR gRNA sequence
catgtcaggctctatttccg

SEQ ID NO: 430391 - DNA, 20 bp, Artificial
  CRISPR gRNA sequence
tatttccggggacctgatct

SEQ ID NO: 430392 - DNA, 20 bp, Artificial
  CRISPR gRNA sequence
tttccggggacctgatctaa

SEQ ID NO: 430393 - DNA, 20 bp, Artificial
  CRISPR gRNA sequence
ccggggacctgatctaaaac

SEQ ID NO: 430394 - DNA, 20 bp, Artificial
  CRISPR gRNA sequence
cggggacctgatctaaaaca

SEQ ID NO: 430395 - DNA, 20 bp, Artificial
  CRISPR gRNA sequence
atctaaaacagttgctgctg

SEQ ID NO: 430396 - DNA, 20 bp, Artificial
  CRISPR gRNA sequence
aaacagttgctgctgggaat

SEQ ID NO: 430397 - DNA, 20 bp, Artificial
  CRISPR gRNA sequence
ctgctgggaatagtcctaga

SEQ ID NO: 430398 - DNA, 20 bp, Artificial
  CRISPR gRNA sequence
ctgggaatagtcctagaagg

SEQ ID NO: 430399 - DNA, 20 bp, Artificial
  CRISPR gRNA sequence
ggaatagtcctagaaggcag

SEQ ID NO: 430400 - DNA, 20 bp, Artificial
  CRISPR gRNA sequence
gaaggcagcctgtaagaaca

SEQ ID NO: 430401 - DNA, 20 bp, Artificial
  CRISPR gRNA sequence
taagaacaggattgtggaat

SEQ ID NO: 430402 - DNA, 20 bp, Artificial
  CRISPR gRNA sequence
tggaatgggatcattcacct

SEQ ID NO: 430403 - DNA, 20 bp, Artificial
  CRISPR gRNA sequence
acctgctagatggcaacaca

SEQ ID NO: 430404 - DNA, 20 bp, Artificial
  CRISPR gRNA sequence
ctagatggcaacacaaaccc

SEQ ID NO: 430405 - DNA, 20 bp, Artificial
  CRISPR gRNA sequence
gatggcaacacaaaccccat

SEQ ID NO: 430406 - DNA, 20 bp, Artificial
  CRISPR gRNA sequence
gtggtgaaatgagatgggac

SEQ ID NO: 430407 - DNA, 20 bp, Artificial
  CRISPR gRNA sequence
tgagctggtgcactgactct

SEQ ID NO: 430408 - DNA, 20 bp, Artificial
  CRISPR gRNA sequence
gtgcactgactctaacattt

SEQ ID NO: 430409 - DNA, 20 bp, Artificial
  CRISPR gRNA sequence
actctaacatttgaggtgta

SEQ ID NO: 430410 - DNA, 20 bp, Artificial
  CRISPR gRNA sequence
taacatttgaggtgtatagg

SEQ ID NO: 430411 - DNA, 20 bp, Artificial
  CRISPR gRNA sequence
acatttgaggtgtatagggt

SEQ ID NO: 430412 - DNA, 20 bp, Artificial
  CRISPR gRNA sequence
gaggtgtatagggtaaatag

SEQ ID NO: 430413 - DNA, 20 bp, Artificial
  CRISPR gRNA sequence
aggtgtatagggtaaatagt

SEQ ID NO: 430414 - DNA, 20 bp, Artificial
  CRISPR gRNA sequence
gtgttagaactctggaattg

SEQ ID NO: 430415 - DNA, 20 bp, Artificial
  CRISPR gRNA sequence
gaactctggaattgggtcaa

SEQ ID NO: 430416 - DNA, 20 bp, Artificial
  CRISPR gRNA sequence
tggaattgggtcaacagtat

SEQ ID NO: 430417 - DNA, 20 bp, Artificial
  CRISPR gRNA sequence
gaattgggtcaacagtatag

SEQ ID NO: 430418 - DNA, 20 bp, Artificial
  CRISPR gRNA sequence
ggtcaacagtatagggtaat

SEQ ID NO: 430419 - DNA, 20 bp, Artificial
  CRISPR gRNA sequence
atattaggactcaaaattga

SEQ ID NO: 430420 - DNA, 20 bp, Artificial
  CRISPR gRNA sequence
ggactcaaaattgacttttg

SEQ ID NO: 430421 - DNA, 20 bp, Artificial
  CRISPR gRNA sequence
aaaattgacttttgctaaat

SEQ ID NO: 430422 - DNA, 20 bp, Artificial
  CRISPR gRNA sequence
acttttgctaaattgcaccg

SEQ ID NO: 430423 - DNA, 20 bp, Artificial
  CRISPR gRNA sequence
ttgctaaattgcaccgatgg

SEQ ID NO: 430424 - DNA, 20 bp, Artificial
  CRISPR gRNA sequence
tgctaaattgcaccgatgga

SEQ ID NO: 430425 - DNA, 20 bp, Artificial
  CRISPR gRNA sequence
gctaaattgcaccgatggac

SEQ ID NO: 430426 - DNA, 20 bp, Artificial
  CRISPR gRNA sequence
ctaaattgcaccgatggact

SEQ ID NO: 430427 - DNA, 20 bp, Artificial
  CRISPR gRNA sequence
aattgcaccgatggactgaa

SEQ ID NO: 430428 - DNA, 20 bp, Artificial
  CRISPR gRNA sequence
caccgatggactgaagtgag

SEQ ID NO: 430429 - DNA, 20 bp, Artificial
  CRISPR gRNA sequence
aagtgagaaaatgacagcct

SEQ ID NO: 430430 - DNA, 20 bp, Artificial
  CRISPR gRNA sequence
agatctatcagcaactcaaa

SEQ ID NO: 430431 - DNA, 20 bp, Artificial
  CRISPR gRNA sequence
tcagcaactcaaagtgtgag

SEQ ID NO: 430432 - DNA, 20 bp, Artificial
  CRISPR gRNA sequence
aaagtgtgagagttaaagct

SEQ ID NO: 430433 - DNA, 20 bp, Artificial
  CRISPR gRNA sequence
aagctcctccttggcagcat

SEQ ID NO: 430434 - DNA, 20 bp, Artificial
  CRISPR gRNA sequence
ctccttggcagcatttaaaa

SEQ ID NO: 430435 - DNA, 20 bp, Artificial
  CRISPR gRNA sequence
cttggcagcatttaaaagac

SEQ ID NO: 430436 - DNA, 20 bp, Artificial
  CRISPR gRNA sequence
ggcagcatttaaaagacact

SEQ ID NO: 430437 - DNA, 20 bp, Artificial
  CRISPR gRNA sequence
gcagcatttaaaagacactc

SEQ ID NO: 430438 - DNA, 20 bp, Artificial
  CRISPR gRNA sequence
aaaagacactcgtctatcca

SEQ ID NO: 430439 - DNA, 20 bp, Artificial
  CRISPR gRNA sequence
aaagacactcgtctatccac

SEQ ID NO: 430440 - DNA, 20 bp, Artificial
  CRISPR gRNA sequence
gtctatccacagctgaagac

SEQ ID NO: 430441 - DNA, 20 bp, Artificial
  CRISPR gRNA sequence
tccacagctgaagaccaggt

SEQ ID NO: 430442 - DNA, 20 bp, Artificial
  CRISPR gRNA sequence
aagaccaggtacataagcta

SEQ ID NO: 430443 - DNA, 20 bp, Artificial
  CRISPR gRNA sequence
attgtaagagggacaggact

SEQ ID NO: 430444 - DNA, 20 bp, Artificial
  CRISPR gRNA sequence
taagagggacaggactttaa

SEQ ID NO: 430445 - DNA, 20 bp, Artificial
  CRISPR gRNA sequence
taaagaaggctgattctaag

SEQ ID NO: 430446 - DNA, 20 bp, Artificial
  CRISPR gRNA sequence
aaagaaggctgattctaagc

SEQ ID NO: 430447 - DNA, 20 bp, Artificial
  CRISPR gRNA sequence
aagaaggctgattctaagcc

SEQ ID NO: 430448 - DNA, 20 bp, Artificial
  CRISPR gRNA sequence
attctaagcctaggtaaatt

SEQ ID NO: 430449 - DNA, 20 bp, Artificial
  CRISPR gRNA sequence
taagcctaggtaaattttct

SEQ ID NO: 430450 - DNA, 20 bp, Artificial
  CRISPR gRNA sequence
agcctaggtaaattttctat

SEQ ID NO: 430451 - DNA, 20 bp, Artificial
  CRISPR gRNA sequence
ggtaaattttctatgccaaa

SEQ ID NO: 430452 - DNA, 20 bp, Artificial
  CRISPR gRNA sequence
tctatgccaaagctagcatc

SEQ ID NO: 430453 - DNA, 20 bp, Artificial
  CRISPR gRNA sequence
ctatgccaaagctagcatct

SEQ ID NO: 430454 - DNA, 20 bp, Artificial
  CRISPR gRNA sequence
tatgccaaagctagcatctt

SEQ ID NO: 430455 - DNA, 20 bp, Artificial
  CRISPR gRNA sequence
tgccaaagctagcatcttga

SEQ ID NO: 430456 - DNA, 20 bp, Artificial
  CRISPR gRNA sequence
gcatcttgatagtagaggag

SEQ ID NO: 430457 - DNA, 20 bp, Artificial
  CRISPR gRNA sequence
gatagtagaggaggagtctc

SEQ ID NO: 430458 - DNA, 20 bp, Artificial
  CRISPR gRNA sequence
atagtagaggaggagtctcc

SEQ ID NO: 430459 - DNA, 20 bp, Artificial
  CRISPR gRNA sequence
ctgaaacttggaatgaggat

SEQ ID NO: 430460 - DNA, 20 bp, Artificial
  CRISPR gRNA sequence
aaacttggaatgaggatctc

SEQ ID NO: 430461 - DNA, 20 bp, Artificial
  CRISPR gRNA sequence
ggaatgaggatctctggaaa

SEQ ID NO: 430462 - DNA, 20 bp, Artificial
  CRISPR gRNA sequence
gaatgaggatctctggaaag

SEQ ID NO: 430463 - DNA, 20 bp, Artificial
  CRISPR gRNA sequence
tggaaagatgcatttgagag

SEQ ID NO: 430464 - DNA, 20 bp, Artificial
  CRISPR gRNA sequence
gaaagatgcatttgagagcc

SEQ ID NO: 430465 - DNA, 20 bp, Artificial
  CRISPR gRNA sequence
gagagccaggaaccacctgc

SEQ ID NO: 430466 - DNA, 20 bp, Artificial
  CRISPR gRNA sequence
agagccaggaaccacctgct

SEQ ID NO: 430467 - DNA, 20 bp, Artificial
  CRISPR gRNA sequence
cttctcttataccatctgga

SEQ ID NO: 430468 - DNA, 20 bp, Artificial
  CRISPR gRNA sequence
ctcttataccatctggagct

SEQ ID NO: 430469 - DNA, 20 bp, Artificial
  CRISPR gRNA sequence
tcttataccatctggagctg

SEQ ID NO: 430470 - DNA, 20 bp, Artificial
  CRISPR gRNA sequence
ttataccatctggagctgca

SEQ ID NO: 430471 - DNA, 20 bp, Artificial
  CRISPR gRNA sequence
ataccatctggagctgcaga

SEQ ID NO: 430472 - DNA, 20 bp, Artificial
  CRISPR gRNA sequence
taccatctggagctgcagaa

SEQ ID NO: 430473 - DNA, 20 bp, Artificial
  CRISPR gRNA sequence
gagctgcagaagtggcccac

SEQ ID NO: 430474 - DNA, 20 bp, Artificial
  CRISPR gRNA sequence
cagaagtggcccacttcccc

SEQ ID NO: 430475 - DNA, 20 bp, Artificial
  CRISPR gRNA sequence
ccccttgatggaaaagaatc

SEQ ID NO: 430476 - DNA, 20 bp, Artificial
  CRISPR gRNA sequence
cccttgatggaaaagaatcc

SEQ ID NO: 430477 - DNA, 20 bp, Artificial
  CRISPR gRNA sequence
gatggaaaagaatccctgct

SEQ ID NO: 430478 - DNA, 20 bp, Artificial
  CRISPR gRNA sequence
atggaaaagaatccctgctg

SEQ ID NO: 430479 - DNA, 20 bp, Artificial
  CRISPR gRNA sequence
ctgggccctgcctctgcctc

SEQ ID NO: 430480 - DNA, 20 bp, Artificial
  CRISPR gRNA sequence
ggccctgcctctgcctcccc

SEQ ID NO: 430481 - DNA, 20 bp, Artificial
  CRISPR gRNA sequence
cctctgcctcccctactgtc

SEQ ID NO: 430482 - DNA, 20 bp, Artificial
  CRISPR gRNA sequence
tgcctcccctactgtccatc

SEQ ID NO: 430483 - DNA, 20 bp, Artificial
  CRISPR gRNA sequence
cctcccctactgtccatcag

SEQ ID NO: 430484 - DNA, 20 bp, Artificial
  CRISPR gRNA sequence
ccctactgtccatcaggccc

SEQ ID NO: 430485 - DNA, 20 bp, Artificial
  CRISPR gRNA sequence
ctgtccatcaggcccgtaat

SEQ ID NO: 430486 - DNA, 20 bp, Artificial
  CRISPR gRNA sequence
tccatcaggcccgtaattag

SEQ ID NO: 430487 - DNA, 20 bp, Artificial
  CRISPR gRNA sequence
ggataaaatctcagcccatg

SEQ ID NO: 430488 - DNA, 20 bp, Artificial
  CRISPR gRNA sequence
agcccatgctaatggaggaa

SEQ ID NO: 430489 - DNA, 20 bp, Artificial
  CRISPR gRNA sequence
atggaggaagtgctgggtct

SEQ ID NO: 430490 - DNA, 20 bp, Artificial
  CRISPR gRNA sequence
ggtctgctaagagaatagaa

SEQ ID NO: 430491 - DNA, 20 bp, Artificial
  CRISPR gRNA sequence
ctaagagaatagaaaggtta

SEQ ID NO: 430492 - DNA, 20 bp, Artificial
  CRISPR gRNA sequence
agagaatagaaaggttatat

SEQ ID NO: 430493 - DNA, 20 bp, Artificial
  CRISPR gRNA sequence
tatactacaggacctggcta

SEQ ID NO: 430494 - DNA, 20 bp, Artificial
  CRISPR gRNA sequence
caggacctggctaacatcta

SEQ ID NO: 430495 - DNA, 20 bp, Artificial
  CRISPR gRNA sequence
gctaacatctactggcaggg

SEQ ID NO: 430496 - DNA, 20 bp, Artificial
  CRISPR gRNA sequence
acatctactggcagggactg

SEQ ID NO: 430497 - DNA, 20 bp, Artificial
  CRISPR gRNA sequence
ctggcagggactgggagaag

SEQ ID NO: 430498 - DNA, 20 bp, Artificial
  CRISPR gRNA sequence
gcagggactgggagaagatg

SEQ ID NO: 430499 - DNA, 20 bp, Artificial
  CRISPR gRNA sequence
ggagaagatgcctaggcatg

SEQ ID NO: 430500 - DNA, 20 bp, Artificial
  CRISPR gRNA sequence
ggcatgaattctgaaggtga

SEQ ID NO: 430501 - DNA, 20 bp, Artificial
  CRISPR gRNA sequence
tgaaggtgatggattgtggt

SEQ ID NO: 430502 - DNA, 20 bp, Artificial
  CRISPR gRNA sequence
aaggtgatggattgtggtag

SEQ ID NO: 430503 - DNA, 20 bp, Artificial
  CRISPR gRNA sequence
tggtagggggtagaacataa

SEQ ID NO: 430504 - DNA, 20 bp, Artificial
  CRISPR gRNA sequence
gatgagggataatgcgtcaa

SEQ ID NO: 430505 - DNA, 20 bp, Artificial
  CRISPR gRNA sequence
gaacgctcaatatttaacac

SEQ ID NO: 430506 - DNA, 20 bp, Artificial
  CRISPR gRNA sequence
aatatttaacaccctcacaa

SEQ ID NO: 430507 - DNA, 20 bp, Artificial
  CRISPR gRNA sequence
aacaccctcacaagggcccc

SEQ ID NO: 430508 - DNA, 20 bp, Artificial
  CRISPR gRNA sequence
acaccctcacaagggcccca

SEQ ID NO: 430509 - DNA, 20 bp, Artificial
  CRISPR gRNA sequence
acaagggccccaggagatga

SEQ ID NO: 430510 - DNA, 20 bp, Artificial
  CRISPR gRNA sequence
tgatatactgctgtcaatag

SEQ ID NO: 430511 - DNA, 20 bp, Artificial
  CRISPR gRNA sequence
atatactgctgtcaatagag

SEQ ID NO: 430512 - DNA, 20 bp, Artificial
  CRISPR gRNA sequence
ctgtcaatagagatgacaac

SEQ ID NO: 430513 - DNA, 20 bp, Artificial
  CRISPR gRNA sequence
tcaatagagatgacaacact

SEQ ID NO: 430514 - DNA, 20 bp, Artificial
  CRISPR gRNA sequence
ctttggcaaactatggaaaa

SEQ ID NO: 430515 - DNA, 20 bp, Artificial
  CRISPR gRNA sequence
tggcaaactatggaaaaggg

SEQ ID NO: 430516 - DNA, 20 bp, Artificial
  CRISPR gRNA sequence
ggcaaactatggaaaagggg

SEQ ID NO: 430517 - DNA, 20 bp, Artificial
  CRISPR gRNA sequence
gcaaactatggaaaagggga

SEQ ID NO: 430518 - DNA, 20 bp, Artificial
  CRISPR gRNA sequence
tggaaaaggggaacaaaatg

SEQ ID NO: 430519 - DNA, 20 bp, Artificial
  CRISPR gRNA sequence
agagaataaacctactaaat

SEQ ID NO: 430520 - DNA, 20 bp, Artificial
  CRISPR gRNA sequence
ctaaatcagaaatggcaaac

SEQ ID NO: 430521 - DNA, 20 bp, Artificial
  CRISPR gRNA sequence
aatcagaaatggcaaactga

SEQ ID NO: 430522 - DNA, 20 bp, Artificial
  CRISPR gRNA sequence
agttttgtgggtcaaatatg

SEQ ID NO: 430523 - DNA, 20 bp, Artificial
  CRISPR gRNA sequence
tgtgggtcaaatatggccca

SEQ ID NO: 430524 - DNA, 20 bp, Artificial
  CRISPR gRNA sequence
gtgggtcaaatatggcccac

SEQ ID NO: 430525 - DNA, 20 bp, Artificial
  CRISPR gRNA sequence
tgggtcaaatatggcccact

SEQ ID NO: 430526 - DNA, 20 bp, Artificial
  CRISPR gRNA sequence
ctggttttttacagcccttg

SEQ ID NO: 430527 - DNA, 20 bp, Artificial
  CRISPR gRNA sequence
gttttttacagcccttgaac

SEQ ID NO: 430528 - DNA, 20 bp, Artificial
  CRISPR gRNA sequence
tttacagcccttgaactaaa

SEQ ID NO: 430529 - DNA, 20 bp, Artificial
  CRISPR gRNA sequence
ttacagcccttgaactaaag

SEQ ID NO: 430530 - DNA, 20 bp, Artificial
  CRISPR gRNA sequence
tacagcccttgaactaaaga

SEQ ID NO: 430531 - DNA, 20 bp, Artificial
  CRISPR gRNA sequence
acagcccttgaactaaagat

SEQ ID NO: 430532 - DNA, 20 bp, Artificial
  CRISPR gRNA sequence
cagcccttgaactaaagatg

SEQ ID NO: 430533 - DNA, 20 bp, Artificial
  CRISPR gRNA sequence
gaactaaagatggcttttat

SEQ ID NO: 430534 - DNA, 20 bp, Artificial
  CRISPR gRNA sequence
aactaaagatggcttttata

SEQ ID NO: 430535 - DNA, 20 bp, Artificial
  CRISPR gRNA sequence
aagatggcttttatatttta

SEQ ID NO: 430536 - DNA, 20 bp, Artificial
  CRISPR gRNA sequence
ttatattttaagtgtttttt

SEQ ID NO: 430537 - DNA, 20 bp, Artificial
  CRISPR gRNA sequence
tatattttaagtgttttttt

SEQ ID NO: 430538 - DNA, 20 bp, Artificial
  CRISPR gRNA sequence
atattttaagtgttttttta

SEQ ID NO: 430539 - DNA, 20 bp, Artificial
  CRISPR gRNA sequence
tattttaagtgtttttttaa

SEQ ID NO: 430540 - DNA, 20 bp, Artificial
  CRISPR gRNA sequence
taagtgtttttttaaaacaa

SEQ ID NO: 430541 - DNA, 20 bp, Artificial
  CRISPR gRNA sequence
aagtgtttttttaaaacaaa

SEQ ID NO: 430542 - DNA, 20 bp, Artificial
  CRISPR gRNA sequence
agtgtttttttaaaacaaaa

SEQ ID NO: 430543 - DNA, 20 bp, Artificial
  CRISPR gRNA sequence
ttttaaaacaaaaatagttt

SEQ ID NO: 430544 - DNA, 20 bp, Artificial
  CRISPR gRNA sequence
tttaaaacaaaaatagtttt

SEQ ID NO: 430545 - DNA, 20 bp, Artificial
  CRISPR gRNA sequence
ttaaaacaaaaatagtttta

SEQ ID NO: 430546 - DNA, 20 bp, Artificial
  CRISPR gRNA sequence
taaaacaaaaatagttttaa

SEQ ID NO: 430547 - DNA, 20 bp, Artificial
  CRISPR gRNA sequence
aaaacaaaaatagttttaaa

SEQ ID NO: 430548 - DNA, 20 bp, Artificial
  CRISPR gRNA sequence
aaacaaaaatagttttaaaa

SEQ ID NO: 430549 - DNA, 20 bp, Artificial
  CRISPR gRNA sequence
taaaaagtaatatcttctgc

SEQ ID NO: 430550 - DNA, 20 bp, Artificial
  CRISPR gRNA sequence
aaaaagtaatatcttctgca

SEQ ID NO: 430551 - DNA, 20 bp, Artificial
  CRISPR gRNA sequence
aaaagtaatatcttctgcac

SEQ ID NO: 430552 - DNA, 20 bp, Artificial
  CRISPR gRNA sequence
ctgcacagcaaaagaaataa

SEQ ID NO: 430553 - DNA, 20 bp, Artificial
  CRISPR gRNA sequence
tgcacagcaaaagaaataat

SEQ ID NO: 430554 - DNA, 20 bp, Artificial
  CRISPR gRNA sequence
cacagcaaaagaaataatca

SEQ ID NO: 430555 - DNA, 20 bp, Artificial
  CRISPR gRNA sequence
ggagaaaatatttgtaaatt

SEQ ID NO: 430556 - DNA, 20 bp, Artificial
  CRISPR gRNA sequence
gtaaattatatatccaacaa

SEQ ID NO: 430557 - DNA, 20 bp, Artificial
  CRISPR gRNA sequence
taaattatatatccaacaaa

SEQ ID NO: 430558 - DNA, 20 bp, Artificial
  CRISPR gRNA sequence
tatatccaacaaaggactaa

SEQ ID NO: 430559 - DNA, 20 bp, Artificial
  CRISPR gRNA sequence
atatccagaatctacaagga

SEQ ID NO: 430560 - DNA, 20 bp, Artificial
  CRISPR gRNA sequence
caaggaactcaaacaaatca

SEQ ID NO: 430561 - DNA, 20 bp, Artificial
  CRISPR gRNA sequence
aaacaaatcagctgaaaaaa

SEQ ID NO: 430562 - DNA, 20 bp, Artificial
  CRISPR gRNA sequence
aaaaaaaaatcccatcaaaa

SEQ ID NO: 430563 - DNA, 20 bp, Artificial
  CRISPR gRNA sequence
aggacataaaaagacaattc

SEQ ID NO: 430564 - DNA, 20 bp, Artificial
  CRISPR gRNA sequence
tcagaaaaggatatacaaat

SEQ ID NO: 430565 - DNA, 20 bp, Artificial
  CRISPR gRNA sequence
agaaaaggatatacaaatgg

SEQ ID NO: 430566 - DNA, 20 bp, Artificial
  CRISPR gRNA sequence
aacatcactaattatcaggg

SEQ ID NO: 430567 - DNA, 20 bp, Artificial
  CRISPR gRNA sequence
attatcagggaaacgcaaat

SEQ ID NO: 430568 - DNA, 20 bp, Artificial
  CRISPR gRNA sequence
tcagggaaacgcaaatcaaa

SEQ ID NO: 430569 - DNA, 20 bp, Artificial
  CRISPR gRNA sequence
actcttgtaagaatggcctt

SEQ ID NO: 430570 - DNA, 20 bp, Artificial
  CRISPR gRNA sequence
ctcttgtaagaatggcctta

SEQ ID NO: 430571 - DNA, 20 bp, Artificial
  CRISPR gRNA sequence
ttgtaagaatggccttaatc

SEQ ID NO: 430572 - DNA, 20 bp, Artificial
  CRISPR gRNA sequence
gtaagaatggccttaatcaa

SEQ ID NO: 430573 - DNA, 20 bp, Artificial
  CRISPR gRNA sequence
taagaatggccttaatcaaa

SEQ ID NO: 430574 - DNA, 20 bp, Artificial
  CRISPR gRNA sequence
aatcaaaaaataaaaaaata

SEQ ID NO: 430575 - DNA, 20 bp, Artificial
  CRISPR gRNA sequence
atcaaaaaataaaaaaataa

SEQ ID NO: 430576 - DNA, 20 bp, Artificial
  CRISPR gRNA sequence
gcatggatgtggtgaaaggg

SEQ ID NO: 430577 - DNA, 20 bp, Artificial
  CRISPR gRNA sequence
ttacactgcttgtgggaatg

SEQ ID NO: 430578 - DNA, 20 bp, Artificial
  CRISPR gRNA sequence
tacactgcttgtgggaatgt

SEQ ID NO: 430579 - DNA, 20 bp, Artificial
  CRISPR gRNA sequence
acactgcttgtgggaatgta

SEQ ID NO: 430580 - DNA, 20 bp, Artificial
  CRISPR gRNA sequence
cactgcttgtgggaatgtaa

SEQ ID NO: 430581 - DNA, 20 bp, Artificial
  CRISPR gRNA sequence
cttgtgggaatgtaaactag

SEQ ID NO: 430582 - DNA, 20 bp, Artificial
  CRISPR gRNA sequence
gtgggaatgtaaactagtat

SEQ ID NO: 430583 - DNA, 20 bp, Artificial
  CRISPR gRNA sequence
tgggaatgtaaactagtatg

SEQ ID NO: 430584 - DNA, 20 bp, Artificial
  CRISPR gRNA sequence
gtatgactatggaaaacagt

SEQ ID NO: 430585 - DNA, 20 bp, Artificial
  CRISPR gRNA sequence
tggaaaacagtgtggagatt

SEQ ID NO: 430586 - DNA, 20 bp, Artificial
  CRISPR gRNA sequence
cttaaggaactaaaagtaga

SEQ ID NO: 430587 - DNA, 20 bp, Artificial
  CRISPR gRNA sequence
aaggaactaaaagtagaact

SEQ ID NO: 430588 - DNA, 20 bp, Artificial
  CRISPR gRNA sequence
aggaactaaaagtagaacta

SEQ ID NO: 430589 - DNA, 20 bp, Artificial
  CRISPR gRNA sequence
aaagtagaactatgatttaa

SEQ ID NO: 430590 - DNA, 20 bp, Artificial
  CRISPR gRNA sequence
tgatttaatccagtaatccc

SEQ ID NO: 430591 - DNA, 20 bp, Artificial
  CRISPR gRNA sequence
aatccagtaatcccactact

SEQ ID NO: 430592 - DNA, 20 bp, Artificial
  CRISPR gRNA sequence
atccagtaatcccactactg

SEQ ID NO: 430593 - DNA, 20 bp, Artificial
  CRISPR gRNA sequence
ctgggtatctatccagagga

SEQ ID NO: 430594 - DNA, 20 bp, Artificial
  CRISPR gRNA sequence
ggtatctatccagaggaaaa

SEQ ID NO: 430595 - DNA, 20 bp, Artificial
  CRISPR gRNA sequence
tccagaggaaaagaagtcat

SEQ ID NO: 430596 - DNA, 20 bp, Artificial
  CRISPR gRNA sequence
tacaaaaagcagcacaattt

SEQ ID NO: 430597 - DNA, 20 bp, Artificial
  CRISPR gRNA sequence
gcaattgcaaaaatatggaa

SEQ ID NO: 430598 - DNA, 20 bp, Artificial
  CRISPR gRNA sequence
caattgcaaaaatatggaac

SEQ ID NO: 430599 - DNA, 20 bp, Artificial
  CRISPR gRNA sequence
caaaaatatggaaccagccc

SEQ ID NO: 430600 - DNA, 20 bp, Artificial
  CRISPR gRNA sequence
taatgtgtctgtgtgtgtgt

SEQ ID NO: 430601 - DNA, 20 bp, Artificial
  CRISPR gRNA sequence
tgtgtgtgtgtgtgtgtgtg

SEQ ID NO: 430602 - DNA, 20 bp, Artificial
  CRISPR gRNA sequence
ctcagccataaaaaggaaca

SEQ ID NO: 430603 - DNA, 20 bp, Artificial
  CRISPR gRNA sequence
agccataaaaaggaacaaaa

SEQ ID NO: 430604 - DNA, 20 bp, Artificial
  CRISPR gRNA sequence
gcagcagcctggatggaatt

SEQ ID NO: 430605 - DNA, 20 bp, Artificial
  CRISPR gRNA sequence
cagcagcctggatggaattg

SEQ ID NO: 430606 - DNA, 20 bp, Artificial
  CRISPR gRNA sequence
gatggaattggaaaccacta

SEQ ID NO: 430607 - DNA, 20 bp, Artificial
  CRISPR gRNA sequence
gaaaccactactataagtga

SEQ ID NO: 430608 - DNA, 20 bp, Artificial
  CRISPR gRNA sequence
ctataagtgaagtaactcag

SEQ ID NO: 430609 - DNA, 20 bp, Artificial
  CRISPR gRNA sequence
taagtgaagtaactcaggaa

SEQ ID NO: 430610 - DNA, 20 bp, Artificial
  CRISPR gRNA sequence
aggaatgaaaaaccaaacat

SEQ ID NO: 430611 - DNA, 20 bp, Artificial
  CRISPR gRNA sequence
tatgttctcactcagaagtg

SEQ ID NO: 430612 - DNA, 20 bp, Artificial
  CRISPR gRNA sequence
tcactcagaagtgggagcta

SEQ ID NO: 430613 - DNA, 20 bp, Artificial
  CRISPR gRNA sequence
actcagaagtgggagctaag

SEQ ID NO: 430614 - DNA, 20 bp, Artificial
  CRISPR gRNA sequence
agaagtgggagctaagctat

SEQ ID NO: 430615 - DNA, 20 bp, Artificial
  CRISPR gRNA sequence
agctatgaggacgcaaaggc

SEQ ID NO: 430616 - DNA, 20 bp, Artificial
  CRISPR gRNA sequence
tgaggacgcaaaggcgttaa

SEQ ID NO: 430617 - DNA, 20 bp, Artificial
  CRISPR gRNA sequence
agaatgatacaagggactaa

SEQ ID NO: 430618 - DNA, 20 bp, Artificial
  CRISPR gRNA sequence
atggactttggggactcagg

SEQ ID NO: 430619 - DNA, 20 bp, Artificial
  CRISPR gRNA sequence
tggggactcagggaaaagag

SEQ ID NO: 430620 - DNA, 20 bp, Artificial
  CRISPR gRNA sequence
ggggactcagggaaaagagt

SEQ ID NO: 430621 - DNA, 20 bp, Artificial
  CRISPR gRNA sequence
gggactcagggaaaagagtg

SEQ ID NO: 430622 - DNA, 20 bp, Artificial
  CRISPR gRNA sequence
agggaaaagagtgggagagg

SEQ ID NO: 430623 - DNA, 20 bp, Artificial
  CRISPR gRNA sequence
agggataaaggactacacac

SEQ ID NO: 430624 - DNA, 20 bp, Artificial
  CRISPR gRNA sequence
cacactgggtacagtgtaca

SEQ ID NO: 430625 - DNA, 20 bp, Artificial
  CRISPR gRNA sequence
ggtacagtgtacactgttcg

SEQ ID NO: 430626 - DNA, 20 bp, Artificial
  CRISPR gRNA sequence
ttcgggtgatgggtgcacca

SEQ ID NO: 430627 - DNA, 20 bp, Artificial
  CRISPR gRNA sequence
gggtgatgggtgcaccaaaa

SEQ ID NO: 430628 - DNA, 20 bp, Artificial
  CRISPR gRNA sequence
agaaatcaccactaaaggac

SEQ ID NO: 430629 - DNA, 20 bp, Artificial
  CRISPR gRNA sequence
aaggacttattccccaaaaa

SEQ ID NO: 430630 - DNA, 20 bp, Artificial
  CRISPR gRNA sequence
attccccaaaaacctattga

SEQ ID NO: 430631 - DNA, 20 bp, Artificial
  CRISPR gRNA sequence
ttccccaaaaacctattgaa

SEQ ID NO: 430632 - DNA, 20 bp, Artificial
  CRISPR gRNA sequence
cccaaaaacctattgaaata

SEQ ID NO: 430633 - DNA, 20 bp, Artificial
  CRISPR gRNA sequence
ttgaaataaaaaatatataa

SEQ ID NO: 430634 - DNA, 20 bp, Artificial
  CRISPR gRNA sequence
aaataaaaaatatataaaaa

SEQ ID NO: 430635 - DNA, 20 bp, Artificial
  CRISPR gRNA sequence
aaacataaaaatttatagaa

SEQ ID NO: 430636 - DNA, 20 bp, Artificial
  CRISPR gRNA sequence
atagaaagaaaaacgaatat

SEQ ID NO: 430637 - DNA, 20 bp, Artificial
  CRISPR gRNA sequence
tagaaagaaaaacgaatatt

SEQ ID NO: 430638 - DNA, 20 bp, Artificial
  CRISPR gRNA sequence
tattacacataaaaattata

SEQ ID NO: 430639 - DNA, 20 bp, Artificial
  CRISPR gRNA sequence
attacacataaaaattatat

SEQ ID NO: 430640 - DNA, 20 bp, Artificial
  CRISPR gRNA sequence
ttacacataaaaattatatg

SEQ ID NO: 430641 - DNA, 20 bp, Artificial
  CRISPR gRNA sequence
cacataaaaattatatgaaa

SEQ ID NO: 430642 - DNA, 20 bp, Artificial
  CRISPR gRNA sequence
tatgaaattaacattttagt

SEQ ID NO: 430643 - DNA, 20 bp, Artificial
  CRISPR gRNA sequence
acattttagtgtttataaat

SEQ ID NO: 430644 - DNA, 20 bp, Artificial
  CRISPR gRNA sequence
tagtgtttataaataaaggt

SEQ ID NO: 430645 - DNA, 20 bp, Artificial
  CRISPR gRNA sequence
agtgtttataaataaaggtt

SEQ ID NO: 430646 - DNA, 20 bp, Artificial
  CRISPR gRNA sequence
gtgtttataaataaaggttt

SEQ ID NO: 430647 - DNA, 20 bp, Artificial
  CRISPR gRNA sequence
ataaataaaggtttgttgga

SEQ ID NO: 430648 - DNA, 20 bp, Artificial
  CRISPR gRNA sequence
taaataaaggtttgttggaa

SEQ ID NO: 430649 - DNA, 20 bp, Artificial
  CRISPR gRNA sequence
gttggaacagagtcatagtc

SEQ ID NO: 430650 - DNA, 20 bp, Artificial
  CRISPR gRNA sequence
ttggaacagagtcatagtca

SEQ ID NO: 430651 - DNA, 20 bp, Artificial
  CRISPR gRNA sequence
gaacagagtcatagtcattc

SEQ ID NO: 430652 - DNA, 20 bp, Artificial
  CRISPR gRNA sequence
atttgtatataatctatagc

SEQ ID NO: 430653 - DNA, 20 bp, Artificial
  CRISPR gRNA sequence
gtatataatctatagcactt

SEQ ID NO: 430654 - DNA, 20 bp, Artificial
  CRISPR gRNA sequence
tatataatctatagcacttt

SEQ ID NO: 430655 - DNA, 20 bp, Artificial
  CRISPR gRNA sequence
tagcactttcacactacaat

SEQ ID NO: 430656 - DNA, 20 bp, Artificial
  CRISPR gRNA sequence
tcacactacaatggcagagt

SEQ ID NO: 430657 - DNA, 20 bp, Artificial
  CRISPR gRNA sequence
cacactacaatggcagagtt

SEQ ID NO: 430658 - DNA, 20 bp, Artificial
  CRISPR gRNA sequence
acactacaatggcagagttg

SEQ ID NO: 430659 - DNA, 20 bp, Artificial
  CRISPR gRNA sequence
caatggcagagttgaattgt

SEQ ID NO: 430660 - DNA, 20 bp, Artificial
  CRISPR gRNA sequence
aattgttgcaacagagacca

SEQ ID NO: 430661 - DNA, 20 bp, Artificial
  CRISPR gRNA sequence
ttgcaacagagaccatatga

SEQ ID NO: 430662 - DNA, 20 bp, Artificial
  CRISPR gRNA sequence
caacagagaccatatgacct

SEQ ID NO: 430663 - DNA, 20 bp, Artificial
  CRISPR gRNA sequence
caaacccaaaaagatatact

SEQ ID NO: 430664 - DNA, 20 bp, Artificial
  CRISPR gRNA sequence
tctgcctctttacagagaaa

SEQ ID NO: 430665 - DNA, 20 bp, Artificial
  CRISPR gRNA sequence
cctctttacagagaaatttt

SEQ ID NO: 430666 - DNA, 20 bp, Artificial
  CRISPR gRNA sequence
tttacagagaaattttgcca

SEQ ID NO: 430667 - DNA, 20 bp, Artificial
  CRISPR gRNA sequence
tacagagaaattttgccaat

SEQ ID NO: 430668 - DNA, 20 bp, Artificial
  CRISPR gRNA sequence
acagagaaattttgccaatc

SEQ ID NO: 430669 - DNA, 20 bp, Artificial
  CRISPR gRNA sequence
cagagaaattttgccaatcc

SEQ ID NO: 430670 - DNA, 20 bp, Artificial
  CRISPR gRNA sequence
tgccaatccctgtactgaat

SEQ ID NO: 430671 - DNA, 20 bp, Artificial
  CRISPR gRNA sequence
gccaatccctgtactgaata

SEQ ID NO: 430672 - DNA, 20 bp, Artificial
  CRISPR gRNA sequence
ccaatccctgtactgaataa

SEQ ID NO: 430673 - DNA, 20 bp, Artificial
  CRISPR gRNA sequence
tactgaataatttccaaaat

SEQ ID NO: 430674 - DNA, 20 bp, Artificial
  CRISPR gRNA sequence
aataatttccaaaatccaat

SEQ ID NO: 430675 - DNA, 20 bp, Artificial
  CRISPR gRNA sequence
ccaaaatccaatagctgatt

SEQ ID NO: 430676 - DNA, 20 bp, Artificial
  CRISPR gRNA sequence
caaaatccaatagctgatta

SEQ ID NO: 430677 - DNA, 20 bp, Artificial
  CRISPR gRNA sequence
attatattgacttttctagg

SEQ ID NO: 430678 - DNA, 20 bp, Artificial
  CRISPR gRNA sequence
tattgacttttctagggaag

SEQ ID NO: 430679 - DNA, 20 bp, Artificial
  CRISPR gRNA sequence
acttttctagggaagatcca

SEQ ID NO: 430680 - DNA, 20 bp, Artificial
  CRISPR gRNA sequence
ttctagggaagatccagaga

SEQ ID NO: 430681 - DNA, 20 bp, Artificial
  CRISPR gRNA sequence
tctagggaagatccagagaa

SEQ ID NO: 430682 - DNA, 20 bp, Artificial
  CRISPR gRNA sequence
ctagggaagatccagagaac

SEQ ID NO: 430683 - DNA, 20 bp, Artificial
  CRISPR gRNA sequence
tagggaagatccagagaaca

SEQ ID NO: 430684 - DNA, 20 bp, Artificial
  CRISPR gRNA sequence
gggaagatccagagaacatc

SEQ ID NO: 430685 - DNA, 20 bp, Artificial
  CRISPR gRNA sequence
aagataatagcaacaataaa

SEQ ID NO: 430686 - DNA, 20 bp, Artificial
  CRISPR gRNA sequence
agataatagcaacaataaag

SEQ ID NO: 430687 - DNA, 20 bp, Artificial
  CRISPR gRNA sequence
ttactaagctggaaaagaat

SEQ ID NO: 430688 - DNA, 20 bp, Artificial
  CRISPR gRNA sequence
tactaagctggaaaagaatg

SEQ ID NO: 430689 - DNA, 20 bp, Artificial
  CRISPR gRNA sequence
actaagctggaaaagaatgt

SEQ ID NO: 430690 - DNA, 20 bp, Artificial
  CRISPR gRNA sequence
ctaagctggaaaagaatgtg

SEQ ID NO: 430691 - DNA, 20 bp, Artificial
  CRISPR gRNA sequence
agctggaaaagaatgtgcta

SEQ ID NO: 430692 - DNA, 20 bp, Artificial
  CRISPR gRNA sequence
gaaaagaatgtgctagggga

SEQ ID NO: 430693 - DNA, 20 bp, Artificial
  CRISPR gRNA sequence
ggggagctccagcatcattg

SEQ ID NO: 430694 - DNA, 20 bp, Artificial
  CRISPR gRNA sequence
cagcatcattgagaagtttg

SEQ ID NO: 430695 - DNA, 20 bp, Artificial
  CRISPR gRNA sequence
agaagtttggtggcatctct

SEQ ID NO: 430696 - DNA, 20 bp, Artificial
  CRISPR gRNA sequence
ggtggcatctctcctctata

SEQ ID NO: 430697 - DNA, 20 bp, Artificial
  CRISPR gRNA sequence
gtggcatctctcctctatag

SEQ ID NO: 430698 - DNA, 20 bp, Artificial
  CRISPR gRNA sequence
tcctctataggctagggcta

SEQ ID NO: 430699 - DNA, 20 bp, Artificial
  CRISPR gRNA sequence
ctctataggctagggctaaa

SEQ ID NO: 430700 - DNA, 20 bp, Artificial
  CRISPR gRNA sequence
tataggctagggctaaaata

SEQ ID NO: 430701 - DNA, 20 bp, Artificial
  CRISPR gRNA sequence
taggctagggctaaaatagg

SEQ ID NO: 430702 - DNA, 20 bp, Artificial
  CRISPR gRNA sequence
gggctaaaataggagatgct

SEQ ID NO: 430703 - DNA, 20 bp, Artificial
  CRISPR gRNA sequence
aaataggagatgcttttaca

SEQ ID NO: 430704 - DNA, 20 bp, Artificial
  CRISPR gRNA sequence
ttacagaactggattcctag

SEQ ID NO: 430705 - DNA, 20 bp, Artificial
  CRISPR gRNA sequence
tacagaactggattcctagt

SEQ ID NO: 430706 - DNA, 20 bp, Artificial
  CRISPR gRNA sequence
acagaactggattcctagta

SEQ ID NO: 430707 - DNA, 20 bp, Artificial
  CRISPR gRNA sequence
cagaactggattcctagtag

SEQ ID NO: 430708 - DNA, 20 bp, Artificial
  CRISPR gRNA sequence
gattcctagtagcaatgagg

SEQ ID NO: 430709 - DNA, 20 bp, Artificial
  CRISPR gRNA sequence
ctagtagcaatgaggatgag

SEQ ID NO: 430710 - DNA, 20 bp, Artificial
  CRISPR gRNA sequence
gtagcaatgaggatgaggag

SEQ ID NO: 430711 - DNA, 20 bp, Artificial
  CRISPR gRNA sequence
aaagaaacaaaatggatgta

SEQ ID NO: 430712 - DNA, 20 bp, Artificial
  CRISPR gRNA sequence
aagaaacaaaatggatgtaa

SEQ ID NO: 430713 - DNA, 20 bp, Artificial
  CRISPR gRNA sequence
cttcaatgggagccaagaaa

SEQ ID NO: 430714 - DNA, 20 bp, Artificial
  CRISPR gRNA sequence
caatgggagccaagaaagcc

SEQ ID NO: 430715 - DNA, 20 bp, Artificial
  CRISPR gRNA sequence
aatgggagccaagaaagcct

SEQ ID NO: 430716 - DNA, 20 bp, Artificial
  CRISPR gRNA sequence
atccatgggaatattaaaat

SEQ ID NO: 430717 - DNA, 20 bp, Artificial
  CRISPR gRNA sequence
aaatggttaatagagcacag

SEQ ID NO: 430718 - DNA, 20 bp, Artificial
  CRISPR gRNA sequence
atagagcacagtgtgcccag

SEQ ID NO: 430719 - DNA, 20 bp, Artificial
  CRISPR gRNA sequence
ggcagccaagaagggtattg

SEQ ID NO: 430720 - DNA, 20 bp, Artificial
  CRISPR gRNA sequence
cttacatacataatcaaaag

SEQ ID NO: 430721 - DNA, 20 bp, Artificial
  CRISPR gRNA sequence
acatacataatcaaaagagg

SEQ ID NO: 430722 - DNA, 20 bp, Artificial
  CRISPR gRNA sequence
catacataatcaaaagaggt

SEQ ID NO: 430723 - DNA, 20 bp, Artificial
  CRISPR gRNA sequence
caagagagaaggctgaagcc

SEQ ID NO: 430724 - DNA, 20 bp, Artificial
  CRISPR gRNA sequence
aagccagccaaccctgtgga

SEQ ID NO: 430725 - DNA, 20 bp, Artificial
  CRISPR gRNA sequence
tggaaagtcaagatcctttg

SEQ ID NO: 430726 - DNA, 20 bp, Artificial
  CRISPR gRNA sequence
tgtccagtgttcatgtctat

SEQ ID NO: 430727 - DNA, 20 bp, Artificial
  CRISPR gRNA sequence
gtccagtgttcatgtctatg

SEQ ID NO: 430728 - DNA, 20 bp, Artificial
  CRISPR gRNA sequence
tccagtgttcatgtctatga

SEQ ID NO: 430729 - DNA, 20 bp, Artificial
  CRISPR gRNA sequence
atgtctatgagcactacttg

SEQ ID NO: 430730 - DNA, 20 bp, Artificial
  CRISPR gRNA sequence
tgagcactacttgaatggat

SEQ ID NO: 430731 - DNA, 20 bp, Artificial
  CRISPR gRNA sequence
cttgaatggataccagccat

SEQ ID NO: 430732 - DNA, 20 bp, Artificial
  CRISPR gRNA sequence
gaatggataccagccatttg

SEQ ID NO: 430733 - DNA, 20 bp, Artificial
  CRISPR gRNA sequence
aatggataccagccatttgc

SEQ ID NO: 430734 - DNA, 20 bp, Artificial
  CRISPR gRNA sequence
gcctcttggctctgctctct

SEQ ID NO: 430735 - DNA, 20 bp, Artificial
  CRISPR gRNA sequence
cctcttggctctgctctcta

SEQ ID NO: 430736 - DNA, 20 bp, Artificial
  CRISPR gRNA sequence
ttggctctgctctctaacct

SEQ ID NO: 430737 - DNA, 20 bp, Artificial
  CRISPR gRNA sequence
ggctctgctctctaaccttc

SEQ ID NO: 430738 - DNA, 20 bp, Artificial
  CRISPR gRNA sequence
gctctgctctctaaccttct

SEQ ID NO: 430739 - DNA, 20 bp, Artificial
  CRISPR gRNA sequence
tgctctctaaccttctccac

SEQ ID NO: 430740 - DNA, 20 bp, Artificial
  CRISPR gRNA sequence
ctctctaaccttctccaccc

SEQ ID NO: 430741 - DNA, 20 bp, Artificial
  CRISPR gRNA sequence
tctaaccttctccaccctat

SEQ ID NO: 430742 - DNA, 20 bp, Artificial
  CRISPR gRNA sequence
taaccttctccaccctattc

SEQ ID NO: 430743 - DNA, 20 bp, Artificial
  CRISPR gRNA sequence
accttctccaccctattctg

SEQ ID NO: 430744 - DNA, 20 bp, Artificial
  CRISPR gRNA sequence
ctccaccctattctgtgccc

SEQ ID NO: 430745 - DNA, 20 bp, Artificial
  CRISPR gRNA sequence
tccaccctattctgtgccct

SEQ ID NO: 430746 - DNA, 20 bp, Artificial
  CRISPR gRNA sequence
caccctattctgtgccctat

SEQ ID NO: 430747 - DNA, 20 bp, Artificial
  CRISPR gRNA sequence
ttctgtgccctatgaagact

SEQ ID NO: 430748 - DNA, 20 bp, Artificial
  CRISPR gRNA sequence
tgtgccctatgaagactgta

SEQ ID NO: 430749 - DNA, 20 bp, Artificial
  CRISPR gRNA sequence
tgccctatgaagactgtact

SEQ ID NO: 430750 - DNA, 20 bp, Artificial
  CRISPR gRNA sequence
tgaagactgtactaaatgta

SEQ ID NO: 430751 - DNA, 20 bp, Artificial
  CRISPR gRNA sequence
tactaaatgtactacatcaa

SEQ ID NO: 430752 - DNA, 20 bp, Artificial
  CRISPR gRNA sequence
aatgtactacatcaatgagt

SEQ ID NO: 430753 - DNA, 20 bp, Artificial
  CRISPR gRNA sequence
catcaatgagtccccttatc

SEQ ID NO: 430754 - DNA, 20 bp, Artificial
  CRISPR gRNA sequence
atcctccatcctaagtttga

SEQ ID NO: 430755 - DNA, 20 bp, Artificial
  CRISPR gRNA sequence
tcctccatcctaagtttgag

SEQ ID NO: 430756 - DNA, 20 bp, Artificial
  CRISPR gRNA sequence
catcctaagtttgaggtcag

SEQ ID NO: 430757 - DNA, 20 bp, Artificial
  CRISPR gRNA sequence
agtttgaggtcagccaatgc

SEQ ID NO: 430758 - DNA, 20 bp, Artificial
  CRISPR gRNA sequence
gaggtcagccaatgcaaagc

SEQ ID NO: 430759 - DNA, 20 bp, Artificial
  CRISPR gRNA sequence
aggtcagccaatgcaaagca

SEQ ID NO: 430760 - DNA, 20 bp, Artificial
  CRISPR gRNA sequence
cctttgttctttctgcaggg

SEQ ID NO: 430761 - DNA, 20 bp, Artificial
  CRISPR gRNA sequence
tgttctttctgcagggtggc

SEQ ID NO: 430762 - DNA, 20 bp, Artificial
  CRISPR gRNA sequence
gttctttctgcagggtggcc

SEQ ID NO: 430763 - DNA, 20 bp, Artificial
  CRISPR gRNA sequence
ttctttctgcagggtggcct

SEQ ID NO: 430764 - DNA, 20 bp, Artificial
  CRISPR gRNA sequence
tttctgcagggtggccttgg

SEQ ID NO: 430765 - DNA, 20 bp, Artificial
  CRISPR gRNA sequence
tctgcagggtggccttggac

SEQ ID NO: 430766 - DNA, 20 bp, Artificial
  CRISPR gRNA sequence
ctgcagggtggccttggact

SEQ ID NO: 430767 - DNA, 20 bp, Artificial
  CRISPR gRNA sequence
tgcagggtggccttggactg

SEQ ID NO: 430768 - DNA, 20 bp, Artificial
  CRISPR gRNA sequence
cagggtggccttggactggt

SEQ ID NO: 430769 - DNA, 20 bp, Artificial
  CRISPR gRNA sequence
ggactggttgtgaccctcca

SEQ ID NO: 430770 - DNA, 20 bp, Artificial
  CRISPR gRNA sequence
gactggttgtgaccctccag

SEQ ID NO: 430771 - DNA, 20 bp, Artificial
  CRISPR gRNA sequence
gttgtgaccctccagcaaag

SEQ ID NO: 430772 - DNA, 20 bp, Artificial
  CRISPR gRNA sequence
tgaccctccagcaaagacta

SEQ ID NO: 430773 - DNA, 20 bp, Artificial
  CRISPR gRNA sequence
cagcaaagactacagcactt

SEQ ID NO: 430774 - DNA, 20 bp, Artificial
  CRISPR gRNA sequence
cagcacttctgaaggagacc

SEQ ID NO: 430775 - DNA, 20 bp, Artificial
  CRISPR gRNA sequence
ctgaaggagacccctccaca

SEQ ID NO: 430776 - DNA, 20 bp, Artificial
  CRISPR gRNA sequence
tgaaggagacccctccacat

SEQ ID NO: 430777 - DNA, 20 bp, Artificial
  CRISPR gRNA sequence
aaggagacccctccacataa

SEQ ID NO: 430778 - DNA, 20 bp, Artificial
  CRISPR gRNA sequence
cacataactctctccttcca

SEQ ID NO: 430779 - DNA, 20 bp, Artificial
  CRISPR gRNA sequence
tctccttccaggctccaata

SEQ ID NO: 430780 - DNA, 20 bp, Artificial
  CRISPR gRNA sequence
tccttccaggctccaataat

SEQ ID NO: 430781 - DNA, 20 bp, Artificial
  CRISPR gRNA sequence
cttccaggctccaataatta

SEQ ID NO: 430782 - DNA, 20 bp, Artificial
  CRISPR gRNA sequence
ccaggctccaataattagcc

SEQ ID NO: 430783 - DNA, 20 bp, Artificial
  CRISPR gRNA sequence
caggctccaataattagccc

SEQ ID NO: 430784 - DNA, 20 bp, Artificial
  CRISPR gRNA sequence
caataattagcccctcccct

SEQ ID NO: 430785 - DNA, 20 bp, Artificial
  CRISPR gRNA sequence
gcccctcccctaccctttga

SEQ ID NO: 430786 - DNA, 20 bp, Artificial
  CRISPR gRNA sequence
ccctaccctttgaagaacta

SEQ ID NO: 430787 - DNA, 20 bp, Artificial
  CRISPR gRNA sequence
ccctttgaagaactaggaat

SEQ ID NO: 430788 - DNA, 20 bp, Artificial
  CRISPR gRNA sequence
tgaagaactaggaatggtta

SEQ ID NO: 430789 - DNA, 20 bp, Artificial
  CRISPR gRNA sequence
gaagaactaggaatggttac

SEQ ID NO: 430790 - DNA, 20 bp, Artificial
  CRISPR gRNA sequence
aagaactaggaatggttaca

SEQ ID NO: 430791 - DNA, 20 bp, Artificial
  CRISPR gRNA sequence
ggaatggttacagcaccttg

SEQ ID NO: 430792 - DNA, 20 bp, Artificial
  CRISPR gRNA sequence
cagcaccttgctactcctcc

SEQ ID NO: 430793 - DNA, 20 bp, Artificial
  CRISPR gRNA sequence
gctactcctccttgtggtgt

SEQ ID NO: 430794 - DNA, 20 bp, Artificial
  CRISPR gRNA sequence
ctactcctccttgtggtgtc

SEQ ID NO: 430795 - DNA, 20 bp, Artificial
  CRISPR gRNA sequence
ctcctccttgtggtgtcctt

SEQ ID NO: 430796 - DNA, 20 bp, Artificial
  CRISPR gRNA sequence
ctccttgtggtgtccttaca

SEQ ID NO: 430797 - DNA, 20 bp, Artificial
  CRISPR gRNA sequence
cttgtggtgtccttacatcc

SEQ ID NO: 430798 - DNA, 20 bp, Artificial
  CRISPR gRNA sequence
gtggtgtccttacatcctac

SEQ ID NO: 430799 - DNA, 20 bp, Artificial
  CRISPR gRNA sequence
tggtgtccttacatcctact

SEQ ID NO: 430800 - DNA, 20 bp, Artificial
  CRISPR gRNA sequence
acatcctactagacttctgg

SEQ ID NO: 430801 - DNA, 20 bp, Artificial
  CRISPR gRNA sequence
catcctactagacttctgga

SEQ ID NO: 430802 - DNA, 20 bp, Artificial
  CRISPR gRNA sequence
ctagacttctggaaatccta

SEQ ID NO: 430803 - DNA, 20 bp, Artificial
  CRISPR gRNA sequence
gacttctggaaatcctatta

SEQ ID NO: 430804 - DNA, 20 bp, Artificial
  CRISPR gRNA sequence
ctggaaatcctattattaaa

SEQ ID NO: 430805 - DNA, 20 bp, Artificial
  CRISPR gRNA sequence
tggaaatcctattattaaac

SEQ ID NO: 430806 - DNA, 20 bp, Artificial
  CRISPR gRNA sequence
gaaatcctattattaaactg

SEQ ID NO: 430807 - DNA, 20 bp, Artificial
  CRISPR gRNA sequence
ttattaaactgtcttcaaac

SEQ ID NO: 430808 - DNA, 20 bp, Artificial
  CRISPR gRNA sequence
ttaaactgtcttcaaacaac

SEQ ID NO: 430809 - DNA, 20 bp, Artificial
  CRISPR gRNA sequence
aactgtcttcaaacaaccca

SEQ ID NO: 430810 - DNA, 20 bp, Artificial
  CRISPR gRNA sequence
tcttcaaacaacccagtttg

SEQ ID NO: 430811 - DNA, 20 bp, Artificial
  CRISPR gRNA sequence
caaacaacccagtttgagta

SEQ ID NO: 430812 - DNA, 20 bp, Artificial
  CRISPR gRNA sequence
aaacaacccagtttgagtac

SEQ ID NO: 430813 - DNA, 20 bp, Artificial
  CRISPR gRNA sequence
gagtactacatgttccctgc

SEQ ID NO: 430814 - DNA, 20 bp, Artificial
  CRISPR gRNA sequence
agtactacatgttccctgct

SEQ ID NO: 430815 - DNA, 20 bp, Artificial
  CRISPR gRNA sequence
catgttccctgctggaaccc

SEQ ID NO: 430816 - DNA, 20 bp, Artificial
  CRISPR gRNA sequence
cctgctggaaccctgaataa

SEQ ID NO: 430817 - DNA, 20 bp, Artificial
  CRISPR gRNA sequence
ctggaaccctgaataatgca

SEQ ID NO: 430818 - DNA, 20 bp, Artificial
  CRISPR gRNA sequence
gaaccctgaataatgcaact

SEQ ID NO: 430819 - DNA, 20 bp, Artificial
  CRISPR gRNA sequence
aataatgcaactataaaatg

SEQ ID NO: 430820 - DNA, 20 bp, Artificial
  CRISPR gRNA sequence
taaaatgctttgagcaagga

SEQ ID NO: 430821 - DNA, 20 bp, Artificial
  CRISPR gRNA sequence
tgagcaaggagagagagaca

SEQ ID NO: 430822 - DNA, 20 bp, Artificial
  CRISPR gRNA sequence
gagcaaggagagagagacag

SEQ ID NO: 430823 - DNA, 20 bp, Artificial
  CRISPR gRNA sequence
agcaaggagagagagacaga

SEQ ID NO: 430824 - DNA, 20 bp, Artificial
  CRISPR gRNA sequence
acaactatatccaaagcaca

SEQ ID NO: 430825 - DNA, 20 bp, Artificial
  CRISPR gRNA sequence
tatccaaagcacaggaaaga

SEQ ID NO: 430826 - DNA, 20 bp, Artificial
  CRISPR gRNA sequence
cacaggaagcagtggaaatg

SEQ ID NO: 430827 - DNA, 20 bp, Artificial
  CRISPR gRNA sequence
gggaatcaaacactgtagaa

SEQ ID NO: 430828 - DNA, 20 bp, Artificial
  CRISPR gRNA sequence
tagaaagggagcaacaggac

SEQ ID NO: 430829 - DNA, 20 bp, Artificial
  CRISPR gRNA sequence
aataggtctcttcacctttt

SEQ ID NO: 430830 - DNA, 20 bp, Artificial
  CRISPR gRNA sequence
ttcacctttttctctttctc

SEQ ID NO: 430831 - DNA, 20 bp, Artificial
  CRISPR gRNA sequence
cacctttttctctttctcta

SEQ ID NO: 430832 - DNA, 20 bp, Artificial
  CRISPR gRNA sequence
acctttttctctttctctac

SEQ ID NO: 430833 - DNA, 20 bp, Artificial
  CRISPR gRNA sequence
tttctctttctctaccctcc

SEQ ID NO: 430834 - DNA, 20 bp, Artificial
  CRISPR gRNA sequence
ttctctttctctaccctcca

SEQ ID NO: 430835 - DNA, 20 bp, Artificial
  CRISPR gRNA sequence
tctctttctctaccctccag

SEQ ID NO: 430836 - DNA, 20 bp, Artificial
  CRISPR gRNA sequence
ctctttctctaccctccaga

SEQ ID NO: 430837 - DNA, 20 bp, Artificial
  CRISPR gRNA sequence
tctttctctaccctccagat

SEQ ID NO: 430838 - DNA, 20 bp, Artificial
  CRISPR gRNA sequence
tttctctaccctccagatga

SEQ ID NO: 430839 - DNA, 20 bp, Artificial
  CRISPR gRNA sequence
tctctaccctccagatgacc

SEQ ID NO: 430840 - DNA, 20 bp, Artificial
  CRISPR gRNA sequence
ctctaccctccagatgacca

SEQ ID NO: 430841 - DNA, 20 bp, Artificial
  CRISPR gRNA sequence
tctaccctccagatgaccaa

SEQ ID NO: 430842 - DNA, 20 bp, Artificial
  CRISPR gRNA sequence
taccctccagatgaccaaag

SEQ ID NO: 430843 - DNA, 20 bp, Artificial
  CRISPR gRNA sequence
ccctccagatgaccaaagtt

SEQ ID NO: 430844 - DNA, 20 bp, Artificial
  CRISPR gRNA sequence
cagatgaccaaagttagtcc

SEQ ID NO: 430845 - DNA, 20 bp, Artificial
  CRISPR gRNA sequence
gtccaggtgcccagaatgaa

SEQ ID NO: 430846 - DNA, 20 bp, Artificial
  CRISPR gRNA sequence
accagtcttgaatccttaac

SEQ ID NO: 430847 - DNA, 20 bp, Artificial
  CRISPR gRNA sequence
gaatccttaacaggaaaagt

SEQ ID NO: 430848 - DNA, 20 bp, Artificial
  CRISPR gRNA sequence
aatccttaacaggaaaagtt

SEQ ID NO: 430849 - DNA, 20 bp, Artificial
  CRISPR gRNA sequence
aacaggaaaagttgttcagc

SEQ ID NO: 430850 - DNA, 20 bp, Artificial
  CRISPR gRNA sequence
acaggaaaagttgttcagct

SEQ ID NO: 430851 - DNA, 20 bp, Artificial
  CRISPR gRNA sequence
ttcagctccttctaaagagc

SEQ ID NO: 430852 - DNA, 20 bp, Artificial
  CRISPR gRNA sequence
agctccttctaaagagcctt

SEQ ID NO: 430853 - DNA, 20 bp, Artificial
  CRISPR gRNA sequence
cttctaaagagcctttgatt

SEQ ID NO: 430854 - DNA, 20 bp, Artificial
  CRISPR gRNA sequence
ctaaagagcctttgattctt

SEQ ID NO: 430855 - DNA, 20 bp, Artificial
  CRISPR gRNA sequence
taaagagcctttgattcttt

SEQ ID NO: 430856 - DNA, 20 bp, Artificial
  CRISPR gRNA sequence
aagagcctttgattctttta

SEQ ID NO: 430857 - DNA, 20 bp, Artificial
  CRISPR gRNA sequence
tgattcttttattccagacc

SEQ ID NO: 430858 - DNA, 20 bp, Artificial
  CRISPR gRNA sequence
gattcttttattccagacca

SEQ ID NO: 430859 - DNA, 20 bp, Artificial
  CRISPR gRNA sequence
attcttttattccagaccat

SEQ ID NO: 430860 - DNA, 20 bp, Artificial
  CRISPR gRNA sequence
ttttattccagaccatcagg

SEQ ID NO: 430861 - DNA, 20 bp, Artificial
  CRISPR gRNA sequence
ttattccagaccatcaggac

SEQ ID NO: 430862 - DNA, 20 bp, Artificial
  CRISPR gRNA sequence
tattccagaccatcaggaca

SEQ ID NO: 430863 - DNA, 20 bp, Artificial
  CRISPR gRNA sequence
attccagaccatcaggacac

SEQ ID NO: 430864 - DNA, 20 bp, Artificial
  CRISPR gRNA sequence
ttccagaccatcaggacact

SEQ ID NO: 430865 - DNA, 20 bp, Artificial
  CRISPR gRNA sequence
cagaccatcaggacactgct

SEQ ID NO: 430866 - DNA, 20 bp, Artificial
  CRISPR gRNA sequence
ctaacagcagagaacctgtt

SEQ ID NO: 430867 - DNA, 20 bp, Artificial
  CRISPR gRNA sequence
acagcagagaacctgttcac

SEQ ID NO: 430868 - DNA, 20 bp, Artificial
  CRISPR gRNA sequence
ttcaccaaccaccatagcag

SEQ ID NO: 430869 - DNA, 20 bp, Artificial
  CRISPR gRNA sequence
accaaccaccatagcagctc

SEQ ID NO: 430870 - DNA, 20 bp, Artificial
  CRISPR gRNA sequence
ccttcccagctaagagatca

SEQ ID NO: 430871 - DNA, 20 bp, Artificial
  CRISPR gRNA sequence
cccagctaagagatcaactt

SEQ ID NO: 430872 - DNA, 20 bp, Artificial
  CRISPR gRNA sequence
ccagctaagagatcaacttt

SEQ ID NO: 430873 - DNA, 20 bp, Artificial
  CRISPR gRNA sequence
agagatcaactttcatcttc

SEQ ID NO: 430874 - DNA, 20 bp, Artificial
  CRISPR gRNA sequence
tcatcttcttcacctccccc

SEQ ID NO: 430875 - DNA, 20 bp, Artificial
  CRISPR gRNA sequence
catcttcttcacctcccccc

SEQ ID NO: 430876 - DNA, 20 bp, Artificial
  CRISPR gRNA sequence
atcttcttcacctcccccct

SEQ ID NO: 430877 - DNA, 20 bp, Artificial
  CRISPR gRNA sequence
cttcacctcccccctctatt

SEQ ID NO: 430878 - DNA, 20 bp, Artificial
  CRISPR gRNA sequence
ttcacctcccccctctattc

SEQ ID NO: 430879 - DNA, 20 bp, Artificial
  CRISPR gRNA sequence
cacctcccccctctattcaa

SEQ ID NO: 430880 - DNA, 20 bp, Artificial
  CRISPR gRNA sequence
acctcccccctctattcaat

SEQ ID NO: 430881 - DNA, 20 bp, Artificial
  CRISPR gRNA sequence
ccccctctattcaatcattt

SEQ ID NO: 430882 - DNA, 20 bp, Artificial
  CRISPR gRNA sequence
tattcaatcatttctcttgt

SEQ ID NO: 430883 - DNA, 20 bp, Artificial
  CRISPR gRNA sequence
ttcaatcatttctcttgtcc

SEQ ID NO: 430884 - DNA, 20 bp, Artificial
  CRISPR gRNA sequence
aatcatttctcttgtcctca

SEQ ID NO: 430885 - DNA, 20 bp, Artificial
  CRISPR gRNA sequence
ctcttgtcctcaccttccca

SEQ ID NO: 430886 - DNA, 20 bp, Artificial
  CRISPR gRNA sequence
tcttgtcctcaccttcccat

SEQ ID NO: 430887 - DNA, 20 bp, Artificial
  CRISPR gRNA sequence
ttgtcctcaccttcccatag

SEQ ID NO: 430888 - DNA, 20 bp, Artificial
  CRISPR gRNA sequence
gtcctcaccttcccatagag

SEQ ID NO: 430889 - DNA, 20 bp, Artificial
  CRISPR gRNA sequence
tcctcaccttcccatagagg

SEQ ID NO: 430890 - DNA, 20 bp, Artificial
  CRISPR gRNA sequence
accttcccatagagggttca

SEQ ID NO: 430891 - DNA, 20 bp, Artificial
  CRISPR gRNA sequence
cccatagagggttcatttcc

SEQ ID NO: 430892 - DNA, 20 bp, Artificial
  CRISPR gRNA sequence
ccatagagggttcatttcct

SEQ ID NO: 430893 - DNA, 20 bp, Artificial
  CRISPR gRNA sequence
atttcctcattatgtctatt

SEQ ID NO: 430894 - DNA, 20 bp, Artificial
  CRISPR gRNA sequence
cctcattatgtctattgtga

SEQ ID NO: 430895 - DNA, 20 bp, Artificial
  CRISPR gRNA sequence
ctcattatgtctattgtgat

SEQ ID NO: 430896 - DNA, 20 bp, Artificial
  CRISPR gRNA sequence
attatgtctattgtgatagc

SEQ ID NO: 430897 - DNA, 20 bp, Artificial
  CRISPR gRNA sequence
tgtctattgtgatagccaac

SEQ ID NO: 430898 - DNA, 20 bp, Artificial
  CRISPR gRNA sequence
ttgtgatagccaacacataa

SEQ ID NO: 430899 - DNA, 20 bp, Artificial
  CRISPR gRNA sequence
tgatagccaacacataaatg

SEQ ID NO: 430900 - DNA, 20 bp, Artificial
  CRISPR gRNA sequence
tagatcattgactttcccaa

SEQ ID NO: 430901 - DNA, 20 bp, Artificial
  CRISPR gRNA sequence
actttcccaatagcaccagc

SEQ ID NO: 430902 - DNA, 20 bp, Artificial
  CRISPR gRNA sequence
tcccaatagcaccagccatg

SEQ ID NO: 430903 - DNA, 20 bp, Artificial
  CRISPR gRNA sequence
cccaatagcaccagccatgt

SEQ ID NO: 430904 - DNA, 20 bp, Artificial
  CRISPR gRNA sequence
ccaatagcaccagccatgtc

SEQ ID NO: 430905 - DNA, 20 bp, Artificial
  CRISPR gRNA sequence
agccactgcagttcaaccag

SEQ ID NO: 430906 - DNA, 20 bp, Artificial
  CRISPR gRNA sequence
cagttcaaccaggctgcaga

SEQ ID NO: 430907 - DNA, 20 bp, Artificial
  CRISPR gRNA sequence
aaccaggctgcagaactgag

SEQ ID NO: 430908 - DNA, 20 bp, Artificial
  CRISPR gRNA sequence
cagaactgagttgttaattg

SEQ ID NO: 430909 - DNA, 20 bp, Artificial
  CRISPR gRNA sequence
agttgttaattgaatggaat

SEQ ID NO: 430910 - DNA, 20 bp, Artificial
  CRISPR gRNA sequence
ttaattgaatggaattagag

SEQ ID NO: 430911 - DNA, 20 bp, Artificial
  CRISPR gRNA sequence
attgaatggaattagagttg

SEQ ID NO: 430912 - DNA, 20 bp, Artificial
  CRISPR gRNA sequence
aatggaattagagttggagg

SEQ ID NO: 430913 - DNA, 20 bp, Artificial
  CRISPR gRNA sequence
gagttggaggaaaagtgggt

SEQ ID NO: 430914 - DNA, 20 bp, Artificial
  CRISPR gRNA sequence
gaggaaaagtgggttaggat

SEQ ID NO: 430915 - DNA, 20 bp, Artificial
  CRISPR gRNA sequence
ggatctcaggtggagggtct

SEQ ID NO: 430916 - DNA, 20 bp, Artificial
  CRISPR gRNA sequence
aggtggagggtctggggtaa

SEQ ID NO: 430917 - DNA, 20 bp, Artificial
  CRISPR gRNA sequence
gggtaaaggtagaaattaca

SEQ ID NO: 430918 - DNA, 20 bp, Artificial
  CRISPR gRNA sequence
caaacttgtgtttcccaaaa

SEQ ID NO: 430919 - DNA, 20 bp, Artificial
  CRISPR gRNA sequence
gtgtttcccaaaatatttat

SEQ ID NO: 430920 - DNA, 20 bp, Artificial
  CRISPR gRNA sequence
tgtttcccaaaatatttatg

SEQ ID NO: 430921 - DNA, 20 bp, Artificial
  CRISPR gRNA sequence
cccaaaatatttatgtggtg

SEQ ID NO: 430922 - DNA, 20 bp, Artificial
  CRISPR gRNA sequence
ccaaaatatttatgtggtga

SEQ ID NO: 430923 - DNA, 20 bp, Artificial
  CRISPR gRNA sequence
atgtggtgacttgaattaag

SEQ ID NO: 430924 - DNA, 20 bp, Artificial
  CRISPR gRNA sequence
tgtggtgacttgaattaagg

SEQ ID NO: 430925 - DNA, 20 bp, Artificial
  CRISPR gRNA sequence
gaattaaggtgacctgggct

SEQ ID NO: 430926 - DNA, 20 bp, Artificial
  CRISPR gRNA sequence
aattaaggtgacctgggctg

SEQ ID NO: 430927 - DNA, 20 bp, Artificial
  CRISPR gRNA sequence
aggtgacctgggctgagctg

SEQ ID NO: 430928 - DNA, 20 bp, Artificial
  CRISPR gRNA sequence
ggctgagctgacttaaaggg

SEQ ID NO: 430929 - DNA, 20 bp, Artificial
  CRISPR gRNA sequence
agctgacttaaagggcccaa

SEQ ID NO: 430930 - DNA, 20 bp, Artificial
  CRISPR gRNA sequence
acttaaagggcccaagagat

SEQ ID NO: 430931 - DNA, 20 bp, Artificial
  CRISPR gRNA sequence
aaagggcccaagagatcaga

SEQ ID NO: 430932 - DNA, 20 bp, Artificial
  CRISPR gRNA sequence
aagggcccaagagatcagac

SEQ ID NO: 430933 - DNA, 20 bp, Artificial
  CRISPR gRNA sequence
tttcactcctcccaatcaat

SEQ ID NO: 430934 - DNA, 20 bp, Artificial
  CRISPR gRNA sequence
tcactcctcccaatcaatac

SEQ ID NO: 430935 - DNA, 20 bp, Artificial
  CRISPR gRNA sequence
cactcctcccaatcaatacc

SEQ ID NO: 430936 - DNA, 20 bp, Artificial
  CRISPR gRNA sequence
actcctcccaatcaatacca

SEQ ID NO: 430937 - DNA, 20 bp, Artificial
  CRISPR gRNA sequence
ctcccaatcaataccagtag

SEQ ID NO: 430938 - DNA, 20 bp, Artificial
  CRISPR gRNA sequence
ccaatcaataccagtagctg

SEQ ID NO: 430939 - DNA, 20 bp, Artificial
  CRISPR gRNA sequence
atgacataaatttcactgat

SEQ ID NO: 430940 - DNA, 20 bp, Artificial
  CRISPR gRNA sequence
cactgatataattctttgtt

SEQ ID NO: 430941 - DNA, 20 bp, Artificial
  CRISPR gRNA sequence
actgatataattctttgtta

SEQ ID NO: 430942 - DNA, 20 bp, Artificial
  CRISPR gRNA sequence
atataattctttgttattta

SEQ ID NO: 430943 - DNA, 20 bp, Artificial
  CRISPR gRNA sequence
tttgttatttataaagattt

SEQ ID NO: 430944 - DNA, 20 bp, Artificial
  CRISPR gRNA sequence
tgttatttataaagatttta

SEQ ID NO: 430945 - DNA, 20 bp, Artificial
  CRISPR gRNA sequence
gttatttataaagattttac

SEQ ID NO: 430946 - DNA, 20 bp, Artificial
  CRISPR gRNA sequence
ttatttataaagattttaca

SEQ ID NO: 430947 - DNA, 20 bp, Artificial
  CRISPR gRNA sequence
tttataaagattttacatga

SEQ ID NO: 430948 - DNA, 20 bp, Artificial
  CRISPR gRNA sequence
ataaagattttacatgaaat

SEQ ID NO: 430949 - DNA, 20 bp, Artificial
  CRISPR gRNA sequence
taaagattttacatgaaata

SEQ ID NO: 430950 - DNA, 20 bp, Artificial
  CRISPR gRNA sequence
tacatgaaatatgccacttg

SEQ ID NO: 430951 - DNA, 20 bp, Artificial
  CRISPR gRNA sequence
acatgaaatatgccacttgt

SEQ ID NO: 430952 - DNA, 20 bp, Artificial
  CRISPR gRNA sequence
catgaaatatgccacttgtt

SEQ ID NO: 430953 - DNA, 20 bp, Artificial
  CRISPR gRNA sequence
gttcatcacaactctatgat

SEQ ID NO: 430954 - DNA, 20 bp, Artificial
  CRISPR gRNA sequence
ttcatcacaactctatgata

SEQ ID NO: 430955 - DNA, 20 bp, Artificial
  CRISPR gRNA sequence
atcacaactctatgatatag

SEQ ID NO: 430956 - DNA, 20 bp, Artificial
  CRISPR gRNA sequence
tatgatatagagtaagccga

SEQ ID NO: 430957 - DNA, 20 bp, Artificial
  CRISPR gRNA sequence
tgatatagagtaagccgaat

SEQ ID NO: 430958 - DNA, 20 bp, Artificial
  CRISPR gRNA sequence
taatacagctatggttttaa

SEQ ID NO: 430959 - DNA, 20 bp, Artificial
  CRISPR gRNA sequence
tggttttaatgtgtccccca

SEQ ID NO: 430960 - DNA, 20 bp, Artificial
  CRISPR gRNA sequence
taatgtgtcccccaaaaggc

SEQ ID NO: 430961 - DNA, 20 bp, Artificial
  CRISPR gRNA sequence
aatgtgtcccccaaaaggcc

SEQ ID NO: 430962 - DNA, 20 bp, Artificial
  CRISPR gRNA sequence
atgtgtcccccaaaaggcca

SEQ ID NO: 430963 - DNA, 20 bp, Artificial
  CRISPR gRNA sequence
gaaacttaattaccattgta

SEQ ID NO: 430964 - DNA, 20 bp, Artificial
  CRISPR gRNA sequence
aattaccattgtaatagtat

SEQ ID NO: 430965 - DNA, 20 bp, Artificial
  CRISPR gRNA sequence
attaccattgtaatagtatt

SEQ ID NO: 430966 - DNA, 20 bp, Artificial
  CRISPR gRNA sequence
ccattgtaatagtattaagt

SEQ ID NO: 430967 - DNA, 20 bp, Artificial
  CRISPR gRNA sequence
taatagtattaagtggtaat

SEQ ID NO: 430968 - DNA, 20 bp, Artificial
  CRISPR gRNA sequence
agtggtaatgcttttaagag

SEQ ID NO: 430969 - DNA, 20 bp, Artificial
  CRISPR gRNA sequence
ttaagaggtgattaggccat

SEQ ID NO: 430970 - DNA, 20 bp, Artificial
  CRISPR gRNA sequence
taagaggtgattaggccatg

SEQ ID NO: 430971 - DNA, 20 bp, Artificial
  CRISPR gRNA sequence
aagaggtgattaggccatga

SEQ ID NO: 430972 - DNA, 20 bp, Artificial
  CRISPR gRNA sequence
agaggtgattaggccatgaa

SEQ ID NO: 430973 - DNA, 20 bp, Artificial
  CRISPR gRNA sequence
ggccatgaagatctgccctc

SEQ ID NO: 430974 - DNA, 20 bp, Artificial
  CRISPR gRNA sequence
ccctcatgaagggattaatg

SEQ ID NO: 430975 - DNA, 20 bp, Artificial
  CRISPR gRNA sequence
atgaagggattaatgccatt

SEQ ID NO: 430976 - DNA, 20 bp, Artificial
  CRISPR gRNA sequence
atgccattatctcaggagtg

SEQ ID NO: 430977 - DNA, 20 bp, Artificial
  CRISPR gRNA sequence
tctcaggagtgggttaggta

SEQ ID NO: 430978 - DNA, 20 bp, Artificial
  CRISPR gRNA sequence
aggagtgggttaggtatcat

SEQ ID NO: 430979 - DNA, 20 bp, Artificial
  CRISPR gRNA sequence
ggtatcatgggagtaagttc

SEQ ID NO: 430980 - DNA, 20 bp, Artificial
  CRISPR gRNA sequence
ctaattaaaaggatgaattt

SEQ ID NO: 430981 - DNA, 20 bp, Artificial
  CRISPR gRNA sequence
attaaaaggatgaatttggc

SEQ ID NO: 430982 - DNA, 20 bp, Artificial
  CRISPR gRNA sequence
aaaggatgaatttggcctca

SEQ ID NO: 430983 - DNA, 20 bp, Artificial
  CRISPR gRNA sequence
ggcctcatttctctctctct

SEQ ID NO: 430984 - DNA, 20 bp, Artificial
  CRISPR gRNA sequence
gcctcatttctctctctctc

SEQ ID NO: 430985 - DNA, 20 bp, Artificial
  CRISPR gRNA sequence
atttctctctctctctcaca

SEQ ID NO: 430986 - DNA, 20 bp, Artificial
  CRISPR gRNA sequence
ctctctctctctcacatgca

SEQ ID NO: 430987 - DNA, 20 bp, Artificial
  CRISPR gRNA sequence
tctctctctctcacatgcat

SEQ ID NO: 430988 - DNA, 20 bp, Artificial
  CRISPR gRNA sequence
tctctctctcacatgcatgc

SEQ ID NO: 430989 - DNA, 20 bp, Artificial
  CRISPR gRNA sequence
tctctctcacatgcatgcac

SEQ ID NO: 430990 - DNA, 20 bp, Artificial
  CRISPR gRNA sequence
tctctcacatgcatgcactc

SEQ ID NO: 430991 - DNA, 20 bp, Artificial
  CRISPR gRNA sequence
tctcacatgcatgcactcat

SEQ ID NO: 430992 - DNA, 20 bp, Artificial
  CRISPR gRNA sequence
tcacatgcatgcactcatca

SEQ ID NO: 430993 - DNA, 20 bp, Artificial
  CRISPR gRNA sequence
acatgcatgcactcatcaca

SEQ ID NO: 430994 - DNA, 20 bp, Artificial
  CRISPR gRNA sequence
atcacatgatgccttctgcc

SEQ ID NO: 430995 - DNA, 20 bp, Artificial
  CRISPR gRNA sequence
ctgccgtgggatgaacctcg

SEQ ID NO: 430996 - DNA, 20 bp, Artificial
  CRISPR gRNA sequence
tgccgtgggatgaacctcgc

SEQ ID NO: 430997 - DNA, 20 bp, Artificial
  CRISPR gRNA sequence
ccgtgggatgaacctcgcca

SEQ ID NO: 430998 - DNA, 20 bp, Artificial
  CRISPR gRNA sequence
gccaaatacaccatgctcct

SEQ ID NO: 430999 - DNA, 20 bp, Artificial
  CRISPR gRNA sequence
ctggacttcccagcctccag

SEQ ID NO: 431000 - DNA, 20 bp, Artificial
  CRISPR gRNA sequence
gacttcccagcctccagaac

SEQ ID NO: 431001 - DNA, 20 bp, Artificial
  CRISPR gRNA sequence
cccagcctccagaaccatga

SEQ ID NO: 431002 - DNA, 20 bp, Artificial
  CRISPR gRNA sequence
ccagcctccagaaccatgag

SEQ ID NO: 431003 - DNA, 20 bp, Artificial
  CRISPR gRNA sequence
cagaaccatgagccaaataa

SEQ ID NO: 431004 - DNA, 20 bp, Artificial
  CRISPR gRNA sequence
cttttctttataaatttccc

SEQ ID NO: 431005 - DNA, 20 bp, Artificial
  CRISPR gRNA sequence
ttttctttataaatttccca

SEQ ID NO: 431006 - DNA, 20 bp, Artificial
  CRISPR gRNA sequence
ttctttataaatttcccaat

SEQ ID NO: 431007 - DNA, 20 bp, Artificial
  CRISPR gRNA sequence
tctttataaatttcccaata

SEQ ID NO: 431008 - DNA, 20 bp, Artificial
  CRISPR gRNA sequence
ctttataaatttcccaataa

SEQ ID NO: 431009 - DNA, 20 bp, Artificial
  CRISPR gRNA sequence
tttataaatttcccaataat

SEQ ID NO: 431010 - DNA, 20 bp, Artificial
  CRISPR gRNA sequence
tataaatttcccaataattg

SEQ ID NO: 431011 - DNA, 20 bp, Artificial
  CRISPR gRNA sequence
ataaatttcccaataattgt

SEQ ID NO: 431012 - DNA, 20 bp, Artificial
  CRISPR gRNA sequence
taaatttcccaataattgta

SEQ ID NO: 431013 - DNA, 20 bp, Artificial
  CRISPR gRNA sequence
cccaataattgtattctgtt

SEQ ID NO: 431014 - DNA, 20 bp, Artificial
  CRISPR gRNA sequence
ccaataattgtattctgtta

SEQ ID NO: 431015 - DNA, 20 bp, Artificial
  CRISPR gRNA sequence
tattctgttacagcggcaga

SEQ ID NO: 431016 - DNA, 20 bp, Artificial
  CRISPR gRNA sequence
tgttacagcggcagaaaata

SEQ ID NO: 431017 - DNA, 20 bp, Artificial
  CRISPR gRNA sequence
ttacagcggcagaaaataga

SEQ ID NO: 431018 - DNA, 20 bp, Artificial
  CRISPR gRNA sequence
cagcggcagaaaatagacta

SEQ ID NO: 431019 - DNA, 20 bp, Artificial
  CRISPR gRNA sequence
agacaaatccccattttata

SEQ ID NO: 431020 - DNA, 20 bp, Artificial
  CRISPR gRNA sequence
tatatataaggaaatgaaga

SEQ ID NO: 431021 - DNA, 20 bp, Artificial
  CRISPR gRNA sequence
atatataaggaaatgaagac

SEQ ID NO: 431022 - DNA, 20 bp, Artificial
  CRISPR gRNA sequence
tatataaggaaatgaagacc

SEQ ID NO: 431023 - DNA, 20 bp, Artificial
  CRISPR gRNA sequence
gaaagattaagtaactttcc

SEQ ID NO: 431024 - DNA, 20 bp, Artificial
  CRISPR gRNA sequence
aaagattaagtaactttcct

SEQ ID NO: 431025 - DNA, 20 bp, Artificial
  CRISPR gRNA sequence
agtaactttcctaaaagcat

SEQ ID NO: 431026 - DNA, 20 bp, Artificial
  CRISPR gRNA sequence
tcctaaaagcatacactcag

SEQ ID NO: 431027 - DNA, 20 bp, Artificial
  CRISPR gRNA sequence
cctaaaagcatacactcagt

SEQ ID NO: 431028 - DNA, 20 bp, Artificial
  CRISPR gRNA sequence
ctaaaagcatacactcagtg

SEQ ID NO: 431029 - DNA, 20 bp, Artificial
  CRISPR gRNA sequence
aaagcatacactcagtgcca

SEQ ID NO: 431030 - DNA, 20 bp, Artificial
  CRISPR gRNA sequence
agtgccaaaactagaaacta

SEQ ID NO: 431031 - DNA, 20 bp, Artificial
  CRISPR gRNA sequence
gaaactagatctttcaattc

SEQ ID NO: 431032 - DNA, 20 bp, Artificial
  CRISPR gRNA sequence
gatctttcaattccccattc

SEQ ID NO: 431033 - DNA, 20 bp, Artificial
  CRISPR gRNA sequence
tcaattccccattcattact

SEQ ID NO: 431034 - DNA, 20 bp, Artificial
  CRISPR gRNA sequence
caattccccattcattactc

SEQ ID NO: 431035 - DNA, 20 bp, Artificial
  CRISPR gRNA sequence
aattccccattcattactct

SEQ ID NO: 431036 - DNA, 20 bp, Artificial
  CRISPR gRNA sequence
cccattcattactctttcag

SEQ ID NO: 431037 - DNA, 20 bp, Artificial
  CRISPR gRNA sequence
attactctttcagccacata

SEQ ID NO: 431038 - DNA, 20 bp, Artificial
  CRISPR gRNA sequence
ctctttcagccacataagct

SEQ ID NO: 431039 - DNA, 20 bp, Artificial
  CRISPR gRNA sequence
tttcagccacataagctctt

SEQ ID NO: 431040 - DNA, 20 bp, Artificial
  CRISPR gRNA sequence
tcagccacataagctcttaa

SEQ ID NO: 431041 - DNA, 20 bp, Artificial
  CRISPR gRNA sequence
cagccacataagctcttaag

SEQ ID NO: 431042 - DNA, 20 bp, Artificial
  CRISPR gRNA sequence
agccacataagctcttaagc

SEQ ID NO: 431043 - DNA, 20 bp, Artificial
  CRISPR gRNA sequence
ttaagctaaacagaggattt

SEQ ID NO: 431044 - DNA, 20 bp, Artificial
  CRISPR gRNA sequence
aagctaaacagaggatttac

SEQ ID NO: 431045 - DNA, 20 bp, Artificial
  CRISPR gRNA sequence
agctaaacagaggatttaca

SEQ ID NO: 431046 - DNA, 20 bp, Artificial
  CRISPR gRNA sequence
aacagaggatttacaacctg

SEQ ID NO: 431047 - DNA, 20 bp, Artificial
  CRISPR gRNA sequence
acaacctgctgatcttgcca

SEQ ID NO: 431048 - DNA, 20 bp, Artificial
  CRISPR gRNA sequence
caacctgctgatcttgccat

SEQ ID NO: 431049 - DNA, 20 bp, Artificial
  CRISPR gRNA sequence
ctgatcttgccatgcccact

SEQ ID NO: 431050 - DNA, 20 bp, Artificial
  CRISPR gRNA sequence
atcttgccatgcccacttta

SEQ ID NO: 431051 - DNA, 20 bp, Artificial
  CRISPR gRNA sequence
gccatgcccactttaccacc

SEQ ID NO: 431052 - DNA, 20 bp, Artificial
  CRISPR gRNA sequence
ccatgcccactttaccacca

SEQ ID NO: 431053 - DNA, 20 bp, Artificial
  CRISPR gRNA sequence
taccaccaattttttttttt

SEQ ID NO: 431054 - DNA, 20 bp, Artificial
  CRISPR gRNA sequence
accaccaatttttttttttt

SEQ ID NO: 431055 - DNA, 20 bp, Artificial
  CRISPR gRNA sequence
ccaccaattttttttttttt

SEQ ID NO: 431056 - DNA, 20 bp, Artificial
  CRISPR gRNA sequence
ttttttttttttagagatag

SEQ ID NO: 431057 - DNA, 20 bp, Artificial
  CRISPR gRNA sequence
tttttttttttagagataga

SEQ ID NO: 431058 - DNA, 20 bp, Artificial
  CRISPR gRNA sequence
ttttttttttagagatagag

SEQ ID NO: 431059 - DNA, 20 bp, Artificial
  CRISPR gRNA sequence
tttttttttagagatagagt

SEQ ID NO: 431060 - DNA, 20 bp, Artificial
  CRISPR gRNA sequence
ttttttttagagatagagtc

SEQ ID NO: 431061 - DNA, 20 bp, Artificial
  CRISPR gRNA sequence
tttttttagagatagagtct

SEQ ID NO: 431062 - DNA, 20 bp, Artificial
  CRISPR gRNA sequence
ttttttagagatagagtctt

SEQ ID NO: 431063 - DNA, 20 bp, Artificial
  CRISPR gRNA sequence
tttttagagatagagtcttg

SEQ ID NO: 431064 - DNA, 20 bp, Artificial
  CRISPR gRNA sequence
ttttagagatagagtcttgc

SEQ ID NO: 431065 - DNA, 20 bp, Artificial
  CRISPR gRNA sequence
tttagagatagagtcttgct

SEQ ID NO: 431066 - DNA, 20 bp, Artificial
  CRISPR gRNA sequence
ttagagatagagtcttgctc

SEQ ID NO: 431067 - DNA, 20 bp, Artificial
  CRISPR gRNA sequence
tagagatagagtcttgctct

SEQ ID NO: 431068 - DNA, 20 bp, Artificial
  CRISPR gRNA sequence
agagatagagtcttgctctg

SEQ ID NO: 431069 - DNA, 20 bp, Artificial
  CRISPR gRNA sequence
gagatagagtcttgctctgt

SEQ ID NO: 431070 - DNA, 20 bp, Artificial
  CRISPR gRNA sequence
gctctgttgcccacgctgga

SEQ ID NO: 431071 - DNA, 20 bp, Artificial
  CRISPR gRNA sequence
ctctgttgcccacgctggag

SEQ ID NO: 431072 - DNA, 20 bp, Artificial
  CRISPR gRNA sequence
tgttgcccacgctggagtgc

SEQ ID NO: 431073 - DNA, 20 bp, Artificial
  CRISPR gRNA sequence
ttgcccacgctggagtgcag

SEQ ID NO: 431074 - DNA, 20 bp, Artificial
  CRISPR gRNA sequence
cccacgctggagtgcagtca

SEQ ID NO: 431075 - DNA, 20 bp, Artificial
  CRISPR gRNA sequence
gagtgcagtcatagctcact

SEQ ID NO: 431076 - DNA, 20 bp, Artificial
  CRISPR gRNA sequence
actgcagccttgaactccta

SEQ ID NO: 431077 - DNA, 20 bp, Artificial
  CRISPR gRNA sequence
cagccttgaactcctagagt

SEQ ID NO: 431078 - DNA, 20 bp, Artificial
  CRISPR gRNA sequence
gaactcctagagtcaagtga

SEQ ID NO: 431079 - DNA, 20 bp, Artificial
  CRISPR gRNA sequence
aactcctagagtcaagtgat

SEQ ID NO: 431080 - DNA, 20 bp, Artificial
  CRISPR gRNA sequence
ctagagtcaagtgatcctcc

SEQ ID NO: 431081 - DNA, 20 bp, Artificial
  CRISPR gRNA sequence
gagtcaagtgatcctcccgc

SEQ ID NO: 431082 - DNA, 20 bp, Artificial
  CRISPR gRNA sequence
ccgccacagtctcccgagtg

SEQ ID NO: 431083 - DNA, 20 bp, Artificial
  CRISPR gRNA sequence
ccgagtgggtggaattatgt

SEQ ID NO: 431084 - DNA, 20 bp, Artificial
  CRISPR gRNA sequence
tgtctattgtgatagccaac

SEQ ID NO: 431085 - DNA, 20 bp, Artificial
  CRISPR gRNA sequence
ttgtgatagccaacacataa

SEQ ID NO: 431086 - DNA, 20 bp, Artificial
  CRISPR gRNA sequence
tgatagccaacacataaatg

SEQ ID NO: 431087 - DNA, 20 bp, Artificial
  CRISPR gRNA sequence
cagatcattgactttcccaa

SEQ ID NO: 431088 - DNA, 20 bp, Artificial
  CRISPR gRNA sequence
actttcccaatagcaccagc

SEQ ID NO: 431089 - DNA, 20 bp, Artificial
  CRISPR gRNA sequence
tcccaatagcaccagccata

SEQ ID NO: 431090 - DNA, 20 bp, Artificial
  CRISPR gRNA sequence
cccaatagcaccagccatat

SEQ ID NO: 431091 - DNA, 20 bp, Artificial
  CRISPR gRNA sequence
ccaatagcaccagccatatc

SEQ ID NO: 431092 - DNA, 20 bp, Artificial
  CRISPR gRNA sequence
tggcttctgaggtgtgagcc

SEQ ID NO: 431093 - DNA, 20 bp, Artificial
  CRISPR gRNA sequence
ctgaggtgtgagccacagct

SEQ ID NO: 431094 - DNA, 20 bp, Artificial
  CRISPR gRNA sequence
tgaggtgtgagccacagctc

SEQ ID NO: 431095 - DNA, 20 bp, Artificial
  CRISPR gRNA sequence
aggtgtgagccacagctcct

SEQ ID NO: 431096 - DNA, 20 bp, Artificial
  CRISPR gRNA sequence
ctggcctaaccctacatttt

SEQ ID NO: 431097 - DNA, 20 bp, Artificial
  CRISPR gRNA sequence
gcctaaccctacatttttgg

SEQ ID NO: 431098 - DNA, 20 bp, Artificial
  CRISPR gRNA sequence
accctacatttttggagtgt

SEQ ID NO: 431099 - DNA, 20 bp, Artificial
  CRISPR gRNA sequence
catttttggagtgtttattt

SEQ ID NO: 431100 - DNA, 20 bp, Artificial
  CRISPR gRNA sequence
ttggagtgtttatttctcat

SEQ ID NO: 431101 - DNA, 20 bp, Artificial
  CRISPR gRNA sequence
tggagtgtttatttctcatt

SEQ ID NO: 431102 - DNA, 20 bp, Artificial
  CRISPR gRNA sequence
ggagtgtttatttctcattc

SEQ ID NO: 431103 - DNA, 20 bp, Artificial
  CRISPR gRNA sequence
gagtgtttatttctcattct

SEQ ID NO: 431104 - DNA, 20 bp, Artificial
  CRISPR gRNA sequence
atttctcattctacagacat

SEQ ID NO: 431105 - DNA, 20 bp, Artificial
  CRISPR gRNA sequence
tttctcattctacagacatg

SEQ ID NO: 431106 - DNA, 20 bp, Artificial
  CRISPR gRNA sequence
ctcattctacagacatgctg

SEQ ID NO: 431107 - DNA, 20 bp, Artificial
  CRISPR gRNA sequence
tcattctacagacatgctgg

SEQ ID NO: 431108 - DNA, 20 bp, Artificial
  CRISPR gRNA sequence
attctacagacatgctgggt

SEQ ID NO: 431109 - DNA, 20 bp, Artificial
  CRISPR gRNA sequence
tacagacatgctgggtaacc

SEQ ID NO: 431110 - DNA, 20 bp, Artificial
  CRISPR gRNA sequence
cagacatgctgggtaaccta

SEQ ID NO: 431111 - DNA, 20 bp, Artificial
  CRISPR gRNA sequence
ggtaacctagcactaccaga

SEQ ID NO: 431112 - DNA, 20 bp, Artificial
  CRISPR gRNA sequence
gcactaccagagagttgtaa

SEQ ID NO: 431113 - DNA, 20 bp, Artificial
  CRISPR gRNA sequence
ccagagagttgtaataatca

SEQ ID NO: 431114 - DNA, 20 bp, Artificial
  CRISPR gRNA sequence
taataatcaaaagagctaat

SEQ ID NO: 431115 - DNA, 20 bp, Artificial
  CRISPR gRNA sequence
atgtgcagaaagctctagca

SEQ ID NO: 431116 - DNA, 20 bp, Artificial
  CRISPR gRNA sequence
tagcatatatagatgcccac

SEQ ID NO: 431117 - DNA, 20 bp, Artificial
  CRISPR gRNA sequence
gcatatatagatgcccacga

SEQ ID NO: 431118 - DNA, 20 bp, Artificial
  CRISPR gRNA sequence
aactctcagagcagtggctt

SEQ ID NO: 431119 - DNA, 20 bp, Artificial
  CRISPR gRNA sequence
tcagagcagtggcttaaggg

SEQ ID NO: 431120 - DNA, 20 bp, Artificial
  CRISPR gRNA sequence
agagcagtggcttaagggat

SEQ ID NO: 431121 - DNA, 20 bp, Artificial
  CRISPR gRNA sequence
aagggataagcagaaaccag

SEQ ID NO: 431122 - DNA, 20 bp, Artificial
  CRISPR gRNA sequence
agggataagcagaaaccagg

SEQ ID NO: 431123 - DNA, 20 bp, Artificial
  CRISPR gRNA sequence
caaatgacagcaagatgggt

SEQ ID NO: 431124 - DNA, 20 bp, Artificial
  CRISPR gRNA sequence
tccagggggtccctccctat

SEQ ID NO: 431125 - DNA, 20 bp, Artificial
  CRISPR gRNA sequence
cctatgagagggacaacgga

SEQ ID NO: 431126 - DNA, 20 bp, Artificial
  CRISPR gRNA sequence
tgagagggacaacggaagag

SEQ ID NO: 431127 - DNA, 20 bp, Artificial
  CRISPR gRNA sequence
cactaataggcagaacaaat

SEQ ID NO: 431128 - DNA, 20 bp, Artificial
  CRISPR gRNA sequence
ataggcagaacaaatgccag

SEQ ID NO: 431129 - DNA, 20 bp, Artificial
  CRISPR gRNA sequence
gggaagatcacatctgggtc

SEQ ID NO: 431130 - DNA, 20 bp, Artificial
  CRISPR gRNA sequence
ggtctctctctgggtggaaa

SEQ ID NO: 431131 - DNA, 20 bp, Artificial
  CRISPR gRNA sequence
tctctgggtggaaagagaac

SEQ ID NO: 431132 - DNA, 20 bp, Artificial
  CRISPR gRNA sequence
tctgggtggaaagagaacct

SEQ ID NO: 431133 - DNA, 20 bp, Artificial
  CRISPR gRNA sequence
tgggtggaaagagaacctga

SEQ ID NO: 431134 - DNA, 20 bp, Artificial
  CRISPR gRNA sequence
ggtggaaagagaacctgaaa

SEQ ID NO: 431135 - DNA, 20 bp, Artificial
  CRISPR gRNA sequence
aaaggacccgggtgccagac

SEQ ID NO: 431136 - DNA, 20 bp, Artificial
  CRISPR gRNA sequence
cggtgtgcagccggagccat

SEQ ID NO: 431137 - DNA, 20 bp, Artificial
  CRISPR gRNA sequence
cctttctagtcaacgcgacc

SEQ ID NO: 431138 - DNA, 20 bp, Artificial
  CRISPR gRNA sequence
tctagtcaacgcgaccacca

SEQ ID NO: 431139 - DNA, 20 bp, Artificial
  CRISPR gRNA sequence
ctagtcaacgcgaccaccac

SEQ ID NO: 431140 - DNA, 20 bp, Artificial
  CRISPR gRNA sequence
tagtcaacgcgaccaccacg

SEQ ID NO: 431141 - DNA, 20 bp, Artificial
  CRISPR gRNA sequence
gtcaacgcgaccaccacgat

SEQ ID NO: 431142 - DNA, 20 bp, Artificial
  CRISPR gRNA sequence
ctgtgcagatgaccaccagc

SEQ ID NO: 431143 - DNA, 20 bp, Artificial
  CRISPR gRNA sequence
tgcagatgaccaccagcgtc

SEQ ID NO: 431144 - DNA, 20 bp, Artificial
  CRISPR gRNA sequence
caagcaatggaatctggaac

SEQ ID NO: 431145 - DNA, 20 bp, Artificial
  CRISPR gRNA sequence
gaacctggcaccgtgctcag

SEQ ID NO: 431146 - DNA, 20 bp, Artificial
  CRISPR gRNA sequence
gcaccgtgctcagccactag

SEQ ID NO: 431147 - DNA, 20 bp, Artificial
  CRISPR gRNA sequence
agccactagagggaggacaa

SEQ ID NO: 431148 - DNA, 20 bp, Artificial
  CRISPR gRNA sequence
gagggaggacaaaacagaga

SEQ ID NO: 431149 - DNA, 20 bp, Artificial
  CRISPR gRNA sequence
atttccccagggcagcctga

SEQ ID NO: 431150 - DNA, 20 bp, Artificial
  CRISPR gRNA sequence
ccccagggcagcctgagctt

SEQ ID NO: 431151 - DNA, 20 bp, Artificial
  CRISPR gRNA sequence
cccagggcagcctgagcttc

SEQ ID NO: 431152 - DNA, 20 bp, Artificial
  CRISPR gRNA sequence
agcttcacggcagagagggg

SEQ ID NO: 431153 - DNA, 20 bp, Artificial
  CRISPR gRNA sequence
cacggcagagaggggaggat

SEQ ID NO: 431154 - DNA, 20 bp, Artificial
  CRISPR gRNA sequence
acggcagagaggggaggatt

SEQ ID NO: 431155 - DNA, 20 bp, Artificial
  CRISPR gRNA sequence
gccaagccctttgtgtaacc

SEQ ID NO: 431156 - DNA, 20 bp, Artificial
  CRISPR gRNA sequence
tgtgtaaccatgggactgga

SEQ ID NO: 431157 - DNA, 20 bp, Artificial
  CRISPR gRNA sequence
gtgtaaccatgggactggag

SEQ ID NO: 431158 - DNA, 20 bp, Artificial
  CRISPR gRNA sequence
tgtaaccatgggactggagc

SEQ ID NO: 431159 - DNA, 20 bp, Artificial
  CRISPR gRNA sequence
gagcctttaagcccaacact

SEQ ID NO: 431160 - DNA, 20 bp, Artificial
  CRISPR gRNA sequence
taagcccaacactttgaaca

SEQ ID NO: 431161 - DNA, 20 bp, Artificial
  CRISPR gRNA sequence
aagcccaacactttgaacag

SEQ ID NO: 431162 - DNA, 20 bp, Artificial
  CRISPR gRNA sequence
agcccaacactttgaacagc

SEQ ID NO: 431163 - DNA, 20 bp, Artificial
  CRISPR gRNA sequence
tgaacagcagagtatccatc

SEQ ID NO: 431164 - DNA, 20 bp, Artificial
  CRISPR gRNA sequence
gaacagcagagtatccatct

SEQ ID NO: 431165 - DNA, 20 bp, Artificial
  CRISPR gRNA sequence
aacagcagagtatccatctg

SEQ ID NO: 431166 - DNA, 20 bp, Artificial
  CRISPR gRNA sequence
gcccatcatgaaatcaatga

SEQ ID NO: 431167 - DNA, 20 bp, Artificial
  CRISPR gRNA sequence
atattttcagcagtggtgta

SEQ ID NO: 431168 - DNA, 20 bp, Artificial
  CRISPR gRNA sequence
tcagcagtggtgtaccttgt

SEQ ID NO: 431169 - DNA, 20 bp, Artificial
  CRISPR gRNA sequence
cagcagtggtgtaccttgta

SEQ ID NO: 431170 - DNA, 20 bp, Artificial
  CRISPR gRNA sequence
agcagtggtgtaccttgtat

SEQ ID NO: 431171 - DNA, 20 bp, Artificial
  CRISPR gRNA sequence
gtatatttgataccagagca

SEQ ID NO: 431172 - DNA, 20 bp, Artificial
  CRISPR gRNA sequence
tatatttgataccagagcag

SEQ ID NO: 431173 - DNA, 20 bp, Artificial
  CRISPR gRNA sequence
gataccagagcaggtcattt

SEQ ID NO: 431174 - DNA, 20 bp, Artificial
  CRISPR gRNA sequence
ataccagagcaggtcatttt

SEQ ID NO: 431175 - DNA, 20 bp, Artificial
  CRISPR gRNA sequence
taacattcgtttcttctatt

SEQ ID NO: 431176 - DNA, 20 bp, Artificial
  CRISPR gRNA sequence
aacattcgtttcttctattt

SEQ ID NO: 431177 - DNA, 20 bp, Artificial
  CRISPR gRNA sequence
acattcgtttcttctatttg

SEQ ID NO: 431178 - DNA, 20 bp, Artificial
  CRISPR gRNA sequence
gtttcttctatttgacaaaa

SEQ ID NO: 431179 - DNA, 20 bp, Artificial
  CRISPR gRNA sequence
cttctatttgacaaaatcat

SEQ ID NO: 431180 - DNA, 20 bp, Artificial
  CRISPR gRNA sequence
ttctatttgacaaaatcatt

SEQ ID NO: 431181 - DNA, 20 bp, Artificial
  CRISPR gRNA sequence
ctatttgacaaaatcatttt

SEQ ID NO: 431182 - DNA, 20 bp, Artificial
  CRISPR gRNA sequence
tatttgacaaaatcattttt

SEQ ID NO: 431183 - DNA, 20 bp, Artificial
  CRISPR gRNA sequence
tttgacaaaatcatttttgg

SEQ ID NO: 431184 - DNA, 20 bp, Artificial
  CRISPR gRNA sequence
gacaaaatcatttttggtaa

SEQ ID NO: 431185 - DNA, 20 bp, Artificial
  CRISPR gRNA sequence
acaaaatcatttttggtaat

SEQ ID NO: 431186 - DNA, 20 bp, Artificial
  CRISPR gRNA sequence
ttggtaatcatgaaatgaaa

SEQ ID NO: 431187 - DNA, 20 bp, Artificial
  CRISPR gRNA sequence
tggtaatcatgaaatgaaac

SEQ ID NO: 431188 - DNA, 20 bp, Artificial
  CRISPR gRNA sequence
ggtaatcatgaaatgaaaca

SEQ ID NO: 431189 - DNA, 20 bp, Artificial
  CRISPR gRNA sequence
gtaatcatgaaatgaaacaa

SEQ ID NO: 431190 - DNA, 20 bp, Artificial
  CRISPR gRNA sequence
cagaaaaaaactcagaaagt

SEQ ID NO: 431191 - DNA, 20 bp, Artificial
  CRISPR gRNA sequence
agaaagtgaatattttcttt

SEQ ID NO: 431192 - DNA, 20 bp, Artificial
  CRISPR gRNA sequence
tcttttattgaacttcaaat

SEQ ID NO: 431193 - DNA, 20 bp, Artificial
  CRISPR gRNA sequence
cttttattgaacttcaaata

SEQ ID NO: 431194 - DNA, 20 bp, Artificial
  CRISPR gRNA sequence
ttttattgaacttcaaatat

SEQ ID NO: 431195 - DNA, 20 bp, Artificial
  CRISPR gRNA sequence
ttattgaacttcaaatatga

SEQ ID NO: 431196 - DNA, 20 bp, Artificial
  CRISPR gRNA sequence
tattgaacttcaaatatgaa

SEQ ID NO: 431197 - DNA, 20 bp, Artificial
  CRISPR gRNA sequence
attgaacttcaaatatgaaa

SEQ ID NO: 431198 - DNA, 20 bp, Artificial
  CRISPR gRNA sequence
ttgaacttcaaatatgaaat

SEQ ID NO: 431199 - DNA, 20 bp, Artificial
  CRISPR gRNA sequence
aacttcaaatatgaaatcat

SEQ ID NO: 431200 - DNA, 20 bp, Artificial
  CRISPR gRNA sequence
caaatatgaaatcatatcaa

SEQ ID NO: 431201 - DNA, 20 bp, Artificial
  CRISPR gRNA sequence
aaatatgaaatcatatcaat

SEQ ID NO: 431202 - DNA, 20 bp, Artificial
  CRISPR gRNA sequence
aattcaaaattaaaataaag

SEQ ID NO: 431203 - DNA, 20 bp, Artificial
  CRISPR gRNA sequence
attcaaaattaaaataaagt

SEQ ID NO: 431204 - DNA, 20 bp, Artificial
  CRISPR gRNA sequence
aaaattaaaataaagttaac

SEQ ID NO: 431205 - DNA, 20 bp, Artificial
  CRISPR gRNA sequence
aaataaagttaacattaaat

SEQ ID NO: 431206 - DNA, 20 bp, Artificial
  CRISPR gRNA sequence
acattaaattacaaaaatga

SEQ ID NO: 431207 - DNA, 20 bp, Artificial
  CRISPR gRNA sequence
aattacaaaaatgaaaaaaa

SEQ ID NO: 431208 - DNA, 20 bp, Artificial
  CRISPR gRNA sequence
caaaaatgaaaaaaagtatg

SEQ ID NO: 431209 - DNA, 20 bp, Artificial
  CRISPR gRNA sequence
ttcccttaagcctataacac

SEQ ID NO: 431210 - DNA, 20 bp, Artificial
  CRISPR gRNA sequence
tcccttaagcctataacact

SEQ ID NO: 431211 - DNA, 20 bp, Artificial
  CRISPR gRNA sequence
cccttaagcctataacactt

SEQ ID NO: 431212 - DNA, 20 bp, Artificial
  CRISPR gRNA sequence
ccttaagcctataacactta

SEQ ID NO: 431213 - DNA, 20 bp, Artificial
  CRISPR gRNA sequence
aagcctataacacttatttc

SEQ ID NO: 431214 - DNA, 20 bp, Artificial
  CRISPR gRNA sequence
agcctataacacttatttcc

SEQ ID NO: 431215 - DNA, 20 bp, Artificial
  CRISPR gRNA sequence
taacacttatttccagctag

SEQ ID NO: 431216 - DNA, 20 bp, Artificial
  CRISPR gRNA sequence
atttccagctaggctgtgaa

SEQ ID NO: 431217 - DNA, 20 bp, Artificial
  CRISPR gRNA sequence
tttccagctaggctgtgaaa

SEQ ID NO: 431218 - DNA, 20 bp, Artificial
  CRISPR gRNA sequence
ccagctaggctgtgaaaccc

SEQ ID NO: 431219 - DNA, 20 bp, Artificial
  CRISPR gRNA sequence
cagctaggctgtgaaaccct

SEQ ID NO: 431220 - DNA, 20 bp, Artificial
  CRISPR gRNA sequence
ggctgtgaaaccctggaggg

SEQ ID NO: 431221 - DNA, 20 bp, Artificial
  CRISPR gRNA sequence
tgaaaccctggagggcatga

SEQ ID NO: 431222 - DNA, 20 bp, Artificial
  CRISPR gRNA sequence
gagggcatgaggctctggac

SEQ ID NO: 431223 - DNA, 20 bp, Artificial
  CRISPR gRNA sequence
tggactcttatcctttgctg

SEQ ID NO: 431224 - DNA, 20 bp, Artificial
  CRISPR gRNA sequence
gactcttatcctttgctgtt

SEQ ID NO: 431225 - DNA, 20 bp, Artificial
  CRISPR gRNA sequence
ttatcctttgctgttttctc

SEQ ID NO: 431226 - DNA, 20 bp, Artificial
  CRISPR gRNA sequence
atcctttgctgttttctcag

SEQ ID NO: 431227 - DNA, 20 bp, Artificial
  CRISPR gRNA sequence
tcctttgctgttttctcagc

SEQ ID NO: 431228 - DNA, 20 bp, Artificial
  CRISPR gRNA sequence
tgctgttttctcagcatctg

SEQ ID NO: 431229 - DNA, 20 bp, Artificial
  CRISPR gRNA sequence
gctgttttctcagcatctga

SEQ ID NO: 431230 - DNA, 20 bp, Artificial
  CRISPR gRNA sequence
ctgttttctcagcatctgac

SEQ ID NO: 431231 - DNA, 20 bp, Artificial
  CRISPR gRNA sequence
ttttctcagcatctgacaca

SEQ ID NO: 431232 - DNA, 20 bp, Artificial
  CRISPR gRNA sequence
tctcagcatctgacacatag

SEQ ID NO: 431233 - DNA, 20 bp, Artificial
  CRISPR gRNA sequence
ctcagcatctgacacatagc

SEQ ID NO: 431234 - DNA, 20 bp, Artificial
  CRISPR gRNA sequence
tcagcatctgacacatagcg

SEQ ID NO: 431235 - DNA, 20 bp, Artificial
  CRISPR gRNA sequence
agcatctgacacatagcgaa

SEQ ID NO: 431236 - DNA, 20 bp, Artificial
  CRISPR gRNA sequence
acacatagcgaatgctcagt

SEQ ID NO: 431237 - DNA, 20 bp, Artificial
  CRISPR gRNA sequence
agtaaatataaatatttgtg

SEQ ID NO: 431238 - DNA, 20 bp, Artificial
  CRISPR gRNA sequence
gtggcataagtgaaatcatg

SEQ ID NO: 431239 - DNA, 20 bp, Artificial
  CRISPR gRNA sequence
tggcataagtgaaatcatga

SEQ ID NO: 431240 - DNA, 20 bp, Artificial
  CRISPR gRNA sequence
gtgcatttcattaagagata

SEQ ID NO: 431241 - DNA, 20 bp, Artificial
  CRISPR gRNA sequence
cattaagagataacatgtaa

SEQ ID NO: 431242 - DNA, 20 bp, Artificial
  CRISPR gRNA sequence
attaagagataacatgtaag

SEQ ID NO: 431243 - DNA, 20 bp, Artificial
  CRISPR gRNA sequence
agagataacatgtaagtgga

SEQ ID NO: 431244 - DNA, 20 bp, Artificial
  CRISPR gRNA sequence
tgaagagatgagtaagatct

SEQ ID NO: 431245 - DNA, 20 bp, Artificial
  CRISPR gRNA sequence
gaagagatgagtaagatctg

SEQ ID NO: 431246 - DNA, 20 bp, Artificial
  CRISPR gRNA sequence
aagagatgagtaagatctga

SEQ ID NO: 431247 - DNA, 20 bp, Artificial
  CRISPR gRNA sequence
acccaagaagaatgtgagaa

SEQ ID NO: 431248 - DNA, 20 bp, Artificial
  CRISPR gRNA sequence
cgctgtaggtaggtttccag

SEQ ID NO: 431249 - DNA, 20 bp, Artificial
  CRISPR gRNA sequence
taggtaggtttccagtctgc

SEQ ID NO: 431250 - DNA, 20 bp, Artificial
  CRISPR gRNA sequence
ccagtctgccccagcagctc

SEQ ID NO: 431251 - DNA, 20 bp, Artificial
  CRISPR gRNA sequence
cagtctgccccagcagctca

SEQ ID NO: 431252 - DNA, 20 bp, Artificial
  CRISPR gRNA sequence
ccccagcagctcaggtaggg

SEQ ID NO: 431253 - DNA, 20 bp, Artificial
  CRISPR gRNA sequence
aggtagggctcaggtatcca

SEQ ID NO: 431254 - DNA, 20 bp, Artificial
  CRISPR gRNA sequence
aggtatccaggggagtcttc

SEQ ID NO: 431255 - DNA, 20 bp, Artificial
  CRISPR gRNA sequence
caaaggatgcagcagaagcc

SEQ ID NO: 431256 - DNA, 20 bp, Artificial
  CRISPR gRNA sequence
aaaggatgcagcagaagcct

SEQ ID NO: 431257 - DNA, 20 bp, Artificial
  CRISPR gRNA sequence
acatctcatccctctaccta

SEQ ID NO: 431258 - DNA, 20 bp, Artificial
  CRISPR gRNA sequence
atccctctacctaagggtct

SEQ ID NO: 431259 - DNA, 20 bp, Artificial
  CRISPR gRNA sequence
tacctaagggtctgggttgc

SEQ ID NO: 431260 - DNA, 20 bp, Artificial
  CRISPR gRNA sequence
cctaagggtctgggttgcta

SEQ ID NO: 431261 - DNA, 20 bp, Artificial
  CRISPR gRNA sequence
agggtctgggttgctaaaag

SEQ ID NO: 431262 - DNA, 20 bp, Artificial
  CRISPR gRNA sequence
ggttgctaaaaggtggctta

SEQ ID NO: 431263 - DNA, 20 bp, Artificial
  CRISPR gRNA sequence
ctaaaaggtggcttaggaat

SEQ ID NO: 431264 - DNA, 20 bp, Artificial
  CRISPR gRNA sequence
aaaggtggcttaggaatcca

SEQ ID NO: 431265 - DNA, 20 bp, Artificial
  CRISPR gRNA sequence
aggaatccaatccataagac

SEQ ID NO: 431266 - DNA, 20 bp, Artificial
  CRISPR gRNA sequence
ggaatccaatccataagaca

SEQ ID NO: 431267 - DNA, 20 bp, Artificial
  CRISPR gRNA sequence
cacaattcaaattccccaga

SEQ ID NO: 431268 - DNA, 20 bp, Artificial
  CRISPR gRNA sequence
aaattccccagaacatgttc

SEQ ID NO: 431269 - DNA, 20 bp, Artificial
  CRISPR gRNA sequence
cccagaacatgttcctcctg

SEQ ID NO: 431270 - DNA, 20 bp, Artificial
  CRISPR gRNA sequence
ctcctgccttgagggactca

SEQ ID NO: 431271 - DNA, 20 bp, Artificial
  CRISPR gRNA sequence
ctgccttgagggactcagtc

SEQ ID NO: 431272 - DNA, 20 bp, Artificial
  CRISPR gRNA sequence
ccttgagggactcagtcaca

SEQ ID NO: 431273 - DNA, 20 bp, Artificial
  CRISPR gRNA sequence
gagggactcagtcacagttg

SEQ ID NO: 431274 - DNA, 20 bp, Artificial
  CRISPR gRNA sequence
agggactcagtcacagttgg

SEQ ID NO: 431275 - DNA, 20 bp, Artificial
  CRISPR gRNA sequence
agtcacagttggccaggacg

SEQ ID NO: 431276 - DNA, 20 bp, Artificial
  CRISPR gRNA sequence
gccaggacggcttctggtta

SEQ ID NO: 431277 - DNA, 20 bp, Artificial
  CRISPR gRNA sequence
ctggttagccatagccatac

SEQ ID NO: 431278 - DNA, 20 bp, Artificial
  CRISPR gRNA sequence
tggttagccatagccataca

SEQ ID NO: 431279 - DNA, 20 bp, Artificial
  CRISPR gRNA sequence
gttagccatagccatacagt

SEQ ID NO: 431280 - DNA, 20 bp, Artificial
  CRISPR gRNA sequence
gccatagccatacagttagc

SEQ ID NO: 431281 - DNA, 20 bp, Artificial
  CRISPR gRNA sequence
gctctggagtaaagaggaca

SEQ ID NO: 431282 - DNA, 20 bp, Artificial
  CRISPR gRNA sequence
tggagtaaagaggacagatg

SEQ ID NO: 431283 - DNA, 20 bp, Artificial
  CRISPR gRNA sequence
gagtaaagaggacagatgga

SEQ ID NO: 431284 - DNA, 20 bp, Artificial
  CRISPR gRNA sequence
cagcaggtaagaggggctgc

SEQ ID NO: 431285 - DNA, 20 bp, Artificial
  CRISPR gRNA sequence
cagagggctatccataaaac

SEQ ID NO: 431286 - DNA, 20 bp, Artificial
  CRISPR gRNA sequence
tccataaaaccaggaaagga

SEQ ID NO: 431287 - DNA, 20 bp, Artificial
  CRISPR gRNA sequence
ggggacagagccagattgga

SEQ ID NO: 431288 - DNA, 20 bp, Artificial
  CRISPR gRNA sequence
gggacagagccagattggag

SEQ ID NO: 431289 - DNA, 20 bp, Artificial
  CRISPR gRNA sequence
gaggcagggttaggcctggg

SEQ ID NO: 431290 - DNA, 20 bp, Artificial
  CRISPR gRNA sequence
ggcctgggttctcttacacc

SEQ ID NO: 431291 - DNA, 20 bp, Artificial
  CRISPR gRNA sequence
ggttctcttacaccttgggg

SEQ ID NO: 431292 - DNA, 20 bp, Artificial
  CRISPR gRNA sequence
tcttacaccttggggacaga

SEQ ID NO: 431293 - DNA, 20 bp, Artificial
  CRISPR gRNA sequence
ttacaccttggggacagatg

SEQ ID NO: 431294 - DNA, 20 bp, Artificial
  CRISPR gRNA sequence
acaccttggggacagatgaa

SEQ ID NO: 431295 - DNA, 20 bp, Artificial
  CRISPR gRNA sequence
caccttggggacagatgaag

SEQ ID NO: 431296 - DNA, 20 bp, Artificial
  CRISPR gRNA sequence
ggggacagatgaagatagat

SEQ ID NO: 431297 - DNA, 20 bp, Artificial
  CRISPR gRNA sequence
gggacagatgaagatagatg

SEQ ID NO: 431298 - DNA, 20 bp, Artificial
  CRISPR gRNA sequence
aggtttagggaagattatga

SEQ ID NO: 431299 - DNA, 20 bp, Artificial
  CRISPR gRNA sequence
agggaagattatgataatga

SEQ ID NO: 431300 - DNA, 20 bp, Artificial
  CRISPR gRNA sequence
gggaagattatgataatgag

SEQ ID NO: 431301 - DNA, 20 bp, Artificial
  CRISPR gRNA sequence
tgataatgagtttggttagg

SEQ ID NO: 431302 - DNA, 20 bp, Artificial
  CRISPR gRNA sequence
ggttaggtttaaggataagt

SEQ ID NO: 431303 - DNA, 20 bp, Artificial
  CRISPR gRNA sequence
gttaggtttaaggataagtt

SEQ ID NO: 431304 - DNA, 20 bp, Artificial
  CRISPR gRNA sequence
ggtttaaggataagttcgag

SEQ ID NO: 431305 - DNA, 20 bp, Artificial
  CRISPR gRNA sequence
aaggataagttcgagataca

SEQ ID NO: 431306 - DNA, 20 bp, Artificial
  CRISPR gRNA sequence
aggataagttcgagatacaa

SEQ ID NO: 431307 - DNA, 20 bp, Artificial
  CRISPR gRNA sequence
gagatacaattgggaccaga

SEQ ID NO: 431308 - DNA, 20 bp, Artificial
  CRISPR gRNA sequence
ggaccagagtggaacttggg

SEQ ID NO: 431309 - DNA, 20 bp, Artificial
  CRISPR gRNA sequence
gggatattagatgtatcaat

SEQ ID NO: 431310 - DNA, 20 bp, Artificial
  CRISPR gRNA sequence
ggatattagatgtatcaatt

SEQ ID NO: 431311 - DNA, 20 bp, Artificial
  CRISPR gRNA sequence
gatgtatcaatttcatttgg

SEQ ID NO: 431312 - DNA, 20 bp, Artificial
  CRISPR gRNA sequence
catttggaatttttggtttg

SEQ ID NO: 431313 - DNA, 20 bp, Artificial
  CRISPR gRNA sequence
atttggaatttttggtttga

SEQ ID NO: 431314 - DNA, 20 bp, Artificial
  CRISPR gRNA sequence
ggaatttttggtttgaaata

SEQ ID NO: 431315 - DNA, 20 bp, Artificial
  CRISPR gRNA sequence
gaatttttggtttgaaataa

SEQ ID NO: 431316 - DNA, 20 bp, Artificial
  CRISPR gRNA sequence
ttggtttgaaataaaagcac

SEQ ID NO: 431317 - DNA, 20 bp, Artificial
  CRISPR gRNA sequence
tggtttgaaataaaagcacc

SEQ ID NO: 431318 - DNA, 20 bp, Artificial
  CRISPR gRNA sequence
ggtttgaaataaaagcacca

SEQ ID NO: 431319 - DNA, 20 bp, Artificial
  CRISPR gRNA sequence
gtttgaaataaaagcaccaa

SEQ ID NO: 431320 - DNA, 20 bp, Artificial
  CRISPR gRNA sequence
gaaataaaagcaccaatgtc

SEQ ID NO: 431321 - DNA, 20 bp, Artificial
  CRISPR gRNA sequence
aaataaaagcaccaatgtct

SEQ ID NO: 431322 - DNA, 20 bp, Artificial
  CRISPR gRNA sequence
cattcacagttatggtcata

SEQ ID NO: 431323 - DNA, 20 bp, Artificial
  CRISPR gRNA sequence
acagttatggtcatagaaca

SEQ ID NO: 431324 - DNA, 20 bp, Artificial
  CRISPR gRNA sequence
tggtcatagaacaaagatat

SEQ ID NO: 431325 - DNA, 20 bp, Artificial
  CRISPR gRNA sequence
tgaaacagaagcagccctga

SEQ ID NO: 431326 - DNA, 20 bp, Artificial
  CRISPR gRNA sequence
gaaacagaagcagccctgag

SEQ ID NO: 431327 - DNA, 20 bp, Artificial
  CRISPR gRNA sequence
aaacagaagcagccctgagt

SEQ ID NO: 431328 - DNA, 20 bp, Artificial
  CRISPR gRNA sequence
agtaagcatgacatcactac

SEQ ID NO: 431329 - DNA, 20 bp, Artificial
  CRISPR gRNA sequence
catgcagggtggggaagggg

SEQ ID NO: 431330 - DNA, 20 bp, Artificial
  CRISPR gRNA sequence
tgtataagggttacttaaaa

SEQ ID NO: 431331 - DNA, 20 bp, Artificial
  CRISPR gRNA sequence
tataagggttacttaaaact

SEQ ID NO: 431332 - DNA, 20 bp, Artificial
  CRISPR gRNA sequence
cttaaaacttctgcctatta

SEQ ID NO: 431333 - DNA, 20 bp, Artificial
  CRISPR gRNA sequence
aaaacttctgcctattaacc

SEQ ID NO: 431334 - DNA, 20 bp, Artificial
  CRISPR gRNA sequence
aaacttctgcctattaacca

SEQ ID NO: 431335 - DNA, 20 bp, Artificial
  CRISPR gRNA sequence
ctgcctattaaccaggttga

SEQ ID NO: 431336 - DNA, 20 bp, Artificial
  CRISPR gRNA sequence
tgcctattaaccaggttgac

SEQ ID NO: 431337 - DNA, 20 bp, Artificial
  CRISPR gRNA sequence
cctattaaccaggttgactt

SEQ ID NO: 431338 - DNA, 20 bp, Artificial
  CRISPR gRNA sequence
ttaaccaggttgactttggg

SEQ ID NO: 431339 - DNA, 20 bp, Artificial
  CRISPR gRNA sequence
accaggttgactttggggtt

SEQ ID NO: 431340 - DNA, 20 bp, Artificial
  CRISPR gRNA sequence
actttggggttaagtacaat

SEQ ID NO: 431341 - DNA, 20 bp, Artificial
  CRISPR gRNA sequence
tggggttaagtacaatttta

SEQ ID NO: 431342 - DNA, 20 bp, Artificial
  CRISPR gRNA sequence
ggggttaagtacaattttag

SEQ ID NO: 431343 - DNA, 20 bp, Artificial
  CRISPR gRNA sequence
gggttaagtacaattttagc

SEQ ID NO: 431344 - DNA, 20 bp, Artificial
  CRISPR gRNA sequence
agtacaattttagcattaag

SEQ ID NO: 431345 - DNA, 20 bp, Artificial
  CRISPR gRNA sequence
tagcattaaggttaggaata

SEQ ID NO: 431346 - DNA, 20 bp, Artificial
  CRISPR gRNA sequence
agcattaaggttaggaatag

SEQ ID NO: 431347 - DNA, 20 bp, Artificial
  CRISPR gRNA sequence
gcattaaggttaggaatagc

SEQ ID NO: 431348 - DNA, 20 bp, Artificial
  CRISPR gRNA sequence
aggttaggaatagcttaaat

SEQ ID NO: 431349 - DNA, 20 bp, Artificial
  CRISPR gRNA sequence
ggaatagcttaaatattaca

SEQ ID NO: 431350 - DNA, 20 bp, Artificial
  CRISPR gRNA sequence
aaatattacagatagtatta

SEQ ID NO: 431351 - DNA, 20 bp, Artificial
  CRISPR gRNA sequence
aatattacagatagtattag

SEQ ID NO: 431352 - DNA, 20 bp, Artificial
  CRISPR gRNA sequence
cagatagtattaggataggg

SEQ ID NO: 431353 - DNA, 20 bp, Artificial
  CRISPR gRNA sequence
ggatagggacttggactaag

SEQ ID NO: 431354 - DNA, 20 bp, Artificial
  CRISPR gRNA sequence
ggactaaggtttgagattag

SEQ ID NO: 431355 - DNA, 20 bp, Artificial
  CRISPR gRNA sequence
gactaaggtttgagattagg

SEQ ID NO: 431356 - DNA, 20 bp, Artificial
  CRISPR gRNA sequence
aggtttgagattaggttcaa

SEQ ID NO: 431357 - DNA, 20 bp, Artificial
  CRISPR gRNA sequence
gagattaggttcaaaaagaa

SEQ ID NO: 431358 - DNA, 20 bp, Artificial
  CRISPR gRNA sequence
agattaggttcaaaaagaag

SEQ ID NO: 431359 - DNA, 20 bp, Artificial
  CRISPR gRNA sequence
ggttcaaaaagaagccaggg

SEQ ID NO: 431360 - DNA, 20 bp, Artificial
  CRISPR gRNA sequence
aaaaagaagccagggtttgt

SEQ ID NO: 431361 - DNA, 20 bp, Artificial
  CRISPR gRNA sequence
gtgctaatgcaagtaattaa

SEQ ID NO: 431362 - DNA, 20 bp, Artificial
  CRISPR gRNA sequence
tgctaatgcaagtaattaag

SEQ ID NO: 431363 - DNA, 20 bp, Artificial
  CRISPR gRNA sequence
atgcaagtaattaaggagag

SEQ ID NO: 431364 - DNA, 20 bp, Artificial
  CRISPR gRNA sequence
aggagagtttgcattccaca

SEQ ID NO: 431365 - DNA, 20 bp, Artificial
  CRISPR gRNA sequence
gcattccacataagcaactg

SEQ ID NO: 431366 - DNA, 20 bp, Artificial
  CRISPR gRNA sequence
cattccacataagcaactga

SEQ ID NO: 431367 - DNA, 20 bp, Artificial
  CRISPR gRNA sequence
cacataagcaactgaccact

SEQ ID NO: 431368 - DNA, 20 bp, Artificial
  CRISPR gRNA sequence
accacttgggaaacaagagg

SEQ ID NO: 431369 - DNA, 20 bp, Artificial
  CRISPR gRNA sequence
gggaaacaagagggaagagc

SEQ ID NO: 431370 - DNA, 20 bp, Artificial
  CRISPR gRNA sequence
ggaaacaagagggaagagcc

SEQ ID NO: 431371 - DNA, 20 bp, Artificial
  CRISPR gRNA sequence
cctggagtctgcaatggcaa

SEQ ID NO: 431372 - DNA, 20 bp, Artificial
  CRISPR gRNA sequence
gagtctgcaatggcaaaagg

SEQ ID NO: 431373 - DNA, 20 bp, Artificial
  CRISPR gRNA sequence
caatggcaaaagggtggaaa

SEQ ID NO: 431374 - DNA, 20 bp, Artificial
  CRISPR gRNA sequence
tgtggggaggctgcacaggg

SEQ ID NO: 431375 - DNA, 20 bp, Artificial
  CRISPR gRNA sequence
gtggggaggctgcacagggg

SEQ ID NO: 431376 - DNA, 20 bp, Artificial
  CRISPR gRNA sequence
tggggaggctgcacaggggt

SEQ ID NO: 431377 - DNA, 20 bp, Artificial
  CRISPR gRNA sequence
cacaggggtccaatagaaca

SEQ ID NO: 431378 - DNA, 20 bp, Artificial
  CRISPR gRNA sequence
ctgatctctctccccagggg

SEQ ID NO: 431379 - DNA, 20 bp, Artificial
  CRISPR gRNA sequence
tgatctctctccccaggggt

SEQ ID NO: 431380 - DNA, 20 bp, Artificial
  CRISPR gRNA sequence
atctctctccccaggggtcc

SEQ ID NO: 431381 - DNA, 20 bp, Artificial
  CRISPR gRNA sequence
tctccccaggggtccatgag

SEQ ID NO: 431382 - DNA, 20 bp, Artificial
  CRISPR gRNA sequence
tccccaggggtccatgagcc

SEQ ID NO: 431383 - DNA, 20 bp, Artificial
  CRISPR gRNA sequence
cccaggggtccatgagccac

SEQ ID NO: 431384 - DNA, 20 bp, Artificial
  CRISPR gRNA sequence
gcaccttcatttccccaggt

SEQ ID NO: 431385 - DNA, 20 bp, Artificial
  CRISPR gRNA sequence
caccttcatttccccaggtt

SEQ ID NO: 431386 - DNA, 20 bp, Artificial
  CRISPR gRNA sequence
catttccccaggttcaggct

SEQ ID NO: 431387 - DNA, 20 bp, Artificial
  CRISPR gRNA sequence
atttccccaggttcaggctg

SEQ ID NO: 431388 - DNA, 20 bp, Artificial
  CRISPR gRNA sequence
ccccaggttcaggctgggaa

SEQ ID NO: 431389 - DNA, 20 bp, Artificial
  CRISPR gRNA sequence
cccaggttcaggctgggaaa

SEQ ID NO: 431390 - DNA, 20 bp, Artificial
  CRISPR gRNA sequence
aggctgggaaatagccgtgc

SEQ ID NO: 431391 - DNA, 20 bp, Artificial
  CRISPR gRNA sequence
ggaaatagccgtgccactgt

SEQ ID NO: 431392 - DNA, 20 bp, Artificial
  CRISPR gRNA sequence
tggtcttggggaggagtgtg

SEQ ID NO: 431393 - DNA, 20 bp, Artificial
  CRISPR gRNA sequence
ggggaggagtgtgcatgtca

SEQ ID NO: 431394 - DNA, 20 bp, Artificial
  CRISPR gRNA sequence
gggaggagtgtgcatgtcag

SEQ ID NO: 431395 - DNA, 20 bp, Artificial
  CRISPR gRNA sequence
catgaatggcctggcctgga

SEQ ID NO: 431396 - DNA, 20 bp, Artificial
  CRISPR gRNA sequence
gcctggagattagcaaccag

SEQ ID NO: 431397 - DNA, 20 bp, Artificial
  CRISPR gRNA sequence
gagattagcaaccagacata

SEQ ID NO: 431398 - DNA, 20 bp, Artificial
  CRISPR gRNA sequence
gcaaccagacatagctccca

SEQ ID NO: 431399 - DNA, 20 bp, Artificial
  CRISPR gRNA sequence
ccatttggtcttcagttgct

SEQ ID NO: 431400 - DNA, 20 bp, Artificial
  CRISPR gRNA sequence
ggtcttcagttgctggtact

SEQ ID NO: 431401 - DNA, 20 bp, Artificial
  CRISPR gRNA sequence
gtcttcagttgctggtacta

SEQ ID NO: 431402 - DNA, 20 bp, Artificial
  CRISPR gRNA sequence
cagttgctggtactaccact

SEQ ID NO: 431403 - DNA, 20 bp, Artificial
  CRISPR gRNA sequence
agttgctggtactaccactc

SEQ ID NO: 431404 - DNA, 20 bp, Artificial
  CRISPR gRNA sequence
ctggtactaccactccacag

SEQ ID NO: 431405 - DNA, 20 bp, Artificial
  CRISPR gRNA sequence
gtactaccactccacagggg

SEQ ID NO: 431406 - DNA, 20 bp, Artificial
  CRISPR gRNA sequence
ccactccacaggggccttct

SEQ ID NO: 431407 - DNA, 20 bp, Artificial
  CRISPR gRNA sequence
cacaggggccttctgcctga

SEQ ID NO: 431408 - DNA, 20 bp, Artificial
  CRISPR gRNA sequence
ctgcctgatgaactccctcc

SEQ ID NO: 431409 - DNA, 20 bp, Artificial
  CRISPR gRNA sequence
tgcctgatgaactccctccc

SEQ ID NO: 431410 - DNA, 20 bp, Artificial
  CRISPR gRNA sequence
cctgatgaactccctccctg

SEQ ID NO: 431411 - DNA, 20 bp, Artificial
  CRISPR gRNA sequence
atgaactccctccctgttcc

SEQ ID NO: 431412 - DNA, 20 bp, Artificial
  CRISPR gRNA sequence
cctccctgttcccggtcctg

SEQ ID NO: 431413 - DNA, 20 bp, Artificial
  CRISPR gRNA sequence
cctgttcccggtcctgccgt

SEQ ID NO: 431414 - DNA, 20 bp, Artificial
  CRISPR gRNA sequence
ttcccggtcctgccgtctgg

SEQ ID NO: 431415 - DNA, 20 bp, Artificial
  CRISPR gRNA sequence
ccggtcctgccgtctggtga

SEQ ID NO: 431416 - DNA, 20 bp, Artificial
  CRISPR gRNA sequence
ccgtctggtgatgggtcctc

SEQ ID NO: 431417 - DNA, 20 bp, Artificial
  CRISPR gRNA sequence
gtgatgggtcctctggcata

SEQ ID NO: 431418 - DNA, 20 bp, Artificial
  CRISPR gRNA sequence
tggcatatgacactggggta

SEQ ID NO: 431419 - DNA, 20 bp, Artificial
  CRISPR gRNA sequence
gcatatgacactggggtaaa

SEQ ID NO: 431420 - DNA, 20 bp, Artificial
  CRISPR gRNA sequence
gggtaaagagcccagaatgg

SEQ ID NO: 431421 - DNA, 20 bp, Artificial
  CRISPR gRNA sequence
ggttactttgccagaatcta

SEQ ID NO: 431422 - DNA, 20 bp, Artificial
  CRISPR gRNA sequence
gttactttgccagaatctag

SEQ ID NO: 431423 - DNA, 20 bp, Artificial
  CRISPR gRNA sequence
ctttgccagaatctaggtcc

SEQ ID NO: 431424 - DNA, 20 bp, Artificial
  CRISPR gRNA sequence
tgccagaatctaggtcccct

SEQ ID NO: 431425 - DNA, 20 bp, Artificial
  CRISPR gRNA sequence
gccagaatctaggtcccctg

SEQ ID NO: 431426 - DNA, 20 bp, Artificial
  CRISPR gRNA sequence
ccagaatctaggtcccctgc

SEQ ID NO: 431427 - DNA, 20 bp, Artificial
  CRISPR gRNA sequence
ggtcccctgccctgcttatt

SEQ ID NO: 431428 - DNA, 20 bp, Artificial
  CRISPR gRNA sequence
ccctgcttattgtcccaggc

SEQ ID NO: 431429 - DNA, 20 bp, Artificial
  CRISPR gRNA sequence
cttattgtcccaggcctcct

SEQ ID NO: 431430 - DNA, 20 bp, Artificial
  CRISPR gRNA sequence
attgtcccaggcctcctcta

SEQ ID NO: 431431 - DNA, 20 bp, Artificial
  CRISPR gRNA sequence
ttgtcccaggcctcctctaa

SEQ ID NO: 431432 - DNA, 20 bp, Artificial
  CRISPR gRNA sequence
tcccaggcctcctctaacca

SEQ ID NO: 431433 - DNA, 20 bp, Artificial
  CRISPR gRNA sequence
ctctaaccatgaaccaataa

SEQ ID NO: 431434 - DNA, 20 bp, Artificial
  CRISPR gRNA sequence
taaccatgaaccaataaata

SEQ ID NO: 431435 - DNA, 20 bp, Artificial
  CRISPR gRNA sequence
accatgaaccaataaatagc

SEQ ID NO: 431436 - DNA, 20 bp, Artificial
  CRISPR gRNA sequence
gcccttatgaagttaagctt

SEQ ID NO: 431437 - DNA, 20 bp, Artificial
  CRISPR gRNA sequence
atgaagttaagcttattacc

SEQ ID NO: 431438 - DNA, 20 bp, Artificial
  CRISPR gRNA sequence
tgaagttaagcttattacct

SEQ ID NO: 431439 - DNA, 20 bp, Artificial
  CRISPR gRNA sequence
agcttattacctatctagca

SEQ ID NO: 431440 - DNA, 20 bp, Artificial
  CRISPR gRNA sequence
attacctatctagcactgtt

SEQ ID NO: 431441 - DNA, 20 bp, Artificial
  CRISPR gRNA sequence
ttacctatctagcactgttg

SEQ ID NO: 431442 - DNA, 20 bp, Artificial
  CRISPR gRNA sequence
cctatctagcactgttgtaa

SEQ ID NO: 431443 - DNA, 20 bp, Artificial
  CRISPR gRNA sequence
tctagcactgttgtaagacc

SEQ ID NO: 431444 - DNA, 20 bp, Artificial
  CRISPR gRNA sequence
gcactgttgtaagaccttac

SEQ ID NO: 431445 - DNA, 20 bp, Artificial
  CRISPR gRNA sequence
ttgtaagaccttacttgtat

SEQ ID NO: 431446 - DNA, 20 bp, Artificial
  CRISPR gRNA sequence
taagaccttacttgtatcag

SEQ ID NO: 431447 - DNA, 20 bp, Artificial
  CRISPR gRNA sequence
acttgtatcagctcatgaaa

SEQ ID NO: 431448 - DNA, 20 bp, Artificial
  CRISPR gRNA sequence
cttgtatcagctcatgaaat

SEQ ID NO: 431449 - DNA, 20 bp, Artificial
  CRISPR gRNA sequence
gtatcagctcatgaaattat

SEQ ID NO: 431450 - DNA, 20 bp, Artificial
  CRISPR gRNA sequence
tatcagctcatgaaattatt

SEQ ID NO: 431451 - DNA, 20 bp, Artificial
  CRISPR gRNA sequence
atgaaattatttgccacatt

SEQ ID NO: 431452 - DNA, 20 bp, Artificial
  CRISPR gRNA sequence
tttgccacattttatcgaca

SEQ ID NO: 431453 - DNA, 20 bp, Artificial
  CRISPR gRNA sequence
gccacattttatcgacaaga

SEQ ID NO: 431454 - DNA, 20 bp, Artificial
  CRISPR gRNA sequence
ccacattttatcgacaagaa

SEQ ID NO: 431455 - DNA, 20 bp, Artificial
  CRISPR gRNA sequence
tatcgacaagaaaactgaga

SEQ ID NO: 431456 - DNA, 20 bp, Artificial
  CRISPR gRNA sequence
atcgacaagaaaactgagaa

SEQ ID NO: 431457 - DNA, 20 bp, Artificial
  CRISPR gRNA sequence
tcgacaagaaaactgagaaa

SEQ ID NO: 431458 - DNA, 20 bp, Artificial
  CRISPR gRNA sequence
agaaaaaaagtacataattt

SEQ ID NO: 431459 - DNA, 20 bp, Artificial
  CRISPR gRNA sequence
acccagacttcgtggggtca

SEQ ID NO: 431460 - DNA, 20 bp, Artificial
  CRISPR gRNA sequence
cccagacttcgtggggtcaa

SEQ ID NO: 431461 - DNA, 20 bp, Artificial
  CRISPR gRNA sequence
cgtggggtcaactgcaatag

SEQ ID NO: 431462 - DNA, 20 bp, Artificial
  CRISPR gRNA sequence
gtggggtcaactgcaatagt

SEQ ID NO: 431463 - DNA, 20 bp, Artificial
  CRISPR gRNA sequence
caatagtcaaccccagacag

SEQ ID NO: 431464 - DNA, 20 bp, Artificial
  CRISPR gRNA sequence
cagagcctcaactcttaacc

SEQ ID NO: 431465 - DNA, 20 bp, Artificial
  CRISPR gRNA sequence
aactcttaaccagtctttgt

SEQ ID NO: 431466 - DNA, 20 bp, Artificial
  CRISPR gRNA sequence
ttaaccagtctttgtttggc

SEQ ID NO: 431467 - DNA, 20 bp, Artificial
  CRISPR gRNA sequence
aaccagtctttgtttggcct

SEQ ID NO: 431468 - DNA, 20 bp, Artificial
  CRISPR gRNA sequence
accagtctttgtttggccta

SEQ ID NO: 431469 - DNA, 20 bp, Artificial
  CRISPR gRNA sequence
tgtttggcctatgtgaaatc

SEQ ID NO: 431470 - DNA, 20 bp, Artificial
  CRISPR gRNA sequence
gtttggcctatgtgaaatca

SEQ ID NO: 431471 - DNA, 20 bp, Artificial
  CRISPR gRNA sequence
tttggcctatgtgaaatcag

SEQ ID NO: 431472 - DNA, 20 bp, Artificial
  CRISPR gRNA sequence
ggcctatgtgaaatcagtta

SEQ ID NO: 431473 - DNA, 20 bp, Artificial
  CRISPR gRNA sequence
gcctatgtgaaatcagttaa

SEQ ID NO: 431474 - DNA, 20 bp, Artificial
  CRISPR gRNA sequence
tgtgaaatcagttaagaagt

SEQ ID NO: 431475 - DNA, 20 bp, Artificial
  CRISPR gRNA sequence
agaagtaacactttgggagg

SEQ ID NO: 431476 - DNA, 20 bp, Artificial
  CRISPR gRNA sequence
tgggaggctgaggcgggcag

SEQ ID NO: 431477 - DNA, 20 bp, Artificial
  CRISPR gRNA sequence
gggaggctgaggcgggcaga

SEQ ID NO: 431478 - DNA, 20 bp, Artificial
  CRISPR gRNA sequence
ggaggctgaggcgggcagat

SEQ ID NO: 431479 - DNA, 20 bp, Artificial
  CRISPR gRNA sequence
aggcgggcagatcactggag

SEQ ID NO: 431480 - DNA, 20 bp, Artificial
  CRISPR gRNA sequence
gaggtcgggagtttgagacc

SEQ ID NO: 431481 - DNA, 20 bp, Artificial
  CRISPR gRNA sequence
gagaccagcctgaccaacgt

SEQ ID NO: 431482 - DNA, 20 bp, Artificial
  CRISPR gRNA sequence
agaccagcctgaccaacgtg

SEQ ID NO: 431483 - DNA, 20 bp, Artificial
  CRISPR gRNA sequence
accaacgtgaagaaaccctg

SEQ ID NO: 431484 - DNA, 20 bp, Artificial
  CRISPR gRNA sequence
tctctactaaaaatacaaaa

SEQ ID NO: 431485 - DNA, 20 bp, Artificial
  CRISPR gRNA sequence
tactaaaaatacaaaattag

SEQ ID NO: 431486 - DNA, 20 bp, Artificial
  CRISPR gRNA sequence
ctaaaaatacaaaattagcc

SEQ ID NO: 431487 - DNA, 20 bp, Artificial
  CRISPR gRNA sequence
aaaatacaaaattagccggg

SEQ ID NO: 431488 - DNA, 20 bp, Artificial
  CRISPR gRNA sequence
gccgggcatggtggtgggtg

SEQ ID NO: 431489 - DNA, 20 bp, Artificial
  CRISPR gRNA sequence
taatcccagatactcaggag

SEQ ID NO: 431490 - DNA, 20 bp, Artificial
  CRISPR gRNA sequence
aggaggctgaggcaggagag

SEQ ID NO: 431491 - DNA, 20 bp, Artificial
  CRISPR gRNA sequence
aggcaggagagaatcgcttg

SEQ ID NO: 431492 - DNA, 20 bp, Artificial
  CRISPR gRNA sequence
gaactcaggaggcggaagtt

SEQ ID NO: 431493 - DNA, 20 bp, Artificial
  CRISPR gRNA sequence
aactcaggaggcggaagttg

SEQ ID NO: 431494 - DNA, 20 bp, Artificial
  CRISPR gRNA sequence
aggaggcggaagttgcagtg

SEQ ID NO: 431495 - DNA, 20 bp, Artificial
  CRISPR gRNA sequence
cagtgagctgagattgcgcc

SEQ ID NO: 431496 - DNA, 20 bp, Artificial
  CRISPR gRNA sequence
agattgcgccattgcactcc

SEQ ID NO: 431497 - DNA, 20 bp, Artificial
  CRISPR gRNA sequence
cgccattgcactccagcctg

SEQ ID NO: 431498 - DNA, 20 bp, Artificial
  CRISPR gRNA sequence
cactccagcctgggcaacaa

SEQ ID NO: 431499 - DNA, 20 bp, Artificial
  CRISPR gRNA sequence
cagcctgggcaacaagagcg

SEQ ID NO: 431500 - DNA, 20 bp, Artificial
  CRISPR gRNA sequence
ggcaacaagagcgaaactcc

SEQ ID NO: 431501 - DNA, 20 bp, Artificial
  CRISPR gRNA sequence
cgtctcaaaaaaaaaaaaaa

SEQ ID NO: 431502 - DNA, 20 bp, Artificial
  CRISPR gRNA sequence
aaaaaaaaaaaaaaaaaaaa

SEQ ID NO: 431503 - DNA, 20 bp, Artificial
  CRISPR gRNA sequence
gaaaggaaactttaaggtaa

SEQ ID NO: 431504 - DNA, 20 bp, Artificial
  CRISPR gRNA sequence
aaaggaaactttaaggtaac

SEQ ID NO: 431505 - DNA, 20 bp, Artificial
  CRISPR gRNA sequence
taaggtaaccttttatcttc

SEQ ID NO: 431506 - DNA, 20 bp, Artificial
  CRISPR gRNA sequence
aaggtaaccttttatcttct

SEQ ID NO: 431507 - DNA, 20 bp, Artificial
  CRISPR gRNA sequence
aggtaaccttttatcttctc

SEQ ID NO: 431508 - DNA, 20 bp, Artificial
  CRISPR gRNA sequence
ttatcttctcagtttacaca

SEQ ID NO: 431509 - DNA, 20 bp, Artificial
  CRISPR gRNA sequence
tatcttctcagtttacacat

SEQ ID NO: 431510 - DNA, 20 bp, Artificial
  CRISPR gRNA sequence
atcttctcagtttacacata

SEQ ID NO: 431511 - DNA, 20 bp, Artificial
  CRISPR gRNA sequence
tcttctcagtttacacatat

SEQ ID NO: 431512 - DNA, 20 bp, Artificial
  CRISPR gRNA sequence
ctcagtttacacatattttg

SEQ ID NO: 431513 - DNA, 20 bp, Artificial
  CRISPR gRNA sequence
tcagtttacacatattttgc

SEQ ID NO: 431514 - DNA, 20 bp, Artificial
  CRISPR gRNA sequence
agtttacacatattttgcaa

SEQ ID NO: 431515 - DNA, 20 bp, Artificial
  CRISPR gRNA sequence
acacatattttgcaaccata

SEQ ID NO: 431516 - DNA, 20 bp, Artificial
  CRISPR gRNA sequence
cacatattttgcaaccatat

SEQ ID NO: 431517 - DNA, 20 bp, Artificial
  CRISPR gRNA sequence
tgcaaccatataacttaatc

SEQ ID NO: 431518 - DNA, 20 bp, Artificial
  CRISPR gRNA sequence
gcaaccatataacttaatct

SEQ ID NO: 431519 - DNA, 20 bp, Artificial
  CRISPR gRNA sequence
caaccatataacttaatctt

SEQ ID NO: 431520 - DNA, 20 bp, Artificial
  CRISPR gRNA sequence
aatcttcaacataactgaca

SEQ ID NO: 431521 - DNA, 20 bp, Artificial
  CRISPR gRNA sequence
atcttcaacataactgacag

SEQ ID NO: 431522 - DNA, 20 bp, Artificial
  CRISPR gRNA sequence
caacataactgacagcagta

SEQ ID NO: 431523 - DNA, 20 bp, Artificial
  CRISPR gRNA sequence
aacataactgacagcagtaa

SEQ ID NO: 431524 - DNA, 20 bp, Artificial
  CRISPR gRNA sequence
acagcagtaaataggagttc

SEQ ID NO: 431525 - DNA, 20 bp, Artificial
  CRISPR gRNA sequence
tgaggatgcagtttagtaga

SEQ ID NO: 431526 - DNA, 20 bp, Artificial
  CRISPR gRNA sequence
aggatgcagtttagtagaac

SEQ ID NO: 431527 - DNA, 20 bp, Artificial
  CRISPR gRNA sequence
agtagaacaaaaacatctgt

SEQ ID NO: 431528 - DNA, 20 bp, Artificial
  CRISPR gRNA sequence
gtagaacaaaaacatctgtg

SEQ ID NO: 431529 - DNA, 20 bp, Artificial
  CRISPR gRNA sequence
tgttaaaatcagctctacca

SEQ ID NO: 431530 - DNA, 20 bp, Artificial
  CRISPR gRNA sequence
aaatcagctctaccactctg

SEQ ID NO: 431531 - DNA, 20 bp, Artificial
  CRISPR gRNA sequence
taccactctgagcaactcca

SEQ ID NO: 431532 - DNA, 20 bp, Artificial
  CRISPR gRNA sequence
ccactctgagcaactccaag

SEQ ID NO: 431533 - DNA, 20 bp, Artificial
  CRISPR gRNA sequence
tgagcaactccaagctccag

SEQ ID NO: 431534 - DNA, 20 bp, Artificial
  CRISPR gRNA sequence
agcaactccaagctccagct

SEQ ID NO: 431535 - DNA, 20 bp, Artificial
  CRISPR gRNA sequence
caagctccagcttctgcctg

SEQ ID NO: 431536 - DNA, 20 bp, Artificial
  CRISPR gRNA sequence
cagcttctgcctgcatcaaa

SEQ ID NO: 431537 - DNA, 20 bp, Artificial
  CRISPR gRNA sequence
ctgcctgcatcaaacaaatg

SEQ ID NO: 431538 - DNA, 20 bp, Artificial
  CRISPR gRNA sequence
tgcctgcatcaaacaaatgg

SEQ ID NO: 431539 - DNA, 20 bp, Artificial
  CRISPR gRNA sequence
cctgcatcaaacaaatggga

SEQ ID NO: 431540 - DNA, 20 bp, Artificial
  CRISPR gRNA sequence
catcaaacaaatgggaatca

SEQ ID NO: 431541 - DNA, 20 bp, Artificial
  CRISPR gRNA sequence
atagttaacacttatacagc

SEQ ID NO: 431542 - DNA, 20 bp, Artificial
  CRISPR gRNA sequence
acacttatacagcacttacc

SEQ ID NO: 431543 - DNA, 20 bp, Artificial
  CRISPR gRNA sequence
atacagcacttaccatgttc

SEQ ID NO: 431544 - DNA, 20 bp, Artificial
  CRISPR gRNA sequence
tacagcacttaccatgttcc

SEQ ID NO: 431545 - DNA, 20 bp, Artificial
  CRISPR gRNA sequence
accatgttccaggcattgtt

SEQ ID NO: 431546 - DNA, 20 bp, Artificial
  CRISPR gRNA sequence
ccatgttccaggcattgttc

SEQ ID NO: 431547 - DNA, 20 bp, Artificial
  CRISPR gRNA sequence
caggcattgttctaagacca

SEQ ID NO: 431548 - DNA, 20 bp, Artificial
  CRISPR gRNA sequence
ttctaagaccattttcttgt

SEQ ID NO: 431549 - DNA, 20 bp, Artificial
  CRISPR gRNA sequence
taagaccattttcttgtagt

SEQ ID NO: 431550 - DNA, 20 bp, Artificial
  CRISPR gRNA sequence
agaccattttcttgtagtag

SEQ ID NO: 431551 - DNA, 20 bp, Artificial
  CRISPR gRNA sequence
tcttgtagtagggaatttaa

SEQ ID NO: 431552 - DNA, 20 bp, Artificial
  CRISPR gRNA sequence
cttgtagtagggaatttaat

SEQ ID NO: 431553 - DNA, 20 bp, Artificial
  CRISPR gRNA sequence
ttgtagtagggaatttaatc

SEQ ID NO: 431554 - DNA, 20 bp, Artificial
  CRISPR gRNA sequence
gtagtagggaatttaatcct

SEQ ID NO: 431555 - DNA, 20 bp, Artificial
  CRISPR gRNA sequence
tagtagggaatttaatccta

SEQ ID NO: 431556 - DNA, 20 bp, Artificial
  CRISPR gRNA sequence
aatcctacattagcatcgca

SEQ ID NO: 431557 - DNA, 20 bp, Artificial
  CRISPR gRNA sequence
atcctacattagcatcgcat

SEQ ID NO: 431558 - DNA, 20 bp, Artificial
  CRISPR gRNA sequence
cattagcatcgcataaggtc

SEQ ID NO: 431559 - DNA, 20 bp, Artificial
  CRISPR gRNA sequence
gcatcgcataaggtcttata

SEQ ID NO: 431560 - DNA, 20 bp, Artificial
  CRISPR gRNA sequence
atattcatcctcctttcaca

SEQ ID NO: 431561 - DNA, 20 bp, Artificial
  CRISPR gRNA sequence
tattcatcctcctttcacag

SEQ ID NO: 431562 - DNA, 20 bp, Artificial
  CRISPR gRNA sequence
atcctcctttcacagatgag

SEQ ID NO: 431563 - DNA, 20 bp, Artificial
  CRISPR gRNA sequence
ctttcacagatgagaaaact

SEQ ID NO: 431564 - DNA, 20 bp, Artificial
  CRISPR gRNA sequence
tcacagatgagaaaactgat

SEQ ID NO: 431565 - DNA, 20 bp, Artificial
  CRISPR gRNA sequence
cacagatgagaaaactgata

SEQ ID NO: 431566 - DNA, 20 bp, Artificial
  CRISPR gRNA sequence
acagatgagaaaactgatac

SEQ ID NO: 431567 - DNA, 20 bp, Artificial
  CRISPR gRNA sequence
atacacagagaagctaagaa

SEQ ID NO: 431568 - DNA, 20 bp, Artificial
  CRISPR gRNA sequence
agaaatcctgtctgagggca

SEQ ID NO: 431569 - DNA, 20 bp, Artificial
  CRISPR gRNA sequence
tctgagggcaacagcagagc

SEQ ID NO: 431570 - DNA, 20 bp, Artificial
  CRISPR gRNA sequence
agggcaacagcagagccagg

SEQ ID NO: 431571 - DNA, 20 bp, Artificial
  CRISPR gRNA sequence
gcacccagactgtctggtgt

SEQ ID NO: 431572 - DNA, 20 bp, Artificial
  CRISPR gRNA sequence
cacccagactgtctggtgtc

SEQ ID NO: 431573 - DNA, 20 bp, Artificial
  CRISPR gRNA sequence
tctggtgtcagagtctgagc

SEQ ID NO: 431574 - DNA, 20 bp, Artificial
  CRISPR gRNA sequence
gtgtcagagtctgagctttt

SEQ ID NO: 431575 - DNA, 20 bp, Artificial
  CRISPR gRNA sequence
agcttttaaccatggtgcta

SEQ ID NO: 431576 - DNA, 20 bp, Artificial
  CRISPR gRNA sequence
ttaaccatggtgctatactg

SEQ ID NO: 431577 - DNA, 20 bp, Artificial
  CRISPR gRNA sequence
taaccatggtgctatactgt

SEQ ID NO: 431578 - DNA, 20 bp, Artificial
  CRISPR gRNA sequence
aaccatggtgctatactgtc

SEQ ID NO: 431579 - DNA, 20 bp, Artificial
  CRISPR gRNA sequence
accatggtgctatactgtct

SEQ ID NO: 431580 - DNA, 20 bp, Artificial
  CRISPR gRNA sequence
tactgtctctcagataagat

SEQ ID NO: 431581 - DNA, 20 bp, Artificial
  CRISPR gRNA sequence
tctctcagataagataagaa

SEQ ID NO: 431582 - DNA, 20 bp, Artificial
  CRISPR gRNA sequence
tcagataagataagaatcct

SEQ ID NO: 431583 - DNA, 20 bp, Artificial
  CRISPR gRNA sequence
agataagataagaatccttt

SEQ ID NO: 431584 - DNA, 20 bp, Artificial
  CRISPR gRNA sequence
ttctaacctctgggaattgg

SEQ ID NO: 431585 - DNA, 20 bp, Artificial
  CRISPR gRNA sequence
tctaacctctgggaattggt

SEQ ID NO: 431586 - DNA, 20 bp, Artificial
  CRISPR gRNA sequence
ctaacctctgggaattggtt

SEQ ID NO: 431587 - DNA, 20 bp, Artificial
  CRISPR gRNA sequence
taacctctgggaattggttt

SEQ ID NO: 431588 - DNA, 20 bp, Artificial
  CRISPR gRNA sequence
acctctgggaattggtttaa

SEQ ID NO: 431589 - DNA, 20 bp, Artificial
  CRISPR gRNA sequence
tgggaattggtttaaatgta

SEQ ID NO: 431590 - DNA, 20 bp, Artificial
  CRISPR gRNA sequence
ggaattggtttaaatgtaca

SEQ ID NO: 431591 - DNA, 20 bp, Artificial
  CRISPR gRNA sequence
gtttaaatgtacaggtggat

SEQ ID NO: 431592 - DNA, 20 bp, Artificial
  CRISPR gRNA sequence
aaatgtacaggtggataaca

SEQ ID NO: 431593 - DNA, 20 bp, Artificial
  CRISPR gRNA sequence
aatgtacaggtggataacaa

SEQ ID NO: 431594 - DNA, 20 bp, Artificial
  CRISPR gRNA sequence
gggaaacttggaagtaccac

SEQ ID NO: 431595 - DNA, 20 bp, Artificial
  CRISPR gRNA sequence
ggaaacttggaagtaccaca

SEQ ID NO: 431596 - DNA, 20 bp, Artificial
  CRISPR gRNA sequence
ggaagtaccacacaaatgta

SEQ ID NO: 431597 - DNA, 20 bp, Artificial
  CRISPR gRNA sequence
gaagtaccacacaaatgtaa

SEQ ID NO: 431598 - DNA, 20 bp, Artificial
  CRISPR gRNA sequence
ctgtacaattaaacttagca

SEQ ID NO: 431599 - DNA, 20 bp, Artificial
  CRISPR gRNA sequence
tacaattaaacttagcacag

SEQ ID NO: 431600 - DNA, 20 bp, Artificial
  CRISPR gRNA sequence
aacttagcacaggctatgtt

SEQ ID NO: 431601 - DNA, 20 bp, Artificial
  CRISPR gRNA sequence
agcacaggctatgtttttaa

SEQ ID NO: 431602 - DNA, 20 bp, Artificial
  CRISPR gRNA sequence
gcacaggctatgtttttaac

SEQ ID NO: 431603 - DNA, 20 bp, Artificial
  CRISPR gRNA sequence
tgtttttaaccagctctact

SEQ ID NO: 431604 - DNA, 20 bp, Artificial
  CRISPR gRNA sequence
ttaaccagctctactcttta

SEQ ID NO: 431605 - DNA, 20 bp, Artificial
  CRISPR gRNA sequence
taaccagctctactctttat

SEQ ID NO: 431606 - DNA, 20 bp, Artificial
  CRISPR gRNA sequence
aaccagctctactctttata

SEQ ID NO: 431607 - DNA, 20 bp, Artificial
  CRISPR gRNA sequence
accagctctactctttatac

SEQ ID NO: 431608 - DNA, 20 bp, Artificial
  CRISPR gRNA sequence
tactctttatacacttaggg

SEQ ID NO: 431609 - DNA, 20 bp, Artificial
  CRISPR gRNA sequence
ctctttatacacttaggggt

SEQ ID NO: 431610 - DNA, 20 bp, Artificial
  CRISPR gRNA sequence
tttatacacttaggggttaa

SEQ ID NO: 431611 - DNA, 20 bp, Artificial
  CRISPR gRNA sequence
tatacacttaggggttaatt

SEQ ID NO: 431612 - DNA, 20 bp, Artificial
  CRISPR gRNA sequence
atacacttaggggttaattc

SEQ ID NO: 431613 - DNA, 20 bp, Artificial
  CRISPR gRNA sequence
tacacttaggggttaattct

SEQ ID NO: 431614 - DNA, 20 bp, Artificial
  CRISPR gRNA sequence
aggggttaattctaatttgc

SEQ ID NO: 431615 - DNA, 20 bp, Artificial
  CRISPR gRNA sequence
ggggttaattctaatttgca

SEQ ID NO: 431616 - DNA, 20 bp, Artificial
  CRISPR gRNA sequence
attctaatttgcacaattat

SEQ ID NO: 431617 - DNA, 20 bp, Artificial
  CRISPR gRNA sequence
taatttgcacaattatacta

SEQ ID NO: 431618 - DNA, 20 bp, Artificial
  CRISPR gRNA sequence
atttgcacaattatactaaa

SEQ ID NO: 431619 - DNA, 20 bp, Artificial
  CRISPR gRNA sequence
gcacaattatactaaaccaa

SEQ ID NO: 431620 - DNA, 20 bp, Artificial
  CRISPR gRNA sequence
cacaattatactaaaccaat

SEQ ID NO: 431621 - DNA, 20 bp, Artificial
  CRISPR gRNA sequence
tactaaaccaataaatggga

SEQ ID NO: 431622 - DNA, 20 bp, Artificial
  CRISPR gRNA sequence
aaccaataaatgggaacttt

SEQ ID NO: 431623 - DNA, 20 bp, Artificial
  CRISPR gRNA sequence
ttgcatatgacctcatcaac

SEQ ID NO: 431624 - DNA, 20 bp, Artificial
  CRISPR gRNA sequence
tgcatatgacctcatcaact

SEQ ID NO: 431625 - DNA, 20 bp, Artificial
  CRISPR gRNA sequence
gcatatgacctcatcaactg

SEQ ID NO: 431626 - DNA, 20 bp, Artificial
  CRISPR gRNA sequence
catatgacctcatcaactgg

SEQ ID NO: 431627 - DNA, 20 bp, Artificial
  CRISPR gRNA sequence
atcaactggtcttcctagga

SEQ ID NO: 431628 - DNA, 20 bp, Artificial
  CRISPR gRNA sequence
gtcttcctaggaaatatagg

SEQ ID NO: 431629 - DNA, 20 bp, Artificial
  CRISPR gRNA sequence
cctaggaaatataggtaaga

SEQ ID NO: 431630 - DNA, 20 bp, Artificial
  CRISPR gRNA sequence
ctaggaaatataggtaagat

SEQ ID NO: 431631 - DNA, 20 bp, Artificial
  CRISPR gRNA sequence
ggaaatataggtaagatgtg

SEQ ID NO: 431632 - DNA, 20 bp, Artificial
  CRISPR gRNA sequence
cttacataagaacagtggtt

SEQ ID NO: 431633 - DNA, 20 bp, Artificial
  CRISPR gRNA sequence
ttacataagaacagtggttc

SEQ ID NO: 431634 - DNA, 20 bp, Artificial
  CRISPR gRNA sequence
acataagaacagtggttctc

SEQ ID NO: 431635 - DNA, 20 bp, Artificial
  CRISPR gRNA sequence
cataagaacagtggttctca

SEQ ID NO: 431636 - DNA, 20 bp, Artificial
  CRISPR gRNA sequence
tcagtattggctgcccatta

SEQ ID NO: 431637 - DNA, 20 bp, Artificial
  CRISPR gRNA sequence
agtattggctgcccattaga

SEQ ID NO: 431638 - DNA, 20 bp, Artificial
  CRISPR gRNA sequence
gctgcccattagaatcacct

SEQ ID NO: 431639 - DNA, 20 bp, Artificial
  CRISPR gRNA sequence
cccattagaatcacctggaa

SEQ ID NO: 431640 - DNA, 20 bp, Artificial
  CRISPR gRNA sequence
gaatcacctggaaatgcttt

SEQ ID NO: 431641 - DNA, 20 bp, Artificial
  CRISPR gRNA sequence
gaaatgcttttagaccttac

SEQ ID NO: 431642 - DNA, 20 bp, Artificial
  CRISPR gRNA sequence
ttagaccttacccttgttta

SEQ ID NO: 431643 - DNA, 20 bp, Artificial
  CRISPR gRNA sequence
tagaccttacccttgtttag

SEQ ID NO: 431644 - DNA, 20 bp, Artificial
  CRISPR gRNA sequence
agaccttacccttgtttagc

SEQ ID NO: 431645 - DNA, 20 bp, Artificial
  CRISPR gRNA sequence
gaccttacccttgtttagct

SEQ ID NO: 431646 - DNA, 20 bp, Artificial
  CRISPR gRNA sequence
acccttgtttagctctgcta

SEQ ID NO: 431647 - DNA, 20 bp, Artificial
  CRISPR gRNA sequence
cccttgtttagctctgctat

SEQ ID NO: 431648 - DNA, 20 bp, Artificial
  CRISPR gRNA sequence
gtttagctctgctattaggg

SEQ ID NO: 431649 - DNA, 20 bp, Artificial
  CRISPR gRNA sequence
tttagctctgctattaggga

SEQ ID NO: 431650 - DNA, 20 bp, Artificial
  CRISPR gRNA sequence
agctctgctattagggattc

SEQ ID NO: 431651 - DNA, 20 bp, Artificial
  CRISPR gRNA sequence
gctctgctattagggattct

SEQ ID NO: 431652 - DNA, 20 bp, Artificial
  CRISPR gRNA sequence
tgctattagggattctgatt

SEQ ID NO: 431653 - DNA, 20 bp, Artificial
  CRISPR gRNA sequence
ctattagggattctgattga

SEQ ID NO: 431654 - DNA, 20 bp, Artificial
  CRISPR gRNA sequence
ttagggattctgattgaatt

SEQ ID NO: 431655 - DNA, 20 bp, Artificial
  CRISPR gRNA sequence
gggattctgattgaattggt

SEQ ID NO: 431656 - DNA, 20 bp, Artificial
  CRISPR gRNA sequence
tgattgaattggtctgggtg

SEQ ID NO: 431657 - DNA, 20 bp, Artificial
  CRISPR gRNA sequence
attgaattggtctgggtgag

SEQ ID NO: 431658 - DNA, 20 bp, Artificial
  CRISPR gRNA sequence
aattggtctgggtgaggcct

SEQ ID NO: 431659 - DNA, 20 bp, Artificial
  CRISPR gRNA sequence
gtctgggtgaggcctcggca

SEQ ID NO: 431660 - DNA, 20 bp, Artificial
  CRISPR gRNA sequence
ggtgaggcctcggcatcagt

SEQ ID NO: 431661 - DNA, 20 bp, Artificial
  CRISPR gRNA sequence
ggcatcagtatgatttaaaa

SEQ ID NO: 431662 - DNA, 20 bp, Artificial
  CRISPR gRNA sequence
aaaatctcctcaggtgattc

SEQ ID NO: 431663 - DNA, 20 bp, Artificial
  CRISPR gRNA sequence
aaatctcctcaggtgattca

SEQ ID NO: 431664 - DNA, 20 bp, Artificial
  CRISPR gRNA sequence
ctcaggtgattcaaatgtga

SEQ ID NO: 431665 - DNA, 20 bp, Artificial
  CRISPR gRNA sequence
aggtgattcaaatgtgatcc

SEQ ID NO: 431666 - DNA, 20 bp, Artificial
  CRISPR gRNA sequence
aaatgtgatcccgaattgag

SEQ ID NO: 431667 - DNA, 20 bp, Artificial
  CRISPR gRNA sequence
agaagccctgctgtgcagtg

SEQ ID NO: 431668 - DNA, 20 bp, Artificial
  CRISPR gRNA sequence
ctgtgcagtgtttcaggatt

SEQ ID NO: 431669 - DNA, 20 bp, Artificial
  CRISPR gRNA sequence
tgcagtgtttcaggattgca

SEQ ID NO: 431670 - DNA, 20 bp, Artificial
  CRISPR gRNA sequence
caggattgcattttctatgc

SEQ ID NO: 431671 - DNA, 20 bp, Artificial
  CRISPR gRNA sequence
aggattgcattttctatgct

SEQ ID NO: 431672 - DNA, 20 bp, Artificial
  CRISPR gRNA sequence
cattttctatgctagaggga

SEQ ID NO: 431673 - DNA, 20 bp, Artificial
  CRISPR gRNA sequence
tctatgctagagggagaggt

SEQ ID NO: 431674 - DNA, 20 bp, Artificial
  CRISPR gRNA sequence
ctatgctagagggagaggtt

SEQ ID NO: 431675 - DNA, 20 bp, Artificial
  CRISPR gRNA sequence
tatgctagagggagaggttt

SEQ ID NO: 431676 - DNA, 20 bp, Artificial
  CRISPR gRNA sequence
tgctagagggagaggtttat

SEQ ID NO: 431677 - DNA, 20 bp, Artificial
  CRISPR gRNA sequence
gagggagaggtttatccacc

SEQ ID NO: 431678 - DNA, 20 bp, Artificial
  CRISPR gRNA sequence
atccaccaacttgctccagc

SEQ ID NO: 431679 - DNA, 20 bp, Artificial
  CRISPR gRNA sequence
tccaccaacttgctccagca

SEQ ID NO: 431680 - DNA, 20 bp, Artificial
  CRISPR gRNA sequence
gctccagcaggaatacctga

SEQ ID NO: 431681 - DNA, 20 bp, Artificial
  CRISPR gRNA sequence
ctccagcaggaatacctgag

SEQ ID NO: 431682 - DNA, 20 bp, Artificial
  CRISPR gRNA sequence
cagcaggaatacctgagctt

SEQ ID NO: 431683 - DNA, 20 bp, Artificial
  CRISPR gRNA sequence
agctttctaggacctccagg

SEQ ID NO: 431684 - DNA, 20 bp, Artificial
  CRISPR gRNA sequence
tctaggacctccaggaagat

SEQ ID NO: 431685 - DNA, 20 bp, Artificial
  CRISPR gRNA sequence
ctaggacctccaggaagatt

SEQ ID NO: 431686 - DNA, 20 bp, Artificial
  CRISPR gRNA sequence
taggacctccaggaagattc

SEQ ID NO: 431687 - DNA, 20 bp, Artificial
  CRISPR gRNA sequence
ggacctccaggaagattctc

SEQ ID NO: 431688 - DNA, 20 bp, Artificial
  CRISPR gRNA sequence
caggaagattctcccagtgt

SEQ ID NO: 431689 - DNA, 20 bp, Artificial
  CRISPR gRNA sequence
tcccagtgtacgtcccatca

SEQ ID NO: 431690 - DNA, 20 bp, Artificial
  CRISPR gRNA sequence
ccagtgtacgtcccatcagg

SEQ ID NO: 431691 - DNA, 20 bp, Artificial
  CRISPR gRNA sequence
ccctgtatcgttcacggtca

SEQ ID NO: 431692 - DNA, 20 bp, Artificial
  CRISPR gRNA sequence
tatcgttcacggtcagcgac

SEQ ID NO: 431693 - DNA, 20 bp, Artificial
  CRISPR gRNA sequence
acggtcagcgactggagggt

SEQ ID NO: 431694 - DNA, 20 bp, Artificial
  CRISPR gRNA sequence
gagggtgaggcccaggccgg

SEQ ID NO: 431695 - DNA, 20 bp, Artificial
  CRISPR gRNA sequence
gggccactcgatccttgaag

SEQ ID NO: 431696 - DNA, 20 bp, Artificial
  CRISPR gRNA sequence
gatccttgaaggatggggag

SEQ ID NO: 431697 - DNA, 20 bp, Artificial
  CRISPR gRNA sequence
gaaggatggggagatgtgcc

SEQ ID NO: 431698 - DNA, 20 bp, Artificial
  CRISPR gRNA sequence
aaggatggggagatgtgcca

SEQ ID NO: 431699 - DNA, 20 bp, Artificial
  CRISPR gRNA sequence
caaatggccagaagctggtc

SEQ ID NO: 431700 - DNA, 20 bp, Artificial
  CRISPR gRNA sequence
gtcctgctgctcccagttga

SEQ ID NO: 431701 - DNA, 20 bp, Artificial
  CRISPR gRNA sequence
ctgctcccagttgacctggg

SEQ ID NO: 431702 - DNA, 20 bp, Artificial
  CRISPR gRNA sequence
ctcccagttgacctgggtca

SEQ ID NO: 431703 - DNA, 20 bp, Artificial
  CRISPR gRNA sequence
ccagttgacctgggtcactt

SEQ ID NO: 431704 - DNA, 20 bp, Artificial
  CRISPR gRNA sequence
acctgggtcacttgtgccgt

SEQ ID NO: 431705 - DNA, 20 bp, Artificial
  CRISPR gRNA sequence
ggtcacttgtgccgtggtgg

SEQ ID NO: 431706 - DNA, 20 bp, Artificial
  CRISPR gRNA sequence
gtgccgtggtggaggagagg

SEQ ID NO: 431707 - DNA, 20 bp, Artificial
  CRISPR gRNA sequence
tgccgtggtggaggagaggt

SEQ ID NO: 431708 - DNA, 20 bp, Artificial
  CRISPR gRNA sequence
taagatgatagagccacctt

SEQ ID NO: 431709 - DNA, 20 bp, Artificial
  CRISPR gRNA sequence
tctctgcagaaatgttcccc

SEQ ID NO: 431710 - DNA, 20 bp, Artificial
  CRISPR gRNA sequence
ctctgcagaaatgttccccg

SEQ ID NO: 431711 - DNA, 20 bp, Artificial
  CRISPR gRNA sequence
tctgcagaaatgttccccgt

SEQ ID NO: 431712 - DNA, 20 bp, Artificial
  CRISPR gRNA sequence
tgcagaaatgttccccgttg

SEQ ID NO: 431713 - DNA, 20 bp, Artificial
  CRISPR gRNA sequence
cagaaatgttccccgttgtt

SEQ ID NO: 431714 - DNA, 20 bp, Artificial
  CRISPR gRNA sequence
cccgttgtttctattgtgcc

SEQ ID NO: 431715 - DNA, 20 bp, Artificial
  CRISPR gRNA sequence
tttctattgtgcctgtcatc

SEQ ID NO: 431716 - DNA, 20 bp, Artificial
  CRISPR gRNA sequence
ctattgtgcctgtcatcatt

SEQ ID NO: 431717 - DNA, 20 bp, Artificial
  CRISPR gRNA sequence
tattgtgcctgtcatcattc

SEQ ID NO: 431718 - DNA, 20 bp, Artificial
  CRISPR gRNA sequence
ttgtgcctgtcatcattcct

SEQ ID NO: 431719 - DNA, 20 bp, Artificial
  CRISPR gRNA sequence
tgcctgtcatcattcctagg

SEQ ID NO: 431720 - DNA, 20 bp, Artificial
  CRISPR gRNA sequence
tcatcattcctagggaagag

SEQ ID NO: 431721 - DNA, 20 bp, Artificial
  CRISPR gRNA sequence
ctagggaagaggacgaagca

SEQ ID NO: 431722 - DNA, 20 bp, Artificial
  CRISPR gRNA sequence
gggaagaggacgaagcacat

SEQ ID NO: 431723 - DNA, 20 bp, Artificial
  CRISPR gRNA sequence
ggtcagcagctggccttcaa

SEQ ID NO: 431724 - DNA, 20 bp, Artificial
  CRISPR gRNA sequence
gccttcaaccttcctagaaa

SEQ ID NO: 431725 - DNA, 20 bp, Artificial
  CRISPR gRNA sequence
caaccttcctagaaaaattc

SEQ ID NO: 431726 - DNA, 20 bp, Artificial
  CRISPR gRNA sequence
aaccttcctagaaaaattct

SEQ ID NO: 431727 - DNA, 20 bp, Artificial
  CRISPR gRNA sequence
cctagaaaaattctaagggc

SEQ ID NO: 431728 - DNA, 20 bp, Artificial
  CRISPR gRNA sequence
ctagaaaaattctaagggcc

SEQ ID NO: 431729 - DNA, 20 bp, Artificial
  CRISPR gRNA sequence
gaaaaattctaagggccttt

SEQ ID NO: 431730 - DNA, 20 bp, Artificial
  CRISPR gRNA sequence
taagggcctttgaggcccca

SEQ ID NO: 431731 - DNA, 20 bp, Artificial
  CRISPR gRNA sequence
agggcctttgaggccccaac

SEQ ID NO: 431732 - DNA, 20 bp, Artificial
  CRISPR gRNA sequence
tgaggccccaactggatttt

SEQ ID NO: 431733 - DNA, 20 bp, Artificial
  CRISPR gRNA sequence
gaggccccaactggattttg

SEQ ID NO: 431734 - DNA, 20 bp, Artificial
  CRISPR gRNA sequence
aggccccaactggattttgg

SEQ ID NO: 431735 - DNA, 20 bp, Artificial
  CRISPR gRNA sequence
gattttggaatgatagtttc

SEQ ID NO: 431736 - DNA, 20 bp, Artificial
  CRISPR gRNA sequence
tggaatgatagtttctccag

SEQ ID NO: 431737 - DNA, 20 bp, Artificial
  CRISPR gRNA sequence
ggaatgatagtttctccagt

SEQ ID NO: 431738 - DNA, 20 bp, Artificial
  CRISPR gRNA sequence
gaatgatagtttctccagtc

SEQ ID NO: 431739 - DNA, 20 bp, Artificial
  CRISPR gRNA sequence
ctccagtccatcctgttgct

SEQ ID NO: 431740 - DNA, 20 bp, Artificial
  CRISPR gRNA sequence
tccagtccatcctgttgctc

SEQ ID NO: 431741 - DNA, 20 bp, Artificial
  CRISPR gRNA sequence
cagtccatcctgttgctcct

SEQ ID NO: 431742 - DNA, 20 bp, Artificial
  CRISPR gRNA sequence
ttgctcctccatagaggctg

SEQ ID NO: 431743 - DNA, 20 bp, Artificial
  CRISPR gRNA sequence
ctcctccatagaggctgtaa

SEQ ID NO: 431744 - DNA, 20 bp, Artificial
  CRISPR gRNA sequence
ctccatagaggctgtaatta

SEQ ID NO: 431745 - DNA, 20 bp, Artificial
  CRISPR gRNA sequence
catagaggctgtaattattt

SEQ ID NO: 431746 - DNA, 20 bp, Artificial
  CRISPR gRNA sequence
taattatttcctgtttcttc

SEQ ID NO: 431747 - DNA, 20 bp, Artificial
  CRISPR gRNA sequence
tttcctgtttcttccatttc

SEQ ID NO: 431748 - DNA, 20 bp, Artificial
  CRISPR gRNA sequence
cctgtttcttccatttcaag

SEQ ID NO: 431749 - DNA, 20 bp, Artificial
  CRISPR gRNA sequence
ctgtttcttccatttcaaga

SEQ ID NO: 431750 - DNA, 20 bp, Artificial
  CRISPR gRNA sequence
tttcttccatttcaagagac

SEQ ID NO: 431751 - DNA, 20 bp, Artificial
  CRISPR gRNA sequence
cttccatttcaagagacgct

SEQ ID NO: 431752 - DNA, 20 bp, Artificial
  CRISPR gRNA sequence
ttccatttcaagagacgctc

SEQ ID NO: 431753 - DNA, 20 bp, Artificial
  CRISPR gRNA sequence
ccatttcaagagacgctcct

SEQ ID NO: 431754 - DNA, 20 bp, Artificial
  CRISPR gRNA sequence
catttcaagagacgctcctc

SEQ ID NO: 431755 - DNA, 20 bp, Artificial
  CRISPR gRNA sequence
caagagacgctcctctccat

SEQ ID NO: 431756 - DNA, 20 bp, Artificial
  CRISPR gRNA sequence
aagagacgctcctctccatg

SEQ ID NO: 431757 - DNA, 20 bp, Artificial
  CRISPR gRNA sequence
ctctccatgcctgttattca

SEQ ID NO: 431758 - DNA, 20 bp, Artificial
  CRISPR gRNA sequence
tccatgcctgttattcaagg

SEQ ID NO: 431759 - DNA, 20 bp, Artificial
  CRISPR gRNA sequence
catgcctgttattcaaggct

SEQ ID NO: 431760 - DNA, 20 bp, Artificial
  CRISPR gRNA sequence
ttattcaaggctcccagtcc

SEQ ID NO: 431761 - DNA, 20 bp, Artificial
  CRISPR gRNA sequence
ttcaaggctcccagtccccc

SEQ ID NO: 431762 - DNA, 20 bp, Artificial
  CRISPR gRNA sequence
aaggctcccagtcccccatt

SEQ ID NO: 431763 - DNA, 20 bp, Artificial
  CRISPR gRNA sequence
ccagtcccccattcaggttg

SEQ ID NO: 431764 - DNA, 20 bp, Artificial
  CRISPR gRNA sequence
aggttgtctttccagtcttc

SEQ ID NO: 431765 - DNA, 20 bp, Artificial
  CRISPR gRNA sequence
tctttccagtcttctcaccc

SEQ ID NO: 431766 - DNA, 20 bp, Artificial
  CRISPR gRNA sequence
tccagtcttctcacccttct

SEQ ID NO: 431767 - DNA, 20 bp, Artificial
  CRISPR gRNA sequence
ccagtcttctcacccttctc

SEQ ID NO: 431768 - DNA, 20 bp, Artificial
  CRISPR gRNA sequence
cagtcttctcacccttctcc

SEQ ID NO: 431769 - DNA, 20 bp, Artificial
  CRISPR gRNA sequence
ctcacccttctccacacatc

SEQ ID NO: 431770 - DNA, 20 bp, Artificial
  CRISPR gRNA sequence
tcacccttctccacacatct

SEQ ID NO: 431771 - DNA, 20 bp, Artificial
  CRISPR gRNA sequence
acccttctccacacatctct

SEQ ID NO: 431772 - DNA, 20 bp, Artificial
  CRISPR gRNA sequence
ctccacacatctctactcca

SEQ ID NO: 431773 - DNA, 20 bp, Artificial
  CRISPR gRNA sequence
tccacacatctctactccag

SEQ ID NO: 431774 - DNA, 20 bp, Artificial
  CRISPR gRNA sequence
cacacatctctactccagcc

SEQ ID NO: 431775 - DNA, 20 bp, Artificial
  CRISPR gRNA sequence
tactccagcccagcccagcc

SEQ ID NO: 431776 - DNA, 20 bp, Artificial
  CRISPR gRNA sequence
ctccagcccagcccagccca

SEQ ID NO: 431777 - DNA, 20 bp, Artificial
  CRISPR gRNA sequence
cagcccagcccagcccatct

SEQ ID NO: 431778 - DNA, 20 bp, Artificial
  CRISPR gRNA sequence
ctccccacccactgccctat

SEQ ID NO: 431779 - DNA, 20 bp, Artificial
  CRISPR gRNA sequence
cccacccactgccctatgct

SEQ ID NO: 431780 - DNA, 20 bp, Artificial
  CRISPR gRNA sequence
ccctatgcttccagagctga

SEQ ID NO: 431781 - DNA, 20 bp, Artificial
  CRISPR gRNA sequence
tgcttccagagctgacttct

SEQ ID NO: 431782 - DNA, 20 bp, Artificial
  CRISPR gRNA sequence
ccagagctgacttctgcccc

SEQ ID NO: 431783 - DNA, 20 bp, Artificial
  CRISPR gRNA sequence
cagagctgacttctgcccct

SEQ ID NO: 431784 - DNA, 20 bp, Artificial
  CRISPR gRNA sequence
acttctgcccctctttacac

SEQ ID NO: 431785 - DNA, 20 bp, Artificial
  CRISPR gRNA sequence
ctgcccctctttacacctcg

SEQ ID NO: 431786 - DNA, 20 bp, Artificial
  CRISPR gRNA sequence
tgcccctctttacacctcgc

SEQ ID NO: 431787 - DNA, 20 bp, Artificial
  CRISPR gRNA sequence
cccctctttacacctcgccc

SEQ ID NO: 431788 - DNA, 20 bp, Artificial
  CRISPR gRNA sequence
tttacacctcgcccacaggg

SEQ ID NO: 431789 - DNA, 20 bp, Artificial
  CRISPR gRNA sequence
tacacctcgcccacagggag

SEQ ID NO: 431790 - DNA, 20 bp, Artificial
  CRISPR gRNA sequence
acacctcgcccacagggagg

SEQ ID NO: 431791 - DNA, 20 bp, Artificial
  CRISPR gRNA sequence
cacctcgcccacagggaggc

SEQ ID NO: 431792 - DNA, 20 bp, Artificial
  CRISPR gRNA sequence
gcccacagggaggcttgtca

SEQ ID NO: 431793 - DNA, 20 bp, Artificial
  CRISPR gRNA sequence
gtcaaggctgcactccctcc

SEQ ID NO: 431794 - DNA, 20 bp, Artificial
  CRISPR gRNA sequence
tcaaggctgcactccctccc

SEQ ID NO: 431795 - DNA, 20 bp, Artificial
  CRISPR gRNA sequence
cactccctccccgcctccta

SEQ ID NO: 431796 - DNA, 20 bp, Artificial
  CRISPR gRNA sequence
cctccccgcctcctagaaga

SEQ ID NO: 431797 - DNA, 20 bp, Artificial
  CRISPR gRNA sequence
cccgcctcctagaagacctc

SEQ ID NO: 431798 - DNA, 20 bp, Artificial
  CRISPR gRNA sequence
ctagaagacctcagcccatc

SEQ ID NO: 431799 - DNA, 20 bp, Artificial
  CRISPR gRNA sequence
gaagacctcagcccatctca

SEQ ID NO: 431800 - DNA, 20 bp, Artificial
  CRISPR gRNA sequence
agcccatctcaacctccctt

SEQ ID NO: 431801 - DNA, 20 bp, Artificial
  CRISPR gRNA sequence
aacctcccttttcctttcac

SEQ ID NO: 431802 - DNA, 20 bp, Artificial
  CRISPR gRNA sequence
ccttttcctttcacattcac

SEQ ID NO: 431803 - DNA, 20 bp, Artificial
  CRISPR gRNA sequence
ttcctttcacattcactgcc

SEQ ID NO: 431804 - DNA, 20 bp, Artificial
  CRISPR gRNA sequence
tcctttcacattcactgcct

SEQ ID NO: 431805 - DNA, 20 bp, Artificial
  CRISPR gRNA sequence
cctttcacattcactgcctg

SEQ ID NO: 431806 - DNA, 20 bp, Artificial
  CRISPR gRNA sequence
ctttcacattcactgcctgt

SEQ ID NO: 431807 - DNA, 20 bp, Artificial
  CRISPR gRNA sequence
tcacattcactgcctgtatt

SEQ ID NO: 431808 - DNA, 20 bp, Artificial
  CRISPR gRNA sequence
cacattcactgcctgtattg

SEQ ID NO: 431809 - DNA, 20 bp, Artificial
  CRISPR gRNA sequence
acattcactgcctgtattgt

SEQ ID NO: 431810 - DNA, 20 bp, Artificial
  CRISPR gRNA sequence
actgcctgtattgtataatt

SEQ ID NO: 431811 - DNA, 20 bp, Artificial
  CRISPR gRNA sequence
cctgtattgtataattagca

SEQ ID NO: 431812 - DNA, 20 bp, Artificial
  CRISPR gRNA sequence
tattgtataattagcacctt

SEQ ID NO: 431813 - DNA, 20 bp, Artificial
  CRISPR gRNA sequence
tataattagcaccttactaa

SEQ ID NO: 431814 - DNA, 20 bp, Artificial
  CRISPR gRNA sequence
gcaccttactaaatgcctgg

SEQ ID NO: 431815 - DNA, 20 bp, Artificial
  CRISPR gRNA sequence
actaaatgcctggcttatga

SEQ ID NO: 431816 - DNA, 20 bp, Artificial
  CRISPR gRNA sequence
ctaaatgcctggcttatgac

SEQ ID NO: 431817 - DNA, 20 bp, Artificial
  CRISPR gRNA sequence
aatgcctggcttatgactac

SEQ ID NO: 431818 - DNA, 20 bp, Artificial
  CRISPR gRNA sequence
gcttatgactacacaactta

SEQ ID NO: 431819 - DNA, 20 bp, Artificial
  CRISPR gRNA sequence
atgactacacaacttagcac

SEQ ID NO: 431820 - DNA, 20 bp, Artificial
  CRISPR gRNA sequence
tgactacacaacttagcacg

SEQ ID NO: 431821 - DNA, 20 bp, Artificial
  CRISPR gRNA sequence
cacaacttagcacgttgccc

SEQ ID NO: 431822 - DNA, 20 bp, Artificial
  CRISPR gRNA sequence
agcacgttgccccctcgcat

SEQ ID NO: 431823 - DNA, 20 bp, Artificial
  CRISPR gRNA sequence
gcacgttgccccctcgcata

SEQ ID NO: 431824 - DNA, 20 bp, Artificial
  CRISPR gRNA sequence
ccccctcgcatattctgcta

SEQ ID NO: 431825 - DNA, 20 bp, Artificial
  CRISPR gRNA sequence
gcatattctgctatgtagct

SEQ ID NO: 431826 - DNA, 20 bp, Artificial
  CRISPR gRNA sequence
tgctatgtagcttcatggcc

SEQ ID NO: 431827 - DNA, 20 bp, Artificial
  CRISPR gRNA sequence
ctatgtagcttcatggccag

SEQ ID NO: 431828 - DNA, 20 bp, Artificial
  CRISPR gRNA sequence
tgtagcttcatggccagctt

SEQ ID NO: 431829 - DNA, 20 bp, Artificial
  CRISPR gRNA sequence
catggccagcttgttatttt

SEQ ID NO: 431830 - DNA, 20 bp, Artificial
  CRISPR gRNA sequence
atggccagcttgttattttc

SEQ ID NO: 431831 - DNA, 20 bp, Artificial
  CRISPR gRNA sequence
gttattttcgtaggcctatt

SEQ ID NO: 431832 - DNA, 20 bp, Artificial
  CRISPR gRNA sequence
ttattttcgtaggcctattt

SEQ ID NO: 431833 - DNA, 20 bp, Artificial
  CRISPR gRNA sequence
ttttcgtaggcctattttgt

SEQ ID NO: 431834 - DNA, 20 bp, Artificial
  CRISPR gRNA sequence
tcgtaggcctattttgtcta

SEQ ID NO: 431835 - DNA, 20 bp, Artificial
  CRISPR gRNA sequence
cgtaggcctattttgtctac

SEQ ID NO: 431836 - DNA, 20 bp, Artificial
  CRISPR gRNA sequence
gtaggcctattttgtctacc

SEQ ID NO: 431837 - DNA, 20 bp, Artificial
  CRISPR gRNA sequence
ttttgtctacccacttagaa

SEQ ID NO: 431838 - DNA, 20 bp, Artificial
  CRISPR gRNA sequence
tgtctacccacttagaatat

SEQ ID NO: 431839 - DNA, 20 bp, Artificial
  CRISPR gRNA sequence
gtctacccacttagaatata

SEQ ID NO: 431840 - DNA, 20 bp, Artificial
  CRISPR gRNA sequence
tctacccacttagaatataa

SEQ ID NO: 431841 - DNA, 20 bp, Artificial
  CRISPR gRNA sequence
cccacttagaatataagccc

SEQ ID NO: 431842 - DNA, 20 bp, Artificial
  CRISPR gRNA sequence
agaatataagcccttgtcag

SEQ ID NO: 431843 - DNA, 20 bp, Artificial
  CRISPR gRNA sequence
gaatataagcccttgtcagc

SEQ ID NO: 431844 - DNA, 20 bp, Artificial
  CRISPR gRNA sequence
gtcagctgataccacctctt

SEQ ID NO: 431845 - DNA, 20 bp, Artificial
  CRISPR gRNA sequence
tcagctgataccacctcttc

SEQ ID NO: 431846 - DNA, 20 bp, Artificial
  CRISPR gRNA sequence
ataccacctcttctgttttt

SEQ ID NO: 431847 - DNA, 20 bp, Artificial
  CRISPR gRNA sequence
ttctgtttttattttgtttt

SEQ ID NO: 431848 - DNA, 20 bp, Artificial
  CRISPR gRNA sequence
ctgtttttattttgttttgt

SEQ ID NO: 431849 - DNA, 20 bp, Artificial
  CRISPR gRNA sequence
tgtttttattttgttttgtt

SEQ ID NO: 431850 - DNA, 20 bp, Artificial
  CRISPR gRNA sequence
tttttattttgttttgtttt

SEQ ID NO: 431851 - DNA, 20 bp, Artificial
  CRISPR gRNA sequence
ttattttgttttgtttttat

SEQ ID NO: 431852 - DNA, 20 bp, Artificial
  CRISPR gRNA sequence
tattttgttttgtttttatg

SEQ ID NO: 431853 - DNA, 20 bp, Artificial
  CRISPR gRNA sequence
attttgttttgtttttatgt

SEQ ID NO: 431854 - DNA, 20 bp, Artificial
  CRISPR gRNA sequence
ttttgttttgtttttatgtt

SEQ ID NO: 431855 - DNA, 20 bp, Artificial
  CRISPR gRNA sequence
tgttttgtttttatgtttct

SEQ ID NO: 431856 - DNA, 20 bp, Artificial
  CRISPR gRNA sequence
gttttgtttttatgtttctt

SEQ ID NO: 431857 - DNA, 20 bp, Artificial
  CRISPR gRNA sequence
ttttgtttttatgtttcttc

SEQ ID NO: 431858 - DNA, 20 bp, Artificial
  CRISPR gRNA sequence
tgtttttatgtttcttcctg

SEQ ID NO: 431859 - DNA, 20 bp, Artificial
  CRISPR gRNA sequence
gtttttatgtttcttcctgc

SEQ ID NO: 431860 - DNA, 20 bp, Artificial
  CRISPR gRNA sequence
tttttatgtttcttcctgcg

SEQ ID NO: 431861 - DNA, 20 bp, Artificial
  CRISPR gRNA sequence
ttatgtttcttcctgcggcc

SEQ ID NO: 431862 - DNA, 20 bp, Artificial
  CRISPR gRNA sequence
tatgtttcttcctgcggcct

SEQ ID NO: 431863 - DNA, 20 bp, Artificial
  CRISPR gRNA sequence
atgtttcttcctgcggccta

SEQ ID NO: 431864 - DNA, 20 bp, Artificial
  CRISPR gRNA sequence
tgtttcttcctgcggcctag

SEQ ID NO: 431865 - DNA, 20 bp, Artificial
  CRISPR gRNA sequence
cttcctgcggcctagttcta

SEQ ID NO: 431866 - DNA, 20 bp, Artificial
  CRISPR gRNA sequence
ttcctgcggcctagttctat

SEQ ID NO: 431867 - DNA, 20 bp, Artificial
  CRISPR gRNA sequence
cctgcggcctagttctatgc

SEQ ID NO: 431868 - DNA, 20 bp, Artificial
  CRISPR gRNA sequence
ctgcggcctagttctatgct

SEQ ID NO: 431869 - DNA, 20 bp, Artificial
  CRISPR gRNA sequence
cggcctagttctatgctgga

SEQ ID NO: 431870 - DNA, 20 bp, Artificial
  CRISPR gRNA sequence
gttctatgctggatgcatta

SEQ ID NO: 431871 - DNA, 20 bp, Artificial
  CRISPR gRNA sequence
tatgctggatgcattatcct

SEQ ID NO: 431872 - DNA, 20 bp, Artificial
  CRISPR gRNA sequence
tgctggatgcattatccttt

SEQ ID NO: 431873 - DNA, 20 bp, Artificial
  CRISPR gRNA sequence
gatgcattatcctttgaaat

SEQ ID NO: 431874 - DNA, 20 bp, Artificial
  CRISPR gRNA sequence
tcctttgaaataaaaccttg

SEQ ID NO: 431875 - DNA, 20 bp, Artificial
  CRISPR gRNA sequence
tgaaataaaaccttgctgtt

SEQ ID NO: 431876 - DNA, 20 bp, Artificial
  CRISPR gRNA sequence
gaaataaaaccttgctgttt

SEQ ID NO: 431877 - DNA, 20 bp, Artificial
  CRISPR gRNA sequence
aaataaaaccttgctgtttg

SEQ ID NO: 431878 - DNA, 20 bp, Artificial
  CRISPR gRNA sequence
gctgtttggttgattgtcat

SEQ ID NO: 431879 - DNA, 20 bp, Artificial
  CRISPR gRNA sequence
ctgtttggttgattgtcatt

SEQ ID NO: 431880 - DNA, 20 bp, Artificial
  CRISPR gRNA sequence
tttggttgattgtcatttgc

SEQ ID NO: 431881 - DNA, 20 bp, Artificial
  CRISPR gRNA sequence
ggttgattgtcatttgcagt

SEQ ID NO: 431882 - DNA, 20 bp, Artificial
  CRISPR gRNA sequence
gttgattgtcatttgcagtg

SEQ ID NO: 431883 - DNA, 20 bp, Artificial
  CRISPR gRNA sequence
attgtcatttgcagtgcctg

SEQ ID NO: 431884 - DNA, 20 bp, Artificial
  CRISPR gRNA sequence
tcatttgcagtgcctgaaaa

SEQ ID NO: 431885 - DNA, 20 bp, Artificial
  CRISPR gRNA sequence
gcagtgcctgaaaaaacctt

SEQ ID NO: 431886 - DNA, 20 bp, Artificial
  CRISPR gRNA sequence
cagtgcctgaaaaaaccttc

SEQ ID NO: 431887 - DNA, 20 bp, Artificial
  CRISPR gRNA sequence
aaaaaaccttcaggaaagcc

SEQ ID NO: 431888 - DNA, 20 bp, Artificial
  CRISPR gRNA sequence
caggaaagccaagaaatcca

SEQ ID NO: 431889 - DNA, 20 bp, Artificial
  CRISPR gRNA sequence
aggaaagccaagaaatccaa

SEQ ID NO: 431890 - DNA, 20 bp, Artificial
  CRISPR gRNA sequence
agcaggaaaccctgcttctc

SEQ ID NO: 431891 - DNA, 20 bp, Artificial
  CRISPR gRNA sequence
gcaggaaaccctgcttctcc

SEQ ID NO: 431892 - DNA, 20 bp, Artificial
  CRISPR gRNA sequence
cttctcccaggcataaccac

SEQ ID NO: 431893 - DNA, 20 bp, Artificial
  CRISPR gRNA sequence
ctcccaggcataaccaccct

SEQ ID NO: 431894 - DNA, 20 bp, Artificial
  CRISPR gRNA sequence
tcccaggcataaccaccctc

SEQ ID NO: 431895 - DNA, 20 bp, Artificial
  CRISPR gRNA sequence
ccaggcataaccaccctctc

SEQ ID NO: 431896 - DNA, 20 bp, Artificial
  CRISPR gRNA sequence
tcagcacttaacctctcccc

SEQ ID NO: 431897 - DNA, 20 bp, Artificial
  CRISPR gRNA sequence
agcacttaacctctccccag

SEQ ID NO: 431898 - DNA, 20 bp, Artificial
  CRISPR gRNA sequence
aacctctccccagcaaccct

SEQ ID NO: 431899 - DNA, 20 bp, Artificial
  CRISPR gRNA sequence
acctctccccagcaaccctg

SEQ ID NO: 431900 - DNA, 20 bp, Artificial
  CRISPR gRNA sequence
tccccagcaaccctgggcac

SEQ ID NO: 431901 - DNA, 20 bp, Artificial
  CRISPR gRNA sequence
cccagcaaccctgggcacat

SEQ ID NO: 431902 - DNA, 20 bp, Artificial
  CRISPR gRNA sequence
ggcacatctccatcctcaga

SEQ ID NO: 431903 - DNA, 20 bp, Artificial
  CRISPR gRNA sequence
catcctcagatagttcagaa

SEQ ID NO: 431904 - DNA, 20 bp, Artificial
  CRISPR gRNA sequence
agatagttcagaaggcaaca

SEQ ID NO: 431905 - DNA, 20 bp, Artificial
  CRISPR gRNA sequence
agaaggcaacataaaaacta

SEQ ID NO: 431906 - DNA, 20 bp, Artificial
  CRISPR gRNA sequence
atttataccacagtttttaa

SEQ ID NO: 431907 - DNA, 20 bp, Artificial
  CRISPR gRNA sequence
ataccacagtttttaaatat

SEQ ID NO: 431908 - DNA, 20 bp, Artificial
  CRISPR gRNA sequence
taccacagtttttaaatatt

SEQ ID NO: 431909 - DNA, 20 bp, Artificial
  CRISPR gRNA sequence
ttaaatatttgtgttcccct

SEQ ID NO: 431910 - DNA, 20 bp, Artificial
  CRISPR gRNA sequence
taaatatttgtgttcccctc

SEQ ID NO: 431911 - DNA, 20 bp, Artificial
  CRISPR gRNA sequence
aaatatttgtgttcccctcc

SEQ ID NO: 431912 - DNA, 20 bp, Artificial
  CRISPR gRNA sequence
aatatttgtgttcccctccc

SEQ ID NO: 431913 - DNA, 20 bp, Artificial
  CRISPR gRNA sequence
gtgttcccctccctcagaaa

SEQ ID NO: 431914 - DNA, 20 bp, Artificial
  CRISPR gRNA sequence
tgttcccctccctcagaaat

SEQ ID NO: 431915 - DNA, 20 bp, Artificial
  CRISPR gRNA sequence
ccctccctcagaaatatttg

SEQ ID NO: 431916 - DNA, 20 bp, Artificial
  CRISPR gRNA sequence
cctcagaaatatttgactct

SEQ ID NO: 431917 - DNA, 20 bp, Artificial
  CRISPR gRNA sequence
agaaatatttgactctgatt

SEQ ID NO: 431918 - DNA, 20 bp, Artificial
  CRISPR gRNA sequence
gactctgatttttaatatag

SEQ ID NO: 431919 - DNA, 20 bp, Artificial
  CRISPR gRNA sequence
actctgatttttaatataga

SEQ ID NO: 431920 - DNA, 20 bp, Artificial
  CRISPR gRNA sequence
tgatttttaatatagaagaa

SEQ ID NO: 431921 - DNA, 20 bp, Artificial
  CRISPR gRNA sequence
atttttaatatagaagaaat

SEQ ID NO: 431922 - DNA, 20 bp, Artificial
  CRISPR gRNA sequence
ttaatatagaagaaataaat

SEQ ID NO: 431923 - DNA, 20 bp, Artificial
  CRISPR gRNA sequence
taatatagaagaaataaatt

SEQ ID NO: 431924 - DNA, 20 bp, Artificial
  CRISPR gRNA sequence
aatatagaagaaataaattt

SEQ ID NO: 431925 - DNA, 20 bp, Artificial
  CRISPR gRNA sequence
atatagaagaaataaattta

SEQ ID NO: 431926 - DNA, 20 bp, Artificial
  CRISPR gRNA sequence
aacaaaaaatcagtctctag

SEQ ID NO: 431927 - DNA, 20 bp, Artificial
  CRISPR gRNA sequence
acaaaaaatcagtctctagt

SEQ ID NO: 431928 - DNA, 20 bp, Artificial
  CRISPR gRNA sequence
tagtggtagaacctctggaa

SEQ ID NO: 431929 - DNA, 20 bp, Artificial
  CRISPR gRNA sequence
gtggtagaacctctggaatc

SEQ ID NO: 431930 - DNA, 20 bp, Artificial
  CRISPR gRNA sequence
tggaatctgtgaaaaagaca

SEQ ID NO: 431931 - DNA, 20 bp, Artificial
  CRISPR gRNA sequence
gaatctgtgaaaaagacatt

SEQ ID NO: 431932 - DNA, 20 bp, Artificial
  CRISPR gRNA sequence
tgaaaaagacattttcaatt

SEQ ID NO: 431933 - DNA, 20 bp, Artificial
  CRISPR gRNA sequence
tcaattcacagagaacttat

SEQ ID NO: 431934 - DNA, 20 bp, Artificial
  CRISPR gRNA sequence
caattcacagagaacttata

SEQ ID NO: 431935 - DNA, 20 bp, Artificial
  CRISPR gRNA sequence
aattcacagagaacttataa

SEQ ID NO: 431936 - DNA, 20 bp, Artificial
  CRISPR gRNA sequence
acagagaacttataatgttt

SEQ ID NO: 431937 - DNA, 20 bp, Artificial
  CRISPR gRNA sequence
ataatgttttcctggaaagt

SEQ ID NO: 431938 - DNA, 20 bp, Artificial
  CRISPR gRNA sequence
taatgttttcctggaaagtt

SEQ ID NO: 431939 - DNA, 20 bp, Artificial
  CRISPR gRNA sequence
tcctggaaagttcctgaaag

SEQ ID NO: 431940 - DNA, 20 bp, Artificial
  CRISPR gRNA sequence
cctggaaagttcctgaaagg

SEQ ID NO: 431941 - DNA, 20 bp, Artificial
  CRISPR gRNA sequence
ctggaaagttcctgaaaggc

SEQ ID NO: 431942 - DNA, 20 bp, Artificial
  CRISPR gRNA sequence
gaaagttcctgaaaggcaac

SEQ ID NO: 431943 - DNA, 20 bp, Artificial
  CRISPR gRNA sequence
ctgaaaggcaacagaaaaga

SEQ ID NO: 431944 - DNA, 20 bp, Artificial
  CRISPR gRNA sequence
aaaggcaacagaaaagaagc

SEQ ID NO: 431945 - DNA, 20 bp, Artificial
  CRISPR gRNA sequence
gagcaggaatgagcttctaa

SEQ ID NO: 431946 - DNA, 20 bp, Artificial
  CRISPR gRNA sequence
ctaaaagcaaactggcaatg

SEQ ID NO: 431947 - DNA, 20 bp, Artificial
  CRISPR gRNA sequence
taaaagcaaactggcaatgc

SEQ ID NO: 431948 - DNA, 20 bp, Artificial
  CRISPR gRNA sequence
aaagcaaactggcaatgcct

SEQ ID NO: 431949 - DNA, 20 bp, Artificial
  CRISPR gRNA sequence
gcaatgcctcctgcccagcc

SEQ ID NO: 431950 - DNA, 20 bp, Artificial
  CRISPR gRNA sequence
ctgcccagcccttcttcttc

SEQ ID NO: 431951 - DNA, 20 bp, Artificial
  CRISPR gRNA sequence
cccagcccttcttcttcctg

SEQ ID NO: 431952 - DNA, 20 bp, Artificial
  CRISPR gRNA sequence
cttcttcctgaaagtagccg

SEQ ID NO: 431953 - DNA, 20 bp, Artificial
  CRISPR gRNA sequence
ttcttcctgaaagtagccga

SEQ ID NO: 431954 - DNA, 20 bp, Artificial
  CRISPR gRNA sequence
cttcctgaaagtagccgact

SEQ ID NO: 431955 - DNA, 20 bp, Artificial
  CRISPR gRNA sequence
ttcctgaaagtagccgactg

SEQ ID NO: 431956 - DNA, 20 bp, Artificial
  CRISPR gRNA sequence
cctgaaagtagccgactgca

SEQ ID NO: 431957 - DNA, 20 bp, Artificial
  CRISPR gRNA sequence
ctgaaagtagccgactgcag

SEQ ID NO: 431958 - DNA, 20 bp, Artificial
  CRISPR gRNA sequence
aaagtagccgactgcagtcc

SEQ ID NO: 431959 - DNA, 20 bp, Artificial
  CRISPR gRNA sequence
cagtcctgctccttcttgtg

SEQ ID NO: 431960 - DNA, 20 bp, Artificial
  CRISPR gRNA sequence
ctccttcttgtgctggccag

SEQ ID NO: 431961 - DNA, 20 bp, Artificial
  CRISPR gRNA sequence
cttcttgtgctggccagtca

SEQ ID NO: 431962 - DNA, 20 bp, Artificial
  CRISPR gRNA sequence
cttgtgctggccagtcaggc

SEQ ID NO: 431963 - DNA, 20 bp, Artificial
  CRISPR gRNA sequence
ttgtgctggccagtcaggct

SEQ ID NO: 431964 - DNA, 20 bp, Artificial
  CRISPR gRNA sequence
gtgctggccagtcaggctcc

SEQ ID NO: 431965 - DNA, 20 bp, Artificial
  CRISPR gRNA sequence
tgctggccagtcaggctcct

SEQ ID NO: 431966 - DNA, 20 bp, Artificial
  CRISPR gRNA sequence
gccagtcaggctcctccaac

SEQ ID NO: 431967 - DNA, 20 bp, Artificial
  CRISPR gRNA sequence
ctccaaccccggaagtctgc

SEQ ID NO: 431968 - DNA, 20 bp, Artificial
  CRISPR gRNA sequence
caaccccggaagtctgcaaa

SEQ ID NO: 431969 - DNA, 20 bp, Artificial
  CRISPR gRNA sequence
caaagtccttcatctgccac

SEQ ID NO: 431970 - DNA, 20 bp, Artificial
  CRISPR gRNA sequence
catctgccaccaaaaacaga

SEQ ID NO: 431971 - DNA, 20 bp, Artificial
  CRISPR gRNA sequence
atctgccaccaaaaacagaa

SEQ ID NO: 431972 - DNA, 20 bp, Artificial
  CRISPR gRNA sequence
ccaccaaaaacagaacccca

SEQ ID NO: 431973 - DNA, 20 bp, Artificial
  CRISPR gRNA sequence
attctcagagattgtccttt

SEQ ID NO: 431974 - DNA, 20 bp, Artificial
  CRISPR gRNA sequence
tcagagattgtcctttctta

SEQ ID NO: 431975 - DNA, 20 bp, Artificial
  CRISPR gRNA sequence
agagattgtcctttcttaaa

SEQ ID NO: 431976 - DNA, 20 bp, Artificial
  CRISPR gRNA sequence
tcctttcttaaataagagta

SEQ ID NO: 431977 - DNA, 20 bp, Artificial
  CRISPR gRNA sequence
tcttaaataagagtacacag

SEQ ID NO: 431978 - DNA, 20 bp, Artificial
  CRISPR gRNA sequence
cttaaataagagtacacagg

SEQ ID NO: 431979 - DNA, 20 bp, Artificial
  CRISPR gRNA sequence
ttaaataagagtacacagga

SEQ ID NO: 431980 - DNA, 20 bp, Artificial
  CRISPR gRNA sequence
aaataagagtacacaggact

SEQ ID NO: 431981 - DNA, 20 bp, Artificial
  CRISPR gRNA sequence
aataagagtacacaggactc

SEQ ID NO: 431982 - DNA, 20 bp, Artificial
  CRISPR gRNA sequence
taaaagttgcaatttctttc

SEQ ID NO: 431983 - DNA, 20 bp, Artificial
  CRISPR gRNA sequence
aaagttgcaatttctttctc

SEQ ID NO: 431984 - DNA, 20 bp, Artificial
  CRISPR gRNA sequence
caatttctttctctcaagca

SEQ ID NO: 431985 - DNA, 20 bp, Artificial
  CRISPR gRNA sequence
ctttctctcaagcagctgtg

SEQ ID NO: 431986 - DNA, 20 bp, Artificial
  CRISPR gRNA sequence
tttctctcaagcagctgtgg

SEQ ID NO: 431987 - DNA, 20 bp, Artificial
  CRISPR gRNA sequence
tctctcaagcagctgtggca

SEQ ID NO: 431988 - DNA, 20 bp, Artificial
  CRISPR gRNA sequence
ctctcaagcagctgtggcat

SEQ ID NO: 431989 - DNA, 20 bp, Artificial
  CRISPR gRNA sequence
tctcaagcagctgtggcatg

SEQ ID NO: 431990 - DNA, 20 bp, Artificial
  CRISPR gRNA sequence
tcaagcagctgtggcatgct

SEQ ID NO: 431991 - DNA, 20 bp, Artificial
  CRISPR gRNA sequence
aagcagctgtggcatgctct

SEQ ID NO: 431992 - DNA, 20 bp, Artificial
  CRISPR gRNA sequence
tggcatgctcttggagtctt

SEQ ID NO: 431993 - DNA, 20 bp, Artificial
  CRISPR gRNA sequence
ttggagtcttccctacacaa

SEQ ID NO: 431994 - DNA, 20 bp, Artificial
  CRISPR gRNA sequence
ggagtcttccctacacaagc

SEQ ID NO: 431995 - DNA, 20 bp, Artificial
  CRISPR gRNA sequence
gagtcttccctacacaagca

SEQ ID NO: 431996 - DNA, 20 bp, Artificial
  CRISPR gRNA sequence
ccctacacaagcacccaagt

SEQ ID NO: 431997 - DNA, 20 bp, Artificial
  CRISPR gRNA sequence
cctacacaagcacccaagtc

SEQ ID NO: 431998 - DNA, 20 bp, Artificial
  CRISPR gRNA sequence
cacaagcacccaagtctcca

SEQ ID NO: 431999 - DNA, 20 bp, Artificial
  CRISPR gRNA sequence
caaccaagcttagccttgtt

SEQ ID NO: 432000 - DNA, 20 bp, Artificial
  CRISPR gRNA sequence
agccttgtttttcctccctg

SEQ ID NO: 432001 - DNA, 20 bp, Artificial
  CRISPR gRNA sequence
gccttgtttttcctccctgc

SEQ ID NO: 432002 - DNA, 20 bp, Artificial
  CRISPR gRNA sequence
gtttttcctccctgctgctc

SEQ ID NO: 432003 - DNA, 20 bp, Artificial
  CRISPR gRNA sequence
tttttcctccctgctgctct

SEQ ID NO: 432004 - DNA, 20 bp, Artificial
  CRISPR gRNA sequence
ttcctccctgctgctctgct

SEQ ID NO: 432005 - DNA, 20 bp, Artificial
  CRISPR gRNA sequence
tcctccctgctgctctgctg

SEQ ID NO: 432006 - DNA, 20 bp, Artificial
  CRISPR gRNA sequence
cctccctgctgctctgctgg

SEQ ID NO: 432007 - DNA, 20 bp, Artificial
  CRISPR gRNA sequence
ctccctgctgctctgctggg

SEQ ID NO: 432008 - DNA, 20 bp, Artificial
  CRISPR gRNA sequence
cctgctgctctgctgggttt

SEQ ID NO: 432009 - DNA, 20 bp, Artificial
  CRISPR gRNA sequence
ctgctctgctgggtttcagg

SEQ ID NO: 432010 - DNA, 20 bp, Artificial
  CRISPR gRNA sequence
ctctgctgggtttcaggcct

SEQ ID NO: 432011 - DNA, 20 bp, Artificial
  CRISPR gRNA sequence
tgctgggtttcaggccttac

SEQ ID NO: 432012 - DNA, 20 bp, Artificial
  CRISPR gRNA sequence
ctgggtttcaggccttacct

SEQ ID NO: 432013 - DNA, 20 bp, Artificial
  CRISPR gRNA sequence
ggtttcaggccttacctgag

SEQ ID NO: 432014 - DNA, 20 bp, Artificial
  CRISPR gRNA sequence
caggccttacctgaggcgag

SEQ ID NO: 432015 - DNA, 20 bp, Artificial
  CRISPR gRNA sequence
aggccttacctgaggcgagg

SEQ ID NO: 432016 - DNA, 20 bp, Artificial
  CRISPR gRNA sequence
acctgaggcgaggggagcct

SEQ ID NO: 432017 - DNA, 20 bp, Artificial
  CRISPR gRNA sequence
cctgaggcgaggggagcctg

SEQ ID NO: 432018 - DNA, 20 bp, Artificial
  CRISPR gRNA sequence
aggcgaggggagcctgcctc

SEQ ID NO: 432019 - DNA, 20 bp, Artificial
  CRISPR gRNA sequence
cctcagcccctgggcccaga

SEQ ID NO: 432020 - DNA, 20 bp, Artificial
  CRISPR gRNA sequence
agcccctgggcccagatcag

SEQ ID NO: 432021 - DNA, 20 bp, Artificial
  CRISPR gRNA sequence
ggcccagatcaggaggagac

SEQ ID NO: 432022 - DNA, 20 bp, Artificial
  CRISPR gRNA sequence
ctgcccagagggcctacagg

SEQ ID NO: 432023 - DNA, 20 bp, Artificial
  CRISPR gRNA sequence
tgcccagagggcctacagga

SEQ ID NO: 432024 - DNA, 20 bp, Artificial
  CRISPR gRNA sequence
cccagagggcctacaggaag

SEQ ID NO: 432025 - DNA, 20 bp, Artificial
  CRISPR gRNA sequence
caggaagcagatgtggcctc

SEQ ID NO: 432026 - DNA, 20 bp, Artificial
  CRISPR gRNA sequence
ttctgccactgaaagtagcc

SEQ ID NO: 432027 - DNA, 20 bp, Artificial
  CRISPR gRNA sequence
ctgccactgaaagtagccga

SEQ ID NO: 432028 - DNA, 20 bp, Artificial
  CRISPR gRNA sequence
tgccactgaaagtagccgac

SEQ ID NO: 432029 - DNA, 20 bp, Artificial
  CRISPR gRNA sequence
ccactgaaagtagccgactg

SEQ ID NO: 432030 - DNA, 20 bp, Artificial
  CRISPR gRNA sequence
aaagtagccgactgcagata

SEQ ID NO: 432031 - DNA, 20 bp, Artificial
  CRISPR gRNA sequence
cagataggacggtaaaactg

SEQ ID NO: 432032 - DNA, 20 bp, Artificial
  CRISPR gRNA sequence
agcctctgagaaaagacggt

SEQ ID NO: 432033 - DNA, 20 bp, Artificial
  CRISPR gRNA sequence
tgagaaaagacggtctcgga

SEQ ID NO: 432034 - DNA, 20 bp, Artificial
  CRISPR gRNA sequence
agaaaagacggtctcggaaa

SEQ ID NO: 432035 - DNA, 20 bp, Artificial
  CRISPR gRNA sequence
ggaaaaaccaagtttggcaa

SEQ ID NO: 432036 - DNA, 20 bp, Artificial
  CRISPR gRNA sequence
ggcaaaaaccatattaaaaa

SEQ ID NO: 432037 - DNA, 20 bp, Artificial
  CRISPR gRNA sequence
gcaaaaaccatattaaaaac

SEQ ID NO: 432038 - DNA, 20 bp, Artificial
  CRISPR gRNA sequence
aaaacacataaagttgtcaa

SEQ ID NO: 432039 - DNA, 20 bp, Artificial
  CRISPR gRNA sequence
tcaacaaatacacaaactgc

SEQ ID NO: 432040 - DNA, 20 bp, Artificial
  CRISPR gRNA sequence
cgcaacctactcatctgaca

SEQ ID NO: 432041 - DNA, 20 bp, Artificial
  CRISPR gRNA sequence
gcaacctactcatctgacaa

SEQ ID NO: 432042 - DNA, 20 bp, Artificial
  CRISPR gRNA sequence
caacctactcatctgacaaa

SEQ ID NO: 432043 - DNA, 20 bp, Artificial
  CRISPR gRNA sequence
tctgacaaagggctaatatc

SEQ ID NO: 432044 - DNA, 20 bp, Artificial
  CRISPR gRNA sequence
tccagaatctacaatgaact

SEQ ID NO: 432045 - DNA, 20 bp, Artificial
  CRISPR gRNA sequence
gaatctacaatgaactcaga

SEQ ID NO: 432046 - DNA, 20 bp, Artificial
  CRISPR gRNA sequence
atctacaatgaactcagaca

SEQ ID NO: 432047 - DNA, 20 bp, Artificial
  CRISPR gRNA sequence
acaatgaactcagacagagc

SEQ ID NO: 432048 - DNA, 20 bp, Artificial
  CRISPR gRNA sequence
acaaacaaacaaacaaaaaa

SEQ ID NO: 432049 - DNA, 20 bp, Artificial
  CRISPR gRNA sequence
aaacagtaaaaaaaaatttt

SEQ ID NO: 432050 - DNA, 20 bp, Artificial
  CRISPR gRNA sequence
agtaaaaaaaaatttttagt

SEQ ID NO: 432051 - DNA, 20 bp, Artificial
  CRISPR gRNA sequence
agtaagttccaattgtgtgt

SEQ ID NO: 432052 - DNA, 20 bp, Artificial
  CRISPR gRNA sequence
attgtgtgtcagaattgtgc

SEQ ID NO: 432053 - DNA, 20 bp, Artificial
  CRISPR gRNA sequence
ttgtgtgtcagaattgtgct

SEQ ID NO: 432054 - DNA, 20 bp, Artificial
  CRISPR gRNA sequence
tgtcagaattgtgctaggcg

SEQ ID NO: 432055 - DNA, 20 bp, Artificial
  CRISPR gRNA sequence
gtcagaattgtgctaggcgc

SEQ ID NO: 432056 - DNA, 20 bp, Artificial
  CRISPR gRNA sequence
tcagaattgtgctaggcgca

SEQ ID NO: 432057 - DNA, 20 bp, Artificial
  CRISPR gRNA sequence
cagaattgtgctaggcgcag

SEQ ID NO: 432058 - DNA, 20 bp, Artificial
  CRISPR gRNA sequence
agaattgtgctaggcgcagg

SEQ ID NO: 432059 - DNA, 20 bp, Artificial
  CRISPR gRNA sequence
taggcgcagggggcaacaat

SEQ ID NO: 432060 - DNA, 20 bp, Artificial
  CRISPR gRNA sequence
cgcagggggcaacaataagc

SEQ ID NO: 432061 - DNA, 20 bp, Artificial
  CRISPR gRNA sequence
gggggcaacaataagcaaga

SEQ ID NO: 432062 - DNA, 20 bp, Artificial
  CRISPR gRNA sequence
aacaataagcaagacagatc

SEQ ID NO: 432063 - DNA, 20 bp, Artificial
  CRISPR gRNA sequence
cctataccgtcttgaaattt

SEQ ID NO: 432064 - DNA, 20 bp, Artificial
  CRISPR gRNA sequence
accgtcttgaaatttaagtt

SEQ ID NO: 432065 - DNA, 20 bp, Artificial
  CRISPR gRNA sequence
ccgtcttgaaatttaagttt

SEQ ID NO: 432066 - DNA, 20 bp, Artificial
  CRISPR gRNA sequence
cgtcttgaaatttaagttta

SEQ ID NO: 432067 - DNA, 20 bp, Artificial
  CRISPR gRNA sequence
ttagggaccactctctgtca

SEQ ID NO: 432068 - DNA, 20 bp, Artificial
  CRISPR gRNA sequence
tagggaccactctctgtcaa

SEQ ID NO: 432069 - DNA, 20 bp, Artificial
  CRISPR gRNA sequence
ccactctctgtcaaaggatc

SEQ ID NO: 432070 - DNA, 20 bp, Artificial
  CRISPR gRNA sequence
tctgtcaaaggatccagcgc

SEQ ID NO: 432071 - DNA, 20 bp, Artificial
  CRISPR gRNA sequence
aggatccagcgctggtaata

SEQ ID NO: 432072 - DNA, 20 bp, Artificial
  CRISPR gRNA sequence
gctggtaatatagattgctg

SEQ ID NO: 432073 - DNA, 20 bp, Artificial
  CRISPR gRNA sequence
ctggtaatatagattgctga

SEQ ID NO: 432074 - DNA, 20 bp, Artificial
  CRISPR gRNA sequence
ggcctttgccttctttccac

SEQ ID NO: 432075 - DNA, 20 bp, Artificial
  CRISPR gRNA sequence
gcctttgccttctttccacc

SEQ ID NO: 432076 - DNA, 20 bp, Artificial
  CRISPR gRNA sequence
gccttctttccaccaggcaa

SEQ ID NO: 432077 - DNA, 20 bp, Artificial
  CRISPR gRNA sequence
ttcttcttctgtgaaaaata

SEQ ID NO: 432078 - DNA, 20 bp, Artificial
  CRISPR gRNA sequence
ttctgtgaaaaatatagctt

SEQ ID NO: 432079 - DNA, 20 bp, Artificial
  CRISPR gRNA sequence
tgaaaaatatagcttcagtt

SEQ ID NO: 432080 - DNA, 20 bp, Artificial
  CRISPR gRNA sequence
ttcagtttggtccacgaata

SEQ ID NO: 432081 - DNA, 20 bp, Artificial
  CRISPR gRNA sequence
agtttggtccacgaatacag

SEQ ID NO: 432082 - DNA, 20 bp, Artificial
  CRISPR gRNA sequence
tggtccacgaatacagaagt

SEQ ID NO: 432083 - DNA, 20 bp, Artificial
  CRISPR gRNA sequence
ccacgaatacagaagttggt

SEQ ID NO: 432084 - DNA, 20 bp, Artificial
  CRISPR gRNA sequence
acgaatacagaagttggtca

SEQ ID NO: 432085 - DNA, 20 bp, Artificial
  CRISPR gRNA sequence
ggtcagagatattttctttc

SEQ ID NO: 432086 - DNA, 20 bp, Artificial
  CRISPR gRNA sequence
ttttctttcaagcacacaac

SEQ ID NO: 432087 - DNA, 20 bp, Artificial
  CRISPR gRNA sequence
agcacacaacaagcaaaact

SEQ ID NO: 432088 - DNA, 20 bp, Artificial
  CRISPR gRNA sequence
aaatgcacttcgtttttccc

SEQ ID NO: 432089 - DNA, 20 bp, Artificial
  CRISPR gRNA sequence
aatgcacttcgtttttccct

SEQ ID NO: 432090 - DNA, 20 bp, Artificial
  CRISPR gRNA sequence
tgcacttcgtttttccctgg

SEQ ID NO: 432091 - DNA, 20 bp, Artificial
  CRISPR gRNA sequence
tgggagctcctgccacatct

SEQ ID NO: 432092 - DNA, 20 bp, Artificial
  CRISPR gRNA sequence
cctgccacatctcagccctg

SEQ ID NO: 432093 - DNA, 20 bp, Artificial
  CRISPR gRNA sequence
ctgccacatctcagccctgc

SEQ ID NO: 432094 - DNA, 20 bp, Artificial
  CRISPR gRNA sequence
tgccacatctcagccctgca

SEQ ID NO: 432095 - DNA, 20 bp, Artificial
  CRISPR gRNA sequence
cacatctcagccctgcaggg

SEQ ID NO: 432096 - DNA, 20 bp, Artificial
  CRISPR gRNA sequence
ccctgcagggcagtcttcat

SEQ ID NO: 432097 - DNA, 20 bp, Artificial
  CRISPR gRNA sequence
cctgcagggcagtcttcata

SEQ ID NO: 432098 - DNA, 20 bp, Artificial
  CRISPR gRNA sequence
ctgcagggcagtcttcataa

SEQ ID NO: 432099 - DNA, 20 bp, Artificial
  CRISPR gRNA sequence
gcagggcagtcttcataagg

SEQ ID NO: 432100 - DNA, 20 bp, Artificial
  CRISPR gRNA sequence
agtcttcataagggagacaa

SEQ ID NO: 432101 - DNA, 20 bp, Artificial
  CRISPR gRNA sequence
cttcataagggagacaaaag

SEQ ID NO: 432102 - DNA, 20 bp, Artificial
  CRISPR gRNA sequence
ttcataagggagacaaaaga

SEQ ID NO: 432103 - DNA, 20 bp, Artificial
  CRISPR gRNA sequence
tcataagggagacaaaagaa

SEQ ID NO: 432104 - DNA, 20 bp, Artificial
  CRISPR gRNA sequence
acaaaagaagggctatgcac

SEQ ID NO: 432105 - DNA, 20 bp, Artificial
  CRISPR gRNA sequence
gggctatgcactggcactga

SEQ ID NO: 432106 - DNA, 20 bp, Artificial
  CRISPR gRNA sequence
tatgcactggcactgacagt

SEQ ID NO: 432107 - DNA, 20 bp, Artificial
  CRISPR gRNA sequence
atgcactggcactgacagtt

SEQ ID NO: 432108 - DNA, 20 bp, Artificial
  CRISPR gRNA sequence
cactggcactgacagttggg

SEQ ID NO: 432109 - DNA, 20 bp, Artificial
  CRISPR gRNA sequence
actggcactgacagttgggc

SEQ ID NO: 432110 - DNA, 20 bp, Artificial
  CRISPR gRNA sequence
ggcactgacagttgggcagg

SEQ ID NO: 432111 - DNA, 20 bp, Artificial
  CRISPR gRNA sequence
tgggcaggcagtgctcaaat

SEQ ID NO: 432112 - DNA, 20 bp, Artificial
  CRISPR gRNA sequence
agcctaaatctcaacattcc

SEQ ID NO: 432113 - DNA, 20 bp, Artificial
  CRISPR gRNA sequence
gcctaaatctcaacattcca

SEQ ID NO: 432114 - DNA, 20 bp, Artificial
  CRISPR gRNA sequence
cctaaatctcaacattccaa

SEQ ID NO: 432115 - DNA, 20 bp, Artificial
  CRISPR gRNA sequence
aacattccaagggaatcttc

SEQ ID NO: 432116 - DNA, 20 bp, Artificial
  CRISPR gRNA sequence
ccaagggaatcttcaagatc

SEQ ID NO: 432117 - DNA, 20 bp, Artificial
  CRISPR gRNA sequence
caagggaatcttcaagatca

SEQ ID NO: 432118 - DNA, 20 bp, Artificial
  CRISPR gRNA sequence
gggaatcttcaagatcaagg

SEQ ID NO: 432119 - DNA, 20 bp, Artificial
  CRISPR gRNA sequence
cttcaagatcaaggtagacc

SEQ ID NO: 432120 - DNA, 20 bp, Artificial
  CRISPR gRNA sequence
agatcaaggtagacctggtc

SEQ ID NO: 432121 - DNA, 20 bp, Artificial
  CRISPR gRNA sequence
cagtcatctcttaatctttt

SEQ ID NO: 432122 - DNA, 20 bp, Artificial
  CRISPR gRNA sequence
agtcatctcttaatctttta

SEQ ID NO: 432123 - DNA, 20 bp, Artificial
  CRISPR gRNA sequence
cttaatcttttaaggatcac

SEQ ID NO: 432124 - DNA, 20 bp, Artificial
  CRISPR gRNA sequence
atcttttaaggatcactggc

SEQ ID NO: 432125 - DNA, 20 bp, Artificial
  CRISPR gRNA sequence
taaggatcactggctggatg

SEQ ID NO: 432126 - DNA, 20 bp, Artificial
  CRISPR gRNA sequence
ggatcactggctggatgtgg

SEQ ID NO: 432127 - DNA, 20 bp, Artificial
  CRISPR gRNA sequence
gtggctcacgcctgtaatcc

SEQ ID NO: 432128 - DNA, 20 bp, Artificial
  CRISPR gRNA sequence
cgcctgtaatcccagtgctt

SEQ ID NO: 432129 - DNA, 20 bp, Artificial
  CRISPR gRNA sequence
gcctgtaatcccagtgcttt

SEQ ID NO: 432130 - DNA, 20 bp, Artificial
  CRISPR gRNA sequence
ctgtaatcccagtgctttgg

SEQ ID NO: 432131 - DNA, 20 bp, Artificial
  CRISPR gRNA sequence
tgtaatcccagtgctttggg

SEQ ID NO: 432132 - DNA, 20 bp, Artificial
  CRISPR gRNA sequence
tcccagtgctttgggaggcc

SEQ ID NO: 432133 - DNA, 20 bp, Artificial
  CRISPR gRNA sequence
cccagtgctttgggaggccg

SEQ ID NO: 432134 - DNA, 20 bp, Artificial
  CRISPR gRNA sequence
agtgctttgggaggccgagg

SEQ ID NO: 432135 - DNA, 20 bp, Artificial
  CRISPR gRNA sequence
gtgctttgggaggccgaggc

SEQ ID NO: 432136 - DNA, 20 bp, Artificial
  CRISPR gRNA sequence
ggccgaggcaggcaaatcat

SEQ ID NO: 432137 - DNA, 20 bp, Artificial
  CRISPR gRNA sequence
gccgaggcaggcaaatcatg

SEQ ID NO: 432138 - DNA, 20 bp, Artificial
  CRISPR gRNA sequence
aggcaggcaaatcatgaggt

SEQ ID NO: 432139 - DNA, 20 bp, Artificial
  CRISPR gRNA sequence
ggcaggcaaatcatgaggtc

SEQ ID NO: 432140 - DNA, 20 bp, Artificial
  CRISPR gRNA sequence
caggcaaatcatgaggtcag

SEQ ID NO: 432141 - DNA, 20 bp, Artificial
  CRISPR gRNA sequence
aatcatgaggtcaggagttt

SEQ ID NO: 432142 - DNA, 20 bp, Artificial
  CRISPR gRNA sequence
tcaggagtttgagaccacac

SEQ ID NO: 432143 - DNA, 20 bp, Artificial
  CRISPR gRNA sequence
tgagaccacactggccaaca

SEQ ID NO: 432144 - DNA, 20 bp, Artificial
  CRISPR gRNA sequence
ctactaaaaatacaacaaat

SEQ ID NO: 432145 - DNA, 20 bp, Artificial
  CRISPR gRNA sequence
taaaaatacaacaaattagc

SEQ ID NO: 432146 - DNA, 20 bp, Artificial
  CRISPR gRNA sequence
aaaaatacaacaaattagct

SEQ ID NO: 432147 - DNA, 20 bp, Artificial
  CRISPR gRNA sequence
tacaacaaattagctgggca

SEQ ID NO: 432148 - DNA, 20 bp, Artificial
  CRISPR gRNA sequence
aacaaattagctgggcatgg

SEQ ID NO: 432149 - DNA, 20 bp, Artificial
  CRISPR gRNA sequence
gtggtgcatgcctgtaatcc

SEQ ID NO: 432150 - DNA, 20 bp, Artificial
  CRISPR gRNA sequence
tgcctgtaatcccagccact

SEQ ID NO: 432151 - DNA, 20 bp, Artificial
  CRISPR gRNA sequence
gcctgtaatcccagccactc

SEQ ID NO: 432152 - DNA, 20 bp, Artificial
  CRISPR gRNA sequence
ctgtaatcccagccactcag

SEQ ID NO: 432153 - DNA, 20 bp, Artificial
  CRISPR gRNA sequence
tgtaatcccagccactcagg

SEQ ID NO: 432154 - DNA, 20 bp, Artificial
  CRISPR gRNA sequence
tcccagccactcaggaggct

SEQ ID NO: 432155 - DNA, 20 bp, Artificial
  CRISPR gRNA sequence
cccagccactcaggaggctg

SEQ ID NO: 432156 - DNA, 20 bp, Artificial
  CRISPR gRNA sequence
agccactcaggaggctgagg

SEQ ID NO: 432157 - DNA, 20 bp, Artificial
  CRISPR gRNA sequence
gccactcaggaggctgaggc

SEQ ID NO: 432158 - DNA, 20 bp, Artificial
  CRISPR gRNA sequence
cactcaggaggctgaggcag

SEQ ID NO: 432159 - DNA, 20 bp, Artificial
  CRISPR gRNA sequence
gcaggagaatcgcttgaacc

SEQ ID NO: 432160 - DNA, 20 bp, Artificial
  CRISPR gRNA sequence
caggagaatcgcttgaaccc

SEQ ID NO: 432161 - DNA, 20 bp, Artificial
  CRISPR gRNA sequence
ggagaatcgcttgaacccag

SEQ ID NO: 432162 - DNA, 20 bp, Artificial
  CRISPR gRNA sequence
gagaatcgcttgaacccagg

SEQ ID NO: 432163 - DNA, 20 bp, Artificial
  CRISPR gRNA sequence
aatcgcttgaacccaggagg

SEQ ID NO: 432164 - DNA, 20 bp, Artificial
  CRISPR gRNA sequence
tcgcttgaacccaggaggcg

SEQ ID NO: 432165 - DNA, 20 bp, Artificial
  CRISPR gRNA sequence
aacccaggaggcggagcttg

SEQ ID NO: 432166 - DNA, 20 bp, Artificial
  CRISPR gRNA sequence
caggaggcggagcttgcagt

SEQ ID NO: 432167 - DNA, 20 bp, Artificial
  CRISPR gRNA sequence
ggcggagcttgcagtgagcc

SEQ ID NO: 432168 - DNA, 20 bp, Artificial
  CRISPR gRNA sequence
gagattgtgccattgcactc

SEQ ID NO: 432169 - DNA, 20 bp, Artificial
  CRISPR gRNA sequence
tgtgccattgcactccagcc

SEQ ID NO: 432170 - DNA, 20 bp, Artificial
  CRISPR gRNA sequence
gtgccattgcactccagcct

SEQ ID NO: 432171 - DNA, 20 bp, Artificial
  CRISPR gRNA sequence
ttgcactccagcctgggcaa

SEQ ID NO: 432172 - DNA, 20 bp, Artificial
  CRISPR gRNA sequence
gcactccagcctgggcaaca

SEQ ID NO: 432173 - DNA, 20 bp, Artificial
  CRISPR gRNA sequence
tccagcctgggcaacagagc

SEQ ID NO: 432174 - DNA, 20 bp, Artificial
  CRISPR gRNA sequence
tctcaaaaacaaaaaacaaa

SEQ ID NO: 432175 - DNA, 20 bp, Artificial
  CRISPR gRNA sequence
ctcaaaaacaaaaaacaaaa

SEQ ID NO: 432176 - DNA, 20 bp, Artificial
  CRISPR gRNA sequence
tcaaaaacaaaaaacaaaaa

SEQ ID NO: 432177 - DNA, 20 bp, Artificial
  CRISPR gRNA sequence
caaaaaacaaaaagggatca

SEQ ID NO: 432178 - DNA, 20 bp, Artificial
  CRISPR gRNA sequence
tcacagatctctttgaaaat

SEQ ID NO: 432179 - DNA, 20 bp, Artificial
  CRISPR gRNA sequence
cagatctctttgaaaatcag

SEQ ID NO: 432180 - DNA, 20 bp, Artificial
  CRISPR gRNA sequence
ttgaaaatcagtggcccctt

SEQ ID NO: 432181 - DNA, 20 bp, Artificial
  CRISPR gRNA sequence
ttagactttctgtgccaaaa

SEQ ID NO: 432182 - DNA, 20 bp, Artificial
  CRISPR gRNA sequence
aaaaagttatgctttcacct

SEQ ID NO: 432183 - DNA, 20 bp, Artificial
  CRISPR gRNA sequence
tatgctttcacctcagcacc

SEQ ID NO: 432184 - DNA, 20 bp, Artificial
  CRISPR gRNA sequence
cctcagcacccagttttccc

SEQ ID NO: 432185 - DNA, 20 bp, Artificial
  CRISPR gRNA sequence
agttttccctagtttatctg

SEQ ID NO: 432186 - DNA, 20 bp, Artificial
  CRISPR gRNA sequence
ctagtttatctgaagtttca

SEQ ID NO: 432187 - DNA, 20 bp, Artificial
  CRISPR gRNA sequence
tatgatgtgcccgaatttcc

SEQ ID NO: 432188 - DNA, 20 bp, Artificial
  CRISPR gRNA sequence
tgatgtgcccgaatttcctg

SEQ ID NO: 432189 - DNA, 20 bp, Artificial
  CRISPR gRNA sequence
gcccgaatttcctggagctc

SEQ ID NO: 432190 - DNA, 20 bp, Artificial
  CRISPR gRNA sequence
ccgaatttcctggagctcca

SEQ ID NO: 432191 - DNA, 20 bp, Artificial
  CRISPR gRNA sequence
agctccagagaccccacgtc

SEQ ID NO: 432192 - DNA, 20 bp, Artificial
  CRISPR gRNA sequence
gaccccacgtcaagaattcc

SEQ ID NO: 432193 - DNA, 20 bp, Artificial
  CRISPR gRNA sequence
agaattcctagtgtatataa

SEQ ID NO: 432194 - DNA, 20 bp, Artificial
  CRISPR gRNA sequence
gtgtatataaaagcccgttt

SEQ ID NO: 432195 - DNA, 20 bp, Artificial
  CRISPR gRNA sequence
gctctaacatccatgattaa

SEQ ID NO: 432196 - DNA, 20 bp, Artificial
  CRISPR gRNA sequence
catccatgattaacagtctc

SEQ ID NO: 432197 - DNA, 20 bp, Artificial
  CRISPR gRNA sequence
atccatgattaacagtctct

SEQ ID NO: 432198 - DNA, 20 bp, Artificial
  CRISPR gRNA sequence
atgattaacagtctctgggt

SEQ ID NO: 432199 - DNA, 20 bp, Artificial
  CRISPR gRNA sequence
tgattaacagtctctgggtt

SEQ ID NO: 432200 - DNA, 20 bp, Artificial
  CRISPR gRNA sequence
tctgggttgggtaactctgt

SEQ ID NO: 432201 - DNA, 20 bp, Artificial
  CRISPR gRNA sequence
taactctgttggcttaaata

SEQ ID NO: 432202 - DNA, 20 bp, Artificial
  CRISPR gRNA sequence
actctgttggcttaaataca

SEQ ID NO: 432203 - DNA, 20 bp, Artificial
  CRISPR gRNA sequence
ctctgttggcttaaatacag

SEQ ID NO: 432204 - DNA, 20 bp, Artificial
  CRISPR gRNA sequence
aggcaatgacatgcctgttt

SEQ ID NO: 432205 - DNA, 20 bp, Artificial
  CRISPR gRNA sequence
atgacatgcctgtttaagtt

SEQ ID NO: 432206 - DNA, 20 bp, Artificial
  CRISPR gRNA sequence
atgcctgtttaagttcagtg

SEQ ID NO: 432207 - DNA, 20 bp, Artificial
  CRISPR gRNA sequence
tgcctgtttaagttcagtgc

SEQ ID NO: 432208 - DNA, 20 bp, Artificial
  CRISPR gRNA sequence
tttaagttcagtgcaggtcc

SEQ ID NO: 432209 - DNA, 20 bp, Artificial
  CRISPR gRNA sequence
tcccagttcaattcccatgt

SEQ ID NO: 432210 - DNA, 20 bp, Artificial
  CRISPR gRNA sequence
gagtcattatcttctgaaaa

SEQ ID NO: 432211 - DNA, 20 bp, Artificial
  CRISPR gRNA sequence
agtcattatcttctgaaaat

SEQ ID NO: 432212 - DNA, 20 bp, Artificial
  CRISPR gRNA sequence
aatgggaaaactctgctcca

SEQ ID NO: 432213 - DNA, 20 bp, Artificial
  CRISPR gRNA sequence
gggaaaactctgctccatag

SEQ ID NO: 432214 - DNA, 20 bp, Artificial
  CRISPR gRNA sequence
aaaactctgctccatagcag

SEQ ID NO: 432215 - DNA, 20 bp, Artificial
  CRISPR gRNA sequence
ctctgctccatagcagtgga

SEQ ID NO: 432216 - DNA, 20 bp, Artificial
  CRISPR gRNA sequence
gtggacagaacctccaaaac

SEQ ID NO: 432217 - DNA, 20 bp, Artificial
  CRISPR gRNA sequence
acagaacctccaaaaccagt

SEQ ID NO: 432218 - DNA, 20 bp, Artificial
  CRISPR gRNA sequence
cagaacctccaaaaccagtc

SEQ ID NO: 432219 - DNA, 20 bp, Artificial
  CRISPR gRNA sequence
ccaaaaccagtcaggtgaca

SEQ ID NO: 432220 - DNA, 20 bp, Artificial
  CRISPR gRNA sequence
cagtcaggtgacacagctca

SEQ ID NO: 432221 - DNA, 20 bp, Artificial
  CRISPR gRNA sequence
acagctcatagtttctgaaa

SEQ ID NO: 432222 - DNA, 20 bp, Artificial
  CRISPR gRNA sequence
tctgaaaaagacaaaacacc

SEQ ID NO: 432223 - DNA, 20 bp, Artificial
  CRISPR gRNA sequence
aaaacaccaagctcaaaaat

SEQ ID NO: 432224 - DNA, 20 bp, Artificial
  CRISPR gRNA sequence
aaacaccaagctcaaaaata

SEQ ID NO: 432225 - DNA, 20 bp, Artificial
  CRISPR gRNA sequence
caccaagctcaaaaataagg

SEQ ID NO: 432226 - DNA, 20 bp, Artificial
  CRISPR gRNA sequence
aagctcaaaaataaggtggt

SEQ ID NO: 432227 - DNA, 20 bp, Artificial
  CRISPR gRNA sequence
aaataaggtggttggatcta

SEQ ID NO: 432228 - DNA, 20 bp, Artificial
  CRISPR gRNA sequence
gttggatctatggcattgca

SEQ ID NO: 432229 - DNA, 20 bp, Artificial
  CRISPR gRNA sequence
cattgcaaagcgacaaccca

SEQ ID NO: 432230 - DNA, 20 bp, Artificial
  CRISPR gRNA sequence
attgcaaagcgacaacccaa

SEQ ID NO: 432231 - DNA, 20 bp, Artificial
  CRISPR gRNA sequence
agcgacaacccaaaggttgt

SEQ ID NO: 432232 - DNA, 20 bp, Artificial
  CRISPR gRNA sequence
gcgacaacccaaaggttgtg

SEQ ID NO: 432233 - DNA, 20 bp, Artificial
  CRISPR gRNA sequence
cgacaacccaaaggttgtga

SEQ ID NO: 432234 - DNA, 20 bp, Artificial
  CRISPR gRNA sequence
gttgctgcctgctgctgaca

SEQ ID NO: 432235 - DNA, 20 bp, Artificial
  CRISPR gRNA sequence
gacatagcaataatactcat

SEQ ID NO: 432236 - DNA, 20 bp, Artificial
  CRISPR gRNA sequence
acatagcaataatactcatt

SEQ ID NO: 432237 - DNA, 20 bp, Artificial
  CRISPR gRNA sequence
ttcatatacgttctcttcaa

SEQ ID NO: 432238 - DNA, 20 bp, Artificial
  CRISPR gRNA sequence
atacgttctcttcaatggta

SEQ ID NO: 432239 - DNA, 20 bp, Artificial
  CRISPR gRNA sequence
tggtatagatgttttcttct

SEQ ID NO: 432240 - DNA, 20 bp, Artificial
  CRISPR gRNA sequence
ctactgcatttgccaatcct

SEQ ID NO: 432241 - DNA, 20 bp, Artificial
  CRISPR gRNA sequence
tactgcatttgccaatcctg

SEQ ID NO: 432242 - DNA, 20 bp, Artificial
  CRISPR gRNA sequence
actgcatttgccaatcctga

SEQ ID NO: 432243 - DNA, 20 bp, Artificial
  CRISPR gRNA sequence
tgcatttgccaatcctgagg

SEQ ID NO: 432244 - DNA, 20 bp, Artificial
  CRISPR gRNA sequence
gcatttgccaatcctgaggg

SEQ ID NO: 432245 - DNA, 20 bp, Artificial
  CRISPR gRNA sequence
catttgccaatcctgaggga

SEQ ID NO: 432246 - DNA, 20 bp, Artificial
  CRISPR gRNA sequence
tttgccaatcctgagggagg

SEQ ID NO: 432247 - DNA, 20 bp, Artificial
  CRISPR gRNA sequence
ttgccaatcctgagggaggg

SEQ ID NO: 432248 - DNA, 20 bp, Artificial
  CRISPR gRNA sequence
caatcctgagggagggaggt

SEQ ID NO: 432249 - DNA, 20 bp, Artificial
  CRISPR gRNA sequence
tgagggagggaggttggcca

SEQ ID NO: 432250 - DNA, 20 bp, Artificial
  CRISPR gRNA sequence
agggagggaggttggccaaa

SEQ ID NO: 432251 - DNA, 20 bp, Artificial
  CRISPR gRNA sequence
gggaggttggccaaagagat

SEQ ID NO: 432252 - DNA, 20 bp, Artificial
  CRISPR gRNA sequence
ggaggttggccaaagagatg

SEQ ID NO: 432253 - DNA, 20 bp, Artificial
  CRISPR gRNA sequence
tggccaaagagatgaggctg

SEQ ID NO: 432254 - DNA, 20 bp, Artificial
  CRISPR gRNA sequence
gagatgaggctgtggaaata

SEQ ID NO: 432255 - DNA, 20 bp, Artificial
  CRISPR gRNA sequence
gctgtggaaataaagtgttg

SEQ ID NO: 432256 - DNA, 20 bp, Artificial
  CRISPR gRNA sequence
ggaaataaagtgttgcggtt

SEQ ID NO: 432257 - DNA, 20 bp, Artificial
  CRISPR gRNA sequence
taaagtgttgcggttgagtt

SEQ ID NO: 432258 - DNA, 20 bp, Artificial
  CRISPR gRNA sequence
cggttgagttaagcatttcc

SEQ ID NO: 432259 - DNA, 20 bp, Artificial
  CRISPR gRNA sequence
ggttgagttaagcatttccc

SEQ ID NO: 432260 - DNA, 20 bp, Artificial
  CRISPR gRNA sequence
taagcatttcccaggtaaca

SEQ ID NO: 432261 - DNA, 20 bp, Artificial
  CRISPR gRNA sequence
atttcccaggtaacacggaa

SEQ ID NO: 432262 - DNA, 20 bp, Artificial
  CRISPR gRNA sequence
ttcccaggtaacacggaata

SEQ ID NO: 432263 - DNA, 20 bp, Artificial
  CRISPR gRNA sequence
aggtaacacggaatagagtt

SEQ ID NO: 432264 - DNA, 20 bp, Artificial
  CRISPR gRNA sequence
gtaacacggaatagagttaa

SEQ ID NO: 432265 - DNA, 20 bp, Artificial
  CRISPR gRNA sequence
acggaatagagttaagagaa

SEQ ID NO: 432266 - DNA, 20 bp, Artificial
  CRISPR gRNA sequence
cggaatagagttaagagaat

SEQ ID NO: 432267 - DNA, 20 bp, Artificial
  CRISPR gRNA sequence
taagagaataggctttccca

SEQ ID NO: 432268 - DNA, 20 bp, Artificial
  CRISPR gRNA sequence
agagaataggctttcccaaa

SEQ ID NO: 432269 - DNA, 20 bp, Artificial
  CRISPR gRNA sequence
aataggctttcccaaagaga

SEQ ID NO: 432270 - DNA, 20 bp, Artificial
  CRISPR gRNA sequence
aaagagacagcaactaaata

SEQ ID NO: 432271 - DNA, 20 bp, Artificial
  CRISPR gRNA sequence
tatagtgcatgatctttgat

SEQ ID NO: 432272 - DNA, 20 bp, Artificial
  CRISPR gRNA sequence
tctttgatcagatgctgaac

SEQ ID NO: 432273 - DNA, 20 bp, Artificial
  CRISPR gRNA sequence
ttgatcagatgctgaacaag

SEQ ID NO: 432274 - DNA, 20 bp, Artificial
  CRISPR gRNA sequence
cagatgctgaacaagtggaa

SEQ ID NO: 432275 - DNA, 20 bp, Artificial
  CRISPR gRNA sequence
gctgaacaagtggaaaagcc

SEQ ID NO: 432276 - DNA, 20 bp, Artificial
  CRISPR gRNA sequence
caagtggaaaagccaagaaa

SEQ ID NO: 432277 - DNA, 20 bp, Artificial
  CRISPR gRNA sequence
gaaatagcaataaaatacta

SEQ ID NO: 432278 - DNA, 20 bp, Artificial
  CRISPR gRNA sequence
aaatagcaataaaatactat

SEQ ID NO: 432279 - DNA, 20 bp, Artificial
  CRISPR gRNA sequence
aatagcaataaaatactatg

SEQ ID NO: 432280 - DNA, 20 bp, Artificial
  CRISPR gRNA sequence
aatactatggggaaacaatt

SEQ ID NO: 432281 - DNA, 20 bp, Artificial
  CRISPR gRNA sequence
tccattaattttaattttct

SEQ ID NO: 432282 - DNA, 20 bp, Artificial
  CRISPR gRNA sequence
ccattaattttaattttctt

SEQ ID NO: 432283 - DNA, 20 bp, Artificial
  CRISPR gRNA sequence
aattttcttaggtataacaa

SEQ ID NO: 432284 - DNA, 20 bp, Artificial
  CRISPR gRNA sequence
gtataacaacagcattgtga

SEQ ID NO: 432285 - DNA, 20 bp, Artificial
  CRISPR gRNA sequence
acaacagcattgtgatagct

SEQ ID NO: 432286 - DNA, 20 bp, Artificial
  CRISPR gRNA sequence
aacagcattgtgatagctaa

SEQ ID NO: 432287 - DNA, 20 bp, Artificial
  CRISPR gRNA sequence
aagagaatatttttatttct

SEQ ID NO: 432288 - DNA, 20 bp, Artificial
  CRISPR gRNA sequence
gagaatatttttatttctcg

SEQ ID NO: 432289 - DNA, 20 bp, Artificial
  CRISPR gRNA sequence
agaatatttttatttctcgg

SEQ ID NO: 432290 - DNA, 20 bp, Artificial
  CRISPR gRNA sequence
atttttatttctcggaggtg

SEQ ID NO: 432291 - DNA, 20 bp, Artificial
  CRISPR gRNA sequence
tttttatttctcggaggtgc

SEQ ID NO: 432292 - DNA, 20 bp, Artificial
  CRISPR gRNA sequence
tttctcggaggtgcaggctg

SEQ ID NO: 432293 - DNA, 20 bp, Artificial
  CRISPR gRNA sequence
cggaggtgcaggctgaagtt

SEQ ID NO: 432294 - DNA, 20 bp, Artificial
  CRISPR gRNA sequence
ggaggtgcaggctgaagttt

SEQ ID NO: 432295 - DNA, 20 bp, Artificial
  CRISPR gRNA sequence
tgcaggctgaagtttaggtg

SEQ ID NO: 432296 - DNA, 20 bp, Artificial
  CRISPR gRNA sequence
tgaagtttaggtgaagtatc

SEQ ID NO: 432297 - DNA, 20 bp, Artificial
  CRISPR gRNA sequence
tctgcaattatgtacacatt

SEQ ID NO: 432298 - DNA, 20 bp, Artificial
  CRISPR gRNA sequence
acatttagattttcaaaaaa

SEQ ID NO: 432299 - DNA, 20 bp, Artificial
  CRISPR gRNA sequence
catttagattttcaaaaaat

SEQ ID NO: 432300 - DNA, 20 bp, Artificial
  CRISPR gRNA sequence
tagattttcaaaaaatgggc

SEQ ID NO: 432301 - DNA, 20 bp, Artificial
  CRISPR gRNA sequence
agattttcaaaaaatgggcc

SEQ ID NO: 432302 - DNA, 20 bp, Artificial
  CRISPR gRNA sequence
aaaaaatgggccgggcgccg

SEQ ID NO: 432303 - DNA, 20 bp, Artificial
  CRISPR gRNA sequence
gtggctcacgcctgtaatcc

SEQ ID NO: 432304 - DNA, 20 bp, Artificial
  CRISPR gRNA sequence
cgcctgtaatcccagcactt

SEQ ID NO: 432305 - DNA, 20 bp, Artificial
  CRISPR gRNA sequence
gcctgtaatcccagcacttt

SEQ ID NO: 432306 - DNA, 20 bp, Artificial
  CRISPR gRNA sequence
ctgtaatcccagcactttgg

SEQ ID NO: 432307 - DNA, 20 bp, Artificial
  CRISPR gRNA sequence
tgtaatcccagcactttggg

SEQ ID NO: 432308 - DNA, 20 bp, Artificial
  CRISPR gRNA sequence
tcccagcactttgggaggct

SEQ ID NO: 432309 - DNA, 20 bp, Artificial
  CRISPR gRNA sequence
gcactttgggaggctgagcc

SEQ ID NO: 432310 - DNA, 20 bp, Artificial
  CRISPR gRNA sequence
ctttgggaggctgagcctgg

SEQ ID NO: 432311 - DNA, 20 bp, Artificial
  CRISPR gRNA sequence
ggctgagcctggcagatcac

SEQ ID NO: 432312 - DNA, 20 bp, Artificial
  CRISPR gRNA sequence
gctgagcctggcagatcacg

SEQ ID NO: 432313 - DNA, 20 bp, Artificial
  CRISPR gRNA sequence
agcctggcagatcacgaggt

SEQ ID NO: 432314 - DNA, 20 bp, Artificial
  CRISPR gRNA sequence
gcctggcagatcacgaggtc

SEQ ID NO: 432315 - DNA, 20 bp, Artificial
  CRISPR gRNA sequence
ctggcagatcacgaggtcag

SEQ ID NO: 432316 - DNA, 20 bp, Artificial
  CRISPR gRNA sequence
gatcacgaggtcaggagttc

SEQ ID NO: 432317 - DNA, 20 bp, Artificial
  CRISPR gRNA sequence
cgaggtcaggagttcgagac

SEQ ID NO: 432318 - DNA, 20 bp, Artificial
  CRISPR gRNA sequence
tcaggagttcgagaccagcc

SEQ ID NO: 432319 - DNA, 20 bp, Artificial
  CRISPR gRNA sequence
cgagaccagcctggccaaca

SEQ ID NO: 432320 - DNA, 20 bp, Artificial
  CRISPR gRNA sequence
ctactaaacatacaaaaaat

SEQ ID NO: 432321 - DNA, 20 bp, Artificial
  CRISPR gRNA sequence
taaacatacaaaaaattagc

SEQ ID NO: 432322 - DNA, 20 bp, Artificial
  CRISPR gRNA sequence
atacaaaaaattagccagcg

SEQ ID NO: 432323 - DNA, 20 bp, Artificial
  CRISPR gRNA sequence
caaaaaattagccagcgtgg

SEQ ID NO: 432324 - DNA, 20 bp, Artificial
  CRISPR gRNA sequence
gtggcatgcacctgtaatcc

SEQ ID NO: 432325 - DNA, 20 bp, Artificial
  CRISPR gRNA sequence
cacctgtaatcccagctact

SEQ ID NO: 432326 - DNA, 20 bp, Artificial
  CRISPR gRNA sequence
acctgtaatcccagctactt

SEQ ID NO: 432327 - DNA, 20 bp, Artificial
  CRISPR gRNA sequence
ctgtaatcccagctacttgg

SEQ ID NO: 432328 - DNA, 20 bp, Artificial
  CRISPR gRNA sequence
tgtaatcccagctacttggg

SEQ ID NO: 432329 - DNA, 20 bp, Artificial
  CRISPR gRNA sequence
agctacttgggaggctaatg

SEQ ID NO: 432330 - DNA, 20 bp, Artificial
  CRISPR gRNA sequence
ctacttgggaggctaatgca

SEQ ID NO: 432331 - DNA, 20 bp, Artificial
  CRISPR gRNA sequence
gcagagaatcgcttgaaccc

SEQ ID NO: 432332 - DNA, 20 bp, Artificial
  CRISPR gRNA sequence
gagaatcgcttgaacccgag

SEQ ID NO: 432333 - DNA, 20 bp, Artificial
  CRISPR gRNA sequence
aatcgcttgaacccgagaag

SEQ ID NO: 432334 - DNA, 20 bp, Artificial
  CRISPR gRNA sequence
tcgcttgaacccgagaagca

SEQ ID NO: 432335 - DNA, 20 bp, Artificial
  CRISPR gRNA sequence
cgcttgaacccgagaagcag

SEQ ID NO: 432336 - DNA, 20 bp, Artificial
  CRISPR gRNA sequence
aacccgagaagcagaggtta

SEQ ID NO: 432337 - DNA, 20 bp, Artificial
  CRISPR gRNA sequence
cgagaagcagaggttatagt

SEQ ID NO: 432338 - DNA, 20 bp, Artificial
  CRISPR gRNA sequence
agcagaggttatagtgagcc

SEQ ID NO: 432339 - DNA, 20 bp, Artificial
  CRISPR gRNA sequence
gcagaggttatagtgagccg

SEQ ID NO: 432340 - DNA, 20 bp, Artificial
  CRISPR gRNA sequence
gaggttgtgccactgcactc

SEQ ID NO: 432341 - DNA, 20 bp, Artificial
  CRISPR gRNA sequence
tgtgccactgcactccagcc

SEQ ID NO: 432342 - DNA, 20 bp, Artificial
  CRISPR gRNA sequence
gtgccactgcactccagcct

SEQ ID NO: 432343 - DNA, 20 bp, Artificial
  CRISPR gRNA sequence
ctgcactccagcctgggtga

SEQ ID NO: 432344 - DNA, 20 bp, Artificial
  CRISPR gRNA sequence
gcactccagcctgggtgaca

SEQ ID NO: 432345 - DNA, 20 bp, Artificial
  CRISPR gRNA sequence
tccagcctgggtgacagagc

SEQ ID NO: 432346 - DNA, 20 bp, Artificial
  CRISPR gRNA sequence
aaaaaaaattattaatgctt

SEQ ID NO: 432347 - DNA, 20 bp, Artificial
  CRISPR gRNA sequence
aaaattattaatgctttaga

SEQ ID NO: 432348 - DNA, 20 bp, Artificial
  CRISPR gRNA sequence
atgctttagatagcattcaa

SEQ ID NO: 432349 - DNA, 20 bp, Artificial
  CRISPR gRNA sequence
tttagatagcattcaatgga

SEQ ID NO: 432350 - DNA, 20 bp, Artificial
  CRISPR gRNA sequence
tagatagcattcaatggaca

SEQ ID NO: 432351 - DNA, 20 bp, Artificial
  CRISPR gRNA sequence
agatagcattcaatggacag

SEQ ID NO: 432352 - DNA, 20 bp, Artificial
  CRISPR gRNA sequence
tgttttgttttgtttgatgc

SEQ ID NO: 432353 - DNA, 20 bp, Artificial
  CRISPR gRNA sequence
gttttgttttgtttgatgct

SEQ ID NO: 432354 - DNA, 20 bp, Artificial
  CRISPR gRNA sequence
ctgggtctttctctgtcacc

SEQ ID NO: 432355 - DNA, 20 bp, Artificial
  CRISPR gRNA sequence
tgggtctttctctgtcaccc

SEQ ID NO: 432356 - DNA, 20 bp, Artificial
  CRISPR gRNA sequence
gtctttctctgtcacccagg

SEQ ID NO: 432357 - DNA, 20 bp, Artificial
  CRISPR gRNA sequence
tctttctctgtcacccaggt

SEQ ID NO: 432358 - DNA, 20 bp, Artificial
  CRISPR gRNA sequence
ctgtcacccaggtgggaatg

SEQ ID NO: 432359 - DNA, 20 bp, Artificial
  CRISPR gRNA sequence
tcacccaggtgggaatgcag

SEQ ID NO: 432360 - DNA, 20 bp, Artificial
  CRISPR gRNA sequence
ggaatgcagtggcacaatca

SEQ ID NO: 432361 - DNA, 20 bp, Artificial
  CRISPR gRNA sequence
ggcacaatcatggctcattg

SEQ ID NO: 432362 - DNA, 20 bp, Artificial
  CRISPR gRNA sequence
agccttcatctcctgtgctc

SEQ ID NO: 432363 - DNA, 20 bp, Artificial
  CRISPR gRNA sequence
ctaatgtttccatttttttg

SEQ ID NO: 432364 - DNA, 20 bp, Artificial
  CRISPR gRNA sequence
aatgtttccatttttttgta

SEQ ID NO: 432365 - DNA, 20 bp, Artificial
  CRISPR gRNA sequence
gtttccatttttttgtagag

SEQ ID NO: 432366 - DNA, 20 bp, Artificial
  CRISPR gRNA sequence
ttccatttttttgtagagaa

SEQ ID NO: 432367 - DNA, 20 bp, Artificial
  CRISPR gRNA sequence
tccatttttttgtagagaag

SEQ ID NO: 432368 - DNA, 20 bp, Artificial
  CRISPR gRNA sequence
agaggtctcatcatgttgcc

SEQ ID NO: 432369 - DNA, 20 bp, Artificial
  CRISPR gRNA sequence
gaggtctcatcatgttgccc

SEQ ID NO: 432370 - DNA, 20 bp, Artificial
  CRISPR gRNA sequence
tctcatcatgttgcccaggc

SEQ ID NO: 432371 - DNA, 20 bp, Artificial
  CRISPR gRNA sequence
ccaggctggtcttgaactcc

SEQ ID NO: 432372 - DNA, 20 bp, Artificial
  CRISPR gRNA sequence
caggctggtcttgaactcct

SEQ ID NO: 432373 - DNA, 20 bp, Artificial
  CRISPR gRNA sequence
ctcatgtgatcctcccacct

SEQ ID NO: 432374 - DNA, 20 bp, Artificial
  CRISPR gRNA sequence
cctcccacctcagcctccca

SEQ ID NO: 432375 - DNA, 20 bp, Artificial
  CRISPR gRNA sequence
acctcagcctcccaaagtgc

SEQ ID NO: 432376 - DNA, 20 bp, Artificial
  CRISPR gRNA sequence
cctcagcctcccaaagtgct

SEQ ID NO: 432377 - DNA, 20 bp, Artificial
  CRISPR gRNA sequence
ctcccaaagtgctgggctta

SEQ ID NO: 432378 - DNA, 20 bp, Artificial
  CRISPR gRNA sequence
tcccaaagtgctgggcttat

SEQ ID NO: 432379 - DNA, 20 bp, Artificial
  CRISPR gRNA sequence
agtgctgggcttataggcgt

SEQ ID NO: 432380 - DNA, 20 bp, Artificial
  CRISPR gRNA sequence
gggcttataggcgtaagcca

SEQ ID NO: 432381 - DNA, 20 bp, Artificial
  CRISPR gRNA sequence
taggcgtaagccacagcacc

SEQ ID NO: 432382 - DNA, 20 bp, Artificial
  CRISPR gRNA sequence
gtaagccacagcacctagcc

SEQ ID NO: 432383 - DNA, 20 bp, Artificial
  CRISPR gRNA sequence
catgtgccaaacatcactaa

SEQ ID NO: 432384 - DNA, 20 bp, Artificial
  CRISPR gRNA sequence
atcactaaaagtctaaaatc

SEQ ID NO: 432385 - DNA, 20 bp, Artificial
  CRISPR gRNA sequence
ctaaaagtctaaaatctagt

SEQ ID NO: 432386 - DNA, 20 bp, Artificial
  CRISPR gRNA sequence
taaaatctagtaagttatgt

SEQ ID NO: 432387 - DNA, 20 bp, Artificial
  CRISPR gRNA sequence
taagccatacctatttgaaa

SEQ ID NO: 432388 - DNA, 20 bp, Artificial
  CRISPR gRNA sequence
acctatttgaaatggatgtg

SEQ ID NO: 432389 - DNA, 20 bp, Artificial
  CRISPR gRNA sequence
cctatttgaaatggatgtgt

SEQ ID NO: 432390 - DNA, 20 bp, Artificial
  CRISPR gRNA sequence
gatgtgtgggtgtgtataat

SEQ ID NO: 432391 - DNA, 20 bp, Artificial
  CRISPR gRNA sequence
atgtgtgggtgtgtataatc

SEQ ID NO: 432392 - DNA, 20 bp, Artificial
  CRISPR gRNA sequence
ggtgtgtataatcaggaacg

SEQ ID NO: 432393 - DNA, 20 bp, Artificial
  CRISPR gRNA sequence
gtgtgtataatcaggaacga

SEQ ID NO: 432394 - DNA, 20 bp, Artificial
  CRISPR gRNA sequence
tataatcaggaacgaaggtc

SEQ ID NO: 432395 - DNA, 20 bp, Artificial
  CRISPR gRNA sequence
atcaggaacgaaggtcaaga

SEQ ID NO: 432396 - DNA, 20 bp, Artificial
  CRISPR gRNA sequence
tcaggaacgaaggtcaagac

SEQ ID NO: 432397 - DNA, 20 bp, Artificial
  CRISPR gRNA sequence
aggaacgaaggtcaagacag

SEQ ID NO: 432398 - DNA, 20 bp, Artificial
  CRISPR gRNA sequence
gtcaagacaggagtctataa

SEQ ID NO: 432399 - DNA, 20 bp, Artificial
  CRISPR gRNA sequence
gacaggagtctataacagac

SEQ ID NO: 432400 - DNA, 20 bp, Artificial
  CRISPR gRNA sequence
aggagtctataacagactag

SEQ ID NO: 432401 - DNA, 20 bp, Artificial
  CRISPR gRNA sequence
tataacagactagcagttct

SEQ ID NO: 432402 - DNA, 20 bp, Artificial
  CRISPR gRNA sequence
tctcagccctgactgttcac

SEQ ID NO: 432403 - DNA, 20 bp, Artificial
  CRISPR gRNA sequence
gactgttcactagaatcacc

SEQ ID NO: 432404 - DNA, 20 bp, Artificial
  CRISPR gRNA sequence
ctgttcactagaatcacctg

SEQ ID NO: 432405 - DNA, 20 bp, Artificial
  CRISPR gRNA sequence
gttcactagaatcacctgga

SEQ ID NO: 432406 - DNA, 20 bp, Artificial
  CRISPR gRNA sequence
agaatcacctggagagcttt

SEQ ID NO: 432407 - DNA, 20 bp, Artificial
  CRISPR gRNA sequence
tttagaacaatttctatgct

SEQ ID NO: 432408 - DNA, 20 bp, Artificial
  CRISPR gRNA sequence
ttagaacaatttctatgctt

SEQ ID NO: 432409 - DNA, 20 bp, Artificial
  CRISPR gRNA sequence
ctatgcttaggcttcatccc

SEQ ID NO: 432410 - DNA, 20 bp, Artificial
  CRISPR gRNA sequence
atgcttaggcttcatcccca

SEQ ID NO: 432411 - DNA, 20 bp, Artificial
  CRISPR gRNA sequence
catccccagagattctgatt

SEQ ID NO: 432412 - DNA, 20 bp, Artificial
  CRISPR gRNA sequence
agattctgattcagttgctc

SEQ ID NO: 432413 - DNA, 20 bp, Artificial
  CRISPR gRNA sequence
gattctgattcagttgctct

SEQ ID NO: 432414 - DNA, 20 bp, Artificial
  CRISPR gRNA sequence
attctgattcagttgctctg

SEQ ID NO: 432415 - DNA, 20 bp, Artificial
  CRISPR gRNA sequence
tgattcagttgctctggggt

SEQ ID NO: 432416 - DNA, 20 bp, Artificial
  CRISPR gRNA sequence
ctctggggttggccctgcat

SEQ ID NO: 432417 - DNA, 20 bp, Artificial
  CRISPR gRNA sequence
ggccctgcattagtacactt

SEQ ID NO: 432418 - DNA, 20 bp, Artificial
  CRISPR gRNA sequence
cattagtacacttcagtgcc

SEQ ID NO: 432419 - DNA, 20 bp, Artificial
  CRISPR gRNA sequence
attagtacacttcagtgcct

SEQ ID NO: 432420 - DNA, 20 bp, Artificial
  CRISPR gRNA sequence
cagtgcctgggtgattctaa

SEQ ID NO: 432421 - DNA, 20 bp, Artificial
  CRISPR gRNA sequence
agtgcctgggtgattctaat

SEQ ID NO: 432422 - DNA, 20 bp, Artificial
  CRISPR gRNA sequence
gtgattctaataggaaacta

SEQ ID NO: 432423 - DNA, 20 bp, Artificial
  CRISPR gRNA sequence
aaactaaagttgaaaatgcc

SEQ ID NO: 432424 - DNA, 20 bp, Artificial
  CRISPR gRNA sequence
aactaaagttgaaaatgcct

SEQ ID NO: 432425 - DNA, 20 bp, Artificial
  CRISPR gRNA sequence
gaaaatgcctgggctgttta

SEQ ID NO: 432426 - DNA, 20 bp, Artificial
  CRISPR gRNA sequence
gggctgtttacagaaatgct

SEQ ID NO: 432427 - DNA, 20 bp, Artificial
  CRISPR gRNA sequence
gtttacagaaatgctgagaa

SEQ ID NO: 432428 - DNA, 20 bp, Artificial
  CRISPR gRNA sequence
gaaatgctgagaacagatac

SEQ ID NO: 432429 - DNA, 20 bp, Artificial
  CRISPR gRNA sequence
aaatgctgagaacagatact

SEQ ID NO: 432430 - DNA, 20 bp, Artificial
  CRISPR gRNA sequence
tgctcacttctgtaacgcct

SEQ ID NO: 432431 - DNA, 20 bp, Artificial
  CRISPR gRNA sequence
acttctgtaacgcctaagtg

SEQ ID NO: 432432 - DNA, 20 bp, Artificial
  CRISPR gRNA sequence
tgtaacgcctaagtgcagcc

SEQ ID NO: 432433 - DNA, 20 bp, Artificial
  CRISPR gRNA sequence
cctaagtgcagcccagaccc

SEQ ID NO: 432434 - DNA, 20 bp, Artificial
  CRISPR gRNA sequence
agcccagaccctggatataa

SEQ ID NO: 432435 - DNA, 20 bp, Artificial
  CRISPR gRNA sequence
gcccagaccctggatataat

SEQ ID NO: 432436 - DNA, 20 bp, Artificial
  CRISPR gRNA sequence
ccagaccctggatataatag

SEQ ID NO: 432437 - DNA, 20 bp, Artificial
  CRISPR gRNA sequence
agctcaatccgttgatgttt

SEQ ID NO: 432438 - DNA, 20 bp, Artificial
  CRISPR gRNA sequence
aatccgttgatgtttcagtt

SEQ ID NO: 432439 - DNA, 20 bp, Artificial
  CRISPR gRNA sequence
ccgttgatgtttcagttcag

SEQ ID NO: 432440 - DNA, 20 bp, Artificial
  CRISPR gRNA sequence
gtggaaaaaccattaatatc

SEQ ID NO: 432441 - DNA, 20 bp, Artificial
  CRISPR gRNA sequence
ccattaatatcgagatgaat

SEQ ID NO: 432442 - DNA, 20 bp, Artificial
  CRISPR gRNA sequence
gaataagcatgttgtattat

SEQ ID NO: 432443 - DNA, 20 bp, Artificial
  CRISPR gRNA sequence
aataagcatgttgtattatt

SEQ ID NO: 432444 - DNA, 20 bp, Artificial
  CRISPR gRNA sequence
ataagcatgttgtattatta

SEQ ID NO: 432445 - DNA, 20 bp, Artificial
  CRISPR gRNA sequence
taaattctataccttaactt

SEQ ID NO: 432446 - DNA, 20 bp, Artificial
  CRISPR gRNA sequence
ataccttaactttagaacta

SEQ ID NO: 432447 - DNA, 20 bp, Artificial
  CRISPR gRNA sequence
ccttaactttagaactaaag

SEQ ID NO: 432448 - DNA, 20 bp, Artificial
  CRISPR gRNA sequence
aactttagaactaaagaagc

SEQ ID NO: 432449 - DNA, 20 bp, Artificial
  CRISPR gRNA sequence
ctttagaactaaagaagcta

SEQ ID NO: 432450 - DNA, 20 bp, Artificial
  CRISPR gRNA sequence
tttagaactaaagaagctag

SEQ ID NO: 432451 - DNA, 20 bp, Artificial
  CRISPR gRNA sequence
actaaagaagctagaggtgt

SEQ ID NO: 432452 - DNA, 20 bp, Artificial
  CRISPR gRNA sequence
ctaaagaagctagaggtgtc

SEQ ID NO: 432453 - DNA, 20 bp, Artificial
  CRISPR gRNA sequence
aagaagctagaggtgtcagg

SEQ ID NO: 432454 - DNA, 20 bp, Artificial
  CRISPR gRNA sequence
gaggtgtcaggaagtacaca

SEQ ID NO: 432455 - DNA, 20 bp, Artificial
  CRISPR gRNA sequence
gtgtcaggaagtacacacag

SEQ ID NO: 432456 - DNA, 20 bp, Artificial
  CRISPR gRNA sequence
ttacattttcacttcataac

SEQ ID NO: 432457 - DNA, 20 bp, Artificial
  CRISPR gRNA sequence
tttcacttcataactagacc

SEQ ID NO: 432458 - DNA, 20 bp, Artificial
  CRISPR gRNA sequence
tcacttcataactagaccta

SEQ ID NO: 432459 - DNA, 20 bp, Artificial
  CRISPR gRNA sequence
ttcataactagacctagaga

SEQ ID NO: 432460 - DNA, 20 bp, Artificial
  CRISPR gRNA sequence
ataactagacctagagaaag

SEQ ID NO: 432461 - DNA, 20 bp, Artificial
  CRISPR gRNA sequence
taactagacctagagaaaga

SEQ ID NO: 432462 - DNA, 20 bp, Artificial
  CRISPR gRNA sequence
ctagacctagagaaagaagg

SEQ ID NO: 432463 - DNA, 20 bp, Artificial
  CRISPR gRNA sequence
gaaagaaggaagtataaact

SEQ ID NO: 432464 - DNA, 20 bp, Artificial
  CRISPR gRNA sequence
aagtataaactcagatctca

SEQ ID NO: 432465 - DNA, 20 bp, Artificial
  CRISPR gRNA sequence
aaactcagatctcaaagccc

SEQ ID NO: 432466 - DNA, 20 bp, Artificial
  CRISPR gRNA sequence
aactcagatctcaaagcccc

SEQ ID NO: 432467 - DNA, 20 bp, Artificial
  CRISPR gRNA sequence
cagatctcaaagccccagga

SEQ ID NO: 432468 - DNA, 20 bp, Artificial
  CRISPR gRNA sequence
agatctcaaagccccaggac

SEQ ID NO: 432469 - DNA, 20 bp, Artificial
  CRISPR gRNA sequence
agccccaggacaggatttct

SEQ ID NO: 432470 - DNA, 20 bp, Artificial
  CRISPR gRNA sequence
ccccaggacaggatttctca

SEQ ID NO: 432471 - DNA, 20 bp, Artificial
  CRISPR gRNA sequence
ggacaggatttctcagagaa

SEQ ID NO: 432472 - DNA, 20 bp, Artificial
  CRISPR gRNA sequence
ggatttctcagagaaaagat

SEQ ID NO: 432473 - DNA, 20 bp, Artificial
  CRISPR gRNA sequence
agagaaaagatcagacatgt

SEQ ID NO: 432474 - DNA, 20 bp, Artificial
  CRISPR gRNA sequence
agaaaagatcagacatgtta

SEQ ID NO: 432475 - DNA, 20 bp, Artificial
  CRISPR gRNA sequence
aaagatcagacatgttagag

SEQ ID NO: 432476 - DNA, 20 bp, Artificial
  CRISPR gRNA sequence
aagatcagacatgttagagt

SEQ ID NO: 432477 - DNA, 20 bp, Artificial
  CRISPR gRNA sequence
agatcagacatgttagagta

SEQ ID NO: 432478 - DNA, 20 bp, Artificial
  CRISPR gRNA sequence
atgttagagtagggacttcc

SEQ ID NO: 432479 - DNA, 20 bp, Artificial
  CRISPR gRNA sequence
ctgtatcttctctttgctat

SEQ ID NO: 432480 - DNA, 20 bp, Artificial
  CRISPR gRNA sequence
tctttgctatgagaataccc

SEQ ID NO: 432481 - DNA, 20 bp, Artificial
  CRISPR gRNA sequence
tgctatgagaataccctagt

SEQ ID NO: 432482 - DNA, 20 bp, Artificial
  CRISPR gRNA sequence
gctatgagaataccctagta

SEQ ID NO: 432483 - DNA, 20 bp, Artificial
  CRISPR gRNA sequence
ctatgagaataccctagtaa

SEQ ID NO: 432484 - DNA, 20 bp, Artificial
  CRISPR gRNA sequence
tatgagaataccctagtaag

SEQ ID NO: 432485 - DNA, 20 bp, Artificial
  CRISPR gRNA sequence
atgagaataccctagtaagg

SEQ ID NO: 432486 - DNA, 20 bp, Artificial
  CRISPR gRNA sequence
ccctagtaagggggaaacaa

SEQ ID NO: 432487 - DNA, 20 bp, Artificial
  CRISPR gRNA sequence
aatgcattcataaaataaat

SEQ ID NO: 432488 - DNA, 20 bp, Artificial
  CRISPR gRNA sequence
attcataaaataaatgagac

SEQ ID NO: 432489 - DNA, 20 bp, Artificial
  CRISPR gRNA sequence
aaatgagacaagaaatcaaa

SEQ ID NO: 432490 - DNA, 20 bp, Artificial
  CRISPR gRNA sequence
aatgagacaagaaatcaaat

SEQ ID NO: 432491 - DNA, 20 bp, Artificial
  CRISPR gRNA sequence
aagaaatcaaataggttcac

SEQ ID NO: 432492 - DNA, 20 bp, Artificial
  CRISPR gRNA sequence
aaatcaaataggttcactgg

SEQ ID NO: 432493 - DNA, 20 bp, Artificial
  CRISPR gRNA sequence
aggttcactggaagcacgca

SEQ ID NO: 432494 - DNA, 20 bp, Artificial
  CRISPR gRNA sequence
cactggaagcacgcatagtt

SEQ ID NO: 432495 - DNA, 20 bp, Artificial
  CRISPR gRNA sequence
actggaagcacgcatagttt

SEQ ID NO: 432496 - DNA, 20 bp, Artificial
  CRISPR gRNA sequence
ctggaagcacgcatagttta

SEQ ID NO: 432497 - DNA, 20 bp, Artificial
  CRISPR gRNA sequence
acgcatagtttagggaaatc

SEQ ID NO: 432498 - DNA, 20 bp, Artificial
  CRISPR gRNA sequence
agggaaatctggtctcatct

SEQ ID NO: 432499 - DNA, 20 bp, Artificial
  CRISPR gRNA sequence
atctggtctcatctcagatt

SEQ ID NO: 432500 - DNA, 20 bp, Artificial
  CRISPR gRNA sequence
gaaactctcaacgtgtgcct

SEQ ID NO: 432501 - DNA, 20 bp, Artificial
  CRISPR gRNA sequence
ctctcaacgtgtgccttaga

SEQ ID NO: 432502 - DNA, 20 bp, Artificial
  CRISPR gRNA sequence
gtgtgccttagatagttata

SEQ ID NO: 432503 - DNA, 20 bp, Artificial
  CRISPR gRNA sequence
gatagttatatggactgtgt

SEQ ID NO: 432504 - DNA, 20 bp, Artificial
  CRISPR gRNA sequence
tgtgttagaaaataataata

SEQ ID NO: 432505 - DNA, 20 bp, Artificial
  CRISPR gRNA sequence
tcttatttaacaaatattat

SEQ ID NO: 432506 - DNA, 20 bp, Artificial
  CRISPR gRNA sequence
tgagacctctactatgtgtc

SEQ ID NO: 432507 - DNA, 20 bp, Artificial
  CRISPR gRNA sequence
gacctctactatgtgtctgg

SEQ ID NO: 432508 - DNA, 20 bp, Artificial
  CRISPR gRNA sequence
tatgtgtctggcagtttgcc

SEQ ID NO: 432509 - DNA, 20 bp, Artificial
  CRISPR gRNA sequence
tctggcagtttgcctggcac

SEQ ID NO: 432510 - DNA, 20 bp, Artificial
  CRISPR gRNA sequence
ctggcagtttgcctggcaca

SEQ ID NO: 432511 - DNA, 20 bp, Artificial
  CRISPR gRNA sequence
tttgcctggcacaaggaaca

SEQ ID NO: 432512 - DNA, 20 bp, Artificial
  CRISPR gRNA sequence
ttgcctggcacaaggaacac

SEQ ID NO: 432513 - DNA, 20 bp, Artificial
  CRISPR gRNA sequence
caaggaacacaggaacataa

SEQ ID NO: 432514 - DNA, 20 bp, Artificial
  CRISPR gRNA sequence
ggaacataaaagtgaattgt

SEQ ID NO: 432515 - DNA, 20 bp, Artificial
  CRISPR gRNA sequence
ttgtgagccctaatttcacg

SEQ ID NO: 432516 - DNA, 20 bp, Artificial
  CRISPR gRNA sequence
acgaagctcacgctctcctg

SEQ ID NO: 432517 - DNA, 20 bp, Artificial
  CRISPR gRNA sequence
cgaagctcacgctctcctgt

SEQ ID NO: 432518 - DNA, 20 bp, Artificial
  CRISPR gRNA sequence
aagctcacgctctcctgtgg

SEQ ID NO: 432519 - DNA, 20 bp, Artificial
  CRISPR gRNA sequence
cgctctcctgtgggagacca

SEQ ID NO: 432520 - DNA, 20 bp, Artificial
  CRISPR gRNA sequence
gtgggagaccaaagaaataa

SEQ ID NO: 432521 - DNA, 20 bp, Artificial
  CRISPR gRNA sequence
accaaagaaataaaagaaaa

SEQ ID NO: 432522 - DNA, 20 bp, Artificial
  CRISPR gRNA sequence
aataaaagaaaacagtaccc

SEQ ID NO: 432523 - DNA, 20 bp, Artificial
  CRISPR gRNA sequence
gaaaacagtaccccagaccc

SEQ ID NO: 432524 - DNA, 20 bp, Artificial
  CRISPR gRNA sequence
cagtaccccagacccaagac

SEQ ID NO: 432525 - DNA, 20 bp, Artificial
  CRISPR gRNA sequence
caagaccagcctgaccaaca

SEQ ID NO: 432526 - DNA, 20 bp, Artificial
  CRISPR gRNA sequence
agaccagcctgaccaacatg

SEQ ID NO: 432527 - DNA, 20 bp, Artificial
  CRISPR gRNA sequence
ctctactaaaaatacaaaat

SEQ ID NO: 432528 - DNA, 20 bp, Artificial
  CRISPR gRNA sequence
actaaaaatacaaaattagc

SEQ ID NO: 432529 - DNA, 20 bp, Artificial
  CRISPR gRNA sequence
aatacaaaattagctggatg

SEQ ID NO: 432530 - DNA, 20 bp, Artificial
  CRISPR gRNA sequence
acaaaattagctggatgtgg

SEQ ID NO: 432531 - DNA, 20 bp, Artificial
  CRISPR gRNA sequence
gtggcccatgcctgtaatcc

SEQ ID NO: 432532 - DNA, 20 bp, Artificial
  CRISPR gRNA sequence
tgcctgtaatcccagctact

SEQ ID NO: 432533 - DNA, 20 bp, Artificial
  CRISPR gRNA sequence
gcctgtaatcccagctactc

SEQ ID NO: 432534 - DNA, 20 bp, Artificial
  CRISPR gRNA sequence
ctgtaatcccagctactcgg

SEQ ID NO: 432535 - DNA, 20 bp, Artificial
  CRISPR gRNA sequence
tgtaatcccagctactcggg

SEQ ID NO: 432536 - DNA, 20 bp, Artificial
  CRISPR gRNA sequence
tcccagctactcgggaggct

SEQ ID NO: 432537 - DNA, 20 bp, Artificial
  CRISPR gRNA sequence
cccagctactcgggaggctg

SEQ ID NO: 432538 - DNA, 20 bp, Artificial
  CRISPR gRNA sequence
agctactcgggaggctgagg

SEQ ID NO: 432539 - DNA, 20 bp, Artificial
  CRISPR gRNA sequence
gctactcgggaggctgaggc

SEQ ID NO: 432540 - DNA, 20 bp, Artificial
  CRISPR gRNA sequence
tactcgggaggctgaggcag

SEQ ID NO: 432541 - DNA, 20 bp, Artificial
  CRISPR gRNA sequence
gcaggagaatcacatgaacc

SEQ ID NO: 432542 - DNA, 20 bp, Artificial
  CRISPR gRNA sequence
caggagaatcacatgaaccc

SEQ ID NO: 432543 - DNA, 20 bp, Artificial
  CRISPR gRNA sequence
ggagaatcacatgaacccgg

SEQ ID NO: 432544 - DNA, 20 bp, Artificial
  CRISPR gRNA sequence
aatcacatgaacccgggaga

SEQ ID NO: 432545 - DNA, 20 bp, Artificial
  CRISPR gRNA sequence
tcacatgaacccgggagacg

SEQ ID NO: 432546 - DNA, 20 bp, Artificial
  CRISPR gRNA sequence
cacatgaacccgggagacgg

SEQ ID NO: 432547 - DNA, 20 bp, Artificial
  CRISPR gRNA sequence
aacccgggagacggaggttg

SEQ ID NO: 432548 - DNA, 20 bp, Artificial
  CRISPR gRNA sequence
cgggagacggaggttgcggt

SEQ ID NO: 432549 - DNA, 20 bp, Artificial
  CRISPR gRNA sequence
gacggaggttgcggtgagcc

SEQ ID NO: 432550 - DNA, 20 bp, Artificial
  CRISPR gRNA sequence
aagattgcgccattgcactc

SEQ ID NO: 432551 - DNA, 20 bp, Artificial
  CRISPR gRNA sequence
tgcgccattgcactccagcc

SEQ ID NO: 432552 - DNA, 20 bp, Artificial
  CRISPR gRNA sequence
gcgccattgcactccagcct

SEQ ID NO: 432553 - DNA, 20 bp, Artificial
  CRISPR gRNA sequence
tgcactccagcctgggcaac

SEQ ID NO: 432554 - DNA, 20 bp, Artificial
  CRISPR gRNA sequence
cactccagcctgggcaacga

SEQ ID NO: 432555 - DNA, 20 bp, Artificial
  CRISPR gRNA sequence
aaaaaaaaaacaacaacaaa

SEQ ID NO: 432556 - DNA, 20 bp, Artificial
  CRISPR gRNA sequence
aaaaaaaaacaacaacaaaa

SEQ ID NO: 432557 - DNA, 20 bp, Artificial
  CRISPR gRNA sequence
aaacaacaacaaaaaggaaa

SEQ ID NO: 432558 - DNA, 20 bp, Artificial
  CRISPR gRNA sequence
aacaaaaaggaaatagtaaa

SEQ ID NO: 432559 - DNA, 20 bp, Artificial
  CRISPR gRNA sequence
acaaaaaggaaatagtaaat

SEQ ID NO: 432560 - DNA, 20 bp, Artificial
  CRISPR gRNA sequence
tcaaattatgatgtattata

SEQ ID NO: 432561 - DNA, 20 bp, Artificial
  CRISPR gRNA sequence
caaattatgatgtattataa

SEQ ID NO: 432562 - DNA, 20 bp, Artificial
  CRISPR gRNA sequence
tataaaggaaaccaacatca

SEQ ID NO: 432563 - DNA, 20 bp, Artificial
  CRISPR gRNA sequence
aaaccaacatcatagtgaaa

SEQ ID NO: 432564 - DNA, 20 bp, Artificial
  CRISPR gRNA sequence
catcatagtgaaacagataa

SEQ ID NO: 432565 - DNA, 20 bp, Artificial
  CRISPR gRNA sequence
tcatagtgaaacagataata

SEQ ID NO: 432566 - DNA, 20 bp, Artificial
  CRISPR gRNA sequence
atagtgaaacagataataga

SEQ ID NO: 432567 - DNA, 20 bp, Artificial
  CRISPR gRNA sequence
tagtgaaacagataatagag

SEQ ID NO: 432568 - DNA, 20 bp, Artificial
  CRISPR gRNA sequence
agtgaaacagataatagaga

SEQ ID NO: 432569 - DNA, 20 bp, Artificial
  CRISPR gRNA sequence
gaaacagataatagagaggg

SEQ ID NO: 432570 - DNA, 20 bp, Artificial
  CRISPR gRNA sequence
cagataatagagagggtggt

SEQ ID NO: 432571 - DNA, 20 bp, Artificial
  CRISPR gRNA sequence
agataatagagagggtggtc

SEQ ID NO: 432572 - DNA, 20 bp, Artificial
  CRISPR gRNA sequence
gataatagagagggtggtca

SEQ ID NO: 432573 - DNA, 20 bp, Artificial
  CRISPR gRNA sequence
aatagagagggtggtcaggg

SEQ ID NO: 432574 - DNA, 20 bp, Artificial
  CRISPR gRNA sequence
atagagagggtggtcaggga

SEQ ID NO: 432575 - DNA, 20 bp, Artificial
  CRISPR gRNA sequence
ggtggtcagggaaggaccct

SEQ ID NO: 432576 - DNA, 20 bp, Artificial
  CRISPR gRNA sequence
tggtcagggaaggaccctca

SEQ ID NO: 432577 - DNA, 20 bp, Artificial
  CRISPR gRNA sequence
gaccctcagagatgaacttt

SEQ ID NO: 432578 - DNA, 20 bp, Artificial
  CRISPR gRNA sequence
tttaagctcgtttctgaaat

SEQ ID NO: 432579 - DNA, 20 bp, Artificial
  CRISPR gRNA sequence
agctcgtttctgaaatgagt

SEQ ID NO: 432580 - DNA, 20 bp, Artificial
  CRISPR gRNA sequence
gtttctgaaatgagtcagcc

SEQ ID NO: 432581 - DNA, 20 bp, Artificial
  CRISPR gRNA sequence
tgaaatgagtcagccaagta

SEQ ID NO: 432582 - DNA, 20 bp, Artificial
  CRISPR gRNA sequence
aaatgagtcagccaagtaaa

SEQ ID NO: 432583 - DNA, 20 bp, Artificial
  CRISPR gRNA sequence
gagtcagccaagtaaagagc

SEQ ID NO: 432584 - DNA, 20 bp, Artificial
  CRISPR gRNA sequence
tcagccaagtaaagagccag

SEQ ID NO: 432585 - DNA, 20 bp, Artificial
  CRISPR gRNA sequence
cagccaagtaaagagccaga

SEQ ID NO: 432586 - DNA, 20 bp, Artificial
  CRISPR gRNA sequence
gccaagtaaagagccagaag

SEQ ID NO: 432587 - DNA, 20 bp, Artificial
  CRISPR gRNA sequence
aagagccagaaggagcattc

SEQ ID NO: 432588 - DNA, 20 bp, Artificial
  CRISPR gRNA sequence
agagccagaaggagcattcc

SEQ ID NO: 432589 - DNA, 20 bp, Artificial
  CRISPR gRNA sequence
cagaaggagcattccaggat

SEQ ID NO: 432590 - DNA, 20 bp, Artificial
  CRISPR gRNA sequence
agaaggagcattccaggatg

SEQ ID NO: 432591 - DNA, 20 bp, Artificial
  CRISPR gRNA sequence
gaaggagcattccaggatga

SEQ ID NO: 432592 - DNA, 20 bp, Artificial
  CRISPR gRNA sequence
aggagcattccaggatgagg

SEQ ID NO: 432593 - DNA, 20 bp, Artificial
  CRISPR gRNA sequence
ggatgagggagccccttgta

SEQ ID NO: 432594 - DNA, 20 bp, Artificial
  CRISPR gRNA sequence
ccccttgtaaagatcttgct

SEQ ID NO: 432595 - DNA, 20 bp, Artificial
  CRISPR gRNA sequence
agtacctgaaactgaaaacg

SEQ ID NO: 432596 - DNA, 20 bp, Artificial
  CRISPR gRNA sequence
cctgaaactgaaaacgtggc

SEQ ID NO: 432597 - DNA, 20 bp, Artificial
  CRISPR gRNA sequence
actgaaaacgtggctggatt

SEQ ID NO: 432598 - DNA, 20 bp, Artificial
  CRISPR gRNA sequence
ctgaaaacgtggctggatta

SEQ ID NO: 432599 - DNA, 20 bp, Artificial
  CRISPR gRNA sequence
tgaaaacgtggctggattaa

SEQ ID NO: 432600 - DNA, 20 bp, Artificial
  CRISPR gRNA sequence
aaaacgtggctggattaagg

SEQ ID NO: 432601 - DNA, 20 bp, Artificial
  CRISPR gRNA sequence
acgtggctggattaagggag

SEQ ID NO: 432602 - DNA, 20 bp, Artificial
  CRISPR gRNA sequence
ctggattaagggagcggccc

SEQ ID NO: 432603 - DNA, 20 bp, Artificial
  CRISPR gRNA sequence
ttaagggagcggcccaagat

SEQ ID NO: 432604 - DNA, 20 bp, Artificial
  CRISPR gRNA sequence
taagggagcggcccaagata

SEQ ID NO: 432605 - DNA, 20 bp, Artificial
  CRISPR gRNA sequence
cggcccaagataaggtctga

SEQ ID NO: 432606 - DNA, 20 bp, Artificial
  CRISPR gRNA sequence
ggcccaagataaggtctgaa

SEQ ID NO: 432607 - DNA, 20 bp, Artificial
  CRISPR gRNA sequence
ccaagataaggtctgaaagg

SEQ ID NO: 432608 - DNA, 20 bp, Artificial
  CRISPR gRNA sequence
caagataaggtctgaaaggt

SEQ ID NO: 432609 - DNA, 20 bp, Artificial
  CRISPR gRNA sequence
ataaggtctgaaaggtaggc

SEQ ID NO: 432610 - DNA, 20 bp, Artificial
  CRISPR gRNA sequence
taaggtctgaaaggtaggct

SEQ ID NO: 432611 - DNA, 20 bp, Artificial
  CRISPR gRNA sequence
aaggtctgaaaggtaggctg

SEQ ID NO: 432612 - DNA, 20 bp, Artificial
  CRISPR gRNA sequence
tctgaaaggtaggctggggc

SEQ ID NO: 432613 - DNA, 20 bp, Artificial
  CRISPR gRNA sequence
ctgaaaggtaggctggggct

SEQ ID NO: 432614 - DNA, 20 bp, Artificial
  CRISPR gRNA sequence
aggctggggctaggtccaat

SEQ ID NO: 432615 - DNA, 20 bp, Artificial
  CRISPR gRNA sequence
taggtccaataagacctttc

SEQ ID NO: 432616 - DNA, 20 bp, Artificial
  CRISPR gRNA sequence
aagacctttccagccataat

SEQ ID NO: 432617 - DNA, 20 bp, Artificial
  CRISPR gRNA sequence
agacctttccagccataatc

SEQ ID NO: 432618 - DNA, 20 bp, Artificial
  CRISPR gRNA sequence
acctttccagccataatcag

SEQ ID NO: 432619 - DNA, 20 bp, Artificial
  CRISPR gRNA sequence
tccagccataatcaggagtc

SEQ ID NO: 432620 - DNA, 20 bp, Artificial
  CRISPR gRNA sequence
aggagtctggattttattct

SEQ ID NO: 432621 - DNA, 20 bp, Artificial
  CRISPR gRNA sequence
ggattttattctaagacctg

SEQ ID NO: 432622 - DNA, 20 bp, Artificial
  CRISPR gRNA sequence
gattttattctaagacctgt

SEQ ID NO: 432623 - DNA, 20 bp, Artificial
  CRISPR gRNA sequence
ctaagacctgtaggaaacct

SEQ ID NO: 432624 - DNA, 20 bp, Artificial
  CRISPR gRNA sequence
ggaaaccttagatttccttg

SEQ ID NO: 432625 - DNA, 20 bp, Artificial
  CRISPR gRNA sequence
gaaaccttagatttccttga

SEQ ID NO: 432626 - DNA, 20 bp, Artificial
  CRISPR gRNA sequence
aaaccttagatttccttgaa

SEQ ID NO: 432627 - DNA, 20 bp, Artificial
  CRISPR gRNA sequence
ccttagatttccttgaaggg

SEQ ID NO: 432628 - DNA, 20 bp, Artificial
  CRISPR gRNA sequence
ttagatttccttgaagggca

SEQ ID NO: 432629 - DNA, 20 bp, Artificial
  CRISPR gRNA sequence
gatgtgatccttatttgttt

SEQ ID NO: 432630 - DNA, 20 bp, Artificial
  CRISPR gRNA sequence
atgtgatccttatttgtttt

SEQ ID NO: 432631 - DNA, 20 bp, Artificial
  CRISPR gRNA sequence
atctcatcatttctgtgttg

SEQ ID NO: 432632 - DNA, 20 bp, Artificial
  CRISPR gRNA sequence
tctcatcatttctgtgttgt

SEQ ID NO: 432633 - DNA, 20 bp, Artificial
  CRISPR gRNA sequence
atcatttctgtgttgtgggt

SEQ ID NO: 432634 - DNA, 20 bp, Artificial
  CRISPR gRNA sequence
tcatttctgtgttgtgggtc

SEQ ID NO: 432635 - DNA, 20 bp, Artificial
  CRISPR gRNA sequence
tgtgttgtgggtcaggaatc

SEQ ID NO: 432636 - DNA, 20 bp, Artificial
  CRISPR gRNA sequence
gtgttgtgggtcaggaatcc

SEQ ID NO: 432637 - DNA, 20 bp, Artificial
  CRISPR gRNA sequence
gtgggtcaggaatccaggtg

SEQ ID NO: 432638 - DNA, 20 bp, Artificial
  CRISPR gRNA sequence
ggaatccaggtgtggcttac

SEQ ID NO: 432639 - DNA, 20 bp, Artificial
  CRISPR gRNA sequence
gaatccaggtgtggcttact

SEQ ID NO: 432640 - DNA, 20 bp, Artificial
  CRISPR gRNA sequence
tgtggcttactgggtacctc

SEQ ID NO: 432641 - DNA, 20 bp, Artificial
  CRISPR gRNA sequence
ttactgggtacctctggatc

SEQ ID NO: 432642 - DNA, 20 bp, Artificial
  CRISPR gRNA sequence
tactgggtacctctggatca

SEQ ID NO: 432643 - DNA, 20 bp, Artificial
  CRISPR gRNA sequence
cctctggatcaaggtctttc

SEQ ID NO: 432644 - DNA, 20 bp, Artificial
  CRISPR gRNA sequence
ctctggatcaaggtctttca

SEQ ID NO: 432645 - DNA, 20 bp, Artificial
  CRISPR gRNA sequence
aggtctttcaaggtgtcttc

SEQ ID NO: 432646 - DNA, 20 bp, Artificial
  CRISPR gRNA sequence
ggtctttcaaggtgtcttct

SEQ ID NO: 432647 - DNA, 20 bp, Artificial
  CRISPR gRNA sequence
gtctttcaaggtgtcttctg

SEQ ID NO: 432648 - DNA, 20 bp, Artificial
  CRISPR gRNA sequence
caaggtgtcttctggggatg

SEQ ID NO: 432649 - DNA, 20 bp, Artificial
  CRISPR gRNA sequence
tttttttttttttttttttt

SEQ ID NO: 432650 - DNA, 20 bp, Artificial
  CRISPR gRNA sequence
ttttttttttttttttgaga

SEQ ID NO: 432651 - DNA, 20 bp, Artificial
  CRISPR gRNA sequence
tttttttttttttttgagac

SEQ ID NO: 432652 - DNA, 20 bp, Artificial
  CRISPR gRNA sequence
ttttttttttttttgagaca

SEQ ID NO: 432653 - DNA, 20 bp, Artificial
  CRISPR gRNA sequence
gagacagggtcttgctctgt

SEQ ID NO: 432654 - DNA, 20 bp, Artificial
  CRISPR gRNA sequence
cagggtcttgctctgttggc

SEQ ID NO: 432655 - DNA, 20 bp, Artificial
  CRISPR gRNA sequence
agggtcttgctctgttggcc

SEQ ID NO: 432656 - DNA, 20 bp, Artificial
  CRISPR gRNA sequence
tcttgctctgttggccaggc

SEQ ID NO: 432657 - DNA, 20 bp, Artificial
  CRISPR gRNA sequence
ctgttggccaggctggaatg

SEQ ID NO: 432658 - DNA, 20 bp, Artificial
  CRISPR gRNA sequence
ttggccaggctggaatgcag

SEQ ID NO: 432659 - DNA, 20 bp, Artificial
  CRISPR gRNA sequence
ccaggctggaatgcagtagt

SEQ ID NO: 432660 - DNA, 20 bp, Artificial
  CRISPR gRNA sequence
tgattgcaactttgaactcc

SEQ ID NO: 432661 - DNA, 20 bp, Artificial
  CRISPR gRNA sequence
gattgcaactttgaactcct

SEQ ID NO: 432662 - DNA, 20 bp, Artificial
  CRISPR gRNA sequence
aactttgaactcctgggctc

SEQ ID NO: 432663 - DNA, 20 bp, Artificial
  CRISPR gRNA sequence
actttgaactcctgggctca

SEQ ID NO: 432664 - DNA, 20 bp, Artificial
  CRISPR gRNA sequence
ctttgaactcctgggctcaa

SEQ ID NO: 432665 - DNA, 20 bp, Artificial
  CRISPR gRNA sequence
ctcaagggatctacccatct

SEQ ID NO: 432666 - DNA, 20 bp, Artificial
  CRISPR gRNA sequence
atctacccatctcagcttct

SEQ ID NO: 432667 - DNA, 20 bp, Artificial
  CRISPR gRNA sequence
tacccatctcagcttctgag

SEQ ID NO: 432668 - DNA, 20 bp, Artificial
  CRISPR gRNA sequence
catctcagcttctgagtagc

SEQ ID NO: 432669 - DNA, 20 bp, Artificial
  CRISPR gRNA sequence
cttctgagtagctagaacta

SEQ ID NO: 432670 - DNA, 20 bp, Artificial
  CRISPR gRNA sequence
ttctgagtagctagaactat

SEQ ID NO: 432671 - DNA, 20 bp, Artificial
  CRISPR gRNA sequence
actataggtgcacactacca

SEQ ID NO: 432672 - DNA, 20 bp, Artificial
  CRISPR gRNA sequence
taggtgcacactaccacagc

SEQ ID NO: 432673 - DNA, 20 bp, Artificial
  CRISPR gRNA sequence
ataattttttttaatgtttt

SEQ ID NO: 432674 - DNA, 20 bp, Artificial
  CRISPR gRNA sequence
taattttttttaatgttttt

SEQ ID NO: 432675 - DNA, 20 bp, Artificial
  CRISPR gRNA sequence
tttttttaatgtttttgggc

SEQ ID NO: 432676 - DNA, 20 bp, Artificial
  CRISPR gRNA sequence
taatgtttttgggctggatg

SEQ ID NO: 432677 - DNA, 20 bp, Artificial
  CRISPR gRNA sequence
tgtttttgggctggatgcag

SEQ ID NO: 432678 - DNA, 20 bp, Artificial
  CRISPR gRNA sequence
gtggctcacgcctgtaatcc

SEQ ID NO: 432679 - DNA, 20 bp, Artificial
  CRISPR gRNA sequence
cgcctgtaatcctagcactt

SEQ ID NO: 432680 - DNA, 20 bp, Artificial
  CRISPR gRNA sequence
gcctgtaatcctagcacttt

SEQ ID NO: 432681 - DNA, 20 bp, Artificial
  CRISPR gRNA sequence
ctgtaatcctagcactttgg

SEQ ID NO: 432682 - DNA, 20 bp, Artificial
  CRISPR gRNA sequence
tgtaatcctagcactttggg

SEQ ID NO: 432683 - DNA, 20 bp, Artificial
  CRISPR gRNA sequence
atcctagcactttgggaggc

SEQ ID NO: 432684 - DNA, 20 bp, Artificial
  CRISPR gRNA sequence
tcctagcactttgggaggca

SEQ ID NO: 432685 - DNA, 20 bp, Artificial
  CRISPR gRNA sequence
tagcactttgggaggcaagg

SEQ ID NO: 432686 - DNA, 20 bp, Artificial
  CRISPR gRNA sequence
agcactttgggaggcaaggc

SEQ ID NO: 432687 - DNA, 20 bp, Artificial
  CRISPR gRNA sequence
actttgggaggcaaggcagg

SEQ ID NO: 432688 - DNA, 20 bp, Artificial
  CRISPR gRNA sequence
gcaaggcaggtggatttctt

SEQ ID NO: 432689 - DNA, 20 bp, Artificial
  CRISPR gRNA sequence
gcaggtggatttcttgagct

SEQ ID NO: 432690 - DNA, 20 bp, Artificial
  CRISPR gRNA sequence
caggtggatttcttgagctt

SEQ ID NO: 432691 - DNA, 20 bp, Artificial
  CRISPR gRNA sequence
ggtggatttcttgagcttgg

SEQ ID NO: 432692 - DNA, 20 bp, Artificial
  CRISPR gRNA sequence
tttcttgagcttgggagttc

SEQ ID NO: 432693 - DNA, 20 bp, Artificial
  CRISPR gRNA sequence
tgagcttgggagttcgagac

SEQ ID NO: 432694 - DNA, 20 bp, Artificial
  CRISPR gRNA sequence
ttgggagttcgagaccagcc

SEQ ID NO: 432695 - DNA, 20 bp, Artificial
  CRISPR gRNA sequence
tgggagttcgagaccagcct

SEQ ID NO: 432696 - DNA, 20 bp, Artificial
  CRISPR gRNA sequence
cgagaccagcctgggcaaca

SEQ ID NO: 432697 - DNA, 20 bp, Artificial
  CRISPR gRNA sequence
tctactaaaaatacaaaaac

SEQ ID NO: 432698 - DNA, 20 bp, Artificial
  CRISPR gRNA sequence
ctaaaaatacaaaaactagc

SEQ ID NO: 432699 - DNA, 20 bp, Artificial
  CRISPR gRNA sequence
taaaaatacaaaaactagcc

SEQ ID NO: 432700 - DNA, 20 bp, Artificial
  CRISPR gRNA sequence
caaaaactagccaggtatgc

SEQ ID NO: 432701 - DNA, 20 bp, Artificial
  CRISPR gRNA sequence
ggtatgctggcacatgcccg

SEQ ID NO: 432702 - DNA, 20 bp, Artificial
  CRISPR gRNA sequence
ctggcacatgcccgtggtcc

SEQ ID NO: 432703 - DNA, 20 bp, Artificial
  CRISPR gRNA sequence
tgcccgtggtcctagctact

SEQ ID NO: 432704 - DNA, 20 bp, Artificial
  CRISPR gRNA sequence
cccgtggtcctagctacttg

SEQ ID NO: 432705 - DNA, 20 bp, Artificial
  CRISPR gRNA sequence
ccgtggtcctagctacttgg

SEQ ID NO: 432706 - DNA, 20 bp, Artificial
  CRISPR gRNA sequence
gtcctagctacttggaggct

SEQ ID NO: 432707 - DNA, 20 bp, Artificial
  CRISPR gRNA sequence
tcctagctacttggaggctg

SEQ ID NO: 432708 - DNA, 20 bp, Artificial
  CRISPR gRNA sequence
tagctacttggaggctgagg

SEQ ID NO: 432709 - DNA, 20 bp, Artificial
  CRISPR gRNA sequence
agctacttggaggctgaggc

SEQ ID NO: 432710 - DNA, 20 bp, Artificial
  CRISPR gRNA sequence
ctacttggaggctgaggcag

SEQ ID NO: 432711 - DNA, 20 bp, Artificial
  CRISPR gRNA sequence
acttggaggctgaggcagga

SEQ ID NO: 432712 - DNA, 20 bp, Artificial
  CRISPR gRNA sequence
gcaggagagttgcttgaact

SEQ ID NO: 432713 - DNA, 20 bp, Artificial
  CRISPR gRNA sequence
caggagagttgcttgaactc

SEQ ID NO: 432714 - DNA, 20 bp, Artificial
  CRISPR gRNA sequence
ggagagttgcttgaactcgg

SEQ ID NO: 432715 - DNA, 20 bp, Artificial
  CRISPR gRNA sequence
gagagttgcttgaactcggg

SEQ ID NO: 432716 - DNA, 20 bp, Artificial
  CRISPR gRNA sequence
agttgcttgaactcgggagg

SEQ ID NO: 432717 - DNA, 20 bp, Artificial
  CRISPR gRNA sequence
ttgcttgaactcgggaggta

SEQ ID NO: 432718 - DNA, 20 bp, Artificial
  CRISPR gRNA sequence
tgcttgaactcgggaggtag

SEQ ID NO: 432719 - DNA, 20 bp, Artificial
  CRISPR gRNA sequence
aactcgggaggtagaggttg

SEQ ID NO: 432720 - DNA, 20 bp, Artificial
  CRISPR gRNA sequence
cgggaggtagaggttgcagt

SEQ ID NO: 432721 - DNA, 20 bp, Artificial
  CRISPR gRNA sequence
atgatcacaccactgcactc

SEQ ID NO: 432722 - DNA, 20 bp, Artificial
  CRISPR gRNA sequence
cacaccactgcactccagcc

SEQ ID NO: 432723 - DNA, 20 bp, Artificial
  CRISPR gRNA sequence
acaccactgcactccagcct

SEQ ID NO: 432724 - DNA, 20 bp, Artificial
  CRISPR gRNA sequence
gtgaatctcaatatgttgcc

SEQ ID NO: 432725 - DNA, 20 bp, Artificial
  CRISPR gRNA sequence
tgaatctcaatatgttgccc

SEQ ID NO: 432726 - DNA, 20 bp, Artificial
  CRISPR gRNA sequence
tctcaatatgttgcccaggc

SEQ ID NO: 432727 - DNA, 20 bp, Artificial
  CRISPR gRNA sequence
ccaggctagtctcaaactcc

SEQ ID NO: 432728 - DNA, 20 bp, Artificial
  CRISPR gRNA sequence
agtctcaaactcctggcctc

SEQ ID NO: 432729 - DNA, 20 bp, Artificial
  CRISPR gRNA sequence
ctcaagtgactctcctgtct

SEQ ID NO: 432730 - DNA, 20 bp, Artificial
  CRISPR gRNA sequence
tctcctgtcttggcctcccg

SEQ ID NO: 432731 - DNA, 20 bp, Artificial
  CRISPR gRNA sequence
gtcttggcctcccgaagtgt

SEQ ID NO: 432732 - DNA, 20 bp, Artificial
  CRISPR gRNA sequence
tcttggcctcccgaagtgtt

SEQ ID NO: 432733 - DNA, 20 bp, Artificial
  CRISPR gRNA sequence
ctcccgaagtgttaggatta

SEQ ID NO: 432734 - DNA, 20 bp, Artificial
  CRISPR gRNA sequence
tcccgaagtgttaggattat

SEQ ID NO: 432735 - DNA, 20 bp, Artificial
  CRISPR gRNA sequence
agtgttaggattataggcat

SEQ ID NO: 432736 - DNA, 20 bp, Artificial
  CRISPR gRNA sequence
taggcatgagccattgtgct

SEQ ID NO: 432737 - DNA, 20 bp, Artificial
  CRISPR gRNA sequence
attgtgctcagacattgatt

SEQ ID NO: 432738 - DNA, 20 bp, Artificial
  CRISPR gRNA sequence
ttgtgctcagacattgattt

SEQ ID NO: 432739 - DNA, 20 bp, Artificial
  CRISPR gRNA sequence
attgatttgggttttaatat

SEQ ID NO: 432740 - DNA, 20 bp, Artificial
  CRISPR gRNA sequence
gggttttaatattggattcg

SEQ ID NO: 432741 - DNA, 20 bp, Artificial
  CRISPR gRNA sequence
ggttttaatattggattcga

SEQ ID NO: 432742 - DNA, 20 bp, Artificial
  CRISPR gRNA sequence
ttttaatattggattcgaag

SEQ ID NO: 432743 - DNA, 20 bp, Artificial
  CRISPR gRNA sequence
tttaatattggattcgaagg

SEQ ID NO: 432744 - DNA, 20 bp, Artificial
  CRISPR gRNA sequence
ttggattcgaaggaggaata

SEQ ID NO: 432745 - DNA, 20 bp, Artificial
  CRISPR gRNA sequence
cgaaggaggaataaagaaat

SEQ ID NO: 432746 - DNA, 20 bp, Artificial
  CRISPR gRNA sequence
aggaggaataaagaaatgag

SEQ ID NO: 432747 - DNA, 20 bp, Artificial
  CRISPR gRNA sequence
aagaaatgagaagataaatt

SEQ ID NO: 432748 - DNA, 20 bp, Artificial
  CRISPR gRNA sequence
aaatgagaagataaattaag

SEQ ID NO: 432749 - DNA, 20 bp, Artificial
  CRISPR gRNA sequence
gataaattaagtagaaataa

SEQ ID NO: 432750 - DNA, 20 bp, Artificial
  CRISPR gRNA sequence
aagtagaaataatggtgtct

SEQ ID NO: 432751 - DNA, 20 bp, Artificial
  CRISPR gRNA sequence
gtagaaataatggtgtcttg

SEQ ID NO: 432752 - DNA, 20 bp, Artificial
  CRISPR gRNA sequence
aaataatggtgtcttggagt

SEQ ID NO: 432753 - DNA, 20 bp, Artificial
  CRISPR gRNA sequence
aataatggtgtcttggagta

SEQ ID NO: 432754 - DNA, 20 bp, Artificial
  CRISPR gRNA sequence
tggtgtcttggagtaaggaa

SEQ ID NO: 432755 - DNA, 20 bp, Artificial
  CRISPR gRNA sequence
ttggagtaaggaatggccaa

SEQ ID NO: 432756 - DNA, 20 bp, Artificial
  CRISPR gRNA sequence
ggagtaaggaatggccaaaa

SEQ ID NO: 432757 - DNA, 20 bp, Artificial
  CRISPR gRNA sequence
aggaatggccaaaagagatg

SEQ ID NO: 432758 - DNA, 20 bp, Artificial
  CRISPR gRNA sequence
gcagaataatgaaaacactt

SEQ ID NO: 432759 - DNA, 20 bp, Artificial
  CRISPR gRNA sequence
aaaacactttagatgtatgt

SEQ ID NO: 432760 - DNA, 20 bp, Artificial
  CRISPR gRNA sequence
aacactttagatgtatgttg

SEQ ID NO: 432761 - DNA, 20 bp, Artificial
  CRISPR gRNA sequence
acactttagatgtatgttgg

SEQ ID NO: 432762 - DNA, 20 bp, Artificial
  CRISPR gRNA sequence
ctttagatgtatgttggagg

SEQ ID NO: 432763 - DNA, 20 bp, Artificial
  CRISPR gRNA sequence
tgtatgttggaggaagactg

SEQ ID NO: 432764 - DNA, 20 bp, Artificial
  CRISPR gRNA sequence
gtatgttggaggaagactgc

SEQ ID NO: 432765 - DNA, 20 bp, Artificial
  CRISPR gRNA sequence
ttctgttgttgtttttctct

SEQ ID NO: 432766 - DNA, 20 bp, Artificial
  CRISPR gRNA sequence
gttgttgtttttctctgaga

SEQ ID NO: 432767 - DNA, 20 bp, Artificial
  CRISPR gRNA sequence
ttgttgtttttctctgagac

SEQ ID NO: 432768 - DNA, 20 bp, Artificial
  CRISPR gRNA sequence
tgttgtttttctctgagaca

SEQ ID NO: 432769 - DNA, 20 bp, Artificial
  CRISPR gRNA sequence
tctccctgtgctgtgtcacc

SEQ ID NO: 432770 - DNA, 20 bp, Artificial
  CRISPR gRNA sequence
ctccctgtgctgtgtcaccc

SEQ ID NO: 432771 - DNA, 20 bp, Artificial
  CRISPR gRNA sequence
ctgtgctgtgtcacccaggc

SEQ ID NO: 432772 - DNA, 20 bp, Artificial
  CRISPR gRNA sequence
gtgtcacccaggctagaatg

SEQ ID NO: 432773 - DNA, 20 bp, Artificial
  CRISPR gRNA sequence
tcacccaggctagaatgcag

SEQ ID NO: 432774 - DNA, 20 bp, Artificial
  CRISPR gRNA sequence
ccaggctagaatgcagcagc

SEQ ID NO: 432775 - DNA, 20 bp, Artificial
  CRISPR gRNA sequence
agaatgcagcagcaagatca

SEQ ID NO: 432776 - DNA, 20 bp, Artificial
  CRISPR gRNA sequence
agcagcaagatcatagttca

SEQ ID NO: 432777 - DNA, 20 bp, Artificial
  CRISPR gRNA sequence
agttcatagcctcaaactcc

SEQ ID NO: 432778 - DNA, 20 bp, Artificial
  CRISPR gRNA sequence
gttcatagcctcaaactcct

SEQ ID NO: 432779 - DNA, 20 bp, Artificial
  CRISPR gRNA sequence
agcctcaaactcctgggctc

SEQ ID NO: 432780 - DNA, 20 bp, Artificial
  CRISPR gRNA sequence
tcttcctgcttcattctcct

SEQ ID NO: 432781 - DNA, 20 bp, Artificial
  CRISPR gRNA sequence
tcctgcttcattctcctgag

SEQ ID NO: 432782 - DNA, 20 bp, Artificial
  CRISPR gRNA sequence
gcttcattctcctgagtagc

SEQ ID NO: 432783 - DNA, 20 bp, Artificial
  CRISPR gRNA sequence
cttcattctcctgagtagct

SEQ ID NO: 432784 - DNA, 20 bp, Artificial
  CRISPR gRNA sequence
ctcctgagtagctgggacga

SEQ ID NO: 432785 - DNA, 20 bp, Artificial
  CRISPR gRNA sequence
tcctgagtagctgggacgat

SEQ ID NO: 432786 - DNA, 20 bp, Artificial
  CRISPR gRNA sequence
taggcgtgcaccaccatacc

SEQ ID NO: 432787 - DNA, 20 bp, Artificial
  CRISPR gRNA sequence
gcaccaccatacccagccct

SEQ ID NO: 432788 - DNA, 20 bp, Artificial
  CRISPR gRNA sequence
caccaccatacccagcccta

SEQ ID NO: 432789 - DNA, 20 bp, Artificial
  CRISPR gRNA sequence
cctaaggaatctcaacatct

SEQ ID NO: 432790 - DNA, 20 bp, Artificial
  CRISPR gRNA sequence
ctaaggaatctcaacatcta

SEQ ID NO: 432791 - DNA, 20 bp, Artificial
  CRISPR gRNA sequence
gaatctcaacatctaaggat

SEQ ID NO: 432792 - DNA, 20 bp, Artificial
  CRISPR gRNA sequence
aatctcaacatctaaggatc

SEQ ID NO: 432793 - DNA, 20 bp, Artificial
  CRISPR gRNA sequence
ctcaacatctaaggatcagg

SEQ ID NO: 432794 - DNA, 20 bp, Artificial
  CRISPR gRNA sequence
aacatctaaggatcaggcag

SEQ ID NO: 432795 - DNA, 20 bp, Artificial
  CRISPR gRNA sequence
atctaaggatcaggcagaag

SEQ ID NO: 432796 - DNA, 20 bp, Artificial
  CRISPR gRNA sequence
caggcagaagaagatctgaa

SEQ ID NO: 432797 - DNA, 20 bp, Artificial
  CRISPR gRNA sequence
gaagaagatctgaaaagcaa

SEQ ID NO: 432798 - DNA, 20 bp, Artificial
  CRISPR gRNA sequence
atctgaaaagcaatggatca

SEQ ID NO: 432799 - DNA, 20 bp, Artificial
  CRISPR gRNA sequence
ctgaaaagcaatggatcaaa

SEQ ID NO: 432800 - DNA, 20 bp, Artificial
  CRISPR gRNA sequence
aaaagcaatggatcaaagag

SEQ ID NO: 432801 - DNA, 20 bp, Artificial
  CRISPR gRNA sequence
caaagagaagaatgtcattt

SEQ ID NO: 432802 - DNA, 20 bp, Artificial
  CRISPR gRNA sequence
agagaagaatgtcatttcag

SEQ ID NO: 432803 - DNA, 20 bp, Artificial
  CRISPR gRNA sequence
agaatgtcatttcagaagcc

SEQ ID NO: 432804 - DNA, 20 bp, Artificial
  CRISPR gRNA sequence
aatgtcatttcagaagccaa

SEQ ID NO: 432805 - DNA, 20 bp, Artificial
  CRISPR gRNA sequence
gtcatttcagaagccaagag

SEQ ID NO: 432806 - DNA, 20 bp, Artificial
  CRISPR gRNA sequence
tcatttcagaagccaagaga

SEQ ID NO: 432807 - DNA, 20 bp, Artificial
  CRISPR gRNA sequence
atttcagaagccaagagaag

SEQ ID NO: 432808 - DNA, 20 bp, Artificial
  CRISPR gRNA sequence
tttcagaagccaagagaagg

SEQ ID NO: 432809 - DNA, 20 bp, Artificial
  CRISPR gRNA sequence
ccaagagaaggaggactttc

SEQ ID NO: 432810 - DNA, 20 bp, Artificial
  CRISPR gRNA sequence
gaaggaggactttctagaat

SEQ ID NO: 432811 - DNA, 20 bp, Artificial
  CRISPR gRNA sequence
agaatgagtgatcaatttaa

SEQ ID NO: 432812 - DNA, 20 bp, Artificial
  CRISPR gRNA sequence
gaatgagtgatcaatttaaa

SEQ ID NO: 432813 - DNA, 20 bp, Artificial
  CRISPR gRNA sequence
ttaaaaggttgactataata

SEQ ID NO: 432814 - DNA, 20 bp, Artificial
  CRISPR gRNA sequence
ggttgactataataaagata

SEQ ID NO: 432815 - DNA, 20 bp, Artificial
  CRISPR gRNA sequence
gttgactataataaagataa

SEQ ID NO: 432816 - DNA, 20 bp, Artificial
  CRISPR gRNA sequence
tataataaagataaaggtat

SEQ ID NO: 432817 - DNA, 20 bp, Artificial
  CRISPR gRNA sequence
ataataaagataaaggtatc

SEQ ID NO: 432818 - DNA, 20 bp, Artificial
  CRISPR gRNA sequence
taaagataaaggtatcaggc

SEQ ID NO: 432819 - DNA, 20 bp, Artificial
  CRISPR gRNA sequence
aaagataaaggtatcaggct

SEQ ID NO: 432820 - DNA, 20 bp, Artificial
  CRISPR gRNA sequence
taaaggtatcaggctgggaa

SEQ ID NO: 432821 - DNA, 20 bp, Artificial
  CRISPR gRNA sequence
aggtatcaggctgggaacgg

SEQ ID NO: 432822 - DNA, 20 bp, Artificial
  CRISPR gRNA sequence
gtggctcacgcctataatcc

SEQ ID NO: 432823 - DNA, 20 bp, Artificial
  CRISPR gRNA sequence
cgcctataatcccagcactt

SEQ ID NO: 432824 - DNA, 20 bp, Artificial
  CRISPR gRNA sequence
gcctataatcccagcacttt

SEQ ID NO: 432825 - DNA, 20 bp, Artificial
  CRISPR gRNA sequence
ctataatcccagcactttgg

SEQ ID NO: 432826 - DNA, 20 bp, Artificial
  CRISPR gRNA sequence
tataatcccagcactttggg

SEQ ID NO: 432827 - DNA, 20 bp, Artificial
  CRISPR gRNA sequence
tcccagcactttgggaggcc

SEQ ID NO: 432828 - DNA, 20 bp, Artificial
  CRISPR gRNA sequence
cccagcactttgggaggcca

SEQ ID NO: 432829 - DNA, 20 bp, Artificial
  CRISPR gRNA sequence
agcactttgggaggccaagg

SEQ ID NO: 432830 - DNA, 20 bp, Artificial
  CRISPR gRNA sequence
gcactttgggaggccaaggc

SEQ ID NO: 432831 - DNA, 20 bp, Artificial
  CRISPR gRNA sequence
ctttgggaggccaaggcggg

SEQ ID NO: 432832 - DNA, 20 bp, Artificial
  CRISPR gRNA sequence
ccaaggcgggcagatcatct

SEQ ID NO: 432833 - DNA, 20 bp, Artificial
  CRISPR gRNA sequence
caaggcgggcagatcatctg

SEQ ID NO: 432834 - DNA, 20 bp, Artificial
  CRISPR gRNA sequence
cgggcagatcatctgaggtc

SEQ ID NO: 432835 - DNA, 20 bp, Artificial
  CRISPR gRNA sequence
ggcagatcatctgaggtcaa

SEQ ID NO: 432836 - DNA, 20 bp, Artificial
  CRISPR gRNA sequence
tcatctgaggtcaagagttt

SEQ ID NO: 432837 - DNA, 20 bp, Artificial
  CRISPR gRNA sequence
tgaggtcaagagtttgagac

SEQ ID NO: 432838 - DNA, 20 bp, Artificial
  CRISPR gRNA sequence
tcaagagtttgagaccagcc

SEQ ID NO: 432839 - DNA, 20 bp, Artificial
  CRISPR gRNA sequence
tgagaccagcctggccaaca

SEQ ID NO: 432840 - DNA, 20 bp, Artificial
  CRISPR gRNA sequence
ctctactaaaaatacaaaat

SEQ ID NO: 432841 - DNA, 20 bp, Artificial
  CRISPR gRNA sequence
actaaaaatacaaaattagc

SEQ ID NO: 432842 - DNA, 20 bp, Artificial
  CRISPR gRNA sequence
ctaaaaatacaaaattagcc

SEQ ID NO: 432843 - DNA, 20 bp, Artificial
  CRISPR gRNA sequence
aatacaaaattagccaggca

SEQ ID NO: 432844 - DNA, 20 bp, Artificial
  CRISPR gRNA sequence
acaaaattagccaggcatgg

SEQ ID NO: 432845 - DNA, 20 bp, Artificial
  CRISPR gRNA sequence
gcggcacatgcatgaaatcc

SEQ ID NO: 432846 - DNA, 20 bp, Artificial
  CRISPR gRNA sequence
tgcatgaaatcccagctact

SEQ ID NO: 432847 - DNA, 20 bp, Artificial
  CRISPR gRNA sequence
gcatgaaatcccagctactc

SEQ ID NO: 432848 - DNA, 20 bp, Artificial
  CRISPR gRNA sequence
atgaaatcccagctactcag

SEQ ID NO: 432849 - DNA, 20 bp, Artificial
  CRISPR gRNA sequence
tgaaatcccagctactcagg

SEQ ID NO: 432850 - DNA, 20 bp, Artificial
  CRISPR gRNA sequence
tcccagctactcaggaggct

SEQ ID NO: 432851 - DNA, 20 bp, Artificial
  CRISPR gRNA sequence
cccagctactcaggaggctg

SEQ ID NO: 432852 - DNA, 20 bp, Artificial
  CRISPR gRNA sequence
ccagctactcaggaggctga

SEQ ID NO: 432853 - DNA, 20 bp, Artificial
  CRISPR gRNA sequence
cagctactcaggaggctgag

SEQ ID NO: 432854 - DNA, 20 bp, Artificial
  CRISPR gRNA sequence
agctactcaggaggctgagg

SEQ ID NO: 432855 - DNA, 20 bp, Artificial
  CRISPR gRNA sequence
gctactcaggaggctgaggg

SEQ ID NO: 432856 - DNA, 20 bp, Artificial
  CRISPR gRNA sequence
tactcaggaggctgaggggg

SEQ ID NO: 432857 - DNA, 20 bp, Artificial
  CRISPR gRNA sequence
gggggagaatcacttgaacc

SEQ ID NO: 432858 - DNA, 20 bp, Artificial
  CRISPR gRNA sequence
ggggagaatcacttgaaccc

SEQ ID NO: 432859 - DNA, 20 bp, Artificial
  CRISPR gRNA sequence
gggagaatcacttgaacccg

SEQ ID NO: 432860 - DNA, 20 bp, Artificial
  CRISPR gRNA sequence
gagaatcacttgaacccggg

SEQ ID NO: 432861 - DNA, 20 bp, Artificial
  CRISPR gRNA sequence
agaatcacttgaacccgggg

SEQ ID NO: 432862 - DNA, 20 bp, Artificial
  CRISPR gRNA sequence
atcacttgaacccggggagg

SEQ ID NO: 432863 - DNA, 20 bp, Artificial
  CRISPR gRNA sequence
cacttgaacccggggaggca

SEQ ID NO: 432864 - DNA, 20 bp, Artificial
  CRISPR gRNA sequence
acttgaacccggggaggcag

SEQ ID NO: 432865 - DNA, 20 bp, Artificial
  CRISPR gRNA sequence
acccggggaggcagaggttg

SEQ ID NO: 432866 - DNA, 20 bp, Artificial
  CRISPR gRNA sequence
ggggaggcagaggttgcagt

SEQ ID NO: 432867 - DNA, 20 bp, Artificial
  CRISPR gRNA sequence
ggcagaggttgcagtgagcc

SEQ ID NO: 432868 - DNA, 20 bp, Artificial
  CRISPR gRNA sequence
aagattgcaccattgcactc

SEQ ID NO: 432869 - DNA, 20 bp, Artificial
  CRISPR gRNA sequence
gcaccattgcactccagcct

SEQ ID NO: 432870 - DNA, 20 bp, Artificial
  CRISPR gRNA sequence
tgcactccagcctaagcaac

SEQ ID NO: 432871 - DNA, 20 bp, Artificial
  CRISPR gRNA sequence
cactccagcctaagcaacaa

SEQ ID NO: 432872 - DNA, 20 bp, Artificial
  CRISPR gRNA sequence
ctgtctcaaaaaaaaaaaaa

SEQ ID NO: 432873 - DNA, 20 bp, Artificial
  CRISPR gRNA sequence
caaaaaaaaaaaaaaagata

SEQ ID NO: 432874 - DNA, 20 bp, Artificial
  CRISPR gRNA sequence
aaaaaaaaaaaaaaagataa

SEQ ID NO: 432875 - DNA, 20 bp, Artificial
  CRISPR gRNA sequence
gtatctgttaatatttaatt

SEQ ID NO: 432876 - DNA, 20 bp, Artificial
  CRISPR gRNA sequence
atatttaatttagaaaactg

SEQ ID NO: 432877 - DNA, 20 bp, Artificial
  CRISPR gRNA sequence
tatttaatttagaaaactga

SEQ ID NO: 432878 - DNA, 20 bp, Artificial
  CRISPR gRNA sequence
taatttagaaaactgaaggt

SEQ ID NO: 432879 - DNA, 20 bp, Artificial
  CRISPR gRNA sequence
tttagaaaactgaaggtcag

SEQ ID NO: 432880 - DNA, 20 bp, Artificial
  CRISPR gRNA sequence
gaaaactgaaggtcagtggt

SEQ ID NO: 432881 - DNA, 20 bp, Artificial
  CRISPR gRNA sequence
tgaccatttccgttgtgctt

SEQ ID NO: 432882 - DNA, 20 bp, Artificial
  CRISPR gRNA sequence
accatttccgttgtgctttg

SEQ ID NO: 432883 - DNA, 20 bp, Artificial
  CRISPR gRNA sequence
atttccgttgtgctttggag

SEQ ID NO: 432884 - DNA, 20 bp, Artificial
  CRISPR gRNA sequence
ttgtgctttggagcagaaac

SEQ ID NO: 432885 - DNA, 20 bp, Artificial
  CRISPR gRNA sequence
ttggagcagaaactagatga

SEQ ID NO: 432886 - DNA, 20 bp, Artificial
  CRISPR gRNA sequence
gagcagaaactagatgatgg

SEQ ID NO: 432887 - DNA, 20 bp, Artificial
  CRISPR gRNA sequence
agcagaaactagatgatggt

SEQ ID NO: 432888 - DNA, 20 bp, Artificial
  CRISPR gRNA sequence
aaactagatgatggtgggtc

SEQ ID NO: 432889 - DNA, 20 bp, Artificial
  CRISPR gRNA sequence
aactagatgatggtgggtca

SEQ ID NO: 432890 - DNA, 20 bp, Artificial
  CRISPR gRNA sequence
ctagatgatggtgggtcaag

SEQ ID NO: 432891 - DNA, 20 bp, Artificial
  CRISPR gRNA sequence
tgatggtgggtcaaggagtg

SEQ ID NO: 432892 - DNA, 20 bp, Artificial
  CRISPR gRNA sequence
ggtgggtcaaggagtgtaga

SEQ ID NO: 432893 - DNA, 20 bp, Artificial
  CRISPR gRNA sequence
gtgggtcaaggagtgtagat

SEQ ID NO: 432894 - DNA, 20 bp, Artificial
  CRISPR gRNA sequence
aaggagtgtagatgggtgaa

SEQ ID NO: 432895 - DNA, 20 bp, Artificial
  CRISPR gRNA sequence
gagtgtagatgggtgaaaag

SEQ ID NO: 432896 - DNA, 20 bp, Artificial
  CRISPR gRNA sequence
gtgtagatgggtgaaaagta

SEQ ID NO: 432897 - DNA, 20 bp, Artificial
  CRISPR gRNA sequence
gacaactcctttgaaaaata

SEQ ID NO: 432898 - DNA, 20 bp, Artificial
  CRISPR gRNA sequence
cctttgaaaaatatggctgt

SEQ ID NO: 432899 - DNA, 20 bp, Artificial
  CRISPR gRNA sequence
aaaaatatggctgtgagaac

SEQ ID NO: 432900 - DNA, 20 bp, Artificial
  CRISPR gRNA sequence
tatggctgtgagaacgagtt

SEQ ID NO: 432901 - DNA, 20 bp, Artificial
  CRISPR gRNA sequence
tgtgagaacgagttgagaaa

SEQ ID NO: 432902 - DNA, 20 bp, Artificial
  CRISPR gRNA sequence
gtgagaacgagttgagaaat

SEQ ID NO: 432903 - DNA, 20 bp, Artificial
  CRISPR gRNA sequence
aacgagttgagaaatgggac

SEQ ID NO: 432904 - DNA, 20 bp, Artificial
  CRISPR gRNA sequence
agttgagaaatgggactagc

SEQ ID NO: 432905 - DNA, 20 bp, Artificial
  CRISPR gRNA sequence
ttgagaaatgggactagctg

SEQ ID NO: 432906 - DNA, 20 bp, Artificial
  CRISPR gRNA sequence
gagaaatgggactagctgga

SEQ ID NO: 432907 - DNA, 20 bp, Artificial
  CRISPR gRNA sequence
agaaatgggactagctggag

SEQ ID NO: 432908 - DNA, 20 bp, Artificial
  CRISPR gRNA sequence
actagctggagaggaatgca

SEQ ID NO: 432909 - DNA, 20 bp, Artificial
  CRISPR gRNA sequence
ctggagaggaatgcatggac

SEQ ID NO: 432910 - DNA, 20 bp, Artificial
  CRISPR gRNA sequence
atatattctgctaatgaaaa

SEQ ID NO: 432911 - DNA, 20 bp, Artificial
  CRISPR gRNA sequence
gctaatgaaaatagcataaa

SEQ ID NO: 432912 - DNA, 20 bp, Artificial
  CRISPR gRNA sequence
tgaaaatagcataaacagaa

SEQ ID NO: 432913 - DNA, 20 bp, Artificial
  CRISPR gRNA sequence
gaaaatagcataaacagaaa

SEQ ID NO: 432914 - DNA, 20 bp, Artificial
  CRISPR gRNA sequence
aaatagcataaacagaaaag

SEQ ID NO: 432915 - DNA, 20 bp, Artificial
  CRISPR gRNA sequence
atagcataaacagaaaagga

SEQ ID NO: 432916 - DNA, 20 bp, Artificial
  CRISPR gRNA sequence
agcataaacagaaaaggaga

SEQ ID NO: 432917 - DNA, 20 bp, Artificial
  CRISPR gRNA sequence
agaaaaggagagagatgact

SEQ ID NO: 432918 - DNA, 20 bp, Artificial
  CRISPR gRNA sequence
aaaggagagagatgactcag

SEQ ID NO: 432919 - DNA, 20 bp, Artificial
  CRISPR gRNA sequence
gagagagatgactcagaaga

SEQ ID NO: 432920 - DNA, 20 bp, Artificial
  CRISPR gRNA sequence
agagagatgactcagaagaa

SEQ ID NO: 432921 - DNA, 20 bp, Artificial
  CRISPR gRNA sequence
gagagatgactcagaagaaa

SEQ ID NO: 432922 - DNA, 20 bp, Artificial
  CRISPR gRNA sequence
actcagaagaaagggataaa

SEQ ID NO: 432923 - DNA, 20 bp, Artificial
  CRISPR gRNA sequence
cagaagaaagggataaaaag

SEQ ID NO: 432924 - DNA, 20 bp, Artificial
  CRISPR gRNA sequence
agaagaaagggataaaaaga

SEQ ID NO: 432925 - DNA, 20 bp, Artificial
  CRISPR gRNA sequence
aagggataaaaagaaggatg

SEQ ID NO: 432926 - DNA, 20 bp, Artificial
  CRISPR gRNA sequence
taaaaagaaggatgaagtct

SEQ ID NO: 432927 - DNA, 20 bp, Artificial
  CRISPR gRNA sequence
agaaggatgaagtcttggcc

SEQ ID NO: 432928 - DNA, 20 bp, Artificial
  CRISPR gRNA sequence
gaaggatgaagtcttggcct

SEQ ID NO: 432929 - DNA, 20 bp, Artificial
  CRISPR gRNA sequence
tgaagtcttggcctaggcaa

SEQ ID NO: 432930 - DNA, 20 bp, Artificial
  CRISPR gRNA sequence
aagtcttggcctaggcaatg

SEQ ID NO: 432931 - DNA, 20 bp, Artificial
  CRISPR gRNA sequence
cctaggcaatggagattaaa

SEQ ID NO: 432932 - DNA, 20 bp, Artificial
  CRISPR gRNA sequence
aaagccctttcatatttcat

SEQ ID NO: 432933 - DNA, 20 bp, Artificial
  CRISPR gRNA sequence
ccctttcatatttcatcagt

SEQ ID NO: 432934 - DNA, 20 bp, Artificial
  CRISPR gRNA sequence
cctttcatatttcatcagtt

SEQ ID NO: 432935 - DNA, 20 bp, Artificial
  CRISPR gRNA sequence
tttcatatttcatcagttag

SEQ ID NO: 432936 - DNA, 20 bp, Artificial
  CRISPR gRNA sequence
tcatatttcatcagttagga

SEQ ID NO: 432937 - DNA, 20 bp, Artificial
  CRISPR gRNA sequence
catatttcatcagttaggag

SEQ ID NO: 432938 - DNA, 20 bp, Artificial
  CRISPR gRNA sequence
atatttcatcagttaggaga

SEQ ID NO: 432939 - DNA, 20 bp, Artificial
  CRISPR gRNA sequence
tatttcatcagttaggagag

SEQ ID NO: 432940 - DNA, 20 bp, Artificial
  CRISPR gRNA sequence
catcagttaggagaggggca

SEQ ID NO: 432941 - DNA, 20 bp, Artificial
  CRISPR gRNA sequence
cagttaggagaggggcaaag

SEQ ID NO: 432942 - DNA, 20 bp, Artificial
  CRISPR gRNA sequence
gagaggggcaaagaagtttt

SEQ ID NO: 432943 - DNA, 20 bp, Artificial
  CRISPR gRNA sequence
aggggcaaagaagttttgag

SEQ ID NO: 432944 - DNA, 20 bp, Artificial
  CRISPR gRNA sequence
ggcaaagaagttttgagcag

SEQ ID NO: 432945 - DNA, 20 bp, Artificial
  CRISPR gRNA sequence
aagaagttttgagcagcagt

SEQ ID NO: 432946 - DNA, 20 bp, Artificial
  CRISPR gRNA sequence
agaagttttgagcagcagtg

SEQ ID NO: 432947 - DNA, 20 bp, Artificial
  CRISPR gRNA sequence
ttttgagcagcagtgaggta

SEQ ID NO: 432948 - DNA, 20 bp, Artificial
  CRISPR gRNA sequence
gagcagcagtgaggtatgga

SEQ ID NO: 432949 - DNA, 20 bp, Artificial
  CRISPR gRNA sequence
tgaggtatggatggtcatct

SEQ ID NO: 432950 - DNA, 20 bp, Artificial
  CRISPR gRNA sequence
aggtatggatggtcatctca

SEQ ID NO: 432951 - DNA, 20 bp, Artificial
  CRISPR gRNA sequence
gtatggatggtcatctcaga

SEQ ID NO: 432952 - DNA, 20 bp, Artificial
  CRISPR gRNA sequence
ggtcatctcagagagtacac

SEQ ID NO: 432953 - DNA, 20 bp, Artificial
  CRISPR gRNA sequence
atctcagagagtacactaga

SEQ ID NO: 432954 - DNA, 20 bp, Artificial
  CRISPR gRNA sequence
cagagagtacactagaaaga

SEQ ID NO: 432955 - DNA, 20 bp, Artificial
  CRISPR gRNA sequence
agagtacactagaaagatgg

SEQ ID NO: 432956 - DNA, 20 bp, Artificial
  CRISPR gRNA sequence
actagaaagatggaagattg

SEQ ID NO: 432957 - DNA, 20 bp, Artificial
  CRISPR gRNA sequence
ctagaaagatggaagattgt

SEQ ID NO: 432958 - DNA, 20 bp, Artificial
  CRISPR gRNA sequence
tagaaagatggaagattgtg

SEQ ID NO: 432959 - DNA, 20 bp, Artificial
  CRISPR gRNA sequence
gaagattgtggggcattatt

SEQ ID NO: 432960 - DNA, 20 bp, Artificial
  CRISPR gRNA sequence
tgtggggcattattgagtgt

SEQ ID NO: 432961 - DNA, 20 bp, Artificial
  CRISPR gRNA sequence
gagtgtcagtttgtttttgt

SEQ ID NO: 432962 - DNA, 20 bp, Artificial
  CRISPR gRNA sequence
agtgtcagtttgtttttgtg

SEQ ID NO: 432963 - DNA, 20 bp, Artificial
  CRISPR gRNA sequence
ttgtgaggtcatgacttaaa

SEQ ID NO: 432964 - DNA, 20 bp, Artificial
  CRISPR gRNA sequence
cttgattttaatattttctc

SEQ ID NO: 432965 - DNA, 20 bp, Artificial
  CRISPR gRNA sequence
atattttctccagcaacttc

SEQ ID NO: 432966 - DNA, 20 bp, Artificial
  CRISPR gRNA sequence
tattttctccagcaacttcc

SEQ ID NO: 432967 - DNA, 20 bp, Artificial
  CRISPR gRNA sequence
attttctccagcaacttcca

SEQ ID NO: 432968 - DNA, 20 bp, Artificial
  CRISPR gRNA sequence
ctccagcaacttccagggaa

SEQ ID NO: 432969 - DNA, 20 bp, Artificial
  CRISPR gRNA sequence
gcaacttccagggaaaagat

SEQ ID NO: 432970 - DNA, 20 bp, Artificial
  CRISPR gRNA sequence
ggaaaagattggaaatgaaa

SEQ ID NO: 432971 - DNA, 20 bp, Artificial
  CRISPR gRNA sequence
gaaaagattggaaatgaaac

SEQ ID NO: 432972 - DNA, 20 bp, Artificial
  CRISPR gRNA sequence
cctttcttatctgtacttct

SEQ ID NO: 432973 - DNA, 20 bp, Artificial
  CRISPR gRNA sequence
ttcttatctgtacttctcag

SEQ ID NO: 432974 - DNA, 20 bp, Artificial
  CRISPR gRNA sequence
tctcagtagccatgtttttt

SEQ ID NO: 432975 - DNA, 20 bp, Artificial
  CRISPR gRNA sequence
tcagtagccatgtttttttg

SEQ ID NO: 432976 - DNA, 20 bp, Artificial
  CRISPR gRNA sequence
gtagccatgtttttttggag

SEQ ID NO: 432977 - DNA, 20 bp, Artificial
  CRISPR gRNA sequence
ggcatatatgtgtgtgtaca

SEQ ID NO: 432978 - DNA, 20 bp, Artificial
  CRISPR gRNA sequence
tatgtgtgtgtacaaagcat

SEQ ID NO: 432979 - DNA, 20 bp, Artificial
  CRISPR gRNA sequence
acaaagcatcagatttcctc

SEQ ID NO: 432980 - DNA, 20 bp, Artificial
  CRISPR gRNA sequence
ccatcactctttatacaaac

SEQ ID NO: 432981 - DNA, 20 bp, Artificial
  CRISPR gRNA sequence
ctctttatacaaactagaat

SEQ ID NO: 432982 - DNA, 20 bp, Artificial
  CRISPR gRNA sequence
gtgctaatatgtataaatta

SEQ ID NO: 432983 - DNA, 20 bp, Artificial
  CRISPR gRNA sequence
cacacacacatatatatata

SEQ ID NO: 432984 - DNA, 20 bp, Artificial
  CRISPR gRNA sequence
acacacatatatatataaag

SEQ ID NO: 432985 - DNA, 20 bp, Artificial
  CRISPR gRNA sequence
gtggtctctaatatatataa

SEQ ID NO: 432986 - DNA, 20 bp, Artificial
  CRISPR gRNA sequence
ctctaatatatataatagta

SEQ ID NO: 432987 - DNA, 20 bp, Artificial
  CRISPR gRNA sequence
atatataatagtaaagctca

SEQ ID NO: 432988 - DNA, 20 bp, Artificial
  CRISPR gRNA sequence
aaagctcaaagttttacttt

SEQ ID NO: 432989 - DNA, 20 bp, Artificial
  CRISPR gRNA sequence
caaagttttactttgagcca

SEQ ID NO: 432990 - DNA, 20 bp, Artificial
  CRISPR gRNA sequence
agttttactttgagccatgg

SEQ ID NO: 432991 - DNA, 20 bp, Artificial
  CRISPR gRNA sequence
tttactttgagccatggcag

SEQ ID NO: 432992 - DNA, 20 bp, Artificial
  CRISPR gRNA sequence
agccatggcagaagtcaaaa

SEQ ID NO: 432993 - DNA, 20 bp, Artificial
  CRISPR gRNA sequence
catggcagaagtcaaaaaag

SEQ ID NO: 432994 - DNA, 20 bp, Artificial
  CRISPR gRNA sequence
gcagaagtcaaaaaagtagt

SEQ ID NO: 432995 - DNA, 20 bp, Artificial
  CRISPR gRNA sequence
aaaaaagtagtgagtgttat

SEQ ID NO: 432996 - DNA, 20 bp, Artificial
  CRISPR gRNA sequence
cagtgctccttaacaatccc

SEQ ID NO: 432997 - DNA, 20 bp, Artificial
  CRISPR gRNA sequence
taacaatccctagtctgttt

SEQ ID NO: 432998 - DNA, 20 bp, Artificial
  CRISPR gRNA sequence
agtctgttttggaaatactc

SEQ ID NO: 432999 - DNA, 20 bp, Artificial
  CRISPR gRNA sequence
tgttttggaaatactcaagt

SEQ ID NO: 433000 - DNA, 20 bp, Artificial
  CRISPR gRNA sequence
gttttggaaatactcaagtg

SEQ ID NO: 433001 - DNA, 20 bp, Artificial
  CRISPR gRNA sequence
ggaaatactcaagtgaggct

SEQ ID NO: 433002 - DNA, 20 bp, Artificial
  CRISPR gRNA sequence
tgcctataatcccaacattt

SEQ ID NO: 433003 - DNA, 20 bp, Artificial
  CRISPR gRNA sequence
gcctataatcccaacatttt

SEQ ID NO: 433004 - DNA, 20 bp, Artificial
  CRISPR gRNA sequence
ctataatcccaacattttgg

SEQ ID NO: 433005 - DNA, 20 bp, Artificial
  CRISPR gRNA sequence
tataatcccaacattttggg

SEQ ID NO: 433006 - DNA, 20 bp, Artificial
  CRISPR gRNA sequence
tcccaacattttgggaggct

SEQ ID NO: 433007 - DNA, 20 bp, Artificial
  CRISPR gRNA sequence
cccaacattttgggaggctg

SEQ ID NO: 433008 - DNA, 20 bp, Artificial
  CRISPR gRNA sequence
aacattttgggaggctgagg

SEQ ID NO: 433009 - DNA, 20 bp, Artificial
  CRISPR gRNA sequence
acattttgggaggctgaggt

SEQ ID NO: 433010 - DNA, 20 bp, Artificial
  CRISPR gRNA sequence
attttgggaggctgaggtgg

SEQ ID NO: 433011 - DNA, 20 bp, Artificial
  CRISPR gRNA sequence
ttttgggaggctgaggtggg

SEQ ID NO: 433012 - DNA, 20 bp, Artificial
  CRISPR gRNA sequence
ctgaggtgggaggattattt

SEQ ID NO: 433013 - DNA, 20 bp, Artificial
  CRISPR gRNA sequence
gtgggaggattatttaagcc

SEQ ID NO: 433014 - DNA, 20 bp, Artificial
  CRISPR gRNA sequence
tgggaggattatttaagccc

SEQ ID NO: 433015 - DNA, 20 bp, Artificial
  CRISPR gRNA sequence
ggaggattatttaagcccag

SEQ ID NO: 433016 - DNA, 20 bp, Artificial
  CRISPR gRNA sequence
ttatttaagcccaggagttt

SEQ ID NO: 433017 - DNA, 20 bp, Artificial
  CRISPR gRNA sequence
taagcccaggagtttgagac

SEQ ID NO: 433018 - DNA, 20 bp, Artificial
  CRISPR gRNA sequence
caggagtttgagaccagctt

SEQ ID NO: 433019 - DNA, 20 bp, Artificial
  CRISPR gRNA sequence
tgagaccagcttgagcaaca

SEQ ID NO: 433020 - DNA, 20 bp, Artificial
  CRISPR gRNA sequence
accagcttgagcaacatagc

SEQ ID NO: 433021 - DNA, 20 bp, Artificial
  CRISPR gRNA sequence
ttttattttatttatttttt

SEQ ID NO: 433022 - DNA, 20 bp, Artificial
  CRISPR gRNA sequence
attttatttattttttgaga

SEQ ID NO: 433023 - DNA, 20 bp, Artificial
  CRISPR gRNA sequence
tttatttattttttgagatg

SEQ ID NO: 433024 - DNA, 20 bp, Artificial
  CRISPR gRNA sequence
ggagtttcactcttgttgcc

SEQ ID NO: 433025 - DNA, 20 bp, Artificial
  CRISPR gRNA sequence
gagtttcactcttgttgccc

SEQ ID NO: 433026 - DNA, 20 bp, Artificial
  CRISPR gRNA sequence
ttcactcttgttgcccaggc

SEQ ID NO: 433027 - DNA, 20 bp, Artificial
  CRISPR gRNA sequence
cactcttgttgcccaggctg

SEQ ID NO: 433028 - DNA, 20 bp, Artificial
  CRISPR gRNA sequence
ttgcccaggctggagtgcaa

SEQ ID NO: 433029 - DNA, 20 bp, Artificial
  CRISPR gRNA sequence
ggagtgcaatggcacgatct

SEQ ID NO: 433030 - DNA, 20 bp, Artificial
  CRISPR gRNA sequence
tcactgcaacctccgcctcc

SEQ ID NO: 433031 - DNA, 20 bp, Artificial
  CRISPR gRNA sequence
cactgcaacctccgcctcct

SEQ ID NO: 433032 - DNA, 20 bp, Artificial
  CRISPR gRNA sequence
aacctccgcctcctgggctc

SEQ ID NO: 433033 - DNA, 20 bp, Artificial
  CRISPR gRNA sequence
ctcaagtgattctcccacct

SEQ ID NO: 433034 - DNA, 20 bp, Artificial
  CRISPR gRNA sequence
ttctcccacctcagcttccc

SEQ ID NO: 433035 - DNA, 20 bp, Artificial
  CRISPR gRNA sequence
tcccacctcagcttcccgag

SEQ ID NO: 433036 - DNA, 20 bp, Artificial
  CRISPR gRNA sequence
acctcagcttcccgagtagc

SEQ ID NO: 433037 - DNA, 20 bp, Artificial
  CRISPR gRNA sequence
ttcccgagtagctggaatta

SEQ ID NO: 433038 - DNA, 20 bp, Artificial
  CRISPR gRNA sequence
tcccgagtagctggaattat

SEQ ID NO: 433039 - DNA, 20 bp, Artificial
  CRISPR gRNA sequence
taggcatgtgcccccatgcc

SEQ ID NO: 433040 - DNA, 20 bp, Artificial
  CRISPR gRNA sequence
cccggctaattttgtatttt

SEQ ID NO: 433041 - DNA, 20 bp, Artificial
  CRISPR gRNA sequence
ggctaattttgtatttttag

SEQ ID NO: 433042 - DNA, 20 bp, Artificial
  CRISPR gRNA sequence
ctaattttgtatttttagta

SEQ ID NO: 433043 - DNA, 20 bp, Artificial
  CRISPR gRNA sequence
tttgtatttttagtagagat

SEQ ID NO: 433044 - DNA, 20 bp, Artificial
  CRISPR gRNA sequence
ttgtatttttagtagagatg

SEQ ID NO: 433045 - DNA, 20 bp, Artificial
  CRISPR gRNA sequence
gagatgaggtttctccacgt

SEQ ID NO: 433046 - DNA, 20 bp, Artificial
  CRISPR gRNA sequence
tgaggtttctccacgttggt

SEQ ID NO: 433047 - DNA, 20 bp, Artificial
  CRISPR gRNA sequence
gaggtttctccacgttggtc

SEQ ID NO: 433048 - DNA, 20 bp, Artificial
  CRISPR gRNA sequence
tttctccacgttggtcaggc

SEQ ID NO: 433049 - DNA, 20 bp, Artificial
  CRISPR gRNA sequence
tcaggctggtctcaaactcc

SEQ ID NO: 433050 - DNA, 20 bp, Artificial
  CRISPR gRNA sequence
tggtctcaaactcccagcct

SEQ ID NO: 433051 - DNA, 20 bp, Artificial
  CRISPR gRNA sequence
ggtctcaaactcccagcctc

SEQ ID NO: 433052 - DNA, 20 bp, Artificial
  CRISPR gRNA sequence
ctcaggttatccactcacct

SEQ ID NO: 433053 - DNA, 20 bp, Artificial
  CRISPR gRNA sequence
ccactcacctcggcctccca

SEQ ID NO: 433054 - DNA, 20 bp, Artificial
  CRISPR gRNA sequence
acctcggcctcccaaagtgc

SEQ ID NO: 433055 - DNA, 20 bp, Artificial
  CRISPR gRNA sequence
cctcggcctcccaaagtgct

SEQ ID NO: 433056 - DNA, 20 bp, Artificial
  CRISPR gRNA sequence
ctcccaaagtgctaggatta

SEQ ID NO: 433057 - DNA, 20 bp, Artificial
  CRISPR gRNA sequence
tcccaaagtgctaggattac

SEQ ID NO: 433058 - DNA, 20 bp, Artificial
  CRISPR gRNA sequence
agtgctaggattacaggcgt

SEQ ID NO: 433059 - DNA, 20 bp, Artificial
  CRISPR gRNA sequence
caggcgtaagccaccgtgct

SEQ ID NO: 433060 - DNA, 20 bp, Artificial
  CRISPR gRNA sequence
attcatcacgcctgtaatcc

SEQ ID NO: 433061 - DNA, 20 bp, Artificial
  CRISPR gRNA sequence
cgcctgtaatcccagcactt

SEQ ID NO: 433062 - DNA, 20 bp, Artificial
  CRISPR gRNA sequence
gcctgtaatcccagcacttt

SEQ ID NO: 433063 - DNA, 20 bp, Artificial
  CRISPR gRNA sequence
ctgtaatcccagcactttgg

SEQ ID NO: 433064 - DNA, 20 bp, Artificial
  CRISPR gRNA sequence
tgtaatcccagcactttggg

SEQ ID NO: 433065 - DNA, 20 bp, Artificial
  CRISPR gRNA sequence
cccagcactttgggaggctg

SEQ ID NO: 433066 - DNA, 20 bp, Artificial
  CRISPR gRNA sequence
agcactttgggaggctgaag

SEQ ID NO: 433067 - DNA, 20 bp, Artificial
  CRISPR gRNA sequence
gcactttgggaggctgaagt

SEQ ID NO: 433068 - DNA, 20 bp, Artificial
  CRISPR gRNA sequence
actttgggaggctgaagtag

SEQ ID NO: 433069 - DNA, 20 bp, Artificial
  CRISPR gRNA sequence
ctttgggaggctgaagtagg

SEQ ID NO: 433070 - DNA, 20 bp, Artificial
  CRISPR gRNA sequence
ctgaagtaggaggatcacct

SEQ ID NO: 433071 - DNA, 20 bp, Artificial
  CRISPR gRNA sequence
gtaggaggatcacctgagct

SEQ ID NO: 433072 - DNA, 20 bp, Artificial
  CRISPR gRNA sequence
taggaggatcacctgagctc

SEQ ID NO: 433073 - DNA, 20 bp, Artificial
  CRISPR gRNA sequence
ggaggatcacctgagctcag

SEQ ID NO: 433074 - DNA, 20 bp, Artificial
  CRISPR gRNA sequence
tcacctgagctcaggagatt

SEQ ID NO: 433075 - DNA, 20 bp, Artificial
  CRISPR gRNA sequence
ggagattgagaccaattttc

SEQ ID NO: 433076 - DNA, 20 bp, Artificial
  CRISPR gRNA sequence
gagattgagaccaattttct

SEQ ID NO: 433077 - DNA, 20 bp, Artificial
  CRISPR gRNA sequence
gaccaattttctgggcaaca

SEQ ID NO: 433078 - DNA, 20 bp, Artificial
  CRISPR gRNA sequence
aaaaaaaaaaaaaaaaaaac

SEQ ID NO: 433079 - DNA, 20 bp, Artificial
  CRISPR gRNA sequence
aaaaaaaaaaaaaaactagc

SEQ ID NO: 433080 - DNA, 20 bp, Artificial
  CRISPR gRNA sequence
aaaaaaaaaaaaaactagcc

SEQ ID NO: 433081 - DNA, 20 bp, Artificial
  CRISPR gRNA sequence
aaaaaaaaactagccaggtg

SEQ ID NO: 433082 - DNA, 20 bp, Artificial
  CRISPR gRNA sequence
aaaaaactagccaggtgtgg

SEQ ID NO: 433083 - DNA, 20 bp, Artificial
  CRISPR gRNA sequence
gtggcatatgcctgtaatct

SEQ ID NO: 433084 - DNA, 20 bp, Artificial
  CRISPR gRNA sequence
tgcctgtaatctcagctact

SEQ ID NO: 433085 - DNA, 20 bp, Artificial
  CRISPR gRNA sequence
gcctgtaatctcagctactt

SEQ ID NO: 433086 - DNA, 20 bp, Artificial
  CRISPR gRNA sequence
ctgtaatctcagctacttgg

SEQ ID NO: 433087 - DNA, 20 bp, Artificial
  CRISPR gRNA sequence
tgtaatctcagctacttggg

SEQ ID NO: 433088 - DNA, 20 bp, Artificial
  CRISPR gRNA sequence
tctcagctacttgggaggct

SEQ ID NO: 433089 - DNA, 20 bp, Artificial
  CRISPR gRNA sequence
ctcagctacttgggaggctg

SEQ ID NO: 433090 - DNA, 20 bp, Artificial
  CRISPR gRNA sequence
tacttgggaggctgaggcac

SEQ ID NO: 433091 - DNA, 20 bp, Artificial
  CRISPR gRNA sequence
gcacaagaattgcttgaacc

SEQ ID NO: 433092 - DNA, 20 bp, Artificial
  CRISPR gRNA sequence
cacaagaattgcttgaaccc

SEQ ID NO: 433093 - DNA, 20 bp, Artificial
  CRISPR gRNA sequence
caagaattgcttgaacccag

SEQ ID NO: 433094 - DNA, 20 bp, Artificial
  CRISPR gRNA sequence
aagaattgcttgaacccagg

SEQ ID NO: 433095 - DNA, 20 bp, Artificial
  CRISPR gRNA sequence
aattgcttgaacccaggagg

SEQ ID NO: 433096 - DNA, 20 bp, Artificial
  CRISPR gRNA sequence
ttgcttgaacccaggaggca

SEQ ID NO: 433097 - DNA, 20 bp, Artificial
  CRISPR gRNA sequence
tgcttgaacccaggaggcag

SEQ ID NO: 433098 - DNA, 20 bp, Artificial
  CRISPR gRNA sequence
aacccaggaggcagaggttg

SEQ ID NO: 433099 - DNA, 20 bp, Artificial
  CRISPR gRNA sequence
caggaggcagaggttgaagt

SEQ ID NO: 433100 - DNA, 20 bp, Artificial
  CRISPR gRNA sequence
ggcagaggttgaagtgagcc

SEQ ID NO: 433101 - DNA, 20 bp, Artificial
  CRISPR gRNA sequence
gagccaagatcacaccactg

SEQ ID NO: 433102 - DNA, 20 bp, Artificial
  CRISPR gRNA sequence
aagatcacaccactgtagtc

SEQ ID NO: 433103 - DNA, 20 bp, Artificial
  CRISPR gRNA sequence
caccactgtagtccagctcc

SEQ ID NO: 433104 - DNA, 20 bp, Artificial
  CRISPR gRNA sequence
accactgtagtccagctccc

SEQ ID NO: 433105 - DNA, 20 bp, Artificial
  CRISPR gRNA sequence
gtagtccagctcccaggtga

SEQ ID NO: 433106 - DNA, 20 bp, Artificial
  CRISPR gRNA sequence
agtccagctcccaggtgaca

SEQ ID NO: 433107 - DNA, 20 bp, Artificial
  CRISPR gRNA sequence
cagctcccaggtgacagagt

SEQ ID NO: 433108 - DNA, 20 bp, Artificial
  CRISPR gRNA sequence
tgatcaattcaaaaattcca

SEQ ID NO: 433109 - DNA, 20 bp, Artificial
  CRISPR gRNA sequence
tggctatctctgaataaacc

SEQ ID NO: 433110 - DNA, 20 bp, Artificial
  CRISPR gRNA sequence
ggctatctctgaataaaccc

SEQ ID NO: 433111 - DNA, 20 bp, Artificial
  CRISPR gRNA sequence
atctctgaataaacccaggt

SEQ ID NO: 433112 - DNA, 20 bp, Artificial
  CRISPR gRNA sequence
tgaataaacccaggtaagtg

SEQ ID NO: 433113 - DNA, 20 bp, Artificial
  CRISPR gRNA sequence
gaataaacccaggtaagtgt

SEQ ID NO: 433114 - DNA, 20 bp, Artificial
  CRISPR gRNA sequence
taaacccaggtaagtgtggg

SEQ ID NO: 433115 - DNA, 20 bp, Artificial
  CRISPR gRNA sequence
aaacccaggtaagtgtgggt

SEQ ID NO: 433116 - DNA, 20 bp, Artificial
  CRISPR gRNA sequence
aacccaggtaagtgtgggtg

SEQ ID NO: 433117 - DNA, 20 bp, Artificial
  CRISPR gRNA sequence
ccaggtaagtgtgggtgggg

SEQ ID NO: 433118 - DNA, 20 bp, Artificial
  CRISPR gRNA sequence
aatccatttaaccataatcg

SEQ ID NO: 433119 - DNA, 20 bp, Artificial
  CRISPR gRNA sequence
ccataatcgcagaaaccata

SEQ ID NO: 433120 - DNA, 20 bp, Artificial
  CRISPR gRNA sequence
atcgcagaaaccataaagat

SEQ ID NO: 433121 - DNA, 20 bp, Artificial
  CRISPR gRNA sequence
tcgcagaaaccataaagatg

SEQ ID NO: 433122 - DNA, 20 bp, Artificial
  CRISPR gRNA sequence
gcagaaaccataaagatgag

SEQ ID NO: 433123 - DNA, 20 bp, Artificial
  CRISPR gRNA sequence
gaaaccataaagatgaggag

SEQ ID NO: 433124 - DNA, 20 bp, Artificial
  CRISPR gRNA sequence
aaaccataaagatgaggagc

SEQ ID NO: 433125 - DNA, 20 bp, Artificial
  CRISPR gRNA sequence
cataaagatgaggagcagga

SEQ ID NO: 433126 - DNA, 20 bp, Artificial
  CRISPR gRNA sequence
gatgaggagcaggacagtcc

SEQ ID NO: 433127 - DNA, 20 bp, Artificial
  CRISPR gRNA sequence
gacagtcctggtttcaaatc

SEQ ID NO: 433128 - DNA, 20 bp, Artificial
  CRISPR gRNA sequence
atcaattaactgtgtaaatg

SEQ ID NO: 433129 - DNA, 20 bp, Artificial
  CRISPR gRNA sequence
tcaattaactgtgtaaatgc

SEQ ID NO: 433130 - DNA, 20 bp, Artificial
  CRISPR gRNA sequence
ttaactgtgtaaatgcaggc

SEQ ID NO: 433131 - DNA, 20 bp, Artificial
  CRISPR gRNA sequence
aggcaagtgacctaaccttt

SEQ ID NO: 433132 - DNA, 20 bp, Artificial
  CRISPR gRNA sequence
ttagcatgctgattctccat

SEQ ID NO: 433133 - DNA, 20 bp, Artificial
  CRISPR gRNA sequence
attctccattagaaacatat

SEQ ID NO: 433134 - DNA, 20 bp, Artificial
  CRISPR gRNA sequence
acatattagtacctatctca

SEQ ID NO: 433135 - DNA, 20 bp, Artificial
  CRISPR gRNA sequence
catattagtacctatctcat

SEQ ID NO: 433136 - DNA, 20 bp, Artificial
  CRISPR gRNA sequence
atattagtacctatctcata

SEQ ID NO: 433137 - DNA, 20 bp, Artificial
  CRISPR gRNA sequence
ttagtacctatctcataggg

SEQ ID NO: 433138 - DNA, 20 bp, Artificial
  CRISPR gRNA sequence
ctatctcatagggtagttac

SEQ ID NO: 433139 - DNA, 20 bp, Artificial
  CRISPR gRNA sequence
acgagaatttaatgcacgta

SEQ ID NO: 433140 - DNA, 20 bp, Artificial
  CRISPR gRNA sequence
tttaatgcacgtaaagcact

SEQ ID NO: 433141 - DNA, 20 bp, Artificial
  CRISPR gRNA sequence
aatgcacgtaaagcacttgg

SEQ ID NO: 433142 - DNA, 20 bp, Artificial
  CRISPR gRNA sequence
cgtaaagcacttggcagctt

SEQ ID NO: 433143 - DNA, 20 bp, Artificial
  CRISPR gRNA sequence
cacttggcagcttcagtcca

SEQ ID NO: 433144 - DNA, 20 bp, Artificial
  CRISPR gRNA sequence
tggcagcttcagtccacagt

SEQ ID NO: 433145 - DNA, 20 bp, Artificial
  CRISPR gRNA sequence
cagcttcagtccacagttag

SEQ ID NO: 433146 - DNA, 20 bp, Artificial
  CRISPR gRNA sequence
agcttcagtccacagttagt

SEQ ID NO: 433147 - DNA, 20 bp, Artificial
  CRISPR gRNA sequence
gcttcagtccacagttagtg

SEQ ID NO: 433148 - DNA, 20 bp, Artificial
  CRISPR gRNA sequence
cttcagtccacagttagtgg

SEQ ID NO: 433149 - DNA, 20 bp, Artificial
  CRISPR gRNA sequence
ttcagtccacagttagtggg

SEQ ID NO: 433150 - DNA, 20 bp, Artificial
  CRISPR gRNA sequence
ggaccaactcatgtttttct

SEQ ID NO: 433151 - DNA, 20 bp, Artificial
  CRISPR gRNA sequence
atgtttttcttggactgttc

SEQ ID NO: 433152 - DNA, 20 bp, Artificial
  CRISPR gRNA sequence
ttcttggactgttccagttt

SEQ ID NO: 433153 - DNA, 20 bp, Artificial
  CRISPR gRNA sequence
gactgttccagttttagccc

SEQ ID NO: 433154 - DNA, 20 bp, Artificial
  CRISPR gRNA sequence
tgttccagttttagccctag

SEQ ID NO: 433155 - DNA, 20 bp, Artificial
  CRISPR gRNA sequence
cctagaagtcccatatatct

SEQ ID NO: 433156 - DNA, 20 bp, Artificial
  CRISPR gRNA sequence
ctagaagtcccatatatctt

SEQ ID NO: 433157 - DNA, 20 bp, Artificial
  CRISPR gRNA sequence
tatatcttaggaacaccctt

SEQ ID NO: 433158 - DNA, 20 bp, Artificial
  CRISPR gRNA sequence
taggaacaccctttagtctt

SEQ ID NO: 433159 - DNA, 20 bp, Artificial
  CRISPR gRNA sequence
ctttagtcttgagctaatct

SEQ ID NO: 433160 - DNA, 20 bp, Artificial
  CRISPR gRNA sequence
tttagtcttgagctaatctg

SEQ ID NO: 433161 - DNA, 20 bp, Artificial
  CRISPR gRNA sequence
gattgctcactctacacaca

SEQ ID NO: 433162 - DNA, 20 bp, Artificial
  CRISPR gRNA sequence
cacagtccctgtttgtgtat

SEQ ID NO: 433163 - DNA, 20 bp, Artificial
  CRISPR gRNA sequence
gtccctgtttgtgtattagt

SEQ ID NO: 433164 - DNA, 20 bp, Artificial
  CRISPR gRNA sequence
ctgtttgtgtattagtaaga

SEQ ID NO: 433165 - DNA, 20 bp, Artificial
  CRISPR gRNA sequence
tgtttgtgtattagtaagaa

SEQ ID NO: 433166 - DNA, 20 bp, Artificial
  CRISPR gRNA sequence
tgctatgtcatattacgctc

SEQ ID NO: 433167 - DNA, 20 bp, Artificial
  CRISPR gRNA sequence
gctatgtcatattacgctct

SEQ ID NO: 433168 - DNA, 20 bp, Artificial
  CRISPR gRNA sequence
ctatgtcatattacgctctg

SEQ ID NO: 433169 - DNA, 20 bp, Artificial
  CRISPR gRNA sequence
catattacgctctggggcat

SEQ ID NO: 433170 - DNA, 20 bp, Artificial
  CRISPR gRNA sequence
atattacgctctggggcata

SEQ ID NO: 433171 - DNA, 20 bp, Artificial
  CRISPR gRNA sequence
cgctctggggcataaggact

SEQ ID NO: 433172 - DNA, 20 bp, Artificial
  CRISPR gRNA sequence
ggacttggtttctgccctaa

SEQ ID NO: 433173 - DNA, 20 bp, Artificial
  CRISPR gRNA sequence
tgccctaaaagaaaataaaa

SEQ ID NO: 433174 - DNA, 20 bp, Artificial
  CRISPR gRNA sequence
taaaatagacacaattataa

SEQ ID NO: 433175 - DNA, 20 bp, Artificial
  CRISPR gRNA sequence
acacaattataaaagtgtgt

SEQ ID NO: 433176 - DNA, 20 bp, Artificial
  CRISPR gRNA sequence
caattataaaagtgtgtgag

SEQ ID NO: 433177 - DNA, 20 bp, Artificial
  CRISPR gRNA sequence
tataaaagtgtgtgagtggc

SEQ ID NO: 433178 - DNA, 20 bp, Artificial
  CRISPR gRNA sequence
ataaaagtgtgtgagtggcc

SEQ ID NO: 433179 - DNA, 20 bp, Artificial
  CRISPR gRNA sequence
agtgtgtgagtggccaggca

SEQ ID NO: 433180 - DNA, 20 bp, Artificial
  CRISPR gRNA sequence
gtgtgagtggccaggcacag

SEQ ID NO: 433181 - DNA, 20 bp, Artificial
  CRISPR gRNA sequence
cgcctgtaatcccaaaacat

SEQ ID NO: 433182 - DNA, 20 bp, Artificial
  CRISPR gRNA sequence
gcctgtaatcccaaaacatt

SEQ ID NO: 433183 - DNA, 20 bp, Artificial
  CRISPR gRNA sequence
ctgtaatcccaaaacattgg

SEQ ID NO: 433184 - DNA, 20 bp, Artificial
  CRISPR gRNA sequence
tgtaatcccaaaacattggg

SEQ ID NO: 433185 - DNA, 20 bp, Artificial
  CRISPR gRNA sequence
tcccaaaacattgggaggtc

SEQ ID NO: 433186 - DNA, 20 bp, Artificial
  CRISPR gRNA sequence
cccaaaacattgggaggtcg

SEQ ID NO: 433187 - DNA, 20 bp, Artificial
  CRISPR gRNA sequence
aaaacattgggaggtcgagg

SEQ ID NO: 433188 - DNA, 20 bp, Artificial
  CRISPR gRNA sequence
cattgggaggtcgaggtgga

SEQ ID NO: 433189 - DNA, 20 bp, Artificial
  CRISPR gRNA sequence
ggtcgaggtggacggatcac

SEQ ID NO: 433190 - DNA, 20 bp, Artificial
  CRISPR gRNA sequence
gtcgaggtggacggatcaca

SEQ ID NO: 433191 - DNA, 20 bp, Artificial
  CRISPR gRNA sequence
aggtggacggatcacaaggt

SEQ ID NO: 433192 - DNA, 20 bp, Artificial
  CRISPR gRNA sequence
ggtggacggatcacaaggtc

SEQ ID NO: 433193 - DNA, 20 bp, Artificial
  CRISPR gRNA sequence
tggacggatcacaaggtcag

SEQ ID NO: 433194 - DNA, 20 bp, Artificial
  CRISPR gRNA sequence
gatcacaaggtcaggagatc

SEQ ID NO: 433195 - DNA, 20 bp, Artificial
  CRISPR gRNA sequence
caagaacatcttgcccaaca

SEQ ID NO: 433196 - DNA, 20 bp, Artificial
  CRISPR gRNA sequence
tctactaaaaatataaaaat

SEQ ID NO: 433197 - DNA, 20 bp, Artificial
  CRISPR gRNA sequence
ctaaaaatataaaaattagc

SEQ ID NO: 433198 - DNA, 20 bp, Artificial
  CRISPR gRNA sequence
taaaaatataaaaattagcc

SEQ ID NO: 433199 - DNA, 20 bp, Artificial
  CRISPR gRNA sequence
atataaaaattagccaggcg

SEQ ID NO: 433200 - DNA, 20 bp, Artificial
  CRISPR gRNA sequence
taaaaattagccaggcgtgg

SEQ ID NO: 433201 - DNA, 20 bp, Artificial
  CRISPR gRNA sequence
ggcgtggtggtacatgcctg

SEQ ID NO: 433202 - DNA, 20 bp, Artificial
  CRISPR gRNA sequence
gtggtacatgcctgtagtcc

SEQ ID NO: 433203 - DNA, 20 bp, Artificial
  CRISPR gRNA sequence
gcctgtagtcccagctactc

SEQ ID NO: 433204 - DNA, 20 bp, Artificial
  CRISPR gRNA sequence
tgtagtcccagctactctgg

SEQ ID NO: 433205 - DNA, 20 bp, Artificial
  CRISPR gRNA sequence
tcccagctactctggaagct

SEQ ID NO: 433206 - DNA, 20 bp, Artificial
  CRISPR gRNA sequence
agctactctggaagctgagt

SEQ ID NO: 433207 - DNA, 20 bp, Artificial
  CRISPR gRNA sequence
gctactctggaagctgagtc

SEQ ID NO: 433208 - DNA, 20 bp, Artificial
  CRISPR gRNA sequence
tactctggaagctgagtcag

SEQ ID NO: 433209 - DNA, 20 bp, Artificial
  CRISPR gRNA sequence
tcaggagaaacacttgaacc

SEQ ID NO: 433210 - DNA, 20 bp, Artificial
  CRISPR gRNA sequence
caggagaaacacttgaaccc

SEQ ID NO: 433211 - DNA, 20 bp, Artificial
  CRISPR gRNA sequence
ggagaaacacttgaacccgg

SEQ ID NO: 433212 - DNA, 20 bp, Artificial
  CRISPR gRNA sequence
gagaaacacttgaacccggg

SEQ ID NO: 433213 - DNA, 20 bp, Artificial
  CRISPR gRNA sequence
aaacacttgaacccgggagg

SEQ ID NO: 433214 - DNA, 20 bp, Artificial
  CRISPR gRNA sequence
acacttgaacccgggaggca

SEQ ID NO: 433215 - DNA, 20 bp, Artificial
  CRISPR gRNA sequence
cacttgaacccgggaggcag

SEQ ID NO: 433216 - DNA, 20 bp, Artificial
  CRISPR gRNA sequence
aacccgggaggcagaggtta

SEQ ID NO: 433217 - DNA, 20 bp, Artificial
  CRISPR gRNA sequence
cgggaggcagaggttacagt

SEQ ID NO: 433218 - DNA, 20 bp, Artificial
  CRISPR gRNA sequence
ggcagaggttacagtgagct

SEQ ID NO: 433219 - DNA, 20 bp, Artificial
  CRISPR gRNA sequence
gagatcgtgccactgcactc

SEQ ID NO: 433220 - DNA, 20 bp, Artificial
  CRISPR gRNA sequence
gtccatctccaaaaaaacaa

SEQ ID NO: 433221 - DNA, 20 bp, Artificial
  CRISPR gRNA sequence
ccaaaaaaacaaaagtgtgc

SEQ ID NO: 433222 - DNA, 20 bp, Artificial
  CRISPR gRNA sequence
caaaaaaacaaaagtgtgcg

SEQ ID NO: 433223 - DNA, 20 bp, Artificial
  CRISPR gRNA sequence
aacaaaagtgtgcgaggttt

SEQ ID NO: 433224 - DNA, 20 bp, Artificial
  CRISPR gRNA sequence
acaaaagtgtgcgaggtttt

SEQ ID NO: 433225 - DNA, 20 bp, Artificial
  CRISPR gRNA sequence
caaaagtgtgcgaggttttg

SEQ ID NO: 433226 - DNA, 20 bp, Artificial
  CRISPR gRNA sequence
aaaagtgtgcgaggttttgg

SEQ ID NO: 433227 - DNA, 20 bp, Artificial
  CRISPR gRNA sequence
gtgcgaggttttgggggtac

SEQ ID NO: 433228 - DNA, 20 bp, Artificial
  CRISPR gRNA sequence
cgaggttttgggggtactgg

SEQ ID NO: 433229 - DNA, 20 bp, Artificial
  CRISPR gRNA sequence
ttgggggtactggaagtatt

SEQ ID NO: 433230 - DNA, 20 bp, Artificial
  CRISPR gRNA sequence
ttagatcttgattgtgatga

SEQ ID NO: 433231 - DNA, 20 bp, Artificial
  CRISPR gRNA sequence
cttctttttttttttttttt

SEQ ID NO: 433232 - DNA, 20 bp, Artificial
  CRISPR gRNA sequence
tctttttttttttttttttg

SEQ ID NO: 433233 - DNA, 20 bp, Artificial
  CRISPR gRNA sequence
gactgtcttattctgttgcc

SEQ ID NO: 433234 - DNA, 20 bp, Artificial
  CRISPR gRNA sequence
actgtcttattctgttgccc

SEQ ID NO: 433235 - DNA, 20 bp, Artificial
  CRISPR gRNA sequence
ctgtcttattctgttgccca

SEQ ID NO: 433236 - DNA, 20 bp, Artificial
  CRISPR gRNA sequence
tcttattctgttgcccaggg

SEQ ID NO: 433237 - DNA, 20 bp, Artificial
  CRISPR gRNA sequence
ttattctgttgcccagggtg

SEQ ID NO: 433238 - DNA, 20 bp, Artificial
  CRISPR gRNA sequence
gatgcaatcaccgctcactg

SEQ ID NO: 433239 - DNA, 20 bp, Artificial
  CRISPR gRNA sequence
accgctcactgcagcctcct

SEQ ID NO: 433240 - DNA, 20 bp, Artificial
  CRISPR gRNA sequence
cactgcagcctcctgagctc

SEQ ID NO: 433241 - DNA, 20 bp, Artificial
  CRISPR gRNA sequence
ctcaagtgatcctcccacct

SEQ ID NO: 433242 - DNA, 20 bp, Artificial
  CRISPR gRNA sequence
tcctcccacctcagcctcct

SEQ ID NO: 433243 - DNA, 20 bp, Artificial
  CRISPR gRNA sequence
tcccacctcagcctcctgag

SEQ ID NO: 433244 - DNA, 20 bp, Artificial
  CRISPR gRNA sequence
acctcagcctcctgagtaga

SEQ ID NO: 433245 - DNA, 20 bp, Artificial
  CRISPR gRNA sequence
cctcagcctcctgagtagat

SEQ ID NO: 433246 - DNA, 20 bp, Artificial
  CRISPR gRNA sequence
ctcctgagtagatgggacta

SEQ ID NO: 433247 - DNA, 20 bp, Artificial
  CRISPR gRNA sequence
tcctgagtagatgggactac

SEQ ID NO: 433248 - DNA, 20 bp, Artificial
  CRISPR gRNA sequence
caggtgtgtgccaccatgcc

SEQ ID NO: 433249 - DNA, 20 bp, Artificial
  CRISPR gRNA sequence
ttattattattattacgttg

SEQ ID NO: 433250 - DNA, 20 bp, Artificial
  CRISPR gRNA sequence
attattattattacgttgta

SEQ ID NO: 433251 - DNA, 20 bp, Artificial
  CRISPR gRNA sequence
ttattattattacgttgtag

SEQ ID NO: 433252 - DNA, 20 bp, Artificial
  CRISPR gRNA sequence
ttattattacgttgtagagg

SEQ ID NO: 433253 - DNA, 20 bp, Artificial
  CRISPR gRNA sequence
tattattacgttgtagaggc

SEQ ID NO: 433254 - DNA, 20 bp, Artificial
  CRISPR gRNA sequence
caggatcctgctttgctgcc

SEQ ID NO: 433255 - DNA, 20 bp, Artificial
  CRISPR gRNA sequence
aggatcctgctttgctgccc

SEQ ID NO: 433256 - DNA, 20 bp, Artificial
  CRISPR gRNA sequence
tttgctgcccaggctgatct

SEQ ID NO: 433257 - DNA, 20 bp, Artificial
  CRISPR gRNA sequence
tgatcttggtctcaaactcc

SEQ ID NO: 433258 - DNA, 20 bp, Artificial
  CRISPR gRNA sequence
gatcttggtctcaaactcct

SEQ ID NO: 433259 - DNA, 20 bp, Artificial
  CRISPR gRNA sequence
ctcaactgatcctctcacct

SEQ ID NO: 433260 - DNA, 20 bp, Artificial
  CRISPR gRNA sequence
cctctcacctcagcttccga

SEQ ID NO: 433261 - DNA, 20 bp, Artificial
  CRISPR gRNA sequence
ttccgaaagtgttgaaaata

SEQ ID NO: 433262 - DNA, 20 bp, Artificial
  CRISPR gRNA sequence
tccgaaagtgttgaaaatac

SEQ ID NO: 433263 - DNA, 20 bp, Artificial
  CRISPR gRNA sequence
agtgttgaaaatacaggcat

SEQ ID NO: 433264 - DNA, 20 bp, Artificial
  CRISPR gRNA sequence
caggcatgagccactgcacc

SEQ ID NO: 433265 - DNA, 20 bp, Artificial
  CRISPR gRNA sequence
attttattactttttttttt

SEQ ID NO: 433266 - DNA, 20 bp, Artificial
  CRISPR gRNA sequence
tattacttttttttttaaga

SEQ ID NO: 433267 - DNA, 20 bp, Artificial
  CRISPR gRNA sequence
gacagtctcactctgtcacc

SEQ ID NO: 433268 - DNA, 20 bp, Artificial
  CRISPR gRNA sequence
acagtctcactctgtcaccc

SEQ ID NO: 433269 - DNA, 20 bp, Artificial
  CRISPR gRNA sequence
tctcactctgtcacccaggc

SEQ ID NO: 433270 - DNA, 20 bp, Artificial
  CRISPR gRNA sequence
tcactctgtcacccaggctg

SEQ ID NO: 433271 - DNA, 20 bp, Artificial
  CRISPR gRNA sequence
ctgtcacccaggctggagtg

SEQ ID NO: 433272 - DNA, 20 bp, Artificial
  CRISPR gRNA sequence
tcacccaggctggagtgcag

SEQ ID NO: 433273 - DNA, 20 bp, Artificial
  CRISPR gRNA sequence
ggagtgcagtggcatgatct

SEQ ID NO: 433274 - DNA, 20 bp, Artificial
  CRISPR gRNA sequence
tcactgtaacctccacctac

SEQ ID NO: 433275 - DNA, 20 bp, Artificial
  CRISPR gRNA sequence
cactgtaacctccacctacc

SEQ ID NO: 433276 - DNA, 20 bp, Artificial
  CRISPR gRNA sequence
aacctccacctaccaggttt

SEQ ID NO: 433277 - DNA, 20 bp, Artificial
  CRISPR gRNA sequence
tttgagtgattcctctgcct

SEQ ID NO: 433278 - DNA, 20 bp, Artificial
  CRISPR gRNA sequence
ttcctctgcctcagcctcct

SEQ ID NO: 433279 - DNA, 20 bp, Artificial
  CRISPR gRNA sequence
ctctgcctcagcctcctgag

SEQ ID NO: 433280 - DNA, 20 bp, Artificial
  CRISPR gRNA sequence
gcctcagcctcctgagtagc

SEQ ID NO: 433281 - DNA, 20 bp, Artificial
  CRISPR gRNA sequence
cctcagcctcctgagtagct

SEQ ID NO: 433282 - DNA, 20 bp, Artificial
  CRISPR gRNA sequence
ctcctgagtagctgggatta

SEQ ID NO: 433283 - DNA, 20 bp, Artificial
  CRISPR gRNA sequence
tcctgagtagctgggattac

SEQ ID NO: 433284 - DNA, 20 bp, Artificial
  CRISPR gRNA sequence
caggcatgcgccaccacacc

SEQ ID NO: 433285 - DNA, 20 bp, Artificial
  CRISPR gRNA sequence
cccggctaattttgtatttt

SEQ ID NO: 433286 - DNA, 20 bp, Artificial
  CRISPR gRNA sequence
ggctaattttgtatttttag

SEQ ID NO: 433287 - DNA, 20 bp, Artificial
  CRISPR gRNA sequence
ctaattttgtatttttagta

SEQ ID NO: 433288 - DNA, 20 bp, Artificial
  CRISPR gRNA sequence
ttttgtatttttagtagaga

SEQ ID NO: 433289 - DNA, 20 bp, Artificial
  CRISPR gRNA sequence
tttgtatttttagtagagat

SEQ ID NO: 433290 - DNA, 20 bp, Artificial
  CRISPR gRNA sequence
ttgtatttttagtagagatg

SEQ ID NO: 433291 - DNA, 20 bp, Artificial
  CRISPR gRNA sequence
gagatggggtctcaccatgt

SEQ ID NO: 433292 - DNA, 20 bp, Artificial
  CRISPR gRNA sequence
ggggtctcaccatgttggcc

SEQ ID NO: 433293 - DNA, 20 bp, Artificial
  CRISPR gRNA sequence
tctcaccatgttggccaagc

SEQ ID NO: 433294 - DNA, 20 bp, Artificial
  CRISPR gRNA sequence
ctcaaatgatccacccccct

SEQ ID NO: 433295 - DNA, 20 bp, Artificial
  CRISPR gRNA sequence
ccacccccctcagcctccca

SEQ ID NO: 433296 - DNA, 20 bp, Artificial
  CRISPR gRNA sequence
ccctcagcctcccaaagtgc

SEQ ID NO: 433297 - DNA, 20 bp, Artificial
  CRISPR gRNA sequence
cctcagcctcccaaagtgct

SEQ ID NO: 433298 - DNA, 20 bp, Artificial
  CRISPR gRNA sequence
ctcccaaagtgctgggatta

SEQ ID NO: 433299 - DNA, 20 bp, Artificial
  CRISPR gRNA sequence
tcccaaagtgctgggattac

SEQ ID NO: 433300 - DNA, 20 bp, Artificial
  CRISPR gRNA sequence
agtgctgggattacaggcgt

SEQ ID NO: 433301 - DNA, 20 bp, Artificial
  CRISPR gRNA sequence
acaggcgtgagccactgcgc

SEQ ID NO: 433302 - DNA, 20 bp, Artificial
  CRISPR gRNA sequence
caggcgtgagccactgcgcc

SEQ ID NO: 433303 - DNA, 20 bp, Artificial
  CRISPR gRNA sequence
ttttgtttttgtttgtttgc

SEQ ID NO: 433304 - DNA, 20 bp, Artificial
  CRISPR gRNA sequence
ttgctagtttaaaaaaaaaa

SEQ ID NO: 433305 - DNA, 20 bp, Artificial
  CRISPR gRNA sequence
tgctagtttaaaaaaaaaaa

SEQ ID NO: 433306 - DNA, 20 bp, Artificial
  CRISPR gRNA sequence
gctagtttaaaaaaaaaaaa

SEQ ID NO: 433307 - DNA, 20 bp, Artificial
  CRISPR gRNA sequence
tttaaaaaaaaaaaagggat

SEQ ID NO: 433308 - DNA, 20 bp, Artificial
  CRISPR gRNA sequence
aaaaaaagggataagtaact

SEQ ID NO: 433309 - DNA, 20 bp, Artificial
  CRISPR gRNA sequence
agggataagtaacttagaaa

SEQ ID NO: 433310 - DNA, 20 bp, Artificial
  CRISPR gRNA sequence
cttagaaaaagctatgtgct

SEQ ID NO: 433311 - DNA, 20 bp, Artificial
  CRISPR gRNA sequence
ctatgtgctaagtaccatga

SEQ ID NO: 433312 - DNA, 20 bp, Artificial
  CRISPR gRNA sequence
atgtgctaagtaccatgatg

SEQ ID NO: 433313 - DNA, 20 bp, Artificial
  CRISPR gRNA sequence
tgtgctaagtaccatgatgg

SEQ ID NO: 433314 - DNA, 20 bp, Artificial
  CRISPR gRNA sequence
aggaaaacattctctaaccc

SEQ ID NO: 433315 - DNA, 20 bp, Artificial
  CRISPR gRNA sequence
ctctaaccccagtcacgacc

SEQ ID NO: 433316 - DNA, 20 bp, Artificial
  CRISPR gRNA sequence
ccagtcacgacccagtgtta

SEQ ID NO: 433317 - DNA, 20 bp, Artificial
  CRISPR gRNA sequence
cagtcacgacccagtgttaa

SEQ ID NO: 433318 - DNA, 20 bp, Artificial
  CRISPR gRNA sequence
agtcacgacccagtgttaaa

SEQ ID NO: 433319 - DNA, 20 bp, Artificial
  CRISPR gRNA sequence
cccagtgttaaagggacttg

SEQ ID NO: 433320 - DNA, 20 bp, Artificial
  CRISPR gRNA sequence
agggacttgcagtctactgc

SEQ ID NO: 433321 - DNA, 20 bp, Artificial
  CRISPR gRNA sequence
ggacttgcagtctactgcca

SEQ ID NO: 433322 - DNA, 20 bp, Artificial
  CRISPR gRNA sequence
acttgcagtctactgccaga

SEQ ID NO: 433323 - DNA, 20 bp, Artificial
  CRISPR gRNA sequence
cttgcagtctactgccagag

SEQ ID NO: 433324 - DNA, 20 bp, Artificial
  CRISPR gRNA sequence
actgccagagaggtatgcct

SEQ ID NO: 433325 - DNA, 20 bp, Artificial
  CRISPR gRNA sequence
tatgcctgagaaaccaataa

SEQ ID NO: 433326 - DNA, 20 bp, Artificial
  CRISPR gRNA sequence
ctgagaaaccaataacagaa

SEQ ID NO: 433327 - DNA, 20 bp, Artificial
  CRISPR gRNA sequence
accaataacagaaaagtgca

SEQ ID NO: 433328 - DNA, 20 bp, Artificial
  CRISPR gRNA sequence
aataacagaaaagtgcacag

SEQ ID NO: 433329 - DNA, 20 bp, Artificial
  CRISPR gRNA sequence
ataacagaaaagtgcacaga

SEQ ID NO: 433330 - DNA, 20 bp, Artificial
  CRISPR gRNA sequence
acagaaaagtgcacagaagg

SEQ ID NO: 433331 - DNA, 20 bp, Artificial
  CRISPR gRNA sequence
gttgtgtttcgtaacaaacc

SEQ ID NO: 433332 - DNA, 20 bp, Artificial
  CRISPR gRNA sequence
ctagacatattcatgaatta

SEQ ID NO: 433333 - DNA, 20 bp, Artificial
  CRISPR gRNA sequence
tattcatgaattaaagaaat

SEQ ID NO: 433334 - DNA, 20 bp, Artificial
  CRISPR gRNA sequence
aattaaagaaattagtttac

SEQ ID NO: 433335 - DNA, 20 bp, Artificial
  CRISPR gRNA sequence
agaaattagtttactggaat

SEQ ID NO: 433336 - DNA, 20 bp, Artificial
  CRISPR gRNA sequence
tttactggaatcagcctgcc

SEQ ID NO: 433337 - DNA, 20 bp, Artificial
  CRISPR gRNA sequence
gcctgcctggatttgatttc

SEQ ID NO: 433338 - DNA, 20 bp, Artificial
  CRISPR gRNA sequence
gatttgatttccggttctgc

SEQ ID NO: 433339 - DNA, 20 bp, Artificial
  CRISPR gRNA sequence
atttgatttccggttctgcc

SEQ ID NO: 433340 - DNA, 20 bp, Artificial
  CRISPR gRNA sequence
aggtactgatgttgaaacct

SEQ ID NO: 433341 - DNA, 20 bp, Artificial
  CRISPR gRNA sequence
ggtactgatgttgaaacctc

SEQ ID NO: 433342 - DNA, 20 bp, Artificial
  CRISPR gRNA sequence
actgatgttgaaacctcggg

SEQ ID NO: 433343 - DNA, 20 bp, Artificial
  CRISPR gRNA sequence
ctgatgttgaaacctcggga

SEQ ID NO: 433344 - DNA, 20 bp, Artificial
  CRISPR gRNA sequence
atgttgaaacctcgggaagg

SEQ ID NO: 433345 - DNA, 20 bp, Artificial
  CRISPR gRNA sequence
tcgggaaggcagcttactct

SEQ ID NO: 433346 - DNA, 20 bp, Artificial
  CRISPR gRNA sequence
gacttcccttcactgtaaaa

SEQ ID NO: 433347 - DNA, 20 bp, Artificial
  CRISPR gRNA sequence
acttcccttcactgtaaaat

SEQ ID NO: 433348 - DNA, 20 bp, Artificial
  CRISPR gRNA sequence
cttcccttcactgtaaaatg

SEQ ID NO: 433349 - DNA, 20 bp, Artificial
  CRISPR gRNA sequence
ccttcactgtaaaatgggga

SEQ ID NO: 433350 - DNA, 20 bp, Artificial
  CRISPR gRNA sequence
ggtactattccttatctcat

SEQ ID NO: 433351 - DNA, 20 bp, Artificial
  CRISPR gRNA sequence
ctattccttatctcataaga

SEQ ID NO: 433352 - DNA, 20 bp, Artificial
  CRISPR gRNA sequence
tgtatgtaaaacatttaacg

SEQ ID NO: 433353 - DNA, 20 bp, Artificial
  CRISPR gRNA sequence
atgtaaaacatttaacgcag

SEQ ID NO: 433354 - DNA, 20 bp, Artificial
  CRISPR gRNA sequence
aataaatattaaataaaaat

SEQ ID NO: 433355 - DNA, 20 bp, Artificial
  CRISPR gRNA sequence
taaaaattagccattattgt

SEQ ID NO: 433356 - DNA, 20 bp, Artificial
  CRISPR gRNA sequence
aaaaattagccattattgtt

SEQ ID NO: 433357 - DNA, 20 bp, Artificial
  CRISPR gRNA sequence
tagccattattgttaggatt

SEQ ID NO: 433358 - DNA, 20 bp, Artificial
  CRISPR gRNA sequence
cattattgttaggatttgga

SEQ ID NO: 433359 - DNA, 20 bp, Artificial
  CRISPR gRNA sequence
gttaggatttggatggacaa

SEQ ID NO: 433360 - DNA, 20 bp, Artificial
  CRISPR gRNA sequence
ttaggatttggatggacaaa

SEQ ID NO: 433361 - DNA, 20 bp, Artificial
  CRISPR gRNA sequence
taggatttggatggacaaaa

SEQ ID NO: 433362 - DNA, 20 bp, Artificial
  CRISPR gRNA sequence
tggatggacaaaagggtatt

SEQ ID NO: 433363 - DNA, 20 bp, Artificial
  CRISPR gRNA sequence
gtatttagtctaatcatctt

SEQ ID NO: 433364 - DNA, 20 bp, Artificial
  CRISPR gRNA sequence
tatttagtctaatcatcttt

SEQ ID NO: 433365 - DNA, 20 bp, Artificial
  CRISPR gRNA sequence
catgaatttgcatttctatc

SEQ ID NO: 433366 - DNA, 20 bp, Artificial
  CRISPR gRNA sequence
atgaatttgcatttctatct

SEQ ID NO: 433367 - DNA, 20 bp, Artificial
  CRISPR gRNA sequence
atttctatctaggtttttac

SEQ ID NO: 433368 - DNA, 20 bp, Artificial
  CRISPR gRNA sequence
gtttttactggttctcactg

SEQ ID NO: 433369 - DNA, 20 bp, Artificial
  CRISPR gRNA sequence
ctcactgaagaatttgttat

SEQ ID NO: 433370 - DNA, 20 bp, Artificial
  CRISPR gRNA sequence
cactgaagaatttgttatca

SEQ ID NO: 433371 - DNA, 20 bp, Artificial
  CRISPR gRNA sequence
actgaagaatttgttatcag

SEQ ID NO: 433372 - DNA, 20 bp, Artificial
  CRISPR gRNA sequence
ctgaagaatttgttatcaga

SEQ ID NO: 433373 - DNA, 20 bp, Artificial
  CRISPR gRNA sequence
gaagaatttgttatcagagg

SEQ ID NO: 433374 - DNA, 20 bp, Artificial
  CRISPR gRNA sequence
agaatttgttatcagaggga

SEQ ID NO: 433375 - DNA, 20 bp, Artificial
  CRISPR gRNA sequence
aatttgttatcagagggaga

SEQ ID NO: 433376 - DNA, 20 bp, Artificial
  CRISPR gRNA sequence
acacttacatttgaaaatta

SEQ ID NO: 433377 - DNA, 20 bp, Artificial
  CRISPR gRNA sequence
atttgaaaattaaagcgccg

SEQ ID NO: 433378 - DNA, 20 bp, Artificial
  CRISPR gRNA sequence
aaaattaaagcgccgaagat

SEQ ID NO: 433379 - DNA, 20 bp, Artificial
  CRISPR gRNA sequence
aattaaagcgccgaagataa

SEQ ID NO: 433380 - DNA, 20 bp, Artificial
  CRISPR gRNA sequence
aaagcgccgaagataagagc

SEQ ID NO: 433381 - DNA, 20 bp, Artificial
  CRISPR gRNA sequence
agcgccgaagataagagcca

SEQ ID NO: 433382 - DNA, 20 bp, Artificial
  CRISPR gRNA sequence
ccgaagataagagccagagc

SEQ ID NO: 433383 - DNA, 20 bp, Artificial
  CRISPR gRNA sequence
gataagagccagagccagcc

SEQ ID NO: 433384 - DNA, 20 bp, Artificial
  CRISPR gRNA sequence
gagccagagccagcccagca

SEQ ID NO: 433385 - DNA, 20 bp, Artificial
  CRISPR gRNA sequence
cacagatccctgctccgatg

SEQ ID NO: 433386 - DNA, 20 bp, Artificial
  CRISPR gRNA sequence
gatgtagatgcctattctga

SEQ ID NO: 433387 - DNA, 20 bp, Artificial
  CRISPR gRNA sequence
gcctattctgatggttgctc

SEQ ID NO: 433388 - DNA, 20 bp, Artificial
  CRISPR gRNA sequence
ctattctgatggttgctcca

SEQ ID NO: 433389 - DNA, 20 bp, Artificial
  CRISPR gRNA sequence
tggttgctccagagtcccgt

SEQ ID NO: 433390 - DNA, 20 bp, Artificial
  CRISPR gRNA sequence
tccagagtcccgtaagtcat

SEQ ID NO: 433391 - DNA, 20 bp, Artificial
  CRISPR gRNA sequence
ccgtaagtcattggccaatc

SEQ ID NO: 433392 - DNA, 20 bp, Artificial
  CRISPR gRNA sequence
gtaagtcattggccaatcta

SEQ ID NO: 433393 - DNA, 20 bp, Artificial
  CRISPR gRNA sequence
tctagagtcccgtaactcat

SEQ ID NO: 433394 - DNA, 20 bp, Artificial
  CRISPR gRNA sequence
ccgtaactcattggccaatg

SEQ ID NO: 433395 - DNA, 20 bp, Artificial
  CRISPR gRNA sequence
gccaatgtggatatttgcta

SEQ ID NO: 433396 - DNA, 20 bp, Artificial
  CRISPR gRNA sequence
atttgctatggaaacacaaa

SEQ ID NO: 433397 - DNA, 20 bp, Artificial
  CRISPR gRNA sequence
tttgctatggaaacacaaac

SEQ ID NO: 433398 - DNA, 20 bp, Artificial
  CRISPR gRNA sequence
tggaaacacaaacaggattt

SEQ ID NO: 433399 - DNA, 20 bp, Artificial
  CRISPR gRNA sequence
aaacacaaacaggatttaag

SEQ ID NO: 433400 - DNA, 20 bp, Artificial
  CRISPR gRNA sequence
aacaggatttaagcagaaaa

SEQ ID NO: 433401 - DNA, 20 bp, Artificial
  CRISPR gRNA sequence
ggatttaagcagaaaacagc

SEQ ID NO: 433402 - DNA, 20 bp, Artificial
  CRISPR gRNA sequence
ctagaaatcgcttgtgtaat

SEQ ID NO: 433403 - DNA, 20 bp, Artificial
  CRISPR gRNA sequence
tcgcttgtgtaatcagcttc

SEQ ID NO: 433404 - DNA, 20 bp, Artificial
  CRISPR gRNA sequence
cagcttcaagatttgtgaat

SEQ ID NO: 433405 - DNA, 20 bp, Artificial
  CRISPR gRNA sequence
ccatcccttttacaacatca

SEQ ID NO: 433406 - DNA, 20 bp, Artificial
  CRISPR gRNA sequence
catcccttttacaacatcac

SEQ ID NO: 433407 - DNA, 20 bp, Artificial
  CRISPR gRNA sequence
ccttttacaacatcacagga

SEQ ID NO: 433408 - DNA, 20 bp, Artificial
  CRISPR gRNA sequence
tacaacatcacaggatggct

SEQ ID NO: 433409 - DNA, 20 bp, Artificial
  CRISPR gRNA sequence
acctttgatctgtcaccttg

SEQ ID NO: 433410 - DNA, 20 bp, Artificial
  CRISPR gRNA sequence
tcaccttgtagccaacactc

SEQ ID NO: 433411 - DNA, 20 bp, Artificial
  CRISPR gRNA sequence
gccaacactcaagccaaccc

SEQ ID NO: 433412 - DNA, 20 bp, Artificial
  CRISPR gRNA sequence
acactcaagccaacccaaga

SEQ ID NO: 433413 - DNA, 20 bp, Artificial
  CRISPR gRNA sequence
cactcaagccaacccaagaa

SEQ ID NO: 433414 - DNA, 20 bp, Artificial
  CRISPR gRNA sequence
actcaagccaacccaagaaa

SEQ ID NO: 433415 - DNA, 20 bp, Artificial
  CRISPR gRNA sequence
aaagggtctcccttaacctt

SEQ ID NO: 433416 - DNA, 20 bp, Artificial
  CRISPR gRNA sequence
agggtctcccttaacctttg

SEQ ID NO: 433417 - DNA, 20 bp, Artificial
  CRISPR gRNA sequence
tctcccttaacctttggagt

SEQ ID NO: 433418 - DNA, 20 bp, Artificial
  CRISPR gRNA sequence
ccttaacctttggagttagc

SEQ ID NO: 433419 - DNA, 20 bp, Artificial
  CRISPR gRNA sequence
cttaacctttggagttagca

SEQ ID NO: 433420 - DNA, 20 bp, Artificial
  CRISPR gRNA sequence
aaatgtgcccttctgtgttg

SEQ ID NO: 433421 - DNA, 20 bp, Artificial
  CRISPR gRNA sequence
aatgtgcccttctgtgttgt

SEQ ID NO: 433422 - DNA, 20 bp, Artificial
  CRISPR gRNA sequence
gtgcccttctgtgttgtggg

SEQ ID NO: 433423 - DNA, 20 bp, Artificial
  CRISPR gRNA sequence
gcccttctgtgttgtgggta

SEQ ID NO: 433424 - DNA, 20 bp, Artificial
  CRISPR gRNA sequence
cttctgtgttgtgggtagag

SEQ ID NO: 433425 - DNA, 20 bp, Artificial
  CRISPR gRNA sequence
ttctgtgttgtgggtagaga

SEQ ID NO: 433426 - DNA, 20 bp, Artificial
  CRISPR gRNA sequence
ctgtgttgtgggtagagaag

SEQ ID NO: 433427 - DNA, 20 bp, Artificial
  CRISPR gRNA sequence
cttaaaaaaaaaaaaaaaaa

SEQ ID NO: 433428 - DNA, 20 bp, Artificial
  CRISPR gRNA sequence
taaaaaaaaaaaaaaaaaaa

SEQ ID NO: 433429 - DNA, 20 bp, Artificial
  CRISPR gRNA sequence
aaaaaaaaaaaaaaaaaaga

SEQ ID NO: 433430 - DNA, 20 bp, Artificial
  CRISPR gRNA sequence
aaaaaaaaaaaaaaagagag

SEQ ID NO: 433431 - DNA, 20 bp, Artificial
  CRISPR gRNA sequence
aaaaaaaaaaaaaagagaga

SEQ ID NO: 433432 - DNA, 20 bp, Artificial
  CRISPR gRNA sequence
aaaaaaaaaaaagagagaag

SEQ ID NO: 433433 - DNA, 20 bp, Artificial
  CRISPR gRNA sequence
aaaagagagaaggagctctt

SEQ ID NO: 433434 - DNA, 20 bp, Artificial
  CRISPR gRNA sequence
ttccctgcccctgcaaaaat

SEQ ID NO: 433435 - DNA, 20 bp, Artificial
  CRISPR gRNA sequence
gcccctgcaaaaattggctt

SEQ ID NO: 433436 - DNA, 20 bp, Artificial
  CRISPR gRNA sequence
ccctgcaaaaattggcttta

SEQ ID NO: 433437 - DNA, 20 bp, Artificial
  CRISPR gRNA sequence
tgcaaaaattggctttagag

SEQ ID NO: 433438 - DNA, 20 bp, Artificial
  CRISPR gRNA sequence
caaaaattggctttagagtg

SEQ ID NO: 433439 - DNA, 20 bp, Artificial
  CRISPR gRNA sequence
gctttagagtggagtcttgt

SEQ ID NO: 433440 - DNA, 20 bp, Artificial
  CRISPR gRNA sequence
gagtggagtcttgttggttc

SEQ ID NO: 433441 - DNA, 20 bp, Artificial
  CRISPR gRNA sequence
ttgttggttcaagatcccct

SEQ ID NO: 433442 - DNA, 20 bp, Artificial
  CRISPR gRNA sequence
caagatcccctaagattccc

SEQ ID NO: 433443 - DNA, 20 bp, Artificial
  CRISPR gRNA sequence
agatcccctaagattcccca

SEQ ID NO: 433444 - DNA, 20 bp, Artificial
  CRISPR gRNA sequence
atcccctaagattccccaga

SEQ ID NO: 433445 - DNA, 20 bp, Artificial
  CRISPR gRNA sequence
taagattccccagagagttt

SEQ ID NO: 433446 - DNA, 20 bp, Artificial
  CRISPR gRNA sequence
agattccccagagagtttta

SEQ ID NO: 433447 - DNA, 20 bp, Artificial
  CRISPR gRNA sequence
ttccccagagagttttagag

SEQ ID NO: 433448 - DNA, 20 bp, Artificial
  CRISPR gRNA sequence
gttttagagtagtttacatt

SEQ ID NO: 433449 - DNA, 20 bp, Artificial
  CRISPR gRNA sequence
aaacgtctatttttcacaaa

SEQ ID NO: 433450 - DNA, 20 bp, Artificial
  CRISPR gRNA sequence
gtctatttttcacaaaaaga

SEQ ID NO: 433451 - DNA, 20 bp, Artificial
  CRISPR gRNA sequence
acaaaaagacagtgattcaa

SEQ ID NO: 433452 - DNA, 20 bp, Artificial
  CRISPR gRNA sequence
aagacagtgattcaatagcc

SEQ ID NO: 433453 - DNA, 20 bp, Artificial
  CRISPR gRNA sequence
attcaatagccaagacttta

SEQ ID NO: 433454 - DNA, 20 bp, Artificial
  CRISPR gRNA sequence
aatagccaagactttacagc

SEQ ID NO: 433455 - DNA, 20 bp, Artificial
  CRISPR gRNA sequence
gccaagactttacagccaga

SEQ ID NO: 433456 - DNA, 20 bp, Artificial
  CRISPR gRNA sequence
actttacagccagacggtcg

SEQ ID NO: 433457 - DNA, 20 bp, Artificial
  CRISPR gRNA sequence
acggtcgtggattcaaatcc

SEQ ID NO: 433458 - DNA, 20 bp, Artificial
  CRISPR gRNA sequence
tggattcaaatcccagctct

SEQ ID NO: 433459 - DNA, 20 bp, Artificial
  CRISPR gRNA sequence
ggattcaaatcccagctctg

SEQ ID NO: 433460 - DNA, 20 bp, Artificial
  CRISPR gRNA sequence
tcaaatcccagctctgaggc

SEQ ID NO: 433461 - DNA, 20 bp, Artificial
  CRISPR gRNA sequence
caaatcccagctctgaggcc

SEQ ID NO: 433462 - DNA, 20 bp, Artificial
  CRISPR gRNA sequence
cccagctctgaggccgggcg

SEQ ID NO: 433463 - DNA, 20 bp, Artificial
  CRISPR gRNA sequence
agctctgaggccgggcgcgg

SEQ ID NO: 433464 - DNA, 20 bp, Artificial
  CRISPR gRNA sequence
gtggctaatgcctgtaatcc

SEQ ID NO: 433465 - DNA, 20 bp, Artificial
  CRISPR gRNA sequence
tgcctgtaatcccagcactt

SEQ ID NO: 433466 - DNA, 20 bp, Artificial
  CRISPR gRNA sequence
gcctgtaatcccagcacttt

SEQ ID NO: 433467 - DNA, 20 bp, Artificial
  CRISPR gRNA sequence
ctgtaatcccagcactttgg

SEQ ID NO: 433468 - DNA, 20 bp, Artificial
  CRISPR gRNA sequence
tgtaatcccagcactttggg

SEQ ID NO: 433469 - DNA, 20 bp, Artificial
  CRISPR gRNA sequence
tcccagcactttgggaggcc

SEQ ID NO: 433470 - DNA, 20 bp, Artificial
  CRISPR gRNA sequence
cccagcactttgggaggcct

SEQ ID NO: 433471 - DNA, 20 bp, Artificial
  CRISPR gRNA sequence
agcactttgggaggcctagg

SEQ ID NO: 433472 - DNA, 20 bp, Artificial
  CRISPR gRNA sequence
gcactttgggaggcctaggc

SEQ ID NO: 433473 - DNA, 20 bp, Artificial
  CRISPR gRNA sequence
ctttgggaggcctaggcagg

SEQ ID NO: 433474 - DNA, 20 bp, Artificial
  CRISPR gRNA sequence
gcaggcggatcacctgacat

SEQ ID NO: 433475 - DNA, 20 bp, Artificial
  CRISPR gRNA sequence
caggcggatcacctgacatc

SEQ ID NO: 433476 - DNA, 20 bp, Artificial
  CRISPR gRNA sequence
ggcggatcacctgacatcag

SEQ ID NO: 433477 - DNA, 20 bp, Artificial
  CRISPR gRNA sequence
tcacctgacatcaggagttt

SEQ ID NO: 433478 - DNA, 20 bp, Artificial
  CRISPR gRNA sequence
tgacatcaggagtttgagac

SEQ ID NO: 433479 - DNA, 20 bp, Artificial
  CRISPR gRNA sequence
tcaggagtttgagaccagcc

SEQ ID NO: 433480 - DNA, 20 bp, Artificial
  CRISPR gRNA sequence
tgagaccagcctggacaaca

SEQ ID NO: 433481 - DNA, 20 bp, Artificial
  CRISPR gRNA sequence
tctactaaaaatacaaaact

SEQ ID NO: 433482 - DNA, 20 bp, Artificial
  CRISPR gRNA sequence
ctaaaaatacaaaacttagc

SEQ ID NO: 433483 - DNA, 20 bp, Artificial
  CRISPR gRNA sequence
taaaaatacaaaacttagcc

SEQ ID NO: 433484 - DNA, 20 bp, Artificial
  CRISPR gRNA sequence
atacaaaacttagccaggcg

SEQ ID NO: 433485 - DNA, 20 bp, Artificial
  CRISPR gRNA sequence
gtaacacatgcctgtaatcc

SEQ ID NO: 433486 - DNA, 20 bp, Artificial
  CRISPR gRNA sequence
cacatgcctgtaatcctagc

SEQ ID NO: 433487 - DNA, 20 bp, Artificial
  CRISPR gRNA sequence
atgcctgtaatcctagctag

SEQ ID NO: 433488 - DNA, 20 bp, Artificial
  CRISPR gRNA sequence
tgcctgtaatcctagctagt

SEQ ID NO: 433489 - DNA, 20 bp, Artificial
  CRISPR gRNA sequence
gcctgtaatcctagctagtg

SEQ ID NO: 433490 - DNA, 20 bp, Artificial
  CRISPR gRNA sequence
ctgtaatcctagctagtggg

SEQ ID NO: 433491 - DNA, 20 bp, Artificial
  CRISPR gRNA sequence
tgtaatcctagctagtgggg

SEQ ID NO: 433492 - DNA, 20 bp, Artificial
  CRISPR gRNA sequence
tcctagctagtggggaggct

SEQ ID NO: 433493 - DNA, 20 bp, Artificial
  CRISPR gRNA sequence
cctagctagtggggaggctg

SEQ ID NO: 433494 - DNA, 20 bp, Artificial
  CRISPR gRNA sequence
agctagtggggaggctgagg

SEQ ID NO: 433495 - DNA, 20 bp, Artificial
  CRISPR gRNA sequence
gctagtggggaggctgaggc

SEQ ID NO: 433496 - DNA, 20 bp, Artificial
  CRISPR gRNA sequence
tagtggggaggctgaggcag

SEQ ID NO: 433497 - DNA, 20 bp, Artificial
  CRISPR gRNA sequence
gcaggagaatcacttaaacc

SEQ ID NO: 433498 - DNA, 20 bp, Artificial
  CRISPR gRNA sequence
caggagaatcacttaaaccc

SEQ ID NO: 433499 - DNA, 20 bp, Artificial
  CRISPR gRNA sequence
ggagaatcacttaaacccag

SEQ ID NO: 433500 - DNA, 20 bp, Artificial
  CRISPR gRNA sequence
gagaatcacttaaacccagg

SEQ ID NO: 433501 - DNA, 20 bp, Artificial
  CRISPR gRNA sequence
tcacttaaacccaggaggca

SEQ ID NO: 433502 - DNA, 20 bp, Artificial
  CRISPR gRNA sequence
taaacccaggaggcaaagac

SEQ ID NO: 433503 - DNA, 20 bp, Artificial
  CRISPR gRNA sequence
aacccaggaggcaaagactg

SEQ ID NO: 433504 - DNA, 20 bp, Artificial
  CRISPR gRNA sequence
aggcaaagactggagtactc

SEQ ID NO: 433505 - DNA, 20 bp, Artificial
  CRISPR gRNA sequence
aagactggagtactcgagtt

SEQ ID NO: 433506 - DNA, 20 bp, Artificial
  CRISPR gRNA sequence
catgccactgcacgccaacc

SEQ ID NO: 433507 - DNA, 20 bp, Artificial
  CRISPR gRNA sequence
atgccactgcacgccaacct

SEQ ID NO: 433508 - DNA, 20 bp, Artificial
  CRISPR gRNA sequence
ctgcacgccaacctgggcaa

SEQ ID NO: 433509 - DNA, 20 bp, Artificial
  CRISPR gRNA sequence
gcacgccaacctgggcaaca

SEQ ID NO: 433510 - DNA, 20 bp, Artificial
  CRISPR gRNA sequence
gccaacctgggcaacagagc

SEQ ID NO: 433511 - DNA, 20 bp, Artificial
  CRISPR gRNA sequence
aaaaaaaaaaaaaaaattcc

SEQ ID NO: 433512 - DNA, 20 bp, Artificial
  CRISPR gRNA sequence
aaattcccagctctgccact

SEQ ID NO: 433513 - DNA, 20 bp, Artificial
  CRISPR gRNA sequence
aattcccagctctgccacta

SEQ ID NO: 433514 - DNA, 20 bp, Artificial
  CRISPR gRNA sequence
attcccagctctgccactaa

SEQ ID NO: 433515 - DNA, 20 bp, Artificial
  CRISPR gRNA sequence
cagctctgccactaagggct

SEQ ID NO: 433516 - DNA, 20 bp, Artificial
  CRISPR gRNA sequence
ctaagggctgagtaatcctg

SEQ ID NO: 433517 - DNA, 20 bp, Artificial
  CRISPR gRNA sequence
aagggctgagtaatcctgta

SEQ ID NO: 433518 - DNA, 20 bp, Artificial
  CRISPR gRNA sequence
gagtaatcctgtagagttat

SEQ ID NO: 433519 - DNA, 20 bp, Artificial
  CRISPR gRNA sequence
agtaatcctgtagagttatc

SEQ ID NO: 433520 - DNA, 20 bp, Artificial
  CRISPR gRNA sequence
gtagagttatcaggaaaact

SEQ ID NO: 433521 - DNA, 20 bp, Artificial
  CRISPR gRNA sequence
agttatcaggaaaactaagt

SEQ ID NO: 433522 - DNA, 20 bp, Artificial
  CRISPR gRNA sequence
ttatcaggaaaactaagtga

SEQ ID NO: 433523 - DNA, 20 bp, Artificial
  CRISPR gRNA sequence
gagagaaaatataaaatgct

SEQ ID NO: 433524 - DNA, 20 bp, Artificial
  CRISPR gRNA sequence
aaaatataaaatgcttagta

SEQ ID NO: 433525 - DNA, 20 bp, Artificial
  CRISPR gRNA sequence
aaatataaaatgcttagtac

SEQ ID NO: 433526 - DNA, 20 bp, Artificial
  CRISPR gRNA sequence
aatataaaatgcttagtaca

SEQ ID NO: 433527 - DNA, 20 bp, Artificial
  CRISPR gRNA sequence
aaaatgcttagtacagggcc

SEQ ID NO: 433528 - DNA, 20 bp, Artificial
  CRISPR gRNA sequence
aataaatgttcaatcaatcg

SEQ ID NO: 433529 - DNA, 20 bp, Artificial
  CRISPR gRNA sequence
agctattattgctattgctc

SEQ ID NO: 433530 - DNA, 20 bp, Artificial
  CRISPR gRNA sequence
aacttgattttctgataact

SEQ ID NO: 433531 - DNA, 20 bp, Artificial
  CRISPR gRNA sequence
cttgattttctgataactga

SEQ ID NO: 433532 - DNA, 20 bp, Artificial
  CRISPR gRNA sequence
aaatcctgtttctaaaattt

SEQ ID NO: 433533 - DNA, 20 bp, Artificial
  CRISPR gRNA sequence
gtttctaaaatttcagtcta

SEQ ID NO: 433534 - DNA, 20 bp, Artificial
  CRISPR gRNA sequence
tttctaaaatttcagtctat

SEQ ID NO: 433535 - DNA, 20 bp, Artificial
  CRISPR gRNA sequence
ctctctttaaaaacaatgat

SEQ ID NO: 433536 - DNA, 20 bp, Artificial
  CRISPR gRNA sequence
tctctttaaaaacaatgatt

SEQ ID NO: 433537 - DNA, 20 bp, Artificial
  CRISPR gRNA sequence
tttaaaaacaatgattaggc

SEQ ID NO: 433538 - DNA, 20 bp, Artificial
  CRISPR gRNA sequence
ttaaaaacaatgattaggcc

SEQ ID NO: 433539 - DNA, 20 bp, Artificial
  CRISPR gRNA sequence
aacaatgattaggccaggtg

SEQ ID NO: 433540 - DNA, 20 bp, Artificial
  CRISPR gRNA sequence
aatgattaggccaggtgcgg

SEQ ID NO: 433541 - DNA, 20 bp, Artificial
  CRISPR gRNA sequence
ggtgcggtggctcacgcctg

SEQ ID NO: 433542 - DNA, 20 bp, Artificial
  CRISPR gRNA sequence
gtggctcacgcctgtagtcc

SEQ ID NO: 433543 - DNA, 20 bp, Artificial
  CRISPR gRNA sequence
cgcctgtagtcccagcactt

SEQ ID NO: 433544 - DNA, 20 bp, Artificial
  CRISPR gRNA sequence
gcctgtagtcccagcacttt

SEQ ID NO: 433545 - DNA, 20 bp, Artificial
  CRISPR gRNA sequence
ctgtagtcccagcactttgg

SEQ ID NO: 433546 - DNA, 20 bp, Artificial
  CRISPR gRNA sequence
tgtagtcccagcactttggg

SEQ ID NO: 433547 - DNA, 20 bp, Artificial
  CRISPR gRNA sequence
tcccagcactttgggaggcc

SEQ ID NO: 433548 - DNA, 20 bp, Artificial
  CRISPR gRNA sequence
cccagcactttgggaggcca

SEQ ID NO: 433549 - DNA, 20 bp, Artificial
  CRISPR gRNA sequence
agcactttgggaggccaagg

SEQ ID NO: 433550 - DNA, 20 bp, Artificial
  CRISPR gRNA sequence
gcactttgggaggccaaggc

SEQ ID NO: 433551 - DNA, 20 bp, Artificial
  CRISPR gRNA sequence
ctttgggaggccaaggcagg

SEQ ID NO: 433552 - DNA, 20 bp, Artificial
  CRISPR gRNA sequence
ggccaaggcaggcagatcac

SEQ ID NO: 433553 - DNA, 20 bp, Artificial
  CRISPR gRNA sequence
gccaaggcaggcagatcacg

SEQ ID NO: 433554 - DNA, 20 bp, Artificial
  CRISPR gRNA sequence
aggcaggcagatcacgaggt

SEQ ID NO: 433555 - DNA, 20 bp, Artificial
  CRISPR gRNA sequence
ggcaggcagatcacgaggtc

SEQ ID NO: 433556 - DNA, 20 bp, Artificial
  CRISPR gRNA sequence
caggcagatcacgaggtcag

SEQ ID NO: 433557 - DNA, 20 bp, Artificial
  CRISPR gRNA sequence
gatcacgaggtcaggagttc

SEQ ID NO: 433558 - DNA, 20 bp, Artificial
  CRISPR gRNA sequence
cgaggtcaggagttcaagac

SEQ ID NO: 433559 - DNA, 20 bp, Artificial
  CRISPR gRNA sequence
tcaggagttcaagaccagcc

SEQ ID NO: 433560 - DNA, 20 bp, Artificial
  CRISPR gRNA sequence
caagaccagcctggccaaca

SEQ ID NO: 433561 - DNA, 20 bp, Artificial
  CRISPR gRNA sequence
tctactaaaaatacaaaaat

SEQ ID NO: 433562 - DNA, 20 bp, Artificial
  CRISPR gRNA sequence
ctaaaaatacaaaaattagc

SEQ ID NO: 433563 - DNA, 20 bp, Artificial
  CRISPR gRNA sequence
taaaaatacaaaaattagcc

SEQ ID NO: 433564 - DNA, 20 bp, Artificial
  CRISPR gRNA sequence
atacaaaaattagccaggtg

SEQ ID NO: 433565 - DNA, 20 bp, Artificial
  CRISPR gRNA sequence
caaaaattagccaggtgtgg

SEQ ID NO: 433566 - DNA, 20 bp, Artificial
  CRISPR gRNA sequence
aaattagccaggtgtggtgg

SEQ ID NO: 433567 - DNA, 20 bp, Artificial
  CRISPR gRNA sequence
aattagccaggtgtggtggc

SEQ ID NO: 433568 - DNA, 20 bp, Artificial
  CRISPR gRNA sequence
ggtgtggtggcgggcaccta

SEQ ID NO: 433569 - DNA, 20 bp, Artificial
  CRISPR gRNA sequence
gtggcgggcacctatagtcc

SEQ ID NO: 433570 - DNA, 20 bp, Artificial
  CRISPR gRNA sequence
cacctatagtcccagctatt

SEQ ID NO: 433571 - DNA, 20 bp, Artificial
  CRISPR gRNA sequence
acctatagtcccagctattt

SEQ ID NO: 433572 - DNA, 20 bp, Artificial
  CRISPR gRNA sequence
ctatagtcccagctatttgg

SEQ ID NO: 433573 - DNA, 20 bp, Artificial
  CRISPR gRNA sequence
tatagtcccagctatttggg

SEQ ID NO: 433574 - DNA, 20 bp, Artificial
  CRISPR gRNA sequence
tcccagctatttgggaggct

SEQ ID NO: 433575 - DNA, 20 bp, Artificial
  CRISPR gRNA sequence
cccagctatttgggaggctg

SEQ ID NO: 433576 - DNA, 20 bp, Artificial
  CRISPR gRNA sequence
agctatttgggaggctgagg

SEQ ID NO: 433577 - DNA, 20 bp, Artificial
  CRISPR gRNA sequence
gctatttgggaggctgaggc

SEQ ID NO: 433578 - DNA, 20 bp, Artificial
  CRISPR gRNA sequence
gcaggacaatcgcttgaacc

SEQ ID NO: 433579 - DNA, 20 bp, Artificial
  CRISPR gRNA sequence
caggacaatcgcttgaaccc

SEQ ID NO: 433580 - DNA, 20 bp, Artificial
  CRISPR gRNA sequence
ggacaatcgcttgaacccag

SEQ ID NO: 433581 - DNA, 20 bp, Artificial
  CRISPR gRNA sequence
gacaatcgcttgaacccagg

SEQ ID NO: 433582 - DNA, 20 bp, Artificial
  CRISPR gRNA sequence
aatcgcttgaacccaggagg

SEQ ID NO: 433583 - DNA, 20 bp, Artificial
  CRISPR gRNA sequence
tcgcttgaacccaggaggca

SEQ ID NO: 433584 - DNA, 20 bp, Artificial
  CRISPR gRNA sequence
cgcttgaacccaggaggcag

SEQ ID NO: 433585 - DNA, 20 bp, Artificial
  CRISPR gRNA sequence
aacccaggaggcagaggttg

SEQ ID NO: 433586 - DNA, 20 bp, Artificial
  CRISPR gRNA sequence
caggaggcagaggttgcagt

SEQ ID NO: 433587 - DNA, 20 bp, Artificial
  CRISPR gRNA sequence
ggcagaggttgcagtgagcc

SEQ ID NO: 433588 - DNA, 20 bp, Artificial
  CRISPR gRNA sequence
gcagaggttgcagtgagcca

SEQ ID NO: 433589 - DNA, 20 bp, Artificial
  CRISPR gRNA sequence
aaggttgtgccattgtactc

SEQ ID NO: 433590 - DNA, 20 bp, Artificial
  CRISPR gRNA sequence
tgtgccattgtactccagcc

SEQ ID NO: 433591 - DNA, 20 bp, Artificial
  CRISPR gRNA sequence
gtgccattgtactccagcct

SEQ ID NO: 433592 - DNA, 20 bp, Artificial
  CRISPR gRNA sequence
tgtactccagcctgggcgac

SEQ ID NO: 433593 - DNA, 20 bp, Artificial
  CRISPR gRNA sequence
tactccagcctgggcgacaa

SEQ ID NO: 433594 - DNA, 20 bp, Artificial
  CRISPR gRNA sequence
taataaataaataataatta

SEQ ID NO: 433595 - DNA, 20 bp, Artificial
  CRISPR gRNA sequence
aataaataaataataattat

SEQ ID NO: 433596 - DNA, 20 bp, Artificial
  CRISPR gRNA sequence
aataaataataattataggc

SEQ ID NO: 433597 - DNA, 20 bp, Artificial
  CRISPR gRNA sequence
ataaataataattataggcc

SEQ ID NO: 433598 - DNA, 20 bp, Artificial
  CRISPR gRNA sequence
caggctcacacctataatcc

SEQ ID NO: 433599 - DNA, 20 bp, Artificial
  CRISPR gRNA sequence
cacctataatcccagcactt

SEQ ID NO: 433600 - DNA, 20 bp, Artificial
  CRISPR gRNA sequence
acctataatcccagcacttt

SEQ ID NO: 433601 - DNA, 20 bp, Artificial
  CRISPR gRNA sequence
tataatcccagcactttggg

SEQ ID NO: 433602 - DNA, 20 bp, Artificial
  CRISPR gRNA sequence
tcccagcactttgggaagct

SEQ ID NO: 433603 - DNA, 20 bp, Artificial
  CRISPR gRNA sequence
agcactttgggaagctgaga

SEQ ID NO: 433604 - DNA, 20 bp, Artificial
  CRISPR gRNA sequence
gcactttgggaagctgagat

SEQ ID NO: 433605 - DNA, 20 bp, Artificial
  CRISPR gRNA sequence
actttgggaagctgagatgg

SEQ ID NO: 433606 - DNA, 20 bp, Artificial
  CRISPR gRNA sequence
ctttgggaagctgagatggg

SEQ ID NO: 433607 - DNA, 20 bp, Artificial
  CRISPR gRNA sequence
ctgagatgggaggatcactt

SEQ ID NO: 433608 - DNA, 20 bp, Artificial
  CRISPR gRNA sequence
atgggaggatcacttgagac

SEQ ID NO: 433609 - DNA, 20 bp, Artificial
  CRISPR gRNA sequence
tgggaggatcacttgagacc

SEQ ID NO: 433610 - DNA, 20 bp, Artificial
  CRISPR gRNA sequence
ggaggatcacttgagaccag

SEQ ID NO: 433611 - DNA, 20 bp, Artificial
  CRISPR gRNA sequence
gatcacttgagaccaggagt

SEQ ID NO: 433612 - DNA, 20 bp, Artificial
  CRISPR gRNA sequence
atcacttgagaccaggagtt

SEQ ID NO: 433613 - DNA, 20 bp, Artificial
  CRISPR gRNA sequence
tcacttgagaccaggagtta

SEQ ID NO: 433614 - DNA, 20 bp, Artificial
  CRISPR gRNA sequence
tgagaccaggagttagggac

SEQ ID NO: 433615 - DNA, 20 bp, Artificial
  CRISPR gRNA sequence
gggaccagcctaataatatt

SEQ ID NO: 433616 - DNA, 20 bp, Artificial
  CRISPR gRNA sequence
acacacacacatataattat

SEQ ID NO: 433617 - DNA, 20 bp, Artificial
  CRISPR gRNA sequence
atttttaaaacaatgaattt

SEQ ID NO: 433618 - DNA, 20 bp, Artificial
  CRISPR gRNA sequence
tttttaaaacaatgaattta

SEQ ID NO: 433619 - DNA, 20 bp, Artificial
  CRISPR gRNA sequence
ttaaaacaatgaatttaagg

SEQ ID NO: 433620 - DNA, 20 bp, Artificial
  CRISPR gRNA sequence
acacattactcctgcaataa

SEQ ID NO: 433621 - DNA, 20 bp, Artificial
  CRISPR gRNA sequence
cacattactcctgcaataac

SEQ ID NO: 433622 - DNA, 20 bp, Artificial
  CRISPR gRNA sequence
cattactcctgcaataacag

SEQ ID NO: 433623 - DNA, 20 bp, Artificial
  CRISPR gRNA sequence
ataacaggagtcctatatgc

SEQ ID NO: 433624 - DNA, 20 bp, Artificial
  CRISPR gRNA sequence
tatgcaagatattgtgcatt

SEQ ID NO: 433625 - DNA, 20 bp, Artificial
  CRISPR gRNA sequence
atattgtgcattaagcattg

SEQ ID NO: 433626 - DNA, 20 bp, Artificial
  CRISPR gRNA sequence
tattgtgcattaagcattgt

SEQ ID NO: 433627 - DNA, 20 bp, Artificial
  CRISPR gRNA sequence
ttaagcattgtgggcacata

SEQ ID NO: 433628 - DNA, 20 bp, Artificial
  CRISPR gRNA sequence
taagcattgtgggcacatac

SEQ ID NO: 433629 - DNA, 20 bp, Artificial
  CRISPR gRNA sequence
ggcacatacaggtccttaaa

SEQ ID NO: 433630 - DNA, 20 bp, Artificial
  CRISPR gRNA sequence
aaaagcactgtttgattgca

SEQ ID NO: 433631 - DNA, 20 bp, Artificial
  CRISPR gRNA sequence
aagcactgtttgattgcaaa

SEQ ID NO: 433632 - DNA, 20 bp, Artificial
  CRISPR gRNA sequence
gcactgtttgattgcaaaga

SEQ ID NO: 433633 - DNA, 20 bp, Artificial
  CRISPR gRNA sequence
ctgtttgattgcaaagagag

SEQ ID NO: 433634 - DNA, 20 bp, Artificial
  CRISPR gRNA sequence
tgtttgattgcaaagagaga

SEQ ID NO: 433635 - DNA, 20 bp, Artificial
  CRISPR gRNA sequence
tttgattgcaaagagagaag

SEQ ID NO: 433636 - DNA, 20 bp, Artificial
  CRISPR gRNA sequence
aagagagaaggagcaaatac

SEQ ID NO: 433637 - DNA, 20 bp, Artificial
  CRISPR gRNA sequence
aggagcaaatacaagatgct

SEQ ID NO: 433638 - DNA, 20 bp, Artificial
  CRISPR gRNA sequence
aaatacaagatgctgagcat

SEQ ID NO: 433639 - DNA, 20 bp, Artificial
  CRISPR gRNA sequence
agcatcagttgtgaatacac

SEQ ID NO: 433640 - DNA, 20 bp, Artificial
  CRISPR gRNA sequence
tcagttgtgaatacacaagc

SEQ ID NO: 433641 - DNA, 20 bp, Artificial
  CRISPR gRNA sequence
gaatacacaagcaagaaact

SEQ ID NO: 433642 - DNA, 20 bp, Artificial
  CRISPR gRNA sequence
gaaactgagtcaaataaatg

SEQ ID NO: 433643 - DNA, 20 bp, Artificial
  CRISPR gRNA sequence
aaactgagtcaaataaatgt

SEQ ID NO: 433644 - DNA, 20 bp, Artificial
  CRISPR gRNA sequence
gtcaaataaatgtgggctcc

SEQ ID NO: 433645 - DNA, 20 bp, Artificial
  CRISPR gRNA sequence
gggctcctggatatgccctc

SEQ ID NO: 433646 - DNA, 20 bp, Artificial
  CRISPR gRNA sequence
tttttttttttttttttttt

SEQ ID NO: 433647 - DNA, 20 bp, Artificial
  CRISPR gRNA sequence
tttttttttttttttgagac

SEQ ID NO: 433648 - DNA, 20 bp, Artificial
  CRISPR gRNA sequence
ttttttttttttttgagaca

SEQ ID NO: 433649 - DNA, 20 bp, Artificial
  CRISPR gRNA sequence
caaggccttgccctgtcacc

SEQ ID NO: 433650 - DNA, 20 bp, Artificial
  CRISPR gRNA sequence
aaggccttgccctgtcacct

SEQ ID NO: 433651 - DNA, 20 bp, Artificial
  CRISPR gRNA sequence
ccttgccctgtcacctagga

SEQ ID NO: 433652 - DNA, 20 bp, Artificial
  CRISPR gRNA sequence
ttgccctgtcacctaggatg

SEQ ID NO: 433653 - DNA, 20 bp, Artificial
  CRISPR gRNA sequence
ctgtcacctaggatggagtg

SEQ ID NO: 433654 - DNA, 20 bp, Artificial
  CRISPR gRNA sequence
tgtcacctaggatggagtgc

SEQ ID NO: 433655 - DNA, 20 bp, Artificial
  CRISPR gRNA sequence
gtcacctaggatggagtgca

SEQ ID NO: 433656 - DNA, 20 bp, Artificial
  CRISPR gRNA sequence
tcacctaggatggagtgcag

SEQ ID NO: 433657 - DNA, 20 bp, Artificial
  CRISPR gRNA sequence
ggagtgcaggggcatgatca

SEQ ID NO: 433658 - DNA, 20 bp, Artificial
  CRISPR gRNA sequence
ggcatgatcacagctcaatg

SEQ ID NO: 433659 - DNA, 20 bp, Artificial
  CRISPR gRNA sequence
tcaatgcagcctcaacctac

SEQ ID NO: 433660 - DNA, 20 bp, Artificial
  CRISPR gRNA sequence
caatgcagcctcaacctact

SEQ ID NO: 433661 - DNA, 20 bp, Artificial
  CRISPR gRNA sequence
agcctcaacctactgggctc

SEQ ID NO: 433662 - DNA, 20 bp, Artificial
  CRISPR gRNA sequence
ctcaagtgatcctcctgcct

SEQ ID NO: 433663 - DNA, 20 bp, Artificial
  CRISPR gRNA sequence
tcctcctgcctcagcctccc

SEQ ID NO: 433664 - DNA, 20 bp, Artificial
  CRISPR gRNA sequence
tcctgcctcagcctcccaag

SEQ ID NO: 433665 - DNA, 20 bp, Artificial
  CRISPR gRNA sequence
gcctcagcctcccaagtagc

SEQ ID NO: 433666 - DNA, 20 bp, Artificial
  CRISPR gRNA sequence
ctcccaagtagctggaacta

SEQ ID NO: 433667 - DNA, 20 bp, Artificial
  CRISPR gRNA sequence
tcccaagtagctggaactac

SEQ ID NO: 433668 - DNA, 20 bp, Artificial
  CRISPR gRNA sequence
tagctggaactacaggtttg

SEQ ID NO: 433669 - DNA, 20 bp, Artificial
  CRISPR gRNA sequence
caggtttgcagcaccatgcc

SEQ ID NO: 433670 - DNA, 20 bp, Artificial
  CRISPR gRNA sequence
attttaaaaaatattttttg

SEQ ID NO: 433671 - DNA, 20 bp, Artificial
  CRISPR gRNA sequence
tttaaaaaatattttttgta

SEQ ID NO: 433672 - DNA, 20 bp, Artificial
  CRISPR gRNA sequence
aaaaatattttttgtagaga

SEQ ID NO: 433673 - DNA, 20 bp, Artificial
  CRISPR gRNA sequence
aaaatattttttgtagagac

SEQ ID NO: 433674 - DNA, 20 bp, Artificial
  CRISPR gRNA sequence
aaatattttttgtagagaca

SEQ ID NO: 433675 - DNA, 20 bp, Artificial
  CRISPR gRNA sequence
agagacagggtgtcactatg

SEQ ID NO: 433676 - DNA, 20 bp, Artificial
  CRISPR gRNA sequence
cagggtgtcactatgtggcc

SEQ ID NO: 433677 - DNA, 20 bp, Artificial
  CRISPR gRNA sequence
agggtgtcactatgtggccc

SEQ ID NO: 433678 - DNA, 20 bp, Artificial
  CRISPR gRNA sequence
tgtcactatgtggcccaggc

SEQ ID NO: 433679 - DNA, 20 bp, Artificial
  CRISPR gRNA sequence
ccaggctagtctcaaactcc

SEQ ID NO: 433680 - DNA, 20 bp, Artificial
  CRISPR gRNA sequence
agtctcaaactcctggtctc

SEQ ID NO: 433681 - DNA, 20 bp, Artificial
  CRISPR gRNA sequence
ctcaagcattccttccacct

SEQ ID NO: 433682 - DNA, 20 bp, Artificial
  CRISPR gRNA sequence
ccttccaccttggcctccta

SEQ ID NO: 433683 - DNA, 20 bp, Artificial
  CRISPR gRNA sequence
accttggcctcctaaagtgc

SEQ ID NO: 433684 - DNA, 20 bp, Artificial
  CRISPR gRNA sequence
ccttggcctcctaaagtgct

SEQ ID NO: 433685 - DNA, 20 bp, Artificial
  CRISPR gRNA sequence
ctcctaaagtgctgggatta

SEQ ID NO: 433686 - DNA, 20 bp, Artificial
  CRISPR gRNA sequence
tcctaaagtgctgggattac

SEQ ID NO: 433687 - DNA, 20 bp, Artificial
  CRISPR gRNA sequence
agtgctgggattacaggcat

SEQ ID NO: 433688 - DNA, 20 bp, Artificial
  CRISPR gRNA sequence
caggcatgagacactgtgcc

SEQ ID NO: 433689 - DNA, 20 bp, Artificial
  CRISPR gRNA sequence
cactgtgcccggcctcctca

SEQ ID NO: 433690 - DNA, 20 bp, Artificial
  CRISPR gRNA sequence
ggcctcctcaaagaattttt

SEQ ID NO: 433691 - DNA, 20 bp, Artificial
  CRISPR gRNA sequence
aatttttaagtcattgctgc

SEQ ID NO: 433692 - DNA, 20 bp, Artificial
  CRISPR gRNA sequence
attgctgcaagcttgccttc

SEQ ID NO: 433693 - DNA, 20 bp, Artificial
  CRISPR gRNA sequence
gctgcaagcttgccttctag

SEQ ID NO: 433694 - DNA, 20 bp, Artificial
  CRISPR gRNA sequence
tctagtggtttttcttttat

SEQ ID NO: 433695 - DNA, 20 bp, Artificial
  CRISPR gRNA sequence
ctagtggtttttcttttatg

SEQ ID NO: 433696 - DNA, 20 bp, Artificial
  CRISPR gRNA sequence
tagtggtttttcttttatga

SEQ ID NO: 433697 - DNA, 20 bp, Artificial
  CRISPR gRNA sequence
ggaatttcgctcttgttgcc

SEQ ID NO: 433698 - DNA, 20 bp, Artificial
  CRISPR gRNA sequence
gaatttcgctcttgttgccc

SEQ ID NO: 433699 - DNA, 20 bp, Artificial
  CRISPR gRNA sequence
ttcgctcttgttgcccaggc

SEQ ID NO: 433700 - DNA, 20 bp, Artificial
  CRISPR gRNA sequence
ttgttgcccaggctggtgtg

SEQ ID NO: 433701 - DNA, 20 bp, Artificial
  CRISPR gRNA sequence
ttgcccaggctggtgtgcag

SEQ ID NO: 433702 - DNA, 20 bp, Artificial
  CRISPR gRNA sequence
ggtgtgcagtggcgcgacct

SEQ ID NO: 433703 - DNA, 20 bp, Artificial
  CRISPR gRNA sequence
tcactgcaacctccacctcc

SEQ ID NO: 433704 - DNA, 20 bp, Artificial
  CRISPR gRNA sequence
aacctccacctcctggattc

SEQ ID NO: 433705 - DNA, 20 bp, Artificial
  CRISPR gRNA sequence
ttcaagcgattctcctgtct

SEQ ID NO: 433706 - DNA, 20 bp, Artificial
  CRISPR gRNA sequence
ttctcctgtctcagcctcct

SEQ ID NO: 433707 - DNA, 20 bp, Artificial
  CRISPR gRNA sequence
tcctgtctcagcctcctgag

SEQ ID NO: 433708 - DNA, 20 bp, Artificial
  CRISPR gRNA sequence
tctcagcctcctgagtagct

SEQ ID NO: 433709 - DNA, 20 bp, Artificial
  CRISPR gRNA sequence
cctgagtagctgagactaca

SEQ ID NO: 433710 - DNA, 20 bp, Artificial
  CRISPR gRNA sequence
ctgagtagctgagactacac

SEQ ID NO: 433711 - DNA, 20 bp, Artificial
  CRISPR gRNA sequence
caggcacacaccaccatacc

SEQ ID NO: 433712 - DNA, 20 bp, Artificial
  CRISPR gRNA sequence
tggctaattttttgtatttt

SEQ ID NO: 433713 - DNA, 20 bp, Artificial
  CRISPR gRNA sequence
ctaattttttgtatttttag

SEQ ID NO: 433714 - DNA, 20 bp, Artificial
  CRISPR gRNA sequence
aattttttgtatttttagta

SEQ ID NO: 433715 - DNA, 20 bp, Artificial
  CRISPR gRNA sequence
ttttgtatttttagtagaga

SEQ ID NO: 433716 - DNA, 20 bp, Artificial
  CRISPR gRNA sequence
tttgtatttttagtagagat

SEQ ID NO: 433717 - DNA, 20 bp, Artificial
  CRISPR gRNA sequence
ttgtatttttagtagagatg

SEQ ID NO: 433718 - DNA, 20 bp, Artificial
  CRISPR gRNA sequence
tggggtttcaccatgttgac

SEQ ID NO: 433719 - DNA, 20 bp, Artificial
  CRISPR gRNA sequence
ggggtttcaccatgttgacc

SEQ ID NO: 433720 - DNA, 20 bp, Artificial
  CRISPR gRNA sequence
tttcaccatgttgaccaggc

SEQ ID NO: 433721 - DNA, 20 bp, Artificial
  CRISPR gRNA sequence
ggctggtctcaaacccctga

SEQ ID NO: 433722 - DNA, 20 bp, Artificial
  CRISPR gRNA sequence
gctggtctcaaacccctgac

SEQ ID NO: 433723 - DNA, 20 bp, Artificial
  CRISPR gRNA sequence
gacaggtgatccaccctact

SEQ ID NO: 433724 - DNA, 20 bp, Artificial
  CRISPR gRNA sequence
ccaccctacttagcctccca

SEQ ID NO: 433725 - DNA, 20 bp, Artificial
  CRISPR gRNA sequence
tacttagcctcccaaagtgc

SEQ ID NO: 433726 - DNA, 20 bp, Artificial
  CRISPR gRNA sequence
acttagcctcccaaagtgct

SEQ ID NO: 433727 - DNA, 20 bp, Artificial
  CRISPR gRNA sequence
ctcccaaagtgctgggatta

SEQ ID NO: 433728 - DNA, 20 bp, Artificial
  CRISPR gRNA sequence
agtgctgggattacagacgt

SEQ ID NO: 433729 - DNA, 20 bp, Artificial
  CRISPR gRNA sequence
cagacgtgagtcactgcgcc

SEQ ID NO: 433730 - DNA, 20 bp, Artificial
  CRISPR gRNA sequence
cgtgagtcactgcgcccagc

SEQ ID NO: 433731 - DNA, 20 bp, Artificial
  CRISPR gRNA sequence
gccagtttttcttttattct

SEQ ID NO: 433732 - DNA, 20 bp, Artificial
  CRISPR gRNA sequence
agtttttcttttattctgag

SEQ ID NO: 433733 - DNA, 20 bp, Artificial
  CRISPR gRNA sequence
gtttttcttttattctgaga

SEQ ID NO: 433734 - DNA, 20 bp, Artificial
  CRISPR gRNA sequence
tttcttttattctgagaagg

SEQ ID NO: 433735 - DNA, 20 bp, Artificial
  CRISPR gRNA sequence
cttttattctgagaaggtag

SEQ ID NO: 433736 - DNA, 20 bp, Artificial
  CRISPR gRNA sequence
ttttattctgagaaggtagc

SEQ ID NO: 433737 - DNA, 20 bp, Artificial
  CRISPR gRNA sequence
tttattctgagaaggtagca

SEQ ID NO: 433738 - DNA, 20 bp, Artificial
  CRISPR gRNA sequence
ttctgagaaggtagcaggga

SEQ ID NO: 433739 - DNA, 20 bp, Artificial
  CRISPR gRNA sequence
gtagcagggacagtaaaatt

SEQ ID NO: 433740 - DNA, 20 bp, Artificial
  CRISPR gRNA sequence
tagcagggacagtaaaattg

SEQ ID NO: 433741 - DNA, 20 bp, Artificial
  CRISPR gRNA sequence
cagtaaaattgaggtttatt

SEQ ID NO: 433742 - DNA, 20 bp, Artificial
  CRISPR gRNA sequence
agtaaaattgaggtttatta

SEQ ID NO: 433743 - DNA, 20 bp, Artificial
  CRISPR gRNA sequence
aattgaggtttattaaggta

SEQ ID NO: 433744 - DNA, 20 bp, Artificial
  CRISPR gRNA sequence
ttaaggtatggctttattta

SEQ ID NO: 433745 - DNA, 20 bp, Artificial
  CRISPR gRNA sequence
tatagttaaatacataaaac

SEQ ID NO: 433746 - DNA, 20 bp, Artificial
  CRISPR gRNA sequence
gttaaatacataaaactggc

SEQ ID NO: 433747 - DNA, 20 bp, Artificial
  CRISPR gRNA sequence
ttaaatacataaaactggct

SEQ ID NO: 433748 - DNA, 20 bp, Artificial
  CRISPR gRNA sequence
ataaaactggctgggcacca

SEQ ID NO: 433749 - DNA, 20 bp, Artificial
  CRISPR gRNA sequence
atggctcatgcctgtaatcc

SEQ ID NO: 433750 - DNA, 20 bp, Artificial
  CRISPR gRNA sequence
tgcctgtaatcccagcactt

SEQ ID NO: 433751 - DNA, 20 bp, Artificial
  CRISPR gRNA sequence
gcctgtaatcccagcacttt

SEQ ID NO: 433752 - DNA, 20 bp, Artificial
  CRISPR gRNA sequence
ctgtaatcccagcactttgg

SEQ ID NO: 433753 - DNA, 20 bp, Artificial
  CRISPR gRNA sequence
tgtaatcccagcactttggg

SEQ ID NO: 433754 - DNA, 20 bp, Artificial
  CRISPR gRNA sequence
tcccagcactttgggaggcc

SEQ ID NO: 433755 - DNA, 20 bp, Artificial
  CRISPR gRNA sequence
agcactttgggaggccaagt

SEQ ID NO: 433756 - DNA, 20 bp, Artificial
  CRISPR gRNA sequence
gcactttgggaggccaagtt

SEQ ID NO: 433757 - DNA, 20 bp, Artificial
  CRISPR gRNA sequence
ctttgggaggccaagttggg

SEQ ID NO: 433758 - DNA, 20 bp, Artificial
  CRISPR gRNA sequence
ccaagttgggcggatcacct

SEQ ID NO: 433759 - DNA, 20 bp, Artificial
  CRISPR gRNA sequence
caagttgggcggatcacctg

SEQ ID NO: 433760 - DNA, 20 bp, Artificial
  CRISPR gRNA sequence
ttgggcggatcacctgaggt

SEQ ID NO: 433761 - DNA, 20 bp, Artificial
  CRISPR gRNA sequence
tgggcggatcacctgaggtc

SEQ ID NO: 433762 - DNA, 20 bp, Artificial
  CRISPR gRNA sequence
ggcggatcacctgaggtcag

SEQ ID NO: 433763 - DNA, 20 bp, Artificial
  CRISPR gRNA sequence
tcacctgaggtcaggagttc

SEQ ID NO: 433764 - DNA, 20 bp, Artificial
  CRISPR gRNA sequence
tgaggtcaggagttcaagac

SEQ ID NO: 433765 - DNA, 20 bp, Artificial
  CRISPR gRNA sequence
caagaccagcctgaccaaca

SEQ ID NO: 433766 - DNA, 20 bp, Artificial
  CRISPR gRNA sequence
agaccagcctgaccaacatg

SEQ ID NO: 433767 - DNA, 20 bp, Artificial
  CRISPR gRNA sequence
ctctactaaaaatacaaaat

SEQ ID NO: 433768 - DNA, 20 bp, Artificial
  CRISPR gRNA sequence
tctactaaaaatacaaaatt

SEQ ID NO: 433769 - DNA, 20 bp, Artificial
  CRISPR gRNA sequence
ctaaaaatacaaaattaggc

SEQ ID NO: 433770 - DNA, 20 bp, Artificial
  CRISPR gRNA sequence
taaaaatacaaaattaggcc

SEQ ID NO: 433771 - DNA, 20 bp, Artificial
  CRISPR gRNA sequence
caaaattaggccaggtgcca

SEQ ID NO: 433772 - DNA, 20 bp, Artificial
  CRISPR gRNA sequence
atggctcacgcctgcaatct

SEQ ID NO: 433773 - DNA, 20 bp, Artificial
  CRISPR gRNA sequence
cgcctgcaatctcagcactt

SEQ ID NO: 433774 - DNA, 20 bp, Artificial
  CRISPR gRNA sequence
gcctgcaatctcagcacttt

SEQ ID NO: 433775 - DNA, 20 bp, Artificial
  CRISPR gRNA sequence
ctgcaatctcagcactttgg

SEQ ID NO: 433776 - DNA, 20 bp, Artificial
  CRISPR gRNA sequence
tgcaatctcagcactttggg

SEQ ID NO: 433777 - DNA, 20 bp, Artificial
  CRISPR gRNA sequence
tctcagcactttgggaggcc

SEQ ID NO: 433778 - DNA, 20 bp, Artificial
  CRISPR gRNA sequence
ctcagcactttgggaggccg

SEQ ID NO: 433779 - DNA, 20 bp, Artificial
  CRISPR gRNA sequence
agcactttgggaggccgagg

SEQ ID NO: 433780 - DNA, 20 bp, Artificial
  CRISPR gRNA sequence
gcactttgggaggccgaggc

SEQ ID NO: 433781 - DNA, 20 bp, Artificial
  CRISPR gRNA sequence
ctttgggaggccgaggcagg

SEQ ID NO: 433782 - DNA, 20 bp, Artificial
  CRISPR gRNA sequence
ccgaggcaggtggatcacct

SEQ ID NO: 433783 - DNA, 20 bp, Artificial
  CRISPR gRNA sequence
cgaggcaggtggatcacctg

SEQ ID NO: 433784 - DNA, 20 bp, Artificial
  CRISPR gRNA sequence
gcaggtggatcacctgaggt

SEQ ID NO: 433785 - DNA, 20 bp, Artificial
  CRISPR gRNA sequence
caggtggatcacctgaggtc

SEQ ID NO: 433786 - DNA, 20 bp, Artificial
  CRISPR gRNA sequence
ggtggatcacctgaggtcag

SEQ ID NO: 433787 - DNA, 20 bp, Artificial
  CRISPR gRNA sequence
tcacctgaggtcaggagttc

SEQ ID NO: 433788 - DNA, 20 bp, Artificial
  CRISPR gRNA sequence
tgaggtcaggagttcaagat

SEQ ID NO: 433789 - DNA, 20 bp, Artificial
  CRISPR gRNA sequence
tcaggagttcaagatcagcc

SEQ ID NO: 433790 - DNA, 20 bp, Artificial
  CRISPR gRNA sequence
caagatcagcctggccaatg

SEQ ID NO: 433791 - DNA, 20 bp, Artificial
  CRISPR gRNA sequence
tctactaaaaataaaaaaat

SEQ ID NO: 433792 - DNA, 20 bp, Artificial
  CRISPR gRNA sequence
ctaaaaataaaaaaattagc

SEQ ID NO: 433793 - DNA, 20 bp, Artificial
  CRISPR gRNA sequence
taaaaataaaaaaattagcc

SEQ ID NO: 433794 - DNA, 20 bp, Artificial
  CRISPR gRNA sequence
ataaaaaaattagccgggtg

SEQ ID NO: 433795 - DNA, 20 bp, Artificial
  CRISPR gRNA sequence
aaaaaattagccgggtgtgg

SEQ ID NO: 433796 - DNA, 20 bp, Artificial
  CRISPR gRNA sequence
gtggctcatgcctgtaatcc

SEQ ID NO: 433797 - DNA, 20 bp, Artificial
  CRISPR gRNA sequence
tgcctgtaatcccagctact

SEQ ID NO: 433798 - DNA, 20 bp, Artificial
  CRISPR gRNA sequence
ctgtaatcccagctactcgg

SEQ ID NO: 433799 - DNA, 20 bp, Artificial
  CRISPR gRNA sequence
tgtaatcccagctactcgga

SEQ ID NO: 433800 - DNA, 20 bp, Artificial
  CRISPR gRNA sequence
tcccagctactcggaaggct

SEQ ID NO: 433801 - DNA, 20 bp, Artificial
  CRISPR gRNA sequence
cccagctactcggaaggctg

SEQ ID NO: 433802 - DNA, 20 bp, Artificial
  CRISPR gRNA sequence
agctactcggaaggctgagg

SEQ ID NO: 433803 - DNA, 20 bp, Artificial
  CRISPR gRNA sequence
gctactcggaaggctgaggc

SEQ ID NO: 433804 - DNA, 20 bp, Artificial
  CRISPR gRNA sequence
tactcggaaggctgaggcag

SEQ ID NO: 433805 - DNA, 20 bp, Artificial
  CRISPR gRNA sequence
gcaggagaatcgcttgaacc

SEQ ID NO: 433806 - DNA, 20 bp, Artificial
  CRISPR gRNA sequence
caggagaatcgcttgaaccc

SEQ ID NO: 433807 - DNA, 20 bp, Artificial
  CRISPR gRNA sequence
ggagaatcgcttgaacccgg

SEQ ID NO: 433808 - DNA, 20 bp, Artificial
  CRISPR gRNA sequence
gagaatcgcttgaacccggg

SEQ ID NO: 433809 - DNA, 20 bp, Artificial
  CRISPR gRNA sequence
aatcgcttgaacccgggagg

SEQ ID NO: 433810 - DNA, 20 bp, Artificial
  CRISPR gRNA sequence
tcgcttgaacccgggaggcg

SEQ ID NO: 433811 - DNA, 20 bp, Artificial
  CRISPR gRNA sequence
cgcttgaacccgggaggcgg

SEQ ID NO: 433812 - DNA, 20 bp, Artificial
  CRISPR gRNA sequence
gaacccgggaggcggaggtt

SEQ ID NO: 433813 - DNA, 20 bp, Artificial
  CRISPR gRNA sequence
aacccgggaggcggaggttg

SEQ ID NO: 433814 - DNA, 20 bp, Artificial
  CRISPR gRNA sequence
cgggaggcggaggttgaggt

SEQ ID NO: 433815 - DNA, 20 bp, Artificial
  CRISPR gRNA sequence
aggcggaggttgaggtgagc

SEQ ID NO: 433816 - DNA, 20 bp, Artificial
  CRISPR gRNA sequence
ggcggaggttgaggtgagcc

SEQ ID NO: 433817 - DNA, 20 bp, Artificial
  CRISPR gRNA sequence
aggatcacacccttgcactc

SEQ ID NO: 433818 - DNA, 20 bp, Artificial
  CRISPR gRNA sequence
cacacccttgcactccagcc

SEQ ID NO: 433819 - DNA, 20 bp, Artificial
  CRISPR gRNA sequence
acacccttgcactccagcct

SEQ ID NO: 433820 - DNA, 20 bp, Artificial
  CRISPR gRNA sequence
tgcactccagcctgggcaac

SEQ ID NO: 433821 - DNA, 20 bp, Artificial
  CRISPR gRNA sequence
cactccagcctgggcaacaa

SEQ ID NO: 433822 - DNA, 20 bp, Artificial
  CRISPR gRNA sequence
tcactttgaatattcctgac

SEQ ID NO: 433823 - DNA, 20 bp, Artificial
  CRISPR gRNA sequence
ctggtgtcttgccatattta

SEQ ID NO: 433824 - DNA, 20 bp, Artificial
  CRISPR gRNA sequence
ggtgtcttgccatatttaaa

SEQ ID NO: 433825 - DNA, 20 bp, Artificial
  CRISPR gRNA sequence
atttaaatactctttcccat

SEQ ID NO: 433826 - DNA, 20 bp, Artificial
  CRISPR gRNA sequence
tttaaatactctttcccatt

SEQ ID NO: 433827 - DNA, 20 bp, Artificial
  CRISPR gRNA sequence
ctttcccattaggattgcaa

SEQ ID NO: 433828 - DNA, 20 bp, Artificial
  CRISPR gRNA sequence
tcccattaggattgcaatgg

SEQ ID NO: 433829 - DNA, 20 bp, Artificial
  CRISPR gRNA sequence
attaggattgcaatggaagc

SEQ ID NO: 433830 - DNA, 20 bp, Artificial
  CRISPR gRNA sequence
aggattgcaatggaagcaag

SEQ ID NO: 433831 - DNA, 20 bp, Artificial
  CRISPR gRNA sequence
tgcaatggaagcaagaagaa

SEQ ID NO: 433832 - DNA, 20 bp, Artificial
  CRISPR gRNA sequence
aagcaagaagaatggtattc

SEQ ID NO: 433833 - DNA, 20 bp, Artificial
  CRISPR gRNA sequence
agcaagaagaatggtattct

SEQ ID NO: 433834 - DNA, 20 bp, Artificial
  CRISPR gRNA sequence
gcaagaagaatggtattcta

SEQ ID NO: 433835 - DNA, 20 bp, Artificial
  CRISPR gRNA sequence
aagaagaatggtattctagg

SEQ ID NO: 433836 - DNA, 20 bp, Artificial
  CRISPR gRNA sequence
aatggtattctagggagatg

SEQ ID NO: 433837 - DNA, 20 bp, Artificial
  CRISPR gRNA sequence
aagaatctttgaaccttcca

SEQ ID NO: 433838 - DNA, 20 bp, Artificial
  CRISPR gRNA sequence
agaatctttgaaccttccac

SEQ ID NO: 433839 - DNA, 20 bp, Artificial
  CRISPR gRNA sequence
gaatctttgaaccttccaca

SEQ ID NO: 433840 - DNA, 20 bp, Artificial
  CRISPR gRNA sequence
tctttgaaccttccacaggg

SEQ ID NO: 433841 - DNA, 20 bp, Artificial
  CRISPR gRNA sequence
tgaaccttccacagggtaga

SEQ ID NO: 433842 - DNA, 20 bp, Artificial
  CRISPR gRNA sequence
ggtagacagttgtgaaattg

SEQ ID NO: 433843 - DNA, 20 bp, Artificial
  CRISPR gRNA sequence
cagttgtgaaattgaagaat

SEQ ID NO: 433844 - DNA, 20 bp, Artificial
  CRISPR gRNA sequence
gttgtgaaattgaagaataa

SEQ ID NO: 433845 - DNA, 20 bp, Artificial
  CRISPR gRNA sequence
ttgtgaaattgaagaataag

SEQ ID NO: 433846 - DNA, 20 bp, Artificial
  CRISPR gRNA sequence
tgtgaaattgaagaataaga

SEQ ID NO: 433847 - DNA, 20 bp, Artificial
  CRISPR gRNA sequence
atgctaatgtttcttctttg

SEQ ID NO: 433848 - DNA, 20 bp, Artificial
  CRISPR gRNA sequence
gtttcttctttgtggttttc

SEQ ID NO: 433849 - DNA, 20 bp, Artificial
  CRISPR gRNA sequence
ttcaagctcttactatatgc

SEQ ID NO: 433850 - DNA, 20 bp, Artificial
  CRISPR gRNA sequence
tcaagctcttactatatgcc

SEQ ID NO: 433851 - DNA, 20 bp, Artificial
  CRISPR gRNA sequence
gcactttacacacatcatgt

SEQ ID NO: 433852 - DNA, 20 bp, Artificial
  CRISPR gRNA sequence
atcatgtcagtccttcatta

SEQ ID NO: 433853 - DNA, 20 bp, Artificial
  CRISPR gRNA sequence
atgtcagtccttcattacag

SEQ ID NO: 433854 - DNA, 20 bp, Artificial
  CRISPR gRNA sequence
tgtcagtccttcattacagc

SEQ ID NO: 433855 - DNA, 20 bp, Artificial
  CRISPR gRNA sequence
cttcattacagcaggcctat

SEQ ID NO: 433856 - DNA, 20 bp, Artificial
  CRISPR gRNA sequence
ttcattacagcaggcctatg

SEQ ID NO: 433857 - DNA, 20 bp, Artificial
  CRISPR gRNA sequence
ttacagcaggcctatgaggt

SEQ ID NO: 433858 - DNA, 20 bp, Artificial
  CRISPR gRNA sequence
ctgtcatcatcaacatgtta

SEQ ID NO: 433859 - DNA, 20 bp, Artificial
  CRISPR gRNA sequence
atcatcaacatgttacagcc

SEQ ID NO: 433860 - DNA, 20 bp, Artificial
  CRISPR gRNA sequence
tcatcaacatgttacagccc

SEQ ID NO: 433861 - DNA, 20 bp, Artificial
  CRISPR gRNA sequence
tgttacagcccaggaatctg

SEQ ID NO: 433862 - DNA, 20 bp, Artificial
  CRISPR gRNA sequence
cagcccaggaatctgaagct

SEQ ID NO: 433863 - DNA, 20 bp, Artificial
  CRISPR gRNA sequence
agcccaggaatctgaagcta

SEQ ID NO: 433864 - DNA, 20 bp, Artificial
  CRISPR gRNA sequence
gcccaggaatctgaagctaa

SEQ ID NO: 433865 - DNA, 20 bp, Artificial
  CRISPR gRNA sequence
atctgaagctaagggaactt

SEQ ID NO: 433866 - DNA, 20 bp, Artificial
  CRISPR gRNA sequence
tctgaagctaagggaactta

SEQ ID NO: 433867 - DNA, 20 bp, Artificial
  CRISPR gRNA sequence
aacttaaggctttttacccc

SEQ ID NO: 433868 - DNA, 20 bp, Artificial
  CRISPR gRNA sequence
acttaaggctttttacccca

SEQ ID NO: 433869 - DNA, 20 bp, Artificial
  CRISPR gRNA sequence
aggctttttaccccaaggac

SEQ ID NO: 433870 - DNA, 20 bp, Artificial
  CRISPR gRNA sequence
ggctttttaccccaaggaca

SEQ ID NO: 433871 - DNA, 20 bp, Artificial
  CRISPR gRNA sequence
tttttaccccaaggacaagg

SEQ ID NO: 433872 - DNA, 20 bp, Artificial
  CRISPR gRNA sequence
ttttaccccaaggacaaggt

SEQ ID NO: 433873 - DNA, 20 bp, Artificial
  CRISPR gRNA sequence
ccaaggacaaggtgggcatg

SEQ ID NO: 433874 - DNA, 20 bp, Artificial
  CRISPR gRNA sequence
caaggacaaggtgggcatga

SEQ ID NO: 433875 - DNA, 20 bp, Artificial
  CRISPR gRNA sequence
ggacaaggtgggcatgaagg

SEQ ID NO: 433876 - DNA, 20 bp, Artificial
  CRISPR gRNA sequence
gtgggcatgaaggaagtcta

SEQ ID NO: 433877 - DNA, 20 bp, Artificial
  CRISPR gRNA sequence
aaagccatgatttcccctcc

SEQ ID NO: 433878 - DNA, 20 bp, Artificial
  CRISPR gRNA sequence
catgatttcccctccaagtt

SEQ ID NO: 433879 - DNA, 20 bp, Artificial
  CRISPR gRNA sequence
cctccaagttgagtacaaca

SEQ ID NO: 433880 - DNA, 20 bp, Artificial
  CRISPR gRNA sequence
tacaacatagctcacaaaaa

SEQ ID NO: 433881 - DNA, 20 bp, Artificial
  CRISPR gRNA sequence
caaaaaaagttacttactgt

SEQ ID NO: 433882 - DNA, 20 bp, Artificial
  CRISPR gRNA sequence
acttactgttagatttatat

SEQ ID NO: 433883 - DNA, 20 bp, Artificial
  CRISPR gRNA sequence
cttactgttagatttatatc

SEQ ID NO: 433884 - DNA, 20 bp, Artificial
  CRISPR gRNA sequence
ttactgttagatttatatca

SEQ ID NO: 433885 - DNA, 20 bp, Artificial
  CRISPR gRNA sequence
actgttagatttatatcagg

SEQ ID NO: 433886 - DNA, 20 bp, Artificial
  CRISPR gRNA sequence
ctgttagatttatatcaggg

SEQ ID NO: 433887 - DNA, 20 bp, Artificial
  CRISPR gRNA sequence
tttatatcagggaggctccc

SEQ ID NO: 433888 - DNA, 20 bp, Artificial
  CRISPR gRNA sequence
gtctgtgtctctgctataaa

SEQ ID NO: 433889 - DNA, 20 bp, Artificial
  CRISPR gRNA sequence
ctgtgtctctgctataaaaa

SEQ ID NO: 433890 - DNA, 20 bp, Artificial
  CRISPR gRNA sequence
gtgtctctgctataaaaaga

SEQ ID NO: 433891 - DNA, 20 bp, Artificial
  CRISPR gRNA sequence
gtctctgctataaaaagaga

SEQ ID NO: 433892 - DNA, 20 bp, Artificial
  CRISPR gRNA sequence
ctctgctataaaaagagaga

SEQ ID NO: 433893 - DNA, 20 bp, Artificial
  CRISPR gRNA sequence
ctgctataaaaagagagaga

SEQ ID NO: 433894 - DNA, 20 bp, Artificial
  CRISPR gRNA sequence
gctataaaaagagagagaga

SEQ ID NO: 433895 - DNA, 20 bp, Artificial
  CRISPR gRNA sequence
tataaaaagagagagagaga

SEQ ID NO: 433896 - DNA, 20 bp, Artificial
  CRISPR gRNA sequence
taaaaagagagagagagaga

SEQ ID NO: 433897 - DNA, 20 bp, Artificial
  CRISPR gRNA sequence
aaaagagagagagagagaga

SEQ ID NO: 433898 - DNA, 20 bp, Artificial
  CRISPR gRNA sequence
aagagagagagagagagaga

SEQ ID NO: 433899 - DNA, 20 bp, Artificial
  CRISPR gRNA sequence
agagagagagagagagagag

SEQ ID NO: 433900 - DNA, 20 bp, Artificial
  CRISPR gRNA sequence
agagagagagagaggaaaaa

SEQ ID NO: 433901 - DNA, 20 bp, Artificial
  CRISPR gRNA sequence
gagagaggaaaaatagccaa

SEQ ID NO: 433902 - DNA, 20 bp, Artificial
  CRISPR gRNA sequence
aggaaaaatagccaatagta

SEQ ID NO: 433903 - DNA, 20 bp, Artificial
  CRISPR gRNA sequence
aaatagccaatagtatagtt

SEQ ID NO: 433904 - DNA, 20 bp, Artificial
  CRISPR gRNA sequence
aagaacgttttcttttatct

SEQ ID NO: 433905 - DNA, 20 bp, Artificial
  CRISPR gRNA sequence
gtacttgtcacaataattaa

SEQ ID NO: 433906 - DNA, 20 bp, Artificial
  CRISPR gRNA sequence
acttgtcacaataattaatg

SEQ ID NO: 433907 - DNA, 20 bp, Artificial
  CRISPR gRNA sequence
ttgtcacaataattaatgga

SEQ ID NO: 433908 - DNA, 20 bp, Artificial
  CRISPR gRNA sequence
cacaataattaatggagaga

SEQ ID NO: 433909 - DNA, 20 bp, Artificial
  CRISPR gRNA sequence
gacaaaatttactgaacacc

SEQ ID NO: 433910 - DNA, 20 bp, Artificial
  CRISPR gRNA sequence
acaaaatttactgaacaccc

SEQ ID NO: 433911 - DNA, 20 bp, Artificial
  CRISPR gRNA sequence
gaacacccaggaatcaactt

SEQ ID NO: 433912 - DNA, 20 bp, Artificial
  CRISPR gRNA sequence
aacacccaggaatcaacttt

SEQ ID NO: 433913 - DNA, 20 bp, Artificial
  CRISPR gRNA sequence
cccaggaatcaactttagga

SEQ ID NO: 433914 - DNA, 20 bp, Artificial
  CRISPR gRNA sequence
gatggccacattttttcatc

SEQ ID NO: 433915 - DNA, 20 bp, Artificial
  CRISPR gRNA sequence
aaccgtactgttttatgaaa

SEQ ID NO: 433916 - DNA, 20 bp, Artificial
  CRISPR gRNA sequence
ccgtactgttttatgaaata

SEQ ID NO: 433917 - DNA, 20 bp, Artificial
  CRISPR gRNA sequence
tatgaaatagagacttctgc

SEQ ID NO: 433918 - DNA, 20 bp, Artificial
  CRISPR gRNA sequence
atgaaatagagacttctgcc

SEQ ID NO: 433919 - DNA, 20 bp, Artificial
  CRISPR gRNA sequence
aaatagagacttctgccagg

SEQ ID NO: 433920 - DNA, 20 bp, Artificial
  CRISPR gRNA sequence
tatgtgctttgtttttttca

SEQ ID NO: 433921 - DNA, 20 bp, Artificial
  CRISPR gRNA sequence
atgtgctttgtttttttcac

SEQ ID NO: 433922 - DNA, 20 bp, Artificial
  CRISPR gRNA sequence
ttttttcacaggaccctaat

SEQ ID NO: 433923 - DNA, 20 bp, Artificial
  CRISPR gRNA sequence
taatgagttctacaaacatc

SEQ ID NO: 433924 - DNA, 20 bp, Artificial
  CRISPR gRNA sequence
aaacatctagcaatattgat

SEQ ID NO: 433925 - DNA, 20 bp, Artificial
  CRISPR gRNA sequence
ctagcaatattgataagact

SEQ ID NO: 433926 - DNA, 20 bp, Artificial
  CRISPR gRNA sequence
tagcaatattgataagactc

SEQ ID NO: 433927 - DNA, 20 bp, Artificial
  CRISPR gRNA sequence
tatttatttatttatttatt

SEQ ID NO: 433928 - DNA, 20 bp, Artificial
  CRISPR gRNA sequence
tttatttatttatttagaca

SEQ ID NO: 433929 - DNA, 20 bp, Artificial
  CRISPR gRNA sequence
cagaatttcactctgtcacc

SEQ ID NO: 433930 - DNA, 20 bp, Artificial
  CRISPR gRNA sequence
agaatttcactctgtcaccc

SEQ ID NO: 433931 - DNA, 20 bp, Artificial
  CRISPR gRNA sequence
tttcactctgtcacccaggc

SEQ ID NO: 433932 - DNA, 20 bp, Artificial
  CRISPR gRNA sequence
tcactctgtcacccaggctg

SEQ ID NO: 433933 - DNA, 20 bp, Artificial
  CRISPR gRNA sequence
ctgtcacccaggctggagtg

SEQ ID NO: 433934 - DNA, 20 bp, Artificial
  CRISPR gRNA sequence
tcacccaggctggagtgcag

SEQ ID NO: 433935 - DNA, 20 bp, Artificial
  CRISPR gRNA sequence
ggagtgcagtggcataatct

SEQ ID NO: 433936 - DNA, 20 bp, Artificial
  CRISPR gRNA sequence
atctcagctcaccgcaacct

SEQ ID NO: 433937 - DNA, 20 bp, Artificial
  CRISPR gRNA sequence
caccgcaacctcggcctccc

SEQ ID NO: 433938 - DNA, 20 bp, Artificial
  CRISPR gRNA sequence
aacctcggcctccctggttc

SEQ ID NO: 433939 - DNA, 20 bp, Artificial
  CRISPR gRNA sequence
ttctcatccctcatcctccc

SEQ ID NO: 433940 - DNA, 20 bp, Artificial
  CRISPR gRNA sequence
tcatccctcatcctcccaag

SEQ ID NO: 433941 - DNA, 20 bp, Artificial
  CRISPR gRNA sequence
ccctcatcctcccaagtagc

SEQ ID NO: 433942 - DNA, 20 bp, Artificial
  CRISPR gRNA sequence
cctcatcctcccaagtagct

SEQ ID NO: 433943 - DNA, 20 bp, Artificial
  CRISPR gRNA sequence
catgcatgcaccaccacgcc

SEQ ID NO: 433944 - DNA, 20 bp, Artificial
  CRISPR gRNA sequence
ccagctaatttttgtatttt

SEQ ID NO: 433945 - DNA, 20 bp, Artificial
  CRISPR gRNA sequence
gctaatttttgtatttttag

SEQ ID NO: 433946 - DNA, 20 bp, Artificial
  CRISPR gRNA sequence
taatttttgtatttttagta

SEQ ID NO: 433947 - DNA, 20 bp, Artificial
  CRISPR gRNA sequence
tttgtatttttagtagagac

SEQ ID NO: 433948 - DNA, 20 bp, Artificial
  CRISPR gRNA sequence
ttgtatttttagtagagacg

SEQ ID NO: 433949 - DNA, 20 bp, Artificial
  CRISPR gRNA sequence
agagacgaggccatgttgac

SEQ ID NO: 433950 - DNA, 20 bp, Artificial
  CRISPR gRNA sequence
gagacgaggccatgttgacc

SEQ ID NO: 433951 - DNA, 20 bp, Artificial
  CRISPR gRNA sequence
cgaggccatgttgaccaggc

SEQ ID NO: 433952 - DNA, 20 bp, Artificial
  CRISPR gRNA sequence
tggttgtgaactcctgacct

SEQ ID NO: 433953 - DNA, 20 bp, Artificial
  CRISPR gRNA sequence
ggttgtgaactcctgacctc

SEQ ID NO: 433954 - DNA, 20 bp, Artificial
  CRISPR gRNA sequence
ctcaggtgatctgcccacct

SEQ ID NO: 433955 - DNA, 20 bp, Artificial
  CRISPR gRNA sequence
acctcagcctcccaaaatgc

SEQ ID NO: 433956 - DNA, 20 bp, Artificial
  CRISPR gRNA sequence
cctcagcctcccaaaatgct

SEQ ID NO: 433957 - DNA, 20 bp, Artificial
  CRISPR gRNA sequence
ctcccaaaatgctgggatta

SEQ ID NO: 433958 - DNA, 20 bp, Artificial
  CRISPR gRNA sequence
tcccaaaatgctgggattac

SEQ ID NO: 433959 - DNA, 20 bp, Artificial
  CRISPR gRNA sequence
ggattacaggtgtgaacgac

SEQ ID NO: 433960 - DNA, 20 bp, Artificial
  CRISPR gRNA sequence
gattacaggtgtgaacgacc

SEQ ID NO: 433961 - DNA, 20 bp, Artificial
  CRISPR gRNA sequence
caggtgtgaacgaccaggct

SEQ ID NO: 433962 - DNA, 20 bp, Artificial
  CRISPR gRNA sequence
tgaacgaccaggcttggcct

SEQ ID NO: 433963 - DNA, 20 bp, Artificial
  CRISPR gRNA sequence
gaacgaccaggcttggcctc

SEQ ID NO: 433964 - DNA, 20 bp, Artificial
  CRISPR gRNA sequence
ctcaggcattatattctaat

SEQ ID NO: 433965 - DNA, 20 bp, Artificial
  CRISPR gRNA sequence
atattctaattagattttaa

SEQ ID NO: 433966 - DNA, 20 bp, Artificial
  CRISPR gRNA sequence
tccttcttttttgttttttt

SEQ ID NO: 433967 - DNA, 20 bp, Artificial
  CRISPR gRNA sequence
tcttttttgtttttttgaga

SEQ ID NO: 433968 - DNA, 20 bp, Artificial
  CRISPR gRNA sequence
gacagtctcactctgttgcc

SEQ ID NO: 433969 - DNA, 20 bp, Artificial
  CRISPR gRNA sequence
acagtctcactctgttgccc

SEQ ID NO: 433970 - DNA, 20 bp, Artificial
  CRISPR gRNA sequence
tctcactctgttgcccaggc

SEQ ID NO: 433971 - DNA, 20 bp, Artificial
  CRISPR gRNA sequence
tcactctgttgcccaggctg

SEQ ID NO: 433972 - DNA, 20 bp, Artificial
  CRISPR gRNA sequence
ctgttgcccaggctggagtg

SEQ ID NO: 433973 - DNA, 20 bp, Artificial
  CRISPR gRNA sequence
ttgcccaggctggagtgcag

SEQ ID NO: 433974 - DNA, 20 bp, Artificial
  CRISPR gRNA sequence
tttcttttttttctttttgc

SEQ ID NO: 433975 - DNA, 20 bp, Artificial
  CRISPR gRNA sequence
ttttttttctttttgcgaga

SEQ ID NO: 433976 - DNA, 20 bp, Artificial
  CRISPR gRNA sequence
cagaatctcactctatcacc

SEQ ID NO: 433977 - DNA, 20 bp, Artificial
  CRISPR gRNA sequence
agaatctcactctatcaccc

SEQ ID NO: 433978 - DNA, 20 bp, Artificial
  CRISPR gRNA sequence
tctcactctatcacccaggc

SEQ ID NO: 433979 - DNA, 20 bp, Artificial
  CRISPR gRNA sequence
tcactctatcacccaggctg

SEQ ID NO: 433980 - DNA, 20 bp, Artificial
  CRISPR gRNA sequence
ctatcacccaggctggagtg

SEQ ID NO: 433981 - DNA, 20 bp, Artificial
  CRISPR gRNA sequence
tcacccaggctggagtgcag

SEQ ID NO: 433982 - DNA, 20 bp, Artificial
  CRISPR gRNA sequence
cactgcaacctccatctcct

SEQ ID NO: 433983 - DNA, 20 bp, Artificial
  CRISPR gRNA sequence
aacctccatctcctgagttc

SEQ ID NO: 433984 - DNA, 20 bp, Artificial
  CRISPR gRNA sequence
ttcaagcgattctcctgcct

SEQ ID NO: 433985 - DNA, 20 bp, Artificial
  CRISPR gRNA sequence
ttctcctgcctcagcctccc

SEQ ID NO: 433986 - DNA, 20 bp, Artificial
  CRISPR gRNA sequence
tcctgcctcagcctccctgg

SEQ ID NO: 433987 - DNA, 20 bp, Artificial
  CRISPR gRNA sequence
gcctcagcctccctggtagc

SEQ ID NO: 433988 - DNA, 20 bp, Artificial
  CRISPR gRNA sequence
cctcagcctccctggtagct

SEQ ID NO: 433989 - DNA, 20 bp, Artificial
  CRISPR gRNA sequence
ctccctggtagctgggacta

SEQ ID NO: 433990 - DNA, 20 bp, Artificial
  CRISPR gRNA sequence
tccctggtagctgggactac

SEQ ID NO: 433991 - DNA, 20 bp, Artificial
  CRISPR gRNA sequence
ccctggtagctgggactaca

SEQ ID NO: 433992 - DNA, 20 bp, Artificial
  CRISPR gRNA sequence
cctggtagctgggactacag

SEQ ID NO: 433993 - DNA, 20 bp, Artificial
  CRISPR gRNA sequence
caggggcacaccaccacaca

SEQ ID NO: 433994 - DNA, 20 bp, Artificial
  CRISPR gRNA sequence
acagctaatttttgtatttt

SEQ ID NO: 433995 - DNA, 20 bp, Artificial
  CRISPR gRNA sequence
gctaatttttgtatttttag

SEQ ID NO: 433996 - DNA, 20 bp, Artificial
  CRISPR gRNA sequence
taatttttgtatttttagta

SEQ ID NO: 433997 - DNA, 20 bp, Artificial
  CRISPR gRNA sequence
ttttgtatttttagtagaga

SEQ ID NO: 433998 - DNA, 20 bp, Artificial
  CRISPR gRNA sequence
tttgtatttttagtagagac

SEQ ID NO: 433999 - DNA, 20 bp, Artificial
  CRISPR gRNA sequence
ttgtatttttagtagagacg

SEQ ID NO: 434000 - DNA, 20 bp, Artificial
  CRISPR gRNA sequence
gagacggggtttcgccatgt

SEQ ID NO: 434001 - DNA, 20 bp, Artificial
  CRISPR gRNA sequence
cggggtttcgccatgttggc

SEQ ID NO: 434002 - DNA, 20 bp, Artificial
  CRISPR gRNA sequence
ggggtttcgccatgttggcc

SEQ ID NO: 434003 - DNA, 20 bp, Artificial
  CRISPR gRNA sequence
tttcgccatgttggccaggc

SEQ ID NO: 434004 - DNA, 20 bp, Artificial
  CRISPR gRNA sequence
agtctcgaactcctgacctc

SEQ ID NO: 434005 - DNA, 20 bp, Artificial
  CRISPR gRNA sequence
ctcaagtgatccacccgcct

SEQ ID NO: 434006 - DNA, 20 bp, Artificial
  CRISPR gRNA sequence
ccacccgcctcggcctccca

SEQ ID NO: 434007 - DNA, 20 bp, Artificial
  CRISPR gRNA sequence
gcctcggcctcccaaagtgc

SEQ ID NO: 434008 - DNA, 20 bp, Artificial
  CRISPR gRNA sequence
cctcggcctcccaaagtgct

SEQ ID NO: 434009 - DNA, 20 bp, Artificial
  CRISPR gRNA sequence
ctcccaaagtgctgggatta

SEQ ID NO: 434010 - DNA, 20 bp, Artificial
  CRISPR gRNA sequence
tcccaaagtgctgggattac

SEQ ID NO: 434011 - DNA, 20 bp, Artificial
  CRISPR gRNA sequence
agtgctgggattacaggcgt

SEQ ID NO: 434012 - DNA, 20 bp, Artificial
  CRISPR gRNA sequence
gtgagccaccgtgccgtgcc

SEQ ID NO: 434013 - DNA, 20 bp, Artificial
  CRISPR gRNA sequence
cagcctccattttcttaaat

SEQ ID NO: 434014 - DNA, 20 bp, Artificial
  CRISPR gRNA sequence
taagttttgcatttactcat

SEQ ID NO: 434015 - DNA, 20 bp, Artificial
  CRISPR gRNA sequence
gttttgcatttactcatgag

SEQ ID NO: 434016 - DNA, 20 bp, Artificial
  CRISPR gRNA sequence
ttttgcatttactcatgaga

SEQ ID NO: 434017 - DNA, 20 bp, Artificial
  CRISPR gRNA sequence
tttgcatttactcatgagaa

SEQ ID NO: 434018 - DNA, 20 bp, Artificial
  CRISPR gRNA sequence
tgcatttactcatgagaagg

SEQ ID NO: 434019 - DNA, 20 bp, Artificial
  CRISPR gRNA sequence
tttactcatgagaagggaga

SEQ ID NO: 434020 - DNA, 20 bp, Artificial
  CRISPR gRNA sequence
ttactcatgagaagggagac

SEQ ID NO: 434021 - DNA, 20 bp, Artificial
  CRISPR gRNA sequence
tactcatgagaagggagaca

SEQ ID NO: 434022 - DNA, 20 bp, Artificial
  CRISPR gRNA sequence
acaaatgaaaataatcactg

SEQ ID NO: 434023 - DNA, 20 bp, Artificial
  CRISPR gRNA sequence
tcactgtggtcacaatgtaa

SEQ ID NO: 434024 - DNA, 20 bp, Artificial
  CRISPR gRNA sequence
cactgtggtcacaatgtaat

SEQ ID NO: 434025 - DNA, 20 bp, Artificial
  CRISPR gRNA sequence
ctgtggtcacaatgtaatag

SEQ ID NO: 434026 - DNA, 20 bp, Artificial
  CRISPR gRNA sequence
ggtcacaatgtaataggagc

SEQ ID NO: 434027 - DNA, 20 bp, Artificial
  CRISPR gRNA sequence
gtcacaatgtaataggagcc

SEQ ID NO: 434028 - DNA, 20 bp, Artificial
  CRISPR gRNA sequence
ttgtgctaaataaactcttt

SEQ ID NO: 434029 - DNA, 20 bp, Artificial
  CRISPR gRNA sequence
ctaaataaactctttcagtg

SEQ ID NO: 434030 - DNA, 20 bp, Artificial
  CRISPR gRNA sequence
aataaactctttcagtgaag

SEQ ID NO: 434031 - DNA, 20 bp, Artificial
  CRISPR gRNA sequence
ttcagtgaagaagctcattt

SEQ ID NO: 434032 - DNA, 20 bp, Artificial
  CRISPR gRNA sequence
cagtgaagaagctcatttta

SEQ ID NO: 434033 - DNA, 20 bp, Artificial
  CRISPR gRNA sequence
aagctcattttagagatact

SEQ ID NO: 434034 - DNA, 20 bp, Artificial
  CRISPR gRNA sequence
ctcattttagagatacttag

SEQ ID NO: 434035 - DNA, 20 bp, Artificial
  CRISPR gRNA sequence
atacttagaagcacttactt

SEQ ID NO: 434036 - DNA, 20 bp, Artificial
  CRISPR gRNA sequence
actttagaactacgcttcta

SEQ ID NO: 434037 - DNA, 20 bp, Artificial
  CRISPR gRNA sequence
ttagaactacgcttctaaag

SEQ ID NO: 434038 - DNA, 20 bp, Artificial
  CRISPR gRNA sequence
agaactacgcttctaaagta

SEQ ID NO: 434039 - DNA, 20 bp, Artificial
  CRISPR gRNA sequence
gcttctaaagtagagactgt

SEQ ID NO: 434040 - DNA, 20 bp, Artificial
  CRISPR gRNA sequence
agactgttagtcccattgca

SEQ ID NO: 434041 - DNA, 20 bp, Artificial
  CRISPR gRNA sequence
ttagtcccattgcacagatg

SEQ ID NO: 434042 - DNA, 20 bp, Artificial
  CRISPR gRNA sequence
cagatgaagaaactgaaaat

SEQ ID NO: 434043 - DNA, 20 bp, Artificial
  CRISPR gRNA sequence
agatgaagaaactgaaaatt

SEQ ID NO: 434044 - DNA, 20 bp, Artificial
  CRISPR gRNA sequence
gatgaagaaactgaaaatta

SEQ ID NO: 434045 - DNA, 20 bp, Artificial
  CRISPR gRNA sequence
gaagaaactgaaaattaggg

SEQ ID NO: 434046 - DNA, 20 bp, Artificial
  CRISPR gRNA sequence
aactgaaaattagggaagtg

SEQ ID NO: 434047 - DNA, 20 bp, Artificial
  CRISPR gRNA sequence
ggaagtgaagtgactaaccc

SEQ ID NO: 434048 - DNA, 20 bp, Artificial
  CRISPR gRNA sequence
gaagtgaagtgactaaccca

SEQ ID NO: 434049 - DNA, 20 bp, Artificial
  CRISPR gRNA sequence
taacccaaggtcacatgact

SEQ ID NO: 434050 - DNA, 20 bp, Artificial
  CRISPR gRNA sequence
tgacttagcaaatgacaaaa

SEQ ID NO: 434051 - DNA, 20 bp, Artificial
  CRISPR gRNA sequence
gacaaaatggccttccaatt

SEQ ID NO: 434052 - DNA, 20 bp, Artificial
  CRISPR gRNA sequence
acaaaatggccttccaattt

SEQ ID NO: 434053 - DNA, 20 bp, Artificial
  CRISPR gRNA sequence
ccttccaatttaggtctgca

SEQ ID NO: 434054 - DNA, 20 bp, Artificial
  CRISPR gRNA sequence
cttaattatactgccttcac

SEQ ID NO: 434055 - DNA, 20 bp, Artificial
  CRISPR gRNA sequence
gccttcaccagcccttacct

SEQ ID NO: 434056 - DNA, 20 bp, Artificial
  CRISPR gRNA sequence
acctcagtgctgtcattatg

SEQ ID NO: 434057 - DNA, 20 bp, Artificial
  CRISPR gRNA sequence
ctcagtgctgtcattatgaa

SEQ ID NO: 434058 - DNA, 20 bp, Artificial
  CRISPR gRNA sequence
tcagtgctgtcattatgaag

SEQ ID NO: 434059 - DNA, 20 bp, Artificial
  CRISPR gRNA sequence
cagtgctgtcattatgaaga

SEQ ID NO: 434060 - DNA, 20 bp, Artificial
  CRISPR gRNA sequence
atgaagagggtcacgttgcc

SEQ ID NO: 434061 - DNA, 20 bp, Artificial
  CRISPR gRNA sequence
tatgcactatgcccttactc

SEQ ID NO: 434062 - DNA, 20 bp, Artificial
  CRISPR gRNA sequence
atgcactatgcccttactct

SEQ ID NO: 434063 - DNA, 20 bp, Artificial
  CRISPR gRNA sequence
ctatgcccttactctaggca

SEQ ID NO: 434064 - DNA, 20 bp, Artificial
  CRISPR gRNA sequence
tatgcccttactctaggcac

SEQ ID NO: 434065 - DNA, 20 bp, Artificial
  CRISPR gRNA sequence
atgcccttactctaggcaca

SEQ ID NO: 434066 - DNA, 20 bp, Artificial
  CRISPR gRNA sequence
tgcccttactctaggcacag

SEQ ID NO: 434067 - DNA, 20 bp, Artificial
  CRISPR gRNA sequence
cttactctaggcacagggga

SEQ ID NO: 434068 - DNA, 20 bp, Artificial
  CRISPR gRNA sequence
tactctaggcacaggggaca

SEQ ID NO: 434069 - DNA, 20 bp, Artificial
  CRISPR gRNA sequence
tctaggcacaggggacagag

SEQ ID NO: 434070 - DNA, 20 bp, Artificial
  CRISPR gRNA sequence
ctaggcacaggggacagagc

SEQ ID NO: 434071 - DNA, 20 bp, Artificial
  CRISPR gRNA sequence
caggggacagagcaggaaac

SEQ ID NO: 434072 - DNA, 20 bp, Artificial
  CRISPR gRNA sequence
ggggacagagcaggaaacaa

SEQ ID NO: 434073 - DNA, 20 bp, Artificial
  CRISPR gRNA sequence
gggacagagcaggaaacaag

SEQ ID NO: 434074 - DNA, 20 bp, Artificial
  CRISPR gRNA sequence
ggacagagcaggaaacaaga

SEQ ID NO: 434075 - DNA, 20 bp, Artificial
  CRISPR gRNA sequence
gacagagcaggaaacaagag

SEQ ID NO: 434076 - DNA, 20 bp, Artificial
  CRISPR gRNA sequence
agcaggaaacaagaggggca

SEQ ID NO: 434077 - DNA, 20 bp, Artificial
  CRISPR gRNA sequence
gcaggaaacaagaggggcac

SEQ ID NO: 434078 - DNA, 20 bp, Artificial
  CRISPR gRNA sequence
gaacactgaattctaaaaat

SEQ ID NO: 434079 - DNA, 20 bp, Artificial
  CRISPR gRNA sequence
tctaaaaataagtacattgc

SEQ ID NO: 434080 - DNA, 20 bp, Artificial
  CRISPR gRNA sequence
ataagtacattgccagcttt

SEQ ID NO: 434081 - DNA, 20 bp, Artificial
  CRISPR gRNA sequence
ttgccagcttttggaaaact

SEQ ID NO: 434082 - DNA, 20 bp, Artificial
  CRISPR gRNA sequence
agcatgcttactcattttta

SEQ ID NO: 434083 - DNA, 20 bp, Artificial
  CRISPR gRNA sequence
gcttactcatttttatggct

SEQ ID NO: 434084 - DNA, 20 bp, Artificial
  CRISPR gRNA sequence
actcatttttatggctgagt

SEQ ID NO: 434085 - DNA, 20 bp, Artificial
  CRISPR gRNA sequence
tcatttttatggctgagtca

SEQ ID NO: 434086 - DNA, 20 bp, Artificial
  CRISPR gRNA sequence
taaatgtcactgtcaccttc

SEQ ID NO: 434087 - DNA, 20 bp, Artificial
  CRISPR gRNA sequence
atgtcactgtcaccttctgg

SEQ ID NO: 434088 - DNA, 20 bp, Artificial
  CRISPR gRNA sequence
tggaagccttaatgtgtata

SEQ ID NO: 434089 - DNA, 20 bp, Artificial
  CRISPR gRNA sequence
ggaagccttaatgtgtataa

SEQ ID NO: 434090 - DNA, 20 bp, Artificial
  CRISPR gRNA sequence
gaagccttaatgtgtataaa

SEQ ID NO: 434091 - DNA, 20 bp, Artificial
  CRISPR gRNA sequence
taaagggtttgactaaatgc

SEQ ID NO: 434092 - DNA, 20 bp, Artificial
  CRISPR gRNA sequence
ggtttgactaaatgctggtt

SEQ ID NO: 434093 - DNA, 20 bp, Artificial
  CRISPR gRNA sequence
aatgctggtttagcaaacta

SEQ ID NO: 434094 - DNA, 20 bp, Artificial
  CRISPR gRNA sequence
actatagtttaaatattata

SEQ ID NO: 434095 - DNA, 20 bp, Artificial
  CRISPR gRNA sequence
ctatagtttaaatattataa

SEQ ID NO: 434096 - DNA, 20 bp, Artificial
  CRISPR gRNA sequence
gtttaaatattataaaggca

SEQ ID NO: 434097 - DNA, 20 bp, Artificial
  CRISPR gRNA sequence
atattataaaggcatagcct

SEQ ID NO: 434098 - DNA, 20 bp, Artificial
  CRISPR gRNA sequence
gcctcagcctaaaattattg

SEQ ID NO: 434099 - DNA, 20 bp, Artificial
  CRISPR gRNA sequence
ctaaaattattgaagaaaaa

SEQ ID NO: 434100 - DNA, 20 bp, Artificial
  CRISPR gRNA sequence
attacttttgccctaattac

SEQ ID NO: 434101 - DNA, 20 bp, Artificial
  CRISPR gRNA sequence
aatttaaaatataaaaacca

SEQ ID NO: 434102 - DNA, 20 bp, Artificial
  CRISPR gRNA sequence
atttaaaatataaaaaccac

SEQ ID NO: 434103 - DNA, 20 bp, Artificial
  CRISPR gRNA sequence
aaatataaaaaccacaggcc

SEQ ID NO: 434104 - DNA, 20 bp, Artificial
  CRISPR gRNA sequence
taaaaaccacaggcctggtg

SEQ ID NO: 434105 - DNA, 20 bp, Artificial
  CRISPR gRNA sequence
aaaccacaggcctggtgcag

SEQ ID NO: 434106 - DNA, 20 bp, Artificial
  CRISPR gRNA sequence
gtggctcacacctgtaatcc

SEQ ID NO: 434107 - DNA, 20 bp, Artificial
  CRISPR gRNA sequence
cacctgtaatcccagcactt

SEQ ID NO: 434108 - DNA, 20 bp, Artificial
  CRISPR gRNA sequence
acctgtaatcccagcacttt

SEQ ID NO: 434109 - DNA, 20 bp, Artificial
  CRISPR gRNA sequence
ctgtaatcccagcactttgg

SEQ ID NO: 434110 - DNA, 20 bp, Artificial
  CRISPR gRNA sequence
tgtaatcccagcactttggg

SEQ ID NO: 434111 - DNA, 20 bp, Artificial
  CRISPR gRNA sequence
tcccagcactttgggaggcc

SEQ ID NO: 434112 - DNA, 20 bp, Artificial
  CRISPR gRNA sequence
cccagcactttgggaggccg

SEQ ID NO: 434113 - DNA, 20 bp, Artificial
  CRISPR gRNA sequence
ccagcactttgggaggccga

SEQ ID NO: 434114 - DNA, 20 bp, Artificial
  CRISPR gRNA sequence
gcactttgggaggccgaggg

SEQ ID NO: 434115 - DNA, 20 bp, Artificial
  CRISPR gRNA sequence
cactttgggaggccgagggc

SEQ ID NO: 434116 - DNA, 20 bp, Artificial
  CRISPR gRNA sequence
tttgggaggccgagggcagg

SEQ ID NO: 434117 - DNA, 20 bp, Artificial
  CRISPR gRNA sequence
gccgagggcaggcagatcac

SEQ ID NO: 434118 - DNA, 20 bp, Artificial
  CRISPR gRNA sequence
ccgagggcaggcagatcacg

SEQ ID NO: 434119 - DNA, 20 bp, Artificial
  CRISPR gRNA sequence
gggcaggcagatcacgaggt

SEQ ID NO: 434120 - DNA, 20 bp, Artificial
  CRISPR gRNA sequence
ggcaggcagatcacgaggtc

SEQ ID NO: 434121 - DNA, 20 bp, Artificial
  CRISPR gRNA sequence
caggcagatcacgaggtcag

SEQ ID NO: 434122 - DNA, 20 bp, Artificial
  CRISPR gRNA sequence
gatcacgaggtcaggagatc

SEQ ID NO: 434123 - DNA, 20 bp, Artificial
  CRISPR gRNA sequence
tcaggagatcgagaccatcc

SEQ ID NO: 434124 - DNA, 20 bp, Artificial
  CRISPR gRNA sequence
cgagaccatcctggccaata

SEQ ID NO: 434125 - DNA, 20 bp, Artificial
  CRISPR gRNA sequence
tctactaaaatacaaaaaat

SEQ ID NO: 434126 - DNA, 20 bp, Artificial
  CRISPR gRNA sequence
ctaaaatacaaaaaattagc

SEQ ID NO: 434127 - DNA, 20 bp, Artificial
  CRISPR gRNA sequence
taaaatacaaaaaattagcc

SEQ ID NO: 434128 - DNA, 20 bp, Artificial
  CRISPR gRNA sequence
tacaaaaaattagccgggcg

SEQ ID NO: 434129 - DNA, 20 bp, Artificial
  CRISPR gRNA sequence
aaaaaattagccgggcgtgg

SEQ ID NO: 434130 - DNA, 20 bp, Artificial
  CRISPR gRNA sequence
ggcgtggtggtgtacgcctg

SEQ ID NO: 434131 - DNA, 20 bp, Artificial
  CRISPR gRNA sequence
gtggtgtacgcctgtagtcc

SEQ ID NO: 434132 - DNA, 20 bp, Artificial
  CRISPR gRNA sequence
cgcctgtagtcccagctact

SEQ ID NO: 434133 - DNA, 20 bp, Artificial
  CRISPR gRNA sequence
gcctgtagtcccagctactc

SEQ ID NO: 434134 - DNA, 20 bp, Artificial
  CRISPR gRNA sequence
ctgtagtcccagctactcag

SEQ ID NO: 434135 - DNA, 20 bp, Artificial
  CRISPR gRNA sequence
tgtagtcccagctactcagg

SEQ ID NO: 434136 - DNA, 20 bp, Artificial
  CRISPR gRNA sequence
tcccagctactcaggaggct

SEQ ID NO: 434137 - DNA, 20 bp, Artificial
  CRISPR gRNA sequence
cccagctactcaggaggctg

SEQ ID NO: 434138 - DNA, 20 bp, Artificial
  CRISPR gRNA sequence
agctactcaggaggctgagg

SEQ ID NO: 434139 - DNA, 20 bp, Artificial
  CRISPR gRNA sequence
tactcaggaggctgaggcag

SEQ ID NO: 434140 - DNA, 20 bp, Artificial
  CRISPR gRNA sequence
gcagtggaatcgcttgaacc

SEQ ID NO: 434141 - DNA, 20 bp, Artificial
  CRISPR gRNA sequence
cagtggaatcgcttgaaccc

SEQ ID NO: 434142 - DNA, 20 bp, Artificial
  CRISPR gRNA sequence
gtggaatcgcttgaacccag

SEQ ID NO: 434143 - DNA, 20 bp, Artificial
  CRISPR gRNA sequence
tggaatcgcttgaacccagg

SEQ ID NO: 434144 - DNA, 20 bp, Artificial
  CRISPR gRNA sequence
aatcgcttgaacccaggagg

SEQ ID NO: 434145 - DNA, 20 bp, Artificial
  CRISPR gRNA sequence
tcgcttgaacccaggaggtg

SEQ ID NO: 434146 - DNA, 20 bp, Artificial
  CRISPR gRNA sequence
cgcttgaacccaggaggtgg

SEQ ID NO: 434147 - DNA, 20 bp, Artificial
  CRISPR gRNA sequence
aacccaggaggtggaggttg

SEQ ID NO: 434148 - DNA, 20 bp, Artificial
  CRISPR gRNA sequence
caggaggtggaggttgcagt

SEQ ID NO: 434149 - DNA, 20 bp, Artificial
  CRISPR gRNA sequence
ggtggaggttgcagtgagcc

SEQ ID NO: 434150 - DNA, 20 bp, Artificial
  CRISPR gRNA sequence
gagatcacaccattgcactc

SEQ ID NO: 434151 - DNA, 20 bp, Artificial
  CRISPR gRNA sequence
cacaccattgcactccagcc

SEQ ID NO: 434152 - DNA, 20 bp, Artificial
  CRISPR gRNA sequence
attgcactccagcctggtga

SEQ ID NO: 434153 - DNA, 20 bp, Artificial
  CRISPR gRNA sequence
tgcactccagcctggtgaca

SEQ ID NO: 434154 - DNA, 20 bp, Artificial
  CRISPR gRNA sequence
ctccagcctggtgacagagc

SEQ ID NO: 434155 - DNA, 20 bp, Artificial
  CRISPR gRNA sequence
catatcaaaaaaataaaaaa

SEQ ID NO: 434156 - DNA, 20 bp, Artificial
  CRISPR gRNA sequence
aataaaaaaaagaccctcat

SEQ ID NO: 434157 - DNA, 20 bp, Artificial
  CRISPR gRNA sequence
ccctcatcagtacaactgct

SEQ ID NO: 434158 - DNA, 20 bp, Artificial
  CRISPR gRNA sequence
gctaagtaaacatgaatctt

SEQ ID NO: 434159 - DNA, 20 bp, Artificial
  CRISPR gRNA sequence
catgaatcttaagtgcacat

SEQ ID NO: 434160 - DNA, 20 bp, Artificial
  CRISPR gRNA sequence
taagattttaaatgtaaatc

SEQ ID NO: 434161 - DNA, 20 bp, Artificial
  CRISPR gRNA sequence
tttaaatgtaaatccagttt

SEQ ID NO: 434162 - DNA, 20 bp, Artificial
  CRISPR gRNA sequence
attatttttcttgataaaaa

SEQ ID NO: 434163 - DNA, 20 bp, Artificial
  CRISPR gRNA sequence
cattttgctatgaaaatgat

SEQ ID NO: 434164 - DNA, 20 bp, Artificial
  CRISPR gRNA sequence
tgaaaatgatcagtaaaatc

SEQ ID NO: 434165 - DNA, 20 bp, Artificial
  CRISPR gRNA sequence
caagcactgttgtgtcatta

SEQ ID NO: 434166 - DNA, 20 bp, Artificial
  CRISPR gRNA sequence
cattacagctttttttcaca

SEQ ID NO: 434167 - DNA, 20 bp, Artificial
  CRISPR gRNA sequence
agctttttttcacacagatt

SEQ ID NO: 434168 - DNA, 20 bp, Artificial
  CRISPR gRNA sequence
cacagatttggccaccaacc

SEQ ID NO: 434169 - DNA, 20 bp, Artificial
  CRISPR gRNA sequence
gatttggccaccaaccaaga

SEQ ID NO: 434170 - DNA, 20 bp, Artificial
  CRISPR gRNA sequence
tggccaccaaccaagatgga

SEQ ID NO: 434171 - DNA, 20 bp, Artificial
  CRISPR gRNA sequence
ggccaccaaccaagatggat

SEQ ID NO: 434172 - DNA, 20 bp, Artificial
  CRISPR gRNA sequence
accaaccaagatggatggga

SEQ ID NO: 434173 - DNA, 20 bp, Artificial
  CRISPR gRNA sequence
caagatggatgggacagttg

SEQ ID NO: 434174 - DNA, 20 bp, Artificial
  CRISPR gRNA sequence
aagatggatgggacagttga

SEQ ID NO: 434175 - DNA, 20 bp, Artificial
  CRISPR gRNA sequence
agatggatgggacagttgaa

SEQ ID NO: 434176 - DNA, 20 bp, Artificial
  CRISPR gRNA sequence
atggatgggacagttgaagg

SEQ ID NO: 434177 - DNA, 20 bp, Artificial
  CRISPR gRNA sequence
gatgggacagttgaagggag

SEQ ID NO: 434178 - DNA, 20 bp, Artificial
  CRISPR gRNA sequence
gggagtggcaatgttctttc

SEQ ID NO: 434179 - DNA, 20 bp, Artificial
  CRISPR gRNA sequence
gagtggcaatgttctttctg

SEQ ID NO: 434180 - DNA, 20 bp, Artificial
  CRISPR gRNA sequence
atgttctttctggagaaacc

SEQ ID NO: 434181 - DNA, 20 bp, Artificial
  CRISPR gRNA sequence
tggagaaaccaagatttgcc

SEQ ID NO: 434182 - DNA, 20 bp, Artificial
  CRISPR gRNA sequence
agaaaccaagatttgcctgg

SEQ ID NO: 434183 - DNA, 20 bp, Artificial
  CRISPR gRNA sequence
gaaaccaagatttgcctggt

SEQ ID NO: 434184 - DNA, 20 bp, Artificial
  CRISPR gRNA sequence
aaaccaagatttgcctggtg

SEQ ID NO: 434185 - DNA, 20 bp, Artificial
  CRISPR gRNA sequence
ccaagatttgcctggtgggg

SEQ ID NO: 434186 - DNA, 20 bp, Artificial
  CRISPR gRNA sequence
caagatttgcctggtggggc

SEQ ID NO: 434187 - DNA, 20 bp, Artificial
  CRISPR gRNA sequence
gatttgcctggtggggcagg

SEQ ID NO: 434188 - DNA, 20 bp, Artificial
  CRISPR gRNA sequence
ttgcctggtggggcaggtag

SEQ ID NO: 434189 - DNA, 20 bp, Artificial
  CRISPR gRNA sequence
cctggtggggcaggtagcag

SEQ ID NO: 434190 - DNA, 20 bp, Artificial
  CRISPR gRNA sequence
tggtggggcaggtagcagcg

SEQ ID NO: 434191 - DNA, 20 bp, Artificial
  CRISPR gRNA sequence
ggtggggcaggtagcagcgg

SEQ ID NO: 434192 - DNA, 20 bp, Artificial
  CRISPR gRNA sequence
gggcaggtagcagcggaggt

SEQ ID NO: 434193 - DNA, 20 bp, Artificial
  CRISPR gRNA sequence
gcagcggaggtgagatgtga

SEQ ID NO: 434194 - DNA, 20 bp, Artificial
  CRISPR gRNA sequence
gtgagatgtgatggccttaa

SEQ ID NO: 434195 - DNA, 20 bp, Artificial
  CRISPR gRNA sequence
gccttaacagtgtataaatt

SEQ ID NO: 434196 - DNA, 20 bp, Artificial
  CRISPR gRNA sequence
ttaacagtgtataaatttag

SEQ ID NO: 434197 - DNA, 20 bp, Artificial
  CRISPR gRNA sequence
tttagtagttaccatctatt

SEQ ID NO: 434198 - DNA, 20 bp, Artificial
  CRISPR gRNA sequence
accatctatttggtacttat

SEQ ID NO: 434199 - DNA, 20 bp, Artificial
  CRISPR gRNA sequence
ccatctatttggtacttatt

SEQ ID NO: 434200 - DNA, 20 bp, Artificial
  CRISPR gRNA sequence
atttggtacttattaggtgc

SEQ ID NO: 434201 - DNA, 20 bp, Artificial
  CRISPR gRNA sequence
tacttattaggtgccagaca

SEQ ID NO: 434202 - DNA, 20 bp, Artificial
  CRISPR gRNA sequence
taggtgccagacatggtgct

SEQ ID NO: 434203 - DNA, 20 bp, Artificial
  CRISPR gRNA sequence
atttaatcctcaaccacaat

SEQ ID NO: 434204 - DNA, 20 bp, Artificial
  CRISPR gRNA sequence
taatcctcaaccacaataag

SEQ ID NO: 434205 - DNA, 20 bp, Artificial
  CRISPR gRNA sequence
aatcctcaaccacaataagt

SEQ ID NO: 434206 - DNA, 20 bp, Artificial
  CRISPR gRNA sequence
ctactattttccccattttt

SEQ ID NO: 434207 - DNA, 20 bp, Artificial
  CRISPR gRNA sequence
ttttccccatttttcagatg

SEQ ID NO: 434208 - DNA, 20 bp, Artificial
  CRISPR gRNA sequence
atttttcagatgaagatact

SEQ ID NO: 434209 - DNA, 20 bp, Artificial
  CRISPR gRNA sequence
cagatgaagatactgagtct

SEQ ID NO: 434210 - DNA, 20 bp, Artificial
  CRISPR gRNA sequence
gatgaagatactgagtctga

SEQ ID NO: 434211 - DNA, 20 bp, Artificial
  CRISPR gRNA sequence
tgaagatactgagtctgaga

SEQ ID NO: 434212 - DNA, 20 bp, Artificial
  CRISPR gRNA sequence
ctgagagagccactttgccc

SEQ ID NO: 434213 - DNA, 20 bp, Artificial
  CRISPR gRNA sequence
ccactttgcccaagatcaca

SEQ ID NO: 434214 - DNA, 20 bp, Artificial
  CRISPR gRNA sequence
aagatcacacagctattaat

SEQ ID NO: 434215 - DNA, 20 bp, Artificial
  CRISPR gRNA sequence
agatcacacagctattaatt

SEQ ID NO: 434216 - DNA, 20 bp, Artificial
  CRISPR gRNA sequence
cacacagctattaattggga

SEQ ID NO: 434217 - DNA, 20 bp, Artificial
  CRISPR gRNA sequence
cagctattaattgggaaagc

SEQ ID NO: 434218 - DNA, 20 bp, Artificial
  CRISPR gRNA sequence
agctattaattgggaaagct

SEQ ID NO: 434219 - DNA, 20 bp, Artificial
  CRISPR gRNA sequence
attgggaaagctaggattta

SEQ ID NO: 434220 - DNA, 20 bp, Artificial
  CRISPR gRNA sequence
gggaaagctaggatttaaag

SEQ ID NO: 434221 - DNA, 20 bp, Artificial
  CRISPR gRNA sequence
gatttaaagcagatctactc

SEQ ID NO: 434222 - DNA, 20 bp, Artificial
  CRISPR gRNA sequence
tttaaagcagatctactcta

SEQ ID NO: 434223 - DNA, 20 bp, Artificial
  CRISPR gRNA sequence
agcagatctactctagagct

SEQ ID NO: 434224 - DNA, 20 bp, Artificial
  CRISPR gRNA sequence
gcagatctactctagagctg

SEQ ID NO: 434225 - DNA, 20 bp, Artificial
  CRISPR gRNA sequence
ctgaggactcacctgtgacc

SEQ ID NO: 434226 - DNA, 20 bp, Artificial
  CRISPR gRNA sequence
tgacccagtccttactcctt

SEQ ID NO: 434227 - DNA, 20 bp, Artificial
  CRISPR gRNA sequence
gacccagtccttactccttc

SEQ ID NO: 434228 - DNA, 20 bp, Artificial
  CRISPR gRNA sequence
ccagtccttactccttcagg

SEQ ID NO: 434229 - DNA, 20 bp, Artificial
  CRISPR gRNA sequence
gtccttactccttcaggtag

SEQ ID NO: 434230 - DNA, 20 bp, Artificial
  CRISPR gRNA sequence
tactccttcaggtagaagac

SEQ ID NO: 434231 - DNA, 20 bp, Artificial
  CRISPR gRNA sequence
tttgttctgtgttcaaattc

SEQ ID NO: 434232 - DNA, 20 bp, Artificial
  CRISPR gRNA sequence
ttgttctgtgttcaaattcc

SEQ ID NO: 434233 - DNA, 20 bp, Artificial
  CRISPR gRNA sequence
gtgttcaaattccaggccct

SEQ ID NO: 434234 - DNA, 20 bp, Artificial
  CRISPR gRNA sequence
ccttggatctcttactttta

SEQ ID NO: 434235 - DNA, 20 bp, Artificial
  CRISPR gRNA sequence
cttggatctcttacttttaa

SEQ ID NO: 434236 - DNA, 20 bp, Artificial
  CRISPR gRNA sequence
ttttttttttttttttttct

SEQ ID NO: 434237 - DNA, 20 bp, Artificial
  CRISPR gRNA sequence
ttttttttttttttctgaga

SEQ ID NO: 434238 - DNA, 20 bp, Artificial
  CRISPR gRNA sequence
tttttttttttttctgagaa

SEQ ID NO: 434239 - DNA, 20 bp, Artificial
  CRISPR gRNA sequence
ttttttttttttctgagaaa

SEQ ID NO: 434240 - DNA, 20 bp, Artificial
  CRISPR gRNA sequence
aagggtctcgctctgttgcc

SEQ ID NO: 434241 - DNA, 20 bp, Artificial
  CRISPR gRNA sequence
agggtctcgctctgttgccc

SEQ ID NO: 434242 - DNA, 20 bp, Artificial
  CRISPR gRNA sequence
ctcgctctgttgcccaggtt

SEQ ID NO: 434243 - DNA, 20 bp, Artificial
  CRISPR gRNA sequence
cgctctgttgcccaggtttg

SEQ ID NO: 434244 - DNA, 20 bp, Artificial
  CRISPR gRNA sequence
tgttgcccaggtttggagta

SEQ ID NO: 434245 - DNA, 20 bp, Artificial
  CRISPR gRNA sequence
tgcccaggtttggagtacag

SEQ ID NO: 434246 - DNA, 20 bp, Artificial
  CRISPR gRNA sequence
ggagtacagtggcaccaact

SEQ ID NO: 434247 - DNA, 20 bp, Artificial
  CRISPR gRNA sequence
acagtggcaccaactcggct

SEQ ID NO: 434248 - DNA, 20 bp, Artificial
  CRISPR gRNA sequence
cagtgaatcctcaacctcct

SEQ ID NO: 434249 - DNA, 20 bp, Artificial
  CRISPR gRNA sequence
atcctcaacctcctgagttc

SEQ ID NO: 434250 - DNA, 20 bp, Artificial
  CRISPR gRNA sequence
ttcaagcaatcttcctgcct

SEQ ID NO: 434251 - DNA, 20 bp, Artificial
  CRISPR gRNA sequence
cttcctgcctcagccctgcc

SEQ ID NO: 434252 - DNA, 20 bp, Artificial
  CRISPR gRNA sequence
cctgcctcagccctgccaag

SEQ ID NO: 434253 - DNA, 20 bp, Artificial
  CRISPR gRNA sequence
cctcagccctgccaagtagc

SEQ ID NO: 434254 - DNA, 20 bp, Artificial
  CRISPR gRNA sequence
ctcagccctgccaagtagct

SEQ ID NO: 434255 - DNA, 20 bp, Artificial
  CRISPR gRNA sequence
ctgccaagtagctgggacta

SEQ ID NO: 434256 - DNA, 20 bp, Artificial
  CRISPR gRNA sequence
tgccaagtagctgggactac

SEQ ID NO: 434257 - DNA, 20 bp, Artificial
  CRISPR gRNA sequence
caggcacatgccaccatgcc

SEQ ID NO: 434258 - DNA, 20 bp, Artificial
  CRISPR gRNA sequence
tttttttttttttttttttt

SEQ ID NO: 434259 - DNA, 20 bp, Artificial
  CRISPR gRNA sequence
tttttttttttttttttttt

SEQ ID NO: 434260 - DNA, 20 bp, Artificial
  CRISPR gRNA sequence
ttttttttttttttttggga

SEQ ID NO: 434261 - DNA, 20 bp, Artificial
  CRISPR gRNA sequence
tggaatctcgctctgttttc

SEQ ID NO: 434262 - DNA, 20 bp, Artificial
  CRISPR gRNA sequence
ggaatctcgctctgttttcc

SEQ ID NO: 434263 - DNA, 20 bp, Artificial
  CRISPR gRNA sequence
tcgctctgttttccaggctt

SEQ ID NO: 434264 - DNA, 20 bp, Artificial
  CRISPR gRNA sequence
cgctctgttttccaggcttc

SEQ ID NO: 434265 - DNA, 20 bp, Artificial
  CRISPR gRNA sequence
ctgttttccaggcttcagga

SEQ ID NO: 434266 - DNA, 20 bp, Artificial
  CRISPR gRNA sequence
ttttccaggcttcaggacag

SEQ ID NO: 434267 - DNA, 20 bp, Artificial
  CRISPR gRNA sequence
ccaggcttcaggacagtggt

SEQ ID NO: 434268 - DNA, 20 bp, Artificial
  CRISPR gRNA sequence
tcaggacagtggtgagatct

SEQ ID NO: 434269 - DNA, 20 bp, Artificial
  CRISPR gRNA sequence
agatctcggttcactcctcc

SEQ ID NO: 434270 - DNA, 20 bp, Artificial
  CRISPR gRNA sequence
gatctcggttcactcctccc

SEQ ID NO: 434271 - DNA, 20 bp, Artificial
  CRISPR gRNA sequence
cggttcactcctcccaggct

SEQ ID NO: 434272 - DNA, 20 bp, Artificial
  CRISPR gRNA sequence
ctcagacaattctcctgcct

SEQ ID NO: 434273 - DNA, 20 bp, Artificial
  CRISPR gRNA sequence
ttctcctgcctcagcctcct

SEQ ID NO: 434274 - DNA, 20 bp, Artificial
  CRISPR gRNA sequence
tcctgcctcagcctcctgag

SEQ ID NO: 434275 - DNA, 20 bp, Artificial
  CRISPR gRNA sequence
gcctcagcctcctgagtagc

SEQ ID NO: 434276 - DNA, 20 bp, Artificial
  CRISPR gRNA sequence
ctcctgagtagctggaatta

SEQ ID NO: 434277 - DNA, 20 bp, Artificial
  CRISPR gRNA sequence
tcctgagtagctggaattat

SEQ ID NO: 434278 - DNA, 20 bp, Artificial
  CRISPR gRNA sequence
taggcatgcaccaccatgac

SEQ ID NO: 434279 - DNA, 20 bp, Artificial
  CRISPR gRNA sequence
ccagctaatttttgtatttt

SEQ ID NO: 434280 - DNA, 20 bp, Artificial
  CRISPR gRNA sequence
gctaatttttgtatttttag

SEQ ID NO: 434281 - DNA, 20 bp, Artificial
  CRISPR gRNA sequence
taatttttgtatttttagta

SEQ ID NO: 434282 - DNA, 20 bp, Artificial
  CRISPR gRNA sequence
ttttgtatttttagtagaga

SEQ ID NO: 434283 - DNA, 20 bp, Artificial
  CRISPR gRNA sequence
tttgtatttttagtagagac

SEQ ID NO: 434284 - DNA, 20 bp, Artificial
  CRISPR gRNA sequence
ttgtatttttagtagagaca

SEQ ID NO: 434285 - DNA, 20 bp, Artificial
  CRISPR gRNA sequence
tgtatttttagtagagacag

SEQ ID NO: 434286 - DNA, 20 bp, Artificial
  CRISPR gRNA sequence
agacaggggtttcaccatct

SEQ ID NO: 434287 - DNA, 20 bp, Artificial
  CRISPR gRNA sequence
aggggtttcaccatcttggc

SEQ ID NO: 434288 - DNA, 20 bp, Artificial
  CRISPR gRNA sequence
ggggtttcaccatcttggcc

SEQ ID NO: 434289 - DNA, 20 bp, Artificial
  CRISPR gRNA sequence
tttcaccatcttggccaggc

SEQ ID NO: 434290 - DNA, 20 bp, Artificial
  CRISPR gRNA sequence
ctggcttaaactcctgacct

SEQ ID NO: 434291 - DNA, 20 bp, Artificial
  CRISPR gRNA sequence
tggcttaaactcctgacctc

SEQ ID NO: 434292 - DNA, 20 bp, Artificial
  CRISPR gRNA sequence
ctcaggtgatccatctgcct

SEQ ID NO: 434293 - DNA, 20 bp, Artificial
  CRISPR gRNA sequence
ccatctgccttggcctccca

SEQ ID NO: 434294 - DNA, 20 bp, Artificial
  CRISPR gRNA sequence
gccttggcctcccaaagtgc

SEQ ID NO: 434295 - DNA, 20 bp, Artificial
  CRISPR gRNA sequence
ccttggcctcccaaagtgct

SEQ ID NO: 434296 - DNA, 20 bp, Artificial
  CRISPR gRNA sequence
ctcccaaagtgctgggatta

SEQ ID NO: 434297 - DNA, 20 bp, Artificial
  CRISPR gRNA sequence
tcccaaagtgctgggattac

SEQ ID NO: 434298 - DNA, 20 bp, Artificial
  CRISPR gRNA sequence
agtgctgggattacaggtgt

SEQ ID NO: 434299 - DNA, 20 bp, Artificial
  CRISPR gRNA sequence
caggtgtgagccactgcact

SEQ ID NO: 434300 - DNA, 20 bp, Artificial
  CRISPR gRNA sequence
agcctaattttttgtattct

SEQ ID NO: 434301 - DNA, 20 bp, Artificial
  CRISPR gRNA sequence
ctaattttttgtattcttag

SEQ ID NO: 434302 - DNA, 20 bp, Artificial
  CRISPR gRNA sequence
aattttttgtattcttagta

SEQ ID NO: 434303 - DNA, 20 bp, Artificial
  CRISPR gRNA sequence
ttttgtattcttagtagaga

SEQ ID NO: 434304 - DNA, 20 bp, Artificial
  CRISPR gRNA sequence
tttgtattcttagtagagat

SEQ ID NO: 434305 - DNA, 20 bp, Artificial
  CRISPR gRNA sequence
ttgtattcttagtagagatg

SEQ ID NO: 434306 - DNA, 20 bp, Artificial
  CRISPR gRNA sequence
tggggttttgccatgttgcc

SEQ ID NO: 434307 - DNA, 20 bp, Artificial
  CRISPR gRNA sequence
ggggttttgccatgttgccc

SEQ ID NO: 434308 - DNA, 20 bp, Artificial
  CRISPR gRNA sequence
ttttgccatgttgcccaggc

SEQ ID NO: 434309 - DNA, 20 bp, Artificial
  CRISPR gRNA sequence
caggctggtcttgaactcct

SEQ ID NO: 434310 - DNA, 20 bp, Artificial
  CRISPR gRNA sequence
ggtcttgaactcctgagctc

SEQ ID NO: 434311 - DNA, 20 bp, Artificial
  CRISPR gRNA sequence
ctccagtgatctgcctgcct

SEQ ID NO: 434312 - DNA, 20 bp, Artificial
  CRISPR gRNA sequence
ctgcctgccttggcctccca

SEQ ID NO: 434313 - DNA, 20 bp, Artificial
  CRISPR gRNA sequence
gccttggcctcccatagtgc

SEQ ID NO: 434314 - DNA, 20 bp, Artificial
  CRISPR gRNA sequence
ccttggcctcccatagtgct

SEQ ID NO: 434315 - DNA, 20 bp, Artificial
  CRISPR gRNA sequence
agtgctgggattacacatgt

SEQ ID NO: 434316 - DNA, 20 bp, Artificial
  CRISPR gRNA sequence
cacatgtgagccactgtgcc

SEQ ID NO: 434317 - DNA, 20 bp, Artificial
  CRISPR gRNA sequence
atgctcccacatcccacatt

SEQ ID NO: 434318 - DNA, 20 bp, Artificial
  CRISPR gRNA sequence
gctcccacatcccacattta

SEQ ID NO: 434319 - DNA, 20 bp, Artificial
  CRISPR gRNA sequence
ccacatcccacatttagagt

SEQ ID NO: 434320 - DNA, 20 bp, Artificial
  CRISPR gRNA sequence
cacatttagagttggtttgc

SEQ ID NO: 434321 - DNA, 20 bp, Artificial
  CRISPR gRNA sequence
atttagagttggtttgccag

SEQ ID NO: 434322 - DNA, 20 bp, Artificial
  CRISPR gRNA sequence
ttacataatgttacatatta

SEQ ID NO: 434323 - DNA, 20 bp, Artificial
  CRISPR gRNA sequence
ttttattttattttcctatt

SEQ ID NO: 434324 - DNA, 20 bp, Artificial
  CRISPR gRNA sequence
tttattttattttcctattt

SEQ ID NO: 434325 - DNA, 20 bp, Artificial
  CRISPR gRNA sequence
tattttattttcctatttag

SEQ ID NO: 434326 - DNA, 20 bp, Artificial
  CRISPR gRNA sequence
aggagctactgacctatttt

SEQ ID NO: 434327 - DNA, 20 bp, Artificial
  CRISPR gRNA sequence
gttgtttcaatattttttct

SEQ ID NO: 434328 - DNA, 20 bp, Artificial
  CRISPR gRNA sequence
tttcaatattttttctcagt

SEQ ID NO: 434329 - DNA, 20 bp, Artificial
  CRISPR gRNA sequence
ttcaatattttttctcagtc

SEQ ID NO: 434330 - DNA, 20 bp, Artificial
  CRISPR gRNA sequence
tttttctcagtcaggccctt

SEQ ID NO: 434331 - DNA, 20 bp, Artificial
  CRISPR gRNA sequence
ttctcagtcaggcccttgag

SEQ ID NO: 434332 - DNA, 20 bp, Artificial
  CRISPR gRNA sequence
agtcaggcccttgagaagct

SEQ ID NO: 434333 - DNA, 20 bp, Artificial
  CRISPR gRNA sequence
tcaggcccttgagaagctca

SEQ ID NO: 434334 - DNA, 20 bp, Artificial
  CRISPR gRNA sequence
caggcccttgagaagctcag

SEQ ID NO: 434335 - DNA, 20 bp, Artificial
  CRISPR gRNA sequence
cttgagaagctcagaggttc

SEQ ID NO: 434336 - DNA, 20 bp, Artificial
  CRISPR gRNA sequence
ttgagaagctcagaggttcg

SEQ ID NO: 434337 - DNA, 20 bp, Artificial
  CRISPR gRNA sequence
tattcccatttttgttgccc

SEQ ID NO: 434338 - DNA, 20 bp, Artificial
  CRISPR gRNA sequence
ttcccatttttgttgcccta

SEQ ID NO: 434339 - DNA, 20 bp, Artificial
  CRISPR gRNA sequence
tcccatttttgttgccctag

SEQ ID NO: 434340 - DNA, 20 bp, Artificial
  CRISPR gRNA sequence
cccatttttgttgccctaga

SEQ ID NO: 434341 - DNA, 20 bp, Artificial
  CRISPR gRNA sequence
atttttgttgccctagaggg

SEQ ID NO: 434342 - DNA, 20 bp, Artificial
  CRISPR gRNA sequence
tttttgttgccctagaggga

SEQ ID NO: 434343 - DNA, 20 bp, Artificial
  CRISPR gRNA sequence
gaactaacaaacaaaaacta

SEQ ID NO: 434344 - DNA, 20 bp, Artificial
  CRISPR gRNA sequence
aactaacaaacaaaaactaa

SEQ ID NO: 434345 - DNA, 20 bp, Artificial
  CRISPR gRNA sequence
actaacaaacaaaaactaaa

SEQ ID NO: 434346 - DNA, 20 bp, Artificial
  CRISPR gRNA sequence
aacaaacaaaaactaaaggg

SEQ ID NO: 434347 - DNA, 20 bp, Artificial
  CRISPR gRNA sequence
acaaacaaaaactaaaggga

SEQ ID NO: 434348 - DNA, 20 bp, Artificial
  CRISPR gRNA sequence
acaaaaactaaagggaaggc

SEQ ID NO: 434349 - DNA, 20 bp, Artificial
  CRISPR gRNA sequence
caaaaactaaagggaaggct

SEQ ID NO: 434350 - DNA, 20 bp, Artificial
  CRISPR gRNA sequence
actaaagggaaggctgggcg

SEQ ID NO: 434351 - DNA, 20 bp, Artificial
  CRISPR gRNA sequence
aaagggaaggctgggcgtgg

SEQ ID NO: 434352 - DNA, 20 bp, Artificial
  CRISPR gRNA sequence
gtggcttacacctgtaatcc

SEQ ID NO: 434353 - DNA, 20 bp, Artificial
  CRISPR gRNA sequence
cacctgtaatcccagcgctt

SEQ ID NO: 434354 - DNA, 20 bp, Artificial
  CRISPR gRNA sequence
acctgtaatcccagcgcttt

SEQ ID NO: 434355 - DNA, 20 bp, Artificial
  CRISPR gRNA sequence
ctgtaatcccagcgctttgg

SEQ ID NO: 434356 - DNA, 20 bp, Artificial
  CRISPR gRNA sequence
tgtaatcccagcgctttggg

SEQ ID NO: 434357 - DNA, 20 bp, Artificial
  CRISPR gRNA sequence
tcccagcgctttgggaggcc

SEQ ID NO: 434358 - DNA, 20 bp, Artificial
  CRISPR gRNA sequence
cccagcgctttgggaggccg

SEQ ID NO: 434359 - DNA, 20 bp, Artificial
  CRISPR gRNA sequence
agcgctttgggaggccgagg

SEQ ID NO: 434360 - DNA, 20 bp, Artificial
  CRISPR gRNA sequence
cgctttgggaggccgaggca

SEQ ID NO: 434361 - DNA, 20 bp, Artificial
  CRISPR gRNA sequence
gctttgggaggccgaggcag

SEQ ID NO: 434362 - DNA, 20 bp, Artificial
  CRISPR gRNA sequence
ctttgggaggccgaggcaga

SEQ ID NO: 434363 - DNA, 20 bp, Artificial
  CRISPR gRNA sequence
ccgaggcagagggatcacct

SEQ ID NO: 434364 - DNA, 20 bp, Artificial
  CRISPR gRNA sequence
cgaggcagagggatcacctg

SEQ ID NO: 434365 - DNA, 20 bp, Artificial
  CRISPR gRNA sequence
gcagagggatcacctgaggt

SEQ ID NO: 434366 - DNA, 20 bp, Artificial
  CRISPR gRNA sequence
cagagggatcacctgaggtt

SEQ ID NO: 434367 - DNA, 20 bp, Artificial
  CRISPR gRNA sequence
gagggatcacctgaggttag

SEQ ID NO: 434368 - DNA, 20 bp, Artificial
  CRISPR gRNA sequence
tcacctgaggttaggagttc

SEQ ID NO: 434369 - DNA, 20 bp, Artificial
  CRISPR gRNA sequence
tgaggttaggagttcgagac

SEQ ID NO: 434370 - DNA, 20 bp, Artificial
  CRISPR gRNA sequence
ttaggagttcgagaccagca

SEQ ID NO: 434371 - DNA, 20 bp, Artificial
  CRISPR gRNA sequence
cgagaccagcatggccacca

SEQ ID NO: 434372 - DNA, 20 bp, Artificial
  CRISPR gRNA sequence
tctaataaaaatacaaaaat

SEQ ID NO: 434373 - DNA, 20 bp, Artificial
  CRISPR gRNA sequence
aataaaaatacaaaaattag

SEQ ID NO: 434374 - DNA, 20 bp, Artificial
  CRISPR gRNA sequence
ataaaaatacaaaaattagc

SEQ ID NO: 434375 - DNA, 20 bp, Artificial
  CRISPR gRNA sequence
taaaaatacaaaaattagcg

SEQ ID NO: 434376 - DNA, 20 bp, Artificial
  CRISPR gRNA sequence
atacaaaaattagcggggcg

SEQ ID NO: 434377 - DNA, 20 bp, Artificial
  CRISPR gRNA sequence
caaaaattagcggggcgtgg

SEQ ID NO: 434378 - DNA, 20 bp, Artificial
  CRISPR gRNA sequence
gtggcgcgcgtctgtaatcc

SEQ ID NO: 434379 - DNA, 20 bp, Artificial
  CRISPR gRNA sequence
cgtctgtaatcccagctact

SEQ ID NO: 434380 - DNA, 20 bp, Artificial
  CRISPR gRNA sequence
gtctgtaatcccagctactt

SEQ ID NO: 434381 - DNA, 20 bp, Artificial
  CRISPR gRNA sequence
ctgtaatcccagctacttgg

SEQ ID NO: 434382 - DNA, 20 bp, Artificial
  CRISPR gRNA sequence
tgtaatcccagctacttggg

SEQ ID NO: 434383 - DNA, 20 bp, Artificial
  CRISPR gRNA sequence
tcccagctacttgggaggct

SEQ ID NO: 434384 - DNA, 20 bp, Artificial
  CRISPR gRNA sequence
cccagctacttgggaggctg

SEQ ID NO: 434385 - DNA, 20 bp, Artificial
  CRISPR gRNA sequence
agctacttgggaggctgagg

SEQ ID NO: 434386 - DNA, 20 bp, Artificial
  CRISPR gRNA sequence
gctacttgggaggctgaggc

SEQ ID NO: 434387 - DNA, 20 bp, Artificial
  CRISPR gRNA sequence
tacttgggaggctgaggcag

SEQ ID NO: 434388 - DNA, 20 bp, Artificial
  CRISPR gRNA sequence
gggaggctgaggcaggagaa

SEQ ID NO: 434389 - DNA, 20 bp, Artificial
  CRISPR gRNA sequence
gcaggagaatggcatgaacc

SEQ ID NO: 434390 - DNA, 20 bp, Artificial
  CRISPR gRNA sequence
caggagaatggcatgaacct

SEQ ID NO: 434391 - DNA, 20 bp, Artificial
  CRISPR gRNA sequence
ggagaatggcatgaacctgg

SEQ ID NO: 434392 - DNA, 20 bp, Artificial
  CRISPR gRNA sequence
gagaatggcatgaacctggg

SEQ ID NO: 434393 - DNA, 20 bp, Artificial
  CRISPR gRNA sequence
aatggcatgaacctgggagg

SEQ ID NO: 434394 - DNA, 20 bp, Artificial
  CRISPR gRNA sequence
tggcatgaacctgggaggca

SEQ ID NO: 434395 - DNA, 20 bp, Artificial
  CRISPR gRNA sequence
aacctgggaggcagagtttg

SEQ ID NO: 434396 - DNA, 20 bp, Artificial
  CRISPR gRNA sequence
tgggaggcagagtttgcagt

SEQ ID NO: 434397 - DNA, 20 bp, Artificial
  CRISPR gRNA sequence
ggcagagtttgcagtgagcc

SEQ ID NO: 434398 - DNA, 20 bp, Artificial
  CRISPR gRNA sequence
aagatcgtgtcattgcactc

SEQ ID NO: 434399 - DNA, 20 bp, Artificial
  CRISPR gRNA sequence
cgtgtcattgcactccagcc

SEQ ID NO: 434400 - DNA, 20 bp, Artificial
  CRISPR gRNA sequence
gtgtcattgcactccagcct

SEQ ID NO: 434401 - DNA, 20 bp, Artificial
  CRISPR gRNA sequence
cattgcactccagcctgggt

SEQ ID NO: 434402 - DNA, 20 bp, Artificial
  CRISPR gRNA sequence
ttgcactccagcctgggtga

SEQ ID NO: 434403 - DNA, 20 bp, Artificial
  CRISPR gRNA sequence
gcactccagcctgggtgaga

SEQ ID NO: 434404 - DNA, 20 bp, Artificial
  CRISPR gRNA sequence
tccagcctgggtgagagagt

SEQ ID NO: 434405 - DNA, 20 bp, Artificial
  CRISPR gRNA sequence
ccgtctcaaaaaaaaaaaaa

SEQ ID NO: 434406 - DNA, 20 bp, Artificial
  CRISPR gRNA sequence
cgtctcaaaaaaaaaaaaaa

SEQ ID NO: 434407 - DNA, 20 bp, Artificial
  CRISPR gRNA sequence
tcaaaaaaaaaaaaaaagga

SEQ ID NO: 434408 - DNA, 20 bp, Artificial
  CRISPR gRNA sequence
aaaaaaggaaagaaaaacta

SEQ ID NO: 434409 - DNA, 20 bp, Artificial
  CRISPR gRNA sequence
aaaaaggaaagaaaaactaa

SEQ ID NO: 434410 - DNA, 20 bp, Artificial
  CRISPR gRNA sequence
aggaaagaaaaactaaagga

SEQ ID NO: 434411 - DNA, 20 bp, Artificial
  CRISPR gRNA sequence
aaagaaaaactaaaggaaag

SEQ ID NO: 434412 - DNA, 20 bp, Artificial
  CRISPR gRNA sequence
ggaaagaagacttctgtctg

SEQ ID NO: 434413 - DNA, 20 bp, Artificial
  CRISPR gRNA sequence
aagaagacttctgtctgtgg

SEQ ID NO: 434414 - DNA, 20 bp, Artificial
  CRISPR gRNA sequence
gaagacttctgtctgtggta

SEQ ID NO: 434415 - DNA, 20 bp, Artificial
  CRISPR gRNA sequence
cttctgtctgtggtagagac

SEQ ID NO: 434416 - DNA, 20 bp, Artificial
  CRISPR gRNA sequence
tctgtggtagagacaagtat

SEQ ID NO: 434417 - DNA, 20 bp, Artificial
  CRISPR gRNA sequence
ctgtggtagagacaagtata

SEQ ID NO: 434418 - DNA, 20 bp, Artificial
  CRISPR gRNA sequence
aaggaaatgcaccacctcga

SEQ ID NO: 434419 - DNA, 20 bp, Artificial
  CRISPR gRNA sequence
aggaaatgcaccacctcgac

SEQ ID NO: 434420 - DNA, 20 bp, Artificial
  CRISPR gRNA sequence
ggaaatgcaccacctcgaca

SEQ ID NO: 434421 - DNA, 20 bp, Artificial
  CRISPR gRNA sequence
aaatgcaccacctcgacagg

SEQ ID NO: 434422 - DNA, 20 bp, Artificial
  CRISPR gRNA sequence
cagggagtgaactccgtcta

SEQ ID NO: 434423 - DNA, 20 bp, Artificial
  CRISPR gRNA sequence
gtctacagcaaatgcccatt

SEQ ID NO: 434424 - DNA, 20 bp, Artificial
  CRISPR gRNA sequence
tacagcaaatgcccattcag

SEQ ID NO: 434425 - DNA, 20 bp, Artificial
  CRISPR gRNA sequence
atgcccattcagtggtgatg

SEQ ID NO: 434426 - DNA, 20 bp, Artificial
  CRISPR gRNA sequence
ttcagtggtgatgtagtaaa

SEQ ID NO: 434427 - DNA, 20 bp, Artificial
  CRISPR gRNA sequence
ggtgatgtagtaaaaagtac

SEQ ID NO: 434428 - DNA, 20 bp, Artificial
  CRISPR gRNA sequence
atgtagtaaaaagtactggc

SEQ ID NO: 434429 - DNA, 20 bp, Artificial
  CRISPR gRNA sequence
tgtagtaaaaagtactggcc

SEQ ID NO: 434430 - DNA, 20 bp, Artificial
  CRISPR gRNA sequence
taaaaagtactggccgggcg

SEQ ID NO: 434431 - DNA, 20 bp, Artificial
  CRISPR gRNA sequence
aaagtactggccgggcgcgg

SEQ ID NO: 434432 - DNA, 20 bp, Artificial
  CRISPR gRNA sequence
gtggctcacgcgtgtaatcc

SEQ ID NO: 434433 - DNA, 20 bp, Artificial
  CRISPR gRNA sequence
cgcgtgtaatcccagcactt

SEQ ID NO: 434434 - DNA, 20 bp, Artificial
  CRISPR gRNA sequence
gcgtgtaatcccagcacttt

SEQ ID NO: 434435 - DNA, 20 bp, Artificial
  CRISPR gRNA sequence
gtgtaatcccagcactttgg

SEQ ID NO: 434436 - DNA, 20 bp, Artificial
  CRISPR gRNA sequence
tgtaatcccagcactttggg

SEQ ID NO: 434437 - DNA, 20 bp, Artificial
  CRISPR gRNA sequence
tcccagcactttgggaggcc

SEQ ID NO: 434438 - DNA, 20 bp, Artificial
  CRISPR gRNA sequence
cccagcactttgggaggccg

SEQ ID NO: 434439 - DNA, 20 bp, Artificial
  CRISPR gRNA sequence
agcactttgggaggccgagg

SEQ ID NO: 434440 - DNA, 20 bp, Artificial
  CRISPR gRNA sequence
gcactttgggaggccgaggc

SEQ ID NO: 434441 - DNA, 20 bp, Artificial
  CRISPR gRNA sequence
actttgggaggccgaggcgg

SEQ ID NO: 434442 - DNA, 20 bp, Artificial
  CRISPR gRNA sequence
ctttgggaggccgaggcggg

SEQ ID NO: 434443 - DNA, 20 bp, Artificial
  CRISPR gRNA sequence
ggccgaggcgggaggatcac

SEQ ID NO: 434444 - DNA, 20 bp, Artificial
  CRISPR gRNA sequence
gccgaggcgggaggatcaca

SEQ ID NO: 434445 - DNA, 20 bp, Artificial
  CRISPR gRNA sequence
aggcgggaggatcacaaggt

SEQ ID NO: 434446 - DNA, 20 bp, Artificial
  CRISPR gRNA sequence
ggcgggaggatcacaaggtc

SEQ ID NO: 434447 - DNA, 20 bp, Artificial
  CRISPR gRNA sequence
cgggaggatcacaaggtcag

SEQ ID NO: 434448 - DNA, 20 bp, Artificial
  CRISPR gRNA sequence
aggatcacaaggtcaggaga

SEQ ID NO: 434449 - DNA, 20 bp, Artificial
  CRISPR gRNA sequence
gatcacaaggtcaggagatg

SEQ ID NO: 434450 - DNA, 20 bp, Artificial
  CRISPR gRNA sequence
tcaggagatggagaccatcc

SEQ ID NO: 434451 - DNA, 20 bp, Artificial
  CRISPR gRNA sequence
ggagaccatcctggctaaca

SEQ ID NO: 434452 - DNA, 20 bp, Artificial
  CRISPR gRNA sequence
tctctactaaaaatacaaaa

SEQ ID NO: 434453 - DNA, 20 bp, Artificial
  CRISPR gRNA sequence
aatacaaaaaagaaaaaaat

SEQ ID NO: 434454 - DNA, 20 bp, Artificial
  CRISPR gRNA sequence
caaaaaagaaaaaaattagc

SEQ ID NO: 434455 - DNA, 20 bp, Artificial
  CRISPR gRNA sequence
aaaaaagaaaaaaattagct

SEQ ID NO: 434456 - DNA, 20 bp, Artificial
  CRISPR gRNA sequence
aaaaaattagctgggcttga

SEQ ID NO: 434457 - DNA, 20 bp, Artificial
  CRISPR gRNA sequence
aaattagctgggcttgatgg

SEQ ID NO: 434458 - DNA, 20 bp, Artificial
  CRISPR gRNA sequence
aattagctgggcttgatggt

SEQ ID NO: 434459 - DNA, 20 bp, Artificial
  CRISPR gRNA sequence
ggcttgatggtgggcgcctg

SEQ ID NO: 434460 - DNA, 20 bp, Artificial
  CRISPR gRNA sequence
atggtgggcgcctgtagtcc

SEQ ID NO: 434461 - DNA, 20 bp, Artificial
  CRISPR gRNA sequence
cgcctgtagtcccagctact

SEQ ID NO: 434462 - DNA, 20 bp, Artificial
  CRISPR gRNA sequence
gcctgtagtcccagctactt

SEQ ID NO: 434463 - DNA, 20 bp, Artificial
  CRISPR gRNA sequence
ctgtagtcccagctacttgg

SEQ ID NO: 434464 - DNA, 20 bp, Artificial
  CRISPR gRNA sequence
tgtagtcccagctacttggg

SEQ ID NO: 434465 - DNA, 20 bp, Artificial
  CRISPR gRNA sequence
tcccagctacttgggaggct

SEQ ID NO: 434466 - DNA, 20 bp, Artificial
  CRISPR gRNA sequence
cccagctacttgggaggctg

SEQ ID NO: 434467 - DNA, 20 bp, Artificial
  CRISPR gRNA sequence
agctacttgggaggctgagg

SEQ ID NO: 434468 - DNA, 20 bp, Artificial
  CRISPR gRNA sequence
gctacttgggaggctgaggc

SEQ ID NO: 434469 - DNA, 20 bp, Artificial
  CRISPR gRNA sequence
tacttgggaggctgaggcag

SEQ ID NO: 434470 - DNA, 20 bp, Artificial
  CRISPR gRNA sequence
gggaggctgaggcaggagaa

SEQ ID NO: 434471 - DNA, 20 bp, Artificial
  CRISPR gRNA sequence
gcaggagaatggcgtgaacc

SEQ ID NO: 434472 - DNA, 20 bp, Artificial
  CRISPR gRNA sequence
caggagaatggcgtgaaccc

SEQ ID NO: 434473 - DNA, 20 bp, Artificial
  CRISPR gRNA sequence
ggagaatggcgtgaacccag

SEQ ID NO: 434474 - DNA, 20 bp, Artificial
  CRISPR gRNA sequence
gagaatggcgtgaacccagg

SEQ ID NO: 434475 - DNA, 20 bp, Artificial
  CRISPR gRNA sequence
aatggcgtgaacccaggagg

SEQ ID NO: 434476 - DNA, 20 bp, Artificial
  CRISPR gRNA sequence
aacccaggaggcggaacttg

SEQ ID NO: 434477 - DNA, 20 bp, Artificial
  CRISPR gRNA sequence
caggaggcggaacttgcagt

SEQ ID NO: 434478 - DNA, 20 bp, Artificial
  CRISPR gRNA sequence
ggcggaacttgcagtgagcc

SEQ ID NO: 434479 - DNA, 20 bp, Artificial
  CRISPR gRNA sequence
gagattgcgccactgcactc

SEQ ID NO: 434480 - DNA, 20 bp, Artificial
  CRISPR gRNA sequence
tgcgccactgcactctagtc

SEQ ID NO: 434481 - DNA, 20 bp, Artificial
  CRISPR gRNA sequence
gcgccactgcactctagtct

SEQ ID NO: 434482 - DNA, 20 bp, Artificial
  CRISPR gRNA sequence
ctgcactctagtctgggtga

SEQ ID NO: 434483 - DNA, 20 bp, Artificial
  CRISPR gRNA sequence
gcactctagtctgggtgaca

SEQ ID NO: 434484 - DNA, 20 bp, Artificial
  CRISPR gRNA sequence
tctagtctgggtgacagagc

SEQ ID NO: 434485 - DNA, 20 bp, Artificial
  CRISPR gRNA sequence
tcaattaaaaaaaaaaaaaa

SEQ ID NO: 434486 - DNA, 20 bp, Artificial
  CRISPR gRNA sequence
aaaaaaaaaaaaaagtactg

SEQ ID NO: 434487 - DNA, 20 bp, Artificial
  CRISPR gRNA sequence
aaaaaaaaagtactgaagca

SEQ ID NO: 434488 - DNA, 20 bp, Artificial
  CRISPR gRNA sequence
aaaaaaaagtactgaagcac

SEQ ID NO: 434489 - DNA, 20 bp, Artificial
  CRISPR gRNA sequence
aaaagtactgaagcacagga

SEQ ID NO: 434490 - DNA, 20 bp, Artificial
  CRISPR gRNA sequence
aaagtactgaagcacaggat

SEQ ID NO: 434491 - DNA, 20 bp, Artificial
  CRISPR gRNA sequence
tactgaagcacaggatggga

SEQ ID NO: 434492 - DNA, 20 bp, Artificial
  CRISPR gRNA sequence
gaagcacaggatgggaaagt

SEQ ID NO: 434493 - DNA, 20 bp, Artificial
  CRISPR gRNA sequence
gtgagactaaatgacccttg

SEQ ID NO: 434494 - DNA, 20 bp, Artificial
  CRISPR gRNA sequence
atgacccttgaagtcccttc

SEQ ID NO: 434495 - DNA, 20 bp, Artificial
  CRISPR gRNA sequence
tgaagtcccttctagcacta

SEQ ID NO: 434496 - DNA, 20 bp, Artificial
  CRISPR gRNA sequence
ccttctagcactatggttgt

SEQ ID NO: 434497 - DNA, 20 bp, Artificial
  CRISPR gRNA sequence
gattctttaaaatataacaa

SEQ ID NO: 434498 - DNA, 20 bp, Artificial
  CRISPR gRNA sequence
atataacaatggcatacaat

SEQ ID NO: 434499 - DNA, 20 bp, Artificial
  CRISPR gRNA sequence
aatggcatacaataagtatc

SEQ ID NO: 434500 - DNA, 20 bp, Artificial
  CRISPR gRNA sequence
ttttctgtccccaccatatt

SEQ ID NO: 434501 - DNA, 20 bp, Artificial
  CRISPR gRNA sequence
tttcctctctaattgcataa

SEQ ID NO: 434502 - DNA, 20 bp, Artificial
  CRISPR gRNA sequence
tctaattgcataaaagatgt

SEQ ID NO: 434503 - DNA, 20 bp, Artificial
  CRISPR gRNA sequence
atgttggctaccaatcacta

SEQ ID NO: 434504 - DNA, 20 bp, Artificial
  CRISPR gRNA sequence
caatcactaaagactaacca

SEQ ID NO: 434505 - DNA, 20 bp, Artificial
  CRISPR gRNA sequence
ctaaccaaagactgaaactt

SEQ ID NO: 434506 - DNA, 20 bp, Artificial
  CRISPR gRNA sequence
aaccaaagactgaaactttg

SEQ ID NO: 434507 - DNA, 20 bp, Artificial
  CRISPR gRNA sequence
ccaaagactgaaactttgga

SEQ ID NO: 434508 - DNA, 20 bp, Artificial
  CRISPR gRNA sequence
aaactttggagagctaaaac

SEQ ID NO: 434509 - DNA, 20 bp, Artificial
  CRISPR gRNA sequence
agagctaaaaccagtaacta

SEQ ID NO: 434510 - DNA, 20 bp, Artificial
  CRISPR gRNA sequence
gtaactatagtaataataaa

SEQ ID NO: 434511 - DNA, 20 bp, Artificial
  CRISPR gRNA sequence
tatagtaataataaacagtt

SEQ ID NO: 434512 - DNA, 20 bp, Artificial
  CRISPR gRNA sequence
aaacagttgagtgcttttta

SEQ ID NO: 434513 - DNA, 20 bp, Artificial
  CRISPR gRNA sequence
aacagttgagtgctttttat

SEQ ID NO: 434514 - DNA, 20 bp, Artificial
  CRISPR gRNA sequence
gttgagtgctttttatgggc

SEQ ID NO: 434515 - DNA, 20 bp, Artificial
  CRISPR gRNA sequence
ttgagtgctttttatgggcc

SEQ ID NO: 434516 - DNA, 20 bp, Artificial
  CRISPR gRNA sequence
tatgggccaggtactatgct

SEQ ID NO: 434517 - DNA, 20 bp, Artificial
  CRISPR gRNA sequence
attacaaccacctcatgaca

SEQ ID NO: 434518 - DNA, 20 bp, Artificial
  CRISPR gRNA sequence
ttacaaccacctcatgacat

SEQ ID NO: 434519 - DNA, 20 bp, Artificial
  CRISPR gRNA sequence
ccacctcatgacatgggcac

SEQ ID NO: 434520 - DNA, 20 bp, Artificial
  CRISPR gRNA sequence
cactggaattatcctcattg

SEQ ID NO: 434521 - DNA, 20 bp, Artificial
  CRISPR gRNA sequence
ctggaattatcctcattgta

SEQ ID NO: 434522 - DNA, 20 bp, Artificial
  CRISPR gRNA sequence
attatcctcattgtagagat

SEQ ID NO: 434523 - DNA, 20 bp, Artificial
  CRISPR gRNA sequence
attgtagagatgagcaaact

SEQ ID NO: 434524 - DNA, 20 bp, Artificial
  CRISPR gRNA sequence
gagatgagcaaactgagctt

SEQ ID NO: 434525 - DNA, 20 bp, Artificial
  CRISPR gRNA sequence
gatgagcaaactgagcttca

SEQ ID NO: 434526 - DNA, 20 bp, Artificial
  CRISPR gRNA sequence
aactgagcttcagagaattt

SEQ ID NO: 434527 - DNA, 20 bp, Artificial
  CRISPR gRNA sequence
agaatttgagcaacttgact

SEQ ID NO: 434528 - DNA, 20 bp, Artificial
  CRISPR gRNA sequence
gaatttgagcaacttgactg

SEQ ID NO: 434529 - DNA, 20 bp, Artificial
  CRISPR gRNA sequence
gagcaacttgactgaggtca

SEQ ID NO: 434530 - DNA, 20 bp, Artificial
  CRISPR gRNA sequence
gcaacttgactgaggtcaca

SEQ ID NO: 434531 - DNA, 20 bp, Artificial
  CRISPR gRNA sequence
actgaggtcacagagctatc

SEQ ID NO: 434532 - DNA, 20 bp, Artificial
  CRISPR gRNA sequence
ggtcacagagctatcaagaa

SEQ ID NO: 434533 - DNA, 20 bp, Artificial
  CRISPR gRNA sequence
ctatcaagaacagctgaaat

SEQ ID NO: 434534 - DNA, 20 bp, Artificial
  CRISPR gRNA sequence
acccattccacctgtcactg

SEQ ID NO: 434535 - DNA, 20 bp, Artificial
  CRISPR gRNA sequence
tcttataatattaacgacaa

SEQ ID NO: 434536 - DNA, 20 bp, Artificial
  CRISPR gRNA sequence
cagctaacatgtacaaattg

SEQ ID NO: 434537 - DNA, 20 bp, Artificial
  CRISPR gRNA sequence
taacatgtacaaattgtggt

SEQ ID NO: 434538 - DNA, 20 bp, Artificial
  CRISPR gRNA sequence
tacaaattgtggtcagacat

SEQ ID NO: 434539 - DNA, 20 bp, Artificial
  CRISPR gRNA sequence
acaaattgtggtcagacatt

SEQ ID NO: 434540 - DNA, 20 bp, Artificial
  CRISPR gRNA sequence
agacattgggataaacgttt

SEQ ID NO: 434541 - DNA, 20 bp, Artificial
  CRISPR gRNA sequence
tttagacattttcttattta

SEQ ID NO: 434542 - DNA, 20 bp, Artificial
  CRISPR gRNA sequence
ttttcttatttaaagcccat

SEQ ID NO: 434543 - DNA, 20 bp, Artificial
  CRISPR gRNA sequence
tttcttatttaaagcccata

SEQ ID NO: 434544 - DNA, 20 bp, Artificial
  CRISPR gRNA sequence
gcccataaggtgtgatttat

SEQ ID NO: 434545 - DNA, 20 bp, Artificial
  CRISPR gRNA sequence
tatgagatttatgacattat

SEQ ID NO: 434546 - DNA, 20 bp, Artificial
  CRISPR gRNA sequence
atgagatttatgacattatg

SEQ ID NO: 434547 - DNA, 20 bp, Artificial
  CRISPR gRNA sequence
agatttatgacattatgagg

SEQ ID NO: 434548 - DNA, 20 bp, Artificial
  CRISPR gRNA sequence
gatttatgacattatgaggt

SEQ ID NO: 434549 - DNA, 20 bp, Artificial
  CRISPR gRNA sequence
cacctattaacctcatttta

SEQ ID NO: 434550 - DNA, 20 bp, Artificial
  CRISPR gRNA sequence
ctattaacctcattttacag

SEQ ID NO: 434551 - DNA, 20 bp, Artificial
  CRISPR gRNA sequence
tttacagaagaaaaaaaaaa

SEQ ID NO: 434552 - DNA, 20 bp, Artificial
  CRISPR gRNA sequence
tacagaagaaaaaaaaaatg

SEQ ID NO: 434553 - DNA, 20 bp, Artificial
  CRISPR gRNA sequence
agaaaaaaaaaatggagctc

SEQ ID NO: 434554 - DNA, 20 bp, Artificial
  CRISPR gRNA sequence
aaaaaaaaaatggagctcca

SEQ ID NO: 434555 - DNA, 20 bp, Artificial
  CRISPR gRNA sequence
aaaaaaaatggagctccaga

SEQ ID NO: 434556 - DNA, 20 bp, Artificial
  CRISPR gRNA sequence
aaatggagctccagagagtt

SEQ ID NO: 434557 - DNA, 20 bp, Artificial
  CRISPR gRNA sequence
tggagctccagagagtttag

SEQ ID NO: 434558 - DNA, 20 bp, Artificial
  CRISPR gRNA sequence
gagctccagagagtttagaa

SEQ ID NO: 434559 - DNA, 20 bp, Artificial
  CRISPR gRNA sequence
ccagagagtttagaagagac

SEQ ID NO: 434560 - DNA, 20 bp, Artificial
  CRISPR gRNA sequence
cagagagtttagaagagacc

SEQ ID NO: 434561 - DNA, 20 bp, Artificial
  CRISPR gRNA sequence
gaagagaccaggacactgac

SEQ ID NO: 434562 - DNA, 20 bp, Artificial
  CRISPR gRNA sequence
cttgacttctgctttatgcc

SEQ ID NO: 434563 - DNA, 20 bp, Artificial
  CRISPR gRNA sequence
ttatgcccagtgttctcttc

SEQ ID NO: 434564 - DNA, 20 bp, Artificial
  CRISPR gRNA sequence
atgcccagtgttctcttctg

SEQ ID NO: 434565 - DNA, 20 bp, Artificial
  CRISPR gRNA sequence
gttctcttctggagcaccct

SEQ ID NO: 434566 - DNA, 20 bp, Artificial
  CRISPR gRNA sequence
cgtccttgctgaattacatg

SEQ ID NO: 434567 - DNA, 20 bp, Artificial
  CRISPR gRNA sequence
gaatttaactattctttctg

SEQ ID NO: 434568 - DNA, 20 bp, Artificial
  CRISPR gRNA sequence
ttaactattctttctgtggc

SEQ ID NO: 434569 - DNA, 20 bp, Artificial
  CRISPR gRNA sequence
ttctttctgtggctggaatc

SEQ ID NO: 434570 - DNA, 20 bp, Artificial
  CRISPR gRNA sequence
tctttctgtggctggaatcc

SEQ ID NO: 434571 - DNA, 20 bp, Artificial
  CRISPR gRNA sequence
ctttctgtggctggaatcca

SEQ ID NO: 434572 - DNA, 20 bp, Artificial
  CRISPR gRNA sequence
tctgtggctggaatccaggg

SEQ ID NO: 434573 - DNA, 20 bp, Artificial
  CRISPR gRNA sequence
ctgtggctggaatccaggga

SEQ ID NO: 434574 - DNA, 20 bp, Artificial
  CRISPR gRNA sequence
ctggaatccagggaaggtga

SEQ ID NO: 434575 - DNA, 20 bp, Artificial
  CRISPR gRNA sequence
tggaatccagggaaggtgat

SEQ ID NO: 434576 - DNA, 20 bp, Artificial
  CRISPR gRNA sequence
gaaggtgatgggctttattc

SEQ ID NO: 434577 - DNA, 20 bp, Artificial
  CRISPR gRNA sequence
gtgatgggctttattctagc

SEQ ID NO: 434578 - DNA, 20 bp, Artificial
  CRISPR gRNA sequence
atgggctttattctagctag

SEQ ID NO: 434579 - DNA, 20 bp, Artificial
  CRISPR gRNA sequence
tgggctttattctagctaga

SEQ ID NO: 434580 - DNA, 20 bp, Artificial
  CRISPR gRNA sequence
attctagctagaaggcatcc

SEQ ID NO: 434581 - DNA, 20 bp, Artificial
  CRISPR gRNA sequence
aatcacctaatccaatgtgt

SEQ ID NO: 434582 - DNA, 20 bp, Artificial
  CRISPR gRNA sequence
aatgtgtcagttcccaaaca

SEQ ID NO: 434583 - DNA, 20 bp, Artificial
  CRISPR gRNA sequence
tcccaaacacagactgacac

SEQ ID NO: 434584 - DNA, 20 bp, Artificial
  CRISPR gRNA sequence
agttcatgaccaaacatcac

SEQ ID NO: 434585 - DNA, 20 bp, Artificial
  CRISPR gRNA sequence
atgaccaaacatcaccagtc

SEQ ID NO: 434586 - DNA, 20 bp, Artificial
  CRISPR gRNA sequence
tgaccaaacatcaccagtcc

SEQ ID NO: 434587 - DNA, 20 bp, Artificial
  CRISPR gRNA sequence
gaccaaacatcaccagtcca

SEQ ID NO: 434588 - DNA, 20 bp, Artificial
  CRISPR gRNA sequence
aaacatcaccagtccagggt

SEQ ID NO: 434589 - DNA, 20 bp, Artificial
  CRISPR gRNA sequence
atcaccagtccagggtcagt

SEQ ID NO: 434590 - DNA, 20 bp, Artificial
  CRISPR gRNA sequence
ccagggtcagtcagaaaatg

SEQ ID NO: 434591 - DNA, 20 bp, Artificial
  CRISPR gRNA sequence
tcagtcagaaaatgtggaca

SEQ ID NO: 434592 - DNA, 20 bp, Artificial
  CRISPR gRNA sequence
gaaaatgtggacaaagtaat

SEQ ID NO: 434593 - DNA, 20 bp, Artificial
  CRISPR gRNA sequence
aatgagcatttcattcaatt

SEQ ID NO: 434594 - DNA, 20 bp, Artificial
  CRISPR gRNA sequence
attcaatttagttaatattt

SEQ ID NO: 434595 - DNA, 20 bp, Artificial
  CRISPR gRNA sequence
ttaatatttaagtaaaatta

SEQ ID NO: 434596 - DNA, 20 bp, Artificial
  CRISPR gRNA sequence
aagtaaaattaaagactata

SEQ ID NO: 434597 - DNA, 20 bp, Artificial
  CRISPR gRNA sequence
aaagtttattaacttttttc

SEQ ID NO: 434598 - DNA, 20 bp, Artificial
  CRISPR gRNA sequence
cttttttccagttaaaattt

SEQ ID NO: 434599 - DNA, 20 bp, Artificial
  CRISPR gRNA sequence
aatttaagtaaaataatcct

SEQ ID NO: 434600 - DNA, 20 bp, Artificial
  CRISPR gRNA sequence
taagtaaaataatcctaagc

SEQ ID NO: 434601 - DNA, 20 bp, Artificial
  CRISPR gRNA sequence
aagccagaccatctttttcc

SEQ ID NO: 434602 - DNA, 20 bp, Artificial
  CRISPR gRNA sequence
agaccatctttttcccagca

SEQ ID NO: 434603 - DNA, 20 bp, Artificial
  CRISPR gRNA sequence
gaccatctttttcccagcac

SEQ ID NO: 434604 - DNA, 20 bp, Artificial
  CRISPR gRNA sequence
cctcttttcaaacactattt

SEQ ID NO: 434605 - DNA, 20 bp, Artificial
  CRISPR gRNA sequence
ctcttttcaaacactatttc

SEQ ID NO: 434606 - DNA, 20 bp, Artificial
  CRISPR gRNA sequence
caaacactatttcaggtgca

SEQ ID NO: 434607 - DNA, 20 bp, Artificial
  CRISPR gRNA sequence
aacactatttcaggtgcacg

SEQ ID NO: 434608 - DNA, 20 bp, Artificial
  CRISPR gRNA sequence
cattcaaaatcctctgaatt

SEQ ID NO: 434609 - DNA, 20 bp, Artificial
  CRISPR gRNA sequence
ttcaaaatcctctgaattca

SEQ ID NO: 434610 - DNA, 20 bp, Artificial
  CRISPR gRNA sequence
aaatcctctgaattcagagc

SEQ ID NO: 434611 - DNA, 20 bp, Artificial
  CRISPR gRNA sequence
tctgaattcagagccagcta

SEQ ID NO: 434612 - DNA, 20 bp, Artificial
  CRISPR gRNA sequence
tccctcctctgccccatgca

SEQ ID NO: 434613 - DNA, 20 bp, Artificial
  CRISPR gRNA sequence
ctgccccatgcatagttacc

SEQ ID NO: 434614 - DNA, 20 bp, Artificial
  CRISPR gRNA sequence
tgccccatgcatagttacct

SEQ ID NO: 434615 - DNA, 20 bp, Artificial
  CRISPR gRNA sequence
gttacctgggccatgtcccc

SEQ ID NO: 434616 - DNA, 20 bp, Artificial
  CRISPR gRNA sequence
acctgggccatgtcccctgg

SEQ ID NO: 434617 - DNA, 20 bp, Artificial
  CRISPR gRNA sequence
gggccatgtcccctggtggt

SEQ ID NO: 434618 - DNA, 20 bp, Artificial
  CRISPR gRNA sequence
cccctggtggtaagcatcct

SEQ ID NO: 434619 - DNA, 20 bp, Artificial
  CRISPR gRNA sequence
tggtggtaagcatccttgga

SEQ ID NO: 434620 - DNA, 20 bp, Artificial
  CRISPR gRNA sequence
ggtggtaagcatccttggaa

SEQ ID NO: 434621 - DNA, 20 bp, Artificial
  CRISPR gRNA sequence
aagcatccttggaaaggctg

SEQ ID NO: 434622 - DNA, 20 bp, Artificial
  CRISPR gRNA sequence
tccttggaaaggctgcagtg

SEQ ID NO: 434623 - DNA, 20 bp, Artificial
  CRISPR gRNA sequence
tgcagtgaagtctctctgcc

SEQ ID NO: 434624 - DNA, 20 bp, Artificial
  CRISPR gRNA sequence
gtgaagtctctctgccgagt

SEQ ID NO: 434625 - DNA, 20 bp, Artificial
  CRISPR gRNA sequence
gtctctctgccgagtcggtg

SEQ ID NO: 434626 - DNA, 20 bp, Artificial
  CRISPR gRNA sequence
tctctctgccgagtcggtgc

SEQ ID NO: 434627 - DNA, 20 bp, Artificial
  CRISPR gRNA sequence
ctctctgccgagtcggtgca

SEQ ID NO: 434628 - DNA, 20 bp, Artificial
  CRISPR gRNA sequence
tctctgccgagtcggtgcag

SEQ ID NO: 434629 - DNA, 20 bp, Artificial
  CRISPR gRNA sequence
agtcggtgcaggggtgacct

SEQ ID NO: 434630 - DNA, 20 bp, Artificial
  CRISPR gRNA sequence
ggggtgaccttggctaatgt

SEQ ID NO: 434631 - DNA, 20 bp, Artificial
  CRISPR gRNA sequence
gctaatgtcagaaacaacat

SEQ ID NO: 434632 - DNA, 20 bp, Artificial
  CRISPR gRNA sequence
ctaatgtcagaaacaacata

SEQ ID NO: 434633 - DNA, 20 bp, Artificial
  CRISPR gRNA sequence
cataaggatgaaaattatct

SEQ ID NO: 434634 - DNA, 20 bp, Artificial
  CRISPR gRNA sequence
taaggatgaaaattatctga

SEQ ID NO: 434635 - DNA, 20 bp, Artificial
  CRISPR gRNA sequence
ggatgaaaattatctgagag

SEQ ID NO: 434636 - DNA, 20 bp, Artificial
  CRISPR gRNA sequence
gaaaattatctgagagcaga

SEQ ID NO: 434637 - DNA, 20 bp, Artificial
  CRISPR gRNA sequence
tgagagcagaaagcttattt

SEQ ID NO: 434638 - DNA, 20 bp, Artificial
  CRISPR gRNA sequence
gagagcagaaagcttatttc

SEQ ID NO: 434639 - DNA, 20 bp, Artificial
  CRISPR gRNA sequence
agagcagaaagcttatttca

SEQ ID NO: 434640 - DNA, 20 bp, Artificial
  CRISPR gRNA sequence
aagcttatttcagggaatca

SEQ ID NO: 434641 - DNA, 20 bp, Artificial
  CRISPR gRNA sequence
agcttatttcagggaatcaa

SEQ ID NO: 434642 - DNA, 20 bp, Artificial
  CRISPR gRNA sequence
gcttatttcagggaatcaaa

SEQ ID NO: 434643 - DNA, 20 bp, Artificial
  CRISPR gRNA sequence
cttatttcagggaatcaaag

SEQ ID NO: 434644 - DNA, 20 bp, Artificial
  CRISPR gRNA sequence
atttcagggaatcaaagggg

SEQ ID NO: 434645 - DNA, 20 bp, Artificial
  CRISPR gRNA sequence
cagggaatcaaaggggcagc

SEQ ID NO: 434646 - DNA, 20 bp, Artificial
  CRISPR gRNA sequence
gcagcaagaaaaaaatgcga

SEQ ID NO: 434647 - DNA, 20 bp, Artificial
  CRISPR gRNA sequence
aaaaaatgcgaaagacaatt

SEQ ID NO: 434648 - DNA, 20 bp, Artificial
  CRISPR gRNA sequence
aatgcgaaagacaattaaga

SEQ ID NO: 434649 - DNA, 20 bp, Artificial
  CRISPR gRNA sequence
tgcgaaagacaattaagaaa

SEQ ID NO: 434650 - DNA, 20 bp, Artificial
  CRISPR gRNA sequence
aagaaagagaaatacaccct

SEQ ID NO: 434651 - DNA, 20 bp, Artificial
  CRISPR gRNA sequence
cctcagcttccaaacctgcc

SEQ ID NO: 434652 - DNA, 20 bp, Artificial
  CRISPR gRNA sequence
cctgcctggatacctacgtt

SEQ ID NO: 434653 - DNA, 20 bp, Artificial
  CRISPR gRNA sequence
tgcctggatacctacgttga

SEQ ID NO: 434654 - DNA, 20 bp, Artificial
  CRISPR gRNA sequence
cacacttcaaatgtttgaca

SEQ ID NO: 434655 - DNA, 20 bp, Artificial
  CRISPR gRNA sequence
acacttcaaatgtttgacaa

SEQ ID NO: 434656 - DNA, 20 bp, Artificial
  CRISPR gRNA sequence
ttcaaatgtttgacaaaggt

SEQ ID NO: 434657 - DNA, 20 bp, Artificial
  CRISPR gRNA sequence
tgtttgacaaaggtaagatg

SEQ ID NO: 434658 - DNA, 20 bp, Artificial
  CRISPR gRNA sequence
tgttacattctgattattaa

SEQ ID NO: 434659 - DNA, 20 bp, Artificial
  CRISPR gRNA sequence
tacattctgattattaatag

SEQ ID NO: 434660 - DNA, 20 bp, Artificial
  CRISPR gRNA sequence
attattaatagcggaactaa

SEQ ID NO: 434661 - DNA, 20 bp, Artificial
  CRISPR gRNA sequence
ggaactaacagccacacaaa

SEQ ID NO: 434662 - DNA, 20 bp, Artificial
  CRISPR gRNA sequence
cacacaaatggccataatta

SEQ ID NO: 434663 - DNA, 20 bp, Artificial
  CRISPR gRNA sequence
acacaaatggccataattac

SEQ ID NO: 434664 - DNA, 20 bp, Artificial
  CRISPR gRNA sequence
atggccataattacaggttg

SEQ ID NO: 434665 - DNA, 20 bp, Artificial
  CRISPR gRNA sequence
actccttatctgaaatgctt

SEQ ID NO: 434666 - DNA, 20 bp, Artificial
  CRISPR gRNA sequence
ttatctgaaatgcttgagat

SEQ ID NO: 434667 - DNA, 20 bp, Artificial
  CRISPR gRNA sequence
gcttgagatcagaaatgttt

SEQ ID NO: 434668 - DNA, 20 bp, Artificial
  CRISPR gRNA sequence
ttttttttttttttttgaaa

SEQ ID NO: 434669 - DNA, 20 bp, Artificial
  CRISPR gRNA sequence
ttttttttttttttgaaacg

SEQ ID NO: 434670 - DNA, 20 bp, Artificial
  CRISPR gRNA sequence
ggagttttgctcttgttgcc

SEQ ID NO: 434671 - DNA, 20 bp, Artificial
  CRISPR gRNA sequence
gagttttgctcttgttgccc

SEQ ID NO: 434672 - DNA, 20 bp, Artificial
  CRISPR gRNA sequence
tttgctcttgttgcccaggc

SEQ ID NO: 434673 - DNA, 20 bp, Artificial
  CRISPR gRNA sequence
tgctcttgttgcccaggctg

SEQ ID NO: 434674 - DNA, 20 bp, Artificial
  CRISPR gRNA sequence
ttgcccaggctggagtgcaa

SEQ ID NO: 434675 - DNA, 20 bp, Artificial
  CRISPR gRNA sequence
ggagtgcaatggcataatct

SEQ ID NO: 434676 - DNA, 20 bp, Artificial
  CRISPR gRNA sequence
tcactgcaacctccgcctcc

SEQ ID NO: 434677 - DNA, 20 bp, Artificial
  CRISPR gRNA sequence
cactgcaacctccgcctcct

SEQ ID NO: 434678 - DNA, 20 bp, Artificial
  CRISPR gRNA sequence
aacctccgcctcctgggttc

SEQ ID NO: 434679 - DNA, 20 bp, Artificial
  CRISPR gRNA sequence
ttcaagcaattctcctgcct

SEQ ID NO: 434680 - DNA, 20 bp, Artificial
  CRISPR gRNA sequence
ttctcctgcctcagactcct

SEQ ID NO: 434681 - DNA, 20 bp, Artificial
  CRISPR gRNA sequence
tcctgcctcagactcctgag

SEQ ID NO: 434682 - DNA, 20 bp, Artificial
  CRISPR gRNA sequence
gcctcagactcctgagtagc

SEQ ID NO: 434683 - DNA, 20 bp, Artificial
  CRISPR gRNA sequence
cctcagactcctgagtagct

SEQ ID NO: 434684 - DNA, 20 bp, Artificial
  CRISPR gRNA sequence
ctcctgagtagctgggacta

SEQ ID NO: 434685 - DNA, 20 bp, Artificial
  CRISPR gRNA sequence
tcctgagtagctgggactac

SEQ ID NO: 434686 - DNA, 20 bp, Artificial
  CRISPR gRNA sequence
caggcatgtgcaaccacacc

SEQ ID NO: 434687 - DNA, 20 bp, Artificial
  CRISPR gRNA sequence
cctggctaattttgtatttt

SEQ ID NO: 434688 - DNA, 20 bp, Artificial
  CRISPR gRNA sequence
ggctaattttgtatttttag

SEQ ID NO: 434689 - DNA, 20 bp, Artificial
  CRISPR gRNA sequence
ctaattttgtatttttagta

SEQ ID NO: 434690 - DNA, 20 bp, Artificial
  CRISPR gRNA sequence
ttttgtatttttagtagaga

SEQ ID NO: 434691 - DNA, 20 bp, Artificial
  CRISPR gRNA sequence
tttgtatttttagtagagac

SEQ ID NO: 434692 - DNA, 20 bp, Artificial
  CRISPR gRNA sequence
ttgtatttttagtagagaca

SEQ ID NO: 434693 - DNA, 20 bp, Artificial
  CRISPR gRNA sequence
gagacagggtttctccatgt

SEQ ID NO: 434694 - DNA, 20 bp, Artificial
  CRISPR gRNA sequence
cagggtttctccatgttggt

SEQ ID NO: 434695 - DNA, 20 bp, Artificial
  CRISPR gRNA sequence
tttctccatgttggtcagac

SEQ ID NO: 434696 - DNA, 20 bp, Artificial
  CRISPR gRNA sequence
tggtctcgaactcccgacct

SEQ ID NO: 434697 - DNA, 20 bp, Artificial
  CRISPR gRNA sequence
ggtctcgaactcccgacctc

SEQ ID NO: 434698 - DNA, 20 bp, Artificial
  CRISPR gRNA sequence
ctcaggtgatccacccacct

SEQ ID NO: 434699 - DNA, 20 bp, Artificial
  CRISPR gRNA sequence
ccacccacctcagcctccca

SEQ ID NO: 434700 - DNA, 20 bp, Artificial
  CRISPR gRNA sequence
acctcagcctcccaaagtgc

SEQ ID NO: 434701 - DNA, 20 bp, Artificial
  CRISPR gRNA sequence
cctcagcctcccaaagtgct

SEQ ID NO: 434702 - DNA, 20 bp, Artificial
  CRISPR gRNA sequence
ctcccaaagtgctgggatta

SEQ ID NO: 434703 - DNA, 20 bp, Artificial
  CRISPR gRNA sequence
tcccaaagtgctgggattat

SEQ ID NO: 434704 - DNA, 20 bp, Artificial
  CRISPR gRNA sequence
agtgctgggattataggcat

SEQ ID NO: 434705 - DNA, 20 bp, Artificial
  CRISPR gRNA sequence
taggcatgagccaccacgcc

SEQ ID NO: 434706 - DNA, 20 bp, Artificial
  CRISPR gRNA sequence
gtttttatttttttattttt

SEQ ID NO: 434707 - DNA, 20 bp, Artificial
  CRISPR gRNA sequence
gcctatacttatgttccaat

SEQ ID NO: 434708 - DNA, 20 bp, Artificial
  CRISPR gRNA sequence
ttttcctttgaatgtcatgt

SEQ ID NO: 434709 - DNA, 20 bp, Artificial
  CRISPR gRNA sequence
atgtcatgtcagtgtccaaa

SEQ ID NO: 434710 - DNA, 20 bp, Artificial
  CRISPR gRNA sequence
tgtcagtgtccaaaaagttt

SEQ ID NO: 434711 - DNA, 20 bp, Artificial
  CRISPR gRNA sequence
gtccaaaaagttttggattt

SEQ ID NO: 434712 - DNA, 20 bp, Artificial
  CRISPR gRNA sequence
ccaaaaagttttggatttta

SEQ ID NO: 434713 - DNA, 20 bp, Artificial
  CRISPR gRNA sequence
ttttggattttagagcattt

SEQ ID NO: 434714 - DNA, 20 bp, Artificial
  CRISPR gRNA sequence
ttttagagcatttcagattt

SEQ ID NO: 434715 - DNA, 20 bp, Artificial
  CRISPR gRNA sequence
tttcagattttggtgcattt

SEQ ID NO: 434716 - DNA, 20 bp, Artificial
  CRISPR gRNA sequence
ttcagattttggtgcatttt

SEQ ID NO: 434717 - DNA, 20 bp, Artificial
  CRISPR gRNA sequence
ttttggtgcattttaggttt

SEQ ID NO: 434718 - DNA, 20 bp, Artificial
  CRISPR gRNA sequence
cattttaggttttagatttt

SEQ ID NO: 434719 - DNA, 20 bp, Artificial
  CRISPR gRNA sequence
aggttttagattttcagatt

SEQ ID NO: 434720 - DNA, 20 bp, Artificial
  CRISPR gRNA sequence
ggttttagattttcagattt

SEQ ID NO: 434721 - DNA, 20 bp, Artificial
  CRISPR gRNA sequence
tttgggatgcccaacctata

SEQ ID NO: 434722 - DNA, 20 bp, Artificial
  CRISPR gRNA sequence
ttgggatgcccaacctataa

SEQ ID NO: 434723 - DNA, 20 bp, Artificial
  CRISPR gRNA sequence
atcacataaaatccttctaa

SEQ ID NO: 434724 - DNA, 20 bp, Artificial
  CRISPR gRNA sequence
cttctaatggcccacatgat

SEQ ID NO: 434725 - DNA, 20 bp, Artificial
  CRISPR gRNA sequence
ggtattattgtcatatttta

SEQ ID NO: 434726 - DNA, 20 bp, Artificial
  CRISPR gRNA sequence
attattgtcatattttatag

SEQ ID NO: 434727 - DNA, 20 bp, Artificial
  CRISPR gRNA sequence
tattgtcatattttatagaa

SEQ ID NO: 434728 - DNA, 20 bp, Artificial
  CRISPR gRNA sequence
attgtcatattttatagaag

SEQ ID NO: 434729 - DNA, 20 bp, Artificial
  CRISPR gRNA sequence
tgtcatattttatagaagag

SEQ ID NO: 434730 - DNA, 20 bp, Artificial
  CRISPR gRNA sequence
ttttatagaagaggagctca

SEQ ID NO: 434731 - DNA, 20 bp, Artificial
  CRISPR gRNA sequence
cagcgtttcaataacttgct

SEQ ID NO: 434732 - DNA, 20 bp, Artificial
  CRISPR gRNA sequence
agcgtttcaataacttgctc

SEQ ID NO: 434733 - DNA, 20 bp, Artificial
  CRISPR gRNA sequence
ataacttgctcaggattata

SEQ ID NO: 434734 - DNA, 20 bp, Artificial
  CRISPR gRNA sequence
cttgctcaggattatatagc

SEQ ID NO: 434735 - DNA, 20 bp, Artificial
  CRISPR gRNA sequence
ctcaggattatatagctagt

SEQ ID NO: 434736 - DNA, 20 bp, Artificial
  CRISPR gRNA sequence
caggattatatagctagtaa

SEQ ID NO: 434737 - DNA, 20 bp, Artificial
  CRISPR gRNA sequence
aggattatatagctagtaag

SEQ ID NO: 434738 - DNA, 20 bp, Artificial
  CRISPR gRNA sequence
attatatagctagtaagagg

SEQ ID NO: 434739 - DNA, 20 bp, Artificial
  CRISPR gRNA sequence
tatatagctagtaagaggca

SEQ ID NO: 434740 - DNA, 20 bp, Artificial
  CRISPR gRNA sequence
tagctagtaagaggcagagt

SEQ ID NO: 434741 - DNA, 20 bp, Artificial
  CRISPR gRNA sequence
ggcagagttagatgtaaact

SEQ ID NO: 434742 - DNA, 20 bp, Artificial
  CRISPR gRNA sequence
gatgtaaactcagctctatc

SEQ ID NO: 434743 - DNA, 20 bp, Artificial
  CRISPR gRNA sequence
atgtaaactcagctctatct

SEQ ID NO: 434744 - DNA, 20 bp, Artificial
  CRISPR gRNA sequence
ctcagctctatctgggcaca

SEQ ID NO: 434745 - DNA, 20 bp, Artificial
  CRISPR gRNA sequence
tgggcacaaagtacatgtta

SEQ ID NO: 434746 - DNA, 20 bp, Artificial
  CRISPR gRNA sequence
gtacatgttatagaaatctt

SEQ ID NO: 434747 - DNA, 20 bp, Artificial
  CRISPR gRNA sequence
tcttaagtctgttcacctcc

SEQ ID NO: 434748 - DNA, 20 bp, Artificial
  CRISPR gRNA sequence
cccagcatacatgcataacc

SEQ ID NO: 434749 - DNA, 20 bp, Artificial
  CRISPR gRNA sequence
agcatacatgcataacccag

SEQ ID NO: 434750 - DNA, 20 bp, Artificial
  CRISPR gRNA sequence
aacccagcagttcaccatgc

SEQ ID NO: 434751 - DNA, 20 bp, Artificial
  CRISPR gRNA sequence
ttcaccatgctggctgcacc

SEQ ID NO: 434752 - DNA, 20 bp, Artificial
  CRISPR gRNA sequence
tcaccatgctggctgcacct

SEQ ID NO: 434753 - DNA, 20 bp, Artificial
  CRISPR gRNA sequence
caccatgctggctgcacctg

SEQ ID NO: 434754 - DNA, 20 bp, Artificial
  CRISPR gRNA sequence
cacctggggtaaaatcacct

SEQ ID NO: 434755 - DNA, 20 bp, Artificial
  CRISPR gRNA sequence
acctggggtaaaatcacctg

SEQ ID NO: 434756 - DNA, 20 bp, Artificial
  CRISPR gRNA sequence
tggggtaaaatcacctgagg

SEQ ID NO: 434757 - DNA, 20 bp, Artificial
  CRISPR gRNA sequence
cctgaggtagactctgtaaa

SEQ ID NO: 434758 - DNA, 20 bp, Artificial
  CRISPR gRNA sequence
ctctgtaaaaagctaatgct

SEQ ID NO: 434759 - DNA, 20 bp, Artificial
  CRISPR gRNA sequence
taatgcttagcatctacctc

SEQ ID NO: 434760 - DNA, 20 bp, Artificial
  CRISPR gRNA sequence
atgcttagcatctacctcca

SEQ ID NO: 434761 - DNA, 20 bp, Artificial
  CRISPR gRNA sequence
tccagagatgctgatttctc

SEQ ID NO: 434762 - DNA, 20 bp, Artificial
  CRISPR gRNA sequence
atgctgatttctctggtttt

SEQ ID NO: 434763 - DNA, 20 bp, Artificial
  CRISPR gRNA sequence
ctgatttctctggtttttgg

SEQ ID NO: 434764 - DNA, 20 bp, Artificial
  CRISPR gRNA sequence
atttctctggtttttggtag

SEQ ID NO: 434765 - DNA, 20 bp, Artificial
  CRISPR gRNA sequence
tttctctggtttttggtagt

SEQ ID NO: 434766 - DNA, 20 bp, Artificial
  CRISPR gRNA sequence
ttctctggtttttggtagtg

SEQ ID NO: 434767 - DNA, 20 bp, Artificial
  CRISPR gRNA sequence
ggttttttcttctgcttttt

SEQ ID NO: 434768 - DNA, 20 bp, Artificial
  CRISPR gRNA sequence
ttttttcttctgctttttaa

SEQ ID NO: 434769 - DNA, 20 bp, Artificial
  CRISPR gRNA sequence
ttcttctgctttttaagaga

SEQ ID NO: 434770 - DNA, 20 bp, Artificial
  CRISPR gRNA sequence
tcttctgctttttaagagat

SEQ ID NO: 434771 - DNA, 20 bp, Artificial
  CRISPR gRNA sequence
cttctgctttttaagagata

SEQ ID NO: 434772 - DNA, 20 bp, Artificial
  CRISPR gRNA sequence
ttctgctttttaagagatag

SEQ ID NO: 434773 - DNA, 20 bp, Artificial
  CRISPR gRNA sequence
tgctttttaagagatagggg

SEQ ID NO: 434774 - DNA, 20 bp, Artificial
  CRISPR gRNA sequence
ttaagagataggggtagcca

SEQ ID NO: 434775 - DNA, 20 bp, Artificial
  CRISPR gRNA sequence
taggggtagccacagtatat

SEQ ID NO: 434776 - DNA, 20 bp, Artificial
  CRISPR gRNA sequence
ggtagccacagtatatcagc

SEQ ID NO: 434777 - DNA, 20 bp, Artificial
  CRISPR gRNA sequence
gtagccacagtatatcagcc

SEQ ID NO: 434778 - DNA, 20 bp, Artificial
  CRISPR gRNA sequence
ccacagtatatcagccaggc

SEQ ID NO: 434779 - DNA, 20 bp, Artificial
  CRISPR gRNA sequence
ggtctcaaactcctgacctc

SEQ ID NO: 434780 - DNA, 20 bp, Artificial
  CRISPR gRNA sequence
ctcaagtgatcctcctgctt

SEQ ID NO: 434781 - DNA, 20 bp, Artificial
  CRISPR gRNA sequence
cctcctgcttcagcctctca

SEQ ID NO: 434782 - DNA, 20 bp, Artificial
  CRISPR gRNA sequence
gcttcagcctctcaaagtat

SEQ ID NO: 434783 - DNA, 20 bp, Artificial
  CRISPR gRNA sequence
cttcagcctctcaaagtatt

SEQ ID NO: 434784 - DNA, 20 bp, Artificial
  CRISPR gRNA sequence
ctctcaaagtattgggatta

SEQ ID NO: 434785 - DNA, 20 bp, Artificial
  CRISPR gRNA sequence
tctcaaagtattgggattat

SEQ ID NO: 434786 - DNA, 20 bp, Artificial
  CRISPR gRNA sequence
agtattgggattataggcat

SEQ ID NO: 434787 - DNA, 20 bp, Artificial
  CRISPR gRNA sequence
taggcatgagccactgtacc

SEQ ID NO: 434788 - DNA, 20 bp, Artificial
  CRISPR gRNA sequence
gccactgtacctggcatcta

SEQ ID NO: 434789 - DNA, 20 bp, Artificial
  CRISPR gRNA sequence
actctctatgtgattctaat

SEQ ID NO: 434790 - DNA, 20 bp, Artificial
  CRISPR gRNA sequence
tctctatgtgattctaatga

SEQ ID NO: 434791 - DNA, 20 bp, Artificial
  CRISPR gRNA sequence
tatgtgattctaatgagagt

SEQ ID NO: 434792 - DNA, 20 bp, Artificial
  CRISPR gRNA sequence
atgtgattctaatgagagtc

SEQ ID NO: 434793 - DNA, 20 bp, Artificial
  CRISPR gRNA sequence
tgtgattctaatgagagtca

SEQ ID NO: 434794 - DNA, 20 bp, Artificial
  CRISPR gRNA sequence
agggtctctaaccactgatc

SEQ ID NO: 434795 - DNA, 20 bp, Artificial
  CRISPR gRNA sequence
gggtctctaaccactgatct

SEQ ID NO: 434796 - DNA, 20 bp, Artificial
  CRISPR gRNA sequence
catctatacattccacccat

SEQ ID NO: 434797 - DNA, 20 bp, Artificial
  CRISPR gRNA sequence
tacattccacccatgagttt

SEQ ID NO: 434798 - DNA, 20 bp, Artificial
  CRISPR gRNA sequence
tcttttcttttttttttttt

SEQ ID NO: 434799 - DNA, 20 bp, Artificial
  CRISPR gRNA sequence
ttctttttttttttttgaga

SEQ ID NO: 434800 - DNA, 20 bp, Artificial
  CRISPR gRNA sequence
ctttttttttttttgagaca

SEQ ID NO: 434801 - DNA, 20 bp, Artificial
  CRISPR gRNA sequence
agacagagtttcacccttgt

SEQ ID NO: 434802 - DNA, 20 bp, Artificial
  CRISPR gRNA sequence
agagtttcacccttgtcagc

SEQ ID NO: 434803 - DNA, 20 bp, Artificial
  CRISPR gRNA sequence
gagtttcacccttgtcagcc

SEQ ID NO: 434804 - DNA, 20 bp, Artificial
  CRISPR gRNA sequence
ttcacccttgtcagccaggc

SEQ ID NO: 434805 - DNA, 20 bp, Artificial
  CRISPR gRNA sequence
cacccttgtcagccaggctg

SEQ ID NO: 434806 - DNA, 20 bp, Artificial
  CRISPR gRNA sequence
tcagccaggctggagtacaa

SEQ ID NO: 434807 - DNA, 20 bp, Artificial
  CRISPR gRNA sequence
ccaggctggagtacaatggc

SEQ ID NO: 434808 - DNA, 20 bp, Artificial
  CRISPR gRNA sequence
ggagtacaatggcgagatct

SEQ ID NO: 434809 - DNA, 20 bp, Artificial
  CRISPR gRNA sequence
ttaccacaacctccgactcc

SEQ ID NO: 434810 - DNA, 20 bp, Artificial
  CRISPR gRNA sequence
taccacaacctccgactccc

SEQ ID NO: 434811 - DNA, 20 bp, Artificial
  CRISPR gRNA sequence
aacctccgactcccaggttc

SEQ ID NO: 434812 - DNA, 20 bp, Artificial
  CRISPR gRNA sequence
ttcaagtgattctcctgctt

SEQ ID NO: 434813 - DNA, 20 bp, Artificial
  CRISPR gRNA sequence
ttctcctgcttcagcccccc

SEQ ID NO: 434814 - DNA, 20 bp, Artificial
  CRISPR gRNA sequence
tcctgcttcagccccccaag

SEQ ID NO: 434815 - DNA, 20 bp, Artificial
  CRISPR gRNA sequence
gcttcagccccccaagtagc

SEQ ID NO: 434816 - DNA, 20 bp, Artificial
  CRISPR gRNA sequence
cccccaagtagctagaatta

SEQ ID NO: 434817 - DNA, 20 bp, Artificial
  CRISPR gRNA sequence
ccccaagtagctagaattac

SEQ ID NO: 434818 - DNA, 20 bp, Artificial
  CRISPR gRNA sequence
caggctcccgtaaccatgcc

SEQ ID NO: 434819 - DNA, 20 bp, Artificial
  CRISPR gRNA sequence
tggctaattttttgtatttt

SEQ ID NO: 434820 - DNA, 20 bp, Artificial
  CRISPR gRNA sequence
ctaattttttgtatttttag

SEQ ID NO: 434821 - DNA, 20 bp, Artificial
  CRISPR gRNA sequence
aattttttgtatttttagtg

SEQ ID NO: 434822 - DNA, 20 bp, Artificial
  CRISPR gRNA sequence
tttgtatttttagtggagac

SEQ ID NO: 434823 - DNA, 20 bp, Artificial
  CRISPR gRNA sequence
ttgtatttttagtggagaca

SEQ ID NO: 434824 - DNA, 20 bp, Artificial
  CRISPR gRNA sequence
gagacaaggttttactatgt

SEQ ID NO: 434825 - DNA, 20 bp, Artificial
  CRISPR gRNA sequence
caaggttttactatgttggc

SEQ ID NO: 434826 - DNA, 20 bp, Artificial
  CRISPR gRNA sequence
aaggttttactatgttggcc

SEQ ID NO: 434827 - DNA, 20 bp, Artificial
  CRISPR gRNA sequence
ttttactatgttggccaggc

SEQ ID NO: 434828 - DNA, 20 bp, Artificial
  CRISPR gRNA sequence
ttcctgacctcatgatccac

SEQ ID NO: 434829 - DNA, 20 bp, Artificial
  CRISPR gRNA sequence
acctcatgatccaccggcct

SEQ ID NO: 434830 - DNA, 20 bp, Artificial
  CRISPR gRNA sequence
ccaccggcctcagcctccca

SEQ ID NO: 434831 - DNA, 20 bp, Artificial
  CRISPR gRNA sequence
gcctcagcctcccaaagtgc

SEQ ID NO: 434832 - DNA, 20 bp, Artificial
  CRISPR gRNA sequence
cctcagcctcccaaagtgct

SEQ ID NO: 434833 - DNA, 20 bp, Artificial
  CRISPR gRNA sequence
gcctcccaaagtgctgggat

SEQ ID NO: 434834 - DNA, 20 bp, Artificial
  CRISPR gRNA sequence
ctcccaaagtgctgggatta

SEQ ID NO: 434835 - DNA, 20 bp, Artificial
  CRISPR gRNA sequence
tcccaaagtgctgggattag

SEQ ID NO: 434836 - DNA, 20 bp, Artificial
  CRISPR gRNA sequence
agtgctgggattagaggtgt

SEQ ID NO: 434837 - DNA, 20 bp, Artificial
  CRISPR gRNA sequence
gaggtgtgagccaccacgcc

SEQ ID NO: 434838 - DNA, 20 bp, Artificial
  CRISPR gRNA sequence
aggtgtgagccaccacgccc

SEQ ID NO: 434839 - DNA, 20 bp, Artificial
  CRISPR gRNA sequence
ccacgcccaggcacacccat

SEQ ID NO: 434840 - DNA, 20 bp, Artificial
  CRISPR gRNA sequence
cacacccatgagttttaaaa

SEQ ID NO: 434841 - DNA, 20 bp, Artificial
  CRISPR gRNA sequence
cacccatgagttttaaaaca

SEQ ID NO: 434842 - DNA, 20 bp, Artificial
  CRISPR gRNA sequence
cccatgagttttaaaacaga

SEQ ID NO: 434843 - DNA, 20 bp, Artificial
  CRISPR gRNA sequence
atgagttttaaaacagagag

SEQ ID NO: 434844 - DNA, 20 bp, Artificial
  CRISPR gRNA sequence
tgagttttaaaacagagaga

SEQ ID NO: 434845 - DNA, 20 bp, Artificial
  CRISPR gRNA sequence
agaaggtgttaaatatcact

SEQ ID NO: 434846 - DNA, 20 bp, Artificial
  CRISPR gRNA sequence
atatcactgagcatcaccaa

SEQ ID NO: 434847 - DNA, 20 bp, Artificial
  CRISPR gRNA sequence
tatcactgagcatcaccaat

SEQ ID NO: 434848 - DNA, 20 bp, Artificial
  CRISPR gRNA sequence
atcactgagcatcaccaatg

SEQ ID NO: 434849 - DNA, 20 bp, Artificial
  CRISPR gRNA sequence
caatggggcctgttaaactt

SEQ ID NO: 434850 - DNA, 20 bp, Artificial
  CRISPR gRNA sequence
aatggggcctgttaaacttt

SEQ ID NO: 434851 - DNA, 20 bp, Artificial
  CRISPR gRNA sequence
gcctgttaaactttaggtct

SEQ ID NO: 434852 - DNA, 20 bp, Artificial
  CRISPR gRNA sequence
tgttaaactttaggtcttag

SEQ ID NO: 434853 - DNA, 20 bp, Artificial
  CRISPR gRNA sequence
aggtcttagtggccctcctc

SEQ ID NO: 434854 - DNA, 20 bp, Artificial
  CRISPR gRNA sequence
ggtcttagtggccctcctcc

SEQ ID NO: 434855 - DNA, 20 bp, Artificial
  CRISPR gRNA sequence
gtcttagtggccctcctcca

SEQ ID NO: 434856 - DNA, 20 bp, Artificial
  CRISPR gRNA sequence
ccctcctccagggctataat

SEQ ID NO: 434857 - DNA, 20 bp, Artificial
  CRISPR gRNA sequence
cctcctccagggctataatt

SEQ ID NO: 434858 - DNA, 20 bp, Artificial
  CRISPR gRNA sequence
ctcctccagggctataatta

SEQ ID NO: 434859 - DNA, 20 bp, Artificial
  CRISPR gRNA sequence
ctccagggctataattaggg

SEQ ID NO: 434860 - DNA, 20 bp, Artificial
  CRISPR gRNA sequence
agggctataattagggaagt

SEQ ID NO: 434861 - DNA, 20 bp, Artificial
  CRISPR gRNA sequence
ggctataattagggaagtca

SEQ ID NO: 434862 - DNA, 20 bp, Artificial
  CRISPR gRNA sequence
taattagggaagtcagagat

SEQ ID NO: 434863 - DNA, 20 bp, Artificial
  CRISPR gRNA sequence
aagtcagagatgagaacaat

SEQ ID NO: 434864 - DNA, 20 bp, Artificial
  CRISPR gRNA sequence
agtacctttaatatgatcca

SEQ ID NO: 434865 - DNA, 20 bp, Artificial
  CRISPR gRNA sequence
acagataaatcttattcata

SEQ ID NO: 434866 - DNA, 20 bp, Artificial
  CRISPR gRNA sequence
ataaatcttattcataaaga

SEQ ID NO: 434867 - DNA, 20 bp, Artificial
  CRISPR gRNA sequence
catgcaaatgtccactcacc

SEQ ID NO: 434868 - DNA, 20 bp, Artificial
  CRISPR gRNA sequence
cctggtttgatgaccaactt

SEQ ID NO: 434869 - DNA, 20 bp, Artificial
  CRISPR gRNA sequence
ctggtttgatgaccaacttc

SEQ ID NO: 434870 - DNA, 20 bp, Artificial
  CRISPR gRNA sequence
ttttcatcattcattatgcc

SEQ ID NO: 434871 - DNA, 20 bp, Artificial
  CRISPR gRNA sequence
tttcatcattcattatgcct

SEQ ID NO: 434872 - DNA, 20 bp, Artificial
  CRISPR gRNA sequence
cattcattatgcctgggatt

SEQ ID NO: 434873 - DNA, 20 bp, Artificial
  CRISPR gRNA sequence
ttatgcctgggatttggatc

SEQ ID NO: 434874 - DNA, 20 bp, Artificial
  CRISPR gRNA sequence
tgcctgggatttggatccgg

SEQ ID NO: 434875 - DNA, 20 bp, Artificial
  CRISPR gRNA sequence
ctgggatttggatccggcag

SEQ ID NO: 434876 - DNA, 20 bp, Artificial
  CRISPR gRNA sequence
ggatttggatccggcagcag

SEQ ID NO: 434877 - DNA, 20 bp, Artificial
  CRISPR gRNA sequence
cagtagatcccactgtctgc

SEQ ID NO: 434878 - DNA, 20 bp, Artificial
  CRISPR gRNA sequence
gtagatcccactgtctgcta

SEQ ID NO: 434879 - DNA, 20 bp, Artificial
  CRISPR gRNA sequence
tgctagagtcacattctcta

SEQ ID NO: 434880 - DNA, 20 bp, Artificial
  CRISPR gRNA sequence
agagtcacattctctatggt

SEQ ID NO: 434881 - DNA, 20 bp, Artificial
  CRISPR gRNA sequence
gagtcacattctctatggtc

SEQ ID NO: 434882 - DNA, 20 bp, Artificial
  CRISPR gRNA sequence
agtcacattctctatggtca

SEQ ID NO: 434883 - DNA, 20 bp, Artificial
  CRISPR gRNA sequence
tcagggacacatctcctttg

SEQ ID NO: 434884 - DNA, 20 bp, Artificial
  CRISPR gRNA sequence
cctttgcggaaatccccatt

SEQ ID NO: 434885 - DNA, 20 bp, Artificial
  CRISPR gRNA sequence
tgcggaaatccccatttagc

SEQ ID NO: 434886 - DNA, 20 bp, Artificial
  CRISPR gRNA sequence
atccccatttagccagtatc

SEQ ID NO: 434887 - DNA, 20 bp, Artificial
  CRISPR gRNA sequence
ataattcacatccctttcat

SEQ ID NO: 434888 - DNA, 20 bp, Artificial
  CRISPR gRNA sequence
acatccctttcatcagtcct

SEQ ID NO: 434889 - DNA, 20 bp, Artificial
  CRISPR gRNA sequence
cacgttgccacattcaaaca

SEQ ID NO: 434890 - DNA, 20 bp, Artificial
  CRISPR gRNA sequence
acgttgccacattcaaacac

SEQ ID NO: 434891 - DNA, 20 bp, Artificial
  CRISPR gRNA sequence
tgccacattcaaacacagga

SEQ ID NO: 434892 - DNA, 20 bp, Artificial
  CRISPR gRNA sequence
gccacattcaaacacaggac

SEQ ID NO: 434893 - DNA, 20 bp, Artificial
  CRISPR gRNA sequence
caggacaggctcctttgccc

SEQ ID NO: 434894 - DNA, 20 bp, Artificial
  CRISPR gRNA sequence
gacaggctcctttgccccag

SEQ ID NO: 434895 - DNA, 20 bp, Artificial
  CRISPR gRNA sequence
ggctcctttgccccagcaga

SEQ ID NO: 434896 - DNA, 20 bp, Artificial
  CRISPR gRNA sequence
gctcctttgccccagcagac

SEQ ID NO: 434897 - DNA, 20 bp, Artificial
  CRISPR gRNA sequence
ttgccccagcagacgggcac

SEQ ID NO: 434898 - DNA, 20 bp, Artificial
  CRISPR gRNA sequence
tgccccagcagacgggcacg

SEQ ID NO: 434899 - DNA, 20 bp, Artificial
  CRISPR gRNA sequence
cagacgggcacgaggttccc

SEQ ID NO: 434900 - DNA, 20 bp, Artificial
  CRISPR gRNA sequence
agacgggcacgaggttccct

SEQ ID NO: 434901 - DNA, 20 bp, Artificial
  CRISPR gRNA sequence
gacgggcacgaggttccctg

SEQ ID NO: 434902 - DNA, 20 bp, Artificial
  CRISPR gRNA sequence
gggcacgaggttccctgggg

SEQ ID NO: 434903 - DNA, 20 bp, Artificial
  CRISPR gRNA sequence
acgaggttccctggggcggc

SEQ ID NO: 434904 - DNA, 20 bp, Artificial
  CRISPR gRNA sequence
cgaggttccctggggcggct

SEQ ID NO: 434905 - DNA, 20 bp, Artificial
  CRISPR gRNA sequence
gaggttccctggggcggctg

SEQ ID NO: 434906 - DNA, 20 bp, Artificial
  CRISPR gRNA sequence
tccctggggcggctggggtg

SEQ ID NO: 434907 - DNA, 20 bp, Artificial
  CRISPR gRNA sequence
ctggggcggctggggtgtag

SEQ ID NO: 434908 - DNA, 20 bp, Artificial
  CRISPR gRNA sequence
gggcggctggggtgtagaag

SEQ ID NO: 434909 - DNA, 20 bp, Artificial
  CRISPR gRNA sequence
ggcggctggggtgtagaagc

SEQ ID NO: 434910 - DNA, 20 bp, Artificial
  CRISPR gRNA sequence
gcggctggggtgtagaagca

SEQ ID NO: 434911 - DNA, 20 bp, Artificial
  CRISPR gRNA sequence
gctggggtgtagaagcaggg

SEQ ID NO: 434912 - DNA, 20 bp, Artificial
  CRISPR gRNA sequence
gggtgtagaagcagggcaga

SEQ ID NO: 434913 - DNA, 20 bp, Artificial
  CRISPR gRNA sequence
ggtgtagaagcagggcagat

SEQ ID NO: 434914 - DNA, 20 bp, Artificial
  CRISPR gRNA sequence
ccgctctgtattccacttct

SEQ ID NO: 434915 - DNA, 20 bp, Artificial
  CRISPR gRNA sequence
cgctctgtattccacttctg

SEQ ID NO: 434916 - DNA, 20 bp, Artificial
  CRISPR gRNA sequence
ccacttctgaggaccctgca

SEQ ID NO: 434917 - DNA, 20 bp, Artificial
  CRISPR gRNA sequence
acttctgaggaccctgcata

SEQ ID NO: 434918 - DNA, 20 bp, Artificial
  CRISPR gRNA sequence
ttctgaggaccctgcataga

SEQ ID NO: 434919 - DNA, 20 bp, Artificial
  CRISPR gRNA sequence
ctgaggaccctgcatagaga

SEQ ID NO: 434920 - DNA, 20 bp, Artificial
  CRISPR gRNA sequence
aggaccctgcatagagagag

SEQ ID NO: 434921 - DNA, 20 bp, Artificial
  CRISPR gRNA sequence
ggaccctgcatagagagaga

SEQ ID NO: 434922 - DNA, 20 bp, Artificial
  CRISPR gRNA sequence
accctgcatagagagagaag

SEQ ID NO: 434923 - DNA, 20 bp, Artificial
  CRISPR gRNA sequence
cctgcatagagagagaagga

SEQ ID NO: 434924 - DNA, 20 bp, Artificial
  CRISPR gRNA sequence
atagagagagaaggagagcc

SEQ ID NO: 434925 - DNA, 20 bp, Artificial
  CRISPR gRNA sequence
gagaaggagagccaagactc

SEQ ID NO: 434926 - DNA, 20 bp, Artificial
  CRISPR gRNA sequence
aaggagagccaagactcaag

SEQ ID NO: 434927 - DNA, 20 bp, Artificial
  CRISPR gRNA sequence
agagccaagactcaagcggt

SEQ ID NO: 434928 - DNA, 20 bp, Artificial
  CRISPR gRNA sequence
ccaagactcaagcggtgagt

SEQ ID NO: 434929 - DNA, 20 bp, Artificial
  CRISPR gRNA sequence
caagactcaagcggtgagtg

SEQ ID NO: 434930 - DNA, 20 bp, Artificial
  CRISPR gRNA sequence
tgagtgaggttactccattt

SEQ ID NO: 434931 - DNA, 20 bp, Artificial
  CRISPR gRNA sequence
gagtgaggttactccatttc

SEQ ID NO: 434932 - DNA, 20 bp, Artificial
  CRISPR gRNA sequence
ctccatttcaggaaaactgc

SEQ ID NO: 434933 - DNA, 20 bp, Artificial
  CRISPR gRNA sequence
aaactgcaagccatgtctta

SEQ ID NO: 434934 - DNA, 20 bp, Artificial
  CRISPR gRNA sequence
aagccatgtcttacagaata

SEQ ID NO: 434935 - DNA, 20 bp, Artificial
  CRISPR gRNA sequence
gccatgtcttacagaataaa

SEQ ID NO: 434936 - DNA, 20 bp, Artificial
  CRISPR gRNA sequence
ccatgtcttacagaataaag

SEQ ID NO: 434937 - DNA, 20 bp, Artificial
  CRISPR gRNA sequence
tgtcttacagaataaagagg

SEQ ID NO: 434938 - DNA, 20 bp, Artificial
  CRISPR gRNA sequence
taaagaggaagctactgctg

SEQ ID NO: 434939 - DNA, 20 bp, Artificial
  CRISPR gRNA sequence
gctactgctgcagtcctgtt

SEQ ID NO: 434940 - DNA, 20 bp, Artificial
  CRISPR gRNA sequence
tactgctgcagtcctgtttg

SEQ ID NO: 434941 - DNA, 20 bp, Artificial
  CRISPR gRNA sequence
actgctgcagtcctgtttgg

SEQ ID NO: 434942 - DNA, 20 bp, Artificial
  CRISPR gRNA sequence
ttcgctgtgacaatgcttct

SEQ ID NO: 434943 - DNA, 20 bp, Artificial
  CRISPR gRNA sequence
gacaatgcttctcagatgtg

SEQ ID NO: 434944 - DNA, 20 bp, Artificial
  CRISPR gRNA sequence
acaatgcttctcagatgtga

SEQ ID NO: 434945 - DNA, 20 bp, Artificial
  CRISPR gRNA sequence
ttctcagatgtgaaggccat

SEQ ID NO: 434946 - DNA, 20 bp, Artificial
  CRISPR gRNA sequence
gtgaaggccatcagaatcac

SEQ ID NO: 434947 - DNA, 20 bp, Artificial
  CRISPR gRNA sequence
tgaaggccatcagaatcact

SEQ ID NO: 434948 - DNA, 20 bp, Artificial
  CRISPR gRNA sequence
aggccatcagaatcactggg

SEQ ID NO: 434949 - DNA, 20 bp, Artificial
  CRISPR gRNA sequence
tgggaagccttgcgaaaaca

SEQ ID NO: 434950 - DNA, 20 bp, Artificial
  CRISPR gRNA sequence
cttgcgaaaacacagattgc

SEQ ID NO: 434951 - DNA, 20 bp, Artificial
  CRISPR gRNA sequence
ttgcgaaaacacagattgct

SEQ ID NO: 434952 - DNA, 20 bp, Artificial
  CRISPR gRNA sequence
agattgctgggctcaactgc

SEQ ID NO: 434953 - DNA, 20 bp, Artificial
  CRISPR gRNA sequence
attgctgggctcaactgcta

SEQ ID NO: 434954 - DNA, 20 bp, Artificial
  CRISPR gRNA sequence
aactgctagagttcctgact

SEQ ID NO: 434955 - DNA, 20 bp, Artificial
  CRISPR gRNA sequence
gctagagttcctgactcagt

SEQ ID NO: 434956 - DNA, 20 bp, Artificial
  CRISPR gRNA sequence
ttcctgactcagttggcctg

SEQ ID NO: 434957 - DNA, 20 bp, Artificial
  CRISPR gRNA sequence
ctgactcagttggcctgtgg

SEQ ID NO: 434958 - DNA, 20 bp, Artificial
  CRISPR gRNA sequence
gactcagttggcctgtggta

SEQ ID NO: 434959 - DNA, 20 bp, Artificial
  CRISPR gRNA sequence
gttggcctgtggtagagcct

SEQ ID NO: 434960 - DNA, 20 bp, Artificial
  CRISPR gRNA sequence
tgagaacttttatttctaac

SEQ ID NO: 434961 - DNA, 20 bp, Artificial
  CRISPR gRNA sequence
tttatttctaacaagttctc

SEQ ID NO: 434962 - DNA, 20 bp, Artificial
  CRISPR gRNA sequence
caagttctcaagtgttgctg

SEQ ID NO: 434963 - DNA, 20 bp, Artificial
  CRISPR gRNA sequence
gttctcaagtgttgctgaag

SEQ ID NO: 434964 - DNA, 20 bp, Artificial
  CRISPR gRNA sequence
tcaagtgttgctgaagtggc

SEQ ID NO: 434965 - DNA, 20 bp, Artificial
  CRISPR gRNA sequence
gttgctgaagtggctggtct

SEQ ID NO: 434966 - DNA, 20 bp, Artificial
  CRISPR gRNA sequence
tggtctcagaacctcacttt

SEQ ID NO: 434967 - DNA, 20 bp, Artificial
  CRISPR gRNA sequence
cactttcagaaacactgccc

SEQ ID NO: 434968 - DNA, 20 bp, Artificial
  CRISPR gRNA sequence
actttcagaaacactgccct

SEQ ID NO: 434969 - DNA, 20 bp, Artificial
  CRISPR gRNA sequence
tttcagaaacactgccctag

SEQ ID NO: 434970 - DNA, 20 bp, Artificial
  CRISPR gRNA sequence
tcagaaacactgccctagga

SEQ ID NO: 434971 - DNA, 20 bp, Artificial
  CRISPR gRNA sequence
actgccctaggagagaattg

SEQ ID NO: 434972 - DNA, 20 bp, Artificial
  CRISPR gRNA sequence
gtggcccaattctgtgaaca

SEQ ID NO: 434973 - DNA, 20 bp, Artificial
  CRISPR gRNA sequence
tggcccaattctgtgaacac

SEQ ID NO: 434974 - DNA, 20 bp, Artificial
  CRISPR gRNA sequence
gcccaattctgtgaacacgg

SEQ ID NO: 434975 - DNA, 20 bp, Artificial
  CRISPR gRNA sequence
attctgtgaacacgggagaa

SEQ ID NO: 434976 - DNA, 20 bp, Artificial
  CRISPR gRNA sequence
ttctgtgaacacgggagaac

SEQ ID NO: 434977 - DNA, 20 bp, Artificial
  CRISPR gRNA sequence
tctgtgaacacgggagaaca

SEQ ID NO: 434978 - DNA, 20 bp, Artificial
  CRISPR gRNA sequence
acacgggagaacagggctga

SEQ ID NO: 434979 - DNA, 20 bp, Artificial
  CRISPR gRNA sequence
gagaacagggctgatggaaa

SEQ ID NO: 434980 - DNA, 20 bp, Artificial
  CRISPR gRNA sequence
ggctgatggaaacagacaat

SEQ ID NO: 434981 - DNA, 20 bp, Artificial
  CRISPR gRNA sequence
gaaacagacaatcagaaaat

SEQ ID NO: 434982 - DNA, 20 bp, Artificial
  CRISPR gRNA sequence
gacaatcagaaaattagtca

SEQ ID NO: 434983 - DNA, 20 bp, Artificial
  CRISPR gRNA sequence
atcagaaaattagtcatggt

SEQ ID NO: 434984 - DNA, 20 bp, Artificial
  CRISPR gRNA sequence
gaaaattagtcatggtcagc

SEQ ID NO: 434985 - DNA, 20 bp, Artificial
  CRISPR gRNA sequence
aaaattagtcatggtcagcc

SEQ ID NO: 434986 - DNA, 20 bp, Artificial
  CRISPR gRNA sequence
agtcatggtcagccaggaaa

SEQ ID NO: 434987 - DNA, 20 bp, Artificial
  CRISPR gRNA sequence
caggaaacggcccgcccatc

SEQ ID NO: 434988 - DNA, 20 bp, Artificial
  CRISPR gRNA sequence
aggaaacggcccgcccatct

SEQ ID NO: 434989 - DNA, 20 bp, Artificial
  CRISPR gRNA sequence
tacttgcttgttcatcaaca

SEQ ID NO: 434990 - DNA, 20 bp, Artificial
  CRISPR gRNA sequence
acttgcttgttcatcaacaa

SEQ ID NO: 434991 - DNA, 20 bp, Artificial
  CRISPR gRNA sequence
cttgcttgttcatcaacaaa

SEQ ID NO: 434992 - DNA, 20 bp, Artificial
  CRISPR gRNA sequence
tgcttgttcatcaacaaagg

SEQ ID NO: 434993 - DNA, 20 bp, Artificial
  CRISPR gRNA sequence
gcttgttcatcaacaaaggg

SEQ ID NO: 434994 - DNA, 20 bp, Artificial
  CRISPR gRNA sequence
cctaacatacttctcttttt

SEQ ID NO: 434995 - DNA, 20 bp, Artificial
  CRISPR gRNA sequence
aacatacttctctttttaag

SEQ ID NO: 434996 - DNA, 20 bp, Artificial
  CRISPR gRNA sequence
tacttctctttttaagcagc

SEQ ID NO: 434997 - DNA, 20 bp, Artificial
  CRISPR gRNA sequence
ctttttaagcagcaagtgca

SEQ ID NO: 434998 - DNA, 20 bp, Artificial
  CRISPR gRNA sequence
gcacagtaaatacaaaccct

SEQ ID NO: 434999 - DNA, 20 bp, Artificial
  CRISPR gRNA sequence
atacaaacccttggttaaat

SEQ ID NO: 435000 - DNA, 20 bp, Artificial
  CRISPR gRNA sequence
tacaaacccttggttaaata

SEQ ID NO: 435001 - DNA, 20 bp, Artificial
  CRISPR gRNA sequence
tgtgtatttgaaactactca

SEQ ID NO: 435002 - DNA, 20 bp, Artificial
  CRISPR gRNA sequence
tgtatttgaaactactcatg

SEQ ID NO: 435003 - DNA, 20 bp, Artificial
  CRISPR gRNA sequence
actactcatggagttgtttt

SEQ ID NO: 435004 - DNA, 20 bp, Artificial
  CRISPR gRNA sequence
ctactcatggagttgtttta

SEQ ID NO: 435005 - DNA, 20 bp, Artificial
  CRISPR gRNA sequence
tggagttgttttaaggttta

SEQ ID NO: 435006 - DNA, 20 bp, Artificial
  CRISPR gRNA sequence
ttaaggtttaaagttgtgaa

SEQ ID NO: 435007 - DNA, 20 bp, Artificial
  CRISPR gRNA sequence
tgtgaaaagaaattaaattt

SEQ ID NO: 435008 - DNA, 20 bp, Artificial
  CRISPR gRNA sequence
gtgaaaagaaattaaatttt

SEQ ID NO: 435009 - DNA, 20 bp, Artificial
  CRISPR gRNA sequence
tttgggaccccaaactcatt

SEQ ID NO: 435010 - DNA, 20 bp, Artificial
  CRISPR gRNA sequence
accccaaactcattcagtca

SEQ ID NO: 435011 - DNA, 20 bp, Artificial
  CRISPR gRNA sequence
ccccaaactcattcagtcaa

SEQ ID NO: 435012 - DNA, 20 bp, Artificial
  CRISPR gRNA sequence
cccaaactcattcagtcaaa

SEQ ID NO: 435013 - DNA, 20 bp, Artificial
  CRISPR gRNA sequence
actcattcagtcaaagggaa

SEQ ID NO: 435014 - DNA, 20 bp, Artificial
  CRISPR gRNA sequence
ttcagtcaaagggaaaagtc

SEQ ID NO: 435015 - DNA, 20 bp, Artificial
  CRISPR gRNA sequence
gtcaaagggaaaagtcaagc

SEQ ID NO: 435016 - DNA, 20 bp, Artificial
  CRISPR gRNA sequence
tcaaagggaaaagtcaagct

SEQ ID NO: 435017 - DNA, 20 bp, Artificial
  CRISPR gRNA sequence
ggaaaagtcaagctgggaac

SEQ ID NO: 435018 - DNA, 20 bp, Artificial
  CRISPR gRNA sequence
gaaaagtcaagctgggaact

SEQ ID NO: 435019 - DNA, 20 bp, Artificial
  CRISPR gRNA sequence
tcaagctgggaactgggtca

SEQ ID NO: 435020 - DNA, 20 bp, Artificial
  CRISPR gRNA sequence
cctctttttgattcctgaat

SEQ ID NO: 435021 - DNA, 20 bp, Artificial
  CRISPR gRNA sequence
tttttgattcctgaataaga

SEQ ID NO: 435022 - DNA, 20 bp, Artificial
  CRISPR gRNA sequence
attcctgaataagatggcta

SEQ ID NO: 435023 - DNA, 20 bp, Artificial
  CRISPR gRNA sequence
ttcctgaataagatggctac

SEQ ID NO: 435024 - DNA, 20 bp, Artificial
  CRISPR gRNA sequence
ataagatggctacaggatga

SEQ ID NO: 435025 - DNA, 20 bp, Artificial
  CRISPR gRNA sequence
taagatggctacaggatgaa

SEQ ID NO: 435026 - DNA, 20 bp, Artificial
  CRISPR gRNA sequence
ctcccccatattttgcccac

SEQ ID NO: 435027 - DNA, 20 bp, Artificial
  CRISPR gRNA sequence
tcccccatattttgcccaca

SEQ ID NO: 435028 - DNA, 20 bp, Artificial
  CRISPR gRNA sequence
tttgcccacaaggaaattcc

SEQ ID NO: 435029 - DNA, 20 bp, Artificial
  CRISPR gRNA sequence
cccacaaggaaattcctggt

SEQ ID NO: 435030 - DNA, 20 bp, Artificial
  CRISPR gRNA sequence
tcctggtcagctgtgcaatg

SEQ ID NO: 435031 - DNA, 20 bp, Artificial
  CRISPR gRNA sequence
agctgtgcaatgcagattga

SEQ ID NO: 435032 - DNA, 20 bp, Artificial
  CRISPR gRNA sequence
gattgatagctcatctttac

SEQ ID NO: 435033 - DNA, 20 bp, Artificial
  CRISPR gRNA sequence
atagctcatctttaccggtg

SEQ ID NO: 435034 - DNA, 20 bp, Artificial
  CRISPR gRNA sequence
ctttaccggtgcggtcaccc

SEQ ID NO: 435035 - DNA, 20 bp, Artificial
  CRISPR gRNA sequence
accggtgcggtcaccctggc

SEQ ID NO: 435036 - DNA, 20 bp, Artificial
  CRISPR gRNA sequence
gtgttatctaatgtaaaatg

SEQ ID NO: 435037 - DNA, 20 bp, Artificial
  CRISPR gRNA sequence
cccttttttatgtgaaaact

SEQ ID NO: 435038 - DNA, 20 bp, Artificial
  CRISPR gRNA sequence
caccttgtcccctttaaatc

SEQ ID NO: 435039 - DNA, 20 bp, Artificial
  CRISPR gRNA sequence
ccttgtcccctttaaatctg

SEQ ID NO: 435040 - DNA, 20 bp, Artificial
  CRISPR gRNA sequence
agccctcaaaatcatcttct

SEQ ID NO: 435041 - DNA, 20 bp, Artificial
  CRISPR gRNA sequence
ctcaaaatcatcttctgaga

SEQ ID NO: 435042 - DNA, 20 bp, Artificial
  CRISPR gRNA sequence
atcatcttctgagaaagtca

SEQ ID NO: 435043 - DNA, 20 bp, Artificial
  CRISPR gRNA sequence
aaagtcatagacctgtctct

SEQ ID NO: 435044 - DNA, 20 bp, Artificial
  CRISPR gRNA sequence
aagtcatagacctgtctctc

SEQ ID NO: 435045 - DNA, 20 bp, Artificial
  CRISPR gRNA sequence
ctcaggtgcctccttaactt

SEQ ID NO: 435046 - DNA, 20 bp, Artificial
  CRISPR gRNA sequence
acaaatctcctaaaatgatt

SEQ ID NO: 435047 - DNA, 20 bp, Artificial
  CRISPR gRNA sequence
ctcattttcctcaaatgaca

SEQ ID NO: 435048 - DNA, 20 bp, Artificial
  CRISPR gRNA sequence
gttttcatatgactcaacta

SEQ ID NO: 435049 - DNA, 20 bp, Artificial
  CRISPR gRNA sequence
aaaacattcaaacactatca

SEQ ID NO: 435050 - DNA, 20 bp, Artificial
  CRISPR gRNA sequence
aaacattcaaacactatcaa

SEQ ID NO: 435051 - DNA, 20 bp, Artificial
  CRISPR gRNA sequence
actatcaaaggtgtatgaaa

SEQ ID NO: 435052 - DNA, 20 bp, Artificial
  CRISPR gRNA sequence
atcaaaggtgtatgaaaaag

SEQ ID NO: 435053 - DNA, 20 bp, Artificial
  CRISPR gRNA sequence
aaggtgtatgaaaaagtggc

SEQ ID NO: 435054 - DNA, 20 bp, Artificial
  CRISPR gRNA sequence
aggtgtatgaaaaagtggcc

SEQ ID NO: 435055 - DNA, 20 bp, Artificial
  CRISPR gRNA sequence
tgaaaaagtggccgggcaca

SEQ ID NO: 435056 - DNA, 20 bp, Artificial
  CRISPR gRNA sequence
aaaagtggccgggcacacgg

SEQ ID NO: 435057 - DNA, 20 bp, Artificial
  CRISPR gRNA sequence
aaagtggccgggcacacggt

SEQ ID NO: 435058 - DNA, 20 bp, Artificial
  CRISPR gRNA sequence
gtgggtcacgcctgtaatcc

SEQ ID NO: 435059 - DNA, 20 bp, Artificial
  CRISPR gRNA sequence
cgcctgtaatcccagcactt

SEQ ID NO: 435060 - DNA, 20 bp, Artificial
  CRISPR gRNA sequence
gcctgtaatcccagcacttt

SEQ ID NO: 435061 - DNA, 20 bp, Artificial
  CRISPR gRNA sequence
ctgtaatcccagcactttgg

SEQ ID NO: 435062 - DNA, 20 bp, Artificial
  CRISPR gRNA sequence
tgtaatcccagcactttggg

SEQ ID NO: 435063 - DNA, 20 bp, Artificial
  CRISPR gRNA sequence
tcccagcactttgggaggct

SEQ ID NO: 435064 - DNA, 20 bp, Artificial
  CRISPR gRNA sequence
agcactttgggaggctgaga

SEQ ID NO: 435065 - DNA, 20 bp, Artificial
  CRISPR gRNA sequence
gcactttgggaggctgagat

SEQ ID NO: 435066 - DNA, 20 bp, Artificial
  CRISPR gRNA sequence
ctttgggaggctgagatggg

SEQ ID NO: 435067 - DNA, 20 bp, Artificial
  CRISPR gRNA sequence
ctgagatgggcagattactt

SEQ ID NO: 435068 - DNA, 20 bp, Artificial
  CRISPR gRNA sequence
tgagatgggcagattacttg

SEQ ID NO: 435069 - DNA, 20 bp, Artificial
  CRISPR gRNA sequence
ggcagattacttgaggccat

SEQ ID NO: 435070 - DNA, 20 bp, Artificial
  CRISPR gRNA sequence
ttacttgaggccatgagttt

SEQ ID NO: 435071 - DNA, 20 bp, Artificial
  CRISPR gRNA sequence
tgaggccatgagtttgagac

SEQ ID NO: 435072 - DNA, 20 bp, Artificial
  CRISPR gRNA sequence
tgagaccagcctgaccaaca

SEQ ID NO: 435073 - DNA, 20 bp, Artificial
  CRISPR gRNA sequence
ctactaaaaattaaaaacat

SEQ ID NO: 435074 - DNA, 20 bp, Artificial
  CRISPR gRNA sequence
taaaaattaaaaacattagc

SEQ ID NO: 435075 - DNA, 20 bp, Artificial
  CRISPR gRNA sequence
aaaaattaaaaacattagct

SEQ ID NO: 435076 - DNA, 20 bp, Artificial
  CRISPR gRNA sequence
ttaaaaacattagctgggtg

SEQ ID NO: 435077 - DNA, 20 bp, Artificial
  CRISPR gRNA sequence
aaaacattagctgggtgtgg

SEQ ID NO: 435078 - DNA, 20 bp, Artificial
  CRISPR gRNA sequence
gtggtgcacgcctgtgatcc

SEQ ID NO: 435079 - DNA, 20 bp, Artificial
  CRISPR gRNA sequence
gcctgtgatcccagctactc

SEQ ID NO: 435080 - DNA, 20 bp, Artificial
  CRISPR gRNA sequence
tcccagctactccggtgcct

SEQ ID NO: 435081 - DNA, 20 bp, Artificial
  CRISPR gRNA sequence
cccagctactccggtgccta

SEQ ID NO: 435082 - DNA, 20 bp, Artificial
  CRISPR gRNA sequence
agctactccggtgcctaagg

SEQ ID NO: 435083 - DNA, 20 bp, Artificial
  CRISPR gRNA sequence
gctactccggtgcctaaggc

SEQ ID NO: 435084 - DNA, 20 bp, Artificial
  CRISPR gRNA sequence
tactccggtgcctaaggcag

SEQ ID NO: 435085 - DNA, 20 bp, Artificial
  CRISPR gRNA sequence
gcaggagaatcacttgaacc

SEQ ID NO: 435086 - DNA, 20 bp, Artificial
  CRISPR gRNA sequence
caggagaatcacttgaacct

SEQ ID NO: 435087 - DNA, 20 bp, Artificial
  CRISPR gRNA sequence
ggagaatcacttgaacctgg

SEQ ID NO: 435088 - DNA, 20 bp, Artificial
  CRISPR gRNA sequence
gagaatcacttgaacctggg

SEQ ID NO: 435089 - DNA, 20 bp, Artificial
  CRISPR gRNA sequence
aatcacttgaacctgggagg

SEQ ID NO: 435090 - DNA, 20 bp, Artificial
  CRISPR gRNA sequence
tcacttgaacctgggaggcg

SEQ ID NO: 435091 - DNA, 20 bp, Artificial
  CRISPR gRNA sequence
aacctgggaggcggagattg

SEQ ID NO: 435092 - DNA, 20 bp, Artificial
  CRISPR gRNA sequence
tgggaggcggagattgcagt

SEQ ID NO: 435093 - DNA, 20 bp, Artificial
  CRISPR gRNA sequence
gagattgcagtgagccaaaa

SEQ ID NO: 435094 - DNA, 20 bp, Artificial
  CRISPR gRNA sequence
atggtgccaccactgcactc

SEQ ID NO: 435095 - DNA, 20 bp, Artificial
  CRISPR gRNA sequence
gccaccactgcactccagcc

SEQ ID NO: 435096 - DNA, 20 bp, Artificial
  CRISPR gRNA sequence
ccaccactgcactccagcct

SEQ ID NO: 435097 - DNA, 20 bp, Artificial
  CRISPR gRNA sequence
ctgcactccagcctgggcaa

SEQ ID NO: 435098 - DNA, 20 bp, Artificial
  CRISPR gRNA sequence
gcactccagcctgggcaata

SEQ ID NO: 435099 - DNA, 20 bp, Artificial
  CRISPR gRNA sequence
tccagcctgggcaatagagt

SEQ ID NO: 435100 - DNA, 20 bp, Artificial
  CRISPR gRNA sequence
actccatctcaattgaaaaa

SEQ ID NO: 435101 - DNA, 20 bp, Artificial
  CRISPR gRNA sequence
tctcaattgaaaaaaagaaa

SEQ ID NO: 435102 - DNA, 20 bp, Artificial
  CRISPR gRNA sequence
aattgaaaaaaagaaaaaga

SEQ ID NO: 435103 - DNA, 20 bp, Artificial
  CRISPR gRNA sequence
aaaaaaagaaaaagaaagaa

SEQ ID NO: 435104 - DNA, 20 bp, Artificial
  CRISPR gRNA sequence
agaaaaagaaagaaaagaaa

SEQ ID NO: 435105 - DNA, 20 bp, Artificial
  CRISPR gRNA sequence
aaagaaaagaaaaagaaaaa

SEQ ID NO: 435106 - DNA, 20 bp, Artificial
  CRISPR gRNA sequence
aagaaaagaaaaagaaaaaa

SEQ ID NO: 435107 - DNA, 20 bp, Artificial
  CRISPR gRNA sequence
aaagaaaaagaaaaaaagga

SEQ ID NO: 435108 - DNA, 20 bp, Artificial
  CRISPR gRNA sequence
aaaagaaaaaaaggaaagaa

SEQ ID NO: 435109 - DNA, 20 bp, Artificial
  CRISPR gRNA sequence
aaaaaaaggaaagaaaagaa

SEQ ID NO: 435110 - DNA, 20 bp, Artificial
  CRISPR gRNA sequence
cccaactctttaccattccc

SEQ ID NO: 435111 - DNA, 20 bp, Artificial
  CRISPR gRNA sequence
cattccctggttccttttcc

SEQ ID NO: 435112 - DNA, 20 bp, Artificial
  CRISPR gRNA sequence
ttccctggttccttttccta

SEQ ID NO: 435113 - DNA, 20 bp, Artificial
  CRISPR gRNA sequence
tttcctagagcttatacatt

SEQ ID NO: 435114 - DNA, 20 bp, Artificial
  CRISPR gRNA sequence
cgacaatgcacacacacaaa

SEQ ID NO: 435115 - DNA, 20 bp, Artificial
  CRISPR gRNA sequence
caatgcacacacacaaatag

SEQ ID NO: 435116 - DNA, 20 bp, Artificial
  CRISPR gRNA sequence
tttaataacattataatttt

SEQ ID NO: 435117 - DNA, 20 bp, Artificial
  CRISPR gRNA sequence
aattttgagacattctatac

SEQ ID NO: 435118 - DNA, 20 bp, Artificial
  CRISPR gRNA sequence
tctataccagtatgttttgt

SEQ ID NO: 435119 - DNA, 20 bp, Artificial
  CRISPR gRNA sequence
tttacccactccctcatcga

SEQ ID NO: 435120 - DNA, 20 bp, Artificial
  CRISPR gRNA sequence
ctccctcatcgacggacatt

SEQ ID NO: 435121 - DNA, 20 bp, Artificial
  CRISPR gRNA sequence
tccctcatcgacggacattt

SEQ ID NO: 435122 - DNA, 20 bp, Artificial
  CRISPR gRNA sequence
cggacatttaggttgcttcc

SEQ ID NO: 435123 - DNA, 20 bp, Artificial
  CRISPR gRNA sequence
tattacaaacaacattacaa

SEQ ID NO: 435124 - DNA, 20 bp, Artificial
  CRISPR gRNA sequence
tctctcccttgtcctctgta

SEQ ID NO: 435125 - DNA, 20 bp, Artificial
  CRISPR gRNA sequence
tcattgtaaatatccatgcc

SEQ ID NO: 435126 - DNA, 20 bp, Artificial
  CRISPR gRNA sequence
ccatgccgagacttacttgt

SEQ ID NO: 435127 - DNA, 20 bp, Artificial
  CRISPR gRNA sequence
tgccgagacttacttgtaag

SEQ ID NO: 435128 - DNA, 20 bp, Artificial
  CRISPR gRNA sequence
cgagacttacttgtaagtag

SEQ ID NO: 435129 - DNA, 20 bp, Artificial
  CRISPR gRNA sequence
gacttacttgtaagtagtag

SEQ ID NO: 435130 - DNA, 20 bp, Artificial
  CRISPR gRNA sequence
ttacttgtaagtagtagcag

SEQ ID NO: 435131 - DNA, 20 bp, Artificial
  CRISPR gRNA sequence
cttgtaagtagtagcagcag

SEQ ID NO: 435132 - DNA, 20 bp, Artificial
  CRISPR gRNA sequence
gtaagtagtagcagcagcag

SEQ ID NO: 435133 - DNA, 20 bp, Artificial
  CRISPR gRNA sequence
agtagtagcagcagcagcag

SEQ ID NO: 435134 - DNA, 20 bp, Artificial
  CRISPR gRNA sequence
gtagtagcagcagcagcagc

SEQ ID NO: 435135 - DNA, 20 bp, Artificial
  CRISPR gRNA sequence
gcagcagcagcagcaggaca

SEQ ID NO: 435136 - DNA, 20 bp, Artificial
  CRISPR gRNA sequence
gcagcagcaggacacagtca

SEQ ID NO: 435137 - DNA, 20 bp, Artificial
  CRISPR gRNA sequence
cagcagcaggacacagtcaa

SEQ ID NO: 435138 - DNA, 20 bp, Artificial
  CRISPR gRNA sequence
agcagcaggacacagtcaaa

SEQ ID NO: 435139 - DNA, 20 bp, Artificial
  CRISPR gRNA sequence
agcaggacacagtcaaaggg

SEQ ID NO: 435140 - DNA, 20 bp, Artificial
  CRISPR gRNA sequence
aaagggaagatgtgaaaaca

SEQ ID NO: 435141 - DNA, 20 bp, Artificial
  CRISPR gRNA sequence
agggaagatgtgaaaacatg

SEQ ID NO: 435142 - DNA, 20 bp, Artificial
  CRISPR gRNA sequence
atgtgaaaacatggagcttg

SEQ ID NO: 435143 - DNA, 20 bp, Artificial
  CRISPR gRNA sequence
tgaaaacatggagcttgcag

SEQ ID NO: 435144 - DNA, 20 bp, Artificial
  CRISPR gRNA sequence
acatggagcttgcagaagaa

SEQ ID NO: 435145 - DNA, 20 bp, Artificial
  CRISPR gRNA sequence
ggagcttgcagaagaaaagt

SEQ ID NO: 435146 - DNA, 20 bp, Artificial
  CRISPR gRNA sequence
agcttgcagaagaaaagtca

SEQ ID NO: 435147 - DNA, 20 bp, Artificial
  CRISPR gRNA sequence
gcttgcagaagaaaagtcag

SEQ ID NO: 435148 - DNA, 20 bp, Artificial
  CRISPR gRNA sequence
aagtcagaggacacctctgt

SEQ ID NO: 435149 - DNA, 20 bp, Artificial
  CRISPR gRNA sequence
agtcagaggacacctctgtt

SEQ ID NO: 435150 - DNA, 20 bp, Artificial
  CRISPR gRNA sequence
gaggacacctctgttaggca

SEQ ID NO: 435151 - DNA, 20 bp, Artificial
  CRISPR gRNA sequence
cacagttttaactctccaaa

SEQ ID NO: 435152 - DNA, 20 bp, Artificial
  CRISPR gRNA sequence
ttttaactctccaaatggac

SEQ ID NO: 435153 - DNA, 20 bp, Artificial
  CRISPR gRNA sequence
tttaactctccaaatggact

SEQ ID NO: 435154 - DNA, 20 bp, Artificial
  CRISPR gRNA sequence
tgtctactccacaatcacat

SEQ ID NO: 435155 - DNA, 20 bp, Artificial
  CRISPR gRNA sequence
ctactccacaatcacatgag

SEQ ID NO: 435156 - DNA, 20 bp, Artificial
  CRISPR gRNA sequence
ctccacaatcacatgagcag

SEQ ID NO: 435157 - DNA, 20 bp, Artificial
  CRISPR gRNA sequence
gagcagtagccgcccccact

SEQ ID NO: 435158 - DNA, 20 bp, Artificial
  CRISPR gRNA sequence
tagccgcccccactgagtgc

SEQ ID NO: 435159 - DNA, 20 bp, Artificial
  CRISPR gRNA sequence
gcccccactgagtgctagct

SEQ ID NO: 435160 - DNA, 20 bp, Artificial
  CRISPR gRNA sequence
gagtgctagctcagcacacc

SEQ ID NO: 435161 - DNA, 20 bp, Artificial
  CRISPR gRNA sequence
agtgctagctcagcacaccc

SEQ ID NO: 435162 - DNA, 20 bp, Artificial
  CRISPR gRNA sequence
acacccgggtgtctgattgc

SEQ ID NO: 435163 - DNA, 20 bp, Artificial
  CRISPR gRNA sequence
ctgattgccagtgattctta

SEQ ID NO: 435164 - DNA, 20 bp, Artificial
  CRISPR gRNA sequence
gattcttatagtaacactgc

SEQ ID NO: 435165 - DNA, 20 bp, Artificial
  CRISPR gRNA sequence
attcttatagtaacactgcc

SEQ ID NO: 435166 - DNA, 20 bp, Artificial
  CRISPR gRNA sequence
tagtaacactgccaggtcta

SEQ ID NO: 435167 - DNA, 20 bp, Artificial
  CRISPR gRNA sequence
ccaggtctacagtcacatta

SEQ ID NO: 435168 - DNA, 20 bp, Artificial
  CRISPR gRNA sequence
caggtctacagtcacattaa

SEQ ID NO: 435169 - DNA, 20 bp, Artificial
  CRISPR gRNA sequence
agtcacattaaaggaaacca

SEQ ID NO: 435170 - DNA, 20 bp, Artificial
  CRISPR gRNA sequence
ccacactacacacatcctgt

SEQ ID NO: 435171 - DNA, 20 bp, Artificial
  CRISPR gRNA sequence
tctgtcctgtgatatcaaca

SEQ ID NO: 435172 - DNA, 20 bp, Artificial
  CRISPR gRNA sequence
tgtcctgtgatatcaacaaa

SEQ ID NO: 435173 - DNA, 20 bp, Artificial
  CRISPR gRNA sequence
gtcctgtgatatcaacaaag

SEQ ID NO: 435174 - DNA, 20 bp, Artificial
  CRISPR gRNA sequence
ctgtgatatcaacaaagagg

SEQ ID NO: 435175 - DNA, 20 bp, Artificial
  CRISPR gRNA sequence
acaaagaggaagcaatactt

SEQ ID NO: 435176 - DNA, 20 bp, Artificial
  CRISPR gRNA sequence
aagaggaagcaatacttcag

SEQ ID NO: 435177 - DNA, 20 bp, Artificial
  CRISPR gRNA sequence
aggaagcaatacttcagtgg

SEQ ID NO: 435178 - DNA, 20 bp, Artificial
  CRISPR gRNA sequence
cagtggaagaaaacgctact

SEQ ID NO: 435179 - DNA, 20 bp, Artificial
  CRISPR gRNA sequence
aagaaaacgctactcagtca

SEQ ID NO: 435180 - DNA, 20 bp, Artificial
  CRISPR gRNA sequence
ctactcagtcatggcacata

SEQ ID NO: 435181 - DNA, 20 bp, Artificial
  CRISPR gRNA sequence
actcagtcatggcacataaa

SEQ ID NO: 435182 - DNA, 20 bp, Artificial
  CRISPR gRNA sequence
tctctttatgtgccatgact

SEQ ID NO: 435183 - DNA, 20 bp, Artificial
  CRISPR gRNA sequence
ctttatgtgccatgactgag

SEQ ID NO: 435184 - DNA, 20 bp, Artificial
  CRISPR gRNA sequence
agtagcgttttcttccactg

SEQ ID NO: 435185 - DNA, 20 bp, Artificial
  CRISPR gRNA sequence
cttcctctttgttgatatca

SEQ ID NO: 435186 - DNA, 20 bp, Artificial
  CRISPR gRNA sequence
ttcctctttgttgatatcac

SEQ ID NO: 435187 - DNA, 20 bp, Artificial
  CRISPR gRNA sequence
tctttgttgatatcacagga

SEQ ID NO: 435188 - DNA, 20 bp, Artificial
  CRISPR gRNA sequence
tgatatcacaggacagacat

SEQ ID NO: 435189 - DNA, 20 bp, Artificial
  CRISPR gRNA sequence
gacagacatcagaacactta

SEQ ID NO: 435190 - DNA, 20 bp, Artificial
  CRISPR gRNA sequence
acagacatcagaacacttac

SEQ ID NO: 435191 - DNA, 20 bp, Artificial
  CRISPR gRNA sequence
gaacacttacaggatgtgtg

SEQ ID NO: 435192 - DNA, 20 bp, Artificial
  CRISPR gRNA sequence
cttacaggatgtgtgtagtg

SEQ ID NO: 435193 - DNA, 20 bp, Artificial
  CRISPR gRNA sequence
atgtgtgtagtgtggcatga

SEQ ID NO: 435194 - DNA, 20 bp, Artificial
  CRISPR gRNA sequence
gtgtgtagtgtggcatgaca

SEQ ID NO: 435195 - DNA, 20 bp, Artificial
  CRISPR gRNA sequence
tgtggcatgacagagaactt

SEQ ID NO: 435196 - DNA, 20 bp, Artificial
  CRISPR gRNA sequence
ggtttcctttaatgtgactg

SEQ ID NO: 435197 - DNA, 20 bp, Artificial
  CRISPR gRNA sequence
ctttaatgtgactgtagacc

SEQ ID NO: 435198 - DNA, 20 bp, Artificial
  CRISPR gRNA sequence
taatgtgactgtagacctgg

SEQ ID NO: 435199 - DNA, 20 bp, Artificial
  CRISPR gRNA sequence
agacctggcagtgttactat

SEQ ID NO: 435200 - DNA, 20 bp, Artificial
  CRISPR gRNA sequence
agtgttactataagaatcac

SEQ ID NO: 435201 - DNA, 20 bp, Artificial
  CRISPR gRNA sequence
ctataagaatcactggcaat

SEQ ID NO: 435202 - DNA, 20 bp, Artificial
  CRISPR gRNA sequence
atcactggcaatcagacacc

SEQ ID NO: 435203 - DNA, 20 bp, Artificial
  CRISPR gRNA sequence
tcactggcaatcagacaccc

SEQ ID NO: 435204 - DNA, 20 bp, Artificial
  CRISPR gRNA sequence
atcagacacccgggtgtgct

SEQ ID NO: 435205 - DNA, 20 bp, Artificial
  CRISPR gRNA sequence
gacacccgggtgtgctgagc

SEQ ID NO: 435206 - DNA, 20 bp, Artificial
  CRISPR gRNA sequence
gggtgtgctgagctagcact

SEQ ID NO: 435207 - DNA, 20 bp, Artificial
  CRISPR gRNA sequence
tgtgctgagctagcactcag

SEQ ID NO: 435208 - DNA, 20 bp, Artificial
  CRISPR gRNA sequence
gtgctgagctagcactcagt

SEQ ID NO: 435209 - DNA, 20 bp, Artificial
  CRISPR gRNA sequence
tgctgagctagcactcagtg

SEQ ID NO: 435210 - DNA, 20 bp, Artificial
  CRISPR gRNA sequence
gctgagctagcactcagtgg

SEQ ID NO: 435211 - DNA, 20 bp, Artificial
  CRISPR gRNA sequence
gagctagcactcagtggggg

SEQ ID NO: 435212 - DNA, 20 bp, Artificial
  CRISPR gRNA sequence
ggctactgctcatgtgattg

SEQ ID NO: 435213 - DNA, 20 bp, Artificial
  CRISPR gRNA sequence
ctactgctcatgtgattgtg

SEQ ID NO: 435214 - DNA, 20 bp, Artificial
  CRISPR gRNA sequence
ctgctcatgtgattgtggag

SEQ ID NO: 435215 - DNA, 20 bp, Artificial
  CRISPR gRNA sequence
tcatgtgattgtggagtaga

SEQ ID NO: 435216 - DNA, 20 bp, Artificial
  CRISPR gRNA sequence
gtgattgtggagtagacagt

SEQ ID NO: 435217 - DNA, 20 bp, Artificial
  CRISPR gRNA sequence
attgtggagtagacagttgg

SEQ ID NO: 435218 - DNA, 20 bp, Artificial
  CRISPR gRNA sequence
gtggagtagacagttggaag

SEQ ID NO: 435219 - DNA, 20 bp, Artificial
  CRISPR gRNA sequence
agacagttggaagaagtacc

SEQ ID NO: 435220 - DNA, 20 bp, Artificial
  CRISPR gRNA sequence
gaagaagtacccagtccatt

SEQ ID NO: 435221 - DNA, 20 bp, Artificial
  CRISPR gRNA sequence
agaagtacccagtccatttg

SEQ ID NO: 435222 - DNA, 20 bp, Artificial
  CRISPR gRNA sequence
aagtacccagtccatttgga

SEQ ID NO: 435223 - DNA, 20 bp, Artificial
  CRISPR gRNA sequence
agagttaaaactgtgcctaa

SEQ ID NO: 435224 - DNA, 20 bp, Artificial
  CRISPR gRNA sequence
agttaaaactgtgcctaaca

SEQ ID NO: 435225 - DNA, 20 bp, Artificial
  CRISPR gRNA sequence
gttaaaactgtgcctaacag

SEQ ID NO: 435226 - DNA, 20 bp, Artificial
  CRISPR gRNA sequence
tcctctgacttttcttctgc

SEQ ID NO: 435227 - DNA, 20 bp, Artificial
  CRISPR gRNA sequence
ctgctgctgctactacttac

SEQ ID NO: 435228 - DNA, 20 bp, Artificial
  CRISPR gRNA sequence
tgctgctactacttacaagt

SEQ ID NO: 435229 - DNA, 20 bp, Artificial
  CRISPR gRNA sequence
tactacttacaagtaagtct

SEQ ID NO: 435230 - DNA, 20 bp, Artificial
  CRISPR gRNA sequence
cttacaagtaagtctcggca

SEQ ID NO: 435231 - DNA, 20 bp, Artificial
  CRISPR gRNA sequence
ggatatttacaatgacataa

SEQ ID NO: 435232 - DNA, 20 bp, Artificial
  CRISPR gRNA sequence
aatgacataatggtgctgta

SEQ ID NO: 435233 - DNA, 20 bp, Artificial
  CRISPR gRNA sequence
tgacataatggtgctgtaca

SEQ ID NO: 435234 - DNA, 20 bp, Artificial
  CRISPR gRNA sequence
gacataatggtgctgtacag

SEQ ID NO: 435235 - DNA, 20 bp, Artificial
  CRISPR gRNA sequence
aatggtgctgtacagaggac

SEQ ID NO: 435236 - DNA, 20 bp, Artificial
  CRISPR gRNA sequence
atggtgctgtacagaggaca

SEQ ID NO: 435237 - DNA, 20 bp, Artificial
  CRISPR gRNA sequence
tggtgctgtacagaggacaa

SEQ ID NO: 435238 - DNA, 20 bp, Artificial
  CRISPR gRNA sequence
gtgctgtacagaggacaagg

SEQ ID NO: 435239 - DNA, 20 bp, Artificial
  CRISPR gRNA sequence
gctgtacagaggacaaggga

SEQ ID NO: 435240 - DNA, 20 bp, Artificial
  CRISPR gRNA sequence
agaggacaagggagagatac

SEQ ID NO: 435241 - DNA, 20 bp, Artificial
  CRISPR gRNA sequence
gaggacaagggagagataca

SEQ ID NO: 435242 - DNA, 20 bp, Artificial
  CRISPR gRNA sequence
acaagggagagatacaagga

SEQ ID NO: 435243 - DNA, 20 bp, Artificial
  CRISPR gRNA sequence
cattgtaatgttgtttgtaa

SEQ ID NO: 435244 - DNA, 20 bp, Artificial
  CRISPR gRNA sequence
aatgttgtttgtaatagcaa

SEQ ID NO: 435245 - DNA, 20 bp, Artificial
  CRISPR gRNA sequence
tgtttgtaatagcaaaagct

SEQ ID NO: 435246 - DNA, 20 bp, Artificial
  CRISPR gRNA sequence
ttgtaatagcaaaagcttgg

SEQ ID NO: 435247 - DNA, 20 bp, Artificial
  CRISPR gRNA sequence
caacctaaatgtccgtcgat

SEQ ID NO: 435248 - DNA, 20 bp, Artificial
  CRISPR gRNA sequence
aacctaaatgtccgtcgatg

SEQ ID NO: 435249 - DNA, 20 bp, Artificial
  CRISPR gRNA sequence
acctaaatgtccgtcgatga

SEQ ID NO: 435250 - DNA, 20 bp, Artificial
  CRISPR gRNA sequence
ctaaatgtccgtcgatgagg

SEQ ID NO: 435251 - DNA, 20 bp, Artificial
  CRISPR gRNA sequence
aatgtccgtcgatgagggag

SEQ ID NO: 435252 - DNA, 20 bp, Artificial
  CRISPR gRNA sequence
atgtccgtcgatgagggagt

SEQ ID NO: 435253 - DNA, 20 bp, Artificial
  CRISPR gRNA sequence
tgatataatcatgatacaaa

SEQ ID NO: 435254 - DNA, 20 bp, Artificial
  CRISPR gRNA sequence
ataatcatgatacaaacagt

SEQ ID NO: 435255 - DNA, 20 bp, Artificial
  CRISPR gRNA sequence
gtgagtctgacaaaacatac

SEQ ID NO: 435256 - DNA, 20 bp, Artificial
  CRISPR gRNA sequence
tctgacaaaacatactggta

SEQ ID NO: 435257 - DNA, 20 bp, Artificial
  CRISPR gRNA sequence
tcaaaattataatgttatta

SEQ ID NO: 435258 - DNA, 20 bp, Artificial
  CRISPR gRNA sequence
ataatgttattaaagaaaaa

SEQ ID NO: 435259 - DNA, 20 bp, Artificial
  CRISPR gRNA sequence
ttattaaagaaaaaaagttg

SEQ ID NO: 435260 - DNA, 20 bp, Artificial
  CRISPR gRNA sequence
ttgcagaataatgcatatat

SEQ ID NO: 435261 - DNA, 20 bp, Artificial
  CRISPR gRNA sequence
tgcagaataatgcatatatt

SEQ ID NO: 435262 - DNA, 20 bp, Artificial
  CRISPR gRNA sequence
tatttgtgtgtgtgcattgt

SEQ ID NO: 435263 - DNA, 20 bp, Artificial
  CRISPR gRNA sequence
atttgtgtgtgtgcattgtc

SEQ ID NO: 435264 - DNA, 20 bp, Artificial
  CRISPR gRNA sequence
tttgtgtgtgtgcattgtcg

SEQ ID NO: 435265 - DNA, 20 bp, Artificial
  CRISPR gRNA sequence
tgtgtgtgtgcattgtcggg

SEQ ID NO: 435266 - DNA, 20 bp, Artificial
  CRISPR gRNA sequence
gtgtgtgcattgtcggggag

SEQ ID NO: 435267 - DNA, 20 bp, Artificial
  CRISPR gRNA sequence
tgtgtgcattgtcggggagc

SEQ ID NO: 435268 - DNA, 20 bp, Artificial
  CRISPR gRNA sequence
tgtcggggagcaggaatatg

SEQ ID NO: 435269 - DNA, 20 bp, Artificial
  CRISPR gRNA sequence
gtggacatttcttaatgtat

SEQ ID NO: 435270 - DNA, 20 bp, Artificial
  CRISPR gRNA sequence
atttcttaatgtataagctc

SEQ ID NO: 435271 - DNA, 20 bp, Artificial
  CRISPR gRNA sequence
tttcttaatgtataagctct

SEQ ID NO: 435272 - DNA, 20 bp, Artificial
  CRISPR gRNA sequence
taatgtataagctctaggaa

SEQ ID NO: 435273 - DNA, 20 bp, Artificial
  CRISPR gRNA sequence
aatgtataagctctaggaaa

SEQ ID NO: 435274 - DNA, 20 bp, Artificial
  CRISPR gRNA sequence
taagctctaggaaaaggaac

SEQ ID NO: 435275 - DNA, 20 bp, Artificial
  CRISPR gRNA sequence
aagctctaggaaaaggaacc

SEQ ID NO: 435276 - DNA, 20 bp, Artificial
  CRISPR gRNA sequence
agctctaggaaaaggaacca

SEQ ID NO: 435277 - DNA, 20 bp, Artificial
  CRISPR gRNA sequence
taggaaaaggaaccagggaa

SEQ ID NO: 435278 - DNA, 20 bp, Artificial
  CRISPR gRNA sequence
aaaggaaccagggaatggta

SEQ ID NO: 435279 - DNA, 20 bp, Artificial
  CRISPR gRNA sequence
aggaaccagggaatggtaaa

SEQ ID NO: 435280 - DNA, 20 bp, Artificial
  CRISPR gRNA sequence
accagggaatggtaaagagt

SEQ ID NO: 435281 - DNA, 20 bp, Artificial
  CRISPR gRNA sequence
ccagggaatggtaaagagtt

SEQ ID NO: 435282 - DNA, 20 bp, Artificial
  CRISPR gRNA sequence
agggaatggtaaagagttgg

SEQ ID NO: 435283 - DNA, 20 bp, Artificial
  CRISPR gRNA sequence
ggaatggtaaagagttggga

SEQ ID NO: 435284 - DNA, 20 bp, Artificial
  CRISPR gRNA sequence
tggtaaagagttgggagagt

SEQ ID NO: 435285 - DNA, 20 bp, Artificial
  CRISPR gRNA sequence
ggtaaagagttgggagagta

SEQ ID NO: 435286 - DNA, 20 bp, Artificial
  CRISPR gRNA sequence
tctttttctttttttcaatt

SEQ ID NO: 435287 - DNA, 20 bp, Artificial
  CRISPR gRNA sequence
tttctttttttcaattgaga

SEQ ID NO: 435288 - DNA, 20 bp, Artificial
  CRISPR gRNA sequence
tctttttttcaattgagatg

SEQ ID NO: 435289 - DNA, 20 bp, Artificial
  CRISPR gRNA sequence
tggagtctcactctattgcc

SEQ ID NO: 435290 - DNA, 20 bp, Artificial
  CRISPR gRNA sequence
ggagtctcactctattgccc

SEQ ID NO: 435291 - DNA, 20 bp, Artificial
  CRISPR gRNA sequence
tctcactctattgcccaggc

SEQ ID NO: 435292 - DNA, 20 bp, Artificial
  CRISPR gRNA sequence
tcactctattgcccaggctg

SEQ ID NO: 435293 - DNA, 20 bp, Artificial
  CRISPR gRNA sequence
ctattgcccaggctggagtg

SEQ ID NO: 435294 - DNA, 20 bp, Artificial
  CRISPR gRNA sequence
ttgcccaggctggagtgcag

SEQ ID NO: 435295 - DNA, 20 bp, Artificial
  CRISPR gRNA sequence
cccaggctggagtgcagtgg

SEQ ID NO: 435296 - DNA, 20 bp, Artificial
  CRISPR gRNA sequence
gtgcagtggtggcaccattt

SEQ ID NO: 435297 - DNA, 20 bp, Artificial
  CRISPR gRNA sequence
tcactgcaatctccgcctcc

SEQ ID NO: 435298 - DNA, 20 bp, Artificial
  CRISPR gRNA sequence
cactgcaatctccgcctccc

SEQ ID NO: 435299 - DNA, 20 bp, Artificial
  CRISPR gRNA sequence
aatctccgcctcccaggttc

SEQ ID NO: 435300 - DNA, 20 bp, Artificial
  CRISPR gRNA sequence
ttcaagtgattctcctgcct

SEQ ID NO: 435301 - DNA, 20 bp, Artificial
  CRISPR gRNA sequence
tcaagtgattctcctgcctt

SEQ ID NO: 435302 - DNA, 20 bp, Artificial
  CRISPR gRNA sequence
gattctcctgccttaggcac

SEQ ID NO: 435303 - DNA, 20 bp, Artificial
  CRISPR gRNA sequence
ttctcctgccttaggcaccg

SEQ ID NO: 435304 - DNA, 20 bp, Artificial
  CRISPR gRNA sequence
tcctgccttaggcaccggag

SEQ ID NO: 435305 - DNA, 20 bp, Artificial
  CRISPR gRNA sequence
gccttaggcaccggagtagc

SEQ ID NO: 435306 - DNA, 20 bp, Artificial
  CRISPR gRNA sequence
ccttaggcaccggagtagct

SEQ ID NO: 435307 - DNA, 20 bp, Artificial
  CRISPR gRNA sequence
caccggagtagctgggatca

SEQ ID NO: 435308 - DNA, 20 bp, Artificial
  CRISPR gRNA sequence
accggagtagctgggatcac

SEQ ID NO: 435309 - DNA, 20 bp, Artificial
  CRISPR gRNA sequence
caggcgtgcaccaccacacc

SEQ ID NO: 435310 - DNA, 20 bp, Artificial
  CRISPR gRNA sequence
cagctaatgtttttaatttt

SEQ ID NO: 435311 - DNA, 20 bp, Artificial
  CRISPR gRNA sequence
ctaatgtttttaatttttag

SEQ ID NO: 435312 - DNA, 20 bp, Artificial
  CRISPR gRNA sequence
aatgtttttaatttttagta

SEQ ID NO: 435313 - DNA, 20 bp, Artificial
  CRISPR gRNA sequence
tttttaatttttagtagaga

SEQ ID NO: 435314 - DNA, 20 bp, Artificial
  CRISPR gRNA sequence
ttttaatttttagtagagac

SEQ ID NO: 435315 - DNA, 20 bp, Artificial
  CRISPR gRNA sequence
tttaatttttagtagagaca

SEQ ID NO: 435316 - DNA, 20 bp, Artificial
  CRISPR gRNA sequence
gagacagggttttaccatgt

SEQ ID NO: 435317 - DNA, 20 bp, Artificial
  CRISPR gRNA sequence
cagggttttaccatgttggt

SEQ ID NO: 435318 - DNA, 20 bp, Artificial
  CRISPR gRNA sequence
agggttttaccatgttggtc

SEQ ID NO: 435319 - DNA, 20 bp, Artificial
  CRISPR gRNA sequence
ttttaccatgttggtcaggc

SEQ ID NO: 435320 - DNA, 20 bp, Artificial
  CRISPR gRNA sequence
tcaggctggtctcaaactca

SEQ ID NO: 435321 - DNA, 20 bp, Artificial
  CRISPR gRNA sequence
ggtctcaaactcatggcctc

SEQ ID NO: 435322 - DNA, 20 bp, Artificial
  CRISPR gRNA sequence
ctcaagtaatctgcccatct

SEQ ID NO: 435323 - DNA, 20 bp, Artificial
  CRISPR gRNA sequence
ctgcccatctcagcctccca

SEQ ID NO: 435324 - DNA, 20 bp, Artificial
  CRISPR gRNA sequence
atctcagcctcccaaagtgc

SEQ ID NO: 435325 - DNA, 20 bp, Artificial
  CRISPR gRNA sequence
tctcagcctcccaaagtgct

SEQ ID NO: 435326 - DNA, 20 bp, Artificial
  CRISPR gRNA sequence
ctcccaaagtgctgggatta

SEQ ID NO: 435327 - DNA, 20 bp, Artificial
  CRISPR gRNA sequence
tcccaaagtgctgggattac

SEQ ID NO: 435328 - DNA, 20 bp, Artificial
  CRISPR gRNA sequence
ggcgtgacccaccgtgtgcc

SEQ ID NO: 435329 - DNA, 20 bp, Artificial
  CRISPR gRNA sequence
actttttcatacacctttga

SEQ ID NO: 435330 - DNA, 20 bp, Artificial
  CRISPR gRNA sequence
gtgtttgaatgtttttactg

SEQ ID NO: 435331 - DNA, 20 bp, Artificial
  CRISPR gRNA sequence
tgaatgtttttactgtagtt

SEQ ID NO: 435332 - DNA, 20 bp, Artificial
  CRISPR gRNA sequence
agttgagtcatatgaaaaca

SEQ ID NO: 435333 - DNA, 20 bp, Artificial
  CRISPR gRNA sequence
gttgagtcatatgaaaacaa

SEQ ID NO: 435334 - DNA, 20 bp, Artificial
  CRISPR gRNA sequence
ttgagtcatatgaaaacaaa

SEQ ID NO: 435335 - DNA, 20 bp, Artificial
  CRISPR gRNA sequence
tgagtcatatgaaaacaaag

SEQ ID NO: 435336 - DNA, 20 bp, Artificial
  CRISPR gRNA sequence
aaggggacataaaaaatcaa

SEQ ID NO: 435337 - DNA, 20 bp, Artificial
  CRISPR gRNA sequence
tatcatatataaaatatata

SEQ ID NO: 435338 - DNA, 20 bp, Artificial
  CRISPR gRNA sequence
tatatatagtttttttttaa

SEQ ID NO: 435339 - DNA, 20 bp, Artificial
  CRISPR gRNA sequence
tggaattaactttgtcattt

SEQ ID NO: 435340 - DNA, 20 bp, Artificial
  CRISPR gRNA sequence
ggaattaactttgtcatttg

SEQ ID NO: 435341 - DNA, 20 bp, Artificial
  CRISPR gRNA sequence
ctttgtcatttgaggaaaat

SEQ ID NO: 435342 - DNA, 20 bp, Artificial
  CRISPR gRNA sequence
tttgtcatttgaggaaaatg

SEQ ID NO: 435343 - DNA, 20 bp, Artificial
  CRISPR gRNA sequence
tgtcatttgaggaaaatgag

SEQ ID NO: 435344 - DNA, 20 bp, Artificial
  CRISPR gRNA sequence
tttgaggaaaatgaggagac

SEQ ID NO: 435345 - DNA, 20 bp, Artificial
  CRISPR gRNA sequence
gagacaagtctcaatcattt

SEQ ID NO: 435346 - DNA, 20 bp, Artificial
  CRISPR gRNA sequence
agacaagtctcaatcatttt

SEQ ID NO: 435347 - DNA, 20 bp, Artificial
  CRISPR gRNA sequence
acaagtctcaatcattttag

SEQ ID NO: 435348 - DNA, 20 bp, Artificial
  CRISPR gRNA sequence
tttaggagatttgtttgcca

SEQ ID NO: 435349 - DNA, 20 bp, Artificial
  CRISPR gRNA sequence
gagatttgtttgccaaagtt

SEQ ID NO: 435350 - DNA, 20 bp, Artificial
  CRISPR gRNA sequence
agatttgtttgccaaagtta

SEQ ID NO: 435351 - DNA, 20 bp, Artificial
  CRISPR gRNA sequence
atttgtttgccaaagttaag

SEQ ID NO: 435352 - DNA, 20 bp, Artificial
  CRISPR gRNA sequence
tttgtttgccaaagttaagg

SEQ ID NO: 435353 - DNA, 20 bp, Artificial
  CRISPR gRNA sequence
ccaaagttaaggaggcacct

SEQ ID NO: 435354 - DNA, 20 bp, Artificial
  CRISPR gRNA sequence
aaagttaaggaggcacctga

SEQ ID NO: 435355 - DNA, 20 bp, Artificial
  CRISPR gRNA sequence
ttaaggaggcacctgagaga

SEQ ID NO: 435356 - DNA, 20 bp, Artificial
  CRISPR gRNA sequence
taaggaggcacctgagagac

SEQ ID NO: 435357 - DNA, 20 bp, Artificial
  CRISPR gRNA sequence
agacaggtctatgactttct

SEQ ID NO: 435358 - DNA, 20 bp, Artificial
  CRISPR gRNA sequence
caggtctatgactttctcag

SEQ ID NO: 435359 - DNA, 20 bp, Artificial
  CRISPR gRNA sequence
ctttctcagaagatgatttt

SEQ ID NO: 435360 - DNA, 20 bp, Artificial
  CRISPR gRNA sequence
tttctcagaagatgattttg

SEQ ID NO: 435361 - DNA, 20 bp, Artificial
  CRISPR gRNA sequence
ttctcagaagatgattttga

SEQ ID NO: 435362 - DNA, 20 bp, Artificial
  CRISPR gRNA sequence
gaagatgattttgagggctc

SEQ ID NO: 435363 - DNA, 20 bp, Artificial
  CRISPR gRNA sequence
ttttgagggctccagattta

SEQ ID NO: 435364 - DNA, 20 bp, Artificial
  CRISPR gRNA sequence
tttgagggctccagatttaa

SEQ ID NO: 435365 - DNA, 20 bp, Artificial
  CRISPR gRNA sequence
ttgagggctccagatttaaa

SEQ ID NO: 435366 - DNA, 20 bp, Artificial
  CRISPR gRNA sequence
tgagggctccagatttaaag

SEQ ID NO: 435367 - DNA, 20 bp, Artificial
  CRISPR gRNA sequence
gctccagatttaaaggggac

SEQ ID NO: 435368 - DNA, 20 bp, Artificial
  CRISPR gRNA sequence
ctccagatttaaaggggaca

SEQ ID NO: 435369 - DNA, 20 bp, Artificial
  CRISPR gRNA sequence
cagatttaaaggggacaagg

SEQ ID NO: 435370 - DNA, 20 bp, Artificial
  CRISPR gRNA sequence
agatttaaaggggacaaggt

SEQ ID NO: 435371 - DNA, 20 bp, Artificial
  CRISPR gRNA sequence
aggggacaaggtgggatatt

SEQ ID NO: 435372 - DNA, 20 bp, Artificial
  CRISPR gRNA sequence
ggacaaggtgggatattgag

SEQ ID NO: 435373 - DNA, 20 bp, Artificial
  CRISPR gRNA sequence
gtgggatattgagaagcact

SEQ ID NO: 435374 - DNA, 20 bp, Artificial
  CRISPR gRNA sequence
cactcagttttcacataaaa

SEQ ID NO: 435375 - DNA, 20 bp, Artificial
  CRISPR gRNA sequence
actcagttttcacataaaaa

SEQ ID NO: 435376 - DNA, 20 bp, Artificial
  CRISPR gRNA sequence
ctcagttttcacataaaaaa

SEQ ID NO: 435377 - DNA, 20 bp, Artificial
  CRISPR gRNA sequence
tcagttttcacataaaaaag

SEQ ID NO: 435378 - DNA, 20 bp, Artificial
  CRISPR gRNA sequence
cagttttcacataaaaaagg

SEQ ID NO: 435379 - DNA, 20 bp, Artificial
  CRISPR gRNA sequence
agttttcacataaaaaaggg

SEQ ID NO: 435380 - DNA, 20 bp, Artificial
  CRISPR gRNA sequence
gttttcacataaaaaagggg

SEQ ID NO: 435381 - DNA, 20 bp, Artificial
  CRISPR gRNA sequence
ttttcacataaaaaaggggg

SEQ ID NO: 435382 - DNA, 20 bp, Artificial
  CRISPR gRNA sequence
tttcacataaaaaagggggg

SEQ ID NO: 435383 - DNA, 20 bp, Artificial
  CRISPR gRNA sequence
ttcacataaaaaaggggggg

SEQ ID NO: 435384 - DNA, 20 bp, Artificial
  CRISPR gRNA sequence
acataaaaaagggggggggg

SEQ ID NO: 435385 - DNA, 20 bp, Artificial
  CRISPR gRNA sequence
ataaaaaaggggggggggca

SEQ ID NO: 435386 - DNA, 20 bp, Artificial
  CRISPR gRNA sequence
taaaaaaggggggggggcag

SEQ ID NO: 435387 - DNA, 20 bp, Artificial
  CRISPR gRNA sequence
gggggggcagaggaaaaata

SEQ ID NO: 435388 - DNA, 20 bp, Artificial
  CRISPR gRNA sequence
ggggggcagaggaaaaatat

SEQ ID NO: 435389 - DNA, 20 bp, Artificial
  CRISPR gRNA sequence
gggggcagaggaaaaatatg

SEQ ID NO: 435390 - DNA, 20 bp, Artificial
  CRISPR gRNA sequence
ggggaatctgcattttacat

SEQ ID NO: 435391 - DNA, 20 bp, Artificial
  CRISPR gRNA sequence
gcattttacattagataaca

SEQ ID NO: 435392 - DNA, 20 bp, Artificial
  CRISPR gRNA sequence
attagataacacagacaaaa

SEQ ID NO: 435393 - DNA, 20 bp, Artificial
  CRISPR gRNA sequence
ttagataacacagacaaaat

SEQ ID NO: 435394 - DNA, 20 bp, Artificial
  CRISPR gRNA sequence
tagataacacagacaaaatg

SEQ ID NO: 435395 - DNA, 20 bp, Artificial
  CRISPR gRNA sequence
ataacacagacaaaatgggg

SEQ ID NO: 435396 - DNA, 20 bp, Artificial
  CRISPR gRNA sequence
taacacagacaaaatggggt

SEQ ID NO: 435397 - DNA, 20 bp, Artificial
  CRISPR gRNA sequence
aacacagacaaaatggggta

SEQ ID NO: 435398 - DNA, 20 bp, Artificial
  CRISPR gRNA sequence
aaatggggtagggaaacaat

SEQ ID NO: 435399 - DNA, 20 bp, Artificial
  CRISPR gRNA sequence
tcagataacgcatttgtgtc

SEQ ID NO: 435400 - DNA, 20 bp, Artificial
  CRISPR gRNA sequence
ataacgcatttgtgtctggc

SEQ ID NO: 435401 - DNA, 20 bp, Artificial
  CRISPR gRNA sequence
taacgcatttgtgtctggcc

SEQ ID NO: 435402 - DNA, 20 bp, Artificial
  CRISPR gRNA sequence
aacgcatttgtgtctggcca

SEQ ID NO: 435403 - DNA, 20 bp, Artificial
  CRISPR gRNA sequence
tctggccagggtgaccgcac

SEQ ID NO: 435404 - DNA, 20 bp, Artificial
  CRISPR gRNA sequence
ccagggtgaccgcaccggta

SEQ ID NO: 435405 - DNA, 20 bp, Artificial
  CRISPR gRNA sequence
gtgaccgcaccggtaaagat

SEQ ID NO: 435406 - DNA, 20 bp, Artificial
  CRISPR gRNA sequence
agctatcaatctgcattgca

SEQ ID NO: 435407 - DNA, 20 bp, Artificial
  CRISPR gRNA sequence
atctgcattgcacagctgac

SEQ ID NO: 435408 - DNA, 20 bp, Artificial
  CRISPR gRNA sequence
tctgcattgcacagctgacc

SEQ ID NO: 435409 - DNA, 20 bp, Artificial
  CRISPR gRNA sequence
gctgaccaggaatttccttg

SEQ ID NO: 435410 - DNA, 20 bp, Artificial
  CRISPR gRNA sequence
ctgaccaggaatttccttgt

SEQ ID NO: 435411 - DNA, 20 bp, Artificial
  CRISPR gRNA sequence
atttccttgtgggcaaaata

SEQ ID NO: 435412 - DNA, 20 bp, Artificial
  CRISPR gRNA sequence
tttccttgtgggcaaaatat

SEQ ID NO: 435413 - DNA, 20 bp, Artificial
  CRISPR gRNA sequence
ttccttgtgggcaaaatatg

SEQ ID NO: 435414 - DNA, 20 bp, Artificial
  CRISPR gRNA sequence
tccttgtgggcaaaatatgg

SEQ ID NO: 435415 - DNA, 20 bp, Artificial
  CRISPR gRNA sequence
cttgtgggcaaaatatgggg

SEQ ID NO: 435416 - DNA, 20 bp, Artificial
  CRISPR gRNA sequence
ttgtgggcaaaatatggggg

SEQ ID NO: 435417 - DNA, 20 bp, Artificial
  CRISPR gRNA sequence
caaaatatgggggaggtatg

SEQ ID NO: 435418 - DNA, 20 bp, Artificial
  CRISPR gRNA sequence
gtatgcagcctttcatcctg

SEQ ID NO: 435419 - DNA, 20 bp, Artificial
  CRISPR gRNA sequence
catcctgtagccatcttatt

SEQ ID NO: 435420 - DNA, 20 bp, Artificial
  CRISPR gRNA sequence
atcctgtagccatcttattc

SEQ ID NO: 435421 - DNA, 20 bp, Artificial
  CRISPR gRNA sequence
catcttattcaggaatcaaa

SEQ ID NO: 435422 - DNA, 20 bp, Artificial
  CRISPR gRNA sequence
tcttattcaggaatcaaaaa

SEQ ID NO: 435423 - DNA, 20 bp, Artificial
  CRISPR gRNA sequence
cttattcaggaatcaaaaag

SEQ ID NO: 435424 - DNA, 20 bp, Artificial
  CRISPR gRNA sequence
tattcaggaatcaaaaagag

SEQ ID NO: 435425 - DNA, 20 bp, Artificial
  CRISPR gRNA sequence
attcaggaatcaaaaagagg

SEQ ID NO: 435426 - DNA, 20 bp, Artificial
  CRISPR gRNA sequence
caggaatcaaaaagaggagg

SEQ ID NO: 435427 - DNA, 20 bp, Artificial
  CRISPR gRNA sequence
aggaatcaaaaagaggaggc

SEQ ID NO: 435428 - DNA, 20 bp, Artificial
  CRISPR gRNA sequence
ggaggcaggtttctgtgacc

SEQ ID NO: 435429 - DNA, 20 bp, Artificial
  CRISPR gRNA sequence
ggtttctgtgacccagttcc

SEQ ID NO: 435430 - DNA, 20 bp, Artificial
  CRISPR gRNA sequence
acttttccctttgactgaat

SEQ ID NO: 435431 - DNA, 20 bp, Artificial
  CRISPR gRNA sequence
tccctttgactgaatgagtt

SEQ ID NO: 435432 - DNA, 20 bp, Artificial
  CRISPR gRNA sequence
ccctttgactgaatgagttt

SEQ ID NO: 435433 - DNA, 20 bp, Artificial
  CRISPR gRNA sequence
cctttgactgaatgagtttg

SEQ ID NO: 435434 - DNA, 20 bp, Artificial
  CRISPR gRNA sequence
aaaccttaaaacaactccat

SEQ ID NO: 435435 - DNA, 20 bp, Artificial
  CRISPR gRNA sequence
ccttaaaacaactccatgag

SEQ ID NO: 435436 - DNA, 20 bp, Artificial
  CRISPR gRNA sequence
atgagtagtttcaaatacac

SEQ ID NO: 435437 - DNA, 20 bp, Artificial
  CRISPR gRNA sequence
cacaagatccttatttaacc

SEQ ID NO: 435438 - DNA, 20 bp, Artificial
  CRISPR gRNA sequence
acaagatccttatttaacca

SEQ ID NO: 435439 - DNA, 20 bp, Artificial
  CRISPR gRNA sequence
caagatccttatttaaccaa

SEQ ID NO: 435440 - DNA, 20 bp, Artificial
  CRISPR gRNA sequence
ctgtgcacttgctgcttaaa

SEQ ID NO: 435441 - DNA, 20 bp, Artificial
  CRISPR gRNA sequence
gtgcacttgctgcttaaaaa

SEQ ID NO: 435442 - DNA, 20 bp, Artificial
  CRISPR gRNA sequence
cacttgctgcttaaaaagag

SEQ ID NO: 435443 - DNA, 20 bp, Artificial
  CRISPR gRNA sequence
gcttaaaaagagaagtatgt

SEQ ID NO: 435444 - DNA, 20 bp, Artificial
  CRISPR gRNA sequence
cttaaaaagagaagtatgtt

SEQ ID NO: 435445 - DNA, 20 bp, Artificial
  CRISPR gRNA sequence
taaaaagagaagtatgttag

SEQ ID NO: 435446 - DNA, 20 bp, Artificial
  CRISPR gRNA sequence
aaaagagaagtatgttagga

SEQ ID NO: 435447 - DNA, 20 bp, Artificial
  CRISPR gRNA sequence
gcctccctttgttgatgaac

SEQ ID NO: 435448 - DNA, 20 bp, Artificial
  CRISPR gRNA sequence
ccctttgttgatgaacaagc

SEQ ID NO: 435449 - DNA, 20 bp, Artificial
  CRISPR gRNA sequence
tttgttgatgaacaagcaag

SEQ ID NO: 435450 - DNA, 20 bp, Artificial
  CRISPR gRNA sequence
tgatgaacaagcaagtagcc

SEQ ID NO: 435451 - DNA, 20 bp, Artificial
  CRISPR gRNA sequence
gaacaagcaagtagcccaga

SEQ ID NO: 435452 - DNA, 20 bp, Artificial
  CRISPR gRNA sequence
aacaagcaagtagcccagat

SEQ ID NO: 435453 - DNA, 20 bp, Artificial
  CRISPR gRNA sequence
aagcaagtagcccagatggg

SEQ ID NO: 435454 - DNA, 20 bp, Artificial
  CRISPR gRNA sequence
agcaagtagcccagatgggc

SEQ ID NO: 435455 - DNA, 20 bp, Artificial
  CRISPR gRNA sequence
cagatgggcgggccgtttcc

SEQ ID NO: 435456 - DNA, 20 bp, Artificial
  CRISPR gRNA sequence
ttctgattgtctgtttccat
